United States Patent 11,369,692 (MATERIALS AND METHODS FOR TREATMENT OF DUCHENNE MUSCULAR DYSTROPHY) - sequence listing, part 27

SEQ ID NO: 889416 - DNA, 22 bp, Artificial Sequence
  chemically synthesized
taatagaggttctttgaagccc

SEQ ID NO: 889417 - DNA, 22 bp, Artificial Sequence
  chemically synthesized
ccaagccaaggaagagggcttc

SEQ ID NO: 889418 - DNA, 22 bp, Artificial Sequence
  chemically synthesized
gccaagccaaggaagagggctt

SEQ ID NO: 889419 - DNA, 22 bp, Artificial Sequence
  chemically synthesized
tgccaagccaaggaagagggct

SEQ ID NO: 889420 - DNA, 22 bp, Artificial Sequence
  chemically synthesized
tttgccaagccaaggaagaggg

SEQ ID NO: 889421 - DNA, 22 bp, Artificial Sequence
  chemically synthesized
ctctttgccaagccaaggaaga

SEQ ID NO: 889422 - DNA, 22 bp, Artificial Sequence
  chemically synthesized
cctctttgccaagccaaggaag

SEQ ID NO: 889423 - DNA, 22 bp, Artificial Sequence
  chemically synthesized
tttgaagccctcttccttggct

SEQ ID NO: 889424 - DNA, 22 bp, Artificial Sequence
  chemically synthesized
tcctctttgccaagccaaggaa

SEQ ID NO: 889425 - DNA, 22 bp, Artificial Sequence
  chemically synthesized
ttcctctttgccaagccaagga

SEQ ID NO: 889426 - DNA, 22 bp, Artificial Sequence
  chemically synthesized
tgaagccctcttccttggcttg

SEQ ID NO: 889427 - DNA, 22 bp, Artificial Sequence
  chemically synthesized
gaagccctcttccttggcttgg

SEQ ID NO: 889428 - DNA, 22 bp, Artificial Sequence
  chemically synthesized
aagccctcttccttggcttggc

SEQ ID NO: 889429 - DNA, 22 bp, Artificial Sequence
  chemically synthesized
ttccttggcttggcaaagagga

SEQ ID NO: 889430 - DNA, 22 bp, Artificial Sequence
  chemically synthesized
ccttggcttggcaaagaggaaa

SEQ ID NO: 889431 - DNA, 22 bp, Artificial Sequence
  chemically synthesized
cttggcttggcaaagaggaaaa

SEQ ID NO: 889432 - DNA, 22 bp, Artificial Sequence
  chemically synthesized
ggcttggcaaagaggaaaagca

SEQ ID NO: 889433 - DNA, 22 bp, Artificial Sequence
  chemically synthesized
gcttggcaaagaggaaaagcac

SEQ ID NO: 889434 - DNA, 22 bp, Artificial Sequence
  chemically synthesized
ggcaaagaggaaaagcactctt

SEQ ID NO: 889435 - DNA, 22 bp, Artificial Sequence
  chemically synthesized
gcaaagaggaaaagcactcttc

SEQ ID NO: 889436 - DNA, 22 bp, Artificial Sequence
  chemically synthesized
tgagggaggggagaagagtgct

SEQ ID NO: 889437 - DNA, 22 bp, Artificial Sequence
  chemically synthesized
atgagggaggggagaagagtgc

SEQ ID NO: 889438 - DNA, 22 bp, Artificial Sequence
  chemically synthesized
ttatgagggaggggagaagagt

SEQ ID NO: 889439 - DNA, 22 bp, Artificial Sequence
  chemically synthesized
cttatgagggaggggagaagag

SEQ ID NO: 889440 - DNA, 22 bp, Artificial Sequence
  chemically synthesized
tcttatgagggaggggagaaga

SEQ ID NO: 889441 - DNA, 22 bp, Artificial Sequence
  chemically synthesized
cctttcttatgagggaggggag

SEQ ID NO: 889442 - DNA, 22 bp, Artificial Sequence
  chemically synthesized
ttccctttcttatgagggaggg

SEQ ID NO: 889443 - DNA, 22 bp, Artificial Sequence
  chemically synthesized
ctgttccctttcttatgaggga

SEQ ID NO: 889444 - DNA, 22 bp, Artificial Sequence
  chemically synthesized
actgttccctttcttatgaggg

SEQ ID NO: 889445 - DNA, 22 bp, Artificial Sequence
  chemically synthesized
tactgttccctttcttatgagg

SEQ ID NO: 889446 - DNA, 22 bp, Artificial Sequence
  chemically synthesized
ttactgttccctttcttatgag

SEQ ID NO: 889447 - DNA, 22 bp, Artificial Sequence
  chemically synthesized
ttctcccctccctcataagaaa

SEQ ID NO: 889448 - DNA, 22 bp, Artificial Sequence
  chemically synthesized
ctcccctccctcataagaaagg

SEQ ID NO: 889449 - DNA, 22 bp, Artificial Sequence
  chemically synthesized
tcccctccctcataagaaaggg

SEQ ID NO: 889450 - DNA, 22 bp, Artificial Sequence
  chemically synthesized
ccctccctcataagaaagggaa

SEQ ID NO: 889451 - DNA, 22 bp, Artificial Sequence
  chemically synthesized
tgacttttactgttccctttct

SEQ ID NO: 889452 - DNA, 22 bp, Artificial Sequence
  chemically synthesized
tatgacttttactgttcccttt

SEQ ID NO: 889453 - DNA, 22 bp, Artificial Sequence
  chemically synthesized
ctatgacttttactgttccctt

SEQ ID NO: 889454 - DNA, 22 bp, Artificial Sequence
  chemically synthesized
cctcataagaaagggaacagta

SEQ ID NO: 889455 - DNA, 22 bp, Artificial Sequence
  chemically synthesized
ataagaaagggaacagtaaaag

SEQ ID NO: 889456 - DNA, 22 bp, Artificial Sequence
  chemically synthesized
gacatgagaaaacttctatgac

SEQ ID NO: 889457 - DNA, 22 bp, Artificial Sequence
  chemically synthesized
ttggacatgagaaaacttctat

SEQ ID NO: 889458 - DNA, 22 bp, Artificial Sequence
  chemically synthesized
gttggacatgagaaaacttcta

SEQ ID NO: 889459 - DNA, 22 bp, Artificial Sequence
  chemically synthesized
acaatttgttggacatgagaaa

SEQ ID NO: 889460 - DNA, 22 bp, Artificial Sequence
  chemically synthesized
aaataggactaacaatttgttg

SEQ ID NO: 889461 - DNA, 22 bp, Artificial Sequence
  chemically synthesized
tctcatgtccaacaaattgtta

SEQ ID NO: 889462 - DNA, 22 bp, Artificial Sequence
  chemically synthesized
ctcatgtccaacaaattgttag

SEQ ID NO: 889463 - DNA, 22 bp, Artificial Sequence
  chemically synthesized
tcatgtccaacaaattgttagt

SEQ ID NO: 889464 - DNA, 22 bp, Artificial Sequence
  chemically synthesized
atgtccaacaaattgttagtcc

SEQ ID NO: 889465 - DNA, 22 bp, Artificial Sequence
  chemically synthesized
gaacagatcattcaaataggac

SEQ ID NO: 889466 - DNA, 22 bp, Artificial Sequence
  chemically synthesized
ctggaacagatcattcaaatag

SEQ ID NO: 889467 - DNA, 22 bp, Artificial Sequence
  chemically synthesized
ttagtcctatttgaatgatctg

SEQ ID NO: 889468 - DNA, 22 bp, Artificial Sequence
  chemically synthesized
gtcctatttgaatgatctgttc

SEQ ID NO: 889469 - DNA, 22 bp, Artificial Sequence
  chemically synthesized
aatgagaattcctggaacagat

SEQ ID NO: 889470 - DNA, 22 bp, Artificial Sequence
  chemically synthesized
gaatgagaattcctggaacaga

SEQ ID NO: 889471 - DNA, 22 bp, Artificial Sequence
  chemically synthesized
ttgaatgagaattcctggaaca

SEQ ID NO: 889472 - DNA, 22 bp, Artificial Sequence
  chemically synthesized
tttgaatgatctgttccaggaa

SEQ ID NO: 889473 - DNA, 22 bp, Artificial Sequence
  chemically synthesized
cttgaatgagaattcctggaac

SEQ ID NO: 889474 - DNA, 22 bp, Artificial Sequence
  chemically synthesized
gaatgatctgttccaggaattc

SEQ ID NO: 889475 - DNA, 22 bp, Artificial Sequence
  chemically synthesized
aatgatctgttccaggaattct

SEQ ID NO: 889476 - DNA, 22 bp, Artificial Sequence
  chemically synthesized
agaacagtttcttgaatgagaa

SEQ ID NO: 889477 - DNA, 22 bp, Artificial Sequence
  chemically synthesized
gagaacagtttcttgaatgaga

SEQ ID NO: 889478 - DNA, 22 bp, Artificial Sequence
  chemically synthesized
ttccaggaattctcattcaaga

SEQ ID NO: 889479 - DNA, 22 bp, Artificial Sequence
  chemically synthesized
caggaattctcattcaagaaac

SEQ ID NO: 889480 - DNA, 22 bp, Artificial Sequence
  chemically synthesized
tcattcaagaaactgttctcaa

SEQ ID NO: 889481 - DNA, 22 bp, Artificial Sequence
  chemically synthesized
attcaagaaactgttctcaagt

SEQ ID NO: 889482 - DNA, 22 bp, Artificial Sequence
  chemically synthesized
aagaaactgttctcaagtttat

SEQ ID NO: 889483 - DNA, 22 bp, Artificial Sequence
  chemically synthesized
cccatataaggaaaaggataaa

SEQ ID NO: 889484 - DNA, 22 bp, Artificial Sequence
  chemically synthesized
gcccatataaggaaaaggataa

SEQ ID NO: 889485 - DNA, 22 bp, Artificial Sequence
  chemically synthesized
ttctcaagtttatccttttcct

SEQ ID NO: 889486 - DNA, 22 bp, Artificial Sequence
  chemically synthesized
acttgcccatataaggaaaagg

SEQ ID NO: 889487 - DNA, 22 bp, Artificial Sequence
  chemically synthesized
tcaagtttatccttttccttat

SEQ ID NO: 889488 - DNA, 22 bp, Artificial Sequence
  chemically synthesized
aagtttatccttttccttatat

SEQ ID NO: 889489 - DNA, 22 bp, Artificial Sequence
  chemically synthesized
accaacctaacttgcccatata

SEQ ID NO: 889490 - DNA, 22 bp, Artificial Sequence
  chemically synthesized
atccttttccttatatgggcaa

SEQ ID NO: 889491 - DNA, 22 bp, Artificial Sequence
  chemically synthesized
tccttttccttatatgggcaag

SEQ ID NO: 889492 - DNA, 22 bp, Artificial Sequence
  chemically synthesized
ttccttatatgggcaagttagg

SEQ ID NO: 889493 - DNA, 22 bp, Artificial Sequence
  chemically synthesized
atcgttcaccaacctaacttgc

SEQ ID NO: 889494 - DNA, 22 bp, Artificial Sequence
  chemically synthesized
tccttatatgggcaagttaggt

SEQ ID NO: 889495 - DNA, 22 bp, Artificial Sequence
  chemically synthesized
catcgttcaccaacctaacttg

SEQ ID NO: 889496 - DNA, 22 bp, Artificial Sequence
  chemically synthesized
ccttatatgggcaagttaggtt

SEQ ID NO: 889497 - DNA, 22 bp, Artificial Sequence
  chemically synthesized
tcatcgttcaccaacctaactt

SEQ ID NO: 889498 - DNA, 22 bp, Artificial Sequence
  chemically synthesized
cttatatgggcaagttaggttg

SEQ ID NO: 889499 - DNA, 22 bp, Artificial Sequence
  chemically synthesized
atatgggcaagttaggttggtg

SEQ ID NO: 889500 - DNA, 22 bp, Artificial Sequence
  chemically synthesized
tatgggcaagttaggttggtga

SEQ ID NO: 889501 - DNA, 22 bp, Artificial Sequence
  chemically synthesized
ggttggtgaacgatgaaaatct

SEQ ID NO: 889502 - DNA, 22 bp, Artificial Sequence
  chemically synthesized
gtgaacgatgaaaatctcatga

SEQ ID NO: 889503 - DNA, 22 bp, Artificial Sequence
  chemically synthesized
caaaaaagggagtagatggtca

SEQ ID NO: 889504 - DNA, 22 bp, Artificial Sequence
  chemically synthesized
atgaccatctactccctttttt

SEQ ID NO: 889505 - DNA, 22 bp, Artificial Sequence
  chemically synthesized
gtaccagaaaaacactccaaaa

SEQ ID NO: 889506 - DNA, 22 bp, Artificial Sequence
  chemically synthesized
ctcccttttttggagtgttttt

SEQ ID NO: 889507 - DNA, 22 bp, Artificial Sequence
  chemically synthesized
ccttttttggagtgtttttctg

SEQ ID NO: 889508 - DNA, 22 bp, Artificial Sequence
  chemically synthesized
ttttggagtgtttttctggtac

SEQ ID NO: 889509 - DNA, 22 bp, Artificial Sequence
  chemically synthesized
tttggagtgtttttctggtacc

SEQ ID NO: 889510 - DNA, 22 bp, Artificial Sequence
  chemically synthesized
cagcagcaagttggtaccagaa

SEQ ID NO: 889511 - DNA, 22 bp, Artificial Sequence
  chemically synthesized
ttggagtgtttttctggtacca

SEQ ID NO: 889512 - DNA, 22 bp, Artificial Sequence
  chemically synthesized
tggagtgtttttctggtaccaa

SEQ ID NO: 889513 - DNA, 22 bp, Artificial Sequence
  chemically synthesized
ggagtgtttttctggtaccaac

SEQ ID NO: 889514 - DNA, 22 bp, Artificial Sequence
  chemically synthesized
gagtgtttttctggtaccaact

SEQ ID NO: 889515 - DNA, 22 bp, Artificial Sequence
  chemically synthesized
ttctggtaccaacttgctgctg

SEQ ID NO: 889516 - DNA, 22 bp, Artificial Sequence
  chemically synthesized
aaaatacccctacagcagcaag

SEQ ID NO: 889517 - DNA, 22 bp, Artificial Sequence
  chemically synthesized
tctggtaccaacttgctgctgt

SEQ ID NO: 889518 - DNA, 22 bp, Artificial Sequence
  chemically synthesized
caaaatacccctacagcagcaa

SEQ ID NO: 889519 - DNA, 22 bp, Artificial Sequence
  chemically synthesized
ctggtaccaacttgctgctgta

SEQ ID NO: 889520 - DNA, 22 bp, Artificial Sequence
  chemically synthesized
tggtaccaacttgctgctgtag

SEQ ID NO: 889521 - DNA, 22 bp, Artificial Sequence
  chemically synthesized
gtaccaacttgctgctgtaggg

SEQ ID NO: 889522 - DNA, 22 bp, Artificial Sequence
  chemically synthesized
gctgctgtaggggtattttgaa

SEQ ID NO: 889523 - DNA, 22 bp, Artificial Sequence
  chemically synthesized
ctgctgtaggggtattttgaag

SEQ ID NO: 889524 - DNA, 22 bp, Artificial Sequence
  chemically synthesized
ctgtaggggtattttgaaggcc

SEQ ID NO: 889525 - DNA, 22 bp, Artificial Sequence
  chemically synthesized
taggggtattttgaaggccttt

SEQ ID NO: 889526 - DNA, 22 bp, Artificial Sequence
  chemically synthesized
aaaaaaaaaaaaaaaaaaaaaa

SEQ ID NO: 889527 - DNA, 22 bp, Artificial Sequence
  chemically synthesized
aaaaaaaaaaaaaaaaaaaaaa

SEQ ID NO: 889528 - DNA, 22 bp, Artificial Sequence
  chemically synthesized
taaaaaaaaaaaaaaaaaaaaa

SEQ ID NO: 889529 - DNA, 22 bp, Artificial Sequence
  chemically synthesized
tgaaggcctttttttttttttt

SEQ ID NO: 889530 - DNA, 22 bp, Artificial Sequence
  chemically synthesized
gaaggccttttttttttttttt

SEQ ID NO: 889531 - DNA, 22 bp, Artificial Sequence
  chemically synthesized
tttaaaaaaaaaaaaaaaaaaa

SEQ ID NO: 889532 - DNA, 22 bp, Artificial Sequence
  chemically synthesized
aaggcctttttttttttttttt

SEQ ID NO: 889533 - DNA, 22 bp, Artificial Sequence
  chemically synthesized
ctttaaaaaaaaaaaaaaaaaa

SEQ ID NO: 889534 - DNA, 22 bp, Artificial Sequence
  chemically synthesized
tttttttttttttttttttttt

SEQ ID NO: 889535 - DNA, 22 bp, Artificial Sequence
  chemically synthesized
ttttttttttttttttttttta

SEQ ID NO: 889536 - DNA, 22 bp, Artificial Sequence
  chemically synthesized
ttttttttttttttttttttaa

SEQ ID NO: 889537 - DNA, 22 bp, Artificial Sequence
  chemically synthesized
tttttttttttttttttttaaa

SEQ ID NO: 889538 - DNA, 22 bp, Artificial Sequence
  chemically synthesized
ttttttttttttttttttaaag

SEQ ID NO: 889539 - DNA, 22 bp, Artificial Sequence
  chemically synthesized
tttttttttttttttttaaaga

SEQ ID NO: 889540 - DNA, 22 bp, Artificial Sequence
  chemically synthesized
ttttttttttttttttaaagaa

SEQ ID NO: 889541 - DNA, 22 bp, Artificial Sequence
  chemically synthesized
tttttttttttttttaaagaag

SEQ ID NO: 889542 - DNA, 22 bp, Artificial Sequence
  chemically synthesized
ttttttttttttttaaagaagt

SEQ ID NO: 889543 - DNA, 22 bp, Artificial Sequence
  chemically synthesized
tttttttttttttaaagaagtc

SEQ ID NO: 889544 - DNA, 22 bp, Artificial Sequence
  chemically synthesized
ttttttttttttaaagaagtct

SEQ ID NO: 889545 - DNA, 22 bp, Artificial Sequence
  chemically synthesized
tttttttttttaaagaagtctt

SEQ ID NO: 889546 - DNA, 22 bp, Artificial Sequence
  chemically synthesized
ttttttttttaaagaagtcttg

SEQ ID NO: 889547 - DNA, 22 bp, Artificial Sequence
  chemically synthesized
tttttttttaaagaagtcttgc

SEQ ID NO: 889548 - DNA, 22 bp, Artificial Sequence
  chemically synthesized
ttttttttaaagaagtcttgct

SEQ ID NO: 889549 - DNA, 22 bp, Artificial Sequence
  chemically synthesized
tttttttaaagaagtcttgctc

SEQ ID NO: 889550 - DNA, 22 bp, Artificial Sequence
  chemically synthesized
ttttttaaagaagtcttgctct

SEQ ID NO: 889551 - DNA, 22 bp, Artificial Sequence
  chemically synthesized
tttttaaagaagtcttgctcta

SEQ ID NO: 889552 - DNA, 22 bp, Artificial Sequence
  chemically synthesized
cggcatggggaatagagcaaga

SEQ ID NO: 889553 - DNA, 22 bp, Artificial Sequence
  chemically synthesized
ttttaaagaagtcttgctctat

SEQ ID NO: 889554 - DNA, 22 bp, Artificial Sequence
  chemically synthesized
tttaaagaagtcttgctctatt

SEQ ID NO: 889555 - DNA, 22 bp, Artificial Sequence
  chemically synthesized
ttaaagaagtcttgctctattc

SEQ ID NO: 889556 - DNA, 22 bp, Artificial Sequence
  chemically synthesized
taaagaagtcttgctctattcc

SEQ ID NO: 889557 - DNA, 22 bp, Artificial Sequence
  chemically synthesized
aaagaagtcttgctctattccc

SEQ ID NO: 889558 - DNA, 22 bp, Artificial Sequence
  chemically synthesized
cactccggcatggggaatagag

SEQ ID NO: 889559 - DNA, 22 bp, Artificial Sequence
  chemically synthesized
aagaagtcttgctctattcccc

SEQ ID NO: 889560 - DNA, 22 bp, Artificial Sequence
  chemically synthesized
gctctattccccatgccggagt

SEQ ID NO: 889561 - DNA, 22 bp, Artificial Sequence
  chemically synthesized
ctctattccccatgccggagtg

SEQ ID NO: 889562 - DNA, 22 bp, Artificial Sequence
  chemically synthesized
tattccccatgccggagtgcag

SEQ ID NO: 889563 - DNA, 22 bp, Artificial Sequence
  chemically synthesized
ttccccatgccggagtgcagtg

SEQ ID NO: 889564 - DNA, 22 bp, Artificial Sequence
  chemically synthesized
cccatgccggagtgcagtggtg

SEQ ID NO: 889565 - DNA, 22 bp, Artificial Sequence
  chemically synthesized
cagtgagccaagatcacaccac

SEQ ID NO: 889566 - DNA, 22 bp, Artificial Sequence
  chemically synthesized
aacccaggaggcggaggttgca

SEQ ID NO: 889567 - DNA, 22 bp, Artificial Sequence
  chemically synthesized
gaacccaggaggcggaggttgc

SEQ ID NO: 889568 - DNA, 22 bp, Artificial Sequence
  chemically synthesized
cttgaacccaggaggcggaggt

SEQ ID NO: 889569 - DNA, 22 bp, Artificial Sequence
  chemically synthesized
ggctcactgcaacctccgcctc

SEQ ID NO: 889570 - DNA, 22 bp, Artificial Sequence
  chemically synthesized
gctcactgcaacctccgcctcc

SEQ ID NO: 889571 - DNA, 22 bp, Artificial Sequence
  chemically synthesized
actgcaacctccgcctcctggg

SEQ ID NO: 889572 - DNA, 22 bp, Artificial Sequence
  chemically synthesized
caacctccgcctcctgggttca

SEQ ID NO: 889573 - DNA, 22 bp, Artificial Sequence
  chemically synthesized
aggcatgagaattgcttgaacc

SEQ ID NO: 889574 - DNA, 22 bp, Artificial Sequence
  chemically synthesized
cgcctcctgggttcaagcaatt

SEQ ID NO: 889575 - DNA, 22 bp, Artificial Sequence
  chemically synthesized
ggaggctgaggcatgagaattg

SEQ ID NO: 889576 - DNA, 22 bp, Artificial Sequence
  chemically synthesized
ctgggttcaagcaattctcatg

SEQ ID NO: 889577 - DNA, 22 bp, Artificial Sequence
  chemically synthesized
ggttcaagcaattctcatgcct

SEQ ID NO: 889578 - DNA, 22 bp, Artificial Sequence
  chemically synthesized
cctgggaggctgaggcatgaga

SEQ ID NO: 889579 - DNA, 22 bp, Artificial Sequence
  chemically synthesized
aagcaattctcatgcctcagcc

SEQ ID NO: 889580 - DNA, 22 bp, Artificial Sequence
  chemically synthesized
tagtcccagctacctgggaggc

SEQ ID NO: 889581 - DNA, 22 bp, Artificial Sequence
  chemically synthesized
tcatgcctcagcctcccaggta

SEQ ID NO: 889582 - DNA, 22 bp, Artificial Sequence
  chemically synthesized
atgcctcagcctcccaggtagc

SEQ ID NO: 889583 - DNA, 22 bp, Artificial Sequence
  chemically synthesized
agcctcccaggtagctgggact

SEQ ID NO: 889584 - DNA, 22 bp, Artificial Sequence
  chemically synthesized
ccaggtagctgggactacaggt

SEQ ID NO: 889585 - DNA, 22 bp, Artificial Sequence
  chemically synthesized
gccaggcatggtggcacgcacc

SEQ ID NO: 889586 - DNA, 22 bp, Artificial Sequence
  chemically synthesized
ggactacaggtgcgtgccacca

SEQ ID NO: 889587 - DNA, 22 bp, Artificial Sequence
  chemically synthesized
caggtgcgtgccaccatgcctg

SEQ ID NO: 889588 - DNA, 22 bp, Artificial Sequence
  chemically synthesized
aaaatagaaaaaattagccagg

SEQ ID NO: 889589 - DNA, 22 bp, Artificial Sequence
  chemically synthesized
ctaaaaatagaaaaaattagcc

SEQ ID NO: 889590 - DNA, 22 bp, Artificial Sequence
  chemically synthesized
tactaaaaatagaaaaaattag

SEQ ID NO: 889591 - DNA, 22 bp, Artificial Sequence
  chemically synthesized
gctaattttttctatttttagt

SEQ ID NO: 889592 - DNA, 22 bp, Artificial Sequence
  chemically synthesized
attttttctatttttagtagag

SEQ ID NO: 889593 - DNA, 22 bp, Artificial Sequence
  chemically synthesized
tttctatttttagtagagatgg

SEQ ID NO: 889594 - DNA, 22 bp, Artificial Sequence
  chemically synthesized
ttctatttttagtagagatggg

SEQ ID NO: 889595 - DNA, 22 bp, Artificial Sequence
  chemically synthesized
tctatttttagtagagatgggg

SEQ ID NO: 889596 - DNA, 22 bp, Artificial Sequence
  chemically synthesized
ctatttttagtagagatggggt

SEQ ID NO: 889597 - DNA, 22 bp, Artificial Sequence
  chemically synthesized
tatttttagtagagatggggtt

SEQ ID NO: 889598 - DNA, 22 bp, Artificial Sequence
  chemically synthesized
ggcaatatagcaaaaccccatc

SEQ ID NO: 889599 - DNA, 22 bp, Artificial Sequence
  chemically synthesized
tttttagtagagatggggtttt

SEQ ID NO: 889600 - DNA, 22 bp, Artificial Sequence
  chemically synthesized
ttagtagagatggggttttgct

SEQ ID NO: 889601 - DNA, 22 bp, Artificial Sequence
  chemically synthesized
tagtagagatggggttttgcta

SEQ ID NO: 889602 - DNA, 22 bp, Artificial Sequence
  chemically synthesized
agtagagatggggttttgctat

SEQ ID NO: 889603 - DNA, 22 bp, Artificial Sequence
  chemically synthesized
gtagagatggggttttgctata

SEQ ID NO: 889604 - DNA, 22 bp, Artificial Sequence
  chemically synthesized
agatcagcctgggcaatatagc

SEQ ID NO: 889605 - DNA, 22 bp, Artificial Sequence
  chemically synthesized
gagatcagcctgggcaatatag

SEQ ID NO: 889606 - DNA, 22 bp, Artificial Sequence
  chemically synthesized
ggagtttgagatcagcctgggc

SEQ ID NO: 889607 - DNA, 22 bp, Artificial Sequence
  chemically synthesized
gggagtttgagatcagcctggg

SEQ ID NO: 889608 - DNA, 22 bp, Artificial Sequence
  chemically synthesized
tgctatattgcccaggctgatc

SEQ ID NO: 889609 - DNA, 22 bp, Artificial Sequence
  chemically synthesized
gctatattgcccaggctgatct

SEQ ID NO: 889610 - DNA, 22 bp, Artificial Sequence
  chemically synthesized
ctatattgcccaggctgatctc

SEQ ID NO: 889611 - DNA, 22 bp, Artificial Sequence
  chemically synthesized
agcttgggagtttgagatcagc

SEQ ID NO: 889612 - DNA, 22 bp, Artificial Sequence
  chemically synthesized
tattgcccaggctgatctcaaa

SEQ ID NO: 889613 - DNA, 22 bp, Artificial Sequence
  chemically synthesized
cctgagcttgggagtttgagat

SEQ ID NO: 889614 - DNA, 22 bp, Artificial Sequence
  chemically synthesized
cccaggctgatctcaaactccc

SEQ ID NO: 889615 - DNA, 22 bp, Artificial Sequence
  chemically synthesized
atctcaaactcccaagctcagg

SEQ ID NO: 889616 - DNA, 22 bp, Artificial Sequence
  chemically synthesized
aaactcccaagctcaggcaatc

SEQ ID NO: 889617 - DNA, 22 bp, Artificial Sequence
  chemically synthesized
ggaggccaaagcaggtggattg

SEQ ID NO: 889618 - DNA, 22 bp, Artificial Sequence
  chemically synthesized
ccaagctcaggcaatccacctg

SEQ ID NO: 889619 - DNA, 22 bp, Artificial Sequence
  chemically synthesized
gggaggccaaagcaggtggatt

SEQ ID NO: 889620 - DNA, 22 bp, Artificial Sequence
  chemically synthesized
tgggaggccaaagcaggtggat

SEQ ID NO: 889621 - DNA, 22 bp, Artificial Sequence
  chemically synthesized
ggactttgggaggccaaagcag

SEQ ID NO: 889622 - DNA, 22 bp, Artificial Sequence
  chemically synthesized
aggcaatccacctgctttggcc

SEQ ID NO: 889623 - DNA, 22 bp, Artificial Sequence
  chemically synthesized
taaccctaggactttgggaggc

SEQ ID NO: 889624 - DNA, 22 bp, Artificial Sequence
  chemically synthesized
ctttggcctcccaaagtcctag

SEQ ID NO: 889625 - DNA, 22 bp, Artificial Sequence
  chemically synthesized
acgtctgtaaccctaggacttt

SEQ ID NO: 889626 - DNA, 22 bp, Artificial Sequence
  chemically synthesized
tggcctcccaaagtcctagggt

SEQ ID NO: 889627 - DNA, 22 bp, Artificial Sequence
  chemically synthesized
ggcctcccaaagtcctagggtt

SEQ ID NO: 889628 - DNA, 22 bp, Artificial Sequence
  chemically synthesized
gcctcccaaagtcctagggtta

SEQ ID NO: 889629 - DNA, 22 bp, Artificial Sequence
  chemically synthesized
ccaaagtcctagggttacagac

SEQ ID NO: 889630 - DNA, 22 bp, Artificial Sequence
  chemically synthesized
agccaggcatggtagctcacgt

SEQ ID NO: 889631 - DNA, 22 bp, Artificial Sequence
  chemically synthesized
cagccaggcatggtagctcacg

SEQ ID NO: 889632 - DNA, 22 bp, Artificial Sequence
  chemically synthesized
tcagccaggcatggtagctcac

SEQ ID NO: 889633 - DNA, 22 bp, Artificial Sequence
  chemically synthesized
gggttacagacgtgagctacca

SEQ ID NO: 889634 - DNA, 22 bp, Artificial Sequence
  chemically synthesized
ggctttcagccaggcatggtag

SEQ ID NO: 889635 - DNA, 22 bp, Artificial Sequence
  chemically synthesized
cagacgtgagctaccatgcctg

SEQ ID NO: 889636 - DNA, 22 bp, Artificial Sequence
  chemically synthesized
acaataaaaattaggctttcag

SEQ ID NO: 889637 - DNA, 22 bp, Artificial Sequence
  chemically synthesized
ccatgcctggctgaaagcctaa

SEQ ID NO: 889638 - DNA, 22 bp, Artificial Sequence
  chemically synthesized
gctgaaagcctaatttttattg

SEQ ID NO: 889639 - DNA, 22 bp, Artificial Sequence
  chemically synthesized
aaagcctaatttttattgttag

SEQ ID NO: 889640 - DNA, 22 bp, Artificial Sequence
  chemically synthesized
tggtaagaggtactaacaataa

SEQ ID NO: 889641 - DNA, 22 bp, Artificial Sequence
  chemically synthesized
atttttattgttagtacctctt

SEQ ID NO: 889642 - DNA, 22 bp, Artificial Sequence
  chemically synthesized
ttattgttagtacctcttacca

SEQ ID NO: 889643 - DNA, 22 bp, Artificial Sequence
  chemically synthesized
tatcaggagttatggtaagagg

SEQ ID NO: 889644 - DNA, 22 bp, Artificial Sequence
  chemically synthesized
tattgttagtacctcttaccat

SEQ ID NO: 889645 - DNA, 22 bp, Artificial Sequence
  chemically synthesized
attgttagtacctcttaccata

SEQ ID NO: 889646 - DNA, 22 bp, Artificial Sequence
  chemically synthesized
ttgttagtacctcttaccataa

SEQ ID NO: 889647 - DNA, 22 bp, Artificial Sequence
  chemically synthesized
ttgtatcaggagttatggtaag

SEQ ID NO: 889648 - DNA, 22 bp, Artificial Sequence
  chemically synthesized
gttgtatcaggagttatggtaa

SEQ ID NO: 889649 - DNA, 22 bp, Artificial Sequence
  chemically synthesized
ttagtacctcttaccataactc

SEQ ID NO: 889650 - DNA, 22 bp, Artificial Sequence
  chemically synthesized
ttgttgtatcaggagttatggt

SEQ ID NO: 889651 - DNA, 22 bp, Artificial Sequence
  chemically synthesized
cttgttgtatcaggagttatgg

SEQ ID NO: 889652 - DNA, 22 bp, Artificial Sequence
  chemically synthesized
tcttgttgtatcaggagttatg

SEQ ID NO: 889653 - DNA, 22 bp, Artificial Sequence
  chemically synthesized
gtacctcttaccataactcctg

SEQ ID NO: 889654 - DNA, 22 bp, Artificial Sequence
  chemically synthesized
ttaccataactcctgatacaac

SEQ ID NO: 889655 - DNA, 22 bp, Artificial Sequence
  chemically synthesized
accataactcctgatacaacaa

SEQ ID NO: 889656 - DNA, 22 bp, Artificial Sequence
  chemically synthesized
ccataactcctgatacaacaag

SEQ ID NO: 889657 - DNA, 22 bp, Artificial Sequence
  chemically synthesized
ctgatacaacaagaaaggtccc

SEQ ID NO: 889658 - DNA, 22 bp, Artificial Sequence
  chemically synthesized
atacaacaagaaaggtcccatt

SEQ ID NO: 889659 - DNA, 22 bp, Artificial Sequence
  chemically synthesized
aggcgtagaaaaagacagtgaa

SEQ ID NO: 889660 - DNA, 22 bp, Artificial Sequence
  chemically synthesized
ctaaggcgtagaaaaagacagt

SEQ ID NO: 889661 - DNA, 22 bp, Artificial Sequence
  chemically synthesized
cctaaggcgtagaaaaagacag

SEQ ID NO: 889662 - DNA, 22 bp, Artificial Sequence
  chemically synthesized
actgtctttttctacgccttag

SEQ ID NO: 889663 - DNA, 22 bp, Artificial Sequence
  chemically synthesized
tctttttctacgccttaggaaa

SEQ ID NO: 889664 - DNA, 22 bp, Artificial Sequence
  chemically synthesized
agatgggaacacatttcctaag

SEQ ID NO: 889665 - DNA, 22 bp, Artificial Sequence
  chemically synthesized
tttctacgccttaggaaatgtg

SEQ ID NO: 889666 - DNA, 22 bp, Artificial Sequence
  chemically synthesized
ttctacgccttaggaaatgtgt

SEQ ID NO: 889667 - DNA, 22 bp, Artificial Sequence
  chemically synthesized
tctacgccttaggaaatgtgtt

SEQ ID NO: 889668 - DNA, 22 bp, Artificial Sequence
  chemically synthesized
ctacgccttaggaaatgtgttc

SEQ ID NO: 889669 - DNA, 22 bp, Artificial Sequence
  chemically synthesized
tacgccttaggaaatgtgttcc

SEQ ID NO: 889670 - DNA, 22 bp, Artificial Sequence
  chemically synthesized
cgccttaggaaatgtgttccca

SEQ ID NO: 889671 - DNA, 22 bp, Artificial Sequence
  chemically synthesized
aggaaatgtgttcccatcttag

SEQ ID NO: 889672 - DNA, 22 bp, Artificial Sequence
  chemically synthesized
gataaggcaaaactaagatggg

SEQ ID NO: 889673 - DNA, 22 bp, Artificial Sequence
  chemically synthesized
ggaaatgtgttcccatcttagt

SEQ ID NO: 889674 - DNA, 22 bp, Artificial Sequence
  chemically synthesized
ttagataaggcaaaactaagat

SEQ ID NO: 889675 - DNA, 22 bp, Artificial Sequence
  chemically synthesized
tgttagataaggcaaaactaag

SEQ ID NO: 889676 - DNA, 22 bp, Artificial Sequence
  chemically synthesized
ggactctgttagataaggcaaa

SEQ ID NO: 889677 - DNA, 22 bp, Artificial Sequence
  chemically synthesized
ccatcttagttttgccttatct

SEQ ID NO: 889678 - DNA, 22 bp, Artificial Sequence
  chemically synthesized
cctgggactctgttagataagg

SEQ ID NO: 889679 - DNA, 22 bp, Artificial Sequence
  chemically synthesized
ccctgggactctgttagataag

SEQ ID NO: 889680 - DNA, 22 bp, Artificial Sequence
  chemically synthesized
agttttgccttatctaacagag

SEQ ID NO: 889681 - DNA, 22 bp, Artificial Sequence
  chemically synthesized
gttttgccttatctaacagagt

SEQ ID NO: 889682 - DNA, 22 bp, Artificial Sequence
  chemically synthesized
tgccttatctaacagagtccca

SEQ ID NO: 889683 - DNA, 22 bp, Artificial Sequence
  chemically synthesized
agtgaatttccctgggactctg

SEQ ID NO: 889684 - DNA, 22 bp, Artificial Sequence
  chemically synthesized
gccttatctaacagagtcccag

SEQ ID NO: 889685 - DNA, 22 bp, Artificial Sequence
  chemically synthesized
ccttatctaacagagtcccagg

SEQ ID NO: 889686 - DNA, 22 bp, Artificial Sequence
  chemically synthesized
atctaacagagtcccagggaaa

SEQ ID NO: 889687 - DNA, 22 bp, Artificial Sequence
  chemically synthesized
tctaacagagtcccagggaaat

SEQ ID NO: 889688 - DNA, 22 bp, Artificial Sequence
  chemically synthesized
acagagtcccagggaaattcac

SEQ ID NO: 889689 - DNA, 22 bp, Artificial Sequence
  chemically synthesized
aaaatgaaaaattgagtgaatt

SEQ ID NO: 889690 - DNA, 22 bp, Artificial Sequence
  chemically synthesized
actaaaaatgaaaaattgagtg

SEQ ID NO: 889691 - DNA, 22 bp, Artificial Sequence
  chemically synthesized
cactaaaaatgaaaaattgagt

SEQ ID NO: 889692 - DNA, 22 bp, Artificial Sequence
  chemically synthesized
ttcactaaaaatgaaaaattga

SEQ ID NO: 889693 - DNA, 22 bp, Artificial Sequence
  chemically synthesized
cttcactaaaaatgaaaaattg

SEQ ID NO: 889694 - DNA, 22 bp, Artificial Sequence
  chemically synthesized
ttcttcactaaaaatgaaaaat

SEQ ID NO: 889695 - DNA, 22 bp, Artificial Sequence
  chemically synthesized
cttcttcactaaaaatgaaaaa

SEQ ID NO: 889696 - DNA, 22 bp, Artificial Sequence
  chemically synthesized
accttcttcttcactaaaaatg

SEQ ID NO: 889697 - DNA, 22 bp, Artificial Sequence
  chemically synthesized
actcaatttttcatttttagtg

SEQ ID NO: 889698 - DNA, 22 bp, Artificial Sequence
  chemically synthesized
aatttttcatttttagtgaaga

SEQ ID NO: 889699 - DNA, 22 bp, Artificial Sequence
  chemically synthesized
acctgaccttcttcttcactaa

SEQ ID NO: 889700 - DNA, 22 bp, Artificial Sequence
  chemically synthesized
aacctgaccttcttcttcacta

SEQ ID NO: 889701 - DNA, 22 bp, Artificial Sequence
  chemically synthesized
taacctgaccttcttcttcact

SEQ ID NO: 889702 - DNA, 22 bp, Artificial Sequence
  chemically synthesized
ttaacctgaccttcttcttcac

SEQ ID NO: 889703 - DNA, 22 bp, Artificial Sequence
  chemically synthesized
tttaacctgaccttcttcttca

SEQ ID NO: 889704 - DNA, 22 bp, Artificial Sequence
  chemically synthesized
ttcatttttagtgaagaagaag

SEQ ID NO: 889705 - DNA, 22 bp, Artificial Sequence
  chemically synthesized
tcatttttagtgaagaagaagg

SEQ ID NO: 889706 - DNA, 22 bp, Artificial Sequence
  chemically synthesized
catttttagtgaagaagaaggt

SEQ ID NO: 889707 - DNA, 22 bp, Artificial Sequence
  chemically synthesized
atttttagtgaagaagaaggtc

SEQ ID NO: 889708 - DNA, 22 bp, Artificial Sequence
  chemically synthesized
ccctttttaacctgaccttctt

SEQ ID NO: 889709 - DNA, 22 bp, Artificial Sequence
  chemically synthesized
accctttttaacctgaccttct

SEQ ID NO: 889710 - DNA, 22 bp, Artificial Sequence
  chemically synthesized
ttagtgaagaagaaggtcaggt

SEQ ID NO: 889711 - DNA, 22 bp, Artificial Sequence
  chemically synthesized
tagtgaagaagaaggtcaggtt

SEQ ID NO: 889712 - DNA, 22 bp, Artificial Sequence
  chemically synthesized
agtgaagaagaaggtcaggtta

SEQ ID NO: 889713 - DNA, 22 bp, Artificial Sequence
  chemically synthesized
acttaccctttttaacctgacc

SEQ ID NO: 889714 - DNA, 22 bp, Artificial Sequence
  chemically synthesized
gtgaagaagaaggtcaggttaa

SEQ ID NO: 889715 - DNA, 22 bp, Artificial Sequence
  chemically synthesized
actcacttaccctttttaacct

SEQ ID NO: 889716 - DNA, 22 bp, Artificial Sequence
  chemically synthesized
aactcacttaccctttttaacc

SEQ ID NO: 889717 - DNA, 22 bp, Artificial Sequence
  chemically synthesized
tttaactcacttacccttttta

SEQ ID NO: 889718 - DNA, 22 bp, Artificial Sequence
  chemically synthesized
cgatattgtttaactcacttac

SEQ ID NO: 889719 - DNA, 22 bp, Artificial Sequence
  chemically synthesized
acgatattgtttaactcactta

SEQ ID NO: 889720 - DNA, 22 bp, Artificial Sequence
  chemically synthesized
tacgatattgtttaactcactt

SEQ ID NO: 889721 - DNA, 22 bp, Artificial Sequence
  chemically synthesized
aaaagggtaagtgagttaaaca

SEQ ID NO: 889722 - DNA, 22 bp, Artificial Sequence
  chemically synthesized
gctttacgatattgtttaactc

SEQ ID NO: 889723 - DNA, 22 bp, Artificial Sequence
  chemically synthesized
ctggctttacgatattgtttaa

SEQ ID NO: 889724 - DNA, 22 bp, Artificial Sequence
  chemically synthesized
actggctttacgatattgttta

SEQ ID NO: 889725 - DNA, 22 bp, Artificial Sequence
  chemically synthesized
acacttactggctttacgatat

SEQ ID NO: 889726 - DNA, 22 bp, Artificial Sequence
  chemically synthesized
aacaatatcgtaaagccagtaa

SEQ ID NO: 889727 - DNA, 22 bp, Artificial Sequence
  chemically synthesized
aatcccagtgctgacacttact

SEQ ID NO: 889728 - DNA, 22 bp, Artificial Sequence
  chemically synthesized
gaatcccagtgctgacacttac

SEQ ID NO: 889729 - DNA, 22 bp, Artificial Sequence
  chemically synthesized
agtttgaatcccagtgctgaca

SEQ ID NO: 889730 - DNA, 22 bp, Artificial Sequence
  chemically synthesized
ggattcaaacttagtcttttgt

SEQ ID NO: 889731 - DNA, 22 bp, Artificial Sequence
  chemically synthesized
aaacttagtcttttgtttcttt

SEQ ID NO: 889732 - DNA, 22 bp, Artificial Sequence
  chemically synthesized
agtcttttgtttctttcccctt

SEQ ID NO: 889733 - DNA, 22 bp, Artificial Sequence
  chemically synthesized
aagtagaataataaggggaaag

SEQ ID NO: 889734 - DNA, 22 bp, Artificial Sequence
  chemically synthesized
gtcttttgtttctttcccctta

SEQ ID NO: 889735 - DNA, 22 bp, Artificial Sequence
  chemically synthesized
agttgaagtagaataataaggg

SEQ ID NO: 889736 - DNA, 22 bp, Artificial Sequence
  chemically synthesized
ttgtttctttccccttattatt

SEQ ID NO: 889737 - DNA, 22 bp, Artificial Sequence
  chemically synthesized
tgtttctttccccttattattc

SEQ ID NO: 889738 - DNA, 22 bp, Artificial Sequence
  chemically synthesized
gtttctttccccttattattct

SEQ ID NO: 889739 - DNA, 22 bp, Artificial Sequence
  chemically synthesized
ctgagttgaagtagaataataa

SEQ ID NO: 889740 - DNA, 22 bp, Artificial Sequence
  chemically synthesized
tttctttccccttattattcta

SEQ ID NO: 889741 - DNA, 22 bp, Artificial Sequence
  chemically synthesized
ctttccccttattattctactt

SEQ ID NO: 889742 - DNA, 22 bp, Artificial Sequence
  chemically synthesized
tttccccttattattctacttc

SEQ ID NO: 889743 - DNA, 22 bp, Artificial Sequence
  chemically synthesized
tccccttattattctacttcaa

SEQ ID NO: 889744 - DNA, 22 bp, Artificial Sequence
  chemically synthesized
ccccttattattctacttcaac

SEQ ID NO: 889745 - DNA, 22 bp, Artificial Sequence
  chemically synthesized
cccttattattctacttcaact

SEQ ID NO: 889746 - DNA, 22 bp, Artificial Sequence
  chemically synthesized
caaaaaccattgctgagttgaa

SEQ ID NO: 889747 - DNA, 22 bp, Artificial Sequence
  chemically synthesized
attattctacttcaactcagca

SEQ ID NO: 889748 - DNA, 22 bp, Artificial Sequence
  chemically synthesized
ttattctacttcaactcagcaa

SEQ ID NO: 889749 - DNA, 22 bp, Artificial Sequence
  chemically synthesized
aactccaaaaaccattgctgag

SEQ ID NO: 889750 - DNA, 22 bp, Artificial Sequence
  chemically synthesized
ttctacttcaactcagcaatgg

SEQ ID NO: 889751 - DNA, 22 bp, Artificial Sequence
  chemically synthesized
ctcaactccaaaaaccattgct

SEQ ID NO: 889752 - DNA, 22 bp, Artificial Sequence
  chemically synthesized
tacttcaactcagcaatggttt

SEQ ID NO: 889753 - DNA, 22 bp, Artificial Sequence
  chemically synthesized
tactcaactccaaaaaccattg

SEQ ID NO: 889754 - DNA, 22 bp, Artificial Sequence
  chemically synthesized
cttcaactcagcaatggttttt

SEQ ID NO: 889755 - DNA, 22 bp, Artificial Sequence
  chemically synthesized
ctactcaactccaaaaaccatt

SEQ ID NO: 889756 - DNA, 22 bp, Artificial Sequence
  chemically synthesized
tctactcaactccaaaaaccat

SEQ ID NO: 889757 - DNA, 22 bp, Artificial Sequence
  chemically synthesized
ttctactcaactccaaaaacca

SEQ ID NO: 889758 - DNA, 22 bp, Artificial Sequence
  chemically synthesized
caactcagcaatggtttttgga

SEQ ID NO: 889759 - DNA, 22 bp, Artificial Sequence
  chemically synthesized
tttctactcaactccaaaaacc

SEQ ID NO: 889760 - DNA, 22 bp, Artificial Sequence
  chemically synthesized
aactcagcaatggtttttggag

SEQ ID NO: 889761 - DNA, 22 bp, Artificial Sequence
  chemically synthesized
ttttttctactcaactccaaaa

SEQ ID NO: 889762 - DNA, 22 bp, Artificial Sequence
  chemically synthesized
gttttttctactcaactccaaa

SEQ ID NO: 889763 - DNA, 22 bp, Artificial Sequence
  chemically synthesized
tgttttttctactcaactccaa

SEQ ID NO: 889764 - DNA, 22 bp, Artificial Sequence
  chemically synthesized
agcaatggtttttggagttgag

SEQ ID NO: 889765 - DNA, 22 bp, Artificial Sequence
  chemically synthesized
ttgttttttctactcaactcca

SEQ ID NO: 889766 - DNA, 22 bp, Artificial Sequence
  chemically synthesized
tttgttttttctactcaactcc

SEQ ID NO: 889767 - DNA, 22 bp, Artificial Sequence
  chemically synthesized
ctttttgttttttctactcaac

SEQ ID NO: 889768 - DNA, 22 bp, Artificial Sequence
  chemically synthesized
actttttgttttttctactcaa

SEQ ID NO: 889769 - DNA, 22 bp, Artificial Sequence
  chemically synthesized
ttactttttgttttttctactc

SEQ ID NO: 889770 - DNA, 22 bp, Artificial Sequence
  chemically synthesized
ctcttactttttgttttttcta

SEQ ID NO: 889771 - DNA, 22 bp, Artificial Sequence
  chemically synthesized
ttggagttgagtagaaaaaaca

SEQ ID NO: 889772 - DNA, 22 bp, Artificial Sequence
  chemically synthesized
cctcttactttttgttttttct

SEQ ID NO: 889773 - DNA, 22 bp, Artificial Sequence
  chemically synthesized
tggagttgagtagaaaaaacaa

SEQ ID NO: 889774 - DNA, 22 bp, Artificial Sequence
  chemically synthesized
ggagttgagtagaaaaaacaaa

SEQ ID NO: 889775 - DNA, 22 bp, Artificial Sequence
  chemically synthesized
gagttgagtagaaaaaacaaaa

SEQ ID NO: 889776 - DNA, 22 bp, Artificial Sequence
  chemically synthesized
agtagaaaaaacaaaaagtaag

SEQ ID NO: 889777 - DNA, 22 bp, Artificial Sequence
  chemically synthesized
ggtaccataatcttcctcttac

SEQ ID NO: 889778 - DNA, 22 bp, Artificial Sequence
  chemically synthesized
tgaacactgggtaccataatct

SEQ ID NO: 889779 - DNA, 22 bp, Artificial Sequence
  chemically synthesized
atgaacactgggtaccataatc

SEQ ID NO: 889780 - DNA, 22 bp, Artificial Sequence
  chemically synthesized
tatgaacactgggtaccataat

SEQ ID NO: 889781 - DNA, 22 bp, Artificial Sequence
  chemically synthesized
tttatgaacactgggtaccata

SEQ ID NO: 889782 - DNA, 22 bp, Artificial Sequence
  chemically synthesized
tctttatgaacactgggtacca

SEQ ID NO: 889783 - DNA, 22 bp, Artificial Sequence
  chemically synthesized
ctctttatgaacactgggtacc

SEQ ID NO: 889784 - DNA, 22 bp, Artificial Sequence
  chemically synthesized
cttctctttatgaacactgggt

SEQ ID NO: 889785 - DNA, 22 bp, Artificial Sequence
  chemically synthesized
tggtacccagtgttcataaaga

SEQ ID NO: 889786 - DNA, 22 bp, Artificial Sequence
  chemically synthesized
ggcatctgcttctctttatgaa

SEQ ID NO: 889787 - DNA, 22 bp, Artificial Sequence
  chemically synthesized
gtggaattaggcatctgcttct

SEQ ID NO: 889788 - DNA, 22 bp, Artificial Sequence
  chemically synthesized
ttagtggaattaggcatctgct

SEQ ID NO: 889789 - DNA, 22 bp, Artificial Sequence
  chemically synthesized
ataaagagaagcagatgcctaa

SEQ ID NO: 889790 - DNA, 22 bp, Artificial Sequence
  chemically synthesized
atctattagtggaattaggcat

SEQ ID NO: 889791 - DNA, 22 bp, Artificial Sequence
  chemically synthesized
catctattagtggaattaggca

SEQ ID NO: 889792 - DNA, 22 bp, Artificial Sequence
  chemically synthesized
tggatagtttcatctattagtg

SEQ ID NO: 889793 - DNA, 22 bp, Artificial Sequence
  chemically synthesized
gtggatagtttcatctattagt

SEQ ID NO: 889794 - DNA, 22 bp, Artificial Sequence
  chemically synthesized
agtttgtggatagtttcatcta

SEQ ID NO: 889795 - DNA, 22 bp, Artificial Sequence
  chemically synthesized
aagtttgtggatagtttcatct

SEQ ID NO: 889796 - DNA, 22 bp, Artificial Sequence
  chemically synthesized
attccactaatagatgaaacta

SEQ ID NO: 889797 - DNA, 22 bp, Artificial Sequence
  chemically synthesized
tttaagtttgtggatagtttca

SEQ ID NO: 889798 - DNA, 22 bp, Artificial Sequence
  chemically synthesized
gtttaagtttgtggatagtttc

SEQ ID NO: 889799 - DNA, 22 bp, Artificial Sequence
  chemically synthesized
cactaatagatgaaactatcca

SEQ ID NO: 889800 - DNA, 22 bp, Artificial Sequence
  chemically synthesized
atagatgaaactatccacaaac

SEQ ID NO: 889801 - DNA, 22 bp, Artificial Sequence
  chemically synthesized
aagcgtgtttgtttaagtttgt

SEQ ID NO: 889802 - DNA, 22 bp, Artificial Sequence
  chemically synthesized
gaagcgtgtttgtttaagtttg

SEQ ID NO: 889803 - DNA, 22 bp, Artificial Sequence
  chemically synthesized
tccacaaacttaaacaaacacg

SEQ ID NO: 889804 - DNA, 22 bp, Artificial Sequence
  chemically synthesized
ataacaccttgaagcgtgtttg

SEQ ID NO: 889805 - DNA, 22 bp, Artificial Sequence
  chemically synthesized
gataacaccttgaagcgtgttt

SEQ ID NO: 889806 - DNA, 22 bp, Artificial Sequence
  chemically synthesized
gcttgataacaccttgaagcgt

SEQ ID NO: 889807 - DNA, 22 bp, Artificial Sequence
  chemically synthesized
tggcttgataacaccttgaagc

SEQ ID NO: 889808 - DNA, 22 bp, Artificial Sequence
  chemically synthesized
aaacaaacacgcttcaaggtgt

SEQ ID NO: 889809 - DNA, 22 bp, Artificial Sequence
  chemically synthesized
aacaaacacgcttcaaggtgtt

SEQ ID NO: 889810 - DNA, 22 bp, Artificial Sequence
  chemically synthesized
caaggtgttatcaagccagaat

SEQ ID NO: 889811 - DNA, 22 bp, Artificial Sequence
  chemically synthesized
ggcaagagtataattctggctt

SEQ ID NO: 889812 - DNA, 22 bp, Artificial Sequence
  chemically synthesized
aaggtgttatcaagccagaatt

SEQ ID NO: 889813 - DNA, 22 bp, Artificial Sequence
  chemically synthesized
tgggcaagagtataattctggc

SEQ ID NO: 889814 - DNA, 22 bp, Artificial Sequence
  chemically synthesized
cctctgggcaagagtataattc

SEQ ID NO: 889815 - DNA, 22 bp, Artificial Sequence
  chemically synthesized
tcaagccagaattatactcttg

SEQ ID NO: 889816 - DNA, 22 bp, Artificial Sequence
  chemically synthesized
ggttgcctctgggcaagagtat

SEQ ID NO: 889817 - DNA, 22 bp, Artificial Sequence
  chemically synthesized
aggttgcctctgggcaagagta

SEQ ID NO: 889818 - DNA, 22 bp, Artificial Sequence
  chemically synthesized
agtttaggttgcctctgggcaa

SEQ ID NO: 889819 - DNA, 22 bp, Artificial Sequence
  chemically synthesized
ctgagtttaggttgcctctggg

SEQ ID NO: 889820 - DNA, 22 bp, Artificial Sequence
  chemically synthesized
tcctgagtttaggttgcctctg

SEQ ID NO: 889821 - DNA, 22 bp, Artificial Sequence
  chemically synthesized
ctcctgagtttaggttgcctct

SEQ ID NO: 889822 - DNA, 22 bp, Artificial Sequence
  chemically synthesized
tactcttgcccagaggcaacct

SEQ ID NO: 889823 - DNA, 22 bp, Artificial Sequence
  chemically synthesized
tctcctgagtttaggttgcctc

SEQ ID NO: 889824 - DNA, 22 bp, Artificial Sequence
  chemically synthesized
ttctcctgagtttaggttgcct

SEQ ID NO: 889825 - DNA, 22 bp, Artificial Sequence
  chemically synthesized
ttgcccagaggcaacctaaact

SEQ ID NO: 889826 - DNA, 22 bp, Artificial Sequence
  chemically synthesized
gcccagaggcaacctaaactca

SEQ ID NO: 889827 - DNA, 22 bp, Artificial Sequence
  chemically synthesized
cccagaggcaacctaaactcag

SEQ ID NO: 889828 - DNA, 22 bp, Artificial Sequence
  chemically synthesized
aatgtttttctcctgagtttag

SEQ ID NO: 889829 - DNA, 22 bp, Artificial Sequence
  chemically synthesized
ttgaatgtttttctcctgagtt

SEQ ID NO: 889830 - DNA, 22 bp, Artificial Sequence
  chemically synthesized
attgaatgtttttctcctgagt

SEQ ID NO: 889831 - DNA, 22 bp, Artificial Sequence
  chemically synthesized
aactcaggagaaaaacattcaa

SEQ ID NO: 889832 - DNA, 22 bp, Artificial Sequence
  chemically synthesized
aacacagatttattgaatgttt

SEQ ID NO: 889833 - DNA, 22 bp, Artificial Sequence
  chemically synthesized
aggagaaaaacattcaataaat

SEQ ID NO: 889834 - DNA, 22 bp, Artificial Sequence
  chemically synthesized
ccatgcaactgaacacagattt

SEQ ID NO: 889835 - DNA, 22 bp, Artificial Sequence
  chemically synthesized
accatgcaactgaacacagatt

SEQ ID NO: 889836 - DNA, 22 bp, Artificial Sequence
  chemically synthesized
taccatgcaactgaacacagat

SEQ ID NO: 889837 - DNA, 22 bp, Artificial Sequence
  chemically synthesized
ttaccatgcaactgaacacaga

SEQ ID NO: 889838 - DNA, 22 bp, Artificial Sequence
  chemically synthesized
ccttttaccatgcaactgaaca

SEQ ID NO: 889839 - DNA, 22 bp, Artificial Sequence
  chemically synthesized
aataaatctgtgttcagttgca

SEQ ID NO: 889840 - DNA, 22 bp, Artificial Sequence
  chemically synthesized
ttcccttttaccatgcaactga

SEQ ID NO: 889841 - DNA, 22 bp, Artificial Sequence
  chemically synthesized
tgttcagttgcatggtaaaagg

SEQ ID NO: 889842 - DNA, 22 bp, Artificial Sequence
  chemically synthesized
agttgcatggtaaaagggaata

SEQ ID NO: 889843 - DNA, 22 bp, Artificial Sequence
  chemically synthesized
gacaaaaagacaaattattccc

SEQ ID NO: 889844 - DNA, 22 bp, Artificial Sequence
  chemically synthesized
catggtaaaagggaataatttg

SEQ ID NO: 889845 - DNA, 22 bp, Artificial Sequence
  chemically synthesized
ctggacaaaaagacaaattatt

SEQ ID NO: 889846 - DNA, 22 bp, Artificial Sequence
  chemically synthesized
gatgacagttactggacaaaaa

SEQ ID NO: 889847 - DNA, 22 bp, Artificial Sequence
  chemically synthesized
gtctttttgtccagtaactgtc

SEQ ID NO: 889848 - DNA, 22 bp, Artificial Sequence
  chemically synthesized
tctttttgtccagtaactgtca

SEQ ID NO: 889849 - DNA, 22 bp, Artificial Sequence
  chemically synthesized
aaaaacactggatgacagttac

SEQ ID NO: 889850 - DNA, 22 bp, Artificial Sequence
  chemically synthesized
tttgtccagtaactgtcatcca

SEQ ID NO: 889851 - DNA, 22 bp, Artificial Sequence
  chemically synthesized
ttgtccagtaactgtcatccag

SEQ ID NO: 889852 - DNA, 22 bp, Artificial Sequence
  chemically synthesized
tgtccagtaactgtcatccagt

SEQ ID NO: 889853 - DNA, 22 bp, Artificial Sequence
  chemically synthesized
gtccagtaactgtcatccagtg

SEQ ID NO: 889854 - DNA, 22 bp, Artificial Sequence
  chemically synthesized
tccagtaactgtcatccagtgt

SEQ ID NO: 889855 - DNA, 22 bp, Artificial Sequence
  chemically synthesized
tcatccagtgtttttcaggaca

SEQ ID NO: 889856 - DNA, 22 bp, Artificial Sequence
  chemically synthesized
gatatgaaaatatcagtggaat

SEQ ID NO: 889857 - DNA, 22 bp, Artificial Sequence
  chemically synthesized
ttcaggacacattccactgata

SEQ ID NO: 889858 - DNA, 22 bp, Artificial Sequence
  chemically synthesized
tcaggacacattccactgatat

SEQ ID NO: 889859 - DNA, 22 bp, Artificial Sequence
  chemically synthesized
caggacacattccactgatatt

SEQ ID NO: 889860 - DNA, 22 bp, Artificial Sequence
  chemically synthesized
aggacacattccactgatattt

SEQ ID NO: 889861 - DNA, 22 bp, Artificial Sequence
  chemically synthesized
tattggatatgaaaatatcagt

SEQ ID NO: 889862 - DNA, 22 bp, Artificial Sequence
  chemically synthesized
atattggatatgaaaatatcag

SEQ ID NO: 889863 - DNA, 22 bp, Artificial Sequence
  chemically synthesized
tatattggatatgaaaatatca

SEQ ID NO: 889864 - DNA, 22 bp, Artificial Sequence
  chemically synthesized
agtgttttatattggatatgaa

SEQ ID NO: 889865 - DNA, 22 bp, Artificial Sequence
  chemically synthesized
cagtgttttatattggatatga

SEQ ID NO: 889866 - DNA, 22 bp, Artificial Sequence
  chemically synthesized
cactgatattttcatatccaat

SEQ ID NO: 889867 - DNA, 22 bp, Artificial Sequence
  chemically synthesized
atattttcatatccaatataaa

SEQ ID NO: 889868 - DNA, 22 bp, Artificial Sequence
  chemically synthesized
gaaaaaagtttcagtgttttat

SEQ ID NO: 889869 - DNA, 22 bp, Artificial Sequence
  chemically synthesized
tcatatccaatataaaacactg

SEQ ID NO: 889870 - DNA, 22 bp, Artificial Sequence
  chemically synthesized
agaaaaaagtttcagtgtttta

SEQ ID NO: 889871 - DNA, 22 bp, Artificial Sequence
  chemically synthesized
catatccaatataaaacactga

SEQ ID NO: 889872 - DNA, 22 bp, Artificial Sequence
  chemically synthesized
tagaaaaaagtttcagtgtttt

SEQ ID NO: 889873 - DNA, 22 bp, Artificial Sequence
  chemically synthesized
atatccaatataaaacactgaa

SEQ ID NO: 889874 - DNA, 22 bp, Artificial Sequence
  chemically synthesized
aaacttttttctaaaggtctct

SEQ ID NO: 889875 - DNA, 22 bp, Artificial Sequence
  chemically synthesized
ttttctaaaggtctcttccttg

SEQ ID NO: 889876 - DNA, 22 bp, Artificial Sequence
  chemically synthesized
tttctaaaggtctcttccttgt

SEQ ID NO: 889877 - DNA, 22 bp, Artificial Sequence
  chemically synthesized
gggaggtaaggaacaaggaaga

SEQ ID NO: 889878 - DNA, 22 bp, Artificial Sequence
  chemically synthesized
ttctaaaggtctcttccttgtt

SEQ ID NO: 889879 - DNA, 22 bp, Artificial Sequence
  chemically synthesized
tctaaaggtctcttccttgttc

SEQ ID NO: 889880 - DNA, 22 bp, Artificial Sequence
  chemically synthesized
ctaaaggtctcttccttgttcc

SEQ ID NO: 889881 - DNA, 22 bp, Artificial Sequence
  chemically synthesized
taaaggtctcttccttgttcct

SEQ ID NO: 889882 - DNA, 22 bp, Artificial Sequence
  chemically synthesized
aaggtctcttccttgttcctta

SEQ ID NO: 889883 - DNA, 22 bp, Artificial Sequence
  chemically synthesized
aaagtggtgttcgggaggtaag

SEQ ID NO: 889884 - DNA, 22 bp, Artificial Sequence
  chemically synthesized
aaaagtggtgttcgggaggtaa

SEQ ID NO: 889885 - DNA, 22 bp, Artificial Sequence
  chemically synthesized
ttccttgttccttacctcccga

SEQ ID NO: 889886 - DNA, 22 bp, Artificial Sequence
  chemically synthesized
taaaagtggtgttcgggaggta

SEQ ID NO: 889887 - DNA, 22 bp, Artificial Sequence
  chemically synthesized
ttaaaagtggtgttcgggaggt

SEQ ID NO: 889888 - DNA, 22 bp, Artificial Sequence
  chemically synthesized
ccttgttccttacctcccgaac

SEQ ID NO: 889889 - DNA, 22 bp, Artificial Sequence
  chemically synthesized
tttaaaagtggtgttcgggagg

SEQ ID NO: 889890 - DNA, 22 bp, Artificial Sequence
  chemically synthesized
cttgttccttacctcccgaaca

SEQ ID NO: 889891 - DNA, 22 bp, Artificial Sequence
  chemically synthesized
gttccttacctcccgaacacca

SEQ ID NO: 889892 - DNA, 22 bp, Artificial Sequence
  chemically synthesized
ttccttacctcccgaacaccac

SEQ ID NO: 889893 - DNA, 22 bp, Artificial Sequence
  chemically synthesized
cttacctcccgaacaccacttt

SEQ ID NO: 889894 - DNA, 22 bp, Artificial Sequence
  chemically synthesized
aaaaaaattttttaaaagtggt

SEQ ID NO: 889895 - DNA, 22 bp, Artificial Sequence
  chemically synthesized
acctcccgaacaccacttttaa

SEQ ID NO: 889896 - DNA, 22 bp, Artificial Sequence
  chemically synthesized
aaaaaaaattttttaaaagtgg

SEQ ID NO: 889897 - DNA, 22 bp, Artificial Sequence
  chemically synthesized
cctcccgaacaccacttttaaa

SEQ ID NO: 889898 - DNA, 22 bp, Artificial Sequence
  chemically synthesized
taaaaaaaattttttaaaagtg

SEQ ID NO: 889899 - DNA, 22 bp, Artificial Sequence
  chemically synthesized
ttaaaaaaaattttttaaaagt

SEQ ID NO: 889900 - DNA, 22 bp, Artificial Sequence
  chemically synthesized
ccgaacaccacttttaaaaaat

SEQ ID NO: 889901 - DNA, 22 bp, Artificial Sequence
  chemically synthesized
atttttaaaaaaaattttttaa

SEQ ID NO: 889902 - DNA, 22 bp, Artificial Sequence
  chemically synthesized
catttttaaaaaaaatttttta

SEQ ID NO: 889903 - DNA, 22 bp, Artificial Sequence
  chemically synthesized
atttcatttttaaaaaaaattt

SEQ ID NO: 889904 - DNA, 22 bp, Artificial Sequence
  chemically synthesized
tctgatttcatttttaaaaaaa

SEQ ID NO: 889905 - DNA, 22 bp, Artificial Sequence
  chemically synthesized
ttaaaaaattttttttaaaaat

SEQ ID NO: 889906 - DNA, 22 bp, Artificial Sequence
  chemically synthesized
ttatctgatttcatttttaaaa

SEQ ID NO: 889907 - DNA, 22 bp, Artificial Sequence
  chemically synthesized
taaaaaattttttttaaaaatg

SEQ ID NO: 889908 - DNA, 22 bp, Artificial Sequence
  chemically synthesized
aaaaaattttttttaaaaatga

SEQ ID NO: 889909 - DNA, 22 bp, Artificial Sequence
  chemically synthesized
aaaaattttttttaaaaatgaa

SEQ ID NO: 889910 - DNA, 22 bp, Artificial Sequence
  chemically synthesized
acctgttatctgatttcatttt

SEQ ID NO: 889911 - DNA, 22 bp, Artificial Sequence
  chemically synthesized
tttttaaaaatgaaatcagata

SEQ ID NO: 889912 - DNA, 22 bp, Artificial Sequence
  chemically synthesized
aagttcacctgttatctgattt

SEQ ID NO: 889913 - DNA, 22 bp, Artificial Sequence
  chemically synthesized
ttttaaaaatgaaatcagataa

SEQ ID NO: 889914 - DNA, 22 bp, Artificial Sequence
  chemically synthesized
tttaaaaatgaaatcagataac

SEQ ID NO: 889915 - DNA, 22 bp, Artificial Sequence
  chemically synthesized
ttaaaaatgaaatcagataaca

SEQ ID NO: 889916 - DNA, 22 bp, Artificial Sequence
  chemically synthesized
taaaaatgaaatcagataacag

SEQ ID NO: 889917 - DNA, 22 bp, Artificial Sequence
  chemically synthesized
gctcaagttcacctgttatctg

SEQ ID NO: 889918 - DNA, 22 bp, Artificial Sequence
  chemically synthesized
aaaaatgaaatcagataacagg

SEQ ID NO: 889919 - DNA, 22 bp, Artificial Sequence
  chemically synthesized
aaaatgaaatcagataacaggt

SEQ ID NO: 889920 - DNA, 22 bp, Artificial Sequence
  chemically synthesized
gatagatgtgtactagctcaag

SEQ ID NO: 889921 - DNA, 22 bp, Artificial Sequence
  chemically synthesized
agatagatgtgtactagctcaa

SEQ ID NO: 889922 - DNA, 22 bp, Artificial Sequence
  chemically synthesized
ccttagatagatgtgtactagc

SEQ ID NO: 889923 - DNA, 22 bp, Artificial Sequence
  chemically synthesized
gagctagtacacatctatctaa

SEQ ID NO: 889924 - DNA, 22 bp, Artificial Sequence
  chemically synthesized
agctagtacacatctatctaag

SEQ ID NO: 889925 - DNA, 22 bp, Artificial Sequence
  chemically synthesized
aaatagtaactcccttagatag

SEQ ID NO: 889926 - DNA, 22 bp, Artificial Sequence
  chemically synthesized
gtacacatctatctaagggagt

SEQ ID NO: 889927 - DNA, 22 bp, Artificial Sequence
  chemically synthesized
aaattcaaatagtaactccctt

SEQ ID NO: 889928 - DNA, 22 bp, Artificial Sequence
  chemically synthesized
tctaagggagttactatttgaa

SEQ ID NO: 889929 - DNA, 22 bp, Artificial Sequence
  chemically synthesized
agggagttactatttgaatttg

SEQ ID NO: 889930 - DNA, 22 bp, Artificial Sequence
  chemically synthesized
gaatggataattcaaattcaaa

SEQ ID NO: 889931 - DNA, 22 bp, Artificial Sequence
  chemically synthesized
agaatggataattcaaattcaa

SEQ ID NO: 889932 - DNA, 22 bp, Artificial Sequence
  chemically synthesized
tagaatggataattcaaattca

SEQ ID NO: 889933 - DNA, 22 bp, Artificial Sequence
  chemically synthesized
actttagaatggataattcaaa

SEQ ID NO: 889934 - DNA, 22 bp, Artificial Sequence
  chemically synthesized
ctatttgaatttgaattatcca

SEQ ID NO: 889935 - DNA, 22 bp, Artificial Sequence
  chemically synthesized
aattcactttagaatggataat

SEQ ID NO: 889936 - DNA, 22 bp, Artificial Sequence
  chemically synthesized
tttgaatttgaattatccattc

SEQ ID NO: 889937 - DNA, 22 bp, Artificial Sequence
  chemically synthesized
gaatttgaattatccattctaa

SEQ ID NO: 889938 - DNA, 22 bp, Artificial Sequence
  chemically synthesized
aatttgaattatccattctaaa

SEQ ID NO: 889939 - DNA, 22 bp, Artificial Sequence
  chemically synthesized
atgtcattaaattcactttaga

SEQ ID NO: 889940 - DNA, 22 bp, Artificial Sequence
  chemically synthesized
gaattatccattctaaagtgaa

SEQ ID NO: 889941 - DNA, 22 bp, Artificial Sequence
  chemically synthesized
aattatccattctaaagtgaat

SEQ ID NO: 889942 - DNA, 22 bp, Artificial Sequence
  chemically synthesized
tccattctaaagtgaatttaat

SEQ ID NO: 889943 - DNA, 22 bp, Artificial Sequence
  chemically synthesized
cagaggttaatgtcattaaatt

SEQ ID NO: 889944 - DNA, 22 bp, Artificial Sequence
  chemically synthesized
gcagaggttaatgtcattaaat

SEQ ID NO: 889945 - DNA, 22 bp, Artificial Sequence
  chemically synthesized
tgcagaggttaatgtcattaaa

SEQ ID NO: 889946 - DNA, 22 bp, Artificial Sequence
  chemically synthesized
taaagtgaatttaatgacatta

SEQ ID NO: 889947 - DNA, 22 bp, Artificial Sequence
  chemically synthesized
gctttgcagaggttaatgtcat

SEQ ID NO: 889948 - DNA, 22 bp, Artificial Sequence
  chemically synthesized
aagtgaatttaatgacattaac

SEQ ID NO: 889949 - DNA, 22 bp, Artificial Sequence
  chemically synthesized
acaaaattagctttgcagaggt

SEQ ID NO: 889950 - DNA, 22 bp, Artificial Sequence
  chemically synthesized
aatgacattaacctctgcaaag

SEQ ID NO: 889951 - DNA, 22 bp, Artificial Sequence
  chemically synthesized
atgacattaacctctgcaaagc

SEQ ID NO: 889952 - DNA, 22 bp, Artificial Sequence
  chemically synthesized
aacattcacaaaattagctttg

SEQ ID NO: 889953 - DNA, 22 bp, Artificial Sequence
  chemically synthesized
acctctgcaaagctaattttgt

SEQ ID NO: 889954 - DNA, 22 bp, Artificial Sequence
  chemically synthesized
tgcaaagctaattttgtgaatg

SEQ ID NO: 889955 - DNA, 22 bp, Artificial Sequence
  chemically synthesized
caaagctaattttgtgaatgtt

SEQ ID NO: 889956 - DNA, 22 bp, Artificial Sequence
  chemically synthesized
atcagtcaggagtgtactcaac

SEQ ID NO: 889957 - DNA, 22 bp, Artificial Sequence
  chemically synthesized
attttgtgaatgttgagtacac

SEQ ID NO: 889958 - DNA, 22 bp, Artificial Sequence
  chemically synthesized
tgtgaatgttgagtacactcct

SEQ ID NO: 889959 - DNA, 22 bp, Artificial Sequence
  chemically synthesized
gtgaatgttgagtacactcctg

SEQ ID NO: 889960 - DNA, 22 bp, Artificial Sequence
  chemically synthesized
tgaatgttgagtacactcctga

SEQ ID NO: 889961 - DNA, 22 bp, Artificial Sequence
  chemically synthesized
ccaattaatcagtcaggagtgt

SEQ ID NO: 889962 - DNA, 22 bp, Artificial Sequence
  chemically synthesized
agtacactcctgactgattaat

SEQ ID NO: 889963 - DNA, 22 bp, Artificial Sequence
  chemically synthesized
ccaatggattcccaattaatca

SEQ ID NO: 889964 - DNA, 22 bp, Artificial Sequence
  chemically synthesized
accaatggattcccaattaatc

SEQ ID NO: 889965 - DNA, 22 bp, Artificial Sequence
  chemically synthesized
ctgactgattaattgggaatcc

SEQ ID NO: 889966 - DNA, 22 bp, Artificial Sequence
  chemically synthesized
actgattaattgggaatccatt

SEQ ID NO: 889967 - DNA, 22 bp, Artificial Sequence
  chemically synthesized
attaattgggaatccattggta

SEQ ID NO: 889968 - DNA, 22 bp, Artificial Sequence
  chemically synthesized
attgggaatccattggtaagtc

SEQ ID NO: 889969 - DNA, 22 bp, Artificial Sequence
  chemically synthesized
gtgggtaaggagtcagacttac

SEQ ID NO: 889970 - DNA, 22 bp, Artificial Sequence
  chemically synthesized
ggaatccattggtaagtctgac

SEQ ID NO: 889971 - DNA, 22 bp, Artificial Sequence
  chemically synthesized
cgtgggtaaggagtcagactta

SEQ ID NO: 889972 - DNA, 22 bp, Artificial Sequence
  chemically synthesized
tcgtgggtaaggagtcagactt

SEQ ID NO: 889973 - DNA, 22 bp, Artificial Sequence
  chemically synthesized
cacgctttcgtgggtaaggagt

SEQ ID NO: 889974 - DNA, 22 bp, Artificial Sequence
  chemically synthesized
ccacgctttcgtgggtaaggag

SEQ ID NO: 889975 - DNA, 22 bp, Artificial Sequence
  chemically synthesized
gtaagtctgactccttacccac

SEQ ID NO: 889976 - DNA, 22 bp, Artificial Sequence
  chemically synthesized
ccatgcttccacgctttcgtgg

SEQ ID NO: 889977 - DNA, 22 bp, Artificial Sequence
  chemically synthesized
actccttacccacgaaagcgtg

SEQ ID NO: 889978 - DNA, 22 bp, Artificial Sequence
  chemically synthesized
atgttaccatgcttccacgctt

SEQ ID NO: 889979 - DNA, 22 bp, Artificial Sequence
  chemically synthesized
cttacccacgaaagcgtggaag

SEQ ID NO: 889980 - DNA, 22 bp, Artificial Sequence
  chemically synthesized
acccacgaaagcgtggaagcat

SEQ ID NO: 889981 - DNA, 22 bp, Artificial Sequence
  chemically synthesized
cccacgaaagcgtggaagcatg

SEQ ID NO: 889982 - DNA, 22 bp, Artificial Sequence
  chemically synthesized
agaatcaaaatctgatgttacc

SEQ ID NO: 889983 - DNA, 22 bp, Artificial Sequence
  chemically synthesized
ctgagaatcaaaatctgatgtt

SEQ ID NO: 889984 - DNA, 22 bp, Artificial Sequence
  chemically synthesized
agattactgagaatcaaaatct

SEQ ID NO: 889985 - DNA, 22 bp, Artificial Sequence
  chemically synthesized
aagaatatactcagattactga

SEQ ID NO: 889986 - DNA, 22 bp, Artificial Sequence
  chemically synthesized
gactcaagaatatactcagatt

SEQ ID NO: 889987 - DNA, 22 bp, Artificial Sequence
  chemically synthesized
tgattctcagtaatctgagtat

SEQ ID NO: 889988 - DNA, 22 bp, Artificial Sequence
  chemically synthesized
gattctcagtaatctgagtata

SEQ ID NO: 889989 - DNA, 22 bp, Artificial Sequence
  chemically synthesized
tagactcaagaatatactcaga

SEQ ID NO: 889990 - DNA, 22 bp, Artificial Sequence
  chemically synthesized
attctcagtaatctgagtatat

SEQ ID NO: 889991 - DNA, 22 bp, Artificial Sequence
  chemically synthesized
tcagtaatctgagtatattctt

SEQ ID NO: 889992 - DNA, 22 bp, Artificial Sequence
  chemically synthesized
ggactctagactcaagaatata

SEQ ID NO: 889993 - DNA, 22 bp, Artificial Sequence
  chemically synthesized
agtaatctgagtatattcttga

SEQ ID NO: 889994 - DNA, 22 bp, Artificial Sequence
  chemically synthesized
agtatattcttgagtctagagt

SEQ ID NO: 889995 - DNA, 22 bp, Artificial Sequence
  chemically synthesized
aaacaaagaagcctgggactct

SEQ ID NO: 889996 - DNA, 22 bp, Artificial Sequence
  chemically synthesized
caaacaaagaagcctgggactc

SEQ ID NO: 889997 - DNA, 22 bp, Artificial Sequence
  chemically synthesized
tcaaacaaagaagcctgggact

SEQ ID NO: 889998 - DNA, 22 bp, Artificial Sequence
  chemically synthesized
ttcaaacaaagaagcctgggac

SEQ ID NO: 889999 - DNA, 22 bp, Artificial Sequence
  chemically synthesized
ttgagtctagagtcccaggctt

SEQ ID NO: 890000 - DNA, 22 bp, Artificial Sequence
  chemically synthesized
gagtctagagtcccaggcttct

SEQ ID NO: 890001 - DNA, 22 bp, Artificial Sequence
  chemically synthesized
agtctagagtcccaggcttctt

SEQ ID NO: 890002 - DNA, 22 bp, Artificial Sequence
  chemically synthesized
gagtcccaggcttctttgtttg

SEQ ID NO: 890003 - DNA, 22 bp, Artificial Sequence
  chemically synthesized
aaccaatgatgcttttcaaaca

SEQ ID NO: 890004 - DNA, 22 bp, Artificial Sequence
  chemically synthesized
taaaccaatgatgcttttcaaa

SEQ ID NO: 890005 - DNA, 22 bp, Artificial Sequence
  chemically synthesized
ctttgtttgaaaagcatcattg

SEQ ID NO: 890006 - DNA, 22 bp, Artificial Sequence
  chemically synthesized
catgttctaaaccaatgatgct

SEQ ID NO: 890007 - DNA, 22 bp, Artificial Sequence
  chemically synthesized
tttgtttgaaaagcatcattgg

SEQ ID NO: 890008 - DNA, 22 bp, Artificial Sequence
  chemically synthesized
ccatgttctaaaccaatgatgc

SEQ ID NO: 890009 - DNA, 22 bp, Artificial Sequence
  chemically synthesized
tccatgttctaaaccaatgatg

SEQ ID NO: 890010 - DNA, 22 bp, Artificial Sequence
  chemically synthesized
tgtttgaaaagcatcattggtt

SEQ ID NO: 890011 - DNA, 22 bp, Artificial Sequence
  chemically synthesized
gtttgaaaagcatcattggttt

SEQ ID NO: 890012 - DNA, 22 bp, Artificial Sequence
  chemically synthesized
tttgaaaagcatcattggttta

SEQ ID NO: 890013 - DNA, 22 bp, Artificial Sequence
  chemically synthesized
gaaaagcatcattggtttagaa

SEQ ID NO: 890014 - DNA, 22 bp, Artificial Sequence
  chemically synthesized
aaaagcatcattggtttagaac

SEQ ID NO: 890015 - DNA, 22 bp, Artificial Sequence
  chemically synthesized
aataagaattttccatgttcta

SEQ ID NO: 890016 - DNA, 22 bp, Artificial Sequence
  chemically synthesized
caataagaattttccatgttct

SEQ ID NO: 890017 - DNA, 22 bp, Artificial Sequence
  chemically synthesized
gtttagaacatggaaaattctt

SEQ ID NO: 890018 - DNA, 22 bp, Artificial Sequence
  chemically synthesized
agaacatggaaaattcttattg

SEQ ID NO: 890019 - DNA, 22 bp, Artificial Sequence
  chemically synthesized
gaacatggaaaattcttattga

SEQ ID NO: 890020 - DNA, 22 bp, Artificial Sequence
  chemically synthesized
aaccaaatgagatttcaataag

SEQ ID NO: 890021 - DNA, 22 bp, Artificial Sequence
  chemically synthesized
aagttgaaccaaatgagatttc

SEQ ID NO: 890022 - DNA, 22 bp, Artificial Sequence
  chemically synthesized
ttattgaaatctcatttggttc

SEQ ID NO: 890023 - DNA, 22 bp, Artificial Sequence
  chemically synthesized
aaaatctgaagttgaaccaaat

SEQ ID NO: 890024 - DNA, 22 bp, Artificial Sequence
  chemically synthesized
attgaaatctcatttggttcaa

SEQ ID NO: 890025 - DNA, 22 bp, Artificial Sequence
  chemically synthesized
ttgaaatctcatttggttcaac

SEQ ID NO: 890026 - DNA, 22 bp, Artificial Sequence
  chemically synthesized
aaatctcatttggttcaacttc

SEQ ID NO: 890027 - DNA, 22 bp, Artificial Sequence
  chemically synthesized
aatactgaaaatctgaagttga

SEQ ID NO: 890028 - DNA, 22 bp, Artificial Sequence
  chemically synthesized
taaatactgaaaatctgaagtt

SEQ ID NO: 890029 - DNA, 22 bp, Artificial Sequence
  chemically synthesized
tctaaatactgaaaatctgaag

SEQ ID NO: 890030 - DNA, 22 bp, Artificial Sequence
  chemically synthesized
atttggttcaacttcagatttt

SEQ ID NO: 890031 - DNA, 22 bp, Artificial Sequence
  chemically synthesized
ctctaaatactgaaaatctgaa

SEQ ID NO: 890032 - DNA, 22 bp, Artificial Sequence
  chemically synthesized
ggttcaacttcagattttcagt

SEQ ID NO: 890033 - DNA, 22 bp, Artificial Sequence
  chemically synthesized
gttcaacttcagattttcagta

SEQ ID NO: 890034 - DNA, 22 bp, Artificial Sequence
  chemically synthesized
aacttcagattttcagtattta

SEQ ID NO: 890035 - DNA, 22 bp, Artificial Sequence
  chemically synthesized
cagattttcagtatttagagaa

SEQ ID NO: 890036 - DNA, 22 bp, Artificial Sequence
  chemically synthesized
agattttcagtatttagagaaa

SEQ ID NO: 890037 - DNA, 22 bp, Artificial Sequence
  chemically synthesized
tacagaaaatgatttctctaaa

SEQ ID NO: 890038 - DNA, 22 bp, Artificial Sequence
  chemically synthesized
tcagtatttagagaaatcattt

SEQ ID NO: 890039 - DNA, 22 bp, Artificial Sequence
  chemically synthesized
cagtatttagagaaatcatttt

SEQ ID NO: 890040 - DNA, 22 bp, Artificial Sequence
  chemically synthesized
agtatttagagaaatcattttc

SEQ ID NO: 890041 - DNA, 22 bp, Artificial Sequence
  chemically synthesized
caaacgtgatctgtacagaaaa

SEQ ID NO: 890042 - DNA, 22 bp, Artificial Sequence
  chemically synthesized
agagaaatcattttctgtacag

SEQ ID NO: 890043 - DNA, 22 bp, Artificial Sequence
  chemically synthesized
tacaaacgtgatctgtacagaa

SEQ ID NO: 890044 - DNA, 22 bp, Artificial Sequence
  chemically synthesized
gagaaatcattttctgtacaga

SEQ ID NO: 890045 - DNA, 22 bp, Artificial Sequence
  chemically synthesized
tctgtacagatcacgtttgtag

SEQ ID NO: 890046 - DNA, 22 bp, Artificial Sequence
  chemically synthesized
ctgtacagatcacgtttgtaga

SEQ ID NO: 890047 - DNA, 22 bp, Artificial Sequence
  chemically synthesized
tgtacagatcacgtttgtagag

SEQ ID NO: 890048 - DNA, 22 bp, Artificial Sequence
  chemically synthesized
tacagatcacgtttgtagagac

SEQ ID NO: 890049 - DNA, 22 bp, Artificial Sequence
  chemically synthesized
gtagagacctcattcatgtttc

SEQ ID NO: 890050 - DNA, 22 bp, Artificial Sequence
  chemically synthesized
tagagacctcattcatgtttcc

SEQ ID NO: 890051 - DNA, 22 bp, Artificial Sequence
  chemically synthesized
attcatgtttcctttttttgtt

SEQ ID NO: 890052 - DNA, 22 bp, Artificial Sequence
  chemically synthesized
atgtttcctttttttgttgttg

SEQ ID NO: 890053 - DNA, 22 bp, Artificial Sequence
  chemically synthesized
cctttttttgttgttgctgttc

SEQ ID NO: 890054 - DNA, 22 bp, Artificial Sequence
  chemically synthesized
ctttttttgttgttgctgttcc

SEQ ID NO: 890055 - DNA, 22 bp, Artificial Sequence
  chemically synthesized
tttttgttgttgctgttccttc

SEQ ID NO: 890056 - DNA, 22 bp, Artificial Sequence
  chemically synthesized
ttttgttgttgctgttccttcg

SEQ ID NO: 890057 - DNA, 22 bp, Artificial Sequence
  chemically synthesized
tttgttgttgctgttccttcgg

SEQ ID NO: 890058 - DNA, 22 bp, Artificial Sequence
  chemically synthesized
ttgttgttgctgttccttcggt

SEQ ID NO: 890059 - DNA, 22 bp, Artificial Sequence
  chemically synthesized
gaggaaagaggcaccgaaggaa

SEQ ID NO: 890060 - DNA, 22 bp, Artificial Sequence
  chemically synthesized
tgttgttgctgttccttcggtg

SEQ ID NO: 890061 - DNA, 22 bp, Artificial Sequence
  chemically synthesized
gttgttgctgttccttcggtgc

SEQ ID NO: 890062 - DNA, 22 bp, Artificial Sequence
  chemically synthesized
ttgttgctgttccttcggtgcc

SEQ ID NO: 890063 - DNA, 22 bp, Artificial Sequence
  chemically synthesized
ctggaggaaagaggcaccgaag

SEQ ID NO: 890064 - DNA, 22 bp, Artificial Sequence
  chemically synthesized
ttgctgttccttcggtgcctct

SEQ ID NO: 890065 - DNA, 22 bp, Artificial Sequence
  chemically synthesized
ctgttccttcggtgcctctttc

SEQ ID NO: 890066 - DNA, 22 bp, Artificial Sequence
  chemically synthesized
ttccttcggtgcctctttcctc

SEQ ID NO: 890067 - DNA, 22 bp, Artificial Sequence
  chemically synthesized
cttcggtgcctctttcctccag

SEQ ID NO: 890068 - DNA, 22 bp, Artificial Sequence
  chemically synthesized
cggtgcctctttcctccaggag

SEQ ID NO: 890069 - DNA, 22 bp, Artificial Sequence
  chemically synthesized
ggtgcctctttcctccaggaga

SEQ ID NO: 890070 - DNA, 22 bp, Artificial Sequence
  chemically synthesized
tttcctccaggagacattctca

SEQ ID NO: 890071 - DNA, 22 bp, Artificial Sequence
  chemically synthesized
tcctccaggagacattctcact

SEQ ID NO: 890072 - DNA, 22 bp, Artificial Sequence
  chemically synthesized
cctccaggagacattctcacta

SEQ ID NO: 890073 - DNA, 22 bp, Artificial Sequence
  chemically synthesized
ctccaggagacattctcactat

SEQ ID NO: 890074 - DNA, 22 bp, Artificial Sequence
  chemically synthesized
caggagacattctcactattct

SEQ ID NO: 890075 - DNA, 22 bp, Artificial Sequence
  chemically synthesized
agaggaggagaaacagaatagt

SEQ ID NO: 890076 - DNA, 22 bp, Artificial Sequence
  chemically synthesized
cagaggaggagaaacagaatag

SEQ ID NO: 890077 - DNA, 22 bp, Artificial Sequence
  chemically synthesized
tcactattctgtttctcctcct

SEQ ID NO: 890078 - DNA, 22 bp, Artificial Sequence
  chemically synthesized
actattctgtttctcctcctct

SEQ ID NO: 890079 - DNA, 22 bp, Artificial Sequence
  chemically synthesized
ttctgtttctcctcctctgaag

SEQ ID NO: 890080 - DNA, 22 bp, Artificial Sequence
  chemically synthesized
atcagcagtagtcttcagagga

SEQ ID NO: 890081 - DNA, 22 bp, Artificial Sequence
  chemically synthesized
tgtttctcctcctctgaagact

SEQ ID NO: 890082 - DNA, 22 bp, Artificial Sequence
  chemically synthesized
tttctcctcctctgaagactac

SEQ ID NO: 890083 - DNA, 22 bp, Artificial Sequence
  chemically synthesized
ctcctcctctgaagactactgc

SEQ ID NO: 890084 - DNA, 22 bp, Artificial Sequence
  chemically synthesized
tcctcctctgaagactactgct

SEQ ID NO: 890085 - DNA, 22 bp, Artificial Sequence
  chemically synthesized
ctcctctgaagactactgctga

SEQ ID NO: 890086 - DNA, 22 bp, Artificial Sequence
  chemically synthesized
ctctgaagactactgctgatta

SEQ ID NO: 890087 - DNA, 22 bp, Artificial Sequence
  chemically synthesized
tgaagactactgctgattagat

SEQ ID NO: 890088 - DNA, 22 bp, Artificial Sequence
  chemically synthesized
aagactactgctgattagatgc

SEQ ID NO: 890089 - DNA, 22 bp, Artificial Sequence
  chemically synthesized
tgccatagaggtgaagcatcta

SEQ ID NO: 890090 - DNA, 22 bp, Artificial Sequence
  chemically synthesized
gtgccatagaggtgaagcatct

SEQ ID NO: 890091 - DNA, 22 bp, Artificial Sequence
  chemically synthesized
ctgctgattagatgcttcacct

SEQ ID NO: 890092 - DNA, 22 bp, Artificial Sequence
  chemically synthesized
gtttgtgccatagaggtgaagc

SEQ ID NO: 890093 - DNA, 22 bp, Artificial Sequence
  chemically synthesized
ctgattagatgcttcacctcta

SEQ ID NO: 890094 - DNA, 22 bp, Artificial Sequence
  chemically synthesized
attagatgcttcacctctatgg

SEQ ID NO: 890095 - DNA, 22 bp, Artificial Sequence
  chemically synthesized
gatgcttcacctctatggcaca

SEQ ID NO: 890096 - DNA, 22 bp, Artificial Sequence
  chemically synthesized
cacctctatggcacaaactagg

SEQ ID NO: 890097 - DNA, 22 bp, Artificial Sequence
  chemically synthesized
acctctatggcacaaactaggc

SEQ ID NO: 890098 - DNA, 22 bp, Artificial Sequence
  chemically synthesized
acaagaagagaagcctagtttg

SEQ ID NO: 890099 - DNA, 22 bp, Artificial Sequence
  chemically synthesized
tatggcacaaactaggcttctc

SEQ ID NO: 890100 - DNA, 22 bp, Artificial Sequence
  chemically synthesized
tggcacaaactaggcttctctt

SEQ ID NO: 890101 - DNA, 22 bp, Artificial Sequence
  chemically synthesized
gtaaaaatcaaactaacaagaa

SEQ ID NO: 890102 - DNA, 22 bp, Artificial Sequence
  chemically synthesized
agtaaaaatcaaactaacaaga

SEQ ID NO: 890103 - DNA, 22 bp, Artificial Sequence
  chemically synthesized
tagtaaaaatcaaactaacaag

SEQ ID NO: 890104 - DNA, 22 bp, Artificial Sequence
  chemically synthesized
ggcttctcttcttgttagtttg

SEQ ID NO: 890105 - DNA, 22 bp, Artificial Sequence
  chemically synthesized
atctttagtaaaaatcaaacta

SEQ ID NO: 890106 - DNA, 22 bp, Artificial Sequence
  chemically synthesized
ctcttcttgttagtttgatttt

SEQ ID NO: 890107 - DNA, 22 bp, Artificial Sequence
  chemically synthesized
tcttcttgttagtttgattttt

SEQ ID NO: 890108 - DNA, 22 bp, Artificial Sequence
  chemically synthesized
ttcttgttagtttgatttttac

SEQ ID NO: 890109 - DNA, 22 bp, Artificial Sequence
  chemically synthesized
aagttcatctttagtaaaaatc

SEQ ID NO: 890110 - DNA, 22 bp, Artificial Sequence
  chemically synthesized
cttgttagtttgatttttacta

SEQ ID NO: 890111 - DNA, 22 bp, Artificial Sequence
  chemically synthesized
ttgttagtttgatttttactaa

SEQ ID NO: 890112 - DNA, 22 bp, Artificial Sequence
  chemically synthesized
gttagtttgatttttactaaag

SEQ ID NO: 890113 - DNA, 22 bp, Artificial Sequence
  chemically synthesized
ttagtttgatttttactaaaga

SEQ ID NO: 890114 - DNA, 22 bp, Artificial Sequence
  chemically synthesized
gtttgatttttactaaagatga

SEQ ID NO: 890115 - DNA, 22 bp, Artificial Sequence
  chemically synthesized
gatttttactaaagatgaactt

SEQ ID NO: 890116 - DNA, 22 bp, Artificial Sequence
  chemically synthesized
atttttactaaagatgaacttc

SEQ ID NO: 890117 - DNA, 22 bp, Artificial Sequence
  chemically synthesized
ggaagaggccattgaagttcat

SEQ ID NO: 890118 - DNA, 22 bp, Artificial Sequence
  chemically synthesized
cggaagaggccattgaagttca

SEQ ID NO: 890119 - DNA, 22 bp, Artificial Sequence
  chemically synthesized
tcggaagaggccattgaagttc

SEQ ID NO: 890120 - DNA, 22 bp, Artificial Sequence
  chemically synthesized
ttactaaagatgaacttcaatg

SEQ ID NO: 890121 - DNA, 22 bp, Artificial Sequence
  chemically synthesized
tactaaagatgaacttcaatgg

SEQ ID NO: 890122 - DNA, 22 bp, Artificial Sequence
  chemically synthesized
actaaagatgaacttcaatggc

SEQ ID NO: 890123 - DNA, 22 bp, Artificial Sequence
  chemically synthesized
ctaaagatgaacttcaatggcc

SEQ ID NO: 890124 - DNA, 22 bp, Artificial Sequence
  chemically synthesized
tgttttcggaagaggccattga

SEQ ID NO: 890125 - DNA, 22 bp, Artificial Sequence
  chemically synthesized
atgttttcggaagaggccattg

SEQ ID NO: 890126 - DNA, 22 bp, Artificial Sequence
  chemically synthesized
aagatgaacttcaatggcctct

SEQ ID NO: 890127 - DNA, 22 bp, Artificial Sequence
  chemically synthesized
gggagtgcttatgttttcggaa

SEQ ID NO: 890128 - DNA, 22 bp, Artificial Sequence
  chemically synthesized
agggagtgcttatgttttcgga

SEQ ID NO: 890129 - DNA, 22 bp, Artificial Sequence
  chemically synthesized
caatggcctcttccgaaaacat

SEQ ID NO: 890130 - DNA, 22 bp, Artificial Sequence
  chemically synthesized
aatggcctcttccgaaaacata

SEQ ID NO: 890131 - DNA, 22 bp, Artificial Sequence
  chemically synthesized
ttccgaaaacataagcactccc

SEQ ID NO: 890132 - DNA, 22 bp, Artificial Sequence
  chemically synthesized
ccgaaaacataagcactcccta

SEQ ID NO: 890133 - DNA, 22 bp, Artificial Sequence
  chemically synthesized
gatgagccagcttagggagtgc

SEQ ID NO: 890134 - DNA, 22 bp, Artificial Sequence
  chemically synthesized
cgaaaacataagcactccctaa

SEQ ID NO: 890135 - DNA, 22 bp, Artificial Sequence
  chemically synthesized
agatgagccagcttagggagtg

SEQ ID NO: 890136 - DNA, 22 bp, Artificial Sequence
  chemically synthesized
cctaagctggctcatctaagac

SEQ ID NO: 890137 - DNA, 22 bp, Artificial Sequence
  chemically synthesized
agctggctcatctaagacctct

SEQ ID NO: 890138 - DNA, 22 bp, Artificial Sequence
  chemically synthesized
gctcatctaagacctctccctt

SEQ ID NO: 890139 - DNA, 22 bp, Artificial Sequence
  chemically synthesized
atctaagacctctcccttccca

SEQ ID NO: 890140 - DNA, 22 bp, Artificial Sequence
  chemically synthesized
agacctctcccttcccatcacc

SEQ ID NO: 890141 - DNA, 22 bp, Artificial Sequence
  chemically synthesized
tcccttcccatcaccaccattc

SEQ ID NO: 890142 - DNA, 22 bp, Artificial Sequence
  chemically synthesized
ccttcccatcaccaccattcct

SEQ ID NO: 890143 - DNA, 22 bp, Artificial Sequence
  chemically synthesized
cccatcaccaccattcctcctt

SEQ ID NO: 890144 - DNA, 22 bp, Artificial Sequence
  chemically synthesized
ccatcaccaccattcctccttc

SEQ ID NO: 890145 - DNA, 22 bp, Artificial Sequence
  chemically synthesized
ctccttcttcctttgactactt

SEQ ID NO: 890146 - DNA, 22 bp, Artificial Sequence
  chemically synthesized
aagggaagatcaaaagtagtca

SEQ ID NO: 890147 - DNA, 22 bp, Artificial Sequence
  chemically synthesized
cttcttcctttgactacttttg

SEQ ID NO: 890148 - DNA, 22 bp, Artificial Sequence
  chemically synthesized
cttcctttgactacttttgatc

SEQ ID NO: 890149 - DNA, 22 bp, Artificial Sequence
  chemically synthesized
ttcctttgactacttttgatct

SEQ ID NO: 890150 - DNA, 22 bp, Artificial Sequence
  chemically synthesized
cctttgactacttttgatcttc

SEQ ID NO: 890151 - DNA, 22 bp, Artificial Sequence
  chemically synthesized
ctttgactacttttgatcttcc

SEQ ID NO: 890152 - DNA, 22 bp, Artificial Sequence
  chemically synthesized
agggagctaaagggaagatcaa

SEQ ID NO: 890153 - DNA, 22 bp, Artificial Sequence
  chemically synthesized
aagggagctaaagggaagatca

SEQ ID NO: 890154 - DNA, 22 bp, Artificial Sequence
  chemically synthesized
tgactacttttgatcttccctt

SEQ ID NO: 890155 - DNA, 22 bp, Artificial Sequence
  chemically synthesized
gactacttttgatcttcccttt

SEQ ID NO: 890156 - DNA, 22 bp, Artificial Sequence
  chemically synthesized
actacttttgatcttcccttta

SEQ ID NO: 890157 - DNA, 22 bp, Artificial Sequence
  chemically synthesized
cttttgatcttccctttagctc

SEQ ID NO: 890158 - DNA, 22 bp, Artificial Sequence
  chemically synthesized
aaggatttaagggagctaaagg

SEQ ID NO: 890159 - DNA, 22 bp, Artificial Sequence
  chemically synthesized
ttgatcttccctttagctccct

SEQ ID NO: 890160 - DNA, 22 bp, Artificial Sequence
  chemically synthesized
tgatcttccctttagctccctt

SEQ ID NO: 890161 - DNA, 22 bp, Artificial Sequence
  chemically synthesized
gatcttccctttagctccctta

SEQ ID NO: 890162 - DNA, 22 bp, Artificial Sequence
  chemically synthesized
atcttccctttagctcccttaa

SEQ ID NO: 890163 - DNA, 22 bp, Artificial Sequence
  chemically synthesized
ccctttagctcccttaaatcct

SEQ ID NO: 890164 - DNA, 22 bp, Artificial Sequence
  chemically synthesized
cctttagctcccttaaatcctt

SEQ ID NO: 890165 - DNA, 22 bp, Artificial Sequence
  chemically synthesized
aagaggaatatgctgaaggatt

SEQ ID NO: 890166 - DNA, 22 bp, Artificial Sequence
  chemically synthesized
tagctcccttaaatccttcagc

SEQ ID NO: 890167 - DNA, 22 bp, Artificial Sequence
  chemically synthesized
gaagaggaatatgctgaaggat

SEQ ID NO: 890168 - DNA, 22 bp, Artificial Sequence
  chemically synthesized
agctcccttaaatccttcagca

SEQ ID NO: 890169 - DNA, 22 bp, Artificial Sequence
  chemically synthesized
gctcccttaaatccttcagcat

SEQ ID NO: 890170 - DNA, 22 bp, Artificial Sequence
  chemically synthesized
ccttaaatccttcagcatattc

SEQ ID NO: 890171 - DNA, 22 bp, Artificial Sequence
  chemically synthesized
aaatccttcagcatattcctct

SEQ ID NO: 890172 - DNA, 22 bp, Artificial Sequence
  chemically synthesized
aatccttcagcatattcctctt

SEQ ID NO: 890173 - DNA, 22 bp, Artificial Sequence
  chemically synthesized
cagcatattcctcttcaaaccc

SEQ ID NO: 890174 - DNA, 22 bp, Artificial Sequence
  chemically synthesized
agcatattcctcttcaaacccg

SEQ ID NO: 890175 - DNA, 22 bp, Artificial Sequence
  chemically synthesized
ctcttcaaacccgtacctgctc

SEQ ID NO: 890176 - DNA, 22 bp, Artificial Sequence
  chemically synthesized
ttcaaacccgtacctgctccat

SEQ ID NO: 890177 - DNA, 22 bp, Artificial Sequence
  chemically synthesized
caaacccgtacctgctccatct

SEQ ID NO: 890178 - DNA, 22 bp, Artificial Sequence
  chemically synthesized
aaacccgtacctgctccatctc

SEQ ID NO: 890179 - DNA, 22 bp, Artificial Sequence
  chemically synthesized
tcatggatggacaaagagatgg

SEQ ID NO: 890180 - DNA, 22 bp, Artificial Sequence
  chemically synthesized
ctccatctctttgtccatccat

SEQ ID NO: 890181 - DNA, 22 bp, Artificial Sequence
  chemically synthesized
catctctttgtccatccatgac

SEQ ID NO: 890182 - DNA, 22 bp, Artificial Sequence
  chemically synthesized
tttgtccatccatgacagacct

SEQ ID NO: 890183 - DNA, 22 bp, Artificial Sequence
  chemically synthesized
tgtccatccatgacagaccttt

SEQ ID NO: 890184 - DNA, 22 bp, Artificial Sequence
  chemically synthesized
gagtaggaagagaaaggtctgt

SEQ ID NO: 890185 - DNA, 22 bp, Artificial Sequence
  chemically synthesized
gtccatccatgacagacctttc

SEQ ID NO: 890186 - DNA, 22 bp, Artificial Sequence
  chemically synthesized
tccatccatgacagacctttct

SEQ ID NO: 890187 - DNA, 22 bp, Artificial Sequence
  chemically synthesized
agagactggagtaggaagagaa

SEQ ID NO: 890188 - DNA, 22 bp, Artificial Sequence
  chemically synthesized
tctcttcctactccagtctctc

SEQ ID NO: 890189 - DNA, 22 bp, Artificial Sequence
  chemically synthesized
ctcttcctactccagtctctca

SEQ ID NO: 890190 - DNA, 22 bp, Artificial Sequence
  chemically synthesized
tcttcctactccagtctctcaa

SEQ ID NO: 890191 - DNA, 22 bp, Artificial Sequence
  chemically synthesized
ttcctactccagtctctcaact

SEQ ID NO: 890192 - DNA, 22 bp, Artificial Sequence
  chemically synthesized
gagaccatagagagttgagaga

SEQ ID NO: 890193 - DNA, 22 bp, Artificial Sequence
  chemically synthesized
agagaccatagagagttgagag

SEQ ID NO: 890194 - DNA, 22 bp, Artificial Sequence
  chemically synthesized
cctactccagtctctcaactct

SEQ ID NO: 890195 - DNA, 22 bp, Artificial Sequence
  chemically synthesized
tagagaccatagagagttgaga

SEQ ID NO: 890196 - DNA, 22 bp, Artificial Sequence
  chemically synthesized
ctactccagtctctcaactctc

SEQ ID NO: 890197 - DNA, 22 bp, Artificial Sequence
  chemically synthesized
ctccagtctctcaactctctat

SEQ ID NO: 890198 - DNA, 22 bp, Artificial Sequence
  chemically synthesized
cagtctctcaactctctatggt

SEQ ID NO: 890199 - DNA, 22 bp, Artificial Sequence
  chemically synthesized
tcaactctctatggtctctaaa

SEQ ID NO: 890200 - DNA, 22 bp, Artificial Sequence
  chemically synthesized
aactctctatggtctctaaagc

SEQ ID NO: 890201 - DNA, 22 bp, Artificial Sequence
  chemically synthesized
tctatggtctctaaagcgttat

SEQ ID NO: 890202 - DNA, 22 bp, Artificial Sequence
  chemically synthesized
tatggtctctaaagcgttatgc

SEQ ID NO: 890203 - DNA, 22 bp, Artificial Sequence
  chemically synthesized
tggtctctaaagcgttatgctc

SEQ ID NO: 890204 - DNA, 22 bp, Artificial Sequence
  chemically synthesized
taaagcgttatgctccctgcca

SEQ ID NO: 890205 - DNA, 22 bp, Artificial Sequence
  chemically synthesized
aagcgttatgctccctgccact

SEQ ID NO: 890206 - DNA, 22 bp, Artificial Sequence
  chemically synthesized
cagagcccccagtagtggcagg

SEQ ID NO: 890207 - DNA, 22 bp, Artificial Sequence
  chemically synthesized
ccagagcccccagtagtggcag

SEQ ID NO: 890208 - DNA, 22 bp, Artificial Sequence
  chemically synthesized
tccagagcccccagtagtggca

SEQ ID NO: 890209 - DNA, 22 bp, Artificial Sequence
  chemically synthesized
tgctccctgccactactggggg

SEQ ID NO: 890210 - DNA, 22 bp, Artificial Sequence
  chemically synthesized
agttttccagagcccccagtag

SEQ ID NO: 890211 - DNA, 22 bp, Artificial Sequence
  chemically synthesized
gagttttccagagcccccagta

SEQ ID NO: 890212 - DNA, 22 bp, Artificial Sequence
  chemically synthesized
cctgccactactgggggctctg

SEQ ID NO: 890213 - DNA, 22 bp, Artificial Sequence
  chemically synthesized
gggtttgagttttccagagccc

SEQ ID NO: 890214 - DNA, 22 bp, Artificial Sequence
  chemically synthesized
ccactactgggggctctggaaa

SEQ ID NO: 890215 - DNA, 22 bp, Artificial Sequence
  chemically synthesized
tggggtttgagttttccagagc

SEQ ID NO: 890216 - DNA, 22 bp, Artificial Sequence
  chemically synthesized
ctggggtttgagttttccagag

SEQ ID NO: 890217 - DNA, 22 bp, Artificial Sequence
  chemically synthesized
cttctggggtttgagttttcca

SEQ ID NO: 890218 - DNA, 22 bp, Artificial Sequence
  chemically synthesized
ctgggggctctggaaaactcaa

SEQ ID NO: 890219 - DNA, 22 bp, Artificial Sequence
  chemically synthesized
ggggctctggaaaactcaaacc

SEQ ID NO: 890220 - DNA, 22 bp, Artificial Sequence
  chemically synthesized
aggtggttgcttctggggtttg

SEQ ID NO: 890221 - DNA, 22 bp, Artificial Sequence
  chemically synthesized
tggaaaactcaaaccccagaag

SEQ ID NO: 890222 - DNA, 22 bp, Artificial Sequence
  chemically synthesized
gaaaactcaaaccccagaagca

SEQ ID NO: 890223 - DNA, 22 bp, Artificial Sequence
  chemically synthesized
aacctcaggtggttgcttctgg

SEQ ID NO: 890224 - DNA, 22 bp, Artificial Sequence
  chemically synthesized
caacctcaggtggttgcttctg

SEQ ID NO: 890225 - DNA, 22 bp, Artificial Sequence
  chemically synthesized
tcaacctcaggtggttgcttct

SEQ ID NO: 890226 - DNA, 22 bp, Artificial Sequence
  chemically synthesized
ttcaacctcaggtggttgcttc

SEQ ID NO: 890227 - DNA, 22 bp, Artificial Sequence
  chemically synthesized
tttcaacctcaggtggttgctt

SEQ ID NO: 890228 - DNA, 22 bp, Artificial Sequence
  chemically synthesized
aaaccccagaagcaaccacctg

SEQ ID NO: 890229 - DNA, 22 bp, Artificial Sequence
  chemically synthesized
gctttttcaacctcaggtggtt

SEQ ID NO: 890230 - DNA, 22 bp, Artificial Sequence
  chemically synthesized
caattagctttttcaacctcag

SEQ ID NO: 890231 - DNA, 22 bp, Artificial Sequence
  chemically synthesized
ccaattagctttttcaacctca

SEQ ID NO: 890232 - DNA, 22 bp, Artificial Sequence
  chemically synthesized
tttccaattagctttttcaacc

SEQ ID NO: 890233 - DNA, 22 bp, Artificial Sequence
  chemically synthesized
aggttgaaaaagctaattggaa

SEQ ID NO: 890234 - DNA, 22 bp, Artificial Sequence
  chemically synthesized
aaaaagctaattggaaacagac

SEQ ID NO: 890235 - DNA, 22 bp, Artificial Sequence
  chemically synthesized
aacgtacacggtatccagtctg

SEQ ID NO: 890236 - DNA, 22 bp, Artificial Sequence
  chemically synthesized
attggaaacagactggataccg

SEQ ID NO: 890237 - DNA, 22 bp, Artificial Sequence
  chemically synthesized
gaaacagactggataccgtgta

SEQ ID NO: 890238 - DNA, 22 bp, Artificial Sequence
  chemically synthesized
caaatcccatctgaacgtacac

SEQ ID NO: 890239 - DNA, 22 bp, Artificial Sequence
  chemically synthesized
gataccgtgtacgttcagatgg

SEQ ID NO: 890240 - DNA, 22 bp, Artificial Sequence
  chemically synthesized
ggtatctccaaatcccatctga

SEQ ID NO: 890241 - DNA, 22 bp, Artificial Sequence
  chemically synthesized
gtggccatctgggtatctccaa

SEQ ID NO: 890242 - DNA, 22 bp, Artificial Sequence
  chemically synthesized
agatgggatttggagataccca

SEQ ID NO: 890243 - DNA, 22 bp, Artificial Sequence
  chemically synthesized
aggagatacctagtggccatct

SEQ ID NO: 890244 - DNA, 22 bp, Artificial Sequence
  chemically synthesized
ggagatacccagatggccacta

SEQ ID NO: 890245 - DNA, 22 bp, Artificial Sequence
  chemically synthesized
gagatacccagatggccactag

SEQ ID NO: 890246 - DNA, 22 bp, Artificial Sequence
  chemically synthesized
agtaaatgactgaggagatacc

SEQ ID NO: 890247 - DNA, 22 bp, Artificial Sequence
  chemically synthesized
gagtaaatgactgaggagatac

SEQ ID NO: 890248 - DNA, 22 bp, Artificial Sequence
  chemically synthesized
aaatttgagtaaatgactgagg

SEQ ID NO: 890249 - DNA, 22 bp, Artificial Sequence
  chemically synthesized
taaaatttgagtaaatgactga

SEQ ID NO: 890250 - DNA, 22 bp, Artificial Sequence
  chemically synthesized
ggtatctcctcagtcatttact

SEQ ID NO: 890251 - DNA, 22 bp, Artificial Sequence
  chemically synthesized
tgttctaaaatttgagtaaatg

SEQ ID NO: 890252 - DNA, 22 bp, Artificial Sequence
  chemically synthesized
ctcagtcatttactcaaatttt

SEQ ID NO: 890253 - DNA, 22 bp, Artificial Sequence
  chemically synthesized
agtcatttactcaaattttaga

SEQ ID NO: 890254 - DNA, 22 bp, Artificial Sequence
  chemically synthesized
tggaggctgtgttctaaaattt

SEQ ID NO: 890255 - DNA, 22 bp, Artificial Sequence
  chemically synthesized
atggaggctgtgttctaaaatt

SEQ ID NO: 890256 - DNA, 22 bp, Artificial Sequence
  chemically synthesized
actcaaattttagaacacagcc

SEQ ID NO: 890257 - DNA, 22 bp, Artificial Sequence
  chemically synthesized
ctcaaattttagaacacagcct

SEQ ID NO: 890258 - DNA, 22 bp, Artificial Sequence
  chemically synthesized
aaattttagaacacagcctcca

SEQ ID NO: 890259 - DNA, 22 bp, Artificial Sequence
  chemically synthesized
atatgtaatttatggaggctgt

SEQ ID NO: 890260 - DNA, 22 bp, Artificial Sequence
  chemically synthesized
ccctgatatgtaatttatggag

SEQ ID NO: 890261 - DNA, 22 bp, Artificial Sequence
  chemically synthesized
tagaacacagcctccataaatt

SEQ ID NO: 890262 - DNA, 22 bp, Artificial Sequence
  chemically synthesized
gccctgatatgtaatttatgga

SEQ ID NO: 890263 - DNA, 22 bp, Artificial Sequence
  chemically synthesized
agaacacagcctccataaatta

SEQ ID NO: 890264 - DNA, 22 bp, Artificial Sequence
  chemically synthesized
tgccctgatatgtaatttatgg

SEQ ID NO: 890265 - DNA, 22 bp, Artificial Sequence
  chemically synthesized
gaacacagcctccataaattac

SEQ ID NO: 890266 - DNA, 22 bp, Artificial Sequence
  chemically synthesized
ttgccctgatatgtaatttatg

SEQ ID NO: 890267 - DNA, 22 bp, Artificial Sequence
  chemically synthesized
ttttgccctgatatgtaattta

SEQ ID NO: 890268 - DNA, 22 bp, Artificial Sequence
  chemically synthesized
cttttgccctgatatgtaattt

SEQ ID NO: 890269 - DNA, 22 bp, Artificial Sequence
  chemically synthesized
tcttttgccctgatatgtaatt

SEQ ID NO: 890270 - DNA, 22 bp, Artificial Sequence
  chemically synthesized
agattttcttttgccctgatat

SEQ ID NO: 890271 - DNA, 22 bp, Artificial Sequence
  chemically synthesized
aagattttcttttgccctgata

SEQ ID NO: 890272 - DNA, 22 bp, Artificial Sequence
  chemically synthesized
cataaattacatatcagggcaa

SEQ ID NO: 890273 - DNA, 22 bp, Artificial Sequence
  chemically synthesized
taagattttcttttgccctgat

SEQ ID NO: 890274 - DNA, 22 bp, Artificial Sequence
  chemically synthesized
ttaagattttcttttgccctga

SEQ ID NO: 890275 - DNA, 22 bp, Artificial Sequence
  chemically synthesized
catatcagggcaaaagaaaatc

SEQ ID NO: 890276 - DNA, 22 bp, Artificial Sequence
  chemically synthesized
tggaggagccttttaagatttt

SEQ ID NO: 890277 - DNA, 22 bp, Artificial Sequence
  chemically synthesized
gtggaggagccttttaagattt

SEQ ID NO: 890278 - DNA, 22 bp, Artificial Sequence
  chemically synthesized
catcaatatttgtggaggagcc

SEQ ID NO: 890279 - DNA, 22 bp, Artificial Sequence
  chemically synthesized
acatcaatatttgtggaggagc

SEQ ID NO: 890280 - DNA, 22 bp, Artificial Sequence
  chemically synthesized
aaaaggctcctccacaaatatt

SEQ ID NO: 890281 - DNA, 22 bp, Artificial Sequence
  chemically synthesized
aaagtttacatcaatatttgtg

SEQ ID NO: 890282 - DNA, 22 bp, Artificial Sequence
  chemically synthesized
aaaggctcctccacaaatattg

SEQ ID NO: 890283 - DNA, 22 bp, Artificial Sequence
  chemically synthesized
ctccacaaatattgatgtaaac

SEQ ID NO: 890284 - DNA, 22 bp, Artificial Sequence
  chemically synthesized
cacaaatattgatgtaaacttt

SEQ ID NO: 890285 - DNA, 22 bp, Artificial Sequence
  chemically synthesized
aatatgagggctaaaagtttac

SEQ ID NO: 890286 - DNA, 22 bp, Artificial Sequence
  chemically synthesized
ctcaatatgagggctaaaagtt

SEQ ID NO: 890287 - DNA, 22 bp, Artificial Sequence
  chemically synthesized
acctactcaatatgagggctaa

SEQ ID NO: 890288 - DNA, 22 bp, Artificial Sequence
  chemically synthesized
atgtaaacttttagccctcata

SEQ ID NO: 890289 - DNA, 22 bp, Artificial Sequence
  chemically synthesized
aattcacctactcaatatgagg

SEQ ID NO: 890290 - DNA, 22 bp, Artificial Sequence
  chemically synthesized
ttagccctcatattgagtaggt

SEQ ID NO: 890291 - DNA, 22 bp, Artificial Sequence
  chemically synthesized
tagccctcatattgagtaggtg

SEQ ID NO: 890292 - DNA, 22 bp, Artificial Sequence
  chemically synthesized
agccctcatattgagtaggtga

SEQ ID NO: 890293 - DNA, 22 bp, Artificial Sequence
  chemically synthesized
gccctcatattgagtaggtgaa

SEQ ID NO: 890294 - DNA, 22 bp, Artificial Sequence
  chemically synthesized
tgaatacaagttaaattcacct

SEQ ID NO: 890295 - DNA, 22 bp, Artificial Sequence
  chemically synthesized
atgaatacaagttaaattcacc

SEQ ID NO: 890296 - DNA, 22 bp, Artificial Sequence
  chemically synthesized
atattgagtaggtgaatttaac

SEQ ID NO: 890297 - DNA, 22 bp, Artificial Sequence
  chemically synthesized
agtaggtgaatttaacttgtat

SEQ ID NO: 890298 - DNA, 22 bp, Artificial Sequence
  chemically synthesized
gcaaagcttatgaatacaagtt

SEQ ID NO: 890299 - DNA, 22 bp, Artificial Sequence
  chemically synthesized
atagccaactagcaaagcttat

SEQ ID NO: 890300 - DNA, 22 bp, Artificial Sequence
  chemically synthesized
aacttgtattcataagctttgc

SEQ ID NO: 890301 - DNA, 22 bp, Artificial Sequence
  chemically synthesized
catagccaactagcaaagctta

SEQ ID NO: 890302 - DNA, 22 bp, Artificial Sequence
  chemically synthesized
acttgtattcataagctttgct

SEQ ID NO: 890303 - DNA, 22 bp, Artificial Sequence
  chemically synthesized
gtattcataagctttgctagtt

SEQ ID NO: 890304 - DNA, 22 bp, Artificial Sequence
  chemically synthesized
tattcataagctttgctagttg

SEQ ID NO: 890305 - DNA, 22 bp, Artificial Sequence
  chemically synthesized
ataagctttgctagttggctat

SEQ ID NO: 890306 - DNA, 22 bp, Artificial Sequence
  chemically synthesized
tcatataccagtatttcatagc

SEQ ID NO: 890307 - DNA, 22 bp, Artificial Sequence
  chemically synthesized
gtcatataccagtatttcatag

SEQ ID NO: 890308 - DNA, 22 bp, Artificial Sequence
  chemically synthesized
tgctagttggctatgaaatact

SEQ ID NO: 890309 - DNA, 22 bp, Artificial Sequence
  chemically synthesized
gctagttggctatgaaatactg

SEQ ID NO: 890310 - DNA, 22 bp, Artificial Sequence
  chemically synthesized
tttgtcatataccagtatttca

SEQ ID NO: 890311 - DNA, 22 bp, Artificial Sequence
  chemically synthesized
ctagttggctatgaaatactgg

SEQ ID NO: 890312 - DNA, 22 bp, Artificial Sequence
  chemically synthesized
gttggctatgaaatactggtat

SEQ ID NO: 890313 - DNA, 22 bp, Artificial Sequence
  chemically synthesized
gctatgaaatactggtatatga

SEQ ID NO: 890314 - DNA, 22 bp, Artificial Sequence
  chemically synthesized
agtgtgaactgtttgtcatata

SEQ ID NO: 890315 - DNA, 22 bp, Artificial Sequence
  chemically synthesized
tgaaatactggtatatgacaaa

SEQ ID NO: 890316 - DNA, 22 bp, Artificial Sequence
  chemically synthesized
gctaagtgtgaactgtttgtca

SEQ ID NO: 890317 - DNA, 22 bp, Artificial Sequence
  chemically synthesized
gtatatgacaaacagttcacac

SEQ ID NO: 890318 - DNA, 22 bp, Artificial Sequence
  chemically synthesized
ggaattagctaagtgtgaactg

SEQ ID NO: 890319 - DNA, 22 bp, Artificial Sequence
  chemically synthesized
tagagaaaactaggaattagct

SEQ ID NO: 890320 - DNA, 22 bp, Artificial Sequence
  chemically synthesized
atagagaaaactaggaattagc

SEQ ID NO: 890321 - DNA, 22 bp, Artificial Sequence
  chemically synthesized
tatagagaaaactaggaattag

SEQ ID NO: 890322 - DNA, 22 bp, Artificial Sequence
  chemically synthesized
ttttatagagaaaactaggaat

SEQ ID NO: 890323 - DNA, 22 bp, Artificial Sequence
  chemically synthesized
acacttagctaattcctagttt

SEQ ID NO: 890324 - DNA, 22 bp, Artificial Sequence
  chemically synthesized
attttatagagaaaactaggaa

SEQ ID NO: 890325 - DNA, 22 bp, Artificial Sequence
  chemically synthesized
agctaattcctagttttctcta

SEQ ID NO: 890326 - DNA, 22 bp, Artificial Sequence
  chemically synthesized
gctaattcctagttttctctat

SEQ ID NO: 890327 - DNA, 22 bp, Artificial Sequence
  chemically synthesized
gtaagtcttattttatagagaa

SEQ ID NO: 890328 - DNA, 22 bp, Artificial Sequence
  chemically synthesized
attcctagttttctctataaaa

SEQ ID NO: 890329 - DNA, 22 bp, Artificial Sequence
  chemically synthesized
ctagttttctctataaaataag

SEQ ID NO: 890330 - DNA, 22 bp, Artificial Sequence
  chemically synthesized
accattagtaagtcttatttta

SEQ ID NO: 890331 - DNA, 22 bp, Artificial Sequence
  chemically synthesized
aaccattagtaagtcttatttt

SEQ ID NO: 890332 - DNA, 22 bp, Artificial Sequence
  chemically synthesized
gttttctctataaaataagact

SEQ ID NO: 890333 - DNA, 22 bp, Artificial Sequence
  chemically synthesized
taaccattagtaagtcttattt

SEQ ID NO: 890334 - DNA, 22 bp, Artificial Sequence
  chemically synthesized
ttaaccattagtaagtcttatt

SEQ ID NO: 890335 - DNA, 22 bp, Artificial Sequence
  chemically synthesized
tctctataaaataagacttact

SEQ ID NO: 890336 - DNA, 22 bp, Artificial Sequence
  chemically synthesized
ctctataaaataagacttacta

SEQ ID NO: 890337 - DNA, 22 bp, Artificial Sequence
  chemically synthesized
tctataaaataagacttactaa

SEQ ID NO: 890338 - DNA, 22 bp, Artificial Sequence
  chemically synthesized
tatttttaaccattagtaagtc

SEQ ID NO: 890339 - DNA, 22 bp, Artificial Sequence
  chemically synthesized
tataaaataagacttactaatg

SEQ ID NO: 890340 - DNA, 22 bp, Artificial Sequence
  chemically synthesized
taaaataagacttactaatggt

SEQ ID NO: 890341 - DNA, 22 bp, Artificial Sequence
  chemically synthesized
attatatttttaaccattagta

SEQ ID NO: 890342 - DNA, 22 bp, Artificial Sequence
  chemically synthesized
catatattgattatatttttaa

SEQ ID NO: 890343 - DNA, 22 bp, Artificial Sequence
  chemically synthesized
acatatattgattatattttta

SEQ ID NO: 890344 - DNA, 22 bp, Artificial Sequence
  chemically synthesized
actaatggttaaaaatataatc

SEQ ID NO: 890345 - DNA, 22 bp, Artificial Sequence
  chemically synthesized
tttacatatattgattatattt

SEQ ID NO: 890346 - DNA, 22 bp, Artificial Sequence
  chemically synthesized
ctaatggttaaaaatataatca

SEQ ID NO: 890347 - DNA, 22 bp, Artificial Sequence
  chemically synthesized
atttacatatattgattatatt

SEQ ID NO: 890348 - DNA, 22 bp, Artificial Sequence
  chemically synthesized
tatttacatatattgattatat

SEQ ID NO: 890349 - DNA, 22 bp, Artificial Sequence
  chemically synthesized
atggttaaaaatataatcaata

SEQ ID NO: 890350 - DNA, 22 bp, Artificial Sequence
  chemically synthesized
gaagttttatttacatatattg

SEQ ID NO: 890351 - DNA, 22 bp, Artificial Sequence
  chemically synthesized
aaaatataatcaatatatgtaa

SEQ ID NO: 890352 - DNA, 22 bp, Artificial Sequence
  chemically synthesized
tggaagttttatttacatatat

SEQ ID NO: 890353 - DNA, 22 bp, Artificial Sequence
  chemically synthesized
ctggaagttttatttacatata

SEQ ID NO: 890354 - DNA, 22 bp, Artificial Sequence
  chemically synthesized
atgtttctggaagttttattta

SEQ ID NO: 890355 - DNA, 22 bp, Artificial Sequence
  chemically synthesized
cccctaatgtttctggaagttt

SEQ ID NO: 890356 - DNA, 22 bp, Artificial Sequence
  chemically synthesized
acccctaatgtttctggaagtt

SEQ ID NO: 890357 - DNA, 22 bp, Artificial Sequence
  chemically synthesized
tacccctaatgtttctggaagt

SEQ ID NO: 890358 - DNA, 22 bp, Artificial Sequence
  chemically synthesized
cctttacccctaatgtttctgg

SEQ ID NO: 890359 - DNA, 22 bp, Artificial Sequence
  chemically synthesized
ccctttacccctaatgtttctg

SEQ ID NO: 890360 - DNA, 22 bp, Artificial Sequence
  chemically synthesized
tttccctttacccctaatgttt

SEQ ID NO: 890361 - DNA, 22 bp, Artificial Sequence
  chemically synthesized
ccagaaacattaggggtaaagg

SEQ ID NO: 890362 - DNA, 22 bp, Artificial Sequence
  chemically synthesized
cagaaacattaggggtaaaggg

SEQ ID NO: 890363 - DNA, 22 bp, Artificial Sequence
  chemically synthesized
catacaaagttgtttcccttta

SEQ ID NO: 890364 - DNA, 22 bp, Artificial Sequence
  chemically synthesized
gcatacaaagttgtttcccttt

SEQ ID NO: 890365 - DNA, 22 bp, Artificial Sequence
  chemically synthesized
tgcatacaaagttgtttccctt

SEQ ID NO: 890366 - DNA, 22 bp, Artificial Sequence
  chemically synthesized
ggggtaaagggaaacaactttg

SEQ ID NO: 890367 - DNA, 22 bp, Artificial Sequence
  chemically synthesized
tatattttgcatacaaagttgt

SEQ ID NO: 890368 - DNA, 22 bp, Artificial Sequence
  chemically synthesized
gtatattttgcatacaaagttg

SEQ ID NO: 890369 - DNA, 22 bp, Artificial Sequence
  chemically synthesized
tgtatgcaaaatatacaaggta

SEQ ID NO: 890370 - DNA, 22 bp, Artificial Sequence
  chemically synthesized
gtatgcaaaatatacaaggtat

SEQ ID NO: 890371 - DNA, 22 bp, Artificial Sequence
  chemically synthesized
tatgcaaaatatacaaggtatg

SEQ ID NO: 890372 - DNA, 22 bp, Artificial Sequence
  chemically synthesized
acaaaaacacatccaacatacc

SEQ ID NO: 890373 - DNA, 22 bp, Artificial Sequence
  chemically synthesized
aacaaaaacacatccaacatac

SEQ ID NO: 890374 - DNA, 22 bp, Artificial Sequence
  chemically synthesized
cttaacaaaaacacatccaaca

SEQ ID NO: 890375 - DNA, 22 bp, Artificial Sequence
  chemically synthesized
ccttaacaaaaacacatccaac

SEQ ID NO: 890376 - DNA, 22 bp, Artificial Sequence
  chemically synthesized
tccttaacaaaaacacatccaa

SEQ ID NO: 890377 - DNA, 22 bp, Artificial Sequence
  chemically synthesized
ttccttaacaaaaacacatcca

SEQ ID NO: 890378 - DNA, 22 bp, Artificial Sequence
  chemically synthesized
tttccttaacaaaaacacatcc

SEQ ID NO: 890379 - DNA, 22 bp, Artificial Sequence
  chemically synthesized
tttttccttaacaaaaacacat

SEQ ID NO: 890380 - DNA, 22 bp, Artificial Sequence
  chemically synthesized
tctttttccttaacaaaaacac

SEQ ID NO: 890381 - DNA, 22 bp, Artificial Sequence
  chemically synthesized
ttctctttttccttaacaaaaa

SEQ ID NO: 890382 - DNA, 22 bp, Artificial Sequence
  chemically synthesized
gatgtgtttttgttaaggaaaa

SEQ ID NO: 890383 - DNA, 22 bp, Artificial Sequence
  chemically synthesized
ggacaaagttattctctttttc

SEQ ID NO: 890384 - DNA, 22 bp, Artificial Sequence
  chemically synthesized
aggacaaagttattctcttttt

SEQ ID NO: 890385 - DNA, 22 bp, Artificial Sequence
  chemically synthesized
ttgttaaggaaaaagagaataa

SEQ ID NO: 890386 - DNA, 22 bp, Artificial Sequence
  chemically synthesized
tgttaaggaaaaagagaataac

SEQ ID NO: 890387 - DNA, 22 bp, Artificial Sequence
  chemically synthesized
atttaggacaaagttattctct

SEQ ID NO: 890388 - DNA, 22 bp, Artificial Sequence
  chemically synthesized
gttaaggaaaaagagaataact

SEQ ID NO: 890389 - DNA, 22 bp, Artificial Sequence
  chemically synthesized
aatttaggacaaagttattctc

SEQ ID NO: 890390 - DNA, 22 bp, Artificial Sequence
  chemically synthesized
ttaaggaaaaagagaataactt

SEQ ID NO: 890391 - DNA, 22 bp, Artificial Sequence
  chemically synthesized
taatttaggacaaagttattct

SEQ ID NO: 890392 - DNA, 22 bp, Artificial Sequence
  chemically synthesized
aggaaaaagagaataactttgt

SEQ ID NO: 890393 - DNA, 22 bp, Artificial Sequence
  chemically synthesized
acagtcattttaatttaggaca

SEQ ID NO: 890394 - DNA, 22 bp, Artificial Sequence
  chemically synthesized
cacagtcattttaatttaggac

SEQ ID NO: 890395 - DNA, 22 bp, Artificial Sequence
  chemically synthesized
tcacagtcattttaatttagga

SEQ ID NO: 890396 - DNA, 22 bp, Artificial Sequence
  chemically synthesized
attttcacagtcattttaattt

SEQ ID NO: 890397 - DNA, 22 bp, Artificial Sequence
  chemically synthesized
ctcattttcacagtcattttaa

SEQ ID NO: 890398 - DNA, 22 bp, Artificial Sequence
  chemically synthesized
cctcattttcacagtcatttta

SEQ ID NO: 890399 - DNA, 22 bp, Artificial Sequence
  chemically synthesized
tgtcctaaattaaaatgactgt

SEQ ID NO: 890400 - DNA, 22 bp, Artificial Sequence
  chemically synthesized
ttcctcattttcacagtcattt

SEQ ID NO: 890401 - DNA, 22 bp, Artificial Sequence
  chemically synthesized
gtcctaaattaaaatgactgtg

SEQ ID NO: 890402 - DNA, 22 bp, Artificial Sequence
  chemically synthesized
tcctaaattaaaatgactgtga

SEQ ID NO: 890403 - DNA, 22 bp, Artificial Sequence
  chemically synthesized
ctcttcctcattttcacagtca

SEQ ID NO: 890404 - DNA, 22 bp, Artificial Sequence
  chemically synthesized
cctcttcctcattttcacagtc

SEQ ID NO: 890405 - DNA, 22 bp, Artificial Sequence
  chemically synthesized
aattaaaatgactgtgaaaatg

SEQ ID NO: 890406 - DNA, 22 bp, Artificial Sequence
  chemically synthesized
taccttcctcttcctcattttc

SEQ ID NO: 890407 - DNA, 22 bp, Artificial Sequence
  chemically synthesized
aaatgactgtgaaaatgaggaa

SEQ ID NO: 890408 - DNA, 22 bp, Artificial Sequence
  chemically synthesized
tcctataccttcctcttcctca

SEQ ID NO: 890409 - DNA, 22 bp, Artificial Sequence
  chemically synthesized
gtcctataccttcctcttcctc

SEQ ID NO: 890410 - DNA, 22 bp, Artificial Sequence
  chemically synthesized
tgtcctataccttcctcttcct

SEQ ID NO: 890411 - DNA, 22 bp, Artificial Sequence
  chemically synthesized
tgaaaatgaggaagaggaaggt

SEQ ID NO: 890412 - DNA, 22 bp, Artificial Sequence
  chemically synthesized
agattttgtcctataccttcct

SEQ ID NO: 890413 - DNA, 22 bp, Artificial Sequence
  chemically synthesized
attcagattttgtcctatacct

SEQ ID NO: 890414 - DNA, 22 bp, Artificial Sequence
  chemically synthesized
caatgttcattcagattttgtc

SEQ ID NO: 890415 - DNA, 22 bp, Artificial Sequence
  chemically synthesized
ccaatgttcattcagattttgt

SEQ ID NO: 890416 - DNA, 22 bp, Artificial Sequence
  chemically synthesized
ccatttccaatgttcattcaga

SEQ ID NO: 890417 - DNA, 22 bp, Artificial Sequence
  chemically synthesized
tgccatttccaatgttcattca

SEQ ID NO: 890418 - DNA, 22 bp, Artificial Sequence
  chemically synthesized
ctgccatttccaatgttcattc

SEQ ID NO: 890419 - DNA, 22 bp, Artificial Sequence
  chemically synthesized
cacaaatcttctgccatttcca

SEQ ID NO: 890420 - DNA, 22 bp, Artificial Sequence
  chemically synthesized
ccacaaatcttctgccatttcc

SEQ ID NO: 890421 - DNA, 22 bp, Artificial Sequence
  chemically synthesized
aatgaacattggaaatggcaga

SEQ ID NO: 890422 - DNA, 22 bp, Artificial Sequence
  chemically synthesized
cttccacaaatcttctgccatt

SEQ ID NO: 890423 - DNA, 22 bp, Artificial Sequence
  chemically synthesized
tccttccacaaatcttctgcca

SEQ ID NO: 890424 - DNA, 22 bp, Artificial Sequence
  chemically synthesized
gaaatggcagaagatttgtgga

SEQ ID NO: 890425 - DNA, 22 bp, Artificial Sequence
  chemically synthesized
acataagactctccttccacaa

SEQ ID NO: 890426 - DNA, 22 bp, Artificial Sequence
  chemically synthesized
ttaacataagactctccttcca

SEQ ID NO: 890427 - DNA, 22 bp, Artificial Sequence
  chemically synthesized
gctattaacataagactctcct

SEQ ID NO: 890428 - DNA, 22 bp, Artificial Sequence
  chemically synthesized
gtggaaggagagtcttatgtta

SEQ ID NO: 890429 - DNA, 22 bp, Artificial Sequence
  chemically synthesized
tggaaggagagtcttatgttaa

SEQ ID NO: 890430 - DNA, 22 bp, Artificial Sequence
  chemically synthesized
gccagcattggctattaacata

SEQ ID NO: 890431 - DNA, 22 bp, Artificial Sequence
  chemically synthesized
agccagcattggctattaacat

SEQ ID NO: 890432 - DNA, 22 bp, Artificial Sequence
  chemically synthesized
tagccagcattggctattaaca

SEQ ID NO: 890433 - DNA, 22 bp, Artificial Sequence
  chemically synthesized
cgttttagccagcattggctat

SEQ ID NO: 890434 - DNA, 22 bp, Artificial Sequence
  chemically synthesized
atgttaatagccaatgctggct

SEQ ID NO: 890435 - DNA, 22 bp, Artificial Sequence
  chemically synthesized
tgttaatagccaatgctggcta

SEQ ID NO: 890436 - DNA, 22 bp, Artificial Sequence
  chemically synthesized
atagccaatgctggctaaaacg

SEQ ID NO: 890437 - DNA, 22 bp, Artificial Sequence
  chemically synthesized
catacacataaatccattccgt

SEQ ID NO: 890438 - DNA, 22 bp, Artificial Sequence
  chemically synthesized
acatacacataaatccattccg

SEQ ID NO: 890439 - DNA, 22 bp, Artificial Sequence
  chemically synthesized
gctaaaacggaatggatttatg

SEQ ID NO: 890440 - DNA, 22 bp, Artificial Sequence
  chemically synthesized
aaacggaatggatttatgtgta

SEQ ID NO: 890441 - DNA, 22 bp, Artificial Sequence
  chemically synthesized
taagagtttacatacacataaa

SEQ ID NO: 890442 - DNA, 22 bp, Artificial Sequence
  chemically synthesized
gtaagagtttacatacacataa

SEQ ID NO: 890443 - DNA, 22 bp, Artificial Sequence
  chemically synthesized
agggtcatttgtaagagtttac

SEQ ID NO: 890444 - DNA, 22 bp, Artificial Sequence
  chemically synthesized
atgtgtatgtaaactcttacaa

SEQ ID NO: 890445 - DNA, 22 bp, Artificial Sequence
  chemically synthesized
tgtgtatgtaaactcttacaaa

SEQ ID NO: 890446 - DNA, 22 bp, Artificial Sequence
  chemically synthesized
atactaagggtcatttgtaaga

SEQ ID NO: 890447 - DNA, 22 bp, Artificial Sequence
  chemically synthesized
ttgatactaagggtcatttgta

SEQ ID NO: 890448 - DNA, 22 bp, Artificial Sequence
  chemically synthesized
ttacaaatgacccttagtatca

SEQ ID NO: 890449 - DNA, 22 bp, Artificial Sequence
  chemically synthesized
atcaatacactgttgatactaa

SEQ ID NO: 890450 - DNA, 22 bp, Artificial Sequence
  chemically synthesized
acaaatgacccttagtatcaac

SEQ ID NO: 890451 - DNA, 22 bp, Artificial Sequence
  chemically synthesized
gatcaatacactgttgatacta

SEQ ID NO: 890452 - DNA, 22 bp, Artificial Sequence
  chemically synthesized
caaatgacccttagtatcaaca

SEQ ID NO: 890453 - DNA, 22 bp, Artificial Sequence
  chemically synthesized
tgatcaatacactgttgatact

SEQ ID NO: 890454 - DNA, 22 bp, Artificial Sequence
  chemically synthesized
ttgatcaatacactgttgatac

SEQ ID NO: 890455 - DNA, 22 bp, Artificial Sequence
  chemically synthesized
atttttgatcaatacactgttg

SEQ ID NO: 890456 - DNA, 22 bp, Artificial Sequence
  chemically synthesized
caactcatttttgatcaataca

SEQ ID NO: 890457 - DNA, 22 bp, Artificial Sequence
  chemically synthesized
agtatcaacagtgtattgatca

SEQ ID NO: 890458 - DNA, 22 bp, Artificial Sequence
  chemically synthesized
gtatcaacagtgtattgatcaa

SEQ ID NO: 890459 - DNA, 22 bp, Artificial Sequence
  chemically synthesized
acaaaaagaaactacaactcat

SEQ ID NO: 890460 - DNA, 22 bp, Artificial Sequence
  chemically synthesized
aacaaaaagaaactacaactca

SEQ ID NO: 890461 - DNA, 22 bp, Artificial Sequence
  chemically synthesized
taacaaaaagaaactacaactc

SEQ ID NO: 890462 - DNA, 22 bp, Artificial Sequence
  chemically synthesized
ttaacaaaaagaaactacaact

SEQ ID NO: 890463 - DNA, 22 bp, Artificial Sequence
  chemically synthesized
tttaacaaaaagaaactacaac

SEQ ID NO: 890464 - DNA, 22 bp, Artificial Sequence
  chemically synthesized
atcaaaaatgagttgtagtttc

SEQ ID NO: 890465 - DNA, 22 bp, Artificial Sequence
  chemically synthesized
tcattttttaacaaaaagaaac

SEQ ID NO: 890466 - DNA, 22 bp, Artificial Sequence
  chemically synthesized
atcattttttaacaaaaagaaa

SEQ ID NO: 890467 - DNA, 22 bp, Artificial Sequence
  chemically synthesized
tatcattttttaacaaaaagaa

SEQ ID NO: 890468 - DNA, 22 bp, Artificial Sequence
  chemically synthesized
tagtttctttttgttaaaaaat

SEQ ID NO: 890469 - DNA, 22 bp, Artificial Sequence
  chemically synthesized
ctttttgttaaaaaatgataaa

SEQ ID NO: 890470 - DNA, 22 bp, Artificial Sequence
  chemically synthesized
tttttgttaaaaaatgataaaa

SEQ ID NO: 890471 - DNA, 22 bp, Artificial Sequence
  chemically synthesized
tttgttaaaaaatgataaaata

SEQ ID NO: 890472 - DNA, 22 bp, Artificial Sequence
  chemically synthesized
ttgttaaaaaatgataaaatat

SEQ ID NO: 890473 - DNA, 22 bp, Artificial Sequence
  chemically synthesized
tgttaaaaaatgataaaatatt

SEQ ID NO: 890474 - DNA, 22 bp, Artificial Sequence
  chemically synthesized
gttaaaaaatgataaaatattc

SEQ ID NO: 890475 - DNA, 22 bp, Artificial Sequence
  chemically synthesized
ttaaaaaatgataaaatattct

SEQ ID NO: 890476 - DNA, 22 bp, Artificial Sequence
  chemically synthesized
aaaaatgataaaatattcttgg

SEQ ID NO: 890477 - DNA, 22 bp, Artificial Sequence
  chemically synthesized
aaaagagcagaccaataatcca

SEQ ID NO: 890478 - DNA, 22 bp, Artificial Sequence
  chemically synthesized
caaaagagcagaccaataatcc

SEQ ID NO: 890479 - DNA, 22 bp, Artificial Sequence
  chemically synthesized
tttcaaaagagcagaccaataa

SEQ ID NO: 890480 - DNA, 22 bp, Artificial Sequence
  chemically synthesized
atttcaaaagagcagaccaata

SEQ ID NO: 890481 - DNA, 22 bp, Artificial Sequence
  chemically synthesized
tatttcaaaagagcagaccaat

SEQ ID NO: 890482 - DNA, 22 bp, Artificial Sequence
  chemically synthesized
ttggattattggtctgctcttt

SEQ ID NO: 890483 - DNA, 22 bp, Artificial Sequence
  chemically synthesized
aattttatttcaaaagagcaga

SEQ ID NO: 890484 - DNA, 22 bp, Artificial Sequence
  chemically synthesized
ggattattggtctgctcttttg

SEQ ID NO: 890485 - DNA, 22 bp, Artificial Sequence
  chemically synthesized
gattattggtctgctcttttga

SEQ ID NO: 890486 - DNA, 22 bp, Artificial Sequence
  chemically synthesized
ttggtctgctcttttgaaataa

SEQ ID NO: 890487 - DNA, 22 bp, Artificial Sequence
  chemically synthesized
agtatattcaattttatttcaa

SEQ ID NO: 890488 - DNA, 22 bp, Artificial Sequence
  chemically synthesized
aagtatattcaattttatttca

SEQ ID NO: 890489 - DNA, 22 bp, Artificial Sequence
  chemically synthesized
gtctgctcttttgaaataaaat

SEQ ID NO: 890490 - DNA, 22 bp, Artificial Sequence
  chemically synthesized
ctcttttgaaataaaattgaat

SEQ ID NO: 890491 - DNA, 22 bp, Artificial Sequence
  chemically synthesized
catacttaagtatattcaattt

SEQ ID NO: 890492 - DNA, 22 bp, Artificial Sequence
  chemically synthesized
ttttgaaataaaattgaatata

SEQ ID NO: 890493 - DNA, 22 bp, Artificial Sequence
  chemically synthesized
ttgaaataaaattgaatatact

SEQ ID NO: 890494 - DNA, 22 bp, Artificial Sequence
  chemically synthesized
tgaaataaaattgaatatactt

SEQ ID NO: 890495 - DNA, 22 bp, Artificial Sequence
  chemically synthesized
gaaataaaattgaatatactta

SEQ ID NO: 890496 - DNA, 22 bp, Artificial Sequence
  chemically synthesized
aaataaaattgaatatacttaa

SEQ ID NO: 890497 - DNA, 22 bp, Artificial Sequence
  chemically synthesized
aatatacttaagtatgcaacat

SEQ ID NO: 890498 - DNA, 22 bp, Artificial Sequence
  chemically synthesized
aagtatgcaacatattttgata

SEQ ID NO: 890499 - DNA, 22 bp, Artificial Sequence
  chemically synthesized
agtatgcaacatattttgatat

SEQ ID NO: 890500 - DNA, 22 bp, Artificial Sequence
  chemically synthesized
tgtgtgcgtatatatatatata

SEQ ID NO: 890501 - DNA, 22 bp, Artificial Sequence
  chemically synthesized
gtgtgtgcgtatatatatatat

SEQ ID NO: 890502 - DNA, 22 bp, Artificial Sequence
  chemically synthesized
tgtgtgtgcgtatatatatata

SEQ ID NO: 890503 - DNA, 22 bp, Artificial Sequence
  chemically synthesized
tgatatatatatatatatatac

SEQ ID NO: 890504 - DNA, 22 bp, Artificial Sequence
  chemically synthesized
gatatatatatatatatatacg

SEQ ID NO: 890505 - DNA, 22 bp, Artificial Sequence
  chemically synthesized
atatatatatatatatatacgc

SEQ ID NO: 890506 - DNA, 22 bp, Artificial Sequence
  chemically synthesized
caattttgtgtgtgcgtatata

SEQ ID NO: 890507 - DNA, 22 bp, Artificial Sequence
  chemically synthesized
gcaattttgtgtgtgcgtatat

SEQ ID NO: 890508 - DNA, 22 bp, Artificial Sequence
  chemically synthesized
tgcaattttgtgtgtgcgtata

SEQ ID NO: 890509 - DNA, 22 bp, Artificial Sequence
  chemically synthesized
ttttgcaattttgtgtgtgcgt

SEQ ID NO: 890510 - DNA, 22 bp, Artificial Sequence
  chemically synthesized
accgaaataattgttttgcaat

SEQ ID NO: 890511 - DNA, 22 bp, Artificial Sequence
  chemically synthesized
gaccgaaataattgttttgcaa

SEQ ID NO: 890512 - DNA, 22 bp, Artificial Sequence
  chemically synthesized
gtttgaccgaaataattgtttt

SEQ ID NO: 890513 - DNA, 22 bp, Artificial Sequence
  chemically synthesized
attagtttgaccgaaataattg

SEQ ID NO: 890514 - DNA, 22 bp, Artificial Sequence
  chemically synthesized
caaaacaattatttcggtcaaa

SEQ ID NO: 890515 - DNA, 22 bp, Artificial Sequence
  chemically synthesized
tttcggtcaaactaattaacat

SEQ ID NO: 890516 - DNA, 22 bp, Artificial Sequence
  chemically synthesized
cggtcaaactaattaacatttt

SEQ ID NO: 890517 - DNA, 22 bp, Artificial Sequence
  chemically synthesized
ggtcaaactaattaacattttc

SEQ ID NO: 890518 - DNA, 22 bp, Artificial Sequence
  chemically synthesized
attaacattttcatcttttcta

SEQ ID NO: 890519 - DNA, 22 bp, Artificial Sequence
  chemically synthesized
agagaagaccaatagaaaagat

SEQ ID NO: 890520 - DNA, 22 bp, Artificial Sequence
  chemically synthesized
ttaagagaagaccaatagaaaa

SEQ ID NO: 890521 - DNA, 22 bp, Artificial Sequence
  chemically synthesized
acattttcatcttttctattgg

SEQ ID NO: 890522 - DNA, 22 bp, Artificial Sequence
  chemically synthesized
attaagagaagaccaatagaaa

SEQ ID NO: 890523 - DNA, 22 bp, Artificial Sequence
  chemically synthesized
ttattaagagaagaccaataga

SEQ ID NO: 890524 - DNA, 22 bp, Artificial Sequence
  chemically synthesized
tcatcttttctattggtcttct

SEQ ID NO: 890525 - DNA, 22 bp, Artificial Sequence
  chemically synthesized
catcttttctattggtcttctc

SEQ ID NO: 890526 - DNA, 22 bp, Artificial Sequence
  chemically synthesized
atcttttctattggtcttctct

SEQ ID NO: 890527 - DNA, 22 bp, Artificial Sequence
  chemically synthesized
caatctcttattaagagaagac

SEQ ID NO: 890528 - DNA, 22 bp, Artificial Sequence
  chemically synthesized
gcaatctcttattaagagaaga

SEQ ID NO: 890529 - DNA, 22 bp, Artificial Sequence
  chemically synthesized
tgcaatctcttattaagagaag

SEQ ID NO: 890530 - DNA, 22 bp, Artificial Sequence
  chemically synthesized
ttctattggtcttctcttaata

SEQ ID NO: 890531 - DNA, 22 bp, Artificial Sequence
  chemically synthesized
tctattggtcttctcttaataa

SEQ ID NO: 890532 - DNA, 22 bp, Artificial Sequence
  chemically synthesized
ctattggtcttctcttaataag

SEQ ID NO: 890533 - DNA, 22 bp, Artificial Sequence
  chemically synthesized
tattggtcttctcttaataaga

SEQ ID NO: 890534 - DNA, 22 bp, Artificial Sequence
  chemically synthesized
ttggtcttctcttaataagaga

SEQ ID NO: 890535 - DNA, 22 bp, Artificial Sequence
  chemically synthesized
gtcttctcttaataagagattg

SEQ ID NO: 890536 - DNA, 22 bp, Artificial Sequence
  chemically synthesized
ctcttaataagagattgcaaaa

SEQ ID NO: 890537 - DNA, 22 bp, Artificial Sequence
  chemically synthesized
tcttaataagagattgcaaaat

SEQ ID NO: 890538 - DNA, 22 bp, Artificial Sequence
  chemically synthesized
ttaataagagattgcaaaattt

SEQ ID NO: 890539 - DNA, 22 bp, Artificial Sequence
  chemically synthesized
aataagagattgcaaaatttgt

SEQ ID NO: 890540 - DNA, 22 bp, Artificial Sequence
  chemically synthesized
ataagagattgcaaaatttgtt

SEQ ID NO: 890541 - DNA, 22 bp, Artificial Sequence
  chemically synthesized
cccaaaatataaaaaaaaaaac

SEQ ID NO: 890542 - DNA, 22 bp, Artificial Sequence
  chemically synthesized
caaaatttgtttttttttttat

SEQ ID NO: 890543 - DNA, 22 bp, Artificial Sequence
  chemically synthesized
tacagattacccaaaatataaa

SEQ ID NO: 890544 - DNA, 22 bp, Artificial Sequence
  chemically synthesized
gtttttttttttatattttggg

SEQ ID NO: 890545 - DNA, 22 bp, Artificial Sequence
  chemically synthesized
ctatacagattacccaaaatat

SEQ ID NO: 890546 - DNA, 22 bp, Artificial Sequence
  chemically synthesized
tttttttttttatattttgggt

SEQ ID NO: 890547 - DNA, 22 bp, Artificial Sequence
  chemically synthesized
cctatacagattacccaaaata

SEQ ID NO: 890548 - DNA, 22 bp, Artificial Sequence
  chemically synthesized
ttttttttatattttgggtaat

SEQ ID NO: 890549 - DNA, 22 bp, Artificial Sequence
  chemically synthesized
tttcctatacagattacccaaa

SEQ ID NO: 890550 - DNA, 22 bp, Artificial Sequence
  chemically synthesized
tttttttatattttgggtaatc

SEQ ID NO: 890551 - DNA, 22 bp, Artificial Sequence
  chemically synthesized
gtttcctatacagattacccaa

SEQ ID NO: 890552 - DNA, 22 bp, Artificial Sequence
  chemically synthesized
ttttttatattttgggtaatct

SEQ ID NO: 890553 - DNA, 22 bp, Artificial Sequence
  chemically synthesized
tttttatattttgggtaatctg

SEQ ID NO: 890554 - DNA, 22 bp, Artificial Sequence
  chemically synthesized
ttttatattttgggtaatctgt

SEQ ID NO: 890555 - DNA, 22 bp, Artificial Sequence
  chemically synthesized
tttatattttgggtaatctgta

SEQ ID NO: 890556 - DNA, 22 bp, Artificial Sequence
  chemically synthesized
ttatattttgggtaatctgtat

SEQ ID NO: 890557 - DNA, 22 bp, Artificial Sequence
  chemically synthesized
tatattttgggtaatctgtata

SEQ ID NO: 890558 - DNA, 22 bp, Artificial Sequence
  chemically synthesized
atattttgggtaatctgtatag

SEQ ID NO: 890559 - DNA, 22 bp, Artificial Sequence
  chemically synthesized
tattttgggtaatctgtatagg

SEQ ID NO: 890560 - DNA, 22 bp, Artificial Sequence
  chemically synthesized
tgggtaatctgtataggaaaca

SEQ ID NO: 890561 - DNA, 22 bp, Artificial Sequence
  chemically synthesized
gggtaatctgtataggaaacaa

SEQ ID NO: 890562 - DNA, 22 bp, Artificial Sequence
  chemically synthesized
ggtaatctgtataggaaacaaa

SEQ ID NO: 890563 - DNA, 22 bp, Artificial Sequence
  chemically synthesized
ataagaaacaatatttgtttcc

SEQ ID NO: 890564 - DNA, 22 bp, Artificial Sequence
  chemically synthesized
tgataagaaacaatatttgttt

SEQ ID NO: 890565 - DNA, 22 bp, Artificial Sequence
  chemically synthesized
ttctgataagaaacaatatttg

SEQ ID NO: 890566 - DNA, 22 bp, Artificial Sequence
  chemically synthesized
attctgataagaaacaatattt

SEQ ID NO: 890567 - DNA, 22 bp, Artificial Sequence
  chemically synthesized
tataggaaacaaatattgtttc

SEQ ID NO: 890568 - DNA, 22 bp, Artificial Sequence
  chemically synthesized
tttcttatcagaataagtacct

SEQ ID NO: 890569 - DNA, 22 bp, Artificial Sequence
  chemically synthesized
cttatcagaataagtacctgtg

SEQ ID NO: 890570 - DNA, 22 bp, Artificial Sequence
  chemically synthesized
ttatcagaataagtacctgtgt

SEQ ID NO: 890571 - DNA, 22 bp, Artificial Sequence
  chemically synthesized
atcagaataagtacctgtgttg

SEQ ID NO: 890572 - DNA, 22 bp, Artificial Sequence
  chemically synthesized
tcagaataagtacctgtgttga

SEQ ID NO: 890573 - DNA, 22 bp, Artificial Sequence
  chemically synthesized
aaggacatacaaaatcaacaca

SEQ ID NO: 890574 - DNA, 22 bp, Artificial Sequence
  chemically synthesized
aaaaaattcaaggacatacaaa

SEQ ID NO: 890575 - DNA, 22 bp, Artificial Sequence
  chemically synthesized
taaaaaaattcaaggacataca

SEQ ID NO: 890576 - DNA, 22 bp, Artificial Sequence
  chemically synthesized
ctaaaaaaattcaaggacatac

SEQ ID NO: 890577 - DNA, 22 bp, Artificial Sequence
  chemically synthesized
tctaaaaaaattcaaggacata

SEQ ID NO: 890578 - DNA, 22 bp, Artificial Sequence
  chemically synthesized
tgttgattttgtatgtccttga

SEQ ID NO: 890579 - DNA, 22 bp, Artificial Sequence
  chemically synthesized
ctttctaaaaaaattcaaggac

SEQ ID NO: 890580 - DNA, 22 bp, Artificial Sequence
  chemically synthesized
attttgtatgtccttgaatttt

SEQ ID NO: 890581 - DNA, 22 bp, Artificial Sequence
  chemically synthesized
tgtatgtccttgaattttttta

SEQ ID NO: 890582 - DNA, 22 bp, Artificial Sequence
  chemically synthesized
gtatgtccttgaatttttttag

SEQ ID NO: 890583 - DNA, 22 bp, Artificial Sequence
  chemically synthesized
tatgtccttgaatttttttaga

SEQ ID NO: 890584 - DNA, 22 bp, Artificial Sequence
  chemically synthesized
caaagagaaaacactactttct

SEQ ID NO: 890585 - DNA, 22 bp, Artificial Sequence
  chemically synthesized
ccaaagagaaaacactactttc

SEQ ID NO: 890586 - DNA, 22 bp, Artificial Sequence
  chemically synthesized
gaatttttttagaaagtagtgt

SEQ ID NO: 890587 - DNA, 22 bp, Artificial Sequence
  chemically synthesized
tccaaagagaaaacactacttt

SEQ ID NO: 890588 - DNA, 22 bp, Artificial Sequence
  chemically synthesized
aatttttttagaaagtagtgtt

SEQ ID NO: 890589 - DNA, 22 bp, Artificial Sequence
  chemically synthesized
tttccaaagagaaaacactact

SEQ ID NO: 890590 - DNA, 22 bp, Artificial Sequence
  chemically synthesized
ttttagaaagtagtgttttctc

SEQ ID NO: 890591 - DNA, 22 bp, Artificial Sequence
  chemically synthesized
gttctttccaaagagaaaacac

SEQ ID NO: 890592 - DNA, 22 bp, Artificial Sequence
  chemically synthesized
tttagaaagtagtgttttctct

SEQ ID NO: 890593 - DNA, 22 bp, Artificial Sequence
  chemically synthesized
agttctttccaaagagaaaaca

SEQ ID NO: 890594 - DNA, 22 bp, Artificial Sequence
  chemically synthesized
ttagaaagtagtgttttctctt

SEQ ID NO: 890595 - DNA, 22 bp, Artificial Sequence
  chemically synthesized
tagttctttccaaagagaaaac

SEQ ID NO: 890596 - DNA, 22 bp, Artificial Sequence
  chemically synthesized
tagaaagtagtgttttctcttt

SEQ ID NO: 890597 - DNA, 22 bp, Artificial Sequence
  chemically synthesized
ttagttctttccaaagagaaaa

SEQ ID NO: 890598 - DNA, 22 bp, Artificial Sequence
  chemically synthesized
agaaagtagtgttttctctttg

SEQ ID NO: 890599 - DNA, 22 bp, Artificial Sequence
  chemically synthesized
gaaagtagtgttttctctttgg

SEQ ID NO: 890600 - DNA, 22 bp, Artificial Sequence
  chemically synthesized
tctctttggaaagaactaaaaa

SEQ ID NO: 890601 - DNA, 22 bp, Artificial Sequence
  chemically synthesized
ctctttggaaagaactaaaaac

SEQ ID NO: 890602 - DNA, 22 bp, Artificial Sequence
  chemically synthesized
tctttggaaagaactaaaaact

SEQ ID NO: 890603 - DNA, 22 bp, Artificial Sequence
  chemically synthesized
tttggaaagaactaaaaacttt

SEQ ID NO: 890604 - DNA, 22 bp, Artificial Sequence
  chemically synthesized
tggaaagaactaaaaactttta

SEQ ID NO: 890605 - DNA, 22 bp, Artificial Sequence
  chemically synthesized
ggaaagaactaaaaacttttac

SEQ ID NO: 890606 - DNA, 22 bp, Artificial Sequence
  chemically synthesized
gaaagaactaaaaacttttacc

SEQ ID NO: 890607 - DNA, 22 bp, Artificial Sequence
  chemically synthesized
aaaacttttaccgtcatgtggc

SEQ ID NO: 890608 - DNA, 22 bp, Artificial Sequence
  chemically synthesized
aaaaataaatgtagaaggccac

SEQ ID NO: 890609 - DNA, 22 bp, Artificial Sequence
  chemically synthesized
caaaaataaatgtagaaggcca

SEQ ID NO: 890610 - DNA, 22 bp, Artificial Sequence
  chemically synthesized
ttaccgtcatgtggccttctac

SEQ ID NO: 890611 - DNA, 22 bp, Artificial Sequence
  chemically synthesized
taccgtcatgtggccttctaca

SEQ ID NO: 890612 - DNA, 22 bp, Artificial Sequence
  chemically synthesized
accgtcatgtggccttctacat

SEQ ID NO: 890613 - DNA, 22 bp, Artificial Sequence
  chemically synthesized
ccgtcatgtggccttctacatt

SEQ ID NO: 890614 - DNA, 22 bp, Artificial Sequence
  chemically synthesized
ctacatttatttttgaaatctt

SEQ ID NO: 890615 - DNA, 22 bp, Artificial Sequence
  chemically synthesized
tacatttatttttgaaatcttt

SEQ ID NO: 890616 - DNA, 22 bp, Artificial Sequence
  chemically synthesized
catttatttttgaaatctttta

SEQ ID NO: 890617 - DNA, 22 bp, Artificial Sequence
  chemically synthesized
atttttgaaatcttttattgtc

SEQ ID NO: 890618 - DNA, 22 bp, Artificial Sequence
  chemically synthesized
tgtaaccaagatgacaataaaa

SEQ ID NO: 890619 - DNA, 22 bp, Artificial Sequence
  chemically synthesized
tttttgaaatcttttattgtca

SEQ ID NO: 890620 - DNA, 22 bp, Artificial Sequence
  chemically synthesized
ttgaaatcttttattgtcatct

SEQ ID NO: 890621 - DNA, 22 bp, Artificial Sequence
  chemically synthesized
cctatgtaaccaagatgacaat

SEQ ID NO: 890622 - DNA, 22 bp, Artificial Sequence
  chemically synthesized
tgaaatcttttattgtcatctt

SEQ ID NO: 890623 - DNA, 22 bp, Artificial Sequence
  chemically synthesized
gaaatcttttattgtcatcttg

SEQ ID NO: 890624 - DNA, 22 bp, Artificial Sequence
  chemically synthesized
aaatcttttattgtcatcttgg

SEQ ID NO: 890625 - DNA, 22 bp, Artificial Sequence
  chemically synthesized
ttattgtcatcttggttacata

SEQ ID NO: 890626 - DNA, 22 bp, Artificial Sequence
  chemically synthesized
tattgtcatcttggttacatag

SEQ ID NO: 890627 - DNA, 22 bp, Artificial Sequence
  chemically synthesized
attgtcatcttggttacatagg

SEQ ID NO: 890628 - DNA, 22 bp, Artificial Sequence
  chemically synthesized
ttgtcatcttggttacataggt

SEQ ID NO: 890629 - DNA, 22 bp, Artificial Sequence
  chemically synthesized
tcatcttggttacataggtagc

SEQ ID NO: 890630 - DNA, 22 bp, Artificial Sequence
  chemically synthesized
tgaaagaatgcatggctaccta

SEQ ID NO: 890631 - DNA, 22 bp, Artificial Sequence
  chemically synthesized
actatgaaagaatgcatggcta

SEQ ID NO: 890632 - DNA, 22 bp, Artificial Sequence
  chemically synthesized
ggttacataggtagccatgcat

SEQ ID NO: 890633 - DNA, 22 bp, Artificial Sequence
  chemically synthesized
gttacataggtagccatgcatt

SEQ ID NO: 890634 - DNA, 22 bp, Artificial Sequence
  chemically synthesized
ctcactatgaaagaatgcatgg

SEQ ID NO: 890635 - DNA, 22 bp, Artificial Sequence
  chemically synthesized
cataggtagccatgcattcttt

SEQ ID NO: 890636 - DNA, 22 bp, Artificial Sequence
  chemically synthesized
aataggatcattgctcactatg

SEQ ID NO: 890637 - DNA, 22 bp, Artificial Sequence
  chemically synthesized
gctgaataggatcattgctcac

SEQ ID NO: 890638 - DNA, 22 bp, Artificial Sequence
  chemically synthesized
ggctgaataggatcattgctca

SEQ ID NO: 890639 - DNA, 22 bp, Artificial Sequence
  chemically synthesized
tttcatagtgagcaatgatcct

SEQ ID NO: 890640 - DNA, 22 bp, Artificial Sequence
  chemically synthesized
tcatagtgagcaatgatcctat

SEQ ID NO: 890641 - DNA, 22 bp, Artificial Sequence
  chemically synthesized
catagtgagcaatgatcctatt

SEQ ID NO: 890642 - DNA, 22 bp, Artificial Sequence
  chemically synthesized
aatacttggctgaataggatca

SEQ ID NO: 890643 - DNA, 22 bp, Artificial Sequence
  chemically synthesized
atagtgagcaatgatcctattc

SEQ ID NO: 890644 - DNA, 22 bp, Artificial Sequence
  chemically synthesized
gaatacttggctgaataggatc

SEQ ID NO: 890645 - DNA, 22 bp, Artificial Sequence
  chemically synthesized
taaaatgacaaaaggtttgaat

SEQ ID NO: 890646 - DNA, 22 bp, Artificial Sequence
  chemically synthesized
ttcagccaagtattcaaacctt

SEQ ID NO: 890647 - DNA, 22 bp, Artificial Sequence
  chemically synthesized
agccaagtattcaaaccttttg

SEQ ID NO: 890648 - DNA, 22 bp, Artificial Sequence
  chemically synthesized
aaaccttttgtcattttacaac

SEQ ID NO: 890649 - DNA, 22 bp, Artificial Sequence
  chemically synthesized
ttgtcattttacaacctttgat

SEQ ID NO: 890650 - DNA, 22 bp, Artificial Sequence
  chemically synthesized
tgtcattttacaacctttgata

SEQ ID NO: 890651 - DNA, 22 bp, Artificial Sequence
  chemically synthesized
ggaaaagcaaaatatcaaaggt

SEQ ID NO: 890652 - DNA, 22 bp, Artificial Sequence
  chemically synthesized
gtcattttacaacctttgatat

SEQ ID NO: 890653 - DNA, 22 bp, Artificial Sequence
  chemically synthesized
tcattttacaacctttgatatt

SEQ ID NO: 890654 - DNA, 22 bp, Artificial Sequence
  chemically synthesized
acctgggaaaagcaaaatatca

SEQ ID NO: 890655 - DNA, 22 bp, Artificial Sequence
  chemically synthesized
tacaacctttgatattttgctt

SEQ ID NO: 890656 - DNA, 22 bp, Artificial Sequence
  chemically synthesized
acaacctttgatattttgcttt

SEQ ID NO: 890657 - DNA, 22 bp, Artificial Sequence
  chemically synthesized
caacctttgatattttgctttt

SEQ ID NO: 890658 - DNA, 22 bp, Artificial Sequence
  chemically synthesized
agaattgacctgggaaaagcaa

SEQ ID NO: 890659 - DNA, 22 bp, Artificial Sequence
  chemically synthesized
aagaattgacctgggaaaagca

SEQ ID NO: 890660 - DNA, 22 bp, Artificial Sequence
  chemically synthesized
tttaagaattgacctgggaaaa

SEQ ID NO: 890661 - DNA, 22 bp, Artificial Sequence
  chemically synthesized
tgatattttgcttttcccaggt

SEQ ID NO: 890662 - DNA, 22 bp, Artificial Sequence
  chemically synthesized
atttaagaattgacctgggaaa

SEQ ID NO: 890663 - DNA, 22 bp, Artificial Sequence
  chemically synthesized
gatattttgcttttcccaggtc

SEQ ID NO: 890664 - DNA, 22 bp, Artificial Sequence
  chemically synthesized
tatttaagaattgacctgggaa

SEQ ID NO: 890665 - DNA, 22 bp, Artificial Sequence
  chemically synthesized
atattttgcttttcccaggtca

SEQ ID NO: 890666 - DNA, 22 bp, Artificial Sequence
  chemically synthesized
tgcttttcccaggtcaattctt

SEQ ID NO: 890667 - DNA, 22 bp, Artificial Sequence
  chemically synthesized
gcttttcccaggtcaattctta

SEQ ID NO: 890668 - DNA, 22 bp, Artificial Sequence
  chemically synthesized
cttttcccaggtcaattcttaa

SEQ ID NO: 890669 - DNA, 22 bp, Artificial Sequence
  chemically synthesized
aaaaaaattttatttaagaatt

SEQ ID NO: 890670 - DNA, 22 bp, Artificial Sequence
  chemically synthesized
ttcccaggtcaattcttaaata

SEQ ID NO: 890671 - DNA, 22 bp, Artificial Sequence
  chemically synthesized
tcccaggtcaattcttaaataa

SEQ ID NO: 890672 - DNA, 22 bp, Artificial Sequence
  chemically synthesized
cccaggtcaattcttaaataaa

SEQ ID NO: 890673 - DNA, 22 bp, Artificial Sequence
  chemically synthesized
ccaggtcaattcttaaataaaa

SEQ ID NO: 890674 - DNA, 22 bp, Artificial Sequence
  chemically synthesized
agattaaaaaaaattttattta

SEQ ID NO: 890675 - DNA, 22 bp, Artificial Sequence
  chemically synthesized
ttaaataaaattttttttaatc

SEQ ID NO: 890676 - DNA, 22 bp, Artificial Sequence
  chemically synthesized
aaaccaatctgagattaaaaaa

SEQ ID NO: 890677 - DNA, 22 bp, Artificial Sequence
  chemically synthesized
caaaccaatctgagattaaaaa

SEQ ID NO: 890678 - DNA, 22 bp, Artificial Sequence
  chemically synthesized
aaataaaattttttttaatctc

SEQ ID NO: 890679 - DNA, 22 bp, Artificial Sequence
  chemically synthesized
tcaaaccaatctgagattaaaa

SEQ ID NO: 890680 - DNA, 22 bp, Artificial Sequence
  chemically synthesized
aataaaattttttttaatctca

SEQ ID NO: 890681 - DNA, 22 bp, Artificial Sequence
  chemically synthesized
ttcaaaccaatctgagattaaa

SEQ ID NO: 890682 - DNA, 22 bp, Artificial Sequence
  chemically synthesized
aaatttttcaaaccaatctgag

SEQ ID NO: 890683 - DNA, 22 bp, Artificial Sequence
  chemically synthesized
gaaatttttcaaaccaatctga

SEQ ID NO: 890684 - DNA, 22 bp, Artificial Sequence
  chemically synthesized
tgaaatttttcaaaccaatctg

SEQ ID NO: 890685 - DNA, 22 bp, Artificial Sequence
  chemically synthesized
tttttaatctcagattggtttg

SEQ ID NO: 890686 - DNA, 22 bp, Artificial Sequence
  chemically synthesized
ttttaatctcagattggtttga

SEQ ID NO: 890687 - DNA, 22 bp, Artificial Sequence
  chemically synthesized
tttaatctcagattggtttgaa

SEQ ID NO: 890688 - DNA, 22 bp, Artificial Sequence
  chemically synthesized
ttaatctcagattggtttgaaa

SEQ ID NO: 890689 - DNA, 22 bp, Artificial Sequence
  chemically synthesized
taatctcagattggtttgaaaa

SEQ ID NO: 890690 - DNA, 22 bp, Artificial Sequence
  chemically synthesized
aatctcagattggtttgaaaaa

SEQ ID NO: 890691 - DNA, 22 bp, Artificial Sequence
  chemically synthesized
atctcagattggtttgaaaaat

SEQ ID NO: 890692 - DNA, 22 bp, Artificial Sequence
  chemically synthesized
agattggtttgaaaaatttcaa

SEQ ID NO: 890693 - DNA, 22 bp, Artificial Sequence
  chemically synthesized
gtttgaaaaatttcaaaggatt

SEQ ID NO: 890694 - DNA, 22 bp, Artificial Sequence
  chemically synthesized
gaaaaatttcaaaggatttgtt

SEQ ID NO: 890695 - DNA, 22 bp, Artificial Sequence
  chemically synthesized
caagggtgcaggaacaaatcct

SEQ ID NO: 890696 - DNA, 22 bp, Artificial Sequence
  chemically synthesized
aaaaatttcaaaggatttgttc

SEQ ID NO: 890697 - DNA, 22 bp, Artificial Sequence
  chemically synthesized
acaagggtgcaggaacaaatcc

SEQ ID NO: 890698 - DNA, 22 bp, Artificial Sequence
  chemically synthesized
tacaagggtgcaggaacaaatc

SEQ ID NO: 890699 - DNA, 22 bp, Artificial Sequence
  chemically synthesized
attttacaagggtgcaggaaca

SEQ ID NO: 890700 - DNA, 22 bp, Artificial Sequence
  chemically synthesized
cattttacaagggtgcaggaac

SEQ ID NO: 890701 - DNA, 22 bp, Artificial Sequence
  chemically synthesized
caaaggatttgttcctgcaccc

SEQ ID NO: 890702 - DNA, 22 bp, Artificial Sequence
  chemically synthesized
aaaggatttgttcctgcaccct

SEQ ID NO: 890703 - DNA, 22 bp, Artificial Sequence
  chemically synthesized
acatccttcattttacaagggt

SEQ ID NO: 890704 - DNA, 22 bp, Artificial Sequence
  chemically synthesized
aacatccttcattttacaaggg

SEQ ID NO: 890705 - DNA, 22 bp, Artificial Sequence
  chemically synthesized
taacatccttcattttacaagg

SEQ ID NO: 890706 - DNA, 22 bp, Artificial Sequence
  chemically synthesized
ttaacatccttcattttacaag

SEQ ID NO: 890707 - DNA, 22 bp, Artificial Sequence
  chemically synthesized
gttcctgcacccttgtaaaatg

SEQ ID NO: 890708 - DNA, 22 bp, Artificial Sequence
  chemically synthesized
ttcctgcacccttgtaaaatga

SEQ ID NO: 890709 - DNA, 22 bp, Artificial Sequence
  chemically synthesized
tttttaacatccttcattttac

SEQ ID NO: 890710 - DNA, 22 bp, Artificial Sequence
  chemically synthesized
ctgcacccttgtaaaatgaagg

SEQ ID NO: 890711 - DNA, 22 bp, Artificial Sequence
  chemically synthesized
gttatttttaacatccttcatt

SEQ ID NO: 890712 - DNA, 22 bp, Artificial Sequence
  chemically synthesized
cacccttgtaaaatgaaggatg

SEQ ID NO: 890713 - DNA, 22 bp, Artificial Sequence
  chemically synthesized
gtaaaatgaaggatgttaaaaa

SEQ ID NO: 890714 - DNA, 22 bp, Artificial Sequence
  chemically synthesized
taaaatgaaggatgttaaaaat

SEQ ID NO: 890715 - DNA, 22 bp, Artificial Sequence
  chemically synthesized
aacataccaaatgaacctagtt

SEQ ID NO: 890716 - DNA, 22 bp, Artificial Sequence
  chemically synthesized
aaaataactaggttcatttggt

SEQ ID NO: 890717 - DNA, 22 bp, Artificial Sequence
  chemically synthesized
tgcaactcaacataccaaatga

SEQ ID NO: 890718 - DNA, 22 bp, Artificial Sequence
  chemically synthesized
atgcaactcaacataccaaatg

SEQ ID NO: 890719 - DNA, 22 bp, Artificial Sequence
  chemically synthesized
tatgcaactcaacataccaaat

SEQ ID NO: 890720 - DNA, 22 bp, Artificial Sequence
  chemically synthesized
ttatgcaactcaacataccaaa

SEQ ID NO: 890721 - DNA, 22 bp, Artificial Sequence
  chemically synthesized
tttatgcaactcaacataccaa

SEQ ID NO: 890722 - DNA, 22 bp, Artificial Sequence
  chemically synthesized
ggttcatttggtatgttgagtt

SEQ ID NO: 890723 - DNA, 22 bp, Artificial Sequence
  chemically synthesized
tcaaagctttttatgcaactca

SEQ ID NO: 890724 - DNA, 22 bp, Artificial Sequence
  chemically synthesized
atttggtatgttgagttgcata

SEQ ID NO: 890725 - DNA, 22 bp, Artificial Sequence
  chemically synthesized
gtcaaagctttttatgcaactc

SEQ ID NO: 890726 - DNA, 22 bp, Artificial Sequence
  chemically synthesized
ttgtcaaagctttttatgcaac

SEQ ID NO: 890727 - DNA, 22 bp, Artificial Sequence
  chemically synthesized
cttgtcaaagctttttatgcaa

SEQ ID NO: 890728 - DNA, 22 bp, Artificial Sequence
  chemically synthesized
ggtatgttgagttgcataaaaa

SEQ ID NO: 890729 - DNA, 22 bp, Artificial Sequence
  chemically synthesized
gtatgttgagttgcataaaaag

SEQ ID NO: 890730 - DNA, 22 bp, Artificial Sequence
  chemically synthesized
ttcttgtcaaagctttttatgc

SEQ ID NO: 890731 - DNA, 22 bp, Artificial Sequence
  chemically synthesized
agttgcataaaaagctttgaca

SEQ ID NO: 890732 - DNA, 22 bp, Artificial Sequence
  chemically synthesized
agcatctcttcttgtcaaagct

SEQ ID NO: 890733 - DNA, 22 bp, Artificial Sequence
  chemically synthesized
cataaaaagctttgacaagaag

SEQ ID NO: 890734 - DNA, 22 bp, Artificial Sequence
  chemically synthesized
gtcaaggttcagcatctcttct

SEQ ID NO: 890735 - DNA, 22 bp, Artificial Sequence
  chemically synthesized
tgacaagaagagatgctgaacc

SEQ ID NO: 890736 - DNA, 22 bp, Artificial Sequence
  chemically synthesized
taacctagtcaaggttcagcat

SEQ ID NO: 890737 - DNA, 22 bp, Artificial Sequence
  chemically synthesized
gacaagaagagatgctgaacct

SEQ ID NO: 890738 - DNA, 22 bp, Artificial Sequence
  chemically synthesized
acaagaagagatgctgaacctt

SEQ ID NO: 890739 - DNA, 22 bp, Artificial Sequence
  chemically synthesized
acccatacaactataacctagt

SEQ ID NO: 890740 - DNA, 22 bp, Artificial Sequence
  chemically synthesized
aaccttgactaggttatagttg

SEQ ID NO: 890741 - DNA, 22 bp, Artificial Sequence
  chemically synthesized
ataatagttgacccatacaact

SEQ ID NO: 890742 - DNA, 22 bp, Artificial Sequence
  chemically synthesized
gactaggttatagttgtatggg

SEQ ID NO: 890743 - DNA, 22 bp, Artificial Sequence
  chemically synthesized
actaggttatagttgtatgggt

SEQ ID NO: 890744 - DNA, 22 bp, Artificial Sequence
  chemically synthesized
tactaataatagttgacccata

SEQ ID NO: 890745 - DNA, 22 bp, Artificial Sequence
  chemically synthesized
ggttatagttgtatgggtcaac

SEQ ID NO: 890746 - DNA, 22 bp, Artificial Sequence
  chemically synthesized
atactaataatagttgacccat

SEQ ID NO: 890747 - DNA, 22 bp, Artificial Sequence
  chemically synthesized
tagttgtatgggtcaactatta

SEQ ID NO: 890748 - DNA, 22 bp, Artificial Sequence
  chemically synthesized
aagtatttatactaataatagt

SEQ ID NO: 890749 - DNA, 22 bp, Artificial Sequence
  chemically synthesized
caagtatttatactaataatag

SEQ ID NO: 890750 - DNA, 22 bp, Artificial Sequence
  chemically synthesized
tcaagtatttatactaataata

SEQ ID NO: 890751 - DNA, 22 bp, Artificial Sequence
  chemically synthesized
tatgggtcaactattattagta

SEQ ID NO: 890752 - DNA, 22 bp, Artificial Sequence
  chemically synthesized
ttcaagtatttatactaataat

SEQ ID NO: 890753 - DNA, 22 bp, Artificial Sequence
  chemically synthesized
taatttttcaagtatttatact

SEQ ID NO: 890754 - DNA, 22 bp, Artificial Sequence
  chemically synthesized
ttataatttttcaagtatttat

SEQ ID NO: 890755 - DNA, 22 bp, Artificial Sequence
  chemically synthesized
attataatttttcaagtattta

SEQ ID NO: 890756 - DNA, 22 bp, Artificial Sequence
  chemically synthesized
ttattagtataaatacttgaaa

SEQ ID NO: 890757 - DNA, 22 bp, Artificial Sequence
  chemically synthesized
ttagtataaatacttgaaaaat

SEQ ID NO: 890758 - DNA, 22 bp, Artificial Sequence
  chemically synthesized
aggatttattataatttttcaa

SEQ ID NO: 890759 - DNA, 22 bp, Artificial Sequence
  chemically synthesized
gtataaatacttgaaaaattat

SEQ ID NO: 890760 - DNA, 22 bp, Artificial Sequence
  chemically synthesized
taaggatttattataatttttc

SEQ ID NO: 890761 - DNA, 22 bp, Artificial Sequence
  chemically synthesized
acaaagttctaaggatttatta

SEQ ID NO: 890762 - DNA, 22 bp, Artificial Sequence
  chemically synthesized
gaaaaattataataaatcctta

SEQ ID NO: 890763 - DNA, 22 bp, Artificial Sequence
  chemically synthesized
aaaaattataataaatccttag

SEQ ID NO: 890764 - DNA, 22 bp, Artificial Sequence
  chemically synthesized
gagcactaacaaagttctaagg

SEQ ID NO: 890765 - DNA, 22 bp, Artificial Sequence
  chemically synthesized
taataaatccttagaactttgt

SEQ ID NO: 890766 - DNA, 22 bp, Artificial Sequence
  chemically synthesized
gagcacctagagcactaacaaa

SEQ ID NO: 890767 - DNA, 22 bp, Artificial Sequence
  chemically synthesized
agaactttgttagtgctctagg

SEQ ID NO: 890768 - DNA, 22 bp, Artificial Sequence
  chemically synthesized
gaactttgttagtgctctaggt

SEQ ID NO: 890769 - DNA, 22 bp, Artificial Sequence
  chemically synthesized
tgttagtgctctaggtgctcta

SEQ ID NO: 890770 - DNA, 22 bp, Artificial Sequence
  chemically synthesized
gttagtgctctaggtgctctag

SEQ ID NO: 890771 - DNA, 22 bp, Artificial Sequence
  chemically synthesized
ttagtgctctaggtgctctagg

SEQ ID NO: 890772 - DNA, 22 bp, Artificial Sequence
  chemically synthesized
gtgctctaggtgctctaggtgt

SEQ ID NO: 890773 - DNA, 22 bp, Artificial Sequence
  chemically synthesized
taggtgctctaggtgtccatga

SEQ ID NO: 890774 - DNA, 22 bp, Artificial Sequence
  chemically synthesized
ggtgctctaggtgtccatgaca

SEQ ID NO: 890775 - DNA, 22 bp, Artificial Sequence
  chemically synthesized
taggtgtccatgacacatcctg

SEQ ID NO: 890776 - DNA, 22 bp, Artificial Sequence
  chemically synthesized
ggtgtccatgacacatcctggt

SEQ ID NO: 890777 - DNA, 22 bp, Artificial Sequence
  chemically synthesized
tcggataaagtagcaccaggat

SEQ ID NO: 890778 - DNA, 22 bp, Artificial Sequence
  chemically synthesized
ttatcggataaagtagcaccag

SEQ ID NO: 890779 - DNA, 22 bp, Artificial Sequence
  chemically synthesized
atgacataatattattatcgga

SEQ ID NO: 890780 - DNA, 22 bp, Artificial Sequence
  chemically synthesized
gtgctactttatccgataataa

SEQ ID NO: 890781 - DNA, 22 bp, Artificial Sequence
  chemically synthesized
ggactgatgacataatattatt

SEQ ID NO: 890782 - DNA, 22 bp, Artificial Sequence
  chemically synthesized
ctttatccgataataatattat

SEQ ID NO: 890783 - DNA, 22 bp, Artificial Sequence
  chemically synthesized
tatccgataataatattatgtc

SEQ ID NO: 890784 - DNA, 22 bp, Artificial Sequence
  chemically synthesized
atccgataataatattatgtca

SEQ ID NO: 890785 - DNA, 22 bp, Artificial Sequence
  chemically synthesized
tccgataataatattatgtcat

SEQ ID NO: 890786 - DNA, 22 bp, Artificial Sequence
  chemically synthesized
gagttaggactgatgacataat

SEQ ID NO: 890787 - DNA, 22 bp, Artificial Sequence
  chemically synthesized
aaataacaactggagttaggac

SEQ ID NO: 890788 - DNA, 22 bp, Artificial Sequence
  chemically synthesized
aaaataacaactggagttagga

SEQ ID NO: 890789 - DNA, 22 bp, Artificial Sequence
  chemically synthesized
taaaataacaactggagttagg

SEQ ID NO: 890790 - DNA, 22 bp, Artificial Sequence
  chemically synthesized
tgtcatcagtcctaactccagt

SEQ ID NO: 890791 - DNA, 22 bp, Artificial Sequence
  chemically synthesized
actccagttgttattttaaaat

SEQ ID NO: 890792 - DNA, 22 bp, Artificial Sequence
  chemically synthesized
gtgccatgccacattttaaaat

SEQ ID NO: 890793 - DNA, 22 bp, Artificial Sequence
  chemically synthesized
cagttgttattttaaaatgtgg

SEQ ID NO: 890794 - DNA, 22 bp, Artificial Sequence
  chemically synthesized
cctggtgccatgccacatttta

SEQ ID NO: 890795 - DNA, 22 bp, Artificial Sequence
  chemically synthesized
ccctggtgccatgccacatttt

SEQ ID NO: 890796 - DNA, 22 bp, Artificial Sequence
  chemically synthesized
tccctggtgccatgccacattt

SEQ ID NO: 890797 - DNA, 22 bp, Artificial Sequence
  chemically synthesized
ttccctggtgccatgccacatt

SEQ ID NO: 890798 - DNA, 22 bp, Artificial Sequence
  chemically synthesized
tttccctggtgccatgccacat

SEQ ID NO: 890799 - DNA, 22 bp, Artificial Sequence
  chemically synthesized
ttttccctggtgccatgccaca

SEQ ID NO: 890800 - DNA, 22 bp, Artificial Sequence
  chemically synthesized
ttattttaaaatgtggcatggc

SEQ ID NO: 890801 - DNA, 22 bp, Artificial Sequence
  chemically synthesized
tttttccctggtgccatgccac

SEQ ID NO: 890802 - DNA, 22 bp, Artificial Sequence
  chemically synthesized
ttttttccctggtgccatgcca

SEQ ID NO: 890803 - DNA, 22 bp, Artificial Sequence
  chemically synthesized
tttttttccctggtgccatgcc

SEQ ID NO: 890804 - DNA, 22 bp, Artificial Sequence
  chemically synthesized
ttttaaaatgtggcatggcacc

SEQ ID NO: 890805 - DNA, 22 bp, Artificial Sequence
  chemically synthesized
taaaatgtggcatggcaccagg

SEQ ID NO: 890806 - DNA, 22 bp, Artificial Sequence
  chemically synthesized
aaaatgtggcatggcaccaggg

SEQ ID NO: 890807 - DNA, 22 bp, Artificial Sequence
  chemically synthesized
aaatgtggcatggcaccaggga

SEQ ID NO: 890808 - DNA, 22 bp, Artificial Sequence
  chemically synthesized
gacaagaaattttttttttccc

SEQ ID NO: 890809 - DNA, 22 bp, Artificial Sequence
  chemically synthesized
attcgacaagaaattttttttt

SEQ ID NO: 890810 - DNA, 22 bp, Artificial Sequence
  chemically synthesized
attcattcgacaagaaattttt

SEQ ID NO: 890811 - DNA, 22 bp, Artificial Sequence
  chemically synthesized
aagatctgattcattcgacaag

SEQ ID NO: 890812 - DNA, 22 bp, Artificial Sequence
  chemically synthesized
cttgtcgaatgaatcagatctt

SEQ ID NO: 890813 - DNA, 22 bp, Artificial Sequence
  chemically synthesized
ttgtcgaatgaatcagatcttt

SEQ ID NO: 890814 - DNA, 22 bp, Artificial Sequence
  chemically synthesized
gtcgaatgaatcagatctttaa

SEQ ID NO: 890815 - DNA, 22 bp, Artificial Sequence
  chemically synthesized
aaatggccataattaaagatct

SEQ ID NO: 890816 - DNA, 22 bp, Artificial Sequence
  chemically synthesized
tcgaatgaatcagatctttaat

SEQ ID NO: 890817 - DNA, 22 bp, Artificial Sequence
  chemically synthesized
aaaatggccataattaaagatc

SEQ ID NO: 890818 - DNA, 22 bp, Artificial Sequence
  chemically synthesized
tgaacgacaaaagacttaaaat

SEQ ID NO: 890819 - DNA, 22 bp, Artificial Sequence
  chemically synthesized
taattatggccattttaagtct

SEQ ID NO: 890820 - DNA, 22 bp, Artificial Sequence
  chemically synthesized
aattatggccattttaagtctt

SEQ ID NO: 890821 - DNA, 22 bp, Artificial Sequence
  chemically synthesized
attatggccattttaagtcttt

SEQ ID NO: 890822 - DNA, 22 bp, Artificial Sequence
  chemically synthesized
tctgtgaacgacaaaagactta

SEQ ID NO: 890823 - DNA, 22 bp, Artificial Sequence
  chemically synthesized
tggccattttaagtcttttgtc

SEQ ID NO: 890824 - DNA, 22 bp, Artificial Sequence
  chemically synthesized
taagtcttttgtcgttcacaga

SEQ ID NO: 890825 - DNA, 22 bp, Artificial Sequence
  chemically synthesized
aagtcttttgtcgttcacagat

SEQ ID NO: 890826 - DNA, 22 bp, Artificial Sequence
  chemically synthesized
agtcttttgtcgttcacagata

SEQ ID NO: 890827 - DNA, 22 bp, Artificial Sequence
  chemically synthesized
ttgtcgttcacagatagttttt

SEQ ID NO: 890828 - DNA, 22 bp, Artificial Sequence
  chemically synthesized
tgtcgttcacagatagtttttg

SEQ ID NO: 890829 - DNA, 22 bp, Artificial Sequence
  chemically synthesized
gtcgttcacagatagtttttgg

SEQ ID NO: 890830 - DNA, 22 bp, Artificial Sequence
  chemically synthesized
tcgttcacagatagtttttggt

SEQ ID NO: 890831 - DNA, 22 bp, Artificial Sequence
  chemically synthesized
acagatagtttttggtttatgc

SEQ ID NO: 890832 - DNA, 22 bp, Artificial Sequence
  chemically synthesized
agggaagcatcagcataaacca

SEQ ID NO: 890833 - DNA, 22 bp, Artificial Sequence
  chemically synthesized
ttggtttatgctgatgcttccc

SEQ ID NO: 890834 - DNA, 22 bp, Artificial Sequence
  chemically synthesized
taagagcactcagggaagcatc

SEQ ID NO: 890835 - DNA, 22 bp, Artificial Sequence
  chemically synthesized
tggtttatgctgatgcttccct

SEQ ID NO: 890836 - DNA, 22 bp, Artificial Sequence
  chemically synthesized
ggtttatgctgatgcttccctg

SEQ ID NO: 890837 - DNA, 22 bp, Artificial Sequence
  chemically synthesized
gtttatgctgatgcttccctga

SEQ ID NO: 890838 - DNA, 22 bp, Artificial Sequence
  chemically synthesized
attgtaagagcactcagggaag

SEQ ID NO: 890839 - DNA, 22 bp, Artificial Sequence
  chemically synthesized
atgctgatgcttccctgagtgc

SEQ ID NO: 890840 - DNA, 22 bp, Artificial Sequence
  chemically synthesized
tgctgatgcttccctgagtgct

SEQ ID NO: 890841 - DNA, 22 bp, Artificial Sequence
  chemically synthesized
actgattgtaagagcactcagg

SEQ ID NO: 890842 - DNA, 22 bp, Artificial Sequence
  chemically synthesized
taactgattgtaagagcactca

SEQ ID NO: 890843 - DNA, 22 bp, Artificial Sequence
  chemically synthesized
atgcttccctgagtgctcttac

SEQ ID NO: 890844 - DNA, 22 bp, Artificial Sequence
  chemically synthesized
acctctaactgattgtaagagc

SEQ ID NO: 890845 - DNA, 22 bp, Artificial Sequence
  chemically synthesized
tgacctctaactgattgtaaga

SEQ ID NO: 890846 - DNA, 22 bp, Artificial Sequence
  chemically synthesized
ccctgagtgctcttacaatcag

SEQ ID NO: 890847 - DNA, 22 bp, Artificial Sequence
  chemically synthesized
cctgagtgctcttacaatcagt

SEQ ID NO: 890848 - DNA, 22 bp, Artificial Sequence
  chemically synthesized
agtgctcttacaatcagttaga

SEQ ID NO: 890849 - DNA, 22 bp, Artificial Sequence
  chemically synthesized
ttacaatcagttagaggtcaga

SEQ ID NO: 890850 - DNA, 22 bp, Artificial Sequence
  chemically synthesized
aagatgatgcattctgacctct

SEQ ID NO: 890851 - DNA, 22 bp, Artificial Sequence
  chemically synthesized
acaatcagttagaggtcagaat

SEQ ID NO: 890852 - DNA, 22 bp, Artificial Sequence
  chemically synthesized
caatcagttagaggtcagaatg

SEQ ID NO: 890853 - DNA, 22 bp, Artificial Sequence
  chemically synthesized
ctgaagatgatgcattctgacc

SEQ ID NO: 890854 - DNA, 22 bp, Artificial Sequence
  chemically synthesized
actgaagatgatgcattctgac

SEQ ID NO: 890855 - DNA, 22 bp, Artificial Sequence
  chemically synthesized
tactgaagatgatgcattctga

SEQ ID NO: 890856 - DNA, 22 bp, Artificial Sequence
  chemically synthesized
ttttactgaagatgatgcattc

SEQ ID NO: 890857 - DNA, 22 bp, Artificial Sequence
  chemically synthesized
gaggtcagaatgcatcatcttc

SEQ ID NO: 890858 - DNA, 22 bp, Artificial Sequence
  chemically synthesized
aaagatggtcctgttttactga

SEQ ID NO: 890859 - DNA, 22 bp, Artificial Sequence
  chemically synthesized
tgggtctcaaagatggtcctgt

SEQ ID NO: 890860 - DNA, 22 bp, Artificial Sequence
  chemically synthesized
ctatgggtctcaaagatggtcc

SEQ ID NO: 890861 - DNA, 22 bp, Artificial Sequence
  chemically synthesized
cctatgggtctcaaagatggtc

SEQ ID NO: 890862 - DNA, 22 bp, Artificial Sequence
  chemically synthesized
cagtaaaacaggaccatctttg

SEQ ID NO: 890863 - DNA, 22 bp, Artificial Sequence
  chemically synthesized
agtaaaacaggaccatctttga

SEQ ID NO: 890864 - DNA, 22 bp, Artificial Sequence
  chemically synthesized
tcgtagtacttcctatgggtct

SEQ ID NO: 890865 - DNA, 22 bp, Artificial Sequence
  chemically synthesized
tgagacccataggaagtactac

SEQ ID NO: 890866 - DNA, 22 bp, Artificial Sequence
  chemically synthesized
gagacccataggaagtactacg

SEQ ID NO: 890867 - DNA, 22 bp, Artificial Sequence
  chemically synthesized
agacccataggaagtactacga

SEQ ID NO: 890868 - DNA, 22 bp, Artificial Sequence
  chemically synthesized
tgtcccagagtacctgtcgtag

SEQ ID NO: 890869 - DNA, 22 bp, Artificial Sequence
  chemically synthesized
cgacaggtactctgggacacag

SEQ ID NO: 890870 - DNA, 22 bp, Artificial Sequence
  chemically synthesized
agcaatggcatcagaagtctgt

SEQ ID NO: 890871 - DNA, 22 bp, Artificial Sequence
  chemically synthesized
aagcaatggcatcagaagtctg

SEQ ID NO: 890872 - DNA, 22 bp, Artificial Sequence
  chemically synthesized
tttaagcaatggcatcagaagt

SEQ ID NO: 890873 - DNA, 22 bp, Artificial Sequence
  chemically synthesized
tgggacacagacttctgatgcc

SEQ ID NO: 890874 - DNA, 22 bp, Artificial Sequence
  chemically synthesized
ggacacagacttctgatgccat

SEQ ID NO: 890875 - DNA, 22 bp, Artificial Sequence
  chemically synthesized
gaagttatttaagcaatggcat

SEQ ID NO: 890876 - DNA, 22 bp, Artificial Sequence
  chemically synthesized
ctgatgccattgcttaaataac

SEQ ID NO: 890877 - DNA, 22 bp, Artificial Sequence
  chemically synthesized
tgatgccattgcttaaataact

SEQ ID NO: 890878 - DNA, 22 bp, Artificial Sequence
  chemically synthesized
atgccattgcttaaataacttc

SEQ ID NO: 890879 - DNA, 22 bp, Artificial Sequence
  chemically synthesized
tccaatggtataatctcgaagt

SEQ ID NO: 890880 - DNA, 22 bp, Artificial Sequence
  chemically synthesized
gtccaatggtataatctcgaag

SEQ ID NO: 890881 - DNA, 22 bp, Artificial Sequence
  chemically synthesized
tgtccaatggtataatctcgaa

SEQ ID NO: 890882 - DNA, 22 bp, Artificial Sequence
  chemically synthesized
cttaaataacttcgagattata

SEQ ID NO: 890883 - DNA, 22 bp, Artificial Sequence
  chemically synthesized
actttgtccaatggtataatct

SEQ ID NO: 890884 - DNA, 22 bp, Artificial Sequence
  chemically synthesized
aaataacttcgagattatacca

SEQ ID NO: 890885 - DNA, 22 bp, Artificial Sequence
  chemically synthesized
aataacttcgagattataccat

SEQ ID NO: 890886 - DNA, 22 bp, Artificial Sequence
  chemically synthesized
cgagattataccattggacaaa

SEQ ID NO: 890887 - DNA, 22 bp, Artificial Sequence
  chemically synthesized
ataaatcctgactttgtccaat

SEQ ID NO: 890888 - DNA, 22 bp, Artificial Sequence
  chemically synthesized
gagattataccattggacaaag

SEQ ID NO: 890889 - DNA, 22 bp, Artificial Sequence
  chemically synthesized
cataaatcctgactttgtccaa

SEQ ID NO: 890890 - DNA, 22 bp, Artificial Sequence
  chemically synthesized
taccattggacaaagtcaggat

SEQ ID NO: 890891 - DNA, 22 bp, Artificial Sequence
  chemically synthesized
acagagtttcataaatcctgac

SEQ ID NO: 890892 - DNA, 22 bp, Artificial Sequence
  chemically synthesized
cacagagtttcataaatcctga

SEQ ID NO: 890893 - DNA, 22 bp, Artificial Sequence
  chemically synthesized
ttcacagagtttcataaatcct

SEQ ID NO: 890894 - DNA, 22 bp, Artificial Sequence
  chemically synthesized
cttcacagagtttcataaatcc

SEQ ID NO: 890895 - DNA, 22 bp, Artificial Sequence
  chemically synthesized
gacaaagtcaggatttatgaaa

SEQ ID NO: 890896 - DNA, 22 bp, Artificial Sequence
  chemically synthesized
atcagcttcttcacagagtttc

SEQ ID NO: 890897 - DNA, 22 bp, Artificial Sequence
  chemically synthesized
atgaactcatcagcttcttcac

SEQ ID NO: 890898 - DNA, 22 bp, Artificial Sequence
  chemically synthesized
catgaactcatcagcttcttca

SEQ ID NO: 890899 - DNA, 22 bp, Artificial Sequence
  chemically synthesized
atgaaactctgtgaagaagctg

SEQ ID NO: 890900 - DNA, 22 bp, Artificial Sequence
  chemically synthesized
tgaaactctgtgaagaagctga

SEQ ID NO: 890901 - DNA, 22 bp, Artificial Sequence
  chemically synthesized
gtagtttcatgaactcatcagc

SEQ ID NO: 890902 - DNA, 22 bp, Artificial Sequence
  chemically synthesized
tgtgaagaagctgatgagttca

SEQ ID NO: 890903 - DNA, 22 bp, Artificial Sequence
  chemically synthesized
tgaagaagctgatgagttcatg

SEQ ID NO: 890904 - DNA, 22 bp, Artificial Sequence
  chemically synthesized
agttagtagtttcatgaactca

SEQ ID NO: 890905 - DNA, 22 bp, Artificial Sequence
  chemically synthesized
gagttagtagtttcatgaactc

SEQ ID NO: 890906 - DNA, 22 bp, Artificial Sequence
  chemically synthesized
atcttgagttagtagtttcatg

SEQ ID NO: 890907 - DNA, 22 bp, Artificial Sequence
  chemically synthesized
gatcttgagttagtagtttcat

SEQ ID NO: 890908 - DNA, 22 bp, Artificial Sequence
  chemically synthesized
cttgatcttgagttagtagttt

SEQ ID NO: 890909 - DNA, 22 bp, Artificial Sequence
  chemically synthesized
atgagttcatgaaactactaac

SEQ ID NO: 890910 - DNA, 22 bp, Artificial Sequence
  chemically synthesized
gcttgatcttgagttagtagtt

SEQ ID NO: 890911 - DNA, 22 bp, Artificial Sequence
  chemically synthesized
tcttgcttgatcttgagttagt

SEQ ID NO: 890912 - DNA, 22 bp, Artificial Sequence
  chemically synthesized
gtcttgcttgatcttgagttag

SEQ ID NO: 890913 - DNA, 22 bp, Artificial Sequence
  chemically synthesized
ttgtcttgcttgatcttgagtt

SEQ ID NO: 890914 - DNA, 22 bp, Artificial Sequence
  chemically synthesized
atgaaactactaactcaagatc

SEQ ID NO: 890915 - DNA, 22 bp, Artificial Sequence
  chemically synthesized
attcttgtcttgcttgatcttg

SEQ ID NO: 890916 - DNA, 22 bp, Artificial Sequence
  chemically synthesized
ctaactcaagatcaagcaagac

SEQ ID NO: 890917 - DNA, 22 bp, Artificial Sequence
  chemically synthesized
actcaagatcaagcaagacaag

SEQ ID NO: 890918 - DNA, 22 bp, Artificial Sequence
  chemically synthesized
aagatcaagcaagacaagaatt

SEQ ID NO: 890919 - DNA, 22 bp, Artificial Sequence
  chemically synthesized
aggcccatgtagttaattcttg

SEQ ID NO: 890920 - DNA, 22 bp, Artificial Sequence
  chemically synthesized
attcaggcccatgtagttaatt

SEQ ID NO: 890921 - DNA, 22 bp, Artificial Sequence
  chemically synthesized
tcagttcattcaggcccatgta

SEQ ID NO: 890922 - DNA, 22 bp, Artificial Sequence
  chemically synthesized
atcagttcattcaggcccatgt

SEQ ID NO: 890923 - DNA, 22 bp, Artificial Sequence
  chemically synthesized
tatcagttcattcaggcccatg

SEQ ID NO: 890924 - DNA, 22 bp, Artificial Sequence
  chemically synthesized
ttatcagttcattcaggcccat

SEQ ID NO: 890925 - DNA, 22 bp, Artificial Sequence
  chemically synthesized
actacatgggcctgaatgaact

SEQ ID NO: 890926 - DNA, 22 bp, Artificial Sequence
  chemically synthesized
catgggcctgaatgaactgata

SEQ ID NO: 890927 - DNA, 22 bp, Artificial Sequence
  chemically synthesized
aatgaactgataaaagatttga

SEQ ID NO: 890928 - DNA, 22 bp, Artificial Sequence
  chemically synthesized
aacaaaagccataatcaaatct

SEQ ID NO: 890929 - DNA, 22 bp, Artificial Sequence
  chemically synthesized
aaacaaaagccataatcaaatc

SEQ ID NO: 890930 - DNA, 22 bp, Artificial Sequence
  chemically synthesized
taaacaaaagccataatcaaat

SEQ ID NO: 890931 - DNA, 22 bp, Artificial Sequence
  chemically synthesized
ataaaagatttgattatggctt

SEQ ID NO: 890932 - DNA, 22 bp, Artificial Sequence
  chemically synthesized
gattatggcttttgtttaaaat

SEQ ID NO: 890933 - DNA, 22 bp, Artificial Sequence
  chemically synthesized
attatggcttttgtttaaaata

SEQ ID NO: 890934 - DNA, 22 bp, Artificial Sequence
  chemically synthesized
aaacatgaggaatattttaaac

SEQ ID NO: 890935 - DNA, 22 bp, Artificial Sequence
  chemically synthesized
tggcttttgtttaaaatattcc

SEQ ID NO: 890936 - DNA, 22 bp, Artificial Sequence
  chemically synthesized
ttgtttaaaatattcctcatgt

SEQ ID NO: 890937 - DNA, 22 bp, Artificial Sequence
  chemically synthesized
tgtttaaaatattcctcatgtt

SEQ ID NO: 890938 - DNA, 22 bp, Artificial Sequence
  chemically synthesized
gtttaaaatattcctcatgttt

SEQ ID NO: 890939 - DNA, 22 bp, Artificial Sequence
  chemically synthesized
tttaaaatattcctcatgtttt

SEQ ID NO: 890940 - DNA, 22 bp, Artificial Sequence
  chemically synthesized
gcaaacagaacattaaaacatg

SEQ ID NO: 890941 - DNA, 22 bp, Artificial Sequence
  chemically synthesized
aaaatattcctcatgttttaat

SEQ ID NO: 890942 - DNA, 22 bp, Artificial Sequence
  chemically synthesized
agcaaacagaacattaaaacat

SEQ ID NO: 890943 - DNA, 22 bp, Artificial Sequence
  chemically synthesized
aaatattcctcatgttttaatg

SEQ ID NO: 890944 - DNA, 22 bp, Artificial Sequence
  chemically synthesized
tatttagcaaacagaacattaa

SEQ ID NO: 890945 - DNA, 22 bp, Artificial Sequence
  chemically synthesized
gtatttagcaaacagaacatta

SEQ ID NO: 890946 - DNA, 22 bp, Artificial Sequence
  chemically synthesized
ttgtatttagcaaacagaacat

SEQ ID NO: 890947 - DNA, 22 bp, Artificial Sequence
  chemically synthesized
ctcatgttttaatgttctgttt

SEQ ID NO: 890948 - DNA, 22 bp, Artificial Sequence
  chemically synthesized
cttgtatttagcaaacagaaca

SEQ ID NO: 890949 - DNA, 22 bp, Artificial Sequence
  chemically synthesized
atgttttaatgttctgtttgct

SEQ ID NO: 890950 - DNA, 22 bp, Artificial Sequence
  chemically synthesized
taatgttctgtttgctaaatac

SEQ ID NO: 890951 - DNA, 22 bp, Artificial Sequence
  chemically synthesized
aatgttctgtttgctaaataca

SEQ ID NO: 890952 - DNA, 22 bp, Artificial Sequence
  chemically synthesized
atgttctgtttgctaaatacaa

SEQ ID NO: 890953 - DNA, 22 bp, Artificial Sequence
  chemically synthesized
tgtttgctaaatacaagaaacg

SEQ ID NO: 890954 - DNA, 22 bp, Artificial Sequence
  chemically synthesized
tttgctaaatacaagaaacgcc

SEQ ID NO: 890955 - DNA, 22 bp, Artificial Sequence
  chemically synthesized
agagaaaaaggaaaggcgtttc

SEQ ID NO: 890956 - DNA, 22 bp, Artificial Sequence
  chemically synthesized
gctaaatacaagaaacgccttt

SEQ ID NO: 890957 - DNA, 22 bp, Artificial Sequence
  chemically synthesized
aagagaaaaaggaaaggcgttt

SEQ ID NO: 890958 - DNA, 22 bp, Artificial Sequence
  chemically synthesized
ctaaatacaagaaacgcctttc

SEQ ID NO: 890959 - DNA, 22 bp, Artificial Sequence
  chemically synthesized
aatacaagaaacgcctttcctt

SEQ ID NO: 890960 - DNA, 22 bp, Artificial Sequence
  chemically synthesized
tagataacttaagagaaaaagg

SEQ ID NO: 890961 - DNA, 22 bp, Artificial Sequence
  chemically synthesized
atgagttatagataacttaaga

SEQ ID NO: 890962 - DNA, 22 bp, Artificial Sequence
  chemically synthesized
tcatgagttatagataacttaa

SEQ ID NO: 890963 - DNA, 22 bp, Artificial Sequence
  chemically synthesized
tcctttttctcttaagttatct

SEQ ID NO: 890964 - DNA, 22 bp, Artificial Sequence
  chemically synthesized
cctttttctcttaagttatcta

SEQ ID NO: 890965 - DNA, 22 bp, Artificial Sequence
  chemically synthesized
ctttttctcttaagttatctat

SEQ ID NO: 890966 - DNA, 22 bp, Artificial Sequence
  chemically synthesized
aattctcatgagttatagataa

SEQ ID NO: 890967 - DNA, 22 bp, Artificial Sequence
  chemically synthesized
tttctcttaagttatctataac

SEQ ID NO: 890968 - DNA, 22 bp, Artificial Sequence
  chemically synthesized
ttctcttaagttatctataact

SEQ ID NO: 890969 - DNA, 22 bp, Artificial Sequence
  chemically synthesized
taaattctcatgagttatagat

SEQ ID NO: 890970 - DNA, 22 bp, Artificial Sequence
  chemically synthesized
tctcttaagttatctataactc

SEQ ID NO: 890971 - DNA, 22 bp, Artificial Sequence
  chemically synthesized
ctcttaagttatctataactca

SEQ ID NO: 890972 - DNA, 22 bp, Artificial Sequence
  chemically synthesized
tcttaagttatctataactcat

SEQ ID NO: 890973 - DNA, 22 bp, Artificial Sequence
  chemically synthesized
ttaagttatctataactcatga

SEQ ID NO: 890974 - DNA, 22 bp, Artificial Sequence
  chemically synthesized
aagttatctataactcatgaga

SEQ ID NO: 890975 - DNA, 22 bp, Artificial Sequence
  chemically synthesized
agttatctataactcatgagaa

SEQ ID NO: 890976 - DNA, 22 bp, Artificial Sequence
  chemically synthesized
tctataactcatgagaatttag

SEQ ID NO: 890977 - DNA, 22 bp, Artificial Sequence
  chemically synthesized
caaaagcatactctaaattctc

SEQ ID NO: 890978 - DNA, 22 bp, Artificial Sequence
  chemically synthesized
acaaaagcatactctaaattct

SEQ ID NO: 890979 - DNA, 22 bp, Artificial Sequence
  chemically synthesized
taactcatgagaatttagagta

SEQ ID NO: 890980 - DNA, 22 bp, Artificial Sequence
  chemically synthesized
tttacaaaagcatactctaaat

SEQ ID NO: 890981 - DNA, 22 bp, Artificial Sequence
  chemically synthesized
tgtttacaaaagcatactctaa

SEQ ID NO: 890982 - DNA, 22 bp, Artificial Sequence
  chemically synthesized
atgagaatttagagtatgcttt

SEQ ID NO: 890983 - DNA, 22 bp, Artificial Sequence
  chemically synthesized
attctgtttacaaaagcatact

SEQ ID NO: 890984 - DNA, 22 bp, Artificial Sequence
  chemically synthesized
cattctgtttacaaaagcatac

SEQ ID NO: 890985 - DNA, 22 bp, Artificial Sequence
  chemically synthesized
atgtttcattctgtttacaaaa

SEQ ID NO: 890986 - DNA, 22 bp, Artificial Sequence
  chemically synthesized
agagtatgcttttgtaaacaga

SEQ ID NO: 890987 - DNA, 22 bp, Artificial Sequence
  chemically synthesized
gagtatgcttttgtaaacagaa

SEQ ID NO: 890988 - DNA, 22 bp, Artificial Sequence
  chemically synthesized
ttgtaaacagaatgaaacatta

SEQ ID NO: 890989 - DNA, 22 bp, Artificial Sequence
  chemically synthesized
tgtaaacagaatgaaacattaa

SEQ ID NO: 890990 - DNA, 22 bp, Artificial Sequence
  chemically synthesized
gtaaacagaatgaaacattaat

SEQ ID NO: 890991 - DNA, 22 bp, Artificial Sequence
  chemically synthesized
taaacagaatgaaacattaatc

SEQ ID NO: 890992 - DNA, 22 bp, Artificial Sequence
  chemically synthesized
cagggatcaggcagggataaaa

SEQ ID NO: 890993 - DNA, 22 bp, Artificial Sequence
  chemically synthesized
acagggatcaggcagggataaa

SEQ ID NO: 890994 - DNA, 22 bp, Artificial Sequence
  chemically synthesized
tacagggatcaggcagggataa

SEQ ID NO: 890995 - DNA, 22 bp, Artificial Sequence
  chemically synthesized
aattttacagggatcaggcagg

SEQ ID NO: 890996 - DNA, 22 bp, Artificial Sequence
  chemically synthesized
atctttttatccctgcctgatc

SEQ ID NO: 890997 - DNA, 22 bp, Artificial Sequence
  chemically synthesized
tgaattttacagggatcaggca

SEQ ID NO: 890998 - DNA, 22 bp, Artificial Sequence
  chemically synthesized
ctgaattttacagggatcaggc

SEQ ID NO: 890999 - DNA, 22 bp, Artificial Sequence
  chemically synthesized
tttatccctgcctgatccctgt

SEQ ID NO: 891000 - DNA, 22 bp, Artificial Sequence
  chemically synthesized
ttatccctgcctgatccctgta

SEQ ID NO: 891001 - DNA, 22 bp, Artificial Sequence
  chemically synthesized
tatccctgcctgatccctgtaa

SEQ ID NO: 891002 - DNA, 22 bp, Artificial Sequence
  chemically synthesized
atccctgcctgatccctgtaaa

SEQ ID NO: 891003 - DNA, 22 bp, Artificial Sequence
  chemically synthesized
tccctgcctgatccctgtaaaa

SEQ ID NO: 891004 - DNA, 22 bp, Artificial Sequence
  chemically synthesized
ggtaagaatttctgaattttac

SEQ ID NO: 891005 - DNA, 22 bp, Artificial Sequence
  chemically synthesized
cctgatccctgtaaaattcaga

SEQ ID NO: 891006 - DNA, 22 bp, Artificial Sequence
  chemically synthesized
atccctgtaaaattcagaaatt

SEQ ID NO: 891007 - DNA, 22 bp, Artificial Sequence
  chemically synthesized
taaaattcagaaattcttaccg

SEQ ID NO: 891008 - DNA, 22 bp, Artificial Sequence
  chemically synthesized
ccatgaaaataagaatactcgg

SEQ ID NO: 891009 - DNA, 22 bp, Artificial Sequence
  chemically synthesized
agaaattcttaccgagtattct

SEQ ID NO: 891010 - DNA, 22 bp, Artificial Sequence
  chemically synthesized
tattgccatgaaaataagaata

SEQ ID NO: 891011 - DNA, 22 bp, Artificial Sequence
  chemically synthesized
ttaccgagtattcttattttca

SEQ ID NO: 891012 - DNA, 22 bp, Artificial Sequence
  chemically synthesized
accgagtattcttattttcatg

SEQ ID NO: 891013 - DNA, 22 bp, Artificial Sequence
  chemically synthesized
ccgagtattcttattttcatgg

SEQ ID NO: 891014 - DNA, 22 bp, Artificial Sequence
  chemically synthesized
tgcaaataattatattgccatg

SEQ ID NO: 891015 - DNA, 22 bp, Artificial Sequence
  chemically synthesized
ttattttcatggcaatataatt

SEQ ID NO: 891016 - DNA, 22 bp, Artificial Sequence
  chemically synthesized
agcctatgcaaataattatatt

SEQ ID NO: 891017 - DNA, 22 bp, Artificial Sequence
  chemically synthesized
attttcatggcaatataattat

SEQ ID NO: 891018 - DNA, 22 bp, Artificial Sequence
  chemically synthesized
ttttcatggcaatataattatt

SEQ ID NO: 891019 - DNA, 22 bp, Artificial Sequence
  chemically synthesized
ttgagcctatgcaaataattat

SEQ ID NO: 891020 - DNA, 22 bp, Artificial Sequence
  chemically synthesized
attgagcctatgcaaataatta

SEQ ID NO: 891021 - DNA, 22 bp, Artificial Sequence
  chemically synthesized
tcatggcaatataattatttgc

SEQ ID NO: 891022 - DNA, 22 bp, Artificial Sequence
  chemically synthesized
catggcaatataattatttgca

SEQ ID NO: 891023 - DNA, 22 bp, Artificial Sequence
  chemically synthesized
atggcaatataattatttgcat

SEQ ID NO: 891024 - DNA, 22 bp, Artificial Sequence
  chemically synthesized
aatatatttattgagcctatgc

SEQ ID NO: 891025 - DNA, 22 bp, Artificial Sequence
  chemically synthesized
cctaaatatatttattgagcct

SEQ ID NO: 891026 - DNA, 22 bp, Artificial Sequence
  chemically synthesized
ttacctaaatatatttattgag

SEQ ID NO: 891027 - DNA, 22 bp, Artificial Sequence
  chemically synthesized
gttacctaaatatatttattga

SEQ ID NO: 891028 - DNA, 22 bp, Artificial Sequence
  chemically synthesized
tttgcataggctcaataaatat

SEQ ID NO: 891029 - DNA, 22 bp, Artificial Sequence
  chemically synthesized
gcataggctcaataaatatatt

SEQ ID NO: 891030 - DNA, 22 bp, Artificial Sequence
  chemically synthesized
cataggctcaataaatatattt

SEQ ID NO: 891031 - DNA, 22 bp, Artificial Sequence
  chemically synthesized
tgtcttgttacctaaatatatt

SEQ ID NO: 891032 - DNA, 22 bp, Artificial Sequence
  chemically synthesized
aattatgtcttgttacctaaat

SEQ ID NO: 891033 - DNA, 22 bp, Artificial Sequence
  chemically synthesized
caattatgtcttgttacctaaa

SEQ ID NO: 891034 - DNA, 22 bp, Artificial Sequence
  chemically synthesized
tcaattatgtcttgttacctaa

SEQ ID NO: 891035 - DNA, 22 bp, Artificial Sequence
  chemically synthesized
aataaatatatttaggtaacaa

SEQ ID NO: 891036 - DNA, 22 bp, Artificial Sequence
  chemically synthesized
ttcaattatgtcttgttaccta

SEQ ID NO: 891037 - DNA, 22 bp, Artificial Sequence
  chemically synthesized
tttcaattatgtcttgttacct

SEQ ID NO: 891038 - DNA, 22 bp, Artificial Sequence
  chemically synthesized
ttttcaattatgtcttgttacc

SEQ ID NO: 891039 - DNA, 22 bp, Artificial Sequence
  chemically synthesized
tatatttttttcaattatgtct

SEQ ID NO: 891040 - DNA, 22 bp, Artificial Sequence
  chemically synthesized
aggtaacaagacataattgaaa

SEQ ID NO: 891041 - DNA, 22 bp, Artificial Sequence
  chemically synthesized
gttatatatttttttcaattat

SEQ ID NO: 891042 - DNA, 22 bp, Artificial Sequence
  chemically synthesized
ggtaacaagacataattgaaaa

SEQ ID NO: 891043 - DNA, 22 bp, Artificial Sequence
  chemically synthesized
ggttatatatttttttcaatta

SEQ ID NO: 891044 - DNA, 22 bp, Artificial Sequence
  chemically synthesized
cagtcaaagccttggttatata

SEQ ID NO: 891045 - DNA, 22 bp, Artificial Sequence
  chemically synthesized
aaaaaaatatataaccaaggct

SEQ ID NO: 891046 - DNA, 22 bp, Artificial Sequence
  chemically synthesized
aaatatgacattccagtcaaag

SEQ ID NO: 891047 - DNA, 22 bp, Artificial Sequence
  chemically synthesized
tcaaatatgacattccagtcaa

SEQ ID NO: 891048 - DNA, 22 bp, Artificial Sequence
  chemically synthesized
attctcaaatatgacattccag

SEQ ID NO: 891049 - DNA, 22 bp, Artificial Sequence
  chemically synthesized
aattctcaaatatgacattcca

SEQ ID NO: 891050 - DNA, 22 bp, Artificial Sequence
  chemically synthesized
tgcacttaattctcaaatatga

SEQ ID NO: 891051 - DNA, 22 bp, Artificial Sequence
  chemically synthesized
tgactggaatgtcatatttgag

SEQ ID NO: 891052 - DNA, 22 bp, Artificial Sequence
  chemically synthesized
gactggaatgtcatatttgaga

SEQ ID NO: 891053 - DNA, 22 bp, Artificial Sequence
  chemically synthesized
tatgcacttaattctcaaatat

SEQ ID NO: 891054 - DNA, 22 bp, Artificial Sequence
  chemically synthesized
actggaatgtcatatttgagaa

SEQ ID NO: 891055 - DNA, 22 bp, Artificial Sequence
  chemically synthesized
actctatgcacttaattctcaa

SEQ ID NO: 891056 - DNA, 22 bp, Artificial Sequence
  chemically synthesized
gaatgtcatatttgagaattaa

SEQ ID NO: 891057 - DNA, 22 bp, Artificial Sequence
  chemically synthesized
gtcacatctgactctatgcact

SEQ ID NO: 891058 - DNA, 22 bp, Artificial Sequence
  chemically synthesized
gagaattaagtgcatagagtca

SEQ ID NO: 891059 - DNA, 22 bp, Artificial Sequence
  chemically synthesized
agaattaagtgcatagagtcag

SEQ ID NO: 891060 - DNA, 22 bp, Artificial Sequence
  chemically synthesized
aaactggtcacatctgactcta

SEQ ID NO: 891061 - DNA, 22 bp, Artificial Sequence
  chemically synthesized
aaaactggtcacatctgactct

SEQ ID NO: 891062 - DNA, 22 bp, Artificial Sequence
  chemically synthesized
cttaaaactggtcacatctgac

SEQ ID NO: 891063 - DNA, 22 bp, Artificial Sequence
  chemically synthesized
agtgcatagagtcagatgtgac

SEQ ID NO: 891064 - DNA, 22 bp, Artificial Sequence
  chemically synthesized
catatagtcaagagtagctcct

SEQ ID NO: 891065 - DNA, 22 bp, Artificial Sequence
  chemically synthesized
gctccatatagtcaagagtagc

SEQ ID NO: 891066 - DNA, 22 bp, Artificial Sequence
  chemically synthesized
tattagctccatatagtcaaga

SEQ ID NO: 891067 - DNA, 22 bp, Artificial Sequence
  chemically synthesized
taaggagctactcttgactata

SEQ ID NO: 891068 - DNA, 22 bp, Artificial Sequence
  chemically synthesized
atattagctccatatagtcaag

SEQ ID NO: 891069 - DNA, 22 bp, Artificial Sequence
  chemically synthesized
aaggagctactcttgactatat

SEQ ID NO: 891070 - DNA, 22 bp, Artificial Sequence
  chemically synthesized
aggagctactcttgactatatg

SEQ ID NO: 891071 - DNA, 22 bp, Artificial Sequence
  chemically synthesized
ctcttgactatatggagctaat

SEQ ID NO: 891072 - DNA, 22 bp, Artificial Sequence
  chemically synthesized
ttgactatatggagctaatata

SEQ ID NO: 891073 - DNA, 22 bp, Artificial Sequence
  chemically synthesized
ccaaaaggggcttatattagct

SEQ ID NO: 891074 - DNA, 22 bp, Artificial Sequence
  chemically synthesized
cccaaaaggggcttatattagc

SEQ ID NO: 891075 - DNA, 22 bp, Artificial Sequence
  chemically synthesized
gactatatggagctaatataag

SEQ ID NO: 891076 - DNA, 22 bp, Artificial Sequence
  chemically synthesized
tcccaaaaggggcttatattag

SEQ ID NO: 891077 - DNA, 22 bp, Artificial Sequence
  chemically synthesized
actatatggagctaatataagc

SEQ ID NO: 891078 - DNA, 22 bp, Artificial Sequence
  chemically synthesized
tatggagctaatataagcccct

SEQ ID NO: 891079 - DNA, 22 bp, Artificial Sequence
  chemically synthesized
atataagccccttttgggaaaa

SEQ ID NO: 891080 - DNA, 22 bp, Artificial Sequence
  chemically synthesized
taagccaggtaccgggacagtt

SEQ ID NO: 891081 - DNA, 22 bp, Artificial Sequence
  chemically synthesized
tgtaagccaggtaccgggacag

SEQ ID NO: 891082 - DNA, 22 bp, Artificial Sequence
  chemically synthesized
ttgggaaaactgtcccggtacc

SEQ ID NO: 891083 - DNA, 22 bp, Artificial Sequence
  chemically synthesized
tgggaaaactgtcccggtacct

SEQ ID NO: 891084 - DNA, 22 bp, Artificial Sequence
  chemically synthesized
gggaaaactgtcccggtacctg

SEQ ID NO: 891085 - DNA, 22 bp, Artificial Sequence
  chemically synthesized
ggaaaactgtcccggtacctgg

SEQ ID NO: 891086 - DNA, 22 bp, Artificial Sequence
  chemically synthesized
ggaattctgtaagccaggtacc

SEQ ID NO: 891087 - DNA, 22 bp, Artificial Sequence
  chemically synthesized
tcccggtacctggcttacagaa

SEQ ID NO: 891088 - DNA, 22 bp, Artificial Sequence
  chemically synthesized
taagattgggaattctgtaagc

SEQ ID NO: 891089 - DNA, 22 bp, Artificial Sequence
  chemically synthesized
agttgtaagattgggaattctg

SEQ ID NO: 891090 - DNA, 22 bp, Artificial Sequence
  chemically synthesized
ctcagttgtaagattgggaatt

SEQ ID NO: 891091 - DNA, 22 bp, Artificial Sequence
  chemically synthesized
actcagttgtaagattgggaat

SEQ ID NO: 891092 - DNA, 22 bp, Artificial Sequence
  chemically synthesized
gcttacagaattcccaatctta

SEQ ID NO: 891093 - DNA, 22 bp, Artificial Sequence
  chemically synthesized
cttactcagttgtaagattggg

SEQ ID NO: 891094 - DNA, 22 bp, Artificial Sequence
  chemically synthesized
ccttactcagttgtaagattgg

SEQ ID NO: 891095 - DNA, 22 bp, Artificial Sequence
  chemically synthesized
acagaattcccaatcttacaac

SEQ ID NO: 891096 - DNA, 22 bp, Artificial Sequence
  chemically synthesized
cagaattcccaatcttacaact

SEQ ID NO: 891097 - DNA, 22 bp, Artificial Sequence
  chemically synthesized
ccaatcttacaactgagtaagg

SEQ ID NO: 891098 - DNA, 22 bp, Artificial Sequence
  chemically synthesized
agaatagaccttccttactcag

SEQ ID NO: 891099 - DNA, 22 bp, Artificial Sequence
  chemically synthesized
ctaagaatagaccttccttact

SEQ ID NO: 891100 - DNA, 22 bp, Artificial Sequence
  chemically synthesized
acaactgagtaaggaaggtcta

SEQ ID NO: 891101 - DNA, 22 bp, Artificial Sequence
  chemically synthesized
caactgagtaaggaaggtctat

SEQ ID NO: 891102 - DNA, 22 bp, Artificial Sequence
  chemically synthesized
ggtctcctaagaatagaccttc

SEQ ID NO: 891103 - DNA, 22 bp, Artificial Sequence
  chemically synthesized
ctgggtctcctaagaatagacc

SEQ ID NO: 891104 - DNA, 22 bp, Artificial Sequence
  chemically synthesized
cctgggtctcctaagaatagac

SEQ ID NO: 891105 - DNA, 22 bp, Artificial Sequence
  chemically synthesized
agtaaggaaggtctattcttag

SEQ ID NO: 891106 - DNA, 22 bp, Artificial Sequence
  chemically synthesized
gtttcctgggtctcctaagaat

SEQ ID NO: 891107 - DNA, 22 bp, Artificial Sequence
  chemically synthesized
ggtttcctgggtctcctaagaa

SEQ ID NO: 891108 - DNA, 22 bp, Artificial Sequence
  chemically synthesized
aaatacccttggtttcctgggt

SEQ ID NO: 891109 - DNA, 22 bp, Artificial Sequence
  chemically synthesized
ttcttaggagacccaggaaacc

SEQ ID NO: 891110 - DNA, 22 bp, Artificial Sequence
  chemically synthesized
ctaaaatacccttggtttcctg

SEQ ID NO: 891111 - DNA, 22 bp, Artificial Sequence
  chemically synthesized
ttaggagacccaggaaaccaag

SEQ ID NO: 891112 - DNA, 22 bp, Artificial Sequence
  chemically synthesized
aggagacccaggaaaccaaggg

SEQ ID NO: 891113 - DNA, 22 bp, Artificial Sequence
  chemically synthesized
ggagacccaggaaaccaagggt

SEQ ID NO: 891114 - DNA, 22 bp, Artificial Sequence
  chemically synthesized
caggttcctaaaatacccttgg

SEQ ID NO: 891115 - DNA, 22 bp, Artificial Sequence
  chemically synthesized
ccaggttcctaaaatacccttg

SEQ ID NO: 891116 - DNA, 22 bp, Artificial Sequence
  chemically synthesized
tccaggttcctaaaataccctt

SEQ ID NO: 891117 - DNA, 22 bp, Artificial Sequence
  chemically synthesized
ttttccaggttcctaaaatacc

SEQ ID NO: 891118 - DNA, 22 bp, Artificial Sequence
  chemically synthesized
tgttttccaggttcctaaaata

SEQ ID NO: 891119 - DNA, 22 bp, Artificial Sequence
  chemically synthesized
aagtgttctgttttccaggttc

SEQ ID NO: 891120 - DNA, 22 bp, Artificial Sequence
  chemically synthesized
agctgaagtgttctgttttcca

SEQ ID NO: 891121 - DNA, 22 bp, Artificial Sequence
  chemically synthesized
taggaacctggaaaacagaaca

SEQ ID NO: 891122 - DNA, 22 bp, Artificial Sequence
  chemically synthesized
aggaacctggaaaacagaacac

SEQ ID NO: 891123 - DNA, 22 bp, Artificial Sequence
  chemically synthesized
ggaacctggaaaacagaacact

SEQ ID NO: 891124 - DNA, 22 bp, Artificial Sequence
  chemically synthesized
tagattcagctgaagtgttctg

SEQ ID NO: 891125 - DNA, 22 bp, Artificial Sequence
  chemically synthesized
gaaaacagaacacttcagctga

SEQ ID NO: 891126 - DNA, 22 bp, Artificial Sequence
  chemically synthesized
aagtaaaatacctatagattca

SEQ ID NO: 891127 - DNA, 22 bp, Artificial Sequence
  chemically synthesized
cctgaagtaaaatacctataga

SEQ ID NO: 891128 - DNA, 22 bp, Artificial Sequence
  chemically synthesized
acctgaagtaaaatacctatag

SEQ ID NO: 891129 - DNA, 22 bp, Artificial Sequence
  chemically synthesized
tacctgaagtaaaatacctata

SEQ ID NO: 891130 - DNA, 22 bp, Artificial Sequence
  chemically synthesized
cagctgaatctataggtatttt

SEQ ID NO: 891131 - DNA, 22 bp, Artificial Sequence
  chemically synthesized
agctgaatctataggtatttta

SEQ ID NO: 891132 - DNA, 22 bp, Artificial Sequence
  chemically synthesized
aatctataggtattttacttca

SEQ ID NO: 891133 - DNA, 22 bp, Artificial Sequence
  chemically synthesized
acatcagattttacctgaagta

SEQ ID NO: 891134 - DNA, 22 bp, Artificial Sequence
  chemically synthesized
gacatcagattttacctgaagt

SEQ ID NO: 891135 - DNA, 22 bp, Artificial Sequence
  chemically synthesized
taggtattttacttcaggtaaa

SEQ ID NO: 891136 - DNA, 22 bp, Artificial Sequence
  chemically synthesized
tacttcaggtaaaatctgatgt

SEQ ID NO: 891137 - DNA, 22 bp, Artificial Sequence
  chemically synthesized
acttcaggtaaaatctgatgtc

SEQ ID NO: 891138 - DNA, 22 bp, Artificial Sequence
  chemically synthesized
cttcaggtaaaatctgatgtca

SEQ ID NO: 891139 - DNA, 22 bp, Artificial Sequence
  chemically synthesized
caggtaaaatctgatgtcaagt

SEQ ID NO: 891140 - DNA, 22 bp, Artificial Sequence
  chemically synthesized
aggtaaaatctgatgtcaagtt

SEQ ID NO: 891141 - DNA, 22 bp, Artificial Sequence
  chemically synthesized
ggaaggcaagtcaagaacttga

SEQ ID NO: 891142 - DNA, 22 bp, Artificial Sequence
  chemically synthesized
aggaaggcaagtcaagaacttg

SEQ ID NO: 891143 - DNA, 22 bp, Artificial Sequence
  chemically synthesized
atgtcaagttcttgacttgcct

SEQ ID NO: 891144 - DNA, 22 bp, Artificial Sequence
  chemically synthesized
caaagtttaggaaggcaagtca

SEQ ID NO: 891145 - DNA, 22 bp, Artificial Sequence
  chemically synthesized
aaagtctccaaagtttaggaag

SEQ ID NO: 891146 - DNA, 22 bp, Artificial Sequence
  chemically synthesized
aaaagtctccaaagtttaggaa

SEQ ID NO: 891147 - DNA, 22 bp, Artificial Sequence
  chemically synthesized
taaaagtctccaaagtttagga

SEQ ID NO: 891148 - DNA, 22 bp, Artificial Sequence
  chemically synthesized
ttgacttgccttcctaaacttt

SEQ ID NO: 891149 - DNA, 22 bp, Artificial Sequence
  chemically synthesized
ttaaaagtctccaaagtttagg

SEQ ID NO: 891150 - DNA, 22 bp, Artificial Sequence
  chemically synthesized
tttaaaagtctccaaagtttag

SEQ ID NO: 891151 - DNA, 22 bp, Artificial Sequence
  chemically synthesized
gacttgccttcctaaactttgg

SEQ ID NO: 891152 - DNA, 22 bp, Artificial Sequence
  chemically synthesized
acttgccttcctaaactttgga

SEQ ID NO: 891153 - DNA, 22 bp, Artificial Sequence
  chemically synthesized
attttttaaaagtctccaaagt

SEQ ID NO: 891154 - DNA, 22 bp, Artificial Sequence
  chemically synthesized
gattttttaaaagtctccaaag

SEQ ID NO: 891155 - DNA, 22 bp, Artificial Sequence
  chemically synthesized
gccttcctaaactttggagact

SEQ ID NO: 891156 - DNA, 22 bp, Artificial Sequence
  chemically synthesized
ccttcctaaactttggagactt

SEQ ID NO: 891157 - DNA, 22 bp, Artificial Sequence
  chemically synthesized
cctaaactttggagacttttaa

SEQ ID NO: 891158 - DNA, 22 bp, Artificial Sequence
  chemically synthesized
agatttgattttttaaaagtct

SEQ ID NO: 891159 - DNA, 22 bp, Artificial Sequence
  chemically synthesized
ctaaactttggagacttttaaa

SEQ ID NO: 891160 - DNA, 22 bp, Artificial Sequence
  chemically synthesized
aactttggagacttttaaaaaa

SEQ ID NO: 891161 - DNA, 22 bp, Artificial Sequence
  chemically synthesized
tggagacttttaaaaaatcaaa

SEQ ID NO: 891162 - DNA, 22 bp, Artificial Sequence
  chemically synthesized
ggagacttttaaaaaatcaaat

SEQ ID NO: 891163 - DNA, 22 bp, Artificial Sequence
  chemically synthesized
gagacttttaaaaaatcaaatc

SEQ ID NO: 891164 - DNA, 22 bp, Artificial Sequence
  chemically synthesized
aaaaatatgaaacctcagattt

SEQ ID NO: 891165 - DNA, 22 bp, Artificial Sequence
  chemically synthesized
aaaaaatatgaaacctcagatt

SEQ ID NO: 891166 - DNA, 22 bp, Artificial Sequence
  chemically synthesized
ttaaaaaatcaaatctgaggtt

SEQ ID NO: 891167 - DNA, 22 bp, Artificial Sequence
  chemically synthesized
taaaaaatcaaatctgaggttt

SEQ ID NO: 891168 - DNA, 22 bp, Artificial Sequence
  chemically synthesized
aaaaaatcaaatctgaggtttc

SEQ ID NO: 891169 - DNA, 22 bp, Artificial Sequence
  chemically synthesized
aaaaatcaaatctgaggtttca

SEQ ID NO: 891170 - DNA, 22 bp, Artificial Sequence
  chemically synthesized
aataaagtagtttaaaaaatat

SEQ ID NO: 891171 - DNA, 22 bp, Artificial Sequence
  chemically synthesized
aggtttcatattttttaaacta

SEQ ID NO: 891172 - DNA, 22 bp, Artificial Sequence
  chemically synthesized
catattttttaaactactttat

SEQ ID NO: 891173 - DNA, 22 bp, Artificial Sequence
  chemically synthesized
atattttttaaactactttatt

SEQ ID NO: 891174 - DNA, 22 bp, Artificial Sequence
  chemically synthesized
tcaatcatacctcaataaagta

SEQ ID NO: 891175 - DNA, 22 bp, Artificial Sequence
  chemically synthesized
gtcaatcatacctcaataaagt

SEQ ID NO: 891176 - DNA, 22 bp, Artificial Sequence
  chemically synthesized
tttgtcaatcatacctcaataa

SEQ ID NO: 891177 - DNA, 22 bp, Artificial Sequence
  chemically synthesized
tttaaactactttattgaggta

SEQ ID NO: 891178 - DNA, 22 bp, Artificial Sequence
  chemically synthesized
ttaaactactttattgaggtat

SEQ ID NO: 891179 - DNA, 22 bp, Artificial Sequence
  chemically synthesized
tgtttgtcaatcatacctcaat

SEQ ID NO: 891180 - DNA, 22 bp, Artificial Sequence
  chemically synthesized
taaactactttattgaggtatg

SEQ ID NO: 891181 - DNA, 22 bp, Artificial Sequence
  chemically synthesized
ctgtttgtcaatcatacctcaa

SEQ ID NO: 891182 - DNA, 22 bp, Artificial Sequence
  chemically synthesized
aaactactttattgaggtatga

SEQ ID NO: 891183 - DNA, 22 bp, Artificial Sequence
  chemically synthesized
tctgtttgtcaatcatacctca

SEQ ID NO: 891184 - DNA, 22 bp, Artificial Sequence
  chemically synthesized
aactactttattgaggtatgat

SEQ ID NO: 891185 - DNA, 22 bp, Artificial Sequence
  chemically synthesized
ctttattgaggtatgattgaca

SEQ ID NO: 891186 - DNA, 22 bp, Artificial Sequence
  chemically synthesized
tattgaggtatgattgacaaac

SEQ ID NO: 891187 - DNA, 22 bp, Artificial Sequence
  chemically synthesized
attgaggtatgattgacaaaca

SEQ ID NO: 891188 - DNA, 22 bp, Artificial Sequence
  chemically synthesized
ttgaggtatgattgacaaacag

SEQ ID NO: 891189 - DNA, 22 bp, Artificial Sequence
  chemically synthesized
aggtatgattgacaaacagaaa

SEQ ID NO: 891190 - DNA, 22 bp, Artificial Sequence
  chemically synthesized
aatatgtacagctttctgtttg

SEQ ID NO: 891191 - DNA, 22 bp, Artificial Sequence
  chemically synthesized
tgcattaaatatgtacagcttt

SEQ ID NO: 891192 - DNA, 22 bp, Artificial Sequence
  chemically synthesized
tatgcattaaatatgtacagct

SEQ ID NO: 891193 - DNA, 22 bp, Artificial Sequence
  chemically synthesized
acaaacagaaagctgtacatat

SEQ ID NO: 891194 - DNA, 22 bp, Artificial Sequence
  chemically synthesized
atcaagttctatgcattaaata

SEQ ID NO: 891195 - DNA, 22 bp, Artificial Sequence
  chemically synthesized
caaactcatcaagttctatgca

SEQ ID NO: 891196 - DNA, 22 bp, Artificial Sequence
  chemically synthesized
tacatatttaatgcatagaact

SEQ ID NO: 891197 - DNA, 22 bp, Artificial Sequence
  chemically synthesized
tctccaaactcatcaagttcta

SEQ ID NO: 891198 - DNA, 22 bp, Artificial Sequence
  chemically synthesized
atctccaaactcatcaagttct

SEQ ID NO: 891199 - DNA, 22 bp, Artificial Sequence
  chemically synthesized
tatctccaaactcatcaagttc

SEQ ID NO: 891200 - DNA, 22 bp, Artificial Sequence
  chemically synthesized
aatgcatagaacttgatgagtt

SEQ ID NO: 891201 - DNA, 22 bp, Artificial Sequence
  chemically synthesized
atgcatagaacttgatgagttt

SEQ ID NO: 891202 - DNA, 22 bp, Artificial Sequence
  chemically synthesized
tatatatactttatctccaaac

SEQ ID NO: 891203 - DNA, 22 bp, Artificial Sequence
  chemically synthesized
gtatatatactttatctccaaa

SEQ ID NO: 891204 - DNA, 22 bp, Artificial Sequence
  chemically synthesized
tgtatatatactttatctccaa

SEQ ID NO: 891205 - DNA, 22 bp, Artificial Sequence
  chemically synthesized
gttttgtatatatactttatct

SEQ ID NO: 891206 - DNA, 22 bp, Artificial Sequence
  chemically synthesized
gatgagtttggagataaagtat

SEQ ID NO: 891207 - DNA, 22 bp, Artificial Sequence
  chemically synthesized
atgagtttggagataaagtata

SEQ ID NO: 891208 - DNA, 22 bp, Artificial Sequence
  chemically synthesized
tggtattggttttgtatatata

SEQ ID NO: 891209 - DNA, 22 bp, Artificial Sequence
  chemically synthesized
ggagataaagtatatatacaaa

SEQ ID NO: 891210 - DNA, 22 bp, Artificial Sequence
  chemically synthesized
gagataaagtatatatacaaaa

SEQ ID NO: 891211 - DNA, 22 bp, Artificial Sequence
  chemically synthesized
tggcatagattgtggtattggt

SEQ ID NO: 891212 - DNA, 22 bp, Artificial Sequence
  chemically synthesized
atggcatagattgtggtattgg

SEQ ID NO: 891213 - DNA, 22 bp, Artificial Sequence
  chemically synthesized
gaggtaacgcataggtttatgg

SEQ ID NO: 891214 - DNA, 22 bp, Artificial Sequence
  chemically synthesized
ggaggtaacgcataggtttatg

SEQ ID NO: 891215 - DNA, 22 bp, Artificial Sequence
  chemically synthesized
tggaggtaacgcataggtttat

SEQ ID NO: 891216 - DNA, 22 bp, Artificial Sequence
  chemically synthesized
ttggaggtaacgcataggttta

SEQ ID NO: 891217 - DNA, 22 bp, Artificial Sequence
  chemically synthesized
tgccataaacctatgcgttacc

SEQ ID NO: 891218 - DNA, 22 bp, Artificial Sequence
  chemically synthesized
tgcgttacctccaaaagtttcc

SEQ ID NO: 891219 - DNA, 22 bp, Artificial Sequence
  chemically synthesized
cctccaaaagtttcctctcacc

SEQ ID NO: 891220 - DNA, 22 bp, Artificial Sequence
  chemically synthesized
caaaagtttcctctcaccttat

SEQ ID NO: 891221 - DNA, 22 bp, Artificial Sequence
  chemically synthesized
ggagcagtggtacataaggtga

SEQ ID NO: 891222 - DNA, 22 bp, Artificial Sequence
  chemically synthesized
aggagcagtggtacataaggtg

SEQ ID NO: 891223 - DNA, 22 bp, Artificial Sequence
  chemically synthesized
taggagcagtggtacataaggt

SEQ ID NO: 891224 - DNA, 22 bp, Artificial Sequence
  chemically synthesized
ttaggagcagtggtacataagg

SEQ ID NO: 891225 - DNA, 22 bp, Artificial Sequence
  chemically synthesized
ttttaggagcagtggtacataa

SEQ ID NO: 891226 - DNA, 22 bp, Artificial Sequence
  chemically synthesized
tcttttaggagcagtggtacat

SEQ ID NO: 891227 - DNA, 22 bp, Artificial Sequence
  chemically synthesized
cctctcaccttatgtaccactg

SEQ ID NO: 891228 - DNA, 22 bp, Artificial Sequence
  chemically synthesized
ctctcaccttatgtaccactgc

SEQ ID NO: 891229 - DNA, 22 bp, Artificial Sequence
  chemically synthesized
ctctcttttaggagcagtggta

SEQ ID NO: 891230 - DNA, 22 bp, Artificial Sequence
  chemically synthesized
tcaccttatgtaccactgctcc

SEQ ID NO: 891231 - DNA, 22 bp, Artificial Sequence
  chemically synthesized
ctactctcttttaggagcagtg

SEQ ID NO: 891232 - DNA, 22 bp, Artificial Sequence
  chemically synthesized
accttatgtaccactgctccta

SEQ ID NO: 891233 - DNA, 22 bp, Artificial Sequence
  chemically synthesized
atgtaccactgctcctaaaaga

SEQ ID NO: 891234 - DNA, 22 bp, Artificial Sequence
  chemically synthesized
tgtaccactgctcctaaaagag

SEQ ID NO: 891235 - DNA, 22 bp, Artificial Sequence
  chemically synthesized
ccacaaaatactactactctct

SEQ ID NO: 891236 - DNA, 22 bp, Artificial Sequence
  chemically synthesized
accacaaaatactactactctc

SEQ ID NO: 891237 - DNA, 22 bp, Artificial Sequence
  chemically synthesized
ttaccacaaaatactactactc

SEQ ID NO: 891238 - DNA, 22 bp, Artificial Sequence
  chemically synthesized
ctcctaaaagagagtagtagta

SEQ ID NO: 891239 - DNA, 22 bp, Artificial Sequence
  chemically synthesized
ctaaaagagagtagtagtattt

SEQ ID NO: 891240 - DNA, 22 bp, Artificial Sequence
  chemically synthesized
aaagagagtagtagtattttgt

SEQ ID NO: 891241 - DNA, 22 bp, Artificial Sequence
  chemically synthesized
agtgttcttaccacaaaatact

SEQ ID NO: 891242 - DNA, 22 bp, Artificial Sequence
  chemically synthesized
aagtgttcttaccacaaaatac

SEQ ID NO: 891243 - DNA, 22 bp, Artificial Sequence
  chemically synthesized
agggcagagtttaagtgttctt

SEQ ID NO: 891244 - DNA, 22 bp, Artificial Sequence
  chemically synthesized
ctgagggcagagtttaagtgtt

SEQ ID NO: 891245 - DNA, 22 bp, Artificial Sequence
  chemically synthesized
gctgagggcagagtttaagtgt

SEQ ID NO: 891246 - DNA, 22 bp, Artificial Sequence
  chemically synthesized
tgtggtaagaacacttaaactc

SEQ ID NO: 891247 - DNA, 22 bp, Artificial Sequence
  chemically synthesized
gtggtaagaacacttaaactct

SEQ ID NO: 891248 - DNA, 22 bp, Artificial Sequence
  chemically synthesized
tggtaagaacacttaaactctg

SEQ ID NO: 891249 - DNA, 22 bp, Artificial Sequence
  chemically synthesized
gaaatttgctgagggcagagtt

SEQ ID NO: 891250 - DNA, 22 bp, Artificial Sequence
  chemically synthesized
tacaattagaaatttgctgagg

SEQ ID NO: 891251 - DNA, 22 bp, Artificial Sequence
  chemically synthesized
aaactctgccctcagcaaattt

SEQ ID NO: 891252 - DNA, 22 bp, Artificial Sequence
  chemically synthesized
aactctgccctcagcaaatttc

SEQ ID NO: 891253 - DNA, 22 bp, Artificial Sequence
  chemically synthesized
tactgtacaattagaaatttgc

SEQ ID NO: 891254 - DNA, 22 bp, Artificial Sequence
  chemically synthesized
tgccctcagcaaatttctaatt

SEQ ID NO: 891255 - DNA, 22 bp, Artificial Sequence
  chemically synthesized
ccctcagcaaatttctaattgt

SEQ ID NO: 891256 - DNA, 22 bp, Artificial Sequence
  chemically synthesized
acgatactgtactgtacaatta

SEQ ID NO: 891257 - DNA, 22 bp, Artificial Sequence
  chemically synthesized
agcaaatttctaattgtacagt

SEQ ID NO: 891258 - DNA, 22 bp, Artificial Sequence
  chemically synthesized
tagttaacgatactgtactgta

SEQ ID NO: 891259 - DNA, 22 bp, Artificial Sequence
  chemically synthesized
ctaattgtacagtacagtatcg

SEQ ID NO: 891260 - DNA, 22 bp, Artificial Sequence
  chemically synthesized
taattgtacagtacagtatcgt

SEQ ID NO: 891261 - DNA, 22 bp, Artificial Sequence
  chemically synthesized
attgtacagtacagtatcgtta

SEQ ID NO: 891262 - DNA, 22 bp, Artificial Sequence
  chemically synthesized
tacagtacagtatcgttaacta

SEQ ID NO: 891263 - DNA, 22 bp, Artificial Sequence
  chemically synthesized
tacagcatagtgcctatagtta

SEQ ID NO: 891264 - DNA, 22 bp, Artificial Sequence
  chemically synthesized
agagatatactgtacagcatag

SEQ ID NO: 891265 - DNA, 22 bp, Artificial Sequence
  chemically synthesized
cagagatatactgtacagcata

SEQ ID NO: 891266 - DNA, 22 bp, Artificial Sequence
  chemically synthesized
actataggcactatgctgtaca

SEQ ID NO: 891267 - DNA, 22 bp, Artificial Sequence
  chemically synthesized
taggcactatgctgtacagtat

SEQ ID NO: 891268 - DNA, 22 bp, Artificial Sequence
  chemically synthesized
aataagtttcagagatatactg

SEQ ID NO: 891269 - DNA, 22 bp, Artificial Sequence
  chemically synthesized
tgctgtacagtatatctctgaa

SEQ ID NO: 891270 - DNA, 22 bp, Artificial Sequence
  chemically synthesized
tacagtatatctctgaaactta

SEQ ID NO: 891271 - DNA, 22 bp, Artificial Sequence
  chemically synthesized
atgaagaatcacaagctgaata

SEQ ID NO: 891272 - DNA, 22 bp, Artificial Sequence
  chemically synthesized
catgaagaatcacaagctgaat

SEQ ID NO: 891273 - DNA, 22 bp, Artificial Sequence
  chemically synthesized
tcatgaagaatcacaagctgaa

SEQ ID NO: 891274 - DNA, 22 bp, Artificial Sequence
  chemically synthesized
tgaaacttattcagcttgtgat

SEQ ID NO: 891275 - DNA, 22 bp, Artificial Sequence
  chemically synthesized
aaacttattcagcttgtgattc

SEQ ID NO: 891276 - DNA, 22 bp, Artificial Sequence
  chemically synthesized
gaagttttcatgaagaatcaca

SEQ ID NO: 891277 - DNA, 22 bp, Artificial Sequence
  chemically synthesized
attcagcttgtgattcttcatg

SEQ ID NO: 891278 - DNA, 22 bp, Artificial Sequence
  chemically synthesized
gctggaagttttcatgaagaat

SEQ ID NO: 891279 - DNA, 22 bp, Artificial Sequence
  chemically synthesized
ttcagcttgtgattcttcatga

SEQ ID NO: 891280 - DNA, 22 bp, Artificial Sequence
  chemically synthesized
agcttgtgattcttcatgaaaa

SEQ ID NO: 891281 - DNA, 22 bp, Artificial Sequence
  chemically synthesized
gtgattcttcatgaaaacttcc

SEQ ID NO: 891282 - DNA, 22 bp, Artificial Sequence
  chemically synthesized
tgattcttcatgaaaacttcca

SEQ ID NO: 891283 - DNA, 22 bp, Artificial Sequence
  chemically synthesized
agtgtgattagctggaagtttt

SEQ ID NO: 891284 - DNA, 22 bp, Artificial Sequence
  chemically synthesized
aagtgtgattagctggaagttt

SEQ ID NO: 891285 - DNA, 22 bp, Artificial Sequence
  chemically synthesized
taagtgtgattagctggaagtt

SEQ ID NO: 891286 - DNA, 22 bp, Artificial Sequence
  chemically synthesized
ttttaagtgtgattagctggaa

SEQ ID NO: 891287 - DNA, 22 bp, Artificial Sequence
  chemically synthesized
ttcatgaaaacttccagctaat

SEQ ID NO: 891288 - DNA, 22 bp, Artificial Sequence
  chemically synthesized
catgaaaacttccagctaatca

SEQ ID NO: 891289 - DNA, 22 bp, Artificial Sequence
  chemically synthesized
atgaaaacttccagctaatcac

SEQ ID NO: 891290 - DNA, 22 bp, Artificial Sequence
  chemically synthesized
ccaaataggctattttaagtgt

SEQ ID NO: 891291 - DNA, 22 bp, Artificial Sequence
  chemically synthesized
accaaataggctattttaagtg

SEQ ID NO: 891292 - DNA, 22 bp, Artificial Sequence
  chemically synthesized
ccagctaatcacacttaaaata

SEQ ID NO: 891293 - DNA, 22 bp, Artificial Sequence
  chemically synthesized
cagctaatcacacttaaaatag

SEQ ID NO: 891294 - DNA, 22 bp, Artificial Sequence
  chemically synthesized
atcacacttaaaatagcctatt

SEQ ID NO: 891295 - DNA, 22 bp, Artificial Sequence
  chemically synthesized
aaaatagcctatttggtaaatt

SEQ ID NO: 891296 - DNA, 22 bp, Artificial Sequence
  chemically synthesized
aaatagcctatttggtaaatta

SEQ ID NO: 891297 - DNA, 22 bp, Artificial Sequence
  chemically synthesized
tataggggtagcaaaaatggta

SEQ ID NO: 891298 - DNA, 22 bp, Artificial Sequence
  chemically synthesized
atataggggtagcaaaaatggt

SEQ ID NO: 891299 - DNA, 22 bp, Artificial Sequence
  chemically synthesized
tttggtaaattaccatttttgc

SEQ ID NO: 891300 - DNA, 22 bp, Artificial Sequence
  chemically synthesized
tttatataggggtagcaaaaat

SEQ ID NO: 891301 - DNA, 22 bp, Artificial Sequence
  chemically synthesized
ggtaaattaccatttttgctac

SEQ ID NO: 891302 - DNA, 22 bp, Artificial Sequence
  chemically synthesized
atttatataggggtagcaaaaa

SEQ ID NO: 891303 - DNA, 22 bp, Artificial Sequence
  chemically synthesized
gtaaattaccatttttgctacc

SEQ ID NO: 891304 - DNA, 22 bp, Artificial Sequence
  chemically synthesized
tttatttatataggggtagcaa

SEQ ID NO: 891305 - DNA, 22 bp, Artificial Sequence
  chemically synthesized
gcctatttatttatataggggt

SEQ ID NO: 891306 - DNA, 22 bp, Artificial Sequence
  chemically synthesized
ccatttttgctacccctatata

SEQ ID NO: 891307 - DNA, 22 bp, Artificial Sequence
  chemically synthesized
ttgctacccctatataaataaa

SEQ ID NO: 891308 - DNA, 22 bp, Artificial Sequence
  chemically synthesized
tgctacccctatataaataaat

SEQ ID NO: 891309 - DNA, 22 bp, Artificial Sequence
  chemically synthesized
gctacccctatataaataaata

SEQ ID NO: 891310 - DNA, 22 bp, Artificial Sequence
  chemically synthesized
ctacccctatataaataaatag

SEQ ID NO: 891311 - DNA, 22 bp, Artificial Sequence
  chemically synthesized
cccctatataaataaataggcc

SEQ ID NO: 891312 - DNA, 22 bp, Artificial Sequence
  chemically synthesized
taaaataagactggcctattta

SEQ ID NO: 891313 - DNA, 22 bp, Artificial Sequence
  chemically synthesized
ataaaataagactggcctattt

SEQ ID NO: 891314 - DNA, 22 bp, Artificial Sequence
  chemically synthesized
tttataaaataagactggccta

SEQ ID NO: 891315 - DNA, 22 bp, Artificial Sequence
  chemically synthesized
gtttataaaataagactggcct

SEQ ID NO: 891316 - DNA, 22 bp, Artificial Sequence
  chemically synthesized
tataaataaataggccagtctt

SEQ ID NO: 891317 - DNA, 22 bp, Artificial Sequence
  chemically synthesized
cttgtttataaaataagactgg

SEQ ID NO: 891318 - DNA, 22 bp, Artificial Sequence
  chemically synthesized
ccttgtttataaaataagactg

SEQ ID NO: 891319 - DNA, 22 bp, Artificial Sequence
  chemically synthesized
tccttgtttataaaataagact

SEQ ID NO: 891320 - DNA, 22 bp, Artificial Sequence
  chemically synthesized
atcaaagtaagactttccttgt

SEQ ID NO: 891321 - DNA, 22 bp, Artificial Sequence
  chemically synthesized
attttataaacaaggaaagtct

SEQ ID NO: 891322 - DNA, 22 bp, Artificial Sequence
  chemically synthesized
ttttataaacaaggaaagtctt

SEQ ID NO: 891323 - DNA, 22 bp, Artificial Sequence
  chemically synthesized
tataaacaaggaaagtcttact

SEQ ID NO: 891324 - DNA, 22 bp, Artificial Sequence
  chemically synthesized
ataaacaaggaaagtcttactt

SEQ ID NO: 891325 - DNA, 22 bp, Artificial Sequence
  chemically synthesized
taaacaaggaaagtcttacttt

SEQ ID NO: 891326 - DNA, 22 bp, Artificial Sequence
  chemically synthesized
atcagtgttaatcaaagtaaga

SEQ ID NO: 891327 - DNA, 22 bp, Artificial Sequence
  chemically synthesized
gatcagtgttaatcaaagtaag

SEQ ID NO: 891328 - DNA, 22 bp, Artificial Sequence
  chemically synthesized
tgatcagtgttaatcaaagtaa

SEQ ID NO: 891329 - DNA, 22 bp, Artificial Sequence
  chemically synthesized
ttgatcagtgttaatcaaagta

SEQ ID NO: 891330 - DNA, 22 bp, Artificial Sequence
  chemically synthesized
ccatcacccttttgatcagtgt

SEQ ID NO: 891331 - DNA, 22 bp, Artificial Sequence
  chemically synthesized
actttgattaacactgatcaaa

SEQ ID NO: 891332 - DNA, 22 bp, Artificial Sequence
  chemically synthesized
taccatcacccttttgatcagt

SEQ ID NO: 891333 - DNA, 22 bp, Artificial Sequence
  chemically synthesized
ctttgattaacactgatcaaaa

SEQ ID NO: 891334 - DNA, 22 bp, Artificial Sequence
  chemically synthesized
tgattaacactgatcaaaaggg

SEQ ID NO: 891335 - DNA, 22 bp, Artificial Sequence
  chemically synthesized
tctctaccatcacccttttgat

SEQ ID NO: 891336 - DNA, 22 bp, Artificial Sequence
  chemically synthesized
gattaacactgatcaaaagggt

SEQ ID NO: 891337 - DNA, 22 bp, Artificial Sequence
  chemically synthesized
attaacactgatcaaaagggtg

SEQ ID NO: 891338 - DNA, 22 bp, Artificial Sequence
  chemically synthesized
tatctctaccatcacccttttg

SEQ ID NO: 891339 - DNA, 22 bp, Artificial Sequence
  chemically synthesized
acactgatcaaaagggtgatgg

SEQ ID NO: 891340 - DNA, 22 bp, Artificial Sequence
  chemically synthesized
aaactctatctctaccatcacc

SEQ ID NO: 891341 - DNA, 22 bp, Artificial Sequence
  chemically synthesized
ctgaaactctatctctaccatc

SEQ ID NO: 891342 - DNA, 22 bp, Artificial Sequence
  chemically synthesized
atcaaaagggtgatggtagaga

SEQ ID NO: 891343 - DNA, 22 bp, Artificial Sequence
  chemically synthesized
ataaccccaagggttactgaaa

SEQ ID NO: 891344 - DNA, 22 bp, Artificial Sequence
  chemically synthesized
gaatctgataaccccaagggtt

SEQ ID NO: 891345 - DNA, 22 bp, Artificial Sequence
  chemically synthesized
cagtaacccttggggttatcag

SEQ ID NO: 891346 - DNA, 22 bp, Artificial Sequence
  chemically synthesized
agtaacccttggggttatcaga

SEQ ID NO: 891347 - DNA, 22 bp, Artificial Sequence
  chemically synthesized
ggggttatcagattctagtcct

SEQ ID NO: 891348 - DNA, 22 bp, Artificial Sequence
  chemically synthesized
gggttatcagattctagtcctg

SEQ ID NO: 891349 - DNA, 22 bp, Artificial Sequence
  chemically synthesized
tcagattctagtcctgttcatt

SEQ ID NO: 891350 - DNA, 22 bp, Artificial Sequence
  chemically synthesized
tagtcctgttcattgtctttga

SEQ ID NO: 891351 - DNA, 22 bp, Artificial Sequence
  chemically synthesized
gtcctgttcattgtctttgatc

SEQ ID NO: 891352 - DNA, 22 bp, Artificial Sequence
  chemically synthesized
caaagaaatgcaaaatagatca

SEQ ID NO: 891353 - DNA, 22 bp, Artificial Sequence
  chemically synthesized
ttcattgtctttgatctatttt

SEQ ID NO: 891354 - DNA, 22 bp, Artificial Sequence
  chemically synthesized
acaaagaaatgcaaaatagatc

SEQ ID NO: 891355 - DNA, 22 bp, Artificial Sequence
  chemically synthesized
attgtctttgatctattttgca

SEQ ID NO: 891356 - DNA, 22 bp, Artificial Sequence
  chemically synthesized
tctttgatctattttgcatttc

SEQ ID NO: 891357 - DNA, 22 bp, Artificial Sequence
  chemically synthesized
tgatctattttgcatttctttg

SEQ ID NO: 891358 - DNA, 22 bp, Artificial Sequence
  chemically synthesized
gatctattttgcatttctttgt

SEQ ID NO: 891359 - DNA, 22 bp, Artificial Sequence
  chemically synthesized
atctattttgcatttctttgta

SEQ ID NO: 891360 - DNA, 22 bp, Artificial Sequence
  chemically synthesized
ttttgcatttctttgtaaacga

SEQ ID NO: 891361 - DNA, 22 bp, Artificial Sequence
  chemically synthesized
tgcatttctttgtaaacgacat

SEQ ID NO: 891362 - DNA, 22 bp, Artificial Sequence
  chemically synthesized
gcatttctttgtaaacgacatg

SEQ ID NO: 891363 - DNA, 22 bp, Artificial Sequence
  chemically synthesized
catttctttgtaaacgacatga

SEQ ID NO: 891364 - DNA, 22 bp, Artificial Sequence
  chemically synthesized
ctttgtaaacgacatgattttt

SEQ ID NO: 891365 - DNA, 22 bp, Artificial Sequence
  chemically synthesized
tttgtaaacgacatgatttttt

SEQ ID NO: 891366 - DNA, 22 bp, Artificial Sequence
  chemically synthesized
tgtaaacgacatgatttttttt

SEQ ID NO: 891367 - DNA, 22 bp, Artificial Sequence
  chemically synthesized
gtaaacgacatgattttttttt

SEQ ID NO: 891368 - DNA, 22 bp, Artificial Sequence
  chemically synthesized
taaacgacatgatttttttttt

SEQ ID NO: 891369 - DNA, 22 bp, Artificial Sequence
  chemically synthesized
caggtaggtaaaaaaaaaaaaa

SEQ ID NO: 891370 - DNA, 22 bp, Artificial Sequence
  chemically synthesized
acaggtaggtaaaaaaaaaaaa

SEQ ID NO: 891371 - DNA, 22 bp, Artificial Sequence
  chemically synthesized
ttttttttttttttttacctac

SEQ ID NO: 891372 - DNA, 22 bp, Artificial Sequence
  chemically synthesized
tttttttttttttttacctacc

SEQ ID NO: 891373 - DNA, 22 bp, Artificial Sequence
  chemically synthesized
ttttttttttttttacctacct

SEQ ID NO: 891374 - DNA, 22 bp, Artificial Sequence
  chemically synthesized
tttttttttttttacctacctg

SEQ ID NO: 891375 - DNA, 22 bp, Artificial Sequence
  chemically synthesized
ttttttttttttacctacctgt

SEQ ID NO: 891376 - DNA, 22 bp, Artificial Sequence
  chemically synthesized
tttttttttttacctacctgta

SEQ ID NO: 891377 - DNA, 22 bp, Artificial Sequence
  chemically synthesized
ttttttttttacctacctgtaa

SEQ ID NO: 891378 - DNA, 22 bp, Artificial Sequence
  chemically synthesized
tttttttttacctacctgtaaa

SEQ ID NO: 891379 - DNA, 22 bp, Artificial Sequence
  chemically synthesized
ttttttttacctacctgtaaat

SEQ ID NO: 891380 - DNA, 22 bp, Artificial Sequence
  chemically synthesized
tttttttacctacctgtaaatt

SEQ ID NO: 891381 - DNA, 22 bp, Artificial Sequence
  chemically synthesized
ttttttacctacctgtaaattg

SEQ ID NO: 891382 - DNA, 22 bp, Artificial Sequence
  chemically synthesized
tttttacctacctgtaaattga

SEQ ID NO: 891383 - DNA, 22 bp, Artificial Sequence
  chemically synthesized
ttttacctacctgtaaattgat

SEQ ID NO: 891384 - DNA, 22 bp, Artificial Sequence
  chemically synthesized
tttacctacctgtaaattgatc

SEQ ID NO: 891385 - DNA, 22 bp, Artificial Sequence
  chemically synthesized
ttacctacctgtaaattgatct

SEQ ID NO: 891386 - DNA, 22 bp, Artificial Sequence
  chemically synthesized
tacctacctgtaaattgatctg

SEQ ID NO: 891387 - DNA, 22 bp, Artificial Sequence
  chemically synthesized
acctacctgtaaattgatctgg

SEQ ID NO: 891388 - DNA, 22 bp, Artificial Sequence
  chemically synthesized
cctacctgtaaattgatctgga

SEQ ID NO: 891389 - DNA, 22 bp, Artificial Sequence
  chemically synthesized
cctgtaaattgatctggatcct

SEQ ID NO: 891390 - DNA, 22 bp, Artificial Sequence
  chemically synthesized
taaattgatctggatcctgctg

SEQ ID NO: 891391 - DNA, 22 bp, Artificial Sequence
  chemically synthesized
atctggatcctgctgtcttaca

SEQ ID NO: 891392 - DNA, 22 bp, Artificial Sequence
  chemically synthesized
gatcctgctgtcttacacattt

SEQ ID NO: 891393 - DNA, 22 bp, Artificial Sequence
  chemically synthesized
gtaaggacggacaaaatgtgta

SEQ ID NO: 891394 - DNA, 22 bp, Artificial Sequence
  chemically synthesized
ctgtcttacacattttgtccgt

SEQ ID NO: 891395 - DNA, 22 bp, Artificial Sequence
  chemically synthesized
aaaattggtaaggacggacaaa

SEQ ID NO: 891396 - DNA, 22 bp, Artificial Sequence
  chemically synthesized
tcttacacattttgtccgtcct

SEQ ID NO: 891397 - DNA, 22 bp, Artificial Sequence
  chemically synthesized
acacattttgtccgtccttacc

SEQ ID NO: 891398 - DNA, 22 bp, Artificial Sequence
  chemically synthesized
cacattttgtccgtccttacca

SEQ ID NO: 891399 - DNA, 22 bp, Artificial Sequence
  chemically synthesized
tgtccgtccttaccaattttca

SEQ ID NO: 891400 - DNA, 22 bp, Artificial Sequence
  chemically synthesized
gtccgtccttaccaattttcag

SEQ ID NO: 891401 - DNA, 22 bp, Artificial Sequence
  chemically synthesized
tccgtccttaccaattttcagt

SEQ ID NO: 891402 - DNA, 22 bp, Artificial Sequence
  chemically synthesized
taaaggaaataaactgaaaatt

SEQ ID NO: 891403 - DNA, 22 bp, Artificial Sequence
  chemically synthesized
accaattttcagtttatttcct

SEQ ID NO: 891404 - DNA, 22 bp, Artificial Sequence
  chemically synthesized
ccaattttcagtttatttcctt

SEQ ID NO: 891405 - DNA, 22 bp, Artificial Sequence
  chemically synthesized
tcagtttatttcctttacaatc

SEQ ID NO: 891406 - DNA, 22 bp, Artificial Sequence
  chemically synthesized
cagtttatttcctttacaatct

SEQ ID NO: 891407 - DNA, 22 bp, Artificial Sequence
  chemically synthesized
agtttatttcctttacaatctg

SEQ ID NO: 891408 - DNA, 22 bp, Artificial Sequence
  chemically synthesized
gagaatcgcagccagattgtaa

SEQ ID NO: 891409 - DNA, 22 bp, Artificial Sequence
  chemically synthesized
ggagaatcgcagccagattgta

SEQ ID NO: 891410 - DNA, 22 bp, Artificial Sequence
  chemically synthesized
atttcctttacaatctggctgc

SEQ ID NO: 891411 - DNA, 22 bp, Artificial Sequence
  chemically synthesized
atttggagaatcgcagccagat

SEQ ID NO: 891412 - DNA, 22 bp, Artificial Sequence
  chemically synthesized
tttcctttacaatctggctgcg

SEQ ID NO: 891413 - DNA, 22 bp, Artificial Sequence
  chemically synthesized
cctttacaatctggctgcgatt

SEQ ID NO: 891414 - DNA, 22 bp, Artificial Sequence
  chemically synthesized
ctttacaatctggctgcgattc

SEQ ID NO: 891415 - DNA, 22 bp, Artificial Sequence
  chemically synthesized
tacaatctggctgcgattctcc

SEQ ID NO: 891416 - DNA, 22 bp, Artificial Sequence
  chemically synthesized
aaatgttaatttggagaatcgc

SEQ ID NO: 891417 - DNA, 22 bp, Artificial Sequence
  chemically synthesized
acaatctggctgcgattctcca

SEQ ID NO: 891418 - DNA, 22 bp, Artificial Sequence
  chemically synthesized
gaaatgttaatttggagaatcg

SEQ ID NO: 891419 - DNA, 22 bp, Artificial Sequence
  chemically synthesized
caatctggctgcgattctccaa

SEQ ID NO: 891420 - DNA, 22 bp, Artificial Sequence
  chemically synthesized
gctgcgattctccaaattaaca

SEQ ID NO: 891421 - DNA, 22 bp, Artificial Sequence
  chemically synthesized
cgattctccaaattaacatttc

SEQ ID NO: 891422 - DNA, 22 bp, Artificial Sequence
  chemically synthesized
tccaaattaacatttcaaattt

SEQ ID NO: 891423 - DNA, 22 bp, Artificial Sequence
  chemically synthesized
caaattaacatttcaaattttt

SEQ ID NO: 891424 - DNA, 22 bp, Artificial Sequence
  chemically synthesized
acatttcaaatttttctcccac

SEQ ID NO: 891425 - DNA, 22 bp, Artificial Sequence
  chemically synthesized
caaatttttctcccaccatcct

SEQ ID NO: 891426 - DNA, 22 bp, Artificial Sequence
  chemically synthesized
aaatttttctcccaccatcctg

SEQ ID NO: 891427 - DNA, 22 bp, Artificial Sequence
  chemically synthesized
agtgtcaccaagtcaggatggt

SEQ ID NO: 891428 - DNA, 22 bp, Artificial Sequence
  chemically synthesized
tcagtgtcaccaagtcaggatg

SEQ ID NO: 891429 - DNA, 22 bp, Artificial Sequence
  chemically synthesized
ttctcccaccatcctgacttgg

SEQ ID NO: 891430 - DNA, 22 bp, Artificial Sequence
  chemically synthesized
tctcccaccatcctgacttggt

SEQ ID NO: 891431 - DNA, 22 bp, Artificial Sequence
  chemically synthesized
gttctcagtgtcaccaagtcag

SEQ ID NO: 891432 - DNA, 22 bp, Artificial Sequence
  chemically synthesized
ctcccaccatcctgacttggtg

SEQ ID NO: 891433 - DNA, 22 bp, Artificial Sequence
  chemically synthesized
agttctcagtgtcaccaagtca

SEQ ID NO: 891434 - DNA, 22 bp, Artificial Sequence
  chemically synthesized
tcccaccatcctgacttggtga

SEQ ID NO: 891435 - DNA, 22 bp, Artificial Sequence
  chemically synthesized
tagttctcagtgtcaccaagtc

SEQ ID NO: 891436 - DNA, 22 bp, Artificial Sequence
  chemically synthesized
ccaccatcctgacttggtgaca

SEQ ID NO: 891437 - DNA, 22 bp, Artificial Sequence
  chemically synthesized
acttggtgacactgagaactaa

SEQ ID NO: 891438 - DNA, 22 bp, Artificial Sequence
  chemically synthesized
ggtgacactgagaactaaaacg

SEQ ID NO: 891439 - DNA, 22 bp, Artificial Sequence
  chemically synthesized
gtgacactgagaactaaaacgt

SEQ ID NO: 891440 - DNA, 22 bp, Artificial Sequence
  chemically synthesized
agtaataatatgggcagtcacg

SEQ ID NO: 891441 - DNA, 22 bp, Artificial Sequence
  chemically synthesized
agaactaaaacgtgactgccca

SEQ ID NO: 891442 - DNA, 22 bp, Artificial Sequence
  chemically synthesized
tctcagtaataatatgggcagt

SEQ ID NO: 891443 - DNA, 22 bp, Artificial Sequence
  chemically synthesized
atctcagtaataatatgggcag

SEQ ID NO: 891444 - DNA, 22 bp, Artificial Sequence
  chemically synthesized
aaacgtgactgcccatattatt

SEQ ID NO: 891445 - DNA, 22 bp, Artificial Sequence
  chemically synthesized
cccatattattactgagataag

SEQ ID NO: 891446 - DNA, 22 bp, Artificial Sequence
  chemically synthesized
gagaagagagtccttatctcag

SEQ ID NO: 891447 - DNA, 22 bp, Artificial Sequence
  chemically synthesized
ttactgagataaggactctctt

SEQ ID NO: 891448 - DNA, 22 bp, Artificial Sequence
  chemically synthesized
ctgagataaggactctcttctc

SEQ ID NO: 891449 - DNA, 22 bp, Artificial Sequence
  chemically synthesized
taagacaacctagagaagagag

SEQ ID NO: 891450 - DNA, 22 bp, Artificial Sequence
  chemically synthesized
agataaggactctcttctctag

SEQ ID NO: 891451 - DNA, 22 bp, Artificial Sequence
  chemically synthesized
tcttctctaggttgtcttatag

SEQ ID NO: 891452 - DNA, 22 bp, Artificial Sequence
  chemically synthesized
ttctctaggttgtcttatagct

SEQ ID NO: 891453 - DNA, 22 bp, Artificial Sequence
  chemically synthesized
tggggaaatggcagctataaga

SEQ ID NO: 891454 - DNA, 22 bp, Artificial Sequence
  chemically synthesized
ctctaggttgtcttatagctgc

SEQ ID NO: 891455 - DNA, 22 bp, Artificial Sequence
  chemically synthesized
tctaggttgtcttatagctgcc

SEQ ID NO: 891456 - DNA, 22 bp, Artificial Sequence
  chemically synthesized
taggttgtcttatagctgccat

SEQ ID NO: 891457 - DNA, 22 bp, Artificial Sequence
  chemically synthesized
ggttgtcttatagctgccattt

SEQ ID NO: 891458 - DNA, 22 bp, Artificial Sequence
  chemically synthesized
gatattgtggggaaatggcagc

SEQ ID NO: 891459 - DNA, 22 bp, Artificial Sequence
  chemically synthesized
agatattgtggggaaatggcag

SEQ ID NO: 891460 - DNA, 22 bp, Artificial Sequence
  chemically synthesized
tagatattgtggggaaatggca

SEQ ID NO: 891461 - DNA, 22 bp, Artificial Sequence
  chemically synthesized
tttagatattgtggggaaatgg

SEQ ID NO: 891462 - DNA, 22 bp, Artificial Sequence
  chemically synthesized
tcttatagctgccatttcccca

SEQ ID NO: 891463 - DNA, 22 bp, Artificial Sequence
  chemically synthesized
ctttagatattgtggggaaatg

SEQ ID NO: 891464 - DNA, 22 bp, Artificial Sequence
  chemically synthesized
atagctgccatttccccacaat

SEQ ID NO: 891465 - DNA, 22 bp, Artificial Sequence
  chemically synthesized
tagctgccatttccccacaata

SEQ ID NO: 891466 - DNA, 22 bp, Artificial Sequence
  chemically synthesized
cagggcttctttagatattgtg

SEQ ID NO: 891467 - DNA, 22 bp, Artificial Sequence
  chemically synthesized
gcagggcttctttagatattgt

SEQ ID NO: 891468 - DNA, 22 bp, Artificial Sequence
  chemically synthesized
ccatttccccacaatatctaaa

SEQ ID NO: 891469 - DNA, 22 bp, Artificial Sequence
  chemically synthesized
cttgcagggcttctttagatat

SEQ ID NO: 891470 - DNA, 22 bp, Artificial Sequence
  chemically synthesized
tgcttgcagggcttctttagat

SEQ ID NO: 891471 - DNA, 22 bp, Artificial Sequence
  chemically synthesized
ctgcttgcagggcttctttaga

SEQ ID NO: 891472 - DNA, 22 bp, Artificial Sequence
  chemically synthesized
ccccacaatatctaaagaagcc

SEQ ID NO: 891473 - DNA, 22 bp, Artificial Sequence
  chemically synthesized
cccacaatatctaaagaagccc

SEQ ID NO: 891474 - DNA, 22 bp, Artificial Sequence
  chemically synthesized
aagaagccctgcaagcagaagc

SEQ ID NO: 891475 - DNA, 22 bp, Artificial Sequence
  chemically synthesized
tagcaagtcatccagcttctgc

SEQ ID NO: 891476 - DNA, 22 bp, Artificial Sequence
  chemically synthesized
atagcaagtcatccagcttctg

SEQ ID NO: 891477 - DNA, 22 bp, Artificial Sequence
  chemically synthesized
tagtttatagcaagtcatccag

SEQ ID NO: 891478 - DNA, 22 bp, Artificial Sequence
  chemically synthesized
gtagtttatagcaagtcatcca

SEQ ID NO: 891479 - DNA, 22 bp, Artificial Sequence
  chemically synthesized
caagcagaagctggatgacttg

SEQ ID NO: 891480 - DNA, 22 bp, Artificial Sequence
  chemically synthesized
tgtagtttatagcaagtcatcc

SEQ ID NO: 891481 - DNA, 22 bp, Artificial Sequence
  chemically synthesized
gatgacttgctataaactacaa

SEQ ID NO: 891482 - DNA, 22 bp, Artificial Sequence
  chemically synthesized
tggtggtgagtcctttgtagtt

SEQ ID NO: 891483 - DNA, 22 bp, Artificial Sequence
  chemically synthesized
ctgtggtggtgagtcctttgta

SEQ ID NO: 891484 - DNA, 22 bp, Artificial Sequence
  chemically synthesized
gctgtggtggtgagtcctttgt

SEQ ID NO: 891485 - DNA, 22 bp, Artificial Sequence
  chemically synthesized
gctataaactacaaaggactca

SEQ ID NO: 891486 - DNA, 22 bp, Artificial Sequence
  chemically synthesized
ctataaactacaaaggactcac

SEQ ID NO: 891487 - DNA, 22 bp, Artificial Sequence
  chemically synthesized
taaactacaaaggactcaccac

SEQ ID NO: 891488 - DNA, 22 bp, Artificial Sequence
  chemically synthesized
tacataatttgctgtggtggtg

SEQ ID NO: 891489 - DNA, 22 bp, Artificial Sequence
  chemically synthesized
caaaggactcaccaccacagca

SEQ ID NO: 891490 - DNA, 22 bp, Artificial Sequence
  chemically synthesized
tctatacataatttgctgtggt

SEQ ID NO: 891491 - DNA, 22 bp, Artificial Sequence
  chemically synthesized
accaccacagcaaattatgtat

SEQ ID NO: 891492 - DNA, 22 bp, Artificial Sequence
  chemically synthesized
caggcatgaaagttgtctatac

SEQ ID NO: 891493 - DNA, 22 bp, Artificial Sequence
  chemically synthesized
tgtatagacaactttcatgcct

SEQ ID NO: 891494 - DNA, 22 bp, Artificial Sequence
  chemically synthesized
caaagcagcagctccaggcatg

SEQ ID NO: 891495 - DNA, 22 bp, Artificial Sequence
  chemically synthesized
catggcctacaaagcagcagct

SEQ ID NO: 891496 - DNA, 22 bp, Artificial Sequence
  chemically synthesized
gcatggcctacaaagcagcagc

SEQ ID NO: 891497 - DNA, 22 bp, Artificial Sequence
  chemically synthesized
tcatgcctggagctgctgcttt

SEQ ID NO: 891498 - DNA, 22 bp, Artificial Sequence
  chemically synthesized
tgcatggcctacaaagcagcag

SEQ ID NO: 891499 - DNA, 22 bp, Artificial Sequence
  chemically synthesized
catgcctggagctgctgctttg

SEQ ID NO: 891500 - DNA, 22 bp, Artificial Sequence
  chemically synthesized
ttgcatggcctacaaagcagca

SEQ ID NO: 891501 - DNA, 22 bp, Artificial Sequence
  chemically synthesized
atgcctggagctgctgctttgt

SEQ ID NO: 891502 - DNA, 22 bp, Artificial Sequence
  chemically synthesized
tttgcatggcctacaaagcagc

SEQ ID NO: 891503 - DNA, 22 bp, Artificial Sequence
  chemically synthesized
aactttttgcatggcctacaaa

SEQ ID NO: 891504 - DNA, 22 bp, Artificial Sequence
  chemically synthesized
gagctgctgctttgtaggccat

SEQ ID NO: 891505 - DNA, 22 bp, Artificial Sequence
  chemically synthesized
ctgaactttttgcatggcctac

SEQ ID NO: 891506 - DNA, 22 bp, Artificial Sequence
  chemically synthesized
actgaactttttgcatggccta

SEQ ID NO: 891507 - DNA, 22 bp, Artificial Sequence
  chemically synthesized
ctgctttgtaggccatgcaaaa

SEQ ID NO: 891508 - DNA, 22 bp, Artificial Sequence
  chemically synthesized
gagtttactgaactttttgcat

SEQ ID NO: 891509 - DNA, 22 bp, Artificial Sequence
  chemically synthesized
ctttgtaggccatgcaaaaagt

SEQ ID NO: 891510 - DNA, 22 bp, Artificial Sequence
  chemically synthesized
tgtaggccatgcaaaaagttca

SEQ ID NO: 891511 - DNA, 22 bp, Artificial Sequence
  chemically synthesized
gtaggccatgcaaaaagttcag

SEQ ID NO: 891512 - DNA, 22 bp, Artificial Sequence
  chemically synthesized
taggccatgcaaaaagttcagt

SEQ ID NO: 891513 - DNA, 22 bp, Artificial Sequence
  chemically synthesized
gagcatggcacggaagaggttg

SEQ ID NO: 891514 - DNA, 22 bp, Artificial Sequence
  chemically synthesized
ggagcatggcacggaagaggtt

SEQ ID NO: 891515 - DNA, 22 bp, Artificial Sequence
  chemically synthesized
agtaaactccaacctcttccgt

SEQ ID NO: 891516 - DNA, 22 bp, Artificial Sequence
  chemically synthesized
ttggagcatggcacggaagagg

SEQ ID NO: 891517 - DNA, 22 bp, Artificial Sequence
  chemically synthesized
cttggagcatggcacggaagag

SEQ ID NO: 891518 - DNA, 22 bp, Artificial Sequence
  chemically synthesized
caacctcttccgtgccatgctc

SEQ ID NO: 891519 - DNA, 22 bp, Artificial Sequence
  chemically synthesized
ttccgtgccatgctccaagaaa

SEQ ID NO: 891520 - DNA, 22 bp, Artificial Sequence
  chemically synthesized
ccgtgccatgctccaagaaatc

SEQ ID NO: 891521 - DNA, 22 bp, Artificial Sequence
  chemically synthesized
cgtgccatgctccaagaaatcc

SEQ ID NO: 891522 - DNA, 22 bp, Artificial Sequence
  chemically synthesized
caagaaatccatcggattgcta

SEQ ID NO: 891523 - DNA, 22 bp, Artificial Sequence
  chemically synthesized
agatggtagagtgaggatggca

SEQ ID NO: 891524 - DNA, 22 bp, Artificial Sequence
  chemically synthesized
tcagatggtagagtgaggatgg

SEQ ID NO: 891525 - DNA, 22 bp, Artificial Sequence
  chemically synthesized
ctactgccatcctcactctacc

SEQ ID NO: 891526 - DNA, 22 bp, Artificial Sequence
  chemically synthesized
ctgccatcctcactctaccatc

SEQ ID NO: 891527 - DNA, 22 bp, Artificial Sequence
  chemically synthesized
taggcattctcagatggtagag

SEQ ID NO: 891528 - DNA, 22 bp, Artificial Sequence
  chemically synthesized
ccatcctcactctaccatctga

SEQ ID NO: 891529 - DNA, 22 bp, Artificial Sequence
  chemically synthesized
ggctgtaggcattctcagatgg

SEQ ID NO: 891530 - DNA, 22 bp, Artificial Sequence
  chemically synthesized
actctaccatctgagaatgcct

SEQ ID NO: 891531 - DNA, 22 bp, Artificial Sequence
  chemically synthesized
gaagctgggctgtaggcattct

SEQ ID NO: 891532 - DNA, 22 bp, Artificial Sequence
  chemically synthesized
taccatctgagaatgcctacag

SEQ ID NO: 891533 - DNA, 22 bp, Artificial Sequence
  chemically synthesized
ctagaagctgggctgtaggcat

SEQ ID NO: 891534 - DNA, 22 bp, Artificial Sequence
  chemically synthesized
ccatctgagaatgcctacagcc

SEQ ID NO: 891535 - DNA, 22 bp, Artificial Sequence
  chemically synthesized
agaatgcctacagcccagcttc

SEQ ID NO: 891536 - DNA, 22 bp, Artificial Sequence
  chemically synthesized
cagcccagcttctaggaatctt

SEQ ID NO: 891537 - DNA, 22 bp, Artificial Sequence
  chemically synthesized
ctaggaatctttttgacttgct

SEQ ID NO: 891538 - DNA, 22 bp, Artificial Sequence
  chemically synthesized
agtccagagggcagcaagtcaa

SEQ ID NO: 891539 - DNA, 22 bp, Artificial Sequence
  chemically synthesized
taggaatctttttgacttgctg

SEQ ID NO: 891540 - DNA, 22 bp, Artificial Sequence
  chemically synthesized
gagtccagagggcagcaagtca

SEQ ID NO: 891541 - DNA, 22 bp, Artificial Sequence
  chemically synthesized
tgagtccagagggcagcaagtc

SEQ ID NO: 891542 - DNA, 22 bp, Artificial Sequence
  chemically synthesized
ggaatctttttgacttgctgcc

SEQ ID NO: 891543 - DNA, 22 bp, Artificial Sequence
  chemically synthesized
ttgagtccagagggcagcaagt

SEQ ID NO: 891544 - DNA, 22 bp, Artificial Sequence
  chemically synthesized
agtttttgagtccagagggcag

SEQ ID NO: 891545 - DNA, 22 bp, Artificial Sequence
  chemically synthesized
tttgacttgctgccctctggac

SEQ ID NO: 891546 - DNA, 22 bp, Artificial Sequence
  chemically synthesized
ttgacttgctgccctctggact

SEQ ID NO: 891547 - DNA, 22 bp, Artificial Sequence
  chemically synthesized
tgacttgctgccctctggactc

SEQ ID NO: 891548 - DNA, 22 bp, Artificial Sequence
  chemically synthesized
gacttgctgccctctggactca

SEQ ID NO: 891549 - DNA, 22 bp, Artificial Sequence
  chemically synthesized
acttgctgccctctggactcaa

SEQ ID NO: 891550 - DNA, 22 bp, Artificial Sequence
  chemically synthesized
caaactcagtttttgagtccag

SEQ ID NO: 891551 - DNA, 22 bp, Artificial Sequence
  chemically synthesized
gctgccctctggactcaaaaac

SEQ ID NO: 891552 - DNA, 22 bp, Artificial Sequence
  chemically synthesized
ctgccctctggactcaaaaact

SEQ ID NO: 891553 - DNA, 22 bp, Artificial Sequence
  chemically synthesized
ccctctggactcaaaaactgag

SEQ ID NO: 891554 - DNA, 22 bp, Artificial Sequence
  chemically synthesized
aagcagactgcaaactcagttt

SEQ ID NO: 891555 - DNA, 22 bp, Artificial Sequence
  chemically synthesized
tggactcaaaaactgagtttgc

SEQ ID NO: 891556 - DNA, 22 bp, Artificial Sequence
  chemically synthesized
gactcaaaaactgagtttgcag

SEQ ID NO: 891557 - DNA, 22 bp, Artificial Sequence
  chemically synthesized
atggttgaagcagactgcaaac

SEQ ID NO: 891558 - DNA, 22 bp, Artificial Sequence
  chemically synthesized
aaaaactgagtttgcagtctgc

SEQ ID NO: 891559 - DNA, 22 bp, Artificial Sequence
  chemically synthesized
agtttgcagtctgcttcaacca

SEQ ID NO: 891560 - DNA, 22 bp, Artificial Sequence
  chemically synthesized
gcagtctgcttcaaccattaat

SEQ ID NO: 891561 - DNA, 22 bp, Artificial Sequence
  chemically synthesized
cagtctgcttcaaccattaatc

SEQ ID NO: 891562 - DNA, 22 bp, Artificial Sequence
  chemically synthesized
gaaggaagacgaagattaatgg

SEQ ID NO: 891563 - DNA, 22 bp, Artificial Sequence
  chemically synthesized
cttcaaccattaatcttcgtct

SEQ ID NO: 891564 - DNA, 22 bp, Artificial Sequence
  chemically synthesized
caaccattaatcttcgtcttcc

SEQ ID NO: 891565 - DNA, 22 bp, Artificial Sequence
  chemically synthesized
aaccattaatcttcgtcttcct

SEQ ID NO: 891566 - DNA, 22 bp, Artificial Sequence
  chemically synthesized
catgaaagttagaaggaagacg

SEQ ID NO: 891567 - DNA, 22 bp, Artificial Sequence
  chemically synthesized
ccatgaaagttagaaggaagac

SEQ ID NO: 891568 - DNA, 22 bp, Artificial Sequence
  chemically synthesized
atcttcgtcttccttctaactt

SEQ ID NO: 891569 - DNA, 22 bp, Artificial Sequence
  chemically synthesized
cgtcttccttctaactttcatg

SEQ ID NO: 891570 - DNA, 22 bp, Artificial Sequence
  chemically synthesized
gtcttccttctaactttcatgg

SEQ ID NO: 891571 - DNA, 22 bp, Artificial Sequence
  chemically synthesized
atgaaggagatttccatgaaag

SEQ ID NO: 891572 - DNA, 22 bp, Artificial Sequence
  chemically synthesized
catgaaggagatttccatgaaa

SEQ ID NO: 891573 - DNA, 22 bp, Artificial Sequence
  chemically synthesized
ccttctaactttcatggaaatc

SEQ ID NO: 891574 - DNA, 22 bp, Artificial Sequence
  chemically synthesized
cttctaactttcatggaaatct

SEQ ID NO: 891575 - DNA, 22 bp, Artificial Sequence
  chemically synthesized
ctaactttcatggaaatctcct

SEQ ID NO: 891576 - DNA, 22 bp, Artificial Sequence
  chemically synthesized
taactttcatggaaatctcctt

SEQ ID NO: 891577 - DNA, 22 bp, Artificial Sequence
  chemically synthesized
actttcatggaaatctccttca

SEQ ID NO: 891578 - DNA, 22 bp, Artificial Sequence
  chemically synthesized
tcatggaaatctccttcatgaa

SEQ ID NO: 891579 - DNA, 22 bp, Artificial Sequence
  chemically synthesized
catggaaatctccttcatgaaa

SEQ ID NO: 891580 - DNA, 22 bp, Artificial Sequence
  chemically synthesized
atggaaatctccttcatgaaat

SEQ ID NO: 891581 - DNA, 22 bp, Artificial Sequence
  chemically synthesized
gtagtaatcagacatttcatga

SEQ ID NO: 891582 - DNA, 22 bp, Artificial Sequence
  chemically synthesized
ggtagtaatcagacatttcatg

SEQ ID NO: 891583 - DNA, 22 bp, Artificial Sequence
  chemically synthesized
acacttggtagtaatcagacat

SEQ ID NO: 891584 - DNA, 22 bp, Artificial Sequence
  chemically synthesized
tgacacttggtagtaatcagac

SEQ ID NO: 891585 - DNA, 22 bp, Artificial Sequence
  chemically synthesized
cttcatgaaatgtctgattact

SEQ ID NO: 891586 - DNA, 22 bp, Artificial Sequence
  chemically synthesized
catgaaatgtctgattactacc

SEQ ID NO: 891587 - DNA, 22 bp, Artificial Sequence
  chemically synthesized
atgaaatgtctgattactacca

SEQ ID NO: 891588 - DNA, 22 bp, Artificial Sequence
  chemically synthesized
aacgaactctgacacttggtag

SEQ ID NO: 891589 - DNA, 22 bp, Artificial Sequence
  chemically synthesized
gctgaacgaactctgacacttg

SEQ ID NO: 891590 - DNA, 22 bp, Artificial Sequence
  chemically synthesized
attactaccaagtgtcagagtt

SEQ ID NO: 891591 - DNA, 22 bp, Artificial Sequence
  chemically synthesized
ctaccaagtgtcagagttcgtt

SEQ ID NO: 891592 - DNA, 22 bp, Artificial Sequence
  chemically synthesized
aaggactagctgaacgaactct

SEQ ID NO: 891593 - DNA, 22 bp, Artificial Sequence
  chemically synthesized
ccaagtgtcagagttcgttcag

SEQ ID NO: 891594 - DNA, 22 bp, Artificial Sequence
  chemically synthesized
ttgaaggactagctgaacgaac

SEQ ID NO: 891595 - DNA, 22 bp, Artificial Sequence
  chemically synthesized
ttgttgaaggactagctgaacg

SEQ ID NO: 891596 - DNA, 22 bp, Artificial Sequence
  chemically synthesized
tgttgttgaaggactagctgaa

SEQ ID NO: 891597 - DNA, 22 bp, Artificial Sequence
  chemically synthesized
ctgttgttgaaggactagctga

SEQ ID NO: 891598 - DNA, 22 bp, Artificial Sequence
  chemically synthesized
agcaggtttctgttgttgaagg

SEQ ID NO: 891599 - DNA, 22 bp, Artificial Sequence
  chemically synthesized
gttcagctagtccttcaacaac

SEQ ID NO: 891600 - DNA, 22 bp, Artificial Sequence
  chemically synthesized
cagcaggtttctgttgttgaag

SEQ ID NO: 891601 - DNA, 22 bp, Artificial Sequence
  chemically synthesized
agctagtccttcaacaacagaa

SEQ ID NO: 891602 - DNA, 22 bp, Artificial Sequence
  chemically synthesized
atttcagcaggtttctgttgtt

SEQ ID NO: 891603 - DNA, 22 bp, Artificial Sequence
  chemically synthesized
gttcatttcagcaggtttctgt

SEQ ID NO: 891604 - DNA, 22 bp, Artificial Sequence
  chemically synthesized
gtccttcaacaacagaaacctg

SEQ ID NO: 891605 - DNA, 22 bp, Artificial Sequence
  chemically synthesized
atctagttcatttcagcaggtt

SEQ ID NO: 891606 - DNA, 22 bp, Artificial Sequence
  chemically synthesized
caacaacagaaacctgctgaaa

SEQ ID NO: 891607 - DNA, 22 bp, Artificial Sequence
  chemically synthesized
aacaacagaaacctgctgaaat

SEQ ID NO: 891608 - DNA, 22 bp, Artificial Sequence
  chemically synthesized
ggaacgccagttcatctagttc

SEQ ID NO: 891609 - DNA, 22 bp, Artificial Sequence
  chemically synthesized
aggaacgccagttcatctagtt

SEQ ID NO: 891610 - DNA, 22 bp, Artificial Sequence
  chemically synthesized
ctgaaatgaactagatgaactg

SEQ ID NO: 891611 - DNA, 22 bp, Artificial Sequence
  chemically synthesized
aaatgaactagatgaactggcg

SEQ ID NO: 891612 - DNA, 22 bp, Artificial Sequence
  chemically synthesized
aaaaacttaggaacgccagttc

SEQ ID NO: 891613 - DNA, 22 bp, Artificial Sequence
  chemically synthesized
ccattgaaaaacttaggaacgc

SEQ ID NO: 891614 - DNA, 22 bp, Artificial Sequence
  chemically synthesized
cccattgaaaaacttaggaacg

SEQ ID NO: 891615 - DNA, 22 bp, Artificial Sequence
  chemically synthesized
tcccattgaaaaacttaggaac

SEQ ID NO: 891616 - DNA, 22 bp, Artificial Sequence
  chemically synthesized
gatgaactggcgttcctaagtt

SEQ ID NO: 891617 - DNA, 22 bp, Artificial Sequence
  chemically synthesized
gcgttcctaagtttttcaatgg

SEQ ID NO: 891618 - DNA, 22 bp, Artificial Sequence
  chemically synthesized
aagggaaaccagttttcccatt

SEQ ID NO: 891619 - DNA, 22 bp, Artificial Sequence
  chemically synthesized
ctaagtttttcaatgggaaaac

SEQ ID NO: 891620 - DNA, 22 bp, Artificial Sequence
  chemically synthesized
ttcaagggaaaccagttttccc

SEQ ID NO: 891621 - DNA, 22 bp, Artificial Sequence
  chemically synthesized
agtttttcaatgggaaaactgg

SEQ ID NO: 891622 - DNA, 22 bp, Artificial Sequence
  chemically synthesized
gttcaagggaaaccagttttcc

SEQ ID NO: 891623 - DNA, 22 bp, Artificial Sequence
  chemically synthesized
tgttcaagggaaaccagttttc

SEQ ID NO: 891624 - DNA, 22 bp, Artificial Sequence
  chemically synthesized
ttcaatgggaaaactggtttcc

SEQ ID NO: 891625 - DNA, 22 bp, Artificial Sequence
  chemically synthesized
tcaatgggaaaactggtttccc

SEQ ID NO: 891626 - DNA, 22 bp, Artificial Sequence
  chemically synthesized
cattttgttcaagggaaaccag

SEQ ID NO: 891627 - DNA, 22 bp, Artificial Sequence
  chemically synthesized
caatgggaaaactggtttccct

SEQ ID NO: 891628 - DNA, 22 bp, Artificial Sequence
  chemically synthesized
aatgggaaaactggtttccctt

SEQ ID NO: 891629 - DNA, 22 bp, Artificial Sequence
  chemically synthesized
tcaaccctccattttgttcaag

SEQ ID NO: 891630 - DNA, 22 bp, Artificial Sequence
  chemically synthesized
gtcaaccctccattttgttcaa

SEQ ID NO: 891631 - DNA, 22 bp, Artificial Sequence
  chemically synthesized
tgtcaaccctccattttgttca

SEQ ID NO: 891632 - DNA, 22 bp, Artificial Sequence
  chemically synthesized
tttgtcaaccctccattttgtt

SEQ ID NO: 891633 - DNA, 22 bp, Artificial Sequence
  chemically synthesized
ctttgtcaaccctccattttgt

SEQ ID NO: 891634 - DNA, 22 bp, Artificial Sequence
  chemically synthesized
gtttcccttgaacaaaatggag

SEQ ID NO: 891635 - DNA, 22 bp, Artificial Sequence
  chemically synthesized
tctttgtcaaccctccattttg

SEQ ID NO: 891636 - DNA, 22 bp, Artificial Sequence
  chemically synthesized
cccttgaacaaaatggagggtt

SEQ ID NO: 891637 - DNA, 22 bp, Artificial Sequence
  chemically synthesized
ccttgaacaaaatggagggttg

SEQ ID NO: 891638 - DNA, 22 bp, Artificial Sequence
  chemically synthesized
aagctttctttgtcaaccctcc

SEQ ID NO: 891639 - DNA, 22 bp, Artificial Sequence
  chemically synthesized
aaagctttctttgtcaaccctc

SEQ ID NO: 891640 - DNA, 22 bp, Artificial Sequence
  chemically synthesized
taaagctttctttgtcaaccct

SEQ ID NO: 891641 - DNA, 22 bp, Artificial Sequence
  chemically synthesized
gaacaaaatggagggttgacaa

SEQ ID NO: 891642 - DNA, 22 bp, Artificial Sequence
  chemically synthesized
ttaaagctttctttgtcaaccc

SEQ ID NO: 891643 - DNA, 22 bp, Artificial Sequence
  chemically synthesized
aacaaaatggagggttgacaaa

SEQ ID NO: 891644 - DNA, 22 bp, Artificial Sequence
  chemically synthesized
agggtatttttaaagctttctt

SEQ ID NO: 891645 - DNA, 22 bp, Artificial Sequence
  chemically synthesized
acaaagaaagctttaaaaatac

SEQ ID NO: 891646 - DNA, 22 bp, Artificial Sequence
  chemically synthesized
aaatgtagtcaaactcagggta

SEQ ID NO: 891647 - DNA, 22 bp, Artificial Sequence
  chemically synthesized
tctcaaatgtagtcaaactcag

SEQ ID NO: 891648 - DNA, 22 bp, Artificial Sequence
  chemically synthesized
taaaaataccctgagtttgact

SEQ ID NO: 891649 - DNA, 22 bp, Artificial Sequence
  chemically synthesized
aaaaataccctgagtttgacta

SEQ ID NO: 891650 - DNA, 22 bp, Artificial Sequence
  chemically synthesized
aaaataccctgagtttgactac

SEQ ID NO: 891651 - DNA, 22 bp, Artificial Sequence
  chemically synthesized
agtttgactacatttgagacag

SEQ ID NO: 891652 - DNA, 22 bp, Artificial Sequence
  chemically synthesized
aagtcaggaagaaatctgtctc

SEQ ID NO: 891653 - DNA, 22 bp, Artificial Sequence
  chemically synthesized
gactacatttgagacagatttc

SEQ ID NO: 891654 - DNA, 22 bp, Artificial Sequence
  chemically synthesized
actacatttgagacagatttct

SEQ ID NO: 891655 - DNA, 22 bp, Artificial Sequence
  chemically synthesized
catttgagacagatttcttcct

SEQ ID NO: 891656 - DNA, 22 bp, Artificial Sequence
  chemically synthesized
gagacagatttcttcctgactt

SEQ ID NO: 891657 - DNA, 22 bp, Artificial Sequence
  chemically synthesized
agacagatttcttcctgacttt

SEQ ID NO: 891658 - DNA, 22 bp, Artificial Sequence
  chemically synthesized
agaaaaggaaggtcaggtctaa

SEQ ID NO: 891659 - DNA, 22 bp, Artificial Sequence
  chemically synthesized
cttcctgactttagacctgacc

SEQ ID NO: 891660 - DNA, 22 bp, Artificial Sequence
  chemically synthesized
taagaaaaggaaggtcaggtct

SEQ ID NO: 891661 - DNA, 22 bp, Artificial Sequence
  chemically synthesized
ttcctgactttagacctgacct

SEQ ID NO: 891662 - DNA, 22 bp, Artificial Sequence
  chemically synthesized
cctgactttagacctgaccttc

SEQ ID NO: 891663 - DNA, 22 bp, Artificial Sequence
  chemically synthesized
ctgactttagacctgaccttcc

SEQ ID NO: 891664 - DNA, 22 bp, Artificial Sequence
  chemically synthesized
actttagacctgaccttccttt

SEQ ID NO: 891665 - DNA, 22 bp, Artificial Sequence
  chemically synthesized
tagacctgaccttccttttctt

SEQ ID NO: 891666 - DNA, 22 bp, Artificial Sequence
  chemically synthesized
agacctgaccttccttttctta

SEQ ID NO: 891667 - DNA, 22 bp, Artificial Sequence
  chemically synthesized
gagtaaatgctctaagaaaagg

SEQ ID NO: 891668 - DNA, 22 bp, Artificial Sequence
  chemically synthesized
gacctgaccttccttttcttag

SEQ ID NO: 891669 - DNA, 22 bp, Artificial Sequence
  chemically synthesized
tagagtaaatgctctaagaaaa

SEQ ID NO: 891670 - DNA, 22 bp, Artificial Sequence
  chemically synthesized
ctagagtaaatgctctaagaaa

SEQ ID NO: 891671 - DNA, 22 bp, Artificial Sequence
  chemically synthesized
tctagagtaaatgctctaagaa

SEQ ID NO: 891672 - DNA, 22 bp, Artificial Sequence
  chemically synthesized
accttccttttcttagagcatt

SEQ ID NO: 891673 - DNA, 22 bp, Artificial Sequence
  chemically synthesized
ccttttcttagagcatttactc

SEQ ID NO: 891674 - DNA, 22 bp, Artificial Sequence
  chemically synthesized
cttttcttagagcatttactct

SEQ ID NO: 891675 - DNA, 22 bp, Artificial Sequence
  chemically synthesized
ttcttagagcatttactctaga

SEQ ID NO: 891676 - DNA, 22 bp, Artificial Sequence
  chemically synthesized
tcttagagcatttactctagaa

SEQ ID NO: 891677 - DNA, 22 bp, Artificial Sequence
  chemically synthesized
cttagagcatttactctagaaa

SEQ ID NO: 891678 - DNA, 22 bp, Artificial Sequence
  chemically synthesized
ttagagcatttactctagaaaa

SEQ ID NO: 891679 - DNA, 22 bp, Artificial Sequence
  chemically synthesized
agagcatttactctagaaaact

SEQ ID NO: 891680 - DNA, 22 bp, Artificial Sequence
  chemically synthesized
gagcatttactctagaaaactt

SEQ ID NO: 891681 - DNA, 22 bp, Artificial Sequence
  chemically synthesized
actctagaaaactttatatatt

SEQ ID NO: 891682 - DNA, 22 bp, Artificial Sequence
  chemically synthesized
ctctagaaaactttatatatta

SEQ ID NO: 891683 - DNA, 22 bp, Artificial Sequence
  chemically synthesized
tagaaaactttatatattattt

SEQ ID NO: 891684 - DNA, 22 bp, Artificial Sequence
  chemically synthesized
aaaaaagtagagaaataatata

SEQ ID NO: 891685 - DNA, 22 bp, Artificial Sequence
  chemically synthesized
gaaaactttatatattatttct

SEQ ID NO: 891686 - DNA, 22 bp, Artificial Sequence
  chemically synthesized
tctcaaaaaagtagagaaataa

SEQ ID NO: 891687 - DNA, 22 bp, Artificial Sequence
  chemically synthesized
gtctcaaaaaagtagagaaata

SEQ ID NO: 891688 - DNA, 22 bp, Artificial Sequence
  chemically synthesized
tgtctcaaaaaagtagagaaat

SEQ ID NO: 891689 - DNA, 22 bp, Artificial Sequence
  chemically synthesized
ttgtctcaaaaaagtagagaaa

SEQ ID NO: 891690 - DNA, 22 bp, Artificial Sequence
  chemically synthesized
tatatattatttctctactttt

SEQ ID NO: 891691 - DNA, 22 bp, Artificial Sequence
  chemically synthesized
atatattatttctctacttttt

SEQ ID NO: 891692 - DNA, 22 bp, Artificial Sequence
  chemically synthesized
tatattatttctctactttttt

SEQ ID NO: 891693 - DNA, 22 bp, Artificial Sequence
  chemically synthesized
ggagaatatttttgtctcaaaa

SEQ ID NO: 891694 - DNA, 22 bp, Artificial Sequence
  chemically synthesized
tttctctacttttttgagacaa

SEQ ID NO: 891695 - DNA, 22 bp, Artificial Sequence
  chemically synthesized
ctctacttttttgagacaaaaa

SEQ ID NO: 891696 - DNA, 22 bp, Artificial Sequence
  chemically synthesized
tctacttttttgagacaaaaat

SEQ ID NO: 891697 - DNA, 22 bp, Artificial Sequence
  chemically synthesized
tacttttttgagacaaaaatat

SEQ ID NO: 891698 - DNA, 22 bp, Artificial Sequence
  chemically synthesized
cttttttgagacaaaaatattc

SEQ ID NO: 891699 - DNA, 22 bp, Artificial Sequence
  chemically synthesized
ttttgagacaaaaatattctcc

SEQ ID NO: 891700 - DNA, 22 bp, Artificial Sequence
  chemically synthesized
tttgagacaaaaatattctcct

SEQ ID NO: 891701 - DNA, 22 bp, Artificial Sequence
  chemically synthesized
ttgagacaaaaatattctccta

SEQ ID NO: 891702 - DNA, 22 bp, Artificial Sequence
  chemically synthesized
tgagacaaaaatattctcctag

SEQ ID NO: 891703 - DNA, 22 bp, Artificial Sequence
  chemically synthesized
gagacaaaaatattctcctagc

SEQ ID NO: 891704 - DNA, 22 bp, Artificial Sequence
  chemically synthesized
agacaaaaatattctcctagcc

SEQ ID NO: 891705 - DNA, 22 bp, Artificial Sequence
  chemically synthesized
aggtataaaagtggcaagaggc

SEQ ID NO: 891706 - DNA, 22 bp, Artificial Sequence
  chemically synthesized
ctgaggtataaaagtggcaaga

SEQ ID NO: 891707 - DNA, 22 bp, Artificial Sequence
  chemically synthesized
ttcctgaggtataaaagtggca

SEQ ID NO: 891708 - DNA, 22 bp, Artificial Sequence
  chemically synthesized
tcctagcctcttgccactttta

SEQ ID NO: 891709 - DNA, 22 bp, Artificial Sequence
  chemically synthesized
attcctgaggtataaaagtggc

SEQ ID NO: 891710 - DNA, 22 bp, Artificial Sequence
  chemically synthesized
ctagcctcttgccacttttata

SEQ ID NO: 891711 - DNA, 22 bp, Artificial Sequence
  chemically synthesized
gcctcttgccacttttatacct

SEQ ID NO: 891712 - DNA, 22 bp, Artificial Sequence
  chemically synthesized
agaaagtttattcctgaggtat

SEQ ID NO: 891713 - DNA, 22 bp, Artificial Sequence
  chemically synthesized
ttgccacttttatacctcagga

SEQ ID NO: 891714 - DNA, 22 bp, Artificial Sequence
  chemically synthesized
gagaaagtttattcctgaggta

SEQ ID NO: 891715 - DNA, 22 bp, Artificial Sequence
  chemically synthesized
gccacttttatacctcaggaat

SEQ ID NO: 891716 - DNA, 22 bp, Artificial Sequence
  chemically synthesized
ccacttttatacctcaggaata

SEQ ID NO: 891717 - DNA, 22 bp, Artificial Sequence
  chemically synthesized
ttatacctcaggaataaacttt

SEQ ID NO: 891718 - DNA, 22 bp, Artificial Sequence
  chemically synthesized
tatacctcaggaataaactttc

SEQ ID NO: 891719 - DNA, 22 bp, Artificial Sequence
  chemically synthesized
ccaagtccttgagaaagtttat

SEQ ID NO: 891720 - DNA, 22 bp, Artificial Sequence
  chemically synthesized
atacctcaggaataaactttct

SEQ ID NO: 891721 - DNA, 22 bp, Artificial Sequence
  chemically synthesized
tacctcaggaataaactttctc

SEQ ID NO: 891722 - DNA, 22 bp, Artificial Sequence
  chemically synthesized
gctcccaagtccttgagaaagt

SEQ ID NO: 891723 - DNA, 22 bp, Artificial Sequence
  chemically synthesized
aggaataaactttctcaaggac

SEQ ID NO: 891724 - DNA, 22 bp, Artificial Sequence
  chemically synthesized
tatcaaagtgctagctcccaag

SEQ ID NO: 891725 - DNA, 22 bp, Artificial Sequence
  chemically synthesized
tatatcaaagtgctagctccca

SEQ ID NO: 891726 - DNA, 22 bp, Artificial Sequence
  chemically synthesized
tctcaaggacttgggagctagc

SEQ ID NO: 891727 - DNA, 22 bp, Artificial Sequence
  chemically synthesized
ctcaaggacttgggagctagca

SEQ ID NO: 891728 - DNA, 22 bp, Artificial Sequence
  chemically synthesized
tcaaggacttgggagctagcac

SEQ ID NO: 891729 - DNA, 22 bp, Artificial Sequence
  chemically synthesized
aaggacttgggagctagcactt

SEQ ID NO: 891730 - DNA, 22 bp, Artificial Sequence
  chemically synthesized
atgattctatatcaaagtgcta

SEQ ID NO: 891731 - DNA, 22 bp, Artificial Sequence
  chemically synthesized
gatgattctatatcaaagtgct

SEQ ID NO: 891732 - DNA, 22 bp, Artificial Sequence
  chemically synthesized
tgatgattctatatcaaagtgc

SEQ ID NO: 891733 - DNA, 22 bp, Artificial Sequence
  chemically synthesized
ttgatgattctatatcaaagtg

SEQ ID NO: 891734 - DNA, 22 bp, Artificial Sequence
  chemically synthesized
tttgatgattctatatcaaagt

SEQ ID NO: 891735 - DNA, 22 bp, Artificial Sequence
  chemically synthesized
ttttgatgattctatatcaaag

SEQ ID NO: 891736 - DNA, 22 bp, Artificial Sequence
  chemically synthesized
gggagctagcactttgatatag

SEQ ID NO: 891737 - DNA, 22 bp, Artificial Sequence
  chemically synthesized
ggagctagcactttgatataga

SEQ ID NO: 891738 - DNA, 22 bp, Artificial Sequence
  chemically synthesized
tcttttttgatgattctatatc

SEQ ID NO: 891739 - DNA, 22 bp, Artificial Sequence
  chemically synthesized
gcactttgatatagaatcatca

SEQ ID NO: 891740 - DNA, 22 bp, Artificial Sequence
  chemically synthesized
gggcactatcttttttgatgat

SEQ ID NO: 891741 - DNA, 22 bp, Artificial Sequence
  chemically synthesized
tgatatagaatcatcaaaaaag

SEQ ID NO: 891742 - DNA, 22 bp, Artificial Sequence
  chemically synthesized
gatatagaatcatcaaaaaaga

SEQ ID NO: 891743 - DNA, 22 bp, Artificial Sequence
  chemically synthesized
atatagaatcatcaaaaaagat

SEQ ID NO: 891744 - DNA, 22 bp, Artificial Sequence
  chemically synthesized
gcagattggggcactatctttt

SEQ ID NO: 891745 - DNA, 22 bp, Artificial Sequence
  chemically synthesized
ccaacagaagactagcagattg

SEQ ID NO: 891746 - DNA, 22 bp, Artificial Sequence
  chemically synthesized
tcctcccaacagaagactagca

SEQ ID NO: 891747 - DNA, 22 bp, Artificial Sequence
  chemically synthesized
ctatcctcccaacagaagacta

SEQ ID NO: 891748 - DNA, 22 bp, Artificial Sequence
  chemically synthesized
gattcctatcctcccaacagaa

SEQ ID NO: 891749 - DNA, 22 bp, Artificial Sequence
  chemically synthesized
ctagtcttctgttgggaggata

SEQ ID NO: 891750 - DNA, 22 bp, Artificial Sequence
  chemically synthesized
gtcttctgttgggaggatagga

SEQ ID NO: 891751 - DNA, 22 bp, Artificial Sequence
  chemically synthesized
tcaaagttagattcctatcctc

SEQ ID NO: 891752 - DNA, 22 bp, Artificial Sequence
  chemically synthesized
atcaaagttagattcctatcct

SEQ ID NO: 891753 - DNA, 22 bp, Artificial Sequence
  chemically synthesized
ctgttgggaggataggaatcta

SEQ ID NO: 891754 - DNA, 22 bp, Artificial Sequence
  chemically synthesized
tgttgggaggataggaatctaa

SEQ ID NO: 891755 - DNA, 22 bp, Artificial Sequence
  chemically synthesized
gcacttatcaaagttagattcc

SEQ ID NO: 891756 - DNA, 22 bp, Artificial Sequence
  chemically synthesized
ttgggaggataggaatctaact

SEQ ID NO: 891757 - DNA, 22 bp, Artificial Sequence
  chemically synthesized
ggaggataggaatctaactttg

SEQ ID NO: 891758 - DNA, 22 bp, Artificial Sequence
  chemically synthesized
attggcacttatcaaagttaga

SEQ ID NO: 891759 - DNA, 22 bp, Artificial Sequence
  chemically synthesized
ctgattggcacttatcaaagtt

SEQ ID NO: 891760 - DNA, 22 bp, Artificial Sequence
  chemically synthesized
gctgattggcacttatcaaagt

SEQ ID NO: 891761 - DNA, 22 bp, Artificial Sequence
  chemically synthesized
tgtttgctgattggcacttatc

SEQ ID NO: 891762 - DNA, 22 bp, Artificial Sequence
  chemically synthesized
actttgataagtgccaatcagc

SEQ ID NO: 891763 - DNA, 22 bp, Artificial Sequence
  chemically synthesized
ggccatctgtgtttgctgattg

SEQ ID NO: 891764 - DNA, 22 bp, Artificial Sequence
  chemically synthesized
aggccatctgtgtttgctgatt

SEQ ID NO: 891765 - DNA, 22 bp, Artificial Sequence
  chemically synthesized
tgataagtgccaatcagcaaac

SEQ ID NO: 891766 - DNA, 22 bp, Artificial Sequence
  chemically synthesized
gataagtgccaatcagcaaaca

SEQ ID NO: 891767 - DNA, 22 bp, Artificial Sequence
  chemically synthesized
ataagtgccaatcagcaaacac

SEQ ID NO: 891768 - DNA, 22 bp, Artificial Sequence
  chemically synthesized
tttaggccatctgtgtttgctg

SEQ ID NO: 891769 - DNA, 22 bp, Artificial Sequence
  chemically synthesized
atttaggccatctgtgtttgct

SEQ ID NO: 891770 - DNA, 22 bp, Artificial Sequence
  chemically synthesized
gtcaatgtgcttatttaggcca

SEQ ID NO: 891771 - DNA, 22 bp, Artificial Sequence
  chemically synthesized
aataagcacattgactaacctc

SEQ ID NO: 891772 - DNA, 22 bp, Artificial Sequence
  chemically synthesized
gatatcaggagggaggttagtc

SEQ ID NO: 891773 - DNA, 22 bp, Artificial Sequence
  chemically synthesized
actaacctccctcctgatatct

SEQ ID NO: 891774 - DNA, 22 bp, Artificial Sequence
  chemically synthesized
gtgagaaagtactagatatcag

SEQ ID NO: 891775 - DNA, 22 bp, Artificial Sequence
  chemically synthesized
acctccctcctgatatctagta

SEQ ID NO: 891776 - DNA, 22 bp, Artificial Sequence
  chemically synthesized
cctcctgatatctagtactttc

SEQ ID NO: 891777 - DNA, 22 bp, Artificial Sequence
  chemically synthesized
agatgagttagtgagaaagtac

SEQ ID NO: 891778 - DNA, 22 bp, Artificial Sequence
  chemically synthesized
ctgatatctagtactttctcac

SEQ ID NO: 891779 - DNA, 22 bp, Artificial Sequence
  chemically synthesized
atatctagtactttctcactaa

SEQ ID NO: 891780 - DNA, 22 bp, Artificial Sequence
  chemically synthesized
agtgctgagatgagttagtgag

SEQ ID NO: 891781 - DNA, 22 bp, Artificial Sequence
  chemically synthesized
taagtgctgagatgagttagtg

SEQ ID NO: 891782 - DNA, 22 bp, Artificial Sequence
  chemically synthesized
gtactttctcactaactcatct

SEQ ID NO: 891783 - DNA, 22 bp, Artificial Sequence
  chemically synthesized
tctcactaactcatctcagcac

SEQ ID NO: 891784 - DNA, 22 bp, Artificial Sequence
  chemically synthesized
ctcactaactcatctcagcact

SEQ ID NO: 891785 - DNA, 22 bp, Artificial Sequence
  chemically synthesized
tcactaactcatctcagcactt

SEQ ID NO: 891786 - DNA, 22 bp, Artificial Sequence
  chemically synthesized
actaactcatctcagcacttag

SEQ ID NO: 891787 - DNA, 22 bp, Artificial Sequence
  chemically synthesized
actcatctcagcacttagaggc

SEQ ID NO: 891788 - DNA, 22 bp, Artificial Sequence
  chemically synthesized
atctcagcacttagaggctctc

SEQ ID NO: 891789 - DNA, 22 bp, Artificial Sequence
  chemically synthesized
aaataaaaggcaggagagcctc

SEQ ID NO: 891790 - DNA, 22 bp, Artificial Sequence
  chemically synthesized
ctgaaataaaaggcaggagagc

SEQ ID NO: 891791 - DNA, 22 bp, Artificial Sequence
  chemically synthesized
agcacttagaggctctcctgcc

SEQ ID NO: 891792 - DNA, 22 bp, Artificial Sequence
  chemically synthesized
tgctgaaataaaaggcaggaga

SEQ ID NO: 891793 - DNA, 22 bp, Artificial Sequence
  chemically synthesized
aattctgctgaaataaaaggca

SEQ ID NO: 891794 - DNA, 22 bp, Artificial Sequence
  chemically synthesized
agaggctctcctgccttttatt

SEQ ID NO: 891795 - DNA, 22 bp, Artificial Sequence
  chemically synthesized
gaggctctcctgccttttattt

SEQ ID NO: 891796 - DNA, 22 bp, Artificial Sequence
  chemically synthesized
aactcaattctgctgaaataaa

SEQ ID NO: 891797 - DNA, 22 bp, Artificial Sequence
  chemically synthesized
tcctgccttttatttcagcaga

SEQ ID NO: 891798 - DNA, 22 bp, Artificial Sequence
  chemically synthesized
ctgccttttatttcagcagaat

SEQ ID NO: 891799 - DNA, 22 bp, Artificial Sequence
  chemically synthesized
ccttttatttcagcagaattga

SEQ ID NO: 891800 - DNA, 22 bp, Artificial Sequence
  chemically synthesized
ttatttcagcagaattgagttc

SEQ ID NO: 891801 - DNA, 22 bp, Artificial Sequence
  chemically synthesized
tatttcagcagaattgagttca

SEQ ID NO: 891802 - DNA, 22 bp, Artificial Sequence
  chemically synthesized
atttcagcagaattgagttcaa

SEQ ID NO: 891803 - DNA, 22 bp, Artificial Sequence
  chemically synthesized
tttcagcagaattgagttcaat

SEQ ID NO: 891804 - DNA, 22 bp, Artificial Sequence
  chemically synthesized
cagcagaattgagttcaatctg

SEQ ID NO: 891805 - DNA, 22 bp, Artificial Sequence
  chemically synthesized
caatagaggagacagattgaac

SEQ ID NO: 891806 - DNA, 22 bp, Artificial Sequence
  chemically synthesized
agcagaattgagttcaatctgt

SEQ ID NO: 891807 - DNA, 22 bp, Artificial Sequence
  chemically synthesized
gcaatagaggagacagattgaa

SEQ ID NO: 891808 - DNA, 22 bp, Artificial Sequence
  chemically synthesized
tgcaatagaggagacagattga

SEQ ID NO: 891809 - DNA, 22 bp, Artificial Sequence
  chemically synthesized
ttgcaatagaggagacagattg

SEQ ID NO: 891810 - DNA, 22 bp, Artificial Sequence
  chemically synthesized
aaaacttttgcaatagaggaga

SEQ ID NO: 891811 - DNA, 22 bp, Artificial Sequence
  chemically synthesized
agttcaatctgtctcctctatt

SEQ ID NO: 891812 - DNA, 22 bp, Artificial Sequence
  chemically synthesized
tgttcaaaacttttgcaataga

SEQ ID NO: 891813 - DNA, 22 bp, Artificial Sequence
  chemically synthesized
aatctgtctcctctattgcaaa

SEQ ID NO: 891814 - DNA, 22 bp, Artificial Sequence
  chemically synthesized
tctcctctattgcaaaagtttt

SEQ ID NO: 891815 - DNA, 22 bp, Artificial Sequence
  chemically synthesized
ctctattgcaaaagttttgaac

SEQ ID NO: 891816 - DNA, 22 bp, Artificial Sequence
  chemically synthesized
tattgcaaaagttttgaacaca

SEQ ID NO: 891817 - DNA, 22 bp, Artificial Sequence
  chemically synthesized
ttgcaaaagttttgaacacagt

SEQ ID NO: 891818 - DNA, 22 bp, Artificial Sequence
  chemically synthesized
caaaagttttgaacacagtctt

SEQ ID NO: 891819 - DNA, 22 bp, Artificial Sequence
  chemically synthesized
gacaacagacaagaaagactgt

SEQ ID NO: 891820 - DNA, 22 bp, Artificial Sequence
  chemically synthesized
tgaacacagtctttcttgtctg

SEQ ID NO: 891821 - DNA, 22 bp, Artificial Sequence
  chemically synthesized
gaacacagtctttcttgtctgt

SEQ ID NO: 891822 - DNA, 22 bp, Artificial Sequence
  chemically synthesized
aacacagtctttcttgtctgtt

SEQ ID NO: 891823 - DNA, 22 bp, Artificial Sequence
  chemically synthesized
tcaaagaaaaatagcactagac

SEQ ID NO: 891824 - DNA, 22 bp, Artificial Sequence
  chemically synthesized
tcttgtctgttgtctagtgcta

SEQ ID NO: 891825 - DNA, 22 bp, Artificial Sequence
  chemically synthesized
cttgtctgttgtctagtgctat

SEQ ID NO: 891826 - DNA, 22 bp, Artificial Sequence
  chemically synthesized
ttgtctgttgtctagtgctatt

SEQ ID NO: 891827 - DNA, 22 bp, Artificial Sequence
  chemically synthesized
gtctgttgtctagtgctatttt

SEQ ID NO: 891828 - DNA, 22 bp, Artificial Sequence
  chemically synthesized
tctgttgtctagtgctattttt

SEQ ID NO: 891829 - DNA, 22 bp, Artificial Sequence
  chemically synthesized
tgagtgttgtcaaagaaaaata

SEQ ID NO: 891830 - DNA, 22 bp, Artificial Sequence
  chemically synthesized
ttgtctagtgctatttttcttt

SEQ ID NO: 891831 - DNA, 22 bp, Artificial Sequence
  chemically synthesized
ctgtgagtgttgtcaaagaaaa

SEQ ID NO: 891832 - DNA, 22 bp, Artificial Sequence
  chemically synthesized
tctagtgctatttttctttgac

SEQ ID NO: 891833 - DNA, 22 bp, Artificial Sequence
  chemically synthesized
gtgctatttttctttgacaaca

SEQ ID NO: 891834 - DNA, 22 bp, Artificial Sequence
  chemically synthesized
acattgctgtgagtgttgtcaa

SEQ ID NO: 891835 - DNA, 22 bp, Artificial Sequence
  chemically synthesized
tttttctttgacaacactcaca

SEQ ID NO: 891836 - DNA, 22 bp, Artificial Sequence
  chemically synthesized
ttctttgacaacactcacagca

SEQ ID NO: 891837 - DNA, 22 bp, Artificial Sequence
  chemically synthesized
tctttgacaacactcacagcaa

SEQ ID NO: 891838 - DNA, 22 bp, Artificial Sequence
  chemically synthesized
tgtgtgttcacattgctgtgag

SEQ ID NO: 891839 - DNA, 22 bp, Artificial Sequence
  chemically synthesized
ctttgacaacactcacagcaat

SEQ ID NO: 891840 - DNA, 22 bp, Artificial Sequence
  chemically synthesized
tttgacaacactcacagcaatg

SEQ ID NO: 891841 - DNA, 22 bp, Artificial Sequence
  chemically synthesized
tgacaacactcacagcaatgtg

SEQ ID NO: 891842 - DNA, 22 bp, Artificial Sequence
  chemically synthesized
gacaacactcacagcaatgtga

SEQ ID NO: 891843 - DNA, 22 bp, Artificial Sequence
  chemically synthesized
acaacactcacagcaatgtgaa

SEQ ID NO: 891844 - DNA, 22 bp, Artificial Sequence
  chemically synthesized
aacactgtgtgtgttcacattg

SEQ ID NO: 891845 - DNA, 22 bp, Artificial Sequence
  chemically synthesized
acagcaatgtgaacacacacag

SEQ ID NO: 891846 - DNA, 22 bp, Artificial Sequence
  chemically synthesized
aagtcactgaacactgtgtgtg

SEQ ID NO: 891847 - DNA, 22 bp, Artificial Sequence
  chemically synthesized
accattaaagtcactgaacact

SEQ ID NO: 891848 - DNA, 22 bp, Artificial Sequence
  chemically synthesized
tagtgactgaccattaaagtca

SEQ ID NO: 891849 - DNA, 22 bp, Artificial Sequence
  chemically synthesized
aattgtagtgactgaccattaa

SEQ ID NO: 891850 - DNA, 22 bp, Artificial Sequence
  chemically synthesized
agtgactttaatggtcagtcac

SEQ ID NO: 891851 - DNA, 22 bp, Artificial Sequence
  chemically synthesized
ccaaaggactcaattgtagtga

SEQ ID NO: 891852 - DNA, 22 bp, Artificial Sequence
  chemically synthesized
taatggtcagtcactacaattg

SEQ ID NO: 891853 - DNA, 22 bp, Artificial Sequence
  chemically synthesized
aatggtcagtcactacaattga

SEQ ID NO: 891854 - DNA, 22 bp, Artificial Sequence
  chemically synthesized
atggtcagtcactacaattgag

SEQ ID NO: 891855 - DNA, 22 bp, Artificial Sequence
  chemically synthesized
aaaactaccaaaggactcaatt

SEQ ID NO: 891856 - DNA, 22 bp, Artificial Sequence
  chemically synthesized
caattgagtcctttggtagttt

SEQ ID NO: 891857 - DNA, 22 bp, Artificial Sequence
  chemically synthesized
agtcctttggtagtttttagtg

SEQ ID NO: 891858 - DNA, 22 bp, Artificial Sequence
  chemically synthesized
cccataatgtcaaatccacact

SEQ ID NO: 891859 - DNA, 22 bp, Artificial Sequence
  chemically synthesized
tggtagtttttagtgtggattt

SEQ ID NO: 891860 - DNA, 22 bp, Artificial Sequence
  chemically synthesized
ggtagtttttagtgtggatttg

SEQ ID NO: 891861 - DNA, 22 bp, Artificial Sequence
  chemically synthesized
gtagtttttagtgtggatttga

SEQ ID NO: 891862 - DNA, 22 bp, Artificial Sequence
  chemically synthesized
ttagtgtggatttgacattatg

SEQ ID NO: 891863 - DNA, 22 bp, Artificial Sequence
  chemically synthesized
tagtgtggatttgacattatgg

SEQ ID NO: 891864 - DNA, 22 bp, Artificial Sequence
  chemically synthesized
agtgtggatttgacattatggg

SEQ ID NO: 891865 - DNA, 22 bp, Artificial Sequence
  chemically synthesized
gtgtggatttgacattatgggc

SEQ ID NO: 891866 - DNA, 22 bp, Artificial Sequence
  chemically synthesized
cagtataaggagcataattgcc

SEQ ID NO: 891867 - DNA, 22 bp, Artificial Sequence
  chemically synthesized
gcagtataaggagcataattgc

SEQ ID NO: 891868 - DNA, 22 bp, Artificial Sequence
  chemically synthesized
gacattatgggcaattatgctc

SEQ ID NO: 891869 - DNA, 22 bp, Artificial Sequence
  chemically synthesized
acattatgggcaattatgctcc

SEQ ID NO: 891870 - DNA, 22 bp, Artificial Sequence
  chemically synthesized
cttgcagtataaggagcataat

SEQ ID NO: 891871 - DNA, 22 bp, Artificial Sequence
  chemically synthesized
ccttgcagtataaggagcataa

SEQ ID NO: 891872 - DNA, 22 bp, Artificial Sequence
  chemically synthesized
ttccttgcagtataaggagcat

SEQ ID NO: 891873 - DNA, 22 bp, Artificial Sequence
  chemically synthesized
tgggcaattatgctccttatac

SEQ ID NO: 891874 - DNA, 22 bp, Artificial Sequence
  chemically synthesized
gctcttccttgcagtataagga

SEQ ID NO: 891875 - DNA, 22 bp, Artificial Sequence
  chemically synthesized
ctggctcttccttgcagtataa

SEQ ID NO: 891876 - DNA, 22 bp, Artificial Sequence
  chemically synthesized
tgctggctcttccttgcagtat

SEQ ID NO: 891877 - DNA, 22 bp, Artificial Sequence
  chemically synthesized
tgctccttatactgcaaggaag

SEQ ID NO: 891878 - DNA, 22 bp, Artificial Sequence
  chemically synthesized
cttatactgcaaggaagagcca

SEQ ID NO: 891879 - DNA, 22 bp, Artificial Sequence
  chemically synthesized
atactgcaaggaagagccagca

SEQ ID NO: 891880 - DNA, 22 bp, Artificial Sequence
  chemically synthesized
tactgcaaggaagagccagcag

SEQ ID NO: 891881 - DNA, 22 bp, Artificial Sequence
  chemically synthesized
caaggaagagccagcagagcca

SEQ ID NO: 891882 - DNA, 22 bp, Artificial Sequence
  chemically synthesized
taaataaacatgacatgtggct

SEQ ID NO: 891883 - DNA, 22 bp, Artificial Sequence
  chemically synthesized
ataaataaacatgacatgtggc

SEQ ID NO: 891884 - DNA, 22 bp, Artificial Sequence
  chemically synthesized
tggtttataaataaacatgaca

SEQ ID NO: 891885 - DNA, 22 bp, Artificial Sequence
  chemically synthesized
tgtggtttataaataaacatga

SEQ ID NO: 891886 - DNA, 22 bp, Artificial Sequence
  chemically synthesized
ctgtggtttataaataaacatg

SEQ ID NO: 891887 - DNA, 22 bp, Artificial Sequence
  chemically synthesized
cttctgtggtttataaataaac

SEQ ID NO: 891888 - DNA, 22 bp, Artificial Sequence
  chemically synthesized
ccttctgtggtttataaataaa

SEQ ID NO: 891889 - DNA, 22 bp, Artificial Sequence
  chemically synthesized
tccttctgtggtttataaataa

SEQ ID NO: 891890 - DNA, 22 bp, Artificial Sequence
  chemically synthesized
aagaatcactttccttctgtgg

SEQ ID NO: 891891 - DNA, 22 bp, Artificial Sequence
  chemically synthesized
atttataaaccacagaaggaaa

SEQ ID NO: 891892 - DNA, 22 bp, Artificial Sequence
  chemically synthesized
tttataaaccacagaaggaaag

SEQ ID NO: 891893 - DNA, 22 bp, Artificial Sequence
  chemically synthesized
ccctcaagaatcactttccttc

SEQ ID NO: 891894 - DNA, 22 bp, Artificial Sequence
  chemically synthesized
ataaaccacagaaggaaagtga

SEQ ID NO: 891895 - DNA, 22 bp, Artificial Sequence
  chemically synthesized
taaaccacagaaggaaagtgat

SEQ ID NO: 891896 - DNA, 22 bp, Artificial Sequence
  chemically synthesized
ctcccctcaagaatcactttcc

SEQ ID NO: 891897 - DNA, 22 bp, Artificial Sequence
  chemically synthesized
cctcccctcaagaatcactttc

SEQ ID NO: 891898 - DNA, 22 bp, Artificial Sequence
  chemically synthesized
tcctcccctcaagaatcacttt

SEQ ID NO: 891899 - DNA, 22 bp, Artificial Sequence
  chemically synthesized
ttcctcccctcaagaatcactt

SEQ ID NO: 891900 - DNA, 22 bp, Artificial Sequence
  chemically synthesized
tttcctcccctcaagaatcact

SEQ ID NO: 891901 - DNA, 22 bp, Artificial Sequence
  chemically synthesized
atcacagggagggggttttttc

SEQ ID NO: 891902 - DNA, 22 bp, Artificial Sequence
  chemically synthesized
aatcacagggagggggtttttt

SEQ ID NO: 891903 - DNA, 22 bp, Artificial Sequence
  chemically synthesized
ttgaggggaggaaaaaaccccc

SEQ ID NO: 891904 - DNA, 22 bp, Artificial Sequence
  chemically synthesized
gaggggaggaaaaaaccccctc

SEQ ID NO: 891905 - DNA, 22 bp, Artificial Sequence
  chemically synthesized
aggggaggaaaaaaccccctcc

SEQ ID NO: 891906 - DNA, 22 bp, Artificial Sequence
  chemically synthesized
atcttaatcacagggagggggt

SEQ ID NO: 891907 - DNA, 22 bp, Artificial Sequence
  chemically synthesized
catcttaatcacagggaggggg

SEQ ID NO: 891908 - DNA, 22 bp, Artificial Sequence
  chemically synthesized
tcatcttaatcacagggagggg

SEQ ID NO: 891909 - DNA, 22 bp, Artificial Sequence
  chemically synthesized
aaatactttcatcttaatcaca

SEQ ID NO: 891910 - DNA, 22 bp, Artificial Sequence
  chemically synthesized
gtgactgaaatactttcatctt

SEQ ID NO: 891911 - DNA, 22 bp, Artificial Sequence
  chemically synthesized
agtgactgaaatactttcatct

SEQ ID NO: 891912 - DNA, 22 bp, Artificial Sequence
  chemically synthesized
cctgtgattaagatgaaagtat

SEQ ID NO: 891913 - DNA, 22 bp, Artificial Sequence
  chemically synthesized
tgattaagatgaaagtatttca

SEQ ID NO: 891914 - DNA, 22 bp, Artificial Sequence
  chemically synthesized
aggcttagtgactgaaatactt

SEQ ID NO: 891915 - DNA, 22 bp, Artificial Sequence
  chemically synthesized
tgttaaggcttagtgactgaaa

SEQ ID NO: 891916 - DNA, 22 bp, Artificial Sequence
  chemically synthesized
agatgaaagtatttcagtcact

SEQ ID NO: 891917 - DNA, 22 bp, Artificial Sequence
  chemically synthesized
atgttaaggcttagtgactgaa

SEQ ID NO: 891918 - DNA, 22 bp, Artificial Sequence
  chemically synthesized
tatgttaaggcttagtgactga

SEQ ID NO: 891919 - DNA, 22 bp, Artificial Sequence
  chemically synthesized
cagtcactaagccttaacataa

SEQ ID NO: 891920 - DNA, 22 bp, Artificial Sequence
  chemically synthesized
agtcactaagccttaacataaa

SEQ ID NO: 891921 - DNA, 22 bp, Artificial Sequence
  chemically synthesized
agccttaacataaaattatgtg

SEQ ID NO: 891922 - DNA, 22 bp, Artificial Sequence
  chemically synthesized
aacataaaattatgtgtcccgc

SEQ ID NO: 891923 - DNA, 22 bp, Artificial Sequence
  chemically synthesized
acataaaattatgtgtcccgcc

SEQ ID NO: 891924 - DNA, 22 bp, Artificial Sequence
  chemically synthesized
aaatatgaggtgtggcgggaca

SEQ ID NO: 891925 - DNA, 22 bp, Artificial Sequence
  chemically synthesized
ttaaaatatgaggtgtggcggg

SEQ ID NO: 891926 - DNA, 22 bp, Artificial Sequence
  chemically synthesized
attaaaatatgaggtgtggcgg

SEQ ID NO: 891927 - DNA, 22 bp, Artificial Sequence
  chemically synthesized
tattaaaatatgaggtgtggcg

SEQ ID NO: 891928 - DNA, 22 bp, Artificial Sequence
  chemically synthesized
ttattaaaatatgaggtgtggc

SEQ ID NO: 891929 - DNA, 22 bp, Artificial Sequence
  chemically synthesized
tttattaaaatatgaggtgtgg

SEQ ID NO: 891930 - DNA, 22 bp, Artificial Sequence
  chemically synthesized
tgtgtcccgccacacctcatat

SEQ ID NO: 891931 - DNA, 22 bp, Artificial Sequence
  chemically synthesized
caaactttttattaaaatatga

SEQ ID NO: 891932 - DNA, 22 bp, Artificial Sequence
  chemically synthesized
ccaaactttttattaaaatatg

SEQ ID NO: 891933 - DNA, 22 bp, Artificial Sequence
  chemically synthesized
tccaaactttttattaaaatat

SEQ ID NO: 891934 - DNA, 22 bp, Artificial Sequence
  chemically synthesized
ctttccaaactttttattaaaa

SEQ ID NO: 891935 - DNA, 22 bp, Artificial Sequence
  chemically synthesized
ctgctttccaaactttttatta

SEQ ID NO: 891936 - DNA, 22 bp, Artificial Sequence
  chemically synthesized
actactgctttccaaacttttt

SEQ ID NO: 891937 - DNA, 22 bp, Artificial Sequence
  chemically synthesized
atattttaataaaaagtttgga

SEQ ID NO: 891938 - DNA, 22 bp, Artificial Sequence
  chemically synthesized
taataaaaagtttggaaagcag

SEQ ID NO: 891939 - DNA, 22 bp, Artificial Sequence
  chemically synthesized
aataaaaagtttggaaagcagt

SEQ ID NO: 891940 - DNA, 22 bp, Artificial Sequence
  chemically synthesized
ataaaaagtttggaaagcagta

SEQ ID NO: 891941 - DNA, 22 bp, Artificial Sequence
  chemically synthesized
acataagactgactactgcttt

SEQ ID NO: 891942 - DNA, 22 bp, Artificial Sequence
  chemically synthesized
tctgacataagactgactactg

SEQ ID NO: 891943 - DNA, 22 bp, Artificial Sequence
  chemically synthesized
atctgacataagactgactact

SEQ ID NO: 891944 - DNA, 22 bp, Artificial Sequence
  chemically synthesized
tttatctgacataagactgact

SEQ ID NO: 891945 - DNA, 22 bp, Artificial Sequence
  chemically synthesized
ggaaagcagtagtcagtcttat

SEQ ID NO: 891946 - DNA, 22 bp, Artificial Sequence
  chemically synthesized
gaaagcagtagtcagtcttatg

SEQ ID NO: 891947 - DNA, 22 bp, Artificial Sequence
  chemically synthesized
gaggtatactatttatctgaca

SEQ ID NO: 891948 - DNA, 22 bp, Artificial Sequence
  chemically synthesized
atgtcagataaatagtatacct

SEQ ID NO: 891949 - DNA, 22 bp, Artificial Sequence
  chemically synthesized
tgtcagataaatagtatacctc

SEQ ID NO: 891950 - DNA, 22 bp, Artificial Sequence
  chemically synthesized
aataatgagctagaggtatact

SEQ ID NO: 891951 - DNA, 22 bp, Artificial Sequence
  chemically synthesized
caataatgagctagaggtatac

SEQ ID NO: 891952 - DNA, 22 bp, Artificial Sequence
  chemically synthesized
tcaataatgagctagaggtata

SEQ ID NO: 891953 - DNA, 22 bp, Artificial Sequence
  chemically synthesized
atgaatgctttcaataatgagc

SEQ ID NO: 891954 - DNA, 22 bp, Artificial Sequence
  chemically synthesized
aatgaatgctttcaataatgag

SEQ ID NO: 891955 - DNA, 22 bp, Artificial Sequence
  chemically synthesized
taatgaatgctttcaataatga

SEQ ID NO: 891956 - DNA, 22 bp, Artificial Sequence
  chemically synthesized
acctttaatgaatgctttcaat

SEQ ID NO: 891957 - DNA, 22 bp, Artificial Sequence
  chemically synthesized
aacctttaatgaatgctttcaa

SEQ ID NO: 891958 - DNA, 22 bp, Artificial Sequence
  chemically synthesized
taacctttaatgaatgctttca

SEQ ID NO: 891959 - DNA, 22 bp, Artificial Sequence
  chemically synthesized
tagctcattattgaaagcattc

SEQ ID NO: 891960 - DNA, 22 bp, Artificial Sequence
  chemically synthesized
ttaacctttaatgaatgctttc

SEQ ID NO: 891961 - DNA, 22 bp, Artificial Sequence
  chemically synthesized
gctcattattgaaagcattcat

SEQ ID NO: 891962 - DNA, 22 bp, Artificial Sequence
  chemically synthesized
tgtttttaacctttaatgaatg

SEQ ID NO: 891963 - DNA, 22 bp, Artificial Sequence
  chemically synthesized
attattgaaagcattcattaaa

SEQ ID NO: 891964 - DNA, 22 bp, Artificial Sequence
  chemically synthesized
atgtttttaacctttaatgaat

SEQ ID NO: 891965 - DNA, 22 bp, Artificial Sequence
  chemically synthesized
ttgaaagcattcattaaaggtt

SEQ ID NO: 891966 - DNA, 22 bp, Artificial Sequence
  chemically synthesized
aaagcattcattaaaggttaaa

SEQ ID NO: 891967 - DNA, 22 bp, Artificial Sequence
  chemically synthesized
taaagggtcttatgtttttaac

SEQ ID NO: 891968 - DNA, 22 bp, Artificial Sequence
  chemically synthesized
tataaagggtcttatgttttta

SEQ ID NO: 891969 - DNA, 22 bp, Artificial Sequence
  chemically synthesized
ctataaagggtcttatgttttt

SEQ ID NO: 891970 - DNA, 22 bp, Artificial Sequence
  chemically synthesized
attaaaggttaaaaacataaga

SEQ ID NO: 891971 - DNA, 22 bp, Artificial Sequence
  chemically synthesized
aaggttaaaaacataagaccct

SEQ ID NO: 891972 - DNA, 22 bp, Artificial Sequence
  chemically synthesized
gaatttctataaagggtcttat

SEQ ID NO: 891973 - DNA, 22 bp, Artificial Sequence
  chemically synthesized
agaatttctataaagggtctta

SEQ ID NO: 891974 - DNA, 22 bp, Artificial Sequence
  chemically synthesized
aaaacataagaccctttataga

SEQ ID NO: 891975 - DNA, 22 bp, Artificial Sequence
  chemically synthesized
agatcccgggaccagtttagaa

SEQ ID NO: 891976 - DNA, 22 bp, Artificial Sequence
  chemically synthesized
tatagaaattctaaactggtcc

SEQ ID NO: 891977 - DNA, 22 bp, Artificial Sequence
  chemically synthesized
atagaaattctaaactggtccc

SEQ ID NO: 891978 - DNA, 22 bp, Artificial Sequence
  chemically synthesized
tagaaattctaaactggtcccg

SEQ ID NO: 891979 - DNA, 22 bp, Artificial Sequence
  chemically synthesized
aatgctaagatcccgggaccag

SEQ ID NO: 891980 - DNA, 22 bp, Artificial Sequence
  chemically synthesized
taaactggtcccgggatcttag

SEQ ID NO: 891981 - DNA, 22 bp, Artificial Sequence
  chemically synthesized
aactggtcccgggatcttagca

SEQ ID NO: 891982 - DNA, 22 bp, Artificial Sequence
  chemically synthesized
agaaatgataattgaatgctaa

SEQ ID NO: 891983 - DNA, 22 bp, Artificial Sequence
  chemically synthesized
gtcccgggatcttagcattcaa

SEQ ID NO: 891984 - DNA, 22 bp, Artificial Sequence
  chemically synthesized
cagaaatgataattgaatgcta

SEQ ID NO: 891985 - DNA, 22 bp, Artificial Sequence
  chemically synthesized
agatttcagaaatgataattga

SEQ ID NO: 891986 - DNA, 22 bp, Artificial Sequence
  chemically synthesized
cagatttcagaaatgataattg

SEQ ID NO: 891987 - DNA, 22 bp, Artificial Sequence
  chemically synthesized
atttcagatttcagaaatgata

SEQ ID NO: 891988 - DNA, 22 bp, Artificial Sequence
  chemically synthesized
agcattcaattatcatttctga

SEQ ID NO: 891989 - DNA, 22 bp, Artificial Sequence
  chemically synthesized
gcattcaattatcatttctgaa

SEQ ID NO: 891990 - DNA, 22 bp, Artificial Sequence
  chemically synthesized
aattatcatttctgaaatctga

SEQ ID NO: 891991 - DNA, 22 bp, Artificial Sequence
  chemically synthesized
tcatttctgaaatctgaaatca

SEQ ID NO: 891992 - DNA, 22 bp, Artificial Sequence
  chemically synthesized
gacataaaatatgttgatttca

SEQ ID NO: 891993 - DNA, 22 bp, Artificial Sequence
  chemically synthesized
agacataaaatatgttgatttc

SEQ ID NO: 891994 - DNA, 22 bp, Artificial Sequence
  chemically synthesized
ctgaaatctgaaatcaacatat

SEQ ID NO: 891995 - DNA, 22 bp, Artificial Sequence
  chemically synthesized
tgaaatctgaaatcaacatatt

SEQ ID NO: 891996 - DNA, 22 bp, Artificial Sequence
  chemically synthesized
aatttagacataaaatatgttg

SEQ ID NO: 891997 - DNA, 22 bp, Artificial Sequence
  chemically synthesized
aaatctgaaatcaacatatttt

SEQ ID NO: 891998 - DNA, 22 bp, Artificial Sequence
  chemically synthesized
tcaatttagacataaaatatgt

SEQ ID NO: 891999 - DNA, 22 bp, Artificial Sequence
  chemically synthesized
aaatcaacatattttatgtcta

SEQ ID NO: 892000 - DNA, 22 bp, Artificial Sequence
  chemically synthesized
aaatatactctcaatttagaca

SEQ ID NO: 892001 - DNA, 22 bp, Artificial Sequence
  chemically synthesized
caaatatactctcaatttagac

SEQ ID NO: 892002 - DNA, 22 bp, Artificial Sequence
  chemically synthesized
tcaaatatactctcaatttaga

SEQ ID NO: 892003 - DNA, 22 bp, Artificial Sequence
  chemically synthesized
attttcaaatatactctcaatt

SEQ ID NO: 892004 - DNA, 22 bp, Artificial Sequence
  chemically synthesized
gattttcaaatatactctcaat

SEQ ID NO: 892005 - DNA, 22 bp, Artificial Sequence
  chemically synthesized
tgattttcaaatatactctcaa

SEQ ID NO: 892006 - DNA, 22 bp, Artificial Sequence
  chemically synthesized
tatgtctaaattgagagtatat

SEQ ID NO: 892007 - DNA, 22 bp, Artificial Sequence
  chemically synthesized
atgtctaaattgagagtatatt

SEQ ID NO: 892008 - DNA, 22 bp, Artificial Sequence
  chemically synthesized
tgtctaaattgagagtatattt

SEQ ID NO: 892009 - DNA, 22 bp, Artificial Sequence
  chemically synthesized
aattttgattttcaaatatact

SEQ ID NO: 892010 - DNA, 22 bp, Artificial Sequence
  chemically synthesized
gaattttgattttcaaatatac

SEQ ID NO: 892011 - DNA, 22 bp, Artificial Sequence
  chemically synthesized
tgaattttgattttcaaatata

SEQ ID NO: 892012 - DNA, 22 bp, Artificial Sequence
  chemically synthesized
aattgagagtatatttgaaaat

SEQ ID NO: 892013 - DNA, 22 bp, Artificial Sequence
  chemically synthesized
agagtatatttgaaaatcaaaa

SEQ ID NO: 892014 - DNA, 22 bp, Artificial Sequence
  chemically synthesized
gaaggcatgcctttgaattttg

SEQ ID NO: 892015 - DNA, 22 bp, Artificial Sequence
  chemically synthesized
gaaaatcaaaattcaaaggcat

SEQ ID NO: 892016 - DNA, 22 bp, Artificial Sequence
  chemically synthesized
aaaatcaaaattcaaaggcatg

SEQ ID NO: 892017 - DNA, 22 bp, Artificial Sequence
  chemically synthesized
ccatcagtcagcccactagaag

SEQ ID NO: 892018 - DNA, 22 bp, Artificial Sequence
  chemically synthesized
cccatcagtcagcccactagaa

SEQ ID NO: 892019 - DNA, 22 bp, Artificial Sequence
  chemically synthesized
aaaggcatgccttctagtgggc

SEQ ID NO: 892020 - DNA, 22 bp, Artificial Sequence
  chemically synthesized
tcccatcagtcagcccactaga

SEQ ID NO: 892021 - DNA, 22 bp, Artificial Sequence
  chemically synthesized
ctagtgggctgactgatgggaa

SEQ ID NO: 892022 - DNA, 22 bp, Artificial Sequence
  chemically synthesized
tagtgggctgactgatgggaaa

SEQ ID NO: 892023 - DNA, 22 bp, Artificial Sequence
  chemically synthesized
gtgggctgactgatgggaaagg

SEQ ID NO: 892024 - DNA, 22 bp, Artificial Sequence
  chemically synthesized
ggcgtaatcacagccctttccc

SEQ ID NO: 892025 - DNA, 22 bp, Artificial Sequence
  chemically synthesized
actgatgggaaagggctgtgat

SEQ ID NO: 892026 - DNA, 22 bp, Artificial Sequence
  chemically synthesized
atgggaaagggctgtgattacg

SEQ ID NO: 892027 - DNA, 22 bp, Artificial Sequence
  chemically synthesized
tgattacgcctaattttcaccc

SEQ ID NO: 892028 - DNA, 22 bp, Artificial Sequence
  chemically synthesized
cgcctaattttcaccctctaca

SEQ ID NO: 892029 - DNA, 22 bp, Artificial Sequence
  chemically synthesized
attttcaccctctacatcacga

SEQ ID NO: 892030 - DNA, 22 bp, Artificial Sequence
  chemically synthesized
tcaccctctacatcacgatctc

SEQ ID NO: 892031 - DNA, 22 bp, Artificial Sequence
  chemically synthesized
caccctctacatcacgatctca

SEQ ID NO: 892032 - DNA, 22 bp, Artificial Sequence
  chemically synthesized
accctctacatcacgatctcat

SEQ ID NO: 892033 - DNA, 22 bp, Artificial Sequence
  chemically synthesized
agaaacataatcaatgagatcg

SEQ ID NO: 892034 - DNA, 22 bp, Artificial Sequence
  chemically synthesized
tacatcacgatctcattgatta

SEQ ID NO: 892035 - DNA, 22 bp, Artificial Sequence
  chemically synthesized
catcacgatctcattgattatg

SEQ ID NO: 892036 - DNA, 22 bp, Artificial Sequence
  chemically synthesized
gcaagctgagaaacataatcaa

SEQ ID NO: 892037 - DNA, 22 bp, Artificial Sequence
  chemically synthesized
agcaagctgagaaacataatca

SEQ ID NO: 892038 - DNA, 22 bp, Artificial Sequence
  chemically synthesized
attgattatgtttctcagcttg

SEQ ID NO: 892039 - DNA, 22 bp, Artificial Sequence
  chemically synthesized
acagaacccttagcaagctgag

SEQ ID NO: 892040 - DNA, 22 bp, Artificial Sequence
  chemically synthesized
attatgtttctcagcttgctaa

SEQ ID NO: 892041 - DNA, 22 bp, Artificial Sequence
  chemically synthesized
tgtttctcagcttgctaagggt

SEQ ID NO: 892042 - DNA, 22 bp, Artificial Sequence
  chemically synthesized
aaaatcacctcacagaaccctt

SEQ ID NO: 892043 - DNA, 22 bp, Artificial Sequence
  chemically synthesized
ctcagcttgctaagggttctgt

SEQ ID NO: 892044 - DNA, 22 bp, Artificial Sequence
  chemically synthesized
gaaaatcacctcacagaaccct

SEQ ID NO: 892045 - DNA, 22 bp, Artificial Sequence
  chemically synthesized
tcagcttgctaagggttctgtg

SEQ ID NO: 892046 - DNA, 22 bp, Artificial Sequence
  chemically synthesized
agcttgctaagggttctgtgag

SEQ ID NO: 892047 - DNA, 22 bp, Artificial Sequence
  chemically synthesized
atcttgaaaatcacctcacaga

SEQ ID NO: 892048 - DNA, 22 bp, Artificial Sequence
  chemically synthesized
gctaagggttctgtgaggtgat

SEQ ID NO: 892049 - DNA, 22 bp, Artificial Sequence
  chemically synthesized
ctaagggttctgtgaggtgatt

SEQ ID NO: 892050 - DNA, 22 bp, Artificial Sequence
  chemically synthesized
agggttctgtgaggtgattttc

SEQ ID NO: 892051 - DNA, 22 bp, Artificial Sequence
  chemically synthesized
tgtgaggtgattttcaagatga

SEQ ID NO: 892052 - DNA, 22 bp, Artificial Sequence
  chemically synthesized
caaatagcaatattcatcttga

SEQ ID NO: 892053 - DNA, 22 bp, Artificial Sequence
  chemically synthesized
tgaggtgattttcaagatgaat

SEQ ID NO: 892054 - DNA, 22 bp, Artificial Sequence
  chemically synthesized
aggaaatcctgcaaatagcaat

SEQ ID NO: 892055 - DNA, 22 bp, Artificial Sequence
  chemically synthesized
tcaagatgaatattgctatttg

SEQ ID NO: 892056 - DNA, 22 bp, Artificial Sequence
  chemically synthesized
caagatgaatattgctatttgc

SEQ ID NO: 892057 - DNA, 22 bp, Artificial Sequence
  chemically synthesized
aagatgaatattgctatttgca

SEQ ID NO: 892058 - DNA, 22 bp, Artificial Sequence
  chemically synthesized
ttcaggaaatcctgcaaatagc

SEQ ID NO: 892059 - DNA, 22 bp, Artificial Sequence
  chemically synthesized
ctattcaggaaatcctgcaaat

SEQ ID NO: 892060 - DNA, 22 bp, Artificial Sequence
  chemically synthesized
ctatttgcaggatttcctgaat

SEQ ID NO: 892061 - DNA, 22 bp, Artificial Sequence
  chemically synthesized
ccgaaatattcctattcaggaa

SEQ ID NO: 892062 - DNA, 22 bp, Artificial Sequence
  chemically synthesized
tttgcaggatttcctgaatagg

SEQ ID NO: 892063 - DNA, 22 bp, Artificial Sequence
  chemically synthesized
ctcccgaaatattcctattcag

SEQ ID NO: 892064 - DNA, 22 bp, Artificial Sequence
  chemically synthesized
actcccgaaatattcctattca

SEQ ID NO: 892065 - DNA, 22 bp, Artificial Sequence
  chemically synthesized
gcaggatttcctgaataggaat

SEQ ID NO: 892066 - DNA, 22 bp, Artificial Sequence
  chemically synthesized
caggatttcctgaataggaata

SEQ ID NO: 892067 - DNA, 22 bp, Artificial Sequence
  chemically synthesized
tgcaatttactcccgaaatatt

SEQ ID NO: 892068 - DNA, 22 bp, Artificial Sequence
  chemically synthesized
gtgcaatttactcccgaaatat

SEQ ID NO: 892069 - DNA, 22 bp, Artificial Sequence
  chemically synthesized
cctgaataggaatatttcggga

SEQ ID NO: 892070 - DNA, 22 bp, Artificial Sequence
  chemically synthesized
ctgaataggaatatttcgggag

SEQ ID NO: 892071 - DNA, 22 bp, Artificial Sequence
  chemically synthesized
gtttgtgcaatttactcccgaa

SEQ ID NO: 892072 - DNA, 22 bp, Artificial Sequence
  chemically synthesized
aataggaatatttcgggagtaa

SEQ ID NO: 892073 - DNA, 22 bp, Artificial Sequence
  chemically synthesized
ggtttgtgcaatttactcccga

SEQ ID NO: 892074 - DNA, 22 bp, Artificial Sequence
  chemically synthesized
cttggtttgtgcaatttactcc

SEQ ID NO: 892075 - DNA, 22 bp, Artificial Sequence
  chemically synthesized
cacattgcttggtttgtgcaat

SEQ ID NO: 892076 - DNA, 22 bp, Artificial Sequence
  chemically synthesized
cgggagtaaattgcacaaacca

SEQ ID NO: 892077 - DNA, 22 bp, Artificial Sequence
  chemically synthesized
gggagtaaattgcacaaaccaa

SEQ ID NO: 892078 - DNA, 22 bp, Artificial Sequence
  chemically synthesized
actgcacattgcttggtttgtg

SEQ ID NO: 892079 - DNA, 22 bp, Artificial Sequence
  chemically synthesized
cacaaaccaagcaatgtgcagt

SEQ ID NO: 892080 - DNA, 22 bp, Artificial Sequence
  chemically synthesized
gagtgaaaattgactgcacatt

SEQ ID NO: 892081 - DNA, 22 bp, Artificial Sequence
  chemically synthesized
tgctggagtgaaaattgactgc

SEQ ID NO: 892082 - DNA, 22 bp, Artificial Sequence
  chemically synthesized
atgctggagtgaaaattgactg

SEQ ID NO: 892083 - DNA, 22 bp, Artificial Sequence
  chemically synthesized
tttatgctggagtgaaaattga

SEQ ID NO: 892084 - DNA, 22 bp, Artificial Sequence
  chemically synthesized
atacattgtttatgctggagtg

SEQ ID NO: 892085 - DNA, 22 bp, Artificial Sequence
  chemically synthesized
taatacattgtttatgctggag

SEQ ID NO: 892086 - DNA, 22 bp, Artificial Sequence
  chemically synthesized
tgttctaatacattgtttatgc

SEQ ID NO: 892087 - DNA, 22 bp, Artificial Sequence
  chemically synthesized
tcactccagcataaacaatgta

SEQ ID NO: 892088 - DNA, 22 bp, Artificial Sequence
  chemically synthesized
cactccagcataaacaatgtat

SEQ ID NO: 892089 - DNA, 22 bp, Artificial Sequence
  chemically synthesized
actccagcataaacaatgtatt

SEQ ID NO: 892090 - DNA, 22 bp, Artificial Sequence
  chemically synthesized
agggctgtgttctaatacattg

SEQ ID NO: 892091 - DNA, 22 bp, Artificial Sequence
  chemically synthesized
aagggctgtgttctaatacatt

SEQ ID NO: 892092 - DNA, 22 bp, Artificial Sequence
  chemically synthesized
taagggctgtgttctaatacat

SEQ ID NO: 892093 - DNA, 22 bp, Artificial Sequence
  chemically synthesized
cagcataaacaatgtattagaa

SEQ ID NO: 892094 - DNA, 22 bp, Artificial Sequence
  chemically synthesized
gaacacagcccttaaagctttt

SEQ ID NO: 892095 - DNA, 22 bp, Artificial Sequence
  chemically synthesized
tgtagtgaaacccagataaaaa

SEQ ID NO: 892096 - DNA, 22 bp, Artificial Sequence
  chemically synthesized
aaagcttttttttatctgggtt

SEQ ID NO: 892097 - DNA, 22 bp, Artificial Sequence
  chemically synthesized
gctgtgtagtgaaacccagata

SEQ ID NO: 892098 - DNA, 22 bp, Artificial Sequence
  chemically synthesized
aagcttttttttatctgggttt

SEQ ID NO: 892099 - DNA, 22 bp, Artificial Sequence
  chemically synthesized
ttttttatctgggtttcactac

SEQ ID NO: 892100 - DNA, 22 bp, Artificial Sequence
  chemically synthesized
tttttatctgggtttcactaca

SEQ ID NO: 892101 - DNA, 22 bp, Artificial Sequence
  chemically synthesized
ttttatctgggtttcactacac

SEQ ID NO: 892102 - DNA, 22 bp, Artificial Sequence
  chemically synthesized
tttatctgggtttcactacaca

SEQ ID NO: 892103 - DNA, 22 bp, Artificial Sequence
  chemically synthesized
ttatctgggtttcactacacag

SEQ ID NO: 892104 - DNA, 22 bp, Artificial Sequence
  chemically synthesized
tatctgggtttcactacacagc

SEQ ID NO: 892105 - DNA, 22 bp, Artificial Sequence
  chemically synthesized
atctgggtttcactacacagct

SEQ ID NO: 892106 - DNA, 22 bp, Artificial Sequence
  chemically synthesized
tctgggtttcactacacagcta

SEQ ID NO: 892107 - DNA, 22 bp, Artificial Sequence
  chemically synthesized
atgaaatgcagctagctgtgta

SEQ ID NO: 892108 - DNA, 22 bp, Artificial Sequence
  chemically synthesized
ttgatgaaatgcagctagctgt

SEQ ID NO: 892109 - DNA, 22 bp, Artificial Sequence
  chemically synthesized
ggtttcactacacagctagctg

SEQ ID NO: 892110 - DNA, 22 bp, Artificial Sequence
  chemically synthesized
attgatgaaatgcagctagctg

SEQ ID NO: 892111 - DNA, 22 bp, Artificial Sequence
  chemically synthesized
ttattgatgaaatgcagctagc

SEQ ID NO: 892112 - DNA, 22 bp, Artificial Sequence
  chemically synthesized
cactacacagctagctgcattt

SEQ ID NO: 892113 - DNA, 22 bp, Artificial Sequence
  chemically synthesized
actacacagctagctgcatttc

SEQ ID NO: 892114 - DNA, 22 bp, Artificial Sequence
  chemically synthesized
actcttattgatgaaatgcagc

SEQ ID NO: 892115 - DNA, 22 bp, Artificial Sequence
  chemically synthesized
cactcttattgatgaaatgcag

SEQ ID NO: 892116 - DNA, 22 bp, Artificial Sequence
  chemically synthesized
cacagctagctgcatttcatca

SEQ ID NO: 892117 - DNA, 22 bp, Artificial Sequence
  chemically synthesized
gtacttcactcttattgatgaa

SEQ ID NO: 892118 - DNA, 22 bp, Artificial Sequence
  chemically synthesized
ggtacttcactcttattgatga

SEQ ID NO: 892119 - DNA, 22 bp, Artificial Sequence
  chemically synthesized
cttggtacttcactcttattga

SEQ ID NO: 892120 - DNA, 22 bp, Artificial Sequence
  chemically synthesized
gctgcatttcatcaataagagt

SEQ ID NO: 892121 - DNA, 22 bp, Artificial Sequence
  chemically synthesized
tctgcttggtacttcactctta

SEQ ID NO: 892122 - DNA, 22 bp, Artificial Sequence
  chemically synthesized
catttcatcaataagagtgaag

SEQ ID NO: 892123 - DNA, 22 bp, Artificial Sequence
  chemically synthesized
gtctgcttggtacttcactctt

SEQ ID NO: 892124 - DNA, 22 bp, Artificial Sequence
  chemically synthesized
tgtctgcttggtacttcactct

SEQ ID NO: 892125 - DNA, 22 bp, Artificial Sequence
  chemically synthesized
catcaataagagtgaagtacca

SEQ ID NO: 892126 - DNA, 22 bp, Artificial Sequence
  chemically synthesized
atcaataagagtgaagtaccaa

SEQ ID NO: 892127 - DNA, 22 bp, Artificial Sequence
  chemically synthesized
agttttgtctgcttggtacttc

SEQ ID NO: 892128 - DNA, 22 bp, Artificial Sequence
  chemically synthesized
tgagcctcagttttgtctgctt

SEQ ID NO: 892129 - DNA, 22 bp, Artificial Sequence
  chemically synthesized
tgtgagcctcagttttgtctgc

SEQ ID NO: 892130 - DNA, 22 bp, Artificial Sequence
  chemically synthesized
tctgtgagcctcagttttgtct

SEQ ID NO: 892131 - DNA, 22 bp, Artificial Sequence
  chemically synthesized
tctctgtgagcctcagttttgt

SEQ ID NO: 892132 - DNA, 22 bp, Artificial Sequence
  chemically synthesized
gaaaaatatgtaataccctctc

SEQ ID NO: 892133 - DNA, 22 bp, Artificial Sequence
  chemically synthesized
aggctcacagagagagggtatt

SEQ ID NO: 892134 - DNA, 22 bp, Artificial Sequence
  chemically synthesized
ttagaaaaatatgtaataccct

SEQ ID NO: 892135 - DNA, 22 bp, Artificial Sequence
  chemically synthesized
acagagagagggtattacatat

SEQ ID NO: 892136 - DNA, 22 bp, Artificial Sequence
  chemically synthesized
agcacacctgttagaaaaatat

SEQ ID NO: 892137 - DNA, 22 bp, Artificial Sequence
  chemically synthesized
tgagcacacctgttagaaaaat

SEQ ID NO: 892138 - DNA, 22 bp, Artificial Sequence
  chemically synthesized
catatttttctaacaggtgtgc

SEQ ID NO: 892139 - DNA, 22 bp, Artificial Sequence
  chemically synthesized
gtcaaactctgagcacacctgt

SEQ ID NO: 892140 - DNA, 22 bp, Artificial Sequence
  chemically synthesized
tagtcaaactctgagcacacct

SEQ ID NO: 892141 - DNA, 22 bp, Artificial Sequence
  chemically synthesized
tctagtcaaactctgagcacac

SEQ ID NO: 892142 - DNA, 22 bp, Artificial Sequence
  chemically synthesized
ctctagtcaaactctgagcaca

SEQ ID NO: 892143 - DNA, 22 bp, Artificial Sequence
  chemically synthesized
tctctagtcaaactctgagcac

SEQ ID NO: 892144 - DNA, 22 bp, Artificial Sequence
  chemically synthesized
ttctaacaggtgtgctcagagt

SEQ ID NO: 892145 - DNA, 22 bp, Artificial Sequence
  chemically synthesized
tctaacaggtgtgctcagagtt

SEQ ID NO: 892146 - DNA, 22 bp, Artificial Sequence
  chemically synthesized
ctaacaggtgtgctcagagttt

SEQ ID NO: 892147 - DNA, 22 bp, Artificial Sequence
  chemically synthesized
ttttctctagtcaaactctgag

SEQ ID NO: 892148 - DNA, 22 bp, Artificial Sequence
  chemically synthesized
taacaggtgtgctcagagtttg

SEQ ID NO: 892149 - DNA, 22 bp, Artificial Sequence
  chemically synthesized
gttttctctagtcaaactctga

SEQ ID NO: 892150 - DNA, 22 bp, Artificial Sequence
  chemically synthesized
acaggtgtgctcagagtttgac

SEQ ID NO: 892151 - DNA, 22 bp, Artificial Sequence
  chemically synthesized
gggtagtttgttttctctagtc

SEQ ID NO: 892152 - DNA, 22 bp, Artificial Sequence
  chemically synthesized
agagtttgactagagaaaacaa

SEQ ID NO: 892153 - DNA, 22 bp, Artificial Sequence
  chemically synthesized
ccattcgggtagtttgttttct

SEQ ID NO: 892154 - DNA, 22 bp, Artificial Sequence
  chemically synthesized
gccattcgggtagtttgttttc

SEQ ID NO: 892155 - DNA, 22 bp, Artificial Sequence
  chemically synthesized
gactagagaaaacaaactaccc

SEQ ID NO: 892156 - DNA, 22 bp, Artificial Sequence
  chemically synthesized
actagagaaaacaaactacccg

SEQ ID NO: 892157 - DNA, 22 bp, Artificial Sequence
  chemically synthesized
aggccttgccattcgggtagtt

SEQ ID NO: 892158 - DNA, 22 bp, Artificial Sequence
  chemically synthesized
gagaaaacaaactacccgaatg

SEQ ID NO: 892159 - DNA, 22 bp, Artificial Sequence
  chemically synthesized
ggaaacaaagggtctgaggcct

SEQ ID NO: 892160 - DNA, 22 bp, Artificial Sequence
  chemically synthesized
cccgaatggcaaggcctcagac

SEQ ID NO: 892161 - DNA, 22 bp, Artificial Sequence
  chemically synthesized
cctcggaaacaaagggtctgag

SEQ ID NO: 892162 - DNA, 22 bp, Artificial Sequence
  chemically synthesized
agaccctttgtttccgaggcag

SEQ ID NO: 892163 - DNA, 22 bp, Artificial Sequence
  chemically synthesized
gccatggtggccatagctgcct

SEQ ID NO: 892164 - DNA, 22 bp, Artificial Sequence
  chemically synthesized
tgtttccgaggcagctatggcc

SEQ ID NO: 892165 - DNA, 22 bp, Artificial Sequence
  chemically synthesized
tctggccatggtggccatagct

SEQ ID NO: 892166 - DNA, 22 bp, Artificial Sequence
  chemically synthesized
gtttccgaggcagctatggcca

SEQ ID NO: 892167 - DNA, 22 bp, Artificial Sequence
  chemically synthesized
gtctggccatggtggccatagc

SEQ ID NO: 892168 - DNA, 22 bp, Artificial Sequence
  chemically synthesized
tttccgaggcagctatggccac

SEQ ID NO: 892169 - DNA, 22 bp, Artificial Sequence
  chemically synthesized
ccgaggcagctatggccaccat

SEQ ID NO: 892170 - DNA, 22 bp, Artificial Sequence
  chemically synthesized
ccttgtctggccatggtggcca

SEQ ID NO: 892171 - DNA, 22 bp, Artificial Sequence
  chemically synthesized
cgaggcagctatggccaccatg

SEQ ID NO: 892172 - DNA, 22 bp, Artificial Sequence
  chemically synthesized
gccttgtctggccatggtggcc

SEQ ID NO: 892173 - DNA, 22 bp, Artificial Sequence
  chemically synthesized
tggccaccatggccagacaagg

SEQ ID NO: 892174 - DNA, 22 bp, Artificial Sequence
  chemically synthesized
aatgtaaagaaacttgccttgt

SEQ ID NO: 892175 - DNA, 22 bp, Artificial Sequence
  chemically synthesized
caaatcctaaatgtaaagaaac

SEQ ID NO: 892176 - DNA, 22 bp, Artificial Sequence
  chemically synthesized
gctccaaatcctaaatgtaaag

SEQ ID NO: 892177 - DNA, 22 bp, Artificial Sequence
  chemically synthesized
ctttacatttaggatttggagc

SEQ ID NO: 892178 - DNA, 22 bp, Artificial Sequence
  chemically synthesized
tttacatttaggatttggagct

SEQ ID NO: 892179 - DNA, 22 bp, Artificial Sequence
  chemically synthesized
tacatttaggatttggagctag

SEQ ID NO: 892180 - DNA, 22 bp, Artificial Sequence
  chemically synthesized
acatttaggatttggagctagg

SEQ ID NO: 892181 - DNA, 22 bp, Artificial Sequence
  chemically synthesized
catttaggatttggagctaggg

SEQ ID NO: 892182 - DNA, 22 bp, Artificial Sequence
  chemically synthesized
aggatttggagctaggggcgtg

SEQ ID NO: 892183 - DNA, 22 bp, Artificial Sequence
  chemically synthesized
ggatttggagctaggggcgtgg

SEQ ID NO: 892184 - DNA, 22 bp, Artificial Sequence
  chemically synthesized
ggagctaggggcgtggctgttc

SEQ ID NO: 892185 - DNA, 22 bp, Artificial Sequence
  chemically synthesized
gagctaggggcgtggctgttcg

SEQ ID NO: 892186 - DNA, 22 bp, Artificial Sequence
  chemically synthesized
ggggcgtggctgttcgtatatc

SEQ ID NO: 892187 - DNA, 22 bp, Artificial Sequence
  chemically synthesized
atgcaaaggaagtagatatacg

SEQ ID NO: 892188 - DNA, 22 bp, Artificial Sequence
  chemically synthesized
ttcgtatatctacttcctttgc

SEQ ID NO: 892189 - DNA, 22 bp, Artificial Sequence
  chemically synthesized
agaaagagttaatgcaaaggaa

SEQ ID NO: 892190 - DNA, 22 bp, Artificial Sequence
  chemically synthesized
aagaaagagttaatgcaaagga

SEQ ID NO: 892191 - DNA, 22 bp, Artificial Sequence
  chemically synthesized
gtatatctacttcctttgcatt

SEQ ID NO: 892192 - DNA, 22 bp, Artificial Sequence
  chemically synthesized
aaatcttaagaaagagttaatg

SEQ ID NO: 892193 - DNA, 22 bp, Artificial Sequence
  chemically synthesized
cttcctttgcattaactctttc

SEQ ID NO: 892194 - DNA, 22 bp, Artificial Sequence
  chemically synthesized
ctaaaatcttaagaaagagtta

SEQ ID NO: 892195 - DNA, 22 bp, Artificial Sequence
  chemically synthesized
actaaaatcttaagaaagagtt

SEQ ID NO: 892196 - DNA, 22 bp, Artificial Sequence
  chemically synthesized
tactaaaatcttaagaaagagt

SEQ ID NO: 892197 - DNA, 22 bp, Artificial Sequence
  chemically synthesized
cctttgcattaactctttctta

SEQ ID NO: 892198 - DNA, 22 bp, Artificial Sequence
  chemically synthesized
ctttgcattaactctttcttaa

SEQ ID NO: 892199 - DNA, 22 bp, Artificial Sequence
  chemically synthesized
tgcattaactctttcttaagat

SEQ ID NO: 892200 - DNA, 22 bp, Artificial Sequence
  chemically synthesized
gcattaactctttcttaagatt

SEQ ID NO: 892201 - DNA, 22 bp, Artificial Sequence
  chemically synthesized
cattaactctttcttaagattt

SEQ ID NO: 892202 - DNA, 22 bp, Artificial Sequence
  chemically synthesized
actctttcttaagattttagta

SEQ ID NO: 892203 - DNA, 22 bp, Artificial Sequence
  chemically synthesized
tttcttaagattttagtaaagg

SEQ ID NO: 892204 - DNA, 22 bp, Artificial Sequence
  chemically synthesized
tcttaagattttagtaaaggtg

SEQ ID NO: 892205 - DNA, 22 bp, Artificial Sequence
  chemically synthesized
cttaagattttagtaaaggtgt

SEQ ID NO: 892206 - DNA, 22 bp, Artificial Sequence
  chemically synthesized
ttaagattttagtaaaggtgtt

SEQ ID NO: 892207 - DNA, 22 bp, Artificial Sequence
  chemically synthesized
aagattttagtaaaggtgtttt

SEQ ID NO: 892208 - DNA, 22 bp, Artificial Sequence
  chemically synthesized
agattttagtaaaggtgttttt

SEQ ID NO: 892209 - DNA, 22 bp, Artificial Sequence
  chemically synthesized
acacaaggtaaaaaaaaaaaaa

SEQ ID NO: 892210 - DNA, 22 bp, Artificial Sequence
  chemically synthesized
tagtaaaggtgttttttttttt

SEQ ID NO: 892211 - DNA, 22 bp, Artificial Sequence
  chemically synthesized
aacacaaggtaaaaaaaaaaaa

SEQ ID NO: 892212 - DNA, 22 bp, Artificial Sequence
  chemically synthesized
agtaaaggtgtttttttttttt

SEQ ID NO: 892213 - DNA, 22 bp, Artificial Sequence
  chemically synthesized
taacacaaggtaaaaaaaaaaa

SEQ ID NO: 892214 - DNA, 22 bp, Artificial Sequence
  chemically synthesized
gtaaaggtgttttttttttttt

SEQ ID NO: 892215 - DNA, 22 bp, Artificial Sequence
  chemically synthesized
ttaacacaaggtaaaaaaaaaa

SEQ ID NO: 892216 - DNA, 22 bp, Artificial Sequence
  chemically synthesized
tttaacacaaggtaaaaaaaaa

SEQ ID NO: 892217 - DNA, 22 bp, Artificial Sequence
  chemically synthesized
ttttaacacaaggtaaaaaaaa

SEQ ID NO: 892218 - DNA, 22 bp, Artificial Sequence
  chemically synthesized
tttttaacacaaggtaaaaaaa

SEQ ID NO: 892219 - DNA, 22 bp, Artificial Sequence
  chemically synthesized
ttttttaacacaaggtaaaaaa

SEQ ID NO: 892220 - DNA, 22 bp, Artificial Sequence
  chemically synthesized
ttttttttttaccttgtgttaa

SEQ ID NO: 892221 - DNA, 22 bp, Artificial Sequence
  chemically synthesized
tttttttttaccttgtgttaaa

SEQ ID NO: 892222 - DNA, 22 bp, Artificial Sequence
  chemically synthesized
ttttttttaccttgtgttaaaa

SEQ ID NO: 892223 - DNA, 22 bp, Artificial Sequence
  chemically synthesized
tttttttaccttgtgttaaaaa

SEQ ID NO: 892224 - DNA, 22 bp, Artificial Sequence
  chemically synthesized
ttttttaccttgtgttaaaaaa

SEQ ID NO: 892225 - DNA, 22 bp, Artificial Sequence
  chemically synthesized
tttttaccttgtgttaaaaaaa

SEQ ID NO: 892226 - DNA, 22 bp, Artificial Sequence
  chemically synthesized
agcacatgcccttttttttaac

SEQ ID NO: 892227 - DNA, 22 bp, Artificial Sequence
  chemically synthesized
ttttaccttgtgttaaaaaaaa

SEQ ID NO: 892228 - DNA, 22 bp, Artificial Sequence
  chemically synthesized
gagcacatgcccttttttttaa

SEQ ID NO: 892229 - DNA, 22 bp, Artificial Sequence
  chemically synthesized
tttaccttgtgttaaaaaaaag

SEQ ID NO: 892230 - DNA, 22 bp, Artificial Sequence
  chemically synthesized
tgagcacatgccctttttttta

SEQ ID NO: 892231 - DNA, 22 bp, Artificial Sequence
  chemically synthesized
ttaccttgtgttaaaaaaaagg

SEQ ID NO: 892232 - DNA, 22 bp, Artificial Sequence
  chemically synthesized
taccttgtgttaaaaaaaaggg

SEQ ID NO: 892233 - DNA, 22 bp, Artificial Sequence
  chemically synthesized
accttgtgttaaaaaaaagggc

SEQ ID NO: 892234 - DNA, 22 bp, Artificial Sequence
  chemically synthesized
ccttgtgttaaaaaaaagggca

SEQ ID NO: 892235 - DNA, 22 bp, Artificial Sequence
  chemically synthesized
gtgttaaaaaaaagggcatgtg

SEQ ID NO: 892236 - DNA, 22 bp, Artificial Sequence
  chemically synthesized
aggagttttgagcacatgccct

SEQ ID NO: 892237 - DNA, 22 bp, Artificial Sequence
  chemically synthesized
tgttaaaaaaaagggcatgtgc

SEQ ID NO: 892238 - DNA, 22 bp, Artificial Sequence
  chemically synthesized
aaggagttttgagcacatgccc

SEQ ID NO: 892239 - DNA, 22 bp, Artificial Sequence
  chemically synthesized
taaggagttttgagcacatgcc

SEQ ID NO: 892240 - DNA, 22 bp, Artificial Sequence
  chemically synthesized
ttaaggagttttgagcacatgc

SEQ ID NO: 892241 - DNA, 22 bp, Artificial Sequence
  chemically synthesized
aaaaaaagggcatgtgctcaaa

SEQ ID NO: 892242 - DNA, 22 bp, Artificial Sequence
  chemically synthesized
aacaccaaaaataaaattttta

SEQ ID NO: 892243 - DNA, 22 bp, Artificial Sequence
  chemically synthesized
aaaactccttaaaaattttatt

SEQ ID NO: 892244 - DNA, 22 bp, Artificial Sequence
  chemically synthesized
ctgaacaccaaaaataaaattt

SEQ ID NO: 892245 - DNA, 22 bp, Artificial Sequence
  chemically synthesized
aaactactgaacaccaaaaata

SEQ ID NO: 892246 - DNA, 22 bp, Artificial Sequence
  chemically synthesized
cttaaaaattttatttttggtg

SEQ ID NO: 892247 - DNA, 22 bp, Artificial Sequence
  chemically synthesized
caaactactgaacaccaaaaat

SEQ ID NO: 892248 - DNA, 22 bp, Artificial Sequence
  chemically synthesized
aaaaattttatttttggtgttc

SEQ ID NO: 892249 - DNA, 22 bp, Artificial Sequence
  chemically synthesized
aaaattttatttttggtgttca

SEQ ID NO: 892250 - DNA, 22 bp, Artificial Sequence
  chemically synthesized
gtttcaaactactgaacaccaa

SEQ ID NO: 892251 - DNA, 22 bp, Artificial Sequence
  chemically synthesized
agtttcaaactactgaacacca

SEQ ID NO: 892252 - DNA, 22 bp, Artificial Sequence
  chemically synthesized
cttagtttcaaactactgaaca

SEQ ID NO: 892253 - DNA, 22 bp, Artificial Sequence
  chemically synthesized
acttagtttcaaactactgaac

SEQ ID NO: 892254 - DNA, 22 bp, Artificial Sequence
  chemically synthesized
tacttagtttcaaactactgaa

SEQ ID NO: 892255 - DNA, 22 bp, Artificial Sequence
  chemically synthesized
tatttttggtgttcagtagttt

SEQ ID NO: 892256 - DNA, 22 bp, Artificial Sequence
  chemically synthesized
atttttggtgttcagtagtttg

SEQ ID NO: 892257 - DNA, 22 bp, Artificial Sequence
  chemically synthesized
tttttggtgttcagtagtttga

SEQ ID NO: 892258 - DNA, 22 bp, Artificial Sequence
  chemically synthesized
ctttacttagtttcaaactact

SEQ ID NO: 892259 - DNA, 22 bp, Artificial Sequence
  chemically synthesized
gctttacttagtttcaaactac

SEQ ID NO: 892260 - DNA, 22 bp, Artificial Sequence
  chemically synthesized
tgctttacttagtttcaaacta

SEQ ID NO: 892261 - DNA, 22 bp, Artificial Sequence
  chemically synthesized
ttggtgttcagtagtttgaaac

SEQ ID NO: 892262 - DNA, 22 bp, Artificial Sequence
  chemically synthesized
tggtgttcagtagtttgaaact

SEQ ID NO: 892263 - DNA, 22 bp, Artificial Sequence
  chemically synthesized
ggtgttcagtagtttgaaacta

SEQ ID NO: 892264 - DNA, 22 bp, Artificial Sequence
  chemically synthesized
gtgttcagtagtttgaaactaa

SEQ ID NO: 892265 - DNA, 22 bp, Artificial Sequence
  chemically synthesized
gactttgctttacttagtttca

SEQ ID NO: 892266 - DNA, 22 bp, Artificial Sequence
  chemically synthesized
agtagtttgaaactaagtaaag

SEQ ID NO: 892267 - DNA, 22 bp, Artificial Sequence
  chemically synthesized
gaaactaagtaaagcaaagtct

SEQ ID NO: 892268 - DNA, 22 bp, Artificial Sequence
  chemically synthesized
aaactaagtaaagcaaagtcta

SEQ ID NO: 892269 - DNA, 22 bp, Artificial Sequence
  chemically synthesized
aagaaagatgggacactagact

SEQ ID NO: 892270 - DNA, 22 bp, Artificial Sequence
  chemically synthesized
agtaaagcaaagtctagtgtcc

SEQ ID NO: 892271 - DNA, 22 bp, Artificial Sequence
  chemically synthesized
cattaaagaaagatgggacact

SEQ ID NO: 892272 - DNA, 22 bp, Artificial Sequence
  chemically synthesized
ccattaaagaaagatgggacac

SEQ ID NO: 892273 - DNA, 22 bp, Artificial Sequence
  chemically synthesized
tccattaaagaaagatgggaca

SEQ ID NO: 892274 - DNA, 22 bp, Artificial Sequence
  chemically synthesized
ttccattaaagaaagatgggac

SEQ ID NO: 892275 - DNA, 22 bp, Artificial Sequence
  chemically synthesized
tttttccattaaagaaagatgg

SEQ ID NO: 892276 - DNA, 22 bp, Artificial Sequence
  chemically synthesized
aactatttttccattaaagaaa

SEQ ID NO: 892277 - DNA, 22 bp, Artificial Sequence
  chemically synthesized
gtgtcccatctttctttaatgg

SEQ ID NO: 892278 - DNA, 22 bp, Artificial Sequence
  chemically synthesized
aaggaattaaactatttttcca

SEQ ID NO: 892279 - DNA, 22 bp, Artificial Sequence
  chemically synthesized
aaaggaattaaactatttttcc

SEQ ID NO: 892280 - DNA, 22 bp, Artificial Sequence
  chemically synthesized
cttaaaggaattaaactatttt

SEQ ID NO: 892281 - DNA, 22 bp, Artificial Sequence
  chemically synthesized
tctttaatggaaaaatagttta

SEQ ID NO: 892282 - DNA, 22 bp, Artificial Sequence
  chemically synthesized
ctttaatggaaaaatagtttaa

SEQ ID NO: 892283 - DNA, 22 bp, Artificial Sequence
  chemically synthesized
tgcttaaaggaattaaactatt

SEQ ID NO: 892284 - DNA, 22 bp, Artificial Sequence
  chemically synthesized
tttaatggaaaaatagtttaat

SEQ ID NO: 892285 - DNA, 22 bp, Artificial Sequence
  chemically synthesized
taatggaaaaatagtttaattc

SEQ ID NO: 892286 - DNA, 22 bp, Artificial Sequence
  chemically synthesized
ctctgcttaaaggaattaaact

SEQ ID NO: 892287 - DNA, 22 bp, Artificial Sequence
  chemically synthesized
aatggaaaaatagtttaattcc

SEQ ID NO: 892288 - DNA, 22 bp, Artificial Sequence
  chemically synthesized
atggaaaaatagtttaattcct

SEQ ID NO: 892289 - DNA, 22 bp, Artificial Sequence
  chemically synthesized
tattcctctgcttaaaggaatt

SEQ ID NO: 892290 - DNA, 22 bp, Artificial Sequence
  chemically synthesized
ctgtattcctctgcttaaagga

SEQ ID NO: 892291 - DNA, 22 bp, Artificial Sequence
  chemically synthesized
cagcctgctgtattcctctgct

SEQ ID NO: 892292 - DNA, 22 bp, Artificial Sequence
  chemically synthesized
acagcctgctgtattcctctgc

SEQ ID NO: 892293 - DNA, 22 bp, Artificial Sequence
  chemically synthesized
aattcctttaagcagaggaata

SEQ ID NO: 892294 - DNA, 22 bp, Artificial Sequence
  chemically synthesized
attcctttaagcagaggaatac

SEQ ID NO: 892295 - DNA, 22 bp, Artificial Sequence
  chemically synthesized
ctttaagcagaggaatacagca

SEQ ID NO: 892296 - DNA, 22 bp, Artificial Sequence
  chemically synthesized
gtccttacagcctgctgtattc

SEQ ID NO: 892297 - DNA, 22 bp, Artificial Sequence
  chemically synthesized
taagcagaggaatacagcaggc

SEQ ID NO: 892298 - DNA, 22 bp, Artificial Sequence
  chemically synthesized
aagcagaggaatacagcaggct

SEQ ID NO: 892299 - DNA, 22 bp, Artificial Sequence
  chemically synthesized
agcagaggaatacagcaggctg

SEQ ID NO: 892300 - DNA, 22 bp, Artificial Sequence
  chemically synthesized
agatataggatattagtcctta

SEQ ID NO: 892301 - DNA, 22 bp, Artificial Sequence
  chemically synthesized
aagatataggatattagtcctt

SEQ ID NO: 892302 - DNA, 22 bp, Artificial Sequence
  chemically synthesized
atttaagatataggatattagt

SEQ ID NO: 892303 - DNA, 22 bp, Artificial Sequence
  chemically synthesized
tgatttaagatataggatatta

SEQ ID NO: 892304 - DNA, 22 bp, Artificial Sequence
  chemically synthesized
ctgatttaagatataggatatt

SEQ ID NO: 892305 - DNA, 22 bp, Artificial Sequence
  chemically synthesized
tctgatttaagatataggatat

SEQ ID NO: 892306 - DNA, 22 bp, Artificial Sequence
  chemically synthesized
ttctgatttaagatataggata

SEQ ID NO: 892307 - DNA, 22 bp, Artificial Sequence
  chemically synthesized
taaggactaatatcctatatct

SEQ ID NO: 892308 - DNA, 22 bp, Artificial Sequence
  chemically synthesized
cacagtttttctgatttaagat

SEQ ID NO: 892309 - DNA, 22 bp, Artificial Sequence
  chemically synthesized
atatcctatatcttaaatcaga

SEQ ID NO: 892310 - DNA, 22 bp, Artificial Sequence
  chemically synthesized
agattgcacagtttttctgatt

SEQ ID NO: 892311 - DNA, 22 bp, Artificial Sequence
  chemically synthesized
ttaagattgcacagtttttctg

SEQ ID NO: 892312 - DNA, 22 bp, Artificial Sequence
  chemically synthesized
attaagattgcacagtttttct

SEQ ID NO: 892313 - DNA, 22 bp, Artificial Sequence
  chemically synthesized
tatcttaaatcagaaaaactgt

SEQ ID NO: 892314 - DNA, 22 bp, Artificial Sequence
  chemically synthesized
aaatcagaaaaactgtgcaatc

SEQ ID NO: 892315 - DNA, 22 bp, Artificial Sequence
  chemically synthesized
aatcagaaaaactgtgcaatct

SEQ ID NO: 892316 - DNA, 22 bp, Artificial Sequence
  chemically synthesized
ataaatgatttattaagattgc

SEQ ID NO: 892317 - DNA, 22 bp, Artificial Sequence
  chemically synthesized
actaataaatgatttattaaga

SEQ ID NO: 892318 - DNA, 22 bp, Artificial Sequence
  chemically synthesized
cactaataaatgatttattaag

SEQ ID NO: 892319 - DNA, 22 bp, Artificial Sequence
  chemically synthesized
tcactaataaatgatttattaa

SEQ ID NO: 892320 - DNA, 22 bp, Artificial Sequence
  chemically synthesized
ctttcactaataaatgatttat

SEQ ID NO: 892321 - DNA, 22 bp, Artificial Sequence
  chemically synthesized
tgcaatcttaataaatcattta

SEQ ID NO: 892322 - DNA, 22 bp, Artificial Sequence
  chemically synthesized
cattcctttcactaataaatga

SEQ ID NO: 892323 - DNA, 22 bp, Artificial Sequence
  chemically synthesized
ccattcctttcactaataaatg

SEQ ID NO: 892324 - DNA, 22 bp, Artificial Sequence
  chemically synthesized
gcttccattcctttcactaata

SEQ ID NO: 892325 - DNA, 22 bp, Artificial Sequence
  chemically synthesized
aataaatcatttattagtgaaa

SEQ ID NO: 892326 - DNA, 22 bp, Artificial Sequence
  chemically synthesized
ataaatcatttattagtgaaag

SEQ ID NO: 892327 - DNA, 22 bp, Artificial Sequence
  chemically synthesized
tctagcttccattcctttcact

SEQ ID NO: 892328 - DNA, 22 bp, Artificial Sequence
  chemically synthesized
gtctagcttccattcctttcac

SEQ ID NO: 892329 - DNA, 22 bp, Artificial Sequence
  chemically synthesized
tgtctagcttccattcctttca

SEQ ID NO: 892330 - DNA, 22 bp, Artificial Sequence
  chemically synthesized
tttgtctagcttccattccttt

SEQ ID NO: 892331 - DNA, 22 bp, Artificial Sequence
  chemically synthesized
attagtgaaaggaatggaagct

SEQ ID NO: 892332 - DNA, 22 bp, Artificial Sequence
  chemically synthesized
ttagtgaaaggaatggaagcta

SEQ ID NO: 892333 - DNA, 22 bp, Artificial Sequence
  chemically synthesized
tccctctttgtctagcttccat

SEQ ID NO: 892334 - DNA, 22 bp, Artificial Sequence
  chemically synthesized
atccctctttgtctagcttcca

SEQ ID NO: 892335 - DNA, 22 bp, Artificial Sequence
  chemically synthesized
tatccctctttgtctagcttcc

SEQ ID NO: 892336 - DNA, 22 bp, Artificial Sequence
  chemically synthesized
gtgaaaggaatggaagctagac

SEQ ID NO: 892337 - DNA, 22 bp, Artificial Sequence
  chemically synthesized
ttatccctctttgtctagcttc

SEQ ID NO: 892338 - DNA, 22 bp, Artificial Sequence
  chemically synthesized
tttatccctctttgtctagctt

SEQ ID NO: 892339 - DNA, 22 bp, Artificial Sequence
  chemically synthesized
ttttttatccctctttgtctag

SEQ ID NO: 892340 - DNA, 22 bp, Artificial Sequence
  chemically synthesized
gttttttatccctctttgtcta

SEQ ID NO: 892341 - DNA, 22 bp, Artificial Sequence
  chemically synthesized
ccttgttttttatccctctttg

SEQ ID NO: 892342 - DNA, 22 bp, Artificial Sequence
  chemically synthesized
accttgttttttatccctcttt

SEQ ID NO: 892343 - DNA, 22 bp, Artificial Sequence
  chemically synthesized
gacaaagagggataaaaaacaa

SEQ ID NO: 892344 - DNA, 22 bp, Artificial Sequence
  chemically synthesized
tgtgaataataatttaccttgt

SEQ ID NO: 892345 - DNA, 22 bp, Artificial Sequence
  chemically synthesized
ggaaatggtgacctgtgtgaat

SEQ ID NO: 892346 - DNA, 22 bp, Artificial Sequence
  chemically synthesized
taattaggaaatggtgacctgt

SEQ ID NO: 892347 - DNA, 22 bp, Artificial Sequence
  chemically synthesized
ataattaggaaatggtgacctg

SEQ ID NO: 892348 - DNA, 22 bp, Artificial Sequence
  chemically synthesized
ttattcacacaggtcaccattt

SEQ ID NO: 892349 - DNA, 22 bp, Artificial Sequence
  chemically synthesized
ttcacacaggtcaccatttcct

SEQ ID NO: 892350 - DNA, 22 bp, Artificial Sequence
  chemically synthesized
acacaggtcaccatttcctaat

SEQ ID NO: 892351 - DNA, 22 bp, Artificial Sequence
  chemically synthesized
aaacccccagcttataattagg

SEQ ID NO: 892352 - DNA, 22 bp, Artificial Sequence
  chemically synthesized
tcaaacccccagcttataatta

SEQ ID NO: 892353 - DNA, 22 bp, Artificial Sequence
  chemically synthesized
cctaattataagctgggggttt

SEQ ID NO: 892354 - DNA, 22 bp, Artificial Sequence
  chemically synthesized
ccaaaaattctcaaacccccag

SEQ ID NO: 892355 - DNA, 22 bp, Artificial Sequence
  chemically synthesized
ctaattataagctgggggtttg

SEQ ID NO: 892356 - DNA, 22 bp, Artificial Sequence
  chemically synthesized
tcccaaaaattctcaaaccccc

SEQ ID NO: 892357 - DNA, 22 bp, Artificial Sequence
  chemically synthesized
ctcccaaaaattctcaaacccc

SEQ ID NO: 892358 - DNA, 22 bp, Artificial Sequence
  chemically synthesized
attataagctgggggtttgaga

SEQ ID NO: 892359 - DNA, 22 bp, Artificial Sequence
  chemically synthesized
taagctgggggtttgagaattt

SEQ ID NO: 892360 - DNA, 22 bp, Artificial Sequence
  chemically synthesized
agagtttctcccaaaaattctc

SEQ ID NO: 892361 - DNA, 22 bp, Artificial Sequence
  chemically synthesized
gagagtttctcccaaaaattct

SEQ ID NO: 892362 - DNA, 22 bp, Artificial Sequence
  chemically synthesized
ggggtttgagaatttttgggag

SEQ ID NO: 892363 - DNA, 22 bp, Artificial Sequence
  chemically synthesized
atgacttgagagtttctcccaa

SEQ ID NO: 892364 - DNA, 22 bp, Artificial Sequence
  chemically synthesized
gatgacttgagagtttctccca

SEQ ID NO: 892365 - DNA, 22 bp, Artificial Sequence
  chemically synthesized
gagaatttttgggagaaactct

SEQ ID NO: 892366 - DNA, 22 bp, Artificial Sequence
  chemically synthesized
agaatttttgggagaaactctc

SEQ ID NO: 892367 - DNA, 22 bp, Artificial Sequence
  chemically synthesized
ttgggagaaactctcaagtcat

SEQ ID NO: 892368 - DNA, 22 bp, Artificial Sequence
  chemically synthesized
tgggagaaactctcaagtcatc

SEQ ID NO: 892369 - DNA, 22 bp, Artificial Sequence
  chemically synthesized
gggagaaactctcaagtcatca

SEQ ID NO: 892370 - DNA, 22 bp, Artificial Sequence
  chemically synthesized
ggagaaactctcaagtcatcaa

SEQ ID NO: 892371 - DNA, 22 bp, Artificial Sequence
  chemically synthesized
tcaagtcatcaaatctatgatt

SEQ ID NO: 892372 - DNA, 22 bp, Artificial Sequence
  chemically synthesized
aagtcatcaaatctatgatttt

SEQ ID NO: 892373 - DNA, 22 bp, Artificial Sequence
  chemically synthesized
aaggtggggggaggggaaacat

SEQ ID NO: 892374 - DNA, 22 bp, Artificial Sequence
  chemically synthesized
tgattttatgtttcccctcccc

SEQ ID NO: 892375 - DNA, 22 bp, Artificial Sequence
  chemically synthesized
tgttcaaggtggggggagggga

SEQ ID NO: 892376 - DNA, 22 bp, Artificial Sequence
  chemically synthesized
tatgtttcccctccccccacct

SEQ ID NO: 892377 - DNA, 22 bp, Artificial Sequence
  chemically synthesized
tggctgtgttcaaggtgggggg

SEQ ID NO: 892378 - DNA, 22 bp, Artificial Sequence
  chemically synthesized
atgtttcccctccccccacctt

SEQ ID NO: 892379 - DNA, 22 bp, Artificial Sequence
  chemically synthesized
gtggctgtgttcaaggtggggg

SEQ ID NO: 892380 - DNA, 22 bp, Artificial Sequence
  chemically synthesized
tgtttcccctccccccaccttg

SEQ ID NO: 892381 - DNA, 22 bp, Artificial Sequence
  chemically synthesized
cttgtggctgtgttcaaggtgg

SEQ ID NO: 892382 - DNA, 22 bp, Artificial Sequence
  chemically synthesized
tgcttgtggctgtgttcaaggt

SEQ ID NO: 892383 - DNA, 22 bp, Artificial Sequence
  chemically synthesized
cccctccccccaccttgaacac

SEQ ID NO: 892384 - DNA, 22 bp, Artificial Sequence
  chemically synthesized
ctgcttgtggctgtgttcaagg

SEQ ID NO: 892385 - DNA, 22 bp, Artificial Sequence
  chemically synthesized
ccctccccccaccttgaacaca

SEQ ID NO: 892386 - DNA, 22 bp, Artificial Sequence
  chemically synthesized
ttctgcttgtggctgtgttcaa

SEQ ID NO: 892387 - DNA, 22 bp, Artificial Sequence
  chemically synthesized
cttctgcttgtggctgtgttca

SEQ ID NO: 892388 - DNA, 22 bp, Artificial Sequence
  chemically synthesized
tcttctgcttgtggctgtgttc

SEQ ID NO: 892389 - DNA, 22 bp, Artificial Sequence
  chemically synthesized
ttcttctgcttgtggctgtgtt

SEQ ID NO: 892390 - DNA, 22 bp, Artificial Sequence
  chemically synthesized
cccccaccttgaacacagccac

SEQ ID NO: 892391 - DNA, 22 bp, Artificial Sequence
  chemically synthesized
tttcttctgcttgtggctgtgt

SEQ ID NO: 892392 - DNA, 22 bp, Artificial Sequence
  chemically synthesized
gcctttttcttctgcttgtggc

SEQ ID NO: 892393 - DNA, 22 bp, Artificial Sequence
  chemically synthesized
agcctttttcttctgcttgtgg

SEQ ID NO: 892394 - DNA, 22 bp, Artificial Sequence
  chemically synthesized
tagcctttttcttctgcttgtg

SEQ ID NO: 892395 - DNA, 22 bp, Artificial Sequence
  chemically synthesized
ttagcctttttcttctgcttgt

SEQ ID NO: 892396 - DNA, 22 bp, Artificial Sequence
  chemically synthesized
gaacacagccacaagcagaaga

SEQ ID NO: 892397 - DNA, 22 bp, Artificial Sequence
  chemically synthesized
ttttagcctttttcttctgctt

SEQ ID NO: 892398 - DNA, 22 bp, Artificial Sequence
  chemically synthesized
aacacagccacaagcagaagaa

SEQ ID NO: 892399 - DNA, 22 bp, Artificial Sequence
  chemically synthesized
aaaaatactcttttagcctttt

SEQ ID NO: 892400 - DNA, 22 bp, Artificial Sequence
  chemically synthesized
caaaaatactcttttagccttt

SEQ ID NO: 892401 - DNA, 22 bp, Artificial Sequence
  chemically synthesized
gagtgcagacttcaaaaatact

SEQ ID NO: 892402 - DNA, 22 bp, Artificial Sequence
  chemically synthesized
tggagtgcagacttcaaaaata

SEQ ID NO: 892403 - DNA, 22 bp, Artificial Sequence
  chemically synthesized
tctctggagtgcagacttcaaa

SEQ ID NO: 892404 - DNA, 22 bp, Artificial Sequence
  chemically synthesized
atctctggagtgcagacttcaa

SEQ ID NO: 892405 - DNA, 22 bp, Artificial Sequence
  chemically synthesized
aaagagtatttttgaagtctgc

SEQ ID NO: 892406 - DNA, 22 bp, Artificial Sequence
  chemically synthesized
ttatctctggagtgcagacttc

SEQ ID NO: 892407 - DNA, 22 bp, Artificial Sequence
  chemically synthesized
cttatctctggagtgcagactt

SEQ ID NO: 892408 - DNA, 22 bp, Artificial Sequence
  chemically synthesized
cgagtttcttatctctggagtg

SEQ ID NO: 892409 - DNA, 22 bp, Artificial Sequence
  chemically synthesized
ttgaagtctgcactccagagat

SEQ ID NO: 892410 - DNA, 22 bp, Artificial Sequence
  chemically synthesized
tgaagtctgcactccagagata

SEQ ID NO: 892411 - DNA, 22 bp, Artificial Sequence
  chemically synthesized
gaagtctgcactccagagataa

SEQ ID NO: 892412 - DNA, 22 bp, Artificial Sequence
  chemically synthesized
aagtctgcactccagagataag

SEQ ID NO: 892413 - DNA, 22 bp, Artificial Sequence
  chemically synthesized
agcacattccgagtttcttatc

SEQ ID NO: 892414 - DNA, 22 bp, Artificial Sequence
  chemically synthesized
tgagcacattccgagtttctta

SEQ ID NO: 892415 - DNA, 22 bp, Artificial Sequence
  chemically synthesized
cactccagagataagaaactcg

SEQ ID NO: 892416 - DNA, 22 bp, Artificial Sequence
  chemically synthesized
cagagataagaaactcggaatg

SEQ ID NO: 892417 - DNA, 22 bp, Artificial Sequence
  chemically synthesized
agtcctctgagcacattccgag

SEQ ID NO: 892418 - DNA, 22 bp, Artificial Sequence
  chemically synthesized
cagtcctctgagcacattccga

SEQ ID NO: 892419 - DNA, 22 bp, Artificial Sequence
  chemically synthesized
gcttcagtcctctgagcacatt

SEQ ID NO: 892420 - DNA, 22 bp, Artificial Sequence
  chemically synthesized
ggcttcagtcctctgagcacat

SEQ ID NO: 892421 - DNA, 22 bp, Artificial Sequence
  chemically synthesized
cttggcttcagtcctctgagca

SEQ ID NO: 892422 - DNA, 22 bp, Artificial Sequence
  chemically synthesized
ggaatgtgctcagaggactgaa

SEQ ID NO: 892423 - DNA, 22 bp, Artificial Sequence
  chemically synthesized
gcagaaaactccttggcttcag

SEQ ID NO: 892424 - DNA, 22 bp, Artificial Sequence
  chemically synthesized
ctggcagaaaactccttggctt

SEQ ID NO: 892425 - DNA, 22 bp, Artificial Sequence
  chemically synthesized
cctggcagaaaactccttggct

SEQ ID NO: 892426 - DNA, 22 bp, Artificial Sequence
  chemically synthesized
tcctggcagaaaactccttggc

SEQ ID NO: 892427 - DNA, 22 bp, Artificial Sequence
  chemically synthesized
agaggactgaagccaaggagtt

SEQ ID NO: 892428 - DNA, 22 bp, Artificial Sequence
  chemically synthesized
ttcctggcagaaaactccttgg

SEQ ID NO: 892429 - DNA, 22 bp, Artificial Sequence
  chemically synthesized
tttcctggcagaaaactccttg

SEQ ID NO: 892430 - DNA, 22 bp, Artificial Sequence
  chemically synthesized
ttttcctggcagaaaactcctt

SEQ ID NO: 892431 - DNA, 22 bp, Artificial Sequence
  chemically synthesized
cttttttcctggcagaaaactc

SEQ ID NO: 892432 - DNA, 22 bp, Artificial Sequence
  chemically synthesized
aagccaaggagttttctgccag

SEQ ID NO: 892433 - DNA, 22 bp, Artificial Sequence
  chemically synthesized
aggggagagggagctgcttttt

SEQ ID NO: 892434 - DNA, 22 bp, Artificial Sequence
  chemically synthesized
tctgccaggaaaaaagcagctc

SEQ ID NO: 892435 - DNA, 22 bp, Artificial Sequence
  chemically synthesized
ctgccaggaaaaaagcagctcc

SEQ ID NO: 892436 - DNA, 22 bp, Artificial Sequence
  chemically synthesized
tgccaggaaaaaagcagctccc

SEQ ID NO: 892437 - DNA, 22 bp, Artificial Sequence
  chemically synthesized
ccaggaaaaaagcagctccctc

SEQ ID NO: 892438 - DNA, 22 bp, Artificial Sequence
  chemically synthesized
aatcactgaggggagagggagc

SEQ ID NO: 892439 - DNA, 22 bp, Artificial Sequence
  chemically synthesized
aaatcactgaggggagagggag

SEQ ID NO: 892440 - DNA, 22 bp, Artificial Sequence
  chemically synthesized
taaatcactgaggggagaggga

SEQ ID NO: 892441 - DNA, 22 bp, Artificial Sequence
  chemically synthesized
ttttaaatcactgaggggagag

SEQ ID NO: 892442 - DNA, 22 bp, Artificial Sequence
  chemically synthesized
gttttaaatcactgaggggaga

SEQ ID NO: 892443 - DNA, 22 bp, Artificial Sequence
  chemically synthesized
cagcttgttttaaatcactgag

SEQ ID NO: 892444 - DNA, 22 bp, Artificial Sequence
  chemically synthesized
ctgcagcttgttttaaatcact

SEQ ID NO: 892445 - DNA, 22 bp, Artificial Sequence
  chemically synthesized
cctctcccctcagtgatttaaa

SEQ ID NO: 892446 - DNA, 22 bp, Artificial Sequence
  chemically synthesized
cctcctgcagcttgttttaaat

SEQ ID NO: 892447 - DNA, 22 bp, Artificial Sequence
  chemically synthesized
tcccctcagtgatttaaaacaa

SEQ ID NO: 892448 - DNA, 22 bp, Artificial Sequence
  chemically synthesized
gcctcctgcagcttgttttaaa

SEQ ID NO: 892449 - DNA, 22 bp, Artificial Sequence
  chemically synthesized
ccctcagtgatttaaaacaagc

SEQ ID NO: 892450 - DNA, 22 bp, Artificial Sequence
  chemically synthesized
agtgatttaaaacaagctgcag

SEQ ID NO: 892451 - DNA, 22 bp, Artificial Sequence
  chemically synthesized
aaaacaagctgcaggaggcaaa

SEQ ID NO: 892452 - DNA, 22 bp, Artificial Sequence
  chemically synthesized
agagtcatgatatttgcctcct

SEQ ID NO: 892453 - DNA, 22 bp, Artificial Sequence
  chemically synthesized
aaacaagctgcaggaggcaaat

SEQ ID NO: 892454 - DNA, 22 bp, Artificial Sequence
  chemically synthesized
tgagagtcatgatatttgcctc

SEQ ID NO: 892455 - DNA, 22 bp, Artificial Sequence
  chemically synthesized
ctgagagtcatgatatttgcct

SEQ ID NO: 892456 - DNA, 22 bp, Artificial Sequence
  chemically synthesized
caggaggcaaatatcatgactc

SEQ ID NO: 892457 - DNA, 22 bp, Artificial Sequence
  chemically synthesized
tgtgtagtttctgagagtcatg

SEQ ID NO: 892458 - DNA, 22 bp, Artificial Sequence
  chemically synthesized
ctgtgtgtagtttctgagagtc

SEQ ID NO: 892459 - DNA, 22 bp, Artificial Sequence
  chemically synthesized
actgctgtgtgtagtttctgag

SEQ ID NO: 892460 - DNA, 22 bp, Artificial Sequence
  chemically synthesized
tcagaaactacacacagcagtg

SEQ ID NO: 892461 - DNA, 22 bp, Artificial Sequence
  chemically synthesized
caagtcaccactcactgctgtg

SEQ ID NO: 892462 - DNA, 22 bp, Artificial Sequence
  chemically synthesized
agaaactacacacagcagtgag

SEQ ID NO: 892463 - DNA, 22 bp, Artificial Sequence
  chemically synthesized
tcaaagctacaagtcaccactc

SEQ ID NO: 892464 - DNA, 22 bp, Artificial Sequence
  chemically synthesized
cacacagcagtgagtggtgact

SEQ ID NO: 892465 - DNA, 22 bp, Artificial Sequence
  chemically synthesized
atcaaagctacaagtcaccact

SEQ ID NO: 892466 - DNA, 22 bp, Artificial Sequence
  chemically synthesized
tatcaaagctacaagtcaccac

SEQ ID NO: 892467 - DNA, 22 bp, Artificial Sequence
  chemically synthesized
tttatcaaagctacaagtcacc

SEQ ID NO: 892468 - DNA, 22 bp, Artificial Sequence
  chemically synthesized
ctttatcaaagctacaagtcac

SEQ ID NO: 892469 - DNA, 22 bp, Artificial Sequence
  chemically synthesized
tctttatcaaagctacaagtca

SEQ ID NO: 892470 - DNA, 22 bp, Artificial Sequence
  chemically synthesized
ttctttatcaaagctacaagtc

SEQ ID NO: 892471 - DNA, 22 bp, Artificial Sequence
  chemically synthesized
atcacttttctttatcaaagct

SEQ ID NO: 892472 - DNA, 22 bp, Artificial Sequence
  chemically synthesized
tgttaatcacttttctttatca

SEQ ID NO: 892473 - DNA, 22 bp, Artificial Sequence
  chemically synthesized
gtagctttgataaagaaaagtg

SEQ ID NO: 892474 - DNA, 22 bp, Artificial Sequence
  chemically synthesized
ggctgtgttaatcacttttctt

SEQ ID NO: 892475 - DNA, 22 bp, Artificial Sequence
  chemically synthesized
tagctttgataaagaaaagtga

SEQ ID NO: 892476 - DNA, 22 bp, Artificial Sequence
  chemically synthesized
tgataaagaaaagtgattaaca

SEQ ID NO: 892477 - DNA, 22 bp, Artificial Sequence
  chemically synthesized
gataaagaaaagtgattaacac

SEQ ID NO: 892478 - DNA, 22 bp, Artificial Sequence
  chemically synthesized
ataaagaaaagtgattaacaca

SEQ ID NO: 892479 - DNA, 22 bp, Artificial Sequence
  chemically synthesized
aagtgaaagccatactcggctg

SEQ ID NO: 892480 - DNA, 22 bp, Artificial Sequence
  chemically synthesized
gaagtgaaagccatactcggct

SEQ ID NO: 892481 - DNA, 22 bp, Artificial Sequence
  chemically synthesized
cagtttgaagtgaaagccatac

SEQ ID NO: 892482 - DNA, 22 bp, Artificial Sequence
  chemically synthesized
acacagccgagtatggctttca

SEQ ID NO: 892483 - DNA, 22 bp, Artificial Sequence
  chemically synthesized
ccaaatgggtccctgcagtttg

SEQ ID NO: 892484 - DNA, 22 bp, Artificial Sequence
  chemically synthesized
tgccaaatgggtccctgcagtt

SEQ ID NO: 892485 - DNA, 22 bp, Artificial Sequence
  chemically synthesized
tcacttcaaactgcagggaccc

SEQ ID NO: 892486 - DNA, 22 bp, Artificial Sequence
  chemically synthesized
cacttcaaactgcagggaccca

SEQ ID NO: 892487 - DNA, 22 bp, Artificial Sequence
  chemically synthesized
acttcaaactgcagggacccat

SEQ ID NO: 892488 - DNA, 22 bp, Artificial Sequence
  chemically synthesized
caaactgcagggacccatttgg

SEQ ID NO: 892489 - DNA, 22 bp, Artificial Sequence
  chemically synthesized
aaactgcagggacccatttggc

SEQ ID NO: 892490 - DNA, 22 bp, Artificial Sequence
  chemically synthesized
tggcccatagggctctgccaaa

SEQ ID NO: 892491 - DNA, 22 bp, Artificial Sequence
  chemically synthesized
cagggacccatttggcagagcc

SEQ ID NO: 892492 - DNA, 22 bp, Artificial Sequence
  chemically synthesized
tctatggcccatagggctctgc

SEQ ID NO: 892493 - DNA, 22 bp, Artificial Sequence
  chemically synthesized
gattgtctatggcccatagggc

SEQ ID NO: 892494 - DNA, 22 bp, Artificial Sequence
  chemically synthesized
cgattgtctatggcccataggg

SEQ ID NO: 892495 - DNA, 22 bp, Artificial Sequence
  chemically synthesized
ggcagagccctatgggccatag

SEQ ID NO: 892496 - DNA, 22 bp, Artificial Sequence
  chemically synthesized
gcagagccctatgggccataga

SEQ ID NO: 892497 - DNA, 22 bp, Artificial Sequence
  chemically synthesized
tgtcttcgattgtctatggccc

SEQ ID NO: 892498 - DNA, 22 bp, Artificial Sequence
  chemically synthesized
cattgtgtcttcgattgtctat

SEQ ID NO: 892499 - DNA, 22 bp, Artificial Sequence
  chemically synthesized
tgggccatagacaatcgaagac

SEQ ID NO: 892500 - DNA, 22 bp, Artificial Sequence
  chemically synthesized
aaataatgaaaacctgcattgt

SEQ ID NO: 892501 - DNA, 22 bp, Artificial Sequence
  chemically synthesized
caaataatgaaaacctgcattg

SEQ ID NO: 892502 - DNA, 22 bp, Artificial Sequence
  chemically synthesized
tcaaataatgaaaacctgcatt

SEQ ID NO: 892503 - DNA, 22 bp, Artificial Sequence
  chemically synthesized
tgccccccggaatggttttcaa

SEQ ID NO: 892504 - DNA, 22 bp, Artificial Sequence
  chemically synthesized
tcattatttgaaaaccattccg

SEQ ID NO: 892505 - DNA, 22 bp, Artificial Sequence
  chemically synthesized
cattatttgaaaaccattccgg

SEQ ID NO: 892506 - DNA, 22 bp, Artificial Sequence
  chemically synthesized
attatttgaaaaccattccggg

SEQ ID NO: 892507 - DNA, 22 bp, Artificial Sequence
  chemically synthesized
tcccagtctgtgccccccggaa

SEQ ID NO: 892508 - DNA, 22 bp, Artificial Sequence
  chemically synthesized
tttgaaaaccattccggggggc

SEQ ID NO: 892509 - DNA, 22 bp, Artificial Sequence
  chemically synthesized
gtcccagtctgtgccccccgga

SEQ ID NO: 892510 - DNA, 22 bp, Artificial Sequence
  chemically synthesized
tgtcccagtctgtgccccccgg

SEQ ID NO: 892511 - DNA, 22 bp, Artificial Sequence
  chemically synthesized
ttgtcccagtctgtgccccccg

SEQ ID NO: 892512 - DNA, 22 bp, Artificial Sequence
  chemically synthesized
gaaaaccattccggggggcaca

SEQ ID NO: 892513 - DNA, 22 bp, Artificial Sequence
  chemically synthesized
aaaaccattccggggggcacag

SEQ ID NO: 892514 - DNA, 22 bp, Artificial Sequence
  chemically synthesized
cggggggcacagactgggacaa

SEQ ID NO: 892515 - DNA, 22 bp, Artificial Sequence
  chemically synthesized
aatcaaaatgacttttgtccca

SEQ ID NO: 892516 - DNA, 22 bp, Artificial Sequence
  chemically synthesized
ctcaatcaaaatgacttttgtc

SEQ ID NO: 892517 - DNA, 22 bp, Artificial Sequence
  chemically synthesized
actcaatcaaaatgacttttgt

SEQ ID NO: 892518 - DNA, 22 bp, Artificial Sequence
  chemically synthesized
tttactcaatcaaaatgacttt

SEQ ID NO: 892519 - DNA, 22 bp, Artificial Sequence
  chemically synthesized
ggacaaaagtcattttgattga

SEQ ID NO: 892520 - DNA, 22 bp, Artificial Sequence
  chemically synthesized
gtacaaatagatcctgtttact

SEQ ID NO: 892521 - DNA, 22 bp, Artificial Sequence
  chemically synthesized
ggtacaaatagatcctgtttac

SEQ ID NO: 892522 - DNA, 22 bp, Artificial Sequence
  chemically synthesized
tgattgagtaaacaggatctat

SEQ ID NO: 892523 - DNA, 22 bp, Artificial Sequence
  chemically synthesized
gattgagtaaacaggatctatt

SEQ ID NO: 892524 - DNA, 22 bp, Artificial Sequence
  chemically synthesized
attgagtaaacaggatctattt

SEQ ID NO: 892525 - DNA, 22 bp, Artificial Sequence
  chemically synthesized
aatcccttggtacaaatagatc

SEQ ID NO: 892526 - DNA, 22 bp, Artificial Sequence
  chemically synthesized
gaatcccttggtacaaatagat

SEQ ID NO: 892527 - DNA, 22 bp, Artificial Sequence
  chemically synthesized
tgaatcccttggtacaaataga

SEQ ID NO: 892528 - DNA, 22 bp, Artificial Sequence
  chemically synthesized
agtaaacaggatctatttgtac

SEQ ID NO: 892529 - DNA, 22 bp, Artificial Sequence
  chemically synthesized
ttgaatcccttggtacaaatag

SEQ ID NO: 892530 - DNA, 22 bp, Artificial Sequence
  chemically synthesized
tttgaatcccttggtacaaata

SEQ ID NO: 892531 - DNA, 22 bp, Artificial Sequence
  chemically synthesized
ttttgaatcccttggtacaaat

SEQ ID NO: 892532 - DNA, 22 bp, Artificial Sequence
  chemically synthesized
tttttgaatcccttggtacaaa

SEQ ID NO: 892533 - DNA, 22 bp, Artificial Sequence
  chemically synthesized
ttttttgaatcccttggtacaa

SEQ ID NO: 892534 - DNA, 22 bp, Artificial Sequence
  chemically synthesized
tttgtaccaagggattcaaaaa

SEQ ID NO: 892535 - DNA, 22 bp, Artificial Sequence
  chemically synthesized
agaaaagatttttttttgaatc

SEQ ID NO: 892536 - DNA, 22 bp, Artificial Sequence
  chemically synthesized
aagaaaagatttttttttgaat

SEQ ID NO: 892537 - DNA, 22 bp, Artificial Sequence
  chemically synthesized
gtaccaagggattcaaaaaaaa

SEQ ID NO: 892538 - DNA, 22 bp, Artificial Sequence
  chemically synthesized
taccaagggattcaaaaaaaaa

SEQ ID NO: 892539 - DNA, 22 bp, Artificial Sequence
  chemically synthesized
gaacacatttaagaaaagattt

SEQ ID NO: 892540 - DNA, 22 bp, Artificial Sequence
  chemically synthesized
ctggaacacatttaagaaaaga

SEQ ID NO: 892541 - DNA, 22 bp, Artificial Sequence
  chemically synthesized
cctggaacacatttaagaaaag

SEQ ID NO: 892542 - DNA, 22 bp, Artificial Sequence
  chemically synthesized
aaaaaaaaatcttttcttaaat

SEQ ID NO: 892543 - DNA, 22 bp, Artificial Sequence
  chemically synthesized
ttcctggaacacatttaagaaa

SEQ ID NO: 892544 - DNA, 22 bp, Artificial Sequence
  chemically synthesized
tcttcctggaacacatttaaga

SEQ ID NO: 892545 - DNA, 22 bp, Artificial Sequence
  chemically synthesized
tctctcttcctggaacacattt

SEQ ID NO: 892546 - DNA, 22 bp, Artificial Sequence
  chemically synthesized
gctatctctcttcctggaacac

SEQ ID NO: 892547 - DNA, 22 bp, Artificial Sequence
  chemically synthesized
ttcttaaatgtgttccaggaag

SEQ ID NO: 892548 - DNA, 22 bp, Artificial Sequence
  chemically synthesized
tcttaaatgtgttccaggaaga

SEQ ID NO: 892549 - DNA, 22 bp, Artificial Sequence
  chemically synthesized
cttaaatgtgttccaggaagag

SEQ ID NO: 892550 - DNA, 22 bp, Artificial Sequence
  chemically synthesized
ttaaatgtgttccaggaagaga

SEQ ID NO: 892551 - DNA, 22 bp, Artificial Sequence
  chemically synthesized
aatgctagctatctctcttcct

SEQ ID NO: 892552 - DNA, 22 bp, Artificial Sequence
  chemically synthesized
aaatgtgttccaggaagagaga

SEQ ID NO: 892553 - DNA, 22 bp, Artificial Sequence
  chemically synthesized
aatgtgttccaggaagagagat

SEQ ID NO: 892554 - DNA, 22 bp, Artificial Sequence
  chemically synthesized
aaaaatactcaatgctagctat

SEQ ID NO: 892555 - DNA, 22 bp, Artificial Sequence
  chemically synthesized
caggaagagagatagctagcat

SEQ ID NO: 892556 - DNA, 22 bp, Artificial Sequence
  chemically synthesized
aaaaaatactcaatgctagcta

SEQ ID NO: 892557 - DNA, 22 bp, Artificial Sequence
  chemically synthesized
taatagtttaaaaaatactcaa

SEQ ID NO: 892558 - DNA, 22 bp, Artificial Sequence
  chemically synthesized
ttataatagtttaaaaaatact

SEQ ID NO: 892559 - DNA, 22 bp, Artificial Sequence
  chemically synthesized
attataatagtttaaaaaatac

SEQ ID NO: 892560 - DNA, 22 bp, Artificial Sequence
  chemically synthesized
tattataatagtttaaaaaata

SEQ ID NO: 892561 - DNA, 22 bp, Artificial Sequence
  chemically synthesized
tttattataatagtttaaaaaa

SEQ ID NO: 892562 - DNA, 22 bp, Artificial Sequence
  chemically synthesized
gcattgagtattttttaaacta

SEQ ID NO: 892563 - DNA, 22 bp, Artificial Sequence
  chemically synthesized
agtattttttaaactattataa

SEQ ID NO: 892564 - DNA, 22 bp, Artificial Sequence
  chemically synthesized
aaatgtgcctctttattataat

SEQ ID NO: 892565 - DNA, 22 bp, Artificial Sequence
  chemically synthesized
tttaaactattataataaagag

SEQ ID NO: 892566 - DNA, 22 bp, Artificial Sequence
  chemically synthesized
gttaaaatgtgcctctttatta

SEQ ID NO: 892567 - DNA, 22 bp, Artificial Sequence
  chemically synthesized
ttaaactattataataaagagg

SEQ ID NO: 892568 - DNA, 22 bp, Artificial Sequence
  chemically synthesized
ggttaaaatgtgcctctttatt

SEQ ID NO: 892569 - DNA, 22 bp, Artificial Sequence
  chemically synthesized
taaactattataataaagaggc

SEQ ID NO: 892570 - DNA, 22 bp, Artificial Sequence
  chemically synthesized
tggttaaaatgtgcctctttat

SEQ ID NO: 892571 - DNA, 22 bp, Artificial Sequence
  chemically synthesized
aaactattataataaagaggca

SEQ ID NO: 892572 - DNA, 22 bp, Artificial Sequence
  chemically synthesized
aactattataataaagaggcac

SEQ ID NO: 892573 - DNA, 22 bp, Artificial Sequence
  chemically synthesized
ttataataaagaggcacatttt

SEQ ID NO: 892574 - DNA, 22 bp, Artificial Sequence
  chemically synthesized
taataaagaggcacattttaac

SEQ ID NO: 892575 - DNA, 22 bp, Artificial Sequence
  chemically synthesized
aatgcaatctttggttaaaatg

SEQ ID NO: 892576 - DNA, 22 bp, Artificial Sequence
  chemically synthesized
aaatgcaatctttggttaaaat

SEQ ID NO: 892577 - DNA, 22 bp, Artificial Sequence
  chemically synthesized
taaatgcaatctttggttaaaa

SEQ ID NO: 892578 - DNA, 22 bp, Artificial Sequence
  chemically synthesized
ttaaatgcaatctttggttaaa

SEQ ID NO: 892579 - DNA, 22 bp, Artificial Sequence
  chemically synthesized
ttttaaatgcaatctttggtta

SEQ ID NO: 892580 - DNA, 22 bp, Artificial Sequence
  chemically synthesized
ctcttttaaatgcaatctttgg

SEQ ID NO: 892581 - DNA, 22 bp, Artificial Sequence
  chemically synthesized
tactcttttaaatgcaatcttt

SEQ ID NO: 892582 - DNA, 22 bp, Artificial Sequence
  chemically synthesized
taaccaaagattgcatttaaaa

SEQ ID NO: 892583 - DNA, 22 bp, Artificial Sequence
  chemically synthesized
aaccaaagattgcatttaaaag

SEQ ID NO: 892584 - DNA, 22 bp, Artificial Sequence
  chemically synthesized
accaaagattgcatttaaaaga

SEQ ID NO: 892585 - DNA, 22 bp, Artificial Sequence
  chemically synthesized
acggtaaaagcacattctactc

SEQ ID NO: 892586 - DNA, 22 bp, Artificial Sequence
  chemically synthesized
catttaaaagagtagaatgtgc

SEQ ID NO: 892587 - DNA, 22 bp, Artificial Sequence
  chemically synthesized
tagctcacggtaaaagcacatt

SEQ ID NO: 892588 - DNA, 22 bp, Artificial Sequence
  chemically synthesized
gtagctcacggtaaaagcacat

SEQ ID NO: 892589 - DNA, 22 bp, Artificial Sequence
  chemically synthesized
aaaagagtagaatgtgctttta

SEQ ID NO: 892590 - DNA, 22 bp, Artificial Sequence
  chemically synthesized
tgtagctcacggtaaaagcaca

SEQ ID NO: 892591 - DNA, 22 bp, Artificial Sequence
  chemically synthesized
aaagagtagaatgtgcttttac

SEQ ID NO: 892592 - DNA, 22 bp, Artificial Sequence
  chemically synthesized
ttgtagctcacggtaaaagcac

SEQ ID NO: 892593 - DNA, 22 bp, Artificial Sequence
  chemically synthesized
tttgtagctcacggtaaaagca

SEQ ID NO: 892594 - DNA, 22 bp, Artificial Sequence
  chemically synthesized
ttaccgtgagctacaaaaagct

SEQ ID NO: 892595 - DNA, 22 bp, Artificial Sequence
  chemically synthesized
ccaaccagaaatagctttttgt

SEQ ID NO: 892596 - DNA, 22 bp, Artificial Sequence
  chemically synthesized
taccgtgagctacaaaaagcta

SEQ ID NO: 892597 - DNA, 22 bp, Artificial Sequence
  chemically synthesized
accgtgagctacaaaaagctat

SEQ ID NO: 892598 - DNA, 22 bp, Artificial Sequence
  chemically synthesized
ccgtgagctacaaaaagctatt

SEQ ID NO: 892599 - DNA, 22 bp, Artificial Sequence
  chemically synthesized
ctcccaaccagaaatagctttt

SEQ ID NO: 892600 - DNA, 22 bp, Artificial Sequence
  chemically synthesized
cctcccaaccagaaatagcttt

SEQ ID NO: 892601 - DNA, 22 bp, Artificial Sequence
  chemically synthesized
tcctcccaaccagaaatagctt

SEQ ID NO: 892602 - DNA, 22 bp, Artificial Sequence
  chemically synthesized
caaaaagctatttctggttggg

SEQ ID NO: 892603 - DNA, 22 bp, Artificial Sequence
  chemically synthesized
tttctggttgggaggaaagact

SEQ ID NO: 892604 - DNA, 22 bp, Artificial Sequence
  chemically synthesized
ctggttgggaggaaagacttta

SEQ ID NO: 892605 - DNA, 22 bp, Artificial Sequence
  chemically synthesized
tggttgggaggaaagactttat

SEQ ID NO: 892606 - DNA, 22 bp, Artificial Sequence
  chemically synthesized
gttgggaggaaagactttatga

SEQ ID NO: 892607 - DNA, 22 bp, Artificial Sequence
  chemically synthesized
cgaagaggaaaggtcataaagt

SEQ ID NO: 892608 - DNA, 22 bp, Artificial Sequence
  chemically synthesized
ggaggaaagactttatgacctt

SEQ ID NO: 892609 - DNA, 22 bp, Artificial Sequence
  chemically synthesized
gcgtaatattgcgaagaggaaa

SEQ ID NO: 892610 - DNA, 22 bp, Artificial Sequence
  chemically synthesized
tatgacctttcctcttcgcaat

SEQ ID NO: 892611 - DNA, 22 bp, Artificial Sequence
  chemically synthesized
atgacctttcctcttcgcaata

SEQ ID NO: 892612 - DNA, 22 bp, Artificial Sequence
  chemically synthesized
tgacctttcctcttcgcaatat

SEQ ID NO: 892613 - DNA, 22 bp, Artificial Sequence
  chemically synthesized
aaaagtaactggcgtaatattg

SEQ ID NO: 892614 - DNA, 22 bp, Artificial Sequence
  chemically synthesized
aaaaagtaactggcgtaatatt

SEQ ID NO: 892615 - DNA, 22 bp, Artificial Sequence
  chemically synthesized
tcctcttcgcaatattacgcca

SEQ ID NO: 892616 - DNA, 22 bp, Artificial Sequence
  chemically synthesized
ttaaaaagtaactggcgtaata

SEQ ID NO: 892617 - DNA, 22 bp, Artificial Sequence
  chemically synthesized
cctcttcgcaatattacgccag

SEQ ID NO: 892618 - DNA, 22 bp, Artificial Sequence
  chemically synthesized
ctcttcgcaatattacgccagt

SEQ ID NO: 892619 - DNA, 22 bp, Artificial Sequence
  chemically synthesized
ttcgcaatattacgccagttac

SEQ ID NO: 892620 - DNA, 22 bp, Artificial Sequence
  chemically synthesized
cgcaatattacgccagttactt

SEQ ID NO: 892621 - DNA, 22 bp, Artificial Sequence
  chemically synthesized
gcaatattacgccagttacttt

SEQ ID NO: 892622 - DNA, 22 bp, Artificial Sequence
  chemically synthesized
tatccagtatattcttaaaaag

SEQ ID NO: 892623 - DNA, 22 bp, Artificial Sequence
  chemically synthesized
atatccagtatattcttaaaaa

SEQ ID NO: 892624 - DNA, 22 bp, Artificial Sequence
  chemically synthesized
cgccagttactttttaagaata

SEQ ID NO: 892625 - DNA, 22 bp, Artificial Sequence
  chemically synthesized
tcttatatccagtatattctta

SEQ ID NO: 892626 - DNA, 22 bp, Artificial Sequence
  chemically synthesized
aattatcttatatccagtatat

SEQ ID NO: 892627 - DNA, 22 bp, Artificial Sequence
  chemically synthesized
ctttttaagaatatactggata

SEQ ID NO: 892628 - DNA, 22 bp, Artificial Sequence
  chemically synthesized
tcaattatcttatatccagtat

SEQ ID NO: 892629 - DNA, 22 bp, Artificial Sequence
  chemically synthesized
tttaagaatatactggatataa

SEQ ID NO: 892630 - DNA, 22 bp, Artificial Sequence
  chemically synthesized
ttaagaatatactggatataag

SEQ ID NO: 892631 - DNA, 22 bp, Artificial Sequence
  chemically synthesized
taagaatatactggatataaga

SEQ ID NO: 892632 - DNA, 22 bp, Artificial Sequence
  chemically synthesized
aagaatatactggatataagat

SEQ ID NO: 892633 - DNA, 22 bp, Artificial Sequence
  chemically synthesized
agaatatactggatataagata

SEQ ID NO: 892634 - DNA, 22 bp, Artificial Sequence
  chemically synthesized
gccaaattctcaattatcttat

SEQ ID NO: 892635 - DNA, 22 bp, Artificial Sequence
  chemically synthesized
agccaaattctcaattatctta

SEQ ID NO: 892636 - DNA, 22 bp, Artificial Sequence
  chemically synthesized
gatataagataattgagaattt

SEQ ID NO: 892637 - DNA, 22 bp, Artificial Sequence
  chemically synthesized
gcccaatacacaataaccttag

SEQ ID NO: 892638 - DNA, 22 bp, Artificial Sequence
  chemically synthesized
ggcccaatacacaataacctta

SEQ ID NO: 892639 - DNA, 22 bp, Artificial Sequence
  chemically synthesized
agaatttggctaaggttattgt

SEQ ID NO: 892640 - DNA, 22 bp, Artificial Sequence
  chemically synthesized
cttggcccaatacacaataacc

SEQ ID NO: 892641 - DNA, 22 bp, Artificial Sequence
  chemically synthesized
ggctaaggttattgtgtattgg

SEQ ID NO: 892642 - DNA, 22 bp, Artificial Sequence
  chemically synthesized
gctaaggttattgtgtattggg

SEQ ID NO: 892643 - DNA, 22 bp, Artificial Sequence
  chemically synthesized
aggttattgtgtattgggccaa

SEQ ID NO: 892644 - DNA, 22 bp, Artificial Sequence
  chemically synthesized
ttgtgtattgggccaagtaact

SEQ ID NO: 892645 - DNA, 22 bp, Artificial Sequence
  chemically synthesized
tgtattgggccaagtaactgta

SEQ ID NO: 892646 - DNA, 22 bp, Artificial Sequence
  chemically synthesized
ggccaagtaactgtactttctt

SEQ ID NO: 892647 - DNA, 22 bp, Artificial Sequence
  chemically synthesized
aataaacaaccccaacaagaaa

SEQ ID NO: 892648 - DNA, 22 bp, Artificial Sequence
  chemically synthesized
ctcaataaacaaccccaacaag

SEQ ID NO: 892649 - DNA, 22 bp, Artificial Sequence
  chemically synthesized
actgctcaataaacaaccccaa

SEQ ID NO: 892650 - DNA, 22 bp, Artificial Sequence
  chemically synthesized
cactgctcaataaacaacccca

SEQ ID NO: 892651 - DNA, 22 bp, Artificial Sequence
  chemically synthesized
tactttcttgttggggttgttt

SEQ ID NO: 892652 - DNA, 22 bp, Artificial Sequence
  chemically synthesized
tcactgctcaataaacaacccc

SEQ ID NO: 892653 - DNA, 22 bp, Artificial Sequence
  chemically synthesized
ttcactgctcaataaacaaccc

SEQ ID NO: 892654 - DNA, 22 bp, Artificial Sequence
  chemically synthesized
tcttgttggggttgtttattga

SEQ ID NO: 892655 - DNA, 22 bp, Artificial Sequence
  chemically synthesized
atttttcactgctcaataaaca

SEQ ID NO: 892656 - DNA, 22 bp, Artificial Sequence
  chemically synthesized
cttgttggggttgtttattgag

SEQ ID NO: 892657 - DNA, 22 bp, Artificial Sequence
  chemically synthesized
ttgttggggttgtttattgagc

SEQ ID NO: 892658 - DNA, 22 bp, Artificial Sequence
  chemically synthesized
gttggggttgtttattgagcag

SEQ ID NO: 892659 - DNA, 22 bp, Artificial Sequence
  chemically synthesized
ttggggttgtttattgagcagt

SEQ ID NO: 892660 - DNA, 22 bp, Artificial Sequence
  chemically synthesized
gggttgtttattgagcagtgaa

SEQ ID NO: 892661 - DNA, 22 bp, Artificial Sequence
  chemically synthesized
atgaatactgatttttcactgc

SEQ ID NO: 892662 - DNA, 22 bp, Artificial Sequence
  chemically synthesized
tttattgagcagtgaaaaatca

SEQ ID NO: 892663 - DNA, 22 bp, Artificial Sequence
  chemically synthesized
catctcatgaatactgattttt

SEQ ID NO: 892664 - DNA, 22 bp, Artificial Sequence
  chemically synthesized
attgagcagtgaaaaatcagta

SEQ ID NO: 892665 - DNA, 22 bp, Artificial Sequence
  chemically synthesized
ttgagcagtgaaaaatcagtat

SEQ ID NO: 892666 - DNA, 22 bp, Artificial Sequence
  chemically synthesized
agcagtgaaaaatcagtattca

SEQ ID NO: 892667 - DNA, 22 bp, Artificial Sequence
  chemically synthesized
accagtacaattacatctcatg

SEQ ID NO: 892668 - DNA, 22 bp, Artificial Sequence
  chemically synthesized
ttcaccagtacaattacatctc

SEQ ID NO: 892669 - DNA, 22 bp, Artificial Sequence
  chemically synthesized
ctattcaccagtacaattacat

SEQ ID NO: 892670 - DNA, 22 bp, Artificial Sequence
  chemically synthesized
gctcctattcaccagtacaatt

SEQ ID NO: 892671 - DNA, 22 bp, Artificial Sequence
  chemically synthesized
atgagatgtaattgtactggtg

SEQ ID NO: 892672 - DNA, 22 bp, Artificial Sequence
  chemically synthesized
actagctcctattcaccagtac

SEQ ID NO: 892673 - DNA, 22 bp, Artificial Sequence
  chemically synthesized
gactagctcctattcaccagta

SEQ ID NO: 892674 - DNA, 22 bp, Artificial Sequence
  chemically synthesized
agaggtgtttgactagctccta

SEQ ID NO: 892675 - DNA, 22 bp, Artificial Sequence
  chemically synthesized
tactggtgaataggagctagtc

SEQ ID NO: 892676 - DNA, 22 bp, Artificial Sequence
  chemically synthesized
tactcagaggtgtttgactagc

SEQ ID NO: 892677 - DNA, 22 bp, Artificial Sequence
  chemically synthesized
gtgaataggagctagtcaaaca

SEQ ID NO: 892678 - DNA, 22 bp, Artificial Sequence
  chemically synthesized
gtacatattgtactcagaggtg

SEQ ID NO: 892679 - DNA, 22 bp, Artificial Sequence
  chemically synthesized
gctagtacatattgtactcaga

SEQ ID NO: 892680 - DNA, 22 bp, Artificial Sequence
  chemically synthesized
agctagtacatattgtactcag

SEQ ID NO: 892681 - DNA, 22 bp, Artificial Sequence
  chemically synthesized
gtcaaacacctctgagtacaat

SEQ ID NO: 892682 - DNA, 22 bp, Artificial Sequence
  chemically synthesized
cacttagctagtacatattgta

SEQ ID NO: 892683 - DNA, 22 bp, Artificial Sequence
  chemically synthesized
tccacttagctagtacatattg

SEQ ID NO: 892684 - DNA, 22 bp, Artificial Sequence
  chemically synthesized
ctccacttagctagtacatatt

SEQ ID NO: 892685 - DNA, 22 bp, Artificial Sequence
  chemically synthesized
tgagtacaatatgtactagcta

SEQ ID NO: 892686 - DNA, 22 bp, Artificial Sequence
  chemically synthesized
agtacaatatgtactagctaag

SEQ ID NO: 892687 - DNA, 22 bp, Artificial Sequence
  chemically synthesized
accatttctccacttagctagt

SEQ ID NO: 892688 - DNA, 22 bp, Artificial Sequence
  chemically synthesized
ggatcctgaccatttctccact

SEQ ID NO: 892689 - DNA, 22 bp, Artificial Sequence
  chemically synthesized
taggatcctgaccatttctcca

SEQ ID NO: 892690 - DNA, 22 bp, Artificial Sequence
  chemically synthesized
gctaagtggagaaatggtcagg

SEQ ID NO: 892691 - DNA, 22 bp, Artificial Sequence
  chemically synthesized
agtggagaaatggtcaggatcc

SEQ ID NO: 892692 - DNA, 22 bp, Artificial Sequence
  chemically synthesized
agggaagccatcagttctagga

SEQ ID NO: 892693 - DNA, 22 bp, Artificial Sequence
  chemically synthesized
gaactgatggcttccctgagac

SEQ ID NO: 892694 - DNA, 22 bp, Artificial Sequence
  chemically synthesized
atggcttccctgagacgatgat

SEQ ID NO: 892695 - DNA, 22 bp, Artificial Sequence
  chemically synthesized
ggtgcgtacaaaacacatcatc

SEQ ID NO: 892696 - DNA, 22 bp, Artificial Sequence
  chemically synthesized
ccctgagacgatgatgtgtttt

SEQ ID NO: 892697 - DNA, 22 bp, Artificial Sequence
  chemically synthesized
cctgagacgatgatgtgttttg

SEQ ID NO: 892698 - DNA, 22 bp, Artificial Sequence
  chemically synthesized
agacgatgatgtgttttgtacg

SEQ ID NO: 892699 - DNA, 22 bp, Artificial Sequence
  chemically synthesized
tgtacgcacccagtcttgcccc

SEQ ID NO: 892700 - DNA, 22 bp, Artificial Sequence
  chemically synthesized
gtacgcacccagtcttgcccct

SEQ ID NO: 892701 - DNA, 22 bp, Artificial Sequence
  chemically synthesized
tacgcacccagtcttgcccctt

SEQ ID NO: 892702 - DNA, 22 bp, Artificial Sequence
  chemically synthesized
gtcatacatgatcacaaggggc

SEQ ID NO: 892703 - DNA, 22 bp, Artificial Sequence
  chemically synthesized
agtcatacatgatcacaagggg

SEQ ID NO: 892704 - DNA, 22 bp, Artificial Sequence
  chemically synthesized
tagtcatacatgatcacaaggg

SEQ ID NO: 892705 - DNA, 22 bp, Artificial Sequence
  chemically synthesized
aattttagtcatacatgatcac

SEQ ID NO: 892706 - DNA, 22 bp, Artificial Sequence
  chemically synthesized
gccccttgtgatcatgtatgac

SEQ ID NO: 892707 - DNA, 22 bp, Artificial Sequence
  chemically synthesized
ccccttgtgatcatgtatgact

SEQ ID NO: 892708 - DNA, 22 bp, Artificial Sequence
  chemically synthesized
gtgatcatgtatgactaaaatt

SEQ ID NO: 892709 - DNA, 22 bp, Artificial Sequence
  chemically synthesized
tgatcatgtatgactaaaattc

SEQ ID NO: 892710 - DNA, 22 bp, Artificial Sequence
  chemically synthesized
atgtcccatcaccctgaatttt

SEQ ID NO: 892711 - DNA, 22 bp, Artificial Sequence
  chemically synthesized
tgatgtcccatcaccctgaatt

SEQ ID NO: 892712 - DNA, 22 bp, Artificial Sequence
  chemically synthesized
ctgatgtcccatcaccctgaat

SEQ ID NO: 892713 - DNA, 22 bp, Artificial Sequence
  chemically synthesized
aaattcagggtgatgggacatc

SEQ ID NO: 892714 - DNA, 22 bp, Artificial Sequence
  chemically synthesized
agggtgatgggacatcagaagc

SEQ ID NO: 892715 - DNA, 22 bp, Artificial Sequence
  chemically synthesized
ataccaagacgtggcttctgat

SEQ ID NO: 892716 - DNA, 22 bp, Artificial Sequence
  chemically synthesized
gataccaagacgtggcttctga

SEQ ID NO: 892717 - DNA, 22 bp, Artificial Sequence
  chemically synthesized
aaggcacagtggaagtcttgat

SEQ ID NO: 892718 - DNA, 22 bp, Artificial Sequence
  chemically synthesized
cacattaaaggcacagtggaag

SEQ ID NO: 892719 - DNA, 22 bp, Artificial Sequence
  chemically synthesized
ggtatcaagacttccactgtgc

SEQ ID NO: 892720 - DNA, 22 bp, Artificial Sequence
  chemically synthesized
gtatcaagacttccactgtgcc

SEQ ID NO: 892721 - DNA, 22 bp, Artificial Sequence
  chemically synthesized
ccactgtgcctttaatgtgcag

SEQ ID NO: 892722 - DNA, 22 bp, Artificial Sequence
  chemically synthesized
cactgtgcctttaatgtgcagg

SEQ ID NO: 892723 - DNA, 22 bp, Artificial Sequence
  chemically synthesized
tgcctttaatgtgcaggctgtt

SEQ ID NO: 892724 - DNA, 22 bp, Artificial Sequence
  chemically synthesized
tacaggatgggtaacaacagcc

SEQ ID NO: 892725 - DNA, 22 bp, Artificial Sequence
  chemically synthesized
taatgtgcaggctgttgttacc

SEQ ID NO: 892726 - DNA, 22 bp, Artificial Sequence
  chemically synthesized
aatgtgcaggctgttgttaccc

SEQ ID NO: 892727 - DNA, 22 bp, Artificial Sequence
  chemically synthesized
atgtgcaggctgttgttaccca

SEQ ID NO: 892728 - DNA, 22 bp, Artificial Sequence
  chemically synthesized
agaaattatacaggatgggtaa

SEQ ID NO: 892729 - DNA, 22 bp, Artificial Sequence
  chemically synthesized
aagaaattatacaggatgggta

SEQ ID NO: 892730 - DNA, 22 bp, Artificial Sequence
  chemically synthesized
taagaaattatacaggatgggt

SEQ ID NO: 892731 - DNA, 22 bp, Artificial Sequence
  chemically synthesized
gctttaagaaattatacaggat

SEQ ID NO: 892732 - DNA, 22 bp, Artificial Sequence
  chemically synthesized
ttgttacccatcctgtataatt

SEQ ID NO: 892733 - DNA, 22 bp, Artificial Sequence
  chemically synthesized
gttagctttaagaaattataca

SEQ ID NO: 892734 - DNA, 22 bp, Artificial Sequence
  chemically synthesized
agttagctttaagaaattatac

SEQ ID NO: 892735 - DNA, 22 bp, Artificial Sequence
  chemically synthesized
ttacccatcctgtataatttct

SEQ ID NO: 892736 - DNA, 22 bp, Artificial Sequence
  chemically synthesized
cccatcctgtataatttcttaa

SEQ ID NO: 892737 - DNA, 22 bp, Artificial Sequence
  chemically synthesized
tataatttcttaaagctaacta

SEQ ID NO: 892738 - DNA, 22 bp, Artificial Sequence
  chemically synthesized
cccagtaacaaatttagttagc

SEQ ID NO: 892739 - DNA, 22 bp, Artificial Sequence
  chemically synthesized
acccagtaacaaatttagttag

SEQ ID NO: 892740 - DNA, 22 bp, Artificial Sequence
  chemically synthesized
tacccagtaacaaatttagtta

SEQ ID NO: 892741 - DNA, 22 bp, Artificial Sequence
  chemically synthesized
cttaaagctaactaaatttgtt

SEQ ID NO: 892742 - DNA, 22 bp, Artificial Sequence
  chemically synthesized
ttaaagctaactaaatttgtta

SEQ ID NO: 892743 - DNA, 22 bp, Artificial Sequence
  chemically synthesized
aaagctaactaaatttgttact

SEQ ID NO: 892744 - DNA, 22 bp, Artificial Sequence
  chemically synthesized
aagctaactaaatttgttactg

SEQ ID NO: 892745 - DNA, 22 bp, Artificial Sequence
  chemically synthesized
actaaatttgttactgggtaaa

SEQ ID NO: 892746 - DNA, 22 bp, Artificial Sequence
  chemically synthesized
cgagacataataggctttaccc

SEQ ID NO: 892747 - DNA, 22 bp, Artificial Sequence
  chemically synthesized
aatttgttactgggtaaagcct

SEQ ID NO: 892748 - DNA, 22 bp, Artificial Sequence
  chemically synthesized
acgagacataataggctttacc

SEQ ID NO: 892749 - DNA, 22 bp, Artificial Sequence
  chemically synthesized
gttactgggtaaagcctattat

SEQ ID NO: 892750 - DNA, 22 bp, Artificial Sequence
  chemically synthesized
aatttacgagacataataggct

SEQ ID NO: 892751 - DNA, 22 bp, Artificial Sequence
  chemically synthesized
ttactgggtaaagcctattatg

SEQ ID NO: 892752 - DNA, 22 bp, Artificial Sequence
  chemically synthesized
ctgggtaaagcctattatgtct

SEQ ID NO: 892753 - DNA, 22 bp, Artificial Sequence
  chemically synthesized
ggtaaagcctattatgtctcgt

SEQ ID NO: 892754 - DNA, 22 bp, Artificial Sequence
  chemically synthesized
atgattaaatttacgagacata

SEQ ID NO: 892755 - DNA, 22 bp, Artificial Sequence
  chemically synthesized
agtctgatgattaaatttacga

SEQ ID NO: 892756 - DNA, 22 bp, Artificial Sequence
  chemically synthesized
ttatgtctcgtaaatttaatca

SEQ ID NO: 892757 - DNA, 22 bp, Artificial Sequence
  chemically synthesized
ggttcagtctgatgattaaatt

SEQ ID NO: 892758 - DNA, 22 bp, Artificial Sequence
  chemically synthesized
gggttcagtctgatgattaaat

SEQ ID NO: 892759 - DNA, 22 bp, Artificial Sequence
  chemically synthesized
tgtctcgtaaatttaatcatca

SEQ ID NO: 892760 - DNA, 22 bp, Artificial Sequence
  chemically synthesized
gtaaatttaatcatcagactga

SEQ ID NO: 892761 - DNA, 22 bp, Artificial Sequence
  chemically synthesized
aatcatcagactgaacccaaga

SEQ ID NO: 892762 - DNA, 22 bp, Artificial Sequence
  chemically synthesized
atcatcagactgaacccaagac

SEQ ID NO: 892763 - DNA, 22 bp, Artificial Sequence
  chemically synthesized
agccagtggcacagtcttgggt

SEQ ID NO: 892764 - DNA, 22 bp, Artificial Sequence
  chemically synthesized
ctcagccagtggcacagtcttg

SEQ ID NO: 892765 - DNA, 22 bp, Artificial Sequence
  chemically synthesized
agcctgctcagccagtggcaca

SEQ ID NO: 892766 - DNA, 22 bp, Artificial Sequence
  chemically synthesized
aacccaagactgtgccactggc

SEQ ID NO: 892767 - DNA, 22 bp, Artificial Sequence
  chemically synthesized
gcacaaaactcagcctgctcag

SEQ ID NO: 892768 - DNA, 22 bp, Artificial Sequence
  chemically synthesized
tgccactggctgagcaggctga

SEQ ID NO: 892769 - DNA, 22 bp, Artificial Sequence
  chemically synthesized
actagcacaaaactcagcctgc

SEQ ID NO: 892770 - DNA, 22 bp, Artificial Sequence
  chemically synthesized
cactagcacaaaactcagcctg

SEQ ID NO: 892771 - DNA, 22 bp, Artificial Sequence
  chemically synthesized
gctgagcaggctgagttttgtg

SEQ ID NO: 892772 - DNA, 22 bp, Artificial Sequence
  chemically synthesized
agcaggctgagttttgtgctag

SEQ ID NO: 892773 - DNA, 22 bp, Artificial Sequence
  chemically synthesized
agttttgtgctagtgaaatgat

SEQ ID NO: 892774 - DNA, 22 bp, Artificial Sequence
  chemically synthesized
tgtgctagtgaaatgatgtcta

SEQ ID NO: 892775 - DNA, 22 bp, Artificial Sequence
  chemically synthesized
gtgctagtgaaatgatgtctac

SEQ ID NO: 892776 - DNA, 22 bp, Artificial Sequence
  chemically synthesized
tggaagtcacaagtagacatca

SEQ ID NO: 892777 - DNA, 22 bp, Artificial Sequence
  chemically synthesized
tgctagtgaaatgatgtctact

SEQ ID NO: 892778 - DNA, 22 bp, Artificial Sequence
  chemically synthesized
gtgaaatgatgtctacttgtga

SEQ ID NO: 892779 - DNA, 22 bp, Artificial Sequence
  chemically synthesized
aagagcagatggcactgtggaa

SEQ ID NO: 892780 - DNA, 22 bp, Artificial Sequence
  chemically synthesized
ctcaagagcagatggcactgtg

SEQ ID NO: 892781 - DNA, 22 bp, Artificial Sequence
  chemically synthesized
cttgtgacttccacagtgccat

SEQ ID NO: 892782 - DNA, 22 bp, Artificial Sequence
  chemically synthesized
ctcctcaagagcagatggcact

SEQ ID NO: 892783 - DNA, 22 bp, Artificial Sequence
  chemically synthesized
gtgacttccacagtgccatctg

SEQ ID NO: 892784 - DNA, 22 bp, Artificial Sequence
  chemically synthesized
tgacttccacagtgccatctgc

SEQ ID NO: 892785 - DNA, 22 bp, Artificial Sequence
  chemically synthesized
atagctactcctcaagagcaga

SEQ ID NO: 892786 - DNA, 22 bp, Artificial Sequence
  chemically synthesized
ccacagtgccatctgctcttga

SEQ ID NO: 892787 - DNA, 22 bp, Artificial Sequence
  chemically synthesized
cacagtgccatctgctcttgag

SEQ ID NO: 892788 - DNA, 22 bp, Artificial Sequence
  chemically synthesized
tgatagctactcctcaagagca

SEQ ID NO: 892789 - DNA, 22 bp, Artificial Sequence
  chemically synthesized
ccattctgatagctactcctca

SEQ ID NO: 892790 - DNA, 22 bp, Artificial Sequence
  chemically synthesized
tgtctaccattctgatagctac

SEQ ID NO: 892791 - DNA, 22 bp, Artificial Sequence
  chemically synthesized
atgtctaccattctgatagcta

SEQ ID NO: 892792 - DNA, 22 bp, Artificial Sequence
  chemically synthesized
ctcttgaggagtagctatcaga

SEQ ID NO: 892793 - DNA, 22 bp, Artificial Sequence
  chemically synthesized
ttgaggagtagctatcagaatg

SEQ ID NO: 892794 - DNA, 22 bp, Artificial Sequence
  chemically synthesized
gaggagtagctatcagaatggt

SEQ ID NO: 892795 - DNA, 22 bp, Artificial Sequence
  chemically synthesized
acacttatgtctaccattctga

SEQ ID NO: 892796 - DNA, 22 bp, Artificial Sequence
  chemically synthesized
aggagtagctatcagaatggta

SEQ ID NO: 892797 - DNA, 22 bp, Artificial Sequence
  chemically synthesized
ctgacacttatgtctaccattc

SEQ ID NO: 892798 - DNA, 22 bp, Artificial Sequence
  chemically synthesized
ctcctgacacttatgtctacca

SEQ ID NO: 892799 - DNA, 22 bp, Artificial Sequence
  chemically synthesized
cctcctgacacttatgtctacc

SEQ ID NO: 892800 - DNA, 22 bp, Artificial Sequence
  chemically synthesized
cttcctcctgacacttatgtct

SEQ ID NO: 892801 - DNA, 22 bp, Artificial Sequence
  chemically synthesized
acttcctcctgacacttatgtc

SEQ ID NO: 892802 - DNA, 22 bp, Artificial Sequence
  chemically synthesized
tcagaatggtagacataagtgt

SEQ ID NO: 892803 - DNA, 22 bp, Artificial Sequence
  chemically synthesized
ccttacttcctcctgacactta

SEQ ID NO: 892804 - DNA, 22 bp, Artificial Sequence
  chemically synthesized
accttacttcctcctgacactt

SEQ ID NO: 892805 - DNA, 22 bp, Artificial Sequence
  chemically synthesized
tgtttaccttacttcctcctga

SEQ ID NO: 892806 - DNA, 22 bp, Artificial Sequence
  chemically synthesized
gactatgtttaccttacttcct

SEQ ID NO: 892807 - DNA, 22 bp, Artificial Sequence
  chemically synthesized
tcgactatgtttaccttacttc

SEQ ID NO: 892808 - DNA, 22 bp, Artificial Sequence
  chemically synthesized
gcaaaatgttctcgactatgtt

SEQ ID NO: 892809 - DNA, 22 bp, Artificial Sequence
  chemically synthesized
gattagcaaaatgttctcgact

SEQ ID NO: 892810 - DNA, 22 bp, Artificial Sequence
  chemically synthesized
aaatgagttagattagcaaaat

SEQ ID NO: 892811 - DNA, 22 bp, Artificial Sequence
  chemically synthesized
caactaaaatgagttagattag

SEQ ID NO: 892812 - DNA, 22 bp, Artificial Sequence
  chemically synthesized
ctacaactaaaatgagttagat

SEQ ID NO: 892813 - DNA, 22 bp, Artificial Sequence
  chemically synthesized
gctacaactaaaatgagttaga

SEQ ID NO: 892814 - DNA, 22 bp, Artificial Sequence
  chemically synthesized
tgctaatctaactcattttagt

SEQ ID NO: 892815 - DNA, 22 bp, Artificial Sequence
  chemically synthesized
gctaatctaactcattttagtt

SEQ ID NO: 892816 - DNA, 22 bp, Artificial Sequence
  chemically synthesized
ctaatctaactcattttagttg

SEQ ID NO: 892817 - DNA, 22 bp, Artificial Sequence
  chemically synthesized
atctaactcattttagttgtag

SEQ ID NO: 892818 - DNA, 22 bp, Artificial Sequence
  chemically synthesized
actcattttagttgtagcaaac

SEQ ID NO: 892819 - DNA, 22 bp, Artificial Sequence
  chemically synthesized
attttagttgtagcaaacttcc

SEQ ID NO: 892820 - DNA, 22 bp, Artificial Sequence
  chemically synthesized
tagttgtagcaaacttccctct

SEQ ID NO: 892821 - DNA, 22 bp, Artificial Sequence
  chemically synthesized
agttgtagcaaacttccctcta

SEQ ID NO: 892822 - DNA, 22 bp, Artificial Sequence
  chemically synthesized
gttgtagcaaacttccctctat

SEQ ID NO: 892823 - DNA, 22 bp, Artificial Sequence
  chemically synthesized
tagcaaacttccctctatctcc

SEQ ID NO: 892824 - DNA, 22 bp, Artificial Sequence
  chemically synthesized
ccctctatctccttgttactca

SEQ ID NO: 892825 - DNA, 22 bp, Artificial Sequence
  chemically synthesized
cctctatctccttgttactcat

SEQ ID NO: 892826 - DNA, 22 bp, Artificial Sequence
  chemically synthesized
gggaagatgggcatgagtaaca

SEQ ID NO: 892827 - DNA, 22 bp, Artificial Sequence
  chemically synthesized
cgggaagatgggcatgagtaac

SEQ ID NO: 892828 - DNA, 22 bp, Artificial Sequence
  chemically synthesized
tatctccttgttactcatgccc

SEQ ID NO: 892829 - DNA, 22 bp, Artificial Sequence
  chemically synthesized
tctccttgttactcatgcccat

SEQ ID NO: 892830 - DNA, 22 bp, Artificial Sequence
  chemically synthesized
cttgttactcatgcccatcttc

SEQ ID NO: 892831 - DNA, 22 bp, Artificial Sequence
  chemically synthesized
gttactcatgcccatcttcccg

SEQ ID NO: 892832 - DNA, 22 bp, Artificial Sequence
  chemically synthesized
ttactcatgcccatcttcccga

SEQ ID NO: 892833 - DNA, 22 bp, Artificial Sequence
  chemically synthesized
ctcatgcccatcttcccgaaac

SEQ ID NO: 892834 - DNA, 22 bp, Artificial Sequence
  chemically synthesized
atgcccatcttcccgaaacttt

SEQ ID NO: 892835 - DNA, 22 bp, Artificial Sequence
  chemically synthesized
gtgaagaggaagtaaaagtttc

SEQ ID NO: 892836 - DNA, 22 bp, Artificial Sequence
  chemically synthesized
tagtgaagaggaagtaaaagtt

SEQ ID NO: 892837 - DNA, 22 bp, Artificial Sequence
  chemically synthesized
cccgaaacttttacttcctctt

SEQ ID NO: 892838 - DNA, 22 bp, Artificial Sequence
  chemically synthesized
ccgaaacttttacttcctcttc

SEQ ID NO: 892839 - DNA, 22 bp, Artificial Sequence
  chemically synthesized
agaatattctagtgaagaggaa

SEQ ID NO: 892840 - DNA, 22 bp, Artificial Sequence
  chemically synthesized
gagaatattctagtgaagagga

SEQ ID NO: 892841 - DNA, 22 bp, Artificial Sequence
  chemically synthesized
ttacttcctcttcactagaata

SEQ ID NO: 892842 - DNA, 22 bp, Artificial Sequence
  chemically synthesized
tacttcctcttcactagaatat

SEQ ID NO: 892843 - DNA, 22 bp, Artificial Sequence
  chemically synthesized
acttcctcttcactagaatatt

SEQ ID NO: 892844 - DNA, 22 bp, Artificial Sequence
  chemically synthesized
cttcctcttcactagaatattc

SEQ ID NO: 892845 - DNA, 22 bp, Artificial Sequence
  chemically synthesized
cctcttcactagaatattctca

SEQ ID NO: 892846 - DNA, 22 bp, Artificial Sequence
  chemically synthesized
ctcttcactagaatattctcaa

SEQ ID NO: 892847 - DNA, 22 bp, Artificial Sequence
  chemically synthesized
ttcactagaatattctcaaact

SEQ ID NO: 892848 - DNA, 22 bp, Artificial Sequence
  chemically synthesized
cactagaatattctcaaacttc

SEQ ID NO: 892849 - DNA, 22 bp, Artificial Sequence
  chemically synthesized
actagaatattctcaaacttcc

SEQ ID NO: 892850 - DNA, 22 bp, Artificial Sequence
  chemically synthesized
agagcaaagggaaaaggaagtt

SEQ ID NO: 892851 - DNA, 22 bp, Artificial Sequence
  chemically synthesized
gaatattctcaaacttcctttt

SEQ ID NO: 892852 - DNA, 22 bp, Artificial Sequence
  chemically synthesized
gaactgagagcaaagggaaaag

SEQ ID NO: 892853 - DNA, 22 bp, Artificial Sequence
  chemically synthesized
tcaaacttccttttccctttgc

SEQ ID NO: 892854 - DNA, 22 bp, Artificial Sequence
  chemically synthesized
ctggaactgagagcaaagggaa

SEQ ID NO: 892855 - DNA, 22 bp, Artificial Sequence
  chemically synthesized
gctggaactgagagcaaaggga

SEQ ID NO: 892856 - DNA, 22 bp, Artificial Sequence
  chemically synthesized
aaacttccttttccctttgctc

SEQ ID NO: 892857 - DNA, 22 bp, Artificial Sequence
  chemically synthesized
tgctggaactgagagcaaaggg

SEQ ID NO: 892858 - DNA, 22 bp, Artificial Sequence
  chemically synthesized
ttttgctggaactgagagcaaa

SEQ ID NO: 892859 - DNA, 22 bp, Artificial Sequence
  chemically synthesized
ccttttccctttgctctcagtt

SEQ ID NO: 892860 - DNA, 22 bp, Artificial Sequence
  chemically synthesized
ttgttttgctggaactgagagc

SEQ ID NO: 892861 - DNA, 22 bp, Artificial Sequence
  chemically synthesized
cttttccctttgctctcagttc

SEQ ID NO: 892862 - DNA, 22 bp, Artificial Sequence
  chemically synthesized
ttccctttgctctcagttccag

SEQ ID NO: 892863 - DNA, 22 bp, Artificial Sequence
  chemically synthesized
gctgttgttttgctggaactga

SEQ ID NO: 892864 - DNA, 22 bp, Artificial Sequence
  chemically synthesized
tccctttgctctcagttccagc

SEQ ID NO: 892865 - DNA, 22 bp, Artificial Sequence
  chemically synthesized
agctgttgttttgctggaactg

SEQ ID NO: 892866 - DNA, 22 bp, Artificial Sequence
  chemically synthesized
ccctttgctctcagttccagca

SEQ ID NO: 892867 - DNA, 22 bp, Artificial Sequence
  chemically synthesized
cctttgctctcagttccagcaa

SEQ ID NO: 892868 - DNA, 22 bp, Artificial Sequence
  chemically synthesized
catttagctgttgttttgctgg

SEQ ID NO: 892869 - DNA, 22 bp, Artificial Sequence
  chemically synthesized
tgctctcagttccagcaaaaca

SEQ ID NO: 892870 - DNA, 22 bp, Artificial Sequence
  chemically synthesized
gctctcagttccagcaaaacaa

SEQ ID NO: 892871 - DNA, 22 bp, Artificial Sequence
  chemically synthesized
ctctcagttccagcaaaacaac

SEQ ID NO: 892872 - DNA, 22 bp, Artificial Sequence
  chemically synthesized
atctccatttagctgttgtttt

SEQ ID NO: 892873 - DNA, 22 bp, Artificial Sequence
  chemically synthesized
tcagttccagcaaaacaacagc

SEQ ID NO: 892874 - DNA, 22 bp, Artificial Sequence
  chemically synthesized
aatctccatttagctgttgttt

SEQ ID NO: 892875 - DNA, 22 bp, Artificial Sequence
  chemically synthesized
taatctccatttagctgttgtt

SEQ ID NO: 892876 - DNA, 22 bp, Artificial Sequence
  chemically synthesized
agttccagcaaaacaacagcta

SEQ ID NO: 892877 - DNA, 22 bp, Artificial Sequence
  chemically synthesized
cagcaaaacaacagctaaatgg

SEQ ID NO: 892878 - DNA, 22 bp, Artificial Sequence
  chemically synthesized
acattttaatctccatttagct

SEQ ID NO: 892879 - DNA, 22 bp, Artificial Sequence
  chemically synthesized
taaaaacctaacattttaatct

SEQ ID NO: 892880 - DNA, 22 bp, Artificial Sequence
  chemically synthesized
aatggagattaaaatgttaggt

SEQ ID NO: 892881 - DNA, 22 bp, Artificial Sequence
  chemically synthesized
tccagtattgtaaaaacctaac

SEQ ID NO: 892882 - DNA, 22 bp, Artificial Sequence
  chemically synthesized
ctgtccagtattgtaaaaacct

SEQ ID NO: 892883 - DNA, 22 bp, Artificial Sequence
  chemically synthesized
actgtccagtattgtaaaaacc

SEQ ID NO: 892884 - DNA, 22 bp, Artificial Sequence
  chemically synthesized
tttactgtccagtattgtaaaa

SEQ ID NO: 892885 - DNA, 22 bp, Artificial Sequence
  chemically synthesized
aaatgttaggtttttacaatac

SEQ ID NO: 892886 - DNA, 22 bp, Artificial Sequence
  chemically synthesized
atttactgtccagtattgtaaa

SEQ ID NO: 892887 - DNA, 22 bp, Artificial Sequence
  chemically synthesized
aatttatttactgtccagtatt

SEQ ID NO: 892888 - DNA, 22 bp, Artificial Sequence
  chemically synthesized
ggtttttacaatactggacagt

SEQ ID NO: 892889 - DNA, 22 bp, Artificial Sequence
  chemically synthesized
ttaaatttatttactgtccagt

SEQ ID NO: 892890 - DNA, 22 bp, Artificial Sequence
  chemically synthesized
attgttaaatttatttactgtc

SEQ ID NO: 892891 - DNA, 22 bp, Artificial Sequence
  chemically synthesized
ttacaatactggacagtaaata

SEQ ID NO: 892892 - DNA, 22 bp, Artificial Sequence
  chemically synthesized
aattgttaaatttatttactgt

SEQ ID NO: 892893 - DNA, 22 bp, Artificial Sequence
  chemically synthesized
tacaatactggacagtaaataa

SEQ ID NO: 892894 - DNA, 22 bp, Artificial Sequence
  chemically synthesized
taattgttaaatttatttactg

SEQ ID NO: 892895 - DNA, 22 bp, Artificial Sequence
  chemically synthesized
acaatactggacagtaaataaa

SEQ ID NO: 892896 - DNA, 22 bp, Artificial Sequence
  chemically synthesized
caatactggacagtaaataaat

SEQ ID NO: 892897 - DNA, 22 bp, Artificial Sequence
  chemically synthesized
actttaattgttaaatttattt

SEQ ID NO: 892898 - DNA, 22 bp, Artificial Sequence
  chemically synthesized
attgactttaattgttaaattt

SEQ ID NO: 892899 - DNA, 22 bp, Artificial Sequence
  chemically synthesized
aattgactttaattgttaaatt

SEQ ID NO: 892900 - DNA, 22 bp, Artificial Sequence
  chemically synthesized
gacagtaaataaatttaacaat

SEQ ID NO: 892901 - DNA, 22 bp, Artificial Sequence
  chemically synthesized
tttaattgactttaattgttaa

SEQ ID NO: 892902 - DNA, 22 bp, Artificial Sequence
  chemically synthesized
atttaattgactttaattgtta

SEQ ID NO: 892903 - DNA, 22 bp, Artificial Sequence
  chemically synthesized
tatttaattgactttaattgtt

SEQ ID NO: 892904 - DNA, 22 bp, Artificial Sequence
  chemically synthesized
ttatttaattgactttaattgt

SEQ ID NO: 892905 - DNA, 22 bp, Artificial Sequence
  chemically synthesized
ttttatttaattgactttaatt

SEQ ID NO: 892906 - DNA, 22 bp, Artificial Sequence
  chemically synthesized
cttttatttaattgactttaat

SEQ ID NO: 892907 - DNA, 22 bp, Artificial Sequence
  chemically synthesized
tcttttatttaattgactttaa

SEQ ID NO: 892908 - DNA, 22 bp, Artificial Sequence
  chemically synthesized
ttcttttatttaattgacttta

SEQ ID NO: 892909 - DNA, 22 bp, Artificial Sequence
  chemically synthesized
tttcttttatttaattgacttt

SEQ ID NO: 892910 - DNA, 22 bp, Artificial Sequence
  chemically synthesized
aacaattaaagtcaattaaata

SEQ ID NO: 892911 - DNA, 22 bp, Artificial Sequence
  chemically synthesized
acaattaaagtcaattaaataa

SEQ ID NO: 892912 - DNA, 22 bp, Artificial Sequence
  chemically synthesized
agtagttttttcttttatttaa

SEQ ID NO: 892913 - DNA, 22 bp, Artificial Sequence
  chemically synthesized
gagtagttttttcttttattta

SEQ ID NO: 892914 - DNA, 22 bp, Artificial Sequence
  chemically synthesized
tgagtagttttttcttttattt

SEQ ID NO: 892915 - DNA, 22 bp, Artificial Sequence
  chemically synthesized
ttgagtagttttttcttttatt

SEQ ID NO: 892916 - DNA, 22 bp, Artificial Sequence
  chemically synthesized
aagtcaattaaataaaagaaaa

SEQ ID NO: 892917 - DNA, 22 bp, Artificial Sequence
  chemically synthesized
aataaaagaaaaaactactcaa

SEQ ID NO: 892918 - DNA, 22 bp, Artificial Sequence
  chemically synthesized
agagtaaaaaggataagtaaca

SEQ ID NO: 892919 - DNA, 22 bp, Artificial Sequence
  chemically synthesized
cagagtaaaaaggataagtaac

SEQ ID NO: 892920 - DNA, 22 bp, Artificial Sequence
  chemically synthesized
ctcaaaaatgttacttatcctt

SEQ ID NO: 892921 - DNA, 22 bp, Artificial Sequence
  chemically synthesized
aaaaatgttacttatccttttt

SEQ ID NO: 892922 - DNA, 22 bp, Artificial Sequence
  chemically synthesized
ggcaacttcagagtaaaaagga

SEQ ID NO: 892923 - DNA, 22 bp, Artificial Sequence
  chemically synthesized
ttgggcaacttcagagtaaaaa

SEQ ID NO: 892924 - DNA, 22 bp, Artificial Sequence
  chemically synthesized
cttatcctttttactctgaagt

SEQ ID NO: 892925 - DNA, 22 bp, Artificial Sequence
  chemically synthesized
atcctttttactctgaagttgc

SEQ ID NO: 892926 - DNA, 22 bp, Artificial Sequence
  chemically synthesized
tcctttttactctgaagttgcc

SEQ ID NO: 892927 - DNA, 22 bp, Artificial Sequence
  chemically synthesized
atgaatgtattgttgggcaact

SEQ ID NO: 892928 - DNA, 22 bp, Artificial Sequence
  chemically synthesized
tttactctgaagttgcccaaca

SEQ ID NO: 892929 - DNA, 22 bp, Artificial Sequence
  chemically synthesized
ttactctgaagttgcccaacaa

SEQ ID NO: 892930 - DNA, 22 bp, Artificial Sequence
  chemically synthesized
ttaatgaatgtattgttgggca

SEQ ID NO: 892931 - DNA, 22 bp, Artificial Sequence
  chemically synthesized
tactctgaagttgcccaacaat

SEQ ID NO: 892932 - DNA, 22 bp, Artificial Sequence
  chemically synthesized
actctgaagttgcccaacaata

SEQ ID NO: 892933 - DNA, 22 bp, Artificial Sequence
  chemically synthesized
ctctgaagttgcccaacaatac

SEQ ID NO: 892934 - DNA, 22 bp, Artificial Sequence
  chemically synthesized
tgaagttgcccaacaatacatt

SEQ ID NO: 892935 - DNA, 22 bp, Artificial Sequence
  chemically synthesized
caatctattaatgaatgtattg

SEQ ID NO: 892936 - DNA, 22 bp, Artificial Sequence
  chemically synthesized
aagttgcccaacaatacattca

SEQ ID NO: 892937 - DNA, 22 bp, Artificial Sequence
  chemically synthesized
aaattacaatctattaatgaat

SEQ ID NO: 892938 - DNA, 22 bp, Artificial Sequence
  chemically synthesized
cccaacaatacattcattaata

SEQ ID NO: 892939 - DNA, 22 bp, Artificial Sequence
  chemically synthesized
attaatagattgtaatttcaac

SEQ ID NO: 892940 - DNA, 22 bp, Artificial Sequence
  chemically synthesized
atagattgtaatttcaacgatt

SEQ ID NO: 892941 - DNA, 22 bp, Artificial Sequence
  chemically synthesized
taatttcaacgattcggtttat

SEQ ID NO: 892942 - DNA, 22 bp, Artificial Sequence
  chemically synthesized
agtagccaatcaaataaaccga

SEQ ID NO: 892943 - DNA, 22 bp, Artificial Sequence
  chemically synthesized
aagtagccaatcaaataaaccg

SEQ ID NO: 892944 - DNA, 22 bp, Artificial Sequence
  chemically synthesized
taagtagccaatcaaataaacc

SEQ ID NO: 892945 - DNA, 22 bp, Artificial Sequence
  chemically synthesized
caacgattcggtttatttgatt

SEQ ID NO: 892946 - DNA, 22 bp, Artificial Sequence
  chemically synthesized
aacgattcggtttatttgattg

SEQ ID NO: 892947 - DNA, 22 bp, Artificial Sequence
  chemically synthesized
ccaaaatctttaagtagccaat

SEQ ID NO: 892948 - DNA, 22 bp, Artificial Sequence
  chemically synthesized
gccaaaatctttaagtagccaa

SEQ ID NO: 892949 - DNA, 22 bp, Artificial Sequence
  chemically synthesized
ggtttatttgattggctactta

SEQ ID NO: 892950 - DNA, 22 bp, Artificial Sequence
  chemically synthesized
tttgccaaaatctttaagtagc

SEQ ID NO: 892951 - DNA, 22 bp, Artificial Sequence
  chemically synthesized
atttgccaaaatctttaagtag

SEQ ID NO: 892952 - DNA, 22 bp, Artificial Sequence
  chemically synthesized
atttgattggctacttaaagat

SEQ ID NO: 892953 - DNA, 22 bp, Artificial Sequence
  chemically synthesized
tttgattggctacttaaagatt

SEQ ID NO: 892954 - DNA, 22 bp, Artificial Sequence
  chemically synthesized
cttatttgccaaaatctttaag

SEQ ID NO: 892955 - DNA, 22 bp, Artificial Sequence
  chemically synthesized
gattggctacttaaagattttg

SEQ ID NO: 892956 - DNA, 22 bp, Artificial Sequence
  chemically synthesized
attggctacttaaagattttgg

SEQ ID NO: 892957 - DNA, 22 bp, Artificial Sequence
  chemically synthesized
cgtctccttatttgccaaaatc

SEQ ID NO: 892958 - DNA, 22 bp, Artificial Sequence
  chemically synthesized
gcgtctccttatttgccaaaat

SEQ ID NO: 892959 - DNA, 22 bp, Artificial Sequence
  chemically synthesized
gctacttaaagattttggcaaa

SEQ ID NO: 892960 - DNA, 22 bp, Artificial Sequence
  chemically synthesized
tgcgtctccttatttgccaaaa

SEQ ID NO: 892961 - DNA, 22 bp, Artificial Sequence
  chemically synthesized
cttaaagattttggcaaataag

SEQ ID NO: 892962 - DNA, 22 bp, Artificial Sequence
  chemically synthesized
aaagattttggcaaataaggag

SEQ ID NO: 892963 - DNA, 22 bp, Artificial Sequence
  chemically synthesized
aagattttggcaaataaggaga

SEQ ID NO: 892964 - DNA, 22 bp, Artificial Sequence
  chemically synthesized
ccccgttttgcgtctccttatt

SEQ ID NO: 892965 - DNA, 22 bp, Artificial Sequence
  chemically synthesized
tggcaaataaggagacgcaaaa

SEQ ID NO: 892966 - DNA, 22 bp, Artificial Sequence
  chemically synthesized
ggcaaataaggagacgcaaaac

SEQ ID NO: 892967 - DNA, 22 bp, Artificial Sequence
  chemically synthesized
gcaaataaggagacgcaaaacg

SEQ ID NO: 892968 - DNA, 22 bp, Artificial Sequence
  chemically synthesized
aatatgctgccccgttttgcgt

SEQ ID NO: 892969 - DNA, 22 bp, Artificial Sequence
  chemically synthesized
caatatgctgccccgttttgcg

SEQ ID NO: 892970 - DNA, 22 bp, Artificial Sequence
  chemically synthesized
tcaatatgctgccccgttttgc

SEQ ID NO: 892971 - DNA, 22 bp, Artificial Sequence
  chemically synthesized
tttcaatatgctgccccgtttt

SEQ ID NO: 892972 - DNA, 22 bp, Artificial Sequence
  chemically synthesized
caaagattctttcaatatgctg

SEQ ID NO: 892973 - DNA, 22 bp, Artificial Sequence
  chemically synthesized
ttccaaagattctttcaatatg

SEQ ID NO: 892974 - DNA, 22 bp, Artificial Sequence
  chemically synthesized
aaggaatctattccaaagattc

SEQ ID NO: 892975 - DNA, 22 bp, Artificial Sequence
  chemically synthesized
caaggaatctattccaaagatt

SEQ ID NO: 892976 - DNA, 22 bp, Artificial Sequence
  chemically synthesized
tcaaggaatctattccaaagat

SEQ ID NO: 892977 - DNA, 22 bp, Artificial Sequence
  chemically synthesized
cctttcaaggaatctattccaa

SEQ ID NO: 892978 - DNA, 22 bp, Artificial Sequence
  chemically synthesized
tccctttcaaggaatctattcc

SEQ ID NO: 892979 - DNA, 22 bp, Artificial Sequence
  chemically synthesized
aaagaatctttggaatagattc

SEQ ID NO: 892980 - DNA, 22 bp, Artificial Sequence
  chemically synthesized
ctccctttcaaggaatctattc

SEQ ID NO: 892981 - DNA, 22 bp, Artificial Sequence
  chemically synthesized
tctccctttcaaggaatctatt

SEQ ID NO: 892982 - DNA, 22 bp, Artificial Sequence
  chemically synthesized
ttctccctttcaaggaatctat

SEQ ID NO: 892983 - DNA, 22 bp, Artificial Sequence
  chemically synthesized
ttttctccctttcaaggaatct

SEQ ID NO: 892984 - DNA, 22 bp, Artificial Sequence
  chemically synthesized
cttttctccctttcaaggaatc

SEQ ID NO: 892985 - DNA, 22 bp, Artificial Sequence
  chemically synthesized
tggaatagattccttgaaaggg

SEQ ID NO: 892986 - DNA, 22 bp, Artificial Sequence
  chemically synthesized
atcttcttttctccctttcaag

SEQ ID NO: 892987 - DNA, 22 bp, Artificial Sequence
  chemically synthesized
ggaatagattccttgaaaggga

SEQ ID NO: 892988 - DNA, 22 bp, Artificial Sequence
  chemically synthesized
gaatagattccttgaaagggag

SEQ ID NO: 892989 - DNA, 22 bp, Artificial Sequence
  chemically synthesized
attgatcttcttttctcccttt

SEQ ID NO: 892990 - DNA, 22 bp, Artificial Sequence
  chemically synthesized
cttgaaagggagaaaagaagat

SEQ ID NO: 892991 - DNA, 22 bp, Artificial Sequence
  chemically synthesized
taaatgctgattgatcttcttt

SEQ ID NO: 892992 - DNA, 22 bp, Artificial Sequence
  chemically synthesized
gtaaatgctgattgatcttctt

SEQ ID NO: 892993 - DNA, 22 bp, Artificial Sequence
  chemically synthesized
gaaagggagaaaagaagatcaa

SEQ ID NO: 892994 - DNA, 22 bp, Artificial Sequence
  chemically synthesized
aaagggagaaaagaagatcaat

SEQ ID NO: 892995 - DNA, 22 bp, Artificial Sequence
  chemically synthesized
gtgtccttgtaaatgctgattg

SEQ ID NO: 892996 - DNA, 22 bp, Artificial Sequence
  chemically synthesized
tagtgtccttgtaaatgctgat

SEQ ID NO: 892997 - DNA, 22 bp, Artificial Sequence
  chemically synthesized
ctagtgtccttgtaaatgctga

SEQ ID NO: 892998 - DNA, 22 bp, Artificial Sequence
  chemically synthesized
ttctagtgtccttgtaaatgct

SEQ ID NO: 892999 - DNA, 22 bp, Artificial Sequence
  chemically synthesized
cttctagtgtccttgtaaatgc

SEQ ID NO: 893000 - DNA, 22 bp, Artificial Sequence
  chemically synthesized
cttcttctagtgtccttgtaaa

SEQ ID NO: 893001 - DNA, 22 bp, Artificial Sequence
  chemically synthesized
tctccttcttctagtgtccttg

SEQ ID NO: 893002 - DNA, 22 bp, Artificial Sequence
  chemically synthesized
aacaccactatctccttcttct

SEQ ID NO: 893003 - DNA, 22 bp, Artificial Sequence
  chemically synthesized
acaaggacactagaagaaggag

SEQ ID NO: 893004 - DNA, 22 bp, Artificial Sequence
  chemically synthesized
caaggacactagaagaaggaga

SEQ ID NO: 893005 - DNA, 22 bp, Artificial Sequence
  chemically synthesized
ccaattgaacaccactatctcc

SEQ ID NO: 893006 - DNA, 22 bp, Artificial Sequence
  chemically synthesized
gaagaaggagatagtggtgttc

SEQ ID NO: 893007 - DNA, 22 bp, Artificial Sequence
  chemically synthesized
agacaatcctgccaattgaaca

SEQ ID NO: 893008 - DNA, 22 bp, Artificial Sequence
  chemically synthesized
cagacaatcctgccaattgaac

SEQ ID NO: 893009 - DNA, 22 bp, Artificial Sequence
  chemically synthesized
aattggcaggattgtctgaagc

SEQ ID NO: 893010 - DNA, 22 bp, Artificial Sequence
  chemically synthesized
caggtaagcgtaaggcttcaga

SEQ ID NO: 893011 - DNA, 22 bp, Artificial Sequence
  chemically synthesized
gcaggattgtctgaagccttac

SEQ ID NO: 893012 - DNA, 22 bp, Artificial Sequence
  chemically synthesized
tctgaagccttacgcttacctg

SEQ ID NO: 893013 - DNA, 22 bp, Artificial Sequence
  chemically synthesized
aagccttacgcttacctgcagt

SEQ ID NO: 893014 - DNA, 22 bp, Artificial Sequence
  chemically synthesized
acgcttacctgcagtatctcat

SEQ ID NO: 893015 - DNA, 22 bp, Artificial Sequence
  chemically synthesized
cgcttacctgcagtatctcatt

SEQ ID NO: 893016 - DNA, 22 bp, Artificial Sequence
  chemically synthesized
acctgcagtatctcattcgtat

SEQ ID NO: 893017 - DNA, 22 bp, Artificial Sequence
  chemically synthesized
cctgcagtatctcattcgtatt

SEQ ID NO: 893018 - DNA, 22 bp, Artificial Sequence
  chemically synthesized
cagtatctcattcgtattctgg

SEQ ID NO: 893019 - DNA, 22 bp, Artificial Sequence
  chemically synthesized
attcgtattctgggtgtcttgg

SEQ ID NO: 893020 - DNA, 22 bp, Artificial Sequence
  chemically synthesized
gtattctgggtgtcttggtact

SEQ ID NO: 893021 - DNA, 22 bp, Artificial Sequence
  chemically synthesized
agtcaatgaataaagacagtac

SEQ ID NO: 893022 - DNA, 22 bp, Artificial Sequence
  chemically synthesized
tgggtgtcttggtactgtcttt

SEQ ID NO: 893023 - DNA, 22 bp, Artificial Sequence
  chemically synthesized
aagtcaatgaataaagacagta

SEQ ID NO: 893024 - DNA, 22 bp, Artificial Sequence
  chemically synthesized
taagtcaatgaataaagacagt

SEQ ID NO: 893025 - DNA, 22 bp, Artificial Sequence
  chemically synthesized
ggtgtcttggtactgtctttat

SEQ ID NO: 893026 - DNA, 22 bp, Artificial Sequence
  chemically synthesized
ttaagtcaatgaataaagacag

SEQ ID NO: 893027 - DNA, 22 bp, Artificial Sequence
  chemically synthesized
ggtactgtctttattcattgac

SEQ ID NO: 893028 - DNA, 22 bp, Artificial Sequence
  chemically synthesized
gtactgtctttattcattgact

SEQ ID NO: 893029 - DNA, 22 bp, Artificial Sequence
  chemically synthesized
tgagtgtttttaagtcaatgaa

SEQ ID NO: 893030 - DNA, 22 bp, Artificial Sequence
  chemically synthesized
gtgagtgtttttaagtcaatga

SEQ ID NO: 893031 - DNA, 22 bp, Artificial Sequence
  chemically synthesized
cttgtgagtgtttttaagtcaa

SEQ ID NO: 893032 - DNA, 22 bp, Artificial Sequence
  chemically synthesized
acttgtgagtgtttttaagtca

SEQ ID NO: 893033 - DNA, 22 bp, Artificial Sequence
  chemically synthesized
tctttattcattgacttaaaaa

SEQ ID NO: 893034 - DNA, 22 bp, Artificial Sequence
  chemically synthesized
tattcattgacttaaaaacact

SEQ ID NO: 893035 - DNA, 22 bp, Artificial Sequence
  chemically synthesized
attcattgacttaaaaacactc

SEQ ID NO: 893036 - DNA, 22 bp, Artificial Sequence
  chemically synthesized
ttcattgacttaaaaacactca

SEQ ID NO: 893037 - DNA, 22 bp, Artificial Sequence
  chemically synthesized
attgacttaaaaacactcacaa

SEQ ID NO: 893038 - DNA, 22 bp, Artificial Sequence
  chemically synthesized
acttaaaaacactcacaagtaa

SEQ ID NO: 893039 - DNA, 22 bp, Artificial Sequence
  chemically synthesized
aaaaacactcacaagtaagcat

SEQ ID NO: 893040 - DNA, 22 bp, Artificial Sequence
  chemically synthesized
aaaacactcacaagtaagcatc

SEQ ID NO: 893041 - DNA, 22 bp, Artificial Sequence
  chemically synthesized
ggatccagtaaatgatgcttac

SEQ ID NO: 893042 - DNA, 22 bp, Artificial Sequence
  chemically synthesized
agcctaggatccagtaaatgat

SEQ ID NO: 893043 - DNA, 22 bp, Artificial Sequence
  chemically synthesized
acaagtaagcatcatttactgg

SEQ ID NO: 893044 - DNA, 22 bp, Artificial Sequence
  chemically synthesized
atatcatacacactcagcctag

SEQ ID NO: 893045 - DNA, 22 bp, Artificial Sequence
  chemically synthesized
actggatcctaggctgagtgtg

SEQ ID NO: 893046 - DNA, 22 bp, Artificial Sequence
  chemically synthesized
ctggatcctaggctgagtgtgt

SEQ ID NO: 893047 - DNA, 22 bp, Artificial Sequence
  chemically synthesized
cactcatatcatacacactcag

SEQ ID NO: 893048 - DNA, 22 bp, Artificial Sequence
  chemically synthesized
tccactcatatcatacacactc

SEQ ID NO: 893049 - DNA, 22 bp, Artificial Sequence
  chemically synthesized
gatcctaggctgagtgtgtatg

SEQ ID NO: 893050 - DNA, 22 bp, Artificial Sequence
  chemically synthesized
ctccactcatatcatacacact

SEQ ID NO: 893051 - DNA, 22 bp, Artificial Sequence
  chemically synthesized
cttctccactcatatcatacac

SEQ ID NO: 893052 - DNA, 22 bp, Artificial Sequence
  chemically synthesized
tgcttctccactcatatcatac

SEQ ID NO: 893053 - DNA, 22 bp, Artificial Sequence
  chemically synthesized
ggctgagtgtgtatgatatgag

SEQ ID NO: 893054 - DNA, 22 bp, Artificial Sequence
  chemically synthesized
tctctgcttctccactcatatc

SEQ ID NO: 893055 - DNA, 22 bp, Artificial Sequence
  chemically synthesized
atctctgcttctccactcatat

SEQ ID NO: 893056 - DNA, 22 bp, Artificial Sequence
  chemically synthesized
agtgtgtatgatatgagtggag

SEQ ID NO: 893057 - DNA, 22 bp, Artificial Sequence
  chemically synthesized
tttatctctgcttctccactca

SEQ ID NO: 893058 - DNA, 22 bp, Artificial Sequence
  chemically synthesized
atttatctctgcttctccactc

SEQ ID NO: 893059 - DNA, 22 bp, Artificial Sequence
  chemically synthesized
ttatttatctctgcttctccac

SEQ ID NO: 893060 - DNA, 22 bp, Artificial Sequence
  chemically synthesized
tcttatttatctctgcttctcc

SEQ ID NO: 893061 - DNA, 22 bp, Artificial Sequence
  chemically synthesized
agtgcagagggcattctcttat

SEQ ID NO: 893062 - DNA, 22 bp, Artificial Sequence
  chemically synthesized
gagtgcagagggcattctctta

SEQ ID NO: 893063 - DNA, 22 bp, Artificial Sequence
  chemically synthesized
tgagtgcagagggcattctctt

SEQ ID NO: 893064 - DNA, 22 bp, Artificial Sequence
  chemically synthesized
tttgagtgcagagggcattctc

SEQ ID NO: 893065 - DNA, 22 bp, Artificial Sequence
  chemically synthesized
ttctttgagtgcagagggcatt

SEQ ID NO: 893066 - DNA, 22 bp, Artificial Sequence
  chemically synthesized
cactgttctttgagtgcagagg

SEQ ID NO: 893067 - DNA, 22 bp, Artificial Sequence
  chemically synthesized
cacatctgcactgttctttgag

SEQ ID NO: 893068 - DNA, 22 bp, Artificial Sequence
  chemically synthesized
attacacatctgcactgttctt

SEQ ID NO: 893069 - DNA, 22 bp, Artificial Sequence
  chemically synthesized
cattacacatctgcactgttct

SEQ ID NO: 893070 - DNA, 22 bp, Artificial Sequence
  chemically synthesized
tgcactcaaagaacagtgcaga

SEQ ID NO: 893071 - DNA, 22 bp, Artificial Sequence
  chemically synthesized
cactcaaagaacagtgcagatg

SEQ ID NO: 893072 - DNA, 22 bp, Artificial Sequence
  chemically synthesized
agtatttcattacacatctgca

SEQ ID NO: 893073 - DNA, 22 bp, Artificial Sequence
  chemically synthesized
aaagaacagtgcagatgtgtaa

SEQ ID NO: 893074 - DNA, 22 bp, Artificial Sequence
  chemically synthesized
tacacctgagtatttcattaca

SEQ ID NO: 893075 - DNA, 22 bp, Artificial Sequence
  chemically synthesized
atacacctgagtatttcattac

SEQ ID NO: 893076 - DNA, 22 bp, Artificial Sequence
  chemically synthesized
tatacacctgagtatttcatta

SEQ ID NO: 893077 - DNA, 22 bp, Artificial Sequence
  chemically synthesized
aattttatacacctgagtattt

SEQ ID NO: 893078 - DNA, 22 bp, Artificial Sequence
  chemically synthesized
aaattttatacacctgagtatt

SEQ ID NO: 893079 - DNA, 22 bp, Artificial Sequence
  chemically synthesized
cacttaaattttatacacctga

SEQ ID NO: 893080 - DNA, 22 bp, Artificial Sequence
  chemically synthesized
acacttaaattttatacacctg

SEQ ID NO: 893081 - DNA, 22 bp, Artificial Sequence
  chemically synthesized
atttacacttaaattttataca

SEQ ID NO: 893082 - DNA, 22 bp, Artificial Sequence
  chemically synthesized
atatgttgatttacacttaaat

SEQ ID NO: 893083 - DNA, 22 bp, Artificial Sequence
  chemically synthesized
aggtgtataaaatttaagtgta

SEQ ID NO: 893084 - DNA, 22 bp, Artificial Sequence
  chemically synthesized
ttcatatgttgatttacactta

SEQ ID NO: 893085 - DNA, 22 bp, Artificial Sequence
  chemically synthesized
ccattgttcatatgttgattta

SEQ ID NO: 893086 - DNA, 22 bp, Artificial Sequence
  chemically synthesized
atctcccattgttcatatgttg

SEQ ID NO: 893087 - DNA, 22 bp, Artificial Sequence
  chemically synthesized
aagtgtaaatcaacatatgaac

SEQ ID NO: 893088 - DNA, 22 bp, Artificial Sequence
  chemically synthesized
agtgtaaatcaacatatgaaca

SEQ ID NO: 893089 - DNA, 22 bp, Artificial Sequence
  chemically synthesized
ttcatctcccattgttcatatg

SEQ ID NO: 893090 - DNA, 22 bp, Artificial Sequence
  chemically synthesized
attcatctcccattgttcatat

SEQ ID NO: 893091 - DNA, 22 bp, Artificial Sequence
  chemically synthesized
tattcatctcccattgttcata

SEQ ID NO: 893092 - DNA, 22 bp, Artificial Sequence
  chemically synthesized
ttattcatctcccattgttcat

SEQ ID NO: 893093 - DNA, 22 bp, Artificial Sequence
  chemically synthesized
tttattcatctcccattgttca

SEQ ID NO: 893094 - DNA, 22 bp, Artificial Sequence
  chemically synthesized
taaacctttttattcatctccc

SEQ ID NO: 893095 - DNA, 22 bp, Artificial Sequence
  chemically synthesized
ataaacctttttattcatctcc

SEQ ID NO: 893096 - DNA, 22 bp, Artificial Sequence
  chemically synthesized
ttataaacctttttattcatct

SEQ ID NO: 893097 - DNA, 22 bp, Artificial Sequence
  chemically synthesized
cttataaacctttttattcatc

SEQ ID NO: 893098 - DNA, 22 bp, Artificial Sequence
  chemically synthesized
ggatttcttataaaccttttta

SEQ ID NO: 893099 - DNA, 22 bp, Artificial Sequence
  chemically synthesized
ttaggatttcttataaaccttt

SEQ ID NO: 893100 - DNA, 22 bp, Artificial Sequence
  chemically synthesized
gaatccctgttaggatttctta

SEQ ID NO: 893101 - DNA, 22 bp, Artificial Sequence
  chemically synthesized
ataagaaatcctaacagggatt

SEQ ID NO: 893102 - DNA, 22 bp, Artificial Sequence
  chemically synthesized
taagaaatcctaacagggattc

SEQ ID NO: 893103 - DNA, 22 bp, Artificial Sequence
  chemically synthesized
cgtaccccaagtagagttagaa

SEQ ID NO: 893104 - DNA, 22 bp, Artificial Sequence
  chemically synthesized
ccgtaccccaagtagagttaga

SEQ ID NO: 893105 - DNA, 22 bp, Artificial Sequence
  chemically synthesized
ttccgtaccccaagtagagtta

SEQ ID NO: 893106 - DNA, 22 bp, Artificial Sequence
  chemically synthesized
cttccgtaccccaagtagagtt

SEQ ID NO: 893107 - DNA, 22 bp, Artificial Sequence
  chemically synthesized
acagggattctaactctacttg

SEQ ID NO: 893108 - DNA, 22 bp, Artificial Sequence
  chemically synthesized
tcttccgtaccccaagtagagt

SEQ ID NO: 893109 - DNA, 22 bp, Artificial Sequence
  chemically synthesized
caagttttcttccgtaccccaa

SEQ ID NO: 893110 - DNA, 22 bp, Artificial Sequence
  chemically synthesized
ccaagttttcttccgtacccca

SEQ ID NO: 893111 - DNA, 22 bp, Artificial Sequence
  chemically synthesized
taactctacttggggtacggaa

SEQ ID NO: 893112 - DNA, 22 bp, Artificial Sequence
  chemically synthesized
actctacttggggtacggaaga

SEQ ID NO: 893113 - DNA, 22 bp, Artificial Sequence
  chemically synthesized
cgtcttccaagttttcttccgt

SEQ ID NO: 893114 - DNA, 22 bp, Artificial Sequence
  chemically synthesized
tacttggggtacggaagaaaac

SEQ ID NO: 893115 - DNA, 22 bp, Artificial Sequence
  chemically synthesized
cttggggtacggaagaaaactt

SEQ ID NO: 893116 - DNA, 22 bp, Artificial Sequence
  chemically synthesized
ggggtacggaagaaaacttgga

SEQ ID NO: 893117 - DNA, 22 bp, Artificial Sequence
  chemically synthesized
gggtacggaagaaaacttggaa

SEQ ID NO: 893118 - DNA, 22 bp, Artificial Sequence
  chemically synthesized
aaagtcattgcgtcttccaagt

SEQ ID NO: 893119 - DNA, 22 bp, Artificial Sequence
  chemically synthesized
agaatgaattcaaagtcattgc

SEQ ID NO: 893120 - DNA, 22 bp, Artificial Sequence
  chemically synthesized
aagaatgaattcaaagtcattg

SEQ ID NO: 893121 - DNA, 22 bp, Artificial Sequence
  chemically synthesized
taagaatgaattcaaagtcatt

SEQ ID NO: 893122 - DNA, 22 bp, Artificial Sequence
  chemically synthesized
tttaagaatgaattcaaagtca

SEQ ID NO: 893123 - DNA, 22 bp, Artificial Sequence
  chemically synthesized
ggaagacgcaatgactttgaat

SEQ ID NO: 893124 - DNA, 22 bp, Artificial Sequence
  chemically synthesized
gaagacgcaatgactttgaatt

SEQ ID NO: 893125 - DNA, 22 bp, Artificial Sequence
  chemically synthesized
cattctttaagaatgaattcaa

SEQ ID NO: 893126 - DNA, 22 bp, Artificial Sequence
  chemically synthesized
ccattctttaagaatgaattca

SEQ ID NO: 893127 - DNA, 22 bp, Artificial Sequence
  chemically synthesized
ttccattctttaagaatgaatt

SEQ ID NO: 893128 - DNA, 22 bp, Artificial Sequence
  chemically synthesized
cttccattctttaagaatgaat

SEQ ID NO: 893129 - DNA, 22 bp, Artificial Sequence
  chemically synthesized
tcttccattctttaagaatgaa

SEQ ID NO: 893130 - DNA, 22 bp, Artificial Sequence
  chemically synthesized
tgaattcattcttaaagaatgg

SEQ ID NO: 893131 - DNA, 22 bp, Artificial Sequence
  chemically synthesized
gaattcattcttaaagaatgga

SEQ ID NO: 893132 - DNA, 22 bp, Artificial Sequence
  chemically synthesized
aattcattcttaaagaatggaa

SEQ ID NO: 893133 - DNA, 22 bp, Artificial Sequence
  chemically synthesized
atataatgaattttcttccatt

SEQ ID NO: 893134 - DNA, 22 bp, Artificial Sequence
  chemically synthesized
gatataatgaattttcttccat

SEQ ID NO: 893135 - DNA, 22 bp, Artificial Sequence
  chemically synthesized
attcttaaagaatggaagaaaa

SEQ ID NO: 893136 - DNA, 22 bp, Artificial Sequence
  chemically synthesized
tgatataatgaattttcttcca

SEQ ID NO: 893137 - DNA, 22 bp, Artificial Sequence
  chemically synthesized
ttttgatataatgaattttctt

SEQ ID NO: 893138 - DNA, 22 bp, Artificial Sequence
  chemically synthesized
ttaaagaatggaagaaaattca

SEQ ID NO: 893139 - DNA, 22 bp, Artificial Sequence
  chemically synthesized
attttgatataatgaattttct

SEQ ID NO: 893140 - DNA, 22 bp, Artificial Sequence
  chemically synthesized
aaagaatggaagaaaattcatt

SEQ ID NO: 893141 - DNA, 22 bp, Artificial Sequence
  chemically synthesized
aagaatggaagaaaattcatta

SEQ ID NO: 893142 - DNA, 22 bp, Artificial Sequence
  chemically synthesized
agtttattttgatataatgaat

SEQ ID NO: 893143 - DNA, 22 bp, Artificial Sequence
  chemically synthesized
cagtttattttgatataatgaa

SEQ ID NO: 893144 - DNA, 22 bp, Artificial Sequence
  chemically synthesized
tcagtttattttgatataatga

SEQ ID NO: 893145 - DNA, 22 bp, Artificial Sequence
  chemically synthesized
tttcagtttattttgatataat

SEQ ID NO: 893146 - DNA, 22 bp, Artificial Sequence
  chemically synthesized
ctttcagtttattttgatataa

SEQ ID NO: 893147 - DNA, 22 bp, Artificial Sequence
  chemically synthesized
aatgacttctttcagtttattt

SEQ ID NO: 893148 - DNA, 22 bp, Artificial Sequence
  chemically synthesized
aaatgacttctttcagtttatt

SEQ ID NO: 893149 - DNA, 22 bp, Artificial Sequence
  chemically synthesized
taaatgacttctttcagtttat

SEQ ID NO: 893150 - DNA, 22 bp, Artificial Sequence
  chemically synthesized
attatatcaaaataaactgaaa

SEQ ID NO: 893151 - DNA, 22 bp, Artificial Sequence
  chemically synthesized
tttaaatgacttctttcagttt

SEQ ID NO: 893152 - DNA, 22 bp, Artificial Sequence
  chemically synthesized
ctttaaatgacttctttcagtt

SEQ ID NO: 893153 - DNA, 22 bp, Artificial Sequence
  chemically synthesized
tatcaaaataaactgaaagaag

SEQ ID NO: 893154 - DNA, 22 bp, Artificial Sequence
  chemically synthesized
ttctttaaatgacttctttcag

SEQ ID NO: 893155 - DNA, 22 bp, Artificial Sequence
  chemically synthesized
tcttctttaaatgacttctttc

SEQ ID NO: 893156 - DNA, 22 bp, Artificial Sequence
  chemically synthesized
tctcttctttaaatgacttctt

SEQ ID NO: 893157 - DNA, 22 bp, Artificial Sequence
  chemically synthesized
ctctcttctttaaatgacttct

SEQ ID NO: 893158 - DNA, 22 bp, Artificial Sequence
  chemically synthesized
tctctcttctttaaatgacttc

SEQ ID NO: 893159 - DNA, 22 bp, Artificial Sequence
  chemically synthesized
gttttctctcttctttaaatga

SEQ ID NO: 893160 - DNA, 22 bp, Artificial Sequence
  chemically synthesized
ggttttctctcttctttaaatg

SEQ ID NO: 893161 - DNA, 22 bp, Artificial Sequence
  chemically synthesized
aaagaagtcatttaaagaagag

SEQ ID NO: 893162 - DNA, 22 bp, Artificial Sequence
  chemically synthesized
tgatcttggttttctctcttct

SEQ ID NO: 893163 - DNA, 22 bp, Artificial Sequence
  chemically synthesized
aaagaagagagaaaaccaagat

SEQ ID NO: 893164 - DNA, 22 bp, Artificial Sequence
  chemically synthesized
aagaagagagaaaaccaagatc

SEQ ID NO: 893165 - DNA, 22 bp, Artificial Sequence
  chemically synthesized
atgtcatacctgtgatcttggt

SEQ ID NO: 893166 - DNA, 22 bp, Artificial Sequence
  chemically synthesized
catgtcatacctgtgatcttgg

SEQ ID NO: 893167 - DNA, 22 bp, Artificial Sequence
  chemically synthesized
catccatgtaatttcatgtcat

SEQ ID NO: 893168 - DNA, 22 bp, Artificial Sequence
  chemically synthesized
ccatccatgtaatttcatgtca

SEQ ID NO: 893169 - DNA, 22 bp, Artificial Sequence
  chemically synthesized
tccatccatgtaatttcatgtc

SEQ ID NO: 893170 - DNA, 22 bp, Artificial Sequence
  chemically synthesized
gtacctttccatccatgtaatt

SEQ ID NO: 893171 - DNA, 22 bp, Artificial Sequence
  chemically synthesized
cctggtacctttccatccatgt

SEQ ID NO: 893172 - DNA, 22 bp, Artificial Sequence
  chemically synthesized
catggatggaaaggtaccaggt

SEQ ID NO: 893173 - DNA, 22 bp, Artificial Sequence
  chemically synthesized
gccacatcaaattacctggtac

SEQ ID NO: 893174 - DNA, 22 bp, Artificial Sequence
  chemically synthesized
cccgtatagtctggccacatca

SEQ ID NO: 893175 - DNA, 22 bp, Artificial Sequence
  chemically synthesized
ccagcaatctccccgtatagtc

SEQ ID NO: 893176 - DNA, 22 bp, Artificial Sequence
  chemically synthesized
gatgtggccagactatacgggg

SEQ ID NO: 893177 - DNA, 22 bp, Artificial Sequence
  chemically synthesized
tgccagcaatctccccgtatag

SEQ ID NO: 893178 - DNA, 22 bp, Artificial Sequence
  chemically synthesized
atgtggccagactatacgggga

SEQ ID NO: 893179 - DNA, 22 bp, Artificial Sequence
  chemically synthesized
attctgccagcaatctccccgt

SEQ ID NO: 893180 - DNA, 22 bp, Artificial Sequence
  chemically synthesized
tcattctgccagcaatctcccc

SEQ ID NO: 893181 - DNA, 22 bp, Artificial Sequence
  chemically synthesized
ctcattctgccagcaatctccc

SEQ ID NO: 893182 - DNA, 22 bp, Artificial Sequence
  chemically synthesized
tcttctcattctgccagcaatc

SEQ ID NO: 893183 - DNA, 22 bp, Artificial Sequence
  chemically synthesized
tatcttctcattctgccagcaa

SEQ ID NO: 893184 - DNA, 22 bp, Artificial Sequence
  chemically synthesized
ctatcttctcattctgccagca

SEQ ID NO: 893185 - DNA, 22 bp, Artificial Sequence
  chemically synthesized
tacggggagattgctggcagaa

SEQ ID NO: 893186 - DNA, 22 bp, Artificial Sequence
  chemically synthesized
tctatcttctcattctgccagc

SEQ ID NO: 893187 - DNA, 22 bp, Artificial Sequence
  chemically synthesized
cctttctatcttctcattctgc

SEQ ID NO: 893188 - DNA, 22 bp, Artificial Sequence
  chemically synthesized
acctttctatcttctcattctg

SEQ ID NO: 893189 - DNA, 22 bp, Artificial Sequence
  chemically synthesized
tacctttctatcttctcattct

SEQ ID NO: 893190 - DNA, 22 bp, Artificial Sequence
  chemically synthesized
cactttacctttctatcttctc

SEQ ID NO: 893191 - DNA, 22 bp, Artificial Sequence
  chemically synthesized
ctggcagaatgagaagatagaa

SEQ ID NO: 893192 - DNA, 22 bp, Artificial Sequence
  chemically synthesized
actacactttacctttctatct

SEQ ID NO: 893193 - DNA, 22 bp, Artificial Sequence
  chemically synthesized
gcagaatgagaagatagaaagg

SEQ ID NO: 893194 - DNA, 22 bp, Artificial Sequence
  chemically synthesized
agactgactacactttaccttt

SEQ ID NO: 893195 - DNA, 22 bp, Artificial Sequence
  chemically synthesized
tcagactgactacactttacct

SEQ ID NO: 893196 - DNA, 22 bp, Artificial Sequence
  chemically synthesized
taaagccctctcagactgacta

SEQ ID NO: 893197 - DNA, 22 bp, Artificial Sequence
  chemically synthesized
tagacattgtaaagccctctca

SEQ ID NO: 893198 - DNA, 22 bp, Artificial Sequence
  chemically synthesized
gtagacattgtaaagccctctc

SEQ ID NO: 893199 - DNA, 22 bp, Artificial Sequence
  chemically synthesized
tgtagacattgtaaagccctct

SEQ ID NO: 893200 - DNA, 22 bp, Artificial Sequence
  chemically synthesized
ttgtagacattgtaaagccctc

SEQ ID NO: 893201 - DNA, 22 bp, Artificial Sequence
  chemically synthesized
ttttgtagacattgtaaagccc

SEQ ID NO: 893202 - DNA, 22 bp, Artificial Sequence
  chemically synthesized
ggctcttttgtagacattgtaa

SEQ ID NO: 893203 - DNA, 22 bp, Artificial Sequence
  chemically synthesized
agagggctttacaatgtctaca

SEQ ID NO: 893204 - DNA, 22 bp, Artificial Sequence
  chemically synthesized
tacaatgtctacaaaagagccc

SEQ ID NO: 893205 - DNA, 22 bp, Artificial Sequence
  chemically synthesized
acaatgtctacaaaagagccca

SEQ ID NO: 893206 - DNA, 22 bp, Artificial Sequence
  chemically synthesized
aaatataatgtctgggctcttt

SEQ ID NO: 893207 - DNA, 22 bp, Artificial Sequence
  chemically synthesized
caatgtctacaaaagagcccag

SEQ ID NO: 893208 - DNA, 22 bp, Artificial Sequence
  chemically synthesized
ctaaaatataatgtctgggctc

SEQ ID NO: 893209 - DNA, 22 bp, Artificial Sequence
  chemically synthesized
ggttcctaaaatataatgtctg

SEQ ID NO: 893210 - DNA, 22 bp, Artificial Sequence
  chemically synthesized
caaaagagcccagacattatat

SEQ ID NO: 893211 - DNA, 22 bp, Artificial Sequence
  chemically synthesized
tgagattaggttcctaaaatat

SEQ ID NO: 893212 - DNA, 22 bp, Artificial Sequence
  chemically synthesized
atgagattaggttcctaaaata

SEQ ID NO: 893213 - DNA, 22 bp, Artificial Sequence
  chemically synthesized
tttatgagattaggttcctaaa

SEQ ID NO: 893214 - DNA, 22 bp, Artificial Sequence
  chemically synthesized
aagttgtttatgagattaggtt

SEQ ID NO: 893215 - DNA, 22 bp, Artificial Sequence
  chemically synthesized
tattttaggaacctaatctcat

SEQ ID NO: 893216 - DNA, 22 bp, Artificial Sequence
  chemically synthesized
taggaacctaatctcataaaca

SEQ ID NO: 893217 - DNA, 22 bp, Artificial Sequence
  chemically synthesized
aggaacctaatctcataaacaa

SEQ ID NO: 893218 - DNA, 22 bp, Artificial Sequence
  chemically synthesized
ggaacctaatctcataaacaac

SEQ ID NO: 893219 - DNA, 22 bp, Artificial Sequence
  chemically synthesized
tccaaaattgaagttgtttatg

SEQ ID NO: 893220 - DNA, 22 bp, Artificial Sequence
  chemically synthesized
atccaaaattgaagttgtttat

SEQ ID NO: 893221 - DNA, 22 bp, Artificial Sequence
  chemically synthesized
cttatccaaaattgaagttgtt

SEQ ID NO: 893222 - DNA, 22 bp, Artificial Sequence
  chemically synthesized
atctcataaacaacttcaattt

SEQ ID NO: 893223 - DNA, 22 bp, Artificial Sequence
  chemically synthesized
atagattccttatccaaaattg

SEQ ID NO: 893224 - DNA, 22 bp, Artificial Sequence
  chemically synthesized
ataaacaacttcaattttggat

SEQ ID NO: 893225 - DNA, 22 bp, Artificial Sequence
  chemically synthesized
atacatattcatagattcctta

SEQ ID NO: 893226 - DNA, 22 bp, Artificial Sequence
  chemically synthesized
aatacatattcatagattcctt

SEQ ID NO: 893227 - DNA, 22 bp, Artificial Sequence
  chemically synthesized
caattttggataaggaatctat

SEQ ID NO: 893228 - DNA, 22 bp, Artificial Sequence
  chemically synthesized
aattttggataaggaatctatg

SEQ ID NO: 893229 - DNA, 22 bp, Artificial Sequence
  chemically synthesized
tgcttaatacatattcatagat

SEQ ID NO: 893230 - DNA, 22 bp, Artificial Sequence
  chemically synthesized
tggataaggaatctatgaatat

SEQ ID NO: 893231 - DNA, 22 bp, Artificial Sequence
  chemically synthesized
ggataaggaatctatgaatatg

SEQ ID NO: 893232 - DNA, 22 bp, Artificial Sequence
  chemically synthesized
gataaggaatctatgaatatgt

SEQ ID NO: 893233 - DNA, 22 bp, Artificial Sequence
  chemically synthesized
attgtgcttaatacatattcat

SEQ ID NO: 893234 - DNA, 22 bp, Artificial Sequence
  chemically synthesized
aattgtgcttaatacatattca

SEQ ID NO: 893235 - DNA, 22 bp, Artificial Sequence
  chemically synthesized
taattgtgcttaatacatattc

SEQ ID NO: 893236 - DNA, 22 bp, Artificial Sequence
  chemically synthesized
ttttaattgtgcttaatacata

SEQ ID NO: 893237 - DNA, 22 bp, Artificial Sequence
  chemically synthesized
tccctgttttaattgtgcttaa

SEQ ID NO: 893238 - DNA, 22 bp, Artificial Sequence
  chemically synthesized
tgaatatgtattaagcacaatt

SEQ ID NO: 893239 - DNA, 22 bp, Artificial Sequence
  chemically synthesized
tatccctgttttaattgtgctt

SEQ ID NO: 893240 - DNA, 22 bp, Artificial Sequence
  chemically synthesized
ctatccctgttttaattgtgct

SEQ ID NO: 893241 - DNA, 22 bp, Artificial Sequence
  chemically synthesized
tctatccctgttttaattgtgc

SEQ ID NO: 893242 - DNA, 22 bp, Artificial Sequence
  chemically synthesized
attttctatccctgttttaatt

SEQ ID NO: 893243 - DNA, 22 bp, Artificial Sequence
  chemically synthesized
tgattcattttctatccctgtt

SEQ ID NO: 893244 - DNA, 22 bp, Artificial Sequence
  chemically synthesized
agcacaattaaaacagggatag

SEQ ID NO: 893245 - DNA, 22 bp, Artificial Sequence
  chemically synthesized
ctgtgattcattttctatccct

SEQ ID NO: 893246 - DNA, 22 bp, Artificial Sequence
  chemically synthesized
ttactgtgattcattttctatc

SEQ ID NO: 893247 - DNA, 22 bp, Artificial Sequence
  chemically synthesized
gttactgtgattcattttctat

SEQ ID NO: 893248 - DNA, 22 bp, Artificial Sequence
  chemically synthesized
aaacagggatagaaaatgaatc

SEQ ID NO: 893249 - DNA, 22 bp, Artificial Sequence
  chemically synthesized
catcatatttgttactgtgatt

SEQ ID NO: 893250 - DNA, 22 bp, Artificial Sequence
  chemically synthesized
gaatgcctgcatcatatttgtt

SEQ ID NO: 893251 - DNA, 22 bp, Artificial Sequence
  chemically synthesized
ctagaatgcctgcatcatattt

SEQ ID NO: 893252 - DNA, 22 bp, Artificial Sequence
  chemically synthesized
tgttactagaatgcctgcatca

SEQ ID NO: 893253 - DNA, 22 bp, Artificial Sequence
  chemically synthesized
atgttactagaatgcctgcatc

SEQ ID NO: 893254 - DNA, 22 bp, Artificial Sequence
  chemically synthesized
aacttatgttactagaatgcct

SEQ ID NO: 893255 - DNA, 22 bp, Artificial Sequence
  chemically synthesized
attaaacttatgttactagaat

SEQ ID NO: 893256 - DNA, 22 bp, Artificial Sequence
  chemically synthesized
cattaaacttatgttactagaa

SEQ ID NO: 893257 - DNA, 22 bp, Artificial Sequence
  chemically synthesized
gaaataaggtcttcattaaact

SEQ ID NO: 893258 - DNA, 22 bp, Artificial Sequence
  chemically synthesized
tagtaacataagtttaatgaag

SEQ ID NO: 893259 - DNA, 22 bp, Artificial Sequence
  chemically synthesized
ctagaaataaggtcttcattaa

SEQ ID NO: 893260 - DNA, 22 bp, Artificial Sequence
  chemically synthesized
gtaacataagtttaatgaagac

SEQ ID NO: 893261 - DNA, 22 bp, Artificial Sequence
  chemically synthesized
actagaaataaggtcttcatta

SEQ ID NO: 893262 - DNA, 22 bp, Artificial Sequence
  chemically synthesized
agcatttactagaaataaggtc

SEQ ID NO: 893263 - DNA, 22 bp, Artificial Sequence
  chemically synthesized
ctcagcatttactagaaataag

SEQ ID NO: 893264 - DNA, 22 bp, Artificial Sequence
  chemically synthesized
cctcagcatttactagaaataa

SEQ ID NO: 893265 - DNA, 22 bp, Artificial Sequence
  chemically synthesized
tcctcagcatttactagaaata

SEQ ID NO: 893266 - DNA, 22 bp, Artificial Sequence
  chemically synthesized
aatgaagaccttatttctagta

SEQ ID NO: 893267 - DNA, 22 bp, Artificial Sequence
  chemically synthesized
ttcctcagcatttactagaaat

SEQ ID NO: 893268 - DNA, 22 bp, Artificial Sequence
  chemically synthesized
atgaagaccttatttctagtaa

SEQ ID NO: 893269 - DNA, 22 bp, Artificial Sequence
  chemically synthesized
tttcctcagcatttactagaaa

SEQ ID NO: 893270 - DNA, 22 bp, Artificial Sequence
  chemically synthesized
ctttttcctcagcatttactag

SEQ ID NO: 893271 - DNA, 22 bp, Artificial Sequence
  chemically synthesized
atttctagtaaatgctgaggaa

SEQ ID NO: 893272 - DNA, 22 bp, Artificial Sequence
  chemically synthesized
tttctagtaaatgctgaggaaa

SEQ ID NO: 893273 - DNA, 22 bp, Artificial Sequence
  chemically synthesized
gaatatgttgctttttcctcag

SEQ ID NO: 893274 - DNA, 22 bp, Artificial Sequence
  chemically synthesized
ctagtaaatgctgaggaaaaag

SEQ ID NO: 893275 - DNA, 22 bp, Artificial Sequence
  chemically synthesized
tagtaaatgctgaggaaaaagc

SEQ ID NO: 893276 - DNA, 22 bp, Artificial Sequence
  chemically synthesized
ctagaatatgttgctttttcct

SEQ ID NO: 893277 - DNA, 22 bp, Artificial Sequence
  chemically synthesized
actagaatatgttgctttttcc

SEQ ID NO: 893278 - DNA, 22 bp, Artificial Sequence
  chemically synthesized
gtaaatgctgaggaaaaagcaa

SEQ ID NO: 893279 - DNA, 22 bp, Artificial Sequence
  chemically synthesized
tactagaatatgttgctttttc

SEQ ID NO: 893280 - DNA, 22 bp, Artificial Sequence
  chemically synthesized
ttttactagaatatgttgcttt

SEQ ID NO: 893281 - DNA, 22 bp, Artificial Sequence
  chemically synthesized
ttattttactagaatatgttgc

SEQ ID NO: 893282 - DNA, 22 bp, Artificial Sequence
  chemically synthesized
ttattattttactagaatatgt

SEQ ID NO: 893283 - DNA, 22 bp, Artificial Sequence
  chemically synthesized
aggaaaaagcaacatattctag

SEQ ID NO: 893284 - DNA, 22 bp, Artificial Sequence
  chemically synthesized
tcataatgataataattattat

SEQ ID NO: 893285 - DNA, 22 bp, Artificial Sequence
  chemically synthesized
tagtaaaataataataattatt

SEQ ID NO: 893286 - DNA, 22 bp, Artificial Sequence
  chemically synthesized
ttgtcataatgataataattat

SEQ ID NO: 893287 - DNA, 22 bp, Artificial Sequence
  chemically synthesized
gtaaaataataataattattat

SEQ ID NO: 893288 - DNA, 22 bp, Artificial Sequence
  chemically synthesized
tcatcatcatcattgttgtcat

SEQ ID NO: 893289 - DNA, 22 bp, Artificial Sequence
  chemically synthesized
gtcatcatcatcattgttgtca

SEQ ID NO: 893290 - DNA, 22 bp, Artificial Sequence
  chemically synthesized
tgtcatcatcatcattgttgtc

SEQ ID NO: 893291 - DNA, 22 bp, Artificial Sequence
  chemically synthesized
ttatcattatgacaacaatgat

SEQ ID NO: 893292 - DNA, 22 bp, Artificial Sequence
  chemically synthesized
tcattatgacaacaatgatgat

SEQ ID NO: 893293 - DNA, 22 bp, Artificial Sequence
  chemically synthesized
tgacaacaatgatgatgatgac

SEQ ID NO: 893294 - DNA, 22 bp, Artificial Sequence
  chemically synthesized
gtcaagcagggaatctttgtca

SEQ ID NO: 893295 - DNA, 22 bp, Artificial Sequence
  chemically synthesized
agtcaagcagggaatctttgtc

SEQ ID NO: 893296 - DNA, 22 bp, Artificial Sequence
  chemically synthesized
aagtttagtcaagcagggaatc

SEQ ID NO: 893297 - DNA, 22 bp, Artificial Sequence
  chemically synthesized
actaaagtttagtcaagcaggg

SEQ ID NO: 893298 - DNA, 22 bp, Artificial Sequence
  chemically synthesized
agaagcctgactaaagtttagt

SEQ ID NO: 893299 - DNA, 22 bp, Artificial Sequence
  chemically synthesized
cctgcttgactaaactttagtc

SEQ ID NO: 893300 - DNA, 22 bp, Artificial Sequence
  chemically synthesized
cttgactaaactttagtcaggc

SEQ ID NO: 893301 - DNA, 22 bp, Artificial Sequence
  chemically synthesized
gactaaactttagtcaggcttc

SEQ ID NO: 893302 - DNA, 22 bp, Artificial Sequence
  chemically synthesized
actaaactttagtcaggcttct

SEQ ID NO: 893303 - DNA, 22 bp, Artificial Sequence
  chemically synthesized
aactttagtcaggcttctgaac

SEQ ID NO: 893304 - DNA, 22 bp, Artificial Sequence
  chemically synthesized
tagtcaggcttctgaaccttcg

SEQ ID NO: 893305 - DNA, 22 bp, Artificial Sequence
  chemically synthesized
agtcaggcttctgaaccttcgc

SEQ ID NO: 893306 - DNA, 22 bp, Artificial Sequence
  chemically synthesized
gtcaggcttctgaaccttcgcc

SEQ ID NO: 893307 - DNA, 22 bp, Artificial Sequence
  chemically synthesized
ctgaaccttcgcctgggctcat

SEQ ID NO: 893308 - DNA, 22 bp, Artificial Sequence
  chemically synthesized
tgaaccttcgcctgggctcatc

SEQ ID NO: 893309 - DNA, 22 bp, Artificial Sequence
  chemically synthesized
aaccttcgcctgggctcatctt

SEQ ID NO: 893310 - DNA, 22 bp, Artificial Sequence
  chemically synthesized
caggggagtgcaaagatgagcc

SEQ ID NO: 893311 - DNA, 22 bp, Artificial Sequence
  chemically synthesized
acaggggagtgcaaagatgagc

SEQ ID NO: 893312 - DNA, 22 bp, Artificial Sequence
  chemically synthesized
tacaggggagtgcaaagatgag

SEQ ID NO: 893313 - DNA, 22 bp, Artificial Sequence
  chemically synthesized
cgcctgggctcatctttgcact

SEQ ID NO: 893314 - DNA, 22 bp, Artificial Sequence
  chemically synthesized
gcctgggctcatctttgcactc

SEQ ID NO: 893315 - DNA, 22 bp, Artificial Sequence
  chemically synthesized
gattttacaggggagtgcaaag

SEQ ID NO: 893316 - DNA, 22 bp, Artificial Sequence
  chemically synthesized
ggctcatctttgcactcccctg

SEQ ID NO: 893317 - DNA, 22 bp, Artificial Sequence
  chemically synthesized
aacctggattttacaggggagt

SEQ ID NO: 893318 - DNA, 22 bp, Artificial Sequence
  chemically synthesized
ctgaacctggattttacagggg

SEQ ID NO: 893319 - DNA, 22 bp, Artificial Sequence
  chemically synthesized
atctttgcactcccctgtaaaa

SEQ ID NO: 893320 - DNA, 22 bp, Artificial Sequence
  chemically synthesized
gctgaacctggattttacaggg

SEQ ID NO: 893321 - DNA, 22 bp, Artificial Sequence
  chemically synthesized
tgctgaacctggattttacagg

SEQ ID NO: 893322 - DNA, 22 bp, Artificial Sequence
  chemically synthesized
tttgctgaacctggattttaca

SEQ ID NO: 893323 - DNA, 22 bp, Artificial Sequence
  chemically synthesized
ctttgctgaacctggattttac

SEQ ID NO: 893324 - DNA, 22 bp, Artificial Sequence
  chemically synthesized
tgcactcccctgtaaaatccag

SEQ ID NO: 893325 - DNA, 22 bp, Artificial Sequence
  chemically synthesized
gcactcccctgtaaaatccagg

SEQ ID NO: 893326 - DNA, 22 bp, Artificial Sequence
  chemically synthesized
cactcccctgtaaaatccaggt

SEQ ID NO: 893327 - DNA, 22 bp, Artificial Sequence
  chemically synthesized
ccctgtaaaatccaggttcagc

SEQ ID NO: 893328 - DNA, 22 bp, Artificial Sequence
  chemically synthesized
acaggcttctttgctgaacctg

SEQ ID NO: 893329 - DNA, 22 bp, Artificial Sequence
  chemically synthesized
taaaatccaggttcagcaaaga

SEQ ID NO: 893330 - DNA, 22 bp, Artificial Sequence
  chemically synthesized
taaaactgacaggcttctttgc

SEQ ID NO: 893331 - DNA, 22 bp, Artificial Sequence
  chemically synthesized
gtaaaactgacaggcttctttg

SEQ ID NO: 893332 - DNA, 22 bp, Artificial Sequence
  chemically synthesized
ttgtaaaactgacaggcttctt

SEQ ID NO: 893333 - DNA, 22 bp, Artificial Sequence
  chemically synthesized
agcaaagaagcctgtcagtttt

SEQ ID NO: 893334 - DNA, 22 bp, Artificial Sequence
  chemically synthesized
tcagttttacaagaacccttta

SEQ ID NO: 893335 - DNA, 22 bp, Artificial Sequence
  chemically synthesized
tacaagaaccctttatccttgg

SEQ ID NO: 893336 - DNA, 22 bp, Artificial Sequence
  chemically synthesized
acaagaaccctttatccttggt

SEQ ID NO: 893337 - DNA, 22 bp, Artificial Sequence
  chemically synthesized
caagaaccctttatccttggta

SEQ ID NO: 893338 - DNA, 22 bp, Artificial Sequence
  chemically synthesized
agggtgatcaggtaccaaggat

SEQ ID NO: 893339 - DNA, 22 bp, Artificial Sequence
  chemically synthesized
tatccttggtacctgatcaccc

SEQ ID NO: 893340 - DNA, 22 bp, Artificial Sequence
  chemically synthesized
atccttggtacctgatcaccct

SEQ ID NO: 893341 - DNA, 22 bp, Artificial Sequence
  chemically synthesized
tccttggtacctgatcaccctc

SEQ ID NO: 893342 - DNA, 22 bp, Artificial Sequence
  chemically synthesized
ggtacctgatcaccctcagtat

SEQ ID NO: 893343 - DNA, 22 bp, Artificial Sequence
  chemically synthesized
gtacctgatcaccctcagtatt

SEQ ID NO: 893344 - DNA, 22 bp, Artificial Sequence
  chemically synthesized
gggaatggtggagaatactgag

SEQ ID NO: 893345 - DNA, 22 bp, Artificial Sequence
  chemically synthesized
ggggaatggtggagaatactga

SEQ ID NO: 893346 - DNA, 22 bp, Artificial Sequence
  chemically synthesized
atcaccctcagtattctccacc

SEQ ID NO: 893347 - DNA, 22 bp, Artificial Sequence
  chemically synthesized
tcagacaacccttggggaatgg

SEQ ID NO: 893348 - DNA, 22 bp, Artificial Sequence
  chemically synthesized
agtattctccaccattccccaa

SEQ ID NO: 893349 - DNA, 22 bp, Artificial Sequence
  chemically synthesized
atcagacaacccttggggaatg

SEQ ID NO: 893350 - DNA, 22 bp, Artificial Sequence
  chemically synthesized
tcttatcagacaacccttgggg

SEQ ID NO: 893351 - DNA, 22 bp, Artificial Sequence
  chemically synthesized
tccaccattccccaagggttgt

SEQ ID NO: 893352 - DNA, 22 bp, Artificial Sequence
  chemically synthesized
caccattccccaagggttgtct

SEQ ID NO: 893353 - DNA, 22 bp, Artificial Sequence
  chemically synthesized
cccaagggttgtctgataagat

SEQ ID NO: 893354 - DNA, 22 bp, Artificial Sequence
  chemically synthesized
aagataggccagggttatctta

SEQ ID NO: 893355 - DNA, 22 bp, Artificial Sequence
  chemically synthesized
ctgaagataggccagggttatc

SEQ ID NO: 893356 - DNA, 22 bp, Artificial Sequence
  chemically synthesized
gctgaagataggccagggttat

SEQ ID NO: 893357 - DNA, 22 bp, Artificial Sequence
  chemically synthesized
ttgctgaagataggccagggtt

SEQ ID NO: 893358 - DNA, 22 bp, Artificial Sequence
  chemically synthesized
tctgataagataaccctggcct

SEQ ID NO: 893359 - DNA, 22 bp, Artificial Sequence
  chemically synthesized
ataagataaccctggcctatct

SEQ ID NO: 893360 - DNA, 22 bp, Artificial Sequence
  chemically synthesized
acaggattcttgctgaagatag

SEQ ID NO: 893361 - DNA, 22 bp, Artificial Sequence
  chemically synthesized
gcctatcttcagcaagaatcct

SEQ ID NO: 893362 - DNA, 22 bp, Artificial Sequence
  chemically synthesized
aaccaacctcacaggattcttg

SEQ ID NO: 893363 - DNA, 22 bp, Artificial Sequence
  chemically synthesized
gctaaaccaacctcacaggatt

SEQ ID NO: 893364 - DNA, 22 bp, Artificial Sequence
  chemically synthesized
tcttcagcaagaatcctgtgag

SEQ ID NO: 893365 - DNA, 22 bp, Artificial Sequence
  chemically synthesized
tggctaaaccaacctcacagga

SEQ ID NO: 893366 - DNA, 22 bp, Artificial Sequence
  chemically synthesized
cagcaagaatcctgtgaggttg

SEQ ID NO: 893367 - DNA, 22 bp, Artificial Sequence
  chemically synthesized
agcaagaatcctgtgaggttgg

SEQ ID NO: 893368 - DNA, 22 bp, Artificial Sequence
  chemically synthesized
tgaggttggtttagccagaatc

SEQ ID NO: 893369 - DNA, 22 bp, Artificial Sequence
  chemically synthesized
gtttagccagaatcccacttac

SEQ ID NO: 893370 - DNA, 22 bp, Artificial Sequence
  chemically synthesized
agccagaatcccacttacccct

SEQ ID NO: 893371 - DNA, 22 bp, Artificial Sequence
  chemically synthesized
agaggaaacatcaggggtaagt

SEQ ID NO: 893372 - DNA, 22 bp, Artificial Sequence
  chemically synthesized
gccagaatcccacttacccctg

SEQ ID NO: 893373 - DNA, 22 bp, Artificial Sequence
  chemically synthesized
ttaagaggaaacatcaggggta

SEQ ID NO: 893374 - DNA, 22 bp, Artificial Sequence
  chemically synthesized
acccctgatgtttcctcttaat

SEQ ID NO: 893375 - DNA, 22 bp, Artificial Sequence
  chemically synthesized
cccctgatgtttcctcttaata

SEQ ID NO: 893376 - DNA, 22 bp, Artificial Sequence
  chemically synthesized
atgtttcctcttaataattttc

SEQ ID NO: 893377 - DNA, 22 bp, Artificial Sequence
  chemically synthesized
cctcttaataattttccatcta

SEQ ID NO: 893378 - DNA, 22 bp, Artificial Sequence
  chemically synthesized
ctcttaataattttccatctac

SEQ ID NO: 893379 - DNA, 22 bp, Artificial Sequence
  chemically synthesized
ttaataattttccatctactga

SEQ ID NO: 893380 - DNA, 22 bp, Artificial Sequence
  chemically synthesized
aataattttccatctactgact

SEQ ID NO: 893381 - DNA, 22 bp, Artificial Sequence
  chemically synthesized
ataattttccatctactgactc

SEQ ID NO: 893382 - DNA, 22 bp, Artificial Sequence
  chemically synthesized
tccatctactgactcctacact

SEQ ID NO: 893383 - DNA, 22 bp, Artificial Sequence
  chemically synthesized
tagccaaggagcagtgtaggag

SEQ ID NO: 893384 - DNA, 22 bp, Artificial Sequence
  chemically synthesized
ccatctactgactcctacactg

SEQ ID NO: 893385 - DNA, 22 bp, Artificial Sequence
  chemically synthesized
atagccaaggagcagtgtagga

SEQ ID NO: 893386 - DNA, 22 bp, Artificial Sequence
  chemically synthesized
catctactgactcctacactgc

SEQ ID NO: 893387 - DNA, 22 bp, Artificial Sequence
  chemically synthesized
ctgactcctacactgctccttg

SEQ ID NO: 893388 - DNA, 22 bp, Artificial Sequence
  chemically synthesized
actcctacactgctccttggct

SEQ ID NO: 893389 - DNA, 22 bp, Artificial Sequence
  chemically synthesized
ctacactgctccttggctataa

SEQ ID NO: 893390 - DNA, 22 bp, Artificial Sequence
  chemically synthesized
cactgctccttggctataaatt

SEQ ID NO: 893391 - DNA, 22 bp, Artificial Sequence
  chemically synthesized
ctccttggctataaattcctac

SEQ ID NO: 893392 - DNA, 22 bp, Artificial Sequence
  chemically synthesized
cttggctataaattcctacttc

SEQ ID NO: 893393 - DNA, 22 bp, Artificial Sequence
  chemically synthesized
aatacagcacagtggaagtagg

SEQ ID NO: 893394 - DNA, 22 bp, Artificial Sequence
  chemically synthesized
ggctataaattcctacttccac

SEQ ID NO: 893395 - DNA, 22 bp, Artificial Sequence
  chemically synthesized
gctataaattcctacttccact

SEQ ID NO: 893396 - DNA, 22 bp, Artificial Sequence
  chemically synthesized
taaatacagcacagtggaagta

SEQ ID NO: 893397 - DNA, 22 bp, Artificial Sequence
  chemically synthesized
taaattcctacttccactgtgc

SEQ ID NO: 893398 - DNA, 22 bp, Artificial Sequence
  chemically synthesized
aactctaaatacagcacagtgg

SEQ ID NO: 893399 - DNA, 22 bp, Artificial Sequence
  chemically synthesized
ggctcaactctaaatacagcac

SEQ ID NO: 893400 - DNA, 22 bp, Artificial Sequence
  chemically synthesized
ctacttccactgtgctgtattt

SEQ ID NO: 893401 - DNA, 22 bp, Artificial Sequence
  chemically synthesized
cttccactgtgctgtatttaga

SEQ ID NO: 893402 - DNA, 22 bp, Artificial Sequence
  chemically synthesized
ccactgtgctgtatttagagtt

SEQ ID NO: 893403 - DNA, 22 bp, Artificial Sequence
  chemically synthesized
cactgtgctgtatttagagttg

SEQ ID NO: 893404 - DNA, 22 bp, Artificial Sequence
  chemically synthesized
tgctgtatttagagttgagccc

SEQ ID NO: 893405 - DNA, 22 bp, Artificial Sequence
  chemically synthesized
gatagagagagattgggctcaa

SEQ ID NO: 893406 - DNA, 22 bp, Artificial Sequence
  chemically synthesized
tatttagagttgagcccaatct

SEQ ID NO: 893407 - DNA, 22 bp, Artificial Sequence
  chemically synthesized
agagttgagcccaatctctctc

SEQ ID NO: 893408 - DNA, 22 bp, Artificial Sequence
  chemically synthesized
gagttgagcccaatctctctct

SEQ ID NO: 893409 - DNA, 22 bp, Artificial Sequence
  chemically synthesized
caggaggttggatagagagaga

SEQ ID NO: 893410 - DNA, 22 bp, Artificial Sequence
  chemically synthesized
agcccaatctctctctatccaa

SEQ ID NO: 893411 - DNA, 22 bp, Artificial Sequence
  chemically synthesized
caatggagtattacaggaggtt

SEQ ID NO: 893412 - DNA, 22 bp, Artificial Sequence
  chemically synthesized
tctctatccaacctcctgtaat

SEQ ID NO: 893413 - DNA, 22 bp, Artificial Sequence
  chemically synthesized
tctatccaacctcctgtaatac

SEQ ID NO: 893414 - DNA, 22 bp, Artificial Sequence
  chemically synthesized
tatccaacctcctgtaatactc

SEQ ID NO: 893415 - DNA, 22 bp, Artificial Sequence
  chemically synthesized
tccaacctcctgtaatactcca

SEQ ID NO: 893416 - DNA, 22 bp, Artificial Sequence
  chemically synthesized
ctgtaatactccattgcagtgg

SEQ ID NO: 893417 - DNA, 22 bp, Artificial Sequence
  chemically synthesized
taatactccattgcagtggtcc

SEQ ID NO: 893418 - DNA, 22 bp, Artificial Sequence
  chemically synthesized
cattgcagtggtccctgtgcct

SEQ ID NO: 893419 - DNA, 22 bp, Artificial Sequence
  chemically synthesized
aggataaccacaataggcacag

SEQ ID NO: 893420 - DNA, 22 bp, Artificial Sequence
  chemically synthesized
cagtggtccctgtgcctattgt

SEQ ID NO: 893421 - DNA, 22 bp, Artificial Sequence
  chemically synthesized
ttcaggataaccacaataggca

SEQ ID NO: 893422 - DNA, 22 bp, Artificial Sequence
  chemically synthesized
attcaggataaccacaataggc

SEQ ID NO: 893423 - DNA, 22 bp, Artificial Sequence
  chemically synthesized
tattcaggataaccacaatagg

SEQ ID NO: 893424 - DNA, 22 bp, Artificial Sequence
  chemically synthesized
tgcctattgtggttatcctgaa

SEQ ID NO: 893425 - DNA, 22 bp, Artificial Sequence
  chemically synthesized
ttgtggttatcctgaataaagt

SEQ ID NO: 893426 - DNA, 22 bp, Artificial Sequence
  chemically synthesized
tggttatcctgaataaagtctt

SEQ ID NO: 893427 - DNA, 22 bp, Artificial Sequence
  chemically synthesized
aagtgtggtaaggaagacttta

SEQ ID NO: 893428 - DNA, 22 bp, Artificial Sequence
  chemically synthesized
ttaaagtgtggtaaggaagact

SEQ ID NO: 893429 - DNA, 22 bp, Artificial Sequence
  chemically synthesized
gttaaagtgtggtaaggaagac

SEQ ID NO: 893430 - DNA, 22 bp, Artificial Sequence
  chemically synthesized
tcctgaataaagtcttccttac

SEQ ID NO: 893431 - DNA, 22 bp, Artificial Sequence
  chemically synthesized
cttgttaaagtgtggtaaggaa

SEQ ID NO: 893432 - DNA, 22 bp, Artificial Sequence
  chemically synthesized
aataaagtcttccttaccacac

SEQ ID NO: 893433 - DNA, 22 bp, Artificial Sequence
  chemically synthesized
ccttaccacactttaacaagta

SEQ ID NO: 893434 - DNA, 22 bp, Artificial Sequence
  chemically synthesized
aagacaaaatattacttgttaa

SEQ ID NO: 893435 - DNA, 22 bp, Artificial Sequence
  chemically synthesized
cttaccacactttaacaagtaa

SEQ ID NO: 893436 - DNA, 22 bp, Artificial Sequence
  chemically synthesized
ttaaagacaaaatattacttgt

SEQ ID NO: 893437 - DNA, 22 bp, Artificial Sequence
  chemically synthesized
accacactttaacaagtaatat

SEQ ID NO: 893438 - DNA, 22 bp, Artificial Sequence
  chemically synthesized
ccacactttaacaagtaatatt

SEQ ID NO: 893439 - DNA, 22 bp, Artificial Sequence
  chemically synthesized
gtatcattattaaagacaaaat

SEQ ID NO: 893440 - DNA, 22 bp, Artificial Sequence
  chemically synthesized
taacaagtaatattttgtcttt

SEQ ID NO: 893441 - DNA, 22 bp, Artificial Sequence
  chemically synthesized
ggtatcattattaaagacaaaa

SEQ ID NO: 893442 - DNA, 22 bp, Artificial Sequence
  chemically synthesized
aacaagtaatattttgtcttta

SEQ ID NO: 893443 - DNA, 22 bp, Artificial Sequence
  chemically synthesized
acaagtaatattttgtctttaa

SEQ ID NO: 893444 - DNA, 22 bp, Artificial Sequence
  chemically synthesized
atttggtatcattattaaagac

SEQ ID NO: 893445 - DNA, 22 bp, Artificial Sequence
  chemically synthesized
tcatttggtatcattattaaag

SEQ ID NO: 893446 - DNA, 22 bp, Artificial Sequence
  chemically synthesized
ctcatttggtatcattattaaa

SEQ ID NO: 893447 - DNA, 22 bp, Artificial Sequence
  chemically synthesized
tctcatttggtatcattattaa

SEQ ID NO: 893448 - DNA, 22 bp, Artificial Sequence
  chemically synthesized
aattttctcatttggtatcatt

SEQ ID NO: 893449 - DNA, 22 bp, Artificial Sequence
  chemically synthesized
tgtctttaataatgataccaaa

SEQ ID NO: 893450 - DNA, 22 bp, Artificial Sequence
  chemically synthesized
gtctttaataatgataccaaat

SEQ ID NO: 893451 - DNA, 22 bp, Artificial Sequence
  chemically synthesized
tctttaataatgataccaaatg

SEQ ID NO: 893452 - DNA, 22 bp, Artificial Sequence
  chemically synthesized
taataatgataccaaatgagaa

SEQ ID NO: 893453 - DNA, 22 bp, Artificial Sequence
  chemically synthesized
aataatgataccaaatgagaaa

SEQ ID NO: 893454 - DNA, 22 bp, Artificial Sequence
  chemically synthesized
ataatgataccaaatgagaaaa

SEQ ID NO: 893455 - DNA, 22 bp, Artificial Sequence
  chemically synthesized
agaaaaatggcaatatcactga

SEQ ID NO: 893456 - DNA, 22 bp, Artificial Sequence
  chemically synthesized
aagaaaaatggcaatatcactg

SEQ ID NO: 893457 - DNA, 22 bp, Artificial Sequence
  chemically synthesized
taagaaaaatggcaatatcact

SEQ ID NO: 893458 - DNA, 22 bp, Artificial Sequence
  chemically synthesized
ttaagaaaaatggcaatatcac

SEQ ID NO: 893459 - DNA, 22 bp, Artificial Sequence
  chemically synthesized
tttaagaaaaatggcaatatca

SEQ ID NO: 893460 - DNA, 22 bp, Artificial Sequence
  chemically synthesized
ttttaagaaaaatggcaatatc

SEQ ID NO: 893461 - DNA, 22 bp, Artificial Sequence
  chemically synthesized
tcttttttaagaaaaatggcaa

SEQ ID NO: 893462 - DNA, 22 bp, Artificial Sequence
  chemically synthesized
gtcttttttaagaaaaatggca

SEQ ID NO: 893463 - DNA, 22 bp, Artificial Sequence
  chemically synthesized
tgtcttttttaagaaaaatggc

SEQ ID NO: 893464 - DNA, 22 bp, Artificial Sequence
  chemically synthesized
ttgtcttttttaagaaaaatgg

SEQ ID NO: 893465 - DNA, 22 bp, Artificial Sequence
  chemically synthesized
agtgatattgccatttttctta

SEQ ID NO: 893466 - DNA, 22 bp, Artificial Sequence
  chemically synthesized
aatatttttgtcttttttaaga

SEQ ID NO: 893467 - DNA, 22 bp, Artificial Sequence
  chemically synthesized
aaatatttttgtcttttttaag

SEQ ID NO: 893468 - DNA, 22 bp, Artificial Sequence
  chemically synthesized
taaatatttttgtcttttttaa

SEQ ID NO: 893469 - DNA, 22 bp, Artificial Sequence
  chemically synthesized
ccatttttcttaaaaaagacaa

SEQ ID NO: 893470 - DNA, 22 bp, Artificial Sequence
  chemically synthesized
ctttaaatatttttgtcttttt

SEQ ID NO: 893471 - DNA, 22 bp, Artificial Sequence
  chemically synthesized
gctttaaatatttttgtctttt

SEQ ID NO: 893472 - DNA, 22 bp, Artificial Sequence
  chemically synthesized
tgctttaaatatttttgtcttt

SEQ ID NO: 893473 - DNA, 22 bp, Artificial Sequence
  chemically synthesized
ttgctttaaatatttttgtctt

SEQ ID NO: 893474 - DNA, 22 bp, Artificial Sequence
  chemically synthesized
tttgctttaaatatttttgtct

SEQ ID NO: 893475 - DNA, 22 bp, Artificial Sequence
  chemically synthesized
ttcttaaaaaagacaaaaatat

SEQ ID NO: 893476 - DNA, 22 bp, Artificial Sequence
  chemically synthesized
tcttaaaaaagacaaaaatatt

SEQ ID NO: 893477 - DNA, 22 bp, Artificial Sequence
  chemically synthesized
cttaaaaaagacaaaaatattt

SEQ ID NO: 893478 - DNA, 22 bp, Artificial Sequence
  chemically synthesized
ttaaaaaagacaaaaatattta

SEQ ID NO: 893479 - DNA, 22 bp, Artificial Sequence
  chemically synthesized
aaaaaagacaaaaatatttaaa

SEQ ID NO: 893480 - DNA, 22 bp, Artificial Sequence
  chemically synthesized
aaaaagacaaaaatatttaaag

SEQ ID NO: 893481 - DNA, 22 bp, Artificial Sequence
  chemically synthesized
aggtagggaactttttgcttta

SEQ ID NO: 893482 - DNA, 22 bp, Artificial Sequence
  chemically synthesized
acgttcaggtagggaacttttt

SEQ ID NO: 893483 - DNA, 22 bp, Artificial Sequence
  chemically synthesized
gacgttcaggtagggaactttt

SEQ ID NO: 893484 - DNA, 22 bp, Artificial Sequence
  chemically synthesized
aaagcaaaaagttccctacctg

SEQ ID NO: 893485 - DNA, 22 bp, Artificial Sequence
  chemically synthesized
aagcaaaaagttccctacctga

SEQ ID NO: 893486 - DNA, 22 bp, Artificial Sequence
  chemically synthesized
cctacctgaacgtcaaatggtc

SEQ ID NO: 893487 - DNA, 22 bp, Artificial Sequence
  chemically synthesized
cctgaacgtcaaatggtccttc

SEQ ID NO: 893488 - DNA, 22 bp, Artificial Sequence
  chemically synthesized
aacgtcaaatggtccttcttgg

SEQ ID NO: 893489 - DNA, 22 bp, Artificial Sequence
  chemically synthesized
taaccaaccaaaccaagaagga

SEQ ID NO: 893490 - DNA, 22 bp, Artificial Sequence
  chemically synthesized
ataaccaaccaaaccaagaagg

SEQ ID NO: 893491 - DNA, 22 bp, Artificial Sequence
  chemically synthesized
gaaatttataaccaaccaaacc

SEQ ID NO: 893492 - DNA, 22 bp, Artificial Sequence
  chemically synthesized
cttggtttggttggttataaat

SEQ ID NO: 893493 - DNA, 22 bp, Artificial Sequence
  chemically synthesized
ttggtttggttggttataaatt

SEQ ID NO: 893494 - DNA, 22 bp, Artificial Sequence
  chemically synthesized
ggaatcagttggaaatttataa

SEQ ID NO: 893495 - DNA, 22 bp, Artificial Sequence
  chemically synthesized
ggtttggttggttataaatttc

SEQ ID NO: 893496 - DNA, 22 bp, Artificial Sequence
  chemically synthesized
gtttggttggttataaatttcc

SEQ ID NO: 893497 - DNA, 22 bp, Artificial Sequence
  chemically synthesized
ttaggaatcagttggaaattta

SEQ ID NO: 893498 - DNA, 22 bp, Artificial Sequence
  chemically synthesized
ggttggttataaatttccaact

SEQ ID NO: 893499 - DNA, 22 bp, Artificial Sequence
  chemically synthesized
ctattaggaatcagttggaaat

SEQ ID NO: 893500 - DNA, 22 bp, Artificial Sequence
  chemically synthesized
gttggttataaatttccaactg

SEQ ID NO: 893501 - DNA, 22 bp, Artificial Sequence
  chemically synthesized
tctcctattaggaatcagttgg

SEQ ID NO: 893502 - DNA, 22 bp, Artificial Sequence
  chemically synthesized
gttataaatttccaactgattc

SEQ ID NO: 893503 - DNA, 22 bp, Artificial Sequence
  chemically synthesized
taaatttccaactgattcctaa

SEQ ID NO: 893504 - DNA, 22 bp, Artificial Sequence
  chemically synthesized
tggttatctcctattaggaatc

SEQ ID NO: 893505 - DNA, 22 bp, Artificial Sequence
  chemically synthesized
ctgtggttatctcctattagga

SEQ ID NO: 893506 - DNA, 22 bp, Artificial Sequence
  chemically synthesized
ccaactgattcctaataggaga

SEQ ID NO: 893507 - DNA, 22 bp, Artificial Sequence
  chemically synthesized
ctgctgtggttatctcctatta

SEQ ID NO: 893508 - DNA, 22 bp, Artificial Sequence
  chemically synthesized
caactgattcctaataggagat

SEQ ID NO: 893509 - DNA, 22 bp, Artificial Sequence
  chemically synthesized
attcctaataggagataaccac

SEQ ID NO: 893510 - DNA, 22 bp, Artificial Sequence
  chemically synthesized
aatcatctgctgctgtggttat

SEQ ID NO: 893511 - DNA, 22 bp, Artificial Sequence
  chemically synthesized
ctaataggagataaccacagca

SEQ ID NO: 893512 - DNA, 22 bp, Artificial Sequence
  chemically synthesized
ataggagataaccacagcagca

SEQ ID NO: 893513 - DNA, 22 bp, Artificial Sequence
  chemically synthesized
aagagcagttaaatcatctgct

SEQ ID NO: 893514 - DNA, 22 bp, Artificial Sequence
  chemically synthesized
gaagagcagttaaatcatctgc

SEQ ID NO: 893515 - DNA, 22 bp, Artificial Sequence
  chemically synthesized
aagaccttgaagagcagttaaa

SEQ ID NO: 893516 - DNA, 22 bp, Artificial Sequence
  chemically synthesized
gaagaccttgaagagcagttaa

SEQ ID NO: 893517 - DNA, 22 bp, Artificial Sequence
  chemically synthesized
aaaaaaagcttgaagaccttga

SEQ ID NO: 893518 - DNA, 22 bp, Artificial Sequence
  chemically synthesized
gaaaaaaagcttgaagaccttg

SEQ ID NO: 893519 - DNA, 22 bp, Artificial Sequence
  chemically synthesized
aactgctcttcaaggtcttcaa

SEQ ID NO: 893520 - DNA, 22 bp, Artificial Sequence
  chemically synthesized
actgctcttcaaggtcttcaag

SEQ ID NO: 893521 - DNA, 22 bp, Artificial Sequence
  chemically synthesized
ctcttcaaggtcttcaagcttt

SEQ ID NO: 893522 - DNA, 22 bp, Artificial Sequence
  chemically synthesized
ggcagcttgaaaaaaagcttga

SEQ ID NO: 893523 - DNA, 22 bp, Artificial Sequence
  chemically synthesized
gggcagcttgaaaaaaagcttg

SEQ ID NO: 893524 - DNA, 22 bp, Artificial Sequence
  chemically synthesized
ttcaaggtcttcaagctttttt

SEQ ID NO: 893525 - DNA, 22 bp, Artificial Sequence
  chemically synthesized
caaggtcttcaagctttttttc

SEQ ID NO: 893526 - DNA, 22 bp, Artificial Sequence
  chemically synthesized
aaggtcttcaagctttttttca

SEQ ID NO: 893527 - DNA, 22 bp, Artificial Sequence
  chemically synthesized
caagctttttttcaagctgccc

SEQ ID NO: 893528 - DNA, 22 bp, Artificial Sequence
  chemically synthesized
aagctttttttcaagctgccca

SEQ ID NO: 893529 - DNA, 22 bp, Artificial Sequence
  chemically synthesized
aaataaaagaccttgggcagct

SEQ ID NO: 893530 - DNA, 22 bp, Artificial Sequence
  chemically synthesized
tttttcaagctgcccaaggtct

SEQ ID NO: 893531 - DNA, 22 bp, Artificial Sequence
  chemically synthesized
ttttcaagctgcccaaggtctt

SEQ ID NO: 893532 - DNA, 22 bp, Artificial Sequence
  chemically synthesized
aagctcaaataaaagaccttgg

SEQ ID NO: 893533 - DNA, 22 bp, Artificial Sequence
  chemically synthesized
tttcaagctgcccaaggtcttt

SEQ ID NO: 893534 - DNA, 22 bp, Artificial Sequence
  chemically synthesized
ttcaagctgcccaaggtctttt

SEQ ID NO: 893535 - DNA, 22 bp, Artificial Sequence
  chemically synthesized
tcaagctgcccaaggtctttta

SEQ ID NO: 893536 - DNA, 22 bp, Artificial Sequence
  chemically synthesized
caagctgcccaaggtcttttat

SEQ ID NO: 893537 - DNA, 22 bp, Artificial Sequence
  chemically synthesized
aagctgcccaaggtcttttatt

SEQ ID NO: 893538 - DNA, 22 bp, Artificial Sequence
  chemically synthesized
cccaaggtcttttatttgagct

SEQ ID NO: 893539 - DNA, 22 bp, Artificial Sequence
  chemically synthesized
agaaacaaggagaaattgaagc

SEQ ID NO: 893540 - DNA, 22 bp, Artificial Sequence
  chemically synthesized
ttatttgagcttcaatttctcc

SEQ ID NO: 893541 - DNA, 22 bp, Artificial Sequence
  chemically synthesized
cctgagaaacaaggagaaattg

SEQ ID NO: 893542 - DNA, 22 bp, Artificial Sequence
  chemically synthesized
tatttgagcttcaatttctcct

SEQ ID NO: 893543 - DNA, 22 bp, Artificial Sequence
  chemically synthesized
acctgagaaacaaggagaaatt

SEQ ID NO: 893544 - DNA, 22 bp, Artificial Sequence
  chemically synthesized
atttgagcttcaatttctcctt

SEQ ID NO: 893545 - DNA, 22 bp, Artificial Sequence
  chemically synthesized
tacctgagaaacaaggagaaat

SEQ ID NO: 893546 - DNA, 22 bp, Artificial Sequence
  chemically synthesized
tttgagcttcaatttctccttg

SEQ ID NO: 893547 - DNA, 22 bp, Artificial Sequence
  chemically synthesized
gagcttcaatttctccttgttt

SEQ ID NO: 893548 - DNA, 22 bp, Artificial Sequence
  chemically synthesized
agcttcaatttctccttgtttc

SEQ ID NO: 893549 - DNA, 22 bp, Artificial Sequence
  chemically synthesized
cagagctttacctgagaaacaa

SEQ ID NO: 893550 - DNA, 22 bp, Artificial Sequence
  chemically synthesized
ccagagctttacctgagaaaca

SEQ ID NO: 893551 - DNA, 22 bp, Artificial Sequence
  chemically synthesized
caatttctccttgtttctcagg

SEQ ID NO: 893552 - DNA, 22 bp, Artificial Sequence
  chemically synthesized
aatttctccttgtttctcaggt

SEQ ID NO: 893553 - DNA, 22 bp, Artificial Sequence
  chemically synthesized
aggtttccagagctttacctga

SEQ ID NO: 893554 - DNA, 22 bp, Artificial Sequence
  chemically synthesized
ctccttgtttctcaggtaaagc

SEQ ID NO: 893555 - DNA, 22 bp, Artificial Sequence
  chemically synthesized
caggtttccagagctttacctg

SEQ ID NO: 893556 - DNA, 22 bp, Artificial Sequence
  chemically synthesized
tccttgtttctcaggtaaagct

SEQ ID NO: 893557 - DNA, 22 bp, Artificial Sequence
  chemically synthesized
tcaggtttccagagctttacct

SEQ ID NO: 893558 - DNA, 22 bp, Artificial Sequence
  chemically synthesized
cttgtttctcaggtaaagctct

SEQ ID NO: 893559 - DNA, 22 bp, Artificial Sequence
  chemically synthesized
ctttcaggtttccagagcttta

SEQ ID NO: 893560 - DNA, 22 bp, Artificial Sequence
  chemically synthesized
cctttcaggtttccagagcttt

SEQ ID NO: 893561 - DNA, 22 bp, Artificial Sequence
  chemically synthesized
gtttctcaggtaaagctctgga

SEQ ID NO: 893562 - DNA, 22 bp, Artificial Sequence
  chemically synthesized
tcctttcaggtttccagagctt

SEQ ID NO: 893563 - DNA, 22 bp, Artificial Sequence
  chemically synthesized
tttctcaggtaaagctctggaa

SEQ ID NO: 893564 - DNA, 22 bp, Artificial Sequence
  chemically synthesized
ctcaggtaaagctctggaaacc

SEQ ID NO: 893565 - DNA, 22 bp, Artificial Sequence
  chemically synthesized
tcaggtaaagctctggaaacct

SEQ ID NO: 893566 - DNA, 22 bp, Artificial Sequence
  chemically synthesized
aggtaaagctctggaaacctga

SEQ ID NO: 893567 - DNA, 22 bp, Artificial Sequence
  chemically synthesized
aaatgtattttcctttcaggtt

SEQ ID NO: 893568 - DNA, 22 bp, Artificial Sequence
  chemically synthesized
aaaatgtattttcctttcaggt

SEQ ID NO: 893569 - DNA, 22 bp, Artificial Sequence
  chemically synthesized
taaaatgtattttcctttcagg

SEQ ID NO: 893570 - DNA, 22 bp, Artificial Sequence
  chemically synthesized
ttaaaatgtattttcctttcag

SEQ ID NO: 893571 - DNA, 22 bp, Artificial Sequence
  chemically synthesized
tttaaaatgtattttcctttca

SEQ ID NO: 893572 - DNA, 22 bp, Artificial Sequence
  chemically synthesized
tggaaacctgaaaggaaaatac

SEQ ID NO: 893573 - DNA, 22 bp, Artificial Sequence
  chemically synthesized
cctttttaaaatgtattttcct

SEQ ID NO: 893574 - DNA, 22 bp, Artificial Sequence
  chemically synthesized
acctttttaaaatgtattttcc

SEQ ID NO: 893575 - DNA, 22 bp, Artificial Sequence
  chemically synthesized
gaaacctgaaaggaaaatacat

SEQ ID NO: 893576 - DNA, 22 bp, Artificial Sequence
  chemically synthesized
tttacctttttaaaatgtattt

SEQ ID NO: 893577 - DNA, 22 bp, Artificial Sequence
  chemically synthesized
aaaggaaaatacattttaaaaa

SEQ ID NO: 893578 - DNA, 22 bp, Artificial Sequence
  chemically synthesized
agaattatttacctttttaaaa

SEQ ID NO: 893579 - DNA, 22 bp, Artificial Sequence
  chemically synthesized
gagaattatttacctttttaaa

SEQ ID NO: 893580 - DNA, 22 bp, Artificial Sequence
  chemically synthesized
tgccttgagaattatttacctt

SEQ ID NO: 893581 - DNA, 22 bp, Artificial Sequence
  chemically synthesized
atgccttgagaattatttacct

SEQ ID NO: 893582 - DNA, 22 bp, Artificial Sequence
  chemically synthesized
gcttatgccttgagaattattt

SEQ ID NO: 893583 - DNA, 22 bp, Artificial Sequence
  chemically synthesized
ggcttatgccttgagaattatt

SEQ ID NO: 893584 - DNA, 22 bp, Artificial Sequence
  chemically synthesized
tggcttatgccttgagaattat

SEQ ID NO: 893585 - DNA, 22 bp, Artificial Sequence
  chemically synthesized
taaaaaggtaaataattctcaa

SEQ ID NO: 893586 - DNA, 22 bp, Artificial Sequence
  chemically synthesized
aaaaaggtaaataattctcaag

SEQ ID NO: 893587 - DNA, 22 bp, Artificial Sequence
  chemically synthesized
aaaaggtaaataattctcaagg

SEQ ID NO: 893588 - DNA, 22 bp, Artificial Sequence
  chemically synthesized
aacattttggcttatgccttga

SEQ ID NO: 893589 - DNA, 22 bp, Artificial Sequence
  chemically synthesized
aaacattttggcttatgccttg

SEQ ID NO: 893590 - DNA, 22 bp, Artificial Sequence
  chemically synthesized
taaacattttggcttatgcctt

SEQ ID NO: 893591 - DNA, 22 bp, Artificial Sequence
  chemically synthesized
ttaaacattttggcttatgcct

SEQ ID NO: 893592 - DNA, 22 bp, Artificial Sequence
  chemically synthesized
tcaaggcataagccaaaatgtt

SEQ ID NO: 893593 - DNA, 22 bp, Artificial Sequence
  chemically synthesized
aaggcataagccaaaatgttta

SEQ ID NO: 893594 - DNA, 22 bp, Artificial Sequence
  chemically synthesized
aaaatatatttttaaacatttt

SEQ ID NO: 893595 - DNA, 22 bp, Artificial Sequence
  chemically synthesized
gaaaatatatttttaaacattt

SEQ ID NO: 893596 - DNA, 22 bp, Artificial Sequence
  chemically synthesized
tgaaaatatatttttaaacatt

SEQ ID NO: 893597 - DNA, 22 bp, Artificial Sequence
  chemically synthesized
ttgaaaatatatttttaaacat

SEQ ID NO: 893598 - DNA, 22 bp, Artificial Sequence
  chemically synthesized
atgataaataacttttgaaaat

SEQ ID NO: 893599 - DNA, 22 bp, Artificial Sequence
  chemically synthesized
catgataaataacttttgaaaa

SEQ ID NO: 893600 - DNA, 22 bp, Artificial Sequence
  chemically synthesized
aaaaatatattttcaaaagtta

SEQ ID NO: 893601 - DNA, 22 bp, Artificial Sequence
  chemically synthesized
aaaatatattttcaaaagttat

SEQ ID NO: 893602 - DNA, 22 bp, Artificial Sequence
  chemically synthesized
taatatttcatgataaataact

SEQ ID NO: 893603 - DNA, 22 bp, Artificial Sequence
  chemically synthesized
tgtaatatttcatgataaataa

SEQ ID NO: 893604 - DNA, 22 bp, Artificial Sequence
  chemically synthesized
tcaaaagttatttatcatgaaa

SEQ ID NO: 893605 - DNA, 22 bp, Artificial Sequence
  chemically synthesized
caaaagttatttatcatgaaat

SEQ ID NO: 893606 - DNA, 22 bp, Artificial Sequence
  chemically synthesized
aaaagttatttatcatgaaata

SEQ ID NO: 893607 - DNA, 22 bp, Artificial Sequence
  chemically synthesized
tttatcatgaaatattacagaa

SEQ ID NO: 893608 - DNA, 22 bp, Artificial Sequence
  chemically synthesized
atcatgaaatattacagaatct

SEQ ID NO: 893609 - DNA, 22 bp, Artificial Sequence
  chemically synthesized
tcatgaaatattacagaatctt

SEQ ID NO: 893610 - DNA, 22 bp, Artificial Sequence
  chemically synthesized
aaataacacaaatcagtaagat

SEQ ID NO: 893611 - DNA, 22 bp, Artificial Sequence
  chemically synthesized
ctaaaataacacaaatcagtaa

SEQ ID NO: 893612 - DNA, 22 bp, Artificial Sequence
  chemically synthesized
cagaatcttactgatttgtgtt

SEQ ID NO: 893613 - DNA, 22 bp, Artificial Sequence
  chemically synthesized
tgctgctaaaataacacaaatc

SEQ ID NO: 893614 - DNA, 22 bp, Artificial Sequence
  chemically synthesized
actgatttgtgttattttagca

SEQ ID NO: 893615 - DNA, 22 bp, Artificial Sequence
  chemically synthesized
ctgatttgtgttattttagcag

SEQ ID NO: 893616 - DNA, 22 bp, Artificial Sequence
  chemically synthesized
atttgtgttattttagcagcat

SEQ ID NO: 893617 - DNA, 22 bp, Artificial Sequence
  chemically synthesized
gtgttattttagcagcataata

SEQ ID NO: 893618 - DNA, 22 bp, Artificial Sequence
  chemically synthesized
tgttattttagcagcataatat

SEQ ID NO: 893619 - DNA, 22 bp, Artificial Sequence
  chemically synthesized
ttttagcagcataatattgatt

SEQ ID NO: 893620 - DNA, 22 bp, Artificial Sequence
  chemically synthesized
tagcagcataatattgattatt

SEQ ID NO: 893621 - DNA, 22 bp, Artificial Sequence
  chemically synthesized
agcagcataatattgattattt

SEQ ID NO: 893622 - DNA, 22 bp, Artificial Sequence
  chemically synthesized
gcagcataatattgattattta

SEQ ID NO: 893623 - DNA, 22 bp, Artificial Sequence
  chemically synthesized
aatcccaacatgtaatatatgt

SEQ ID NO: 893624 - DNA, 22 bp, Artificial Sequence
  chemically synthesized
gttaaatcccaacatgtaatat

SEQ ID NO: 893625 - DNA, 22 bp, Artificial Sequence
  chemically synthesized
attatttacatatattacatgt

SEQ ID NO: 893626 - DNA, 22 bp, Artificial Sequence
  chemically synthesized
tttacatatattacatgttggg

SEQ ID NO: 893627 - DNA, 22 bp, Artificial Sequence
  chemically synthesized
acatatattacatgttgggatt

SEQ ID NO: 893628 - DNA, 22 bp, Artificial Sequence
  chemically synthesized
catatattacatgttgggattt

SEQ ID NO: 893629 - DNA, 22 bp, Artificial Sequence
  chemically synthesized
aatacattggttaaatcccaac

SEQ ID NO: 893630 - DNA, 22 bp, Artificial Sequence
  chemically synthesized
gaatacattggttaaatcccaa

SEQ ID NO: 893631 - DNA, 22 bp, Artificial Sequence
  chemically synthesized
tgaatacattggttaaatccca

SEQ ID NO: 893632 - DNA, 22 bp, Artificial Sequence
  chemically synthesized
catgttgggatttaaccaatgt

SEQ ID NO: 893633 - DNA, 22 bp, Artificial Sequence
  chemically synthesized
atgaataattttgaatacattg

SEQ ID NO: 893634 - DNA, 22 bp, Artificial Sequence
  chemically synthesized
ggatttaaccaatgtattcaaa

SEQ ID NO: 893635 - DNA, 22 bp, Artificial Sequence
  chemically synthesized
aaccaatgtattcaaaattatt

SEQ ID NO: 893636 - DNA, 22 bp, Artificial Sequence
  chemically synthesized
accaatgtattcaaaattattc

SEQ ID NO: 893637 - DNA, 22 bp, Artificial Sequence
  chemically synthesized
tagcaggttaatgaataatttt

SEQ ID NO: 893638 - DNA, 22 bp, Artificial Sequence
  chemically synthesized
gtagcaggttaatgaataattt

SEQ ID NO: 893639 - DNA, 22 bp, Artificial Sequence
  chemically synthesized
tgtagcaggttaatgaataatt

SEQ ID NO: 893640 - DNA, 22 bp, Artificial Sequence
  chemically synthesized
ttgtagcaggttaatgaataat

SEQ ID NO: 893641 - DNA, 22 bp, Artificial Sequence
  chemically synthesized
aaaattattcattaacctgcta

SEQ ID NO: 893642 - DNA, 22 bp, Artificial Sequence
  chemically synthesized
aagcaaagaatttttgtagcag

SEQ ID NO: 893643 - DNA, 22 bp, Artificial Sequence
  chemically synthesized
aaagcaaagaatttttgtagca

SEQ ID NO: 893644 - DNA, 22 bp, Artificial Sequence
  chemically synthesized
taaagcaaagaatttttgtagc

SEQ ID NO: 893645 - DNA, 22 bp, Artificial Sequence
  chemically synthesized
ttcattaacctgctacaaaaat

SEQ ID NO: 893646 - DNA, 22 bp, Artificial Sequence
  chemically synthesized
tttaaagcaaagaatttttgta

SEQ ID NO: 893647 - DNA, 22 bp, Artificial Sequence
  chemically synthesized
ctttaaagcaaagaatttttgt

SEQ ID NO: 893648 - DNA, 22 bp, Artificial Sequence
  chemically synthesized
attaacctgctacaaaaattct

SEQ ID NO: 893649 - DNA, 22 bp, Artificial Sequence
  chemically synthesized
gtttctttaaagcaaagaattt

SEQ ID NO: 893650 - DNA, 22 bp, Artificial Sequence
  chemically synthesized
acctgctacaaaaattctttgc

SEQ ID NO: 893651 - DNA, 22 bp, Artificial Sequence
  chemically synthesized
ctacaaaaattctttgctttaa

SEQ ID NO: 893652 - DNA, 22 bp, Artificial Sequence
  chemically synthesized
caaaaattctttgctttaaaga

SEQ ID NO: 893653 - DNA, 22 bp, Artificial Sequence
  chemically synthesized
caaaaaggtattagtttcttta

SEQ ID NO: 893654 - DNA, 22 bp, Artificial Sequence
  chemically synthesized
tttgctttaaagaaactaatac

SEQ ID NO: 893655 - DNA, 22 bp, Artificial Sequence
  chemically synthesized
aaattccaaaaaggtattagtt

SEQ ID NO: 893656 - DNA, 22 bp, Artificial Sequence
  chemically synthesized
tgctttaaagaaactaatacct

SEQ ID NO: 893657 - DNA, 22 bp, Artificial Sequence
  chemically synthesized
gaaattccaaaaaggtattagt

SEQ ID NO: 893658 - DNA, 22 bp, Artificial Sequence
  chemically synthesized
gctttaaagaaactaatacctt

SEQ ID NO: 893659 - DNA, 22 bp, Artificial Sequence
  chemically synthesized
tgaaattccaaaaaggtattag

SEQ ID NO: 893660 - DNA, 22 bp, Artificial Sequence
  chemically synthesized
ctttaaagaaactaataccttt

SEQ ID NO: 893661 - DNA, 22 bp, Artificial Sequence
  chemically synthesized
taaagaaactaatacctttttg

SEQ ID NO: 893662 - DNA, 22 bp, Artificial Sequence
  chemically synthesized
aaagaaactaatacctttttgg

SEQ ID NO: 893663 - DNA, 22 bp, Artificial Sequence
  chemically synthesized
aagaaactaatacctttttgga

SEQ ID NO: 893664 - DNA, 22 bp, Artificial Sequence
  chemically synthesized
atacctttttggaatttcaaaa

SEQ ID NO: 893665 - DNA, 22 bp, Artificial Sequence
  chemically synthesized
tgtaaggtgtgtgttttgaaat

SEQ ID NO: 893666 - DNA, 22 bp, Artificial Sequence
  chemically synthesized
gtgtaaggtgtgtgttttgaaa

SEQ ID NO: 893667 - DNA, 22 bp, Artificial Sequence
  chemically synthesized
tgtgtaaggtgtgtgttttgaa

SEQ ID NO: 893668 - DNA, 22 bp, Artificial Sequence
  chemically synthesized
tttggaatttcaaaacacacac

SEQ ID NO: 893669 - DNA, 22 bp, Artificial Sequence
  chemically synthesized
ttggaatttcaaaacacacacc

SEQ ID NO: 893670 - DNA, 22 bp, Artificial Sequence
  chemically synthesized
tggaatttcaaaacacacacct

SEQ ID NO: 893671 - DNA, 22 bp, Artificial Sequence
  chemically synthesized
tgcctttgtgtaaggtgtgtgt

SEQ ID NO: 893672 - DNA, 22 bp, Artificial Sequence
  chemically synthesized
ggaatttcaaaacacacacctt

SEQ ID NO: 893673 - DNA, 22 bp, Artificial Sequence
  chemically synthesized
gaatttcaaaacacacacctta

SEQ ID NO: 893674 - DNA, 22 bp, Artificial Sequence
  chemically synthesized
gctatgcctttgtgtaaggtgt

SEQ ID NO: 893675 - DNA, 22 bp, Artificial Sequence
  chemically synthesized
caaaacacacaccttacacaaa

SEQ ID NO: 893676 - DNA, 22 bp, Artificial Sequence
  chemically synthesized
aaaacacacaccttacacaaag

SEQ ID NO: 893677 - DNA, 22 bp, Artificial Sequence
  chemically synthesized
cagttggctatgcctttgtgta

SEQ ID NO: 893678 - DNA, 22 bp, Artificial Sequence
  chemically synthesized
tcagttgcagttggctatgcct

SEQ ID NO: 893679 - DNA, 22 bp, Artificial Sequence
  chemically synthesized
atcagttgcagttggctatgcc

SEQ ID NO: 893680 - DNA, 22 bp, Artificial Sequence
  chemically synthesized
tatcagttgcagttggctatgc

SEQ ID NO: 893681 - DNA, 22 bp, Artificial Sequence
  chemically synthesized
ctttatcagttgcagttggcta

SEQ ID NO: 893682 - DNA, 22 bp, Artificial Sequence
  chemically synthesized
acacaaaggcatagccaactgc

SEQ ID NO: 893683 - DNA, 22 bp, Artificial Sequence
  chemically synthesized
actttatcagttgcagttggct

SEQ ID NO: 893684 - DNA, 22 bp, Artificial Sequence
  chemically synthesized
cacaaaggcatagccaactgca

SEQ ID NO: 893685 - DNA, 22 bp, Artificial Sequence
  chemically synthesized
tactttatcagttgcagttggc

SEQ ID NO: 893686 - DNA, 22 bp, Artificial Sequence
  chemically synthesized
tttactttatcagttgcagttg

SEQ ID NO: 893687 - DNA, 22 bp, Artificial Sequence
  chemically synthesized
ctttactttatcagttgcagtt

SEQ ID NO: 893688 - DNA, 22 bp, Artificial Sequence
  chemically synthesized
caactgataaagtaaagaaata

SEQ ID NO: 893689 - DNA, 22 bp, Artificial Sequence
  chemically synthesized
ataaagtaaagaaatacatctt

SEQ ID NO: 893690 - DNA, 22 bp, Artificial Sequence
  chemically synthesized
agtgaataaatgaaagatgtat

SEQ ID NO: 893691 - DNA, 22 bp, Artificial Sequence
  chemically synthesized
gtaactgagtgaataaatgaaa

SEQ ID NO: 893692 - DNA, 22 bp, Artificial Sequence
  chemically synthesized
agtaactgagtgaataaatgaa

SEQ ID NO: 893693 - DNA, 22 bp, Artificial Sequence
  chemically synthesized
tcatttattcactcagttacta

SEQ ID NO: 893694 - DNA, 22 bp, Artificial Sequence
  chemically synthesized
catttattcactcagttactaa

SEQ ID NO: 893695 - DNA, 22 bp, Artificial Sequence
  chemically synthesized
atttattcactcagttactaaa

SEQ ID NO: 893696 - DNA, 22 bp, Artificial Sequence
  chemically synthesized
attcactcagttactaaatata

SEQ ID NO: 893697 - DNA, 22 bp, Artificial Sequence
  chemically synthesized
ttcactcagttactaaatatac

SEQ ID NO: 893698 - DNA, 22 bp, Artificial Sequence
  chemically synthesized
actcagttactaaatatactgg

SEQ ID NO: 893699 - DNA, 22 bp, Artificial Sequence
  chemically synthesized
agttactaaatatactggtgtg

SEQ ID NO: 893700 - DNA, 22 bp, Artificial Sequence
  chemically synthesized
ctaaatatactggtgtgttgtg

SEQ ID NO: 893701 - DNA, 22 bp, Artificial Sequence
  chemically synthesized
aatatactggtgtgttgtgtat

SEQ ID NO: 893702 - DNA, 22 bp, Artificial Sequence
  chemically synthesized
gtgtgttgtgtattatatgcca

SEQ ID NO: 893703 - DNA, 22 bp, Artificial Sequence
  chemically synthesized
caaaggaagcgcgtatggcata

SEQ ID NO: 893704 - DNA, 22 bp, Artificial Sequence
  chemically synthesized
tgtattatatgccatacgcgct

SEQ ID NO: 893705 - DNA, 22 bp, Artificial Sequence
  chemically synthesized
taactgcaaaggaagcgcgtat

SEQ ID NO: 893706 - DNA, 22 bp, Artificial Sequence
  chemically synthesized
ataactgcaaaggaagcgcgta

SEQ ID NO: 893707 - DNA, 22 bp, Artificial Sequence
  chemically synthesized
tataactgcaaaggaagcgcgt

SEQ ID NO: 893708 - DNA, 22 bp, Artificial Sequence
  chemically synthesized
ttataactgcaaaggaagcgcg

SEQ ID NO: 893709 - DNA, 22 bp, Artificial Sequence
  chemically synthesized
tatgccatacgcgcttcctttg

SEQ ID NO: 893710 - DNA, 22 bp, Artificial Sequence
  chemically synthesized
atttttataactgcaaaggaag

SEQ ID NO: 893711 - DNA, 22 bp, Artificial Sequence
  chemically synthesized
ttcatttttataactgcaaagg

SEQ ID NO: 893712 - DNA, 22 bp, Artificial Sequence
  chemically synthesized
attcatttttataactgcaaag

SEQ ID NO: 893713 - DNA, 22 bp, Artificial Sequence
  chemically synthesized
gcttattcatttttataactgc

SEQ ID NO: 893714 - DNA, 22 bp, Artificial Sequence
  chemically synthesized
ggcttattcatttttataactg

SEQ ID NO: 893715 - DNA, 22 bp, Artificial Sequence
  chemically synthesized
cctttgcagttataaaaatgaa

SEQ ID NO: 893716 - DNA, 22 bp, Artificial Sequence
  chemically synthesized
ctttgcagttataaaaatgaat

SEQ ID NO: 893717 - DNA, 22 bp, Artificial Sequence
  chemically synthesized
aataacttggcttattcatttt

SEQ ID NO: 893718 - DNA, 22 bp, Artificial Sequence
  chemically synthesized
tgcagttataaaaatgaataag

SEQ ID NO: 893719 - DNA, 22 bp, Artificial Sequence
  chemically synthesized
gcagttataaaaatgaataagc

SEQ ID NO: 893720 - DNA, 22 bp, Artificial Sequence
  chemically synthesized
cagttataaaaatgaataagcc

SEQ ID NO: 893721 - DNA, 22 bp, Artificial Sequence
  chemically synthesized
atgctgaataacttggcttatt

SEQ ID NO: 893722 - DNA, 22 bp, Artificial Sequence
  chemically synthesized
taaaaatgaataagccaagtta

SEQ ID NO: 893723 - DNA, 22 bp, Artificial Sequence
  chemically synthesized
gtgctaatgctgaataacttgg

SEQ ID NO: 893724 - DNA, 22 bp, Artificial Sequence
  chemically synthesized
tatatctggtgctaatgctgaa

SEQ ID NO: 893725 - DNA, 22 bp, Artificial Sequence
  chemically synthesized
tgttatatatctggtgctaatg

SEQ ID NO: 893726 - DNA, 22 bp, Artificial Sequence
  chemically synthesized
ttcagcattagcaccagatata

SEQ ID NO: 893727 - DNA, 22 bp, Artificial Sequence
  chemically synthesized
gaagacctgtgttatatatctg

SEQ ID NO: 893728 - DNA, 22 bp, Artificial Sequence
  chemically synthesized
agcattagcaccagatatataa

SEQ ID NO: 893729 - DNA, 22 bp, Artificial Sequence
  chemically synthesized
agaagacctgtgttatatatct

SEQ ID NO: 893730 - DNA, 22 bp, Artificial Sequence
  chemically synthesized
ggatttagaagacctgtgttat

SEQ ID NO: 893731 - DNA, 22 bp, Artificial Sequence
  chemically synthesized
gcaccagatatataacacaggt

SEQ ID NO: 893732 - DNA, 22 bp, Artificial Sequence
  chemically synthesized
gggatttagaagacctgtgtta

SEQ ID NO: 893733 - DNA, 22 bp, Artificial Sequence
  chemically synthesized
atttgggatttagaagacctgt

SEQ ID NO: 893734 - DNA, 22 bp, Artificial Sequence
  chemically synthesized
aataaaaatcactcatttggga

SEQ ID NO: 893735 - DNA, 22 bp, Artificial Sequence
  chemically synthesized
ctaaatcccaaatgagtgattt

SEQ ID NO: 893736 - DNA, 22 bp, Artificial Sequence
  chemically synthesized
taaatcccaaatgagtgatttt

SEQ ID NO: 893737 - DNA, 22 bp, Artificial Sequence
  chemically synthesized
aatcccaaatgagtgattttta

SEQ ID NO: 893738 - DNA, 22 bp, Artificial Sequence
  chemically synthesized
ggatgcgcattgaataaaaatc

SEQ ID NO: 893739 - DNA, 22 bp, Artificial Sequence
  chemically synthesized
aggatgcgcattgaataaaaat

SEQ ID NO: 893740 - DNA, 22 bp, Artificial Sequence
  chemically synthesized
taggatgcgcattgaataaaaa

SEQ ID NO: 893741 - DNA, 22 bp, Artificial Sequence
  chemically synthesized
attttaggatgcgcattgaata

SEQ ID NO: 893742 - DNA, 22 bp, Artificial Sequence
  chemically synthesized
aattttaggatgcgcattgaat

SEQ ID NO: 893743 - DNA, 22 bp, Artificial Sequence
  chemically synthesized
taattttaggatgcgcattgaa

SEQ ID NO: 893744 - DNA, 22 bp, Artificial Sequence
  chemically synthesized
gttttaattttaggatgcgcat

SEQ ID NO: 893745 - DNA, 22 bp, Artificial Sequence
  chemically synthesized
ggttttaattttaggatgcgca

SEQ ID NO: 893746 - DNA, 22 bp, Artificial Sequence
  chemically synthesized
ttattcaatgcgcatcctaaaa

SEQ ID NO: 893747 - DNA, 22 bp, Artificial Sequence
  chemically synthesized
gtttggttttaattttaggatg

SEQ ID NO: 893748 - DNA, 22 bp, Artificial Sequence
  chemically synthesized
tattcaatgcgcatcctaaaat

SEQ ID NO: 893749 - DNA, 22 bp, Artificial Sequence
  chemically synthesized
attcaatgcgcatcctaaaatt

SEQ ID NO: 893750 - DNA, 22 bp, Artificial Sequence
  chemically synthesized
ttcaatgcgcatcctaaaatta

SEQ ID NO: 893751 - DNA, 22 bp, Artificial Sequence
  chemically synthesized
aatgcgcatcctaaaattaaaa

SEQ ID NO: 893752 - DNA, 22 bp, Artificial Sequence
  chemically synthesized
tagttggtttggttttaatttt

SEQ ID NO: 893753 - DNA, 22 bp, Artificial Sequence
  chemically synthesized
aaattaaaaccaaaccaactat

SEQ ID NO: 893754 - DNA, 22 bp, Artificial Sequence
  chemically synthesized
tacaaacaaaattatagttggt

SEQ ID NO: 893755 - DNA, 22 bp, Artificial Sequence
  chemically synthesized
ctatacaaacaaaattatagtt

SEQ ID NO: 893756 - DNA, 22 bp, Artificial Sequence
  chemically synthesized
aaaccaaaccaactataatttt

SEQ ID NO: 893757 - DNA, 22 bp, Artificial Sequence
  chemically synthesized
taattttgtttgtatagcaatc

SEQ ID NO: 893758 - DNA, 22 bp, Artificial Sequence
  chemically synthesized
tgtttgtatagcaatcatttct

SEQ ID NO: 893759 - DNA, 22 bp, Artificial Sequence
  chemically synthesized
gtttgtatagcaatcatttctt

SEQ ID NO: 893760 - DNA, 22 bp, Artificial Sequence
  chemically synthesized
tttgtatagcaatcatttcttc

SEQ ID NO: 893761 - DNA, 22 bp, Artificial Sequence
  chemically synthesized
gtatagcaatcatttcttctac

SEQ ID NO: 893762 - DNA, 22 bp, Artificial Sequence
  chemically synthesized
gaagcaagtatagtagaagaaa

SEQ ID NO: 893763 - DNA, 22 bp, Artificial Sequence
  chemically synthesized
tatagcaatcatttcttctact

SEQ ID NO: 893764 - DNA, 22 bp, Artificial Sequence
  chemically synthesized
cttctactatacttgcttctag

SEQ ID NO: 893765 - DNA, 22 bp, Artificial Sequence
  chemically synthesized
ttctactatacttgcttctagc

SEQ ID NO: 893766 - DNA, 22 bp, Artificial Sequence
  chemically synthesized
ctactatacttgcttctagctt

SEQ ID NO: 893767 - DNA, 22 bp, Artificial Sequence
  chemically synthesized
tactatacttgcttctagcttt

SEQ ID NO: 893768 - DNA, 22 bp, Artificial Sequence
  chemically synthesized
catgacataaaagaaagctaga

SEQ ID NO: 893769 - DNA, 22 bp, Artificial Sequence
  chemically synthesized
ctatacttgcttctagctttct

SEQ ID NO: 893770 - DNA, 22 bp, Artificial Sequence
  chemically synthesized
ccatgacataaaagaaagctag

SEQ ID NO: 893771 - DNA, 22 bp, Artificial Sequence
  chemically synthesized
tacttgcttctagctttctttt

SEQ ID NO: 893772 - DNA, 22 bp, Artificial Sequence
  chemically synthesized
caatcttccatgacataaaaga

SEQ ID NO: 893773 - DNA, 22 bp, Artificial Sequence
  chemically synthesized
gcttctagctttcttttatgtc

SEQ ID NO: 893774 - DNA, 22 bp, Artificial Sequence
  chemically synthesized
acaatcttccatgacataaaag

SEQ ID NO: 893775 - DNA, 22 bp, Artificial Sequence
  chemically synthesized
cttctagctttcttttatgtca

SEQ ID NO: 893776 - DNA, 22 bp, Artificial Sequence
  chemically synthesized
tacaatcttccatgacataaaa

SEQ ID NO: 893777 - DNA, 22 bp, Artificial Sequence
  chemically synthesized
ttacaatcttccatgacataaa

SEQ ID NO: 893778 - DNA, 22 bp, Artificial Sequence
  chemically synthesized
ctagctttcttttatgtcatgg

SEQ ID NO: 893779 - DNA, 22 bp, Artificial Sequence
  chemically synthesized
tagctttcttttatgtcatgga

SEQ ID NO: 893780 - DNA, 22 bp, Artificial Sequence
  chemically synthesized
cttttacaatcttccatgacat

SEQ ID NO: 893781 - DNA, 22 bp, Artificial Sequence
  chemically synthesized
ccttttacaatcttccatgaca

SEQ ID NO: 893782 - DNA, 22 bp, Artificial Sequence
  chemically synthesized
gctttcttttatgtcatggaag

SEQ ID NO: 893783 - DNA, 22 bp, Artificial Sequence
  chemically synthesized
tcttttatgtcatggaagattg

SEQ ID NO: 893784 - DNA, 22 bp, Artificial Sequence
  chemically synthesized
cttttatgtcatggaagattgt

SEQ ID NO: 893785 - DNA, 22 bp, Artificial Sequence
  chemically synthesized
ttttatgtcatggaagattgta

SEQ ID NO: 893786 - DNA, 22 bp, Artificial Sequence
  chemically synthesized
ttatgtcatggaagattgtaaa

SEQ ID NO: 893787 - DNA, 22 bp, Artificial Sequence
  chemically synthesized
tatgtcatggaagattgtaaaa

SEQ ID NO: 893788 - DNA, 22 bp, Artificial Sequence
  chemically synthesized
atgtcatggaagattgtaaaag

SEQ ID NO: 893789 - DNA, 22 bp, Artificial Sequence
  chemically synthesized
tgtcatggaagattgtaaaagg

SEQ ID NO: 893790 - DNA, 22 bp, Artificial Sequence
  chemically synthesized
tacatgaagggacttcctttta

SEQ ID NO: 893791 - DNA, 22 bp, Artificial Sequence
  chemically synthesized
gtacatgaagggacttcctttt

SEQ ID NO: 893792 - DNA, 22 bp, Artificial Sequence
  chemically synthesized
cttgtacatgaagggacttcct

SEQ ID NO: 893793 - DNA, 22 bp, Artificial Sequence
  chemically synthesized
ccttgtacatgaagggacttcc

SEQ ID NO: 893794 - DNA, 22 bp, Artificial Sequence
  chemically synthesized
tccttgtacatgaagggacttc

SEQ ID NO: 893795 - DNA, 22 bp, Artificial Sequence
  chemically synthesized
taaaaggaagtcccttcatgta

SEQ ID NO: 893796 - DNA, 22 bp, Artificial Sequence
  chemically synthesized
ccaattttccttgtacatgaag

SEQ ID NO: 893797 - DNA, 22 bp, Artificial Sequence
  chemically synthesized
accaattttccttgtacatgaa

SEQ ID NO: 893798 - DNA, 22 bp, Artificial Sequence
  chemically synthesized
catgtacaaggaaaattggtaa

SEQ ID NO: 893799 - DNA, 22 bp, Artificial Sequence
  chemically synthesized
atgtacaaggaaaattggtaag

SEQ ID NO: 893800 - DNA, 22 bp, Artificial Sequence
  chemically synthesized
acaaaaacgcataacttaccaa

SEQ ID NO: 893801 - DNA, 22 bp, Artificial Sequence
  chemically synthesized
tagctcacaaaaacgcataact

SEQ ID NO: 893802 - DNA, 22 bp, Artificial Sequence
  chemically synthesized
acaaactatagctcacaaaaac

SEQ ID NO: 893803 - DNA, 22 bp, Artificial Sequence
  chemically synthesized
gtaagttatgcgtttttgtgag

SEQ ID NO: 893804 - DNA, 22 bp, Artificial Sequence
  chemically synthesized
ggactcacaaactatagctcac

SEQ ID NO: 893805 - DNA, 22 bp, Artificial Sequence
  chemically synthesized
tgcgtttttgtgagctatagtt

SEQ ID NO: 893806 - DNA, 22 bp, Artificial Sequence
  chemically synthesized
ctaggactcacaaactatagct

SEQ ID NO: 893807 - DNA, 22 bp, Artificial Sequence
  chemically synthesized
actaggactcacaaactatagc

SEQ ID NO: 893808 - DNA, 22 bp, Artificial Sequence
  chemically synthesized
tttactaggactcacaaactat

SEQ ID NO: 893809 - DNA, 22 bp, Artificial Sequence
  chemically synthesized
tgtttactaggactcacaaact

SEQ ID NO: 893810 - DNA, 22 bp, Artificial Sequence
  chemically synthesized
ttgtgagctatagtttgtgagt

SEQ ID NO: 893811 - DNA, 22 bp, Artificial Sequence
  chemically synthesized
ctgtttactaggactcacaaac

SEQ ID NO: 893812 - DNA, 22 bp, Artificial Sequence
  chemically synthesized
tgtgagctatagtttgtgagtc

SEQ ID NO: 893813 - DNA, 22 bp, Artificial Sequence
  chemically synthesized
gtgagctatagtttgtgagtcc

SEQ ID NO: 893814 - DNA, 22 bp, Artificial Sequence
  chemically synthesized
tgagctatagtttgtgagtcct

SEQ ID NO: 893815 - DNA, 22 bp, Artificial Sequence
  chemically synthesized
cttctgtttactaggactcaca

SEQ ID NO: 893816 - DNA, 22 bp, Artificial Sequence
  chemically synthesized
tagtttgtgagtcctagtaaac

SEQ ID NO: 893817 - DNA, 22 bp, Artificial Sequence
  chemically synthesized
aaccacctgcttctgtttacta

SEQ ID NO: 893818 - DNA, 22 bp, Artificial Sequence
  chemically synthesized
gtgagtcctagtaaacagaagc

SEQ ID NO: 893819 - DNA, 22 bp, Artificial Sequence
  chemically synthesized
tgagtcctagtaaacagaagca

SEQ ID NO: 893820 - DNA, 22 bp, Artificial Sequence
  chemically synthesized
atctcaaccacctgcttctgtt

SEQ ID NO: 893821 - DNA, 22 bp, Artificial Sequence
  chemically synthesized
tcatctcaaccacctgcttctg

SEQ ID NO: 893822 - DNA, 22 bp, Artificial Sequence
  chemically synthesized
ctcatctcaaccacctgcttct

SEQ ID NO: 893823 - DNA, 22 bp, Artificial Sequence
  chemically synthesized
cttctcatctcaaccacctgct

SEQ ID NO: 893824 - DNA, 22 bp, Artificial Sequence
  chemically synthesized
acttctcatctcaaccacctgc

SEQ ID NO: 893825 - DNA, 22 bp, Artificial Sequence
  chemically synthesized
tacttctcatctcaaccacctg

SEQ ID NO: 893826 - DNA, 22 bp, Artificial Sequence
  chemically synthesized
gtaaacagaagcaggtggttga

SEQ ID NO: 893827 - DNA, 22 bp, Artificial Sequence
  chemically synthesized
ttacttctcatctcaaccacct

SEQ ID NO: 893828 - DNA, 22 bp, Artificial Sequence
  chemically synthesized
tttacttctcatctcaaccacc

SEQ ID NO: 893829 - DNA, 22 bp, Artificial Sequence
  chemically synthesized
tttttacttctcatctcaacca

SEQ ID NO: 893830 - DNA, 22 bp, Artificial Sequence
  chemically synthesized
atccaaatgttctttttacttc

SEQ ID NO: 893831 - DNA, 22 bp, Artificial Sequence
  chemically synthesized
taatccaaatgttctttttact

SEQ ID NO: 893832 - DNA, 22 bp, Artificial Sequence
  chemically synthesized
ctctaatccaaatgttcttttt

SEQ ID NO: 893833 - DNA, 22 bp, Artificial Sequence
  chemically synthesized
agatgagaagtaaaaagaacat

SEQ ID NO: 893834 - DNA, 22 bp, Artificial Sequence
  chemically synthesized
cagtctactctaatccaaatgt

SEQ ID NO: 893835 - DNA, 22 bp, Artificial Sequence
  chemically synthesized
ttacagtctactctaatccaaa

SEQ ID NO: 893836 - DNA, 22 bp, Artificial Sequence
  chemically synthesized
tgttacagtctactctaatcca

SEQ ID NO: 893837 - DNA, 22 bp, Artificial Sequence
  chemically synthesized
taatcattctgttacagtctac

SEQ ID NO: 893838 - DNA, 22 bp, Artificial Sequence
  chemically synthesized
ggattagagtagactgtaacag

SEQ ID NO: 893839 - DNA, 22 bp, Artificial Sequence
  chemically synthesized
gattagagtagactgtaacaga

SEQ ID NO: 893840 - DNA, 22 bp, Artificial Sequence
  chemically synthesized
gagtagactgtaacagaatgat

SEQ ID NO: 893841 - DNA, 22 bp, Artificial Sequence
  chemically synthesized
ataaaaataacctataatcatt

SEQ ID NO: 893842 - DNA, 22 bp, Artificial Sequence
  chemically synthesized
aataaaaataacctataatcat

SEQ ID NO: 893843 - DNA, 22 bp, Artificial Sequence
  chemically synthesized
ttaataaaaataacctataatc

SEQ ID NO: 893844 - DNA, 22 bp, Artificial Sequence
  chemically synthesized
taacagaatgattataggttat

SEQ ID NO: 893845 - DNA, 22 bp, Artificial Sequence
  chemically synthesized
atctcttaataaaaataaccta

SEQ ID NO: 893846 - DNA, 22 bp, Artificial Sequence
  chemically synthesized
gcatatactgatctcttaataa

SEQ ID NO: 893847 - DNA, 22 bp, Artificial Sequence
  chemically synthesized
taggttatttttattaagagat

SEQ ID NO: 893848 - DNA, 22 bp, Artificial Sequence
  chemically synthesized
tttttattaagagatcagtata

SEQ ID NO: 893849 - DNA, 22 bp, Artificial Sequence
  chemically synthesized
ttattaagagatcagtatatgc

SEQ ID NO: 893850 - DNA, 22 bp, Artificial Sequence
  chemically synthesized
tattaagagatcagtatatgcc

SEQ ID NO: 893851 - DNA, 22 bp, Artificial Sequence
  chemically synthesized
attaagagatcagtatatgcca

SEQ ID NO: 893852 - DNA, 22 bp, Artificial Sequence
  chemically synthesized
ttaagagatcagtatatgccaa

SEQ ID NO: 893853 - DNA, 22 bp, Artificial Sequence
  chemically synthesized
caaggatgatggttggcatata

SEQ ID NO: 893854 - DNA, 22 bp, Artificial Sequence
  chemically synthesized
ccaaggatgatggttggcatat

SEQ ID NO: 893855 - DNA, 22 bp, Artificial Sequence
  chemically synthesized
agagatcagtatatgccaacca

SEQ ID NO: 893856 - DNA, 22 bp, Artificial Sequence
  chemically synthesized
caaatgtgaaacttccaaggat

SEQ ID NO: 893857 - DNA, 22 bp, Artificial Sequence
  chemically synthesized
aggaagtctacaaatgtgaaac

SEQ ID NO: 893858 - DNA, 22 bp, Artificial Sequence
  chemically synthesized
ggaagtttcacatttgtagact

SEQ ID NO: 893859 - DNA, 22 bp, Artificial Sequence
  chemically synthesized
gaagtttcacatttgtagactt

SEQ ID NO: 893860 - DNA, 22 bp, Artificial Sequence
  chemically synthesized
gatggattaaggaagtctacaa

SEQ ID NO: 893861 - DNA, 22 bp, Artificial Sequence
  chemically synthesized
ttggatggattaaggaagtcta

SEQ ID NO: 893862 - DNA, 22 bp, Artificial Sequence
  chemically synthesized
cacatttgtagacttccttaat

SEQ ID NO: 893863 - DNA, 22 bp, Artificial Sequence
  chemically synthesized
acatttgtagacttccttaatc

SEQ ID NO: 893864 - DNA, 22 bp, Artificial Sequence
  chemically synthesized
gtagacttccttaatccatcca

SEQ ID NO: 893865 - DNA, 22 bp, Artificial Sequence
  chemically synthesized
tagacttccttaatccatccaa

SEQ ID NO: 893866 - DNA, 22 bp, Artificial Sequence
  chemically synthesized
tgtcgtagcattgttggatgga

SEQ ID NO: 893867 - DNA, 22 bp, Artificial Sequence
  chemically synthesized
ccttaatccatccaacaatgct

SEQ ID NO: 893868 - DNA, 22 bp, Artificial Sequence
  chemically synthesized
cttaatccatccaacaatgcta

SEQ ID NO: 893869 - DNA, 22 bp, Artificial Sequence
  chemically synthesized
aatccatccaacaatgctacga

SEQ ID NO: 893870 - DNA, 22 bp, Artificial Sequence
  chemically synthesized
atccatccaacaatgctacgac

SEQ ID NO: 893871 - DNA, 22 bp, Artificial Sequence
  chemically synthesized
cgacatagatattattatgatc

SEQ ID NO: 893872 - DNA, 22 bp, Artificial Sequence
  chemically synthesized
ttatgatcccactatcacacat

SEQ ID NO: 893873 - DNA, 22 bp, Artificial Sequence
  chemically synthesized
tgatcccactatcacacatggg

SEQ ID NO: 893874 - DNA, 22 bp, Artificial Sequence
  chemically synthesized
aaccccaacgtcatcacccatg

SEQ ID NO: 893875 - DNA, 22 bp, Artificial Sequence
  chemically synthesized
caaccccaacgtcatcacccat

SEQ ID NO: 893876 - DNA, 22 bp, Artificial Sequence
  chemically synthesized
tcaaccccaacgtcatcaccca

SEQ ID NO: 893877 - DNA, 22 bp, Artificial Sequence
  chemically synthesized
ttcaaccccaacgtcatcaccc

SEQ ID NO: 893878 - DNA, 22 bp, Artificial Sequence
  chemically synthesized
tttcaaccccaacgtcatcacc

SEQ ID NO: 893879 - DNA, 22 bp, Artificial Sequence
  chemically synthesized
ttttcaaccccaacgtcatcac

SEQ ID NO: 893880 - DNA, 22 bp, Artificial Sequence
  chemically synthesized
tcacacatgggtgatgacgttg

SEQ ID NO: 893881 - DNA, 22 bp, Artificial Sequence
  chemically synthesized
atgtttttttcaaccccaacgt

SEQ ID NO: 893882 - DNA, 22 bp, Artificial Sequence
  chemically synthesized
aatgtttttttcaaccccaacg

SEQ ID NO: 893883 - DNA, 22 bp, Artificial Sequence
  chemically synthesized
tttaatgtttttttcaacccca

SEQ ID NO: 893884 - DNA, 22 bp, Artificial Sequence
  chemically synthesized
acctatttaatgtttttttcaa

SEQ ID NO: 893885 - DNA, 22 bp, Artificial Sequence
  chemically synthesized
ctaacctatttaatgttttttt

SEQ ID NO: 893886 - DNA, 22 bp, Artificial Sequence
  chemically synthesized
cctaacctatttaatgtttttt

SEQ ID NO: 893887 - DNA, 22 bp, Artificial Sequence
  chemically synthesized
cttcctaacctatttaatgttt

SEQ ID NO: 893888 - DNA, 22 bp, Artificial Sequence
  chemically synthesized
gggttgaaaaaaacattaaata

SEQ ID NO: 893889 - DNA, 22 bp, Artificial Sequence
  chemically synthesized
aaaaaaacattaaataggttag

SEQ ID NO: 893890 - DNA, 22 bp, Artificial Sequence
  chemically synthesized
ataccatgtcatgctgcttcct

SEQ ID NO: 893891 - DNA, 22 bp, Artificial Sequence
  chemically synthesized
aataccatgtcatgctgcttcc

SEQ ID NO: 893892 - DNA, 22 bp, Artificial Sequence
  chemically synthesized
aataggttaggaagcagcatga

SEQ ID NO: 893893 - DNA, 22 bp, Artificial Sequence
  chemically synthesized
acaatgcttaataccatgtcat

SEQ ID NO: 893894 - DNA, 22 bp, Artificial Sequence
  chemically synthesized
ggaagcagcatgacatggtatt

SEQ ID NO: 893895 - DNA, 22 bp, Artificial Sequence
  chemically synthesized
gacctcacaatgcttaatacca

SEQ ID NO: 893896 - DNA, 22 bp, Artificial Sequence
  chemically synthesized
tagacctcacaatgcttaatac

SEQ ID NO: 893897 - DNA, 22 bp, Artificial Sequence
  chemically synthesized
actctagacctcacaatgctta

SEQ ID NO: 893898 - DNA, 22 bp, Artificial Sequence
  chemically synthesized
agcattgtgaggtctagagtta

SEQ ID NO: 893899 - DNA, 22 bp, Artificial Sequence
  chemically synthesized
aaatccaagtggcctaactcta

SEQ ID NO: 893900 - DNA, 22 bp, Artificial Sequence
  chemically synthesized
tgaggtctagagttaggccact

SEQ ID NO: 893901 - DNA, 22 bp, Artificial Sequence
  chemically synthesized
gaaccagaattgaaatccaagt

SEQ ID NO: 893902 - DNA, 22 bp, Artificial Sequence
  chemically synthesized
gagttaggccacttggatttca

SEQ ID NO: 893903 - DNA, 22 bp, Artificial Sequence
  chemically synthesized
ggccacttggatttcaattctg

SEQ ID NO: 893904 - DNA, 22 bp, Artificial Sequence
  chemically synthesized
ggcaagaactagaaccagaatt

SEQ ID NO: 893905 - DNA, 22 bp, Artificial Sequence
  chemically synthesized
ggatttcaattctggttctagt

SEQ ID NO: 893906 - DNA, 22 bp, Artificial Sequence
  chemically synthesized
gatttcaattctggttctagtt

SEQ ID NO: 893907 - DNA, 22 bp, Artificial Sequence
  chemically synthesized
aaatgttaggcaagaactagaa

SEQ ID NO: 893908 - DNA, 22 bp, Artificial Sequence
  chemically synthesized
caattctggttctagttcttgc

SEQ ID NO: 893909 - DNA, 22 bp, Artificial Sequence
  chemically synthesized
aattctggttctagttcttgcc

SEQ ID NO: 893910 - DNA, 22 bp, Artificial Sequence
  chemically synthesized
gctaaaatgttaggcaagaact

SEQ ID NO: 893911 - DNA, 22 bp, Artificial Sequence
  chemically synthesized
ggctaaaatgttaggcaagaac

SEQ ID NO: 893912 - DNA, 22 bp, Artificial Sequence
  chemically synthesized
tggttctagttcttgcctaaca

SEQ ID NO: 893913 - DNA, 22 bp, Artificial Sequence
  chemically synthesized
gttctagttcttgcctaacatt

SEQ ID NO: 893914 - DNA, 22 bp, Artificial Sequence
  chemically synthesized
tagttcttgcctaacattttag

SEQ ID NO: 893915 - DNA, 22 bp, Artificial Sequence
  chemically synthesized
gagaaaacttggctaaaatgtt

SEQ ID NO: 893916 - DNA, 22 bp, Artificial Sequence
  chemically synthesized
gttcttgcctaacattttagcc

SEQ ID NO: 893917 - DNA, 22 bp, Artificial Sequence
  chemically synthesized
ttgcctaacattttagccaagt

SEQ ID NO: 893918 - DNA, 22 bp, Artificial Sequence
  chemically synthesized
agagttagagaaaacttggcta

SEQ ID NO: 893919 - DNA, 22 bp, Artificial Sequence
  chemically synthesized
gcctaacattttagccaagttt

SEQ ID NO: 893920 - DNA, 22 bp, Artificial Sequence
  chemically synthesized
cctaacattttagccaagtttt

SEQ ID NO: 893921 - DNA, 22 bp, Artificial Sequence
  chemically synthesized
acattttagccaagttttctct

SEQ ID NO: 893922 - DNA, 22 bp, Artificial Sequence
  chemically synthesized
tagccaagttttctctaactct

SEQ ID NO: 893923 - DNA, 22 bp, Artificial Sequence
  chemically synthesized
agccaagttttctctaactctc

SEQ ID NO: 893924 - DNA, 22 bp, Artificial Sequence
  chemically synthesized
gccaagttttctctaactctca

SEQ ID NO: 893925 - DNA, 22 bp, Artificial Sequence
  chemically synthesized
cagaggaggcattgagagttag

SEQ ID NO: 893926 - DNA, 22 bp, Artificial Sequence
  chemically synthesized
tctctaactctcaatgcctcct

SEQ ID NO: 893927 - DNA, 22 bp, Artificial Sequence
  chemically synthesized
ctctaactctcaatgcctcctc

SEQ ID NO: 893928 - DNA, 22 bp, Artificial Sequence
  chemically synthesized
tctaactctcaatgcctcctct

SEQ ID NO: 893929 - DNA, 22 bp, Artificial Sequence
  chemically synthesized
tccccaatctacagaggaggca

SEQ ID NO: 893930 - DNA, 22 bp, Artificial Sequence
  chemically synthesized
taactctcaatgcctcctctgt

SEQ ID NO: 893931 - DNA, 22 bp, Artificial Sequence
  chemically synthesized
actctcaatgcctcctctgtag

SEQ ID NO: 893932 - DNA, 22 bp, Artificial Sequence
  chemically synthesized
tcattgtccccaatctacagag

SEQ ID NO: 893933 - DNA, 22 bp, Artificial Sequence
  chemically synthesized
tcaatgcctcctctgtagattg

SEQ ID NO: 893934 - DNA, 22 bp, Artificial Sequence
  chemically synthesized
aatgcctcctctgtagattggg

SEQ ID NO: 893935 - DNA, 22 bp, Artificial Sequence
  chemically synthesized
ctctgtagattggggacaatga

SEQ ID NO: 893936 - DNA, 22 bp, Artificial Sequence
  chemically synthesized
tgaagcaggtgctatcattgtc

SEQ ID NO: 893937 - DNA, 22 bp, Artificial Sequence
  chemically synthesized
tgtagattggggacaatgatag

SEQ ID NO: 893938 - DNA, 22 bp, Artificial Sequence
  chemically synthesized
tagattggggacaatgatagca

SEQ ID NO: 893939 - DNA, 22 bp, Artificial Sequence
  chemically synthesized
gggacaatgatagcacctgctt

SEQ ID NO: 893940 - DNA, 22 bp, Artificial Sequence
  chemically synthesized
acagtaatcctatgaagcaggt

SEQ ID NO: 893941 - DNA, 22 bp, Artificial Sequence
  chemically synthesized
agtcctaacagtaatcctatga

SEQ ID NO: 893942 - DNA, 22 bp, Artificial Sequence
  chemically synthesized
ctgagtcctaacagtaatccta

SEQ ID NO: 893943 - DNA, 22 bp, Artificial Sequence
  chemically synthesized
cttcataggattactgttagga

SEQ ID NO: 893944 - DNA, 22 bp, Artificial Sequence
  chemically synthesized
cataggattactgttaggactc

SEQ ID NO: 893945 - DNA, 22 bp, Artificial Sequence
  chemically synthesized
ataggattactgttaggactca

SEQ ID NO: 893946 - DNA, 22 bp, Artificial Sequence
  chemically synthesized
agggatgacgttactgagtcct

SEQ ID NO: 893947 - DNA, 22 bp, Artificial Sequence
  chemically synthesized
ctgttaggactcagtaacgtca

SEQ ID NO: 893948 - DNA, 22 bp, Artificial Sequence
  chemically synthesized
ttaggactcagtaacgtcatcc

SEQ ID NO: 893949 - DNA, 22 bp, Artificial Sequence
  chemically synthesized
aggtatgttcagggatgacgtt

SEQ ID NO: 893950 - DNA, 22 bp, Artificial Sequence
  chemically synthesized
taaggtatgttcagggatgacg

SEQ ID NO: 893951 - DNA, 22 bp, Artificial Sequence
  chemically synthesized
ggactcagtaacgtcatccctg

SEQ ID NO: 893952 - DNA, 22 bp, Artificial Sequence
  chemically synthesized
ctctaaggtatgttcagggatg

SEQ ID NO: 893953 - DNA, 22 bp, Artificial Sequence
  chemically synthesized
agtaacgtcatccctgaacata

SEQ ID NO: 893954 - DNA, 22 bp, Artificial Sequence
  chemically synthesized
tcatgcagagtattgctctaag

SEQ ID NO: 893955 - DNA, 22 bp, Artificial Sequence
  chemically synthesized
attatcatgcagagtattgctc

SEQ ID NO: 893956 - DNA, 22 bp, Artificial Sequence
  chemically synthesized
aacataccttagagcaatactc

SEQ ID NO: 893957 - DNA, 22 bp, Artificial Sequence
  chemically synthesized
tcattcattatcatgcagagta

SEQ ID NO: 893958 - DNA, 22 bp, Artificial Sequence
  chemically synthesized
ttgtcattcattatcatgcaga

SEQ ID NO: 893959 - DNA, 22 bp, Artificial Sequence
  chemically synthesized
attgtcattcattatcatgcag

SEQ ID NO: 893960 - DNA, 22 bp, Artificial Sequence
  chemically synthesized
agagcaatactctgcatgataa

SEQ ID NO: 893961 - DNA, 22 bp, Artificial Sequence
  chemically synthesized
tattgtcattcattatcatgca

SEQ ID NO: 893962 - DNA, 22 bp, Artificial Sequence
  chemically synthesized
gagcaatactctgcatgataat

SEQ ID NO: 893963 - DNA, 22 bp, Artificial Sequence
  chemically synthesized
ataactttattgtcattcatta

SEQ ID NO: 893964 - DNA, 22 bp, Artificial Sequence
  chemically synthesized
aataactttattgtcattcatt

SEQ ID NO: 893965 - DNA, 22 bp, Artificial Sequence
  chemically synthesized
cttaataactttattgtcattc

SEQ ID NO: 893966 - DNA, 22 bp, Artificial Sequence
  chemically synthesized
tgcatgataatgaatgacaata

SEQ ID NO: 893967 - DNA, 22 bp, Artificial Sequence
  chemically synthesized
catgataatgaatgacaataaa

SEQ ID NO: 893968 - DNA, 22 bp, Artificial Sequence
  chemically synthesized
ctacttaataactttattgtca

SEQ ID NO: 893969 - DNA, 22 bp, Artificial Sequence
  chemically synthesized
agcaataatcactgctacttaa

SEQ ID NO: 893970 - DNA, 22 bp, Artificial Sequence
  chemically synthesized
gagcaataatcactgctactta

SEQ ID NO: 893971 - DNA, 22 bp, Artificial Sequence
  chemically synthesized
ttaagtagcagtgattattgct

SEQ ID NO: 893972 - DNA, 22 bp, Artificial Sequence
  chemically synthesized
catgtaagcttgagcaataatc

SEQ ID NO: 893973 - DNA, 22 bp, Artificial Sequence
  chemically synthesized
acatgtaagcttgagcaataat

SEQ ID NO: 893974 - DNA, 22 bp, Artificial Sequence
  chemically synthesized
agtagcagtgattattgctcaa

SEQ ID NO: 893975 - DNA, 22 bp, Artificial Sequence
  chemically synthesized
tttacatgtaagcttgagcaat

SEQ ID NO: 893976 - DNA, 22 bp, Artificial Sequence
  chemically synthesized
atttacatgtaagcttgagcaa

SEQ ID NO: 893977 - DNA, 22 bp, Artificial Sequence
  chemically synthesized
tatttacatgtaagcttgagca

SEQ ID NO: 893978 - DNA, 22 bp, Artificial Sequence
  chemically synthesized
tttatttacatgtaagcttgag

SEQ ID NO: 893979 - DNA, 22 bp, Artificial Sequence
  chemically synthesized
gctctttatttacatgtaagct

SEQ ID NO: 893980 - DNA, 22 bp, Artificial Sequence
  chemically synthesized
ttgctcaagcttacatgtaaat

SEQ ID NO: 893981 - DNA, 22 bp, Artificial Sequence
  chemically synthesized
tcctggctctttatttacatgt

SEQ ID NO: 893982 - DNA, 22 bp, Artificial Sequence
  chemically synthesized
ctcaagcttacatgtaaataaa

SEQ ID NO: 893983 - DNA, 22 bp, Artificial Sequence
  chemically synthesized
aagcttacatgtaaataaagag

SEQ ID NO: 893984 - DNA, 22 bp, Artificial Sequence
  chemically synthesized
agcctatcctggctctttattt

SEQ ID NO: 893985 - DNA, 22 bp, Artificial Sequence
  chemically synthesized
acatgtaaataaagagccagga

SEQ ID NO: 893986 - DNA, 22 bp, Artificial Sequence
  chemically synthesized
catgtaaataaagagccaggat

SEQ ID NO: 893987 - DNA, 22 bp, Artificial Sequence
  chemically synthesized
cagtgctcagcctatcctggct

SEQ ID NO: 893988 - DNA, 22 bp, Artificial Sequence
  chemically synthesized
caggcaagagctacagtgctca

SEQ ID NO: 893989 - DNA, 22 bp, Artificial Sequence
  chemically synthesized
ggattacaggcaagagctacag

SEQ ID NO: 893990 - DNA, 22 bp, Artificial Sequence
  chemically synthesized
agcactgtagctcttgcctgta

SEQ ID NO: 893991 - DNA, 22 bp, Artificial Sequence
  chemically synthesized
ccaaagtgctgggattacaggc

SEQ ID NO: 893992 - DNA, 22 bp, Artificial Sequence
  chemically synthesized
tagctcttgcctgtaatcccag

SEQ ID NO: 893993 - DNA, 22 bp, Artificial Sequence
  chemically synthesized
agcctcccaaagtgctgggatt

SEQ ID NO: 893994 - DNA, 22 bp, Artificial Sequence
  chemically synthesized
ttgcctgtaatcccagcacttt

SEQ ID NO: 893995 - DNA, 22 bp, Artificial Sequence
  chemically synthesized
cctcagcctcccaaagtgctgg

SEQ ID NO: 893996 - DNA, 22 bp, Artificial Sequence
  chemically synthesized
gcctgtaatcccagcactttgg

SEQ ID NO: 893997 - DNA, 22 bp, Artificial Sequence
  chemically synthesized
cctgtaatcccagcactttggg

SEQ ID NO: 893998 - DNA, 22 bp, Artificial Sequence
  chemically synthesized
ctgcctcagcctcccaaagtgc

SEQ ID NO: 893999 - DNA, 22 bp, Artificial Sequence
  chemically synthesized
taatcccagcactttgggaggc

SEQ ID NO: 894000 - DNA, 22 bp, Artificial Sequence
  chemically synthesized
aagcaatcctcctgcctcagcc

SEQ ID NO: 894001 - DNA, 22 bp, Artificial Sequence
  chemically synthesized
ggctcaagcaatcctcctgcct

SEQ ID NO: 894002 - DNA, 22 bp, Artificial Sequence
  chemically synthesized
tgggaggctgaggcaggaggat

SEQ ID NO: 894003 - DNA, 22 bp, Artificial Sequence
  chemically synthesized
gggaggctgaggcaggaggatt

SEQ ID NO: 894004 - DNA, 22 bp, Artificial Sequence
  chemically synthesized
ctgggctcaagcaatcctcctg

SEQ ID NO: 894005 - DNA, 22 bp, Artificial Sequence
  chemically synthesized
ggaggctgaggcaggaggattg

SEQ ID NO: 894006 - DNA, 22 bp, Artificial Sequence
  chemically synthesized
gaactcctgggctcaagcaatc

SEQ ID NO: 894007 - DNA, 22 bp, Artificial Sequence
  chemically synthesized
aggcaggaggattgcttgagcc

SEQ ID NO: 894008 - DNA, 22 bp, Artificial Sequence
  chemically synthesized
gcctcgaactcctgggctcaag

SEQ ID NO: 894009 - DNA, 22 bp, Artificial Sequence
  chemically synthesized
tccaggctggcctcgaactcct

SEQ ID NO: 894010 - DNA, 22 bp, Artificial Sequence
  chemically synthesized
cttgagcccaggagttcgaggc

SEQ ID NO: 894011 - DNA, 22 bp, Artificial Sequence
  chemically synthesized
tgttgtccaggctggcctcgaa

SEQ ID NO: 894012 - DNA, 22 bp, Artificial Sequence
  chemically synthesized
gagcccaggagttcgaggccag

SEQ ID NO: 894013 - DNA, 22 bp, Artificial Sequence
  chemically synthesized
agcccaggagttcgaggccagc

SEQ ID NO: 894014 - DNA, 22 bp, Artificial Sequence
  chemically synthesized
ctatgttgtccaggctggcctc

SEQ ID NO: 894015 - DNA, 22 bp, Artificial Sequence
  chemically synthesized
gaggccagcctggacaacatag

SEQ ID NO: 894016 - DNA, 22 bp, Artificial Sequence
  chemically synthesized
tagagatgggagtgttgctatg

SEQ ID NO: 894017 - DNA, 22 bp, Artificial Sequence
  chemically synthesized
gtagagatgggagtgttgctat

SEQ ID NO: 894018 - DNA, 22 bp, Artificial Sequence
  chemically synthesized
tgtagagatgggagtgttgcta

SEQ ID NO: 894019 - DNA, 22 bp, Artificial Sequence
  chemically synthesized
ttgtagagatgggagtgttgct

SEQ ID NO: 894020 - DNA, 22 bp, Artificial Sequence
  chemically synthesized
tttgtagagatgggagtgttgc

SEQ ID NO: 894021 - DNA, 22 bp, Artificial Sequence
  chemically synthesized
ttttgtagagatgggagtgttg

SEQ ID NO: 894022 - DNA, 22 bp, Artificial Sequence
  chemically synthesized
tttttgtagagatgggagtgtt

SEQ ID NO: 894023 - DNA, 22 bp, Artificial Sequence
  chemically synthesized
gacaacatagcaacactcccat

SEQ ID NO: 894024 - DNA, 22 bp, Artificial Sequence
  chemically synthesized
ttttttgtagagatgggagtgt

SEQ ID NO: 894025 - DNA, 22 bp, Artificial Sequence
  chemically synthesized
tttttttgtagagatgggagtg

SEQ ID NO: 894026 - DNA, 22 bp, Artificial Sequence
  chemically synthesized
ttttttttttgtagagatggga

SEQ ID NO: 894027 - DNA, 22 bp, Artificial Sequence
  chemically synthesized
gttttttttttgtagagatggg

SEQ ID NO: 894028 - DNA, 22 bp, Artificial Sequence
  chemically synthesized
tgttttttttttgtagagatgg

SEQ ID NO: 894029 - DNA, 22 bp, Artificial Sequence
  chemically synthesized
ttgttttttttttgtagagatg

SEQ ID NO: 894030 - DNA, 22 bp, Artificial Sequence
  chemically synthesized
tttgttttttttttgtagagat

SEQ ID NO: 894031 - DNA, 22 bp, Artificial Sequence
  chemically synthesized
ttttgttttttttttgtagaga

SEQ ID NO: 894032 - DNA, 22 bp, Artificial Sequence
  chemically synthesized
tttttgttttttttttgtagag

SEQ ID NO: 894033 - DNA, 22 bp, Artificial Sequence
  chemically synthesized
ttttttttgttttttttttgta

SEQ ID NO: 894034 - DNA, 22 bp, Artificial Sequence
  chemically synthesized
gttttttttgttttttttttgt

SEQ ID NO: 894035 - DNA, 22 bp, Artificial Sequence
  chemically synthesized
tgttttttttgttttttttttg

SEQ ID NO: 894036 - DNA, 22 bp, Artificial Sequence
  chemically synthesized
ttgttttttttgtttttttttt

SEQ ID NO: 894037 - DNA, 22 bp, Artificial Sequence
  chemically synthesized
tttgttttttttgttttttttt

SEQ ID NO: 894038 - DNA, 22 bp, Artificial Sequence
  chemically synthesized
ccatctctacaaaaaaaaaaca

SEQ ID NO: 894039 - DNA, 22 bp, Artificial Sequence
  chemically synthesized
ttttttgttttttttgtttttt

SEQ ID NO: 894040 - DNA, 22 bp, Artificial Sequence
  chemically synthesized
gttttttgttttttttgttttt

SEQ ID NO: 894041 - DNA, 22 bp, Artificial Sequence
  chemically synthesized
tgttttttgttttttttgtttt

SEQ ID NO: 894042 - DNA, 22 bp, Artificial Sequence
  chemically synthesized
tacaaaaaaaaaacaaaaaaaa

SEQ ID NO: 894043 - DNA, 22 bp, Artificial Sequence
  chemically synthesized
ttttgttttttgttttttttgt

SEQ ID NO: 894044 - DNA, 22 bp, Artificial Sequence
  chemically synthesized
gttttgttttttgttttttttg

SEQ ID NO: 894045 - DNA, 22 bp, Artificial Sequence
  chemically synthesized
caaaaaaaaaacaaaaaaaaca

SEQ ID NO: 894046 - DNA, 22 bp, Artificial Sequence
  chemically synthesized
tgttttgttttttgtttttttt

SEQ ID NO: 894047 - DNA, 22 bp, Artificial Sequence
  chemically synthesized
ttttgttttgttttttgttttt

SEQ ID NO: 894048 - DNA, 22 bp, Artificial Sequence
  chemically synthesized
gttttgttttgttttttgtttt

SEQ ID NO: 894049 - DNA, 22 bp, Artificial Sequence
  chemically synthesized
tgttttgttttgttttttgttt

SEQ ID NO: 894050 - DNA, 22 bp, Artificial Sequence
  chemically synthesized
ttttgttttgttttgttttttg

SEQ ID NO: 894051 - DNA, 22 bp, Artificial Sequence
  chemically synthesized
gttttgttttgttttgtttttt

SEQ ID NO: 894052 - DNA, 22 bp, Artificial Sequence
  chemically synthesized
tgttttgttttgttttgttttt

SEQ ID NO: 894053 - DNA, 22 bp, Artificial Sequence
  chemically synthesized
ttgttttgttttgttttgtttt

SEQ ID NO: 894054 - DNA, 22 bp, Artificial Sequence
  chemically synthesized
tttgttttgttttgttttgttt

SEQ ID NO: 894055 - DNA, 22 bp, Artificial Sequence
  chemically synthesized
ttttgttttgttttgttttgtt

SEQ ID NO: 894056 - DNA, 22 bp, Artificial Sequence
  chemically synthesized
tttttttgttttgttttgtttt

SEQ ID NO: 894057 - DNA, 22 bp, Artificial Sequence
  chemically synthesized
tgtttttttgttttgttttgtt

SEQ ID NO: 894058 - DNA, 22 bp, Artificial Sequence
  chemically synthesized
gctctgtttttttgttttgttt

SEQ ID NO: 894059 - DNA, 22 bp, Artificial Sequence
  chemically synthesized
tggctctgtttttttgttttgt

SEQ ID NO: 894060 - DNA, 22 bp, Artificial Sequence
  chemically synthesized
ttctggctctgtttttttgttt

SEQ ID NO: 894061 - DNA, 22 bp, Artificial Sequence
  chemically synthesized
attctggctctgtttttttgtt

SEQ ID NO: 894062 - DNA, 22 bp, Artificial Sequence
  chemically synthesized
tttattctggctctgttttttt

SEQ ID NO: 894063 - DNA, 22 bp, Artificial Sequence
  chemically synthesized
gtttattctggctctgtttttt

SEQ ID NO: 894064 - DNA, 22 bp, Artificial Sequence
  chemically synthesized
ttgtttattctggctctgtttt

SEQ ID NO: 894065 - DNA, 22 bp, Artificial Sequence
  chemically synthesized
ctcttgtttattctggctctgt

SEQ ID NO: 894066 - DNA, 22 bp, Artificial Sequence
  chemically synthesized
actcttgtttattctggctctg

SEQ ID NO: 894067 - DNA, 22 bp, Artificial Sequence
  chemically synthesized
tactcttgtttattctggctct

SEQ ID NO: 894068 - DNA, 22 bp, Artificial Sequence
  chemically synthesized
aagaaaatagctttactcttgt

SEQ ID NO: 894069 - DNA, 22 bp, Artificial Sequence
  chemically synthesized
tgaagaaaatagctttactctt

SEQ ID NO: 894070 - DNA, 22 bp, Artificial Sequence
  chemically synthesized
atattctgaagaaaatagcttt

SEQ ID NO: 894071 - DNA, 22 bp, Artificial Sequence
  chemically synthesized
gatattctgaagaaaatagctt

SEQ ID NO: 894072 - DNA, 22 bp, Artificial Sequence
  chemically synthesized
ttgatattctgaagaaaatagc

SEQ ID NO: 894073 - DNA, 22 bp, Artificial Sequence
  chemically synthesized
actcttgatattctgaagaaaa

SEQ ID NO: 894074 - DNA, 22 bp, Artificial Sequence
  chemically synthesized
aactcttgatattctgaagaaa

SEQ ID NO: 894075 - DNA, 22 bp, Artificial Sequence
  chemically synthesized
taactcttgatattctgaagaa

SEQ ID NO: 894076 - DNA, 22 bp, Artificial Sequence
  chemically synthesized
ttttcttcagaatatcaagagt

SEQ ID NO: 894077 - DNA, 22 bp, Artificial Sequence
  chemically synthesized
ggatgccagttttaactcttga

SEQ ID NO: 894078 - DNA, 22 bp, Artificial Sequence
  chemically synthesized
tcttcagaatatcaagagttaa

SEQ ID NO: 894079 - DNA, 22 bp, Artificial Sequence
  chemically synthesized
cttcagaatatcaagagttaaa

SEQ ID NO: 894080 - DNA, 22 bp, Artificial Sequence
  chemically synthesized
tgggatgccagttttaactctt

SEQ ID NO: 894081 - DNA, 22 bp, Artificial Sequence
  chemically synthesized
ttcagaatatcaagagttaaaa

SEQ ID NO: 894082 - DNA, 22 bp, Artificial Sequence
  chemically synthesized
cagaatatcaagagttaaaact

SEQ ID NO: 894083 - DNA, 22 bp, Artificial Sequence
  chemically synthesized
ttctgggatgccagttttaact

SEQ ID NO: 894084 - DNA, 22 bp, Artificial Sequence
  chemically synthesized
agaatatcaagagttaaaactg

SEQ ID NO: 894085 - DNA, 22 bp, Artificial Sequence
  chemically synthesized
attctgggatgccagttttaac

SEQ ID NO: 894086 - DNA, 22 bp, Artificial Sequence
  chemically synthesized
tattctgggatgccagttttaa

SEQ ID NO: 894087 - DNA, 22 bp, Artificial Sequence
  chemically synthesized
tttattctgggatgccagtttt

SEQ ID NO: 894088 - DNA, 22 bp, Artificial Sequence
  chemically synthesized
aattctttattctgggatgcca

SEQ ID NO: 894089 - DNA, 22 bp, Artificial Sequence
  chemically synthesized
aaattctttattctgggatgcc

SEQ ID NO: 894090 - DNA, 22 bp, Artificial Sequence
  chemically synthesized
aaactggcatcccagaataaag

SEQ ID NO: 894091 - DNA, 22 bp, Artificial Sequence
  chemically synthesized
caagtttaaattctttattctg

SEQ ID NO: 894092 - DNA, 22 bp, Artificial Sequence
  chemically synthesized
gcatcccagaataaagaattta

SEQ ID NO: 894093 - DNA, 22 bp, Artificial Sequence
  chemically synthesized
tcattacaagtttaaattcttt

SEQ ID NO: 894094 - DNA, 22 bp, Artificial Sequence
  chemically synthesized
gtaaagagctatcattacaagt

SEQ ID NO: 894095 - DNA, 22 bp, Artificial Sequence
  chemically synthesized
atagtctcgtaaagagctatca

SEQ ID NO: 894096 - DNA, 22 bp, Artificial Sequence
  chemically synthesized
aaacttgtaatgatagctcttt

SEQ ID NO: 894097 - DNA, 22 bp, Artificial Sequence
  chemically synthesized
aacttgtaatgatagctcttta

SEQ ID NO: 894098 - DNA, 22 bp, Artificial Sequence
  chemically synthesized
ttaatagtctcgtaaagagcta

SEQ ID NO: 894099 - DNA, 22 bp, Artificial Sequence
  chemically synthesized
gtaatgatagctctttacgaga

SEQ ID NO: 894100 - DNA, 22 bp, Artificial Sequence
  chemically synthesized
taatgatagctctttacgagac

SEQ ID NO: 894101 - DNA, 22 bp, Artificial Sequence
  chemically synthesized
cagtggtattgttaatagtctc

SEQ ID NO: 894102 - DNA, 22 bp, Artificial Sequence
  chemically synthesized
tattacagtggtattgttaata

SEQ ID NO: 894103 - DNA, 22 bp, Artificial Sequence
  chemically synthesized
gtattacagtggtattgttaat

SEQ ID NO: 894104 - DNA, 22 bp, Artificial Sequence
  chemically synthesized
tttacgagactattaacaatac

SEQ ID NO: 894105 - DNA, 22 bp, Artificial Sequence
  chemically synthesized
tgtattacagtggtattgttaa

SEQ ID NO: 894106 - DNA, 22 bp, Artificial Sequence
  chemically synthesized
tacgagactattaacaatacca

SEQ ID NO: 894107 - DNA, 22 bp, Artificial Sequence
  chemically synthesized
acgagactattaacaataccac

SEQ ID NO: 894108 - DNA, 22 bp, Artificial Sequence
  chemically synthesized
cgagactattaacaataccact

SEQ ID NO: 894109 - DNA, 22 bp, Artificial Sequence
  chemically synthesized
ttaacaataccactgtaataca

SEQ ID NO: 894110 - DNA, 22 bp, Artificial Sequence
  chemically synthesized
cagtgtaatattttgtattaca

SEQ ID NO: 894111 - DNA, 22 bp, Artificial Sequence
  chemically synthesized
acaataccactgtaatacaaaa

SEQ ID NO: 894112 - DNA, 22 bp, Artificial Sequence
  chemically synthesized
atattgcagtgtaatattttgt

SEQ ID NO: 894113 - DNA, 22 bp, Artificial Sequence
  chemically synthesized
ttcatattgcagtgtaatattt

SEQ ID NO: 894114 - DNA, 22 bp, Artificial Sequence
  chemically synthesized
attcatattgcagtgtaatatt

SEQ ID NO: 894115 - DNA, 22 bp, Artificial Sequence
  chemically synthesized
tattcatattgcagtgtaatat

SEQ ID NO: 894116 - DNA, 22 bp, Artificial Sequence
  chemically synthesized
taatacaaaatattacactgca

SEQ ID NO: 894117 - DNA, 22 bp, Artificial Sequence
  chemically synthesized
taaaattttattcatattgcag

SEQ ID NO: 894118 - DNA, 22 bp, Artificial Sequence
  chemically synthesized
cactgcaatatgaataaaattt

SEQ ID NO: 894119 - DNA, 22 bp, Artificial Sequence
  chemically synthesized
caatatgaataaaattttataa

SEQ ID NO: 894120 - DNA, 22 bp, Artificial Sequence
  chemically synthesized
tggaacagatgtatattataaa

SEQ ID NO: 894121 - DNA, 22 bp, Artificial Sequence
  chemically synthesized
ttatggaacagatgtatattat

SEQ ID NO: 894122 - DNA, 22 bp, Artificial Sequence
  chemically synthesized
tataatatacatctgttccata

SEQ ID NO: 894123 - DNA, 22 bp, Artificial Sequence
  chemically synthesized
ataatatattattatggaacag

SEQ ID NO: 894124 - DNA, 22 bp, Artificial Sequence
  chemically synthesized
ataatatacatctgttccataa

SEQ ID NO: 894125 - DNA, 22 bp, Artificial Sequence
  chemically synthesized
taatatacatctgttccataat

SEQ ID NO: 894126 - DNA, 22 bp, Artificial Sequence
  chemically synthesized
ttcataatatattattatggaa

SEQ ID NO: 894127 - DNA, 22 bp, Artificial Sequence
  chemically synthesized
ttattcataatatattattatg

SEQ ID NO: 894128 - DNA, 22 bp, Artificial Sequence
  chemically synthesized
ttattattcataatatattatt

SEQ ID NO: 894129 - DNA, 22 bp, Artificial Sequence
  chemically synthesized
tattattattcataatatatta

SEQ ID NO: 894130 - DNA, 22 bp, Artificial Sequence
  chemically synthesized
tctattattattcataatatat

SEQ ID NO: 894131 - DNA, 22 bp, Artificial Sequence
  chemically synthesized
ctctattattattcataatata

SEQ ID NO: 894132 - DNA, 22 bp, Artificial Sequence
  chemically synthesized
ttccataataatatattatgaa

SEQ ID NO: 894133 - DNA, 22 bp, Artificial Sequence
  chemically synthesized
cataataatatattatgaataa

SEQ ID NO: 894134 - DNA, 22 bp, Artificial Sequence
  chemically synthesized
aaatcttctctattattattca

SEQ ID NO: 894135 - DNA, 22 bp, Artificial Sequence
  chemically synthesized
aaaatcttctctattattattc

SEQ ID NO: 894136 - DNA, 22 bp, Artificial Sequence
  chemically synthesized
taaaatcttctctattattatt

SEQ ID NO: 894137 - DNA, 22 bp, Artificial Sequence
  chemically synthesized
ttaaaatcttctctattattat

SEQ ID NO: 894138 - DNA, 22 bp, Artificial Sequence
  chemically synthesized
tttttaaaatcttctctattat

SEQ ID NO: 894139 - DNA, 22 bp, Artificial Sequence
  chemically synthesized
atttttaaaatcttctctatta

SEQ ID NO: 894140 - DNA, 22 bp, Artificial Sequence
  chemically synthesized
gtttatttttaaaatcttctct

SEQ ID NO: 894141 - DNA, 22 bp, Artificial Sequence
  chemically synthesized
tgaataataatagagaagattt

SEQ ID NO: 894142 - DNA, 22 bp, Artificial Sequence
  chemically synthesized
tctagtttatttttaaaatctt

SEQ ID NO: 894143 - DNA, 22 bp, Artificial Sequence
  chemically synthesized
gtatattatctagtttattttt

SEQ ID NO: 894144 - DNA, 22 bp, Artificial Sequence
  chemically synthesized
taaaaataaactagataatata

SEQ ID NO: 894145 - DNA, 22 bp, Artificial Sequence
  chemically synthesized
aaaaataaactagataatatac

SEQ ID NO: 894146 - DNA, 22 bp, Artificial Sequence
  chemically synthesized
tgtgacacactggtatattatc

SEQ ID NO: 894147 - DNA, 22 bp, Artificial Sequence
  chemically synthesized
aaaataaactagataatatacc

SEQ ID NO: 894148 - DNA, 22 bp, Artificial Sequence
  chemically synthesized
atgtgacacactggtatattat

SEQ ID NO: 894149 - DNA, 22 bp, Artificial Sequence
  chemically synthesized
tttatgtgacacactggtatat

SEQ ID NO: 894150 - DNA, 22 bp, Artificial Sequence
  chemically synthesized
gataatataccagtgtgtcaca

SEQ ID NO: 894151 - DNA, 22 bp, Artificial Sequence
  chemically synthesized
caaagcatgtgacattgtttat

SEQ ID NO: 894152 - DNA, 22 bp, Artificial Sequence
  chemically synthesized
ttccaaagcatgtgacattgtt

SEQ ID NO: 894153 - DNA, 22 bp, Artificial Sequence
  chemically synthesized
aaacaattgttccaaagcatgt

SEQ ID NO: 894154 - DNA, 22 bp, Artificial Sequence
  chemically synthesized
aaagtatctaaaacaattgttc

SEQ ID NO: 894155 - DNA, 22 bp, Artificial Sequence
  chemically synthesized
aaaagtatctaaaacaattgtt

SEQ ID NO: 894156 - DNA, 22 bp, Artificial Sequence
  chemically synthesized
taaaagtatctaaaacaattgt

SEQ ID NO: 894157 - DNA, 22 bp, Artificial Sequence
  chemically synthesized
ttttaaaagtatctaaaacaat

SEQ ID NO: 894158 - DNA, 22 bp, Artificial Sequence
  chemically synthesized
attttaaaagtatctaaaacaa

SEQ ID NO: 894159 - DNA, 22 bp, Artificial Sequence
  chemically synthesized
tggaacaattgttttagatact

SEQ ID NO: 894160 - DNA, 22 bp, Artificial Sequence
  chemically synthesized
ggaacaattgttttagatactt

SEQ ID NO: 894161 - DNA, 22 bp, Artificial Sequence
  chemically synthesized
gaacaattgttttagatacttt

SEQ ID NO: 894162 - DNA, 22 bp, Artificial Sequence
  chemically synthesized
gtgacttattttaaaagtatct

SEQ ID NO: 894163 - DNA, 22 bp, Artificial Sequence
  chemically synthesized
attagtgacttattttaaaagt

SEQ ID NO: 894164 - DNA, 22 bp, Artificial Sequence
  chemically synthesized
ttcattagtgacttattttaaa

SEQ ID NO: 894165 - DNA, 22 bp, Artificial Sequence
  chemically synthesized
ttttagatacttttaaaataag

SEQ ID NO: 894166 - DNA, 22 bp, Artificial Sequence
  chemically synthesized
tagatacttttaaaataagtca

SEQ ID NO: 894167 - DNA, 22 bp, Artificial Sequence
  chemically synthesized
agatacttttaaaataagtcac

SEQ ID NO: 894168 - DNA, 22 bp, Artificial Sequence
  chemically synthesized
gatacttttaaaataagtcact

SEQ ID NO: 894169 - DNA, 22 bp, Artificial Sequence
  chemically synthesized
aacaatgtactgttcattagtg

SEQ ID NO: 894170 - DNA, 22 bp, Artificial Sequence
  chemically synthesized
ttaaaataagtcactaatgaac

SEQ ID NO: 894171 - DNA, 22 bp, Artificial Sequence
  chemically synthesized
taaaataagtcactaatgaaca

SEQ ID NO: 894172 - DNA, 22 bp, Artificial Sequence
  chemically synthesized
aaaataagtcactaatgaacag

SEQ ID NO: 894173 - DNA, 22 bp, Artificial Sequence
  chemically synthesized
aaataagtcactaatgaacagt

SEQ ID NO: 894174 - DNA, 22 bp, Artificial Sequence
  chemically synthesized
catccaattaaacaatgtactg

SEQ ID NO: 894175 - DNA, 22 bp, Artificial Sequence
  chemically synthesized
gcatccaattaaacaatgtact

SEQ ID NO: 894176 - DNA, 22 bp, Artificial Sequence
  chemically synthesized
ttgcatccaattaaacaatgta

SEQ ID NO: 894177 - DNA, 22 bp, Artificial Sequence
  chemically synthesized
atgaacagtacattgtttaatt

SEQ ID NO: 894178 - DNA, 22 bp, Artificial Sequence
  chemically synthesized
actcttgcatccaattaaacaa

SEQ ID NO: 894179 - DNA, 22 bp, Artificial Sequence
  chemically synthesized
ctaactcttgcatccaattaaa

SEQ ID NO: 894180 - DNA, 22 bp, Artificial Sequence
  chemically synthesized
atctcctaactcttgcatccaa

SEQ ID NO: 894181 - DNA, 22 bp, Artificial Sequence
  chemically synthesized
catctcctaactcttgcatcca

SEQ ID NO: 894182 - DNA, 22 bp, Artificial Sequence
  chemically synthesized
tcatctcctaactcttgcatcc

SEQ ID NO: 894183 - DNA, 22 bp, Artificial Sequence
  chemically synthesized
ttcatctcctaactcttgcatc

SEQ ID NO: 894184 - DNA, 22 bp, Artificial Sequence
  chemically synthesized
tttcatctcctaactcttgcat

SEQ ID NO: 894185 - DNA, 22 bp, Artificial Sequence
  chemically synthesized
tttttcatctcctaactcttgc

SEQ ID NO: 894186 - DNA, 22 bp, Artificial Sequence
  chemically synthesized
tttaattggatgcaagagttag

SEQ ID NO: 894187 - DNA, 22 bp, Artificial Sequence
  chemically synthesized
tctttttcatctcctaactctt

SEQ ID NO: 894188 - DNA, 22 bp, Artificial Sequence
  chemically synthesized
ctctttttcatctcctaactct

SEQ ID NO: 894189 - DNA, 22 bp, Artificial Sequence
  chemically synthesized
aattggatgcaagagttaggag

SEQ ID NO: 894190 - DNA, 22 bp, Artificial Sequence
  chemically synthesized
tctctttttcatctcctaactc

SEQ ID NO: 894191 - DNA, 22 bp, Artificial Sequence
  chemically synthesized
attggatgcaagagttaggaga

SEQ ID NO: 894192 - DNA, 22 bp, Artificial Sequence
  chemically synthesized
gatgcaagagttaggagatgaa

SEQ ID NO: 894193 - DNA, 22 bp, Artificial Sequence
  chemically synthesized
gacaactttctctttttcatct

SEQ ID NO: 894194 - DNA, 22 bp, Artificial Sequence
  chemically synthesized
tcgacaactttctctttttcat

SEQ ID NO: 894195 - DNA, 22 bp, Artificial Sequence
  chemically synthesized
ctcgacaactttctctttttca

SEQ ID NO: 894196 - DNA, 22 bp, Artificial Sequence
  chemically synthesized
tctcgacaactttctctttttc

SEQ ID NO: 894197 - DNA, 22 bp, Artificial Sequence
  chemically synthesized
ttctcgacaactttctcttttt

SEQ ID NO: 894198 - DNA, 22 bp, Artificial Sequence
  chemically synthesized
tttctcgacaactttctctttt

SEQ ID NO: 894199 - DNA, 22 bp, Artificial Sequence
  chemically synthesized
ttttctcgacaactttctcttt

SEQ ID NO: 894200 - DNA, 22 bp, Artificial Sequence
  chemically synthesized
ggagatgaaaaagagaaagttg

SEQ ID NO: 894201 - DNA, 22 bp, Artificial Sequence
  chemically synthesized
atttttttctcgacaactttct

SEQ ID NO: 894202 - DNA, 22 bp, Artificial Sequence
  chemically synthesized
attgatttttttctcgacaact

SEQ ID NO: 894203 - DNA, 22 bp, Artificial Sequence
  chemically synthesized
tacattaattgatttttttctc

SEQ ID NO: 894204 - DNA, 22 bp, Artificial Sequence
  chemically synthesized
tgtacattaattgatttttttc

SEQ ID NO: 894205 - DNA, 22 bp, Artificial Sequence
  chemically synthesized
ctgtacattaattgattttttt

SEQ ID NO: 894206 - DNA, 22 bp, Artificial Sequence
  chemically synthesized
tctgtacattaattgatttttt

SEQ ID NO: 894207 - DNA, 22 bp, Artificial Sequence
  chemically synthesized
ttctgtacattaattgattttt

SEQ ID NO: 894208 - DNA, 22 bp, Artificial Sequence
  chemically synthesized
atttttctgtacattaattgat

SEQ ID NO: 894209 - DNA, 22 bp, Artificial Sequence
  chemically synthesized
tcgagaaaaaaatcaattaatg

SEQ ID NO: 894210 - DNA, 22 bp, Artificial Sequence
  chemically synthesized
aaattcatttttctgtacatta

SEQ ID NO: 894211 - DNA, 22 bp, Artificial Sequence
  chemically synthesized
aaaattcatttttctgtacatt

SEQ ID NO: 894212 - DNA, 22 bp, Artificial Sequence
  chemically synthesized
tttaaaattcatttttctgtac

SEQ ID NO: 894213 - DNA, 22 bp, Artificial Sequence
  chemically synthesized
gtttaaaattcatttttctgta

SEQ ID NO: 894214 - DNA, 22 bp, Artificial Sequence
  chemically synthesized
atgtacagaaaaatgaatttta

SEQ ID NO: 894215 - DNA, 22 bp, Artificial Sequence
  chemically synthesized
cgtatacaatcttgtttaaaat

SEQ ID NO: 894216 - DNA, 22 bp, Artificial Sequence
  chemically synthesized
acgtatacaatcttgtttaaaa

SEQ ID NO: 894217 - DNA, 22 bp, Artificial Sequence
  chemically synthesized
tttacgtatacaatcttgttta

SEQ ID NO: 894218 - DNA, 22 bp, Artificial Sequence
  chemically synthesized
tacatattgtttacgtatacaa

SEQ ID NO: 894219 - DNA, 22 bp, Artificial Sequence
  chemically synthesized
taaacaagattgtatacgtaaa

SEQ ID NO: 894220 - DNA, 22 bp, Artificial Sequence
  chemically synthesized
aaacaagattgtatacgtaaac

SEQ ID NO: 894221 - DNA, 22 bp, Artificial Sequence
  chemically synthesized
actgtacatattgtttacgtat

SEQ ID NO: 894222 - DNA, 22 bp, Artificial Sequence
  chemically synthesized
aacaagattgtatacgtaaaca

SEQ ID NO: 894223 - DNA, 22 bp, Artificial Sequence
  chemically synthesized
cactgtacatattgtttacgta

SEQ ID NO: 894224 - DNA, 22 bp, Artificial Sequence
  chemically synthesized
tatacgtaaacaatatgtacag

SEQ ID NO: 894225 - DNA, 22 bp, Artificial Sequence
  chemically synthesized
caagacgtttcactgtacatat

SEQ ID NO: 894226 - DNA, 22 bp, Artificial Sequence
  chemically synthesized
acaagacgtttcactgtacata

SEQ ID NO: 894227 - DNA, 22 bp, Artificial Sequence
  chemically synthesized
acaacatatatacatgcattta

SEQ ID NO: 894228 - DNA, 22 bp, Artificial Sequence
  chemically synthesized
cacaacatatatacatgcattt

SEQ ID NO: 894229 - DNA, 22 bp, Artificial Sequence
  chemically synthesized
tcacaacatatatacatgcatt

SEQ ID NO: 894230 - DNA, 22 bp, Artificial Sequence
  chemically synthesized
ttcacaacatatatacatgcat

SEQ ID NO: 894231 - DNA, 22 bp, Artificial Sequence
  chemically synthesized
gtaaatgcatgtatatatgttg

SEQ ID NO: 894232 - DNA, 22 bp, Artificial Sequence
  chemically synthesized
atgaatttttcacaacatatat

SEQ ID NO: 894233 - DNA, 22 bp, Artificial Sequence
  chemically synthesized
taaatgcatgtatatatgttgt

SEQ ID NO: 894234 - DNA, 22 bp, Artificial Sequence
  chemically synthesized
tacagtctcatgaatttttcac

SEQ ID NO: 894235 - DNA, 22 bp, Artificial Sequence
  chemically synthesized
atacagtctcatgaatttttca

SEQ ID NO: 894236 - DNA, 22 bp, Artificial Sequence
  chemically synthesized
cttatacagtctcatgaatttt

SEQ ID NO: 894237 - DNA, 22 bp, Artificial Sequence
  chemically synthesized
gcttatacagtctcatgaattt

SEQ ID NO: 894238 - DNA, 22 bp, Artificial Sequence
  chemically synthesized
tgcttatacagtctcatgaatt

SEQ ID NO: 894239 - DNA, 22 bp, Artificial Sequence
  chemically synthesized
atcctttgcttatacagtctca

SEQ ID NO: 894240 - DNA, 22 bp, Artificial Sequence
  chemically synthesized
tgaaaaattcatgagactgtat

SEQ ID NO: 894241 - DNA, 22 bp, Artificial Sequence
  chemically synthesized
gatgttaatcctttgcttatac

SEQ ID NO: 894242 - DNA, 22 bp, Artificial Sequence
  chemically synthesized
atgagactgtataagcaaagga

SEQ ID NO: 894243 - DNA, 22 bp, Artificial Sequence
  chemically synthesized
tataagcaaaggattaacatcc

SEQ ID NO: 894244 - DNA, 22 bp, Artificial Sequence
  chemically synthesized
caacagcccaggctggatgtta

SEQ ID NO: 894245 - DNA, 22 bp, Artificial Sequence
  chemically synthesized
acctgcaacagcccaggctgga

SEQ ID NO: 894246 - DNA, 22 bp, Artificial Sequence
  chemically synthesized
acatccagcctgggctgttgca

SEQ ID NO: 894247 - DNA, 22 bp, Artificial Sequence
  chemically synthesized
gggtcagtcccagactgacctg

SEQ ID NO: 894248 - DNA, 22 bp, Artificial Sequence
  chemically synthesized
ggctgttgcaggtcagtctggg

SEQ ID NO: 894249 - DNA, 22 bp, Artificial Sequence
  chemically synthesized
ttgcaggtcagtctgggactga

SEQ ID NO: 894250 - DNA, 22 bp, Artificial Sequence
  chemically synthesized
tgggagcctagggtcagtccca

SEQ ID NO: 894251 - DNA, 22 bp, Artificial Sequence
  chemically synthesized
caggtcagtctgggactgaccc

SEQ ID NO: 894252 - DNA, 22 bp, Artificial Sequence
  chemically synthesized
ggactgaccctaggctcccaca

SEQ ID NO: 894253 - DNA, 22 bp, Artificial Sequence
  chemically synthesized
caaggaaacagtgctgtgggag

SEQ ID NO: 894254 - DNA, 22 bp, Artificial Sequence
  chemically synthesized
ccaaggaaacagtgctgtggga

SEQ ID NO: 894255 - DNA, 22 bp, Artificial Sequence
  chemically synthesized
accctaggctcccacagcactg

SEQ ID NO: 894256 - DNA, 22 bp, Artificial Sequence
  chemically synthesized
gtgtttccaaggaaacagtgct

SEQ ID NO: 894257 - DNA, 22 bp, Artificial Sequence
  chemically synthesized
ggctcccacagcactgtttcct

SEQ ID NO: 894258 - DNA, 22 bp, Artificial Sequence
  chemically synthesized
aagttagtgtttccaaggaaac

SEQ ID NO: 894259 - DNA, 22 bp, Artificial Sequence
  chemically synthesized
aaagttagtgtttccaaggaaa

SEQ ID NO: 894260 - DNA, 22 bp, Artificial Sequence
  chemically synthesized
ccacagcactgtttccttggaa

SEQ ID NO: 894261 - DNA, 22 bp, Artificial Sequence
  chemically synthesized
atcttaaagttagtgtttccaa

SEQ ID NO: 894262 - DNA, 22 bp, Artificial Sequence
  chemically synthesized
ccattcatcttaaagttagtgt

SEQ ID NO: 894263 - DNA, 22 bp, Artificial Sequence
  chemically synthesized
tttccttggaaacactaacttt

SEQ ID NO: 894264 - DNA, 22 bp, Artificial Sequence
  chemically synthesized
cccattcatcttaaagttagtg

SEQ ID NO: 894265 - DNA, 22 bp, Artificial Sequence
  chemically synthesized
ccttggaaacactaactttaag

SEQ ID NO: 894266 - DNA, 22 bp, Artificial Sequence
  chemically synthesized
cttggaaacactaactttaaga

SEQ ID NO: 894267 - DNA, 22 bp, Artificial Sequence
  chemically synthesized
ggaaacactaactttaagatga

SEQ ID NO: 894268 - DNA, 22 bp, Artificial Sequence
  chemically synthesized
gaaacactaactttaagatgaa

SEQ ID NO: 894269 - DNA, 22 bp, Artificial Sequence
  chemically synthesized
actttaagatgaatgggaaatg

SEQ ID NO: 894270 - DNA, 22 bp, Artificial Sequence
  chemically synthesized
taagatgaatgggaaatgttgg

SEQ ID NO: 894271 - DNA, 22 bp, Artificial Sequence
  chemically synthesized
aagatgaatgggaaatgttggg

SEQ ID NO: 894272 - DNA, 22 bp, Artificial Sequence
  chemically synthesized
agatgaatgggaaatgttgggc

SEQ ID NO: 894273 - DNA, 22 bp, Artificial Sequence
  chemically synthesized
cacacgacaaagccaggcccaa

SEQ ID NO: 894274 - DNA, 22 bp, Artificial Sequence
  chemically synthesized
ggcctggctttgtcgtgtggaa

SEQ ID NO: 894275 - DNA, 22 bp, Artificial Sequence
  chemically synthesized
cgatgaggtgcagttccacacg

SEQ ID NO: 894276 - DNA, 22 bp, Artificial Sequence
  chemically synthesized
ctgcgatgaggtgcagttccac

SEQ ID NO: 894277 - DNA, 22 bp, Artificial Sequence
  chemically synthesized
gctttgtcgtgtggaactgcac

SEQ ID NO: 894278 - DNA, 22 bp, Artificial Sequence
  chemically synthesized
tgtcgtgtggaactgcacctca

SEQ ID NO: 894279 - DNA, 22 bp, Artificial Sequence
  chemically synthesized
gtcgtgtggaactgcacctcat

SEQ ID NO: 894280 - DNA, 22 bp, Artificial Sequence
  chemically synthesized
acagctcctgcgatgaggtgca

SEQ ID NO: 894281 - DNA, 22 bp, Artificial Sequence
  chemically synthesized
tcgtgtggaactgcacctcatc

SEQ ID NO: 894282 - DNA, 22 bp, Artificial Sequence
  chemically synthesized
caactgacagctcctgcgatga

SEQ ID NO: 894283 - DNA, 22 bp, Artificial Sequence
  chemically synthesized
tattccaactgacagctcctgc

SEQ ID NO: 894284 - DNA, 22 bp, Artificial Sequence
  chemically synthesized
cacctcatcgcaggagctgtca

SEQ ID NO: 894285 - DNA, 22 bp, Artificial Sequence
  chemically synthesized
atcgcaggagctgtcagttgga

SEQ ID NO: 894286 - DNA, 22 bp, Artificial Sequence
  chemically synthesized
tcagttggaatacagtccttgg

SEQ ID NO: 894287 - DNA, 22 bp, Artificial Sequence
  chemically synthesized
tagtcacgtggatccaaggact

SEQ ID NO: 894288 - DNA, 22 bp, Artificial Sequence
  chemically synthesized
gaatacagtccttggatccacg

SEQ ID NO: 894289 - DNA, 22 bp, Artificial Sequence
  chemically synthesized
caccattgtagtcacgtggatc

SEQ ID NO: 894290 - DNA, 22 bp, Artificial Sequence
  chemically synthesized
acaccattgtagtcacgtggat

SEQ ID NO: 894291 - DNA, 22 bp, Artificial Sequence
  chemically synthesized
tacaccattgtagtcacgtgga

SEQ ID NO: 894292 - DNA, 22 bp, Artificial Sequence
  chemically synthesized
ttacaccattgtagtcacgtgg

SEQ ID NO: 894293 - DNA, 22 bp, Artificial Sequence
  chemically synthesized
ggatccacgtgactacaatggt

SEQ ID NO: 894294 - DNA, 22 bp, Artificial Sequence
  chemically synthesized
gatccacgtgactacaatggtg

SEQ ID NO: 894295 - DNA, 22 bp, Artificial Sequence
  chemically synthesized
ccatcagtcttttacaccattg

SEQ ID NO: 894296 - DNA, 22 bp, Artificial Sequence
  chemically synthesized
cccatcagtcttttacaccatt

SEQ ID NO: 894297 - DNA, 22 bp, Artificial Sequence
  chemically synthesized
tatttcccatcagtcttttaca

SEQ ID NO: 894298 - DNA, 22 bp, Artificial Sequence
  chemically synthesized
caatggtgtaaaagactgatgg

SEQ ID NO: 894299 - DNA, 22 bp, Artificial Sequence
  chemically synthesized
aacaggagccaccacctgtatt

SEQ ID NO: 894300 - DNA, 22 bp, Artificial Sequence
  chemically synthesized
caacaggagccaccacctgtat

SEQ ID NO: 894301 - DNA, 22 bp, Artificial Sequence
  chemically synthesized
atgggaaatacaggtggtggct

SEQ ID NO: 894302 - DNA, 22 bp, Artificial Sequence
  chemically synthesized
ctgttgaaggtgacctgcacac

SEQ ID NO: 894303 - DNA, 22 bp, Artificial Sequence
  chemically synthesized
ttgaaggtgacctgcacacttc

SEQ ID NO: 894304 - DNA, 22 bp, Artificial Sequence
  chemically synthesized
aaggtgacctgcacacttcttg

SEQ ID NO: 894305 - DNA, 22 bp, Artificial Sequence
  chemically synthesized
ccaggaatgagaggcaagaagt

SEQ ID NO: 894306 - DNA, 22 bp, Artificial Sequence
  chemically synthesized
cacacttcttgcctctcattcc

SEQ ID NO: 894307 - DNA, 22 bp, Artificial Sequence
  chemically synthesized
cttgcctctcattcctggcagc

SEQ ID NO: 894308 - DNA, 22 bp, Artificial Sequence
  chemically synthesized
ttgcctctcattcctggcagcc

SEQ ID NO: 894309 - DNA, 22 bp, Artificial Sequence
  chemically synthesized
gcctctcattcctggcagcctt

SEQ ID NO: 894310 - DNA, 22 bp, Artificial Sequence
  chemically synthesized
cctctcattcctggcagccttt

SEQ ID NO: 894311 - DNA, 22 bp, Artificial Sequence
  chemically synthesized
acccacacagggaaaggctgcc

SEQ ID NO: 894312 - DNA, 22 bp, Artificial Sequence
  chemically synthesized
tcacccacacagggaaaggctg

SEQ ID NO: 894313 - DNA, 22 bp, Artificial Sequence
  chemically synthesized
tcattcctggcagcctttccct

SEQ ID NO: 894314 - DNA, 22 bp, Artificial Sequence
  chemically synthesized
attcctggcagcctttccctgt

SEQ ID NO: 894315 - DNA, 22 bp, Artificial Sequence
  chemically synthesized
ctggcagcctttccctgtgtgg

SEQ ID NO: 894316 - DNA, 22 bp, Artificial Sequence
  chemically synthesized
cccaactctcacccacacaggg

SEQ ID NO: 894317 - DNA, 22 bp, Artificial Sequence
  chemically synthesized
gcccaactctcacccacacagg

SEQ ID NO: 894318 - DNA, 22 bp, Artificial Sequence
  chemically synthesized
tgcccaactctcacccacacag

SEQ ID NO: 894319 - DNA, 22 bp, Artificial Sequence
  chemically synthesized
gcagcctttccctgtgtgggtg

SEQ ID NO: 894320 - DNA, 22 bp, Artificial Sequence
  chemically synthesized
ttgcccaactctcacccacaca

SEQ ID NO: 894321 - DNA, 22 bp, Artificial Sequence
  chemically synthesized
ttttgcccaactctcacccaca

SEQ ID NO: 894322 - DNA, 22 bp, Artificial Sequence
  chemically synthesized
cttttgcccaactctcacccac

SEQ ID NO: 894323 - DNA, 22 bp, Artificial Sequence
  chemically synthesized
tccctgtgtgggtgagagttgg

SEQ ID NO: 894324 - DNA, 22 bp, Artificial Sequence
  chemically synthesized
ccctgtgtgggtgagagttggg

SEQ ID NO: 894325 - DNA, 22 bp, Artificial Sequence
  chemically synthesized
cctgtgtgggtgagagttgggc

SEQ ID NO: 894326 - DNA, 22 bp, Artificial Sequence
  chemically synthesized
tgtgggtgagagttgggcaaaa

SEQ ID NO: 894327 - DNA, 22 bp, Artificial Sequence
  chemically synthesized
aaacacaatgcttcttttgccc

SEQ ID NO: 894328 - DNA, 22 bp, Artificial Sequence
  chemically synthesized
tctgaaacacaatgcttctttt

SEQ ID NO: 894329 - DNA, 22 bp, Artificial Sequence
  chemically synthesized
tgctatctgaaacacaatgctt

SEQ ID NO: 894330 - DNA, 22 bp, Artificial Sequence
  chemically synthesized
tgtgctatctgaaacacaatgc

SEQ ID NO: 894331 - DNA, 22 bp, Artificial Sequence
  chemically synthesized
ggcaaaagaagcattgtgtttc

SEQ ID NO: 894332 - DNA, 22 bp, Artificial Sequence
  chemically synthesized
atggacattctgtgctatctga

SEQ ID NO: 894333 - DNA, 22 bp, Artificial Sequence
  chemically synthesized
atgattcatggacattctgtgc

SEQ ID NO: 894334 - DNA, 22 bp, Artificial Sequence
  chemically synthesized
tgtttcagatagcacagaatgt

SEQ ID NO: 894335 - DNA, 22 bp, Artificial Sequence
  chemically synthesized
aattcatgattcatggacattc

SEQ ID NO: 894336 - DNA, 22 bp, Artificial Sequence
  chemically synthesized
cagatagcacagaatgtccatg

SEQ ID NO: 894337 - DNA, 22 bp, Artificial Sequence
  chemically synthesized
agatagcacagaatgtccatga

SEQ ID NO: 894338 - DNA, 22 bp, Artificial Sequence
  chemically synthesized
agatattgttctctttgcttga

SEQ ID NO: 894339 - DNA, 22 bp, Artificial Sequence
  chemically synthesized
acaaaacacaaatcaagcaaag

SEQ ID NO: 894340 - DNA, 22 bp, Artificial Sequence
  chemically synthesized
ttctctttgcttgatttgtgtt

SEQ ID NO: 894341 - DNA, 22 bp, Artificial Sequence
  chemically synthesized
tctttgcttgatttgtgttttg

SEQ ID NO: 894342 - DNA, 22 bp, Artificial Sequence
  chemically synthesized
tttgcttgatttgtgttttgtg

SEQ ID NO: 894343 - DNA, 22 bp, Artificial Sequence
  chemically synthesized
tggatgtgaactcacaaaacac

SEQ ID NO: 894344 - DNA, 22 bp, Artificial Sequence
  chemically synthesized
tgcttgatttgtgttttgtgag

SEQ ID NO: 894345 - DNA, 22 bp, Artificial Sequence
  chemically synthesized
gcttgatttgtgttttgtgagt

SEQ ID NO: 894346 - DNA, 22 bp, Artificial Sequence
  chemically synthesized
cttgatttgtgttttgtgagtt

SEQ ID NO: 894347 - DNA, 22 bp, Artificial Sequence
  chemically synthesized
gatttgtgttttgtgagttcac

SEQ ID NO: 894348 - DNA, 22 bp, Artificial Sequence
  chemically synthesized
atttgtgttttgtgagttcaca

SEQ ID NO: 894349 - DNA, 22 bp, Artificial Sequence
  chemically synthesized
gtgttttgtgagttcacatcca

SEQ ID NO: 894350 - DNA, 22 bp, Artificial Sequence
  chemically synthesized
tgttttgtgagttcacatccat

SEQ ID NO: 894351 - DNA, 22 bp, Artificial Sequence
  chemically synthesized
tgtgagttcacatccataacta

SEQ ID NO: 894352 - DNA, 22 bp, Artificial Sequence
  chemically synthesized
gtgagttcacatccataactac

SEQ ID NO: 894353 - DNA, 22 bp, Artificial Sequence
  chemically synthesized
agcaccacaggtgtagttatgg

SEQ ID NO: 894354 - DNA, 22 bp, Artificial Sequence
  chemically synthesized
tgagttcacatccataactaca

SEQ ID NO: 894355 - DNA, 22 bp, Artificial Sequence
  chemically synthesized
acatccataactacacctgtgg

SEQ ID NO: 894356 - DNA, 22 bp, Artificial Sequence
  chemically synthesized
cacctgtggtgctgaactcttg

SEQ ID NO: 894357 - DNA, 22 bp, Artificial Sequence
  chemically synthesized
tggtgctgaactcttgtgtgtg

SEQ ID NO: 894358 - DNA, 22 bp, Artificial Sequence
  chemically synthesized
aactcttgtgtgtgtgtgtgtg

SEQ ID NO: 894359 - DNA, 22 bp, Artificial Sequence
  chemically synthesized
ttgtgtgtgtgtgtgtgtgtgt

SEQ ID NO: 894360 - DNA, 22 bp, Artificial Sequence
  chemically synthesized
gtgtgtgtgtgtgtgtgtgtgt

SEQ ID NO: 894361 - DNA, 22 bp, Artificial Sequence
  chemically synthesized
tgtgtgtgtgtgtgtgtgtgtg

SEQ ID NO: 894362 - DNA, 22 bp, Artificial Sequence
  chemically synthesized
tgtgcgcgcgtgcgtgcacaca

SEQ ID NO: 894363 - DNA, 22 bp, Artificial Sequence
  chemically synthesized
catcacacatacctgtgtgcgc

SEQ ID NO: 894364 - DNA, 22 bp, Artificial Sequence
  chemically synthesized
taacatcacctacatcacacat

SEQ ID NO: 894365 - DNA, 22 bp, Artificial Sequence
  chemically synthesized
gtaacatcacctacatcacaca

SEQ ID NO: 894366 - DNA, 22 bp, Artificial Sequence
  chemically synthesized
cagacgtaggagtatatttgta

SEQ ID NO: 894367 - DNA, 22 bp, Artificial Sequence
  chemically synthesized
gatcatgtattacagacgtagg

SEQ ID NO: 894368 - DNA, 22 bp, Artificial Sequence
  chemically synthesized
caaatatactcctacgtctgta

SEQ ID NO: 894369 - DNA, 22 bp, Artificial Sequence
  chemically synthesized
aggacatcattagatcatgtat

SEQ ID NO: 894370 - DNA, 22 bp, Artificial Sequence
  chemically synthesized
ctacgtctgtaatacatgatct

SEQ ID NO: 894371 - DNA, 22 bp, Artificial Sequence
  chemically synthesized
cgtctgtaatacatgatctaat

SEQ ID NO: 894372 - DNA, 22 bp, Artificial Sequence
  chemically synthesized
taatacatgatctaatgatgtc

SEQ ID NO: 894373 - DNA, 22 bp, Artificial Sequence
  chemically synthesized
aaaaataagttgaggacatcat

SEQ ID NO: 894374 - DNA, 22 bp, Artificial Sequence
  chemically synthesized
gaaaaataagttgaggacatca

SEQ ID NO: 894375 - DNA, 22 bp, Artificial Sequence
  chemically synthesized
aaatgcttgaaaaataagttga

SEQ ID NO: 894376 - DNA, 22 bp, Artificial Sequence
  chemically synthesized
aaaatgcttgaaaaataagttg

SEQ ID NO: 894377 - DNA, 22 bp, Artificial Sequence
  chemically synthesized
taaaatgcttgaaaaataagtt

SEQ ID NO: 894378 - DNA, 22 bp, Artificial Sequence
  chemically synthesized
atgatgtcctcaacttattttt

SEQ ID NO: 894379 - DNA, 22 bp, Artificial Sequence
  chemically synthesized
ctttaaaatgcttgaaaaataa

SEQ ID NO: 894380 - DNA, 22 bp, Artificial Sequence
  chemically synthesized
cctcctttaaaatgcttgaaaa

SEQ ID NO: 894381 - DNA, 22 bp, Artificial Sequence
  chemically synthesized
gttacctcctttaaaatgcttg

SEQ ID NO: 894382 - DNA, 22 bp, Artificial Sequence
  chemically synthesized
aacttatttttcaagcatttta

SEQ ID NO: 894383 - DNA, 22 bp, Artificial Sequence
  chemically synthesized
agttacctcctttaaaatgctt

SEQ ID NO: 894384 - DNA, 22 bp, Artificial Sequence
  chemically synthesized
atttttcaagcattttaaagga

SEQ ID NO: 894385 - DNA, 22 bp, Artificial Sequence
  chemically synthesized
tttttcaagcattttaaaggag

SEQ ID NO: 894386 - DNA, 22 bp, Artificial Sequence
  chemically synthesized
ttcaagcattttaaaggaggta

SEQ ID NO: 894387 - DNA, 22 bp, Artificial Sequence
  chemically synthesized
tcaagcattttaaaggaggtaa

SEQ ID NO: 894388 - DNA, 22 bp, Artificial Sequence
  chemically synthesized
caagcattttaaaggaggtaac

SEQ ID NO: 894389 - DNA, 22 bp, Artificial Sequence
  chemically synthesized
aagcattttaaaggaggtaact

SEQ ID NO: 894390 - DNA, 22 bp, Artificial Sequence
  chemically synthesized
taaaggaggtaactaaacattt

SEQ ID NO: 894391 - DNA, 22 bp, Artificial Sequence
  chemically synthesized
aaaggaggtaactaaacatttt

SEQ ID NO: 894392 - DNA, 22 bp, Artificial Sequence
  chemically synthesized
aaggaggtaactaaacatttta

SEQ ID NO: 894393 - DNA, 22 bp, Artificial Sequence
  chemically synthesized
aacattttatttttattggatc

SEQ ID NO: 894394 - DNA, 22 bp, Artificial Sequence
  chemically synthesized
tgagtagaaaatgatccaataa

SEQ ID NO: 894395 - DNA, 22 bp, Artificial Sequence
  chemically synthesized
gtgagtagaaaatgatccaata

SEQ ID NO: 894396 - DNA, 22 bp, Artificial Sequence
  chemically synthesized
cttgtgagtagaaaatgatcca

SEQ ID NO: 894397 - DNA, 22 bp, Artificial Sequence
  chemically synthesized
tatttttattggatcattttct

SEQ ID NO: 894398 - DNA, 22 bp, Artificial Sequence
  chemically synthesized
atttttattggatcattttcta

SEQ ID NO: 894399 - DNA, 22 bp, Artificial Sequence
  chemically synthesized
tttttattggatcattttctac

SEQ ID NO: 894400 - DNA, 22 bp, Artificial Sequence
  chemically synthesized
catctacttgtgagtagaaaat

SEQ ID NO: 894401 - DNA, 22 bp, Artificial Sequence
  chemically synthesized
acatctacttgtgagtagaaaa

SEQ ID NO: 894402 - DNA, 22 bp, Artificial Sequence
  chemically synthesized
ttattggatcattttctactca

SEQ ID NO: 894403 - DNA, 22 bp, Artificial Sequence
  chemically synthesized
tacatctacttgtgagtagaaa

SEQ ID NO: 894404 - DNA, 22 bp, Artificial Sequence
  chemically synthesized
tattggatcattttctactcac

SEQ ID NO: 894405 - DNA, 22 bp, Artificial Sequence
  chemically synthesized
ttacatctacttgtgagtagaa

SEQ ID NO: 894406 - DNA, 22 bp, Artificial Sequence
  chemically synthesized
attggatcattttctactcaca

SEQ ID NO: 894407 - DNA, 22 bp, Artificial Sequence
  chemically synthesized
tttacatctacttgtgagtaga

SEQ ID NO: 894408 - DNA, 22 bp, Artificial Sequence
  chemically synthesized
ttggatcattttctactcacaa

SEQ ID NO: 894409 - DNA, 22 bp, Artificial Sequence
  chemically synthesized
gatcattttctactcacaagta

SEQ ID NO: 894410 - DNA, 22 bp, Artificial Sequence
  chemically synthesized
taaaacgctttttacatctact

SEQ ID NO: 894411 - DNA, 22 bp, Artificial Sequence
  chemically synthesized
tctactcacaagtagatgtaaa

SEQ ID NO: 894412 - DNA, 22 bp, Artificial Sequence
  chemically synthesized
ctactcacaagtagatgtaaaa

SEQ ID NO: 894413 - DNA, 22 bp, Artificial Sequence
  chemically synthesized
tactcacaagtagatgtaaaaa

SEQ ID NO: 894414 - DNA, 22 bp, Artificial Sequence
  chemically synthesized
ctcacaagtagatgtaaaaagc

SEQ ID NO: 894415 - DNA, 22 bp, Artificial Sequence
  chemically synthesized
aagctgtaaaacgctttttaca

SEQ ID NO: 894416 - DNA, 22 bp, Artificial Sequence
  chemically synthesized
acaagtagatgtaaaaagcgtt

SEQ ID NO: 894417 - DNA, 22 bp, Artificial Sequence
  chemically synthesized
gttgaagctgtaaaacgctttt

SEQ ID NO: 894418 - DNA, 22 bp, Artificial Sequence
  chemically synthesized
ttagttgaagctgtaaaacgct

SEQ ID NO: 894419 - DNA, 22 bp, Artificial Sequence
  chemically synthesized
gatgttgttagttgaagctgta

SEQ ID NO: 894420 - DNA, 22 bp, Artificial Sequence
  chemically synthesized
agatgttgttagttgaagctgt

SEQ ID NO: 894421 - DNA, 22 bp, Artificial Sequence
  chemically synthesized
gaggcatttagatgttgttagt

SEQ ID NO: 894422 - DNA, 22 bp, Artificial Sequence
  chemically synthesized
tacagcttcaactaacaacatc

SEQ ID NO: 894423 - DNA, 22 bp, Artificial Sequence
  chemically synthesized
acagcttcaactaacaacatct

SEQ ID NO: 894424 - DNA, 22 bp, Artificial Sequence
  chemically synthesized
cagcttcaactaacaacatcta

SEQ ID NO: 894425 - DNA, 22 bp, Artificial Sequence
  chemically synthesized
agagtctagaggcatttagatg

SEQ ID NO: 894426 - DNA, 22 bp, Artificial Sequence
  chemically synthesized
cagagtctagaggcatttagat

SEQ ID NO: 894427 - DNA, 22 bp, Artificial Sequence
  chemically synthesized
caactaacaacatctaaatgcc

SEQ ID NO: 894428 - DNA, 22 bp, Artificial Sequence
  chemically synthesized
aactaacaacatctaaatgcct

SEQ ID NO: 894429 - DNA, 22 bp, Artificial Sequence
  chemically synthesized
acaacatctaaatgcctctaga

SEQ ID NO: 894430 - DNA, 22 bp, Artificial Sequence
  chemically synthesized
agtagcttcagagtctagaggc

SEQ ID NO: 894431 - DNA, 22 bp, Artificial Sequence
  chemically synthesized
tctcagtagcttcagagtctag

SEQ ID NO: 894432 - DNA, 22 bp, Artificial Sequence
  chemically synthesized
ttatctcagtagcttcagagtc

SEQ ID NO: 894433 - DNA, 22 bp, Artificial Sequence
  chemically synthesized
aatgcctctagactctgaagct

SEQ ID NO: 894434 - DNA, 22 bp, Artificial Sequence
  chemically synthesized
tagactctgaagctactgagat

SEQ ID NO: 894435 - DNA, 22 bp, Artificial Sequence
  chemically synthesized
gactctgaagctactgagataa

SEQ ID NO: 894436 - DNA, 22 bp, Artificial Sequence
  chemically synthesized
tgaagctactgagataatagcc

SEQ ID NO: 894437 - DNA, 22 bp, Artificial Sequence
  chemically synthesized
ggaaaatatgatggctattatc

SEQ ID NO: 894438 - DNA, 22 bp, Artificial Sequence
  chemically synthesized
aggaaaatatgatggctattat

SEQ ID NO: 894439 - DNA, 22 bp, Artificial Sequence
  chemically synthesized
aagctactgagataatagccat

SEQ ID NO: 894440 - DNA, 22 bp, Artificial Sequence
  chemically synthesized
taggaaaatatgatggctatta

SEQ ID NO: 894441 - DNA, 22 bp, Artificial Sequence
  chemically synthesized
ctgagataatagccatcatatt

SEQ ID NO: 894442 - DNA, 22 bp, Artificial Sequence
  chemically synthesized
gagattttaggaaaatatgatg

SEQ ID NO: 894443 - DNA, 22 bp, Artificial Sequence
  chemically synthesized
agagattttaggaaaatatgat

SEQ ID NO: 894444 - DNA, 22 bp, Artificial Sequence
  chemically synthesized
agataatagccatcatattttc

SEQ ID NO: 894445 - DNA, 22 bp, Artificial Sequence
  chemically synthesized
tagagattttaggaaaatatga

SEQ ID NO: 894446 - DNA, 22 bp, Artificial Sequence
  chemically synthesized
agttttagagattttaggaaaa

SEQ ID NO: 894447 - DNA, 22 bp, Artificial Sequence
  chemically synthesized
atcgctcagttttagagatttt

SEQ ID NO: 894448 - DNA, 22 bp, Artificial Sequence
  chemically synthesized
tcctaaaatctctaaaactgag

SEQ ID NO: 894449 - DNA, 22 bp, Artificial Sequence
  chemically synthesized
cctaaaatctctaaaactgagc

SEQ ID NO: 894450 - DNA, 22 bp, Artificial Sequence
  chemically synthesized
ctaaaatctctaaaactgagcg

SEQ ID NO: 894451 - DNA, 22 bp, Artificial Sequence
  chemically synthesized
aaatctctaaaactgagcgatg

SEQ ID NO: 894452 - DNA, 22 bp, Artificial Sequence
  chemically synthesized
taaaactgagcgatgaactcct

SEQ ID NO: 894453 - DNA, 22 bp, Artificial Sequence
  chemically synthesized
aaactgagcgatgaactccttt

SEQ ID NO: 894454 - DNA, 22 bp, Artificial Sequence
  chemically synthesized
atgatcagataaaaaggagttc

SEQ ID NO: 894455 - DNA, 22 bp, Artificial Sequence
  chemically synthesized
catgatcagataaaaaggagtt

SEQ ID NO: 894456 - DNA, 22 bp, Artificial Sequence
  chemically synthesized
agcgatgaactcctttttatct

SEQ ID NO: 894457 - DNA, 22 bp, Artificial Sequence
  chemically synthesized
ctttttatctgatcatgaaatt

SEQ ID NO: 894458 - DNA, 22 bp, Artificial Sequence
  chemically synthesized
aatgaaacgtgaacaatttcat

SEQ ID NO: 894459 - DNA, 22 bp, Artificial Sequence
  chemically synthesized
tttatctgatcatgaaattgtt

SEQ ID NO: 894460 - DNA, 22 bp, Artificial Sequence
  chemically synthesized
ttatctgatcatgaaattgttc

SEQ ID NO: 894461 - DNA, 22 bp, Artificial Sequence
  chemically synthesized
tatctgatcatgaaattgttca

SEQ ID NO: 894462 - DNA, 22 bp, Artificial Sequence
  chemically synthesized
atctgatcatgaaattgttcac

SEQ ID NO: 894463 - DNA, 22 bp, Artificial Sequence
  chemically synthesized
tctgatcatgaaattgttcacg

SEQ ID NO: 894464 - DNA, 22 bp, Artificial Sequence
  chemically synthesized
atcatgaaattgttcacgtttc

SEQ ID NO: 894465 - DNA, 22 bp, Artificial Sequence
  chemically synthesized
tatatgaagcctaaatgaaacg

SEQ ID NO: 894466 - DNA, 22 bp, Artificial Sequence
  chemically synthesized
atatatgaagcctaaatgaaac

SEQ ID NO: 894467 - DNA, 22 bp, Artificial Sequence
  chemically synthesized
tgcttatatatgaagcctaaat

SEQ ID NO: 894468 - DNA, 22 bp, Artificial Sequence
  chemically synthesized
ttcacgtttcatttaggcttca

SEQ ID NO: 894469 - DNA, 22 bp, Artificial Sequence
  chemically synthesized
tgtgcttatatatgaagcctaa

SEQ ID NO: 894470 - DNA, 22 bp, Artificial Sequence
  chemically synthesized
ctgtgcttatatatgaagccta

SEQ ID NO: 894471 - DNA, 22 bp, Artificial Sequence
  chemically synthesized
acgtttcatttaggcttcatat

SEQ ID NO: 894472 - DNA, 22 bp, Artificial Sequence
  chemically synthesized
catttaggcttcatatataagc

SEQ ID NO: 894473 - DNA, 22 bp, Artificial Sequence
  chemically synthesized
atttaggcttcatatataagca

SEQ ID NO: 894474 - DNA, 22 bp, Artificial Sequence
  chemically synthesized
tacagatttctgtgcttatata

SEQ ID NO: 894475 - DNA, 22 bp, Artificial Sequence
  chemically synthesized
aggcttcatatataagcacaga

SEQ ID NO: 894476 - DNA, 22 bp, Artificial Sequence
  chemically synthesized
ggcttcatatataagcacagaa

SEQ ID NO: 894477 - DNA, 22 bp, Artificial Sequence
  chemically synthesized
aatgttatacagatttctgtgc

SEQ ID NO: 894478 - DNA, 22 bp, Artificial Sequence
  chemically synthesized
catatataagcacagaaatctg

SEQ ID NO: 894479 - DNA, 22 bp, Artificial Sequence
  chemically synthesized
atatataagcacagaaatctgt

SEQ ID NO: 894480 - DNA, 22 bp, Artificial Sequence
  chemically synthesized
gttaaatgttatacagatttct

SEQ ID NO: 894481 - DNA, 22 bp, Artificial Sequence
  chemically synthesized
agttaaatgttatacagatttc

SEQ ID NO: 894482 - DNA, 22 bp, Artificial Sequence
  chemically synthesized
tataacatttaactaagactgc

SEQ ID NO: 894483 - DNA, 22 bp, Artificial Sequence
  chemically synthesized
aactaagactgctggtttcctt

SEQ ID NO: 894484 - DNA, 22 bp, Artificial Sequence
  chemically synthesized
actaagactgctggtttcctta

SEQ ID NO: 894485 - DNA, 22 bp, Artificial Sequence
  chemically synthesized
agactgctggtttccttatcat

SEQ ID NO: 894486 - DNA, 22 bp, Artificial Sequence
  chemically synthesized
ctggtttccttatcatcctccc

SEQ ID NO: 894487 - DNA, 22 bp, Artificial Sequence
  chemically synthesized
gtttccttatcatcctcccata

SEQ ID NO: 894488 - DNA, 22 bp, Artificial Sequence
  chemically synthesized
caaggaagggatagtatgggag

SEQ ID NO: 894489 - DNA, 22 bp, Artificial Sequence
  chemically synthesized
ccttatcatcctcccatactat

SEQ ID NO: 894490 - DNA, 22 bp, Artificial Sequence
  chemically synthesized
cttatcatcctcccatactatc

SEQ ID NO: 894491 - DNA, 22 bp, Artificial Sequence
  chemically synthesized
ttacaaggaagggatagtatgg

SEQ ID NO: 894492 - DNA, 22 bp, Artificial Sequence
  chemically synthesized
tattacaaggaagggatagtat

SEQ ID NO: 894493 - DNA, 22 bp, Artificial Sequence
  chemically synthesized
atcatcctcccatactatccct

SEQ ID NO: 894494 - DNA, 22 bp, Artificial Sequence
  chemically synthesized
tcatcctcccatactatccctt

SEQ ID NO: 894495 - DNA, 22 bp, Artificial Sequence
  chemically synthesized
cctctattacaaggaagggata

SEQ ID NO: 894496 - DNA, 22 bp, Artificial Sequence
  chemically synthesized
acctctattacaaggaagggat

SEQ ID NO: 894497 - DNA, 22 bp, Artificial Sequence
  chemically synthesized
tacctctattacaaggaaggga

SEQ ID NO: 894498 - DNA, 22 bp, Artificial Sequence
  chemically synthesized
ttttacctctattacaaggaag

SEQ ID NO: 894499 - DNA, 22 bp, Artificial Sequence
  chemically synthesized
ccatactatcccttccttgtaa

SEQ ID NO: 894500 - DNA, 22 bp, Artificial Sequence
  chemically synthesized
tcccttccttgtaatagaggta

SEQ ID NO: 894501 - DNA, 22 bp, Artificial Sequence
  chemically synthesized
tcaggaattgttttacctctat

SEQ ID NO: 894502 - DNA, 22 bp, Artificial Sequence
  chemically synthesized
tgtcaggaattgttttacctct

SEQ ID NO: 894503 - DNA, 22 bp, Artificial Sequence
  chemically synthesized
ctgtcaggaattgttttacctc

SEQ ID NO: 894504 - DNA, 22 bp, Artificial Sequence
  chemically synthesized
tctgtcaggaattgttttacct

SEQ ID NO: 894505 - DNA, 22 bp, Artificial Sequence
  chemically synthesized
ccttgtaatagaggtaaaacaa

SEQ ID NO: 894506 - DNA, 22 bp, Artificial Sequence
  chemically synthesized
cttgtaatagaggtaaaacaat

SEQ ID NO: 894507 - DNA, 22 bp, Artificial Sequence
  chemically synthesized
ttttctgtcaggaattgtttta

SEQ ID NO: 894508 - DNA, 22 bp, Artificial Sequence
  chemically synthesized
gtaatagaggtaaaacaattcc

SEQ ID NO: 894509 - DNA, 22 bp, Artificial Sequence
  chemically synthesized
taatagaggtaaaacaattcct

SEQ ID NO: 894510 - DNA, 22 bp, Artificial Sequence
  chemically synthesized
cactgttttctgtcaggaattg

SEQ ID NO: 894511 - DNA, 22 bp, Artificial Sequence
  chemically synthesized
acccattacactgttttctgtc

SEQ ID NO: 894512 - DNA, 22 bp, Artificial Sequence
  chemically synthesized
ctgacagaaaacagtgtaatgg

SEQ ID NO: 894513 - DNA, 22 bp, Artificial Sequence
  chemically synthesized
gtcaaatctgacccattacact

SEQ ID NO: 894514 - DNA, 22 bp, Artificial Sequence
  chemically synthesized
acagaaaacagtgtaatgggtc

SEQ ID NO: 894515 - DNA, 22 bp, Artificial Sequence
  chemically synthesized
cagatattagtcaaatctgacc

SEQ ID NO: 894516 - DNA, 22 bp, Artificial Sequence
  chemically synthesized
ttccagatattagtcaaatctg

SEQ ID NO: 894517 - DNA, 22 bp, Artificial Sequence
  chemically synthesized
attattccagatattagtcaaa

SEQ ID NO: 894518 - DNA, 22 bp, Artificial Sequence
  chemically synthesized
cattattccagatattagtcaa

SEQ ID NO: 894519 - DNA, 22 bp, Artificial Sequence
  chemically synthesized
tcatttcattattccagatatt

SEQ ID NO: 894520 - DNA, 22 bp, Artificial Sequence
  chemically synthesized
gactaatatctggaataatgaa

SEQ ID NO: 894521 - DNA, 22 bp, Artificial Sequence
  chemically synthesized
actaatatctggaataatgaaa

SEQ ID NO: 894522 - DNA, 22 bp, Artificial Sequence
  chemically synthesized
atgataagctatcatttcatta

SEQ ID NO: 894523 - DNA, 22 bp, Artificial Sequence
  chemically synthesized
atatctggaataatgaaatgat

SEQ ID NO: 894524 - DNA, 22 bp, Artificial Sequence
  chemically synthesized
gtctcatgataagctatcattt

SEQ ID NO: 894525 - DNA, 22 bp, Artificial Sequence
  chemically synthesized
cgtctcatgataagctatcatt

SEQ ID NO: 894526 - DNA, 22 bp, Artificial Sequence
  chemically synthesized
gaataatgaaatgatagcttat

SEQ ID NO: 894527 - DNA, 22 bp, Artificial Sequence
  chemically synthesized
aaaatttcgtctcatgataagc

SEQ ID NO: 894528 - DNA, 22 bp, Artificial Sequence
  chemically synthesized
agctgaaaatttcgtctcatga

SEQ ID NO: 894529 - DNA, 22 bp, Artificial Sequence
  chemically synthesized
atcatgagacgaaattttcagc

SEQ ID NO: 894530 - DNA, 22 bp, Artificial Sequence
  chemically synthesized
tcatgagacgaaattttcagct

SEQ ID NO: 894531 - DNA, 22 bp, Artificial Sequence
  chemically synthesized
aagcaacatcataattaagctg

SEQ ID NO: 894532 - DNA, 22 bp, Artificial Sequence
  chemically synthesized
tcagcttaattatgatgttgct

SEQ ID NO: 894533 - DNA, 22 bp, Artificial Sequence
  chemically synthesized
cagcttaattatgatgttgctt

SEQ ID NO: 894534 - DNA, 22 bp, Artificial Sequence
  chemically synthesized
agcttaattatgatgttgcttt

SEQ ID NO: 894535 - DNA, 22 bp, Artificial Sequence
  chemically synthesized
agaggataaacctaaagcaaca

SEQ ID NO: 894536 - DNA, 22 bp, Artificial Sequence
  chemically synthesized
aattatgatgttgctttaggtt

SEQ ID NO: 894537 - DNA, 22 bp, Artificial Sequence
  chemically synthesized
attatgatgttgctttaggttt

SEQ ID NO: 894538 - DNA, 22 bp, Artificial Sequence
  chemically synthesized
tgatgttgctttaggtttatcc

SEQ ID NO: 894539 - DNA, 22 bp, Artificial Sequence
  chemically synthesized
ctttaggtttatcctctcagat

SEQ ID NO: 894540 - DNA, 22 bp, Artificial Sequence
  chemically synthesized
taggtttatcctctcagatctt

SEQ ID NO: 894541 - DNA, 22 bp, Artificial Sequence
  chemically synthesized
aggtttatcctctcagatcttg

SEQ ID NO: 894542 - DNA, 22 bp, Artificial Sequence
  chemically synthesized
ggtttatcctctcagatcttgt

SEQ ID NO: 894543 - DNA, 22 bp, Artificial Sequence
  chemically synthesized
tgatggtgggaaagacaagatc

SEQ ID NO: 894544 - DNA, 22 bp, Artificial Sequence
  chemically synthesized
atcctctcagatcttgtctttc

SEQ ID NO: 894545 - DNA, 22 bp, Artificial Sequence
  chemically synthesized
tcctctcagatcttgtctttcc

SEQ ID NO: 894546 - DNA, 22 bp, Artificial Sequence
  chemically synthesized
tcagatcttgtctttcccacca

SEQ ID NO: 894547 - DNA, 22 bp, Artificial Sequence
  chemically synthesized
agatcttgtctttcccaccatc

SEQ ID NO: 894548 - DNA, 22 bp, Artificial Sequence
  chemically synthesized
gtctttcccaccatcataacat

SEQ ID NO: 894549 - DNA, 22 bp, Artificial Sequence
  chemically synthesized
tctttcccaccatcataacatt

SEQ ID NO: 894550 - DNA, 22 bp, Artificial Sequence
  chemically synthesized
aatagcatgaggtaaatgttat

SEQ ID NO: 894551 - DNA, 22 bp, Artificial Sequence
  chemically synthesized
tcccaccatcataacatttacc

SEQ ID NO: 894552 - DNA, 22 bp, Artificial Sequence
  chemically synthesized
cccaccatcataacatttacct

SEQ ID NO: 894553 - DNA, 22 bp, Artificial Sequence
  chemically synthesized
ccaccatcataacatttacctc

SEQ ID NO: 894554 - DNA, 22 bp, Artificial Sequence
  chemically synthesized
acctcatgctatttaactttct

SEQ ID NO: 894555 - DNA, 22 bp, Artificial Sequence
  chemically synthesized
cctcatgctatttaactttcta

SEQ ID NO: 894556 - DNA, 22 bp, Artificial Sequence
  chemically synthesized
atgctatttaactttctattta

SEQ ID NO: 894557 - DNA, 22 bp, Artificial Sequence
  chemically synthesized
tttaactttctatttacattgc

SEQ ID NO: 894558 - DNA, 22 bp, Artificial Sequence
  chemically synthesized
aactttctatttacattgctcc

SEQ ID NO: 894559 - DNA, 22 bp, Artificial Sequence
  chemically synthesized
actttctatttacattgctcct

SEQ ID NO: 894560 - DNA, 22 bp, Artificial Sequence
  chemically synthesized
tctatttacattgctccttctc

SEQ ID NO: 894561 - DNA, 22 bp, Artificial Sequence
  chemically synthesized
ctatttacattgctccttctca

SEQ ID NO: 894562 - DNA, 22 bp, Artificial Sequence
  chemically synthesized
tatttacattgctccttctcac

SEQ ID NO: 894563 - DNA, 22 bp, Artificial Sequence
  chemically synthesized
tttacattgctccttctcactg

SEQ ID NO: 894564 - DNA, 22 bp, Artificial Sequence
  chemically synthesized
acattgctccttctcactgacc

SEQ ID NO: 894565 - DNA, 22 bp, Artificial Sequence
  chemically synthesized
cattgctccttctcactgacct

SEQ ID NO: 894566 - DNA, 22 bp, Artificial Sequence
  chemically synthesized
acccagaaatcaaaggtcagtg

SEQ ID NO: 894567 - DNA, 22 bp, Artificial Sequence
  chemically synthesized
gacccagaaatcaaaggtcagt

SEQ ID NO: 894568 - DNA, 22 bp, Artificial Sequence
  chemically synthesized
ctccttctcactgacctttgat

SEQ ID NO: 894569 - DNA, 22 bp, Artificial Sequence
  chemically synthesized
tttgacccagaaatcaaaggtc

SEQ ID NO: 894570 - DNA, 22 bp, Artificial Sequence
  chemically synthesized
gtttgacccagaaatcaaaggt

SEQ ID NO: 894571 - DNA, 22 bp, Artificial Sequence
  chemically synthesized
cttctcactgacctttgatttc

SEQ ID NO: 894572 - DNA, 22 bp, Artificial Sequence
  chemically synthesized
ctcactgacctttgatttctgg

SEQ ID NO: 894573 - DNA, 22 bp, Artificial Sequence
  chemically synthesized
tcactgacctttgatttctggg

SEQ ID NO: 894574 - DNA, 22 bp, Artificial Sequence
  chemically synthesized
actgacctttgatttctgggtc

SEQ ID NO: 894575 - DNA, 22 bp, Artificial Sequence
  chemically synthesized
acctttgatttctgggtcaaac

SEQ ID NO: 894576 - DNA, 22 bp, Artificial Sequence
  chemically synthesized
ggaacagagcttgtttgaccca

SEQ ID NO: 894577 - DNA, 22 bp, Artificial Sequence
  chemically synthesized
aggaacagagcttgtttgaccc

SEQ ID NO: 894578 - DNA, 22 bp, Artificial Sequence
  chemically synthesized
tgatttctgggtcaaacaagct

SEQ ID NO: 894579 - DNA, 22 bp, Artificial Sequence
  chemically synthesized
gatttctgggtcaaacaagctc

SEQ ID NO: 894580 - DNA, 22 bp, Artificial Sequence
  chemically synthesized
atttctgggtcaaacaagctct

SEQ ID NO: 894581 - DNA, 22 bp, Artificial Sequence
  chemically synthesized
ctgggtcaaacaagctctgttc

SEQ ID NO: 894582 - DNA, 22 bp, Artificial Sequence
  chemically synthesized
tgggtcaaacaagctctgttcc

SEQ ID NO: 894583 - DNA, 22 bp, Artificial Sequence
  chemically synthesized
ggtcaaacaagctctgttccta

SEQ ID NO: 894584 - DNA, 22 bp, Artificial Sequence
  chemically synthesized
gtgaaggtccatcatatttagg

SEQ ID NO: 894585 - DNA, 22 bp, Artificial Sequence
  chemically synthesized
ggtgaaggtccatcatatttag

SEQ ID NO: 894586 - DNA, 22 bp, Artificial Sequence
  chemically synthesized
tggtgaaggtccatcatattta

SEQ ID NO: 894587 - DNA, 22 bp, Artificial Sequence
  chemically synthesized
ttggtgaaggtccatcatattt

SEQ ID NO: 894588 - DNA, 22 bp, Artificial Sequence
  chemically synthesized
tgttcctaaatatgatggacct

SEQ ID NO: 894589 - DNA, 22 bp, Artificial Sequence
  chemically synthesized
ttcctaaatatgatggaccttc

SEQ ID NO: 894590 - DNA, 22 bp, Artificial Sequence
  chemically synthesized
acaaacttttggtgaaggtcca

SEQ ID NO: 894591 - DNA, 22 bp, Artificial Sequence
  chemically synthesized
aacaaacttttggtgaaggtcc

SEQ ID NO: 894592 - DNA, 22 bp, Artificial Sequence
  chemically synthesized
ctaaatatgatggaccttcacc

SEQ ID NO: 894593 - DNA, 22 bp, Artificial Sequence
  chemically synthesized
taacaaacttttggtgaaggtc

SEQ ID NO: 894594 - DNA, 22 bp, Artificial Sequence
  chemically synthesized
ttaacaaacttttggtgaaggt

SEQ ID NO: 894595 - DNA, 22 bp, Artificial Sequence
  chemically synthesized
aatatgatggaccttcaccaaa

SEQ ID NO: 894596 - DNA, 22 bp, Artificial Sequence
  chemically synthesized
tttttaacaaacttttggtgaa

SEQ ID NO: 894597 - DNA, 22 bp, Artificial Sequence
  chemically synthesized
gaaattgtttttaacaaacttt

SEQ ID NO: 894598 - DNA, 22 bp, Artificial Sequence
  chemically synthesized
ggaaattgtttttaacaaactt

SEQ ID NO: 894599 - DNA, 22 bp, Artificial Sequence
  chemically synthesized
aatttggaaattgtttttaaca

SEQ ID NO: 894600 - DNA, 22 bp, Artificial Sequence
  chemically synthesized
caccaaaagtttgttaaaaaca

SEQ ID NO: 894601 - DNA, 22 bp, Artificial Sequence
  chemically synthesized
accaaaagtttgttaaaaacaa

SEQ ID NO: 894602 - DNA, 22 bp, Artificial Sequence
  chemically synthesized
gttaaaaacaatttccaaattc

SEQ ID NO: 894603 - DNA, 22 bp, Artificial Sequence
  chemically synthesized
ttaaaaacaatttccaaattca

SEQ ID NO: 894604 - DNA, 22 bp, Artificial Sequence
  chemically synthesized
aaaacaatttccaaattcagga

SEQ ID NO: 894605 - DNA, 22 bp, Artificial Sequence
  chemically synthesized
aaaaaataataatcctgaattt

SEQ ID NO: 894606 - DNA, 22 bp, Artificial Sequence
  chemically synthesized
cattgaaaaaataataatcctg

SEQ ID NO: 894607 - DNA, 22 bp, Artificial Sequence
  chemically synthesized
acattgaaaaaataataatcct

SEQ ID NO: 894608 - DNA, 22 bp, Artificial Sequence
  chemically synthesized
ttacattgaaaaaataataatc

SEQ ID NO: 894609 - DNA, 22 bp, Artificial Sequence
  chemically synthesized
cttacattgaaaaaataataat

SEQ ID NO: 894610 - DNA, 22 bp, Artificial Sequence
  chemically synthesized
ccaaattcaggattattatttt

SEQ ID NO: 894611 - DNA, 22 bp, Artificial Sequence
  chemically synthesized
caaattcaggattattattttt

SEQ ID NO: 894612 - DNA, 22 bp, Artificial Sequence
  chemically synthesized
cttcttacattgaaaaaataat

SEQ ID NO: 894613 - DNA, 22 bp, Artificial Sequence
  chemically synthesized
aggattattattttttcaatgt

SEQ ID NO: 894614 - DNA, 22 bp, Artificial Sequence
  chemically synthesized
ttattttttcaatgtaagaagc

SEQ ID NO: 894615 - DNA, 22 bp, Artificial Sequence
  chemically synthesized
tagacatatactgcttcttaca

SEQ ID NO: 894616 - DNA, 22 bp, Artificial Sequence
  chemically synthesized
ttttttcaatgtaagaagcagt

SEQ ID NO: 894617 - DNA, 22 bp, Artificial Sequence
  chemically synthesized
ctatagacatatactgcttctt

SEQ ID NO: 894618 - DNA, 22 bp, Artificial Sequence
  chemically synthesized
tttcaatgtaagaagcagtata

SEQ ID NO: 894619 - DNA, 22 bp, Artificial Sequence
  chemically synthesized
ttcaatgtaagaagcagtatat

SEQ ID NO: 894620 - DNA, 22 bp, Artificial Sequence
  chemically synthesized
actactatagacatatactgct

SEQ ID NO: 894621 - DNA, 22 bp, Artificial Sequence
  chemically synthesized
tcaatgtaagaagcagtatatg

SEQ ID NO: 894622 - DNA, 22 bp, Artificial Sequence
  chemically synthesized
caatgtaagaagcagtatatgt

SEQ ID NO: 894623 - DNA, 22 bp, Artificial Sequence
  chemically synthesized
aatgtaagaagcagtatatgtc

SEQ ID NO: 894624 - DNA, 22 bp, Artificial Sequence
  chemically synthesized
tggttgactactatagacatat

SEQ ID NO: 894625 - DNA, 22 bp, Artificial Sequence
  chemically synthesized
gtggttgactactatagacata

SEQ ID NO: 894626 - DNA, 22 bp, Artificial Sequence
  chemically synthesized
tgtggttgactactatagacat

SEQ ID NO: 894627 - DNA, 22 bp, Artificial Sequence
  chemically synthesized
ttgtggttgactactatagaca

SEQ ID NO: 894628 - DNA, 22 bp, Artificial Sequence
  chemically synthesized
tttgtggttgactactatagac

SEQ ID NO: 894629 - DNA, 22 bp, Artificial Sequence
  chemically synthesized
ttttgtggttgactactataga

SEQ ID NO: 894630 - DNA, 22 bp, Artificial Sequence
  chemically synthesized
catttttttgtggttgactact

SEQ ID NO: 894631 - DNA, 22 bp, Artificial Sequence
  chemically synthesized
acatttttttgtggttgactac

SEQ ID NO: 894632 - DNA, 22 bp, Artificial Sequence
  chemically synthesized
tagtagtcaaccacaaaaaaat

SEQ ID NO: 894633 - DNA, 22 bp, Artificial Sequence
  chemically synthesized
aggatacaatttacattttttt

SEQ ID NO: 894634 - DNA, 22 bp, Artificial Sequence
  chemically synthesized
gaggatacaatttacatttttt

SEQ ID NO: 894635 - DNA, 22 bp, Artificial Sequence
  chemically synthesized
acttgaggatacaatttacatt

SEQ ID NO: 894636 - DNA, 22 bp, Artificial Sequence
  chemically synthesized
aacttgaggatacaatttacat

SEQ ID NO: 894637 - DNA, 22 bp, Artificial Sequence
  chemically synthesized
tttaacttgaggatacaattta

SEQ ID NO: 894638 - DNA, 22 bp, Artificial Sequence
  chemically synthesized
aagttatttaacttgaggatac

SEQ ID NO: 894639 - DNA, 22 bp, Artificial Sequence
  chemically synthesized
attaaagttatttaacttgagg

SEQ ID NO: 894640 - DNA, 22 bp, Artificial Sequence
  chemically synthesized
ttaattaaagttatttaacttg

SEQ ID NO: 894641 - DNA, 22 bp, Artificial Sequence
  chemically synthesized
tctgttaattaaagttatttaa

SEQ ID NO: 894642 - DNA, 22 bp, Artificial Sequence
  chemically synthesized
gtctgttaattaaagttattta

SEQ ID NO: 894643 - DNA, 22 bp, Artificial Sequence
  chemically synthesized
tatcctcaagttaaataacttt

SEQ ID NO: 894644 - DNA, 22 bp, Artificial Sequence
  chemically synthesized
tgtctgttaattaaagttattt

SEQ ID NO: 894645 - DNA, 22 bp, Artificial Sequence
  chemically synthesized
ttgtctgttaattaaagttatt

SEQ ID NO: 894646 - DNA, 22 bp, Artificial Sequence
  chemically synthesized
aagttaaataactttaattaac

SEQ ID NO: 894647 - DNA, 22 bp, Artificial Sequence
  chemically synthesized
atatttttgtctgttaattaaa

SEQ ID NO: 894648 - DNA, 22 bp, Artificial Sequence
  chemically synthesized
ctgatatttttgtctgttaatt

SEQ ID NO: 894649 - DNA, 22 bp, Artificial Sequence
  chemically synthesized
actgatatttttgtctgttaat

SEQ ID NO: 894650 - DNA, 22 bp, Artificial Sequence
  chemically synthesized
aataactttaattaacagacaa

SEQ ID NO: 894651 - DNA, 22 bp, Artificial Sequence
  chemically synthesized
taattaacagacaaaaatatca

SEQ ID NO: 894652 - DNA, 22 bp, Artificial Sequence
  chemically synthesized
aattaacagacaaaaatatcag

SEQ ID NO: 894653 - DNA, 22 bp, Artificial Sequence
  chemically synthesized
attaacagacaaaaatatcagt

SEQ ID NO: 894654 - DNA, 22 bp, Artificial Sequence
  chemically synthesized
tatagtccagtttactgatatt

SEQ ID NO: 894655 - DNA, 22 bp, Artificial Sequence
  chemically synthesized
atatagtccagtttactgatat

SEQ ID NO: 894656 - DNA, 22 bp, Artificial Sequence
  chemically synthesized
tatatagtccagtttactgata

SEQ ID NO: 894657 - DNA, 22 bp, Artificial Sequence
  chemically synthesized
acagacaaaaatatcagtaaac

SEQ ID NO: 894658 - DNA, 22 bp, Artificial Sequence
  chemically synthesized
ttatatagtccagtttactgat

SEQ ID NO: 894659 - DNA, 22 bp, Artificial Sequence
  chemically synthesized
tttatatagtccagtttactga

SEQ ID NO: 894660 - DNA, 22 bp, Artificial Sequence
  chemically synthesized
attttttatatagtccagttta

SEQ ID NO: 894661 - DNA, 22 bp, Artificial Sequence
  chemically synthesized
gattttttatatagtccagttt

SEQ ID NO: 894662 - DNA, 22 bp, Artificial Sequence
  chemically synthesized
tgattttttatatagtccagtt

SEQ ID NO: 894663 - DNA, 22 bp, Artificial Sequence
  chemically synthesized
ttgattttttatatagtccagt

SEQ ID NO: 894664 - DNA, 22 bp, Artificial Sequence
  chemically synthesized
gtcgtgcagaagcttttgattt

SEQ ID NO: 894665 - DNA, 22 bp, Artificial Sequence
  chemically synthesized
gactatataaaaaatcaaaagc

SEQ ID NO: 894666 - DNA, 22 bp, Artificial Sequence
  chemically synthesized
ggtcgtgcagaagcttttgatt

SEQ ID NO: 894667 - DNA, 22 bp, Artificial Sequence
  chemically synthesized
tggtcgtgcagaagcttttgat

SEQ ID NO: 894668 - DNA, 22 bp, Artificial Sequence
  chemically synthesized
ttggtcgtgcagaagcttttga

SEQ ID NO: 894669 - DNA, 22 bp, Artificial Sequence
  chemically synthesized
ttttggtcgtgcagaagctttt

SEQ ID NO: 894670 - DNA, 22 bp, Artificial Sequence
  chemically synthesized
tataaaaaatcaaaagcttctg

SEQ ID NO: 894671 - DNA, 22 bp, Artificial Sequence
  chemically synthesized
tggctcttttggtcgtgcagaa

SEQ ID NO: 894672 - DNA, 22 bp, Artificial Sequence
  chemically synthesized
cctatggctcttttggtcgtgc

SEQ ID NO: 894673 - DNA, 22 bp, Artificial Sequence
  chemically synthesized
gcctatggctcttttggtcgtg

SEQ ID NO: 894674 - DNA, 22 bp, Artificial Sequence
  chemically synthesized
tgcctatggctcttttggtcgt

SEQ ID NO: 894675 - DNA, 22 bp, Artificial Sequence
  chemically synthesized
attttgcctatggctcttttgg

SEQ ID NO: 894676 - DNA, 22 bp, Artificial Sequence
  chemically synthesized
gattttgcctatggctcttttg

SEQ ID NO: 894677 - DNA, 22 bp, Artificial Sequence
  chemically synthesized
tgattttgcctatggctctttt

SEQ ID NO: 894678 - DNA, 22 bp, Artificial Sequence
  chemically synthesized
ttgattttgcctatggctcttt

SEQ ID NO: 894679 - DNA, 22 bp, Artificial Sequence
  chemically synthesized
ctgcacgaccaaaagagccata

SEQ ID NO: 894680 - DNA, 22 bp, Artificial Sequence
  chemically synthesized
tgcacgaccaaaagagccatag

SEQ ID NO: 894681 - DNA, 22 bp, Artificial Sequence
  chemically synthesized
tttttgattttgcctatggctc

SEQ ID NO: 894682 - DNA, 22 bp, Artificial Sequence
  chemically synthesized
cacgaccaaaagagccataggc

SEQ ID NO: 894683 - DNA, 22 bp, Artificial Sequence
  chemically synthesized
gtttttgattttgcctatggct

SEQ ID NO: 894684 - DNA, 22 bp, Artificial Sequence
  chemically synthesized
atttgtttttgattttgcctat

SEQ ID NO: 894685 - DNA, 22 bp, Artificial Sequence
  chemically synthesized
ttcatttgtttttgattttgcc

SEQ ID NO: 894686 - DNA, 22 bp, Artificial Sequence
  chemically synthesized
ataattgttcatttgtttttga

SEQ ID NO: 894687 - DNA, 22 bp, Artificial Sequence
  chemically synthesized
cataattgttcatttgtttttg

SEQ ID NO: 894688 - DNA, 22 bp, Artificial Sequence
  chemically synthesized
tcataattgttcatttgttttt

SEQ ID NO: 894689 - DNA, 22 bp, Artificial Sequence
  chemically synthesized
ttcataattgttcatttgtttt

SEQ ID NO: 894690 - DNA, 22 bp, Artificial Sequence
  chemically synthesized
tttttcataattgttcatttgt

SEQ ID NO: 894691 - DNA, 22 bp, Artificial Sequence
  chemically synthesized
atttttcataattgttcatttg

SEQ ID NO: 894692 - DNA, 22 bp, Artificial Sequence
  chemically synthesized
gacatgagtcacaagcatttat

SEQ ID NO: 894693 - DNA, 22 bp, Artificial Sequence
  chemically synthesized
agacatgagtcacaagcattta

SEQ ID NO: 894694 - DNA, 22 bp, Artificial Sequence
  chemically synthesized
tgaaaaataaatgcttgtgact

SEQ ID NO: 894695 - DNA, 22 bp, Artificial Sequence
  chemically synthesized
gtcccttagacatgagtcacaa

SEQ ID NO: 894696 - DNA, 22 bp, Artificial Sequence
  chemically synthesized
ggaaaattagtcccttagacat

SEQ ID NO: 894697 - DNA, 22 bp, Artificial Sequence
  chemically synthesized
gtgactcatgtctaagggacta

SEQ ID NO: 894698 - DNA, 22 bp, Artificial Sequence
  chemically synthesized
tgactcatgtctaagggactaa

SEQ ID NO: 894699 - DNA, 22 bp, Artificial Sequence
  chemically synthesized
atgtgttaggaaaattagtccc

SEQ ID NO: 894700 - DNA, 22 bp, Artificial Sequence
  chemically synthesized
catgtgttaggaaaattagtcc

SEQ ID NO: 894701 - DNA, 22 bp, Artificial Sequence
  chemically synthesized
tcatgtgttaggaaaattagtc

SEQ ID NO: 894702 - DNA, 22 bp, Artificial Sequence
  chemically synthesized
atgtctaagggactaattttcc

SEQ ID NO: 894703 - DNA, 22 bp, Artificial Sequence
  chemically synthesized
agggactaattttcctaacaca

SEQ ID NO: 894704 - DNA, 22 bp, Artificial Sequence
  chemically synthesized
cagaaggtctttcatgtgttag

SEQ ID NO: 894705 - DNA, 22 bp, Artificial Sequence
  chemically synthesized
gcagaaggtctttcatgtgtta

SEQ ID NO: 894706 - DNA, 22 bp, Artificial Sequence
  chemically synthesized
tgcagaaggtctttcatgtgtt

SEQ ID NO: 894707 - DNA, 22 bp, Artificial Sequence
  chemically synthesized
ctttgcagaaggtctttcatgt

SEQ ID NO: 894708 - DNA, 22 bp, Artificial Sequence
  chemically synthesized
attttcctaacacatgaaagac

SEQ ID NO: 894709 - DNA, 22 bp, Artificial Sequence
  chemically synthesized
ttactttgcagaaggtctttca

SEQ ID NO: 894710 - DNA, 22 bp, Artificial Sequence
  chemically synthesized
attactttgcagaaggtctttc

SEQ ID NO: 894711 - DNA, 22 bp, Artificial Sequence
  chemically synthesized
tcctaacacatgaaagaccttc

SEQ ID NO: 894712 - DNA, 22 bp, Artificial Sequence
  chemically synthesized
cctaacacatgaaagaccttct

SEQ ID NO: 894713 - DNA, 22 bp, Artificial Sequence
  chemically synthesized
ttattactttgcagaaggtctt

SEQ ID NO: 894714 - DNA, 22 bp, Artificial Sequence
  chemically synthesized
ctaacacatgaaagaccttctg

SEQ ID NO: 894715 - DNA, 22 bp, Artificial Sequence
  chemically synthesized
cttattactttgcagaaggtct

SEQ ID NO: 894716 - DNA, 22 bp, Artificial Sequence
  chemically synthesized
tcttattactttgcagaaggtc

SEQ ID NO: 894717 - DNA, 22 bp, Artificial Sequence
  chemically synthesized
ttcttattactttgcagaaggt

SEQ ID NO: 894718 - DNA, 22 bp, Artificial Sequence
  chemically synthesized
acacatgaaagaccttctgcaa

SEQ ID NO: 894719 - DNA, 22 bp, Artificial Sequence
  chemically synthesized
tttcttattactttgcagaagg

SEQ ID NO: 894720 - DNA, 22 bp, Artificial Sequence
  chemically synthesized
gcctttttcttattactttgca

SEQ ID NO: 894721 - DNA, 22 bp, Artificial Sequence
  chemically synthesized
ttggcctttttcttattacttt

SEQ ID NO: 894722 - DNA, 22 bp, Artificial Sequence
  chemically synthesized
ggttgttggcctttttcttatt

SEQ ID NO: 894723 - DNA, 22 bp, Artificial Sequence
  chemically synthesized
gggttgttggcctttttcttat

SEQ ID NO: 894724 - DNA, 22 bp, Artificial Sequence
  chemically synthesized
tgggttgttggcctttttctta

SEQ ID NO: 894725 - DNA, 22 bp, Artificial Sequence
  chemically synthesized
ctgcaaagtaataagaaaaagg

SEQ ID NO: 894726 - DNA, 22 bp, Artificial Sequence
  chemically synthesized
ttgggttgttggcctttttctt

SEQ ID NO: 894727 - DNA, 22 bp, Artificial Sequence
  chemically synthesized
tgcaaagtaataagaaaaaggc

SEQ ID NO: 894728 - DNA, 22 bp, Artificial Sequence
  chemically synthesized
ttttgggttgttggcctttttc

SEQ ID NO: 894729 - DNA, 22 bp, Artificial Sequence
  chemically synthesized
caaagtaataagaaaaaggcca

SEQ ID NO: 894730 - DNA, 22 bp, Artificial Sequence
  chemically synthesized
cttttgggttgttggccttttt

SEQ ID NO: 894731 - DNA, 22 bp, Artificial Sequence
  chemically synthesized
tcttttgggttgttggcctttt

SEQ ID NO: 894732 - DNA, 22 bp, Artificial Sequence
  chemically synthesized
tccaattttcttttgggttgtt

SEQ ID NO: 894733 - DNA, 22 bp, Artificial Sequence
  chemically synthesized
gtccaattttcttttgggttgt

SEQ ID NO: 894734 - DNA, 22 bp, Artificial Sequence
  chemically synthesized
tgtccaattttcttttgggttg

SEQ ID NO: 894735 - DNA, 22 bp, Artificial Sequence
  chemically synthesized
ttgtccaattttcttttgggtt

SEQ ID NO: 894736 - DNA, 22 bp, Artificial Sequence
  chemically synthesized
tcttttgtccaattttcttttg

SEQ ID NO: 894737 - DNA, 22 bp, Artificial Sequence
  chemically synthesized
atcttttgtccaattttctttt

SEQ ID NO: 894738 - DNA, 22 bp, Artificial Sequence
  chemically synthesized
tccttatcttttgtccaatttt

SEQ ID NO: 894739 - DNA, 22 bp, Artificial Sequence
  chemically synthesized
tgaactgtccttatcttttgtc

SEQ ID NO: 894740 - DNA, 22 bp, Artificial Sequence
  chemically synthesized
tgtgaactgtccttatcttttg

SEQ ID NO: 894741 - DNA, 22 bp, Artificial Sequence
  chemically synthesized
ctgtgaactgtccttatctttt

SEQ ID NO: 894742 - DNA, 22 bp, Artificial Sequence
  chemically synthesized
tctgtgaactgtccttatcttt

SEQ ID NO: 894743 - DNA, 22 bp, Artificial Sequence
  chemically synthesized
ttctgtgaactgtccttatctt

SEQ ID NO: 894744 - DNA, 22 bp, Artificial Sequence
  chemically synthesized
ttttctgtgaactgtccttatc

SEQ ID NO: 894745 - DNA, 22 bp, Artificial Sequence
  chemically synthesized
cttttctgtgaactgtccttat

SEQ ID NO: 894746 - DNA, 22 bp, Artificial Sequence
  chemically synthesized
tcttttctgtgaactgtcctta

SEQ ID NO: 894747 - DNA, 22 bp, Artificial Sequence
  chemically synthesized
gacaaaagataaggacagttca

SEQ ID NO: 894748 - DNA, 22 bp, Artificial Sequence
  chemically synthesized
tattttcttttctgtgaactgt

SEQ ID NO: 894749 - DNA, 22 bp, Artificial Sequence
  chemically synthesized
gtattttcttttctgtgaactg

SEQ ID NO: 894750 - DNA, 22 bp, Artificial Sequence
  chemically synthesized
tgtattttcttttctgtgaact

SEQ ID NO: 894751 - DNA, 22 bp, Artificial Sequence
  chemically synthesized
aaatcctttgtattttcttttc

SEQ ID NO: 894752 - DNA, 22 bp, Artificial Sequence
  chemically synthesized
aaaatcctttgtattttctttt

SEQ ID NO: 894753 - DNA, 22 bp, Artificial Sequence
  chemically synthesized
taaaatcctttgtattttcttt

SEQ ID NO: 894754 - DNA, 22 bp, Artificial Sequence
  chemically synthesized
ttaaaatcctttgtattttctt

SEQ ID NO: 894755 - DNA, 22 bp, Artificial Sequence
  chemically synthesized
acagaaaagaaaatacaaagga

SEQ ID NO: 894756 - DNA, 22 bp, Artificial Sequence
  chemically synthesized
atgcttttaaaatcctttgtat

SEQ ID NO: 894757 - DNA, 22 bp, Artificial Sequence
  chemically synthesized
ttcatgcttttaaaatcctttg

SEQ ID NO: 894758 - DNA, 22 bp, Artificial Sequence
  chemically synthesized
tgttcatgcttttaaaatcctt

SEQ ID NO: 894759 - DNA, 22 bp, Artificial Sequence
  chemically synthesized
ctgttcatgcttttaaaatcct

SEQ ID NO: 894760 - DNA, 22 bp, Artificial Sequence
  chemically synthesized
agcttctgttcatgcttttaaa

SEQ ID NO: 894761 - DNA, 22 bp, Artificial Sequence
  chemically synthesized
ccaaggctaagcttctgttcat

SEQ ID NO: 894762 - DNA, 22 bp, Artificial Sequence
  chemically synthesized
ttaccaaggctaagcttctgtt

SEQ ID NO: 894763 - DNA, 22 bp, Artificial Sequence
  chemically synthesized
taaaagcatgaacagaagctta

SEQ ID NO: 894764 - DNA, 22 bp, Artificial Sequence
  chemically synthesized
aaaagcatgaacagaagcttag

SEQ ID NO: 894765 - DNA, 22 bp, Artificial Sequence
  chemically synthesized
aaagcatgaacagaagcttagc

SEQ ID NO: 894766 - DNA, 22 bp, Artificial Sequence
  chemically synthesized
attattaccaaggctaagcttc

SEQ ID NO: 894767 - DNA, 22 bp, Artificial Sequence
  chemically synthesized
tcattattaccaaggctaagct

SEQ ID NO: 894768 - DNA, 22 bp, Artificial Sequence
  chemically synthesized
tctcattattaccaaggctaag

SEQ ID NO: 894769 - DNA, 22 bp, Artificial Sequence
  chemically synthesized
ctctcattattaccaaggctaa

SEQ ID NO: 894770 - DNA, 22 bp, Artificial Sequence
  chemically synthesized
atttctctcattattaccaagg

SEQ ID NO: 894771 - DNA, 22 bp, Artificial Sequence
  chemically synthesized
catttctctcattattaccaag

SEQ ID NO: 894772 - DNA, 22 bp, Artificial Sequence
  chemically synthesized
tcatttctctcattattaccaa

SEQ ID NO: 894773 - DNA, 22 bp, Artificial Sequence
  chemically synthesized
attttcatttctctcattatta

SEQ ID NO: 894774 - DNA, 22 bp, Artificial Sequence
  chemically synthesized
taattttcatttctctcattat

SEQ ID NO: 894775 - DNA, 22 bp, Artificial Sequence
  chemically synthesized
agccttggtaataatgagagaa

SEQ ID NO: 894776 - DNA, 22 bp, Artificial Sequence
  chemically synthesized
gccttggtaataatgagagaaa

SEQ ID NO: 894777 - DNA, 22 bp, Artificial Sequence
  chemically synthesized
ggtaataatgagagaaatgaaa

SEQ ID NO: 894778 - DNA, 22 bp, Artificial Sequence
  chemically synthesized
gtaataatgagagaaatgaaaa

SEQ ID NO: 894779 - DNA, 22 bp, Artificial Sequence
  chemically synthesized
ccagtgcaatagatgaagctct

SEQ ID NO: 894780 - DNA, 22 bp, Artificial Sequence
  chemically synthesized
gccagtgcaatagatgaagctc

SEQ ID NO: 894781 - DNA, 22 bp, Artificial Sequence
  chemically synthesized
tgccagtgcaatagatgaagct

SEQ ID NO: 894782 - DNA, 22 bp, Artificial Sequence
  chemically synthesized
ttgccagtgcaatagatgaagc

SEQ ID NO: 894783 - DNA, 22 bp, Artificial Sequence
  chemically synthesized
aatttttgccagtgcaatagat

SEQ ID NO: 894784 - DNA, 22 bp, Artificial Sequence
  chemically synthesized
gaatttttgccagtgcaataga

SEQ ID NO: 894785 - DNA, 22 bp, Artificial Sequence
  chemically synthesized
gagcttcatctattgcactggc

SEQ ID NO: 894786 - DNA, 22 bp, Artificial Sequence
  chemically synthesized
cagacttgaatttttgccagtg

SEQ ID NO: 894787 - DNA, 22 bp, Artificial Sequence
  chemically synthesized
catctattgcactggcaaaaat

SEQ ID NO: 894788 - DNA, 22 bp, Artificial Sequence
  chemically synthesized
atctattgcactggcaaaaatt

SEQ ID NO: 894789 - DNA, 22 bp, Artificial Sequence
  chemically synthesized
ttgcactggcaaaaattcaagt

SEQ ID NO: 894790 - DNA, 22 bp, Artificial Sequence
  chemically synthesized
cactggcaaaaattcaagtctg

SEQ ID NO: 894791 - DNA, 22 bp, Artificial Sequence
  chemically synthesized
gcaaaaattcaagtctgcaggt

SEQ ID NO: 894792 - DNA, 22 bp, Artificial Sequence
  chemically synthesized
gcagcatagtgtacctgcagac

SEQ ID NO: 894793 - DNA, 22 bp, Artificial Sequence
  chemically synthesized
ggcagcatagtgtacctgcaga

SEQ ID NO: 894794 - DNA, 22 bp, Artificial Sequence
  chemically synthesized
aagtctgcaggtacactatgct

SEQ ID NO: 894795 - DNA, 22 bp, Artificial Sequence
  chemically synthesized
ccacagccttggcagcatagtg

SEQ ID NO: 894796 - DNA, 22 bp, Artificial Sequence
  chemically synthesized
cccacagccttggcagcatagt

SEQ ID NO: 894797 - DNA, 22 bp, Artificial Sequence
  chemically synthesized
tcccacagccttggcagcatag

SEQ ID NO: 894798 - DNA, 22 bp, Artificial Sequence
  chemically synthesized
caggtacactatgctgccaagg

SEQ ID NO: 894799 - DNA, 22 bp, Artificial Sequence
  chemically synthesized
cattttcccacagccttggcag

SEQ ID NO: 894800 - DNA, 22 bp, Artificial Sequence
  chemically synthesized
tgctgccaaggctgtgggaaaa

SEQ ID NO: 894801 - DNA, 22 bp, Artificial Sequence
  chemically synthesized
ccaaggctgtgggaaaatgcag

SEQ ID NO: 894802 - DNA, 22 bp, Artificial Sequence
  chemically synthesized
tgggaaaatgcagactcttcta

SEQ ID NO: 894803 - DNA, 22 bp, Artificial Sequence
  chemically synthesized
ccaccagccacgtagaagagtc

SEQ ID NO: 894804 - DNA, 22 bp, Artificial Sequence
  chemically synthesized
cccaccagccacgtagaagagt

SEQ ID NO: 894805 - DNA, 22 bp, Artificial Sequence
  chemically synthesized
ttctacgtggctggtgggaagt

SEQ ID NO: 894806 - DNA, 22 bp, Artificial Sequence
  chemically synthesized
ctacgtggctggtgggaagtat

SEQ ID NO: 894807 - DNA, 22 bp, Artificial Sequence
  chemically synthesized
tacgtggctggtgggaagtata

SEQ ID NO: 894808 - DNA, 22 bp, Artificial Sequence
  chemically synthesized
cgtggctggtgggaagtataca

SEQ ID NO: 894809 - DNA, 22 bp, Artificial Sequence
  chemically synthesized
cacaagaggtacacaaatgtat

SEQ ID NO: 894810 - DNA, 22 bp, Artificial Sequence
  chemically synthesized
ccacaagaggtacacaaatgta

SEQ ID NO: 894811 - DNA, 22 bp, Artificial Sequence
  chemically synthesized
gtgggaagtatacatttgtgta

SEQ ID NO: 894812 - DNA, 22 bp, Artificial Sequence
  chemically synthesized
ccttccacaagaggtacacaaa

SEQ ID NO: 894813 - DNA, 22 bp, Artificial Sequence
  chemically synthesized
gtgtacctcttgtggaaggcag

SEQ ID NO: 894814 - DNA, 22 bp, Artificial Sequence
  chemically synthesized
tgtacctcttgtggaaggcagt

SEQ ID NO: 894815 - DNA, 22 bp, Artificial Sequence
  chemically synthesized
tagatatggccaaactgccttc

SEQ ID NO: 894816 - DNA, 22 bp, Artificial Sequence
  chemically synthesized
atagatatggccaaactgcctt

SEQ ID NO: 894817 - DNA, 22 bp, Artificial Sequence
  chemically synthesized
tatagatatggccaaactgcct

SEQ ID NO: 894818 - DNA, 22 bp, Artificial Sequence
  chemically synthesized
ttatagatatggccaaactgcc

SEQ ID NO: 894819 - DNA, 22 bp, Artificial Sequence
  chemically synthesized
tttatagatatggccaaactgc

SEQ ID NO: 894820 - DNA, 22 bp, Artificial Sequence
  chemically synthesized
ttgtggaaggcagtttggccat

SEQ ID NO: 894821 - DNA, 22 bp, Artificial Sequence
  chemically synthesized
gtggaaggcagtttggccatat

SEQ ID NO: 894822 - DNA, 22 bp, Artificial Sequence
  chemically synthesized
tggaaggcagtttggccatatc

SEQ ID NO: 894823 - DNA, 22 bp, Artificial Sequence
  chemically synthesized
catgctttttatagatatggcc

SEQ ID NO: 894824 - DNA, 22 bp, Artificial Sequence
  chemically synthesized
acatgctttttatagatatggc

SEQ ID NO: 894825 - DNA, 22 bp, Artificial Sequence
  chemically synthesized
ggccatatctataaaaagcatg

SEQ ID NO: 894826 - DNA, 22 bp, Artificial Sequence
  chemically synthesized
gccatatctataaaaagcatgt

SEQ ID NO: 894827 - DNA, 22 bp, Artificial Sequence
  chemically synthesized
caggtcaaagtttacatgcttt

SEQ ID NO: 894828 - DNA, 22 bp, Artificial Sequence
  chemically synthesized
ccaggtcaaagtttacatgctt

SEQ ID NO: 894829 - DNA, 22 bp, Artificial Sequence
  chemically synthesized
taaaaagcatgtaaactttgac

SEQ ID NO: 894830 - DNA, 22 bp, Artificial Sequence
  chemically synthesized
ggaataaaatttccaggtcaaa

SEQ ID NO: 894831 - DNA, 22 bp, Artificial Sequence
  chemically synthesized
ctgggaataaaatttccaggtc

SEQ ID NO: 894832 - DNA, 22 bp, Artificial Sequence
  chemically synthesized
tgacctggaaattttattccca

SEQ ID NO: 894833 - DNA, 22 bp, Artificial Sequence
  chemically synthesized
gacctggaaattttattcccag

SEQ ID NO: 894834 - DNA, 22 bp, Artificial Sequence
  chemically synthesized
caaaataaattcctgggaataa

SEQ ID NO: 894835 - DNA, 22 bp, Artificial Sequence
  chemically synthesized
acctggaaattttattcccagg

SEQ ID NO: 894836 - DNA, 22 bp, Artificial Sequence
  chemically synthesized
gaaattttattcccaggaattt

SEQ ID NO: 894837 - DNA, 22 bp, Artificial Sequence
  chemically synthesized
gaaacaaatctacaaaataaat

SEQ ID NO: 894838 - DNA, 22 bp, Artificial Sequence
  chemically synthesized
tattcccaggaatttattttgt

SEQ ID NO: 894839 - DNA, 22 bp, Artificial Sequence
  chemically synthesized
attcccaggaatttattttgta

SEQ ID NO: 894840 - DNA, 22 bp, Artificial Sequence
  chemically synthesized
tagaaacaaatctacaaaataa

SEQ ID NO: 894841 - DNA, 22 bp, Artificial Sequence
  chemically synthesized
ttcccaggaatttattttgtag

SEQ ID NO: 894842 - DNA, 22 bp, Artificial Sequence
  chemically synthesized
ccaggaatttattttgtagatt

SEQ ID NO: 894843 - DNA, 22 bp, Artificial Sequence
  chemically synthesized
attctagaaacaaatctacaaa

SEQ ID NO: 894844 - DNA, 22 bp, Artificial Sequence
  chemically synthesized
aattctagaaacaaatctacaa

SEQ ID NO: 894845 - DNA, 22 bp, Artificial Sequence
  chemically synthesized
accttaattctagaaacaaatc

SEQ ID NO: 894846 - DNA, 22 bp, Artificial Sequence
  chemically synthesized
attttgtagatttgtttctaga

SEQ ID NO: 894847 - DNA, 22 bp, Artificial Sequence
  chemically synthesized
ttttgtagatttgtttctagaa

SEQ ID NO: 894848 - DNA, 22 bp, Artificial Sequence
  chemically synthesized
cacattaaccttaattctagaa

SEQ ID NO: 894849 - DNA, 22 bp, Artificial Sequence
  chemically synthesized
tgtagatttgtttctagaatta

SEQ ID NO: 894850 - DNA, 22 bp, Artificial Sequence
  chemically synthesized
gtagatttgtttctagaattaa

SEQ ID NO: 894851 - DNA, 22 bp, Artificial Sequence
  chemically synthesized
tagatttgtttctagaattaag

SEQ ID NO: 894852 - DNA, 22 bp, Artificial Sequence
  chemically synthesized
actgcacattaaccttaattct

SEQ ID NO: 894853 - DNA, 22 bp, Artificial Sequence
  chemically synthesized
ccctcactgcacattaacctta

SEQ ID NO: 894854 - DNA, 22 bp, Artificial Sequence
  chemically synthesized
gtttctagaattaaggttaatg

SEQ ID NO: 894855 - DNA, 22 bp, Artificial Sequence
  chemically synthesized
tttctagaattaaggttaatgt

SEQ ID NO: 894856 - DNA, 22 bp, Artificial Sequence
  chemically synthesized
taccctcactgcacattaacct

SEQ ID NO: 894857 - DNA, 22 bp, Artificial Sequence
  chemically synthesized
ctagaattaaggttaatgtgca

SEQ ID NO: 894858 - DNA, 22 bp, Artificial Sequence
  chemically synthesized
ctctaccctcactgcacattaa

SEQ ID NO: 894859 - DNA, 22 bp, Artificial Sequence
  chemically synthesized
tagaattaaggttaatgtgcag

SEQ ID NO: 894860 - DNA, 22 bp, Artificial Sequence
  chemically synthesized
gaattaaggttaatgtgcagtg

SEQ ID NO: 894861 - DNA, 22 bp, Artificial Sequence
  chemically synthesized
aggttaatgtgcagtgagggta

SEQ ID NO: 894862 - DNA, 22 bp, Artificial Sequence
  chemically synthesized
cccatcatctgctctaccctca

SEQ ID NO: 894863 - DNA, 22 bp, Artificial Sequence
  chemically synthesized
atgtgcagtgagggtagagcag

SEQ ID NO: 894864 - DNA, 22 bp, Artificial Sequence
  chemically synthesized
accctacccatcatctgctcta

SEQ ID NO: 894865 - DNA, 22 bp, Artificial Sequence
  chemically synthesized
aaaatataaaaggtacagtaaa

SEQ ID NO: 894866 - DNA, 22 bp, Artificial Sequence
  chemically synthesized
ttcaaaatataaaaggtacagt

SEQ ID NO: 894867 - DNA, 22 bp, Artificial Sequence
  chemically synthesized
cattgttcaaaatataaaaggt

SEQ ID NO: 894868 - DNA, 22 bp, Artificial Sequence
  chemically synthesized
acattgttcaaaatataaaagg

SEQ ID NO: 894869 - DNA, 22 bp, Artificial Sequence
  chemically synthesized
tttactgtaccttttatatttt

SEQ ID NO: 894870 - DNA, 22 bp, Artificial Sequence
  chemically synthesized
ttactgtaccttttatattttg

SEQ ID NO: 894871 - DNA, 22 bp, Artificial Sequence
  chemically synthesized
tactgtaccttttatattttga

SEQ ID NO: 894872 - DNA, 22 bp, Artificial Sequence
  chemically synthesized
actgtaccttttatattttgaa

SEQ ID NO: 894873 - DNA, 22 bp, Artificial Sequence
  chemically synthesized
ctgtaccttttatattttgaac

SEQ ID NO: 894874 - DNA, 22 bp, Artificial Sequence
  chemically synthesized
taccttttatattttgaacaat

SEQ ID NO: 894875 - DNA, 22 bp, Artificial Sequence
  chemically synthesized
ttatattttgaacaatgtaaat

SEQ ID NO: 894876 - DNA, 22 bp, Artificial Sequence
  chemically synthesized
atacagtaatgcatttacattg

SEQ ID NO: 894877 - DNA, 22 bp, Artificial Sequence
  chemically synthesized
tatattttgaacaatgtaaatg

SEQ ID NO: 894878 - DNA, 22 bp, Artificial Sequence
  chemically synthesized
atattttgaacaatgtaaatgc

SEQ ID NO: 894879 - DNA, 22 bp, Artificial Sequence
  chemically synthesized
tattttgaacaatgtaaatgca

SEQ ID NO: 894880 - DNA, 22 bp, Artificial Sequence
  chemically synthesized
tgaacaatgtaaatgcattact

SEQ ID NO: 894881 - DNA, 22 bp, Artificial Sequence
  chemically synthesized
gaacaatgtaaatgcattactg

SEQ ID NO: 894882 - DNA, 22 bp, Artificial Sequence
  chemically synthesized
aacaatgtaaatgcattactgt

SEQ ID NO: 894883 - DNA, 22 bp, Artificial Sequence
  chemically synthesized
acagtgtgagagcagactaata

SEQ ID NO: 894884 - DNA, 22 bp, Artificial Sequence
  chemically synthesized
ttaacagtgtgagagcagacta

SEQ ID NO: 894885 - DNA, 22 bp, Artificial Sequence
  chemically synthesized
gttaacagtgtgagagcagact

SEQ ID NO: 894886 - DNA, 22 bp, Artificial Sequence
  chemically synthesized
tgttaacagtgtgagagcagac

SEQ ID NO: 894887 - DNA, 22 bp, Artificial Sequence
  chemically synthesized
ctgtattagtctgctctcacac

SEQ ID NO: 894888 - DNA, 22 bp, Artificial Sequence
  chemically synthesized
tattagtctgctctcacactgt

SEQ ID NO: 894889 - DNA, 22 bp, Artificial Sequence
  chemically synthesized
agatatgtctttgttaacagtg

SEQ ID NO: 894890 - DNA, 22 bp, Artificial Sequence
  chemically synthesized
gtctgctctcacactgttaaca

SEQ ID NO: 894891 - DNA, 22 bp, Artificial Sequence
  chemically synthesized
ctctcacactgttaacaaagac

SEQ ID NO: 894892 - DNA, 22 bp, Artificial Sequence
  chemically synthesized
tcacactgttaacaaagacata

SEQ ID NO: 894893 - DNA, 22 bp, Artificial Sequence
  chemically synthesized
acactgttaacaaagacatatc

SEQ ID NO: 894894 - DNA, 22 bp, Artificial Sequence
  chemically synthesized
taaatcacccagtctcagatat

SEQ ID NO: 894895 - DNA, 22 bp, Artificial Sequence
  chemically synthesized
ttaacaaagacatatctgagac

SEQ ID NO: 894896 - DNA, 22 bp, Artificial Sequence
  chemically synthesized
ataaatcacccagtctcagata

SEQ ID NO: 894897 - DNA, 22 bp, Artificial Sequence
  chemically synthesized
tataaatcacccagtctcagat

SEQ ID NO: 894898 - DNA, 22 bp, Artificial Sequence
  chemically synthesized
acaaagacatatctgagactgg

SEQ ID NO: 894899 - DNA, 22 bp, Artificial Sequence
  chemically synthesized
ctttataaatcacccagtctca

SEQ ID NO: 894900 - DNA, 22 bp, Artificial Sequence
  chemically synthesized
cctttataaatcacccagtctc

SEQ ID NO: 894901 - DNA, 22 bp, Artificial Sequence
  chemically synthesized
tcctttataaatcacccagtct

SEQ ID NO: 894902 - DNA, 22 bp, Artificial Sequence
  chemically synthesized
tttcctttataaatcacccagt

SEQ ID NO: 894903 - DNA, 22 bp, Artificial Sequence
  chemically synthesized
aacctctttcctttataaatca

SEQ ID NO: 894904 - DNA, 22 bp, Artificial Sequence
  chemically synthesized
agactgggtgatttataaagga

SEQ ID NO: 894905 - DNA, 22 bp, Artificial Sequence
  chemically synthesized
ggtgatttataaaggaaagagg

SEQ ID NO: 894906 - DNA, 22 bp, Artificial Sequence
  chemically synthesized
ataaaggaaagaggtttaatgg

SEQ ID NO: 894907 - DNA, 22 bp, Artificial Sequence
  chemically synthesized
taaaggaaagaggtttaatgga

SEQ ID NO: 894908 - DNA, 22 bp, Artificial Sequence
  chemically synthesized
aatggactcaccattctacatg

SEQ ID NO: 894909 - DNA, 22 bp, Artificial Sequence
  chemically synthesized
atggactcaccattctacatgg

SEQ ID NO: 894910 - DNA, 22 bp, Artificial Sequence
  chemically synthesized
tgaggcccccccccgccatgta

SEQ ID NO: 894911 - DNA, 22 bp, Artificial Sequence
  chemically synthesized
accattctacatggcggggggg

SEQ ID NO: 894912 - DNA, 22 bp, Artificial Sequence
  chemically synthesized
ccatgattgtgaggcccccccc

SEQ ID NO: 894913 - DNA, 22 bp, Artificial Sequence
  chemically synthesized
tgccatgattgtgaggcccccc

SEQ ID NO: 894914 - DNA, 22 bp, Artificial Sequence
  chemically synthesized
tacatggcgggggggggcctca

SEQ ID NO: 894915 - DNA, 22 bp, Artificial Sequence
  chemically synthesized
ctgccatgattgtgaggccccc

SEQ ID NO: 894916 - DNA, 22 bp, Artificial Sequence
  chemically synthesized
catggcgggggggggcctcaca

SEQ ID NO: 894917 - DNA, 22 bp, Artificial Sequence
  chemically synthesized
ccttctgccatgattgtgaggc

SEQ ID NO: 894918 - DNA, 22 bp, Artificial Sequence
  chemically synthesized
gccttctgccatgattgtgagg

SEQ ID NO: 894919 - DNA, 22 bp, Artificial Sequence
  chemically synthesized
tgccttctgccatgattgtgag

SEQ ID NO: 894920 - DNA, 22 bp, Artificial Sequence
  chemically synthesized
ctttgccttctgccatgattgt

SEQ ID NO: 894921 - DNA, 22 bp, Artificial Sequence
  chemically synthesized
tcctttgccttctgccatgatt

SEQ ID NO: 894922 - DNA, 22 bp, Artificial Sequence
  chemically synthesized
ctcctttgccttctgccatgat

SEQ ID NO: 894923 - DNA, 22 bp, Artificial Sequence
  chemically synthesized
cttctcctttgccttctgccat

SEQ ID NO: 894924 - DNA, 22 bp, Artificial Sequence
  chemically synthesized
gcttctcctttgccttctgcca

SEQ ID NO: 894925 - DNA, 22 bp, Artificial Sequence
  chemically synthesized
tgcttctcctttgccttctgcc

SEQ ID NO: 894926 - DNA, 22 bp, Artificial Sequence
  chemically synthesized
ttgcttctcctttgccttctgc

SEQ ID NO: 894927 - DNA, 22 bp, Artificial Sequence
  chemically synthesized
acaatcatggcagaaggcaaag

SEQ ID NO: 894928 - DNA, 22 bp, Artificial Sequence
  chemically synthesized
ccatgtagaatgtgtttttgct

SEQ ID NO: 894929 - DNA, 22 bp, Artificial Sequence
  chemically synthesized
ctgccatgtagaatgtgttttt

SEQ ID NO: 894930 - DNA, 22 bp, Artificial Sequence
  chemically synthesized
cctgctgccatgtagaatgtgt

SEQ ID NO: 894931 - DNA, 22 bp, Artificial Sequence
  chemically synthesized
ccctgctgccatgtagaatgtg

SEQ ID NO: 894932 - DNA, 22 bp, Artificial Sequence
  chemically synthesized
ttccctgctgccatgtagaatg

SEQ ID NO: 894933 - DNA, 22 bp, Artificial Sequence
  chemically synthesized
tcttccctgctgccatgtagaa

SEQ ID NO: 894934 - DNA, 22 bp, Artificial Sequence
  chemically synthesized
agcaagctctcttccctgctgc

SEQ ID NO: 894935 - DNA, 22 bp, Artificial Sequence
  chemically synthesized
ccctgagcaagctctcttccct

SEQ ID NO: 894936 - DNA, 22 bp, Artificial Sequence
  chemically synthesized
tacatggcagcagggaagagag

SEQ ID NO: 894937 - DNA, 22 bp, Artificial Sequence
  chemically synthesized
catggcagcagggaagagagct

SEQ ID NO: 894938 - DNA, 22 bp, Artificial Sequence
  chemically synthesized
taaatgtgagttcccctgagca

SEQ ID NO: 894939 - DNA, 22 bp, Artificial Sequence
  chemically synthesized
ataaatgtgagttcccctgagc

SEQ ID NO: 894940 - DNA, 22 bp, Artificial Sequence
  chemically synthesized
tataaatgtgagttcccctgag

SEQ ID NO: 894941 - DNA, 22 bp, Artificial Sequence
  chemically synthesized
atagttttataaatgtgagttc

SEQ ID NO: 894942 - DNA, 22 bp, Artificial Sequence
  chemically synthesized
gctcaggggaactcacatttat

SEQ ID NO: 894943 - DNA, 22 bp, Artificial Sequence
  chemically synthesized
ctcaggggaactcacatttata

SEQ ID NO: 894944 - DNA, 22 bp, Artificial Sequence
  chemically synthesized
aggggaactcacatttataaaa

SEQ ID NO: 894945 - DNA, 22 bp, Artificial Sequence
  chemically synthesized
acaagatctgatagttttataa

SEQ ID NO: 894946 - DNA, 22 bp, Artificial Sequence
  chemically synthesized
cacaagatctgatagttttata

SEQ ID NO: 894947 - DNA, 22 bp, Artificial Sequence
  chemically synthesized
acatttataaaactatcagatc

SEQ ID NO: 894948 - DNA, 22 bp, Artificial Sequence
  chemically synthesized
ataaaactatcagatcttgtga

SEQ ID NO: 894949 - DNA, 22 bp, Artificial Sequence
  chemically synthesized
taaaactatcagatcttgtgaa

SEQ ID NO: 894950 - DNA, 22 bp, Artificial Sequence
  chemically synthesized
ataatcagtaagtttcacaaga

SEQ ID NO: 894951 - DNA, 22 bp, Artificial Sequence
  chemically synthesized
ctgataatcagtaagtttcaca

SEQ ID NO: 894952 - DNA, 22 bp, Artificial Sequence
  chemically synthesized
tcctgataatcagtaagtttca

SEQ ID NO: 894953 - DNA, 22 bp, Artificial Sequence
  chemically synthesized
tcagatcttgtgaaacttactg

SEQ ID NO: 894954 - DNA, 22 bp, Artificial Sequence
  chemically synthesized
ttctcctgataatcagtaagtt

SEQ ID NO: 894955 - DNA, 22 bp, Artificial Sequence
  chemically synthesized
gtgaaacttactgattatcagg

SEQ ID NO: 894956 - DNA, 22 bp, Artificial Sequence
  chemically synthesized
tgaaacttactgattatcagga

SEQ ID NO: 894957 - DNA, 22 bp, Artificial Sequence
  chemically synthesized
actgattatcaggagaacagta

SEQ ID NO: 894958 - DNA, 22 bp, Artificial Sequence
  chemically synthesized
ctgattatcaggagaacagtat

SEQ ID NO: 894959 - DNA, 22 bp, Artificial Sequence
  chemically synthesized
attatcaggagaacagtatggg

SEQ ID NO: 894960 - DNA, 22 bp, Artificial Sequence
  chemically synthesized
tcaggagaacagtatgggggat

SEQ ID NO: 894961 - DNA, 22 bp, Artificial Sequence
  chemically synthesized
aatcatggaagaggatccccca

SEQ ID NO: 894962 - DNA, 22 bp, Artificial Sequence
  chemically synthesized
ttccatgattcaattatctgca

SEQ ID NO: 894963 - DNA, 22 bp, Artificial Sequence
  chemically synthesized
ccatgattcaattatctgcacc

SEQ ID NO: 894964 - DNA, 22 bp, Artificial Sequence
  chemically synthesized
catgattcaattatctgcacct

SEQ ID NO: 894965 - DNA, 22 bp, Artificial Sequence
  chemically synthesized
aattatctgcacctggctccac

SEQ ID NO: 894966 - DNA, 22 bp, Artificial Sequence
  chemically synthesized
tctgcacctggctccacccttg

SEQ ID NO: 894967 - DNA, 22 bp, Artificial Sequence
  chemically synthesized
cacctggctccacccttgacat

SEQ ID NO: 894968 - DNA, 22 bp, Artificial Sequence
  chemically synthesized
tggtaatccccacatgtcaagg

SEQ ID NO: 894969 - DNA, 22 bp, Artificial Sequence
  chemically synthesized
gctccacccttgacatgtgggg

SEQ ID NO: 894970 - DNA, 22 bp, Artificial Sequence
  chemically synthesized
aattatggtaatccccacatgt

SEQ ID NO: 894971 - DNA, 22 bp, Artificial Sequence
  chemically synthesized
gaattatggtaatccccacatg

SEQ ID NO: 894972 - DNA, 22 bp, Artificial Sequence
  chemically synthesized
cacccttgacatgtggggatta

SEQ ID NO: 894973 - DNA, 22 bp, Artificial Sequence
  chemically synthesized
accttgaattatggtaatcccc

SEQ ID NO: 894974 - DNA, 22 bp, Artificial Sequence
  chemically synthesized
gacatgtggggattaccataat

SEQ ID NO: 894975 - DNA, 22 bp, Artificial Sequence
  chemically synthesized
acatgtggggattaccataatt

SEQ ID NO: 894976 - DNA, 22 bp, Artificial Sequence
  chemically synthesized
tgtccccacccaaatctcacct

SEQ ID NO: 894977 - DNA, 22 bp, Artificial Sequence
  chemically synthesized
ccataattcaaggtgagatttg

SEQ ID NO: 894978 - DNA, 22 bp, Artificial Sequence
  chemically synthesized
gctgtgtccccacccaaatctc

SEQ ID NO: 894979 - DNA, 22 bp, Artificial Sequence
  chemically synthesized
ggctgtgtccccacccaaatct

SEQ ID NO: 894980 - DNA, 22 bp, Artificial Sequence
  chemically synthesized
aaggtgagatttgggtggggac

SEQ ID NO: 894981 - DNA, 22 bp, Artificial Sequence
  chemically synthesized
acatggtttggctgtgtcccca

SEQ ID NO: 894982 - DNA, 22 bp, Artificial Sequence
  chemically synthesized
gggtggggacacagccaaacca

SEQ ID NO: 894983 - DNA, 22 bp, Artificial Sequence
  chemically synthesized
ggtggggacacagccaaaccat

SEQ ID NO: 894984 - DNA, 22 bp, Artificial Sequence
  chemically synthesized
caaaagtaattgacatggtttg

SEQ ID NO: 894985 - DNA, 22 bp, Artificial Sequence
  chemically synthesized
acaaaagtaattgacatggttt

SEQ ID NO: 894986 - DNA, 22 bp, Artificial Sequence
  chemically synthesized
tacaaaagtaattgacatggtt

SEQ ID NO: 894987 - DNA, 22 bp, Artificial Sequence
  chemically synthesized
ttacaaaagtaattgacatggt

SEQ ID NO: 894988 - DNA, 22 bp, Artificial Sequence
  chemically synthesized
tttacaaaagtaattgacatgg

SEQ ID NO: 894989 - DNA, 22 bp, Artificial Sequence
  chemically synthesized
aataattttttacaaaagtaat

SEQ ID NO: 894990 - DNA, 22 bp, Artificial Sequence
  chemically synthesized
ttaaataattttttacaaaagt

SEQ ID NO: 894991 - DNA, 22 bp, Artificial Sequence
  chemically synthesized
attaaataattttttacaaaag

SEQ ID NO: 894992 - DNA, 22 bp, Artificial Sequence
  chemically synthesized
cttattaaataattttttacaa

SEQ ID NO: 894993 - DNA, 22 bp, Artificial Sequence
  chemically synthesized
ccttattaaataattttttaca

SEQ ID NO: 894994 - DNA, 22 bp, Artificial Sequence
  chemically synthesized
tccttattaaataattttttac

SEQ ID NO: 894995 - DNA, 22 bp, Artificial Sequence
  chemically synthesized
cttttgtaaaaaattatttaat

SEQ ID NO: 894996 - DNA, 22 bp, Artificial Sequence
  chemically synthesized
ttgtaaaaaattatttaataag

SEQ ID NO: 894997 - DNA, 22 bp, Artificial Sequence
  chemically synthesized
tgtaaaaaattatttaataagg

SEQ ID NO: 894998 - DNA, 22 bp, Artificial Sequence
  chemically synthesized
gtaaaaaattatttaataagga

SEQ ID NO: 894999 - DNA, 22 bp, Artificial Sequence
  chemically synthesized
gtacagtagttttccttattaa

SEQ ID NO: 895000 - DNA, 22 bp, Artificial Sequence
  chemically synthesized
taaaaaattatttaataaggaa

SEQ ID NO: 895001 - DNA, 22 bp, Artificial Sequence
  chemically synthesized
tttaataaggaaaactactgta

SEQ ID NO: 895002 - DNA, 22 bp, Artificial Sequence
  chemically synthesized
aataaggaaaactactgtacca

SEQ ID NO: 895003 - DNA, 22 bp, Artificial Sequence
  chemically synthesized
ataaggaaaactactgtaccag

SEQ ID NO: 895004 - DNA, 22 bp, Artificial Sequence
  chemically synthesized
tggtaggaagatgagctggtac

SEQ ID NO: 895005 - DNA, 22 bp, Artificial Sequence
  chemically synthesized
gtggtaggaagatgagctggta

SEQ ID NO: 895006 - DNA, 22 bp, Artificial Sequence
  chemically synthesized
tgtggtaggaagatgagctggt

SEQ ID NO: 895007 - DNA, 22 bp, Artificial Sequence
  chemically synthesized
ctgtaccagctcatcttcctac

SEQ ID NO: 895008 - DNA, 22 bp, Artificial Sequence
  chemically synthesized
aacaacattttgtggtaggaag

SEQ ID NO: 895009 - DNA, 22 bp, Artificial Sequence
  chemically synthesized
taccagctcatcttcctaccac

SEQ ID NO: 895010 - DNA, 22 bp, Artificial Sequence
  chemically synthesized
tcaacaacattttgtggtagga

SEQ ID NO: 895011 - DNA, 22 bp, Artificial Sequence
  chemically synthesized
ctcaacaacattttgtggtagg

SEQ ID NO: 895012 - DNA, 22 bp, Artificial Sequence
  chemically synthesized
atcttcctaccacaaaatgttg

SEQ ID NO: 895013 - DNA, 22 bp, Artificial Sequence
  chemically synthesized
cctaccacaaaatgttgttgag

SEQ ID NO: 895014 - DNA, 22 bp, Artificial Sequence
  chemically synthesized
ctaccacaaaatgttgttgaga

SEQ ID NO: 895015 - DNA, 22 bp, Artificial Sequence
  chemically synthesized
ccacaaaatgttgttgagaaat

SEQ ID NO: 895016 - DNA, 22 bp, Artificial Sequence
  chemically synthesized
aaatatgcaaagtgtaatttct

SEQ ID NO: 895017 - DNA, 22 bp, Artificial Sequence
  chemically synthesized
ttaaaatatgcaaagtgtaatt

SEQ ID NO: 895018 - DNA, 22 bp, Artificial Sequence
  chemically synthesized
attattaaaatatgcaaagtgt

SEQ ID NO: 895019 - DNA, 22 bp, Artificial Sequence
  chemically synthesized
ttgagaaattacactttgcata

SEQ ID NO: 895020 - DNA, 22 bp, Artificial Sequence
  chemically synthesized
agaaattacactttgcatattt

SEQ ID NO: 895021 - DNA, 22 bp, Artificial Sequence
  chemically synthesized
cactttgcatattttaataatg

SEQ ID NO: 895022 - DNA, 22 bp, Artificial Sequence
  chemically synthesized
tgcatattttaataatgaatca

SEQ ID NO: 895023 - DNA, 22 bp, Artificial Sequence
  chemically synthesized
gcatattttaataatgaatcat

SEQ ID NO: 895024 - DNA, 22 bp, Artificial Sequence
  chemically synthesized
catattttaataatgaatcatt

SEQ ID NO: 895025 - DNA, 22 bp, Artificial Sequence
  chemically synthesized
taccagaataataatgattcat

SEQ ID NO: 895026 - DNA, 22 bp, Artificial Sequence
  chemically synthesized
taataatgaatcattattattc

SEQ ID NO: 895027 - DNA, 22 bp, Artificial Sequence
  chemically synthesized
aataatgaatcattattattct

SEQ ID NO: 895028 - DNA, 22 bp, Artificial Sequence
  chemically synthesized
ataatgaatcattattattctg

SEQ ID NO: 895029 - DNA, 22 bp, Artificial Sequence
  chemically synthesized
gatatgttataccagaataata

SEQ ID NO: 895030 - DNA, 22 bp, Artificial Sequence
  chemically synthesized
agatatgttataccagaataat

SEQ ID NO: 895031 - DNA, 22 bp, Artificial Sequence
  chemically synthesized
tagatatgttataccagaataa

SEQ ID NO: 895032 - DNA, 22 bp, Artificial Sequence
  chemically synthesized
atggctttagatatgttatacc

SEQ ID NO: 895033 - DNA, 22 bp, Artificial Sequence
  chemically synthesized
actgatggctttagatatgtta

SEQ ID NO: 895034 - DNA, 22 bp, Artificial Sequence
  chemically synthesized
ttattctggtataacatatcta

SEQ ID NO: 895035 - DNA, 22 bp, Artificial Sequence
  chemically synthesized
cactgatggctttagatatgtt

SEQ ID NO: 895036 - DNA, 22 bp, Artificial Sequence
  chemically synthesized
tcactgatggctttagatatgt

SEQ ID NO: 895037 - DNA, 22 bp, Artificial Sequence
  chemically synthesized
ttcactgatggctttagatatg

SEQ ID NO: 895038 - DNA, 22 bp, Artificial Sequence
  chemically synthesized
ttctggtataacatatctaaag

SEQ ID NO: 895039 - DNA, 22 bp, Artificial Sequence
  chemically synthesized
tggtataacatatctaaagcca

SEQ ID NO: 895040 - DNA, 22 bp, Artificial Sequence
  chemically synthesized
gtataacatatctaaagccatc

SEQ ID NO: 895041 - DNA, 22 bp, Artificial Sequence
  chemically synthesized
agagcatttttcactgatggct

SEQ ID NO: 895042 - DNA, 22 bp, Artificial Sequence
  chemically synthesized
cagagcatttttcactgatggc

SEQ ID NO: 895043 - DNA, 22 bp, Artificial Sequence
  chemically synthesized
ttcagagcatttttcactgatg

SEQ ID NO: 895044 - DNA, 22 bp, Artificial Sequence
  chemically synthesized
aagccatcagtgaaaaatgctc

SEQ ID NO: 895045 - DNA, 22 bp, Artificial Sequence
  chemically synthesized
ccaaagaaaactcttcagagca

SEQ ID NO: 895046 - DNA, 22 bp, Artificial Sequence
  chemically synthesized
agtgatattgccaaagaaaact

SEQ ID NO: 895047 - DNA, 22 bp, Artificial Sequence
  chemically synthesized
tgaagagttttctttggcaata

SEQ ID NO: 895048 - DNA, 22 bp, Artificial Sequence
  chemically synthesized
aagagttttctttggcaatatc

SEQ ID NO: 895049 - DNA, 22 bp, Artificial Sequence
  chemically synthesized
cacccaaccattaagtgatatt

SEQ ID NO: 895050 - DNA, 22 bp, Artificial Sequence
  chemically synthesized
ccacccaaccattaagtgatat

SEQ ID NO: 895051 - DNA, 22 bp, Artificial Sequence
  chemically synthesized
tctttggcaatatcacttaatg

SEQ ID NO: 895052 - DNA, 22 bp, Artificial Sequence
  chemically synthesized
ctttggcaatatcacttaatgg

SEQ ID NO: 895053 - DNA, 22 bp, Artificial Sequence
  chemically synthesized
atttccacccaaccattaagtg

SEQ ID NO: 895054 - DNA, 22 bp, Artificial Sequence
  chemically synthesized
tttggcaatatcacttaatggt

SEQ ID NO: 895055 - DNA, 22 bp, Artificial Sequence
  chemically synthesized
gatttccacccaaccattaagt

SEQ ID NO: 895056 - DNA, 22 bp, Artificial Sequence
  chemically synthesized
tggcaatatcacttaatggttg

SEQ ID NO: 895057 - DNA, 22 bp, Artificial Sequence
  chemically synthesized
ttgatttccacccaaccattaa

SEQ ID NO: 895058 - DNA, 22 bp, Artificial Sequence
  chemically synthesized
ggcaatatcacttaatggttgg

SEQ ID NO: 895059 - DNA, 22 bp, Artificial Sequence
  chemically synthesized
gcaatatcacttaatggttggg

SEQ ID NO: 895060 - DNA, 22 bp, Artificial Sequence
  chemically synthesized
aaagttcttgatttccacccaa

SEQ ID NO: 895061 - DNA, 22 bp, Artificial Sequence
  chemically synthesized
aatggttgggtggaaatcaaga

SEQ ID NO: 895062 - DNA, 22 bp, Artificial Sequence
  chemically synthesized
atggttgggtggaaatcaagaa

SEQ ID NO: 895063 - DNA, 22 bp, Artificial Sequence
  chemically synthesized
ggtggaaatcaagaacttttaa

SEQ ID NO: 895064 - DNA, 22 bp, Artificial Sequence
  chemically synthesized
ttaacacatattttttttgtgc

SEQ ID NO: 895065 - DNA, 22 bp, Artificial Sequence
  chemically synthesized
aagtgcagaagagcacaaaaaa

SEQ ID NO: 895066 - DNA, 22 bp, Artificial Sequence
  chemically synthesized
taacacatattttttttgtgct

SEQ ID NO: 895067 - DNA, 22 bp, Artificial Sequence
  chemically synthesized
aaagtgcagaagagcacaaaaa

SEQ ID NO: 895068 - DNA, 22 bp, Artificial Sequence
  chemically synthesized
aacacatattttttttgtgctc

SEQ ID NO: 895069 - DNA, 22 bp, Artificial Sequence
  chemically synthesized
taaagtgcagaagagcacaaaa

SEQ ID NO: 895070 - DNA, 22 bp, Artificial Sequence
  chemically synthesized
acacatattttttttgtgctct

SEQ ID NO: 895071 - DNA, 22 bp, Artificial Sequence
  chemically synthesized
ttttaaagtgcagaagagcaca

SEQ ID NO: 895072 - DNA, 22 bp, Artificial Sequence
  chemically synthesized
gaaactgttttaaagtgcagaa

SEQ ID NO: 895073 - DNA, 22 bp, Artificial Sequence
  chemically synthesized
tttttgtgctcttctgcacttt

SEQ ID NO: 895074 - DNA, 22 bp, Artificial Sequence
  chemically synthesized
ttttgtgctcttctgcacttta

SEQ ID NO: 895075 - DNA, 22 bp, Artificial Sequence
  chemically synthesized
tttgtgctcttctgcactttaa

SEQ ID NO: 895076 - DNA, 22 bp, Artificial Sequence
  chemically synthesized
ctggaaactgttttaaagtgca

SEQ ID NO: 895077 - DNA, 22 bp, Artificial Sequence
  chemically synthesized
ttgtgctcttctgcactttaaa

SEQ ID NO: 895078 - DNA, 22 bp, Artificial Sequence
  chemically synthesized
tgtgctcttctgcactttaaaa

SEQ ID NO: 895079 - DNA, 22 bp, Artificial Sequence
  chemically synthesized
gtgctcttctgcactttaaaac

SEQ ID NO: 895080 - DNA, 22 bp, Artificial Sequence
  chemically synthesized
tgctcttctgcactttaaaaca

SEQ ID NO: 895081 - DNA, 22 bp, Artificial Sequence
  chemically synthesized
gattcctggaaactgttttaaa

SEQ ID NO: 895082 - DNA, 22 bp, Artificial Sequence
  chemically synthesized
tcgattcctggaaactgtttta

SEQ ID NO: 895083 - DNA, 22 bp, Artificial Sequence
  chemically synthesized
ttctgcactttaaaacagtttc

SEQ ID NO: 895084 - DNA, 22 bp, Artificial Sequence
  chemically synthesized
ctgcactttaaaacagtttcca

SEQ ID NO: 895085 - DNA, 22 bp, Artificial Sequence
  chemically synthesized
tgcactttaaaacagtttccag

SEQ ID NO: 895086 - DNA, 22 bp, Artificial Sequence
  chemically synthesized
cactttaaaacagtttccagga

SEQ ID NO: 895087 - DNA, 22 bp, Artificial Sequence
  chemically synthesized
gaatactctcgattcctggaaa

SEQ ID NO: 895088 - DNA, 22 bp, Artificial Sequence
  chemically synthesized
ggaatactctcgattcctggaa

SEQ ID NO: 895089 - DNA, 22 bp, Artificial Sequence
  chemically synthesized
taaaacagtttccaggaatcga

SEQ ID NO: 895090 - DNA, 22 bp, Artificial Sequence
  chemically synthesized
aaaacagtttccaggaatcgag

SEQ ID NO: 895091 - DNA, 22 bp, Artificial Sequence
  chemically synthesized
aaacagtttccaggaatcgaga

SEQ ID NO: 895092 - DNA, 22 bp, Artificial Sequence
  chemically synthesized
cgtgaagtatttggaatactct

SEQ ID NO: 895093 - DNA, 22 bp, Artificial Sequence
  chemically synthesized
ccgtgaagtatttggaatactc

SEQ ID NO: 895094 - DNA, 22 bp, Artificial Sequence
  chemically synthesized
ccaggaatcgagagtattccaa

SEQ ID NO: 895095 - DNA, 22 bp, Artificial Sequence
  chemically synthesized
tccgtgaagtatttggaatact

SEQ ID NO: 895096 - DNA, 22 bp, Artificial Sequence
  chemically synthesized
caggaatcgagagtattccaaa

SEQ ID NO: 895097 - DNA, 22 bp, Artificial Sequence
  chemically synthesized
ttccgtgaagtatttggaatac

SEQ ID NO: 895098 - DNA, 22 bp, Artificial Sequence
  chemically synthesized
tatttttccgtgaagtatttgg

SEQ ID NO: 895099 - DNA, 22 bp, Artificial Sequence
  chemically synthesized
ttatatttttccgtgaagtatt

SEQ ID NO: 895100 - DNA, 22 bp, Artificial Sequence
  chemically synthesized
acacctgttatatttttccgtg

SEQ ID NO: 895101 - DNA, 22 bp, Artificial Sequence
  chemically synthesized
caaatacttcacggaaaaatat

SEQ ID NO: 895102 - DNA, 22 bp, Artificial Sequence
  chemically synthesized
ctcacacctgttatatttttcc

SEQ ID NO: 895103 - DNA, 22 bp, Artificial Sequence
  chemically synthesized
tacattactcacacctgttata

SEQ ID NO: 895104 - DNA, 22 bp, Artificial Sequence
  chemically synthesized
cacggaaaaatataacaggtgt

SEQ ID NO: 895105 - DNA, 22 bp, Artificial Sequence
  chemically synthesized
acggaaaaatataacaggtgtg

SEQ ID NO: 895106 - DNA, 22 bp, Artificial Sequence
  chemically synthesized
cacgttatacattactcacacc

SEQ ID NO: 895107 - DNA, 22 bp, Artificial Sequence
  chemically synthesized
ccacgttatacattactcacac

SEQ ID NO: 895108 - DNA, 22 bp, Artificial Sequence
  chemically synthesized
tccacgttatacattactcaca

SEQ ID NO: 895109 - DNA, 22 bp, Artificial Sequence
  chemically synthesized
ttccacgttatacattactcac

SEQ ID NO: 895110 - DNA, 22 bp, Artificial Sequence
  chemically synthesized
tttccacgttatacattactca

SEQ ID NO: 895111 - DNA, 22 bp, Artificial Sequence
  chemically synthesized
atctttttccacgttatacatt

SEQ ID NO: 895112 - DNA, 22 bp, Artificial Sequence
  chemically synthesized
aatctttttccacgttatacat

SEQ ID NO: 895113 - DNA, 22 bp, Artificial Sequence
  chemically synthesized
atacaaaccttaatctttttcc

SEQ ID NO: 895114 - DNA, 22 bp, Artificial Sequence
  chemically synthesized
aaacacatagaatctgatacaa

SEQ ID NO: 895115 - DNA, 22 bp, Artificial Sequence
  chemically synthesized
aaaacacatagaatctgataca

SEQ ID NO: 895116 - DNA, 22 bp, Artificial Sequence
  chemically synthesized
atttaaaacacatagaatctga

SEQ ID NO: 895117 - DNA, 22 bp, Artificial Sequence
  chemically synthesized
aggtttgtatcagattctatgt

SEQ ID NO: 895118 - DNA, 22 bp, Artificial Sequence
  chemically synthesized
gtatcagattctatgtgtttta

SEQ ID NO: 895119 - DNA, 22 bp, Artificial Sequence
  chemically synthesized
tatcagattctatgtgttttaa

SEQ ID NO: 895120 - DNA, 22 bp, Artificial Sequence
  chemically synthesized
tatgtgttttaaattaatttac

SEQ ID NO: 895121 - DNA, 22 bp, Artificial Sequence
  chemically synthesized
tgtgttttaaattaatttacat

SEQ ID NO: 895122 - DNA, 22 bp, Artificial Sequence
  chemically synthesized
taaattaatttacatttatatt

SEQ ID NO: 895123 - DNA, 22 bp, Artificial Sequence
  chemically synthesized
aaattaatttacatttatattt

SEQ ID NO: 895124 - DNA, 22 bp, Artificial Sequence
  chemically synthesized
aattaatttacatttatattta

SEQ ID NO: 895125 - DNA, 22 bp, Artificial Sequence
  chemically synthesized
atttacatttatatttactatt

SEQ ID NO: 895126 - DNA, 22 bp, Artificial Sequence
  chemically synthesized
atgtgaatgcaaaatagtaaat

SEQ ID NO: 895127 - DNA, 22 bp, Artificial Sequence
  chemically synthesized
gatgtgaatgcaaaatagtaaa

SEQ ID NO: 895128 - DNA, 22 bp, Artificial Sequence
  chemically synthesized
tgatgtgaatgcaaaatagtaa

SEQ ID NO: 895129 - DNA, 22 bp, Artificial Sequence
  chemically synthesized
acatttatatttactattttgc

SEQ ID NO: 895130 - DNA, 22 bp, Artificial Sequence
  chemically synthesized
catttatatttactattttgca

SEQ ID NO: 895131 - DNA, 22 bp, Artificial Sequence
  chemically synthesized
tactttgatgtgaatgcaaaat

SEQ ID NO: 895132 - DNA, 22 bp, Artificial Sequence
  chemically synthesized
atatttactattttgcattcac

SEQ ID NO: 895133 - DNA, 22 bp, Artificial Sequence
  chemically synthesized
tatttactattttgcattcaca

SEQ ID NO: 895134 - DNA, 22 bp, Artificial Sequence
  chemically synthesized
tgtctatactttgatgtgaatg

SEQ ID NO: 895135 - DNA, 22 bp, Artificial Sequence
  chemically synthesized
gtgtctatactttgatgtgaat

SEQ ID NO: 895136 - DNA, 22 bp, Artificial Sequence
  chemically synthesized
actattttgcattcacatcaaa

SEQ ID NO: 895137 - DNA, 22 bp, Artificial Sequence
  chemically synthesized
ctattttgcattcacatcaaag

SEQ ID NO: 895138 - DNA, 22 bp, Artificial Sequence
  chemically synthesized
ttttgcattcacatcaaagtat

SEQ ID NO: 895139 - DNA, 22 bp, Artificial Sequence
  chemically synthesized
tgcattcacatcaaagtataga

SEQ ID NO: 895140 - DNA, 22 bp, Artificial Sequence
  chemically synthesized
gcattcacatcaaagtatagac

SEQ ID NO: 895141 - DNA, 22 bp, Artificial Sequence
  chemically synthesized
cattcacatcaaagtatagaca

SEQ ID NO: 895142 - DNA, 22 bp, Artificial Sequence
  chemically synthesized
ccggtcaggtgtttgtgtctat

SEQ ID NO: 895143 - DNA, 22 bp, Artificial Sequence
  chemically synthesized
accggtcaggtgtttgtgtcta

SEQ ID NO: 895144 - DNA, 22 bp, Artificial Sequence
  chemically synthesized
acatcaaagtatagacacaaac

SEQ ID NO: 895145 - DNA, 22 bp, Artificial Sequence
  chemically synthesized
taccggtcaggtgtttgtgtct

SEQ ID NO: 895146 - DNA, 22 bp, Artificial Sequence
  chemically synthesized
gaaaaatgatgtattttaccgg

SEQ ID NO: 895147 - DNA, 22 bp, Artificial Sequence
  chemically synthesized
ttagaaaaatgatgtattttac

SEQ ID NO: 895148 - DNA, 22 bp, Artificial Sequence
  chemically synthesized
accggtaaaatacatcattttt

SEQ ID NO: 895149 - DNA, 22 bp, Artificial Sequence
  chemically synthesized
taatacataaaaggattattag

SEQ ID NO: 895150 - DNA, 22 bp, Artificial Sequence
  chemically synthesized
ataatacataaaaggattatta

SEQ ID NO: 895151 - DNA, 22 bp, Artificial Sequence
  chemically synthesized
tataatacataaaaggattatt

SEQ ID NO: 895152 - DNA, 22 bp, Artificial Sequence
  chemically synthesized
ttctaataatccttttatgtat

SEQ ID NO: 895153 - DNA, 22 bp, Artificial Sequence
  chemically synthesized
tctaataatccttttatgtatt

SEQ ID NO: 895154 - DNA, 22 bp, Artificial Sequence
  chemically synthesized
ctaataatccttttatgtatta

SEQ ID NO: 895155 - DNA, 22 bp, Artificial Sequence
  chemically synthesized
taataatccttttatgtattat

SEQ ID NO: 895156 - DNA, 22 bp, Artificial Sequence
  chemically synthesized
ataatccttttatgtattataa

SEQ ID NO: 895157 - DNA, 22 bp, Artificial Sequence
  chemically synthesized
tatgaagagcatggttttataa

SEQ ID NO: 895158 - DNA, 22 bp, Artificial Sequence
  chemically synthesized
ttatgtattataaaaccatgct

SEQ ID NO: 895159 - DNA, 22 bp, Artificial Sequence
  chemically synthesized
tatgtattataaaaccatgctc

SEQ ID NO: 895160 - DNA, 22 bp, Artificial Sequence
  chemically synthesized
atgtattataaaaccatgctct

SEQ ID NO: 895161 - DNA, 22 bp, Artificial Sequence
  chemically synthesized
tgtattataaaaccatgctctt

SEQ ID NO: 895162 - DNA, 22 bp, Artificial Sequence
  chemically synthesized
taaaaccatgctcttcatataa

SEQ ID NO: 895163 - DNA, 22 bp, Artificial Sequence
  chemically synthesized
accacagggaacatgttatatg

SEQ ID NO: 895164 - DNA, 22 bp, Artificial Sequence
  chemically synthesized
caccacagggaacatgttatat

SEQ ID NO: 895165 - DNA, 22 bp, Artificial Sequence
  chemically synthesized
tcaccacagggaacatgttata

SEQ ID NO: 895166 - DNA, 22 bp, Artificial Sequence
  chemically synthesized
tttcaccacagggaacatgtta

SEQ ID NO: 895167 - DNA, 22 bp, Artificial Sequence
  chemically synthesized
ctttcaccacagggaacatgtt

SEQ ID NO: 895168 - DNA, 22 bp, Artificial Sequence
  chemically synthesized
tctttcaccacagggaacatgt

SEQ ID NO: 895169 - DNA, 22 bp, Artificial Sequence
  chemically synthesized
ttttctttcaccacagggaaca

SEQ ID NO: 895170 - DNA, 22 bp, Artificial Sequence
  chemically synthesized
ttcatataacatgttccctgtg

SEQ ID NO: 895171 - DNA, 22 bp, Artificial Sequence
  chemically synthesized
gttttctttcaccacagggaac

SEQ ID NO: 895172 - DNA, 22 bp, Artificial Sequence
  chemically synthesized
catataacatgttccctgtggt

SEQ ID NO: 895173 - DNA, 22 bp, Artificial Sequence
  chemically synthesized
atataacatgttccctgtggtg

SEQ ID NO: 895174 - DNA, 22 bp, Artificial Sequence
  chemically synthesized
aatgtgtttgttttctttcacc

SEQ ID NO: 895175 - DNA, 22 bp, Artificial Sequence
  chemically synthesized
cctgtggtgaaagaaaacaaac

SEQ ID NO: 895176 - DNA, 22 bp, Artificial Sequence
  chemically synthesized
tggtgaaagaaaacaaacacat

SEQ ID NO: 895177 - DNA, 22 bp, Artificial Sequence
  chemically synthesized
acacataagggaattgaatgtg

SEQ ID NO: 895178 - DNA, 22 bp, Artificial Sequence
  chemically synthesized
aattaacacataagggaattga

SEQ ID NO: 895179 - DNA, 22 bp, Artificial Sequence
  chemically synthesized
gatactaaattaacacataagg

SEQ ID NO: 895180 - DNA, 22 bp, Artificial Sequence
  chemically synthesized
agatactaaattaacacataag

SEQ ID NO: 895181 - DNA, 22 bp, Artificial Sequence
  chemically synthesized
aattcccttatgtgttaattta

SEQ ID NO: 895182 - DNA, 22 bp, Artificial Sequence
  chemically synthesized
ccttatgtgttaatttagtatc

SEQ ID NO: 895183 - DNA, 22 bp, Artificial Sequence
  chemically synthesized
atgtgttaatttagtatctaag

SEQ ID NO: 895184 - DNA, 22 bp, Artificial Sequence
  chemically synthesized
ggtcaagatgtgcttagatact

SEQ ID NO: 895185 - DNA, 22 bp, Artificial Sequence
  chemically synthesized
tgtgttaatttagtatctaagc

SEQ ID NO: 895186 - DNA, 22 bp, Artificial Sequence
  chemically synthesized
atttagtatctaagcacatctt

SEQ ID NO: 895187 - DNA, 22 bp, Artificial Sequence
  chemically synthesized
tgtgaaattaggtcaagatgtg

SEQ ID NO: 895188 - DNA, 22 bp, Artificial Sequence
  chemically synthesized
gtgtgaaattaggtcaagatgt

SEQ ID NO: 895189 - DNA, 22 bp, Artificial Sequence
  chemically synthesized
agtatctaagcacatcttgacc

SEQ ID NO: 895190 - DNA, 22 bp, Artificial Sequence
  chemically synthesized
gtatctaagcacatcttgacct

SEQ ID NO: 895191 - DNA, 22 bp, Artificial Sequence
  chemically synthesized
agcacatcttgacctaatttca

SEQ ID NO: 895192 - DNA, 22 bp, Artificial Sequence
  chemically synthesized
gacctaatttcacacaagatta

SEQ ID NO: 895193 - DNA, 22 bp, Artificial Sequence
  chemically synthesized
acctaatttcacacaagattac

SEQ ID NO: 895194 - DNA, 22 bp, Artificial Sequence
  chemically synthesized
aaagaataaggaaagtaatctt

SEQ ID NO: 895195 - DNA, 22 bp, Artificial Sequence
  chemically synthesized
atttcacacaagattactttcc

SEQ ID NO: 895196 - DNA, 22 bp, Artificial Sequence
  chemically synthesized
cacacaagattactttccttat

SEQ ID NO: 895197 - DNA, 22 bp, Artificial Sequence
  chemically synthesized
acacaagattactttccttatt

SEQ ID NO: 895198 - DNA, 22 bp, Artificial Sequence
  chemically synthesized
agagattgaaagaataaggaaa

SEQ ID NO: 895199 - DNA, 22 bp, Artificial Sequence
  chemically synthesized
acattcagagattgaaagaata

SEQ ID NO: 895200 - DNA, 22 bp, Artificial Sequence
  chemically synthesized
ctttccttattctttcaatctc

SEQ ID NO: 895201 - DNA, 22 bp, Artificial Sequence
  chemically synthesized
aaattaacattcagagattgaa

SEQ ID NO: 895202 - DNA, 22 bp, Artificial Sequence
  chemically synthesized
gaaattaacattcagagattga

SEQ ID NO: 895203 - DNA, 22 bp, Artificial Sequence
  chemically synthesized
tccttattctttcaatctctga

SEQ ID NO: 895204 - DNA, 22 bp, Artificial Sequence
  chemically synthesized
ccttattctttcaatctctgaa

SEQ ID NO: 895205 - DNA, 22 bp, Artificial Sequence
  chemically synthesized
cttattctttcaatctctgaat

SEQ ID NO: 895206 - DNA, 22 bp, Artificial Sequence
  chemically synthesized
attctttcaatctctgaatgtt

SEQ ID NO: 895207 - DNA, 22 bp, Artificial Sequence
  chemically synthesized
ttctttcaatctctgaatgtta

SEQ ID NO: 895208 - DNA, 22 bp, Artificial Sequence
  chemically synthesized
tttcaatctctgaatgttaatt

SEQ ID NO: 895209 - DNA, 22 bp, Artificial Sequence
  chemically synthesized
tcaatctctgaatgttaatttc

SEQ ID NO: 895210 - DNA, 22 bp, Artificial Sequence
  chemically synthesized
caatctctgaatgttaatttca

SEQ ID NO: 895211 - DNA, 22 bp, Artificial Sequence
  chemically synthesized
aatctctgaatgttaatttcaa

SEQ ID NO: 895212 - DNA, 22 bp, Artificial Sequence
  chemically synthesized
aaacatatacatttgaaattaa

SEQ ID NO: 895213 - DNA, 22 bp, Artificial Sequence
  chemically synthesized
tgaatgttaatttcaaatgtat

SEQ ID NO: 895214 - DNA, 22 bp, Artificial Sequence
  chemically synthesized
atattaaaacatatacatttga

SEQ ID NO: 895215 - DNA, 22 bp, Artificial Sequence
  chemically synthesized
aatattaaaacatatacatttg

SEQ ID NO: 895216 - DNA, 22 bp, Artificial Sequence
  chemically synthesized
aatgttaatttcaaatgtatat

SEQ ID NO: 895217 - DNA, 22 bp, Artificial Sequence
  chemically synthesized
tcttaatattaaaacatataca

SEQ ID NO: 895218 - DNA, 22 bp, Artificial Sequence
  chemically synthesized
atcttaatattaaaacatatac

SEQ ID NO: 895219 - DNA, 22 bp, Artificial Sequence
  chemically synthesized
atttcaaatgtatatgttttaa

SEQ ID NO: 895220 - DNA, 22 bp, Artificial Sequence
  chemically synthesized
cttatcttaatattaaaacata

SEQ ID NO: 895221 - DNA, 22 bp, Artificial Sequence
  chemically synthesized
gcttatcttaatattaaaacat

SEQ ID NO: 895222 - DNA, 22 bp, Artificial Sequence
  chemically synthesized
tgcttatcttaatattaaaaca

SEQ ID NO: 895223 - DNA, 22 bp, Artificial Sequence
  chemically synthesized
ttgcttatcttaatattaaaac

SEQ ID NO: 895224 - DNA, 22 bp, Artificial Sequence
  chemically synthesized
caaatgtatatgttttaatatt

SEQ ID NO: 895225 - DNA, 22 bp, Artificial Sequence
  chemically synthesized
aaatgtatatgttttaatatta

SEQ ID NO: 895226 - DNA, 22 bp, Artificial Sequence
  chemically synthesized
aaacagacacttttgcttatct

SEQ ID NO: 895227 - DNA, 22 bp, Artificial Sequence
  chemically synthesized
taaaacagacacttttgcttat

SEQ ID NO: 895228 - DNA, 22 bp, Artificial Sequence
  chemically synthesized
ctaaaacagacacttttgctta

SEQ ID NO: 895229 - DNA, 22 bp, Artificial Sequence
  chemically synthesized
taatattaagataagcaaaagt

SEQ ID NO: 895230 - DNA, 22 bp, Artificial Sequence
  chemically synthesized
aatattaagataagcaaaagtg

SEQ ID NO: 895231 - DNA, 22 bp, Artificial Sequence
  chemically synthesized
atattaagataagcaaaagtgt

SEQ ID NO: 895232 - DNA, 22 bp, Artificial Sequence
  chemically synthesized
tttctaaaacagacacttttgc

SEQ ID NO: 895233 - DNA, 22 bp, Artificial Sequence
  chemically synthesized
atttctaaaacagacacttttg

SEQ ID NO: 895234 - DNA, 22 bp, Artificial Sequence
  chemically synthesized
agataagcaaaagtgtctgttt

SEQ ID NO: 895235 - DNA, 22 bp, Artificial Sequence
  chemically synthesized
atatgtttatttctaaaacaga

SEQ ID NO: 895236 - DNA, 22 bp, Artificial Sequence
  chemically synthesized
aatatgtttatttctaaaacag

SEQ ID NO: 895237 - DNA, 22 bp, Artificial Sequence
  chemically synthesized
tgaaatccatcttaatatgttt

SEQ ID NO: 895238 - DNA, 22 bp, Artificial Sequence
  chemically synthesized
ttttagaaataaacatattaag

SEQ ID NO: 895239 - DNA, 22 bp, Artificial Sequence
  chemically synthesized
tagaaataaacatattaagatg

SEQ ID NO: 895240 - DNA, 22 bp, Artificial Sequence
  chemically synthesized
tgttatgaaatccatcttaata

SEQ ID NO: 895241 - DNA, 22 bp, Artificial Sequence
  chemically synthesized
agaaataaacatattaagatgg

SEQ ID NO: 895242 - DNA, 22 bp, Artificial Sequence
  chemically synthesized
gtgttatgaaatccatcttaat

SEQ ID NO: 895243 - DNA, 22 bp, Artificial Sequence
  chemically synthesized
gaaataaacatattaagatgga

SEQ ID NO: 895244 - DNA, 22 bp, Artificial Sequence
  chemically synthesized
tgtgttatgaaatccatcttaa

SEQ ID NO: 895245 - DNA, 22 bp, Artificial Sequence
  chemically synthesized
aaatgttttgtgttatgaaatc

SEQ ID NO: 895246 - DNA, 22 bp, Artificial Sequence
  chemically synthesized
taaaatgttttgtgttatgaaa

SEQ ID NO: 895247 - DNA, 22 bp, Artificial Sequence
  chemically synthesized
ctaaaatgttttgtgttatgaa

SEQ ID NO: 895248 - DNA, 22 bp, Artificial Sequence
  chemically synthesized
tctaaaatgttttgtgttatga

SEQ ID NO: 895249 - DNA, 22 bp, Artificial Sequence
  chemically synthesized
ttctaaaatgttttgtgttatg

SEQ ID NO: 895250 - DNA, 22 bp, Artificial Sequence
  chemically synthesized
agatggatttcataacacaaaa

SEQ ID NO: 895251 - DNA, 22 bp, Artificial Sequence
  chemically synthesized
atttttctaaaatgttttgtgt

SEQ ID NO: 895252 - DNA, 22 bp, Artificial Sequence
  chemically synthesized
aatttttctaaaatgttttgtg

SEQ ID NO: 895253 - DNA, 22 bp, Artificial Sequence
  chemically synthesized
taatttttctaaaatgttttgt

SEQ ID NO: 895254 - DNA, 22 bp, Artificial Sequence
  chemically synthesized
cataacacaaaacattttagaa

SEQ ID NO: 895255 - DNA, 22 bp, Artificial Sequence
  chemically synthesized
acactttaatttttctaaaatg

SEQ ID NO: 895256 - DNA, 22 bp, Artificial Sequence
  chemically synthesized
ataacacaaaacattttagaaa

SEQ ID NO: 895257 - DNA, 22 bp, Artificial Sequence
  chemically synthesized
aacactttaatttttctaaaat

SEQ ID NO: 895258 - DNA, 22 bp, Artificial Sequence
  chemically synthesized
tgcttaacactttaatttttct

SEQ ID NO: 895259 - DNA, 22 bp, Artificial Sequence
  chemically synthesized
atgcttaacactttaatttttc

SEQ ID NO: 895260 - DNA, 22 bp, Artificial Sequence
  chemically synthesized
tatgcttaacactttaattttt

SEQ ID NO: 895261 - DNA, 22 bp, Artificial Sequence
  chemically synthesized
ttatgcttaacactttaatttt

SEQ ID NO: 895262 - DNA, 22 bp, Artificial Sequence
  chemically synthesized
tttttatgcttaacactttaat

SEQ ID NO: 895263 - DNA, 22 bp, Artificial Sequence
  chemically synthesized
ctatttttatgcttaacacttt

SEQ ID NO: 895264 - DNA, 22 bp, Artificial Sequence
  chemically synthesized
actatttttatgcttaacactt

SEQ ID NO: 895265 - DNA, 22 bp, Artificial Sequence
  chemically synthesized
tagaaaaattaaagtgttaagc

SEQ ID NO: 895266 - DNA, 22 bp, Artificial Sequence
  chemically synthesized
agaaaaattaaagtgttaagca

SEQ ID NO: 895267 - DNA, 22 bp, Artificial Sequence
  chemically synthesized
ttactatttttatgcttaacac

SEQ ID NO: 895268 - DNA, 22 bp, Artificial Sequence
  chemically synthesized
gaaaaattaaagtgttaagcat

SEQ ID NO: 895269 - DNA, 22 bp, Artificial Sequence
  chemically synthesized
cttactatttttatgcttaaca

SEQ ID NO: 895270 - DNA, 22 bp, Artificial Sequence
  chemically synthesized
ttcttactatttttatgcttaa

SEQ ID NO: 895271 - DNA, 22 bp, Artificial Sequence
  chemically synthesized
cagttcttcttactatttttat

SEQ ID NO: 895272 - DNA, 22 bp, Artificial Sequence
  chemically synthesized
aagtgttaagcataaaaatagt

SEQ ID NO: 895273 - DNA, 22 bp, Artificial Sequence
  chemically synthesized
ttccagttcttcttactatttt

SEQ ID NO: 895274 - DNA, 22 bp, Artificial Sequence
  chemically synthesized
attccagttcttcttactattt

SEQ ID NO: 895275 - DNA, 22 bp, Artificial Sequence
  chemically synthesized
tattccagttcttcttactatt

SEQ ID NO: 895276 - DNA, 22 bp, Artificial Sequence
  chemically synthesized
agcataaaaatagtaagaagaa

SEQ ID NO: 895277 - DNA, 22 bp, Artificial Sequence
  chemically synthesized
cccacgccaatattttattcca

SEQ ID NO: 895278 - DNA, 22 bp, Artificial Sequence
  chemically synthesized
ccccacgccaatattttattcc

SEQ ID NO: 895279 - DNA, 22 bp, Artificial Sequence
  chemically synthesized
aaaggcttccccacgccaatat

SEQ ID NO: 895280 - DNA, 22 bp, Artificial Sequence
  chemically synthesized
taaaaggcttccccacgccaat

SEQ ID NO: 895281 - DNA, 22 bp, Artificial Sequence
  chemically synthesized
ctaaaaggcttccccacgccaa

SEQ ID NO: 895282 - DNA, 22 bp, Artificial Sequence
  chemically synthesized
gaataaaatattggcgtgggga

SEQ ID NO: 895283 - DNA, 22 bp, Artificial Sequence
  chemically synthesized
cttctaaaaggcttccccacgc

SEQ ID NO: 895284 - DNA, 22 bp, Artificial Sequence
  chemically synthesized
gcttctaaaaggcttccccacg

SEQ ID NO: 895285 - DNA, 22 bp, Artificial Sequence
  chemically synthesized
tgcttctaaaaggcttccccac

SEQ ID NO: 895286 - DNA, 22 bp, Artificial Sequence
  chemically synthesized
ttgcttctaaaaggcttcccca

SEQ ID NO: 895287 - DNA, 22 bp, Artificial Sequence
  chemically synthesized
tttgcttctaaaaggcttcccc

SEQ ID NO: 895288 - DNA, 22 bp, Artificial Sequence
  chemically synthesized
ttttgcttctaaaaggcttccc

SEQ ID NO: 895289 - DNA, 22 bp, Artificial Sequence
  chemically synthesized
tttttgcttctaaaaggcttcc

SEQ ID NO: 895290 - DNA, 22 bp, Artificial Sequence
  chemically synthesized
tttttttgcttctaaaaggctt

SEQ ID NO: 895291 - DNA, 22 bp, Artificial Sequence
  chemically synthesized
gcgtggggaagccttttagaag

SEQ ID NO: 895292 - DNA, 22 bp, Artificial Sequence
  chemically synthesized
tattctttttttgcttctaaaa

SEQ ID NO: 895293 - DNA, 22 bp, Artificial Sequence
  chemically synthesized
atattctttttttgcttctaaa

SEQ ID NO: 895294 - DNA, 22 bp, Artificial Sequence
  chemically synthesized
tatattctttttttgcttctaa

SEQ ID NO: 895295 - DNA, 22 bp, Artificial Sequence
  chemically synthesized
ttatattctttttttgcttcta

SEQ ID NO: 895296 - DNA, 22 bp, Artificial Sequence
  chemically synthesized
tttatattctttttttgcttct

SEQ ID NO: 895297 - DNA, 22 bp, Artificial Sequence
  chemically synthesized
aatctttttatattcttttttt

SEQ ID NO: 895298 - DNA, 22 bp, Artificial Sequence
  chemically synthesized
ttagaagcaaaaaaagaatata

SEQ ID NO: 895299 - DNA, 22 bp, Artificial Sequence
  chemically synthesized
tagaagcaaaaaaagaatataa

SEQ ID NO: 895300 - DNA, 22 bp, Artificial Sequence
  chemically synthesized
tattcaatctttttatattctt

SEQ ID NO: 895301 - DNA, 22 bp, Artificial Sequence
  chemically synthesized
agaagcaaaaaaagaatataaa

SEQ ID NO: 895302 - DNA, 22 bp, Artificial Sequence
  chemically synthesized
gaagcaaaaaaagaatataaaa

SEQ ID NO: 895303 - DNA, 22 bp, Artificial Sequence
  chemically synthesized
taagtgaatacgcatattatat

SEQ ID NO: 895304 - DNA, 22 bp, Artificial Sequence
  chemically synthesized
ataagtgaatacgcatattata

SEQ ID NO: 895305 - DNA, 22 bp, Artificial Sequence
  chemically synthesized
atttataagtgaatacgcatat

SEQ ID NO: 895306 - DNA, 22 bp, Artificial Sequence
  chemically synthesized
aatttataagtgaatacgcata

SEQ ID NO: 895307 - DNA, 22 bp, Artificial Sequence
  chemically synthesized
taatttataagtgaatacgcat

SEQ ID NO: 895308 - DNA, 22 bp, Artificial Sequence
  chemically synthesized
aatataatatgcgtattcactt

SEQ ID NO: 895309 - DNA, 22 bp, Artificial Sequence
  chemically synthesized
gtggctttaatttataagtgaa

SEQ ID NO: 895310 - DNA, 22 bp, Artificial Sequence
  chemically synthesized
attagtggctttaatttataag

SEQ ID NO: 895311 - DNA, 22 bp, Artificial Sequence
  chemically synthesized
gattagtggctttaatttataa

SEQ ID NO: 895312 - DNA, 22 bp, Artificial Sequence
  chemically synthesized
tgattagtggctttaatttata

SEQ ID NO: 895313 - DNA, 22 bp, Artificial Sequence
  chemically synthesized
attttgattagtggctttaatt

SEQ ID NO: 895314 - DNA, 22 bp, Artificial Sequence
  chemically synthesized
aattttgattagtggctttaat

SEQ ID NO: 895315 - DNA, 22 bp, Artificial Sequence
  chemically synthesized
taattttgattagtggctttaa

SEQ ID NO: 895316 - DNA, 22 bp, Artificial Sequence
  chemically synthesized
acttataaattaaagccactaa

SEQ ID NO: 895317 - DNA, 22 bp, Artificial Sequence
  chemically synthesized
ttttaattttgattagtggctt

SEQ ID NO: 895318 - DNA, 22 bp, Artificial Sequence
  chemically synthesized
gttttaattttgattagtggct

SEQ ID NO: 895319 - DNA, 22 bp, Artificial Sequence
  chemically synthesized
ataaattaaagccactaatcaa

SEQ ID NO: 895320 - DNA, 22 bp, Artificial Sequence
  chemically synthesized
taaattaaagccactaatcaaa

SEQ ID NO: 895321 - DNA, 22 bp, Artificial Sequence
  chemically synthesized
tcatttgttttaattttgatta

SEQ ID NO: 895322 - DNA, 22 bp, Artificial Sequence
  chemically synthesized
aagccactaatcaaaattaaaa

SEQ ID NO: 895323 - DNA, 22 bp, Artificial Sequence
  chemically synthesized
ccagttgtcatttgttttaatt

SEQ ID NO: 895324 - DNA, 22 bp, Artificial Sequence
  chemically synthesized
atcaaaattaaaacaaatgaca

SEQ ID NO: 895325 - DNA, 22 bp, Artificial Sequence
  chemically synthesized
caaatattcccagttgtcattt

SEQ ID NO: 895326 - DNA, 22 bp, Artificial Sequence
  chemically synthesized
aaacaaatgacaactgggaata

SEQ ID NO: 895327 - DNA, 22 bp, Artificial Sequence
  chemically synthesized
atatatgctgcaaatattccca

SEQ ID NO: 895328 - DNA, 22 bp, Artificial Sequence
  chemically synthesized
tgtctgatatatgctgcaaata

SEQ ID NO: 895329 - DNA, 22 bp, Artificial Sequence
  chemically synthesized
ccctgtgtctgatatatgctgc

SEQ ID NO: 895330 - DNA, 22 bp, Artificial Sequence
  chemically synthesized
ggaatatttgcagcatatatca

SEQ ID NO: 895331 - DNA, 22 bp, Artificial Sequence
  chemically synthesized
ttaccctgtgtctgatatatgc

SEQ ID NO: 895332 - DNA, 22 bp, Artificial Sequence
  chemically synthesized
aaattattaccctgtgtctgat

SEQ ID NO: 895333 - DNA, 22 bp, Artificial Sequence
  chemically synthesized
gcagcatatatcagacacaggg

SEQ ID NO: 895334 - DNA, 22 bp, Artificial Sequence
  chemically synthesized
cagcatatatcagacacagggt

SEQ ID NO: 895335 - DNA, 22 bp, Artificial Sequence
  chemically synthesized
tatgctaaaattattaccctgt

SEQ ID NO: 895336 - DNA, 22 bp, Artificial Sequence
  chemically synthesized
atatgctaaaattattaccctg

SEQ ID NO: 895337 - DNA, 22 bp, Artificial Sequence
  chemically synthesized
tatatgctaaaattattaccct

SEQ ID NO: 895338 - DNA, 22 bp, Artificial Sequence
  chemically synthesized
ttatatgctaaaattattaccc

SEQ ID NO: 895339 - DNA, 22 bp, Artificial Sequence
  chemically synthesized
tttatatgctaaaattattacc

SEQ ID NO: 895340 - DNA, 22 bp, Artificial Sequence
  chemically synthesized
ttttatatgctaaaattattac

SEQ ID NO: 895341 - DNA, 22 bp, Artificial Sequence
  chemically synthesized
aaagatttttttatatgctaaa

SEQ ID NO: 895342 - DNA, 22 bp, Artificial Sequence
  chemically synthesized
attaaaagatttttttatatgc

SEQ ID NO: 895343 - DNA, 22 bp, Artificial Sequence
  chemically synthesized
ctcattaaaagatttttttata

SEQ ID NO: 895344 - DNA, 22 bp, Artificial Sequence
  chemically synthesized
actcattaaaagatttttttat

SEQ ID NO: 895345 - DNA, 22 bp, Artificial Sequence
  chemically synthesized
tactcattaaaagattttttta

SEQ ID NO: 895346 - DNA, 22 bp, Artificial Sequence
  chemically synthesized
ttactcattaaaagattttttt

SEQ ID NO: 895347 - DNA, 22 bp, Artificial Sequence
  chemically synthesized
tttactcattaaaagatttttt

SEQ ID NO: 895348 - DNA, 22 bp, Artificial Sequence
  chemically synthesized
ttttactcattaaaagattttt

SEQ ID NO: 895349 - DNA, 22 bp, Artificial Sequence
  chemically synthesized
tttttactcattaaaagatttt

SEQ ID NO: 895350 - DNA, 22 bp, Artificial Sequence
  chemically synthesized
tagcatataaaaaaatctttta

SEQ ID NO: 895351 - DNA, 22 bp, Artificial Sequence
  chemically synthesized
agcatataaaaaaatcttttaa

SEQ ID NO: 895352 - DNA, 22 bp, Artificial Sequence
  chemically synthesized
gcatataaaaaaatcttttaat

SEQ ID NO: 895353 - DNA, 22 bp, Artificial Sequence
  chemically synthesized
ctttttttactcattaaaagat

SEQ ID NO: 895354 - DNA, 22 bp, Artificial Sequence
  chemically synthesized
cctttttttactcattaaaaga

SEQ ID NO: 895355 - DNA, 22 bp, Artificial Sequence
  chemically synthesized
tcctttttttactcattaaaag

SEQ ID NO: 895356 - DNA, 22 bp, Artificial Sequence
  chemically synthesized
ttcctttttttactcattaaaa

SEQ ID NO: 895357 - DNA, 22 bp, Artificial Sequence
  chemically synthesized
cagtagatttttccttttttta

SEQ ID NO: 895358 - DNA, 22 bp, Artificial Sequence
  chemically synthesized
ccagtagatttttccttttttt

SEQ ID NO: 895359 - DNA, 22 bp, Artificial Sequence
  chemically synthesized
tccagtagatttttcctttttt

SEQ ID NO: 895360 - DNA, 22 bp, Artificial Sequence
  chemically synthesized
ttaatgagtaaaaaaaggaaaa

SEQ ID NO: 895361 - DNA, 22 bp, Artificial Sequence
  chemically synthesized
taatgagtaaaaaaaggaaaaa

SEQ ID NO: 895362 - DNA, 22 bp, Artificial Sequence
  chemically synthesized
aatgagtaaaaaaaggaaaaat

SEQ ID NO: 895363 - DNA, 22 bp, Artificial Sequence
  chemically synthesized
atgagtaaaaaaaggaaaaatc

SEQ ID NO: 895364 - DNA, 22 bp, Artificial Sequence
  chemically synthesized
tccagttttccagtagattttt

SEQ ID NO: 895365 - DNA, 22 bp, Artificial Sequence
  chemically synthesized
atccagttttccagtagatttt

SEQ ID NO: 895366 - DNA, 22 bp, Artificial Sequence
  chemically synthesized
tatccagttttccagtagattt

SEQ ID NO: 895367 - DNA, 22 bp, Artificial Sequence
  chemically synthesized
tttatccagttttccagtagat

SEQ ID NO: 895368 - DNA, 22 bp, Artificial Sequence
  chemically synthesized
tgttctttatccagttttccag

SEQ ID NO: 895369 - DNA, 22 bp, Artificial Sequence
  chemically synthesized
atgttctttatccagttttcca

SEQ ID NO: 895370 - DNA, 22 bp, Artificial Sequence
  chemically synthesized
tatgttctttatccagttttcc

SEQ ID NO: 895371 - DNA, 22 bp, Artificial Sequence
  chemically synthesized
ttatgttctttatccagttttc

SEQ ID NO: 895372 - DNA, 22 bp, Artificial Sequence
  chemically synthesized
tttatgttctttatccagtttt

SEQ ID NO: 895373 - DNA, 22 bp, Artificial Sequence
  chemically synthesized
tttttatgttctttatccagtt

SEQ ID NO: 895374 - DNA, 22 bp, Artificial Sequence
  chemically synthesized
ctttttatgttctttatccagt

SEQ ID NO: 895375 - DNA, 22 bp, Artificial Sequence
  chemically synthesized
ctggaaaactggataaagaaca

SEQ ID NO: 895376 - DNA, 22 bp, Artificial Sequence
  chemically synthesized
tcaatttctttttatgttcttt

SEQ ID NO: 895377 - DNA, 22 bp, Artificial Sequence
  chemically synthesized
gaaaactggataaagaacataa

SEQ ID NO: 895378 - DNA, 22 bp, Artificial Sequence
  chemically synthesized
gtcaatttctttttatgttctt

SEQ ID NO: 895379 - DNA, 22 bp, Artificial Sequence
  chemically synthesized
tgtcaatttctttttatgttct

SEQ ID NO: 895380 - DNA, 22 bp, Artificial Sequence
  chemically synthesized
ttgtcaatttctttttatgttc

SEQ ID NO: 895381 - DNA, 22 bp, Artificial Sequence
  chemically synthesized
catttttgtcaatttcttttta

SEQ ID NO: 895382 - DNA, 22 bp, Artificial Sequence
  chemically synthesized
gataaagaacataaaaagaaat

SEQ ID NO: 895383 - DNA, 22 bp, Artificial Sequence
  chemically synthesized
acatttttgtcaatttcttttt

SEQ ID NO: 895384 - DNA, 22 bp, Artificial Sequence
  chemically synthesized
tttacatttttgtcaatttctt

SEQ ID NO: 895385 - DNA, 22 bp, Artificial Sequence
  chemically synthesized
gctgtttacatttttgtcaatt

SEQ ID NO: 895386 - DNA, 22 bp, Artificial Sequence
  chemically synthesized
ttggctgtttacatttttgtca

SEQ ID NO: 895387 - DNA, 22 bp, Artificial Sequence
  chemically synthesized
attggctgtttacatttttgtc

SEQ ID NO: 895388 - DNA, 22 bp, Artificial Sequence
  chemically synthesized
tttattggctgtttacattttt

SEQ ID NO: 895389 - DNA, 22 bp, Artificial Sequence
  chemically synthesized
gtttattggctgtttacatttt

SEQ ID NO: 895390 - DNA, 22 bp, Artificial Sequence
  chemically synthesized
ttgtttattggctgtttacatt

SEQ ID NO: 895391 - DNA, 22 bp, Artificial Sequence
  chemically synthesized
cttgtttattggctgtttacat

SEQ ID NO: 895392 - DNA, 22 bp, Artificial Sequence
  chemically synthesized
tcttgtttattggctgtttaca

SEQ ID NO: 895393 - DNA, 22 bp, Artificial Sequence
  chemically synthesized
ttcttgtttattggctgtttac

SEQ ID NO: 895394 - DNA, 22 bp, Artificial Sequence
  chemically synthesized
tttcttgtttattggctgttta

SEQ ID NO: 895395 - DNA, 22 bp, Artificial Sequence
  chemically synthesized
acaaaaatgtaaacagccaata

SEQ ID NO: 895396 - DNA, 22 bp, Artificial Sequence
  chemically synthesized
gattttttcttgtttattggct

SEQ ID NO: 895397 - DNA, 22 bp, Artificial Sequence
  chemically synthesized
tctggattttttcttgtttatt

SEQ ID NO: 895398 - DNA, 22 bp, Artificial Sequence
  chemically synthesized
actgtctggattttttcttgtt

SEQ ID NO: 895399 - DNA, 22 bp, Artificial Sequence
  chemically synthesized
ctaactgtctggattttttctt

SEQ ID NO: 895400 - DNA, 22 bp, Artificial Sequence
  chemically synthesized
attactaactgtctggattttt

SEQ ID NO: 895401 - DNA, 22 bp, Artificial Sequence
  chemically synthesized
attgattactaactgtctggat

SEQ ID NO: 895402 - DNA, 22 bp, Artificial Sequence
  chemically synthesized
cattgattactaactgtctgga

SEQ ID NO: 895403 - DNA, 22 bp, Artificial Sequence
  chemically synthesized
catttcattgattactaactgt

SEQ ID NO: 895404 - DNA, 22 bp, Artificial Sequence
  chemically synthesized
gcatttcattgattactaactg

SEQ ID NO: 895405 - DNA, 22 bp, Artificial Sequence
  chemically synthesized
tgcatttcattgattactaact

SEQ ID NO: 895406 - DNA, 22 bp, Artificial Sequence
  chemically synthesized
ctttgcatttcattgattacta

SEQ ID NO: 895407 - DNA, 22 bp, Artificial Sequence
  chemically synthesized
cctttgcatttcattgattact

SEQ ID NO: 895408 - DNA, 22 bp, Artificial Sequence
  chemically synthesized
tcctttgcatttcattgattac

SEQ ID NO: 895409 - DNA, 22 bp, Artificial Sequence
  chemically synthesized
ttttcctttgcatttcattgat

SEQ ID NO: 895410 - DNA, 22 bp, Artificial Sequence
  chemically synthesized
ctgttttcctttgcatttcatt

SEQ ID NO: 895411 - DNA, 22 bp, Artificial Sequence
  chemically synthesized
gtaatcaatgaaatgcaaagga

SEQ ID NO: 895412 - DNA, 22 bp, Artificial Sequence
  chemically synthesized
atataatagataaataatagta

SEQ ID NO: 895413 - DNA, 22 bp, Artificial Sequence
  chemically synthesized
cagaaactaatataatagataa

SEQ ID NO: 895414 - DNA, 22 bp, Artificial Sequence
  chemically synthesized
acagaaactaatataatagata

SEQ ID NO: 895415 - DNA, 22 bp, Artificial Sequence
  chemically synthesized
tacagaaactaatataatagat

SEQ ID NO: 895416 - DNA, 22 bp, Artificial Sequence
  chemically synthesized
tactattatttatctattatat

SEQ ID NO: 895417 - DNA, 22 bp, Artificial Sequence
  chemically synthesized
ttacagaaactaatataataga

SEQ ID NO: 895418 - DNA, 22 bp, Artificial Sequence
  chemically synthesized
ttatttatctattatattagtt

SEQ ID NO: 895419 - DNA, 22 bp, Artificial Sequence
  chemically synthesized
tttatctattatattagtttct

SEQ ID NO: 895420 - DNA, 22 bp, Artificial Sequence
  chemically synthesized
atctattatattagtttctgta

SEQ ID NO: 895421 - DNA, 22 bp, Artificial Sequence
  chemically synthesized
acaaagaccttttacagaaact

SEQ ID NO: 895422 - DNA, 22 bp, Artificial Sequence
  chemically synthesized
tctattatattagtttctgtaa

SEQ ID NO: 895423 - DNA, 22 bp, Artificial Sequence
  chemically synthesized
gacaaagaccttttacagaaac

SEQ ID NO: 895424 - DNA, 22 bp, Artificial Sequence
  chemically synthesized
tgacaaagaccttttacagaaa

SEQ ID NO: 895425 - DNA, 22 bp, Artificial Sequence
  chemically synthesized
ttatattagtttctgtaaaagg

SEQ ID NO: 895426 - DNA, 22 bp, Artificial Sequence
  chemically synthesized
tattagtttctgtaaaaggtct

SEQ ID NO: 895427 - DNA, 22 bp, Artificial Sequence
  chemically synthesized
cagaactttgacaaagaccttt

SEQ ID NO: 895428 - DNA, 22 bp, Artificial Sequence
  chemically synthesized
ccagaactttgacaaagacctt

SEQ ID NO: 895429 - DNA, 22 bp, Artificial Sequence
  chemically synthesized
tccagaactttgacaaagacct

SEQ ID NO: 895430 - DNA, 22 bp, Artificial Sequence
  chemically synthesized
gtttctgtaaaaggtctttgtc

SEQ ID NO: 895431 - DNA, 22 bp, Artificial Sequence
  chemically synthesized
ttttccagaactttgacaaaga

SEQ ID NO: 895432 - DNA, 22 bp, Artificial Sequence
  chemically synthesized
gttttccagaactttgacaaag

SEQ ID NO: 895433 - DNA, 22 bp, Artificial Sequence
  chemically synthesized
ctgtaaaaggtctttgtcaaag

SEQ ID NO: 895434 - DNA, 22 bp, Artificial Sequence
  chemically synthesized
tgtaaaaggtctttgtcaaagt

SEQ ID NO: 895435 - DNA, 22 bp, Artificial Sequence
  chemically synthesized
cttgttttccagaactttgaca

SEQ ID NO: 895436 - DNA, 22 bp, Artificial Sequence
  chemically synthesized
taaaaggtctttgtcaaagttc

SEQ ID NO: 895437 - DNA, 22 bp, Artificial Sequence
  chemically synthesized
tgtcaaagttctggaaaacaag

SEQ ID NO: 895438 - DNA, 22 bp, Artificial Sequence
  chemically synthesized
gtcaaagttctggaaaacaagc

SEQ ID NO: 895439 - DNA, 22 bp, Artificial Sequence
  chemically synthesized
tcaaagttctggaaaacaagca

SEQ ID NO: 895440 - DNA, 22 bp, Artificial Sequence
  chemically synthesized
caaggaagatcataaaattgct

SEQ ID NO: 895441 - DNA, 22 bp, Artificial Sequence
  chemically synthesized
tggaaaacaagcaattttatga

SEQ ID NO: 895442 - DNA, 22 bp, Artificial Sequence
  chemically synthesized
gaaaacaagcaattttatgatc

SEQ ID NO: 895443 - DNA, 22 bp, Artificial Sequence
  chemically synthesized
tataatagggctccaaggaaga

SEQ ID NO: 895444 - DNA, 22 bp, Artificial Sequence
  chemically synthesized
tatgatcttccttggagcccta

SEQ ID NO: 895445 - DNA, 22 bp, Artificial Sequence
  chemically synthesized
atgatcttccttggagccctat

SEQ ID NO: 895446 - DNA, 22 bp, Artificial Sequence
  chemically synthesized
tgatcttccttggagccctatt

SEQ ID NO: 895447 - DNA, 22 bp, Artificial Sequence
  chemically synthesized
ccttggagccctattatacagt

SEQ ID NO: 895448 - DNA, 22 bp, Artificial Sequence
  chemically synthesized
cttggagccctattatacagtc

SEQ ID NO: 895449 - DNA, 22 bp, Artificial Sequence
  chemically synthesized
aaatgtggtgaatgactgtata

SEQ ID NO: 895450 - DNA, 22 bp, Artificial Sequence
  chemically synthesized
ggagccctattatacagtcatt

SEQ ID NO: 895451 - DNA, 22 bp, Artificial Sequence
  chemically synthesized
gagccctattatacagtcattc

SEQ ID NO: 895452 - DNA, 22 bp, Artificial Sequence
  chemically synthesized
actgaaatgtggtgaatgactg

SEQ ID NO: 895453 - DNA, 22 bp, Artificial Sequence
  chemically synthesized
ttgactgaaatgtggtgaatga

SEQ ID NO: 895454 - DNA, 22 bp, Artificial Sequence
  chemically synthesized
ttatacagtcattcaccacatt

SEQ ID NO: 895455 - DNA, 22 bp, Artificial Sequence
  chemically synthesized
tacagtcattcaccacatttca

SEQ ID NO: 895456 - DNA, 22 bp, Artificial Sequence
  chemically synthesized
accacatttcagtcaacagact

SEQ ID NO: 895457 - DNA, 22 bp, Artificial Sequence
  chemically synthesized
ataggatcacagtcagtctgtt

SEQ ID NO: 895458 - DNA, 22 bp, Artificial Sequence
  chemically synthesized
cagtcaacagactgactgtgat

SEQ ID NO: 895459 - DNA, 22 bp, Artificial Sequence
  chemically synthesized
taatctcataggatcacagtca

SEQ ID NO: 895460 - DNA, 22 bp, Artificial Sequence
  chemically synthesized
agtcaacagactgactgtgatc

SEQ ID NO: 895461 - DNA, 22 bp, Artificial Sequence
  chemically synthesized
cattgtaatctcataggatcac

SEQ ID NO: 895462 - DNA, 22 bp, Artificial Sequence
  chemically synthesized
agctccattgtaatctcatagg

SEQ ID NO: 895463 - DNA, 22 bp, Artificial Sequence
  chemically synthesized
cagctccattgtaatctcatag

SEQ ID NO: 895464 - DNA, 22 bp, Artificial Sequence
  chemically synthesized
tcagctccattgtaatctcata

SEQ ID NO: 895465 - DNA, 22 bp, Artificial Sequence
  chemically synthesized
ttcagctccattgtaatctcat

SEQ ID NO: 895466 - DNA, 22 bp, Artificial Sequence
  chemically synthesized
actgtgatcctatgagattaca

SEQ ID NO: 895467 - DNA, 22 bp, Artificial Sequence
  chemically synthesized
tgatcctatgagattacaatgg

SEQ ID NO: 895468 - DNA, 22 bp, Artificial Sequence
  chemically synthesized
tgagattacaatggagctgaaa

SEQ ID NO: 895469 - DNA, 22 bp, Artificial Sequence
  chemically synthesized
ggtaataggaatttttcagctc

SEQ ID NO: 895470 - DNA, 22 bp, Artificial Sequence
  chemically synthesized
caatggagctgaaaaattccta

SEQ ID NO: 895471 - DNA, 22 bp, Artificial Sequence
  chemically synthesized
tgacatcactaggtaataggaa

SEQ ID NO: 895472 - DNA, 22 bp, Artificial Sequence
  chemically synthesized
cactgtgacatcactaggtaat

SEQ ID NO: 895473 - DNA, 22 bp, Artificial Sequence
  chemically synthesized
aaaaattcctattacctagtga

SEQ ID NO: 895474 - DNA, 22 bp, Artificial Sequence
  chemically synthesized
attgcactgtgacatcactagg

SEQ ID NO: 895475 - DNA, 22 bp, Artificial Sequence
  chemically synthesized
ctattacctagtgatgtcacag

SEQ ID NO: 895476 - DNA, 22 bp, Artificial Sequence
  chemically synthesized
ttacctagtgatgtcacagtgc

SEQ ID NO: 895477 - DNA, 22 bp, Artificial Sequence
  chemically synthesized
cctagtgatgtcacagtgcaat

SEQ ID NO: 895478 - DNA, 22 bp, Artificial Sequence
  chemically synthesized
gtgatgtcacagtgcaatgaat

SEQ ID NO: 895479 - DNA, 22 bp, Artificial Sequence
  chemically synthesized
caccagcatcaccacaaacgtg

SEQ ID NO: 895480 - DNA, 22 bp, Artificial Sequence
  chemically synthesized
acaccagcatcaccacaaacgt

SEQ ID NO: 895481 - DNA, 22 bp, Artificial Sequence
  chemically synthesized
cttacaccagcatcaccacaaa

SEQ ID NO: 895482 - DNA, 22 bp, Artificial Sequence
  chemically synthesized
gcttacaccagcatcaccacaa

SEQ ID NO: 895483 - DNA, 22 bp, Artificial Sequence
  chemically synthesized
ctctcacgtttgtggtgatgct

SEQ ID NO: 895484 - DNA, 22 bp, Artificial Sequence
  chemically synthesized
tcacgtttgtggtgatgctggt

SEQ ID NO: 895485 - DNA, 22 bp, Artificial Sequence
  chemically synthesized
acgtttgtggtgatgctggtgt

SEQ ID NO: 895486 - DNA, 22 bp, Artificial Sequence
  chemically synthesized
gtggtgatgctggtgtaagcaa

SEQ ID NO: 895487 - DNA, 22 bp, Artificial Sequence
  chemically synthesized
tggtgatgctggtgtaagcaaa

SEQ ID NO: 895488 - DNA, 22 bp, Artificial Sequence
  chemically synthesized
gcagtgcagtaggtttgcttac

SEQ ID NO: 895489 - DNA, 22 bp, Artificial Sequence
  chemically synthesized
tataactggcagtgcagtaggt

SEQ ID NO: 895490 - DNA, 22 bp, Artificial Sequence
  chemically synthesized
atataactggcagtgcagtagg

SEQ ID NO: 895491 - DNA, 22 bp, Artificial Sequence
  chemically synthesized
gtgtaagcaaacctactgcact

SEQ ID NO: 895492 - DNA, 22 bp, Artificial Sequence
  chemically synthesized
tatataactggcagtgcagtag

SEQ ID NO: 895493 - DNA, 22 bp, Artificial Sequence
  chemically synthesized
ttatataactggcagtgcagta

SEQ ID NO: 895494 - DNA, 22 bp, Artificial Sequence
  chemically synthesized
tatttttatataactggcagtg

SEQ ID NO: 895495 - DNA, 22 bp, Artificial Sequence
  chemically synthesized
tgctgtatttttatataactgg

SEQ ID NO: 895496 - DNA, 22 bp, Artificial Sequence
  chemically synthesized
ctgcactgccagttatataaaa

SEQ ID NO: 895497 - DNA, 22 bp, Artificial Sequence
  chemically synthesized
tctgtgctgtatttttatataa

SEQ ID NO: 895498 - DNA, 22 bp, Artificial Sequence
  chemically synthesized
gtctgtgctgtatttttatata

SEQ ID NO: 895499 - DNA, 22 bp, Artificial Sequence
  chemically synthesized
cactgccagttatataaaaata

SEQ ID NO: 895500 - DNA, 22 bp, Artificial Sequence
  chemically synthesized
ccagttatataaaaatacagca

SEQ ID NO: 895501 - DNA, 22 bp, Artificial Sequence
  chemically synthesized
tacatacttgtctgtgctgtat

SEQ ID NO: 895502 - DNA, 22 bp, Artificial Sequence
  chemically synthesized
tataaaaatacagcacagacaa

SEQ ID NO: 895503 - DNA, 22 bp, Artificial Sequence
  chemically synthesized
catactgtacatacttgtctgt

SEQ ID NO: 895504 - DNA, 22 bp, Artificial Sequence
  chemically synthesized
tcaagtattgcatactgtacat

SEQ ID NO: 895505 - DNA, 22 bp, Artificial Sequence
  chemically synthesized
tcattatcaagtattgcatact

SEQ ID NO: 895506 - DNA, 22 bp, Artificial Sequence
  chemically synthesized
ttatcattatcaagtattgcat

SEQ ID NO: 895507 - DNA, 22 bp, Artificial Sequence
  chemically synthesized
attatcattatcaagtattgca

SEQ ID NO: 895508 - DNA, 22 bp, Artificial Sequence
  chemically synthesized
tttattatcattatcaagtatt

SEQ ID NO: 895509 - DNA, 22 bp, Artificial Sequence
  chemically synthesized
gataatgataataaacaactgt

SEQ ID NO: 895510 - DNA, 22 bp, Artificial Sequence
  chemically synthesized
ataatgataataaacaactgtt

SEQ ID NO: 895511 - DNA, 22 bp, Artificial Sequence
  chemically synthesized
agaatatagtaaatacataaac

SEQ ID NO: 895512 - DNA, 22 bp, Artificial Sequence
  chemically synthesized
attaagaatatagtaaatacat

SEQ ID NO: 895513 - DNA, 22 bp, Artificial Sequence
  chemically synthesized
ttattggtttatgtatttacta

SEQ ID NO: 895514 - DNA, 22 bp, Artificial Sequence
  chemically synthesized
ttggtttatgtatttactatat

SEQ ID NO: 895515 - DNA, 22 bp, Artificial Sequence
  chemically synthesized
aactaattaagaatatagtaaa

SEQ ID NO: 895516 - DNA, 22 bp, Artificial Sequence
  chemically synthesized
gaactaattaagaatatagtaa

SEQ ID NO: 895517 - DNA, 22 bp, Artificial Sequence
  chemically synthesized
tgaactaattaagaatatagta

SEQ ID NO: 895518 - DNA, 22 bp, Artificial Sequence
  chemically synthesized
gtttatgtatttactatattct

SEQ ID NO: 895519 - DNA, 22 bp, Artificial Sequence
  chemically synthesized
ttgaactaattaagaatatagt

SEQ ID NO: 895520 - DNA, 22 bp, Artificial Sequence
  chemically synthesized
ttttgaactaattaagaatata

SEQ ID NO: 895521 - DNA, 22 bp, Artificial Sequence
  chemically synthesized
cttttgaactaattaagaatat

SEQ ID NO: 895522 - DNA, 22 bp, Artificial Sequence
  chemically synthesized
atgtatttactatattcttaat

SEQ ID NO: 895523 - DNA, 22 bp, Artificial Sequence
  chemically synthesized
tgtatttactatattcttaatt

SEQ ID NO: 895524 - DNA, 22 bp, Artificial Sequence
  chemically synthesized
actatattcttaattagttcaa

SEQ ID NO: 895525 - DNA, 22 bp, Artificial Sequence
  chemically synthesized
ctatattcttaattagttcaaa

SEQ ID NO: 895526 - DNA, 22 bp, Artificial Sequence
  chemically synthesized
tattcttaattagttcaaaaga

SEQ ID NO: 895527 - DNA, 22 bp, Artificial Sequence
  chemically synthesized
ttaattagttcaaaagaaggca

SEQ ID NO: 895528 - DNA, 22 bp, Artificial Sequence
  chemically synthesized
ataggataacaatgccttcttt

SEQ ID NO: 895529 - DNA, 22 bp, Artificial Sequence
  chemically synthesized
aattagttcaaaagaaggcatt

SEQ ID NO: 895530 - DNA, 22 bp, Artificial Sequence
  chemically synthesized
attagttcaaaagaaggcattg

SEQ ID NO: 895531 - DNA, 22 bp, Artificial Sequence
  chemically synthesized
gttcaaaagaaggcattgttat

SEQ ID NO: 895532 - DNA, 22 bp, Artificial Sequence
  chemically synthesized
tcatctcataggataacaatgc

SEQ ID NO: 895533 - DNA, 22 bp, Artificial Sequence
  chemically synthesized
aaaagaaggcattgttatccta

SEQ ID NO: 895534 - DNA, 22 bp, Artificial Sequence
  chemically synthesized
atgaaactatcatctcatagga

SEQ ID NO: 895535 - DNA, 22 bp, Artificial Sequence
  chemically synthesized
ttatcctatgagatgatagttt

SEQ ID NO: 895536 - DNA, 22 bp, Artificial Sequence
  chemically synthesized
tcctatgagatgatagtttcat

SEQ ID NO: 895537 - DNA, 22 bp, Artificial Sequence
  chemically synthesized
tgagatgatagtttcatgaatg

SEQ ID NO: 895538 - DNA, 22 bp, Artificial Sequence
  chemically synthesized
atgggcaatgaaacattcatga

SEQ ID NO: 895539 - DNA, 22 bp, Artificial Sequence
  chemically synthesized
catgggcaatgaaacattcatg

SEQ ID NO: 895540 - DNA, 22 bp, Artificial Sequence
  chemically synthesized
gaaggtcttcatgggcaatgaa

SEQ ID NO: 895541 - DNA, 22 bp, Artificial Sequence
  chemically synthesized
catgaatgtttcattgcccatg

SEQ ID NO: 895542 - DNA, 22 bp, Artificial Sequence
  chemically synthesized
atgaatgtttcattgcccatga

SEQ ID NO: 895543 - DNA, 22 bp, Artificial Sequence
  chemically synthesized
tcccccactggaaggtcttcat

SEQ ID NO: 895544 - DNA, 22 bp, Artificial Sequence
  chemically synthesized
cattgcccatgaagaccttcca

SEQ ID NO: 895545 - DNA, 22 bp, Artificial Sequence
  chemically synthesized
attgcccatgaagaccttccag

SEQ ID NO: 895546 - DNA, 22 bp, Artificial Sequence
  chemically synthesized
cccatgaagaccttccagtggg

SEQ ID NO: 895547 - DNA, 22 bp, Artificial Sequence
  chemically synthesized
cacatgctgtcccccactggaa

SEQ ID NO: 895548 - DNA, 22 bp, Artificial Sequence
  chemically synthesized
ccacatgctgtcccccactgga

SEQ ID NO: 895549 - DNA, 22 bp, Artificial Sequence
  chemically synthesized
cacttccacatgctgtccccca

SEQ ID NO: 895550 - DNA, 22 bp, Artificial Sequence
  chemically synthesized
ccacttccacatgctgtccccc

SEQ ID NO: 895551 - DNA, 22 bp, Artificial Sequence
  chemically synthesized
tcttccacttccacatgctgtc

SEQ ID NO: 895552 - DNA, 22 bp, Artificial Sequence
  chemically synthesized
ccagtgggggacagcatgtgga

SEQ ID NO: 895553 - DNA, 22 bp, Artificial Sequence
  chemically synthesized
cagtgggggacagcatgtggaa

SEQ ID NO: 895554 - DNA, 22 bp, Artificial Sequence
  chemically synthesized
catgggtcaggatcatcaatat

SEQ ID NO: 895555 - DNA, 22 bp, Artificial Sequence
  chemically synthesized
ggcctacatgggtcaggatcat

SEQ ID NO: 895556 - DNA, 22 bp, Artificial Sequence
  chemically synthesized
atgatcctgacccatgtaggcc

SEQ ID NO: 895557 - DNA, 22 bp, Artificial Sequence
  chemically synthesized
acccatgtaggcctaggctcat

SEQ ID NO: 895558 - DNA, 22 bp, Artificial Sequence
  chemically synthesized
aaaagtaaaacacaaacacgca

SEQ ID NO: 895559 - DNA, 22 bp, Artificial Sequence
  chemically synthesized
ttaaaaagtaaaacacaaacac

SEQ ID NO: 895560 - DNA, 22 bp, Artificial Sequence
  chemically synthesized
ggctcatgtgcgtgtttgtgtt

SEQ ID NO: 895561 - DNA, 22 bp, Artificial Sequence
  chemically synthesized
tgttaaaaagtaaaacacaaac

SEQ ID NO: 895562 - DNA, 22 bp, Artificial Sequence
  chemically synthesized
ctgttaaaaagtaaaacacaaa

SEQ ID NO: 895563 - DNA, 22 bp, Artificial Sequence
  chemically synthesized
tctgttaaaaagtaaaacacaa

SEQ ID NO: 895564 - DNA, 22 bp, Artificial Sequence
  chemically synthesized
ttctgttaaaaagtaaaacaca

SEQ ID NO: 895565 - DNA, 22 bp, Artificial Sequence
  chemically synthesized
atgtgcgtgtttgtgttttact

SEQ ID NO: 895566 - DNA, 22 bp, Artificial Sequence
  chemically synthesized
agcttttctgttaaaaagtaaa

SEQ ID NO: 895567 - DNA, 22 bp, Artificial Sequence
  chemically synthesized
aagcttttctgttaaaaagtaa

SEQ ID NO: 895568 - DNA, 22 bp, Artificial Sequence
  chemically synthesized
tttaagcttttctgttaaaaag

SEQ ID NO: 895569 - DNA, 22 bp, Artificial Sequence
  chemically synthesized
ctgtttaagcttttctgttaaa

SEQ ID NO: 895570 - DNA, 22 bp, Artificial Sequence
  chemically synthesized
gtgttttactttttaacagaaa

SEQ ID NO: 895571 - DNA, 22 bp, Artificial Sequence
  chemically synthesized
gctgtttaagcttttctgttaa

SEQ ID NO: 895572 - DNA, 22 bp, Artificial Sequence
  chemically synthesized
tgttttactttttaacagaaaa

SEQ ID NO: 895573 - DNA, 22 bp, Artificial Sequence
  chemically synthesized
tgctgtttaagcttttctgtta

SEQ ID NO: 895574 - DNA, 22 bp, Artificial Sequence
  chemically synthesized
ttgctgtttaagcttttctgtt

SEQ ID NO: 895575 - DNA, 22 bp, Artificial Sequence
  chemically synthesized
tactttttaacagaaaagctta

SEQ ID NO: 895576 - DNA, 22 bp, Artificial Sequence
  chemically synthesized
actttttaacagaaaagcttaa

SEQ ID NO: 895577 - DNA, 22 bp, Artificial Sequence
  chemically synthesized
ctttttaacagaaaagcttaaa

SEQ ID NO: 895578 - DNA, 22 bp, Artificial Sequence
  chemically synthesized
atatttttgctgtttaagcttt

SEQ ID NO: 895579 - DNA, 22 bp, Artificial Sequence
  chemically synthesized
aatatttttgctgtttaagctt

SEQ ID NO: 895580 - DNA, 22 bp, Artificial Sequence
  chemically synthesized
taatatttttgctgtttaagct

SEQ ID NO: 895581 - DNA, 22 bp, Artificial Sequence
  chemically synthesized
tttaacagaaaagcttaaacag

SEQ ID NO: 895582 - DNA, 22 bp, Artificial Sequence
  chemically synthesized
ttaatatttttgctgtttaagc

SEQ ID NO: 895583 - DNA, 22 bp, Artificial Sequence
  chemically synthesized
ttaacagaaaagcttaaacagc

SEQ ID NO: 895584 - DNA, 22 bp, Artificial Sequence
  chemically synthesized
taacagaaaagcttaaacagca

SEQ ID NO: 895585 - DNA, 22 bp, Artificial Sequence
  chemically synthesized
aacagaaaagcttaaacagcaa

SEQ ID NO: 895586 - DNA, 22 bp, Artificial Sequence
  chemically synthesized
tttttaatatttttgctgttta

SEQ ID NO: 895587 - DNA, 22 bp, Artificial Sequence
  chemically synthesized
acagaaaagcttaaacagcaaa

SEQ ID NO: 895588 - DNA, 22 bp, Artificial Sequence
  chemically synthesized
atttttaatatttttgctgttt

SEQ ID NO: 895589 - DNA, 22 bp, Artificial Sequence
  chemically synthesized
ttatttttaatatttttgctgt

SEQ ID NO: 895590 - DNA, 22 bp, Artificial Sequence
  chemically synthesized
cttatttttaatatttttgctg

SEQ ID NO: 895591 - DNA, 22 bp, Artificial Sequence
  chemically synthesized
tcttatttttaatatttttgct

SEQ ID NO: 895592 - DNA, 22 bp, Artificial Sequence
  chemically synthesized
aaacagcaaaaatattaaaaat

SEQ ID NO: 895593 - DNA, 22 bp, Artificial Sequence
  chemically synthesized
aacagcaaaaatattaaaaata

SEQ ID NO: 895594 - DNA, 22 bp, Artificial Sequence
  chemically synthesized
tagcagctttcttatttttaat

SEQ ID NO: 895595 - DNA, 22 bp, Artificial Sequence
  chemically synthesized
ttgtagcagctttcttattttt

SEQ ID NO: 895596 - DNA, 22 bp, Artificial Sequence
  chemically synthesized
attgtagcagctttcttatttt

SEQ ID NO: 895597 - DNA, 22 bp, Artificial Sequence
  chemically synthesized
tatccttattgtagcagctttc

SEQ ID NO: 895598 - DNA, 22 bp, Artificial Sequence
  chemically synthesized
atatccttattgtagcagcttt

SEQ ID NO: 895599 - DNA, 22 bp, Artificial Sequence
  chemically synthesized
tatatccttattgtagcagctt

SEQ ID NO: 895600 - DNA, 22 bp, Artificial Sequence
  chemically synthesized
aaaataagaaagctgctacaat

SEQ ID NO: 895601 - DNA, 22 bp, Artificial Sequence
  chemically synthesized
ctacaataaggatataaaatat

SEQ ID NO: 895602 - DNA, 22 bp, Artificial Sequence
  chemically synthesized
caataaggatataaaatatttt

SEQ ID NO: 895603 - DNA, 22 bp, Artificial Sequence
  chemically synthesized
aacacccgtacaaaaatatttt

SEQ ID NO: 895604 - DNA, 22 bp, Artificial Sequence
  chemically synthesized
aaacatgaacacgttgaacacc

SEQ ID NO: 895605 - DNA, 22 bp, Artificial Sequence
  chemically synthesized
aaaacatgaacacgttgaacac

SEQ ID NO: 895606 - DNA, 22 bp, Artificial Sequence
  chemically synthesized
ttgtacgggtgttcaacgtgtt

SEQ ID NO: 895607 - DNA, 22 bp, Artificial Sequence
  chemically synthesized
gcttaaaacatgaacacgttga

SEQ ID NO: 895608 - DNA, 22 bp, Artificial Sequence
  chemically synthesized
tgtacgggtgttcaacgtgttc

SEQ ID NO: 895609 - DNA, 22 bp, Artificial Sequence
  chemically synthesized
agcttaaaacatgaacacgttg

SEQ ID NO: 895610 - DNA, 22 bp, Artificial Sequence
  chemically synthesized
gtacgggtgttcaacgtgttca

SEQ ID NO: 895611 - DNA, 22 bp, Artificial Sequence
  chemically synthesized
tacgggtgttcaacgtgttcat

SEQ ID NO: 895612 - DNA, 22 bp, Artificial Sequence
  chemically synthesized
taataacacttagcttaaaaca

SEQ ID NO: 895613 - DNA, 22 bp, Artificial Sequence
  chemically synthesized
aacgtgttcatgttttaagcta

SEQ ID NO: 895614 - DNA, 22 bp, Artificial Sequence
  chemically synthesized
tgtaataacacttagcttaaaa

SEQ ID NO: 895615 - DNA, 22 bp, Artificial Sequence
  chemically synthesized
actctgtaataacacttagctt

SEQ ID NO: 895616 - DNA, 22 bp, Artificial Sequence
  chemically synthesized
gactctgtaataacacttagct

SEQ ID NO: 895617 - DNA, 22 bp, Artificial Sequence
  chemically synthesized
tgactctgtaataacacttagc

SEQ ID NO: 895618 - DNA, 22 bp, Artificial Sequence
  chemically synthesized
ttgactctgtaataacacttag

SEQ ID NO: 895619 - DNA, 22 bp, Artificial Sequence
  chemically synthesized
atgttttaagctaagtgttatt

SEQ ID NO: 895620 - DNA, 22 bp, Artificial Sequence
  chemically synthesized
agtttttgactctgtaataaca

SEQ ID NO: 895621 - DNA, 22 bp, Artificial Sequence
  chemically synthesized
aagtttttgactctgtaataac

SEQ ID NO: 895622 - DNA, 22 bp, Artificial Sequence
  chemically synthesized
taagtttttgactctgtaataa

SEQ ID NO: 895623 - DNA, 22 bp, Artificial Sequence
  chemically synthesized
taagctaagtgttattacagag

SEQ ID NO: 895624 - DNA, 22 bp, Artificial Sequence
  chemically synthesized
ttaagtttttgactctgtaata

SEQ ID NO: 895625 - DNA, 22 bp, Artificial Sequence
  chemically synthesized
aagctaagtgttattacagagt

SEQ ID NO: 895626 - DNA, 22 bp, Artificial Sequence
  chemically synthesized
tttaagtttttgactctgtaat

SEQ ID NO: 895627 - DNA, 22 bp, Artificial Sequence
  chemically synthesized
agctaagtgttattacagagtc

SEQ ID NO: 895628 - DNA, 22 bp, Artificial Sequence
  chemically synthesized
ttttaagtttttgactctgtaa

SEQ ID NO: 895629 - DNA, 22 bp, Artificial Sequence
  chemically synthesized
tttttaagtttttgactctgta

SEQ ID NO: 895630 - DNA, 22 bp, Artificial Sequence
  chemically synthesized
ttttttaagtttttgactctgt

SEQ ID NO: 895631 - DNA, 22 bp, Artificial Sequence
  chemically synthesized
tttttttaagtttttgactctg

SEQ ID NO: 895632 - DNA, 22 bp, Artificial Sequence
  chemically synthesized
agtgttattacagagtcaaaaa

SEQ ID NO: 895633 - DNA, 22 bp, Artificial Sequence
  chemically synthesized
taaactttttttttaagttttt

SEQ ID NO: 895634 - DNA, 22 bp, Artificial Sequence
  chemically synthesized
ataaactttttttttaagtttt

SEQ ID NO: 895635 - DNA, 22 bp, Artificial Sequence
  chemically synthesized
ttacagagtcaaaaacttaaaa

SEQ ID NO: 895636 - DNA, 22 bp, Artificial Sequence
  chemically synthesized
tataaactttttttttaagttt

SEQ ID NO: 895637 - DNA, 22 bp, Artificial Sequence
  chemically synthesized
cagagtcaaaaacttaaaaaaa

SEQ ID NO: 895638 - DNA, 22 bp, Artificial Sequence
  chemically synthesized
ctttataaactttttttttaag

SEQ ID NO: 895639 - DNA, 22 bp, Artificial Sequence
  chemically synthesized
actttataaactttttttttaa

SEQ ID NO: 895640 - DNA, 22 bp, Artificial Sequence
  chemically synthesized
tactttataaacttttttttta

SEQ ID NO: 895641 - DNA, 22 bp, Artificial Sequence
  chemically synthesized
ttactttataaacttttttttt

SEQ ID NO: 895642 - DNA, 22 bp, Artificial Sequence
  chemically synthesized
tttactttataaactttttttt

SEQ ID NO: 895643 - DNA, 22 bp, Artificial Sequence
  chemically synthesized
ttttactttataaacttttttt

SEQ ID NO: 895644 - DNA, 22 bp, Artificial Sequence
  chemically synthesized
tagtaacttttttactttataa

SEQ ID NO: 895645 - DNA, 22 bp, Artificial Sequence
  chemically synthesized
aaaaaaaaagtttataaagtaa

SEQ ID NO: 895646 - DNA, 22 bp, Artificial Sequence
  chemically synthesized
atagtaacttttttactttata

SEQ ID NO: 895647 - DNA, 22 bp, Artificial Sequence
  chemically synthesized
aaaaaaaagtttataaagtaaa

SEQ ID NO: 895648 - DNA, 22 bp, Artificial Sequence
  chemically synthesized
gcttatagtaacttttttactt

SEQ ID NO: 895649 - DNA, 22 bp, Artificial Sequence
  chemically synthesized
agcttatagtaacttttttact

SEQ ID NO: 895650 - DNA, 22 bp, Artificial Sequence
  chemically synthesized
accttagcttatagtaactttt

SEQ ID NO: 895651 - DNA, 22 bp, Artificial Sequence
  chemically synthesized
ataaagtaaaaaagttactata

SEQ ID NO: 895652 - DNA, 22 bp, Artificial Sequence
  chemically synthesized
taaagtaaaaaagttactataa

SEQ ID NO: 895653 - DNA, 22 bp, Artificial Sequence
  chemically synthesized
atgataagttaaccttagctta

SEQ ID NO: 895654 - DNA, 22 bp, Artificial Sequence
  chemically synthesized
attaatgataagttaaccttag

SEQ ID NO: 895655 - DNA, 22 bp, Artificial Sequence
  chemically synthesized
cattaatgataagttaacctta

SEQ ID NO: 895656 - DNA, 22 bp, Artificial Sequence
  chemically synthesized
tcattaatgataagttaacctt

SEQ ID NO: 895657 - DNA, 22 bp, Artificial Sequence
  chemically synthesized
ctataagctaaggttaacttat

SEQ ID NO: 895658 - DNA, 22 bp, Artificial Sequence
  chemically synthesized
ttttcattaatgataagttaac

SEQ ID NO: 895659 - DNA, 22 bp, Artificial Sequence
  chemically synthesized
attttcattaatgataagttaa

SEQ ID NO: 895660 - DNA, 22 bp, Artificial Sequence
  chemically synthesized
taagctaaggttaacttatcat

SEQ ID NO: 895661 - DNA, 22 bp, Artificial Sequence
  chemically synthesized
gcccatttattttcattaatga

SEQ ID NO: 895662 - DNA, 22 bp, Artificial Sequence
  chemically synthesized
aggttaacttatcattaatgaa

SEQ ID NO: 895663 - DNA, 22 bp, Artificial Sequence
  chemically synthesized
acttatcattaatgaaaataaa

SEQ ID NO: 895664 - DNA, 22 bp, Artificial Sequence
  chemically synthesized
atcattaatgaaaataaatggg

SEQ ID NO: 895665 - DNA, 22 bp, Artificial Sequence
  chemically synthesized
tcattaatgaaaataaatgggc

SEQ ID NO: 895666 - DNA, 22 bp, Artificial Sequence
  chemically synthesized
atgaaaataaatgggccaggcg

SEQ ID NO: 895667 - DNA, 22 bp, Artificial Sequence
  chemically synthesized
caggcgtgagccaccgcgcctg

SEQ ID NO: 895668 - DNA, 22 bp, Artificial Sequence
  chemically synthesized
ggattacaggcgtgagccaccg

SEQ ID NO: 895669 - DNA, 22 bp, Artificial Sequence
  chemically synthesized
ccaaagtgctgggattacaggc

SEQ ID NO: 895670 - DNA, 22 bp, Artificial Sequence
  chemically synthesized
ggcctcccaaagtgctgggatt

SEQ ID NO: 895671 - DNA, 22 bp, Artificial Sequence
  chemically synthesized
acgcctgtaatcccagcacttt

SEQ ID NO: 895672 - DNA, 22 bp, Artificial Sequence
  chemically synthesized
taatcccagcactttgggaggc

SEQ ID NO: 895673 - DNA, 22 bp, Artificial Sequence
  chemically synthesized
tgatccacccgcctcggcctcc

SEQ ID NO: 895674 - DNA, 22 bp, Artificial Sequence
  chemically synthesized
gtgatccacccgcctcggcctc

SEQ ID NO: 895675 - DNA, 22 bp, Artificial Sequence
  chemically synthesized
accttgtgatccacccgcctcg

SEQ ID NO: 895676 - DNA, 22 bp, Artificial Sequence
  chemically synthesized
ctgaccttgtgatccacccgcc

SEQ ID NO: 895677 - DNA, 22 bp, Artificial Sequence
  chemically synthesized
tgggaggccgaggcgggtggat

SEQ ID NO: 895678 - DNA, 22 bp, Artificial Sequence
  chemically synthesized
gggaggccgaggcgggtggatc

SEQ ID NO: 895679 - DNA, 22 bp, Artificial Sequence
  chemically synthesized
ggaggccgaggcgggtggatca

SEQ ID NO: 895680 - DNA, 22 bp, Artificial Sequence
  chemically synthesized
gccaggatggtcccgatctcct

SEQ ID NO: 895681 - DNA, 22 bp, Artificial Sequence
  chemically synthesized
accgtgttagccaggatggtcc

SEQ ID NO: 895682 - DNA, 22 bp, Artificial Sequence
  chemically synthesized
caccgtgttagccaggatggtc

SEQ ID NO: 895683 - DNA, 22 bp, Artificial Sequence
  chemically synthesized
gtagagatggggtttcaccgtg

SEQ ID NO: 895684 - DNA, 22 bp, Artificial Sequence
  chemically synthesized
agtagagatggggtttcaccgt

SEQ ID NO: 895685 - DNA, 22 bp, Artificial Sequence
  chemically synthesized
tagtagagatggggtttcaccg

SEQ ID NO: 895686 - DNA, 22 bp, Artificial Sequence
  chemically synthesized
ttagtagagatggggtttcacc

SEQ ID NO: 895687 - DNA, 22 bp, Artificial Sequence
  chemically synthesized
gctaacacggtgaaaccccatc

SEQ ID NO: 895688 - DNA, 22 bp, Artificial Sequence
  chemically synthesized
tatttttagtagagatggggtt

SEQ ID NO: 895689 - DNA, 22 bp, Artificial Sequence
  chemically synthesized
gtatttttagtagagatggggt

SEQ ID NO: 895690 - DNA, 22 bp, Artificial Sequence
  chemically synthesized
tgtatttttagtagagatgggg

SEQ ID NO: 895691 - DNA, 22 bp, Artificial Sequence
  chemically synthesized
acacggtgaaaccccatctcta

SEQ ID NO: 895692 - DNA, 22 bp, Artificial Sequence
  chemically synthesized
ttgtatttttagtagagatggg

SEQ ID NO: 895693 - DNA, 22 bp, Artificial Sequence
  chemically synthesized
tttgtatttttagtagagatgg

SEQ ID NO: 895694 - DNA, 22 bp, Artificial Sequence
  chemically synthesized
ttttgtatttttagtagagatg

SEQ ID NO: 895695 - DNA, 22 bp, Artificial Sequence
  chemically synthesized
tttttgtatttttagtagagat

SEQ ID NO: 895696 - DNA, 22 bp, Artificial Sequence
  chemically synthesized
ttttttgtatttttagtagaga

SEQ ID NO: 895697 - DNA, 22 bp, Artificial Sequence
  chemically synthesized
tttttttgtatttttagtagag

SEQ ID NO: 895698 - DNA, 22 bp, Artificial Sequence
  chemically synthesized
ttttttttgtatttttagtaga

SEQ ID NO: 895699 - DNA, 22 bp, Artificial Sequence
  chemically synthesized
tttttttttgtatttttagtag

SEQ ID NO: 895700 - DNA, 22 bp, Artificial Sequence
  chemically synthesized
ttttttttttgtatttttagta

SEQ ID NO: 895701 - DNA, 22 bp, Artificial Sequence
  chemically synthesized
tttttttttttgtatttttagt

SEQ ID NO: 895702 - DNA, 22 bp, Artificial Sequence
  chemically synthesized
ttttttttttttgtatttttag

SEQ ID NO: 895703 - DNA, 22 bp, Artificial Sequence
  chemically synthesized
tttttttttttttgtattttta

SEQ ID NO: 895704 - DNA, 22 bp, Artificial Sequence
  chemically synthesized
ttttttttttttttgtattttt

SEQ ID NO: 895705 - DNA, 22 bp, Artificial Sequence
  chemically synthesized
tcttttttttttttttttgtat

SEQ ID NO: 895706 - DNA, 22 bp, Artificial Sequence
  chemically synthesized
atcttttttttttttttttgta

SEQ ID NO: 895707 - DNA, 22 bp, Artificial Sequence
  chemically synthesized
tatcttttttttttttttttgt

SEQ ID NO: 895708 - DNA, 22 bp, Artificial Sequence
  chemically synthesized
ttatcttttttttttttttttg

SEQ ID NO: 895709 - DNA, 22 bp, Artificial Sequence
  chemically synthesized
tactaaaaatacaaaaaaaaaa

SEQ ID NO: 895710 - DNA, 22 bp, Artificial Sequence
  chemically synthesized
ctaaaaatacaaaaaaaaaaaa

SEQ ID NO: 895711 - DNA, 22 bp, Artificial Sequence
  chemically synthesized
aaaatacaaaaaaaaaaaaaaa

SEQ ID NO: 895712 - DNA, 22 bp, Artificial Sequence
  chemically synthesized
tgaggacacatttttatctttt

SEQ ID NO: 895713 - DNA, 22 bp, Artificial Sequence
  chemically synthesized
atgaggacacatttttatcttt

SEQ ID NO: 895714 - DNA, 22 bp, Artificial Sequence
  chemically synthesized
aatttatgaggacacattttta

SEQ ID NO: 895715 - DNA, 22 bp, Artificial Sequence
  chemically synthesized
cactaaatttatgaggacacat

SEQ ID NO: 895716 - DNA, 22 bp, Artificial Sequence
  chemically synthesized
ggctgcactaaatttatgagga

SEQ ID NO: 895717 - DNA, 22 bp, Artificial Sequence
  chemically synthesized
tatagttaggctgcactaaatt

SEQ ID NO: 895718 - DNA, 22 bp, Artificial Sequence
  chemically synthesized
ataaatttagtgcagcctaact

SEQ ID NO: 895719 - DNA, 22 bp, Artificial Sequence
  chemically synthesized
caaacactgtatagttaggctg

SEQ ID NO: 895720 - DNA, 22 bp, Artificial Sequence
  chemically synthesized
acaaacactgtatagttaggct

SEQ ID NO: 895721 - DNA, 22 bp, Artificial Sequence
  chemically synthesized
agtgcagcctaactatacagtg

SEQ ID NO: 895722 - DNA, 22 bp, Artificial Sequence
  chemically synthesized
gtgcagcctaactatacagtgt

SEQ ID NO: 895723 - DNA, 22 bp, Artificial Sequence
  chemically synthesized
actatacagtgtttgtaaactg

SEQ ID NO: 895724 - DNA, 22 bp, Artificial Sequence
  chemically synthesized
tacggtaccatacagtttacaa

SEQ ID NO: 895725 - DNA, 22 bp, Artificial Sequence
  chemically synthesized
ttgtacggtaccatacagttta

SEQ ID NO: 895726 - DNA, 22 bp, Artificial Sequence
  chemically synthesized
tacagtgtttgtaaactgtatg

SEQ ID NO: 895727 - DNA, 22 bp, Artificial Sequence
  chemically synthesized
agacattattgtacggtaccat

SEQ ID NO: 895728 - DNA, 22 bp, Artificial Sequence
  chemically synthesized
gtaaactgtatggtaccgtaca

SEQ ID NO: 895729 - DNA, 22 bp, Artificial Sequence
  chemically synthesized
taaactgtatggtaccgtacaa

SEQ ID NO: 895730 - DNA, 22 bp, Artificial Sequence
  chemically synthesized
tatggtaccgtacaataatgtc

SEQ ID NO: 895731 - DNA, 22 bp, Artificial Sequence
  chemically synthesized
agatttcacatttgctcaccac

SEQ ID NO: 895732 - DNA, 22 bp, Artificial Sequence
  chemically synthesized
gatttcacatttgctcaccact

SEQ ID NO: 895733 - DNA, 22 bp, Artificial Sequence
  chemically synthesized
cacatttgctcaccactaccac

SEQ ID NO: 895734 - DNA, 22 bp, Artificial Sequence
  chemically synthesized
acatttgctcaccactaccact

SEQ ID NO: 895735 - DNA, 22 bp, Artificial Sequence
  chemically synthesized
ggtgagtcggtgagtgagtggt

SEQ ID NO: 895736 - DNA, 22 bp, Artificial Sequence
  chemically synthesized
gctcaccactaccactcactca

SEQ ID NO: 895737 - DNA, 22 bp, Artificial Sequence
  chemically synthesized
tgggtgagtcggtgagtgagtg

SEQ ID NO: 895738 - DNA, 22 bp, Artificial Sequence
  chemically synthesized
ctcaccactaccactcactcac

SEQ ID NO: 895739 - DNA, 22 bp, Artificial Sequence
  chemically synthesized
ctctgggtgagtcggtgagtga

SEQ ID NO: 895740 - DNA, 22 bp, Artificial Sequence
  chemically synthesized
accactaccactcactcaccga

SEQ ID NO: 895741 - DNA, 22 bp, Artificial Sequence
  chemically synthesized
aaagttgctctgggtgagtcgg

SEQ ID NO: 895742 - DNA, 22 bp, Artificial Sequence
  chemically synthesized
ccactcactcaccgactcaccc

SEQ ID NO: 895743 - DNA, 22 bp, Artificial Sequence
  chemically synthesized
actcaccgactcacccagagca

SEQ ID NO: 895744 - DNA, 22 bp, Artificial Sequence
  chemically synthesized
caggactcaaagttgctctggg

SEQ ID NO: 895745 - DNA, 22 bp, Artificial Sequence
  chemically synthesized
gcaggactcaaagttgctctgg

SEQ ID NO: 895746 - DNA, 22 bp, Artificial Sequence
  chemically synthesized
accgactcacccagagcaactt

SEQ ID NO: 895747 - DNA, 22 bp, Artificial Sequence
  chemically synthesized
acccagagcaactttgagtcct

SEQ ID NO: 895748 - DNA, 22 bp, Artificial Sequence
  chemically synthesized
ccatgaatggagcttgcaggac

SEQ ID NO: 895749 - DNA, 22 bp, Artificial Sequence
  chemically synthesized
accatgaatggagcttgcagga

SEQ ID NO: 895750 - DNA, 22 bp, Artificial Sequence
  chemically synthesized
tgagtcctgcaagctccattca

SEQ ID NO: 895751 - DNA, 22 bp, Artificial Sequence
  chemically synthesized
gagtcctgcaagctccattcat

SEQ ID NO: 895752 - DNA, 22 bp, Artificial Sequence
  chemically synthesized
agtcctgcaagctccattcatg

SEQ ID NO: 895753 - DNA, 22 bp, Artificial Sequence
  chemically synthesized
catacggtatttaccatgaatg

SEQ ID NO: 895754 - DNA, 22 bp, Artificial Sequence
  chemically synthesized
caagctccattcatggtaaata

SEQ ID NO: 895755 - DNA, 22 bp, Artificial Sequence
  chemically synthesized
cattcatggtaaataccgtatg

SEQ ID NO: 895756 - DNA, 22 bp, Artificial Sequence
  chemically synthesized
atggtaaataccgtatgcagct

SEQ ID NO: 895757 - DNA, 22 bp, Artificial Sequence
  chemically synthesized
tactattttttatcatttgtat

SEQ ID NO: 895758 - DNA, 22 bp, Artificial Sequence
  chemically synthesized
ttttttatcatttgtatactgt

SEQ ID NO: 895759 - DNA, 22 bp, Artificial Sequence
  chemically synthesized
tttatcatttgtatactgtatt

SEQ ID NO: 895760 - DNA, 22 bp, Artificial Sequence
  chemically synthesized
ttatcatttgtatactgtattt

SEQ ID NO: 895761 - DNA, 22 bp, Artificial Sequence
  chemically synthesized
tatcatttgtatactgtatttt

SEQ ID NO: 895762 - DNA, 22 bp, Artificial Sequence
  chemically synthesized
atcatttgtatactgtattttt

SEQ ID NO: 895763 - DNA, 22 bp, Artificial Sequence
  chemically synthesized
tcatttgtatactgtattttta

SEQ ID NO: 895764 - DNA, 22 bp, Artificial Sequence
  chemically synthesized
gtatactgtatttttacggtac

SEQ ID NO: 895765 - DNA, 22 bp, Artificial Sequence
  chemically synthesized
gacacagaaaatgtaccgtaaa

SEQ ID NO: 895766 - DNA, 22 bp, Artificial Sequence
  chemically synthesized
tatactgtatttttacggtaca

SEQ ID NO: 895767 - DNA, 22 bp, Artificial Sequence
  chemically synthesized
tatttttacggtacattttctg

SEQ ID NO: 895768 - DNA, 22 bp, Artificial Sequence
  chemically synthesized
tgtatctagacacagaaaatgt

SEQ ID NO: 895769 - DNA, 22 bp, Artificial Sequence
  chemically synthesized
gtgtatctagacacagaaaatg

SEQ ID NO: 895770 - DNA, 22 bp, Artificial Sequence
  chemically synthesized
ttacggtacattttctgtgtct

SEQ ID NO: 895771 - DNA, 22 bp, Artificial Sequence
  chemically synthesized
tacggtacattttctgtgtcta

SEQ ID NO: 895772 - DNA, 22 bp, Artificial Sequence
  chemically synthesized
acggtacattttctgtgtctag

SEQ ID NO: 895773 - DNA, 22 bp, Artificial Sequence
  chemically synthesized
cggtacattttctgtgtctaga

SEQ ID NO: 895774 - DNA, 22 bp, Artificial Sequence
  chemically synthesized
tcacacaacaatatttgtgtat

SEQ ID NO: 895775 - DNA, 22 bp, Artificial Sequence
  chemically synthesized
tctgtgtctagatacacaaata

SEQ ID NO: 895776 - DNA, 22 bp, Artificial Sequence
  chemically synthesized
ctgtgtctagatacacaaatat

SEQ ID NO: 895777 - DNA, 22 bp, Artificial Sequence
  chemically synthesized
tgtgtctagatacacaaatatt

SEQ ID NO: 895778 - DNA, 22 bp, Artificial Sequence
  chemically synthesized
tgtctagatacacaaatattgt

SEQ ID NO: 895779 - DNA, 22 bp, Artificial Sequence
  chemically synthesized
tagtcaattgtcacacaacaat

SEQ ID NO: 895780 - DNA, 22 bp, Artificial Sequence
  chemically synthesized
gatacacaaatattgttgtgtg

SEQ ID NO: 895781 - DNA, 22 bp, Artificial Sequence
  chemically synthesized
aatactgtagtcaattgtcaca

SEQ ID NO: 895782 - DNA, 22 bp, Artificial Sequence
  chemically synthesized
ctgaatactgtagtcaattgtc

SEQ ID NO: 895783 - DNA, 22 bp, Artificial Sequence
  chemically synthesized
actgaatactgtagtcaattgt

SEQ ID NO: 895784 - DNA, 22 bp, Artificial Sequence
  chemically synthesized
tactgaatactgtagtcaattg

SEQ ID NO: 895785 - DNA, 22 bp, Artificial Sequence
  chemically synthesized
ttgtgtgacaattgactacagt

SEQ ID NO: 895786 - DNA, 22 bp, Artificial Sequence
  chemically synthesized
tgtgacaattgactacagtatt

SEQ ID NO: 895787 - DNA, 22 bp, Artificial Sequence
  chemically synthesized
catgtgactttactgaatactg

SEQ ID NO: 895788 - DNA, 22 bp, Artificial Sequence
  chemically synthesized
tactgcatgtgactttactgaa

SEQ ID NO: 895789 - DNA, 22 bp, Artificial Sequence
  chemically synthesized
actacagtattcagtaaagtca

SEQ ID NO: 895790 - DNA, 22 bp, Artificial Sequence
  chemically synthesized
cagtattcagtaaagtcacatg

SEQ ID NO: 895791 - DNA, 22 bp, Artificial Sequence
  chemically synthesized
caaacctgtactgcatgtgact

SEQ ID NO: 895792 - DNA, 22 bp, Artificial Sequence
  chemically synthesized
ggctacaaacctgtactgcatg

SEQ ID NO: 895793 - DNA, 22 bp, Artificial Sequence
  chemically synthesized
agtaaagtcacatgcagtacag

SEQ ID NO: 895794 - DNA, 22 bp, Artificial Sequence
  chemically synthesized
ctaggctacaaacctgtactgc

SEQ ID NO: 895795 - DNA, 22 bp, Artificial Sequence
  chemically synthesized
ctcctaggctacaaacctgtac

SEQ ID NO: 895796 - DNA, 22 bp, Artificial Sequence
  chemically synthesized
tatggtacagcatattgctcct

SEQ ID NO: 895797 - DNA, 22 bp, Artificial Sequence
  chemically synthesized
gtagcctaggagcaatatgctg

SEQ ID NO: 895798 - DNA, 22 bp, Artificial Sequence
  chemically synthesized
tagcctaggagcaatatgctgt

SEQ ID NO: 895799 - DNA, 22 bp, Artificial Sequence
  chemically synthesized
ggagcaatatgctgtaccatat

SEQ ID NO: 895800 - DNA, 22 bp, Artificial Sequence
  chemically synthesized
cacatccaggctatatggtaca

SEQ ID NO: 895801 - DNA, 22 bp, Artificial Sequence
  chemically synthesized
ctgcacatccaggctatatggt

SEQ ID NO: 895802 - DNA, 22 bp, Artificial Sequence
  chemically synthesized
taccatatagcctggatgtgca

SEQ ID NO: 895803 - DNA, 22 bp, Artificial Sequence
  chemically synthesized
cacaaagatagatggtatagcc

SEQ ID NO: 895804 - DNA, 22 bp, Artificial Sequence
  chemically synthesized
gatgtgcagtaggctataccat

SEQ ID NO: 895805 - DNA, 22 bp, Artificial Sequence
  chemically synthesized
acacaaagatagatggtatagc

SEQ ID NO: 895806 - DNA, 22 bp, Artificial Sequence
  chemically synthesized
taccatctatctttgtgtaagt

SEQ ID NO: 895807 - DNA, 22 bp, Artificial Sequence
  chemically synthesized
tataatcatagagtgtacttac

SEQ ID NO: 895808 - DNA, 22 bp, Artificial Sequence
  chemically synthesized
ttgtataatcatagagtgtact

SEQ ID NO: 895809 - DNA, 22 bp, Artificial Sequence
  chemically synthesized
tctttgtgtaagtacactctat

SEQ ID NO: 895810 - DNA, 22 bp, Artificial Sequence
  chemically synthesized
ttgttgtataatcatagagtgt

SEQ ID NO: 895811 - DNA, 22 bp, Artificial Sequence
  chemically synthesized
gttgttgtataatcatagagtg

SEQ ID NO: 895812 - DNA, 22 bp, Artificial Sequence
  chemically synthesized
tgttgttgtataatcatagagt

SEQ ID NO: 895813 - DNA, 22 bp, Artificial Sequence
  chemically synthesized
tgtgtaagtacactctatgatt

SEQ ID NO: 895814 - DNA, 22 bp, Artificial Sequence
  chemically synthesized
gtgtaagtacactctatgatta

SEQ ID NO: 895815 - DNA, 22 bp, Artificial Sequence
  chemically synthesized
tgtaagtacactctatgattat

SEQ ID NO: 895816 - DNA, 22 bp, Artificial Sequence
  chemically synthesized
ggtgattttgttgttgtataat

SEQ ID NO: 895817 - DNA, 22 bp, Artificial Sequence
  chemically synthesized
tatgattatacaacaacaaaat

SEQ ID NO: 895818 - DNA, 22 bp, Artificial Sequence
  chemically synthesized
tgattatacaacaacaaaatca

SEQ ID NO: 895819 - DNA, 22 bp, Artificial Sequence
  chemically synthesized
aaaaatgtgtcattaggtgatt

SEQ ID NO: 895820 - DNA, 22 bp, Artificial Sequence
  chemically synthesized
tacaacaacaaaatcacctaat

SEQ ID NO: 895821 - DNA, 22 bp, Artificial Sequence
  chemically synthesized
tgaaaaatgtgtcattaggtga

SEQ ID NO: 895822 - DNA, 22 bp, Artificial Sequence
  chemically synthesized
acaaatgagatatgttctgaaa

SEQ ID NO: 895823 - DNA, 22 bp, Artificial Sequence
  chemically synthesized
aacaaatgagatatgttctgaa

SEQ ID NO: 895824 - DNA, 22 bp, Artificial Sequence
  chemically synthesized
atgacacatttttcagaacata

SEQ ID NO: 895825 - DNA, 22 bp, Artificial Sequence
  chemically synthesized
ttaacaaatgagatatgttctg

SEQ ID NO: 895826 - DNA, 22 bp, Artificial Sequence
  chemically synthesized
cttaacaaatgagatatgttct

SEQ ID NO: 895827 - DNA, 22 bp, Artificial Sequence
  chemically synthesized
ttcagaacatatctcatttgtt

SEQ ID NO: 895828 - DNA, 22 bp, Artificial Sequence
  chemically synthesized
tcagaacatatctcatttgtta

SEQ ID NO: 895829 - DNA, 22 bp, Artificial Sequence
  chemically synthesized
cagaacatatctcatttgttaa

SEQ ID NO: 895830 - DNA, 22 bp, Artificial Sequence
  chemically synthesized
agaacatatctcatttgttaag

SEQ ID NO: 895831 - DNA, 22 bp, Artificial Sequence
  chemically synthesized
gcaacatatatagtcatgcatt

SEQ ID NO: 895832 - DNA, 22 bp, Artificial Sequence
  chemically synthesized
atttgttaagaaatgcatgact

SEQ ID NO: 895833 - DNA, 22 bp, Artificial Sequence
  chemically synthesized
ctagcaacatatatagtcatgc

SEQ ID NO: 895834 - DNA, 22 bp, Artificial Sequence
  chemically synthesized
gttaagaaatgcatgactatat

SEQ ID NO: 895835 - DNA, 22 bp, Artificial Sequence
  chemically synthesized
ttaagaaatgcatgactatata

SEQ ID NO: 895836 - DNA, 22 bp, Artificial Sequence
  chemically synthesized
agaaatgcatgactatatatgt

SEQ ID NO: 895837 - DNA, 22 bp, Artificial Sequence
  chemically synthesized
ccaaattactagcaacatatat

SEQ ID NO: 895838 - DNA, 22 bp, Artificial Sequence
  chemically synthesized
aattaccaaattactagcaaca

SEQ ID NO: 895839 - DNA, 22 bp, Artificial Sequence
  chemically synthesized
ggtctgaattaccaaattacta

SEQ ID NO: 895840 - DNA, 22 bp, Artificial Sequence
  chemically synthesized
cggtctgaattaccaaattact

SEQ ID NO: 895841 - DNA, 22 bp, Artificial Sequence
  chemically synthesized
tatatgttgctagtaatttggt

SEQ ID NO: 895842 - DNA, 22 bp, Artificial Sequence
  chemically synthesized
tcggtctgaattaccaaattac

SEQ ID NO: 895843 - DNA, 22 bp, Artificial Sequence
  chemically synthesized
ttcggtctgaattaccaaatta

SEQ ID NO: 895844 - DNA, 22 bp, Artificial Sequence
  chemically synthesized
acttttcggtctgaattaccaa

SEQ ID NO: 895845 - DNA, 22 bp, Artificial Sequence
  chemically synthesized
aacttttcggtctgaattacca

SEQ ID NO: 895846 - DNA, 22 bp, Artificial Sequence
  chemically synthesized
ctagtaatttggtaattcagac

SEQ ID NO: 895847 - DNA, 22 bp, Artificial Sequence
  chemically synthesized
gtaatttggtaattcagaccga

SEQ ID NO: 895848 - DNA, 22 bp, Artificial Sequence
  chemically synthesized
ggtaattcagaccgaaaagtta

SEQ ID NO: 895849 - DNA, 22 bp, Artificial Sequence
  chemically synthesized
gtaattcagaccgaaaagttaa

SEQ ID NO: 895850 - DNA, 22 bp, Artificial Sequence
  chemically synthesized
cagggtagaagcttaacttttc

SEQ ID NO: 895851 - DNA, 22 bp, Artificial Sequence
  chemically synthesized
ccagggtagaagcttaactttt

SEQ ID NO: 895852 - DNA, 22 bp, Artificial Sequence
  chemically synthesized
agaccgaaaagttaagcttcta

SEQ ID NO: 895853 - DNA, 22 bp, Artificial Sequence
  chemically synthesized
tagtttccagggtagaagctta

SEQ ID NO: 895854 - DNA, 22 bp, Artificial Sequence
  chemically synthesized
gtagtttccagggtagaagctt

SEQ ID NO: 895855 - DNA, 22 bp, Artificial Sequence
  chemically synthesized
agtagtgtttgtagtttccagg

SEQ ID NO: 895856 - DNA, 22 bp, Artificial Sequence
  chemically synthesized
agcttctaccctggaaactaca

SEQ ID NO: 895857 - DNA, 22 bp, Artificial Sequence
  chemically synthesized
tctcagtagtgtttgtagtttc

SEQ ID NO: 895858 - DNA, 22 bp, Artificial Sequence
  chemically synthesized
ctaccctggaaactacaaacac

SEQ ID NO: 895859 - DNA, 22 bp, Artificial Sequence
  chemically synthesized
actgtctcagtagtgtttgtag

SEQ ID NO: 895860 - DNA, 22 bp, Artificial Sequence
  chemically synthesized
taccctggaaactacaaacact

SEQ ID NO: 895861 - DNA, 22 bp, Artificial Sequence
  chemically synthesized
cactgtctcagtagtgtttgta

SEQ ID NO: 895862 - DNA, 22 bp, Artificial Sequence
  chemically synthesized
ccctggaaactacaaacactac

SEQ ID NO: 895863 - DNA, 22 bp, Artificial Sequence
  chemically synthesized
ttcactgtctcagtagtgtttg

SEQ ID NO: 895864 - DNA, 22 bp, Artificial Sequence
  chemically synthesized
cttcactgtctcagtagtgttt

SEQ ID NO: 895865 - DNA, 22 bp, Artificial Sequence
  chemically synthesized
tcttcactgtctcagtagtgtt

SEQ ID NO: 895866 - DNA, 22 bp, Artificial Sequence
  chemically synthesized
gaaactacaaacactactgaga

SEQ ID NO: 895867 - DNA, 22 bp, Artificial Sequence
  chemically synthesized
cattttcttcactgtctcagta

SEQ ID NO: 895868 - DNA, 22 bp, Artificial Sequence
  chemically synthesized
acattttcttcactgtctcagt

SEQ ID NO: 895869 - DNA, 22 bp, Artificial Sequence
  chemically synthesized
tttacattttcttcactgtctc

SEQ ID NO: 895870 - DNA, 22 bp, Artificial Sequence
  chemically synthesized
caaacactactgagacagtgaa

SEQ ID NO: 895871 - DNA, 22 bp, Artificial Sequence
  chemically synthesized
gtttacattttcttcactgtct

SEQ ID NO: 895872 - DNA, 22 bp, Artificial Sequence
  chemically synthesized
tttgtttacattttcttcactg

SEQ ID NO: 895873 - DNA, 22 bp, Artificial Sequence
  chemically synthesized
tatttgtttacattttcttcac

SEQ ID NO: 895874 - DNA, 22 bp, Artificial Sequence
  chemically synthesized
ctgagacagtgaagaaaatgta

SEQ ID NO: 895875 - DNA, 22 bp, Artificial Sequence
  chemically synthesized
agacagtgaagaaaatgtaaac

SEQ ID NO: 895876 - DNA, 22 bp, Artificial Sequence
  chemically synthesized
atgaagaaggtagtcctctatt

SEQ ID NO: 895877 - DNA, 22 bp, Artificial Sequence
  chemically synthesized
attcatgaagaaggtagtcctc

SEQ ID NO: 895878 - DNA, 22 bp, Artificial Sequence
  chemically synthesized
taattcatgaagaaggtagtcc

SEQ ID NO: 895879 - DNA, 22 bp, Artificial Sequence
  chemically synthesized
ctaattcatgaagaaggtagtc

SEQ ID NO: 895880 - DNA, 22 bp, Artificial Sequence
  chemically synthesized
tctaattcatgaagaaggtagt

SEQ ID NO: 895881 - DNA, 22 bp, Artificial Sequence
  chemically synthesized
gactttctaattcatgaagaag

SEQ ID NO: 895882 - DNA, 22 bp, Artificial Sequence
  chemically synthesized
cagtattggactttctaattca

SEQ ID NO: 895883 - DNA, 22 bp, Artificial Sequence
  chemically synthesized
acagtattggactttctaattc

SEQ ID NO: 895884 - DNA, 22 bp, Artificial Sequence
  chemically synthesized
tacagtattggactttctaatt

SEQ ID NO: 895885 - DNA, 22 bp, Artificial Sequence
  chemically synthesized
ccttcttcatgaattagaaagt

SEQ ID NO: 895886 - DNA, 22 bp, Artificial Sequence
  chemically synthesized
cttcatgaattagaaagtccaa

SEQ ID NO: 895887 - DNA, 22 bp, Artificial Sequence
  chemically synthesized
ttcatgaattagaaagtccaat

SEQ ID NO: 895888 - DNA, 22 bp, Artificial Sequence
  chemically synthesized
catgaattagaaagtccaatac

SEQ ID NO: 895889 - DNA, 22 bp, Artificial Sequence
  chemically synthesized
atgaattagaaagtccaatact

SEQ ID NO: 895890 - DNA, 22 bp, Artificial Sequence
  chemically synthesized
gaaagtccaatactgtaaagat

SEQ ID NO: 895891 - DNA, 22 bp, Artificial Sequence
  chemically synthesized
aagagagggcagatatctttac

SEQ ID NO: 895892 - DNA, 22 bp, Artificial Sequence
  chemically synthesized
gaagagagggcagatatcttta

SEQ ID NO: 895893 - DNA, 22 bp, Artificial Sequence
  chemically synthesized
tttgaagagagggcagatatct

SEQ ID NO: 895894 - DNA, 22 bp, Artificial Sequence
  chemically synthesized
tagattatttgaagagagggca

SEQ ID NO: 895895 - DNA, 22 bp, Artificial Sequence
  chemically synthesized
atagattatttgaagagagggc

SEQ ID NO: 895896 - DNA, 22 bp, Artificial Sequence
  chemically synthesized
taaagatatctgccctctcttc

SEQ ID NO: 895897 - DNA, 22 bp, Artificial Sequence
  chemically synthesized
aatttatagattatttgaagag

SEQ ID NO: 895898 - DNA, 22 bp, Artificial Sequence
  chemically synthesized
cattgaatttatagattatttg

SEQ ID NO: 895899 - DNA, 22 bp, Artificial Sequence
  chemically synthesized
ccctctcttcaaataatctata

SEQ ID NO: 895900 - DNA, 22 bp, Artificial Sequence
  chemically synthesized
agattgcattgaatttatagat

SEQ ID NO: 895901 - DNA, 22 bp, Artificial Sequence
  chemically synthesized
tcttcaaataatctataaattc

SEQ ID NO: 895902 - DNA, 22 bp, Artificial Sequence
  chemically synthesized
ttcaaataatctataaattcaa

SEQ ID NO: 895903 - DNA, 22 bp, Artificial Sequence
  chemically synthesized
attgagattgcattgaatttat

SEQ ID NO: 895904 - DNA, 22 bp, Artificial Sequence
  chemically synthesized
gattgagattgcattgaattta

SEQ ID NO: 895905 - DNA, 22 bp, Artificial Sequence
  chemically synthesized
caaataatctataaattcaatg

SEQ ID NO: 895906 - DNA, 22 bp, Artificial Sequence
  chemically synthesized
tgattgagattgcattgaattt

SEQ ID NO: 895907 - DNA, 22 bp, Artificial Sequence
  chemically synthesized
aaataatctataaattcaatgc

SEQ ID NO: 895908 - DNA, 22 bp, Artificial Sequence
  chemically synthesized
caattttgattgagattgcatt

SEQ ID NO: 895909 - DNA, 22 bp, Artificial Sequence
  chemically synthesized
ctgcaattttgattgagattgc

SEQ ID NO: 895910 - DNA, 22 bp, Artificial Sequence
  chemically synthesized
taaattcaatgcaatctcaatc

SEQ ID NO: 895911 - DNA, 22 bp, Artificial Sequence
  chemically synthesized
aatgcaatctcaatcaaaattg

SEQ ID NO: 895912 - DNA, 22 bp, Artificial Sequence
  chemically synthesized
agaaatggttgctgcaattttg

SEQ ID NO: 895913 - DNA, 22 bp, Artificial Sequence
  chemically synthesized
ctaagaaatggttgctgcaatt

SEQ ID NO: 895914 - DNA, 22 bp, Artificial Sequence
  chemically synthesized
tactaagaaatggttgctgcaa

SEQ ID NO: 895915 - DNA, 22 bp, Artificial Sequence
  chemically synthesized
ctactaagaaatggttgctgca

SEQ ID NO: 895916 - DNA, 22 bp, Artificial Sequence
  chemically synthesized
aatcaaaattgcagcaaccatt

SEQ ID NO: 895917 - DNA, 22 bp, Artificial Sequence
  chemically synthesized
gcatgtcaatttctactaagaa

SEQ ID NO: 895918 - DNA, 22 bp, Artificial Sequence
  chemically synthesized
cagcaaccatttcttagtagaa

SEQ ID NO: 895919 - DNA, 22 bp, Artificial Sequence
  chemically synthesized
ggattggcatgtcaatttctac

SEQ ID NO: 895920 - DNA, 22 bp, Artificial Sequence
  chemically synthesized
aggattggcatgtcaatttcta

SEQ ID NO: 895921 - DNA, 22 bp, Artificial Sequence
  chemically synthesized
cttagtagaaattgacatgcca

SEQ ID NO: 895922 - DNA, 22 bp, Artificial Sequence
  chemically synthesized
ttagtagaaattgacatgccaa

SEQ ID NO: 895923 - DNA, 22 bp, Artificial Sequence
  chemically synthesized
agtagaaattgacatgccaatc

SEQ ID NO: 895924 - DNA, 22 bp, Artificial Sequence
  chemically synthesized
gtagaaattgacatgccaatcc

SEQ ID NO: 895925 - DNA, 22 bp, Artificial Sequence
  chemically synthesized
catataaatcttaggattggca

SEQ ID NO: 895926 - DNA, 22 bp, Artificial Sequence
  chemically synthesized
acatataaatcttaggattggc

SEQ ID NO: 895927 - DNA, 22 bp, Artificial Sequence
  chemically synthesized
cacttacatataaatcttagga

SEQ ID NO: 895928 - DNA, 22 bp, Artificial Sequence
  chemically synthesized
gcacttacatataaatcttagg

SEQ ID NO: 895929 - DNA, 22 bp, Artificial Sequence
  chemically synthesized
tgcacttacatataaatcttag

SEQ ID NO: 895930 - DNA, 22 bp, Artificial Sequence
  chemically synthesized
acatgccaatcctaagatttat

SEQ ID NO: 895931 - DNA, 22 bp, Artificial Sequence
  chemically synthesized
gccctttgcacttacatataaa

SEQ ID NO: 895932 - DNA, 22 bp, Artificial Sequence
  chemically synthesized
agccctttgcacttacatataa

SEQ ID NO: 895933 - DNA, 22 bp, Artificial Sequence
  chemically synthesized
ttagccctttgcacttacatat

SEQ ID NO: 895934 - DNA, 22 bp, Artificial Sequence
  chemically synthesized
agatttatatgtaagtgcaaag

SEQ ID NO: 895935 - DNA, 22 bp, Artificial Sequence
  chemically synthesized
gatattcttagccctttgcact

SEQ ID NO: 895936 - DNA, 22 bp, Artificial Sequence
  chemically synthesized
ggatattcttagccctttgcac

SEQ ID NO: 895937 - DNA, 22 bp, Artificial Sequence
  chemically synthesized
atatgtaagtgcaaagggctaa

SEQ ID NO: 895938 - DNA, 22 bp, Artificial Sequence
  chemically synthesized
ccttggatattcttagcccttt

SEQ ID NO: 895939 - DNA, 22 bp, Artificial Sequence
  chemically synthesized
tatgtaagtgcaaagggctaag

SEQ ID NO: 895940 - DNA, 22 bp, Artificial Sequence
  chemically synthesized
aaagttgccttggatattctta

SEQ ID NO: 895941 - DNA, 22 bp, Artificial Sequence
  chemically synthesized
caaagttgccttggatattctt

SEQ ID NO: 895942 - DNA, 22 bp, Artificial Sequence
  chemically synthesized
ttcaaagttgccttggatattc

SEQ ID NO: 895943 - DNA, 22 bp, Artificial Sequence
  chemically synthesized
gtcgttcttcaaagttgccttg

SEQ ID NO: 895944 - DNA, 22 bp, Artificial Sequence
  chemically synthesized
cgtcgttcttcaaagttgcctt

SEQ ID NO: 895945 - DNA, 22 bp, Artificial Sequence
  chemically synthesized
agaatatccaaggcaactttga

SEQ ID NO: 895946 - DNA, 22 bp, Artificial Sequence
  chemically synthesized
aacttcgtcgttcttcaaagtt

SEQ ID NO: 895947 - DNA, 22 bp, Artificial Sequence
  chemically synthesized
aaacttcgtcgttcttcaaagt

SEQ ID NO: 895948 - DNA, 22 bp, Artificial Sequence
  chemically synthesized
ttaaacttcgtcgttcttcaaa

SEQ ID NO: 895949 - DNA, 22 bp, Artificial Sequence
  chemically synthesized
gtggcaaacattcttaaacttc

SEQ ID NO: 895950 - DNA, 22 bp, Artificial Sequence
  chemically synthesized
tgaagaacgacgaagtttaaga

SEQ ID NO: 895951 - DNA, 22 bp, Artificial Sequence
  chemically synthesized
gaagaacgacgaagtttaagaa

SEQ ID NO: 895952 - DNA, 22 bp, Artificial Sequence
  chemically synthesized
aagaacgacgaagtttaagaat

SEQ ID NO: 895953 - DNA, 22 bp, Artificial Sequence
  chemically synthesized
atgtctggtggcaaacattctt

SEQ ID NO: 895954 - DNA, 22 bp, Artificial Sequence
  chemically synthesized
aagaatgtttgccaccagacat

SEQ ID NO: 895955 - DNA, 22 bp, Artificial Sequence
  chemically synthesized
taataaatattcatgtctggtg

SEQ ID NO: 895956 - DNA, 22 bp, Artificial Sequence
  chemically synthesized
agaatgtttgccaccagacatg

SEQ ID NO: 895957 - DNA, 22 bp, Artificial Sequence
  chemically synthesized
attataataaatattcatgtct

SEQ ID NO: 895958 - DNA, 22 bp, Artificial Sequence
  chemically synthesized
aattataataaatattcatgtc

SEQ ID NO: 895959 - DNA, 22 bp, Artificial Sequence
  chemically synthesized
gccaccagacatgaatatttat

SEQ ID NO: 895960 - DNA, 22 bp, Artificial Sequence
  chemically synthesized
ccaccagacatgaatatttatt

SEQ ID NO: 895961 - DNA, 22 bp, Artificial Sequence
  chemically synthesized
aatcccacacaggcttaattat

SEQ ID NO: 895962 - DNA, 22 bp, Artificial Sequence
  chemically synthesized
caatcccacacaggcttaatta

SEQ ID NO: 895963 - DNA, 22 bp, Artificial Sequence
  chemically synthesized
acttcaatcccacacaggctta

SEQ ID NO: 895964 - DNA, 22 bp, Artificial Sequence
  chemically synthesized
tcacttcaatcccacacaggct

SEQ ID NO: 895965 - DNA, 22 bp, Artificial Sequence
  chemically synthesized
attataattaagcctgtgtggg

SEQ ID NO: 895966 - DNA, 22 bp, Artificial Sequence
  chemically synthesized
ttataattaagcctgtgtggga

SEQ ID NO: 895967 - DNA, 22 bp, Artificial Sequence
  chemically synthesized
ttctcacttcaatcccacacag

SEQ ID NO: 895968 - DNA, 22 bp, Artificial Sequence
  chemically synthesized
gttctcacttcaatcccacaca

SEQ ID NO: 895969 - DNA, 22 bp, Artificial Sequence
  chemically synthesized
taattaagcctgtgtgggattg

SEQ ID NO: 895970 - DNA, 22 bp, Artificial Sequence
  chemically synthesized
agcctgtgtgggattgaagtga

SEQ ID NO: 895971 - DNA, 22 bp, Artificial Sequence
  chemically synthesized
tatagatgatttgttctcactt

SEQ ID NO: 895972 - DNA, 22 bp, Artificial Sequence
  chemically synthesized
tgtgggattgaagtgagaacaa

SEQ ID NO: 895973 - DNA, 22 bp, Artificial Sequence
  chemically synthesized
ggaaacgctatatagatgattt

SEQ ID NO: 895974 - DNA, 22 bp, Artificial Sequence
  chemically synthesized
aagtgagaacaaatcatctata

SEQ ID NO: 895975 - DNA, 22 bp, Artificial Sequence
  chemically synthesized
tatagcgtttcctaatttatac

SEQ ID NO: 895976 - DNA, 22 bp, Artificial Sequence
  chemically synthesized
agtgacaccatcgtataaatta

SEQ ID NO: 895977 - DNA, 22 bp, Artificial Sequence
  chemically synthesized
aagtgacaccatcgtataaatt

SEQ ID NO: 895978 - DNA, 22 bp, Artificial Sequence
  chemically synthesized
caacttaagtgacaccatcgta

SEQ ID NO: 895979 - DNA, 22 bp, Artificial Sequence
  chemically synthesized
ccaacttaagtgacaccatcgt

SEQ ID NO: 895980 - DNA, 22 bp, Artificial Sequence
  chemically synthesized
tccaacttaagtgacaccatcg

SEQ ID NO: 895981 - DNA, 22 bp, Artificial Sequence
  chemically synthesized
cctaatttatacgatggtgtca

SEQ ID NO: 895982 - DNA, 22 bp, Artificial Sequence
  chemically synthesized
ttccaacttaagtgacaccatc

SEQ ID NO: 895983 - DNA, 22 bp, Artificial Sequence
  chemically synthesized
ctaatttatacgatggtgtcac

SEQ ID NO: 895984 - DNA, 22 bp, Artificial Sequence
  chemically synthesized
atttatacgatggtgtcactta

SEQ ID NO: 895985 - DNA, 22 bp, Artificial Sequence
  chemically synthesized
atacgatggtgtcacttaagtt

SEQ ID NO: 895986 - DNA, 22 bp, Artificial Sequence
  chemically synthesized
tacgatggtgtcacttaagttg

SEQ ID NO: 895987 - DNA, 22 bp, Artificial Sequence
  chemically synthesized
aaaagatcatccttttccaact

SEQ ID NO: 895988 - DNA, 22 bp, Artificial Sequence
  chemically synthesized
ctgaaaagatcatccttttcca

SEQ ID NO: 895989 - DNA, 22 bp, Artificial Sequence
  chemically synthesized
actgaaaagatcatccttttcc

SEQ ID NO: 895990 - DNA, 22 bp, Artificial Sequence
  chemically synthesized
tttactgaaaagatcatccttt

SEQ ID NO: 895991 - DNA, 22 bp, Artificial Sequence
  chemically synthesized
aagttggaaaaggatgatcttt

SEQ ID NO: 895992 - DNA, 22 bp, Artificial Sequence
  chemically synthesized
agttggaaaaggatgatctttt

SEQ ID NO: 895993 - DNA, 22 bp, Artificial Sequence
  chemically synthesized
gtgctatttactgaaaagatca

SEQ ID NO: 895994 - DNA, 22 bp, Artificial Sequence
  chemically synthesized
ggtgctatttactgaaaagatc

SEQ ID NO: 895995 - DNA, 22 bp, Artificial Sequence
  chemically synthesized
gaaaaggatgatcttttcagta

SEQ ID NO: 895996 - DNA, 22 bp, Artificial Sequence
  chemically synthesized
acttggtgctatttactgaaaa

SEQ ID NO: 895997 - DNA, 22 bp, Artificial Sequence
  chemically synthesized
atcagttaacttggtgctattt

SEQ ID NO: 895998 - DNA, 22 bp, Artificial Sequence
  chemically synthesized
ttcagtaaatagcaccaagtta

SEQ ID NO: 895999 - DNA, 22 bp, Artificial Sequence
  chemically synthesized
tcagtaaatagcaccaagttaa

SEQ ID NO: 896000 - DNA, 22 bp, Artificial Sequence
  chemically synthesized
cagtaaatagcaccaagttaac

SEQ ID NO: 896001 - DNA, 22 bp, Artificial Sequence
  chemically synthesized
agtaaatagcaccaagttaact

SEQ ID NO: 896002 - DNA, 22 bp, Artificial Sequence
  chemically synthesized
aaatgactaatcagttaacttg

SEQ ID NO: 896003 - DNA, 22 bp, Artificial Sequence
  chemically synthesized
caaatgactaatcagttaactt

SEQ ID NO: 896004 - DNA, 22 bp, Artificial Sequence
  chemically synthesized
tcaaatgactaatcagttaact

SEQ ID NO: 896005 - DNA, 22 bp, Artificial Sequence
  chemically synthesized
ttcaaatgactaatcagttaac

SEQ ID NO: 896006 - DNA, 22 bp, Artificial Sequence
  chemically synthesized
atgtttttcaaatgactaatca

SEQ ID NO: 896007 - DNA, 22 bp, Artificial Sequence
  chemically synthesized
actgattagtcatttgaaaaac

SEQ ID NO: 896008 - DNA, 22 bp, Artificial Sequence
  chemically synthesized
attagtcatttgaaaaacatga

SEQ ID NO: 896009 - DNA, 22 bp, Artificial Sequence
  chemically synthesized
gtcatttgaaaaacatgaacct

SEQ ID NO: 896010 - DNA, 22 bp, Artificial Sequence
  chemically synthesized
gaaaaacatgaaccttgactct

SEQ ID NO: 896011 - DNA, 22 bp, Artificial Sequence
  chemically synthesized
tgtatgatgtggagagtcaagg

SEQ ID NO: 896012 - DNA, 22 bp, Artificial Sequence
  chemically synthesized
aaaaacatgaaccttgactctc

SEQ ID NO: 896013 - DNA, 22 bp, Artificial Sequence
  chemically synthesized
gtgtatgatgtggagagtcaag

SEQ ID NO: 896014 - DNA, 22 bp, Artificial Sequence
  chemically synthesized
tgtgtatgatgtggagagtcaa

SEQ ID NO: 896015 - DNA, 22 bp, Artificial Sequence
  chemically synthesized
tgttttgtgtatgatgtggaga

SEQ ID NO: 896016 - DNA, 22 bp, Artificial Sequence
  chemically synthesized
atgttttgtgtatgatgtggag

SEQ ID NO: 896017 - DNA, 22 bp, Artificial Sequence
  chemically synthesized
gaatttatgttttgtgtatgat

SEQ ID NO: 896018 - DNA, 22 bp, Artificial Sequence
  chemically synthesized
gactctccacatcatacacaaa

SEQ ID NO: 896019 - DNA, 22 bp, Artificial Sequence
  chemically synthesized
actctccacatcatacacaaaa

SEQ ID NO: 896020 - DNA, 22 bp, Artificial Sequence
  chemically synthesized
tccacatcatacacaaaacata

SEQ ID NO: 896021 - DNA, 22 bp, Artificial Sequence
  chemically synthesized
cacatcatacacaaaacataaa

SEQ ID NO: 896022 - DNA, 22 bp, Artificial Sequence
  chemically synthesized
caaacaatctagaatttatgtt

SEQ ID NO: 896023 - DNA, 22 bp, Artificial Sequence
  chemically synthesized
aggtctgcaaacaatctagaat

SEQ ID NO: 896024 - DNA, 22 bp, Artificial Sequence
  chemically synthesized
cattgaggtctgcaaacaatct

SEQ ID NO: 896025 - DNA, 22 bp, Artificial Sequence
  chemically synthesized
acattgaggtctgcaaacaatc

SEQ ID NO: 896026 - DNA, 22 bp, Artificial Sequence
  chemically synthesized
tacattgaggtctgcaaacaat

SEQ ID NO: 896027 - DNA, 22 bp, Artificial Sequence
  chemically synthesized
ttacattgaggtctgcaaacaa

SEQ ID NO: 896028 - DNA, 22 bp, Artificial Sequence
  chemically synthesized
ccttttacattgaggtctgcaa

SEQ ID NO: 896029 - DNA, 22 bp, Artificial Sequence
  chemically synthesized
gccttttacattgaggtctgca

SEQ ID NO: 896030 - DNA, 22 bp, Artificial Sequence
  chemically synthesized
tgccttttacattgaggtctgc

SEQ ID NO: 896031 - DNA, 22 bp, Artificial Sequence
  chemically synthesized
ttgccttttacattgaggtctg

SEQ ID NO: 896032 - DNA, 22 bp, Artificial Sequence
  chemically synthesized
tagattgtttgcagacctcaat

SEQ ID NO: 896033 - DNA, 22 bp, Artificial Sequence
  chemically synthesized
tttgccttttacattgaggtct

SEQ ID NO: 896034 - DNA, 22 bp, Artificial Sequence
  chemically synthesized
ttttgccttttacattgaggtc

SEQ ID NO: 896035 - DNA, 22 bp, Artificial Sequence
  chemically synthesized
gattgtttgcagacctcaatgt

SEQ ID NO: 896036 - DNA, 22 bp, Artificial Sequence
  chemically synthesized
tttttttgccttttacattgag

SEQ ID NO: 896037 - DNA, 22 bp, Artificial Sequence
  chemically synthesized
atttttttgccttttacattga

SEQ ID NO: 896038 - DNA, 22 bp, Artificial Sequence
  chemically synthesized
tatttttttgccttttacattg

SEQ ID NO: 896039 - DNA, 22 bp, Artificial Sequence
  chemically synthesized
tttgcagacctcaatgtaaaag

SEQ ID NO: 896040 - DNA, 22 bp, Artificial Sequence
  chemically synthesized
gcagacctcaatgtaaaaggca

SEQ ID NO: 896041 - DNA, 22 bp, Artificial Sequence
  chemically synthesized
cagacctcaatgtaaaaggcaa

SEQ ID NO: 896042 - DNA, 22 bp, Artificial Sequence
  chemically synthesized
aaaactttatttttttgccttt

SEQ ID NO: 896043 - DNA, 22 bp, Artificial Sequence
  chemically synthesized
gaaaactttatttttttgcctt

SEQ ID NO: 896044 - DNA, 22 bp, Artificial Sequence
  chemically synthesized
tgaaaactttatttttttgcct

SEQ ID NO: 896045 - DNA, 22 bp, Artificial Sequence
  chemically synthesized
ttgaaaactttatttttttgcc

SEQ ID NO: 896046 - DNA, 22 bp, Artificial Sequence
  chemically synthesized
ttttgaaaactttatttttttg

SEQ ID NO: 896047 - DNA, 22 bp, Artificial Sequence
  chemically synthesized
aatgtaaaaggcaaaaaaataa

SEQ ID NO: 896048 - DNA, 22 bp, Artificial Sequence
  chemically synthesized
cttttgaaaactttattttttt

SEQ ID NO: 896049 - DNA, 22 bp, Artificial Sequence
  chemically synthesized
tcttttgaaaactttatttttt

SEQ ID NO: 896050 - DNA, 22 bp, Artificial Sequence
  chemically synthesized
tattttcttttgaaaactttat

SEQ ID NO: 896051 - DNA, 22 bp, Artificial Sequence
  chemically synthesized
tatattttcttttgaaaacttt

SEQ ID NO: 896052 - DNA, 22 bp, Artificial Sequence
  chemically synthesized
ctatattttcttttgaaaactt

SEQ ID NO: 896053 - DNA, 22 bp, Artificial Sequence
  chemically synthesized
tctatattttcttttgaaaact

SEQ ID NO: 896054 - DNA, 22 bp, Artificial Sequence
  chemically synthesized
ttctatattttcttttgaaaac

SEQ ID NO: 896055 - DNA, 22 bp, Artificial Sequence
  chemically synthesized
tttctatattttcttttgaaaa

SEQ ID NO: 896056 - DNA, 22 bp, Artificial Sequence
  chemically synthesized
ttttctatattttcttttgaaa

SEQ ID NO: 896057 - DNA, 22 bp, Artificial Sequence
  chemically synthesized
agatttttttctatattttctt

SEQ ID NO: 896058 - DNA, 22 bp, Artificial Sequence
  chemically synthesized
ttgagatttttttctatatttt

SEQ ID NO: 896059 - DNA, 22 bp, Artificial Sequence
  chemically synthesized
tcaaaagaaaatatagaaaaaa

SEQ ID NO: 896060 - DNA, 22 bp, Artificial Sequence
  chemically synthesized
caaaagaaaatatagaaaaaaa

SEQ ID NO: 896061 - DNA, 22 bp, Artificial Sequence
  chemically synthesized
aaattgttgagatttttttcta

SEQ ID NO: 896062 - DNA, 22 bp, Artificial Sequence
  chemically synthesized
aaaagaaaatatagaaaaaaat

SEQ ID NO: 896063 - DNA, 22 bp, Artificial Sequence
  chemically synthesized
acctaaaattgttgagattttt

SEQ ID NO: 896064 - DNA, 22 bp, Artificial Sequence
  chemically synthesized
aaaaataatacattaacctaaa

SEQ ID NO: 896065 - DNA, 22 bp, Artificial Sequence
  chemically synthesized
aaaaaataatacattaacctaa

SEQ ID NO: 896066 - DNA, 22 bp, Artificial Sequence
  chemically synthesized
tttaaaaaataatacattaacc

SEQ ID NO: 896067 - DNA, 22 bp, Artificial Sequence
  chemically synthesized
gtttaaaaaataatacattaac

SEQ ID NO: 896068 - DNA, 22 bp, Artificial Sequence
  chemically synthesized
aacaattttaggttaatgtatt

SEQ ID NO: 896069 - DNA, 22 bp, Artificial Sequence
  chemically synthesized
tgtcttgtttaaaaaataatac

SEQ ID NO: 896070 - DNA, 22 bp, Artificial Sequence
  chemically synthesized
atgtcttgtttaaaaaataata

SEQ ID NO: 896071 - DNA, 22 bp, Artificial Sequence
  chemically synthesized
tatgtcttgtttaaaaaataat

SEQ ID NO: 896072 - DNA, 22 bp, Artificial Sequence
  chemically synthesized
taggttaatgtattatttttta

SEQ ID NO: 896073 - DNA, 22 bp, Artificial Sequence
  chemically synthesized
ttatgtcttgtttaaaaaataa

SEQ ID NO: 896074 - DNA, 22 bp, Artificial Sequence
  chemically synthesized
aggttaatgtattattttttaa

SEQ ID NO: 896075 - DNA, 22 bp, Artificial Sequence
  chemically synthesized
tttatgtcttgtttaaaaaata

SEQ ID NO: 896076 - DNA, 22 bp, Artificial Sequence
  chemically synthesized
ggttaatgtattattttttaaa

SEQ ID NO: 896077 - DNA, 22 bp, Artificial Sequence
  chemically synthesized
atgtattattttttaaacaaga

SEQ ID NO: 896078 - DNA, 22 bp, Artificial Sequence
  chemically synthesized
atgctttttatgtcttgtttaa

SEQ ID NO: 896079 - DNA, 22 bp, Artificial Sequence
  chemically synthesized
tggctaatgctttttatgtctt

SEQ ID NO: 896080 - DNA, 22 bp, Artificial Sequence
  chemically synthesized
atggctaatgctttttatgtct

SEQ ID NO: 896081 - DNA, 22 bp, Artificial Sequence
  chemically synthesized
ttttttaaacaagacataaaaa

SEQ ID NO: 896082 - DNA, 22 bp, Artificial Sequence
  chemically synthesized
tatggctaatgctttttatgtc

SEQ ID NO: 896083 - DNA, 22 bp, Artificial Sequence
  chemically synthesized
tttaaacaagacataaaaagca

SEQ ID NO: 896084 - DNA, 22 bp, Artificial Sequence
  chemically synthesized
ctttatggctaatgctttttat

SEQ ID NO: 896085 - DNA, 22 bp, Artificial Sequence
  chemically synthesized
ttaaacaagacataaaaagcat

SEQ ID NO: 896086 - DNA, 22 bp, Artificial Sequence
  chemically synthesized
cctttatggctaatgcttttta

SEQ ID NO: 896087 - DNA, 22 bp, Artificial Sequence
  chemically synthesized
taaacaagacataaaaagcatt

SEQ ID NO: 896088 - DNA, 22 bp, Artificial Sequence
  chemically synthesized
tcctttatggctaatgcttttt

SEQ ID NO: 896089 - DNA, 22 bp, Artificial Sequence
  chemically synthesized
aaacaagacataaaaagcatta

SEQ ID NO: 896090 - DNA, 22 bp, Artificial Sequence
  chemically synthesized
ttcctttatggctaatgctttt

SEQ ID NO: 896091 - DNA, 22 bp, Artificial Sequence
  chemically synthesized
aacaagacataaaaagcattag

SEQ ID NO: 896092 - DNA, 22 bp, Artificial Sequence
  chemically synthesized
tcagtcttttcctttatggcta

SEQ ID NO: 896093 - DNA, 22 bp, Artificial Sequence
  chemically synthesized
atcagtcttttcctttatggct

SEQ ID NO: 896094 - DNA, 22 bp, Artificial Sequence
  chemically synthesized
atttatcagtcttttcctttat

SEQ ID NO: 896095 - DNA, 22 bp, Artificial Sequence
  chemically synthesized
gatttatcagtcttttccttta

SEQ ID NO: 896096 - DNA, 22 bp, Artificial Sequence
  chemically synthesized
gccataaaggaaaagactgata

SEQ ID NO: 896097 - DNA, 22 bp, Artificial Sequence
  chemically synthesized
ataaatggagtttgatttatca

SEQ ID NO: 896098 - DNA, 22 bp, Artificial Sequence
  chemically synthesized
ctgataaatggagtttgattta

SEQ ID NO: 896099 - DNA, 22 bp, Artificial Sequence
  chemically synthesized
cctgataaatggagtttgattt

SEQ ID NO: 896100 - DNA, 22 bp, Artificial Sequence
  chemically synthesized
tcctgataaatggagtttgatt

SEQ ID NO: 896101 - DNA, 22 bp, Artificial Sequence
  chemically synthesized
acaatctttcctgataaatgga

SEQ ID NO: 896102 - DNA, 22 bp, Artificial Sequence
  chemically synthesized
ataaatcaaactccatttatca

SEQ ID NO: 896103 - DNA, 22 bp, Artificial Sequence
  chemically synthesized
aacaatctttcctgataaatgg

SEQ ID NO: 896104 - DNA, 22 bp, Artificial Sequence
  chemically synthesized
ttaacaatctttcctgataaat

SEQ ID NO: 896105 - DNA, 22 bp, Artificial Sequence
  chemically synthesized
tcttaacaatctttcctgataa

SEQ ID NO: 896106 - DNA, 22 bp, Artificial Sequence
  chemically synthesized
ctcttaacaatctttcctgata

SEQ ID NO: 896107 - DNA, 22 bp, Artificial Sequence
  chemically synthesized
tctcttaacaatctttcctgat

SEQ ID NO: 896108 - DNA, 22 bp, Artificial Sequence
  chemically synthesized
ttctcttaacaatctttcctga

SEQ ID NO: 896109 - DNA, 22 bp, Artificial Sequence
  chemically synthesized
tttctcttaacaatctttcctg

SEQ ID NO: 896110 - DNA, 22 bp, Artificial Sequence
  chemically synthesized
ttttctcttaacaatctttcct

SEQ ID NO: 896111 - DNA, 22 bp, Artificial Sequence
  chemically synthesized
tttttttctcttaacaatcttt

SEQ ID NO: 896112 - DNA, 22 bp, Artificial Sequence
  chemically synthesized
catttatcaggaaagattgtta

SEQ ID NO: 896113 - DNA, 22 bp, Artificial Sequence
  chemically synthesized
atttttttctcttaacaatctt

SEQ ID NO: 896114 - DNA, 22 bp, Artificial Sequence
  chemically synthesized
tatttttttctcttaacaatct

SEQ ID NO: 896115 - DNA, 22 bp, Artificial Sequence
  chemically synthesized
ctttatttttttctcttaacaa

SEQ ID NO: 896116 - DNA, 22 bp, Artificial Sequence
  chemically synthesized
atcaggaaagattgttaagaga

SEQ ID NO: 896117 - DNA, 22 bp, Artificial Sequence
  chemically synthesized
gctttatttttttctcttaaca

SEQ ID NO: 896118 - DNA, 22 bp, Artificial Sequence
  chemically synthesized
tcaggaaagattgttaagagaa

SEQ ID NO: 896119 - DNA, 22 bp, Artificial Sequence
  chemically synthesized
tgctttatttttttctcttaac

SEQ ID NO: 896120 - DNA, 22 bp, Artificial Sequence
  chemically synthesized
aactttgctttatttttttctc

SEQ ID NO: 896121 - DNA, 22 bp, Artificial Sequence
  chemically synthesized
caacctaaactttgctttattt

SEQ ID NO: 896122 - DNA, 22 bp, Artificial Sequence
  chemically synthesized
ttaagagaaaaaaataaagcaa

SEQ ID NO: 896123 - DNA, 22 bp, Artificial Sequence
  chemically synthesized
ccaacctaaactttgctttatt

SEQ ID NO: 896124 - DNA, 22 bp, Artificial Sequence
  chemically synthesized
tccaacctaaactttgctttat

SEQ ID NO: 896125 - DNA, 22 bp, Artificial Sequence
  chemically synthesized
ttccaacctaaactttgcttta

SEQ ID NO: 896126 - DNA, 22 bp, Artificial Sequence
  chemically synthesized
agagaaaaaaataaagcaaagt

SEQ ID NO: 896127 - DNA, 22 bp, Artificial Sequence
  chemically synthesized
tttccaacctaaactttgcttt

SEQ ID NO: 896128 - DNA, 22 bp, Artificial Sequence
  chemically synthesized
cgaatatctttttccaacctaa

SEQ ID NO: 896129 - DNA, 22 bp, Artificial Sequence
  chemically synthesized
tgcattgcgaatatctttttcc

SEQ ID NO: 896130 - DNA, 22 bp, Artificial Sequence
  chemically synthesized
aggttggaaaaagatattcgca

SEQ ID NO: 896131 - DNA, 22 bp, Artificial Sequence
  chemically synthesized
ggttggaaaaagatattcgcaa

SEQ ID NO: 896132 - DNA, 22 bp, Artificial Sequence
  chemically synthesized
tcagatctatgcattgcgaata

SEQ ID NO: 896133 - DNA, 22 bp, Artificial Sequence
  chemically synthesized
gtcagatctatgcattgcgaat

SEQ ID NO: 896134 - DNA, 22 bp, Artificial Sequence
  chemically synthesized
tgtcagatctatgcattgcgaa

SEQ ID NO: 896135 - DNA, 22 bp, Artificial Sequence
  chemically synthesized
gaaaaagatattcgcaatgcat

SEQ ID NO: 896136 - DNA, 22 bp, Artificial Sequence
  chemically synthesized
gatacaagtcctttgtcagatc

SEQ ID NO: 896137 - DNA, 22 bp, Artificial Sequence
  chemically synthesized
ggatacaagtcctttgtcagat

SEQ ID NO: 896138 - DNA, 22 bp, Artificial Sequence
  chemically synthesized
gcaatgcatagatctgacaaag

SEQ ID NO: 896139 - DNA, 22 bp, Artificial Sequence
  chemically synthesized
tttggatacaagtcctttgtca

SEQ ID NO: 896140 - DNA, 22 bp, Artificial Sequence
  chemically synthesized
atgtagaagttatttggataca

SEQ ID NO: 896141 - DNA, 22 bp, Artificial Sequence
  chemically synthesized
acaaaggacttgtatccaaata

SEQ ID NO: 896142 - DNA, 22 bp, Artificial Sequence
  chemically synthesized
ctgatgtagaagttatttggat

SEQ ID NO: 896143 - DNA, 22 bp, Artificial Sequence
  chemically synthesized
actgatgtagaagttatttgga

SEQ ID NO: 896144 - DNA, 22 bp, Artificial Sequence
  chemically synthesized
ttactgatgtagaagttatttg

SEQ ID NO: 896145 - DNA, 22 bp, Artificial Sequence
  chemically synthesized
cttactgatgtagaagttattt

SEQ ID NO: 896146 - DNA, 22 bp, Artificial Sequence
  chemically synthesized
tcttactgatgtagaagttatt

SEQ ID NO: 896147 - DNA, 22 bp, Artificial Sequence
  chemically synthesized
ttcttactgatgtagaagttat

SEQ ID NO: 896148 - DNA, 22 bp, Artificial Sequence
  chemically synthesized
tttcttactgatgtagaagtta

SEQ ID NO: 896149 - DNA, 22 bp, Artificial Sequence
  chemically synthesized
gtatccaaataacttctacatc

SEQ ID NO: 896150 - DNA, 22 bp, Artificial Sequence
  chemically synthesized
tatccaaataacttctacatca

SEQ ID NO: 896151 - DNA, 22 bp, Artificial Sequence
  chemically synthesized
tctttttcttactgatgtagaa

SEQ ID NO: 896152 - DNA, 22 bp, Artificial Sequence
  chemically synthesized
aaaataatagttgtctttttct

SEQ ID NO: 896153 - DNA, 22 bp, Artificial Sequence
  chemically synthesized
ctacatcagtaagaaaaagaca

SEQ ID NO: 896154 - DNA, 22 bp, Artificial Sequence
  chemically synthesized
tacatcagtaagaaaaagacaa

SEQ ID NO: 896155 - DNA, 22 bp, Artificial Sequence
  chemically synthesized
catcagtaagaaaaagacaact

SEQ ID NO: 896156 - DNA, 22 bp, Artificial Sequence
  chemically synthesized
cccattaaaaataatagttgtc

SEQ ID NO: 896157 - DNA, 22 bp, Artificial Sequence
  chemically synthesized
gcccattaaaaataatagttgt

SEQ ID NO: 896158 - DNA, 22 bp, Artificial Sequence
  chemically synthesized
tgcccattaaaaataatagttg

SEQ ID NO: 896159 - DNA, 22 bp, Artificial Sequence
  chemically synthesized
ttgcccattaaaaataatagtt

SEQ ID NO: 896160 - DNA, 22 bp, Artificial Sequence
  chemically synthesized
tgcaaatcttttgcccattaaa

SEQ ID NO: 896161 - DNA, 22 bp, Artificial Sequence
  chemically synthesized
ttatttttaatgggcaaaagat

SEQ ID NO: 896162 - DNA, 22 bp, Artificial Sequence
  chemically synthesized
tttttaatgggcaaaagatttg

SEQ ID NO: 896163 - DNA, 22 bp, Artificial Sequence
  chemically synthesized
ttaatgggcaaaagatttgcat

SEQ ID NO: 896164 - DNA, 22 bp, Artificial Sequence
  chemically synthesized
tgtgaagtcattatgcaaatct

SEQ ID NO: 896165 - DNA, 22 bp, Artificial Sequence
  chemically synthesized
taatgggcaaaagatttgcata

SEQ ID NO: 896166 - DNA, 22 bp, Artificial Sequence
  chemically synthesized
atgtgaagtcattatgcaaatc

SEQ ID NO: 896167 - DNA, 22 bp, Artificial Sequence
  chemically synthesized
aatgggcaaaagatttgcataa

SEQ ID NO: 896168 - DNA, 22 bp, Artificial Sequence
  chemically synthesized
atgggcaaaagatttgcataat

SEQ ID NO: 896169 - DNA, 22 bp, Artificial Sequence
  chemically synthesized
ttatgtgaagtcattatgcaaa

SEQ ID NO: 896170 - DNA, 22 bp, Artificial Sequence
  chemically synthesized
tatcctcttatgtgaagtcatt

SEQ ID NO: 896171 - DNA, 22 bp, Artificial Sequence
  chemically synthesized
atatcctcttatgtgaagtcat

SEQ ID NO: 896172 - DNA, 22 bp, Artificial Sequence
  chemically synthesized
tatatcctcttatgtgaagtca

SEQ ID NO: 896173 - DNA, 22 bp, Artificial Sequence
  chemically synthesized
ttatatcctcttatgtgaagtc

SEQ ID NO: 896174 - DNA, 22 bp, Artificial Sequence
  chemically synthesized
gcataatgacttcacataagag

SEQ ID NO: 896175 - DNA, 22 bp, Artificial Sequence
  chemically synthesized
cataatgacttcacataagagg

SEQ ID NO: 896176 - DNA, 22 bp, Artificial Sequence
  chemically synthesized
gtgccatttttatatcctctta

SEQ ID NO: 896177 - DNA, 22 bp, Artificial Sequence
  chemically synthesized
acgattagtgccatttttatat

SEQ ID NO: 896178 - DNA, 22 bp, Artificial Sequence
  chemically synthesized
cacataagaggatataaaaatg

SEQ ID NO: 896179 - DNA, 22 bp, Artificial Sequence
  chemically synthesized
acataagaggatataaaaatgg

SEQ ID NO: 896180 - DNA, 22 bp, Artificial Sequence
  chemically synthesized
caatcacctgacgattagtgcc

SEQ ID NO: 896181 - DNA, 22 bp, Artificial Sequence
  chemically synthesized
gcaatcacctgacgattagtgc

SEQ ID NO: 896182 - DNA, 22 bp, Artificial Sequence
  chemically synthesized
atttgcaatcacctgacgatta

SEQ ID NO: 896183 - DNA, 22 bp, Artificial Sequence
  chemically synthesized
aatttgcaatcacctgacgatt

SEQ ID NO: 896184 - DNA, 22 bp, Artificial Sequence
  chemically synthesized
taatttgcaatcacctgacgat

SEQ ID NO: 896185 - DNA, 22 bp, Artificial Sequence
  chemically synthesized
tgttttaatttgcaatcacctg

SEQ ID NO: 896186 - DNA, 22 bp, Artificial Sequence
  chemically synthesized
attgtgttttaatttgcaatca

SEQ ID NO: 896187 - DNA, 22 bp, Artificial Sequence
  chemically synthesized
cattgtgttttaatttgcaatc

SEQ ID NO: 896188 - DNA, 22 bp, Artificial Sequence
  chemically synthesized
atcgtcaggtgattgcaaatta

SEQ ID NO: 896189 - DNA, 22 bp, Artificial Sequence
  chemically synthesized
caaattaaaacacaatgaaata

SEQ ID NO: 896190 - DNA, 22 bp, Artificial Sequence
  chemically synthesized
ggtgaatgtgaaatggtatttc

SEQ ID NO: 896191 - DNA, 22 bp, Artificial Sequence
  chemically synthesized
aggtgaatgtgaaatggtattt

SEQ ID NO: 896192 - DNA, 22 bp, Artificial Sequence
  chemically synthesized
aaacacaatgaaataccatttc

SEQ ID NO: 896193 - DNA, 22 bp, Artificial Sequence
  chemically synthesized
accatttaggtgaatgtgaaat

SEQ ID NO: 896194 - DNA, 22 bp, Artificial Sequence
  chemically synthesized
aaccatttaggtgaatgtgaaa

SEQ ID NO: 896195 - DNA, 22 bp, Artificial Sequence
  chemically synthesized
taaccatttaggtgaatgtgaa

SEQ ID NO: 896196 - DNA, 22 bp, Artificial Sequence
  chemically synthesized
ttaaccatttaggtgaatgtga

SEQ ID NO: 896197 - DNA, 22 bp, Artificial Sequence
  chemically synthesized
tccttttaaccatttaggtgaa

SEQ ID NO: 896198 - DNA, 22 bp, Artificial Sequence
  chemically synthesized
atccttttaaccatttaggtga

SEQ ID NO: 896199 - DNA, 22 bp, Artificial Sequence
  chemically synthesized
tatccttttaaccatttaggtg

SEQ ID NO: 896200 - DNA, 22 bp, Artificial Sequence
  chemically synthesized
cacattcacctaaatggttaaa

SEQ ID NO: 896201 - DNA, 22 bp, Artificial Sequence
  chemically synthesized
aacctttatccttttaaccatt

SEQ ID NO: 896202 - DNA, 22 bp, Artificial Sequence
  chemically synthesized
acattcacctaaatggttaaaa

SEQ ID NO: 896203 - DNA, 22 bp, Artificial Sequence
  chemically synthesized
caacctttatccttttaaccat

SEQ ID NO: 896204 - DNA, 22 bp, Artificial Sequence
  chemically synthesized
tcaacctttatccttttaacca

SEQ ID NO: 896205 - DNA, 22 bp, Artificial Sequence
  chemically synthesized
acctaaatggttaaaaggataa

SEQ ID NO: 896206 - DNA, 22 bp, Artificial Sequence
  chemically synthesized
aatggttaaaaggataaaggtt

SEQ ID NO: 896207 - DNA, 22 bp, Artificial Sequence
  chemically synthesized
atcaagagtatgtattttcaac

SEQ ID NO: 896208 - DNA, 22 bp, Artificial Sequence
  chemically synthesized
aaaggataaaggttgaaaatac

SEQ ID NO: 896209 - DNA, 22 bp, Artificial Sequence
  chemically synthesized
atccacatattcatcaagagta

SEQ ID NO: 896210 - DNA, 22 bp, Artificial Sequence
  chemically synthesized
aaaatacatactcttgatgaat

SEQ ID NO: 896211 - DNA, 22 bp, Artificial Sequence
  chemically synthesized
gttgatccacatattcatcaag

SEQ ID NO: 896212 - DNA, 22 bp, Artificial Sequence
  chemically synthesized
tagttgatccacatattcatca

SEQ ID NO: 896213 - DNA, 22 bp, Artificial Sequence
  chemically synthesized
ctagttgatccacatattcatc

SEQ ID NO: 896214 - DNA, 22 bp, Artificial Sequence
  chemically synthesized
ttgatgaatatgtggatcaact

SEQ ID NO: 896215 - DNA, 22 bp, Artificial Sequence
  chemically synthesized
gatgaatatgtggatcaactag

SEQ ID NO: 896216 - DNA, 22 bp, Artificial Sequence
  chemically synthesized
atgaatatgtggatcaactaga

SEQ ID NO: 896217 - DNA, 22 bp, Artificial Sequence
  chemically synthesized
accagcagtatataagacttct

SEQ ID NO: 896218 - DNA, 22 bp, Artificial Sequence
  chemically synthesized
caccagcagtatataagacttc

SEQ ID NO: 896219 - DNA, 22 bp, Artificial Sequence
  chemically synthesized
tcaccagcagtatataagactt

SEQ ID NO: 896220 - DNA, 22 bp, Artificial Sequence
  chemically synthesized
attttcaccagcagtatataag

SEQ ID NO: 896221 - DNA, 22 bp, Artificial Sequence
  chemically synthesized
agttcattttcaccagcagtat

SEQ ID NO: 896222 - DNA, 22 bp, Artificial Sequence
  chemically synthesized
cagttcattttcaccagcagta

SEQ ID NO: 896223 - DNA, 22 bp, Artificial Sequence
  chemically synthesized
gaagtcttatatactgctggtg

SEQ ID NO: 896224 - DNA, 22 bp, Artificial Sequence
  chemically synthesized
atatactgctggtgaaaatgaa

SEQ ID NO: 896225 - DNA, 22 bp, Artificial Sequence
  chemically synthesized
tatactgctggtgaaaatgaac

SEQ ID NO: 896226 - DNA, 22 bp, Artificial Sequence
  chemically synthesized
agtgtggtcatttcagttcatt

SEQ ID NO: 896227 - DNA, 22 bp, Artificial Sequence
  chemically synthesized
cagtgtggtcatttcagttcat

SEQ ID NO: 896228 - DNA, 22 bp, Artificial Sequence
  chemically synthesized
tcagtgtggtcatttcagttca

SEQ ID NO: 896229 - DNA, 22 bp, Artificial Sequence
  chemically synthesized
ttcagtgtggtcatttcagttc

SEQ ID NO: 896230 - DNA, 22 bp, Artificial Sequence
  chemically synthesized
ctggtgaaaatgaactgaaatg

SEQ ID NO: 896231 - DNA, 22 bp, Artificial Sequence
  chemically synthesized
gtgaaaatgaactgaaatgacc

SEQ ID NO: 896232 - DNA, 22 bp, Artificial Sequence
  chemically synthesized
aaatgaccacactgaaaaactg

SEQ ID NO: 896233 - DNA, 22 bp, Artificial Sequence
  chemically synthesized
gaatcaccaaaaaacagttttt

SEQ ID NO: 896234 - DNA, 22 bp, Artificial Sequence
  chemically synthesized
ggaatcaccaaaaaacagtttt

SEQ ID NO: 896235 - DNA, 22 bp, Artificial Sequence
  chemically synthesized
tggaatcaccaaaaaacagttt

SEQ ID NO: 896236 - DNA, 22 bp, Artificial Sequence
  chemically synthesized
gctttggaatcaccaaaaaaca

SEQ ID NO: 896237 - DNA, 22 bp, Artificial Sequence
  chemically synthesized
ggctttggaatcaccaaaaaac

SEQ ID NO: 896238 - DNA, 22 bp, Artificial Sequence
  chemically synthesized
aaaaactgttttttggtgattc

SEQ ID NO: 896239 - DNA, 22 bp, Artificial Sequence
  chemically synthesized
ttttttggtgattccaaagcca

SEQ ID NO: 896240 - DNA, 22 bp, Artificial Sequence
  chemically synthesized
tttggtgattccaaagccaaat

SEQ ID NO: 896241 - DNA, 22 bp, Artificial Sequence
  chemically synthesized
ttggtgattccaaagccaaatg

SEQ ID NO: 896242 - DNA, 22 bp, Artificial Sequence
  chemically synthesized
tggtgattccaaagccaaatgt

SEQ ID NO: 896243 - DNA, 22 bp, Artificial Sequence
  chemically synthesized
ggtgattccaaagccaaatgta

SEQ ID NO: 896244 - DNA, 22 bp, Artificial Sequence
  chemically synthesized
gtgattccaaagccaaatgtac

SEQ ID NO: 896245 - DNA, 22 bp, Artificial Sequence
  chemically synthesized
ggtcataagatgtgtacatttg

SEQ ID NO: 896246 - DNA, 22 bp, Artificial Sequence
  chemically synthesized
caaagccaaatgtacacatctt

SEQ ID NO: 896247 - DNA, 22 bp, Artificial Sequence
  chemically synthesized
atatacgtggaagtacaatggc

SEQ ID NO: 896248 - DNA, 22 bp, Artificial Sequence
  chemically synthesized
aatatacgtggaagtacaatgg

SEQ ID NO: 896249 - DNA, 22 bp, Artificial Sequence
  chemically synthesized
taatatacgtggaagtacaatg

SEQ ID NO: 896250 - DNA, 22 bp, Artificial Sequence
  chemically synthesized
ttaatatacgtggaagtacaat

SEQ ID NO: 896251 - DNA, 22 bp, Artificial Sequence
  chemically synthesized
atgacctagccattgtacttcc

SEQ ID NO: 896252 - DNA, 22 bp, Artificial Sequence
  chemically synthesized
tgacctagccattgtacttcca

SEQ ID NO: 896253 - DNA, 22 bp, Artificial Sequence
  chemically synthesized
tttttaatatacgtggaagtac

SEQ ID NO: 896254 - DNA, 22 bp, Artificial Sequence
  chemically synthesized
atttttaatatacgtggaagta

SEQ ID NO: 896255 - DNA, 22 bp, Artificial Sequence
  chemically synthesized
gccattgtacttccacgtatat

SEQ ID NO: 896256 - DNA, 22 bp, Artificial Sequence
  chemically synthesized
tacttccacgtatattaaaaat

SEQ ID NO: 896257 - DNA, 22 bp, Artificial Sequence
  chemically synthesized
ccacgtatattaaaaataaata

SEQ ID NO: 896258 - DNA, 22 bp, Artificial Sequence
  chemically synthesized
catatatgtatatatttatttt

SEQ ID NO: 896259 - DNA, 22 bp, Artificial Sequence
  chemically synthesized
cacgtatattaaaaataaatat

SEQ ID NO: 896260 - DNA, 22 bp, Artificial Sequence
  chemically synthesized
ctgcatatatgtatatatttat

SEQ ID NO: 896261 - DNA, 22 bp, Artificial Sequence
  chemically synthesized
gctgcatatatgtatatattta

SEQ ID NO: 896262 - DNA, 22 bp, Artificial Sequence
  chemically synthesized
tgctgcatatatgtatatattt

SEQ ID NO: 896263 - DNA, 22 bp, Artificial Sequence
  chemically synthesized
tcctttgctgcatatatgtata

SEQ ID NO: 896264 - DNA, 22 bp, Artificial Sequence
  chemically synthesized
aaaataaatatatacatatatg

SEQ ID NO: 896265 - DNA, 22 bp, Artificial Sequence
  chemically synthesized
ctgtcctttgctgcatatatgt

SEQ ID NO: 896266 - DNA, 22 bp, Artificial Sequence
  chemically synthesized
gtgtgatgttcctgtcctttgc

SEQ ID NO: 896267 - DNA, 22 bp, Artificial Sequence
  chemically synthesized
ggaaaaatgctggtgtgatgtt

SEQ ID NO: 896268 - DNA, 22 bp, Artificial Sequence
  chemically synthesized
ttaggaaaaatgctggtgtgat

SEQ ID NO: 896269 - DNA, 22 bp, Artificial Sequence
  chemically synthesized
tggggctattaggaaaaatgct

SEQ ID NO: 896270 - DNA, 22 bp, Artificial Sequence
  chemically synthesized
ttatggggctattaggaaaaat

SEQ ID NO: 896271 - DNA, 22 bp, Artificial Sequence
  chemically synthesized
tgtctattatggggctattagg

SEQ ID NO: 896272 - DNA, 22 bp, Artificial Sequence
  chemically synthesized
ggctgtgtctattatggggcta

SEQ ID NO: 896273 - DNA, 22 bp, Artificial Sequence
  chemically synthesized
ttcctaatagccccataataga

SEQ ID NO: 896274 - DNA, 22 bp, Artificial Sequence
  chemically synthesized
tcctaatagccccataatagac

SEQ ID NO: 896275 - DNA, 22 bp, Artificial Sequence
  chemically synthesized
cctaatagccccataatagaca

SEQ ID NO: 896276 - DNA, 22 bp, Artificial Sequence
  chemically synthesized
ctaatagccccataatagacac

SEQ ID NO: 896277 - DNA, 22 bp, Artificial Sequence
  chemically synthesized
atagccccataatagacacagc

SEQ ID NO: 896278 - DNA, 22 bp, Artificial Sequence
  chemically synthesized
atcaatggacattgggctgtgt

SEQ ID NO: 896279 - DNA, 22 bp, Artificial Sequence
  chemically synthesized
ctaatcaatggacattgggctg

SEQ ID NO: 896280 - DNA, 22 bp, Artificial Sequence
  chemically synthesized
tgctaatcaatggacattgggc

SEQ ID NO: 896281 - DNA, 22 bp, Artificial Sequence
  chemically synthesized
tccattctgctaatcaatggac

SEQ ID NO: 896282 - DNA, 22 bp, Artificial Sequence
  chemically synthesized
atccattctgctaatcaatgga

SEQ ID NO: 896283 - DNA, 22 bp, Artificial Sequence
  chemically synthesized
attagcagaatggataaactgt

SEQ ID NO: 896284 - DNA, 22 bp, Artificial Sequence
  chemically synthesized
tgtgaatatgccacagtttatc

SEQ ID NO: 896285 - DNA, 22 bp, Artificial Sequence
  chemically synthesized
ttgtgtgaatatgccacagttt

SEQ ID NO: 896286 - DNA, 22 bp, Artificial Sequence
  chemically synthesized
gcagaatggataaactgtggca

SEQ ID NO: 896287 - DNA, 22 bp, Artificial Sequence
  chemically synthesized
tattgtgtgaatatgccacagt

SEQ ID NO: 896288 - DNA, 22 bp, Artificial Sequence
  chemically synthesized
tgtatggtattctattgtgtga

SEQ ID NO: 896289 - DNA, 22 bp, Artificial Sequence
  chemically synthesized
tatgtatggtattctattgtgt

SEQ ID NO: 896290 - DNA, 22 bp, Artificial Sequence
  chemically synthesized
ctatgtatggtattctattgtg

SEQ ID NO: 896291 - DNA, 22 bp, Artificial Sequence
  chemically synthesized
tggcatattcacacaatagaat

SEQ ID NO: 896292 - DNA, 22 bp, Artificial Sequence
  chemically synthesized
tctatgtatggtattctattgt

SEQ ID NO: 896293 - DNA, 22 bp, Artificial Sequence
  chemically synthesized
ttctatgtatggtattctattg

SEQ ID NO: 896294 - DNA, 22 bp, Artificial Sequence
  chemically synthesized
gtttttctatgtatggtattct

SEQ ID NO: 896295 - DNA, 22 bp, Artificial Sequence
  chemically synthesized
agtttttctatgtatggtattc

SEQ ID NO: 896296 - DNA, 22 bp, Artificial Sequence
  chemically synthesized
acacaatagaataccatacata

SEQ ID NO: 896297 - DNA, 22 bp, Artificial Sequence
  chemically synthesized
gtttagtttttctatgtatggt

SEQ ID NO: 896298 - DNA, 22 bp, Artificial Sequence
  chemically synthesized
tgccatagttagtttagttttt

SEQ ID NO: 896299 - DNA, 22 bp, Artificial Sequence
  chemically synthesized
cctgtgccatagttagtttagt

SEQ ID NO: 896300 - DNA, 22 bp, Artificial Sequence
  chemically synthesized
ttgcctgtgccatagttagttt

SEQ ID NO: 896301 - DNA, 22 bp, Artificial Sequence
  chemically synthesized
tgctattgcctgtgccatagtt

SEQ ID NO: 896302 - DNA, 22 bp, Artificial Sequence
  chemically synthesized
tatgctattgcctgtgccatag

SEQ ID NO: 896303 - DNA, 22 bp, Artificial Sequence
  chemically synthesized
ttctatgctattgcctgtgcca

SEQ ID NO: 896304 - DNA, 22 bp, Artificial Sequence
  chemically synthesized
aactaactatggcacaggcaat

SEQ ID NO: 896305 - DNA, 22 bp, Artificial Sequence
  chemically synthesized
actatggcacaggcaatagcat

SEQ ID NO: 896306 - DNA, 22 bp, Artificial Sequence
  chemically synthesized
tgatattattctatgctattgc

SEQ ID NO: 896307 - DNA, 22 bp, Artificial Sequence
  chemically synthesized
gtgatattattctatgctattg

SEQ ID NO: 896308 - DNA, 22 bp, Artificial Sequence
  chemically synthesized
tgtgatattattctatgctatt

SEQ ID NO: 896309 - DNA, 22 bp, Artificial Sequence
  chemically synthesized
ttgtgatattattctatgctat

SEQ ID NO: 896310 - DNA, 22 bp, Artificial Sequence
  chemically synthesized
tggcacaggcaatagcatagaa

SEQ ID NO: 896311 - DNA, 22 bp, Artificial Sequence
  chemically synthesized
tttttgtgatattattctatgc

SEQ ID NO: 896312 - DNA, 22 bp, Artificial Sequence
  chemically synthesized
aacattatttttgtgatattat

SEQ ID NO: 896313 - DNA, 22 bp, Artificial Sequence
  chemically synthesized
ctcaacattatttttgtgatat

SEQ ID NO: 896314 - DNA, 22 bp, Artificial Sequence
  chemically synthesized
acatgtcctgctcaacattatt

SEQ ID NO: 896315 - DNA, 22 bp, Artificial Sequence
  chemically synthesized
gacatgtcctgctcaacattat

SEQ ID NO: 896316 - DNA, 22 bp, Artificial Sequence
  chemically synthesized
tatttgacatgtcctgctcaac

SEQ ID NO: 896317 - DNA, 22 bp, Artificial Sequence
  chemically synthesized
gtatttgacatgtcctgctcaa

SEQ ID NO: 896318 - DNA, 22 bp, Artificial Sequence
  chemically synthesized
agcaggacatgtcaaatacaag

SEQ ID NO: 896319 - DNA, 22 bp, Artificial Sequence
  chemically synthesized
taaacagaatcatccagtatat

SEQ ID NO: 896320 - DNA, 22 bp, Artificial Sequence
  chemically synthesized
ctataaacagaatcatccagta

SEQ ID NO: 896321 - DNA, 22 bp, Artificial Sequence
  chemically synthesized
aaattactataaacagaatcat

SEQ ID NO: 896322 - DNA, 22 bp, Artificial Sequence
  chemically synthesized
gaaattactataaacagaatca

SEQ ID NO: 896323 - DNA, 22 bp, Artificial Sequence
  chemically synthesized
tgaaattactataaacagaatc

SEQ ID NO: 896324 - DNA, 22 bp, Artificial Sequence
  chemically synthesized
actttgaaattactataaacag

SEQ ID NO: 896325 - DNA, 22 bp, Artificial Sequence
  chemically synthesized
gactttgaaattactataaaca

SEQ ID NO: 896326 - DNA, 22 bp, Artificial Sequence
  chemically synthesized
tgactttgaaattactataaac

SEQ ID NO: 896327 - DNA, 22 bp, Artificial Sequence
  chemically synthesized
gatgattctgtttatagtaatt

SEQ ID NO: 896328 - DNA, 22 bp, Artificial Sequence
  chemically synthesized
gttttgactttgaaattactat

SEQ ID NO: 896329 - DNA, 22 bp, Artificial Sequence
  chemically synthesized
gattagttttgactttgaaatt

SEQ ID NO: 896330 - DNA, 22 bp, Artificial Sequence
  chemically synthesized
tgtttatagtaatttcaaagtc

SEQ ID NO: 896331 - DNA, 22 bp, Artificial Sequence
  chemically synthesized
tttatagtaatttcaaagtcaa

SEQ ID NO: 896332 - DNA, 22 bp, Artificial Sequence
  chemically synthesized
atagtaatttcaaagtcaaaac

SEQ ID NO: 896333 - DNA, 22 bp, Artificial Sequence
  chemically synthesized
acacctagattagttttgactt

SEQ ID NO: 896334 - DNA, 22 bp, Artificial Sequence
  chemically synthesized
tagtaatttcaaagtcaaaact

SEQ ID NO: 896335 - DNA, 22 bp, Artificial Sequence
  chemically synthesized
taacacctagattagttttgac

SEQ ID NO: 896336 - DNA, 22 bp, Artificial Sequence
  chemically synthesized
ctaacacctagattagttttga

SEQ ID NO: 896337 - DNA, 22 bp, Artificial Sequence
  chemically synthesized
acttctaacacctagattagtt

SEQ ID NO: 896338 - DNA, 22 bp, Artificial Sequence
  chemically synthesized
gacttctaacacctagattagt

SEQ ID NO: 896339 - DNA, 22 bp, Artificial Sequence
  chemically synthesized
tgacttctaacacctagattag

SEQ ID NO: 896340 - DNA, 22 bp, Artificial Sequence
  chemically synthesized
caaagtcaaaactaatctaggt

SEQ ID NO: 896341 - DNA, 22 bp, Artificial Sequence
  chemically synthesized
ttgacttctaacacctagatta

SEQ ID NO: 896342 - DNA, 22 bp, Artificial Sequence
  chemically synthesized
aaagtcaaaactaatctaggtg

SEQ ID NO: 896343 - DNA, 22 bp, Artificial Sequence
  chemically synthesized
ttttgacttctaacacctagat

SEQ ID NO: 896344 - DNA, 22 bp, Artificial Sequence
  chemically synthesized
atctaggtgttagaagtcaaaa

SEQ ID NO: 896345 - DNA, 22 bp, Artificial Sequence
  chemically synthesized
ccaaagataagcactcttttga

SEQ ID NO: 896346 - DNA, 22 bp, Artificial Sequence
  chemically synthesized
ggtgttagaagtcaaaagagtg

SEQ ID NO: 896347 - DNA, 22 bp, Artificial Sequence
  chemically synthesized
tcccaaagataagcactctttt

SEQ ID NO: 896348 - DNA, 22 bp, Artificial Sequence
  chemically synthesized
gaagtcaaaagagtgcttatct

SEQ ID NO: 896349 - DNA, 22 bp, Artificial Sequence
  chemically synthesized
ccaccaccctctcccaaagata

SEQ ID NO: 896350 - DNA, 22 bp, Artificial Sequence
  chemically synthesized
ccctgccaccaccctctcccaa

SEQ ID NO: 896351 - DNA, 22 bp, Artificial Sequence
  chemically synthesized
tcccctgccaccaccctctccc

SEQ ID NO: 896352 - DNA, 22 bp, Artificial Sequence
  chemically synthesized
atctttgggagagggtggtggc

SEQ ID NO: 896353 - DNA, 22 bp, Artificial Sequence
  chemically synthesized
tctttgggagagggtggtggca

SEQ ID NO: 896354 - DNA, 22 bp, Artificial Sequence
  chemically synthesized
tgagcctctcccctgccaccac

SEQ ID NO: 896355 - DNA, 22 bp, Artificial Sequence
  chemically synthesized
tgggagagggtggtggcagggg

SEQ ID NO: 896356 - DNA, 22 bp, Artificial Sequence
  chemically synthesized
gggagagggtggtggcagggga

SEQ ID NO: 896357 - DNA, 22 bp, Artificial Sequence
  chemically synthesized
ggagagggtggtggcaggggag

SEQ ID NO: 896358 - DNA, 22 bp, Artificial Sequence
  chemically synthesized
ccagttatgagcctctcccctg

SEQ ID NO: 896359 - DNA, 22 bp, Artificial Sequence
  chemically synthesized
cctcccagttatgagcctctcc

SEQ ID NO: 896360 - DNA, 22 bp, Artificial Sequence
  chemically synthesized
atgttccctcccagttatgagc

SEQ ID NO: 896361 - DNA, 22 bp, Artificial Sequence
  chemically synthesized
tcatgttccctcccagttatga

SEQ ID NO: 896362 - DNA, 22 bp, Artificial Sequence
  chemically synthesized
aggagcccctctcatgttccct

SEQ ID NO: 896363 - DNA, 22 bp, Artificial Sequence
  chemically synthesized
ataactgggagggaacatgaga

SEQ ID NO: 896364 - DNA, 22 bp, Artificial Sequence
  chemically synthesized
cctcaggagcccctctcatgtt

SEQ ID NO: 896365 - DNA, 22 bp, Artificial Sequence
  chemically synthesized
ggagggaacatgagaggggctc

SEQ ID NO: 896366 - DNA, 22 bp, Artificial Sequence
  chemically synthesized
gaacattacctcaggagcccct

SEQ ID NO: 896367 - DNA, 22 bp, Artificial Sequence
  chemically synthesized
aagaattagaacattacctcag

SEQ ID NO: 896368 - DNA, 22 bp, Artificial Sequence
  chemically synthesized
ccaccaagttcaagaattagaa

SEQ ID NO: 896369 - DNA, 22 bp, Artificial Sequence
  chemically synthesized
ctgaggtaatgttctaattctt

SEQ ID NO: 896370 - DNA, 22 bp, Artificial Sequence
  chemically synthesized
ctaccaccaagttcaagaatta

SEQ ID NO: 896371 - DNA, 22 bp, Artificial Sequence
  chemically synthesized
aggtaatgttctaattcttgaa

SEQ ID NO: 896372 - DNA, 22 bp, Artificial Sequence
  chemically synthesized
taattcttgaacttggtggtag

SEQ ID NO: 896373 - DNA, 22 bp, Artificial Sequence
  chemically synthesized
attcttgaacttggtggtagta

SEQ ID NO: 896374 - DNA, 22 bp, Artificial Sequence
  chemically synthesized
gtgtatccatgctactaccacc

SEQ ID NO: 896375 - DNA, 22 bp, Artificial Sequence
  chemically synthesized
agtgtatccatgctactaccac

SEQ ID NO: 896376 - DNA, 22 bp, Artificial Sequence
  chemically synthesized
ttgaacttggtggtagtagcat

SEQ ID NO: 896377 - DNA, 22 bp, Artificial Sequence
  chemically synthesized
gaacttggtggtagtagcatgg

SEQ ID NO: 896378 - DNA, 22 bp, Artificial Sequence
  chemically synthesized
aacttggtggtagtagcatgga

SEQ ID NO: 896379 - DNA, 22 bp, Artificial Sequence
  chemically synthesized
aaaaaaacttagtgtatccatg

SEQ ID NO: 896380 - DNA, 22 bp, Artificial Sequence
  chemically synthesized
ggtggtagtagcatggatacac

SEQ ID NO: 896381 - DNA, 22 bp, Artificial Sequence
  chemically synthesized
aaaaaaaacttagtgtatccat

SEQ ID NO: 896382 - DNA, 22 bp, Artificial Sequence
  chemically synthesized
gtggtagtagcatggatacact

SEQ ID NO: 896383 - DNA, 22 bp, Artificial Sequence
  chemically synthesized
taaaaaaaacttagtgtatcca

SEQ ID NO: 896384 - DNA, 22 bp, Artificial Sequence
  chemically synthesized
ttaaaaaaaacttagtgtatcc

SEQ ID NO: 896385 - DNA, 22 bp, Artificial Sequence
  chemically synthesized
agggatttttaaaaaaaactta

SEQ ID NO: 896386 - DNA, 22 bp, Artificial Sequence
  chemically synthesized
agttttttttaaaaatccctga

SEQ ID NO: 896387 - DNA, 22 bp, Artificial Sequence
  chemically synthesized
tttttaaaaatccctgaatttc

SEQ ID NO: 896388 - DNA, 22 bp, Artificial Sequence
  chemically synthesized
ttttaaaaatccctgaatttct

SEQ ID NO: 896389 - DNA, 22 bp, Artificial Sequence
  chemically synthesized
tttaaaaatccctgaatttcta

SEQ ID NO: 896390 - DNA, 22 bp, Artificial Sequence
  chemically synthesized
ttaaaaatccctgaatttctat

SEQ ID NO: 896391 - DNA, 22 bp, Artificial Sequence
  chemically synthesized
taaaaatccctgaatttctatt

SEQ ID NO: 896392 - DNA, 22 bp, Artificial Sequence
  chemically synthesized
aaaaatccctgaatttctattc

SEQ ID NO: 896393 - DNA, 22 bp, Artificial Sequence
  chemically synthesized
aaaatccctgaatttctattct

SEQ ID NO: 896394 - DNA, 22 bp, Artificial Sequence
  chemically synthesized
aatttctattcttatgatttgt

SEQ ID NO: 896395 - DNA, 22 bp, Artificial Sequence
  chemically synthesized
ctattcttatgatttgtgtact

SEQ ID NO: 896396 - DNA, 22 bp, Artificial Sequence
  chemically synthesized
tattcttatgatttgtgtactt

SEQ ID NO: 896397 - DNA, 22 bp, Artificial Sequence
  chemically synthesized
ttcttatgatttgtgtactttt

SEQ ID NO: 896398 - DNA, 22 bp, Artificial Sequence
  chemically synthesized
ttatgatttgtgtacttttcta

SEQ ID NO: 896399 - DNA, 22 bp, Artificial Sequence
  chemically synthesized
atgatttgtgtacttttctatg

SEQ ID NO: 896400 - DNA, 22 bp, Artificial Sequence
  chemically synthesized
tgatttgtgtacttttctatgt

SEQ ID NO: 896401 - DNA, 22 bp, Artificial Sequence
  chemically synthesized
aagtataaagacacatagaaaa

SEQ ID NO: 896402 - DNA, 22 bp, Artificial Sequence
  chemically synthesized
aactgaagtataaagacacata

SEQ ID NO: 896403 - DNA, 22 bp, Artificial Sequence
  chemically synthesized
gtgtacttttctatgtgtcttt

SEQ ID NO: 896404 - DNA, 22 bp, Artificial Sequence
  chemically synthesized
tgtacttttctatgtgtcttta

SEQ ID NO: 896405 - DNA, 22 bp, Artificial Sequence
  chemically synthesized
taaactgaagtataaagacaca

SEQ ID NO: 896406 - DNA, 22 bp, Artificial Sequence
  chemically synthesized
ctaaactgaagtataaagacac

SEQ ID NO: 896407 - DNA, 22 bp, Artificial Sequence
  chemically synthesized
tctaaactgaagtataaagaca

SEQ ID NO: 896408 - DNA, 22 bp, Artificial Sequence
  chemically synthesized
ttctatgtgtctttatacttca

SEQ ID NO: 896409 - DNA, 22 bp, Artificial Sequence
  chemically synthesized
tctatgtgtctttatacttcag

SEQ ID NO: 896410 - DNA, 22 bp, Artificial Sequence
  chemically synthesized
ctatgtgtctttatacttcagt

SEQ ID NO: 896411 - DNA, 22 bp, Artificial Sequence
  chemically synthesized
tatgtgtctttatacttcagtt

SEQ ID NO: 896412 - DNA, 22 bp, Artificial Sequence
  chemically synthesized
tcaaattttctaaactgaagta

SEQ ID NO: 896413 - DNA, 22 bp, Artificial Sequence
  chemically synthesized
atcaaattttctaaactgaagt

SEQ ID NO: 896414 - DNA, 22 bp, Artificial Sequence
  chemically synthesized
tgtgtctttatacttcagttta

SEQ ID NO: 896415 - DNA, 22 bp, Artificial Sequence
  chemically synthesized
tatcaaattttctaaactgaag

SEQ ID NO: 896416 - DNA, 22 bp, Artificial Sequence
  chemically synthesized
tatacttcagtttagaaaattt

SEQ ID NO: 896417 - DNA, 22 bp, Artificial Sequence
  chemically synthesized
atacttcagtttagaaaatttg

SEQ ID NO: 896418 - DNA, 22 bp, Artificial Sequence
  chemically synthesized
aagtagttttatcaaattttct

SEQ ID NO: 896419 - DNA, 22 bp, Artificial Sequence
  chemically synthesized
tacttcagtttagaaaatttga

SEQ ID NO: 896420 - DNA, 22 bp, Artificial Sequence
  chemically synthesized
aaagtagttttatcaaattttc

SEQ ID NO: 896421 - DNA, 22 bp, Artificial Sequence
  chemically synthesized
taaagtagttttatcaaatttt

SEQ ID NO: 896422 - DNA, 22 bp, Artificial Sequence
  chemically synthesized
ttaaagtagttttatcaaattt

SEQ ID NO: 896423 - DNA, 22 bp, Artificial Sequence
  chemically synthesized
cagtttagaaaatttgataaaa

SEQ ID NO: 896424 - DNA, 22 bp, Artificial Sequence
  chemically synthesized
agtttagaaaatttgataaaac

SEQ ID NO: 896425 - DNA, 22 bp, Artificial Sequence
  chemically synthesized
aggcttttaaagtagttttatc

SEQ ID NO: 896426 - DNA, 22 bp, Artificial Sequence
  chemically synthesized
aaggcttttaaagtagttttat

SEQ ID NO: 896427 - DNA, 22 bp, Artificial Sequence
  chemically synthesized
agaaaatttgataaaactactt

SEQ ID NO: 896428 - DNA, 22 bp, Artificial Sequence
  chemically synthesized
gaaaatttgataaaactacttt

SEQ ID NO: 896429 - DNA, 22 bp, Artificial Sequence
  chemically synthesized
gataaaactactttaaaagcct

SEQ ID NO: 896430 - DNA, 22 bp, Artificial Sequence
  chemically synthesized
ataaaactactttaaaagcctt

SEQ ID NO: 896431 - DNA, 22 bp, Artificial Sequence
  chemically synthesized
aagggaatgagtaatcttaagg

SEQ ID NO: 896432 - DNA, 22 bp, Artificial Sequence
  chemically synthesized
ctttaaaagccttaagattact

SEQ ID NO: 896433 - DNA, 22 bp, Artificial Sequence
  chemically synthesized
taaaagccttaagattactcat

SEQ ID NO: 896434 - DNA, 22 bp, Artificial Sequence
  chemically synthesized
gagttgaagggaatgagtaatc

SEQ ID NO: 896435 - DNA, 22 bp, Artificial Sequence
  chemically synthesized
aaaagccttaagattactcatt

SEQ ID NO: 896436 - DNA, 22 bp, Artificial Sequence
  chemically synthesized
ggagttgaagggaatgagtaat

SEQ ID NO: 896437 - DNA, 22 bp, Artificial Sequence
  chemically synthesized
aaagccttaagattactcattc

SEQ ID NO: 896438 - DNA, 22 bp, Artificial Sequence
  chemically synthesized
tggagttgaagggaatgagtaa

SEQ ID NO: 896439 - DNA, 22 bp, Artificial Sequence
  chemically synthesized
aagattactcattcccttcaac

SEQ ID NO: 896440 - DNA, 22 bp, Artificial Sequence
  chemically synthesized
agattactcattcccttcaact

SEQ ID NO: 896441 - DNA, 22 bp, Artificial Sequence
  chemically synthesized
ctcattcccttcaactccaaaa

SEQ ID NO: 896442 - DNA, 22 bp, Artificial Sequence
  chemically synthesized
atagaagtagcattttggagtt

SEQ ID NO: 896443 - DNA, 22 bp, Artificial Sequence
  chemically synthesized
attcccttcaactccaaaatgc

SEQ ID NO: 896444 - DNA, 22 bp, Artificial Sequence
  chemically synthesized
ccttcaactccaaaatgctact

SEQ ID NO: 896445 - DNA, 22 bp, Artificial Sequence
  chemically synthesized
ggaaaattcatagaagtagcat

SEQ ID NO: 896446 - DNA, 22 bp, Artificial Sequence
  chemically synthesized
caactccaaaatgctacttcta

SEQ ID NO: 896447 - DNA, 22 bp, Artificial Sequence
  chemically synthesized
aactccaaaatgctacttctat

SEQ ID NO: 896448 - DNA, 22 bp, Artificial Sequence
  chemically synthesized
ccctaggaaaattcatagaagt

SEQ ID NO: 896449 - DNA, 22 bp, Artificial Sequence
  chemically synthesized
caaaatgctacttctatgaatt

SEQ ID NO: 896450 - DNA, 22 bp, Artificial Sequence
  chemically synthesized
atattcccctaggaaaattcat

SEQ ID NO: 896451 - DNA, 22 bp, Artificial Sequence
  chemically synthesized
tgatattcccctaggaaaattc

SEQ ID NO: 896452 - DNA, 22 bp, Artificial Sequence
  chemically synthesized
tctctgatattcccctaggaaa

SEQ ID NO: 896453 - DNA, 22 bp, Artificial Sequence
  chemically synthesized
cttctatgaattttcctagggg

SEQ ID NO: 896454 - DNA, 22 bp, Artificial Sequence
  chemically synthesized
atctctgatattcccctaggaa

SEQ ID NO: 896455 - DNA, 22 bp, Artificial Sequence
  chemically synthesized
ctatgaattttcctaggggaat

SEQ ID NO: 896456 - DNA, 22 bp, Artificial Sequence
  chemically synthesized
tatgaattttcctaggggaata

SEQ ID NO: 896457 - DNA, 22 bp, Artificial Sequence
  chemically synthesized
tgtttatctctgatattcccct

SEQ ID NO: 896458 - DNA, 22 bp, Artificial Sequence
  chemically synthesized
tgaattttcctaggggaatatc

SEQ ID NO: 896459 - DNA, 22 bp, Artificial Sequence
  chemically synthesized
tgtgtttatctctgatattccc

SEQ ID NO: 896460 - DNA, 22 bp, Artificial Sequence
  chemically synthesized
tcctaggggaatatcagagata

SEQ ID NO: 896461 - DNA, 22 bp, Artificial Sequence
  chemically synthesized
cctaggggaatatcagagataa

SEQ ID NO: 896462 - DNA, 22 bp, Artificial Sequence
  chemically synthesized
ctaggggaatatcagagataaa

SEQ ID NO: 896463 - DNA, 22 bp, Artificial Sequence
  chemically synthesized
ggggaatatcagagataaacac

SEQ ID NO: 896464 - DNA, 22 bp, Artificial Sequence
  chemically synthesized
tcataggtctctgtgtttatct

SEQ ID NO: 896465 - DNA, 22 bp, Artificial Sequence
  chemically synthesized
gtcataggtctctgtgtttatc

SEQ ID NO: 896466 - DNA, 22 bp, Artificial Sequence
  chemically synthesized
ttgtcataggtctctgtgttta

SEQ ID NO: 896467 - DNA, 22 bp, Artificial Sequence
  chemically synthesized
aacattcttgtcataggtctct

SEQ ID NO: 896468 - DNA, 22 bp, Artificial Sequence
  chemically synthesized
gccagagtgacataattgaaca

SEQ ID NO: 896469 - DNA, 22 bp, Artificial Sequence
  chemically synthesized
cgccagagtgacataattgaac

SEQ ID NO: 896470 - DNA, 22 bp, Artificial Sequence
  chemically synthesized
tcgccagagtgacataattgaa

SEQ ID NO: 896471 - DNA, 22 bp, Artificial Sequence
  chemically synthesized
tgacaagaatgttcaattatgt

SEQ ID NO: 896472 - DNA, 22 bp, Artificial Sequence
  chemically synthesized
ttcgccagagtgacataattga

SEQ ID NO: 896473 - DNA, 22 bp, Artificial Sequence
  chemically synthesized
tttcgccagagtgacataattg

SEQ ID NO: 896474 - DNA, 22 bp, Artificial Sequence
  chemically synthesized
actttttcgccagagtgacata

SEQ ID NO: 896475 - DNA, 22 bp, Artificial Sequence
  chemically synthesized
cactttttcgccagagtgacat

SEQ ID NO: 896476 - DNA, 22 bp, Artificial Sequence
  chemically synthesized
gtttcactttttcgccagagtg

SEQ ID NO: 896477 - DNA, 22 bp, Artificial Sequence
  chemically synthesized
cgtttcactttttcgccagagt

SEQ ID NO: 896478 - DNA, 22 bp, Artificial Sequence
  chemically synthesized
aattatgtcactctggcgaaaa

SEQ ID NO: 896479 - DNA, 22 bp, Artificial Sequence
  chemically synthesized
tgtcactctggcgaaaaagtga

SEQ ID NO: 896480 - DNA, 22 bp, Artificial Sequence
  chemically synthesized
gggagatttcgtttcacttttt

SEQ ID NO: 896481 - DNA, 22 bp, Artificial Sequence
  chemically synthesized
ggggagatttcgtttcactttt

SEQ ID NO: 896482 - DNA, 22 bp, Artificial Sequence
  chemically synthesized
tttggggagatttcgtttcact

SEQ ID NO: 896483 - DNA, 22 bp, Artificial Sequence
  chemically synthesized
tatttggggagatttcgtttca

SEQ ID NO: 896484 - DNA, 22 bp, Artificial Sequence
  chemically synthesized
tggcgaaaaagtgaaacgaaat

SEQ ID NO: 896485 - DNA, 22 bp, Artificial Sequence
  chemically synthesized
gcgaaaaagtgaaacgaaatct

SEQ ID NO: 896486 - DNA, 22 bp, Artificial Sequence
  chemically synthesized
ttctatttggggagatttcgtt

SEQ ID NO: 896487 - DNA, 22 bp, Artificial Sequence
  chemically synthesized
attctatttggggagatttcgt

SEQ ID NO: 896488 - DNA, 22 bp, Artificial Sequence
  chemically synthesized
tgtaaaagcagtttattctatt

SEQ ID NO: 896489 - DNA, 22 bp, Artificial Sequence
  chemically synthesized
attatgtaaaagcagtttattc

SEQ ID NO: 896490 - DNA, 22 bp, Artificial Sequence
  chemically synthesized
cattatgtaaaagcagtttatt

SEQ ID NO: 896491 - DNA, 22 bp, Artificial Sequence
  chemically synthesized
cccaaatagaataaactgcttt

SEQ ID NO: 896492 - DNA, 22 bp, Artificial Sequence
  chemically synthesized
atggacgcaacatatttcatta

SEQ ID NO: 896493 - DNA, 22 bp, Artificial Sequence
  chemically synthesized
aatggacgcaacatatttcatt

SEQ ID NO: 896494 - DNA, 22 bp, Artificial Sequence
  chemically synthesized
taatggacgcaacatatttcat

SEQ ID NO: 896495 - DNA, 22 bp, Artificial Sequence
  chemically synthesized
cttttacataatgaaatatgtt

SEQ ID NO: 896496 - DNA, 22 bp, Artificial Sequence
  chemically synthesized
ctttaatggacgcaacatattt

SEQ ID NO: 896497 - DNA, 22 bp, Artificial Sequence
  chemically synthesized
actttaatggacgcaacatatt

SEQ ID NO: 896498 - DNA, 22 bp, Artificial Sequence
  chemically synthesized
ttacataatgaaatatgttgcg

SEQ ID NO: 896499 - DNA, 22 bp, Artificial Sequence
  chemically synthesized
tacataatgaaatatgttgcgt

SEQ ID NO: 896500 - DNA, 22 bp, Artificial Sequence
  chemically synthesized
acataatgaaatatgttgcgtc

SEQ ID NO: 896501 - DNA, 22 bp, Artificial Sequence
  chemically synthesized
cataatgaaatatgttgcgtcc

SEQ ID NO: 896502 - DNA, 22 bp, Artificial Sequence
  chemically synthesized
ataatatttactttaatggacg

SEQ ID NO: 896503 - DNA, 22 bp, Artificial Sequence
  chemically synthesized
cataatatttactttaatggac

SEQ ID NO: 896504 - DNA, 22 bp, Artificial Sequence
  chemically synthesized
tcataatatttactttaatgga

SEQ ID NO: 896505 - DNA, 22 bp, Artificial Sequence
  chemically synthesized
ttcataatatttactttaatgg

SEQ ID NO: 896506 - DNA, 22 bp, Artificial Sequence
  chemically synthesized
cgtccattaaagtaaatattat

SEQ ID NO: 896507 - DNA, 22 bp, Artificial Sequence
  chemically synthesized
agtgtaataggatgtttttcat

SEQ ID NO: 896508 - DNA, 22 bp, Artificial Sequence
  chemically synthesized
aagtaaatattatgaaaaacat

SEQ ID NO: 896509 - DNA, 22 bp, Artificial Sequence
  chemically synthesized
cagtgtaataggatgtttttca

SEQ ID NO: 896510 - DNA, 22 bp, Artificial Sequence
  chemically synthesized
tcagtgtaataggatgtttttc

SEQ ID NO: 896511 - DNA, 22 bp, Artificial Sequence
  chemically synthesized
ttcagtgtaataggatgttttt

SEQ ID NO: 896512 - DNA, 22 bp, Artificial Sequence
  chemically synthesized
atatttttcagtgtaataggat

SEQ ID NO: 896513 - DNA, 22 bp, Artificial Sequence
  chemically synthesized
tgaaaaacatcctattacactg

SEQ ID NO: 896514 - DNA, 22 bp, Artificial Sequence
  chemically synthesized
atatgtcattaatatttttcag

SEQ ID NO: 896515 - DNA, 22 bp, Artificial Sequence
  chemically synthesized
aatatgtcattaatatttttca

SEQ ID NO: 896516 - DNA, 22 bp, Artificial Sequence
  chemically synthesized
taatatgtcattaatatttttc

SEQ ID NO: 896517 - DNA, 22 bp, Artificial Sequence
  chemically synthesized
ttaatatgtcattaatattttt

SEQ ID NO: 896518 - DNA, 22 bp, Artificial Sequence
  chemically synthesized
ttacactgaaaaatattaatga

SEQ ID NO: 896519 - DNA, 22 bp, Artificial Sequence
  chemically synthesized
cactgaaaaatattaatgacat

SEQ ID NO: 896520 - DNA, 22 bp, Artificial Sequence
  chemically synthesized
atatatttttaatatgtcatta

SEQ ID NO: 896521 - DNA, 22 bp, Artificial Sequence
  chemically synthesized
aatatatttttaatatgtcatt

SEQ ID NO: 896522 - DNA, 22 bp, Artificial Sequence
  chemically synthesized
taatatatttttaatatgtcat

SEQ ID NO: 896523 - DNA, 22 bp, Artificial Sequence
  chemically synthesized
ttaatatatttttaatatgtca

SEQ ID NO: 896524 - DNA, 22 bp, Artificial Sequence
  chemically synthesized
aaaaatattaatgacatattaa

SEQ ID NO: 896525 - DNA, 22 bp, Artificial Sequence
  chemically synthesized
tttttaatatatttttaatatg

SEQ ID NO: 896526 - DNA, 22 bp, Artificial Sequence
  chemically synthesized
atttttaatatatttttaatat

SEQ ID NO: 896527 - DNA, 22 bp, Artificial Sequence
  chemically synthesized
atgacatattaaaaatatatta

SEQ ID NO: 896528 - DNA, 22 bp, Artificial Sequence
  chemically synthesized
aaaatatattaaaaataaatta

SEQ ID NO: 896529 - DNA, 22 bp, Artificial Sequence
  chemically synthesized
aaaataaattatggttttgatt

SEQ ID NO: 896530 - DNA, 22 bp, Artificial Sequence
  chemically synthesized
atatgtaaaatatgcatacaaa

SEQ ID NO: 896531 - DNA, 22 bp, Artificial Sequence
  chemically synthesized
tggttttgattttgtatgcata

SEQ ID NO: 896532 - DNA, 22 bp, Artificial Sequence
  chemically synthesized
tgattttgtatgcatattttac

SEQ ID NO: 896533 - DNA, 22 bp, Artificial Sequence
  chemically synthesized
gattttgtatgcatattttaca

SEQ ID NO: 896534 - DNA, 22 bp, Artificial Sequence
  chemically synthesized
attttgtatgcatattttacat

SEQ ID NO: 896535 - DNA, 22 bp, Artificial Sequence
  chemically synthesized
tgtgtcgatactgatatgtaaa

SEQ ID NO: 896536 - DNA, 22 bp, Artificial Sequence
  chemically synthesized
tgtatgcatattttacatatca

SEQ ID NO: 896537 - DNA, 22 bp, Artificial Sequence
  chemically synthesized
gtatgcatattttacatatcag

SEQ ID NO: 896538 - DNA, 22 bp, Artificial Sequence
  chemically synthesized
tatgcatattttacatatcagt

SEQ ID NO: 896539 - DNA, 22 bp, Artificial Sequence
  chemically synthesized
ctgtgtgtcgatactgatatgt

SEQ ID NO: 896540 - DNA, 22 bp, Artificial Sequence
  chemically synthesized
gctgtgtgtcgatactgatatg

SEQ ID NO: 896541 - DNA, 22 bp, Artificial Sequence
  chemically synthesized
tgctgtgtgtcgatactgatat

SEQ ID NO: 896542 - DNA, 22 bp, Artificial Sequence
  chemically synthesized
atgtcctttgctgtgtgtcgat

SEQ ID NO: 896543 - DNA, 22 bp, Artificial Sequence
  chemically synthesized
tacatatcagtatcgacacaca

SEQ ID NO: 896544 - DNA, 22 bp, Artificial Sequence
  chemically synthesized
acatatcagtatcgacacacag

SEQ ID NO: 896545 - DNA, 22 bp, Artificial Sequence
  chemically synthesized
catatcagtatcgacacacagc

SEQ ID NO: 896546 - DNA, 22 bp, Artificial Sequence
  chemically synthesized
ttcatgtcctttgctgtgtgtc

SEQ ID NO: 896547 - DNA, 22 bp, Artificial Sequence
  chemically synthesized
gagaaatatctattcatgtcct

SEQ ID NO: 896548 - DNA, 22 bp, Artificial Sequence
  chemically synthesized
agagaaatatctattcatgtcc

SEQ ID NO: 896549 - DNA, 22 bp, Artificial Sequence
  chemically synthesized
tagagaaatatctattcatgtc

SEQ ID NO: 896550 - DNA, 22 bp, Artificial Sequence
  chemically synthesized
ctttagagaaatatctattcat

SEQ ID NO: 896551 - DNA, 22 bp, Artificial Sequence
  chemically synthesized
gctttagagaaatatctattca

SEQ ID NO: 896552 - DNA, 22 bp, Artificial Sequence
  chemically synthesized
tatgtttgctttagagaaatat

SEQ ID NO: 896553 - DNA, 22 bp, Artificial Sequence
  chemically synthesized
gtatgtttgctttagagaaata

SEQ ID NO: 896554 - DNA, 22 bp, Artificial Sequence
  chemically synthesized
gccatttgtatgtttgctttag

SEQ ID NO: 896555 - DNA, 22 bp, Artificial Sequence
  chemically synthesized
ttagccatttgtatgtttgctt

SEQ ID NO: 896556 - DNA, 22 bp, Artificial Sequence
  chemically synthesized
gttagccatttgtatgtttgct

SEQ ID NO: 896557 - DNA, 22 bp, Artificial Sequence
  chemically synthesized
ctctaaagcaaacatacaaatg

SEQ ID NO: 896558 - DNA, 22 bp, Artificial Sequence
  chemically synthesized
tctaaagcaaacatacaaatgg

SEQ ID NO: 896559 - DNA, 22 bp, Artificial Sequence
  chemically synthesized
atatgcttgttagccatttgta

SEQ ID NO: 896560 - DNA, 22 bp, Artificial Sequence
  chemically synthesized
taaagcaaacatacaaatggct

SEQ ID NO: 896561 - DNA, 22 bp, Artificial Sequence
  chemically synthesized
catatgcttgttagccatttgt

SEQ ID NO: 896562 - DNA, 22 bp, Artificial Sequence
  chemically synthesized
tcatatgcttgttagccatttg

SEQ ID NO: 896563 - DNA, 22 bp, Artificial Sequence
  chemically synthesized
aagcaaacatacaaatggctaa

SEQ ID NO: 896564 - DNA, 22 bp, Artificial Sequence
  chemically synthesized
ttcatatgcttgttagccattt

SEQ ID NO: 896565 - DNA, 22 bp, Artificial Sequence
  chemically synthesized
tttcatatgcttgttagccatt

SEQ ID NO: 896566 - DNA, 22 bp, Artificial Sequence
  chemically synthesized
ttttcatatgcttgttagccat

SEQ ID NO: 896567 - DNA, 22 bp, Artificial Sequence
  chemically synthesized
tttttcatatgcttgttagcca

SEQ ID NO: 896568 - DNA, 22 bp, Artificial Sequence
  chemically synthesized
ttttttcatatgcttgttagcc

SEQ ID NO: 896569 - DNA, 22 bp, Artificial Sequence
  chemically synthesized
tttttttcatatgcttgttagc

SEQ ID NO: 896570 - DNA, 22 bp, Artificial Sequence
  chemically synthesized
ttttttttcatatgcttgttag

SEQ ID NO: 896571 - DNA, 22 bp, Artificial Sequence
  chemically synthesized
atcatttttttttttcatatgc

SEQ ID NO: 896572 - DNA, 22 bp, Artificial Sequence
  chemically synthesized
acaagcatatgaaaaaaaaaaa

SEQ ID NO: 896573 - DNA, 22 bp, Artificial Sequence
  chemically synthesized
gtgaggttgatcattttttttt

SEQ ID NO: 896574 - DNA, 22 bp, Artificial Sequence
  chemically synthesized
attagtgaggttgatcattttt

SEQ ID NO: 896575 - DNA, 22 bp, Artificial Sequence
  chemically synthesized
ctgattagtgaggttgatcatt

SEQ ID NO: 896576 - DNA, 22 bp, Artificial Sequence
  chemically synthesized
cctgctgattagtgaggttgat

SEQ ID NO: 896577 - DNA, 22 bp, Artificial Sequence
  chemically synthesized
ccctgctgattagtgaggttga

SEQ ID NO: 896578 - DNA, 22 bp, Artificial Sequence
  chemically synthesized
catttccctgctgattagtgag

SEQ ID NO: 896579 - DNA, 22 bp, Artificial Sequence
  chemically synthesized
gcatttccctgctgattagtga

SEQ ID NO: 896580 - DNA, 22 bp, Artificial Sequence
  chemically synthesized
atttgcatttccctgctgatta

SEQ ID NO: 896581 - DNA, 22 bp, Artificial Sequence
  chemically synthesized
gatttgcatttccctgctgatt

SEQ ID NO: 896582 - DNA, 22 bp, Artificial Sequence
  chemically synthesized
tgatttgcatttccctgctgat

SEQ ID NO: 896583 - DNA, 22 bp, Artificial Sequence
  chemically synthesized
gctttgatttgcatttccctgc

SEQ ID NO: 896584 - DNA, 22 bp, Artificial Sequence
  chemically synthesized
ggctttgatttgcatttccctg

SEQ ID NO: 896585 - DNA, 22 bp, Artificial Sequence
  chemically synthesized
tggctttgatttgcatttccct

SEQ ID NO: 896586 - DNA, 22 bp, Artificial Sequence
  chemically synthesized
actaatcagcagggaaatgcaa

SEQ ID NO: 896587 - DNA, 22 bp, Artificial Sequence
  chemically synthesized
ttttggctttgatttgcatttc

SEQ ID NO: 896588 - DNA, 22 bp, Artificial Sequence
  chemically synthesized
attttggctttgatttgcattt

SEQ ID NO: 896589 - DNA, 22 bp, Artificial Sequence
  chemically synthesized
atcagcagggaaatgcaaatca

SEQ ID NO: 896590 - DNA, 22 bp, Artificial Sequence
  chemically synthesized
acaggtataagatgatatctta

SEQ ID NO: 896591 - DNA, 22 bp, Artificial Sequence
  chemically synthesized
taacaggtataagatgatatct

SEQ ID NO: 896592 - DNA, 22 bp, Artificial Sequence
  chemically synthesized
ataatagtcattctaacaggta

SEQ ID NO: 896593 - DNA, 22 bp, Artificial Sequence
  chemically synthesized
gataatagtcattctaacaggt

SEQ ID NO: 896594 - DNA, 22 bp, Artificial Sequence
  chemically synthesized
tgataatagtcattctaacagg

SEQ ID NO: 896595 - DNA, 22 bp, Artificial Sequence
  chemically synthesized
ttgataatagtcattctaacag

SEQ ID NO: 896596 - DNA, 22 bp, Artificial Sequence
  chemically synthesized
tttgataatagtcattctaaca

SEQ ID NO: 896597 - DNA, 22 bp, Artificial Sequence
  chemically synthesized
tctttttgataatagtcattct

SEQ ID NO: 896598 - DNA, 22 bp, Artificial Sequence
  chemically synthesized
gtctttttgataatagtcattc

SEQ ID NO: 896599 - DNA, 22 bp, Artificial Sequence
  chemically synthesized
tgtctttttgataatagtcatt

SEQ ID NO: 896600 - DNA, 22 bp, Artificial Sequence
  chemically synthesized
atacctgttagaatgactatta

SEQ ID NO: 896601 - DNA, 22 bp, Artificial Sequence
  chemically synthesized
ttgtctttttgataatagtcat

SEQ ID NO: 896602 - DNA, 22 bp, Artificial Sequence
  chemically synthesized
tacctgttagaatgactattat

SEQ ID NO: 896603 - DNA, 22 bp, Artificial Sequence
  chemically synthesized
ttttgtctttttgataatagtc

SEQ ID NO: 896604 - DNA, 22 bp, Artificial Sequence
  chemically synthesized
cttttgtctttttgataatagt

SEQ ID NO: 896605 - DNA, 22 bp, Artificial Sequence
  chemically synthesized
tcttttgtctttttgataatag

SEQ ID NO: 896606 - DNA, 22 bp, Artificial Sequence
  chemically synthesized
ttcttttgtctttttgataata

SEQ ID NO: 896607 - DNA, 22 bp, Artificial Sequence
  chemically synthesized
ttagaatgactattatcaaaaa

SEQ ID NO: 896608 - DNA, 22 bp, Artificial Sequence
  chemically synthesized
gaatgactattatcaaaaagac

SEQ ID NO: 896609 - DNA, 22 bp, Artificial Sequence
  chemically synthesized
gccaacacttttcttttgtctt

SEQ ID NO: 896610 - DNA, 22 bp, Artificial Sequence
  chemically synthesized
tggccaacacttttcttttgtc

SEQ ID NO: 896611 - DNA, 22 bp, Artificial Sequence
  chemically synthesized
ttatcaaaaagacaaaagaaaa

SEQ ID NO: 896612 - DNA, 22 bp, Artificial Sequence
  chemically synthesized
tcaaaaagacaaaagaaaagtg

SEQ ID NO: 896613 - DNA, 22 bp, Artificial Sequence
  chemically synthesized
cacattctggccaacacttttc

SEQ ID NO: 896614 - DNA, 22 bp, Artificial Sequence
  chemically synthesized
tccacattctggccaacacttt

SEQ ID NO: 896615 - DNA, 22 bp, Artificial Sequence
  chemically synthesized
ctccacattctggccaacactt

SEQ ID NO: 896616 - DNA, 22 bp, Artificial Sequence
  chemically synthesized
tctccacattctggccaacact

SEQ ID NO: 896617 - DNA, 22 bp, Artificial Sequence
  chemically synthesized
ttctccacattctggccaacac

SEQ ID NO: 896618 - DNA, 22 bp, Artificial Sequence
  chemically synthesized
ttttctccacattctggccaac

SEQ ID NO: 896619 - DNA, 22 bp, Artificial Sequence
  chemically synthesized
tcttttctccacattctggcca

SEQ ID NO: 896620 - DNA, 22 bp, Artificial Sequence
  chemically synthesized
tacaagggttctcttttctcca

SEQ ID NO: 896621 - DNA, 22 bp, Artificial Sequence
  chemically synthesized
gccagaatgtggagaaaagaga

SEQ ID NO: 896622 - DNA, 22 bp, Artificial Sequence
  chemically synthesized
ccatcaacattgtacaagggtt

SEQ ID NO: 896623 - DNA, 22 bp, Artificial Sequence
  chemically synthesized
cattcccatcaacattgtacaa

SEQ ID NO: 896624 - DNA, 22 bp, Artificial Sequence
  chemically synthesized
acattcccatcaacattgtaca

SEQ ID NO: 896625 - DNA, 22 bp, Artificial Sequence
  chemically synthesized
atttacattcccatcaacattg

SEQ ID NO: 896626 - DNA, 22 bp, Artificial Sequence
  chemically synthesized
tactaatttacattcccatcaa

SEQ ID NO: 896627 - DNA, 22 bp, Artificial Sequence
  chemically synthesized
gtacaatgttgatgggaatgta

SEQ ID NO: 896628 - DNA, 22 bp, Artificial Sequence
  chemically synthesized
tacaatgttgatgggaatgtaa

SEQ ID NO: 896629 - DNA, 22 bp, Artificial Sequence
  chemically synthesized
cacaataattatactaatttac

SEQ ID NO: 896630 - DNA, 22 bp, Artificial Sequence
  chemically synthesized
ccacaataattatactaattta

SEQ ID NO: 896631 - DNA, 22 bp, Artificial Sequence
  chemically synthesized
tccacaataattatactaattt

SEQ ID NO: 896632 - DNA, 22 bp, Artificial Sequence
  chemically synthesized
atgggaatgtaaattagtataa

SEQ ID NO: 896633 - DNA, 22 bp, Artificial Sequence
  chemically synthesized
ttttccacaataattatactaa

SEQ ID NO: 896634 - DNA, 22 bp, Artificial Sequence
  chemically synthesized
catactgttttccacaataatt

SEQ ID NO: 896635 - DNA, 22 bp, Artificial Sequence
  chemically synthesized
ccatactgttttccacaataat

SEQ ID NO: 896636 - DNA, 22 bp, Artificial Sequence
  chemically synthesized
gtataattattgtggaaaacag

SEQ ID NO: 896637 - DNA, 22 bp, Artificial Sequence
  chemically synthesized
tggatcttccatactgttttcc

SEQ ID NO: 896638 - DNA, 22 bp, Artificial Sequence
  chemically synthesized
gtggatcttccatactgttttc

SEQ ID NO: 896639 - DNA, 22 bp, Artificial Sequence
  chemically synthesized
tgtggatcttccatactgtttt

SEQ ID NO: 896640 - DNA, 22 bp, Artificial Sequence
  chemically synthesized
ttgtggaaaacagtatggaaga

SEQ ID NO: 896641 - DNA, 22 bp, Artificial Sequence
  chemically synthesized
atgttttgtggatcttccatac

SEQ ID NO: 896642 - DNA, 22 bp, Artificial Sequence
  chemically synthesized
aatgttttgtggatcttccata

SEQ ID NO: 896643 - DNA, 22 bp, Artificial Sequence
  chemically synthesized
taatgttttgtggatcttccat

SEQ ID NO: 896644 - DNA, 22 bp, Artificial Sequence
  chemically synthesized
tggaaaacagtatggaagatcc

SEQ ID NO: 896645 - DNA, 22 bp, Artificial Sequence
  chemically synthesized
ttaatgttttgtggatcttcca

SEQ ID NO: 896646 - DNA, 22 bp, Artificial Sequence
  chemically synthesized
tttttaatgttttgtggatctt

SEQ ID NO: 896647 - DNA, 22 bp, Artificial Sequence
  chemically synthesized
tatttttaatgttttgtggatc

SEQ ID NO: 896648 - DNA, 22 bp, Artificial Sequence
  chemically synthesized
aatcatatggtagttctatttt

SEQ ID NO: 896649 - DNA, 22 bp, Artificial Sequence
  chemically synthesized
ctaaatcatatggtagttctat

SEQ ID NO: 896650 - DNA, 22 bp, Artificial Sequence
  chemically synthesized
aaaatagaactaccatatgatt

SEQ ID NO: 896651 - DNA, 22 bp, Artificial Sequence
  chemically synthesized
ccatatgatttagcaatcttat

SEQ ID NO: 896652 - DNA, 22 bp, Artificial Sequence
  chemically synthesized
gatatatgcccagagataagat

SEQ ID NO: 896653 - DNA, 22 bp, Artificial Sequence
  chemically synthesized
ggatatatgcccagagataaga

SEQ ID NO: 896654 - DNA, 22 bp, Artificial Sequence
  chemically synthesized
tggatatatgcccagagataag

SEQ ID NO: 896655 - DNA, 22 bp, Artificial Sequence
  chemically synthesized
ttggatatatgcccagagataa

SEQ ID NO: 896656 - DNA, 22 bp, Artificial Sequence
  chemically synthesized
ttttggatatatgcccagagat

SEQ ID NO: 896657 - DNA, 22 bp, Artificial Sequence
  chemically synthesized
agcaatcttatctctgggcata

SEQ ID NO: 896658 - DNA, 22 bp, Artificial Sequence
  chemically synthesized
gcaatcttatctctgggcatat

SEQ ID NO: 896659 - DNA, 22 bp, Artificial Sequence
  chemically synthesized
agttcttttggatatatgccca

SEQ ID NO: 896660 - DNA, 22 bp, Artificial Sequence
  chemically synthesized
cagttcttttggatatatgccc

SEQ ID NO: 896661 - DNA, 22 bp, Artificial Sequence
  chemically synthesized
atttcagttcttttggatatat

SEQ ID NO: 896662 - DNA, 22 bp, Artificial Sequence
  chemically synthesized
atctctgggcatatatccaaaa

SEQ ID NO: 896663 - DNA, 22 bp, Artificial Sequence
  chemically synthesized
tctctgggcatatatccaaaag

SEQ ID NO: 896664 - DNA, 22 bp, Artificial Sequence
  chemically synthesized
tgggcatatatccaaaagaact

SEQ ID NO: 896665 - DNA, 22 bp, Artificial Sequence
  chemically synthesized
ggcatatatccaaaagaactga

SEQ ID NO: 896666 - DNA, 22 bp, Artificial Sequence
  chemically synthesized
aaaatactgatttcagttcttt

SEQ ID NO: 896667 - DNA, 22 bp, Artificial Sequence
  chemically synthesized
caaaatactgatttcagttctt

SEQ ID NO: 896668 - DNA, 22 bp, Artificial Sequence
  chemically synthesized
ttcaaaatactgatttcagttc

SEQ ID NO: 896669 - DNA, 22 bp, Artificial Sequence
  chemically synthesized
aaatcagtattttgaagagata

SEQ ID NO: 896670 - DNA, 22 bp, Artificial Sequence
  chemically synthesized
tgaagagatatctgccctctca

SEQ ID NO: 896671 - DNA, 22 bp, Artificial Sequence
  chemically synthesized
gaagagatatctgccctctcat

SEQ ID NO: 896672 - DNA, 22 bp, Artificial Sequence
  chemically synthesized
aagagatatctgccctctcatg

SEQ ID NO: 896673 - DNA, 22 bp, Artificial Sequence
  chemically synthesized
caaatagtgccgcagtaaacat

SEQ ID NO: 896674 - DNA, 22 bp, Artificial Sequence
  chemically synthesized
ttgcaaatagtgccgcagtaaa

SEQ ID NO: 896675 - DNA, 22 bp, Artificial Sequence
  chemically synthesized
ccctctcatgtttactgcggca

SEQ ID NO: 896676 - DNA, 22 bp, Artificial Sequence
  chemically synthesized
gctattgcaaatagtgccgcag

SEQ ID NO: 896677 - DNA, 22 bp, Artificial Sequence
  chemically synthesized
ggctattgcaaatagtgccgca

SEQ ID NO: 896678 - DNA, 22 bp, Artificial Sequence
  chemically synthesized
tcatgtttactgcggcactatt

SEQ ID NO: 896679 - DNA, 22 bp, Artificial Sequence
  chemically synthesized
atgtttactgcggcactatttg

SEQ ID NO: 896680 - DNA, 22 bp, Artificial Sequence
  chemically synthesized
catatcttggctattgcaaata

SEQ ID NO: 896681 - DNA, 22 bp, Artificial Sequence
  chemically synthesized
actgcggcactatttgcaatag

SEQ ID NO: 896682 - DNA, 22 bp, Artificial Sequence
  chemically synthesized
ctgcggcactatttgcaatagc

SEQ ID NO: 896683 - DNA, 22 bp, Artificial Sequence
  chemically synthesized
attccatatcttggctattgca

SEQ ID NO: 896684 - DNA, 22 bp, Artificial Sequence
  chemically synthesized
cggcactatttgcaatagccaa

SEQ ID NO: 896685 - DNA, 22 bp, Artificial Sequence
  chemically synthesized
ggttgattccatatcttggcta

SEQ ID NO: 896686 - DNA, 22 bp, Artificial Sequence
  chemically synthesized
aggttgattccatatcttggct

SEQ ID NO: 896687 - DNA, 22 bp, Artificial Sequence
  chemically synthesized
tttgcaatagccaagatatgga

SEQ ID NO: 896688 - DNA, 22 bp, Artificial Sequence
  chemically synthesized
gcaatagccaagatatggaatc

SEQ ID NO: 896689 - DNA, 22 bp, Artificial Sequence
  chemically synthesized
caatagccaagatatggaatca

SEQ ID NO: 896690 - DNA, 22 bp, Artificial Sequence
  chemically synthesized
atggacatttaggttgattcca

SEQ ID NO: 896691 - DNA, 22 bp, Artificial Sequence
  chemically synthesized
ttgatggacatttaggttgatt

SEQ ID NO: 896692 - DNA, 22 bp, Artificial Sequence
  chemically synthesized
attgatggacatttaggttgat

SEQ ID NO: 896693 - DNA, 22 bp, Artificial Sequence
  chemically synthesized
atttattgatggacatttaggt

SEQ ID NO: 896694 - DNA, 22 bp, Artificial Sequence
  chemically synthesized
accgttcatttattgatggaca

SEQ ID NO: 896695 - DNA, 22 bp, Artificial Sequence
  chemically synthesized
aaccgttcatttattgatggac

SEQ ID NO: 896696 - DNA, 22 bp, Artificial Sequence
  chemically synthesized
taaccgttcatttattgatgga

SEQ ID NO: 896697 - DNA, 22 bp, Artificial Sequence
  chemically synthesized
tttaaccgttcatttattgatg

SEQ ID NO: 896698 - DNA, 22 bp, Artificial Sequence
  chemically synthesized
ctttaaccgttcatttattgat

SEQ ID NO: 896699 - DNA, 22 bp, Artificial Sequence
  chemically synthesized
aatgtccatcaataaatgaacg

SEQ ID NO: 896700 - DNA, 22 bp, Artificial Sequence
  chemically synthesized
tataccgcaatttctttaaccg

SEQ ID NO: 896701 - DNA, 22 bp, Artificial Sequence
  chemically synthesized
atataccgcaatttctttaacc

SEQ ID NO: 896702 - DNA, 22 bp, Artificial Sequence
  chemically synthesized
tgtttatataccgcaatttctt

SEQ ID NO: 896703 - DNA, 22 bp, Artificial Sequence
  chemically synthesized
cattgtgtttatataccgcaat

SEQ ID NO: 896704 - DNA, 22 bp, Artificial Sequence
  chemically synthesized
aagaaattgcggtatataaaca

SEQ ID NO: 896705 - DNA, 22 bp, Artificial Sequence
  chemically synthesized
aatagagttccattgtgtttat

SEQ ID NO: 896706 - DNA, 22 bp, Artificial Sequence
  chemically synthesized
cggtatataaacacaatggaac

SEQ ID NO: 896707 - DNA, 22 bp, Artificial Sequence
  chemically synthesized
aggctgaatagagttccattgt

SEQ ID NO: 896708 - DNA, 22 bp, Artificial Sequence
  chemically synthesized
ctaaggctgaatagagttccat

SEQ ID NO: 896709 - DNA, 22 bp, Artificial Sequence
  chemically synthesized
cctaaggctgaatagagttcca

SEQ ID NO: 896710 - DNA, 22 bp, Artificial Sequence
  chemically synthesized
tcctaaggctgaatagagttcc

SEQ ID NO: 896711 - DNA, 22 bp, Artificial Sequence
  chemically synthesized
tttcctaaggctgaatagagtt

SEQ ID NO: 896712 - DNA, 22 bp, Artificial Sequence
  chemically synthesized
ctttcctaaggctgaatagagt

SEQ ID NO: 896713 - DNA, 22 bp, Artificial Sequence
  chemically synthesized
tctttcctaaggctgaatagag

SEQ ID NO: 896714 - DNA, 22 bp, Artificial Sequence
  chemically synthesized
tttctttcctaaggctgaatag

SEQ ID NO: 896715 - DNA, 22 bp, Artificial Sequence
  chemically synthesized
ctttctttcctaaggctgaata

SEQ ID NO: 896716 - DNA, 22 bp, Artificial Sequence
  chemically synthesized
tattcagccttaggaaagaaag

SEQ ID NO: 896717 - DNA, 22 bp, Artificial Sequence
  chemically synthesized
ttcagccttaggaaagaaagaa

SEQ ID NO: 896718 - DNA, 22 bp, Artificial Sequence
  chemically synthesized
caaatgacaggatttctttctt

SEQ ID NO: 896719 - DNA, 22 bp, Artificial Sequence
  chemically synthesized
agccttaggaaagaaagaaatc

SEQ ID NO: 896720 - DNA, 22 bp, Artificial Sequence
  chemically synthesized
ttgcaaatgacaggatttcttt

SEQ ID NO: 896721 - DNA, 22 bp, Artificial Sequence
  chemically synthesized
aggaaagaaagaaatcctgtca

SEQ ID NO: 896722 - DNA, 22 bp, Artificial Sequence
  chemically synthesized
ggaaagaaagaaatcctgtcat

SEQ ID NO: 896723 - DNA, 22 bp, Artificial Sequence
  chemically synthesized
aatccgtgttgttgcaaatgac

SEQ ID NO: 896724 - DNA, 22 bp, Artificial Sequence
  chemically synthesized
cagttcaatccgtgttgttgca

SEQ ID NO: 896725 - DNA, 22 bp, Artificial Sequence
  chemically synthesized
ccagttcaatccgtgttgttgc

SEQ ID NO: 896726 - DNA, 22 bp, Artificial Sequence
  chemically synthesized
tcatttgcaacaacacggattg

SEQ ID NO: 896727 - DNA, 22 bp, Artificial Sequence
  chemically synthesized
gcaacaacacggattgaactgg

SEQ ID NO: 896728 - DNA, 22 bp, Artificial Sequence
  chemically synthesized
acatcatgtcttccagttcaat

SEQ ID NO: 896729 - DNA, 22 bp, Artificial Sequence
  chemically synthesized
caacaacacggattgaactgga

SEQ ID NO: 896730 - DNA, 22 bp, Artificial Sequence
  chemically synthesized
gacatcatgtcttccagttcaa

SEQ ID NO: 896731 - DNA, 22 bp, Artificial Sequence
  chemically synthesized
acttgacatcatgtcttccagt

SEQ ID NO: 896732 - DNA, 22 bp, Artificial Sequence
  chemically synthesized
cacttgacatcatgtcttccag

SEQ ID NO: 896733 - DNA, 22 bp, Artificial Sequence
  chemically synthesized
tttcacttgacatcatgtcttc

SEQ ID NO: 896734 - DNA, 22 bp, Artificial Sequence
  chemically synthesized
atttcacttgacatcatgtctt

SEQ ID NO: 896735 - DNA, 22 bp, Artificial Sequence
  chemically synthesized
gcttatttcacttgacatcatg

SEQ ID NO: 896736 - DNA, 22 bp, Artificial Sequence
  chemically synthesized
aactggaagacatgatgtcaag

SEQ ID NO: 896737 - DNA, 22 bp, Artificial Sequence
  chemically synthesized
cctagcttatttcacttgacat

SEQ ID NO: 896738 - DNA, 22 bp, Artificial Sequence
  chemically synthesized
gcctagcttatttcacttgaca

SEQ ID NO: 896739 - DNA, 22 bp, Artificial Sequence
  chemically synthesized
tgcctagcttatttcacttgac

SEQ ID NO: 896740 - DNA, 22 bp, Artificial Sequence
  chemically synthesized
gaagacatgatgtcaagtgaaa

SEQ ID NO: 896741 - DNA, 22 bp, Artificial Sequence
  chemically synthesized
tttgcctagcttatttcacttg

SEQ ID NO: 896742 - DNA, 22 bp, Artificial Sequence
  chemically synthesized
ctttgcctagcttatttcactt

SEQ ID NO: 896743 - DNA, 22 bp, Artificial Sequence
  chemically synthesized
tctttgcctagcttatttcact

SEQ ID NO: 896744 - DNA, 22 bp, Artificial Sequence
  chemically synthesized
cctttctttgcctagcttattt

SEQ ID NO: 896745 - DNA, 22 bp, Artificial Sequence
  chemically synthesized
gcctttctttgcctagcttatt

SEQ ID NO: 896746 - DNA, 22 bp, Artificial Sequence
  chemically synthesized
ggcaaagaaaggcaaatactgt

SEQ ID NO: 896747 - DNA, 22 bp, Artificial Sequence
  chemically synthesized
acatataagtgaaatcatacag

SEQ ID NO: 896748 - DNA, 22 bp, Artificial Sequence
  chemically synthesized
cacatataagtgaaatcataca

SEQ ID NO: 896749 - DNA, 22 bp, Artificial Sequence
  chemically synthesized
gatttcacatataagtgaaatc

SEQ ID NO: 896750 - DNA, 22 bp, Artificial Sequence
  chemically synthesized
agatttcacatataagtgaaat

SEQ ID NO: 896751 - DNA, 22 bp, Artificial Sequence
  chemically synthesized
tagatttcacatataagtgaaa

SEQ ID NO: 896752 - DNA, 22 bp, Artificial Sequence
  chemically synthesized
ttagatttcacatataagtgaa

SEQ ID NO: 896753 - DNA, 22 bp, Artificial Sequence
  chemically synthesized
tatgatttcacttatatgtgaa

SEQ ID NO: 896754 - DNA, 22 bp, Artificial Sequence
  chemically synthesized
acatttttagatttcacatata

SEQ ID NO: 896755 - DNA, 22 bp, Artificial Sequence
  chemically synthesized
gacatttttagatttcacatat

SEQ ID NO: 896756 - DNA, 22 bp, Artificial Sequence
  chemically synthesized
agtttgacatttttagatttca

SEQ ID NO: 896757 - DNA, 22 bp, Artificial Sequence
  chemically synthesized
cacttatatgtgaaatctaaaa

SEQ ID NO: 896758 - DNA, 22 bp, Artificial Sequence
  chemically synthesized
tgagtttgacatttttagattt

SEQ ID NO: 896759 - DNA, 22 bp, Artificial Sequence
  chemically synthesized
acttatatgtgaaatctaaaaa

SEQ ID NO: 896760 - DNA, 22 bp, Artificial Sequence
  chemically synthesized
tctgagtttgacatttttagat

SEQ ID NO: 896761 - DNA, 22 bp, Artificial Sequence
  chemically synthesized
ctctgagtttgacatttttaga

SEQ ID NO: 896762 - DNA, 22 bp, Artificial Sequence
  chemically synthesized
atatgtgaaatctaaaaatgtc

SEQ ID NO: 896763 - DNA, 22 bp, Artificial Sequence
  chemically synthesized
tatgtgaaatctaaaaatgtca

SEQ ID NO: 896764 - DNA, 22 bp, Artificial Sequence
  chemically synthesized
tttctctgagtttgacattttt

SEQ ID NO: 896765 - DNA, 22 bp, Artificial Sequence
  chemically synthesized
tgtttctctgagtttgacattt

SEQ ID NO: 896766 - DNA, 22 bp, Artificial Sequence
  chemically synthesized
tctgtttctctgagtttgacat

SEQ ID NO: 896767 - DNA, 22 bp, Artificial Sequence
  chemically synthesized
ctctgtttctctgagtttgaca

SEQ ID NO: 896768 - DNA, 22 bp, Artificial Sequence
  chemically synthesized
tctctgtttctctgagtttgac

SEQ ID NO: 896769 - DNA, 22 bp, Artificial Sequence
  chemically synthesized
ttctctgtttctctgagtttga

SEQ ID NO: 896770 - DNA, 22 bp, Artificial Sequence
  chemically synthesized
aaaatgtcaaactcagagaaac

SEQ ID NO: 896771 - DNA, 22 bp, Artificial Sequence
  chemically synthesized
ataaccaccatttttctctgtt

SEQ ID NO: 896772 - DNA, 22 bp, Artificial Sequence
  chemically synthesized
agagaaacagagaaaaatggtg

SEQ ID NO: 896773 - DNA, 22 bp, Artificial Sequence
  chemically synthesized
ccaaatcaccccacccccagga

SEQ ID NO: 896774 - DNA, 22 bp, Artificial Sequence
  chemically synthesized
ttagatcctgggggtggggtga

SEQ ID NO: 896775 - DNA, 22 bp, Artificial Sequence
  chemically synthesized
gatcctgggggtggggtgattt

SEQ ID NO: 896776 - DNA, 22 bp, Artificial Sequence
  chemically synthesized
atcaatatctcccaaatcaccc

SEQ ID NO: 896777 - DNA, 22 bp, Artificial Sequence
  chemically synthesized
catcaatatctcccaaatcacc

SEQ ID NO: 896778 - DNA, 22 bp, Artificial Sequence
  chemically synthesized
tcatcaatatctcccaaatcac

SEQ ID NO: 896779 - DNA, 22 bp, Artificial Sequence
  chemically synthesized
ttcatcaatatctcccaaatca

SEQ ID NO: 896780 - DNA, 22 bp, Artificial Sequence
  chemically synthesized
ggggtggggtgatttgggagat

SEQ ID NO: 896781 - DNA, 22 bp, Artificial Sequence
  chemically synthesized
tgtatcttttcatcaatatctc

SEQ ID NO: 896782 - DNA, 22 bp, Artificial Sequence
  chemically synthesized
aaattgtgtatcttttcatcaa

SEQ ID NO: 896783 - DNA, 22 bp, Artificial Sequence
  chemically synthesized
gggagatattgatgaaaagata

SEQ ID NO: 896784 - DNA, 22 bp, Artificial Sequence
  chemically synthesized
ggagatattgatgaaaagatac

SEQ ID NO: 896785 - DNA, 22 bp, Artificial Sequence
  chemically synthesized
tcaaactgaaattgtgtatctt

SEQ ID NO: 896786 - DNA, 22 bp, Artificial Sequence
  chemically synthesized
ctgtcaaactgaaattgtgtat

SEQ ID NO: 896787 - DNA, 22 bp, Artificial Sequence
  chemically synthesized
ctcctgtcaaactgaaattgtg

SEQ ID NO: 896788 - DNA, 22 bp, Artificial Sequence
  chemically synthesized
atgaaaagatacacaatttcag

SEQ ID NO: 896789 - DNA, 22 bp, Artificial Sequence
  chemically synthesized
ttcctcctgtcaaactgaaatt

SEQ ID NO: 896790 - DNA, 22 bp, Artificial Sequence
  chemically synthesized
attcctcctgtcaaactgaaat

SEQ ID NO: 896791 - DNA, 22 bp, Artificial Sequence
  chemically synthesized
ggatttattcctcctgtcaaac

SEQ ID NO: 896792 - DNA, 22 bp, Artificial Sequence
  chemically synthesized
cagtttgacaggaggaataaat

SEQ ID NO: 896793 - DNA, 22 bp, Artificial Sequence
  chemically synthesized
agtttgacaggaggaataaatc

SEQ ID NO: 896794 - DNA, 22 bp, Artificial Sequence
  chemically synthesized
caacagataactaggatttatt

SEQ ID NO: 896795 - DNA, 22 bp, Artificial Sequence
  chemically synthesized
gacaggaggaataaatcctagt

SEQ ID NO: 896796 - DNA, 22 bp, Artificial Sequence
  chemically synthesized
acaggaggaataaatcctagtt

SEQ ID NO: 896797 - DNA, 22 bp, Artificial Sequence
  chemically synthesized
agttacaacagataactaggat

SEQ ID NO: 896798 - DNA, 22 bp, Artificial Sequence
  chemically synthesized
acagtagtcaccctgagttaca

SEQ ID NO: 896799 - DNA, 22 bp, Artificial Sequence
  chemically synthesized
gttatctgttgtaactcagggt

SEQ ID NO: 896800 - DNA, 22 bp, Artificial Sequence
  chemically synthesized
ctaacagtagtcaccctgagtt

SEQ ID NO: 896801 - DNA, 22 bp, Artificial Sequence
  chemically synthesized
ttactaacagtagtcaccctga

SEQ ID NO: 896802 - DNA, 22 bp, Artificial Sequence
  chemically synthesized
tctgttgtaactcagggtgact

SEQ ID NO: 896803 - DNA, 22 bp, Artificial Sequence
  chemically synthesized
ttgttactaacagtagtcaccc

SEQ ID NO: 896804 - DNA, 22 bp, Artificial Sequence
  chemically synthesized
ttgtaactcagggtgactactg

SEQ ID NO: 896805 - DNA, 22 bp, Artificial Sequence
  chemically synthesized
taactcagggtgactactgtta

SEQ ID NO: 896806 - DNA, 22 bp, Artificial Sequence
  chemically synthesized
agggtgactactgttagtaaca

SEQ ID NO: 896807 - DNA, 22 bp, Artificial Sequence
  chemically synthesized
caagtatacgttattgttacta

SEQ ID NO: 896808 - DNA, 22 bp, Artificial Sequence
  chemically synthesized
ccaagtatacgttattgttact

SEQ ID NO: 896809 - DNA, 22 bp, Artificial Sequence
  chemically synthesized
ctgttagtaacaataacgtata

SEQ ID NO: 896810 - DNA, 22 bp, Artificial Sequence
  chemically synthesized
gtaatttccaagtatacgttat

SEQ ID NO: 896811 - DNA, 22 bp, Artificial Sequence
  chemically synthesized
agtaatttccaagtatacgtta

SEQ ID NO: 896812 - DNA, 22 bp, Artificial Sequence
  chemically synthesized
tagtaatttccaagtatacgtt

SEQ ID NO: 896813 - DNA, 22 bp, Artificial Sequence
  chemically synthesized
ttagtaacaataacgtatactt

SEQ ID NO: 896814 - DNA, 22 bp, Artificial Sequence
  chemically synthesized
ttagtaatttccaagtatacgt

SEQ ID NO: 896815 - DNA, 22 bp, Artificial Sequence
  chemically synthesized
gtaacaataacgtatacttgga

SEQ ID NO: 896816 - DNA, 22 bp, Artificial Sequence
  chemically synthesized
cttttagtaatttccaagtata

SEQ ID NO: 896817 - DNA, 22 bp, Artificial Sequence
  chemically synthesized
aaatctacttttagtaatttcc

SEQ ID NO: 896818 - DNA, 22 bp, Artificial Sequence
  chemically synthesized
aaaatctacttttagtaatttc

SEQ ID NO: 896819 - DNA, 22 bp, Artificial Sequence
  chemically synthesized
ggaaattactaaaagtagattt

SEQ ID NO: 896820 - DNA, 22 bp, Artificial Sequence
  chemically synthesized
gaaattactaaaagtagatttt

SEQ ID NO: 896821 - DNA, 22 bp, Artificial Sequence
  chemically synthesized
tggtaagaacacttaaaatcta

SEQ ID NO: 896822 - DNA, 22 bp, Artificial Sequence
  chemically synthesized
gtggtaagaacacttaaaatct

SEQ ID NO: 896823 - DNA, 22 bp, Artificial Sequence
  chemically synthesized
tgtggtaagaacacttaaaatc

SEQ ID NO: 896824 - DNA, 22 bp, Artificial Sequence
  chemically synthesized
ttgtggtaagaacacttaaaat

SEQ ID NO: 896825 - DNA, 22 bp, Artificial Sequence
  chemically synthesized
tttgtggtaagaacacttaaaa

SEQ ID NO: 896826 - DNA, 22 bp, Artificial Sequence
  chemically synthesized
ctaaaagtagattttaagtgtt

SEQ ID NO: 896827 - DNA, 22 bp, Artificial Sequence
  chemically synthesized
ttttttgtggtaagaacactta

SEQ ID NO: 896828 - DNA, 22 bp, Artificial Sequence
  chemically synthesized
aaagtagattttaagtgttctt

SEQ ID NO: 896829 - DNA, 22 bp, Artificial Sequence
  chemically synthesized
ttattttttgtggtaagaacac

SEQ ID NO: 896830 - DNA, 22 bp, Artificial Sequence
  chemically synthesized
attattttttgtggtaagaaca

SEQ ID NO: 896831 - DNA, 22 bp, Artificial Sequence
  chemically synthesized
catacttattattttttgtggt

SEQ ID NO: 896832 - DNA, 22 bp, Artificial Sequence
  chemically synthesized
taagtgttcttaccacaaaaaa

SEQ ID NO: 896833 - DNA, 22 bp, Artificial Sequence
  chemically synthesized
acatacttattattttttgtgg

SEQ ID NO: 896834 - DNA, 22 bp, Artificial Sequence
  chemically synthesized
aagtgttcttaccacaaaaaat

SEQ ID NO: 896835 - DNA, 22 bp, Artificial Sequence
  chemically synthesized
agtgttcttaccacaaaaaata

SEQ ID NO: 896836 - DNA, 22 bp, Artificial Sequence
  chemically synthesized
ccttacatacttattatttttt

SEQ ID NO: 896837 - DNA, 22 bp, Artificial Sequence
  chemically synthesized
attaccttacatacttattatt

SEQ ID NO: 896838 - DNA, 22 bp, Artificial Sequence
  chemically synthesized
ttaccacaaaaaataataagta

SEQ ID NO: 896839 - DNA, 22 bp, Artificial Sequence
  chemically synthesized
accacaaaaaataataagtatg

SEQ ID NO: 896840 - DNA, 22 bp, Artificial Sequence
  chemically synthesized
ccacaaaaaataataagtatgt

SEQ ID NO: 896841 - DNA, 22 bp, Artificial Sequence
  chemically synthesized
tagaacatattcattaccttac

SEQ ID NO: 896842 - DNA, 22 bp, Artificial Sequence
  chemically synthesized
aatcaagctatagaacatattc

SEQ ID NO: 896843 - DNA, 22 bp, Artificial Sequence
  chemically synthesized
cggaatgactaaatcaagctat

SEQ ID NO: 896844 - DNA, 22 bp, Artificial Sequence
  chemically synthesized
tatagcttgatttagtcattcc

SEQ ID NO: 896845 - DNA, 22 bp, Artificial Sequence
  chemically synthesized
tagcttgatttagtcattccgc

SEQ ID NO: 896846 - DNA, 22 bp, Artificial Sequence
  chemically synthesized
tgaaataaacattgcggaatga

SEQ ID NO: 896847 - DNA, 22 bp, Artificial Sequence
  chemically synthesized
gatttagtcattccgcaatgtt

SEQ ID NO: 896848 - DNA, 22 bp, Artificial Sequence
  chemically synthesized
atttagtcattccgcaatgttt

SEQ ID NO: 896849 - DNA, 22 bp, Artificial Sequence
  chemically synthesized
agtcattccgcaatgtttattt

SEQ ID NO: 896850 - DNA, 22 bp, Artificial Sequence
  chemically synthesized
gtcattccgcaatgtttatttc

SEQ ID NO: 896851 - DNA, 22 bp, Artificial Sequence
  chemically synthesized
tgaaatatcacatattgtgaaa

SEQ ID NO: 896852 - DNA, 22 bp, Artificial Sequence
  chemically synthesized
cgcaatgtttatttcacaatat

SEQ ID NO: 896853 - DNA, 22 bp, Artificial Sequence
  chemically synthesized
atttcacaatatgtgatatttc

SEQ ID NO: 896854 - DNA, 22 bp, Artificial Sequence
  chemically synthesized
tttcacaatatgtgatatttca

SEQ ID NO: 896855 - DNA, 22 bp, Artificial Sequence
  chemically synthesized
cacaatatgtgatatttcacaa

SEQ ID NO: 896856 - DNA, 22 bp, Artificial Sequence
  chemically synthesized
acaatatgtgatatttcacaat

SEQ ID NO: 896857 - DNA, 22 bp, Artificial Sequence
  chemically synthesized
tcatggtgtacaatgtgatatt

SEQ ID NO: 896858 - DNA, 22 bp, Artificial Sequence
  chemically synthesized
ttgtcatggtgtacaatgtgat

SEQ ID NO: 896859 - DNA, 22 bp, Artificial Sequence
  chemically synthesized
tattattgtcatggtgtacaat

SEQ ID NO: 896860 - DNA, 22 bp, Artificial Sequence
  chemically synthesized
cacaatatcacattgtacacca

SEQ ID NO: 896861 - DNA, 22 bp, Artificial Sequence
  chemically synthesized
acaatatcacattgtacaccat

SEQ ID NO: 896862 - DNA, 22 bp, Artificial Sequence
  chemically synthesized
acaaataaaaattgtattattg

SEQ ID NO: 896863 - DNA, 22 bp, Artificial Sequence
  chemically synthesized
tacaccatgacaataatacaat

SEQ ID NO: 896864 - DNA, 22 bp, Artificial Sequence
  chemically synthesized
aaaaattgacaaataaaaattg

SEQ ID NO: 896865 - DNA, 22 bp, Artificial Sequence
  chemically synthesized
taaaaaattgacaaataaaaat

SEQ ID NO: 896866 - DNA, 22 bp, Artificial Sequence
  chemically synthesized
ctaaaaaattgacaaataaaaa

SEQ ID NO: 896867 - DNA, 22 bp, Artificial Sequence
  chemically synthesized
tctaaaaaattgacaaataaaa

SEQ ID NO: 896868 - DNA, 22 bp, Artificial Sequence
  chemically synthesized
aattttctaaaaaattgacaaa

SEQ ID NO: 896869 - DNA, 22 bp, Artificial Sequence
  chemically synthesized
aaattttctaaaaaattgacaa

SEQ ID NO: 896870 - DNA, 22 bp, Artificial Sequence
  chemically synthesized
taaattttctaaaaaattgaca

SEQ ID NO: 896871 - DNA, 22 bp, Artificial Sequence
  chemically synthesized
ttaaattttctaaaaaattgac

SEQ ID NO: 896872 - DNA, 22 bp, Artificial Sequence
  chemically synthesized
ttatttgtcaattttttagaaa

SEQ ID NO: 896873 - DNA, 22 bp, Artificial Sequence
  chemically synthesized
tatttgtcaattttttagaaaa

SEQ ID NO: 896874 - DNA, 22 bp, Artificial Sequence
  chemically synthesized
atttgtcaattttttagaaaat

SEQ ID NO: 896875 - DNA, 22 bp, Artificial Sequence
  chemically synthesized
tttgtcaattttttagaaaatt

SEQ ID NO: 896876 - DNA, 22 bp, Artificial Sequence
  chemically synthesized
tgtgtaaatttttaaattttct

SEQ ID NO: 896877 - DNA, 22 bp, Artificial Sequence
  chemically synthesized
gtcaattttttagaaaatttaa

SEQ ID NO: 896878 - DNA, 22 bp, Artificial Sequence
  chemically synthesized
tcaattttttagaaaatttaaa

SEQ ID NO: 896879 - DNA, 22 bp, Artificial Sequence
  chemically synthesized
tttagaaaatttaaaaatttac

SEQ ID NO: 896880 - DNA, 22 bp, Artificial Sequence
  chemically synthesized
ttagaaaatttaaaaatttaca

SEQ ID NO: 896881 - DNA, 22 bp, Artificial Sequence
  chemically synthesized
tagaaaatttaaaaatttacac

SEQ ID NO: 896882 - DNA, 22 bp, Artificial Sequence
  chemically synthesized
agaaaatttaaaaatttacaca

SEQ ID NO: 896883 - DNA, 22 bp, Artificial Sequence
  chemically synthesized
gaaaatttaaaaatttacacat

SEQ ID NO: 896884 - DNA, 22 bp, Artificial Sequence
  chemically synthesized
acaaatatgaaaatctatgtgt

SEQ ID NO: 896885 - DNA, 22 bp, Artificial Sequence
  chemically synthesized
aaaaatttacacatagattttc

SEQ ID NO: 896886 - DNA, 22 bp, Artificial Sequence
  chemically synthesized
aaaatttacacatagattttca

SEQ ID NO: 896887 - DNA, 22 bp, Artificial Sequence
  chemically synthesized
atcattcacaaatatgaaaatc

SEQ ID NO: 896888 - DNA, 22 bp, Artificial Sequence
  chemically synthesized
taatcattcacaaatatgaaaa

SEQ ID NO: 896889 - DNA, 22 bp, Artificial Sequence
  chemically synthesized
ctaatcattcacaaatatgaaa

SEQ ID NO: 896890 - DNA, 22 bp, Artificial Sequence
  chemically synthesized
acacatagattttcatatttgt

SEQ ID NO: 896891 - DNA, 22 bp, Artificial Sequence
  chemically synthesized
cacatagattttcatatttgtg

SEQ ID NO: 896892 - DNA, 22 bp, Artificial Sequence
  chemically synthesized
tcatatttgtgaatgattagaa

SEQ ID NO: 896893 - DNA, 22 bp, Artificial Sequence
  chemically synthesized
catatttgtgaatgattagaaa

SEQ ID NO: 896894 - DNA, 22 bp, Artificial Sequence
  chemically synthesized
atatttgtgaatgattagaaat

SEQ ID NO: 896895 - DNA, 22 bp, Artificial Sequence
  chemically synthesized
aagtgtgcatgtatttctaatc

SEQ ID NO: 896896 - DNA, 22 bp, Artificial Sequence
  chemically synthesized
ctaaagtgtgcatgtatttcta

SEQ ID NO: 896897 - DNA, 22 bp, Artificial Sequence
  chemically synthesized
gtgaatgattagaaatacatgc

SEQ ID NO: 896898 - DNA, 22 bp, Artificial Sequence
  chemically synthesized
tgaatgattagaaatacatgca

SEQ ID NO: 896899 - DNA, 22 bp, Artificial Sequence
  chemically synthesized
aaggttactaaagtgtgcatgt

SEQ ID NO: 896900 - DNA, 22 bp, Artificial Sequence
  chemically synthesized
caaggttactaaagtgtgcatg

SEQ ID NO: 896901 - DNA, 22 bp, Artificial Sequence
  chemically synthesized
tcaaggttactaaagtgtgcat

SEQ ID NO: 896902 - DNA, 22 bp, Artificial Sequence
  chemically synthesized
ctttcaaggttactaaagtgtg

SEQ ID NO: 896903 - DNA, 22 bp, Artificial Sequence
  chemically synthesized
gaaatacatgcacactttagta

SEQ ID NO: 896904 - DNA, 22 bp, Artificial Sequence
  chemically synthesized
taatactcctttcaaggttact

SEQ ID NO: 896905 - DNA, 22 bp, Artificial Sequence
  chemically synthesized
ataatactcctttcaaggttac

SEQ ID NO: 896906 - DNA, 22 bp, Artificial Sequence
  chemically synthesized
tagtaaccttgaaaggagtatt

SEQ ID NO: 896907 - DNA, 22 bp, Artificial Sequence
  chemically synthesized
agtaaccttgaaaggagtatta

SEQ ID NO: 896908 - DNA, 22 bp, Artificial Sequence
  chemically synthesized
gtaaccttgaaaggagtattat

SEQ ID NO: 896909 - DNA, 22 bp, Artificial Sequence
  chemically synthesized
aaatcatgtataatttataata

SEQ ID NO: 896910 - DNA, 22 bp, Artificial Sequence
  chemically synthesized
gaaaggagtattataaattata

SEQ ID NO: 896911 - DNA, 22 bp, Artificial Sequence
  chemically synthesized
aaaggagtattataaattatac

SEQ ID NO: 896912 - DNA, 22 bp, Artificial Sequence
  chemically synthesized
cattaaaatcatgtataattta

SEQ ID NO: 896913 - DNA, 22 bp, Artificial Sequence
  chemically synthesized
aaaattacattaaaatcatgta

SEQ ID NO: 896914 - DNA, 22 bp, Artificial Sequence
  chemically synthesized
taaattatacatgattttaatg

SEQ ID NO: 896915 - DNA, 22 bp, Artificial Sequence
  chemically synthesized
tacatgattttaatgtaatttt

SEQ ID NO: 896916 - DNA, 22 bp, Artificial Sequence
  chemically synthesized
aaaagggacaaaaatattaaaa

SEQ ID NO: 896917 - DNA, 22 bp, Artificial Sequence
  chemically synthesized
gaaaagggacaaaaatattaaa

SEQ ID NO: 896918 - DNA, 22 bp, Artificial Sequence
  chemically synthesized
tgaaaagggacaaaaatattaa

SEQ ID NO: 896919 - DNA, 22 bp, Artificial Sequence
  chemically synthesized
taatgtaatttttaatattttt

SEQ ID NO: 896920 - DNA, 22 bp, Artificial Sequence
  chemically synthesized
aatgtaatttttaatatttttg

SEQ ID NO: 896921 - DNA, 22 bp, Artificial Sequence
  chemically synthesized
atgtaatttttaatatttttgt

SEQ ID NO: 896922 - DNA, 22 bp, Artificial Sequence
  chemically synthesized
agtggtaactttgaaaagggac

SEQ ID NO: 896923 - DNA, 22 bp, Artificial Sequence
  chemically synthesized
ttaatatttttgtcccttttca

SEQ ID NO: 896924 - DNA, 22 bp, Artificial Sequence
  chemically synthesized
taatatttttgtcccttttcaa

SEQ ID NO: 896925 - DNA, 22 bp, Artificial Sequence
  chemically synthesized
tgagtggtaactttgaaaaggg

SEQ ID NO: 896926 - DNA, 22 bp, Artificial Sequence
  chemically synthesized
aatatttttgtcccttttcaaa

SEQ ID NO: 896927 - DNA, 22 bp, Artificial Sequence
  chemically synthesized
ctgagtggtaactttgaaaagg

SEQ ID NO: 896928 - DNA, 22 bp, Artificial Sequence
  chemically synthesized
atatttttgtcccttttcaaag

SEQ ID NO: 896929 - DNA, 22 bp, Artificial Sequence
  chemically synthesized
tctgagtggtaactttgaaaag

SEQ ID NO: 896930 - DNA, 22 bp, Artificial Sequence
  chemically synthesized
tttctgagtggtaactttgaaa

SEQ ID NO: 896931 - DNA, 22 bp, Artificial Sequence
  chemically synthesized
ttgtcccttttcaaagttacca

SEQ ID NO: 896932 - DNA, 22 bp, Artificial Sequence
  chemically synthesized
tgtcccttttcaaagttaccac

SEQ ID NO: 896933 - DNA, 22 bp, Artificial Sequence
  chemically synthesized
gtcccttttcaaagttaccact

SEQ ID NO: 896934 - DNA, 22 bp, Artificial Sequence
  chemically synthesized
tcccttttcaaagttaccactc

SEQ ID NO: 896935 - DNA, 22 bp, Artificial Sequence
  chemically synthesized
ttcaaagttaccactcagaaag

SEQ ID NO: 896936 - DNA, 22 bp, Artificial Sequence
  chemically synthesized
tcaaagttaccactcagaaaga

SEQ ID NO: 896937 - DNA, 22 bp, Artificial Sequence
  chemically synthesized
caaagttaccactcagaaagaa

SEQ ID NO: 896938 - DNA, 22 bp, Artificial Sequence
  chemically synthesized
aaagttaccactcagaaagaat

SEQ ID NO: 896939 - DNA, 22 bp, Artificial Sequence
  chemically synthesized
acatataaaacatataatattc

SEQ ID NO: 896940 - DNA, 22 bp, Artificial Sequence
  chemically synthesized
ccactcagaaagaatattatat

SEQ ID NO: 896941 - DNA, 22 bp, Artificial Sequence
  chemically synthesized
aacatataaaacatataatatt

SEQ ID NO: 896942 - DNA, 22 bp, Artificial Sequence
  chemically synthesized
tttaacatataaaacatataat

SEQ ID NO: 896943 - DNA, 22 bp, Artificial Sequence
  chemically synthesized
tatttaacatataaaacatata

SEQ ID NO: 896944 - DNA, 22 bp, Artificial Sequence
  chemically synthesized
agaaagaatattatatgtttta

SEQ ID NO: 896945 - DNA, 22 bp, Artificial Sequence
  chemically synthesized
ctatttaacatataaaacatat

SEQ ID NO: 896946 - DNA, 22 bp, Artificial Sequence
  chemically synthesized
tttctatttaacatataaaaca

SEQ ID NO: 896947 - DNA, 22 bp, Artificial Sequence
  chemically synthesized
atttctatttaacatataaaac

SEQ ID NO: 896948 - DNA, 22 bp, Artificial Sequence
  chemically synthesized
tttatttctatttaacatataa

SEQ ID NO: 896949 - DNA, 22 bp, Artificial Sequence
  chemically synthesized
ttatttatttctatttaacata

SEQ ID NO: 896950 - DNA, 22 bp, Artificial Sequence
  chemically synthesized
attatttatttctatttaacat

SEQ ID NO: 896951 - DNA, 22 bp, Artificial Sequence
  chemically synthesized
tatgttttatatgttaaataga

SEQ ID NO: 896952 - DNA, 22 bp, Artificial Sequence
  chemically synthesized
cttattatttatttctatttaa

SEQ ID NO: 896953 - DNA, 22 bp, Artificial Sequence
  chemically synthesized
tatatgttaaatagaaataaat

SEQ ID NO: 896954 - DNA, 22 bp, Artificial Sequence
  chemically synthesized
atatgttaaatagaaataaata

SEQ ID NO: 896955 - DNA, 22 bp, Artificial Sequence
  chemically synthesized
tatgttaaatagaaataaataa

SEQ ID NO: 896956 - DNA, 22 bp, Artificial Sequence
  chemically synthesized
aatagaaataaataataagtag

SEQ ID NO: 896957 - DNA, 22 bp, Artificial Sequence
  chemically synthesized
agaggaatagccaccaaaccag

SEQ ID NO: 896958 - DNA, 22 bp, Artificial Sequence
  chemically synthesized
cagaggaatagccaccaaacca

SEQ ID NO: 896959 - DNA, 22 bp, Artificial Sequence
  chemically synthesized
atatttcagaggaatagccacc

SEQ ID NO: 896960 - DNA, 22 bp, Artificial Sequence
  chemically synthesized
ctaatatttcagaggaatagcc

SEQ ID NO: 896961 - DNA, 22 bp, Artificial Sequence
  chemically synthesized
ttgctaatatttcagaggaata

SEQ ID NO: 896962 - DNA, 22 bp, Artificial Sequence
  chemically synthesized
gtttggtggctattcctctgaa

SEQ ID NO: 896963 - DNA, 22 bp, Artificial Sequence
  chemically synthesized
ttgttgctaatatttcagagga

SEQ ID NO: 896964 - DNA, 22 bp, Artificial Sequence
  chemically synthesized
attgttgctaatatttcagagg

SEQ ID NO: 896965 - DNA, 22 bp, Artificial Sequence
  chemically synthesized
tattgttgctaatatttcagag

SEQ ID NO: 896966 - DNA, 22 bp, Artificial Sequence
  chemically synthesized
ggtggctattcctctgaaatat

SEQ ID NO: 896967 - DNA, 22 bp, Artificial Sequence
  chemically synthesized
gtggctattcctctgaaatatt

SEQ ID NO: 896968 - DNA, 22 bp, Artificial Sequence
  chemically synthesized
ttcctctgaaatattagcaaca

SEQ ID NO: 896969 - DNA, 22 bp, Artificial Sequence
  chemically synthesized
ctctgaaatattagcaacaata

SEQ ID NO: 896970 - DNA, 22 bp, Artificial Sequence
  chemically synthesized
taatagtaattttattgttgct

SEQ ID NO: 896971 - DNA, 22 bp, Artificial Sequence
  chemically synthesized
tgaaatattagcaacaataaaa

SEQ ID NO: 896972 - DNA, 22 bp, Artificial Sequence
  chemically synthesized
aaatattagcaacaataaaatt

SEQ ID NO: 896973 - DNA, 22 bp, Artificial Sequence
  chemically synthesized
agttataatagtaattttattg

SEQ ID NO: 896974 - DNA, 22 bp, Artificial Sequence
  chemically synthesized
gcaacaataaaattactattat

SEQ ID NO: 896975 - DNA, 22 bp, Artificial Sequence
  chemically synthesized
taaacctaagttataatagtaa

SEQ ID NO: 896976 - DNA, 22 bp, Artificial Sequence
  chemically synthesized
aaatatgttgtaaacctaagtt

SEQ ID NO: 896977 - DNA, 22 bp, Artificial Sequence
  chemically synthesized
ctattataacttaggtttacaa

SEQ ID NO: 896978 - DNA, 22 bp, Artificial Sequence
  chemically synthesized
ttataacttaggtttacaacat

SEQ ID NO: 896979 - DNA, 22 bp, Artificial Sequence
  chemically synthesized
taacttaggtttacaacatatt

SEQ ID NO: 896980 - DNA, 22 bp, Artificial Sequence
  chemically synthesized
aggtttacaacatatttcaggt

SEQ ID NO: 896981 - DNA, 22 bp, Artificial Sequence
  chemically synthesized
ggtttacaacatatttcaggta

SEQ ID NO: 896982 - DNA, 22 bp, Artificial Sequence
  chemically synthesized
acaacatatttcaggtacttca

SEQ ID NO: 896983 - DNA, 22 bp, Artificial Sequence
  chemically synthesized
caacatatttcaggtacttcat

SEQ ID NO: 896984 - DNA, 22 bp, Artificial Sequence
  chemically synthesized
caggtacttcatgatggatttt

SEQ ID NO: 896985 - DNA, 22 bp, Artificial Sequence
  chemically synthesized
aggtacttcatgatggatttta

SEQ ID NO: 896986 - DNA, 22 bp, Artificial Sequence
  chemically synthesized
catgatggattttacttatatt

SEQ ID NO: 896987 - DNA, 22 bp, Artificial Sequence
  chemically synthesized
atgatggattttacttatattc

SEQ ID NO: 896988 - DNA, 22 bp, Artificial Sequence
  chemically synthesized
tacttatattcactttcttatt

SEQ ID NO: 896989 - DNA, 22 bp, Artificial Sequence
  chemically synthesized
acttatattcactttcttattc

SEQ ID NO: 896990 - DNA, 22 bp, Artificial Sequence
  chemically synthesized
cttatattcactttcttattct

SEQ ID NO: 896991 - DNA, 22 bp, Artificial Sequence
  chemically synthesized
ataggatcatgggtagaataag

SEQ ID NO: 896992 - DNA, 22 bp, Artificial Sequence
  chemically synthesized
atattcactttcttattctacc

SEQ ID NO: 896993 - DNA, 22 bp, Artificial Sequence
  chemically synthesized
cataggatcatgggtagaataa

SEQ ID NO: 896994 - DNA, 22 bp, Artificial Sequence
  chemically synthesized
tattcactttcttattctaccc

SEQ ID NO: 896995 - DNA, 22 bp, Artificial Sequence
  chemically synthesized
actttcttattctacccatgat

SEQ ID NO: 896996 - DNA, 22 bp, Artificial Sequence
  chemically synthesized
tgtacttcataggatcatgggt

SEQ ID NO: 896997 - DNA, 22 bp, Artificial Sequence
  chemically synthesized
tcttattctacccatgatccta

SEQ ID NO: 896998 - DNA, 22 bp, Artificial Sequence
  chemically synthesized
cttattctacccatgatcctat

SEQ ID NO: 896999 - DNA, 22 bp, Artificial Sequence
  chemically synthesized
ttattctacccatgatcctatg

SEQ ID NO: 897000 - DNA, 22 bp, Artificial Sequence
  chemically synthesized
attctacccatgatcctatgaa

SEQ ID NO: 897001 - DNA, 22 bp, Artificial Sequence
  chemically synthesized
ttctacccatgatcctatgaag

SEQ ID NO: 897002 - DNA, 22 bp, Artificial Sequence
  chemically synthesized
gaaaatgttatgtacttcatag

SEQ ID NO: 897003 - DNA, 22 bp, Artificial Sequence
  chemically synthesized
tacccatgatcctatgaagtac

SEQ ID NO: 897004 - DNA, 22 bp, Artificial Sequence
  chemically synthesized
agaaaatgttatgtacttcata

SEQ ID NO: 897005 - DNA, 22 bp, Artificial Sequence
  chemically synthesized
tagaaaatgttatgtacttcat

SEQ ID NO: 897006 - DNA, 22 bp, Artificial Sequence
  chemically synthesized
cccatgatcctatgaagtacat

SEQ ID NO: 897007 - DNA, 22 bp, Artificial Sequence
  chemically synthesized
ataattttagaaaatgttatgt

SEQ ID NO: 897008 - DNA, 22 bp, Artificial Sequence
  chemically synthesized
gataattttagaaaatgttatg

SEQ ID NO: 897009 - DNA, 22 bp, Artificial Sequence
  chemically synthesized
acttgataattttagaaaatgt

SEQ ID NO: 897010 - DNA, 22 bp, Artificial Sequence
  chemically synthesized
tgaagtacataacattttctaa

SEQ ID NO: 897011 - DNA, 22 bp, Artificial Sequence
  chemically synthesized
atatcctcacttgataatttta

SEQ ID NO: 897012 - DNA, 22 bp, Artificial Sequence
  chemically synthesized
aatatcctcacttgataatttt

SEQ ID NO: 897013 - DNA, 22 bp, Artificial Sequence
  chemically synthesized
atccttaatatcctcacttgat

SEQ ID NO: 897014 - DNA, 22 bp, Artificial Sequence
  chemically synthesized
tctaaaattatcaagtgaggat

SEQ ID NO: 897015 - DNA, 22 bp, Artificial Sequence
  chemically synthesized
ttgatccttaatatcctcactt

SEQ ID NO: 897016 - DNA, 22 bp, Artificial Sequence
  chemically synthesized
ctaaaattatcaagtgaggata

SEQ ID NO: 897017 - DNA, 22 bp, Artificial Sequence
  chemically synthesized
taaaattatcaagtgaggatat

SEQ ID NO: 897018 - DNA, 22 bp, Artificial Sequence
  chemically synthesized
aaattatcaagtgaggatatta

SEQ ID NO: 897019 - DNA, 22 bp, Artificial Sequence
  chemically synthesized
tattgttgatccttaatatcct

SEQ ID NO: 897020 - DNA, 22 bp, Artificial Sequence
  chemically synthesized
atattgttgatccttaatatcc

SEQ ID NO: 897021 - DNA, 22 bp, Artificial Sequence
  chemically synthesized
tttatattgttgatccttaata

SEQ ID NO: 897022 - DNA, 22 bp, Artificial Sequence
  chemically synthesized
tcaagtgaggatattaaggatc

SEQ ID NO: 897023 - DNA, 22 bp, Artificial Sequence
  chemically synthesized
tgaatattatttatattgttga

SEQ ID NO: 897024 - DNA, 22 bp, Artificial Sequence
  chemically synthesized
atgaatattatttatattgttg

SEQ ID NO: 897025 - DNA, 22 bp, Artificial Sequence
  chemically synthesized
aggatcaacaatataaataata

SEQ ID NO: 897026 - DNA, 22 bp, Artificial Sequence
  chemically synthesized
gtaaccttatgaatattattta

SEQ ID NO: 897027 - DNA, 22 bp, Artificial Sequence
  chemically synthesized
ctagtaaccttatgaatattat

SEQ ID NO: 897028 - DNA, 22 bp, Artificial Sequence
  chemically synthesized
actagtaaccttatgaatatta

SEQ ID NO: 897029 - DNA, 22 bp, Artificial Sequence
  chemically synthesized
cttactagtaaccttatgaata

SEQ ID NO: 897030 - DNA, 22 bp, Artificial Sequence
  chemically synthesized
ttacttactagtaaccttatga

SEQ ID NO: 897031 - DNA, 22 bp, Artificial Sequence
  chemically synthesized
gttacttactagtaaccttatg

SEQ ID NO: 897032 - DNA, 22 bp, Artificial Sequence
  chemically synthesized
tgttacttactagtaaccttat

SEQ ID NO: 897033 - DNA, 22 bp, Artificial Sequence
  chemically synthesized
gtgccatctttgttacttacta

SEQ ID NO: 897034 - DNA, 22 bp, Artificial Sequence
  chemically synthesized
agtgccatctttgttacttact

SEQ ID NO: 897035 - DNA, 22 bp, Artificial Sequence
  chemically synthesized
ataaggttactagtaagtaaca

SEQ ID NO: 897036 - DNA, 22 bp, Artificial Sequence
  chemically synthesized
gatatttagtgccatctttgtt

SEQ ID NO: 897037 - DNA, 22 bp, Artificial Sequence
  chemically synthesized
ctagtaagtaacaaagatggca

SEQ ID NO: 897038 - DNA, 22 bp, Artificial Sequence
  chemically synthesized
gtaagtaacaaagatggcacta

SEQ ID NO: 897039 - DNA, 22 bp, Artificial Sequence
  chemically synthesized
aatatccaggttttactgactt

SEQ ID NO: 897040 - DNA, 22 bp, Artificial Sequence
  chemically synthesized
tactgacttcatattctactct

SEQ ID NO: 897041 - DNA, 22 bp, Artificial Sequence
  chemically synthesized
actgacttcatattctactctt

SEQ ID NO: 897042 - DNA, 22 bp, Artificial Sequence
  chemically synthesized
ctgacttcatattctactcttt

SEQ ID NO: 897043 - DNA, 22 bp, Artificial Sequence
  chemically synthesized
acttcatattctactctttcct

SEQ ID NO: 897044 - DNA, 22 bp, Artificial Sequence
  chemically synthesized
ggagggaagagggaaggaaaga

SEQ ID NO: 897045 - DNA, 22 bp, Artificial Sequence
  chemically synthesized
gggagggaagagggaaggaaag

SEQ ID NO: 897046 - DNA, 22 bp, Artificial Sequence
  chemically synthesized
catattctactctttccttccc

SEQ ID NO: 897047 - DNA, 22 bp, Artificial Sequence
  chemically synthesized
tgggagggaagagggaaggaaa

SEQ ID NO: 897048 - DNA, 22 bp, Artificial Sequence
  chemically synthesized
atattctactctttccttccct

SEQ ID NO: 897049 - DNA, 22 bp, Artificial Sequence
  chemically synthesized
tactctttccttccctcttccc

SEQ ID NO: 897050 - DNA, 22 bp, Artificial Sequence
  chemically synthesized
ctctttccttccctcttccctc

SEQ ID NO: 897051 - DNA, 22 bp, Artificial Sequence
  chemically synthesized
tttccttccctcttccctccca

SEQ ID NO: 897052 - DNA, 22 bp, Artificial Sequence
  chemically synthesized
gaaagtatgttttgggagggaa

SEQ ID NO: 897053 - DNA, 22 bp, Artificial Sequence
  chemically synthesized
tccttccctcttccctcccaaa

SEQ ID NO: 897054 - DNA, 22 bp, Artificial Sequence
  chemically synthesized
ccttccctcttccctcccaaaa

SEQ ID NO: 897055 - DNA, 22 bp, Artificial Sequence
  chemically synthesized
cttccctcttccctcccaaaac

SEQ ID NO: 897056 - DNA, 22 bp, Artificial Sequence
  chemically synthesized
ccctcttccctcccaaaacata

SEQ ID NO: 897057 - DNA, 22 bp, Artificial Sequence
  chemically synthesized
cctcttccctcccaaaacatac

SEQ ID NO: 897058 - DNA, 22 bp, Artificial Sequence
  chemically synthesized
aaagatactggaaagtatgttt

SEQ ID NO: 897059 - DNA, 22 bp, Artificial Sequence
  chemically synthesized
gaaagatactggaaagtatgtt

SEQ ID NO: 897060 - DNA, 22 bp, Artificial Sequence
  chemically synthesized
ttccctcccaaaacatactttc

SEQ ID NO: 897061 - DNA, 22 bp, Artificial Sequence
  chemically synthesized
tgaaagatactggaaagtatgt

SEQ ID NO: 897062 - DNA, 22 bp, Artificial Sequence
  chemically synthesized
ccctcccaaaacatactttcca

SEQ ID NO: 897063 - DNA, 22 bp, Artificial Sequence
  chemically synthesized
cctcccaaaacatactttccag

SEQ ID NO: 897064 - DNA, 22 bp, Artificial Sequence
  chemically synthesized
ccaaaacatactttccagtatc

SEQ ID NO: 897065 - DNA, 22 bp, Artificial Sequence
  chemically synthesized
tccagtatctttcaaaattgac

SEQ ID NO: 897066 - DNA, 22 bp, Artificial Sequence
  chemically synthesized
ccagtatctttcaaaattgaca

SEQ ID NO: 897067 - DNA, 22 bp, Artificial Sequence
  chemically synthesized
cagtatctttcaaaattgacat

SEQ ID NO: 897068 - DNA, 22 bp, Artificial Sequence
  chemically synthesized
tcaaaattgacatcatctgggc

SEQ ID NO: 897069 - DNA, 22 bp, Artificial Sequence
  chemically synthesized
caaaattgacatcatctgggcc

SEQ ID NO: 897070 - DNA, 22 bp, Artificial Sequence
  chemically synthesized
aaaattgacatcatctgggccg

SEQ ID NO: 897071 - DNA, 22 bp, Artificial Sequence
  chemically synthesized
acatcatctgggccgggcgcgg

SEQ ID NO: 897072 - DNA, 22 bp, Artificial Sequence
  chemically synthesized
caggcgtgagccaccgcgcccg

SEQ ID NO: 897073 - DNA, 22 bp, Artificial Sequence
  chemically synthesized
ggattacaggcgtgagccaccg

SEQ ID NO: 897074 - DNA, 22 bp, Artificial Sequence
  chemically synthesized
ggccgggcgcggtggctcacgc

SEQ ID NO: 897075 - DNA, 22 bp, Artificial Sequence
  chemically synthesized
cccaaagtgctgggattacagg

SEQ ID NO: 897076 - DNA, 22 bp, Artificial Sequence
  chemically synthesized
ggcctccccaaagtgctgggat

SEQ ID NO: 897077 - DNA, 22 bp, Artificial Sequence
  chemically synthesized
acgcctgtaatcccagcacttt

SEQ ID NO: 897078 - DNA, 22 bp, Artificial Sequence
  chemically synthesized
taatcccagcactttggggagg

SEQ ID NO: 897079 - DNA, 22 bp, Artificial Sequence
  chemically synthesized
tgatccgcccgcctcggcctcc

SEQ ID NO: 897080 - DNA, 22 bp, Artificial Sequence
  chemically synthesized
atgatccgcccgcctcggcctc

SEQ ID NO: 897081 - DNA, 22 bp, Artificial Sequence
  chemically synthesized
accttatgatccgcccgcctcg

SEQ ID NO: 897082 - DNA, 22 bp, Artificial Sequence
  chemically synthesized
tggggaggccgaggcgggcgga

SEQ ID NO: 897083 - DNA, 22 bp, Artificial Sequence
  chemically synthesized
ctgaccttatgatccgcccgcc

SEQ ID NO: 897084 - DNA, 22 bp, Artificial Sequence
  chemically synthesized
ggggaggccgaggcgggcggat

SEQ ID NO: 897085 - DNA, 22 bp, Artificial Sequence
  chemically synthesized
gggaggccgaggcgggcggatc

SEQ ID NO: 897086 - DNA, 22 bp, Artificial Sequence
  chemically synthesized
gatctcctgaccttatgatccg

SEQ ID NO: 897087 - DNA, 22 bp, Artificial Sequence
  chemically synthesized
gccaggatggtctcgatctcct

SEQ ID NO: 897088 - DNA, 22 bp, Artificial Sequence
  chemically synthesized
accgtgttagccaggatggtct

SEQ ID NO: 897089 - DNA, 22 bp, Artificial Sequence
  chemically synthesized
caccgtgttagccaggatggtc

SEQ ID NO: 897090 - DNA, 22 bp, Artificial Sequence
  chemically synthesized
gtagagacggggtttcaccgtg

SEQ ID NO: 897091 - DNA, 22 bp, Artificial Sequence
  chemically synthesized
agtagagacggggtttcaccgt

SEQ ID NO: 897092 - DNA, 22 bp, Artificial Sequence
  chemically synthesized
tagtagagacggggtttcaccg

SEQ ID NO: 897093 - DNA, 22 bp, Artificial Sequence
  chemically synthesized
ttagtagagacggggtttcacc

SEQ ID NO: 897094 - DNA, 22 bp, Artificial Sequence
  chemically synthesized
gctaacacggtgaaaccccgtc

SEQ ID NO: 897095 - DNA, 22 bp, Artificial Sequence
  chemically synthesized
tatttttagtagagacggggtt

SEQ ID NO: 897096 - DNA, 22 bp, Artificial Sequence
  chemically synthesized
gtatttttagtagagacggggt

SEQ ID NO: 897097 - DNA, 22 bp, Artificial Sequence
  chemically synthesized
tgtatttttagtagagacgggg

SEQ ID NO: 897098 - DNA, 22 bp, Artificial Sequence
  chemically synthesized
acacggtgaaaccccgtctcta

SEQ ID NO: 897099 - DNA, 22 bp, Artificial Sequence
  chemically synthesized
ttgtatttttagtagagacggg

SEQ ID NO: 897100 - DNA, 22 bp, Artificial Sequence
  chemically synthesized
tttgtatttttagtagagacgg

SEQ ID NO: 897101 - DNA, 22 bp, Artificial Sequence
  chemically synthesized
attttttgtatttttagtagag

SEQ ID NO: 897102 - DNA, 22 bp, Artificial Sequence
  chemically synthesized
tactaaaaatacaaaaaattag

SEQ ID NO: 897103 - DNA, 22 bp, Artificial Sequence
  chemically synthesized
ctaaaaatacaaaaaattagcc

SEQ ID NO: 897104 - DNA, 22 bp, Artificial Sequence
  chemically synthesized
aaaatacaaaaaattagccggg

SEQ ID NO: 897105 - DNA, 22 bp, Artificial Sequence
  chemically synthesized
caggtgcccaccaccatgcccg

SEQ ID NO: 897106 - DNA, 22 bp, Artificial Sequence
  chemically synthesized
ggactacaggtgcccaccacca

SEQ ID NO: 897107 - DNA, 22 bp, Artificial Sequence
  chemically synthesized
gccgggcatggtggtgggcacc

SEQ ID NO: 897108 - DNA, 22 bp, Artificial Sequence
  chemically synthesized
cagagtagctgggactacaggt

SEQ ID NO: 897109 - DNA, 22 bp, Artificial Sequence
  chemically synthesized
agcctccagagtagctgggact

SEQ ID NO: 897110 - DNA, 22 bp, Artificial Sequence
  chemically synthesized
cctcagcctccagagtagctgg

SEQ ID NO: 897111 - DNA, 22 bp, Artificial Sequence
  chemically synthesized
ctgcctcagcctccagagtagc

SEQ ID NO: 897112 - DNA, 22 bp, Artificial Sequence
  chemically synthesized
tcctgcctcagcctccagagta

SEQ ID NO: 897113 - DNA, 22 bp, Artificial Sequence
  chemically synthesized
tagtcccagctactctggaggc

SEQ ID NO: 897114 - DNA, 22 bp, Artificial Sequence
  chemically synthesized
acaccattctcctgcctcagcc

SEQ ID NO: 897115 - DNA, 22 bp, Artificial Sequence
  chemically synthesized
ctctggaggctgaggcaggaga

SEQ ID NO: 897116 - DNA, 22 bp, Artificial Sequence
  chemically synthesized
agttcacaccattctcctgcct

SEQ ID NO: 897117 - DNA, 22 bp, Artificial Sequence
  chemically synthesized
tggaggctgaggcaggagaatg

SEQ ID NO: 897118 - DNA, 22 bp, Artificial Sequence
  chemically synthesized
ctaagttcacaccattctcctg

SEQ ID NO: 897119 - DNA, 22 bp, Artificial Sequence
  chemically synthesized
gaggctgaggcaggagaatggt

SEQ ID NO: 897120 - DNA, 22 bp, Artificial Sequence
  chemically synthesized
cacctcctaagttcacaccatt

SEQ ID NO: 897121 - DNA, 22 bp, Artificial Sequence
  chemically synthesized
aggcaggagaatggtgtgaact

SEQ ID NO: 897122 - DNA, 22 bp, Artificial Sequence
  chemically synthesized
caaactccacctcctaagttca

SEQ ID NO: 897123 - DNA, 22 bp, Artificial Sequence
  chemically synthesized
actgcaaactccacctcctaag

SEQ ID NO: 897124 - DNA, 22 bp, Artificial Sequence
  chemically synthesized
ggctcactgcaaactccacctc

SEQ ID NO: 897125 - DNA, 22 bp, Artificial Sequence
  chemically synthesized
aggaggtggagtttgcagtgag

SEQ ID NO: 897126 - DNA, 22 bp, Artificial Sequence
  chemically synthesized
ggaggtggagtttgcagtgagc

SEQ ID NO: 897127 - DNA, 22 bp, Artificial Sequence
  chemically synthesized
gcagtgagccgagatcgcgcca

SEQ ID NO: 897128 - DNA, 22 bp, Artificial Sequence
  chemically synthesized
cagtgagccgagatcgcgccac

SEQ ID NO: 897129 - DNA, 22 bp, Artificial Sequence
  chemically synthesized
tcgcccaggcaggagtgcagtg

SEQ ID NO: 897130 - DNA, 22 bp, Artificial Sequence
  chemically synthesized
tgtcgcccaggcaggagtgcag

SEQ ID NO: 897131 - DNA, 22 bp, Artificial Sequence
  chemically synthesized
gctctgtcgcccaggcaggagt

SEQ ID NO: 897132 - DNA, 22 bp, Artificial Sequence
  chemically synthesized
cactcctgcctgggcgacagag

SEQ ID NO: 897133 - DNA, 22 bp, Artificial Sequence
  chemically synthesized
tgagacggagtctcgctctgtc

SEQ ID NO: 897134 - DNA, 22 bp, Artificial Sequence
  chemically synthesized
gtgagacggagtctcgctctgt

SEQ ID NO: 897135 - DNA, 22 bp, Artificial Sequence
  chemically synthesized
ctgcctgggcgacagagcgaga

SEQ ID NO: 897136 - DNA, 22 bp, Artificial Sequence
  chemically synthesized
tgtgagacggagtctcgctctg

SEQ ID NO: 897137 - DNA, 22 bp, Artificial Sequence
  chemically synthesized
ttgtgagacggagtctcgctct

SEQ ID NO: 897138 - DNA, 22 bp, Artificial Sequence
  chemically synthesized
tttgtgagacggagtctcgctc

SEQ ID NO: 897139 - DNA, 22 bp, Artificial Sequence
  chemically synthesized
cctgggcgacagagcgagactc

SEQ ID NO: 897140 - DNA, 22 bp, Artificial Sequence
  chemically synthesized
ttttgtgagacggagtctcgct

SEQ ID NO: 897141 - DNA, 22 bp, Artificial Sequence
  chemically synthesized
tttttgtgagacggagtctcgc

SEQ ID NO: 897142 - DNA, 22 bp, Artificial Sequence
  chemically synthesized
ttttttgtgagacggagtctcg

SEQ ID NO: 897143 - DNA, 22 bp, Artificial Sequence
  chemically synthesized
tttttttgtgagacggagtctc

SEQ ID NO: 897144 - DNA, 22 bp, Artificial Sequence
  chemically synthesized
ggcgacagagcgagactccgtc

SEQ ID NO: 897145 - DNA, 22 bp, Artificial Sequence
  chemically synthesized
ttttttttgtgagacggagtct

SEQ ID NO: 897146 - DNA, 22 bp, Artificial Sequence
  chemically synthesized
tttttttttgtgagacggagtc

SEQ ID NO: 897147 - DNA, 22 bp, Artificial Sequence
  chemically synthesized
ttttttttttgtgagacggagt

SEQ ID NO: 897148 - DNA, 22 bp, Artificial Sequence
  chemically synthesized
tttttttttttgtgagacggag

SEQ ID NO: 897149 - DNA, 22 bp, Artificial Sequence
  chemically synthesized
ttttttttttttgtgagacgga

SEQ ID NO: 897150 - DNA, 22 bp, Artificial Sequence
  chemically synthesized
tttttttttttttgtgagacgg

SEQ ID NO: 897151 - DNA, 22 bp, Artificial Sequence
  chemically synthesized
ttttttttttttttgtgagacg

SEQ ID NO: 897152 - DNA, 22 bp, Artificial Sequence
  chemically synthesized
tttttttttttttttgtgagac

SEQ ID NO: 897153 - DNA, 22 bp, Artificial Sequence
  chemically synthesized
ttttttttttttttttgtgaga

SEQ ID NO: 897154 - DNA, 22 bp, Artificial Sequence
  chemically synthesized
tttttttttttttttttgtgag

SEQ ID NO: 897155 - DNA, 22 bp, Artificial Sequence
  chemically synthesized
ttttttttttttttttttgtga

SEQ ID NO: 897156 - DNA, 22 bp, Artificial Sequence
  chemically synthesized
tttttttttttttttttttgtg

SEQ ID NO: 897157 - DNA, 22 bp, Artificial Sequence
  chemically synthesized
ttttttttttttttttttttgt

SEQ ID NO: 897158 - DNA, 22 bp, Artificial Sequence
  chemically synthesized
tttttttttttttttttttttg

SEQ ID NO: 897159 - DNA, 22 bp, Artificial Sequence
  chemically synthesized
tttttttttttttttttttttt

SEQ ID NO: 897160 - DNA, 22 bp, Artificial Sequence
  chemically synthesized
tttttttttttttttttttttt

SEQ ID NO: 897161 - DNA, 22 bp, Artificial Sequence
  chemically synthesized
tttttttttttttttttttttt

SEQ ID NO: 897162 - DNA, 22 bp, Artificial Sequence
  chemically synthesized
cgtctcacaaaaaaaaaaaaaa

SEQ ID NO: 897163 - DNA, 22 bp, Artificial Sequence
  chemically synthesized
tttttttttttttttttttttt

SEQ ID NO: 897164 - DNA, 22 bp, Artificial Sequence
  chemically synthesized
cttttttttttttttttttttt

SEQ ID NO: 897165 - DNA, 22 bp, Artificial Sequence
  chemically synthesized
tctttttttttttttttttttt

SEQ ID NO: 897166 - DNA, 22 bp, Artificial Sequence
  chemically synthesized
ttcttttttttttttttttttt

SEQ ID NO: 897167 - DNA, 22 bp, Artificial Sequence
  chemically synthesized
tttctttttttttttttttttt

SEQ ID NO: 897168 - DNA, 22 bp, Artificial Sequence
  chemically synthesized
ttttcttttttttttttttttt

SEQ ID NO: 897169 - DNA, 22 bp, Artificial Sequence
  chemically synthesized
acaaaaaaaaaaaaaaaaaaaa

SEQ ID NO: 897170 - DNA, 22 bp, Artificial Sequence
  chemically synthesized
tttttctttttttttttttttt

SEQ ID NO: 897171 - DNA, 22 bp, Artificial Sequence
  chemically synthesized
ttttttcttttttttttttttt

SEQ ID NO: 897172 - DNA, 22 bp, Artificial Sequence
  chemically synthesized
tttttttctttttttttttttt

SEQ ID NO: 897173 - DNA, 22 bp, Artificial Sequence
  chemically synthesized
tcaaatgatgtctttttttttc

SEQ ID NO: 897174 - DNA, 22 bp, Artificial Sequence
  chemically synthesized
atcaaatgatgtcttttttttt

SEQ ID NO: 897175 - DNA, 22 bp, Artificial Sequence
  chemically synthesized
aatagatccatttatcaaatga

SEQ ID NO: 897176 - DNA, 22 bp, Artificial Sequence
  chemically synthesized
aaatagatccatttatcaaatg

SEQ ID NO: 897177 - DNA, 22 bp, Artificial Sequence
  chemically synthesized
aaaagcataagtttaaatagat

SEQ ID NO: 897178 - DNA, 22 bp, Artificial Sequence
  chemically synthesized
gataaatggatctatttaaact

SEQ ID NO: 897179 - DNA, 22 bp, Artificial Sequence
  chemically synthesized
ttgaaaagcataagtttaaata

SEQ ID NO: 897180 - DNA, 22 bp, Artificial Sequence
  chemically synthesized
ataaatggatctatttaaactt

SEQ ID NO: 897181 - DNA, 22 bp, Artificial Sequence
  chemically synthesized
acacaaataactattgaaaagc

SEQ ID NO: 897182 - DNA, 22 bp, Artificial Sequence
  chemically synthesized
tttaaacttatgcttttcaata

SEQ ID NO: 897183 - DNA, 22 bp, Artificial Sequence
  chemically synthesized
aaacttatgcttttcaatagtt

SEQ ID NO: 897184 - DNA, 22 bp, Artificial Sequence
  chemically synthesized
aacttatgcttttcaatagtta

SEQ ID NO: 897185 - DNA, 22 bp, Artificial Sequence
  chemically synthesized
tactcacacaaataactattga

SEQ ID NO: 897186 - DNA, 22 bp, Artificial Sequence
  chemically synthesized
atgcttttcaatagttatttgt

SEQ ID NO: 897187 - DNA, 22 bp, Artificial Sequence
  chemically synthesized
tgcttttcaatagttatttgtg

SEQ ID NO: 897188 - DNA, 22 bp, Artificial Sequence
  chemically synthesized
ttcaatagttatttgtgtgagt

SEQ ID NO: 897189 - DNA, 22 bp, Artificial Sequence
  chemically synthesized
tcaatagttatttgtgtgagta

SEQ ID NO: 897190 - DNA, 22 bp, Artificial Sequence
  chemically synthesized
caatagttatttgtgtgagtac

SEQ ID NO: 897191 - DNA, 22 bp, Artificial Sequence
  chemically synthesized
agggtatagattgtactcacac

SEQ ID NO: 897192 - DNA, 22 bp, Artificial Sequence
  chemically synthesized
aatagttatttgtgtgagtaca

SEQ ID NO: 897193 - DNA, 22 bp, Artificial Sequence
  chemically synthesized
agtattaagggtatagattgta

SEQ ID NO: 897194 - DNA, 22 bp, Artificial Sequence
  chemically synthesized
tttgtgtgagtacaatctatac

SEQ ID NO: 897195 - DNA, 22 bp, Artificial Sequence
  chemically synthesized
gtgtgagtacaatctataccct

SEQ ID NO: 897196 - DNA, 22 bp, Artificial Sequence
  chemically synthesized
tgtgagtacaatctataccctt

SEQ ID NO: 897197 - DNA, 22 bp, Artificial Sequence
  chemically synthesized
atgatactaagtattaagggta

SEQ ID NO: 897198 - DNA, 22 bp, Artificial Sequence
  chemically synthesized
aatgatactaagtattaagggt

SEQ ID NO: 897199 - DNA, 22 bp, Artificial Sequence
  chemically synthesized
taatgatactaagtattaaggg

SEQ ID NO: 897200 - DNA, 22 bp, Artificial Sequence
  chemically synthesized
ctttaatgatactaagtattaa

SEQ ID NO: 897201 - DNA, 22 bp, Artificial Sequence
  chemically synthesized
tacccttaatacttagtatcat

SEQ ID NO: 897202 - DNA, 22 bp, Artificial Sequence
  chemically synthesized
aatgtatattgctttaatgata

SEQ ID NO: 897203 - DNA, 22 bp, Artificial Sequence
  chemically synthesized
tcaatgtatattgctttaatga

SEQ ID NO: 897204 - DNA, 22 bp, Artificial Sequence
  chemically synthesized
aatacttagtatcattaaagca

SEQ ID NO: 897205 - DNA, 22 bp, Artificial Sequence
  chemically synthesized
ctcaatgtatattgctttaatg

SEQ ID NO: 897206 - DNA, 22 bp, Artificial Sequence
  chemically synthesized
atacttagtatcattaaagcaa

SEQ ID NO: 897207 - DNA, 22 bp, Artificial Sequence
  chemically synthesized
acttctcaatgtatattgcttt

SEQ ID NO: 897208 - DNA, 22 bp, Artificial Sequence
  chemically synthesized
agtatcattaaagcaatataca

SEQ ID NO: 897209 - DNA, 22 bp, Artificial Sequence
  chemically synthesized
gtatcattaaagcaatatacat

SEQ ID NO: 897210 - DNA, 22 bp, Artificial Sequence
  chemically synthesized
aagttgacttctcaatgtatat

SEQ ID NO: 897211 - DNA, 22 bp, Artificial Sequence
  chemically synthesized
ttgaagttgacttctcaatgta

SEQ ID NO: 897212 - DNA, 22 bp, Artificial Sequence
  chemically synthesized
attgaagttgacttctcaatgt

SEQ ID NO: 897213 - DNA, 22 bp, Artificial Sequence
  chemically synthesized
ttattgaagttgacttctcaat

SEQ ID NO: 897214 - DNA, 22 bp, Artificial Sequence
  chemically synthesized
aagcaatatacattgagaagtc

SEQ ID NO: 897215 - DNA, 22 bp, Artificial Sequence
  chemically synthesized
cttattgaagttgacttctcaa

SEQ ID NO: 897216 - DNA, 22 bp, Artificial Sequence
  chemically synthesized
tttcttattgaagttgacttct

SEQ ID NO: 897217 - DNA, 22 bp, Artificial Sequence
  chemically synthesized
tattatttcttattgaagttga

SEQ ID NO: 897218 - DNA, 22 bp, Artificial Sequence
  chemically synthesized
atattatttcttattgaagttg

SEQ ID NO: 897219 - DNA, 22 bp, Artificial Sequence
  chemically synthesized
atttatattatttcttattgaa

SEQ ID NO: 897220 - DNA, 22 bp, Artificial Sequence
  chemically synthesized
catttatattatttcttattga

SEQ ID NO: 897221 - DNA, 22 bp, Artificial Sequence
  chemically synthesized
agaagtcaacttcaataagaaa

SEQ ID NO: 897222 - DNA, 22 bp, Artificial Sequence
  chemically synthesized
catgcatttcatttatattatt

SEQ ID NO: 897223 - DNA, 22 bp, Artificial Sequence
  chemically synthesized
gcatgcatttcatttatattat

SEQ ID NO: 897224 - DNA, 22 bp, Artificial Sequence
  chemically synthesized
caataagaaataatataaatga

SEQ ID NO: 897225 - DNA, 22 bp, Artificial Sequence
  chemically synthesized
cttgcatgcatttcatttatat

SEQ ID NO: 897226 - DNA, 22 bp, Artificial Sequence
  chemically synthesized
aataagaaataatataaatgaa

SEQ ID NO: 897227 - DNA, 22 bp, Artificial Sequence
  chemically synthesized
acttgcatgcatttcatttata

SEQ ID NO: 897228 - DNA, 22 bp, Artificial Sequence
  chemically synthesized
aaaatatgtttacttgcatgca

SEQ ID NO: 897229 - DNA, 22 bp, Artificial Sequence
  chemically synthesized
caaaatatgtttacttgcatgc

SEQ ID NO: 897230 - DNA, 22 bp, Artificial Sequence
  chemically synthesized
tcaaaatatgtttacttgcatg

SEQ ID NO: 897231 - DNA, 22 bp, Artificial Sequence
  chemically synthesized
attttcaaaatatgtttacttg

SEQ ID NO: 897232 - DNA, 22 bp, Artificial Sequence
  chemically synthesized
atattcattttcaaaatatgtt

SEQ ID NO: 897233 - DNA, 22 bp, Artificial Sequence
  chemically synthesized
atattaatattcattttcaaaa

SEQ ID NO: 897234 - DNA, 22 bp, Artificial Sequence
  chemically synthesized
aaaatattcatattaatattca

SEQ ID NO: 897235 - DNA, 22 bp, Artificial Sequence
  chemically synthesized
caaaatattcatattaatattc

SEQ ID NO: 897236 - DNA, 22 bp, Artificial Sequence
  chemically synthesized
tcaaaatattcatattaatatt

SEQ ID NO: 897237 - DNA, 22 bp, Artificial Sequence
  chemically synthesized
tgaaaatgaatattaatatgaa

SEQ ID NO: 897238 - DNA, 22 bp, Artificial Sequence
  chemically synthesized
attttcaaaatattcatattaa

SEQ ID NO: 897239 - DNA, 22 bp, Artificial Sequence
  chemically synthesized
gaaaatgaatattaatatgaat

SEQ ID NO: 897240 - DNA, 22 bp, Artificial Sequence
  chemically synthesized
aattttcaaaatattcatatta

SEQ ID NO: 897241 - DNA, 22 bp, Artificial Sequence
  chemically synthesized
aaaatgaatattaatatgaata

SEQ ID NO: 897242 - DNA, 22 bp, Artificial Sequence
  chemically synthesized
taattttcaaaatattcatatt

SEQ ID NO: 897243 - DNA, 22 bp, Artificial Sequence
  chemically synthesized
atatgaatattttgaaaattaa

SEQ ID NO: 897244 - DNA, 22 bp, Artificial Sequence
  chemically synthesized
acaaatggcaaacagtaatgtt

SEQ ID NO: 897245 - DNA, 22 bp, Artificial Sequence
  chemically synthesized
tgaaaattaaaacattactgtt

SEQ ID NO: 897246 - DNA, 22 bp, Artificial Sequence
  chemically synthesized
gaaaattaaaacattactgttt

SEQ ID NO: 897247 - DNA, 22 bp, Artificial Sequence
  chemically synthesized
aaaattaaaacattactgtttg

SEQ ID NO: 897248 - DNA, 22 bp, Artificial Sequence
  chemically synthesized
aaacattactgtttgccatttg

SEQ ID NO: 897249 - DNA, 22 bp, Artificial Sequence
  chemically synthesized
gtccccataaaattaacaaatg

SEQ ID NO: 897250 - DNA, 22 bp, Artificial Sequence
  chemically synthesized
tagtccccataaaattaacaaa

SEQ ID NO: 897251 - DNA, 22 bp, Artificial Sequence
  chemically synthesized
ctagtccccataaaattaacaa

SEQ ID NO: 897252 - DNA, 22 bp, Artificial Sequence
  chemically synthesized
ctgtttgccatttgttaatttt

SEQ ID NO: 897253 - DNA, 22 bp, Artificial Sequence
  chemically synthesized
ttctagtccccataaaattaac

SEQ ID NO: 897254 - DNA, 22 bp, Artificial Sequence
  chemically synthesized
tttgccatttgttaattttatg

SEQ ID NO: 897255 - DNA, 22 bp, Artificial Sequence
  chemically synthesized
ttcttctagtccccataaaatt

SEQ ID NO: 897256 - DNA, 22 bp, Artificial Sequence
  chemically synthesized
gccatttgttaattttatgggg

SEQ ID NO: 897257 - DNA, 22 bp, Artificial Sequence
  chemically synthesized
ccatttgttaattttatgggga

SEQ ID NO: 897258 - DNA, 22 bp, Artificial Sequence
  chemically synthesized
actgttcttctagtccccataa

SEQ ID NO: 897259 - DNA, 22 bp, Artificial Sequence
  chemically synthesized
taactgttcttctagtccccat

SEQ ID NO: 897260 - DNA, 22 bp, Artificial Sequence
  chemically synthesized
gttaattttatggggactagaa

SEQ ID NO: 897261 - DNA, 22 bp, Artificial Sequence
  chemically synthesized
ttaattttatggggactagaag

SEQ ID NO: 897262 - DNA, 22 bp, Artificial Sequence
  chemically synthesized
attttatggggactagaagaac

SEQ ID NO: 897263 - DNA, 22 bp, Artificial Sequence
  chemically synthesized
ataagcattctaactgttcttc

SEQ ID NO: 897264 - DNA, 22 bp, Artificial Sequence
  chemically synthesized
tatggggactagaagaacagtt

SEQ ID NO: 897265 - DNA, 22 bp, Artificial Sequence
  chemically synthesized
gataagcattctaactgttctt

SEQ ID NO: 897266 - DNA, 22 bp, Artificial Sequence
  chemically synthesized
atggggactagaagaacagtta

SEQ ID NO: 897267 - DNA, 22 bp, Artificial Sequence
  chemically synthesized
tggggactagaagaacagttag

SEQ ID NO: 897268 - DNA, 22 bp, Artificial Sequence
  chemically synthesized
gaagaacagttagaatgcttat

SEQ ID NO: 897269 - DNA, 22 bp, Artificial Sequence
  chemically synthesized
atcataatccaaaaatgcattt

SEQ ID NO: 897270 - DNA, 22 bp, Artificial Sequence
  chemically synthesized
gaatgcttatcaaatgcatttt

SEQ ID NO: 897271 - DNA, 22 bp, Artificial Sequence
  chemically synthesized
gattaatcataatccaaaaatg

SEQ ID NO: 897272 - DNA, 22 bp, Artificial Sequence
  chemically synthesized
ggattaatcataatccaaaaat

SEQ ID NO: 897273 - DNA, 22 bp, Artificial Sequence
  chemically synthesized
tggattaatcataatccaaaaa

SEQ ID NO: 897274 - DNA, 22 bp, Artificial Sequence
  chemically synthesized
atcaaatgcatttttggattat

SEQ ID NO: 897275 - DNA, 22 bp, Artificial Sequence
  chemically synthesized
tcaaatgcatttttggattatg

SEQ ID NO: 897276 - DNA, 22 bp, Artificial Sequence
  chemically synthesized
aacatgattttggattaatcat

SEQ ID NO: 897277 - DNA, 22 bp, Artificial Sequence
  chemically synthesized
aaacatgattttggattaatca

SEQ ID NO: 897278 - DNA, 22 bp, Artificial Sequence
  chemically synthesized
ttggattatgattaatccaaaa

SEQ ID NO: 897279 - DNA, 22 bp, Artificial Sequence
  chemically synthesized
tggattatgattaatccaaaat

SEQ ID NO: 897280 - DNA, 22 bp, Artificial Sequence
  chemically synthesized
ggattatgattaatccaaaatc

SEQ ID NO: 897281 - DNA, 22 bp, Artificial Sequence
  chemically synthesized
gattatgattaatccaaaatca

SEQ ID NO: 897282 - DNA, 22 bp, Artificial Sequence
  chemically synthesized
tgattaatccaaaatcatgttt

SEQ ID NO: 897283 - DNA, 22 bp, Artificial Sequence
  chemically synthesized
tatcatgataatttaaacatga

SEQ ID NO: 897284 - DNA, 22 bp, Artificial Sequence
  chemically synthesized
atccaaaatcatgtttaaatta

SEQ ID NO: 897285 - DNA, 22 bp, Artificial Sequence
  chemically synthesized
tcacaattatatcatgataatt

SEQ ID NO: 897286 - DNA, 22 bp, Artificial Sequence
  chemically synthesized
atcacaattatatcatgataat

SEQ ID NO: 897287 - DNA, 22 bp, Artificial Sequence
  chemically synthesized
aaattatcatgatataattgtg

SEQ ID NO: 897288 - DNA, 22 bp, Artificial Sequence
  chemically synthesized
aattatcatgatataattgtga

SEQ ID NO: 897289 - DNA, 22 bp, Artificial Sequence
  chemically synthesized
tcatgatataattgtgataagc

SEQ ID NO: 897290 - DNA, 22 bp, Artificial Sequence
  chemically synthesized
tgataagcatcttctctatttt

SEQ ID NO: 897291 - DNA, 22 bp, Artificial Sequence
  chemically synthesized
taaaataaatgacaagccaacc

SEQ ID NO: 897292 - DNA, 22 bp, Artificial Sequence
  chemically synthesized
ctctattttggttggcttgtca

SEQ ID NO: 897293 - DNA, 22 bp, Artificial Sequence
  chemically synthesized
ttataaaataaatgacaagcca

SEQ ID NO: 897294 - DNA, 22 bp, Artificial Sequence
  chemically synthesized
tctattttggttggcttgtcat

SEQ ID NO: 897295 - DNA, 22 bp, Artificial Sequence
  chemically synthesized
tattataaaataaatgacaagc

SEQ ID NO: 897296 - DNA, 22 bp, Artificial Sequence
  chemically synthesized
tattttggttggcttgtcattt

SEQ ID NO: 897297 - DNA, 22 bp, Artificial Sequence
  chemically synthesized
ctattataaaataaatgacaag

SEQ ID NO: 897298 - DNA, 22 bp, Artificial Sequence
  chemically synthesized
ttttggttggcttgtcatttat

SEQ ID NO: 897299 - DNA, 22 bp, Artificial Sequence
  chemically synthesized
tggttggcttgtcatttatttt

SEQ ID NO: 897300 - DNA, 22 bp, Artificial Sequence
  chemically synthesized
tgcttctattataaaataaatg

SEQ ID NO: 897301 - DNA, 22 bp, Artificial Sequence
  chemically synthesized
ggttggcttgtcatttatttta

SEQ ID NO: 897302 - DNA, 22 bp, Artificial Sequence
  chemically synthesized
gttggcttgtcatttattttat

SEQ ID NO: 897303 - DNA, 22 bp, Artificial Sequence
  chemically synthesized
tctatgcttctattataaaata

SEQ ID NO: 897304 - DNA, 22 bp, Artificial Sequence
  chemically synthesized
gcttgtcatttattttataata

SEQ ID NO: 897305 - DNA, 22 bp, Artificial Sequence
  chemically synthesized
tgttatctatgcttctattata

SEQ ID NO: 897306 - DNA, 22 bp, Artificial Sequence
  chemically synthesized
gtcatttattttataatagaag

SEQ ID NO: 897307 - DNA, 22 bp, Artificial Sequence
  chemically synthesized
atgttatctatgcttctattat

SEQ ID NO: 897308 - DNA, 22 bp, Artificial Sequence
  chemically synthesized
tcatttattttataatagaagc

SEQ ID NO: 897309 - DNA, 22 bp, Artificial Sequence
  chemically synthesized
attttataatagaagcatagat

SEQ ID NO: 897310 - DNA, 22 bp, Artificial Sequence
  chemically synthesized
ttttataatagaagcatagata

SEQ ID NO: 897311 - DNA, 22 bp, Artificial Sequence
  chemically synthesized
taacaacttatgttatctatgc

SEQ ID NO: 897312 - DNA, 22 bp, Artificial Sequence
  chemically synthesized
ataacaacttatgttatctatg

SEQ ID NO: 897313 - DNA, 22 bp, Artificial Sequence
  chemically synthesized
tataatagaagcatagataaca

SEQ ID NO: 897314 - DNA, 22 bp, Artificial Sequence
  chemically synthesized
tataacaacttatgttatctat

SEQ ID NO: 897315 - DNA, 22 bp, Artificial Sequence
  chemically synthesized
ataatagaagcatagataacat

SEQ ID NO: 897316 - DNA, 22 bp, Artificial Sequence
  chemically synthesized
taatagaagcatagataacata

SEQ ID NO: 897317 - DNA, 22 bp, Artificial Sequence
  chemically synthesized
atctttataacaacttatgtta

SEQ ID NO: 897318 - DNA, 22 bp, Artificial Sequence
  chemically synthesized
aatctttataacaacttatgtt

SEQ ID NO: 897319 - DNA, 22 bp, Artificial Sequence
  chemically synthesized
taatctttataacaacttatgt

SEQ ID NO: 897320 - DNA, 22 bp, Artificial Sequence
  chemically synthesized
ttaatctttataacaacttatg

SEQ ID NO: 897321 - DNA, 22 bp, Artificial Sequence
  chemically synthesized
tttttaatctttataacaactt

SEQ ID NO: 897322 - DNA, 22 bp, Artificial Sequence
  chemically synthesized
ttatttttaatctttataacaa

SEQ ID NO: 897323 - DNA, 22 bp, Artificial Sequence
  chemically synthesized
ttattatttttaatctttataa

SEQ ID NO: 897324 - DNA, 22 bp, Artificial Sequence
  chemically synthesized
cctattattatttttaatcttt

SEQ ID NO: 897325 - DNA, 22 bp, Artificial Sequence
  chemically synthesized
aaaattccctattattattttt

SEQ ID NO: 897326 - DNA, 22 bp, Artificial Sequence
  chemically synthesized
ttataaagattaaaaataataa

SEQ ID NO: 897327 - DNA, 22 bp, Artificial Sequence
  chemically synthesized
taaagattaaaaataataatag

SEQ ID NO: 897328 - DNA, 22 bp, Artificial Sequence
  chemically synthesized
gaattgaaaattccctattatt

SEQ ID NO: 897329 - DNA, 22 bp, Artificial Sequence
  chemically synthesized
ttggaattgaaaattccctatt

SEQ ID NO: 897330 - DNA, 22 bp, Artificial Sequence
  chemically synthesized
attggaattgaaaattccctat

SEQ ID NO: 897331 - DNA, 22 bp, Artificial Sequence
  chemically synthesized
aaaataataatagggaattttc

SEQ ID NO: 897332 - DNA, 22 bp, Artificial Sequence
  chemically synthesized
cttattggaattgaaaattccc

SEQ ID NO: 897333 - DNA, 22 bp, Artificial Sequence
  chemically synthesized
ttacttattggaattgaaaatt

SEQ ID NO: 897334 - DNA, 22 bp, Artificial Sequence
  chemically synthesized
tcaattccaataagtaataatt

SEQ ID NO: 897335 - DNA, 22 bp, Artificial Sequence
  chemically synthesized
aaatatcatgtaaattattact

SEQ ID NO: 897336 - DNA, 22 bp, Artificial Sequence
  chemically synthesized
caattccaataagtaataattt

SEQ ID NO: 897337 - DNA, 22 bp, Artificial Sequence
  chemically synthesized
aattccaataagtaataattta

SEQ ID NO: 897338 - DNA, 22 bp, Artificial Sequence
  chemically synthesized
caataagtaataatttacatga

SEQ ID NO: 897339 - DNA, 22 bp, Artificial Sequence
  chemically synthesized
aaaataatgctaaaatatcatg

SEQ ID NO: 897340 - DNA, 22 bp, Artificial Sequence
  chemically synthesized
gaaaataatgctaaaatatcat

SEQ ID NO: 897341 - DNA, 22 bp, Artificial Sequence
  chemically synthesized
tgaaaataatgctaaaatatca

SEQ ID NO: 897342 - DNA, 22 bp, Artificial Sequence
  chemically synthesized
ttgaaaataatgctaaaatatc

SEQ ID NO: 897343 - DNA, 22 bp, Artificial Sequence
  chemically synthesized
tttgaaaataatgctaaaatat

SEQ ID NO: 897344 - DNA, 22 bp, Artificial Sequence
  chemically synthesized
aattttttgaaaataatgctaa

SEQ ID NO: 897345 - DNA, 22 bp, Artificial Sequence
  chemically synthesized
acatgatattttagcattattt

SEQ ID NO: 897346 - DNA, 22 bp, Artificial Sequence
  chemically synthesized
catgatattttagcattatttt

SEQ ID NO: 897347 - DNA, 22 bp, Artificial Sequence
  chemically synthesized
cattaaattttttgaaaataat

SEQ ID NO: 897348 - DNA, 22 bp, Artificial Sequence
  chemically synthesized
acattaaattttttgaaaataa

SEQ ID NO: 897349 - DNA, 22 bp, Artificial Sequence
  chemically synthesized
tagcattattttcaaaaaattt

SEQ ID NO: 897350 - DNA, 22 bp, Artificial Sequence
  chemically synthesized
agcatttacattaaattttttg

SEQ ID NO: 897351 - DNA, 22 bp, Artificial Sequence
  chemically synthesized
agcattattttcaaaaaattta

SEQ ID NO: 897352 - DNA, 22 bp, Artificial Sequence
  chemically synthesized
gcattattttcaaaaaatttaa

SEQ ID NO: 897353 - DNA, 22 bp, Artificial Sequence
  chemically synthesized
cgaattcagcatttacattaaa

SEQ ID NO: 897354 - DNA, 22 bp, Artificial Sequence
  chemically synthesized
ttttcaaaaaatttaatgtaaa

SEQ ID NO: 897355 - DNA, 22 bp, Artificial Sequence
  chemically synthesized
ccgaattcagcatttacattaa

SEQ ID NO: 897356 - DNA, 22 bp, Artificial Sequence
  chemically synthesized
tcaaaaaatttaatgtaaatgc

SEQ ID NO: 897357 - DNA, 22 bp, Artificial Sequence
  chemically synthesized
caaaaaatttaatgtaaatgct

SEQ ID NO: 897358 - DNA, 22 bp, Artificial Sequence
  chemically synthesized
aaaaaatttaatgtaaatgctg

SEQ ID NO: 897359 - DNA, 22 bp, Artificial Sequence
  chemically synthesized
agtacagaagtttccgaattca

SEQ ID NO: 897360 - DNA, 22 bp, Artificial Sequence
  chemically synthesized
aatgtaaatgctgaattcggaa

SEQ ID NO: 897361 - DNA, 22 bp, Artificial Sequence
  chemically synthesized
aagtacagaagtttccgaattc

SEQ ID NO: 897362 - DNA, 22 bp, Artificial Sequence
  chemically synthesized
atgtaaatgctgaattcggaaa

SEQ ID NO: 897363 - DNA, 22 bp, Artificial Sequence
  chemically synthesized
taagtacagaagtttccgaatt

SEQ ID NO: 897364 - DNA, 22 bp, Artificial Sequence
  chemically synthesized
ttaagtacagaagtttccgaat

SEQ ID NO: 897365 - DNA, 22 bp, Artificial Sequence
  chemically synthesized
tttaagtacagaagtttccgaa

SEQ ID NO: 897366 - DNA, 22 bp, Artificial Sequence
  chemically synthesized
ttttttaagtacagaagtttcc

SEQ ID NO: 897367 - DNA, 22 bp, Artificial Sequence
  chemically synthesized
attttttaagtacagaagtttc

SEQ ID NO: 897368 - DNA, 22 bp, Artificial Sequence
  chemically synthesized
tattttttaagtacagaagttt

SEQ ID NO: 897369 - DNA, 22 bp, Artificial Sequence
  chemically synthesized
aattcggaaacttctgtactta

SEQ ID NO: 897370 - DNA, 22 bp, Artificial Sequence
  chemically synthesized
ggaaacttctgtacttaaaaaa

SEQ ID NO: 897371 - DNA, 22 bp, Artificial Sequence
  chemically synthesized
aatcaagtctttattttttaag

SEQ ID NO: 897372 - DNA, 22 bp, Artificial Sequence
  chemically synthesized
aaattcaatcaagtctttattt

SEQ ID NO: 897373 - DNA, 22 bp, Artificial Sequence
  chemically synthesized
ctgtacttaaaaaataaagact

SEQ ID NO: 897374 - DNA, 22 bp, Artificial Sequence
  chemically synthesized
tgtacttaaaaaataaagactt

SEQ ID NO: 897375 - DNA, 22 bp, Artificial Sequence
  chemically synthesized
tacttaaaaaataaagacttga

SEQ ID NO: 897376 - DNA, 22 bp, Artificial Sequence
  chemically synthesized
agttaaaattcaatcaagtctt

SEQ ID NO: 897377 - DNA, 22 bp, Artificial Sequence
  chemically synthesized
aaaaaataaagacttgattgaa

SEQ ID NO: 897378 - DNA, 22 bp, Artificial Sequence
  chemically synthesized
aaaaataaagacttgattgaat

SEQ ID NO: 897379 - DNA, 22 bp, Artificial Sequence
  chemically synthesized
aaattaagttaaaattcaatca

SEQ ID NO: 897380 - DNA, 22 bp, Artificial Sequence
  chemically synthesized
aaaattaagttaaaattcaatc

SEQ ID NO: 897381 - DNA, 22 bp, Artificial Sequence
  chemically synthesized
taaaattaagttaaaattcaat

SEQ ID NO: 897382 - DNA, 22 bp, Artificial Sequence
  chemically synthesized
gattgaattttaacttaatttt

SEQ ID NO: 897383 - DNA, 22 bp, Artificial Sequence
  chemically synthesized
attgaattttaacttaatttta

SEQ ID NO: 897384 - DNA, 22 bp, Artificial Sequence
  chemically synthesized
tgtgagataggattttaaaatt

SEQ ID NO: 897385 - DNA, 22 bp, Artificial Sequence
  chemically synthesized
aattttaacttaattttaaaat

SEQ ID NO: 897386 - DNA, 22 bp, Artificial Sequence
  chemically synthesized
taacttaattttaaaatcctat

SEQ ID NO: 897387 - DNA, 22 bp, Artificial Sequence
  chemically synthesized
aacttaattttaaaatcctatc

SEQ ID NO: 897388 - DNA, 22 bp, Artificial Sequence
  chemically synthesized
ggaattgtgtgagataggattt

SEQ ID NO: 897389 - DNA, 22 bp, Artificial Sequence
  chemically synthesized
acttaattttaaaatcctatct

SEQ ID NO: 897390 - DNA, 22 bp, Artificial Sequence
  chemically synthesized
gttaggaattgtgtgagatagg

SEQ ID NO: 897391 - DNA, 22 bp, Artificial Sequence
  chemically synthesized
aattttaaaatcctatctcaca

SEQ ID NO: 897392 - DNA, 22 bp, Artificial Sequence
  chemically synthesized
agttaggaattgtgtgagatag

SEQ ID NO: 897393 - DNA, 22 bp, Artificial Sequence
  chemically synthesized
attttaaaatcctatctcacac

SEQ ID NO: 897394 - DNA, 22 bp, Artificial Sequence
  chemically synthesized
taaaatcctatctcacacaatt

SEQ ID NO: 897395 - DNA, 22 bp, Artificial Sequence
  chemically synthesized
aaaatcctatctcacacaattc

SEQ ID NO: 897396 - DNA, 22 bp, Artificial Sequence
  chemically synthesized
gtatttagttaggaattgtgtg

SEQ ID NO: 897397 - DNA, 22 bp, Artificial Sequence
  chemically synthesized
aaatcctatctcacacaattcc

SEQ ID NO: 897398 - DNA, 22 bp, Artificial Sequence
  chemically synthesized
atctggtatttagttaggaatt

SEQ ID NO: 897399 - DNA, 22 bp, Artificial Sequence
  chemically synthesized
tctcacacaattcctaactaaa

SEQ ID NO: 897400 - DNA, 22 bp, Artificial Sequence
  chemically synthesized
attcatctggtatttagttagg

SEQ ID NO: 897401 - DNA, 22 bp, Artificial Sequence
  chemically synthesized
cattcatctggtatttagttag

SEQ ID NO: 897402 - DNA, 22 bp, Artificial Sequence
  chemically synthesized
acacaattcctaactaaatacc

SEQ ID NO: 897403 - DNA, 22 bp, Artificial Sequence
  chemically synthesized
ctaactaaataccagatgaatg

SEQ ID NO: 897404 - DNA, 22 bp, Artificial Sequence
  chemically synthesized
catgtaacatttcattcatctg

SEQ ID NO: 897405 - DNA, 22 bp, Artificial Sequence
  chemically synthesized
acatgtaacatttcattcatct

SEQ ID NO: 897406 - DNA, 22 bp, Artificial Sequence
  chemically synthesized
tacatgtaacatttcattcatc

SEQ ID NO: 897407 - DNA, 22 bp, Artificial Sequence
  chemically synthesized
actaaataccagatgaatgaaa

SEQ ID NO: 897408 - DNA, 22 bp, Artificial Sequence
  chemically synthesized
ttacatgtaacatttcattcat

SEQ ID NO: 897409 - DNA, 22 bp, Artificial Sequence
  chemically synthesized
tttacatgtaacatttcattca

SEQ ID NO: 897410 - DNA, 22 bp, Artificial Sequence
  chemically synthesized
ttttacatgtaacatttcattc

SEQ ID NO: 897411 - DNA, 22 bp, Artificial Sequence
  chemically synthesized
aataccagatgaatgaaatgtt

SEQ ID NO: 897412 - DNA, 22 bp, Artificial Sequence
  chemically synthesized
aatttttttacatgtaacattt

SEQ ID NO: 897413 - DNA, 22 bp, Artificial Sequence
  chemically synthesized
tagttcaatttttttacatgta

SEQ ID NO: 897414 - DNA, 22 bp, Artificial Sequence
  chemically synthesized
atagttcaatttttttacatgt

SEQ ID NO: 897415 - DNA, 22 bp, Artificial Sequence
  chemically synthesized
tatagttcaatttttttacatg

SEQ ID NO: 897416 - DNA, 22 bp, Artificial Sequence
  chemically synthesized
ttatagttcaatttttttacat

SEQ ID NO: 897417 - DNA, 22 bp, Artificial Sequence
  chemically synthesized
cttttatagttcaattttttta

SEQ ID NO: 897418 - DNA, 22 bp, Artificial Sequence
  chemically synthesized
attacttttatagttcaatttt

SEQ ID NO: 897419 - DNA, 22 bp, Artificial Sequence
  chemically synthesized
cattacttttatagttcaattt

SEQ ID NO: 897420 - DNA, 22 bp, Artificial Sequence
  chemically synthesized
tcattacttttatagttcaatt

SEQ ID NO: 897421 - DNA, 22 bp, Artificial Sequence
  chemically synthesized
catgtaaaaaaattgaactata

SEQ ID NO: 897422 - DNA, 22 bp, Artificial Sequence
  chemically synthesized
ccatattttcattacttttata

SEQ ID NO: 897423 - DNA, 22 bp, Artificial Sequence
  chemically synthesized
aactataaaagtaatgaaaata

SEQ ID NO: 897424 - DNA, 22 bp, Artificial Sequence
  chemically synthesized
taagaatagcctcccatatttt

SEQ ID NO: 897425 - DNA, 22 bp, Artificial Sequence
  chemically synthesized
taaaagtaatgaaaatatggga

SEQ ID NO: 897426 - DNA, 22 bp, Artificial Sequence
  chemically synthesized
aaattataagaatagcctccca

SEQ ID NO: 897427 - DNA, 22 bp, Artificial Sequence
  chemically synthesized
aattaaaattataagaatagcc

SEQ ID NO: 897428 - DNA, 22 bp, Artificial Sequence
  chemically synthesized
aaattaaaattataagaatagc

SEQ ID NO: 897429 - DNA, 22 bp, Artificial Sequence
  chemically synthesized
taaattaaaattataagaatag

SEQ ID NO: 897430 - DNA, 22 bp, Artificial Sequence
  chemically synthesized
ttaaattaaaattataagaata

SEQ ID NO: 897431 - DNA, 22 bp, Artificial Sequence
  chemically synthesized
tggcttttaaattaaaattata

SEQ ID NO: 897432 - DNA, 22 bp, Artificial Sequence
  chemically synthesized
atggcttttaaattaaaattat

SEQ ID NO: 897433 - DNA, 22 bp, Artificial Sequence
  chemically synthesized
tatggcttttaaattaaaatta

SEQ ID NO: 897434 - DNA, 22 bp, Artificial Sequence
  chemically synthesized
ctttatggcttttaaattaaaa

SEQ ID NO: 897435 - DNA, 22 bp, Artificial Sequence
  chemically synthesized
ttcttataattttaatttaaaa

SEQ ID NO: 897436 - DNA, 22 bp, Artificial Sequence
  chemically synthesized
ttataattttaatttaaaagcc

SEQ ID NO: 897437 - DNA, 22 bp, Artificial Sequence
  chemically synthesized
ataattttaatttaaaagccat

SEQ ID NO: 897438 - DNA, 22 bp, Artificial Sequence
  chemically synthesized
taattttaatttaaaagccata

SEQ ID NO: 897439 - DNA, 22 bp, Artificial Sequence
  chemically synthesized
taatttaaaagccataaagtaa

SEQ ID NO: 897440 - DNA, 22 bp, Artificial Sequence
  chemically synthesized
aatttaaaagccataaagtaat

SEQ ID NO: 897441 - DNA, 22 bp, Artificial Sequence
  chemically synthesized
tgaatgtaagtcattactttat

SEQ ID NO: 897442 - DNA, 22 bp, Artificial Sequence
  chemically synthesized
atttaaaagccataaagtaatg

SEQ ID NO: 897443 - DNA, 22 bp, Artificial Sequence
  chemically synthesized
ctatgaatgtaagtcattactt

SEQ ID NO: 897444 - DNA, 22 bp, Artificial Sequence
  chemically synthesized
aaaagccataaagtaatgactt

SEQ ID NO: 897445 - DNA, 22 bp, Artificial Sequence
  chemically synthesized
aaagccataaagtaatgactta

SEQ ID NO: 897446 - DNA, 22 bp, Artificial Sequence
  chemically synthesized
tactgctatgaatgtaagtcat

SEQ ID NO: 897447 - DNA, 22 bp, Artificial Sequence
  chemically synthesized
atactgctatgaatgtaagtca

SEQ ID NO: 897448 - DNA, 22 bp, Artificial Sequence
  chemically synthesized
tatactgctatgaatgtaagtc

SEQ ID NO: 897449 - DNA, 22 bp, Artificial Sequence
  chemically synthesized
tgtaaagaaattttatactgct

SEQ ID NO: 897450 - DNA, 22 bp, Artificial Sequence
  chemically synthesized
atgtaaagaaattttatactgc

SEQ ID NO: 897451 - DNA, 22 bp, Artificial Sequence
  chemically synthesized
tatgtaaagaaattttatactg

SEQ ID NO: 897452 - DNA, 22 bp, Artificial Sequence
  chemically synthesized
ttatgtaaagaaattttatact

SEQ ID NO: 897453 - DNA, 22 bp, Artificial Sequence
  chemically synthesized
acattcatagcagtataaaatt

SEQ ID NO: 897454 - DNA, 22 bp, Artificial Sequence
  chemically synthesized
tttatgtaaagaaattttatac

SEQ ID NO: 897455 - DNA, 22 bp, Artificial Sequence
  chemically synthesized
cattcatagcagtataaaattt

SEQ ID NO: 897456 - DNA, 22 bp, Artificial Sequence
  chemically synthesized
attttttatgtaaagaaatttt

SEQ ID NO: 897457 - DNA, 22 bp, Artificial Sequence
  chemically synthesized
gattttttatgtaaagaaattt

SEQ ID NO: 897458 - DNA, 22 bp, Artificial Sequence
  chemically synthesized
atagcagtataaaatttcttta

SEQ ID NO: 897459 - DNA, 22 bp, Artificial Sequence
  chemically synthesized
tttgattttttatgtaaagaaa

SEQ ID NO: 897460 - DNA, 22 bp, Artificial Sequence
  chemically synthesized
gtttgattttttatgtaaagaa

SEQ ID NO: 897461 - DNA, 22 bp, Artificial Sequence
  chemically synthesized
gcttgtttgattttttatgtaa

SEQ ID NO: 897462 - DNA, 22 bp, Artificial Sequence
  chemically synthesized
ggcttgtttgattttttatgta

SEQ ID NO: 897463 - DNA, 22 bp, Artificial Sequence
  chemically synthesized
tggcttgtttgattttttatgt

SEQ ID NO: 897464 - DNA, 22 bp, Artificial Sequence
  chemically synthesized
tttggcttgtttgattttttat

SEQ ID NO: 897465 - DNA, 22 bp, Artificial Sequence
  chemically synthesized
ctttggcttgtttgatttttta

SEQ ID NO: 897466 - DNA, 22 bp, Artificial Sequence
  chemically synthesized
tctttggcttgtttgatttttt

SEQ ID NO: 897467 - DNA, 22 bp, Artificial Sequence
  chemically synthesized
ttctttggcttgtttgattttt

SEQ ID NO: 897468 - DNA, 22 bp, Artificial Sequence
  chemically synthesized
tttctttggcttgtttgatttt

SEQ ID NO: 897469 - DNA, 22 bp, Artificial Sequence
  chemically synthesized
ctttacataaaaaatcaaacaa

SEQ ID NO: 897470 - DNA, 22 bp, Artificial Sequence
  chemically synthesized
tttacataaaaaatcaaacaag

SEQ ID NO: 897471 - DNA, 22 bp, Artificial Sequence
  chemically synthesized
cctttttctttggcttgtttga

SEQ ID NO: 897472 - DNA, 22 bp, Artificial Sequence
  chemically synthesized
tacataaaaaatcaaacaagcc

SEQ ID NO: 897473 - DNA, 22 bp, Artificial Sequence
  chemically synthesized
gcctttttctttggcttgtttg

SEQ ID NO: 897474 - DNA, 22 bp, Artificial Sequence
  chemically synthesized
acataaaaaatcaaacaagcca

SEQ ID NO: 897475 - DNA, 22 bp, Artificial Sequence
  chemically synthesized
tgcctttttctttggcttgttt

SEQ ID NO: 897476 - DNA, 22 bp, Artificial Sequence
  chemically synthesized
cataaaaaatcaaacaagccaa

SEQ ID NO: 897477 - DNA, 22 bp, Artificial Sequence
  chemically synthesized
ttgcctttttctttggcttgtt

SEQ ID NO: 897478 - DNA, 22 bp, Artificial Sequence
  chemically synthesized
tttttgcctttttctttggctt

SEQ ID NO: 897479 - DNA, 22 bp, Artificial Sequence
  chemically synthesized
agagtgtcaaaaagatgaattg

SEQ ID NO: 897480 - DNA, 22 bp, Artificial Sequence
  chemically synthesized
aagagtgtcaaaaagatgaatt

SEQ ID NO: 897481 - DNA, 22 bp, Artificial Sequence
  chemically synthesized
tcttaagagtgtcaaaaagatg

SEQ ID NO: 897482 - DNA, 22 bp, Artificial Sequence
  chemically synthesized
atcttaagagtgtcaaaaagat

SEQ ID NO: 897483 - DNA, 22 bp, Artificial Sequence
  chemically synthesized
tatcttaagagtgtcaaaaaga

SEQ ID NO: 897484 - DNA, 22 bp, Artificial Sequence
  chemically synthesized
ttatcttaagagtgtcaaaaag

SEQ ID NO: 897485 - DNA, 22 bp, Artificial Sequence
  chemically synthesized
atctttttgacactcttaagat

SEQ ID NO: 897486 - DNA, 22 bp, Artificial Sequence
  chemically synthesized
tgagaatgtttttatcttaaga

SEQ ID NO: 897487 - DNA, 22 bp, Artificial Sequence
  chemically synthesized
gtgagaatgtttttatcttaag

SEQ ID NO: 897488 - DNA, 22 bp, Artificial Sequence
  chemically synthesized
tttgacactcttaagataaaaa

SEQ ID NO: 897489 - DNA, 22 bp, Artificial Sequence
  chemically synthesized
ttgacactcttaagataaaaac

SEQ ID NO: 897490 - DNA, 22 bp, Artificial Sequence
  chemically synthesized
atttgtgagaatgtttttatct

SEQ ID NO: 897491 - DNA, 22 bp, Artificial Sequence
  chemically synthesized
tgacactcttaagataaaaaca

SEQ ID NO: 897492 - DNA, 22 bp, Artificial Sequence
  chemically synthesized
gacactcttaagataaaaacat

SEQ ID NO: 897493 - DNA, 22 bp, Artificial Sequence
  chemically synthesized
acactcttaagataaaaacatt

SEQ ID NO: 897494 - DNA, 22 bp, Artificial Sequence
  chemically synthesized
ctgatttgtgagaatgttttta

SEQ ID NO: 897495 - DNA, 22 bp, Artificial Sequence
  chemically synthesized
tactgatttgtgagaatgtttt

SEQ ID NO: 897496 - DNA, 22 bp, Artificial Sequence
  chemically synthesized
ctactgatttgtgagaatgttt

SEQ ID NO: 897497 - DNA, 22 bp, Artificial Sequence
  chemically synthesized
tctactgatttgtgagaatgtt

SEQ ID NO: 897498 - DNA, 22 bp, Artificial Sequence
  chemically synthesized
ttctactgatttgtgagaatgt

SEQ ID NO: 897499 - DNA, 22 bp, Artificial Sequence
  chemically synthesized
ttaagataaaaacattctcaca

SEQ ID NO: 897500 - DNA, 22 bp, Artificial Sequence
  chemically synthesized
tttctactgatttgtgagaatg

SEQ ID NO: 897501 - DNA, 22 bp, Artificial Sequence
  chemically synthesized
ttttctactgatttgtgagaat

SEQ ID NO: 897502 - DNA, 22 bp, Artificial Sequence
  chemically synthesized
aagataaaaacattctcacaaa

SEQ ID NO: 897503 - DNA, 22 bp, Artificial Sequence
  chemically synthesized
tttttctactgatttgtgagaa

SEQ ID NO: 897504 - DNA, 22 bp, Artificial Sequence
  chemically synthesized
agataaaaacattctcacaaat

SEQ ID NO: 897505 - DNA, 22 bp, Artificial Sequence
  chemically synthesized
tctttttttctactgatttgtg

SEQ ID NO: 897506 - DNA, 22 bp, Artificial Sequence
  chemically synthesized
gtctttttttctactgatttgt

SEQ ID NO: 897507 - DNA, 22 bp, Artificial Sequence
  chemically synthesized
agtatttgtctttttttctact

SEQ ID NO: 897508 - DNA, 22 bp, Artificial Sequence
  chemically synthesized
tcacaaatcagtagaaaaaaag

SEQ ID NO: 897509 - DNA, 22 bp, Artificial Sequence
  chemically synthesized
attgagtatttgtctttttttc

SEQ ID NO: 897510 - DNA, 22 bp, Artificial Sequence
  chemically synthesized
acaaatcagtagaaaaaaagac

SEQ ID NO: 897511 - DNA, 22 bp, Artificial Sequence
  chemically synthesized
aattgagtatttgtcttttttt

SEQ ID NO: 897512 - DNA, 22 bp, Artificial Sequence
  chemically synthesized
taattgagtatttgtctttttt

SEQ ID NO: 897513 - DNA, 22 bp, Artificial Sequence
  chemically synthesized
ttaattgagtatttgtcttttt

SEQ ID NO: 897514 - DNA, 22 bp, Artificial Sequence
  chemically synthesized
tttaattgagtatttgtctttt

SEQ ID NO: 897515 - DNA, 22 bp, Artificial Sequence
  chemically synthesized
tcctttttaattgagtatttgt

SEQ ID NO: 897516 - DNA, 22 bp, Artificial Sequence
  chemically synthesized
attatcctttttaattgagtat

SEQ ID NO: 897517 - DNA, 22 bp, Artificial Sequence
  chemically synthesized
ctcattatcctttttaattgag

SEQ ID NO: 897518 - DNA, 22 bp, Artificial Sequence
  chemically synthesized
ttcctcattatcctttttaatt

SEQ ID NO: 897519 - DNA, 22 bp, Artificial Sequence
  chemically synthesized
aatggtctattcctcattatcc

SEQ ID NO: 897520 - DNA, 22 bp, Artificial Sequence
  chemically synthesized
aattaaaaaggataatgaggaa

SEQ ID NO: 897521 - DNA, 22 bp, Artificial Sequence
  chemically synthesized
ctaaatggtctattcctcatta

SEQ ID NO: 897522 - DNA, 22 bp, Artificial Sequence
  chemically synthesized
cctaaatggtctattcctcatt

SEQ ID NO: 897523 - DNA, 22 bp, Artificial Sequence
  chemically synthesized
tcctaaatggtctattcctcat

SEQ ID NO: 897524 - DNA, 22 bp, Artificial Sequence
  chemically synthesized
tttcctaaatggtctattcctc

SEQ ID NO: 897525 - DNA, 22 bp, Artificial Sequence
  chemically synthesized
aaaaggataatgaggaatagac

SEQ ID NO: 897526 - DNA, 22 bp, Artificial Sequence
  chemically synthesized
tagttctttcctaaatggtcta

SEQ ID NO: 897527 - DNA, 22 bp, Artificial Sequence
  chemically synthesized
tacataggtcagttatagttct

SEQ ID NO: 897528 - DNA, 22 bp, Artificial Sequence
  chemically synthesized
aggaaagaactataactgacct

SEQ ID NO: 897529 - DNA, 22 bp, Artificial Sequence
  chemically synthesized
ggaaagaactataactgaccta

SEQ ID NO: 897530 - DNA, 22 bp, Artificial Sequence
  chemically synthesized
ataggcctatacataggtcagt

SEQ ID NO: 897531 - DNA, 22 bp, Artificial Sequence
  chemically synthesized
aataggcctatacataggtcag

SEQ ID NO: 897532 - DNA, 22 bp, Artificial Sequence
  chemically synthesized
taataggcctatacataggtca

SEQ ID NO: 897533 - DNA, 22 bp, Artificial Sequence
  chemically synthesized
taactgacctatgtataggcct

SEQ ID NO: 897534 - DNA, 22 bp, Artificial Sequence
  chemically synthesized
acctatgtataggcctattaaa

SEQ ID NO: 897535 - DNA, 22 bp, Artificial Sequence
  chemically synthesized
gtgaagtcaaacaattttaata

SEQ ID NO: 897536 - DNA, 22 bp, Artificial Sequence
  chemically synthesized
tgtataggcctattaaaattgt

SEQ ID NO: 897537 - DNA, 22 bp, Artificial Sequence
  chemically synthesized
ctagtgaagtcaaacaatttta

SEQ ID NO: 897538 - DNA, 22 bp, Artificial Sequence
  chemically synthesized
cctagtgaagtcaaacaatttt

SEQ ID NO: 897539 - DNA, 22 bp, Artificial Sequence
  chemically synthesized
tcctagtgaagtcaaacaattt

SEQ ID NO: 897540 - DNA, 22 bp, Artificial Sequence
  chemically synthesized
aattttcctagtgaagtcaaac

SEQ ID NO: 897541 - DNA, 22 bp, Artificial Sequence
  chemically synthesized
gaattttcctagtgaagtcaaa

SEQ ID NO: 897542 - DNA, 22 bp, Artificial Sequence
  chemically synthesized
ttaaaattgtttgacttcacta

SEQ ID NO: 897543 - DNA, 22 bp, Artificial Sequence
  chemically synthesized
tttgaattttcctagtgaagtc

SEQ ID NO: 897544 - DNA, 22 bp, Artificial Sequence
  chemically synthesized
aaattgtttgacttcactagga

SEQ ID NO: 897545 - DNA, 22 bp, Artificial Sequence
  chemically synthesized
cctgtttgaattttcctagtga

SEQ ID NO: 897546 - DNA, 22 bp, Artificial Sequence
  chemically synthesized
tttgacttcactaggaaaattc

SEQ ID NO: 897547 - DNA, 22 bp, Artificial Sequence
  chemically synthesized
cacctccctgtttgaattttcc

SEQ ID NO: 897548 - DNA, 22 bp, Artificial Sequence
  chemically synthesized
gacttcactaggaaaattcaaa

SEQ ID NO: 897549 - DNA, 22 bp, Artificial Sequence
  chemically synthesized
acttcactaggaaaattcaaac

SEQ ID NO: 897550 - DNA, 22 bp, Artificial Sequence
  chemically synthesized
cactaggaaaattcaaacaggg

SEQ ID NO: 897551 - DNA, 22 bp, Artificial Sequence
  chemically synthesized
actaggaaaattcaaacaggga

SEQ ID NO: 897552 - DNA, 22 bp, Artificial Sequence
  chemically synthesized
ggaaaattcaaacagggaggtg

SEQ ID NO: 897553 - DNA, 22 bp, Artificial Sequence
  chemically synthesized
aatcaataggtgcaatattaca

SEQ ID NO: 897554 - DNA, 22 bp, Artificial Sequence
  chemically synthesized
aaacagggaggtgtaatattgc

SEQ ID NO: 897555 - DNA, 22 bp, Artificial Sequence
  chemically synthesized
ttaaatcaataggtgcaatatt

SEQ ID NO: 897556 - DNA, 22 bp, Artificial Sequence
  chemically synthesized
gttaaatcaataggtgcaatat

SEQ ID NO: 897557 - DNA, 22 bp, Artificial Sequence
  chemically synthesized
tgttaaatcaataggtgcaata

SEQ ID NO: 897558 - DNA, 22 bp, Artificial Sequence
  chemically synthesized
aatctttgttaaatcaataggt

SEQ ID NO: 897559 - DNA, 22 bp, Artificial Sequence
  chemically synthesized
aaatctttgttaaatcaatagg

SEQ ID NO: 897560 - DNA, 22 bp, Artificial Sequence
  chemically synthesized
taaatctttgttaaatcaatag

SEQ ID NO: 897561 - DNA, 22 bp, Artificial Sequence
  chemically synthesized
cacctattgatttaacaaagat

SEQ ID NO: 897562 - DNA, 22 bp, Artificial Sequence
  chemically synthesized
ttgatttaacaaagatttaaaa

SEQ ID NO: 897563 - DNA, 22 bp, Artificial Sequence
  chemically synthesized
atttaacaaagatttaaaacac

SEQ ID NO: 897564 - DNA, 22 bp, Artificial Sequence
  chemically synthesized
cagtgcaagatagtgttttaaa

SEQ ID NO: 897565 - DNA, 22 bp, Artificial Sequence
  chemically synthesized
aacaaagatttaaaacactatc

SEQ ID NO: 897566 - DNA, 22 bp, Artificial Sequence
  chemically synthesized
acaaagatttaaaacactatct

SEQ ID NO: 897567 - DNA, 22 bp, Artificial Sequence
  chemically synthesized
tattgcagtgcaagatagtgtt

SEQ ID NO: 897568 - DNA, 22 bp, Artificial Sequence
  chemically synthesized
ttgtattgcagtgcaagatagt

SEQ ID NO: 897569 - DNA, 22 bp, Artificial Sequence
  chemically synthesized
aaaacactatcttgcactgcaa

SEQ ID NO: 897570 - DNA, 22 bp, Artificial Sequence
  chemically synthesized
aaacactatcttgcactgcaat

SEQ ID NO: 897571 - DNA, 22 bp, Artificial Sequence
  chemically synthesized
tatgagactattgtattgcagt

SEQ ID NO: 897572 - DNA, 22 bp, Artificial Sequence
  chemically synthesized
ttgtatgagactattgtattgc

SEQ ID NO: 897573 - DNA, 22 bp, Artificial Sequence
  chemically synthesized
tgttgtatgagactattgtatt

SEQ ID NO: 897574 - DNA, 22 bp, Artificial Sequence
  chemically synthesized
tcttgcactgcaatacaatagt

SEQ ID NO: 897575 - DNA, 22 bp, Artificial Sequence
  chemically synthesized
ctgttgtatgagactattgtat

SEQ ID NO: 897576 - DNA, 22 bp, Artificial Sequence
  chemically synthesized
gcactgcaatacaatagtctca

SEQ ID NO: 897577 - DNA, 22 bp, Artificial Sequence
  chemically synthesized
cactgcaatacaatagtctcat

SEQ ID NO: 897578 - DNA, 22 bp, Artificial Sequence
  chemically synthesized
caatacaatagtctcatacaac

SEQ ID NO: 897579 - DNA, 22 bp, Artificial Sequence
  chemically synthesized
accacacaatttctgttgtatg

SEQ ID NO: 897580 - DNA, 22 bp, Artificial Sequence
  chemically synthesized
atacaacagaaattgtgtggtg

SEQ ID NO: 897581 - DNA, 22 bp, Artificial Sequence
  chemically synthesized
tcagtaatgagaagacccaatt

SEQ ID NO: 897582 - DNA, 22 bp, Artificial Sequence
  chemically synthesized
ctatcagtaatgagaagaccca

SEQ ID NO: 897583 - DNA, 22 bp, Artificial Sequence
  chemically synthesized
gctatcagtaatgagaagaccc

SEQ ID NO: 897584 - DNA, 22 bp, Artificial Sequence
  chemically synthesized
tgtggtgaattgggtcttctca

SEQ ID NO: 897585 - DNA, 22 bp, Artificial Sequence
  chemically synthesized
cttgctatcagtaatgagaaga

SEQ ID NO: 897586 - DNA, 22 bp, Artificial Sequence
  chemically synthesized
gcttgctatcagtaatgagaag

SEQ ID NO: 897587 - DNA, 22 bp, Artificial Sequence
  chemically synthesized
tttgcttgctatcagtaatgag

SEQ ID NO: 897588 - DNA, 22 bp, Artificial Sequence
  chemically synthesized
atttgcttgctatcagtaatga

SEQ ID NO: 897589 - DNA, 22 bp, Artificial Sequence
  chemically synthesized
tatttgcttgctatcagtaatg

SEQ ID NO: 897590 - DNA, 22 bp, Artificial Sequence
  chemically synthesized
ggtcttctcattactgatagca

SEQ ID NO: 897591 - DNA, 22 bp, Artificial Sequence
  chemically synthesized
attttatttgcttgctatcagt

SEQ ID NO: 897592 - DNA, 22 bp, Artificial Sequence
  chemically synthesized
cattttatttgcttgctatcag

SEQ ID NO: 897593 - DNA, 22 bp, Artificial Sequence
  chemically synthesized
ctcattactgatagcaagcaaa

SEQ ID NO: 897594 - DNA, 22 bp, Artificial Sequence
  chemically synthesized
tcattactgatagcaagcaaat

SEQ ID NO: 897595 - DNA, 22 bp, Artificial Sequence
  chemically synthesized
attactgatagcaagcaaataa

SEQ ID NO: 897596 - DNA, 22 bp, Artificial Sequence
  chemically synthesized
ctgatagcaagcaaataaaatg

SEQ ID NO: 897597 - DNA, 22 bp, Artificial Sequence
  chemically synthesized
ccagagatatttcattttattt

SEQ ID NO: 897598 - DNA, 22 bp, Artificial Sequence
  chemically synthesized
atagcaagcaaataaaatgaaa

SEQ ID NO: 897599 - DNA, 22 bp, Artificial Sequence
  chemically synthesized
atcgacacccaaccccactccc

SEQ ID NO: 897600 - DNA, 22 bp, Artificial Sequence
  chemically synthesized
cctcatcgacacccaaccccac

SEQ ID NO: 897601 - DNA, 22 bp, Artificial Sequence
  chemically synthesized
tgggagtggggttgggtgtcga

SEQ ID NO: 897602 - DNA, 22 bp, Artificial Sequence
  chemically synthesized
ggagtggggttgggtgtcgatg

SEQ ID NO: 897603 - DNA, 22 bp, Artificial Sequence
  chemically synthesized
caaaaacctacctcatcgacac

SEQ ID NO: 897604 - DNA, 22 bp, Artificial Sequence
  chemically synthesized
ggtgtcgatgaggtaggttttt

SEQ ID NO: 897605 - DNA, 22 bp, Artificial Sequence
  chemically synthesized
gatatgaactacaaaaacctac

SEQ ID NO: 897606 - DNA, 22 bp, Artificial Sequence
  chemically synthesized
agatatgaactacaaaaaccta

SEQ ID NO: 897607 - DNA, 22 bp, Artificial Sequence
  chemically synthesized
tagatatgaactacaaaaacct

SEQ ID NO: 897608 - DNA, 22 bp, Artificial Sequence
  chemically synthesized
gactttagatatgaactacaaa

SEQ ID NO: 897609 - DNA, 22 bp, Artificial Sequence
  chemically synthesized
agactttagatatgaactacaa

SEQ ID NO: 897610 - DNA, 22 bp, Artificial Sequence
  chemically synthesized
tagactttagatatgaactaca

SEQ ID NO: 897611 - DNA, 22 bp, Artificial Sequence
  chemically synthesized
aaatgttttagactttagatat

SEQ ID NO: 897612 - DNA, 22 bp, Artificial Sequence
  chemically synthesized
ttgtagttcatatctaaagtct

SEQ ID NO: 897613 - DNA, 22 bp, Artificial Sequence
  chemically synthesized
tgtagttcatatctaaagtcta

SEQ ID NO: 897614 - DNA, 22 bp, Artificial Sequence
  chemically synthesized
gtagttcatatctaaagtctaa

SEQ ID NO: 897615 - DNA, 22 bp, Artificial Sequence
  chemically synthesized
tagttcatatctaaagtctaaa

SEQ ID NO: 897616 - DNA, 22 bp, Artificial Sequence
  chemically synthesized
agtgcactaaaatgttttagac

SEQ ID NO: 897617 - DNA, 22 bp, Artificial Sequence
  chemically synthesized
atatctaaagtctaaaacattt

SEQ ID NO: 897618 - DNA, 22 bp, Artificial Sequence
  chemically synthesized
gtctaagtgcactaaaatgttt

SEQ ID NO: 897619 - DNA, 22 bp, Artificial Sequence
  chemically synthesized
tggtctaagtgcactaaaatgt

SEQ ID NO: 897620 - DNA, 22 bp, Artificial Sequence
  chemically synthesized
aagtctaaaacattttagtgca

SEQ ID NO: 897621 - DNA, 22 bp, Artificial Sequence
  chemically synthesized
aaacattttagtgcacttagac

SEQ ID NO: 897622 - DNA, 22 bp, Artificial Sequence
  chemically synthesized
aaagtaaaatctctggtctaag

SEQ ID NO: 897623 - DNA, 22 bp, Artificial Sequence
  chemically synthesized
aaaagtaaaatctctggtctaa

SEQ ID NO: 897624 - DNA, 22 bp, Artificial Sequence
  chemically synthesized
taaaagtaaaatctctggtcta

SEQ ID NO: 897625 - DNA, 22 bp, Artificial Sequence
  chemically synthesized
tagtgcacttagaccagagatt

SEQ ID NO: 897626 - DNA, 22 bp, Artificial Sequence
  chemically synthesized
agtgcacttagaccagagattt

SEQ ID NO: 897627 - DNA, 22 bp, Artificial Sequence
  chemically synthesized
gtgcacttagaccagagatttt

SEQ ID NO: 897628 - DNA, 22 bp, Artificial Sequence
  chemically synthesized
aaattttaaaagtaaaatctct

SEQ ID NO: 897629 - DNA, 22 bp, Artificial Sequence
  chemically synthesized
gaaattttaaaagtaaaatctc

SEQ ID NO: 897630 - DNA, 22 bp, Artificial Sequence
  chemically synthesized
tgaaattttaaaagtaaaatct

SEQ ID NO: 897631 - DNA, 22 bp, Artificial Sequence
  chemically synthesized
ttgaaattttaaaagtaaaatc

SEQ ID NO: 897632 - DNA, 22 bp, Artificial Sequence
  chemically synthesized
tttgaaattttaaaagtaaaat

SEQ ID NO: 897633 - DNA, 22 bp, Artificial Sequence
  chemically synthesized
ttttgaaattttaaaagtaaaa

SEQ ID NO: 897634 - DNA, 22 bp, Artificial Sequence
  chemically synthesized
agaccagagattttacttttaa

SEQ ID NO: 897635 - DNA, 22 bp, Artificial Sequence
  chemically synthesized
gaccagagattttacttttaaa

SEQ ID NO: 897636 - DNA, 22 bp, Artificial Sequence
  chemically synthesized
cagaaaatttttttgaaatttt

SEQ ID NO: 897637 - DNA, 22 bp, Artificial Sequence
  chemically synthesized
attgcagaaaatttttttgaaa

SEQ ID NO: 897638 - DNA, 22 bp, Artificial Sequence
  chemically synthesized
tacttttaaaatttcaaaaaaa

SEQ ID NO: 897639 - DNA, 22 bp, Artificial Sequence
  chemically synthesized
acttttaaaatttcaaaaaaat

SEQ ID NO: 897640 - DNA, 22 bp, Artificial Sequence
  chemically synthesized
cttttaaaatttcaaaaaaatt

SEQ ID NO: 897641 - DNA, 22 bp, Artificial Sequence
  chemically synthesized
ttaaaatttcaaaaaaattttc

SEQ ID NO: 897642 - DNA, 22 bp, Artificial Sequence
  chemically synthesized
taaaatttcaaaaaaattttct

SEQ ID NO: 897643 - DNA, 22 bp, Artificial Sequence
  chemically synthesized
aaaatttcaaaaaaattttctg

SEQ ID NO: 897644 - DNA, 22 bp, Artificial Sequence
  chemically synthesized
aaatttcaaaaaaattttctgc

SEQ ID NO: 897645 - DNA, 22 bp, Artificial Sequence
  chemically synthesized
caaaaaaattttctgcaatgaa

SEQ ID NO: 897646 - DNA, 22 bp, Artificial Sequence
  chemically synthesized
aaaaaaattttctgcaatgaat

SEQ ID NO: 897647 - DNA, 22 bp, Artificial Sequence
  chemically synthesized
aaagaagcacatattcattgca

SEQ ID NO: 897648 - DNA, 22 bp, Artificial Sequence
  chemically synthesized
aaaagaagcacatattcattgc

SEQ ID NO: 897649 - DNA, 22 bp, Artificial Sequence
  chemically synthesized
taaaagaagcacatattcattg

SEQ ID NO: 897650 - DNA, 22 bp, Artificial Sequence
  chemically synthesized
ttaaaagaagcacatattcatt

SEQ ID NO: 897651 - DNA, 22 bp, Artificial Sequence
  chemically synthesized
tttaaaagaagcacatattcat

SEQ ID NO: 897652 - DNA, 22 bp, Artificial Sequence
  chemically synthesized
ttttaaaagaagcacatattca

SEQ ID NO: 897653 - DNA, 22 bp, Artificial Sequence
  chemically synthesized
ttttttaaaagaagcacatatt

SEQ ID NO: 897654 - DNA, 22 bp, Artificial Sequence
  chemically synthesized
cttttttaaaagaagcacatat

SEQ ID NO: 897655 - DNA, 22 bp, Artificial Sequence
  chemically synthesized
tcttttttaaaagaagcacata

SEQ ID NO: 897656 - DNA, 22 bp, Artificial Sequence
  chemically synthesized
tctgcaatgaatatgtgcttct

SEQ ID NO: 897657 - DNA, 22 bp, Artificial Sequence
  chemically synthesized
ctgcaatgaatatgtgcttctt

SEQ ID NO: 897658 - DNA, 22 bp, Artificial Sequence
  chemically synthesized
tgcaatgaatatgtgcttcttt

SEQ ID NO: 897659 - DNA, 22 bp, Artificial Sequence
  chemically synthesized
caatgaatatgtgcttctttta

SEQ ID NO: 897660 - DNA, 22 bp, Artificial Sequence
  chemically synthesized
aaataatgattttcttttttaa

SEQ ID NO: 897661 - DNA, 22 bp, Artificial Sequence
  chemically synthesized
aaaataatgattttctttttta

SEQ ID NO: 897662 - DNA, 22 bp, Artificial Sequence
  chemically synthesized
tatttaaaataatgattttctt

SEQ ID NO: 897663 - DNA, 22 bp, Artificial Sequence
  chemically synthesized
cttttaaaaaagaaaatcatta

SEQ ID NO: 897664 - DNA, 22 bp, Artificial Sequence
  chemically synthesized
ttttaaaaaagaaaatcattat

SEQ ID NO: 897665 - DNA, 22 bp, Artificial Sequence
  chemically synthesized
ttaaaaaagaaaatcattattt

SEQ ID NO: 897666 - DNA, 22 bp, Artificial Sequence
  chemically synthesized
taaaaaagaaaatcattatttt

SEQ ID NO: 897667 - DNA, 22 bp, Artificial Sequence
  chemically synthesized
aaaaaagaaaatcattatttta

SEQ ID NO: 897668 - DNA, 22 bp, Artificial Sequence
  chemically synthesized
aaaaagaaaatcattattttaa

SEQ ID NO: 897669 - DNA, 22 bp, Artificial Sequence
  chemically synthesized
tagaagtatacatgtgtaccta

SEQ ID NO: 897670 - DNA, 22 bp, Artificial Sequence
  chemically synthesized
tatagaagtatacatgtgtacc

SEQ ID NO: 897671 - DNA, 22 bp, Artificial Sequence
  chemically synthesized
ttttaaatataggtacacatgt

SEQ ID NO: 897672 - DNA, 22 bp, Artificial Sequence
  chemically synthesized
ctatagaagtatacatgtgtac

SEQ ID NO: 897673 - DNA, 22 bp, Artificial Sequence
  chemically synthesized
tctatagaagtatacatgtgta

SEQ ID NO: 897674 - DNA, 22 bp, Artificial Sequence
  chemically synthesized
taaatataggtacacatgtata

SEQ ID NO: 897675 - DNA, 22 bp, Artificial Sequence
  chemically synthesized
tttctatagaagtatacatgtg

SEQ ID NO: 897676 - DNA, 22 bp, Artificial Sequence
  chemically synthesized
aaatataggtacacatgtatac

SEQ ID NO: 897677 - DNA, 22 bp, Artificial Sequence
  chemically synthesized
aatataggtacacatgtatact

SEQ ID NO: 897678 - DNA, 22 bp, Artificial Sequence
  chemically synthesized
catacataaacctctttctata

SEQ ID NO: 897679 - DNA, 22 bp, Artificial Sequence
  chemically synthesized
ggcactacatacataaacctct

SEQ ID NO: 897680 - DNA, 22 bp, Artificial Sequence
  chemically synthesized
aggcactacatacataaacctc

SEQ ID NO: 897681 - DNA, 22 bp, Artificial Sequence
  chemically synthesized
taggcactacatacataaacct

SEQ ID NO: 897682 - DNA, 22 bp, Artificial Sequence
  chemically synthesized
ctatagaaagaggtttatgtat

SEQ ID NO: 897683 - DNA, 22 bp, Artificial Sequence
  chemically synthesized
tatagaaagaggtttatgtatg

SEQ ID NO: 897684 - DNA, 22 bp, Artificial Sequence
  chemically synthesized
tagaaagaggtttatgtatgta

SEQ ID NO: 897685 - DNA, 22 bp, Artificial Sequence
  chemically synthesized
ggcacattttaggcactacata

SEQ ID NO: 897686 - DNA, 22 bp, Artificial Sequence
  chemically synthesized
atgtatgtagtgcctaaaatgt

SEQ ID NO: 897687 - DNA, 22 bp, Artificial Sequence
  chemically synthesized
tgtatgtagtgcctaaaatgtg

SEQ ID NO: 897688 - DNA, 22 bp, Artificial Sequence
  chemically synthesized
atagatatgttgggcacatttt

SEQ ID NO: 897689 - DNA, 22 bp, Artificial Sequence
  chemically synthesized
ttgatagatatgttgggcacat

SEQ ID NO: 897690 - DNA, 22 bp, Artificial Sequence
  chemically synthesized
gatgttgttgatagatatgttg

SEQ ID NO: 897691 - DNA, 22 bp, Artificial Sequence
  chemically synthesized
aaatgtgcccaacatatctatc

SEQ ID NO: 897692 - DNA, 22 bp, Artificial Sequence
  chemically synthesized
ttagatgttgttgatagatatg

SEQ ID NO: 897693 - DNA, 22 bp, Artificial Sequence
  chemically synthesized
ttattagatgttgttgatagat

SEQ ID NO: 897694 - DNA, 22 bp, Artificial Sequence
  chemically synthesized
tagagttgttattagatgttgt

SEQ ID NO: 897695 - DNA, 22 bp, Artificial Sequence
  chemically synthesized
tattatagagttgttattagat

SEQ ID NO: 897696 - DNA, 22 bp, Artificial Sequence
  chemically synthesized
tcaacaacatctaataacaact

SEQ ID NO: 897697 - DNA, 22 bp, Artificial Sequence
  chemically synthesized
cctgtattatagagttgttatt

SEQ ID NO: 897698 - DNA, 22 bp, Artificial Sequence
  chemically synthesized
ataacaactctataatacaggt

SEQ ID NO: 897699 - DNA, 22 bp, Artificial Sequence
  chemically synthesized
ggaacaataatactacctgtat

SEQ ID NO: 897700 - DNA, 22 bp, Artificial Sequence
  chemically synthesized
tataatacaggtagtattattg

SEQ ID NO: 897701 - DNA, 22 bp, Artificial Sequence
  chemically synthesized
taatacaggtagtattattgtt

SEQ ID NO: 897702 - DNA, 22 bp, Artificial Sequence
  chemically synthesized
tacaagtcacatgcgtacactg

SEQ ID NO: 897703 - DNA, 22 bp, Artificial Sequence
  chemically synthesized
gtacaagtcacatgcgtacact

SEQ ID NO: 897704 - DNA, 22 bp, Artificial Sequence
  chemically synthesized
ttgttcccagtgtacgcatgtg

SEQ ID NO: 897705 - DNA, 22 bp, Artificial Sequence
  chemically synthesized
accttgtacaagtcacatgcgt

SEQ ID NO: 897706 - DNA, 22 bp, Artificial Sequence
  chemically synthesized
ttcccagtgtacgcatgtgact

SEQ ID NO: 897707 - DNA, 22 bp, Artificial Sequence
  chemically synthesized
tctgaccttgtacaagtcacat

SEQ ID NO: 897708 - DNA, 22 bp, Artificial Sequence
  chemically synthesized
ccagtgtacgcatgtgacttgt

SEQ ID NO: 897709 - DNA, 22 bp, Artificial Sequence
  chemically synthesized
acagctatctgaccttgtacaa

SEQ ID NO: 897710 - DNA, 22 bp, Artificial Sequence
  chemically synthesized
cacagctatctgaccttgtaca

SEQ ID NO: 897711 - DNA, 22 bp, Artificial Sequence
  chemically synthesized
ccatttcacagctatctgacct

SEQ ID NO: 897712 - DNA, 22 bp, Artificial Sequence
  chemically synthesized
gttaccatttcacagctatctg

SEQ ID NO: 897713 - DNA, 22 bp, Artificial Sequence
  chemically synthesized
ggttaccatttcacagctatct

SEQ ID NO: 897714 - DNA, 22 bp, Artificial Sequence
  chemically synthesized
gtacaaggtcagatagctgtga

SEQ ID NO: 897715 - DNA, 22 bp, Artificial Sequence
  chemically synthesized
tacaaggtcagatagctgtgaa

SEQ ID NO: 897716 - DNA, 22 bp, Artificial Sequence
  chemically synthesized
gcttggttaccatttcacagct

SEQ ID NO: 897717 - DNA, 22 bp, Artificial Sequence
  chemically synthesized
aaatcctagcttggttaccatt

SEQ ID NO: 897718 - DNA, 22 bp, Artificial Sequence
  chemically synthesized
ggttcaaatcctagcttggtta

SEQ ID NO: 897719 - DNA, 22 bp, Artificial Sequence
  chemically synthesized
gggttcaaatcctagcttggtt

SEQ ID NO: 897720 - DNA, 22 bp, Artificial Sequence
  chemically synthesized
ttgggttcaaatcctagcttgg

SEQ ID NO: 897721 - DNA, 22 bp, Artificial Sequence
  chemically synthesized
tgaaatggtaaccaagctagga

SEQ ID NO: 897722 - DNA, 22 bp, Artificial Sequence
  chemically synthesized
cttgggttcaaatcctagcttg

SEQ ID NO: 897723 - DNA, 22 bp, Artificial Sequence
  chemically synthesized
acttcttgggttcaaatcctag

SEQ ID NO: 897724 - DNA, 22 bp, Artificial Sequence
  chemically synthesized
aaagcctaacttcttgggttca

SEQ ID NO: 897725 - DNA, 22 bp, Artificial Sequence
  chemically synthesized
caaagcctaacttcttgggttc

SEQ ID NO: 897726 - DNA, 22 bp, Artificial Sequence
  chemically synthesized
ggatttgaacccaagaagttag

SEQ ID NO: 897727 - DNA, 22 bp, Artificial Sequence
  chemically synthesized
gaacccaagaagttaggctttg

SEQ ID NO: 897728 - DNA, 22 bp, Artificial Sequence
  chemically synthesized
aacccaagaagttaggctttga

SEQ ID NO: 897729 - DNA, 22 bp, Artificial Sequence
  chemically synthesized
acaggataggcttcaaagccta

SEQ ID NO: 897730 - DNA, 22 bp, Artificial Sequence
  chemically synthesized
ggctttgaagcctatcctgtta

SEQ ID NO: 897731 - DNA, 22 bp, Artificial Sequence
  chemically synthesized
tgaagcctatcctgttaaccac

SEQ ID NO: 897732 - DNA, 22 bp, Artificial Sequence
  chemically synthesized
gaagcctatcctgttaaccact

SEQ ID NO: 897733 - DNA, 22 bp, Artificial Sequence
  chemically synthesized
aagcctatcctgttaaccactg

SEQ ID NO: 897734 - DNA, 22 bp, Artificial Sequence
  chemically synthesized
tcctgttaaccactgtactatt

SEQ ID NO: 897735 - DNA, 22 bp, Artificial Sequence
  chemically synthesized
ttaaccactgtactattttacc

SEQ ID NO: 897736 - DNA, 22 bp, Artificial Sequence
  chemically synthesized
aagggaatgagaggtaaaatag

SEQ ID NO: 897737 - DNA, 22 bp, Artificial Sequence
  chemically synthesized
accactgtactattttacctct

SEQ ID NO: 897738 - DNA, 22 bp, Artificial Sequence
  chemically synthesized
tactattttacctctcattccc

SEQ ID NO: 897739 - DNA, 22 bp, Artificial Sequence
  chemically synthesized
ttttacctctcattccctttag

SEQ ID NO: 897740 - DNA, 22 bp, Artificial Sequence
  chemically synthesized
aaagtcatatagctaaagggaa

SEQ ID NO: 897741 - DNA, 22 bp, Artificial Sequence
  chemically synthesized
tcaaagtcatatagctaaaggg

SEQ ID NO: 897742 - DNA, 22 bp, Artificial Sequence
  chemically synthesized
tacctctcattccctttagcta

SEQ ID NO: 897743 - DNA, 22 bp, Artificial Sequence
  chemically synthesized
ctcaaagtcatatagctaaagg

SEQ ID NO: 897744 - DNA, 22 bp, Artificial Sequence
  chemically synthesized
acctctcattccctttagctat

SEQ ID NO: 897745 - DNA, 22 bp, Artificial Sequence
  chemically synthesized
tctcaaagtcatatagctaaag

SEQ ID NO: 897746 - DNA, 22 bp, Artificial Sequence
  chemically synthesized
cctctcattccctttagctata

SEQ ID NO: 897747 - DNA, 22 bp, Artificial Sequence
  chemically synthesized
tcattccctttagctatatgac

SEQ ID NO: 897748 - DNA, 22 bp, Artificial Sequence
  chemically synthesized
attccctttagctatatgactt

SEQ ID NO: 897749 - DNA, 22 bp, Artificial Sequence
  chemically synthesized
cctttagctatatgactttgag

SEQ ID NO: 897750 - DNA, 22 bp, Artificial Sequence
  chemically synthesized
atatagtatattttctcaaagt

SEQ ID NO: 897751 - DNA, 22 bp, Artificial Sequence
  chemically synthesized
tagctatatgactttgagaaaa

SEQ ID NO: 897752 - DNA, 22 bp, Artificial Sequence
  chemically synthesized
agctatatgactttgagaaaat

SEQ ID NO: 897753 - DNA, 22 bp, Artificial Sequence
  chemically synthesized
gctatatgactttgagaaaata

SEQ ID NO: 897754 - DNA, 22 bp, Artificial Sequence
  chemically synthesized
cactcatatagtatattttctc

SEQ ID NO: 897755 - DNA, 22 bp, Artificial Sequence
  chemically synthesized
gcactcatatagtatattttct

SEQ ID NO: 897756 - DNA, 22 bp, Artificial Sequence
  chemically synthesized
tgcactcatatagtatattttc

SEQ ID NO: 897757 - DNA, 22 bp, Artificial Sequence
  chemically synthesized
tatgactttgagaaaatatact

SEQ ID NO: 897758 - DNA, 22 bp, Artificial Sequence
  chemically synthesized
ttgcactcatatagtatatttt

SEQ ID NO: 897759 - DNA, 22 bp, Artificial Sequence
  chemically synthesized
ttttgcactcatatagtatatt

SEQ ID NO: 897760 - DNA, 22 bp, Artificial Sequence
  chemically synthesized
cttttgcactcatatagtatat

SEQ ID NO: 897761 - DNA, 22 bp, Artificial Sequence
  chemically synthesized
tgagaaaatatactatatgagt

SEQ ID NO: 897762 - DNA, 22 bp, Artificial Sequence
  chemically synthesized
gagaaaatatactatatgagtg

SEQ ID NO: 897763 - DNA, 22 bp, Artificial Sequence
  chemically synthesized
agaaaatatactatatgagtgc

SEQ ID NO: 897764 - DNA, 22 bp, Artificial Sequence
  chemically synthesized
tatgagtgcaaaagaaggtttg

SEQ ID NO: 897765 - DNA, 22 bp, Artificial Sequence
  chemically synthesized
tgtaaacaaaaagcaaaccttc

SEQ ID NO: 897766 - DNA, 22 bp, Artificial Sequence
  chemically synthesized
tgaaattgtgtaaacaaaaagc

SEQ ID NO: 897767 - DNA, 22 bp, Artificial Sequence
  chemically synthesized
gtgaaattgtgtaaacaaaaag

SEQ ID NO: 897768 - DNA, 22 bp, Artificial Sequence
  chemically synthesized
tgtgaaattgtgtaaacaaaaa

SEQ ID NO: 897769 - DNA, 22 bp, Artificial Sequence
  chemically synthesized
ttttgtgaaattgtgtaaacaa

SEQ ID NO: 897770 - DNA, 22 bp, Artificial Sequence
  chemically synthesized
attttgtgaaattgtgtaaaca

SEQ ID NO: 897771 - DNA, 22 bp, Artificial Sequence
  chemically synthesized
gctttttgtttacacaatttca

SEQ ID NO: 897772 - DNA, 22 bp, Artificial Sequence
  chemically synthesized
ctttttgtttacacaatttcac

SEQ ID NO: 897773 - DNA, 22 bp, Artificial Sequence
  chemically synthesized
aaggaatttattttgtgaaatt

SEQ ID NO: 897774 - DNA, 22 bp, Artificial Sequence
  chemically synthesized
tttgtttacacaatttcacaaa

SEQ ID NO: 897775 - DNA, 22 bp, Artificial Sequence
  chemically synthesized
ttgtttacacaatttcacaaaa

SEQ ID NO: 897776 - DNA, 22 bp, Artificial Sequence
  chemically synthesized
tgtttacacaatttcacaaaat

SEQ ID NO: 897777 - DNA, 22 bp, Artificial Sequence
  chemically synthesized
gtttacacaatttcacaaaata

SEQ ID NO: 897778 - DNA, 22 bp, Artificial Sequence
  chemically synthesized
tttacacaatttcacaaaataa

SEQ ID NO: 897779 - DNA, 22 bp, Artificial Sequence
  chemically synthesized
acacaatttcacaaaataaatt

SEQ ID NO: 897780 - DNA, 22 bp, Artificial Sequence
  chemically synthesized
cacaatttcacaaaataaattc

SEQ ID NO: 897781 - DNA, 22 bp, Artificial Sequence
  chemically synthesized
cagtcagtacctaaaggaattt

SEQ ID NO: 897782 - DNA, 22 bp, Artificial Sequence
  chemically synthesized
cacaaaataaattcctttaggt

SEQ ID NO: 897783 - DNA, 22 bp, Artificial Sequence
  chemically synthesized
acaaaataaattcctttaggta

SEQ ID NO: 897784 - DNA, 22 bp, Artificial Sequence
  chemically synthesized
tagtaagctccagtcagtacct

SEQ ID NO: 897785 - DNA, 22 bp, Artificial Sequence
  chemically synthesized
ctttaggtactgactggagctt

SEQ ID NO: 897786 - DNA, 22 bp, Artificial Sequence
  chemically synthesized
taggtactgactggagcttact

SEQ ID NO: 897787 - DNA, 22 bp, Artificial Sequence
  chemically synthesized
tgaagaaattgtagtaagctcc

SEQ ID NO: 897788 - DNA, 22 bp, Artificial Sequence
  chemically synthesized
aggtactgactggagcttacta

SEQ ID NO: 897789 - DNA, 22 bp, Artificial Sequence
  chemically synthesized
ggtactgactggagcttactac

SEQ ID NO: 897790 - DNA, 22 bp, Artificial Sequence
  chemically synthesized
aaagttatgaagaaattgtagt

SEQ ID NO: 897791 - DNA, 22 bp, Artificial Sequence
  chemically synthesized
caaagttatgaagaaattgtag

SEQ ID NO: 897792 - DNA, 22 bp, Artificial Sequence
  chemically synthesized
actggagcttactacaatttct

SEQ ID NO: 897793 - DNA, 22 bp, Artificial Sequence
  chemically synthesized
tcaaagttatgaagaaattgta

SEQ ID NO: 897794 - DNA, 22 bp, Artificial Sequence
  chemically synthesized
ctttcaaagttatgaagaaatt

SEQ ID NO: 897795 - DNA, 22 bp, Artificial Sequence
  chemically synthesized
gagcttactacaatttcttcat

SEQ ID NO: 897796 - DNA, 22 bp, Artificial Sequence
  chemically synthesized
actttcaaagttatgaagaaat

SEQ ID NO: 897797 - DNA, 22 bp, Artificial Sequence
  chemically synthesized
actacaatttcttcataacttt

SEQ ID NO: 897798 - DNA, 22 bp, Artificial Sequence
  chemically synthesized
ctacaatttcttcataactttg

SEQ ID NO: 897799 - DNA, 22 bp, Artificial Sequence
  chemically synthesized
caatttcttcataactttgaaa

SEQ ID NO: 897800 - DNA, 22 bp, Artificial Sequence
  chemically synthesized
tcatcccacttactttcaaagt

SEQ ID NO: 897801 - DNA, 22 bp, Artificial Sequence
  chemically synthesized
tatcatcccacttactttcaaa

SEQ ID NO: 897802 - DNA, 22 bp, Artificial Sequence
  chemically synthesized
cttcataactttgaaagtaagt

SEQ ID NO: 897803 - DNA, 22 bp, Artificial Sequence
  chemically synthesized
ttcataactttgaaagtaagtg

SEQ ID NO: 897804 - DNA, 22 bp, Artificial Sequence
  chemically synthesized
cataactttgaaagtaagtggg

SEQ ID NO: 897805 - DNA, 22 bp, Artificial Sequence
  chemically synthesized
ataactttgaaagtaagtggga

SEQ ID NO: 897806 - DNA, 22 bp, Artificial Sequence
  chemically synthesized
tgaaagtaagtgggatgataga

SEQ ID NO: 897807 - DNA, 22 bp, Artificial Sequence
  chemically synthesized
gaaagtaagtgggatgatagag

SEQ ID NO: 897808 - DNA, 22 bp, Artificial Sequence
  chemically synthesized
aaagtaagtgggatgatagagc

SEQ ID NO: 897809 - DNA, 22 bp, Artificial Sequence
  chemically synthesized
atagtggcaaggaaaatagggc

SEQ ID NO: 897810 - DNA, 22 bp, Artificial Sequence
  chemically synthesized
gatagtggcaaggaaaataggg

SEQ ID NO: 897811 - DNA, 22 bp, Artificial Sequence
  chemically synthesized
aatttgatagtggcaaggaaaa

SEQ ID NO: 897812 - DNA, 22 bp, Artificial Sequence
  chemically synthesized
aaaactgaatttgatagtggca

SEQ ID NO: 897813 - DNA, 22 bp, Artificial Sequence
  chemically synthesized
gaaaactgaatttgatagtggc

SEQ ID NO: 897814 - DNA, 22 bp, Artificial Sequence
  chemically synthesized
tgaaaactgaatttgatagtgg

SEQ ID NO: 897815 - DNA, 22 bp, Artificial Sequence
  chemically synthesized
ttttccttgccactatcaaatt

SEQ ID NO: 897816 - DNA, 22 bp, Artificial Sequence
  chemically synthesized
tccttgccactatcaaattcag

SEQ ID NO: 897817 - DNA, 22 bp, Artificial Sequence
  chemically synthesized
ccttgccactatcaaattcagt

SEQ ID NO: 897818 - DNA, 22 bp, Artificial Sequence
  chemically synthesized
cttgccactatcaaattcagtt

SEQ ID NO: 897819 - DNA, 22 bp, Artificial Sequence
  chemically synthesized
gccactatcaaattcagttttc

SEQ ID NO: 897820 - DNA, 22 bp, Artificial Sequence
  chemically synthesized
ccactatcaaattcagttttca

SEQ ID NO: 897821 - DNA, 22 bp, Artificial Sequence
  chemically synthesized
tcaaattcagttttcaaaactg

SEQ ID NO: 897822 - DNA, 22 bp, Artificial Sequence
  chemically synthesized
agttttcaaaactgccactcat

SEQ ID NO: 897823 - DNA, 22 bp, Artificial Sequence
  chemically synthesized
agcaagagaatcaatgagtggc

SEQ ID NO: 897824 - DNA, 22 bp, Artificial Sequence
  chemically synthesized
aagcaagagaatcaatgagtgg

SEQ ID NO: 897825 - DNA, 22 bp, Artificial Sequence
  chemically synthesized
taagcaagagaatcaatgagtg

SEQ ID NO: 897826 - DNA, 22 bp, Artificial Sequence
  chemically synthesized
tcaaaactgccactcattgatt

SEQ ID NO: 897827 - DNA, 22 bp, Artificial Sequence
  chemically synthesized
caaaactgccactcattgattc

SEQ ID NO: 897828 - DNA, 22 bp, Artificial Sequence
  chemically synthesized
aaaactgccactcattgattct

SEQ ID NO: 897829 - DNA, 22 bp, Artificial Sequence
  chemically synthesized
ccactcattgattctcttgctt

SEQ ID NO: 897830 - DNA, 22 bp, Artificial Sequence
  chemically synthesized
attgattctcttgcttaaaatt

SEQ ID NO: 897831 - DNA, 22 bp, Artificial Sequence
  chemically synthesized
gaaatcagtcacacaattttaa

SEQ ID NO: 897832 - DNA, 22 bp, Artificial Sequence
  chemically synthesized
attctcttgcttaaaattgtgt

SEQ ID NO: 897833 - DNA, 22 bp, Artificial Sequence
  chemically synthesized
ttggaaatcagtcacacaattt

SEQ ID NO: 897834 - DNA, 22 bp, Artificial Sequence
  chemically synthesized
tcttgcttaaaattgtgtgact

SEQ ID NO: 897835 - DNA, 22 bp, Artificial Sequence
  chemically synthesized
ttgcttaaaattgtgtgactga

SEQ ID NO: 897836 - DNA, 22 bp, Artificial Sequence
  chemically synthesized
gcttaaaattgtgtgactgatt

SEQ ID NO: 897837 - DNA, 22 bp, Artificial Sequence
  chemically synthesized
gaggctattggaaatcagtcac

SEQ ID NO: 897838 - DNA, 22 bp, Artificial Sequence
  chemically synthesized
cttaaaattgtgtgactgattt

SEQ ID NO: 897839 - DNA, 22 bp, Artificial Sequence
  chemically synthesized
aaaattgtgtgactgatttcca

SEQ ID NO: 897840 - DNA, 22 bp, Artificial Sequence
  chemically synthesized
aaattgtgtgactgatttccaa

SEQ ID NO: 897841 - DNA, 22 bp, Artificial Sequence
  chemically synthesized
aagaagttggaggctattggaa

SEQ ID NO: 897842 - DNA, 22 bp, Artificial Sequence
  chemically synthesized
tgtgactgatttccaatagcct

SEQ ID NO: 897843 - DNA, 22 bp, Artificial Sequence
  chemically synthesized
atttccaatagcctccaacttc

SEQ ID NO: 897844 - DNA, 22 bp, Artificial Sequence
  chemically synthesized
ccaatagcctccaacttcttta

SEQ ID NO: 897845 - DNA, 22 bp, Artificial Sequence
  chemically synthesized
caatagcctccaacttctttag

SEQ ID NO: 897846 - DNA, 22 bp, Artificial Sequence
  chemically synthesized
gataaaggcaggctaaagaagt

SEQ ID NO: 897847 - DNA, 22 bp, Artificial Sequence
  chemically synthesized
agataaaggcaggctaaagaag

SEQ ID NO: 897848 - DNA, 22 bp, Artificial Sequence
  chemically synthesized
tagataaaggcaggctaaagaa

SEQ ID NO: 897849 - DNA, 22 bp, Artificial Sequence
  chemically synthesized
ttagataaaggcaggctaaaga

SEQ ID NO: 897850 - DNA, 22 bp, Artificial Sequence
  chemically synthesized
tttagataaaggcaggctaaag

SEQ ID NO: 897851 - DNA, 22 bp, Artificial Sequence
  chemically synthesized
caacttctttagcctgccttta

SEQ ID NO: 897852 - DNA, 22 bp, Artificial Sequence
  chemically synthesized
agaaccattttttagataaagg

SEQ ID NO: 897853 - DNA, 22 bp, Artificial Sequence
  chemically synthesized
ctttagcctgcctttatctaaa

SEQ ID NO: 897854 - DNA, 22 bp, Artificial Sequence
  chemically synthesized
tttagcctgcctttatctaaaa

SEQ ID NO: 897855 - DNA, 22 bp, Artificial Sequence
  chemically synthesized
ttaagaaccattttttagataa

SEQ ID NO: 897856 - DNA, 22 bp, Artificial Sequence
  chemically synthesized
tagcctgcctttatctaaaaaa

SEQ ID NO: 897857 - DNA, 22 bp, Artificial Sequence
  chemically synthesized
agcctgcctttatctaaaaaat

SEQ ID NO: 897858 - DNA, 22 bp, Artificial Sequence
  chemically synthesized
gcctgcctttatctaaaaaatg

SEQ ID NO: 897859 - DNA, 22 bp, Artificial Sequence
  chemically synthesized
cctttatctaaaaaatggttct

SEQ ID NO: 897860 - DNA, 22 bp, Artificial Sequence
  chemically synthesized
tatctaaaaaatggttcttaac

SEQ ID NO: 897861 - DNA, 22 bp, Artificial Sequence
  chemically synthesized
atctaaaaaatggttcttaaca

SEQ ID NO: 897862 - DNA, 22 bp, Artificial Sequence
  chemically synthesized
tctaaaaaatggttcttaacaa

SEQ ID NO: 897863 - DNA, 22 bp, Artificial Sequence
  chemically synthesized
aaaaatggttcttaacaatctg

SEQ ID NO: 897864 - DNA, 22 bp, Artificial Sequence
  chemically synthesized
aagaatggaagatagcgtcaga

SEQ ID NO: 897865 - DNA, 22 bp, Artificial Sequence
  chemically synthesized
gaagaatggaagatagcgtcag

SEQ ID NO: 897866 - DNA, 22 bp, Artificial Sequence
  chemically synthesized
ttaacaatctgacgctatcttc

SEQ ID NO: 897867 - DNA, 22 bp, Artificial Sequence
  chemically synthesized
aacaatctgacgctatcttcca

SEQ ID NO: 897868 - DNA, 22 bp, Artificial Sequence
  chemically synthesized
acaatctgacgctatcttccat

SEQ ID NO: 897869 - DNA, 22 bp, Artificial Sequence
  chemically synthesized
ggaagatttgaagaatggaaga

SEQ ID NO: 897870 - DNA, 22 bp, Artificial Sequence
  chemically synthesized
ttaggaagatttgaagaatgga

SEQ ID NO: 897871 - DNA, 22 bp, Artificial Sequence
  chemically synthesized
acgctatcttccattcttcaaa

SEQ ID NO: 897872 - DNA, 22 bp, Artificial Sequence
  chemically synthesized
ttattaggaagatttgaagaat

SEQ ID NO: 897873 - DNA, 22 bp, Artificial Sequence
  chemically synthesized
gttattaggaagatttgaagaa

SEQ ID NO: 897874 - DNA, 22 bp, Artificial Sequence
  chemically synthesized
tgttattaggaagatttgaaga

SEQ ID NO: 897875 - DNA, 22 bp, Artificial Sequence
  chemically synthesized
tcttccattcttcaaatcttcc

SEQ ID NO: 897876 - DNA, 22 bp, Artificial Sequence
  chemically synthesized
ccattcttcaaatcttcctaat

SEQ ID NO: 897877 - DNA, 22 bp, Artificial Sequence
  chemically synthesized
cattcttcaaatcttcctaata

SEQ ID NO: 897878 - DNA, 22 bp, Artificial Sequence
  chemically synthesized
ttcaaatcttcctaataacaaa

SEQ ID NO: 897879 - DNA, 22 bp, Artificial Sequence
  chemically synthesized
caaatcttcctaataacaaagc

SEQ ID NO: 897880 - DNA, 22 bp, Artificial Sequence
  chemically synthesized
aaatcttcctaataacaaagca

SEQ ID NO: 897881 - DNA, 22 bp, Artificial Sequence
  chemically synthesized
cctaataacaaagcacttcttt

SEQ ID NO: 897882 - DNA, 22 bp, Artificial Sequence
  chemically synthesized
ctaataacaaagcacttctttt

SEQ ID NO: 897883 - DNA, 22 bp, Artificial Sequence
  chemically synthesized
ataacaaagcacttcttttggt

SEQ ID NO: 897884 - DNA, 22 bp, Artificial Sequence
  chemically synthesized
cttttggtctgttcctctgaca

SEQ ID NO: 897885 - DNA, 22 bp, Artificial Sequence
  chemically synthesized
ttttggtctgttcctctgacat

SEQ ID NO: 897886 - DNA, 22 bp, Artificial Sequence
  chemically synthesized
ttggtctgttcctctgacattg

SEQ ID NO: 897887 - DNA, 22 bp, Artificial Sequence
  chemically synthesized
tggtctgttcctctgacattgt

SEQ ID NO: 897888 - DNA, 22 bp, Artificial Sequence
  chemically synthesized
atggcagagtacacaatgtcag

SEQ ID NO: 897889 - DNA, 22 bp, Artificial Sequence
  chemically synthesized
ggtctgttcctctgacattgtg

SEQ ID NO: 897890 - DNA, 22 bp, Artificial Sequence
  chemically synthesized
aatggcagagtacacaatgtca

SEQ ID NO: 897891 - DNA, 22 bp, Artificial Sequence
  chemically synthesized
gtctgttcctctgacattgtgt

SEQ ID NO: 897892 - DNA, 22 bp, Artificial Sequence
  chemically synthesized
taatggcagagtacacaatgtc

SEQ ID NO: 897893 - DNA, 22 bp, Artificial Sequence
  chemically synthesized
ttcctctgacattgtgtactct

SEQ ID NO: 897894 - DNA, 22 bp, Artificial Sequence
  chemically synthesized
ctctgacattgtgtactctgcc

SEQ ID NO: 897895 - DNA, 22 bp, Artificial Sequence
  chemically synthesized
tgacattgtgtactctgccatt

SEQ ID NO: 897896 - DNA, 22 bp, Artificial Sequence
  chemically synthesized
acattgtgtactctgccattaa

SEQ ID NO: 897897 - DNA, 22 bp, Artificial Sequence
  chemically synthesized
agggaaaagaagacattttaat

SEQ ID NO: 897898 - DNA, 22 bp, Artificial Sequence
  chemically synthesized
tgtactctgccattaaaatgtc

SEQ ID NO: 897899 - DNA, 22 bp, Artificial Sequence
  chemically synthesized
ttgagggaaaagaagacatttt

SEQ ID NO: 897900 - DNA, 22 bp, Artificial Sequence
  chemically synthesized
attgagggaaaagaagacattt

SEQ ID NO: 897901 - DNA, 22 bp, Artificial Sequence
  chemically synthesized
tattgagggaaaagaagacatt

SEQ ID NO: 897902 - DNA, 22 bp, Artificial Sequence
  chemically synthesized
tgccattaaaatgtcttctttt

SEQ ID NO: 897903 - DNA, 22 bp, Artificial Sequence
  chemically synthesized
ccattaaaatgtcttcttttcc

SEQ ID NO: 897904 - DNA, 22 bp, Artificial Sequence
  chemically synthesized
aaatgtcttcttttccctcaat

SEQ ID NO: 897905 - DNA, 22 bp, Artificial Sequence
  chemically synthesized
cttttccctcaataaaatatct

SEQ ID NO: 897906 - DNA, 22 bp, Artificial Sequence
  chemically synthesized
ttttccctcaataaaatatctc

SEQ ID NO: 897907 - DNA, 22 bp, Artificial Sequence
  chemically synthesized
ttccctcaataaaatatctctt

SEQ ID NO: 897908 - DNA, 22 bp, Artificial Sequence
  chemically synthesized
tccctcaataaaatatctcttt

SEQ ID NO: 897909 - DNA, 22 bp, Artificial Sequence
  chemically synthesized
ccctcaataaaatatctctttt

SEQ ID NO: 897910 - DNA, 22 bp, Artificial Sequence
  chemically synthesized
cctcaataaaatatctcttttc

SEQ ID NO: 897911 - DNA, 22 bp, Artificial Sequence
  chemically synthesized
tatgtgtcgataaggaaaagag

SEQ ID NO: 897912 - DNA, 22 bp, Artificial Sequence
  chemically synthesized
atatgtgtcgataaggaaaaga

SEQ ID NO: 897913 - DNA, 22 bp, Artificial Sequence
  chemically synthesized
aataaaatatctcttttcctta

SEQ ID NO: 897914 - DNA, 22 bp, Artificial Sequence
  chemically synthesized
tatatgtgtcgataaggaaaag

SEQ ID NO: 897915 - DNA, 22 bp, Artificial Sequence
  chemically synthesized
ggaagagttttatatgtgtcga

SEQ ID NO: 897916 - DNA, 22 bp, Artificial Sequence
  chemically synthesized
ttttccttatcgacacatataa

SEQ ID NO: 897917 - DNA, 22 bp, Artificial Sequence
  chemically synthesized
ttccttatcgacacatataaaa

SEQ ID NO: 897918 - DNA, 22 bp, Artificial Sequence
  chemically synthesized
tccttatcgacacatataaaac

SEQ ID NO: 897919 - DNA, 22 bp, Artificial Sequence
  chemically synthesized
ccttatcgacacatataaaact

SEQ ID NO: 897920 - DNA, 22 bp, Artificial Sequence
  chemically synthesized
cttatcgacacatataaaactc

SEQ ID NO: 897921 - DNA, 22 bp, Artificial Sequence
  chemically synthesized
atcgacacatataaaactcttc

SEQ ID NO: 897922 - DNA, 22 bp, Artificial Sequence
  chemically synthesized
tcgacacatataaaactcttcc

SEQ ID NO: 897923 - DNA, 22 bp, Artificial Sequence
  chemically synthesized
cccaaaacatgaaggattggga

SEQ ID NO: 897924 - DNA, 22 bp, Artificial Sequence
  chemically synthesized
ttacccaaaacatgaaggattg

SEQ ID NO: 897925 - DNA, 22 bp, Artificial Sequence
  chemically synthesized
attacccaaaacatgaaggatt

SEQ ID NO: 897926 - DNA, 22 bp, Artificial Sequence
  chemically synthesized
tattacccaaaacatgaaggat

SEQ ID NO: 897927 - DNA, 22 bp, Artificial Sequence
  chemically synthesized
ttattacccaaaacatgaagga

SEQ ID NO: 897928 - DNA, 22 bp, Artificial Sequence
  chemically synthesized
ttcccaatccttcatgttttgg

SEQ ID NO: 897929 - DNA, 22 bp, Artificial Sequence
  chemically synthesized
cccaatccttcatgttttgggt

SEQ ID NO: 897930 - DNA, 22 bp, Artificial Sequence
  chemically synthesized
ccaatccttcatgttttgggta

SEQ ID NO: 897931 - DNA, 22 bp, Artificial Sequence
  chemically synthesized
aggaggtggaacttttattacc

SEQ ID NO: 897932 - DNA, 22 bp, Artificial Sequence
  chemically synthesized
tgaggaggtggaacttttatta

SEQ ID NO: 897933 - DNA, 22 bp, Artificial Sequence
  chemically synthesized
catgttttgggtaataaaagtt

SEQ ID NO: 897934 - DNA, 22 bp, Artificial Sequence
  chemically synthesized
atgttttgggtaataaaagttc

SEQ ID NO: 897935 - DNA, 22 bp, Artificial Sequence
  chemically synthesized
tctgaggaggtggaacttttat

SEQ ID NO: 897936 - DNA, 22 bp, Artificial Sequence
  chemically synthesized
ctctgaggaggtggaactttta

SEQ ID NO: 897937 - DNA, 22 bp, Artificial Sequence
  chemically synthesized
tgggtaataaaagttccacctc

SEQ ID NO: 897938 - DNA, 22 bp, Artificial Sequence
  chemically synthesized
gggtaataaaagttccacctcc

SEQ ID NO: 897939 - DNA, 22 bp, Artificial Sequence
  chemically synthesized
ggtaataaaagttccacctcct

SEQ ID NO: 897940 - DNA, 22 bp, Artificial Sequence
  chemically synthesized
agcaatcttctctgaggaggtg

SEQ ID NO: 897941 - DNA, 22 bp, Artificial Sequence
  chemically synthesized
cagagggattaagcaatcttct

SEQ ID NO: 897942 - DNA, 22 bp, Artificial Sequence
  chemically synthesized
cacctcctcagagaagattgct

SEQ ID NO: 897943 - DNA, 22 bp, Artificial Sequence
  chemically synthesized
ccagagggattaagcaatcttc

SEQ ID NO: 897944 - DNA, 22 bp, Artificial Sequence
  chemically synthesized
cttccagagggattaagcaatc

SEQ ID NO: 897945 - DNA, 22 bp, Artificial Sequence
  chemically synthesized
ccttccagagggattaagcaat

SEQ ID NO: 897946 - DNA, 22 bp, Artificial Sequence
  chemically synthesized
ctcagagaagattgcttaatcc

SEQ ID NO: 897947 - DNA, 22 bp, Artificial Sequence
  chemically synthesized
tttccttccagagggattaagc

SEQ ID NO: 897948 - DNA, 22 bp, Artificial Sequence
  chemically synthesized
agagaagattgcttaatccctc

SEQ ID NO: 897949 - DNA, 22 bp, Artificial Sequence
  chemically synthesized
cttaatccctctggaaggaaat

SEQ ID NO: 897950 - DNA, 22 bp, Artificial Sequence
  chemically synthesized
gatagaatcattatttccttcc

SEQ ID NO: 897951 - DNA, 22 bp, Artificial Sequence
  chemically synthesized
aatccctctggaaggaaataat

SEQ ID NO: 897952 - DNA, 22 bp, Artificial Sequence
  chemically synthesized
ttagatagaatcattatttcct

SEQ ID NO: 897953 - DNA, 22 bp, Artificial Sequence
  chemically synthesized
atccctctggaaggaaataatg

SEQ ID NO: 897954 - DNA, 22 bp, Artificial Sequence
  chemically synthesized
attagatagaatcattatttcc

SEQ ID NO: 897955 - DNA, 22 bp, Artificial Sequence
  chemically synthesized
gagtttattagatagaatcatt

SEQ ID NO: 897956 - DNA, 22 bp, Artificial Sequence
  chemically synthesized
tggaaggaaataatgattctat

SEQ ID NO: 897957 - DNA, 22 bp, Artificial Sequence
  chemically synthesized
gaaggaaataatgattctatct

SEQ ID NO: 897958 - DNA, 22 bp, Artificial Sequence
  chemically synthesized
atgctagagtttattagataga

SEQ ID NO: 897959 - DNA, 22 bp, Artificial Sequence
  chemically synthesized
tatctaataaactctagcatta

SEQ ID NO: 897960 - DNA, 22 bp, Artificial Sequence
  chemically synthesized
tctaataaactctagcattaat

SEQ ID NO: 897961 - DNA, 22 bp, Artificial Sequence
  chemically synthesized
ataaactctagcattaattacc

SEQ ID NO: 897962 - DNA, 22 bp, Artificial Sequence
  chemically synthesized
atgaagtagcccaggtaattaa

SEQ ID NO: 897963 - DNA, 22 bp, Artificial Sequence
  chemically synthesized
tagcattaattacctgggctac

SEQ ID NO: 897964 - DNA, 22 bp, Artificial Sequence
  chemically synthesized
gcattaattacctgggctactt

SEQ ID NO: 897965 - DNA, 22 bp, Artificial Sequence
  chemically synthesized
acggtgtctaatgaagtagccc

SEQ ID NO: 897966 - DNA, 22 bp, Artificial Sequence
  chemically synthesized
attacctgggctacttcattag

SEQ ID NO: 897967 - DNA, 22 bp, Artificial Sequence
  chemically synthesized
cctgggctacttcattagacac

SEQ ID NO: 897968 - DNA, 22 bp, Artificial Sequence
  chemically synthesized
ggctacttcattagacaccgtc

SEQ ID NO: 897969 - DNA, 22 bp, Artificial Sequence
  chemically synthesized
cttcattagacaccgtcagtta

SEQ ID NO: 897970 - DNA, 22 bp, Artificial Sequence
  chemically synthesized
cattagacaccgtcagttatta

SEQ ID NO: 897971 - DNA, 22 bp, Artificial Sequence
  chemically synthesized
attagacaccgtcagttattac

SEQ ID NO: 897972 - DNA, 22 bp, Artificial Sequence
  chemically synthesized
gacaccgtcagttattactttt

SEQ ID NO: 897973 - DNA, 22 bp, Artificial Sequence
  chemically synthesized
gaagagaacagtaaaataaaga

SEQ ID NO: 897974 - DNA, 22 bp, Artificial Sequence
  chemically synthesized
ttacttttttctttattttact

SEQ ID NO: 897975 - DNA, 22 bp, Artificial Sequence
  chemically synthesized
cttttttctttattttactgtt

SEQ ID NO: 897976 - DNA, 22 bp, Artificial Sequence
  chemically synthesized
ttttctttattttactgttctc

SEQ ID NO: 897977 - DNA, 22 bp, Artificial Sequence
  chemically synthesized
tttctttattttactgttctct

SEQ ID NO: 897978 - DNA, 22 bp, Artificial Sequence
  chemically synthesized
ttctttattttactgttctctt

SEQ ID NO: 897979 - DNA, 22 bp, Artificial Sequence
  chemically synthesized
tctttattttactgttctcttc

SEQ ID NO: 897980 - DNA, 22 bp, Artificial Sequence
  chemically synthesized
ctttattttactgttctcttcc

SEQ ID NO: 897981 - DNA, 22 bp, Artificial Sequence
  chemically synthesized
tttattttactgttctcttcca

SEQ ID NO: 897982 - DNA, 22 bp, Artificial Sequence
  chemically synthesized
tattttactgttctcttccaac

SEQ ID NO: 897983 - DNA, 22 bp, Artificial Sequence
  chemically synthesized
attttactgttctcttccaact

SEQ ID NO: 897984 - DNA, 22 bp, Artificial Sequence
  chemically synthesized
ttttactgttctcttccaactt

SEQ ID NO: 897985 - DNA, 22 bp, Artificial Sequence
  chemically synthesized
tactgttctcttccaacttatg

SEQ ID NO: 897986 - DNA, 22 bp, Artificial Sequence
  chemically synthesized
actgttctcttccaacttatgt

SEQ ID NO: 897987 - DNA, 22 bp, Artificial Sequence
  chemically synthesized
ctgttctcttccaacttatgtc

SEQ ID NO: 897988 - DNA, 22 bp, Artificial Sequence
  chemically synthesized
ttctcttccaacttatgtcttc

SEQ ID NO: 897989 - DNA, 22 bp, Artificial Sequence
  chemically synthesized
tcttccaacttatgtcttcttt

SEQ ID NO: 897990 - DNA, 22 bp, Artificial Sequence
  chemically synthesized
ttccaacttatgtcttctttct

SEQ ID NO: 897991 - DNA, 22 bp, Artificial Sequence
  chemically synthesized
ccaacttatgtcttctttcttc

SEQ ID NO: 897992 - DNA, 22 bp, Artificial Sequence
  chemically synthesized
caacttatgtcttctttcttct

SEQ ID NO: 897993 - DNA, 22 bp, Artificial Sequence
  chemically synthesized
gggagagacaagagaagaaaga

SEQ ID NO: 897994 - DNA, 22 bp, Artificial Sequence
  chemically synthesized
ggggagagacaagagaagaaag

SEQ ID NO: 897995 - DNA, 22 bp, Artificial Sequence
  chemically synthesized
tggggagagacaagagaagaaa

SEQ ID NO: 897996 - DNA, 22 bp, Artificial Sequence
  chemically synthesized
ttggggagagacaagagaagaa

SEQ ID NO: 897997 - DNA, 22 bp, Artificial Sequence
  chemically synthesized
atgtcttctttcttctcttgtc

SEQ ID NO: 897998 - DNA, 22 bp, Artificial Sequence
  chemically synthesized
tgtcttctttcttctcttgtct

SEQ ID NO: 897999 - DNA, 22 bp, Artificial Sequence
  chemically synthesized
gcttttggggagagacaagaga

SEQ ID NO: 898000 - DNA, 22 bp, Artificial Sequence
  chemically synthesized
tagcttttggggagagacaaga

SEQ ID NO: 898001 - DNA, 22 bp, Artificial Sequence
  chemically synthesized
ctttcttctcttgtctctcccc

SEQ ID NO: 898002 - DNA, 22 bp, Artificial Sequence
  chemically synthesized
tttcttctcttgtctctcccca

SEQ ID NO: 898003 - DNA, 22 bp, Artificial Sequence
  chemically synthesized
tcttctcttgtctctccccaaa

SEQ ID NO: 898004 - DNA, 22 bp, Artificial Sequence
  chemically synthesized
cttctcttgtctctccccaaaa

SEQ ID NO: 898005 - DNA, 22 bp, Artificial Sequence
  chemically synthesized
ttctcttgtctctccccaaaag

SEQ ID NO: 898006 - DNA, 22 bp, Artificial Sequence
  chemically synthesized
ctcttgtctctccccaaaagct

SEQ ID NO: 898007 - DNA, 22 bp, Artificial Sequence
  chemically synthesized
tcttgtctctccccaaaagcta

SEQ ID NO: 898008 - DNA, 22 bp, Artificial Sequence
  chemically synthesized
ttgtctctccccaaaagctaga

SEQ ID NO: 898009 - DNA, 22 bp, Artificial Sequence
  chemically synthesized
gtctctccccaaaagctagaat

SEQ ID NO: 898010 - DNA, 22 bp, Artificial Sequence
  chemically synthesized
tctctccccaaaagctagaata

SEQ ID NO: 898011 - DNA, 22 bp, Artificial Sequence
  chemically synthesized
tgtgtatgtgtgagtattctag

SEQ ID NO: 898012 - DNA, 22 bp, Artificial Sequence
  chemically synthesized
tccccaaaagctagaatactca

SEQ ID NO: 898013 - DNA, 22 bp, Artificial Sequence
  chemically synthesized
cccaaaagctagaatactcaca

SEQ ID NO: 898014 - DNA, 22 bp, Artificial Sequence
  chemically synthesized
tggctgtgtgtatgtgtgagta

SEQ ID NO: 898015 - DNA, 22 bp, Artificial Sequence
  chemically synthesized
aattgtggctgtgtgtatgtgt

SEQ ID NO: 898016 - DNA, 22 bp, Artificial Sequence
  chemically synthesized
gaatactcacacatacacacag

SEQ ID NO: 898017 - DNA, 22 bp, Artificial Sequence
  chemically synthesized
acacatacacacagccacaatt

SEQ ID NO: 898018 - DNA, 22 bp, Artificial Sequence
  chemically synthesized
acggtatataaagatgtaaaat

SEQ ID NO: 898019 - DNA, 22 bp, Artificial Sequence
  chemically synthesized
ctaacggtatataaagatgtaa

SEQ ID NO: 898020 - DNA, 22 bp, Artificial Sequence
  chemically synthesized
aattttacatctttatataccg

SEQ ID NO: 898021 - DNA, 22 bp, Artificial Sequence
  chemically synthesized
tacatctttatataccgttagt

SEQ ID NO: 898022 - DNA, 22 bp, Artificial Sequence
  chemically synthesized
acatctttatataccgttagta

SEQ ID NO: 898023 - DNA, 22 bp, Artificial Sequence
  chemically synthesized
catctttatataccgttagtaa

SEQ ID NO: 898024 - DNA, 22 bp, Artificial Sequence
  chemically synthesized
tatcatgtaagaaaagttacta

SEQ ID NO: 898025 - DNA, 22 bp, Artificial Sequence
  chemically synthesized
tatataccgttagtaacttttc

SEQ ID NO: 898026 - DNA, 22 bp, Artificial Sequence
  chemically synthesized
atataccgttagtaacttttct

SEQ ID NO: 898027 - DNA, 22 bp, Artificial Sequence
  chemically synthesized
tataccgttagtaacttttctt

SEQ ID NO: 898028 - DNA, 22 bp, Artificial Sequence
  chemically synthesized
acaaatgctatatcatgtaaga

SEQ ID NO: 898029 - DNA, 22 bp, Artificial Sequence
  chemically synthesized
aacaaatgctatatcatgtaag

SEQ ID NO: 898030 - DNA, 22 bp, Artificial Sequence
  chemically synthesized
gtaacttttcttacatgatata

SEQ ID NO: 898031 - DNA, 22 bp, Artificial Sequence
  chemically synthesized
atttaacaaatgctatatcatg

SEQ ID NO: 898032 - DNA, 22 bp, Artificial Sequence
  chemically synthesized
ttcatttaacaaatgctatatc

SEQ ID NO: 898033 - DNA, 22 bp, Artificial Sequence
  chemically synthesized
ttcttacatgatatagcatttg

SEQ ID NO: 898034 - DNA, 22 bp, Artificial Sequence
  chemically synthesized
tcttacatgatatagcatttgt

SEQ ID NO: 898035 - DNA, 22 bp, Artificial Sequence
  chemically synthesized
cttacatgatatagcatttgtt

SEQ ID NO: 898036 - DNA, 22 bp, Artificial Sequence
  chemically synthesized
ttacatgatatagcatttgtta

SEQ ID NO: 898037 - DNA, 22 bp, Artificial Sequence
  chemically synthesized
acatgatatagcatttgttaaa

SEQ ID NO: 898038 - DNA, 22 bp, Artificial Sequence
  chemically synthesized
tatgattgttcatttaacaaat

SEQ ID NO: 898039 - DNA, 22 bp, Artificial Sequence
  chemically synthesized
catgatatagcatttgttaaat

SEQ ID NO: 898040 - DNA, 22 bp, Artificial Sequence
  chemically synthesized
gtatgattgttcatttaacaaa

SEQ ID NO: 898041 - DNA, 22 bp, Artificial Sequence
  chemically synthesized
tgtatgattgttcatttaacaa

SEQ ID NO: 898042 - DNA, 22 bp, Artificial Sequence
  chemically synthesized
ttttgtatgattgttcatttaa

SEQ ID NO: 898043 - DNA, 22 bp, Artificial Sequence
  chemically synthesized
attgttttgtatgattgttcat

SEQ ID NO: 898044 - DNA, 22 bp, Artificial Sequence
  chemically synthesized
gttaaatgaacaatcatacaaa

SEQ ID NO: 898045 - DNA, 22 bp, Artificial Sequence
  chemically synthesized
ttaaatgaacaatcatacaaaa

SEQ ID NO: 898046 - DNA, 22 bp, Artificial Sequence
  chemically synthesized
aatgaacaatcatacaaaacaa

SEQ ID NO: 898047 - DNA, 22 bp, Artificial Sequence
  chemically synthesized
gcgaatgattgattgttttgta

SEQ ID NO: 898048 - DNA, 22 bp, Artificial Sequence
  chemically synthesized
ttagcgaatgattgattgtttt

SEQ ID NO: 898049 - DNA, 22 bp, Artificial Sequence
  chemically synthesized
attagcgaatgattgattgttt

SEQ ID NO: 898050 - DNA, 22 bp, Artificial Sequence
  chemically synthesized
tattagcgaatgattgattgtt

SEQ ID NO: 898051 - DNA, 22 bp, Artificial Sequence
  chemically synthesized
ttttattagcgaatgattgatt

SEQ ID NO: 898052 - DNA, 22 bp, Artificial Sequence
  chemically synthesized
tgttttattagcgaatgattga

SEQ ID NO: 898053 - DNA, 22 bp, Artificial Sequence
  chemically synthesized
ctgttttattagcgaatgattg

SEQ ID NO: 898054 - DNA, 22 bp, Artificial Sequence
  chemically synthesized
tctgttttattagcgaatgatt

SEQ ID NO: 898055 - DNA, 22 bp, Artificial Sequence
  chemically synthesized
ttctgttttattagcgaatgat

SEQ ID NO: 898056 - DNA, 22 bp, Artificial Sequence
  chemically synthesized
ttttctgttttattagcgaatg

SEQ ID NO: 898057 - DNA, 22 bp, Artificial Sequence
  chemically synthesized
tcttttctgttttattagcgaa

SEQ ID NO: 898058 - DNA, 22 bp, Artificial Sequence
  chemically synthesized
ctcttttctgttttattagcga

SEQ ID NO: 898059 - DNA, 22 bp, Artificial Sequence
  chemically synthesized
ccttctcttttctgttttatta

SEQ ID NO: 898060 - DNA, 22 bp, Artificial Sequence
  chemically synthesized
accttctcttttctgttttatt

SEQ ID NO: 898061 - DNA, 22 bp, Artificial Sequence
  chemically synthesized
ggagatttaccttctcttttct

SEQ ID NO: 898062 - DNA, 22 bp, Artificial Sequence
  chemically synthesized
gctaataaaacagaaaagagaa

SEQ ID NO: 898063 - DNA, 22 bp, Artificial Sequence
  chemically synthesized
aggagatttaccttctcttttc

SEQ ID NO: 898064 - DNA, 22 bp, Artificial Sequence
  chemically synthesized
taggagatttaccttctctttt

SEQ ID NO: 898065 - DNA, 22 bp, Artificial Sequence
  chemically synthesized
ttaggagatttaccttctcttt

SEQ ID NO: 898066 - DNA, 22 bp, Artificial Sequence
  chemically synthesized
ataaaacagaaaagagaaggta

SEQ ID NO: 898067 - DNA, 22 bp, Artificial Sequence
  chemically synthesized
aaagtgtacaagaacataagcg

SEQ ID NO: 898068 - DNA, 22 bp, Artificial Sequence
  chemically synthesized
caaagtgtacaagaacataagc

SEQ ID NO: 898069 - DNA, 22 bp, Artificial Sequence
  chemically synthesized
tcaaagtgtacaagaacataag

SEQ ID NO: 898070 - DNA, 22 bp, Artificial Sequence
  chemically synthesized
ctaaaaacgcttatgttcttgt

SEQ ID NO: 898071 - DNA, 22 bp, Artificial Sequence
  chemically synthesized
aaaacgcttatgttcttgtaca

SEQ ID NO: 898072 - DNA, 22 bp, Artificial Sequence
  chemically synthesized
atgttcttgtacactttgaaaa

SEQ ID NO: 898073 - DNA, 22 bp, Artificial Sequence
  chemically synthesized
tgttcttgtacactttgaaaac

SEQ ID NO: 898074 - DNA, 22 bp, Artificial Sequence
  chemically synthesized
ttgtacactttgaaaacgctta

SEQ ID NO: 898075 - DNA, 22 bp, Artificial Sequence
  chemically synthesized
gtacactttgaaaacgcttatg

SEQ ID NO: 898076 - DNA, 22 bp, Artificial Sequence
  chemically synthesized
tacactttgaaaacgcttatgt

SEQ ID NO: 898077 - DNA, 22 bp, Artificial Sequence
  chemically synthesized
gaaatgtcatgtataaggacat

SEQ ID NO: 898078 - DNA, 22 bp, Artificial Sequence
  chemically synthesized
tgaaaacgcttatgtccttata

SEQ ID NO: 898079 - DNA, 22 bp, Artificial Sequence
  chemically synthesized
gaaaacgcttatgtccttatac

SEQ ID NO: 898080 - DNA, 22 bp, Artificial Sequence
  chemically synthesized
aaaacgcttatgtccttataca

SEQ ID NO: 898081 - DNA, 22 bp, Artificial Sequence
  chemically synthesized
atgtccttatacatgacatttc

SEQ ID NO: 898082 - DNA, 22 bp, Artificial Sequence
  chemically synthesized
tgtccttatacatgacatttcc

SEQ ID NO: 898083 - DNA, 22 bp, Artificial Sequence
  chemically synthesized
aaatgggaaacagagttggaaa

SEQ ID NO: 898084 - DNA, 22 bp, Artificial Sequence
  chemically synthesized
atacatgacatttccaactctg

SEQ ID NO: 898085 - DNA, 22 bp, Artificial Sequence
  chemically synthesized
tacatgacatttccaactctgt

SEQ ID NO: 898086 - DNA, 22 bp, Artificial Sequence
  chemically synthesized
acacatagcctaaaatgggaaa

SEQ ID NO: 898087 - DNA, 22 bp, Artificial Sequence
  chemically synthesized
ccaactctgtttcccattttag

SEQ ID NO: 898088 - DNA, 22 bp, Artificial Sequence
  chemically synthesized
caactctgtttcccattttagg

SEQ ID NO: 898089 - DNA, 22 bp, Artificial Sequence
  chemically synthesized
gatattcacacatagcctaaaa

SEQ ID NO: 898090 - DNA, 22 bp, Artificial Sequence
  chemically synthesized
ggatattcacacatagcctaaa

SEQ ID NO: 898091 - DNA, 22 bp, Artificial Sequence
  chemically synthesized
tgtttcccattttaggctatgt

SEQ ID NO: 898092 - DNA, 22 bp, Artificial Sequence
  chemically synthesized
tttcccattttaggctatgtgt

SEQ ID NO: 898093 - DNA, 22 bp, Artificial Sequence
  chemically synthesized
cccattttaggctatgtgtgaa

SEQ ID NO: 898094 - DNA, 22 bp, Artificial Sequence
  chemically synthesized
ccattttaggctatgtgtgaat

SEQ ID NO: 898095 - DNA, 22 bp, Artificial Sequence
  chemically synthesized
gtgaacttggatattcacacat

SEQ ID NO: 898096 - DNA, 22 bp, Artificial Sequence
  chemically synthesized
tgctagtgaacttggatattca

SEQ ID NO: 898097 - DNA, 22 bp, Artificial Sequence
  chemically synthesized
taggctatgtgtgaatatccaa

SEQ ID NO: 898098 - DNA, 22 bp, Artificial Sequence
  chemically synthesized
aggctatgtgtgaatatccaag

SEQ ID NO: 898099 - DNA, 22 bp, Artificial Sequence
  chemically synthesized
ggctatgtgtgaatatccaagt

SEQ ID NO: 898100 - DNA, 22 bp, Artificial Sequence
  chemically synthesized
actgtgctagtgaacttggata

SEQ ID NO: 898101 - DNA, 22 bp, Artificial Sequence
  chemically synthesized
tgactgtgctagtgaacttgga

SEQ ID NO: 898102 - DNA, 22 bp, Artificial Sequence
  chemically synthesized
tgtgtgaatatccaagttcact

SEQ ID NO: 898103 - DNA, 22 bp, Artificial Sequence
  chemically synthesized
ttctgactgtgctagtgaactt

SEQ ID NO: 898104 - DNA, 22 bp, Artificial Sequence
  chemically synthesized
actagcacagtcagaacaggtg

SEQ ID NO: 898105 - DNA, 22 bp, Artificial Sequence
  chemically synthesized
gcacagtcagaacaggtgttac

SEQ ID NO: 898106 - DNA, 22 bp, Artificial Sequence
  chemically synthesized
gtccagccgccaagtaacacct

SEQ ID NO: 898107 - DNA, 22 bp, Artificial Sequence
  chemically synthesized
actagtccagccgccaagtaac

SEQ ID NO: 898108 - DNA, 22 bp, Artificial Sequence
  chemically synthesized
cactagtccagccgccaagtaa

SEQ ID NO: 898109 - DNA, 22 bp, Artificial Sequence
  chemically synthesized
acatcaaatttcactagtccag

SEQ ID NO: 898110 - DNA, 22 bp, Artificial Sequence
  chemically synthesized
ctcacatcaaatttcactagtc

SEQ ID NO: 898111 - DNA, 22 bp, Artificial Sequence
  chemically synthesized
cttggcggctggactagtgaaa

SEQ ID NO: 898112 - DNA, 22 bp, Artificial Sequence
  chemically synthesized
ggcggctggactagtgaaattt

SEQ ID NO: 898113 - DNA, 22 bp, Artificial Sequence
  chemically synthesized
gcggctggactagtgaaatttg

SEQ ID NO: 898114 - DNA, 22 bp, Artificial Sequence
  chemically synthesized
tattcctcacatcaaatttcac

SEQ ID NO: 898115 - DNA, 22 bp, Artificial Sequence
  chemically synthesized
tgtattcctcacatcaaatttc

SEQ ID NO: 898116 - DNA, 22 bp, Artificial Sequence
  chemically synthesized
ctctgtattcctcacatcaaat

SEQ ID NO: 898117 - DNA, 22 bp, Artificial Sequence
  chemically synthesized
gactagtgaaatttgatgtgag

SEQ ID NO: 898118 - DNA, 22 bp, Artificial Sequence
  chemically synthesized
tactctgtattcctcacatcaa

SEQ ID NO: 898119 - DNA, 22 bp, Artificial Sequence
  chemically synthesized
ctactctgtattcctcacatca

SEQ ID NO: 898120 - DNA, 22 bp, Artificial Sequence
  chemically synthesized
ttctactctgtattcctcacat

SEQ ID NO: 898121 - DNA, 22 bp, Artificial Sequence
  chemically synthesized
gtgaaatttgatgtgaggaata

SEQ ID NO: 898122 - DNA, 22 bp, Artificial Sequence
  chemically synthesized
ccctcttctactctgtattcct

SEQ ID NO: 898123 - DNA, 22 bp, Artificial Sequence
  chemically synthesized
gatgtgaggaatacagagtaga

SEQ ID NO: 898124 - DNA, 22 bp, Artificial Sequence
  chemically synthesized
atgtgaggaatacagagtagaa

SEQ ID NO: 898125 - DNA, 22 bp, Artificial Sequence
  chemically synthesized
aagagggtctaccctcttctac

SEQ ID NO: 898126 - DNA, 22 bp, Artificial Sequence
  chemically synthesized
accctcaagagggtctaccctc

SEQ ID NO: 898127 - DNA, 22 bp, Artificial Sequence
  chemically synthesized
actgaccctcaagagggtctac

SEQ ID NO: 898128 - DNA, 22 bp, Artificial Sequence
  chemically synthesized
gactgaccctcaagagggtcta

SEQ ID NO: 898129 - DNA, 22 bp, Artificial Sequence
  chemically synthesized
ttgactgaccctcaagagggtc

SEQ ID NO: 898130 - DNA, 22 bp, Artificial Sequence
  chemically synthesized
gtcctcttgactgaccctcaag

SEQ ID NO: 898131 - DNA, 22 bp, Artificial Sequence
  chemically synthesized
agtcctcttgactgaccctcaa

SEQ ID NO: 898132 - DNA, 22 bp, Artificial Sequence
  chemically synthesized
cttagtcctcttgactgaccct

SEQ ID NO: 898133 - DNA, 22 bp, Artificial Sequence
  chemically synthesized
ttccttagtcctcttgactgac

SEQ ID NO: 898134 - DNA, 22 bp, Artificial Sequence
  chemically synthesized
attccttagtcctcttgactga

SEQ ID NO: 898135 - DNA, 22 bp, Artificial Sequence
  chemically synthesized
tattccttagtcctcttgactg

SEQ ID NO: 898136 - DNA, 22 bp, Artificial Sequence
  chemically synthesized
ttgagggtcagtcaagaggact

SEQ ID NO: 898137 - DNA, 22 bp, Artificial Sequence
  chemically synthesized
gagggtcagtcaagaggactaa

SEQ ID NO: 898138 - DNA, 22 bp, Artificial Sequence
  chemically synthesized
agggtcagtcaagaggactaag

SEQ ID NO: 898139 - DNA, 22 bp, Artificial Sequence
  chemically synthesized
acagaaaacatatcaagaattt

SEQ ID NO: 898140 - DNA, 22 bp, Artificial Sequence
  chemically synthesized
actaacagaaaacatatcaaga

SEQ ID NO: 898141 - DNA, 22 bp, Artificial Sequence
  chemically synthesized
aggaataaaattcttgatatgt

SEQ ID NO: 898142 - DNA, 22 bp, Artificial Sequence
  chemically synthesized
ttgatatgttttctgttagtta

SEQ ID NO: 898143 - DNA, 22 bp, Artificial Sequence
  chemically synthesized
gatatgttttctgttagttagc

SEQ ID NO: 898144 - DNA, 22 bp, Artificial Sequence
  chemically synthesized
atatgttttctgttagttagct

SEQ ID NO: 898145 - DNA, 22 bp, Artificial Sequence
  chemically synthesized
tctgttagttagcttgatgtca

SEQ ID NO: 898146 - DNA, 22 bp, Artificial Sequence
  chemically synthesized
ctgttagttagcttgatgtcat

SEQ ID NO: 898147 - DNA, 22 bp, Artificial Sequence
  chemically synthesized
tgttagttagcttgatgtcatg

SEQ ID NO: 898148 - DNA, 22 bp, Artificial Sequence
  chemically synthesized
cagccccagaatccatgacatc

SEQ ID NO: 898149 - DNA, 22 bp, Artificial Sequence
  chemically synthesized
ttagttagcttgatgtcatgga

SEQ ID NO: 898150 - DNA, 22 bp, Artificial Sequence
  chemically synthesized
gttagcttgatgtcatggattc

SEQ ID NO: 898151 - DNA, 22 bp, Artificial Sequence
  chemically synthesized
tctccagccccagaatccatga

SEQ ID NO: 898152 - DNA, 22 bp, Artificial Sequence
  chemically synthesized
gcttgatgtcatggattctggg

SEQ ID NO: 898153 - DNA, 22 bp, Artificial Sequence
  chemically synthesized
gccctgtctccagccccagaat

SEQ ID NO: 898154 - DNA, 22 bp, Artificial Sequence
  chemically synthesized
gatgtcatggattctggggctg

SEQ ID NO: 898155 - DNA, 22 bp, Artificial Sequence
  chemically synthesized
atgtcatggattctggggctgg

SEQ ID NO: 898156 - DNA, 22 bp, Artificial Sequence
  chemically synthesized
atacctagccctgtctccagcc

SEQ ID NO: 898157 - DNA, 22 bp, Artificial Sequence
  chemically synthesized
attaatacctagccctgtctcc

SEQ ID NO: 898158 - DNA, 22 bp, Artificial Sequence
  chemically synthesized
tggggctggagacagggctagg

SEQ ID NO: 898159 - DNA, 22 bp, Artificial Sequence
  chemically synthesized
caattaattaatacctagccct

SEQ ID NO: 898160 - DNA, 22 bp, Artificial Sequence
  chemically synthesized
gggctggagacagggctaggta

SEQ ID NO: 898161 - DNA, 22 bp, Artificial Sequence
  chemically synthesized
gtcctgcaattaattaatacct

SEQ ID NO: 898162 - DNA, 22 bp, Artificial Sequence
  chemically synthesized
gagacagggctaggtattaatt

SEQ ID NO: 898163 - DNA, 22 bp, Artificial Sequence
  chemically synthesized
ccactagtcctgcaattaatta

SEQ ID NO: 898164 - DNA, 22 bp, Artificial Sequence
  chemically synthesized
ggtattaattaattgcaggact

SEQ ID NO: 898165 - DNA, 22 bp, Artificial Sequence
  chemically synthesized
cacggatattaccactagtcct

SEQ ID NO: 898166 - DNA, 22 bp, Artificial Sequence
  chemically synthesized
attaattgcaggactagtggta

SEQ ID NO: 898167 - DNA, 22 bp, Artificial Sequence
  chemically synthesized
attacacggatattaccactag

SEQ ID NO: 898168 - DNA, 22 bp, Artificial Sequence
  chemically synthesized
attgcaggactagtggtaatat

SEQ ID NO: 898169 - DNA, 22 bp, Artificial Sequence
  chemically synthesized
aattaattacacggatattacc

SEQ ID NO: 898170 - DNA, 22 bp, Artificial Sequence
  chemically synthesized
caggactagtggtaatatccgt

SEQ ID NO: 898171 - DNA, 22 bp, Artificial Sequence
  chemically synthesized
attgaattaattacacggatat

SEQ ID NO: 898172 - DNA, 22 bp, Artificial Sequence
  chemically synthesized
gtggtaatatccgtgtaattaa

SEQ ID NO: 898173 - DNA, 22 bp, Artificial Sequence
  chemically synthesized
ggtaaatattgattgaattaat

SEQ ID NO: 898174 - DNA, 22 bp, Artificial Sequence
  chemically synthesized
ctaggtaaatattgattgaatt

SEQ ID NO: 898175 - DNA, 22 bp, Artificial Sequence
  chemically synthesized
attcaatcaatatttacctagt

SEQ ID NO: 898176 - DNA, 22 bp, Artificial Sequence
  chemically synthesized
gaacaaaatagctactaggtaa

SEQ ID NO: 898177 - DNA, 22 bp, Artificial Sequence
  chemically synthesized
aatcaatatttacctagtagct

SEQ ID NO: 898178 - DNA, 22 bp, Artificial Sequence
  chemically synthesized
acctagtagctattttgttcca

SEQ ID NO: 898179 - DNA, 22 bp, Artificial Sequence
  chemically synthesized
cctagtagctattttgttccag

SEQ ID NO: 898180 - DNA, 22 bp, Artificial Sequence
  chemically synthesized
gtagctattttgttccagccgc

SEQ ID NO: 898181 - DNA, 22 bp, Artificial Sequence
  chemically synthesized
cagaagcaatacagggcagcgg

SEQ ID NO: 898182 - DNA, 22 bp, Artificial Sequence
  chemically synthesized
ttttgttccagccgctgccctg

SEQ ID NO: 898183 - DNA, 22 bp, Artificial Sequence
  chemically synthesized
tgttccagccgctgccctgtat

SEQ ID NO: 898184 - DNA, 22 bp, Artificial Sequence
  chemically synthesized
gttccagccgctgccctgtatt

SEQ ID NO: 898185 - DNA, 22 bp, Artificial Sequence
  chemically synthesized
ttccagccgctgccctgtattg

SEQ ID NO: 898186 - DNA, 22 bp, Artificial Sequence
  chemically synthesized
cagccgctgccctgtattgctt

SEQ ID NO: 898187 - DNA, 22 bp, Artificial Sequence
  chemically synthesized
agtcaactacagaagcaataca

SEQ ID NO: 898188 - DNA, 22 bp, Artificial Sequence
  chemically synthesized
cagtcaactacagaagcaatac

SEQ ID NO: 898189 - DNA, 22 bp, Artificial Sequence
  chemically synthesized
ccctgtattgcttctgtagttg

SEQ ID NO: 898190 - DNA, 22 bp, Artificial Sequence
  chemically synthesized
tattgcttctgtagttgactga

SEQ ID NO: 898191 - DNA, 22 bp, Artificial Sequence
  chemically synthesized
cttctgtagttgactgaagttg

SEQ ID NO: 898192 - DNA, 22 bp, Artificial Sequence
  chemically synthesized
ctgtagttgactgaagttggcc

SEQ ID NO: 898193 - DNA, 22 bp, Artificial Sequence
  chemically synthesized
tgtagttgactgaagttggcca

SEQ ID NO: 898194 - DNA, 22 bp, Artificial Sequence
  chemically synthesized
tagttgactgaagttggccatt

SEQ ID NO: 898195 - DNA, 22 bp, Artificial Sequence
  chemically synthesized
cacgtagccatacaatggccaa

SEQ ID NO: 898196 - DNA, 22 bp, Artificial Sequence
  chemically synthesized
acacgtagccatacaatggcca

SEQ ID NO: 898197 - DNA, 22 bp, Artificial Sequence
  chemically synthesized
actgaagttggccattgtatgg

SEQ ID NO: 898198 - DNA, 22 bp, Artificial Sequence
  chemically synthesized
gagacttacacgtagccataca

SEQ ID NO: 898199 - DNA, 22 bp, Artificial Sequence
  chemically synthesized
aagttggccattgtatggctac

SEQ ID NO: 898200 - DNA, 22 bp, Artificial Sequence
  chemically synthesized
gcattggagacttacacgtagc

SEQ ID NO: 898201 - DNA, 22 bp, Artificial Sequence
  chemically synthesized
gccattgtatggctacgtgtaa

SEQ ID NO: 898202 - DNA, 22 bp, Artificial Sequence
  chemically synthesized
tatggctacgtgtaagtctcca

SEQ ID NO: 898203 - DNA, 22 bp, Artificial Sequence
  chemically synthesized
cgtgtaagtctccaatgccaat

SEQ ID NO: 898204 - DNA, 22 bp, Artificial Sequence
  chemically synthesized
aaggtagagggatattggcatt

SEQ ID NO: 898205 - DNA, 22 bp, Artificial Sequence
  chemically synthesized
caaggtagagggatattggcat

SEQ ID NO: 898206 - DNA, 22 bp, Artificial Sequence
  chemically synthesized
tcaaggtagagggatattggca

SEQ ID NO: 898207 - DNA, 22 bp, Artificial Sequence
  chemically synthesized
ttttcaaggtagagggatattg

SEQ ID NO: 898208 - DNA, 22 bp, Artificial Sequence
  chemically synthesized
gctattttcaaggtagagggat

SEQ ID NO: 898209 - DNA, 22 bp, Artificial Sequence
  chemically synthesized
agctattttcaaggtagaggga

SEQ ID NO: 898210 - DNA, 22 bp, Artificial Sequence
  chemically synthesized
caatgccaatatccctctacct

SEQ ID NO: 898211 - DNA, 22 bp, Artificial Sequence
  chemically synthesized
tttagctattttcaaggtagag

SEQ ID NO: 898212 - DNA, 22 bp, Artificial Sequence
  chemically synthesized
ttatttagctattttcaaggta

SEQ ID NO: 898213 - DNA, 22 bp, Artificial Sequence
  chemically synthesized
agagtgcgctgttatttagcta

SEQ ID NO: 898214 - DNA, 22 bp, Artificial Sequence
  chemically synthesized
taccttgaaaatagctaaataa

SEQ ID NO: 898215 - DNA, 22 bp, Artificial Sequence
  chemically synthesized
ccttgaaaatagctaaataaca

SEQ ID NO: 898216 - DNA, 22 bp, Artificial Sequence
  chemically synthesized
gaaaatagctaaataacagcgc

SEQ ID NO: 898217 - DNA, 22 bp, Artificial Sequence
  chemically synthesized
aaaatagctaaataacagcgca

SEQ ID NO: 898218 - DNA, 22 bp, Artificial Sequence
  chemically synthesized
aaatgcattcagagtgcgctgt

SEQ ID NO: 898219 - DNA, 22 bp, Artificial Sequence
  chemically synthesized
cctaaaatgcattcagagtgcg

SEQ ID NO: 898220 - DNA, 22 bp, Artificial Sequence
  chemically synthesized
gcctaaaatgcattcagagtgc

SEQ ID NO: 898221 - DNA, 22 bp, Artificial Sequence
  chemically synthesized
aataacagcgcactctgaatgc

SEQ ID NO: 898222 - DNA, 22 bp, Artificial Sequence
  chemically synthesized
ggggcaacagaatatttgccta

SEQ ID NO: 898223 - DNA, 22 bp, Artificial Sequence
  chemically synthesized
tgaatgcattttaggcaaatat

SEQ ID NO: 898224 - DNA, 22 bp, Artificial Sequence
  chemically synthesized
aatgcattttaggcaaatattc

SEQ ID NO: 898225 - DNA, 22 bp, Artificial Sequence
  chemically synthesized
gttgggggcaacagaatatttg

SEQ ID NO: 898226 - DNA, 22 bp, Artificial Sequence
  chemically synthesized
ggttgggggcaacagaatattt

SEQ ID NO: 898227 - DNA, 22 bp, Artificial Sequence
  chemically synthesized
tggttgggggcaacagaatatt

SEQ ID NO: 898228 - DNA, 22 bp, Artificial Sequence
  chemically synthesized
ttggttgggggcaacagaatat

SEQ ID NO: 898229 - DNA, 22 bp, Artificial Sequence
  chemically synthesized
taggcaaatattctgttgcccc

SEQ ID NO: 898230 - DNA, 22 bp, Artificial Sequence
  chemically synthesized
aggcaaatattctgttgccccc

SEQ ID NO: 898231 - DNA, 22 bp, Artificial Sequence
  chemically synthesized
ggcaaatattctgttgccccca

SEQ ID NO: 898232 - DNA, 22 bp, Artificial Sequence
  chemically synthesized
ggggaggtgatttttggttggg

SEQ ID NO: 898233 - DNA, 22 bp, Artificial Sequence
  chemically synthesized
gggggaggtgatttttggttgg

SEQ ID NO: 898234 - DNA, 22 bp, Artificial Sequence
  chemically synthesized
tgttgcccccaaccaaaaatca

SEQ ID NO: 898235 - DNA, 22 bp, Artificial Sequence
  chemically synthesized
atttgggggaggtgatttttgg

SEQ ID NO: 898236 - DNA, 22 bp, Artificial Sequence
  chemically synthesized
ttgcccccaaccaaaaatcacc

SEQ ID NO: 898237 - DNA, 22 bp, Artificial Sequence
  chemically synthesized
ctaatttgggggaggtgatttt

SEQ ID NO: 898238 - DNA, 22 bp, Artificial Sequence
  chemically synthesized
cccccaaccaaaaatcacctcc

SEQ ID NO: 898239 - DNA, 22 bp, Artificial Sequence
  chemically synthesized
gtattactaatttgggggaggt

SEQ ID NO: 898240 - DNA, 22 bp, Artificial Sequence
  chemically synthesized
attggtattactaatttggggg

SEQ ID NO: 898241 - DNA, 22 bp, Artificial Sequence
  chemically synthesized
aattggtattactaatttgggg

SEQ ID NO: 898242 - DNA, 22 bp, Artificial Sequence
  chemically synthesized
tttaattggtattactaatttg

SEQ ID NO: 898243 - DNA, 22 bp, Artificial Sequence
  chemically synthesized
ccccaaattagtaataccaatt

SEQ ID NO: 898244 - DNA, 22 bp, Artificial Sequence
  chemically synthesized
catgaattatttaattggtatt

SEQ ID NO: 898245 - DNA, 22 bp, Artificial Sequence
  chemically synthesized
acatgaattatttaattggtat

SEQ ID NO: 898246 - DNA, 22 bp, Artificial Sequence
  chemically synthesized
gtaataccaattaaataattca

SEQ ID NO: 898247 - DNA, 22 bp, Artificial Sequence
  chemically synthesized
tccaaaagaagataatggttta

SEQ ID NO: 898248 - DNA, 22 bp, Artificial Sequence
  chemically synthesized
aataattcatgtaaaccattat

SEQ ID NO: 898249 - DNA, 22 bp, Artificial Sequence
  chemically synthesized
atccaaaagaagataatggttt

SEQ ID NO: 898250 - DNA, 22 bp, Artificial Sequence
  chemically synthesized
tatccaaaagaagataatggtt

SEQ ID NO: 898251 - DNA, 22 bp, Artificial Sequence
  chemically synthesized
atgtaaaccattatcttctttt

SEQ ID NO: 898252 - DNA, 22 bp, Artificial Sequence
  chemically synthesized
cgtgcattttatccaaaagaag

SEQ ID NO: 898253 - DNA, 22 bp, Artificial Sequence
  chemically synthesized
atactacgtgcattttatccaa

SEQ ID NO: 898254 - DNA, 22 bp, Artificial Sequence
  chemically synthesized
catactacgtgcattttatcca

SEQ ID NO: 898255 - DNA, 22 bp, Artificial Sequence
  chemically synthesized
tcttcttttggataaaatgcac

SEQ ID NO: 898256 - DNA, 22 bp, Artificial Sequence
  chemically synthesized
cttttggataaaatgcacgtag

SEQ ID NO: 898257 - DNA, 22 bp, Artificial Sequence
  chemically synthesized
ttttggataaaatgcacgtagt

SEQ ID NO: 898258 - DNA, 22 bp, Artificial Sequence
  chemically synthesized
caaatatttcatactacgtgca

SEQ ID NO: 898259 - DNA, 22 bp, Artificial Sequence
  chemically synthesized
ttggataaaatgcacgtagtat

SEQ ID NO: 898260 - DNA, 22 bp, Artificial Sequence
  chemically synthesized
tccaaatatttcatactacgtg

SEQ ID NO: 898261 - DNA, 22 bp, Artificial Sequence
  chemically synthesized
tggataaaatgcacgtagtatg

SEQ ID NO: 898262 - DNA, 22 bp, Artificial Sequence
  chemically synthesized
ggataaaatgcacgtagtatga

SEQ ID NO: 898263 - DNA, 22 bp, Artificial Sequence
  chemically synthesized
gataaaatgcacgtagtatgaa

SEQ ID NO: 898264 - DNA, 22 bp, Artificial Sequence
  chemically synthesized
agaaatgtgtgaggcaaaatga

SEQ ID NO: 898265 - DNA, 22 bp, Artificial Sequence
  chemically synthesized
ttaagaaatgtgtgaggcaaaa

SEQ ID NO: 898266 - DNA, 22 bp, Artificial Sequence
  chemically synthesized
ggagagttcattttgcctcaca

SEQ ID NO: 898267 - DNA, 22 bp, Artificial Sequence
  chemically synthesized
gagagttcattttgcctcacac

SEQ ID NO: 898268 - DNA, 22 bp, Artificial Sequence
  chemically synthesized
ttgttaagaaatgtgtgaggca

SEQ ID NO: 898269 - DNA, 22 bp, Artificial Sequence
  chemically synthesized
ttgttgttaagaaatgtgtgag

SEQ ID NO: 898270 - DNA, 22 bp, Artificial Sequence
  chemically synthesized
attgttgttaagaaatgtgtga

SEQ ID NO: 898271 - DNA, 22 bp, Artificial Sequence
  chemically synthesized
attttgcctcacacatttctta

SEQ ID NO: 898272 - DNA, 22 bp, Artificial Sequence
  chemically synthesized
atttattgttgttaagaaatgt

SEQ ID NO: 898273 - DNA, 22 bp, Artificial Sequence
  chemically synthesized
tgcctcacacatttcttaacaa

SEQ ID NO: 898274 - DNA, 22 bp, Artificial Sequence
  chemically synthesized
gcctcacacatttcttaacaac

SEQ ID NO: 898275 - DNA, 22 bp, Artificial Sequence
  chemically synthesized
cctcacacatttcttaacaaca

SEQ ID NO: 898276 - DNA, 22 bp, Artificial Sequence
  chemically synthesized
acacatttcttaacaacaataa

SEQ ID NO: 898277 - DNA, 22 bp, Artificial Sequence
  chemically synthesized
cagtgacattaatttattgttg

SEQ ID NO: 898278 - DNA, 22 bp, Artificial Sequence
  chemically synthesized
tccagtgacattaatttattgt

SEQ ID NO: 898279 - DNA, 22 bp, Artificial Sequence
  chemically synthesized
gttctccagtgacattaattta

SEQ ID NO: 898280 - DNA, 22 bp, Artificial Sequence
  chemically synthesized
cttaacaacaataaattaatgt

SEQ ID NO: 898281 - DNA, 22 bp, Artificial Sequence
  chemically synthesized
ttaacaacaataaattaatgtc

SEQ ID NO: 898282 - DNA, 22 bp, Artificial Sequence
  chemically synthesized
aacaacaataaattaatgtcac

SEQ ID NO: 898283 - DNA, 22 bp, Artificial Sequence
  chemically synthesized
acaacaataaattaatgtcact

SEQ ID NO: 898284 - DNA, 22 bp, Artificial Sequence
  chemically synthesized
agtctagttctccagtgacatt

SEQ ID NO: 898285 - DNA, 22 bp, Artificial Sequence
  chemically synthesized
ctaagtctagttctccagtgac

SEQ ID NO: 898286 - DNA, 22 bp, Artificial Sequence
  chemically synthesized
gctaagtctagttctccagtga

SEQ ID NO: 898287 - DNA, 22 bp, Artificial Sequence
  chemically synthesized
tgctaagtctagttctccagtg

SEQ ID NO: 898288 - DNA, 22 bp, Artificial Sequence
  chemically synthesized
atgtcactggagaactagactt

SEQ ID NO: 898289 - DNA, 22 bp, Artificial Sequence
  chemically synthesized
ggaagatatctttgctaagtct

SEQ ID NO: 898290 - DNA, 22 bp, Artificial Sequence
  chemically synthesized
gagaactagacttagcaaagat

SEQ ID NO: 898291 - DNA, 22 bp, Artificial Sequence
  chemically synthesized
tgcctgggaagatatctttgct

SEQ ID NO: 898292 - DNA, 22 bp, Artificial Sequence
  chemically synthesized
gtgcctgggaagatatctttgc

SEQ ID NO: 898293 - DNA, 22 bp, Artificial Sequence
  chemically synthesized
tgtgcctgggaagatatctttg

SEQ ID NO: 898294 - DNA, 22 bp, Artificial Sequence
  chemically synthesized
gacttagcaaagatatcttccc

SEQ ID NO: 898295 - DNA, 22 bp, Artificial Sequence
  chemically synthesized
agcaaagatatcttcccaggca

SEQ ID NO: 898296 - DNA, 22 bp, Artificial Sequence
  chemically synthesized
gcaaagatatcttcccaggcac

SEQ ID NO: 898297 - DNA, 22 bp, Artificial Sequence
  chemically synthesized
taaaaataatcgagttttgtgc

SEQ ID NO: 898298 - DNA, 22 bp, Artificial Sequence
  chemically synthesized
cccaggcacaaaactcgattat

SEQ ID NO: 898299 - DNA, 22 bp, Artificial Sequence
  chemically synthesized
ccaggcacaaaactcgattatt

SEQ ID NO: 898300 - DNA, 22 bp, Artificial Sequence
  chemically synthesized
ccacgagaccagttgtaaaaat

SEQ ID NO: 898301 - DNA, 22 bp, Artificial Sequence
  chemically synthesized
accacgagaccagttgtaaaaa

SEQ ID NO: 898302 - DNA, 22 bp, Artificial Sequence
  chemically synthesized
taccacgagaccagttgtaaaa

SEQ ID NO: 898303 - DNA, 22 bp, Artificial Sequence
  chemically synthesized
gattatttttacaactggtctc

SEQ ID NO: 898304 - DNA, 22 bp, Artificial Sequence
  chemically synthesized
tttttacaactggtctcgtggt

SEQ ID NO: 898305 - DNA, 22 bp, Artificial Sequence
  chemically synthesized
gtgagggatattttaccacgag

SEQ ID NO: 898306 - DNA, 22 bp, Artificial Sequence
  chemically synthesized
ttacaactggtctcgtggtaaa

SEQ ID NO: 898307 - DNA, 22 bp, Artificial Sequence
  chemically synthesized
tacaactggtctcgtggtaaaa

SEQ ID NO: 898308 - DNA, 22 bp, Artificial Sequence
  chemically synthesized
acaactggtctcgtggtaaaat

SEQ ID NO: 898309 - DNA, 22 bp, Artificial Sequence
  chemically synthesized
ctagtgagggatattttaccac

SEQ ID NO: 898310 - DNA, 22 bp, Artificial Sequence
  chemically synthesized
caactggtctcgtggtaaaata

SEQ ID NO: 898311 - DNA, 22 bp, Artificial Sequence
  chemically synthesized
gtctcgtggtaaaatatccctc

SEQ ID NO: 898312 - DNA, 22 bp, Artificial Sequence
  chemically synthesized
gtggtaaaatatccctcactag

SEQ ID NO: 898313 - DNA, 22 bp, Artificial Sequence
  chemically synthesized
cagagggaaagaaaataaatga

SEQ ID NO: 898314 - DNA, 22 bp, Artificial Sequence
  chemically synthesized
ccagagggaaagaaaataaatg

SEQ ID NO: 898315 - DNA, 22 bp, Artificial Sequence
  chemically synthesized
actaggaggtcatttattttct

SEQ ID NO: 898316 - DNA, 22 bp, Artificial Sequence
  chemically synthesized
aatttccagagggaaagaaaat

SEQ ID NO: 898317 - DNA, 22 bp, Artificial Sequence
  chemically synthesized
ggaggtcatttattttctttcc

SEQ ID NO: 898318 - DNA, 22 bp, Artificial Sequence
  chemically synthesized
ttaaatttccagagggaaagaa

SEQ ID NO: 898319 - DNA, 22 bp, Artificial Sequence
  chemically synthesized
attaaatttccagagggaaaga

SEQ ID NO: 898320 - DNA, 22 bp, Artificial Sequence
  chemically synthesized
tattaaatttccagagggaaag

SEQ ID NO: 898321 - DNA, 22 bp, Artificial Sequence
  chemically synthesized
ttttattaaatttccagaggga

SEQ ID NO: 898322 - DNA, 22 bp, Artificial Sequence
  chemically synthesized
attttctttccctctggaaatt

SEQ ID NO: 898323 - DNA, 22 bp, Artificial Sequence
  chemically synthesized
ttttctttccctctggaaattt

SEQ ID NO: 898324 - DNA, 22 bp, Artificial Sequence
  chemically synthesized
atcattattttattaaatttcc

SEQ ID NO: 898325 - DNA, 22 bp, Artificial Sequence
  chemically synthesized
tctttccctctggaaatttaat

SEQ ID NO: 898326 - DNA, 22 bp, Artificial Sequence
  chemically synthesized
ctttccctctggaaatttaata

SEQ ID NO: 898327 - DNA, 22 bp, Artificial Sequence
  chemically synthesized
tttccctctggaaatttaataa

SEQ ID NO: 898328 - DNA, 22 bp, Artificial Sequence
  chemically synthesized
tccctctggaaatttaataaaa

SEQ ID NO: 898329 - DNA, 22 bp, Artificial Sequence
  chemically synthesized
ccctctggaaatttaataaaat

SEQ ID NO: 898330 - DNA, 22 bp, Artificial Sequence
  chemically synthesized
cctctggaaatttaataaaata

SEQ ID NO: 898331 - DNA, 22 bp, Artificial Sequence
  chemically synthesized
tggaaatttaataaaataatga

SEQ ID NO: 898332 - DNA, 22 bp, Artificial Sequence
  chemically synthesized
agtcatatattcatcattattt

SEQ ID NO: 898333 - DNA, 22 bp, Artificial Sequence
  chemically synthesized
gaaatttaataaaataatgatg

SEQ ID NO: 898334 - DNA, 22 bp, Artificial Sequence
  chemically synthesized
cagtcatatattcatcattatt

SEQ ID NO: 898335 - DNA, 22 bp, Artificial Sequence
  chemically synthesized
tcagtcatatattcatcattat

SEQ ID NO: 898336 - DNA, 22 bp, Artificial Sequence
  chemically synthesized
ttcagtcatatattcatcatta

SEQ ID NO: 898337 - DNA, 22 bp, Artificial Sequence
  chemically synthesized
aataaaataatgatgaatatat

SEQ ID NO: 898338 - DNA, 22 bp, Artificial Sequence
  chemically synthesized
ataaaataatgatgaatatatg

SEQ ID NO: 898339 - DNA, 22 bp, Artificial Sequence
  chemically synthesized
gtggcatataaccacaatgtat

SEQ ID NO: 898340 - DNA, 22 bp, Artificial Sequence
  chemically synthesized
aaaaatacattgtggttatatg

SEQ ID NO: 898341 - DNA, 22 bp, Artificial Sequence
  chemically synthesized
aaatatctggtggcatataacc

SEQ ID NO: 898342 - DNA, 22 bp, Artificial Sequence
  chemically synthesized
aaaatatctggtggcatataac

SEQ ID NO: 898343 - DNA, 22 bp, Artificial Sequence
  chemically synthesized
taaaatatctggtggcatataa

SEQ ID NO: 898344 - DNA, 22 bp, Artificial Sequence
  chemically synthesized
tagttttaaaatatctggtggc

SEQ ID NO: 898345 - DNA, 22 bp, Artificial Sequence
  chemically synthesized
atagttttaaaatatctggtgg

SEQ ID NO: 898346 - DNA, 22 bp, Artificial Sequence
  chemically synthesized
tggttatatgccaccagatatt

SEQ ID NO: 898347 - DNA, 22 bp, Artificial Sequence
  chemically synthesized
tatgccaccagatattttaaaa

SEQ ID NO: 898348 - DNA, 22 bp, Artificial Sequence
  chemically synthesized
tatatggatttatagttttaaa

SEQ ID NO: 898349 - DNA, 22 bp, Artificial Sequence
  chemically synthesized
cattgtatatggatttatagtt

SEQ ID NO: 898350 - DNA, 22 bp, Artificial Sequence
  chemically synthesized
acattgtatatggatttatagt

SEQ ID NO: 898351 - DNA, 22 bp, Artificial Sequence
  chemically synthesized
tacattgtatatggatttatag

SEQ ID NO: 898352 - DNA, 22 bp, Artificial Sequence
  chemically synthesized
ttacattgtatatggatttata

SEQ ID NO: 898353 - DNA, 22 bp, Artificial Sequence
  chemically synthesized
taaaactataaatccatataca

SEQ ID NO: 898354 - DNA, 22 bp, Artificial Sequence
  chemically synthesized
aaaactataaatccatatacaa

SEQ ID NO: 898355 - DNA, 22 bp, Artificial Sequence
  chemically synthesized
gtcacttttacattgtatatgg

SEQ ID NO: 898356 - DNA, 22 bp, Artificial Sequence
  chemically synthesized
aaactataaatccatatacaat

SEQ ID NO: 898357 - DNA, 22 bp, Artificial Sequence
  chemically synthesized
taattagtcacttttacattgt

SEQ ID NO: 898358 - DNA, 22 bp, Artificial Sequence
  chemically synthesized
taaatccatatacaatgtaaaa

SEQ ID NO: 898359 - DNA, 22 bp, Artificial Sequence
  chemically synthesized
gtaattagtcacttttacattg

SEQ ID NO: 898360 - DNA, 22 bp, Artificial Sequence
  chemically synthesized
aatgtcataaaaatgatttgta

SEQ ID NO: 898361 - DNA, 22 bp, Artificial Sequence
  chemically synthesized
ggggctgaatgtcataaaaatg

SEQ ID NO: 898362 - DNA, 22 bp, Artificial Sequence
  chemically synthesized
attacaaatcatttttatgaca

SEQ ID NO: 898363 - DNA, 22 bp, Artificial Sequence
  chemically synthesized
caaatcatttttatgacattca

SEQ ID NO: 898364 - DNA, 22 bp, Artificial Sequence
  chemically synthesized
tgccactgggggctgaatgtca

SEQ ID NO: 898365 - DNA, 22 bp, Artificial Sequence
  chemically synthesized
ttatgacattcagcccccagtg

SEQ ID NO: 898366 - DNA, 22 bp, Artificial Sequence
  chemically synthesized
cgagagctatgccactgggggc

SEQ ID NO: 898367 - DNA, 22 bp, Artificial Sequence
  chemically synthesized
tatgacattcagcccccagtgg

SEQ ID NO: 898368 - DNA, 22 bp, Artificial Sequence
  chemically synthesized
atgacattcagcccccagtggc

SEQ ID NO: 898369 - DNA, 22 bp, Artificial Sequence
  chemically synthesized
tgacattcagcccccagtggca

SEQ ID NO: 898370 - DNA, 22 bp, Artificial Sequence
  chemically synthesized
agcccccagtggcatagctctc

SEQ ID NO: 898371 - DNA, 22 bp, Artificial Sequence
  chemically synthesized
aagtaatattccgagagctatg

SEQ ID NO: 898372 - DNA, 22 bp, Artificial Sequence
  chemically synthesized
aaagtaatattccgagagctat

SEQ ID NO: 898373 - DNA, 22 bp, Artificial Sequence
  chemically synthesized
taaagtaatattccgagagcta

SEQ ID NO: 898374 - DNA, 22 bp, Artificial Sequence
  chemically synthesized
ttaaagtaatattccgagagct

SEQ ID NO: 898375 - DNA, 22 bp, Artificial Sequence
  chemically synthesized
cttttaaagtaatattccgaga

SEQ ID NO: 898376 - DNA, 22 bp, Artificial Sequence
  chemically synthesized
acttttaaagtaatattccgag

SEQ ID NO: 898377 - DNA, 22 bp, Artificial Sequence
  chemically synthesized
tcggaatattactttaaaagta

SEQ ID NO: 898378 - DNA, 22 bp, Artificial Sequence
  chemically synthesized
ggaatattactttaaaagtaag

SEQ ID NO: 898379 - DNA, 22 bp, Artificial Sequence
  chemically synthesized
aaaaggaaatccacttactttt

SEQ ID NO: 898380 - DNA, 22 bp, Artificial Sequence
  chemically synthesized
aaaaaggaaatccacttacttt

SEQ ID NO: 898381 - DNA, 22 bp, Artificial Sequence
  chemically synthesized
taaaaaggaaatccacttactt

SEQ ID NO: 898382 - DNA, 22 bp, Artificial Sequence
  chemically synthesized
ctttaaaagtaagtggatttcc

SEQ ID NO: 898383 - DNA, 22 bp, Artificial Sequence
  chemically synthesized
taaaagtaagtggatttccttt

SEQ ID NO: 898384 - DNA, 22 bp, Artificial Sequence
  chemically synthesized
aaaagtaagtggatttcctttt

SEQ ID NO: 898385 - DNA, 22 bp, Artificial Sequence
  chemically synthesized
aaagtaagtggatttccttttt

SEQ ID NO: 898386 - DNA, 22 bp, Artificial Sequence
  chemically synthesized
cctttttaaagcatgtggattt

SEQ ID NO: 898387 - DNA, 22 bp, Artificial Sequence
  chemically synthesized
ctttttaaagcatgtggatttt

SEQ ID NO: 898388 - DNA, 22 bp, Artificial Sequence
  chemically synthesized
tttaaagcatgtggattttact

SEQ ID NO: 898389 - DNA, 22 bp, Artificial Sequence
  chemically synthesized
ttaaagcatgtggattttactt

SEQ ID NO: 898390 - DNA, 22 bp, Artificial Sequence
  chemically synthesized
taaagcatgtggattttactta

SEQ ID NO: 898391 - DNA, 22 bp, Artificial Sequence
  chemically synthesized
aaagcatgtggattttacttac

SEQ ID NO: 898392 - DNA, 22 bp, Artificial Sequence
  chemically synthesized
aagcatgtggattttacttacg

SEQ ID NO: 898393 - DNA, 22 bp, Artificial Sequence
  chemically synthesized
tacttacgatgcttatacatct

SEQ ID NO: 898394 - DNA, 22 bp, Artificial Sequence
  chemically synthesized
acttacgatgcttatacatcta

SEQ ID NO: 898395 - DNA, 22 bp, Artificial Sequence
  chemically synthesized
cttacgatgcttatacatctat

SEQ ID NO: 898396 - DNA, 22 bp, Artificial Sequence
  chemically synthesized
acgatgcttatacatctatatt

SEQ ID NO: 898397 - DNA, 22 bp, Artificial Sequence
  chemically synthesized
cgatgcttatacatctatattt

SEQ ID NO: 898398 - DNA, 22 bp, Artificial Sequence
  chemically synthesized
gaaacaatgtaggaaatataga

SEQ ID NO: 898399 - DNA, 22 bp, Artificial Sequence
  chemically synthesized
aaactggaaacaatgtaggaaa

SEQ ID NO: 898400 - DNA, 22 bp, Artificial Sequence
  chemically synthesized
atacatctatatttcctacatt

SEQ ID NO: 898401 - DNA, 22 bp, Artificial Sequence
  chemically synthesized
aaaactggaaacaatgtaggaa

SEQ ID NO: 898402 - DNA, 22 bp, Artificial Sequence
  chemically synthesized
tacatctatatttcctacattg

SEQ ID NO: 898403 - DNA, 22 bp, Artificial Sequence
  chemically synthesized
tatttcctacattgtttccagt

SEQ ID NO: 898404 - DNA, 22 bp, Artificial Sequence
  chemically synthesized
tcagatacttaaaactggaaac

SEQ ID NO: 898405 - DNA, 22 bp, Artificial Sequence
  chemically synthesized
ttatcagatacttaaaactgga

SEQ ID NO: 898406 - DNA, 22 bp, Artificial Sequence
  chemically synthesized
cctacattgtttccagttttaa

SEQ ID NO: 898407 - DNA, 22 bp, Artificial Sequence
  chemically synthesized
ctacattgtttccagttttaag

SEQ ID NO: 898408 - DNA, 22 bp, Artificial Sequence
  chemically synthesized
actgttatcagatacttaaaac

SEQ ID NO: 898409 - DNA, 22 bp, Artificial Sequence
  chemically synthesized
cattgtttccagttttaagtat

SEQ ID NO: 898410 - DNA, 22 bp, Artificial Sequence
  chemically synthesized
cactgttatcagatacttaaaa

SEQ ID NO: 898411 - DNA, 22 bp, Artificial Sequence
  chemically synthesized
tttccagttttaagtatctgat

SEQ ID NO: 898412 - DNA, 22 bp, Artificial Sequence
  chemically synthesized
ccagttttaagtatctgataac

SEQ ID NO: 898413 - DNA, 22 bp, Artificial Sequence
  chemically synthesized
cagttttaagtatctgataaca

SEQ ID NO: 898414 - DNA, 22 bp, Artificial Sequence
  chemically synthesized
acacaggggacttcactgttat

SEQ ID NO: 898415 - DNA, 22 bp, Artificial Sequence
  chemically synthesized
gacacaggggacttcactgtta

SEQ ID NO: 898416 - DNA, 22 bp, Artificial Sequence
  chemically synthesized
taagtatctgataacagtgaag

SEQ ID NO: 898417 - DNA, 22 bp, Artificial Sequence
  chemically synthesized
aagtatctgataacagtgaagt

SEQ ID NO: 898418 - DNA, 22 bp, Artificial Sequence
  chemically synthesized
agtatctgataacagtgaagtc

SEQ ID NO: 898419 - DNA, 22 bp, Artificial Sequence
  chemically synthesized
tgatttgacacaggggacttca

SEQ ID NO: 898420 - DNA, 22 bp, Artificial Sequence
  chemically synthesized
ataacagtgaagtcccctgtgt

SEQ ID NO: 898421 - DNA, 22 bp, Artificial Sequence
  chemically synthesized
acatacactgtgatttgacaca

SEQ ID NO: 898422 - DNA, 22 bp, Artificial Sequence
  chemically synthesized
tgcaataaaactaacatacact

SEQ ID NO: 898423 - DNA, 22 bp, Artificial Sequence
  chemically synthesized
tgtcaaatcacagtgtatgtta

SEQ ID NO: 898424 - DNA, 22 bp, Artificial Sequence
  chemically synthesized
gttttattgcataaccacttca

SEQ ID NO: 898425 - DNA, 22 bp, Artificial Sequence
  chemically synthesized
tattgcataaccacttcattac

SEQ ID NO: 898426 - DNA, 22 bp, Artificial Sequence
  chemically synthesized
attgcataaccacttcattacc

SEQ ID NO: 898427 - DNA, 22 bp, Artificial Sequence
  chemically synthesized
ttgcataaccacttcattacca

SEQ ID NO: 898428 - DNA, 22 bp, Artificial Sequence
  chemically synthesized
cataaccacttcattaccacac

SEQ ID NO: 898429 - DNA, 22 bp, Artificial Sequence
  chemically synthesized
agaaaaataacaaaatccatgt

SEQ ID NO: 898430 - DNA, 22 bp, Artificial Sequence
  chemically synthesized
gagaaaaataacaaaatccatg

SEQ ID NO: 898431 - DNA, 22 bp, Artificial Sequence
  chemically synthesized
cattaccacacatggattttgt

SEQ ID NO: 898432 - DNA, 22 bp, Artificial Sequence
  chemically synthesized
attaccacacatggattttgtt

SEQ ID NO: 898433 - DNA, 22 bp, Artificial Sequence
  chemically synthesized
ccacacatggattttgttattt

SEQ ID NO: 898434 - DNA, 22 bp, Artificial Sequence
  chemically synthesized
aggtcttgagaaaaataacaaa

SEQ ID NO: 898435 - DNA, 22 bp, Artificial Sequence
  chemically synthesized
gaggtcttgagaaaaataacaa

SEQ ID NO: 898436 - DNA, 22 bp, Artificial Sequence
  chemically synthesized
tatgtttgaggtcttgagaaaa

SEQ ID NO: 898437 - DNA, 22 bp, Artificial Sequence
  chemically synthesized
tgttatttttctcaagacctca

SEQ ID NO: 898438 - DNA, 22 bp, Artificial Sequence
  chemically synthesized
gttatttttctcaagacctcaa

SEQ ID NO: 898439 - DNA, 22 bp, Artificial Sequence
  chemically synthesized
ttatttttctcaagacctcaaa

SEQ ID NO: 898440 - DNA, 22 bp, Artificial Sequence
  chemically synthesized
tttttctcaagacctcaaacat

SEQ ID NO: 898441 - DNA, 22 bp, Artificial Sequence
  chemically synthesized
gtaatgtattatatgtttgagg

SEQ ID NO: 898442 - DNA, 22 bp, Artificial Sequence
  chemically synthesized
ttctcaagacctcaaacatata

SEQ ID NO: 898443 - DNA, 22 bp, Artificial Sequence
  chemically synthesized
tctcaagacctcaaacatataa

SEQ ID NO: 898444 - DNA, 22 bp, Artificial Sequence
  chemically synthesized
cctcgtaatgtattatatgttt

SEQ ID NO: 898445 - DNA, 22 bp, Artificial Sequence
  chemically synthesized
ctcaagacctcaaacatataat

SEQ ID NO: 898446 - DNA, 22 bp, Artificial Sequence
  chemically synthesized
acctcgtaatgtattatatgtt

SEQ ID NO: 898447 - DNA, 22 bp, Artificial Sequence
  chemically synthesized
tcaagacctcaaacatataata

SEQ ID NO: 898448 - DNA, 22 bp, Artificial Sequence
  chemically synthesized
aagacctcaaacatataataca

SEQ ID NO: 898449 - DNA, 22 bp, Artificial Sequence
  chemically synthesized
atttacctcgtaatgtattata

SEQ ID NO: 898450 - DNA, 22 bp, Artificial Sequence
  chemically synthesized
aaacatataatacattacgagg

SEQ ID NO: 898451 - DNA, 22 bp, Artificial Sequence
  chemically synthesized
gaaatgttcatttacctcgtaa

SEQ ID NO: 898452 - DNA, 22 bp, Artificial Sequence
  chemically synthesized
ctagaaatgttcatttacctcg

SEQ ID NO: 898453 - DNA, 22 bp, Artificial Sequence
  chemically synthesized
gctagaaatgttcatttacctc

SEQ ID NO: 898454 - DNA, 22 bp, Artificial Sequence
  chemically synthesized
aaatcttgctagaaatgttcat

SEQ ID NO: 898455 - DNA, 22 bp, Artificial Sequence
  chemically synthesized
gaaatcttgctagaaatgttca

SEQ ID NO: 898456 - DNA, 22 bp, Artificial Sequence
  chemically synthesized
tgaaatcttgctagaaatgttc

SEQ ID NO: 898457 - DNA, 22 bp, Artificial Sequence
  chemically synthesized
cgaggtaaatgaacatttctag

SEQ ID NO: 898458 - DNA, 22 bp, Artificial Sequence
  chemically synthesized
actttgaaatcttgctagaaat

SEQ ID NO: 898459 - DNA, 22 bp, Artificial Sequence
  chemically synthesized
ctgactttgaaatcttgctaga

SEQ ID NO: 898460 - DNA, 22 bp, Artificial Sequence
  chemically synthesized
actgactttgaaatcttgctag

SEQ ID NO: 898461 - DNA, 22 bp, Artificial Sequence
  chemically synthesized
tactgactttgaaatcttgcta

SEQ ID NO: 898462 - DNA, 22 bp, Artificial Sequence
  chemically synthesized
ctagcaagatttcaaagtcagt

SEQ ID NO: 898463 - DNA, 22 bp, Artificial Sequence
  chemically synthesized
tagcaagatttcaaagtcagta

SEQ ID NO: 898464 - DNA, 22 bp, Artificial Sequence
  chemically synthesized
tacatcaaattttactgacttt

SEQ ID NO: 898465 - DNA, 22 bp, Artificial Sequence
  chemically synthesized
gcaagatttcaaagtcagtaaa

SEQ ID NO: 898466 - DNA, 22 bp, Artificial Sequence
  chemically synthesized
ttgtacatcaaattttactgac

SEQ ID NO: 898467 - DNA, 22 bp, Artificial Sequence
  chemically synthesized
attgtacatcaaattttactga

SEQ ID NO: 898468 - DNA, 22 bp, Artificial Sequence
  chemically synthesized
tttattgtacatcaaattttac

SEQ ID NO: 898469 - DNA, 22 bp, Artificial Sequence
  chemically synthesized
caaagtcagtaaaatttgatgt

SEQ ID NO: 898470 - DNA, 22 bp, Artificial Sequence
  chemically synthesized
aaagtcagtaaaatttgatgta

SEQ ID NO: 898471 - DNA, 22 bp, Artificial Sequence
  chemically synthesized
ccaacctatttattgtacatca

SEQ ID NO: 898472 - DNA, 22 bp, Artificial Sequence
  chemically synthesized
caaggactgccaacctatttat

SEQ ID NO: 898473 - DNA, 22 bp, Artificial Sequence
  chemically synthesized
tccaaggactgccaacctattt

SEQ ID NO: 898474 - DNA, 22 bp, Artificial Sequence
  chemically synthesized
gatgtacaataaataggttggc

SEQ ID NO: 898475 - DNA, 22 bp, Artificial Sequence
  chemically synthesized
atgtacaataaataggttggca

SEQ ID NO: 898476 - DNA, 22 bp, Artificial Sequence
  chemically synthesized
gcagtccttggagaactctgcc

SEQ ID NO: 898477 - DNA, 22 bp, Artificial Sequence
  chemically synthesized
gtgtggtaataagggcagagtt

SEQ ID NO: 898478 - DNA, 22 bp, Artificial Sequence
  chemically synthesized
agtgtggtaataagggcagagt

SEQ ID NO: 898479 - DNA, 22 bp, Artificial Sequence
  chemically synthesized
tagtgtggtaataagggcagag

SEQ ID NO: 898480 - DNA, 22 bp, Artificial Sequence
  chemically synthesized
ggagaactctgcccttattacc

SEQ ID NO: 898481 - DNA, 22 bp, Artificial Sequence
  chemically synthesized
gagaactctgcccttattacca

SEQ ID NO: 898482 - DNA, 22 bp, Artificial Sequence
  chemically synthesized
tgcccttattaccacactaaaa

SEQ ID NO: 898483 - DNA, 22 bp, Artificial Sequence
  chemically synthesized
cccttattaccacactaaaacc

SEQ ID NO: 898484 - DNA, 22 bp, Artificial Sequence
  chemically synthesized
aaaagtcaatatggttttagtg

SEQ ID NO: 898485 - DNA, 22 bp, Artificial Sequence
  chemically synthesized
ctgaaaagtcaatatggtttta

SEQ ID NO: 898486 - DNA, 22 bp, Artificial Sequence
  chemically synthesized
actgaaaagtcaatatggtttt

SEQ ID NO: 898487 - DNA, 22 bp, Artificial Sequence
  chemically synthesized
attaccacactaaaaccatatt

SEQ ID NO: 898488 - DNA, 22 bp, Artificial Sequence
  chemically synthesized
ttaccacactaaaaccatattg

SEQ ID NO: 898489 - DNA, 22 bp, Artificial Sequence
  chemically synthesized
ccacactaaaaccatattgact

SEQ ID NO: 898490 - DNA, 22 bp, Artificial Sequence
  chemically synthesized
aaaccatattgacttttcagta

SEQ ID NO: 898491 - DNA, 22 bp, Artificial Sequence
  chemically synthesized
atgaacaccaaagtttactgaa

SEQ ID NO: 898492 - DNA, 22 bp, Artificial Sequence
  chemically synthesized
ctcatgaacaccaaagtttact

SEQ ID NO: 898493 - DNA, 22 bp, Artificial Sequence
  chemically synthesized
acttttcagtaaactttggtgt

SEQ ID NO: 898494 - DNA, 22 bp, Artificial Sequence
  chemically synthesized
ttcagtaaactttggtgttcat

SEQ ID NO: 898495 - DNA, 22 bp, Artificial Sequence
  chemically synthesized
tcagtaaactttggtgttcatg

SEQ ID NO: 898496 - DNA, 22 bp, Artificial Sequence
  chemically synthesized
cagtaaactttggtgttcatga

SEQ ID NO: 898497 - DNA, 22 bp, Artificial Sequence
  chemically synthesized
agtaaactttggtgttcatgag

SEQ ID NO: 898498 - DNA, 22 bp, Artificial Sequence
  chemically synthesized
atgaataacagtgctgctcatg

SEQ ID NO: 898499 - DNA, 22 bp, Artificial Sequence
  chemically synthesized
tggtgttcatgagcagcactgt

SEQ ID NO: 898500 - DNA, 22 bp, Artificial Sequence
  chemically synthesized
ggtgttcatgagcagcactgtt

SEQ ID NO: 898501 - DNA, 22 bp, Artificial Sequence
  chemically synthesized
gtgttcatgagcagcactgtta

SEQ ID NO: 898502 - DNA, 22 bp, Artificial Sequence
  chemically synthesized
atgagcagcactgttattcatt

SEQ ID NO: 898503 - DNA, 22 bp, Artificial Sequence
  chemically synthesized
caaacaaataaattaatgaata

SEQ ID NO: 898504 - DNA, 22 bp, Artificial Sequence
  chemically synthesized
tactgcaaacaaataaattaat

SEQ ID NO: 898505 - DNA, 22 bp, Artificial Sequence
  chemically synthesized
atactgcaaacaaataaattaa

SEQ ID NO: 898506 - DNA, 22 bp, Artificial Sequence
  chemically synthesized
ttattcattaatttatttgttt

SEQ ID NO: 898507 - DNA, 22 bp, Artificial Sequence
  chemically synthesized
gatgcttatactgcaaacaaat

SEQ ID NO: 898508 - DNA, 22 bp, Artificial Sequence
  chemically synthesized
ttcattaatttatttgtttgca

SEQ ID NO: 898509 - DNA, 22 bp, Artificial Sequence
  chemically synthesized
attaatttatttgtttgcagta

SEQ ID NO: 898510 - DNA, 22 bp, Artificial Sequence
  chemically synthesized
atttatttgtttgcagtataag

SEQ ID NO: 898511 - DNA, 22 bp, Artificial Sequence
  chemically synthesized
atttgtttgcagtataagcatc

SEQ ID NO: 898512 - DNA, 22 bp, Artificial Sequence
  chemically synthesized
accatggagttagatgcttata

SEQ ID NO: 898513 - DNA, 22 bp, Artificial Sequence
  chemically synthesized
tttgtttgcagtataagcatct

SEQ ID NO: 898514 - DNA, 22 bp, Artificial Sequence
  chemically synthesized
gaccatggagttagatgcttat

SEQ ID NO: 898515 - DNA, 22 bp, Artificial Sequence
  chemically synthesized
tgaccatggagttagatgctta

SEQ ID NO: 898516 - DNA, 22 bp, Artificial Sequence
  chemically synthesized
gtttgcagtataagcatctaac

SEQ ID NO: 898517 - DNA, 22 bp, Artificial Sequence
  chemically synthesized
tttgaccatggagttagatgct

SEQ ID NO: 898518 - DNA, 22 bp, Artificial Sequence
  chemically synthesized
tttgcagtataagcatctaact

SEQ ID NO: 898519 - DNA, 22 bp, Artificial Sequence
  chemically synthesized
gcagtataagcatctaactcca

SEQ ID NO: 898520 - DNA, 22 bp, Artificial Sequence
  chemically synthesized
cagtataagcatctaactccat

SEQ ID NO: 898521 - DNA, 22 bp, Artificial Sequence
  chemically synthesized
agtattctttgaccatggagtt

SEQ ID NO: 898522 - DNA, 22 bp, Artificial Sequence
  chemically synthesized
ttaagtattctttgaccatgga

SEQ ID NO: 898523 - DNA, 22 bp, Artificial Sequence
  chemically synthesized
actccatggtcaaagaatactt

SEQ ID NO: 898524 - DNA, 22 bp, Artificial Sequence
  chemically synthesized
acgtatattattaagtattctt

SEQ ID NO: 898525 - DNA, 22 bp, Artificial Sequence
  chemically synthesized
catggtcaaagaatacttaata

SEQ ID NO: 898526 - DNA, 22 bp, Artificial Sequence
  chemically synthesized
tccatgtactcacgtatattat

SEQ ID NO: 898527 - DNA, 22 bp, Artificial Sequence
  chemically synthesized
aataatatacgtgagtacatgg

SEQ ID NO: 898528 - DNA, 22 bp, Artificial Sequence
  chemically synthesized
ataatatacgtgagtacatgga

SEQ ID NO: 898529 - DNA, 22 bp, Artificial Sequence
  chemically synthesized
gatcaaggtgaacagtcagaaa

SEQ ID NO: 898530 - DNA, 22 bp, Artificial Sequence
  chemically synthesized
agatcaaggtgaacagtcagaa

SEQ ID NO: 898531 - DNA, 22 bp, Artificial Sequence
  chemically synthesized
gggtaggtttagatcaaggtga

SEQ ID NO: 898532 - DNA, 22 bp, Artificial Sequence
  chemically synthesized
agggtaggtttagatcaaggtg

SEQ ID NO: 898533 - DNA, 22 bp, Artificial Sequence
  chemically synthesized
tagggtaggtttagatcaaggt

SEQ ID NO: 898534 - DNA, 22 bp, Artificial Sequence
  chemically synthesized
tctgactgttcaccttgatcta

SEQ ID NO: 898535 - DNA, 22 bp, Artificial Sequence
  chemically synthesized
ctgactgttcaccttgatctaa

SEQ ID NO: 898536 - DNA, 22 bp, Artificial Sequence
  chemically synthesized
tgactgttcaccttgatctaaa

SEQ ID NO: 898537 - DNA, 22 bp, Artificial Sequence
  chemically synthesized
actttagggtaggtttagatca

SEQ ID NO: 898538 - DNA, 22 bp, Artificial Sequence
  chemically synthesized
actgttcaccttgatctaaacc

SEQ ID NO: 898539 - DNA, 22 bp, Artificial Sequence
  chemically synthesized
cctaactttagggtaggtttag

SEQ ID NO: 898540 - DNA, 22 bp, Artificial Sequence
  chemically synthesized
ttcaccttgatctaaacctacc

SEQ ID NO: 898541 - DNA, 22 bp, Artificial Sequence
  chemically synthesized
ttacctaactttagggtaggtt

SEQ ID NO: 898542 - DNA, 22 bp, Artificial Sequence
  chemically synthesized
accttgatctaaacctacccta

SEQ ID NO: 898543 - DNA, 22 bp, Artificial Sequence
  chemically synthesized
gttacctaactttagggtaggt

SEQ ID NO: 898544 - DNA, 22 bp, Artificial Sequence
  chemically synthesized
gatctaaacctaccctaaagtt

SEQ ID NO: 898545 - DNA, 22 bp, Artificial Sequence
  chemically synthesized
atctaaacctaccctaaagtta

SEQ ID NO: 898546 - DNA, 22 bp, Artificial Sequence
  chemically synthesized
aagggcttgttacctaacttta

SEQ ID NO: 898547 - DNA, 22 bp, Artificial Sequence
  chemically synthesized
aacctaccctaaagttaggtaa

SEQ ID NO: 898548 - DNA, 22 bp, Artificial Sequence
  chemically synthesized
ccctaaagttaggtaacaagcc

SEQ ID NO: 898549 - DNA, 22 bp, Artificial Sequence
  chemically synthesized
caggagccattaaagggcttgt

SEQ ID NO: 898550 - DNA, 22 bp, Artificial Sequence
  chemically synthesized
aagttaggtaacaagcccttta

SEQ ID NO: 898551 - DNA, 22 bp, Artificial Sequence
  chemically synthesized
atgcctccaggagccattaaag

SEQ ID NO: 898552 - DNA, 22 bp, Artificial Sequence
  chemically synthesized
ggtaacaagccctttaatggct

SEQ ID NO: 898553 - DNA, 22 bp, Artificial Sequence
  chemically synthesized
tctaatgcctccaggagccatt

SEQ ID NO: 898554 - DNA, 22 bp, Artificial Sequence
  chemically synthesized
gtctaatgcctccaggagccat

SEQ ID NO: 898555 - DNA, 22 bp, Artificial Sequence
  chemically synthesized
atttgtctaatgcctccaggag

SEQ ID NO: 898556 - DNA, 22 bp, Artificial Sequence
  chemically synthesized
catttgtctaatgcctccagga

SEQ ID NO: 898557 - DNA, 22 bp, Artificial Sequence
  chemically synthesized
acttcatttgtctaatgcctcc

SEQ ID NO: 898558 - DNA, 22 bp, Artificial Sequence
  chemically synthesized
taatggctcctggaggcattag

SEQ ID NO: 898559 - DNA, 22 bp, Artificial Sequence
  chemically synthesized
aatggctcctggaggcattaga

SEQ ID NO: 898560 - DNA, 22 bp, Artificial Sequence
  chemically synthesized
atggctcctggaggcattagac

SEQ ID NO: 898561 - DNA, 22 bp, Artificial Sequence
  chemically synthesized
ttcacttcatttgtctaatgcc

SEQ ID NO: 898562 - DNA, 22 bp, Artificial Sequence
  chemically synthesized
ctggaggcattagacaaatgaa

SEQ ID NO: 898563 - DNA, 22 bp, Artificial Sequence
  chemically synthesized
gaggcattagacaaatgaagtg

SEQ ID NO: 898564 - DNA, 22 bp, Artificial Sequence
  chemically synthesized
gacaaatgaagtgaataggtga

SEQ ID NO: 898565 - DNA, 22 bp, Artificial Sequence
  chemically synthesized
agcaaatcaatgtcacctattc

SEQ ID NO: 898566 - DNA, 22 bp, Artificial Sequence
  chemically synthesized
gagcaaatcaatgtcacctatt

SEQ ID NO: 898567 - DNA, 22 bp, Artificial Sequence
  chemically synthesized
aggtttgagcaaatcaatgtca

SEQ ID NO: 898568 - DNA, 22 bp, Artificial Sequence
  chemically synthesized
ttgaggtttgagcaaatcaatg

SEQ ID NO: 898569 - DNA, 22 bp, Artificial Sequence
  chemically synthesized
gaactattgaggtttgagcaaa

SEQ ID NO: 898570 - DNA, 22 bp, Artificial Sequence
  chemically synthesized
agaactattgaggtttgagcaa

SEQ ID NO: 898571 - DNA, 22 bp, Artificial Sequence
  chemically synthesized
tagaactattgaggtttgagca

SEQ ID NO: 898572 - DNA, 22 bp, Artificial Sequence
  chemically synthesized
atttgctcaaacctcaatagtt

SEQ ID NO: 898573 - DNA, 22 bp, Artificial Sequence
  chemically synthesized
taaaatccattttagaactatt

SEQ ID NO: 898574 - DNA, 22 bp, Artificial Sequence
  chemically synthesized
gctcaaacctcaatagttctaa

SEQ ID NO: 898575 - DNA, 22 bp, Artificial Sequence
  chemically synthesized
ctcaaacctcaatagttctaaa

SEQ ID NO: 898576 - DNA, 22 bp, Artificial Sequence
  chemically synthesized
aaacctcaatagttctaaaatg

SEQ ID NO: 898577 - DNA, 22 bp, Artificial Sequence
  chemically synthesized
aatagttctaaaatggatttta

SEQ ID NO: 898578 - DNA, 22 bp, Artificial Sequence
  chemically synthesized
gatgggtataaatccctataaa

SEQ ID NO: 898579 - DNA, 22 bp, Artificial Sequence
  chemically synthesized
taaaatggattttatagggatt

SEQ ID NO: 898580 - DNA, 22 bp, Artificial Sequence
  chemically synthesized
aaatggattttatagggattta

SEQ ID NO: 898581 - DNA, 22 bp, Artificial Sequence
  chemically synthesized
tatagggatttatacccatcta

SEQ ID NO: 898582 - DNA, 22 bp, Artificial Sequence
  chemically synthesized
atagggatttatacccatctaa

SEQ ID NO: 898583 - DNA, 22 bp, Artificial Sequence
  chemically synthesized
tagggatttatacccatctaac

SEQ ID NO: 898584 - DNA, 22 bp, Artificial Sequence
  chemically synthesized
tgggtaggtggatagttagatg

SEQ ID NO: 898585 - DNA, 22 bp, Artificial Sequence
  chemically synthesized
gtgggtaggtggatagttagat

SEQ ID NO: 898586 - DNA, 22 bp, Artificial Sequence
  chemically synthesized
atacccatctaactatccacct

SEQ ID NO: 898587 - DNA, 22 bp, Artificial Sequence
  chemically synthesized
tacccatctaactatccaccta

SEQ ID NO: 898588 - DNA, 22 bp, Artificial Sequence
  chemically synthesized
gtgaagagtttgtgggtaggtg

SEQ ID NO: 898589 - DNA, 22 bp, Artificial Sequence
  chemically synthesized
agtgaagagtttgtgggtaggt

SEQ ID NO: 898590 - DNA, 22 bp, Artificial Sequence
  chemically synthesized
tttagtgaagagtttgtgggta

SEQ ID NO: 898591 - DNA, 22 bp, Artificial Sequence
  chemically synthesized
actatccacctacccacaaact

SEQ ID NO: 898592 - DNA, 22 bp, Artificial Sequence
  chemically synthesized
tccacctacccacaaactcttc

SEQ ID NO: 898593 - DNA, 22 bp, Artificial Sequence
  chemically synthesized
cccacaaactcttcactaaata

SEQ ID NO: 898594 - DNA, 22 bp, Artificial Sequence
  chemically synthesized
ttcactaaataatgtgattttg

SEQ ID NO: 898595 - DNA, 22 bp, Artificial Sequence
  chemically synthesized
aacagtatgtgaccaaaatcac

SEQ ID NO: 898596 - DNA, 22 bp, Artificial Sequence
  chemically synthesized
cactaaataatgtgattttggt

SEQ ID NO: 898597 - DNA, 22 bp, Artificial Sequence
  chemically synthesized
aaacagtatgtgaccaaaatca

SEQ ID NO: 898598 - DNA, 22 bp, Artificial Sequence
  chemically synthesized
actaaataatgtgattttggtc

SEQ ID NO: 898599 - DNA, 22 bp, Artificial Sequence
  chemically synthesized
aataatgtgattttggtcacat

SEQ ID NO: 898600 - DNA, 22 bp, Artificial Sequence
  chemically synthesized
agggtttaaacagtatgtgacc

SEQ ID NO: 898601 - DNA, 22 bp, Artificial Sequence
  chemically synthesized
tcctcagggtttaaacagtatg

SEQ ID NO: 898602 - DNA, 22 bp, Artificial Sequence
  chemically synthesized
ttgtcctcagggtttaaacagt

SEQ ID NO: 898603 - DNA, 22 bp, Artificial Sequence
  chemically synthesized
attgtcctcagggtttaaacag

SEQ ID NO: 898604 - DNA, 22 bp, Artificial Sequence
  chemically synthesized
tattgtcctcagggtttaaaca

SEQ ID NO: 898605 - DNA, 22 bp, Artificial Sequence
  chemically synthesized
tggtcacatactgtttaaaccc

SEQ ID NO: 898606 - DNA, 22 bp, Artificial Sequence
  chemically synthesized
ggtcacatactgtttaaaccct

SEQ ID NO: 898607 - DNA, 22 bp, Artificial Sequence
  chemically synthesized
gtcacatactgtttaaaccctg

SEQ ID NO: 898608 - DNA, 22 bp, Artificial Sequence
  chemically synthesized
aattttattgtcctcagggttt

SEQ ID NO: 898609 - DNA, 22 bp, Artificial Sequence
  chemically synthesized
aaattttattgtcctcagggtt

SEQ ID NO: 898610 - DNA, 22 bp, Artificial Sequence
  chemically synthesized
taaattttattgtcctcagggt

SEQ ID NO: 898611 - DNA, 22 bp, Artificial Sequence
  chemically synthesized
tttaaattttattgtcctcagg

SEQ ID NO: 898612 - DNA, 22 bp, Artificial Sequence
  chemically synthesized
ctttaaattttattgtcctcag

SEQ ID NO: 898613 - DNA, 22 bp, Artificial Sequence
  chemically synthesized
tttaaaccctgaggacaataaa

SEQ ID NO: 898614 - DNA, 22 bp, Artificial Sequence
  chemically synthesized
acttctttaaattttattgtcc

SEQ ID NO: 898615 - DNA, 22 bp, Artificial Sequence
  chemically synthesized
aacttctttaaattttattgtc

SEQ ID NO: 898616 - DNA, 22 bp, Artificial Sequence
  chemically synthesized
aaaccctgaggacaataaaatt

SEQ ID NO: 898617 - DNA, 22 bp, Artificial Sequence
  chemically synthesized
aaccctgaggacaataaaattt

SEQ ID NO: 898618 - DNA, 22 bp, Artificial Sequence
  chemically synthesized
catttaacttctttaaatttta

SEQ ID NO: 898619 - DNA, 22 bp, Artificial Sequence
  chemically synthesized
aggacaataaaatttaaagaag

SEQ ID NO: 898620 - DNA, 22 bp, Artificial Sequence
  chemically synthesized
aattacatttaacttctttaaa

SEQ ID NO: 898621 - DNA, 22 bp, Artificial Sequence
  chemically synthesized
aaagaagttaaatgtaatttaa

SEQ ID NO: 898622 - DNA, 22 bp, Artificial Sequence
  chemically synthesized
aagaagttaaatgtaatttaat

SEQ ID NO: 898623 - DNA, 22 bp, Artificial Sequence
  chemically synthesized
aatgtaatttaatctctctctc

SEQ ID NO: 898624 - DNA, 22 bp, Artificial Sequence
  chemically synthesized
aatctctctctctgtctctctc

SEQ ID NO: 898625 - DNA, 22 bp, Artificial Sequence
  chemically synthesized
atctctctctctgtctctctct

SEQ ID NO: 898626 - DNA, 22 bp, Artificial Sequence
  chemically synthesized
tctctctgtctctctctctctc

SEQ ID NO: 898627 - DNA, 22 bp, Artificial Sequence
  chemically synthesized
tctctgtctctctctctctctc

SEQ ID NO: 898628 - DNA, 22 bp, Artificial Sequence
  chemically synthesized
tctgtctctctctctctctctc

SEQ ID NO: 898629 - DNA, 22 bp, Artificial Sequence
  chemically synthesized
tgtctctctctctctctctctc

SEQ ID NO: 898630 - DNA, 22 bp, Artificial Sequence
  chemically synthesized
tctctctctctctctctctctc

SEQ ID NO: 898631 - DNA, 22 bp, Artificial Sequence
  chemically synthesized
tctctctctctctctctctctc

SEQ ID NO: 898632 - DNA, 22 bp, Artificial Sequence
  chemically synthesized
tctctctctctctctctctctc

SEQ ID NO: 898633 - DNA, 22 bp, Artificial Sequence
  chemically synthesized
tctctctctctctctctctcac

SEQ ID NO: 898634 - DNA, 22 bp, Artificial Sequence
  chemically synthesized
tctctctctctctctctcacac

SEQ ID NO: 898635 - DNA, 22 bp, Artificial Sequence
  chemically synthesized
tctctctctctctctcacacac

SEQ ID NO: 898636 - DNA, 22 bp, Artificial Sequence
  chemically synthesized
tctctctctctctcacacacac

SEQ ID NO: 898637 - DNA, 22 bp, Artificial Sequence
  chemically synthesized
tctctctctctcacacacacac

SEQ ID NO: 898638 - DNA, 22 bp, Artificial Sequence
  chemically synthesized
tctctctctcacacacacacac

SEQ ID NO: 898639 - DNA, 22 bp, Artificial Sequence
  chemically synthesized
tctctctcacacacacacacac

SEQ ID NO: 898640 - DNA, 22 bp, Artificial Sequence
  chemically synthesized
tctctcacacacacacacacac

SEQ ID NO: 898641 - DNA, 22 bp, Artificial Sequence
  chemically synthesized
tctcacacacacacacacacac

SEQ ID NO: 898642 - DNA, 22 bp, Artificial Sequence
  chemically synthesized
tcacacacacacacacacacac

SEQ ID NO: 898643 - DNA, 22 bp, Artificial Sequence
  chemically synthesized
acacacacacacacacacacac

SEQ ID NO: 898644 - DNA, 22 bp, Artificial Sequence
  chemically synthesized
tggtgtgcgtgtgtgtgtgtgt

SEQ ID NO: 898645 - DNA, 22 bp, Artificial Sequence
  chemically synthesized
tgtggtgtgcgtgtgtgtgtgt

SEQ ID NO: 898646 - DNA, 22 bp, Artificial Sequence
  chemically synthesized
taacaacacattctgtggtgtg

SEQ ID NO: 898647 - DNA, 22 bp, Artificial Sequence
  chemically synthesized
gtaacaacacattctgtggtgt

SEQ ID NO: 898648 - DNA, 22 bp, Artificial Sequence
  chemically synthesized
atttgtaacaacacattctgtg

SEQ ID NO: 898649 - DNA, 22 bp, Artificial Sequence
  chemically synthesized
ttacaaattaaccccgtatttt

SEQ ID NO: 898650 - DNA, 22 bp, Artificial Sequence
  chemically synthesized
caaattaaccccgtatttttct

SEQ ID NO: 898651 - DNA, 22 bp, Artificial Sequence
  chemically synthesized
ggagggagggagagagggagaa

SEQ ID NO: 898652 - DNA, 22 bp, Artificial Sequence
  chemically synthesized
accccgtatttttctccctctc

SEQ ID NO: 898653 - DNA, 22 bp, Artificial Sequence
  chemically synthesized
gagtacggctgggagggaggga

SEQ ID NO: 898654 - DNA, 22 bp, Artificial Sequence
  chemically synthesized
ttctccctctctccctccctcc

SEQ ID NO: 898655 - DNA, 22 bp, Artificial Sequence
  chemically synthesized
agagtacggctgggagggaggg

SEQ ID NO: 898656 - DNA, 22 bp, Artificial Sequence
  chemically synthesized
tctccctctctccctccctccc

SEQ ID NO: 898657 - DNA, 22 bp, Artificial Sequence
  chemically synthesized
ctccctctctccctccctccca

SEQ ID NO: 898658 - DNA, 22 bp, Artificial Sequence
  chemically synthesized
tccctctctccctccctcccag

SEQ ID NO: 898659 - DNA, 22 bp, Artificial Sequence
  chemically synthesized
tttagagtacggctgggaggga

SEQ ID NO: 898660 - DNA, 22 bp, Artificial Sequence
  chemically synthesized
gtttagagtacggctgggaggg

SEQ ID NO: 898661 - DNA, 22 bp, Artificial Sequence
  chemically synthesized
cctctctccctccctcccagcc

SEQ ID NO: 898662 - DNA, 22 bp, Artificial Sequence
  chemically synthesized
tgtttagagtacggctgggagg

SEQ ID NO: 898663 - DNA, 22 bp, Artificial Sequence
  chemically synthesized
tctccctccctcccagccgtac

SEQ ID NO: 898664 - DNA, 22 bp, Artificial Sequence
  chemically synthesized
tccctccctcccagccgtactc

SEQ ID NO: 898665 - DNA, 22 bp, Artificial Sequence
  chemically synthesized
cctccctcccagccgtactcta

SEQ ID NO: 898666 - DNA, 22 bp, Artificial Sequence
  chemically synthesized
tagagcctttgtttagagtacg

SEQ ID NO: 898667 - DNA, 22 bp, Artificial Sequence
  chemically synthesized
gtagagcctttgtttagagtac

SEQ ID NO: 898668 - DNA, 22 bp, Artificial Sequence
  chemically synthesized
tgtagagcctttgtttagagta

SEQ ID NO: 898669 - DNA, 22 bp, Artificial Sequence
  chemically synthesized
cctcccagccgtactctaaaca

SEQ ID NO: 898670 - DNA, 22 bp, Artificial Sequence
  chemically synthesized
ctttgtagagcctttgtttaga

SEQ ID NO: 898671 - DNA, 22 bp, Artificial Sequence
  chemically synthesized
ccagccgtactctaaacaaagg

SEQ ID NO: 898672 - DNA, 22 bp, Artificial Sequence
  chemically synthesized
gtgctactttgtagagcctttg

SEQ ID NO: 898673 - DNA, 22 bp, Artificial Sequence
  chemically synthesized
agtgctactttgtagagccttt

SEQ ID NO: 898674 - DNA, 22 bp, Artificial Sequence
  chemically synthesized
tttagtgctactttgtagagcc

SEQ ID NO: 898675 - DNA, 22 bp, Artificial Sequence
  chemically synthesized
gtttagtgctactttgtagagc

SEQ ID NO: 898676 - DNA, 22 bp, Artificial Sequence
  chemically synthesized
taaacaaaggctctacaaagta

SEQ ID NO: 898677 - DNA, 22 bp, Artificial Sequence
  chemically synthesized
aacaaaggctctacaaagtagc

SEQ ID NO: 898678 - DNA, 22 bp, Artificial Sequence
  chemically synthesized
tacaaagtagcactaaacaagg

SEQ ID NO: 898679 - DNA, 22 bp, Artificial Sequence
  chemically synthesized
caaagtagcactaaacaagggc

SEQ ID NO: 898680 - DNA, 22 bp, Artificial Sequence
  chemically synthesized
gagagtgtgggaataaagtagc

SEQ ID NO: 898681 - DNA, 22 bp, Artificial Sequence
  chemically synthesized
attggagagtgtgggaataaag

SEQ ID NO: 898682 - DNA, 22 bp, Artificial Sequence
  chemically synthesized
aacaagggctactttattccca

SEQ ID NO: 898683 - DNA, 22 bp, Artificial Sequence
  chemically synthesized
tgattggagagtgtgggaataa

SEQ ID NO: 898684 - DNA, 22 bp, Artificial Sequence
  chemically synthesized
ctgattggagagtgtgggaata

SEQ ID NO: 898685 - DNA, 22 bp, Artificial Sequence
  chemically synthesized
ctttattcccacactctccaat

SEQ ID NO: 898686 - DNA, 22 bp, Artificial Sequence
  chemically synthesized
tattcccacactctccaatcag

SEQ ID NO: 898687 - DNA, 22 bp, Artificial Sequence
  chemically synthesized
attcccacactctccaatcaga

SEQ ID NO: 898688 - DNA, 22 bp, Artificial Sequence
  chemically synthesized
ttcccacactctccaatcagaa

SEQ ID NO: 898689 - DNA, 22 bp, Artificial Sequence
  chemically synthesized
ccacactctccaatcagaaatc

SEQ ID NO: 898690 - DNA, 22 bp, Artificial Sequence
  chemically synthesized
aagcaaataagatcaaagattt

SEQ ID NO: 898691 - DNA, 22 bp, Artificial Sequence
  chemically synthesized
caagcaaataagatcaaagatt

SEQ ID NO: 898692 - DNA, 22 bp, Artificial Sequence
  chemically synthesized
tccaatcagaaatctttgatct

SEQ ID NO: 898693 - DNA, 22 bp, Artificial Sequence
  chemically synthesized
caatcagaaatctttgatctta

SEQ ID NO: 898694 - DNA, 22 bp, Artificial Sequence
  chemically synthesized
aggtccttcaagcaaataagat

SEQ ID NO: 898695 - DNA, 22 bp, Artificial Sequence
  chemically synthesized
atgctaaggtccttcaagcaaa

SEQ ID NO: 898696 - DNA, 22 bp, Artificial Sequence
  chemically synthesized
tgatcttatttgcttgaaggac

SEQ ID NO: 898697 - DNA, 22 bp, Artificial Sequence
  chemically synthesized
gatcttatttgcttgaaggacc

SEQ ID NO: 898698 - DNA, 22 bp, Artificial Sequence
  chemically synthesized
atcttatttgcttgaaggacct

SEQ ID NO: 898699 - DNA, 22 bp, Artificial Sequence
  chemically synthesized
atttgcttgaaggaccttagca

SEQ ID NO: 898700 - DNA, 22 bp, Artificial Sequence
  chemically synthesized
tttgcttgaaggaccttagcat

SEQ ID NO: 898701 - DNA, 22 bp, Artificial Sequence
  chemically synthesized
tatcagccaggctgatgctaag

SEQ ID NO: 898702 - DNA, 22 bp, Artificial Sequence
  chemically synthesized
gcttgaaggaccttagcatcag

SEQ ID NO: 898703 - DNA, 22 bp, Artificial Sequence
  chemically synthesized
cttgaaggaccttagcatcagc

SEQ ID NO: 898704 - DNA, 22 bp, Artificial Sequence
  chemically synthesized
tgtatcagccaggctgatgcta

SEQ ID NO: 898705 - DNA, 22 bp, Artificial Sequence
  chemically synthesized
ctgtatcagccaggctgatgct

SEQ ID NO: 898706 - DNA, 22 bp, Artificial Sequence
  chemically synthesized
tctgtatcagccaggctgatgc

SEQ ID NO: 898707 - DNA, 22 bp, Artificial Sequence
  chemically synthesized
gaaggaccttagcatcagcctg

SEQ ID NO: 898708 - DNA, 22 bp, Artificial Sequence
  chemically synthesized
ttctgtatcagccaggctgatg

SEQ ID NO: 898709 - DNA, 22 bp, Artificial Sequence
  chemically synthesized
aaggaccttagcatcagcctgg

SEQ ID NO: 898710 - DNA, 22 bp, Artificial Sequence
  chemically synthesized
agcatcagcctggctgatacag

SEQ ID NO: 898711 - DNA, 22 bp, Artificial Sequence
  chemically synthesized
gcatcagcctggctgatacaga

SEQ ID NO: 898712 - DNA, 22 bp, Artificial Sequence
  chemically synthesized
cgaatccaagggacatttttct

SEQ ID NO: 898713 - DNA, 22 bp, Artificial Sequence
  chemically synthesized
ctacgaatccaagggacatttt

SEQ ID NO: 898714 - DNA, 22 bp, Artificial Sequence
  chemically synthesized
gctgatacagaaaaatgtccct

SEQ ID NO: 898715 - DNA, 22 bp, Artificial Sequence
  chemically synthesized
cctacgaatccaagggacattt

SEQ ID NO: 898716 - DNA, 22 bp, Artificial Sequence
  chemically synthesized
atacagaaaaatgtcccttgga

SEQ ID NO: 898717 - DNA, 22 bp, Artificial Sequence
  chemically synthesized
aaaatgatatttcctacgaatc

SEQ ID NO: 898718 - DNA, 22 bp, Artificial Sequence
  chemically synthesized
ggattcgtaggaaatatcattt

SEQ ID NO: 898719 - DNA, 22 bp, Artificial Sequence
  chemically synthesized
gattcgtaggaaatatcatttt

SEQ ID NO: 898720 - DNA, 22 bp, Artificial Sequence
  chemically synthesized
gtaggaaatatcatttttaata

SEQ ID NO: 898721 - DNA, 22 bp, Artificial Sequence
  chemically synthesized
ttaatatttttgtttgctcatt

SEQ ID NO: 898722 - DNA, 22 bp, Artificial Sequence
  chemically synthesized
taatatttttgtttgctcattt

SEQ ID NO: 898723 - DNA, 22 bp, Artificial Sequence
  chemically synthesized
aatatttttgtttgctcatttt

SEQ ID NO: 898724 - DNA, 22 bp, Artificial Sequence
  chemically synthesized
atatttttgtttgctcattttg

SEQ ID NO: 898725 - DNA, 22 bp, Artificial Sequence
  chemically synthesized
tcaaacaaatgaacaaaatgag

SEQ ID NO: 898726 - DNA, 22 bp, Artificial Sequence
  chemically synthesized
atcaaacaaatgaacaaaatga

SEQ ID NO: 898727 - DNA, 22 bp, Artificial Sequence
  chemically synthesized
tatcaaacaaatgaacaaaatg

SEQ ID NO: 898728 - DNA, 22 bp, Artificial Sequence
  chemically synthesized
ttatcaaacaaatgaacaaaat

SEQ ID NO: 898729 - DNA, 22 bp, Artificial Sequence
  chemically synthesized
ttgtttgctcattttgttcatt

SEQ ID NO: 898730 - DNA, 22 bp, Artificial Sequence
  chemically synthesized
tgtttgctcattttgttcattt

SEQ ID NO: 898731 - DNA, 22 bp, Artificial Sequence
  chemically synthesized
gtttgctcattttgttcatttg

SEQ ID NO: 898732 - DNA, 22 bp, Artificial Sequence
  chemically synthesized
tttgctcattttgttcatttgt

SEQ ID NO: 898733 - DNA, 22 bp, Artificial Sequence
  chemically synthesized
aatttttatcaaacaaatgaac

SEQ ID NO: 898734 - DNA, 22 bp, Artificial Sequence
  chemically synthesized
gaatttttatcaaacaaatgaa

SEQ ID NO: 898735 - DNA, 22 bp, Artificial Sequence
  chemically synthesized
gctcattttgttcatttgtttg

SEQ ID NO: 898736 - DNA, 22 bp, Artificial Sequence
  chemically synthesized
ctcattttgttcatttgtttga

SEQ ID NO: 898737 - DNA, 22 bp, Artificial Sequence
  chemically synthesized
cttgaatttttatcaaacaaat

SEQ ID NO: 898738 - DNA, 22 bp, Artificial Sequence
  chemically synthesized
ccttgaatttttatcaaacaaa

SEQ ID NO: 898739 - DNA, 22 bp, Artificial Sequence
  chemically synthesized
tccttgaatttttatcaaacaa

SEQ ID NO: 898740 - DNA, 22 bp, Artificial Sequence
  chemically synthesized
attttgttcatttgtttgataa

SEQ ID NO: 898741 - DNA, 22 bp, Artificial Sequence
  chemically synthesized
gttttccttgaatttttatcaa

SEQ ID NO: 898742 - DNA, 22 bp, Artificial Sequence
  chemically synthesized
tgttcatttgtttgataaaaat

SEQ ID NO: 898743 - DNA, 22 bp, Artificial Sequence
  chemically synthesized
agttttccttgaatttttatca

SEQ ID NO: 898744 - DNA, 22 bp, Artificial Sequence
  chemically synthesized
gttcatttgtttgataaaaatt

SEQ ID NO: 898745 - DNA, 22 bp, Artificial Sequence
  chemically synthesized
ttcatttgtttgataaaaattc

SEQ ID NO: 898746 - DNA, 22 bp, Artificial Sequence
  chemically synthesized
atttgtttgataaaaattcaag

SEQ ID NO: 898747 - DNA, 22 bp, Artificial Sequence
  chemically synthesized
gtttgataaaaattcaaggaaa

SEQ ID NO: 898748 - DNA, 22 bp, Artificial Sequence
  chemically synthesized
tttgataaaaattcaaggaaaa

SEQ ID NO: 898749 - DNA, 22 bp, Artificial Sequence
  chemically synthesized
gataaaaattcaaggaaaacta

SEQ ID NO: 898750 - DNA, 22 bp, Artificial Sequence
  chemically synthesized
ataaaaattcaaggaaaactaa

SEQ ID NO: 898751 - DNA, 22 bp, Artificial Sequence
  chemically synthesized
tacagatcatgacttagttttc

SEQ ID NO: 898752 - DNA, 22 bp, Artificial Sequence
  chemically synthesized
aaggaaaactaagtcatgatct

SEQ ID NO: 898753 - DNA, 22 bp, Artificial Sequence
  chemically synthesized
ggtaaaactgtacagatcatga

SEQ ID NO: 898754 - DNA, 22 bp, Artificial Sequence
  chemically synthesized
gggtaaaactgtacagatcatg

SEQ ID NO: 898755 - DNA, 22 bp, Artificial Sequence
  chemically synthesized
cttgggtaaaactgtacagatc

SEQ ID NO: 898756 - DNA, 22 bp, Artificial Sequence
  chemically synthesized
ttgcttgggtaaaactgtacag

SEQ ID NO: 898757 - DNA, 22 bp, Artificial Sequence
  chemically synthesized
gttgcttgggtaaaactgtaca

SEQ ID NO: 898758 - DNA, 22 bp, Artificial Sequence
  chemically synthesized
agtcatgatctgtacagtttta

SEQ ID NO: 898759 - DNA, 22 bp, Artificial Sequence
  chemically synthesized
ttgttgcttgggtaaaactgta

SEQ ID NO: 898760 - DNA, 22 bp, Artificial Sequence
  chemically synthesized
tggttcttgttgcttgggtaaa

SEQ ID NO: 898761 - DNA, 22 bp, Artificial Sequence
  chemically synthesized
ttatggttcttgttgcttgggt

SEQ ID NO: 898762 - DNA, 22 bp, Artificial Sequence
  chemically synthesized
gttatggttcttgttgcttggg

SEQ ID NO: 898763 - DNA, 22 bp, Artificial Sequence
  chemically synthesized
tacagttttacccaagcaacaa

SEQ ID NO: 898764 - DNA, 22 bp, Artificial Sequence
  chemically synthesized
tttgttatggttcttgttgctt

SEQ ID NO: 898765 - DNA, 22 bp, Artificial Sequence
  chemically synthesized
ttatttgttatggttcttgttg

SEQ ID NO: 898766 - DNA, 22 bp, Artificial Sequence
  chemically synthesized
ttgttatttgttatggttcttg

SEQ ID NO: 898767 - DNA, 22 bp, Artificial Sequence
  chemically synthesized
tacccaagcaacaagaaccata

SEQ ID NO: 898768 - DNA, 22 bp, Artificial Sequence
  chemically synthesized
acccaagcaacaagaaccataa

SEQ ID NO: 898769 - DNA, 22 bp, Artificial Sequence
  chemically synthesized
cccaagcaacaagaaccataac

SEQ ID NO: 898770 - DNA, 22 bp, Artificial Sequence
  chemically synthesized
aataaatatcaagttattgtta

SEQ ID NO: 898771 - DNA, 22 bp, Artificial Sequence
  chemically synthesized
agggcctaaataaatatcaagt

SEQ ID NO: 898772 - DNA, 22 bp, Artificial Sequence
  chemically synthesized
acagacacctcagggcctaaat

SEQ ID NO: 898773 - DNA, 22 bp, Artificial Sequence
  chemically synthesized
aacagacacctcagggcctaaa

SEQ ID NO: 898774 - DNA, 22 bp, Artificial Sequence
  chemically synthesized
taacagacacctcagggcctaa

SEQ ID NO: 898775 - DNA, 22 bp, Artificial Sequence
  chemically synthesized
gatatttatttaggccctgagg

SEQ ID NO: 898776 - DNA, 22 bp, Artificial Sequence
  chemically synthesized
atatttatttaggccctgaggt

SEQ ID NO: 898777 - DNA, 22 bp, Artificial Sequence
  chemically synthesized
atttaggccctgaggtgtctgt

SEQ ID NO: 898778 - DNA, 22 bp, Artificial Sequence
  chemically synthesized
tttaggccctgaggtgtctgtt

SEQ ID NO: 898779 - DNA, 22 bp, Artificial Sequence
  chemically synthesized
agaaaccaaattttaacagaca

SEQ ID NO: 898780 - DNA, 22 bp, Artificial Sequence
  chemically synthesized
aggccctgaggtgtctgttaaa

SEQ ID NO: 898781 - DNA, 22 bp, Artificial Sequence
  chemically synthesized
ggccctgaggtgtctgttaaaa

SEQ ID NO: 898782 - DNA, 22 bp, Artificial Sequence
  chemically synthesized
ttaagaaaccaaattttaacag

SEQ ID NO: 898783 - DNA, 22 bp, Artificial Sequence
  chemically synthesized
tattaagaaaccaaattttaac

SEQ ID NO: 898784 - DNA, 22 bp, Artificial Sequence
  chemically synthesized
aggtgtctgttaaaatttggtt

SEQ ID NO: 898785 - DNA, 22 bp, Artificial Sequence
  chemically synthesized
aattctattaagaaaccaaatt

SEQ ID NO: 898786 - DNA, 22 bp, Artificial Sequence
  chemically synthesized
aaattctattaagaaaccaaat

SEQ ID NO: 898787 - DNA, 22 bp, Artificial Sequence
  chemically synthesized
taaattctattaagaaaccaaa

SEQ ID NO: 898788 - DNA, 22 bp, Artificial Sequence
  chemically synthesized
ttaaattctattaagaaaccaa

SEQ ID NO: 898789 - DNA, 22 bp, Artificial Sequence
  chemically synthesized
tttaaattctattaagaaacca

SEQ ID NO: 898790 - DNA, 22 bp, Artificial Sequence
  chemically synthesized
ttttaaattctattaagaaacc

SEQ ID NO: 898791 - DNA, 22 bp, Artificial Sequence
  chemically synthesized
tttttaaattctattaagaaac

SEQ ID NO: 898792 - DNA, 22 bp, Artificial Sequence
  chemically synthesized
ttttttaaattctattaagaaa

SEQ ID NO: 898793 - DNA, 22 bp, Artificial Sequence
  chemically synthesized
ttaaaatttggtttcttaatag

SEQ ID NO: 898794 - DNA, 22 bp, Artificial Sequence
  chemically synthesized
tttttttaaattctattaagaa

SEQ ID NO: 898795 - DNA, 22 bp, Artificial Sequence
  chemically synthesized
ttttttttaaattctattaaga

SEQ ID NO: 898796 - DNA, 22 bp, Artificial Sequence
  chemically synthesized
tttttttttaaattctattaag

SEQ ID NO: 898797 - DNA, 22 bp, Artificial Sequence
  chemically synthesized
aaatttggtttcttaatagaat

SEQ ID NO: 898798 - DNA, 22 bp, Artificial Sequence
  chemically synthesized
ttttttttttttaaattctatt

SEQ ID NO: 898799 - DNA, 22 bp, Artificial Sequence
  chemically synthesized
ggtttcttaatagaatttaaaa

SEQ ID NO: 898800 - DNA, 22 bp, Artificial Sequence
  chemically synthesized
gtttcttaatagaatttaaaaa

SEQ ID NO: 898801 - DNA, 22 bp, Artificial Sequence
  chemically synthesized
cttaatagaatttaaaaaaaaa

SEQ ID NO: 898802 - DNA, 22 bp, Artificial Sequence
  chemically synthesized
ttaatagaatttaaaaaaaaaa

SEQ ID NO: 898803 - DNA, 22 bp, Artificial Sequence
  chemically synthesized
aatagaatttaaaaaaaaaaaa

SEQ ID NO: 898804 - DNA, 22 bp, Artificial Sequence
  chemically synthesized
atagaatttaaaaaaaaaaaac

SEQ ID NO: 898805 - DNA, 22 bp, Artificial Sequence
  chemically synthesized
aaaaaaaaaaaacagtctcctt

SEQ ID NO: 898806 - DNA, 22 bp, Artificial Sequence
  chemically synthesized
aaaaaaaaaaacagtctccttc

SEQ ID NO: 898807 - DNA, 22 bp, Artificial Sequence
  chemically synthesized
tataaaagtaaaaagaaggaga

SEQ ID NO: 898808 - DNA, 22 bp, Artificial Sequence
  chemically synthesized
atataaaagtaaaaagaaggag

SEQ ID NO: 898809 - DNA, 22 bp, Artificial Sequence
  chemically synthesized
aagtacagtgatttatataaaa

SEQ ID NO: 898810 - DNA, 22 bp, Artificial Sequence
  chemically synthesized
cttctttttacttttatataaa

SEQ ID NO: 898811 - DNA, 22 bp, Artificial Sequence
  chemically synthesized
tgaagtacagtgatttatataa

SEQ ID NO: 898812 - DNA, 22 bp, Artificial Sequence
  chemically synthesized
ctttttacttttatataaatca

SEQ ID NO: 898813 - DNA, 22 bp, Artificial Sequence
  chemically synthesized
tttttacttttatataaatcac

SEQ ID NO: 898814 - DNA, 22 bp, Artificial Sequence
  chemically synthesized
tttacttttatataaatcactg

SEQ ID NO: 898815 - DNA, 22 bp, Artificial Sequence
  chemically synthesized
ttacttttatataaatcactgt

SEQ ID NO: 898816 - DNA, 22 bp, Artificial Sequence
  chemically synthesized
tacttttatataaatcactgta

SEQ ID NO: 898817 - DNA, 22 bp, Artificial Sequence
  chemically synthesized
acttttatataaatcactgtac

SEQ ID NO: 898818 - DNA, 22 bp, Artificial Sequence
  chemically synthesized
cttttatataaatcactgtact

SEQ ID NO: 898819 - DNA, 22 bp, Artificial Sequence
  chemically synthesized
ttatataaatcactgtacttca

SEQ ID NO: 898820 - DNA, 22 bp, Artificial Sequence
  chemically synthesized
aaatccatattctgaagtacag

SEQ ID NO: 898821 - DNA, 22 bp, Artificial Sequence
  chemically synthesized
tatataaatcactgtacttcag

SEQ ID NO: 898822 - DNA, 22 bp, Artificial Sequence
  chemically synthesized
atataaatcactgtacttcaga

SEQ ID NO: 898823 - DNA, 22 bp, Artificial Sequence
  chemically synthesized
tataaatcactgtacttcagaa

SEQ ID NO: 898824 - DNA, 22 bp, Artificial Sequence
  chemically synthesized
cccccctgaaatccatattctg

SEQ ID NO: 898825 - DNA, 22 bp, Artificial Sequence
  chemically synthesized
ccccccctgaaatccatattct

SEQ ID NO: 898826 - DNA, 22 bp, Artificial Sequence
  chemically synthesized
tccccccctgaaatccatattc

SEQ ID NO: 898827 - DNA, 22 bp, Artificial Sequence
  chemically synthesized
tttccccccctgaaatccatat

SEQ ID NO: 898828 - DNA, 22 bp, Artificial Sequence
  chemically synthesized
ctttccccccctgaaatccata

SEQ ID NO: 898829 - DNA, 22 bp, Artificial Sequence
  chemically synthesized
tctttccccccctgaaatccat

SEQ ID NO: 898830 - DNA, 22 bp, Artificial Sequence
  chemically synthesized
tacttcagaatatggatttcag

SEQ ID NO: 898831 - DNA, 22 bp, Artificial Sequence
  chemically synthesized
cctttctttccccccctgaaat

SEQ ID NO: 898832 - DNA, 22 bp, Artificial Sequence
  chemically synthesized
ccctttctttccccccctgaaa

SEQ ID NO: 898833 - DNA, 22 bp, Artificial Sequence
  chemically synthesized
cagaatatggatttcagggggg

SEQ ID NO: 898834 - DNA, 22 bp, Artificial Sequence
  chemically synthesized
tccctttctttccccccctgaa

SEQ ID NO: 898835 - DNA, 22 bp, Artificial Sequence
  chemically synthesized
agaatatggatttcaggggggg

SEQ ID NO: 898836 - DNA, 22 bp, Artificial Sequence
  chemically synthesized
tgtggtgtagttttccctttct

SEQ ID NO: 898837 - DNA, 22 bp, Artificial Sequence
  chemically synthesized
cagggggggaaagaaagggaaa

SEQ ID NO: 898838 - DNA, 22 bp, Artificial Sequence
  chemically synthesized
agggggggaaagaaagggaaaa

SEQ ID NO: 898839 - DNA, 22 bp, Artificial Sequence
  chemically synthesized
aggatacgtgattatgtggtgt

SEQ ID NO: 898840 - DNA, 22 bp, Artificial Sequence
  chemically synthesized
gaggatacgtgattatgtggtg

SEQ ID NO: 898841 - DNA, 22 bp, Artificial Sequence
  chemically synthesized
aatttgaggatacgtgattatg

SEQ ID NO: 898842 - DNA, 22 bp, Artificial Sequence
  chemically synthesized
tgaatttgaggatacgtgatta

SEQ ID NO: 898843 - DNA, 22 bp, Artificial Sequence
  chemically synthesized
ctgaatttgaggatacgtgatt

SEQ ID NO: 898844 - DNA, 22 bp, Artificial Sequence
  chemically synthesized
caccacataatcacgtatcctc

SEQ ID NO: 898845 - DNA, 22 bp, Artificial Sequence
  chemically synthesized
aatgaaacttctgaatttgagg

SEQ ID NO: 898846 - DNA, 22 bp, Artificial Sequence
  chemically synthesized
aaatgaaacttctgaatttgag

SEQ ID NO: 898847 - DNA, 22 bp, Artificial Sequence
  chemically synthesized
ttaaatgaaacttctgaatttg

SEQ ID NO: 898848 - DNA, 22 bp, Artificial Sequence
  chemically synthesized
cttaaatgaaacttctgaattt

SEQ ID NO: 898849 - DNA, 22 bp, Artificial Sequence
  chemically synthesized
tttcttaaatgaaacttctgaa

SEQ ID NO: 898850 - DNA, 22 bp, Artificial Sequence
  chemically synthesized
aattgtttcttaaatgaaactt

SEQ ID NO: 898851 - DNA, 22 bp, Artificial Sequence
  chemically synthesized
aaattcagaagtttcatttaag

SEQ ID NO: 898852 - DNA, 22 bp, Artificial Sequence
  chemically synthesized
agaagtttcatttaagaaacaa

SEQ ID NO: 898853 - DNA, 22 bp, Artificial Sequence
  chemically synthesized
catttaagaaacaatttagctg

SEQ ID NO: 898854 - DNA, 22 bp, Artificial Sequence
  chemically synthesized
atttaagaaacaatttagctgg

SEQ ID NO: 898855 - DNA, 22 bp, Artificial Sequence
  chemically synthesized
aagaaacaatttagctggggat

SEQ ID NO: 898856 - DNA, 22 bp, Artificial Sequence
  chemically synthesized
agaaacaatttagctggggatg

SEQ ID NO: 898857 - DNA, 22 bp, Artificial Sequence
  chemically synthesized
taggcaggcaccaccatcccca

SEQ ID NO: 898858 - DNA, 22 bp, Artificial Sequence
  chemically synthesized
ggattataggcaggcaccacca

SEQ ID NO: 898859 - DNA, 22 bp, Artificial Sequence
  chemically synthesized
agctggggatggtggtgcctgc

SEQ ID NO: 898860 - DNA, 22 bp, Artificial Sequence
  chemically synthesized
gctggggatggtggtgcctgcc

SEQ ID NO: 898861 - DNA, 22 bp, Artificial Sequence
  chemically synthesized
gggatggtggtgcctgcctata

SEQ ID NO: 898862 - DNA, 22 bp, Artificial Sequence
  chemically synthesized
ccaaagtgctaggattataggc

SEQ ID NO: 898863 - DNA, 22 bp, Artificial Sequence
  chemically synthesized
ggcctcccaaagtgctaggatt

SEQ ID NO: 898864 - DNA, 22 bp, Artificial Sequence
  chemically synthesized
ctcggcctcccaaagtgctagg

SEQ ID NO: 898865 - DNA, 22 bp, Artificial Sequence
  chemically synthesized
cctcggcctcccaaagtgctag

SEQ ID NO: 898866 - DNA, 22 bp, Artificial Sequence
  chemically synthesized
cctataatcctagcactttggg

SEQ ID NO: 898867 - DNA, 22 bp, Artificial Sequence
  chemically synthesized
cttcctcggcctcccaaagtgc

SEQ ID NO: 898868 - DNA, 22 bp, Artificial Sequence
  chemically synthesized
taatcctagcactttgggaggc

SEQ ID NO: 898869 - DNA, 22 bp, Artificial Sequence
  chemically synthesized
aagcagtcctccttcctcggcc

SEQ ID NO: 898870 - DNA, 22 bp, Artificial Sequence
  chemically synthesized
gcactttgggaggccgaggaag

SEQ ID NO: 898871 - DNA, 22 bp, Artificial Sequence
  chemically synthesized
ggctcaagcagtcctccttcct

SEQ ID NO: 898872 - DNA, 22 bp, Artificial Sequence
  chemically synthesized
tgggaggccgaggaaggaggac

SEQ ID NO: 898873 - DNA, 22 bp, Artificial Sequence
  chemically synthesized
gggaggccgaggaaggaggact

SEQ ID NO: 898874 - DNA, 22 bp, Artificial Sequence
  chemically synthesized
ctgggctcaagcagtcctcctt

SEQ ID NO: 898875 - DNA, 22 bp, Artificial Sequence
  chemically synthesized
ggaggccgaggaaggaggactg

SEQ ID NO: 898876 - DNA, 22 bp, Artificial Sequence
  chemically synthesized
gtatccaactcctgggctcaag

SEQ ID NO: 898877 - DNA, 22 bp, Artificial Sequence
  chemically synthesized
ccaggctggtatccaactcctg

SEQ ID NO: 898878 - DNA, 22 bp, Artificial Sequence
  chemically synthesized
cttgagcccaggagttggatac

SEQ ID NO: 898879 - DNA, 22 bp, Artificial Sequence
  chemically synthesized
cctcccaggctggtatccaact

SEQ ID NO: 898880 - DNA, 22 bp, Artificial Sequence
  chemically synthesized
gagcccaggagttggataccag

SEQ ID NO: 898881 - DNA, 22 bp, Artificial Sequence
  chemically synthesized
agcccaggagttggataccagc

SEQ ID NO: 898882 - DNA, 22 bp, Artificial Sequence
  chemically synthesized
tgttgcctcccaggctggtatc

SEQ ID NO: 898883 - DNA, 22 bp, Artificial Sequence
  chemically synthesized
actatgttgcctcccaggctgg

SEQ ID NO: 898884 - DNA, 22 bp, Artificial Sequence
  chemically synthesized
gataccagcctgggaggcaaca

SEQ ID NO: 898885 - DNA, 22 bp, Artificial Sequence
  chemically synthesized
aaacaacaatctcactatgttg

SEQ ID NO: 898886 - DNA, 22 bp, Artificial Sequence
  chemically synthesized
gaaacaacaatctcactatgtt

SEQ ID NO: 898887 - DNA, 22 bp, Artificial Sequence
  chemically synthesized
tgaaacaacaatctcactatgt

SEQ ID NO: 898888 - DNA, 22 bp, Artificial Sequence
  chemically synthesized
ttgaaacaacaatctcactatg

SEQ ID NO: 898889 - DNA, 22 bp, Artificial Sequence
  chemically synthesized
tttgaaacaacaatctcactat

SEQ ID NO: 898890 - DNA, 22 bp, Artificial Sequence
  chemically synthesized
ttttgaaacaacaatctcacta

SEQ ID NO: 898891 - DNA, 22 bp, Artificial Sequence
  chemically synthesized
tttttgaaacaacaatctcact

SEQ ID NO: 898892 - DNA, 22 bp, Artificial Sequence
  chemically synthesized
ggaggcaacatagtgagattgt

SEQ ID NO: 898893 - DNA, 22 bp, Artificial Sequence
  chemically synthesized
ttttttttgaaacaacaatctc

SEQ ID NO: 898894 - DNA, 22 bp, Artificial Sequence
  chemically synthesized
gttttttttgaaacaacaatct

SEQ ID NO: 898895 - DNA, 22 bp, Artificial Sequence
  chemically synthesized
tgttttttttgaaacaacaatc

SEQ ID NO: 898896 - DNA, 22 bp, Artificial Sequence
  chemically synthesized
ttttgttttttttgaaacaaca

SEQ ID NO: 898897 - DNA, 22 bp, Artificial Sequence
  chemically synthesized
gttttgttttttttgaaacaac

SEQ ID NO: 898898 - DNA, 22 bp, Artificial Sequence
  chemically synthesized
tgttttgttttttttgaaacaa

SEQ ID NO: 898899 - DNA, 22 bp, Artificial Sequence
  chemically synthesized
ttgttttgttttttttgaaaca

SEQ ID NO: 898900 - DNA, 22 bp, Artificial Sequence
  chemically synthesized
tttgttttgttttttttgaaac

SEQ ID NO: 898901 - DNA, 22 bp, Artificial Sequence
  chemically synthesized
ttttgttttgttttttttgaaa

SEQ ID NO: 898902 - DNA, 22 bp, Artificial Sequence
  chemically synthesized
tttttgttttgttttttttgaa

SEQ ID NO: 898903 - DNA, 22 bp, Artificial Sequence
  chemically synthesized
ttttttgttttgttttttttga

SEQ ID NO: 898904 - DNA, 22 bp, Artificial Sequence
  chemically synthesized
tttttttgttttgttttttttg

SEQ ID NO: 898905 - DNA, 22 bp, Artificial Sequence
  chemically synthesized
ttttttttgttttgtttttttt

SEQ ID NO: 898906 - DNA, 22 bp, Artificial Sequence
  chemically synthesized
tttttttttgttttgttttttt

SEQ ID NO: 898907 - DNA, 22 bp, Artificial Sequence
  chemically synthesized
tttttttttttgttttgttttt

SEQ ID NO: 898908 - DNA, 22 bp, Artificial Sequence
  chemically synthesized
ctttttttttttgttttgtttt

SEQ ID NO: 898909 - DNA, 22 bp, Artificial Sequence
  chemically synthesized
ttgtttcaaaaaaaacaaaaca

SEQ ID NO: 898910 - DNA, 22 bp, Artificial Sequence
  chemically synthesized
ttctttttttttttgttttgtt

SEQ ID NO: 898911 - DNA, 22 bp, Artificial Sequence
  chemically synthesized
cttctttttttttttgttttgt

SEQ ID NO: 898912 - DNA, 22 bp, Artificial Sequence
  chemically synthesized
tttcaaaaaaaacaaaacaaaa

SEQ ID NO: 898913 - DNA, 22 bp, Artificial Sequence
  chemically synthesized
ttcttctttttttttttgtttt

SEQ ID NO: 898914 - DNA, 22 bp, Artificial Sequence
  chemically synthesized
cttcttctttttttttttgttt

SEQ ID NO: 898915 - DNA, 22 bp, Artificial Sequence
  chemically synthesized
caaaaaaaacaaaacaaaaaaa

SEQ ID NO: 898916 - DNA, 22 bp, Artificial Sequence
  chemically synthesized
tcttcttctttttttttttgtt

SEQ ID NO: 898917 - DNA, 22 bp, Artificial Sequence
  chemically synthesized
aaaaaaaacaaaacaaaaaaaa

SEQ ID NO: 898918 - DNA, 22 bp, Artificial Sequence
  chemically synthesized
tttcttcttctttttttttttg

SEQ ID NO: 898919 - DNA, 22 bp, Artificial Sequence
  chemically synthesized
ctttcttcttcttttttttttt

SEQ ID NO: 898920 - DNA, 22 bp, Artificial Sequence
  chemically synthesized
tctttcttcttctttttttttt

SEQ ID NO: 898921 - DNA, 22 bp, Artificial Sequence
  chemically synthesized
tttctttcttcttctttttttt

SEQ ID NO: 898922 - DNA, 22 bp, Artificial Sequence
  chemically synthesized
ctttctttcttcttcttttttt

SEQ ID NO: 898923 - DNA, 22 bp, Artificial Sequence
  chemically synthesized
tctttctttcttcttctttttt

SEQ ID NO: 898924 - DNA, 22 bp, Artificial Sequence
  chemically synthesized
tttctttctttcttcttctttt

SEQ ID NO: 898925 - DNA, 22 bp, Artificial Sequence
  chemically synthesized
ctttctttctttcttcttcttt

SEQ ID NO: 898926 - DNA, 22 bp, Artificial Sequence
  chemically synthesized
tctttctttctttcttcttctt

SEQ ID NO: 898927 - DNA, 22 bp, Artificial Sequence
  chemically synthesized
ttctttctttctttcttcttct

SEQ ID NO: 898928 - DNA, 22 bp, Artificial Sequence
  chemically synthesized
tttctttctttctttcttcttc

SEQ ID NO: 898929 - DNA, 22 bp, Artificial Sequence
  chemically synthesized
ttttctttctttctttcttctt

SEQ ID NO: 898930 - DNA, 22 bp, Artificial Sequence
  chemically synthesized
ttttttctttctttctttcttc

SEQ ID NO: 898931 - DNA, 22 bp, Artificial Sequence
  chemically synthesized
cttttttctttctttctttctt

SEQ ID NO: 898932 - DNA, 22 bp, Artificial Sequence
  chemically synthesized
tcttttttctttctttctttct

SEQ ID NO: 898933 - DNA, 22 bp, Artificial Sequence
  chemically synthesized
ttcttttttctttctttctttc

SEQ ID NO: 898934 - DNA, 22 bp, Artificial Sequence
  chemically synthesized
tttttcttttttctttctttct

SEQ ID NO: 898935 - DNA, 22 bp, Artificial Sequence
  chemically synthesized
gtttttcttttttctttctttc

SEQ ID NO: 898936 - DNA, 22 bp, Artificial Sequence
  chemically synthesized
tgtttttcttttttctttcttt

SEQ ID NO: 898937 - DNA, 22 bp, Artificial Sequence
  chemically synthesized
ctttgtttttcttttttctttc

SEQ ID NO: 898938 - DNA, 22 bp, Artificial Sequence
  chemically synthesized
ataaattgctttgtttttcttt

SEQ ID NO: 898939 - DNA, 22 bp, Artificial Sequence
  chemically synthesized
gataaattgctttgtttttctt

SEQ ID NO: 898940 - DNA, 22 bp, Artificial Sequence
  chemically synthesized
tgataaattgctttgtttttct

SEQ ID NO: 898941 - DNA, 22 bp, Artificial Sequence
  chemically synthesized
cattttgataaattgctttgtt

SEQ ID NO: 898942 - DNA, 22 bp, Artificial Sequence
  chemically synthesized
aagttacattttgataaattgc

SEQ ID NO: 898943 - DNA, 22 bp, Artificial Sequence
  chemically synthesized
aaagttacattttgataaattg

SEQ ID NO: 898944 - DNA, 22 bp, Artificial Sequence
  chemically synthesized
aatttaaagttacattttgata

SEQ ID NO: 898945 - DNA, 22 bp, Artificial Sequence
  chemically synthesized
aaatttaaagttacattttgat

SEQ ID NO: 898946 - DNA, 22 bp, Artificial Sequence
  chemically synthesized
atacatttaaatttaaagttac

SEQ ID NO: 898947 - DNA, 22 bp, Artificial Sequence
  chemically synthesized
aatacatttaaatttaaagtta

SEQ ID NO: 898948 - DNA, 22 bp, Artificial Sequence
  chemically synthesized
atcaaaatgtaactttaaattt

SEQ ID NO: 898949 - DNA, 22 bp, Artificial Sequence
  chemically synthesized
tcaaaatgtaactttaaattta

SEQ ID NO: 898950 - DNA, 22 bp, Artificial Sequence
  chemically synthesized
agtttaatacatttaaatttaa

SEQ ID NO: 898951 - DNA, 22 bp, Artificial Sequence
  chemically synthesized
aagtttaatacatttaaattta

SEQ ID NO: 898952 - DNA, 22 bp, Artificial Sequence
  chemically synthesized
tatttaagtttaatacatttaa

SEQ ID NO: 898953 - DNA, 22 bp, Artificial Sequence
  chemically synthesized
aattgtatttaagtttaataca

SEQ ID NO: 898954 - DNA, 22 bp, Artificial Sequence
  chemically synthesized
aaattgtatttaagtttaatac

SEQ ID NO: 898955 - DNA, 22 bp, Artificial Sequence
  chemically synthesized
taaatttaaatgtattaaactt

SEQ ID NO: 898956 - DNA, 22 bp, Artificial Sequence
  chemically synthesized
aaatttaaatgtattaaactta

SEQ ID NO: 898957 - DNA, 22 bp, Artificial Sequence
  chemically synthesized
aatttaaatgtattaaacttaa

SEQ ID NO: 898958 - DNA, 22 bp, Artificial Sequence
  chemically synthesized
atatttaaattgtatttaagtt

SEQ ID NO: 898959 - DNA, 22 bp, Artificial Sequence
  chemically synthesized
aaatgtattaaacttaaataca

SEQ ID NO: 898960 - DNA, 22 bp, Artificial Sequence
  chemically synthesized
aatgtattaaacttaaatacaa

SEQ ID NO: 898961 - DNA, 22 bp, Artificial Sequence
  chemically synthesized
aggaactgatatttaaattgta

SEQ ID NO: 898962 - DNA, 22 bp, Artificial Sequence
  chemically synthesized
aacttaaatacaatttaaatat

SEQ ID NO: 898963 - DNA, 22 bp, Artificial Sequence
  chemically synthesized
aaatacaatttaaatatcagtt

SEQ ID NO: 898964 - DNA, 22 bp, Artificial Sequence
  chemically synthesized
aatacaatttaaatatcagttc

SEQ ID NO: 898965 - DNA, 22 bp, Artificial Sequence
  chemically synthesized
aaatatcagttccttagttgca

SEQ ID NO: 898966 - DNA, 22 bp, Artificial Sequence
  chemically synthesized
aatatcagttccttagttgcac

SEQ ID NO: 898967 - DNA, 22 bp, Artificial Sequence
  chemically synthesized
gaaatgtggtaagtgcaactaa

SEQ ID NO: 898968 - DNA, 22 bp, Artificial Sequence
  chemically synthesized
agcattggaaatgtggtaagtg

SEQ ID NO: 898969 - DNA, 22 bp, Artificial Sequence
  chemically synthesized
gagcattggaaatgtggtaagt

SEQ ID NO: 898970 - DNA, 22 bp, Artificial Sequence
  chemically synthesized
tgagcattggaaatgtggtaag

SEQ ID NO: 898971 - DNA, 22 bp, Artificial Sequence
  chemically synthesized
cttagttgcacttaccacattt

SEQ ID NO: 898972 - DNA, 22 bp, Artificial Sequence
  chemically synthesized
agttgcacttaccacatttcca

SEQ ID NO: 898973 - DNA, 22 bp, Artificial Sequence
  chemically synthesized
gttgcacttaccacatttccaa

SEQ ID NO: 898974 - DNA, 22 bp, Artificial Sequence
  chemically synthesized
cacttaccacatttccaatgct

SEQ ID NO: 898975 - DNA, 22 bp, Artificial Sequence
  chemically synthesized
accacatttccaatgctcaaaa

SEQ ID NO: 898976 - DNA, 22 bp, Artificial Sequence
  chemically synthesized
atacaatgtgggttttgagcat

SEQ ID NO: 898977 - DNA, 22 bp, Artificial Sequence
  chemically synthesized
ccacatttccaatgctcaaaac

SEQ ID NO: 898978 - DNA, 22 bp, Artificial Sequence
  chemically synthesized
tctaatacaatgtgggttttga

SEQ ID NO: 898979 - DNA, 22 bp, Artificial Sequence
  chemically synthesized
ccaatgctcaaaacccacattg

SEQ ID NO: 898980 - DNA, 22 bp, Artificial Sequence
  chemically synthesized
ccctgtctaatacaatgtgggt

SEQ ID NO: 898981 - DNA, 22 bp, Artificial Sequence
  chemically synthesized
caatgctcaaaacccacattgt

SEQ ID NO: 898982 - DNA, 22 bp, Artificial Sequence
  chemically synthesized
tgccctgtctaatacaatgtgg

SEQ ID NO: 898983 - DNA, 22 bp, Artificial Sequence
  chemically synthesized
tctgccctgtctaatacaatgt

SEQ ID NO: 898984 - DNA, 22 bp, Artificial Sequence
  chemically synthesized
ctctgccctgtctaatacaatg

SEQ ID NO: 898985 - DNA, 22 bp, Artificial Sequence
  chemically synthesized
tctctgccctgtctaatacaat

SEQ ID NO: 898986 - DNA, 22 bp, Artificial Sequence
  chemically synthesized
aaaacccacattgtattagaca

SEQ ID NO: 898987 - DNA, 22 bp, Artificial Sequence
  chemically synthesized
tattagacagggcagagaaaga

SEQ ID NO: 898988 - DNA, 22 bp, Artificial Sequence
  chemically synthesized
taatgagtatggtctttctctg

SEQ ID NO: 898989 - DNA, 22 bp, Artificial Sequence
  chemically synthesized
ataatgagtatggtctttctct

SEQ ID NO: 898990 - DNA, 22 bp, Artificial Sequence
  chemically synthesized
tataatgagtatggtctttctc

SEQ ID NO: 898991 - DNA, 22 bp, Artificial Sequence
  chemically synthesized
ttataatgagtatggtctttct

SEQ ID NO: 898992 - DNA, 22 bp, Artificial Sequence
  chemically synthesized
tttataatgagtatggtctttc

SEQ ID NO: 898993 - DNA, 22 bp, Artificial Sequence
  chemically synthesized
gacagggcagagaaagaccata

SEQ ID NO: 898994 - DNA, 22 bp, Artificial Sequence
  chemically synthesized
ttttataatgagtatggtcttt

SEQ ID NO: 898995 - DNA, 22 bp, Artificial Sequence
  chemically synthesized
aagataacttttttataatgag

SEQ ID NO: 898996 - DNA, 22 bp, Artificial Sequence
  chemically synthesized
ttcaagataacttttttataat

SEQ ID NO: 898997 - DNA, 22 bp, Artificial Sequence
  chemically synthesized
taacactgttcaagataacttt

SEQ ID NO: 898998 - DNA, 22 bp, Artificial Sequence
  chemically synthesized
gtaacactgttcaagataactt

SEQ ID NO: 898999 - DNA, 22 bp, Artificial Sequence
  chemically synthesized
attataaaaaagttatcttgaa

SEQ ID NO: 899000 - DNA, 22 bp, Artificial Sequence
  chemically synthesized
taaaaaagttatcttgaacagt

SEQ ID NO: 899001 - DNA, 22 bp, Artificial Sequence
  chemically synthesized
tcttgaacagtgttacaagccg

SEQ ID NO: 899002 - DNA, 22 bp, Artificial Sequence
  chemically synthesized
gaacagtgttacaagccgtact

SEQ ID NO: 899003 - DNA, 22 bp, Artificial Sequence
  chemically synthesized
aacagtgttacaagccgtacta

SEQ ID NO: 899004 - DNA, 22 bp, Artificial Sequence
  chemically synthesized
gatgcataagcaaatagtgtag

SEQ ID NO: 899005 - DNA, 22 bp, Artificial Sequence
  chemically synthesized
agatgcataagcaaatagtgta

SEQ ID NO: 899006 - DNA, 22 bp, Artificial Sequence
  chemically synthesized
tagatgcataagcaaatagtgt

SEQ ID NO: 899007 - DNA, 22 bp, Artificial Sequence
  chemically synthesized
caagccgtactacactatttgc

SEQ ID NO: 899008 - DNA, 22 bp, Artificial Sequence
  chemically synthesized
ttagatgcataagcaaatagtg

SEQ ID NO: 899009 - DNA, 22 bp, Artificial Sequence
  chemically synthesized
tttagatgcataagcaaatagt

SEQ ID NO: 899010 - DNA, 22 bp, Artificial Sequence
  chemically synthesized
gcaagttttttagatgcataag

SEQ ID NO: 899011 - DNA, 22 bp, Artificial Sequence
  chemically synthesized
cactatttgcttatgcatctaa

SEQ ID NO: 899012 - DNA, 22 bp, Artificial Sequence
  chemically synthesized
tttgcttatgcatctaaaaaac

SEQ ID NO: 899013 - DNA, 22 bp, Artificial Sequence
  chemically synthesized
gcttatgcatctaaaaaacttg

SEQ ID NO: 899014 - DNA, 22 bp, Artificial Sequence
  chemically synthesized
cttatgcatctaaaaaacttgc

SEQ ID NO: 899015 - DNA, 22 bp, Artificial Sequence
  chemically synthesized
atgcatctaaaaaacttgccaa

SEQ ID NO: 899016 - DNA, 22 bp, Artificial Sequence
  chemically synthesized
tgcatctaaaaaacttgccaat

SEQ ID NO: 899017 - DNA, 22 bp, Artificial Sequence
  chemically synthesized
aaaaaatcatgaagattggcaa

SEQ ID NO: 899018 - DNA, 22 bp, Artificial Sequence
  chemically synthesized
caaaaaatcatgaagattggca

SEQ ID NO: 899019 - DNA, 22 bp, Artificial Sequence
  chemically synthesized
tcaaaaaatcatgaagattggc

SEQ ID NO: 899020 - DNA, 22 bp, Artificial Sequence
  chemically synthesized
aaaaacttgccaatcttcatga

SEQ ID NO: 899021 - DNA, 22 bp, Artificial Sequence
  chemically synthesized
cgctttcaaaaaatcatgaaga

SEQ ID NO: 899022 - DNA, 22 bp, Artificial Sequence
  chemically synthesized
gccaatcttcatgattttttga

SEQ ID NO: 899023 - DNA, 22 bp, Artificial Sequence
  chemically synthesized
ccaatcttcatgattttttgaa

SEQ ID NO: 899024 - DNA, 22 bp, Artificial Sequence
  chemically synthesized
aaatgttacgctttcaaaaaat

SEQ ID NO: 899025 - DNA, 22 bp, Artificial Sequence
  chemically synthesized
taaaatgttacgctttcaaaaa

SEQ ID NO: 899026 - DNA, 22 bp, Artificial Sequence
  chemically synthesized
ctaaaatgttacgctttcaaaa

SEQ ID NO: 899027 - DNA, 22 bp, Artificial Sequence
  chemically synthesized
tctaaaatgttacgctttcaaa

SEQ ID NO: 899028 - DNA, 22 bp, Artificial Sequence
  chemically synthesized
ttttctaaaatgttacgctttc

SEQ ID NO: 899029 - DNA, 22 bp, Artificial Sequence
  chemically synthesized
catgattttttgaaagcgtaac

SEQ ID NO: 899030 - DNA, 22 bp, Artificial Sequence
  chemically synthesized
atgattttttgaaagcgtaaca

SEQ ID NO: 899031 - DNA, 22 bp, Artificial Sequence
  chemically synthesized
attattttctaaaatgttacgc

SEQ ID NO: 899032 - DNA, 22 bp, Artificial Sequence
  chemically synthesized
ctgattattttctaaaatgtta

SEQ ID NO: 899033 - DNA, 22 bp, Artificial Sequence
  chemically synthesized
tttgaaagcgtaacattttaga

SEQ ID NO: 899034 - DNA, 22 bp, Artificial Sequence
  chemically synthesized
ttgaaagcgtaacattttagaa

SEQ ID NO: 899035 - DNA, 22 bp, Artificial Sequence
  chemically synthesized
tgaaagcgtaacattttagaaa

SEQ ID NO: 899036 - DNA, 22 bp, Artificial Sequence
  chemically synthesized
gaaagcgtaacattttagaaaa

SEQ ID NO: 899037 - DNA, 22 bp, Artificial Sequence
  chemically synthesized
aaagcgtaacattttagaaaat

SEQ ID NO: 899038 - DNA, 22 bp, Artificial Sequence
  chemically synthesized
aacactactgattattttctaa

SEQ ID NO: 899039 - DNA, 22 bp, Artificial Sequence
  chemically synthesized
gaacactactgattattttcta

SEQ ID NO: 899040 - DNA, 22 bp, Artificial Sequence
  chemically synthesized
tagaaaataatcagtagtgttc

SEQ ID NO: 899041 - DNA, 22 bp, Artificial Sequence
  chemically synthesized
gtatatatatttgaacactact

SEQ ID NO: 899042 - DNA, 22 bp, Artificial Sequence
  chemically synthesized
agaaaataatcagtagtgttca

SEQ ID NO: 899043 - DNA, 22 bp, Artificial Sequence
  chemically synthesized
gaaaataatcagtagtgttcaa

SEQ ID NO: 899044 - DNA, 22 bp, Artificial Sequence
  chemically synthesized
tcaaattggtatatatatttga

SEQ ID NO: 899045 - DNA, 22 bp, Artificial Sequence
  chemically synthesized
aaactatcaaattggtatatat

SEQ ID NO: 899046 - DNA, 22 bp, Artificial Sequence
  chemically synthesized
ttgaaactatcaaattggtata

SEQ ID NO: 899047 - DNA, 22 bp, Artificial Sequence
  chemically synthesized
aaatatatataccaatttgata

SEQ ID NO: 899048 - DNA, 22 bp, Artificial Sequence
  chemically synthesized
atggtcatattattgaaactat

SEQ ID NO: 899049 - DNA, 22 bp, Artificial Sequence
  chemically synthesized
gatagtttcaataatatgacca

SEQ ID NO: 899050 - DNA, 22 bp, Artificial Sequence
  chemically synthesized
atagtttcaataatatgaccat

SEQ ID NO: 899051 - DNA, 22 bp, Artificial Sequence
  chemically synthesized
aaaccagcaattcatggtcata

SEQ ID NO: 899052 - DNA, 22 bp, Artificial Sequence
  chemically synthesized
caataatatgaccatgaattgc

SEQ ID NO: 899053 - DNA, 22 bp, Artificial Sequence
  chemically synthesized
aaattaaaaccagcaattcatg

SEQ ID NO: 899054 - DNA, 22 bp, Artificial Sequence
  chemically synthesized
aataatatgaccatgaattgct

SEQ ID NO: 899055 - DNA, 22 bp, Artificial Sequence
  chemically synthesized
gacagaaaatattgaaattaaa

SEQ ID NO: 899056 - DNA, 22 bp, Artificial Sequence
  chemically synthesized
tagacagaaaatattgaaatta

SEQ ID NO: 899057 - DNA, 22 bp, Artificial Sequence
  chemically synthesized
ctagacagaaaatattgaaatt

SEQ ID NO: 899058 - DNA, 22 bp, Artificial Sequence
  chemically synthesized
tctagacagaaaatattgaaat

SEQ ID NO: 899059 - DNA, 22 bp, Artificial Sequence
  chemically synthesized
ctggttttaatttcaatatttt

SEQ ID NO: 899060 - DNA, 22 bp, Artificial Sequence
  chemically synthesized
gttttaatttcaatattttctg

SEQ ID NO: 899061 - DNA, 22 bp, Artificial Sequence
  chemically synthesized
taatttcaatattttctgtcta

SEQ ID NO: 899062 - DNA, 22 bp, Artificial Sequence
  chemically synthesized
aatttcaatattttctgtctag

SEQ ID NO: 899063 - DNA, 22 bp, Artificial Sequence
  chemically synthesized
atttcaatattttctgtctaga

SEQ ID NO: 899064 - DNA, 22 bp, Artificial Sequence
  chemically synthesized
gagaaaaacaagctttctagac

SEQ ID NO: 899065 - DNA, 22 bp, Artificial Sequence
  chemically synthesized
caatattttctgtctagaaagc

SEQ ID NO: 899066 - DNA, 22 bp, Artificial Sequence
  chemically synthesized
ggagaaaaacaagctttctaga

SEQ ID NO: 899067 - DNA, 22 bp, Artificial Sequence
  chemically synthesized
aatattttctgtctagaaagct

SEQ ID NO: 899068 - DNA, 22 bp, Artificial Sequence
  chemically synthesized
tggagaaaaacaagctttctag

SEQ ID NO: 899069 - DNA, 22 bp, Artificial Sequence
  chemically synthesized
tctgtctagaaagcttgttttt

SEQ ID NO: 899070 - DNA, 22 bp, Artificial Sequence
  chemically synthesized
ctgtctagaaagcttgtttttc

SEQ ID NO: 899071 - DNA, 22 bp, Artificial Sequence
  chemically synthesized
tgtctagaaagcttgtttttct

SEQ ID NO: 899072 - DNA, 22 bp, Artificial Sequence
  chemically synthesized
tctagaaagcttgtttttctcc

SEQ ID NO: 899073 - DNA, 22 bp, Artificial Sequence
  chemically synthesized
gagaatgagttttggagaaaaa

SEQ ID NO: 899074 - DNA, 22 bp, Artificial Sequence
  chemically synthesized
agagaatgagttttggagaaaa

SEQ ID NO: 899075 - DNA, 22 bp, Artificial Sequence
  chemically synthesized
tagagaatgagttttggagaaa

SEQ ID NO: 899076 - DNA, 22 bp, Artificial Sequence
  chemically synthesized
gaaagcttgtttttctccaaaa

SEQ ID NO: 899077 - DNA, 22 bp, Artificial Sequence
  chemically synthesized
ttagagaatgagttttggagaa

SEQ ID NO: 899078 - DNA, 22 bp, Artificial Sequence
  chemically synthesized
tttagagaatgagttttggaga

SEQ ID NO: 899079 - DNA, 22 bp, Artificial Sequence
  chemically synthesized
ttttttagagaatgagttttgg

SEQ ID NO: 899080 - DNA, 22 bp, Artificial Sequence
  chemically synthesized
gttttttagagaatgagttttg

SEQ ID NO: 899081 - DNA, 22 bp, Artificial Sequence
  chemically synthesized
tgttttttagagaatgagtttt

SEQ ID NO: 899082 - DNA, 22 bp, Artificial Sequence
  chemically synthesized
gtttttctccaaaactcattct

SEQ ID NO: 899083 - DNA, 22 bp, Artificial Sequence
  chemically synthesized
tttttctccaaaactcattctc

SEQ ID NO: 899084 - DNA, 22 bp, Artificial Sequence
  chemically synthesized
ttttgttttttagagaatgagt

SEQ ID NO: 899085 - DNA, 22 bp, Artificial Sequence
  chemically synthesized
gttttgttttttagagaatgag

SEQ ID NO: 899086 - DNA, 22 bp, Artificial Sequence
  chemically synthesized
tgttttgttttttagagaatga

SEQ ID NO: 899087 - DNA, 22 bp, Artificial Sequence
  chemically synthesized
ttctccaaaactcattctctaa

SEQ ID NO: 899088 - DNA, 22 bp, Artificial Sequence
  chemically synthesized
tctccaaaactcattctctaaa

SEQ ID NO: 899089 - DNA, 22 bp, Artificial Sequence
  chemically synthesized
ctccaaaactcattctctaaaa

SEQ ID NO: 899090 - DNA, 22 bp, Artificial Sequence
  chemically synthesized
ttttgttttgttttttagagaa

SEQ ID NO: 899091 - DNA, 22 bp, Artificial Sequence
  chemically synthesized
tccaaaactcattctctaaaaa

SEQ ID NO: 899092 - DNA, 22 bp, Artificial Sequence
  chemically synthesized
gttttgttttgttttttagaga

SEQ ID NO: 899093 - DNA, 22 bp, Artificial Sequence
  chemically synthesized
tgttttgttttgttttttagag

SEQ ID NO: 899094 - DNA, 22 bp, Artificial Sequence
  chemically synthesized
caaaactcattctctaaaaaac

SEQ ID NO: 899095 - DNA, 22 bp, Artificial Sequence
  chemically synthesized
ttttgttttgttttgtttttta

SEQ ID NO: 899096 - DNA, 22 bp, Artificial Sequence
  chemically synthesized
gttttgttttgttttgtttttt

SEQ ID NO: 899097 - DNA, 22 bp, Artificial Sequence
  chemically synthesized
tgttttgttttgttttgttttt

SEQ ID NO: 899098 - DNA, 22 bp, Artificial Sequence
  chemically synthesized
ttgttttgttttgttttgtttt

SEQ ID NO: 899099 - DNA, 22 bp, Artificial Sequence
  chemically synthesized
attctctaaaaaacaaaacaaa

SEQ ID NO: 899100 - DNA, 22 bp, Artificial Sequence
  chemically synthesized
tttttgttttgttttgttttgt

SEQ ID NO: 899101 - DNA, 22 bp, Artificial Sequence
  chemically synthesized
tatttttgttttgttttgtttt

SEQ ID NO: 899102 - DNA, 22 bp, Artificial Sequence
  chemically synthesized
ctatttttgttttgttttgttt

SEQ ID NO: 899103 - DNA, 22 bp, Artificial Sequence
  chemically synthesized
tctaaaaaacaaaacaaaacaa

SEQ ID NO: 899104 - DNA, 22 bp, Artificial Sequence
  chemically synthesized
tctatttttgttttgttttgtt

SEQ ID NO: 899105 - DNA, 22 bp, Artificial Sequence
  chemically synthesized
taaaaaacaaaacaaaacaaaa

SEQ ID NO: 899106 - DNA, 22 bp, Artificial Sequence
  chemically synthesized
aaaaacaaaacaaaacaaaaca

SEQ ID NO: 899107 - DNA, 22 bp, Artificial Sequence
  chemically synthesized
agtgtggtggttttctattttt

SEQ ID NO: 899108 - DNA, 22 bp, Artificial Sequence
  chemically synthesized
cagtgtggtggttttctatttt

SEQ ID NO: 899109 - DNA, 22 bp, Artificial Sequence
  chemically synthesized
tcagtgtggtggttttctattt

SEQ ID NO: 899110 - DNA, 22 bp, Artificial Sequence
  chemically synthesized
ttcagtgtggtggttttctatt

SEQ ID NO: 899111 - DNA, 22 bp, Artificial Sequence
  chemically synthesized
ttttcagtgtggtggttttcta

SEQ ID NO: 899112 - DNA, 22 bp, Artificial Sequence
  chemically synthesized
cttttcagtgtggtggttttct

SEQ ID NO: 899113 - DNA, 22 bp, Artificial Sequence
  chemically synthesized
agatgaaggcaaaggaatagga

SEQ ID NO: 899114 - DNA, 22 bp, Artificial Sequence
  chemically synthesized
aaaagaaatcctattcctttgc

SEQ ID NO: 899115 - DNA, 22 bp, Artificial Sequence
  chemically synthesized
cattcagatgaaggcaaaggaa

SEQ ID NO: 899116 - DNA, 22 bp, Artificial Sequence
  chemically synthesized
ttcctttgccttcatctgaatg

SEQ ID NO: 899117 - DNA, 22 bp, Artificial Sequence
  chemically synthesized
ctttgccttcatctgaatggaa

SEQ ID NO: 899118 - DNA, 22 bp, Artificial Sequence
  chemically synthesized
tgccttcatctgaatggaatca

SEQ ID NO: 899119 - DNA, 22 bp, Artificial Sequence
  chemically synthesized
gccttcatctgaatggaatcat

SEQ ID NO: 899120 - DNA, 22 bp, Artificial Sequence
  chemically synthesized
ccttcatctgaatggaatcatt

SEQ ID NO: 899121 - DNA, 22 bp, Artificial Sequence
  chemically synthesized
aacatgacaataaaatgattcc

SEQ ID NO: 899122 - DNA, 22 bp, Artificial Sequence
  chemically synthesized
aaacatgacaataaaatgattc

SEQ ID NO: 899123 - DNA, 22 bp, Artificial Sequence
  chemically synthesized
catctgaatggaatcattttat

SEQ ID NO: 899124 - DNA, 22 bp, Artificial Sequence
  chemically synthesized
atctgaatggaatcattttatt

SEQ ID NO: 899125 - DNA, 22 bp, Artificial Sequence
  chemically synthesized
tatgtttaaacatgacaataaa

SEQ ID NO: 899126 - DNA, 22 bp, Artificial Sequence
  chemically synthesized
aatggaatcattttattgtcat

SEQ ID NO: 899127 - DNA, 22 bp, Artificial Sequence
  chemically synthesized
atatgtttaaacatgacaataa

SEQ ID NO: 899128 - DNA, 22 bp, Artificial Sequence
  chemically synthesized
tatttatatgtttaaacatgac

SEQ ID NO: 899129 - DNA, 22 bp, Artificial Sequence
  chemically synthesized
atatttatatgtttaaacatga

SEQ ID NO: 899130 - DNA, 22 bp, Artificial Sequence
  chemically synthesized
tatatttatatgtttaaacatg

SEQ ID NO: 899131 - DNA, 22 bp, Artificial Sequence
  chemically synthesized
ttatatttatatgtttaaacat

SEQ ID NO: 899132 - DNA, 22 bp, Artificial Sequence
  chemically synthesized
tttatatttatatgtttaaaca

SEQ ID NO: 899133 - DNA, 22 bp, Artificial Sequence
  chemically synthesized
ttttatatttatatgtttaaac

SEQ ID NO: 899134 - DNA, 22 bp, Artificial Sequence
  chemically synthesized
tttttatatttatatgtttaaa

SEQ ID NO: 899135 - DNA, 22 bp, Artificial Sequence
  chemically synthesized
tattgtcatgtttaaacatata

SEQ ID NO: 899136 - DNA, 22 bp, Artificial Sequence
  chemically synthesized
attgtcatgtttaaacatataa

SEQ ID NO: 899137 - DNA, 22 bp, Artificial Sequence
  chemically synthesized
ttgtcatgtttaaacatataaa

SEQ ID NO: 899138 - DNA, 22 bp, Artificial Sequence
  chemically synthesized
tcatgtttaaacatataaatat

SEQ ID NO: 899139 - DNA, 22 bp, Artificial Sequence
  chemically synthesized
atagaaaattttttttatattt

SEQ ID NO: 899140 - DNA, 22 bp, Artificial Sequence
  chemically synthesized
gatagaaaattttttttatatt

SEQ ID NO: 899141 - DNA, 22 bp, Artificial Sequence
  chemically synthesized
aaacatataaatataaaaaaaa

SEQ ID NO: 899142 - DNA, 22 bp, Artificial Sequence
  chemically synthesized
aacatataaatataaaaaaaat

SEQ ID NO: 899143 - DNA, 22 bp, Artificial Sequence
  chemically synthesized
tgtaggtcatgccatttgatag

SEQ ID NO: 899144 - DNA, 22 bp, Artificial Sequence
  chemically synthesized
tctatcaaatggcatgacctac

SEQ ID NO: 899145 - DNA, 22 bp, Artificial Sequence
  chemically synthesized
ctatcaaatggcatgacctaca

SEQ ID NO: 899146 - DNA, 22 bp, Artificial Sequence
  chemically synthesized
tatcaaatggcatgacctacat

SEQ ID NO: 899147 - DNA, 22 bp, Artificial Sequence
  chemically synthesized
tcaaatggcatgacctacataa

SEQ ID NO: 899148 - DNA, 22 bp, Artificial Sequence
  chemically synthesized
cacatagaaaagataaatgtga

SEQ ID NO: 899149 - DNA, 22 bp, Artificial Sequence
  chemically synthesized
cataactcacatttatcttttc

SEQ ID NO: 899150 - DNA, 22 bp, Artificial Sequence
  chemically synthesized
acatttatcttttctatgtgta

SEQ ID NO: 899151 - DNA, 22 bp, Artificial Sequence
  chemically synthesized
caacaatatgaatattacacat

SEQ ID NO: 899152 - DNA, 22 bp, Artificial Sequence
  chemically synthesized
atcttttctatgtgtaatattc

SEQ ID NO: 899153 - DNA, 22 bp, Artificial Sequence
  chemically synthesized
tcttttctatgtgtaatattca

SEQ ID NO: 899154 - DNA, 22 bp, Artificial Sequence
  chemically synthesized
ttctatgtgtaatattcatatt

SEQ ID NO: 899155 - DNA, 22 bp, Artificial Sequence
  chemically synthesized
tctatgtgtaatattcatattg

SEQ ID NO: 899156 - DNA, 22 bp, Artificial Sequence
  chemically synthesized
ctatgtgtaatattcatattgt

SEQ ID NO: 899157 - DNA, 22 bp, Artificial Sequence
  chemically synthesized
tatgtgtaatattcatattgtt

SEQ ID NO: 899158 - DNA, 22 bp, Artificial Sequence
  chemically synthesized
tgtgtaatattcatattgttgc

SEQ ID NO: 899159 - DNA, 22 bp, Artificial Sequence
  chemically synthesized
atattgttgcaatttgatgcat

SEQ ID NO: 899160 - DNA, 22 bp, Artificial Sequence
  chemically synthesized
ttgcaatttgatgcattattgt

SEQ ID NO: 899161 - DNA, 22 bp, Artificial Sequence
  chemically synthesized
atagtataaataacaataatgc

SEQ ID NO: 899162 - DNA, 22 bp, Artificial Sequence
  chemically synthesized
catagtataaataacaataatg

SEQ ID NO: 899163 - DNA, 22 bp, Artificial Sequence
  chemically synthesized
caatttgatgcattattgttat

SEQ ID NO: 899164 - DNA, 22 bp, Artificial Sequence
  chemically synthesized
cttcatagtataaataacaata

SEQ ID NO: 899165 - DNA, 22 bp, Artificial Sequence
  chemically synthesized
gcttcatagtataaataacaat

SEQ ID NO: 899166 - DNA, 22 bp, Artificial Sequence
  chemically synthesized
gatgcattattgttatttatac

SEQ ID NO: 899167 - DNA, 22 bp, Artificial Sequence
  chemically synthesized
atgcattattgttatttatact

SEQ ID NO: 899168 - DNA, 22 bp, Artificial Sequence
  chemically synthesized
ttgttatttatactatgaagca

SEQ ID NO: 899169 - DNA, 22 bp, Artificial Sequence
  chemically synthesized
ttatttatactatgaagcaaat

SEQ ID NO: 899170 - DNA, 22 bp, Artificial Sequence
  chemically synthesized
tttatactatgaagcaaatgca

SEQ ID NO: 899171 - DNA, 22 bp, Artificial Sequence
  chemically synthesized
atactatgaagcaaatgcatat

SEQ ID NO: 899172 - DNA, 22 bp, Artificial Sequence
  chemically synthesized
agtggataagcaatatgcattt

SEQ ID NO: 899173 - DNA, 22 bp, Artificial Sequence
  chemically synthesized
tactatgaagcaaatgcatatt

SEQ ID NO: 899174 - DNA, 22 bp, Artificial Sequence
  chemically synthesized
attgagtggataagcaatatgc

SEQ ID NO: 899175 - DNA, 22 bp, Artificial Sequence
  chemically synthesized
cattgagtggataagcaatatg

SEQ ID NO: 899176 - DNA, 22 bp, Artificial Sequence
  chemically synthesized
tgaagcaaatgcatattgctta

SEQ ID NO: 899177 - DNA, 22 bp, Artificial Sequence
  chemically synthesized
gccatgtttcattgagtggata

SEQ ID NO: 899178 - DNA, 22 bp, Artificial Sequence
  chemically synthesized
ttagccatgtttcattgagtgg

SEQ ID NO: 899179 - DNA, 22 bp, Artificial Sequence
  chemically synthesized
gttagccatgtttcattgagtg

SEQ ID NO: 899180 - DNA, 22 bp, Artificial Sequence
  chemically synthesized
tgttagccatgtttcattgagt

SEQ ID NO: 899181 - DNA, 22 bp, Artificial Sequence
  chemically synthesized
tttgttagccatgtttcattga

SEQ ID NO: 899182 - DNA, 22 bp, Artificial Sequence
  chemically synthesized
ctttgttagccatgtttcattg

SEQ ID NO: 899183 - DNA, 22 bp, Artificial Sequence
  chemically synthesized
cttatccactcaatgaaacatg

SEQ ID NO: 899184 - DNA, 22 bp, Artificial Sequence
  chemically synthesized
ttctttgttagccatgtttcat

SEQ ID NO: 899185 - DNA, 22 bp, Artificial Sequence
  chemically synthesized
cttctttgttagccatgtttca

SEQ ID NO: 899186 - DNA, 22 bp, Artificial Sequence
  chemically synthesized
tcttctttgttagccatgtttc

SEQ ID NO: 899187 - DNA, 22 bp, Artificial Sequence
  chemically synthesized
atccactcaatgaaacatggct

SEQ ID NO: 899188 - DNA, 22 bp, Artificial Sequence
  chemically synthesized
tccactcaatgaaacatggcta

SEQ ID NO: 899189 - DNA, 22 bp, Artificial Sequence
  chemically synthesized
attttcttctttgttagccatg

SEQ ID NO: 899190 - DNA, 22 bp, Artificial Sequence
  chemically synthesized
aatgaaacatggctaacaaaga

SEQ ID NO: 899191 - DNA, 22 bp, Artificial Sequence
  chemically synthesized
cagggatactgattttcttctt

SEQ ID NO: 899192 - DNA, 22 bp, Artificial Sequence
  chemically synthesized
aaagttccagggatactgattt

SEQ ID NO: 899193 - DNA, 22 bp, Artificial Sequence
  chemically synthesized
acaaagaagaaaatcagtatcc

SEQ ID NO: 899194 - DNA, 22 bp, Artificial Sequence
  chemically synthesized
gtaaggttaaaagttccaggga

SEQ ID NO: 899195 - DNA, 22 bp, Artificial Sequence
  chemically synthesized
ttggtaaggttaaaagttccag

SEQ ID NO: 899196 - DNA, 22 bp, Artificial Sequence
  chemically synthesized
gttggtaaggttaaaagttcca

SEQ ID NO: 899197 - DNA, 22 bp, Artificial Sequence
  chemically synthesized
cttgttggtaaggttaaaagtt

SEQ ID NO: 899198 - DNA, 22 bp, Artificial Sequence
  chemically synthesized
acttgttggtaaggttaaaagt

SEQ ID NO: 899199 - DNA, 22 bp, Artificial Sequence
  chemically synthesized
tacttgttggtaaggttaaaag

SEQ ID NO: 899200 - DNA, 22 bp, Artificial Sequence
  chemically synthesized
ttttacttgttggtaaggttaa

SEQ ID NO: 899201 - DNA, 22 bp, Artificial Sequence
  chemically synthesized
ttattttacttgttggtaaggt

SEQ ID NO: 899202 - DNA, 22 bp, Artificial Sequence
  chemically synthesized
gaacttttaaccttaccaacaa

SEQ ID NO: 899203 - DNA, 22 bp, Artificial Sequence
  chemically synthesized
ttaaccttaccaacaagtaaaa

SEQ ID NO: 899204 - DNA, 22 bp, Artificial Sequence
  chemically synthesized
taaccttaccaacaagtaaaat

SEQ ID NO: 899205 - DNA, 22 bp, Artificial Sequence
  chemically synthesized
tatgatattattattttacttg

SEQ ID NO: 899206 - DNA, 22 bp, Artificial Sequence
  chemically synthesized
aaccttaccaacaagtaaaata

SEQ ID NO: 899207 - DNA, 22 bp, Artificial Sequence
  chemically synthesized
accttaccaacaagtaaaataa

SEQ ID NO: 899208 - DNA, 22 bp, Artificial Sequence
  chemically synthesized
tatatgatattattattttact

SEQ ID NO: 899209 - DNA, 22 bp, Artificial Sequence
  chemically synthesized
accaacaagtaaaataataata

SEQ ID NO: 899210 - DNA, 22 bp, Artificial Sequence
  chemically synthesized
ccaacaagtaaaataataatat

SEQ ID NO: 899211 - DNA, 22 bp, Artificial Sequence
  chemically synthesized
ccaggagtagcaattctatatg

SEQ ID NO: 899212 - DNA, 22 bp, Artificial Sequence
  chemically synthesized
agcatcaccattcccaggagta

SEQ ID NO: 899213 - DNA, 22 bp, Artificial Sequence
  chemically synthesized
taagcatcaccattcccaggag

SEQ ID NO: 899214 - DNA, 22 bp, Artificial Sequence
  chemically synthesized
ctaagcatcaccattcccagga

SEQ ID NO: 899215 - DNA, 22 bp, Artificial Sequence
  chemically synthesized
tctaagcatcaccattcccagg

SEQ ID NO: 899216 - DNA, 22 bp, Artificial Sequence
  chemically synthesized
ctactcctgggaatggtgatgc

SEQ ID NO: 899217 - DNA, 22 bp, Artificial Sequence
  chemically synthesized
aaaacctttctaagcatcacca

SEQ ID NO: 899218 - DNA, 22 bp, Artificial Sequence
  chemically synthesized
ctcctgggaatggtgatgctta

SEQ ID NO: 899219 - DNA, 22 bp, Artificial Sequence
  chemically synthesized
ctgggaatggtgatgcttagaa

SEQ ID NO: 899220 - DNA, 22 bp, Artificial Sequence
  chemically synthesized
tgttcaaaacctttctaagcat

SEQ ID NO: 899221 - DNA, 22 bp, Artificial Sequence
  chemically synthesized
ggaatggtgatgcttagaaagg

SEQ ID NO: 899222 - DNA, 22 bp, Artificial Sequence
  chemically synthesized
ccgatgttgtgttcaaaacctt

SEQ ID NO: 899223 - DNA, 22 bp, Artificial Sequence
  chemically synthesized
cccgatgttgtgttcaaaacct

SEQ ID NO: 899224 - DNA, 22 bp, Artificial Sequence
  chemically synthesized
ttcccgatgttgtgttcaaaac

SEQ ID NO: 899225 - DNA, 22 bp, Artificial Sequence
  chemically synthesized
agaaaggttttgaacacaacat

SEQ ID NO: 899226 - DNA, 22 bp, Artificial Sequence
  chemically synthesized
gaaaggttttgaacacaacatc

SEQ ID NO: 899227 - DNA, 22 bp, Artificial Sequence
  chemically synthesized
tgaacacaacatcgggaagagt

SEQ ID NO: 899228 - DNA, 22 bp, Artificial Sequence
  chemically synthesized
gaacacaacatcgggaagagtt

SEQ ID NO: 899229 - DNA, 22 bp, Artificial Sequence
  chemically synthesized
aacacaacatcgggaagagttg

SEQ ID NO: 899230 - DNA, 22 bp, Artificial Sequence
  chemically synthesized
acatatgccaatgccaactctt

SEQ ID NO: 899231 - DNA, 22 bp, Artificial Sequence
  chemically synthesized
cacatatgccaatgccaactct

SEQ ID NO: 899232 - DNA, 22 bp, Artificial Sequence
  chemically synthesized
caacttcacatatgccaatgcc

SEQ ID NO: 899233 - DNA, 22 bp, Artificial Sequence
  chemically synthesized
gtaaagctacaacttcacatat

SEQ ID NO: 899234 - DNA, 22 bp, Artificial Sequence
  chemically synthesized
gcattggcatatgtgaagttgt

SEQ ID NO: 899235 - DNA, 22 bp, Artificial Sequence
  chemically synthesized
gcatatgtgaagttgtagcttt

SEQ ID NO: 899236 - DNA, 22 bp, Artificial Sequence
  chemically synthesized
ataccgtcacacagctagtaaa

SEQ ID NO: 899237 - DNA, 22 bp, Artificial Sequence
  chemically synthesized
ctcataccgtcacacagctagt

SEQ ID NO: 899238 - DNA, 22 bp, Artificial Sequence
  chemically synthesized
cctcataccgtcacacagctag

SEQ ID NO: 899239 - DNA, 22 bp, Artificial Sequence
  chemically synthesized
tcctcataccgtcacacagcta

SEQ ID NO: 899240 - DNA, 22 bp, Artificial Sequence
  chemically synthesized
tagctttactagctgtgtgacg

SEQ ID NO: 899241 - DNA, 22 bp, Artificial Sequence
  chemically synthesized
actttcctcataccgtcacaca

SEQ ID NO: 899242 - DNA, 22 bp, Artificial Sequence
  chemically synthesized
tactagctgtgtgacggtatga

SEQ ID NO: 899243 - DNA, 22 bp, Artificial Sequence
  chemically synthesized
tattcactttcctcataccgtc

SEQ ID NO: 899244 - DNA, 22 bp, Artificial Sequence
  chemically synthesized
actagctgtgtgacggtatgag

SEQ ID NO: 899245 - DNA, 22 bp, Artificial Sequence
  chemically synthesized
ctagctgtgtgacggtatgagg

SEQ ID NO: 899246 - DNA, 22 bp, Artificial Sequence
  chemically synthesized
gctgtgtgacggtatgaggaaa

SEQ ID NO: 899247 - DNA, 22 bp, Artificial Sequence
  chemically synthesized
aattgtattcactttcctcata

SEQ ID NO: 899248 - DNA, 22 bp, Artificial Sequence
  chemically synthesized
gaattgtattcactttcctcat

SEQ ID NO: 899249 - DNA, 22 bp, Artificial Sequence
  chemically synthesized
tgaattgtattcactttcctca

SEQ ID NO: 899250 - DNA, 22 bp, Artificial Sequence
  chemically synthesized
tgtgacggtatgaggaaagtga

SEQ ID NO: 899251 - DNA, 22 bp, Artificial Sequence
  chemically synthesized
gccagcaggaagagaccaaccc

SEQ ID NO: 899252 - DNA, 22 bp, Artificial Sequence
  chemically synthesized
tggccagcaggaagagaccaac

SEQ ID NO: 899253 - DNA, 22 bp, Artificial Sequence
  chemically synthesized
ctggccagcaggaagagaccaa

SEQ ID NO: 899254 - DNA, 22 bp, Artificial Sequence
  chemically synthesized
ttctggccagcaggaagagacc

SEQ ID NO: 899255 - DNA, 22 bp, Artificial Sequence
  chemically synthesized
aaagatgggttggtctcttcct

SEQ ID NO: 899256 - DNA, 22 bp, Artificial Sequence
  chemically synthesized
tcttctggccagcaggaagaga

SEQ ID NO: 899257 - DNA, 22 bp, Artificial Sequence
  chemically synthesized
ctcttctggccagcaggaagag

SEQ ID NO: 899258 - DNA, 22 bp, Artificial Sequence
  chemically synthesized
ttctcttctggccagcaggaag

SEQ ID NO: 899259 - DNA, 22 bp, Artificial Sequence
  chemically synthesized
tcttctcttctggccagcagga

SEQ ID NO: 899260 - DNA, 22 bp, Artificial Sequence
  chemically synthesized
ctctcttctcttctggccagca

SEQ ID NO: 899261 - DNA, 22 bp, Artificial Sequence
  chemically synthesized
gctctcttctcttctggccagc

SEQ ID NO: 899262 - DNA, 22 bp, Artificial Sequence
  chemically synthesized
tgctctcttctcttctggccag

SEQ ID NO: 899263 - DNA, 22 bp, Artificial Sequence
  chemically synthesized
gtctcttcctgctggccagaag

SEQ ID NO: 899264 - DNA, 22 bp, Artificial Sequence
  chemically synthesized
tttgctctcttctcttctggcc

SEQ ID NO: 899265 - DNA, 22 bp, Artificial Sequence
  chemically synthesized
ctttgctctcttctcttctggc

SEQ ID NO: 899266 - DNA, 22 bp, Artificial Sequence
  chemically synthesized
tctttgctctcttctcttctgg

SEQ ID NO: 899267 - DNA, 22 bp, Artificial Sequence
  chemically synthesized
ttctttgctctcttctcttctg

SEQ ID NO: 899268 - DNA, 22 bp, Artificial Sequence
  chemically synthesized
ttcctgctggccagaagagaag

SEQ ID NO: 899269 - DNA, 22 bp, Artificial Sequence
  chemically synthesized
tttctttgctctcttctcttct

SEQ ID NO: 899270 - DNA, 22 bp, Artificial Sequence
  chemically synthesized
ttttctttgctctcttctcttc

SEQ ID NO: 899271 - DNA, 22 bp, Artificial Sequence
  chemically synthesized
cctgctggccagaagagaagag

SEQ ID NO: 899272 - DNA, 22 bp, Artificial Sequence
  chemically synthesized
tttttctttgctctcttctctt

SEQ ID NO: 899273 - DNA, 22 bp, Artificial Sequence
  chemically synthesized
ctgctggccagaagagaagaga

SEQ ID NO: 899274 - DNA, 22 bp, Artificial Sequence
  chemically synthesized
tttttttctttgctctcttctc

SEQ ID NO: 899275 - DNA, 22 bp, Artificial Sequence
  chemically synthesized
ctggccagaagagaagagagca

SEQ ID NO: 899276 - DNA, 22 bp, Artificial Sequence
  chemically synthesized
tctttttttctttgctctcttc

SEQ ID NO: 899277 - DNA, 22 bp, Artificial Sequence
  chemically synthesized
gccagaagagaagagagcaaag

SEQ ID NO: 899278 - DNA, 22 bp, Artificial Sequence
  chemically synthesized
tatccatattctctttttttct

SEQ ID NO: 899279 - DNA, 22 bp, Artificial Sequence
  chemically synthesized
atatccatattctctttttttc

SEQ ID NO: 899280 - DNA, 22 bp, Artificial Sequence
  chemically synthesized
aaatttatatccatattctctt

SEQ ID NO: 899281 - DNA, 22 bp, Artificial Sequence
  chemically synthesized
caaatttatatccatattctct

SEQ ID NO: 899282 - DNA, 22 bp, Artificial Sequence
  chemically synthesized
tcaaatttatatccatattctc

SEQ ID NO: 899283 - DNA, 22 bp, Artificial Sequence
  chemically synthesized
ttcaaatttatatccatattct

SEQ ID NO: 899284 - DNA, 22 bp, Artificial Sequence
  chemically synthesized
tttcaaatttatatccatattc

SEQ ID NO: 899285 - DNA, 22 bp, Artificial Sequence
  chemically synthesized
tttttcaaatttatatccatat

SEQ ID NO: 899286 - DNA, 22 bp, Artificial Sequence
  chemically synthesized
ctttttcaaatttatatccata

SEQ ID NO: 899287 - DNA, 22 bp, Artificial Sequence
  chemically synthesized
tctttttcaaatttatatccat

SEQ ID NO: 899288 - DNA, 22 bp, Artificial Sequence
  chemically synthesized
ttctttttcaaatttatatcca

SEQ ID NO: 899289 - DNA, 22 bp, Artificial Sequence
  chemically synthesized
cagagaaatcaagtatttttct

SEQ ID NO: 899290 - DNA, 22 bp, Artificial Sequence
  chemically synthesized
ccagagaaatcaagtatttttc

SEQ ID NO: 899291 - DNA, 22 bp, Artificial Sequence
  chemically synthesized
tttccagagaaatcaagtattt

SEQ ID NO: 899292 - DNA, 22 bp, Artificial Sequence
  chemically synthesized
gaaaaagaaaaatacttgattt

SEQ ID NO: 899293 - DNA, 22 bp, Artificial Sequence
  chemically synthesized
ttgtttccagagaaatcaagta

SEQ ID NO: 899294 - DNA, 22 bp, Artificial Sequence
  chemically synthesized
aaaaagaaaaatacttgatttc

SEQ ID NO: 899295 - DNA, 22 bp, Artificial Sequence
  chemically synthesized
attgtttccagagaaatcaagt

SEQ ID NO: 899296 - DNA, 22 bp, Artificial Sequence
  chemically synthesized
tattgtttccagagaaatcaag

SEQ ID NO: 899297 - DNA, 22 bp, Artificial Sequence
  chemically synthesized
ttattgtttccagagaaatcaa

SEQ ID NO: 899298 - DNA, 22 bp, Artificial Sequence
  chemically synthesized
tttattgtttccagagaaatca

SEQ ID NO: 899299 - DNA, 22 bp, Artificial Sequence
  chemically synthesized
ttttattgtttccagagaaatc

SEQ ID NO: 899300 - DNA, 22 bp, Artificial Sequence
  chemically synthesized
atttttttattgtttccagaga

SEQ ID NO: 899301 - DNA, 22 bp, Artificial Sequence
  chemically synthesized
ccctgatttttttattgtttcc

SEQ ID NO: 899302 - DNA, 22 bp, Artificial Sequence
  chemically synthesized
gccctgatttttttattgtttc

SEQ ID NO: 899303 - DNA, 22 bp, Artificial Sequence
  chemically synthesized
tgccctgatttttttattgttt

SEQ ID NO: 899304 - DNA, 22 bp, Artificial Sequence
  chemically synthesized
gatttctctggaaacaataaaa

SEQ ID NO: 899305 - DNA, 22 bp, Artificial Sequence
  chemically synthesized
ttgccctgatttttttattgtt

SEQ ID NO: 899306 - DNA, 22 bp, Artificial Sequence
  chemically synthesized
atttctctggaaacaataaaaa

SEQ ID NO: 899307 - DNA, 22 bp, Artificial Sequence
  chemically synthesized
acttttgccctgatttttttat

SEQ ID NO: 899308 - DNA, 22 bp, Artificial Sequence
  chemically synthesized
ctctggaaacaataaaaaaatc

SEQ ID NO: 899309 - DNA, 22 bp, Artificial Sequence
  chemically synthesized
tctggaaacaataaaaaaatca

SEQ ID NO: 899310 - DNA, 22 bp, Artificial Sequence
  chemically synthesized
tggaaacaataaaaaaatcagg

SEQ ID NO: 899311 - DNA, 22 bp, Artificial Sequence
  chemically synthesized
gaaacaataaaaaaatcagggc

SEQ ID NO: 899312 - DNA, 22 bp, Artificial Sequence
  chemically synthesized
gcacctgacttttgccctgatt

SEQ ID NO: 899313 - DNA, 22 bp, Artificial Sequence
  chemically synthesized
ggcacctgacttttgccctgat

SEQ ID NO: 899314 - DNA, 22 bp, Artificial Sequence
  chemically synthesized
tggcacctgacttttgccctga

SEQ ID NO: 899315 - DNA, 22 bp, Artificial Sequence
  chemically synthesized
ttttggcacctgacttttgccc

SEQ ID NO: 899316 - DNA, 22 bp, Artificial Sequence
  chemically synthesized
gcagaatataaaactattttgg

SEQ ID NO: 899317 - DNA, 22 bp, Artificial Sequence
  chemically synthesized
tggcaacaatcctcgcagaata

SEQ ID NO: 899318 - DNA, 22 bp, Artificial Sequence
  chemically synthesized
tatattctgcgaggattgttgc

SEQ ID NO: 899319 - DNA, 22 bp, Artificial Sequence
  chemically synthesized
atattctgcgaggattgttgcc

SEQ ID NO: 899320 - DNA, 22 bp, Artificial Sequence
  chemically synthesized
aaatggggttatggcaacaatc

SEQ ID NO: 899321 - DNA, 22 bp, Artificial Sequence
  chemically synthesized
tattctgcgaggattgttgcca

SEQ ID NO: 899322 - DNA, 22 bp, Artificial Sequence
  chemically synthesized
ttgaaatggggttatggcaaca

SEQ ID NO: 899323 - DNA, 22 bp, Artificial Sequence
  chemically synthesized
tgcgaggattgttgccataacc

SEQ ID NO: 899324 - DNA, 22 bp, Artificial Sequence
  chemically synthesized
ctgttgaaatggggttatggca

SEQ ID NO: 899325 - DNA, 22 bp, Artificial Sequence
  chemically synthesized
cgaggattgttgccataacccc

SEQ ID NO: 899326 - DNA, 22 bp, Artificial Sequence
  chemically synthesized
cccaagtctcctgttgaaatgg

SEQ ID NO: 899327 - DNA, 22 bp, Artificial Sequence
  chemically synthesized
ttgccataaccccatttcaaca

SEQ ID NO: 899328 - DNA, 22 bp, Artificial Sequence
  chemically synthesized
tgcccaagtctcctgttgaaat

SEQ ID NO: 899329 - DNA, 22 bp, Artificial Sequence
  chemically synthesized
ccataaccccatttcaacagga

SEQ ID NO: 899330 - DNA, 22 bp, Artificial Sequence
  chemically synthesized
ccctctgcccaagtctcctgtt

SEQ ID NO: 899331 - DNA, 22 bp, Artificial Sequence
  chemically synthesized
ctgccctctgcccaagtctcct

SEQ ID NO: 899332 - DNA, 22 bp, Artificial Sequence
  chemically synthesized
gctgccctctgcccaagtctcc

SEQ ID NO: 899333 - DNA, 22 bp, Artificial Sequence
  chemically synthesized
caacaggagacttgggcagagg

SEQ ID NO: 899334 - DNA, 22 bp, Artificial Sequence
  chemically synthesized
aacaggagacttgggcagaggg

SEQ ID NO: 899335 - DNA, 22 bp, Artificial Sequence
  chemically synthesized
gggcagagggcagcaaactatg

SEQ ID NO: 899336 - DNA, 22 bp, Artificial Sequence
  chemically synthesized
ggcagagggcagcaaactatgg

SEQ ID NO: 899337 - DNA, 22 bp, Artificial Sequence
  chemically synthesized
aatgtgacccataagccatagt

SEQ ID NO: 899338 - DNA, 22 bp, Artificial Sequence
  chemically synthesized
tggcttatgggtcacattcagc

SEQ ID NO: 899339 - DNA, 22 bp, Artificial Sequence
  chemically synthesized
tacaaagacatatggtggctga

SEQ ID NO: 899340 - DNA, 22 bp, Artificial Sequence
  chemically synthesized
atgggtcacattcagccaccat

SEQ ID NO: 899341 - DNA, 22 bp, Artificial Sequence
  chemically synthesized
tgggtcacattcagccaccata

SEQ ID NO: 899342 - DNA, 22 bp, Artificial Sequence
  chemically synthesized
aaactgtacaaagacatatggt

SEQ ID NO: 899343 - DNA, 22 bp, Artificial Sequence
  chemically synthesized
tcaaactgtacaaagacatatg

SEQ ID NO: 899344 - DNA, 22 bp, Artificial Sequence
  chemically synthesized
gttctcaaactgtacaaagaca

SEQ ID NO: 899345 - DNA, 22 bp, Artificial Sequence
  chemically synthesized
agccaccatatgtctttgtaca

SEQ ID NO: 899346 - DNA, 22 bp, Artificial Sequence
  chemically synthesized
ttagttctcaaactgtacaaag

SEQ ID NO: 899347 - DNA, 22 bp, Artificial Sequence
  chemically synthesized
aaacaattgttagttctcaaac

SEQ ID NO: 899348 - DNA, 22 bp, Artificial Sequence
  chemically synthesized
tgtacagtttgagaactaacaa

SEQ ID NO: 899349 - DNA, 22 bp, Artificial Sequence
  chemically synthesized
gtacagtttgagaactaacaat

SEQ ID NO: 899350 - DNA, 22 bp, Artificial Sequence
  chemically synthesized
tacagtttgagaactaacaatt

SEQ ID NO: 899351 - DNA, 22 bp, Artificial Sequence
  chemically synthesized
aaatgttaaaacaattgttagt

SEQ ID NO: 899352 - DNA, 22 bp, Artificial Sequence
  chemically synthesized
caaatgttaaaacaattgttag

SEQ ID NO: 899353 - DNA, 22 bp, Artificial Sequence
  chemically synthesized
ttcaaatgttaaaacaattgtt

SEQ ID NO: 899354 - DNA, 22 bp, Artificial Sequence
  chemically synthesized
cttcaaatgttaaaacaattgt

SEQ ID NO: 899355 - DNA, 22 bp, Artificial Sequence
  chemically synthesized
gagaactaacaattgttttaac

SEQ ID NO: 899356 - DNA, 22 bp, Artificial Sequence
  chemically synthesized
agaactaacaattgttttaaca

SEQ ID NO: 899357 - DNA, 22 bp, Artificial Sequence
  chemically synthesized
agtttcttcaaatgttaaaaca

SEQ ID NO: 899358 - DNA, 22 bp, Artificial Sequence
  chemically synthesized
cagtttcttcaaatgttaaaac

SEQ ID NO: 899359 - DNA, 22 bp, Artificial Sequence
  chemically synthesized
tcagtttcttcaaatgttaaaa

SEQ ID NO: 899360 - DNA, 22 bp, Artificial Sequence
  chemically synthesized
ttttcagtttcttcaaatgtta

SEQ ID NO: 899361 - DNA, 22 bp, Artificial Sequence
  chemically synthesized
acaattgttttaacatttgaag

SEQ ID NO: 899362 - DNA, 22 bp, Artificial Sequence
  chemically synthesized
attattttcagtttcttcaaat

SEQ ID NO: 899363 - DNA, 22 bp, Artificial Sequence
  chemically synthesized
ttaattattttcagtttcttca

SEQ ID NO: 899364 - DNA, 22 bp, Artificial Sequence
  chemically synthesized
attaattattttcagtttcttc

SEQ ID NO: 899365 - DNA, 22 bp, Artificial Sequence
  chemically synthesized
ttttaacatttgaagaaactga

SEQ ID NO: 899366 - DNA, 22 bp, Artificial Sequence
  chemically synthesized
taacatttgaagaaactgaaaa

SEQ ID NO: 899367 - DNA, 22 bp, Artificial Sequence
  chemically synthesized
aacatttgaagaaactgaaaat

SEQ ID NO: 899368 - DNA, 22 bp, Artificial Sequence
  chemically synthesized
acatttgaagaaactgaaaata

SEQ ID NO: 899369 - DNA, 22 bp, Artificial Sequence
  chemically synthesized
acccatttattaattattttca

SEQ ID NO: 899370 - DNA, 22 bp, Artificial Sequence
  chemically synthesized
gaagaaactgaaaataattaat

SEQ ID NO: 899371 - DNA, 22 bp, Artificial Sequence
  chemically synthesized
aagaaactgaaaataattaata

SEQ ID NO: 899372 - DNA, 22 bp, Artificial Sequence
  chemically synthesized
atgtctcacccatttattaatt

SEQ ID NO: 899373 - DNA, 22 bp, Artificial Sequence
  chemically synthesized
aaaataattaataaatgggtga

SEQ ID NO: 899374 - DNA, 22 bp, Artificial Sequence
  chemically synthesized
atataatattcatgtctcaccc

SEQ ID NO: 899375 - DNA, 22 bp, Artificial Sequence
  chemically synthesized
catataatattcatgtctcacc

SEQ ID NO: 899376 - DNA, 22 bp, Artificial Sequence
  chemically synthesized
ataaatgggtgagacatgaata

SEQ ID NO: 899377 - DNA, 22 bp, Artificial Sequence
  chemically synthesized
aatttcatataatattcatgtc

SEQ ID NO: 899378 - DNA, 22 bp, Artificial Sequence
  chemically synthesized
gaatttcatataatattcatgt

SEQ ID NO: 899379 - DNA, 22 bp, Artificial Sequence
  chemically synthesized
gggacacaaatttgaatttcat

SEQ ID NO: 899380 - DNA, 22 bp, Artificial Sequence
  chemically synthesized
ggggacacaaatttgaatttca

SEQ ID NO: 899381 - DNA, 22 bp, Artificial Sequence
  chemically synthesized
cttggggacacaaatttgaatt

SEQ ID NO: 899382 - DNA, 22 bp, Artificial Sequence
  chemically synthesized
acttggggacacaaatttgaat

SEQ ID NO: 899383 - DNA, 22 bp, Artificial Sequence
  chemically synthesized
tatgaaattcaaatttgtgtcc

SEQ ID NO: 899384 - DNA, 22 bp, Artificial Sequence
  chemically synthesized
aaatttgtgtccccaagtaaat

SEQ ID NO: 899385 - DNA, 22 bp, Artificial Sequence
  chemically synthesized
tgtcccgtgacaatttacttgg

SEQ ID NO: 899386 - DNA, 22 bp, Artificial Sequence
  chemically synthesized
gtgtccccaagtaaattgtcac

SEQ ID NO: 899387 - DNA, 22 bp, Artificial Sequence
  chemically synthesized
tgtccccaagtaaattgtcacg

SEQ ID NO: 899388 - DNA, 22 bp, Artificial Sequence
  chemically synthesized
tcacgggacacagccatgccca

SEQ ID NO: 899389 - DNA, 22 bp, Artificial Sequence
  chemically synthesized
cacataaacgaatgggcatggc

SEQ ID NO: 899390 - DNA, 22 bp, Artificial Sequence
  chemically synthesized
atacgtaactacacataaacga

SEQ ID NO: 899391 - DNA, 22 bp, Artificial Sequence
  chemically synthesized
gtttatgtgtagttacgtatta

SEQ ID NO: 899392 - DNA, 22 bp, Artificial Sequence
  chemically synthesized
atgtgtagttacgtattagggc

SEQ ID NO: 899393 - DNA, 22 bp, Artificial Sequence
  chemically synthesized
tgtgtagttacgtattagggct

SEQ ID NO: 899394 - DNA, 22 bp, Artificial Sequence
  chemically synthesized
tggatcaaaagcagccctaata

SEQ ID NO: 899395 - DNA, 22 bp, Artificial Sequence
  chemically synthesized
ttgtggatcaaaagcagcccta

SEQ ID NO: 899396 - DNA, 22 bp, Artificial Sequence
  chemically synthesized
cgtattagggctgcttttgatc

SEQ ID NO: 899397 - DNA, 22 bp, Artificial Sequence
  chemically synthesized
acaccgctattgtggatcaaaa

SEQ ID NO: 899398 - DNA, 22 bp, Artificial Sequence
  chemically synthesized
aacaccgctattgtggatcaaa

SEQ ID NO: 899399 - DNA, 22 bp, Artificial Sequence
  chemically synthesized
cttaacaccgctattgtggatc

SEQ ID NO: 899400 - DNA, 22 bp, Artificial Sequence
  chemically synthesized
gggctgcttttgatccacaata

SEQ ID NO: 899401 - DNA, 22 bp, Artificial Sequence
  chemically synthesized
cttttgatccacaatagcggtg

SEQ ID NO: 899402 - DNA, 22 bp, Artificial Sequence
  chemically synthesized
ccacgactacttaacaccgcta

SEQ ID NO: 899403 - DNA, 22 bp, Artificial Sequence
  chemically synthesized
ttgatccacaatagcggtgtta

SEQ ID NO: 899404 - DNA, 22 bp, Artificial Sequence
  chemically synthesized
tgatccacaatagcggtgttaa

SEQ ID NO: 899405 - DNA, 22 bp, Artificial Sequence
  chemically synthesized
tgccacgactacttaacaccgc

SEQ ID NO: 899406 - DNA, 22 bp, Artificial Sequence
  chemically synthesized
gatccacaatagcggtgttaag

SEQ ID NO: 899407 - DNA, 22 bp, Artificial Sequence
  chemically synthesized
atccacaatagcggtgttaagt

SEQ ID NO: 899408 - DNA, 22 bp, Artificial Sequence
  chemically synthesized
caggccaataggtctctgccac

SEQ ID NO: 899409 - DNA, 22 bp, Artificial Sequence
  chemically synthesized
gcaggccaataggtctctgcca

SEQ ID NO: 899410 - DNA, 22 bp, Artificial Sequence
  chemically synthesized
tgcaggccaataggtctctgcc

SEQ ID NO: 899411 - DNA, 22 bp, Artificial Sequence
  chemically synthesized
agtagtcgtggcagagacctat

SEQ ID NO: 899412 - DNA, 22 bp, Artificial Sequence
  chemically synthesized
ggctttgcaggccaataggtct

SEQ ID NO: 899413 - DNA, 22 bp, Artificial Sequence
  chemically synthesized
aggctttgcaggccaataggtc

SEQ ID NO: 899414 - DNA, 22 bp, Artificial Sequence
  chemically synthesized
taggctttgcaggccaataggt

SEQ ID NO: 899415 - DNA, 22 bp, Artificial Sequence
  chemically synthesized
ttggcctgcaaagcctaaaaca

SEQ ID NO: 899416 - DNA, 22 bp, Artificial Sequence
  chemically synthesized
gcctgcaaagcctaaaacattt

SEQ ID NO: 899417 - DNA, 22 bp, Artificial Sequence
  chemically synthesized
taacggtccagatggtaaatgt

SEQ ID NO: 899418 - DNA, 22 bp, Artificial Sequence
  chemically synthesized
caaagcctaaaacatttaccat

SEQ ID NO: 899419 - DNA, 22 bp, Artificial Sequence
  chemically synthesized
tataacggtccagatggtaaat

SEQ ID NO: 899420 - DNA, 22 bp, Artificial Sequence
  chemically synthesized
ctataacggtccagatggtaaa

SEQ ID NO: 899421 - DNA, 22 bp, Artificial Sequence
  chemically synthesized
tctataacggtccagatggtaa

SEQ ID NO: 899422 - DNA, 22 bp, Artificial Sequence
  chemically synthesized
aaacatttaccatctggaccgt

SEQ ID NO: 899423 - DNA, 22 bp, Artificial Sequence
  chemically synthesized
accatctggaccgttatagaaa

SEQ ID NO: 899424 - DNA, 22 bp, Artificial Sequence
  chemically synthesized
ccatctggaccgttatagaaag

SEQ ID NO: 899425 - DNA, 22 bp, Artificial Sequence
  chemically synthesized
gagcagaggtcagcaaactttc

SEQ ID NO: 899426 - DNA, 22 bp, Artificial Sequence
  chemically synthesized
gaccgttatagaaagtttgctg

SEQ ID NO: 899427 - DNA, 22 bp, Artificial Sequence
  chemically synthesized
aacacctagagcagaggtcagc

SEQ ID NO: 899428 - DNA, 22 bp, Artificial Sequence
  chemically synthesized
gaacacctagagcagaggtcag

SEQ ID NO: 899429 - DNA, 22 bp, Artificial Sequence
  chemically synthesized
tagaaagtttgctgacctctgc

SEQ ID NO: 899430 - DNA, 22 bp, Artificial Sequence
  chemically synthesized
cttgaacacctagagcagaggt

SEQ ID NO: 899431 - DNA, 22 bp, Artificial Sequence
  chemically synthesized
gctgacctctgctctaggtgtt

SEQ ID NO: 899432 - DNA, 22 bp, Artificial Sequence
  chemically synthesized
ctgacctctgctctaggtgttc

SEQ ID NO: 899433 - DNA, 22 bp, Artificial Sequence
  chemically synthesized
ggccacaactccttgaacacct

SEQ ID NO: 899434 - DNA, 22 bp, Artificial Sequence
  chemically synthesized
acctctgctctaggtgttcaag

SEQ ID NO: 899435 - DNA, 22 bp, Artificial Sequence
  chemically synthesized
tgctctaggtgttcaaggagtt

SEQ ID NO: 899436 - DNA, 22 bp, Artificial Sequence
  chemically synthesized
gaggttgggccacaactccttg

SEQ ID NO: 899437 - DNA, 22 bp, Artificial Sequence
  chemically synthesized
ctctaggtgttcaaggagttgt

SEQ ID NO: 899438 - DNA, 22 bp, Artificial Sequence
  chemically synthesized
taggtgttcaaggagttgtggc

SEQ ID NO: 899439 - DNA, 22 bp, Artificial Sequence
  chemically synthesized
ggtgttcaaggagttgtggccc

SEQ ID NO: 899440 - DNA, 22 bp, Artificial Sequence
  chemically synthesized
gatggactggaggttgggccac

SEQ ID NO: 899441 - DNA, 22 bp, Artificial Sequence
  chemically synthesized
agatggactggaggttgggcca

SEQ ID NO: 899442 - DNA, 22 bp, Artificial Sequence
  chemically synthesized
aaggagttgtggcccaacctcc

SEQ ID NO: 899443 - DNA, 22 bp, Artificial Sequence
  chemically synthesized
tggcccaacctccagtccatct

SEQ ID NO: 899444 - DNA, 22 bp, Artificial Sequence
  chemically synthesized
aaatacaggcaggaccaagact

SEQ ID NO: 899445 - DNA, 22 bp, Artificial Sequence
  chemically synthesized
cagtccatctaagtcttggtcc

SEQ ID NO: 899446 - DNA, 22 bp, Artificial Sequence
  chemically synthesized
tgaaatacaggcaggaccaaga

SEQ ID NO: 899447 - DNA, 22 bp, Artificial Sequence
  chemically synthesized
aagcggctctgaaatacaggca

SEQ ID NO: 899448 - DNA, 22 bp, Artificial Sequence
  chemically synthesized
agtcttggtcctgcctgtattt

SEQ ID NO: 899449 - DNA, 22 bp, Artificial Sequence
  chemically synthesized
ggtcctgcctgtatttcagagc

SEQ ID NO: 899450 - DNA, 22 bp, Artificial Sequence
  chemically synthesized
gtcctgcctgtatttcagagcc

SEQ ID NO: 899451 - DNA, 22 bp, Artificial Sequence
  chemically synthesized
acccgttaaagcggctctgaaa

SEQ ID NO: 899452 - DNA, 22 bp, Artificial Sequence
  chemically synthesized
cctgtatttcagagccgcttta

SEQ ID NO: 899453 - DNA, 22 bp, Artificial Sequence
  chemically synthesized
accaactcacccgttaaagcgg

SEQ ID NO: 899454 - DNA, 22 bp, Artificial Sequence
  chemically synthesized
tatttcagagccgctttaacgg

SEQ ID NO: 899455 - DNA, 22 bp, Artificial Sequence
  chemically synthesized
cactcaccaactcacccgttaa

SEQ ID NO: 899456 - DNA, 22 bp, Artificial Sequence
  chemically synthesized
cagagccgctttaacgggtgag

SEQ ID NO: 899457 - DNA, 22 bp, Artificial Sequence
  chemically synthesized
agagccgctttaacgggtgagt

SEQ ID NO: 899458 - DNA, 22 bp, Artificial Sequence
  chemically synthesized
tactgcactcaccaactcaccc

SEQ ID NO: 899459 - DNA, 22 bp, Artificial Sequence
  chemically synthesized
taacgggtgagttggtgagtgc

SEQ ID NO: 899460 - DNA, 22 bp, Artificial Sequence
  chemically synthesized
aagccctgtactgcactcacca

SEQ ID NO: 899461 - DNA, 22 bp, Artificial Sequence
  chemically synthesized
aacgggtgagttggtgagtgca

SEQ ID NO: 899462 - DNA, 22 bp, Artificial Sequence
  chemically synthesized
acgggtgagttggtgagtgcag

SEQ ID NO: 899463 - DNA, 22 bp, Artificial Sequence
  chemically synthesized
gtacattgaagccctgtactgc

SEQ ID NO: 899464 - DNA, 22 bp, Artificial Sequence
  chemically synthesized
tcgtacattgaagccctgtact

SEQ ID NO: 899465 - DNA, 22 bp, Artificial Sequence
  chemically synthesized
ctcgtacattgaagccctgtac

SEQ ID NO: 899466 - DNA, 22 bp, Artificial Sequence
  chemically synthesized
gtgagtgcagtacagggcttca

SEQ ID NO: 899467 - DNA, 22 bp, Artificial Sequence
  chemically synthesized
tttctcgtacattgaagccctg

SEQ ID NO: 899468 - DNA, 22 bp, Artificial Sequence
  chemically synthesized
atttctcgtacattgaagccct

SEQ ID NO: 899469 - DNA, 22 bp, Artificial Sequence
  chemically synthesized
tatttctcgtacattgaagccc

SEQ ID NO: 899470 - DNA, 22 bp, Artificial Sequence
  chemically synthesized
ttatttctcgtacattgaagcc

SEQ ID NO: 899471 - DNA, 22 bp, Artificial Sequence
  chemically synthesized
tttatttctcgtacattgaagc

SEQ ID NO: 899472 - DNA, 22 bp, Artificial Sequence
  chemically synthesized
ttttatttctcgtacattgaag

SEQ ID NO: 899473 - DNA, 22 bp, Artificial Sequence
  chemically synthesized
aaagtttttttatttctcgtac

SEQ ID NO: 899474 - DNA, 22 bp, Artificial Sequence
  chemically synthesized
aaaagtttttttatttctcgta

SEQ ID NO: 899475 - DNA, 22 bp, Artificial Sequence
  chemically synthesized
catttaaaagtttttttatttc

SEQ ID NO: 899476 - DNA, 22 bp, Artificial Sequence
  chemically synthesized
caatgtacgagaaataaaaaaa

SEQ ID NO: 899477 - DNA, 22 bp, Artificial Sequence
  chemically synthesized
aatgtacgagaaataaaaaaac

SEQ ID NO: 899478 - DNA, 22 bp, Artificial Sequence
  chemically synthesized
atggatactgcatttaaaagtt

SEQ ID NO: 899479 - DNA, 22 bp, Artificial Sequence
  chemically synthesized
ggtaaattaatggatactgcat

SEQ ID NO: 899480 - DNA, 22 bp, Artificial Sequence
  chemically synthesized
gggtaaattaatggatactgca

SEQ ID NO: 899481 - DNA, 22 bp, Artificial Sequence
  chemically synthesized
caatttgggtaaattaatggat

SEQ ID NO: 899482 - DNA, 22 bp, Artificial Sequence
  chemically synthesized
ttaaatgcagtatccattaatt

SEQ ID NO: 899483 - DNA, 22 bp, Artificial Sequence
  chemically synthesized
ccaatttgggtaaattaatgga

SEQ ID NO: 899484 - DNA, 22 bp, Artificial Sequence
  chemically synthesized
taaatgcagtatccattaattt

SEQ ID NO: 899485 - DNA, 22 bp, Artificial Sequence
  chemically synthesized
tccaatttgggtaaattaatgg

SEQ ID NO: 899486 - DNA, 22 bp, Artificial Sequence
  chemically synthesized
aaatgcagtatccattaattta

SEQ ID NO: 899487 - DNA, 22 bp, Artificial Sequence
  chemically synthesized
aatgcagtatccattaatttac

SEQ ID NO: 899488 - DNA, 22 bp, Artificial Sequence
  chemically synthesized
tccattttccaatttgggtaaa

SEQ ID NO: 899489 - DNA, 22 bp, Artificial Sequence
  chemically synthesized
gtccattttccaatttgggtaa

SEQ ID NO: 899490 - DNA, 22 bp, Artificial Sequence
  chemically synthesized
tcttgtccattttccaatttgg

SEQ ID NO: 899491 - DNA, 22 bp, Artificial Sequence
  chemically synthesized
atttacccaaattggaaaatgg

SEQ ID NO: 899492 - DNA, 22 bp, Artificial Sequence
  chemically synthesized
acccaaattggaaaatggacaa

SEQ ID NO: 899493 - DNA, 22 bp, Artificial Sequence
  chemically synthesized
cccaaattggaaaatggacaag

SEQ ID NO: 899494 - DNA, 22 bp, Artificial Sequence
  chemically synthesized
caccaaaggatgctgtcttgtc

SEQ ID NO: 899495 - DNA, 22 bp, Artificial Sequence
  chemically synthesized
ccaccaaaggatgctgtcttgt

SEQ ID NO: 899496 - DNA, 22 bp, Artificial Sequence
  chemically synthesized
gaaaatggacaagacagcatcc

SEQ ID NO: 899497 - DNA, 22 bp, Artificial Sequence
  chemically synthesized
aaaaaatttccaccaaaggatg

SEQ ID NO: 899498 - DNA, 22 bp, Artificial Sequence
  chemically synthesized
aaaaaaatttccaccaaaggat

SEQ ID NO: 899499 - DNA, 22 bp, Artificial Sequence
  chemically synthesized
tggtggaaatttttttaaatcc

SEQ ID NO: 899500 - DNA, 22 bp, Artificial Sequence
  chemically synthesized
ggtggaaatttttttaaatcca

SEQ ID NO: 899501 - DNA, 22 bp, Artificial Sequence
  chemically synthesized
gtggaaatttttttaaatccac

SEQ ID NO: 899502 - DNA, 22 bp, Artificial Sequence
  chemically synthesized
ttttaaatccacgaccctcctg

SEQ ID NO: 899503 - DNA, 22 bp, Artificial Sequence
  chemically synthesized
tttaaatccacgaccctcctgg

SEQ ID NO: 899504 - DNA, 22 bp, Artificial Sequence
  chemically synthesized
ttaaatccacgaccctcctggt

SEQ ID NO: 899505 - DNA, 22 bp, Artificial Sequence
  chemically synthesized
taaatccacgaccctcctggtc

SEQ ID NO: 899506 - DNA, 22 bp, Artificial Sequence
  chemically synthesized
aaatccacgaccctcctggtct

SEQ ID NO: 899507 - DNA, 22 bp, Artificial Sequence
  chemically synthesized
aatccacgaccctcctggtctg

SEQ ID NO: 899508 - DNA, 22 bp, Artificial Sequence
  chemically synthesized
caaagtgtcccaaaaacagacc

SEQ ID NO: 899509 - DNA, 22 bp, Artificial Sequence
  chemically synthesized
gctacaaagtgtcccaaaaaca

SEQ ID NO: 899510 - DNA, 22 bp, Artificial Sequence
  chemically synthesized
ctggtctgtttttgggacactt

SEQ ID NO: 899511 - DNA, 22 bp, Artificial Sequence
  chemically synthesized
gtctgtttttgggacactttgt

SEQ ID NO: 899512 - DNA, 22 bp, Artificial Sequence
  chemically synthesized
tacatactggctacaaagtgtc

SEQ ID NO: 899513 - DNA, 22 bp, Artificial Sequence
  chemically synthesized
gtacatactggctacaaagtgt

SEQ ID NO: 899514 - DNA, 22 bp, Artificial Sequence
  chemically synthesized
tttttgggacactttgtagcca

SEQ ID NO: 899515 - DNA, 22 bp, Artificial Sequence
  chemically synthesized
ttgggacactttgtagccagta

SEQ ID NO: 899516 - DNA, 22 bp, Artificial Sequence
  chemically synthesized
tgggacactttgtagccagtat

SEQ ID NO: 899517 - DNA, 22 bp, Artificial Sequence
  chemically synthesized
gggacactttgtagccagtatg

SEQ ID NO: 899518 - DNA, 22 bp, Artificial Sequence
  chemically synthesized
ggacactttgtagccagtatgt

SEQ ID NO: 899519 - DNA, 22 bp, Artificial Sequence
  chemically synthesized
aatcagacatttgtacatactg

SEQ ID NO: 899520 - DNA, 22 bp, Artificial Sequence
  chemically synthesized
tgtagccagtatgtacaaatgt

SEQ ID NO: 899521 - DNA, 22 bp, Artificial Sequence
  chemically synthesized
gtagccagtatgtacaaatgtc

SEQ ID NO: 899522 - DNA, 22 bp, Artificial Sequence
  chemically synthesized
tagccagtatgtacaaatgtct

SEQ ID NO: 899523 - DNA, 22 bp, Artificial Sequence
  chemically synthesized
gtcccagatggatggcccagct

SEQ ID NO: 899524 - DNA, 22 bp, Artificial Sequence
  chemically synthesized
gctggtcccagatggatggccc

SEQ ID NO: 899525 - DNA, 22 bp, Artificial Sequence
  chemically synthesized
atttagctgggccatccatctg

SEQ ID NO: 899526 - DNA, 22 bp, Artificial Sequence
  chemically synthesized
agctagctggtcccagatggat

SEQ ID NO: 899527 - DNA, 22 bp, Artificial Sequence
  chemically synthesized
cagctagctggtcccagatgga

SEQ ID NO: 899528 - DNA, 22 bp, Artificial Sequence
  chemically synthesized
agctgggccatccatctgggac

SEQ ID NO: 899529 - DNA, 22 bp, Artificial Sequence
  chemically synthesized
gctgggccatccatctgggacc

SEQ ID NO: 899530 - DNA, 22 bp, Artificial Sequence
  chemically synthesized
ggccatccatctgggaccagct

SEQ ID NO: 899531 - DNA, 22 bp, Artificial Sequence
  chemically synthesized
caagcttcagctagctggtccc

SEQ ID NO: 899532 - DNA, 22 bp, Artificial Sequence
  chemically synthesized
cgattgcaagcttcagctagct

SEQ ID NO: 899533 - DNA, 22 bp, Artificial Sequence
  chemically synthesized
actgcgattgcaagcttcagct

SEQ ID NO: 899534 - DNA, 22 bp, Artificial Sequence
  chemically synthesized
ggaccagctagctgaagcttgc

SEQ ID NO: 899535 - DNA, 22 bp, Artificial Sequence
  chemically synthesized
agctaactgcgattgcaagctt

SEQ ID NO: 899536 - DNA, 22 bp, Artificial Sequence
  chemically synthesized
cagctaactgcgattgcaagct

SEQ ID NO: 899537 - DNA, 22 bp, Artificial Sequence
  chemically synthesized
aaatttcagctaactgcgattg

SEQ ID NO: 899538 - DNA, 22 bp, Artificial Sequence
  chemically synthesized
gctgaagcttgcaatcgcagtt

SEQ ID NO: 899539 - DNA, 22 bp, Artificial Sequence
  chemically synthesized
caaatttcagctaactgcgatt

SEQ ID NO: 899540 - DNA, 22 bp, Artificial Sequence
  chemically synthesized
aagcttgcaatcgcagttagct

SEQ ID NO: 899541 - DNA, 22 bp, Artificial Sequence
  chemically synthesized
aagtttcaaatttcagctaact

SEQ ID NO: 899542 - DNA, 22 bp, Artificial Sequence
  chemically synthesized
gcaatcgcagttagctgaaatt

SEQ ID NO: 899543 - DNA, 22 bp, Artificial Sequence
  chemically synthesized
caatcgcagttagctgaaattt

SEQ ID NO: 899544 - DNA, 22 bp, Artificial Sequence
  chemically synthesized
aaatattcaagtttcaaatttc

SEQ ID NO: 899545 - DNA, 22 bp, Artificial Sequence
  chemically synthesized
gaaatattcaagtttcaaattt

SEQ ID NO: 899546 - DNA, 22 bp, Artificial Sequence
  chemically synthesized
ccacttgaaatattcaagtttc

SEQ ID NO: 899547 - DNA, 22 bp, Artificial Sequence
  chemically synthesized
gctgaaatttgaaacttgaata

SEQ ID NO: 899548 - DNA, 22 bp, Artificial Sequence
  chemically synthesized
aaatttgaaacttgaatatttc

SEQ ID NO: 899549 - DNA, 22 bp, Artificial Sequence
  chemically synthesized
aatgtctaccacttgaaatatt

SEQ ID NO: 899550 - DNA, 22 bp, Artificial Sequence
  chemically synthesized
ctaaatgtctaccacttgaaat

SEQ ID NO: 899551 - DNA, 22 bp, Artificial Sequence
  chemically synthesized
gaaacttgaatatttcaagtgg

SEQ ID NO: 899552 - DNA, 22 bp, Artificial Sequence
  chemically synthesized
aaacttgaatatttcaagtggt

SEQ ID NO: 899553 - DNA, 22 bp, Artificial Sequence
  chemically synthesized
ttgctaaatgtctaccacttga

SEQ ID NO: 899554 - DNA, 22 bp, Artificial Sequence
  chemically synthesized
ttattgctaaatgtctaccact

SEQ ID NO: 899555 - DNA, 22 bp, Artificial Sequence
  chemically synthesized
gttattgctaaatgtctaccac

SEQ ID NO: 899556 - DNA, 22 bp, Artificial Sequence
  chemically synthesized
gaatatttcaagtggtagacat

SEQ ID NO: 899557 - DNA, 22 bp, Artificial Sequence
  chemically synthesized
aatatttcaagtggtagacatt

SEQ ID NO: 899558 - DNA, 22 bp, Artificial Sequence
  chemically synthesized
caagtggtagacatttagcaat

SEQ ID NO: 899559 - DNA, 22 bp, Artificial Sequence
  chemically synthesized
aagtggtagacatttagcaata

SEQ ID NO: 899560 - DNA, 22 bp, Artificial Sequence
  chemically synthesized
agcaataacaaattatctacat

SEQ ID NO: 899561 - DNA, 22 bp, Artificial Sequence
  chemically synthesized
gcaataacaaattatctacatc

SEQ ID NO: 899562 - DNA, 22 bp, Artificial Sequence
  chemically synthesized
aaagatatcaaataatgatgta

SEQ ID NO: 899563 - DNA, 22 bp, Artificial Sequence
  chemically synthesized
tctacatcattatttgatatct

SEQ ID NO: 899564 - DNA, 22 bp, Artificial Sequence
  chemically synthesized
gaatgcaaattaaaagatatca

SEQ ID NO: 899565 - DNA, 22 bp, Artificial Sequence
  chemically synthesized
ggaatgcaaattaaaagatatc

SEQ ID NO: 899566 - DNA, 22 bp, Artificial Sequence
  chemically synthesized
catcattatttgatatctttta

SEQ ID NO: 899567 - DNA, 22 bp, Artificial Sequence
  chemically synthesized
ttggaatgcaaattaaaagata

SEQ ID NO: 899568 - DNA, 22 bp, Artificial Sequence
  chemically synthesized
cttggaatgcaaattaaaagat

SEQ ID NO: 899569 - DNA, 22 bp, Artificial Sequence
  chemically synthesized
tttgatatcttttaatttgcat

SEQ ID NO: 899570 - DNA, 22 bp, Artificial Sequence
  chemically synthesized
gatatcttttaatttgcattcc

SEQ ID NO: 899571 - DNA, 22 bp, Artificial Sequence
  chemically synthesized
atatcttttaatttgcattcca

SEQ ID NO: 899572 - DNA, 22 bp, Artificial Sequence
  chemically synthesized
gaaacgcacaacttcttggaat

SEQ ID NO: 899573 - DNA, 22 bp, Artificial Sequence
  chemically synthesized
ggaaacgcacaacttcttggaa

SEQ ID NO: 899574 - DNA, 22 bp, Artificial Sequence
  chemically synthesized
tggaaacgcacaacttcttgga

SEQ ID NO: 899575 - DNA, 22 bp, Artificial Sequence
  chemically synthesized
ttaatttgcattccaagaagtt

SEQ ID NO: 899576 - DNA, 22 bp, Artificial Sequence
  chemically synthesized
taatttgcattccaagaagttg

SEQ ID NO: 899577 - DNA, 22 bp, Artificial Sequence
  chemically synthesized
aatttgcattccaagaagttgt

SEQ ID NO: 899578 - DNA, 22 bp, Artificial Sequence
  chemically synthesized
ctttggaaacgcacaacttctt

SEQ ID NO: 899579 - DNA, 22 bp, Artificial Sequence
  chemically synthesized
atttgcattccaagaagttgtg

SEQ ID NO: 899580 - DNA, 22 bp, Artificial Sequence
  chemically synthesized
actgctttggaaacgcacaact

SEQ ID NO: 899581 - DNA, 22 bp, Artificial Sequence
  chemically synthesized
gcattccaagaagttgtgcgtt

SEQ ID NO: 899582 - DNA, 22 bp, Artificial Sequence
  chemically synthesized
cactgctttggaaacgcacaac

SEQ ID NO: 899583 - DNA, 22 bp, Artificial Sequence
  chemically synthesized
cattccaagaagttgtgcgttt

SEQ ID NO: 899584 - DNA, 22 bp, Artificial Sequence
  chemically synthesized
tcactgctttggaaacgcacaa

SEQ ID NO: 899585 - DNA, 22 bp, Artificial Sequence
  chemically synthesized
tttcactgctttggaaacgcac

SEQ ID NO: 899586 - DNA, 22 bp, Artificial Sequence
  chemically synthesized
ctttcactgctttggaaacgca

SEQ ID NO: 899587 - DNA, 22 bp, Artificial Sequence
  chemically synthesized
tctttcactgctttggaaacgc

SEQ ID NO: 899588 - DNA, 22 bp, Artificial Sequence
  chemically synthesized
caagaagttgtgcgtttccaaa

SEQ ID NO: 899589 - DNA, 22 bp, Artificial Sequence
  chemically synthesized
ttttctttcactgctttggaaa

SEQ ID NO: 899590 - DNA, 22 bp, Artificial Sequence
  chemically synthesized
attttctttcactgctttggaa

SEQ ID NO: 899591 - DNA, 22 bp, Artificial Sequence
  chemically synthesized
tattttctttcactgctttgga

SEQ ID NO: 899592 - DNA, 22 bp, Artificial Sequence
  chemically synthesized
ttttattttctttcactgcttt

SEQ ID NO: 899593 - DNA, 22 bp, Artificial Sequence
  chemically synthesized
gttttattttctttcactgctt

SEQ ID NO: 899594 - DNA, 22 bp, Artificial Sequence
  chemically synthesized
tgttttattttctttcactgct

SEQ ID NO: 899595 - DNA, 22 bp, Artificial Sequence
  chemically synthesized
tgcgtttccaaagcagtgaaag

SEQ ID NO: 899596 - DNA, 22 bp, Artificial Sequence
  chemically synthesized
ttgttttattttctttcactgc

SEQ ID NO: 899597 - DNA, 22 bp, Artificial Sequence
  chemically synthesized
aatttttgttttattttctttc

SEQ ID NO: 899598 - DNA, 22 bp, Artificial Sequence
  chemically synthesized
aaatttttgttttattttcttt

SEQ ID NO: 899599 - DNA, 22 bp, Artificial Sequence
  chemically synthesized
ccaaagcagtgaaagaaaataa

SEQ ID NO: 899600 - DNA, 22 bp, Artificial Sequence
  chemically synthesized
taaatttttgttttattttctt

SEQ ID NO: 899601 - DNA, 22 bp, Artificial Sequence
  chemically synthesized
caaagcagtgaaagaaaataaa

SEQ ID NO: 899602 - DNA, 22 bp, Artificial Sequence
  chemically synthesized
ttaaatttttgttttattttct

SEQ ID NO: 899603 - DNA, 22 bp, Artificial Sequence
  chemically synthesized
tttaaatttttgttttattttc

SEQ ID NO: 899604 - DNA, 22 bp, Artificial Sequence
  chemically synthesized
cattttttaaatttttgtttta

SEQ ID NO: 899605 - DNA, 22 bp, Artificial Sequence
  chemically synthesized
ccattttttaaatttttgtttt

SEQ ID NO: 899606 - DNA, 22 bp, Artificial Sequence
  chemically synthesized
acatatcgtttccattttttaa

SEQ ID NO: 899607 - DNA, 22 bp, Artificial Sequence
  chemically synthesized
tgttgacatatcgtttccattt

SEQ ID NO: 899608 - DNA, 22 bp, Artificial Sequence
  chemically synthesized
atgttgacatatcgtttccatt

SEQ ID NO: 899609 - DNA, 22 bp, Artificial Sequence
  chemically synthesized
tatgttgacatatcgtttccat

SEQ ID NO: 899610 - DNA, 22 bp, Artificial Sequence
  chemically synthesized
ttatgttgacatatcgtttcca

SEQ ID NO: 899611 - DNA, 22 bp, Artificial Sequence
  chemically synthesized
gcttttatgttgacatatcgtt

SEQ ID NO: 899612 - DNA, 22 bp, Artificial Sequence
  chemically synthesized
aaaaaatggaaacgatatgtca

SEQ ID NO: 899613 - DNA, 22 bp, Artificial Sequence
  chemically synthesized
tggcttttatgttgacatatcg

SEQ ID NO: 899614 - DNA, 22 bp, Artificial Sequence
  chemically synthesized
aaaaatggaaacgatatgtcaa

SEQ ID NO: 899615 - DNA, 22 bp, Artificial Sequence
  chemically synthesized
ctggcttttatgttgacatatc

SEQ ID NO: 899616 - DNA, 22 bp, Artificial Sequence
  chemically synthesized
tctggcttttatgttgacatat

SEQ ID NO: 899617 - DNA, 22 bp, Artificial Sequence
  chemically synthesized
ttctggcttttatgttgacata

SEQ ID NO: 899618 - DNA, 22 bp, Artificial Sequence
  chemically synthesized
tttctggcttttatgttgacat

SEQ ID NO: 899619 - DNA, 22 bp, Artificial Sequence
  chemically synthesized
ttttctggcttttatgttgaca

SEQ ID NO: 899620 - DNA, 22 bp, Artificial Sequence
  chemically synthesized
atttttttctggcttttatgtt

SEQ ID NO: 899621 - DNA, 22 bp, Artificial Sequence
  chemically synthesized
aaaattaatttttttctggctt

SEQ ID NO: 899622 - DNA, 22 bp, Artificial Sequence
  chemically synthesized
aaaaattaatttttttctggct

SEQ ID NO: 899623 - DNA, 22 bp, Artificial Sequence
  chemically synthesized
taaaaattaatttttttctggc

SEQ ID NO: 899624 - DNA, 22 bp, Artificial Sequence
  chemically synthesized
cagggtataatagtattttaaa

SEQ ID NO: 899625 - DNA, 22 bp, Artificial Sequence
  chemically synthesized
acagggtataatagtattttaa

SEQ ID NO: 899626 - DNA, 22 bp, Artificial Sequence
  chemically synthesized
atttttaaaatactattatacc

SEQ ID NO: 899627 - DNA, 22 bp, Artificial Sequence
  chemically synthesized
cacgtaatttacagggtataat

SEQ ID NO: 899628 - DNA, 22 bp, Artificial Sequence
  chemically synthesized
ttaaaatactattataccctgt

SEQ ID NO: 899629 - DNA, 22 bp, Artificial Sequence
  chemically synthesized
taaaatactattataccctgta

SEQ ID NO: 899630 - DNA, 22 bp, Artificial Sequence
  chemically synthesized
aaaatactattataccctgtaa

SEQ ID NO: 899631 - DNA, 22 bp, Artificial Sequence
  chemically synthesized
aaatactattataccctgtaaa

SEQ ID NO: 899632 - DNA, 22 bp, Artificial Sequence
  chemically synthesized
ttataccctgtaaattacgtgt

SEQ ID NO: 899633 - DNA, 22 bp, Artificial Sequence
  chemically synthesized
tgcccatcaaggctacacgtaa

SEQ ID NO: 899634 - DNA, 22 bp, Artificial Sequence
  chemically synthesized
taccctgtaaattacgtgtagc

SEQ ID NO: 899635 - DNA, 22 bp, Artificial Sequence
  chemically synthesized
tatgcccatcaaggctacacgt

SEQ ID NO: 899636 - DNA, 22 bp, Artificial Sequence
  chemically synthesized
taaattacgtgtagccttgatg

SEQ ID NO: 899637 - DNA, 22 bp, Artificial Sequence
  chemically synthesized
cgtgtagccttgatgggcatag

SEQ ID NO: 899638 - DNA, 22 bp, Artificial Sequence
  chemically synthesized
accggtgaagttctatgcccat

SEQ ID NO: 899639 - DNA, 22 bp, Artificial Sequence
  chemically synthesized
ccatattaaccggtgaagttct

SEQ ID NO: 899640 - DNA, 22 bp, Artificial Sequence
  chemically synthesized
gatgggcatagaacttcaccgg

SEQ ID NO: 899641 - DNA, 22 bp, Artificial Sequence
  chemically synthesized
atgggcatagaacttcaccggt

SEQ ID NO: 899642 - DNA, 22 bp, Artificial Sequence
  chemically synthesized
gtggctaccatattaaccggtg

SEQ ID NO: 899643 - DNA, 22 bp, Artificial Sequence
  chemically synthesized
catgtggttagtggctaccata

SEQ ID NO: 899644 - DNA, 22 bp, Artificial Sequence
  chemically synthesized
caccggttaatatggtagccac

SEQ ID NO: 899645 - DNA, 22 bp, Artificial Sequence
  chemically synthesized
accggttaatatggtagccact

SEQ ID NO: 899646 - DNA, 22 bp, Artificial Sequence
  chemically synthesized
aatagctacatgtggttagtgg

SEQ ID NO: 899647 - DNA, 22 bp, Artificial Sequence
  chemically synthesized
atatggtagccactaaccacat

SEQ ID NO: 899648 - DNA, 22 bp, Artificial Sequence
  chemically synthesized
ggtgctcaatagctacatgtgg

SEQ ID NO: 899649 - DNA, 22 bp, Artificial Sequence
  chemically synthesized
ggctgggtgctcaatagctaca

SEQ ID NO: 899650 - DNA, 22 bp, Artificial Sequence
  chemically synthesized
tgggctgggtgctcaatagcta

SEQ ID NO: 899651 - DNA, 22 bp, Artificial Sequence
  chemically synthesized
accacatgtagctattgagcac

SEQ ID NO: 899652 - DNA, 22 bp, Artificial Sequence
  chemically synthesized
caaataggcatattctgggctg

SEQ ID NO: 899653 - DNA, 22 bp, Artificial Sequence
  chemically synthesized
ttgagcacccagcccagaatat

SEQ ID NO: 899654 - DNA, 22 bp, Artificial Sequence
  chemically synthesized
ttccaaataggcatattctggg

SEQ ID NO: 899655 - DNA, 22 bp, Artificial Sequence
  chemically synthesized
agcacccagcccagaatatgcc

SEQ ID NO: 899656 - DNA, 22 bp, Artificial Sequence
  chemically synthesized
cagcatatgtctattccaaata

SEQ ID NO: 899657 - DNA, 22 bp, Artificial Sequence
  chemically synthesized
acagcatatgtctattccaaat

SEQ ID NO: 899658 - DNA, 22 bp, Artificial Sequence
  chemically synthesized
tacagcatatgtctattccaaa

SEQ ID NO: 899659 - DNA, 22 bp, Artificial Sequence
  chemically synthesized
tttggaatagacatatgctgta

SEQ ID NO: 899660 - DNA, 22 bp, Artificial Sequence
  chemically synthesized
ggaatagacatatgctgtaaaa

SEQ ID NO: 899661 - DNA, 22 bp, Artificial Sequence
  chemically synthesized
gaatagacatatgctgtaaaat

SEQ ID NO: 899662 - DNA, 22 bp, Artificial Sequence
  chemically synthesized
ggaatccaatatgtattttaca

SEQ ID NO: 899663 - DNA, 22 bp, Artificial Sequence
  chemically synthesized
cggaatccaatatgtattttac

SEQ ID NO: 899664 - DNA, 22 bp, Artificial Sequence
  chemically synthesized
tgccttcggaatccaatatgta

SEQ ID NO: 899665 - DNA, 22 bp, Artificial Sequence
  chemically synthesized
taaaatacatattggattccga

SEQ ID NO: 899666 - DNA, 22 bp, Artificial Sequence
  chemically synthesized
agtactatgccttcggaatcca

SEQ ID NO: 899667 - DNA, 22 bp, Artificial Sequence
  chemically synthesized
cagtactatgccttcggaatcc

SEQ ID NO: 899668 - DNA, 22 bp, Artificial Sequence
  chemically synthesized
tcagtactatgccttcggaatc

SEQ ID NO: 899669 - DNA, 22 bp, Artificial Sequence
  chemically synthesized
ttcagtactatgccttcggaat

SEQ ID NO: 899670 - DNA, 22 bp, Artificial Sequence
  chemically synthesized
tttcagtactatgccttcggaa

SEQ ID NO: 899671 - DNA, 22 bp, Artificial Sequence
  chemically synthesized
ttttcagtactatgccttcgga

SEQ ID NO: 899672 - DNA, 22 bp, Artificial Sequence
  chemically synthesized
tttttcagtactatgccttcgg

SEQ ID NO: 899673 - DNA, 22 bp, Artificial Sequence
  chemically synthesized
ttttttcagtactatgccttcg

SEQ ID NO: 899674 - DNA, 22 bp, Artificial Sequence
  chemically synthesized
tttttttcagtactatgccttc

SEQ ID NO: 899675 - DNA, 22 bp, Artificial Sequence
  chemically synthesized
ttttttttcagtactatgcctt

SEQ ID NO: 899676 - DNA, 22 bp, Artificial Sequence
  chemically synthesized
tttttttttcagtactatgcct

SEQ ID NO: 899677 - DNA, 22 bp, Artificial Sequence
  chemically synthesized
tttttttttttcagtactatgc

SEQ ID NO: 899678 - DNA, 22 bp, Artificial Sequence
  chemically synthesized
gattccgaaggcatagtactga

SEQ ID NO: 899679 - DNA, 22 bp, Artificial Sequence
  chemically synthesized
gattctttttttttttcagtac

SEQ ID NO: 899680 - DNA, 22 bp, Artificial Sequence
  chemically synthesized
ggattctttttttttttcagta

SEQ ID NO: 899681 - DNA, 22 bp, Artificial Sequence
  chemically synthesized
cgaaggcatagtactgaaaaaa

SEQ ID NO: 899682 - DNA, 22 bp, Artificial Sequence
  chemically synthesized
tggattctttttttttttcagt

SEQ ID NO: 899683 - DNA, 22 bp, Artificial Sequence
  chemically synthesized
aaatattttggattcttttttt

SEQ ID NO: 899684 - DNA, 22 bp, Artificial Sequence
  chemically synthesized
aaaaaaaaaaagaatccaaaat

SEQ ID NO: 899685 - DNA, 22 bp, Artificial Sequence
  chemically synthesized
agtgatgcatggatgaattaaa

SEQ ID NO: 899686 - DNA, 22 bp, Artificial Sequence
  chemically synthesized
tcattaagtgatgcatggatga

SEQ ID NO: 899687 - DNA, 22 bp, Artificial Sequence
  chemically synthesized
ctgtcattaagtgatgcatgga

SEQ ID NO: 899688 - DNA, 22 bp, Artificial Sequence
  chemically synthesized
taattcatccatgcatcactta

SEQ ID NO: 899689 - DNA, 22 bp, Artificial Sequence
  chemically synthesized
aattcatccatgcatcacttaa

SEQ ID NO: 899690 - DNA, 22 bp, Artificial Sequence
  chemically synthesized
attcatccatgcatcacttaat

SEQ ID NO: 899691 - DNA, 22 bp, Artificial Sequence
  chemically synthesized
atccatgcatcacttaatgaca

SEQ ID NO: 899692 - DNA, 22 bp, Artificial Sequence
  chemically synthesized
agaatgtattcctgtcattaag

SEQ ID NO: 899693 - DNA, 22 bp, Artificial Sequence
  chemically synthesized
tcagaatgtattcctgtcatta

SEQ ID NO: 899694 - DNA, 22 bp, Artificial Sequence
  chemically synthesized
atgacacatctctcagaatgta

SEQ ID NO: 899695 - DNA, 22 bp, Artificial Sequence
  chemically synthesized
aatgacaggaatacattctgag

SEQ ID NO: 899696 - DNA, 22 bp, Artificial Sequence
  chemically synthesized
atgacaggaatacattctgaga

SEQ ID NO: 899697 - DNA, 22 bp, Artificial Sequence
  chemically synthesized
tgagagatgtgtcattaggtga

SEQ ID NO: 899698 - DNA, 22 bp, Artificial Sequence
  chemically synthesized
cataaggataaaatcacctaat

SEQ ID NO: 899699 - DNA, 22 bp, Artificial Sequence
  chemically synthesized
agagatgtgtcattaggtgatt

SEQ ID NO: 899700 - DNA, 22 bp, Artificial Sequence
  chemically synthesized
gcataaggataaaatcacctaa

SEQ ID NO: 899701 - DNA, 22 bp, Artificial Sequence
  chemically synthesized
tgatgtttgcataaggataaaa

SEQ ID NO: 899702 - DNA, 22 bp, Artificial Sequence
  chemically synthesized
ggtgattttatccttatgcaaa

SEQ ID NO: 899703 - DNA, 22 bp, Artificial Sequence
  chemically synthesized
tatccttatgcaaacatcatag

SEQ ID NO: 899704 - DNA, 22 bp, Artificial Sequence
  chemically synthesized
tgtaggtacacactatgatgtt

SEQ ID NO: 899705 - DNA, 22 bp, Artificial Sequence
  chemically synthesized
atccttatgcaaacatcatagt

SEQ ID NO: 899706 - DNA, 22 bp, Artificial Sequence
  chemically synthesized
gtgtaggtacacactatgatgt

SEQ ID NO: 899707 - DNA, 22 bp, Artificial Sequence
  chemically synthesized
tccttatgcaaacatcatagtg

SEQ ID NO: 899708 - DNA, 22 bp, Artificial Sequence
  chemically synthesized
ggtttgtgtaggtacacactat

SEQ ID NO: 899709 - DNA, 22 bp, Artificial Sequence
  chemically synthesized
atgcaaacatcatagtgtgtac

SEQ ID NO: 899710 - DNA, 22 bp, Artificial Sequence
  chemically synthesized
tgcaaacatcatagtgtgtacc

SEQ ID NO: 899711 - DNA, 22 bp, Artificial Sequence
  chemically synthesized
tatgtaccacctaggtttgtgt

SEQ ID NO: 899712 - DNA, 22 bp, Artificial Sequence
  chemically synthesized
cacaaacctaggtggtacatat

SEQ ID NO: 899713 - DNA, 22 bp, Artificial Sequence
  chemically synthesized
ggtgtgtagtaggctatatgta

SEQ ID NO: 899714 - DNA, 22 bp, Artificial Sequence
  chemically synthesized
ggtggtacatatagcctactac

SEQ ID NO: 899715 - DNA, 22 bp, Artificial Sequence
  chemically synthesized
tatcatgtagcctaggtgtgta

SEQ ID NO: 899716 - DNA, 22 bp, Artificial Sequence
  chemically synthesized
ggctatatcatgtagcctaggt

SEQ ID NO: 899717 - DNA, 22 bp, Artificial Sequence
  chemically synthesized
ctacacacctaggctacatgat

SEQ ID NO: 899718 - DNA, 22 bp, Artificial Sequence
  chemically synthesized
cacacctaggctacatgatata

SEQ ID NO: 899719 - DNA, 22 bp, Artificial Sequence
  chemically synthesized
cagcccaggagcattaggctat

SEQ ID NO: 899720 - DNA, 22 bp, Artificial Sequence
  chemically synthesized
ggctacatgatatagcctaatg

SEQ ID NO: 899721 - DNA, 22 bp, Artificial Sequence
  chemically synthesized
gcagcccaggagcattaggcta

SEQ ID NO: 899722 - DNA, 22 bp, Artificial Sequence
  chemically synthesized
catgatatagcctaatgctcct

SEQ ID NO: 899723 - DNA, 22 bp, Artificial Sequence
  chemically synthesized
cacaaatttgcagcccaggagc

SEQ ID NO: 899724 - DNA, 22 bp, Artificial Sequence
  chemically synthesized
atgctcctgggctgcaaatttg

SEQ ID NO: 899725 - DNA, 22 bp, Artificial Sequence
  chemically synthesized
ctgggctgcaaatttgtgcagc

SEQ ID NO: 899726 - DNA, 22 bp, Artificial Sequence
  chemically synthesized
agtacagtcacgtgctgcacaa

SEQ ID NO: 899727 - DNA, 22 bp, Artificial Sequence
  chemically synthesized
ggctgcaaatttgtgcagcacg

SEQ ID NO: 899728 - DNA, 22 bp, Artificial Sequence
  chemically synthesized
caaatttgtgcagcacgtgact

SEQ ID NO: 899729 - DNA, 22 bp, Artificial Sequence
  chemically synthesized
tagtattcagtacagtcacgtg

SEQ ID NO: 899730 - DNA, 22 bp, Artificial Sequence
  chemically synthesized
ctgtagtattcagtacagtcac

SEQ ID NO: 899731 - DNA, 22 bp, Artificial Sequence
  chemically synthesized
cctgtagtattcagtacagtca

SEQ ID NO: 899732 - DNA, 22 bp, Artificial Sequence
  chemically synthesized
gtgcagcacgtgactgtactga

SEQ ID NO: 899733 - DNA, 22 bp, Artificial Sequence
  chemically synthesized
tgcagcacgtgactgtactgaa

SEQ ID NO: 899734 - DNA, 22 bp, Artificial Sequence
  chemically synthesized
gaatttcctgtagtattcagta

SEQ ID NO: 899735 - DNA, 22 bp, Artificial Sequence
  chemically synthesized
tgttagaatttcctgtagtatt

SEQ ID NO: 899736 - DNA, 22 bp, Artificial Sequence
  chemically synthesized
ccactatgttagaatttcctgt

SEQ ID NO: 899737 - DNA, 22 bp, Artificial Sequence
  chemically synthesized
tactgaatactacaggaaattc

SEQ ID NO: 899738 - DNA, 22 bp, Artificial Sequence
  chemically synthesized
gccactatgttagaatttcctg

SEQ ID NO: 899739 - DNA, 22 bp, Artificial Sequence
  chemically synthesized
aatactacaggaaattctaaca

SEQ ID NO: 899740 - DNA, 22 bp, Artificial Sequence
  chemically synthesized
caggaaattctaacatagtggc

SEQ ID NO: 899741 - DNA, 22 bp, Artificial Sequence
  chemically synthesized
gatgcacgagtacttgccacta

SEQ ID NO: 899742 - DNA, 22 bp, Artificial Sequence
  chemically synthesized
agatgcacgagtacttgccact

SEQ ID NO: 899743 - DNA, 22 bp, Artificial Sequence
  chemically synthesized
taacatagtggcaagtactcgt

SEQ ID NO: 899744 - DNA, 22 bp, Artificial Sequence
  chemically synthesized
acatagtggcaagtactcgtgc

SEQ ID NO: 899745 - DNA, 22 bp, Artificial Sequence
  chemically synthesized
ggtatgtttagatgcacgagta

SEQ ID NO: 899746 - DNA, 22 bp, Artificial Sequence
  chemically synthesized
aggtatgtttagatgcacgagt

SEQ ID NO: 899747 - DNA, 22 bp, Artificial Sequence
  chemically synthesized
tgtttaggtatgtttagatgca

SEQ ID NO: 899748 - DNA, 22 bp, Artificial Sequence
  chemically synthesized
tatgtttaggtatgtttagatg

SEQ ID NO: 899749 - DNA, 22 bp, Artificial Sequence
  chemically synthesized
ctatgtttaggtatgtttagat

SEQ ID NO: 899750 - DNA, 22 bp, Artificial Sequence
  chemically synthesized
tctatgtttaggtatgtttaga

SEQ ID NO: 899751 - DNA, 22 bp, Artificial Sequence
  chemically synthesized
ttctatgtttaggtatgtttag

SEQ ID NO: 899752 - DNA, 22 bp, Artificial Sequence
  chemically synthesized
tttctatgtttaggtatgttta

SEQ ID NO: 899753 - DNA, 22 bp, Artificial Sequence
  chemically synthesized
gtgcatctaaacatacctaaac

SEQ ID NO: 899754 - DNA, 22 bp, Artificial Sequence
  chemically synthesized
ccatacctttttctatgtttag

SEQ ID NO: 899755 - DNA, 22 bp, Artificial Sequence
  chemically synthesized
accatacctttttctatgttta

SEQ ID NO: 899756 - DNA, 22 bp, Artificial Sequence
  chemically synthesized
aacatacctaaacatagaaaaa

SEQ ID NO: 899757 - DNA, 22 bp, Artificial Sequence
  chemically synthesized
aacatagaaaaaggtatggtaa

SEQ ID NO: 899758 - DNA, 22 bp, Artificial Sequence
  chemically synthesized
taatacagtaggtttaccatac

SEQ ID NO: 899759 - DNA, 22 bp, Artificial Sequence
  chemically synthesized
ataggattataatacagtaggt

SEQ ID NO: 899760 - DNA, 22 bp, Artificial Sequence
  chemically synthesized
gtgatctaataggattataata

SEQ ID NO: 899761 - DNA, 22 bp, Artificial Sequence
  chemically synthesized
ctgtattataatcctattagat

SEQ ID NO: 899762 - DNA, 22 bp, Artificial Sequence
  chemically synthesized
tatatacactggtgatctaata

SEQ ID NO: 899763 - DNA, 22 bp, Artificial Sequence
  chemically synthesized
tattataatcctattagatcac

SEQ ID NO: 899764 - DNA, 22 bp, Artificial Sequence
  chemically synthesized
taatcctattagatcaccagtg

SEQ ID NO: 899765 - DNA, 22 bp, Artificial Sequence
  chemically synthesized
ttagatcaccagtgtatatata

SEQ ID NO: 899766 - DNA, 22 bp, Artificial Sequence
  chemically synthesized
gtccatgataaactatatatac

SEQ ID NO: 899767 - DNA, 22 bp, Artificial Sequence
  chemically synthesized
ggtccatgataaactatatata

SEQ ID NO: 899768 - DNA, 22 bp, Artificial Sequence
  chemically synthesized
gatcaccagtgtatatatagtt

SEQ ID NO: 899769 - DNA, 22 bp, Artificial Sequence
  chemically synthesized
tggtccatgataaactatatat

SEQ ID NO: 899770 - DNA, 22 bp, Artificial Sequence
  chemically synthesized
tgtgtaatgaggttttggtcca

SEQ ID NO: 899771 - DNA, 22 bp, Artificial Sequence
  chemically synthesized
atcatggaccaaaacctcatta

SEQ ID NO: 899772 - DNA, 22 bp, Artificial Sequence
  chemically synthesized
tcatggaccaaaacctcattac

SEQ ID NO: 899773 - DNA, 22 bp, Artificial Sequence
  chemically synthesized
attacacatagcatgactgtat

SEQ ID NO: 899774 - DNA, 22 bp, Artificial Sequence
  chemically synthesized
caatcagtgcaaaaatacagtc

SEQ ID NO: 899775 - DNA, 22 bp, Artificial Sequence
  chemically synthesized
cacatagcatgactgtattttt

SEQ ID NO: 899776 - DNA, 22 bp, Artificial Sequence
  chemically synthesized
acgttgcaatcagtgcaaaaat

SEQ ID NO: 899777 - DNA, 22 bp, Artificial Sequence
  chemically synthesized
gacgttgcaatcagtgcaaaaa

SEQ ID NO: 899778 - DNA, 22 bp, Artificial Sequence
  chemically synthesized
tgacgttgcaatcagtgcaaaa

SEQ ID NO: 899779 - DNA, 22 bp, Artificial Sequence
  chemically synthesized
tatcattttgacgttgcaatca

SEQ ID NO: 899780 - DNA, 22 bp, Artificial Sequence
  chemically synthesized
tatttttgcactgattgcaacg

SEQ ID NO: 899781 - DNA, 22 bp, Artificial Sequence
  chemically synthesized
ttgcactgattgcaacgtcaaa

SEQ ID NO: 899782 - DNA, 22 bp, Artificial Sequence
  chemically synthesized
aaattgtatcattttgacgttg

SEQ ID NO: 899783 - DNA, 22 bp, Artificial Sequence
  chemically synthesized
tgcactgattgcaacgtcaaaa

SEQ ID NO: 899784 - DNA, 22 bp, Artificial Sequence
  chemically synthesized
gcactgattgcaacgtcaaaat

SEQ ID NO: 899785 - DNA, 22 bp, Artificial Sequence
  chemically synthesized
cactgattgcaacgtcaaaatg

SEQ ID NO: 899786 - DNA, 22 bp, Artificial Sequence
  chemically synthesized
attgcaacgtcaaaatgataca

SEQ ID NO: 899787 - DNA, 22 bp, Artificial Sequence
  chemically synthesized
caacgtcaaaatgatacaattt

SEQ ID NO: 899788 - DNA, 22 bp, Artificial Sequence
  chemically synthesized
acccagtgtatctaaaattgta

SEQ ID NO: 899789 - DNA, 22 bp, Artificial Sequence
  chemically synthesized
aacccagtgtatctaaaattgt

SEQ ID NO: 899790 - DNA, 22 bp, Artificial Sequence
  chemically synthesized
tttaacccagtgtatctaaaat

SEQ ID NO: 899791 - DNA, 22 bp, Artificial Sequence
  chemically synthesized
atttaacccagtgtatctaaaa

SEQ ID NO: 899792 - DNA, 22 bp, Artificial Sequence
  chemically synthesized
tatttaacccagtgtatctaaa

SEQ ID NO: 899793 - DNA, 22 bp, Artificial Sequence
  chemically synthesized
tatgttttatttaacccagtgt

SEQ ID NO: 899794 - DNA, 22 bp, Artificial Sequence
  chemically synthesized
gattatatgttttatttaaccc

SEQ ID NO: 899795 - DNA, 22 bp, Artificial Sequence
  chemically synthesized
ggattatatgttttatttaacc

SEQ ID NO: 899796 - DNA, 22 bp, Artificial Sequence
  chemically synthesized
tagatacactgggttaaataaa

SEQ ID NO: 899797 - DNA, 22 bp, Artificial Sequence
  chemically synthesized
agatacactgggttaaataaaa

SEQ ID NO: 899798 - DNA, 22 bp, Artificial Sequence
  chemically synthesized
gatacactgggttaaataaaac

SEQ ID NO: 899799 - DNA, 22 bp, Artificial Sequence
  chemically synthesized
tttggattatatgttttattta

SEQ ID NO: 899800 - DNA, 22 bp, Artificial Sequence
  chemically synthesized
atttggattatatgttttattt

SEQ ID NO: 899801 - DNA, 22 bp, Artificial Sequence
  chemically synthesized
ggttaaataaaacatataatcc

SEQ ID NO: 899802 - DNA, 22 bp, Artificial Sequence
  chemically synthesized
aataaaacatataatccaaata

SEQ ID NO: 899803 - DNA, 22 bp, Artificial Sequence
  chemically synthesized
aaatagtaaaaataaacaggtg

SEQ ID NO: 899804 - DNA, 22 bp, Artificial Sequence
  chemically synthesized
cacctgtttatttttactattt

SEQ ID NO: 899805 - DNA, 22 bp, Artificial Sequence
  chemically synthesized
atggccacattaaaatagtaaa

SEQ ID NO: 899806 - DNA, 22 bp, Artificial Sequence
  chemically synthesized
acctgtttatttttactatttt

SEQ ID NO: 899807 - DNA, 22 bp, Artificial Sequence
  chemically synthesized
aatggccacattaaaatagtaa

SEQ ID NO: 899808 - DNA, 22 bp, Artificial Sequence
  chemically synthesized
tttatttttactattttaatgt

SEQ ID NO: 899809 - DNA, 22 bp, Artificial Sequence
  chemically synthesized
atcttaatggccacattaaaat

SEQ ID NO: 899810 - DNA, 22 bp, Artificial Sequence
  chemically synthesized
aatcttaatggccacattaaaa

SEQ ID NO: 899811 - DNA, 22 bp, Artificial Sequence
  chemically synthesized
taatcttaatggccacattaaa

SEQ ID NO: 899812 - DNA, 22 bp, Artificial Sequence
  chemically synthesized
atttttactattttaatgtggc

SEQ ID NO: 899813 - DNA, 22 bp, Artificial Sequence
  chemically synthesized
tttttactattttaatgtggcc

SEQ ID NO: 899814 - DNA, 22 bp, Artificial Sequence
  chemically synthesized
ttttaatcttaatggccacatt

SEQ ID NO: 899815 - DNA, 22 bp, Artificial Sequence
  chemically synthesized
ttactattttaatgtggccatt

SEQ ID NO: 899816 - DNA, 22 bp, Artificial Sequence
  chemically synthesized
tactattttaatgtggccatta

SEQ ID NO: 899817 - DNA, 22 bp, Artificial Sequence
  chemically synthesized
actattttaatgtggccattaa

SEQ ID NO: 899818 - DNA, 22 bp, Artificial Sequence
  chemically synthesized
ctattttaatgtggccattaag

SEQ ID NO: 899819 - DNA, 22 bp, Artificial Sequence
  chemically synthesized
ttttaatgtggccattaagatt

SEQ ID NO: 899820 - DNA, 22 bp, Artificial Sequence
  chemically synthesized
taatgtggccattaagattaaa

SEQ ID NO: 899821 - DNA, 22 bp, Artificial Sequence
  chemically synthesized
aatgtggccattaagattaaaa

SEQ ID NO: 899822 - DNA, 22 bp, Artificial Sequence
  chemically synthesized
atgtggccattaagattaaaat

SEQ ID NO: 899823 - DNA, 22 bp, Artificial Sequence
  chemically synthesized
agattaaaataacatatgtggc

SEQ ID NO: 899824 - DNA, 22 bp, Artificial Sequence
  chemically synthesized
cagagcgtaatgtgagccacat

SEQ ID NO: 899825 - DNA, 22 bp, Artificial Sequence
  chemically synthesized
aaataacatatgtggctcacat

SEQ ID NO: 899826 - DNA, 22 bp, Artificial Sequence
  chemically synthesized
ttacagagcgtaatgtgagcca

SEQ ID NO: 899827 - DNA, 22 bp, Artificial Sequence
  chemically synthesized
cattattacagagcgtaatgtg

SEQ ID NO: 899828 - DNA, 22 bp, Artificial Sequence
  chemically synthesized
ttgcattattacagagcgtaat

SEQ ID NO: 899829 - DNA, 22 bp, Artificial Sequence
  chemically synthesized
ctattgcattattacagagcgt

SEQ ID NO: 899830 - DNA, 22 bp, Artificial Sequence
  chemically synthesized
acattacgctctgtaataatgc

SEQ ID NO: 899831 - DNA, 22 bp, Artificial Sequence
  chemically synthesized
cgctctgtaataatgcaatagc

SEQ ID NO: 899832 - DNA, 22 bp, Artificial Sequence
  chemically synthesized
tagaataaaagctgctattgca

SEQ ID NO: 899833 - DNA, 22 bp, Artificial Sequence
  chemically synthesized
ctatagaataaaagctgctatt

SEQ ID NO: 899834 - DNA, 22 bp, Artificial Sequence
  chemically synthesized
tgtaataatgcaatagcagctt

SEQ ID NO: 899835 - DNA, 22 bp, Artificial Sequence
  chemically synthesized
taataatgcaatagcagctttt

SEQ ID NO: 899836 - DNA, 22 bp, Artificial Sequence
  chemically synthesized
ctactatagaataaaagctgct

SEQ ID NO: 899837 - DNA, 22 bp, Artificial Sequence
  chemically synthesized
ttcctactatagaataaaagct

SEQ ID NO: 899838 - DNA, 22 bp, Artificial Sequence
  chemically synthesized
ctattcctactatagaataaaa

SEQ ID NO: 899839 - DNA, 22 bp, Artificial Sequence
  chemically synthesized
tgctattcctactatagaataa

SEQ ID NO: 899840 - DNA, 22 bp, Artificial Sequence
  chemically synthesized
ctgctattcctactatagaata

SEQ ID NO: 899841 - DNA, 22 bp, Artificial Sequence
  chemically synthesized
tctgctattcctactatagaat

SEQ ID NO: 899842 - DNA, 22 bp, Artificial Sequence
  chemically synthesized
ttctgctattcctactatagaa

SEQ ID NO: 899843 - DNA, 22 bp, Artificial Sequence
  chemically synthesized
atatttttctgctattcctact

SEQ ID NO: 899844 - DNA, 22 bp, Artificial Sequence
  chemically synthesized
aatatttttctgctattcctac

SEQ ID NO: 899845 - DNA, 22 bp, Artificial Sequence
  chemically synthesized
ttattctatagtaggaatagca

SEQ ID NO: 899846 - DNA, 22 bp, Artificial Sequence
  chemically synthesized
tattctatagtaggaatagcag

SEQ ID NO: 899847 - DNA, 22 bp, Artificial Sequence
  chemically synthesized
attctatagtaggaatagcaga

SEQ ID NO: 899848 - DNA, 22 bp, Artificial Sequence
  chemically synthesized
atttaatatttttctgctattc

SEQ ID NO: 899849 - DNA, 22 bp, Artificial Sequence
  chemically synthesized
ttctatagtaggaatagcagaa

SEQ ID NO: 899850 - DNA, 22 bp, Artificial Sequence
  chemically synthesized
catttaatatttttctgctatt

SEQ ID NO: 899851 - DNA, 22 bp, Artificial Sequence
  chemically synthesized
tcatttaatatttttctgctat

SEQ ID NO: 899852 - DNA, 22 bp, Artificial Sequence
  chemically synthesized
tatagtaggaatagcagaaaaa

SEQ ID NO: 899853 - DNA, 22 bp, Artificial Sequence
  chemically synthesized
tagtaggaatagcagaaaaata

SEQ ID NO: 899854 - DNA, 22 bp, Artificial Sequence
  chemically synthesized
tggatgatctttcatttaatat

SEQ ID NO: 899855 - DNA, 22 bp, Artificial Sequence
  chemically synthesized
acatctatggatgatctttcat

SEQ ID NO: 899856 - DNA, 22 bp, Artificial Sequence
  chemically synthesized
gacatctatggatgatctttca

SEQ ID NO: 899857 - DNA, 22 bp, Artificial Sequence
  chemically synthesized
tgacatctatggatgatctttc

SEQ ID NO: 899858 - DNA, 22 bp, Artificial Sequence
  chemically synthesized
ttgacatctatggatgatcttt

SEQ ID NO: 899859 - DNA, 22 bp, Artificial Sequence
  chemically synthesized
aatgaaagatcatccatagatg

SEQ ID NO: 899860 - DNA, 22 bp, Artificial Sequence
  chemically synthesized
acatgacttttgacatctatgg

SEQ ID NO: 899861 - DNA, 22 bp, Artificial Sequence
  chemically synthesized
aaactcacatgacttttgacat

SEQ ID NO: 899862 - DNA, 22 bp, Artificial Sequence
  chemically synthesized
gaagatatactaaaactcacat

SEQ ID NO: 899863 - DNA, 22 bp, Artificial Sequence
  chemically synthesized
agaagatatactaaaactcaca

SEQ ID NO: 899864 - DNA, 22 bp, Artificial Sequence
  chemically synthesized
aaataatcaacttagaagatat

SEQ ID NO: 899865 - DNA, 22 bp, Artificial Sequence
  chemically synthesized
ttaaaataatcaacttagaaga

SEQ ID NO: 899866 - DNA, 22 bp, Artificial Sequence
  chemically synthesized
attaaaataatcaacttagaag

SEQ ID NO: 899867 - DNA, 22 bp, Artificial Sequence
  chemically synthesized
tattaaaataatcaacttagaa

SEQ ID NO: 899868 - DNA, 22 bp, Artificial Sequence
  chemically synthesized
ttattaaaataatcaacttaga

SEQ ID NO: 899869 - DNA, 22 bp, Artificial Sequence
  chemically synthesized
tagtatatcttctaagttgatt

SEQ ID NO: 899870 - DNA, 22 bp, Artificial Sequence
  chemically synthesized
agtatatcttctaagttgatta

SEQ ID NO: 899871 - DNA, 22 bp, Artificial Sequence
  chemically synthesized
gtatatcttctaagttgattat

SEQ ID NO: 899872 - DNA, 22 bp, Artificial Sequence
  chemically synthesized
ccttttattaaaataatcaact

SEQ ID NO: 899873 - DNA, 22 bp, Artificial Sequence
  chemically synthesized
accttttattaaaataatcaac

SEQ ID NO: 899874 - DNA, 22 bp, Artificial Sequence
  chemically synthesized
ttaccttttattaaaataatca

SEQ ID NO: 899875 - DNA, 22 bp, Artificial Sequence
  chemically synthesized
cctcttaccttttattaaaata

SEQ ID NO: 899876 - DNA, 22 bp, Artificial Sequence
  chemically synthesized
acctcttaccttttattaaaat

SEQ ID NO: 899877 - DNA, 22 bp, Artificial Sequence
  chemically synthesized
ctaagttgattattttaataaa

SEQ ID NO: 899878 - DNA, 22 bp, Artificial Sequence
  chemically synthesized
tacctcttaccttttattaaaa

SEQ ID NO: 899879 - DNA, 22 bp, Artificial Sequence
  chemically synthesized
taagttgattattttaataaaa

SEQ ID NO: 899880 - DNA, 22 bp, Artificial Sequence
  chemically synthesized
tttacctcttaccttttattaa

SEQ ID NO: 899881 - DNA, 22 bp, Artificial Sequence
  chemically synthesized
agttgattattttaataaaagg

SEQ ID NO: 899882 - DNA, 22 bp, Artificial Sequence
  chemically synthesized
attattttaataaaaggtaaga

SEQ ID NO: 899883 - DNA, 22 bp, Artificial Sequence
  chemically synthesized
ttttaataaaaggtaagaggta

SEQ ID NO: 899884 - DNA, 22 bp, Artificial Sequence
  chemically synthesized
taataaaaggtaagaggtaaag

SEQ ID NO: 899885 - DNA, 22 bp, Artificial Sequence
  chemically synthesized
ataagaaaacctctttacctct

SEQ ID NO: 899886 - DNA, 22 bp, Artificial Sequence
  chemically synthesized
aataaaaggtaagaggtaaaga

SEQ ID NO: 899887 - DNA, 22 bp, Artificial Sequence
  chemically synthesized
ataaaaggtaagaggtaaagag

SEQ ID NO: 899888 - DNA, 22 bp, Artificial Sequence
  chemically synthesized
tgttaataagaaaacctcttta

SEQ ID NO: 899889 - DNA, 22 bp, Artificial Sequence
  chemically synthesized
atgttatgttaataagaaaacc

SEQ ID NO: 899890 - DNA, 22 bp, Artificial Sequence
  chemically synthesized
tcttattaacataacatcaatt

SEQ ID NO: 899891 - DNA, 22 bp, Artificial Sequence
  chemically synthesized
cttattaacataacatcaattt

SEQ ID NO: 899892 - DNA, 22 bp, Artificial Sequence
  chemically synthesized
ttattaacataacatcaatttt

SEQ ID NO: 899893 - DNA, 22 bp, Artificial Sequence
  chemically synthesized
gtgggggcaagaaaaattgatg

SEQ ID NO: 899894 - DNA, 22 bp, Artificial Sequence
  chemically synthesized
agtgggggcaagaaaaattgat

SEQ ID NO: 899895 - DNA, 22 bp, Artificial Sequence
  chemically synthesized
attaacataacatcaatttttc

SEQ ID NO: 899896 - DNA, 22 bp, Artificial Sequence
  chemically synthesized
ttaacataacatcaatttttct

SEQ ID NO: 899897 - DNA, 22 bp, Artificial Sequence
  chemically synthesized
tttagtgggggcaagaaaaatt

SEQ ID NO: 899898 - DNA, 22 bp, Artificial Sequence
  chemically synthesized
atttagtgggggcaagaaaaat

SEQ ID NO: 899899 - DNA, 22 bp, Artificial Sequence
  chemically synthesized
acataacatcaatttttcttgc

SEQ ID NO: 899900 - DNA, 22 bp, Artificial Sequence
  chemically synthesized
agcatttatttagtgggggcaa

SEQ ID NO: 899901 - DNA, 22 bp, Artificial Sequence
  chemically synthesized
ttcagcatttatttagtggggg

SEQ ID NO: 899902 - DNA, 22 bp, Artificial Sequence
  chemically synthesized
gttcagcatttatttagtgggg

SEQ ID NO: 899903 - DNA, 22 bp, Artificial Sequence
  chemically synthesized
ttcttgcccccactaaataaat

SEQ ID NO: 899904 - DNA, 22 bp, Artificial Sequence
  chemically synthesized
tcttgcccccactaaataaatg

SEQ ID NO: 899905 - DNA, 22 bp, Artificial Sequence
  chemically synthesized
cttgcccccactaaataaatgc

SEQ ID NO: 899906 - DNA, 22 bp, Artificial Sequence
  chemically synthesized
ttgcccccactaaataaatgct

SEQ ID NO: 899907 - DNA, 22 bp, Artificial Sequence
  chemically synthesized
aaatatttgttcagcatttatt

SEQ ID NO: 899908 - DNA, 22 bp, Artificial Sequence
  chemically synthesized
aaaatatttgttcagcatttat

SEQ ID NO: 899909 - DNA, 22 bp, Artificial Sequence
  chemically synthesized
gcccccactaaataaatgctga

SEQ ID NO: 899910 - DNA, 22 bp, Artificial Sequence
  chemically synthesized
cccccactaaataaatgctgaa

SEQ ID NO: 899911 - DNA, 22 bp, Artificial Sequence
  chemically synthesized
cttaaaatatttgttcagcatt

SEQ ID NO: 899912 - DNA, 22 bp, Artificial Sequence
  chemically synthesized
gcttaaaatatttgttcagcat

SEQ ID NO: 899913 - DNA, 22 bp, Artificial Sequence
  chemically synthesized
aataaatgctgaacaaatattt

SEQ ID NO: 899914 - DNA, 22 bp, Artificial Sequence
  chemically synthesized
atacgcttgcttaaaatatttg

SEQ ID NO: 899915 - DNA, 22 bp, Artificial Sequence
  chemically synthesized
catacgcttgcttaaaatattt

SEQ ID NO: 899916 - DNA, 22 bp, Artificial Sequence
  chemically synthesized
cttcatacgcttgcttaaaata

SEQ ID NO: 899917 - DNA, 22 bp, Artificial Sequence
  chemically synthesized
aacaaatattttaagcaagcgt

SEQ ID NO: 899918 - DNA, 22 bp, Artificial Sequence
  chemically synthesized
atgctccttcatacgcttgctt

SEQ ID NO: 899919 - DNA, 22 bp, Artificial Sequence
  chemically synthesized
gatgctccttcatacgcttgct

SEQ ID NO: 899920 - DNA, 22 bp, Artificial Sequence
  chemically synthesized
tttgatgctccttcatacgctt

SEQ ID NO: 899921 - DNA, 22 bp, Artificial Sequence
  chemically synthesized
ctatttgatgctccttcatacg

SEQ ID NO: 899922 - DNA, 22 bp, Artificial Sequence
  chemically synthesized
taagcaagcgtatgaaggagca

SEQ ID NO: 899923 - DNA, 22 bp, Artificial Sequence
  chemically synthesized
aagcaagcgtatgaaggagcat

SEQ ID NO: 899924 - DNA, 22 bp, Artificial Sequence
  chemically synthesized
agcaagcgtatgaaggagcatc

SEQ ID NO: 899925 - DNA, 22 bp, Artificial Sequence
  chemically synthesized
aagacaagctactatttgatgc

SEQ ID NO: 899926 - DNA, 22 bp, Artificial Sequence
  chemically synthesized
ttcaagacaagctactatttga

SEQ ID NO: 899927 - DNA, 22 bp, Artificial Sequence
  chemically synthesized
gttcaagacaagctactatttg

SEQ ID NO: 899928 - DNA, 22 bp, Artificial Sequence
  chemically synthesized
gggacaccttgttcaagacaag

SEQ ID NO: 899929 - DNA, 22 bp, Artificial Sequence
  chemically synthesized
ggaaacacactggggacacctt

SEQ ID NO: 899930 - DNA, 22 bp, Artificial Sequence
  chemically synthesized
gtcttgaacaaggtgtccccag

SEQ ID NO: 899931 - DNA, 22 bp, Artificial Sequence
  chemically synthesized
tcttgaacaaggtgtccccagt

SEQ ID NO: 899932 - DNA, 22 bp, Artificial Sequence
  chemically synthesized
gaacaaggtgtccccagtgtgt

SEQ ID NO: 899933 - DNA, 22 bp, Artificial Sequence
  chemically synthesized
aacaaggtgtccccagtgtgtt

SEQ ID NO: 899934 - DNA, 22 bp, Artificial Sequence
  chemically synthesized
aatgagtctaggaaacacactg

SEQ ID NO: 899935 - DNA, 22 bp, Artificial Sequence
  chemically synthesized
caatgagtctaggaaacacact

SEQ ID NO: 899936 - DNA, 22 bp, Artificial Sequence
  chemically synthesized
tcaatgagtctaggaaacacac

SEQ ID NO: 899937 - DNA, 22 bp, Artificial Sequence
  chemically synthesized
ttcaatgagtctaggaaacaca

SEQ ID NO: 899938 - DNA, 22 bp, Artificial Sequence
  chemically synthesized
ttttcaatgagtctaggaaaca

SEQ ID NO: 899939 - DNA, 22 bp, Artificial Sequence
  chemically synthesized
cttttcaatgagtctaggaaac

SEQ ID NO: 899940 - DNA, 22 bp, Artificial Sequence
  chemically synthesized
cttcttttcaatgagtctagga

SEQ ID NO: 899941 - DNA, 22 bp, Artificial Sequence
  chemically synthesized
cctagactcattgaaaagaagc

SEQ ID NO: 899942 - DNA, 22 bp, Artificial Sequence
  chemically synthesized
ctagactcattgaaaagaagca

SEQ ID NO: 899943 - DNA, 22 bp, Artificial Sequence
  chemically synthesized
acatacgtaaggttgcttcttt

SEQ ID NO: 899944 - DNA, 22 bp, Artificial Sequence
  chemically synthesized
gactcattgaaaagaagcaacc

SEQ ID NO: 899945 - DNA, 22 bp, Artificial Sequence
  chemically synthesized
attgaaaagaagcaaccttacg

SEQ ID NO: 899946 - DNA, 22 bp, Artificial Sequence
  chemically synthesized
aaaagaagcaaccttacgtatg

SEQ ID NO: 899947 - DNA, 22 bp, Artificial Sequence
  chemically synthesized
accacatgggattaacatacgt

SEQ ID NO: 899948 - DNA, 22 bp, Artificial Sequence
  chemically synthesized
acgtatgttaatcccatgtggt

SEQ ID NO: 899949 - DNA, 22 bp, Artificial Sequence
  chemically synthesized
cgtatgttaatcccatgtggtt

SEQ ID NO: 899950 - DNA, 22 bp, Artificial Sequence
  chemically synthesized
aacatggaggccagaaattaac

SEQ ID NO: 899951 - DNA, 22 bp, Artificial Sequence
  chemically synthesized
atcccatgtggttaatttctgg

SEQ ID NO: 899952 - DNA, 22 bp, Artificial Sequence
  chemically synthesized
atttctggcctccatgtttaat

SEQ ID NO: 899953 - DNA, 22 bp, Artificial Sequence
  chemically synthesized
gtatgagagatcaattaaacat

SEQ ID NO: 899954 - DNA, 22 bp, Artificial Sequence
  chemically synthesized
ctggcctccatgtttaattgat

SEQ ID NO: 899955 - DNA, 22 bp, Artificial Sequence
  chemically synthesized
tggcctccatgtttaattgatc

SEQ ID NO: 899956 - DNA, 22 bp, Artificial Sequence
  chemically synthesized
gcctccatgtttaattgatctc

SEQ ID NO: 899957 - DNA, 22 bp, Artificial Sequence
  chemically synthesized
gaggccctagtatgagagatca

SEQ ID NO: 899958 - DNA, 22 bp, Artificial Sequence
  chemically synthesized
catgtttaattgatctctcata

SEQ ID NO: 899959 - DNA, 22 bp, Artificial Sequence
  chemically synthesized
aattgatctctcatactagggc

SEQ ID NO: 899960 - DNA, 22 bp, Artificial Sequence
  chemically synthesized
attgatctctcatactagggcc

SEQ ID NO: 899961 - DNA, 22 bp, Artificial Sequence
  chemically synthesized
atctctcatactagggcctcta

SEQ ID NO: 899962 - DNA, 22 bp, Artificial Sequence
  chemically synthesized
gaggacggtggctagaggccct

SEQ ID NO: 899963 - DNA, 22 bp, Artificial Sequence
  chemically synthesized
ggaggacggtggctagaggccc

SEQ ID NO: 899964 - DNA, 22 bp, Artificial Sequence
  chemically synthesized
tcatactagggcctctagccac

SEQ ID NO: 899965 - DNA, 22 bp, Artificial Sequence
  chemically synthesized
atactagggcctctagccaccg

SEQ ID NO: 899966 - DNA, 22 bp, Artificial Sequence
  chemically synthesized
gggcctctagccaccgtcctcc

SEQ ID NO: 899967 - DNA, 22 bp, Artificial Sequence
  chemically synthesized
atgcacaaccttggaggacggt

SEQ ID NO: 899968 - DNA, 22 bp, Artificial Sequence
  chemically synthesized
catgcacaaccttggaggacgg

SEQ ID NO: 899969 - DNA, 22 bp, Artificial Sequence
  chemically synthesized
gtttcatgcacaaccttggagg

SEQ ID NO: 899970 - DNA, 22 bp, Artificial Sequence
  chemically synthesized
tagccaccgtcctccaaggttg

SEQ ID NO: 899971 - DNA, 22 bp, Artificial Sequence
  chemically synthesized
tggtttcatgcacaaccttgga

SEQ ID NO: 899972 - DNA, 22 bp, Artificial Sequence
  chemically synthesized
gccaccgtcctccaaggttgtg

SEQ ID NO: 899973 - DNA, 22 bp, Artificial Sequence
  chemically synthesized
tagggttctggtttcatgcaca

SEQ ID NO: 899974 - DNA, 22 bp, Artificial Sequence
  chemically synthesized
caaggttgtgcatgaaaccaga

SEQ ID NO: 899975 - DNA, 22 bp, Artificial Sequence
  chemically synthesized
agacaaaactgtagggttctgg

SEQ ID NO: 899976 - DNA, 22 bp, Artificial Sequence
  chemically synthesized
cagacaaaactgtagggttctg

SEQ ID NO: 899977 - DNA, 22 bp, Artificial Sequence
  chemically synthesized
tgcatgaaaccagaaccctaca

SEQ ID NO: 899978 - DNA, 22 bp, Artificial Sequence
  chemically synthesized
cagttttgtctgaagcacactg

SEQ ID NO: 899979 - DNA, 22 bp, Artificial Sequence
  chemically synthesized
tgtctgaagcacactgcttgtc

SEQ ID NO: 899980 - DNA, 22 bp, Artificial Sequence
  chemically synthesized
gtctgaagcacactgcttgtcc

SEQ ID NO: 899981 - DNA, 22 bp, Artificial Sequence
  chemically synthesized
tctgaagcacactgcttgtcct

SEQ ID NO: 899982 - DNA, 22 bp, Artificial Sequence
  chemically synthesized
ggggccaaaaatgtaggacaag

SEQ ID NO: 899983 - DNA, 22 bp, Artificial Sequence
  chemically synthesized
aagcacactgcttgtcctacat

SEQ ID NO: 899984 - DNA, 22 bp, Artificial Sequence
  chemically synthesized
cttgtcctacatttttggcccc

SEQ ID NO: 899985 - DNA, 22 bp, Artificial Sequence
  chemically synthesized
gtcctacatttttggcccccag

SEQ ID NO: 899986 - DNA, 22 bp, Artificial Sequence
  chemically synthesized
tcctacatttttggcccccagg

SEQ ID NO: 899987 - DNA, 22 bp, Artificial Sequence
  chemically synthesized
cgtgatatgcagcctgggggcc

SEQ ID NO: 899988 - DNA, 22 bp, Artificial Sequence
  chemically synthesized
catttttggcccccaggctgca

SEQ ID NO: 899989 - DNA, 22 bp, Artificial Sequence
  chemically synthesized
ttggcccccaggctgcatatca

SEQ ID NO: 899990 - DNA, 22 bp, Artificial Sequence
  chemically synthesized
tggcccccaggctgcatatcac

SEQ ID NO: 899991 - DNA, 22 bp, Artificial Sequence
  chemically synthesized
ggcccccaggctgcatatcacg

SEQ ID NO: 899992 - DNA, 22 bp, Artificial Sequence
  chemically synthesized
gcccccaggctgcatatcacgc

SEQ ID NO: 899993 - DNA, 22 bp, Artificial Sequence
  chemically synthesized
atgaaaaatagggttgcgtgat

SEQ ID NO: 899994 - DNA, 22 bp, Artificial Sequence
  chemically synthesized
catatcacgcaaccctattttt

SEQ ID NO: 899995 - DNA, 22 bp, Artificial Sequence
  chemically synthesized
agaccagaagttaatgaaaaat

SEQ ID NO: 899996 - DNA, 22 bp, Artificial Sequence
  chemically synthesized
cccctcagaccagaagttaatg

SEQ ID NO: 899997 - DNA, 22 bp, Artificial Sequence
  chemically synthesized
ccccctcagaccagaagttaat

SEQ ID NO: 899998 - DNA, 22 bp, Artificial Sequence
  chemically synthesized
tttttcattaacttctggtctg

SEQ ID NO: 899999 - DNA, 22 bp, Artificial Sequence
  chemically synthesized
agtaccttccccctcagaccag

SEQ ID NO: 900000 - DNA, 22 bp, Artificial Sequence
  chemically synthesized
ttcattaacttctggtctgagg

SEQ ID NO: 900001 - DNA, 22 bp, Artificial Sequence
  chemically synthesized
cagtaccttccccctcagacca

SEQ ID NO: 900002 - DNA, 22 bp, Artificial Sequence
  chemically synthesized
tcattaacttctggtctgaggg

SEQ ID NO: 900003 - DNA, 22 bp, Artificial Sequence
  chemically synthesized
tcagtaccttccccctcagacc

SEQ ID NO: 900004 - DNA, 22 bp, Artificial Sequence
  chemically synthesized
cattaacttctggtctgagggg

SEQ ID NO: 900005 - DNA, 22 bp, Artificial Sequence
  chemically synthesized
ttcagtaccttccccctcagac

SEQ ID NO: 900006 - DNA, 22 bp, Artificial Sequence
  chemically synthesized
attaacttctggtctgaggggg

SEQ ID NO: 900007 - DNA, 22 bp, Artificial Sequence
  chemically synthesized
tttcagtaccttccccctcaga

SEQ ID NO: 900008 - DNA, 22 bp, Artificial Sequence
  chemically synthesized
ttttcagtaccttccccctcag

SEQ ID NO: 900009 - DNA, 22 bp, Artificial Sequence
  chemically synthesized
acttctggtctgagggggaagg

SEQ ID NO: 900010 - DNA, 22 bp, Artificial Sequence
  chemically synthesized
cttttttcagtaccttccccct

SEQ ID NO: 900011 - DNA, 22 bp, Artificial Sequence
  chemically synthesized
ccttttttcagtaccttccccc

SEQ ID NO: 900012 - DNA, 22 bp, Artificial Sequence
  chemically synthesized
ttccttttttcagtaccttccc

SEQ ID NO: 900013 - DNA, 22 bp, Artificial Sequence
  chemically synthesized
ctggtctgagggggaaggtact

SEQ ID NO: 900014 - DNA, 22 bp, Artificial Sequence
  chemically synthesized
tggtctgagggggaaggtactg

SEQ ID NO: 900015 - DNA, 22 bp, Artificial Sequence
  chemically synthesized
gtctgagggggaaggtactgaa

SEQ ID NO: 900016 - DNA, 22 bp, Artificial Sequence
  chemically synthesized
agggggaaggtactgaaaaaag

SEQ ID NO: 900017 - DNA, 22 bp, Artificial Sequence
  chemically synthesized
aagtacagctcttccttttttc

SEQ ID NO: 900018 - DNA, 22 bp, Artificial Sequence
  chemically synthesized
ttcaagtacagctcttcctttt

SEQ ID NO: 900019 - DNA, 22 bp, Artificial Sequence
  chemically synthesized
aaaaaaggaagagctgtacttg

SEQ ID NO: 900020 - DNA, 22 bp, Artificial Sequence
  chemically synthesized
tgtgacagtaacattattcaag

SEQ ID NO: 900021 - DNA, 22 bp, Artificial Sequence
  chemically synthesized
gtgtgacagtaacattattcaa

SEQ ID NO: 900022 - DNA, 22 bp, Artificial Sequence
  chemically synthesized
tgtgtgacagtaacattattca

SEQ ID NO: 900023 - DNA, 22 bp, Artificial Sequence
  chemically synthesized
ttgtgtgacagtaacattattc

SEQ ID NO: 900024 - DNA, 22 bp, Artificial Sequence
  chemically synthesized
tttgtgtgacagtaacattatt

SEQ ID NO: 900025 - DNA, 22 bp, Artificial Sequence
  chemically synthesized
ttttgtgtgacagtaacattat

SEQ ID NO: 900026 - DNA, 22 bp, Artificial Sequence
  chemically synthesized
tttttgtgtgacagtaacatta

SEQ ID NO: 900027 - DNA, 22 bp, Artificial Sequence
  chemically synthesized
tacttgaataatgttactgtca

SEQ ID NO: 900028 - DNA, 22 bp, Artificial Sequence
  chemically synthesized
ccctttttttgtgtgacagtaa

SEQ ID NO: 900029 - DNA, 22 bp, Artificial Sequence
  chemically synthesized
cccctttttttgtgtgacagta

SEQ ID NO: 900030 - DNA, 22 bp, Artificial Sequence
  chemically synthesized
tcccctttttttgtgtgacagt

SEQ ID NO: 900031 - DNA, 22 bp, Artificial Sequence
  chemically synthesized
gaataatgttactgtcacacaa

SEQ ID NO: 900032 - DNA, 22 bp, Artificial Sequence
  chemically synthesized
aataatgttactgtcacacaaa

SEQ ID NO: 900033 - DNA, 22 bp, Artificial Sequence
  chemically synthesized
cctttcccctttttttgtgtga

SEQ ID NO: 900034 - DNA, 22 bp, Artificial Sequence
  chemically synthesized
cctccctttcccctttttttgt

SEQ ID NO: 900035 - DNA, 22 bp, Artificial Sequence
  chemically synthesized
cctccctccctttccccttttt

SEQ ID NO: 900036 - DNA, 22 bp, Artificial Sequence
  chemically synthesized
ctgtcacacaaaaaaaggggaa

SEQ ID NO: 900037 - DNA, 22 bp, Artificial Sequence
  chemically synthesized
tcacacaaaaaaaggggaaagg

SEQ ID NO: 900038 - DNA, 22 bp, Artificial Sequence
  chemically synthesized
cctccctccctccctttcccct

SEQ ID NO: 900039 - DNA, 22 bp, Artificial Sequence
  chemically synthesized
ccctccctccctccctttcccc

SEQ ID NO: 900040 - DNA, 22 bp, Artificial Sequence
  chemically synthesized
tccctccctccctccctttccc

SEQ ID NO: 900041 - DNA, 22 bp, Artificial Sequence
  chemically synthesized
ttccctccctccctccctttcc

SEQ ID NO: 900042 - DNA, 22 bp, Artificial Sequence
  chemically synthesized
agacccgggaatggaggccagg

SEQ ID NO: 900043 - DNA, 22 bp, Artificial Sequence
  chemically synthesized
atctgagacccgggaatggagg

SEQ ID NO: 900044 - DNA, 22 bp, Artificial Sequence
  chemically synthesized
gcctccattcccgggtctcaga

SEQ ID NO: 900045 - DNA, 22 bp, Artificial Sequence
  chemically synthesized
ccaccaggcatcctcatctgag

SEQ ID NO: 900046 - DNA, 22 bp, Artificial Sequence
  chemically synthesized
cattcccgggtctcagatgagg

SEQ ID NO: 900047 - DNA, 22 bp, Artificial Sequence
  chemically synthesized
ccgggtctcagatgaggatgcc

SEQ ID NO: 900048 - DNA, 22 bp, Artificial Sequence
  chemically synthesized
caagggaaactaccaccaggca

SEQ ID NO: 900049 - DNA, 22 bp, Artificial Sequence
  chemically synthesized
agatgaggatgcctggtggtag

SEQ ID NO: 900050 - DNA, 22 bp, Artificial Sequence
  chemically synthesized
ctacaagggaaactaccaccag

SEQ ID NO: 900051 - DNA, 22 bp, Artificial Sequence
  chemically synthesized
tccctcctacaagggaaactac

SEQ ID NO: 900052 - DNA, 22 bp, Artificial Sequence
  chemically synthesized
cctatccctcctacaagggaaa

SEQ ID NO: 900053 - DNA, 22 bp, Artificial Sequence
  chemically synthesized
gtggtagtttcccttgtaggag

SEQ ID NO: 900054 - DNA, 22 bp, Artificial Sequence
  chemically synthesized
ccctgcctatccctcctacaag

SEQ ID NO: 900055 - DNA, 22 bp, Artificial Sequence
  chemically synthesized
attaccctgcctatccctccta

SEQ ID NO: 900056 - DNA, 22 bp, Artificial Sequence
  chemically synthesized
gattaccctgcctatccctcct

SEQ ID NO: 900057 - DNA, 22 bp, Artificial Sequence
  chemically synthesized
ccttgattaccctgcctatccc

SEQ ID NO: 900058 - DNA, 22 bp, Artificial Sequence
  chemically synthesized
cccttgtaggagggataggcag

SEQ ID NO: 900059 - DNA, 22 bp, Artificial Sequence
  chemically synthesized
cccttgattaccctgcctatcc

SEQ ID NO: 900060 - DNA, 22 bp, Artificial Sequence
  chemically synthesized
ccttgtaggagggataggcagg

SEQ ID NO: 900061 - DNA, 22 bp, Artificial Sequence
  chemically synthesized
cttcccttgattaccctgccta

SEQ ID NO: 900062 - DNA, 22 bp, Artificial Sequence
  chemically synthesized
ccttcccttgattaccctgcct

SEQ ID NO: 900063 - DNA, 22 bp, Artificial Sequence
  chemically synthesized
gtaggagggataggcagggtaa

SEQ ID NO: 900064 - DNA, 22 bp, Artificial Sequence
  chemically synthesized
tccttcccttgattaccctgcc

SEQ ID NO: 900065 - DNA, 22 bp, Artificial Sequence
  chemically synthesized
taggagggataggcagggtaat

SEQ ID NO: 900066 - DNA, 22 bp, Artificial Sequence
  chemically synthesized
tttccttcccttgattaccctg

SEQ ID NO: 900067 - DNA, 22 bp, Artificial Sequence
  chemically synthesized
tctttccttcccttgattaccc

SEQ ID NO: 900068 - DNA, 22 bp, Artificial Sequence
  chemically synthesized
tctctttccttcccttgattac

SEQ ID NO: 900069 - DNA, 22 bp, Artificial Sequence
  chemically synthesized
tctctctttccttcccttgatt

SEQ ID NO: 900070 - DNA, 22 bp, Artificial Sequence
  chemically synthesized
gccacatgcctctctctctttc

SEQ ID NO: 900071 - DNA, 22 bp, Artificial Sequence
  chemically synthesized
cgccacatgcctctctctcttt

SEQ ID NO: 900072 - DNA, 22 bp, Artificial Sequence
  chemically synthesized
tcgccacatgcctctctctctt

SEQ ID NO: 900073 - DNA, 22 bp, Artificial Sequence
  chemically synthesized
ttcgccacatgcctctctctct

SEQ ID NO: 900074 - DNA, 22 bp, Artificial Sequence
  chemically synthesized
tttcgccacatgcctctctctc

SEQ ID NO: 900075 - DNA, 22 bp, Artificial Sequence
  chemically synthesized
cctttttcgccacatgcctctc

SEQ ID NO: 900076 - DNA, 22 bp, Artificial Sequence
  chemically synthesized
ccctttttcgccacatgcctct

SEQ ID NO: 900077 - DNA, 22 bp, Artificial Sequence
  chemically synthesized
acttccctttttcgccacatgc

SEQ ID NO: 900078 - DNA, 22 bp, Artificial Sequence
  chemically synthesized
tcacttccctttttcgccacat

SEQ ID NO: 900079 - DNA, 22 bp, Artificial Sequence
  chemically synthesized
aactctcacttccctttttcgc

SEQ ID NO: 900080 - DNA, 22 bp, Artificial Sequence
  chemically synthesized
gtgtaatccctcaactctcact

SEQ ID NO: 900081 - DNA, 22 bp, Artificial Sequence
  chemically synthesized
catgcagcactagtgtaatccc

SEQ ID NO: 900082 - DNA, 22 bp, Artificial Sequence
  chemically synthesized
ccctgcatgcagcactagtgta

SEQ ID NO: 900083 - DNA, 22 bp, Artificial Sequence
  chemically synthesized
cccctgcatgcagcactagtgt

SEQ ID NO: 900084 - DNA, 22 bp, Artificial Sequence
  chemically synthesized
agggattacactagtgctgcat

SEQ ID NO: 900085 - DNA, 22 bp, Artificial Sequence
  chemically synthesized
tcccttcccctgcatgcagcac

SEQ ID NO: 900086 - DNA, 22 bp, Artificial Sequence
  chemically synthesized
ctgtcccttcccctgcatgcag

SEQ ID NO: 900087 - DNA, 22 bp, Artificial Sequence
  chemically synthesized
cactagtgctgcatgcagggga

SEQ ID NO: 900088 - DNA, 22 bp, Artificial Sequence
  chemically synthesized
gttactgtcccttcccctgcat

SEQ ID NO: 900089 - DNA, 22 bp, Artificial Sequence
  chemically synthesized
ttagttactgtcccttcccctg

SEQ ID NO: 900090 - DNA, 22 bp, Artificial Sequence
  chemically synthesized
gtgctgcatgcaggggaaggga

SEQ ID NO: 900091 - DNA, 22 bp, Artificial Sequence
  chemically synthesized
tgttagttactgtcccttcccc

SEQ ID NO: 900092 - DNA, 22 bp, Artificial Sequence
  chemically synthesized
catgcaggggaagggacagtaa

SEQ ID NO: 900093 - DNA, 22 bp, Artificial Sequence
  chemically synthesized
caaacctctgttagttactgtc

SEQ ID NO: 900094 - DNA, 22 bp, Artificial Sequence
  chemically synthesized
ccaaacctctgttagttactgt

SEQ ID NO: 900095 - DNA, 22 bp, Artificial Sequence
  chemically synthesized
acttccaaacctctgttagtta

SEQ ID NO: 900096 - DNA, 22 bp, Artificial Sequence
  chemically synthesized
cctgacttccaaacctctgtta

SEQ ID NO: 900097 - DNA, 22 bp, Artificial Sequence
  chemically synthesized
gaagtcaggttgcctgacttcc

SEQ ID NO: 900098 - DNA, 22 bp, Artificial Sequence
  chemically synthesized
acagaggtttggaagtcaggca

SEQ ID NO: 900099 - DNA, 22 bp, Artificial Sequence
  chemically synthesized
ggaagtcaggcaacctgacttc

SEQ ID NO: 900100 - DNA, 22 bp, Artificial Sequence
  chemically synthesized
gaagtcaggcaacctgacttct

SEQ ID NO: 900101 - DNA, 22 bp, Artificial Sequence
  chemically synthesized
taagtagcggtagaggtggtat

SEQ ID NO: 900102 - DNA, 22 bp, Artificial Sequence
  chemically synthesized
tataagtagcggtagaggtggt

SEQ ID NO: 900103 - DNA, 22 bp, Artificial Sequence
  chemically synthesized
acttctaataccacctctaccg

SEQ ID NO: 900104 - DNA, 22 bp, Artificial Sequence
  chemically synthesized
ggattctataagtagcggtaga

SEQ ID NO: 900105 - DNA, 22 bp, Artificial Sequence
  chemically synthesized
ctaataccacctctaccgctac

SEQ ID NO: 900106 - DNA, 22 bp, Artificial Sequence
  chemically synthesized
taataccacctctaccgctact

SEQ ID NO: 900107 - DNA, 22 bp, Artificial Sequence
  chemically synthesized
ataccacctctaccgctactta

SEQ ID NO: 900108 - DNA, 22 bp, Artificial Sequence
  chemically synthesized
agggaaggccctcggattctat

SEQ ID NO: 900109 - DNA, 22 bp, Artificial Sequence
  chemically synthesized
taccgctacttatagaatccga

SEQ ID NO: 900110 - DNA, 22 bp, Artificial Sequence
  chemically synthesized
ccgctacttatagaatccgagg

SEQ ID NO: 900111 - DNA, 22 bp, Artificial Sequence
  chemically synthesized
cttatagaatccgagggccttc

SEQ ID NO: 900112 - DNA, 22 bp, Artificial Sequence
  chemically synthesized
caaggatactcagggaaggccc

SEQ ID NO: 900113 - DNA, 22 bp, Artificial Sequence
  chemically synthesized
atagaatccgagggccttccct

SEQ ID NO: 900114 - DNA, 22 bp, Artificial Sequence
  chemically synthesized
tagaatccgagggccttccctg

SEQ ID NO: 900115 - DNA, 22 bp, Artificial Sequence
  chemically synthesized
agttccaaggatactcagggaa

SEQ ID NO: 900116 - DNA, 22 bp, Artificial Sequence
  chemically synthesized
cagttccaaggatactcaggga

SEQ ID NO: 900117 - DNA, 22 bp, Artificial Sequence
  chemically synthesized
tcagttccaaggatactcaggg

SEQ ID NO: 900118 - DNA, 22 bp, Artificial Sequence
  chemically synthesized
ttcagttccaaggatactcagg

SEQ ID NO: 900119 - DNA, 22 bp, Artificial Sequence
  chemically synthesized
catttttcagttccaaggatac

SEQ ID NO: 900120 - DNA, 22 bp, Artificial Sequence
  chemically synthesized
ccctgagtatccttggaactga

SEQ ID NO: 900121 - DNA, 22 bp, Artificial Sequence
  chemically synthesized
cctgagtatccttggaactgaa

SEQ ID NO: 900122 - DNA, 22 bp, Artificial Sequence
  chemically synthesized
agtatccttggaactgaaaaat

SEQ ID NO: 900123 - DNA, 22 bp, Artificial Sequence
  chemically synthesized
atcaaatgtctgcatttttcag

SEQ ID NO: 900124 - DNA, 22 bp, Artificial Sequence
  chemically synthesized
atctgatcaaatgtctgcattt

SEQ ID NO: 900125 - DNA, 22 bp, Artificial Sequence
  chemically synthesized
ggaactgaaaaatgcagacatt

SEQ ID NO: 900126 - DNA, 22 bp, Artificial Sequence
  chemically synthesized
gaactgaaaaatgcagacattt

SEQ ID NO: 900127 - DNA, 22 bp, Artificial Sequence
  chemically synthesized
agaattaatctgatcaaatgtc

SEQ ID NO: 900128 - DNA, 22 bp, Artificial Sequence
  chemically synthesized
aaaaatgcagacatttgatcag

SEQ ID NO: 900129 - DNA, 22 bp, Artificial Sequence
  chemically synthesized
gaagggacctcagaattaatct

SEQ ID NO: 900130 - DNA, 22 bp, Artificial Sequence
  chemically synthesized
gatcagattaattctgaggtcc

SEQ ID NO: 900131 - DNA, 22 bp, Artificial Sequence
  chemically synthesized
atcagattaattctgaggtccc

SEQ ID NO: 900132 - DNA, 22 bp, Artificial Sequence
  chemically synthesized
tggaacagtcaagctagaaggg

SEQ ID NO: 900133 - DNA, 22 bp, Artificial Sequence
  chemically synthesized
gtggaacagtcaagctagaagg

SEQ ID NO: 900134 - DNA, 22 bp, Artificial Sequence
  chemically synthesized
attctgaggtcccttctagctt

SEQ ID NO: 900135 - DNA, 22 bp, Artificial Sequence
  chemically synthesized
tgaggtcccttctagcttgact

SEQ ID NO: 900136 - DNA, 22 bp, Artificial Sequence
  chemically synthesized
aggtcccttctagcttgactgt

SEQ ID NO: 900137 - DNA, 22 bp, Artificial Sequence
  chemically synthesized
ctagcttgactgttccacaaac

SEQ ID NO: 900138 - DNA, 22 bp, Artificial Sequence
  chemically synthesized
tagcttgactgttccacaaaca

SEQ ID NO: 900139 - DNA, 22 bp, Artificial Sequence
  chemically synthesized
ccagagacaaaatgtttgtgga

SEQ ID NO: 900140 - DNA, 22 bp, Artificial Sequence
  chemically synthesized
gcttgactgttccacaaacatt

SEQ ID NO: 900141 - DNA, 22 bp, Artificial Sequence
  chemically synthesized
cctgccagagacaaaatgtttg

SEQ ID NO: 900142 - DNA, 22 bp, Artificial Sequence
  chemically synthesized
gactgttccacaaacattttgt

SEQ ID NO: 900143 - DNA, 22 bp, Artificial Sequence
  chemically synthesized
actgttccacaaacattttgtc

SEQ ID NO: 900144 - DNA, 22 bp, Artificial Sequence
  chemically synthesized
cattccctgccagagacaaaat

SEQ ID NO: 900145 - DNA, 22 bp, Artificial Sequence
  chemically synthesized
ttccacaaacattttgtctctg

SEQ ID NO: 900146 - DNA, 22 bp, Artificial Sequence
  chemically synthesized
ctccattccctgccagagacaa

SEQ ID NO: 900147 - DNA, 22 bp, Artificial Sequence
  chemically synthesized
cacaaacattttgtctctggca

SEQ ID NO: 900148 - DNA, 22 bp, Artificial Sequence
  chemically synthesized
tgtatactcctccattccctgc

SEQ ID NO: 900149 - DNA, 22 bp, Artificial Sequence
  chemically synthesized
tgtctctggcagggaatggagg

SEQ ID NO: 900150 - DNA, 22 bp, Artificial Sequence
  chemically synthesized
gtctctggcagggaatggagga

SEQ ID NO: 900151 - DNA, 22 bp, Artificial Sequence
  chemically synthesized
tctctggcagggaatggaggag

SEQ ID NO: 900152 - DNA, 22 bp, Artificial Sequence
  chemically synthesized
agggctgtgtatactcctccat

SEQ ID NO: 900153 - DNA, 22 bp, Artificial Sequence
  chemically synthesized
tggcagggaatggaggagtata

SEQ ID NO: 900154 - DNA, 22 bp, Artificial Sequence
  chemically synthesized
gcagggaatggaggagtataca

SEQ ID NO: 900155 - DNA, 22 bp, Artificial Sequence
  chemically synthesized
agtgacacgttcagggctgtgt

SEQ ID NO: 900156 - DNA, 22 bp, Artificial Sequence
  chemically synthesized
aagctcagtgacacgttcaggg

SEQ ID NO: 900157 - DNA, 22 bp, Artificial Sequence
  chemically synthesized
gaagctcagtgacacgttcagg

SEQ ID NO: 900158 - DNA, 22 bp, Artificial Sequence
  chemically synthesized
ttgaagctcagtgacacgttca

SEQ ID NO: 900159 - DNA, 22 bp, Artificial Sequence
  chemically synthesized
cttgaagctcagtgacacgttc

SEQ ID NO: 900160 - DNA, 22 bp, Artificial Sequence
  chemically synthesized
tcttcttgaagctcagtgacac

SEQ ID NO: 900161 - DNA, 22 bp, Artificial Sequence
  chemically synthesized
gtcttcttgaagctcagtgaca

SEQ ID NO: 900162 - DNA, 22 bp, Artificial Sequence
  chemically synthesized
tgtcttcttgaagctcagtgac

SEQ ID NO: 900163 - DNA, 22 bp, Artificial Sequence
  chemically synthesized
aacgtgtcactgagcttcaaga

SEQ ID NO: 900164 - DNA, 22 bp, Artificial Sequence
  chemically synthesized
agcttcaagaagacaaagactg

SEQ ID NO: 900165 - DNA, 22 bp, Artificial Sequence
  chemically synthesized
caagaagacaaagactgtgtct

SEQ ID NO: 900166 - DNA, 22 bp, Artificial Sequence
  chemically synthesized
aagaagacaaagactgtgtctg

SEQ ID NO: 900167 - DNA, 22 bp, Artificial Sequence
  chemically synthesized
acaggcatccaggtgtcaggca

SEQ ID NO: 900168 - DNA, 22 bp, Artificial Sequence
  chemically synthesized
tgttcacaggcatccaggtgtc

SEQ ID NO: 900169 - DNA, 22 bp, Artificial Sequence
  chemically synthesized
gtgttcacaggcatccaggtgt

SEQ ID NO: 900170 - DNA, 22 bp, Artificial Sequence
  chemically synthesized
tgtgttcacaggcatccaggtg

SEQ ID NO: 900171 - DNA, 22 bp, Artificial Sequence
  chemically synthesized
tgtctgcctgacacctggatgc

SEQ ID NO: 900172 - DNA, 22 bp, Artificial Sequence
  chemically synthesized
ttgtgttcacaggcatccaggt

SEQ ID NO: 900173 - DNA, 22 bp, Artificial Sequence
  chemically synthesized
cctgacacctggatgcctgtga

SEQ ID NO: 900174 - DNA, 22 bp, Artificial Sequence
  chemically synthesized
acacctggatgcctgtgaacac

SEQ ID NO: 900175 - DNA, 22 bp, Artificial Sequence
  chemically synthesized
agagaagatcttttgtgttcac

SEQ ID NO: 900176 - DNA, 22 bp, Artificial Sequence
  chemically synthesized
gatgcctgtgaacacaaaagat

SEQ ID NO: 900177 - DNA, 22 bp, Artificial Sequence
  chemically synthesized
tgaacacaaaagatcttctctg

SEQ ID NO: 900178 - DNA, 22 bp, Artificial Sequence
  chemically synthesized
ccaataaaccctcagagaagat

SEQ ID NO: 900179 - DNA, 22 bp, Artificial Sequence
  chemically synthesized
tgtcacaagctcccaataaacc

SEQ ID NO: 900180 - DNA, 22 bp, Artificial Sequence
  chemically synthesized
ctctgagggtttattgggagct

SEQ ID NO: 900181 - DNA, 22 bp, Artificial Sequence
  chemically synthesized
tctgagggtttattgggagctt

SEQ ID NO: 900182 - DNA, 22 bp, Artificial Sequence
  chemically synthesized
ggcctatgtcacaagctcccaa

SEQ ID NO: 900183 - DNA, 22 bp, Artificial Sequence
  chemically synthesized
aggcctatgtcacaagctccca

SEQ ID NO: 900184 - DNA, 22 bp, Artificial Sequence
  chemically synthesized
tgagggtttattgggagcttgt

SEQ ID NO: 900185 - DNA, 22 bp, Artificial Sequence
  chemically synthesized
taggcctatgtcacaagctccc

SEQ ID NO: 900186 - DNA, 22 bp, Artificial Sequence
  chemically synthesized
agggtttattgggagcttgtga

SEQ ID NO: 900187 - DNA, 22 bp, Artificial Sequence
  chemically synthesized
cacattttaggcctatgtcaca

SEQ ID NO: 900188 - DNA, 22 bp, Artificial Sequence
  chemically synthesized
ccacattttaggcctatgtcac

SEQ ID NO: 900189 - DNA, 22 bp, Artificial Sequence
  chemically synthesized
attgggagcttgtgacataggc

SEQ ID NO: 900190 - DNA, 22 bp, Artificial Sequence
  chemically synthesized
tccacattttaggcctatgtca

SEQ ID NO: 900191 - DNA, 22 bp, Artificial Sequence
  chemically synthesized
ttgggagcttgtgacataggcc

SEQ ID NO: 900192 - DNA, 22 bp, Artificial Sequence
  chemically synthesized
ggagcttgtgacataggcctaa

SEQ ID NO: 900193 - DNA, 22 bp, Artificial Sequence
  chemically synthesized
gtgacataggcctaaaatgtgg

SEQ ID NO: 900194 - DNA, 22 bp, Artificial Sequence
  chemically synthesized
tcacaggattttccacatttta

SEQ ID NO: 900195 - DNA, 22 bp, Artificial Sequence
  chemically synthesized
tgacataggcctaaaatgtgga

SEQ ID NO: 900196 - DNA, 22 bp, Artificial Sequence
  chemically synthesized
ttgtcacaggattttccacatt

SEQ ID NO: 900197 - DNA, 22 bp, Artificial Sequence
  chemically synthesized
aaatgtggaaaatcctgtgaca

SEQ ID NO: 900198 - DNA, 22 bp, Artificial Sequence
  chemically synthesized
gggtgacagggtatcctgttgt

SEQ ID NO: 900199 - DNA, 22 bp, Artificial Sequence
  chemically synthesized
agggtgacagggtatcctgttg

SEQ ID NO: 900200 - DNA, 22 bp, Artificial Sequence
  chemically synthesized
cttagggtgacagggtatcctg

SEQ ID NO: 900201 - DNA, 22 bp, Artificial Sequence
  chemically synthesized
tgacaacaggataccctgtcac

SEQ ID NO: 900202 - DNA, 22 bp, Artificial Sequence
  chemically synthesized
catctgcttagggtgacagggt

SEQ ID NO: 900203 - DNA, 22 bp, Artificial Sequence
  chemically synthesized
acatctgcttagggtgacaggg

SEQ ID NO: 900204 - DNA, 22 bp, Artificial Sequence
  chemically synthesized
agcttacatctgcttagggtga

SEQ ID NO: 900205 - DNA, 22 bp, Artificial Sequence
  chemically synthesized
tcaccctaagcagatgtaagct

SEQ ID NO: 900206 - DNA, 22 bp, Artificial Sequence
  chemically synthesized
tgaagaaaattaagcttacatc

SEQ ID NO: 900207 - DNA, 22 bp, Artificial Sequence
  chemically synthesized
ctgtgaagaaaattaagcttac

SEQ ID NO: 900208 - DNA, 22 bp, Artificial Sequence
  chemically synthesized
gctgtgaagaaaattaagctta

SEQ ID NO: 900209 - DNA, 22 bp, Artificial Sequence
  chemically synthesized
agcagatgtaagcttaattttc

SEQ ID NO: 900210 - DNA, 22 bp, Artificial Sequence
  chemically synthesized
tcttgctgtgaagaaaattaag

SEQ ID NO: 900211 - DNA, 22 bp, Artificial Sequence
  chemically synthesized
attatcttgctgtgaagaaaat

SEQ ID NO: 900212 - DNA, 22 bp, Artificial Sequence
  chemically synthesized
ctcattatcttgctgtgaagaa

SEQ ID NO: 900213 - DNA, 22 bp, Artificial Sequence
  chemically synthesized
ttgctcattatcttgctgtgaa

SEQ ID NO: 900214 - DNA, 22 bp, Artificial Sequence
  chemically synthesized
tattgctcattatcttgctgtg

SEQ ID NO: 900215 - DNA, 22 bp, Artificial Sequence
  chemically synthesized
aattttcttcacagcaagataa

SEQ ID NO: 900216 - DNA, 22 bp, Artificial Sequence
  chemically synthesized
ttctattgctcattatcttgct

SEQ ID NO: 900217 - DNA, 22 bp, Artificial Sequence
  chemically synthesized
attttcttcacagcaagataat

SEQ ID NO: 900218 - DNA, 22 bp, Artificial Sequence
  chemically synthesized
tattctattgctcattatcttg

SEQ ID NO: 900219 - DNA, 22 bp, Artificial Sequence
  chemically synthesized
tcttcacagcaagataatgagc

SEQ ID NO: 900220 - DNA, 22 bp, Artificial Sequence
  chemically synthesized
cttcacagcaagataatgagca

SEQ ID NO: 900221 - DNA, 22 bp, Artificial Sequence
  chemically synthesized
ttcacagcaagataatgagcaa

SEQ ID NO: 900222 - DNA, 22 bp, Artificial Sequence
  chemically synthesized
ggttctattctattgctcatta

SEQ ID NO: 900223 - DNA, 22 bp, Artificial Sequence
  chemically synthesized
cacagcaagataatgagcaata

SEQ ID NO: 900224 - DNA, 22 bp, Artificial Sequence
  chemically synthesized
acagcaagataatgagcaatag

SEQ ID NO: 900225 - DNA, 22 bp, Artificial Sequence
  chemically synthesized
ttaggttctattctattgctca

SEQ ID NO: 900226 - DNA, 22 bp, Artificial Sequence
  chemically synthesized
gttaggttctattctattgctc

SEQ ID NO: 900227 - DNA, 22 bp, Artificial Sequence
  chemically synthesized
tgttaggttctattctattgct

SEQ ID NO: 900228 - DNA, 22 bp, Artificial Sequence
  chemically synthesized
ctttgttaggttctattctatt

SEQ ID NO: 900229 - DNA, 22 bp, Artificial Sequence
  chemically synthesized
atccaaaattgctttgttaggt

SEQ ID NO: 900230 - DNA, 22 bp, Artificial Sequence
  chemically synthesized
agccctcatccaaaattgcttt

SEQ ID NO: 900231 - DNA, 22 bp, Artificial Sequence
  chemically synthesized
tgttaagccctcatccaaaatt

SEQ ID NO: 900232 - DNA, 22 bp, Artificial Sequence
  chemically synthesized
attgtgttaagccctcatccaa

SEQ ID NO: 900233 - DNA, 22 bp, Artificial Sequence
  chemically synthesized
acaaagcaattttggatgaggg

SEQ ID NO: 900234 - DNA, 22 bp, Artificial Sequence
  chemically synthesized
tggatgagggcttaacacaatc

SEQ ID NO: 900235 - DNA, 22 bp, Artificial Sequence
  chemically synthesized
ggatgagggcttaacacaatca

SEQ ID NO: 900236 - DNA, 22 bp, Artificial Sequence
  chemically synthesized
gatgagggcttaacacaatcaa

SEQ ID NO: 900237 - DNA, 22 bp, Artificial Sequence
  chemically synthesized
gaacaccatggcagttgattgt

SEQ ID NO: 900238 - DNA, 22 bp, Artificial Sequence
  chemically synthesized
aacacaatcaactgccatggtg

SEQ ID NO: 900239 - DNA, 22 bp, Artificial Sequence
  chemically synthesized
acacaatcaactgccatggtgt

SEQ ID NO: 900240 - DNA, 22 bp, Artificial Sequence
  chemically synthesized
taaataaatggctggaacacca

SEQ ID NO: 900241 - DNA, 22 bp, Artificial Sequence
  chemically synthesized
aatcctgtaaataaatggctgg

SEQ ID NO: 900242 - DNA, 22 bp, Artificial Sequence
  chemically synthesized
aaatcctgtaaataaatggctg

SEQ ID NO: 900243 - DNA, 22 bp, Artificial Sequence
  chemically synthesized
ccatggtgttccagccatttat

SEQ ID NO: 900244 - DNA, 22 bp, Artificial Sequence
  chemically synthesized
cagccatttatttacaggattt

SEQ ID NO: 900245 - DNA, 22 bp, Artificial Sequence
  chemically synthesized
gaggaaagacgtttaaatcctg

SEQ ID NO: 900246 - DNA, 22 bp, Artificial Sequence
  chemically synthesized
ggaggaaagacgtttaaatcct

SEQ ID NO: 900247 - DNA, 22 bp, Artificial Sequence
  chemically synthesized
tggaggaaagacgtttaaatcc

SEQ ID NO: 900248 - DNA, 22 bp, Artificial Sequence
  chemically synthesized
atttacaggatttaaacgtctt

SEQ ID NO: 900249 - DNA, 22 bp, Artificial Sequence
  chemically synthesized
tttacaggatttaaacgtcttt

SEQ ID NO: 900250 - DNA, 22 bp, Artificial Sequence
  chemically synthesized
acaggatttaaacgtctttcct

SEQ ID NO: 900251 - DNA, 22 bp, Artificial Sequence
  chemically synthesized
caggatttaaacgtctttcctc

SEQ ID NO: 900252 - DNA, 22 bp, Artificial Sequence
  chemically synthesized
gcaggagtcccggctttggagg

SEQ ID NO: 900253 - DNA, 22 bp, Artificial Sequence
  chemically synthesized
aaacgtctttcctccaaagccg

SEQ ID NO: 900254 - DNA, 22 bp, Artificial Sequence
  chemically synthesized
aacgtctttcctccaaagccgg

SEQ ID NO: 900255 - DNA, 22 bp, Artificial Sequence
  chemically synthesized
tctggcaggagtcccggctttg

SEQ ID NO: 900256 - DNA, 22 bp, Artificial Sequence
  chemically synthesized
tcctccaaagccgggactcctg

SEQ ID NO: 900257 - DNA, 22 bp, Artificial Sequence
  chemically synthesized
cctccaaagccgggactcctgc

SEQ ID NO: 900258 - DNA, 22 bp, Artificial Sequence
  chemically synthesized
ctccaaagccgggactcctgcc

SEQ ID NO: 900259 - DNA, 22 bp, Artificial Sequence
  chemically synthesized
cacaggttatctggcaggagtc

SEQ ID NO: 900260 - DNA, 22 bp, Artificial Sequence
  chemically synthesized
caaagccgggactcctgccaga

SEQ ID NO: 900261 - DNA, 22 bp, Artificial Sequence
  chemically synthesized
ggtccattacacaggttatctg

SEQ ID NO: 900262 - DNA, 22 bp, Artificial Sequence
  chemically synthesized
cactaggtccattacacaggtt

SEQ ID NO: 900263 - DNA, 22 bp, Artificial Sequence
  chemically synthesized
ctgccagataacctgtgtaatg

SEQ ID NO: 900264 - DNA, 22 bp, Artificial Sequence
  chemically synthesized
ccagataacctgtgtaatggac

SEQ ID NO: 900265 - DNA, 22 bp, Artificial Sequence
  chemically synthesized
gtgtaggtcattgcactaggtc

SEQ ID NO: 900266 - DNA, 22 bp, Artificial Sequence
  chemically synthesized
ggtgtaggtcattgcactaggt

SEQ ID NO: 900267 - DNA, 22 bp, Artificial Sequence
  chemically synthesized
tgtaatggacctagtgcaatga

SEQ ID NO: 900268 - DNA, 22 bp, Artificial Sequence
  chemically synthesized
gccatttggtgtaggtcattgc

SEQ ID NO: 900269 - DNA, 22 bp, Artificial Sequence
  chemically synthesized
ttagccatttggtgtaggtcat

SEQ ID NO: 900270 - DNA, 22 bp, Artificial Sequence
  chemically synthesized
gtgcaatgacctacaccaaatg

SEQ ID NO: 900271 - DNA, 22 bp, Artificial Sequence
  chemically synthesized
gacaaaattgttagccatttgg

SEQ ID NO: 900272 - DNA, 22 bp, Artificial Sequence
  chemically synthesized
caccaaatggctaacaattttg

SEQ ID NO: 900273 - DNA, 22 bp, Artificial Sequence
  chemically synthesized
gcaaagcccatgggctggacaa

SEQ ID NO: 900274 - DNA, 22 bp, Artificial Sequence
  chemically synthesized
acaattttgtccagcccatggg

SEQ ID NO: 900275 - DNA, 22 bp, Artificial Sequence
  chemically synthesized
tgtccagcccatgggctttgcg

SEQ ID NO: 900276 - DNA, 22 bp, Artificial Sequence
  chemically synthesized
gtccagcccatgggctttgcga

SEQ ID NO: 900277 - DNA, 22 bp, Artificial Sequence
  chemically synthesized
tccagcccatgggctttgcgag

SEQ ID NO: 900278 - DNA, 22 bp, Artificial Sequence
  chemically synthesized
gccagagccaagagatgagccc

SEQ ID NO: 900279 - DNA, 22 bp, Artificial Sequence
  chemically synthesized
agccagagccaagagatgagcc

SEQ ID NO: 900280 - DNA, 22 bp, Artificial Sequence
  chemically synthesized
tgcgagtggggctcatctcttg

SEQ ID NO: 900281 - DNA, 22 bp, Artificial Sequence
  chemically synthesized
gcgagtggggctcatctcttgg

SEQ ID NO: 900282 - DNA, 22 bp, Artificial Sequence
  chemically synthesized
cgagtggggctcatctcttggc

SEQ ID NO: 900283 - DNA, 22 bp, Artificial Sequence
  chemically synthesized
catacttagccagagccaagag

SEQ ID NO: 900284 - DNA, 22 bp, Artificial Sequence
  chemically synthesized
atctcttggctctggctaagta

SEQ ID NO: 900285 - DNA, 22 bp, Artificial Sequence
  chemically synthesized
ttggctctggctaagtatgcag

SEQ ID NO: 900286 - DNA, 22 bp, Artificial Sequence
  chemically synthesized
ggctctggctaagtatgcagct

SEQ ID NO: 900287 - DNA, 22 bp, Artificial Sequence
  chemically synthesized
gctctggctaagtatgcagcta

SEQ ID NO: 900288 - DNA, 22 bp, Artificial Sequence
  chemically synthesized
tggctaagtatgcagctacatt

SEQ ID NO: 900289 - DNA, 22 bp, Artificial Sequence
  chemically synthesized
ccacatcatcgggaatgtagct

SEQ ID NO: 900290 - DNA, 22 bp, Artificial Sequence
  chemically synthesized
gctaagtatgcagctacattcc

SEQ ID NO: 900291 - DNA, 22 bp, Artificial Sequence
  chemically synthesized
agtatgcagctacattcccgat

SEQ ID NO: 900292 - DNA, 22 bp, Artificial Sequence
  chemically synthesized
aaatgttgccacatcatcggga

SEQ ID NO: 900293 - DNA, 22 bp, Artificial Sequence
  chemically synthesized
cattcccgatgatgtggcaaca

SEQ ID NO: 900294 - DNA, 22 bp, Artificial Sequence
  chemically synthesized
ccgatgatgtggcaacatttta

SEQ ID NO: 900295 - DNA, 22 bp, Artificial Sequence
  chemically synthesized
gaaaccagagcctaaaatgttg

SEQ ID NO: 900296 - DNA, 22 bp, Artificial Sequence
  chemically synthesized
ctggaaaccagagcctaaaatg

SEQ ID NO: 900297 - DNA, 22 bp, Artificial Sequence
  chemically synthesized
tcctggaaaccagagcctaaaa

SEQ ID NO: 900298 - DNA, 22 bp, Artificial Sequence
  chemically synthesized
tctcctggaaaccagagcctaa

SEQ ID NO: 900299 - DNA, 22 bp, Artificial Sequence
  chemically synthesized
agctctctcctggaaaccagag

SEQ ID NO: 900300 - DNA, 22 bp, Artificial Sequence
  chemically synthesized
tgtctcagctctctcctggaaa

SEQ ID NO: 900301 - DNA, 22 bp, Artificial Sequence
  chemically synthesized
taggctctggtttccaggagag

SEQ ID NO: 900302 - DNA, 22 bp, Artificial Sequence
  chemically synthesized
aggctctggtttccaggagaga

SEQ ID NO: 900303 - DNA, 22 bp, Artificial Sequence
  chemically synthesized
ggctctggtttccaggagagag

SEQ ID NO: 900304 - DNA, 22 bp, Artificial Sequence
  chemically synthesized
tggtttccaggagagagctgag

SEQ ID NO: 900305 - DNA, 22 bp, Artificial Sequence
  chemically synthesized
agaatagctgtgtctcagctct

SEQ ID NO: 900306 - DNA, 22 bp, Artificial Sequence
  chemically synthesized
gtttccaggagagagctgagac

SEQ ID NO: 900307 - DNA, 22 bp, Artificial Sequence
  chemically synthesized
ccaggagagagctgagacacag

SEQ ID NO: 900308 - DNA, 22 bp, Artificial Sequence
  chemically synthesized
caggagagagctgagacacagc

SEQ ID NO: 900309 - DNA, 22 bp, Artificial Sequence
  chemically synthesized
ccaaggcctgagaatagctgtg

SEQ ID NO: 900310 - DNA, 22 bp, Artificial Sequence
  chemically synthesized
agacacagctattctcaggcct

SEQ ID NO: 900311 - DNA, 22 bp, Artificial Sequence
  chemically synthesized
aaagcggtggttcccaaggcct

SEQ ID NO: 900312 - DNA, 22 bp, Artificial Sequence
  chemically synthesized
tcaaagcggtggttcccaaggc

SEQ ID NO: 900313 - DNA, 22 bp, Artificial Sequence
  chemically synthesized
ctcaaagcggtggttcccaagg

SEQ ID NO: 900314 - DNA, 22 bp, Artificial Sequence
  chemically synthesized
tttctcaaagcggtggttccca

SEQ ID NO: 900315 - DNA, 22 bp, Artificial Sequence
  chemically synthesized
ttctcaggccttgggaaccacc

SEQ ID NO: 900316 - DNA, 22 bp, Artificial Sequence
  chemically synthesized
gtttctcaaagcggtggttccc

SEQ ID NO: 900317 - DNA, 22 bp, Artificial Sequence
  chemically synthesized
tcaggccttgggaaccaccgct

SEQ ID NO: 900318 - DNA, 22 bp, Artificial Sequence
  chemically synthesized
acttgtttctcaaagcggtggt

SEQ ID NO: 900319 - DNA, 22 bp, Artificial Sequence
  chemically synthesized
aggccttgggaaccaccgcttt

SEQ ID NO: 900320 - DNA, 22 bp, Artificial Sequence
  chemically synthesized
ctaacttgtttctcaaagcggt

SEQ ID NO: 900321 - DNA, 22 bp, Artificial Sequence
  chemically synthesized
cctaacttgtttctcaaagcgg

SEQ ID NO: 900322 - DNA, 22 bp, Artificial Sequence
  chemically synthesized
tcctaacttgtttctcaaagcg

SEQ ID NO: 900323 - DNA, 22 bp, Artificial Sequence
  chemically synthesized
gggaaccaccgctttgagaaac

SEQ ID NO: 900324 - DNA, 22 bp, Artificial Sequence
  chemically synthesized
ggaaccaccgctttgagaaaca

SEQ ID NO: 900325 - DNA, 22 bp, Artificial Sequence
  chemically synthesized
cattttcctaacttgtttctca

SEQ ID NO: 900326 - DNA, 22 bp, Artificial Sequence
  chemically synthesized
tgcattttcctaacttgtttct

SEQ ID NO: 900327 - DNA, 22 bp, Artificial Sequence
  chemically synthesized
tgagaaacaagttaggaaaatg

SEQ ID NO: 900328 - DNA, 22 bp, Artificial Sequence
  chemically synthesized
gagaaacaagttaggaaaatgc

SEQ ID NO: 900329 - DNA, 22 bp, Artificial Sequence
  chemically synthesized
agaaacaagttaggaaaatgca

SEQ ID NO: 900330 - DNA, 22 bp, Artificial Sequence
  chemically synthesized
ccccgggacgtaaggtcctctg

SEQ ID NO: 900331 - DNA, 22 bp, Artificial Sequence
  chemically synthesized
cccccgggacgtaaggtcctct

SEQ ID NO: 900332 - DNA, 22 bp, Artificial Sequence
  chemically synthesized
ggaaaatgcagaggaccttacg

SEQ ID NO: 900333 - DNA, 22 bp, Artificial Sequence
  chemically synthesized
tgagtttcccccgggacgtaag

SEQ ID NO: 900334 - DNA, 22 bp, Artificial Sequence
  chemically synthesized
tgtgagtttcccccgggacgta

SEQ ID NO: 900335 - DNA, 22 bp, Artificial Sequence
  chemically synthesized
ctgtgagtttcccccgggacgt

SEQ ID NO: 900336 - DNA, 22 bp, Artificial Sequence
  chemically synthesized
acgtcccgggggaaactcacag

SEQ ID NO: 900337 - DNA, 22 bp, Artificial Sequence
  chemically synthesized
cgtcccgggggaaactcacaga

SEQ ID NO: 900338 - DNA, 22 bp, Artificial Sequence
  chemically synthesized
taaagatgccccaaaacttctg

SEQ ID NO: 900339 - DNA, 22 bp, Artificial Sequence
  chemically synthesized
acaaatattataaagatgcccc

SEQ ID NO: 900340 - DNA, 22 bp, Artificial Sequence
  chemically synthesized
acagaagttttggggcatcttt

SEQ ID NO: 900341 - DNA, 22 bp, Artificial Sequence
  chemically synthesized
attgacaaatattataaagatg

SEQ ID NO: 900342 - DNA, 22 bp, Artificial Sequence
  chemically synthesized
cattgacaaatattataaagat

SEQ ID NO: 900343 - DNA, 22 bp, Artificial Sequence
  chemically synthesized
tcattgacaaatattataaaga

SEQ ID NO: 900344 - DNA, 22 bp, Artificial Sequence
  chemically synthesized
cctttcattgacaaatattata

SEQ ID NO: 900345 - DNA, 22 bp, Artificial Sequence
  chemically synthesized
tggggcatctttataatatttg

SEQ ID NO: 900346 - DNA, 22 bp, Artificial Sequence
  chemically synthesized
ccctttcattgacaaatattat

SEQ ID NO: 900347 - DNA, 22 bp, Artificial Sequence
  chemically synthesized
ggggcatctttataatatttgt

SEQ ID NO: 900348 - DNA, 22 bp, Artificial Sequence
  chemically synthesized
tccctttcattgacaaatatta

SEQ ID NO: 900349 - DNA, 22 bp, Artificial Sequence
  chemically synthesized
gggcatctttataatatttgtc

SEQ ID NO: 900350 - DNA, 22 bp, Artificial Sequence
  chemically synthesized
ctttccctttcattgacaaata

SEQ ID NO: 900351 - DNA, 22 bp, Artificial Sequence
  chemically synthesized
tataatatttgtcaatgaaagg

SEQ ID NO: 900352 - DNA, 22 bp, Artificial Sequence
  chemically synthesized
ataatatttgtcaatgaaaggg

SEQ ID NO: 900353 - DNA, 22 bp, Artificial Sequence
  chemically synthesized
taatatttgtcaatgaaaggga

SEQ ID NO: 900354 - DNA, 22 bp, Artificial Sequence
  chemically synthesized
aaaggaatgttcctttcccttt

SEQ ID NO: 900355 - DNA, 22 bp, Artificial Sequence
  chemically synthesized
caaaggaatgttcctttccctt

SEQ ID NO: 900356 - DNA, 22 bp, Artificial Sequence
  chemically synthesized
tcaaaggaatgttcctttccct

SEQ ID NO: 900357 - DNA, 22 bp, Artificial Sequence
  chemically synthesized
gtcaatgaaagggaaaggaaca

SEQ ID NO: 900358 - DNA, 22 bp, Artificial Sequence
  chemically synthesized
tcaatgaaagggaaaggaacat

SEQ ID NO: 900359 - DNA, 22 bp, Artificial Sequence
  chemically synthesized
cctttcaaaggaatgttccttt

SEQ ID NO: 900360 - DNA, 22 bp, Artificial Sequence
  chemically synthesized
gcctttcaaaggaatgttcctt

SEQ ID NO: 900361 - DNA, 22 bp, Artificial Sequence
  chemically synthesized
tgtttgcctttcaaaggaatgt

SEQ ID NO: 900362 - DNA, 22 bp, Artificial Sequence
  chemically synthesized
tgtgtttgcctttcaaaggaat

SEQ ID NO: 900363 - DNA, 22 bp, Artificial Sequence
  chemically synthesized
ctttgaaaggcaaacacagaac

SEQ ID NO: 900364 - DNA, 22 bp, Artificial Sequence
  chemically synthesized
ggaacagagcaagttctgtgtt

SEQ ID NO: 900365 - DNA, 22 bp, Artificial Sequence
  chemically synthesized
tgaaaggcaaacacagaacttg

SEQ ID NO: 900366 - DNA, 22 bp, Artificial Sequence
  chemically synthesized
gaaaggcaaacacagaacttgc

SEQ ID NO: 900367 - DNA, 22 bp, Artificial Sequence
  chemically synthesized
aaaggcaaacacagaacttgct

SEQ ID NO: 900368 - DNA, 22 bp, Artificial Sequence
  chemically synthesized
gaggcataagttgggaacagag

SEQ ID NO: 900369 - DNA, 22 bp, Artificial Sequence
  chemically synthesized
ggaggcataagttgggaacaga

SEQ ID NO: 900370 - DNA, 22 bp, Artificial Sequence
  chemically synthesized
gctctgttcccaacttatgcct

SEQ ID NO: 900371 - DNA, 22 bp, Artificial Sequence
  chemically synthesized
acacagccttggaggcataagt

SEQ ID NO: 900372 - DNA, 22 bp, Artificial Sequence
  chemically synthesized
ctctgttcccaacttatgcctc

SEQ ID NO: 900373 - DNA, 22 bp, Artificial Sequence
  chemically synthesized
ctcacacagccttggaggcata

SEQ ID NO: 900374 - DNA, 22 bp, Artificial Sequence
  chemically synthesized
tgttcccaacttatgcctccaa

SEQ ID NO: 900375 - DNA, 22 bp, Artificial Sequence
  chemically synthesized
ttcccaacttatgcctccaagg

SEQ ID NO: 900376 - DNA, 22 bp, Artificial Sequence
  chemically synthesized
ccaacttatgcctccaaggctg

SEQ ID NO: 900377 - DNA, 22 bp, Artificial Sequence
  chemically synthesized
agaagaatctcctcacacagcc

SEQ ID NO: 900378 - DNA, 22 bp, Artificial Sequence
  chemically synthesized
cagaagaatctcctcacacagc

SEQ ID NO: 900379 - DNA, 22 bp, Artificial Sequence
  chemically synthesized
atgcctccaaggctgtgtgagg

SEQ ID NO: 900380 - DNA, 22 bp, Artificial Sequence
  chemically synthesized
tgcctccaaggctgtgtgagga

SEQ ID NO: 900381 - DNA, 22 bp, Artificial Sequence
  chemically synthesized
caaggctgtgtgaggagattct

SEQ ID NO: 900382 - DNA, 22 bp, Artificial Sequence
  chemically synthesized
tgtgaggagattcttctgaagt

SEQ ID NO: 900383 - DNA, 22 bp, Artificial Sequence
  chemically synthesized
atggacagcgatgtgtagactt

SEQ ID NO: 900384 - DNA, 22 bp, Artificial Sequence
  chemically synthesized
taatggacagcgatgtgtagac

SEQ ID NO: 900385 - DNA, 22 bp, Artificial Sequence
  chemically synthesized
ttctgaagtctacacatcgctg

SEQ ID NO: 900386 - DNA, 22 bp, Artificial Sequence
  chemically synthesized
ctgaagtctacacatcgctgtc

SEQ ID NO: 900387 - DNA, 22 bp, Artificial Sequence
  chemically synthesized
tgaagtctacacatcgctgtcc

SEQ ID NO: 900388 - DNA, 22 bp, Artificial Sequence
  chemically synthesized
aagtctacacatcgctgtccat

SEQ ID NO: 900389 - DNA, 22 bp, Artificial Sequence
  chemically synthesized
atagagatgctctaatggacag

SEQ ID NO: 900390 - DNA, 22 bp, Artificial Sequence
  chemically synthesized
tctaatagagatgctctaatgg

SEQ ID NO: 900391 - DNA, 22 bp, Artificial Sequence
  chemically synthesized
cacatcgctgtccattagagca

SEQ ID NO: 900392 - DNA, 22 bp, Artificial Sequence
  chemically synthesized
aaatgtctgtctaatagagatg

SEQ ID NO: 900393 - DNA, 22 bp, Artificial Sequence
  chemically synthesized
tccattagagcatctctattag

SEQ ID NO: 900394 - DNA, 22 bp, Artificial Sequence
  chemically synthesized
gagcatctctattagacagaca

SEQ ID NO: 900395 - DNA, 22 bp, Artificial Sequence
  chemically synthesized
tattagacagacattttaattt

SEQ ID NO: 900396 - DNA, 22 bp, Artificial Sequence
  chemically synthesized
atcccaatgaagaaattaaaat

SEQ ID NO: 900397 - DNA, 22 bp, Artificial Sequence
  chemically synthesized
catcccaatgaagaaattaaaa

SEQ ID NO: 900398 - DNA, 22 bp, Artificial Sequence
  chemically synthesized
ttagacagacattttaatttct

SEQ ID NO: 900399 - DNA, 22 bp, Artificial Sequence
  chemically synthesized
gacagacattttaatttcttca

SEQ ID NO: 900400 - DNA, 22 bp, Artificial Sequence
  chemically synthesized
tgtaaaaagtttcatcccaatg

SEQ ID NO: 900401 - DNA, 22 bp, Artificial Sequence
  chemically synthesized
taatttcttcattgggatgaaa

SEQ ID NO: 900402 - DNA, 22 bp, Artificial Sequence
  chemically synthesized
ctgtgtaaaaagtttcatccca

SEQ ID NO: 900403 - DNA, 22 bp, Artificial Sequence
  chemically synthesized
aatttcttcattgggatgaaac

SEQ ID NO: 900404 - DNA, 22 bp, Artificial Sequence
  chemically synthesized
atttcttcattgggatgaaact

SEQ ID NO: 900405 - DNA, 22 bp, Artificial Sequence
  chemically synthesized
cttcattgggatgaaacttttt

SEQ ID NO: 900406 - DNA, 22 bp, Artificial Sequence
  chemically synthesized
ttcattgggatgaaacttttta

SEQ ID NO: 900407 - DNA, 22 bp, Artificial Sequence
  chemically synthesized
cattgggatgaaactttttaca

SEQ ID NO: 900408 - DNA, 22 bp, Artificial Sequence
  chemically synthesized
attgggatgaaactttttacac

SEQ ID NO: 900409 - DNA, 22 bp, Artificial Sequence
  chemically synthesized
ggatgaaactttttacacagta

SEQ ID NO: 900410 - DNA, 22 bp, Artificial Sequence
  chemically synthesized
caaagtcgcagtatctactgtg

SEQ ID NO: 900411 - DNA, 22 bp, Artificial Sequence
  chemically synthesized
tttacacagtagatactgcgac

SEQ ID NO: 900412 - DNA, 22 bp, Artificial Sequence
  chemically synthesized
ttacacagtagatactgcgact

SEQ ID NO: 900413 - DNA, 22 bp, Artificial Sequence
  chemically synthesized
tacacagtagatactgcgactt

SEQ ID NO: 900414 - DNA, 22 bp, Artificial Sequence
  chemically synthesized
acacagtagatactgcgacttt

SEQ ID NO: 900415 - DNA, 22 bp, Artificial Sequence
  chemically synthesized
cacagtagatactgcgactttg

SEQ ID NO: 900416 - DNA, 22 bp, Artificial Sequence
  chemically synthesized
atacaaacattacaaagtcgca

SEQ ID NO: 900417 - DNA, 22 bp, Artificial Sequence
  chemically synthesized
agttcatacaaacattacaaag

SEQ ID NO: 900418 - DNA, 22 bp, Artificial Sequence
  chemically synthesized
cagttcatacaaacattacaaa

SEQ ID NO: 900419 - DNA, 22 bp, Artificial Sequence
  chemically synthesized
cagcttcagttcatacaaacat

SEQ ID NO: 900420 - DNA, 22 bp, Artificial Sequence
  chemically synthesized
cgactttgtaatgtttgtatga

SEQ ID NO: 900421 - DNA, 22 bp, Artificial Sequence
  chemically synthesized
attccagcttcagttcatacaa

SEQ ID NO: 900422 - DNA, 22 bp, Artificial Sequence
  chemically synthesized
aattccagcttcagttcataca

SEQ ID NO: 900423 - DNA, 22 bp, Artificial Sequence
  chemically synthesized
taattccagcttcagttcatac

SEQ ID NO: 900424 - DNA, 22 bp, Artificial Sequence
  chemically synthesized
tgtaatgtttgtatgaactgaa

SEQ ID NO: 900425 - DNA, 22 bp, Artificial Sequence
  chemically synthesized
gtaatgtttgtatgaactgaag

SEQ ID NO: 900426 - DNA, 22 bp, Artificial Sequence
  chemically synthesized
ttttaattccagcttcagttca

SEQ ID NO: 900427 - DNA, 22 bp, Artificial Sequence
  chemically synthesized
taatgtttgtatgaactgaagc

SEQ ID NO: 900428 - DNA, 22 bp, Artificial Sequence
  chemically synthesized
ttgttttaattccagcttcagt

SEQ ID NO: 900429 - DNA, 22 bp, Artificial Sequence
  chemically synthesized
gttgttttaattccagcttcag

SEQ ID NO: 900430 - DNA, 22 bp, Artificial Sequence
  chemically synthesized
gtatgaactgaagctggaatta

SEQ ID NO: 900431 - DNA, 22 bp, Artificial Sequence
  chemically synthesized
tatgaactgaagctggaattaa

SEQ ID NO: 900432 - DNA, 22 bp, Artificial Sequence
  chemically synthesized
agatttgttgttttaattccag

SEQ ID NO: 900433 - DNA, 22 bp, Artificial Sequence
  chemically synthesized
cagatttgttgttttaattcca

SEQ ID NO: 900434 - DNA, 22 bp, Artificial Sequence
  chemically synthesized
aagctggaattaaaacaacaaa

SEQ ID NO: 900435 - DNA, 22 bp, Artificial Sequence
  chemically synthesized
gaattaaaacaacaaatctgaa

SEQ ID NO: 900436 - DNA, 22 bp, Artificial Sequence
  chemically synthesized
aaacaacaaatctgaagccatg

SEQ ID NO: 900437 - DNA, 22 bp, Artificial Sequence
  chemically synthesized
tataaaagtgatgaaaaagacc

SEQ ID NO: 900438 - DNA, 22 bp, Artificial Sequence
  chemically synthesized
atataaaagtgatgaaaaagac

SEQ ID NO: 900439 - DNA, 22 bp, Artificial Sequence
  chemically synthesized
aagccatggtctttttcatcac

SEQ ID NO: 900440 - DNA, 22 bp, Artificial Sequence
  chemically synthesized
agtaatttatataaaagtgatg

SEQ ID NO: 900441 - DNA, 22 bp, Artificial Sequence
  chemically synthesized
tgagtaatttatataaaagtga

SEQ ID NO: 900442 - DNA, 22 bp, Artificial Sequence
  chemically synthesized
gaactctgagtaatttatataa

SEQ ID NO: 900443 - DNA, 22 bp, Artificial Sequence
  chemically synthesized
tttcatcacttttatataaatt

SEQ ID NO: 900444 - DNA, 22 bp, Artificial Sequence
  chemically synthesized
ttcatcacttttatataaatta

SEQ ID NO: 900445 - DNA, 22 bp, Artificial Sequence
  chemically synthesized
tcatcacttttatataaattac

SEQ ID NO: 900446 - DNA, 22 bp, Artificial Sequence
  chemically synthesized
catcacttttatataaattact

SEQ ID NO: 900447 - DNA, 22 bp, Artificial Sequence
  chemically synthesized
atcacttttatataaattactc

SEQ ID NO: 900448 - DNA, 22 bp, Artificial Sequence
  chemically synthesized
caatctggaactctgagtaatt

SEQ ID NO: 900449 - DNA, 22 bp, Artificial Sequence
  chemically synthesized
ttatataaattactcagagttc

SEQ ID NO: 900450 - DNA, 22 bp, Artificial Sequence
  chemically synthesized
tatataaattactcagagttcc

SEQ ID NO: 900451 - DNA, 22 bp, Artificial Sequence
  chemically synthesized
atataaattactcagagttcca

SEQ ID NO: 900452 - DNA, 22 bp, Artificial Sequence
  chemically synthesized
tataaattactcagagttccag

SEQ ID NO: 900453 - DNA, 22 bp, Artificial Sequence
  chemically synthesized
ctcagagttccagattgcaatt

SEQ ID NO: 900454 - DNA, 22 bp, Artificial Sequence
  chemically synthesized
agagttccagattgcaattcat

SEQ ID NO: 900455 - DNA, 22 bp, Artificial Sequence
  chemically synthesized
taaaaatatatagatgaattgc

SEQ ID NO: 900456 - DNA, 22 bp, Artificial Sequence
  chemically synthesized
acctgtaaaaatatatagatga

SEQ ID NO: 900457 - DNA, 22 bp, Artificial Sequence
  chemically synthesized
cagattgcaattcatctatata

SEQ ID NO: 900458 - DNA, 22 bp, Artificial Sequence
  chemically synthesized
cacctgtaaaaatatatagatg

SEQ ID NO: 900459 - DNA, 22 bp, Artificial Sequence
  chemically synthesized
atgcttcacctgtaaaaatata

SEQ ID NO: 900460 - DNA, 22 bp, Artificial Sequence
  chemically synthesized
caattcatctatatatttttac

SEQ ID NO: 900461 - DNA, 22 bp, Artificial Sequence
  chemically synthesized
aattcatgcttcacctgtaaaa

SEQ ID NO: 900462 - DNA, 22 bp, Artificial Sequence
  chemically synthesized
aaattcatgcttcacctgtaaa

SEQ ID NO: 900463 - DNA, 22 bp, Artificial Sequence
  chemically synthesized
atctatatatttttacaggtga

SEQ ID NO: 900464 - DNA, 22 bp, Artificial Sequence
  chemically synthesized
taaattcatgcttcacctgtaa

SEQ ID NO: 900465 - DNA, 22 bp, Artificial Sequence
  chemically synthesized
ttaaattcatgcttcacctgta

SEQ ID NO: 900466 - DNA, 22 bp, Artificial Sequence
  chemically synthesized
tttaaattcatgcttcacctgt

SEQ ID NO: 900467 - DNA, 22 bp, Artificial Sequence
  chemically synthesized
ttttaaattcatgcttcacctg

SEQ ID NO: 900468 - DNA, 22 bp, Artificial Sequence
  chemically synthesized
tttttaaattcatgcttcacct

SEQ ID NO: 900469 - DNA, 22 bp, Artificial Sequence
  chemically synthesized
tatatttttacaggtgaagcat

SEQ ID NO: 900470 - DNA, 22 bp, Artificial Sequence
  chemically synthesized
ttttttaaattcatgcttcacc

SEQ ID NO: 900471 - DNA, 22 bp, Artificial Sequence
  chemically synthesized
aatttttttttaaattcatgct

SEQ ID NO: 900472 - DNA, 22 bp, Artificial Sequence
  chemically synthesized
aaatttttttttaaattcatgc

SEQ ID NO: 900473 - DNA, 22 bp, Artificial Sequence
  chemically synthesized
ttacaggtgaagcatgaattta

SEQ ID NO: 900474 - DNA, 22 bp, Artificial Sequence
  chemically synthesized
taaatttttttttaaattcatg

SEQ ID NO: 900475 - DNA, 22 bp, Artificial Sequence
  chemically synthesized
tacaggtgaagcatgaatttaa

SEQ ID NO: 900476 - DNA, 22 bp, Artificial Sequence
  chemically synthesized
ttaaatttttttttaaattcat

SEQ ID NO: 900477 - DNA, 22 bp, Artificial Sequence
  chemically synthesized
acaggtgaagcatgaatttaaa

SEQ ID NO: 900478 - DNA, 22 bp, Artificial Sequence
  chemically synthesized
tttaaatttttttttaaattca

SEQ ID NO: 900479 - DNA, 22 bp, Artificial Sequence
  chemically synthesized
caggtgaagcatgaatttaaaa

SEQ ID NO: 900480 - DNA, 22 bp, Artificial Sequence
  chemically synthesized
aatgagtgaaaccactttttaa

SEQ ID NO: 900481 - DNA, 22 bp, Artificial Sequence
  chemically synthesized
aaatgagtgaaaccacttttta

SEQ ID NO: 900482 - DNA, 22 bp, Artificial Sequence
  chemically synthesized
aaaaaaaaatttaaaaagtggt

SEQ ID NO: 900483 - DNA, 22 bp, Artificial Sequence
  chemically synthesized
taaatgagtgaaaccacttttt

SEQ ID NO: 900484 - DNA, 22 bp, Artificial Sequence
  chemically synthesized
aaaaaaaatttaaaaagtggtt

SEQ ID NO: 900485 - DNA, 22 bp, Artificial Sequence
  chemically synthesized
ttaaatgagtgaaaccactttt

SEQ ID NO: 900486 - DNA, 22 bp, Artificial Sequence
  chemically synthesized
tttaaatgagtgaaaccacttt

SEQ ID NO: 900487 - DNA, 22 bp, Artificial Sequence
  chemically synthesized
aacagttttttaaatgagtgaa

SEQ ID NO: 900488 - DNA, 22 bp, Artificial Sequence
  chemically synthesized
aaaaagtggtttcactcattta

SEQ ID NO: 900489 - DNA, 22 bp, Artificial Sequence
  chemically synthesized
aaaagtggtttcactcatttaa

SEQ ID NO: 900490 - DNA, 22 bp, Artificial Sequence
  chemically synthesized
accaattcaacagttttttaaa

SEQ ID NO: 900491 - DNA, 22 bp, Artificial Sequence
  chemically synthesized
cactcatttaaaaaactgttga

SEQ ID NO: 900492 - DNA, 22 bp, Artificial Sequence
  chemically synthesized
actcatttaaaaaactgttgaa

SEQ ID NO: 900493 - DNA, 22 bp, Artificial Sequence
  chemically synthesized
atttaaaaaactgttgaattgg

SEQ ID NO: 900494 - DNA, 22 bp, Artificial Sequence
  chemically synthesized
aaaaaactgttgaattggttag

SEQ ID NO: 900495 - DNA, 22 bp, Artificial Sequence
  chemically synthesized
accagtaaccaactaaccaatt

SEQ ID NO: 900496 - DNA, 22 bp, Artificial Sequence
  chemically synthesized
aaaaactgttgaattggttagt

SEQ ID NO: 900497 - DNA, 22 bp, Artificial Sequence
  chemically synthesized
aaccagtaaccaactaaccaat

SEQ ID NO: 900498 - DNA, 22 bp, Artificial Sequence
  chemically synthesized
taaccagtaaccaactaaccaa

SEQ ID NO: 900499 - DNA, 22 bp, Artificial Sequence
  chemically synthesized
ttaaccagtaaccaactaacca

SEQ ID NO: 900500 - DNA, 22 bp, Artificial Sequence
  chemically synthesized
ttttaaccagtaaccaactaac

SEQ ID NO: 900501 - DNA, 22 bp, Artificial Sequence
  chemically synthesized
cttttaaccagtaaccaactaa

SEQ ID NO: 900502 - DNA, 22 bp, Artificial Sequence
  chemically synthesized
tcttttaaccagtaaccaacta

SEQ ID NO: 900503 - DNA, 22 bp, Artificial Sequence
  chemically synthesized
ttcttttaaccagtaaccaact

SEQ ID NO: 900504 - DNA, 22 bp, Artificial Sequence
  chemically synthesized
ttgaattggttagttggttact

SEQ ID NO: 900505 - DNA, 22 bp, Artificial Sequence
  chemically synthesized
aattggttagttggttactggt

SEQ ID NO: 900506 - DNA, 22 bp, Artificial Sequence
  chemically synthesized
aataatttttcttttaaccagt

SEQ ID NO: 900507 - DNA, 22 bp, Artificial Sequence
  chemically synthesized
gttagttggttactggttaaaa

SEQ ID NO: 900508 - DNA, 22 bp, Artificial Sequence
  chemically synthesized
gttggttactggttaaaagaaa

SEQ ID NO: 900509 - DNA, 22 bp, Artificial Sequence
  chemically synthesized
gttactggttaaaagaaaaatt

SEQ ID NO: 900510 - DNA, 22 bp, Artificial Sequence
  chemically synthesized
ctggttaaaagaaaaattattt

SEQ ID NO: 900511 - DNA, 22 bp, Artificial Sequence
  chemically synthesized
gttaaaagaaaaattatttagg

SEQ ID NO: 900512 - DNA, 22 bp, Artificial Sequence
  chemically synthesized
gcatataaaaggccctaaataa

SEQ ID NO: 900513 - DNA, 22 bp, Artificial Sequence
  chemically synthesized
aaagaaaaattatttagggcct

SEQ ID NO: 900514 - DNA, 22 bp, Artificial Sequence
  chemically synthesized
cctggcatataaaaggccctaa

SEQ ID NO: 900515 - DNA, 22 bp, Artificial Sequence
  chemically synthesized
gcatactgcctggcatataaaa

SEQ ID NO: 900516 - DNA, 22 bp, Artificial Sequence
  chemically synthesized
tttagggccttttatatgccag

SEQ ID NO: 900517 - DNA, 22 bp, Artificial Sequence
  chemically synthesized
cctagcatactgcctggcatat

SEQ ID NO: 900518 - DNA, 22 bp, Artificial Sequence
  chemically synthesized
acctagcatactgcctggcata

SEQ ID NO: 900519 - DNA, 22 bp, Artificial Sequence
  chemically synthesized
agggccttttatatgccaggca

SEQ ID NO: 900520 - DNA, 22 bp, Artificial Sequence
  chemically synthesized
gggccttttatatgccaggcag

SEQ ID NO: 900521 - DNA, 22 bp, Artificial Sequence
  chemically synthesized
ttatatgccaggcagtatgcta

SEQ ID NO: 900522 - DNA, 22 bp, Artificial Sequence
  chemically synthesized
tatatgccaggcagtatgctag

SEQ ID NO: 900523 - DNA, 22 bp, Artificial Sequence
  chemically synthesized
atatgccaggcagtatgctagg

SEQ ID NO: 900524 - DNA, 22 bp, Artificial Sequence
  chemically synthesized
tatgccaggcagtatgctaggt

SEQ ID NO: 900525 - DNA, 22 bp, Artificial Sequence
  chemically synthesized
atagaagggagggatgatttac

SEQ ID NO: 900526 - DNA, 22 bp, Artificial Sequence
  chemically synthesized
ggtaaatcatccctcccttcta

SEQ ID NO: 900527 - DNA, 22 bp, Artificial Sequence
  chemically synthesized
cagaataagtgttcatagaagg

SEQ ID NO: 900528 - DNA, 22 bp, Artificial Sequence
  chemically synthesized
ccagaataagtgttcatagaag

SEQ ID NO: 900529 - DNA, 22 bp, Artificial Sequence
  chemically synthesized
ttccagaataagtgttcataga

SEQ ID NO: 900530 - DNA, 22 bp, Artificial Sequence
  chemically synthesized
cttccagaataagtgttcatag

SEQ ID NO: 900531 - DNA, 22 bp, Artificial Sequence
  chemically synthesized
tcttccagaataagtgttcata

SEQ ID NO: 900532 - DNA, 22 bp, Artificial Sequence
  chemically synthesized
ttcttccagaataagtgttcat

SEQ ID NO: 900533 - DNA, 22 bp, Artificial Sequence
  chemically synthesized
tttcttccagaataagtgttca

SEQ ID NO: 900534 - DNA, 22 bp, Artificial Sequence
  chemically synthesized
ttttcttccagaataagtgttc

SEQ ID NO: 900535 - DNA, 22 bp, Artificial Sequence
  chemically synthesized
tttttcttccagaataagtgtt

SEQ ID NO: 900536 - DNA, 22 bp, Artificial Sequence
  chemically synthesized
ccttctatgaacacttattctg

SEQ ID NO: 900537 - DNA, 22 bp, Artificial Sequence
  chemically synthesized
ctatgaacacttattctggaag

SEQ ID NO: 900538 - DNA, 22 bp, Artificial Sequence
  chemically synthesized
tatgaacacttattctggaaga

SEQ ID NO: 900539 - DNA, 22 bp, Artificial Sequence
  chemically synthesized
aatacattttttttcttccaga

SEQ ID NO: 900540 - DNA, 22 bp, Artificial Sequence
  chemically synthesized
tgaacacttattctggaagaaa

SEQ ID NO: 900541 - DNA, 22 bp, Artificial Sequence
  chemically synthesized
aaatacattttttttcttccag

SEQ ID NO: 900542 - DNA, 22 bp, Artificial Sequence
  chemically synthesized
tgtttaaatacattttttttct

SEQ ID NO: 900543 - DNA, 22 bp, Artificial Sequence
  chemically synthesized
tgtgtttaaatacatttttttt

SEQ ID NO: 900544 - DNA, 22 bp, Artificial Sequence
  chemically synthesized
attctggaagaaaaaaaatgta

SEQ ID NO: 900545 - DNA, 22 bp, Artificial Sequence
  chemically synthesized
ttctggaagaaaaaaaatgtat

SEQ ID NO: 900546 - DNA, 22 bp, Artificial Sequence
  chemically synthesized
aattctgtgtttaaatacattt

SEQ ID NO: 900547 - DNA, 22 bp, Artificial Sequence
  chemically synthesized
tggaagaaaaaaaatgtattta

SEQ ID NO: 900548 - DNA, 22 bp, Artificial Sequence
  chemically synthesized
gaagaaaaaaaatgtatttaaa

SEQ ID NO: 900549 - DNA, 22 bp, Artificial Sequence
  chemically synthesized
gtaattgaattctgtgtttaaa

SEQ ID NO: 900550 - DNA, 22 bp, Artificial Sequence
  chemically synthesized
ggtaattgaattctgtgtttaa

SEQ ID NO: 900551 - DNA, 22 bp, Artificial Sequence
  chemically synthesized
atcacttggtaattgaattctg

SEQ ID NO: 900552 - DNA, 22 bp, Artificial Sequence
  chemically synthesized
aaacacagaattcaattaccaa

SEQ ID NO: 900553 - DNA, 22 bp, Artificial Sequence
  chemically synthesized
aacacagaattcaattaccaag

SEQ ID NO: 900554 - DNA, 22 bp, Artificial Sequence
  chemically synthesized
gagtattcatcacttggtaatt

SEQ ID NO: 900555 - DNA, 22 bp, Artificial Sequence
  chemically synthesized
ttagagtattcatcacttggta

SEQ ID NO: 900556 - DNA, 22 bp, Artificial Sequence
  chemically synthesized
attagagtattcatcacttggt

SEQ ID NO: 900557 - DNA, 22 bp, Artificial Sequence
  chemically synthesized
tattagagtattcatcacttgg

SEQ ID NO: 900558 - DNA, 22 bp, Artificial Sequence
  chemically synthesized
tctttattagagtattcatcac

SEQ ID NO: 900559 - DNA, 22 bp, Artificial Sequence
  chemically synthesized
aattaccaagtgatgaatactc

SEQ ID NO: 900560 - DNA, 22 bp, Artificial Sequence
  chemically synthesized
tgtctgtctttattagagtatt

SEQ ID NO: 900561 - DNA, 22 bp, Artificial Sequence
  chemically synthesized
ccaagtgatgaatactctaata

SEQ ID NO: 900562 - DNA, 22 bp, Artificial Sequence
  chemically synthesized
tagtgtattgtgtctgtcttta

SEQ ID NO: 900563 - DNA, 22 bp, Artificial Sequence
  chemically synthesized
gtagtgtattgtgtctgtcttt

SEQ ID NO: 900564 - DNA, 22 bp, Artificial Sequence
  chemically synthesized
tgtagtgtattgtgtctgtctt

SEQ ID NO: 900565 - DNA, 22 bp, Artificial Sequence
  chemically synthesized
taataaagacagacacaataca

SEQ ID NO: 900566 - DNA, 22 bp, Artificial Sequence
  chemically synthesized
catgactttgtagtgtattgtg

SEQ ID NO: 900567 - DNA, 22 bp, Artificial Sequence
  chemically synthesized
ataaagacagacacaatacact

SEQ ID NO: 900568 - DNA, 22 bp, Artificial Sequence
  chemically synthesized
cagactccatgactttgtagtg

SEQ ID NO: 900569 - DNA, 22 bp, Artificial Sequence
  chemically synthesized
caaagtcatggagtctggaggg

SEQ ID NO: 900570 - DNA, 22 bp, Artificial Sequence
  chemically synthesized
caggagacagaggccctccaga

SEQ ID NO: 900571 - DNA, 22 bp, Artificial Sequence
  chemically synthesized
tccaggagacagaggccctcca

SEQ ID NO: 900572 - DNA, 22 bp, Artificial Sequence
  chemically synthesized
ctccaggagacagaggccctcc

SEQ ID NO: 900573 - DNA, 22 bp, Artificial Sequence
  chemically synthesized
tctccaggagacagaggccctc

SEQ ID NO: 900574 - DNA, 22 bp, Artificial Sequence
  chemically synthesized
tttctccaggagacagaggccc

SEQ ID NO: 900575 - DNA, 22 bp, Artificial Sequence
  chemically synthesized
cattctttctccaggagacaga

SEQ ID NO: 900576 - DNA, 22 bp, Artificial Sequence
  chemically synthesized
tccattctttctccaggagaca

SEQ ID NO: 900577 - DNA, 22 bp, Artificial Sequence
  chemically synthesized
gagggcctctgtctcctggaga

SEQ ID NO: 900578 - DNA, 22 bp, Artificial Sequence
  chemically synthesized
tctctccattctttctccagga

SEQ ID NO: 900579 - DNA, 22 bp, Artificial Sequence
  chemically synthesized
ctgtctctccattctttctcca

SEQ ID NO: 900580 - DNA, 22 bp, Artificial Sequence
  chemically synthesized
cctcctgtctctccattctttc

SEQ ID NO: 900581 - DNA, 22 bp, Artificial Sequence
  chemically synthesized
tgtctcctggagaaagaatgga

SEQ ID NO: 900582 - DNA, 22 bp, Artificial Sequence
  chemically synthesized
tctcctggagaaagaatggaga

SEQ ID NO: 900583 - DNA, 22 bp, Artificial Sequence
  chemically synthesized
ctgcctcctgtctctccattct

SEQ ID NO: 900584 - DNA, 22 bp, Artificial Sequence
  chemically synthesized
tcctgcctcctgtctctccatt

SEQ ID NO: 900585 - DNA, 22 bp, Artificial Sequence
  chemically synthesized
ctggagaaagaatggagagaca

SEQ ID NO: 900586 - DNA, 22 bp, Artificial Sequence
  chemically synthesized
tctcctgcctcctgtctctcca

SEQ ID NO: 900587 - DNA, 22 bp, Artificial Sequence
  chemically synthesized
ctctcctgcctcctgtctctcc

SEQ ID NO: 900588 - DNA, 22 bp, Artificial Sequence
  chemically synthesized
gagaaagaatggagagacagga

SEQ ID NO: 900589 - DNA, 22 bp, Artificial Sequence
  chemically synthesized
tgaaatcatccttctctcctgc

SEQ ID NO: 900590 - DNA, 22 bp, Artificial Sequence
  chemically synthesized
tgtgaaatcatccttctctcct

SEQ ID NO: 900591 - DNA, 22 bp, Artificial Sequence
  chemically synthesized
aaatgagatatcctctgtgaaa

SEQ ID NO: 900592 - DNA, 22 bp, Artificial Sequence
  chemically synthesized
acagaaaattcaaatgagatat

SEQ ID NO: 900593 - DNA, 22 bp, Artificial Sequence
  chemically synthesized
cacagaggatatctcatttgaa

SEQ ID NO: 900594 - DNA, 22 bp, Artificial Sequence
  chemically synthesized
attaacagaaaattcaaatgag

SEQ ID NO: 900595 - DNA, 22 bp, Artificial Sequence
  chemically synthesized
acagaggatatctcatttgaat

SEQ ID NO: 900596 - DNA, 22 bp, Artificial Sequence
  chemically synthesized
cccattaattaacagaaaattc

SEQ ID NO: 900597 - DNA, 22 bp, Artificial Sequence
  chemically synthesized
acccattaattaacagaaaatt

SEQ ID NO: 900598 - DNA, 22 bp, Artificial Sequence
  chemically synthesized
atttgaattttctgttaattaa

SEQ ID NO: 900599 - DNA, 22 bp, Artificial Sequence
  chemically synthesized
gatagtttacccattaattaac

SEQ ID NO: 900600 - DNA, 22 bp, Artificial Sequence
  chemically synthesized
cgatagtttacccattaattaa

SEQ ID NO: 900601 - DNA, 22 bp, Artificial Sequence
  chemically synthesized
tcgatagtttacccattaatta

SEQ ID NO: 900602 - DNA, 22 bp, Artificial Sequence
  chemically synthesized
gaattttctgttaattaatggg

SEQ ID NO: 900603 - DNA, 22 bp, Artificial Sequence
  chemically synthesized
aattttctgttaattaatgggt

SEQ ID NO: 900604 - DNA, 22 bp, Artificial Sequence
  chemically synthesized
tctgttaattaatgggtaaact

SEQ ID NO: 900605 - DNA, 22 bp, Artificial Sequence
  chemically synthesized
ctgttaattaatgggtaaacta

SEQ ID NO: 900606 - DNA, 22 bp, Artificial Sequence
  chemically synthesized
tgttaattaatgggtaaactat

SEQ ID NO: 900607 - DNA, 22 bp, Artificial Sequence
  chemically synthesized
ttaattaatgggtaaactatcg

SEQ ID NO: 900608 - DNA, 22 bp, Artificial Sequence
  chemically synthesized
cgcagaatagctttcgatagtt

SEQ ID NO: 900609 - DNA, 22 bp, Artificial Sequence
  chemically synthesized
attaatgggtaaactatcgaaa

SEQ ID NO: 900610 - DNA, 22 bp, Artificial Sequence
  chemically synthesized
atgggtaaactatcgaaagcta

SEQ ID NO: 900611 - DNA, 22 bp, Artificial Sequence
  chemically synthesized
atgggctgcgcagaatagcttt

SEQ ID NO: 900612 - DNA, 22 bp, Artificial Sequence
  chemically synthesized
aatgggctgcgcagaatagctt

SEQ ID NO: 900613 - DNA, 22 bp, Artificial Sequence
  chemically synthesized
taatgggctgcgcagaatagct

SEQ ID NO: 900614 - DNA, 22 bp, Artificial Sequence
  chemically synthesized
ttaatgggctgcgcagaatagc

SEQ ID NO: 900615 - DNA, 22 bp, Artificial Sequence
  chemically synthesized
tcgaaagctattctgcgcagcc

SEQ ID NO: 900616 - DNA, 22 bp, Artificial Sequence
  chemically synthesized
ttctgcgcagcccattaaaagg

SEQ ID NO: 900617 - DNA, 22 bp, Artificial Sequence
  chemically synthesized
agccaacagagtaccttttaat

SEQ ID NO: 900618 - DNA, 22 bp, Artificial Sequence
  chemically synthesized
gagccaacagagtaccttttaa

SEQ ID NO: 900619 - DNA, 22 bp, Artificial Sequence
  chemically synthesized
tgcgcagcccattaaaaggtac

SEQ ID NO: 900620 - DNA, 22 bp, Artificial Sequence
  chemically synthesized
cgcagcccattaaaaggtactc

SEQ ID NO: 900621 - DNA, 22 bp, Artificial Sequence
  chemically synthesized
tcaagcttgagccaacagagta

SEQ ID NO: 900622 - DNA, 22 bp, Artificial Sequence
  chemically synthesized
aaaggtactctgttggctcaag

SEQ ID NO: 900623 - DNA, 22 bp, Artificial Sequence
  chemically synthesized
acacactgtcaagcttgagcca

SEQ ID NO: 900624 - DNA, 22 bp, Artificial Sequence
  chemically synthesized
ctcacacactgtcaagcttgag

SEQ ID NO: 900625 - DNA, 22 bp, Artificial Sequence
  chemically synthesized
cctcacacactgtcaagcttga

SEQ ID NO: 900626 - DNA, 22 bp, Artificial Sequence
  chemically synthesized
ttcctcacacactgtcaagctt

SEQ ID NO: 900627 - DNA, 22 bp, Artificial Sequence
  chemically synthesized
cttcctcacacactgtcaagct

SEQ ID NO: 900628 - DNA, 22 bp, Artificial Sequence
  chemically synthesized
tgttggctcaagcttgacagtg

SEQ ID NO: 900629 - DNA, 22 bp, Artificial Sequence
  chemically synthesized
ttcttcctcacacactgtcaag

SEQ ID NO: 900630 - DNA, 22 bp, Artificial Sequence
  chemically synthesized
cttcttcctcacacactgtcaa

SEQ ID NO: 900631 - DNA, 22 bp, Artificial Sequence
  chemically synthesized
ttggctcaagcttgacagtgtg

SEQ ID NO: 900632 - DNA, 22 bp, Artificial Sequence
  chemically synthesized
tcttcttcctcacacactgtca

SEQ ID NO: 900633 - DNA, 22 bp, Artificial Sequence
  chemically synthesized
tttcttcttcctcacacactgt

SEQ ID NO: 900634 - DNA, 22 bp, Artificial Sequence
  chemically synthesized
gctcaagcttgacagtgtgtga

SEQ ID NO: 900635 - DNA, 22 bp, Artificial Sequence
  chemically synthesized
aagcttgacagtgtgtgaggaa

SEQ ID NO: 900636 - DNA, 22 bp, Artificial Sequence
  chemically synthesized
gacagtgtgtgaggaagaagaa

SEQ ID NO: 900637 - DNA, 22 bp, Artificial Sequence
  chemically synthesized
acagtgtgtgaggaagaagaaa

SEQ ID NO: 900638 - DNA, 22 bp, Artificial Sequence
  chemically synthesized
gtcataagatctctttcttctt

SEQ ID NO: 900639 - DNA, 22 bp, Artificial Sequence
  chemically synthesized
taaggcaaccctagtcataaga

SEQ ID NO: 900640 - DNA, 22 bp, Artificial Sequence
  chemically synthesized
ataaggcaaccctagtcataag

SEQ ID NO: 900641 - DNA, 22 bp, Artificial Sequence
  chemically synthesized
tataaggcaaccctagtcataa

SEQ ID NO: 900642 - DNA, 22 bp, Artificial Sequence
  chemically synthesized
tattttataaggcaaccctagt

SEQ ID NO: 900643 - DNA, 22 bp, Artificial Sequence
  chemically synthesized
atgactagggttgccttataaa

SEQ ID NO: 900644 - DNA, 22 bp, Artificial Sequence
  chemically synthesized
tgactagggttgccttataaaa

SEQ ID NO: 900645 - DNA, 22 bp, Artificial Sequence
  chemically synthesized
gggttgccttataaaatacagg

SEQ ID NO: 900646 - DNA, 22 bp, Artificial Sequence
  chemically synthesized
ccttataaaatacaggatacca

SEQ ID NO: 900647 - DNA, 22 bp, Artificial Sequence
  chemically synthesized
tacaaaatgtaaatggtatcct

SEQ ID NO: 900648 - DNA, 22 bp, Artificial Sequence
  chemically synthesized
atacaaaatgtaaatggtatcc

SEQ ID NO: 900649 - DNA, 22 bp, Artificial Sequence
  chemically synthesized
ataaaatacaggataccattta

SEQ ID NO: 900650 - DNA, 22 bp, Artificial Sequence
  chemically synthesized
taaaatacaggataccatttac

SEQ ID NO: 900651 - DNA, 22 bp, Artificial Sequence
  chemically synthesized
cttatacaaaatgtaaatggta

SEQ ID NO: 900652 - DNA, 22 bp, Artificial Sequence
  chemically synthesized
aaaagtatcgattgcttataca

SEQ ID NO: 900653 - DNA, 22 bp, Artificial Sequence
  chemically synthesized
acattttgtataagcaatcgat

SEQ ID NO: 900654 - DNA, 22 bp, Artificial Sequence
  chemically synthesized
cattttgtataagcaatcgata

SEQ ID NO: 900655 - DNA, 22 bp, Artificial Sequence
  chemically synthesized
tgtataagcaatcgatactttt

SEQ ID NO: 900656 - DNA, 22 bp, Artificial Sequence
  chemically synthesized
gtataagcaatcgatacttttc

SEQ ID NO: 900657 - DNA, 22 bp, Artificial Sequence
  chemically synthesized
tataagcaatcgatacttttca

SEQ ID NO: 900658 - DNA, 22 bp, Artificial Sequence
  chemically synthesized
caacaaaaaatactgaaaagta

SEQ ID NO: 900659 - DNA, 22 bp, Artificial Sequence
  chemically synthesized
tgtcccaaatactacaacaaaa

SEQ ID NO: 900660 - DNA, 22 bp, Artificial Sequence
  chemically synthesized
ttcagtattttttgttgtagta

SEQ ID NO: 900661 - DNA, 22 bp, Artificial Sequence
  chemically synthesized
tcagtattttttgttgtagtat

SEQ ID NO: 900662 - DNA, 22 bp, Artificial Sequence
  chemically synthesized
cagtattttttgttgtagtatt

SEQ ID NO: 900663 - DNA, 22 bp, Artificial Sequence
  chemically synthesized
agtattttttgttgtagtattt

SEQ ID NO: 900664 - DNA, 22 bp, Artificial Sequence
  chemically synthesized
agcataactatgtcccaaatac

SEQ ID NO: 900665 - DNA, 22 bp, Artificial Sequence
  chemically synthesized
taagcataactatgtcccaaat

SEQ ID NO: 900666 - DNA, 22 bp, Artificial Sequence
  chemically synthesized
tttgttgtagtatttgggacat

SEQ ID NO: 900667 - DNA, 22 bp, Artificial Sequence
  chemically synthesized
ttgttgtagtatttgggacata

SEQ ID NO: 900668 - DNA, 22 bp, Artificial Sequence
  chemically synthesized
tgttgtagtatttgggacatag

SEQ ID NO: 900669 - DNA, 22 bp, Artificial Sequence
  chemically synthesized
gttgtagtatttgggacatagt

SEQ ID NO: 900670 - DNA, 22 bp, Artificial Sequence
  chemically synthesized
ttgtagtatttgggacatagtt

SEQ ID NO: 900671 - DNA, 22 bp, Artificial Sequence
  chemically synthesized
tagtatttgggacatagttatg

SEQ ID NO: 900672 - DNA, 22 bp, Artificial Sequence
  chemically synthesized
gggacatagttatgcttagaat

SEQ ID NO: 900673 - DNA, 22 bp, Artificial Sequence
  chemically synthesized
ggacatagttatgcttagaatt

SEQ ID NO: 900674 - DNA, 22 bp, Artificial Sequence
  chemically synthesized
tgcttagaattctggatgtttc

SEQ ID NO: 900675 - DNA, 22 bp, Artificial Sequence
  chemically synthesized
gcaaataaaaatatgaaacatc

SEQ ID NO: 900676 - DNA, 22 bp, Artificial Sequence
  chemically synthesized
agaattctggatgtttcatatt

SEQ ID NO: 900677 - DNA, 22 bp, Artificial Sequence
  chemically synthesized
gaattctggatgtttcatattt

SEQ ID NO: 900678 - DNA, 22 bp, Artificial Sequence
  chemically synthesized
tggatgtttcatatttttattt

SEQ ID NO: 900679 - DNA, 22 bp, Artificial Sequence
  chemically synthesized
gatgtttcatatttttatttgc

SEQ ID NO: 900680 - DNA, 22 bp, Artificial Sequence
  chemically synthesized
ggatcccaagaattagcaaata

SEQ ID NO: 900681 - DNA, 22 bp, Artificial Sequence
  chemically synthesized
catatttttatttgctaattct

SEQ ID NO: 900682 - DNA, 22 bp, Artificial Sequence
  chemically synthesized
atatttttatttgctaattctt

SEQ ID NO: 900683 - DNA, 22 bp, Artificial Sequence
  chemically synthesized
ttatttgctaattcttgggatc

SEQ ID NO: 900684 - DNA, 22 bp, Artificial Sequence
  chemically synthesized
tatttgctaattcttgggatcc

SEQ ID NO: 900685 - DNA, 22 bp, Artificial Sequence
  chemically synthesized
cagtcataactaggatcccaag

SEQ ID NO: 900686 - DNA, 22 bp, Artificial Sequence
  chemically synthesized
atttgctaattcttgggatcct

SEQ ID NO: 900687 - DNA, 22 bp, Artificial Sequence
  chemically synthesized
tttgctaattcttgggatccta

SEQ ID NO: 900688 - DNA, 22 bp, Artificial Sequence
  chemically synthesized
gctaattcttgggatcctagtt

SEQ ID NO: 900689 - DNA, 22 bp, Artificial Sequence
  chemically synthesized
ctaattcttgggatcctagtta

SEQ ID NO: 900690 - DNA, 22 bp, Artificial Sequence
  chemically synthesized
cacattccagtcataactagga

SEQ ID NO: 900691 - DNA, 22 bp, Artificial Sequence
  chemically synthesized
ccacattccagtcataactagg

SEQ ID NO: 900692 - DNA, 22 bp, Artificial Sequence
  chemically synthesized
attcttgggatcctagttatga

SEQ ID NO: 900693 - DNA, 22 bp, Artificial Sequence
  chemically synthesized
ttccacattccagtcataacta

SEQ ID NO: 900694 - DNA, 22 bp, Artificial Sequence
  chemically synthesized
cttccacattccagtcataact

SEQ ID NO: 900695 - DNA, 22 bp, Artificial Sequence
  chemically synthesized
tcttccacattccagtcataac

SEQ ID NO: 900696 - DNA, 22 bp, Artificial Sequence
  chemically synthesized
ttgggatcctagttatgactgg

SEQ ID NO: 900697 - DNA, 22 bp, Artificial Sequence
  chemically synthesized
gggatcctagttatgactggaa

SEQ ID NO: 900698 - DNA, 22 bp, Artificial Sequence
  chemically synthesized
ttttcttccacattccagtcat

SEQ ID NO: 900699 - DNA, 22 bp, Artificial Sequence
  chemically synthesized
ggatcctagttatgactggaat

SEQ ID NO: 900700 - DNA, 22 bp, Artificial Sequence
  chemically synthesized
gtattgttttcttccacattcc

SEQ ID NO: 900701 - DNA, 22 bp, Artificial Sequence
  chemically synthesized
gttatgactggaatgtggaaga

SEQ ID NO: 900702 - DNA, 22 bp, Artificial Sequence
  chemically synthesized
agctggtattgttttcttccac

SEQ ID NO: 900703 - DNA, 22 bp, Artificial Sequence
  chemically synthesized
tgactggaatgtggaagaaaac

SEQ ID NO: 900704 - DNA, 22 bp, Artificial Sequence
  chemically synthesized
gaatgtggaagaaaacaatacc

SEQ ID NO: 900705 - DNA, 22 bp, Artificial Sequence
  chemically synthesized
aaatcatattcagctggtattg

SEQ ID NO: 900706 - DNA, 22 bp, Artificial Sequence
  chemically synthesized
caaatcatattcagctggtatt

SEQ ID NO: 900707 - DNA, 22 bp, Artificial Sequence
  chemically synthesized
ttcaaatcatattcagctggta

SEQ ID NO: 900708 - DNA, 22 bp, Artificial Sequence
  chemically synthesized
aatatgatttgaagagttttgt

SEQ ID NO: 900709 - DNA, 22 bp, Artificial Sequence
  chemically synthesized
catgtcatggcacacaaaactc

SEQ ID NO: 900710 - DNA, 22 bp, Artificial Sequence
  chemically synthesized
aaaactccatgtcatggcacac

SEQ ID NO: 900711 - DNA, 22 bp, Artificial Sequence
  chemically synthesized
gaagagttttgtgtgccatgac

SEQ ID NO: 900712 - DNA, 22 bp, Artificial Sequence
  chemically synthesized
aagagttttgtgtgccatgaca

SEQ ID NO: 900713 - DNA, 22 bp, Artificial Sequence
  chemically synthesized
tgtgtgccatgacatggagttt

SEQ ID NO: 900714 - DNA, 22 bp, Artificial Sequence
  chemically synthesized
gtgtgccatgacatggagtttt

SEQ ID NO: 900715 - DNA, 22 bp, Artificial Sequence
  chemically synthesized
tagaataagttcaaaactccat

SEQ ID NO: 900716 - DNA, 22 bp, Artificial Sequence
  chemically synthesized
tgtgccatgacatggagttttg

SEQ ID NO: 900717 - DNA, 22 bp, Artificial Sequence
  chemically synthesized
tccctgtagaataagttcaaaa

SEQ ID NO: 900718 - DNA, 22 bp, Artificial Sequence
  chemically synthesized
atccctgtagaataagttcaaa

SEQ ID NO: 900719 - DNA, 22 bp, Artificial Sequence
  chemically synthesized
aaaagtgtttatccctgtagaa

SEQ ID NO: 900720 - DNA, 22 bp, Artificial Sequence
  chemically synthesized
caaaagtgtttatccctgtaga

SEQ ID NO: 900721 - DNA, 22 bp, Artificial Sequence
  chemically synthesized
tcaaaagtgtttatccctgtag

SEQ ID NO: 900722 - DNA, 22 bp, Artificial Sequence
  chemically synthesized
ttcaaaagtgtttatccctgta

SEQ ID NO: 900723 - DNA, 22 bp, Artificial Sequence
  chemically synthesized
tgaacttattctacagggataa

SEQ ID NO: 900724 - DNA, 22 bp, Artificial Sequence
  chemically synthesized
gaacttattctacagggataaa

SEQ ID NO: 900725 - DNA, 22 bp, Artificial Sequence
  chemically synthesized
ttttcaaaagtgtttatccctg

SEQ ID NO: 900726 - DNA, 22 bp, Artificial Sequence
  chemically synthesized
aacttattctacagggataaac

SEQ ID NO: 900727 - DNA, 22 bp, Artificial Sequence
  chemically synthesized
attctacagggataaacacttt

SEQ ID NO: 900728 - DNA, 22 bp, Artificial Sequence
  chemically synthesized
ttctacagggataaacactttt

SEQ ID NO: 900729 - DNA, 22 bp, Artificial Sequence
  chemically synthesized
tataaactcttttcaaaagtgt

SEQ ID NO: 900730 - DNA, 22 bp, Artificial Sequence
  chemically synthesized
tacagggataaacacttttgaa

SEQ ID NO: 900731 - DNA, 22 bp, Artificial Sequence
  chemically synthesized
gtataaactcttttcaaaagtg

SEQ ID NO: 900732 - DNA, 22 bp, Artificial Sequence
  chemically synthesized
tgtataaactcttttcaaaagt

SEQ ID NO: 900733 - DNA, 22 bp, Artificial Sequence
  chemically synthesized
cagggataaacacttttgaaaa

SEQ ID NO: 900734 - DNA, 22 bp, Artificial Sequence
  chemically synthesized
aagtcaactttgtataaactct

SEQ ID NO: 900735 - DNA, 22 bp, Artificial Sequence
  chemically synthesized
taaagtcaactttgtataaact

SEQ ID NO: 900736 - DNA, 22 bp, Artificial Sequence
  chemically synthesized
ctaaagtcaactttgtataaac

SEQ ID NO: 900737 - DNA, 22 bp, Artificial Sequence
  chemically synthesized
ttgaaaagagtttatacaaagt

SEQ ID NO: 900738 - DNA, 22 bp, Artificial Sequence
  chemically synthesized
tgaaaagagtttatacaaagtt

SEQ ID NO: 900739 - DNA, 22 bp, Artificial Sequence
  chemically synthesized
gaaaagagtttatacaaagttg

SEQ ID NO: 900740 - DNA, 22 bp, Artificial Sequence
  chemically synthesized
aaaagagtttatacaaagttga

SEQ ID NO: 900741 - DNA, 22 bp, Artificial Sequence
  chemically synthesized
atccttctaaagtcaactttgt

SEQ ID NO: 900742 - DNA, 22 bp, Artificial Sequence
  chemically synthesized
taatccttctaaagtcaacttt

SEQ ID NO: 900743 - DNA, 22 bp, Artificial Sequence
  chemically synthesized
actctaatccttctaaagtcaa

SEQ ID NO: 900744 - DNA, 22 bp, Artificial Sequence
  chemically synthesized
gactctaatccttctaaagtca

SEQ ID NO: 900745 - DNA, 22 bp, Artificial Sequence
  chemically synthesized
tgactctaatccttctaaagtc

SEQ ID NO: 900746 - DNA, 22 bp, Artificial Sequence
  chemically synthesized
atacaaagttgactttagaagg

SEQ ID NO: 900747 - DNA, 22 bp, Artificial Sequence
  chemically synthesized
tacaaagttgactttagaagga

SEQ ID NO: 900748 - DNA, 22 bp, Artificial Sequence
  chemically synthesized
aagtccccctttgactctaatc

SEQ ID NO: 900749 - DNA, 22 bp, Artificial Sequence
  chemically synthesized
caagtccccctttgactctaat

SEQ ID NO: 900750 - DNA, 22 bp, Artificial Sequence
  chemically synthesized
actttagaaggattagagtcaa

SEQ ID NO: 900751 - DNA, 22 bp, Artificial Sequence
  chemically synthesized
tagaaggattagagtcaaaggg

SEQ ID NO: 900752 - DNA, 22 bp, Artificial Sequence
  chemically synthesized
agaaggattagagtcaaagggg

SEQ ID NO: 900753 - DNA, 22 bp, Artificial Sequence
  chemically synthesized
gaaggattagagtcaaaggggg

SEQ ID NO: 900754 - DNA, 22 bp, Artificial Sequence
  chemically synthesized
atggtttcaagtccccctttga

SEQ ID NO: 900755 - DNA, 22 bp, Artificial Sequence
  chemically synthesized
aatggtttcaagtccccctttg

SEQ ID NO: 900756 - DNA, 22 bp, Artificial Sequence
  chemically synthesized
ttaatggtttcaagtccccctt

SEQ ID NO: 900757 - DNA, 22 bp, Artificial Sequence
  chemically synthesized
cttaatggtttcaagtccccct

SEQ ID NO: 900758 - DNA, 22 bp, Artificial Sequence
  chemically synthesized
acttcttaatggtttcaagtcc

SEQ ID NO: 900759 - DNA, 22 bp, Artificial Sequence
  chemically synthesized
gagtcaaagggggacttgaaac

SEQ ID NO: 900760 - DNA, 22 bp, Artificial Sequence
  chemically synthesized
gacttcttaatggtttcaagtc

SEQ ID NO: 900761 - DNA, 22 bp, Artificial Sequence
  chemically synthesized
gggcttgacttcttaatggttt

SEQ ID NO: 900762 - DNA, 22 bp, Artificial Sequence
  chemically synthesized
ctggggcttgacttcttaatgg

SEQ ID NO: 900763 - DNA, 22 bp, Artificial Sequence
  chemically synthesized
gaaaccattaagaagtcaagcc

SEQ ID NO: 900764 - DNA, 22 bp, Artificial Sequence
  chemically synthesized
aaaccattaagaagtcaagccc

SEQ ID NO: 900765 - DNA, 22 bp, Artificial Sequence
  chemically synthesized
atgccattactggggcttgact

SEQ ID NO: 900766 - DNA, 22 bp, Artificial Sequence
  chemically synthesized
ttcatgccattactggggcttg

SEQ ID NO: 900767 - DNA, 22 bp, Artificial Sequence
  chemically synthesized
tgttcatgccattactggggct

SEQ ID NO: 900768 - DNA, 22 bp, Artificial Sequence
  chemically synthesized
agaagtcaagccccagtaatgg

SEQ ID NO: 900769 - DNA, 22 bp, Artificial Sequence
  chemically synthesized
gaaagcagaatgagctctgttc

SEQ ID NO: 900770 - DNA, 22 bp, Artificial Sequence
  chemically synthesized
ggaaagcagaatgagctctgtt

SEQ ID NO: 900771 - DNA, 22 bp, Artificial Sequence
  chemically synthesized
gatatttggaaagcagaatgag

SEQ ID NO: 900772 - DNA, 22 bp, Artificial Sequence
  chemically synthesized
cagattagatatttggaaagca

SEQ ID NO: 900773 - DNA, 22 bp, Artificial Sequence
  chemically synthesized
ctgcagattagatatttggaaa

SEQ ID NO: 900774 - DNA, 22 bp, Artificial Sequence
  chemically synthesized
attctgctttccaaatatctaa

SEQ ID NO: 900775 - DNA, 22 bp, Artificial Sequence
  chemically synthesized
agtatctactgcagattagata

SEQ ID NO: 900776 - DNA, 22 bp, Artificial Sequence
  chemically synthesized
tgctttccaaatatctaatctg

SEQ ID NO: 900777 - DNA, 22 bp, Artificial Sequence
  chemically synthesized
ctttccaaatatctaatctgca

SEQ ID NO: 900778 - DNA, 22 bp, Artificial Sequence
  chemically synthesized
tccaaatatctaatctgcagta

SEQ ID NO: 900779 - DNA, 22 bp, Artificial Sequence
  chemically synthesized
ccaaatatctaatctgcagtag

SEQ ID NO: 900780 - DNA, 22 bp, Artificial Sequence
  chemically synthesized
caaatatctaatctgcagtaga

SEQ ID NO: 900781 - DNA, 22 bp, Artificial Sequence
  chemically synthesized
cagccactaagtatctactgca

SEQ ID NO: 900782 - DNA, 22 bp, Artificial Sequence
  chemically synthesized
atctgcagtagatacttagtgg

SEQ ID NO: 900783 - DNA, 22 bp, Artificial Sequence
  chemically synthesized
cagtagatacttagtggctgga

SEQ ID NO: 900784 - DNA, 22 bp, Artificial Sequence
  chemically synthesized
agtggctggaatcacctctgac

SEQ ID NO: 900785 - DNA, 22 bp, Artificial Sequence
  chemically synthesized
gtggctggaatcacctctgaca

SEQ ID NO: 900786 - DNA, 22 bp, Artificial Sequence
  chemically synthesized
tcacaggtcagccatgtcagag

SEQ ID NO: 900787 - DNA, 22 bp, Artificial Sequence
  chemically synthesized
gaatcacctctgacatggctga

SEQ ID NO: 900788 - DNA, 22 bp, Artificial Sequence
  chemically synthesized
tgacatggctgacctgtgacag

SEQ ID NO: 900789 - DNA, 22 bp, Artificial Sequence
  chemically synthesized
acatggctgacctgtgacagct

SEQ ID NO: 900790 - DNA, 22 bp, Artificial Sequence
  chemically synthesized
gcaatgtgcagatgaaatagct

SEQ ID NO: 900791 - DNA, 22 bp, Artificial Sequence
  chemically synthesized
acctgtgacagctatttcatct

SEQ ID NO: 900792 - DNA, 22 bp, Artificial Sequence
  chemically synthesized
tgacagctatttcatctgcaca

SEQ ID NO: 900793 - DNA, 22 bp, Artificial Sequence
  chemically synthesized
agcacagagatattggcaatgt

SEQ ID NO: 900794 - DNA, 22 bp, Artificial Sequence
  chemically synthesized
tttcatctgcacattgccaata

SEQ ID NO: 900795 - DNA, 22 bp, Artificial Sequence
  chemically synthesized
ctaagcacagagatattggcaa

SEQ ID NO: 900796 - DNA, 22 bp, Artificial Sequence
  chemically synthesized
catctgcacattgccaatatct

SEQ ID NO: 900797 - DNA, 22 bp, Artificial Sequence
  chemically synthesized
atctgcacattgccaatatctc

SEQ ID NO: 900798 - DNA, 22 bp, Artificial Sequence
  chemically synthesized
cacattgccaatatctctgtgc

SEQ ID NO: 900799 - DNA, 22 bp, Artificial Sequence
  chemically synthesized
gagaatctcctaagcacagaga

SEQ ID NO: 900800 - DNA, 22 bp, Artificial Sequence
  chemically synthesized
agagaatctcctaagcacagag

SEQ ID NO: 900801 - DNA, 22 bp, Artificial Sequence
  chemically synthesized
tagagaatctcctaagcacaga

SEQ ID NO: 900802 - DNA, 22 bp, Artificial Sequence
  chemically synthesized
ccaatatctctgtgcttaggag

SEQ ID NO: 900803 - DNA, 22 bp, Artificial Sequence
  chemically synthesized
tgccgcgctttagagaatctcc

SEQ ID NO: 900804 - DNA, 22 bp, Artificial Sequence
  chemically synthesized
tgtgcttaggagattctctaaa

SEQ ID NO: 900805 - DNA, 22 bp, Artificial Sequence
  chemically synthesized
tgcttaggagattctctaaagc

SEQ ID NO: 900806 - DNA, 22 bp, Artificial Sequence
  chemically synthesized
aggagattctctaaagcgcggc

SEQ ID NO: 900807 - DNA, 22 bp, Artificial Sequence
  chemically synthesized
ggagattctctaaagcgcggca

SEQ ID NO: 900808 - DNA, 22 bp, Artificial Sequence
  chemically synthesized
tctaaagcgcggcataattttt

SEQ ID NO: 900809 - DNA, 22 bp, Artificial Sequence
  chemically synthesized
taaagcgcggcataatttttct

SEQ ID NO: 900810 - DNA, 22 bp, Artificial Sequence
  chemically synthesized
aagcgcggcataatttttcttg

SEQ ID NO: 900811 - DNA, 22 bp, Artificial Sequence
  chemically synthesized
atgaaacaggaaaggggaaatc

SEQ ID NO: 900812 - DNA, 22 bp, Artificial Sequence
  chemically synthesized
ttcttggatttcccctttcctg

SEQ ID NO: 900813 - DNA, 22 bp, Artificial Sequence
  chemically synthesized
tcttggatttcccctttcctgt

SEQ ID NO: 900814 - DNA, 22 bp, Artificial Sequence
  chemically synthesized
cttggatttcccctttcctgtt

SEQ ID NO: 900815 - DNA, 22 bp, Artificial Sequence
  chemically synthesized
ttggatttcccctttcctgttt

SEQ ID NO: 900816 - DNA, 22 bp, Artificial Sequence
  chemically synthesized
ggatttcccctttcctgtttca

SEQ ID NO: 900817 - DNA, 22 bp, Artificial Sequence
  chemically synthesized
gatttcccctttcctgtttcat

SEQ ID NO: 900818 - DNA, 22 bp, Artificial Sequence
  chemically synthesized
cccctttcctgtttcattaacc

SEQ ID NO: 900819 - DNA, 22 bp, Artificial Sequence
  chemically synthesized
ccctttcctgtttcattaaccc

SEQ ID NO: 900820 - DNA, 22 bp, Artificial Sequence
  chemically synthesized
tcctgtttcattaaccctattc

SEQ ID NO: 900821 - DNA, 22 bp, Artificial Sequence
  chemically synthesized
cctgtttcattaaccctattct

SEQ ID NO: 900822 - DNA, 22 bp, Artificial Sequence
  chemically synthesized
ctgtttcattaaccctattctt

SEQ ID NO: 900823 - DNA, 22 bp, Artificial Sequence
  chemically synthesized
aaatgtaagagtgaaagaatag

SEQ ID NO: 900824 - DNA, 22 bp, Artificial Sequence
  chemically synthesized
tttcattaaccctattctttca

SEQ ID NO: 900825 - DNA, 22 bp, Artificial Sequence
  chemically synthesized
cattaaccctattctttcactc

SEQ ID NO: 900826 - DNA, 22 bp, Artificial Sequence
  chemically synthesized
attaaccctattctttcactct

SEQ ID NO: 900827 - DNA, 22 bp, Artificial Sequence
  chemically synthesized
atcctcaaatgtaagagtgaaa

SEQ ID NO: 900828 - DNA, 22 bp, Artificial Sequence
  chemically synthesized
accctattctttcactcttaca

SEQ ID NO: 900829 - DNA, 22 bp, Artificial Sequence
  chemically synthesized
ttctttcactcttacatttgag

SEQ ID NO: 900830 - DNA, 22 bp, Artificial Sequence
  chemically synthesized
tttcactcttacatttgaggat

SEQ ID NO: 900831 - DNA, 22 bp, Artificial Sequence
  chemically synthesized
tcactcttacatttgaggatga

SEQ ID NO: 900832 - DNA, 22 bp, Artificial Sequence
  chemically synthesized
cactcttacatttgaggatgaa

SEQ ID NO: 900833 - DNA, 22 bp, Artificial Sequence
  chemically synthesized
gaagcagagaagttcatcctca

SEQ ID NO: 900834 - DNA, 22 bp, Artificial Sequence
  chemically synthesized
actcttacatttgaggatgaac

SEQ ID NO: 900835 - DNA, 22 bp, Artificial Sequence
  chemically synthesized
ttacatttgaggatgaacttct

SEQ ID NO: 900836 - DNA, 22 bp, Artificial Sequence
  chemically synthesized
acatttgaggatgaacttctct

SEQ ID NO: 900837 - DNA, 22 bp, Artificial Sequence
  chemically synthesized
catttgaggatgaacttctctg

SEQ ID NO: 900838 - DNA, 22 bp, Artificial Sequence
  chemically synthesized
gaggatgaacttctctgcttcc

SEQ ID NO: 900839 - DNA, 22 bp, Artificial Sequence
  chemically synthesized
aggatgaacttctctgcttcca

SEQ ID NO: 900840 - DNA, 22 bp, Artificial Sequence
  chemically synthesized
ctctgcttccaatttcttgtct

SEQ ID NO: 900841 - DNA, 22 bp, Artificial Sequence
  chemically synthesized
tctgcttccaatttcttgtctt

SEQ ID NO: 900842 - DNA, 22 bp, Artificial Sequence
  chemically synthesized
aagaacagaatgtaagacaaga

SEQ ID NO: 900843 - DNA, 22 bp, Artificial Sequence
  chemically synthesized
tgcttccaatttcttgtcttac

SEQ ID NO: 900844 - DNA, 22 bp, Artificial Sequence
  chemically synthesized
cttccaatttcttgtcttacat

SEQ ID NO: 900845 - DNA, 22 bp, Artificial Sequence
  chemically synthesized
ccaatttcttgtcttacattct

SEQ ID NO: 900846 - DNA, 22 bp, Artificial Sequence
  chemically synthesized
caatttcttgtcttacattctg

SEQ ID NO: 900847 - DNA, 22 bp, Artificial Sequence
  chemically synthesized
aatacactcaagaacagaatgt

SEQ ID NO: 900848 - DNA, 22 bp, Artificial Sequence
  chemically synthesized
aaatacactcaagaacagaatg

SEQ ID NO: 900849 - DNA, 22 bp, Artificial Sequence
  chemically synthesized
cttgtcttacattctgttcttg

SEQ ID NO: 900850 - DNA, 22 bp, Artificial Sequence
  chemically synthesized
ttgtcttacattctgttcttga

SEQ ID NO: 900851 - DNA, 22 bp, Artificial Sequence
  chemically synthesized
gtttaaatacactcaagaacag

SEQ ID NO: 900852 - DNA, 22 bp, Artificial Sequence
  chemically synthesized
gtcttacattctgttcttgagt

SEQ ID NO: 900853 - DNA, 22 bp, Artificial Sequence
  chemically synthesized
tcttacattctgttcttgagtg

SEQ ID NO: 900854 - DNA, 22 bp, Artificial Sequence
  chemically synthesized
acattctgttcttgagtgtatt

SEQ ID NO: 900855 - DNA, 22 bp, Artificial Sequence
  chemically synthesized
cattctgttcttgagtgtattt

SEQ ID NO: 900856 - DNA, 22 bp, Artificial Sequence
  chemically synthesized
tgttcttgagtgtatttaaact

SEQ ID NO: 900857 - DNA, 22 bp, Artificial Sequence
  chemically synthesized
ttcttgagtgtatttaaactaa

SEQ ID NO: 900858 - DNA, 22 bp, Artificial Sequence
  chemically synthesized
ttgagtgtatttaaactaacac

SEQ ID NO: 900859 - DNA, 22 bp, Artificial Sequence
  chemically synthesized
gagtgtatttaaactaacactt

SEQ ID NO: 900860 - DNA, 22 bp, Artificial Sequence
  chemically synthesized
agtgtatttaaactaacacttt

SEQ ID NO: 900861 - DNA, 22 bp, Artificial Sequence
  chemically synthesized
gaagaaatggaaaaggataaag

SEQ ID NO: 900862 - DNA, 22 bp, Artificial Sequence
  chemically synthesized
ggaagaaatggaaaaggataaa

SEQ ID NO: 900863 - DNA, 22 bp, Artificial Sequence
  chemically synthesized
tggaagaaatggaaaaggataa

SEQ ID NO: 900864 - DNA, 22 bp, Artificial Sequence
  chemically synthesized
aaactaacactttatccttttc

SEQ ID NO: 900865 - DNA, 22 bp, Artificial Sequence
  chemically synthesized
ttggaagaaatggaaaaggata

SEQ ID NO: 900866 - DNA, 22 bp, Artificial Sequence
  chemically synthesized
aactaacactttatccttttcc

SEQ ID NO: 900867 - DNA, 22 bp, Artificial Sequence
  chemically synthesized
tttggaagaaatggaaaaggat

SEQ ID NO: 900868 - DNA, 22 bp, Artificial Sequence
  chemically synthesized
ctttttggaagaaatggaaaag

SEQ ID NO: 900869 - DNA, 22 bp, Artificial Sequence
  chemically synthesized
actttttggaagaaatggaaaa

SEQ ID NO: 900870 - DNA, 22 bp, Artificial Sequence
  chemically synthesized
acactttatccttttccatttc

SEQ ID NO: 900871 - DNA, 22 bp, Artificial Sequence
  chemically synthesized
tccttactttttggaagaaatg

SEQ ID NO: 900872 - DNA, 22 bp, Artificial Sequence
  chemically synthesized
atccttactttttggaagaaat

SEQ ID NO: 900873 - DNA, 22 bp, Artificial Sequence
  chemically synthesized
tatccttttccatttcttccaa

SEQ ID NO: 900874 - DNA, 22 bp, Artificial Sequence
  chemically synthesized
atccttttccatttcttccaaa

SEQ ID NO: 900875 - DNA, 22 bp, Artificial Sequence
  chemically synthesized
tccttttccatttcttccaaaa

SEQ ID NO: 900876 - DNA, 22 bp, Artificial Sequence
  chemically synthesized
ttccatttcttccaaaaagtaa

SEQ ID NO: 900877 - DNA, 22 bp, Artificial Sequence
  chemically synthesized
tccatttcttccaaaaagtaag

SEQ ID NO: 900878 - DNA, 22 bp, Artificial Sequence
  chemically synthesized
ccatttcttccaaaaagtaagg

SEQ ID NO: 900879 - DNA, 22 bp, Artificial Sequence
  chemically synthesized
catttcttccaaaaagtaagga

SEQ ID NO: 900880 - DNA, 22 bp, Artificial Sequence
  chemically synthesized
cttccaaaaagtaaggataaat

SEQ ID NO: 900881 - DNA, 22 bp, Artificial Sequence
  chemically synthesized
ttccaaaaagtaaggataaatg

SEQ ID NO: 900882 - DNA, 22 bp, Artificial Sequence
  chemically synthesized
ccaaaaagtaaggataaatggt

SEQ ID NO: 900883 - DNA, 22 bp, Artificial Sequence
  chemically synthesized
caaaaagtaaggataaatggtc

SEQ ID NO: 900884 - DNA, 22 bp, Artificial Sequence
  chemically synthesized
caaataaatcaaggaccattta

SEQ ID NO: 900885 - DNA, 22 bp, Artificial Sequence
  chemically synthesized
gcaaataaatcaaggaccattt

SEQ ID NO: 900886 - DNA, 22 bp, Artificial Sequence
  chemically synthesized
agggaaagaagtagcttgcaaa

SEQ ID NO: 900887 - DNA, 22 bp, Artificial Sequence
  chemically synthesized
cagggaaagaagtagcttgcaa

SEQ ID NO: 900888 - DNA, 22 bp, Artificial Sequence
  chemically synthesized
tcagggaaagaagtagcttgca

SEQ ID NO: 900889 - DNA, 22 bp, Artificial Sequence
  chemically synthesized
ttcagggaaagaagtagcttgc

SEQ ID NO: 900890 - DNA, 22 bp, Artificial Sequence
  chemically synthesized
tttcagggaaagaagtagcttg

SEQ ID NO: 900891 - DNA, 22 bp, Artificial Sequence
  chemically synthesized
gatttatttgcaagctacttct

SEQ ID NO: 900892 - DNA, 22 bp, Artificial Sequence
  chemically synthesized
atttatttgcaagctacttctt

SEQ ID NO: 900893 - DNA, 22 bp, Artificial Sequence
  chemically synthesized
atttgcaagctacttctttccc

SEQ ID NO: 900894 - DNA, 22 bp, Artificial Sequence
  chemically synthesized
tttgcaagctacttctttccct

SEQ ID NO: 900895 - DNA, 22 bp, Artificial Sequence
  chemically synthesized
gcaagctacttctttccctgaa

SEQ ID NO: 900896 - DNA, 22 bp, Artificial Sequence
  chemically synthesized
caagctacttctttccctgaaa

SEQ ID NO: 900897 - DNA, 22 bp, Artificial Sequence
  chemically synthesized
aggatcacccaaactttttcag

SEQ ID NO: 900898 - DNA, 22 bp, Artificial Sequence
  chemically synthesized
cttctttccctgaaaaagtttg

SEQ ID NO: 900899 - DNA, 22 bp, Artificial Sequence
  chemically synthesized
ctttccctgaaaaagtttgggt

SEQ ID NO: 900900 - DNA, 22 bp, Artificial Sequence
  chemically synthesized
atgctaaggatcacccaaactt

SEQ ID NO: 900901 - DNA, 22 bp, Artificial Sequence
  chemically synthesized
tttccctgaaaaagtttgggtg

SEQ ID NO: 900902 - DNA, 22 bp, Artificial Sequence
  chemically synthesized
tccctgaaaaagtttgggtgat

SEQ ID NO: 900903 - DNA, 22 bp, Artificial Sequence
  chemically synthesized
ccctgaaaaagtttgggtgatc

SEQ ID NO: 900904 - DNA, 22 bp, Artificial Sequence
  chemically synthesized
cctgaaaaagtttgggtgatcc

SEQ ID NO: 900905 - DNA, 22 bp, Artificial Sequence
  chemically synthesized
aaccctgatgctaaggatcacc

SEQ ID NO: 900906 - DNA, 22 bp, Artificial Sequence
  chemically synthesized
aaaaagtttgggtgatccttag

SEQ ID NO: 900907 - DNA, 22 bp, Artificial Sequence
  chemically synthesized
gtcatactaaaccctgatgcta

SEQ ID NO: 900908 - DNA, 22 bp, Artificial Sequence
  chemically synthesized
agtcatactaaaccctgatgct

SEQ ID NO: 900909 - DNA, 22 bp, Artificial Sequence
  chemically synthesized
gggtgatccttagcatcagggt

SEQ ID NO: 900910 - DNA, 22 bp, Artificial Sequence
  chemically synthesized
tagtcatactaaaccctgatgc

SEQ ID NO: 900911 - DNA, 22 bp, Artificial Sequence
  chemically synthesized
ggtgatccttagcatcagggtt

SEQ ID NO: 900912 - DNA, 22 bp, Artificial Sequence
  chemically synthesized
ttagtcatactaaaccctgatg

SEQ ID NO: 900913 - DNA, 22 bp, Artificial Sequence
  chemically synthesized
ttttagtcatactaaaccctga

SEQ ID NO: 900914 - DNA, 22 bp, Artificial Sequence
  chemically synthesized
cttttagtcatactaaaccctg

SEQ ID NO: 900915 - DNA, 22 bp, Artificial Sequence
  chemically synthesized
tcttttagtcatactaaaccct

SEQ ID NO: 900916 - DNA, 22 bp, Artificial Sequence
  chemically synthesized
ttcttttagtcatactaaaccc

SEQ ID NO: 900917 - DNA, 22 bp, Artificial Sequence
  chemically synthesized
agcatcagggtttagtatgact

SEQ ID NO: 900918 - DNA, 22 bp, Artificial Sequence
  chemically synthesized
gcatcagggtttagtatgacta

SEQ ID NO: 900919 - DNA, 22 bp, Artificial Sequence
  chemically synthesized
atacatatttttcttttagtca

SEQ ID NO: 900920 - DNA, 22 bp, Artificial Sequence
  chemically synthesized
agtatgactaaaagaaaaatat

SEQ ID NO: 900921 - DNA, 22 bp, Artificial Sequence
  chemically synthesized
gtatgactaaaagaaaaatatg

SEQ ID NO: 900922 - DNA, 22 bp, Artificial Sequence
  chemically synthesized
tacaataactaatacatatttt

SEQ ID NO: 900923 - DNA, 22 bp, Artificial Sequence
  chemically synthesized
gtacaataactaatacatattt

SEQ ID NO: 900924 - DNA, 22 bp, Artificial Sequence
  chemically synthesized
tcttgtacaataactaatacat

SEQ ID NO: 900925 - DNA, 22 bp, Artificial Sequence
  chemically synthesized
aaagaaaaatatgtattagtta

SEQ ID NO: 900926 - DNA, 22 bp, Artificial Sequence
  chemically synthesized
aagttatcttgtacaataacta

SEQ ID NO: 900927 - DNA, 22 bp, Artificial Sequence
  chemically synthesized
aaagatcattcaagttatcttg

SEQ ID NO: 900928 - DNA, 22 bp, Artificial Sequence
  chemically synthesized
aaaagatcattcaagttatctt

SEQ ID NO: 900929 - DNA, 22 bp, Artificial Sequence
  chemically synthesized
gttattgtacaagataacttga

SEQ ID NO: 900930 - DNA, 22 bp, Artificial Sequence
  chemically synthesized
ttgtacaagataacttgaatga

SEQ ID NO: 900931 - DNA, 22 bp, Artificial Sequence
  chemically synthesized
taaaatttaaaagatcattcaa

SEQ ID NO: 900932 - DNA, 22 bp, Artificial Sequence
  chemically synthesized
tacaagataacttgaatgatct

SEQ ID NO: 900933 - DNA, 22 bp, Artificial Sequence
  chemically synthesized
acatatgaactgtaaaatttaa

SEQ ID NO: 900934 - DNA, 22 bp, Artificial Sequence
  chemically synthesized
cacatatgaactgtaaaattta

SEQ ID NO: 900935 - DNA, 22 bp, Artificial Sequence
  chemically synthesized
gaatgatcttttaaattttaca

SEQ ID NO: 900936 - DNA, 22 bp, Artificial Sequence
  chemically synthesized
tcacatatgaactgtaaaattt

SEQ ID NO: 900937 - DNA, 22 bp, Artificial Sequence
  chemically synthesized
aatgatcttttaaattttacag

SEQ ID NO: 900938 - DNA, 22 bp, Artificial Sequence
  chemically synthesized
tttcacatatgaactgtaaaat

SEQ ID NO: 900939 - DNA, 22 bp, Artificial Sequence
  chemically synthesized
ctttcacatatgaactgtaaaa

SEQ ID NO: 900940 - DNA, 22 bp, Artificial Sequence
  chemically synthesized
ttaaattttacagttcatatgt

SEQ ID NO: 900941 - DNA, 22 bp, Artificial Sequence
  chemically synthesized
taaattttacagttcatatgtg

SEQ ID NO: 900942 - DNA, 22 bp, Artificial Sequence
  chemically synthesized
ccaagtttctttcacatatgaa

SEQ ID NO: 900943 - DNA, 22 bp, Artificial Sequence
  chemically synthesized
aaattttacagttcatatgtga

SEQ ID NO: 900944 - DNA, 22 bp, Artificial Sequence
  chemically synthesized
aattttacagttcatatgtgaa

SEQ ID NO: 900945 - DNA, 22 bp, Artificial Sequence
  chemically synthesized
tacagttcatatgtgaaagaaa

SEQ ID NO: 900946 - DNA, 22 bp, Artificial Sequence
  chemically synthesized
acagttcatatgtgaaagaaac

SEQ ID NO: 900947 - DNA, 22 bp, Artificial Sequence
  chemically synthesized
cagttcatatgtgaaagaaact

SEQ ID NO: 900948 - DNA, 22 bp, Artificial Sequence
  chemically synthesized
ggaagaccctgccaagtttctt

SEQ ID NO: 900949 - DNA, 22 bp, Artificial Sequence
  chemically synthesized
aggaagaccctgccaagtttct

SEQ ID NO: 900950 - DNA, 22 bp, Artificial Sequence
  chemically synthesized
atatgtgaaagaaacttggcag

SEQ ID NO: 900951 - DNA, 22 bp, Artificial Sequence
  chemically synthesized
tccaatttaggaagaccctgcc

SEQ ID NO: 900952 - DNA, 22 bp, Artificial Sequence
  chemically synthesized
ttgtccaatttaggaagaccct

SEQ ID NO: 900953 - DNA, 22 bp, Artificial Sequence
  chemically synthesized
attgtccaatttaggaagaccc

SEQ ID NO: 900954 - DNA, 22 bp, Artificial Sequence
  chemically synthesized
caatttattgtccaatttagga

SEQ ID NO: 900955 - DNA, 22 bp, Artificial Sequence
  chemically synthesized
ggcagggtcttcctaaattgga

SEQ ID NO: 900956 - DNA, 22 bp, Artificial Sequence
  chemically synthesized
gcagggtcttcctaaattggac

SEQ ID NO: 900957 - DNA, 22 bp, Artificial Sequence
  chemically synthesized
ttacaatttattgtccaattta

SEQ ID NO: 900958 - DNA, 22 bp, Artificial Sequence
  chemically synthesized
cctaaattggacaataaattgt

SEQ ID NO: 900959 - DNA, 22 bp, Artificial Sequence
  chemically synthesized
ctaaattggacaataaattgta

SEQ ID NO: 900960 - DNA, 22 bp, Artificial Sequence
  chemically synthesized
aattggacaataaattgtaata

SEQ ID NO: 900961 - DNA, 22 bp, Artificial Sequence
  chemically synthesized
gtgatgtcacataaattattac

SEQ ID NO: 900962 - DNA, 22 bp, Artificial Sequence
  chemically synthesized
gacaataaattgtaataattta

SEQ ID NO: 900963 - DNA, 22 bp, Artificial Sequence
  chemically synthesized
ttggtgatgtcacataaattat

SEQ ID NO: 900964 - DNA, 22 bp, Artificial Sequence
  chemically synthesized
ttattggtgatgtcacataaat

SEQ ID NO: 900965 - DNA, 22 bp, Artificial Sequence
  chemically synthesized
attattggtgatgtcacataaa

SEQ ID NO: 900966 - DNA, 22 bp, Artificial Sequence
  chemically synthesized
aacttattattggtgatgtcac

SEQ ID NO: 900967 - DNA, 22 bp, Artificial Sequence
  chemically synthesized
taataatttatgtgacatcacc

SEQ ID NO: 900968 - DNA, 22 bp, Artificial Sequence
  chemically synthesized
caacttattattggtgatgtca

SEQ ID NO: 900969 - DNA, 22 bp, Artificial Sequence
  chemically synthesized
tcaacttattattggtgatgtc

SEQ ID NO: 900970 - DNA, 22 bp, Artificial Sequence
  chemically synthesized
cattttcaacttattattggtg

SEQ ID NO: 900971 - DNA, 22 bp, Artificial Sequence
  chemically synthesized
acattttcaacttattattggt

SEQ ID NO: 900972 - DNA, 22 bp, Artificial Sequence
  chemically synthesized
tacattttcaacttattattgg

SEQ ID NO: 900973 - DNA, 22 bp, Artificial Sequence
  chemically synthesized
atgtgacatcaccaataataag

SEQ ID NO: 900974 - DNA, 22 bp, Artificial Sequence
  chemically synthesized
tgtgacatcaccaataataagt

SEQ ID NO: 900975 - DNA, 22 bp, Artificial Sequence
  chemically synthesized
ttttacattttcaacttattat

SEQ ID NO: 900976 - DNA, 22 bp, Artificial Sequence
  chemically synthesized
attttacattttcaacttatta

SEQ ID NO: 900977 - DNA, 22 bp, Artificial Sequence
  chemically synthesized
gaaaagtttattttacattttc

SEQ ID NO: 900978 - DNA, 22 bp, Artificial Sequence
  chemically synthesized
agaaaagtttattttacatttt

SEQ ID NO: 900979 - DNA, 22 bp, Artificial Sequence
  chemically synthesized
atagtttagaaaagtttatttt

SEQ ID NO: 900980 - DNA, 22 bp, Artificial Sequence
  chemically synthesized
aaaatgtaaaataaacttttct

SEQ ID NO: 900981 - DNA, 22 bp, Artificial Sequence
  chemically synthesized
tcattgatagtttagaaaagtt

SEQ ID NO: 900982 - DNA, 22 bp, Artificial Sequence
  chemically synthesized
tatcattgatagtttagaaaag

SEQ ID NO: 900983 - DNA, 22 bp, Artificial Sequence
  chemically synthesized
ctatcattgatagtttagaaaa

SEQ ID NO: 900984 - DNA, 22 bp, Artificial Sequence
  chemically synthesized
acttctatcattgatagtttag

SEQ ID NO: 900985 - DNA, 22 bp, Artificial Sequence
  chemically synthesized
gacttctatcattgatagttta

SEQ ID NO: 900986 - DNA, 22 bp, Artificial Sequence
  chemically synthesized
aaatttgacttctatcattgat

SEQ ID NO: 900987 - DNA, 22 bp, Artificial Sequence
  chemically synthesized
ttctaaactatcaatgatagaa

SEQ ID NO: 900988 - DNA, 22 bp, Artificial Sequence
  chemically synthesized
tctaaactatcaatgatagaag

SEQ ID NO: 900989 - DNA, 22 bp, Artificial Sequence
  chemically synthesized
attaaaatttgacttctatcat

SEQ ID NO: 900990 - DNA, 22 bp, Artificial Sequence
  chemically synthesized
ctaaactatcaatgatagaagt

SEQ ID NO: 900991 - DNA, 22 bp, Artificial Sequence
  chemically synthesized
taaactatcaatgatagaagtc

SEQ ID NO: 900992 - DNA, 22 bp, Artificial Sequence
  chemically synthesized
ttgattaaaatttgacttctat

SEQ ID NO: 900993 - DNA, 22 bp, Artificial Sequence
  chemically synthesized
aactatcaatgatagaagtcaa

SEQ ID NO: 900994 - DNA, 22 bp, Artificial Sequence
  chemically synthesized
tcaatgatagaagtcaaatttt

SEQ ID NO: 900995 - DNA, 22 bp, Artificial Sequence
  chemically synthesized
ccccagcattgttgattaaaat

SEQ ID NO: 900996 - DNA, 22 bp, Artificial Sequence
  chemically synthesized
cccccagcattgttgattaaaa

SEQ ID NO: 900997 - DNA, 22 bp, Artificial Sequence
  chemically synthesized
tcccccagcattgttgattaaa

SEQ ID NO: 900998 - DNA, 22 bp, Artificial Sequence
  chemically synthesized
tttcccccagcattgttgatta

SEQ ID NO: 900999 - DNA, 22 bp, Artificial Sequence
  chemically synthesized
ctctttcccccagcattgttga

SEQ ID NO: 901000 - DNA, 22 bp, Artificial Sequence
  chemically synthesized
actctttcccccagcattgttg

SEQ ID NO: 901001 - DNA, 22 bp, Artificial Sequence
  chemically synthesized
taatcaacaatgctgggggaaa

SEQ ID NO: 901002 - DNA, 22 bp, Artificial Sequence
  chemically synthesized
aatcaacaatgctgggggaaag

SEQ ID NO: 901003 - DNA, 22 bp, Artificial Sequence
  chemically synthesized
atcaacaatgctgggggaaaga

SEQ ID NO: 901004 - DNA, 22 bp, Artificial Sequence
  chemically synthesized
ggggaaagagtaaattattttc

SEQ ID NO: 901005 - DNA, 22 bp, Artificial Sequence
  chemically synthesized
atgtgagagcatcagaaaataa

SEQ ID NO: 901006 - DNA, 22 bp, Artificial Sequence
  chemically synthesized
catgtgagagcatcagaaaata

SEQ ID NO: 901007 - DNA, 22 bp, Artificial Sequence
  chemically synthesized
ttcatgtgagagcatcagaaaa

SEQ ID NO: 901008 - DNA, 22 bp, Artificial Sequence
  chemically synthesized
agcacctcttcatgtgagagca

SEQ ID NO: 901009 - DNA, 22 bp, Artificial Sequence
  chemically synthesized
cagcacctcttcatgtgagagc

SEQ ID NO: 901010 - DNA, 22 bp, Artificial Sequence
  chemically synthesized
tcagcacctcttcatgtgagag

SEQ ID NO: 901011 - DNA, 22 bp, Artificial Sequence
  chemically synthesized
ttttctgatgctctcacatgaa

SEQ ID NO: 901012 - DNA, 22 bp, Artificial Sequence
  chemically synthesized
tttcagcacctcttcatgtgag

SEQ ID NO: 901013 - DNA, 22 bp, Artificial Sequence
  chemically synthesized
tctgatgctctcacatgaagag

SEQ ID NO: 901014 - DNA, 22 bp, Artificial Sequence
  chemically synthesized
ctgatgctctcacatgaagagg

SEQ ID NO: 901015 - DNA, 22 bp, Artificial Sequence
  chemically synthesized
tgatgctctcacatgaagaggt

SEQ ID NO: 901016 - DNA, 22 bp, Artificial Sequence
  chemically synthesized
atgctctcacatgaagaggtgc

SEQ ID NO: 901017 - DNA, 22 bp, Artificial Sequence
  chemically synthesized
gatgcatcctctttcagcacct

SEQ ID NO: 901018 - DNA, 22 bp, Artificial Sequence
  chemically synthesized
tcacatgaagaggtgctgaaag

SEQ ID NO: 901019 - DNA, 22 bp, Artificial Sequence
  chemically synthesized
tggatgcatcctctttcagcac

SEQ ID NO: 901020 - DNA, 22 bp, Artificial Sequence
  chemically synthesized
ctggatgcatcctctttcagca

SEQ ID NO: 901021 - DNA, 22 bp, Artificial Sequence
  chemically synthesized
acatgaagaggtgctgaaagag

SEQ ID NO: 901022 - DNA, 22 bp, Artificial Sequence
  chemically synthesized
tctggatgcatcctctttcagc

SEQ ID NO: 901023 - DNA, 22 bp, Artificial Sequence
  chemically synthesized
tctttctggatgcatcctcttt

SEQ ID NO: 901024 - DNA, 22 bp, Artificial Sequence
  chemically synthesized
tatctttctggatgcatcctct

SEQ ID NO: 901025 - DNA, 22 bp, Artificial Sequence
  chemically synthesized
ctatctttctggatgcatcctc

SEQ ID NO: 901026 - DNA, 22 bp, Artificial Sequence
  chemically synthesized
tctatctttctggatgcatcct

SEQ ID NO: 901027 - DNA, 22 bp, Artificial Sequence
  chemically synthesized
ttctatctttctggatgcatcc

SEQ ID NO: 901028 - DNA, 22 bp, Artificial Sequence
  chemically synthesized
tttctatctttctggatgcatc

SEQ ID NO: 901029 - DNA, 22 bp, Artificial Sequence
  chemically synthesized
aaagaggatgcatccagaaaga

SEQ ID NO: 901030 - DNA, 22 bp, Artificial Sequence
  chemically synthesized
aaataattttttctatctttct

SEQ ID NO: 901031 - DNA, 22 bp, Artificial Sequence
  chemically synthesized
gaatatacagtgtctgaaataa

SEQ ID NO: 901032 - DNA, 22 bp, Artificial Sequence
  chemically synthesized
caatactagaatatacagtgtc

SEQ ID NO: 901033 - DNA, 22 bp, Artificial Sequence
  chemically synthesized
tgcaatactagaatatacagtg

SEQ ID NO: 901034 - DNA, 22 bp, Artificial Sequence
  chemically synthesized
tttcagacactgtatattctag

SEQ ID NO: 901035 - DNA, 22 bp, Artificial Sequence
  chemically synthesized
cagacactgtatattctagtat

SEQ ID NO: 901036 - DNA, 22 bp, Artificial Sequence
  chemically synthesized
agacactgtatattctagtatt

SEQ ID NO: 901037 - DNA, 22 bp, Artificial Sequence
  chemically synthesized
ataatgaaccatctctgcaata

SEQ ID NO: 901038 - DNA, 22 bp, Artificial Sequence
  chemically synthesized
aataatgaaccatctctgcaat

SEQ ID NO: 901039 - DNA, 22 bp, Artificial Sequence
  chemically synthesized
tatattctagtattgcagagat

SEQ ID NO: 901040 - DNA, 22 bp, Artificial Sequence
  chemically synthesized
ttaataatgaaccatctctgca

SEQ ID NO: 901041 - DNA, 22 bp, Artificial Sequence
  chemically synthesized
cttaataatgaaccatctctgc

SEQ ID NO: 901042 - DNA, 22 bp, Artificial Sequence
  chemically synthesized
tcttaataatgaaccatctctg

SEQ ID NO: 901043 - DNA, 22 bp, Artificial Sequence
  chemically synthesized
tagtattgcagagatggttcat

SEQ ID NO: 901044 - DNA, 22 bp, Artificial Sequence
  chemically synthesized
gtattgcagagatggttcatta

SEQ ID NO: 901045 - DNA, 22 bp, Artificial Sequence
  chemically synthesized
cagagatggttcattattaaga

SEQ ID NO: 901046 - DNA, 22 bp, Artificial Sequence
  chemically synthesized
aaaaaaataagcagaatgtttt

SEQ ID NO: 901047 - DNA, 22 bp, Artificial Sequence
  chemically synthesized
attattaagaaaacattctgct

SEQ ID NO: 901048 - DNA, 22 bp, Artificial Sequence
  chemically synthesized
ttaagaaaacattctgcttatt

SEQ ID NO: 901049 - DNA, 22 bp, Artificial Sequence
  chemically synthesized
agaaaacattctgcttattttt

SEQ ID NO: 901050 - DNA, 22 bp, Artificial Sequence
  chemically synthesized
tgcttatttttttcaatttttg

SEQ ID NO: 901051 - DNA, 22 bp, Artificial Sequence
  chemically synthesized
cttatttttttcaatttttgtg

SEQ ID NO: 901052 - DNA, 22 bp, Artificial Sequence
  chemically synthesized
atttttttcaatttttgtgatg

SEQ ID NO: 901053 - DNA, 22 bp, Artificial Sequence
  chemically synthesized
tttttttcaatttttgtgatgt

SEQ ID NO: 901054 - DNA, 22 bp, Artificial Sequence
  chemically synthesized
ttttcaatttttgtgatgtatg

SEQ ID NO: 901055 - DNA, 22 bp, Artificial Sequence
  chemically synthesized
tttcaatttttgtgatgtatgt

SEQ ID NO: 901056 - DNA, 22 bp, Artificial Sequence
  chemically synthesized
ttcaatttttgtgatgtatgtg

SEQ ID NO: 901057 - DNA, 22 bp, Artificial Sequence
  chemically synthesized
tcaatttttgtgatgtatgtgg

SEQ ID NO: 901058 - DNA, 22 bp, Artificial Sequence
  chemically synthesized
caatttttgtgatgtatgtggt

SEQ ID NO: 901059 - DNA, 22 bp, Artificial Sequence
  chemically synthesized
aatttttgtgatgtatgtggtt

SEQ ID NO: 901060 - DNA, 22 bp, Artificial Sequence
  chemically synthesized
aaaagatgacagataaccacat

SEQ ID NO: 901061 - DNA, 22 bp, Artificial Sequence
  chemically synthesized
aaaaagatgacagataaccaca

SEQ ID NO: 901062 - DNA, 22 bp, Artificial Sequence
  chemically synthesized
taaaaagatgacagataaccac

SEQ ID NO: 901063 - DNA, 22 bp, Artificial Sequence
  chemically synthesized
ttgtgatgtatgtggttatctg

SEQ ID NO: 901064 - DNA, 22 bp, Artificial Sequence
  chemically synthesized
ttaaaaagatgacagataacca

SEQ ID NO: 901065 - DNA, 22 bp, Artificial Sequence
  chemically synthesized
tgtgatgtatgtggttatctgt

SEQ ID NO: 901066 - DNA, 22 bp, Artificial Sequence
  chemically synthesized
gtgatgtatgtggttatctgtc

SEQ ID NO: 901067 - DNA, 22 bp, Artificial Sequence
  chemically synthesized
tgatgtatgtggttatctgtca

SEQ ID NO: 901068 - DNA, 22 bp, Artificial Sequence
  chemically synthesized
tacgtttttaaaaagatgacag

SEQ ID NO: 901069 - DNA, 22 bp, Artificial Sequence
  chemically synthesized
tctgtcatctttttaaaaacgt

SEQ ID NO: 901070 - DNA, 22 bp, Artificial Sequence
  chemically synthesized
tcatctttttaaaaacgtataa

SEQ ID NO: 901071 - DNA, 22 bp, Artificial Sequence
  chemically synthesized
tttaaaaacgtataatttgtta

SEQ ID NO: 901072 - DNA, 22 bp, Artificial Sequence
  chemically synthesized
ttaaaaacgtataatttgttat

SEQ ID NO: 901073 - DNA, 22 bp, Artificial Sequence
  chemically synthesized
taaaaacgtataatttgttatg

SEQ ID NO: 901074 - DNA, 22 bp, Artificial Sequence
  chemically synthesized
aaaaacgtataatttgttatga

SEQ ID NO: 901075 - DNA, 22 bp, Artificial Sequence
  chemically synthesized
aaaacgtataatttgttatgat

SEQ ID NO: 901076 - DNA, 22 bp, Artificial Sequence
  chemically synthesized
tagaaagaaaggaaatcataac

SEQ ID NO: 901077 - DNA, 22 bp, Artificial Sequence
  chemically synthesized
gttatgatttcctttctttcta

SEQ ID NO: 901078 - DNA, 22 bp, Artificial Sequence
  chemically synthesized
ttatgatttcctttctttctat

SEQ ID NO: 901079 - DNA, 22 bp, Artificial Sequence
  chemically synthesized
tgatttcctttctttctataat

SEQ ID NO: 901080 - DNA, 22 bp, Artificial Sequence
  chemically synthesized
ggtatgaacatgattatagaaa

SEQ ID NO: 901081 - DNA, 22 bp, Artificial Sequence
  chemically synthesized
cctttctttctataatcatgtt

SEQ ID NO: 901082 - DNA, 22 bp, Artificial Sequence
  chemically synthesized
ctttctttctataatcatgttc

SEQ ID NO: 901083 - DNA, 22 bp, Artificial Sequence
  chemically synthesized
tctttctataatcatgttcata

SEQ ID NO: 901084 - DNA, 22 bp, Artificial Sequence
  chemically synthesized
ctttctataatcatgttcatac

SEQ ID NO: 901085 - DNA, 22 bp, Artificial Sequence
  chemically synthesized
tttctataatcatgttcatacc

SEQ ID NO: 901086 - DNA, 22 bp, Artificial Sequence
  chemically synthesized
tctataatcatgttcataccta

SEQ ID NO: 901087 - DNA, 22 bp, Artificial Sequence
  chemically synthesized
ctataatcatgttcatacctaa

SEQ ID NO: 901088 - DNA, 22 bp, Artificial Sequence
  chemically synthesized
tataatcatgttcatacctaat

SEQ ID NO: 901089 - DNA, 22 bp, Artificial Sequence
  chemically synthesized
taatcatgttcatacctaattt

SEQ ID NO: 901090 - DNA, 22 bp, Artificial Sequence
  chemically synthesized
atacctaattttatatttgtcc

SEQ ID NO: 901091 - DNA, 22 bp, Artificial Sequence
  chemically synthesized
agtcaaagaatataacaggaca

SEQ ID NO: 901092 - DNA, 22 bp, Artificial Sequence
  chemically synthesized
aagtcaaagaatataacaggac

SEQ ID NO: 901093 - DNA, 22 bp, Artificial Sequence
  chemically synthesized
attttatatttgtcctgttata

SEQ ID NO: 901094 - DNA, 22 bp, Artificial Sequence
  chemically synthesized
taagtcaaagaatataacagga

SEQ ID NO: 901095 - DNA, 22 bp, Artificial Sequence
  chemically synthesized
tttaagtcaaagaatataacag

SEQ ID NO: 901096 - DNA, 22 bp, Artificial Sequence
  chemically synthesized
ctttaagtcaaagaatataaca

SEQ ID NO: 901097 - DNA, 22 bp, Artificial Sequence
  chemically synthesized
tatatttgtcctgttatattct

SEQ ID NO: 901098 - DNA, 22 bp, Artificial Sequence
  chemically synthesized
tctttaagtcaaagaatataac

SEQ ID NO: 901099 - DNA, 22 bp, Artificial Sequence
  chemically synthesized
atatttgtcctgttatattctt

SEQ ID NO: 901100 - DNA, 22 bp, Artificial Sequence
  chemically synthesized
tatttgtcctgttatattcttt

SEQ ID NO: 901101 - DNA, 22 bp, Artificial Sequence
  chemically synthesized
gtcctgttatattctttgactt

SEQ ID NO: 901102 - DNA, 22 bp, Artificial Sequence
  chemically synthesized
gcagttttctttaagtcaaaga

SEQ ID NO: 901103 - DNA, 22 bp, Artificial Sequence
  chemically synthesized
tcctgttatattctttgactta

SEQ ID NO: 901104 - DNA, 22 bp, Artificial Sequence
  chemically synthesized
ggcagttttctttaagtcaaag

SEQ ID NO: 901105 - DNA, 22 bp, Artificial Sequence
  chemically synthesized
atttggcagttttctttaagtc

SEQ ID NO: 901106 - DNA, 22 bp, Artificial Sequence
  chemically synthesized
ttatattctttgacttaaagaa

SEQ ID NO: 901107 - DNA, 22 bp, Artificial Sequence
  chemically synthesized
taatttggcagttttctttaag

SEQ ID NO: 901108 - DNA, 22 bp, Artificial Sequence
  chemically synthesized
tattctttgacttaaagaaaac

SEQ ID NO: 901109 - DNA, 22 bp, Artificial Sequence
  chemically synthesized
tttgacttaaagaaaactgcca

SEQ ID NO: 901110 - DNA, 22 bp, Artificial Sequence
  chemically synthesized
tgacttaaagaaaactgccaaa

SEQ ID NO: 901111 - DNA, 22 bp, Artificial Sequence
  chemically synthesized
gacttaaagaaaactgccaaat

SEQ ID NO: 901112 - DNA, 22 bp, Artificial Sequence
  chemically synthesized
aagcacattctaatttggcagt

SEQ ID NO: 901113 - DNA, 22 bp, Artificial Sequence
  chemically synthesized
acttaaagaaaactgccaaatt

SEQ ID NO: 901114 - DNA, 22 bp, Artificial Sequence
  chemically synthesized
gaagcacattctaatttggcag

SEQ ID NO: 901115 - DNA, 22 bp, Artificial Sequence
  chemically synthesized
aaagaaaactgccaaattagaa

SEQ ID NO: 901116 - DNA, 22 bp, Artificial Sequence
  chemically synthesized
aagaaaactgccaaattagaat

SEQ ID NO: 901117 - DNA, 22 bp, Artificial Sequence
  chemically synthesized
aaacttgaagcacattctaatt

SEQ ID NO: 901118 - DNA, 22 bp, Artificial Sequence
  chemically synthesized
tgaaacttgaagcacattctaa

SEQ ID NO: 901119 - DNA, 22 bp, Artificial Sequence
  chemically synthesized
ctgaaacttgaagcacattcta

SEQ ID NO: 901120 - DNA, 22 bp, Artificial Sequence
  chemically synthesized
tctgaaacttgaagcacattct

SEQ ID NO: 901121 - DNA, 22 bp, Artificial Sequence
  chemically synthesized
gttttctgaaacttgaagcaca

SEQ ID NO: 901122 - DNA, 22 bp, Artificial Sequence
  chemically synthesized
ccaaattagaatgtgcttcaag

SEQ ID NO: 901123 - DNA, 22 bp, Artificial Sequence
  chemically synthesized
gaatgtgcttcaagtttcagaa

SEQ ID NO: 901124 - DNA, 22 bp, Artificial Sequence
  chemically synthesized
caagtttcagaaaaccagatct

SEQ ID NO: 901125 - DNA, 22 bp, Artificial Sequence
  chemically synthesized
aagtttcagaaaaccagatcta

SEQ ID NO: 901126 - DNA, 22 bp, Artificial Sequence
  chemically synthesized
cagaaaaccagatctacctctg

SEQ ID NO: 901127 - DNA, 22 bp, Artificial Sequence
  chemically synthesized
agaaaaccagatctacctctgc

SEQ ID NO: 901128 - DNA, 22 bp, Artificial Sequence
  chemically synthesized
aataaaggtaaaagaataagca

SEQ ID NO: 901129 - DNA, 22 bp, Artificial Sequence
  chemically synthesized
tactcaataaaggtaaaagaat

SEQ ID NO: 901130 - DNA, 22 bp, Artificial Sequence
  chemically synthesized
tatactcaataaaggtaaaaga

SEQ ID NO: 901131 - DNA, 22 bp, Artificial Sequence
  chemically synthesized
cctctgcttattcttttacctt

SEQ ID NO: 901132 - DNA, 22 bp, Artificial Sequence
  chemically synthesized
ctatactcaataaaggtaaaag

SEQ ID NO: 901133 - DNA, 22 bp, Artificial Sequence
  chemically synthesized
tctatactcaataaaggtaaaa

SEQ ID NO: 901134 - DNA, 22 bp, Artificial Sequence
  chemically synthesized
tgcttattcttttacctttatt

SEQ ID NO: 901135 - DNA, 22 bp, Artificial Sequence
  chemically synthesized
cttattcttttacctttattga

SEQ ID NO: 901136 - DNA, 22 bp, Artificial Sequence
  chemically synthesized
attcttttacctttattgagta

SEQ ID NO: 901137 - DNA, 22 bp, Artificial Sequence
  chemically synthesized
ttcttttacctttattgagtat

SEQ ID NO: 901138 - DNA, 22 bp, Artificial Sequence
  chemically synthesized
ttttacctttattgagtataga

SEQ ID NO: 901139 - DNA, 22 bp, Artificial Sequence
  chemically synthesized
aatgaaatggttttctatactc

SEQ ID NO: 901140 - DNA, 22 bp, Artificial Sequence
  chemically synthesized
ttacctttattgagtatagaaa

SEQ ID NO: 901141 - DNA, 22 bp, Artificial Sequence
  chemically synthesized
tacctttattgagtatagaaaa

SEQ ID NO: 901142 - DNA, 22 bp, Artificial Sequence
  chemically synthesized
acctttattgagtatagaaaac

SEQ ID NO: 901143 - DNA, 22 bp, Artificial Sequence
  chemically synthesized
cctttattgagtatagaaaacc

SEQ ID NO: 901144 - DNA, 22 bp, Artificial Sequence
  chemically synthesized
tattgagtatagaaaaccattt

SEQ ID NO: 901145 - DNA, 22 bp, Artificial Sequence
  chemically synthesized
ggatactgaatgaaatggtttt

SEQ ID NO: 901146 - DNA, 22 bp, Artificial Sequence
  chemically synthesized
attgagtatagaaaaccatttc

SEQ ID NO: 901147 - DNA, 22 bp, Artificial Sequence
  chemically synthesized
aggatactgaatgaaatggttt

SEQ ID NO: 901148 - DNA, 22 bp, Artificial Sequence
  chemically synthesized
ttgagtatagaaaaccatttca

SEQ ID NO: 901149 - DNA, 22 bp, Artificial Sequence
  chemically synthesized
taggatactgaatgaaatggtt

SEQ ID NO: 901150 - DNA, 22 bp, Artificial Sequence
  chemically synthesized
agtatagaaaaccatttcattc

SEQ ID NO: 901151 - DNA, 22 bp, Artificial Sequence
  chemically synthesized
ttttaggatactgaatgaaatg

SEQ ID NO: 901152 - DNA, 22 bp, Artificial Sequence
  chemically synthesized
gttattttaggatactgaatga

SEQ ID NO: 901153 - DNA, 22 bp, Artificial Sequence
  chemically synthesized
taccaaattagttattttagga

SEQ ID NO: 901154 - DNA, 22 bp, Artificial Sequence
  chemically synthesized
cattcagtatcctaaaataact

SEQ ID NO: 901155 - DNA, 22 bp, Artificial Sequence
  chemically synthesized
attcagtatcctaaaataacta

SEQ ID NO: 901156 - DNA, 22 bp, Artificial Sequence
  chemically synthesized
agtatcctaaaataactaattt

SEQ ID NO: 901157 - DNA, 22 bp, Artificial Sequence
  chemically synthesized
caatgcctataccaaattagtt

SEQ ID NO: 901158 - DNA, 22 bp, Artificial Sequence
  chemically synthesized
gcaatgcctataccaaattagt

SEQ ID NO: 901159 - DNA, 22 bp, Artificial Sequence
  chemically synthesized
aaataactaatttggtataggc

SEQ ID NO: 901160 - DNA, 22 bp, Artificial Sequence
  chemically synthesized
atttggtataggcattgcaaat

SEQ ID NO: 901161 - DNA, 22 bp, Artificial Sequence
  chemically synthesized
aaagtaaaagaagagatttgca

SEQ ID NO: 901162 - DNA, 22 bp, Artificial Sequence
  chemically synthesized
ggtataggcattgcaaatctct

SEQ ID NO: 901163 - DNA, 22 bp, Artificial Sequence
  chemically synthesized
caaagtaaaagaagagatttgc

SEQ ID NO: 901164 - DNA, 22 bp, Artificial Sequence
  chemically synthesized
gtataggcattgcaaatctctt

SEQ ID NO: 901165 - DNA, 22 bp, Artificial Sequence
  chemically synthesized
caaatctcttcttttactttga

SEQ ID NO: 901166 - DNA, 22 bp, Artificial Sequence
  chemically synthesized
gaaacgatggggtcttcaaagt

SEQ ID NO: 901167 - DNA, 22 bp, Artificial Sequence
  chemically synthesized
ttagaaacgatggggtcttcaa

SEQ ID NO: 901168 - DNA, 22 bp, Artificial Sequence
  chemically synthesized
ttcttttactttgaagacccca

SEQ ID NO: 901169 - DNA, 22 bp, Artificial Sequence
  chemically synthesized
cttttactttgaagaccccatc

SEQ ID NO: 901170 - DNA, 22 bp, Artificial Sequence
  chemically synthesized
ttttactttgaagaccccatcg

SEQ ID NO: 901171 - DNA, 22 bp, Artificial Sequence
  chemically synthesized
catctgttagaaacgatggggt

SEQ ID NO: 901172 - DNA, 22 bp, Artificial Sequence
  chemically synthesized
ttactttgaagaccccatcgtt

SEQ ID NO: 901173 - DNA, 22 bp, Artificial Sequence
  chemically synthesized
acatctgttagaaacgatgggg

SEQ ID NO: 901174 - DNA, 22 bp, Artificial Sequence
  chemically synthesized
tactttgaagaccccatcgttt

SEQ ID NO: 901175 - DNA, 22 bp, Artificial Sequence
  chemically synthesized
tacatctgttagaaacgatggg

SEQ ID NO: 901176 - DNA, 22 bp, Artificial Sequence
  chemically synthesized
actttgaagaccccatcgtttc

SEQ ID NO: 901177 - DNA, 22 bp, Artificial Sequence
  chemically synthesized
ttacatctgttagaaacgatgg

SEQ ID NO: 901178 - DNA, 22 bp, Artificial Sequence
  chemically synthesized
ctttgaagaccccatcgtttct

SEQ ID NO: 901179 - DNA, 22 bp, Artificial Sequence
  chemically synthesized
tttttacatctgttagaaacga

SEQ ID NO: 901180 - DNA, 22 bp, Artificial Sequence
  chemically synthesized
tgaagaccccatcgtttctaac

SEQ ID NO: 901181 - DNA, 22 bp, Artificial Sequence
  chemically synthesized
gtttttacatctgttagaaacg

SEQ ID NO: 901182 - DNA, 22 bp, Artificial Sequence
  chemically synthesized
gaagaccccatcgtttctaaca

SEQ ID NO: 901183 - DNA, 22 bp, Artificial Sequence
  chemically synthesized
tgtttttacatctgttagaaac

SEQ ID NO: 901184 - DNA, 22 bp, Artificial Sequence
  chemically synthesized
aagaccccatcgtttctaacag

SEQ ID NO: 901185 - DNA, 22 bp, Artificial Sequence
  chemically synthesized
ttgtttttacatctgttagaaa

SEQ ID NO: 901186 - DNA, 22 bp, Artificial Sequence
  chemically synthesized
tttgtttttacatctgttagaa

SEQ ID NO: 901187 - DNA, 22 bp, Artificial Sequence
  chemically synthesized
tttttgtttttacatctgttag

SEQ ID NO: 901188 - DNA, 22 bp, Artificial Sequence
  chemically synthesized
ctttttgtttttacatctgtta

SEQ ID NO: 901189 - DNA, 22 bp, Artificial Sequence
  chemically synthesized
tctttttgtttttacatctgtt

SEQ ID NO: 901190 - DNA, 22 bp, Artificial Sequence
  chemically synthesized
ttttctttttgtttttacatct

SEQ ID NO: 901191 - DNA, 22 bp, Artificial Sequence
  chemically synthesized
gttttctttttgtttttacatc

SEQ ID NO: 901192 - DNA, 22 bp, Artificial Sequence
  chemically synthesized
tgttttctttttgtttttacat

SEQ ID NO: 901193 - DNA, 22 bp, Artificial Sequence
  chemically synthesized
ttgttttctttttgtttttaca

SEQ ID NO: 901194 - DNA, 22 bp, Artificial Sequence
  chemically synthesized
tttttgttttctttttgttttt

SEQ ID NO: 901195 - DNA, 22 bp, Artificial Sequence
  chemically synthesized
ctaacagatgtaaaaacaaaaa

SEQ ID NO: 901196 - DNA, 22 bp, Artificial Sequence
  chemically synthesized
atttttgttttctttttgtttt

SEQ ID NO: 901197 - DNA, 22 bp, Artificial Sequence
  chemically synthesized
taacagatgtaaaaacaaaaag

SEQ ID NO: 901198 - DNA, 22 bp, Artificial Sequence
  chemically synthesized
tatttttgttttctttttgttt

SEQ ID NO: 901199 - DNA, 22 bp, Artificial Sequence
  chemically synthesized
ttatttttgttttctttttgtt

SEQ ID NO: 901200 - DNA, 22 bp, Artificial Sequence
  chemically synthesized
acagatgtaaaaacaaaaagaa

SEQ ID NO: 901201 - DNA, 22 bp, Artificial Sequence
  chemically synthesized
tttatttttgttttctttttgt

SEQ ID NO: 901202 - DNA, 22 bp, Artificial Sequence
  chemically synthesized
taagtcagataaaatcattttt

SEQ ID NO: 901203 - DNA, 22 bp, Artificial Sequence
  chemically synthesized
ataagtcagataaaatcatttt

SEQ ID NO: 901204 - DNA, 22 bp, Artificial Sequence
  chemically synthesized
cttataagtcagataaaatcat

SEQ ID NO: 901205 - DNA, 22 bp, Artificial Sequence
  chemically synthesized
atgtactacttataagtcagat

SEQ ID NO: 901206 - DNA, 22 bp, Artificial Sequence
  chemically synthesized
aatgtactacttataagtcaga

SEQ ID NO: 901207 - DNA, 22 bp, Artificial Sequence
  chemically synthesized
taatgtactacttataagtcag

SEQ ID NO: 901208 - DNA, 22 bp, Artificial Sequence
  chemically synthesized
gttttaatgtactacttataag

SEQ ID NO: 901209 - DNA, 22 bp, Artificial Sequence
  chemically synthesized
tatctgacttataagtagtaca

SEQ ID NO: 901210 - DNA, 22 bp, Artificial Sequence
  chemically synthesized
aactagttttaatgtactactt

SEQ ID NO: 901211 - DNA, 22 bp, Artificial Sequence
  chemically synthesized
atctgacttataagtagtacat

SEQ ID NO: 901212 - DNA, 22 bp, Artificial Sequence
  chemically synthesized
tctgacttataagtagtacatt

SEQ ID NO: 901213 - DNA, 22 bp, Artificial Sequence
  chemically synthesized
acttataagtagtacattaaaa

SEQ ID NO: 901214 - DNA, 22 bp, Artificial Sequence
  chemically synthesized
ataagtagtacattaaaactag

SEQ ID NO: 901215 - DNA, 22 bp, Artificial Sequence
  chemically synthesized
taagtagtacattaaaactagt

SEQ ID NO: 901216 - DNA, 22 bp, Artificial Sequence
  chemically synthesized
gatcaaaaactcaactagtttt

SEQ ID NO: 901217 - DNA, 22 bp, Artificial Sequence
  chemically synthesized
agatcaaaaactcaactagttt

SEQ ID NO: 901218 - DNA, 22 bp, Artificial Sequence
  chemically synthesized
tagatcaaaaactcaactagtt

SEQ ID NO: 901219 - DNA, 22 bp, Artificial Sequence
  chemically synthesized
aattttagatcaaaaactcaac

SEQ ID NO: 901220 - DNA, 22 bp, Artificial Sequence
  chemically synthesized
aaattttagatcaaaaactcaa

SEQ ID NO: 901221 - DNA, 22 bp, Artificial Sequence
  chemically synthesized
taaattttagatcaaaaactca

SEQ ID NO: 901222 - DNA, 22 bp, Artificial Sequence
  chemically synthesized
ttaaattttagatcaaaaactc

SEQ ID NO: 901223 - DNA, 22 bp, Artificial Sequence
  chemically synthesized
aaactagttgagtttttgatct

SEQ ID NO: 901224 - DNA, 22 bp, Artificial Sequence
  chemically synthesized
tttttaaattttagatcaaaaa

SEQ ID NO: 901225 - DNA, 22 bp, Artificial Sequence
  chemically synthesized
attatttttaaattttagatca

SEQ ID NO: 901226 - DNA, 22 bp, Artificial Sequence
  chemically synthesized
gttgagtttttgatctaaaatt

SEQ ID NO: 901227 - DNA, 22 bp, Artificial Sequence
  chemically synthesized
ggctaattatttttaaatttta

SEQ ID NO: 901228 - DNA, 22 bp, Artificial Sequence
  chemically synthesized
agtttttgatctaaaatttaaa

SEQ ID NO: 901229 - DNA, 22 bp, Artificial Sequence
  chemically synthesized
ttgatctaaaatttaaaaataa

SEQ ID NO: 901230 - DNA, 22 bp, Artificial Sequence
  chemically synthesized
tgatctaaaatttaaaaataat

SEQ ID NO: 901231 - DNA, 22 bp, Artificial Sequence
  chemically synthesized
gatctaaaatttaaaaataatt

SEQ ID NO: 901232 - DNA, 22 bp, Artificial Sequence
  chemically synthesized
atctaaaatttaaaaataatta

SEQ ID NO: 901233 - DNA, 22 bp, Artificial Sequence
  chemically synthesized
tcagaaactcggctaattattt

SEQ ID NO: 901234 - DNA, 22 bp, Artificial Sequence
  chemically synthesized
tatcagaaactcggctaattat

SEQ ID NO: 901235 - DNA, 22 bp, Artificial Sequence
  chemically synthesized
aaatttaaaaataattagccga

SEQ ID NO: 901236 - DNA, 22 bp, Artificial Sequence
  chemically synthesized
ttctatcagaaactcggctaat

SEQ ID NO: 901237 - DNA, 22 bp, Artificial Sequence
  chemically synthesized
aaaaataattagccgagtttct

SEQ ID NO: 901238 - DNA, 22 bp, Artificial Sequence
  chemically synthesized
aaaataattagccgagtttctg

SEQ ID NO: 901239 - DNA, 22 bp, Artificial Sequence
  chemically synthesized
taaaatgttgttctatcagaaa

SEQ ID NO: 901240 - DNA, 22 bp, Artificial Sequence
  chemically synthesized
gccgagtttctgatagaacaac

SEQ ID NO: 901241 - DNA, 22 bp, Artificial Sequence
  chemically synthesized
ctgatagaacaacattttacaa

SEQ ID NO: 901242 - DNA, 22 bp, Artificial Sequence
  chemically synthesized
tgatagaacaacattttacaat

SEQ ID NO: 901243 - DNA, 22 bp, Artificial Sequence
  chemically synthesized
atagaacaacattttacaattt

SEQ ID NO: 901244 - DNA, 22 bp, Artificial Sequence
  chemically synthesized
tacaatttctttgcttttttct

SEQ ID NO: 901245 - DNA, 22 bp, Artificial Sequence
  chemically synthesized
acaatttctttgcttttttctt

SEQ ID NO: 901246 - DNA, 22 bp, Artificial Sequence
  chemically synthesized
caatttctttgcttttttcttt

SEQ ID NO: 901247 - DNA, 22 bp, Artificial Sequence
  chemically synthesized
ctttgcttttttcttttttttt

SEQ ID NO: 901248 - DNA, 22 bp, Artificial Sequence
  chemically synthesized
tttgcttttttctttttttttt

SEQ ID NO: 901249 - DNA, 22 bp, Artificial Sequence
  chemically synthesized
tgcttttttcttttttttttct

SEQ ID NO: 901250 - DNA, 22 bp, Artificial Sequence
  chemically synthesized
gcttttttcttttttttttctt

SEQ ID NO: 901251 - DNA, 22 bp, Artificial Sequence
  chemically synthesized
cttttttcttttttttttcttt

SEQ ID NO: 901252 - DNA, 22 bp, Artificial Sequence
  chemically synthesized
aagtacaataataaaagaaaaa

SEQ ID NO: 901253 - DNA, 22 bp, Artificial Sequence
  chemically synthesized
aaagtacaataataaaagaaaa

SEQ ID NO: 901254 - DNA, 22 bp, Artificial Sequence
  chemically synthesized
ttttcttttttttttcttttat

SEQ ID NO: 901255 - DNA, 22 bp, Artificial Sequence
  chemically synthesized
tttcttttttttttcttttatt

SEQ ID NO: 901256 - DNA, 22 bp, Artificial Sequence
  chemically synthesized
ttcttttttttttcttttatta

SEQ ID NO: 901257 - DNA, 22 bp, Artificial Sequence
  chemically synthesized
tcttttttttttcttttattat

SEQ ID NO: 901258 - DNA, 22 bp, Artificial Sequence
  chemically synthesized
cttttttttttcttttattatt

SEQ ID NO: 901259 - DNA, 22 bp, Artificial Sequence
  chemically synthesized
ttttttttttcttttattattg

SEQ ID NO: 901260 - DNA, 22 bp, Artificial Sequence
  chemically synthesized
aaacttaaagtacaataataaa

SEQ ID NO: 901261 - DNA, 22 bp, Artificial Sequence
  chemically synthesized
ttttttttcttttattattgta

SEQ ID NO: 901262 - DNA, 22 bp, Artificial Sequence
  chemically synthesized
tttttttcttttattattgtac

SEQ ID NO: 901263 - DNA, 22 bp, Artificial Sequence
  chemically synthesized
ttttttcttttattattgtact

SEQ ID NO: 901264 - DNA, 22 bp, Artificial Sequence
  chemically synthesized
tttttcttttattattgtactt

SEQ ID NO: 901265 - DNA, 22 bp, Artificial Sequence
  chemically synthesized
ttttcttttattattgtacttt

SEQ ID NO: 901266 - DNA, 22 bp, Artificial Sequence
  chemically synthesized
tttcttttattattgtacttta

SEQ ID NO: 901267 - DNA, 22 bp, Artificial Sequence
  chemically synthesized
ttcttttattattgtactttaa

SEQ ID NO: 901268 - DNA, 22 bp, Artificial Sequence
  chemically synthesized
tcttttattattgtactttaag

SEQ ID NO: 901269 - DNA, 22 bp, Artificial Sequence
  chemically synthesized
cttttattattgtactttaagt

SEQ ID NO: 901270 - DNA, 22 bp, Artificial Sequence
  chemically synthesized
ttttattattgtactttaagtt

SEQ ID NO: 901271 - DNA, 22 bp, Artificial Sequence
  chemically synthesized
ttattattgtactttaagtttt

SEQ ID NO: 901272 - DNA, 22 bp, Artificial Sequence
  chemically synthesized
tattattgtactttaagtttta

SEQ ID NO: 901273 - DNA, 22 bp, Artificial Sequence
  chemically synthesized
attattgtactttaagttttag

SEQ ID NO: 901274 - DNA, 22 bp, Artificial Sequence
  chemically synthesized
ttattgtactttaagttttagg

SEQ ID NO: 901275 - DNA, 22 bp, Artificial Sequence
  chemically synthesized
ttgtactttaagttttagggta

SEQ ID NO: 901276 - DNA, 22 bp, Artificial Sequence
  chemically synthesized
tactttaagttttagggtacat

SEQ ID NO: 901277 - DNA, 22 bp, Artificial Sequence
  chemically synthesized
cacaatgtgcacatgtacccta

SEQ ID NO: 901278 - DNA, 22 bp, Artificial Sequence
  chemically synthesized
taagttttagggtacatgtgca

SEQ ID NO: 901279 - DNA, 22 bp, Artificial Sequence
  chemically synthesized
acctgcacaatgtgcacatgta

SEQ ID NO: 901280 - DNA, 22 bp, Artificial Sequence
  chemically synthesized
aagttttagggtacatgtgcac

SEQ ID NO: 901281 - DNA, 22 bp, Artificial Sequence
  chemically synthesized
agttttagggtacatgtgcaca

SEQ ID NO: 901282 - DNA, 22 bp, Artificial Sequence
  chemically synthesized
tagggtacatgtgcacattgtg

SEQ ID NO: 901283 - DNA, 22 bp, Artificial Sequence
  chemically synthesized
agggtacatgtgcacattgtgc

SEQ ID NO: 901284 - DNA, 22 bp, Artificial Sequence
  chemically synthesized
gggtacatgtgcacattgtgca

SEQ ID NO: 901285 - DNA, 22 bp, Artificial Sequence
  chemically synthesized
tgcaggttagttacatatgtat

SEQ ID NO: 901286 - DNA, 22 bp, Artificial Sequence
  chemically synthesized
gttacatatgtatacatgtgcc

SEQ ID NO: 901287 - DNA, 22 bp, Artificial Sequence
  chemically synthesized
catatgtatacatgtgccatgc

SEQ ID NO: 901288 - DNA, 22 bp, Artificial Sequence
  chemically synthesized
gtgggtgcagcgcgccagcatg

SEQ ID NO: 901289 - DNA, 22 bp, Artificial Sequence
  chemically synthesized
gatgacaagttagtgggtgcag

SEQ ID NO: 901290 - DNA, 22 bp, Artificial Sequence
  chemically synthesized
gcgcgctgcacccactaacttg

SEQ ID NO: 901291 - DNA, 22 bp, Artificial Sequence
  chemically synthesized
cacccactaacttgtcatctag

SEQ ID NO: 901292 - DNA, 22 bp, Artificial Sequence
  chemically synthesized
ggagatatacccaatgctagat

SEQ ID NO: 901293 - DNA, 22 bp, Artificial Sequence
  chemically synthesized
acttgtcatctagcattgggta

SEQ ID NO: 901294 - DNA, 22 bp, Artificial Sequence
  chemically synthesized
gtcatctagcattgggtatatc

SEQ ID NO: 901295 - DNA, 22 bp, Artificial Sequence
  chemically synthesized
tcatctagcattgggtatatct

SEQ ID NO: 901296 - DNA, 22 bp, Artificial Sequence
  chemically synthesized
gcattgggtatatctcccaatg

SEQ ID NO: 901297 - DNA, 22 bp, Artificial Sequence
  chemically synthesized
ggtatatctcccaatgctatcc

SEQ ID NO: 901298 - DNA, 22 bp, Artificial Sequence
  chemically synthesized
tggggtgggggaaggggggagg

SEQ ID NO: 901299 - DNA, 22 bp, Artificial Sequence
  chemically synthesized
ccaatgctatccctcccccctt

SEQ ID NO: 901300 - DNA, 22 bp, Artificial Sequence
  chemically synthesized
ttgtggggtgggggaagggggg

SEQ ID NO: 901301 - DNA, 22 bp, Artificial Sequence
  chemically synthesized
tccctccccccttcccccaccc

SEQ ID NO: 901302 - DNA, 22 bp, Artificial Sequence
  chemically synthesized
gggactgttgtggggtggggga

SEQ ID NO: 901303 - DNA, 22 bp, Artificial Sequence
  chemically synthesized
tggggactgttgtggggtgggg

SEQ ID NO: 901304 - DNA, 22 bp, Artificial Sequence
  chemically synthesized
cccccttcccccaccccacaac

SEQ ID NO: 901305 - DNA, 22 bp, Artificial Sequence
  chemically synthesized
cccccaccccacaacagtcccc

SEQ ID NO: 901306 - DNA, 22 bp, Artificial Sequence
  chemically synthesized
ccccaccccacaacagtcccca

SEQ ID NO: 901307 - DNA, 22 bp, Artificial Sequence
  chemically synthesized
aacaatgagaacacatggacac

SEQ ID NO: 901308 - DNA, 22 bp, Artificial Sequence
  chemically synthesized
cccttcctgtgtccatgtgttc

SEQ ID NO: 901309 - DNA, 22 bp, Artificial Sequence
  chemically synthesized
cctgtgtccatgtgttctcatt

SEQ ID NO: 901310 - DNA, 22 bp, Artificial Sequence
  chemically synthesized
ctgtgtccatgtgttctcattg

SEQ ID NO: 901311 - DNA, 22 bp, Artificial Sequence
  chemically synthesized
tgtccatgtgttctcattgttc

SEQ ID NO: 901312 - DNA, 22 bp, Artificial Sequence
  chemically synthesized
ataggtgggaattgaacaatga

SEQ ID NO: 901313 - DNA, 22 bp, Artificial Sequence
  chemically synthesized
actcataggtgggaattgaaca

SEQ ID NO: 901314 - DNA, 22 bp, Artificial Sequence
  chemically synthesized
tcactcataggtgggaattgaa

SEQ ID NO: 901315 - DNA, 22 bp, Artificial Sequence
  chemically synthesized
tcattgttcaattcccacctat

SEQ ID NO: 901316 - DNA, 22 bp, Artificial Sequence
  chemically synthesized
attgttcaattcccacctatga

SEQ ID NO: 901317 - DNA, 22 bp, Artificial Sequence
  chemically synthesized
ttcaattcccacctatgagtga

SEQ ID NO: 901318 - DNA, 22 bp, Artificial Sequence
  chemically synthesized
aattcccacctatgagtgagaa

SEQ ID NO: 901319 - DNA, 22 bp, Artificial Sequence
  chemically synthesized
ccacctatgagtgagaacatgc

SEQ ID NO: 901320 - DNA, 22 bp, Artificial Sequence
  chemically synthesized
tgagtgagaacatgcggtgttt

SEQ ID NO: 901321 - DNA, 22 bp, Artificial Sequence
  chemically synthesized
tcgcaagaacaaaaaaccaaac

SEQ ID NO: 901322 - DNA, 22 bp, Artificial Sequence
  chemically synthesized
agtaaactgtcgcaagaacaaa

SEQ ID NO: 901323 - DNA, 22 bp, Artificial Sequence
  chemically synthesized
tcagtaaactgtcgcaagaaca

SEQ ID NO: 901324 - DNA, 22 bp, Artificial Sequence
  chemically synthesized
ggttttttgttcttgcgacagt

SEQ ID NO: 901325 - DNA, 22 bp, Artificial Sequence
  chemically synthesized
gttttttgttcttgcgacagtt

SEQ ID NO: 901326 - DNA, 22 bp, Artificial Sequence
  chemically synthesized
tttgttcttgcgacagtttact

SEQ ID NO: 901327 - DNA, 22 bp, Artificial Sequence
  chemically synthesized
ttgttcttgcgacagtttactg

SEQ ID NO: 901328 - DNA, 22 bp, Artificial Sequence
  chemically synthesized
tgttcttgcgacagtttactga

SEQ ID NO: 901329 - DNA, 22 bp, Artificial Sequence
  chemically synthesized
gttcttgcgacagtttactgag

SEQ ID NO: 901330 - DNA, 22 bp, Artificial Sequence
  chemically synthesized
gaaatcatcgttctcagtaaac

SEQ ID NO: 901331 - DNA, 22 bp, Artificial Sequence
  chemically synthesized
ttcttgcgacagtttactgaga

SEQ ID NO: 901332 - DNA, 22 bp, Artificial Sequence
  chemically synthesized
ttgcgacagtttactgagaacg

SEQ ID NO: 901333 - DNA, 22 bp, Artificial Sequence
  chemically synthesized
gcgacagtttactgagaacgat

SEQ ID NO: 901334 - DNA, 22 bp, Artificial Sequence
  chemically synthesized
cgacagtttactgagaacgatg

SEQ ID NO: 901335 - DNA, 22 bp, Artificial Sequence
  chemically synthesized
actgagaacgatgatttccaat

SEQ ID NO: 901336 - DNA, 22 bp, Artificial Sequence
  chemically synthesized
ctgagaacgatgatttccaatt

SEQ ID NO: 901337 - DNA, 22 bp, Artificial Sequence
  chemically synthesized
agaacgatgatttccaatttca

SEQ ID NO: 901338 - DNA, 22 bp, Artificial Sequence
  chemically synthesized
taggcacatgggtgaaattgga

SEQ ID NO: 901339 - DNA, 22 bp, Artificial Sequence
  chemically synthesized
gtaggcacatgggtgaaattgg

SEQ ID NO: 901340 - DNA, 22 bp, Artificial Sequence
  chemically synthesized
tgtaggcacatgggtgaaattg

SEQ ID NO: 901341 - DNA, 22 bp, Artificial Sequence
  chemically synthesized
atgtcctttgtaggcacatggg

SEQ ID NO: 901342 - DNA, 22 bp, Artificial Sequence
  chemically synthesized
ccaatttcacccatgtgcctac

SEQ ID NO: 901343 - DNA, 22 bp, Artificial Sequence
  chemically synthesized
caatttcacccatgtgcctaca

SEQ ID NO: 901344 - DNA, 22 bp, Artificial Sequence
  chemically synthesized
cacccatgtgcctacaaaggac

SEQ ID NO: 901345 - DNA, 22 bp, Artificial Sequence
  chemically synthesized
acccatgtgcctacaaaggaca

SEQ ID NO: 901346 - DNA, 22 bp, Artificial Sequence
  chemically synthesized
caaaggacatgaactcatcctt

SEQ ID NO: 901347 - DNA, 22 bp, Artificial Sequence
  chemically synthesized
tgcagccataaaaaaggatgag

SEQ ID NO: 901348 - DNA, 22 bp, Artificial Sequence
  chemically synthesized
atccttttttatggctgcatag

SEQ ID NO: 901349 - DNA, 22 bp, Artificial Sequence
  chemically synthesized
ttttatggctgcatagtattgc

SEQ ID NO: 901350 - DNA, 22 bp, Artificial Sequence
  chemically synthesized
tttatggctgcatagtattgca

SEQ ID NO: 901351 - DNA, 22 bp, Artificial Sequence
  chemically synthesized
ttatggctgcatagtattgcat

SEQ ID NO: 901352 - DNA, 22 bp, Artificial Sequence
  chemically synthesized
tatggctgcatagtattgcatg

SEQ ID NO: 901353 - DNA, 22 bp, Artificial Sequence
  chemically synthesized
atggctgcatagtattgcatgg

SEQ ID NO: 901354 - DNA, 22 bp, Artificial Sequence
  chemically synthesized
tggctgcatagtattgcatggt

SEQ ID NO: 901355 - DNA, 22 bp, Artificial Sequence
  chemically synthesized
catagtattgcatggtgtatat

SEQ ID NO: 901356 - DNA, 22 bp, Artificial Sequence
  chemically synthesized
agaaaatgtggcacatatacac

SEQ ID NO: 901357 - DNA, 22 bp, Artificial Sequence
  chemically synthesized
gattaagaaaatgtggcacata

SEQ ID NO: 901358 - DNA, 22 bp, Artificial Sequence
  chemically synthesized
catggtgtatatgtgccacatt

SEQ ID NO: 901359 - DNA, 22 bp, Artificial Sequence
  chemically synthesized
tcttaatccagtctatcattgt

SEQ ID NO: 901360 - DNA, 22 bp, Artificial Sequence
  chemically synthesized
cttaatccagtctatcattgtt

SEQ ID NO: 901361 - DNA, 22 bp, Artificial Sequence
  chemically synthesized
ttaatccagtctatcattgttg

SEQ ID NO: 901362 - DNA, 22 bp, Artificial Sequence
  chemically synthesized
aatccagtctatcattgttgga

SEQ ID NO: 901363 - DNA, 22 bp, Artificial Sequence
  chemically synthesized
atccagtctatcattgttggac

SEQ ID NO: 901364 - DNA, 22 bp, Artificial Sequence
  chemically synthesized
gaaccaacccaaatgtccaaca

SEQ ID NO: 901365 - DNA, 22 bp, Artificial Sequence
  chemically synthesized
ggaaccaacccaaatgtccaac

SEQ ID NO: 901366 - DNA, 22 bp, Artificial Sequence
  chemically synthesized
tcattgttggacatttgggttg

SEQ ID NO: 901367 - DNA, 22 bp, Artificial Sequence
  chemically synthesized
ttggacatttgggttggttcca

SEQ ID NO: 901368 - DNA, 22 bp, Artificial Sequence
  chemically synthesized
gacatttgggttggttccaagt

SEQ ID NO: 901369 - DNA, 22 bp, Artificial Sequence
  chemically synthesized
acaatagcaaagacttggaacc

SEQ ID NO: 901370 - DNA, 22 bp, Artificial Sequence
  chemically synthesized
ttcacaatagcaaagacttgga

SEQ ID NO: 901371 - DNA, 22 bp, Artificial Sequence
  chemically synthesized
gggttggttccaagtctttgct

SEQ ID NO: 901372 - DNA, 22 bp, Artificial Sequence
  chemically synthesized
ggttggttccaagtctttgcta

SEQ ID NO: 901373 - DNA, 22 bp, Artificial Sequence
  chemically synthesized
cggcgctattcacaatagcaaa

SEQ ID NO: 901374 - DNA, 22 bp, Artificial Sequence
  chemically synthesized
gttccaagtctttgctattgtg

SEQ ID NO: 901375 - DNA, 22 bp, Artificial Sequence
  chemically synthesized
ttgcggcgctattcacaatagc

SEQ ID NO: 901376 - DNA, 22 bp, Artificial Sequence
  chemically synthesized
attgcggcgctattcacaatag

SEQ ID NO: 901377 - DNA, 22 bp, Artificial Sequence
  chemically synthesized
caagtctttgctattgtgaata

SEQ ID NO: 901378 - DNA, 22 bp, Artificial Sequence
  chemically synthesized
tgctattgtgaatagcgccgca

SEQ ID NO: 901379 - DNA, 22 bp, Artificial Sequence
  chemically synthesized
gctattgtgaatagcgccgcaa

SEQ ID NO: 901380 - DNA, 22 bp, Artificial Sequence
  chemically synthesized
ctattgtgaatagcgccgcaat

SEQ ID NO: 901381 - DNA, 22 bp, Artificial Sequence
  chemically synthesized
ttgtgaatagcgccgcaataaa

SEQ ID NO: 901382 - DNA, 22 bp, Artificial Sequence
  chemically synthesized
tgaatagcgccgcaataaacat

SEQ ID NO: 901383 - DNA, 22 bp, Artificial Sequence
  chemically synthesized
taaagacacatgcacacgtatg

SEQ ID NO: 901384 - DNA, 22 bp, Artificial Sequence
  chemically synthesized
ctataaagacacatgcacacgt

SEQ ID NO: 901385 - DNA, 22 bp, Artificial Sequence
  chemically synthesized
taaatcatgctgctataaagac

SEQ ID NO: 901386 - DNA, 22 bp, Artificial Sequence
  chemically synthesized
tatagcagcatgatttatagtc

SEQ ID NO: 901387 - DNA, 22 bp, Artificial Sequence
  chemically synthesized
atagcagcatgatttatagtcc

SEQ ID NO: 901388 - DNA, 22 bp, Artificial Sequence
  chemically synthesized
tagcagcatgatttatagtcct

SEQ ID NO: 901389 - DNA, 22 bp, Artificial Sequence
  chemically synthesized
ggtatatacccaaaggactata

SEQ ID NO: 901390 - DNA, 22 bp, Artificial Sequence
  chemically synthesized
ctgggtatatacccaaaggact

SEQ ID NO: 901391 - DNA, 22 bp, Artificial Sequence
  chemically synthesized
atagtcctttgggtatataccc

SEQ ID NO: 901392 - DNA, 22 bp, Artificial Sequence
  chemically synthesized
tagtcctttgggtatataccca

SEQ ID NO: 901393 - DNA, 22 bp, Artificial Sequence
  chemically synthesized
acccagccatcccattactggg

SEQ ID NO: 901394 - DNA, 22 bp, Artificial Sequence
  chemically synthesized
gacccagccatcccattactgg

SEQ ID NO: 901395 - DNA, 22 bp, Artificial Sequence
  chemically synthesized
tgggtatatacccagtaatggg

SEQ ID NO: 901396 - DNA, 22 bp, Artificial Sequence
  chemically synthesized
gggtatatacccagtaatggga

SEQ ID NO: 901397 - DNA, 22 bp, Artificial Sequence
  chemically synthesized
ggtatatacccagtaatgggat

SEQ ID NO: 901398 - DNA, 22 bp, Artificial Sequence
  chemically synthesized
gaaataccatttgacccagcca

SEQ ID NO: 901399 - DNA, 22 bp, Artificial Sequence
  chemically synthesized
gaactagaaataccatttgacc

SEQ ID NO: 901400 - DNA, 22 bp, Artificial Sequence
  chemically synthesized
agggatctagaactagaaatac

SEQ ID NO: 901401 - DNA, 22 bp, Artificial Sequence
  chemically synthesized
ggtcaaatggtatttctagttc

SEQ ID NO: 901402 - DNA, 22 bp, Artificial Sequence
  chemically synthesized
ctcagggatctagaactagaaa

SEQ ID NO: 901403 - DNA, 22 bp, Artificial Sequence
  chemically synthesized
ctagttctagatccctgaggaa

SEQ ID NO: 901404 - DNA, 22 bp, Artificial Sequence
  chemically synthesized
tagttctagatccctgaggaat

SEQ ID NO: 901405 - DNA, 22 bp, Artificial Sequence
  chemically synthesized
gttctagatccctgaggaatcg

SEQ ID NO: 901406 - DNA, 22 bp, Artificial Sequence
  chemically synthesized
tggaagtcggtgtggcgattcc

SEQ ID NO: 901407 - DNA, 22 bp, Artificial Sequence
  chemically synthesized
tagatccctgaggaatcgccac

SEQ ID NO: 901408 - DNA, 22 bp, Artificial Sequence
  chemically synthesized
gatccctgaggaatcgccacac

SEQ ID NO: 901409 - DNA, 22 bp, Artificial Sequence
  chemically synthesized
aaccattgtggaagtcggtgtg

SEQ ID NO: 901410 - DNA, 22 bp, Artificial Sequence
  chemically synthesized
aggaatcgccacaccgacttcc

SEQ ID NO: 901411 - DNA, 22 bp, Artificial Sequence
  chemically synthesized
gttcaaccattgtggaagtcgg

SEQ ID NO: 901412 - DNA, 22 bp, Artificial Sequence
  chemically synthesized
taaactagttcaaccattgtgg

SEQ ID NO: 901413 - DNA, 22 bp, Artificial Sequence
  chemically synthesized
gtgggactgtaaactagttcaa

SEQ ID NO: 901414 - DNA, 22 bp, Artificial Sequence
  chemically synthesized
ccacaatggttgaactagttta

SEQ ID NO: 901415 - DNA, 22 bp, Artificial Sequence
  chemically synthesized
ttggtgggactgtaaactagtt

SEQ ID NO: 901416 - DNA, 22 bp, Artificial Sequence
  chemically synthesized
cacaatggttgaactagtttac

SEQ ID NO: 901417 - DNA, 22 bp, Artificial Sequence
  chemically synthesized
cactgttggtgggactgtaaac

SEQ ID NO: 901418 - DNA, 22 bp, Artificial Sequence
  chemically synthesized
acactgttggtgggactgtaaa

SEQ ID NO: 901419 - DNA, 22 bp, Artificial Sequence
  chemically synthesized
tacactgttggtgggactgtaa

SEQ ID NO: 901420 - DNA, 22 bp, Artificial Sequence
  chemically synthesized
ttacactgttggtgggactgta

SEQ ID NO: 901421 - DNA, 22 bp, Artificial Sequence
  chemically synthesized
aactagtttacagtcccaccaa

SEQ ID NO: 901422 - DNA, 22 bp, Artificial Sequence
  chemically synthesized
gtttacagtcccaccaacagtg

SEQ ID NO: 901423 - DNA, 22 bp, Artificial Sequence
  chemically synthesized
acagtcccaccaacagtgtaaa

SEQ ID NO: 901424 - DNA, 22 bp, Artificial Sequence
  chemically synthesized
cagtcccaccaacagtgtaaaa

SEQ ID NO: 901425 - DNA, 22 bp, Artificial Sequence
  chemically synthesized
gagaggatgtggagaaatagga

SEQ ID NO: 901426 - DNA, 22 bp, Artificial Sequence
  chemically synthesized
ctatttctccacatcctctcca

SEQ ID NO: 901427 - DNA, 22 bp, Artificial Sequence
  chemically synthesized
tttctccacatcctctccagca

SEQ ID NO: 901428 - DNA, 22 bp, Artificial Sequence
  chemically synthesized
ctccacatcctctccagcacct

SEQ ID NO: 901429 - DNA, 22 bp, Artificial Sequence
  chemically synthesized
tccacatcctctccagcacctg

SEQ ID NO: 901430 - DNA, 22 bp, Artificial Sequence
  chemically synthesized
cacatcctctccagcacctgtt

SEQ ID NO: 901431 - DNA, 22 bp, Artificial Sequence
  chemically synthesized
aaaagtcaggaaacaacaggtg

SEQ ID NO: 901432 - DNA, 22 bp, Artificial Sequence
  chemically synthesized
tccagcacctgttgtttcctga

SEQ ID NO: 901433 - DNA, 22 bp, Artificial Sequence
  chemically synthesized
cagcacctgttgtttcctgact

SEQ ID NO: 901434 - DNA, 22 bp, Artificial Sequence
  chemically synthesized
gaatggcaatcattaaaaagtc

SEQ ID NO: 901435 - DNA, 22 bp, Artificial Sequence
  chemically synthesized
ttgtttcctgactttttaatga

SEQ ID NO: 901436 - DNA, 22 bp, Artificial Sequence
  chemically synthesized
tttcctgactttttaatgattg

SEQ ID NO: 901437 - DNA, 22 bp, Artificial Sequence
  chemically synthesized
cctgactttttaatgattgcca

SEQ ID NO: 901438 - DNA, 22 bp, Artificial Sequence
  chemically synthesized
ctgactttttaatgattgccat

SEQ ID NO: 901439 - DNA, 22 bp, Artificial Sequence
  chemically synthesized
acaccagttagaatggcaatca

SEQ ID NO: 901440 - DNA, 22 bp, Artificial Sequence
  chemically synthesized
actttttaatgattgccattct

SEQ ID NO: 901441 - DNA, 22 bp, Artificial Sequence
  chemically synthesized
tttaatgattgccattctaact

SEQ ID NO: 901442 - DNA, 22 bp, Artificial Sequence
  chemically synthesized
ttaatgattgccattctaactg

SEQ ID NO: 901443 - DNA, 22 bp, Artificial Sequence
  chemically synthesized
taatgattgccattctaactgg

SEQ ID NO: 901444 - DNA, 22 bp, Artificial Sequence
  chemically synthesized
aatgattgccattctaactggt

SEQ ID NO: 901445 - DNA, 22 bp, Artificial Sequence
  chemically synthesized
atgattgccattctaactggtg

SEQ ID NO: 901446 - DNA, 22 bp, Artificial Sequence
  chemically synthesized
ccattctaactggtgtgagatg

SEQ ID NO: 901447 - DNA, 22 bp, Artificial Sequence
  chemically synthesized
taactggtgtgagatggtatct

SEQ ID NO: 901448 - DNA, 22 bp, Artificial Sequence
  chemically synthesized
actggtgtgagatggtatctca

SEQ ID NO: 901449 - DNA, 22 bp, Artificial Sequence
  chemically synthesized
gtgtgagatggtatctcattgt

SEQ ID NO: 901450 - DNA, 22 bp, Artificial Sequence
  chemically synthesized
gccatcagagaaatgcaaatca

SEQ ID NO: 901451 - DNA, 22 bp, Artificial Sequence
  chemically synthesized
attgtggttttgatttgcattt

SEQ ID NO: 901452 - DNA, 22 bp, Artificial Sequence
  chemically synthesized
tggttttgatttgcatttctct

SEQ ID NO: 901453 - DNA, 22 bp, Artificial Sequence
  chemically synthesized
accatcactggccatcagagaa

SEQ ID NO: 901454 - DNA, 22 bp, Artificial Sequence
  chemically synthesized
tgatttgcatttctctgatggc

SEQ ID NO: 901455 - DNA, 22 bp, Artificial Sequence
  chemically synthesized
gatttgcatttctctgatggcc

SEQ ID NO: 901456 - DNA, 22 bp, Artificial Sequence
  chemically synthesized
atttgcatttctctgatggcca

SEQ ID NO: 901457 - DNA, 22 bp, Artificial Sequence
  chemically synthesized
gcatttctctgatggccagtga

SEQ ID NO: 901458 - DNA, 22 bp, Artificial Sequence
  chemically synthesized
catttctctgatggccagtgat

SEQ ID NO: 901459 - DNA, 22 bp, Artificial Sequence
  chemically synthesized
ctctgatggccagtgatggtga

SEQ ID NO: 901460 - DNA, 22 bp, Artificial Sequence
  chemically synthesized
tctgatggccagtgatggtgag

SEQ ID NO: 901461 - DNA, 22 bp, Artificial Sequence
  chemically synthesized
tgatggccagtgatggtgagca

SEQ ID NO: 901462 - DNA, 22 bp, Artificial Sequence
  chemically synthesized
atggccagtgatggtgagcatt

SEQ ID NO: 901463 - DNA, 22 bp, Artificial Sequence
  chemically synthesized
tgcagccaaaaaacacatgaaa

SEQ ID NO: 901464 - DNA, 22 bp, Artificial Sequence
  chemically synthesized
atgcagccaaaaaacacatgaa

SEQ ID NO: 901465 - DNA, 22 bp, Artificial Sequence
  chemically synthesized
tttcatgtgttttttggctgca

SEQ ID NO: 901466 - DNA, 22 bp, Artificial Sequence
  chemically synthesized
ttcatgtgttttttggctgcat

SEQ ID NO: 901467 - DNA, 22 bp, Artificial Sequence
  chemically synthesized
tcatgtgttttttggctgcata

SEQ ID NO: 901468 - DNA, 22 bp, Artificial Sequence
  chemically synthesized
catgtgttttttggctgcataa

SEQ ID NO: 901469 - DNA, 22 bp, Artificial Sequence
  chemically synthesized
aaaagaagacatttatgcagcc

SEQ ID NO: 901470 - DNA, 22 bp, Artificial Sequence
  chemically synthesized
atgtgttttttggctgcataaa

SEQ ID NO: 901471 - DNA, 22 bp, Artificial Sequence
  chemically synthesized
tcaaaagaagacatttatgcag

SEQ ID NO: 901472 - DNA, 22 bp, Artificial Sequence
  chemically synthesized
ctcaaaagaagacatttatgca

SEQ ID NO: 901473 - DNA, 22 bp, Artificial Sequence
  chemically synthesized
tttggctgcataaatgtcttct

SEQ ID NO: 901474 - DNA, 22 bp, Artificial Sequence
  chemically synthesized
ttggctgcataaatgtcttctt

SEQ ID NO: 901475 - DNA, 22 bp, Artificial Sequence
  chemically synthesized
tggctgcataaatgtcttcttt

SEQ ID NO: 901476 - DNA, 22 bp, Artificial Sequence
  chemically synthesized
ggctgcataaatgtcttctttt

SEQ ID NO: 901477 - DNA, 22 bp, Artificial Sequence
  chemically synthesized
gctgcataaatgtcttcttttg

SEQ ID NO: 901478 - DNA, 22 bp, Artificial Sequence
  chemically synthesized
cataaatgtcttcttttgagaa

SEQ ID NO: 901479 - DNA, 22 bp, Artificial Sequence
  chemically synthesized
cttttgagaagtgtctgttcat

SEQ ID NO: 901480 - DNA, 22 bp, Artificial Sequence
  chemically synthesized
ttttgagaagtgtctgttcatg

SEQ ID NO: 901481 - DNA, 22 bp, Artificial Sequence
  chemically synthesized
ttgagaagtgtctgttcatgtc

SEQ ID NO: 901482 - DNA, 22 bp, Artificial Sequence
  chemically synthesized
tgagaagtgtctgttcatgtcc

SEQ ID NO: 901483 - DNA, 22 bp, Artificial Sequence
  chemically synthesized
gagaagtgtctgttcatgtcct

SEQ ID NO: 901484 - DNA, 22 bp, Artificial Sequence
  chemically synthesized
agaagtgtctgttcatgtcctt

SEQ ID NO: 901485 - DNA, 22 bp, Artificial Sequence
  chemically synthesized
ttcatgtccttcgcccactttt

SEQ ID NO: 901486 - DNA, 22 bp, Artificial Sequence
  chemically synthesized
atgtccttcgcccactttttga

SEQ ID NO: 901487 - DNA, 22 bp, Artificial Sequence
  chemically synthesized
cgcccactttttgatggggttg

SEQ ID NO: 901488 - DNA, 22 bp, Artificial Sequence
  chemically synthesized
gcccactttttgatggggttgt

SEQ ID NO: 901489 - DNA, 22 bp, Artificial Sequence
  chemically synthesized
caagaaaaaaacaaacaacccc

SEQ ID NO: 901490 - DNA, 22 bp, Artificial Sequence
  chemically synthesized
acaagaaaaaaacaaacaaccc

SEQ ID NO: 901491 - DNA, 22 bp, Artificial Sequence
  chemically synthesized
tttgatggggttgtttgttttt

SEQ ID NO: 901492 - DNA, 22 bp, Artificial Sequence
  chemically synthesized
ttgatggggttgtttgtttttt

SEQ ID NO: 901493 - DNA, 22 bp, Artificial Sequence
  chemically synthesized
tgatggggttgtttgttttttt

SEQ ID NO: 901494 - DNA, 22 bp, Artificial Sequence
  chemically synthesized
gatggggttgtttgtttttttc

SEQ ID NO: 901495 - DNA, 22 bp, Artificial Sequence
  chemically synthesized
atggggttgtttgtttttttct

SEQ ID NO: 901496 - DNA, 22 bp, Artificial Sequence
  chemically synthesized
caacaaatttacaagaaaaaaa

SEQ ID NO: 901497 - DNA, 22 bp, Artificial Sequence
  chemically synthesized
tttgtttttttcttgtaaattt

SEQ ID NO: 901498 - DNA, 22 bp, Artificial Sequence
  chemically synthesized
caatgaactccaacaaatttac

SEQ ID NO: 901499 - DNA, 22 bp, Artificial Sequence
  chemically synthesized
gtttttttcttgtaaatttgtt

SEQ ID NO: 901500 - DNA, 22 bp, Artificial Sequence
  chemically synthesized
tttttttcttgtaaatttgttg

SEQ ID NO: 901501 - DNA, 22 bp, Artificial Sequence
  chemically synthesized
ttttcttgtaaatttgttggag

SEQ ID NO: 901502 - DNA, 22 bp, Artificial Sequence
  chemically synthesized
tttcttgtaaatttgttggagt

SEQ ID NO: 901503 - DNA, 22 bp, Artificial Sequence
  chemically synthesized
ttcttgtaaatttgttggagtt

SEQ ID NO: 901504 - DNA, 22 bp, Artificial Sequence
  chemically synthesized
tcttgtaaatttgttggagttc

SEQ ID NO: 901505 - DNA, 22 bp, Artificial Sequence
  chemically synthesized
cttgtaaatttgttggagttca

SEQ ID NO: 901506 - DNA, 22 bp, Artificial Sequence
  chemically synthesized
ttgtaaatttgttggagttcat

SEQ ID NO: 901507 - DNA, 22 bp, Artificial Sequence
  chemically synthesized
gtaaatttgttggagttcattg

SEQ ID NO: 901508 - DNA, 22 bp, Artificial Sequence
  chemically synthesized
taaatttgttggagttcattgt

SEQ ID NO: 901509 - DNA, 22 bp, Artificial Sequence
  chemically synthesized
atatccagaatctacaatgaac

SEQ ID NO: 901510 - DNA, 22 bp, Artificial Sequence
  chemically synthesized
gttggagttcattgtagattct

SEQ ID NO: 901511 - DNA, 22 bp, Artificial Sequence
  chemically synthesized
ttggagttcattgtagattctg

SEQ ID NO: 901512 - DNA, 22 bp, Artificial Sequence
  chemically synthesized
gagttcattgtagattctggat

SEQ ID NO: 901513 - DNA, 22 bp, Artificial Sequence
  chemically synthesized
ataaagggctaatatccagaat

SEQ ID NO: 901514 - DNA, 22 bp, Artificial Sequence
  chemically synthesized
attgtagattctggatattagc

SEQ ID NO: 901515 - DNA, 22 bp, Artificial Sequence
  chemically synthesized
atctgataaagggctaatatcc

SEQ ID NO: 901516 - DNA, 22 bp, Artificial Sequence
  chemically synthesized
ctcatctgataaagggctaata

SEQ ID NO: 901517 - DNA, 22 bp, Artificial Sequence
  chemically synthesized
tagattctggatattagccctt

SEQ ID NO: 901518 - DNA, 22 bp, Artificial Sequence
  chemically synthesized
tggatattagccctttatcaga

SEQ ID NO: 901519 - DNA, 22 bp, Artificial Sequence
  chemically synthesized
gcaacctactcatctgataaag

SEQ ID NO: 901520 - DNA, 22 bp, Artificial Sequence
  chemically synthesized
cgcaacctactcatctgataaa

SEQ ID NO: 901521 - DNA, 22 bp, Artificial Sequence
  chemically synthesized
gatattagccctttatcagatg

SEQ ID NO: 901522 - DNA, 22 bp, Artificial Sequence
  chemically synthesized
tcgcaacctactcatctgataa

SEQ ID NO: 901523 - DNA, 22 bp, Artificial Sequence
  chemically synthesized
gccctttatcagatgagtaggt

SEQ ID NO: 901524 - DNA, 22 bp, Artificial Sequence
  chemically synthesized
tatcagatgagtaggttgcgaa

SEQ ID NO: 901525 - DNA, 22 bp, Artificial Sequence
  chemically synthesized
atcagatgagtaggttgcgaaa

SEQ ID NO: 901526 - DNA, 22 bp, Artificial Sequence
  chemically synthesized
tcagatgagtaggttgcgaaaa

SEQ ID NO: 901527 - DNA, 22 bp, Artificial Sequence
  chemically synthesized
caaaatgggagaaaattttcgc

SEQ ID NO: 901528 - DNA, 22 bp, Artificial Sequence
  chemically synthesized
cgaaaattttctcccattttgt

SEQ ID NO: 901529 - DNA, 22 bp, Artificial Sequence
  chemically synthesized
tctcccattttgtaggttgcct

SEQ ID NO: 901530 - DNA, 22 bp, Artificial Sequence
  chemically synthesized
ctcccattttgtaggttgcctg

SEQ ID NO: 901531 - DNA, 22 bp, Artificial Sequence
  chemically synthesized
tcccattttgtaggttgcctgt

SEQ ID NO: 901532 - DNA, 22 bp, Artificial Sequence
  chemically synthesized
ccatcagagtgaacaggcaacc

SEQ ID NO: 901533 - DNA, 22 bp, Artificial Sequence
  chemically synthesized
ccattttgtaggttgcctgttc

SEQ ID NO: 901534 - DNA, 22 bp, Artificial Sequence
  chemically synthesized
tgtaggttgcctgttcactctg

SEQ ID NO: 901535 - DNA, 22 bp, Artificial Sequence
  chemically synthesized
gtaggttgcctgttcactctga

SEQ ID NO: 901536 - DNA, 22 bp, Artificial Sequence
  chemically synthesized
taggttgcctgttcactctgat

SEQ ID NO: 901537 - DNA, 22 bp, Artificial Sequence
  chemically synthesized
cctgttcactctgatggtagtt

SEQ ID NO: 901538 - DNA, 22 bp, Artificial Sequence
  chemically synthesized
cacagcaaaagaaactaccatc

SEQ ID NO: 901539 - DNA, 22 bp, Artificial Sequence
  chemically synthesized
tgcacagcaaaagaaactacca

SEQ ID NO: 901540 - DNA, 22 bp, Artificial Sequence
  chemically synthesized
ctgcacagcaaaagaaactacc

SEQ ID NO: 901541 - DNA, 22 bp, Artificial Sequence
  chemically synthesized
ttcactctgatggtagtttctt

SEQ ID NO: 901542 - DNA, 22 bp, Artificial Sequence
  chemically synthesized
actctgatggtagtttcttttg

SEQ ID NO: 901543 - DNA, 22 bp, Artificial Sequence
  chemically synthesized
tgatggtagtttcttttgctgt

SEQ ID NO: 901544 - DNA, 22 bp, Artificial Sequence
  chemically synthesized
aggagcttctgcacagcaaaag

SEQ ID NO: 901545 - DNA, 22 bp, Artificial Sequence
  chemically synthesized
atggtagtttcttttgctgtgc

SEQ ID NO: 901546 - DNA, 22 bp, Artificial Sequence
  chemically synthesized
aactaaggagcttctgcacagc

SEQ ID NO: 901547 - DNA, 22 bp, Artificial Sequence
  chemically synthesized
attaaactaaggagcttctgca

SEQ ID NO: 901548 - DNA, 22 bp, Artificial Sequence
  chemically synthesized
cttttgctgtgcagaagctcct

SEQ ID NO: 901549 - DNA, 22 bp, Artificial Sequence
  chemically synthesized
ttttgctgtgcagaagctcctt

SEQ ID NO: 901550 - DNA, 22 bp, Artificial Sequence
  chemically synthesized
ttgctgtgcagaagctccttag

SEQ ID NO: 901551 - DNA, 22 bp, Artificial Sequence
  chemically synthesized
tgctgtgcagaagctccttagt

SEQ ID NO: 901552 - DNA, 22 bp, Artificial Sequence
  chemically synthesized
gctgtgcagaagctccttagtt

SEQ ID NO: 901553 - DNA, 22 bp, Artificial Sequence
  chemically synthesized
ctgtgcagaagctccttagttt

SEQ ID NO: 901554 - DNA, 22 bp, Artificial Sequence
  chemically synthesized
tgcagaagctccttagtttaat

SEQ ID NO: 901555 - DNA, 22 bp, Artificial Sequence
  chemically synthesized
acaaatgggatctaattaaact

SEQ ID NO: 901556 - DNA, 22 bp, Artificial Sequence
  chemically synthesized
cttagtttaattagatcccatt

SEQ ID NO: 901557 - DNA, 22 bp, Artificial Sequence
  chemically synthesized
agtttaattagatcccatttgt

SEQ ID NO: 901558 - DNA, 22 bp, Artificial Sequence
  chemically synthesized
gtttaattagatcccatttgtc

SEQ ID NO: 901559 - DNA, 22 bp, Artificial Sequence
  chemically synthesized
aattagatcccatttgtcaatt

SEQ ID NO: 901560 - DNA, 22 bp, Artificial Sequence
  chemically synthesized
attagatcccatttgtcaattt

SEQ ID NO: 901561 - DNA, 22 bp, Artificial Sequence
  chemically synthesized
gatcccatttgtcaattttggc

SEQ ID NO: 901562 - DNA, 22 bp, Artificial Sequence
  chemically synthesized
gtcaattttggcttttgttgcc

SEQ ID NO: 901563 - DNA, 22 bp, Artificial Sequence
  chemically synthesized
tcaattttggcttttgttgcca

SEQ ID NO: 901564 - DNA, 22 bp, Artificial Sequence
  chemically synthesized
aaacaccaaaaccaatggcaac

SEQ ID NO: 901565 - DNA, 22 bp, Artificial Sequence
  chemically synthesized
tggcttttgttgccattggttt

SEQ ID NO: 901566 - DNA, 22 bp, Artificial Sequence
  chemically synthesized
ggcttttgttgccattggtttt

SEQ ID NO: 901567 - DNA, 22 bp, Artificial Sequence
  chemically synthesized
gcttttgttgccattggttttg

SEQ ID NO: 901568 - DNA, 22 bp, Artificial Sequence
  chemically synthesized
atgtctaaaacaccaaaaccaa

SEQ ID NO: 901569 - DNA, 22 bp, Artificial Sequence
  chemically synthesized
catgtctaaaacaccaaaacca

SEQ ID NO: 901570 - DNA, 22 bp, Artificial Sequence
  chemically synthesized
ttgttgccattggttttggtgt

SEQ ID NO: 901571 - DNA, 22 bp, Artificial Sequence
  chemically synthesized
tgttgccattggttttggtgtt

SEQ ID NO: 901572 - DNA, 22 bp, Artificial Sequence
  chemically synthesized
gttgccattggttttggtgttt

SEQ ID NO: 901573 - DNA, 22 bp, Artificial Sequence
  chemically synthesized
ttgccattggttttggtgtttt

SEQ ID NO: 901574 - DNA, 22 bp, Artificial Sequence
  chemically synthesized
ccattggttttggtgttttaga

SEQ ID NO: 901575 - DNA, 22 bp, Artificial Sequence
  chemically synthesized
gttttggtgttttagacatgaa

SEQ ID NO: 901576 - DNA, 22 bp, Artificial Sequence
  chemically synthesized
tggtgttttagacatgaagtcc

SEQ ID NO: 901577 - DNA, 22 bp, Artificial Sequence
  chemically synthesized
ggtgttttagacatgaagtcct

SEQ ID NO: 901578 - DNA, 22 bp, Artificial Sequence
  chemically synthesized
gtgttttagacatgaagtcctt

SEQ ID NO: 901579 - DNA, 22 bp, Artificial Sequence
  chemically synthesized
aggacataggcatgggcaagga

SEQ ID NO: 901580 - DNA, 22 bp, Artificial Sequence
  chemically synthesized
tagacatgaagtccttgcccat

SEQ ID NO: 901581 - DNA, 22 bp, Artificial Sequence
  chemically synthesized
agacatgaagtccttgcccatg

SEQ ID NO: 901582 - DNA, 22 bp, Artificial Sequence
  chemically synthesized
gacatgaagtccttgcccatgc

SEQ ID NO: 901583 - DNA, 22 bp, Artificial Sequence
  chemically synthesized
ccattcaggacataggcatggg

SEQ ID NO: 901584 - DNA, 22 bp, Artificial Sequence
  chemically synthesized
aggcattaccattcaggacata

SEQ ID NO: 901585 - DNA, 22 bp, Artificial Sequence
  chemically synthesized
gaggcattaccattcaggacat

SEQ ID NO: 901586 - DNA, 22 bp, Artificial Sequence
  chemically synthesized
gcccatgcctatgtcctgaatg

SEQ ID NO: 901587 - DNA, 22 bp, Artificial Sequence
  chemically synthesized
ttgaggcattaccattcaggac

SEQ ID NO: 901588 - DNA, 22 bp, Artificial Sequence
  chemically synthesized
cccatgcctatgtcctgaatgg

SEQ ID NO: 901589 - DNA, 22 bp, Artificial Sequence
  chemically synthesized
tcttgaggcattaccattcagg

SEQ ID NO: 901590 - DNA, 22 bp, Artificial Sequence
  chemically synthesized
ttctcttgaggcattaccattc

SEQ ID NO: 901591 - DNA, 22 bp, Artificial Sequence
  chemically synthesized
attctcttgaggcattaccatt

SEQ ID NO: 901592 - DNA, 22 bp, Artificial Sequence
  chemically synthesized
tattctcttgaggcattaccat

SEQ ID NO: 901593 - DNA, 22 bp, Artificial Sequence
  chemically synthesized
tgtcctgaatggtaatgcctca

SEQ ID NO: 901594 - DNA, 22 bp, Artificial Sequence
  chemically synthesized
ggcattttattctcttgaggca

SEQ ID NO: 901595 - DNA, 22 bp, Artificial Sequence
  chemically synthesized
ctaggcattttattctcttgag

SEQ ID NO: 901596 - DNA, 22 bp, Artificial Sequence
  chemically synthesized
aatggtaatgcctcaagagaat

SEQ ID NO: 901597 - DNA, 22 bp, Artificial Sequence
  chemically synthesized
gattcctaggcattttattctc

SEQ ID NO: 901598 - DNA, 22 bp, Artificial Sequence
  chemically synthesized
taagttggattcctaggcattt

SEQ ID NO: 901599 - DNA, 22 bp, Artificial Sequence
  chemically synthesized
gtaagttggattcctaggcatt

SEQ ID NO: 901600 - DNA, 22 bp, Artificial Sequence
  chemically synthesized
aagagaataaaatgcctaggaa

SEQ ID NO: 901601 - DNA, 22 bp, Artificial Sequence
  chemically synthesized
acatcccttgtaagttggattc

SEQ ID NO: 901602 - DNA, 22 bp, Artificial Sequence
  chemically synthesized
cacatcccttgtaagttggatt

SEQ ID NO: 901603 - DNA, 22 bp, Artificial Sequence
  chemically synthesized
ggaatccaacttacaagggatg

SEQ ID NO: 901604 - DNA, 22 bp, Artificial Sequence
  chemically synthesized
aagaggtccttcacatcccttg

SEQ ID NO: 901605 - DNA, 22 bp, Artificial Sequence
  chemically synthesized
gaagaggtccttcacatccctt

SEQ ID NO: 901606 - DNA, 22 bp, Artificial Sequence
  chemically synthesized
cttgaagaggtccttcacatcc

SEQ ID NO: 901607 - DNA, 22 bp, Artificial Sequence
  chemically synthesized
tccttgaagaggtccttcacat

SEQ ID NO: 901608 - DNA, 22 bp, Artificial Sequence
  chemically synthesized
acaagggatgtgaaggacctct

SEQ ID NO: 901609 - DNA, 22 bp, Artificial Sequence
  chemically synthesized
caagggatgtgaaggacctctt

SEQ ID NO: 901610 - DNA, 22 bp, Artificial Sequence
  chemically synthesized
tagttctccttgaagaggtcct

SEQ ID NO: 901611 - DNA, 22 bp, Artificial Sequence
  chemically synthesized
gtagttctccttgaagaggtcc

SEQ ID NO: 901612 - DNA, 22 bp, Artificial Sequence
  chemically synthesized
agcagtggtttgtagttctcct

SEQ ID NO: 901613 - DNA, 22 bp, Artificial Sequence
  chemically synthesized
gagcagtggtttgtagttctcc

SEQ ID NO: 901614 - DNA, 22 bp, Artificial Sequence
  chemically synthesized
cttgagcagtggtttgtagttc

SEQ ID NO: 901615 - DNA, 22 bp, Artificial Sequence
  chemically synthesized
ccttgagcagtggtttgtagtt

SEQ ID NO: 901616 - DNA, 22 bp, Artificial Sequence
  chemically synthesized
ttcaaggagaactacaaaccac

SEQ ID NO: 901617 - DNA, 22 bp, Artificial Sequence
  chemically synthesized
tttccttgagcagtggtttgta

SEQ ID NO: 901618 - DNA, 22 bp, Artificial Sequence
  chemically synthesized
atttccttgagcagtggtttgt

SEQ ID NO: 901619 - DNA, 22 bp, Artificial Sequence
  chemically synthesized
caaggagaactacaaaccactg

SEQ ID NO: 901620 - DNA, 22 bp, Artificial Sequence
  chemically synthesized
tatttccttgagcagtggtttg

SEQ ID NO: 901621 - DNA, 22 bp, Artificial Sequence
  chemically synthesized
aaggagaactacaaaccactgc

SEQ ID NO: 901622 - DNA, 22 bp, Artificial Sequence
  chemically synthesized
ttatttccttgagcagtggttt

SEQ ID NO: 901623 - DNA, 22 bp, Artificial Sequence
  chemically synthesized
ttttatttccttgagcagtggt

SEQ ID NO: 901624 - DNA, 22 bp, Artificial Sequence
  chemically synthesized
tatcctcttttatttccttgag

SEQ ID NO: 901625 - DNA, 22 bp, Artificial Sequence
  chemically synthesized
gtatcctcttttatttccttga

SEQ ID NO: 901626 - DNA, 22 bp, Artificial Sequence
  chemically synthesized
caaaccactgctcaaggaaata

SEQ ID NO: 901627 - DNA, 22 bp, Artificial Sequence
  chemically synthesized
tttgtatcctcttttatttcct

SEQ ID NO: 901628 - DNA, 22 bp, Artificial Sequence
  chemically synthesized
gtttgtatcctcttttatttcc

SEQ ID NO: 901629 - DNA, 22 bp, Artificial Sequence
  chemically synthesized
catttgtttgtatcctctttta

SEQ ID NO: 901630 - DNA, 22 bp, Artificial Sequence
  chemically synthesized
ccatttgtttgtatcctctttt

SEQ ID NO: 901631 - DNA, 22 bp, Artificial Sequence
  chemically synthesized
ctcaaggaaataaaagaggata

SEQ ID NO: 901632 - DNA, 22 bp, Artificial Sequence
  chemically synthesized
ttccatttgtttgtatcctctt

SEQ ID NO: 901633 - DNA, 22 bp, Artificial Sequence
  chemically synthesized
aaggaaataaaagaggatacaa

SEQ ID NO: 901634 - DNA, 22 bp, Artificial Sequence
  chemically synthesized
cccatgagcatggaatgttctt

SEQ ID NO: 901635 - DNA, 22 bp, Artificial Sequence
  chemically synthesized
ctacccatgagcatggaatgtt

SEQ ID NO: 901636 - DNA, 22 bp, Artificial Sequence
  chemically synthesized
cctacccatgagcatggaatgt

SEQ ID NO: 901637 - DNA, 22 bp, Artificial Sequence
  chemically synthesized
ttcctacccatgagcatggaat

SEQ ID NO: 901638 - DNA, 22 bp, Artificial Sequence
  chemically synthesized
attcttcctacccatgagcatg

SEQ ID NO: 901639 - DNA, 22 bp, Artificial Sequence
  chemically synthesized
acgatattgattcttcctaccc

SEQ ID NO: 901640 - DNA, 22 bp, Artificial Sequence
  chemically synthesized
cacgatattgattcttcctacc

SEQ ID NO: 901641 - DNA, 22 bp, Artificial Sequence
  chemically synthesized
tcacgatattgattcttcctac

SEQ ID NO: 901642 - DNA, 22 bp, Artificial Sequence
  chemically synthesized
catgctcatgggtaggaagaat

SEQ ID NO: 901643 - DNA, 22 bp, Artificial Sequence
  chemically synthesized
atgggtaggaagaatcaatatc

SEQ ID NO: 901644 - DNA, 22 bp, Artificial Sequence
  chemically synthesized
ggcagtatgaccattttcacga

SEQ ID NO: 901645 - DNA, 22 bp, Artificial Sequence
  chemically synthesized
gggcagtatgaccattttcacg

SEQ ID NO: 901646 - DNA, 22 bp, Artificial Sequence
  chemically synthesized
ccttgggcagtatgaccatttt

SEQ ID NO: 901647 - DNA, 22 bp, Artificial Sequence
  chemically synthesized
taaattaccttgggcagtatga

SEQ ID NO: 901648 - DNA, 22 bp, Artificial Sequence
  chemically synthesized
aatctgtaaattaccttgggca

SEQ ID NO: 901649 - DNA, 22 bp, Artificial Sequence
  chemically synthesized
cccaaggtaatttacagattca

SEQ ID NO: 901650 - DNA, 22 bp, Artificial Sequence
  chemically synthesized
atggggatggcattgaatctgt

SEQ ID NO: 901651 - DNA, 22 bp, Artificial Sequence
  chemically synthesized
gatggggatggcattgaatctg

SEQ ID NO: 901652 - DNA, 22 bp, Artificial Sequence
  chemically synthesized
gtagcttgatggggatggcatt

SEQ ID NO: 901653 - DNA, 22 bp, Artificial Sequence
  chemically synthesized
acagattcaatgccatccccat

SEQ ID NO: 901654 - DNA, 22 bp, Artificial Sequence
  chemically synthesized
cagattcaatgccatccccatc

SEQ ID NO: 901655 - DNA, 22 bp, Artificial Sequence
  chemically synthesized
aatgccatccccatcaagctac

SEQ ID NO: 901656 - DNA, 22 bp, Artificial Sequence
  chemically synthesized
tgaagaaaggcattggtagctt

SEQ ID NO: 901657 - DNA, 22 bp, Artificial Sequence
  chemically synthesized
tgtgaagaaaggcattggtagc

SEQ ID NO: 901658 - DNA, 22 bp, Artificial Sequence
  chemically synthesized
caattctgtgaagaaaggcatt

SEQ ID NO: 901659 - DNA, 22 bp, Artificial Sequence
  chemically synthesized
ccaattctgtgaagaaaggcat

SEQ ID NO: 901660 - DNA, 22 bp, Artificial Sequence
  chemically synthesized
tccaattctgtgaagaaaggca

SEQ ID NO: 901661 - DNA, 22 bp, Artificial Sequence
  chemically synthesized
ttccaattctgtgaagaaaggc

SEQ ID NO: 901662 - DNA, 22 bp, Artificial Sequence
  chemically synthesized
tttccaattctgtgaagaaagg

SEQ ID NO: 901663 - DNA, 22 bp, Artificial Sequence
  chemically synthesized
ccaatgcctttcttcacagaat

SEQ ID NO: 901664 - DNA, 22 bp, Artificial Sequence
  chemically synthesized
aagtagttttttccaattctgt

SEQ ID NO: 901665 - DNA, 22 bp, Artificial Sequence
  chemically synthesized
aaagtagttttttccaattctg

SEQ ID NO: 901666 - DNA, 22 bp, Artificial Sequence
  chemically synthesized
taaagtagttttttccaattct

SEQ ID NO: 901667 - DNA, 22 bp, Artificial Sequence
  chemically synthesized
tcttcacagaattggaaaaaac

SEQ ID NO: 901668 - DNA, 22 bp, Artificial Sequence
  chemically synthesized
cttcacagaattggaaaaaact

SEQ ID NO: 901669 - DNA, 22 bp, Artificial Sequence
  chemically synthesized
ttcacagaattggaaaaaacta

SEQ ID NO: 901670 - DNA, 22 bp, Artificial Sequence
  chemically synthesized
cacagaattggaaaaaactact

SEQ ID NO: 901671 - DNA, 22 bp, Artificial Sequence
  chemically synthesized
acagaattggaaaaaactactt

SEQ ID NO: 901672 - DNA, 22 bp, Artificial Sequence
  chemically synthesized
catatgaactttaaagtagttt

SEQ ID NO: 901673 - DNA, 22 bp, Artificial Sequence
  chemically synthesized
gttccatatgaactttaaagta

SEQ ID NO: 901674 - DNA, 22 bp, Artificial Sequence
  chemically synthesized
ggttccatatgaactttaaagt

SEQ ID NO: 901675 - DNA, 22 bp, Artificial Sequence
  chemically synthesized
tggttccatatgaactttaaag

SEQ ID NO: 901676 - DNA, 22 bp, Artificial Sequence
  chemically synthesized
ttggttccatatgaactttaaa

SEQ ID NO: 901677 - DNA, 22 bp, Artificial Sequence
  chemically synthesized
gaaaaaactactttaaagttca

SEQ ID NO: 901678 - DNA, 22 bp, Artificial Sequence
  chemically synthesized
tttggttccatatgaactttaa

SEQ ID NO: 901679 - DNA, 22 bp, Artificial Sequence
  chemically synthesized
ttttggttccatatgaacttta

SEQ ID NO: 901680 - DNA, 22 bp, Artificial Sequence
  chemically synthesized
ttttttggttccatatgaactt

SEQ ID NO: 901681 - DNA, 22 bp, Artificial Sequence
  chemically synthesized
ctttaaagttcatatggaacca

SEQ ID NO: 901682 - DNA, 22 bp, Artificial Sequence
  chemically synthesized
taaagttcatatggaaccaaaa

SEQ ID NO: 901683 - DNA, 22 bp, Artificial Sequence
  chemically synthesized
aaagttcatatggaaccaaaaa

SEQ ID NO: 901684 - DNA, 22 bp, Artificial Sequence
  chemically synthesized
aagttcatatggaaccaaaaaa

SEQ ID NO: 901685 - DNA, 22 bp, Artificial Sequence
  chemically synthesized
gcgatgcgggctcttttttggt

SEQ ID NO: 901686 - DNA, 22 bp, Artificial Sequence
  chemically synthesized
ggcgatgcgggctcttttttgg

SEQ ID NO: 901687 - DNA, 22 bp, Artificial Sequence
  chemically synthesized
atatggaaccaaaaaagagccc

SEQ ID NO: 901688 - DNA, 22 bp, Artificial Sequence
  chemically synthesized
acttggcgatgcgggctctttt

SEQ ID NO: 901689 - DNA, 22 bp, Artificial Sequence
  chemically synthesized
aggattgacttggcgatgcggg

SEQ ID NO: 901690 - DNA, 22 bp, Artificial Sequence
  chemically synthesized
gctcaggattgacttggcgatg

SEQ ID NO: 901691 - DNA, 22 bp, Artificial Sequence
  chemically synthesized
ggctcaggattgacttggcgat

SEQ ID NO: 901692 - DNA, 22 bp, Artificial Sequence
  chemically synthesized
tggctcaggattgacttggcga

SEQ ID NO: 901693 - DNA, 22 bp, Artificial Sequence
  chemically synthesized
ttggctcaggattgacttggcg

SEQ ID NO: 901694 - DNA, 22 bp, Artificial Sequence
  chemically synthesized
ttttggctcaggattgacttgg

SEQ ID NO: 901695 - DNA, 22 bp, Artificial Sequence
  chemically synthesized
ttcttttggctcaggattgact

SEQ ID NO: 901696 - DNA, 22 bp, Artificial Sequence
  chemically synthesized
gttcttttggctcaggattgac

SEQ ID NO: 901697 - DNA, 22 bp, Artificial Sequence
  chemically synthesized
tgttcttttggctcaggattga

SEQ ID NO: 901698 - DNA, 22 bp, Artificial Sequence
  chemically synthesized
cagctttgttcttttggctcag

SEQ ID NO: 901699 - DNA, 22 bp, Artificial Sequence
  chemically synthesized
agccaaaagaacaaagctggag

SEQ ID NO: 901700 - DNA, 22 bp, Artificial Sequence
  chemically synthesized
aagtcaggtagtgtgatgcctc

SEQ ID NO: 901701 - DNA, 22 bp, Artificial Sequence
  chemically synthesized
gaagtcaggtagtgtgatgcct

SEQ ID NO: 901702 - DNA, 22 bp, Artificial Sequence
  chemically synthesized
gaggcatcacactacctgactt

SEQ ID NO: 901703 - DNA, 22 bp, Artificial Sequence
  chemically synthesized
tagtatagtttgaagtcaggta

SEQ ID NO: 901704 - DNA, 22 bp, Artificial Sequence
  chemically synthesized
gtagtatagtttgaagtcaggt

SEQ ID NO: 901705 - DNA, 22 bp, Artificial Sequence
  chemically synthesized
tagccttgtagtatagtttgaa

SEQ ID NO: 901706 - DNA, 22 bp, Artificial Sequence
  chemically synthesized
ctgtagccttgtagtatagttt

SEQ ID NO: 901707 - DNA, 22 bp, Artificial Sequence
  chemically synthesized
cctgacttcaaactatactaca

SEQ ID NO: 901708 - DNA, 22 bp, Artificial Sequence
  chemically synthesized
gttactgtagccttgtagtata

SEQ ID NO: 901709 - DNA, 22 bp, Artificial Sequence
  chemically synthesized
ggttactgtagccttgtagtat

SEQ ID NO: 901710 - DNA, 22 bp, Artificial Sequence
  chemically synthesized
tggttactgtagccttgtagta

SEQ ID NO: 901711 - DNA, 22 bp, Artificial Sequence
  chemically synthesized
acttcaaactatactacaaggc

SEQ ID NO: 901712 - DNA, 22 bp, Artificial Sequence
  chemically synthesized
ttttggttactgtagccttgta

SEQ ID NO: 901713 - DNA, 22 bp, Artificial Sequence
  chemically synthesized
caaactatactacaaggctaca

SEQ ID NO: 901714 - DNA, 22 bp, Artificial Sequence
  chemically synthesized
aaactatactacaaggctacag

SEQ ID NO: 901715 - DNA, 22 bp, Artificial Sequence
  chemically synthesized
tactacaaggctacagtaacca

SEQ ID NO: 901716 - DNA, 22 bp, Artificial Sequence
  chemically synthesized
caaggctacagtaaccaaaaca

SEQ ID NO: 901717 - DNA, 22 bp, Artificial Sequence
  chemically synthesized
gtaccagtaccatgctgttttg

SEQ ID NO: 901718 - DNA, 22 bp, Artificial Sequence
  chemically synthesized
ggtaccagtaccatgctgtttt

SEQ ID NO: 901719 - DNA, 22 bp, Artificial Sequence
  chemically synthesized
tggtaccagtaccatgctgttt

SEQ ID NO: 901720 - DNA, 22 bp, Artificial Sequence
  chemically synthesized
cagtaaccaaaacagcatggta

SEQ ID NO: 901721 - DNA, 22 bp, Artificial Sequence
  chemically synthesized
ttttggtaccagtaccatgctg

SEQ ID NO: 901722 - DNA, 22 bp, Artificial Sequence
  chemically synthesized
tgttttggtaccagtaccatgc

SEQ ID NO: 901723 - DNA, 22 bp, Artificial Sequence
  chemically synthesized
tatctctgttttggtaccagta

SEQ ID NO: 901724 - DNA, 22 bp, Artificial Sequence
  chemically synthesized
atctatatctctgttttggtac

SEQ ID NO: 901725 - DNA, 22 bp, Artificial Sequence
  chemically synthesized
cattgatctatatctctgtttt

SEQ ID NO: 901726 - DNA, 22 bp, Artificial Sequence
  chemically synthesized
ttccattgatctatatctctgt

SEQ ID NO: 901727 - DNA, 22 bp, Artificial Sequence
  chemically synthesized
tgttccattgatctatatctct

SEQ ID NO: 901728 - DNA, 22 bp, Artificial Sequence
  chemically synthesized
gtaccaaaacagagatatagat

SEQ ID NO: 901729 - DNA, 22 bp, Artificial Sequence
  chemically synthesized
ttctgttccattgatctatatc

SEQ ID NO: 901730 - DNA, 22 bp, Artificial Sequence
  chemically synthesized
tgttctgttccattgatctata

SEQ ID NO: 901731 - DNA, 22 bp, Artificial Sequence
  chemically synthesized
agggctctgttctgttccattg

SEQ ID NO: 901732 - DNA, 22 bp, Artificial Sequence
  chemically synthesized
tgagggctctgttctgttccat

SEQ ID NO: 901733 - DNA, 22 bp, Artificial Sequence
  chemically synthesized
ctgagggctctgttctgttcca

SEQ ID NO: 901734 - DNA, 22 bp, Artificial Sequence
  chemically synthesized
cttctgagggctctgttctgtt

SEQ ID NO: 901735 - DNA, 22 bp, Artificial Sequence
  chemically synthesized
tagatatgcggcgttacttctg

SEQ ID NO: 901736 - DNA, 22 bp, Artificial Sequence
  chemically synthesized
agaagtaacgccgcatatctac

SEQ ID NO: 901737 - DNA, 22 bp, Artificial Sequence
  chemically synthesized
tcaaagatcagatagttgtaga

SEQ ID NO: 901738 - DNA, 22 bp, Artificial Sequence
  chemically synthesized
gtcaaagatcagatagttgtag

SEQ ID NO: 901739 - DNA, 22 bp, Artificial Sequence
  chemically synthesized
aggtttgtcaaagatcagatag

SEQ ID NO: 901740 - DNA, 22 bp, Artificial Sequence
  chemically synthesized
tcaggtttgtcaaagatcagat

SEQ ID NO: 901741 - DNA, 22 bp, Artificial Sequence
  chemically synthesized
ctcaggtttgtcaaagatcaga

SEQ ID NO: 901742 - DNA, 22 bp, Artificial Sequence
  chemically synthesized
tctcaggtttgtcaaagatcag

SEQ ID NO: 901743 - DNA, 22 bp, Artificial Sequence
  chemically synthesized
ttctcaggtttgtcaaagatca

SEQ ID NO: 901744 - DNA, 22 bp, Artificial Sequence
  chemically synthesized
tttttctcaggtttgtcaaaga

SEQ ID NO: 901745 - DNA, 22 bp, Artificial Sequence
  chemically synthesized
caactatctgatctttgacaaa

SEQ ID NO: 901746 - DNA, 22 bp, Artificial Sequence
  chemically synthesized
gtttttctcaggtttgtcaaag

SEQ ID NO: 901747 - DNA, 22 bp, Artificial Sequence
  chemically synthesized
cttgtttttctcaggtttgtca

SEQ ID NO: 901748 - DNA, 22 bp, Artificial Sequence
  chemically synthesized
tctgatctttgacaaacctgag

SEQ ID NO: 901749 - DNA, 22 bp, Artificial Sequence
  chemically synthesized
atctttgacaaacctgagaaaa

SEQ ID NO: 901750 - DNA, 22 bp, Artificial Sequence
  chemically synthesized
cccattgcttgtttttctcagg

SEQ ID NO: 901751 - DNA, 22 bp, Artificial Sequence
  chemically synthesized
ccccattgcttgtttttctcag

SEQ ID NO: 901752 - DNA, 22 bp, Artificial Sequence
  chemically synthesized
tccccattgcttgtttttctca

SEQ ID NO: 901753 - DNA, 22 bp, Artificial Sequence
  chemically synthesized
tgacaaacctgagaaaaacaag

SEQ ID NO: 901754 - DNA, 22 bp, Artificial Sequence
  chemically synthesized
gacaaacctgagaaaaacaagc

SEQ ID NO: 901755 - DNA, 22 bp, Artificial Sequence
  chemically synthesized
acaaacctgagaaaaacaagca

SEQ ID NO: 901756 - DNA, 22 bp, Artificial Sequence
  chemically synthesized
agaaaaacaagcaatggggaaa

SEQ ID NO: 901757 - DNA, 22 bp, Artificial Sequence
  chemically synthesized
aatagggaatcctttccccatt

SEQ ID NO: 901758 - DNA, 22 bp, Artificial Sequence
  chemically synthesized
ttaaatagggaatcctttcccc

SEQ ID NO: 901759 - DNA, 22 bp, Artificial Sequence
  chemically synthesized
attaaatagggaatcctttccc

SEQ ID NO: 901760 - DNA, 22 bp, Artificial Sequence
  chemically synthesized
ccagcaccgtttattaaatagg

SEQ ID NO: 901761 - DNA, 22 bp, Artificial Sequence
  chemically synthesized
cccagcaccgtttattaaatag

SEQ ID NO: 901762 - DNA, 22 bp, Artificial Sequence
  chemically synthesized
tcccagcaccgtttattaaata

SEQ ID NO: 901763 - DNA, 22 bp, Artificial Sequence
  chemically synthesized
gccaattttcccagcaccgttt

SEQ ID NO: 901764 - DNA, 22 bp, Artificial Sequence
  chemically synthesized
cctatttaataaacggtgctgg

SEQ ID NO: 901765 - DNA, 22 bp, Artificial Sequence
  chemically synthesized
tttaataaacggtgctgggaaa

SEQ ID NO: 901766 - DNA, 22 bp, Artificial Sequence
  chemically synthesized
aataaacggtgctgggaaaatt

SEQ ID NO: 901767 - DNA, 22 bp, Artificial Sequence
  chemically synthesized
ataaacggtgctgggaaaattg

SEQ ID NO: 901768 - DNA, 22 bp, Artificial Sequence
  chemically synthesized
cgtatggctagccaattttccc

SEQ ID NO: 901769 - DNA, 22 bp, Artificial Sequence
  chemically synthesized
tacgtatggctagccaattttc

SEQ ID NO: 901770 - DNA, 22 bp, Artificial Sequence
  chemically synthesized
ctacgtatggctagccaatttt

SEQ ID NO: 901771 - DNA, 22 bp, Artificial Sequence
  chemically synthesized
tctacgtatggctagccaattt

SEQ ID NO: 901772 - DNA, 22 bp, Artificial Sequence
  chemically synthesized
agctttctacgtatggctagcc

SEQ ID NO: 901773 - DNA, 22 bp, Artificial Sequence
  chemically synthesized
cagctttctacgtatggctagc

SEQ ID NO: 901774 - DNA, 22 bp, Artificial Sequence
  chemically synthesized
ggaaaattggctagccatacgt

SEQ ID NO: 901775 - DNA, 22 bp, Artificial Sequence
  chemically synthesized
gctagccatacgtagaaagctg

SEQ ID NO: 901776 - DNA, 22 bp, Artificial Sequence
  chemically synthesized
gccatacgtagaaagctgaaac

SEQ ID NO: 901777 - DNA, 22 bp, Artificial Sequence
  chemically synthesized
tataaggtgtaaggaagggatc

SEQ ID NO: 901778 - DNA, 22 bp, Artificial Sequence
  chemically synthesized
gtataaggtgtaaggaagggat

SEQ ID NO: 901779 - DNA, 22 bp, Artificial Sequence
  chemically synthesized
tgtataaggtgtaaggaaggga

SEQ ID NO: 901780 - DNA, 22 bp, Artificial Sequence
  chemically synthesized
ttgtataaggtgtaaggaaggg

SEQ ID NO: 901781 - DNA, 22 bp, Artificial Sequence
  chemically synthesized
aaactggatcccttccttacac

SEQ ID NO: 901782 - DNA, 22 bp, Artificial Sequence
  chemically synthesized
atttttgtataaggtgtaagga

SEQ ID NO: 901783 - DNA, 22 bp, Artificial Sequence
  chemically synthesized
gatcccttccttacaccttata

SEQ ID NO: 901784 - DNA, 22 bp, Artificial Sequence
  chemically synthesized
aattgatttttgtataaggtgt

SEQ ID NO: 901785 - DNA, 22 bp, Artificial Sequence
  chemically synthesized
gaattgatttttgtataaggtg

SEQ ID NO: 901786 - DNA, 22 bp, Artificial Sequence
  chemically synthesized
ccttacaccttatacaaaaatc

SEQ ID NO: 901787 - DNA, 22 bp, Artificial Sequence
  chemically synthesized
cttacaccttatacaaaaatca

SEQ ID NO: 901788 - DNA, 22 bp, Artificial Sequence
  chemically synthesized
atccatcttgaattgatttttg

SEQ ID NO: 901789 - DNA, 22 bp, Artificial Sequence
  chemically synthesized
aatccatcttgaattgattttt

SEQ ID NO: 901790 - DNA, 22 bp, Artificial Sequence
  chemically synthesized
acaccttatacaaaaatcaatt

SEQ ID NO: 901791 - DNA, 22 bp, Artificial Sequence
  chemically synthesized
taatccatcttgaattgatttt

SEQ ID NO: 901792 - DNA, 22 bp, Artificial Sequence
  chemically synthesized
caccttatacaaaaatcaattc

SEQ ID NO: 901793 - DNA, 22 bp, Artificial Sequence
  chemically synthesized
agtctttaatccatcttgaatt

SEQ ID NO: 901794 - DNA, 22 bp, Artificial Sequence
  chemically synthesized
atacaaaaatcaattcaagatg

SEQ ID NO: 901795 - DNA, 22 bp, Artificial Sequence
  chemically synthesized
aagtctttaatccatcttgaat

SEQ ID NO: 901796 - DNA, 22 bp, Artificial Sequence
  chemically synthesized
tacaaaaatcaattcaagatgg

SEQ ID NO: 901797 - DNA, 22 bp, Artificial Sequence
  chemically synthesized
acgtttaagtctttaatccatc

SEQ ID NO: 901798 - DNA, 22 bp, Artificial Sequence
  chemically synthesized
ggtctaacgtttaagtctttaa

SEQ ID NO: 901799 - DNA, 22 bp, Artificial Sequence
  chemically synthesized
aggtctaacgtttaagtcttta

SEQ ID NO: 901800 - DNA, 22 bp, Artificial Sequence
  chemically synthesized
taggtctaacgtttaagtcttt

SEQ ID NO: 901801 - DNA, 22 bp, Artificial Sequence
  chemically synthesized
aagatggattaaagacttaaac

SEQ ID NO: 901802 - DNA, 22 bp, Artificial Sequence
  chemically synthesized
tggttttaggtctaacgtttaa

SEQ ID NO: 901803 - DNA, 22 bp, Artificial Sequence
  chemically synthesized
atggttttaggtctaacgttta

SEQ ID NO: 901804 - DNA, 22 bp, Artificial Sequence
  chemically synthesized
tatggttttaggtctaacgttt

SEQ ID NO: 901805 - DNA, 22 bp, Artificial Sequence
  chemically synthesized
ttatggttttaggtctaacgtt

SEQ ID NO: 901806 - DNA, 22 bp, Artificial Sequence
  chemically synthesized
aagacttaaacgttagacctaa

SEQ ID NO: 901807 - DNA, 22 bp, Artificial Sequence
  chemically synthesized
gggtttttatggttttaggtct

SEQ ID NO: 901808 - DNA, 22 bp, Artificial Sequence
  chemically synthesized
tagggtttttatggttttaggt

SEQ ID NO: 901809 - DNA, 22 bp, Artificial Sequence
  chemically synthesized
ctagggtttttatggttttagg

SEQ ID NO: 901810 - DNA, 22 bp, Artificial Sequence
  chemically synthesized
aaacgttagacctaaaaccata

SEQ ID NO: 901811 - DNA, 22 bp, Artificial Sequence
  chemically synthesized
aacgttagacctaaaaccataa

SEQ ID NO: 901812 - DNA, 22 bp, Artificial Sequence
  chemically synthesized
tcttctagggtttttatggttt

SEQ ID NO: 901813 - DNA, 22 bp, Artificial Sequence
  chemically synthesized
ggttatcttctagggtttttat

SEQ ID NO: 901814 - DNA, 22 bp, Artificial Sequence
  chemically synthesized
gacctaaaaccataaaaaccct

SEQ ID NO: 901815 - DNA, 22 bp, Artificial Sequence
  chemically synthesized
aaaccataaaaaccctagaaga

SEQ ID NO: 901816 - DNA, 22 bp, Artificial Sequence
  chemically synthesized
taatgcctaggttatcttctag

SEQ ID NO: 901817 - DNA, 22 bp, Artificial Sequence
  chemically synthesized
agaaaagaaattgtaatgccta

SEQ ID NO: 901818 - DNA, 22 bp, Artificial Sequence
  chemically synthesized
aagaaaagaaattgtaatgcct

SEQ ID NO: 901819 - DNA, 22 bp, Artificial Sequence
  chemically synthesized
gaagataacctaggcattacaa

SEQ ID NO: 901820 - DNA, 22 bp, Artificial Sequence
  chemically synthesized
cttaagaaaagaaattgtaatg

SEQ ID NO: 901821 - DNA, 22 bp, Artificial Sequence
  chemically synthesized
ggcattacaatttcttttctta

SEQ ID NO: 901822 - DNA, 22 bp, Artificial Sequence
  chemically synthesized
aaaccatcattccttaagaaaa

SEQ ID NO: 901823 - DNA, 22 bp, Artificial Sequence
  chemically synthesized
ctcaaaccatcattccttaaga

SEQ ID NO: 901824 - DNA, 22 bp, Artificial Sequence
  chemically synthesized
caatttcttttcttaaggaatg

SEQ ID NO: 901825 - DNA, 22 bp, Artificial Sequence
  chemically synthesized
cttttcttaaggaatgatggtt

SEQ ID NO: 901826 - DNA, 22 bp, Artificial Sequence
  chemically synthesized
aaggattactcaaaccatcatt

SEQ ID NO: 901827 - DNA, 22 bp, Artificial Sequence
  chemically synthesized
ttttcttaaggaatgatggttt

SEQ ID NO: 901828 - DNA, 22 bp, Artificial Sequence
  chemically synthesized
ttcttaaggaatgatggtttga

SEQ ID NO: 901829 - DNA, 22 bp, Artificial Sequence
  chemically synthesized
tcttaaggaatgatggtttgag

SEQ ID NO: 901830 - DNA, 22 bp, Artificial Sequence
  chemically synthesized
cttaaggaatgatggtttgagt

SEQ ID NO: 901831 - DNA, 22 bp, Artificial Sequence
  chemically synthesized
ttaaggaatgatggtttgagta

SEQ ID NO: 901832 - DNA, 22 bp, Artificial Sequence
  chemically synthesized
aaggaatgatggtttgagtaat

SEQ ID NO: 901833 - DNA, 22 bp, Artificial Sequence
  chemically synthesized
aggaatgatggtttgagtaatc

SEQ ID NO: 901834 - DNA, 22 bp, Artificial Sequence
  chemically synthesized
gagtaatcctttagggttttac

SEQ ID NO: 901835 - DNA, 22 bp, Artificial Sequence
  chemically synthesized
agtaatcctttagggttttacc

SEQ ID NO: 901836 - DNA, 22 bp, Artificial Sequence
  chemically synthesized
atggcatgtaaagggtaaaacc

SEQ ID NO: 901837 - DNA, 22 bp, Artificial Sequence
  chemically synthesized
aatggcatgtaaagggtaaaac

SEQ ID NO: 901838 - DNA, 22 bp, Artificial Sequence
  chemically synthesized
tagggttttaccctttacatgc

SEQ ID NO: 901839 - DNA, 22 bp, Artificial Sequence
  chemically synthesized
agggttttaccctttacatgcc

SEQ ID NO: 901840 - DNA, 22 bp, Artificial Sequence
  chemically synthesized
tgacaatttaatggcatgtaaa

SEQ ID NO: 901841 - DNA, 22 bp, Artificial Sequence
  chemically synthesized
gggttttaccctttacatgcca

SEQ ID NO: 901842 - DNA, 22 bp, Artificial Sequence
  chemically synthesized
attatgacaatttaatggcatg

SEQ ID NO: 901843 - DNA, 22 bp, Artificial Sequence
  chemically synthesized
taccctttacatgccattaaat

SEQ ID NO: 901844 - DNA, 22 bp, Artificial Sequence
  chemically synthesized
accctttacatgccattaaatt

SEQ ID NO: 901845 - DNA, 22 bp, Artificial Sequence
  chemically synthesized
ccctttacatgccattaaattg

SEQ ID NO: 901846 - DNA, 22 bp, Artificial Sequence
  chemically synthesized
tacatgccattaaattgtcata

SEQ ID NO: 901847 - DNA, 22 bp, Artificial Sequence
  chemically synthesized
acatgccattaaattgtcataa

SEQ ID NO: 901848 - DNA, 22 bp, Artificial Sequence
  chemically synthesized
catgatgattaattatgacaat

SEQ ID NO: 901849 - DNA, 22 bp, Artificial Sequence
  chemically synthesized
catgccattaaattgtcataat

SEQ ID NO: 901850 - DNA, 22 bp, Artificial Sequence
  chemically synthesized
ttgcatgatgattaattatgac

SEQ ID NO: 901851 - DNA, 22 bp, Artificial Sequence
  chemically synthesized
caacctgttgcatgatgattaa

SEQ ID NO: 901852 - DNA, 22 bp, Artificial Sequence
  chemically synthesized
aattgtcataattaatcatcat

SEQ ID NO: 901853 - DNA, 22 bp, Artificial Sequence
  chemically synthesized
tcataattaatcatcatgcaac

SEQ ID NO: 901854 - DNA, 22 bp, Artificial Sequence
  chemically synthesized
catgttacaacctgttgcatga

SEQ ID NO: 901855 - DNA, 22 bp, Artificial Sequence
  chemically synthesized
acatgttacaacctgttgcatg

SEQ ID NO: 901856 - DNA, 22 bp, Artificial Sequence
  chemically synthesized
tacatgttacaacctgttgcat

SEQ ID NO: 901857 - DNA, 22 bp, Artificial Sequence
  chemically synthesized
atcatcatgcaacaggttgtaa

SEQ ID NO: 901858 - DNA, 22 bp, Artificial Sequence
  chemically synthesized
tcactttacatgttacaacctg

SEQ ID NO: 901859 - DNA, 22 bp, Artificial Sequence
  chemically synthesized
aattgtcactttacatgttaca

SEQ ID NO: 901860 - DNA, 22 bp, Artificial Sequence
  chemically synthesized
taaattgtcactttacatgtta

SEQ ID NO: 901861 - DNA, 22 bp, Artificial Sequence
  chemically synthesized
tatcagcctctaaattgtcact

SEQ ID NO: 901862 - DNA, 22 bp, Artificial Sequence
  chemically synthesized
taacatgtaaagtgacaattta

SEQ ID NO: 901863 - DNA, 22 bp, Artificial Sequence
  chemically synthesized
tgtatcagcctctaaattgtca

SEQ ID NO: 901864 - DNA, 22 bp, Artificial Sequence
  chemically synthesized
ctgtatcagcctctaaattgtc

SEQ ID NO: 901865 - DNA, 22 bp, Artificial Sequence
  chemically synthesized
ttctgtatcagcctctaaattg

SEQ ID NO: 901866 - DNA, 22 bp, Artificial Sequence
  chemically synthesized
ttcttctgtatcagcctctaaa

SEQ ID NO: 901867 - DNA, 22 bp, Artificial Sequence
  chemically synthesized
gctattcttctgtatcagcctc

SEQ ID NO: 901868 - DNA, 22 bp, Artificial Sequence
  chemically synthesized
ttcgctattcttctgtatcagc

SEQ ID NO: 901869 - DNA, 22 bp, Artificial Sequence
  chemically synthesized
ttattcgctattcttctgtatc

SEQ ID NO: 901870 - DNA, 22 bp, Artificial Sequence
  chemically synthesized
agaggctgatacagaagaatag

SEQ ID NO: 901871 - DNA, 22 bp, Artificial Sequence
  chemically synthesized
gaggctgatacagaagaatagc

SEQ ID NO: 901872 - DNA, 22 bp, Artificial Sequence
  chemically synthesized
aacccctgttattcgctattct

SEQ ID NO: 901873 - DNA, 22 bp, Artificial Sequence
  chemically synthesized
atacagaagaatagcgaataac

SEQ ID NO: 901874 - DNA, 22 bp, Artificial Sequence
  chemically synthesized
aagaaatgatgcataaaaacta

SEQ ID NO: 901875 - DNA, 22 bp, Artificial Sequence
  chemically synthesized
ctgaagaaatgatgcataaaaa

SEQ ID NO: 901876 - DNA, 22 bp, Artificial Sequence
  chemically synthesized
cctgaagaaatgatgcataaaa

SEQ ID NO: 901877 - DNA, 22 bp, Artificial Sequence
  chemically synthesized
tcctgaagaaatgatgcataaa

SEQ ID NO: 901878 - DNA, 22 bp, Artificial Sequence
  chemically synthesized
agtttttatgcatcatttcttc

SEQ ID NO: 901879 - DNA, 22 bp, Artificial Sequence
  chemically synthesized
gtttttatgcatcatttcttca

SEQ ID NO: 901880 - DNA, 22 bp, Artificial Sequence
  chemically synthesized
atgatgtgttttcctgaagaaa

SEQ ID NO: 901881 - DNA, 22 bp, Artificial Sequence
  chemically synthesized
ttatgcatcatttcttcaggaa

SEQ ID NO: 901882 - DNA, 22 bp, Artificial Sequence
  chemically synthesized
tatgcatcatttcttcaggaaa

SEQ ID NO: 901883 - DNA, 22 bp, Artificial Sequence
  chemically synthesized
atgcatcatttcttcaggaaaa

SEQ ID NO: 901884 - DNA, 22 bp, Artificial Sequence
  chemically synthesized
tgcatcatttcttcaggaaaac

SEQ ID NO: 901885 - DNA, 22 bp, Artificial Sequence
  chemically synthesized
ccctcatgatgtgttttcctga

SEQ ID NO: 901886 - DNA, 22 bp, Artificial Sequence
  chemically synthesized
cccctcatgatgtgttttcctg

SEQ ID NO: 901887 - DNA, 22 bp, Artificial Sequence
  chemically synthesized
tttcccctcatgatgtgttttc

SEQ ID NO: 901888 - DNA, 22 bp, Artificial Sequence
  chemically synthesized
cttcaggaaaacacatcatgag

SEQ ID NO: 901889 - DNA, 22 bp, Artificial Sequence
  chemically synthesized
ttcaggaaaacacatcatgagg

SEQ ID NO: 901890 - DNA, 22 bp, Artificial Sequence
  chemically synthesized
aaagctatttcccctcatgatg

SEQ ID NO: 901891 - DNA, 22 bp, Artificial Sequence
  chemically synthesized
caggaaaacacatcatgagggg

SEQ ID NO: 901892 - DNA, 22 bp, Artificial Sequence
  chemically synthesized
aggaaaacacatcatgagggga

SEQ ID NO: 901893 - DNA, 22 bp, Artificial Sequence
  chemically synthesized
ttcaaagctatttcccctcatg

SEQ ID NO: 901894 - DNA, 22 bp, Artificial Sequence
  chemically synthesized
attcaaagctatttcccctcat

SEQ ID NO: 901895 - DNA, 22 bp, Artificial Sequence
  chemically synthesized
aacttattcaaagctatttccc

SEQ ID NO: 901896 - DNA, 22 bp, Artificial Sequence
  chemically synthesized
actgaacttattcaaagctatt

SEQ ID NO: 901897 - DNA, 22 bp, Artificial Sequence
  chemically synthesized
cactgaacttattcaaagctat

SEQ ID NO: 901898 - DNA, 22 bp, Artificial Sequence
  chemically synthesized
aatggcaaccttcactgaactt

SEQ ID NO: 901899 - DNA, 22 bp, Artificial Sequence
  chemically synthesized
actaaatggcaaccttcactga

SEQ ID NO: 901900 - DNA, 22 bp, Artificial Sequence
  chemically synthesized
tgaataagttcagtgaaggttg

SEQ ID NO: 901901 - DNA, 22 bp, Artificial Sequence
  chemically synthesized
gaataagttcagtgaaggttgc

SEQ ID NO: 901902 - DNA, 22 bp, Artificial Sequence
  chemically synthesized
attaactaaatggcaaccttca

SEQ ID NO: 901903 - DNA, 22 bp, Artificial Sequence
  chemically synthesized
aataagttcagtgaaggttgcc

SEQ ID NO: 901904 - DNA, 22 bp, Artificial Sequence
  chemically synthesized
agttaattaactaaatggcaac

SEQ ID NO: 901905 - DNA, 22 bp, Artificial Sequence
  chemically synthesized
agtgaaggttgccatttagtta

SEQ ID NO: 901906 - DNA, 22 bp, Artificial Sequence
  chemically synthesized
atgaaaatggttaagttaatta

SEQ ID NO: 901907 - DNA, 22 bp, Artificial Sequence
  chemically synthesized
ccatttagttaattaacttaac

SEQ ID NO: 901908 - DNA, 22 bp, Artificial Sequence
  chemically synthesized
ctaatgaaaatggttaagttaa

SEQ ID NO: 901909 - DNA, 22 bp, Artificial Sequence
  chemically synthesized
agttaattaacttaaccatttt

SEQ ID NO: 901910 - DNA, 22 bp, Artificial Sequence
  chemically synthesized
agtctgctaatgaaaatggtta

SEQ ID NO: 901911 - DNA, 22 bp, Artificial Sequence
  chemically synthesized
gttaattaacttaaccattttc

SEQ ID NO: 901912 - DNA, 22 bp, Artificial Sequence
  chemically synthesized
attaacttaaccattttcatta

SEQ ID NO: 901913 - DNA, 22 bp, Artificial Sequence
  chemically synthesized
acttaaccattttcattagcag

SEQ ID NO: 901914 - DNA, 22 bp, Artificial Sequence
  chemically synthesized
aagtcaatactgagtctgctaa

SEQ ID NO: 901915 - DNA, 22 bp, Artificial Sequence
  chemically synthesized
aaccattttcattagcagactc

SEQ ID NO: 901916 - DNA, 22 bp, Artificial Sequence
  chemically synthesized
accattttcattagcagactca

SEQ ID NO: 901917 - DNA, 22 bp, Artificial Sequence
  chemically synthesized
taaagtcaatactgagtctgct

SEQ ID NO: 901918 - DNA, 22 bp, Artificial Sequence
  chemically synthesized
tcattagcagactcagtattga

SEQ ID NO: 901919 - DNA, 22 bp, Artificial Sequence
  chemically synthesized
cattagcagactcagtattgac

SEQ ID NO: 901920 - DNA, 22 bp, Artificial Sequence
  chemically synthesized
attagcagactcagtattgact

SEQ ID NO: 901921 - DNA, 22 bp, Artificial Sequence
  chemically synthesized
gcagactcagtattgactttag

SEQ ID NO: 901922 - DNA, 22 bp, Artificial Sequence
  chemically synthesized
agcagacagtattctaaagtca

SEQ ID NO: 901923 - DNA, 22 bp, Artificial Sequence
  chemically synthesized
agtattgactttagaatactgt

SEQ ID NO: 901924 - DNA, 22 bp, Artificial Sequence
  chemically synthesized
gaagaaattaagcagacagtat

SEQ ID NO: 901925 - DNA, 22 bp, Artificial Sequence
  chemically synthesized
ggaagaaattaagcagacagta

SEQ ID NO: 901926 - DNA, 22 bp, Artificial Sequence
  chemically synthesized
actttagaatactgtctgctta

SEQ ID NO: 901927 - DNA, 22 bp, Artificial Sequence
  chemically synthesized
tttggaagaaattaagcagaca

SEQ ID NO: 901928 - DNA, 22 bp, Artificial Sequence
  chemically synthesized
tagaatactgtctgcttaattt

SEQ ID NO: 901929 - DNA, 22 bp, Artificial Sequence
  chemically synthesized
attgtttggaagaaattaagca

SEQ ID NO: 901930 - DNA, 22 bp, Artificial Sequence
  chemically synthesized
agaatactgtctgcttaatttc

SEQ ID NO: 901931 - DNA, 22 bp, Artificial Sequence
  chemically synthesized
gaatactgtctgcttaatttct

SEQ ID NO: 901932 - DNA, 22 bp, Artificial Sequence
  chemically synthesized
tctgcttaatttcttccaaaca

SEQ ID NO: 901933 - DNA, 22 bp, Artificial Sequence
  chemically synthesized
atacatattcattgtttggaag

SEQ ID NO: 901934 - DNA, 22 bp, Artificial Sequence
  chemically synthesized
catacatattcattgtttggaa

SEQ ID NO: 901935 - DNA, 22 bp, Artificial Sequence
  chemically synthesized
cttaatttcttccaaacaatga

SEQ ID NO: 901936 - DNA, 22 bp, Artificial Sequence
  chemically synthesized
aatttcttccaaacaatgaata

SEQ ID NO: 901937 - DNA, 22 bp, Artificial Sequence
  chemically synthesized
atttcttccaaacaatgaatat

SEQ ID NO: 901938 - DNA, 22 bp, Artificial Sequence
  chemically synthesized
gtggtgtttcatacatattcat

SEQ ID NO: 901939 - DNA, 22 bp, Artificial Sequence
  chemically synthesized
ggtggtgtttcatacatattca

SEQ ID NO: 901940 - DNA, 22 bp, Artificial Sequence
  chemically synthesized
cttccaaacaatgaatatgtat

SEQ ID NO: 901941 - DNA, 22 bp, Artificial Sequence
  chemically synthesized
tggtggtgtttcatacatattc

SEQ ID NO: 901942 - DNA, 22 bp, Artificial Sequence
  chemically synthesized
ttccaaacaatgaatatgtatg

SEQ ID NO: 901943 - DNA, 22 bp, Artificial Sequence
  chemically synthesized
ccaaacaatgaatatgtatgaa

SEQ ID NO: 901944 - DNA, 22 bp, Artificial Sequence
  chemically synthesized
caaacaatgaatatgtatgaaa

SEQ ID NO: 901945 - DNA, 22 bp, Artificial Sequence
  chemically synthesized
cctttggtggtgtttcatacat

SEQ ID NO: 901946 - DNA, 22 bp, Artificial Sequence
  chemically synthesized
acctttggtggtgtttcataca

SEQ ID NO: 901947 - DNA, 22 bp, Artificial Sequence
  chemically synthesized
tacctttggtggtgtttcatac

SEQ ID NO: 901948 - DNA, 22 bp, Artificial Sequence
  chemically synthesized
actttacctttggtggtgtttc

SEQ ID NO: 901949 - DNA, 22 bp, Artificial Sequence
  chemically synthesized
cactttacctttggtggtgttt

SEQ ID NO: 901950 - DNA, 22 bp, Artificial Sequence
  chemically synthesized
tcactttacctttggtggtgtt

SEQ ID NO: 901951 - DNA, 22 bp, Artificial Sequence
  chemically synthesized
attttcactttacctttggtgg

SEQ ID NO: 901952 - DNA, 22 bp, Artificial Sequence
  chemically synthesized
cattttcactttacctttggtg

SEQ ID NO: 901953 - DNA, 22 bp, Artificial Sequence
  chemically synthesized
tcttcattttcactttaccttt

SEQ ID NO: 901954 - DNA, 22 bp, Artificial Sequence
  chemically synthesized
tattgtcttcattttcacttta

SEQ ID NO: 901955 - DNA, 22 bp, Artificial Sequence
  chemically synthesized
cctatattgtcttcattttcac

SEQ ID NO: 901956 - DNA, 22 bp, Artificial Sequence
  chemically synthesized
acctatattgtcttcattttca

SEQ ID NO: 901957 - DNA, 22 bp, Artificial Sequence
  chemically synthesized
tacctatattgtcttcattttc

SEQ ID NO: 901958 - DNA, 22 bp, Artificial Sequence
  chemically synthesized
cattttacctatattgtcttca

SEQ ID NO: 901959 - DNA, 22 bp, Artificial Sequence
  chemically synthesized
acattttacctatattgtcttc

SEQ ID NO: 901960 - DNA, 22 bp, Artificial Sequence
  chemically synthesized
tacattttacctatattgtctt

SEQ ID NO: 901961 - DNA, 22 bp, Artificial Sequence
  chemically synthesized
ttacattttacctatattgtct

SEQ ID NO: 901962 - DNA, 22 bp, Artificial Sequence
  chemically synthesized
atttttacattttacctatatt

SEQ ID NO: 901963 - DNA, 22 bp, Artificial Sequence
  chemically synthesized
aatttttacattttacctatat

SEQ ID NO: 901964 - DNA, 22 bp, Artificial Sequence
  chemically synthesized
ataatttaatttttacatttta

SEQ ID NO: 901965 - DNA, 22 bp, Artificial Sequence
  chemically synthesized
aataatttaatttttacatttt

SEQ ID NO: 901966 - DNA, 22 bp, Artificial Sequence
  chemically synthesized
taataatttaatttttacattt

SEQ ID NO: 901967 - DNA, 22 bp, Artificial Sequence
  chemically synthesized
atatattttaataatttaattt

SEQ ID NO: 901968 - DNA, 22 bp, Artificial Sequence
  chemically synthesized
tgatatattttaataatttaat

SEQ ID NO: 901969 - DNA, 22 bp, Artificial Sequence
  chemically synthesized
ctgatatattttaataatttaa

SEQ ID NO: 901970 - DNA, 22 bp, Artificial Sequence
  chemically synthesized
tctgatatattttaataattta

SEQ ID NO: 901971 - DNA, 22 bp, Artificial Sequence
  chemically synthesized
ttctgatatattttaataattt

SEQ ID NO: 901972 - DNA, 22 bp, Artificial Sequence
  chemically synthesized
cacatacttttctgatatattt

SEQ ID NO: 901973 - DNA, 22 bp, Artificial Sequence
  chemically synthesized
aattattaaaatatatcagaaa

SEQ ID NO: 901974 - DNA, 22 bp, Artificial Sequence
  chemically synthesized
ttaaaatatatcagaaaagtat

SEQ ID NO: 901975 - DNA, 22 bp, Artificial Sequence
  chemically synthesized
taaatgtattccacatactttt

SEQ ID NO: 901976 - DNA, 22 bp, Artificial Sequence
  chemically synthesized
aaatatatcagaaaagtatgtg

SEQ ID NO: 901977 - DNA, 22 bp, Artificial Sequence
  chemically synthesized
ataaatgtattccacatacttt

SEQ ID NO: 901978 - DNA, 22 bp, Artificial Sequence
  chemically synthesized
aatataagtttataaatgtatt

SEQ ID NO: 901979 - DNA, 22 bp, Artificial Sequence
  chemically synthesized
caattgaatataagtttataaa

SEQ ID NO: 901980 - DNA, 22 bp, Artificial Sequence
  chemically synthesized
gaggagcacactgcaattgaat

SEQ ID NO: 901981 - DNA, 22 bp, Artificial Sequence
  chemically synthesized
ggaggagcacactgcaattgaa

SEQ ID NO: 901982 - DNA, 22 bp, Artificial Sequence
  chemically synthesized
ataaacttatattcaattgcag

SEQ ID NO: 901983 - DNA, 22 bp, Artificial Sequence
  chemically synthesized
taaacttatattcaattgcagt

SEQ ID NO: 901984 - DNA, 22 bp, Artificial Sequence
  chemically synthesized
aaagtttggaggagcacactgc

SEQ ID NO: 901985 - DNA, 22 bp, Artificial Sequence
  chemically synthesized
aaaagtttggaggagcacactg

SEQ ID NO: 901986 - DNA, 22 bp, Artificial Sequence
  chemically synthesized
atattcaattgcagtgtgctcc

SEQ ID NO: 901987 - DNA, 22 bp, Artificial Sequence
  chemically synthesized
tattcaattgcagtgtgctcct

SEQ ID NO: 901988 - DNA, 22 bp, Artificial Sequence
  chemically synthesized
aattgcagtgtgctcctccaaa

SEQ ID NO: 901989 - DNA, 22 bp, Artificial Sequence
  chemically synthesized
cagtgtgctcctccaaactttt

SEQ ID NO: 901990 - DNA, 22 bp, Artificial Sequence
  chemically synthesized
tgccaaggtcatatcttaaaag

SEQ ID NO: 901991 - DNA, 22 bp, Artificial Sequence
  chemically synthesized
ctccaaacttttaagatatgac

SEQ ID NO: 901992 - DNA, 22 bp, Artificial Sequence
  chemically synthesized
caaacttttaagatatgacctt

SEQ ID NO: 901993 - DNA, 22 bp, Artificial Sequence
  chemically synthesized
aaataatgtgcctatgccaagg

SEQ ID NO: 901994 - DNA, 22 bp, Artificial Sequence
  chemically synthesized
ttaagatatgaccttggcatag

SEQ ID NO: 901995 - DNA, 22 bp, Artificial Sequence
  chemically synthesized
taagatatgaccttggcatagg

SEQ ID NO: 901996 - DNA, 22 bp, Artificial Sequence
  chemically synthesized
aagatatgaccttggcataggc

SEQ ID NO: 901997 - DNA, 22 bp, Artificial Sequence
  chemically synthesized
agatatgaccttggcataggca

SEQ ID NO: 901998 - DNA, 22 bp, Artificial Sequence
  chemically synthesized
agcagctgaaataatgtgccta

SEQ ID NO: 901999 - DNA, 22 bp, Artificial Sequence
  chemically synthesized
tgctaagcagctgaaataatgt

SEQ ID NO: 902000 - DNA, 22 bp, Artificial Sequence
  chemically synthesized
ggcataggcacattatttcagc

SEQ ID NO: 902001 - DNA, 22 bp, Artificial Sequence
  chemically synthesized
gcataggcacattatttcagct

SEQ ID NO: 902002 - DNA, 22 bp, Artificial Sequence
  chemically synthesized
caaatcctgtgctaagcagctg

SEQ ID NO: 902003 - DNA, 22 bp, Artificial Sequence
  chemically synthesized
ttacaaatcctgtgctaagcag

SEQ ID NO: 902004 - DNA, 22 bp, Artificial Sequence
  chemically synthesized
tttcagctgcttagcacaggat

SEQ ID NO: 902005 - DNA, 22 bp, Artificial Sequence
  chemically synthesized
agattattacaaatcctgtgct

SEQ ID NO: 902006 - DNA, 22 bp, Artificial Sequence
  chemically synthesized
cagctgcttagcacaggatttg

SEQ ID NO: 902007 - DNA, 22 bp, Artificial Sequence
  chemically synthesized
agctgcttagcacaggatttgt

SEQ ID NO: 902008 - DNA, 22 bp, Artificial Sequence
  chemically synthesized
taaaattgagattattacaaat

SEQ ID NO: 902009 - DNA, 22 bp, Artificial Sequence
  chemically synthesized
cttagcacaggatttgtaataa

SEQ ID NO: 902010 - DNA, 22 bp, Artificial Sequence
  chemically synthesized
ataaaattgagattattacaaa

SEQ ID NO: 902011 - DNA, 22 bp, Artificial Sequence
  chemically synthesized
ttataaaattgagattattaca

SEQ ID NO: 902012 - DNA, 22 bp, Artificial Sequence
  chemically synthesized
agcacaggatttgtaataatct

SEQ ID NO: 902013 - DNA, 22 bp, Artificial Sequence
  chemically synthesized
cttataaaattgagattattac

SEQ ID NO: 902014 - DNA, 22 bp, Artificial Sequence
  chemically synthesized
gcacaggatttgtaataatctc

SEQ ID NO: 902015 - DNA, 22 bp, Artificial Sequence
  chemically synthesized
tcttataaaattgagattatta

SEQ ID NO: 902016 - DNA, 22 bp, Artificial Sequence
  chemically synthesized
gtaataatctcaattttataag

SEQ ID NO: 902017 - DNA, 22 bp, Artificial Sequence
  chemically synthesized
gaaatgcattttcttataaaat

SEQ ID NO: 902018 - DNA, 22 bp, Artificial Sequence
  chemically synthesized
taataatctcaattttataaga

SEQ ID NO: 902019 - DNA, 22 bp, Artificial Sequence
  chemically synthesized
agaaatgcattttcttataaaa

SEQ ID NO: 902020 - DNA, 22 bp, Artificial Sequence
  chemically synthesized
aattttataagaaaatgcattt

SEQ ID NO: 902021 - DNA, 22 bp, Artificial Sequence
  chemically synthesized
caaccaatttagaaatgcattt

SEQ ID NO: 902022 - DNA, 22 bp, Artificial Sequence
  chemically synthesized
tccaaccaatttagaaatgcat

SEQ ID NO: 902023 - DNA, 22 bp, Artificial Sequence
  chemically synthesized
ctccaaccaatttagaaatgca

SEQ ID NO: 902024 - DNA, 22 bp, Artificial Sequence
  chemically synthesized
tataagaaaatgcatttctaaa

SEQ ID NO: 902025 - DNA, 22 bp, Artificial Sequence
  chemically synthesized
ataagaaaatgcatttctaaat

SEQ ID NO: 902026 - DNA, 22 bp, Artificial Sequence
  chemically synthesized
taagaaaatgcatttctaaatt

SEQ ID NO: 902027 - DNA, 22 bp, Artificial Sequence
  chemically synthesized
gccttctccaaccaatttagaa

SEQ ID NO: 902028 - DNA, 22 bp, Artificial Sequence
  chemically synthesized
agccttctccaaccaatttaga

SEQ ID NO: 902029 - DNA, 22 bp, Artificial Sequence
  chemically synthesized
tagccttctccaaccaatttag

SEQ ID NO: 902030 - DNA, 22 bp, Artificial Sequence
  chemically synthesized
ttttagccttctccaaccaatt

SEQ ID NO: 902031 - DNA, 22 bp, Artificial Sequence
  chemically synthesized
tgcattgttttagccttctcca

SEQ ID NO: 902032 - DNA, 22 bp, Artificial Sequence
  chemically synthesized
atgcattgttttagccttctcc

SEQ ID NO: 902033 - DNA, 22 bp, Artificial Sequence
  chemically synthesized
ctaaattggttggagaaggcta

SEQ ID NO: 902034 - DNA, 22 bp, Artificial Sequence
  chemically synthesized
taaattggttggagaaggctaa

SEQ ID NO: 902035 - DNA, 22 bp, Artificial Sequence
  chemically synthesized
aattggttggagaaggctaaaa

SEQ ID NO: 902036 - DNA, 22 bp, Artificial Sequence
  chemically synthesized
gatttatgcattgttttagcct

SEQ ID NO: 902037 - DNA, 22 bp, Artificial Sequence
  chemically synthesized
gttggagaaggctaaaacaatg

SEQ ID NO: 902038 - DNA, 22 bp, Artificial Sequence
  chemically synthesized
gagaaggctaaaacaatgcata

SEQ ID NO: 902039 - DNA, 22 bp, Artificial Sequence
  chemically synthesized
agtgcactggatttatgcattg

SEQ ID NO: 902040 - DNA, 22 bp, Artificial Sequence
  chemically synthesized
tattcagtgcactggatttatg

SEQ ID NO: 902041 - DNA, 22 bp, Artificial Sequence
  chemically synthesized
aaacaatgcataaatccagtgc

SEQ ID NO: 902042 - DNA, 22 bp, Artificial Sequence
  chemically synthesized
aagcagaaaattatattcagtg

SEQ ID NO: 902043 - DNA, 22 bp, Artificial Sequence
  chemically synthesized
gatcgtcagttgaagcagaaaa

SEQ ID NO: 902044 - DNA, 22 bp, Artificial Sequence
  chemically synthesized
aatataattttctgcttcaact

SEQ ID NO: 902045 - DNA, 22 bp, Artificial Sequence
  chemically synthesized
aaaagactagatcgtcagttga

SEQ ID NO: 902046 - DNA, 22 bp, Artificial Sequence
  chemically synthesized
caaaagactagatcgtcagttg

SEQ ID NO: 902047 - DNA, 22 bp, Artificial Sequence
  chemically synthesized
ttcaaaagactagatcgtcagt

SEQ ID NO: 902048 - DNA, 22 bp, Artificial Sequence
  chemically synthesized
tctgcttcaactgacgatctag

SEQ ID NO: 902049 - DNA, 22 bp, Artificial Sequence
  chemically synthesized
ttcttcaaaagactagatcgtc

SEQ ID NO: 902050 - DNA, 22 bp, Artificial Sequence
  chemically synthesized
ctgcttcaactgacgatctagt

SEQ ID NO: 902051 - DNA, 22 bp, Artificial Sequence
  chemically synthesized
tgcttcaactgacgatctagtc

SEQ ID NO: 902052 - DNA, 22 bp, Artificial Sequence
  chemically synthesized
cttcaactgacgatctagtctt

SEQ ID NO: 902053 - DNA, 22 bp, Artificial Sequence
  chemically synthesized
caactgacgatctagtcttttg

SEQ ID NO: 902054 - DNA, 22 bp, Artificial Sequence
  chemically synthesized
aactgacgatctagtcttttga

SEQ ID NO: 902055 - DNA, 22 bp, Artificial Sequence
  chemically synthesized
acgatctagtcttttgaagaac

SEQ ID NO: 902056 - DNA, 22 bp, Artificial Sequence
  chemically synthesized
aaaaaaaaaaagcctgttcttc

SEQ ID NO: 902057 - DNA, 22 bp, Artificial Sequence
  chemically synthesized
gtcttttgaagaacaggctttt

SEQ ID NO: 902058 - DNA, 22 bp, Artificial Sequence
  chemically synthesized
ttgaagaacaggcttttttttt

SEQ ID NO: 902059 - DNA, 22 bp, Artificial Sequence
  chemically synthesized
tgaagaacaggctttttttttt

SEQ ID NO: 902060 - DNA, 22 bp, Artificial Sequence
  chemically synthesized
gaagaacaggcttttttttttt

SEQ ID NO: 902061 - DNA, 22 bp, Artificial Sequence
  chemically synthesized
aagaacaggctttttttttttt

SEQ ID NO: 902062 - DNA, 22 bp, Artificial Sequence
  chemically synthesized
ttttttttttaaccatttttgg

SEQ ID NO: 902063 - DNA, 22 bp, Artificial Sequence
  chemically synthesized
tttttttttaaccatttttggc

SEQ ID NO: 902064 - DNA, 22 bp, Artificial Sequence
  chemically synthesized
ttttttttaaccatttttggcc

SEQ ID NO: 902065 - DNA, 22 bp, Artificial Sequence
  chemically synthesized
tttttttaaccatttttggcca

SEQ ID NO: 902066 - DNA, 22 bp, Artificial Sequence
  chemically synthesized
ttttttaaccatttttggccat

SEQ ID NO: 902067 - DNA, 22 bp, Artificial Sequence
  chemically synthesized
cagaaaatgaatatggccaaaa

SEQ ID NO: 902068 - DNA, 22 bp, Artificial Sequence
  chemically synthesized
tttttaaccatttttggccata

SEQ ID NO: 902069 - DNA, 22 bp, Artificial Sequence
  chemically synthesized
ttttaaccatttttggccatat

SEQ ID NO: 902070 - DNA, 22 bp, Artificial Sequence
  chemically synthesized
tttaaccatttttggccatatt

SEQ ID NO: 902071 - DNA, 22 bp, Artificial Sequence
  chemically synthesized
ttaaccatttttggccatattc

SEQ ID NO: 902072 - DNA, 22 bp, Artificial Sequence
  chemically synthesized
taaccatttttggccatattca

SEQ ID NO: 902073 - DNA, 22 bp, Artificial Sequence
  chemically synthesized
aaccatttttggccatattcat

SEQ ID NO: 902074 - DNA, 22 bp, Artificial Sequence
  chemically synthesized
accatttttggccatattcatt

SEQ ID NO: 902075 - DNA, 22 bp, Artificial Sequence
  chemically synthesized
caacatgaagttgcagaaaatg

SEQ ID NO: 902076 - DNA, 22 bp, Artificial Sequence
  chemically synthesized
ttggccatattcattttctgca

SEQ ID NO: 902077 - DNA, 22 bp, Artificial Sequence
  chemically synthesized
tggccatattcattttctgcaa

SEQ ID NO: 902078 - DNA, 22 bp, Artificial Sequence
  chemically synthesized
ggccatattcattttctgcaac

SEQ ID NO: 902079 - DNA, 22 bp, Artificial Sequence
  chemically synthesized
ttccaacatgaagttgcagaaa

SEQ ID NO: 902080 - DNA, 22 bp, Artificial Sequence
  chemically synthesized
gccatattcattttctgcaact

SEQ ID NO: 902081 - DNA, 22 bp, Artificial Sequence
  chemically synthesized
attccaacatgaagttgcagaa

SEQ ID NO: 902082 - DNA, 22 bp, Artificial Sequence
  chemically synthesized
tttattccaacatgaagttgca

SEQ ID NO: 902083 - DNA, 22 bp, Artificial Sequence
  chemically synthesized
atttattccaacatgaagttgc

SEQ ID NO: 902084 - DNA, 22 bp, Artificial Sequence
  chemically synthesized
tatttattccaacatgaagttg

SEQ ID NO: 902085 - DNA, 22 bp, Artificial Sequence
  chemically synthesized
attttctgcaacttcatgttgg

SEQ ID NO: 902086 - DNA, 22 bp, Artificial Sequence
  chemically synthesized
attttatttattccaacatgaa

SEQ ID NO: 902087 - DNA, 22 bp, Artificial Sequence
  chemically synthesized
ctgattttatttattccaacat

SEQ ID NO: 902088 - DNA, 22 bp, Artificial Sequence
  chemically synthesized
tctgcaacttcatgttggaata

SEQ ID NO: 902089 - DNA, 22 bp, Artificial Sequence
  chemically synthesized
ctgcaacttcatgttggaataa

SEQ ID NO: 902090 - DNA, 22 bp, Artificial Sequence
  chemically synthesized
tgcaacttcatgttggaataaa

SEQ ID NO: 902091 - DNA, 22 bp, Artificial Sequence
  chemically synthesized
caacttcatgttggaataaata

SEQ ID NO: 902092 - DNA, 22 bp, Artificial Sequence
  chemically synthesized
catgttggaataaataaaatca

SEQ ID NO: 902093 - DNA, 22 bp, Artificial Sequence
  chemically synthesized
atgttggaataaataaaatcag

SEQ ID NO: 902094 - DNA, 22 bp, Artificial Sequence
  chemically synthesized
gaataaataaaatcagcaggtg

SEQ ID NO: 902095 - DNA, 22 bp, Artificial Sequence
  chemically synthesized
caaaaatcaataggcacctgct

SEQ ID NO: 902096 - DNA, 22 bp, Artificial Sequence
  chemically synthesized
cctccaaaaatcaataggcacc

SEQ ID NO: 902097 - DNA, 22 bp, Artificial Sequence
  chemically synthesized
tccctccaaaaatcaataggca

SEQ ID NO: 902098 - DNA, 22 bp, Artificial Sequence
  chemically synthesized
ctccctccaaaaatcaataggc

SEQ ID NO: 902099 - DNA, 22 bp, Artificial Sequence
  chemically synthesized
cgaatgagatttctccctccaa

SEQ ID NO: 902100 - DNA, 22 bp, Artificial Sequence
  chemically synthesized
acgaatgagatttctccctcca

SEQ ID NO: 902101 - DNA, 22 bp, Artificial Sequence
  chemically synthesized
ttgatttttggagggagaaatc

SEQ ID NO: 902102 - DNA, 22 bp, Artificial Sequence
  chemically synthesized
agtcttacgaatgagatttctc

SEQ ID NO: 902103 - DNA, 22 bp, Artificial Sequence
  chemically synthesized
atttttggagggagaaatctca

SEQ ID NO: 902104 - DNA, 22 bp, Artificial Sequence
  chemically synthesized
cagtcttacgaatgagatttct

SEQ ID NO: 902105 - DNA, 22 bp, Artificial Sequence
  chemically synthesized
tcagtcttacgaatgagatttc

SEQ ID NO: 902106 - DNA, 22 bp, Artificial Sequence
  chemically synthesized
ttcagtcttacgaatgagattt

SEQ ID NO: 902107 - DNA, 22 bp, Artificial Sequence
  chemically synthesized
tttcagtcttacgaatgagatt

SEQ ID NO: 902108 - DNA, 22 bp, Artificial Sequence
  chemically synthesized
ttggagggagaaatctcattcg

SEQ ID NO: 902109 - DNA, 22 bp, Artificial Sequence
  chemically synthesized
ttttcagtcttacgaatgagat

SEQ ID NO: 902110 - DNA, 22 bp, Artificial Sequence
  chemically synthesized
tggagggagaaatctcattcgt

SEQ ID NO: 902111 - DNA, 22 bp, Artificial Sequence
  chemically synthesized
tttttcagtcttacgaatgaga

SEQ ID NO: 902112 - DNA, 22 bp, Artificial Sequence
  chemically synthesized
ggagggagaaatctcattcgta

SEQ ID NO: 902113 - DNA, 22 bp, Artificial Sequence
  chemically synthesized
gagggagaaatctcattcgtaa

SEQ ID NO: 902114 - DNA, 22 bp, Artificial Sequence
  chemically synthesized
actttttttcagtcttacgaat

SEQ ID NO: 902115 - DNA, 22 bp, Artificial Sequence
  chemically synthesized
cactttttttcagtcttacgaa

SEQ ID NO: 902116 - DNA, 22 bp, Artificial Sequence
  chemically synthesized
tgatggacttcactttttttca

SEQ ID NO: 902117 - DNA, 22 bp, Artificial Sequence
  chemically synthesized
attcgtaagactgaaaaaaagt

SEQ ID NO: 902118 - DNA, 22 bp, Artificial Sequence
  chemically synthesized
gttatgatggacttcacttttt

SEQ ID NO: 902119 - DNA, 22 bp, Artificial Sequence
  chemically synthesized
gtaagactgaaaaaaagtgaag

SEQ ID NO: 902120 - DNA, 22 bp, Artificial Sequence
  chemically synthesized
atcagttggttatgatggactt

SEQ ID NO: 902121 - DNA, 22 bp, Artificial Sequence
  chemically synthesized
aaaaaaagtgaagtccatcata

SEQ ID NO: 902122 - DNA, 22 bp, Artificial Sequence
  chemically synthesized
ttcatcagttggttatgatgga

SEQ ID NO: 902123 - DNA, 22 bp, Artificial Sequence
  chemically synthesized
gttcatcagttggttatgatgg

SEQ ID NO: 902124 - DNA, 22 bp, Artificial Sequence
  chemically synthesized
acacgtatttgttcatcagttg

SEQ ID NO: 902125 - DNA, 22 bp, Artificial Sequence
  chemically synthesized
cacacgtatttgttcatcagtt

SEQ ID NO: 902126 - DNA, 22 bp, Artificial Sequence
  chemically synthesized
tcacacgtatttgttcatcagt

SEQ ID NO: 902127 - DNA, 22 bp, Artificial Sequence
  chemically synthesized
aattttcacacgtatttgttca

SEQ ID NO: 902128 - DNA, 22 bp, Artificial Sequence
  chemically synthesized
caattttcacacgtatttgttc

SEQ ID NO: 902129 - DNA, 22 bp, Artificial Sequence
  chemically synthesized
ttcaattttcacacgtatttgt

SEQ ID NO: 902130 - DNA, 22 bp, Artificial Sequence
  chemically synthesized
cttcaattttcacacgtatttg

SEQ ID NO: 902131 - DNA, 22 bp, Artificial Sequence
  chemically synthesized
tcttcaattttcacacgtattt

SEQ ID NO: 902132 - DNA, 22 bp, Artificial Sequence
  chemically synthesized
ttttcttcaattttcacacgta

SEQ ID NO: 902133 - DNA, 22 bp, Artificial Sequence
  chemically synthesized
atgaacaaatacgtgtgaaaat

SEQ ID NO: 902134 - DNA, 22 bp, Artificial Sequence
  chemically synthesized
ttattttcttcaattttcacac

SEQ ID NO: 902135 - DNA, 22 bp, Artificial Sequence
  chemically synthesized
cgttattattttcttcaatttt

SEQ ID NO: 902136 - DNA, 22 bp, Artificial Sequence
  chemically synthesized
tacgttattattttcttcaatt

SEQ ID NO: 902137 - DNA, 22 bp, Artificial Sequence
  chemically synthesized
ctacgttattattttcttcaat

SEQ ID NO: 902138 - DNA, 22 bp, Artificial Sequence
  chemically synthesized
tttctacgttattattttcttc

SEQ ID NO: 902139 - DNA, 22 bp, Artificial Sequence
  chemically synthesized
gtttctacgttattattttctt

SEQ ID NO: 902140 - DNA, 22 bp, Artificial Sequence
  chemically synthesized
tgtttctacgttattattttct

SEQ ID NO: 902141 - DNA, 22 bp, Artificial Sequence
  chemically synthesized
ccctttgtttctacgttattat

SEQ ID NO: 902142 - DNA, 22 bp, Artificial Sequence
  chemically synthesized
accctttgtttctacgttatta

SEQ ID NO: 902143 - DNA, 22 bp, Artificial Sequence
  chemically synthesized
aagaaaataataacgtagaaac

SEQ ID NO: 902144 - DNA, 22 bp, Artificial Sequence
  chemically synthesized
tatcgatatttaccctttgttt

SEQ ID NO: 902145 - DNA, 22 bp, Artificial Sequence
  chemically synthesized
aatagttgtatcgatatttacc

SEQ ID NO: 902146 - DNA, 22 bp, Artificial Sequence
  chemically synthesized
aaaatcagtcatattaaatagt

SEQ ID NO: 902147 - DNA, 22 bp, Artificial Sequence
  chemically synthesized
gaaaatcagtcatattaaatag

SEQ ID NO: 902148 - DNA, 22 bp, Artificial Sequence
  chemically synthesized
tttaatatgactgattttcaaa

SEQ ID NO: 902149 - DNA, 22 bp, Artificial Sequence
  chemically synthesized
aatatgactgattttcaaatct

SEQ ID NO: 902150 - DNA, 22 bp, Artificial Sequence
  chemically synthesized
atatgactgattttcaaatctg

SEQ ID NO: 902151 - DNA, 22 bp, Artificial Sequence
  chemically synthesized
gagacaacaaatccagatttga

SEQ ID NO: 902152 - DNA, 22 bp, Artificial Sequence
  chemically synthesized
ctagagacaacaaatccagatt

SEQ ID NO: 902153 - DNA, 22 bp, Artificial Sequence
  chemically synthesized
attttcaaatctggatttgttg

SEQ ID NO: 902154 - DNA, 22 bp, Artificial Sequence
  chemically synthesized
caactcctagagacaacaaatc

SEQ ID NO: 902155 - DNA, 22 bp, Artificial Sequence
  chemically synthesized
ccaactcctagagacaacaaat

SEQ ID NO: 902156 - DNA, 22 bp, Artificial Sequence
  chemically synthesized
tcaaatctggatttgttgtctc

SEQ ID NO: 902157 - DNA, 22 bp, Artificial Sequence
  chemically synthesized
caaatctggatttgttgtctct

SEQ ID NO: 902158 - DNA, 22 bp, Artificial Sequence
  chemically synthesized
aaatctggatttgttgtctcta

SEQ ID NO: 902159 - DNA, 22 bp, Artificial Sequence
  chemically synthesized
ccaccttccaactcctagagac

SEQ ID NO: 902160 - DNA, 22 bp, Artificial Sequence
  chemically synthesized
cccaccttccaactcctagaga

SEQ ID NO: 902161 - DNA, 22 bp, Artificial Sequence
  chemically synthesized
gatttgttgtctctaggagttg

SEQ ID NO: 902162 - DNA, 22 bp, Artificial Sequence
  chemically synthesized
gttgtctctaggagttggaagg

SEQ ID NO: 902163 - DNA, 22 bp, Artificial Sequence
  chemically synthesized
caggccttcccaccttccaact

SEQ ID NO: 902164 - DNA, 22 bp, Artificial Sequence
  chemically synthesized
ttgtctctaggagttggaaggt

SEQ ID NO: 902165 - DNA, 22 bp, Artificial Sequence
  chemically synthesized
gcaggccttcccaccttccaac

SEQ ID NO: 902166 - DNA, 22 bp, Artificial Sequence
  chemically synthesized
tgcaggccttcccaccttccaa

SEQ ID NO: 902167 - DNA, 22 bp, Artificial Sequence
  chemically synthesized
tctctaggagttggaaggtggg

SEQ ID NO: 902168 - DNA, 22 bp, Artificial Sequence
  chemically synthesized
taggagttggaaggtgggaagg

SEQ ID NO: 902169 - DNA, 22 bp, Artificial Sequence
  chemically synthesized
ggagttggaaggtgggaaggcc

SEQ ID NO: 902170 - DNA, 22 bp, Artificial Sequence
  chemically synthesized
ataaaaaaaattttgcaggcct

SEQ ID NO: 902171 - DNA, 22 bp, Artificial Sequence
  chemically synthesized
gaaggtgggaaggcctgcaaaa

SEQ ID NO: 902172 - DNA, 22 bp, Artificial Sequence
  chemically synthesized
aattaataaaaaaaattttgca

SEQ ID NO: 902173 - DNA, 22 bp, Artificial Sequence
  chemically synthesized
aaattaataaaaaaaattttgc

SEQ ID NO: 902174 - DNA, 22 bp, Artificial Sequence
  chemically synthesized
taaattaataaaaaaaattttg

SEQ ID NO: 902175 - DNA, 22 bp, Artificial Sequence
  chemically synthesized
ttttaaattaataaaaaaaatt

SEQ ID NO: 902176 - DNA, 22 bp, Artificial Sequence
  chemically synthesized
caaaattttttttattaattta

SEQ ID NO: 902177 - DNA, 22 bp, Artificial Sequence
  chemically synthesized
tttttattaatttaaaatagga

SEQ ID NO: 902178 - DNA, 22 bp, Artificial Sequence
  chemically synthesized
ttttattaatttaaaataggac

SEQ ID NO: 902179 - DNA, 22 bp, Artificial Sequence
  chemically synthesized
tttattaatttaaaataggacg

SEQ ID NO: 902180 - DNA, 22 bp, Artificial Sequence
  chemically synthesized
ttattaatttaaaataggacga

SEQ ID NO: 902181 - DNA, 22 bp, Artificial Sequence
  chemically synthesized
tattaatttaaaataggacgat

SEQ ID NO: 902182 - DNA, 22 bp, Artificial Sequence
  chemically synthesized
tatggaatgtatatcgtcctat

SEQ ID NO: 902183 - DNA, 22 bp, Artificial Sequence
  chemically synthesized
attaatttaaaataggacgata

SEQ ID NO: 902184 - DNA, 22 bp, Artificial Sequence
  chemically synthesized
ttaatttaaaataggacgatat

SEQ ID NO: 902185 - DNA, 22 bp, Artificial Sequence
  chemically synthesized
atttaaaataggacgatataca

SEQ ID NO: 902186 - DNA, 22 bp, Artificial Sequence
  chemically synthesized
aaaataggacgatatacattcc

SEQ ID NO: 902187 - DNA, 22 bp, Artificial Sequence
  chemically synthesized
aaataggacgatatacattcca

SEQ ID NO: 902188 - DNA, 22 bp, Artificial Sequence
  chemically synthesized
agaaaataaataatcgctgtat

SEQ ID NO: 902189 - DNA, 22 bp, Artificial Sequence
  chemically synthesized
tggttaagaaaataaataatcg

SEQ ID NO: 902190 - DNA, 22 bp, Artificial Sequence
  chemically synthesized
ttatggttaagaaaataaataa

SEQ ID NO: 902191 - DNA, 22 bp, Artificial Sequence
  chemically synthesized
catacagcgattatttattttc

SEQ ID NO: 902192 - DNA, 22 bp, Artificial Sequence
  chemically synthesized
agactgttatggttaagaaaat

SEQ ID NO: 902193 - DNA, 22 bp, Artificial Sequence
  chemically synthesized
gttaagactgttatggttaaga

SEQ ID NO: 902194 - DNA, 22 bp, Artificial Sequence
  chemically synthesized
tagttaagactgttatggttaa

SEQ ID NO: 902195 - DNA, 22 bp, Artificial Sequence
  chemically synthesized
tttattttcttaaccataacag

SEQ ID NO: 902196 - DNA, 22 bp, Artificial Sequence
  chemically synthesized
attttcttaaccataacagtct

SEQ ID NO: 902197 - DNA, 22 bp, Artificial Sequence
  chemically synthesized
ttttcttaaccataacagtctt

SEQ ID NO: 902198 - DNA, 22 bp, Artificial Sequence
  chemically synthesized
tgtgctctagttaagactgtta

SEQ ID NO: 902199 - DNA, 22 bp, Artificial Sequence
  chemically synthesized
tcttaaccataacagtcttaac

SEQ ID NO: 902200 - DNA, 22 bp, Artificial Sequence
  chemically synthesized
ctgtgtgctctagttaagactg

SEQ ID NO: 902201 - DNA, 22 bp, Artificial Sequence
  chemically synthesized
cttaaccataacagtcttaact

SEQ ID NO: 902202 - DNA, 22 bp, Artificial Sequence
  chemically synthesized
ttaaccataacagtcttaacta

SEQ ID NO: 902203 - DNA, 22 bp, Artificial Sequence
  chemically synthesized
tgctgtgtgctctagttaagac

SEQ ID NO: 902204 - DNA, 22 bp, Artificial Sequence
  chemically synthesized
aaccataacagtcttaactaga

SEQ ID NO: 902205 - DNA, 22 bp, Artificial Sequence
  chemically synthesized
accataacagtcttaactagag

SEQ ID NO: 902206 - DNA, 22 bp, Artificial Sequence
  chemically synthesized
attctgctgtgtgctctagtta

SEQ ID NO: 902207 - DNA, 22 bp, Artificial Sequence
  chemically synthesized
cccaattgattctgctgtgtgc

SEQ ID NO: 902208 - DNA, 22 bp, Artificial Sequence
  chemically synthesized
ctacccaattgattctgctgtg

SEQ ID NO: 902209 - DNA, 22 bp, Artificial Sequence
  chemically synthesized
aactagagcacacagcagaatc

SEQ ID NO: 902210 - DNA, 22 bp, Artificial Sequence
  chemically synthesized
actagagcacacagcagaatca

SEQ ID NO: 902211 - DNA, 22 bp, Artificial Sequence
  chemically synthesized
gagcacacagcagaatcaattg

SEQ ID NO: 902212 - DNA, 22 bp, Artificial Sequence
  chemically synthesized
aaacaaaataaaacaaaaactc

SEQ ID NO: 902213 - DNA, 22 bp, Artificial Sequence
  chemically synthesized
ggtaggagtttttgttttattt

SEQ ID NO: 902214 - DNA, 22 bp, Artificial Sequence
  chemically synthesized
gatatacatattaaaacaaaat

SEQ ID NO: 902215 - DNA, 22 bp, Artificial Sequence
  chemically synthesized
ggatatacatattaaaacaaaa

SEQ ID NO: 902216 - DNA, 22 bp, Artificial Sequence
  chemically synthesized
ttgttttattttgttttaatat

SEQ ID NO: 902217 - DNA, 22 bp, Artificial Sequence
  chemically synthesized
tgttttattttgttttaatatg

SEQ ID NO: 902218 - DNA, 22 bp, Artificial Sequence
  chemically synthesized
gttttattttgttttaatatgt

SEQ ID NO: 902219 - DNA, 22 bp, Artificial Sequence
  chemically synthesized
ttttattttgttttaatatgta

SEQ ID NO: 902220 - DNA, 22 bp, Artificial Sequence
  chemically synthesized
tattttgttttaatatgtatat

SEQ ID NO: 902221 - DNA, 22 bp, Artificial Sequence
  chemically synthesized
attttgttttaatatgtatatc

SEQ ID NO: 902222 - DNA, 22 bp, Artificial Sequence
  chemically synthesized
gtatggagcttggatatacata

SEQ ID NO: 902223 - DNA, 22 bp, Artificial Sequence
  chemically synthesized
ttttgttttaatatgtatatcc

SEQ ID NO: 902224 - DNA, 22 bp, Artificial Sequence
  chemically synthesized
tggtatggagcttggatataca

SEQ ID NO: 902225 - DNA, 22 bp, Artificial Sequence
  chemically synthesized
tgttttaatatgtatatccaag

SEQ ID NO: 902226 - DNA, 22 bp, Artificial Sequence
  chemically synthesized
tctggtatggagcttggatata

SEQ ID NO: 902227 - DNA, 22 bp, Artificial Sequence
  chemically synthesized
gttttaatatgtatatccaagc

SEQ ID NO: 902228 - DNA, 22 bp, Artificial Sequence
  chemically synthesized
ttttaatatgtatatccaagct

SEQ ID NO: 902229 - DNA, 22 bp, Artificial Sequence
  chemically synthesized
taatatgtatatccaagctcca

SEQ ID NO: 902230 - DNA, 22 bp, Artificial Sequence
  chemically synthesized
gattctctggtatggagcttgg

SEQ ID NO: 902231 - DNA, 22 bp, Artificial Sequence
  chemically synthesized
aatatgtatatccaagctccat

SEQ ID NO: 902232 - DNA, 22 bp, Artificial Sequence
  chemically synthesized
atatgtatatccaagctccata

SEQ ID NO: 902233 - DNA, 22 bp, Artificial Sequence
  chemically synthesized
tggaattagattctctggtatg

SEQ ID NO: 902234 - DNA, 22 bp, Artificial Sequence
  chemically synthesized
atggaattagattctctggtat

SEQ ID NO: 902235 - DNA, 22 bp, Artificial Sequence
  chemically synthesized
caaacttatggaattagattct

SEQ ID NO: 902236 - DNA, 22 bp, Artificial Sequence
  chemically synthesized
cataccagagaatctaattcca

SEQ ID NO: 902237 - DNA, 22 bp, Artificial Sequence
  chemically synthesized
cattacaaacttatggaattag

SEQ ID NO: 902238 - DNA, 22 bp, Artificial Sequence
  chemically synthesized
tcgcgactccattacaaactta

SEQ ID NO: 902239 - DNA, 22 bp, Artificial Sequence
  chemically synthesized
agctatcgcgactccattacaa

SEQ ID NO: 902240 - DNA, 22 bp, Artificial Sequence
  chemically synthesized
attccataagtttgtaatggag

SEQ ID NO: 902241 - DNA, 22 bp, Artificial Sequence
  chemically synthesized
cataagtttgtaatggagtcgc

SEQ ID NO: 902242 - DNA, 22 bp, Artificial Sequence
  chemically synthesized
ggttgagctatcgcgactccat

SEQ ID NO: 902243 - DNA, 22 bp, Artificial Sequence
  chemically synthesized
gtaatggagtcgcgatagctca

SEQ ID NO: 902244 - DNA, 22 bp, Artificial Sequence
  chemically synthesized
taatggagtcgcgatagctcaa

SEQ ID NO: 902245 - DNA, 22 bp, Artificial Sequence
  chemically synthesized
taaatagaaaaattaggttgag

SEQ ID NO: 902246 - DNA, 22 bp, Artificial Sequence
  chemically synthesized
tattataaatagaaaaattagg

SEQ ID NO: 902247 - DNA, 22 bp, Artificial Sequence
  chemically synthesized
tatattataaatagaaaaatta

SEQ ID NO: 902248 - DNA, 22 bp, Artificial Sequence
  chemically synthesized
ctatattataaatagaaaaatt

SEQ ID NO: 902249 - DNA, 22 bp, Artificial Sequence
  chemically synthesized
tttctatattataaatagaaaa

SEQ ID NO: 902250 - DNA, 22 bp, Artificial Sequence
  chemically synthesized
aacctaatttttctatttataa

SEQ ID NO: 902251 - DNA, 22 bp, Artificial Sequence
  chemically synthesized
agcatctatttctatattataa

SEQ ID NO: 902252 - DNA, 22 bp, Artificial Sequence
  chemically synthesized
atttttctatttataatataga

SEQ ID NO: 902253 - DNA, 22 bp, Artificial Sequence
  chemically synthesized
ttctatttataatatagaaata

SEQ ID NO: 902254 - DNA, 22 bp, Artificial Sequence
  chemically synthesized
tctatttataatatagaaatag

SEQ ID NO: 902255 - DNA, 22 bp, Artificial Sequence
  chemically synthesized
ggatctaagcatctatttctat

SEQ ID NO: 902256 - DNA, 22 bp, Artificial Sequence
  chemically synthesized
ctatttataatatagaaataga

SEQ ID NO: 902257 - DNA, 22 bp, Artificial Sequence
  chemically synthesized
tatttataatatagaaatagat

SEQ ID NO: 902258 - DNA, 22 bp, Artificial Sequence
  chemically synthesized
tttataatatagaaatagatgc

SEQ ID NO: 902259 - DNA, 22 bp, Artificial Sequence
  chemically synthesized
ataatatagaaatagatgctta

SEQ ID NO: 902260 - DNA, 22 bp, Artificial Sequence
  chemically synthesized
taatatagaaatagatgcttag

SEQ ID NO: 902261 - DNA, 22 bp, Artificial Sequence
  chemically synthesized
taccactgggatctaagcatct

SEQ ID NO: 902262 - DNA, 22 bp, Artificial Sequence
  chemically synthesized
gtaccactgggatctaagcatc

SEQ ID NO: 902263 - DNA, 22 bp, Artificial Sequence
  chemically synthesized
gcagggatgtttgtaccactgg

SEQ ID NO: 902264 - DNA, 22 bp, Artificial Sequence
  chemically synthesized
tagcagggatgtttgtaccact

SEQ ID NO: 902265 - DNA, 22 bp, Artificial Sequence
  chemically synthesized
agatcccagtggtacaaacatc

SEQ ID NO: 902266 - DNA, 22 bp, Artificial Sequence
  chemically synthesized
gatcccagtggtacaaacatcc

SEQ ID NO: 902267 - DNA, 22 bp, Artificial Sequence
  chemically synthesized
tgtgggctctagcagggatgtt

SEQ ID NO: 902268 - DNA, 22 bp, Artificial Sequence
  chemically synthesized
gtgtgggctctagcagggatgt

SEQ ID NO: 902269 - DNA, 22 bp, Artificial Sequence
  chemically synthesized
cagtttgtgtgggctctagcag

SEQ ID NO: 902270 - DNA, 22 bp, Artificial Sequence
  chemically synthesized
ataggcattgcagtttgtgtgg

SEQ ID NO: 902271 - DNA, 22 bp, Artificial Sequence
  chemically synthesized
ctaataggcattgcagtttgtg

SEQ ID NO: 902272 - DNA, 22 bp, Artificial Sequence
  chemically synthesized
ctagagcccacacaaactgcaa

SEQ ID NO: 902273 - DNA, 22 bp, Artificial Sequence
  chemically synthesized
ctactaataggcattgcagttt

SEQ ID NO: 902274 - DNA, 22 bp, Artificial Sequence
  chemically synthesized
actactaataggcattgcagtt

SEQ ID NO: 902275 - DNA, 22 bp, Artificial Sequence
  chemically synthesized
gagcccacacaaactgcaatgc

SEQ ID NO: 902276 - DNA, 22 bp, Artificial Sequence
  chemically synthesized
ttactactaataggcattgcag

SEQ ID NO: 902277 - DNA, 22 bp, Artificial Sequence
  chemically synthesized
cttactactaataggcattgca

SEQ ID NO: 902278 - DNA, 22 bp, Artificial Sequence
  chemically synthesized
tcttactactaataggcattgc

SEQ ID NO: 902279 - DNA, 22 bp, Artificial Sequence
  chemically synthesized
attttcttactactaataggca

SEQ ID NO: 902280 - DNA, 22 bp, Artificial Sequence
  chemically synthesized
caatgcctattagtagtaagaa

SEQ ID NO: 902281 - DNA, 22 bp, Artificial Sequence
  chemically synthesized
aaaagagaagcagtctcatttt

SEQ ID NO: 902282 - DNA, 22 bp, Artificial Sequence
  chemically synthesized
ttagtagtaagaaaatgagact

SEQ ID NO: 902283 - DNA, 22 bp, Artificial Sequence
  chemically synthesized
gtagtaagaaaatgagactgct

SEQ ID NO: 902284 - DNA, 22 bp, Artificial Sequence
  chemically synthesized
agaatgagaacaaaatgttaaa

SEQ ID NO: 902285 - DNA, 22 bp, Artificial Sequence
  chemically synthesized
cttctctttttaacattttgtt

SEQ ID NO: 902286 - DNA, 22 bp, Artificial Sequence
  chemically synthesized
ctctttttaacattttgttctc

SEQ ID NO: 902287 - DNA, 22 bp, Artificial Sequence
  chemically synthesized
tctttttaacattttgttctca

SEQ ID NO: 902288 - DNA, 22 bp, Artificial Sequence
  chemically synthesized
tttttaacattttgttctcatt

SEQ ID NO: 902289 - DNA, 22 bp, Artificial Sequence
  chemically synthesized
tttaacattttgttctcattct

SEQ ID NO: 902290 - DNA, 22 bp, Artificial Sequence
  chemically synthesized
ttaacattttgttctcattctc

SEQ ID NO: 902291 - DNA, 22 bp, Artificial Sequence
  chemically synthesized
taacattttgttctcattctca

SEQ ID NO: 902292 - DNA, 22 bp, Artificial Sequence
  chemically synthesized
aacattttgttctcattctcaa

SEQ ID NO: 902293 - DNA, 22 bp, Artificial Sequence
  chemically synthesized
acattttgttctcattctcaat

SEQ ID NO: 902294 - DNA, 22 bp, Artificial Sequence
  chemically synthesized
aggtaaatgcagattgagaatg

SEQ ID NO: 902295 - DNA, 22 bp, Artificial Sequence
  chemically synthesized
tgttctcattctcaatctgcat

SEQ ID NO: 902296 - DNA, 22 bp, Artificial Sequence
  chemically synthesized
gttctcattctcaatctgcatt

SEQ ID NO: 902297 - DNA, 22 bp, Artificial Sequence
  chemically synthesized
ttctcattctcaatctgcattt

SEQ ID NO: 902298 - DNA, 22 bp, Artificial Sequence
  chemically synthesized
gtaaatctgaggtaaatgcaga

SEQ ID NO: 902299 - DNA, 22 bp, Artificial Sequence
  chemically synthesized
agtaaatctgaggtaaatgcag

SEQ ID NO: 902300 - DNA, 22 bp, Artificial Sequence
  chemically synthesized
tcattctcaatctgcatttacc

SEQ ID NO: 902301 - DNA, 22 bp, Artificial Sequence
  chemically synthesized
attctcaatctgcatttacctc

SEQ ID NO: 902302 - DNA, 22 bp, Artificial Sequence
  chemically synthesized
gacttagtaaatctgaggtaaa

SEQ ID NO: 902303 - DNA, 22 bp, Artificial Sequence
  chemically synthesized
agacttagtaaatctgaggtaa

SEQ ID NO: 902304 - DNA, 22 bp, Artificial Sequence
  chemically synthesized
tcaatctgcatttacctcagat

SEQ ID NO: 902305 - DNA, 22 bp, Artificial Sequence
  chemically synthesized
tagacttagtaaatctgaggta

SEQ ID NO: 902306 - DNA, 22 bp, Artificial Sequence
  chemically synthesized
aatctgcatttacctcagattt

SEQ ID NO: 902307 - DNA, 22 bp, Artificial Sequence
  chemically synthesized
agttttagacttagtaaatctg

SEQ ID NO: 902308 - DNA, 22 bp, Artificial Sequence
  chemically synthesized
gagttttagacttagtaaatct

SEQ ID NO: 902309 - DNA, 22 bp, Artificial Sequence
  chemically synthesized
catttacctcagatttactaag

SEQ ID NO: 902310 - DNA, 22 bp, Artificial Sequence
  chemically synthesized
acttgagttttagacttagtaa

SEQ ID NO: 902311 - DNA, 22 bp, Artificial Sequence
  chemically synthesized
gacttgagttttagacttagta

SEQ ID NO: 902312 - DNA, 22 bp, Artificial Sequence
  chemically synthesized
acctcagatttactaagtctaa

SEQ ID NO: 902313 - DNA, 22 bp, Artificial Sequence
  chemically synthesized
cctcagatttactaagtctaaa

SEQ ID NO: 902314 - DNA, 22 bp, Artificial Sequence
  chemically synthesized
cacttgacttgagttttagact

SEQ ID NO: 902315 - DNA, 22 bp, Artificial Sequence
  chemically synthesized
agatttactaagtctaaaactc

SEQ ID NO: 902316 - DNA, 22 bp, Artificial Sequence
  chemically synthesized
cactacacttgacttgagtttt

SEQ ID NO: 902317 - DNA, 22 bp, Artificial Sequence
  chemically synthesized
actaagtctaaaactcaagtca

SEQ ID NO: 902318 - DNA, 22 bp, Artificial Sequence
  chemically synthesized
ctgcactacacttgacttgagt

SEQ ID NO: 902319 - DNA, 22 bp, Artificial Sequence
  chemically synthesized
ctaagtctaaaactcaagtcaa

SEQ ID NO: 902320 - DNA, 22 bp, Artificial Sequence
  chemically synthesized
actgcactacacttgacttgag

SEQ ID NO: 902321 - DNA, 22 bp, Artificial Sequence
  chemically synthesized
tactgcactacacttgacttga

SEQ ID NO: 902322 - DNA, 22 bp, Artificial Sequence
  chemically synthesized
agtctaaaactcaagtcaagtg

SEQ ID NO: 902323 - DNA, 22 bp, Artificial Sequence
  chemically synthesized
ttttactgcactacacttgact

SEQ ID NO: 902324 - DNA, 22 bp, Artificial Sequence
  chemically synthesized
gttttactgcactacacttgac

SEQ ID NO: 902325 - DNA, 22 bp, Artificial Sequence
  chemically synthesized
cttgttttactgcactacactt

SEQ ID NO: 902326 - DNA, 22 bp, Artificial Sequence
  chemically synthesized
aaactcaagtcaagtgtagtgc

SEQ ID NO: 902327 - DNA, 22 bp, Artificial Sequence
  chemically synthesized
acttgttttactgcactacact

SEQ ID NO: 902328 - DNA, 22 bp, Artificial Sequence
  chemically synthesized
acttacttgttttactgcacta

SEQ ID NO: 902329 - DNA, 22 bp, Artificial Sequence
  chemically synthesized
aacttacttgttttactgcact

SEQ ID NO: 902330 - DNA, 22 bp, Artificial Sequence
  chemically synthesized
aagtcaagtgtagtgcagtaaa

SEQ ID NO: 902331 - DNA, 22 bp, Artificial Sequence
  chemically synthesized
ttaacttacttgttttactgca

SEQ ID NO: 902332 - DNA, 22 bp, Artificial Sequence
  chemically synthesized
cagctcttaacttacttgtttt

SEQ ID NO: 902333 - DNA, 22 bp, Artificial Sequence
  chemically synthesized
ccagctcttaacttacttgttt

SEQ ID NO: 902334 - DNA, 22 bp, Artificial Sequence
  chemically synthesized
caccgagtccttccagctctta

SEQ ID NO: 902335 - DNA, 22 bp, Artificial Sequence
  chemically synthesized
ttacaccgagtccttccagctc

SEQ ID NO: 902336 - DNA, 22 bp, Artificial Sequence
  chemically synthesized
agagctggaaggactcggtgta

SEQ ID NO: 902337 - DNA, 22 bp, Artificial Sequence
  chemically synthesized
gaaggactcggtgtaacagtgt

SEQ ID NO: 902338 - DNA, 22 bp, Artificial Sequence
  chemically synthesized
ggtgtaacagtgtgcattatga

SEQ ID NO: 902339 - DNA, 22 bp, Artificial Sequence
  chemically synthesized
aaatccaaaggcacataagtca

SEQ ID NO: 902340 - DNA, 22 bp, Artificial Sequence
  chemically synthesized
tgacttatgtgcctttggattt

SEQ ID NO: 902341 - DNA, 22 bp, Artificial Sequence
  chemically synthesized
cccccaaaactaaaatccaaag

SEQ ID NO: 902342 - DNA, 22 bp, Artificial Sequence
  chemically synthesized
atgtgcctttggattttagttt

SEQ ID NO: 902343 - DNA, 22 bp, Artificial Sequence
  chemically synthesized
tgtgcctttggattttagtttt

SEQ ID NO: 902344 - DNA, 22 bp, Artificial Sequence
  chemically synthesized
aagtggttccccccaaaactaa

SEQ ID NO: 902345 - DNA, 22 bp, Artificial Sequence
  chemically synthesized
aaagtggttccccccaaaacta

SEQ ID NO: 902346 - DNA, 22 bp, Artificial Sequence
  chemically synthesized
tggattttagttttggggggaa

SEQ ID NO: 902347 - DNA, 22 bp, Artificial Sequence
  chemically synthesized
ggattttagttttggggggaac

SEQ ID NO: 902348 - DNA, 22 bp, Artificial Sequence
  chemically synthesized
gattttagttttggggggaacc

SEQ ID NO: 902349 - DNA, 22 bp, Artificial Sequence
  chemically synthesized
tagttttggggggaaccacttt

SEQ ID NO: 902350 - DNA, 22 bp, Artificial Sequence
  chemically synthesized
agttttggggggaaccacttta

SEQ ID NO: 902351 - DNA, 22 bp, Artificial Sequence
  chemically synthesized
gttttggggggaaccactttaa

SEQ ID NO: 902352 - DNA, 22 bp, Artificial Sequence
  chemically synthesized
tggggggaaccactttaagccc

SEQ ID NO: 902353 - DNA, 22 bp, Artificial Sequence
  chemically synthesized
ggggggaaccactttaagccca

SEQ ID NO: 902354 - DNA, 22 bp, Artificial Sequence
  chemically synthesized
caaaagaagaaatgggcttaaa

SEQ ID NO: 902355 - DNA, 22 bp, Artificial Sequence
  chemically synthesized
gggggaaccactttaagcccat

SEQ ID NO: 902356 - DNA, 22 bp, Artificial Sequence
  chemically synthesized
tacaaaagaagaaatgggctta

SEQ ID NO: 902357 - DNA, 22 bp, Artificial Sequence
  chemically synthesized
ttctacaaaagaagaaatgggc

SEQ ID NO: 902358 - DNA, 22 bp, Artificial Sequence
  chemically synthesized
tgttctacaaaagaagaaatgg

SEQ ID NO: 902359 - DNA, 22 bp, Artificial Sequence
  chemically synthesized
tctgttctacaaaagaagaaat

SEQ ID NO: 902360 - DNA, 22 bp, Artificial Sequence
  chemically synthesized
actctctgttctacaaaagaag

SEQ ID NO: 902361 - DNA, 22 bp, Artificial Sequence
  chemically synthesized
taagcccatttcttcttttgta

SEQ ID NO: 902362 - DNA, 22 bp, Artificial Sequence
  chemically synthesized
aagcccatttcttcttttgtag

SEQ ID NO: 902363 - DNA, 22 bp, Artificial Sequence
  chemically synthesized
agcccatttcttcttttgtaga

SEQ ID NO: 902364 - DNA, 22 bp, Artificial Sequence
  chemically synthesized
tgagaattaactctctgttcta

SEQ ID NO: 902365 - DNA, 22 bp, Artificial Sequence
  chemically synthesized
cttcttttgtagaacagagagt

SEQ ID NO: 902366 - DNA, 22 bp, Artificial Sequence
  chemically synthesized
ttcttttgtagaacagagagtt

SEQ ID NO: 902367 - DNA, 22 bp, Artificial Sequence
  chemically synthesized
cttttgtagaacagagagttaa

SEQ ID NO: 902368 - DNA, 22 bp, Artificial Sequence
  chemically synthesized
ttttgtagaacagagagttaat

SEQ ID NO: 902369 - DNA, 22 bp, Artificial Sequence
  chemically synthesized
ttgtagaacagagagttaattc

SEQ ID NO: 902370 - DNA, 22 bp, Artificial Sequence
  chemically synthesized
tgtagaacagagagttaattct

SEQ ID NO: 902371 - DNA, 22 bp, Artificial Sequence
  chemically synthesized
gtagaacagagagttaattctc

SEQ ID NO: 902372 - DNA, 22 bp, Artificial Sequence
  chemically synthesized
tagaacagagagttaattctca

SEQ ID NO: 902373 - DNA, 22 bp, Artificial Sequence
  chemically synthesized
ggaagtatagatactgtgagaa

SEQ ID NO: 902374 - DNA, 22 bp, Artificial Sequence
  chemically synthesized
attctcacagtatctatacttc

SEQ ID NO: 902375 - DNA, 22 bp, Artificial Sequence
  chemically synthesized
tcacagtatctatacttcctag

SEQ ID NO: 902376 - DNA, 22 bp, Artificial Sequence
  chemically synthesized
acagtatctatacttcctagtt

SEQ ID NO: 902377 - DNA, 22 bp, Artificial Sequence
  chemically synthesized
cacatggagaaaaggaagagga

SEQ ID NO: 902378 - DNA, 22 bp, Artificial Sequence
  chemically synthesized
tacttcctagttcctcttcctt

SEQ ID NO: 902379 - DNA, 22 bp, Artificial Sequence
  chemically synthesized
cctagttcctcttccttttctc

SEQ ID NO: 902380 - DNA, 22 bp, Artificial Sequence
  chemically synthesized
ctagttcctcttccttttctcc

SEQ ID NO: 902381 - DNA, 22 bp, Artificial Sequence
  chemically synthesized
gttcctcttccttttctccatg

SEQ ID NO: 902382 - DNA, 22 bp, Artificial Sequence
  chemically synthesized
tggagtaaattacacatggaga

SEQ ID NO: 902383 - DNA, 22 bp, Artificial Sequence
  chemically synthesized
ctcttccttttctccatgtgta

SEQ ID NO: 902384 - DNA, 22 bp, Artificial Sequence
  chemically synthesized
ttccttttctccatgtgtaatt

SEQ ID NO: 902385 - DNA, 22 bp, Artificial Sequence
  chemically synthesized
ccttttctccatgtgtaattta

SEQ ID NO: 902386 - DNA, 22 bp, Artificial Sequence
  chemically synthesized
cttttctccatgtgtaatttac

SEQ ID NO: 902387 - DNA, 22 bp, Artificial Sequence
  chemically synthesized
ttctccatgtgtaatttactcc

SEQ ID NO: 902388 - DNA, 22 bp, Artificial Sequence
  chemically synthesized
tctccatgtgtaatttactcca

SEQ ID NO: 902389 - DNA, 22 bp, Artificial Sequence
  chemically synthesized
ctccatgtgtaatttactccac

SEQ ID NO: 902390 - DNA, 22 bp, Artificial Sequence
  chemically synthesized
tccatgtgtaatttactccaca

SEQ ID NO: 902391 - DNA, 22 bp, Artificial Sequence
  chemically synthesized
catgtgtaatttactccacagt

SEQ ID NO: 902392 - DNA, 22 bp, Artificial Sequence
  chemically synthesized
actccacagtcttcttttattt

SEQ ID NO: 902393 - DNA, 22 bp, Artificial Sequence
  chemically synthesized
ctccacagtcttcttttatttt

SEQ ID NO: 902394 - DNA, 22 bp, Artificial Sequence
  chemically synthesized
cacagtcttcttttattttgca

SEQ ID NO: 902395 - DNA, 22 bp, Artificial Sequence
  chemically synthesized
cttttattttgcatcactgata

SEQ ID NO: 902396 - DNA, 22 bp, Artificial Sequence
  chemically synthesized
ttttattttgcatcactgatac

SEQ ID NO: 902397 - DNA, 22 bp, Artificial Sequence
  chemically synthesized
ttattttgcatcactgatacgg

SEQ ID NO: 902398 - DNA, 22 bp, Artificial Sequence
  chemically synthesized
tattttgcatcactgatacggt

SEQ ID NO: 902399 - DNA, 22 bp, Artificial Sequence
  chemically synthesized
attttgcatcactgatacggtt

SEQ ID NO: 902400 - DNA, 22 bp, Artificial Sequence
  chemically synthesized
ttttgcatcactgatacggttt

SEQ ID NO: 902401 - DNA, 22 bp, Artificial Sequence
  chemically synthesized
tgcatcactgatacggtttggc

SEQ ID NO: 902402 - DNA, 22 bp, Artificial Sequence
  chemically synthesized
ggtggagacacagccaaaccgt

SEQ ID NO: 902403 - DNA, 22 bp, Artificial Sequence
  chemically synthesized
gcatcactgatacggtttggct

SEQ ID NO: 902404 - DNA, 22 bp, Artificial Sequence
  chemically synthesized
gggtggagacacagccaaaccg

SEQ ID NO: 902405 - DNA, 22 bp, Artificial Sequence
  chemically synthesized
catcactgatacggtttggctg

SEQ ID NO: 902406 - DNA, 22 bp, Artificial Sequence
  chemically synthesized
atacggtttggctgtgtctcca

SEQ ID NO: 902407 - DNA, 22 bp, Artificial Sequence
  chemically synthesized
aacatgagatttgggtggagac

SEQ ID NO: 902408 - DNA, 22 bp, Artificial Sequence
  chemically synthesized
ggctgtgtctccacccaaatct

SEQ ID NO: 902409 - DNA, 22 bp, Artificial Sequence
  chemically synthesized
gctgtgtctccacccaaatctc

SEQ ID NO: 902410 - DNA, 22 bp, Artificial Sequence
  chemically synthesized
tgtctccacccaaatctcatgt

SEQ ID NO: 902411 - DNA, 22 bp, Artificial Sequence
  chemically synthesized
cacccaaatctcatgttgaatt

SEQ ID NO: 902412 - DNA, 22 bp, Artificial Sequence
  chemically synthesized
ccataacacatgggaattcaac

SEQ ID NO: 902413 - DNA, 22 bp, Artificial Sequence
  chemically synthesized
ggtccctcccataacacatggg

SEQ ID NO: 902414 - DNA, 22 bp, Artificial Sequence
  chemically synthesized
atgttgaattcccatgtgttat

SEQ ID NO: 902415 - DNA, 22 bp, Artificial Sequence
  chemically synthesized
ccactgggtccctcccataaca

SEQ ID NO: 902416 - DNA, 22 bp, Artificial Sequence
  chemically synthesized
aattcccatgtgttatgggagg

SEQ ID NO: 902417 - DNA, 22 bp, Artificial Sequence
  chemically synthesized
cctcccactgggtccctcccat

SEQ ID NO: 902418 - DNA, 22 bp, Artificial Sequence
  chemically synthesized
ccatgtgttatgggagggaccc

SEQ ID NO: 902419 - DNA, 22 bp, Artificial Sequence
  chemically synthesized
aattacctcccactgggtccct

SEQ ID NO: 902420 - DNA, 22 bp, Artificial Sequence
  chemically synthesized
tgggagggacccagtgggaggt

SEQ ID NO: 902421 - DNA, 22 bp, Artificial Sequence
  chemically synthesized
cccccatgattaaattacctcc

SEQ ID NO: 902422 - DNA, 22 bp, Artificial Sequence
  chemically synthesized
gaacagcacaggaaagacctgc

SEQ ID NO: 902423 - DNA, 22 bp, Artificial Sequence
  chemically synthesized
aatcatgggggcaggtctttcc

SEQ ID NO: 902424 - DNA, 22 bp, Artificial Sequence
  chemically synthesized
atcatgggggcaggtctttcct

SEQ ID NO: 902425 - DNA, 22 bp, Artificial Sequence
  chemically synthesized
acaatcactagaacagcacagg

SEQ ID NO: 902426 - DNA, 22 bp, Artificial Sequence
  chemically synthesized
ttcacaatcactagaacagcac

SEQ ID NO: 902427 - DNA, 22 bp, Artificial Sequence
  chemically synthesized
attcacaatcactagaacagca

SEQ ID NO: 902428 - DNA, 22 bp, Artificial Sequence
  chemically synthesized
tcctgtgctgttctagtgattg

SEQ ID NO: 902429 - DNA, 22 bp, Artificial Sequence
  chemically synthesized
cctgtgctgttctagtgattgt

SEQ ID NO: 902430 - DNA, 22 bp, Artificial Sequence
  chemically synthesized
ctgtgctgttctagtgattgtg

SEQ ID NO: 902431 - DNA, 22 bp, Artificial Sequence
  chemically synthesized
atgagacttattcacaatcact

SEQ ID NO: 902432 - DNA, 22 bp, Artificial Sequence
  chemically synthesized
tgctgttctagtgattgtgaat

SEQ ID NO: 902433 - DNA, 22 bp, Artificial Sequence
  chemically synthesized
ttctagtgattgtgaataagtc

SEQ ID NO: 902434 - DNA, 22 bp, Artificial Sequence
  chemically synthesized
tagtgattgtgaataagtctca

SEQ ID NO: 902435 - DNA, 22 bp, Artificial Sequence
  chemically synthesized
gtgattgtgaataagtctcatg

SEQ ID NO: 902436 - DNA, 22 bp, Artificial Sequence
  chemically synthesized
aaaaccatcagatctcatgaga

SEQ ID NO: 902437 - DNA, 22 bp, Artificial Sequence
  chemically synthesized
caaaaccatcagatctcatgag

SEQ ID NO: 902438 - DNA, 22 bp, Artificial Sequence
  chemically synthesized
tcaaaaccatcagatctcatga

SEQ ID NO: 902439 - DNA, 22 bp, Artificial Sequence
  chemically synthesized
ttcaaaaccatcagatctcatg

SEQ ID NO: 902440 - DNA, 22 bp, Artificial Sequence
  chemically synthesized
tgaataagtctcatgagatctg

SEQ ID NO: 902441 - DNA, 22 bp, Artificial Sequence
  chemically synthesized
cgcttttcaaaaccatcagatc

SEQ ID NO: 902442 - DNA, 22 bp, Artificial Sequence
  chemically synthesized
atgagatctgatggttttgaaa

SEQ ID NO: 902443 - DNA, 22 bp, Artificial Sequence
  chemically synthesized
gagggaaactccgcttttcaaa

SEQ ID NO: 902444 - DNA, 22 bp, Artificial Sequence
  chemically synthesized
ggagggaaactccgcttttcaa

SEQ ID NO: 902445 - DNA, 22 bp, Artificial Sequence
  chemically synthesized
tggagggaaactccgcttttca

SEQ ID NO: 902446 - DNA, 22 bp, Artificial Sequence
  chemically synthesized
ttggagggaaactccgcttttc

SEQ ID NO: 902447 - DNA, 22 bp, Artificial Sequence
  chemically synthesized
atggttttgaaaagcggagttt

SEQ ID NO: 902448 - DNA, 22 bp, Artificial Sequence
  chemically synthesized
tgaaaagcggagtttccctcca

SEQ ID NO: 902449 - DNA, 22 bp, Artificial Sequence
  chemically synthesized
gaaaagcggagtttccctccaa

SEQ ID NO: 902450 - DNA, 22 bp, Artificial Sequence
  chemically synthesized
aaaagcggagtttccctccaaa

SEQ ID NO: 902451 - DNA, 22 bp, Artificial Sequence
  chemically synthesized
ccctccaaaagctctctctttg

SEQ ID NO: 902452 - DNA, 22 bp, Artificial Sequence
  chemically synthesized
cctccaaaagctctctctttga

SEQ ID NO: 902453 - DNA, 22 bp, Artificial Sequence
  chemically synthesized
caaaagctctctctttgactgc

SEQ ID NO: 902454 - DNA, 22 bp, Artificial Sequence
  chemically synthesized
cgtggatgggcagcagtcaaag

SEQ ID NO: 902455 - DNA, 22 bp, Artificial Sequence
  chemically synthesized
acgtggatgggcagcagtcaaa

SEQ ID NO: 902456 - DNA, 22 bp, Artificial Sequence
  chemically synthesized
tctctttgactgctgcccatcc

SEQ ID NO: 902457 - DNA, 22 bp, Artificial Sequence
  chemically synthesized
tctttgactgctgcccatccac

SEQ ID NO: 902458 - DNA, 22 bp, Artificial Sequence
  chemically synthesized
tttgactgctgcccatccacgt

SEQ ID NO: 902459 - DNA, 22 bp, Artificial Sequence
  chemically synthesized
tgactgctgcccatccacgtaa

SEQ ID NO: 902460 - DNA, 22 bp, Artificial Sequence
  chemically synthesized
gactgctgcccatccacgtaag

SEQ ID NO: 902461 - DNA, 22 bp, Artificial Sequence
  chemically synthesized
actgctgcccatccacgtaaga

SEQ ID NO: 902462 - DNA, 22 bp, Artificial Sequence
  chemically synthesized
ctgcccatccacgtaagatgtg

SEQ ID NO: 902463 - DNA, 22 bp, Artificial Sequence
  chemically synthesized
cccatccacgtaagatgtgact

SEQ ID NO: 902464 - DNA, 22 bp, Artificial Sequence
  chemically synthesized
tggcaccaggcaaggaggaacg

SEQ ID NO: 902465 - DNA, 22 bp, Artificial Sequence
  chemically synthesized
acaactatggcaccaggcaagg

SEQ ID NO: 902466 - DNA, 22 bp, Artificial Sequence
  chemically synthesized
gttcctccttgcctggtgccat

SEQ ID NO: 902467 - DNA, 22 bp, Artificial Sequence
  chemically synthesized
ctccttgcctggtgccatagtt

SEQ ID NO: 902468 - DNA, 22 bp, Artificial Sequence
  chemically synthesized
gggagacctcacaactatggca

SEQ ID NO: 902469 - DNA, 22 bp, Artificial Sequence
  chemically synthesized
cttgcctggtgccatagttgtg

SEQ ID NO: 902470 - DNA, 22 bp, Artificial Sequence
  chemically synthesized
gctggggagacctcacaactat

SEQ ID NO: 902471 - DNA, 22 bp, Artificial Sequence
  chemically synthesized
ggctggggagacctcacaacta

SEQ ID NO: 902472 - DNA, 22 bp, Artificial Sequence
  chemically synthesized
gcctggtgccatagttgtgagg

SEQ ID NO: 902473 - DNA, 22 bp, Artificial Sequence
  chemically synthesized
cctggtgccatagttgtgaggt

SEQ ID NO: 902474 - DNA, 22 bp, Artificial Sequence
  chemically synthesized
cacttggctggggagacctcac

SEQ ID NO: 902475 - DNA, 22 bp, Artificial Sequence
  chemically synthesized
gtgccatagttgtgaggtctcc

SEQ ID NO: 902476 - DNA, 22 bp, Artificial Sequence
  chemically synthesized
cggttccacttggctggggaga

SEQ ID NO: 902477 - DNA, 22 bp, Artificial Sequence
  chemically synthesized
acggttccacttggctggggag

SEQ ID NO: 902478 - DNA, 22 bp, Artificial Sequence
  chemically synthesized
tgaggtctccccagccaagtgg

SEQ ID NO: 902479 - DNA, 22 bp, Artificial Sequence
  chemically synthesized
atggacttacggttccacttgg

SEQ ID NO: 902480 - DNA, 22 bp, Artificial Sequence
  chemically synthesized
aatggacttacggttccacttg

SEQ ID NO: 902481 - DNA, 22 bp, Artificial Sequence
  chemically synthesized
cccagccaagtggaaccgtaag

SEQ ID NO: 902482 - DNA, 22 bp, Artificial Sequence
  chemically synthesized
caaaagaaagaggtttaatgga

SEQ ID NO: 902483 - DNA, 22 bp, Artificial Sequence
  chemically synthesized
acaaaagaaagaggtttaatgg

SEQ ID NO: 902484 - DNA, 22 bp, Artificial Sequence
  chemically synthesized
ggcaatttacaaaagaaagagg

SEQ ID NO: 902485 - DNA, 22 bp, Artificial Sequence
  chemically synthesized
aacctctttcttttgtaaattg

SEQ ID NO: 902486 - DNA, 22 bp, Artificial Sequence
  chemically synthesized
tttcttttgtaaattgcccagt

SEQ ID NO: 902487 - DNA, 22 bp, Artificial Sequence
  chemically synthesized
tcttttgtaaattgcccagtct

SEQ ID NO: 902488 - DNA, 22 bp, Artificial Sequence
  chemically synthesized
cttttgtaaattgcccagtctc

SEQ ID NO: 902489 - DNA, 22 bp, Artificial Sequence
  chemically synthesized
ttttgtaaattgcccagtctcg

SEQ ID NO: 902490 - DNA, 22 bp, Artificial Sequence
  chemically synthesized
ttgtaaattgcccagtctcggg

SEQ ID NO: 902491 - DNA, 22 bp, Artificial Sequence
  chemically synthesized
tgtaaattgcccagtctcgggt

SEQ ID NO: 902492 - DNA, 22 bp, Artificial Sequence
  chemically synthesized
gtaaattgcccagtctcgggta

SEQ ID NO: 902493 - DNA, 22 bp, Artificial Sequence
  chemically synthesized
cggataaagacatacccgagac

SEQ ID NO: 902494 - DNA, 22 bp, Artificial Sequence
  chemically synthesized
taaattgcccagtctcgggtat

SEQ ID NO: 902495 - DNA, 22 bp, Artificial Sequence
  chemically synthesized
acactgcggataaagacatacc

SEQ ID NO: 902496 - DNA, 22 bp, Artificial Sequence
  chemically synthesized
cacactgcggataaagacatac

SEQ ID NO: 902497 - DNA, 22 bp, Artificial Sequence
  chemically synthesized
cccagtctcgggtatgtcttta

SEQ ID NO: 902498 - DNA, 22 bp, Artificial Sequence
  chemically synthesized
tcacactgcggataaagacata

SEQ ID NO: 902499 - DNA, 22 bp, Artificial Sequence
  chemically synthesized
gtccattttcacactgcggata

SEQ ID NO: 902500 - DNA, 22 bp, Artificial Sequence
  chemically synthesized
gggtatgtctttatccgcagtg

SEQ ID NO: 902501 - DNA, 22 bp, Artificial Sequence
  chemically synthesized
tattagtccattttcacactgc

SEQ ID NO: 902502 - DNA, 22 bp, Artificial Sequence
  chemically synthesized
ctgtattagtccattttcacac

SEQ ID NO: 902503 - DNA, 22 bp, Artificial Sequence
  chemically synthesized
tatccgcagtgtgaaaatggac

SEQ ID NO: 902504 - DNA, 22 bp, Artificial Sequence
  chemically synthesized
atccgcagtgtgaaaatggact

SEQ ID NO: 902505 - DNA, 22 bp, Artificial Sequence
  chemically synthesized
tccgcagtgtgaaaatggacta

SEQ ID NO: 902506 - DNA, 22 bp, Artificial Sequence
  chemically synthesized
gtaccaaattactgtattagtc

SEQ ID NO: 902507 - DNA, 22 bp, Artificial Sequence
  chemically synthesized
ctggtaccaaattactgtatta

SEQ ID NO: 902508 - DNA, 22 bp, Artificial Sequence
  chemically synthesized
tactggtaccaaattactgtat

SEQ ID NO: 902509 - DNA, 22 bp, Artificial Sequence
  chemically synthesized
atacagtaatttggtaccagta

SEQ ID NO: 902510 - DNA, 22 bp, Artificial Sequence
  chemically synthesized
agcagtgccccactctactggt

SEQ ID NO: 902511 - DNA, 22 bp, Artificial Sequence
  chemically synthesized
cagcagtgccccactctactgg

SEQ ID NO: 902512 - DNA, 22 bp, Artificial Sequence
  chemically synthesized
tcagcagtgccccactctactg

SEQ ID NO: 902513 - DNA, 22 bp, Artificial Sequence
  chemically synthesized
ttcagcagtgccccactctact

SEQ ID NO: 902514 - DNA, 22 bp, Artificial Sequence
  chemically synthesized
ggtaccagtagagtggggcact

SEQ ID NO: 902515 - DNA, 22 bp, Artificial Sequence
  chemically synthesized
gtaccagtagagtggggcactg

SEQ ID NO: 902516 - DNA, 22 bp, Artificial Sequence
  chemically synthesized
gggtgtcttttcagcagtgccc

SEQ ID NO: 902517 - DNA, 22 bp, Artificial Sequence
  chemically synthesized
cgggtgtcttttcagcagtgcc

SEQ ID NO: 902518 - DNA, 22 bp, Artificial Sequence
  chemically synthesized
tcgggtgtcttttcagcagtgc

SEQ ID NO: 902519 - DNA, 22 bp, Artificial Sequence
  chemically synthesized
cacattttcgggtgtcttttca

SEQ ID NO: 902520 - DNA, 22 bp, Artificial Sequence
  chemically synthesized
ccacattttcgggtgtcttttc

SEQ ID NO: 902521 - DNA, 22 bp, Artificial Sequence
  chemically synthesized
ctgaaaagacacccgaaaatgt

SEQ ID NO: 902522 - DNA, 22 bp, Artificial Sequence
  chemically synthesized
caaagtcgcttccacattttcg

SEQ ID NO: 902523 - DNA, 22 bp, Artificial Sequence
  chemically synthesized
ccaaagtcgcttccacattttc

SEQ ID NO: 902524 - DNA, 22 bp, Artificial Sequence
  chemically synthesized
aaaagacacccgaaaatgtgga

SEQ ID NO: 902525 - DNA, 22 bp, Artificial Sequence
  chemically synthesized
cgcacttccaaagtcgcttcca

SEQ ID NO: 902526 - DNA, 22 bp, Artificial Sequence
  chemically synthesized
catgttacgcacttccaaagtc

SEQ ID NO: 902527 - DNA, 22 bp, Artificial Sequence
  chemically synthesized
tgcatgttacgcacttccaaag

SEQ ID NO: 902528 - DNA, 22 bp, Artificial Sequence
  chemically synthesized
taccagactctgcatgttacgc

SEQ ID NO: 902529 - DNA, 22 bp, Artificial Sequence
  chemically synthesized
tggaagtgcgtaacatgcagag

SEQ ID NO: 902530 - DNA, 22 bp, Artificial Sequence
  chemically synthesized
ggaagtgcgtaacatgcagagt

SEQ ID NO: 902531 - DNA, 22 bp, Artificial Sequence
  chemically synthesized
gaagtgcgtaacatgcagagtc

SEQ ID NO: 902532 - DNA, 22 bp, Artificial Sequence
  chemically synthesized
caaactgtaccagactctgcat

SEQ ID NO: 902533 - DNA, 22 bp, Artificial Sequence
  chemically synthesized
agccctccaaactgtaccagac

SEQ ID NO: 902534 - DNA, 22 bp, Artificial Sequence
  chemically synthesized
tgagccctccaaactgtaccag

SEQ ID NO: 902535 - DNA, 22 bp, Artificial Sequence
  chemically synthesized
ctgagccctccaaactgtacca

SEQ ID NO: 902536 - DNA, 22 bp, Artificial Sequence
  chemically synthesized
ttctgagccctccaaactgtac

SEQ ID NO: 902537 - DNA, 22 bp, Artificial Sequence
  chemically synthesized
cttctgagccctccaaactgta

SEQ ID NO: 902538 - DNA, 22 bp, Artificial Sequence
  chemically synthesized
tcttctgagccctccaaactgt

SEQ ID NO: 902539 - DNA, 22 bp, Artificial Sequence
  chemically synthesized
ctttcttctgagccctccaaac

SEQ ID NO: 902540 - DNA, 22 bp, Artificial Sequence
  chemically synthesized
cctttcttctgagccctccaaa

SEQ ID NO: 902541 - DNA, 22 bp, Artificial Sequence
  chemically synthesized
tcctttcttctgagccctccaa

SEQ ID NO: 902542 - DNA, 22 bp, Artificial Sequence
  chemically synthesized
gtacagtttggagggctcagaa

SEQ ID NO: 902543 - DNA, 22 bp, Artificial Sequence
  chemically synthesized
tcccacattttcctttcttctg

SEQ ID NO: 902544 - DNA, 22 bp, Artificial Sequence
  chemically synthesized
ggagggctcagaagaaaggaaa

SEQ ID NO: 902545 - DNA, 22 bp, Artificial Sequence
  chemically synthesized
gagggctcagaagaaaggaaaa

SEQ ID NO: 902546 - DNA, 22 bp, Artificial Sequence
  chemically synthesized
caaactgtcccacattttcctt

SEQ ID NO: 902547 - DNA, 22 bp, Artificial Sequence
  chemically synthesized
agaagaaaggaaaatgtgggac

SEQ ID NO: 902548 - DNA, 22 bp, Artificial Sequence
  chemically synthesized
ggaagttccaaactgtcccaca

SEQ ID NO: 902549 - DNA, 22 bp, Artificial Sequence
  chemically synthesized
gatgtaagaggttaggaagttc

SEQ ID NO: 902550 - DNA, 22 bp, Artificial Sequence
  chemically synthesized
ggaacttcctaacctcttacat

SEQ ID NO: 902551 - DNA, 22 bp, Artificial Sequence
  chemically synthesized
gaacttcctaacctcttacatc

SEQ ID NO: 902552 - DNA, 22 bp, Artificial Sequence
  chemically synthesized
cctaacctcttacatccagcct

SEQ ID NO: 902553 - DNA, 22 bp, Artificial Sequence
  chemically synthesized
ctaacctcttacatccagcctg

SEQ ID NO: 902554 - DNA, 22 bp, Artificial Sequence
  chemically synthesized
ggaatgtaaaaggccaggctgg

SEQ ID NO: 902555 - DNA, 22 bp, Artificial Sequence
  chemically synthesized
acctcttacatccagcctggcc

SEQ ID NO: 902556 - DNA, 22 bp, Artificial Sequence
  chemically synthesized
tgggaatgtaaaaggccaggct

SEQ ID NO: 902557 - DNA, 22 bp, Artificial Sequence
  chemically synthesized
ctctgggaatgtaaaaggccag

SEQ ID NO: 902558 - DNA, 22 bp, Artificial Sequence
  chemically synthesized
ttacatccagcctggcctttta

SEQ ID NO: 902559 - DNA, 22 bp, Artificial Sequence
  chemically synthesized
gctctgggaatgtaaaaggcca

SEQ ID NO: 902560 - DNA, 22 bp, Artificial Sequence
  chemically synthesized
acatccagcctggccttttaca

SEQ ID NO: 902561 - DNA, 22 bp, Artificial Sequence
  chemically synthesized
ttgctctgggaatgtaaaaggc

SEQ ID NO: 902562 - DNA, 22 bp, Artificial Sequence
  chemically synthesized
catccagcctggccttttacat

SEQ ID NO: 902563 - DNA, 22 bp, Artificial Sequence
  chemically synthesized
cttgctctgggaatgtaaaagg

SEQ ID NO: 902564 - DNA, 22 bp, Artificial Sequence
  chemically synthesized
aacagacttcttgctctgggaa

SEQ ID NO: 902565 - DNA, 22 bp, Artificial Sequence
  chemically synthesized
gaacagacttcttgctctggga

SEQ ID NO: 902566 - DNA, 22 bp, Artificial Sequence
  chemically synthesized
gccttttacattcccagagcaa

SEQ ID NO: 902567 - DNA, 22 bp, Artificial Sequence
  chemically synthesized
ttacattcccagagcaagaagt

SEQ ID NO: 902568 - DNA, 22 bp, Artificial Sequence
  chemically synthesized
tacattcccagagcaagaagtc

SEQ ID NO: 902569 - DNA, 22 bp, Artificial Sequence
  chemically synthesized
acattcccagagcaagaagtct

SEQ ID NO: 902570 - DNA, 22 bp, Artificial Sequence
  chemically synthesized
cattcccagagcaagaagtctg

SEQ ID NO: 902571 - DNA, 22 bp, Artificial Sequence
  chemically synthesized
ccagagcaagaagtctgttcaa

SEQ ID NO: 902572 - DNA, 22 bp, Artificial Sequence
  chemically synthesized
cggtggcccagataataaggac

SEQ ID NO: 902573 - DNA, 22 bp, Artificial Sequence
  chemically synthesized
ccggtggcccagataataagga

SEQ ID NO: 902574 - DNA, 22 bp, Artificial Sequence
  chemically synthesized
tccggtggcccagataataagg

SEQ ID NO: 902575 - DNA, 22 bp, Artificial Sequence
  chemically synthesized
ttccggtggcccagataataag

SEQ ID NO: 902576 - DNA, 22 bp, Artificial Sequence
  chemically synthesized
tttccggtggcccagataataa

SEQ ID NO: 902577 - DNA, 22 bp, Artificial Sequence
  chemically synthesized
ttcaagtccttattatctgggc

SEQ ID NO: 902578 - DNA, 22 bp, Artificial Sequence
  chemically synthesized
aagtccttattatctgggccac

SEQ ID NO: 902579 - DNA, 22 bp, Artificial Sequence
  chemically synthesized
agatatatattttttccggtgg

SEQ ID NO: 902580 - DNA, 22 bp, Artificial Sequence
  chemically synthesized
gagatatatattttttccggtg

SEQ ID NO: 902581 - DNA, 22 bp, Artificial Sequence
  chemically synthesized
attatctgggccaccggaaaaa

SEQ ID NO: 902582 - DNA, 22 bp, Artificial Sequence
  chemically synthesized
ttatctgggccaccggaaaaaa

SEQ ID NO: 902583 - DNA, 22 bp, Artificial Sequence
  chemically synthesized
gtttgagatatatattttttcc

SEQ ID NO: 902584 - DNA, 22 bp, Artificial Sequence
  chemically synthesized
tctgggccaccggaaaaaatat

SEQ ID NO: 902585 - DNA, 22 bp, Artificial Sequence
  chemically synthesized
ggccaccggaaaaaatatatat

SEQ ID NO: 902586 - DNA, 22 bp, Artificial Sequence
  chemically synthesized
caaactggtttgagatatatat

SEQ ID NO: 902587 - DNA, 22 bp, Artificial Sequence
  chemically synthesized
gaggtctacaaactggtttgag

SEQ ID NO: 902588 - DNA, 22 bp, Artificial Sequence
  chemically synthesized
aaaccagtttgtagacctccag

SEQ ID NO: 902589 - DNA, 22 bp, Artificial Sequence
  chemically synthesized
cagcaggtagagactggaggtc

SEQ ID NO: 902590 - DNA, 22 bp, Artificial Sequence
  chemically synthesized
aattacagcaggtagagactgg

SEQ ID NO: 902591 - DNA, 22 bp, Artificial Sequence
  chemically synthesized
gtagacctccagtctctacctg

SEQ ID NO: 902592 - DNA, 22 bp, Artificial Sequence
  chemically synthesized
tagacctccagtctctacctgc

SEQ ID NO: 902593 - DNA, 22 bp, Artificial Sequence
  chemically synthesized
cagtctctacctgctgtaattc

SEQ ID NO: 902594 - DNA, 22 bp, Artificial Sequence
  chemically synthesized
atggcaatgcaggggttgaatt

SEQ ID NO: 902595 - DNA, 22 bp, Artificial Sequence
  chemically synthesized
tacctgctgtaattcaacccct

SEQ ID NO: 902596 - DNA, 22 bp, Artificial Sequence
  chemically synthesized
cctgctgtaattcaacccctgc

SEQ ID NO: 902597 - DNA, 22 bp, Artificial Sequence
  chemically synthesized
agtctgatggcaatgcaggggt

SEQ ID NO: 902598 - DNA, 22 bp, Artificial Sequence
  chemically synthesized
ctgtaattcaacccctgcattg

SEQ ID NO: 902599 - DNA, 22 bp, Artificial Sequence
  chemically synthesized
taattcaacccctgcattgcca

SEQ ID NO: 902600 - DNA, 22 bp, Artificial Sequence
  chemically synthesized
gaagactcagtctgatggcaat

SEQ ID NO: 902601 - DNA, 22 bp, Artificial Sequence
  chemically synthesized
agaagactcagtctgatggcaa

SEQ ID NO: 902602 - DNA, 22 bp, Artificial Sequence
  chemically synthesized
tagaagactcagtctgatggca

SEQ ID NO: 902603 - DNA, 22 bp, Artificial Sequence
  chemically synthesized
aacccctgcattgccatcagac

SEQ ID NO: 902604 - DNA, 22 bp, Artificial Sequence
  chemically synthesized
ttttagaagactcagtctgatg

SEQ ID NO: 902605 - DNA, 22 bp, Artificial Sequence
  chemically synthesized
attttagaagactcagtctgat

SEQ ID NO: 902606 - DNA, 22 bp, Artificial Sequence
  chemically synthesized
tattttagaagactcagtctga

SEQ ID NO: 902607 - DNA, 22 bp, Artificial Sequence
  chemically synthesized
cattgccatcagactgagtctt

SEQ ID NO: 902608 - DNA, 22 bp, Artificial Sequence
  chemically synthesized
agttttattttagaagactcag

SEQ ID NO: 902609 - DNA, 22 bp, Artificial Sequence
  chemically synthesized
ccatcagactgagtcttctaaa

SEQ ID NO: 902610 - DNA, 22 bp, Artificial Sequence
  chemically synthesized
agaattaagttttattttagaa

SEQ ID NO: 902611 - DNA, 22 bp, Artificial Sequence
  chemically synthesized
aagaattaagttttattttaga

SEQ ID NO: 902612 - DNA, 22 bp, Artificial Sequence
  chemically synthesized
taagaattaagttttattttag

SEQ ID NO: 902613 - DNA, 22 bp, Artificial Sequence
  chemically synthesized
ttaagaattaagttttatttta

SEQ ID NO: 902614 - DNA, 22 bp, Artificial Sequence
  chemically synthesized
atttttaagaattaagttttat

SEQ ID NO: 902615 - DNA, 22 bp, Artificial Sequence
  chemically synthesized
agtcttctaaaataaaacttaa

SEQ ID NO: 902616 - DNA, 22 bp, Artificial Sequence
  chemically synthesized
ctaaaataaaacttaattctta

SEQ ID NO: 902617 - DNA, 22 bp, Artificial Sequence
  chemically synthesized
taaaataaaacttaattcttaa

SEQ ID NO: 902618 - DNA, 22 bp, Artificial Sequence
  chemically synthesized
aaataaaacttaattcttaaaa

SEQ ID NO: 902619 - DNA, 22 bp, Artificial Sequence
  chemically synthesized
acaggggagggactcattttta

SEQ ID NO: 902620 - DNA, 22 bp, Artificial Sequence
  chemically synthesized
aattcttaaaaatgagtccctc

SEQ ID NO: 902621 - DNA, 22 bp, Artificial Sequence
  chemically synthesized
attcttaaaaatgagtccctcc

SEQ ID NO: 902622 - DNA, 22 bp, Artificial Sequence
  chemically synthesized
ttaaaaatgagtccctcccctg

SEQ ID NO: 902623 - DNA, 22 bp, Artificial Sequence
  chemically synthesized
ataatccactcacaggggaggg

SEQ ID NO: 902624 - DNA, 22 bp, Artificial Sequence
  chemically synthesized
aaaaatgagtccctcccctgtg

SEQ ID NO: 902625 - DNA, 22 bp, Artificial Sequence
  chemically synthesized
aaaatgagtccctcccctgtga

SEQ ID NO: 902626 - DNA, 22 bp, Artificial Sequence
  chemically synthesized
ccctgtgagtggattatcagta

SEQ ID NO: 902627 - DNA, 22 bp, Artificial Sequence
  chemically synthesized
tgagtggattatcagtatttgt

SEQ ID NO: 902628 - DNA, 22 bp, Artificial Sequence
  chemically synthesized
cccatatgcacatacaacaaat

SEQ ID NO: 902629 - DNA, 22 bp, Artificial Sequence
  chemically synthesized
ccccatatgcacatacaacaaa

SEQ ID NO: 902630 - DNA, 22 bp, Artificial Sequence
  chemically synthesized
tccccatatgcacatacaacaa

SEQ ID NO: 902631 - DNA, 22 bp, Artificial Sequence
  chemically synthesized
tcagtatttgttgtatgtgcat

SEQ ID NO: 902632 - DNA, 22 bp, Artificial Sequence
  chemically synthesized
gttgtatgtgcatatggggaaa

SEQ ID NO: 902633 - DNA, 22 bp, Artificial Sequence
  chemically synthesized
ttgtatgtgcatatggggaaag

SEQ ID NO: 902634 - DNA, 22 bp, Artificial Sequence
  chemically synthesized
tatgtgcatatggggaaaggtt

SEQ ID NO: 902635 - DNA, 22 bp, Artificial Sequence
  chemically synthesized
gaggagcatgggtagcgtaacc

SEQ ID NO: 902636 - DNA, 22 bp, Artificial Sequence
  chemically synthesized
cgctacccatgctcctctagac

SEQ ID NO: 902637 - DNA, 22 bp, Artificial Sequence
  chemically synthesized
cccatgctcctctagacattct

SEQ ID NO: 902638 - DNA, 22 bp, Artificial Sequence
  chemically synthesized
catgggagaatataccagaatg

SEQ ID NO: 902639 - DNA, 22 bp, Artificial Sequence
  chemically synthesized
ctctagacattctggtatattc

SEQ ID NO: 902640 - DNA, 22 bp, Artificial Sequence
  chemically synthesized
tagacattctggtatattctcc

SEQ ID NO: 902641 - DNA, 22 bp, Artificial Sequence
  chemically synthesized
tatgtctacatgggagaatata

SEQ ID NO: 902642 - DNA, 22 bp, Artificial Sequence
  chemically synthesized
gtatgtctacatgggagaatat

SEQ ID NO: 902643 - DNA, 22 bp, Artificial Sequence
  chemically synthesized
gacattctggtatattctccca

SEQ ID NO: 902644 - DNA, 22 bp, Artificial Sequence
  chemically synthesized
ccttgtatgtctacatgggaga

SEQ ID NO: 902645 - DNA, 22 bp, Artificial Sequence
  chemically synthesized
tgccttgtatgtctacatggga

SEQ ID NO: 902646 - DNA, 22 bp, Artificial Sequence
  chemically synthesized
tggtatattctcccatgtagac

SEQ ID NO: 902647 - DNA, 22 bp, Artificial Sequence
  chemically synthesized
gtatattctcccatgtagacat

SEQ ID NO: 902648 - DNA, 22 bp, Artificial Sequence
  chemically synthesized
gctctgccttgtatgtctacat

SEQ ID NO: 902649 - DNA, 22 bp, Artificial Sequence
  chemically synthesized
ggctctgccttgtatgtctaca

SEQ ID NO: 902650 - DNA, 22 bp, Artificial Sequence
  chemically synthesized
tcccatgtagacatacaaggca

SEQ ID NO: 902651 - DNA, 22 bp, Artificial Sequence
  chemically synthesized
ccatgtagacatacaaggcaga

SEQ ID NO: 902652 - DNA, 22 bp, Artificial Sequence
  chemically synthesized
ataaaggaaggccttggctctg

SEQ ID NO: 902653 - DNA, 22 bp, Artificial Sequence
  chemically synthesized
ccccagtaaatggttcataaag

SEQ ID NO: 902654 - DNA, 22 bp, Artificial Sequence
  chemically synthesized
cccccagtaaatggttcataaa

SEQ ID NO: 902655 - DNA, 22 bp, Artificial Sequence
  chemically synthesized
tcccccagtaaatggttcataa

SEQ ID NO: 902656 - DNA, 22 bp, Artificial Sequence
  chemically synthesized
ttttcccccagtaaatggttca

SEQ ID NO: 902657 - DNA, 22 bp, Artificial Sequence
  chemically synthesized
cctttatgaaccatttactggg

SEQ ID NO: 902658 - DNA, 22 bp, Artificial Sequence
  chemically synthesized
ctttatgaaccatttactgggg

SEQ ID NO: 902659 - DNA, 22 bp, Artificial Sequence
  chemically synthesized
tatgaaccatttactgggggaa

SEQ ID NO: 902660 - DNA, 22 bp, Artificial Sequence
  chemically synthesized
atgaaccatttactgggggaaa

SEQ ID NO: 902661 - DNA, 22 bp, Artificial Sequence
  chemically synthesized
tgaaccatttactgggggaaaa

SEQ ID NO: 902662 - DNA, 22 bp, Artificial Sequence
  chemically synthesized
actgggggaaaataatgtatcg

SEQ ID NO: 902663 - DNA, 22 bp, Artificial Sequence
  chemically synthesized
ctgggggaaaataatgtatcgg

SEQ ID NO: 902664 - DNA, 22 bp, Artificial Sequence
  chemically synthesized
ggggaaaataatgtatcggatc

SEQ ID NO: 902665 - DNA, 22 bp, Artificial Sequence
  chemically synthesized
gtccatatcagggagtaaagtg

SEQ ID NO: 902666 - DNA, 22 bp, Artificial Sequence
  chemically synthesized
gcattagtccatatcagggagt

SEQ ID NO: 902667 - DNA, 22 bp, Artificial Sequence
  chemically synthesized
tagcattagtccatatcaggga

SEQ ID NO: 902668 - DNA, 22 bp, Artificial Sequence
  chemically synthesized
ctagcattagtccatatcaggg

SEQ ID NO: 902669 - DNA, 22 bp, Artificial Sequence
  chemically synthesized
cttctagcattagtccatatca

SEQ ID NO: 902670 - DNA, 22 bp, Artificial Sequence
  chemically synthesized
tactccctgatatggactaatg

SEQ ID NO: 902671 - DNA, 22 bp, Artificial Sequence
  chemically synthesized
aactgcttctagcattagtcca

SEQ ID NO: 902672 - DNA, 22 bp, Artificial Sequence
  chemically synthesized
actccctgatatggactaatgc

SEQ ID NO: 902673 - DNA, 22 bp, Artificial Sequence
  chemically synthesized
ctccctgatatggactaatgct

SEQ ID NO: 902674 - DNA, 22 bp, Artificial Sequence
  chemically synthesized
cctgatatggactaatgctaga

SEQ ID NO: 902675 - DNA, 22 bp, Artificial Sequence
  chemically synthesized
atatggactaatgctagaagca

SEQ ID NO: 902676 - DNA, 22 bp, Artificial Sequence
  chemically synthesized
aagacagtagattcaactgctt

SEQ ID NO: 902677 - DNA, 22 bp, Artificial Sequence
  chemically synthesized
atgctagaagcagttgaatcta

SEQ ID NO: 902678 - DNA, 22 bp, Artificial Sequence
  chemically synthesized
tcccattaaagacagtagattc

SEQ ID NO: 902679 - DNA, 22 bp, Artificial Sequence
  chemically synthesized
tgtcccattaaagacagtagat

SEQ ID NO: 902680 - DNA, 22 bp, Artificial Sequence
  chemically synthesized
gaagcagttgaatctactgtct

SEQ ID NO: 902681 - DNA, 22 bp, Artificial Sequence
  chemically synthesized
agcacaactctgtcccattaaa

SEQ ID NO: 902682 - DNA, 22 bp, Artificial Sequence
  chemically synthesized
aatctactgtctttaatgggac

SEQ ID NO: 902683 - DNA, 22 bp, Artificial Sequence
  chemically synthesized
gagcacaactctgtcccattaa

SEQ ID NO: 902684 - DNA, 22 bp, Artificial Sequence
  chemically synthesized
ctgtctttaatgggacagagtt

SEQ ID NO: 902685 - DNA, 22 bp, Artificial Sequence
  chemically synthesized
tctttaatgggacagagttgtg

SEQ ID NO: 902686 - DNA, 22 bp, Artificial Sequence
  chemically synthesized
atgatccttgagcacaactctg

SEQ ID NO: 902687 - DNA, 22 bp, Artificial Sequence
  chemically synthesized
taatgggacagagttgtgctca

SEQ ID NO: 902688 - DNA, 22 bp, Artificial Sequence
  chemically synthesized
aatgggacagagttgtgctcaa

SEQ ID NO: 902689 - DNA, 22 bp, Artificial Sequence
  chemically synthesized
atgggacagagttgtgctcaag

SEQ ID NO: 902690 - DNA, 22 bp, Artificial Sequence
  chemically synthesized
tggttaatgatccttgagcaca

SEQ ID NO: 902691 - DNA, 22 bp, Artificial Sequence
  chemically synthesized
tgctcaaggatcattaaccaca

SEQ ID NO: 902692 - DNA, 22 bp, Artificial Sequence
  chemically synthesized
agtaagggcggtggttgtggtt

SEQ ID NO: 902693 - DNA, 22 bp, Artificial Sequence
  chemically synthesized
aaggatcattaaccacaaccac

SEQ ID NO: 902694 - DNA, 22 bp, Artificial Sequence
  chemically synthesized
tgagtaagggcggtggttgtgg

SEQ ID NO: 902695 - DNA, 22 bp, Artificial Sequence
  chemically synthesized
tctctgagtaagggcggtggtt

SEQ ID NO: 902696 - DNA, 22 bp, Artificial Sequence
  chemically synthesized
atctctgagtaagggcggtggt

SEQ ID NO: 902697 - DNA, 22 bp, Artificial Sequence
  chemically synthesized
tatctctgagtaagggcggtgg

SEQ ID NO: 902698 - DNA, 22 bp, Artificial Sequence
  chemically synthesized
accacaaccaccgcccttactc

SEQ ID NO: 902699 - DNA, 22 bp, Artificial Sequence
  chemically synthesized
aatctttatctctgagtaaggg

SEQ ID NO: 902700 - DNA, 22 bp, Artificial Sequence
  chemically synthesized
aaatctttatctctgagtaagg

SEQ ID NO: 902701 - DNA, 22 bp, Artificial Sequence
  chemically synthesized
agagatcttaaatctttatctc

SEQ ID NO: 902702 - DNA, 22 bp, Artificial Sequence
  chemically synthesized
actcagagataaagatttaaga

SEQ ID NO: 902703 - DNA, 22 bp, Artificial Sequence
  chemically synthesized
ctcagagataaagatttaagat

SEQ ID NO: 902704 - DNA, 22 bp, Artificial Sequence
  chemically synthesized
agagataaagatttaagatctc

SEQ ID NO: 902705 - DNA, 22 bp, Artificial Sequence
  chemically synthesized
gccaccatgctaagagatctta

SEQ ID NO: 902706 - DNA, 22 bp, Artificial Sequence
  chemically synthesized
agccaccatgctaagagatctt

SEQ ID NO: 902707 - DNA, 22 bp, Artificial Sequence
  chemically synthesized
tagccaccatgctaagagatct

SEQ ID NO: 902708 - DNA, 22 bp, Artificial Sequence
  chemically synthesized
aaaacctttagccaccatgcta

SEQ ID NO: 902709 - DNA, 22 bp, Artificial Sequence
  chemically synthesized
gaaaacctttagccaccatgct

SEQ ID NO: 902710 - DNA, 22 bp, Artificial Sequence
  chemically synthesized
aagatctcttagcatggtggct

SEQ ID NO: 902711 - DNA, 22 bp, Artificial Sequence
  chemically synthesized
agatctcttagcatggtggcta

SEQ ID NO: 902712 - DNA, 22 bp, Artificial Sequence
  chemically synthesized
ttagcatggtggctaaaggttt

SEQ ID NO: 902713 - DNA, 22 bp, Artificial Sequence
  chemically synthesized
ggcaagagtttgaaaaccttta

SEQ ID NO: 902714 - DNA, 22 bp, Artificial Sequence
  chemically synthesized
agcatggtggctaaaggttttc

SEQ ID NO: 902715 - DNA, 22 bp, Artificial Sequence
  chemically synthesized
gggcaagagtttgaaaaccttt

SEQ ID NO: 902716 - DNA, 22 bp, Artificial Sequence
  chemically synthesized
gcatggtggctaaaggttttca

SEQ ID NO: 902717 - DNA, 22 bp, Artificial Sequence
  chemically synthesized
aaggttttcaaactcttgccca

SEQ ID NO: 902718 - DNA, 22 bp, Artificial Sequence
  chemically synthesized
aaaaggtatgtttgggcaagag

SEQ ID NO: 902719 - DNA, 22 bp, Artificial Sequence
  chemically synthesized
acattgaaaaggtatgtttggg

SEQ ID NO: 902720 - DNA, 22 bp, Artificial Sequence
  chemically synthesized
tcaaactcttgcccaaacatac

SEQ ID NO: 902721 - DNA, 22 bp, Artificial Sequence
  chemically synthesized
gacattgaaaaggtatgtttgg

SEQ ID NO: 902722 - DNA, 22 bp, Artificial Sequence
  chemically synthesized
caaactcttgcccaaacatacc

SEQ ID NO: 902723 - DNA, 22 bp, Artificial Sequence
  chemically synthesized
aaactcttgcccaaacatacct

SEQ ID NO: 902724 - DNA, 22 bp, Artificial Sequence
  chemically synthesized
tgtttgacattgaaaaggtatg

SEQ ID NO: 902725 - DNA, 22 bp, Artificial Sequence
  chemically synthesized
ttgcccaaacataccttttcaa

SEQ ID NO: 902726 - DNA, 22 bp, Artificial Sequence
  chemically synthesized
gcccaaacataccttttcaatg

SEQ ID NO: 902727 - DNA, 22 bp, Artificial Sequence
  chemically synthesized
cccaaacataccttttcaatgt

SEQ ID NO: 902728 - DNA, 22 bp, Artificial Sequence
  chemically synthesized
aatagagcaaggtgattgtgtt

SEQ ID NO: 902729 - DNA, 22 bp, Artificial Sequence
  chemically synthesized
ttcaatgtcaaacacaatcacc

SEQ ID NO: 902730 - DNA, 22 bp, Artificial Sequence
  chemically synthesized
tcaatgtcaaacacaatcacct

SEQ ID NO: 902731 - DNA, 22 bp, Artificial Sequence
  chemically synthesized
ctgaatagagcaaggtgattgt

SEQ ID NO: 902732 - DNA, 22 bp, Artificial Sequence
  chemically synthesized
caatgtcaaacacaatcacctt

SEQ ID NO: 902733 - DNA, 22 bp, Artificial Sequence
  chemically synthesized
aatgtcaaacacaatcaccttg

SEQ ID NO: 902734 - DNA, 22 bp, Artificial Sequence
  chemically synthesized
ctcctgaatagagcaaggtgat

SEQ ID NO: 902735 - DNA, 22 bp, Artificial Sequence
  chemically synthesized
tggtaggattcctcctgaatag

SEQ ID NO: 902736 - DNA, 22 bp, Artificial Sequence
  chemically synthesized
gctctattcaggaggaatccta

SEQ ID NO: 902737 - DNA, 22 bp, Artificial Sequence
  chemically synthesized
ctctattcaggaggaatcctac

SEQ ID NO: 902738 - DNA, 22 bp, Artificial Sequence
  chemically synthesized
tattcaggaggaatcctaccat

SEQ ID NO: 902739 - DNA, 22 bp, Artificial Sequence
  chemically synthesized
taaacaaaatattatggtagga

SEQ ID NO: 902740 - DNA, 22 bp, Artificial Sequence
  chemically synthesized
ttcaggaggaatcctaccataa

SEQ ID NO: 902741 - DNA, 22 bp, Artificial Sequence
  chemically synthesized
aggaggaatcctaccataatat

SEQ ID NO: 902742 - DNA, 22 bp, Artificial Sequence
  chemically synthesized
taggtggagagactgtaaacaa

SEQ ID NO: 902743 - DNA, 22 bp, Artificial Sequence
  chemically synthesized
ccataatattttgtttacagtc

SEQ ID NO: 902744 - DNA, 22 bp, Artificial Sequence
  chemically synthesized
ttataggtggagagactgtaaa

SEQ ID NO: 902745 - DNA, 22 bp, Artificial Sequence
  chemically synthesized
tgtttacagtctctccacctat

SEQ ID NO: 902746 - DNA, 22 bp, Artificial Sequence
  chemically synthesized
gtttacagtctctccacctata

SEQ ID NO: 902747 - DNA, 22 bp, Artificial Sequence
  chemically synthesized
tttacagtctctccacctataa

SEQ ID NO: 902748 - DNA, 22 bp, Artificial Sequence
  chemically synthesized
acagtctctccacctataataa

SEQ ID NO: 902749 - DNA, 22 bp, Artificial Sequence
  chemically synthesized
cagtctctccacctataataat

SEQ ID NO: 902750 - DNA, 22 bp, Artificial Sequence
  chemically synthesized
aagagaagaggaaagattatta

SEQ ID NO: 902751 - DNA, 22 bp, Artificial Sequence
  chemically synthesized
tccacctataataatctttcct

SEQ ID NO: 902752 - DNA, 22 bp, Artificial Sequence
  chemically synthesized
cacctataataatctttcctct

SEQ ID NO: 902753 - DNA, 22 bp, Artificial Sequence
  chemically synthesized
cagtactcaagagaagaggaaa

SEQ ID NO: 902754 - DNA, 22 bp, Artificial Sequence
  chemically synthesized
gcagtactcaagagaagaggaa

SEQ ID NO: 902755 - DNA, 22 bp, Artificial Sequence
  chemically synthesized
taataatctttcctcttctctt

SEQ ID NO: 902756 - DNA, 22 bp, Artificial Sequence
  chemically synthesized
aagtagaatttgcagtactcaa

SEQ ID NO: 902757 - DNA, 22 bp, Artificial Sequence
  chemically synthesized
tcctcttctcttgagtactgca

SEQ ID NO: 902758 - DNA, 22 bp, Artificial Sequence
  chemically synthesized
tgaagtagaatttgcagtactc

SEQ ID NO: 902759 - DNA, 22 bp, Artificial Sequence
  chemically synthesized
cctcttctcttgagtactgcaa

SEQ ID NO: 902760 - DNA, 22 bp, Artificial Sequence
  chemically synthesized
ctcttctcttgagtactgcaaa

SEQ ID NO: 902761 - DNA, 22 bp, Artificial Sequence
  chemically synthesized
ttctgaagtagaatttgcagta

SEQ ID NO: 902762 - DNA, 22 bp, Artificial Sequence
  chemically synthesized
ttctcttgagtactgcaaattc

SEQ ID NO: 902763 - DNA, 22 bp, Artificial Sequence
  chemically synthesized
tattctgaagtagaatttgcag

SEQ ID NO: 902764 - DNA, 22 bp, Artificial Sequence
  chemically synthesized
ctcttgagtactgcaaattcta

SEQ ID NO: 902765 - DNA, 22 bp, Artificial Sequence
  chemically synthesized
tcttgagtactgcaaattctac

SEQ ID NO: 902766 - DNA, 22 bp, Artificial Sequence
  chemically synthesized
ttctattctgaagtagaatttg

SEQ ID NO: 902767 - DNA, 22 bp, Artificial Sequence
  chemically synthesized
ttgagtactgcaaattctactt

SEQ ID NO: 902768 - DNA, 22 bp, Artificial Sequence
  chemically synthesized
gagtactgcaaattctacttca

SEQ ID NO: 902769 - DNA, 22 bp, Artificial Sequence
  chemically synthesized
agtactgcaaattctacttcag

SEQ ID NO: 902770 - DNA, 22 bp, Artificial Sequence
  chemically synthesized
caaattctacttcagaatagaa

SEQ ID NO: 902771 - DNA, 22 bp, Artificial Sequence
  chemically synthesized
atgtagacattgttctattctg

SEQ ID NO: 902772 - DNA, 22 bp, Artificial Sequence
  chemically synthesized
tacttcagaatagaacaatgtc

SEQ ID NO: 902773 - DNA, 22 bp, Artificial Sequence
  chemically synthesized
cttcagaatagaacaatgtcta

SEQ ID NO: 902774 - DNA, 22 bp, Artificial Sequence
  chemically synthesized
cagaatagaacaatgtctacat

SEQ ID NO: 902775 - DNA, 22 bp, Artificial Sequence
  chemically synthesized
agaatagaacaatgtctacatg

SEQ ID NO: 902776 - DNA, 22 bp, Artificial Sequence
  chemically synthesized
gaccacaaaagaaggccctcat

SEQ ID NO: 902777 - DNA, 22 bp, Artificial Sequence
  chemically synthesized
ggaccacaaaagaaggccctca

SEQ ID NO: 902778 - DNA, 22 bp, Artificial Sequence
  chemically synthesized
catgagggccttcttttgtggt

SEQ ID NO: 902779 - DNA, 22 bp, Artificial Sequence
  chemically synthesized
tagcagaagcaaaatggccttg

SEQ ID NO: 902780 - DNA, 22 bp, Artificial Sequence
  chemically synthesized
cttttgtggtccaaggccattt

SEQ ID NO: 902781 - DNA, 22 bp, Artificial Sequence
  chemically synthesized
ttttgtggtccaaggccatttt

SEQ ID NO: 902782 - DNA, 22 bp, Artificial Sequence
  chemically synthesized
ttgtggtccaaggccattttgc

SEQ ID NO: 902783 - DNA, 22 bp, Artificial Sequence
  chemically synthesized
tgtggtccaaggccattttgct

SEQ ID NO: 902784 - DNA, 22 bp, Artificial Sequence
  chemically synthesized
gtggtccaaggccattttgctt

SEQ ID NO: 902785 - DNA, 22 bp, Artificial Sequence
  chemically synthesized
tggtccaaggccattttgcttc

SEQ ID NO: 902786 - DNA, 22 bp, Artificial Sequence
  chemically synthesized
aaataaactatagcagaagcaa

SEQ ID NO: 902787 - DNA, 22 bp, Artificial Sequence
  chemically synthesized
tcaaataaactatagcagaagc

SEQ ID NO: 902788 - DNA, 22 bp, Artificial Sequence
  chemically synthesized
ctcaaataaactatagcagaag

SEQ ID NO: 902789 - DNA, 22 bp, Artificial Sequence
  chemically synthesized
tctcaaataaactatagcagaa

SEQ ID NO: 902790 - DNA, 22 bp, Artificial Sequence
  chemically synthesized
ttttctcaaataaactatagca

SEQ ID NO: 902791 - DNA, 22 bp, Artificial Sequence
  chemically synthesized
tgcttctgctatagtttatttg

SEQ ID NO: 902792 - DNA, 22 bp, Artificial Sequence
  chemically synthesized
gcttctgctatagtttatttga

SEQ ID NO: 902793 - DNA, 22 bp, Artificial Sequence
  chemically synthesized
cttctgctatagtttatttgag

SEQ ID NO: 902794 - DNA, 22 bp, Artificial Sequence
  chemically synthesized
ctgctatagtttatttgagaaa

SEQ ID NO: 902795 - DNA, 22 bp, Artificial Sequence
  chemically synthesized
tgctatagtttatttgagaaaa

SEQ ID NO: 902796 - DNA, 22 bp, Artificial Sequence
  chemically synthesized
ctatagtttatttgagaaaata

SEQ ID NO: 902797 - DNA, 22 bp, Artificial Sequence
  chemically synthesized
tagtttatttgagaaaataatt

SEQ ID NO: 902798 - DNA, 22 bp, Artificial Sequence
  chemically synthesized
cccaaggacagacaattatttt

SEQ ID NO: 902799 - DNA, 22 bp, Artificial Sequence
  chemically synthesized
atttgagaaaataattgtctgt

SEQ ID NO: 902800 - DNA, 22 bp, Artificial Sequence
  chemically synthesized
tttgagaaaataattgtctgtc

SEQ ID NO: 902801 - DNA, 22 bp, Artificial Sequence
  chemically synthesized
gagaaaataattgtctgtcctt

SEQ ID NO: 902802 - DNA, 22 bp, Artificial Sequence
  chemically synthesized
agaaaataattgtctgtccttg

SEQ ID NO: 902803 - DNA, 22 bp, Artificial Sequence
  chemically synthesized
tctgtccttgggcaactcctgt

SEQ ID NO: 902804 - DNA, 22 bp, Artificial Sequence
  chemically synthesized
tccttgggcaactcctgtacta

SEQ ID NO: 902805 - DNA, 22 bp, Artificial Sequence
  chemically synthesized
caacaaaggacggtagtacagg

SEQ ID NO: 902806 - DNA, 22 bp, Artificial Sequence
  chemically synthesized
gggcaactcctgtactaccgtc

SEQ ID NO: 902807 - DNA, 22 bp, Artificial Sequence
  chemically synthesized
ggcaactcctgtactaccgtcc

SEQ ID NO: 902808 - DNA, 22 bp, Artificial Sequence
  chemically synthesized
agattgcaacaaaggacggtag

SEQ ID NO: 902809 - DNA, 22 bp, Artificial Sequence
  chemically synthesized
ctgtactaccgtcctttgttgc

SEQ ID NO: 902810 - DNA, 22 bp, Artificial Sequence
  chemically synthesized
tactaccgtcctttgttgcaat

SEQ ID NO: 902811 - DNA, 22 bp, Artificial Sequence
  chemically synthesized
tgtggaaagttgagattgcaac

SEQ ID NO: 902812 - DNA, 22 bp, Artificial Sequence
  chemically synthesized
ccgtcctttgttgcaatctcaa

SEQ ID NO: 902813 - DNA, 22 bp, Artificial Sequence
  chemically synthesized
tgttgcaatctcaactttccac

SEQ ID NO: 902814 - DNA, 22 bp, Artificial Sequence
  chemically synthesized
gaaagtaattatgtggaaagtt

SEQ ID NO: 902815 - DNA, 22 bp, Artificial Sequence
  chemically synthesized
gttgcaatctcaactttccaca

SEQ ID NO: 902816 - DNA, 22 bp, Artificial Sequence
  chemically synthesized
ggaaagtaattatgtggaaagt

SEQ ID NO: 902817 - DNA, 22 bp, Artificial Sequence
  chemically synthesized
ttgcaatctcaactttccacat

SEQ ID NO: 902818 - DNA, 22 bp, Artificial Sequence
  chemically synthesized
caatctcaactttccacataat

SEQ ID NO: 902819 - DNA, 22 bp, Artificial Sequence
  chemically synthesized
aactttccacataattactttc

SEQ ID NO: 902820 - DNA, 22 bp, Artificial Sequence
  chemically synthesized
gtagtatagcttggaaagtaat

SEQ ID NO: 902821 - DNA, 22 bp, Artificial Sequence
  chemically synthesized
tccacataattactttccaagc

SEQ ID NO: 902822 - DNA, 22 bp, Artificial Sequence
  chemically synthesized
cctcgtagtatagcttggaaag

SEQ ID NO: 902823 - DNA, 22 bp, Artificial Sequence
  chemically synthesized
ccacataattactttccaagct

SEQ ID NO: 902824 - DNA, 22 bp, Artificial Sequence
  chemically synthesized
gcctcgtagtatagcttggaaa

SEQ ID NO: 902825 - DNA, 22 bp, Artificial Sequence
  chemically synthesized
cacataattactttccaagcta

SEQ ID NO: 902826 - DNA, 22 bp, Artificial Sequence
  chemically synthesized
tgcctcgtagtatagcttggaa

SEQ ID NO: 902827 - DNA, 22 bp, Artificial Sequence
  chemically synthesized
cctttgcctcgtagtatagctt

SEQ ID NO: 902828 - DNA, 22 bp, Artificial Sequence
  chemically synthesized
ctttccaagctatactacgagg

SEQ ID NO: 902829 - DNA, 22 bp, Artificial Sequence
  chemically synthesized
tccaagctatactacgaggcaa

SEQ ID NO: 902830 - DNA, 22 bp, Artificial Sequence
  chemically synthesized
ataatcctccctttgcctcgta

SEQ ID NO: 902831 - DNA, 22 bp, Artificial Sequence
  chemically synthesized
ccaagctatactacgaggcaaa

SEQ ID NO: 902832 - DNA, 22 bp, Artificial Sequence
  chemically synthesized
cataatcctccctttgcctcgt

SEQ ID NO: 902833 - DNA, 22 bp, Artificial Sequence
  chemically synthesized
caagctatactacgaggcaaag

SEQ ID NO: 902834 - DNA, 22 bp, Artificial Sequence
  chemically synthesized
aacccttcataatcctcccttt

SEQ ID NO: 902835 - DNA, 22 bp, Artificial Sequence
  chemically synthesized
tactacgaggcaaagggaggat

SEQ ID NO: 902836 - DNA, 22 bp, Artificial Sequence
  chemically synthesized
cgaggcaaagggaggattatga

SEQ ID NO: 902837 - DNA, 22 bp, Artificial Sequence
  chemically synthesized
tgaagggtttagggttactctc

SEQ ID NO: 902838 - DNA, 22 bp, Artificial Sequence
  chemically synthesized
cagtgaagcggaagagagagta

SEQ ID NO: 902839 - DNA, 22 bp, Artificial Sequence
  chemically synthesized
agggttactctctcttccgctt

SEQ ID NO: 902840 - DNA, 22 bp, Artificial Sequence
  chemically synthesized
gggttactctctcttccgcttc

SEQ ID NO: 902841 - DNA, 22 bp, Artificial Sequence
  chemically synthesized
ctctctcttccgcttcactgta

SEQ ID NO: 902842 - DNA, 22 bp, Artificial Sequence
  chemically synthesized
tctcttccgcttcactgtaatt

SEQ ID NO: 902843 - DNA, 22 bp, Artificial Sequence
  chemically synthesized
aataaagaatagaaattacagt

SEQ ID NO: 902844 - DNA, 22 bp, Artificial Sequence
  chemically synthesized
tcttccgcttcactgtaatttc

SEQ ID NO: 902845 - DNA, 22 bp, Artificial Sequence
  chemically synthesized
taaataaagaatagaaattaca

SEQ ID NO: 902846 - DNA, 22 bp, Artificial Sequence
  chemically synthesized
ttccgcttcactgtaatttcta

SEQ ID NO: 902847 - DNA, 22 bp, Artificial Sequence
  chemically synthesized
ctaaataaagaatagaaattac

SEQ ID NO: 902848 - DNA, 22 bp, Artificial Sequence
  chemically synthesized
ccgcttcactgtaatttctatt

SEQ ID NO: 902849 - DNA, 22 bp, Artificial Sequence
  chemically synthesized
cgcttcactgtaatttctattc

SEQ ID NO: 902850 - DNA, 22 bp, Artificial Sequence
  chemically synthesized
cactgtaatttctattctttat

SEQ ID NO: 902851 - DNA, 22 bp, Artificial Sequence
  chemically synthesized
actgtaatttctattctttatt

SEQ ID NO: 902852 - DNA, 22 bp, Artificial Sequence
  chemically synthesized
taatttctattctttatttaga

SEQ ID NO: 902853 - DNA, 22 bp, Artificial Sequence
  chemically synthesized
ctattctttatttagaaacatt

SEQ ID NO: 902854 - DNA, 22 bp, Artificial Sequence
  chemically synthesized
tattctttatttagaaacattc

SEQ ID NO: 902855 - DNA, 22 bp, Artificial Sequence
  chemically synthesized
ttctttatttagaaacattctg

SEQ ID NO: 902856 - DNA, 22 bp, Artificial Sequence
  chemically synthesized
tttatttagaaacattctgtct

SEQ ID NO: 902857 - DNA, 22 bp, Artificial Sequence
  chemically synthesized
tatttagaaacattctgtctat

SEQ ID NO: 902858 - DNA, 22 bp, Artificial Sequence
  chemically synthesized
atttagaaacattctgtctatt

SEQ ID NO: 902859 - DNA, 22 bp, Artificial Sequence
  chemically synthesized
tttagaaacattctgtctattc

SEQ ID NO: 902860 - DNA, 22 bp, Artificial Sequence
  chemically synthesized
caaaataataaaggaatagaca

SEQ ID NO: 902861 - DNA, 22 bp, Artificial Sequence
  chemically synthesized
agaaacattctgtctattcctt

SEQ ID NO: 902862 - DNA, 22 bp, Artificial Sequence
  chemically synthesized
gaaacattctgtctattccttt

SEQ ID NO: 902863 - DNA, 22 bp, Artificial Sequence
  chemically synthesized
tagactacaaaataataaagga

SEQ ID NO: 902864 - DNA, 22 bp, Artificial Sequence
  chemically synthesized
ttatagactacaaaataataaa

SEQ ID NO: 902865 - DNA, 22 bp, Artificial Sequence
  chemically synthesized
tgtctattcctttattattttg

SEQ ID NO: 902866 - DNA, 22 bp, Artificial Sequence
  chemically synthesized
tctattcctttattattttgta

SEQ ID NO: 902867 - DNA, 22 bp, Artificial Sequence
  chemically synthesized
ttcctttattattttgtagtct

SEQ ID NO: 902868 - DNA, 22 bp, Artificial Sequence
  chemically synthesized
tatgattattatagactacaaa

SEQ ID NO: 902869 - DNA, 22 bp, Artificial Sequence
  chemically synthesized
ctttattattttgtagtctata

SEQ ID NO: 902870 - DNA, 22 bp, Artificial Sequence
  chemically synthesized
tattattttgtagtctataata

SEQ ID NO: 902871 - DNA, 22 bp, Artificial Sequence
  chemically synthesized
attattttgtagtctataataa

SEQ ID NO: 902872 - DNA, 22 bp, Artificial Sequence
  chemically synthesized
ttattttgtagtctataataat

SEQ ID NO: 902873 - DNA, 22 bp, Artificial Sequence
  chemically synthesized
ttttgtagtctataataatcat

SEQ ID NO: 902874 - DNA, 22 bp, Artificial Sequence
  chemically synthesized
ataagatgttgtatgattatta

SEQ ID NO: 902875 - DNA, 22 bp, Artificial Sequence
  chemically synthesized
tgtagtctataataatcataca

SEQ ID NO: 902876 - DNA, 22 bp, Artificial Sequence
  chemically synthesized
gtagtctataataatcatacaa

SEQ ID NO: 902877 - DNA, 22 bp, Artificial Sequence
  chemically synthesized
tagtctataataatcatacaac

SEQ ID NO: 902878 - DNA, 22 bp, Artificial Sequence
  chemically synthesized
taataatcatacaacatcttat

SEQ ID NO: 902879 - DNA, 22 bp, Artificial Sequence
  chemically synthesized
attaatatgacactatattttg

SEQ ID NO: 902880 - DNA, 22 bp, Artificial Sequence
  chemically synthesized
ttaatatgacactatattttgg

SEQ ID NO: 902881 - DNA, 22 bp, Artificial Sequence
  chemically synthesized
atatgacactatattttggata

SEQ ID NO: 902882 - DNA, 22 bp, Artificial Sequence
  chemically synthesized
gtaatataatagagggcatatc

SEQ ID NO: 902883 - DNA, 22 bp, Artificial Sequence
  chemically synthesized
tattttggatatgccctctatt

SEQ ID NO: 902884 - DNA, 22 bp, Artificial Sequence
  chemically synthesized
tggatatgccctctattatatt

SEQ ID NO: 902885 - DNA, 22 bp, Artificial Sequence
  chemically synthesized
ggatatgccctctattatatta

SEQ ID NO: 902886 - DNA, 22 bp, Artificial Sequence
  chemically synthesized
tgtaaatattagtaatataata

SEQ ID NO: 902887 - DNA, 22 bp, Artificial Sequence
  chemically synthesized
gatatgccctctattatattac

SEQ ID NO: 902888 - DNA, 22 bp, Artificial Sequence
  chemically synthesized
atgtaaatattagtaatataat

SEQ ID NO: 902889 - DNA, 22 bp, Artificial Sequence
  chemically synthesized
catttatgtaaatattagtaat

SEQ ID NO: 902890 - DNA, 22 bp, Artificial Sequence
  chemically synthesized
acatttatgtaaatattagtaa

SEQ ID NO: 902891 - DNA, 22 bp, Artificial Sequence
  chemically synthesized
tattatattactaatatttaca

SEQ ID NO: 902892 - DNA, 22 bp, Artificial Sequence
  chemically synthesized
ttatattactaatatttacata

SEQ ID NO: 902893 - DNA, 22 bp, Artificial Sequence
  chemically synthesized
tattactaatatttacataaat

SEQ ID NO: 902894 - DNA, 22 bp, Artificial Sequence
  chemically synthesized
ctaatatttacataaatgtaaa

SEQ ID NO: 902895 - DNA, 22 bp, Artificial Sequence
  chemically synthesized
atatttacataaatgtaaacat

SEQ ID NO: 902896 - DNA, 22 bp, Artificial Sequence
  chemically synthesized
ggatcatggaaataaaaatgtt

SEQ ID NO: 902897 - DNA, 22 bp, Artificial Sequence
  chemically synthesized
acataaatgtaaacatttttat

SEQ ID NO: 902898 - DNA, 22 bp, Artificial Sequence
  chemically synthesized
cataaatgtaaacatttttatt

SEQ ID NO: 902899 - DNA, 22 bp, Artificial Sequence
  chemically synthesized
ttatttccatgatcctagtgac

SEQ ID NO: 902900 - DNA, 22 bp, Artificial Sequence
  chemically synthesized
gaaacggtaaaagtcactagga

SEQ ID NO: 902901 - DNA, 22 bp, Artificial Sequence
  chemically synthesized
tatttccatgatcctagtgact

SEQ ID NO: 902902 - DNA, 22 bp, Artificial Sequence
  chemically synthesized
atttccatgatcctagtgactt

SEQ ID NO: 902903 - DNA, 22 bp, Artificial Sequence
  chemically synthesized
tttccatgatcctagtgacttt

SEQ ID NO: 902904 - DNA, 22 bp, Artificial Sequence
  chemically synthesized
ccatgatcctagtgacttttac

SEQ ID NO: 902905 - DNA, 22 bp, Artificial Sequence
  chemically synthesized
catgatcctagtgacttttacc

SEQ ID NO: 902906 - DNA, 22 bp, Artificial Sequence
  chemically synthesized
aaaataaatacattagaaacgg

SEQ ID NO: 902907 - DNA, 22 bp, Artificial Sequence
  chemically synthesized
aaaaataaatacattagaaacg

SEQ ID NO: 902908 - DNA, 22 bp, Artificial Sequence
  chemically synthesized
gtgacttttaccgtttctaatg

SEQ ID NO: 902909 - DNA, 22 bp, Artificial Sequence
  chemically synthesized
atttaaaaataaatacattaga

SEQ ID NO: 902910 - DNA, 22 bp, Artificial Sequence
  chemically synthesized
ttaccgtttctaatgtatttat

SEQ ID NO: 902911 - DNA, 22 bp, Artificial Sequence
  chemically synthesized
taccgtttctaatgtatttatt

SEQ ID NO: 902912 - DNA, 22 bp, Artificial Sequence
  chemically synthesized
accgtttctaatgtatttattt

SEQ ID NO: 902913 - DNA, 22 bp, Artificial Sequence
  chemically synthesized
ccgtttctaatgtatttatttt

SEQ ID NO: 902914 - DNA, 22 bp, Artificial Sequence
  chemically synthesized
tgtgttaatttaaaaataaata

SEQ ID NO: 902915 - DNA, 22 bp, Artificial Sequence
  chemically synthesized
ctaatgtatttatttttaaatt

SEQ ID NO: 902916 - DNA, 22 bp, Artificial Sequence
  chemically synthesized
taatgtatttatttttaaatta

SEQ ID NO: 902917 - DNA, 22 bp, Artificial Sequence
  chemically synthesized
atgtatttatttttaaattaac

SEQ ID NO: 902918 - DNA, 22 bp, Artificial Sequence
  chemically synthesized
atttttaaattaacacataaca

SEQ ID NO: 902919 - DNA, 22 bp, Artificial Sequence
  chemically synthesized
tttttaaattaacacataacat

SEQ ID NO: 902920 - DNA, 22 bp, Artificial Sequence
  chemically synthesized
ttaaattaacacataacattgt

SEQ ID NO: 902921 - DNA, 22 bp, Artificial Sequence
  chemically synthesized
taaattaacacataacattgta

SEQ ID NO: 902922 - DNA, 22 bp, Artificial Sequence
  chemically synthesized
aaattaacacataacattgtat

SEQ ID NO: 902923 - DNA, 22 bp, Artificial Sequence
  chemically synthesized
aattaacacataacattgtatg

SEQ ID NO: 902924 - DNA, 22 bp, Artificial Sequence
  chemically synthesized
tacacaataaatacatacaatg

SEQ ID NO: 902925 - DNA, 22 bp, Artificial Sequence
  chemically synthesized
acacataacattgtatgtattt

SEQ ID NO: 902926 - DNA, 22 bp, Artificial Sequence
  chemically synthesized
aaaacatgttgtacacaataaa

SEQ ID NO: 902927 - DNA, 22 bp, Artificial Sequence
  chemically synthesized
caaaacatgttgtacacaataa

SEQ ID NO: 902928 - DNA, 22 bp, Artificial Sequence
  chemically synthesized
tatgtatttattgtgtacaaca

SEQ ID NO: 902929 - DNA, 22 bp, Artificial Sequence
  chemically synthesized
attgtgtacaacatgttttgaa

SEQ ID NO: 902930 - DNA, 22 bp, Artificial Sequence
  chemically synthesized
ttgtgtacaacatgttttgaaa

SEQ ID NO: 902931 - DNA, 22 bp, Artificial Sequence
  chemically synthesized
tgtacaacatgttttgaaatat

SEQ ID NO: 902932 - DNA, 22 bp, Artificial Sequence
  chemically synthesized
cacagtgtatgcatatttcaaa

SEQ ID NO: 902933 - DNA, 22 bp, Artificial Sequence
  chemically synthesized
gccattccacagtgtatgcata

SEQ ID NO: 902934 - DNA, 22 bp, Artificial Sequence
  chemically synthesized
agccattccacagtgtatgcat

SEQ ID NO: 902935 - DNA, 22 bp, Artificial Sequence
  chemically synthesized
aatttagccattccacagtgta

SEQ ID NO: 902936 - DNA, 22 bp, Artificial Sequence
  chemically synthesized
tgaaatatgcatacactgtgga

SEQ ID NO: 902937 - DNA, 22 bp, Artificial Sequence
  chemically synthesized
gaaatatgcatacactgtggaa

SEQ ID NO: 902938 - DNA, 22 bp, Artificial Sequence
  chemically synthesized
aaatatgcatacactgtggaat

SEQ ID NO: 902939 - DNA, 22 bp, Artificial Sequence
  chemically synthesized
tctcaatttagccattccacag

SEQ ID NO: 902940 - DNA, 22 bp, Artificial Sequence
  chemically synthesized
attatctcaatttagccattcc

SEQ ID NO: 902941 - DNA, 22 bp, Artificial Sequence
  chemically synthesized
tggaatggctaaattgagataa

SEQ ID NO: 902942 - DNA, 22 bp, Artificial Sequence
  chemically synthesized
aattgagataattaacatatgc

SEQ ID NO: 902943 - DNA, 22 bp, Artificial Sequence
  chemically synthesized
agataattaacatatgcattac

SEQ ID NO: 902944 - DNA, 22 bp, Artificial Sequence
  chemically synthesized
acatatgcattaccccacattc

SEQ ID NO: 902945 - DNA, 22 bp, Artificial Sequence
  chemically synthesized
accataaaaaaatgataagaat

SEQ ID NO: 902946 - DNA, 22 bp, Artificial Sequence
  chemically synthesized
tcaccataaaaaaatgataaga

SEQ ID NO: 902947 - DNA, 22 bp, Artificial Sequence
  chemically synthesized
ccccacattcttatcatttttt

SEQ ID NO: 902948 - DNA, 22 bp, Artificial Sequence
  chemically synthesized
aacattctcaccataaaaaaat

SEQ ID NO: 902949 - DNA, 22 bp, Artificial Sequence
  chemically synthesized
aaacattctcaccataaaaaaa

SEQ ID NO: 902950 - DNA, 22 bp, Artificial Sequence
  chemically synthesized
taaacattctcaccataaaaaa

SEQ ID NO: 902951 - DNA, 22 bp, Artificial Sequence
  chemically synthesized
ttatcatttttttatggtgaga

SEQ ID NO: 902952 - DNA, 22 bp, Artificial Sequence
  chemically synthesized
cattttaaacattctcaccata

SEQ ID NO: 902953 - DNA, 22 bp, Artificial Sequence
  chemically synthesized
atcatttttttatggtgagaat

SEQ ID NO: 902954 - DNA, 22 bp, Artificial Sequence
  chemically synthesized
tcatttttttatggtgagaatg

SEQ ID NO: 902955 - DNA, 22 bp, Artificial Sequence
  chemically synthesized
ttttatggtgagaatgtttaaa

SEQ ID NO: 902956 - DNA, 22 bp, Artificial Sequence
  chemically synthesized
tttatggtgagaatgtttaaaa

SEQ ID NO: 902957 - DNA, 22 bp, Artificial Sequence
  chemically synthesized
ttatggtgagaatgtttaaaat

SEQ ID NO: 902958 - DNA, 22 bp, Artificial Sequence
  chemically synthesized
ccaagagattacattttaaaca

SEQ ID NO: 902959 - DNA, 22 bp, Artificial Sequence
  chemically synthesized
tatggtgagaatgtttaaaatg

SEQ ID NO: 902960 - DNA, 22 bp, Artificial Sequence
  chemically synthesized
atggtgagaatgtttaaaatgt

SEQ ID NO: 902961 - DNA, 22 bp, Artificial Sequence
  chemically synthesized
tggtgagaatgtttaaaatgta

SEQ ID NO: 902962 - DNA, 22 bp, Artificial Sequence
  chemically synthesized
aaaattgccaagagattacatt

SEQ ID NO: 902963 - DNA, 22 bp, Artificial Sequence
  chemically synthesized
gaaaattgccaagagattacat

SEQ ID NO: 902964 - DNA, 22 bp, Artificial Sequence
  chemically synthesized
ttgaaaattgccaagagattac

SEQ ID NO: 902965 - DNA, 22 bp, Artificial Sequence
  chemically synthesized
tattcttgaaaattgccaagag

SEQ ID NO: 902966 - DNA, 22 bp, Artificial Sequence
  chemically synthesized
aaaatgtaatctcttggcaatt

SEQ ID NO: 902967 - DNA, 22 bp, Artificial Sequence
  chemically synthesized
aaatgtaatctcttggcaattt

SEQ ID NO: 902968 - DNA, 22 bp, Artificial Sequence
  chemically synthesized
ataacaatgcattgtattcttg

SEQ ID NO: 902969 - DNA, 22 bp, Artificial Sequence
  chemically synthesized
ttggcaattttcaagaatacaa

SEQ ID NO: 902970 - DNA, 22 bp, Artificial Sequence
  chemically synthesized
ggcaattttcaagaatacaatg

SEQ ID NO: 902971 - DNA, 22 bp, Artificial Sequence
  chemically synthesized
gcaattttcaagaatacaatgc

SEQ ID NO: 902972 - DNA, 22 bp, Artificial Sequence
  chemically synthesized
tagttaataacaatgcattgta

SEQ ID NO: 902973 - DNA, 22 bp, Artificial Sequence
  chemically synthesized
ctatagttaataacaatgcatt

SEQ ID NO: 902974 - DNA, 22 bp, Artificial Sequence
  chemically synthesized
tcaagaatacaatgcattgtta

SEQ ID NO: 902975 - DNA, 22 bp, Artificial Sequence
  chemically synthesized
caagaatacaatgcattgttat

SEQ ID NO: 902976 - DNA, 22 bp, Artificial Sequence
  chemically synthesized
aagaatacaatgcattgttatt

SEQ ID NO: 902977 - DNA, 22 bp, Artificial Sequence
  chemically synthesized
aaaggaatggagattactatag

SEQ ID NO: 902978 - DNA, 22 bp, Artificial Sequence
  chemically synthesized
ttattaactatagtaatctcca

SEQ ID NO: 902979 - DNA, 22 bp, Artificial Sequence
  chemically synthesized
ttaactatagtaatctccattc

SEQ ID NO: 902980 - DNA, 22 bp, Artificial Sequence
  chemically synthesized
actatagtaatctccattcctt

SEQ ID NO: 902981 - DNA, 22 bp, Artificial Sequence
  chemically synthesized
agcagatacctaaaaggaatgg

SEQ ID NO: 902982 - DNA, 22 bp, Artificial Sequence
  chemically synthesized
tagtaatctccattccttttag

SEQ ID NO: 902983 - DNA, 22 bp, Artificial Sequence
  chemically synthesized
cattccttttaggtatctgctt

SEQ ID NO: 902984 - DNA, 22 bp, Artificial Sequence
  chemically synthesized
cttttaggtatctgcttaggct

SEQ ID NO: 902985 - DNA, 22 bp, Artificial Sequence
  chemically synthesized
tgtgtatgataccagcctaagc

SEQ ID NO: 902986 - DNA, 22 bp, Artificial Sequence
  chemically synthesized
ttaggtatctgcttaggctggt

SEQ ID NO: 902987 - DNA, 22 bp, Artificial Sequence
  chemically synthesized
taggtatctgcttaggctggta

SEQ ID NO: 902988 - DNA, 22 bp, Artificial Sequence
  chemically synthesized
ttatgtgtatgataccagccta

SEQ ID NO: 902989 - DNA, 22 bp, Artificial Sequence
  chemically synthesized
aggtatctgcttaggctggtat

SEQ ID NO: 902990 - DNA, 22 bp, Artificial Sequence
  chemically synthesized
attatgtgtatgataccagcct

SEQ ID NO: 902991 - DNA, 22 bp, Artificial Sequence
  chemically synthesized
ggtatctgcttaggctggtatc

SEQ ID NO: 902992 - DNA, 22 bp, Artificial Sequence
  chemically synthesized
aacatttattatgtgtatgata

SEQ ID NO: 902993 - DNA, 22 bp, Artificial Sequence
  chemically synthesized
cttaggctggtatcatacacat

SEQ ID NO: 902994 - DNA, 22 bp, Artificial Sequence
  chemically synthesized
aggctggtatcatacacataat

SEQ ID NO: 902995 - DNA, 22 bp, Artificial Sequence
  chemically synthesized
ggctggtatcatacacataata

SEQ ID NO: 902996 - DNA, 22 bp, Artificial Sequence
  chemically synthesized
gtatcatacacataataaatgt

SEQ ID NO: 902997 - DNA, 22 bp, Artificial Sequence
  chemically synthesized
cataaataattgaacatttatt

SEQ ID NO: 902998 - DNA, 22 bp, Artificial Sequence
  chemically synthesized
attccataaataattgaacatt

SEQ ID NO: 902999 - DNA, 22 bp, Artificial Sequence
  chemically synthesized
ttcattccataaataattgaac

SEQ ID NO: 903000 - DNA, 22 bp, Artificial Sequence
  chemically synthesized
gttcattccataaataattgaa

SEQ ID NO: 903001 - DNA, 22 bp, Artificial Sequence
  chemically synthesized
ggtttgttcattccataaataa

SEQ ID NO: 903002 - DNA, 22 bp, Artificial Sequence
  chemically synthesized
aattatttatggaatgaacaaa

SEQ ID NO: 903003 - DNA, 22 bp, Artificial Sequence
  chemically synthesized
tttatggaatgaacaaacccaa

SEQ ID NO: 903004 - DNA, 22 bp, Artificial Sequence
  chemically synthesized
aagaaataaaacattgggtttg

SEQ ID NO: 903005 - DNA, 22 bp, Artificial Sequence
  chemically synthesized
atggaatgaacaaacccaatgt

SEQ ID NO: 903006 - DNA, 22 bp, Artificial Sequence
  chemically synthesized
tggaatgaacaaacccaatgtt

SEQ ID NO: 903007 - DNA, 22 bp, Artificial Sequence
  chemically synthesized
attaaagaaataaaacattggg

SEQ ID NO: 903008 - DNA, 22 bp, Artificial Sequence
  chemically synthesized
attcattaaagaaataaaacat

SEQ ID NO: 903009 - DNA, 22 bp, Artificial Sequence
  chemically synthesized
agaatgaactaattcattaaag

SEQ ID NO: 903010 - DNA, 22 bp, Artificial Sequence
  chemically synthesized
cagaatgaactaattcattaaa

SEQ ID NO: 903011 - DNA, 22 bp, Artificial Sequence
  chemically synthesized
tcagaatgaactaattcattaa

SEQ ID NO: 903012 - DNA, 22 bp, Artificial Sequence
  chemically synthesized
gttttcagaatgaactaattca

SEQ ID NO: 903013 - DNA, 22 bp, Artificial Sequence
  chemically synthesized
tatttctttaatgaattagttc

SEQ ID NO: 903014 - DNA, 22 bp, Artificial Sequence
  chemically synthesized
atttctttaatgaattagttca

SEQ ID NO: 903015 - DNA, 22 bp, Artificial Sequence
  chemically synthesized
tttctttaatgaattagttcat

SEQ ID NO: 903016 - DNA, 22 bp, Artificial Sequence
  chemically synthesized
ctttaatgaattagttcattct

SEQ ID NO: 903017 - DNA, 22 bp, Artificial Sequence
  chemically synthesized
tttaatgaattagttcattctg

SEQ ID NO: 903018 - DNA, 22 bp, Artificial Sequence
  chemically synthesized
taatgaattagttcattctgaa

SEQ ID NO: 903019 - DNA, 22 bp, Artificial Sequence
  chemically synthesized
aatgaattagttcattctgaaa

SEQ ID NO: 903020 - DNA, 22 bp, Artificial Sequence
  chemically synthesized
atgaattagttcattctgaaaa

SEQ ID NO: 903021 - DNA, 22 bp, Artificial Sequence
  chemically synthesized
acagaagtattagttttcagaa

SEQ ID NO: 903022 - DNA, 22 bp, Artificial Sequence
  chemically synthesized
attgacagaagtattagttttc

SEQ ID NO: 903023 - DNA, 22 bp, Artificial Sequence
  chemically synthesized
gttcattctgaaaactaatact

SEQ ID NO: 903024 - DNA, 22 bp, Artificial Sequence
  chemically synthesized
ttgattgacagaagtattagtt

SEQ ID NO: 903025 - DNA, 22 bp, Artificial Sequence
  chemically synthesized
ttgttgattgacagaagtatta

SEQ ID NO: 903026 - DNA, 22 bp, Artificial Sequence
  chemically synthesized
attctgaaaactaatacttctg

SEQ ID NO: 903027 - DNA, 22 bp, Artificial Sequence
  chemically synthesized
attgttgttgattgacagaagt

SEQ ID NO: 903028 - DNA, 22 bp, Artificial Sequence
  chemically synthesized
tgaaaactaatacttctgtcaa

SEQ ID NO: 903029 - DNA, 22 bp, Artificial Sequence
  chemically synthesized
aaaactaatacttctgtcaatc

SEQ ID NO: 903030 - DNA, 22 bp, Artificial Sequence
  chemically synthesized
attgattgttgttgattgacag

SEQ ID NO: 903031 - DNA, 22 bp, Artificial Sequence
  chemically synthesized
gttgattgattgttgttgattg

SEQ ID NO: 903032 - DNA, 22 bp, Artificial Sequence
  chemically synthesized
atacttctgtcaatcaacaaca

SEQ ID NO: 903033 - DNA, 22 bp, Artificial Sequence
  chemically synthesized
aagttggttgattgattgttgt

SEQ ID NO: 903034 - DNA, 22 bp, Artificial Sequence
  chemically synthesized
gaagttggttgattgattgttg

SEQ ID NO: 903035 - DNA, 22 bp, Artificial Sequence
  chemically synthesized
ctgtcaatcaacaacaatcaat

SEQ ID NO: 903036 - DNA, 22 bp, Artificial Sequence
  chemically synthesized
tgaagttggttgattgattgtt

SEQ ID NO: 903037 - DNA, 22 bp, Artificial Sequence
  chemically synthesized
tgtcaatcaacaacaatcaatc

SEQ ID NO: 903038 - DNA, 22 bp, Artificial Sequence
  chemically synthesized
tcaatcaacaacaatcaatcaa

SEQ ID NO: 903039 - DNA, 22 bp, Artificial Sequence
  chemically synthesized
ctttgaagttggttgattgatt

SEQ ID NO: 903040 - DNA, 22 bp, Artificial Sequence
  chemically synthesized
acgaagagaagttactttgaag

SEQ ID NO: 903041 - DNA, 22 bp, Artificial Sequence
  chemically synthesized
taacgaagagaagttactttga

SEQ ID NO: 903042 - DNA, 22 bp, Artificial Sequence
  chemically synthesized
gtcatctctaacgaagagaagt

SEQ ID NO: 903043 - DNA, 22 bp, Artificial Sequence
  chemically synthesized
ctagtcatctctaacgaagaga

SEQ ID NO: 903044 - DNA, 22 bp, Artificial Sequence
  chemically synthesized
caaagtaacttctcttcgttag

SEQ ID NO: 903045 - DNA, 22 bp, Artificial Sequence
  chemically synthesized
aaagtaacttctcttcgttaga

SEQ ID NO: 903046 - DNA, 22 bp, Artificial Sequence
  chemically synthesized
aggctgctagtcatctctaacg

SEQ ID NO: 903047 - DNA, 22 bp, Artificial Sequence
  chemically synthesized
atactaaggctgctagtcatct

SEQ ID NO: 903048 - DNA, 22 bp, Artificial Sequence
  chemically synthesized
ctcttcgttagagatgactagc

SEQ ID NO: 903049 - DNA, 22 bp, Artificial Sequence
  chemically synthesized
gatactaaggctgctagtcatc

SEQ ID NO: 903050 - DNA, 22 bp, Artificial Sequence
  chemically synthesized
tcttcgttagagatgactagca

SEQ ID NO: 903051 - DNA, 22 bp, Artificial Sequence
  chemically synthesized
ttcgttagagatgactagcagc

SEQ ID NO: 903052 - DNA, 22 bp, Artificial Sequence
  chemically synthesized
cgttagagatgactagcagcct

SEQ ID NO: 903053 - DNA, 22 bp, Artificial Sequence
  chemically synthesized
gttagagatgactagcagcctt

SEQ ID NO: 903054 - DNA, 22 bp, Artificial Sequence
  chemically synthesized
gagatgactagcagccttagta

SEQ ID NO: 903055 - DNA, 22 bp, Artificial Sequence
  chemically synthesized
ataatcaccaatttgatactaa

SEQ ID NO: 903056 - DNA, 22 bp, Artificial Sequence
  chemically synthesized
aataatcaccaatttgatacta

SEQ ID NO: 903057 - DNA, 22 bp, Artificial Sequence
  chemically synthesized
gcagccttagtatcaaattggt

SEQ ID NO: 903058 - DNA, 22 bp, Artificial Sequence
  chemically synthesized
tccgtcttaataatcaccaatt

SEQ ID NO: 903059 - DNA, 22 bp, Artificial Sequence
  chemically synthesized
agtatcaaattggtgattatta

SEQ ID NO: 903060 - DNA, 22 bp, Artificial Sequence
  chemically synthesized
gtatcaaattggtgattattaa

SEQ ID NO: 903061 - DNA, 22 bp, Artificial Sequence
  chemically synthesized
tcatgttgtccgtcttaataat

SEQ ID NO: 903062 - DNA, 22 bp, Artificial Sequence
  chemically synthesized
atcatgttgtccgtcttaataa

SEQ ID NO: 903063 - DNA, 22 bp, Artificial Sequence
  chemically synthesized
tatcatgttgtccgtcttaata

SEQ ID NO: 903064 - DNA, 22 bp, Artificial Sequence
  chemically synthesized
gtgattattaagacggacaaca

SEQ ID NO: 903065 - DNA, 22 bp, Artificial Sequence
  chemically synthesized
ttaagacggacaacatgataaa

SEQ ID NO: 903066 - DNA, 22 bp, Artificial Sequence
  chemically synthesized
tggggtgaatattttatcatgt

SEQ ID NO: 903067 - DNA, 22 bp, Artificial Sequence
  chemically synthesized
agacggacaacatgataaaata

SEQ ID NO: 903068 - DNA, 22 bp, Artificial Sequence
  chemically synthesized
gagagcgggagttatggggtga

SEQ ID NO: 903069 - DNA, 22 bp, Artificial Sequence
  chemically synthesized
ggagagcgggagttatggggtg

SEQ ID NO: 903070 - DNA, 22 bp, Artificial Sequence
  chemically synthesized
tggagagcgggagttatggggt

SEQ ID NO: 903071 - DNA, 22 bp, Artificial Sequence
  chemically synthesized
actttggagagcgggagttatg

SEQ ID NO: 903072 - DNA, 22 bp, Artificial Sequence
  chemically synthesized
accccataactcccgctctcca

SEQ ID NO: 903073 - DNA, 22 bp, Artificial Sequence
  chemically synthesized
aagaattcactttggagagcgg

SEQ ID NO: 903074 - DNA, 22 bp, Artificial Sequence
  chemically synthesized
aaagaattcactttggagagcg

SEQ ID NO: 903075 - DNA, 22 bp, Artificial Sequence
  chemically synthesized
ccgctctccaaagtgaattctt

SEQ ID NO: 903076 - DNA, 22 bp, Artificial Sequence
  chemically synthesized
tccaaagtgaattctttaaatc

SEQ ID NO: 903077 - DNA, 22 bp, Artificial Sequence
  chemically synthesized
catatcaaaagagatttaaaga

SEQ ID NO: 903078 - DNA, 22 bp, Artificial Sequence
  chemically synthesized
gcatatcaaaagagatttaaag

SEQ ID NO: 903079 - DNA, 22 bp, Artificial Sequence
  chemically synthesized
caaagtgaattctttaaatctc

SEQ ID NO: 903080 - DNA, 22 bp, Artificial Sequence
  chemically synthesized
tgcatatcaaaagagatttaaa

SEQ ID NO: 903081 - DNA, 22 bp, Artificial Sequence
  chemically synthesized
aactttgcatatcaaaagagat

SEQ ID NO: 903082 - DNA, 22 bp, Artificial Sequence
  chemically synthesized
actgaactttgcatatcaaaag

SEQ ID NO: 903083 - DNA, 22 bp, Artificial Sequence
  chemically synthesized
tcactgaactttgcatatcaaa

SEQ ID NO: 903084 - DNA, 22 bp, Artificial Sequence
  chemically synthesized
tttaaatctcttttgatatgca

SEQ ID NO: 903085 - DNA, 22 bp, Artificial Sequence
  chemically synthesized
ctcactgaactttgcatatcaa

SEQ ID NO: 903086 - DNA, 22 bp, Artificial Sequence
  chemically synthesized
taaatctcttttgatatgcaaa

SEQ ID NO: 903087 - DNA, 22 bp, Artificial Sequence
  chemically synthesized
aaatctcttttgatatgcaaag

SEQ ID NO: 903088 - DNA, 22 bp, Artificial Sequence
  chemically synthesized
aatctcttttgatatgcaaagt

SEQ ID NO: 903089 - DNA, 22 bp, Artificial Sequence
  chemically synthesized
acttctcactgaactttgcata

SEQ ID NO: 903090 - DNA, 22 bp, Artificial Sequence
  chemically synthesized
ttttgatatgcaaagttcagtg

SEQ ID NO: 903091 - DNA, 22 bp, Artificial Sequence
  chemically synthesized
ttgatatgcaaagttcagtgag

SEQ ID NO: 903092 - DNA, 22 bp, Artificial Sequence
  chemically synthesized
tgatatgcaaagttcagtgaga

SEQ ID NO: 903093 - DNA, 22 bp, Artificial Sequence
  chemically synthesized
gatatgcaaagttcagtgagaa

SEQ ID NO: 903094 - DNA, 22 bp, Artificial Sequence
  chemically synthesized
atatgcaaagttcagtgagaag

SEQ ID NO: 903095 - DNA, 22 bp, Artificial Sequence
  chemically synthesized
ggtgacagaaggtgttcacttc

SEQ ID NO: 903096 - DNA, 22 bp, Artificial Sequence
  chemically synthesized
ctaggtgacagaaggtgttcac

SEQ ID NO: 903097 - DNA, 22 bp, Artificial Sequence
  chemically synthesized
agtgagaagtgaacaccttctg

SEQ ID NO: 903098 - DNA, 22 bp, Artificial Sequence
  chemically synthesized
agatcagcacgttgctaggtga

SEQ ID NO: 903099 - DNA, 22 bp, Artificial Sequence
  chemically synthesized
aagatcagcacgttgctaggtg

SEQ ID NO: 903100 - DNA, 22 bp, Artificial Sequence
  chemically synthesized
tttaagatcagcacgttgctag

SEQ ID NO: 903101 - DNA, 22 bp, Artificial Sequence
  chemically synthesized
gtttaagatcagcacgttgcta

SEQ ID NO: 903102 - DNA, 22 bp, Artificial Sequence
  chemically synthesized
ctgtcacctagcaacgtgctga

SEQ ID NO: 903103 - DNA, 22 bp, Artificial Sequence
  chemically synthesized
tgtcacctagcaacgtgctgat

SEQ ID NO: 903104 - DNA, 22 bp, Artificial Sequence
  chemically synthesized
gccttgtttaagatcagcacgt

SEQ ID NO: 903105 - DNA, 22 bp, Artificial Sequence
  chemically synthesized
tcacctagcaacgtgctgatct

SEQ ID NO: 903106 - DNA, 22 bp, Artificial Sequence
  chemically synthesized
actggccttgtttaagatcagc

SEQ ID NO: 903107 - DNA, 22 bp, Artificial Sequence
  chemically synthesized
gcaacgtgctgatcttaaacaa

SEQ ID NO: 903108 - DNA, 22 bp, Artificial Sequence
  chemically synthesized
agcgaggttaactggccttgtt

SEQ ID NO: 903109 - DNA, 22 bp, Artificial Sequence
  chemically synthesized
atcttaaacaaggccagttaac

SEQ ID NO: 903110 - DNA, 22 bp, Artificial Sequence
  chemically synthesized
aaacaaggccagttaacctcgc

SEQ ID NO: 903111 - DNA, 22 bp, Artificial Sequence
  chemically synthesized
aacaaggccagttaacctcgct

SEQ ID NO: 903112 - DNA, 22 bp, Artificial Sequence
  chemically synthesized
agaaagagaaatccaggttcag

SEQ ID NO: 903113 - DNA, 22 bp, Artificial Sequence
  chemically synthesized
ttcagaaagagaaatccaggtt

SEQ ID NO: 903114 - DNA, 22 bp, Artificial Sequence
  chemically synthesized
gttcagaaagagaaatccaggt

SEQ ID NO: 903115 - DNA, 22 bp, Artificial Sequence
  chemically synthesized
tgttcagaaagagaaatccagg

SEQ ID NO: 903116 - DNA, 22 bp, Artificial Sequence
  chemically synthesized
acctcgctgaacctggatttct

SEQ ID NO: 903117 - DNA, 22 bp, Artificial Sequence
  chemically synthesized
tttgttcagaaagagaaatcca

SEQ ID NO: 903118 - DNA, 22 bp, Artificial Sequence
  chemically synthesized
ctttgttcagaaagagaaatcc

SEQ ID NO: 903119 - DNA, 22 bp, Artificial Sequence
  chemically synthesized
tctttgttcagaaagagaaatc

SEQ ID NO: 903120 - DNA, 22 bp, Artificial Sequence
  chemically synthesized
gctgaacctggatttctctttc

SEQ ID NO: 903121 - DNA, 22 bp, Artificial Sequence
  chemically synthesized
tctttctttgttcagaaagaga

SEQ ID NO: 903122 - DNA, 22 bp, Artificial Sequence
  chemically synthesized
gtctttctttgttcagaaagag

SEQ ID NO: 903123 - DNA, 22 bp, Artificial Sequence
  chemically synthesized
aacctggatttctctttctgaa

SEQ ID NO: 903124 - DNA, 22 bp, Artificial Sequence
  chemically synthesized
gatttctctttctgaacaaaga

SEQ ID NO: 903125 - DNA, 22 bp, Artificial Sequence
  chemically synthesized
ctctttctgaacaaagaaagac

SEQ ID NO: 903126 - DNA, 22 bp, Artificial Sequence
  chemically synthesized
tctttctgaacaaagaaagaca

SEQ ID NO: 903127 - DNA, 22 bp, Artificial Sequence
  chemically synthesized
tttctgaacaaagaaagacaag

SEQ ID NO: 903128 - DNA, 22 bp, Artificial Sequence
  chemically synthesized
taggaggtggatcttgtctttc

SEQ ID NO: 903129 - DNA, 22 bp, Artificial Sequence
  chemically synthesized
tctgaacaaagaaagacaagat

SEQ ID NO: 903130 - DNA, 22 bp, Artificial Sequence
  chemically synthesized
ctgaacaaagaaagacaagatc

SEQ ID NO: 903131 - DNA, 22 bp, Artificial Sequence
  chemically synthesized
tgaacaaagaaagacaagatcc

SEQ ID NO: 903132 - DNA, 22 bp, Artificial Sequence
  chemically synthesized
aacaaagaaagacaagatccac

SEQ ID NO: 903133 - DNA, 22 bp, Artificial Sequence
  chemically synthesized
agtcacagaagttataggaggt

SEQ ID NO: 903134 - DNA, 22 bp, Artificial Sequence
  chemically synthesized
gagtcacagaagttataggagg

SEQ ID NO: 903135 - DNA, 22 bp, Artificial Sequence
  chemically synthesized
atttgagtcacagaagttatag

SEQ ID NO: 903136 - DNA, 22 bp, Artificial Sequence
  chemically synthesized
gctcatttgagtcacagaagtt

SEQ ID NO: 903137 - DNA, 22 bp, Artificial Sequence
  chemically synthesized
tacattagctcatttgagtcac

SEQ ID NO: 903138 - DNA, 22 bp, Artificial Sequence
  chemically synthesized
ctataacttctgtgactcaaat

SEQ ID NO: 903139 - DNA, 22 bp, Artificial Sequence
  chemically synthesized
ctatacattagctcatttgagt

SEQ ID NO: 903140 - DNA, 22 bp, Artificial Sequence
  chemically synthesized
taacttctgtgactcaaatgag

SEQ ID NO: 903141 - DNA, 22 bp, Artificial Sequence
  chemically synthesized
cctatacattagctcatttgag

SEQ ID NO: 903142 - DNA, 22 bp, Artificial Sequence
  chemically synthesized
ctgtgactcaaatgagctaatg

SEQ ID NO: 903143 - DNA, 22 bp, Artificial Sequence
  chemically synthesized
tgtgactcaaatgagctaatgt

SEQ ID NO: 903144 - DNA, 22 bp, Artificial Sequence
  chemically synthesized
tgactcaaatgagctaatgtat

SEQ ID NO: 903145 - DNA, 22 bp, Artificial Sequence
  chemically synthesized
cacagtatttcctatacattag

SEQ ID NO: 903146 - DNA, 22 bp, Artificial Sequence
  chemically synthesized
aaatgagctaatgtataggaaa

SEQ ID NO: 903147 - DNA, 22 bp, Artificial Sequence
  chemically synthesized
tatgttgcacagtatttcctat

SEQ ID NO: 903148 - DNA, 22 bp, Artificial Sequence
  chemically synthesized
atgtataggaaatactgtgcaa

SEQ ID NO: 903149 - DNA, 22 bp, Artificial Sequence
  chemically synthesized
taaaccactatatgttgcacag

SEQ ID NO: 903150 - DNA, 22 bp, Artificial Sequence
  chemically synthesized
ataaaccactatatgttgcaca

SEQ ID NO: 903151 - DNA, 22 bp, Artificial Sequence
  chemically synthesized
tggtttataaaccactatatgt

SEQ ID NO: 903152 - DNA, 22 bp, Artificial Sequence
  chemically synthesized
atggtttataaaccactatatg

SEQ ID NO: 903153 - DNA, 22 bp, Artificial Sequence
  chemically synthesized
tatggtttataaaccactatat

SEQ ID NO: 903154 - DNA, 22 bp, Artificial Sequence
  chemically synthesized
tgcaacatatagtggtttataa

SEQ ID NO: 903155 - DNA, 22 bp, Artificial Sequence
  chemically synthesized
agaattttatggtttataaacc

SEQ ID NO: 903156 - DNA, 22 bp, Artificial Sequence
  chemically synthesized
cagaattttatggtttataaac

SEQ ID NO: 903157 - DNA, 22 bp, Artificial Sequence
  chemically synthesized
tcagaattttatggtttataaa

SEQ ID NO: 903158 - DNA, 22 bp, Artificial Sequence
  chemically synthesized
ttcagaattttatggtttataa

SEQ ID NO: 903159 - DNA, 22 bp, Artificial Sequence
  chemically synthesized
tttcagaattttatggtttata

SEQ ID NO: 903160 - DNA, 22 bp, Artificial Sequence
  chemically synthesized
attttttcagaattttatggtt

SEQ ID NO: 903161 - DNA, 22 bp, Artificial Sequence
  chemically synthesized
ataaaccataaaattctgaaaa

SEQ ID NO: 903162 - DNA, 22 bp, Artificial Sequence
  chemically synthesized
aatcagctaattttttcagaat

SEQ ID NO: 903163 - DNA, 22 bp, Artificial Sequence
  chemically synthesized
taaaccataaaattctgaaaaa

SEQ ID NO: 903164 - DNA, 22 bp, Artificial Sequence
  chemically synthesized
gttcaatcagctaattttttca

SEQ ID NO: 903165 - DNA, 22 bp, Artificial Sequence
  chemically synthesized
actggttcaatcagctaatttt

SEQ ID NO: 903166 - DNA, 22 bp, Artificial Sequence
  chemically synthesized
ctcactggttcaatcagctaat

SEQ ID NO: 903167 - DNA, 22 bp, Artificial Sequence
  chemically synthesized
tactcactggttcaatcagcta

SEQ ID NO: 903168 - DNA, 22 bp, Artificial Sequence
  chemically synthesized
tgaaaaaattagctgattgaac

SEQ ID NO: 903169 - DNA, 22 bp, Artificial Sequence
  chemically synthesized
aaaaaattagctgattgaacca

SEQ ID NO: 903170 - DNA, 22 bp, Artificial Sequence
  chemically synthesized
cgctctactcactggttcaatc

SEQ ID NO: 903171 - DNA, 22 bp, Artificial Sequence
  chemically synthesized
cctacgctctactcactggttc

SEQ ID NO: 903172 - DNA, 22 bp, Artificial Sequence
  chemically synthesized
gcctacgctctactcactggtt

SEQ ID NO: 903173 - DNA, 22 bp, Artificial Sequence
  chemically synthesized
tgcctacgctctactcactggt

SEQ ID NO: 903174 - DNA, 22 bp, Artificial Sequence
  chemically synthesized
gctgattgaaccagtgagtaga

SEQ ID NO: 903175 - DNA, 22 bp, Artificial Sequence
  chemically synthesized
attgaaccagtgagtagagcgt

SEQ ID NO: 903176 - DNA, 22 bp, Artificial Sequence
  chemically synthesized
tatcgctttgcctacgctctac

SEQ ID NO: 903177 - DNA, 22 bp, Artificial Sequence
  chemically synthesized
atatcgctttgcctacgctcta

SEQ ID NO: 903178 - DNA, 22 bp, Artificial Sequence
  chemically synthesized
aaccagtgagtagagcgtaggc

SEQ ID NO: 903179 - DNA, 22 bp, Artificial Sequence
  chemically synthesized
ttatatcgctttgcctacgctc

SEQ ID NO: 903180 - DNA, 22 bp, Artificial Sequence
  chemically synthesized
ctcttatatcgctttgcctacg

SEQ ID NO: 903181 - DNA, 22 bp, Artificial Sequence
  chemically synthesized
gtactgctcttatatcgctttg

SEQ ID NO: 903182 - DNA, 22 bp, Artificial Sequence
  chemically synthesized
atcagcaaattagtactgctct

SEQ ID NO: 903183 - DNA, 22 bp, Artificial Sequence
  chemically synthesized
atcacctaatcagcaaattagt

SEQ ID NO: 903184 - DNA, 22 bp, Artificial Sequence
  chemically synthesized
catcacctaatcagcaaattag

SEQ ID NO: 903185 - DNA, 22 bp, Artificial Sequence
  chemically synthesized
tcatcacctaatcagcaaatta

SEQ ID NO: 903186 - DNA, 22 bp, Artificial Sequence
  chemically synthesized
attttcatcacctaatcagcaa

SEQ ID NO: 903187 - DNA, 22 bp, Artificial Sequence
  chemically synthesized
ctaattttcatcacctaatcag

SEQ ID NO: 903188 - DNA, 22 bp, Artificial Sequence
  chemically synthesized
actaattttcatcacctaatca

SEQ ID NO: 903189 - DNA, 22 bp, Artificial Sequence
  chemically synthesized
atttgctgattaggtgatgaaa

SEQ ID NO: 903190 - DNA, 22 bp, Artificial Sequence
  chemically synthesized
agtgtttactaattttcatcac

SEQ ID NO: 903191 - DNA, 22 bp, Artificial Sequence
  chemically synthesized
gctgattaggtgatgaaaatta

SEQ ID NO: 903192 - DNA, 22 bp, Artificial Sequence
  chemically synthesized
ctgattaggtgatgaaaattag

SEQ ID NO: 903193 - DNA, 22 bp, Artificial Sequence
  chemically synthesized
attaggtgatgaaaattagtaa

SEQ ID NO: 903194 - DNA, 22 bp, Artificial Sequence
  chemically synthesized
ggtgatgaaaattagtaaacac

SEQ ID NO: 903195 - DNA, 22 bp, Artificial Sequence
  chemically synthesized
gtagcaaaatctgagtgtttac

SEQ ID NO: 903196 - DNA, 22 bp, Artificial Sequence
  chemically synthesized
ttagtagcaaaatctgagtgtt

SEQ ID NO: 903197 - DNA, 22 bp, Artificial Sequence
  chemically synthesized
attagtagcaaaatctgagtgt

SEQ ID NO: 903198 - DNA, 22 bp, Artificial Sequence
  chemically synthesized
gtaaacactcagattttgctac

SEQ ID NO: 903199 - DNA, 22 bp, Artificial Sequence
  chemically synthesized
cagcaatacatttattagtagc

SEQ ID NO: 903200 - DNA, 22 bp, Artificial Sequence
  chemically synthesized
gcagcaatacatttattagtag

SEQ ID NO: 903201 - DNA, 22 bp, Artificial Sequence
  chemically synthesized
tgcagcaatacatttattagta

SEQ ID NO: 903202 - DNA, 22 bp, Artificial Sequence
  chemically synthesized
agattttgctactaataaatgt

SEQ ID NO: 903203 - DNA, 22 bp, Artificial Sequence
  chemically synthesized
cattttgcagcaatacatttat

SEQ ID NO: 903204 - DNA, 22 bp, Artificial Sequence
  chemically synthesized
tgctactaataaatgtattgct

SEQ ID NO: 903205 - DNA, 22 bp, Artificial Sequence
  chemically synthesized
gctactaataaatgtattgctg

SEQ ID NO: 903206 - DNA, 22 bp, Artificial Sequence
  chemically synthesized
ctactaataaatgtattgctgc

SEQ ID NO: 903207 - DNA, 22 bp, Artificial Sequence
  chemically synthesized
ctaataaatgtattgctgcaaa

SEQ ID NO: 903208 - DNA, 22 bp, Artificial Sequence
  chemically synthesized
accgtcagttacattttgcagc

SEQ ID NO: 903209 - DNA, 22 bp, Artificial Sequence
  chemically synthesized
ataaatgtattgctgcaaaatg

SEQ ID NO: 903210 - DNA, 22 bp, Artificial Sequence
  chemically synthesized
aaccgtcagttacattttgcag

SEQ ID NO: 903211 - DNA, 22 bp, Artificial Sequence
  chemically synthesized
tagtttaaccgtcagttacatt

SEQ ID NO: 903212 - DNA, 22 bp, Artificial Sequence
  chemically synthesized
ctgcaaaatgtaactgacggtt

SEQ ID NO: 903213 - DNA, 22 bp, Artificial Sequence
  chemically synthesized
aatgattgtagtttaaccgtca

SEQ ID NO: 903214 - DNA, 22 bp, Artificial Sequence
  chemically synthesized
caaaatgtaactgacggttaaa

SEQ ID NO: 903215 - DNA, 22 bp, Artificial Sequence
  chemically synthesized
ttgaatgattgtagtttaaccg

SEQ ID NO: 903216 - DNA, 22 bp, Artificial Sequence
  chemically synthesized
ttattgaatgattgtagtttaa

SEQ ID NO: 903217 - DNA, 22 bp, Artificial Sequence
  chemically synthesized
acggttaaactacaatcattca

SEQ ID NO: 903218 - DNA, 22 bp, Artificial Sequence
  chemically synthesized
aacaaattattattgaatgatt

SEQ ID NO: 903219 - DNA, 22 bp, Artificial Sequence
  chemically synthesized
aactacaatcattcaataataa

SEQ ID NO: 903220 - DNA, 22 bp, Artificial Sequence
  chemically synthesized
ggagatgttcaacaaattatta

SEQ ID NO: 903221 - DNA, 22 bp, Artificial Sequence
  chemically synthesized
caatcattcaataataatttgt

SEQ ID NO: 903222 - DNA, 22 bp, Artificial Sequence
  chemically synthesized
tacctaggagatgttcaacaaa

SEQ ID NO: 903223 - DNA, 22 bp, Artificial Sequence
  chemically synthesized
atacctaggagatgttcaacaa

SEQ ID NO: 903224 - DNA, 22 bp, Artificial Sequence
  chemically synthesized
tatacctaggagatgttcaaca

SEQ ID NO: 903225 - DNA, 22 bp, Artificial Sequence
  chemically synthesized
aataataatttgttgaacatct

SEQ ID NO: 903226 - DNA, 22 bp, Artificial Sequence
  chemically synthesized
taatgctttatacctaggagat

SEQ ID NO: 903227 - DNA, 22 bp, Artificial Sequence
  chemically synthesized
ataatgctttatacctaggaga

SEQ ID NO: 903228 - DNA, 22 bp, Artificial Sequence
  chemically synthesized
gttgaacatctcctaggtataa

SEQ ID NO: 903229 - DNA, 22 bp, Artificial Sequence
  chemically synthesized
ttgaacatctcctaggtataaa

SEQ ID NO: 903230 - DNA, 22 bp, Artificial Sequence
  chemically synthesized
gtcttataatgctttataccta

SEQ ID NO: 903231 - DNA, 22 bp, Artificial Sequence
  chemically synthesized
ggtcttataatgctttatacct

SEQ ID NO: 903232 - DNA, 22 bp, Artificial Sequence
  chemically synthesized
tggtcttataatgctttatacc

SEQ ID NO: 903233 - DNA, 22 bp, Artificial Sequence
  chemically synthesized
aacatctcctaggtataaagca

SEQ ID NO: 903234 - DNA, 22 bp, Artificial Sequence
  chemically synthesized
ttggtcttataatgctttatac

SEQ ID NO: 903235 - DNA, 22 bp, Artificial Sequence
  chemically synthesized
ttttggtcttataatgctttat

SEQ ID NO: 903236 - DNA, 22 bp, Artificial Sequence
  chemically synthesized
cttttggtcttataatgcttta

SEQ ID NO: 903237 - DNA, 22 bp, Artificial Sequence
  chemically synthesized
ctaggtataaagcattataaga

SEQ ID NO: 903238 - DNA, 22 bp, Artificial Sequence
  chemically synthesized
gatttcttttggtcttataatg

SEQ ID NO: 903239 - DNA, 22 bp, Artificial Sequence
  chemically synthesized
ggatttcttttggtcttataat

SEQ ID NO: 903240 - DNA, 22 bp, Artificial Sequence
  chemically synthesized
ggtataaagcattataagacca

SEQ ID NO: 903241 - DNA, 22 bp, Artificial Sequence
  chemically synthesized
ttggatttcttttggtcttata

SEQ ID NO: 903242 - DNA, 22 bp, Artificial Sequence
  chemically synthesized
taagaccaaaagaaatccaaga

SEQ ID NO: 903243 - DNA, 22 bp, Artificial Sequence
  chemically synthesized
tacgggatgtaattcttggatt

SEQ ID NO: 903244 - DNA, 22 bp, Artificial Sequence
  chemically synthesized
ggattatacgggatgtaattct

SEQ ID NO: 903245 - DNA, 22 bp, Artificial Sequence
  chemically synthesized
catcccgtataatcctagttgt

SEQ ID NO: 903246 - DNA, 22 bp, Artificial Sequence
  chemically synthesized
gttgtggatttatatttttctt

SEQ ID NO: 903247 - DNA, 22 bp, Artificial Sequence
  chemically synthesized
tggatttatatttttctttttg

SEQ ID NO: 903248 - DNA, 22 bp, Artificial Sequence
  chemically synthesized
cacacccagtatcaaaaagaaa

SEQ ID NO: 903249 - DNA, 22 bp, Artificial Sequence
  chemically synthesized
acacacccagtatcaaaaagaa

SEQ ID NO: 903250 - DNA, 22 bp, Artificial Sequence
  chemically synthesized
tacacacccagtatcaaaaaga

SEQ ID NO: 903251 - DNA, 22 bp, Artificial Sequence
  chemically synthesized
ttttacacacccagtatcaaaa

SEQ ID NO: 903252 - DNA, 22 bp, Artificial Sequence
  chemically synthesized
atatttttctttttgatactgg

SEQ ID NO: 903253 - DNA, 22 bp, Artificial Sequence
  chemically synthesized
tatttttctttttgatactggg

SEQ ID NO: 903254 - DNA, 22 bp, Artificial Sequence
  chemically synthesized
agtctattttacacacccagta

SEQ ID NO: 903255 - DNA, 22 bp, Artificial Sequence
  chemically synthesized
gagtctattttacacacccagt

SEQ ID NO: 903256 - DNA, 22 bp, Artificial Sequence
  chemically synthesized
ttctttttgatactgggtgtgt

SEQ ID NO: 903257 - DNA, 22 bp, Artificial Sequence
  chemically synthesized
tgagtctattttacacacccag

SEQ ID NO: 903258 - DNA, 22 bp, Artificial Sequence
  chemically synthesized
tctttttgatactgggtgtgta

SEQ ID NO: 903259 - DNA, 22 bp, Artificial Sequence
  chemically synthesized
ttgagtctattttacacaccca

SEQ ID NO: 903260 - DNA, 22 bp, Artificial Sequence
  chemically synthesized
ctttttgatactgggtgtgtaa

SEQ ID NO: 903261 - DNA, 22 bp, Artificial Sequence
  chemically synthesized
tttgagtctattttacacaccc

SEQ ID NO: 903262 - DNA, 22 bp, Artificial Sequence
  chemically synthesized
tttttgatactgggtgtgtaaa

SEQ ID NO: 903263 - DNA, 22 bp, Artificial Sequence
  chemically synthesized
tttgatactgggtgtgtaaaat

SEQ ID NO: 903264 - DNA, 22 bp, Artificial Sequence
  chemically synthesized
ttgatactgggtgtgtaaaata

SEQ ID NO: 903265 - DNA, 22 bp, Artificial Sequence
  chemically synthesized
tgatactgggtgtgtaaaatag

SEQ ID NO: 903266 - DNA, 22 bp, Artificial Sequence
  chemically synthesized
gatactgggtgtgtaaaataga

SEQ ID NO: 903267 - DNA, 22 bp, Artificial Sequence
  chemically synthesized
atactgggtgtgtaaaatagac

SEQ ID NO: 903268 - DNA, 22 bp, Artificial Sequence
  chemically synthesized
ggtgtgtaaaatagactcaaaa

SEQ ID NO: 903269 - DNA, 22 bp, Artificial Sequence
  chemically synthesized
aaggggaaaaaatcattttttg

SEQ ID NO: 903270 - DNA, 22 bp, Artificial Sequence
  chemically synthesized
aaaggggaaaaaatcatttttt

SEQ ID NO: 903271 - DNA, 22 bp, Artificial Sequence
  chemically synthesized
aaaaaatgattttttccccttt

SEQ ID NO: 903272 - DNA, 22 bp, Artificial Sequence
  chemically synthesized
aatgagcaaacaaaaatcttaa

SEQ ID NO: 903273 - DNA, 22 bp, Artificial Sequence
  chemically synthesized
tttcccctttaagatttttgtt

SEQ ID NO: 903274 - DNA, 22 bp, Artificial Sequence
  chemically synthesized
ttcccctttaagatttttgttt

SEQ ID NO: 903275 - DNA, 22 bp, Artificial Sequence
  chemically synthesized
tcccctttaagatttttgtttg

SEQ ID NO: 903276 - DNA, 22 bp, Artificial Sequence
  chemically synthesized
cccctttaagatttttgtttgc

SEQ ID NO: 903277 - DNA, 22 bp, Artificial Sequence
  chemically synthesized
ccctttaagatttttgtttgct

SEQ ID NO: 903278 - DNA, 22 bp, Artificial Sequence
  chemically synthesized
taagatttttgtttgctcattg

SEQ ID NO: 903279 - DNA, 22 bp, Artificial Sequence
  chemically synthesized
aagatttttgtttgctcattga

SEQ ID NO: 903280 - DNA, 22 bp, Artificial Sequence
  chemically synthesized
agatttttgtttgctcattgaa

SEQ ID NO: 903281 - DNA, 22 bp, Artificial Sequence
  chemically synthesized
atgtagccaaccacgattcaat

SEQ ID NO: 903282 - DNA, 22 bp, Artificial Sequence
  chemically synthesized
ttgtttgctcattgaatcgtgg

SEQ ID NO: 903283 - DNA, 22 bp, Artificial Sequence
  chemically synthesized
tgtttgctcattgaatcgtggt

SEQ ID NO: 903284 - DNA, 22 bp, Artificial Sequence
  chemically synthesized
gtttgctcattgaatcgtggtt

SEQ ID NO: 903285 - DNA, 22 bp, Artificial Sequence
  chemically synthesized
cctgatgtagccaaccacgatt

SEQ ID NO: 903286 - DNA, 22 bp, Artificial Sequence
  chemically synthesized
tttgctcattgaatcgtggttg

SEQ ID NO: 903287 - DNA, 22 bp, Artificial Sequence
  chemically synthesized
tgcctgatgtagccaaccacga

SEQ ID NO: 903288 - DNA, 22 bp, Artificial Sequence
  chemically synthesized
gctcattgaatcgtggttggct

SEQ ID NO: 903289 - DNA, 22 bp, Artificial Sequence
  chemically synthesized
ctcattgaatcgtggttggcta

SEQ ID NO: 903290 - DNA, 22 bp, Artificial Sequence
  chemically synthesized
attgaatcgtggttggctacat

SEQ ID NO: 903291 - DNA, 22 bp, Artificial Sequence
  chemically synthesized
aaatctctgcctgatgtagcca

SEQ ID NO: 903292 - DNA, 22 bp, Artificial Sequence
  chemically synthesized
aaaatctctgcctgatgtagcc

SEQ ID NO: 903293 - DNA, 22 bp, Artificial Sequence
  chemically synthesized
aatcgtggttggctacatcagg

SEQ ID NO: 903294 - DNA, 22 bp, Artificial Sequence
  chemically synthesized
ccttaaaatctctgcctgatgt

SEQ ID NO: 903295 - DNA, 22 bp, Artificial Sequence
  chemically synthesized
cccttaaaatctctgcctgatg

SEQ ID NO: 903296 - DNA, 22 bp, Artificial Sequence
  chemically synthesized
tcccttaaaatctctgcctgat

SEQ ID NO: 903297 - DNA, 22 bp, Artificial Sequence
  chemically synthesized
gctacatcaggcagagatttta

SEQ ID NO: 903298 - DNA, 22 bp, Artificial Sequence
  chemically synthesized
catcaggcagagattttaaggg

SEQ ID NO: 903299 - DNA, 22 bp, Artificial Sequence
  chemically synthesized
aaaataggttttcccttaaaat

SEQ ID NO: 903300 - DNA, 22 bp, Artificial Sequence
  chemically synthesized
ttgaaaataggttttcccttaa

SEQ ID NO: 903301 - DNA, 22 bp, Artificial Sequence
  chemically synthesized
gttgaaaataggttttccctta

SEQ ID NO: 903302 - DNA, 22 bp, Artificial Sequence
  chemically synthesized
tcttgttgaaaataggttttcc

SEQ ID NO: 903303 - DNA, 22 bp, Artificial Sequence
  chemically synthesized
tgtcttgttgaaaataggtttt

SEQ ID NO: 903304 - DNA, 22 bp, Artificial Sequence
  chemically synthesized
ctctgtcttgttgaaaataggt

SEQ ID NO: 903305 - DNA, 22 bp, Artificial Sequence
  chemically synthesized
actctgtcttgttgaaaatagg

SEQ ID NO: 903306 - DNA, 22 bp, Artificial Sequence
  chemically synthesized
taagggaaaacctattttcaac

SEQ ID NO: 903307 - DNA, 22 bp, Artificial Sequence
  chemically synthesized
aagggaaaacctattttcaaca

SEQ ID NO: 903308 - DNA, 22 bp, Artificial Sequence
  chemically synthesized
agggaaaacctattttcaacaa

SEQ ID NO: 903309 - DNA, 22 bp, Artificial Sequence
  chemically synthesized
acttactctgtcttgttgaaaa

SEQ ID NO: 903310 - DNA, 22 bp, Artificial Sequence
  chemically synthesized
gaattgacttactctgtcttgt

SEQ ID NO: 903311 - DNA, 22 bp, Artificial Sequence
  chemically synthesized
agaattgacttactctgtcttg

SEQ ID NO: 903312 - DNA, 22 bp, Artificial Sequence
  chemically synthesized
cttagaattgacttactctgtc

SEQ ID NO: 903313 - DNA, 22 bp, Artificial Sequence
  chemically synthesized
ttttcaacaagacagagtaagt

SEQ ID NO: 903314 - DNA, 22 bp, Artificial Sequence
  chemically synthesized
tcaacaagacagagtaagtcaa

SEQ ID NO: 903315 - DNA, 22 bp, Artificial Sequence
  chemically synthesized
caacaagacagagtaagtcaat

SEQ ID NO: 903316 - DNA, 22 bp, Artificial Sequence
  chemically synthesized
aacaagacagagtaagtcaatt

SEQ ID NO: 903317 - DNA, 22 bp, Artificial Sequence
  chemically synthesized
gccgcagagttgcttagaattg

SEQ ID NO: 903318 - DNA, 22 bp, Artificial Sequence
  chemically synthesized
caacatgtattagccgcagagt

SEQ ID NO: 903319 - DNA, 22 bp, Artificial Sequence
  chemically synthesized
taagcaactctgcggctaatac

SEQ ID NO: 903320 - DNA, 22 bp, Artificial Sequence
  chemically synthesized
agcaactctgcggctaatacat

SEQ ID NO: 903321 - DNA, 22 bp, Artificial Sequence
  chemically synthesized
tatgaaccctacaacatgtatt

SEQ ID NO: 903322 - DNA, 22 bp, Artificial Sequence
  chemically synthesized
tgcggctaatacatgttgtagg

SEQ ID NO: 903323 - DNA, 22 bp, Artificial Sequence
  chemically synthesized
cggctaatacatgttgtagggt

SEQ ID NO: 903324 - DNA, 22 bp, Artificial Sequence
  chemically synthesized
atacatgttgtagggttcatat

SEQ ID NO: 903325 - DNA, 22 bp, Artificial Sequence
  chemically synthesized
tgaagaagaaattatatgaacc

SEQ ID NO: 903326 - DNA, 22 bp, Artificial Sequence
  chemically synthesized
tgtgaagaagaaattatatgaa

SEQ ID NO: 903327 - DNA, 22 bp, Artificial Sequence
  chemically synthesized
tctctgtgaagaagaaattata

SEQ ID NO: 903328 - DNA, 22 bp, Artificial Sequence
  chemically synthesized
tagggttcatataatttcttct

SEQ ID NO: 903329 - DNA, 22 bp, Artificial Sequence
  chemically synthesized
atataatttcttcttcacagag

SEQ ID NO: 903330 - DNA, 22 bp, Artificial Sequence
  chemically synthesized
cttcttcacagagacaattgtc

SEQ ID NO: 903331 - DNA, 22 bp, Artificial Sequence
  chemically synthesized
ttcttcacagagacaattgtcc

SEQ ID NO: 903332 - DNA, 22 bp, Artificial Sequence
  chemically synthesized
cttcacagagacaattgtccct

SEQ ID NO: 903333 - DNA, 22 bp, Artificial Sequence
  chemically synthesized
ttcacagagacaattgtcccta

SEQ ID NO: 903334 - DNA, 22 bp, Artificial Sequence
  chemically synthesized
agaggtgtcataatagggacaa

SEQ ID NO: 903335 - DNA, 22 bp, Artificial Sequence
  chemically synthesized
cacagagacaattgtccctatt

SEQ ID NO: 903336 - DNA, 22 bp, Artificial Sequence
  chemically synthesized
acagagacaattgtccctatta

SEQ ID NO: 903337 - DNA, 22 bp, Artificial Sequence
  chemically synthesized
tccctattatgacacctctcaa

SEQ ID NO: 903338 - DNA, 22 bp, Artificial Sequence
  chemically synthesized
gataaacaatggcaatgttgag

SEQ ID NO: 903339 - DNA, 22 bp, Artificial Sequence
  chemically synthesized
ttatgacacctctcaacattgc

SEQ ID NO: 903340 - DNA, 22 bp, Artificial Sequence
  chemically synthesized
tagataaacaatggcaatgttg

SEQ ID NO: 903341 - DNA, 22 bp, Artificial Sequence
  chemically synthesized
tgacacctctcaacattgccat

SEQ ID NO: 903342 - DNA, 22 bp, Artificial Sequence
  chemically synthesized
ttctagataaacaatggcaatg

SEQ ID NO: 903343 - DNA, 22 bp, Artificial Sequence
  chemically synthesized
tcaacattgccattgtttatct

SEQ ID NO: 903344 - DNA, 22 bp, Artificial Sequence
  chemically synthesized
aacattgccattgtttatctag

SEQ ID NO: 903345 - DNA, 22 bp, Artificial Sequence
  chemically synthesized
gatgtcattgttctagataaac

SEQ ID NO: 903346 - DNA, 22 bp, Artificial Sequence
  chemically synthesized
ttggatgtcattgttctagata

SEQ ID NO: 903347 - DNA, 22 bp, Artificial Sequence
  chemically synthesized
attggatgtcattgttctagat

SEQ ID NO: 903348 - DNA, 22 bp, Artificial Sequence
  chemically synthesized
tattggatgtcattgttctaga

SEQ ID NO: 903349 - DNA, 22 bp, Artificial Sequence
  chemically synthesized
ccattgtttatctagaacaatg

SEQ ID NO: 903350 - DNA, 22 bp, Artificial Sequence
  chemically synthesized
taattttattggatgtcattgt

SEQ ID NO: 903351 - DNA, 22 bp, Artificial Sequence
  chemically synthesized
tttatctagaacaatgacatcc

SEQ ID NO: 903352 - DNA, 22 bp, Artificial Sequence
  chemically synthesized
attataattttattggatgtca

SEQ ID NO: 903353 - DNA, 22 bp, Artificial Sequence
  chemically synthesized
atctagaacaatgacatccaat

SEQ ID NO: 903354 - DNA, 22 bp, Artificial Sequence
  chemically synthesized
tctagaacaatgacatccaata

SEQ ID NO: 903355 - DNA, 22 bp, Artificial Sequence
  chemically synthesized
tcattataattttattggatgt

SEQ ID NO: 903356 - DNA, 22 bp, Artificial Sequence
  chemically synthesized
gaacaatgacatccaataaaat

SEQ ID NO: 903357 - DNA, 22 bp, Artificial Sequence
  chemically synthesized
catgtatcgctctcattataat

SEQ ID NO: 903358 - DNA, 22 bp, Artificial Sequence
  chemically synthesized
aattacatgtatcgctctcatt

SEQ ID NO: 903359 - DNA, 22 bp, Artificial Sequence
  chemically synthesized
aaattacatgtatcgctctcat

SEQ ID NO: 903360 - DNA, 22 bp, Artificial Sequence
  chemically synthesized
taaattacatgtatcgctctca

SEQ ID NO: 903361 - DNA, 22 bp, Artificial Sequence
  chemically synthesized
taatgagagcgatacatgtaat

SEQ ID NO: 903362 - DNA, 22 bp, Artificial Sequence
  chemically synthesized
taatgtgtagaaaattttaaat

SEQ ID NO: 903363 - DNA, 22 bp, Artificial Sequence
  chemically synthesized
gtaatgtgtagaaaattttaaa

SEQ ID NO: 903364 - DNA, 22 bp, Artificial Sequence
  chemically synthesized
tgtaatgtgtagaaaattttaa

SEQ ID NO: 903365 - DNA, 22 bp, Artificial Sequence
  chemically synthesized
ttgtaatgtgtagaaaatttta

SEQ ID NO: 903366 - DNA, 22 bp, Artificial Sequence
  chemically synthesized
cttttgtaatgtgtagaaaatt

SEQ ID NO: 903367 - DNA, 22 bp, Artificial Sequence
  chemically synthesized
acttttgtaatgtgtagaaaat

SEQ ID NO: 903368 - DNA, 22 bp, Artificial Sequence
  chemically synthesized
tacttttgtaatgtgtagaaaa

SEQ ID NO: 903369 - DNA, 22 bp, Artificial Sequence
  chemically synthesized
ttacttttgtaatgtgtagaaa

SEQ ID NO: 903370 - DNA, 22 bp, Artificial Sequence
  chemically synthesized
tttacttttgtaatgtgtagaa

SEQ ID NO: 903371 - DNA, 22 bp, Artificial Sequence
  chemically synthesized
ttttttacttttgtaatgtgta

SEQ ID NO: 903372 - DNA, 22 bp, Artificial Sequence
  chemically synthesized
aaaattttctacacattacaaa

SEQ ID NO: 903373 - DNA, 22 bp, Artificial Sequence
  chemically synthesized
aaattttctacacattacaaaa

SEQ ID NO: 903374 - DNA, 22 bp, Artificial Sequence
  chemically synthesized
acctgttttttacttttgtaat

SEQ ID NO: 903375 - DNA, 22 bp, Artificial Sequence
  chemically synthesized
gacctgttttttacttttgtaa

SEQ ID NO: 903376 - DNA, 22 bp, Artificial Sequence
  chemically synthesized
tctacacattacaaaagtaaaa

SEQ ID NO: 903377 - DNA, 22 bp, Artificial Sequence
  chemically synthesized
atttgacctgttttttactttt

SEQ ID NO: 903378 - DNA, 22 bp, Artificial Sequence
  chemically synthesized
ctacacattacaaaagtaaaaa

SEQ ID NO: 903379 - DNA, 22 bp, Artificial Sequence
  chemically synthesized
tacacattacaaaagtaaaaaa

SEQ ID NO: 903380 - DNA, 22 bp, Artificial Sequence
  chemically synthesized
cacattacaaaagtaaaaaaca

SEQ ID NO: 903381 - DNA, 22 bp, Artificial Sequence
  chemically synthesized
aaattaatttgacctgtttttt

SEQ ID NO: 903382 - DNA, 22 bp, Artificial Sequence
  chemically synthesized
caaaagtaaaaaacaggtcaaa

SEQ ID NO: 903383 - DNA, 22 bp, Artificial Sequence
  chemically synthesized
aagaaaatataacattaaaatt

SEQ ID NO: 903384 - DNA, 22 bp, Artificial Sequence
  chemically synthesized
agttaaagaaaatataacatta

SEQ ID NO: 903385 - DNA, 22 bp, Artificial Sequence
  chemically synthesized
aagttaaagaaaatataacatt

SEQ ID NO: 903386 - DNA, 22 bp, Artificial Sequence
  chemically synthesized
tttaagttaaagaaaatataac

SEQ ID NO: 903387 - DNA, 22 bp, Artificial Sequence
  chemically synthesized
attttaatgttatattttcttt

SEQ ID NO: 903388 - DNA, 22 bp, Artificial Sequence
  chemically synthesized
gctatttaagttaaagaaaata

SEQ ID NO: 903389 - DNA, 22 bp, Artificial Sequence
  chemically synthesized
ggctatttaagttaaagaaaat

SEQ ID NO: 903390 - DNA, 22 bp, Artificial Sequence
  chemically synthesized
taatgttatattttctttaact

SEQ ID NO: 903391 - DNA, 22 bp, Artificial Sequence
  chemically synthesized
aatgttatattttctttaactt

SEQ ID NO: 903392 - DNA, 22 bp, Artificial Sequence
  chemically synthesized
atgttatattttctttaactta

SEQ ID NO: 903393 - DNA, 22 bp, Artificial Sequence
  chemically synthesized
tattttctttaacttaaatagc

SEQ ID NO: 903394 - DNA, 22 bp, Artificial Sequence
  chemically synthesized
aagtgacaacaatttggctatt

SEQ ID NO: 903395 - DNA, 22 bp, Artificial Sequence
  chemically synthesized
tctttaacttaaatagccaaat

SEQ ID NO: 903396 - DNA, 22 bp, Artificial Sequence
  chemically synthesized
ctttaacttaaatagccaaatt

SEQ ID NO: 903397 - DNA, 22 bp, Artificial Sequence
  chemically synthesized
tttaacttaaatagccaaattg

SEQ ID NO: 903398 - DNA, 22 bp, Artificial Sequence
  chemically synthesized
taacttaaatagccaaattgtt

SEQ ID NO: 903399 - DNA, 22 bp, Artificial Sequence
  chemically synthesized
aacttaaatagccaaattgttg

SEQ ID NO: 903400 - DNA, 22 bp, Artificial Sequence
  chemically synthesized
acttaaatagccaaattgttgt

SEQ ID NO: 903401 - DNA, 22 bp, Artificial Sequence
  chemically synthesized
aaatagccaaattgttgtcact

SEQ ID NO: 903402 - DNA, 22 bp, Artificial Sequence
  chemically synthesized
agtacaggttgaagtgacaaca

SEQ ID NO: 903403 - DNA, 22 bp, Artificial Sequence
  chemically synthesized
aatagccaaattgttgtcactt

SEQ ID NO: 903404 - DNA, 22 bp, Artificial Sequence
  chemically synthesized
tattgagtacaggttgaagtga

SEQ ID NO: 903405 - DNA, 22 bp, Artificial Sequence
  chemically synthesized
atattgagtacaggttgaagtg

SEQ ID NO: 903406 - DNA, 22 bp, Artificial Sequence
  chemically synthesized
tatattgagtacaggttgaagt

SEQ ID NO: 903407 - DNA, 22 bp, Artificial Sequence
  chemically synthesized
ttatattgagtacaggttgaag

SEQ ID NO: 903408 - DNA, 22 bp, Artificial Sequence
  chemically synthesized
tttatattgagtacaggttgaa

SEQ ID NO: 903409 - DNA, 22 bp, Artificial Sequence
  chemically synthesized
ttgtcacttcaacctgtactca

SEQ ID NO: 903410 - DNA, 22 bp, Artificial Sequence
  chemically synthesized
gtactttttatattgagtacag

SEQ ID NO: 903411 - DNA, 22 bp, Artificial Sequence
  chemically synthesized
tcacttcaacctgtactcaata

SEQ ID NO: 903412 - DNA, 22 bp, Artificial Sequence
  chemically synthesized
attggtactttttatattgagt

SEQ ID NO: 903413 - DNA, 22 bp, Artificial Sequence
  chemically synthesized
caacctgtactcaatataaaaa

SEQ ID NO: 903414 - DNA, 22 bp, Artificial Sequence
  chemically synthesized
aacctgtactcaatataaaaag

SEQ ID NO: 903415 - DNA, 22 bp, Artificial Sequence
  chemically synthesized
tactcaatataaaaagtaccaa

SEQ ID NO: 903416 - DNA, 22 bp, Artificial Sequence
  chemically synthesized
aatataaaaagtaccaatgaga

SEQ ID NO: 903417 - DNA, 22 bp, Artificial Sequence
  chemically synthesized
agtatgaaaaaaataaaatatc

SEQ ID NO: 903418 - DNA, 22 bp, Artificial Sequence
  chemically synthesized
caaaacctaagtatgaaaaaaa

SEQ ID NO: 903419 - DNA, 22 bp, Artificial Sequence
  chemically synthesized
accaaattacaaaacctaagta

SEQ ID NO: 903420 - DNA, 22 bp, Artificial Sequence
  chemically synthesized
tatttttttcatacttaggttt

SEQ ID NO: 903421 - DNA, 22 bp, Artificial Sequence
  chemically synthesized
atttttttcatacttaggtttt

SEQ ID NO: 903422 - DNA, 22 bp, Artificial Sequence
  chemically synthesized
tttttttcatacttaggttttg

SEQ ID NO: 903423 - DNA, 22 bp, Artificial Sequence
  chemically synthesized
ttttcatacttaggttttgtaa

SEQ ID NO: 903424 - DNA, 22 bp, Artificial Sequence
  chemically synthesized
tttcatacttaggttttgtaat

SEQ ID NO: 903425 - DNA, 22 bp, Artificial Sequence
  chemically synthesized
ttcatacttaggttttgtaatt

SEQ ID NO: 903426 - DNA, 22 bp, Artificial Sequence
  chemically synthesized
tcatacttaggttttgtaattt

SEQ ID NO: 903427 - DNA, 22 bp, Artificial Sequence
  chemically synthesized
catacttaggttttgtaatttg

SEQ ID NO: 903428 - DNA, 22 bp, Artificial Sequence
  chemically synthesized
atacttaggttttgtaatttgg

SEQ ID NO: 903429 - DNA, 22 bp, Artificial Sequence
  chemically synthesized
taagtataaaacactcaccaaa

SEQ ID NO: 903430 - DNA, 22 bp, Artificial Sequence
  chemically synthesized
aggttttgtaatttggtgagtg

SEQ ID NO: 903431 - DNA, 22 bp, Artificial Sequence
  chemically synthesized
ggttttgtaatttggtgagtgt

SEQ ID NO: 903432 - DNA, 22 bp, Artificial Sequence
  chemically synthesized
tgtaatttggtgagtgttttat

SEQ ID NO: 903433 - DNA, 22 bp, Artificial Sequence
  chemically synthesized
gtaatttggtgagtgttttata

SEQ ID NO: 903434 - DNA, 22 bp, Artificial Sequence
  chemically synthesized
taatttggtgagtgttttatac

SEQ ID NO: 903435 - DNA, 22 bp, Artificial Sequence
  chemically synthesized
aaatgtgctgtaagtataaaac

SEQ ID NO: 903436 - DNA, 22 bp, Artificial Sequence
  chemically synthesized
ggtgagtgttttatacttacag

SEQ ID NO: 903437 - DNA, 22 bp, Artificial Sequence
  chemically synthesized
gtgagtgttttatacttacagc

SEQ ID NO: 903438 - DNA, 22 bp, Artificial Sequence
  chemically synthesized
gtccccactgaaatgtgctgta

SEQ ID NO: 903439 - DNA, 22 bp, Artificial Sequence
  chemically synthesized
tatacttacagcacatttcagt

SEQ ID NO: 903440 - DNA, 22 bp, Artificial Sequence
  chemically synthesized
atacttacagcacatttcagtg

SEQ ID NO: 903441 - DNA, 22 bp, Artificial Sequence
  chemically synthesized
tacttacagcacatttcagtgg

SEQ ID NO: 903442 - DNA, 22 bp, Artificial Sequence
  chemically synthesized
aaatatggctagtccccactga

SEQ ID NO: 903443 - DNA, 22 bp, Artificial Sequence
  chemically synthesized
gaaatatggctagtccccactg

SEQ ID NO: 903444 - DNA, 22 bp, Artificial Sequence
  chemically synthesized
acagcacatttcagtggggact

SEQ ID NO: 903445 - DNA, 22 bp, Artificial Sequence
  chemically synthesized
cagcacatttcagtggggacta

SEQ ID NO: 903446 - DNA, 22 bp, Artificial Sequence
  chemically synthesized
cagtggggactagccatatttc

SEQ ID NO: 903447 - DNA, 22 bp, Artificial Sequence
  chemically synthesized
agtggggactagccatatttca

SEQ ID NO: 903448 - DNA, 22 bp, Artificial Sequence
  chemically synthesized
ccatatgagcatttgaaatatg

SEQ ID NO: 903449 - DNA, 22 bp, Artificial Sequence
  chemically synthesized
gccatatttcaaatgctcatat

SEQ ID NO: 903450 - DNA, 22 bp, Artificial Sequence
  chemically synthesized
caaatgctcatatggtaggctg

SEQ ID NO: 903451 - DNA, 22 bp, Artificial Sequence
  chemically synthesized
aaatgctcatatggtaggctgt

SEQ ID NO: 903452 - DNA, 22 bp, Artificial Sequence
  chemically synthesized
caatgtggtaacaacagcctac

SEQ ID NO: 903453 - DNA, 22 bp, Artificial Sequence
  chemically synthesized
tccaatgtggtaacaacagcct

SEQ ID NO: 903454 - DNA, 22 bp, Artificial Sequence
  chemically synthesized
atatggtaggctgttgttacca

SEQ ID NO: 903455 - DNA, 22 bp, Artificial Sequence
  chemically synthesized
agatcagtgctctccaatgtgg

SEQ ID NO: 903456 - DNA, 22 bp, Artificial Sequence
  chemically synthesized
gagatcagtgctctccaatgtg

SEQ ID NO: 903457 - DNA, 22 bp, Artificial Sequence
  chemically synthesized
tgagatcagtgctctccaatgt

SEQ ID NO: 903458 - DNA, 22 bp, Artificial Sequence
  chemically synthesized
ctttgagatcagtgctctccaa

SEQ ID NO: 903459 - DNA, 22 bp, Artificial Sequence
  chemically synthesized
ttgttaccacattggagagcac

SEQ ID NO: 903460 - DNA, 22 bp, Artificial Sequence
  chemically synthesized
cctttgagatcagtgctctcca

SEQ ID NO: 903461 - DNA, 22 bp, Artificial Sequence
  chemically synthesized
tcctttgagatcagtgctctcc

SEQ ID NO: 903462 - DNA, 22 bp, Artificial Sequence
  chemically synthesized
ttaccacattggagagcactga

SEQ ID NO: 903463 - DNA, 22 bp, Artificial Sequence
  chemically synthesized
ccacattggagagcactgatct

SEQ ID NO: 903464 - DNA, 22 bp, Artificial Sequence
  chemically synthesized
gagagcactgatctcaaaggaa

SEQ ID NO: 903465 - DNA, 22 bp, Artificial Sequence
  chemically synthesized
gacgaaatgtccaactttcctt

SEQ ID NO: 903466 - DNA, 22 bp, Artificial Sequence
  chemically synthesized
ggacgaaatgtccaactttcct

SEQ ID NO: 903467 - DNA, 22 bp, Artificial Sequence
  chemically synthesized
atctcaaaggaaagttggacat

SEQ ID NO: 903468 - DNA, 22 bp, Artificial Sequence
  chemically synthesized
aaaggaaagttggacatttcgt

SEQ ID NO: 903469 - DNA, 22 bp, Artificial Sequence
  chemically synthesized
aacaaaaacttggacgaaatgt

SEQ ID NO: 903470 - DNA, 22 bp, Artificial Sequence
  chemically synthesized
gaacaaaaacttggacgaaatg

SEQ ID NO: 903471 - DNA, 22 bp, Artificial Sequence
  chemically synthesized
tttgaacaaaaacttggacgaa

SEQ ID NO: 903472 - DNA, 22 bp, Artificial Sequence
  chemically synthesized
atttgaacaaaaacttggacga

SEQ ID NO: 903473 - DNA, 22 bp, Artificial Sequence
  chemically synthesized
tatttgaacaaaaacttggacg

SEQ ID NO: 903474 - DNA, 22 bp, Artificial Sequence
  chemically synthesized
ttatttgaacaaaaacttggac

SEQ ID NO: 903475 - DNA, 22 bp, Artificial Sequence
  chemically synthesized
tttatttgaacaaaaacttgga

SEQ ID NO: 903476 - DNA, 22 bp, Artificial Sequence
  chemically synthesized
gacatttcgtccaagtttttgt

SEQ ID NO: 903477 - DNA, 22 bp, Artificial Sequence
  chemically synthesized
atcagttttttatttgaacaaa

SEQ ID NO: 903478 - DNA, 22 bp, Artificial Sequence
  chemically synthesized
aatcagttttttatttgaacaa

SEQ ID NO: 903479 - DNA, 22 bp, Artificial Sequence
  chemically synthesized
cgtccaagtttttgttcaaata

SEQ ID NO: 903480 - DNA, 22 bp, Artificial Sequence
  chemically synthesized
gtccaagtttttgttcaaataa

SEQ ID NO: 903481 - DNA, 22 bp, Artificial Sequence
  chemically synthesized
aaagtttaatcagttttttatt

SEQ ID NO: 903482 - DNA, 22 bp, Artificial Sequence
  chemically synthesized
ctcaaagtttaatcagtttttt

SEQ ID NO: 903483 - DNA, 22 bp, Artificial Sequence
  chemically synthesized
gctcaaagtttaatcagttttt

SEQ ID NO: 903484 - DNA, 22 bp, Artificial Sequence
  chemically synthesized
ttgttcaaataaaaaactgatt

SEQ ID NO: 903485 - DNA, 22 bp, Artificial Sequence
  chemically synthesized
tgttcaaataaaaaactgatta

SEQ ID NO: 903486 - DNA, 22 bp, Artificial Sequence
  chemically synthesized
gttcaaataaaaaactgattaa

SEQ ID NO: 903487 - DNA, 22 bp, Artificial Sequence
  chemically synthesized
ttcaaataaaaaactgattaaa

SEQ ID NO: 903488 - DNA, 22 bp, Artificial Sequence
  chemically synthesized
atatttgctcaaagtttaatca

SEQ ID NO: 903489 - DNA, 22 bp, Artificial Sequence
  chemically synthesized
aaataaaaaactgattaaactt

SEQ ID NO: 903490 - DNA, 22 bp, Artificial Sequence
  chemically synthesized
ataagaataattcatatttgct

SEQ ID NO: 903491 - DNA, 22 bp, Artificial Sequence
  chemically synthesized
attaaactttgagcaaatatga

SEQ ID NO: 903492 - DNA, 22 bp, Artificial Sequence
  chemically synthesized
aactttgagcaaatatgaatta

SEQ ID NO: 903493 - DNA, 22 bp, Artificial Sequence
  chemically synthesized
tgagcaaatatgaattattctt

SEQ ID NO: 903494 - DNA, 22 bp, Artificial Sequence
  chemically synthesized
gagcaaatatgaattattctta

SEQ ID NO: 903495 - DNA, 22 bp, Artificial Sequence
  chemically synthesized
agcaaatatgaattattcttat

SEQ ID NO: 903496 - DNA, 22 bp, Artificial Sequence
  chemically synthesized
agaggaagaaacaataagagac

SEQ ID NO: 903497 - DNA, 22 bp, Artificial Sequence
  chemically synthesized
gagaggaagaaacaataagaga

SEQ ID NO: 903498 - DNA, 22 bp, Artificial Sequence
  chemically synthesized
tgagaggaagaaacaataagag

SEQ ID NO: 903499 - DNA, 22 bp, Artificial Sequence
  chemically synthesized
ttcttatcagtctcttattgtt

SEQ ID NO: 903500 - DNA, 22 bp, Artificial Sequence
  chemically synthesized
ttgagaggaagaaacaataaga

SEQ ID NO: 903501 - DNA, 22 bp, Artificial Sequence
  chemically synthesized
ttatcagtctcttattgtttct

SEQ ID NO: 903502 - DNA, 22 bp, Artificial Sequence
  chemically synthesized
atcagtctcttattgtttcttc

SEQ ID NO: 903503 - DNA, 22 bp, Artificial Sequence
  chemically synthesized
tcagtctcttattgtttcttcc

SEQ ID NO: 903504 - DNA, 22 bp, Artificial Sequence
  chemically synthesized
cgaatatttttgagaggaagaa

SEQ ID NO: 903505 - DNA, 22 bp, Artificial Sequence
  chemically synthesized
ttattgtttcttcctctcaaaa

SEQ ID NO: 903506 - DNA, 22 bp, Artificial Sequence
  chemically synthesized
attgtttcttcctctcaaaaat

SEQ ID NO: 903507 - DNA, 22 bp, Artificial Sequence
  chemically synthesized
ttgtttcttcctctcaaaaata

SEQ ID NO: 903508 - DNA, 22 bp, Artificial Sequence
  chemically synthesized
taatattgcgaatatttttgag

SEQ ID NO: 903509 - DNA, 22 bp, Artificial Sequence
  chemically synthesized
ataatattgcgaatatttttga

SEQ ID NO: 903510 - DNA, 22 bp, Artificial Sequence
  chemically synthesized
tataatattgcgaatatttttg

SEQ ID NO: 903511 - DNA, 22 bp, Artificial Sequence
  chemically synthesized
tttcttcctctcaaaaatattc

SEQ ID NO: 903512 - DNA, 22 bp, Artificial Sequence
  chemically synthesized
cttcctctcaaaaatattcgca

SEQ ID NO: 903513 - DNA, 22 bp, Artificial Sequence
  chemically synthesized
gttttataatattgcgaatatt

SEQ ID NO: 903514 - DNA, 22 bp, Artificial Sequence
  chemically synthesized
ttcctctcaaaaatattcgcaa

SEQ ID NO: 903515 - DNA, 22 bp, Artificial Sequence
  chemically synthesized
cctctcaaaaatattcgcaata

SEQ ID NO: 903516 - DNA, 22 bp, Artificial Sequence
  chemically synthesized
ctggttttataatattgcgaat

SEQ ID NO: 903517 - DNA, 22 bp, Artificial Sequence
  chemically synthesized
ctctcaaaaatattcgcaatat

SEQ ID NO: 903518 - DNA, 22 bp, Artificial Sequence
  chemically synthesized
tcaaaaatattcgcaatattat

SEQ ID NO: 903519 - DNA, 22 bp, Artificial Sequence
  chemically synthesized
aaaaatattcgcaatattataa

SEQ ID NO: 903520 - DNA, 22 bp, Artificial Sequence
  chemically synthesized
acattgctggttttataatatt

SEQ ID NO: 903521 - DNA, 22 bp, Artificial Sequence
  chemically synthesized
aacattgctggttttataatat

SEQ ID NO: 903522 - DNA, 22 bp, Artificial Sequence
  chemically synthesized
gcaatattataaaaccagcaat

SEQ ID NO: 903523 - DNA, 22 bp, Artificial Sequence
  chemically synthesized
agtatgtttaacattgctggtt

SEQ ID NO: 903524 - DNA, 22 bp, Artificial Sequence
  chemically synthesized
taaaaccagcaatgttaaacat

SEQ ID NO: 903525 - DNA, 22 bp, Artificial Sequence
  chemically synthesized
aaatggtgagttcagtatgttt

SEQ ID NO: 903526 - DNA, 22 bp, Artificial Sequence
  chemically synthesized
caaatggtgagttcagtatgtt

SEQ ID NO: 903527 - DNA, 22 bp, Artificial Sequence
  chemically synthesized
tcaaatggtgagttcagtatgt

SEQ ID NO: 903528 - DNA, 22 bp, Artificial Sequence
  chemically synthesized
ttcaaatggtgagttcagtatg

SEQ ID NO: 903529 - DNA, 22 bp, Artificial Sequence
  chemically synthesized
tttcaaatggtgagttcagtat

SEQ ID NO: 903530 - DNA, 22 bp, Artificial Sequence
  chemically synthesized
catctttttcaaatggtgagtt

SEQ ID NO: 903531 - DNA, 22 bp, Artificial Sequence
  chemically synthesized
ccatctttttcaaatggtgagt

SEQ ID NO: 903532 - DNA, 22 bp, Artificial Sequence
  chemically synthesized
aacatactgaactcaccatttg

SEQ ID NO: 903533 - DNA, 22 bp, Artificial Sequence
  chemically synthesized
tcttccatctttttcaaatggt

SEQ ID NO: 903534 - DNA, 22 bp, Artificial Sequence
  chemically synthesized
atcttccatctttttcaaatgg

SEQ ID NO: 903535 - DNA, 22 bp, Artificial Sequence
  chemically synthesized
ttatcttccatctttttcaaat

SEQ ID NO: 903536 - DNA, 22 bp, Artificial Sequence
  chemically synthesized
aactcaccatttgaaaaagatg

SEQ ID NO: 903537 - DNA, 22 bp, Artificial Sequence
  chemically synthesized
accatttgaaaaagatggaaga

SEQ ID NO: 903538 - DNA, 22 bp, Artificial Sequence
  chemically synthesized
tgaaaatgattcttatcttcca

SEQ ID NO: 903539 - DNA, 22 bp, Artificial Sequence
  chemically synthesized
ttgtgaaaatgattcttatctt

SEQ ID NO: 903540 - DNA, 22 bp, Artificial Sequence
  chemically synthesized
gaaaaagatggaagataagaat

SEQ ID NO: 903541 - DNA, 22 bp, Artificial Sequence
  chemically synthesized
attgtgaaaatgattcttatct

SEQ ID NO: 903542 - DNA, 22 bp, Artificial Sequence
  chemically synthesized
aaaaagatggaagataagaatc

SEQ ID NO: 903543 - DNA, 22 bp, Artificial Sequence
  chemically synthesized
tcacaataaatgctgtaccata

SEQ ID NO: 903544 - DNA, 22 bp, Artificial Sequence
  chemically synthesized
gtgtggggatagtatggtacag

SEQ ID NO: 903545 - DNA, 22 bp, Artificial Sequence
  chemically synthesized
cacaataaatgctgtaccatac

SEQ ID NO: 903546 - DNA, 22 bp, Artificial Sequence
  chemically synthesized
ggtgtggggatagtatggtaca

SEQ ID NO: 903547 - DNA, 22 bp, Artificial Sequence
  chemically synthesized
acaataaatgctgtaccatact

SEQ ID NO: 903548 - DNA, 22 bp, Artificial Sequence
  chemically synthesized
tggtgtggggatagtatggtac

SEQ ID NO: 903549 - DNA, 22 bp, Artificial Sequence
  chemically synthesized
ctttggtgtggggatagtatgg

SEQ ID NO: 903550 - DNA, 22 bp, Artificial Sequence
  chemically synthesized
taccatactatccccacaccaa

SEQ ID NO: 903551 - DNA, 22 bp, Artificial Sequence
  chemically synthesized
aaataacaaaatggctgctttg

SEQ ID NO: 903552 - DNA, 22 bp, Artificial Sequence
  chemically synthesized
aaaataacaaaatggctgcttt

SEQ ID NO: 903553 - DNA, 22 bp, Artificial Sequence
  chemically synthesized
tccccacaccaaagcagccatt

SEQ ID NO: 903554 - DNA, 22 bp, Artificial Sequence
  chemically synthesized
ttaaaataacaaaatggctgct

SEQ ID NO: 903555 - DNA, 22 bp, Artificial Sequence
  chemically synthesized
cttaaaataacaaaatggctgc

SEQ ID NO: 903556 - DNA, 22 bp, Artificial Sequence
  chemically synthesized
atatgtatttcttaaaataaca

SEQ ID NO: 903557 - DNA, 22 bp, Artificial Sequence
  chemically synthesized
catatgtatttcttaaaataac

SEQ ID NO: 903558 - DNA, 22 bp, Artificial Sequence
  chemically synthesized
tcatatgtatttcttaaaataa

SEQ ID NO: 903559 - DNA, 22 bp, Artificial Sequence
  chemically synthesized
tgttattttaagaaatacatat

SEQ ID NO: 903560 - DNA, 22 bp, Artificial Sequence
  chemically synthesized
gttattttaagaaatacatatg

SEQ ID NO: 903561 - DNA, 22 bp, Artificial Sequence
  chemically synthesized
ttattttaagaaatacatatga

SEQ ID NO: 903562 - DNA, 22 bp, Artificial Sequence
  chemically synthesized
acagaagaattttcatatgtat

SEQ ID NO: 903563 - DNA, 22 bp, Artificial Sequence
  chemically synthesized
ttttaagaaatacatatgaaaa

SEQ ID NO: 903564 - DNA, 22 bp, Artificial Sequence
  chemically synthesized
taagaaatacatatgaaaattc

SEQ ID NO: 903565 - DNA, 22 bp, Artificial Sequence
  chemically synthesized
aagaaatacatatgaaaattct

SEQ ID NO: 903566 - DNA, 22 bp, Artificial Sequence
  chemically synthesized
agtattcacagaagaattttca

SEQ ID NO: 903567 - DNA, 22 bp, Artificial Sequence
  chemically synthesized
agaaatacatatgaaaattctt

SEQ ID NO: 903568 - DNA, 22 bp, Artificial Sequence
  chemically synthesized
cagtattcacagaagaattttc

SEQ ID NO: 903569 - DNA, 22 bp, Artificial Sequence
  chemically synthesized
tcagtattcacagaagaatttt

SEQ ID NO: 903570 - DNA, 22 bp, Artificial Sequence
  chemically synthesized
ctttcagtattcacagaagaat

SEQ ID NO: 903571 - DNA, 22 bp, Artificial Sequence
  chemically synthesized
gctttcagtattcacagaagaa

SEQ ID NO: 903572 - DNA, 22 bp, Artificial Sequence
  chemically synthesized
tacccacatttgctttcagtat

SEQ ID NO: 903573 - DNA, 22 bp, Artificial Sequence
  chemically synthesized
atacccacatttgctttcagta

SEQ ID NO: 903574 - DNA, 22 bp, Artificial Sequence
  chemically synthesized
ttctgtgaatactgaaagcaaa

SEQ ID NO: 903575 - DNA, 22 bp, Artificial Sequence
  chemically synthesized
ctgtgaatactgaaagcaaatg

SEQ ID NO: 903576 - DNA, 22 bp, Artificial Sequence
  chemically synthesized
tgtgaatactgaaagcaaatgt

SEQ ID NO: 903577 - DNA, 22 bp, Artificial Sequence
  chemically synthesized
tgaatactgaaagcaaatgtgg

SEQ ID NO: 903578 - DNA, 22 bp, Artificial Sequence
  chemically synthesized
cataagcagagatttataccca

SEQ ID NO: 903579 - DNA, 22 bp, Artificial Sequence
  chemically synthesized
aaagcaaatgtgggtataaatc

SEQ ID NO: 903580 - DNA, 22 bp, Artificial Sequence
  chemically synthesized
ttgcataagcagagatttatac

SEQ ID NO: 903581 - DNA, 22 bp, Artificial Sequence
  chemically synthesized
attgcataagcagagatttata

SEQ ID NO: 903582 - DNA, 22 bp, Artificial Sequence
  chemically synthesized
tattgcataagcagagatttat

SEQ ID NO: 903583 - DNA, 22 bp, Artificial Sequence
  chemically synthesized
agtatacattttattgcataag

SEQ ID NO: 903584 - DNA, 22 bp, Artificial Sequence
  chemically synthesized
aagtatacattttattgcataa

SEQ ID NO: 903585 - DNA, 22 bp, Artificial Sequence
  chemically synthesized
taagtatacattttattgcata

SEQ ID NO: 903586 - DNA, 22 bp, Artificial Sequence
  chemically synthesized
tgcttatgcaataaaatgtata

SEQ ID NO: 903587 - DNA, 22 bp, Artificial Sequence
  chemically synthesized
cttatgcaataaaatgtatact

SEQ ID NO: 903588 - DNA, 22 bp, Artificial Sequence
  chemically synthesized
taatgtaattttaagtatacat

SEQ ID NO: 903589 - DNA, 22 bp, Artificial Sequence
  chemically synthesized
atgcaataaaatgtatacttaa

SEQ ID NO: 903590 - DNA, 22 bp, Artificial Sequence
  chemically synthesized
tgcaataaaatgtatacttaaa

SEQ ID NO: 903591 - DNA, 22 bp, Artificial Sequence
  chemically synthesized
atctgtaatgtaattttaagta

SEQ ID NO: 903592 - DNA, 22 bp, Artificial Sequence
  chemically synthesized
catctgtaatgtaattttaagt

SEQ ID NO: 903593 - DNA, 22 bp, Artificial Sequence
  chemically synthesized
ttcatctgtaatgtaattttaa

SEQ ID NO: 903594 - DNA, 22 bp, Artificial Sequence
  chemically synthesized
tgtatgattcttcatctgtaat

SEQ ID NO: 903595 - DNA, 22 bp, Artificial Sequence
  chemically synthesized
aaaattacattacagatgaaga

SEQ ID NO: 903596 - DNA, 22 bp, Artificial Sequence
  chemically synthesized
aaattacattacagatgaagaa

SEQ ID NO: 903597 - DNA, 22 bp, Artificial Sequence
  chemically synthesized
cattacagatgaagaatcatac

SEQ ID NO: 903598 - DNA, 22 bp, Artificial Sequence
  chemically synthesized
cagatgaagaatcatacatagc

SEQ ID NO: 903599 - DNA, 22 bp, Artificial Sequence
  chemically synthesized
caaacagaaatgtcaaaataca

SEQ ID NO: 903600 - DNA, 22 bp, Artificial Sequence
  chemically synthesized
tacctttgctgtattttgacat

SEQ ID NO: 903601 - DNA, 22 bp, Artificial Sequence
  chemically synthesized
ttgcaaacagaaatgtcaaaat

SEQ ID NO: 903602 - DNA, 22 bp, Artificial Sequence
  chemically synthesized
attgcaaacagaaatgtcaaaa

SEQ ID NO: 903603 - DNA, 22 bp, Artificial Sequence
  chemically synthesized
cctttgctgtattttgacattt

SEQ ID NO: 903604 - DNA, 22 bp, Artificial Sequence
  chemically synthesized
tattgcaaacagaaatgtcaaa

SEQ ID NO: 903605 - DNA, 22 bp, Artificial Sequence
  chemically synthesized
ttattgcaaacagaaatgtcaa

SEQ ID NO: 903606 - DNA, 22 bp, Artificial Sequence
  chemically synthesized
tgctgtattttgacatttctgt

SEQ ID NO: 903607 - DNA, 22 bp, Artificial Sequence
  chemically synthesized
gctgtattttgacatttctgtt

SEQ ID NO: 903608 - DNA, 22 bp, Artificial Sequence
  chemically synthesized
ctgtattttgacatttctgttt

SEQ ID NO: 903609 - DNA, 22 bp, Artificial Sequence
  chemically synthesized
tattttgacatttctgtttgca

SEQ ID NO: 903610 - DNA, 22 bp, Artificial Sequence
  chemically synthesized
aaaagcttttattgcaaacaga

SEQ ID NO: 903611 - DNA, 22 bp, Artificial Sequence
  chemically synthesized
ttaaaaagcttttattgcaaac

SEQ ID NO: 903612 - DNA, 22 bp, Artificial Sequence
  chemically synthesized
tgacatttctgtttgcaataaa

SEQ ID NO: 903613 - DNA, 22 bp, Artificial Sequence
  chemically synthesized
tattaaaaagcttttattgcaa

SEQ ID NO: 903614 - DNA, 22 bp, Artificial Sequence
  chemically synthesized
gacatttctgtttgcaataaaa

SEQ ID NO: 903615 - DNA, 22 bp, Artificial Sequence
  chemically synthesized
acatttctgtttgcaataaaag

SEQ ID NO: 903616 - DNA, 22 bp, Artificial Sequence
  chemically synthesized
tgcctctattaaaaagctttta

SEQ ID NO: 903617 - DNA, 22 bp, Artificial Sequence
  chemically synthesized
ctgtttgcaataaaagcttttt

SEQ ID NO: 903618 - DNA, 22 bp, Artificial Sequence
  chemically synthesized
tgtttgcaataaaagcttttta

SEQ ID NO: 903619 - DNA, 22 bp, Artificial Sequence
  chemically synthesized
tttgcaataaaagctttttaat

SEQ ID NO: 903620 - DNA, 22 bp, Artificial Sequence
  chemically synthesized
gcaataaaagctttttaataga

SEQ ID NO: 903621 - DNA, 22 bp, Artificial Sequence
  chemically synthesized
caataaaagctttttaatagag

SEQ ID NO: 903622 - DNA, 22 bp, Artificial Sequence
  chemically synthesized
atgaagagctgtgcctctatta

SEQ ID NO: 903623 - DNA, 22 bp, Artificial Sequence
  chemically synthesized
tattcatgaagagctgtgcctc

SEQ ID NO: 903624 - DNA, 22 bp, Artificial Sequence
  chemically synthesized
ctatattcatgaagagctgtgc

SEQ ID NO: 903625 - DNA, 22 bp, Artificial Sequence
  chemically synthesized
actatattcatgaagagctgtg

SEQ ID NO: 903626 - DNA, 22 bp, Artificial Sequence
  chemically synthesized
tttaatagaggcacagctcttc

SEQ ID NO: 903627 - DNA, 22 bp, Artificial Sequence
  chemically synthesized
ttaatagaggcacagctcttca

SEQ ID NO: 903628 - DNA, 22 bp, Artificial Sequence
  chemically synthesized
taatagaggcacagctcttcat

SEQ ID NO: 903629 - DNA, 22 bp, Artificial Sequence
  chemically synthesized
aatagaggcacagctcttcatg

SEQ ID NO: 903630 - DNA, 22 bp, Artificial Sequence
  chemically synthesized
atagaggcacagctcttcatga

SEQ ID NO: 903631 - DNA, 22 bp, Artificial Sequence
  chemically synthesized
aaatccttactatattcatgaa

SEQ ID NO: 903632 - DNA, 22 bp, Artificial Sequence
  chemically synthesized
gtaactaaaatccttactatat

SEQ ID NO: 903633 - DNA, 22 bp, Artificial Sequence
  chemically synthesized
ctagtaactaaaatccttacta

SEQ ID NO: 903634 - DNA, 22 bp, Artificial Sequence
  chemically synthesized
cctagtaactaaaatccttact

SEQ ID NO: 903635 - DNA, 22 bp, Artificial Sequence
  chemically synthesized
ttcatgaatatagtaaggattt

SEQ ID NO: 903636 - DNA, 22 bp, Artificial Sequence
  chemically synthesized
catgaatatagtaaggatttta

SEQ ID NO: 903637 - DNA, 22 bp, Artificial Sequence
  chemically synthesized
tttcctagtaactaaaatcctt

SEQ ID NO: 903638 - DNA, 22 bp, Artificial Sequence
  chemically synthesized
atgaatatagtaaggattttag

SEQ ID NO: 903639 - DNA, 22 bp, Artificial Sequence
  chemically synthesized
atttcctagtaactaaaatcct

SEQ ID NO: 903640 - DNA, 22 bp, Artificial Sequence
  chemically synthesized
ttatttcctagtaactaaaatc

SEQ ID NO: 903641 - DNA, 22 bp, Artificial Sequence
  chemically synthesized
cttatttcctagtaactaaaat

SEQ ID NO: 903642 - DNA, 22 bp, Artificial Sequence
  chemically synthesized
tcttatttcctagtaactaaaa

SEQ ID NO: 903643 - DNA, 22 bp, Artificial Sequence
  chemically synthesized
tttcttatttcctagtaactaa

SEQ ID NO: 903644 - DNA, 22 bp, Artificial Sequence
  chemically synthesized
aagtaatgttctttcttatttc

SEQ ID NO: 903645 - DNA, 22 bp, Artificial Sequence
  chemically synthesized
tagttactaggaaataagaaag

SEQ ID NO: 903646 - DNA, 22 bp, Artificial Sequence
  chemically synthesized
agttactaggaaataagaaaga

SEQ ID NO: 903647 - DNA, 22 bp, Artificial Sequence
  chemically synthesized
gttactaggaaataagaaagaa

SEQ ID NO: 903648 - DNA, 22 bp, Artificial Sequence
  chemically synthesized
aatattgaagtaatgttctttc

SEQ ID NO: 903649 - DNA, 22 bp, Artificial Sequence
  chemically synthesized
ctaggaaataagaaagaacatt

SEQ ID NO: 903650 - DNA, 22 bp, Artificial Sequence
  chemically synthesized
ggaaataagaaagaacattact

SEQ ID NO: 903651 - DNA, 22 bp, Artificial Sequence
  chemically synthesized
agaactcaatattgaagtaatg

SEQ ID NO: 903652 - DNA, 22 bp, Artificial Sequence
  chemically synthesized
tgttaagaactcaatattgaag

SEQ ID NO: 903653 - DNA, 22 bp, Artificial Sequence
  chemically synthesized
atgttaagaactcaatattgaa

SEQ ID NO: 903654 - DNA, 22 bp, Artificial Sequence
  chemically synthesized
atttatgttaagaactcaatat

SEQ ID NO: 903655 - DNA, 22 bp, Artificial Sequence
  chemically synthesized
tcatttatgttaagaactcaat

SEQ ID NO: 903656 - DNA, 22 bp, Artificial Sequence
  chemically synthesized
cttcaatattgagttcttaaca

SEQ ID NO: 903657 - DNA, 22 bp, Artificial Sequence
  chemically synthesized
tgctctcatttatgttaagaac

SEQ ID NO: 903658 - DNA, 22 bp, Artificial Sequence
  chemically synthesized
atgctctcatttatgttaagaa

SEQ ID NO: 903659 - DNA, 22 bp, Artificial Sequence
  chemically synthesized
tatgctctcatttatgttaaga

SEQ ID NO: 903660 - DNA, 22 bp, Artificial Sequence
  chemically synthesized
caatattgagttcttaacataa

SEQ ID NO: 903661 - DNA, 22 bp, Artificial Sequence
  chemically synthesized
ttatgctctcatttatgttaag

SEQ ID NO: 903662 - DNA, 22 bp, Artificial Sequence
  chemically synthesized
aatattgagttcttaacataaa

SEQ ID NO: 903663 - DNA, 22 bp, Artificial Sequence
  chemically synthesized
agttcttaacataaatgagagc

SEQ ID NO: 903664 - DNA, 22 bp, Artificial Sequence
  chemically synthesized
acgtaatttttatgctctcatt

SEQ ID NO: 903665 - DNA, 22 bp, Artificial Sequence
  chemically synthesized
gacgtaatttttatgctctcat

SEQ ID NO: 903666 - DNA, 22 bp, Artificial Sequence
  chemically synthesized
tgacgtaatttttatgctctca

SEQ ID NO: 903667 - DNA, 22 bp, Artificial Sequence
  chemically synthesized
ttaacataaatgagagcataaa

SEQ ID NO: 903668 - DNA, 22 bp, Artificial Sequence
  chemically synthesized
aacataaatgagagcataaaaa

SEQ ID NO: 903669 - DNA, 22 bp, Artificial Sequence
  chemically synthesized
acataaatgagagcataaaaat

SEQ ID NO: 903670 - DNA, 22 bp, Artificial Sequence
  chemically synthesized
aagatatctttgacgtaatttt

SEQ ID NO: 903671 - DNA, 22 bp, Artificial Sequence
  chemically synthesized
gtaaaatctaaagatatctttg

SEQ ID NO: 903672 - DNA, 22 bp, Artificial Sequence
  chemically synthesized
ctagtaaaatctaaagatatct

SEQ ID NO: 903673 - DNA, 22 bp, Artificial Sequence
  chemically synthesized
cctagtaaaatctaaagatatc

SEQ ID NO: 903674 - DNA, 22 bp, Artificial Sequence
  chemically synthesized
cgtcaaagatatctttagattt

SEQ ID NO: 903675 - DNA, 22 bp, Artificial Sequence
  chemically synthesized
tggcaaatatttcctagtaaaa

SEQ ID NO: 903676 - DNA, 22 bp, Artificial Sequence
  chemically synthesized
tagattttactaggaaatattt

SEQ ID NO: 903677 - DNA, 22 bp, Artificial Sequence
  chemically synthesized
agattttactaggaaatatttg

SEQ ID NO: 903678 - DNA, 22 bp, Artificial Sequence
  chemically synthesized
gattttactaggaaatatttgc

SEQ ID NO: 903679 - DNA, 22 bp, Artificial Sequence
  chemically synthesized
aaaagtattgtggcaaatattt

SEQ ID NO: 903680 - DNA, 22 bp, Artificial Sequence
  chemically synthesized
caaaagtattgtggcaaatatt

SEQ ID NO: 903681 - DNA, 22 bp, Artificial Sequence
  chemically synthesized
tcaaaagtattgtggcaaatat

SEQ ID NO: 903682 - DNA, 22 bp, Artificial Sequence
  chemically synthesized
ttcaaaagtattgtggcaaata

SEQ ID NO: 903683 - DNA, 22 bp, Artificial Sequence
  chemically synthesized
tttcaaaagtattgtggcaaat

SEQ ID NO: 903684 - DNA, 22 bp, Artificial Sequence
  chemically synthesized
tactaggaaatatttgccacaa

SEQ ID NO: 903685 - DNA, 22 bp, Artificial Sequence
  chemically synthesized
actaggaaatatttgccacaat

SEQ ID NO: 903686 - DNA, 22 bp, Artificial Sequence
  chemically synthesized
ctaggaaatatttgccacaata

SEQ ID NO: 903687 - DNA, 22 bp, Artificial Sequence
  chemically synthesized
ttttttcaaaagtattgtggca

SEQ ID NO: 903688 - DNA, 22 bp, Artificial Sequence
  chemically synthesized
ggaaatatttgccacaatactt

SEQ ID NO: 903689 - DNA, 22 bp, Artificial Sequence
  chemically synthesized
ttattttttcaaaagtattgtg

SEQ ID NO: 903690 - DNA, 22 bp, Artificial Sequence
  chemically synthesized
ctattattttttcaaaagtatt

SEQ ID NO: 903691 - DNA, 22 bp, Artificial Sequence
  chemically synthesized
gccacaatacttttgaaaaaat

SEQ ID NO: 903692 - DNA, 22 bp, Artificial Sequence
  chemically synthesized
ccacaatacttttgaaaaaata

SEQ ID NO: 903693 - DNA, 22 bp, Artificial Sequence
  chemically synthesized
taaaattcctattattttttca

SEQ ID NO: 903694 - DNA, 22 bp, Artificial Sequence
  chemically synthesized
ttgaaaaaataataggaatttt

SEQ ID NO: 903695 - DNA, 22 bp, Artificial Sequence
  chemically synthesized
tgaaaaaataataggaatttta

SEQ ID NO: 903696 - DNA, 22 bp, Artificial Sequence
  chemically synthesized
gaaaaaataataggaattttat

SEQ ID NO: 903697 - DNA, 22 bp, Artificial Sequence
  chemically synthesized
aaaaaataataggaattttata

SEQ ID NO: 903698 - DNA, 22 bp, Artificial Sequence
  chemically synthesized
tataatgaatgtctataaaatt

SEQ ID NO: 903699 - DNA, 22 bp, Artificial Sequence
  chemically synthesized
atataatgaatgtctataaaat

SEQ ID NO: 903700 - DNA, 22 bp, Artificial Sequence
  chemically synthesized
tatataatgaatgtctataaaa

SEQ ID NO: 903701 - DNA, 22 bp, Artificial Sequence
  chemically synthesized
ttatataatgaatgtctataaa

SEQ ID NO: 903702 - DNA, 22 bp, Artificial Sequence
  chemically synthesized
tttatataatgaatgtctataa

SEQ ID NO: 903703 - DNA, 22 bp, Artificial Sequence
  chemically synthesized
ttttttatataatgaatgtcta

SEQ ID NO: 903704 - DNA, 22 bp, Artificial Sequence
  chemically synthesized
attttttatataatgaatgtct

SEQ ID NO: 903705 - DNA, 22 bp, Artificial Sequence
  chemically synthesized
tattttttatataatgaatgtc

SEQ ID NO: 903706 - DNA, 22 bp, Artificial Sequence
  chemically synthesized
tatagacattcattatataaaa

SEQ ID NO: 903707 - DNA, 22 bp, Artificial Sequence
  chemically synthesized
atagacattcattatataaaaa

SEQ ID NO: 903708 - DNA, 22 bp, Artificial Sequence
  chemically synthesized
tagacattcattatataaaaaa

SEQ ID NO: 903709 - DNA, 22 bp, Artificial Sequence
  chemically synthesized
atatatggtgttttatttttta

SEQ ID NO: 903710 - DNA, 22 bp, Artificial Sequence
  chemically synthesized
catatatggtgttttatttttt

SEQ ID NO: 903711 - DNA, 22 bp, Artificial Sequence
  chemically synthesized
tcatatatggtgttttattttt

SEQ ID NO: 903712 - DNA, 22 bp, Artificial Sequence
  chemically synthesized
attatataaaaaataaaacacc

SEQ ID NO: 903713 - DNA, 22 bp, Artificial Sequence
  chemically synthesized
atattttcatatatggtgtttt

SEQ ID NO: 903714 - DNA, 22 bp, Artificial Sequence
  chemically synthesized
tataaaaaataaaacaccatat

SEQ ID NO: 903715 - DNA, 22 bp, Artificial Sequence
  chemically synthesized
tcatattttcatatatggtgtt

SEQ ID NO: 903716 - DNA, 22 bp, Artificial Sequence
  chemically synthesized
aactctcatattttcatatatg

SEQ ID NO: 903717 - DNA, 22 bp, Artificial Sequence
  chemically synthesized
aaactctcatattttcatatat

SEQ ID NO: 903718 - DNA, 22 bp, Artificial Sequence
  chemically synthesized
atttaaactctcatattttcat

SEQ ID NO: 903719 - DNA, 22 bp, Artificial Sequence
  chemically synthesized
atgctgatttaaactctcatat

SEQ ID NO: 903720 - DNA, 22 bp, Artificial Sequence
  chemically synthesized
tcatgctgatttaaactctcat

SEQ ID NO: 903721 - DNA, 22 bp, Artificial Sequence
  chemically synthesized
ctcatgctgatttaaactctca

SEQ ID NO: 903722 - DNA, 22 bp, Artificial Sequence
  chemically synthesized
atgcaaagcttctcatgctgat

SEQ ID NO: 903723 - DNA, 22 bp, Artificial Sequence
  chemically synthesized
aatgcaaagcttctcatgctga

SEQ ID NO: 903724 - DNA, 22 bp, Artificial Sequence
  chemically synthesized
taatgcaaagcttctcatgctg

SEQ ID NO: 903725 - DNA, 22 bp, Artificial Sequence
  chemically synthesized
gttttaatgcaaagcttctcat

SEQ ID NO: 903726 - DNA, 22 bp, Artificial Sequence
  chemically synthesized
agttttaatgcaaagcttctca

SEQ ID NO: 903727 - DNA, 22 bp, Artificial Sequence
  chemically synthesized
aaatcagcatgagaagctttgc

SEQ ID NO: 903728 - DNA, 22 bp, Artificial Sequence
  chemically synthesized
aatcagcatgagaagctttgca

SEQ ID NO: 903729 - DNA, 22 bp, Artificial Sequence
  chemically synthesized
atatgtatttagttttaatgca

SEQ ID NO: 903730 - DNA, 22 bp, Artificial Sequence
  chemically synthesized
tgcattaaaactaaatacatat

SEQ ID NO: 903731 - DNA, 22 bp, Artificial Sequence
  chemically synthesized
gcattaaaactaaatacatatg

SEQ ID NO: 903732 - DNA, 22 bp, Artificial Sequence
  chemically synthesized
cattaaaactaaatacatatga

SEQ ID NO: 903733 - DNA, 22 bp, Artificial Sequence
  chemically synthesized
ccaaatacagatgattcatatg

SEQ ID NO: 903734 - DNA, 22 bp, Artificial Sequence
  chemically synthesized
aaactaaatacatatgaatcat

SEQ ID NO: 903735 - DNA, 22 bp, Artificial Sequence
  chemically synthesized
aggctcccaaatacagatgatt

SEQ ID NO: 903736 - DNA, 22 bp, Artificial Sequence
  chemically synthesized
aatacatatgaatcatctgtat

SEQ ID NO: 903737 - DNA, 22 bp, Artificial Sequence
  chemically synthesized
caaccactgaggctcccaaata

SEQ ID NO: 903738 - DNA, 22 bp, Artificial Sequence
  chemically synthesized
tatttgggagcctcagtggttg

SEQ ID NO: 903739 - DNA, 22 bp, Artificial Sequence
  chemically synthesized
gggagcctcagtggttgcagcc

SEQ ID NO: 903740 - DNA, 22 bp, Artificial Sequence
  chemically synthesized
ggagcctcagtggttgcagcct

SEQ ID NO: 903741 - DNA, 22 bp, Artificial Sequence
  chemically synthesized
agagatagtataaggctgcaac

SEQ ID NO: 903742 - DNA, 22 bp, Artificial Sequence
  chemically synthesized
taagagatagtataaggctgca

SEQ ID NO: 903743 - DNA, 22 bp, Artificial Sequence
  chemically synthesized
tctaagagatagtataaggctg

SEQ ID NO: 903744 - DNA, 22 bp, Artificial Sequence
  chemically synthesized
ctctaagagatagtataaggct

SEQ ID NO: 903745 - DNA, 22 bp, Artificial Sequence
  chemically synthesized
tctctaagagatagtataaggc

SEQ ID NO: 903746 - DNA, 22 bp, Artificial Sequence
  chemically synthesized
ttctctaagagatagtataagg

SEQ ID NO: 903747 - DNA, 22 bp, Artificial Sequence
  chemically synthesized
agtggttgcagccttatactat

SEQ ID NO: 903748 - DNA, 22 bp, Artificial Sequence
  chemically synthesized
cagccttatactatctcttaga

SEQ ID NO: 903749 - DNA, 22 bp, Artificial Sequence
  chemically synthesized
tgaaatatttttctctaagaga

SEQ ID NO: 903750 - DNA, 22 bp, Artificial Sequence
  chemically synthesized
atactatctcttagagaaaaat

SEQ ID NO: 903751 - DNA, 22 bp, Artificial Sequence
  chemically synthesized
tactatctcttagagaaaaata

SEQ ID NO: 903752 - DNA, 22 bp, Artificial Sequence
  chemically synthesized
gaatggattatgaaatattttt

SEQ ID NO: 903753 - DNA, 22 bp, Artificial Sequence
  chemically synthesized
tctcttagagaaaaatatttca

SEQ ID NO: 903754 - DNA, 22 bp, Artificial Sequence
  chemically synthesized
ttagagaaaaatatttcataat

SEQ ID NO: 903755 - DNA, 22 bp, Artificial Sequence
  chemically synthesized
agagaaaaatatttcataatcc

SEQ ID NO: 903756 - DNA, 22 bp, Artificial Sequence
  chemically synthesized
gagaaaaatatttcataatcca

SEQ ID NO: 903757 - DNA, 22 bp, Artificial Sequence
  chemically synthesized
atacatacatgattggaatgga

SEQ ID NO: 903758 - DNA, 22 bp, Artificial Sequence
  chemically synthesized
aatacatacatgattggaatgg

SEQ ID NO: 903759 - DNA, 22 bp, Artificial Sequence
  chemically synthesized
taatacatacatgattggaatg

SEQ ID NO: 903760 - DNA, 22 bp, Artificial Sequence
  chemically synthesized
cataatccattccaatcatgta

SEQ ID NO: 903761 - DNA, 22 bp, Artificial Sequence
  chemically synthesized
ataatccattccaatcatgtat

SEQ ID NO: 903762 - DNA, 22 bp, Artificial Sequence
  chemically synthesized
tcataaactttaatacatacat

SEQ ID NO: 903763 - DNA, 22 bp, Artificial Sequence
  chemically synthesized
tgttgtcataaactttaataca

SEQ ID NO: 903764 - DNA, 22 bp, Artificial Sequence
  chemically synthesized
caatcatgtatgtattaaagtt

SEQ ID NO: 903765 - DNA, 22 bp, Artificial Sequence
  chemically synthesized
ggggacagctatgttgtcataa

SEQ ID NO: 903766 - DNA, 22 bp, Artificial Sequence
  chemically synthesized
aagtttatgacaacatagctgt

SEQ ID NO: 903767 - DNA, 22 bp, Artificial Sequence
  chemically synthesized
atgacaacatagctgtccccca

SEQ ID NO: 903768 - DNA, 22 bp, Artificial Sequence
  chemically synthesized
tgacaacatagctgtcccccaa

SEQ ID NO: 903769 - DNA, 22 bp, Artificial Sequence
  chemically synthesized
aaaaagtacatggggttggggg

SEQ ID NO: 903770 - DNA, 22 bp, Artificial Sequence
  chemically synthesized
caaaaagtacatggggttgggg

SEQ ID NO: 903771 - DNA, 22 bp, Artificial Sequence
  chemically synthesized
atatttcaaaaagtacatgggg

SEQ ID NO: 903772 - DNA, 22 bp, Artificial Sequence
  chemically synthesized
catatttcaaaaagtacatggg

SEQ ID NO: 903773 - DNA, 22 bp, Artificial Sequence
  chemically synthesized
tcccccaaccccatgtactttt

SEQ ID NO: 903774 - DNA, 22 bp, Artificial Sequence
  chemically synthesized
cttcatatttcaaaaagtacat

SEQ ID NO: 903775 - DNA, 22 bp, Artificial Sequence
  chemically synthesized
ttccttcatatttcaaaaagta

SEQ ID NO: 903776 - DNA, 22 bp, Artificial Sequence
  chemically synthesized
attccttcatatttcaaaaagt

SEQ ID NO: 903777 - DNA, 22 bp, Artificial Sequence
  chemically synthesized
aatttattccttcatatttcaa

SEQ ID NO: 903778 - DNA, 22 bp, Artificial Sequence
  chemically synthesized
agaaattgaatttattccttca

SEQ ID NO: 903779 - DNA, 22 bp, Artificial Sequence
  chemically synthesized
tttgaaatatgaaggaataaat

SEQ ID NO: 903780 - DNA, 22 bp, Artificial Sequence
  chemically synthesized
ttgaaatatgaaggaataaatt

SEQ ID NO: 903781 - DNA, 22 bp, Artificial Sequence
  chemically synthesized
tgaaatatgaaggaataaattc

SEQ ID NO: 903782 - DNA, 22 bp, Artificial Sequence
  chemically synthesized
gaaatatgaaggaataaattca

SEQ ID NO: 903783 - DNA, 22 bp, Artificial Sequence
  chemically synthesized
aaatatgaaggaataaattcaa

SEQ ID NO: 903784 - DNA, 22 bp, Artificial Sequence
  chemically synthesized
agtgtagtaatatattaagaaa

SEQ ID NO: 903785 - DNA, 22 bp, Artificial Sequence
  chemically synthesized
ttaagtgtagtaatatattaag

SEQ ID NO: 903786 - DNA, 22 bp, Artificial Sequence
  chemically synthesized
aatttcttaatatattactaca

SEQ ID NO: 903787 - DNA, 22 bp, Artificial Sequence
  chemically synthesized
tcataatctgttaagtgtagta

SEQ ID NO: 903788 - DNA, 22 bp, Artificial Sequence
  chemically synthesized
gtcataatctgttaagtgtagt

SEQ ID NO: 903789 - DNA, 22 bp, Artificial Sequence
  chemically synthesized
cttaatatattactacacttaa

SEQ ID NO: 903790 - DNA, 22 bp, Artificial Sequence
  chemically synthesized
ttaatatattactacacttaac

SEQ ID NO: 903791 - DNA, 22 bp, Artificial Sequence
  chemically synthesized
aatatattactacacttaacag

SEQ ID NO: 903792 - DNA, 22 bp, Artificial Sequence
  chemically synthesized
atatattactacacttaacaga

SEQ ID NO: 903793 - DNA, 22 bp, Artificial Sequence
  chemically synthesized
gagaagtatttgtcataatctg

SEQ ID NO: 903794 - DNA, 22 bp, Artificial Sequence
  chemically synthesized
ctacacttaacagattatgaca

SEQ ID NO: 903795 - DNA, 22 bp, Artificial Sequence
  chemically synthesized
cacttaacagattatgacaaat

SEQ ID NO: 903796 - DNA, 22 bp, Artificial Sequence
  chemically synthesized
tataattagagaagtatttgtc

SEQ ID NO: 903797 - DNA, 22 bp, Artificial Sequence
  chemically synthesized
gtataattagagaagtatttgt

SEQ ID NO: 903798 - DNA, 22 bp, Artificial Sequence
  chemically synthesized
aacagattatgacaaatacttc

SEQ ID NO: 903799 - DNA, 22 bp, Artificial Sequence
  chemically synthesized
tgtataattagagaagtatttg

SEQ ID NO: 903800 - DNA, 22 bp, Artificial Sequence
  chemically synthesized
acagattatgacaaatacttct

SEQ ID NO: 903801 - DNA, 22 bp, Artificial Sequence
  chemically synthesized
ttgtataattagagaagtattt

SEQ ID NO: 903802 - DNA, 22 bp, Artificial Sequence
  chemically synthesized
tttgtataattagagaagtatt

SEQ ID NO: 903803 - DNA, 22 bp, Artificial Sequence
  chemically synthesized
ttttgtataattagagaagtat

SEQ ID NO: 903804 - DNA, 22 bp, Artificial Sequence
  chemically synthesized
atttttttgtataattagagaa

SEQ ID NO: 903805 - DNA, 22 bp, Artificial Sequence
  chemically synthesized
tgacaaatacttctctaattat

SEQ ID NO: 903806 - DNA, 22 bp, Artificial Sequence
  chemically synthesized
caaacctaatttttttgtataa

SEQ ID NO: 903807 - DNA, 22 bp, Artificial Sequence
  chemically synthesized
tccaaacctaatttttttgtat

SEQ ID NO: 903808 - DNA, 22 bp, Artificial Sequence
  chemically synthesized
ctctaattatacaaaaaaatta

SEQ ID NO: 903809 - DNA, 22 bp, Artificial Sequence
  chemically synthesized
tctaattatacaaaaaaattag

SEQ ID NO: 903810 - DNA, 22 bp, Artificial Sequence
  chemically synthesized
ggattctccaaacctaattttt

SEQ ID NO: 903811 - DNA, 22 bp, Artificial Sequence
  chemically synthesized
taattatacaaaaaaattaggt

SEQ ID NO: 903812 - DNA, 22 bp, Artificial Sequence
  chemically synthesized
tgggattctccaaacctaattt

SEQ ID NO: 903813 - DNA, 22 bp, Artificial Sequence
  chemically synthesized
attatacaaaaaaattaggttt

SEQ ID NO: 903814 - DNA, 22 bp, Artificial Sequence
  chemically synthesized
tacaaaaaaattaggtttggag

SEQ ID NO: 903815 - DNA, 22 bp, Artificial Sequence
  chemically synthesized
atactctgggattctccaaacc

SEQ ID NO: 903816 - DNA, 22 bp, Artificial Sequence
  chemically synthesized
ggtttggagaatcccagagtat

SEQ ID NO: 903817 - DNA, 22 bp, Artificial Sequence
  chemically synthesized
aaaatgcagctaatactctggg

SEQ ID NO: 903818 - DNA, 22 bp, Artificial Sequence
  chemically synthesized
gaaaatgcagctaatactctgg

SEQ ID NO: 903819 - DNA, 22 bp, Artificial Sequence
  chemically synthesized
ggagaatcccagagtattagct

SEQ ID NO: 903820 - DNA, 22 bp, Artificial Sequence
  chemically synthesized
gagaatcccagagtattagctg

SEQ ID NO: 903821 - DNA, 22 bp, Artificial Sequence
  chemically synthesized
gcatttgaaaatgcagctaata

SEQ ID NO: 903822 - DNA, 22 bp, Artificial Sequence
  chemically synthesized
ctggcatttgaaaatgcagcta

SEQ ID NO: 903823 - DNA, 22 bp, Artificial Sequence
  chemically synthesized
acctgctggcatttgaaaatgc

SEQ ID NO: 903824 - DNA, 22 bp, Artificial Sequence
  chemically synthesized
cacctgctggcatttgaaaatg

SEQ ID NO: 903825 - DNA, 22 bp, Artificial Sequence
  chemically synthesized
ccttcacctgctggcatttgaa

SEQ ID NO: 903826 - DNA, 22 bp, Artificial Sequence
  chemically synthesized
cccttcacctgctggcatttga

SEQ ID NO: 903827 - DNA, 22 bp, Artificial Sequence
  chemically synthesized
gctgcattttcaaatgccagca

SEQ ID NO: 903828 - DNA, 22 bp, Artificial Sequence
  chemically synthesized
tttcccttcacctgctggcatt

SEQ ID NO: 903829 - DNA, 22 bp, Artificial Sequence
  chemically synthesized
cattttcaaatgccagcaggtg

SEQ ID NO: 903830 - DNA, 22 bp, Artificial Sequence
  chemically synthesized
tcaaatgccagcaggtgaaggg

SEQ ID NO: 903831 - DNA, 22 bp, Artificial Sequence
  chemically synthesized
caaatgccagcaggtgaaggga

SEQ ID NO: 903832 - DNA, 22 bp, Artificial Sequence
  chemically synthesized
aaatgccagcaggtgaagggaa

SEQ ID NO: 903833 - DNA, 22 bp, Artificial Sequence
  chemically synthesized
ccaccacggattatttcccttc

SEQ ID NO: 903834 - DNA, 22 bp, Artificial Sequence
  chemically synthesized
cccaccacggattatttccctt

SEQ ID NO: 903835 - DNA, 22 bp, Artificial Sequence
  chemically synthesized
gagtcttcccaccacggattat

SEQ ID NO: 903836 - DNA, 22 bp, Artificial Sequence
  chemically synthesized
agagtcttcccaccacggatta

SEQ ID NO: 903837 - DNA, 22 bp, Artificial Sequence
  chemically synthesized
tagagtcttcccaccacggatt

SEQ ID NO: 903838 - DNA, 22 bp, Artificial Sequence
  chemically synthesized
agtgccattttagagtcttccc

SEQ ID NO: 903839 - DNA, 22 bp, Artificial Sequence
  chemically synthesized
ggagacagagatcactgagtgc

SEQ ID NO: 903840 - DNA, 22 bp, Artificial Sequence
  chemically synthesized
taaaatggcactcagtgatctc

SEQ ID NO: 903841 - DNA, 22 bp, Artificial Sequence
  chemically synthesized
aaatggcactcagtgatctctg

SEQ ID NO: 903842 - DNA, 22 bp, Artificial Sequence
  chemically synthesized
aaatactaggagacagagatca

SEQ ID NO: 903843 - DNA, 22 bp, Artificial Sequence
  chemically synthesized
aaggactcaaatactaggagac

SEQ ID NO: 903844 - DNA, 22 bp, Artificial Sequence
  chemically synthesized
agtgatctctgtctcctagtat

SEQ ID NO: 903845 - DNA, 22 bp, Artificial Sequence
  chemically synthesized
ttaaaggactcaaatactagga

SEQ ID NO: 903846 - DNA, 22 bp, Artificial Sequence
  chemically synthesized
tgtctcctagtatttgagtcct

SEQ ID NO: 903847 - DNA, 22 bp, Artificial Sequence
  chemically synthesized
tctcctagtatttgagtccttt

SEQ ID NO: 903848 - DNA, 22 bp, Artificial Sequence
  chemically synthesized
ctagtatttgagtcctttaata

SEQ ID NO: 903849 - DNA, 22 bp, Artificial Sequence
  chemically synthesized
aaggggaggaaattattaaagg

SEQ ID NO: 903850 - DNA, 22 bp, Artificial Sequence
  chemically synthesized
gtatttgagtcctttaataatt

SEQ ID NO: 903851 - DNA, 22 bp, Artificial Sequence
  chemically synthesized
tcaaggggaggaaattattaaa

SEQ ID NO: 903852 - DNA, 22 bp, Artificial Sequence
  chemically synthesized
gagtcctttaataatttcctcc

SEQ ID NO: 903853 - DNA, 22 bp, Artificial Sequence
  chemically synthesized
agtcctttaataatttcctccc

SEQ ID NO: 903854 - DNA, 22 bp, Artificial Sequence
  chemically synthesized
accactctcaaggggaggaaat

SEQ ID NO: 903855 - DNA, 22 bp, Artificial Sequence
  chemically synthesized
gaccactctcaaggggaggaaa

SEQ ID NO: 903856 - DNA, 22 bp, Artificial Sequence
  chemically synthesized
taataatttcctccccttgaga

SEQ ID NO: 903857 - DNA, 22 bp, Artificial Sequence
  chemically synthesized
aataatttcctccccttgagag

SEQ ID NO: 903858 - DNA, 22 bp, Artificial Sequence
  chemically synthesized
ataatttcctccccttgagagt

SEQ ID NO: 903859 - DNA, 22 bp, Artificial Sequence
  chemically synthesized
cctccccttgagagtggtcaag

SEQ ID NO: 903860 - DNA, 22 bp, Artificial Sequence
  chemically synthesized
ctccccttgagagtggtcaaga

SEQ ID NO: 903861 - DNA, 22 bp, Artificial Sequence
  chemically synthesized
cccttgagagtggtcaagactt

SEQ ID NO: 903862 - DNA, 22 bp, Artificial Sequence
  chemically synthesized
tcagaagcaagtcaaaagtctt

SEQ ID NO: 903863 - DNA, 22 bp, Artificial Sequence
  chemically synthesized
gtcagaagcaagtcaaaagtct

SEQ ID NO: 903864 - DNA, 22 bp, Artificial Sequence
  chemically synthesized
gagagtggtcaagacttttgac

SEQ ID NO: 903865 - DNA, 22 bp, Artificial Sequence
  chemically synthesized
agagtggtcaagacttttgact

SEQ ID NO: 903866 - DNA, 22 bp, Artificial Sequence
  chemically synthesized
cttgtcagaagcaagtcaaaag

SEQ ID NO: 903867 - DNA, 22 bp, Artificial Sequence
  chemically synthesized
tgcttgtcagaagcaagtcaaa

SEQ ID NO: 903868 - DNA, 22 bp, Artificial Sequence
  chemically synthesized
acatattctgcttgtcagaagc

SEQ ID NO: 903869 - DNA, 22 bp, Artificial Sequence
  chemically synthesized
gacatattctgcttgtcagaag

SEQ ID NO: 903870 - DNA, 22 bp, Artificial Sequence
  chemically synthesized
tgacatattctgcttgtcagaa

SEQ ID NO: 903871 - DNA, 22 bp, Artificial Sequence
  chemically synthesized
ttgacttgcttctgacaagcag

SEQ ID NO: 903872 - DNA, 22 bp, Artificial Sequence
  chemically synthesized
tgacttgcttctgacaagcaga

SEQ ID NO: 903873 - DNA, 22 bp, Artificial Sequence
  chemically synthesized
tctttgacatattctgcttgtc

SEQ ID NO: 903874 - DNA, 22 bp, Artificial Sequence
  chemically synthesized
gacttgcttctgacaagcagaa

SEQ ID NO: 903875 - DNA, 22 bp, Artificial Sequence
  chemically synthesized
gtctttgacatattctgcttgt

SEQ ID NO: 903876 - DNA, 22 bp, Artificial Sequence
  chemically synthesized
acttgcttctgacaagcagaat

SEQ ID NO: 903877 - DNA, 22 bp, Artificial Sequence
  chemically synthesized
tgtctttgacatattctgcttg

SEQ ID NO: 903878 - DNA, 22 bp, Artificial Sequence
  chemically synthesized
ttgtctttgacatattctgctt

SEQ ID NO: 903879 - DNA, 22 bp, Artificial Sequence
  chemically synthesized
gcttctgacaagcagaatatgt

SEQ ID NO: 903880 - DNA, 22 bp, Artificial Sequence
  chemically synthesized
cttctgacaagcagaatatgtc

SEQ ID NO: 903881 - DNA, 22 bp, Artificial Sequence
  chemically synthesized
ctgacaagcagaatatgtcaaa

SEQ ID NO: 903882 - DNA, 22 bp, Artificial Sequence
  chemically synthesized
tgacaagcagaatatgtcaaag

SEQ ID NO: 903883 - DNA, 22 bp, Artificial Sequence
  chemically synthesized
acaagcagaatatgtcaaagac

SEQ ID NO: 903884 - DNA, 22 bp, Artificial Sequence
  chemically synthesized
gagaagtgatatccttttgtct

SEQ ID NO: 903885 - DNA, 22 bp, Artificial Sequence
  chemically synthesized
attggagaagtgatatcctttt

SEQ ID NO: 903886 - DNA, 22 bp, Artificial Sequence
  chemically synthesized
tgtagcctaattggagaagtga

SEQ ID NO: 903887 - DNA, 22 bp, Artificial Sequence
  chemically synthesized
atgtagcctaattggagaagtg

SEQ ID NO: 903888 - DNA, 22 bp, Artificial Sequence
  chemically synthesized
ctccaattaggctacataagat

SEQ ID NO: 903889 - DNA, 22 bp, Artificial Sequence
  chemically synthesized
tccaattaggctacataagatt

SEQ ID NO: 903890 - DNA, 22 bp, Artificial Sequence
  chemically synthesized
caattaggctacataagattgg

SEQ ID NO: 903891 - DNA, 22 bp, Artificial Sequence
  chemically synthesized
gcaagacaaaagtcccaatctt

SEQ ID NO: 903892 - DNA, 22 bp, Artificial Sequence
  chemically synthesized
ctagcaagacaaaagtcccaat

SEQ ID NO: 903893 - DNA, 22 bp, Artificial Sequence
  chemically synthesized
ggctacataagattgggacttt

SEQ ID NO: 903894 - DNA, 22 bp, Artificial Sequence
  chemically synthesized
cataagattgggacttttgtct

SEQ ID NO: 903895 - DNA, 22 bp, Artificial Sequence
  chemically synthesized
ggacttttgtcttgctagcaat

SEQ ID NO: 903896 - DNA, 22 bp, Artificial Sequence
  chemically synthesized
ttgtcttgctagcaatttcact

SEQ ID NO: 903897 - DNA, 22 bp, Artificial Sequence
  chemically synthesized
tgtcttgctagcaatttcactc

SEQ ID NO: 903898 - DNA, 22 bp, Artificial Sequence
  chemically synthesized
gtcttgctagcaatttcactct

SEQ ID NO: 903899 - DNA, 22 bp, Artificial Sequence
  chemically synthesized
tcttgctagcaatttcactctt

SEQ ID NO: 903900 - DNA, 22 bp, Artificial Sequence
  chemically synthesized
gctagcaatttcactctttctc

SEQ ID NO: 903901 - DNA, 22 bp, Artificial Sequence
  chemically synthesized
ctagcaatttcactctttctct

SEQ ID NO: 903902 - DNA, 22 bp, Artificial Sequence
  chemically synthesized
gcaatttcactctttctctgtc

SEQ ID NO: 903903 - DNA, 22 bp, Artificial Sequence
  chemically synthesized
cactctttctctgtctctttcc

SEQ ID NO: 903904 - DNA, 22 bp, Artificial Sequence
  chemically synthesized
actctttctctgtctctttccc

SEQ ID NO: 903905 - DNA, 22 bp, Artificial Sequence
  chemically synthesized
tttctctgtctctttcccccct

SEQ ID NO: 903906 - DNA, 22 bp, Artificial Sequence
  chemically synthesized
tctctgtctctttcccccctcc

SEQ ID NO: 903907 - DNA, 22 bp, Artificial Sequence
  chemically synthesized
ctctgtctctttcccccctccc

SEQ ID NO: 903908 - DNA, 22 bp, Artificial Sequence
  chemically synthesized
tctgtctctttcccccctcccc

SEQ ID NO: 903909 - DNA, 22 bp, Artificial Sequence
  chemically synthesized
tgtctctttcccccctccccca

SEQ ID NO: 903910 - DNA, 22 bp, Artificial Sequence
  chemically synthesized
tctctttcccccctcccccact

SEQ ID NO: 903911 - DNA, 22 bp, Artificial Sequence
  chemically synthesized
tttcccccctcccccactttct

SEQ ID NO: 903912 - DNA, 22 bp, Artificial Sequence
  chemically synthesized
tcccccctcccccactttctct

SEQ ID NO: 903913 - DNA, 22 bp, Artificial Sequence
  chemically synthesized
cccccctcccccactttctctc

SEQ ID NO: 903914 - DNA, 22 bp, Artificial Sequence
  chemically synthesized
atcaaaatcagtgagagaaagt

SEQ ID NO: 903915 - DNA, 22 bp, Artificial Sequence
  chemically synthesized
ccccctcccccactttctctca

SEQ ID NO: 903916 - DNA, 22 bp, Artificial Sequence
  chemically synthesized
cctcatcaaaatcagtgagaga

SEQ ID NO: 903917 - DNA, 22 bp, Artificial Sequence
  chemically synthesized
gcctcatcaaaatcagtgagag

SEQ ID NO: 903918 - DNA, 22 bp, Artificial Sequence
  chemically synthesized
ccccactttctctcactgattt

SEQ ID NO: 903919 - DNA, 22 bp, Artificial Sequence
  chemically synthesized
tctctcactgattttgatgagg

SEQ ID NO: 903920 - DNA, 22 bp, Artificial Sequence
  chemically synthesized
ctctcactgattttgatgaggc

SEQ ID NO: 903921 - DNA, 22 bp, Artificial Sequence
  chemically synthesized
acatggcaatttgcctcatcaa

SEQ ID NO: 903922 - DNA, 22 bp, Artificial Sequence
  chemically synthesized
tctcactgattttgatgaggca

SEQ ID NO: 903923 - DNA, 22 bp, Artificial Sequence
  chemically synthesized
taacatggcaatttgcctcatc

SEQ ID NO: 903924 - DNA, 22 bp, Artificial Sequence
  chemically synthesized
tcactgattttgatgaggcaaa

SEQ ID NO: 903925 - DNA, 22 bp, Artificial Sequence
  chemically synthesized
actgattttgatgaggcaaatt

SEQ ID NO: 903926 - DNA, 22 bp, Artificial Sequence
  chemically synthesized
ggtctctaacatggcaatttgc

SEQ ID NO: 903927 - DNA, 22 bp, Artificial Sequence
  chemically synthesized
attttgatgaggcaaattgcca

SEQ ID NO: 903928 - DNA, 22 bp, Artificial Sequence
  chemically synthesized
cggtctctaacatggcaatttg

SEQ ID NO: 903929 - DNA, 22 bp, Artificial Sequence
  chemically synthesized
cttcggtctctaacatggcaat

SEQ ID NO: 903930 - DNA, 22 bp, Artificial Sequence
  chemically synthesized
tgatgaggcaaattgccatgtt

SEQ ID NO: 903931 - DNA, 22 bp, Artificial Sequence
  chemically synthesized
gatgaggcaaattgccatgtta

SEQ ID NO: 903932 - DNA, 22 bp, Artificial Sequence
  chemically synthesized
atgaggcaaattgccatgttag

SEQ ID NO: 903933 - DNA, 22 bp, Artificial Sequence
  chemically synthesized
gttccttcggtctctaacatgg

SEQ ID NO: 903934 - DNA, 22 bp, Artificial Sequence
  chemically synthesized
agttccttcggtctctaacatg

SEQ ID NO: 903935 - DNA, 22 bp, Artificial Sequence
  chemically synthesized
ccatgttagagaccgaaggaac

SEQ ID NO: 903936 - DNA, 22 bp, Artificial Sequence
  chemically synthesized
atggccacgtttagttccttcg

SEQ ID NO: 903937 - DNA, 22 bp, Artificial Sequence
  chemically synthesized
gctgatggccacgtttagttcc

SEQ ID NO: 903938 - DNA, 22 bp, Artificial Sequence
  chemically synthesized
gagaccgaaggaactaaacgtg

SEQ ID NO: 903939 - DNA, 22 bp, Artificial Sequence
  chemically synthesized
ttggctgatggccacgtttagt

SEQ ID NO: 903940 - DNA, 22 bp, Artificial Sequence
  chemically synthesized
gttggctgatggccacgtttag

SEQ ID NO: 903941 - DNA, 22 bp, Artificial Sequence
  chemically synthesized
ttgttggctgatggccacgttt

SEQ ID NO: 903942 - DNA, 22 bp, Artificial Sequence
  chemically synthesized
cttgttggctgatggccacgtt

SEQ ID NO: 903943 - DNA, 22 bp, Artificial Sequence
  chemically synthesized
tcttgttggctgatggccacgt

SEQ ID NO: 903944 - DNA, 22 bp, Artificial Sequence
  chemically synthesized
ttcttgttggctgatggccacg

SEQ ID NO: 903945 - DNA, 22 bp, Artificial Sequence
  chemically synthesized
cttttcttgttggctgatggcc

SEQ ID NO: 903946 - DNA, 22 bp, Artificial Sequence
  chemically synthesized
ccttttcttgttggctgatggc

SEQ ID NO: 903947 - DNA, 22 bp, Artificial Sequence
  chemically synthesized
aacgtggccatcagccaacaag

SEQ ID NO: 903948 - DNA, 22 bp, Artificial Sequence
  chemically synthesized
tagtcttccttttcttgttggc

SEQ ID NO: 903949 - DNA, 22 bp, Artificial Sequence
  chemically synthesized
gactgtagtcttccttttcttg

SEQ ID NO: 903950 - DNA, 22 bp, Artificial Sequence
  chemically synthesized
ttggactgtagtcttccttttc

SEQ ID NO: 903951 - DNA, 22 bp, Artificial Sequence
  chemically synthesized
catgtgggttattggactgtag

SEQ ID NO: 903952 - DNA, 22 bp, Artificial Sequence
  chemically synthesized
agttccatgtgggttattggac

SEQ ID NO: 903953 - DNA, 22 bp, Artificial Sequence
  chemically synthesized
cagttccatgtgggttattgga

SEQ ID NO: 903954 - DNA, 22 bp, Artificial Sequence
  chemically synthesized
gtaagtttcagttccatgtggg

SEQ ID NO: 903955 - DNA, 22 bp, Artificial Sequence
  chemically synthesized
cagtccaataacccacatggaa

SEQ ID NO: 903956 - DNA, 22 bp, Artificial Sequence
  chemically synthesized
ttggtaagtttcagttccatgt

SEQ ID NO: 903957 - DNA, 22 bp, Artificial Sequence
  chemically synthesized
ttgttggtaagtttcagttcca

SEQ ID NO: 903958 - DNA, 22 bp, Artificial Sequence
  chemically synthesized
acctgttgttggtaagtttcag

SEQ ID NO: 903959 - DNA, 22 bp, Artificial Sequence
  chemically synthesized
caaactcacctgttgttggtaa

SEQ ID NO: 903960 - DNA, 22 bp, Artificial Sequence
  chemically synthesized
ccaaactcacctgttgttggta

SEQ ID NO: 903961 - DNA, 22 bp, Artificial Sequence
  chemically synthesized
cttccaaactcacctgttgttg

SEQ ID NO: 903962 - DNA, 22 bp, Artificial Sequence
  chemically synthesized
aaacttaccaacaacaggtgag

SEQ ID NO: 903963 - DNA, 22 bp, Artificial Sequence
  chemically synthesized
accaacaacaggtgagtttgga

SEQ ID NO: 903964 - DNA, 22 bp, Artificial Sequence
  chemically synthesized
gaaggacctgcttccaaactca

SEQ ID NO: 903965 - DNA, 22 bp, Artificial Sequence
  chemically synthesized
ccaacaacaggtgagtttggaa

SEQ ID NO: 903966 - DNA, 22 bp, Artificial Sequence
  chemically synthesized
ggaaggacctgcttccaaactc

SEQ ID NO: 903967 - DNA, 22 bp, Artificial Sequence
  chemically synthesized
ccttggaaggacctgcttccaa

SEQ ID NO: 903968 - DNA, 22 bp, Artificial Sequence
  chemically synthesized
gccttggaaggacctgcttcca

SEQ ID NO: 903969 - DNA, 22 bp, Artificial Sequence
  chemically synthesized
aaagcttgccttggaaggacct

SEQ ID NO: 903970 - DNA, 22 bp, Artificial Sequence
  chemically synthesized
gaaagcttgccttggaaggacc

SEQ ID NO: 903971 - DNA, 22 bp, Artificial Sequence
  chemically synthesized
atttgaaagcttgccttggaag

SEQ ID NO: 903972 - DNA, 22 bp, Artificial Sequence
  chemically synthesized
ggaagcaggtccttccaaggca

SEQ ID NO: 903973 - DNA, 22 bp, Artificial Sequence
  chemically synthesized
gaagcaggtccttccaaggcaa

SEQ ID NO: 903974 - DNA, 22 bp, Artificial Sequence
  chemically synthesized
gggtctcatttgaaagcttgcc

SEQ ID NO: 903975 - DNA, 22 bp, Artificial Sequence
  chemically synthesized
ccaaggcaagctttcaaatgag

SEQ ID NO: 903976 - DNA, 22 bp, Artificial Sequence
  chemically synthesized
caaggcaagctttcaaatgaga

SEQ ID NO: 903977 - DNA, 22 bp, Artificial Sequence
  chemically synthesized
gccagggctagggtctcatttg

SEQ ID NO: 903978 - DNA, 22 bp, Artificial Sequence
  chemically synthesized
ggtgttggccagggctagggtc

SEQ ID NO: 903979 - DNA, 22 bp, Artificial Sequence
  chemically synthesized
tcaaatgagaccctagccctgg

SEQ ID NO: 903980 - DNA, 22 bp, Artificial Sequence
  chemically synthesized
caaatgagaccctagccctggc

SEQ ID NO: 903981 - DNA, 22 bp, Artificial Sequence
  chemically synthesized
aaatgagaccctagccctggcc

SEQ ID NO: 903982 - DNA, 22 bp, Artificial Sequence
  chemically synthesized
cacactaggtgttggccagggc

SEQ ID NO: 903983 - DNA, 22 bp, Artificial Sequence
  chemically synthesized
acaaaggctgcacactaggtgt

SEQ ID NO: 903984 - DNA, 22 bp, Artificial Sequence
  chemically synthesized
gccctggccaacacctagtgtg

SEQ ID NO: 903985 - DNA, 22 bp, Artificial Sequence
  chemically synthesized
tcacaaaggctgcacactaggt

SEQ ID NO: 903986 - DNA, 22 bp, Artificial Sequence
  chemically synthesized
gccaacacctagtgtgcagcct

SEQ ID NO: 903987 - DNA, 22 bp, Artificial Sequence
  chemically synthesized
ggggtctctcacaaaggctgca

SEQ ID NO: 903988 - DNA, 22 bp, Artificial Sequence
  chemically synthesized
cggggtctctcacaaaggctgc

SEQ ID NO: 903989 - DNA, 22 bp, Artificial Sequence
  chemically synthesized
cttcggggtctctcacaaaggc

SEQ ID NO: 903990 - DNA, 22 bp, Artificial Sequence
  chemically synthesized
gcttcggggtctctcacaaagg

SEQ ID NO: 903991 - DNA, 22 bp, Artificial Sequence
  chemically synthesized
tgcttcggggtctctcacaaag

SEQ ID NO: 903992 - DNA, 22 bp, Artificial Sequence
  chemically synthesized
tttgcttcggggtctctcacaa

SEQ ID NO: 903993 - DNA, 22 bp, Artificial Sequence
  chemically synthesized
gtgtgcagcctttgtgagagac

SEQ ID NO: 903994 - DNA, 22 bp, Artificial Sequence
  chemically synthesized
tccatattctttgcttcggggt

SEQ ID NO: 903995 - DNA, 22 bp, Artificial Sequence
  chemically synthesized
tgtgagagaccccgaagcaaag

SEQ ID NO: 903996 - DNA, 22 bp, Artificial Sequence
  chemically synthesized
gtgagagaccccgaagcaaaga

SEQ ID NO: 903997 - DNA, 22 bp, Artificial Sequence
  chemically synthesized
tgagagaccccgaagcaaagaa

SEQ ID NO: 903998 - DNA, 22 bp, Artificial Sequence
  chemically synthesized
ggcatagattatccatattctt

SEQ ID NO: 903999 - DNA, 22 bp, Artificial Sequence
  chemically synthesized
tgcctagacttctgacccatat

SEQ ID NO: 904000 - DNA, 22 bp, Artificial Sequence
  chemically synthesized
gagtatcaggatacatatgggt

SEQ ID NO: 904001 - DNA, 22 bp, Artificial Sequence
  chemically synthesized
agagtatcaggatacatatggg

SEQ ID NO: 904002 - DNA, 22 bp, Artificial Sequence
  chemically synthesized
tagagtatcaggatacatatgg

SEQ ID NO: 904003 - DNA, 22 bp, Artificial Sequence
  chemically synthesized
gacttctgacccatatgtatcc

SEQ ID NO: 904004 - DNA, 22 bp, Artificial Sequence
  chemically synthesized
tatctttagagtatcaggatac

SEQ ID NO: 904005 - DNA, 22 bp, Artificial Sequence
  chemically synthesized
ctgacccatatgtatcctgata

SEQ ID NO: 904006 - DNA, 22 bp, Artificial Sequence
  chemically synthesized
tgacccatatgtatcctgatac

SEQ ID NO: 904007 - DNA, 22 bp, Artificial Sequence
  chemically synthesized
acccatatgtatcctgatactc

SEQ ID NO: 904008 - DNA, 22 bp, Artificial Sequence
  chemically synthesized
aaactgtatctttagagtatca

SEQ ID NO: 904009 - DNA, 22 bp, Artificial Sequence
  chemically synthesized
aaaactgtatctttagagtatc

SEQ ID NO: 904010 - DNA, 22 bp, Artificial Sequence
  chemically synthesized
atactctaaagatacagtttta

SEQ ID NO: 904011 - DNA, 22 bp, Artificial Sequence
  chemically synthesized
caaagataggggcttaaaactg

SEQ ID NO: 904012 - DNA, 22 bp, Artificial Sequence
  chemically synthesized
ctacaaagataggggcttaaaa

SEQ ID NO: 904013 - DNA, 22 bp, Artificial Sequence
  chemically synthesized
taaagatacagttttaagcccc

SEQ ID NO: 904014 - DNA, 22 bp, Artificial Sequence
  chemically synthesized
aagatacagttttaagccccta

SEQ ID NO: 904015 - DNA, 22 bp, Artificial Sequence
  chemically synthesized
cataacaattactacaaagata

SEQ ID NO: 904016 - DNA, 22 bp, Artificial Sequence
  chemically synthesized
ctgcataacaattactacaaag

SEQ ID NO: 904017 - DNA, 22 bp, Artificial Sequence
  chemically synthesized
taagcccctatctttgtagtaa

SEQ ID NO: 904018 - DNA, 22 bp, Artificial Sequence
  chemically synthesized
aagcccctatctttgtagtaat

SEQ ID NO: 904019 - DNA, 22 bp, Artificial Sequence
  chemically synthesized
agcccctatctttgtagtaatt

SEQ ID NO: 904020 - DNA, 22 bp, Artificial Sequence
  chemically synthesized
ttgctgcataacaattactaca

SEQ ID NO: 904021 - DNA, 22 bp, Artificial Sequence
  chemically synthesized
tctattgctgcataacaattac

SEQ ID NO: 904022 - DNA, 22 bp, Artificial Sequence
  chemically synthesized
tctttgtagtaattgttatgca

SEQ ID NO: 904023 - DNA, 22 bp, Artificial Sequence
  chemically synthesized
gttgtctattgctgcataacaa

SEQ ID NO: 904024 - DNA, 22 bp, Artificial Sequence
  chemically synthesized
tgtagtaattgttatgcagcaa

SEQ ID NO: 904025 - DNA, 22 bp, Artificial Sequence
  chemically synthesized
gtagtaattgttatgcagcaat

SEQ ID NO: 904026 - DNA, 22 bp, Artificial Sequence
  chemically synthesized
tagtaattgttatgcagcaata

SEQ ID NO: 904027 - DNA, 22 bp, Artificial Sequence
  chemically synthesized
tgtattagttgtctattgctgc

SEQ ID NO: 904028 - DNA, 22 bp, Artificial Sequence
  chemically synthesized
ttatgcagcaatagacaactaa

SEQ ID NO: 904029 - DNA, 22 bp, Artificial Sequence
  chemically synthesized
taatattatgtattagttgtct

SEQ ID NO: 904030 - DNA, 22 bp, Artificial Sequence
  chemically synthesized
tgcagcaatagacaactaatac

SEQ ID NO: 904031 - DNA, 22 bp, Artificial Sequence
  chemically synthesized
aaaagattataatattatgtat

SEQ ID NO: 904032 - DNA, 22 bp, Artificial Sequence
  chemically synthesized
aaaaagattataatattatgta

SEQ ID NO: 904033 - DNA, 22 bp, Artificial Sequence
  chemically synthesized
ttaaaaagattataatattatg

SEQ ID NO: 904034 - DNA, 22 bp, Artificial Sequence
  chemically synthesized
cttaaaaagattataatattat

SEQ ID NO: 904035 - DNA, 22 bp, Artificial Sequence
  chemically synthesized
tttcttaaaaagattataatat

SEQ ID NO: 904036 - DNA, 22 bp, Artificial Sequence
  chemically synthesized
gtttcttaaaaagattataata

SEQ ID NO: 904037 - DNA, 22 bp, Artificial Sequence
  chemically synthesized
atacataatattataatctttt

SEQ ID NO: 904038 - DNA, 22 bp, Artificial Sequence
  chemically synthesized
tatttgtttcttaaaaagatta

SEQ ID NO: 904039 - DNA, 22 bp, Artificial Sequence
  chemically synthesized
ctatatttgtttcttaaaaaga

SEQ ID NO: 904040 - DNA, 22 bp, Artificial Sequence
  chemically synthesized
tgttactatatttgtttcttaa

SEQ ID NO: 904041 - DNA, 22 bp, Artificial Sequence
  chemically synthesized
atgttactatatttgtttctta

SEQ ID NO: 904042 - DNA, 22 bp, Artificial Sequence
  chemically synthesized
tatgttactatatttgtttctt

SEQ ID NO: 904043 - DNA, 22 bp, Artificial Sequence
  chemically synthesized
ttatgttactatatttgtttct

SEQ ID NO: 904044 - DNA, 22 bp, Artificial Sequence
  chemically synthesized
taatctttttaagaaacaaata

SEQ ID NO: 904045 - DNA, 22 bp, Artificial Sequence
  chemically synthesized
atttttatgttactatatttgt

SEQ ID NO: 904046 - DNA, 22 bp, Artificial Sequence
  chemically synthesized
aatttttatgttactatatttg

SEQ ID NO: 904047 - DNA, 22 bp, Artificial Sequence
  chemically synthesized
tttaagaaacaaatatagtaac

SEQ ID NO: 904048 - DNA, 22 bp, Artificial Sequence
  chemically synthesized
tttaatttttatgttactatat

SEQ ID NO: 904049 - DNA, 22 bp, Artificial Sequence
  chemically synthesized
ttaagaaacaaatatagtaaca

SEQ ID NO: 904050 - DNA, 22 bp, Artificial Sequence
  chemically synthesized
taagaaacaaatatagtaacat

SEQ ID NO: 904051 - DNA, 22 bp, Artificial Sequence
  chemically synthesized
aagaaacaaatatagtaacata

SEQ ID NO: 904052 - DNA, 22 bp, Artificial Sequence
  chemically synthesized
agaaacaaatatagtaacataa

SEQ ID NO: 904053 - DNA, 22 bp, Artificial Sequence
  chemically synthesized
accattatttaatttttatgtt

SEQ ID NO: 904054 - DNA, 22 bp, Artificial Sequence
  chemically synthesized
caccattatttaatttttatgt

SEQ ID NO: 904055 - DNA, 22 bp, Artificial Sequence
  chemically synthesized
caacttcaccattatttaattt

SEQ ID NO: 904056 - DNA, 22 bp, Artificial Sequence
  chemically synthesized
aaaaccctacaacttcaccatt

SEQ ID NO: 904057 - DNA, 22 bp, Artificial Sequence
  chemically synthesized
tactgaaaaccctacaacttca

SEQ ID NO: 904058 - DNA, 22 bp, Artificial Sequence
  chemically synthesized
ctatactgaaaaccctacaact

SEQ ID NO: 904059 - DNA, 22 bp, Artificial Sequence
  chemically synthesized
aataatggtgaagttgtagggt

SEQ ID NO: 904060 - DNA, 22 bp, Artificial Sequence
  chemically synthesized
caatactcctatactgaaaacc

SEQ ID NO: 904061 - DNA, 22 bp, Artificial Sequence
  chemically synthesized
gcaatactcctatactgaaaac

SEQ ID NO: 904062 - DNA, 22 bp, Artificial Sequence
  chemically synthesized
tatttgcaatactcctatactg

SEQ ID NO: 904063 - DNA, 22 bp, Artificial Sequence
  chemically synthesized
atatttgcaatactcctatact

SEQ ID NO: 904064 - DNA, 22 bp, Artificial Sequence
  chemically synthesized
tagggttttcagtataggagta

SEQ ID NO: 904065 - DNA, 22 bp, Artificial Sequence
  chemically synthesized
ttatatttgcaatactcctata

SEQ ID NO: 904066 - DNA, 22 bp, Artificial Sequence
  chemically synthesized
tcagtataggagtattgcaaat

SEQ ID NO: 904067 - DNA, 22 bp, Artificial Sequence
  chemically synthesized
cagtataggagtattgcaaata

SEQ ID NO: 904068 - DNA, 22 bp, Artificial Sequence
  chemically synthesized
agtataggagtattgcaaatat

SEQ ID NO: 904069 - DNA, 22 bp, Artificial Sequence
  chemically synthesized
aaatatggtccgttcttatatt

SEQ ID NO: 904070 - DNA, 22 bp, Artificial Sequence
  chemically synthesized
gttaaaatatggtccgttctta

SEQ ID NO: 904071 - DNA, 22 bp, Artificial Sequence
  chemically synthesized
caaatataagaacggaccatat

SEQ ID NO: 904072 - DNA, 22 bp, Artificial Sequence
  chemically synthesized
agtaactcgttaaaatatggtc

SEQ ID NO: 904073 - DNA, 22 bp, Artificial Sequence
  chemically synthesized
cagtaactcgttaaaatatggt

SEQ ID NO: 904074 - DNA, 22 bp, Artificial Sequence
  chemically synthesized
tcagtaactcgttaaaatatgg

SEQ ID NO: 904075 - DNA, 22 bp, Artificial Sequence
  chemically synthesized
ttcagtaactcgttaaaatatg

SEQ ID NO: 904076 - DNA, 22 bp, Artificial Sequence
  chemically synthesized
tttttcagtaactcgttaaaat

SEQ ID NO: 904077 - DNA, 22 bp, Artificial Sequence
  chemically synthesized
gccactatttttcagtaactcg

SEQ ID NO: 904078 - DNA, 22 bp, Artificial Sequence
  chemically synthesized
aaattcgccactatttttcagt

SEQ ID NO: 904079 - DNA, 22 bp, Artificial Sequence
  chemically synthesized
aaaattcgccactatttttcag

SEQ ID NO: 904080 - DNA, 22 bp, Artificial Sequence
  chemically synthesized
taaaattcgccactatttttca

SEQ ID NO: 904081 - DNA, 22 bp, Artificial Sequence
  chemically synthesized
taacgagttactgaaaaatagt

SEQ ID NO: 904082 - DNA, 22 bp, Artificial Sequence
  chemically synthesized
aacgagttactgaaaaatagtg

SEQ ID NO: 904083 - DNA, 22 bp, Artificial Sequence
  chemically synthesized
acgagttactgaaaaatagtgg

SEQ ID NO: 904084 - DNA, 22 bp, Artificial Sequence
  chemically synthesized
aaactttaaaattcgccactat

SEQ ID NO: 904085 - DNA, 22 bp, Artificial Sequence
  chemically synthesized
ctgaaaaatagtggcgaatttt

SEQ ID NO: 904086 - DNA, 22 bp, Artificial Sequence
  chemically synthesized
acattgaaactttaaaattcgc

SEQ ID NO: 904087 - DNA, 22 bp, Artificial Sequence
  chemically synthesized
aaaaatagtggcgaattttaaa

SEQ ID NO: 904088 - DNA, 22 bp, Artificial Sequence
  chemically synthesized
tgacattgaaactttaaaattc

SEQ ID NO: 904089 - DNA, 22 bp, Artificial Sequence
  chemically synthesized
ctgacattgaaactttaaaatt

SEQ ID NO: 904090 - DNA, 22 bp, Artificial Sequence
  chemically synthesized
tctgacattgaaactttaaaat

SEQ ID NO: 904091 - DNA, 22 bp, Artificial Sequence
  chemically synthesized
tttctgacattgaaactttaaa

SEQ ID NO: 904092 - DNA, 22 bp, Artificial Sequence
  chemically synthesized
ctttctgacattgaaactttaa

SEQ ID NO: 904093 - DNA, 22 bp, Artificial Sequence
  chemically synthesized
ttctttctgacattgaaacttt

SEQ ID NO: 904094 - DNA, 22 bp, Artificial Sequence
  chemically synthesized
cttctttctgacattgaaactt

SEQ ID NO: 904095 - DNA, 22 bp, Artificial Sequence
  chemically synthesized
atttcttctttctgacattgaa

SEQ ID NO: 904096 - DNA, 22 bp, Artificial Sequence
  chemically synthesized
gatttcttctttctgacattga

SEQ ID NO: 904097 - DNA, 22 bp, Artificial Sequence
  chemically synthesized
taaagtttcaatgtcagaaaga

SEQ ID NO: 904098 - DNA, 22 bp, Artificial Sequence
  chemically synthesized
aaagtttcaatgtcagaaagaa

SEQ ID NO: 904099 - DNA, 22 bp, Artificial Sequence
  chemically synthesized
aagtttcaatgtcagaaagaag

SEQ ID NO: 904100 - DNA, 22 bp, Artificial Sequence
  chemically synthesized
agtatatatttgatttcttctt

SEQ ID NO: 904101 - DNA, 22 bp, Artificial Sequence
  chemically synthesized
caatgtcagaaagaagaaatca

SEQ ID NO: 904102 - DNA, 22 bp, Artificial Sequence
  chemically synthesized
aatgtcagaaagaagaaatcaa

SEQ ID NO: 904103 - DNA, 22 bp, Artificial Sequence
  chemically synthesized
atctgagtatatatttgatttc

SEQ ID NO: 904104 - DNA, 22 bp, Artificial Sequence
  chemically synthesized
catctgagtatatatttgattt

SEQ ID NO: 904105 - DNA, 22 bp, Artificial Sequence
  chemically synthesized
tcatttcatctgagtatatatt

SEQ ID NO: 904106 - DNA, 22 bp, Artificial Sequence
  chemically synthesized
atcatttcatctgagtatatat

SEQ ID NO: 904107 - DNA, 22 bp, Artificial Sequence
  chemically synthesized
tatcatttcatctgagtatata

SEQ ID NO: 904108 - DNA, 22 bp, Artificial Sequence
  chemically synthesized
atggttttatcatttcatctga

SEQ ID NO: 904109 - DNA, 22 bp, Artificial Sequence
  chemically synthesized
aatggttttatcatttcatctg

SEQ ID NO: 904110 - DNA, 22 bp, Artificial Sequence
  chemically synthesized
agatgaaatgataaaaccatta

SEQ ID NO: 904111 - DNA, 22 bp, Artificial Sequence
  chemically synthesized
gaaatgtgagagggtgcatgaa

SEQ ID NO: 904112 - DNA, 22 bp, Artificial Sequence
  chemically synthesized
atgttagaaatgtgagagggtg

SEQ ID NO: 904113 - DNA, 22 bp, Artificial Sequence
  chemically synthesized
aggtttcatgcaccctctcaca

SEQ ID NO: 904114 - DNA, 22 bp, Artificial Sequence
  chemically synthesized
aaaattaatgttagaaatgtga

SEQ ID NO: 904115 - DNA, 22 bp, Artificial Sequence
  chemically synthesized
catgcaccctctcacatttcta

SEQ ID NO: 904116 - DNA, 22 bp, Artificial Sequence
  chemically synthesized
gaaaattaatgttagaaatgtg

SEQ ID NO: 904117 - DNA, 22 bp, Artificial Sequence
  chemically synthesized
atgcaccctctcacatttctaa

SEQ ID NO: 904118 - DNA, 22 bp, Artificial Sequence
  chemically synthesized
aaatttgaaaattaatgttaga

SEQ ID NO: 904119 - DNA, 22 bp, Artificial Sequence
  chemically synthesized
aaaatttgaaaattaatgttag

SEQ ID NO: 904120 - DNA, 22 bp, Artificial Sequence
  chemically synthesized
cttaaaatttgaaaattaatgt

SEQ ID NO: 904121 - DNA, 22 bp, Artificial Sequence
  chemically synthesized
tcacatttctaacattaatttt

SEQ ID NO: 904122 - DNA, 22 bp, Artificial Sequence
  chemically synthesized
tacttaaaatttgaaaattaat

SEQ ID NO: 904123 - DNA, 22 bp, Artificial Sequence
  chemically synthesized
acatttctaacattaattttca

SEQ ID NO: 904124 - DNA, 22 bp, Artificial Sequence
  chemically synthesized
ttctacttaaaatttgaaaatt

SEQ ID NO: 904125 - DNA, 22 bp, Artificial Sequence
  chemically synthesized
ctaacattaattttcaaatttt

SEQ ID NO: 904126 - DNA, 22 bp, Artificial Sequence
  chemically synthesized
taacattaattttcaaatttta

SEQ ID NO: 904127 - DNA, 22 bp, Artificial Sequence
  chemically synthesized
tcactgttctacttaaaatttg

SEQ ID NO: 904128 - DNA, 22 bp, Artificial Sequence
  chemically synthesized
acattaattttcaaattttaag

SEQ ID NO: 904129 - DNA, 22 bp, Artificial Sequence
  chemically synthesized
atcactgttctacttaaaattt

SEQ ID NO: 904130 - DNA, 22 bp, Artificial Sequence
  chemically synthesized
tatcactgttctacttaaaatt

SEQ ID NO: 904131 - DNA, 22 bp, Artificial Sequence
  chemically synthesized
attttcaaattttaagtagaac

SEQ ID NO: 904132 - DNA, 22 bp, Artificial Sequence
  chemically synthesized
atctttatcactgttctactta

SEQ ID NO: 904133 - DNA, 22 bp, Artificial Sequence
  chemically synthesized
ttcatctttatcactgttctac

SEQ ID NO: 904134 - DNA, 22 bp, Artificial Sequence
  chemically synthesized
tcaaattttaagtagaacagtg

SEQ ID NO: 904135 - DNA, 22 bp, Artificial Sequence
  chemically synthesized
caaattttaagtagaacagtga

SEQ ID NO: 904136 - DNA, 22 bp, Artificial Sequence
  chemically synthesized
aaattttaagtagaacagtgat

SEQ ID NO: 904137 - DNA, 22 bp, Artificial Sequence
  chemically synthesized
taagtagaacagtgataaagat

SEQ ID NO: 904138 - DNA, 22 bp, Artificial Sequence
  chemically synthesized
acaatattattcatctttatca

SEQ ID NO: 904139 - DNA, 22 bp, Artificial Sequence
  chemically synthesized
aagtagaacagtgataaagatg

SEQ ID NO: 904140 - DNA, 22 bp, Artificial Sequence
  chemically synthesized
agtagaacagtgataaagatga

SEQ ID NO: 904141 - DNA, 22 bp, Artificial Sequence
  chemically synthesized
gaagattgacaatattattcat

SEQ ID NO: 904142 - DNA, 22 bp, Artificial Sequence
  chemically synthesized
aaataaaactagaagattgaca

SEQ ID NO: 904143 - DNA, 22 bp, Artificial Sequence
  chemically synthesized
tcaatcttctagttttatttta

SEQ ID NO: 904144 - DNA, 22 bp, Artificial Sequence
  chemically synthesized
aatgcaaggtgctaaaataaaa

SEQ ID NO: 904145 - DNA, 22 bp, Artificial Sequence
  chemically synthesized
aaatgcaaggtgctaaaataaa

SEQ ID NO: 904146 - DNA, 22 bp, Artificial Sequence
  chemically synthesized
taaatgcaaggtgctaaaataa

SEQ ID NO: 904147 - DNA, 22 bp, Artificial Sequence
  chemically synthesized
ttttaaatgcaaggtgctaaaa

SEQ ID NO: 904148 - DNA, 22 bp, Artificial Sequence
  chemically synthesized
ctagttttattttagcaccttg

SEQ ID NO: 904149 - DNA, 22 bp, Artificial Sequence
  chemically synthesized
tagttttattttagcaccttgc

SEQ ID NO: 904150 - DNA, 22 bp, Artificial Sequence
  chemically synthesized
tctgttttaaatgcaaggtgct

SEQ ID NO: 904151 - DNA, 22 bp, Artificial Sequence
  chemically synthesized
gttttattttagcaccttgcat

SEQ ID NO: 904152 - DNA, 22 bp, Artificial Sequence
  chemically synthesized
tattttagcaccttgcatttaa

SEQ ID NO: 904153 - DNA, 22 bp, Artificial Sequence
  chemically synthesized
attttagcaccttgcatttaaa

SEQ ID NO: 904154 - DNA, 22 bp, Artificial Sequence
  chemically synthesized
ttttagcaccttgcatttaaaa

SEQ ID NO: 904155 - DNA, 22 bp, Artificial Sequence
  chemically synthesized
tagcaccttgcatttaaaacag

SEQ ID NO: 904156 - DNA, 22 bp, Artificial Sequence
  chemically synthesized
agcaccttgcatttaaaacaga

SEQ ID NO: 904157 - DNA, 22 bp, Artificial Sequence
  chemically synthesized
aaagataaattgtctgttttaa

SEQ ID NO: 904158 - DNA, 22 bp, Artificial Sequence
  chemically synthesized
gcaccttgcatttaaaacagac

SEQ ID NO: 904159 - DNA, 22 bp, Artificial Sequence
  chemically synthesized
gcatttaaaacagacaatttat

SEQ ID NO: 904160 - DNA, 22 bp, Artificial Sequence
  chemically synthesized
catttaaaacagacaatttatc

SEQ ID NO: 904161 - DNA, 22 bp, Artificial Sequence
  chemically synthesized
aaaacagacaatttatctttga

SEQ ID NO: 904162 - DNA, 22 bp, Artificial Sequence
  chemically synthesized
aaacagacaatttatctttgag

SEQ ID NO: 904163 - DNA, 22 bp, Artificial Sequence
  chemically synthesized
aagtaccaacaactcaaagata

SEQ ID NO: 904164 - DNA, 22 bp, Artificial Sequence
  chemically synthesized
gaagtaccaacaactcaaagat

SEQ ID NO: 904165 - DNA, 22 bp, Artificial Sequence
  chemically synthesized
tttgaagtaccaacaactcaaa

SEQ ID NO: 904166 - DNA, 22 bp, Artificial Sequence
  chemically synthesized
atctttgagttgttggtacttc

SEQ ID NO: 904167 - DNA, 22 bp, Artificial Sequence
  chemically synthesized
aaaaaactatttgaagtaccaa

SEQ ID NO: 904168 - DNA, 22 bp, Artificial Sequence
  chemically synthesized
tctttgagttgttggtacttca

SEQ ID NO: 904169 - DNA, 22 bp, Artificial Sequence
  chemically synthesized
aaaaaaactatttgaagtacca

SEQ ID NO: 904170 - DNA, 22 bp, Artificial Sequence
  chemically synthesized
taaaaaaactatttgaagtacc

SEQ ID NO: 904171 - DNA, 22 bp, Artificial Sequence
  chemically synthesized
tgagttgttggtacttcaaata

SEQ ID NO: 904172 - DNA, 22 bp, Artificial Sequence
  chemically synthesized
gagttgttggtacttcaaatag

SEQ ID NO: 904173 - DNA, 22 bp, Artificial Sequence
  chemically synthesized
agttgttggtacttcaaatagt

SEQ ID NO: 904174 - DNA, 22 bp, Artificial Sequence
  chemically synthesized
tggaaactttaaaaaaactatt

SEQ ID NO: 904175 - DNA, 22 bp, Artificial Sequence
  chemically synthesized
ttggtacttcaaatagtttttt

SEQ ID NO: 904176 - DNA, 22 bp, Artificial Sequence
  chemically synthesized
gtacttcaaatagtttttttaa

SEQ ID NO: 904177 - DNA, 22 bp, Artificial Sequence
  chemically synthesized
caaatagtttttttaaagtttc

SEQ ID NO: 904178 - DNA, 22 bp, Artificial Sequence
  chemically synthesized
tgtgaaattgtggaaactttaa

SEQ ID NO: 904179 - DNA, 22 bp, Artificial Sequence
  chemically synthesized
aaatagtttttttaaagtttcc

SEQ ID NO: 904180 - DNA, 22 bp, Artificial Sequence
  chemically synthesized
tgtgtgaaattgtggaaacttt

SEQ ID NO: 904181 - DNA, 22 bp, Artificial Sequence
  chemically synthesized
gtctctgtgtgaaattgtggaa

SEQ ID NO: 904182 - DNA, 22 bp, Artificial Sequence
  chemically synthesized
ttttaaagtttccacaatttca

SEQ ID NO: 904183 - DNA, 22 bp, Artificial Sequence
  chemically synthesized
tttaaagtttccacaatttcac

SEQ ID NO: 904184 - DNA, 22 bp, Artificial Sequence
  chemically synthesized
ttaaagtttccacaatttcaca

SEQ ID NO: 904185 - DNA, 22 bp, Artificial Sequence
  chemically synthesized
taaagtttccacaatttcacac

SEQ ID NO: 904186 - DNA, 22 bp, Artificial Sequence
  chemically synthesized
gcattcgtctctgtgtgaaatt

SEQ ID NO: 904187 - DNA, 22 bp, Artificial Sequence
  chemically synthesized
aaagtttccacaatttcacaca

SEQ ID NO: 904188 - DNA, 22 bp, Artificial Sequence
  chemically synthesized
agcattcgtctctgtgtgaaat

SEQ ID NO: 904189 - DNA, 22 bp, Artificial Sequence
  chemically synthesized
aagtttccacaatttcacacag

SEQ ID NO: 904190 - DNA, 22 bp, Artificial Sequence
  chemically synthesized
ttagcattcgtctctgtgtgaa

SEQ ID NO: 904191 - DNA, 22 bp, Artificial Sequence
  chemically synthesized
ccacaatttcacacagagacga

SEQ ID NO: 904192 - DNA, 22 bp, Artificial Sequence
  chemically synthesized
cacaatttcacacagagacgaa

SEQ ID NO: 904193 - DNA, 22 bp, Artificial Sequence
  chemically synthesized
acagattcttagcattcgtctc

SEQ ID NO: 904194 - DNA, 22 bp, Artificial Sequence
  chemically synthesized
aacagattcttagcattcgtct

SEQ ID NO: 904195 - DNA, 22 bp, Artificial Sequence
  chemically synthesized
cacacagagacgaatgctaaga

SEQ ID NO: 904196 - DNA, 22 bp, Artificial Sequence
  chemically synthesized
acacagagacgaatgctaagaa

SEQ ID NO: 904197 - DNA, 22 bp, Artificial Sequence
  chemically synthesized
aaagcaagcttaacagattctt

SEQ ID NO: 904198 - DNA, 22 bp, Artificial Sequence
  chemically synthesized
cctaaaagcaagcttaacagat

SEQ ID NO: 904199 - DNA, 22 bp, Artificial Sequence
  chemically synthesized
ccctaaaagcaagcttaacaga

SEQ ID NO: 904200 - DNA, 22 bp, Artificial Sequence
  chemically synthesized
tccctaaaagcaagcttaacag

SEQ ID NO: 904201 - DNA, 22 bp, Artificial Sequence
  chemically synthesized
ttccctaaaagcaagcttaaca

SEQ ID NO: 904202 - DNA, 22 bp, Artificial Sequence
  chemically synthesized
agaatctgttaagcttgctttt

SEQ ID NO: 904203 - DNA, 22 bp, Artificial Sequence
  chemically synthesized
aggcatccttttccctaaaagc

SEQ ID NO: 904204 - DNA, 22 bp, Artificial Sequence
  chemically synthesized
gaggcatccttttccctaaaag

SEQ ID NO: 904205 - DNA, 22 bp, Artificial Sequence
  chemically synthesized
tgaggcatccttttccctaaaa

SEQ ID NO: 904206 - DNA, 22 bp, Artificial Sequence
  chemically synthesized
ttaagcttgcttttagggaaaa

SEQ ID NO: 904207 - DNA, 22 bp, Artificial Sequence
  chemically synthesized
agcttgcttttagggaaaagga

SEQ ID NO: 904208 - DNA, 22 bp, Artificial Sequence
  chemically synthesized
tgactttgaggcatccttttcc

SEQ ID NO: 904209 - DNA, 22 bp, Artificial Sequence
  chemically synthesized
gtgactttgaggcatccttttc

SEQ ID NO: 904210 - DNA, 22 bp, Artificial Sequence
  chemically synthesized
tgtgactttgaggcatcctttt

SEQ ID NO: 904211 - DNA, 22 bp, Artificial Sequence
  chemically synthesized
gcttttagggaaaaggatgcct

SEQ ID NO: 904212 - DNA, 22 bp, Artificial Sequence
  chemically synthesized
cttttagggaaaaggatgcctc

SEQ ID NO: 904213 - DNA, 22 bp, Artificial Sequence
  chemically synthesized
ttagggaaaaggatgcctcaaa

SEQ ID NO: 904214 - DNA, 22 bp, Artificial Sequence
  chemically synthesized
tagggaaaaggatgcctcaaag

SEQ ID NO: 904215 - DNA, 22 bp, Artificial Sequence
  chemically synthesized
agggaaaaggatgcctcaaagt

SEQ ID NO: 904216 - DNA, 22 bp, Artificial Sequence
  chemically synthesized
aaaagttttgtgactttgaggc

SEQ ID NO: 904217 - DNA, 22 bp, Artificial Sequence
  chemically synthesized
gggaaaaggatgcctcaaagtc

SEQ ID NO: 904218 - DNA, 22 bp, Artificial Sequence
  chemically synthesized
aaaaagttttgtgactttgagg

SEQ ID NO: 904219 - DNA, 22 bp, Artificial Sequence
  chemically synthesized
aaagtcacaaaactttttaaac

SEQ ID NO: 904220 - DNA, 22 bp, Artificial Sequence
  chemically synthesized
acccccaaagaaccaagtttaa

SEQ ID NO: 904221 - DNA, 22 bp, Artificial Sequence
  chemically synthesized
cacccccaaagaaccaagttta

SEQ ID NO: 904222 - DNA, 22 bp, Artificial Sequence
  chemically synthesized
tcacccccaaagaaccaagttt

SEQ ID NO: 904223 - DNA, 22 bp, Artificial Sequence
  chemically synthesized
ttcacccccaaagaaccaagtt

SEQ ID NO: 904224 - DNA, 22 bp, Artificial Sequence
  chemically synthesized
tttcacccccaaagaaccaagt

SEQ ID NO: 904225 - DNA, 22 bp, Artificial Sequence
  chemically synthesized
ctttttcacccccaaagaacca

SEQ ID NO: 904226 - DNA, 22 bp, Artificial Sequence
  chemically synthesized
tttaaacttggttctttggggg

SEQ ID NO: 904227 - DNA, 22 bp, Artificial Sequence
  chemically synthesized
ttaaacttggttctttgggggt

SEQ ID NO: 904228 - DNA, 22 bp, Artificial Sequence
  chemically synthesized
taaacttggttctttgggggtg

SEQ ID NO: 904229 - DNA, 22 bp, Artificial Sequence
  chemically synthesized
aaacttggttctttgggggtga

SEQ ID NO: 904230 - DNA, 22 bp, Artificial Sequence
  chemically synthesized
aacttggttctttgggggtgaa

SEQ ID NO: 904231 - DNA, 22 bp, Artificial Sequence
  chemically synthesized
ggttctttgggggtgaaaaagc

SEQ ID NO: 904232 - DNA, 22 bp, Artificial Sequence
  chemically synthesized
gttctttgggggtgaaaaagca

SEQ ID NO: 904233 - DNA, 22 bp, Artificial Sequence
  chemically synthesized
gtgaaaaatatgcctgcttttt

SEQ ID NO: 904234 - DNA, 22 bp, Artificial Sequence
  chemically synthesized
tttgggggtgaaaaagcaggca

SEQ ID NO: 904235 - DNA, 22 bp, Artificial Sequence
  chemically synthesized
tgggggtgaaaaagcaggcata

SEQ ID NO: 904236 - DNA, 22 bp, Artificial Sequence
  chemically synthesized
gggggtgaaaaagcaggcatat

SEQ ID NO: 904237 - DNA, 22 bp, Artificial Sequence
  chemically synthesized
ggggtgaaaaagcaggcatatt

SEQ ID NO: 904238 - DNA, 22 bp, Artificial Sequence
  chemically synthesized
gaaaattggtgaaaaatatgcc

SEQ ID NO: 904239 - DNA, 22 bp, Artificial Sequence
  chemically synthesized
agaaaattggtgaaaaatatgc

SEQ ID NO: 904240 - DNA, 22 bp, Artificial Sequence
  chemically synthesized
acatgtaaaatttagaaaattg

SEQ ID NO: 904241 - DNA, 22 bp, Artificial Sequence
  chemically synthesized
aacatgtaaaatttagaaaatt

SEQ ID NO: 904242 - DNA, 22 bp, Artificial Sequence
  chemically synthesized
ttcaccaattttctaaatttta

SEQ ID NO: 904243 - DNA, 22 bp, Artificial Sequence
  chemically synthesized
caatttaacatgtaaaatttag

SEQ ID NO: 904244 - DNA, 22 bp, Artificial Sequence
  chemically synthesized
tcaccaattttctaaattttac

SEQ ID NO: 904245 - DNA, 22 bp, Artificial Sequence
  chemically synthesized
ccaatttaacatgtaaaattta

SEQ ID NO: 904246 - DNA, 22 bp, Artificial Sequence
  chemically synthesized
caccaattttctaaattttaca

SEQ ID NO: 904247 - DNA, 22 bp, Artificial Sequence
  chemically synthesized
accaattttctaaattttacat

SEQ ID NO: 904248 - DNA, 22 bp, Artificial Sequence
  chemically synthesized
cttccaatttaacatgtaaaat

SEQ ID NO: 904249 - DNA, 22 bp, Artificial Sequence
  chemically synthesized
acttccaatttaacatgtaaaa

SEQ ID NO: 904250 - DNA, 22 bp, Artificial Sequence
  chemically synthesized
tctaaattttacatgttaaatt

SEQ ID NO: 904251 - DNA, 22 bp, Artificial Sequence
  chemically synthesized
ctaaattttacatgttaaattg

SEQ ID NO: 904252 - DNA, 22 bp, Artificial Sequence
  chemically synthesized
taaattttacatgttaaattgg

SEQ ID NO: 904253 - DNA, 22 bp, Artificial Sequence
  chemically synthesized
aattttacatgttaaattggaa

SEQ ID NO: 904254 - DNA, 22 bp, Artificial Sequence
  chemically synthesized
acataaatcttacttccaattt

SEQ ID NO: 904255 - DNA, 22 bp, Artificial Sequence
  chemically synthesized
aacataaatcttacttccaatt

SEQ ID NO: 904256 - DNA, 22 bp, Artificial Sequence
  chemically synthesized
tacatgttaaattggaagtaag

SEQ ID NO: 904257 - DNA, 22 bp, Artificial Sequence
  chemically synthesized
acatgttaaattggaagtaaga

SEQ ID NO: 904258 - DNA, 22 bp, Artificial Sequence
  chemically synthesized
catgttaaattggaagtaagat

SEQ ID NO: 904259 - DNA, 22 bp, Artificial Sequence
  chemically synthesized
ataaacagtttaacataaatct

SEQ ID NO: 904260 - DNA, 22 bp, Artificial Sequence
  chemically synthesized
aattggaagtaagatttatgtt

SEQ ID NO: 904261 - DNA, 22 bp, Artificial Sequence
  chemically synthesized
aataaacagtttaacataaatc

SEQ ID NO: 904262 - DNA, 22 bp, Artificial Sequence
  chemically synthesized
taataaacagtttaacataaat

SEQ ID NO: 904263 - DNA, 22 bp, Artificial Sequence
  chemically synthesized
gaagtaagatttatgttaaact

SEQ ID NO: 904264 - DNA, 22 bp, Artificial Sequence
  chemically synthesized
atatgttttaataaacagttta

SEQ ID NO: 904265 - DNA, 22 bp, Artificial Sequence
  chemically synthesized
aatatgttttaataaacagttt

SEQ ID NO: 904266 - DNA, 22 bp, Artificial Sequence
  chemically synthesized
taatatgttttaataaacagtt

SEQ ID NO: 904267 - DNA, 22 bp, Artificial Sequence
  chemically synthesized
tctttaatatgttttaataaac

SEQ ID NO: 904268 - DNA, 22 bp, Artificial Sequence
  chemically synthesized
atctttaatatgttttaataaa

SEQ ID NO: 904269 - DNA, 22 bp, Artificial Sequence
  chemically synthesized
atgttaaactgtttattaaaac

SEQ ID NO: 904270 - DNA, 22 bp, Artificial Sequence
  chemically synthesized
tgttaaactgtttattaaaaca

SEQ ID NO: 904271 - DNA, 22 bp, Artificial Sequence
  chemically synthesized
aactgtttattaaaacatatta

SEQ ID NO: 904272 - DNA, 22 bp, Artificial Sequence
  chemically synthesized
acatggtttatctttaatatgt

SEQ ID NO: 904273 - DNA, 22 bp, Artificial Sequence
  chemically synthesized
tcacatggtttatctttaatat

SEQ ID NO: 904274 - DNA, 22 bp, Artificial Sequence
  chemically synthesized
tttattaaaacatattaaagat

SEQ ID NO: 904275 - DNA, 22 bp, Artificial Sequence
  chemically synthesized
tctcacatggtttatctttaat

SEQ ID NO: 904276 - DNA, 22 bp, Artificial Sequence
  chemically synthesized
attaaaacatattaaagataaa

SEQ ID NO: 904277 - DNA, 22 bp, Artificial Sequence
  chemically synthesized
ttaaaacatattaaagataaac

SEQ ID NO: 904278 - DNA, 22 bp, Artificial Sequence
  chemically synthesized
cattctctcacatggtttatct

SEQ ID NO: 904279 - DNA, 22 bp, Artificial Sequence
  chemically synthesized
aaacatattaaagataaaccat

SEQ ID NO: 904280 - DNA, 22 bp, Artificial Sequence
  chemically synthesized
attccattctctcacatggttt

SEQ ID NO: 904281 - DNA, 22 bp, Artificial Sequence
  chemically synthesized
gattccattctctcacatggtt

SEQ ID NO: 904282 - DNA, 22 bp, Artificial Sequence
  chemically synthesized
tgattccattctctcacatggt

SEQ ID NO: 904283 - DNA, 22 bp, Artificial Sequence
  chemically synthesized
aagataaaccatgtgagagaat

SEQ ID NO: 904284 - DNA, 22 bp, Artificial Sequence
  chemically synthesized
cattttgattccattctctcac

SEQ ID NO: 904285 - DNA, 22 bp, Artificial Sequence
  chemically synthesized
tccattttgattccattctctc

SEQ ID NO: 904286 - DNA, 22 bp, Artificial Sequence
  chemically synthesized
aagtgagcaaggtaggaaattc

SEQ ID NO: 904287 - DNA, 22 bp, Artificial Sequence
  chemically synthesized
gttgaagtgagcaaggtaggaa

SEQ ID NO: 904288 - DNA, 22 bp, Artificial Sequence
  chemically synthesized
attggttgaagtgagcaaggta

SEQ ID NO: 904289 - DNA, 22 bp, Artificial Sequence
  chemically synthesized
aattggttgaagtgagcaaggt

SEQ ID NO: 904290 - DNA, 22 bp, Artificial Sequence
  chemically synthesized
ttaattggttgaagtgagcaag

SEQ ID NO: 904291 - DNA, 22 bp, Artificial Sequence
  chemically synthesized
tgttcttaattggttgaagtga

SEQ ID NO: 904292 - DNA, 22 bp, Artificial Sequence
  chemically synthesized
cctaccttgctcacttcaacca

SEQ ID NO: 904293 - DNA, 22 bp, Artificial Sequence
  chemically synthesized
ctaccttgctcacttcaaccaa

SEQ ID NO: 904294 - DNA, 22 bp, Artificial Sequence
  chemically synthesized
ccttgctcacttcaaccaatta

SEQ ID NO: 904295 - DNA, 22 bp, Artificial Sequence
  chemically synthesized
ccaattatgttcttaattggtt

SEQ ID NO: 904296 - DNA, 22 bp, Artificial Sequence
  chemically synthesized
gctcacttcaaccaattaagaa

SEQ ID NO: 904297 - DNA, 22 bp, Artificial Sequence
  chemically synthesized
ctaccaattatgttcttaattg

SEQ ID NO: 904298 - DNA, 22 bp, Artificial Sequence
  chemically synthesized
ctcacttcaaccaattaagaac

SEQ ID NO: 904299 - DNA, 22 bp, Artificial Sequence
  chemically synthesized
gctaccaattatgttcttaatt

SEQ ID NO: 904300 - DNA, 22 bp, Artificial Sequence
  chemically synthesized
tgctaccaattatgttcttaat

SEQ ID NO: 904301 - DNA, 22 bp, Artificial Sequence
  chemically synthesized
ttgctaccaattatgttcttaa

SEQ ID NO: 904302 - DNA, 22 bp, Artificial Sequence
  chemically synthesized
acttcaaccaattaagaacata

SEQ ID NO: 904303 - DNA, 22 bp, Artificial Sequence
  chemically synthesized
caaccaattaagaacataattg

SEQ ID NO: 904304 - DNA, 22 bp, Artificial Sequence
  chemically synthesized
atcttttgctaccaattatgtt

SEQ ID NO: 904305 - DNA, 22 bp, Artificial Sequence
  chemically synthesized
aaccaattaagaacataattgg

SEQ ID NO: 904306 - DNA, 22 bp, Artificial Sequence
  chemically synthesized
catcttttgctaccaattatgt

SEQ ID NO: 904307 - DNA, 22 bp, Artificial Sequence
  chemically synthesized
ttcatcttttgctaccaattat

SEQ ID NO: 904308 - DNA, 22 bp, Artificial Sequence
  chemically synthesized
cctcttcatcttttgctaccaa

SEQ ID NO: 904309 - DNA, 22 bp, Artificial Sequence
  chemically synthesized
agaacataattggtagcaaaag

SEQ ID NO: 904310 - DNA, 22 bp, Artificial Sequence
  chemically synthesized
aaatctccctcttcatcttttg

SEQ ID NO: 904311 - DNA, 22 bp, Artificial Sequence
  chemically synthesized
cctgaaatctccctcttcatct

SEQ ID NO: 904312 - DNA, 22 bp, Artificial Sequence
  chemically synthesized
acctgaaatctccctcttcatc

SEQ ID NO: 904313 - DNA, 22 bp, Artificial Sequence
  chemically synthesized
tacctgaaatctccctcttcat

SEQ ID NO: 904314 - DNA, 22 bp, Artificial Sequence
  chemically synthesized
ttacctgaaatctccctcttca

SEQ ID NO: 904315 - DNA, 22 bp, Artificial Sequence
  chemically synthesized
gtagcaaaagatgaagagggag

SEQ ID NO: 904316 - DNA, 22 bp, Artificial Sequence
  chemically synthesized
ttttacctgaaatctccctctt

SEQ ID NO: 904317 - DNA, 22 bp, Artificial Sequence
  chemically synthesized
tcttttacctgaaatctccctc

SEQ ID NO: 904318 - DNA, 22 bp, Artificial Sequence
  chemically synthesized
ttctcttttacctgaaatctcc

SEQ ID NO: 904319 - DNA, 22 bp, Artificial Sequence
  chemically synthesized
tgttctcttttacctgaaatct

SEQ ID NO: 904320 - DNA, 22 bp, Artificial Sequence
  chemically synthesized
ctgttctcttttacctgaaatc

SEQ ID NO: 904321 - DNA, 22 bp, Artificial Sequence
  chemically synthesized
atttctgttctcttttacctga

SEQ ID NO: 904322 - DNA, 22 bp, Artificial Sequence
  chemically synthesized
aatttctgttctcttttacctg

SEQ ID NO: 904323 - DNA, 22 bp, Artificial Sequence
  chemically synthesized
taatttctgttctcttttacct

SEQ ID NO: 904324 - DNA, 22 bp, Artificial Sequence
  chemically synthesized
ttaatttctgttctcttttacc

SEQ ID NO: 904325 - DNA, 22 bp, Artificial Sequence
  chemically synthesized
tttaatttctgttctcttttac

SEQ ID NO: 904326 - DNA, 22 bp, Artificial Sequence
  chemically synthesized
ttttaatttctgttctctttta

SEQ ID NO: 904327 - DNA, 22 bp, Artificial Sequence
  chemically synthesized
tttttaatttctgttctctttt

SEQ ID NO: 904328 - DNA, 22 bp, Artificial Sequence
  chemically synthesized
ttttttaatttctgttctcttt

SEQ ID NO: 904329 - DNA, 22 bp, Artificial Sequence
  chemically synthesized
tttttttaatttctgttctctt

SEQ ID NO: 904330 - DNA, 22 bp, Artificial Sequence
  chemically synthesized
ctttttttttaatttctgttct

SEQ ID NO: 904331 - DNA, 22 bp, Artificial Sequence
  chemically synthesized
cctttttttttaatttctgttc

SEQ ID NO: 904332 - DNA, 22 bp, Artificial Sequence
  chemically synthesized
caggtaaaagagaacagaaatt

SEQ ID NO: 904333 - DNA, 22 bp, Artificial Sequence
  chemically synthesized
aggtaaaagagaacagaaatta

SEQ ID NO: 904334 - DNA, 22 bp, Artificial Sequence
  chemically synthesized
cccccttcctttttttttaatt

SEQ ID NO: 904335 - DNA, 22 bp, Artificial Sequence
  chemically synthesized
tccccccttcctttttttttaa

SEQ ID NO: 904336 - DNA, 22 bp, Artificial Sequence
  chemically synthesized
ctccccccttccttttttttta

SEQ ID NO: 904337 - DNA, 22 bp, Artificial Sequence
  chemically synthesized
tctccccccttccttttttttt

SEQ ID NO: 904338 - DNA, 22 bp, Artificial Sequence
  chemically synthesized
cctttctccccccttccttttt

SEQ ID NO: 904339 - DNA, 22 bp, Artificial Sequence
  chemically synthesized
ttgcctttctccccccttcctt

SEQ ID NO: 904340 - DNA, 22 bp, Artificial Sequence
  chemically synthesized
tgttgcctttctccccccttcc

SEQ ID NO: 904341 - DNA, 22 bp, Artificial Sequence
  chemically synthesized
aaaaaaaaggaaggggggagaa

SEQ ID NO: 904342 - DNA, 22 bp, Artificial Sequence
  chemically synthesized
gtctctgttgcctttctccccc

SEQ ID NO: 904343 - DNA, 22 bp, Artificial Sequence
  chemically synthesized
cccatctcgtctctgttgcctt

SEQ ID NO: 904344 - DNA, 22 bp, Artificial Sequence
  chemically synthesized
ccccatctcgtctctgttgcct

SEQ ID NO: 904345 - DNA, 22 bp, Artificial Sequence
  chemically synthesized
tccccatctcgtctctgttgcc

SEQ ID NO: 904346 - DNA, 22 bp, Artificial Sequence
  chemically synthesized
ttccccatctcgtctctgttgc

SEQ ID NO: 904347 - DNA, 22 bp, Artificial Sequence
  chemically synthesized
ttttccccatctcgtctctgtt

SEQ ID NO: 904348 - DNA, 22 bp, Artificial Sequence
  chemically synthesized
ctcttttccccatctcgtctct

SEQ ID NO: 904349 - DNA, 22 bp, Artificial Sequence
  chemically synthesized
gctcttttccccatctcgtctc

SEQ ID NO: 904350 - DNA, 22 bp, Artificial Sequence
  chemically synthesized
tgctcttttccccatctcgtct

SEQ ID NO: 904351 - DNA, 22 bp, Artificial Sequence
  chemically synthesized
atcccctttgctcttttcccca

SEQ ID NO: 904352 - DNA, 22 bp, Artificial Sequence
  chemically synthesized
aagatgtgttaatcccctttgc

SEQ ID NO: 904353 - DNA, 22 bp, Artificial Sequence
  chemically synthesized
tcaagatgtgttaatccccttt

SEQ ID NO: 904354 - DNA, 22 bp, Artificial Sequence
  chemically synthesized
accctctcaagatgtgttaatc

SEQ ID NO: 904355 - DNA, 22 bp, Artificial Sequence
  chemically synthesized
atctcaccctctcaagatgtgt

SEQ ID NO: 904356 - DNA, 22 bp, Artificial Sequence
  chemically synthesized
catctcaccctctcaagatgtg

SEQ ID NO: 904357 - DNA, 22 bp, Artificial Sequence
  chemically synthesized
tcatctcaccctctcaagatgt

SEQ ID NO: 904358 - DNA, 22 bp, Artificial Sequence
  chemically synthesized
acactttcatctcaccctctca

SEQ ID NO: 904359 - DNA, 22 bp, Artificial Sequence
  chemically synthesized
ctcacactttcatctcaccctc

SEQ ID NO: 904360 - DNA, 22 bp, Artificial Sequence
  chemically synthesized
acacatcttgagagggtgagat

SEQ ID NO: 904361 - DNA, 22 bp, Artificial Sequence
  chemically synthesized
cctcacactttcatctcaccct

SEQ ID NO: 904362 - DNA, 22 bp, Artificial Sequence
  chemically synthesized
tcctcacactttcatctcaccc

SEQ ID NO: 904363 - DNA, 22 bp, Artificial Sequence
  chemically synthesized
ttcctcacactttcatctcacc

SEQ ID NO: 904364 - DNA, 22 bp, Artificial Sequence
  chemically synthesized
tttcctcacactttcatctcac

SEQ ID NO: 904365 - DNA, 22 bp, Artificial Sequence
  chemically synthesized
ctttttcctcacactttcatct

SEQ ID NO: 904366 - DNA, 22 bp, Artificial Sequence
  chemically synthesized
actttttcctcacactttcatc

SEQ ID NO: 904367 - DNA, 22 bp, Artificial Sequence
  chemically synthesized
tactttttcctcacactttcat

SEQ ID NO: 904368 - DNA, 22 bp, Artificial Sequence
  chemically synthesized
gagagggtgagatgaaagtgtg

SEQ ID NO: 904369 - DNA, 22 bp, Artificial Sequence
  chemically synthesized
ttactttttcctcacactttca

SEQ ID NO: 904370 - DNA, 22 bp, Artificial Sequence
  chemically synthesized
agagggtgagatgaaagtgtga

SEQ ID NO: 904371 - DNA, 22 bp, Artificial Sequence
  chemically synthesized
tttactttttcctcacactttc

SEQ ID NO: 904372 - DNA, 22 bp, Artificial Sequence
  chemically synthesized
taattttttactttttcctcac

SEQ ID NO: 904373 - DNA, 22 bp, Artificial Sequence
  chemically synthesized
atgctataattttttacttttt

SEQ ID NO: 904374 - DNA, 22 bp, Artificial Sequence
  chemically synthesized
catgctataattttttactttt

SEQ ID NO: 904375 - DNA, 22 bp, Artificial Sequence
  chemically synthesized
tcatgctataattttttacttt

SEQ ID NO: 904376 - DNA, 22 bp, Artificial Sequence
  chemically synthesized
ttttcatgctataattttttac

SEQ ID NO: 904377 - DNA, 22 bp, Artificial Sequence
  chemically synthesized
tattttcatgctataatttttt

SEQ ID NO: 904378 - DNA, 22 bp, Artificial Sequence
  chemically synthesized
catctctattttcatgctataa

SEQ ID NO: 904379 - DNA, 22 bp, Artificial Sequence
  chemically synthesized
gtacactacatctctattttca

SEQ ID NO: 904380 - DNA, 22 bp, Artificial Sequence
  chemically synthesized
tagcatgaaaatagagatgtag

SEQ ID NO: 904381 - DNA, 22 bp, Artificial Sequence
  chemically synthesized
catgttagtacactacatctct

SEQ ID NO: 904382 - DNA, 22 bp, Artificial Sequence
  chemically synthesized
tattacatgttagtacactaca

SEQ ID NO: 904383 - DNA, 22 bp, Artificial Sequence
  chemically synthesized
tatattacatgttagtacacta

SEQ ID NO: 904384 - DNA, 22 bp, Artificial Sequence
  chemically synthesized
atcaactctatattacatgtta

SEQ ID NO: 904385 - DNA, 22 bp, Artificial Sequence
  chemically synthesized
catcaactctatattacatgtt

SEQ ID NO: 904386 - DNA, 22 bp, Artificial Sequence
  chemically synthesized
caacatgtcttcatcaactcta

SEQ ID NO: 904387 - DNA, 22 bp, Artificial Sequence
  chemically synthesized
acatgtaatatagagttgatga

SEQ ID NO: 904388 - DNA, 22 bp, Artificial Sequence
  chemically synthesized
attccaacatgtcttcatcaac

SEQ ID NO: 904389 - DNA, 22 bp, Artificial Sequence
  chemically synthesized
agaagttaattccaacatgtct

SEQ ID NO: 904390 - DNA, 22 bp, Artificial Sequence
  chemically synthesized
cagaagttaattccaacatgtc

SEQ ID NO: 904391 - DNA, 22 bp, Artificial Sequence
  chemically synthesized
tcagaagttaattccaacatgt

SEQ ID NO: 904392 - DNA, 22 bp, Artificial Sequence
  chemically synthesized
atgaagacatgttggaattaac

SEQ ID NO: 904393 - DNA, 22 bp, Artificial Sequence
  chemically synthesized
atcaacaattttcagaagttaa

SEQ ID NO: 904394 - DNA, 22 bp, Artificial Sequence
  chemically synthesized
tgcattcatcaacaattttcag

SEQ ID NO: 904395 - DNA, 22 bp, Artificial Sequence
  chemically synthesized
gaattaacttctgaaaattgtt

SEQ ID NO: 904396 - DNA, 22 bp, Artificial Sequence
  chemically synthesized
aactgtgcattcatcaacaatt

SEQ ID NO: 904397 - DNA, 22 bp, Artificial Sequence
  chemically synthesized
taaactgtgcattcatcaacaa

SEQ ID NO: 904398 - DNA, 22 bp, Artificial Sequence
  chemically synthesized
acttctgaaaattgttgatgaa

SEQ ID NO: 904399 - DNA, 22 bp, Artificial Sequence
  chemically synthesized
ctaaactgtgcattcatcaaca

SEQ ID NO: 904400 - DNA, 22 bp, Artificial Sequence
  chemically synthesized
ctgaaaattgttgatgaatgca

SEQ ID NO: 904401 - DNA, 22 bp, Artificial Sequence
  chemically synthesized
tgaaaattgttgatgaatgcac

SEQ ID NO: 904402 - DNA, 22 bp, Artificial Sequence
  chemically synthesized
aaaattgttgatgaatgcacag

SEQ ID NO: 904403 - DNA, 22 bp, Artificial Sequence
  chemically synthesized
gtcatttctaaactgtgcattc

SEQ ID NO: 904404 - DNA, 22 bp, Artificial Sequence
  chemically synthesized
ttcgtcatttctaaactgtgca

SEQ ID NO: 904405 - DNA, 22 bp, Artificial Sequence
  chemically synthesized
ttattcgtcatttctaaactgt

SEQ ID NO: 904406 - DNA, 22 bp, Artificial Sequence
  chemically synthesized
ttgatgaatgcacagtttagaa

SEQ ID NO: 904407 - DNA, 22 bp, Artificial Sequence
  chemically synthesized
atgaatgcacagtttagaaatg

SEQ ID NO: 904408 - DNA, 22 bp, Artificial Sequence
  chemically synthesized
agaaatgacgaataatagttct

SEQ ID NO: 904409 - DNA, 22 bp, Artificial Sequence
  chemically synthesized
gaaatgacgaataatagttcta

SEQ ID NO: 904410 - DNA, 22 bp, Artificial Sequence
  chemically synthesized
aatggaaatggaatagaactat

SEQ ID NO: 904411 - DNA, 22 bp, Artificial Sequence
  chemically synthesized
aaatggaaatggaatagaacta

SEQ ID NO: 904412 - DNA, 22 bp, Artificial Sequence
  chemically synthesized
taaatggaaatggaatagaact

SEQ ID NO: 904413 - DNA, 22 bp, Artificial Sequence
  chemically synthesized
tcctttaaatggaaatggaata

SEQ ID NO: 904414 - DNA, 22 bp, Artificial Sequence
  chemically synthesized
atcctttaaatggaaatggaat

SEQ ID NO: 904415 - DNA, 22 bp, Artificial Sequence
  chemically synthesized
tatcctttaaatggaaatggaa

SEQ ID NO: 904416 - DNA, 22 bp, Artificial Sequence
  chemically synthesized
aagcctttatcctttaaatgga

SEQ ID NO: 904417 - DNA, 22 bp, Artificial Sequence
  chemically synthesized
gaagcctttatcctttaaatgg

SEQ ID NO: 904418 - DNA, 22 bp, Artificial Sequence
  chemically synthesized
tgaagcctttatcctttaaatg

SEQ ID NO: 904419 - DNA, 22 bp, Artificial Sequence
  chemically synthesized
tattccatttccatttaaagga

SEQ ID NO: 904420 - DNA, 22 bp, Artificial Sequence
  chemically synthesized
ttccatttccatttaaaggata

SEQ ID NO: 904421 - DNA, 22 bp, Artificial Sequence
  chemically synthesized
catttccatttaaaggataaag

SEQ ID NO: 904422 - DNA, 22 bp, Artificial Sequence
  chemically synthesized
atgcattttgaagcctttatcc

SEQ ID NO: 904423 - DNA, 22 bp, Artificial Sequence
  chemically synthesized
catgcattttgaagcctttatc

SEQ ID NO: 904424 - DNA, 22 bp, Artificial Sequence
  chemically synthesized
tcatgcattttgaagcctttat

SEQ ID NO: 904425 - DNA, 22 bp, Artificial Sequence
  chemically synthesized
ccatttaaaggataaaggcttc

SEQ ID NO: 904426 - DNA, 22 bp, Artificial Sequence
  chemically synthesized
ttcatgcattttgaagccttta

SEQ ID NO: 904427 - DNA, 22 bp, Artificial Sequence
  chemically synthesized
catttaaaggataaaggcttca

SEQ ID NO: 904428 - DNA, 22 bp, Artificial Sequence
  chemically synthesized
aaaggataaaggcttcaaaatg

SEQ ID NO: 904429 - DNA, 22 bp, Artificial Sequence
  chemically synthesized
taatttttcatgcattttgaag

SEQ ID NO: 904430 - DNA, 22 bp, Artificial Sequence
  chemically synthesized
aaggataaaggcttcaaaatgc

SEQ ID NO: 904431 - DNA, 22 bp, Artificial Sequence
  chemically synthesized
ataatttttcatgcattttgaa

SEQ ID NO: 904432 - DNA, 22 bp, Artificial Sequence
  chemically synthesized
tataatttttcatgcattttga

SEQ ID NO: 904433 - DNA, 22 bp, Artificial Sequence
  chemically synthesized
actttataatttttcatgcatt

SEQ ID NO: 904434 - DNA, 22 bp, Artificial Sequence
  chemically synthesized
aaaattcactttataatttttc

SEQ ID NO: 904435 - DNA, 22 bp, Artificial Sequence
  chemically synthesized
aaaaattcactttataattttt

SEQ ID NO: 904436 - DNA, 22 bp, Artificial Sequence
  chemically synthesized
caaaatgcatgaaaaattataa

SEQ ID NO: 904437 - DNA, 22 bp, Artificial Sequence
  chemically synthesized
aaaatgcatgaaaaattataaa

SEQ ID NO: 904438 - DNA, 22 bp, Artificial Sequence
  chemically synthesized
atgaaccatttaaaaattcact

SEQ ID NO: 904439 - DNA, 22 bp, Artificial Sequence
  chemically synthesized
catgaaccatttaaaaattcac

SEQ ID NO: 904440 - DNA, 22 bp, Artificial Sequence
  chemically synthesized
agatttcatgaaccatttaaaa

SEQ ID NO: 904441 - DNA, 22 bp, Artificial Sequence
  chemically synthesized
taaagtgaatttttaaatggtt

SEQ ID NO: 904442 - DNA, 22 bp, Artificial Sequence
  chemically synthesized
agaaagctgagatttcatgaac

SEQ ID NO: 904443 - DNA, 22 bp, Artificial Sequence
  chemically synthesized
cagaaagctgagatttcatgaa

SEQ ID NO: 904444 - DNA, 22 bp, Artificial Sequence
  chemically synthesized
ttaaatggttcatgaaatctca

SEQ ID NO: 904445 - DNA, 22 bp, Artificial Sequence
  chemically synthesized
gtttcagaaagctgagatttca

SEQ ID NO: 904446 - DNA, 22 bp, Artificial Sequence
  chemically synthesized
taaatggttcatgaaatctcag

SEQ ID NO: 904447 - DNA, 22 bp, Artificial Sequence
  chemically synthesized
agtttcagaaagctgagatttc

SEQ ID NO: 904448 - DNA, 22 bp, Artificial Sequence
  chemically synthesized
aaatggttcatgaaatctcagc

SEQ ID NO: 904449 - DNA, 22 bp, Artificial Sequence
  chemically synthesized
aatggttcatgaaatctcagct

SEQ ID NO: 904450 - DNA, 22 bp, Artificial Sequence
  chemically synthesized
atttagtttcagaaagctgaga

SEQ ID NO: 904451 - DNA, 22 bp, Artificial Sequence
  chemically synthesized
atgaaatctcagctttctgaaa

SEQ ID NO: 904452 - DNA, 22 bp, Artificial Sequence
  chemically synthesized
agctttctgaaactaaattagc

SEQ ID NO: 904453 - DNA, 22 bp, Artificial Sequence
  chemically synthesized
aaaaacaaaagaagctaattta

SEQ ID NO: 904454 - DNA, 22 bp, Artificial Sequence
  chemically synthesized
tctgaaactaaattagcttctt

SEQ ID NO: 904455 - DNA, 22 bp, Artificial Sequence
  chemically synthesized
ctgaaactaaattagcttcttt

SEQ ID NO: 904456 - DNA, 22 bp, Artificial Sequence
  chemically synthesized
tgaaactaaattagcttctttt

SEQ ID NO: 904457 - DNA, 22 bp, Artificial Sequence
  chemically synthesized
gaatctgaaaaacaaaagaagc

SEQ ID NO: 904458 - DNA, 22 bp, Artificial Sequence
  chemically synthesized
aaactaaattagcttcttttgt

SEQ ID NO: 904459 - DNA, 22 bp, Artificial Sequence
  chemically synthesized
cgaatctgaaaaacaaaagaag

SEQ ID NO: 904460 - DNA, 22 bp, Artificial Sequence
  chemically synthesized
aattagcttcttttgtttttca

SEQ ID NO: 904461 - DNA, 22 bp, Artificial Sequence
  chemically synthesized
gcttcttttgtttttcagattc

SEQ ID NO: 904462 - DNA, 22 bp, Artificial Sequence
  chemically synthesized
cttttgtttttcagattcgaaa

SEQ ID NO: 904463 - DNA, 22 bp, Artificial Sequence
  chemically synthesized
ttttgtttttcagattcgaaac

SEQ ID NO: 904464 - DNA, 22 bp, Artificial Sequence
  chemically synthesized
ttgtttttcagattcgaaactc

SEQ ID NO: 904465 - DNA, 22 bp, Artificial Sequence
  chemically synthesized
tgtttttcagattcgaaactct

SEQ ID NO: 904466 - DNA, 22 bp, Artificial Sequence
  chemically synthesized
gtttttcagattcgaaactcta

SEQ ID NO: 904467 - DNA, 22 bp, Artificial Sequence
  chemically synthesized
tttttcagattcgaaactctat

SEQ ID NO: 904468 - DNA, 22 bp, Artificial Sequence
  chemically synthesized
ttcagattcgaaactctatgat

SEQ ID NO: 904469 - DNA, 22 bp, Artificial Sequence
  chemically synthesized
tcagattcgaaactctatgata

SEQ ID NO: 904470 - DNA, 22 bp, Artificial Sequence
  chemically synthesized
cagattcgaaactctatgatat

SEQ ID NO: 904471 - DNA, 22 bp, Artificial Sequence
  chemically synthesized
agattcgaaactctatgatatg

SEQ ID NO: 904472 - DNA, 22 bp, Artificial Sequence
  chemically synthesized
gaaactctatgatatggtttgg

SEQ ID NO: 904473 - DNA, 22 bp, Artificial Sequence
  chemically synthesized
gtacagacacagccaaaccata

SEQ ID NO: 904474 - DNA, 22 bp, Artificial Sequence
  chemically synthesized
ggtacagacacagccaaaccat

SEQ ID NO: 904475 - DNA, 22 bp, Artificial Sequence
  chemically synthesized
tggtacagacacagccaaacca

SEQ ID NO: 904476 - DNA, 22 bp, Artificial Sequence
  chemically synthesized
ttggtacagacacagccaaacc

SEQ ID NO: 904477 - DNA, 22 bp, Artificial Sequence
  chemically synthesized
tatgatatggtttggctgtgtc

SEQ ID NO: 904478 - DNA, 22 bp, Artificial Sequence
  chemically synthesized
tgatatggtttggctgtgtctg

SEQ ID NO: 904479 - DNA, 22 bp, Artificial Sequence
  chemically synthesized
agatgagcttttggtacagaca

SEQ ID NO: 904480 - DNA, 22 bp, Artificial Sequence
  chemically synthesized
aagatgagcttttggtacagac

SEQ ID NO: 904481 - DNA, 22 bp, Artificial Sequence
  chemically synthesized
ggctgtgtctgtaccaaaagct

SEQ ID NO: 904482 - DNA, 22 bp, Artificial Sequence
  chemically synthesized
gctgtgtctgtaccaaaagctc

SEQ ID NO: 904483 - DNA, 22 bp, Artificial Sequence
  chemically synthesized
tgtctgtaccaaaagctcatct

SEQ ID NO: 904484 - DNA, 22 bp, Artificial Sequence
  chemically synthesized
tgggaacaacagcttaagatga

SEQ ID NO: 904485 - DNA, 22 bp, Artificial Sequence
  chemically synthesized
taccaaaagctcatcttaagct

SEQ ID NO: 904486 - DNA, 22 bp, Artificial Sequence
  chemically synthesized
atcttaagctgttgttcccata

SEQ ID NO: 904487 - DNA, 22 bp, Artificial Sequence
  chemically synthesized
aagctgttgttcccataacccc

SEQ ID NO: 904488 - DNA, 22 bp, Artificial Sequence
  chemically synthesized
ccaggacgtgtgggggttatgg

SEQ ID NO: 904489 - DNA, 22 bp, Artificial Sequence
  chemically synthesized
agctgttgttcccataaccccc

SEQ ID NO: 904490 - DNA, 22 bp, Artificial Sequence
  chemically synthesized
ttgttcccataacccccacacg

SEQ ID NO: 904491 - DNA, 22 bp, Artificial Sequence
  chemically synthesized
atccctcccaggacgtgtgggg

SEQ ID NO: 904492 - DNA, 22 bp, Artificial Sequence
  chemically synthesized
ttcccataacccccacacgtcc

SEQ ID NO: 904493 - DNA, 22 bp, Artificial Sequence
  chemically synthesized
ccataacccccacacgtcctgg

SEQ ID NO: 904494 - DNA, 22 bp, Artificial Sequence
  chemically synthesized
cacctgatccctcccaggacgt

SEQ ID NO: 904495 - DNA, 22 bp, Artificial Sequence
  chemically synthesized
tctccacctgatccctcccagg

SEQ ID NO: 904496 - DNA, 22 bp, Artificial Sequence
  chemically synthesized
aattatctccacctgatccctc

SEQ ID NO: 904497 - DNA, 22 bp, Artificial Sequence
  chemically synthesized
ggagggatcaggtggagataat

SEQ ID NO: 904498 - DNA, 22 bp, Artificial Sequence
  chemically synthesized
aatcacggcgggcggttaccct

SEQ ID NO: 904499 - DNA, 22 bp, Artificial Sequence
  chemically synthesized
tcacaagaacagcatgagggta

SEQ ID NO: 904500 - DNA, 22 bp, Artificial Sequence
  chemically synthesized
actgtcacaagaacagcatgag

SEQ ID NO: 904501 - DNA, 22 bp, Artificial Sequence
  chemically synthesized
ccctcatgctgttcttgtgaca

SEQ ID NO: 904502 - DNA, 22 bp, Artificial Sequence
  chemically synthesized
gtgagaactcactgtcacaaga

SEQ ID NO: 904503 - DNA, 22 bp, Artificial Sequence
  chemically synthesized
atgctgttcttgtgacagtgag

SEQ ID NO: 904504 - DNA, 22 bp, Artificial Sequence
  chemically synthesized
ttcttgtgacagtgagttctca

SEQ ID NO: 904505 - DNA, 22 bp, Artificial Sequence
  chemically synthesized
ttgtgacagtgagttctcacga

SEQ ID NO: 904506 - DNA, 22 bp, Artificial Sequence
  chemically synthesized
gtgacagtgagttctcacgagg

SEQ ID NO: 904507 - DNA, 22 bp, Artificial Sequence
  chemically synthesized
tgacagtgagttctcacgaggt

SEQ ID NO: 904508 - DNA, 22 bp, Artificial Sequence
  chemically synthesized
taaaaccatcagacctcgtgag

SEQ ID NO: 904509 - DNA, 22 bp, Artificial Sequence
  chemically synthesized
ataaaaccatcagacctcgtga

SEQ ID NO: 904510 - DNA, 22 bp, Artificial Sequence
  chemically synthesized
tcacgaggtctgatggttttat

SEQ ID NO: 904511 - DNA, 22 bp, Artificial Sequence
  chemically synthesized
acgaggtctgatggttttataa

SEQ ID NO: 904512 - DNA, 22 bp, Artificial Sequence
  chemically synthesized
atggttttataaggggcttttc

SEQ ID NO: 904513 - DNA, 22 bp, Artificial Sequence
  chemically synthesized
tataaggggcttttccctcttt

SEQ ID NO: 904514 - DNA, 22 bp, Artificial Sequence
  chemically synthesized
ataaggggcttttccctctttt

SEQ ID NO: 904515 - DNA, 22 bp, Artificial Sequence
  chemically synthesized
taaggggcttttccctcttttg

SEQ ID NO: 904516 - DNA, 22 bp, Artificial Sequence
  chemically synthesized
ttccctcttttgctcattctcc

SEQ ID NO: 904517 - DNA, 22 bp, Artificial Sequence
  chemically synthesized
tccctcttttgctcattctcct

SEQ ID NO: 904518 - DNA, 22 bp, Artificial Sequence
  chemically synthesized
ccctcttttgctcattctcctc

SEQ ID NO: 904519 - DNA, 22 bp, Artificial Sequence
  chemically synthesized
cctcttttgctcattctcctcc

SEQ ID NO: 904520 - DNA, 22 bp, Artificial Sequence
  chemically synthesized
acatggcagcaggaaggaggag

SEQ ID NO: 904521 - DNA, 22 bp, Artificial Sequence
  chemically synthesized
ttttgctcattctcctccttcc

SEQ ID NO: 904522 - DNA, 22 bp, Artificial Sequence
  chemically synthesized
cacatggcagcaggaaggagga

SEQ ID NO: 904523 - DNA, 22 bp, Artificial Sequence
  chemically synthesized
ttgctcattctcctccttcctg

SEQ ID NO: 904524 - DNA, 22 bp, Artificial Sequence
  chemically synthesized
ttcacatggcagcaggaaggag

SEQ ID NO: 904525 - DNA, 22 bp, Artificial Sequence
  chemically synthesized
tgctcattctcctccttcctgc

SEQ ID NO: 904526 - DNA, 22 bp, Artificial Sequence
  chemically synthesized
cttcacatggcagcaggaagga

SEQ ID NO: 904527 - DNA, 22 bp, Artificial Sequence
  chemically synthesized
gctcattctcctccttcctgct

SEQ ID NO: 904528 - DNA, 22 bp, Artificial Sequence
  chemically synthesized
ctcattctcctccttcctgctg

SEQ ID NO: 904529 - DNA, 22 bp, Artificial Sequence
  chemically synthesized
ttcttcacatggcagcaggaag

SEQ ID NO: 904530 - DNA, 22 bp, Artificial Sequence
  chemically synthesized
cttcttcacatggcagcaggaa

SEQ ID NO: 904531 - DNA, 22 bp, Artificial Sequence
  chemically synthesized
attctcctccttcctgctgcca

SEQ ID NO: 904532 - DNA, 22 bp, Artificial Sequence
  chemically synthesized
tcctccttcctgctgccatgtg

SEQ ID NO: 904533 - DNA, 22 bp, Artificial Sequence
  chemically synthesized
ctccttcctgctgccatgtgaa

SEQ ID NO: 904534 - DNA, 22 bp, Artificial Sequence
  chemically synthesized
cttcctgctgccatgtgaagaa

SEQ ID NO: 904535 - DNA, 22 bp, Artificial Sequence
  chemically synthesized
cctgctgccatgtgaagaagaa

SEQ ID NO: 904536 - DNA, 22 bp, Artificial Sequence
  chemically synthesized
ctgctgccatgtgaagaagaag

SEQ ID NO: 904537 - DNA, 22 bp, Artificial Sequence
  chemically synthesized
ctgccatgtgaagaagaaggtg

SEQ ID NO: 904538 - DNA, 22 bp, Artificial Sequence
  chemically synthesized
ccatgtgaagaagaaggtgttt

SEQ ID NO: 904539 - DNA, 22 bp, Artificial Sequence
  chemically synthesized
caatcatggcagatggggaagc

SEQ ID NO: 904540 - DNA, 22 bp, Artificial Sequence
  chemically synthesized
acaatcatggcagatggggaag

SEQ ID NO: 904541 - DNA, 22 bp, Artificial Sequence
  chemically synthesized
aggaaacttacaatcatggcag

SEQ ID NO: 904542 - DNA, 22 bp, Artificial Sequence
  chemically synthesized
gcttccccatctgccatgattg

SEQ ID NO: 904543 - DNA, 22 bp, Artificial Sequence
  chemically synthesized
cttccccatctgccatgattgt

SEQ ID NO: 904544 - DNA, 22 bp, Artificial Sequence
  chemically synthesized
ccccatctgccatgattgtaag

SEQ ID NO: 904545 - DNA, 22 bp, Artificial Sequence
  chemically synthesized
cccatctgccatgattgtaagt

SEQ ID NO: 904546 - DNA, 22 bp, Artificial Sequence
  chemically synthesized
gggaggcctcaggaaacttaca

SEQ ID NO: 904547 - DNA, 22 bp, Artificial Sequence
  chemically synthesized
ccatgattgtaagtttcctgag

SEQ ID NO: 904548 - DNA, 22 bp, Artificial Sequence
  chemically synthesized
agcatggctggggaggcctcag

SEQ ID NO: 904549 - DNA, 22 bp, Artificial Sequence
  chemically synthesized
taagtttcctgaggcctcccca

SEQ ID NO: 904550 - DNA, 22 bp, Artificial Sequence
  chemically synthesized
acagttcagcatggctggggag

SEQ ID NO: 904551 - DNA, 22 bp, Artificial Sequence
  chemically synthesized
cctgaggcctccccagccatgc

SEQ ID NO: 904552 - DNA, 22 bp, Artificial Sequence
  chemically synthesized
actcacagttcagcatggctgg

SEQ ID NO: 904553 - DNA, 22 bp, Artificial Sequence
  chemically synthesized
ctgaggcctccccagccatgct

SEQ ID NO: 904554 - DNA, 22 bp, Artificial Sequence
  chemically synthesized
aggcctccccagccatgctgaa

SEQ ID NO: 904555 - DNA, 22 bp, Artificial Sequence
  chemically synthesized
attgactcacagttcagcatgg

SEQ ID NO: 904556 - DNA, 22 bp, Artificial Sequence
  chemically synthesized
aattgactcacagttcagcatg

SEQ ID NO: 904557 - DNA, 22 bp, Artificial Sequence
  chemically synthesized
cccagccatgctgaactgtgag

SEQ ID NO: 904558 - DNA, 22 bp, Artificial Sequence
  chemically synthesized
taaaggaaagtgatttaattga

SEQ ID NO: 904559 - DNA, 22 bp, Artificial Sequence
  chemically synthesized
ataaaggaaagtgatttaattg

SEQ ID NO: 904560 - DNA, 22 bp, Artificial Sequence
  chemically synthesized
aactgtgagtcaattaaatcac

SEQ ID NO: 904561 - DNA, 22 bp, Artificial Sequence
  chemically synthesized
tgagtcaattaaatcactttcc

SEQ ID NO: 904562 - DNA, 22 bp, Artificial Sequence
  chemically synthesized
ggtaatttataaaggaaagtga

SEQ ID NO: 904563 - DNA, 22 bp, Artificial Sequence
  chemically synthesized
agactgggtaatttataaagga

SEQ ID NO: 904564 - DNA, 22 bp, Artificial Sequence
  chemically synthesized
aatcactttcctttataaatta

SEQ ID NO: 904565 - DNA, 22 bp, Artificial Sequence
  chemically synthesized
tcctttataaattacccagtct

SEQ ID NO: 904566 - DNA, 22 bp, Artificial Sequence
  chemically synthesized
cctttataaattacccagtctc

SEQ ID NO: 904567 - DNA, 22 bp, Artificial Sequence
  chemically synthesized
ctttataaattacccagtctca

SEQ ID NO: 904568 - DNA, 22 bp, Artificial Sequence
  chemically synthesized
ataaagacatacctgagactgg

SEQ ID NO: 904569 - DNA, 22 bp, Artificial Sequence
  chemically synthesized
tataaattacccagtctcaggt

SEQ ID NO: 904570 - DNA, 22 bp, Artificial Sequence
  chemically synthesized
ataaattacccagtctcaggta

SEQ ID NO: 904571 - DNA, 22 bp, Artificial Sequence
  chemically synthesized
ctaataaagacatacctgagac

SEQ ID NO: 904572 - DNA, 22 bp, Artificial Sequence
  chemically synthesized
taaattacccagtctcaggtat

SEQ ID NO: 904573 - DNA, 22 bp, Artificial Sequence
  chemically synthesized
acactgctaataaagacatacc

SEQ ID NO: 904574 - DNA, 22 bp, Artificial Sequence
  chemically synthesized
cccagtctcaggtatgtcttta

SEQ ID NO: 904575 - DNA, 22 bp, Artificial Sequence
  chemically synthesized
tcacactgctaataaagacata

SEQ ID NO: 904576 - DNA, 22 bp, Artificial Sequence
  chemically synthesized
ttctcacactgctaataaagac

SEQ ID NO: 904577 - DNA, 22 bp, Artificial Sequence
  chemically synthesized
aggtatgtctttattagcagtg

SEQ ID NO: 904578 - DNA, 22 bp, Artificial Sequence
  chemically synthesized
tattagcagtgtgagaacagac

SEQ ID NO: 904579 - DNA, 22 bp, Artificial Sequence
  chemically synthesized
attagcagtgtgagaacagact

SEQ ID NO: 904580 - DNA, 22 bp, Artificial Sequence
  chemically synthesized
ttagcagtgtgagaacagactg

SEQ ID NO: 904581 - DNA, 22 bp, Artificial Sequence
  chemically synthesized
gcagtgtgagaacagactgata

SEQ ID NO: 904582 - DNA, 22 bp, Artificial Sequence
  chemically synthesized
tatggaatgaaatatatcagtc

SEQ ID NO: 904583 - DNA, 22 bp, Artificial Sequence
  chemically synthesized
gtgttgtatggaatgaaatata

SEQ ID NO: 904584 - DNA, 22 bp, Artificial Sequence
  chemically synthesized
gttggtgttgtatggaatgaaa

SEQ ID NO: 904585 - DNA, 22 bp, Artificial Sequence
  chemically synthesized
atatatttcattccatacaaca

SEQ ID NO: 904586 - DNA, 22 bp, Artificial Sequence
  chemically synthesized
gtatgagacctggttggtgttg

SEQ ID NO: 904587 - DNA, 22 bp, Artificial Sequence
  chemically synthesized
cattccatacaacaccaaccag

SEQ ID NO: 904588 - DNA, 22 bp, Artificial Sequence
  chemically synthesized
attccatacaacaccaaccagg

SEQ ID NO: 904589 - DNA, 22 bp, Artificial Sequence
  chemically synthesized
catacaacaccaaccaggtctc

SEQ ID NO: 904590 - DNA, 22 bp, Artificial Sequence
  chemically synthesized
caagacctggtatgagacctgg

SEQ ID NO: 904591 - DNA, 22 bp, Artificial Sequence
  chemically synthesized
gtatcatctacaagacctggta

SEQ ID NO: 904592 - DNA, 22 bp, Artificial Sequence
  chemically synthesized
ggtatcatctacaagacctggt

SEQ ID NO: 904593 - DNA, 22 bp, Artificial Sequence
  chemically synthesized
tttggtatcatctacaagacct

SEQ ID NO: 904594 - DNA, 22 bp, Artificial Sequence
  chemically synthesized
atttggtatcatctacaagacc

SEQ ID NO: 904595 - DNA, 22 bp, Artificial Sequence
  chemically synthesized
ataccaggtcttgtagatgata

SEQ ID NO: 904596 - DNA, 22 bp, Artificial Sequence
  chemically synthesized
agagagtttatttggtatcatc

SEQ ID NO: 904597 - DNA, 22 bp, Artificial Sequence
  chemically synthesized
cagagagtttatttggtatcat

SEQ ID NO: 904598 - DNA, 22 bp, Artificial Sequence
  chemically synthesized
gtagatgataccaaataaactc

SEQ ID NO: 904599 - DNA, 22 bp, Artificial Sequence
  chemically synthesized
tagatgataccaaataaactct

SEQ ID NO: 904600 - DNA, 22 bp, Artificial Sequence
  chemically synthesized
ggaaaaatatgtttcagagagt

SEQ ID NO: 904601 - DNA, 22 bp, Artificial Sequence
  chemically synthesized
tctgaaacatatttttcctaat

SEQ ID NO: 904602 - DNA, 22 bp, Artificial Sequence
  chemically synthesized
tgaaacatatttttcctaattc

SEQ ID NO: 904603 - DNA, 22 bp, Artificial Sequence
  chemically synthesized
aatgggacaaaaagaattagga

SEQ ID NO: 904604 - DNA, 22 bp, Artificial Sequence
  chemically synthesized
aaacatatttttcctaattctt

SEQ ID NO: 904605 - DNA, 22 bp, Artificial Sequence
  chemically synthesized
acaattcaatgggacaaaaaga

SEQ ID NO: 904606 - DNA, 22 bp, Artificial Sequence
  chemically synthesized
cacaattcaatgggacaaaaag

SEQ ID NO: 904607 - DNA, 22 bp, Artificial Sequence
  chemically synthesized
ttcctaattctttttgtcccat

SEQ ID NO: 904608 - DNA, 22 bp, Artificial Sequence
  chemically synthesized
tcctaattctttttgtcccatt

SEQ ID NO: 904609 - DNA, 22 bp, Artificial Sequence
  chemically synthesized
cctaattctttttgtcccattg

SEQ ID NO: 904610 - DNA, 22 bp, Artificial Sequence
  chemically synthesized
ctaattctttttgtcccattga

SEQ ID NO: 904611 - DNA, 22 bp, Artificial Sequence
  chemically synthesized
attctttttgtcccattgaatt

SEQ ID NO: 904612 - DNA, 22 bp, Artificial Sequence
  chemically synthesized
tttttgtcccattgaattgtga

SEQ ID NO: 904613 - DNA, 22 bp, Artificial Sequence
  chemically synthesized
tttgtcccattgaattgtgaaa

SEQ ID NO: 904614 - DNA, 22 bp, Artificial Sequence
  chemically synthesized
ttgtcccattgaattgtgaaat

SEQ ID NO: 904615 - DNA, 22 bp, Artificial Sequence
  chemically synthesized
tgtcccattgaattgtgaaatt

SEQ ID NO: 904616 - DNA, 22 bp, Artificial Sequence
  chemically synthesized
gtcccattgaattgtgaaattg

SEQ ID NO: 904617 - DNA, 22 bp, Artificial Sequence
  chemically synthesized
tcccattgaattgtgaaattgt

SEQ ID NO: 904618 - DNA, 22 bp, Artificial Sequence
  chemically synthesized
tagatgaaagtgtacaatttca

SEQ ID NO: 904619 - DNA, 22 bp, Artificial Sequence
  chemically synthesized
ctgtagatgaaagtgtacaatt

SEQ ID NO: 904620 - DNA, 22 bp, Artificial Sequence
  chemically synthesized
gctgtagatgaaagtgtacaat

SEQ ID NO: 904621 - DNA, 22 bp, Artificial Sequence
  chemically synthesized
aattgtgaaattgtacactttc

SEQ ID NO: 904622 - DNA, 22 bp, Artificial Sequence
  chemically synthesized
tgaaattgtacactttcatcta

SEQ ID NO: 904623 - DNA, 22 bp, Artificial Sequence
  chemically synthesized
caatatttgctgtagatgaaag

SEQ ID NO: 904624 - DNA, 22 bp, Artificial Sequence
  chemically synthesized
ccaatatttgctgtagatgaaa

SEQ ID NO: 904625 - DNA, 22 bp, Artificial Sequence
  chemically synthesized
tccaatatttgctgtagatgaa

SEQ ID NO: 904626 - DNA, 22 bp, Artificial Sequence
  chemically synthesized
tacactttcatctacagcaaat

SEQ ID NO: 904627 - DNA, 22 bp, Artificial Sequence
  chemically synthesized
tcatctacagcaaatattggaa

SEQ ID NO: 904628 - DNA, 22 bp, Artificial Sequence
  chemically synthesized
catctacagcaaatattggaaa

SEQ ID NO: 904629 - DNA, 22 bp, Artificial Sequence
  chemically synthesized
atctacagcaaatattggaaag

SEQ ID NO: 904630 - DNA, 22 bp, Artificial Sequence
  chemically synthesized
cagatgcagaaactttccaata

SEQ ID NO: 904631 - DNA, 22 bp, Artificial Sequence
  chemically synthesized
ccagatgcagaaactttccaat

SEQ ID NO: 904632 - DNA, 22 bp, Artificial Sequence
  chemically synthesized
cagcaaatattggaaagtttct

SEQ ID NO: 904633 - DNA, 22 bp, Artificial Sequence
  chemically synthesized
aaaatcttccagatgcagaaac

SEQ ID NO: 904634 - DNA, 22 bp, Artificial Sequence
  chemically synthesized
caaaatcttccagatgcagaaa

SEQ ID NO: 904635 - DNA, 22 bp, Artificial Sequence
  chemically synthesized
tcaaaatcttccagatgcagaa

SEQ ID NO: 904636 - DNA, 22 bp, Artificial Sequence
  chemically synthesized
actttcaaaatcttccagatgc

SEQ ID NO: 904637 - DNA, 22 bp, Artificial Sequence
  chemically synthesized
cactttcaaaatcttccagatg

SEQ ID NO: 904638 - DNA, 22 bp, Artificial Sequence
  chemically synthesized
gaaagtttctgcatctggaaga

SEQ ID NO: 904639 - DNA, 22 bp, Artificial Sequence
  chemically synthesized
tcactttcaaaatcttccagat

SEQ ID NO: 904640 - DNA, 22 bp, Artificial Sequence
  chemically synthesized
ttcactttcaaaatcttccaga

SEQ ID NO: 904641 - DNA, 22 bp, Artificial Sequence
  chemically synthesized
ttttcactttcaaaatcttcca

SEQ ID NO: 904642 - DNA, 22 bp, Artificial Sequence
  chemically synthesized
ctgcatctggaagattttgaaa

SEQ ID NO: 904643 - DNA, 22 bp, Artificial Sequence
  chemically synthesized
tgcatctggaagattttgaaag

SEQ ID NO: 904644 - DNA, 22 bp, Artificial Sequence
  chemically synthesized
catctggaagattttgaaagtg

SEQ ID NO: 904645 - DNA, 22 bp, Artificial Sequence
  chemically synthesized
gaagattttgaaagtgaaaaga

SEQ ID NO: 904646 - DNA, 22 bp, Artificial Sequence
  chemically synthesized
atggcaatataagataattctt

SEQ ID NO: 904647 - DNA, 22 bp, Artificial Sequence
  chemically synthesized
tgaaagtgaaaagaattatctt

SEQ ID NO: 904648 - DNA, 22 bp, Artificial Sequence
  chemically synthesized
gaaagtgaaaagaattatctta

SEQ ID NO: 904649 - DNA, 22 bp, Artificial Sequence
  chemically synthesized
aaagtgaaaagaattatcttat

SEQ ID NO: 904650 - DNA, 22 bp, Artificial Sequence
  chemically synthesized
tgtcattcatggcaatataaga

SEQ ID NO: 904651 - DNA, 22 bp, Artificial Sequence
  chemically synthesized
tcaagggctgtgtcattcatgg

SEQ ID NO: 904652 - DNA, 22 bp, Artificial Sequence
  chemically synthesized
atcaagggctgtgtcattcatg

SEQ ID NO: 904653 - DNA, 22 bp, Artificial Sequence
  chemically synthesized
tcttatattgccatgaatgaca

SEQ ID NO: 904654 - DNA, 22 bp, Artificial Sequence
  chemically synthesized
atttatcaagggctgtgtcatt

SEQ ID NO: 904655 - DNA, 22 bp, Artificial Sequence
  chemically synthesized
atattgccatgaatgacacagc

SEQ ID NO: 904656 - DNA, 22 bp, Artificial Sequence
  chemically synthesized
tattgccatgaatgacacagcc

SEQ ID NO: 904657 - DNA, 22 bp, Artificial Sequence
  chemically synthesized
ctcatttatcaagggctgtgtc

SEQ ID NO: 904658 - DNA, 22 bp, Artificial Sequence
  chemically synthesized
ctactcatttatcaagggctgt

SEQ ID NO: 904659 - DNA, 22 bp, Artificial Sequence
  chemically synthesized
ccatgaatgacacagcccttga

SEQ ID NO: 904660 - DNA, 22 bp, Artificial Sequence
  chemically synthesized
acatattcctactcatttatca

SEQ ID NO: 904661 - DNA, 22 bp, Artificial Sequence
  chemically synthesized
gataaatgagtaggaatatgtg

SEQ ID NO: 904662 - DNA, 22 bp, Artificial Sequence
  chemically synthesized
aagtaaatatctcacatattcc

SEQ ID NO: 904663 - DNA, 22 bp, Artificial Sequence
  chemically synthesized
ataaatgagtaggaatatgtga

SEQ ID NO: 904664 - DNA, 22 bp, Artificial Sequence
  chemically synthesized
aaagtaaatatctcacatattc

SEQ ID NO: 904665 - DNA, 22 bp, Artificial Sequence
  chemically synthesized
taaagtaaatatctcacatatt

SEQ ID NO: 904666 - DNA, 22 bp, Artificial Sequence
  chemically synthesized
aagacaattttaaagtaaatat

SEQ ID NO: 904667 - DNA, 22 bp, Artificial Sequence
  chemically synthesized
aaagacaattttaaagtaaata

SEQ ID NO: 904668 - DNA, 22 bp, Artificial Sequence
  chemically synthesized
taaagacaattttaaagtaaat

SEQ ID NO: 904669 - DNA, 22 bp, Artificial Sequence
  chemically synthesized
cctttaaagacaattttaaagt

SEQ ID NO: 904670 - DNA, 22 bp, Artificial Sequence
  chemically synthesized
actttaaaattgtctttaaagg

SEQ ID NO: 904671 - DNA, 22 bp, Artificial Sequence
  chemically synthesized
ctttaaaattgtctttaaaggc

SEQ ID NO: 904672 - DNA, 22 bp, Artificial Sequence
  chemically synthesized
taaaattgtctttaaaggcaat

SEQ ID NO: 904673 - DNA, 22 bp, Artificial Sequence
  chemically synthesized
aaaattgtctttaaaggcaata

SEQ ID NO: 904674 - DNA, 22 bp, Artificial Sequence
  chemically synthesized
aaattgtctttaaaggcaatat

SEQ ID NO: 904675 - DNA, 22 bp, Artificial Sequence
  chemically synthesized
tctttaaaggcaatatccattc

SEQ ID NO: 904676 - DNA, 22 bp, Artificial Sequence
  chemically synthesized
tgatgtcaataatagaatggat

SEQ ID NO: 904677 - DNA, 22 bp, Artificial Sequence
  chemically synthesized
taaaggcaatatccattctatt

SEQ ID NO: 904678 - DNA, 22 bp, Artificial Sequence
  chemically synthesized
aaaggcaatatccattctatta

SEQ ID NO: 904679 - DNA, 22 bp, Artificial Sequence
  chemically synthesized
aaggcaatatccattctattat

SEQ ID NO: 904680 - DNA, 22 bp, Artificial Sequence
  chemically synthesized
aatgttatgatgtcaataatag

SEQ ID NO: 904681 - DNA, 22 bp, Artificial Sequence
  chemically synthesized
actcaatgttatgatgtcaata

SEQ ID NO: 904682 - DNA, 22 bp, Artificial Sequence
  chemically synthesized
tattattgacatcataacattg

SEQ ID NO: 904683 - DNA, 22 bp, Artificial Sequence
  chemically synthesized
ttattgacatcataacattgag

SEQ ID NO: 904684 - DNA, 22 bp, Artificial Sequence
  chemically synthesized
ataatatgttcactcaatgtta

SEQ ID NO: 904685 - DNA, 22 bp, Artificial Sequence
  chemically synthesized
ttgacatcataacattgagtga

SEQ ID NO: 904686 - DNA, 22 bp, Artificial Sequence
  chemically synthesized
gctgataatatgttcactcaat

SEQ ID NO: 904687 - DNA, 22 bp, Artificial Sequence
  chemically synthesized
acatcataacattgagtgaaca

SEQ ID NO: 904688 - DNA, 22 bp, Artificial Sequence
  chemically synthesized
aatctggctgataatatgttca

SEQ ID NO: 904689 - DNA, 22 bp, Artificial Sequence
  chemically synthesized
ctaaatctggctgataatatgt

SEQ ID NO: 904690 - DNA, 22 bp, Artificial Sequence
  chemically synthesized
actaaatctggctgataatatg

SEQ ID NO: 904691 - DNA, 22 bp, Artificial Sequence
  chemically synthesized
tactaaatctggctgataatat

SEQ ID NO: 904692 - DNA, 22 bp, Artificial Sequence
  chemically synthesized
agtgaacatattatcagccaga

SEQ ID NO: 904693 - DNA, 22 bp, Artificial Sequence
  chemically synthesized
tacagttttactaaatctggct

SEQ ID NO: 904694 - DNA, 22 bp, Artificial Sequence
  chemically synthesized
actgtacagttttactaaatct

SEQ ID NO: 904695 - DNA, 22 bp, Artificial Sequence
  chemically synthesized
tcagccagatttagtaaaactg

SEQ ID NO: 904696 - DNA, 22 bp, Artificial Sequence
  chemically synthesized
gaaaattcactgtacagtttta

SEQ ID NO: 904697 - DNA, 22 bp, Artificial Sequence
  chemically synthesized
tggaaaattcactgtacagttt

SEQ ID NO: 904698 - DNA, 22 bp, Artificial Sequence
  chemically synthesized
agtaaaactgtacagtgaattt

SEQ ID NO: 904699 - DNA, 22 bp, Artificial Sequence
  chemically synthesized
gtaaaactgtacagtgaatttt

SEQ ID NO: 904700 - DNA, 22 bp, Artificial Sequence
  chemically synthesized
tacaaggatatctctggaaaat

SEQ ID NO: 904701 - DNA, 22 bp, Artificial Sequence
  chemically synthesized
tacagtgaattttccagagata

SEQ ID NO: 904702 - DNA, 22 bp, Artificial Sequence
  chemically synthesized
tgttatacaaggatatctctgg

SEQ ID NO: 904703 - DNA, 22 bp, Artificial Sequence
  chemically synthesized
atgttatacaaggatatctctg

SEQ ID NO: 904704 - DNA, 22 bp, Artificial Sequence
  chemically synthesized
gatgacttatgttatacaagga

SEQ ID NO: 904705 - DNA, 22 bp, Artificial Sequence
  chemically synthesized
tccagagatatccttgtataac

SEQ ID NO: 904706 - DNA, 22 bp, Artificial Sequence
  chemically synthesized
ccagagatatccttgtataaca

SEQ ID NO: 904707 - DNA, 22 bp, Artificial Sequence
  chemically synthesized
cagagatatccttgtataacat

SEQ ID NO: 904708 - DNA, 22 bp, Artificial Sequence
  chemically synthesized
tggagactagatgacttatgtt

SEQ ID NO: 904709 - DNA, 22 bp, Artificial Sequence
  chemically synthesized
tgtggagactagatgacttatg

SEQ ID NO: 904710 - DNA, 22 bp, Artificial Sequence
  chemically synthesized
ctgtggagactagatgacttat

SEQ ID NO: 904711 - DNA, 22 bp, Artificial Sequence
  chemically synthesized
gtataacataagtcatctagtc

SEQ ID NO: 904712 - DNA, 22 bp, Artificial Sequence
  chemically synthesized
tataacataagtcatctagtct

SEQ ID NO: 904713 - DNA, 22 bp, Artificial Sequence
  chemically synthesized
aatcatttctgtggagactaga

SEQ ID NO: 904714 - DNA, 22 bp, Artificial Sequence
  chemically synthesized
caatcatttctgtggagactag

SEQ ID NO: 904715 - DNA, 22 bp, Artificial Sequence
  chemically synthesized
gtcaaggaatttcaatcatttc

SEQ ID NO: 904716 - DNA, 22 bp, Artificial Sequence
  chemically synthesized
gtctccacagaaatgattgaaa

SEQ ID NO: 904717 - DNA, 22 bp, Artificial Sequence
  chemically synthesized
gtctagtcaaggaatttcaatc

SEQ ID NO: 904718 - DNA, 22 bp, Artificial Sequence
  chemically synthesized
agtctagtcaaggaatttcaat

SEQ ID NO: 904719 - DNA, 22 bp, Artificial Sequence
  chemically synthesized
cacagaaatgattgaaattcct

SEQ ID NO: 904720 - DNA, 22 bp, Artificial Sequence
  chemically synthesized
cttagtctagtcaaggaatttc

SEQ ID NO: 904721 - DNA, 22 bp, Artificial Sequence
  chemically synthesized
aaattccttgactagactaagc

SEQ ID NO: 904722 - DNA, 22 bp, Artificial Sequence
  chemically synthesized
taaccaatggagctgcttagtc

SEQ ID NO: 904723 - DNA, 22 bp, Artificial Sequence
  chemically synthesized
ctgtaaccaatggagctgctta

SEQ ID NO: 904724 - DNA, 22 bp, Artificial Sequence
  chemically synthesized
cttgactagactaagcagctcc

SEQ ID NO: 904725 - DNA, 22 bp, Artificial Sequence
  chemically synthesized
actgtaaccaatggagctgctt

SEQ ID NO: 904726 - DNA, 22 bp, Artificial Sequence
  chemically synthesized
gactagactaagcagctccatt

SEQ ID NO: 904727 - DNA, 22 bp, Artificial Sequence
  chemically synthesized
actagactaagcagctccattg

SEQ ID NO: 904728 - DNA, 22 bp, Artificial Sequence
  chemically synthesized
gatttactgtaaccaatggagc

SEQ ID NO: 904729 - DNA, 22 bp, Artificial Sequence
  chemically synthesized
ggatttactgtaaccaatggag

SEQ ID NO: 904730 - DNA, 22 bp, Artificial Sequence
  chemically synthesized
gactaagcagctccattggtta

SEQ ID NO: 904731 - DNA, 22 bp, Artificial Sequence
  chemically synthesized
tttggatttactgtaaccaatg

SEQ ID NO: 904732 - DNA, 22 bp, Artificial Sequence
  chemically synthesized
agcagctccattggttacagta

SEQ ID NO: 904733 - DNA, 22 bp, Artificial Sequence
  chemically synthesized
cattggttacagtaaatccaaa

SEQ ID NO: 904734 - DNA, 22 bp, Artificial Sequence
  chemically synthesized
gagggggaaattgtttggattt

SEQ ID NO: 904735 - DNA, 22 bp, Artificial Sequence
  chemically synthesized
gttacagtaaatccaaacaatt

SEQ ID NO: 904736 - DNA, 22 bp, Artificial Sequence
  chemically synthesized
cagtaaatccaaacaatttccc

SEQ ID NO: 904737 - DNA, 22 bp, Artificial Sequence
  chemically synthesized
ccccctccaacctcaccttcta

SEQ ID NO: 904738 - DNA, 22 bp, Artificial Sequence
  chemically synthesized
cccctccaacctcaccttctac

SEQ ID NO: 904739 - DNA, 22 bp, Artificial Sequence
  chemically synthesized
caacctcaccttctactttatg

SEQ ID NO: 904740 - DNA, 22 bp, Artificial Sequence
  chemically synthesized
accttctactttatgctcacat

SEQ ID NO: 904741 - DNA, 22 bp, Artificial Sequence
  chemically synthesized
ctactttatgctcacatctact

SEQ ID NO: 904742 - DNA, 22 bp, Artificial Sequence
  chemically synthesized
tactttatgctcacatctactt

SEQ ID NO: 904743 - DNA, 22 bp, Artificial Sequence
  chemically synthesized
agatcataaacaaaagtagatg

SEQ ID NO: 904744 - DNA, 22 bp, Artificial Sequence
  chemically synthesized
ctttatgctcacatctactttt

SEQ ID NO: 904745 - DNA, 22 bp, Artificial Sequence
  chemically synthesized
tatgctcacatctacttttgtt

SEQ ID NO: 904746 - DNA, 22 bp, Artificial Sequence
  chemically synthesized
atgctcacatctacttttgttt

SEQ ID NO: 904747 - DNA, 22 bp, Artificial Sequence
  chemically synthesized
tgctcacatctacttttgttta

SEQ ID NO: 904748 - DNA, 22 bp, Artificial Sequence
  chemically synthesized
aaattgagatcataaacaaaag

SEQ ID NO: 904749 - DNA, 22 bp, Artificial Sequence
  chemically synthesized
acatctacttttgtttatgatc

SEQ ID NO: 904750 - DNA, 22 bp, Artificial Sequence
  chemically synthesized
cttttgtttatgatctcaattt

SEQ ID NO: 904751 - DNA, 22 bp, Artificial Sequence
  chemically synthesized
agacatggacctgaaattgaga

SEQ ID NO: 904752 - DNA, 22 bp, Artificial Sequence
  chemically synthesized
aagacatggacctgaaattgag

SEQ ID NO: 904753 - DNA, 22 bp, Artificial Sequence
  chemically synthesized
ttgtttatgatctcaatttcag

SEQ ID NO: 904754 - DNA, 22 bp, Artificial Sequence
  chemically synthesized
tgtttatgatctcaatttcagg

SEQ ID NO: 904755 - DNA, 22 bp, Artificial Sequence
  chemically synthesized
gtttatgatctcaatttcaggt

SEQ ID NO: 904756 - DNA, 22 bp, Artificial Sequence
  chemically synthesized
tttatgatctcaatttcaggtc

SEQ ID NO: 904757 - DNA, 22 bp, Artificial Sequence
  chemically synthesized
catttaagacatggacctgaaa

SEQ ID NO: 904758 - DNA, 22 bp, Artificial Sequence
  chemically synthesized
atgatctcaatttcaggtccat

SEQ ID NO: 904759 - DNA, 22 bp, Artificial Sequence
  chemically synthesized
tgatctcaatttcaggtccatg

SEQ ID NO: 904760 - DNA, 22 bp, Artificial Sequence
  chemically synthesized
gtaggtctacatttaagacatg

SEQ ID NO: 904761 - DNA, 22 bp, Artificial Sequence
  chemically synthesized
aatttcaggtccatgtcttaaa

SEQ ID NO: 904762 - DNA, 22 bp, Artificial Sequence
  chemically synthesized
agtaggtctacatttaagacat

SEQ ID NO: 904763 - DNA, 22 bp, Artificial Sequence
  chemically synthesized
tagtaggtctacatttaagaca

SEQ ID NO: 904764 - DNA, 22 bp, Artificial Sequence
  chemically synthesized
ttttagtaggtctacatttaag

SEQ ID NO: 904765 - DNA, 22 bp, Artificial Sequence
  chemically synthesized
caggtccatgtcttaaatgtag

SEQ ID NO: 904766 - DNA, 22 bp, Artificial Sequence
  chemically synthesized
aggtccatgtcttaaatgtaga

SEQ ID NO: 904767 - DNA, 22 bp, Artificial Sequence
  chemically synthesized
gagtaaatgtcctattttagta

SEQ ID NO: 904768 - DNA, 22 bp, Artificial Sequence
  chemically synthesized
aaatgtagacctactaaaatag

SEQ ID NO: 904769 - DNA, 22 bp, Artificial Sequence
  chemically synthesized
ggagtaaatgtcctattttagt

SEQ ID NO: 904770 - DNA, 22 bp, Artificial Sequence
  chemically synthesized
aatgtagacctactaaaatagg

SEQ ID NO: 904771 - DNA, 22 bp, Artificial Sequence
  chemically synthesized
aaatttggagtaaatgtcctat

SEQ ID NO: 904772 - DNA, 22 bp, Artificial Sequence
  chemically synthesized
ctaaaataggacatttactcca

SEQ ID NO: 904773 - DNA, 22 bp, Artificial Sequence
  chemically synthesized
aaataggacatttactccaaat

SEQ ID NO: 904774 - DNA, 22 bp, Artificial Sequence
  chemically synthesized
caaccagggaaggaattgaaat

SEQ ID NO: 904775 - DNA, 22 bp, Artificial Sequence
  chemically synthesized
actccaaatttcaattccttcc

SEQ ID NO: 904776 - DNA, 22 bp, Artificial Sequence
  chemically synthesized
ctccaaatttcaattccttccc

SEQ ID NO: 904777 - DNA, 22 bp, Artificial Sequence
  chemically synthesized
caaatttcaattccttccctgg

SEQ ID NO: 904778 - DNA, 22 bp, Artificial Sequence
  chemically synthesized
aaaacatggctgcaaccaggga

SEQ ID NO: 904779 - DNA, 22 bp, Artificial Sequence
  chemically synthesized
caattccttccctggttgcagc

SEQ ID NO: 904780 - DNA, 22 bp, Artificial Sequence
  chemically synthesized
aattccttccctggttgcagcc

SEQ ID NO: 904781 - DNA, 22 bp, Artificial Sequence
  chemically synthesized
gtgtctcaaaacatggctgcaa

SEQ ID NO: 904782 - DNA, 22 bp, Artificial Sequence
  chemically synthesized
tggtgtctcaaaacatggctgc

SEQ ID NO: 904783 - DNA, 22 bp, Artificial Sequence
  chemically synthesized
cttccctggttgcagccatgtt

SEQ ID NO: 904784 - DNA, 22 bp, Artificial Sequence
  chemically synthesized
ccctggttgcagccatgttttg

SEQ ID NO: 904785 - DNA, 22 bp, Artificial Sequence
  chemically synthesized
cctggttgcagccatgttttga

SEQ ID NO: 904786 - DNA, 22 bp, Artificial Sequence
  chemically synthesized
cattctggtgtctcaaaacatg

SEQ ID NO: 904787 - DNA, 22 bp, Artificial Sequence
  chemically synthesized
acattctggtgtctcaaaacat

SEQ ID NO: 904788 - DNA, 22 bp, Artificial Sequence
  chemically synthesized
gttgcagccatgttttgagaca

SEQ ID NO: 904789 - DNA, 22 bp, Artificial Sequence
  chemically synthesized
cagccatgttttgagacaccag

SEQ ID NO: 904790 - DNA, 22 bp, Artificial Sequence
  chemically synthesized
tgtgtcttacattctggtgtct

SEQ ID NO: 904791 - DNA, 22 bp, Artificial Sequence
  chemically synthesized
tgtgtgtcttacattctggtgt

SEQ ID NO: 904792 - DNA, 22 bp, Artificial Sequence
  chemically synthesized
ctgtgtgtcttacattctggtg

SEQ ID NO: 904793 - DNA, 22 bp, Artificial Sequence
  chemically synthesized
tttctgtgtgtcttacattctg

SEQ ID NO: 904794 - DNA, 22 bp, Artificial Sequence
  chemically synthesized
tgtttctgtgtgtcttacattc

SEQ ID NO: 904795 - DNA, 22 bp, Artificial Sequence
  chemically synthesized
ctgtttctgtgtgtcttacatt

SEQ ID NO: 904796 - DNA, 22 bp, Artificial Sequence
  chemically synthesized
tgagacaccagaatgtaagaca

SEQ ID NO: 904797 - DNA, 22 bp, Artificial Sequence
  chemically synthesized
tctgtttctgtgtgtcttacat

SEQ ID NO: 904798 - DNA, 22 bp, Artificial Sequence
  chemically synthesized
gagacaccagaatgtaagacac

SEQ ID NO: 904799 - DNA, 22 bp, Artificial Sequence
  chemically synthesized
agacaccagaatgtaagacaca

SEQ ID NO: 904800 - DNA, 22 bp, Artificial Sequence
  chemically synthesized
cacagtattttctgtttctgtg

SEQ ID NO: 904801 - DNA, 22 bp, Artificial Sequence
  chemically synthesized
ccacagtattttctgtttctgt

SEQ ID NO: 904802 - DNA, 22 bp, Artificial Sequence
  chemically synthesized
cttccacagtattttctgtttc

SEQ ID NO: 904803 - DNA, 22 bp, Artificial Sequence
  chemically synthesized
ccttccacagtattttctgttt

SEQ ID NO: 904804 - DNA, 22 bp, Artificial Sequence
  chemically synthesized
ttccttccacagtattttctgt

SEQ ID NO: 904805 - DNA, 22 bp, Artificial Sequence
  chemically synthesized
attcttccttccacagtatttt

SEQ ID NO: 904806 - DNA, 22 bp, Artificial Sequence
  chemically synthesized
aaaagatgttgattcttccttc

SEQ ID NO: 904807 - DNA, 22 bp, Artificial Sequence
  chemically synthesized
tggaaggaagaatcaacatctt

SEQ ID NO: 904808 - DNA, 22 bp, Artificial Sequence
  chemically synthesized
tatcacaataagttgaaaagat

SEQ ID NO: 904809 - DNA, 22 bp, Artificial Sequence
  chemically synthesized
atatcacaataagttgaaaaga

SEQ ID NO: 904810 - DNA, 22 bp, Artificial Sequence
  chemically synthesized
aaatttatatcacaataagttg

SEQ ID NO: 904811 - DNA, 22 bp, Artificial Sequence
  chemically synthesized
caaatttatatcacaataagtt

SEQ ID NO: 904812 - DNA, 22 bp, Artificial Sequence
  chemically synthesized
tcaaatttatatcacaataagt

SEQ ID NO: 904813 - DNA, 22 bp, Artificial Sequence
  chemically synthesized
ttcaaatttatatcacaataag

SEQ ID NO: 904814 - DNA, 22 bp, Artificial Sequence
  chemically synthesized
ttcaacttattgtgatataaat

SEQ ID NO: 904815 - DNA, 22 bp, Artificial Sequence
  chemically synthesized
tcaacttattgtgatataaatt

SEQ ID NO: 904816 - DNA, 22 bp, Artificial Sequence
  chemically synthesized
caacttattgtgatataaattt

SEQ ID NO: 904817 - DNA, 22 bp, Artificial Sequence
  chemically synthesized
aacttattgtgatataaatttg

SEQ ID NO: 904818 - DNA, 22 bp, Artificial Sequence
  chemically synthesized
catgtcatagcttttcaaattt

SEQ ID NO: 904819 - DNA, 22 bp, Artificial Sequence
  chemically synthesized
attgtgatataaatttgaaaag

SEQ ID NO: 904820 - DNA, 22 bp, Artificial Sequence
  chemically synthesized
ttgtgatataaatttgaaaagc

SEQ ID NO: 904821 - DNA, 22 bp, Artificial Sequence
  chemically synthesized
tgatataaatttgaaaagctat

SEQ ID NO: 904822 - DNA, 22 bp, Artificial Sequence
  chemically synthesized
aatcagaattccatgtcatagc

SEQ ID NO: 904823 - DNA, 22 bp, Artificial Sequence
  chemically synthesized
gaaaagctatgacatggaattc

SEQ ID NO: 904824 - DNA, 22 bp, Artificial Sequence
  chemically synthesized
aaaagctatgacatggaattct

SEQ ID NO: 904825 - DNA, 22 bp, Artificial Sequence
  chemically synthesized
tgacatggaattctgattcaat

SEQ ID NO: 904826 - DNA, 22 bp, Artificial Sequence
  chemically synthesized
caaggagatcatggatatcaat

SEQ ID NO: 904827 - DNA, 22 bp, Artificial Sequence
  chemically synthesized
acaaggagatcatggatatcaa

SEQ ID NO: 904828 - DNA, 22 bp, Artificial Sequence
  chemically synthesized
tgattcaattgatatccatgat

SEQ ID NO: 904829 - DNA, 22 bp, Artificial Sequence
  chemically synthesized
attcaattgatatccatgatct

SEQ ID NO: 904830 - DNA, 22 bp, Artificial Sequence
  chemically synthesized
aggtacttacaaggagatcatg

SEQ ID NO: 904831 - DNA, 22 bp, Artificial Sequence
  chemically synthesized
aattgatatccatgatctcctt

SEQ ID NO: 904832 - DNA, 22 bp, Artificial Sequence
  chemically synthesized
atatccatgatctccttgtaag

SEQ ID NO: 904833 - DNA, 22 bp, Artificial Sequence
  chemically synthesized
agtactcaggtacttacaagga

SEQ ID NO: 904834 - DNA, 22 bp, Artificial Sequence
  chemically synthesized
cagtactcaggtacttacaagg

SEQ ID NO: 904835 - DNA, 22 bp, Artificial Sequence
  chemically synthesized
gcttcagtactcaggtacttac

SEQ ID NO: 904836 - DNA, 22 bp, Artificial Sequence
  chemically synthesized
cttgtaagtacctgagtactga

SEQ ID NO: 904837 - DNA, 22 bp, Artificial Sequence
  chemically synthesized
gtaagtacctgagtactgaagc

SEQ ID NO: 904838 - DNA, 22 bp, Artificial Sequence
  chemically synthesized
taagtacctgagtactgaagcc

SEQ ID NO: 904839 - DNA, 22 bp, Artificial Sequence
  chemically synthesized
agtactgaagccaactgtcttg

SEQ ID NO: 904840 - DNA, 22 bp, Artificial Sequence
  chemically synthesized
ggagacccaaatcaagacagtt

SEQ ID NO: 904841 - DNA, 22 bp, Artificial Sequence
  chemically synthesized
ctgggagacccaaatcaagaca

SEQ ID NO: 904842 - DNA, 22 bp, Artificial Sequence
  chemically synthesized
ctactgggagacccaaatcaag

SEQ ID NO: 904843 - DNA, 22 bp, Artificial Sequence
  chemically synthesized
aagccaactgtcttgatttggg

SEQ ID NO: 904844 - DNA, 22 bp, Artificial Sequence
  chemically synthesized
gctactgggagacccaaatcaa

SEQ ID NO: 904845 - DNA, 22 bp, Artificial Sequence
  chemically synthesized
ggtttgctactgggagacccaa

SEQ ID NO: 904846 - DNA, 22 bp, Artificial Sequence
  chemically synthesized
tgggtttgctactgggagaccc

SEQ ID NO: 904847 - DNA, 22 bp, Artificial Sequence
  chemically synthesized
ctgggtttgctactgggagacc

SEQ ID NO: 904848 - DNA, 22 bp, Artificial Sequence
  chemically synthesized
tcttgatttgggtctcccagta

SEQ ID NO: 904849 - DNA, 22 bp, Artificial Sequence
  chemically synthesized
tttctgggtttgctactgggag

SEQ ID NO: 904850 - DNA, 22 bp, Artificial Sequence
  chemically synthesized
atttctgggtttgctactggga

SEQ ID NO: 904851 - DNA, 22 bp, Artificial Sequence
  chemically synthesized
tatttctgggtttgctactggg

SEQ ID NO: 904852 - DNA, 22 bp, Artificial Sequence
  chemically synthesized
gatttgggtctcccagtagcaa

SEQ ID NO: 904853 - DNA, 22 bp, Artificial Sequence
  chemically synthesized
ttatttctgggtttgctactgg

SEQ ID NO: 904854 - DNA, 22 bp, Artificial Sequence
  chemically synthesized
atttgggtctcccagtagcaaa

SEQ ID NO: 904855 - DNA, 22 bp, Artificial Sequence
  chemically synthesized
gggtctcccagtagcaaaccca

SEQ ID NO: 904856 - DNA, 22 bp, Artificial Sequence
  chemically synthesized
ggtctcccagtagcaaacccag

SEQ ID NO: 904857 - DNA, 22 bp, Artificial Sequence
  chemically synthesized
aaatttttatttctgggtttgc

SEQ ID NO: 904858 - DNA, 22 bp, Artificial Sequence
  chemically synthesized
agctcaaatttttatttctggg

SEQ ID NO: 904859 - DNA, 22 bp, Artificial Sequence
  chemically synthesized
ccagtagcaaacccagaaataa

SEQ ID NO: 904860 - DNA, 22 bp, Artificial Sequence
  chemically synthesized
gagctcaaatttttatttctgg

SEQ ID NO: 904861 - DNA, 22 bp, Artificial Sequence
  chemically synthesized
cttgagctcaaatttttatttc

SEQ ID NO: 904862 - DNA, 22 bp, Artificial Sequence
  chemically synthesized
gaatcacatcccaaaactactt

SEQ ID NO: 904863 - DNA, 22 bp, Artificial Sequence
  chemically synthesized
gagctcaagtagttttgggatg

SEQ ID NO: 904864 - DNA, 22 bp, Artificial Sequence
  chemically synthesized
agctcaagtagttttgggatgt

SEQ ID NO: 904865 - DNA, 22 bp, Artificial Sequence
  chemically synthesized
atgtgtcctggaatcacatccc

SEQ ID NO: 904866 - DNA, 22 bp, Artificial Sequence
  chemically synthesized
aagtagttttgggatgtgattc

SEQ ID NO: 904867 - DNA, 22 bp, Artificial Sequence
  chemically synthesized
ttgatgtgtcctggaatcacat

SEQ ID NO: 904868 - DNA, 22 bp, Artificial Sequence
  chemically synthesized
accctgttgatgtgtcctggaa

SEQ ID NO: 904869 - DNA, 22 bp, Artificial Sequence
  chemically synthesized
tgggatgtgattccaggacaca

SEQ ID NO: 904870 - DNA, 22 bp, Artificial Sequence
  chemically synthesized
tcaccctgttgatgtgtcctgg

SEQ ID NO: 904871 - DNA, 22 bp, Artificial Sequence
  chemically synthesized
gggatgtgattccaggacacat

SEQ ID NO: 904872 - DNA, 22 bp, Artificial Sequence
  chemically synthesized
ctcaccctgttgatgtgtcctg

SEQ ID NO: 904873 - DNA, 22 bp, Artificial Sequence
  chemically synthesized
ggatgtgattccaggacacatc

SEQ ID NO: 904874 - DNA, 22 bp, Artificial Sequence
  chemically synthesized
ttctcaccctgttgatgtgtcc

SEQ ID NO: 904875 - DNA, 22 bp, Artificial Sequence
  chemically synthesized
cttctcaccctgttgatgtgtc

SEQ ID NO: 904876 - DNA, 22 bp, Artificial Sequence
  chemically synthesized
acttcttctcaccctgttgatg

SEQ ID NO: 904877 - DNA, 22 bp, Artificial Sequence
  chemically synthesized
cacttcttctcaccctgttgat

SEQ ID NO: 904878 - DNA, 22 bp, Artificial Sequence
  chemically synthesized
tttcacttcttctcaccctgtt

SEQ ID NO: 904879 - DNA, 22 bp, Artificial Sequence
  chemically synthesized
caggacacatcaacagggtgag

SEQ ID NO: 904880 - DNA, 22 bp, Artificial Sequence
  chemically synthesized
cctatttcacttcttctcaccc

SEQ ID NO: 904881 - DNA, 22 bp, Artificial Sequence
  chemically synthesized
ccctatttcacttcttctcacc

SEQ ID NO: 904882 - DNA, 22 bp, Artificial Sequence
  chemically synthesized
tcttccctatttcacttcttct

SEQ ID NO: 904883 - DNA, 22 bp, Artificial Sequence
  chemically synthesized
gctatcttccctatttcacttc

SEQ ID NO: 904884 - DNA, 22 bp, Artificial Sequence
  chemically synthesized
ttggctatcttccctatttcac

SEQ ID NO: 904885 - DNA, 22 bp, Artificial Sequence
  chemically synthesized
attggctatcttccctatttca

SEQ ID NO: 904886 - DNA, 22 bp, Artificial Sequence
  chemically synthesized
tattggctatcttccctatttc

SEQ ID NO: 904887 - DNA, 22 bp, Artificial Sequence
  chemically synthesized
catgataatataccctttattg

SEQ ID NO: 904888 - DNA, 22 bp, Artificial Sequence
  chemically synthesized
gcatgataatataccctttatt

SEQ ID NO: 904889 - DNA, 22 bp, Artificial Sequence
  chemically synthesized
atgacttgcatgataatatacc

SEQ ID NO: 904890 - DNA, 22 bp, Artificial Sequence
  chemically synthesized
acattgatgacttgcatgataa

SEQ ID NO: 904891 - DNA, 22 bp, Artificial Sequence
  chemically synthesized
ttcacattgatgacttgcatga

SEQ ID NO: 904892 - DNA, 22 bp, Artificial Sequence
  chemically synthesized
agttgttcacattgatgacttg

SEQ ID NO: 904893 - DNA, 22 bp, Artificial Sequence
  chemically synthesized
agattcagttgttcacattgat

SEQ ID NO: 904894 - DNA, 22 bp, Artificial Sequence
  chemically synthesized
tcatgcaagtcatcaatgtgaa

SEQ ID NO: 904895 - DNA, 22 bp, Artificial Sequence
  chemically synthesized
gggataacagggagtattaaga

SEQ ID NO: 904896 - DNA, 22 bp, Artificial Sequence
  chemically synthesized
agggataacagggagtattaag

SEQ ID NO: 904897 - DNA, 22 bp, Artificial Sequence
  chemically synthesized
tagggataacagggagtattaa

SEQ ID NO: 904898 - DNA, 22 bp, Artificial Sequence
  chemically synthesized
ttagggataacagggagtatta

SEQ ID NO: 904899 - DNA, 22 bp, Artificial Sequence
  chemically synthesized
ttttagggataacagggagtat

SEQ ID NO: 904900 - DNA, 22 bp, Artificial Sequence
  chemically synthesized
cttttagggataacagggagta

SEQ ID NO: 904901 - DNA, 22 bp, Artificial Sequence
  chemically synthesized
aatcttaatactccctgttatc

SEQ ID NO: 904902 - DNA, 22 bp, Artificial Sequence
  chemically synthesized
catcttcttttagggataacag

SEQ ID NO: 904903 - DNA, 22 bp, Artificial Sequence
  chemically synthesized
ctacatcttcttttagggataa

SEQ ID NO: 904904 - DNA, 22 bp, Artificial Sequence
  chemically synthesized
aatactccctgttatccctaaa

SEQ ID NO: 904905 - DNA, 22 bp, Artificial Sequence
  chemically synthesized
cctacatcttcttttagggata

SEQ ID NO: 904906 - DNA, 22 bp, Artificial Sequence
  chemically synthesized
atactccctgttatccctaaaa

SEQ ID NO: 904907 - DNA, 22 bp, Artificial Sequence
  chemically synthesized
gtttcctacatcttcttttagg

SEQ ID NO: 904908 - DNA, 22 bp, Artificial Sequence
  chemically synthesized
agtttcctacatcttcttttag

SEQ ID NO: 904909 - DNA, 22 bp, Artificial Sequence
  chemically synthesized
cctgttatccctaaaagaagat

SEQ ID NO: 904910 - DNA, 22 bp, Artificial Sequence
  chemically synthesized
ttatccctaaaagaagatgtag

SEQ ID NO: 904911 - DNA, 22 bp, Artificial Sequence
  chemically synthesized
tccctaaaagaagatgtaggaa

SEQ ID NO: 904912 - DNA, 22 bp, Artificial Sequence
  chemically synthesized
cagtagccttagtttcctacat

SEQ ID NO: 904913 - DNA, 22 bp, Artificial Sequence
  chemically synthesized
gttacagtagccttagtttcct

SEQ ID NO: 904914 - DNA, 22 bp, Artificial Sequence
  chemically synthesized
aaagaagatgtaggaaactaag

SEQ ID NO: 904915 - DNA, 22 bp, Artificial Sequence
  chemically synthesized
ggttacagtagccttagtttcc

SEQ ID NO: 904916 - DNA, 22 bp, Artificial Sequence
  chemically synthesized
tggttacagtagccttagtttc

SEQ ID NO: 904917 - DNA, 22 bp, Artificial Sequence
  chemically synthesized
ttttggttacagtagccttagt

SEQ ID NO: 904918 - DNA, 22 bp, Artificial Sequence
  chemically synthesized
aggctactgtaaccaaaacagc

SEQ ID NO: 904919 - DNA, 22 bp, Artificial Sequence
  chemically synthesized
gtaccagtaccatgctgttttg

SEQ ID NO: 904920 - DNA, 22 bp, Artificial Sequence
  chemically synthesized
ggtaccagtaccatgctgtttt

SEQ ID NO: 904921 - DNA, 22 bp, Artificial Sequence
  chemically synthesized
tggtaccagtaccatgctgttt

SEQ ID NO: 904922 - DNA, 22 bp, Artificial Sequence
  chemically synthesized
ctgtaaccaaaacagcatggta

SEQ ID NO: 904923 - DNA, 22 bp, Artificial Sequence
  chemically synthesized
ttttggtaccagtaccatgctg

SEQ ID NO: 904924 - DNA, 22 bp, Artificial Sequence
  chemically synthesized
tgttttggtaccagtaccatgc

SEQ ID NO: 904925 - DNA, 22 bp, Artificial Sequence
  chemically synthesized
taaccaaaacagcatggtactg

SEQ ID NO: 904926 - DNA, 22 bp, Artificial Sequence
  chemically synthesized
tatctctgttttggtaccagta

SEQ ID NO: 904927 - DNA, 22 bp, Artificial Sequence
  chemically synthesized
gtctatatctctgttttggtac

SEQ ID NO: 904928 - DNA, 22 bp, Artificial Sequence
  chemically synthesized
cattggtctatatctctgtttt

SEQ ID NO: 904929 - DNA, 22 bp, Artificial Sequence
  chemically synthesized
ttccattggtctatatctctgt

SEQ ID NO: 904930 - DNA, 22 bp, Artificial Sequence
  chemically synthesized
tgttccattggtctatatctct

SEQ ID NO: 904931 - DNA, 22 bp, Artificial Sequence
  chemically synthesized
gtaccaaaacagagatatagac

SEQ ID NO: 904932 - DNA, 22 bp, Artificial Sequence
  chemically synthesized
cgttctgttccattggtctata

SEQ ID NO: 904933 - DNA, 22 bp, Artificial Sequence
  chemically synthesized
ccgttctgttccattggtctat

SEQ ID NO: 904934 - DNA, 22 bp, Artificial Sequence
  chemically synthesized
aggcttccgttctgttccattg

SEQ ID NO: 904935 - DNA, 22 bp, Artificial Sequence
  chemically synthesized
tgaggcttccgttctgttccat

SEQ ID NO: 904936 - DNA, 22 bp, Artificial Sequence
  chemically synthesized
ctgaggcttccgttctgttcca

SEQ ID NO: 904937 - DNA, 22 bp, Artificial Sequence
  chemically synthesized
tttctgaggcttccgttctgtt

SEQ ID NO: 904938 - DNA, 22 bp, Artificial Sequence
  chemically synthesized
tagatgtgtggtattatttctg

SEQ ID NO: 904939 - DNA, 22 bp, Artificial Sequence
  chemically synthesized
agaaataataccacacatctac

SEQ ID NO: 904940 - DNA, 22 bp, Artificial Sequence
  chemically synthesized
tcaaagatcagatagttgtaga

SEQ ID NO: 904941 - DNA, 22 bp, Artificial Sequence
  chemically synthesized
gtcaaagatcagatagttgtag

SEQ ID NO: 904942 - DNA, 22 bp, Artificial Sequence
  chemically synthesized
tcaggtttgtcaaagatcagat

SEQ ID NO: 904943 - DNA, 22 bp, Artificial Sequence
  chemically synthesized
gtcaggtttgtcaaagatcaga

SEQ ID NO: 904944 - DNA, 22 bp, Artificial Sequence
  chemically synthesized
tgtcaggtttgtcaaagatcag

SEQ ID NO: 904945 - DNA, 22 bp, Artificial Sequence
  chemically synthesized
ttgtcaggtttgtcaaagatca

SEQ ID NO: 904946 - DNA, 22 bp, Artificial Sequence
  chemically synthesized
tttgtcaggtttgtcaaagatc

SEQ ID NO: 904947 - DNA, 22 bp, Artificial Sequence
  chemically synthesized
caactatctgatctttgacaaa

SEQ ID NO: 904948 - DNA, 22 bp, Artificial Sequence
  chemically synthesized
ttttttgtcaggtttgtcaaag

SEQ ID NO: 904949 - DNA, 22 bp, Artificial Sequence
  chemically synthesized
gttttttgtcaggtttgtcaaa

SEQ ID NO: 904950 - DNA, 22 bp, Artificial Sequence
  chemically synthesized
ttgttttttgtcaggtttgtca

SEQ ID NO: 904951 - DNA, 22 bp, Artificial Sequence
  chemically synthesized
cttgttttttgtcaggtttgtc

SEQ ID NO: 904952 - DNA, 22 bp, Artificial Sequence
  chemically synthesized
tctgatctttgacaaacctgac

SEQ ID NO: 904953 - DNA, 22 bp, Artificial Sequence
  chemically synthesized
atctttgacaaacctgacaaaa

SEQ ID NO: 904954 - DNA, 22 bp, Artificial Sequence
  chemically synthesized
cccatttcttgttttttgtcag

SEQ ID NO: 904955 - DNA, 22 bp, Artificial Sequence
  chemically synthesized
ccccatttcttgttttttgtca

SEQ ID NO: 904956 - DNA, 22 bp, Artificial Sequence
  chemically synthesized
tccccatttcttgttttttgtc

SEQ ID NO: 904957 - DNA, 22 bp, Artificial Sequence
  chemically synthesized
tgacaaacctgacaaaaaacaa

SEQ ID NO: 904958 - DNA, 22 bp, Artificial Sequence
  chemically synthesized
gacaaacctgacaaaaaacaag

SEQ ID NO: 904959 - DNA, 22 bp, Artificial Sequence
  chemically synthesized
acaaacctgacaaaaaacaaga

SEQ ID NO: 904960 - DNA, 22 bp, Artificial Sequence
  chemically synthesized
acaaaaaacaagaaatggggaa

SEQ ID NO: 904961 - DNA, 22 bp, Artificial Sequence
  chemically synthesized
aatagggaatcctttccccatt

SEQ ID NO: 904962 - DNA, 22 bp, Artificial Sequence
  chemically synthesized
ttaaatagggaatcctttcccc

SEQ ID NO: 904963 - DNA, 22 bp, Artificial Sequence
  chemically synthesized
attaaatagggaatcctttccc

SEQ ID NO: 904964 - DNA, 22 bp, Artificial Sequence
  chemically synthesized
ccagcaccatttattaaatagg

SEQ ID NO: 904965 - DNA, 22 bp, Artificial Sequence
  chemically synthesized
cccagcaccatttattaaatag

SEQ ID NO: 904966 - DNA, 22 bp, Artificial Sequence
  chemically synthesized
tcccagcaccatttattaaata

SEQ ID NO: 904967 - DNA, 22 bp, Artificial Sequence
  chemically synthesized
gccagttttcccagcaccattt

SEQ ID NO: 904968 - DNA, 22 bp, Artificial Sequence
  chemically synthesized
cctatttaataaatggtgctgg

SEQ ID NO: 904969 - DNA, 22 bp, Artificial Sequence
  chemically synthesized
tttaataaatggtgctgggaaa

SEQ ID NO: 904970 - DNA, 22 bp, Artificial Sequence
  chemically synthesized
aataaatggtgctgggaaaact

SEQ ID NO: 904971 - DNA, 22 bp, Artificial Sequence
  chemically synthesized
ataaatggtgctgggaaaactg

SEQ ID NO: 904972 - DNA, 22 bp, Artificial Sequence
  chemically synthesized
catatggctagccagttttccc

SEQ ID NO: 904973 - DNA, 22 bp, Artificial Sequence
  chemically synthesized
tacatatggctagccagttttc

SEQ ID NO: 904974 - DNA, 22 bp, Artificial Sequence
  chemically synthesized
ctacatatggctagccagtttt

SEQ ID NO: 904975 - DNA, 22 bp, Artificial Sequence
  chemically synthesized
tctacatatggctagccagttt

SEQ ID NO: 904976 - DNA, 22 bp, Artificial Sequence
  chemically synthesized
agctttctacatatggctagcc

SEQ ID NO: 904977 - DNA, 22 bp, Artificial Sequence
  chemically synthesized
cagctttctacatatggctagc

SEQ ID NO: 904978 - DNA, 22 bp, Artificial Sequence
  chemically synthesized
ggaaaactggctagccatatgt

SEQ ID NO: 904979 - DNA, 22 bp, Artificial Sequence
  chemically synthesized
gctagccatatgtagaaagctg

SEQ ID NO: 904980 - DNA, 22 bp, Artificial Sequence
  chemically synthesized
gccatatgtagaaagctgaaac

SEQ ID NO: 904981 - DNA, 22 bp, Artificial Sequence
  chemically synthesized
tataaggtgtaaggaagggatc

SEQ ID NO: 904982 - DNA, 22 bp, Artificial Sequence
  chemically synthesized
gtataaggtgtaaggaagggat

SEQ ID NO: 904983 - DNA, 22 bp, Artificial Sequence
  chemically synthesized
tgtataaggtgtaaggaaggga

SEQ ID NO: 904984 - DNA, 22 bp, Artificial Sequence
  chemically synthesized
ttgtataaggtgtaaggaaggg

SEQ ID NO: 904985 - DNA, 22 bp, Artificial Sequence
  chemically synthesized
aaactggatcccttccttacac

SEQ ID NO: 904986 - DNA, 22 bp, Artificial Sequence
  chemically synthesized
atttttgtataaggtgtaagga

SEQ ID NO: 904987 - DNA, 22 bp, Artificial Sequence
  chemically synthesized
attaatttttgtataaggtgta

SEQ ID NO: 904988 - DNA, 22 bp, Artificial Sequence
  chemically synthesized
gatcccttccttacaccttata

SEQ ID NO: 904989 - DNA, 22 bp, Artificial Sequence
  chemically synthesized
aattaattaatttttgtataag

SEQ ID NO: 904990 - DNA, 22 bp, Artificial Sequence
  chemically synthesized
gaattaattaatttttgtataa

SEQ ID NO: 904991 - DNA, 22 bp, Artificial Sequence
  chemically synthesized
ccttacaccttatacaaaaatt

SEQ ID NO: 904992 - DNA, 22 bp, Artificial Sequence
  chemically synthesized
cttacaccttatacaaaaatta

SEQ ID NO: 904993 - DNA, 22 bp, Artificial Sequence
  chemically synthesized
acaccttatacaaaaattaatt

SEQ ID NO: 904994 - DNA, 22 bp, Artificial Sequence
  chemically synthesized
caccttatacaaaaattaatta

SEQ ID NO: 904995 - DNA, 22 bp, Artificial Sequence
  chemically synthesized
atccatcttgaattaattaatt

SEQ ID NO: 904996 - DNA, 22 bp, Artificial Sequence
  chemically synthesized
aatccatcttgaattaattaat

SEQ ID NO: 904997 - DNA, 22 bp, Artificial Sequence
  chemically synthesized
taatccatcttgaattaattaa

SEQ ID NO: 904998 - DNA, 22 bp, Artificial Sequence
  chemically synthesized
atacaaaaattaattaattcaa

SEQ ID NO: 904999 - DNA, 22 bp, Artificial Sequence
  chemically synthesized
tacaaaaattaattaattcaag

SEQ ID NO: 905000 - DNA, 22 bp, Artificial Sequence
  chemically synthesized
acatgtaagtctttaatccatc

SEQ ID NO: 905001 - DNA, 22 bp, Artificial Sequence
  chemically synthesized
attaattcaagatggattaaag

SEQ ID NO: 905002 - DNA, 22 bp, Artificial Sequence
  chemically synthesized
attcaagatggattaaagactt

SEQ ID NO: 905003 - DNA, 22 bp, Artificial Sequence
  chemically synthesized
ggtctaacatgtaagtctttaa

SEQ ID NO: 905004 - DNA, 22 bp, Artificial Sequence
  chemically synthesized
aggtctaacatgtaagtcttta

SEQ ID NO: 905005 - DNA, 22 bp, Artificial Sequence
  chemically synthesized
taggtctaacatgtaagtcttt

SEQ ID NO: 905006 - DNA, 22 bp, Artificial Sequence
  chemically synthesized
aagatggattaaagacttacat

SEQ ID NO: 905007 - DNA, 22 bp, Artificial Sequence
  chemically synthesized
tggttttaggtctaacatgtaa

SEQ ID NO: 905008 - DNA, 22 bp, Artificial Sequence
  chemically synthesized
atggttttaggtctaacatgta

SEQ ID NO: 905009 - DNA, 22 bp, Artificial Sequence
  chemically synthesized
tatggttttaggtctaacatgt

SEQ ID NO: 905010 - DNA, 22 bp, Artificial Sequence
  chemically synthesized
aagacttacatgttagacctaa

SEQ ID NO: 905011 - DNA, 22 bp, Artificial Sequence
  chemically synthesized
gggttttatggttttaggtcta

SEQ ID NO: 905012 - DNA, 22 bp, Artificial Sequence
  chemically synthesized
tagggttttatggttttaggtc

SEQ ID NO: 905013 - DNA, 22 bp, Artificial Sequence
  chemically synthesized
ctagggttttatggttttaggt

SEQ ID NO: 905014 - DNA, 22 bp, Artificial Sequence
  chemically synthesized
ttctagggttttatggttttag

SEQ ID NO: 905015 - DNA, 22 bp, Artificial Sequence
  chemically synthesized
acatgttagacctaaaaccata

SEQ ID NO: 905016 - DNA, 22 bp, Artificial Sequence
  chemically synthesized
cttctagggttttatggtttta

SEQ ID NO: 905017 - DNA, 22 bp, Artificial Sequence
  chemically synthesized
catgttagacctaaaaccataa

SEQ ID NO: 905018 - DNA, 22 bp, Artificial Sequence
  chemically synthesized
tcttctagggttttatggtttt

SEQ ID NO: 905019 - DNA, 22 bp, Artificial Sequence
  chemically synthesized
ggttttcttctagggttttatg

SEQ ID NO: 905020 - DNA, 22 bp, Artificial Sequence
  chemically synthesized
gacctaaaaccataaaacccta

SEQ ID NO: 905021 - DNA, 22 bp, Artificial Sequence
  chemically synthesized
cctaggttttcttctagggttt

SEQ ID NO: 905022 - DNA, 22 bp, Artificial Sequence
  chemically synthesized
aaaccataaaaccctagaagaa

SEQ ID NO: 905023 - DNA, 22 bp, Artificial Sequence
  chemically synthesized
aatggtattgcctaggttttct

SEQ ID NO: 905024 - DNA, 22 bp, Artificial Sequence
  chemically synthesized
tcctgaatggtattgcctaggt

SEQ ID NO: 905025 - DNA, 22 bp, Artificial Sequence
  chemically synthesized
gtcctgaatggtattgcctagg

SEQ ID NO: 905026 - DNA, 22 bp, Artificial Sequence
  chemically synthesized
tgtcctgaatggtattgcctag

SEQ ID NO: 905027 - DNA, 22 bp, Artificial Sequence
  chemically synthesized
gaagaaaacctaggcaatacca

SEQ ID NO: 905028 - DNA, 22 bp, Artificial Sequence
  chemically synthesized
cccatgcctttgtcctgaatgg

SEQ ID NO: 905029 - DNA, 22 bp, Artificial Sequence
  chemically synthesized
gcccatgcctttgtcctgaatg

SEQ ID NO: 905030 - DNA, 22 bp, Artificial Sequence
  chemically synthesized
ggcaataccattcaggacaaag

SEQ ID NO: 905031 - DNA, 22 bp, Artificial Sequence
  chemically synthesized
atcatgaagtccttgcccatgc

SEQ ID NO: 905032 - DNA, 22 bp, Artificial Sequence
  chemically synthesized
catcatgaagtccttgcccatg

SEQ ID NO: 905033 - DNA, 22 bp, Artificial Sequence
  chemically synthesized
tcatcatgaagtccttgcccat

SEQ ID NO: 905034 - DNA, 22 bp, Artificial Sequence
  chemically synthesized
aggacaaaggcatgggcaagga

SEQ ID NO: 905035 - DNA, 22 bp, Artificial Sequence
  chemically synthesized
gtgttttcatcatgaagtcctt

SEQ ID NO: 905036 - DNA, 22 bp, Artificial Sequence
  chemically synthesized
ggtgttttcatcatgaagtcct

SEQ ID NO: 905037 - DNA, 22 bp, Artificial Sequence
  chemically synthesized
tggtgttttcatcatgaagtcc

SEQ ID NO: 905038 - DNA, 22 bp, Artificial Sequence
  chemically synthesized
ttggtgttttcatcatgaagtc

SEQ ID NO: 905039 - DNA, 22 bp, Artificial Sequence
  chemically synthesized
cttttggtgttttcatcatgaa

SEQ ID NO: 905040 - DNA, 22 bp, Artificial Sequence
  chemically synthesized
ccattgcttttggtgttttcat

SEQ ID NO: 905041 - DNA, 22 bp, Artificial Sequence
  chemically synthesized
ttgccattgcttttggtgtttt

SEQ ID NO: 905042 - DNA, 22 bp, Artificial Sequence
  chemically synthesized
tgttgccattgcttttggtgtt

SEQ ID NO: 905043 - DNA, 22 bp, Artificial Sequence
  chemically synthesized
ctgttgccattgcttttggtgt

SEQ ID NO: 905044 - DNA, 22 bp, Artificial Sequence
  chemically synthesized
catgatgaaaacaccaaaagca

SEQ ID NO: 905045 - DNA, 22 bp, Artificial Sequence
  chemically synthesized
atgatgaaaacaccaaaagcaa

SEQ ID NO: 905046 - DNA, 22 bp, Artificial Sequence
  chemically synthesized
gcttctgttgccattgcttttg

SEQ ID NO: 905047 - DNA, 22 bp, Artificial Sequence
  chemically synthesized
ggcttctgttgccattgctttt

SEQ ID NO: 905048 - DNA, 22 bp, Artificial Sequence
  chemically synthesized
tggcttctgttgccattgcttt

SEQ ID NO: 905049 - DNA, 22 bp, Artificial Sequence
  chemically synthesized
tcaattttggcttctgttgcca

SEQ ID NO: 905050 - DNA, 22 bp, Artificial Sequence
  chemically synthesized
gtcaattttggcttctgttgcc

SEQ ID NO: 905051 - DNA, 22 bp, Artificial Sequence
  chemically synthesized
gatcccatttgtcaattttggc

SEQ ID NO: 905052 - DNA, 22 bp, Artificial Sequence
  chemically synthesized
attagatcccatttgtcaattt

SEQ ID NO: 905053 - DNA, 22 bp, Artificial Sequence
  chemically synthesized
aattagatcccatttgtcaatt

SEQ ID NO: 905054 - DNA, 22 bp, Artificial Sequence
  chemically synthesized
gtttaattagatcccatttgtc

SEQ ID NO: 905055 - DNA, 22 bp, Artificial Sequence
  chemically synthesized
cgtttaattagatcccatttgt

SEQ ID NO: 905056 - DNA, 22 bp, Artificial Sequence
  chemically synthesized
tcgtttaattagatcccatttg

SEQ ID NO: 905057 - DNA, 22 bp, Artificial Sequence
  chemically synthesized
tttcgtttaattagatcccatt

SEQ ID NO: 905058 - DNA, 22 bp, Artificial Sequence
  chemically synthesized
acaaatgggatctaattaaacg

SEQ ID NO: 905059 - DNA, 22 bp, Artificial Sequence
  chemically synthesized
tgcagaagctctttcgtttaat

SEQ ID NO: 905060 - DNA, 22 bp, Artificial Sequence
  chemically synthesized
ctgtgcagaagctctttcgttt

SEQ ID NO: 905061 - DNA, 22 bp, Artificial Sequence
  chemically synthesized
gctgtgcagaagctctttcgtt

SEQ ID NO: 905062 - DNA, 22 bp, Artificial Sequence
  chemically synthesized
tgctgtgcagaagctctttcgt

SEQ ID NO: 905063 - DNA, 22 bp, Artificial Sequence
  chemically synthesized
ttgctgtgcagaagctctttcg

SEQ ID NO: 905064 - DNA, 22 bp, Artificial Sequence
  chemically synthesized
ttttgctgtgcagaagctcttt

SEQ ID NO: 905065 - DNA, 22 bp, Artificial Sequence
  chemically synthesized
cttttgctgtgcagaagctctt

SEQ ID NO: 905066 - DNA, 22 bp, Artificial Sequence
  chemically synthesized
tcttttgctgtgcagaagctct

SEQ ID NO: 905067 - DNA, 22 bp, Artificial Sequence
  chemically synthesized
attaaacgaaagagcttctgca

SEQ ID NO: 905068 - DNA, 22 bp, Artificial Sequence
  chemically synthesized
aacgaaagagcttctgcacagc

SEQ ID NO: 905069 - DNA, 22 bp, Artificial Sequence
  chemically synthesized
atggtactttcttttgctgtgc

SEQ ID NO: 905070 - DNA, 22 bp, Artificial Sequence
  chemically synthesized
tgatggtactttcttttgctgt

SEQ ID NO: 905071 - DNA, 22 bp, Artificial Sequence
  chemically synthesized
actctgatggtactttcttttg

SEQ ID NO: 905072 - DNA, 22 bp, Artificial Sequence
  chemically synthesized
ttcactctgatggtactttctt

SEQ ID NO: 905073 - DNA, 22 bp, Artificial Sequence
  chemically synthesized
ctgcacagcaaaagaaagtacc

SEQ ID NO: 905074 - DNA, 22 bp, Artificial Sequence
  chemically synthesized
gttcactctgatggtactttct

SEQ ID NO: 905075 - DNA, 22 bp, Artificial Sequence
  chemically synthesized
tgcacagcaaaagaaagtacca

SEQ ID NO: 905076 - DNA, 22 bp, Artificial Sequence
  chemically synthesized
cacagcaaaagaaagtaccatc

SEQ ID NO: 905077 - DNA, 22 bp, Artificial Sequence
  chemically synthesized
cttgttcactctgatggtactt

SEQ ID NO: 905078 - DNA, 22 bp, Artificial Sequence
  chemically synthesized
tgtaggttgcttgttcactctg

SEQ ID NO: 905079 - DNA, 22 bp, Artificial Sequence
  chemically synthesized
ccattatgtaggttgcttgttc

SEQ ID NO: 905080 - DNA, 22 bp, Artificial Sequence
  chemically synthesized
tcccattatgtaggttgcttgt

SEQ ID NO: 905081 - DNA, 22 bp, Artificial Sequence
  chemically synthesized
ctcccattatgtaggttgcttg

SEQ ID NO: 905082 - DNA, 22 bp, Artificial Sequence
  chemically synthesized
tctcccattatgtaggttgctt

SEQ ID NO: 905083 - DNA, 22 bp, Artificial Sequence
  chemically synthesized
caaaaattttctcccattatgt

SEQ ID NO: 905084 - DNA, 22 bp, Artificial Sequence
  chemically synthesized
cataatgggagaaaatttttgc

SEQ ID NO: 905085 - DNA, 22 bp, Artificial Sequence
  chemically synthesized
tcagatgggtagattgcaaaaa

SEQ ID NO: 905086 - DNA, 22 bp, Artificial Sequence
  chemically synthesized
gtcagatgggtagattgcaaaa

SEQ ID NO: 905087 - DNA, 22 bp, Artificial Sequence
  chemically synthesized
tgtcagatgggtagattgcaaa

SEQ ID NO: 905088 - DNA, 22 bp, Artificial Sequence
  chemically synthesized
gccctttgtcagatgggtagat

SEQ ID NO: 905089 - DNA, 22 bp, Artificial Sequence
  chemically synthesized
ttgcaatctacccatctgacaa

SEQ ID NO: 905090 - DNA, 22 bp, Artificial Sequence
  chemically synthesized
gatattagccctttgtcagatg

SEQ ID NO: 905091 - DNA, 22 bp, Artificial Sequence
  chemically synthesized
tgcaatctacccatctgacaaa

SEQ ID NO: 905092 - DNA, 22 bp, Artificial Sequence
  chemically synthesized
gcaatctacccatctgacaaag

SEQ ID NO: 905093 - DNA, 22 bp, Artificial Sequence
  chemically synthesized
tcgatattagccctttgtcaga

SEQ ID NO: 905094 - DNA, 22 bp, Artificial Sequence
  chemically synthesized
caatctacccatctgacaaagg

SEQ ID NO: 905095 - DNA, 22 bp, Artificial Sequence
  chemically synthesized
tagattctcgatattagccctt

SEQ ID NO: 905096 - DNA, 22 bp, Artificial Sequence
  chemically synthesized
cccatctgacaaagggctaata

SEQ ID NO: 905097 - DNA, 22 bp, Artificial Sequence
  chemically synthesized
gtagattctcgatattagccct

SEQ ID NO: 905098 - DNA, 22 bp, Artificial Sequence
  chemically synthesized
tgtagattctcgatattagccc

SEQ ID NO: 905099 - DNA, 22 bp, Artificial Sequence
  chemically synthesized
tttgtagattctcgatattagc

SEQ ID NO: 905100 - DNA, 22 bp, Artificial Sequence
  chemically synthesized
acaaagggctaatatcgagaat

SEQ ID NO: 905101 - DNA, 22 bp, Artificial Sequence
  chemically synthesized
agttctttgtagattctcgata

SEQ ID NO: 905102 - DNA, 22 bp, Artificial Sequence
  chemically synthesized
aagttctttgtagattctcgat

SEQ ID NO: 905103 - DNA, 22 bp, Artificial Sequence
  chemically synthesized
tttaagttctttgtagattctc

SEQ ID NO: 905104 - DNA, 22 bp, Artificial Sequence
  chemically synthesized
gtttaagttctttgtagattct

SEQ ID NO: 905105 - DNA, 22 bp, Artificial Sequence
  chemically synthesized
atatcgagaatctacaaagaac

SEQ ID NO: 905106 - DNA, 22 bp, Artificial Sequence
  chemically synthesized
taaatttgtttaagttctttgt

SEQ ID NO: 905107 - DNA, 22 bp, Artificial Sequence
  chemically synthesized
gtaaatttgtttaagttctttg

SEQ ID NO: 905108 - DNA, 22 bp, Artificial Sequence
  chemically synthesized
ttgtaaatttgtttaagttctt

SEQ ID NO: 905109 - DNA, 22 bp, Artificial Sequence
  chemically synthesized
cttgtaaatttgtttaagttct

SEQ ID NO: 905110 - DNA, 22 bp, Artificial Sequence
  chemically synthesized
tcttgtaaatttgtttaagttc

SEQ ID NO: 905111 - DNA, 22 bp, Artificial Sequence
  chemically synthesized
ttcttgtaaatttgtttaagtt

SEQ ID NO: 905112 - DNA, 22 bp, Artificial Sequence
  chemically synthesized
tttcttgtaaatttgtttaagt

SEQ ID NO: 905113 - DNA, 22 bp, Artificial Sequence
  chemically synthesized
ttttcttgtaaatttgtttaag

SEQ ID NO: 905114 - DNA, 22 bp, Artificial Sequence
  chemically synthesized
gtttttttcttgtaaatttgtt

SEQ ID NO: 905115 - DNA, 22 bp, Artificial Sequence
  chemically synthesized
caaagaacttaaacaaatttac

SEQ ID NO: 905116 - DNA, 22 bp, Artificial Sequence
  chemically synthesized
gatgaggttggtttttttcttg

SEQ ID NO: 905117 - DNA, 22 bp, Artificial Sequence
  chemically synthesized
aaacaaatttacaagaaaaaaa

SEQ ID NO: 905118 - DNA, 22 bp, Artificial Sequence
  chemically synthesized
cgatgaggttggtttttttctt

SEQ ID NO: 905119 - DNA, 22 bp, Artificial Sequence
  chemically synthesized
aacaaatttacaagaaaaaaac

SEQ ID NO: 905120 - DNA, 22 bp, Artificial Sequence
  chemically synthesized
tcgatgaggttggtttttttct

SEQ ID NO: 905121 - DNA, 22 bp, Artificial Sequence
  chemically synthesized
ttcgatgaggttggtttttttc

SEQ ID NO: 905122 - DNA, 22 bp, Artificial Sequence
  chemically synthesized
acaagaaaaaaaccaacctcat

SEQ ID NO: 905123 - DNA, 22 bp, Artificial Sequence
  chemically synthesized
gccgacttttcgatgaggttgg

SEQ ID NO: 905124 - DNA, 22 bp, Artificial Sequence
  chemically synthesized
caagaaaaaaaccaacctcatc

SEQ ID NO: 905125 - DNA, 22 bp, Artificial Sequence
  chemically synthesized
ggccgacttttcgatgaggttg

SEQ ID NO: 905126 - DNA, 22 bp, Artificial Sequence
  chemically synthesized
tccttggccgacttttcgatga

SEQ ID NO: 905127 - DNA, 22 bp, Artificial Sequence
  chemically synthesized
ctatccttggccgacttttcga

SEQ ID NO: 905128 - DNA, 22 bp, Artificial Sequence
  chemically synthesized
ttcctatccttggccgactttt

SEQ ID NO: 905129 - DNA, 22 bp, Artificial Sequence
  chemically synthesized
atcgaaaagtcggccaaggata

SEQ ID NO: 905130 - DNA, 22 bp, Artificial Sequence
  chemically synthesized
agaagtgtctgttcctatcctt

SEQ ID NO: 905131 - DNA, 22 bp, Artificial Sequence
  chemically synthesized
gagaagtgtctgttcctatcct

SEQ ID NO: 905132 - DNA, 22 bp, Artificial Sequence
  chemically synthesized
tgagaagtgtctgttcctatcc

SEQ ID NO: 905133 - DNA, 22 bp, Artificial Sequence
  chemically synthesized
ttgagaagtgtctgttcctatc

SEQ ID NO: 905134 - DNA, 22 bp, Artificial Sequence
  chemically synthesized
ttttgagaagtgtctgttccta

SEQ ID NO: 905135 - DNA, 22 bp, Artificial Sequence
  chemically synthesized
cttttgagaagtgtctgttcct

SEQ ID NO: 905136 - DNA, 22 bp, Artificial Sequence
  chemically synthesized
cataaatgtcttcttttgagaa

SEQ ID NO: 905137 - DNA, 22 bp, Artificial Sequence
  chemically synthesized
gctgcataaatgtcttcttttg

SEQ ID NO: 905138 - DNA, 22 bp, Artificial Sequence
  chemically synthesized
ttagctgcataaatgtcttctt

SEQ ID NO: 905139 - DNA, 22 bp, Artificial Sequence
  chemically synthesized
ctcaaaagaagacatttatgca

SEQ ID NO: 905140 - DNA, 22 bp, Artificial Sequence
  chemically synthesized
tcaaaagaagacatttatgcag

SEQ ID NO: 905141 - DNA, 22 bp, Artificial Sequence
  chemically synthesized
atgtgtctgttagctgcataaa

SEQ ID NO: 905142 - DNA, 22 bp, Artificial Sequence
  chemically synthesized
aaaagaagacatttatgcagct

SEQ ID NO: 905143 - DNA, 22 bp, Artificial Sequence
  chemically synthesized
catgtgtctgttagctgcataa

SEQ ID NO: 905144 - DNA, 22 bp, Artificial Sequence
  chemically synthesized
tcatgtgtctgttagctgcata

SEQ ID NO: 905145 - DNA, 22 bp, Artificial Sequence
  chemically synthesized
ttcatgtgtctgttagctgcat

SEQ ID NO: 905146 - DNA, 22 bp, Artificial Sequence
  chemically synthesized
tttcatgtgtctgttagctgca

SEQ ID NO: 905147 - DNA, 22 bp, Artificial Sequence
  chemically synthesized
atgcagctaacagacacatgaa

SEQ ID NO: 905148 - DNA, 22 bp, Artificial Sequence
  chemically synthesized
tgcagctaacagacacatgaaa

SEQ ID NO: 905149 - DNA, 22 bp, Artificial Sequence
  chemically synthesized
acagacacatgaaaaaatgctc

SEQ ID NO: 905150 - DNA, 22 bp, Artificial Sequence
  chemically synthesized
atgaccagtgatgatgagcatt

SEQ ID NO: 905151 - DNA, 22 bp, Artificial Sequence
  chemically synthesized
tgatgaccagtgatgatgagca

SEQ ID NO: 905152 - DNA, 22 bp, Artificial Sequence
  chemically synthesized
tctgatgaccagtgatgatgag

SEQ ID NO: 905153 - DNA, 22 bp, Artificial Sequence
  chemically synthesized
ctctgatgaccagtgatgatga

SEQ ID NO: 905154 - DNA, 22 bp, Artificial Sequence
  chemically synthesized
catttctctgatgaccagtgat

SEQ ID NO: 905155 - DNA, 22 bp, Artificial Sequence
  chemically synthesized
gcatttctctgatgaccagtga

SEQ ID NO: 905156 - DNA, 22 bp, Artificial Sequence
  chemically synthesized
atttgcatttctctgatgacca

SEQ ID NO: 905157 - DNA, 22 bp, Artificial Sequence
  chemically synthesized
gatttgcatttctctgatgacc

SEQ ID NO: 905158 - DNA, 22 bp, Artificial Sequence
  chemically synthesized
tgatttgcatttctctgatgac

SEQ ID NO: 905159 - DNA, 22 bp, Artificial Sequence
  chemically synthesized
atcatcactggtcatcagagaa

SEQ ID NO: 905160 - DNA, 22 bp, Artificial Sequence
  chemically synthesized
tggttttgatttgcatttctct

SEQ ID NO: 905161 - DNA, 22 bp, Artificial Sequence
  chemically synthesized
attgtggttttgatttgcattt

SEQ ID NO: 905162 - DNA, 22 bp, Artificial Sequence
  chemically synthesized
gtcatcagagaaatgcaaatca

SEQ ID NO: 905163 - DNA, 22 bp, Artificial Sequence
  chemically synthesized
gagtgagatggtatctcattgt

SEQ ID NO: 905164 - DNA, 22 bp, Artificial Sequence
  chemically synthesized
actggagtgagatggtatctca

SEQ ID NO: 905165 - DNA, 22 bp, Artificial Sequence
  chemically synthesized
taactggagtgagatggtatct

SEQ ID NO: 905166 - DNA, 22 bp, Artificial Sequence
  chemically synthesized
atgatcaccattctaactggag

SEQ ID NO: 905167 - DNA, 22 bp, Artificial Sequence
  chemically synthesized
aatgatcaccattctaactgga

SEQ ID NO: 905168 - DNA, 22 bp, Artificial Sequence
  chemically synthesized
taatgatcaccattctaactgg

SEQ ID NO: 905169 - DNA, 22 bp, Artificial Sequence
  chemically synthesized
ttaatgatcaccattctaactg

SEQ ID NO: 905170 - DNA, 22 bp, Artificial Sequence
  chemically synthesized
tttaatgatcaccattctaact

SEQ ID NO: 905171 - DNA, 22 bp, Artificial Sequence
  chemically synthesized
actttttaatgatcaccattct

SEQ ID NO: 905172 - DNA, 22 bp, Artificial Sequence
  chemically synthesized
actccagttagaatggtgatca

SEQ ID NO: 905173 - DNA, 22 bp, Artificial Sequence
  chemically synthesized
ctgactttttaatgatcaccat

SEQ ID NO: 905174 - DNA, 22 bp, Artificial Sequence
  chemically synthesized
cctgactttttaatgatcacca

SEQ ID NO: 905175 - DNA, 22 bp, Artificial Sequence
  chemically synthesized
cagttagaatggtgatcattaa

SEQ ID NO: 905176 - DNA, 22 bp, Artificial Sequence
  chemically synthesized
tttcctgactttttaatgatca

SEQ ID NO: 905177 - DNA, 22 bp, Artificial Sequence
  chemically synthesized
ttgtttcctgactttttaatga

SEQ ID NO: 905178 - DNA, 22 bp, Artificial Sequence
  chemically synthesized
gaatggtgatcattaaaaagtc

SEQ ID NO: 905179 - DNA, 22 bp, Artificial Sequence
  chemically synthesized
cagcatctgttgtttcctgact

SEQ ID NO: 905180 - DNA, 22 bp, Artificial Sequence
  chemically synthesized
tccagcatctgttgtttcctga

SEQ ID NO: 905181 - DNA, 22 bp, Artificial Sequence
  chemically synthesized
aaaagtcaggaaacaacagatg

SEQ ID NO: 905182 - DNA, 22 bp, Artificial Sequence
  chemically synthesized
cacatcctctccagcatctgtt

SEQ ID NO: 905183 - DNA, 22 bp, Artificial Sequence
  chemically synthesized
tccacatcctctccagcatctg

SEQ ID NO: 905184 - DNA, 22 bp, Artificial Sequence
  chemically synthesized
ctccacatcctctccagcatct

SEQ ID NO: 905185 - DNA, 22 bp, Artificial Sequence
  chemically synthesized
tttctccacatcctctccagca

SEQ ID NO: 905186 - DNA, 22 bp, Artificial Sequence
  chemically synthesized
ctgtttctccacatcctctcca

SEQ ID NO: 905187 - DNA, 22 bp, Artificial Sequence
  chemically synthesized
gagaggatgtggagaaacagga

SEQ ID NO: 905188 - DNA, 22 bp, Artificial Sequence
  chemically synthesized
cagtcccaccaacggtgtgaaa

SEQ ID NO: 905189 - DNA, 22 bp, Artificial Sequence
  chemically synthesized
acagtcccaccaacggtgtgaa

SEQ ID NO: 905190 - DNA, 22 bp, Artificial Sequence
  chemically synthesized
gtttacagtcccaccaacggtg

SEQ ID NO: 905191 - DNA, 22 bp, Artificial Sequence
  chemically synthesized
aactagtttacagtcccaccaa

SEQ ID NO: 905192 - DNA, 22 bp, Artificial Sequence
  chemically synthesized
tcacaccgttggtgggactgta

SEQ ID NO: 905193 - DNA, 22 bp, Artificial Sequence
  chemically synthesized
cacaccgttggtgggactgtaa

SEQ ID NO: 905194 - DNA, 22 bp, Artificial Sequence
  chemically synthesized
acaccgttggtgggactgtaaa

SEQ ID NO: 905195 - DNA, 22 bp, Artificial Sequence
  chemically synthesized
cacaatggttgaactagtttac

SEQ ID NO: 905196 - DNA, 22 bp, Artificial Sequence
  chemically synthesized
ccacaatggttgaactagttta

SEQ ID NO: 905197 - DNA, 22 bp, Artificial Sequence
  chemically synthesized
gtgggactgtaaactagttcaa

SEQ ID NO: 905198 - DNA, 22 bp, Artificial Sequence
  chemically synthesized
tcttccacaatggttgaactag

SEQ ID NO: 905199 - DNA, 22 bp, Artificial Sequence
  chemically synthesized
taaactagttcaaccattgtgg

SEQ ID NO: 905200 - DNA, 22 bp, Artificial Sequence
  chemically synthesized
gttcaaccattgtggaagacag

SEQ ID NO: 905201 - DNA, 22 bp, Artificial Sequence
  chemically synthesized
aggaatcgccacactgtcttcc

SEQ ID NO: 905202 - DNA, 22 bp, Artificial Sequence
  chemically synthesized
gaggaatcgccacactgtcttc

SEQ ID NO: 905203 - DNA, 22 bp, Artificial Sequence
  chemically synthesized
aaccattgtggaagacagtgtg

SEQ ID NO: 905204 - DNA, 22 bp, Artificial Sequence
  chemically synthesized
gatccttgaggaatcgccacac

SEQ ID NO: 905205 - DNA, 22 bp, Artificial Sequence
  chemically synthesized
tagatccttgaggaatcgccac

SEQ ID NO: 905206 - DNA, 22 bp, Artificial Sequence
  chemically synthesized
tggaagacagtgtggcgattcc

SEQ ID NO: 905207 - DNA, 22 bp, Artificial Sequence
  chemically synthesized
gttctagatccttgaggaatcg

SEQ ID NO: 905208 - DNA, 22 bp, Artificial Sequence
  chemically synthesized
tagttctagatccttgaggaat

SEQ ID NO: 905209 - DNA, 22 bp, Artificial Sequence
  chemically synthesized
ctagttctagatccttgaggaa

SEQ ID NO: 905210 - DNA, 22 bp, Artificial Sequence
  chemically synthesized
ctcaaggatctagaactagaaa

SEQ ID NO: 905211 - DNA, 22 bp, Artificial Sequence
  chemically synthesized
aaggatctagaactagaaatac

SEQ ID NO: 905212 - DNA, 22 bp, Artificial Sequence
  chemically synthesized
gaactagaaataccatttgacc

SEQ ID NO: 905213 - DNA, 22 bp, Artificial Sequence
  chemically synthesized
gaaataccatttgacccggcca

SEQ ID NO: 905214 - DNA, 22 bp, Artificial Sequence
  chemically synthesized
ggtatatacccagtaatgggat

SEQ ID NO: 905215 - DNA, 22 bp, Artificial Sequence
  chemically synthesized
gggtatatacccagtaatggga

SEQ ID NO: 905216 - DNA, 22 bp, Artificial Sequence
  chemically synthesized
tgggtatatacccagtaatggg

SEQ ID NO: 905217 - DNA, 22 bp, Artificial Sequence
  chemically synthesized
gacccggccatcccattactgg

SEQ ID NO: 905218 - DNA, 22 bp, Artificial Sequence
  chemically synthesized
acccggccatcccattactggg

SEQ ID NO: 905219 - DNA, 22 bp, Artificial Sequence
  chemically synthesized
taatcctttgggtatataccca

SEQ ID NO: 905220 - DNA, 22 bp, Artificial Sequence
  chemically synthesized
ataatcctttgggtatataccc

SEQ ID NO: 905221 - DNA, 22 bp, Artificial Sequence
  chemically synthesized
ctgggtatatacccaaaggatt

SEQ ID NO: 905222 - DNA, 22 bp, Artificial Sequence
  chemically synthesized
ggtatatacccaaaggattata

SEQ ID NO: 905223 - DNA, 22 bp, Artificial Sequence
  chemically synthesized
tagcagcatgatttataatcct

SEQ ID NO: 905224 - DNA, 22 bp, Artificial Sequence
  chemically synthesized
atagcagcatgatttataatcc

SEQ ID NO: 905225 - DNA, 22 bp, Artificial Sequence
  chemically synthesized
tatagcagcatgatttataatc

SEQ ID NO: 905226 - DNA, 22 bp, Artificial Sequence
  chemically synthesized
taaatcatgctgctataaagac

SEQ ID NO: 905227 - DNA, 22 bp, Artificial Sequence
  chemically synthesized
ctataaagacacatgcacacgt

SEQ ID NO: 905228 - DNA, 22 bp, Artificial Sequence
  chemically synthesized
taaagacacatgcacacgtatg

SEQ ID NO: 905229 - DNA, 22 bp, Artificial Sequence
  chemically synthesized
tgaatagtgccgcaataaacat

SEQ ID NO: 905230 - DNA, 22 bp, Artificial Sequence
  chemically synthesized
ttgtgaatagtgccgcaataaa

SEQ ID NO: 905231 - DNA, 22 bp, Artificial Sequence
  chemically synthesized
ctattgtgaatagtgccgcaat

SEQ ID NO: 905232 - DNA, 22 bp, Artificial Sequence
  chemically synthesized
gctattgtgaatagtgccgcaa

SEQ ID NO: 905233 - DNA, 22 bp, Artificial Sequence
  chemically synthesized
tgctattgtgaatagtgccgca

SEQ ID NO: 905234 - DNA, 22 bp, Artificial Sequence
  chemically synthesized
caagtctttgctattgtgaata

SEQ ID NO: 905235 - DNA, 22 bp, Artificial Sequence
  chemically synthesized
attgcggcactattcacaatag

SEQ ID NO: 905236 - DNA, 22 bp, Artificial Sequence
  chemically synthesized
ttgcggcactattcacaatagc

SEQ ID NO: 905237 - DNA, 22 bp, Artificial Sequence
  chemically synthesized
gttccaagtctttgctattgtg

SEQ ID NO: 905238 - DNA, 22 bp, Artificial Sequence
  chemically synthesized
cggcactattcacaatagcaaa

SEQ ID NO: 905239 - DNA, 22 bp, Artificial Sequence
  chemically synthesized
ggttggttccaagtctttgcta

SEQ ID NO: 905240 - DNA, 22 bp, Artificial Sequence
  chemically synthesized
gggttggttccaagtctttgct

SEQ ID NO: 905241 - DNA, 22 bp, Artificial Sequence
  chemically synthesized
ttcacaatagcaaagacttgga

SEQ ID NO: 905242 - DNA, 22 bp, Artificial Sequence
  chemically synthesized
acaatagcaaagacttggaacc

SEQ ID NO: 905243 - DNA, 22 bp, Artificial Sequence
  chemically synthesized
atggacatttgggttggttcca

SEQ ID NO: 905244 - DNA, 22 bp, Artificial Sequence
  chemically synthesized
tcactgatggacatttgggttg

SEQ ID NO: 905245 - DNA, 22 bp, Artificial Sequence
  chemically synthesized
ggaaccaacccaaatgtccatc

SEQ ID NO: 905246 - DNA, 22 bp, Artificial Sequence
  chemically synthesized
gaaccaacccaaatgtccatca

SEQ ID NO: 905247 - DNA, 22 bp, Artificial Sequence
  chemically synthesized
atccagtctatcactgatggac

SEQ ID NO: 905248 - DNA, 22 bp, Artificial Sequence
  chemically synthesized
aatccagtctatcactgatgga

SEQ ID NO: 905249 - DNA, 22 bp, Artificial Sequence
  chemically synthesized
ttaatccagtctatcactgatg

SEQ ID NO: 905250 - DNA, 22 bp, Artificial Sequence
  chemically synthesized
cttaatccagtctatcactgat

SEQ ID NO: 905251 - DNA, 22 bp, Artificial Sequence
  chemically synthesized
tcttaatccagtctatcactga

SEQ ID NO: 905252 - DNA, 22 bp, Artificial Sequence
  chemically synthesized
catggtgtgtatgtgccacatt

SEQ ID NO: 905253 - DNA, 22 bp, Artificial Sequence
  chemically synthesized
gattaagaaaatgtggcacata

SEQ ID NO: 905254 - DNA, 22 bp, Artificial Sequence
  chemically synthesized
agaaaatgtggcacatacacac

SEQ ID NO: 905255 - DNA, 22 bp, Artificial Sequence
  chemically synthesized
cgtagtattccatggtgtgtat

SEQ ID NO: 905256 - DNA, 22 bp, Artificial Sequence
  chemically synthesized
tggttgcgtagtattccatggt

SEQ ID NO: 905257 - DNA, 22 bp, Artificial Sequence
  chemically synthesized
atggttgcgtagtattccatgg

SEQ ID NO: 905258 - DNA, 22 bp, Artificial Sequence
  chemically synthesized
tatggttgcgtagtattccatg

SEQ ID NO: 905259 - DNA, 22 bp, Artificial Sequence
  chemically synthesized
ttatggttgcgtagtattccat

SEQ ID NO: 905260 - DNA, 22 bp, Artificial Sequence
  chemically synthesized
tttatggttgcgtagtattcca

SEQ ID NO: 905261 - DNA, 22 bp, Artificial Sequence
  chemically synthesized
ttttatggttgcgtagtattcc

SEQ ID NO: 905262 - DNA, 22 bp, Artificial Sequence
  chemically synthesized
atccttttttatggttgcgtag

SEQ ID NO: 905263 - DNA, 22 bp, Artificial Sequence
  chemically synthesized
cgcaaccataaaaaaggatgag

SEQ ID NO: 905264 - DNA, 22 bp, Artificial Sequence
  chemically synthesized
aaaggacataaacaactcatcc

SEQ ID NO: 905265 - DNA, 22 bp, Artificial Sequence
  chemically synthesized
caaaggacataaacaactcatc

SEQ ID NO: 905266 - DNA, 22 bp, Artificial Sequence
  chemically synthesized
atccatgtcccttcaaaggaca

SEQ ID NO: 905267 - DNA, 22 bp, Artificial Sequence
  chemically synthesized
catccatgtcccttcaaaggac

SEQ ID NO: 905268 - DNA, 22 bp, Artificial Sequence
  chemically synthesized
cagcttcatccatgtcccttca

SEQ ID NO: 905269 - DNA, 22 bp, Artificial Sequence
  chemically synthesized
tttatgtcctttgaagggacat

SEQ ID NO: 905270 - DNA, 22 bp, Artificial Sequence
  chemically synthesized
ccagcttcatccatgtcccttc

SEQ ID NO: 905271 - DNA, 22 bp, Artificial Sequence
  chemically synthesized
atgtcctttgaagggacatgga

SEQ ID NO: 905272 - DNA, 22 bp, Artificial Sequence
  chemically synthesized
tgtcctttgaagggacatggat

SEQ ID NO: 905273 - DNA, 22 bp, Artificial Sequence
  chemically synthesized
gtttccagcttcatccatgtcc

SEQ ID NO: 905274 - DNA, 22 bp, Artificial Sequence
  chemically synthesized
tgaagggacatggatgaagctg

SEQ ID NO: 905275 - DNA, 22 bp, Artificial Sequence
  chemically synthesized
gaagggacatggatgaagctgg

SEQ ID NO: 905276 - DNA, 22 bp, Artificial Sequence
  chemically synthesized
aagggacatggatgaagctgga

SEQ ID NO: 905277 - DNA, 22 bp, Artificial Sequence
  chemically synthesized
agaatgttggtttccagcttca

SEQ ID NO: 905278 - DNA, 22 bp, Artificial Sequence
  chemically synthesized
ctcagaatgttggtttccagct

SEQ ID NO: 905279 - DNA, 22 bp, Artificial Sequence
  chemically synthesized
gctcagaatgttggtttccagc

SEQ ID NO: 905280 - DNA, 22 bp, Artificial Sequence
  chemically synthesized
tgatagtttgctcagaatgttg

SEQ ID NO: 905281 - DNA, 22 bp, Artificial Sequence
  chemically synthesized
gtgatagtttgctcagaatgtt

SEQ ID NO: 905282 - DNA, 22 bp, Artificial Sequence
  chemically synthesized
tccttgtgatagtttgctcaga

SEQ ID NO: 905283 - DNA, 22 bp, Artificial Sequence
  chemically synthesized
gaaaccaacattctgagcaaac

SEQ ID NO: 905284 - DNA, 22 bp, Artificial Sequence
  chemically synthesized
tgtccttgtgatagtttgctca

SEQ ID NO: 905285 - DNA, 22 bp, Artificial Sequence
  chemically synthesized
ctgtccttgtgatagtttgctc

SEQ ID NO: 905286 - DNA, 22 bp, Artificial Sequence
  chemically synthesized
tctgtccttgtgatagtttgct

SEQ ID NO: 905287 - DNA, 22 bp, Artificial Sequence
  chemically synthesized
gttttctgtccttgtgatagtt

SEQ ID NO: 905288 - DNA, 22 bp, Artificial Sequence
  chemically synthesized
ggttttctgtccttgtgatagt

SEQ ID NO: 905289 - DNA, 22 bp, Artificial Sequence
  chemically synthesized
tgagcaaactatcacaaggaca

SEQ ID NO: 905290 - DNA, 22 bp, Artificial Sequence
  chemically synthesized
agcaaactatcacaaggacaga

SEQ ID NO: 905291 - DNA, 22 bp, Artificial Sequence
  chemically synthesized
tcacaaggacagaaaaccaaac

SEQ ID NO: 905292 - DNA, 22 bp, Artificial Sequence
  chemically synthesized
tgagtgaggacatgcggtgttt

SEQ ID NO: 905293 - DNA, 22 bp, Artificial Sequence
  chemically synthesized
ccacctatgagtgaggacatgc

SEQ ID NO: 905294 - DNA, 22 bp, Artificial Sequence
  chemically synthesized
aattcccacctatgagtgagga

SEQ ID NO: 905295 - DNA, 22 bp, Artificial Sequence
  chemically synthesized
ttcaattcccacctatgagtga

SEQ ID NO: 905296 - DNA, 22 bp, Artificial Sequence
  chemically synthesized
attgttcaattcccacctatga

SEQ ID NO: 905297 - DNA, 22 bp, Artificial Sequence
  chemically synthesized
cattgttcaattcccacctatg

SEQ ID NO: 905298 - DNA, 22 bp, Artificial Sequence
  chemically synthesized
tcattgttcaattcccacctat

SEQ ID NO: 905299 - DNA, 22 bp, Artificial Sequence
  chemically synthesized
actcataggtgggaattgaaca

SEQ ID NO: 905300 - DNA, 22 bp, Artificial Sequence
  chemically synthesized
ataggtgggaattgaacaatga

SEQ ID NO: 905301 - DNA, 22 bp, Artificial Sequence
  chemically synthesized
tgtccaagtgttttcattgttc

SEQ ID NO: 905302 - DNA, 22 bp, Artificial Sequence
  chemically synthesized
cgctgtgtccaagtgttttcat

SEQ ID NO: 905303 - DNA, 22 bp, Artificial Sequence
  chemically synthesized
cctgcgctgtgtccaagtgttt

SEQ ID NO: 905304 - DNA, 22 bp, Artificial Sequence
  chemically synthesized
aacaatgaaaacacttggacac

SEQ ID NO: 905305 - DNA, 22 bp, Artificial Sequence
  chemically synthesized
ggacacagcgcaggcaacatca

SEQ ID NO: 905306 - DNA, 22 bp, Artificial Sequence
  chemically synthesized
gacacagcgcaggcaacatcac

SEQ ID NO: 905307 - DNA, 22 bp, Artificial Sequence
  chemically synthesized
cccagccccccaccccacgaca

SEQ ID NO: 905308 - DNA, 22 bp, Artificial Sequence
  chemically synthesized
tccctccccagccccccacccc

SEQ ID NO: 905309 - DNA, 22 bp, Artificial Sequence
  chemically synthesized
gggcctgtcgtggggtgggggg

SEQ ID NO: 905310 - DNA, 22 bp, Artificial Sequence
  chemically synthesized
atgctatccctccccagccccc

SEQ ID NO: 905311 - DNA, 22 bp, Artificial Sequence
  chemically synthesized
tcgtggggtggggggctgggga

SEQ ID NO: 905312 - DNA, 22 bp, Artificial Sequence
  chemically synthesized
ctaatgctatccctccccagcc

SEQ ID NO: 905313 - DNA, 22 bp, Artificial Sequence
  chemically synthesized
tcctaatgctatccctccccag

SEQ ID NO: 905314 - DNA, 22 bp, Artificial Sequence
  chemically synthesized
ctcctaatgctatccctcccca

SEQ ID NO: 905315 - DNA, 22 bp, Artificial Sequence
  chemically synthesized
tttctcctaatgctatccctcc

SEQ ID NO: 905316 - DNA, 22 bp, Artificial Sequence
  chemically synthesized
gctatttctcctaatgctatcc

SEQ ID NO: 905317 - DNA, 22 bp, Artificial Sequence
  chemically synthesized
cattagctatttctcctaatgc

SEQ ID NO: 905318 - DNA, 22 bp, Artificial Sequence
  chemically synthesized
acattagctatttctcctaatg

SEQ ID NO: 905319 - DNA, 22 bp, Artificial Sequence
  chemically synthesized
gggagggatagcattaggagaa

SEQ ID NO: 905320 - DNA, 22 bp, Artificial Sequence
  chemically synthesized
gtcatttacattagctatttct

SEQ ID NO: 905321 - DNA, 22 bp, Artificial Sequence
  chemically synthesized
actcgtcatttacattagctat

SEQ ID NO: 905322 - DNA, 22 bp, Artificial Sequence
  chemically synthesized
ggagaaatagctaatgtaaatg

SEQ ID NO: 905323 - DNA, 22 bp, Artificial Sequence
  chemically synthesized
cacccattaactcgtcatttac

SEQ ID NO: 905324 - DNA, 22 bp, Artificial Sequence
  chemically synthesized
gtgtgctgcacccattaactcg

SEQ ID NO: 905325 - DNA, 22 bp, Artificial Sequence
  chemically synthesized
atgtaaatgacgagttaatggg

SEQ ID NO: 905326 - DNA, 22 bp, Artificial Sequence
  chemically synthesized
atgggtgcagcacaccagcatg

SEQ ID NO: 905327 - DNA, 22 bp, Artificial Sequence
  chemically synthesized
cataggtatgcgtgggccatgc

SEQ ID NO: 905328 - DNA, 22 bp, Artificial Sequence
  chemically synthesized
ttacataggtatgcgtgggcca

SEQ ID NO: 905329 - DNA, 22 bp, Artificial Sequence
  chemically synthesized
gttacataggtatgcgtgggcc

SEQ ID NO: 905330 - DNA, 22 bp, Artificial Sequence
  chemically synthesized
gggtacatgtgcacaacgtgca

SEQ ID NO: 905331 - DNA, 22 bp, Artificial Sequence
  chemically synthesized
tgtaacaaacctgcacgttgtg

SEQ ID NO: 905332 - DNA, 22 bp, Artificial Sequence
  chemically synthesized
tagggtacatgtgcacaacgtg

SEQ ID NO: 905333 - DNA, 22 bp, Artificial Sequence
  chemically synthesized
aagttctagggtacatgtgcac

SEQ ID NO: 905334 - DNA, 22 bp, Artificial Sequence
  chemically synthesized
gaagttctagggtacatgtgca

SEQ ID NO: 905335 - DNA, 22 bp, Artificial Sequence
  chemically synthesized
cacgttgtgcacatgtacccta

SEQ ID NO: 905336 - DNA, 22 bp, Artificial Sequence
  chemically synthesized
tgcacatgtaccctagaacttc

SEQ ID NO: 905337 - DNA, 22 bp, Artificial Sequence
  chemically synthesized
gaacttcaagtatatatatata

SEQ ID NO: 905338 - DNA, 22 bp, Artificial Sequence
  chemically synthesized
caagtatatatatatacttata

SEQ ID NO: 905339 - DNA, 22 bp, Artificial Sequence
  chemically synthesized
aagtatatatatatacttatat

SEQ ID NO: 905340 - DNA, 22 bp, Artificial Sequence
  chemically synthesized
atataagtatatatataagtat

SEQ ID NO: 905341 - DNA, 22 bp, Artificial Sequence
  chemically synthesized
catataagtatatatataagta

SEQ ID NO: 905342 - DNA, 22 bp, Artificial Sequence
  chemically synthesized
tcatataagtatatatataagt

SEQ ID NO: 905343 - DNA, 22 bp, Artificial Sequence
  chemically synthesized
catctttcatataagtatatat

SEQ ID NO: 905344 - DNA, 22 bp, Artificial Sequence
  chemically synthesized
cctacatctttcatataagtat

SEQ ID NO: 905345 - DNA, 22 bp, Artificial Sequence
  chemically synthesized
attccctacatctttcatataa

SEQ ID NO: 905346 - DNA, 22 bp, Artificial Sequence
  chemically synthesized
aattccctacatctttcatata

SEQ ID NO: 905347 - DNA, 22 bp, Artificial Sequence
  chemically synthesized
atatatatacttatatgaaaga

SEQ ID NO: 905348 - DNA, 22 bp, Artificial Sequence
  chemically synthesized
tatatatacttatatgaaagat

SEQ ID NO: 905349 - DNA, 22 bp, Artificial Sequence
  chemically synthesized
caagcttaattccctacatctt

SEQ ID NO: 905350 - DNA, 22 bp, Artificial Sequence
  chemically synthesized
atatgaaagatgtagggaatta

SEQ ID NO: 905351 - DNA, 22 bp, Artificial Sequence
  chemically synthesized
tatgaaagatgtagggaattaa

SEQ ID NO: 905352 - DNA, 22 bp, Artificial Sequence
  chemically synthesized
ataactccaagcttaattccct

SEQ ID NO: 905353 - DNA, 22 bp, Artificial Sequence
  chemically synthesized
agatctaataactccaagctta

SEQ ID NO: 905354 - DNA, 22 bp, Artificial Sequence
  chemically synthesized
cagatctaataactccaagctt

SEQ ID NO: 905355 - DNA, 22 bp, Artificial Sequence
  chemically synthesized
cccttcagatctaataactcca

SEQ ID NO: 905356 - DNA, 22 bp, Artificial Sequence
  chemically synthesized
gcccttcagatctaataactcc

SEQ ID NO: 905357 - DNA, 22 bp, Artificial Sequence
  chemically synthesized
agcttggagttattagatctga

SEQ ID NO: 905358 - DNA, 22 bp, Artificial Sequence
  chemically synthesized
tcccccttgcccttcagatcta

SEQ ID NO: 905359 - DNA, 22 bp, Artificial Sequence
  chemically synthesized
ggagttattagatctgaagggc

SEQ ID NO: 905360 - DNA, 22 bp, Artificial Sequence
  chemically synthesized
gagttattagatctgaagggca

SEQ ID NO: 905361 - DNA, 22 bp, Artificial Sequence
  chemically synthesized
ttagatctgaagggcaaggggg

SEQ ID NO: 905362 - DNA, 22 bp, Artificial Sequence
  chemically synthesized
gatctgaagggcaagggggaca

SEQ ID NO: 905363 - DNA, 22 bp, Artificial Sequence
  chemically synthesized
atagatcaataccctgtccccc

SEQ ID NO: 905364 - DNA, 22 bp, Artificial Sequence
  chemically synthesized
aagggcaagggggacagggtat

SEQ ID NO: 905365 - DNA, 22 bp, Artificial Sequence
  chemically synthesized
tagagcagcagttgatagatca

SEQ ID NO: 905366 - DNA, 22 bp, Artificial Sequence
  chemically synthesized
tgcccctgtagagcagcagttg

SEQ ID NO: 905367 - DNA, 22 bp, Artificial Sequence
  chemically synthesized
atctatcaactgctgctctaca

SEQ ID NO: 905368 - DNA, 22 bp, Artificial Sequence
  chemically synthesized
tcaactgctgctctacaggggc

SEQ ID NO: 905369 - DNA, 22 bp, Artificial Sequence
  chemically synthesized
ctgctctacaggggcataactg

SEQ ID NO: 905370 - DNA, 22 bp, Artificial Sequence
  chemically synthesized
ctctacaggggcataactgcta

SEQ ID NO: 905371 - DNA, 22 bp, Artificial Sequence
  chemically synthesized
tacaggggcataactgctacat

SEQ ID NO: 905372 - DNA, 22 bp, Artificial Sequence
  chemically synthesized
ggagagagcagaaatgtagcag

SEQ ID NO: 905373 - DNA, 22 bp, Artificial Sequence
  chemically synthesized
caggggcataactgctacattt

SEQ ID NO: 905374 - DNA, 22 bp, Artificial Sequence
  chemically synthesized
gggagagagcagaaatgtagca

SEQ ID NO: 905375 - DNA, 22 bp, Artificial Sequence
  chemically synthesized
ttgggagagagcagaaatgtag

SEQ ID NO: 905376 - DNA, 22 bp, Artificial Sequence
  chemically synthesized
attcttgggagagagcagaaat

SEQ ID NO: 905377 - DNA, 22 bp, Artificial Sequence
  chemically synthesized
ctcattcttgggagagagcaga

SEQ ID NO: 905378 - DNA, 22 bp, Artificial Sequence
  chemically synthesized
tgctcattcttgggagagagca

SEQ ID NO: 905379 - DNA, 22 bp, Artificial Sequence
  chemically synthesized
ctacatttctgctctctcccaa

SEQ ID NO: 905380 - DNA, 22 bp, Artificial Sequence
  chemically synthesized
tctctgctcattcttgggagag

SEQ ID NO: 905381 - DNA, 22 bp, Artificial Sequence
  chemically synthesized
catttctgctctctcccaagaa

SEQ ID NO: 905382 - DNA, 22 bp, Artificial Sequence
  chemically synthesized
gggctatctctgctcattcttg

SEQ ID NO: 905383 - DNA, 22 bp, Artificial Sequence
  chemically synthesized
ctgctctctcccaagaatgagc

SEQ ID NO: 905384 - DNA, 22 bp, Artificial Sequence
  chemically synthesized
ggggctatctctgctcattctt

SEQ ID NO: 905385 - DNA, 22 bp, Artificial Sequence
  chemically synthesized
tgctctctcccaagaatgagca

SEQ ID NO: 905386 - DNA, 22 bp, Artificial Sequence
  chemically synthesized
ctctctcccaagaatgagcaga

SEQ ID NO: 905387 - DNA, 22 bp, Artificial Sequence
  chemically synthesized
cttggggctatctctgctcatt

SEQ ID NO: 905388 - DNA, 22 bp, Artificial Sequence
  chemically synthesized
gcttggggctatctctgctcat

SEQ ID NO: 905389 - DNA, 22 bp, Artificial Sequence
  chemically synthesized
tgcttggggctatctctgctca

SEQ ID NO: 905390 - DNA, 22 bp, Artificial Sequence
  chemically synthesized
tctcccaagaatgagcagagat

SEQ ID NO: 905391 - DNA, 22 bp, Artificial Sequence
  chemically synthesized
tttgcttggggctatctctgct

SEQ ID NO: 905392 - DNA, 22 bp, Artificial Sequence
  chemically synthesized
tcccaagaatgagcagagatag

SEQ ID NO: 905393 - DNA, 22 bp, Artificial Sequence
  chemically synthesized
ccaagaatgagcagagatagcc

SEQ ID NO: 905394 - DNA, 22 bp, Artificial Sequence
  chemically synthesized
catctctttgcttggggctatc

SEQ ID NO: 905395 - DNA, 22 bp, Artificial Sequence
  chemically synthesized
gcatctctttgcttggggctat

SEQ ID NO: 905396 - DNA, 22 bp, Artificial Sequence
  chemically synthesized
tacttgcatctctttgcttggg

SEQ ID NO: 905397 - DNA, 22 bp, Artificial Sequence
  chemically synthesized
ctgtacttgcatctctttgctt

SEQ ID NO: 905398 - DNA, 22 bp, Artificial Sequence
  chemically synthesized
cctgtacttgcatctctttgct

SEQ ID NO: 905399 - DNA, 22 bp, Artificial Sequence
  chemically synthesized
caacttcctgtacttgcatctc

SEQ ID NO: 905400 - DNA, 22 bp, Artificial Sequence
  chemically synthesized
ccaacttcctgtacttgcatct

SEQ ID NO: 905401 - DNA, 22 bp, Artificial Sequence
  chemically synthesized
atttccaacttcctgtacttgc

SEQ ID NO: 905402 - DNA, 22 bp, Artificial Sequence
  chemically synthesized
aatttccaacttcctgtacttg

SEQ ID NO: 905403 - DNA, 22 bp, Artificial Sequence
  chemically synthesized
ttaatttccaacttcctgtact

SEQ ID NO: 905404 - DNA, 22 bp, Artificial Sequence
  chemically synthesized
cttaatttccaacttcctgtac

SEQ ID NO: 905405 - DNA, 22 bp, Artificial Sequence
  chemically synthesized
tacgtgcttcttaatttccaac

SEQ ID NO: 905406 - DNA, 22 bp, Artificial Sequence
  chemically synthesized
atacgtgcttcttaatttccaa

SEQ ID NO: 905407 - DNA, 22 bp, Artificial Sequence
  chemically synthesized
tatacgtgcttcttaatttcca

SEQ ID NO: 905408 - DNA, 22 bp, Artificial Sequence
  chemically synthesized
ttatacgtgcttcttaatttcc

SEQ ID NO: 905409 - DNA, 22 bp, Artificial Sequence
  chemically synthesized
ccatttttatacgtgcttctta

SEQ ID NO: 905410 - DNA, 22 bp, Artificial Sequence
  chemically synthesized
accatttttatacgtgcttctt

SEQ ID NO: 905411 - DNA, 22 bp, Artificial Sequence
  chemically synthesized
gaaattaagaagcacgtataaa

SEQ ID NO: 905412 - DNA, 22 bp, Artificial Sequence
  chemically synthesized
gcacttaccatttttatacgtg

SEQ ID NO: 905413 - DNA, 22 bp, Artificial Sequence
  chemically synthesized
agcacttaccatttttatacgt

SEQ ID NO: 905414 - DNA, 22 bp, Artificial Sequence
  chemically synthesized
tagcacttaccatttttatacg

SEQ ID NO: 905415 - DNA, 22 bp, Artificial Sequence
  chemically synthesized
agaagcacgtataaaaatggta

SEQ ID NO: 905416 - DNA, 22 bp, Artificial Sequence
  chemically synthesized
tcggtgccccaccgatatccct

SEQ ID NO: 905417 - DNA, 22 bp, Artificial Sequence
  chemically synthesized
aagggatatcggtggggcaccg

SEQ ID NO: 905418 - DNA, 22 bp, Artificial Sequence
  chemically synthesized
tagcagatactgtcggtgcccc

SEQ ID NO: 905419 - DNA, 22 bp, Artificial Sequence
  chemically synthesized
aggaaaaaatgtatgaggtgtt

SEQ ID NO: 905420 - DNA, 22 bp, Artificial Sequence
  chemically synthesized
aaggaaaaaatgtatgaggtgt

SEQ ID NO: 905421 - DNA, 22 bp, Artificial Sequence
  chemically synthesized
ctacaacacctcatacattttt

SEQ ID NO: 905422 - DNA, 22 bp, Artificial Sequence
  chemically synthesized
caacacctcatacattttttcc

SEQ ID NO: 905423 - DNA, 22 bp, Artificial Sequence
  chemically synthesized
tggagatcatttaaggaaaaaa

SEQ ID NO: 905424 - DNA, 22 bp, Artificial Sequence
  chemically synthesized
atacattttttccttaaatgat

SEQ ID NO: 905425 - DNA, 22 bp, Artificial Sequence
  chemically synthesized
tttccttaaatgatctccacaa

SEQ ID NO: 905426 - DNA, 22 bp, Artificial Sequence
  chemically synthesized
ttccttaaatgatctccacaac

SEQ ID NO: 905427 - DNA, 22 bp, Artificial Sequence
  chemically synthesized
tccttaaatgatctccacaacc

SEQ ID NO: 905428 - DNA, 22 bp, Artificial Sequence
  chemically synthesized
caaatgtaggcaggttgtggag

SEQ ID NO: 905429 - DNA, 22 bp, Artificial Sequence
  chemically synthesized
ccttaaatgatctccacaacct

SEQ ID NO: 905430 - DNA, 22 bp, Artificial Sequence
  chemically synthesized
ccaaatgtaggcaggttgtgga

SEQ ID NO: 905431 - DNA, 22 bp, Artificial Sequence
  chemically synthesized
cttaaatgatctccacaacctg

SEQ ID NO: 905432 - DNA, 22 bp, Artificial Sequence
  chemically synthesized
tccaaatgtaggcaggttgtgg

SEQ ID NO: 905433 - DNA, 22 bp, Artificial Sequence
  chemically synthesized
aaatgatctccacaacctgcct

SEQ ID NO: 905434 - DNA, 22 bp, Artificial Sequence
  chemically synthesized
aatgatctccacaacctgccta

SEQ ID NO: 905435 - DNA, 22 bp, Artificial Sequence
  chemically synthesized
caacaatactttccaaatgtag

SEQ ID NO: 905436 - DNA, 22 bp, Artificial Sequence
  chemically synthesized
cacaacctgcctacatttggaa

SEQ ID NO: 905437 - DNA, 22 bp, Artificial Sequence
  chemically synthesized
acattacaacaatactttccaa

SEQ ID NO: 905438 - DNA, 22 bp, Artificial Sequence
  chemically synthesized
gacattacaacaatactttcca

SEQ ID NO: 905439 - DNA, 22 bp, Artificial Sequence
  chemically synthesized
tgacattacaacaatactttcc

SEQ ID NO: 905440 - DNA, 22 bp, Artificial Sequence
  chemically synthesized
cctacatttggaaagtattgtt

SEQ ID NO: 905441 - DNA, 22 bp, Artificial Sequence
  chemically synthesized
catttggaaagtattgttgtaa

SEQ ID NO: 905442 - DNA, 22 bp, Artificial Sequence
  chemically synthesized
aatggtaattttgacattacaa

SEQ ID NO: 905443 - DNA, 22 bp, Artificial Sequence
  chemically synthesized
ggaaagtattgttgtaatgtca

SEQ ID NO: 905444 - DNA, 22 bp, Artificial Sequence
  chemically synthesized
gaaagtattgttgtaatgtcaa

SEQ ID NO: 905445 - DNA, 22 bp, Artificial Sequence
  chemically synthesized
atgaaactgaatggtaattttg

SEQ ID NO: 905446 - DNA, 22 bp, Artificial Sequence
  chemically synthesized
ttgtaatgtcaaaattaccatt

SEQ ID NO: 905447 - DNA, 22 bp, Artificial Sequence
  chemically synthesized
taatgtcaaaattaccattcag

SEQ ID NO: 905448 - DNA, 22 bp, Artificial Sequence
  chemically synthesized
gtcaattaatgaaactgaatgg

SEQ ID NO: 905449 - DNA, 22 bp, Artificial Sequence
  chemically synthesized
agtcaattaatgaaactgaatg

SEQ ID NO: 905450 - DNA, 22 bp, Artificial Sequence
  chemically synthesized
tagtcaattaatgaaactgaat

SEQ ID NO: 905451 - DNA, 22 bp, Artificial Sequence
  chemically synthesized
ttagtcaattaatgaaactgaa

SEQ ID NO: 905452 - DNA, 22 bp, Artificial Sequence
  chemically synthesized
tttagtcaattaatgaaactga

SEQ ID NO: 905453 - DNA, 22 bp, Artificial Sequence
  chemically synthesized
attttttagtcaattaatgaaa

SEQ ID NO: 905454 - DNA, 22 bp, Artificial Sequence
  chemically synthesized
gattttttagtcaattaatgaa

SEQ ID NO: 905455 - DNA, 22 bp, Artificial Sequence
  chemically synthesized
ccattcagtttcattaattgac

SEQ ID NO: 905456 - DNA, 22 bp, Artificial Sequence
  chemically synthesized
acttgattttttagtcaattaa

SEQ ID NO: 905457 - DNA, 22 bp, Artificial Sequence
  chemically synthesized
gacttgattttttagtcaatta

SEQ ID NO: 905458 - DNA, 22 bp, Artificial Sequence
  chemically synthesized
tgacttgattttttagtcaatt

SEQ ID NO: 905459 - DNA, 22 bp, Artificial Sequence
  chemically synthesized
agtttcattaattgactaaaaa

SEQ ID NO: 905460 - DNA, 22 bp, Artificial Sequence
  chemically synthesized
ctttgacttgattttttagtca

SEQ ID NO: 905461 - DNA, 22 bp, Artificial Sequence
  chemically synthesized
cattaattgactaaaaaatcaa

SEQ ID NO: 905462 - DNA, 22 bp, Artificial Sequence
  chemically synthesized
attaattgactaaaaaatcaag

SEQ ID NO: 905463 - DNA, 22 bp, Artificial Sequence
  chemically synthesized
tcacattgctttgacttgattt

SEQ ID NO: 905464 - DNA, 22 bp, Artificial Sequence
  chemically synthesized
attgactaaaaaatcaagtcaa

SEQ ID NO: 905465 - DNA, 22 bp, Artificial Sequence
  chemically synthesized
actaaaaaatcaagtcaaagca

SEQ ID NO: 905466 - DNA, 22 bp, Artificial Sequence
  chemically synthesized
aaaaatcaagtcaaagcaatgt

SEQ ID NO: 905467 - DNA, 22 bp, Artificial Sequence
  chemically synthesized
ggaaaagataaccaaccaatat

SEQ ID NO: 905468 - DNA, 22 bp, Artificial Sequence
  chemically synthesized
gttggttatcttttcctaattc

SEQ ID NO: 905469 - DNA, 22 bp, Artificial Sequence
  chemically synthesized
gttatcttttcctaattcatct

SEQ ID NO: 905470 - DNA, 22 bp, Artificial Sequence
  chemically synthesized
tcttttcctaattcatctatct

SEQ ID NO: 905471 - DNA, 22 bp, Artificial Sequence
  chemically synthesized
ttcctaattcatctatctattc

SEQ ID NO: 905472 - DNA, 22 bp, Artificial Sequence
  chemically synthesized
tcctaattcatctatctattct

SEQ ID NO: 905473 - DNA, 22 bp, Artificial Sequence
  chemically synthesized
cctaattcatctatctattctg

SEQ ID NO: 905474 - DNA, 22 bp, Artificial Sequence
  chemically synthesized
ctaattcatctatctattctgt

SEQ ID NO: 905475 - DNA, 22 bp, Artificial Sequence
  chemically synthesized
attcatctatctattctgtcta

SEQ ID NO: 905476 - DNA, 22 bp, Artificial Sequence
  chemically synthesized
ataaacagacaggtagacagaa

SEQ ID NO: 905477 - DNA, 22 bp, Artificial Sequence
  chemically synthesized
atctatctattctgtctacctg

SEQ ID NO: 905478 - DNA, 22 bp, Artificial Sequence
  chemically synthesized
actgataaacagacaggtagac

SEQ ID NO: 905479 - DNA, 22 bp, Artificial Sequence
  chemically synthesized
tctattctgtctacctgtctgt

SEQ ID NO: 905480 - DNA, 22 bp, Artificial Sequence
  chemically synthesized
ttctgtctacctgtctgtttat

SEQ ID NO: 905481 - DNA, 22 bp, Artificial Sequence
  chemically synthesized
tgtctacctgtctgtttatcag

SEQ ID NO: 905482 - DNA, 22 bp, Artificial Sequence
  chemically synthesized
tctacctgtctgtttatcagtc

SEQ ID NO: 905483 - DNA, 22 bp, Artificial Sequence
  chemically synthesized
cctgtctgtttatcagtcaatc

SEQ ID NO: 905484 - DNA, 22 bp, Artificial Sequence
  chemically synthesized
tctgtttatcagtcaatcatct

SEQ ID NO: 905485 - DNA, 22 bp, Artificial Sequence
  chemically synthesized
tttatcagtcaatcatctttca

SEQ ID NO: 905486 - DNA, 22 bp, Artificial Sequence
  chemically synthesized
atcagtcaatcatctttcaccc

SEQ ID NO: 905487 - DNA, 22 bp, Artificial Sequence
  chemically synthesized
aaaggaacgtaagggtgaaaga

SEQ ID NO: 905488 - DNA, 22 bp, Artificial Sequence
  chemically synthesized
tcagtcaatcatctttcaccct

SEQ ID NO: 905489 - DNA, 22 bp, Artificial Sequence
  chemically synthesized
ctcaaaggaacgtaagggtgaa

SEQ ID NO: 905490 - DNA, 22 bp, Artificial Sequence
  chemically synthesized
tcacccttacgttcctttgagg

SEQ ID NO: 905491 - DNA, 22 bp, Artificial Sequence
  chemically synthesized
cacccttacgttcctttgagga

SEQ ID NO: 905492 - DNA, 22 bp, Artificial Sequence
  chemically synthesized
acccttacgttcctttgaggaa

SEQ ID NO: 905493 - DNA, 22 bp, Artificial Sequence
  chemically synthesized
acgttcctttgaggaactttgc

SEQ ID NO: 905494 - DNA, 22 bp, Artificial Sequence
  chemically synthesized
cgttcctttgaggaactttgca

SEQ ID NO: 905495 - DNA, 22 bp, Artificial Sequence
  chemically synthesized
ctttgaggaactttgcacctac

SEQ ID NO: 905496 - DNA, 22 bp, Artificial Sequence
  chemically synthesized
tgaggaactttgcacctacttc

SEQ ID NO: 905497 - DNA, 22 bp, Artificial Sequence
  chemically synthesized
gaggaactttgcacctacttct

SEQ ID NO: 905498 - DNA, 22 bp, Artificial Sequence
  chemically synthesized
aggaactttgcacctacttctc

SEQ ID NO: 905499 - DNA, 22 bp, Artificial Sequence
  chemically synthesized
caccacaacaaaggtagagaag

SEQ ID NO: 905500 - DNA, 22 bp, Artificial Sequence
  chemically synthesized
tgcacctacttctctacctttg

SEQ ID NO: 905501 - DNA, 22 bp, Artificial Sequence
  chemically synthesized
gcacctacttctctacctttgt

SEQ ID NO: 905502 - DNA, 22 bp, Artificial Sequence
  chemically synthesized
cacctacttctctacctttgtt

SEQ ID NO: 905503 - DNA, 22 bp, Artificial Sequence
  chemically synthesized
cagctgcaccacaacaaaggta

SEQ ID NO: 905504 - DNA, 22 bp, Artificial Sequence
  chemically synthesized
tacagctgcaccacaacaaagg

SEQ ID NO: 905505 - DNA, 22 bp, Artificial Sequence
  chemically synthesized
cttctctacctttgttgtggtg

SEQ ID NO: 905506 - DNA, 22 bp, Artificial Sequence
  chemically synthesized
ctctacctttgttgtggtgcag

SEQ ID NO: 905507 - DNA, 22 bp, Artificial Sequence
  chemically synthesized
tctacctttgttgtggtgcagc

SEQ ID NO: 905508 - DNA, 22 bp, Artificial Sequence
  chemically synthesized
tacctttgttgtggtgcagctg

SEQ ID NO: 905509 - DNA, 22 bp, Artificial Sequence
  chemically synthesized
aaccaaactctacagctgcacc

SEQ ID NO: 905510 - DNA, 22 bp, Artificial Sequence
  chemically synthesized
cctttgttgtggtgcagctgta

SEQ ID NO: 905511 - DNA, 22 bp, Artificial Sequence
  chemically synthesized
tgttgtggtgcagctgtagagt

SEQ ID NO: 905512 - DNA, 22 bp, Artificial Sequence
  chemically synthesized
aatctcaaccaaactctacagc

SEQ ID NO: 905513 - DNA, 22 bp, Artificial Sequence
  chemically synthesized
gttgtggtgcagctgtagagtt

SEQ ID NO: 905514 - DNA, 22 bp, Artificial Sequence
  chemically synthesized
ttgtggtgcagctgtagagttt

SEQ ID NO: 905515 - DNA, 22 bp, Artificial Sequence
  chemically synthesized
tggtgcagctgtagagtttggt

SEQ ID NO: 905516 - DNA, 22 bp, Artificial Sequence
  chemically synthesized
aaagtcattaaatctcaaccaa

SEQ ID NO: 905517 - DNA, 22 bp, Artificial Sequence
  chemically synthesized
tagagtttggttgagatttaat

SEQ ID NO: 905518 - DNA, 22 bp, Artificial Sequence
  chemically synthesized
cagctaaaagtcattaaatctc

SEQ ID NO: 905519 - DNA, 22 bp, Artificial Sequence
  chemically synthesized
tacagctaaaagtcattaaatc

SEQ ID NO: 905520 - DNA, 22 bp, Artificial Sequence
  chemically synthesized
ctacagctaaaagtcattaaat

SEQ ID NO: 905521 - DNA, 22 bp, Artificial Sequence
  chemically synthesized
acttctacagctaaaagtcatt

SEQ ID NO: 905522 - DNA, 22 bp, Artificial Sequence
  chemically synthesized
ggttgagatttaatgactttta

SEQ ID NO: 905523 - DNA, 22 bp, Artificial Sequence
  chemically synthesized
gttgagatttaatgacttttag

SEQ ID NO: 905524 - DNA, 22 bp, Artificial Sequence
  chemically synthesized
agatttaatgacttttagctgt

SEQ ID NO: 905525 - DNA, 22 bp, Artificial Sequence
  chemically synthesized
aatcacacctcacttctacagc

SEQ ID NO: 905526 - DNA, 22 bp, Artificial Sequence
  chemically synthesized
aatgacttttagctgtagaagt

SEQ ID NO: 905527 - DNA, 22 bp, Artificial Sequence
  chemically synthesized
atgacttttagctgtagaagtg

SEQ ID NO: 905528 - DNA, 22 bp, Artificial Sequence
  chemically synthesized
tactaaatcacacctcacttct

SEQ ID NO: 905529 - DNA, 22 bp, Artificial Sequence
  chemically synthesized
ctgtactaaatcacacctcact

SEQ ID NO: 905530 - DNA, 22 bp, Artificial Sequence
  chemically synthesized
ttagctgtagaagtgaggtgtg

SEQ ID NO: 905531 - DNA, 22 bp, Artificial Sequence
  chemically synthesized
tagctgtagaagtgaggtgtga

SEQ ID NO: 905532 - DNA, 22 bp, Artificial Sequence
  chemically synthesized
agctgtagaagtgaggtgtgat

SEQ ID NO: 905533 - DNA, 22 bp, Artificial Sequence
  chemically synthesized
gctgtagaagtgaggtgtgatt

SEQ ID NO: 905534 - DNA, 22 bp, Artificial Sequence
  chemically synthesized
attcctgtactaaatcacacct

SEQ ID NO: 905535 - DNA, 22 bp, Artificial Sequence
  chemically synthesized
tagaagtgaggtgtgatttagt

SEQ ID NO: 905536 - DNA, 22 bp, Artificial Sequence
  chemically synthesized
ggtcacatgctcattcctgtac

SEQ ID NO: 905537 - DNA, 22 bp, Artificial Sequence
  chemically synthesized
aattaggtcacatgctcattcc

SEQ ID NO: 905538 - DNA, 22 bp, Artificial Sequence
  chemically synthesized
gcctgaattaggtcacatgctc

SEQ ID NO: 905539 - DNA, 22 bp, Artificial Sequence
  chemically synthesized
agtacaggaatgagcatgtgac

SEQ ID NO: 905540 - DNA, 22 bp, Artificial Sequence
  chemically synthesized
gtacaggaatgagcatgtgacc

SEQ ID NO: 905541 - DNA, 22 bp, Artificial Sequence
  chemically synthesized
actggcctgaattaggtcacat

SEQ ID NO: 905542 - DNA, 22 bp, Artificial Sequence
  chemically synthesized
aaactgactggcctgaattagg

SEQ ID NO: 905543 - DNA, 22 bp, Artificial Sequence
  chemically synthesized
tgaaactgactggcctgaatta

SEQ ID NO: 905544 - DNA, 22 bp, Artificial Sequence
  chemically synthesized
ctctgaaactgactggcctgaa

SEQ ID NO: 905545 - DNA, 22 bp, Artificial Sequence
  chemically synthesized
attcaggccagtcagtttcaga

SEQ ID NO: 905546 - DNA, 22 bp, Artificial Sequence
  chemically synthesized
aggccagtcagtttcagagcag

SEQ ID NO: 905547 - DNA, 22 bp, Artificial Sequence
  chemically synthesized
ccaaagcatccaggaaagactg

SEQ ID NO: 905548 - DNA, 22 bp, Artificial Sequence
  chemically synthesized
cccaaagcatccaggaaagact

SEQ ID NO: 905549 - DNA, 22 bp, Artificial Sequence
  chemically synthesized
tcccaaagcatccaggaaagac

SEQ ID NO: 905550 - DNA, 22 bp, Artificial Sequence
  chemically synthesized
tttcccaaagcatccaggaaag

SEQ ID NO: 905551 - DNA, 22 bp, Artificial Sequence
  chemically synthesized
ctttcccaaagcatccaggaaa

SEQ ID NO: 905552 - DNA, 22 bp, Artificial Sequence
  chemically synthesized
cagagcagtctttcctggatgc

SEQ ID NO: 905553 - DNA, 22 bp, Artificial Sequence
  chemically synthesized
agagcagtctttcctggatgct

SEQ ID NO: 905554 - DNA, 22 bp, Artificial Sequence
  chemically synthesized
gggaccttctttcccaaagcat

SEQ ID NO: 905555 - DNA, 22 bp, Artificial Sequence
  chemically synthesized
agggaccttctttcccaaagca

SEQ ID NO: 905556 - DNA, 22 bp, Artificial Sequence
  chemically synthesized
tagggaccttctttcccaaagc

SEQ ID NO: 905557 - DNA, 22 bp, Artificial Sequence
  chemically synthesized
tttagggaccttctttcccaaa

SEQ ID NO: 905558 - DNA, 22 bp, Artificial Sequence
  chemically synthesized
tcctggatgctttgggaaagaa

SEQ ID NO: 905559 - DNA, 22 bp, Artificial Sequence
  chemically synthesized
cctggatgctttgggaaagaag

SEQ ID NO: 905560 - DNA, 22 bp, Artificial Sequence
  chemically synthesized
ctggatgctttgggaaagaagg

SEQ ID NO: 905561 - DNA, 22 bp, Artificial Sequence
  chemically synthesized
gatgctttgggaaagaaggtcc

SEQ ID NO: 905562 - DNA, 22 bp, Artificial Sequence
  chemically synthesized
tgggaaagaaggtccctaaaga

SEQ ID NO: 905563 - DNA, 22 bp, Artificial Sequence
  chemically synthesized
atgaaaatcatctctttaggga

SEQ ID NO: 905564 - DNA, 22 bp, Artificial Sequence
  chemically synthesized
gggaaagaaggtccctaaagag

SEQ ID NO: 905565 - DNA, 22 bp, Artificial Sequence
  chemically synthesized
gatgaaaatcatctctttaggg

SEQ ID NO: 905566 - DNA, 22 bp, Artificial Sequence
  chemically synthesized
ggaaagaaggtccctaaagaga

SEQ ID NO: 905567 - DNA, 22 bp, Artificial Sequence
  chemically synthesized
tgatgaaaatcatctctttagg

SEQ ID NO: 905568 - DNA, 22 bp, Artificial Sequence
  chemically synthesized
ttgatgaaaatcatctctttag

SEQ ID NO: 905569 - DNA, 22 bp, Artificial Sequence
  chemically synthesized
cttttgatgaaaatcatctctt

SEQ ID NO: 905570 - DNA, 22 bp, Artificial Sequence
  chemically synthesized
acttttgatgaaaatcatctct

SEQ ID NO: 905571 - DNA, 22 bp, Artificial Sequence
  chemically synthesized
caaacttacttttgatgaaaat

SEQ ID NO: 905572 - DNA, 22 bp, Artificial Sequence
  chemically synthesized
aagagatgattttcatcaaaag

SEQ ID NO: 905573 - DNA, 22 bp, Artificial Sequence
  chemically synthesized
agaacccacatctgcaaactta

SEQ ID NO: 905574 - DNA, 22 bp, Artificial Sequence
  chemically synthesized
cagaacccacatctgcaaactt

SEQ ID NO: 905575 - DNA, 22 bp, Artificial Sequence
  chemically synthesized
tcatcaaaagtaagtttgcaga

SEQ ID NO: 905576 - DNA, 22 bp, Artificial Sequence
  chemically synthesized
catcaaaagtaagtttgcagat

SEQ ID NO: 905577 - DNA, 22 bp, Artificial Sequence
  chemically synthesized
atcaaaagtaagtttgcagatg

SEQ ID NO: 905578 - DNA, 22 bp, Artificial Sequence
  chemically synthesized
aagccgtttcagaacccacatc

SEQ ID NO: 905579 - DNA, 22 bp, Artificial Sequence
  chemically synthesized
gcagatgtgggttctgaaacgg

SEQ ID NO: 905580 - DNA, 22 bp, Artificial Sequence
  chemically synthesized
cagatgtgggttctgaaacggc

SEQ ID NO: 905581 - DNA, 22 bp, Artificial Sequence
  chemically synthesized
gtgacaaaaatggcctgaagcc

SEQ ID NO: 905582 - DNA, 22 bp, Artificial Sequence
  chemically synthesized
ggtgacaaaaatggcctgaagc

SEQ ID NO: 905583 - DNA, 22 bp, Artificial Sequence
  chemically synthesized
ttggtgacaaaaatggcctgaa

SEQ ID NO: 905584 - DNA, 22 bp, Artificial Sequence
  chemically synthesized
tgaaacggcttcaggccatttt

SEQ ID NO: 905585 - DNA, 22 bp, Artificial Sequence
  chemically synthesized
cctcttggtgacaaaaatggcc

SEQ ID NO: 905586 - DNA, 22 bp, Artificial Sequence
  chemically synthesized
aaacggcttcaggccatttttg

SEQ ID NO: 905587 - DNA, 22 bp, Artificial Sequence
  chemically synthesized
ccctcttggtgacaaaaatggc

SEQ ID NO: 905588 - DNA, 22 bp, Artificial Sequence
  chemically synthesized
acttccctcttggtgacaaaaa

SEQ ID NO: 905589 - DNA, 22 bp, Artificial Sequence
  chemically synthesized
caggccatttttgtcaccaaga

SEQ ID NO: 905590 - DNA, 22 bp, Artificial Sequence
  chemically synthesized
acctgacttccctcttggtgac

SEQ ID NO: 905591 - DNA, 22 bp, Artificial Sequence
  chemically synthesized
aggccatttttgtcaccaagag

SEQ ID NO: 905592 - DNA, 22 bp, Artificial Sequence
  chemically synthesized
cacctgacttccctcttggtga

SEQ ID NO: 905593 - DNA, 22 bp, Artificial Sequence
  chemically synthesized
gcagcttcacctgacttccctc

SEQ ID NO: 905594 - DNA, 22 bp, Artificial Sequence
  chemically synthesized
ttgtcaccaagagggaagtcag

SEQ ID NO: 905595 - DNA, 22 bp, Artificial Sequence
  chemically synthesized
tgtcaccaagagggaagtcagg

SEQ ID NO: 905596 - DNA, 22 bp, Artificial Sequence
  chemically synthesized
gtcaccaagagggaagtcaggt

SEQ ID NO: 905597 - DNA, 22 bp, Artificial Sequence
  chemically synthesized
tcaccaagagggaagtcaggtg

SEQ ID NO: 905598 - DNA, 22 bp, Artificial Sequence
  chemically synthesized
acctagcagcttcacctgactt

SEQ ID NO: 905599 - DNA, 22 bp, Artificial Sequence
  chemically synthesized
tgttgacctagcagcttcacct

SEQ ID NO: 905600 - DNA, 22 bp, Artificial Sequence
  chemically synthesized
tgtgttgacctagcagcttcac

SEQ ID NO: 905601 - DNA, 22 bp, Artificial Sequence
  chemically synthesized
ctgtgttgacctagcagcttca

SEQ ID NO: 905602 - DNA, 22 bp, Artificial Sequence
  chemically synthesized
tctgtgttgacctagcagcttc

SEQ ID NO: 905603 - DNA, 22 bp, Artificial Sequence
  chemically synthesized
ttctgtgttgacctagcagctt

SEQ ID NO: 905604 - DNA, 22 bp, Artificial Sequence
  chemically synthesized
tttttctgtgttgacctagcag

SEQ ID NO: 905605 - DNA, 22 bp, Artificial Sequence
  chemically synthesized
tatttttctgtgttgacctagc

SEQ ID NO: 905606 - DNA, 22 bp, Artificial Sequence
  chemically synthesized
ggttctatttttctgtgttgac

SEQ ID NO: 905607 - DNA, 22 bp, Artificial Sequence
  chemically synthesized
tgggttctatttttctgtgttg

SEQ ID NO: 905608 - DNA, 22 bp, Artificial Sequence
  chemically synthesized
tctgggttctatttttctgtgt

SEQ ID NO: 905609 - DNA, 22 bp, Artificial Sequence
  chemically synthesized
ctctgggttctatttttctgtg

SEQ ID NO: 905610 - DNA, 22 bp, Artificial Sequence
  chemically synthesized
ctaggtcaacacagaaaaatag

SEQ ID NO: 905611 - DNA, 22 bp, Artificial Sequence
  chemically synthesized
ggtcaacacagaaaaatagaac

SEQ ID NO: 905612 - DNA, 22 bp, Artificial Sequence
  chemically synthesized
acatttctctgggttctatttt

SEQ ID NO: 905613 - DNA, 22 bp, Artificial Sequence
  chemically synthesized
cacatttctctgggttctattt

SEQ ID NO: 905614 - DNA, 22 bp, Artificial Sequence
  chemically synthesized
tcacatttctctgggttctatt

SEQ ID NO: 905615 - DNA, 22 bp, Artificial Sequence
  chemically synthesized
ttcacatttctctgggttctat

SEQ ID NO: 905616 - DNA, 22 bp, Artificial Sequence
  chemically synthesized
tttcacatttctctgggttcta

SEQ ID NO: 905617 - DNA, 22 bp, Artificial Sequence
  chemically synthesized
ttttcacatttctctgggttct

SEQ ID NO: 905618 - DNA, 22 bp, Artificial Sequence
  chemically synthesized
tttttcacatttctctgggttc

SEQ ID NO: 905619 - DNA, 22 bp, Artificial Sequence
  chemically synthesized
ttttttcacatttctctgggtt

SEQ ID NO: 905620 - DNA, 22 bp, Artificial Sequence
  chemically synthesized
tttttttcacatttctctgggt

SEQ ID NO: 905621 - DNA, 22 bp, Artificial Sequence
  chemically synthesized
ttttttttcacatttctctggg

SEQ ID NO: 905622 - DNA, 22 bp, Artificial Sequence
  chemically synthesized
tttttttttcacatttctctgg

SEQ ID NO: 905623 - DNA, 22 bp, Artificial Sequence
  chemically synthesized
ttttttttttcacatttctctg

SEQ ID NO: 905624 - DNA, 22 bp, Artificial Sequence
  chemically synthesized
tttttttttttcacatttctct

SEQ ID NO: 905625 - DNA, 22 bp, Artificial Sequence
  chemically synthesized
ttttttttttttcacatttctc

SEQ ID NO: 905626 - DNA, 22 bp, Artificial Sequence
  chemically synthesized
tttttttttttttcacatttct

SEQ ID NO: 905627 - DNA, 22 bp, Artificial Sequence
  chemically synthesized
ttttttttttttttcacatttc

SEQ ID NO: 905628 - DNA, 22 bp, Artificial Sequence
  chemically synthesized
tttttttttttttttcacattt

SEQ ID NO: 905629 - DNA, 22 bp, Artificial Sequence
  chemically synthesized
ttttttttttttttttttcaca

SEQ ID NO: 905630 - DNA, 22 bp, Artificial Sequence
  chemically synthesized
gttttttttttttttttttcac

SEQ ID NO: 905631 - DNA, 22 bp, Artificial Sequence
  chemically synthesized
ttgttttttttttttttttttc

SEQ ID NO: 905632 - DNA, 22 bp, Artificial Sequence
  chemically synthesized
cttgtttttttttttttttttt

SEQ ID NO: 905633 - DNA, 22 bp, Artificial Sequence
  chemically synthesized
tttcttgttttttttttttttt

SEQ ID NO: 905634 - DNA, 22 bp, Artificial Sequence
  chemically synthesized
gtttcttgtttttttttttttt

SEQ ID NO: 905635 - DNA, 22 bp, Artificial Sequence
  chemically synthesized
tgtttcttgttttttttttttt

SEQ ID NO: 905636 - DNA, 22 bp, Artificial Sequence
  chemically synthesized
ttgtttcttgtttttttttttt

SEQ ID NO: 905637 - DNA, 22 bp, Artificial Sequence
  chemically synthesized
tttgtttcttgttttttttttt

SEQ ID NO: 905638 - DNA, 22 bp, Artificial Sequence
  chemically synthesized
cggttttttgtttcttgttttt

SEQ ID NO: 905639 - DNA, 22 bp, Artificial Sequence
  chemically synthesized
aacaataaatatgatcaaggtt

SEQ ID NO: 905640 - DNA, 22 bp, Artificial Sequence
  chemically synthesized
aaacaataaatatgatcaaggt

SEQ ID NO: 905641 - DNA, 22 bp, Artificial Sequence
  chemically synthesized
atttaaacaataaatatgatca

SEQ ID NO: 905642 - DNA, 22 bp, Artificial Sequence
  chemically synthesized
aaactgatttaaacaataaata

SEQ ID NO: 905643 - DNA, 22 bp, Artificial Sequence
  chemically synthesized
gtctcaaactgatttaaacaat

SEQ ID NO: 905644 - DNA, 22 bp, Artificial Sequence
  chemically synthesized
gatcatatttattgtttaaatc

SEQ ID NO: 905645 - DNA, 22 bp, Artificial Sequence
  chemically synthesized
atcatatttattgtttaaatca

SEQ ID NO: 905646 - DNA, 22 bp, Artificial Sequence
  chemically synthesized
attgtttaaatcagtttgagac

SEQ ID NO: 905647 - DNA, 22 bp, Artificial Sequence
  chemically synthesized
ttgtttaaatcagtttgagacc

SEQ ID NO: 905648 - DNA, 22 bp, Artificial Sequence
  chemically synthesized
tttaaatcagtttgagaccagt

SEQ ID NO: 905649 - DNA, 22 bp, Artificial Sequence
  chemically synthesized
taagtgacagaaaactggtctc

SEQ ID NO: 905650 - DNA, 22 bp, Artificial Sequence
  chemically synthesized
aaatcagtttgagaccagtttt

SEQ ID NO: 905651 - DNA, 22 bp, Artificial Sequence
  chemically synthesized
aatcagtttgagaccagttttc

SEQ ID NO: 905652 - DNA, 22 bp, Artificial Sequence
  chemically synthesized
atgctgtaagtgacagaaaact

SEQ ID NO: 905653 - DNA, 22 bp, Artificial Sequence
  chemically synthesized
aatgctgtaagtgacagaaaac

SEQ ID NO: 905654 - DNA, 22 bp, Artificial Sequence
  chemically synthesized
ttaatgctgtaagtgacagaaa

SEQ ID NO: 905655 - DNA, 22 bp, Artificial Sequence
  chemically synthesized
tcttaatgctgtaagtgacaga

SEQ ID NO: 905656 - DNA, 22 bp, Artificial Sequence
  chemically synthesized
gagaccagttttctgtcactta

SEQ ID NO: 905657 - DNA, 22 bp, Artificial Sequence
  chemically synthesized
agaccagttttctgtcacttac

SEQ ID NO: 905658 - DNA, 22 bp, Artificial Sequence
  chemically synthesized
gttctcttaatgctgtaagtga

SEQ ID NO: 905659 - DNA, 22 bp, Artificial Sequence
  chemically synthesized
ttggttctcttaatgctgtaag

SEQ ID NO: 905660 - DNA, 22 bp, Artificial Sequence
  chemically synthesized
tctgtcacttacagcattaaga

SEQ ID NO: 905661 - DNA, 22 bp, Artificial Sequence
  chemically synthesized
ctgtcacttacagcattaagag

SEQ ID NO: 905662 - DNA, 22 bp, Artificial Sequence
  chemically synthesized
tgtcacttacagcattaagaga

SEQ ID NO: 905663 - DNA, 22 bp, Artificial Sequence
  chemically synthesized
tcacttacagcattaagagaac

SEQ ID NO: 905664 - DNA, 22 bp, Artificial Sequence
  chemically synthesized
atgcgtctattggttctcttaa

SEQ ID NO: 905665 - DNA, 22 bp, Artificial Sequence
  chemically synthesized
aatgcgtctattggttctctta

SEQ ID NO: 905666 - DNA, 22 bp, Artificial Sequence
  chemically synthesized
acttaatgcgtctattggttct

SEQ ID NO: 905667 - DNA, 22 bp, Artificial Sequence
  chemically synthesized
acagcattaagagaaccaatag

SEQ ID NO: 905668 - DNA, 22 bp, Artificial Sequence
  chemically synthesized
cagcattaagagaaccaataga

SEQ ID NO: 905669 - DNA, 22 bp, Artificial Sequence
  chemically synthesized
agagaaccaatagacgcattaa

SEQ ID NO: 905670 - DNA, 22 bp, Artificial Sequence
  chemically synthesized
taagtaactgacttaatgcgtc

SEQ ID NO: 905671 - DNA, 22 bp, Artificial Sequence
  chemically synthesized
atatgcctgtaagtaactgact

SEQ ID NO: 905672 - DNA, 22 bp, Artificial Sequence
  chemically synthesized
actaatatgcctgtaagtaact

SEQ ID NO: 905673 - DNA, 22 bp, Artificial Sequence
  chemically synthesized
taactaatatgcctgtaagtaa

SEQ ID NO: 905674 - DNA, 22 bp, Artificial Sequence
  chemically synthesized
gttctaactaatatgcctgtaa

SEQ ID NO: 905675 - DNA, 22 bp, Artificial Sequence
  chemically synthesized
agtcagttacttacaggcatat

SEQ ID NO: 905676 - DNA, 22 bp, Artificial Sequence
  chemically synthesized
cttacaggcatattagttagaa

SEQ ID NO: 905677 - DNA, 22 bp, Artificial Sequence
  chemically synthesized
acaggcatattagttagaacta

SEQ ID NO: 905678 - DNA, 22 bp, Artificial Sequence
  chemically synthesized
caggcatattagttagaactaa

SEQ ID NO: 905679 - DNA, 22 bp, Artificial Sequence
  chemically synthesized
tgaagtgtcatggaggattagt

SEQ ID NO: 905680 - DNA, 22 bp, Artificial Sequence
  chemically synthesized
tgtgaagtgtcatggaggatta

SEQ ID NO: 905681 - DNA, 22 bp, Artificial Sequence
  chemically synthesized
ctgtgaagtgtcatggaggatt

SEQ ID NO: 905682 - DNA, 22 bp, Artificial Sequence
  chemically synthesized
gttagaactaatcctccatgac

SEQ ID NO: 905683 - DNA, 22 bp, Artificial Sequence
  chemically synthesized
accttctgtgaagtgtcatgga

SEQ ID NO: 905684 - DNA, 22 bp, Artificial Sequence
  chemically synthesized
caccttctgtgaagtgtcatgg

SEQ ID NO: 905685 - DNA, 22 bp, Artificial Sequence
  chemically synthesized
gaactaatcctccatgacactt

SEQ ID NO: 905686 - DNA, 22 bp, Artificial Sequence
  chemically synthesized
atcctccatgacacttcacaga

SEQ ID NO: 905687 - DNA, 22 bp, Artificial Sequence
  chemically synthesized
catgacacttcacagaaggtga

SEQ ID NO: 905688 - DNA, 22 bp, Artificial Sequence
  chemically synthesized
aaaatgcatgaatcttcacctt

SEQ ID NO: 905689 - DNA, 22 bp, Artificial Sequence
  chemically synthesized
aaaaatgcatgaatcttcacct

SEQ ID NO: 905690 - DNA, 22 bp, Artificial Sequence
  chemically synthesized
taaaaatgcatgaatcttcacc

SEQ ID NO: 905691 - DNA, 22 bp, Artificial Sequence
  chemically synthesized
ttttaaaaatgcatgaatcttc

SEQ ID NO: 905692 - DNA, 22 bp, Artificial Sequence
  chemically synthesized
cacagaaggtgaagattcatgc

SEQ ID NO: 905693 - DNA, 22 bp, Artificial Sequence
  chemically synthesized
acagaaggtgaagattcatgca

SEQ ID NO: 905694 - DNA, 22 bp, Artificial Sequence
  chemically synthesized
atgcatttttaaaataattcat

SEQ ID NO: 905695 - DNA, 22 bp, Artificial Sequence
  chemically synthesized
aagtaaaatgatagaatgaatt

SEQ ID NO: 905696 - DNA, 22 bp, Artificial Sequence
  chemically synthesized
ttaaaataattcattctatcat

SEQ ID NO: 905697 - DNA, 22 bp, Artificial Sequence
  chemically synthesized
taaaataattcattctatcatt

SEQ ID NO: 905698 - DNA, 22 bp, Artificial Sequence
  chemically synthesized
aaaataattcattctatcattt

SEQ ID NO: 905699 - DNA, 22 bp, Artificial Sequence
  chemically synthesized
aaataattcattctatcatttt

SEQ ID NO: 905700 - DNA, 22 bp, Artificial Sequence
  chemically synthesized
tgatattcaagtaaaatgatag

SEQ ID NO: 905701 - DNA, 22 bp, Artificial Sequence
  chemically synthesized
atgatattcaagtaaaatgata

SEQ ID NO: 905702 - DNA, 22 bp, Artificial Sequence
  chemically synthesized
tatgatattcaagtaaaatgat

SEQ ID NO: 905703 - DNA, 22 bp, Artificial Sequence
  chemically synthesized
ttatgatattcaagtaaaatga

SEQ ID NO: 905704 - DNA, 22 bp, Artificial Sequence
  chemically synthesized
attctatcattttacttgaata

SEQ ID NO: 905705 - DNA, 22 bp, Artificial Sequence
  chemically synthesized
tatcattttacttgaatatcat

SEQ ID NO: 905706 - DNA, 22 bp, Artificial Sequence
  chemically synthesized
tcattttacttgaatatcataa

SEQ ID NO: 905707 - DNA, 22 bp, Artificial Sequence
  chemically synthesized
accgagagatttttatgatatt

SEQ ID NO: 905708 - DNA, 22 bp, Artificial Sequence
  chemically synthesized
tacttgaatatcataaaaatct

SEQ ID NO: 905709 - DNA, 22 bp, Artificial Sequence
  chemically synthesized
acactaaccgagagatttttat

SEQ ID NO: 905710 - DNA, 22 bp, Artificial Sequence
  chemically synthesized
acttgaatatcataaaaatctc

SEQ ID NO: 905711 - DNA, 22 bp, Artificial Sequence
  chemically synthesized
cttgaatatcataaaaatctct

SEQ ID NO: 905712 - DNA, 22 bp, Artificial Sequence
  chemically synthesized
ttaacactaaccgagagatttt

SEQ ID NO: 905713 - DNA, 22 bp, Artificial Sequence
  chemically synthesized
gttaacactaaccgagagattt

SEQ ID NO: 905714 - DNA, 22 bp, Artificial Sequence
  chemically synthesized
gaatatcataaaaatctctcgg

SEQ ID NO: 905715 - DNA, 22 bp, Artificial Sequence
  chemically synthesized
aatatcataaaaatctctcggt

SEQ ID NO: 905716 - DNA, 22 bp, Artificial Sequence
  chemically synthesized
tttgttaacactaaccgagaga

SEQ ID NO: 905717 - DNA, 22 bp, Artificial Sequence
  chemically synthesized
ttatttgttaacactaaccgag

SEQ ID NO: 905718 - DNA, 22 bp, Artificial Sequence
  chemically synthesized
tcggttagtgttaacaaataat

SEQ ID NO: 905719 - DNA, 22 bp, Artificial Sequence
  chemically synthesized
ggttagtgttaacaaataatag

SEQ ID NO: 905720 - DNA, 22 bp, Artificial Sequence
  chemically synthesized
gaaaaacgaaagaaaactatta

SEQ ID NO: 905721 - DNA, 22 bp, Artificial Sequence
  chemically synthesized
gtgttaacaaataatagttttc

SEQ ID NO: 905722 - DNA, 22 bp, Artificial Sequence
  chemically synthesized
acaaataatagttttctttcgt

SEQ ID NO: 905723 - DNA, 22 bp, Artificial Sequence
  chemically synthesized
ggtgttagaaaaacgaaagaaa

SEQ ID NO: 905724 - DNA, 22 bp, Artificial Sequence
  chemically synthesized
aggtgttagaaaaacgaaagaa

SEQ ID NO: 905725 - DNA, 22 bp, Artificial Sequence
  chemically synthesized
taggtgttagaaaaacgaaaga

SEQ ID NO: 905726 - DNA, 22 bp, Artificial Sequence
  chemically synthesized
tctttcgtttttctaacaccta

SEQ ID NO: 905727 - DNA, 22 bp, Artificial Sequence
  chemically synthesized
ctttcgtttttctaacacctaa

SEQ ID NO: 905728 - DNA, 22 bp, Artificial Sequence
  chemically synthesized
tgaaatatggttttaggtgtta

SEQ ID NO: 905729 - DNA, 22 bp, Artificial Sequence
  chemically synthesized
tttcgtttttctaacacctaaa

SEQ ID NO: 905730 - DNA, 22 bp, Artificial Sequence
  chemically synthesized
tcgtttttctaacacctaaaac

SEQ ID NO: 905731 - DNA, 22 bp, Artificial Sequence
  chemically synthesized
cgtttttctaacacctaaaacc

SEQ ID NO: 905732 - DNA, 22 bp, Artificial Sequence
  chemically synthesized
gtttttctaacacctaaaacca

SEQ ID NO: 905733 - DNA, 22 bp, Artificial Sequence
  chemically synthesized
tgggattatgaaatatggtttt

SEQ ID NO: 905734 - DNA, 22 bp, Artificial Sequence
  chemically synthesized
ttctaacacctaaaaccatatt

SEQ ID NO: 905735 - DNA, 22 bp, Artificial Sequence
  chemically synthesized
tctaacacctaaaaccatattt

SEQ ID NO: 905736 - DNA, 22 bp, Artificial Sequence
  chemically synthesized
ctaacacctaaaaccatatttc

SEQ ID NO: 905737 - DNA, 22 bp, Artificial Sequence
  chemically synthesized
taacacctaaaaccatatttca

SEQ ID NO: 905738 - DNA, 22 bp, Artificial Sequence
  chemically synthesized
acacctaaaaccatatttcata

SEQ ID NO: 905739 - DNA, 22 bp, Artificial Sequence
  chemically synthesized
acattatgggattatgaaatat

SEQ ID NO: 905740 - DNA, 22 bp, Artificial Sequence
  chemically synthesized
cacattatgggattatgaaata

SEQ ID NO: 905741 - DNA, 22 bp, Artificial Sequence
  chemically synthesized
tttcacattatgggattatgaa

SEQ ID NO: 905742 - DNA, 22 bp, Artificial Sequence
  chemically synthesized
aaaccatatttcataatcccat

SEQ ID NO: 905743 - DNA, 22 bp, Artificial Sequence
  chemically synthesized
acactatttcacattatgggat

SEQ ID NO: 905744 - DNA, 22 bp, Artificial Sequence
  chemically synthesized
ttcacactatttcacattatgg

SEQ ID NO: 905745 - DNA, 22 bp, Artificial Sequence
  chemically synthesized
cataatcccataatgtgaaata

SEQ ID NO: 905746 - DNA, 22 bp, Artificial Sequence
  chemically synthesized
ataatcccataatgtgaaatag

SEQ ID NO: 905747 - DNA, 22 bp, Artificial Sequence
  chemically synthesized
catattattcacactatttcac

SEQ ID NO: 905748 - DNA, 22 bp, Artificial Sequence
  chemically synthesized
ttacatattattcacactattt

SEQ ID NO: 905749 - DNA, 22 bp, Artificial Sequence
  chemically synthesized
aactgttacatattattcacac

SEQ ID NO: 905750 - DNA, 22 bp, Artificial Sequence
  chemically synthesized
gaactgttacatattattcaca

SEQ ID NO: 905751 - DNA, 22 bp, Artificial Sequence
  chemically synthesized
gaacataatgtttgaactgtta

SEQ ID NO: 905752 - DNA, 22 bp, Artificial Sequence
  chemically synthesized
tggaacataatgtttgaactgt

SEQ ID NO: 905753 - DNA, 22 bp, Artificial Sequence
  chemically synthesized
ctggaacataatgtttgaactg

SEQ ID NO: 905754 - DNA, 22 bp, Artificial Sequence
  chemically synthesized
ttctggaacataatgtttgaac

SEQ ID NO: 905755 - DNA, 22 bp, Artificial Sequence
  chemically synthesized
tcttctggaacataatgtttga

SEQ ID NO: 905756 - DNA, 22 bp, Artificial Sequence
  chemically synthesized
tctcttctggaacataatgttt

SEQ ID NO: 905757 - DNA, 22 bp, Artificial Sequence
  chemically synthesized
aaacattatgttccagaagaga

SEQ ID NO: 905758 - DNA, 22 bp, Artificial Sequence
  chemically synthesized
tgttccagaagagagagatttt

SEQ ID NO: 905759 - DNA, 22 bp, Artificial Sequence
  chemically synthesized
cagaagagagagatttttattt

SEQ ID NO: 905760 - DNA, 22 bp, Artificial Sequence
  chemically synthesized
aaaaaatagaaagaaaaaataa

SEQ ID NO: 905761 - DNA, 22 bp, Artificial Sequence
  chemically synthesized
gagttcaaaaaatagaaagaaa

SEQ ID NO: 905762 - DNA, 22 bp, Artificial Sequence
  chemically synthesized
tggagttcaaaaaatagaaaga

SEQ ID NO: 905763 - DNA, 22 bp, Artificial Sequence
  chemically synthesized
tctggagttcaaaaaatagaaa

SEQ ID NO: 905764 - DNA, 22 bp, Artificial Sequence
  chemically synthesized
ttattttttctttctatttttt

SEQ ID NO: 905765 - DNA, 22 bp, Artificial Sequence
  chemically synthesized
tctctggagttcaaaaaataga

SEQ ID NO: 905766 - DNA, 22 bp, Artificial Sequence
  chemically synthesized
tattttttctttctattttttg

SEQ ID NO: 905767 - DNA, 22 bp, Artificial Sequence
  chemically synthesized
attttttctttctattttttga

SEQ ID NO: 905768 - DNA, 22 bp, Artificial Sequence
  chemically synthesized
ttttttctttctattttttgaa

SEQ ID NO: 905769 - DNA, 22 bp, Artificial Sequence
  chemically synthesized
tttctttctattttttgaactc

SEQ ID NO: 905770 - DNA, 22 bp, Artificial Sequence
  chemically synthesized
ttctttctattttttgaactcc

SEQ ID NO: 905771 - DNA, 22 bp, Artificial Sequence
  chemically synthesized
tctttctattttttgaactcca

SEQ ID NO: 905772 - DNA, 22 bp, Artificial Sequence
  chemically synthesized
aaaatctctctctggagttcaa

SEQ ID NO: 905773 - DNA, 22 bp, Artificial Sequence
  chemically synthesized
ctttctattttttgaactccag

SEQ ID NO: 905774 - DNA, 22 bp, Artificial Sequence
  chemically synthesized
aaaaatctctctctggagttca

SEQ ID NO: 905775 - DNA, 22 bp, Artificial Sequence
  chemically synthesized
tttctattttttgaactccaga

SEQ ID NO: 905776 - DNA, 22 bp, Artificial Sequence
  chemically synthesized
tctattttttgaactccagaga

SEQ ID NO: 905777 - DNA, 22 bp, Artificial Sequence
  chemically synthesized
ctattttttgaactccagagag

SEQ ID NO: 905778 - DNA, 22 bp, Artificial Sequence
  chemically synthesized
tattttttgaactccagagaga

SEQ ID NO: 905779 - DNA, 22 bp, Artificial Sequence
  chemically synthesized
ttttttgaactccagagagaga

SEQ ID NO: 905780 - DNA, 22 bp, Artificial Sequence
  chemically synthesized
caaatttaaaaatctctctctg

SEQ ID NO: 905781 - DNA, 22 bp, Artificial Sequence
  chemically synthesized
tttgaactccagagagagattt

SEQ ID NO: 905782 - DNA, 22 bp, Artificial Sequence
  chemically synthesized
ttgaactccagagagagatttt

SEQ ID NO: 905783 - DNA, 22 bp, Artificial Sequence
  chemically synthesized
tgaactccagagagagattttt

SEQ ID NO: 905784 - DNA, 22 bp, Artificial Sequence
  chemically synthesized
gaactccagagagagattttta

SEQ ID NO: 905785 - DNA, 22 bp, Artificial Sequence
  chemically synthesized
aaactgcaaatttaaaaatctc

SEQ ID NO: 905786 - DNA, 22 bp, Artificial Sequence
  chemically synthesized
aactccagagagagatttttaa

SEQ ID NO: 905787 - DNA, 22 bp, Artificial Sequence
  chemically synthesized
atctcaaactgcaaatttaaaa

SEQ ID NO: 905788 - DNA, 22 bp, Artificial Sequence
  chemically synthesized
cagagagagatttttaaatttg

SEQ ID NO: 905789 - DNA, 22 bp, Artificial Sequence
  chemically synthesized
taatctcaaactgcaaatttaa

SEQ ID NO: 905790 - DNA, 22 bp, Artificial Sequence
  chemically synthesized
gaaagctctaatctcaaactgc

SEQ ID NO: 905791 - DNA, 22 bp, Artificial Sequence
  chemically synthesized
ttggaaagctctaatctcaaac

SEQ ID NO: 905792 - DNA, 22 bp, Artificial Sequence
  chemically synthesized
ttaaatttgcagtttgagatta

SEQ ID NO: 905793 - DNA, 22 bp, Artificial Sequence
  chemically synthesized
taaatttgcagtttgagattag

SEQ ID NO: 905794 - DNA, 22 bp, Artificial Sequence
  chemically synthesized
aaatttgcagtttgagattaga

SEQ ID NO: 905795 - DNA, 22 bp, Artificial Sequence
  chemically synthesized
aatttgcagtttgagattagag

SEQ ID NO: 905796 - DNA, 22 bp, Artificial Sequence
  chemically synthesized
agctgttggaaagctctaatct

SEQ ID NO: 905797 - DNA, 22 bp, Artificial Sequence
  chemically synthesized
cagctgttggaaagctctaatc

SEQ ID NO: 905798 - DNA, 22 bp, Artificial Sequence
  chemically synthesized
gcagtttgagattagagctttc

SEQ ID NO: 905799 - DNA, 22 bp, Artificial Sequence
  chemically synthesized
cagtttgagattagagctttcc

SEQ ID NO: 905800 - DNA, 22 bp, Artificial Sequence
  chemically synthesized
gagattagagctttccaacagc

SEQ ID NO: 905801 - DNA, 22 bp, Artificial Sequence
  chemically synthesized
agattagagctttccaacagct

SEQ ID NO: 905802 - DNA, 22 bp, Artificial Sequence
  chemically synthesized
aaaatagtaaacacttcagctg

SEQ ID NO: 905803 - DNA, 22 bp, Artificial Sequence
  chemically synthesized
gagctttccaacagctgaagtg

SEQ ID NO: 905804 - DNA, 22 bp, Artificial Sequence
  chemically synthesized
tcaaaatagtaaacacttcagc

SEQ ID NO: 905805 - DNA, 22 bp, Artificial Sequence
  chemically synthesized
tctcaaaatagtaaacacttca

SEQ ID NO: 905806 - DNA, 22 bp, Artificial Sequence
  chemically synthesized
ctctcaaaatagtaaacacttc

SEQ ID NO: 905807 - DNA, 22 bp, Artificial Sequence
  chemically synthesized
tccaacagctgaagtgtttact

SEQ ID NO: 905808 - DNA, 22 bp, Artificial Sequence
  chemically synthesized
ccaacagctgaagtgtttacta

SEQ ID NO: 905809 - DNA, 22 bp, Artificial Sequence
  chemically synthesized
caacagctgaagtgtttactat

SEQ ID NO: 905810 - DNA, 22 bp, Artificial Sequence
  chemically synthesized
gcaagtcttctctcaaaatagt

SEQ ID NO: 905811 - DNA, 22 bp, Artificial Sequence
  chemically synthesized
cgcaagtcttctctcaaaatag

SEQ ID NO: 905812 - DNA, 22 bp, Artificial Sequence
  chemically synthesized
tcgcaagtcttctctcaaaata

SEQ ID NO: 905813 - DNA, 22 bp, Artificial Sequence
  chemically synthesized
aagtgtttactattttgagaga

SEQ ID NO: 905814 - DNA, 22 bp, Artificial Sequence
  chemically synthesized
ctttcgcaagtcttctctcaaa

SEQ ID NO: 905815 - DNA, 22 bp, Artificial Sequence
  chemically synthesized
gctttcgcaagtcttctctcaa

SEQ ID NO: 905816 - DNA, 22 bp, Artificial Sequence
  chemically synthesized
tgctttcgcaagtcttctctca

SEQ ID NO: 905817 - DNA, 22 bp, Artificial Sequence
  chemically synthesized
actattttgagagaagacttgc

SEQ ID NO: 905818 - DNA, 22 bp, Artificial Sequence
  chemically synthesized
acctttgctttcgcaagtcttc

SEQ ID NO: 905819 - DNA, 22 bp, Artificial Sequence
  chemically synthesized
ctattttgagagaagacttgcg

SEQ ID NO: 905820 - DNA, 22 bp, Artificial Sequence
  chemically synthesized
ttttgagagaagacttgcgaaa

SEQ ID NO: 905821 - DNA, 22 bp, Artificial Sequence
  chemically synthesized
ggttaacctttgctttcgcaag

SEQ ID NO: 905822 - DNA, 22 bp, Artificial Sequence
  chemically synthesized
tgagagaagacttgcgaaagca

SEQ ID NO: 905823 - DNA, 22 bp, Artificial Sequence
  chemically synthesized
gagagaagacttgcgaaagcaa

SEQ ID NO: 905824 - DNA, 22 bp, Artificial Sequence
  chemically synthesized
ctaggttaacctttgctttcgc

SEQ ID NO: 905825 - DNA, 22 bp, Artificial Sequence
  chemically synthesized
agagaagacttgcgaaagcaaa

SEQ ID NO: 905826 - DNA, 22 bp, Artificial Sequence
  chemically synthesized
gcgaaagcaaaggttaacctag

SEQ ID NO: 905827 - DNA, 22 bp, Artificial Sequence
  chemically synthesized
cgaaagcaaaggttaacctagt

SEQ ID NO: 905828 - DNA, 22 bp, Artificial Sequence
  chemically synthesized
ccaacgaaggcacagcaggtac

SEQ ID NO: 905829 - DNA, 22 bp, Artificial Sequence
  chemically synthesized
gccaacgaaggcacagcaggta

SEQ ID NO: 905830 - DNA, 22 bp, Artificial Sequence
  chemically synthesized
acctagtagtacctgctgtgcc

SEQ ID NO: 905831 - DNA, 22 bp, Artificial Sequence
  chemically synthesized
atttgccaacgaaggcacagca

SEQ ID NO: 905832 - DNA, 22 bp, Artificial Sequence
  chemically synthesized
catttgccaacgaaggcacagc

SEQ ID NO: 905833 - DNA, 22 bp, Artificial Sequence
  chemically synthesized
gtagtacctgctgtgccttcgt

SEQ ID NO: 905834 - DNA, 22 bp, Artificial Sequence
  chemically synthesized
cttcatttgccaacgaaggcac

SEQ ID NO: 905835 - DNA, 22 bp, Artificial Sequence
  chemically synthesized
ccttcatttgccaacgaaggca

SEQ ID NO: 905836 - DNA, 22 bp, Artificial Sequence
  chemically synthesized
tccttcatttgccaacgaaggc

SEQ ID NO: 905837 - DNA, 22 bp, Artificial Sequence
  chemically synthesized
ctgtgccttcgttggcaaatga

SEQ ID NO: 905838 - DNA, 22 bp, Artificial Sequence
  chemically synthesized
tgtgattttccttcatttgcca

SEQ ID NO: 905839 - DNA, 22 bp, Artificial Sequence
  chemically synthesized
tgccttcgttggcaaatgaagg

SEQ ID NO: 905840 - DNA, 22 bp, Artificial Sequence
  chemically synthesized
cgttggcaaatgaaggaaaatc

SEQ ID NO: 905841 - DNA, 22 bp, Artificial Sequence
  chemically synthesized
gttggcaaatgaaggaaaatca

SEQ ID NO: 905842 - DNA, 22 bp, Artificial Sequence
  chemically synthesized
gcaaatgaaggaaaatcacaca

SEQ ID NO: 905843 - DNA, 22 bp, Artificial Sequence
  chemically synthesized
ccaggcaaatgccaccatctgt

SEQ ID NO: 905844 - DNA, 22 bp, Artificial Sequence
  chemically synthesized
gcacccaactcccaggcaaatg

SEQ ID NO: 905845 - DNA, 22 bp, Artificial Sequence
  chemically synthesized
agaggacacccctggcacccaa

SEQ ID NO: 905846 - DNA, 22 bp, Artificial Sequence
  chemically synthesized
gagaggacacccctggcaccca

SEQ ID NO: 905847 - DNA, 22 bp, Artificial Sequence
  chemically synthesized
tgagaggacacccctggcaccc

SEQ ID NO: 905848 - DNA, 22 bp, Artificial Sequence
  chemically synthesized
gcctgggagttgggtgccaggg

SEQ ID NO: 905849 - DNA, 22 bp, Artificial Sequence
  chemically synthesized
cctgggagttgggtgccagggg

SEQ ID NO: 905850 - DNA, 22 bp, Artificial Sequence
  chemically synthesized
ggagttgggtgccaggggtgtc

SEQ ID NO: 905851 - DNA, 22 bp, Artificial Sequence
  chemically synthesized
tgtgcctttgagaggacacccc

SEQ ID NO: 905852 - DNA, 22 bp, Artificial Sequence
  chemically synthesized
gtgtgcctttgagaggacaccc

SEQ ID NO: 905853 - DNA, 22 bp, Artificial Sequence
  chemically synthesized
tgtgtgcctttgagaggacacc

SEQ ID NO: 905854 - DNA, 22 bp, Artificial Sequence
  chemically synthesized
ttgtgtgcctttgagaggacac

SEQ ID NO: 905855 - DNA, 22 bp, Artificial Sequence
  chemically synthesized
tttgtgtgcctttgagaggaca

SEQ ID NO: 905856 - DNA, 22 bp, Artificial Sequence
  chemically synthesized
ggtgccaggggtgtcctctcaa

SEQ ID NO: 905857 - DNA, 22 bp, Artificial Sequence
  chemically synthesized
tctttttgtgtgcctttgagag

SEQ ID NO: 905858 - DNA, 22 bp, Artificial Sequence
  chemically synthesized
tatctttttgtgtgcctttgag

SEQ ID NO: 905859 - DNA, 22 bp, Artificial Sequence
  chemically synthesized
attctatctttttgtgtgcctt

SEQ ID NO: 905860 - DNA, 22 bp, Artificial Sequence
  chemically synthesized
cattctatctttttgtgtgcct

SEQ ID NO: 905861 - DNA, 22 bp, Artificial Sequence
  chemically synthesized
tcaaaggcacacaaaaagatag

SEQ ID NO: 905862 - DNA, 22 bp, Artificial Sequence
  chemically synthesized
aaaggcacacaaaaagatagaa

SEQ ID NO: 905863 - DNA, 22 bp, Artificial Sequence
  chemically synthesized
agaaaagagagacatttcattc

SEQ ID NO: 905864 - DNA, 22 bp, Artificial Sequence
  chemically synthesized
aagaaaagagagacatttcatt

SEQ ID NO: 905865 - DNA, 22 bp, Artificial Sequence
  chemically synthesized
caacaaatccacatccacatat

SEQ ID NO: 905866 - DNA, 22 bp, Artificial Sequence
  chemically synthesized
tcttttcttaaatatgtggatg

SEQ ID NO: 905867 - DNA, 22 bp, Artificial Sequence
  chemically synthesized
ccaacaaatccacatccacata

SEQ ID NO: 905868 - DNA, 22 bp, Artificial Sequence
  chemically synthesized
tccaacaaatccacatccacat

SEQ ID NO: 905869 - DNA, 22 bp, Artificial Sequence
  chemically synthesized
ttttcttaaatatgtggatgtg

SEQ ID NO: 905870 - DNA, 22 bp, Artificial Sequence
  chemically synthesized
ttccaacaaatccacatccaca

SEQ ID NO: 905871 - DNA, 22 bp, Artificial Sequence
  chemically synthesized
tttccaacaaatccacatccac

SEQ ID NO: 905872 - DNA, 22 bp, Artificial Sequence
  chemically synthesized
ttcttaaatatgtggatgtgga

SEQ ID NO: 905873 - DNA, 22 bp, Artificial Sequence
  chemically synthesized
tcttaaatatgtggatgtggat

SEQ ID NO: 905874 - DNA, 22 bp, Artificial Sequence
  chemically synthesized
cttaaatatgtggatgtggatt

SEQ ID NO: 905875 - DNA, 22 bp, Artificial Sequence
  chemically synthesized
ttaaatatgtggatgtggattt

SEQ ID NO: 905876 - DNA, 22 bp, Artificial Sequence
  chemically synthesized
aaatatgtggatgtggatttgt

SEQ ID NO: 905877 - DNA, 22 bp, Artificial Sequence
  chemically synthesized
aatatgtggatgtggatttgtt

SEQ ID NO: 905878 - DNA, 22 bp, Artificial Sequence
  chemically synthesized
aagtgtgggtaaagtaattttt

SEQ ID NO: 905879 - DNA, 22 bp, Artificial Sequence
  chemically synthesized
caagtgtgggtaaagtaatttt

SEQ ID NO: 905880 - DNA, 22 bp, Artificial Sequence
  chemically synthesized
tcaagtgtgggtaaagtaattt

SEQ ID NO: 905881 - DNA, 22 bp, Artificial Sequence
  chemically synthesized
ttcaagtgtgggtaaagtaatt

SEQ ID NO: 905882 - DNA, 22 bp, Artificial Sequence
  chemically synthesized
gttggaaaaaattactttaccc

SEQ ID NO: 905883 - DNA, 22 bp, Artificial Sequence
  chemically synthesized
ttggaaaaaattactttaccca

SEQ ID NO: 905884 - DNA, 22 bp, Artificial Sequence
  chemically synthesized
gaaaaaattactttacccacac

SEQ ID NO: 905885 - DNA, 22 bp, Artificial Sequence
  chemically synthesized
ctttacccacacttgaaaagtc

SEQ ID NO: 905886 - DNA, 22 bp, Artificial Sequence
  chemically synthesized
tacccacacttgaaaagtcatc

SEQ ID NO: 905887 - DNA, 22 bp, Artificial Sequence
  chemically synthesized
acccacacttgaaaagtcatca

SEQ ID NO: 905888 - DNA, 22 bp, Artificial Sequence
  chemically synthesized
cccacacttgaaaagtcatcac

SEQ ID NO: 905889 - DNA, 22 bp, Artificial Sequence
  chemically synthesized
tggtggtggtgacagtggtgat

SEQ ID NO: 905890 - DNA, 22 bp, Artificial Sequence
  chemically synthesized
gaaaagtcatcaccactgtcac

SEQ ID NO: 905891 - DNA, 22 bp, Artificial Sequence
  chemically synthesized
attgtggtggtggtgacagtgg

SEQ ID NO: 905892 - DNA, 22 bp, Artificial Sequence
  chemically synthesized
aaaagtcatcaccactgtcacc

SEQ ID NO: 905893 - DNA, 22 bp, Artificial Sequence
  chemically synthesized
attgattgtggtggtggtgaca

SEQ ID NO: 905894 - DNA, 22 bp, Artificial Sequence
  chemically synthesized
aattgattgattgtggtggtgg

SEQ ID NO: 905895 - DNA, 22 bp, Artificial Sequence
  chemically synthesized
ttaaattgattgattgtggtgg

SEQ ID NO: 905896 - DNA, 22 bp, Artificial Sequence
  chemically synthesized
actattaaattgattgattgtg

SEQ ID NO: 905897 - DNA, 22 bp, Artificial Sequence
  chemically synthesized
tcaccaccaccacaatcaatca

SEQ ID NO: 905898 - DNA, 22 bp, Artificial Sequence
  chemically synthesized
atacatgttcactattaaattg

SEQ ID NO: 905899 - DNA, 22 bp, Artificial Sequence
  chemically synthesized
aaggattaatacatgttcacta

SEQ ID NO: 905900 - DNA, 22 bp, Artificial Sequence
  chemically synthesized
aatagtgaacatgtattaatcc

SEQ ID NO: 905901 - DNA, 22 bp, Artificial Sequence
  chemically synthesized
atagtgaacatgtattaatcct

SEQ ID NO: 905902 - DNA, 22 bp, Artificial Sequence
  chemically synthesized
gcaagggagaatgtggtacata

SEQ ID NO: 905903 - DNA, 22 bp, Artificial Sequence
  chemically synthesized
atcctttagtatgtaccacatt

SEQ ID NO: 905904 - DNA, 22 bp, Artificial Sequence
  chemically synthesized
cctggcaagggagaatgtggta

SEQ ID NO: 905905 - DNA, 22 bp, Artificial Sequence
  chemically synthesized
gcctggcaagggagaatgtggt

SEQ ID NO: 905906 - DNA, 22 bp, Artificial Sequence
  chemically synthesized
cttgcctggcaagggagaatgt

SEQ ID NO: 905907 - DNA, 22 bp, Artificial Sequence
  chemically synthesized
tagtatgtaccacattctccct

SEQ ID NO: 905908 - DNA, 22 bp, Artificial Sequence
  chemically synthesized
gcttgcctggcaagggagaatg

SEQ ID NO: 905909 - DNA, 22 bp, Artificial Sequence
  chemically synthesized
agtatgtaccacattctccctt

SEQ ID NO: 905910 - DNA, 22 bp, Artificial Sequence
  chemically synthesized
gtatgtaccacattctcccttg

SEQ ID NO: 905911 - DNA, 22 bp, Artificial Sequence
  chemically synthesized
cttgcttgcctggcaagggaga

SEQ ID NO: 905912 - DNA, 22 bp, Artificial Sequence
  chemically synthesized
aattccttgcttgcctggcaag

SEQ ID NO: 905913 - DNA, 22 bp, Artificial Sequence
  chemically synthesized
tcccttgccaggcaagcaagga

SEQ ID NO: 905914 - DNA, 22 bp, Artificial Sequence
  chemically synthesized
ccttgccaggcaagcaaggaat

SEQ ID NO: 905915 - DNA, 22 bp, Artificial Sequence
  chemically synthesized
gaacaaagctgaattccttgct

SEQ ID NO: 905916 - DNA, 22 bp, Artificial Sequence
  chemically synthesized
gccaggcaagcaaggaattcag

SEQ ID NO: 905917 - DNA, 22 bp, Artificial Sequence
  chemically synthesized
ccaggcaagcaaggaattcagc

SEQ ID NO: 905918 - DNA, 22 bp, Artificial Sequence
  chemically synthesized
tgccaaacagcagtctagaaca

SEQ ID NO: 905919 - DNA, 22 bp, Artificial Sequence
  chemically synthesized
agactgtgccaaacagcagtct

SEQ ID NO: 905920 - DNA, 22 bp, Artificial Sequence
  chemically synthesized
agctttgttctagactgctgtt

SEQ ID NO: 905921 - DNA, 22 bp, Artificial Sequence
  chemically synthesized
tgttctagactgctgtttggca

SEQ ID NO: 905922 - DNA, 22 bp, Artificial Sequence
  chemically synthesized
gttctagactgctgtttggcac

SEQ ID NO: 905923 - DNA, 22 bp, Artificial Sequence
  chemically synthesized
ttctagactgctgtttggcaca

SEQ ID NO: 905924 - DNA, 22 bp, Artificial Sequence
  chemically synthesized
tagactgctgtttggcacagtc

SEQ ID NO: 905925 - DNA, 22 bp, Artificial Sequence
  chemically synthesized
gactgctgtttggcacagtctt

SEQ ID NO: 905926 - DNA, 22 bp, Artificial Sequence
  chemically synthesized
gaaggagaataacctaagactg

SEQ ID NO: 905927 - DNA, 22 bp, Artificial Sequence
  chemically synthesized
ctgtttggcacagtcttaggtt

SEQ ID NO: 905928 - DNA, 22 bp, Artificial Sequence
  chemically synthesized
ttagaaggagaataacctaaga

SEQ ID NO: 905929 - DNA, 22 bp, Artificial Sequence
  chemically synthesized
tttggcacagtcttaggttatt

SEQ ID NO: 905930 - DNA, 22 bp, Artificial Sequence
  chemically synthesized
ggcacagtcttaggttattctc

SEQ ID NO: 905931 - DNA, 22 bp, Artificial Sequence
  chemically synthesized
cactgttagaaggagaataacc

SEQ ID NO: 905932 - DNA, 22 bp, Artificial Sequence
  chemically synthesized
gcacagtcttaggttattctcc

SEQ ID NO: 905933 - DNA, 22 bp, Artificial Sequence
  chemically synthesized
gcactgttagaaggagaataac

SEQ ID NO: 905934 - DNA, 22 bp, Artificial Sequence
  chemically synthesized
tgcactgttagaaggagaataa

SEQ ID NO: 905935 - DNA, 22 bp, Artificial Sequence
  chemically synthesized
agtgctttgcactgttagaagg

SEQ ID NO: 905936 - DNA, 22 bp, Artificial Sequence
  chemically synthesized
aggttattctccttctaacagt

SEQ ID NO: 905937 - DNA, 22 bp, Artificial Sequence
  chemically synthesized
taagtgctttgcactgttagaa

SEQ ID NO: 905938 - DNA, 22 bp, Artificial Sequence
  chemically synthesized
ggttattctccttctaacagtg

SEQ ID NO: 905939 - DNA, 22 bp, Artificial Sequence
  chemically synthesized
tattctaagtgctttgcactgt

SEQ ID NO: 905940 - DNA, 22 bp, Artificial Sequence
  chemically synthesized
ttctccttctaacagtgcaaag

SEQ ID NO: 905941 - DNA, 22 bp, Artificial Sequence
  chemically synthesized
tccttctaacagtgcaaagcac

SEQ ID NO: 905942 - DNA, 22 bp, Artificial Sequence
  chemically synthesized
cttctaacagtgcaaagcactt

SEQ ID NO: 905943 - DNA, 22 bp, Artificial Sequence
  chemically synthesized
ctaacagtgcaaagcacttaga

SEQ ID NO: 905944 - DNA, 22 bp, Artificial Sequence
  chemically synthesized
taacagtgcaaagcacttagaa

SEQ ID NO: 905945 - DNA, 22 bp, Artificial Sequence
  chemically synthesized
tgtatcgactgtattctaagtg

SEQ ID NO: 905946 - DNA, 22 bp, Artificial Sequence
  chemically synthesized
acagtgcaaagcacttagaata

SEQ ID NO: 905947 - DNA, 22 bp, Artificial Sequence
  chemically synthesized
ctgtgtatcgactgtattctaa

SEQ ID NO: 905948 - DNA, 22 bp, Artificial Sequence
  chemically synthesized
actgtgtatcgactgtattcta

SEQ ID NO: 905949 - DNA, 22 bp, Artificial Sequence
  chemically synthesized
ataacttactgtgtatcgactg

SEQ ID NO: 905950 - DNA, 22 bp, Artificial Sequence
  chemically synthesized
ttaataacttactgtgtatcga

SEQ ID NO: 905951 - DNA, 22 bp, Artificial Sequence
  chemically synthesized
attaataacttactgtgtatcg

SEQ ID NO: 905952 - DNA, 22 bp, Artificial Sequence
  chemically synthesized
agaatacagtcgatacacagta

SEQ ID NO: 905953 - DNA, 22 bp, Artificial Sequence
  chemically synthesized
gaatacagtcgatacacagtaa

SEQ ID NO: 905954 - DNA, 22 bp, Artificial Sequence
  chemically synthesized
atatttattaataacttactgt

SEQ ID NO: 905955 - DNA, 22 bp, Artificial Sequence
  chemically synthesized
ggtaatgatagttaatatttat

SEQ ID NO: 905956 - DNA, 22 bp, Artificial Sequence
  chemically synthesized
ttaataaatattaactatcatt

SEQ ID NO: 905957 - DNA, 22 bp, Artificial Sequence
  chemically synthesized
agtgtgttaggtaatgatagtt

SEQ ID NO: 905958 - DNA, 22 bp, Artificial Sequence
  chemically synthesized
ataaatattaactatcattacc

SEQ ID NO: 905959 - DNA, 22 bp, Artificial Sequence
  chemically synthesized
ctcagtgtgttaggtaatgata

SEQ ID NO: 905960 - DNA, 22 bp, Artificial Sequence
  chemically synthesized
aagattcctcagtgtgttaggt

SEQ ID NO: 905961 - DNA, 22 bp, Artificial Sequence
  chemically synthesized
actatcattacctaacacactg

SEQ ID NO: 905962 - DNA, 22 bp, Artificial Sequence
  chemically synthesized
tcattacctaacacactgagga

SEQ ID NO: 905963 - DNA, 22 bp, Artificial Sequence
  chemically synthesized
ggagagttaaagattcctcagt

SEQ ID NO: 905964 - DNA, 22 bp, Artificial Sequence
  chemically synthesized
gggagagttaaagattcctcag

SEQ ID NO: 905965 - DNA, 22 bp, Artificial Sequence
  chemically synthesized
cctaacacactgaggaatcttt

SEQ ID NO: 905966 - DNA, 22 bp, Artificial Sequence
  chemically synthesized
cttgggagagttaaagattcct

SEQ ID NO: 905967 - DNA, 22 bp, Artificial Sequence
  chemically synthesized
acacactgaggaatctttaact

SEQ ID NO: 905968 - DNA, 22 bp, Artificial Sequence
  chemically synthesized
cccactccttgggagagttaaa

SEQ ID NO: 905969 - DNA, 22 bp, Artificial Sequence
  chemically synthesized
aggaatctttaactctcccaag

SEQ ID NO: 905970 - DNA, 22 bp, Artificial Sequence
  chemically synthesized
aagtcctccccactccttggga

SEQ ID NO: 905971 - DNA, 22 bp, Artificial Sequence
  chemically synthesized
gaagtcctccccactccttggg

SEQ ID NO: 905972 - DNA, 22 bp, Artificial Sequence
  chemically synthesized
tgaagtcctccccactccttgg

SEQ ID NO: 905973 - DNA, 22 bp, Artificial Sequence
  chemically synthesized
ttttgaagtcctccccactcct

SEQ ID NO: 905974 - DNA, 22 bp, Artificial Sequence
  chemically synthesized
taactctcccaaggagtgggga

SEQ ID NO: 905975 - DNA, 22 bp, Artificial Sequence
  chemically synthesized
aactctcccaaggagtggggag

SEQ ID NO: 905976 - DNA, 22 bp, Artificial Sequence
  chemically synthesized
actctcccaaggagtggggagg

SEQ ID NO: 905977 - DNA, 22 bp, Artificial Sequence
  chemically synthesized
ctgttttgaagtcctccccact

SEQ ID NO: 905978 - DNA, 22 bp, Artificial Sequence
  chemically synthesized
tcccaaggagtggggaggactt

SEQ ID NO: 905979 - DNA, 22 bp, Artificial Sequence
  chemically synthesized
attcctgttttgaagtcctccc

SEQ ID NO: 905980 - DNA, 22 bp, Artificial Sequence
  chemically synthesized
ccaaggagtggggaggacttca

SEQ ID NO: 905981 - DNA, 22 bp, Artificial Sequence
  chemically synthesized
actgattcctgttttgaagtcc

SEQ ID NO: 905982 - DNA, 22 bp, Artificial Sequence
  chemically synthesized
aactgattcctgttttgaagtc

SEQ ID NO: 905983 - DNA, 22 bp, Artificial Sequence
  chemically synthesized
caaaacaggaatcagttaaatt

SEQ ID NO: 905984 - DNA, 22 bp, Artificial Sequence
  chemically synthesized
aaaacaggaatcagttaaattt

SEQ ID NO: 905985 - DNA, 22 bp, Artificial Sequence
  chemically synthesized
gacggtccaaggagaaatttaa

SEQ ID NO: 905986 - DNA, 22 bp, Artificial Sequence
  chemically synthesized
cactagacggtccaaggagaaa

SEQ ID NO: 905987 - DNA, 22 bp, Artificial Sequence
  chemically synthesized
aatttctccttggaccgtctag

SEQ ID NO: 905988 - DNA, 22 bp, Artificial Sequence
  chemically synthesized
caccaagcctgcactagacggt

SEQ ID NO: 905989 - DNA, 22 bp, Artificial Sequence
  chemically synthesized
ctccttggaccgtctagtgcag

SEQ ID NO: 905990 - DNA, 22 bp, Artificial Sequence
  chemically synthesized
tccttggaccgtctagtgcagg

SEQ ID NO: 905991 - DNA, 22 bp, Artificial Sequence
  chemically synthesized
tatctacaccaagcctgcacta

SEQ ID NO: 905992 - DNA, 22 bp, Artificial Sequence
  chemically synthesized
cttggaccgtctagtgcaggct

SEQ ID NO: 905993 - DNA, 22 bp, Artificial Sequence
  chemically synthesized
atatctacaccaagcctgcact

SEQ ID NO: 905994 - DNA, 22 bp, Artificial Sequence
  chemically synthesized
tatatctacaccaagcctgcac

SEQ ID NO: 905995 - DNA, 22 bp, Artificial Sequence
  chemically synthesized
ttatatctacaccaagcctgca

SEQ ID NO: 905996 - DNA, 22 bp, Artificial Sequence
  chemically synthesized
ggaccgtctagtgcaggcttgg

SEQ ID NO: 905997 - DNA, 22 bp, Artificial Sequence
  chemically synthesized
tttatatctacaccaagcctgc

SEQ ID NO: 905998 - DNA, 22 bp, Artificial Sequence
  chemically synthesized
gaccgtctagtgcaggcttggt

SEQ ID NO: 905999 - DNA, 22 bp, Artificial Sequence
  chemically synthesized
tttttatatctacaccaagcct

SEQ ID NO: 906000 - DNA, 22 bp, Artificial Sequence
  chemically synthesized
ctttttatatctacaccaagcc

SEQ ID NO: 906001 - DNA, 22 bp, Artificial Sequence
  chemically synthesized
tttctttttatatctacaccaa

SEQ ID NO: 906002 - DNA, 22 bp, Artificial Sequence
  chemically synthesized
atttctttttatatctacacca

SEQ ID NO: 906003 - DNA, 22 bp, Artificial Sequence
  chemically synthesized
tatttctttttatatctacacc

SEQ ID NO: 906004 - DNA, 22 bp, Artificial Sequence
  chemically synthesized
gtgcaggcttggtgtagatata

SEQ ID NO: 906005 - DNA, 22 bp, Artificial Sequence
  chemically synthesized
taccaatattttatttcttttt

SEQ ID NO: 906006 - DNA, 22 bp, Artificial Sequence
  chemically synthesized
ggtgtagatataaaaagaaata

SEQ ID NO: 906007 - DNA, 22 bp, Artificial Sequence
  chemically synthesized
gtaccaatattttatttctttt

SEQ ID NO: 906008 - DNA, 22 bp, Artificial Sequence
  chemically synthesized
gtgtagatataaaaagaaataa

SEQ ID NO: 906009 - DNA, 22 bp, Artificial Sequence
  chemically synthesized
gtttgtaccaatattttatttc

SEQ ID NO: 906010 - DNA, 22 bp, Artificial Sequence
  chemically synthesized
agtttgtaccaatattttattt

SEQ ID NO: 906011 - DNA, 22 bp, Artificial Sequence
  chemically synthesized
agatgtgtcaggcatttagttt

SEQ ID NO: 906012 - DNA, 22 bp, Artificial Sequence
  chemically synthesized
cctcagatgtgtcaggcattta

SEQ ID NO: 906013 - DNA, 22 bp, Artificial Sequence
  chemically synthesized
tacctcagatgtgtcaggcatt

SEQ ID NO: 906014 - DNA, 22 bp, Artificial Sequence
  chemically synthesized
ctacctcagatgtgtcaggcat

SEQ ID NO: 906015 - DNA, 22 bp, Artificial Sequence
  chemically synthesized
gtacaaactaaatgcctgacac

SEQ ID NO: 906016 - DNA, 22 bp, Artificial Sequence
  chemically synthesized
gtttctacctcagatgtgtcag

SEQ ID NO: 906017 - DNA, 22 bp, Artificial Sequence
  chemically synthesized
gttagtttctacctcagatgtg

SEQ ID NO: 906018 - DNA, 22 bp, Artificial Sequence
  chemically synthesized
aatgcctgacacatctgaggta

SEQ ID NO: 906019 - DNA, 22 bp, Artificial Sequence
  chemically synthesized
caacgttcgttagtttctacct

SEQ ID NO: 906020 - DNA, 22 bp, Artificial Sequence
  chemically synthesized
acaacgttcgttagtttctacc

SEQ ID NO: 906021 - DNA, 22 bp, Artificial Sequence
  chemically synthesized
acacatctgaggtagaaactaa

SEQ ID NO: 906022 - DNA, 22 bp, Artificial Sequence
  chemically synthesized
acttacaacgttcgttagtttc

SEQ ID NO: 906023 - DNA, 22 bp, Artificial Sequence
  chemically synthesized
cacttacaacgttcgttagttt

SEQ ID NO: 906024 - DNA, 22 bp, Artificial Sequence
  chemically synthesized
aggtagaaactaacgaacgttg

SEQ ID NO: 906025 - DNA, 22 bp, Artificial Sequence
  chemically synthesized
agcccacagcagtatttcactt

SEQ ID NO: 906026 - DNA, 22 bp, Artificial Sequence
  chemically synthesized
acgaacgttgtaagtgaaatac

SEQ ID NO: 906027 - DNA, 22 bp, Artificial Sequence
  chemically synthesized
tcctcagcccacagcagtattt

SEQ ID NO: 906028 - DNA, 22 bp, Artificial Sequence
  chemically synthesized
ttatcctcagcccacagcagta

SEQ ID NO: 906029 - DNA, 22 bp, Artificial Sequence
  chemically synthesized
taagtgaaatactgctgtgggc

SEQ ID NO: 906030 - DNA, 22 bp, Artificial Sequence
  chemically synthesized
ctgttatcctcagcccacagca

SEQ ID NO: 906031 - DNA, 22 bp, Artificial Sequence
  chemically synthesized
gcctcctgttatcctcagccca

SEQ ID NO: 906032 - DNA, 22 bp, Artificial Sequence
  chemically synthesized
ggcctcctgttatcctcagccc

SEQ ID NO: 906033 - DNA, 22 bp, Artificial Sequence
  chemically synthesized
ctgtgggctgaggataacagga

SEQ ID NO: 906034 - DNA, 22 bp, Artificial Sequence
  chemically synthesized
tgggctgaggataacaggaggc

SEQ ID NO: 906035 - DNA, 22 bp, Artificial Sequence
  chemically synthesized
caaacaagatccatcttggcct

SEQ ID NO: 906036 - DNA, 22 bp, Artificial Sequence
  chemically synthesized
aggataacaggaggccaagatg

SEQ ID NO: 906037 - DNA, 22 bp, Artificial Sequence
  chemically synthesized
tcatctccaaacaagatccatc

SEQ ID NO: 906038 - DNA, 22 bp, Artificial Sequence
  chemically synthesized
gtcatctccaaacaagatccat

SEQ ID NO: 906039 - DNA, 22 bp, Artificial Sequence
  chemically synthesized
ccttgtcatctccaaacaagat

SEQ ID NO: 906040 - DNA, 22 bp, Artificial Sequence
  chemically synthesized
atcccatagagcctgccttgtc

SEQ ID NO: 906041 - DNA, 22 bp, Artificial Sequence
  chemically synthesized
gtttggagatgacaaggcaggc

SEQ ID NO: 906042 - DNA, 22 bp, Artificial Sequence
  chemically synthesized
taatcccatagagcctgccttg

SEQ ID NO: 906043 - DNA, 22 bp, Artificial Sequence
  chemically synthesized
tttggagatgacaaggcaggct

SEQ ID NO: 906044 - DNA, 22 bp, Artificial Sequence
  chemically synthesized
ctaatcccatagagcctgcctt

SEQ ID NO: 906045 - DNA, 22 bp, Artificial Sequence
  chemically synthesized
tctaatcccatagagcctgcct

SEQ ID NO: 906046 - DNA, 22 bp, Artificial Sequence
  chemically synthesized
ggagatgacaaggcaggctcta

SEQ ID NO: 906047 - DNA, 22 bp, Artificial Sequence
  chemically synthesized
gagatgacaaggcaggctctat

SEQ ID NO: 906048 - DNA, 22 bp, Artificial Sequence
  chemically synthesized
ctttctaatcccatagagcctg

SEQ ID NO: 906049 - DNA, 22 bp, Artificial Sequence
  chemically synthesized
tcctttctaatcccatagagcc

SEQ ID NO: 906050 - DNA, 22 bp, Artificial Sequence
  chemically synthesized
ctcctttctaatcccatagagc

SEQ ID NO: 906051 - DNA, 22 bp, Artificial Sequence
  chemically synthesized
acttctcctttctaatcccata

SEQ ID NO: 906052 - DNA, 22 bp, Artificial Sequence
  chemically synthesized
aatctgacttctcctttctaat

SEQ ID NO: 906053 - DNA, 22 bp, Artificial Sequence
  chemically synthesized
taaatctgacttctcctttcta

SEQ ID NO: 906054 - DNA, 22 bp, Artificial Sequence
  chemically synthesized
tatgggattagaaaggagaagt

SEQ ID NO: 906055 - DNA, 22 bp, Artificial Sequence
  chemically synthesized
tgggattagaaaggagaagtca

SEQ ID NO: 906056 - DNA, 22 bp, Artificial Sequence
  chemically synthesized
gaaaggagaagtcagatttaga

SEQ ID NO: 906057 - DNA, 22 bp, Artificial Sequence
  chemically synthesized
ataccaccaatctctaaatctg

SEQ ID NO: 906058 - DNA, 22 bp, Artificial Sequence
  chemically synthesized
aataccaccaatctctaaatct

SEQ ID NO: 906059 - DNA, 22 bp, Artificial Sequence
  chemically synthesized
ttaataccaccaatctctaaat

SEQ ID NO: 906060 - DNA, 22 bp, Artificial Sequence
  chemically synthesized
tcttaataccaccaatctctaa

SEQ ID NO: 906061 - DNA, 22 bp, Artificial Sequence
  chemically synthesized
tctcttaataccaccaatctct

SEQ ID NO: 906062 - DNA, 22 bp, Artificial Sequence
  chemically synthesized
ctctcttaataccaccaatctc

SEQ ID NO: 906063 - DNA, 22 bp, Artificial Sequence
  chemically synthesized
cttctctcttaataccaccaat

SEQ ID NO: 906064 - DNA, 22 bp, Artificial Sequence
  chemically synthesized
ccttctctcttaataccaccaa

SEQ ID NO: 906065 - DNA, 22 bp, Artificial Sequence
  chemically synthesized
tccttctctcttaataccacca

SEQ ID NO: 906066 - DNA, 22 bp, Artificial Sequence
  chemically synthesized
ttccttctctcttaataccacc

SEQ ID NO: 906067 - DNA, 22 bp, Artificial Sequence
  chemically synthesized
tttccttctctcttaataccac

SEQ ID NO: 906068 - DNA, 22 bp, Artificial Sequence
  chemically synthesized
ttttccttctctcttaatacca

SEQ ID NO: 906069 - DNA, 22 bp, Artificial Sequence
  chemically synthesized
agagattggtggtattaagaga

SEQ ID NO: 906070 - DNA, 22 bp, Artificial Sequence
  chemically synthesized
gagattggtggtattaagagag

SEQ ID NO: 906071 - DNA, 22 bp, Artificial Sequence
  chemically synthesized
ccttttttccttctctcttaat

SEQ ID NO: 906072 - DNA, 22 bp, Artificial Sequence
  chemically synthesized
gtggtattaagagagaaggaaa

SEQ ID NO: 906073 - DNA, 22 bp, Artificial Sequence
  chemically synthesized
gaaagtctaccttttttccttc

SEQ ID NO: 906074 - DNA, 22 bp, Artificial Sequence
  chemically synthesized
agaaagtctaccttttttcctt

SEQ ID NO: 906075 - DNA, 22 bp, Artificial Sequence
  chemically synthesized
agagagaaggaaaaaaggtaga

SEQ ID NO: 906076 - DNA, 22 bp, Artificial Sequence
  chemically synthesized
gtccacttagaaagtctacctt

SEQ ID NO: 906077 - DNA, 22 bp, Artificial Sequence
  chemically synthesized
cctggtccacttagaaagtcta

SEQ ID NO: 906078 - DNA, 22 bp, Artificial Sequence
  chemically synthesized
cctgcctggtccacttagaaag

SEQ ID NO: 906079 - DNA, 22 bp, Artificial Sequence
  chemically synthesized
attccctgcctggtccacttag

SEQ ID NO: 906080 - DNA, 22 bp, Artificial Sequence
  chemically synthesized
tgattccctgcctggtccactt

SEQ ID NO: 906081 - DNA, 22 bp, Artificial Sequence
  chemically synthesized
gcctctgattccctgcctggtc

SEQ ID NO: 906082 - DNA, 22 bp, Artificial Sequence
  chemically synthesized
ctcgcctctgattccctgcctg

SEQ ID NO: 906083 - DNA, 22 bp, Artificial Sequence
  chemically synthesized
tctaagtggaccaggcagggaa

SEQ ID NO: 906084 - DNA, 22 bp, Artificial Sequence
  chemically synthesized
cctcgcctctgattccctgcct

SEQ ID NO: 906085 - DNA, 22 bp, Artificial Sequence
  chemically synthesized
ctaagtggaccaggcagggaat

SEQ ID NO: 906086 - DNA, 22 bp, Artificial Sequence
  chemically synthesized
taagtggaccaggcagggaatc

SEQ ID NO: 906087 - DNA, 22 bp, Artificial Sequence
  chemically synthesized
ttcctcgcctctgattccctgc

SEQ ID NO: 906088 - DNA, 22 bp, Artificial Sequence
  chemically synthesized
cttcctcgcctctgattccctg

SEQ ID NO: 906089 - DNA, 22 bp, Artificial Sequence
  chemically synthesized
agtggaccaggcagggaatcag

SEQ ID NO: 906090 - DNA, 22 bp, Artificial Sequence
  chemically synthesized
tcttcctcgcctctgattccct

SEQ ID NO: 906091 - DNA, 22 bp, Artificial Sequence
  chemically synthesized
ttttcttcctcgcctctgattc

SEQ ID NO: 906092 - DNA, 22 bp, Artificial Sequence
  chemically synthesized
tgttttcttcctcgcctctgat

SEQ ID NO: 906093 - DNA, 22 bp, Artificial Sequence
  chemically synthesized
ttctgttttcttcctcgcctct

SEQ ID NO: 906094 - DNA, 22 bp, Artificial Sequence
  chemically synthesized
gttctgttttcttcctcgcctc

SEQ ID NO: 906095 - DNA, 22 bp, Artificial Sequence
  chemically synthesized
catttgttctgttttcttcctc

SEQ ID NO: 906096 - DNA, 22 bp, Artificial Sequence
  chemically synthesized
ccatttgttctgttttcttcct

SEQ ID NO: 906097 - DNA, 22 bp, Artificial Sequence
  chemically synthesized
tccatttgttctgttttcttcc

SEQ ID NO: 906098 - DNA, 22 bp, Artificial Sequence
  chemically synthesized
tttccatttgttctgttttctt

SEQ ID NO: 906099 - DNA, 22 bp, Artificial Sequence
  chemically synthesized
cccaatgttctttccatttgtt

SEQ ID NO: 906100 - DNA, 22 bp, Artificial Sequence
  chemically synthesized
ccatcaaaatgagactacccaa

SEQ ID NO: 906101 - DNA, 22 bp, Artificial Sequence
  chemically synthesized
aggctgccatcaaaatgagact

SEQ ID NO: 906102 - DNA, 22 bp, Artificial Sequence
  chemically synthesized
actcaggctgccatcaaaatga

SEQ ID NO: 906103 - DNA, 22 bp, Artificial Sequence
  chemically synthesized
cactcaggctgccatcaaaatg

SEQ ID NO: 906104 - DNA, 22 bp, Artificial Sequence
  chemically synthesized
tcactcaggctgccatcaaaat

SEQ ID NO: 906105 - DNA, 22 bp, Artificial Sequence
  chemically synthesized
ggtagtctcattttgatggcag

SEQ ID NO: 906106 - DNA, 22 bp, Artificial Sequence
  chemically synthesized
gtcattttcactcaggctgcca

SEQ ID NO: 906107 - DNA, 22 bp, Artificial Sequence
  chemically synthesized
attttgatggcagcctgagtga

SEQ ID NO: 906108 - DNA, 22 bp, Artificial Sequence
  chemically synthesized
ccactggtcattttcactcagg

SEQ ID NO: 906109 - DNA, 22 bp, Artificial Sequence
  chemically synthesized
tcccactggtcattttcactca

SEQ ID NO: 906110 - DNA, 22 bp, Artificial Sequence
  chemically synthesized
tgatggcagcctgagtgaaaat

SEQ ID NO: 906111 - DNA, 22 bp, Artificial Sequence
  chemically synthesized
ctcccactggtcattttcactc

SEQ ID NO: 906112 - DNA, 22 bp, Artificial Sequence
  chemically synthesized
gatggcagcctgagtgaaaatg

SEQ ID NO: 906113 - DNA, 22 bp, Artificial Sequence
  chemically synthesized
tctcccactggtcattttcact

SEQ ID NO: 906114 - DNA, 22 bp, Artificial Sequence
  chemically synthesized
atggcagcctgagtgaaaatga

SEQ ID NO: 906115 - DNA, 22 bp, Artificial Sequence
  chemically synthesized
atattttctcccactggtcatt

SEQ ID NO: 906116 - DNA, 22 bp, Artificial Sequence
  chemically synthesized
tgatattttctcccactggtca

SEQ ID NO: 906117 - DNA, 22 bp, Artificial Sequence
  chemically synthesized
ctgatattttctcccactggtc

SEQ ID NO: 906118 - DNA, 22 bp, Artificial Sequence
  chemically synthesized
agtgaaaatgaccagtgggaga

SEQ ID NO: 906119 - DNA, 22 bp, Artificial Sequence
  chemically synthesized
tagaaatcttctgatattttct

SEQ ID NO: 906120 - DNA, 22 bp, Artificial Sequence
  chemically synthesized
agctatagaaatcttctgatat

SEQ ID NO: 906121 - DNA, 22 bp, Artificial Sequence
  chemically synthesized
tgtcattcagctatagaaatct

SEQ ID NO: 906122 - DNA, 22 bp, Artificial Sequence
  chemically synthesized
caacccctgtgtcattcagcta

SEQ ID NO: 906123 - DNA, 22 bp, Artificial Sequence
  chemically synthesized
ccaacccctgtgtcattcagct

SEQ ID NO: 906124 - DNA, 22 bp, Artificial Sequence
  chemically synthesized
ggtttccaacccctgtgtcatt

SEQ ID NO: 906125 - DNA, 22 bp, Artificial Sequence
  chemically synthesized
ctatagctgaatgacacagggg

SEQ ID NO: 906126 - DNA, 22 bp, Artificial Sequence
  chemically synthesized
tatagctgaatgacacaggggt

SEQ ID NO: 906127 - DNA, 22 bp, Artificial Sequence
  chemically synthesized
tagctgaatgacacaggggttg

SEQ ID NO: 906128 - DNA, 22 bp, Artificial Sequence
  chemically synthesized
gccctgggtttccaacccctgt

SEQ ID NO: 906129 - DNA, 22 bp, Artificial Sequence
  chemically synthesized
agccctgggtttccaacccctg

SEQ ID NO: 906130 - DNA, 22 bp, Artificial Sequence
  chemically synthesized
tagccctgggtttccaacccct

SEQ ID NO: 906131 - DNA, 22 bp, Artificial Sequence
  chemically synthesized
ctttagccctgggtttccaacc

SEQ ID NO: 906132 - DNA, 22 bp, Artificial Sequence
  chemically synthesized
aatgacacaggggttggaaacc

SEQ ID NO: 906133 - DNA, 22 bp, Artificial Sequence
  chemically synthesized
tcctttagccctgggtttccaa

SEQ ID NO: 906134 - DNA, 22 bp, Artificial Sequence
  chemically synthesized
ctcctttagccctgggtttcca

SEQ ID NO: 906135 - DNA, 22 bp, Artificial Sequence
  chemically synthesized
ataaatttctcctttagccctg

SEQ ID NO: 906136 - DNA, 22 bp, Artificial Sequence
  chemically synthesized
gataaatttctcctttagccct

SEQ ID NO: 906137 - DNA, 22 bp, Artificial Sequence
  chemically synthesized
cttgataaatttctcctttagc

SEQ ID NO: 906138 - DNA, 22 bp, Artificial Sequence
  chemically synthesized
gaaacccagggctaaaggagaa

SEQ ID NO: 906139 - DNA, 22 bp, Artificial Sequence
  chemically synthesized
aaggagaaatttatcaaggaac

SEQ ID NO: 906140 - DNA, 22 bp, Artificial Sequence
  chemically synthesized
gtaagggaaacagttccttgat

SEQ ID NO: 906141 - DNA, 22 bp, Artificial Sequence
  chemically synthesized
agtaagggaaacagttccttga

SEQ ID NO: 906142 - DNA, 22 bp, Artificial Sequence
  chemically synthesized
tggatttagtaagggaaacagt

SEQ ID NO: 906143 - DNA, 22 bp, Artificial Sequence
  chemically synthesized
atcaaggaactgtttcccttac

SEQ ID NO: 906144 - DNA, 22 bp, Artificial Sequence
  chemically synthesized
tcaaggaactgtttcccttact

SEQ ID NO: 906145 - DNA, 22 bp, Artificial Sequence
  chemically synthesized
tgtgggcgatgctgtggattta

SEQ ID NO: 906146 - DNA, 22 bp, Artificial Sequence
  chemically synthesized
tttcccttactaaatccacagc

SEQ ID NO: 906147 - DNA, 22 bp, Artificial Sequence
  chemically synthesized
cccttactaaatccacagcatc

SEQ ID NO: 906148 - DNA, 22 bp, Artificial Sequence
  chemically synthesized
ccttactaaatccacagcatcg

SEQ ID NO: 906149 - DNA, 22 bp, Artificial Sequence
  chemically synthesized
tacctatgtgggcgatgctgtg

SEQ ID NO: 906150 - DNA, 22 bp, Artificial Sequence
  chemically synthesized
actaaatccacagcatcgccca

SEQ ID NO: 906151 - DNA, 22 bp, Artificial Sequence
  chemically synthesized
ctaaatccacagcatcgcccac

SEQ ID NO: 906152 - DNA, 22 bp, Artificial Sequence
  chemically synthesized
aatccacagcatcgcccacata

SEQ ID NO: 906153 - DNA, 22 bp, Artificial Sequence
  chemically synthesized
gacaaacaagtctgtacctatg

SEQ ID NO: 906154 - DNA, 22 bp, Artificial Sequence
  chemically synthesized
ccatgtagtcacaaaatcctag

SEQ ID NO: 906155 - DNA, 22 bp, Artificial Sequence
  chemically synthesized
gtttgtctaggattttgtgact

SEQ ID NO: 906156 - DNA, 22 bp, Artificial Sequence
  chemically synthesized
tttgtctaggattttgtgacta

SEQ ID NO: 906157 - DNA, 22 bp, Artificial Sequence
  chemically synthesized
gtctaggattttgtgactacat

SEQ ID NO: 906158 - DNA, 22 bp, Artificial Sequence
  chemically synthesized
tctaggattttgtgactacatg

SEQ ID NO: 906159 - DNA, 22 bp, Artificial Sequence
  chemically synthesized
ataaggcaaactgccatgtagt

SEQ ID NO: 906160 - DNA, 22 bp, Artificial Sequence
  chemically synthesized
gataaggcaaactgccatgtag

SEQ ID NO: 906161 - DNA, 22 bp, Artificial Sequence
  chemically synthesized
ggattttgtgactacatggcag

SEQ ID NO: 906162 - DNA, 22 bp, Artificial Sequence
  chemically synthesized
tgataaggcaaactgccatgta

SEQ ID NO: 906163 - DNA, 22 bp, Artificial Sequence
  chemically synthesized
actttgataaggcaaactgcca

SEQ ID NO: 906164 - DNA, 22 bp, Artificial Sequence
  chemically synthesized
tgtgactacatggcagtttgcc

SEQ ID NO: 906165 - DNA, 22 bp, Artificial Sequence
  chemically synthesized
gtgactacatggcagtttgcct

SEQ ID NO: 906166 - DNA, 22 bp, Artificial Sequence
  chemically synthesized
tgactacatggcagtttgcctt

SEQ ID NO: 906167 - DNA, 22 bp, Artificial Sequence
  chemically synthesized
actcactttgataaggcaaact

SEQ ID NO: 906168 - DNA, 22 bp, Artificial Sequence
  chemically synthesized
cactcactttgataaggcaaac

SEQ ID NO: 906169 - DNA, 22 bp, Artificial Sequence
  chemically synthesized
tcactcactttgataaggcaaa

SEQ ID NO: 906170 - DNA, 22 bp, Artificial Sequence
  chemically synthesized
catggcagtttgccttatcaaa

SEQ ID NO: 906171 - DNA, 22 bp, Artificial Sequence
  chemically synthesized
cccatcctttcactcactttga

SEQ ID NO: 906172 - DNA, 22 bp, Artificial Sequence
  chemically synthesized
ccccatcctttcactcactttg

SEQ ID NO: 906173 - DNA, 22 bp, Artificial Sequence
  chemically synthesized
tccccatcctttcactcacttt

SEQ ID NO: 906174 - DNA, 22 bp, Artificial Sequence
  chemically synthesized
ttccccatcctttcactcactt

SEQ ID NO: 906175 - DNA, 22 bp, Artificial Sequence
  chemically synthesized
gccttatcaaagtgagtgaaag

SEQ ID NO: 906176 - DNA, 22 bp, Artificial Sequence
  chemically synthesized
ccttatcaaagtgagtgaaagg

SEQ ID NO: 906177 - DNA, 22 bp, Artificial Sequence
  chemically synthesized
ccttttccccatcctttcactc

SEQ ID NO: 906178 - DNA, 22 bp, Artificial Sequence
  chemically synthesized
cccttttccccatcctttcact

SEQ ID NO: 906179 - DNA, 22 bp, Artificial Sequence
  chemically synthesized
tcccttttccccatcctttcac

SEQ ID NO: 906180 - DNA, 22 bp, Artificial Sequence
  chemically synthesized
atcaaagtgagtgaaaggatgg

SEQ ID NO: 906181 - DNA, 22 bp, Artificial Sequence
  chemically synthesized
tcaaagtgagtgaaaggatggg

SEQ ID NO: 906182 - DNA, 22 bp, Artificial Sequence
  chemically synthesized
ctttcccttttccccatccttt

SEQ ID NO: 906183 - DNA, 22 bp, Artificial Sequence
  chemically synthesized
gctttcccttttccccatcctt

SEQ ID NO: 906184 - DNA, 22 bp, Artificial Sequence
  chemically synthesized
tcttgctttcccttttccccat

SEQ ID NO: 906185 - DNA, 22 bp, Artificial Sequence
  chemically synthesized
ctgtcttgctttcccttttccc

SEQ ID NO: 906186 - DNA, 22 bp, Artificial Sequence
  chemically synthesized
cctgtcttgctttcccttttcc

SEQ ID NO: 906187 - DNA, 22 bp, Artificial Sequence
  chemically synthesized
ttcctgtcttgctttccctttt

SEQ ID NO: 906188 - DNA, 22 bp, Artificial Sequence
  chemically synthesized
tcttcctgtcttgctttccctt

SEQ ID NO: 906189 - DNA, 22 bp, Artificial Sequence
  chemically synthesized
ctcttcctgtcttgctttccct

SEQ ID NO: 906190 - DNA, 22 bp, Artificial Sequence
  chemically synthesized
tctcttcctgtcttgctttccc

SEQ ID NO: 906191 - DNA, 22 bp, Artificial Sequence
  chemically synthesized
ttctcttcctgtcttgctttcc

SEQ ID NO: 906192 - DNA, 22 bp, Artificial Sequence
  chemically synthesized
tttctcttcctgtcttgctttc

SEQ ID NO: 906193 - DNA, 22 bp, Artificial Sequence
  chemically synthesized
tttttctcttcctgtcttgctt

SEQ ID NO: 906194 - DNA, 22 bp, Artificial Sequence
  chemically synthesized
ctttttctcttcctgtcttgct

SEQ ID NO: 906195 - DNA, 22 bp, Artificial Sequence
  chemically synthesized
tttctttttctcttcctgtctt

SEQ ID NO: 906196 - DNA, 22 bp, Artificial Sequence
  chemically synthesized
cctatttctttttctcttcctg

SEQ ID NO: 906197 - DNA, 22 bp, Artificial Sequence
  chemically synthesized
tccctatttctttttctcttcc

SEQ ID NO: 906198 - DNA, 22 bp, Artificial Sequence
  chemically synthesized
actctccctatttctttttctc

SEQ ID NO: 906199 - DNA, 22 bp, Artificial Sequence
  chemically synthesized
tgacaagagcctcactctccct

SEQ ID NO: 906200 - DNA, 22 bp, Artificial Sequence
  chemically synthesized
attgtgacaagagcctcactct

SEQ ID NO: 906201 - DNA, 22 bp, Artificial Sequence
  chemically synthesized
caagttgattgtgacaagagcc

SEQ ID NO: 906202 - DNA, 22 bp, Artificial Sequence
  chemically synthesized
agcaattacaagttgattgtga

SEQ ID NO: 906203 - DNA, 22 bp, Artificial Sequence
  chemically synthesized
ttcagcaattacaagttgattg

SEQ ID NO: 906204 - DNA, 22 bp, Artificial Sequence
  chemically synthesized
ttgtcacaatcaacttgtaatt

SEQ ID NO: 906205 - DNA, 22 bp, Artificial Sequence
  chemically synthesized
gtcacaatcaacttgtaattgc

SEQ ID NO: 906206 - DNA, 22 bp, Artificial Sequence
  chemically synthesized
tcacaatcaacttgtaattgct

SEQ ID NO: 906207 - DNA, 22 bp, Artificial Sequence
  chemically synthesized
gtaattgctgaacagtgtgttg

SEQ ID NO: 906208 - DNA, 22 bp, Artificial Sequence
  chemically synthesized
acatgaaagcaccaacacactg

SEQ ID NO: 906209 - DNA, 22 bp, Artificial Sequence
  chemically synthesized
taattgctgaacagtgtgttgg

SEQ ID NO: 906210 - DNA, 22 bp, Artificial Sequence
  chemically synthesized
tgacatgaaagcaccaacacac

SEQ ID NO: 906211 - DNA, 22 bp, Artificial Sequence
  chemically synthesized
cctctgacatgaaagcaccaac

SEQ ID NO: 906212 - DNA, 22 bp, Artificial Sequence
  chemically synthesized
ctgaacagtgtgttggtgcttt

SEQ ID NO: 906213 - DNA, 22 bp, Artificial Sequence
  chemically synthesized
aacagtgtgttggtgctttcat

SEQ ID NO: 906214 - DNA, 22 bp, Artificial Sequence
  chemically synthesized
taaatgttacctctgacatgaa

SEQ ID NO: 906215 - DNA, 22 bp, Artificial Sequence
  chemically synthesized
tgtaaatgttacctctgacatg

SEQ ID NO: 906216 - DNA, 22 bp, Artificial Sequence
  chemically synthesized
ctgtaaatgttacctctgacat

SEQ ID NO: 906217 - DNA, 22 bp, Artificial Sequence
  chemically synthesized
gtgctttcatgtcagaggtaac

SEQ ID NO: 906218 - DNA, 22 bp, Artificial Sequence
  chemically synthesized
tcatgtcagaggtaacatttac

SEQ ID NO: 906219 - DNA, 22 bp, Artificial Sequence
  chemically synthesized
catgtcagaggtaacatttaca

SEQ ID NO: 906220 - DNA, 22 bp, Artificial Sequence
  chemically synthesized
atgtcagaggtaacatttacag

SEQ ID NO: 906221 - DNA, 22 bp, Artificial Sequence
  chemically synthesized
aaatgtgtcatttctgtaaatg

SEQ ID NO: 906222 - DNA, 22 bp, Artificial Sequence
  chemically synthesized
aaaatgtgtcatttctgtaaat

SEQ ID NO: 906223 - DNA, 22 bp, Artificial Sequence
  chemically synthesized
agggccttaaaatgtgtcattt

SEQ ID NO: 906224 - DNA, 22 bp, Artificial Sequence
  chemically synthesized
ccctcagggccttaaaatgtgt

SEQ ID NO: 906225 - DNA, 22 bp, Artificial Sequence
  chemically synthesized
cccctcagggccttaaaatgtg

SEQ ID NO: 906226 - DNA, 22 bp, Artificial Sequence
  chemically synthesized
acagaaatgacacattttaagg

SEQ ID NO: 906227 - DNA, 22 bp, Artificial Sequence
  chemically synthesized
cagaaatgacacattttaaggc

SEQ ID NO: 906228 - DNA, 22 bp, Artificial Sequence
  chemically synthesized
ccttcccctcagggccttaaaa

SEQ ID NO: 906229 - DNA, 22 bp, Artificial Sequence
  chemically synthesized
atctgccttcccctcagggcct

SEQ ID NO: 906230 - DNA, 22 bp, Artificial Sequence
  chemically synthesized
tcctaatctgccttcccctcag

SEQ ID NO: 906231 - DNA, 22 bp, Artificial Sequence
  chemically synthesized
tatcctaatctgccttcccctc

SEQ ID NO: 906232 - DNA, 22 bp, Artificial Sequence
  chemically synthesized
ctatcctaatctgccttcccct

SEQ ID NO: 906233 - DNA, 22 bp, Artificial Sequence
  chemically synthesized
taaggccctgaggggaaggcag

SEQ ID NO: 906234 - DNA, 22 bp, Artificial Sequence
  chemically synthesized
aaggccctgaggggaaggcaga

SEQ ID NO: 906235 - DNA, 22 bp, Artificial Sequence
  chemically synthesized
aggccctgaggggaaggcagat

SEQ ID NO: 906236 - DNA, 22 bp, Artificial Sequence
  chemically synthesized
taagcttctatcctaatctgcc

SEQ ID NO: 906237 - DNA, 22 bp, Artificial Sequence
  chemically synthesized
aggggaaggcagattaggatag

SEQ ID NO: 906238 - DNA, 22 bp, Artificial Sequence
  chemically synthesized
taaagcagcaatacattataag

SEQ ID NO: 906239 - DNA, 22 bp, Artificial Sequence
  chemically synthesized
ggatagaagcttataatgtatt

SEQ ID NO: 906240 - DNA, 22 bp, Artificial Sequence
  chemically synthesized
ataatgtattgctgctttatag

SEQ ID NO: 906241 - DNA, 22 bp, Artificial Sequence
  chemically synthesized
taatgtattgctgctttatagt

SEQ ID NO: 906242 - DNA, 22 bp, Artificial Sequence
  chemically synthesized
caaacagtgataaaactataaa

SEQ ID NO: 906243 - DNA, 22 bp, Artificial Sequence
  chemically synthesized
ccaaacagtgataaaactataa

SEQ ID NO: 906244 - DNA, 22 bp, Artificial Sequence
  chemically synthesized
tccaaacagtgataaaactata

SEQ ID NO: 906245 - DNA, 22 bp, Artificial Sequence
  chemically synthesized
ctgctttatagttttatcactg

SEQ ID NO: 906246 - DNA, 22 bp, Artificial Sequence
  chemically synthesized
ctttatagttttatcactgttt

SEQ ID NO: 906247 - DNA, 22 bp, Artificial Sequence
  chemically synthesized
tatagttttatcactgtttgga

SEQ ID NO: 906248 - DNA, 22 bp, Artificial Sequence
  chemically synthesized
atagttttatcactgtttggaa

SEQ ID NO: 906249 - DNA, 22 bp, Artificial Sequence
  chemically synthesized
tagttttatcactgtttggaaa

SEQ ID NO: 906250 - DNA, 22 bp, Artificial Sequence
  chemically synthesized
taaataaaatgaaatactttcc

SEQ ID NO: 906251 - DNA, 22 bp, Artificial Sequence
  chemically synthesized
tatcactgtttggaaagtattt

SEQ ID NO: 906252 - DNA, 22 bp, Artificial Sequence
  chemically synthesized
atcactgtttggaaagtatttc

SEQ ID NO: 906253 - DNA, 22 bp, Artificial Sequence
  chemically synthesized
tcactgtttggaaagtatttca

SEQ ID NO: 906254 - DNA, 22 bp, Artificial Sequence
  chemically synthesized
cagagctataaataaaatgaaa

SEQ ID NO: 906255 - DNA, 22 bp, Artificial Sequence
  chemically synthesized
tttggaaagtatttcattttat

SEQ ID NO: 906256 - DNA, 22 bp, Artificial Sequence
  chemically synthesized
ctacagagctataaataaaatg

SEQ ID NO: 906257 - DNA, 22 bp, Artificial Sequence
  chemically synthesized
ggaaagtatttcattttattta

SEQ ID NO: 906258 - DNA, 22 bp, Artificial Sequence
  chemically synthesized
cctacagagctataaataaaat

SEQ ID NO: 906259 - DNA, 22 bp, Artificial Sequence
  chemically synthesized
gaaagtatttcattttatttat

SEQ ID NO: 906260 - DNA, 22 bp, Artificial Sequence
  chemically synthesized
tcctacagagctataaataaaa

SEQ ID NO: 906261 - DNA, 22 bp, Artificial Sequence
  chemically synthesized
gtaattttcctacagagctata

SEQ ID NO: 906262 - DNA, 22 bp, Artificial Sequence
  chemically synthesized
agtaattttcctacagagctat

SEQ ID NO: 906263 - DNA, 22 bp, Artificial Sequence
  chemically synthesized
tagtaattttcctacagagcta

SEQ ID NO: 906264 - DNA, 22 bp, Artificial Sequence
  chemically synthesized
cattttatttatagctctgtag

SEQ ID NO: 906265 - DNA, 22 bp, Artificial Sequence
  chemically synthesized
ttagtaattttcctacagagct

SEQ ID NO: 906266 - DNA, 22 bp, Artificial Sequence
  chemically synthesized
attttatttatagctctgtagg

SEQ ID NO: 906267 - DNA, 22 bp, Artificial Sequence
  chemically synthesized
tttagtaattttcctacagagc

SEQ ID NO: 906268 - DNA, 22 bp, Artificial Sequence
  chemically synthesized
ttttagtaattttcctacagag

SEQ ID NO: 906269 - DNA, 22 bp, Artificial Sequence
  chemically synthesized
tatttatagctctgtaggaaaa

SEQ ID NO: 906270 - DNA, 22 bp, Artificial Sequence
  chemically synthesized
atttatagctctgtaggaaaat

SEQ ID NO: 906271 - DNA, 22 bp, Artificial Sequence
  chemically synthesized
tttatagctctgtaggaaaatt

SEQ ID NO: 906272 - DNA, 22 bp, Artificial Sequence
  chemically synthesized
atagctctgtaggaaaattact

SEQ ID NO: 906273 - DNA, 22 bp, Artificial Sequence
  chemically synthesized
tagctctgtaggaaaattacta

SEQ ID NO: 906274 - DNA, 22 bp, Artificial Sequence
  chemically synthesized
tcataatttttttagtaatttt

SEQ ID NO: 906275 - DNA, 22 bp, Artificial Sequence
  chemically synthesized
gttatcataatttttttagtaa

SEQ ID NO: 906276 - DNA, 22 bp, Artificial Sequence
  chemically synthesized
tgtaggaaaattactaaaaaaa

SEQ ID NO: 906277 - DNA, 22 bp, Artificial Sequence
  chemically synthesized
taggaaaattactaaaaaaatt

SEQ ID NO: 906278 - DNA, 22 bp, Artificial Sequence
  chemically synthesized
ctaaaaaaattatgataactaa

SEQ ID NO: 906279 - DNA, 22 bp, Artificial Sequence
  chemically synthesized
aaaaaattatgataactaatac

SEQ ID NO: 906280 - DNA, 22 bp, Artificial Sequence
  chemically synthesized
tgataactaatacttactgatg

SEQ ID NO: 906281 - DNA, 22 bp, Artificial Sequence
  chemically synthesized
agcacatggtaagacatcagta

SEQ ID NO: 906282 - DNA, 22 bp, Artificial Sequence
  chemically synthesized
agctcagcacatggtaagacat

SEQ ID NO: 906283 - DNA, 22 bp, Artificial Sequence
  chemically synthesized
atacttactgatgtcttaccat

SEQ ID NO: 906284 - DNA, 22 bp, Artificial Sequence
  chemically synthesized
aaacctgagctcagcacatggt

SEQ ID NO: 906285 - DNA, 22 bp, Artificial Sequence
  chemically synthesized
actgatgtcttaccatgtgctg

SEQ ID NO: 906286 - DNA, 22 bp, Artificial Sequence
  chemically synthesized
ctgatgtcttaccatgtgctga

SEQ ID NO: 906287 - DNA, 22 bp, Artificial Sequence
  chemically synthesized
atgtcttaccatgtgctgagct

SEQ ID NO: 906288 - DNA, 22 bp, Artificial Sequence
  chemically synthesized
agaagctgaaacctgagctcag

SEQ ID NO: 906289 - DNA, 22 bp, Artificial Sequence
  chemically synthesized
aagaagctgaaacctgagctca

SEQ ID NO: 906290 - DNA, 22 bp, Artificial Sequence
  chemically synthesized
accatgtgctgagctcaggttt

SEQ ID NO: 906291 - DNA, 22 bp, Artificial Sequence
  chemically synthesized
ccatgtgctgagctcaggtttc

SEQ ID NO: 906292 - DNA, 22 bp, Artificial Sequence
  chemically synthesized
atgacacatttaagaagctgaa

SEQ ID NO: 906293 - DNA, 22 bp, Artificial Sequence
  chemically synthesized
agctcaggtttcagcttcttaa

SEQ ID NO: 906294 - DNA, 22 bp, Artificial Sequence
  chemically synthesized
aggtttcagcttcttaaatgtg

SEQ ID NO: 906295 - DNA, 22 bp, Artificial Sequence
  chemically synthesized
tagtcacctaatgacacattta

SEQ ID NO: 906296 - DNA, 22 bp, Artificial Sequence
  chemically synthesized
gtagtcacctaatgacacattt

SEQ ID NO: 906297 - DNA, 22 bp, Artificial Sequence
  chemically synthesized
tgtagtcacctaatgacacatt

SEQ ID NO: 906298 - DNA, 22 bp, Artificial Sequence
  chemically synthesized
ttgtagtcacctaatgacacat

SEQ ID NO: 906299 - DNA, 22 bp, Artificial Sequence
  chemically synthesized
cagcttcttaaatgtgtcatta

SEQ ID NO: 906300 - DNA, 22 bp, Artificial Sequence
  chemically synthesized
agcttcttaaatgtgtcattag

SEQ ID NO: 906301 - DNA, 22 bp, Artificial Sequence
  chemically synthesized
cttttgtagtcacctaatgaca

SEQ ID NO: 906302 - DNA, 22 bp, Artificial Sequence
  chemically synthesized
acttttgtagtcacctaatgac

SEQ ID NO: 906303 - DNA, 22 bp, Artificial Sequence
  chemically synthesized
cttaaatgtgtcattaggtgac

SEQ ID NO: 906304 - DNA, 22 bp, Artificial Sequence
  chemically synthesized
ttaaatgtgtcattaggtgact

SEQ ID NO: 906305 - DNA, 22 bp, Artificial Sequence
  chemically synthesized
aaatgtgtcattaggtgactac

SEQ ID NO: 906306 - DNA, 22 bp, Artificial Sequence
  chemically synthesized
aatgtgtcattaggtgactaca

SEQ ID NO: 906307 - DNA, 22 bp, Artificial Sequence
  chemically synthesized
ggtgactacaaaagtaagtgtt

SEQ ID NO: 906308 - DNA, 22 bp, Artificial Sequence
  chemically synthesized
catgaatgtgaaaacaacactt

SEQ ID NO: 906309 - DNA, 22 bp, Artificial Sequence
  chemically synthesized
caaaagtaagtgttgttttcac

SEQ ID NO: 906310 - DNA, 22 bp, Artificial Sequence
  chemically synthesized
aatatcaaatggcaagttccat

SEQ ID NO: 906311 - DNA, 22 bp, Artificial Sequence
  chemically synthesized
ttttcacattcatggaacttgc

SEQ ID NO: 906312 - DNA, 22 bp, Artificial Sequence
  chemically synthesized
caatatcaaatggcaagttcca

SEQ ID NO: 906313 - DNA, 22 bp, Artificial Sequence
  chemically synthesized
tcacattcatggaacttgccat

SEQ ID NO: 906314 - DNA, 22 bp, Artificial Sequence
  chemically synthesized
cacattcatggaacttgccatt

SEQ ID NO: 906315 - DNA, 22 bp, Artificial Sequence
  chemically synthesized
acattcatggaacttgccattt

SEQ ID NO: 906316 - DNA, 22 bp, Artificial Sequence
  chemically synthesized
atggaacttgccatttgatatt

SEQ ID NO: 906317 - DNA, 22 bp, Artificial Sequence
  chemically synthesized
agaatgtatttcaatatcaaat

SEQ ID NO: 906318 - DNA, 22 bp, Artificial Sequence
  chemically synthesized
aagaatgtatttcaatatcaaa

SEQ ID NO: 906319 - DNA, 22 bp, Artificial Sequence
  chemically synthesized
tttaagaatgtatttcaatatc

SEQ ID NO: 906320 - DNA, 22 bp, Artificial Sequence
  chemically synthesized
atttaagaatgtatttcaatat

SEQ ID NO: 906321 - DNA, 22 bp, Artificial Sequence
  chemically synthesized
gccatttgatattgaaatacat

SEQ ID NO: 906322 - DNA, 22 bp, Artificial Sequence
  chemically synthesized
ccatttgatattgaaatacatt

SEQ ID NO: 906323 - DNA, 22 bp, Artificial Sequence
  chemically synthesized
gatattgaaatacattcttaaa

SEQ ID NO: 906324 - DNA, 22 bp, Artificial Sequence
  chemically synthesized
atattgaaatacattcttaaat

SEQ ID NO: 906325 - DNA, 22 bp, Artificial Sequence
  chemically synthesized
aaatacattcttaaataaatgt

SEQ ID NO: 906326 - DNA, 22 bp, Artificial Sequence
  chemically synthesized
aaatgatgtataacataatcac

SEQ ID NO: 906327 - DNA, 22 bp, Artificial Sequence
  chemically synthesized
ttaaataaatgtgattatgtta

SEQ ID NO: 906328 - DNA, 22 bp, Artificial Sequence
  chemically synthesized
aaataaatgtgattatgttata

SEQ ID NO: 906329 - DNA, 22 bp, Artificial Sequence
  chemically synthesized
attaaaatgatgtataacataa

SEQ ID NO: 906330 - DNA, 22 bp, Artificial Sequence
  chemically synthesized
aataaatgtgattatgttatac

SEQ ID NO: 906331 - DNA, 22 bp, Artificial Sequence
  chemically synthesized
tgttatacatcattttaatgag

SEQ ID NO: 906332 - DNA, 22 bp, Artificial Sequence
  chemically synthesized
tacatcattttaatgagcattt

SEQ ID NO: 906333 - DNA, 22 bp, Artificial Sequence
  chemically synthesized
gcaaaaaaaaaaaaagtgagaa

SEQ ID NO: 906334 - DNA, 22 bp, Artificial Sequence
  chemically synthesized
taatgagcatttctcacttttt

SEQ ID NO: 906335 - DNA, 22 bp, Artificial Sequence
  chemically synthesized
aatgagcatttctcactttttt

SEQ ID NO: 906336 - DNA, 22 bp, Artificial Sequence
  chemically synthesized
atgagcatttctcacttttttt

SEQ ID NO: 906337 - DNA, 22 bp, Artificial Sequence
  chemically synthesized
ctcactttttttttttttgcta

SEQ ID NO: 906338 - DNA, 22 bp, Artificial Sequence
  chemically synthesized
tcactttttttttttttgctaa

SEQ ID NO: 906339 - DNA, 22 bp, Artificial Sequence
  chemically synthesized
actttttttttttttgctaatg

SEQ ID NO: 906340 - DNA, 22 bp, Artificial Sequence
  chemically synthesized
tttttttttttgctaatgactt

SEQ ID NO: 906341 - DNA, 22 bp, Artificial Sequence
  chemically synthesized
ttttttttttgctaatgactta

SEQ ID NO: 906342 - DNA, 22 bp, Artificial Sequence
  chemically synthesized
tttttttttgctaatgacttat

SEQ ID NO: 906343 - DNA, 22 bp, Artificial Sequence
  chemically synthesized
ttttttttgctaatgacttatt

SEQ ID NO: 906344 - DNA, 22 bp, Artificial Sequence
  chemically synthesized
tttttttgctaatgacttatta

SEQ ID NO: 906345 - DNA, 22 bp, Artificial Sequence
  chemically synthesized
ttttttgctaatgacttattac

SEQ ID NO: 906346 - DNA, 22 bp, Artificial Sequence
  chemically synthesized
tttttgctaatgacttattact

SEQ ID NO: 906347 - DNA, 22 bp, Artificial Sequence
  chemically synthesized
ttttgctaatgacttattactt

SEQ ID NO: 906348 - DNA, 22 bp, Artificial Sequence
  chemically synthesized
tttgctaatgacttattacttg

SEQ ID NO: 906349 - DNA, 22 bp, Artificial Sequence
  chemically synthesized
ttgctaatgacttattacttgc

SEQ ID NO: 906350 - DNA, 22 bp, Artificial Sequence
  chemically synthesized
tgctaatgacttattacttgct

SEQ ID NO: 906351 - DNA, 22 bp, Artificial Sequence
  chemically synthesized
gctaatgacttattacttgctg

SEQ ID NO: 906352 - DNA, 22 bp, Artificial Sequence
  chemically synthesized
ctaatgacttattacttgctgt

SEQ ID NO: 906353 - DNA, 22 bp, Artificial Sequence
  chemically synthesized
atgacttattacttgctgttta

SEQ ID NO: 906354 - DNA, 22 bp, Artificial Sequence
  chemically synthesized
aaataaacataaaataaacagc

SEQ ID NO: 906355 - DNA, 22 bp, Artificial Sequence
  chemically synthesized
attacttgctgtttattttatg

SEQ ID NO: 906356 - DNA, 22 bp, Artificial Sequence
  chemically synthesized
ttacttgctgtttattttatgt

SEQ ID NO: 906357 - DNA, 22 bp, Artificial Sequence
  chemically synthesized
cttgctgtttattttatgttta

SEQ ID NO: 906358 - DNA, 22 bp, Artificial Sequence
  chemically synthesized
catagtctaaaataaacataaa

SEQ ID NO: 906359 - DNA, 22 bp, Artificial Sequence
  chemically synthesized
ccatagtctaaaataaacataa

SEQ ID NO: 906360 - DNA, 22 bp, Artificial Sequence
  chemically synthesized
gctgtttattttatgtttattt

SEQ ID NO: 906361 - DNA, 22 bp, Artificial Sequence
  chemically synthesized
ctgtttattttatgtttatttt

SEQ ID NO: 906362 - DNA, 22 bp, Artificial Sequence
  chemically synthesized
tttattttatgtttattttaga

SEQ ID NO: 906363 - DNA, 22 bp, Artificial Sequence
  chemically synthesized
attttatgtttattttagacta

SEQ ID NO: 906364 - DNA, 22 bp, Artificial Sequence
  chemically synthesized
acatcatttccatagtctaaaa

SEQ ID NO: 906365 - DNA, 22 bp, Artificial Sequence
  chemically synthesized
ttttatgtttattttagactat

SEQ ID NO: 906366 - DNA, 22 bp, Artificial Sequence
  chemically synthesized
tatgtttattttagactatgga

SEQ ID NO: 906367 - DNA, 22 bp, Artificial Sequence
  chemically synthesized
tctaacatcatttccatagtct

SEQ ID NO: 906368 - DNA, 22 bp, Artificial Sequence
  chemically synthesized
atgtttattttagactatggaa

SEQ ID NO: 906369 - DNA, 22 bp, Artificial Sequence
  chemically synthesized
gtctaacatcatttccatagtc

SEQ ID NO: 906370 - DNA, 22 bp, Artificial Sequence
  chemically synthesized
tgtttattttagactatggaaa

SEQ ID NO: 906371 - DNA, 22 bp, Artificial Sequence
  chemically synthesized
tgtctaacatcatttccatagt

SEQ ID NO: 906372 - DNA, 22 bp, Artificial Sequence
  chemically synthesized
ttgtctaacatcatttccatag

SEQ ID NO: 906373 - DNA, 22 bp, Artificial Sequence
  chemically synthesized
tttgtctaacatcatttccata

SEQ ID NO: 906374 - DNA, 22 bp, Artificial Sequence
  chemically synthesized
attttagactatggaaatgatg

SEQ ID NO: 906375 - DNA, 22 bp, Artificial Sequence
  chemically synthesized
ctttttgtctaacatcatttcc

SEQ ID NO: 906376 - DNA, 22 bp, Artificial Sequence
  chemically synthesized
ttttagactatggaaatgatgt

SEQ ID NO: 906377 - DNA, 22 bp, Artificial Sequence
  chemically synthesized
gctttttgtctaacatcatttc

SEQ ID NO: 906378 - DNA, 22 bp, Artificial Sequence
  chemically synthesized
tagactatggaaatgatgttag

SEQ ID NO: 906379 - DNA, 22 bp, Artificial Sequence
  chemically synthesized
agactatggaaatgatgttaga

SEQ ID NO: 906380 - DNA, 22 bp, Artificial Sequence
  chemically synthesized
gactatggaaatgatgttagac

SEQ ID NO: 906381 - DNA, 22 bp, Artificial Sequence
  chemically synthesized
gaatttgctttttgtctaacat

SEQ ID NO: 906382 - DNA, 22 bp, Artificial Sequence
  chemically synthesized
tggaaatgatgttagacaaaaa

SEQ ID NO: 906383 - DNA, 22 bp, Artificial Sequence
  chemically synthesized
gaataagaaaaacgctcgaatt

SEQ ID NO: 906384 - DNA, 22 bp, Artificial Sequence
  chemically synthesized
gacaaaaagcaaattcgagcgt

SEQ ID NO: 906385 - DNA, 22 bp, Artificial Sequence
  chemically synthesized
aactcgaataagaaaaacgctc

SEQ ID NO: 906386 - DNA, 22 bp, Artificial Sequence
  chemically synthesized
gaactcgaataagaaaaacgct

SEQ ID NO: 906387 - DNA, 22 bp, Artificial Sequence
  chemically synthesized
tgaactcgaataagaaaaacgc

SEQ ID NO: 906388 - DNA, 22 bp, Artificial Sequence
  chemically synthesized
gagcgtttttcttattcgagtt

SEQ ID NO: 906389 - DNA, 22 bp, Artificial Sequence
  chemically synthesized
caatccattttgaactcgaata

SEQ ID NO: 906390 - DNA, 22 bp, Artificial Sequence
  chemically synthesized
acaatccattttgaactcgaat

SEQ ID NO: 906391 - DNA, 22 bp, Artificial Sequence
  chemically synthesized
tacaatccattttgaactcgaa

SEQ ID NO: 906392 - DNA, 22 bp, Artificial Sequence
  chemically synthesized
tttacaatccattttgaactcg

SEQ ID NO: 906393 - DNA, 22 bp, Artificial Sequence
  chemically synthesized
ctttacaatccattttgaactc

SEQ ID NO: 906394 - DNA, 22 bp, Artificial Sequence
  chemically synthesized
ttcttattcgagttcaaaatgg

SEQ ID NO: 906395 - DNA, 22 bp, Artificial Sequence
  chemically synthesized
cttctttacaatccattttgaa

SEQ ID NO: 906396 - DNA, 22 bp, Artificial Sequence
  chemically synthesized
tcttattcgagttcaaaatgga

SEQ ID NO: 906397 - DNA, 22 bp, Artificial Sequence
  chemically synthesized
cttattcgagttcaaaatggat

SEQ ID NO: 906398 - DNA, 22 bp, Artificial Sequence
  chemically synthesized
tgcttctttacaatccattttg

SEQ ID NO: 906399 - DNA, 22 bp, Artificial Sequence
  chemically synthesized
ttattcgagttcaaaatggatt

SEQ ID NO: 906400 - DNA, 22 bp, Artificial Sequence
  chemically synthesized
attcgagttcaaaatggattgt

SEQ ID NO: 906401 - DNA, 22 bp, Artificial Sequence
  chemically synthesized
ttcgagttcaaaatggattgta

SEQ ID NO: 906402 - DNA, 22 bp, Artificial Sequence
  chemically synthesized
cctctgcttctttacaatccat

SEQ ID NO: 906403 - DNA, 22 bp, Artificial Sequence
  chemically synthesized
gagttcaaaatggattgtaaag

SEQ ID NO: 906404 - DNA, 22 bp, Artificial Sequence
  chemically synthesized
cgagttgcctctgcttctttac

SEQ ID NO: 906405 - DNA, 22 bp, Artificial Sequence
  chemically synthesized
aaaatggattgtaaagaagcag

SEQ ID NO: 906406 - DNA, 22 bp, Artificial Sequence
  chemically synthesized
acattgcgagttgcctctgctt

SEQ ID NO: 906407 - DNA, 22 bp, Artificial Sequence
  chemically synthesized
gacattgcgagttgcctctgct

SEQ ID NO: 906408 - DNA, 22 bp, Artificial Sequence
  chemically synthesized
tgacattgcgagttgcctctgc

SEQ ID NO: 906409 - DNA, 22 bp, Artificial Sequence
  chemically synthesized
ttgacattgcgagttgcctctg

SEQ ID NO: 906410 - DNA, 22 bp, Artificial Sequence
  chemically synthesized
taaagaagcagaggcaactcgc

SEQ ID NO: 906411 - DNA, 22 bp, Artificial Sequence
  chemically synthesized
gccaaatgtgtttttgacattg

SEQ ID NO: 906412 - DNA, 22 bp, Artificial Sequence
  chemically synthesized
ggccaaatgtgtttttgacatt

SEQ ID NO: 906413 - DNA, 22 bp, Artificial Sequence
  chemically synthesized
gcaatgtcaaaaacacatttgg

SEQ ID NO: 906414 - DNA, 22 bp, Artificial Sequence
  chemically synthesized
gcagtaacttggccaaatgtgt

SEQ ID NO: 906415 - DNA, 22 bp, Artificial Sequence
  chemically synthesized
ttagcagtaacttggccaaatg

SEQ ID NO: 906416 - DNA, 22 bp, Artificial Sequence
  chemically synthesized
gttagcagtaacttggccaaat

SEQ ID NO: 906417 - DNA, 22 bp, Artificial Sequence
  chemically synthesized
tgcgtttgttagcagtaacttg

SEQ ID NO: 906418 - DNA, 22 bp, Artificial Sequence
  chemically synthesized
cactgtgcgtttgttagcagta

SEQ ID NO: 906419 - DNA, 22 bp, Artificial Sequence
  chemically synthesized
ggccaagttactgctaacaaac

SEQ ID NO: 906420 - DNA, 22 bp, Artificial Sequence
  chemically synthesized
gccaagttactgctaacaaacg

SEQ ID NO: 906421 - DNA, 22 bp, Artificial Sequence
  chemically synthesized
aaccaccactgcactgtgcgtt

SEQ ID NO: 906422 - DNA, 22 bp, Artificial Sequence
  chemically synthesized
gaaccaccactgcactgtgcgt

SEQ ID NO: 906423 - DNA, 22 bp, Artificial Sequence
  chemically synthesized
ctgctaacaaacgcacagtgca

SEQ ID NO: 906424 - DNA, 22 bp, Artificial Sequence
  chemically synthesized
ttgaaccaccactgcactgtgc

SEQ ID NO: 906425 - DNA, 22 bp, Artificial Sequence
  chemically synthesized
cttgaaccaccactgcactgtg

SEQ ID NO: 906426 - DNA, 22 bp, Artificial Sequence
  chemically synthesized
ctaacaaacgcacagtgcagtg

SEQ ID NO: 906427 - DNA, 22 bp, Artificial Sequence
  chemically synthesized
acaaacgcacagtgcagtggtg

SEQ ID NO: 906428 - DNA, 22 bp, Artificial Sequence
  chemically synthesized
aaaaacttcttgaaccaccact

SEQ ID NO: 906429 - DNA, 22 bp, Artificial Sequence
  chemically synthesized
gaaaaacttcttgaaccaccac

SEQ ID NO: 906430 - DNA, 22 bp, Artificial Sequence
  chemically synthesized
tgaaaaacttcttgaaccacca

SEQ ID NO: 906431 - DNA, 22 bp, Artificial Sequence
  chemically synthesized
ctttgaaaaacttcttgaacca

SEQ ID NO: 906432 - DNA, 22 bp, Artificial Sequence
  chemically synthesized
tctcctttgaaaaacttcttga

SEQ ID NO: 906433 - DNA, 22 bp, Artificial Sequence
  chemically synthesized
atctcctttgaaaaacttcttg

SEQ ID NO: 906434 - DNA, 22 bp, Artificial Sequence
  chemically synthesized
ttatctcctttgaaaaacttct

SEQ ID NO: 906435 - DNA, 22 bp, Artificial Sequence
  chemically synthesized
aagactcttatctcctttgaaa

SEQ ID NO: 906436 - DNA, 22 bp, Artificial Sequence
  chemically synthesized
caagactcttatctcctttgaa

SEQ ID NO: 906437 - DNA, 22 bp, Artificial Sequence
  chemically synthesized
aagaagtttttcaaaggagata

SEQ ID NO: 906438 - DNA, 22 bp, Artificial Sequence
  chemically synthesized
atcttcaagactcttatctcct

SEQ ID NO: 906439 - DNA, 22 bp, Artificial Sequence
  chemically synthesized
ttcaaaggagataagagtcttg

SEQ ID NO: 906440 - DNA, 22 bp, Artificial Sequence
  chemically synthesized
tcaaaggagataagagtcttga

SEQ ID NO: 906441 - DNA, 22 bp, Artificial Sequence
  chemically synthesized
cgcccctcatcttcaagactct

SEQ ID NO: 906442 - DNA, 22 bp, Artificial Sequence
  chemically synthesized
caaaggagataagagtcttgaa

SEQ ID NO: 906443 - DNA, 22 bp, Artificial Sequence
  chemically synthesized
aaaggagataagagtcttgaag

SEQ ID NO: 906444 - DNA, 22 bp, Artificial Sequence
  chemically synthesized
atggccagccactacgcccctc

SEQ ID NO: 906445 - DNA, 22 bp, Artificial Sequence
  chemically synthesized
tgatggccagccactacgcccc

SEQ ID NO: 906446 - DNA, 22 bp, Artificial Sequence
  chemically synthesized
ctgatggccagccactacgccc

SEQ ID NO: 906447 - DNA, 22 bp, Artificial Sequence
  chemically synthesized
gaagatgaggggcgtagtggct

SEQ ID NO: 906448 - DNA, 22 bp, Artificial Sequence
  chemically synthesized
aagatgaggggcgtagtggctg

SEQ ID NO: 906449 - DNA, 22 bp, Artificial Sequence
  chemically synthesized
tcaacttctgatggccagccac

SEQ ID NO: 906450 - DNA, 22 bp, Artificial Sequence
  chemically synthesized
aatcggtcattgtcaacttctg

SEQ ID NO: 906451 - DNA, 22 bp, Artificial Sequence
  chemically synthesized
gtctcaatcggtcattgtcaac

SEQ ID NO: 906452 - DNA, 22 bp, Artificial Sequence
  chemically synthesized
gccatcagaagttgacaatgac

SEQ ID NO: 906453 - DNA, 22 bp, Artificial Sequence
  chemically synthesized
gatgattggtctcaatcggtca

SEQ ID NO: 906454 - DNA, 22 bp, Artificial Sequence
  chemically synthesized
cgatgattggtctcaatcggtc

SEQ ID NO: 906455 - DNA, 22 bp, Artificial Sequence
  chemically synthesized
acaatgaccgattgagaccaat

SEQ ID NO: 906456 - DNA, 22 bp, Artificial Sequence
  chemically synthesized
taagaggatcagcttcgatgat

SEQ ID NO: 906457 - DNA, 22 bp, Artificial Sequence
  chemically synthesized
agaccaatcatcgaagctgatc

SEQ ID NO: 906458 - DNA, 22 bp, Artificial Sequence
  chemically synthesized
gtgtagttgtaagaggatcagc

SEQ ID NO: 906459 - DNA, 22 bp, Artificial Sequence
  chemically synthesized
tcgtgtagttgtaagaggatca

SEQ ID NO: 906460 - DNA, 22 bp, Artificial Sequence
  chemically synthesized
ctcgtgtagttgtaagaggatc

SEQ ID NO: 906461 - DNA, 22 bp, Artificial Sequence
  chemically synthesized
ggcaacttctcgtgtagttgta

SEQ ID NO: 906462 - DNA, 22 bp, Artificial Sequence
  chemically synthesized
ctcggcaacttctcgtgtagtt

SEQ ID NO: 906463 - DNA, 22 bp, Artificial Sequence
  chemically synthesized
atcctcttacaactacacgaga

SEQ ID NO: 906464 - DNA, 22 bp, Artificial Sequence
  chemically synthesized
agttcctcggcaacttctcgtg

SEQ ID NO: 906465 - DNA, 22 bp, Artificial Sequence
  chemically synthesized
ttacaactacacgagaagttgc

SEQ ID NO: 906466 - DNA, 22 bp, Artificial Sequence
  chemically synthesized
acaactacacgagaagttgccg

SEQ ID NO: 906467 - DNA, 22 bp, Artificial Sequence
  chemically synthesized
caactacacgagaagttgccga

SEQ ID NO: 906468 - DNA, 22 bp, Artificial Sequence
  chemically synthesized
acattgagttcctcggcaactt

SEQ ID NO: 906469 - DNA, 22 bp, Artificial Sequence
  chemically synthesized
cacgagaagttgccgaggaact

SEQ ID NO: 906470 - DNA, 22 bp, Artificial Sequence
  chemically synthesized
tgaaatggttgacattgagttc

SEQ ID NO: 906471 - DNA, 22 bp, Artificial Sequence
  chemically synthesized
ccgaggaactcaatgtcaacca

SEQ ID NO: 906472 - DNA, 22 bp, Artificial Sequence
  chemically synthesized
aacaactgtgaaatggttgaca

SEQ ID NO: 906473 - DNA, 22 bp, Artificial Sequence
  chemically synthesized
aaatgctgaacaactgtgaaat

SEQ ID NO: 906474 - DNA, 22 bp, Artificial Sequence
  chemically synthesized
caaatgctgaacaactgtgaaa

SEQ ID NO: 906475 - DNA, 22 bp, Artificial Sequence
  chemically synthesized
aatgtcaaccatttcacagttg

SEQ ID NO: 906476 - DNA, 22 bp, Artificial Sequence
  chemically synthesized
cttcaaatgctgaacaactgtg

SEQ ID NO: 906477 - DNA, 22 bp, Artificial Sequence
  chemically synthesized
gcttcaaatgctgaacaactgt

SEQ ID NO: 906478 - DNA, 22 bp, Artificial Sequence
  chemically synthesized
caatttgcttcaaatgctgaac

SEQ ID NO: 906479 - DNA, 22 bp, Artificial Sequence
  chemically synthesized
ccaatttgcttcaaatgctgaa

SEQ ID NO: 906480 - DNA, 22 bp, Artificial Sequence
  chemically synthesized
tccaatttgcttcaaatgctga

SEQ ID NO: 906481 - DNA, 22 bp, Artificial Sequence
  chemically synthesized
cacagttgttcagcatttgaag

SEQ ID NO: 906482 - DNA, 22 bp, Artificial Sequence
  chemically synthesized
acagttgttcagcatttgaagc

SEQ ID NO: 906483 - DNA, 22 bp, Artificial Sequence
  chemically synthesized
gcctttccaatttgcttcaaat

SEQ ID NO: 906484 - DNA, 22 bp, Artificial Sequence
  chemically synthesized
cgcctttccaatttgcttcaaa

SEQ ID NO: 906485 - DNA, 22 bp, Artificial Sequence
  chemically synthesized
tcgcctttccaatttgcttcaa

SEQ ID NO: 906486 - DNA, 22 bp, Artificial Sequence
  chemically synthesized
ttcgcctttccaatttgcttca

SEQ ID NO: 906487 - DNA, 22 bp, Artificial Sequence
  chemically synthesized
tttcgcctttccaatttgcttc

SEQ ID NO: 906488 - DNA, 22 bp, Artificial Sequence
  chemically synthesized
ttcagcatttgaagcaaattgg

SEQ ID NO: 906489 - DNA, 22 bp, Artificial Sequence
  chemically synthesized
agcatttgaagcaaattggaaa

SEQ ID NO: 906490 - DNA, 22 bp, Artificial Sequence
  chemically synthesized
tcgagttttttcgcctttccaa

SEQ ID NO: 906491 - DNA, 22 bp, Artificial Sequence
  chemically synthesized
atcgagttttttcgcctttcca

SEQ ID NO: 906492 - DNA, 22 bp, Artificial Sequence
  chemically synthesized
gaagcaaattggaaaggcgaaa

SEQ ID NO: 906493 - DNA, 22 bp, Artificial Sequence
  chemically synthesized
aagcaaattggaaaggcgaaaa

SEQ ID NO: 906494 - DNA, 22 bp, Artificial Sequence
  chemically synthesized
gaaaggcgaaaaaactcgataa

SEQ ID NO: 906495 - DNA, 22 bp, Artificial Sequence
  chemically synthesized
tgaggcacccacttatcgagtt

SEQ ID NO: 906496 - DNA, 22 bp, Artificial Sequence
  chemically synthesized
atgaggcacccacttatcgagt

SEQ ID NO: 906497 - DNA, 22 bp, Artificial Sequence
  chemically synthesized
cttatgaggcacccacttatcg

SEQ ID NO: 906498 - DNA, 22 bp, Artificial Sequence
  chemically synthesized
tgcttatgaggcacccacttat

SEQ ID NO: 906499 - DNA, 22 bp, Artificial Sequence
  chemically synthesized
gctctgcttatgaggcacccac

SEQ ID NO: 906500 - DNA, 22 bp, Artificial Sequence
  chemically synthesized
cgctctgcttatgaggcaccca

SEQ ID NO: 906501 - DNA, 22 bp, Artificial Sequence
  chemically synthesized
tcgctctgcttatgaggcaccc

SEQ ID NO: 906502 - DNA, 22 bp, Artificial Sequence
  chemically synthesized
ttttcgctctgcttatgaggca

SEQ ID NO: 906503 - DNA, 22 bp, Artificial Sequence
  chemically synthesized
attttcgctctgcttatgaggc

SEQ ID NO: 906504 - DNA, 22 bp, Artificial Sequence
  chemically synthesized
gataagtgggtgcctcataagc

SEQ ID NO: 906505 - DNA, 22 bp, Artificial Sequence
  chemically synthesized
tattttcgctctgcttatgagg

SEQ ID NO: 906506 - DNA, 22 bp, Artificial Sequence
  chemically synthesized
ttattttcgctctgcttatgag

SEQ ID NO: 906507 - DNA, 22 bp, Artificial Sequence
  chemically synthesized
ataagcagagcgaaaataaaag

SEQ ID NO: 906508 - DNA, 22 bp, Artificial Sequence
  chemically synthesized
aaaatgacgatacttttatttt

SEQ ID NO: 906509 - DNA, 22 bp, Artificial Sequence
  chemically synthesized
caaaatgacgatacttttattt

SEQ ID NO: 906510 - DNA, 22 bp, Artificial Sequence
  chemically synthesized
gcgtagaataagagaagatggc

SEQ ID NO: 906511 - DNA, 22 bp, Artificial Sequence
  chemically synthesized
ttggcgtagaataagagaagat

SEQ ID NO: 906512 - DNA, 22 bp, Artificial Sequence
  chemically synthesized
tgaagtgccatcttctcttatt

SEQ ID NO: 906513 - DNA, 22 bp, Artificial Sequence
  chemically synthesized
ttgttggcgtagaataagagaa

SEQ ID NO: 906514 - DNA, 22 bp, Artificial Sequence
  chemically synthesized
gaagtgccatcttctcttattc

SEQ ID NO: 906515 - DNA, 22 bp, Artificial Sequence
  chemically synthesized
aagtgccatcttctcttattct

SEQ ID NO: 906516 - DNA, 22 bp, Artificial Sequence
  chemically synthesized
ttgttgttggcgtagaataaga

SEQ ID NO: 906517 - DNA, 22 bp, Artificial Sequence
  chemically synthesized
gttgttgttggcgtagaataag

SEQ ID NO: 906518 - DNA, 22 bp, Artificial Sequence
  chemically synthesized
ctcttattctacgccaacaaca

SEQ ID NO: 906519 - DNA, 22 bp, Artificial Sequence
  chemically synthesized
tcttattctacgccaacaacaa

SEQ ID NO: 906520 - DNA, 22 bp, Artificial Sequence
  chemically synthesized
ttattctacgccaacaacaaca

SEQ ID NO: 906521 - DNA, 22 bp, Artificial Sequence
  chemically synthesized
attctacgccaacaacaacaaa

SEQ ID NO: 906522 - DNA, 22 bp, Artificial Sequence
  chemically synthesized
ttctacgccaacaacaacaaac

SEQ ID NO: 906523 - DNA, 22 bp, Artificial Sequence
  chemically synthesized
tacgccaacaacaacaaaccat

SEQ ID NO: 906524 - DNA, 22 bp, Artificial Sequence
  chemically synthesized
cgccaacaacaacaaaccattt

SEQ ID NO: 906525 - DNA, 22 bp, Artificial Sequence
  chemically synthesized
caatccgatcaagaaatggttt

SEQ ID NO: 906526 - DNA, 22 bp, Artificial Sequence
  chemically synthesized
cacgttacaatccgatcaagaa

SEQ ID NO: 906527 - DNA, 22 bp, Artificial Sequence
  chemically synthesized
ttgcacgttacaatccgatcaa

SEQ ID NO: 906528 - DNA, 22 bp, Artificial Sequence
  chemically synthesized
gttgcacgttacaatccgatca

SEQ ID NO: 906529 - DNA, 22 bp, Artificial Sequence
  chemically synthesized
tgttgcacgttacaatccgatc

SEQ ID NO: 906530 - DNA, 22 bp, Artificial Sequence
  chemically synthesized
ttgttgcacgttacaatccgat

SEQ ID NO: 906531 - DNA, 22 bp, Artificial Sequence
  chemically synthesized
tttgttgcacgttacaatccga

SEQ ID NO: 906532 - DNA, 22 bp, Artificial Sequence
  chemically synthesized
cttgatcggattgtaacgtgca

SEQ ID NO: 906533 - DNA, 22 bp, Artificial Sequence
  chemically synthesized
ttgatcggattgtaacgtgcaa

SEQ ID NO: 906534 - DNA, 22 bp, Artificial Sequence
  chemically synthesized
gatcggattgtaacgtgcaaca

SEQ ID NO: 906535 - DNA, 22 bp, Artificial Sequence
  chemically synthesized
aaatccactttttgttgcacgt

SEQ ID NO: 906536 - DNA, 22 bp, Artificial Sequence
  chemically synthesized
atcggattgtaacgtgcaacaa

SEQ ID NO: 906537 - DNA, 22 bp, Artificial Sequence
  chemically synthesized
aaaatccactttttgttgcacg

SEQ ID NO: 906538 - DNA, 22 bp, Artificial Sequence
  chemically synthesized
tcgtttaaaatccactttttgt

SEQ ID NO: 906539 - DNA, 22 bp, Artificial Sequence
  chemically synthesized
taacgtgcaacaaaaagtggat

SEQ ID NO: 906540 - DNA, 22 bp, Artificial Sequence
  chemically synthesized
ggcatcgccagttgtcgtttaa

SEQ ID NO: 906541 - DNA, 22 bp, Artificial Sequence
  chemically synthesized
aactgggcatcgccagttgtcg

SEQ ID NO: 906542 - DNA, 22 bp, Artificial Sequence
  chemically synthesized
taaacgacaactggcgatgccc

SEQ ID NO: 906543 - DNA, 22 bp, Artificial Sequence
  chemically synthesized
aaacgacaactggcgatgccca

SEQ ID NO: 906544 - DNA, 22 bp, Artificial Sequence
  chemically synthesized
aacgacaactggcgatgcccag

SEQ ID NO: 906545 - DNA, 22 bp, Artificial Sequence
  chemically synthesized
agtccagccactgaactgggca

SEQ ID NO: 906546 - DNA, 22 bp, Artificial Sequence
  chemically synthesized
tcagtccagccactgaactggg

SEQ ID NO: 906547 - DNA, 22 bp, Artificial Sequence
  chemically synthesized
ctcagtccagccactgaactgg

SEQ ID NO: 906548 - DNA, 22 bp, Artificial Sequence
  chemically synthesized
ttctcagtccagccactgaact

SEQ ID NO: 906549 - DNA, 22 bp, Artificial Sequence
  chemically synthesized
cttctcagtccagccactgaac

SEQ ID NO: 906550 - DNA, 22 bp, Artificial Sequence
  chemically synthesized
gcgatgcccagttcagtggctg

SEQ ID NO: 906551 - DNA, 22 bp, Artificial Sequence
  chemically synthesized
gagcttcttctcagtccagcca

SEQ ID NO: 906552 - DNA, 22 bp, Artificial Sequence
  chemically synthesized
ggagcttcttctcagtccagcc

SEQ ID NO: 906553 - DNA, 22 bp, Artificial Sequence
  chemically synthesized
tggagcttcttctcagtccagc

SEQ ID NO: 906554 - DNA, 22 bp, Artificial Sequence
  chemically synthesized
agtggctggactgagaagaagc

SEQ ID NO: 906555 - DNA, 22 bp, Artificial Sequence
  chemically synthesized
gaaagtgctttggagcttcttc

SEQ ID NO: 906556 - DNA, 22 bp, Artificial Sequence
  chemically synthesized
ggaaagtgctttggagcttctt

SEQ ID NO: 906557 - DNA, 22 bp, Artificial Sequence
  chemically synthesized
tggaaagtgctttggagcttct

SEQ ID NO: 906558 - DNA, 22 bp, Artificial Sequence
  chemically synthesized
gactgagaagaagctccaaagc

SEQ ID NO: 906559 - DNA, 22 bp, Artificial Sequence
  chemically synthesized
gctttggaaagtgctttggagc

SEQ ID NO: 906560 - DNA, 22 bp, Artificial Sequence
  chemically synthesized
ggctttggaaagtgctttggag

SEQ ID NO: 906561 - DNA, 22 bp, Artificial Sequence
  chemically synthesized
agaagaagctccaaagcacttt

SEQ ID NO: 906562 - DNA, 22 bp, Artificial Sequence
  chemically synthesized
gtacaagtttggctttggaaag

SEQ ID NO: 906563 - DNA, 22 bp, Artificial Sequence
  chemically synthesized
ggtacaagtttggctttggaaa

SEQ ID NO: 906564 - DNA, 22 bp, Artificial Sequence
  chemically synthesized
tggtacaagtttggctttggaa

SEQ ID NO: 906565 - DNA, 22 bp, Artificial Sequence
  chemically synthesized
ttggtacaagtttggctttgga

SEQ ID NO: 906566 - DNA, 22 bp, Artificial Sequence
  chemically synthesized
caaagcactttccaaagccaaa

SEQ ID NO: 906567 - DNA, 22 bp, Artificial Sequence
  chemically synthesized
tccaaagccaaacttgtaccaa

SEQ ID NO: 906568 - DNA, 22 bp, Artificial Sequence
  chemically synthesized
ccaaagccaaacttgtaccaaa

SEQ ID NO: 906569 - DNA, 22 bp, Artificial Sequence
  chemically synthesized
caaagccaaacttgtaccaaaa

SEQ ID NO: 906570 - DNA, 22 bp, Artificial Sequence
  chemically synthesized
gtaccaaaagtcatggtcactg

SEQ ID NO: 906571 - DNA, 22 bp, Artificial Sequence
  chemically synthesized
taccaaaagtcatggtcactgt

SEQ ID NO: 906572 - DNA, 22 bp, Artificial Sequence
  chemically synthesized
ttcactggtctcctgctggcct

SEQ ID NO: 906573 - DNA, 22 bp, Artificial Sequence
  chemically synthesized
actggtctcctgctggcctgac

SEQ ID NO: 906574 - DNA, 22 bp, Artificial Sequence
  chemically synthesized
agaaagcggtagtgggtcaggc

SEQ ID NO: 906575 - DNA, 22 bp, Artificial Sequence
  chemically synthesized
gtctcctgctggcctgacccac

SEQ ID NO: 906576 - DNA, 22 bp, Artificial Sequence
  chemically synthesized
ctgctggcctgacccactaccg

SEQ ID NO: 906577 - DNA, 22 bp, Artificial Sequence
  chemically synthesized
ctggcctgacccactaccgctt

SEQ ID NO: 906578 - DNA, 22 bp, Artificial Sequence
  chemically synthesized
gccgggattcagaaagcggtag

SEQ ID NO: 906579 - DNA, 22 bp, Artificial Sequence
  chemically synthesized
cgccgggattcagaaagcggta

SEQ ID NO: 906580 - DNA, 22 bp, Artificial Sequence
  chemically synthesized
gcctgacccactaccgctttct

SEQ ID NO: 906581 - DNA, 22 bp, Artificial Sequence
  chemically synthesized
acccactaccgctttctgaatc

SEQ ID NO: 906582 - DNA, 22 bp, Artificial Sequence
  chemically synthesized
ccgctttctgaatcccggcgaa

SEQ ID NO: 906583 - DNA, 22 bp, Artificial Sequence
  chemically synthesized
aaatgtagtggtttcgccggga

SEQ ID NO: 906584 - DNA, 22 bp, Artificial Sequence
  chemically synthesized
tcaaatgtagtggtttcgccgg

SEQ ID NO: 906585 - DNA, 22 bp, Artificial Sequence
  chemically synthesized
ctcaaatgtagtggtttcgccg

SEQ ID NO: 906586 - DNA, 22 bp, Artificial Sequence
  chemically synthesized
tctgaatcccggcgaaaccact

SEQ ID NO: 906587 - DNA, 22 bp, Artificial Sequence
  chemically synthesized
ctgaatcccggcgaaaccacta

SEQ ID NO: 906588 - DNA, 22 bp, Artificial Sequence
  chemically synthesized
tgaatcccggcgaaaccactac

SEQ ID NO: 906589 - DNA, 22 bp, Artificial Sequence
  chemically synthesized
aatcccggcgaaaccactacat

SEQ ID NO: 906590 - DNA, 22 bp, Artificial Sequence
  chemically synthesized
agcatacttctcaaatgtagtg

SEQ ID NO: 906591 - DNA, 22 bp, Artificial Sequence
  chemically synthesized
ctgagcatacttctcaaatgta

SEQ ID NO: 906592 - DNA, 22 bp, Artificial Sequence
  chemically synthesized
actgagcatacttctcaaatgt

SEQ ID NO: 906593 - DNA, 22 bp, Artificial Sequence
  chemically synthesized
atcaatttactgagcatacttc

SEQ ID NO: 906594 - DNA, 22 bp, Artificial Sequence
  chemically synthesized
catttgagaagtatgctcagta

SEQ ID NO: 906595 - DNA, 22 bp, Artificial Sequence
  chemically synthesized
atgtatctcatcaatttactga

SEQ ID NO: 906596 - DNA, 22 bp, Artificial Sequence
  chemically synthesized
gagaagtatgctcagtaaattg

SEQ ID NO: 906597 - DNA, 22 bp, Artificial Sequence
  chemically synthesized
gatgtatctcatcaatttactg

SEQ ID NO: 906598 - DNA, 22 bp, Artificial Sequence
  chemically synthesized
agaagtatgctcagtaaattga

SEQ ID NO: 906599 - DNA, 22 bp, Artificial Sequence
  chemically synthesized
tgatgtatctcatcaatttact

SEQ ID NO: 906600 - DNA, 22 bp, Artificial Sequence
  chemically synthesized
ttgatgtatctcatcaatttac

SEQ ID NO: 906601 - DNA, 22 bp, Artificial Sequence
  chemically synthesized
agtaaattgatgagatacatca

SEQ ID NO: 906602 - DNA, 22 bp, Artificial Sequence
  chemically synthesized
caggcatggcagtttttgatgt

SEQ ID NO: 906603 - DNA, 22 bp, Artificial Sequence
  chemically synthesized
gctgcaggcatggcagtttttg

SEQ ID NO: 906604 - DNA, 22 bp, Artificial Sequence
  chemically synthesized
atgagatacatcaaaaactgcc

SEQ ID NO: 906605 - DNA, 22 bp, Artificial Sequence
  chemically synthesized
ctggctgcaggcatggcagttt

SEQ ID NO: 906606 - DNA, 22 bp, Artificial Sequence
  chemically synthesized
accactgctggctgcaggcatg

SEQ ID NO: 906607 - DNA, 22 bp, Artificial Sequence
  chemically synthesized
ttgaccactgctggctgcaggc

SEQ ID NO: 906608 - DNA, 22 bp, Artificial Sequence
  chemically synthesized
tgttgaccactgctggctgcag

SEQ ID NO: 906609 - DNA, 22 bp, Artificial Sequence
  chemically synthesized
ctgttgaccactgctggctgca

SEQ ID NO: 906610 - DNA, 22 bp, Artificial Sequence
  chemically synthesized
tctgttgaccactgctggctgc

SEQ ID NO: 906611 - DNA, 22 bp, Artificial Sequence
  chemically synthesized
ccatgcctgcagccagcagtgg

SEQ ID NO: 906612 - DNA, 22 bp, Artificial Sequence
  chemically synthesized
ggccctttctgttgaccactgc

SEQ ID NO: 906613 - DNA, 22 bp, Artificial Sequence
  chemically synthesized
cagccagcagtggtcaacagaa

SEQ ID NO: 906614 - DNA, 22 bp, Artificial Sequence
  chemically synthesized
tcacagagaagaattgggccct

SEQ ID NO: 906615 - DNA, 22 bp, Artificial Sequence
  chemically synthesized
tgcgacgtgcggtcgggcgttg

SEQ ID NO: 906616 - DNA, 22 bp, Artificial Sequence
  chemically synthesized
ttctctgtgacaacgcccgacc

SEQ ID NO: 906617 - DNA, 22 bp, Artificial Sequence
  chemically synthesized
ctctgtgacaacgcccgaccgc

SEQ ID NO: 906618 - DNA, 22 bp, Artificial Sequence
  chemically synthesized
gttgtgcgacgtgcggtcgggc

SEQ ID NO: 906619 - DNA, 22 bp, Artificial Sequence
  chemically synthesized
tctgtgacaacgcccgaccgca

SEQ ID NO: 906620 - DNA, 22 bp, Artificial Sequence
  chemically synthesized
tgtgacaacgcccgaccgcacg

SEQ ID NO: 906621 - DNA, 22 bp, Artificial Sequence
  chemically synthesized
tgacaacgcccgaccgcacgtc

SEQ ID NO: 906622 - DNA, 22 bp, Artificial Sequence
  chemically synthesized
tgaagcgttggttgtgcgacgt

SEQ ID NO: 906623 - DNA, 22 bp, Artificial Sequence
  chemically synthesized
gtgaagcgttggttgtgcgacg

SEQ ID NO: 906624 - DNA, 22 bp, Artificial Sequence
  chemically synthesized
aacttgtgaagcgttggttgtg

SEQ ID NO: 906625 - DNA, 22 bp, Artificial Sequence
  chemically synthesized
attcaacttgtgaagcgttggt

SEQ ID NO: 906626 - DNA, 22 bp, Artificial Sequence
  chemically synthesized
gcccgattcattcaacttgtga

SEQ ID NO: 906627 - DNA, 22 bp, Artificial Sequence
  chemically synthesized
ctagcccgattcattcaacttg

SEQ ID NO: 906628 - DNA, 22 bp, Artificial Sequence
  chemically synthesized
cctagcccgattcattcaactt

SEQ ID NO: 906629 - DNA, 22 bp, Artificial Sequence
  chemically synthesized
cacaagttgaatgaatcgggct

SEQ ID NO: 906630 - DNA, 22 bp, Artificial Sequence
  chemically synthesized
acaagttgaatgaatcgggcta

SEQ ID NO: 906631 - DNA, 22 bp, Artificial Sequence
  chemically synthesized
aatgaatcgggctaggaagttt

SEQ ID NO: 906632 - DNA, 22 bp, Artificial Sequence
  chemically synthesized
ggaagttttgcctcatctgcca

SEQ ID NO: 906633 - DNA, 22 bp, Artificial Sequence
  chemically synthesized
agaggtcaggtaaatatggcag

SEQ ID NO: 906634 - DNA, 22 bp, Artificial Sequence
  chemically synthesized
tgcctcatctgccatatttacc

SEQ ID NO: 906635 - DNA, 22 bp, Artificial Sequence
  chemically synthesized
gttgagaggtcaggtaaatatg

SEQ ID NO: 906636 - DNA, 22 bp, Artificial Sequence
  chemically synthesized
gcctcatctgccatatttacct

SEQ ID NO: 906637 - DNA, 22 bp, Artificial Sequence
  chemically synthesized
cctcatctgccatatttacctg

SEQ ID NO: 906638 - DNA, 22 bp, Artificial Sequence
  chemically synthesized
atctgccatatttacctgacct

SEQ ID NO: 906639 - DNA, 22 bp, Artificial Sequence
  chemically synthesized
ccatatttacctgacctctcaa

SEQ ID NO: 906640 - DNA, 22 bp, Artificial Sequence
  chemically synthesized
acctgacctctcaaccaactga

SEQ ID NO: 906641 - DNA, 22 bp, Artificial Sequence
  chemically synthesized
aagaagtggtagtcagttggtt

SEQ ID NO: 906642 - DNA, 22 bp, Artificial Sequence
  chemically synthesized
cctgacctctcaaccaactgac

SEQ ID NO: 906643 - DNA, 22 bp, Artificial Sequence
  chemically synthesized
gaagaagtggtagtcagttggt

SEQ ID NO: 906644 - DNA, 22 bp, Artificial Sequence
  chemically synthesized
acctctcaaccaactgactacc

SEQ ID NO: 906645 - DNA, 22 bp, Artificial Sequence
  chemically synthesized
tcaaccaactgactaccacttc

SEQ ID NO: 906646 - DNA, 22 bp, Artificial Sequence
  chemically synthesized
aaccaactgactaccacttctt

SEQ ID NO: 906647 - DNA, 22 bp, Artificial Sequence
  chemically synthesized
tcgagatgcttgaagaagtggt

SEQ ID NO: 906648 - DNA, 22 bp, Artificial Sequence
  chemically synthesized
actaccacttcttcaagcatct

SEQ ID NO: 906649 - DNA, 22 bp, Artificial Sequence
  chemically synthesized
taaaaagttgtcgagatgcttg

SEQ ID NO: 906650 - DNA, 22 bp, Artificial Sequence
  chemically synthesized
ccacttcttcaagcatctcgac

SEQ ID NO: 906651 - DNA, 22 bp, Artificial Sequence
  chemically synthesized
cctgtaaaaagttgtcgagatg

SEQ ID NO: 906652 - DNA, 22 bp, Artificial Sequence
  chemically synthesized
ccctgtaaaaagttgtcgagat

SEQ ID NO: 906653 - DNA, 22 bp, Artificial Sequence
  chemically synthesized
tccctgtaaaaagttgtcgaga

SEQ ID NO: 906654 - DNA, 22 bp, Artificial Sequence
  chemically synthesized
cttcaagcatctcgacaacttt

SEQ ID NO: 906655 - DNA, 22 bp, Artificial Sequence
  chemically synthesized
ttcaagcatctcgacaactttt

SEQ ID NO: 906656 - DNA, 22 bp, Artificial Sequence
  chemically synthesized
caagcatctcgacaacttttta

SEQ ID NO: 906657 - DNA, 22 bp, Artificial Sequence
  chemically synthesized
aagcatctcgacaactttttac

SEQ ID NO: 906658 - DNA, 22 bp, Artificial Sequence
  chemically synthesized
tggaagcattttccctgtaaaa

SEQ ID NO: 906659 - DNA, 22 bp, Artificial Sequence
  chemically synthesized
gttgtggaagcattttccctgt

SEQ ID NO: 906660 - DNA, 22 bp, Artificial Sequence
  chemically synthesized
gacaactttttacagggaaaat

SEQ ID NO: 906661 - DNA, 22 bp, Artificial Sequence
  chemically synthesized
ctagttgtggaagcattttccc

SEQ ID NO: 906662 - DNA, 22 bp, Artificial Sequence
  chemically synthesized
tttacagggaaaatgcttccac

SEQ ID NO: 906663 - DNA, 22 bp, Artificial Sequence
  chemically synthesized
atcctgctagttgtggaagcat

SEQ ID NO: 906664 - DNA, 22 bp, Artificial Sequence
  chemically synthesized
ttacagggaaaatgcttccaca

SEQ ID NO: 906665 - DNA, 22 bp, Artificial Sequence
  chemically synthesized
catcctgctagttgtggaagca

SEQ ID NO: 906666 - DNA, 22 bp, Artificial Sequence
  chemically synthesized
tacagggaaaatgcttccacaa

SEQ ID NO: 906667 - DNA, 22 bp, Artificial Sequence
  chemically synthesized
acagggaaaatgcttccacaac

SEQ ID NO: 906668 - DNA, 22 bp, Artificial Sequence
  chemically synthesized
ttcatcctgctagttgtggaag

SEQ ID NO: 906669 - DNA, 22 bp, Artificial Sequence
  chemically synthesized
cagggaaaatgcttccacaact

SEQ ID NO: 906670 - DNA, 22 bp, Artificial Sequence
  chemically synthesized
cttcatcctgctagttgtggaa

SEQ ID NO: 906671 - DNA, 22 bp, Artificial Sequence
  chemically synthesized
tcttcatcctgctagttgtgga

SEQ ID NO: 906672 - DNA, 22 bp, Artificial Sequence
  chemically synthesized
gaaagcattttcttcatcctgc

SEQ ID NO: 906673 - DNA, 22 bp, Artificial Sequence
  chemically synthesized
ggaaagcattttcttcatcctg

SEQ ID NO: 906674 - DNA, 22 bp, Artificial Sequence
  chemically synthesized
ccacaactagcaggatgaagaa

SEQ ID NO: 906675 - DNA, 22 bp, Artificial Sequence
  chemically synthesized
ttggaaagcattttcttcatcc

SEQ ID NO: 906676 - DNA, 22 bp, Artificial Sequence
  chemically synthesized
cacaactagcaggatgaagaaa

SEQ ID NO: 906677 - DNA, 22 bp, Artificial Sequence
  chemically synthesized
gcaggatgaagaaaatgctttc

SEQ ID NO: 906678 - DNA, 22 bp, Artificial Sequence
  chemically synthesized
aatgaactcttggaaagcattt

SEQ ID NO: 906679 - DNA, 22 bp, Artificial Sequence
  chemically synthesized
ggattcaatgaactcttggaaa

SEQ ID NO: 906680 - DNA, 22 bp, Artificial Sequence
  chemically synthesized
gggattcaatgaactcttggaa

SEQ ID NO: 906681 - DNA, 22 bp, Artificial Sequence
  chemically synthesized
tgggattcaatgaactcttgga

SEQ ID NO: 906682 - DNA, 22 bp, Artificial Sequence
  chemically synthesized
atgctttgggattcaatgaact

SEQ ID NO: 906683 - DNA, 22 bp, Artificial Sequence
  chemically synthesized
tccaagagttcattgaatccca

SEQ ID NO: 906684 - DNA, 22 bp, Artificial Sequence
  chemically synthesized
ccaagagttcattgaatcccaa

SEQ ID NO: 906685 - DNA, 22 bp, Artificial Sequence
  chemically synthesized
caagagttcattgaatcccaaa

SEQ ID NO: 906686 - DNA, 22 bp, Artificial Sequence
  chemically synthesized
tagcataaaaattcatgctttg

SEQ ID NO: 906687 - DNA, 22 bp, Artificial Sequence
  chemically synthesized
attgaatcccaaagcatgaatt

SEQ ID NO: 906688 - DNA, 22 bp, Artificial Sequence
  chemically synthesized
ctgtagcataaaaattcatgct

SEQ ID NO: 906689 - DNA, 22 bp, Artificial Sequence
  chemically synthesized
ttcctgtagcataaaaattcat

SEQ ID NO: 906690 - DNA, 22 bp, Artificial Sequence
  chemically synthesized
aatcccaaagcatgaattttta

SEQ ID NO: 906691 - DNA, 22 bp, Artificial Sequence
  chemically synthesized
attcctgtagcataaaaattca

SEQ ID NO: 906692 - DNA, 22 bp, Artificial Sequence
  chemically synthesized
ttatgctacaggaataaacaca

SEQ ID NO: 906693 - DNA, 22 bp, Artificial Sequence
  chemically synthesized
tatgctacaggaataaacacac

SEQ ID NO: 906694 - DNA, 22 bp, Artificial Sequence
  chemically synthesized
atgctacaggaataaacacact

SEQ ID NO: 906695 - DNA, 22 bp, Artificial Sequence
  chemically synthesized
tgctacaggaataaacacactt

SEQ ID NO: 906696 - DNA, 22 bp, Artificial Sequence
  chemically synthesized
ccaagaagaaataagtgtgttt

SEQ ID NO: 906697 - DNA, 22 bp, Artificial Sequence
  chemically synthesized
gccaagaagaaataagtgtgtt

SEQ ID NO: 906698 - DNA, 22 bp, Artificial Sequence
  chemically synthesized
tgccaagaagaaataagtgtgt

SEQ ID NO: 906699 - DNA, 22 bp, Artificial Sequence
  chemically synthesized
ttgccaagaagaaataagtgtg

SEQ ID NO: 906700 - DNA, 22 bp, Artificial Sequence
  chemically synthesized
caggaataaacacacttatttc

SEQ ID NO: 906701 - DNA, 22 bp, Artificial Sequence
  chemically synthesized
cagtcaacacatttttgccaag

SEQ ID NO: 906702 - DNA, 22 bp, Artificial Sequence
  chemically synthesized
atttcttcttggcaaaaatgtg

SEQ ID NO: 906703 - DNA, 22 bp, Artificial Sequence
  chemically synthesized
tttcttcttggcaaaaatgtgt

SEQ ID NO: 906704 - DNA, 22 bp, Artificial Sequence
  chemically synthesized
cttcttggcaaaaatgtgttga

SEQ ID NO: 906705 - DNA, 22 bp, Artificial Sequence
  chemically synthesized
ttcttggcaaaaatgtgttgac

SEQ ID NO: 906706 - DNA, 22 bp, Artificial Sequence
  chemically synthesized
cttggcaaaaatgtgttgactg

SEQ ID NO: 906707 - DNA, 22 bp, Artificial Sequence
  chemically synthesized
ttggcaaaaatgtgttgactgt

SEQ ID NO: 906708 - DNA, 22 bp, Artificial Sequence
  chemically synthesized
ggcaaaaatgtgttgactgtaa

SEQ ID NO: 906709 - DNA, 22 bp, Artificial Sequence
  chemically synthesized
gcaaaaatgtgttgactgtaac

SEQ ID NO: 906710 - DNA, 22 bp, Artificial Sequence
  chemically synthesized
atcaaagtaggaaccgttacag

SEQ ID NO: 906711 - DNA, 22 bp, Artificial Sequence
  chemically synthesized
ttaatcaaagtaggaaccgtta

SEQ ID NO: 906712 - DNA, 22 bp, Artificial Sequence
  chemically synthesized
attaatcaaagtaggaaccgtt

SEQ ID NO: 906713 - DNA, 22 bp, Artificial Sequence
  chemically synthesized
tattaatcaaagtaggaaccgt

SEQ ID NO: 906714 - DNA, 22 bp, Artificial Sequence
  chemically synthesized
actgtaacggttcctactttga

SEQ ID NO: 906715 - DNA, 22 bp, Artificial Sequence
  chemically synthesized
taacggttcctactttgattaa

SEQ ID NO: 906716 - DNA, 22 bp, Artificial Sequence
  chemically synthesized
aagcacatctttattaatcaaa

SEQ ID NO: 906717 - DNA, 22 bp, Artificial Sequence
  chemically synthesized
ggctcaagcacatctttattaa

SEQ ID NO: 906718 - DNA, 22 bp, Artificial Sequence
  chemically synthesized
ctactttgattaataaagatgt

SEQ ID NO: 906719 - DNA, 22 bp, Artificial Sequence
  chemically synthesized
ctttgattaataaagatgtgct

SEQ ID NO: 906720 - DNA, 22 bp, Artificial Sequence
  chemically synthesized
taactaggctcaagcacatctt

SEQ ID NO: 906721 - DNA, 22 bp, Artificial Sequence
  chemically synthesized
tgattaataaagatgtgcttga

SEQ ID NO: 906722 - DNA, 22 bp, Artificial Sequence
  chemically synthesized
gattaataaagatgtgcttgag

SEQ ID NO: 906723 - DNA, 22 bp, Artificial Sequence
  chemically synthesized
attaataaagatgtgcttgagc

SEQ ID NO: 906724 - DNA, 22 bp, Artificial Sequence
  chemically synthesized
aatcattataactaggctcaag

SEQ ID NO: 906725 - DNA, 22 bp, Artificial Sequence
  chemically synthesized
ataaagatgtgcttgagcctag

SEQ ID NO: 906726 - DNA, 22 bp, Artificial Sequence
  chemically synthesized
aaatcattataactaggctcaa

SEQ ID NO: 906727 - DNA, 22 bp, Artificial Sequence
  chemically synthesized
taaatcattataactaggctca

SEQ ID NO: 906728 - DNA, 22 bp, Artificial Sequence
  chemically synthesized
gagcctagttataatgatttaa

SEQ ID NO: 906729 - DNA, 22 bp, Artificial Sequence
  chemically synthesized
ggaccgtgaattttaaatcatt

SEQ ID NO: 906730 - DNA, 22 bp, Artificial Sequence
  chemically synthesized
agcctagttataatgatttaaa

SEQ ID NO: 906731 - DNA, 22 bp, Artificial Sequence
  chemically synthesized
gggaccgtgaattttaaatcat

SEQ ID NO: 906732 - DNA, 22 bp, Artificial Sequence
  chemically synthesized
gttataatgatttaaaattcac

SEQ ID NO: 906733 - DNA, 22 bp, Artificial Sequence
  chemically synthesized
cagtttgggaccgtgaatttta

SEQ ID NO: 906734 - DNA, 22 bp, Artificial Sequence
  chemically synthesized
taatgatttaaaattcacggtc

SEQ ID NO: 906735 - DNA, 22 bp, Artificial Sequence
  chemically synthesized
aaaattcacggtcccaaactgc

SEQ ID NO: 906736 - DNA, 22 bp, Artificial Sequence
  chemically synthesized
aaattcacggtcccaaactgca

SEQ ID NO: 906737 - DNA, 22 bp, Artificial Sequence
  chemically synthesized
gtgcaaaagaaattgcagtttg

SEQ ID NO: 906738 - DNA, 22 bp, Artificial Sequence
  chemically synthesized
acggtcccaaactgcaatttct

SEQ ID NO: 906739 - DNA, 22 bp, Artificial Sequence
  chemically synthesized
ggttggtgcaaaagaaattgca

SEQ ID NO: 906740 - DNA, 22 bp, Artificial Sequence
  chemically synthesized
agatatattaggttggtgcaaa

SEQ ID NO: 906741 - DNA, 22 bp, Artificial Sequence
  chemically synthesized
caatttcttttgcaccaaccta

SEQ ID NO: 906742 - DNA, 22 bp, Artificial Sequence
  chemically synthesized
cttttgcaccaacctaatatat

SEQ ID NO: 906743 - DNA, 22 bp, Artificial Sequence
  chemically synthesized
ttttgcaccaacctaatatatc

SEQ ID NO: 906744 - DNA, 22 bp, Artificial Sequence
  chemically synthesized
ttgcaccaacctaatatatctc

SEQ ID NO: 906745 - DNA, 22 bp, Artificial Sequence
  chemically synthesized
caaaaatggactgagatatatt

SEQ ID NO: 906746 - DNA, 22 bp, Artificial Sequence
  chemically synthesized
tgcaccaacctaatatatctca

SEQ ID NO: 906747 - DNA, 22 bp, Artificial Sequence
  chemically synthesized
gcaccaacctaatatatctcag

SEQ ID NO: 906748 - DNA, 22 bp, Artificial Sequence
  chemically synthesized
caccaacctaatatatctcagt

SEQ ID NO: 906749 - DNA, 22 bp, Artificial Sequence
  chemically synthesized
atatatctcagtccatttttgt

SEQ ID NO: 906750 - DNA, 22 bp, Artificial Sequence
  chemically synthesized
agtccatttttgtagggccatt

SEQ ID NO: 906751 - DNA, 22 bp, Artificial Sequence
  chemically synthesized
gaaacaggaacaaaaatggccc

SEQ ID NO: 906752 - DNA, 22 bp, Artificial Sequence
  chemically synthesized
acctggaaacaggaacaaaaat

SEQ ID NO: 906753 - DNA, 22 bp, Artificial Sequence
  chemically synthesized
ttgtagggccatttttgttcct

SEQ ID NO: 906754 - DNA, 22 bp, Artificial Sequence
  chemically synthesized
tcacctggaaacaggaacaaaa

SEQ ID NO: 906755 - DNA, 22 bp, Artificial Sequence
  chemically synthesized
tgtagggccatttttgttcctg

SEQ ID NO: 906756 - DNA, 22 bp, Artificial Sequence
  chemically synthesized
ctcacctggaaacaggaacaaa

SEQ ID NO: 906757 - DNA, 22 bp, Artificial Sequence
  chemically synthesized
gtagggccatttttgttcctgt

SEQ ID NO: 906758 - DNA, 22 bp, Artificial Sequence
  chemically synthesized
tctcacctggaaacaggaacaa

SEQ ID NO: 906759 - DNA, 22 bp, Artificial Sequence
  chemically synthesized
tagggccatttttgttcctgtt

SEQ ID NO: 906760 - DNA, 22 bp, Artificial Sequence
  chemically synthesized
agttttctcacctggaaacagg

SEQ ID NO: 906761 - DNA, 22 bp, Artificial Sequence
  chemically synthesized
ttgttcctgtttccaggtgaga

SEQ ID NO: 906762 - DNA, 22 bp, Artificial Sequence
  chemically synthesized
tggtctcagttttctcacctgg

SEQ ID NO: 906763 - DNA, 22 bp, Artificial Sequence
  chemically synthesized
tgttcctgtttccaggtgagaa

SEQ ID NO: 906764 - DNA, 22 bp, Artificial Sequence
  chemically synthesized
gttcctgtttccaggtgagaaa

SEQ ID NO: 906765 - DNA, 22 bp, Artificial Sequence
  chemically synthesized
tgtggtctcagttttctcacct

SEQ ID NO: 906766 - DNA, 22 bp, Artificial Sequence
  chemically synthesized
ttcctgtttccaggtgagaaaa

SEQ ID NO: 906767 - DNA, 22 bp, Artificial Sequence
  chemically synthesized
tctgtggtctcagttttctcac

SEQ ID NO: 906768 - DNA, 22 bp, Artificial Sequence
  chemically synthesized
ctgtttccaggtgagaaaactg

SEQ ID NO: 906769 - DNA, 22 bp, Artificial Sequence
  chemically synthesized
tttccaggtgagaaaactgaga

SEQ ID NO: 906770 - DNA, 22 bp, Artificial Sequence
  chemically synthesized
ccaggtgagaaaactgagacca

SEQ ID NO: 906771 - DNA, 22 bp, Artificial Sequence
  chemically synthesized
caggtgagaaaactgagaccac

SEQ ID NO: 906772 - DNA, 22 bp, Artificial Sequence
  chemically synthesized
tgtcatctctctgtggtctcag

SEQ ID NO: 906773 - DNA, 22 bp, Artificial Sequence
  chemically synthesized
gctgtgtcatctctctgtggtc

SEQ ID NO: 906774 - DNA, 22 bp, Artificial Sequence
  chemically synthesized
ctagctgtgtcatctctctgtg

SEQ ID NO: 906775 - DNA, 22 bp, Artificial Sequence
  chemically synthesized
actagctgtgtcatctctctgt

SEQ ID NO: 906776 - DNA, 22 bp, Artificial Sequence
  chemically synthesized
cttactagctgtgtcatctctc

SEQ ID NO: 906777 - DNA, 22 bp, Artificial Sequence
  chemically synthesized
agaccacagagagatgacacag

SEQ ID NO: 906778 - DNA, 22 bp, Artificial Sequence
  chemically synthesized
cacaaattccttactagctgtg

SEQ ID NO: 906779 - DNA, 22 bp, Artificial Sequence
  chemically synthesized
ccacaaattccttactagctgt

SEQ ID NO: 906780 - DNA, 22 bp, Artificial Sequence
  chemically synthesized
ccaaataatcgccttccacaaa

SEQ ID NO: 906781 - DNA, 22 bp, Artificial Sequence
  chemically synthesized
gtaaggaatttgtggaaggcga

SEQ ID NO: 906782 - DNA, 22 bp, Artificial Sequence
  chemically synthesized
tggggctgccaaataatcgcct

SEQ ID NO: 906783 - DNA, 22 bp, Artificial Sequence
  chemically synthesized
attgtggggctgccaaataatc

SEQ ID NO: 906784 - DNA, 22 bp, Artificial Sequence
  chemically synthesized
gtggaaggcgattatttggcag

SEQ ID NO: 906785 - DNA, 22 bp, Artificial Sequence
  chemically synthesized
tggaaggcgattatttggcagc

SEQ ID NO: 906786 - DNA, 22 bp, Artificial Sequence
  chemically synthesized
tttggcagccccacaattaatc

SEQ ID NO: 906787 - DNA, 22 bp, Artificial Sequence
  chemically synthesized
ggcagccccacaattaatcacg

SEQ ID NO: 906788 - DNA, 22 bp, Artificial Sequence
  chemically synthesized
gcagccccacaattaatcacgc

SEQ ID NO: 906789 - DNA, 22 bp, Artificial Sequence
  chemically synthesized
cacaaaggcatgaatccaagag

SEQ ID NO: 906790 - DNA, 22 bp, Artificial Sequence
  chemically synthesized
atcacgcctcttggattcatgc

SEQ ID NO: 906791 - DNA, 22 bp, Artificial Sequence
  chemically synthesized
ttggattcatgcctttgtgtag

SEQ ID NO: 906792 - DNA, 22 bp, Artificial Sequence
  chemically synthesized
ggattcatgcctttgtgtagtc

SEQ ID NO: 906793 - DNA, 22 bp, Artificial Sequence
  chemically synthesized
gattcatgcctttgtgtagtcc

SEQ ID NO: 906794 - DNA, 22 bp, Artificial Sequence
  chemically synthesized
atgcctttgtgtagtcccttct

SEQ ID NO: 906795 - DNA, 22 bp, Artificial Sequence
  chemically synthesized
agaatcaaaatgagaagggact

SEQ ID NO: 906796 - DNA, 22 bp, Artificial Sequence
  chemically synthesized
tgtgtagtcccttctcattttg

SEQ ID NO: 906797 - DNA, 22 bp, Artificial Sequence
  chemically synthesized
gtgtagtcccttctcattttga

SEQ ID NO: 906798 - DNA, 22 bp, Artificial Sequence
  chemically synthesized
tgtagtcccttctcattttgat

SEQ ID NO: 906799 - DNA, 22 bp, Artificial Sequence
  chemically synthesized
ctcattttgattctgaacttgg

SEQ ID NO: 906800 - DNA, 22 bp, Artificial Sequence
  chemically synthesized
tcattttgattctgaacttggc

SEQ ID NO: 906801 - DNA, 22 bp, Artificial Sequence
  chemically synthesized
attttgattctgaacttggcca

SEQ ID NO: 906802 - DNA, 22 bp, Artificial Sequence
  chemically synthesized
tgattctgaacttggccatatg

SEQ ID NO: 906803 - DNA, 22 bp, Artificial Sequence
  chemically synthesized
gccaaagccaggcatatggcca

SEQ ID NO: 906804 - DNA, 22 bp, Artificial Sequence
  chemically synthesized
gattctgaacttggccatatgc

SEQ ID NO: 906805 - DNA, 22 bp, Artificial Sequence
  chemically synthesized
attctgaacttggccatatgcc

SEQ ID NO: 906806 - DNA, 22 bp, Artificial Sequence
  chemically synthesized
tgaacttggccatatgcctggc

SEQ ID NO: 906807 - DNA, 22 bp, Artificial Sequence
  chemically synthesized
aacttggccatatgcctggctt

SEQ ID NO: 906808 - DNA, 22 bp, Artificial Sequence
  chemically synthesized
tcccattggccaaagccaggca

SEQ ID NO: 906809 - DNA, 22 bp, Artificial Sequence
  chemically synthesized
ctatcccattggccaaagccag

SEQ ID NO: 906810 - DNA, 22 bp, Artificial Sequence
  chemically synthesized
ggccatatgcctggctttggcc

SEQ ID NO: 906811 - DNA, 22 bp, Artificial Sequence
  chemically synthesized
gccatatgcctggctttggcca

SEQ ID NO: 906812 - DNA, 22 bp, Artificial Sequence
  chemically synthesized
ctactatcccattggccaaagc

SEQ ID NO: 906813 - DNA, 22 bp, Artificial Sequence
  chemically synthesized
gctactatcccattggccaaag

SEQ ID NO: 906814 - DNA, 22 bp, Artificial Sequence
  chemically synthesized
tatcacacttgctactatccca

SEQ ID NO: 906815 - DNA, 22 bp, Artificial Sequence
  chemically synthesized
gctttggccaatgggatagtag

SEQ ID NO: 906816 - DNA, 22 bp, Artificial Sequence
  chemically synthesized
gtatcacacttgctactatccc

SEQ ID NO: 906817 - DNA, 22 bp, Artificial Sequence
  chemically synthesized
tttgtatcacacttgctactat

SEQ ID NO: 906818 - DNA, 22 bp, Artificial Sequence
  chemically synthesized
tggccaatgggatagtagcaag

SEQ ID NO: 906819 - DNA, 22 bp, Artificial Sequence
  chemically synthesized
ggccaatgggatagtagcaagt

SEQ ID NO: 906820 - DNA, 22 bp, Artificial Sequence
  chemically synthesized
tgtttgtatcacacttgctact

SEQ ID NO: 906821 - DNA, 22 bp, Artificial Sequence
  chemically synthesized
gccaatgggatagtagcaagtg

SEQ ID NO: 906822 - DNA, 22 bp, Artificial Sequence
  chemically synthesized
ctgtttgtatcacacttgctac

SEQ ID NO: 906823 - DNA, 22 bp, Artificial Sequence
  chemically synthesized
tcaagcttctgtttgtatcaca

SEQ ID NO: 906824 - DNA, 22 bp, Artificial Sequence
  chemically synthesized
atcaagcttctgtttgtatcac

SEQ ID NO: 906825 - DNA, 22 bp, Artificial Sequence
  chemically synthesized
aaagacttatcaagcttctgtt

SEQ ID NO: 906826 - DNA, 22 bp, Artificial Sequence
  chemically synthesized
caaagacttatcaagcttctgt

SEQ ID NO: 906827 - DNA, 22 bp, Artificial Sequence
  chemically synthesized
gataagtctttgaagattggtg

SEQ ID NO: 906828 - DNA, 22 bp, Artificial Sequence
  chemically synthesized
caaaagaacaagcaccaatctt

SEQ ID NO: 906829 - DNA, 22 bp, Artificial Sequence
  chemically synthesized
ataagtctttgaagattggtgc

SEQ ID NO: 906830 - DNA, 22 bp, Artificial Sequence
  chemically synthesized
ccaaaagaacaagcaccaatct

SEQ ID NO: 906831 - DNA, 22 bp, Artificial Sequence
  chemically synthesized
tgaagattggtgcttgttcttt

SEQ ID NO: 906832 - DNA, 22 bp, Artificial Sequence
  chemically synthesized
gaagattggtgcttgttctttt

SEQ ID NO: 906833 - DNA, 22 bp, Artificial Sequence
  chemically synthesized
aagattggtgcttgttcttttg

SEQ ID NO: 906834 - DNA, 22 bp, Artificial Sequence
  chemically synthesized
tgaagaagccttccaaaagaac

SEQ ID NO: 906835 - DNA, 22 bp, Artificial Sequence
  chemically synthesized
tgtgaagaagccttccaaaaga

SEQ ID NO: 906836 - DNA, 22 bp, Artificial Sequence
  chemically synthesized
gtgcttgttcttttggaaggct

SEQ ID NO: 906837 - DNA, 22 bp, Artificial Sequence
  chemically synthesized
agttctgtgaagaagccttcca

SEQ ID NO: 906838 - DNA, 22 bp, Artificial Sequence
  chemically synthesized
gttcttttggaaggcttcttca

SEQ ID NO: 906839 - DNA, 22 bp, Artificial Sequence
  chemically synthesized
ttcttttggaaggcttcttcac

SEQ ID NO: 906840 - DNA, 22 bp, Artificial Sequence
  chemically synthesized
gtggttgagttctgtgaagaag

SEQ ID NO: 906841 - DNA, 22 bp, Artificial Sequence
  chemically synthesized
ggtggttgagttctgtgaagaa

SEQ ID NO: 906842 - DNA, 22 bp, Artificial Sequence
  chemically synthesized
ttttggaaggcttcttcacaga

SEQ ID NO: 906843 - DNA, 22 bp, Artificial Sequence
  chemically synthesized
ttggaaggcttcttcacagaac

SEQ ID NO: 906844 - DNA, 22 bp, Artificial Sequence
  chemically synthesized
tggaaggcttcttcacagaact

SEQ ID NO: 906845 - DNA, 22 bp, Artificial Sequence
  chemically synthesized
ggaaggcttcttcacagaactc

SEQ ID NO: 906846 - DNA, 22 bp, Artificial Sequence
  chemically synthesized
gaaggcttcttcacagaactca

SEQ ID NO: 906847 - DNA, 22 bp, Artificial Sequence
  chemically synthesized
cccacagcttggtggttgagtt

SEQ ID NO: 906848 - DNA, 22 bp, Artificial Sequence
  chemically synthesized
ccccacagcttggtggttgagt

SEQ ID NO: 906849 - DNA, 22 bp, Artificial Sequence
  chemically synthesized
cttcacagaactcaaccaccaa

SEQ ID NO: 906850 - DNA, 22 bp, Artificial Sequence
  chemically synthesized
ttcacagaactcaaccaccaag

SEQ ID NO: 906851 - DNA, 22 bp, Artificial Sequence
  chemically synthesized
gcttccccacagcttggtggtt

SEQ ID NO: 906852 - DNA, 22 bp, Artificial Sequence
  chemically synthesized
ggcttccccacagcttggtggt

SEQ ID NO: 906853 - DNA, 22 bp, Artificial Sequence
  chemically synthesized
cacagaactcaaccaccaagct

SEQ ID NO: 906854 - DNA, 22 bp, Artificial Sequence
  chemically synthesized
tggcttccccacagcttggtgg

SEQ ID NO: 906855 - DNA, 22 bp, Artificial Sequence
  chemically synthesized
acagaactcaaccaccaagctg

SEQ ID NO: 906856 - DNA, 22 bp, Artificial Sequence
  chemically synthesized
ctttggcttccccacagcttgg

SEQ ID NO: 906857 - DNA, 22 bp, Artificial Sequence
  chemically synthesized
aaccaccaagctgtggggaagc

SEQ ID NO: 906858 - DNA, 22 bp, Artificial Sequence
  chemically synthesized
catgtgtctcctttggcttccc

SEQ ID NO: 906859 - DNA, 22 bp, Artificial Sequence
  chemically synthesized
tccatgtgtctcctttggcttc

SEQ ID NO: 906860 - DNA, 22 bp, Artificial Sequence
  chemically synthesized
ctccatgtgtctcctttggctt

SEQ ID NO: 906861 - DNA, 22 bp, Artificial Sequence
  chemically synthesized
tcttctccatgtgtctcctttg

SEQ ID NO: 906862 - DNA, 22 bp, Artificial Sequence
  chemically synthesized
tggggaagccaaaggagacaca

SEQ ID NO: 906863 - DNA, 22 bp, Artificial Sequence
  chemically synthesized
cattgtcttctccatgtgtctc

SEQ ID NO: 906864 - DNA, 22 bp, Artificial Sequence
  chemically synthesized
ccattgtcttctccatgtgtct

SEQ ID NO: 906865 - DNA, 22 bp, Artificial Sequence
  chemically synthesized
tttccattgtcttctccatgtg

SEQ ID NO: 906866 - DNA, 22 bp, Artificial Sequence
  chemically synthesized
gtttccattgtcttctccatgt

SEQ ID NO: 906867 - DNA, 22 bp, Artificial Sequence
  chemically synthesized
agtttgtttccattgtcttctc

SEQ ID NO: 906868 - DNA, 22 bp, Artificial Sequence
  chemically synthesized
gccatgagcctcagtttgtttc

SEQ ID NO: 906869 - DNA, 22 bp, Artificial Sequence
  chemically synthesized
ttggccatgagcctcagtttgt

SEQ ID NO: 906870 - DNA, 22 bp, Artificial Sequence
  chemically synthesized
aagctattggccatgagcctca

SEQ ID NO: 906871 - DNA, 22 bp, Artificial Sequence
  chemically synthesized
agctaaagctattggccatgag

SEQ ID NO: 906872 - DNA, 22 bp, Artificial Sequence
  chemically synthesized
agaactcagctaaagctattgg

SEQ ID NO: 906873 - DNA, 22 bp, Artificial Sequence
  chemically synthesized
aggctcatggccaatagcttta

SEQ ID NO: 906874 - DNA, 22 bp, Artificial Sequence
  chemically synthesized
ccagctgagaactcagctaaag

SEQ ID NO: 906875 - DNA, 22 bp, Artificial Sequence
  chemically synthesized
atggccaatagctttagctgag

SEQ ID NO: 906876 - DNA, 22 bp, Artificial Sequence
  chemically synthesized
cctaccagctgagaactcagct

SEQ ID NO: 906877 - DNA, 22 bp, Artificial Sequence
  chemically synthesized
gtgctgcctaccagctgagaac

SEQ ID NO: 906878 - DNA, 22 bp, Artificial Sequence
  chemically synthesized
tagctgagttctcagctggtag

SEQ ID NO: 906879 - DNA, 22 bp, Artificial Sequence
  chemically synthesized
agctgagttctcagctggtagg

SEQ ID NO: 906880 - DNA, 22 bp, Artificial Sequence
  chemically synthesized
gctgagttctcagctggtaggc

SEQ ID NO: 906881 - DNA, 22 bp, Artificial Sequence
  chemically synthesized
gcagttggtgctgcctaccagc

SEQ ID NO: 906882 - DNA, 22 bp, Artificial Sequence
  chemically synthesized
agttctcagctggtaggcagca

SEQ ID NO: 906883 - DNA, 22 bp, Artificial Sequence
  chemically synthesized
tcagctggtaggcagcaccaac

SEQ ID NO: 906884 - DNA, 22 bp, Artificial Sequence
  chemically synthesized
acatgactggcagttggtgctg

SEQ ID NO: 906885 - DNA, 22 bp, Artificial Sequence
  chemically synthesized
agctggtaggcagcaccaactg

SEQ ID NO: 906886 - DNA, 22 bp, Artificial Sequence
  chemically synthesized
actcacatgactggcagttggt

SEQ ID NO: 906887 - DNA, 22 bp, Artificial Sequence
  chemically synthesized
gtaggcagcaccaactgccagt

SEQ ID NO: 906888 - DNA, 22 bp, Artificial Sequence
  chemically synthesized
gaaagtccaaaatggcctcact

SEQ ID NO: 906889 - DNA, 22 bp, Artificial Sequence
  chemically synthesized
ccagtcatgtgagtgaggccat

SEQ ID NO: 906890 - DNA, 22 bp, Artificial Sequence
  chemically synthesized
ggaaagctggaaagtccaaaat

SEQ ID NO: 906891 - DNA, 22 bp, Artificial Sequence
  chemically synthesized
tggactttccagctttcccagt

SEQ ID NO: 906892 - DNA, 22 bp, Artificial Sequence
  chemically synthesized
ggactttccagctttcccagtg

SEQ ID NO: 906893 - DNA, 22 bp, Artificial Sequence
  chemically synthesized
gactttccagctttcccagtgt

SEQ ID NO: 906894 - DNA, 22 bp, Artificial Sequence
  chemically synthesized
atatcaaccaagacactgggaa

SEQ ID NO: 906895 - DNA, 22 bp, Artificial Sequence
  chemically synthesized
tccagctttcccagtgtcttgg

SEQ ID NO: 906896 - DNA, 22 bp, Artificial Sequence
  chemically synthesized
acctgatatcaaccaagacact

SEQ ID NO: 906897 - DNA, 22 bp, Artificial Sequence
  chemically synthesized
ccagctttcccagtgtcttggt

SEQ ID NO: 906898 - DNA, 22 bp, Artificial Sequence
  chemically synthesized
cacctgatatcaaccaagacac

SEQ ID NO: 906899 - DNA, 22 bp, Artificial Sequence
  chemically synthesized
cagctttcccagtgtcttggtt

SEQ ID NO: 906900 - DNA, 22 bp, Artificial Sequence
  chemically synthesized
cttcacctgatatcaaccaaga

SEQ ID NO: 906901 - DNA, 22 bp, Artificial Sequence
  chemically synthesized
tcccagtgtcttggttgatatc

SEQ ID NO: 906902 - DNA, 22 bp, Artificial Sequence
  chemically synthesized
cccagtgtcttggttgatatca

SEQ ID NO: 906903 - DNA, 22 bp, Artificial Sequence
  chemically synthesized
atctgcttcacctgatatcaac

SEQ ID NO: 906904 - DNA, 22 bp, Artificial Sequence
  chemically synthesized
ccagtgtcttggttgatatcag

SEQ ID NO: 906905 - DNA, 22 bp, Artificial Sequence
  chemically synthesized
tgatattcatctgcttcacctg

SEQ ID NO: 906906 - DNA, 22 bp, Artificial Sequence
  chemically synthesized
ggttgatatcaggtgaagcaga

SEQ ID NO: 906907 - DNA, 22 bp, Artificial Sequence
  chemically synthesized
gttgatatcaggtgaagcagat

SEQ ID NO: 906908 - DNA, 22 bp, Artificial Sequence
  chemically synthesized
actatgatattcatctgcttca

SEQ ID NO: 906909 - DNA, 22 bp, Artificial Sequence
  chemically synthesized
atatcaggtgaagcagatgaat

SEQ ID NO: 906910 - DNA, 22 bp, Artificial Sequence
  chemically synthesized
agagttgactatgatattcatc

SEQ ID NO: 906911 - DNA, 22 bp, Artificial Sequence
  chemically synthesized
tgagagttgactatgatattca

SEQ ID NO: 906912 - DNA, 22 bp, Artificial Sequence
  chemically synthesized
ataattctgagagttgactatg

SEQ ID NO: 906913 - DNA, 22 bp, Artificial Sequence
  chemically synthesized
tcataattctgagagttgacta

SEQ ID NO: 906914 - DNA, 22 bp, Artificial Sequence
  chemically synthesized
ctcataattctgagagttgact

SEQ ID NO: 906915 - DNA, 22 bp, Artificial Sequence
  chemically synthesized
cgatttctcataattctgagag

SEQ ID NO: 906916 - DNA, 22 bp, Artificial Sequence
  chemically synthesized
acgatttctcataattctgaga

SEQ ID NO: 906917 - DNA, 22 bp, Artificial Sequence
  chemically synthesized
tacgatttctcataattctgag

SEQ ID NO: 906918 - DNA, 22 bp, Artificial Sequence
  chemically synthesized
tcagaattatgagaaatcgtaa

SEQ ID NO: 906919 - DNA, 22 bp, Artificial Sequence
  chemically synthesized
aaataagatagttttacgattt

SEQ ID NO: 906920 - DNA, 22 bp, Artificial Sequence
  chemically synthesized
agaattatgagaaatcgtaaaa

SEQ ID NO: 906921 - DNA, 22 bp, Artificial Sequence
  chemically synthesized
aaaataagatagttttacgatt

SEQ ID NO: 906922 - DNA, 22 bp, Artificial Sequence
  chemically synthesized
gcttaaaataagatagttttac

SEQ ID NO: 906923 - DNA, 22 bp, Artificial Sequence
  chemically synthesized
tgagaaatcgtaaaactatctt

SEQ ID NO: 906924 - DNA, 22 bp, Artificial Sequence
  chemically synthesized
ctggcttaaaataagatagttt

SEQ ID NO: 906925 - DNA, 22 bp, Artificial Sequence
  chemically synthesized
aaagttactggcttaaaataag

SEQ ID NO: 906926 - DNA, 22 bp, Artificial Sequence
  chemically synthesized
taaaagttactggcttaaaata

SEQ ID NO: 906927 - DNA, 22 bp, Artificial Sequence
  chemically synthesized
tcttattttaagccagtaactt

SEQ ID NO: 906928 - DNA, 22 bp, Artificial Sequence
  chemically synthesized
attttaagccagtaacttttag

SEQ ID NO: 906929 - DNA, 22 bp, Artificial Sequence
  chemically synthesized
ttttaagccagtaacttttaga

SEQ ID NO: 906930 - DNA, 22 bp, Artificial Sequence
  chemically synthesized
tgcaacaaaccactctaaaagt

SEQ ID NO: 906931 - DNA, 22 bp, Artificial Sequence
  chemically synthesized
taagccagtaacttttagagtg

SEQ ID NO: 906932 - DNA, 22 bp, Artificial Sequence
  chemically synthesized
aagccagtaacttttagagtgg

SEQ ID NO: 906933 - DNA, 22 bp, Artificial Sequence
  chemically synthesized
agccagtaacttttagagtggt

SEQ ID NO: 906934 - DNA, 22 bp, Artificial Sequence
  chemically synthesized
tatatgctatgcaacaaaccac

SEQ ID NO: 906935 - DNA, 22 bp, Artificial Sequence
  chemically synthesized
cagttatatatgctatgcaaca

SEQ ID NO: 906936 - DNA, 22 bp, Artificial Sequence
  chemically synthesized
ttagagtggtttgttgcatagc

SEQ ID NO: 906937 - DNA, 22 bp, Artificial Sequence
  chemically synthesized
tagagtggtttgttgcatagca

SEQ ID NO: 906938 - DNA, 22 bp, Artificial Sequence
  chemically synthesized
agagtggtttgttgcatagcat

SEQ ID NO: 906939 - DNA, 22 bp, Artificial Sequence
  chemically synthesized
ttccagttatatatgctatgca

SEQ ID NO: 906940 - DNA, 22 bp, Artificial Sequence
  chemically synthesized
gagtggtttgttgcatagcata

SEQ ID NO: 906941 - DNA, 22 bp, Artificial Sequence
  chemically synthesized
tgttccagttatatatgctatg

SEQ ID NO: 906942 - DNA, 22 bp, Artificial Sequence
  chemically synthesized
actctgttccagttatatatgc

SEQ ID NO: 906943 - DNA, 22 bp, Artificial Sequence
  chemically synthesized
cactctgttccagttatatatg

SEQ ID NO: 906944 - DNA, 22 bp, Artificial Sequence
  chemically synthesized
gttgcatagcatatataactgg

SEQ ID NO: 906945 - DNA, 22 bp, Artificial Sequence
  chemically synthesized
ttgcatagcatatataactgga

SEQ ID NO: 906946 - DNA, 22 bp, Artificial Sequence
  chemically synthesized
atttcactctgttccagttata

SEQ ID NO: 906947 - DNA, 22 bp, Artificial Sequence
  chemically synthesized
gatttcactctgttccagttat

SEQ ID NO: 906948 - DNA, 22 bp, Artificial Sequence
  chemically synthesized
tgatttcactctgttccagtta

SEQ ID NO: 906949 - DNA, 22 bp, Artificial Sequence
  chemically synthesized
catagcatatataactggaaca

SEQ ID NO: 906950 - DNA, 22 bp, Artificial Sequence
  chemically synthesized
aaattttgatttcactctgttc

SEQ ID NO: 906951 - DNA, 22 bp, Artificial Sequence
  chemically synthesized
gttcaaattttgatttcactct

SEQ ID NO: 906952 - DNA, 22 bp, Artificial Sequence
  chemically synthesized
cctggttcaaattttgatttca

SEQ ID NO: 906953 - DNA, 22 bp, Artificial Sequence
  chemically synthesized
tgcctggttcaaattttgattt

SEQ ID NO: 906954 - DNA, 22 bp, Artificial Sequence
  chemically synthesized
gaacagagtgaaatcaaaattt

SEQ ID NO: 906955 - DNA, 22 bp, Artificial Sequence
  chemically synthesized
ctctgcctggttcaaattttga

SEQ ID NO: 906956 - DNA, 22 bp, Artificial Sequence
  chemically synthesized
ctactctgcctggttcaaattt

SEQ ID NO: 906957 - DNA, 22 bp, Artificial Sequence
  chemically synthesized
gacatgttactactctgcctgg

SEQ ID NO: 906958 - DNA, 22 bp, Artificial Sequence
  chemically synthesized
gttcgacatgttactactctgc

SEQ ID NO: 906959 - DNA, 22 bp, Artificial Sequence
  chemically synthesized
gaaccaggcagagtagtaacat

SEQ ID NO: 906960 - DNA, 22 bp, Artificial Sequence
  chemically synthesized
aaccaggcagagtagtaacatg

SEQ ID NO: 906961 - DNA, 22 bp, Artificial Sequence
  chemically synthesized
tatagttagttcgacatgttac

SEQ ID NO: 906962 - DNA, 22 bp, Artificial Sequence
  chemically synthesized
atcctgtatagttagttcgaca

SEQ ID NO: 906963 - DNA, 22 bp, Artificial Sequence
  chemically synthesized
aatcctgtatagttagttcgac

SEQ ID NO: 906964 - DNA, 22 bp, Artificial Sequence
  chemically synthesized
taatcctgtatagttagttcga

SEQ ID NO: 906965 - DNA, 22 bp, Artificial Sequence
  chemically synthesized
ttaatcctgtatagttagttcg

SEQ ID NO: 906966 - DNA, 22 bp, Artificial Sequence
  chemically synthesized
tttaatcctgtatagttagttc

SEQ ID NO: 906967 - DNA, 22 bp, Artificial Sequence
  chemically synthesized
ttttaatcctgtatagttagtt

SEQ ID NO: 906968 - DNA, 22 bp, Artificial Sequence
  chemically synthesized
tttttaatcctgtatagttagt

SEQ ID NO: 906969 - DNA, 22 bp, Artificial Sequence
  chemically synthesized
ttttttttaatcctgtatagtt

SEQ ID NO: 906970 - DNA, 22 bp, Artificial Sequence
  chemically synthesized
agaagctgttttttttaatcct

SEQ ID NO: 906971 - DNA, 22 bp, Artificial Sequence
  chemically synthesized
gagaagctgttttttttaatcc

SEQ ID NO: 906972 - DNA, 22 bp, Artificial Sequence
  chemically synthesized
tgagaagctgttttttttaatc

SEQ ID NO: 906973 - DNA, 22 bp, Artificial Sequence
  chemically synthesized
actatacaggattaaaaaaaac

SEQ ID NO: 906974 - DNA, 22 bp, Artificial Sequence
  chemically synthesized
actttgagaagctgtttttttt

SEQ ID NO: 906975 - DNA, 22 bp, Artificial Sequence
  chemically synthesized
cactttgagaagctgttttttt

SEQ ID NO: 906976 - DNA, 22 bp, Artificial Sequence
  chemically synthesized
tacaggattaaaaaaaacagct

SEQ ID NO: 906977 - DNA, 22 bp, Artificial Sequence
  chemically synthesized
cttcactttgagaagctgtttt

SEQ ID NO: 906978 - DNA, 22 bp, Artificial Sequence
  chemically synthesized
tgcttcactttgagaagctgtt

SEQ ID NO: 906979 - DNA, 22 bp, Artificial Sequence
  chemically synthesized
aaaaaaacagcttctcaaagtg

SEQ ID NO: 906980 - DNA, 22 bp, Artificial Sequence
  chemically synthesized
ctcaaagtgaagcagaacttta

SEQ ID NO: 906981 - DNA, 22 bp, Artificial Sequence
  chemically synthesized
tcaaagtgaagcagaactttat

SEQ ID NO: 906982 - DNA, 22 bp, Artificial Sequence
  chemically synthesized
aaagtgaagcagaactttatct

SEQ ID NO: 906983 - DNA, 22 bp, Artificial Sequence
  chemically synthesized
aaaaaacaaataaagataaagt

SEQ ID NO: 906984 - DNA, 22 bp, Artificial Sequence
  chemically synthesized
caaaaaacaaataaagataaag

SEQ ID NO: 906985 - DNA, 22 bp, Artificial Sequence
  chemically synthesized
tttcaaaaaacaaataaagata

SEQ ID NO: 906986 - DNA, 22 bp, Artificial Sequence
  chemically synthesized
atttcaaaaaacaaataaagat

SEQ ID NO: 906987 - DNA, 22 bp, Artificial Sequence
  chemically synthesized
tatctttatttgttttttgaaa

SEQ ID NO: 906988 - DNA, 22 bp, Artificial Sequence
  chemically synthesized
atctttatttgttttttgaaat

SEQ ID NO: 906989 - DNA, 22 bp, Artificial Sequence
  chemically synthesized
tctttatttgttttttgaaata

SEQ ID NO: 906990 - DNA, 22 bp, Artificial Sequence
  chemically synthesized
tatttgttttttgaaataaata

SEQ ID NO: 906991 - DNA, 22 bp, Artificial Sequence
  chemically synthesized
atttgttttttgaaataaatat

SEQ ID NO: 906992 - DNA, 22 bp, Artificial Sequence
  chemically synthesized
tttgttttttgaaataaatatt

SEQ ID NO: 906993 - DNA, 22 bp, Artificial Sequence
  chemically synthesized
gttttttgaaataaatattcta

SEQ ID NO: 906994 - DNA, 22 bp, Artificial Sequence
  chemically synthesized
gtatagccaatgtagaatattt

SEQ ID NO: 906995 - DNA, 22 bp, Artificial Sequence
  chemically synthesized
ttttttgaaataaatattctac

SEQ ID NO: 906996 - DNA, 22 bp, Artificial Sequence
  chemically synthesized
tttgaaataaatattctacatt

SEQ ID NO: 906997 - DNA, 22 bp, Artificial Sequence
  chemically synthesized
ttgaaataaatattctacattg

SEQ ID NO: 906998 - DNA, 22 bp, Artificial Sequence
  chemically synthesized
tgaaataaatattctacattgg

SEQ ID NO: 906999 - DNA, 22 bp, Artificial Sequence
  chemically synthesized
gaaataaatattctacattggc

SEQ ID NO: 907000 - DNA, 22 bp, Artificial Sequence
  chemically synthesized
aaataaatattctacattggct

SEQ ID NO: 907001 - DNA, 22 bp, Artificial Sequence
  chemically synthesized
gtatatcacgtagtctggtata

SEQ ID NO: 907002 - DNA, 22 bp, Artificial Sequence
  chemically synthesized
tacattggctataccagactac

SEQ ID NO: 907003 - DNA, 22 bp, Artificial Sequence
  chemically synthesized
cattggctataccagactacgt

SEQ ID NO: 907004 - DNA, 22 bp, Artificial Sequence
  chemically synthesized
gctataccagactacgtgatat

SEQ ID NO: 907005 - DNA, 22 bp, Artificial Sequence
  chemically synthesized
taccagactacgtgatatacta

SEQ ID NO: 907006 - DNA, 22 bp, Artificial Sequence
  chemically synthesized
cgtgatatactagtatgctatt

SEQ ID NO: 907007 - DNA, 22 bp, Artificial Sequence
  chemically synthesized
gtatgctattttaccttactgt

SEQ ID NO: 907008 - DNA, 22 bp, Artificial Sequence
  chemically synthesized
ttttaccttactgtgtctctct

SEQ ID NO: 907009 - DNA, 22 bp, Artificial Sequence
  chemically synthesized
taccttactgtgtctctcttcc

SEQ ID NO: 907010 - DNA, 22 bp, Artificial Sequence
  chemically synthesized
accttactgtgtctctcttcct

SEQ ID NO: 907011 - DNA, 22 bp, Artificial Sequence
  chemically synthesized
ccttactgtgtctctcttcctg

SEQ ID NO: 907012 - DNA, 22 bp, Artificial Sequence
  chemically synthesized
actgtgtctctcttcctgtttc

SEQ ID NO: 907013 - DNA, 22 bp, Artificial Sequence
  chemically synthesized
acataagagcaggaaacaggaa

SEQ ID NO: 907014 - DNA, 22 bp, Artificial Sequence
  chemically synthesized
ctgtgtctctcttcctgtttcc

SEQ ID NO: 907015 - DNA, 22 bp, Artificial Sequence
  chemically synthesized
tgtctctcttcctgtttcctgc

SEQ ID NO: 907016 - DNA, 22 bp, Artificial Sequence
  chemically synthesized
tatattcacataagagcaggaa

SEQ ID NO: 907017 - DNA, 22 bp, Artificial Sequence
  chemically synthesized
tcttcctgtttcctgctcttat

SEQ ID NO: 907018 - DNA, 22 bp, Artificial Sequence
  chemically synthesized
tctgtatattcacataagagca

SEQ ID NO: 907019 - DNA, 22 bp, Artificial Sequence
  chemically synthesized
ttcctgtttcctgctcttatgt

SEQ ID NO: 907020 - DNA, 22 bp, Artificial Sequence
  chemically synthesized
cctgtttcctgctcttatgtga

SEQ ID NO: 907021 - DNA, 22 bp, Artificial Sequence
  chemically synthesized
ctgtttcctgctcttatgtgaa

SEQ ID NO: 907022 - DNA, 22 bp, Artificial Sequence
  chemically synthesized
tttcctgctcttatgtgaatat

SEQ ID NO: 907023 - DNA, 22 bp, Artificial Sequence
  chemically synthesized
cctgctcttatgtgaatataca

SEQ ID NO: 907024 - DNA, 22 bp, Artificial Sequence
  chemically synthesized
ctgctcttatgtgaatatacag

SEQ ID NO: 907025 - DNA, 22 bp, Artificial Sequence
  chemically synthesized
ctcttatgtgaatatacagaca

SEQ ID NO: 907026 - DNA, 22 bp, Artificial Sequence
  chemically synthesized
ttatgtgaatatacagacaatc

SEQ ID NO: 907027 - DNA, 22 bp, Artificial Sequence
  chemically synthesized
atgtgaatatacagacaatcct

SEQ ID NO: 907028 - DNA, 22 bp, Artificial Sequence
  chemically synthesized
tgtgaatatacagacaatcctt

SEQ ID NO: 907029 - DNA, 22 bp, Artificial Sequence
  chemically synthesized
agagcaaagataatgtcaccag

SEQ ID NO: 907030 - DNA, 22 bp, Artificial Sequence
  chemically synthesized
ctgagagcaaagataatgtcac

SEQ ID NO: 907031 - DNA, 22 bp, Artificial Sequence
  chemically synthesized
ttcctgagagcaaagataatgt

SEQ ID NO: 907032 - DNA, 22 bp, Artificial Sequence
  chemically synthesized
gttcctgagagcaaagataatg

SEQ ID NO: 907033 - DNA, 22 bp, Artificial Sequence
  chemically synthesized
tgttcctgagagcaaagataat

SEQ ID NO: 907034 - DNA, 22 bp, Artificial Sequence
  chemically synthesized
tttgttcctgagagcaaagata

SEQ ID NO: 907035 - DNA, 22 bp, Artificial Sequence
  chemically synthesized
tctggtgacattatctttgctc

SEQ ID NO: 907036 - DNA, 22 bp, Artificial Sequence
  chemically synthesized
ctggtgacattatctttgctct

SEQ ID NO: 907037 - DNA, 22 bp, Artificial Sequence
  chemically synthesized
tggtgacattatctttgctctc

SEQ ID NO: 907038 - DNA, 22 bp, Artificial Sequence
  chemically synthesized
gtgacattatctttgctctcag

SEQ ID NO: 907039 - DNA, 22 bp, Artificial Sequence
  chemically synthesized
tctttgctctcaggaacaaaga

SEQ ID NO: 907040 - DNA, 22 bp, Artificial Sequence
  chemically synthesized
tgctctcaggaacaaagaatga

SEQ ID NO: 907041 - DNA, 22 bp, Artificial Sequence
  chemically synthesized
gctctcaggaacaaagaatgac

SEQ ID NO: 907042 - DNA, 22 bp, Artificial Sequence
  chemically synthesized
ctctcaggaacaaagaatgacc

SEQ ID NO: 907043 - DNA, 22 bp, Artificial Sequence
  chemically synthesized
tcaggaacaaagaatgacctta

SEQ ID NO: 907044 - DNA, 22 bp, Artificial Sequence
  chemically synthesized
aggaacaaagaatgaccttatt

SEQ ID NO: 907045 - DNA, 22 bp, Artificial Sequence
  chemically synthesized
attacatttacctatatcatca

SEQ ID NO: 907046 - DNA, 22 bp, Artificial Sequence
  chemically synthesized
ttacatttacctatatcatcac

SEQ ID NO: 907047 - DNA, 22 bp, Artificial Sequence
  chemically synthesized
catttacctatatcatcactac

SEQ ID NO: 907048 - DNA, 22 bp, Artificial Sequence
  chemically synthesized
aaatgtgaaaggggtagtgatg

SEQ ID NO: 907049 - DNA, 22 bp, Artificial Sequence
  chemically synthesized
acctatatcatcactacccctt

SEQ ID NO: 907050 - DNA, 22 bp, Artificial Sequence
  chemically synthesized
attaaaatgtgaaaggggtagt

SEQ ID NO: 907051 - DNA, 22 bp, Artificial Sequence
  chemically synthesized
cctatatcatcactaccccttt

SEQ ID NO: 907052 - DNA, 22 bp, Artificial Sequence
  chemically synthesized
tatcatcactacccctttcaca

SEQ ID NO: 907053 - DNA, 22 bp, Artificial Sequence
  chemically synthesized
gtgctaattaaaatgtgaaagg

SEQ ID NO: 907054 - DNA, 22 bp, Artificial Sequence
  chemically synthesized
ggtgctaattaaaatgtgaaag

SEQ ID NO: 907055 - DNA, 22 bp, Artificial Sequence
  chemically synthesized
caatttggtgctaattaaaatg

SEQ ID NO: 907056 - DNA, 22 bp, Artificial Sequence
  chemically synthesized
tacaatttggtgctaattaaaa

SEQ ID NO: 907057 - DNA, 22 bp, Artificial Sequence
  chemically synthesized
cccctttcacattttaattagc

SEQ ID NO: 907058 - DNA, 22 bp, Artificial Sequence
  chemically synthesized
ctacaatttggtgctaattaaa

SEQ ID NO: 907059 - DNA, 22 bp, Artificial Sequence
  chemically synthesized
tctacaatttggtgctaattaa

SEQ ID NO: 907060 - DNA, 22 bp, Artificial Sequence
  chemically synthesized
ttctacaatttggtgctaatta

SEQ ID NO: 907061 - DNA, 22 bp, Artificial Sequence
  chemically synthesized
tttttctacaatttggtgctaa

SEQ ID NO: 907062 - DNA, 22 bp, Artificial Sequence
  chemically synthesized
tcacattttaattagcaccaaa

SEQ ID NO: 907063 - DNA, 22 bp, Artificial Sequence
  chemically synthesized
cacattttaattagcaccaaat

SEQ ID NO: 907064 - DNA, 22 bp, Artificial Sequence
  chemically synthesized
acattttaattagcaccaaatt

SEQ ID NO: 907065 - DNA, 22 bp, Artificial Sequence
  chemically synthesized
cataattgtttttctacaattt

SEQ ID NO: 907066 - DNA, 22 bp, Artificial Sequence
  chemically synthesized
taattagcaccaaattgtagaa

SEQ ID NO: 907067 - DNA, 22 bp, Artificial Sequence
  chemically synthesized
acataattgtttttctacaatt

SEQ ID NO: 907068 - DNA, 22 bp, Artificial Sequence
  chemically synthesized
aattagcaccaaattgtagaaa

SEQ ID NO: 907069 - DNA, 22 bp, Artificial Sequence
  chemically synthesized
attagcaccaaattgtagaaaa

SEQ ID NO: 907070 - DNA, 22 bp, Artificial Sequence
  chemically synthesized
gcaccaaattgtagaaaaacaa

SEQ ID NO: 907071 - DNA, 22 bp, Artificial Sequence
  chemically synthesized
ataatttacataattgtttttc

SEQ ID NO: 907072 - DNA, 22 bp, Artificial Sequence
  chemically synthesized
ctaataatttacataattgttt

SEQ ID NO: 907073 - DNA, 22 bp, Artificial Sequence
  chemically synthesized
tgctaataatttacataattgt

SEQ ID NO: 907074 - DNA, 22 bp, Artificial Sequence
  chemically synthesized
tctctgctaataatttacataa

SEQ ID NO: 907075 - DNA, 22 bp, Artificial Sequence
  chemically synthesized
tagaaaaacaattatgtaaatt

SEQ ID NO: 907076 - DNA, 22 bp, Artificial Sequence
  chemically synthesized
tgtaaattattagcagagatag

SEQ ID NO: 907077 - DNA, 22 bp, Artificial Sequence
  chemically synthesized
aaagagacagagaggccactat

SEQ ID NO: 907078 - DNA, 22 bp, Artificial Sequence
  chemically synthesized
gaaagagacagagaggccacta

SEQ ID NO: 907079 - DNA, 22 bp, Artificial Sequence
  chemically synthesized
ttagcagagatagtggcctctc

SEQ ID NO: 907080 - DNA, 22 bp, Artificial Sequence
  chemically synthesized
gcagagatagtggcctctctgt

SEQ ID NO: 907081 - DNA, 22 bp, Artificial Sequence
  chemically synthesized
atcttgaaagagacagagaggc

SEQ ID NO: 907082 - DNA, 22 bp, Artificial Sequence
  chemically synthesized
agtcatattaatcttgaaagag

SEQ ID NO: 907083 - DNA, 22 bp, Artificial Sequence
  chemically synthesized
tctgtctctttcaagattaata

SEQ ID NO: 907084 - DNA, 22 bp, Artificial Sequence
  chemically synthesized
tgtctctttcaagattaatatg

SEQ ID NO: 907085 - DNA, 22 bp, Artificial Sequence
  chemically synthesized
accacaactcagtcatattaat

SEQ ID NO: 907086 - DNA, 22 bp, Artificial Sequence
  chemically synthesized
tctctttcaagattaatatgac

SEQ ID NO: 907087 - DNA, 22 bp, Artificial Sequence
  chemically synthesized
caccacaactcagtcatattaa

SEQ ID NO: 907088 - DNA, 22 bp, Artificial Sequence
  chemically synthesized
ttcaccacaactcagtcatatt

SEQ ID NO: 907089 - DNA, 22 bp, Artificial Sequence
  chemically synthesized
tttcaagattaatatgactgag

SEQ ID NO: 907090 - DNA, 22 bp, Artificial Sequence
  chemically synthesized
ttcttcaccacaactcagtcat

SEQ ID NO: 907091 - DNA, 22 bp, Artificial Sequence
  chemically synthesized
tcaagattaatatgactgagtt

SEQ ID NO: 907092 - DNA, 22 bp, Artificial Sequence
  chemically synthesized
attcttcaccacaactcagtca

SEQ ID NO: 907093 - DNA, 22 bp, Artificial Sequence
  chemically synthesized
caagattaatatgactgagttg

SEQ ID NO: 907094 - DNA, 22 bp, Artificial Sequence
  chemically synthesized
aagattaatatgactgagttgt

SEQ ID NO: 907095 - DNA, 22 bp, Artificial Sequence
  chemically synthesized
acttattcttcaccacaactca

SEQ ID NO: 907096 - DNA, 22 bp, Artificial Sequence
  chemically synthesized
atatgactgagttgtggtgaag

SEQ ID NO: 907097 - DNA, 22 bp, Artificial Sequence
  chemically synthesized
tcattgacttattcttcaccac

SEQ ID NO: 907098 - DNA, 22 bp, Artificial Sequence
  chemically synthesized
gtcattgacttattcttcacca

SEQ ID NO: 907099 - DNA, 22 bp, Artificial Sequence
  chemically synthesized
accttgtcattgacttattctt

SEQ ID NO: 907100 - DNA, 22 bp, Artificial Sequence
  chemically synthesized
agttgtggtgaagaataagtca

SEQ ID NO: 907101 - DNA, 22 bp, Artificial Sequence
  chemically synthesized
tggtgaagaataagtcaatgac

SEQ ID NO: 907102 - DNA, 22 bp, Artificial Sequence
  chemically synthesized
gaatggatgctgaccttgtcat

SEQ ID NO: 907103 - DNA, 22 bp, Artificial Sequence
  chemically synthesized
tggaatggatgctgaccttgtc

SEQ ID NO: 907104 - DNA, 22 bp, Artificial Sequence
  chemically synthesized
ctctggaatggatgctgacctt

SEQ ID NO: 907105 - DNA, 22 bp, Artificial Sequence
  chemically synthesized
cctctggaatggatgctgacct

SEQ ID NO: 907106 - DNA, 22 bp, Artificial Sequence
  chemically synthesized
aaaatcttcctctggaatggat

SEQ ID NO: 907107 - DNA, 22 bp, Artificial Sequence
  chemically synthesized
caaaatcttcctctggaatgga

SEQ ID NO: 907108 - DNA, 22 bp, Artificial Sequence
  chemically synthesized
tcaaaatcttcctctggaatgg

SEQ ID NO: 907109 - DNA, 22 bp, Artificial Sequence
  chemically synthesized
ttcaaaatcttcctctggaatg

SEQ ID NO: 907110 - DNA, 22 bp, Artificial Sequence
  chemically synthesized
tttcaaaatcttcctctggaat

SEQ ID NO: 907111 - DNA, 22 bp, Artificial Sequence
  chemically synthesized
ttttcaaaatcttcctctggaa

SEQ ID NO: 907112 - DNA, 22 bp, Artificial Sequence
  chemically synthesized
tttttcaaaatcttcctctgga

SEQ ID NO: 907113 - DNA, 22 bp, Artificial Sequence
  chemically synthesized
ttttttttcaaaatcttcctct

SEQ ID NO: 907114 - DNA, 22 bp, Artificial Sequence
  chemically synthesized
gttttttttcaaaatcttcctc

SEQ ID NO: 907115 - DNA, 22 bp, Artificial Sequence
  chemically synthesized
tgttttttttcaaaatcttcct

SEQ ID NO: 907116 - DNA, 22 bp, Artificial Sequence
  chemically synthesized
ttgttttttttcaaaatcttcc

SEQ ID NO: 907117 - DNA, 22 bp, Artificial Sequence
  chemically synthesized
tttttgttttttttcaaaatct

SEQ ID NO: 907118 - DNA, 22 bp, Artificial Sequence
  chemically synthesized
gtttttgttttttttcaaaatc

SEQ ID NO: 907119 - DNA, 22 bp, Artificial Sequence
  chemically synthesized
tgtttttgttttttttcaaaat

SEQ ID NO: 907120 - DNA, 22 bp, Artificial Sequence
  chemically synthesized
ttgtttttgttttttttcaaaa

SEQ ID NO: 907121 - DNA, 22 bp, Artificial Sequence
  chemically synthesized
cagaggaagattttgaaaaaaa

SEQ ID NO: 907122 - DNA, 22 bp, Artificial Sequence
  chemically synthesized
tttttgtttttgttttttttca

SEQ ID NO: 907123 - DNA, 22 bp, Artificial Sequence
  chemically synthesized
gtttttgtttttgttttttttc

SEQ ID NO: 907124 - DNA, 22 bp, Artificial Sequence
  chemically synthesized
tgtttttgtttttgtttttttt

SEQ ID NO: 907125 - DNA, 22 bp, Artificial Sequence
  chemically synthesized
ttttgtttttgtttttgttttt

SEQ ID NO: 907126 - DNA, 22 bp, Artificial Sequence
  chemically synthesized
gttttgtttttgtttttgtttt

SEQ ID NO: 907127 - DNA, 22 bp, Artificial Sequence
  chemically synthesized
tgttttgtttttgtttttgttt

SEQ ID NO: 907128 - DNA, 22 bp, Artificial Sequence
  chemically synthesized
ttttgttttgtttttgtttttg

SEQ ID NO: 907129 - DNA, 22 bp, Artificial Sequence
  chemically synthesized
gttttgttttgtttttgttttt

SEQ ID NO: 907130 - DNA, 22 bp, Artificial Sequence
  chemically synthesized
tgaaaaaaaacaaaaacaaaaa

SEQ ID NO: 907131 - DNA, 22 bp, Artificial Sequence
  chemically synthesized
tgttttgttttgtttttgtttt

SEQ ID NO: 907132 - DNA, 22 bp, Artificial Sequence
  chemically synthesized
gaaaaaaaacaaaaacaaaaac

SEQ ID NO: 907133 - DNA, 22 bp, Artificial Sequence
  chemically synthesized
aaaaaaaacaaaaacaaaaaca

SEQ ID NO: 907134 - DNA, 22 bp, Artificial Sequence
  chemically synthesized
ttttgttttgttttgtttttgt

SEQ ID NO: 907135 - DNA, 22 bp, Artificial Sequence
  chemically synthesized
gttttgttttgttttgtttttg

SEQ ID NO: 907136 - DNA, 22 bp, Artificial Sequence
  chemically synthesized
tgttttgttttgttttgttttt

SEQ ID NO: 907137 - DNA, 22 bp, Artificial Sequence
  chemically synthesized
ttttgttttgttttgttttgtt

SEQ ID NO: 907138 - DNA, 22 bp, Artificial Sequence
  chemically synthesized
gttttgttttgttttgttttgt

SEQ ID NO: 907139 - DNA, 22 bp, Artificial Sequence
  chemically synthesized
tgttttgttttgttttgttttg

SEQ ID NO: 907140 - DNA, 22 bp, Artificial Sequence
  chemically synthesized
ttttgttttgttttgttttgtt

SEQ ID NO: 907141 - DNA, 22 bp, Artificial Sequence
  chemically synthesized
gttttgttttgttttgttttgt

SEQ ID NO: 907142 - DNA, 22 bp, Artificial Sequence
  chemically synthesized
tgttttgttttgttttgttttg

SEQ ID NO: 907143 - DNA, 22 bp, Artificial Sequence
  chemically synthesized
ttgttttgttttgttttgtttt

SEQ ID NO: 907144 - DNA, 22 bp, Artificial Sequence
  chemically synthesized
tttttgttttgttttgttttgt

SEQ ID NO: 907145 - DNA, 22 bp, Artificial Sequence
  chemically synthesized
gtttttgttttgttttgttttg

SEQ ID NO: 907146 - DNA, 22 bp, Artificial Sequence
  chemically synthesized
tgtttttgttttgttttgtttt

SEQ ID NO: 907147 - DNA, 22 bp, Artificial Sequence
  chemically synthesized
ttttgtttttgttttgttttgt

SEQ ID NO: 907148 - DNA, 22 bp, Artificial Sequence
  chemically synthesized
gttttgtttttgttttgttttg

SEQ ID NO: 907149 - DNA, 22 bp, Artificial Sequence
  chemically synthesized
tgttttgtttttgttttgtttt

SEQ ID NO: 907150 - DNA, 22 bp, Artificial Sequence
  chemically synthesized
ttgttttgtttttgttttgttt

SEQ ID NO: 907151 - DNA, 22 bp, Artificial Sequence
  chemically synthesized
agtgtttttgttttgtttttgt

SEQ ID NO: 907152 - DNA, 22 bp, Artificial Sequence
  chemically synthesized
cccaaatgcctaagtgtttttg

SEQ ID NO: 907153 - DNA, 22 bp, Artificial Sequence
  chemically synthesized
ccccaaatgcctaagtgttttt

SEQ ID NO: 907154 - DNA, 22 bp, Artificial Sequence
  chemically synthesized
tccccaaatgcctaagtgtttt

SEQ ID NO: 907155 - DNA, 22 bp, Artificial Sequence
  chemically synthesized
agtgataagagcagcctttccc

SEQ ID NO: 907156 - DNA, 22 bp, Artificial Sequence
  chemically synthesized
aggcatttggggaaaggctgct

SEQ ID NO: 907157 - DNA, 22 bp, Artificial Sequence
  chemically synthesized
ggcatttggggaaaggctgctc

SEQ ID NO: 907158 - DNA, 22 bp, Artificial Sequence
  chemically synthesized
ggggaaaggctgctcttatcac

SEQ ID NO: 907159 - DNA, 22 bp, Artificial Sequence
  chemically synthesized
gggaaaggctgctcttatcact

SEQ ID NO: 907160 - DNA, 22 bp, Artificial Sequence
  chemically synthesized
cccaaataaatgtctcagtgat

SEQ ID NO: 907161 - DNA, 22 bp, Artificial Sequence
  chemically synthesized
acccaaataaatgtctcagtga

SEQ ID NO: 907162 - DNA, 22 bp, Artificial Sequence
  chemically synthesized
ttacccaaataaatgtctcagt

SEQ ID NO: 907163 - DNA, 22 bp, Artificial Sequence
  chemically synthesized
ctcttatcactgagacatttat

SEQ ID NO: 907164 - DNA, 22 bp, Artificial Sequence
  chemically synthesized
ttatcactgagacatttatttg

SEQ ID NO: 907165 - DNA, 22 bp, Artificial Sequence
  chemically synthesized
atcactgagacatttatttggg

SEQ ID NO: 907166 - DNA, 22 bp, Artificial Sequence
  chemically synthesized
tcactgagacatttatttgggt

SEQ ID NO: 907167 - DNA, 22 bp, Artificial Sequence
  chemically synthesized
tcgaaaaattcttacccaaata

SEQ ID NO: 907168 - DNA, 22 bp, Artificial Sequence
  chemically synthesized
agacatttatttgggtaagaat

SEQ ID NO: 907169 - DNA, 22 bp, Artificial Sequence
  chemically synthesized
gatacacctatcgaaaaattct

SEQ ID NO: 907170 - DNA, 22 bp, Artificial Sequence
  chemically synthesized
tagatacacctatcgaaaaatt

SEQ ID NO: 907171 - DNA, 22 bp, Artificial Sequence
  chemically synthesized
atttgggtaagaatttttcgat

SEQ ID NO: 907172 - DNA, 22 bp, Artificial Sequence
  chemically synthesized
tttgggtaagaatttttcgata

SEQ ID NO: 907173 - DNA, 22 bp, Artificial Sequence
  chemically synthesized
gttctagatacacctatcgaaa

SEQ ID NO: 907174 - DNA, 22 bp, Artificial Sequence
  chemically synthesized
gggtaagaatttttcgataggt

SEQ ID NO: 907175 - DNA, 22 bp, Artificial Sequence
  chemically synthesized
ggtaagaatttttcgataggtg

SEQ ID NO: 907176 - DNA, 22 bp, Artificial Sequence
  chemically synthesized
tagttctagatacacctatcga

SEQ ID NO: 907177 - DNA, 22 bp, Artificial Sequence
  chemically synthesized
tctagttctagatacacctatc

SEQ ID NO: 907178 - DNA, 22 bp, Artificial Sequence
  chemically synthesized
aagttctctagttctagataca

SEQ ID NO: 907179 - DNA, 22 bp, Artificial Sequence
  chemically synthesized
ttcgataggtgtatctagaact

SEQ ID NO: 907180 - DNA, 22 bp, Artificial Sequence
  chemically synthesized
tcgataggtgtatctagaacta

SEQ ID NO: 907181 - DNA, 22 bp, Artificial Sequence
  chemically synthesized
actgaagttctctagttctaga

SEQ ID NO: 907182 - DNA, 22 bp, Artificial Sequence
  chemically synthesized
cgataggtgtatctagaactag

SEQ ID NO: 907183 - DNA, 22 bp, Artificial Sequence
  chemically synthesized
gataggtgtatctagaactaga

SEQ ID NO: 907184 - DNA, 22 bp, Artificial Sequence
  chemically synthesized
aaggcaaagctcactgaagttc

SEQ ID NO: 907185 - DNA, 22 bp, Artificial Sequence
  chemically synthesized
gaaggcaaagctcactgaagtt

SEQ ID NO: 907186 - DNA, 22 bp, Artificial Sequence
  chemically synthesized
gaactagagaacttcagtgagc

SEQ ID NO: 907187 - DNA, 22 bp, Artificial Sequence
  chemically synthesized
gtttgaaggcaaagctcactga

SEQ ID NO: 907188 - DNA, 22 bp, Artificial Sequence
  chemically synthesized
ggtttgaaggcaaagctcactg

SEQ ID NO: 907189 - DNA, 22 bp, Artificial Sequence
  chemically synthesized
gagaacttcagtgagctttgcc

SEQ ID NO: 907190 - DNA, 22 bp, Artificial Sequence
  chemically synthesized
tgatttggtttgaaggcaaagc

SEQ ID NO: 907191 - DNA, 22 bp, Artificial Sequence
  chemically synthesized
cagtgagctttgccttcaaacc

SEQ ID NO: 907192 - DNA, 22 bp, Artificial Sequence
  chemically synthesized
agtgagctttgccttcaaacca

SEQ ID NO: 907193 - DNA, 22 bp, Artificial Sequence
  chemically synthesized
gagaagatactgtgatttggtt

SEQ ID NO: 907194 - DNA, 22 bp, Artificial Sequence
  chemically synthesized
ttagagaagatactgtgatttg

SEQ ID NO: 907195 - DNA, 22 bp, Artificial Sequence
  chemically synthesized
tgccttcaaaccaaatcacagt

SEQ ID NO: 907196 - DNA, 22 bp, Artificial Sequence
  chemically synthesized
gccttcaaaccaaatcacagta

SEQ ID NO: 907197 - DNA, 22 bp, Artificial Sequence
  chemically synthesized
ccttcaaaccaaatcacagtat

SEQ ID NO: 907198 - DNA, 22 bp, Artificial Sequence
  chemically synthesized
caaaccaaatcacagtatcttc

SEQ ID NO: 907199 - DNA, 22 bp, Artificial Sequence
  chemically synthesized
aaaccaaatcacagtatcttct

SEQ ID NO: 907200 - DNA, 22 bp, Artificial Sequence
  chemically synthesized
gataattattagagaagatact

SEQ ID NO: 907201 - DNA, 22 bp, Artificial Sequence
  chemically synthesized
agataattattagagaagatac

SEQ ID NO: 907202 - DNA, 22 bp, Artificial Sequence
  chemically synthesized
tagataattattagagaagata

SEQ ID NO: 907203 - DNA, 22 bp, Artificial Sequence
  chemically synthesized
ttagataattattagagaagat

SEQ ID NO: 907204 - DNA, 22 bp, Artificial Sequence
  chemically synthesized
tttttagataattattagagaa

SEQ ID NO: 907205 - DNA, 22 bp, Artificial Sequence
  chemically synthesized
ctctaataattatctaaaaaca

SEQ ID NO: 907206 - DNA, 22 bp, Artificial Sequence
  chemically synthesized
tctaataattatctaaaaacaa

SEQ ID NO: 907207 - DNA, 22 bp, Artificial Sequence
  chemically synthesized
taataattatctaaaaacaacc

SEQ ID NO: 907208 - DNA, 22 bp, Artificial Sequence
  chemically synthesized
ataattatctaaaaacaaccat

SEQ ID NO: 907209 - DNA, 22 bp, Artificial Sequence
  chemically synthesized
tctaaaaacaaccattgcctcc

SEQ ID NO: 907210 - DNA, 22 bp, Artificial Sequence
  chemically synthesized
acgcagtccagaagtggaggca

SEQ ID NO: 907211 - DNA, 22 bp, Artificial Sequence
  chemically synthesized
aaaacaaccattgcctccactt

SEQ ID NO: 907212 - DNA, 22 bp, Artificial Sequence
  chemically synthesized
cctccacttctggactgcgtca

SEQ ID NO: 907213 - DNA, 22 bp, Artificial Sequence
  chemically synthesized
cacttctggactgcgtcagatc

SEQ ID NO: 907214 - DNA, 22 bp, Artificial Sequence
  chemically synthesized
ctggactgcgtcagatccaccc

SEQ ID NO: 907215 - DNA, 22 bp, Artificial Sequence
  chemically synthesized
tggactgcgtcagatccacccg

SEQ ID NO: 907216 - DNA, 22 bp, Artificial Sequence
  chemically synthesized
gactgcgtcagatccacccgtt

SEQ ID NO: 907217 - DNA, 22 bp, Artificial Sequence
  chemically synthesized
cgtcagatccacccgttttatg

SEQ ID NO: 907218 - DNA, 22 bp, Artificial Sequence
  chemically synthesized
tggtgatgcaaacaaggaaagc

SEQ ID NO: 907219 - DNA, 22 bp, Artificial Sequence
  chemically synthesized
tatgctctcttgctttccttgt

SEQ ID NO: 907220 - DNA, 22 bp, Artificial Sequence
  chemically synthesized
atgctctcttgctttccttgtt

SEQ ID NO: 907221 - DNA, 22 bp, Artificial Sequence
  chemically synthesized
tgctctcttgctttccttgttt

SEQ ID NO: 907222 - DNA, 22 bp, Artificial Sequence
  chemically synthesized
aaattgtggtgatgcaaacaag

SEQ ID NO: 907223 - DNA, 22 bp, Artificial Sequence
  chemically synthesized
tcttgctttccttgtttgcatc

SEQ ID NO: 907224 - DNA, 22 bp, Artificial Sequence
  chemically synthesized
ttgctttccttgtttgcatcac

SEQ ID NO: 907225 - DNA, 22 bp, Artificial Sequence
  chemically synthesized
gttcaaattgtggtgatgcaaa

SEQ ID NO: 907226 - DNA, 22 bp, Artificial Sequence
  chemically synthesized
agttcaaattgtggtgatgcaa

SEQ ID NO: 907227 - DNA, 22 bp, Artificial Sequence
  chemically synthesized
gctttccttgtttgcatcacca

SEQ ID NO: 907228 - DNA, 22 bp, Artificial Sequence
  chemically synthesized
ctttccttgtttgcatcaccac

SEQ ID NO: 907229 - DNA, 22 bp, Artificial Sequence
  chemically synthesized
cttagttcaaattgtggtgatg

SEQ ID NO: 907230 - DNA, 22 bp, Artificial Sequence
  chemically synthesized
tccttgtttgcatcaccacaat

SEQ ID NO: 907231 - DNA, 22 bp, Artificial Sequence
  chemically synthesized
ccttgtttgcatcaccacaatt

SEQ ID NO: 907232 - DNA, 22 bp, Artificial Sequence
  chemically synthesized
cttgtttgcatcaccacaattt

SEQ ID NO: 907233 - DNA, 22 bp, Artificial Sequence
  chemically synthesized
gtttgcatcaccacaatttgaa

SEQ ID NO: 907234 - DNA, 22 bp, Artificial Sequence
  chemically synthesized
tttgcatcaccacaatttgaac

SEQ ID NO: 907235 - DNA, 22 bp, Artificial Sequence
  chemically synthesized
gcatcaccacaatttgaactaa

SEQ ID NO: 907236 - DNA, 22 bp, Artificial Sequence
  chemically synthesized
catcaccacaatttgaactaag

SEQ ID NO: 907237 - DNA, 22 bp, Artificial Sequence
  chemically synthesized
gaactaagcaattattactttg

SEQ ID NO: 907238 - DNA, 22 bp, Artificial Sequence
  chemically synthesized
aactaagcaattattactttga

SEQ ID NO: 907239 - DNA, 22 bp, Artificial Sequence
  chemically synthesized
tgtaatcccaccatcaaagtaa

SEQ ID NO: 907240 - DNA, 22 bp, Artificial Sequence
  chemically synthesized
atgtaatcccaccatcaaagta

SEQ ID NO: 907241 - DNA, 22 bp, Artificial Sequence
  chemically synthesized
tatgtaatcccaccatcaaagt

SEQ ID NO: 907242 - DNA, 22 bp, Artificial Sequence
  chemically synthesized
ttatgtaatcccaccatcaaag

SEQ ID NO: 907243 - DNA, 22 bp, Artificial Sequence
  chemically synthesized
agcaattattactttgatggtg

SEQ ID NO: 907244 - DNA, 22 bp, Artificial Sequence
  chemically synthesized
tttatgtaatcccaccatcaaa

SEQ ID NO: 907245 - DNA, 22 bp, Artificial Sequence
  chemically synthesized
ctttttatgtaatcccaccatc

SEQ ID NO: 907246 - DNA, 22 bp, Artificial Sequence
  chemically synthesized
ttactttgatggtgggattaca

SEQ ID NO: 907247 - DNA, 22 bp, Artificial Sequence
  chemically synthesized
ctttgatggtgggattacataa

SEQ ID NO: 907248 - DNA, 22 bp, Artificial Sequence
  chemically synthesized
tgatggtgggattacataaaaa

SEQ ID NO: 907249 - DNA, 22 bp, Artificial Sequence
  chemically synthesized
gatggtgggattacataaaaag

SEQ ID NO: 907250 - DNA, 22 bp, Artificial Sequence
  chemically synthesized
atggtgggattacataaaaagc

SEQ ID NO: 907251 - DNA, 22 bp, Artificial Sequence
  chemically synthesized
cataaaaagcaacgatttttct

SEQ ID NO: 907252 - DNA, 22 bp, Artificial Sequence
  chemically synthesized
aagtcaaggatgagaaaaatcg

SEQ ID NO: 907253 - DNA, 22 bp, Artificial Sequence
  chemically synthesized
gaagtcaaggatgagaaaaatc

SEQ ID NO: 907254 - DNA, 22 bp, Artificial Sequence
  chemically synthesized
tgaagtcaaggatgagaaaaat

SEQ ID NO: 907255 - DNA, 22 bp, Artificial Sequence
  chemically synthesized
ttgaagtcaaggatgagaaaaa

SEQ ID NO: 907256 - DNA, 22 bp, Artificial Sequence
  chemically synthesized
tttgaagtcaaggatgagaaaa

SEQ ID NO: 907257 - DNA, 22 bp, Artificial Sequence
  chemically synthesized
aataaagctttttgaagtcaag

SEQ ID NO: 907258 - DNA, 22 bp, Artificial Sequence
  chemically synthesized
ttctcatccttgacttcaaaaa

SEQ ID NO: 907259 - DNA, 22 bp, Artificial Sequence
  chemically synthesized
tctcatccttgacttcaaaaag

SEQ ID NO: 907260 - DNA, 22 bp, Artificial Sequence
  chemically synthesized
ctcatccttgacttcaaaaagc

SEQ ID NO: 907261 - DNA, 22 bp, Artificial Sequence
  chemically synthesized
tcatccttgacttcaaaaagct

SEQ ID NO: 907262 - DNA, 22 bp, Artificial Sequence
  chemically synthesized
aatgattcaataaagctttttg

SEQ ID NO: 907263 - DNA, 22 bp, Artificial Sequence
  chemically synthesized
atccttgacttcaaaaagcttt

SEQ ID NO: 907264 - DNA, 22 bp, Artificial Sequence
  chemically synthesized
agctaaatgattcaataaagct

SEQ ID NO: 907265 - DNA, 22 bp, Artificial Sequence
  chemically synthesized
gacttcaaaaagctttattgaa

SEQ ID NO: 907266 - DNA, 22 bp, Artificial Sequence
  chemically synthesized
acttcaaaaagctttattgaat

SEQ ID NO: 907267 - DNA, 22 bp, Artificial Sequence
  chemically synthesized
caaaaagctttattgaatcatt

SEQ ID NO: 907268 - DNA, 22 bp, Artificial Sequence
  chemically synthesized
aaaaagctttattgaatcattt

SEQ ID NO: 907269 - DNA, 22 bp, Artificial Sequence
  chemically synthesized
aaatgtaagctaagctaaatga

SEQ ID NO: 907270 - DNA, 22 bp, Artificial Sequence
  chemically synthesized
caaatgtaagctaagctaaatg

SEQ ID NO: 907271 - DNA, 22 bp, Artificial Sequence
  chemically synthesized
tcaaatgtaagctaagctaaat

SEQ ID NO: 907272 - DNA, 22 bp, Artificial Sequence
  chemically synthesized
tattgaatcatttagcttagct

SEQ ID NO: 907273 - DNA, 22 bp, Artificial Sequence
  chemically synthesized
attgaatcatttagcttagctt

SEQ ID NO: 907274 - DNA, 22 bp, Artificial Sequence
  chemically synthesized
ttgaatcatttagcttagctta

SEQ ID NO: 907275 - DNA, 22 bp, Artificial Sequence
  chemically synthesized
agttttcaaatgtaagctaagc

SEQ ID NO: 907276 - DNA, 22 bp, Artificial Sequence
  chemically synthesized
tgagttttcaaatgtaagctaa

SEQ ID NO: 907277 - DNA, 22 bp, Artificial Sequence
  chemically synthesized
aatcatttagcttagcttacat

SEQ ID NO: 907278 - DNA, 22 bp, Artificial Sequence
  chemically synthesized
cattctgagttttcaaatgtaa

SEQ ID NO: 907279 - DNA, 22 bp, Artificial Sequence
  chemically synthesized
agcttagcttacatttgaaaac

SEQ ID NO: 907280 - DNA, 22 bp, Artificial Sequence
  chemically synthesized
gcttagcttacatttgaaaact

SEQ ID NO: 907281 - DNA, 22 bp, Artificial Sequence
  chemically synthesized
agcttacatttgaaaactcaga

SEQ ID NO: 907282 - DNA, 22 bp, Artificial Sequence
  chemically synthesized
gcttacatttgaaaactcagaa

SEQ ID NO: 907283 - DNA, 22 bp, Artificial Sequence
  chemically synthesized
acatttgaaaactcagaatgga

SEQ ID NO: 907284 - DNA, 22 bp, Artificial Sequence
  chemically synthesized
catttgaaaactcagaatggag

SEQ ID NO: 907285 - DNA, 22 bp, Artificial Sequence
  chemically synthesized
gaaaactcagaatggagtggtg

SEQ ID NO: 907286 - DNA, 22 bp, Artificial Sequence
  chemically synthesized
aaaactcagaatggagtggtgg

SEQ ID NO: 907287 - DNA, 22 bp, Artificial Sequence
  chemically synthesized
cacacccccatacccaccactc

SEQ ID NO: 907288 - DNA, 22 bp, Artificial Sequence
  chemically synthesized
tccacacccccatacccaccac

SEQ ID NO: 907289 - DNA, 22 bp, Artificial Sequence
  chemically synthesized
agaatggagtggtgggtatggg

SEQ ID NO: 907290 - DNA, 22 bp, Artificial Sequence
  chemically synthesized
cctctccacacccccataccca

SEQ ID NO: 907291 - DNA, 22 bp, Artificial Sequence
  chemically synthesized
tccctctccacacccccatacc

SEQ ID NO: 907292 - DNA, 22 bp, Artificial Sequence
  chemically synthesized
tctccctctccacacccccata

SEQ ID NO: 907293 - DNA, 22 bp, Artificial Sequence
  chemically synthesized
ctctccctctccacacccccat

SEQ ID NO: 907294 - DNA, 22 bp, Artificial Sequence
  chemically synthesized
taaatccagtacttctctccct

SEQ ID NO: 907295 - DNA, 22 bp, Artificial Sequence
  chemically synthesized
gactataaatccagtacttctc

SEQ ID NO: 907296 - DNA, 22 bp, Artificial Sequence
  chemically synthesized
tgcaagacctagactataaatc

SEQ ID NO: 907297 - DNA, 22 bp, Artificial Sequence
  chemically synthesized
gatttatagtctaggtcttgca

SEQ ID NO: 907298 - DNA, 22 bp, Artificial Sequence
  chemically synthesized
gacgaccacctatgcaagacct

SEQ ID NO: 907299 - DNA, 22 bp, Artificial Sequence
  chemically synthesized
atagtctaggtcttgcataggt

SEQ ID NO: 907300 - DNA, 22 bp, Artificial Sequence
  chemically synthesized
tagtctaggtcttgcataggtg

SEQ ID NO: 907301 - DNA, 22 bp, Artificial Sequence
  chemically synthesized
ggtcttgcataggtggtcgtcc

SEQ ID NO: 907302 - DNA, 22 bp, Artificial Sequence
  chemically synthesized
gcataggtggtcgtccagcact

SEQ ID NO: 907303 - DNA, 22 bp, Artificial Sequence
  chemically synthesized
cataggtggtcgtccagcactt

SEQ ID NO: 907304 - DNA, 22 bp, Artificial Sequence
  chemically synthesized
cagcccaggcacaaagacagca

SEQ ID NO: 907305 - DNA, 22 bp, Artificial Sequence
  chemically synthesized
tccagcccaggcacaaagacag

SEQ ID NO: 907306 - DNA, 22 bp, Artificial Sequence
  chemically synthesized
tctccagcccaggcacaaagac

SEQ ID NO: 907307 - DNA, 22 bp, Artificial Sequence
  chemically synthesized
actgctgtctttgtgcctgggc

SEQ ID NO: 907308 - DNA, 22 bp, Artificial Sequence
  chemically synthesized
ctgctgtctttgtgcctgggct

SEQ ID NO: 907309 - DNA, 22 bp, Artificial Sequence
  chemically synthesized
cacattctctccagcccaggca

SEQ ID NO: 907310 - DNA, 22 bp, Artificial Sequence
  chemically synthesized
tccacattctctccagcccagg

SEQ ID NO: 907311 - DNA, 22 bp, Artificial Sequence
  chemically synthesized
ctgtctttgtgcctgggctgga

SEQ ID NO: 907312 - DNA, 22 bp, Artificial Sequence
  chemically synthesized
ctccacattctctccagcccag

SEQ ID NO: 907313 - DNA, 22 bp, Artificial Sequence
  chemically synthesized
tctccacattctctccagccca

SEQ ID NO: 907314 - DNA, 22 bp, Artificial Sequence
  chemically synthesized
ttctccacattctctccagccc

SEQ ID NO: 907315 - DNA, 22 bp, Artificial Sequence
  chemically synthesized
tctttgtgcctgggctggagag

SEQ ID NO: 907316 - DNA, 22 bp, Artificial Sequence
  chemically synthesized
cttttctccacattctctccag

SEQ ID NO: 907317 - DNA, 22 bp, Artificial Sequence
  chemically synthesized
ccttttctccacattctctcca

SEQ ID NO: 907318 - DNA, 22 bp, Artificial Sequence
  chemically synthesized
tgtgcctgggctggagagaatg

SEQ ID NO: 907319 - DNA, 22 bp, Artificial Sequence
  chemically synthesized
tccttttctccacattctctcc

SEQ ID NO: 907320 - DNA, 22 bp, Artificial Sequence
  chemically synthesized
gtgcctgggctggagagaatgt

SEQ ID NO: 907321 - DNA, 22 bp, Artificial Sequence
  chemically synthesized
tgcctgggctggagagaatgtg

SEQ ID NO: 907322 - DNA, 22 bp, Artificial Sequence
  chemically synthesized
ggctggagagaatgtggagaaa

SEQ ID NO: 907323 - DNA, 22 bp, Artificial Sequence
  chemically synthesized
gagagaatgtggagaaaaggaa

SEQ ID NO: 907324 - DNA, 22 bp, Artificial Sequence
  chemically synthesized
ccaacagtgtgcaaggttttcc

SEQ ID NO: 907325 - DNA, 22 bp, Artificial Sequence
  chemically synthesized
ctaccaacagtgtgcaaggttt

SEQ ID NO: 907326 - DNA, 22 bp, Artificial Sequence
  chemically synthesized
tattcctaccaacagtgtgcaa

SEQ ID NO: 907327 - DNA, 22 bp, Artificial Sequence
  chemically synthesized
atattcctaccaacagtgtgca

SEQ ID NO: 907328 - DNA, 22 bp, Artificial Sequence
  chemically synthesized
atttatattcctaccaacagtg

SEQ ID NO: 907329 - DNA, 22 bp, Artificial Sequence
  chemically synthesized
tactaatttatattcctaccaa

SEQ ID NO: 907330 - DNA, 22 bp, Artificial Sequence
  chemically synthesized
gcacactgttggtaggaatata

SEQ ID NO: 907331 - DNA, 22 bp, Artificial Sequence
  chemically synthesized
cacactgttggtaggaatataa

SEQ ID NO: 907332 - DNA, 22 bp, Artificial Sequence
  chemically synthesized
tagtggttgtactaatttatat

SEQ ID NO: 907333 - DNA, 22 bp, Artificial Sequence
  chemically synthesized
tatagtggttgtactaatttat

SEQ ID NO: 907334 - DNA, 22 bp, Artificial Sequence
  chemically synthesized
ttggtaggaatataaattagta

SEQ ID NO: 907335 - DNA, 22 bp, Artificial Sequence
  chemically synthesized
tctatagtggttgtactaattt

SEQ ID NO: 907336 - DNA, 22 bp, Artificial Sequence
  chemically synthesized
gtaggaatataaattagtacaa

SEQ ID NO: 907337 - DNA, 22 bp, Artificial Sequence
  chemically synthesized
ttctctatagtggttgtactaa

SEQ ID NO: 907338 - DNA, 22 bp, Artificial Sequence
  chemically synthesized
caaactgttctctatagtggtt

SEQ ID NO: 907339 - DNA, 22 bp, Artificial Sequence
  chemically synthesized
gtacaaccactatagagaacag

SEQ ID NO: 907340 - DNA, 22 bp, Artificial Sequence
  chemically synthesized
aggaacctccaaactgttctct

SEQ ID NO: 907341 - DNA, 22 bp, Artificial Sequence
  chemically synthesized
gaggaacctccaaactgttctc

SEQ ID NO: 907342 - DNA, 22 bp, Artificial Sequence
  chemically synthesized
tgaggaacctccaaactgttct

SEQ ID NO: 907343 - DNA, 22 bp, Artificial Sequence
  chemically synthesized
ttgaggaacctccaaactgttc

SEQ ID NO: 907344 - DNA, 22 bp, Artificial Sequence
  chemically synthesized
tttgaggaacctccaaactgtt

SEQ ID NO: 907345 - DNA, 22 bp, Artificial Sequence
  chemically synthesized
ttttgaggaacctccaaactgt

SEQ ID NO: 907346 - DNA, 22 bp, Artificial Sequence
  chemically synthesized
cttttttgaggaacctccaaac

SEQ ID NO: 907347 - DNA, 22 bp, Artificial Sequence
  chemically synthesized
acttttttgaggaacctccaaa

SEQ ID NO: 907348 - DNA, 22 bp, Artificial Sequence
  chemically synthesized
tacttttttgaggaacctccaa

SEQ ID NO: 907349 - DNA, 22 bp, Artificial Sequence
  chemically synthesized
tagagaacagtttggaggttcc

SEQ ID NO: 907350 - DNA, 22 bp, Artificial Sequence
  chemically synthesized
ttacttttttgaggaacctcca

SEQ ID NO: 907351 - DNA, 22 bp, Artificial Sequence
  chemically synthesized
tttttacttttttgaggaacct

SEQ ID NO: 907352 - DNA, 22 bp, Artificial Sequence
  chemically synthesized
tatttttacttttttgaggaac

SEQ ID NO: 907353 - DNA, 22 bp, Artificial Sequence
  chemically synthesized
ggaggttcctcaaaaaagtaaa

SEQ ID NO: 907354 - DNA, 22 bp, Artificial Sequence
  chemically synthesized
gaggttcctcaaaaaagtaaaa

SEQ ID NO: 907355 - DNA, 22 bp, Artificial Sequence
  chemically synthesized
ctcaaaaaagtaaaaatagagc

SEQ ID NO: 907356 - DNA, 22 bp, Artificial Sequence
  chemically synthesized
gatcatagggaagctctatttt

SEQ ID NO: 907357 - DNA, 22 bp, Artificial Sequence
  chemically synthesized
aaaaaagtaaaaatagagcttc

SEQ ID NO: 907358 - DNA, 22 bp, Artificial Sequence
  chemically synthesized
ctggatcatagggaagctctat

SEQ ID NO: 907359 - DNA, 22 bp, Artificial Sequence
  chemically synthesized
ccctatgatccagcaatcccac

SEQ ID NO: 907360 - DNA, 22 bp, Artificial Sequence
  chemically synthesized
cctatgatccagcaatcccact

SEQ ID NO: 907361 - DNA, 22 bp, Artificial Sequence
  chemically synthesized
ggtatatacccagcagtgggat

SEQ ID NO: 907362 - DNA, 22 bp, Artificial Sequence
  chemically synthesized
gggtatatacccagcagtggga

SEQ ID NO: 907363 - DNA, 22 bp, Artificial Sequence
  chemically synthesized
tgatccagcaatcccactgctg

SEQ ID NO: 907364 - DNA, 22 bp, Artificial Sequence
  chemically synthesized
tgggtatatacccagcagtggg

SEQ ID NO: 907365 - DNA, 22 bp, Artificial Sequence
  chemically synthesized
tttgggtatatacccagcagtg

SEQ ID NO: 907366 - DNA, 22 bp, Artificial Sequence
  chemically synthesized
ctttgggtatatacccagcagt

SEQ ID NO: 907367 - DNA, 22 bp, Artificial Sequence
  chemically synthesized
tctttgggtatatacccagcag

SEQ ID NO: 907368 - DNA, 22 bp, Artificial Sequence
  chemically synthesized
ctttctttgggtatatacccag

SEQ ID NO: 907369 - DNA, 22 bp, Artificial Sequence
  chemically synthesized
cctttctttgggtatataccca

SEQ ID NO: 907370 - DNA, 22 bp, Artificial Sequence
  chemically synthesized
atttcctttctttgggtatata

SEQ ID NO: 907371 - DNA, 22 bp, Artificial Sequence
  chemically synthesized
ctgggtatatacccaaagaaag

SEQ ID NO: 907372 - DNA, 22 bp, Artificial Sequence
  chemically synthesized
ggtatatacccaaagaaaggaa

SEQ ID NO: 907373 - DNA, 22 bp, Artificial Sequence
  chemically synthesized
gtcaatatactgatttcctttc

SEQ ID NO: 907374 - DNA, 22 bp, Artificial Sequence
  chemically synthesized
cgtcaatatactgatttccttt

SEQ ID NO: 907375 - DNA, 22 bp, Artificial Sequence
  chemically synthesized
caataaacatgggaatgcagat

SEQ ID NO: 907376 - DNA, 22 bp, Artificial Sequence
  chemically synthesized
acgaaatatctgcattcccatg

SEQ ID NO: 907377 - DNA, 22 bp, Artificial Sequence
  chemically synthesized
tgaatagagctgcaataaacat

SEQ ID NO: 907378 - DNA, 22 bp, Artificial Sequence
  chemically synthesized
ttgtgaatagagctgcaataaa

SEQ ID NO: 907379 - DNA, 22 bp, Artificial Sequence
  chemically synthesized
cattcccatgtttattgcagct

SEQ ID NO: 907380 - DNA, 22 bp, Artificial Sequence
  chemically synthesized
gctattgtgaatagagctgcaa

SEQ ID NO: 907381 - DNA, 22 bp, Artificial Sequence
  chemically synthesized
ggctattgtgaatagagctgca

SEQ ID NO: 907382 - DNA, 22 bp, Artificial Sequence
  chemically synthesized
ccatgtttattgcagctctatt

SEQ ID NO: 907383 - DNA, 22 bp, Artificial Sequence
  chemically synthesized
caaaccttggctattgtgaata

SEQ ID NO: 907384 - DNA, 22 bp, Artificial Sequence
  chemically synthesized
ccaaaccttggctattgtgaat

SEQ ID NO: 907385 - DNA, 22 bp, Artificial Sequence
  chemically synthesized
attgcagctctattcacaatag

SEQ ID NO: 907386 - DNA, 22 bp, Artificial Sequence
  chemically synthesized
tccaaaccttggctattgtgaa

SEQ ID NO: 907387 - DNA, 22 bp, Artificial Sequence
  chemically synthesized
ttgcagctctattcacaatagc

SEQ ID NO: 907388 - DNA, 22 bp, Artificial Sequence
  chemically synthesized
ttccaaaccttggctattgtga

SEQ ID NO: 907389 - DNA, 22 bp, Artificial Sequence
  chemically synthesized
tttccaaaccttggctattgtg

SEQ ID NO: 907390 - DNA, 22 bp, Artificial Sequence
  chemically synthesized
cagctctattcacaatagccaa

SEQ ID NO: 907391 - DNA, 22 bp, Artificial Sequence
  chemically synthesized
aattttttccaaaccttggcta

SEQ ID NO: 907392 - DNA, 22 bp, Artificial Sequence
  chemically synthesized
aaattttttccaaaccttggct

SEQ ID NO: 907393 - DNA, 22 bp, Artificial Sequence
  chemically synthesized
tattcacaatagccaaggtttg

SEQ ID NO: 907394 - DNA, 22 bp, Artificial Sequence
  chemically synthesized
ttcacaatagccaaggtttgga

SEQ ID NO: 907395 - DNA, 22 bp, Artificial Sequence
  chemically synthesized
acaatagccaaggtttggaaaa

SEQ ID NO: 907396 - DNA, 22 bp, Artificial Sequence
  chemically synthesized
atggacacttaaattttttcca

SEQ ID NO: 907397 - DNA, 22 bp, Artificial Sequence
  chemically synthesized
ttgatggacacttaaatttttt

SEQ ID NO: 907398 - DNA, 22 bp, Artificial Sequence
  chemically synthesized
gttgatggacacttaaattttt

SEQ ID NO: 907399 - DNA, 22 bp, Artificial Sequence
  chemically synthesized
atttgttgatggacacttaaat

SEQ ID NO: 907400 - DNA, 22 bp, Artificial Sequence
  chemically synthesized
ggaaaaaatttaagtgtccatc

SEQ ID NO: 907401 - DNA, 22 bp, Artificial Sequence
  chemically synthesized
gaaaaaatttaagtgtccatca

SEQ ID NO: 907402 - DNA, 22 bp, Artificial Sequence
  chemically synthesized
tccattcatttgttgatggaca

SEQ ID NO: 907403 - DNA, 22 bp, Artificial Sequence
  chemically synthesized
atccattcatttgttgatggac

SEQ ID NO: 907404 - DNA, 22 bp, Artificial Sequence
  chemically synthesized
tatccattcatttgttgatgga

SEQ ID NO: 907405 - DNA, 22 bp, Artificial Sequence
  chemically synthesized
tttatccattcatttgttgatg

SEQ ID NO: 907406 - DNA, 22 bp, Artificial Sequence
  chemically synthesized
ctttatccattcatttgttgat

SEQ ID NO: 907407 - DNA, 22 bp, Artificial Sequence
  chemically synthesized
tctttatccattcatttgttga

SEQ ID NO: 907408 - DNA, 22 bp, Artificial Sequence
  chemically synthesized
aagtgtccatcaacaaatgaat

SEQ ID NO: 907409 - DNA, 22 bp, Artificial Sequence
  chemically synthesized
agtgtccatcaacaaatgaatg

SEQ ID NO: 907410 - DNA, 22 bp, Artificial Sequence
  chemically synthesized
tgtatatgtaccacgttttctt

SEQ ID NO: 907411 - DNA, 22 bp, Artificial Sequence
  chemically synthesized
gtgtatatgtaccacgttttct

SEQ ID NO: 907412 - DNA, 22 bp, Artificial Sequence
  chemically synthesized
catttgtgtatatgtaccacgt

SEQ ID NO: 907413 - DNA, 22 bp, Artificial Sequence
  chemically synthesized
tggcagaatagtactccatttg

SEQ ID NO: 907414 - DNA, 22 bp, Artificial Sequence
  chemically synthesized
tatggcagaatagtactccatt

SEQ ID NO: 907415 - DNA, 22 bp, Artificial Sequence
  chemically synthesized
ctatggcagaatagtactccat

SEQ ID NO: 907416 - DNA, 22 bp, Artificial Sequence
  chemically synthesized
tctatggcagaatagtactcca

SEQ ID NO: 907417 - DNA, 22 bp, Artificial Sequence
  chemically synthesized
ttctatggcagaatagtactcc

SEQ ID NO: 907418 - DNA, 22 bp, Artificial Sequence
  chemically synthesized
aatcttttctatggcagaatag

SEQ ID NO: 907419 - DNA, 22 bp, Artificial Sequence
  chemically synthesized
ttctgccatagaaaagattgag

SEQ ID NO: 907420 - DNA, 22 bp, Artificial Sequence
  chemically synthesized
caaatgacaggatctcaatctt

SEQ ID NO: 907421 - DNA, 22 bp, Artificial Sequence
  chemically synthesized
tgccatagaaaagattgagatc

SEQ ID NO: 907422 - DNA, 22 bp, Artificial Sequence
  chemically synthesized
ttgcaaatgacaggatctcaat

SEQ ID NO: 907423 - DNA, 22 bp, Artificial Sequence
  chemically synthesized
ccatagaaaagattgagatcct

SEQ ID NO: 907424 - DNA, 22 bp, Artificial Sequence
  chemically synthesized
catccatgttgttgcaaatgac

SEQ ID NO: 907425 - DNA, 22 bp, Artificial Sequence
  chemically synthesized
ccatccatgttgttgcaaatga

SEQ ID NO: 907426 - DNA, 22 bp, Artificial Sequence
  chemically synthesized
agatcctgtcatttgcaacaac

SEQ ID NO: 907427 - DNA, 22 bp, Artificial Sequence
  chemically synthesized
catttccatccatgttgttgca

SEQ ID NO: 907428 - DNA, 22 bp, Artificial Sequence
  chemically synthesized
tcatttgcaacaacatggatgg

SEQ ID NO: 907429 - DNA, 22 bp, Artificial Sequence
  chemically synthesized
gcaacaacatggatggaaatgg

SEQ ID NO: 907430 - DNA, 22 bp, Artificial Sequence
  chemically synthesized
agataatgacctccatttccat

SEQ ID NO: 907431 - DNA, 22 bp, Artificial Sequence
  chemically synthesized
caacaacatggatggaaatgga

SEQ ID NO: 907432 - DNA, 22 bp, Artificial Sequence
  chemically synthesized
aagataatgacctccatttcca

SEQ ID NO: 907433 - DNA, 22 bp, Artificial Sequence
  chemically synthesized
cttaagataatgacctccattt

SEQ ID NO: 907434 - DNA, 22 bp, Artificial Sequence
  chemically synthesized
gcttaagataatgacctccatt

SEQ ID NO: 907435 - DNA, 22 bp, Artificial Sequence
  chemically synthesized
tgcttaagataatgacctccat

SEQ ID NO: 907436 - DNA, 22 bp, Artificial Sequence
  chemically synthesized
ttttgcttaagataatgacctc

SEQ ID NO: 907437 - DNA, 22 bp, Artificial Sequence
  chemically synthesized
attttgcttaagataatgacct

SEQ ID NO: 907438 - DNA, 22 bp, Artificial Sequence
  chemically synthesized
gcttattttgcttaagataatg

SEQ ID NO: 907439 - DNA, 22 bp, Artificial Sequence
  chemically synthesized
ggcttattttgcttaagataat

SEQ ID NO: 907440 - DNA, 22 bp, Artificial Sequence
  chemically synthesized
tgcttggcttattttgcttaag

SEQ ID NO: 907441 - DNA, 22 bp, Artificial Sequence
  chemically synthesized
tgtgcttggcttattttgctta

SEQ ID NO: 907442 - DNA, 22 bp, Artificial Sequence
  chemically synthesized
ctgtgcttggcttattttgctt

SEQ ID NO: 907443 - DNA, 22 bp, Artificial Sequence
  chemically synthesized
tctgtgcttggcttattttgct

SEQ ID NO: 907444 - DNA, 22 bp, Artificial Sequence
  chemically synthesized
ttctgtgcttggcttattttgc

SEQ ID NO: 907445 - DNA, 22 bp, Artificial Sequence
  chemically synthesized
tcttaagcaaaataagccaagc

SEQ ID NO: 907446 - DNA, 22 bp, Artificial Sequence
  chemically synthesized
aagcaaaataagccaagcacag

SEQ ID NO: 907447 - DNA, 22 bp, Artificial Sequence
  chemically synthesized
agcaaaataagccaagcacaga

SEQ ID NO: 907448 - DNA, 22 bp, Artificial Sequence
  chemically synthesized
caaataagtgagaacatgagat

SEQ ID NO: 907449 - DNA, 22 bp, Artificial Sequence
  chemically synthesized
tgcaaataagtgagaacatgag

SEQ ID NO: 907450 - DNA, 22 bp, Artificial Sequence
  chemically synthesized
gattctgcaaataagtgagaac

SEQ ID NO: 907451 - DNA, 22 bp, Artificial Sequence
  chemically synthesized
agattctgcaaataagtgagaa

SEQ ID NO: 907452 - DNA, 22 bp, Artificial Sequence
  chemically synthesized
tagattctgcaaataagtgaga

SEQ ID NO: 907453 - DNA, 22 bp, Artificial Sequence
  chemically synthesized
ttagattctgcaaataagtgag

SEQ ID NO: 907454 - DNA, 22 bp, Artificial Sequence
  chemically synthesized
atttttagattctgcaaataag

SEQ ID NO: 907455 - DNA, 22 bp, Artificial Sequence
  chemically synthesized
gatttttagattctgcaaataa

SEQ ID NO: 907456 - DNA, 22 bp, Artificial Sequence
  chemically synthesized
tgatttttagattctgcaaata

SEQ ID NO: 907457 - DNA, 22 bp, Artificial Sequence
  chemically synthesized
atgttctcacttatttgcagaa

SEQ ID NO: 907458 - DNA, 22 bp, Artificial Sequence
  chemically synthesized
ttttgatttttagattctgcaa

SEQ ID NO: 907459 - DNA, 22 bp, Artificial Sequence
  chemically synthesized
tcacttatttgcagaatctaaa

SEQ ID NO: 907460 - DNA, 22 bp, Artificial Sequence
  chemically synthesized
cattgttttgatttttagattc

SEQ ID NO: 907461 - DNA, 22 bp, Artificial Sequence
  chemically synthesized
acttatttgcagaatctaaaaa

SEQ ID NO: 907462 - DNA, 22 bp, Artificial Sequence
  chemically synthesized
atttgcagaatctaaaaatcaa

SEQ ID NO: 907463 - DNA, 22 bp, Artificial Sequence
  chemically synthesized
tttgcagaatctaaaaatcaaa

SEQ ID NO: 907464 - DNA, 22 bp, Artificial Sequence
  chemically synthesized
gcagaatctaaaaatcaaaaca

SEQ ID NO: 907465 - DNA, 22 bp, Artificial Sequence
  chemically synthesized
cagaatctaaaaatcaaaacaa

SEQ ID NO: 907466 - DNA, 22 bp, Artificial Sequence
  chemically synthesized
tgtccatgagttccattgtttt

SEQ ID NO: 907467 - DNA, 22 bp, Artificial Sequence
  chemically synthesized
tatgtccatgagttccattgtt

SEQ ID NO: 907468 - DNA, 22 bp, Artificial Sequence
  chemically synthesized
tctatgtccatgagttccattg

SEQ ID NO: 907469 - DNA, 22 bp, Artificial Sequence
  chemically synthesized
aaaatcaaaacaatggaactca

SEQ ID NO: 907470 - DNA, 22 bp, Artificial Sequence
  chemically synthesized
ctctctatgtccatgagttcca

SEQ ID NO: 907471 - DNA, 22 bp, Artificial Sequence
  chemically synthesized
tactctctatgtccatgagttc

SEQ ID NO: 907472 - DNA, 22 bp, Artificial Sequence
  chemically synthesized
ctactctctatgtccatgagtt

SEQ ID NO: 907473 - DNA, 22 bp, Artificial Sequence
  chemically synthesized
tctactctctatgtccatgagt

SEQ ID NO: 907474 - DNA, 22 bp, Artificial Sequence
  chemically synthesized
cctttctactctctatgtccat

SEQ ID NO: 907475 - DNA, 22 bp, Artificial Sequence
  chemically synthesized
gcaactacctttctactctcta

SEQ ID NO: 907476 - DNA, 22 bp, Artificial Sequence
  chemically synthesized
tggcaactacctttctactctc

SEQ ID NO: 907477 - DNA, 22 bp, Artificial Sequence
  chemically synthesized
atggacatagagagtagaaagg

SEQ ID NO: 907478 - DNA, 22 bp, Artificial Sequence
  chemically synthesized
ccagcctctggcaactaccttt

SEQ ID NO: 907479 - DNA, 22 bp, Artificial Sequence
  chemically synthesized
cccagcctctggcaactacctt

SEQ ID NO: 907480 - DNA, 22 bp, Artificial Sequence
  chemically synthesized
tccttcccagcctctggcaact

SEQ ID NO: 907481 - DNA, 22 bp, Artificial Sequence
  chemically synthesized
cactatccttcccagcctctgg

SEQ ID NO: 907482 - DNA, 22 bp, Artificial Sequence
  chemically synthesized
ctccactatccttcccagcctc

SEQ ID NO: 907483 - DNA, 22 bp, Artificial Sequence
  chemically synthesized
cccgactcctccactatccttc

SEQ ID NO: 907484 - DNA, 22 bp, Artificial Sequence
  chemically synthesized
ccagaggctgggaaggatagtg

SEQ ID NO: 907485 - DNA, 22 bp, Artificial Sequence
  chemically synthesized
ccccctccccgactcctccact

SEQ ID NO: 907486 - DNA, 22 bp, Artificial Sequence
  chemically synthesized
ggaaggatagtggaggagtcgg

SEQ ID NO: 907487 - DNA, 22 bp, Artificial Sequence
  chemically synthesized
accatcccgctgccccctcccc

SEQ ID NO: 907488 - DNA, 22 bp, Artificial Sequence
  chemically synthesized
tacccattaaccatcccgctgc

SEQ ID NO: 907489 - DNA, 22 bp, Artificial Sequence
  chemically synthesized
gtacccattaaccatcccgctg

SEQ ID NO: 907490 - DNA, 22 bp, Artificial Sequence
  chemically synthesized
tgtacccattaaccatcccgct

SEQ ID NO: 907491 - DNA, 22 bp, Artificial Sequence
  chemically synthesized
ttgtacccattaaccatcccgc

SEQ ID NO: 907492 - DNA, 22 bp, Artificial Sequence
  chemically synthesized
tttgtacccattaaccatcccg

SEQ ID NO: 907493 - DNA, 22 bp, Artificial Sequence
  chemically synthesized
agtattttttgtacccattaac

SEQ ID NO: 907494 - DNA, 22 bp, Artificial Sequence
  chemically synthesized
ctaagtattttttgtacccatt

SEQ ID NO: 907495 - DNA, 22 bp, Artificial Sequence
  chemically synthesized
cctaagtattttttgtacccat

SEQ ID NO: 907496 - DNA, 22 bp, Artificial Sequence
  chemically synthesized
tcctaagtattttttgtaccca

SEQ ID NO: 907497 - DNA, 22 bp, Artificial Sequence
  chemically synthesized
ttcctaagtattttttgtaccc

SEQ ID NO: 907498 - DNA, 22 bp, Artificial Sequence
  chemically synthesized
atttttcctaagtattttttgt

SEQ ID NO: 907499 - DNA, 22 bp, Artificial Sequence
  chemically synthesized
ttcatttttcctaagtattttt

SEQ ID NO: 907500 - DNA, 22 bp, Artificial Sequence
  chemically synthesized
atgggtacaaaaaatacttagg

SEQ ID NO: 907501 - DNA, 22 bp, Artificial Sequence
  chemically synthesized
ggtattattcatttttcctaag

SEQ ID NO: 907502 - DNA, 22 bp, Artificial Sequence
  chemically synthesized
tcgaatactgggtattattcat

SEQ ID NO: 907503 - DNA, 22 bp, Artificial Sequence
  chemically synthesized
aggaaaaatgaataatacccag

SEQ ID NO: 907504 - DNA, 22 bp, Artificial Sequence
  chemically synthesized
tgctatcgaatactgggtatta

SEQ ID NO: 907505 - DNA, 22 bp, Artificial Sequence
  chemically synthesized
ggaaaaatgaataatacccagt

SEQ ID NO: 907506 - DNA, 22 bp, Artificial Sequence
  chemically synthesized
ttgtgctatcgaatactgggta

SEQ ID NO: 907507 - DNA, 22 bp, Artificial Sequence
  chemically synthesized
acgatagtcaccctgttgtgct

SEQ ID NO: 907508 - DNA, 22 bp, Artificial Sequence
  chemically synthesized
gacgatagtcaccctgttgtgc

SEQ ID NO: 907509 - DNA, 22 bp, Artificial Sequence
  chemically synthesized
tgacgatagtcaccctgttgtg

SEQ ID NO: 907510 - DNA, 22 bp, Artificial Sequence
  chemically synthesized
ttttgacgatagtcaccctgtt

SEQ ID NO: 907511 - DNA, 22 bp, Artificial Sequence
  chemically synthesized
gatagcacaacagggtgactat

SEQ ID NO: 907512 - DNA, 22 bp, Artificial Sequence
  chemically synthesized
cattattttgacgatagtcacc

SEQ ID NO: 907513 - DNA, 22 bp, Artificial Sequence
  chemically synthesized
aatgtgcagttacattattttg

SEQ ID NO: 907514 - DNA, 22 bp, Artificial Sequence
  chemically synthesized
aaatgtgcagttacattatttt

SEQ ID NO: 907515 - DNA, 22 bp, Artificial Sequence
  chemically synthesized
taaatgtgcagttacattattt

SEQ ID NO: 907516 - DNA, 22 bp, Artificial Sequence
  chemically synthesized
ttaaatgtgcagttacattatt

SEQ ID NO: 907517 - DNA, 22 bp, Artificial Sequence
  chemically synthesized
tttttaaatgtgcagttacatt

SEQ ID NO: 907518 - DNA, 22 bp, Artificial Sequence
  chemically synthesized
atttttaaatgtgcagttacat

SEQ ID NO: 907519 - DNA, 22 bp, Artificial Sequence
  chemically synthesized
tcgtcaaaataatgtaactgca

SEQ ID NO: 907520 - DNA, 22 bp, Artificial Sequence
  chemically synthesized
tttatttttaaatgtgcagtta

SEQ ID NO: 907521 - DNA, 22 bp, Artificial Sequence
  chemically synthesized
atttatttttaaatgtgcagtt

SEQ ID NO: 907522 - DNA, 22 bp, Artificial Sequence
  chemically synthesized
ttatttatttttaaatgtgcag

SEQ ID NO: 907523 - DNA, 22 bp, Artificial Sequence
  chemically synthesized
tactcttatttatttttaaatg

SEQ ID NO: 907524 - DNA, 22 bp, Artificial Sequence
  chemically synthesized
cacatttaaaaataaataagag

SEQ ID NO: 907525 - DNA, 22 bp, Artificial Sequence
  chemically synthesized
caaacaatccaattatactctt

SEQ ID NO: 907526 - DNA, 22 bp, Artificial Sequence
  chemically synthesized
aaaaataaataagagtataatt

SEQ ID NO: 907527 - DNA, 22 bp, Artificial Sequence
  chemically synthesized
aaaataaataagagtataattg

SEQ ID NO: 907528 - DNA, 22 bp, Artificial Sequence
  chemically synthesized
tgttacaaacaatccaattata

SEQ ID NO: 907529 - DNA, 22 bp, Artificial Sequence
  chemically synthesized
gtgttacaaacaatccaattat

SEQ ID NO: 907530 - DNA, 22 bp, Artificial Sequence
  chemically synthesized
tgtgttacaaacaatccaatta

SEQ ID NO: 907531 - DNA, 22 bp, Artificial Sequence
  chemically synthesized
ttgtgttacaaacaatccaatt

SEQ ID NO: 907532 - DNA, 22 bp, Artificial Sequence
  chemically synthesized
atcttttgtgttacaaacaatc

SEQ ID NO: 907533 - DNA, 22 bp, Artificial Sequence
  chemically synthesized
cagcattaatcttttgtgttac

SEQ ID NO: 907534 - DNA, 22 bp, Artificial Sequence
  chemically synthesized
gattgtttgtaacacaaaagat

SEQ ID NO: 907535 - DNA, 22 bp, Artificial Sequence
  chemically synthesized
tttgtaacacaaaagattaatg

SEQ ID NO: 907536 - DNA, 22 bp, Artificial Sequence
  chemically synthesized
gtaacacaaaagattaatgctg

SEQ ID NO: 907537 - DNA, 22 bp, Artificial Sequence
  chemically synthesized
taacacaaaagattaatgctgg

SEQ ID NO: 907538 - DNA, 22 bp, Artificial Sequence
  chemically synthesized
atgctggagggggtggatcccc

SEQ ID NO: 907539 - DNA, 22 bp, Artificial Sequence
  chemically synthesized
gagggggtggatcccccgttct

SEQ ID NO: 907540 - DNA, 22 bp, Artificial Sequence
  chemically synthesized
tccatgatgtgattattatgca

SEQ ID NO: 907541 - DNA, 22 bp, Artificial Sequence
  chemically synthesized
catgatgtgattattatgcatt

SEQ ID NO: 907542 - DNA, 22 bp, Artificial Sequence
  chemically synthesized
acacaagcatgcaatgcataat

SEQ ID NO: 907543 - DNA, 22 bp, Artificial Sequence
  chemically synthesized
gacacaagcatgcaatgcataa

SEQ ID NO: 907544 - DNA, 22 bp, Artificial Sequence
  chemically synthesized
tgacacaagcatgcaatgcata

SEQ ID NO: 907545 - DNA, 22 bp, Artificial Sequence
  chemically synthesized
agatgttttgacacaagcatgc

SEQ ID NO: 907546 - DNA, 22 bp, Artificial Sequence
  chemically synthesized
gagatgttttgacacaagcatg

SEQ ID NO: 907547 - DNA, 22 bp, Artificial Sequence
  chemically synthesized
ttatgcattgcatgcttgtgtc

SEQ ID NO: 907548 - DNA, 22 bp, Artificial Sequence
  chemically synthesized
tgcattgcatgcttgtgtcaaa

SEQ ID NO: 907549 - DNA, 22 bp, Artificial Sequence
  chemically synthesized
tggggtacttgagatgttttga

SEQ ID NO: 907550 - DNA, 22 bp, Artificial Sequence
  chemically synthesized
atggggtacttgagatgttttg

SEQ ID NO: 907551 - DNA, 22 bp, Artificial Sequence
  chemically synthesized
catgcttgtgtcaaaacatctc

SEQ ID NO: 907552 - DNA, 22 bp, Artificial Sequence
  chemically synthesized
gtgtcaaaacatctcaagtacc

SEQ ID NO: 907553 - DNA, 22 bp, Artificial Sequence
  chemically synthesized
tgtcaaaacatctcaagtaccc

SEQ ID NO: 907554 - DNA, 22 bp, Artificial Sequence
  chemically synthesized
aagtaccccataaatacataca

SEQ ID NO: 907555 - DNA, 22 bp, Artificial Sequence
  chemically synthesized
tgggtacatagtaggtgtatgt

SEQ ID NO: 907556 - DNA, 22 bp, Artificial Sequence
  chemically synthesized
gtgggtacatagtaggtgtatg

SEQ ID NO: 907557 - DNA, 22 bp, Artificial Sequence
  chemically synthesized
tgtgggtacatagtaggtgtat

SEQ ID NO: 907558 - DNA, 22 bp, Artificial Sequence
  chemically synthesized
ttgtgggtacatagtaggtgta

SEQ ID NO: 907559 - DNA, 22 bp, Artificial Sequence
  chemically synthesized
aatttttgtgggtacatagtag

SEQ ID NO: 907560 - DNA, 22 bp, Artificial Sequence
  chemically synthesized
aaatttttgtgggtacatagta

SEQ ID NO: 907561 - DNA, 22 bp, Artificial Sequence
  chemically synthesized
taaatttttgtgggtacatagt

SEQ ID NO: 907562 - DNA, 22 bp, Artificial Sequence
  chemically synthesized
ttaaatttttgtgggtacatag

SEQ ID NO: 907563 - DNA, 22 bp, Artificial Sequence
  chemically synthesized
tttaaatttttgtgggtacata

SEQ ID NO: 907564 - DNA, 22 bp, Artificial Sequence
  chemically synthesized
ttttaaatttttgtgggtacat

SEQ ID NO: 907565 - DNA, 22 bp, Artificial Sequence
  chemically synthesized
aaatttttttaaatttttgtgg

SEQ ID NO: 907566 - DNA, 22 bp, Artificial Sequence
  chemically synthesized
aaaatttttttaaatttttgtg

SEQ ID NO: 907567 - DNA, 22 bp, Artificial Sequence
  chemically synthesized
taaaatttttttaaatttttgt

SEQ ID NO: 907568 - DNA, 22 bp, Artificial Sequence
  chemically synthesized
ttaaaatttttttaaatttttg

SEQ ID NO: 907569 - DNA, 22 bp, Artificial Sequence
  chemically synthesized
ctatgtacccacaaaaatttaa

SEQ ID NO: 907570 - DNA, 22 bp, Artificial Sequence
  chemically synthesized
tttaaaatttttttaaattttt

SEQ ID NO: 907571 - DNA, 22 bp, Artificial Sequence
  chemically synthesized
tttttaaaatttttttaaattt

SEQ ID NO: 907572 - DNA, 22 bp, Artificial Sequence
  chemically synthesized
tgtacccacaaaaatttaaaaa

SEQ ID NO: 907573 - DNA, 22 bp, Artificial Sequence
  chemically synthesized
tctttttaaaatttttttaaat

SEQ ID NO: 907574 - DNA, 22 bp, Artificial Sequence
  chemically synthesized
tctctttttaaaatttttttaa

SEQ ID NO: 907575 - DNA, 22 bp, Artificial Sequence
  chemically synthesized
ccacaaccaattctctcttttt

SEQ ID NO: 907576 - DNA, 22 bp, Artificial Sequence
  chemically synthesized
aaaaaaattttaaaaagagaga

SEQ ID NO: 907577 - DNA, 22 bp, Artificial Sequence
  chemically synthesized
aaaaaattttaaaaagagagaa

SEQ ID NO: 907578 - DNA, 22 bp, Artificial Sequence
  chemically synthesized
ctaccacaaccaattctctctt

SEQ ID NO: 907579 - DNA, 22 bp, Artificial Sequence
  chemically synthesized
ctcctaccacaaccaattctct

SEQ ID NO: 907580 - DNA, 22 bp, Artificial Sequence
  chemically synthesized
tctgctcctaccacaaccaatt

SEQ ID NO: 907581 - DNA, 22 bp, Artificial Sequence
  chemically synthesized
taaaaagagagaattggttgtg

SEQ ID NO: 907582 - DNA, 22 bp, Artificial Sequence
  chemically synthesized
aaaaagagagaattggttgtgg

SEQ ID NO: 907583 - DNA, 22 bp, Artificial Sequence
  chemically synthesized
aaaagagagaattggttgtggt

SEQ ID NO: 907584 - DNA, 22 bp, Artificial Sequence
  chemically synthesized
tgctatctgctcctaccacaac

SEQ ID NO: 907585 - DNA, 22 bp, Artificial Sequence
  chemically synthesized
gttgtggtaggagcagatagca

SEQ ID NO: 907586 - DNA, 22 bp, Artificial Sequence
  chemically synthesized
taaagtgaaagttatgctatct

SEQ ID NO: 907587 - DNA, 22 bp, Artificial Sequence
  chemically synthesized
tggtaggagcagatagcataac

SEQ ID NO: 907588 - DNA, 22 bp, Artificial Sequence
  chemically synthesized
atggtccagtgacctataaagt

SEQ ID NO: 907589 - DNA, 22 bp, Artificial Sequence
  chemically synthesized
ctcatggtccagtgacctataa

SEQ ID NO: 907590 - DNA, 22 bp, Artificial Sequence
  chemically synthesized
tcactttataggtcactggacc

SEQ ID NO: 907591 - DNA, 22 bp, Artificial Sequence
  chemically synthesized
cactttataggtcactggacca

SEQ ID NO: 907592 - DNA, 22 bp, Artificial Sequence
  chemically synthesized
actttataggtcactggaccat

SEQ ID NO: 907593 - DNA, 22 bp, Artificial Sequence
  chemically synthesized
tataggtcactggaccatgagg

SEQ ID NO: 907594 - DNA, 22 bp, Artificial Sequence
  chemically synthesized
ataggtcactggaccatgagga

SEQ ID NO: 907595 - DNA, 22 bp, Artificial Sequence
  chemically synthesized
taggtcactggaccatgaggaa

SEQ ID NO: 907596 - DNA, 22 bp, Artificial Sequence
  chemically synthesized
catcagatcaagatatggttcc

SEQ ID NO: 907597 - DNA, 22 bp, Artificial Sequence
  chemically synthesized
tccatcagatcaagatatggtt

SEQ ID NO: 907598 - DNA, 22 bp, Artificial Sequence
  chemically synthesized
ctccatcagatcaagatatggt

SEQ ID NO: 907599 - DNA, 22 bp, Artificial Sequence
  chemically synthesized
gaccatgaggaaccatatcttg

SEQ ID NO: 907600 - DNA, 22 bp, Artificial Sequence
  chemically synthesized
tcttctccatcagatcaagata

SEQ ID NO: 907601 - DNA, 22 bp, Artificial Sequence
  chemically synthesized
tggatgatgcactgtcttctcc

SEQ ID NO: 907602 - DNA, 22 bp, Artificial Sequence
  chemically synthesized
gatctgatggagaagacagtgc

SEQ ID NO: 907603 - DNA, 22 bp, Artificial Sequence
  chemically synthesized
tctgtggatgatgcactgtctt

SEQ ID NO: 907604 - DNA, 22 bp, Artificial Sequence
  chemically synthesized
atctgatggagaagacagtgca

SEQ ID NO: 907605 - DNA, 22 bp, Artificial Sequence
  chemically synthesized
atggagaagacagtgcatcatc

SEQ ID NO: 907606 - DNA, 22 bp, Artificial Sequence
  chemically synthesized
aaagtccattgtctgtggatga

SEQ ID NO: 907607 - DNA, 22 bp, Artificial Sequence
  chemically synthesized
catccagctaaaagtccattgt

SEQ ID NO: 907608 - DNA, 22 bp, Artificial Sequence
  chemically synthesized
ctgcatccagctaaaagtccat

SEQ ID NO: 907609 - DNA, 22 bp, Artificial Sequence
  chemically synthesized
actgcatccagctaaaagtcca

SEQ ID NO: 907610 - DNA, 22 bp, Artificial Sequence
  chemically synthesized
acttactgcatccagctaaaag

SEQ ID NO: 907611 - DNA, 22 bp, Artificial Sequence
  chemically synthesized
attcacttactgcatccagcta

SEQ ID NO: 907612 - DNA, 22 bp, Artificial Sequence
  chemically synthesized
ttagctggatgcagtaagtgaa

SEQ ID NO: 907613 - DNA, 22 bp, Artificial Sequence
  chemically synthesized
tagctggatgcagtaagtgaat

SEQ ID NO: 907614 - DNA, 22 bp, Artificial Sequence
  chemically synthesized
agctggatgcagtaagtgaatg

SEQ ID NO: 907615 - DNA, 22 bp, Artificial Sequence
  chemically synthesized
gctggatgcagtaagtgaatga

SEQ ID NO: 907616 - DNA, 22 bp, Artificial Sequence
  chemically synthesized
gatgcagtaagtgaatgagact

SEQ ID NO: 907617 - DNA, 22 bp, Artificial Sequence
  chemically synthesized
ccaagagagaccagtcaaagtc

SEQ ID NO: 907618 - DNA, 22 bp, Artificial Sequence
  chemically synthesized
cccaagagagaccagtcaaagt

SEQ ID NO: 907619 - DNA, 22 bp, Artificial Sequence
  chemically synthesized
tgactggtctctcttgggaagg

SEQ ID NO: 907620 - DNA, 22 bp, Artificial Sequence
  chemically synthesized
gactggtctctcttgggaaggc

SEQ ID NO: 907621 - DNA, 22 bp, Artificial Sequence
  chemically synthesized
actggtctctcttgggaaggca

SEQ ID NO: 907622 - DNA, 22 bp, Artificial Sequence
  chemically synthesized
gtctctcttgggaaggcactgt

SEQ ID NO: 907623 - DNA, 22 bp, Artificial Sequence
  chemically synthesized
tcatcaagagaacacacagtgc

SEQ ID NO: 907624 - DNA, 22 bp, Artificial Sequence
  chemically synthesized
atcatcaagagaacacacagtg

SEQ ID NO: 907625 - DNA, 22 bp, Artificial Sequence
  chemically synthesized
tcttgggaaggcactgtgtgtt

SEQ ID NO: 907626 - DNA, 22 bp, Artificial Sequence
  chemically synthesized
ttatcatcaagagaacacacag

SEQ ID NO: 907627 - DNA, 22 bp, Artificial Sequence
  chemically synthesized
ttgggaaggcactgtgtgttct

SEQ ID NO: 907628 - DNA, 22 bp, Artificial Sequence
  chemically synthesized
cttatcatcaagagaacacaca

SEQ ID NO: 907629 - DNA, 22 bp, Artificial Sequence
  chemically synthesized
tcttatcatcaagagaacacac

SEQ ID NO: 907630 - DNA, 22 bp, Artificial Sequence
  chemically synthesized
gggaaggcactgtgtgttctct

SEQ ID NO: 907631 - DNA, 22 bp, Artificial Sequence
  chemically synthesized
ggaaggcactgtgtgttctctt

SEQ ID NO: 907632 - DNA, 22 bp, Artificial Sequence
  chemically synthesized
tttcttatcatcaagagaacac

SEQ ID NO: 907633 - DNA, 22 bp, Artificial Sequence
  chemically synthesized
tctttcttatcatcaagagaac

SEQ ID NO: 907634 - DNA, 22 bp, Artificial Sequence
  chemically synthesized
tgtgttctcttgatgataagaa

SEQ ID NO: 907635 - DNA, 22 bp, Artificial Sequence
  chemically synthesized
tcttgatgataagaaagagagt

SEQ ID NO: 907636 - DNA, 22 bp, Artificial Sequence
  chemically synthesized
ttgatgataagaaagagagtgc

SEQ ID NO: 907637 - DNA, 22 bp, Artificial Sequence
  chemically synthesized
gatgataagaaagagagtgcat

SEQ ID NO: 907638 - DNA, 22 bp, Artificial Sequence
  chemically synthesized
atgataagaaagagagtgcatg

SEQ ID NO: 907639 - DNA, 22 bp, Artificial Sequence
  chemically synthesized
gtcccacaaatatccatgcact

SEQ ID NO: 907640 - DNA, 22 bp, Artificial Sequence
  chemically synthesized
catgctggtcccacaaatatcc

SEQ ID NO: 907641 - DNA, 22 bp, Artificial Sequence
  chemically synthesized
aaaatctccatgctggtcccac

SEQ ID NO: 907642 - DNA, 22 bp, Artificial Sequence
  chemically synthesized
caaaatctccatgctggtccca

SEQ ID NO: 907643 - DNA, 22 bp, Artificial Sequence
  chemically synthesized
catttcaaaatctccatgctgg

SEQ ID NO: 907644 - DNA, 22 bp, Artificial Sequence
  chemically synthesized
gtgggaccagcatggagatttt

SEQ ID NO: 907645 - DNA, 22 bp, Artificial Sequence
  chemically synthesized
tgggaccagcatggagattttg

SEQ ID NO: 907646 - DNA, 22 bp, Artificial Sequence
  chemically synthesized
aatataatactgcatttcaaaa

SEQ ID NO: 907647 - DNA, 22 bp, Artificial Sequence
  chemically synthesized
tcaatataatactgcatttcaa

SEQ ID NO: 907648 - DNA, 22 bp, Artificial Sequence
  chemically synthesized
ttctcaatataatactgcattt

SEQ ID NO: 907649 - DNA, 22 bp, Artificial Sequence
  chemically synthesized
tactattctcaatataatactg

SEQ ID NO: 907650 - DNA, 22 bp, Artificial Sequence
  chemically synthesized
tgaaatgcagtattatattgag

SEQ ID NO: 907651 - DNA, 22 bp, Artificial Sequence
  chemically synthesized
gaaatgcagtattatattgaga

SEQ ID NO: 907652 - DNA, 22 bp, Artificial Sequence
  chemically synthesized
aaatgcagtattatattgagaa

SEQ ID NO: 907653 - DNA, 22 bp, Artificial Sequence
  chemically synthesized
gcaaggcagctatactattctc

SEQ ID NO: 907654 - DNA, 22 bp, Artificial Sequence
  chemically synthesized
tattgagaatagtatagctgcc

SEQ ID NO: 907655 - DNA, 22 bp, Artificial Sequence
  chemically synthesized
agaatagtatagctgccttgct

SEQ ID NO: 907656 - DNA, 22 bp, Artificial Sequence
  chemically synthesized
aaaaggaacacaggctagcaag

SEQ ID NO: 907657 - DNA, 22 bp, Artificial Sequence
  chemically synthesized
taaaaaggaacacaggctagca

SEQ ID NO: 907658 - DNA, 22 bp, Artificial Sequence
  chemically synthesized
ctctaaaaaggaacacaggcta

SEQ ID NO: 907659 - DNA, 22 bp, Artificial Sequence
  chemically synthesized
tgctctaaaaaggaacacaggc

SEQ ID NO: 907660 - DNA, 22 bp, Artificial Sequence
  chemically synthesized
ccttgctagcctgtgttccttt

SEQ ID NO: 907661 - DNA, 22 bp, Artificial Sequence
  chemically synthesized
gctagcctgtgttcctttttag

SEQ ID NO: 907662 - DNA, 22 bp, Artificial Sequence
  chemically synthesized
ctagcctgtgttcctttttaga

SEQ ID NO: 907663 - DNA, 22 bp, Artificial Sequence
  chemically synthesized
gcctgtgttcctttttagagca

SEQ ID NO: 907664 - DNA, 22 bp, Artificial Sequence
  chemically synthesized
ggtacgtagtctctgctctaaa

SEQ ID NO: 907665 - DNA, 22 bp, Artificial Sequence
  chemically synthesized
tgttcctttttagagcagagac

SEQ ID NO: 907666 - DNA, 22 bp, Artificial Sequence
  chemically synthesized
ctttttagagcagagactacgt

SEQ ID NO: 907667 - DNA, 22 bp, Artificial Sequence
  chemically synthesized
tttagagcagagactacgtacc

SEQ ID NO: 907668 - DNA, 22 bp, Artificial Sequence
  chemically synthesized
ttagagcagagactacgtacct

SEQ ID NO: 907669 - DNA, 22 bp, Artificial Sequence
  chemically synthesized
tagagcagagactacgtaccta

SEQ ID NO: 907670 - DNA, 22 bp, Artificial Sequence
  chemically synthesized
agagcagagactacgtacctag

SEQ ID NO: 907671 - DNA, 22 bp, Artificial Sequence
  chemically synthesized
gagcagagactacgtacctagg

SEQ ID NO: 907672 - DNA, 22 bp, Artificial Sequence
  chemically synthesized
ccacataaagtccagcctaggt

SEQ ID NO: 907673 - DNA, 22 bp, Artificial Sequence
  chemically synthesized
cccacataaagtccagcctagg

SEQ ID NO: 907674 - DNA, 22 bp, Artificial Sequence
  chemically synthesized
tcccacataaagtccagcctag

SEQ ID NO: 907675 - DNA, 22 bp, Artificial Sequence
  chemically synthesized
cgtacctaggctggactttatg

SEQ ID NO: 907676 - DNA, 22 bp, Artificial Sequence
  chemically synthesized
ggctggactttatgtgggaaag

SEQ ID NO: 907677 - DNA, 22 bp, Artificial Sequence
  chemically synthesized
gactttatgtgggaaagataca

SEQ ID NO: 907678 - DNA, 22 bp, Artificial Sequence
  chemically synthesized
aaacaatatagatatgtgtatc

SEQ ID NO: 907679 - DNA, 22 bp, Artificial Sequence
  chemically synthesized
tatgtgggaaagatacacatat

SEQ ID NO: 907680 - DNA, 22 bp, Artificial Sequence
  chemically synthesized
caaacaatatagatatgtgtat

SEQ ID NO: 907681 - DNA, 22 bp, Artificial Sequence
  chemically synthesized
atgtgggaaagatacacatatc

SEQ ID NO: 907682 - DNA, 22 bp, Artificial Sequence
  chemically synthesized
tgtgggaaagatacacatatct

SEQ ID NO: 907683 - DNA, 22 bp, Artificial Sequence
  chemically synthesized
catgtttcaaacaatatagata

SEQ ID NO: 907684 - DNA, 22 bp, Artificial Sequence
  chemically synthesized
ccatgtttcaaacaatatagat

SEQ ID NO: 907685 - DNA, 22 bp, Artificial Sequence
  chemically synthesized
tattgtttgaaacatggaaact

SEQ ID NO: 907686 - DNA, 22 bp, Artificial Sequence
  chemically synthesized
taataaaaataccccaagtttc

SEQ ID NO: 907687 - DNA, 22 bp, Artificial Sequence
  chemically synthesized
tttgaaacatggaaacttgggg

SEQ ID NO: 907688 - DNA, 22 bp, Artificial Sequence
  chemically synthesized
ctataataaaaataccccaagt

SEQ ID NO: 907689 - DNA, 22 bp, Artificial Sequence
  chemically synthesized
gaaacatggaaacttggggtat

SEQ ID NO: 907690 - DNA, 22 bp, Artificial Sequence
  chemically synthesized
aaacatggaaacttggggtatt

SEQ ID NO: 907691 - DNA, 22 bp, Artificial Sequence
  chemically synthesized
agctactataataaaaataccc

SEQ ID NO: 907692 - DNA, 22 bp, Artificial Sequence
  chemically synthesized
ggggtatttttattatagtagc

SEQ ID NO: 907693 - DNA, 22 bp, Artificial Sequence
  chemically synthesized
gggtatttttattatagtagct

SEQ ID NO: 907694 - DNA, 22 bp, Artificial Sequence
  chemically synthesized
agggtgtagactgagctactat

SEQ ID NO: 907695 - DNA, 22 bp, Artificial Sequence
  chemically synthesized
tcagggtgtagactgagctact

SEQ ID NO: 907696 - DNA, 22 bp, Artificial Sequence
  chemically synthesized
ctcagggtgtagactgagctac

SEQ ID NO: 907697 - DNA, 22 bp, Artificial Sequence
  chemically synthesized
ttattatagtagctcagtctac

SEQ ID NO: 907698 - DNA, 22 bp, Artificial Sequence
  chemically synthesized
tattatagtagctcagtctaca

SEQ ID NO: 907699 - DNA, 22 bp, Artificial Sequence
  chemically synthesized
attatagtagctcagtctacac

SEQ ID NO: 907700 - DNA, 22 bp, Artificial Sequence
  chemically synthesized
agatttctcagggtgtagactg

SEQ ID NO: 907701 - DNA, 22 bp, Artificial Sequence
  chemically synthesized
ttatagtagctcagtctacacc

SEQ ID NO: 907702 - DNA, 22 bp, Artificial Sequence
  chemically synthesized
cagatttctcagggtgtagact

SEQ ID NO: 907703 - DNA, 22 bp, Artificial Sequence
  chemically synthesized
tcagatttctcagggtgtagac

SEQ ID NO: 907704 - DNA, 22 bp, Artificial Sequence
  chemically synthesized
ttcagatttctcagggtgtaga

SEQ ID NO: 907705 - DNA, 22 bp, Artificial Sequence
  chemically synthesized
tagtagctcagtctacaccctg

SEQ ID NO: 907706 - DNA, 22 bp, Artificial Sequence
  chemically synthesized
tcttttcagatttctcagggtg

SEQ ID NO: 907707 - DNA, 22 bp, Artificial Sequence
  chemically synthesized
attgtcttttcagatttctcag

SEQ ID NO: 907708 - DNA, 22 bp, Artificial Sequence
  chemically synthesized
agtctacaccctgagaaatctg

SEQ ID NO: 907709 - DNA, 22 bp, Artificial Sequence
  chemically synthesized
tcattgtcttttcagatttctc

SEQ ID NO: 907710 - DNA, 22 bp, Artificial Sequence
  chemically synthesized
caccctgagaaatctgaaaaga

SEQ ID NO: 907711 - DNA, 22 bp, Artificial Sequence
  chemically synthesized
agaaatctgaaaagacaatgag

SEQ ID NO: 907712 - DNA, 22 bp, Artificial Sequence
  chemically synthesized
caaatgcagccgttctcattgt

SEQ ID NO: 907713 - DNA, 22 bp, Artificial Sequence
  chemically synthesized
aaaagacaatgagaacggctgc

SEQ ID NO: 907714 - DNA, 22 bp, Artificial Sequence
  chemically synthesized
tataattacaaatgcagccgtt

SEQ ID NO: 907715 - DNA, 22 bp, Artificial Sequence
  chemically synthesized
aaatggattatataattacaaa

SEQ ID NO: 907716 - DNA, 22 bp, Artificial Sequence
  chemically synthesized
catttgtaattatataatccat

SEQ ID NO: 907717 - DNA, 22 bp, Artificial Sequence
  chemically synthesized
gtaattatataatccattttaa

SEQ ID NO: 907718 - DNA, 22 bp, Artificial Sequence
  chemically synthesized
taattatataatccattttaat

SEQ ID NO: 907719 - DNA, 22 bp, Artificial Sequence
  chemically synthesized
gagggggacaaacattaaaatg

SEQ ID NO: 907720 - DNA, 22 bp, Artificial Sequence
  chemically synthesized
ggagggggacaaacattaaaat

SEQ ID NO: 907721 - DNA, 22 bp, Artificial Sequence
  chemically synthesized
tataatccattttaatgtttgt

SEQ ID NO: 907722 - DNA, 22 bp, Artificial Sequence
  chemically synthesized
catttggagggggacaaacatt

SEQ ID NO: 907723 - DNA, 22 bp, Artificial Sequence
  chemically synthesized
acatttggagggggacaaacat

SEQ ID NO: 907724 - DNA, 22 bp, Artificial Sequence
  chemically synthesized
tggatcttacatttggaggggg

SEQ ID NO: 907725 - DNA, 22 bp, Artificial Sequence
  chemically synthesized
atggatcttacatttggagggg

SEQ ID NO: 907726 - DNA, 22 bp, Artificial Sequence
  chemically synthesized
taatgtttgtccccctccaaat

SEQ ID NO: 907727 - DNA, 22 bp, Artificial Sequence
  chemically synthesized
tatggatcttacatttggaggg

SEQ ID NO: 907728 - DNA, 22 bp, Artificial Sequence
  chemically synthesized
aatgtttgtccccctccaaatg

SEQ ID NO: 907729 - DNA, 22 bp, Artificial Sequence
  chemically synthesized
atgtttgtccccctccaaatgt

SEQ ID NO: 907730 - DNA, 22 bp, Artificial Sequence
  chemically synthesized
tctttatggatcttacatttgg

SEQ ID NO: 907731 - DNA, 22 bp, Artificial Sequence
  chemically synthesized
gtctttatggatcttacatttg

SEQ ID NO: 907732 - DNA, 22 bp, Artificial Sequence
  chemically synthesized
gtccccctccaaatgtaagatc

SEQ ID NO: 907733 - DNA, 22 bp, Artificial Sequence
  chemically synthesized
tccccctccaaatgtaagatcc

SEQ ID NO: 907734 - DNA, 22 bp, Artificial Sequence
  chemically synthesized
caaatgtaagatccataaagac

SEQ ID NO: 907735 - DNA, 22 bp, Artificial Sequence
  chemically synthesized
tgaacagacagacacttgtctt

SEQ ID NO: 907736 - DNA, 22 bp, Artificial Sequence
  chemically synthesized
aggaatgaggatagagttatga

SEQ ID NO: 907737 - DNA, 22 bp, Artificial Sequence
  chemically synthesized
tctgttcataactctatcctca

SEQ ID NO: 907738 - DNA, 22 bp, Artificial Sequence
  chemically synthesized
ttcataactctatcctcattcc

SEQ ID NO: 907739 - DNA, 22 bp, Artificial Sequence
  chemically synthesized
ataactctatcctcattcctta

SEQ ID NO: 907740 - DNA, 22 bp, Artificial Sequence
  chemically synthesized
caatatggtataatgttaagga

SEQ ID NO: 907741 - DNA, 22 bp, Artificial Sequence
  chemically synthesized
ccaatatggtataatgttaagg

SEQ ID NO: 907742 - DNA, 22 bp, Artificial Sequence
  chemically synthesized
tatcctcattccttaacattat

SEQ ID NO: 907743 - DNA, 22 bp, Artificial Sequence
  chemically synthesized
tcctcattccttaacattatac

SEQ ID NO: 907744 - DNA, 22 bp, Artificial Sequence
  chemically synthesized
agtgtttccaatatggtataat

SEQ ID NO: 907745 - DNA, 22 bp, Artificial Sequence
  chemically synthesized
attccttaacattataccatat

SEQ ID NO: 907746 - DNA, 22 bp, Artificial Sequence
  chemically synthesized
ttaagtgtttccaatatggtat

SEQ ID NO: 907747 - DNA, 22 bp, Artificial Sequence
  chemically synthesized
attaagtgtttccaatatggta

SEQ ID NO: 907748 - DNA, 22 bp, Artificial Sequence
  chemically synthesized
cttaacattataccatattgga

SEQ ID NO: 907749 - DNA, 22 bp, Artificial Sequence
  chemically synthesized
aacattataccatattggaaac

SEQ ID NO: 907750 - DNA, 22 bp, Artificial Sequence
  chemically synthesized
acattataccatattggaaaca

SEQ ID NO: 907751 - DNA, 22 bp, Artificial Sequence
  chemically synthesized
agtatttattaagtgtttccaa

SEQ ID NO: 907752 - DNA, 22 bp, Artificial Sequence
  chemically synthesized
taccatattggaaacacttaat

SEQ ID NO: 907753 - DNA, 22 bp, Artificial Sequence
  chemically synthesized
tgtatacattcagtatttatta

SEQ ID NO: 907754 - DNA, 22 bp, Artificial Sequence
  chemically synthesized
atgtatacattcagtatttatt

SEQ ID NO: 907755 - DNA, 22 bp, Artificial Sequence
  chemically synthesized
gaaacacttaataaatactgaa

SEQ ID NO: 907756 - DNA, 22 bp, Artificial Sequence
  chemically synthesized
gtttatgtatacattcagtatt

SEQ ID NO: 907757 - DNA, 22 bp, Artificial Sequence
  chemically synthesized
ggtttatgtatacattcagtat

SEQ ID NO: 907758 - DNA, 22 bp, Artificial Sequence
  chemically synthesized
aataaatactgaatgtatacat

SEQ ID NO: 907759 - DNA, 22 bp, Artificial Sequence
  chemically synthesized
ataaatactgaatgtatacata

SEQ ID NO: 907760 - DNA, 22 bp, Artificial Sequence
  chemically synthesized
aatgtatacataaaccaaggta

SEQ ID NO: 907761 - DNA, 22 bp, Artificial Sequence
  chemically synthesized
ggagtatagaaacagtaccttg

SEQ ID NO: 907762 - DNA, 22 bp, Artificial Sequence
  chemically synthesized
tgcaaaatcctaggagtataga

SEQ ID NO: 907763 - DNA, 22 bp, Artificial Sequence
  chemically synthesized
atgcaaaatcctaggagtatag

SEQ ID NO: 907764 - DNA, 22 bp, Artificial Sequence
  chemically synthesized
tatgcaaaatcctaggagtata

SEQ ID NO: 907765 - DNA, 22 bp, Artificial Sequence
  chemically synthesized
tttctatactcctaggattttg

SEQ ID NO: 907766 - DNA, 22 bp, Artificial Sequence
  chemically synthesized
aaagatactttatgcaaaatcc

SEQ ID NO: 907767 - DNA, 22 bp, Artificial Sequence
  chemically synthesized
ctatactcctaggattttgcat

SEQ ID NO: 907768 - DNA, 22 bp, Artificial Sequence
  chemically synthesized
tatactcctaggattttgcata

SEQ ID NO: 907769 - DNA, 22 bp, Artificial Sequence
  chemically synthesized
tactcctaggattttgcataaa

SEQ ID NO: 907770 - DNA, 22 bp, Artificial Sequence
  chemically synthesized
ctaggattttgcataaagtatc

SEQ ID NO: 907771 - DNA, 22 bp, Artificial Sequence
  chemically synthesized
ggattttgcataaagtatcttt

SEQ ID NO: 907772 - DNA, 22 bp, Artificial Sequence
  chemically synthesized
tgcataaagtatctttgaggat

SEQ ID NO: 907773 - DNA, 22 bp, Artificial Sequence
  chemically synthesized
gcataaagtatctttgaggatc

SEQ ID NO: 907774 - DNA, 22 bp, Artificial Sequence
  chemically synthesized
gagggtcacaaagatcctcaaa

SEQ ID NO: 907775 - DNA, 22 bp, Artificial Sequence
  chemically synthesized
cataaagtatctttgaggatct

SEQ ID NO: 907776 - DNA, 22 bp, Artificial Sequence
  chemically synthesized
tgaggatctttgtgaccctcta

SEQ ID NO: 907777 - DNA, 22 bp, Artificial Sequence
  chemically synthesized
gaggatctttgtgaccctctag

SEQ ID NO: 907778 - DNA, 22 bp, Artificial Sequence
  chemically synthesized
aggatctttgtgaccctctaga

SEQ ID NO: 907779 - DNA, 22 bp, Artificial Sequence
  chemically synthesized
aaaagccaatagtctagagggt

SEQ ID NO: 907780 - DNA, 22 bp, Artificial Sequence
  chemically synthesized
tcaaaagccaatagtctagagg

SEQ ID NO: 907781 - DNA, 22 bp, Artificial Sequence
  chemically synthesized
tgtgaccctctagactattggc

SEQ ID NO: 907782 - DNA, 22 bp, Artificial Sequence
  chemically synthesized
gtgaccctctagactattggct

SEQ ID NO: 907783 - DNA, 22 bp, Artificial Sequence
  chemically synthesized
tgaccctctagactattggctt

SEQ ID NO: 907784 - DNA, 22 bp, Artificial Sequence
  chemically synthesized
tagactattggcttttgagaat

SEQ ID NO: 907785 - DNA, 22 bp, Artificial Sequence
  chemically synthesized
acacagtatcaatattctcaaa

SEQ ID NO: 907786 - DNA, 22 bp, Artificial Sequence
  chemically synthesized
gactattggcttttgagaatat

SEQ ID NO: 907787 - DNA, 22 bp, Artificial Sequence
  chemically synthesized
ttggcttttgagaatattgata

SEQ ID NO: 907788 - DNA, 22 bp, Artificial Sequence
  chemically synthesized
gcttttgagaatattgatactg

SEQ ID NO: 907789 - DNA, 22 bp, Artificial Sequence
  chemically synthesized
acgtaatattgacacagtatca

SEQ ID NO: 907790 - DNA, 22 bp, Artificial Sequence
  chemically synthesized
ttgagaatattgatactgtgtc

SEQ ID NO: 907791 - DNA, 22 bp, Artificial Sequence
  chemically synthesized
tcacgtaatattgacacagtat

SEQ ID NO: 907792 - DNA, 22 bp, Artificial Sequence
  chemically synthesized
tgagaatattgatactgtgtca

SEQ ID NO: 907793 - DNA, 22 bp, Artificial Sequence
  chemically synthesized
gagaatattgatactgtgtcaa

SEQ ID NO: 907794 - DNA, 22 bp, Artificial Sequence
  chemically synthesized
agaatattgatactgtgtcaat

SEQ ID NO: 907795 - DNA, 22 bp, Artificial Sequence
  chemically synthesized
attctcacgtaatattgacaca

SEQ ID NO: 907796 - DNA, 22 bp, Artificial Sequence
  chemically synthesized
atcctgattctcacgtaatatt

SEQ ID NO: 907797 - DNA, 22 bp, Artificial Sequence
  chemically synthesized
atactgtgtcaatattacgtga

SEQ ID NO: 907798 - DNA, 22 bp, Artificial Sequence
  chemically synthesized
tgtcaatattacgtgagaatca

SEQ ID NO: 907799 - DNA, 22 bp, Artificial Sequence
  chemically synthesized
atcaactaatcctgattctcac

SEQ ID NO: 907800 - DNA, 22 bp, Artificial Sequence
  chemically synthesized
taatcaactaatcctgattctc

SEQ ID NO: 907801 - DNA, 22 bp, Artificial Sequence
  chemically synthesized
ctaatcaactaatcctgattct

SEQ ID NO: 907802 - DNA, 22 bp, Artificial Sequence
  chemically synthesized
agatttctaatcaactaatcct

SEQ ID NO: 907803 - DNA, 22 bp, Artificial Sequence
  chemically synthesized
cgtgagaatcaggattagttga

SEQ ID NO: 907804 - DNA, 22 bp, Artificial Sequence
  chemically synthesized
tgtattcagatttctaatcaac

SEQ ID NO: 907805 - DNA, 22 bp, Artificial Sequence
  chemically synthesized
ctatgtattcagatttctaatc

SEQ ID NO: 907806 - DNA, 22 bp, Artificial Sequence
  chemically synthesized
gttgattagaaatctgaataca

SEQ ID NO: 907807 - DNA, 22 bp, Artificial Sequence
  chemically synthesized
agatgcattcctatgtattcag

SEQ ID NO: 907808 - DNA, 22 bp, Artificial Sequence
  chemically synthesized
attagaaatctgaatacatagg

SEQ ID NO: 907809 - DNA, 22 bp, Artificial Sequence
  chemically synthesized
agttaagatgcattcctatgta

SEQ ID NO: 907810 - DNA, 22 bp, Artificial Sequence
  chemically synthesized
gaaatctgaatacataggaatg

SEQ ID NO: 907811 - DNA, 22 bp, Artificial Sequence
  chemically synthesized
aatacataggaatgcatcttaa

SEQ ID NO: 907812 - DNA, 22 bp, Artificial Sequence
  chemically synthesized
acaagtaaggtattcagttaag

SEQ ID NO: 907813 - DNA, 22 bp, Artificial Sequence
  chemically synthesized
accccctcacaagtaaggtatt

SEQ ID NO: 907814 - DNA, 22 bp, Artificial Sequence
  chemically synthesized
tcaccccctcacaagtaaggta

SEQ ID NO: 907815 - DNA, 22 bp, Artificial Sequence
  chemically synthesized
ctcaccccctcacaagtaaggt

SEQ ID NO: 907816 - DNA, 22 bp, Artificial Sequence
  chemically synthesized
aactgaataccttacttgtgag

SEQ ID NO: 907817 - DNA, 22 bp, Artificial Sequence
  chemically synthesized
actgaataccttacttgtgagg

SEQ ID NO: 907818 - DNA, 22 bp, Artificial Sequence
  chemically synthesized
agtttctcaccccctcacaagt

SEQ ID NO: 907819 - DNA, 22 bp, Artificial Sequence
  chemically synthesized
ttaagtttctcaccccctcaca

SEQ ID NO: 907820 - DNA, 22 bp, Artificial Sequence
  chemically synthesized
aataccttacttgtgagggggt

SEQ ID NO: 907821 - DNA, 22 bp, Artificial Sequence
  chemically synthesized
caatctattaagtttctcaccc

SEQ ID NO: 907822 - DNA, 22 bp, Artificial Sequence
  chemically synthesized
gcaatctattaagtttctcacc

SEQ ID NO: 907823 - DNA, 22 bp, Artificial Sequence
  chemically synthesized
acttgtgagggggtgagaaact

SEQ ID NO: 907824 - DNA, 22 bp, Artificial Sequence
  chemically synthesized
cttgtgagggggtgagaaactt

SEQ ID NO: 907825 - DNA, 22 bp, Artificial Sequence
  chemically synthesized
gtgagggggtgagaaacttaat

SEQ ID NO: 907826 - DNA, 22 bp, Artificial Sequence
  chemically synthesized
tgagggggtgagaaacttaata

SEQ ID NO: 907827 - DNA, 22 bp, Artificial Sequence
  chemically synthesized
ccacaccttgcaatctattaag

SEQ ID NO: 907828 - DNA, 22 bp, Artificial Sequence
  chemically synthesized
aatagattgcaaggtgtggtag

SEQ ID NO: 907829 - DNA, 22 bp, Artificial Sequence
  chemically synthesized
atagattgcaaggtgtggtaga

SEQ ID NO: 907830 - DNA, 22 bp, Artificial Sequence
  chemically synthesized
caaggtgtggtagattgcactg

SEQ ID NO: 907831 - DNA, 22 bp, Artificial Sequence
  chemically synthesized
caaaaagatgtgcatacagaga

SEQ ID NO: 907832 - DNA, 22 bp, Artificial Sequence
  chemically synthesized
cactggtgacctctctgtatgc

SEQ ID NO: 907833 - DNA, 22 bp, Artificial Sequence
  chemically synthesized
gtgacctctctgtatgcacatc

SEQ ID NO: 907834 - DNA, 22 bp, Artificial Sequence
  chemically synthesized
aaagtcacattgcaaaaagatg

SEQ ID NO: 907835 - DNA, 22 bp, Artificial Sequence
  chemically synthesized
aaaagtcacattgcaaaaagat

SEQ ID NO: 907836 - DNA, 22 bp, Artificial Sequence
  chemically synthesized
tctgtatgcacatctttttgca

SEQ ID NO: 907837 - DNA, 22 bp, Artificial Sequence
  chemically synthesized
taaaagtcacattgcaaaaaga

SEQ ID NO: 907838 - DNA, 22 bp, Artificial Sequence
  chemically synthesized
tgtatgcacatctttttgcaat

SEQ ID NO: 907839 - DNA, 22 bp, Artificial Sequence
  chemically synthesized
tatgcacatctttttgcaatgt

SEQ ID NO: 907840 - DNA, 22 bp, Artificial Sequence
  chemically synthesized
atggtagcaactttaaaagtca

SEQ ID NO: 907841 - DNA, 22 bp, Artificial Sequence
  chemically synthesized
tttgcaatgtgacttttaaagt

SEQ ID NO: 907842 - DNA, 22 bp, Artificial Sequence
  chemically synthesized
ctgatggtagcaactttaaaag

SEQ ID NO: 907843 - DNA, 22 bp, Artificial Sequence
  chemically synthesized
ttgcaatgtgacttttaaagtt

SEQ ID NO: 907844 - DNA, 22 bp, Artificial Sequence
  chemically synthesized
tgcaatgtgacttttaaagttg

SEQ ID NO: 907845 - DNA, 22 bp, Artificial Sequence
  chemically synthesized
gcaatgtgacttttaaagttgc

SEQ ID NO: 907846 - DNA, 22 bp, Artificial Sequence
  chemically synthesized
caatgtgacttttaaagttgct

SEQ ID NO: 907847 - DNA, 22 bp, Artificial Sequence
  chemically synthesized
caactcctgatggtagcaactt

SEQ ID NO: 907848 - DNA, 22 bp, Artificial Sequence
  chemically synthesized
ttaaagttgctaccatcaggag

SEQ ID NO: 907849 - DNA, 22 bp, Artificial Sequence
  chemically synthesized
taaagttgctaccatcaggagt

SEQ ID NO: 907850 - DNA, 22 bp, Artificial Sequence
  chemically synthesized
aaagttgctaccatcaggagtt

SEQ ID NO: 907851 - DNA, 22 bp, Artificial Sequence
  chemically synthesized
aagttgctaccatcaggagttg

SEQ ID NO: 907852 - DNA, 22 bp, Artificial Sequence
  chemically synthesized
gggaaataggttacaactcctg

SEQ ID NO: 907853 - DNA, 22 bp, Artificial Sequence
  chemically synthesized
ctaccatcaggagttgtaacct

SEQ ID NO: 907854 - DNA, 22 bp, Artificial Sequence
  chemically synthesized
ccatcaggagttgtaacctatt

SEQ ID NO: 907855 - DNA, 22 bp, Artificial Sequence
  chemically synthesized
agggattagggaaataggttac

SEQ ID NO: 907856 - DNA, 22 bp, Artificial Sequence
  chemically synthesized
taacctatttccctaatccctg

SEQ ID NO: 907857 - DNA, 22 bp, Artificial Sequence
  chemically synthesized
tttccctaatccctgaatatgg

SEQ ID NO: 907858 - DNA, 22 bp, Artificial Sequence
  chemically synthesized
ccctaatccctgaatatgggcc

SEQ ID NO: 907859 - DNA, 22 bp, Artificial Sequence
  chemically synthesized
cctaatccctgaatatgggcct

SEQ ID NO: 907860 - DNA, 22 bp, Artificial Sequence
  chemically synthesized
atccctgaatatgggcctgcct

SEQ ID NO: 907861 - DNA, 22 bp, Artificial Sequence
  chemically synthesized
accaaagcaaatcacaaggcag

SEQ ID NO: 907862 - DNA, 22 bp, Artificial Sequence
  chemically synthesized
aaccaaagcaaatcacaaggca

SEQ ID NO: 907863 - DNA, 22 bp, Artificial Sequence
  chemically synthesized
taaccaaagcaaatcacaaggc

SEQ ID NO: 907864 - DNA, 22 bp, Artificial Sequence
  chemically synthesized
aatatgggcctgccttgtgatt

SEQ ID NO: 907865 - DNA, 22 bp, Artificial Sequence
  chemically synthesized
ttaaccaaagcaaatcacaagg

SEQ ID NO: 907866 - DNA, 22 bp, Artificial Sequence
  chemically synthesized
tttaaccaaagcaaatcacaag

SEQ ID NO: 907867 - DNA, 22 bp, Artificial Sequence
  chemically synthesized
ttttaaccaaagcaaatcacaa

SEQ ID NO: 907868 - DNA, 22 bp, Artificial Sequence
  chemically synthesized
acacatttttttaaccaaagca

SEQ ID NO: 907869 - DNA, 22 bp, Artificial Sequence
  chemically synthesized
ccttgtgatttgctttggttaa

SEQ ID NO: 907870 - DNA, 22 bp, Artificial Sequence
  chemically synthesized
taacacatttttttaaccaaag

SEQ ID NO: 907871 - DNA, 22 bp, Artificial Sequence
  chemically synthesized
ctaacacatttttttaaccaaa

SEQ ID NO: 907872 - DNA, 22 bp, Artificial Sequence
  chemically synthesized
gtgatttgctttggttaaaaaa

SEQ ID NO: 907873 - DNA, 22 bp, Artificial Sequence
  chemically synthesized
tgatttgctttggttaaaaaaa

SEQ ID NO: 907874 - DNA, 22 bp, Artificial Sequence
  chemically synthesized
atttctaacacatttttttaac

SEQ ID NO: 907875 - DNA, 22 bp, Artificial Sequence
  chemically synthesized
actcatttctaacacatttttt

SEQ ID NO: 907876 - DNA, 22 bp, Artificial Sequence
  chemically synthesized
gctttggttaaaaaaatgtgtt

SEQ ID NO: 907877 - DNA, 22 bp, Artificial Sequence
  chemically synthesized
ctttggttaaaaaaatgtgtta

SEQ ID NO: 907878 - DNA, 22 bp, Artificial Sequence
  chemically synthesized
gctcactcatttctaacacatt

SEQ ID NO: 907879 - DNA, 22 bp, Artificial Sequence
  chemically synthesized
tggttaaaaaaatgtgttagaa

SEQ ID NO: 907880 - DNA, 22 bp, Artificial Sequence
  chemically synthesized
ggttaaaaaaatgtgttagaaa

SEQ ID NO: 907881 - DNA, 22 bp, Artificial Sequence
  chemically synthesized
gttaaaaaaatgtgttagaaat

SEQ ID NO: 907882 - DNA, 22 bp, Artificial Sequence
  chemically synthesized
gagctggctcactcatttctaa

SEQ ID NO: 907883 - DNA, 22 bp, Artificial Sequence
  chemically synthesized
ggagctggctcactcatttcta

SEQ ID NO: 907884 - DNA, 22 bp, Artificial Sequence
  chemically synthesized
aaaaaatgtgttagaaatgagt

SEQ ID NO: 907885 - DNA, 22 bp, Artificial Sequence
  chemically synthesized
agcttggagctggctcactcat

SEQ ID NO: 907886 - DNA, 22 bp, Artificial Sequence
  chemically synthesized
aagcttggagctggctcactca

SEQ ID NO: 907887 - DNA, 22 bp, Artificial Sequence
  chemically synthesized
aagcttaagcttggagctggct

SEQ ID NO: 907888 - DNA, 22 bp, Artificial Sequence
  chemically synthesized
gaagcttaagcttggagctggc

SEQ ID NO: 907889 - DNA, 22 bp, Artificial Sequence
  chemically synthesized
gaaatgagtgagccagctccaa

SEQ ID NO: 907890 - DNA, 22 bp, Artificial Sequence
  chemically synthesized
ttgaagcttaagcttggagctg

SEQ ID NO: 907891 - DNA, 22 bp, Artificial Sequence
  chemically synthesized
cttgaagcttaagcttggagct

SEQ ID NO: 907892 - DNA, 22 bp, Artificial Sequence
  chemically synthesized
caagcttaagcttcaagaagtc

SEQ ID NO: 907893 - DNA, 22 bp, Artificial Sequence
  chemically synthesized
atagagaaggaaacaagacttc

SEQ ID NO: 907894 - DNA, 22 bp, Artificial Sequence
  chemically synthesized
taatagagaaggaaacaagact

SEQ ID NO: 907895 - DNA, 22 bp, Artificial Sequence
  chemically synthesized
aagcttcaagaagtcttgtttc

SEQ ID NO: 907896 - DNA, 22 bp, Artificial Sequence
  chemically synthesized
agcttcaagaagtcttgtttcc

SEQ ID NO: 907897 - DNA, 22 bp, Artificial Sequence
  chemically synthesized
caagaagtcttgtttccttctc

SEQ ID NO: 907898 - DNA, 22 bp, Artificial Sequence
  chemically synthesized
aagaagtcttgtttccttctct

SEQ ID NO: 907899 - DNA, 22 bp, Artificial Sequence
  chemically synthesized
gtttccttctctattagaatcc

SEQ ID NO: 907900 - DNA, 22 bp, Artificial Sequence
  chemically synthesized
atgcaagaaacaggattctaat

SEQ ID NO: 907901 - DNA, 22 bp, Artificial Sequence
  chemically synthesized
tttccttctctattagaatcct

SEQ ID NO: 907902 - DNA, 22 bp, Artificial Sequence
  chemically synthesized
tcatgcaagaaacaggattcta

SEQ ID NO: 907903 - DNA, 22 bp, Artificial Sequence
  chemically synthesized
ccttctctattagaatcctgtt

SEQ ID NO: 907904 - DNA, 22 bp, Artificial Sequence
  chemically synthesized
cttctctattagaatcctgttt

SEQ ID NO: 907905 - DNA, 22 bp, Artificial Sequence
  chemically synthesized
ttctcatgcaagaaacaggatt

SEQ ID NO: 907906 - DNA, 22 bp, Artificial Sequence
  chemically synthesized
attctcatgcaagaaacaggat

SEQ ID NO: 907907 - DNA, 22 bp, Artificial Sequence
  chemically synthesized
ctctattagaatcctgtttctt

SEQ ID NO: 907908 - DNA, 22 bp, Artificial Sequence
  chemically synthesized
tctattagaatcctgtttcttg

SEQ ID NO: 907909 - DNA, 22 bp, Artificial Sequence
  chemically synthesized
tattagaatcctgtttcttgca

SEQ ID NO: 907910 - DNA, 22 bp, Artificial Sequence
  chemically synthesized
ggcttattctcatgcaagaaac

SEQ ID NO: 907911 - DNA, 22 bp, Artificial Sequence
  chemically synthesized
ttagaatcctgtttcttgcatg

SEQ ID NO: 907912 - DNA, 22 bp, Artificial Sequence
  chemically synthesized
ctgggcttattctcatgcaaga

SEQ ID NO: 907913 - DNA, 22 bp, Artificial Sequence
  chemically synthesized
gaatcctgtttcttgcatgaga

SEQ ID NO: 907914 - DNA, 22 bp, Artificial Sequence
  chemically synthesized
tttcttgcatgagaataagccc

SEQ ID NO: 907915 - DNA, 22 bp, Artificial Sequence
  chemically synthesized
ggcaagcgctcctgggcttatt

SEQ ID NO: 907916 - DNA, 22 bp, Artificial Sequence
  chemically synthesized
cggcaagcgctcctgggcttat

SEQ ID NO: 907917 - DNA, 22 bp, Artificial Sequence
  chemically synthesized
cttgcatgagaataagcccagg

SEQ ID NO: 907918 - DNA, 22 bp, Artificial Sequence
  chemically synthesized
ttgcatgagaataagcccagga

SEQ ID NO: 907919 - DNA, 22 bp, Artificial Sequence
  chemically synthesized
gcatgagaataagcccaggagc

SEQ ID NO: 907920 - DNA, 22 bp, Artificial Sequence
  chemically synthesized
catgagaataagcccaggagcg

SEQ ID NO: 907921 - DNA, 22 bp, Artificial Sequence
  chemically synthesized
atccttcggcaagcgctcctgg

SEQ ID NO: 907922 - DNA, 22 bp, Artificial Sequence
  chemically synthesized
tcatccttcggcaagcgctcct

SEQ ID NO: 907923 - DNA, 22 bp, Artificial Sequence
  chemically synthesized
catatggtctctcatccttcgg

SEQ ID NO: 907924 - DNA, 22 bp, Artificial Sequence
  chemically synthesized
ctccatatggtctctcatcctt

SEQ ID NO: 907925 - DNA, 22 bp, Artificial Sequence
  chemically synthesized
tgctccatatggtctctcatcc

SEQ ID NO: 907926 - DNA, 22 bp, Artificial Sequence
  chemically synthesized
acctctgctccatatggtctct

SEQ ID NO: 907927 - DNA, 22 bp, Artificial Sequence
  chemically synthesized
gccgaaggatgagagaccatat

SEQ ID NO: 907928 - DNA, 22 bp, Artificial Sequence
  chemically synthesized
ccgaaggatgagagaccatatg

SEQ ID NO: 907929 - DNA, 22 bp, Artificial Sequence
  chemically synthesized
ggatgattcacctctgctccat

SEQ ID NO: 907930 - DNA, 22 bp, Artificial Sequence
  chemically synthesized
gcataagcgcagctaggatgat

SEQ ID NO: 907931 - DNA, 22 bp, Artificial Sequence
  chemically synthesized
tctagcataagcgcagctagga

SEQ ID NO: 907932 - DNA, 22 bp, Artificial Sequence
  chemically synthesized
atctagcataagcgcagctagg

SEQ ID NO: 907933 - DNA, 22 bp, Artificial Sequence
  chemically synthesized
gcttatctagcataagcgcagc

SEQ ID NO: 907934 - DNA, 22 bp, Artificial Sequence
  chemically synthesized
ggggctggcttatctagcataa

SEQ ID NO: 907935 - DNA, 22 bp, Artificial Sequence
  chemically synthesized
gctgcgcttatgctagataagc

SEQ ID NO: 907936 - DNA, 22 bp, Artificial Sequence
  chemically synthesized
cgcttatgctagataagccagc

SEQ ID NO: 907937 - DNA, 22 bp, Artificial Sequence
  chemically synthesized
atgggtgggctaggggctggct

SEQ ID NO: 907938 - DNA, 22 bp, Artificial Sequence
  chemically synthesized
atgctagataagccagccccta

SEQ ID NO: 907939 - DNA, 22 bp, Artificial Sequence
  chemically synthesized
tgctagataagccagcccctag

SEQ ID NO: 907940 - DNA, 22 bp, Artificial Sequence
  chemically synthesized
gataagccagcccctagcccac

SEQ ID NO: 907941 - DNA, 22 bp, Artificial Sequence
  chemically synthesized
agtcagctaatgggtgggctag

SEQ ID NO: 907942 - DNA, 22 bp, Artificial Sequence
  chemically synthesized
cagtcagctaatgggtgggcta

SEQ ID NO: 907943 - DNA, 22 bp, Artificial Sequence
  chemically synthesized
tcagtcagctaatgggtgggct

SEQ ID NO: 907944 - DNA, 22 bp, Artificial Sequence
  chemically synthesized
atacattttcagtcagctaatg

SEQ ID NO: 907945 - DNA, 22 bp, Artificial Sequence
  chemically synthesized
actcatacattttcagtcagct

SEQ ID NO: 907946 - DNA, 22 bp, Artificial Sequence
  chemically synthesized
gcccacccattagctgactgaa

SEQ ID NO: 907947 - DNA, 22 bp, Artificial Sequence
  chemically synthesized
gctcactcatacattttcagtc

SEQ ID NO: 907948 - DNA, 22 bp, Artificial Sequence
  chemically synthesized
tggctcactcatacattttcag

SEQ ID NO: 907949 - DNA, 22 bp, Artificial Sequence
  chemically synthesized
ttctggctcactcatacatttt

SEQ ID NO: 907950 - DNA, 22 bp, Artificial Sequence
  chemically synthesized
gctgactgaaaatgtatgagtg

SEQ ID NO: 907951 - DNA, 22 bp, Artificial Sequence
  chemically synthesized
tgttgttctggctcactcatac

SEQ ID NO: 907952 - DNA, 22 bp, Artificial Sequence
  chemically synthesized
actgaaaatgtatgagtgagcc

SEQ ID NO: 907953 - DNA, 22 bp, Artificial Sequence
  chemically synthesized
ttgtgttgttctggctcactca

SEQ ID NO: 907954 - DNA, 22 bp, Artificial Sequence
  chemically synthesized
aaaatgtatgagtgagccagaa

SEQ ID NO: 907955 - DNA, 22 bp, Artificial Sequence
  chemically synthesized
tggggtcccgtgagctgttgtg

SEQ ID NO: 907956 - DNA, 22 bp, Artificial Sequence
  chemically synthesized
cacacagtctgtggggtcccgt

SEQ ID NO: 907957 - DNA, 22 bp, Artificial Sequence
  chemically synthesized
taattgcacacagtctgtgggg

SEQ ID NO: 907958 - DNA, 22 bp, Artificial Sequence
  chemically synthesized
ataattgcacacagtctgtggg

SEQ ID NO: 907959 - DNA, 22 bp, Artificial Sequence
  chemically synthesized
acgggaccccacagactgtgtg

SEQ ID NO: 907960 - DNA, 22 bp, Artificial Sequence
  chemically synthesized
tcaccatttataattgcacaca

SEQ ID NO: 907961 - DNA, 22 bp, Artificial Sequence
  chemically synthesized
aaattatcaccatttataattg

SEQ ID NO: 907962 - DNA, 22 bp, Artificial Sequence
  chemically synthesized
aaaattatcaccatttataatt

SEQ ID NO: 907963 - DNA, 22 bp, Artificial Sequence
  chemically synthesized
acttaaaattatcaccatttat

SEQ ID NO: 907964 - DNA, 22 bp, Artificial Sequence
  chemically synthesized
tgtgcaattataaatggtgata

SEQ ID NO: 907965 - DNA, 22 bp, Artificial Sequence
  chemically synthesized
ttgacttaaaattatcaccatt

SEQ ID NO: 907966 - DNA, 22 bp, Artificial Sequence
  chemically synthesized
attgacttaaaattatcaccat

SEQ ID NO: 907967 - DNA, 22 bp, Artificial Sequence
  chemically synthesized
aaacttattgacttaaaattat

SEQ ID NO: 907968 - DNA, 22 bp, Artificial Sequence
  chemically synthesized
taaatggtgataattttaagtc

SEQ ID NO: 907969 - DNA, 22 bp, Artificial Sequence
  chemically synthesized
tgtaacaaatcaccctaaaact

SEQ ID NO: 907970 - DNA, 22 bp, Artificial Sequence
  chemically synthesized
taagtcaataagttttagggtg

SEQ ID NO: 907971 - DNA, 22 bp, Artificial Sequence
  chemically synthesized
aagtcaataagttttagggtga

SEQ ID NO: 907972 - DNA, 22 bp, Artificial Sequence
  chemically synthesized
agtcaataagttttagggtgat

SEQ ID NO: 907973 - DNA, 22 bp, Artificial Sequence
  chemically synthesized
caatagtgttatgtaacaaatc

SEQ ID NO: 907974 - DNA, 22 bp, Artificial Sequence
  chemically synthesized
gcaatagtgttatgtaacaaat

SEQ ID NO: 907975 - DNA, 22 bp, Artificial Sequence
  chemically synthesized
tagggtgatttgttacataaca

SEQ ID NO: 907976 - DNA, 22 bp, Artificial Sequence
  chemically synthesized
agggtgatttgttacataacac

SEQ ID NO: 907977 - DNA, 22 bp, Artificial Sequence
  chemically synthesized
gggtgatttgttacataacact

SEQ ID NO: 907978 - DNA, 22 bp, Artificial Sequence
  chemically synthesized
gttacataacactattgcaaat

SEQ ID NO: 907979 - DNA, 22 bp, Artificial Sequence
  chemically synthesized
caatagtgtaaaatttgcaata

SEQ ID NO: 907980 - DNA, 22 bp, Artificial Sequence
  chemically synthesized
ttacataacactattgcaaatt

SEQ ID NO: 907981 - DNA, 22 bp, Artificial Sequence
  chemically synthesized
cataacactattgcaaatttta

SEQ ID NO: 907982 - DNA, 22 bp, Artificial Sequence
  chemically synthesized
agtaataactccaatagtgtaa

SEQ ID NO: 907983 - DNA, 22 bp, Artificial Sequence
  chemically synthesized
ttgcaaattttacactattgga

SEQ ID NO: 907984 - DNA, 22 bp, Artificial Sequence
  chemically synthesized
caaattttacactattggagtt

SEQ ID NO: 907985 - DNA, 22 bp, Artificial Sequence
  chemically synthesized
tatatcagttaagtaataactc

SEQ ID NO: 907986 - DNA, 22 bp, Artificial Sequence
  chemically synthesized
tacactattggagttattactt

SEQ ID NO: 907987 - DNA, 22 bp, Artificial Sequence
  chemically synthesized
acactattggagttattactta

SEQ ID NO: 907988 - DNA, 22 bp, Artificial Sequence
  chemically synthesized
cactattggagttattacttaa

SEQ ID NO: 907989 - DNA, 22 bp, Artificial Sequence
  chemically synthesized
ccctatatatcagttaagtaat

SEQ ID NO: 907990 - DNA, 22 bp, Artificial Sequence
  chemically synthesized
cccctatatatcagttaagtaa

SEQ ID NO: 907991 - DNA, 22 bp, Artificial Sequence
  chemically synthesized
tcccctatatatcagttaagta

SEQ ID NO: 907992 - DNA, 22 bp, Artificial Sequence
  chemically synthesized
ttggagttattacttaactgat

SEQ ID NO: 907993 - DNA, 22 bp, Artificial Sequence
  chemically synthesized
gctttcccctatatatcagtta

SEQ ID NO: 907994 - DNA, 22 bp, Artificial Sequence
  chemically synthesized
gagttattacttaactgatata

SEQ ID NO: 907995 - DNA, 22 bp, Artificial Sequence
  chemically synthesized
tggctttcccctatatatcagt

SEQ ID NO: 907996 - DNA, 22 bp, Artificial Sequence
  chemically synthesized
ctggctttcccctatatatcag

SEQ ID NO: 907997 - DNA, 22 bp, Artificial Sequence
  chemically synthesized
ttacttaactgatatatagggg

SEQ ID NO: 907998 - DNA, 22 bp, Artificial Sequence
  chemically synthesized
ccatttctggctttcccctata

SEQ ID NO: 907999 - DNA, 22 bp, Artificial Sequence
  chemically synthesized
cttaactgatatataggggaaa

SEQ ID NO: 908000 - DNA, 22 bp, Artificial Sequence
  chemically synthesized
aactgatatataggggaaagcc

SEQ ID NO: 908001 - DNA, 22 bp, Artificial Sequence
  chemically synthesized
actcccatttctggctttcccc

SEQ ID NO: 908002 - DNA, 22 bp, Artificial Sequence
  chemically synthesized
actgatatataggggaaagcca

SEQ ID NO: 908003 - DNA, 22 bp, Artificial Sequence
  chemically synthesized
atatataggggaaagccagaaa

SEQ ID NO: 908004 - DNA, 22 bp, Artificial Sequence
  chemically synthesized
taccaagcctcactcccatttc

SEQ ID NO: 908005 - DNA, 22 bp, Artificial Sequence
  chemically synthesized
actgtaccaagcctcactccca

SEQ ID NO: 908006 - DNA, 22 bp, Artificial Sequence
  chemically synthesized
aactgtaccaagcctcactccc

SEQ ID NO: 908007 - DNA, 22 bp, Artificial Sequence
  chemically synthesized
ttaactgtaccaagcctcactc

SEQ ID NO: 908008 - DNA, 22 bp, Artificial Sequence
  chemically synthesized
agaactcttaactgtaccaagc

SEQ ID NO: 908009 - DNA, 22 bp, Artificial Sequence
  chemically synthesized
aagaactcttaactgtaccaag

SEQ ID NO: 908010 - DNA, 22 bp, Artificial Sequence
  chemically synthesized
tttaagaactcttaactgtacc

SEQ ID NO: 908011 - DNA, 22 bp, Artificial Sequence
  chemically synthesized
gtattatttaagaactcttaac

SEQ ID NO: 908012 - DNA, 22 bp, Artificial Sequence
  chemically synthesized
tggtattatttaagaactctta

SEQ ID NO: 908013 - DNA, 22 bp, Artificial Sequence
  chemically synthesized
ggtacagttaagagttcttaaa

SEQ ID NO: 908014 - DNA, 22 bp, Artificial Sequence
  chemically synthesized
gtacagttaagagttcttaaat

SEQ ID NO: 908015 - DNA, 22 bp, Artificial Sequence
  chemically synthesized
aggactctggtattatttaaga

SEQ ID NO: 908016 - DNA, 22 bp, Artificial Sequence
  chemically synthesized
ggattgaggactctggtattat

SEQ ID NO: 908017 - DNA, 22 bp, Artificial Sequence
  chemically synthesized
agagttcttaaataataccaga

SEQ ID NO: 908018 - DNA, 22 bp, Artificial Sequence
  chemically synthesized
aggattgaggactctggtatta

SEQ ID NO: 908019 - DNA, 22 bp, Artificial Sequence
  chemically synthesized
taggattgaggactctggtatt

SEQ ID NO: 908020 - DNA, 22 bp, Artificial Sequence
  chemically synthesized
ttaaataataccagagtcctca

SEQ ID NO: 908021 - DNA, 22 bp, Artificial Sequence
  chemically synthesized
aaataataccagagtcctcaat

SEQ ID NO: 908022 - DNA, 22 bp, Artificial Sequence
  chemically synthesized
aataataccagagtcctcaatc

SEQ ID NO: 908023 - DNA, 22 bp, Artificial Sequence
  chemically synthesized
aaaatcaaaatcagtaatttta

SEQ ID NO: 908024 - DNA, 22 bp, Artificial Sequence
  chemically synthesized
attcaaaatcaaaatcagtaat

SEQ ID NO: 908025 - DNA, 22 bp, Artificial Sequence
  chemically synthesized
aatcctaaaattactgattttg

SEQ ID NO: 908026 - DNA, 22 bp, Artificial Sequence
  chemically synthesized
gatactcattcaaaatcaaaat

SEQ ID NO: 908027 - DNA, 22 bp, Artificial Sequence
  chemically synthesized
agatactcattcaaaatcaaaa

SEQ ID NO: 908028 - DNA, 22 bp, Artificial Sequence
  chemically synthesized
tagatactcattcaaaatcaaa

SEQ ID NO: 908029 - DNA, 22 bp, Artificial Sequence
  chemically synthesized
aaattactgattttgattttga

SEQ ID NO: 908030 - DNA, 22 bp, Artificial Sequence
  chemically synthesized
actttagatactcattcaaaat

SEQ ID NO: 908031 - DNA, 22 bp, Artificial Sequence
  chemically synthesized
ctgattttgattttgaatgagt

SEQ ID NO: 908032 - DNA, 22 bp, Artificial Sequence
  chemically synthesized
attttgattttgaatgagtatc

SEQ ID NO: 908033 - DNA, 22 bp, Artificial Sequence
  chemically synthesized
agcctgactttagatactcatt

SEQ ID NO: 908034 - DNA, 22 bp, Artificial Sequence
  chemically synthesized
tgattttgaatgagtatctaaa

SEQ ID NO: 908035 - DNA, 22 bp, Artificial Sequence
  chemically synthesized
gattttgaatgagtatctaaag

SEQ ID NO: 908036 - DNA, 22 bp, Artificial Sequence
  chemically synthesized
attttgaatgagtatctaaagt

SEQ ID NO: 908037 - DNA, 22 bp, Artificial Sequence
  chemically synthesized
tgaatgagtatctaaagtcagg

SEQ ID NO: 908038 - DNA, 22 bp, Artificial Sequence
  chemically synthesized
caaagaattgagcctgacttta

SEQ ID NO: 908039 - DNA, 22 bp, Artificial Sequence
  chemically synthesized
gaatgagtatctaaagtcaggc

SEQ ID NO: 908040 - DNA, 22 bp, Artificial Sequence
  chemically synthesized
gcaaagaattgagcctgacttt

SEQ ID NO: 908041 - DNA, 22 bp, Artificial Sequence
  chemically synthesized
aatgagtatctaaagtcaggct

SEQ ID NO: 908042 - DNA, 22 bp, Artificial Sequence
  chemically synthesized
tgcaaagaattgagcctgactt

SEQ ID NO: 908043 - DNA, 22 bp, Artificial Sequence
  chemically synthesized
agacatctttgcaaagaattga

SEQ ID NO: 908044 - DNA, 22 bp, Artificial Sequence
  chemically synthesized
cagacatctttgcaaagaattg

SEQ ID NO: 908045 - DNA, 22 bp, Artificial Sequence
  chemically synthesized
aagtcaggctcaattctttgca

SEQ ID NO: 908046 - DNA, 22 bp, Artificial Sequence
  chemically synthesized
ttcagacatctttgcaaagaat

SEQ ID NO: 908047 - DNA, 22 bp, Artificial Sequence
  chemically synthesized
aattctttgcaaagatgtctga

SEQ ID NO: 908048 - DNA, 22 bp, Artificial Sequence
  chemically synthesized
ccatgaatgtctcttcagacat

SEQ ID NO: 908049 - DNA, 22 bp, Artificial Sequence
  chemically synthesized
gccatgaatgtctcttcagaca

SEQ ID NO: 908050 - DNA, 22 bp, Artificial Sequence
  chemically synthesized
tttgcaaagatgtctgaagaga

SEQ ID NO: 908051 - DNA, 22 bp, Artificial Sequence
  chemically synthesized
tgcaaagatgtctgaagagaca

SEQ ID NO: 908052 - DNA, 22 bp, Artificial Sequence
  chemically synthesized
atttgccatgaatgtctcttca

SEQ ID NO: 908053 - DNA, 22 bp, Artificial Sequence
  chemically synthesized
gcaaagatgtctgaagagacat

SEQ ID NO: 908054 - DNA, 22 bp, Artificial Sequence
  chemically synthesized
caaagatgtctgaagagacatt

SEQ ID NO: 908055 - DNA, 22 bp, Artificial Sequence
  chemically synthesized
cccccattgatttgccatgaat

SEQ ID NO: 908056 - DNA, 22 bp, Artificial Sequence
  chemically synthesized
aagagacattcatggcaaatca

SEQ ID NO: 908057 - DNA, 22 bp, Artificial Sequence
  chemically synthesized
agtggttacccccattgatttg

SEQ ID NO: 908058 - DNA, 22 bp, Artificial Sequence
  chemically synthesized
cagtggttacccccattgattt

SEQ ID NO: 908059 - DNA, 22 bp, Artificial Sequence
  chemically synthesized
tcagtggttacccccattgatt

SEQ ID NO: 908060 - DNA, 22 bp, Artificial Sequence
  chemically synthesized
ttcagtggttacccccattgat

SEQ ID NO: 908061 - DNA, 22 bp, Artificial Sequence
  chemically synthesized
tttcagtggttacccccattga

SEQ ID NO: 908062 - DNA, 22 bp, Artificial Sequence
  chemically synthesized
atggcaaatcaatgggggtaac

SEQ ID NO: 908063 - DNA, 22 bp, Artificial Sequence
  chemically synthesized
aaatcactttttcagtggttac

SEQ ID NO: 908064 - DNA, 22 bp, Artificial Sequence
  chemically synthesized
taaaatcactttttcagtggtt

SEQ ID NO: 908065 - DNA, 22 bp, Artificial Sequence
  chemically synthesized
ctaaaatcactttttcagtggt

SEQ ID NO: 908066 - DNA, 22 bp, Artificial Sequence
  chemically synthesized
ataatgatcttctaaaatcact

SEQ ID NO: 908067 - DNA, 22 bp, Artificial Sequence
  chemically synthesized
taataatgatcttctaaaatca

SEQ ID NO: 908068 - DNA, 22 bp, Artificial Sequence
  chemically synthesized
ctaataatgatcttctaaaatc

SEQ ID NO: 908069 - DNA, 22 bp, Artificial Sequence
  chemically synthesized
aaaaagtgattttagaagatca

SEQ ID NO: 908070 - DNA, 22 bp, Artificial Sequence
  chemically synthesized
ggtcttctaataatgatcttct

SEQ ID NO: 908071 - DNA, 22 bp, Artificial Sequence
  chemically synthesized
ttaggtcttctaataatgatct

SEQ ID NO: 908072 - DNA, 22 bp, Artificial Sequence
  chemically synthesized
ttattaggtcttctaataatga

SEQ ID NO: 908073 - DNA, 22 bp, Artificial Sequence
  chemically synthesized
gctattattaggtcttctaata

SEQ ID NO: 908074 - DNA, 22 bp, Artificial Sequence
  chemically synthesized
tagaagatcattattagaagac

SEQ ID NO: 908075 - DNA, 22 bp, Artificial Sequence
  chemically synthesized
agaagatcattattagaagacc

SEQ ID NO: 908076 - DNA, 22 bp, Artificial Sequence
  chemically synthesized
gaagatcattattagaagacct

SEQ ID NO: 908077 - DNA, 22 bp, Artificial Sequence
  chemically synthesized
ttagaagacctaataatagcta

SEQ ID NO: 908078 - DNA, 22 bp, Artificial Sequence
  chemically synthesized
gaagacctaataatagctagta

SEQ ID NO: 908079 - DNA, 22 bp, Artificial Sequence
  chemically synthesized
ataatagctagtattttttggc

SEQ ID NO: 908080 - DNA, 22 bp, Artificial Sequence
  chemically synthesized
atacagagtaagtggccaaaaa

SEQ ID NO: 908081 - DNA, 22 bp, Artificial Sequence
  chemically synthesized
gtattttttggccacttactct

SEQ ID NO: 908082 - DNA, 22 bp, Artificial Sequence
  chemically synthesized
ggcaacagctgatacagagtaa

SEQ ID NO: 908083 - DNA, 22 bp, Artificial Sequence
  chemically synthesized
gggcaacagctgatacagagta

SEQ ID NO: 908084 - DNA, 22 bp, Artificial Sequence
  chemically synthesized
tgggcaacagctgatacagagt

SEQ ID NO: 908085 - DNA, 22 bp, Artificial Sequence
  chemically synthesized
tttggccacttactctgtatca

SEQ ID NO: 908086 - DNA, 22 bp, Artificial Sequence
  chemically synthesized
ttggccacttactctgtatcag

SEQ ID NO: 908087 - DNA, 22 bp, Artificial Sequence
  chemically synthesized
tggccacttactctgtatcagc

SEQ ID NO: 908088 - DNA, 22 bp, Artificial Sequence
  chemically synthesized
ctttgggcaacagctgatacag

SEQ ID NO: 908089 - DNA, 22 bp, Artificial Sequence
  chemically synthesized
ggccacttactctgtatcagct

SEQ ID NO: 908090 - DNA, 22 bp, Artificial Sequence
  chemically synthesized
gccacttactctgtatcagctg

SEQ ID NO: 908091 - DNA, 22 bp, Artificial Sequence
  chemically synthesized
actgctttgggcaacagctgat

SEQ ID NO: 908092 - DNA, 22 bp, Artificial Sequence
  chemically synthesized
cactgctttgggcaacagctga

SEQ ID NO: 908093 - DNA, 22 bp, Artificial Sequence
  chemically synthesized
tcactgctttgggcaacagctg

SEQ ID NO: 908094 - DNA, 22 bp, Artificial Sequence
  chemically synthesized
tttcactgctttgggcaacagc

SEQ ID NO: 908095 - DNA, 22 bp, Artificial Sequence
  chemically synthesized
actctgtatcagctgttgccca

SEQ ID NO: 908096 - DNA, 22 bp, Artificial Sequence
  chemically synthesized
ctctgtatcagctgttgcccaa

SEQ ID NO: 908097 - DNA, 22 bp, Artificial Sequence
  chemically synthesized
cctctttcactgctttgggcaa

SEQ ID NO: 908098 - DNA, 22 bp, Artificial Sequence
  chemically synthesized
tgtatcagctgttgcccaaagc

SEQ ID NO: 908099 - DNA, 22 bp, Artificial Sequence
  chemically synthesized
ccctctttcactgctttgggca

SEQ ID NO: 908100 - DNA, 22 bp, Artificial Sequence
  chemically synthesized
tccctctttcactgctttgggc

SEQ ID NO: 908101 - DNA, 22 bp, Artificial Sequence
  chemically synthesized
tatcagctgttgcccaaagcag

SEQ ID NO: 908102 - DNA, 22 bp, Artificial Sequence
  chemically synthesized
tttccctctttcactgctttgg

SEQ ID NO: 908103 - DNA, 22 bp, Artificial Sequence
  chemically synthesized
ctttccctctttcactgctttg

SEQ ID NO: 908104 - DNA, 22 bp, Artificial Sequence
  chemically synthesized
ttgcccaaagcagtgaaagagg

SEQ ID NO: 908105 - DNA, 22 bp, Artificial Sequence
  chemically synthesized
agggtatttctttccctctttc

SEQ ID NO: 908106 - DNA, 22 bp, Artificial Sequence
  chemically synthesized
cccaaagcagtgaaagagggaa

SEQ ID NO: 908107 - DNA, 22 bp, Artificial Sequence
  chemically synthesized
cagggtatttctttccctcttt

SEQ ID NO: 908108 - DNA, 22 bp, Artificial Sequence
  chemically synthesized
gagagcaggagaaggggagatt

SEQ ID NO: 908109 - DNA, 22 bp, Artificial Sequence
  chemically synthesized
aaatctccccttctcctgctct

SEQ ID NO: 908110 - DNA, 22 bp, Artificial Sequence
  chemically synthesized
gcaggagattggagagcaggag

SEQ ID NO: 908111 - DNA, 22 bp, Artificial Sequence
  chemically synthesized
cccttctcctgctctccaatct

SEQ ID NO: 908112 - DNA, 22 bp, Artificial Sequence
  chemically synthesized
ctcctgctctccaatctcctgc

SEQ ID NO: 908113 - DNA, 22 bp, Artificial Sequence
  chemically synthesized
tcctgctctccaatctcctgcc

SEQ ID NO: 908114 - DNA, 22 bp, Artificial Sequence
  chemically synthesized
ctgctctccaatctcctgccaa

SEQ ID NO: 908115 - DNA, 22 bp, Artificial Sequence
  chemically synthesized
accagtgggaggcgttggcagg

SEQ ID NO: 908116 - DNA, 22 bp, Artificial Sequence
  chemically synthesized
ctctccaatctcctgccaacgc

SEQ ID NO: 908117 - DNA, 22 bp, Artificial Sequence
  chemically synthesized
aaccagtgggaggcgttggcag

SEQ ID NO: 908118 - DNA, 22 bp, Artificial Sequence
  chemically synthesized
tccaatctcctgccaacgcctc

SEQ ID NO: 908119 - DNA, 22 bp, Artificial Sequence
  chemically synthesized
caatctcctgccaacgcctccc

SEQ ID NO: 908120 - DNA, 22 bp, Artificial Sequence
  chemically synthesized
tatagatttaaccagtgggagg

SEQ ID NO: 908121 - DNA, 22 bp, Artificial Sequence
  chemically synthesized
tgtatagatttaaccagtggga

SEQ ID NO: 908122 - DNA, 22 bp, Artificial Sequence
  chemically synthesized
ctgccaacgcctcccactggtt

SEQ ID NO: 908123 - DNA, 22 bp, Artificial Sequence
  chemically synthesized
ctgtatagatttaaccagtggg

SEQ ID NO: 908124 - DNA, 22 bp, Artificial Sequence
  chemically synthesized
ccaacgcctcccactggttaaa

SEQ ID NO: 908125 - DNA, 22 bp, Artificial Sequence
  chemically synthesized
tcttctgtatagatttaaccag

SEQ ID NO: 908126 - DNA, 22 bp, Artificial Sequence
  chemically synthesized
aactatcttctgtatagattta

SEQ ID NO: 908127 - DNA, 22 bp, Artificial Sequence
  chemically synthesized
tcaactatcttctgtatagatt

SEQ ID NO: 908128 - DNA, 22 bp, Artificial Sequence
  chemically synthesized
ctcaactatcttctgtatagat

SEQ ID NO: 908129 - DNA, 22 bp, Artificial Sequence
  chemically synthesized
ccactggttaaatctatacaga

SEQ ID NO: 908130 - DNA, 22 bp, Artificial Sequence
  chemically synthesized
ttctcaactatcttctgtatag

SEQ ID NO: 908131 - DNA, 22 bp, Artificial Sequence
  chemically synthesized
cttctcaactatcttctgtata

SEQ ID NO: 908132 - DNA, 22 bp, Artificial Sequence
  chemically synthesized
tcttctcaactatcttctgtat

SEQ ID NO: 908133 - DNA, 22 bp, Artificial Sequence
  chemically synthesized
gttaaatctatacagaagatag

SEQ ID NO: 908134 - DNA, 22 bp, Artificial Sequence
  chemically synthesized
aggctttcttctcaactatctt

SEQ ID NO: 908135 - DNA, 22 bp, Artificial Sequence
  chemically synthesized
aatctatacagaagatagttga

SEQ ID NO: 908136 - DNA, 22 bp, Artificial Sequence
  chemically synthesized
ctcaggctttcttctcaactat

SEQ ID NO: 908137 - DNA, 22 bp, Artificial Sequence
  chemically synthesized
ttcctcaggctttcttctcaac

SEQ ID NO: 908138 - DNA, 22 bp, Artificial Sequence
  chemically synthesized
tacagaagatagttgagaagaa

SEQ ID NO: 908139 - DNA, 22 bp, Artificial Sequence
  chemically synthesized
attcctcaggctttcttctcaa

SEQ ID NO: 908140 - DNA, 22 bp, Artificial Sequence
  chemically synthesized
accttattcctcaggctttctt

SEQ ID NO: 908141 - DNA, 22 bp, Artificial Sequence
  chemically synthesized
cactcaccttattcctcaggct

SEQ ID NO: 908142 - DNA, 22 bp, Artificial Sequence
  chemically synthesized
agaagaaagcctgaggaataag

SEQ ID NO: 908143 - DNA, 22 bp, Artificial Sequence
  chemically synthesized
acctccactcaccttattcctc

SEQ ID NO: 908144 - DNA, 22 bp, Artificial Sequence
  chemically synthesized
caagaagctcacctccactcac

SEQ ID NO: 908145 - DNA, 22 bp, Artificial Sequence
  chemically synthesized
aggaataaggtgagtggaggtg

SEQ ID NO: 908146 - DNA, 22 bp, Artificial Sequence
  chemically synthesized
tatattgcaagaagctcacctc

SEQ ID NO: 908147 - DNA, 22 bp, Artificial Sequence
  chemically synthesized
tgcaatatattgtatattgcaa

SEQ ID NO: 908148 - DNA, 22 bp, Artificial Sequence
  chemically synthesized
tgtgcaatatattgtatattgc

SEQ ID NO: 908149 - DNA, 22 bp, Artificial Sequence
  chemically synthesized
ctgtgcaatatattgtatattg

SEQ ID NO: 908150 - DNA, 22 bp, Artificial Sequence
  chemically synthesized
tctgtgcaatatattgtatatt

SEQ ID NO: 908151 - DNA, 22 bp, Artificial Sequence
  chemically synthesized
tttctgtgcaatatattgtata

SEQ ID NO: 908152 - DNA, 22 bp, Artificial Sequence
  chemically synthesized
ctctttctgtgcaatatattgt

SEQ ID NO: 908153 - DNA, 22 bp, Artificial Sequence
  chemically synthesized
cctctttctgtgcaatatattg

SEQ ID NO: 908154 - DNA, 22 bp, Artificial Sequence
  chemically synthesized
cttgcaatatacaatatattgc

SEQ ID NO: 908155 - DNA, 22 bp, Artificial Sequence
  chemically synthesized
ttgcaatatacaatatattgca

SEQ ID NO: 908156 - DNA, 22 bp, Artificial Sequence
  chemically synthesized
cttcctctttctgtgcaatata

SEQ ID NO: 908157 - DNA, 22 bp, Artificial Sequence
  chemically synthesized
gcaatatacaatatattgcaca

SEQ ID NO: 908158 - DNA, 22 bp, Artificial Sequence
  chemically synthesized
ccttcctctttctgtgcaatat

SEQ ID NO: 908159 - DNA, 22 bp, Artificial Sequence
  chemically synthesized
caatatacaatatattgcacag

SEQ ID NO: 908160 - DNA, 22 bp, Artificial Sequence
  chemically synthesized
aatttccttcctctttctgtgc

SEQ ID NO: 908161 - DNA, 22 bp, Artificial Sequence
  chemically synthesized
actcaatttccttcctctttct

SEQ ID NO: 908162 - DNA, 22 bp, Artificial Sequence
  chemically synthesized
cacagaaagaggaaggaaattg

SEQ ID NO: 908163 - DNA, 22 bp, Artificial Sequence
  chemically synthesized
ccacagattcactcaatttcct

SEQ ID NO: 908164 - DNA, 22 bp, Artificial Sequence
  chemically synthesized
cccacagattcactcaatttcc

SEQ ID NO: 908165 - DNA, 22 bp, Artificial Sequence
  chemically synthesized
tcccacagattcactcaatttc

SEQ ID NO: 908166 - DNA, 22 bp, Artificial Sequence
  chemically synthesized
ataacccaagtataactttccc

SEQ ID NO: 908167 - DNA, 22 bp, Artificial Sequence
  chemically synthesized
agtgaatctgtgggaaagttat

SEQ ID NO: 908168 - DNA, 22 bp, Artificial Sequence
  chemically synthesized
tggggttcataacccaagtata

SEQ ID NO: 908169 - DNA, 22 bp, Artificial Sequence
  chemically synthesized
tgggaaagttatacttgggtta

SEQ ID NO: 908170 - DNA, 22 bp, Artificial Sequence
  chemically synthesized
tacttgggttatgaaccccaca

SEQ ID NO: 908171 - DNA, 22 bp, Artificial Sequence
  chemically synthesized
aaacatagatcgttgtggggtt

SEQ ID NO: 908172 - DNA, 22 bp, Artificial Sequence
  chemically synthesized
gaaacatagatcgttgtggggt

SEQ ID NO: 908173 - DNA, 22 bp, Artificial Sequence
  chemically synthesized
tgaaacatagatcgttgtgggg

SEQ ID NO: 908174 - DNA, 22 bp, Artificial Sequence
  chemically synthesized
gggttatgaaccccacaacgat

SEQ ID NO: 908175 - DNA, 22 bp, Artificial Sequence
  chemically synthesized
ggttatgaaccccacaacgatc

SEQ ID NO: 908176 - DNA, 22 bp, Artificial Sequence
  chemically synthesized
tacctttgaaacatagatcgtt

SEQ ID NO: 908177 - DNA, 22 bp, Artificial Sequence
  chemically synthesized
atacctttgaaacatagatcgt

SEQ ID NO: 908178 - DNA, 22 bp, Artificial Sequence
  chemically synthesized
tgaaccccacaacgatctatgt

SEQ ID NO: 908179 - DNA, 22 bp, Artificial Sequence
  chemically synthesized
aaatgatttatacctttgaaac

SEQ ID NO: 908180 - DNA, 22 bp, Artificial Sequence
  chemically synthesized
tgtttcaaaggtataaatcatt

SEQ ID NO: 908181 - DNA, 22 bp, Artificial Sequence
  chemically synthesized
caaaggtataaatcatttgaat

SEQ ID NO: 908182 - DNA, 22 bp, Artificial Sequence
  chemically synthesized
aaaggtataaatcatttgaatg

SEQ ID NO: 908183 - DNA, 22 bp, Artificial Sequence
  chemically synthesized
acagaaaatatgaacacattca

SEQ ID NO: 908184 - DNA, 22 bp, Artificial Sequence
  chemically synthesized
gacagaaaatatgaacacattc

SEQ ID NO: 908185 - DNA, 22 bp, Artificial Sequence
  chemically synthesized
tgacagaaaatatgaacacatt

SEQ ID NO: 908186 - DNA, 22 bp, Artificial Sequence
  chemically synthesized
gaatgtgttcatattttctgtc

SEQ ID NO: 908187 - DNA, 22 bp, Artificial Sequence
  chemically synthesized
aatgtgttcatattttctgtca

SEQ ID NO: 908188 - DNA, 22 bp, Artificial Sequence
  chemically synthesized
atattttctgtcaaagttgata

SEQ ID NO: 908189 - DNA, 22 bp, Artificial Sequence
  chemically synthesized
tctgtcaaagttgatatgtatc

SEQ ID NO: 908190 - DNA, 22 bp, Artificial Sequence
  chemically synthesized
ctgtcaaagttgatatgtatct

SEQ ID NO: 908191 - DNA, 22 bp, Artificial Sequence
  chemically synthesized
tgtcaaagttgatatgtatctt

SEQ ID NO: 908192 - DNA, 22 bp, Artificial Sequence
  chemically synthesized
atccgaccacagaagatacata

SEQ ID NO: 908193 - DNA, 22 bp, Artificial Sequence
  chemically synthesized
tcaaagttgatatgtatcttct

SEQ ID NO: 908194 - DNA, 22 bp, Artificial Sequence
  chemically synthesized
atatgtatcttctgtggtcgga

SEQ ID NO: 908195 - DNA, 22 bp, Artificial Sequence
  chemically synthesized
tgaagcacattcatccgaccac

SEQ ID NO: 908196 - DNA, 22 bp, Artificial Sequence
  chemically synthesized
atgaagcacattcatccgacca

SEQ ID NO: 908197 - DNA, 22 bp, Artificial Sequence
  chemically synthesized
atatttatgaagcacattcatc

SEQ ID NO: 908198 - DNA, 22 bp, Artificial Sequence
  chemically synthesized
gatatttatgaagcacattcat

SEQ ID NO: 908199 - DNA, 22 bp, Artificial Sequence
  chemically synthesized
ctgtggtcggatgaatgtgctt

SEQ ID NO: 908200 - DNA, 22 bp, Artificial Sequence
  chemically synthesized
ttgatatttatgaagcacattc

SEQ ID NO: 908201 - DNA, 22 bp, Artificial Sequence
  chemically synthesized
tgtggtcggatgaatgtgcttc

SEQ ID NO: 908202 - DNA, 22 bp, Artificial Sequence
  chemically synthesized
tggtcggatgaatgtgcttcat

SEQ ID NO: 908203 - DNA, 22 bp, Artificial Sequence
  chemically synthesized
tctcttgatatttatgaagcac

SEQ ID NO: 908204 - DNA, 22 bp, Artificial Sequence
  chemically synthesized
gtctcttgatatttatgaagca

SEQ ID NO: 908205 - DNA, 22 bp, Artificial Sequence
  chemically synthesized
tgtctcttgatatttatgaagc

SEQ ID NO: 908206 - DNA, 22 bp, Artificial Sequence
  chemically synthesized
caaaaagattttgtctcttgat

SEQ ID NO: 908207 - DNA, 22 bp, Artificial Sequence
  chemically synthesized
gcaaaaagattttgtctcttga

SEQ ID NO: 908208 - DNA, 22 bp, Artificial Sequence
  chemically synthesized
tgcaaaaagattttgtctcttg

SEQ ID NO: 908209 - DNA, 22 bp, Artificial Sequence
  chemically synthesized
cataaatatcaagagacaaaat

SEQ ID NO: 908210 - DNA, 22 bp, Artificial Sequence
  chemically synthesized
ataaatatcaagagacaaaatc

SEQ ID NO: 908211 - DNA, 22 bp, Artificial Sequence
  chemically synthesized
gaaaggcctttgcaaaaagatt

SEQ ID NO: 908212 - DNA, 22 bp, Artificial Sequence
  chemically synthesized
agatactggaaaggcctttgca

SEQ ID NO: 908213 - DNA, 22 bp, Artificial Sequence
  chemically synthesized
tgagatactggaaaggcctttg

SEQ ID NO: 908214 - DNA, 22 bp, Artificial Sequence
  chemically synthesized
tttgcaaaggcctttccagtat

SEQ ID NO: 908215 - DNA, 22 bp, Artificial Sequence
  chemically synthesized
ttgcaaaggcctttccagtatc

SEQ ID NO: 908216 - DNA, 22 bp, Artificial Sequence
  chemically synthesized
tgcaaaggcctttccagtatct

SEQ ID NO: 908217 - DNA, 22 bp, Artificial Sequence
  chemically synthesized
gcaaaggcctttccagtatctc

SEQ ID NO: 908218 - DNA, 22 bp, Artificial Sequence
  chemically synthesized
caaaggcctttccagtatctca

SEQ ID NO: 908219 - DNA, 22 bp, Artificial Sequence
  chemically synthesized
tccagtatctcagaacacactg

SEQ ID NO: 908220 - DNA, 22 bp, Artificial Sequence
  chemically synthesized
ccagtatctcagaacacactgt

SEQ ID NO: 908221 - DNA, 22 bp, Artificial Sequence
  chemically synthesized
aatggaatgcatacagtgtgtt

SEQ ID NO: 908222 - DNA, 22 bp, Artificial Sequence
  chemically synthesized
cagtatctcagaacacactgta

SEQ ID NO: 908223 - DNA, 22 bp, Artificial Sequence
  chemically synthesized
agaacacactgtatgcattcca

SEQ ID NO: 908224 - DNA, 22 bp, Artificial Sequence
  chemically synthesized
accaccaatcccattcaatgga

SEQ ID NO: 908225 - DNA, 22 bp, Artificial Sequence
  chemically synthesized
tatgcattccattgaatgggat

SEQ ID NO: 908226 - DNA, 22 bp, Artificial Sequence
  chemically synthesized
tgtaggagttgaccaccaatcc

SEQ ID NO: 908227 - DNA, 22 bp, Artificial Sequence
  chemically synthesized
cattgaatgggattggtggtca

SEQ ID NO: 908228 - DNA, 22 bp, Artificial Sequence
  chemically synthesized
aatgggattggtggtcaactcc

SEQ ID NO: 908229 - DNA, 22 bp, Artificial Sequence
  chemically synthesized
tcaagagtctgtgtaggagttg

SEQ ID NO: 908230 - DNA, 22 bp, Artificial Sequence
  chemically synthesized
gtggtcaactcctacacagact

SEQ ID NO: 908231 - DNA, 22 bp, Artificial Sequence
  chemically synthesized
ctacacagactcttgatagcca

SEQ ID NO: 908232 - DNA, 22 bp, Artificial Sequence
  chemically synthesized
cacagactcttgatagccactc

SEQ ID NO: 908233 - DNA, 22 bp, Artificial Sequence
  chemically synthesized
aatggtagggaggtagagagtg

SEQ ID NO: 908234 - DNA, 22 bp, Artificial Sequence
  chemically synthesized
aaatggtagggaggtagagagt

SEQ ID NO: 908235 - DNA, 22 bp, Artificial Sequence
  chemically synthesized
ttaaatggtagggaggtagaga

SEQ ID NO: 908236 - DNA, 22 bp, Artificial Sequence
  chemically synthesized
ttgatagccactctctacctcc

SEQ ID NO: 908237 - DNA, 22 bp, Artificial Sequence
  chemically synthesized
cttaaatggtagggaggtagag

SEQ ID NO: 908238 - DNA, 22 bp, Artificial Sequence
  chemically synthesized
gatagccactctctacctccct

SEQ ID NO: 908239 - DNA, 22 bp, Artificial Sequence
  chemically synthesized
atagccactctctacctcccta

SEQ ID NO: 908240 - DNA, 22 bp, Artificial Sequence
  chemically synthesized
cttcttaaatggtagggaggta

SEQ ID NO: 908241 - DNA, 22 bp, Artificial Sequence
  chemically synthesized
tacttcttaaatggtagggagg

SEQ ID NO: 908242 - DNA, 22 bp, Artificial Sequence
  chemically synthesized
ctctacttcttaaatggtaggg

SEQ ID NO: 908243 - DNA, 22 bp, Artificial Sequence
  chemically synthesized
gctctacttcttaaatggtagg

SEQ ID NO: 908244 - DNA, 22 bp, Artificial Sequence
  chemically synthesized
tctacctccctaccatttaaga

SEQ ID NO: 908245 - DNA, 22 bp, Artificial Sequence
  chemically synthesized
tacctccctaccatttaagaag

SEQ ID NO: 908246 - DNA, 22 bp, Artificial Sequence
  chemically synthesized
cctccctaccatttaagaagta

SEQ ID NO: 908247 - DNA, 22 bp, Artificial Sequence
  chemically synthesized
gtccccttgctctacttcttaa

SEQ ID NO: 908248 - DNA, 22 bp, Artificial Sequence
  chemically synthesized
cctaccatttaagaagtagagc

SEQ ID NO: 908249 - DNA, 22 bp, Artificial Sequence
  chemically synthesized
cctggtccccttgctctacttc

SEQ ID NO: 908250 - DNA, 22 bp, Artificial Sequence
  chemically synthesized
ccatttaagaagtagagcaagg

SEQ ID NO: 908251 - DNA, 22 bp, Artificial Sequence
  chemically synthesized
gttccctggtccccttgctcta

SEQ ID NO: 908252 - DNA, 22 bp, Artificial Sequence
  chemically synthesized
aagaagtagagcaaggggacca

SEQ ID NO: 908253 - DNA, 22 bp, Artificial Sequence
  chemically synthesized
agaagtagagcaaggggaccag

SEQ ID NO: 908254 - DNA, 22 bp, Artificial Sequence
  chemically synthesized
aagatgctggttccctggtccc

SEQ ID NO: 908255 - DNA, 22 bp, Artificial Sequence
  chemically synthesized
caagatgctggttccctggtcc

SEQ ID NO: 908256 - DNA, 22 bp, Artificial Sequence
  chemically synthesized
atttcaagatgctggttccctg

SEQ ID NO: 908257 - DNA, 22 bp, Artificial Sequence
  chemically synthesized
cccccctaatttcaagatgctg

SEQ ID NO: 908258 - DNA, 22 bp, Artificial Sequence
  chemically synthesized
ccccccctaatttcaagatgct

SEQ ID NO: 908259 - DNA, 22 bp, Artificial Sequence
  chemically synthesized
catttccccccctaatttcaag

SEQ ID NO: 908260 - DNA, 22 bp, Artificial Sequence
  chemically synthesized
tgcatttccccccctaatttca

SEQ ID NO: 908261 - DNA, 22 bp, Artificial Sequence
  chemically synthesized
aggttctgcatttcccccccta

SEQ ID NO: 908262 - DNA, 22 bp, Artificial Sequence
  chemically synthesized
gaaattagggggggaaatgcag

SEQ ID NO: 908263 - DNA, 22 bp, Artificial Sequence
  chemically synthesized
aaattagggggggaaatgcaga

SEQ ID NO: 908264 - DNA, 22 bp, Artificial Sequence
  chemically synthesized
cataggacctgaggttctgcat

SEQ ID NO: 908265 - DNA, 22 bp, Artificial Sequence
  chemically synthesized
gcataggacctgaggttctgca

SEQ ID NO: 908266 - DNA, 22 bp, Artificial Sequence
  chemically synthesized
gggggggaaatgcagaacctca

SEQ ID NO: 908267 - DNA, 22 bp, Artificial Sequence
  chemically synthesized
ttgcataggacctgaggttctg

SEQ ID NO: 908268 - DNA, 22 bp, Artificial Sequence
  chemically synthesized
aatggctcttgcataggacctg

SEQ ID NO: 908269 - DNA, 22 bp, Artificial Sequence
  chemically synthesized
attcaatggctcttgcatagga

SEQ ID NO: 908270 - DNA, 22 bp, Artificial Sequence
  chemically synthesized
ctgattcaatggctcttgcata

SEQ ID NO: 908271 - DNA, 22 bp, Artificial Sequence
  chemically synthesized
aggtcctatgcaagagccattg

SEQ ID NO: 908272 - DNA, 22 bp, Artificial Sequence
  chemically synthesized
aaatcaggttactgattcaatg

SEQ ID NO: 908273 - DNA, 22 bp, Artificial Sequence
  chemically synthesized
tgcaagagccattgaatcagta

SEQ ID NO: 908274 - DNA, 22 bp, Artificial Sequence
  chemically synthesized
ttaaaatcaggttactgattca

SEQ ID NO: 908275 - DNA, 22 bp, Artificial Sequence
  chemically synthesized
gttaaaatcaggttactgattc

SEQ ID NO: 908276 - DNA, 22 bp, Artificial Sequence
  chemically synthesized
agatcttgttaaaatcaggtta

SEQ ID NO: 908277 - DNA, 22 bp, Artificial Sequence
  chemically synthesized
gagatcttgttaaaatcaggtt

SEQ ID NO: 908278 - DNA, 22 bp, Artificial Sequence
  chemically synthesized
aatcagtaacctgattttaaca

SEQ ID NO: 908279 - DNA, 22 bp, Artificial Sequence
  chemically synthesized
aaacaggaatcaccttgagatc

SEQ ID NO: 908280 - DNA, 22 bp, Artificial Sequence
  chemically synthesized
attttaacaagatctcaaggtg

SEQ ID NO: 908281 - DNA, 22 bp, Artificial Sequence
  chemically synthesized
ctgaaacaggaatcaccttgag

SEQ ID NO: 908282 - DNA, 22 bp, Artificial Sequence
  chemically synthesized
actgaaacaggaatcaccttga

SEQ ID NO: 908283 - DNA, 22 bp, Artificial Sequence
  chemically synthesized
taacaagatctcaaggtgattc

SEQ ID NO: 908284 - DNA, 22 bp, Artificial Sequence
  chemically synthesized
aacaagatctcaaggtgattcc

SEQ ID NO: 908285 - DNA, 22 bp, Artificial Sequence
  chemically synthesized
acaagatctcaaggtgattcct

SEQ ID NO: 908286 - DNA, 22 bp, Artificial Sequence
  chemically synthesized
atgacttactgaaacaggaatc

SEQ ID NO: 908287 - DNA, 22 bp, Artificial Sequence
  chemically synthesized
attgatgacttactgaaacagg

SEQ ID NO: 908288 - DNA, 22 bp, Artificial Sequence
  chemically synthesized
aaggtgattcctgtttcagtaa

SEQ ID NO: 908289 - DNA, 22 bp, Artificial Sequence
  chemically synthesized
tcaacaacattaattgatgact

SEQ ID NO: 908290 - DNA, 22 bp, Artificial Sequence
  chemically synthesized
ctgtttcagtaagtcatcaatt

SEQ ID NO: 908291 - DNA, 22 bp, Artificial Sequence
  chemically synthesized
tttcagtaagtcatcaattaat

SEQ ID NO: 908292 - DNA, 22 bp, Artificial Sequence
  chemically synthesized
cagtaagtcatcaattaatgtt

SEQ ID NO: 908293 - DNA, 22 bp, Artificial Sequence
  chemically synthesized
agtaagtcatcaattaatgttg

SEQ ID NO: 908294 - DNA, 22 bp, Artificial Sequence
  chemically synthesized
ccagaatctatcaacaacatta

SEQ ID NO: 908295 - DNA, 22 bp, Artificial Sequence
  chemically synthesized
cccagaatctatcaacaacatt

SEQ ID NO: 908296 - DNA, 22 bp, Artificial Sequence
  chemically synthesized
agtcacagtttcccagaatcta

SEQ ID NO: 908297 - DNA, 22 bp, Artificial Sequence
  chemically synthesized
atgttgttgatagattctggga

SEQ ID NO: 908298 - DNA, 22 bp, Artificial Sequence
  chemically synthesized
cctaagtcacagtttcccagaa

SEQ ID NO: 908299 - DNA, 22 bp, Artificial Sequence
  chemically synthesized
gcctaagtcacagtttcccaga

SEQ ID NO: 908300 - DNA, 22 bp, Artificial Sequence
  chemically synthesized
tgcctaagtcacagtttcccag

SEQ ID NO: 908301 - DNA, 22 bp, Artificial Sequence
  chemically synthesized
ttgatagattctgggaaactgt

SEQ ID NO: 908302 - DNA, 22 bp, Artificial Sequence
  chemically synthesized
atagattctgggaaactgtgac

SEQ ID NO: 908303 - DNA, 22 bp, Artificial Sequence
  chemically synthesized
tatgtcattttgcctaagtcac

SEQ ID NO: 908304 - DNA, 22 bp, Artificial Sequence
  chemically synthesized
tgggaaactgtgacttaggcaa

SEQ ID NO: 908305 - DNA, 22 bp, Artificial Sequence
  chemically synthesized
attatatgtcattttgcctaag

SEQ ID NO: 908306 - DNA, 22 bp, Artificial Sequence
  chemically synthesized
ggaaactgtgacttaggcaaaa

SEQ ID NO: 908307 - DNA, 22 bp, Artificial Sequence
  chemically synthesized
cattatatgtcattttgcctaa

SEQ ID NO: 908308 - DNA, 22 bp, Artificial Sequence
  chemically synthesized
gtttcattatatgtcattttgc

SEQ ID NO: 908309 - DNA, 22 bp, Artificial Sequence
  chemically synthesized
tgacttaggcaaaatgacatat

SEQ ID NO: 908310 - DNA, 22 bp, Artificial Sequence
  chemically synthesized
aggcaaaatgacatataatgaa

SEQ ID NO: 908311 - DNA, 22 bp, Artificial Sequence
  chemically synthesized
ggcaaaatgacatataatgaaa

SEQ ID NO: 908312 - DNA, 22 bp, Artificial Sequence
  chemically synthesized
tggtaagattggtttcattata

SEQ ID NO: 908313 - DNA, 22 bp, Artificial Sequence
  chemically synthesized
gcctatggtaagattggtttca

SEQ ID NO: 908314 - DNA, 22 bp, Artificial Sequence
  chemically synthesized
tcaattagcctatggtaagatt

SEQ ID NO: 908315 - DNA, 22 bp, Artificial Sequence
  chemically synthesized
atcaattagcctatggtaagat

SEQ ID NO: 908316 - DNA, 22 bp, Artificial Sequence
  chemically synthesized
tttatcaattagcctatggtaa

SEQ ID NO: 908317 - DNA, 22 bp, Artificial Sequence
  chemically synthesized
gtttatcaattagcctatggta

SEQ ID NO: 908318 - DNA, 22 bp, Artificial Sequence
  chemically synthesized
ttgtttatcaattagcctatgg

SEQ ID NO: 908319 - DNA, 22 bp, Artificial Sequence
  chemically synthesized
attcttgtttatcaattagcct

SEQ ID NO: 908320 - DNA, 22 bp, Artificial Sequence
  chemically synthesized
aattcttgtttatcaattagcc

SEQ ID NO: 908321 - DNA, 22 bp, Artificial Sequence
  chemically synthesized
accataggctaattgataaaca

SEQ ID NO: 908322 - DNA, 22 bp, Artificial Sequence
  chemically synthesized
ccataggctaattgataaacaa

SEQ ID NO: 908323 - DNA, 22 bp, Artificial Sequence
  chemically synthesized
attgataaacaagaattaagtt

SEQ ID NO: 908324 - DNA, 22 bp, Artificial Sequence
  chemically synthesized
ataaacaagaattaagttccta

SEQ ID NO: 908325 - DNA, 22 bp, Artificial Sequence
  chemically synthesized
tgaacacaggtatgcagtagga

SEQ ID NO: 908326 - DNA, 22 bp, Artificial Sequence
  chemically synthesized
gtgaacacaggtatgcagtagg

SEQ ID NO: 908327 - DNA, 22 bp, Artificial Sequence
  chemically synthesized
tgtgaacacaggtatgcagtag

SEQ ID NO: 908328 - DNA, 22 bp, Artificial Sequence
  chemically synthesized
agttcctactgcatacctgtgt

SEQ ID NO: 908329 - DNA, 22 bp, Artificial Sequence
  chemically synthesized
gatcatgttttgtgaacacagg

SEQ ID NO: 908330 - DNA, 22 bp, Artificial Sequence
  chemically synthesized
ctactgcatacctgtgttcaca

SEQ ID NO: 908331 - DNA, 22 bp, Artificial Sequence
  chemically synthesized
ctgcatacctgtgttcacaaaa

SEQ ID NO: 908332 - DNA, 22 bp, Artificial Sequence
  chemically synthesized
gatgttggatcatgttttgtga

SEQ ID NO: 908333 - DNA, 22 bp, Artificial Sequence
  chemically synthesized
catacctgtgttcacaaaacat

SEQ ID NO: 908334 - DNA, 22 bp, Artificial Sequence
  chemically synthesized
agatgttggatcatgttttgtg

SEQ ID NO: 908335 - DNA, 22 bp, Artificial Sequence
  chemically synthesized
tttagatgttggatcatgtttt

SEQ ID NO: 908336 - DNA, 22 bp, Artificial Sequence
  chemically synthesized
atttagatgttggatcatgttt

SEQ ID NO: 908337 - DNA, 22 bp, Artificial Sequence
  chemically synthesized
tatttagatgttggatcatgtt

SEQ ID NO: 908338 - DNA, 22 bp, Artificial Sequence
  chemically synthesized
tgttcacaaaacatgatccaac

SEQ ID NO: 908339 - DNA, 22 bp, Artificial Sequence
  chemically synthesized
gggtctttatttagatgttgga

SEQ ID NO: 908340 - DNA, 22 bp, Artificial Sequence
  chemically synthesized
acaaaacatgatccaacatcta

SEQ ID NO: 908341 - DNA, 22 bp, Artificial Sequence
  chemically synthesized
ggggtctttatttagatgttgg

SEQ ID NO: 908342 - DNA, 22 bp, Artificial Sequence
  chemically synthesized
gaagtgcttggggtctttattt

SEQ ID NO: 908343 - DNA, 22 bp, Artificial Sequence
  chemically synthesized
atattagaagtgcttggggtct

SEQ ID NO: 908344 - DNA, 22 bp, Artificial Sequence
  chemically synthesized
aatattagaagtgcttggggtc

SEQ ID NO: 908345 - DNA, 22 bp, Artificial Sequence
  chemically synthesized
agtttaatattagaagtgcttg

SEQ ID NO: 908346 - DNA, 22 bp, Artificial Sequence
  chemically synthesized
aataaagaccccaagcacttct

SEQ ID NO: 908347 - DNA, 22 bp, Artificial Sequence
  chemically synthesized
tgagtttaatattagaagtgct

SEQ ID NO: 908348 - DNA, 22 bp, Artificial Sequence
  chemically synthesized
ctgagtttaatattagaagtgc

SEQ ID NO: 908349 - DNA, 22 bp, Artificial Sequence
  chemically synthesized
tttctgagtttaatattagaag

SEQ ID NO: 908350 - DNA, 22 bp, Artificial Sequence
  chemically synthesized
atttctgagtttaatattagaa

SEQ ID NO: 908351 - DNA, 22 bp, Artificial Sequence
  chemically synthesized
acatttatttctgagtttaata

SEQ ID NO: 908352 - DNA, 22 bp, Artificial Sequence
  chemically synthesized
ctaatattaaactcagaaataa

SEQ ID NO: 908353 - DNA, 22 bp, Artificial Sequence
  chemically synthesized
taatattaaactcagaaataaa

SEQ ID NO: 908354 - DNA, 22 bp, Artificial Sequence
  chemically synthesized
atattaaactcagaaataaatg

SEQ ID NO: 908355 - DNA, 22 bp, Artificial Sequence
  chemically synthesized
aactcagaaataaatgtgagat

SEQ ID NO: 908356 - DNA, 22 bp, Artificial Sequence
  chemically synthesized
aagtggatgtatatctcacatt

SEQ ID NO: 908357 - DNA, 22 bp, Artificial Sequence
  chemically synthesized
taaagtggatgtatatctcaca

SEQ ID NO: 908358 - DNA, 22 bp, Artificial Sequence
  chemically synthesized
ctaaagtggatgtatatctcac

SEQ ID NO: 908359 - DNA, 22 bp, Artificial Sequence
  chemically synthesized
tctaaagtggatgtatatctca

SEQ ID NO: 908360 - DNA, 22 bp, Artificial Sequence
  chemically synthesized
agaaataaatgtgagatataca

SEQ ID NO: 908361 - DNA, 22 bp, Artificial Sequence
  chemically synthesized
atctttctaaagtggatgtata

SEQ ID NO: 908362 - DNA, 22 bp, Artificial Sequence
  chemically synthesized
ttaatctttctaaagtggatgt

SEQ ID NO: 908363 - DNA, 22 bp, Artificial Sequence
  chemically synthesized
attaatctttctaaagtggatg

SEQ ID NO: 908364 - DNA, 22 bp, Artificial Sequence
  chemically synthesized
tattaatctttctaaagtggat

SEQ ID NO: 908365 - DNA, 22 bp, Artificial Sequence
  chemically synthesized
ttattaatctttctaaagtgga

SEQ ID NO: 908366 - DNA, 22 bp, Artificial Sequence
  chemically synthesized
gtttttattaatctttctaaag

SEQ ID NO: 908367 - DNA, 22 bp, Artificial Sequence
  chemically synthesized
ctggtttttattaatctttcta

SEQ ID NO: 908368 - DNA, 22 bp, Artificial Sequence
  chemically synthesized
ctcctggtttttattaatcttt

SEQ ID NO: 908369 - DNA, 22 bp, Artificial Sequence
  chemically synthesized
cctcctggtttttattaatctt

SEQ ID NO: 908370 - DNA, 22 bp, Artificial Sequence
  chemically synthesized
tcctcctggtttttattaatct

SEQ ID NO: 908371 - DNA, 22 bp, Artificial Sequence
  chemically synthesized
tagaaagattaataaaaaccag

SEQ ID NO: 908372 - DNA, 22 bp, Artificial Sequence
  chemically synthesized
agaaagattaataaaaaccagg

SEQ ID NO: 908373 - DNA, 22 bp, Artificial Sequence
  chemically synthesized
gaaagattaataaaaaccagga

SEQ ID NO: 908374 - DNA, 22 bp, Artificial Sequence
  chemically synthesized
ggtaaataattttcctcctggt

SEQ ID NO: 908375 - DNA, 22 bp, Artificial Sequence
  chemically synthesized
ataaaaaccaggaggaaaatta

SEQ ID NO: 908376 - DNA, 22 bp, Artificial Sequence
  chemically synthesized
accaaaaactgggtaaataatt

SEQ ID NO: 908377 - DNA, 22 bp, Artificial Sequence
  chemically synthesized
attcaccaaaaactgggtaaat

SEQ ID NO: 908378 - DNA, 22 bp, Artificial Sequence
  chemically synthesized
actgattcaccaaaaactgggt

SEQ ID NO: 908379 - DNA, 22 bp, Artificial Sequence
  chemically synthesized
tcactcactgattcaccaaaaa

SEQ ID NO: 908380 - DNA, 22 bp, Artificial Sequence
  chemically synthesized
tttacccagtttttggtgaatc

SEQ ID NO: 908381 - DNA, 22 bp, Artificial Sequence
  chemically synthesized
acccagtttttggtgaatcagt

SEQ ID NO: 908382 - DNA, 22 bp, Artificial Sequence
  chemically synthesized
cccagtttttggtgaatcagtg

SEQ ID NO: 908383 - DNA, 22 bp, Artificial Sequence
  chemically synthesized
caaacactgtcactcactgatt

SEQ ID NO: 908384 - DNA, 22 bp, Artificial Sequence
  chemically synthesized
ttggtgaatcagtgagtgacag

SEQ ID NO: 908385 - DNA, 22 bp, Artificial Sequence
  chemically synthesized
tggtgaatcagtgagtgacagt

SEQ ID NO: 908386 - DNA, 22 bp, Artificial Sequence
  chemically synthesized
ggtgaatcagtgagtgacagtg

SEQ ID NO: 908387 - DNA, 22 bp, Artificial Sequence
  chemically synthesized
gtgaatcagtgagtgacagtgt

SEQ ID NO: 908388 - DNA, 22 bp, Artificial Sequence
  chemically synthesized
aatgaaccaccgccactgcaaa

SEQ ID NO: 908389 - DNA, 22 bp, Artificial Sequence
  chemically synthesized
gaatgaaccaccgccactgcaa

SEQ ID NO: 908390 - DNA, 22 bp, Artificial Sequence
  chemically synthesized
cttgaatgaaccaccgccactg

SEQ ID NO: 908391 - DNA, 22 bp, Artificial Sequence
  chemically synthesized
ttccttgaatgaaccaccgcca

SEQ ID NO: 908392 - DNA, 22 bp, Artificial Sequence
  chemically synthesized
attccttgaatgaaccaccgcc

SEQ ID NO: 908393 - DNA, 22 bp, Artificial Sequence
  chemically synthesized
gcagtggcggtggttcattcaa

SEQ ID NO: 908394 - DNA, 22 bp, Artificial Sequence
  chemically synthesized
cagtggcggtggttcattcaag

SEQ ID NO: 908395 - DNA, 22 bp, Artificial Sequence
  chemically synthesized
caaacatttattccttgaatga

SEQ ID NO: 908396 - DNA, 22 bp, Artificial Sequence
  chemically synthesized
gcaaacatttattccttgaatg

SEQ ID NO: 908397 - DNA, 22 bp, Artificial Sequence
  chemically synthesized
tgcaaacatttattccttgaat

SEQ ID NO: 908398 - DNA, 22 bp, Artificial Sequence
  chemically synthesized
tgctttgcaaacatttattcct

SEQ ID NO: 908399 - DNA, 22 bp, Artificial Sequence
  chemically synthesized
atgctttgcaaacatttattcc

SEQ ID NO: 908400 - DNA, 22 bp, Artificial Sequence
  chemically synthesized
attcaaggaataaatgtttgca

SEQ ID NO: 908401 - DNA, 22 bp, Artificial Sequence
  chemically synthesized
gcagtttatgctttgcaaacat

SEQ ID NO: 908402 - DNA, 22 bp, Artificial Sequence
  chemically synthesized
aaggaataaatgtttgcaaagc

SEQ ID NO: 908403 - DNA, 22 bp, Artificial Sequence
  chemically synthesized
gcaaagcataaactgccaggat

SEQ ID NO: 908404 - DNA, 22 bp, Artificial Sequence
  chemically synthesized
caaagcataaactgccaggatt

SEQ ID NO: 908405 - DNA, 22 bp, Artificial Sequence
  chemically synthesized
tggtgagagaaggcaatcctgg

SEQ ID NO: 908406 - DNA, 22 bp, Artificial Sequence
  chemically synthesized
gtggtgagagaaggcaatcctg

SEQ ID NO: 908407 - DNA, 22 bp, Artificial Sequence
  chemically synthesized
tgtggtgagagaaggcaatcct

SEQ ID NO: 908408 - DNA, 22 bp, Artificial Sequence
  chemically synthesized
aactttgtggtgagagaaggca

SEQ ID NO: 908409 - DNA, 22 bp, Artificial Sequence
  chemically synthesized
gaactttgtggtgagagaaggc

SEQ ID NO: 908410 - DNA, 22 bp, Artificial Sequence
  chemically synthesized
tgaactttgtggtgagagaagg

SEQ ID NO: 908411 - DNA, 22 bp, Artificial Sequence
  chemically synthesized
ttgaactttgtggtgagagaag

SEQ ID NO: 908412 - DNA, 22 bp, Artificial Sequence
  chemically synthesized
ccaggattgccttctctcacca

SEQ ID NO: 908413 - DNA, 22 bp, Artificial Sequence
  chemically synthesized
tttttgaactttgtggtgagag

SEQ ID NO: 908414 - DNA, 22 bp, Artificial Sequence
  chemically synthesized
gtttttgaactttgtggtgaga

SEQ ID NO: 908415 - DNA, 22 bp, Artificial Sequence
  chemically synthesized
tttgtttttgaactttgtggtg

SEQ ID NO: 908416 - DNA, 22 bp, Artificial Sequence
  chemically synthesized
ttgtttgtttttgaactttgtg

SEQ ID NO: 908417 - DNA, 22 bp, Artificial Sequence
  chemically synthesized
ccttctctcaccacaaagttca

SEQ ID NO: 908418 - DNA, 22 bp, Artificial Sequence
  chemically synthesized
attattgtttgtttttgaactt

SEQ ID NO: 908419 - DNA, 22 bp, Artificial Sequence
  chemically synthesized
ctctcaccacaaagttcaaaaa

SEQ ID NO: 908420 - DNA, 22 bp, Artificial Sequence
  chemically synthesized
tctcaccacaaagttcaaaaac

SEQ ID NO: 908421 - DNA, 22 bp, Artificial Sequence
  chemically synthesized
tcaccacaaagttcaaaaacaa

SEQ ID NO: 908422 - DNA, 22 bp, Artificial Sequence
  chemically synthesized
accacaaagttcaaaaacaaac

SEQ ID NO: 908423 - DNA, 22 bp, Artificial Sequence
  chemically synthesized
ccatattgattattgtttgttt

SEQ ID NO: 908424 - DNA, 22 bp, Artificial Sequence
  chemically synthesized
agtgagctgccatattgattat

SEQ ID NO: 908425 - DNA, 22 bp, Artificial Sequence
  chemically synthesized
aaaaacaaacaataatcaatat

SEQ ID NO: 908426 - DNA, 22 bp, Artificial Sequence
  chemically synthesized
cagaagtgctcagtgagctgcc

SEQ ID NO: 908427 - DNA, 22 bp, Artificial Sequence
  chemically synthesized
tacagaagtgctcagtgagctg

SEQ ID NO: 908428 - DNA, 22 bp, Artificial Sequence
  chemically synthesized
atgctctacagaagtgctcagt

SEQ ID NO: 908429 - DNA, 22 bp, Artificial Sequence
  chemically synthesized
actgagcacttctgtagagcat

SEQ ID NO: 908430 - DNA, 22 bp, Artificial Sequence
  chemically synthesized
agcacttctgtagagcatcaat

SEQ ID NO: 908431 - DNA, 22 bp, Artificial Sequence
  chemically synthesized
ctgtagagcatcaattattgtc

SEQ ID NO: 908432 - DNA, 22 bp, Artificial Sequence
  chemically synthesized
tgtagagcatcaattattgtca

SEQ ID NO: 908433 - DNA, 22 bp, Artificial Sequence
  chemically synthesized
tagagcatcaattattgtcacg

SEQ ID NO: 908434 - DNA, 22 bp, Artificial Sequence
  chemically synthesized
aataatcataaagatgcgtgac

SEQ ID NO: 908435 - DNA, 22 bp, Artificial Sequence
  chemically synthesized
ttgtcacgcatctttatgatta

SEQ ID NO: 908436 - DNA, 22 bp, Artificial Sequence
  chemically synthesized
atatagtattcaataatcataa

SEQ ID NO: 908437 - DNA, 22 bp, Artificial Sequence
  chemically synthesized
tcacgcatctttatgattattg

SEQ ID NO: 908438 - DNA, 22 bp, Artificial Sequence
  chemically synthesized
tatgattattgaatactatatg

SEQ ID NO: 908439 - DNA, 22 bp, Artificial Sequence
  chemically synthesized
atgattattgaatactatatga

SEQ ID NO: 908440 - DNA, 22 bp, Artificial Sequence
  chemically synthesized
tgaaataaaaattcatatagta

SEQ ID NO: 908441 - DNA, 22 bp, Artificial Sequence
  chemically synthesized
tgattattgaatactatatgaa

SEQ ID NO: 908442 - DNA, 22 bp, Artificial Sequence
  chemically synthesized
ctgtgaaataaaaattcatata

SEQ ID NO: 908443 - DNA, 22 bp, Artificial Sequence
  chemically synthesized
ttgaatactatatgaattttta

SEQ ID NO: 908444 - DNA, 22 bp, Artificial Sequence
  chemically synthesized
aatactatatgaatttttattt

SEQ ID NO: 908445 - DNA, 22 bp, Artificial Sequence
  chemically synthesized
atataaattactgtgaaataaa

SEQ ID NO: 908446 - DNA, 22 bp, Artificial Sequence
  chemically synthesized
tatgaatttttatttcacagta

SEQ ID NO: 908447 - DNA, 22 bp, Artificial Sequence
  chemically synthesized
aattaatataaattactgtgaa

SEQ ID NO: 908448 - DNA, 22 bp, Artificial Sequence
  chemically synthesized
ttatttcacagtaatttatatt

SEQ ID NO: 908449 - DNA, 22 bp, Artificial Sequence
  chemically synthesized
tatttcacagtaatttatatta

SEQ ID NO: 908450 - DNA, 22 bp, Artificial Sequence
  chemically synthesized
atttcacagtaatttatattaa

SEQ ID NO: 908451 - DNA, 22 bp, Artificial Sequence
  chemically synthesized
tttcacagtaatttatattaat

SEQ ID NO: 908452 - DNA, 22 bp, Artificial Sequence
  chemically synthesized
cacagtaatttatattaattca

SEQ ID NO: 908453 - DNA, 22 bp, Artificial Sequence
  chemically synthesized
acagtaatttatattaattcag

SEQ ID NO: 908454 - DNA, 22 bp, Artificial Sequence
  chemically synthesized
gaaaatgaatgactgaattaat

SEQ ID NO: 908455 - DNA, 22 bp, Artificial Sequence
  chemically synthesized
ggaaaatgaatgactgaattaa

SEQ ID NO: 908456 - DNA, 22 bp, Artificial Sequence
  chemically synthesized
atattaattcagtcattcattt

SEQ ID NO: 908457 - DNA, 22 bp, Artificial Sequence
  chemically synthesized
tattaattcagtcattcatttt

SEQ ID NO: 908458 - DNA, 22 bp, Artificial Sequence
  chemically synthesized
gaatacgtggcttggaaaatga

SEQ ID NO: 908459 - DNA, 22 bp, Artificial Sequence
  chemically synthesized
attcagtcattcattttccaag

SEQ ID NO: 908460 - DNA, 22 bp, Artificial Sequence
  chemically synthesized
aactggaatacgtggcttggaa

SEQ ID NO: 908461 - DNA, 22 bp, Artificial Sequence
  chemically synthesized
agtcattcattttccaagccac

SEQ ID NO: 908462 - DNA, 22 bp, Artificial Sequence
  chemically synthesized
attttccaagccacgtattcca

SEQ ID NO: 908463 - DNA, 22 bp, Artificial Sequence
  chemically synthesized
ccaagtccctgaactggaatac

SEQ ID NO: 908464 - DNA, 22 bp, Artificial Sequence
  chemically synthesized
tccaagccacgtattccagttc

SEQ ID NO: 908465 - DNA, 22 bp, Artificial Sequence
  chemically synthesized
ccaagccacgtattccagttca

SEQ ID NO: 908466 - DNA, 22 bp, Artificial Sequence
  chemically synthesized
caagccacgtattccagttcag

SEQ ID NO: 908467 - DNA, 22 bp, Artificial Sequence
  chemically synthesized
gcctcccaagtccctgaactgg

SEQ ID NO: 908468 - DNA, 22 bp, Artificial Sequence
  chemically synthesized
tggcctcccaagtccctgaact

SEQ ID NO: 908469 - DNA, 22 bp, Artificial Sequence
  chemically synthesized
cagttcagggacttgggaggcc

SEQ ID NO: 908470 - DNA, 22 bp, Artificial Sequence
  chemically synthesized
ccaggatgggctctggcctccc

SEQ ID NO: 908471 - DNA, 22 bp, Artificial Sequence
  chemically synthesized
agggacttgggaggccagagcc

SEQ ID NO: 908472 - DNA, 22 bp, Artificial Sequence
  chemically synthesized
agttgccaggatgggctctggc

SEQ ID NO: 908473 - DNA, 22 bp, Artificial Sequence
  chemically synthesized
tgagttgccaggatgggctctg

SEQ ID NO: 908474 - DNA, 22 bp, Artificial Sequence
  chemically synthesized
gggaggccagagcccatcctgg

SEQ ID NO: 908475 - DNA, 22 bp, Artificial Sequence
  chemically synthesized
ggaggccagagcccatcctggc

SEQ ID NO: 908476 - DNA, 22 bp, Artificial Sequence
  chemically synthesized
gtgctctgagttgccaggatgg

SEQ ID NO: 908477 - DNA, 22 bp, Artificial Sequence
  chemically synthesized
tctggtgctctgagttgccagg

SEQ ID NO: 908478 - DNA, 22 bp, Artificial Sequence
  chemically synthesized
ctgtctggtgctctgagttgcc

SEQ ID NO: 908479 - DNA, 22 bp, Artificial Sequence
  chemically synthesized
gctcctgtctggtgctctgagt

SEQ ID NO: 908480 - DNA, 22 bp, Artificial Sequence
  chemically synthesized
gcaactcagagcaccagacagg

SEQ ID NO: 908481 - DNA, 22 bp, Artificial Sequence
  chemically synthesized
ccagtgttggctcctgtctggt

SEQ ID NO: 908482 - DNA, 22 bp, Artificial Sequence
  chemically synthesized
agagcaccagacaggagccaac

SEQ ID NO: 908483 - DNA, 22 bp, Artificial Sequence
  chemically synthesized
cgatagaatggcatccctgcca

SEQ ID NO: 908484 - DNA, 22 bp, Artificial Sequence
  chemically synthesized
tgccctgcgatagaatggcatc

SEQ ID NO: 908485 - DNA, 22 bp, Artificial Sequence
  chemically synthesized
cgactgtgccctgcgatagaat

SEQ ID NO: 908486 - DNA, 22 bp, Artificial Sequence
  chemically synthesized
gcagggatgccattctatcgca

SEQ ID NO: 908487 - DNA, 22 bp, Artificial Sequence
  chemically synthesized
tgtgtctacgactgtgccctgc

SEQ ID NO: 908488 - DNA, 22 bp, Artificial Sequence
  chemically synthesized
atgtgtctacgactgtgccctg

SEQ ID NO: 908489 - DNA, 22 bp, Artificial Sequence
  chemically synthesized
tatcgcagggcacagtcgtaga

SEQ ID NO: 908490 - DNA, 22 bp, Artificial Sequence
  chemically synthesized
tcgcagggcacagtcgtagaca

SEQ ID NO: 908491 - DNA, 22 bp, Artificial Sequence
  chemically synthesized
tccccatgtgagtgtttatgtg

SEQ ID NO: 908492 - DNA, 22 bp, Artificial Sequence
  chemically synthesized
cattgtccccatgtgagtgttt

SEQ ID NO: 908493 - DNA, 22 bp, Artificial Sequence
  chemically synthesized
gtgtgtctacattgtccccatg

SEQ ID NO: 908494 - DNA, 22 bp, Artificial Sequence
  chemically synthesized
ggggaattggtgtgtctacatt

SEQ ID NO: 908495 - DNA, 22 bp, Artificial Sequence
  chemically synthesized
acatggggacaatgtagacaca

SEQ ID NO: 908496 - DNA, 22 bp, Artificial Sequence
  chemically synthesized
tgcacgttaggggaattggtgt

SEQ ID NO: 908497 - DNA, 22 bp, Artificial Sequence
  chemically synthesized
acatgtcccaaactgtgcacgt

SEQ ID NO: 908498 - DNA, 22 bp, Artificial Sequence
  chemically synthesized
ctcacatgtcccaaactgtgca

SEQ ID NO: 908499 - DNA, 22 bp, Artificial Sequence
  chemically synthesized
cctcacatgtcccaaactgtgc

SEQ ID NO: 908500 - DNA, 22 bp, Artificial Sequence
  chemically synthesized
ccctaacgtgcacagtttggga

SEQ ID NO: 908501 - DNA, 22 bp, Artificial Sequence
  chemically synthesized
gtttcctcacatgtcccaaact

SEQ ID NO: 908502 - DNA, 22 bp, Artificial Sequence
  chemically synthesized
tggtttcctcacatgtcccaaa

SEQ ID NO: 908503 - DNA, 22 bp, Artificial Sequence
  chemically synthesized
acgtgcacagtttgggacatgt

SEQ ID NO: 908504 - DNA, 22 bp, Artificial Sequence
  chemically synthesized
gtactctggtttcctcacatgt

SEQ ID NO: 908505 - DNA, 22 bp, Artificial Sequence
  chemically synthesized
tagtactctggtttcctcacat

SEQ ID NO: 908506 - DNA, 22 bp, Artificial Sequence
  chemically synthesized
ctagtactctggtttcctcaca

SEQ ID NO: 908507 - DNA, 22 bp, Artificial Sequence
  chemically synthesized
ttctagtactctggtttcctca

SEQ ID NO: 908508 - DNA, 22 bp, Artificial Sequence
  chemically synthesized
cttctagtactctggtttcctc

SEQ ID NO: 908509 - DNA, 22 bp, Artificial Sequence
  chemically synthesized
tcttctagtactctggtttcct

SEQ ID NO: 908510 - DNA, 22 bp, Artificial Sequence
  chemically synthesized
gggacatgtgaggaaaccagag

SEQ ID NO: 908511 - DNA, 22 bp, Artificial Sequence
  chemically synthesized
ggacatgtgaggaaaccagagt

SEQ ID NO: 908512 - DNA, 22 bp, Artificial Sequence
  chemically synthesized
tgggttttcttctagtactctg

SEQ ID NO: 908513 - DNA, 22 bp, Artificial Sequence
  chemically synthesized
tgtgggttttcttctagtactc

SEQ ID NO: 908514 - DNA, 22 bp, Artificial Sequence
  chemically synthesized
tctctgtgggttttcttctagt

SEQ ID NO: 908515 - DNA, 22 bp, Artificial Sequence
  chemically synthesized
gtctctgtgggttttcttctag

SEQ ID NO: 908516 - DNA, 22 bp, Artificial Sequence
  chemically synthesized
tgtctctgtgggttttcttcta

SEQ ID NO: 908517 - DNA, 22 bp, Artificial Sequence
  chemically synthesized
ttgtctctgtgggttttcttct

SEQ ID NO: 908518 - DNA, 22 bp, Artificial Sequence
  chemically synthesized
ttttgtctctgtgggttttctt

SEQ ID NO: 908519 - DNA, 22 bp, Artificial Sequence
  chemically synthesized
cttttgtctctgtgggttttct

SEQ ID NO: 908520 - DNA, 22 bp, Artificial Sequence
  chemically synthesized
tcttttgtctctgtgggttttc

SEQ ID NO: 908521 - DNA, 22 bp, Artificial Sequence
  chemically synthesized
gaagaaaacccacagagacaaa

SEQ ID NO: 908522 - DNA, 22 bp, Artificial Sequence
  chemically synthesized
tgtggggttttcttttgtctct

SEQ ID NO: 908523 - DNA, 22 bp, Artificial Sequence
  chemically synthesized
tctatgtggggttttcttttgt

SEQ ID NO: 908524 - DNA, 22 bp, Artificial Sequence
  chemically synthesized
ggggggcactgtctatgtgggg

SEQ ID NO: 908525 - DNA, 22 bp, Artificial Sequence
  chemically synthesized
agctaggggggcactgtctatg

SEQ ID NO: 908526 - DNA, 22 bp, Artificial Sequence
  chemically synthesized
tatctcagctaggggggcactg

SEQ ID NO: 908527 - DNA, 22 bp, Artificial Sequence
  chemically synthesized
gcaagggaaaaaactgtatctc

SEQ ID NO: 908528 - DNA, 22 bp, Artificial Sequence
  chemically synthesized
taatattggcaagggaaaaaac

SEQ ID NO: 908529 - DNA, 22 bp, Artificial Sequence
  chemically synthesized
gctgagatacagttttttccct

SEQ ID NO: 908530 - DNA, 22 bp, Artificial Sequence
  chemically synthesized
agatacagttttttcccttgcc

SEQ ID NO: 908531 - DNA, 22 bp, Artificial Sequence
  chemically synthesized
tgttataatattggcaagggaa

SEQ ID NO: 908532 - DNA, 22 bp, Artificial Sequence
  chemically synthesized
agcatcactgtgttataatatt

SEQ ID NO: 908533 - DNA, 22 bp, Artificial Sequence
  chemically synthesized
tttcccttgccaatattataac

SEQ ID NO: 908534 - DNA, 22 bp, Artificial Sequence
  chemically synthesized
ttcccttgccaatattataaca

SEQ ID NO: 908535 - DNA, 22 bp, Artificial Sequence
  chemically synthesized
tcccttgccaatattataacac

SEQ ID NO: 908536 - DNA, 22 bp, Artificial Sequence
  chemically synthesized
cccttgccaatattataacaca

SEQ ID NO: 908537 - DNA, 22 bp, Artificial Sequence
  chemically synthesized
attgagcatcactgtgttataa

SEQ ID NO: 908538 - DNA, 22 bp, Artificial Sequence
  chemically synthesized
ccttgccaatattataacacag

SEQ ID NO: 908539 - DNA, 22 bp, Artificial Sequence
  chemically synthesized
cattgagcatcactgtgttata

SEQ ID NO: 908540 - DNA, 22 bp, Artificial Sequence
  chemically synthesized
tttcattgagcatcactgtgtt

SEQ ID NO: 908541 - DNA, 22 bp, Artificial Sequence
  chemically synthesized
gccaatattataacacagtgat

SEQ ID NO: 908542 - DNA, 22 bp, Artificial Sequence
  chemically synthesized
ccaatattataacacagtgatg

SEQ ID NO: 908543 - DNA, 22 bp, Artificial Sequence
  chemically synthesized
aataatgttgtttcattgagca

SEQ ID NO: 908544 - DNA, 22 bp, Artificial Sequence
  chemically synthesized
taacacagtgatgctcaatgaa

SEQ ID NO: 908545 - DNA, 22 bp, Artificial Sequence
  chemically synthesized
gaataatgttgtttcattgagc

SEQ ID NO: 908546 - DNA, 22 bp, Artificial Sequence
  chemically synthesized
aatgaaacaacattattcaagg

SEQ ID NO: 908547 - DNA, 22 bp, Artificial Sequence
  chemically synthesized
atgtacggcaggtccttgaata

SEQ ID NO: 908548 - DNA, 22 bp, Artificial Sequence
  chemically synthesized
aatgtacggcaggtccttgaat

SEQ ID NO: 908549 - DNA, 22 bp, Artificial Sequence
  chemically synthesized
taatgtacggcaggtccttgaa

SEQ ID NO: 908550 - DNA, 22 bp, Artificial Sequence
  chemically synthesized
aaactttaatgtacggcaggtc

SEQ ID NO: 908551 - DNA, 22 bp, Artificial Sequence
  chemically synthesized
tcaaactttaatgtacggcagg

SEQ ID NO: 908552 - DNA, 22 bp, Artificial Sequence
  chemically synthesized
ctcaaactttaatgtacggcag

SEQ ID NO: 908553 - DNA, 22 bp, Artificial Sequence
  chemically synthesized
ttcaaggacctgccgtacatta

SEQ ID NO: 908554 - DNA, 22 bp, Artificial Sequence
  chemically synthesized
aaggacctgccgtacattaaag

SEQ ID NO: 908555 - DNA, 22 bp, Artificial Sequence
  chemically synthesized
ccgtacattaaagtttgagaag

SEQ ID NO: 908556 - DNA, 22 bp, Artificial Sequence
  chemically synthesized
aagtttgagaagttctgctcta

SEQ ID NO: 908557 - DNA, 22 bp, Artificial Sequence
  chemically synthesized
gagaagttctgctctacgtgat

SEQ ID NO: 908558 - DNA, 22 bp, Artificial Sequence
  chemically synthesized
agaagttctgctctacgtgatg

SEQ ID NO: 908559 - DNA, 22 bp, Artificial Sequence
  chemically synthesized
tgctctacgtgatggcacgtgg

SEQ ID NO: 908560 - DNA, 22 bp, Artificial Sequence
  chemically synthesized
ctctacgtgatggcacgtggat

SEQ ID NO: 908561 - DNA, 22 bp, Artificial Sequence
  chemically synthesized
tacgtgatggcacgtggatctt

SEQ ID NO: 908562 - DNA, 22 bp, Artificial Sequence
  chemically synthesized
cgtgatggcacgtggatcttta

SEQ ID NO: 908563 - DNA, 22 bp, Artificial Sequence
  chemically synthesized
atagcagtggtaaggggtaaag

SEQ ID NO: 908564 - DNA, 22 bp, Artificial Sequence
  chemically synthesized
taatagcagtggtaaggggtaa

SEQ ID NO: 908565 - DNA, 22 bp, Artificial Sequence
  chemically synthesized
ccataaaattctaatagcagtg

SEQ ID NO: 908566 - DNA, 22 bp, Artificial Sequence
  chemically synthesized
taccccttaccactgctattag

SEQ ID NO: 908567 - DNA, 22 bp, Artificial Sequence
  chemically synthesized
accccttaccactgctattaga

SEQ ID NO: 908568 - DNA, 22 bp, Artificial Sequence
  chemically synthesized
ccccttaccactgctattagaa

SEQ ID NO: 908569 - DNA, 22 bp, Artificial Sequence
  chemically synthesized
accactgctattagaattttat

SEQ ID NO: 908570 - DNA, 22 bp, Artificial Sequence
  chemically synthesized
ccactgctattagaattttatg

SEQ ID NO: 908571 - DNA, 22 bp, Artificial Sequence
  chemically synthesized
caaagtaggttaccataaaatt

SEQ ID NO: 908572 - DNA, 22 bp, Artificial Sequence
  chemically synthesized
ttacaaagtaggttaccataaa

SEQ ID NO: 908573 - DNA, 22 bp, Artificial Sequence
  chemically synthesized
ctattagaattttatggtaacc

SEQ ID NO: 908574 - DNA, 22 bp, Artificial Sequence
  chemically synthesized
ctattacaaagtaggttaccat

SEQ ID NO: 908575 - DNA, 22 bp, Artificial Sequence
  chemically synthesized
ttagaattttatggtaacctac

SEQ ID NO: 908576 - DNA, 22 bp, Artificial Sequence
  chemically synthesized
gaattttatggtaacctacttt

SEQ ID NO: 908577 - DNA, 22 bp, Artificial Sequence
  chemically synthesized
tggttactattacaaagtaggt

SEQ ID NO: 908578 - DNA, 22 bp, Artificial Sequence
  chemically synthesized
tatggtaacctactttgtaata

SEQ ID NO: 908579 - DNA, 22 bp, Artificial Sequence
  chemically synthesized
aattgtggttactattacaaag

SEQ ID NO: 908580 - DNA, 22 bp, Artificial Sequence
  chemically synthesized
atggtaacctactttgtaatag

SEQ ID NO: 908581 - DNA, 22 bp, Artificial Sequence
  chemically synthesized
tggtaacctactttgtaatagt

SEQ ID NO: 908582 - DNA, 22 bp, Artificial Sequence
  chemically synthesized
cgaggagttaaattgtggttac

SEQ ID NO: 908583 - DNA, 22 bp, Artificial Sequence
  chemically synthesized
ctttgtaatagtaaccacaatt

SEQ ID NO: 908584 - DNA, 22 bp, Artificial Sequence
  chemically synthesized
ttacgaggagttaaattgtggt

SEQ ID NO: 908585 - DNA, 22 bp, Artificial Sequence
  chemically synthesized
attacgaggagttaaattgtgg

SEQ ID NO: 908586 - DNA, 22 bp, Artificial Sequence
  chemically synthesized
tgtaatagtaaccacaatttaa

SEQ ID NO: 908587 - DNA, 22 bp, Artificial Sequence
  chemically synthesized
tattacgaggagttaaattgtg

SEQ ID NO: 908588 - DNA, 22 bp, Artificial Sequence
  chemically synthesized
gtaatagtaaccacaatttaac

SEQ ID NO: 908589 - DNA, 22 bp, Artificial Sequence
  chemically synthesized
taatagtaaccacaatttaact

SEQ ID NO: 908590 - DNA, 22 bp, Artificial Sequence
  chemically synthesized
tcatactttattacgaggagtt

SEQ ID NO: 908591 - DNA, 22 bp, Artificial Sequence
  chemically synthesized
aactcctcgtaataaagtatga

SEQ ID NO: 908592 - DNA, 22 bp, Artificial Sequence
  chemically synthesized
actcctcgtaataaagtatgat

SEQ ID NO: 908593 - DNA, 22 bp, Artificial Sequence
  chemically synthesized
ctcgtaataaagtatgatagta

SEQ ID NO: 908594 - DNA, 22 bp, Artificial Sequence
  chemically synthesized
aaaacacaatatatactatcat

SEQ ID NO: 908595 - DNA, 22 bp, Artificial Sequence
  chemically synthesized
gtaataaagtatgatagtatat

SEQ ID NO: 908596 - DNA, 22 bp, Artificial Sequence
  chemically synthesized
gtgaggaactaaaaacacaata

SEQ ID NO: 908597 - DNA, 22 bp, Artificial Sequence
  chemically synthesized
ccagcgtctagtgaggaactaa

SEQ ID NO: 908598 - DNA, 22 bp, Artificial Sequence
  chemically synthesized
tgtttttagttcctcactagac

SEQ ID NO: 908599 - DNA, 22 bp, Artificial Sequence
  chemically synthesized
cccatctcccagcgtctagtga

SEQ ID NO: 908600 - DNA, 22 bp, Artificial Sequence
  chemically synthesized
gcccatctcccagcgtctagtg

SEQ ID NO: 908601 - DNA, 22 bp, Artificial Sequence
  chemically synthesized
ttagttcctcactagacgctgg

SEQ ID NO: 908602 - DNA, 22 bp, Artificial Sequence
  chemically synthesized
tagttcctcactagacgctggg

SEQ ID NO: 908603 - DNA, 22 bp, Artificial Sequence
  chemically synthesized
agttcctcactagacgctggga

SEQ ID NO: 908604 - DNA, 22 bp, Artificial Sequence
  chemically synthesized
gttcctcactagacgctgggag

SEQ ID NO: 908605 - DNA, 22 bp, Artificial Sequence
  chemically synthesized
ctcactagacgctgggagatgg

SEQ ID NO: 908606 - DNA, 22 bp, Artificial Sequence
  chemically synthesized
tgaagcatgtttgcccatctcc

SEQ ID NO: 908607 - DNA, 22 bp, Artificial Sequence
  chemically synthesized
actagacgctgggagatgggca

SEQ ID NO: 908608 - DNA, 22 bp, Artificial Sequence
  chemically synthesized
gacgctgggagatgggcaaaca

SEQ ID NO: 908609 - DNA, 22 bp, Artificial Sequence
  chemically synthesized
ggagatgggcaaacatgcttca

SEQ ID NO: 908610 - DNA, 22 bp, Artificial Sequence
  chemically synthesized
tccaacagtgatgcattatgaa

SEQ ID NO: 908611 - DNA, 22 bp, Artificial Sequence
  chemically synthesized
gtccaacagtgatgcattatga

SEQ ID NO: 908612 - DNA, 22 bp, Artificial Sequence
  chemically synthesized
atttgtccaacagtgatgcatt

SEQ ID NO: 908613 - DNA, 22 bp, Artificial Sequence
  chemically synthesized
ctcatttgtccaacagtgatgc

SEQ ID NO: 908614 - DNA, 22 bp, Artificial Sequence
  chemically synthesized
gttcctcatttgtccaacagtg

SEQ ID NO: 908615 - DNA, 22 bp, Artificial Sequence
  chemically synthesized
cataatgcatcactgttggaca

SEQ ID NO: 908616 - DNA, 22 bp, Artificial Sequence
  chemically synthesized
tagttcctcatttgtccaacag

SEQ ID NO: 908617 - DNA, 22 bp, Artificial Sequence
  chemically synthesized
ataatgcatcactgttggacaa

SEQ ID NO: 908618 - DNA, 22 bp, Artificial Sequence
  chemically synthesized
gtgcctctagttcctcatttgt

SEQ ID NO: 908619 - DNA, 22 bp, Artificial Sequence
  chemically synthesized
agtgcctctagttcctcatttg

SEQ ID NO: 908620 - DNA, 22 bp, Artificial Sequence
  chemically synthesized
ttagtgcctctagttcctcatt

SEQ ID NO: 908621 - DNA, 22 bp, Artificial Sequence
  chemically synthesized
ttggacaaatgaggaactagag

SEQ ID NO: 908622 - DNA, 22 bp, Artificial Sequence
  chemically synthesized
aatctcttagtgcctctagttc

SEQ ID NO: 908623 - DNA, 22 bp, Artificial Sequence
  chemically synthesized
aaatctcttagtgcctctagtt

SEQ ID NO: 908624 - DNA, 22 bp, Artificial Sequence
  chemically synthesized
gacaaatgaggaactagaggca

SEQ ID NO: 908625 - DNA, 22 bp, Artificial Sequence
  chemically synthesized
tttaaatctcttagtgcctcta

SEQ ID NO: 908626 - DNA, 22 bp, Artificial Sequence
  chemically synthesized
atttaaatctcttagtgcctct

SEQ ID NO: 908627 - DNA, 22 bp, Artificial Sequence
  chemically synthesized
tgggccacttatttaaatctct

SEQ ID NO: 908628 - DNA, 22 bp, Artificial Sequence
  chemically synthesized
gaggcactaagagatttaaata

SEQ ID NO: 908629 - DNA, 22 bp, Artificial Sequence
  chemically synthesized
ataactgtgggccacttattta

SEQ ID NO: 908630 - DNA, 22 bp, Artificial Sequence
  chemically synthesized
actcataactgtgggccactta

SEQ ID NO: 908631 - DNA, 22 bp, Artificial Sequence
  chemically synthesized
agagatttaaataagtggccca

SEQ ID NO: 908632 - DNA, 22 bp, Artificial Sequence
  chemically synthesized
actaactcataactgtgggcca

SEQ ID NO: 908633 - DNA, 22 bp, Artificial Sequence
  chemically synthesized
aaataagtggcccacagttatg

SEQ ID NO: 908634 - DNA, 22 bp, Artificial Sequence
  chemically synthesized
aataagtggcccacagttatga

SEQ ID NO: 908635 - DNA, 22 bp, Artificial Sequence
  chemically synthesized
aacactcactaactcataactg

SEQ ID NO: 908636 - DNA, 22 bp, Artificial Sequence
  chemically synthesized
gacccaggttcaacactcacta

SEQ ID NO: 908637 - DNA, 22 bp, Artificial Sequence
  chemically synthesized
agtctagacccaggttcaacac

SEQ ID NO: 908638 - DNA, 22 bp, Artificial Sequence
  chemically synthesized
tgagttagtgagtgttgaacct

SEQ ID NO: 908639 - DNA, 22 bp, Artificial Sequence
  chemically synthesized
ataactcagtctagacccaggt

SEQ ID NO: 908640 - DNA, 22 bp, Artificial Sequence
  chemically synthesized
gtgagtgttgaacctgggtcta

SEQ ID NO: 908641 - DNA, 22 bp, Artificial Sequence
  chemically synthesized
cagttcataactcagtctagac

SEQ ID NO: 908642 - DNA, 22 bp, Artificial Sequence
  chemically synthesized
gcagttcataactcagtctaga

SEQ ID NO: 908643 - DNA, 22 bp, Artificial Sequence
  chemically synthesized
aacctgggtctagactgagtta

SEQ ID NO: 908644 - DNA, 22 bp, Artificial Sequence
  chemically synthesized
aacttgcagttcataactcagt

SEQ ID NO: 908645 - DNA, 22 bp, Artificial Sequence
  chemically synthesized
ggtctagactgagttatgaact

SEQ ID NO: 908646 - DNA, 22 bp, Artificial Sequence
  chemically synthesized
gactgagttatgaactgcaagt

SEQ ID NO: 908647 - DNA, 22 bp, Artificial Sequence
  chemically synthesized
gaaagatcactaaacttgcagt

SEQ ID NO: 908648 - DNA, 22 bp, Artificial Sequence
  chemically synthesized
agttatgaactgcaagtttagt

SEQ ID NO: 908649 - DNA, 22 bp, Artificial Sequence
  chemically synthesized
agtcctggaaagatcactaaac

SEQ ID NO: 908650 - DNA, 22 bp, Artificial Sequence
  chemically synthesized
tgaactgcaagtttagtgatct

SEQ ID NO: 908651 - DNA, 22 bp, Artificial Sequence
  chemically synthesized
atctcagtcctggaaagatcac

SEQ ID NO: 908652 - DNA, 22 bp, Artificial Sequence
  chemically synthesized
caagtttagtgatctttccagg

SEQ ID NO: 908653 - DNA, 22 bp, Artificial Sequence
  chemically synthesized
catgcctcatctcagtcctgga

SEQ ID NO: 908654 - DNA, 22 bp, Artificial Sequence
  chemically synthesized
tccatgcctcatctcagtcctg

SEQ ID NO: 908655 - DNA, 22 bp, Artificial Sequence
  chemically synthesized
agtgatctttccaggactgaga

SEQ ID NO: 908656 - DNA, 22 bp, Artificial Sequence
  chemically synthesized
gtgatctttccaggactgagat

SEQ ID NO: 908657 - DNA, 22 bp, Artificial Sequence
  chemically synthesized
ttctccatgcctcatctcagtc

SEQ ID NO: 908658 - DNA, 22 bp, Artificial Sequence
  chemically synthesized
attctccatgcctcatctcagt

SEQ ID NO: 908659 - DNA, 22 bp, Artificial Sequence
  chemically synthesized
ttattctccatgcctcatctca

SEQ ID NO: 908660 - DNA, 22 bp, Artificial Sequence
  chemically synthesized
cttattctccatgcctcatctc

SEQ ID NO: 908661 - DNA, 22 bp, Artificial Sequence
  chemically synthesized
tccaggactgagatgaggcatg

SEQ ID NO: 908662 - DNA, 22 bp, Artificial Sequence
  chemically synthesized
ccaggactgagatgaggcatgg

SEQ ID NO: 908663 - DNA, 22 bp, Artificial Sequence
  chemically synthesized
caggactgagatgaggcatgga

SEQ ID NO: 908664 - DNA, 22 bp, Artificial Sequence
  chemically synthesized
caccttcttattctccatgcct

SEQ ID NO: 908665 - DNA, 22 bp, Artificial Sequence
  chemically synthesized
agatgaggcatggagaataaga

SEQ ID NO: 908666 - DNA, 22 bp, Artificial Sequence
  chemically synthesized
tgtaatgagtgccaccgttcca

SEQ ID NO: 908667 - DNA, 22 bp, Artificial Sequence
  chemically synthesized
gtgtaatgagtgccaccgttcc

SEQ ID NO: 908668 - DNA, 22 bp, Artificial Sequence
  chemically synthesized
atggtttgtgtaatgagtgcca

SEQ ID NO: 908669 - DNA, 22 bp, Artificial Sequence
  chemically synthesized
taatggtttgtgtaatgagtgc

SEQ ID NO: 908670 - DNA, 22 bp, Artificial Sequence
  chemically synthesized
aaatattctaatggtttgtgta

SEQ ID NO: 908671 - DNA, 22 bp, Artificial Sequence
  chemically synthesized
attacacaaaccattagaatat

SEQ ID NO: 908672 - DNA, 22 bp, Artificial Sequence
  chemically synthesized
ccaacgtggcctcaaatattct

SEQ ID NO: 908673 - DNA, 22 bp, Artificial Sequence
  chemically synthesized
cacaaaccattagaatatttga

SEQ ID NO: 908674 - DNA, 22 bp, Artificial Sequence
  chemically synthesized
attcccaacgtggcctcaaata

SEQ ID NO: 908675 - DNA, 22 bp, Artificial Sequence
  chemically synthesized
gaatatttgaggccacgttggg

SEQ ID NO: 908676 - DNA, 22 bp, Artificial Sequence
  chemically synthesized
gcgtgtggttaattcccaacgt

SEQ ID NO: 908677 - DNA, 22 bp, Artificial Sequence
  chemically synthesized
agttcgcgtgtggttaattccc

SEQ ID NO: 908678 - DNA, 22 bp, Artificial Sequence
  chemically synthesized
gaggccacgttgggaattaacc

SEQ ID NO: 908679 - DNA, 22 bp, Artificial Sequence
  chemically synthesized
aggccacgttgggaattaacca

SEQ ID NO: 908680 - DNA, 22 bp, Artificial Sequence
  chemically synthesized
tcagttcgcgtgtggttaattc

SEQ ID NO: 908681 - DNA, 22 bp, Artificial Sequence
  chemically synthesized
ctcagttcgcgtgtggttaatt

SEQ ID NO: 908682 - DNA, 22 bp, Artificial Sequence
  chemically synthesized
cagcttctcagttcgcgtgtgg

SEQ ID NO: 908683 - DNA, 22 bp, Artificial Sequence
  chemically synthesized
ccagcttctcagttcgcgtgtg

SEQ ID NO: 908684 - DNA, 22 bp, Artificial Sequence
  chemically synthesized
tccagcttctcagttcgcgtgt

SEQ ID NO: 908685 - DNA, 22 bp, Artificial Sequence
  chemically synthesized
ggaattaaccacacgcgaactg

SEQ ID NO: 908686 - DNA, 22 bp, Artificial Sequence
  chemically synthesized
accacacgcgaactgagaagct

SEQ ID NO: 908687 - DNA, 22 bp, Artificial Sequence
  chemically synthesized
aagatacccctttccagcttct

SEQ ID NO: 908688 - DNA, 22 bp, Artificial Sequence
  chemically synthesized
aaagatacccctttccagcttc

SEQ ID NO: 908689 - DNA, 22 bp, Artificial Sequence
  chemically synthesized
ttaaagatacccctttccagct

SEQ ID NO: 908690 - DNA, 22 bp, Artificial Sequence
  chemically synthesized
cttaaagatacccctttccagc

SEQ ID NO: 908691 - DNA, 22 bp, Artificial Sequence
  chemically synthesized
tcttaaagatacccctttccag

SEQ ID NO: 908692 - DNA, 22 bp, Artificial Sequence
  chemically synthesized
gttttcttaaagataccccttt

SEQ ID NO: 908693 - DNA, 22 bp, Artificial Sequence
  chemically synthesized
agaagctggaaaggggtatctt

SEQ ID NO: 908694 - DNA, 22 bp, Artificial Sequence
  chemically synthesized
gaaaggggtatctttaagaaaa

SEQ ID NO: 908695 - DNA, 22 bp, Artificial Sequence
  chemically synthesized
gggtgaaggattagttttctta

SEQ ID NO: 908696 - DNA, 22 bp, Artificial Sequence
  chemically synthesized
cgggtgaaggattagttttctt

SEQ ID NO: 908697 - DNA, 22 bp, Artificial Sequence
  chemically synthesized
cttcgggtgaaggattagtttt

SEQ ID NO: 908698 - DNA, 22 bp, Artificial Sequence
  chemically synthesized
tacttcgggtgaaggattagtt

SEQ ID NO: 908699 - DNA, 22 bp, Artificial Sequence
  chemically synthesized
ctacttcgggtgaaggattagt

SEQ ID NO: 908700 - DNA, 22 bp, Artificial Sequence
  chemically synthesized
taagaaaactaatccttcaccc

SEQ ID NO: 908701 - DNA, 22 bp, Artificial Sequence
  chemically synthesized
aagaaaactaatccttcacccg

SEQ ID NO: 908702 - DNA, 22 bp, Artificial Sequence
  chemically synthesized
agaaaactaatccttcacccga

SEQ ID NO: 908703 - DNA, 22 bp, Artificial Sequence
  chemically synthesized
aataatcatttctacttcgggt

SEQ ID NO: 908704 - DNA, 22 bp, Artificial Sequence
  chemically synthesized
atccttcacccgaagtagaaat

SEQ ID NO: 908705 - DNA, 22 bp, Artificial Sequence
  chemically synthesized
cacccgaagtagaaatgattat

SEQ ID NO: 908706 - DNA, 22 bp, Artificial Sequence
  chemically synthesized
acccgaagtagaaatgattatt

SEQ ID NO: 908707 - DNA, 22 bp, Artificial Sequence
  chemically synthesized
gaatgcagtatgattaaataat

SEQ ID NO: 908708 - DNA, 22 bp, Artificial Sequence
  chemically synthesized
aaactagaatgcagtatgatta

SEQ ID NO: 908709 - DNA, 22 bp, Artificial Sequence
  chemically synthesized
tgctgaaactagaatgcagtat

SEQ ID NO: 908710 - DNA, 22 bp, Artificial Sequence
  chemically synthesized
atgctgaaactagaatgcagta

SEQ ID NO: 908711 - DNA, 22 bp, Artificial Sequence
  chemically synthesized
tatgctgaaactagaatgcagt

SEQ ID NO: 908712 - DNA, 22 bp, Artificial Sequence
  chemically synthesized
tttaatcatactgcattctagt

SEQ ID NO: 908713 - DNA, 22 bp, Artificial Sequence
  chemically synthesized
aatcatactgcattctagtttc

SEQ ID NO: 908714 - DNA, 22 bp, Artificial Sequence
  chemically synthesized
atcatactgcattctagtttca

SEQ ID NO: 908715 - DNA, 22 bp, Artificial Sequence
  chemically synthesized
aagtctttatgctgaaactaga

SEQ ID NO: 908716 - DNA, 22 bp, Artificial Sequence
  chemically synthesized
acatgttcaagtctttatgctg

SEQ ID NO: 908717 - DNA, 22 bp, Artificial Sequence
  chemically synthesized
cattctagtttcagcataaaga

SEQ ID NO: 908718 - DNA, 22 bp, Artificial Sequence
  chemically synthesized
tagtttcagcataaagacttga

SEQ ID NO: 908719 - DNA, 22 bp, Artificial Sequence
  chemically synthesized
acattaacatgttcaagtcttt

SEQ ID NO: 908720 - DNA, 22 bp, Artificial Sequence
  chemically synthesized
gtttcagcataaagacttgaac

SEQ ID NO: 908721 - DNA, 22 bp, Artificial Sequence
  chemically synthesized
cagcataaagacttgaacatgt

SEQ ID NO: 908722 - DNA, 22 bp, Artificial Sequence
  chemically synthesized
agcataaagacttgaacatgtt

SEQ ID NO: 908723 - DNA, 22 bp, Artificial Sequence
  chemically synthesized
aaaaaaaagatgttgacattaa

SEQ ID NO: 908724 - DNA, 22 bp, Artificial Sequence
  chemically synthesized
gaacatgttaatgtcaacatct

SEQ ID NO: 908725 - DNA, 22 bp, Artificial Sequence
  chemically synthesized
aacatgttaatgtcaacatctt

SEQ ID NO: 908726 - DNA, 22 bp, Artificial Sequence
  chemically synthesized
atgtcaacatctttttttttaa

SEQ ID NO: 908727 - DNA, 22 bp, Artificial Sequence
  chemically synthesized
aaacaaacaaaaaaaaaaagat

SEQ ID NO: 908728 - DNA, 22 bp, Artificial Sequence
  chemically synthesized
tttttttaatcttttttttttt

SEQ ID NO: 908729 - DNA, 22 bp, Artificial Sequence
  chemically synthesized
tctcaaacaaacaaaaaaaaaa

SEQ ID NO: 908730 - DNA, 22 bp, Artificial Sequence
  chemically synthesized
ttttttaatctttttttttttg

SEQ ID NO: 908731 - DNA, 22 bp, Artificial Sequence
  chemically synthesized
tttttaatctttttttttttgt

SEQ ID NO: 908732 - DNA, 22 bp, Artificial Sequence
  chemically synthesized
tgtctcaaacaaacaaaaaaaa

SEQ ID NO: 908733 - DNA, 22 bp, Artificial Sequence
  chemically synthesized
ttttaatctttttttttttgtt

SEQ ID NO: 908734 - DNA, 22 bp, Artificial Sequence
  chemically synthesized
tttaatctttttttttttgttt

SEQ ID NO: 908735 - DNA, 22 bp, Artificial Sequence
  chemically synthesized
ttaatctttttttttttgtttg

SEQ ID NO: 908736 - DNA, 22 bp, Artificial Sequence
  chemically synthesized
taatctttttttttttgtttgt

SEQ ID NO: 908737 - DNA, 22 bp, Artificial Sequence
  chemically synthesized
aatctttttttttttgtttgtt

SEQ ID NO: 908738 - DNA, 22 bp, Artificial Sequence
  chemically synthesized
atctttttttttttgtttgttt

SEQ ID NO: 908739 - DNA, 22 bp, Artificial Sequence
  chemically synthesized
tttttttttgtttgtttgagac

SEQ ID NO: 908740 - DNA, 22 bp, Artificial Sequence
  chemically synthesized
ttttttttgtttgtttgagaca

SEQ ID NO: 908741 - DNA, 22 bp, Artificial Sequence
  chemically synthesized
tttttttgtttgtttgagacag

SEQ ID NO: 908742 - DNA, 22 bp, Artificial Sequence
  chemically synthesized
ttttttgtttgtttgagacaga

SEQ ID NO: 908743 - DNA, 22 bp, Artificial Sequence
  chemically synthesized
tttttgtttgtttgagacagag

SEQ ID NO: 908744 - DNA, 22 bp, Artificial Sequence
  chemically synthesized
ttttgtttgtttgagacagagt

SEQ ID NO: 908745 - DNA, 22 bp, Artificial Sequence
  chemically synthesized
tttgtttgtttgagacagagtc

SEQ ID NO: 908746 - DNA, 22 bp, Artificial Sequence
  chemically synthesized
ttgtttgtttgagacagagtct

SEQ ID NO: 908747 - DNA, 22 bp, Artificial Sequence
  chemically synthesized
ggcaaccgagtgagactctgtc

SEQ ID NO: 908748 - DNA, 22 bp, Artificial Sequence
  chemically synthesized
tgtttgtttgagacagagtctc

SEQ ID NO: 908749 - DNA, 22 bp, Artificial Sequence
  chemically synthesized
gtttgtttgagacagagtctca

SEQ ID NO: 908750 - DNA, 22 bp, Artificial Sequence
  chemically synthesized
tttgtttgagacagagtctcac

SEQ ID NO: 908751 - DNA, 22 bp, Artificial Sequence
  chemically synthesized
gtttgagacagagtctcactcg

SEQ ID NO: 908752 - DNA, 22 bp, Artificial Sequence
  chemically synthesized
tttgagacagagtctcactcgg

SEQ ID NO: 908753 - DNA, 22 bp, Artificial Sequence
  chemically synthesized
cagcctgggcaaccgagtgaga

SEQ ID NO: 908754 - DNA, 22 bp, Artificial Sequence
  chemically synthesized
gagacagagtctcactcggttg

SEQ ID NO: 908755 - DNA, 22 bp, Artificial Sequence
  chemically synthesized
agacagagtctcactcggttgc

SEQ ID NO: 908756 - DNA, 22 bp, Artificial Sequence
  chemically synthesized
cattccagcctgggcaaccgag

SEQ ID NO: 908757 - DNA, 22 bp, Artificial Sequence
  chemically synthesized
actcggttgcccaggctggaat

SEQ ID NO: 908758 - DNA, 22 bp, Artificial Sequence
  chemically synthesized
ggttgcccaggctggaatgcag

SEQ ID NO: 908759 - DNA, 22 bp, Artificial Sequence
  chemically synthesized
cccaggctggaatgcagtggcg

SEQ ID NO: 908760 - DNA, 22 bp, Artificial Sequence
  chemically synthesized
cagtgaaaggagatcacgccac

SEQ ID NO: 908761 - DNA, 22 bp, Artificial Sequence
  chemically synthesized
gaatgcagtggcgtgatctcct

SEQ ID NO: 908762 - DNA, 22 bp, Artificial Sequence
  chemically synthesized
aacccaggaggcggaggttgca

SEQ ID NO: 908763 - DNA, 22 bp, Artificial Sequence
  chemically synthesized
gaacccaggaggcggaggttgc

SEQ ID NO: 908764 - DNA, 22 bp, Artificial Sequence
  chemically synthesized
ctttcactgcaacctccgcctc

SEQ ID NO: 908765 - DNA, 22 bp, Artificial Sequence
  chemically synthesized
tcactgcaacctccgcctcctg

SEQ ID NO: 908766 - DNA, 22 bp, Artificial Sequence
  chemically synthesized
cactgcaacctccgcctcctgg

SEQ ID NO: 908767 - DNA, 22 bp, Artificial Sequence
  chemically synthesized
actgcaacctccgcctcctggg

SEQ ID NO: 908768 - DNA, 22 bp, Artificial Sequence
  chemically synthesized
caacctccgcctcctgggttca

SEQ ID NO: 908769 - DNA, 22 bp, Artificial Sequence
  chemically synthesized
aggcaggagaatcatttgaacc

SEQ ID NO: 908770 - DNA, 22 bp, Artificial Sequence
  chemically synthesized
cgcctcctgggttcaaatgatt

SEQ ID NO: 908771 - DNA, 22 bp, Artificial Sequence
  chemically synthesized
ggaggctgaggcaggagaatca

SEQ ID NO: 908772 - DNA, 22 bp, Artificial Sequence
  chemically synthesized
ctgggttcaaatgattctcctg

SEQ ID NO: 908773 - DNA, 22 bp, Artificial Sequence
  chemically synthesized
gggaggctgaggcaggagaatc

SEQ ID NO: 908774 - DNA, 22 bp, Artificial Sequence
  chemically synthesized
ggttcaaatgattctcctgcct

SEQ ID NO: 908775 - DNA, 22 bp, Artificial Sequence
  chemically synthesized
cttgggaggctgaggcaggaga

SEQ ID NO: 908776 - DNA, 22 bp, Artificial Sequence
  chemically synthesized
aaatgattctcctgcctcagcc

SEQ ID NO: 908777 - DNA, 22 bp, Artificial Sequence
  chemically synthesized
aatcacagctacttgggaggct

SEQ ID NO: 908778 - DNA, 22 bp, Artificial Sequence
  chemically synthesized
gaatcacagctacttgggaggc

SEQ ID NO: 908779 - DNA, 22 bp, Artificial Sequence
  chemically synthesized
tcctgcctcagcctcccaagta

SEQ ID NO: 908780 - DNA, 22 bp, Artificial Sequence
  chemically synthesized
ctgcctcagcctcccaagtagc

SEQ ID NO: 908781 - DNA, 22 bp, Artificial Sequence
  chemically synthesized
cctcagcctcccaagtagctgt

SEQ ID NO: 908782 - DNA, 22 bp, Artificial Sequence
  chemically synthesized
agcctcccaagtagctgtgatt

SEQ ID NO: 908783 - DNA, 22 bp, Artificial Sequence
  chemically synthesized
ccaagtagctgtgattcaagtc

SEQ ID NO: 908784 - DNA, 22 bp, Artificial Sequence
  chemically synthesized
ggcgtggtggcacatgacttga

SEQ ID NO: 908785 - DNA, 22 bp, Artificial Sequence
  chemically synthesized
gctgggcgtggtggcacatgac

SEQ ID NO: 908786 - DNA, 22 bp, Artificial Sequence
  chemically synthesized
tgattcaagtcatgtgccacca

SEQ ID NO: 908787 - DNA, 22 bp, Artificial Sequence
  chemically synthesized
aagtcatgtgccaccacgccca

SEQ ID NO: 908788 - DNA, 22 bp, Artificial Sequence
  chemically synthesized
aaaatacaaaaattagctgggc

SEQ ID NO: 908789 - DNA, 22 bp, Artificial Sequence
  chemically synthesized
ctaaaaatacaaaaattagctg

SEQ ID NO: 908790 - DNA, 22 bp, Artificial Sequence
  chemically synthesized
tactaaaaatacaaaaattagc

SEQ ID NO: 908791 - DNA, 22 bp, Artificial Sequence
  chemically synthesized
tctctactaaaaatacaaaaat

SEQ ID NO: 908792 - DNA, 22 bp, Artificial Sequence
  chemically synthesized
tcaaaccctgtctctactaaaa

SEQ ID NO: 908793 - DNA, 22 bp, Artificial Sequence
  chemically synthesized
atttttgtatttttagtagaga

SEQ ID NO: 908794 - DNA, 22 bp, Artificial Sequence
  chemically synthesized
ttgtatttttagtagagacagg

SEQ ID NO: 908795 - DNA, 22 bp, Artificial Sequence
  chemically synthesized
tgtatttttagtagagacaggg

SEQ ID NO: 908796 - DNA, 22 bp, Artificial Sequence
  chemically synthesized
gtatttttagtagagacagggt

SEQ ID NO: 908797 - DNA, 22 bp, Artificial Sequence
  chemically synthesized
tatttttagtagagacagggtt

SEQ ID NO: 908798 - DNA, 22 bp, Artificial Sequence
  chemically synthesized
gccaacattgtcaaaccctgtc

SEQ ID NO: 908799 - DNA, 22 bp, Artificial Sequence
  chemically synthesized
ttagtagagacagggtttgaca

SEQ ID NO: 908800 - DNA, 22 bp, Artificial Sequence
  chemically synthesized
tagtagagacagggtttgacaa

SEQ ID NO: 908801 - DNA, 22 bp, Artificial Sequence
  chemically synthesized
agtagagacagggtttgacaat

SEQ ID NO: 908802 - DNA, 22 bp, Artificial Sequence
  chemically synthesized
gtagagacagggtttgacaatg

SEQ ID NO: 908803 - DNA, 22 bp, Artificial Sequence
  chemically synthesized
aagaccagcctggccaacattg

SEQ ID NO: 908804 - DNA, 22 bp, Artificial Sequence
  chemically synthesized
gacaatgttggccaggctggtc

SEQ ID NO: 908805 - DNA, 22 bp, Artificial Sequence
  chemically synthesized
acaatgttggccaggctggtct

SEQ ID NO: 908806 - DNA, 22 bp, Artificial Sequence
  chemically synthesized
aggtcagagttcaagaccagcc

SEQ ID NO: 908807 - DNA, 22 bp, Artificial Sequence
  chemically synthesized
gaggtcagagttcaagaccagc

SEQ ID NO: 908808 - DNA, 22 bp, Artificial Sequence
  chemically synthesized
gccaggctggtcttgaactctg

SEQ ID NO: 908809 - DNA, 22 bp, Artificial Sequence
  chemically synthesized
gtcttgaactctgacctcaagt

SEQ ID NO: 908810 - DNA, 22 bp, Artificial Sequence
  chemically synthesized
gaactctgacctcaagtggcct

SEQ ID NO: 908811 - DNA, 22 bp, Artificial Sequence
  chemically synthesized
aactctgacctcaagtggcctg

SEQ ID NO: 908812 - DNA, 22 bp, Artificial Sequence
  chemically synthesized
ggaggccaaggagggcaggcca

SEQ ID NO: 908813 - DNA, 22 bp, Artificial Sequence
  chemically synthesized
gggaggccaaggagggcaggcc

SEQ ID NO: 908814 - DNA, 22 bp, Artificial Sequence
  chemically synthesized
tgacctcaagtggcctgccctc

SEQ ID NO: 908815 - DNA, 22 bp, Artificial Sequence
  chemically synthesized
tgggaggccaaggagggcaggc

SEQ ID NO: 908816 - DNA, 22 bp, Artificial Sequence
  chemically synthesized
acctcaagtggcctgccctcct

SEQ ID NO: 908817 - DNA, 22 bp, Artificial Sequence
  chemically synthesized
aagtggcctgccctccttggcc

SEQ ID NO: 908818 - DNA, 22 bp, Artificial Sequence
  chemically synthesized
taatcccagcactttgggaggc

SEQ ID NO: 908819 - DNA, 22 bp, Artificial Sequence
  chemically synthesized
ccctccttggcctcccaaagtg

SEQ ID NO: 908820 - DNA, 22 bp, Artificial Sequence
  chemically synthesized
acgcctgtaatcccagcacttt

SEQ ID NO: 908821 - DNA, 22 bp, Artificial Sequence
  chemically synthesized
cttggcctcccaaagtgctggg

SEQ ID NO: 908822 - DNA, 22 bp, Artificial Sequence
  chemically synthesized
ggcctcccaaagtgctgggatt

SEQ ID NO: 908823 - DNA, 22 bp, Artificial Sequence
  chemically synthesized
gcctcccaaagtgctgggatta

SEQ ID NO: 908824 - DNA, 22 bp, Artificial Sequence
  chemically synthesized
ccaaagtgctgggattacaggc

SEQ ID NO: 908825 - DNA, 22 bp, Artificial Sequence
  chemically synthesized
ggcacggtggctcacgcctgta

SEQ ID NO: 908826 - DNA, 22 bp, Artificial Sequence
  chemically synthesized
aggctgggcacggtggctcacg

SEQ ID NO: 908827 - DNA, 22 bp, Artificial Sequence
  chemically synthesized
ggattacaggcgtgagccaccg

SEQ ID NO: 908828 - DNA, 22 bp, Artificial Sequence
  chemically synthesized
caggcgtgagccaccgtgccca

SEQ ID NO: 908829 - DNA, 22 bp, Artificial Sequence
  chemically synthesized
agaaagatgttgaggctgggca

SEQ ID NO: 908830 - DNA, 22 bp, Artificial Sequence
  chemically synthesized
aaataattaagaaagatgttga

SEQ ID NO: 908831 - DNA, 22 bp, Artificial Sequence
  chemically synthesized
ctaaaataattaagaaagatgt

SEQ ID NO: 908832 - DNA, 22 bp, Artificial Sequence
  chemically synthesized
attactaaaataattaagaaag

SEQ ID NO: 908833 - DNA, 22 bp, Artificial Sequence
  chemically synthesized
aattactaaaataattaagaaa

SEQ ID NO: 908834 - DNA, 22 bp, Artificial Sequence
  chemically synthesized
taattactaaaataattaagaa

SEQ ID NO: 908835 - DNA, 22 bp, Artificial Sequence
  chemically synthesized
ttttaattactaaaataattaa

SEQ ID NO: 908836 - DNA, 22 bp, Artificial Sequence
  chemically synthesized
aacatctttcttaattatttta

SEQ ID NO: 908837 - DNA, 22 bp, Artificial Sequence
  chemically synthesized
tcttaattattttagtaattaa

SEQ ID NO: 908838 - DNA, 22 bp, Artificial Sequence
  chemically synthesized
cttaattattttagtaattaaa

SEQ ID NO: 908839 - DNA, 22 bp, Artificial Sequence
  chemically synthesized
ttaattattttagtaattaaaa

SEQ ID NO: 908840 - DNA, 22 bp, Artificial Sequence
  chemically synthesized
aattattttagtaattaaaata

SEQ ID NO: 908841 - DNA, 22 bp, Artificial Sequence
  chemically synthesized
attattttagtaattaaaatag

SEQ ID NO: 908842 - DNA, 22 bp, Artificial Sequence
  chemically synthesized
ggagcagacaaaaactatttta

SEQ ID NO: 908843 - DNA, 22 bp, Artificial Sequence
  chemically synthesized
gggagcagacaaaaactatttt

SEQ ID NO: 908844 - DNA, 22 bp, Artificial Sequence
  chemically synthesized
ttttagtaattaaaatagtttt

SEQ ID NO: 908845 - DNA, 22 bp, Artificial Sequence
  chemically synthesized
tagtaattaaaatagtttttgt

SEQ ID NO: 908846 - DNA, 22 bp, Artificial Sequence
  chemically synthesized
agtaattaaaatagtttttgtc

SEQ ID NO: 908847 - DNA, 22 bp, Artificial Sequence
  chemically synthesized
gtaattaaaatagtttttgtct

SEQ ID NO: 908848 - DNA, 22 bp, Artificial Sequence
  chemically synthesized
atatagtttgggagcagacaaa

SEQ ID NO: 908849 - DNA, 22 bp, Artificial Sequence
  chemically synthesized
catatagtttgggagcagacaa

SEQ ID NO: 908850 - DNA, 22 bp, Artificial Sequence
  chemically synthesized
aaatagtttttgtctgctccca

SEQ ID NO: 908851 - DNA, 22 bp, Artificial Sequence
  chemically synthesized
ttgtctgctcccaaactatatg

SEQ ID NO: 908852 - DNA, 22 bp, Artificial Sequence
  chemically synthesized
tgggtaagatttcatatagttt

SEQ ID NO: 908853 - DNA, 22 bp, Artificial Sequence
  chemically synthesized
tgtctgctcccaaactatatga

SEQ ID NO: 908854 - DNA, 22 bp, Artificial Sequence
  chemically synthesized
gtctgctcccaaactatatgaa

SEQ ID NO: 908855 - DNA, 22 bp, Artificial Sequence
  chemically synthesized
tatgggtaagatttcatatagt

SEQ ID NO: 908856 - DNA, 22 bp, Artificial Sequence
  chemically synthesized
tctgctcccaaactatatgaaa

SEQ ID NO: 908857 - DNA, 22 bp, Artificial Sequence
  chemically synthesized
ctcccaaactatatgaaatctt

SEQ ID NO: 908858 - DNA, 22 bp, Artificial Sequence
  chemically synthesized
ccaaactatatgaaatcttacc

SEQ ID NO: 908859 - DNA, 22 bp, Artificial Sequence
  chemically synthesized
atagaaaagacactctatgggt

SEQ ID NO: 908860 - DNA, 22 bp, Artificial Sequence
  chemically synthesized
tatgaaatcttacccatagagt

SEQ ID NO: 908861 - DNA, 22 bp, Artificial Sequence
  chemically synthesized
acccatagagtgtcttttctat

SEQ ID NO: 908862 - DNA, 22 bp, Artificial Sequence
  chemically synthesized
cccatagagtgtcttttctatt

SEQ ID NO: 908863 - DNA, 22 bp, Artificial Sequence
  chemically synthesized
ttctattaattttcctgttttg

SEQ ID NO: 908864 - DNA, 22 bp, Artificial Sequence
  chemically synthesized
tctattaattttcctgttttgt

SEQ ID NO: 908865 - DNA, 22 bp, Artificial Sequence
  chemically synthesized
ctattaattttcctgttttgtg

SEQ ID NO: 908866 - DNA, 22 bp, Artificial Sequence
  chemically synthesized
tattaattttcctgttttgtgt

SEQ ID NO: 908867 - DNA, 22 bp, Artificial Sequence
  chemically synthesized
ttaattttcctgttttgtgtgt

SEQ ID NO: 908868 - DNA, 22 bp, Artificial Sequence
  chemically synthesized
attttcctgttttgtgtgttgg

SEQ ID NO: 908869 - DNA, 22 bp, Artificial Sequence
  chemically synthesized
agaacaaataaaggccaacaca

SEQ ID NO: 908870 - DNA, 22 bp, Artificial Sequence
  chemically synthesized
tcctgttttgtgtgttggcctt

SEQ ID NO: 908871 - DNA, 22 bp, Artificial Sequence
  chemically synthesized
cctgttttgtgtgttggccttt

SEQ ID NO: 908872 - DNA, 22 bp, Artificial Sequence
  chemically synthesized
ctgttttgtgtgttggccttta

SEQ ID NO: 908873 - DNA, 22 bp, Artificial Sequence
  chemically synthesized
attgagaacaaataaaggccaa

SEQ ID NO: 908874 - DNA, 22 bp, Artificial Sequence
  chemically synthesized
ttttgtgtgttggcctttattt

SEQ ID NO: 908875 - DNA, 22 bp, Artificial Sequence
  chemically synthesized
ttcattgagaacaaataaaggc

SEQ ID NO: 908876 - DNA, 22 bp, Artificial Sequence
  chemically synthesized
attcattgagaacaaataaagg

SEQ ID NO: 908877 - DNA, 22 bp, Artificial Sequence
  chemically synthesized
tgtgtgttggcctttatttgtt

SEQ ID NO: 908878 - DNA, 22 bp, Artificial Sequence
  chemically synthesized
gtgtgttggcctttatttgttc

SEQ ID NO: 908879 - DNA, 22 bp, Artificial Sequence
  chemically synthesized
tgtgttggcctttatttgttct

SEQ ID NO: 908880 - DNA, 22 bp, Artificial Sequence
  chemically synthesized
gcctttatttgttctcaatgaa

SEQ ID NO: 908881 - DNA, 22 bp, Artificial Sequence
  chemically synthesized
tataggcccttattcattgaga

SEQ ID NO: 908882 - DNA, 22 bp, Artificial Sequence
  chemically synthesized
tatttgttctcaatgaataagg

SEQ ID NO: 908883 - DNA, 22 bp, Artificial Sequence
  chemically synthesized
atttgttctcaatgaataaggg

SEQ ID NO: 908884 - DNA, 22 bp, Artificial Sequence
  chemically synthesized
tttgttctcaatgaataagggc

SEQ ID NO: 908885 - DNA, 22 bp, Artificial Sequence
  chemically synthesized
aggtgctatataggcccttatt

SEQ ID NO: 908886 - DNA, 22 bp, Artificial Sequence
  chemically synthesized
gttctcaatgaataagggccta

SEQ ID NO: 908887 - DNA, 22 bp, Artificial Sequence
  chemically synthesized
ttctcaatgaataagggcctat

SEQ ID NO: 908888 - DNA, 22 bp, Artificial Sequence
  chemically synthesized
tcaatgaataagggcctatata

SEQ ID NO: 908889 - DNA, 22 bp, Artificial Sequence
  chemically synthesized
atattcaggtgctatataggcc

SEQ ID NO: 908890 - DNA, 22 bp, Artificial Sequence
  chemically synthesized
aatgaataagggcctatatagc

SEQ ID NO: 908891 - DNA, 22 bp, Artificial Sequence
  chemically synthesized
tatagcacctgaatattaattt

SEQ ID NO: 908892 - DNA, 22 bp, Artificial Sequence
  chemically synthesized
aggaagagaaaaaaattaatat

SEQ ID NO: 908893 - DNA, 22 bp, Artificial Sequence
  chemically synthesized
gttaaggaagagaaaaaaatta

SEQ ID NO: 908894 - DNA, 22 bp, Artificial Sequence
  chemically synthesized
ctggttaaggaagagaaaaaaa

SEQ ID NO: 908895 - DNA, 22 bp, Artificial Sequence
  chemically synthesized
aatattaatttttttctcttcc

SEQ ID NO: 908896 - DNA, 22 bp, Artificial Sequence
  chemically synthesized
agctgctggttaaggaagagaa

SEQ ID NO: 908897 - DNA, 22 bp, Artificial Sequence
  chemically synthesized
atttttttctcttccttaacca

SEQ ID NO: 908898 - DNA, 22 bp, Artificial Sequence
  chemically synthesized
gaatcactgagctgctggttaa

SEQ ID NO: 908899 - DNA, 22 bp, Artificial Sequence
  chemically synthesized
ttttctcttccttaaccagcag

SEQ ID NO: 908900 - DNA, 22 bp, Artificial Sequence
  chemically synthesized
tttctcttccttaaccagcagc

SEQ ID NO: 908901 - DNA, 22 bp, Artificial Sequence
  chemically synthesized
ttctcttccttaaccagcagct

SEQ ID NO: 908902 - DNA, 22 bp, Artificial Sequence
  chemically synthesized
tctcttccttaaccagcagctc

SEQ ID NO: 908903 - DNA, 22 bp, Artificial Sequence
  chemically synthesized
ctcttccttaaccagcagctca

SEQ ID NO: 908904 - DNA, 22 bp, Artificial Sequence
  chemically synthesized
tcttccttaaccagcagctcag

SEQ ID NO: 908905 - DNA, 22 bp, Artificial Sequence
  chemically synthesized
ttccttaaccagcagctcagtg

SEQ ID NO: 908906 - DNA, 22 bp, Artificial Sequence
  chemically synthesized
ccttaaccagcagctcagtgat

SEQ ID NO: 908907 - DNA, 22 bp, Artificial Sequence
  chemically synthesized
cttaaccagcagctcagtgatt

SEQ ID NO: 908908 - DNA, 22 bp, Artificial Sequence
  chemically synthesized
tcagtgatgttagaatcactga

SEQ ID NO: 908909 - DNA, 22 bp, Artificial Sequence
  chemically synthesized
atcagtgatgttagaatcactg

SEQ ID NO: 908910 - DNA, 22 bp, Artificial Sequence
  chemically synthesized
aaccagcagctcagtgattcta

SEQ ID NO: 908911 - DNA, 22 bp, Artificial Sequence
  chemically synthesized
tatcagtgatgttagaatcact

SEQ ID NO: 908912 - DNA, 22 bp, Artificial Sequence
  chemically synthesized
accagcagctcagtgattctaa

SEQ ID NO: 908913 - DNA, 22 bp, Artificial Sequence
  chemically synthesized
agtgattctaacatcactgata

SEQ ID NO: 908914 - DNA, 22 bp, Artificial Sequence
  chemically synthesized
atcagtgatgtgtattttatca

SEQ ID NO: 908915 - DNA, 22 bp, Artificial Sequence
  chemically synthesized
catcagtgatgtgtattttatc

SEQ ID NO: 908916 - DNA, 22 bp, Artificial Sequence
  chemically synthesized
tcatcagtgatgtgtattttat

SEQ ID NO: 908917 - DNA, 22 bp, Artificial Sequence
  chemically synthesized
taacatcactgataaaatacac

SEQ ID NO: 908918 - DNA, 22 bp, Artificial Sequence
  chemically synthesized
acatcactgataaaatacacat

SEQ ID NO: 908919 - DNA, 22 bp, Artificial Sequence
  chemically synthesized
ttttcatcagtgatgtgtattt

SEQ ID NO: 908920 - DNA, 22 bp, Artificial Sequence
  chemically synthesized
attttcatcagtgatgtgtatt

SEQ ID NO: 908921 - DNA, 22 bp, Artificial Sequence
  chemically synthesized
tattttcatcagtgatgtgtat

SEQ ID NO: 908922 - DNA, 22 bp, Artificial Sequence
  chemically synthesized
ttttattttcatcagtgatgtg

SEQ ID NO: 908923 - DNA, 22 bp, Artificial Sequence
  chemically synthesized
ttgttttattttcatcagtgat

SEQ ID NO: 908924 - DNA, 22 bp, Artificial Sequence
  chemically synthesized
ataaaatacacatcactgatga

SEQ ID NO: 908925 - DNA, 22 bp, Artificial Sequence
  chemically synthesized
attgttttattttcatcagtga

SEQ ID NO: 908926 - DNA, 22 bp, Artificial Sequence
  chemically synthesized
tattgttttattttcatcagtg

SEQ ID NO: 908927 - DNA, 22 bp, Artificial Sequence
  chemically synthesized
ctttattgttttattttcatca

SEQ ID NO: 908928 - DNA, 22 bp, Artificial Sequence
  chemically synthesized
gaggttgctttattgttttatt

SEQ ID NO: 908929 - DNA, 22 bp, Artificial Sequence
  chemically synthesized
ctagaggttgctttattgtttt

SEQ ID NO: 908930 - DNA, 22 bp, Artificial Sequence
  chemically synthesized
atgaaaataaaacaataaagca

SEQ ID NO: 908931 - DNA, 22 bp, Artificial Sequence
  chemically synthesized
tctcctagaggttgctttattg

SEQ ID NO: 908932 - DNA, 22 bp, Artificial Sequence
  chemically synthesized
cagttatctcctagaggttgct

SEQ ID NO: 908933 - DNA, 22 bp, Artificial Sequence
  chemically synthesized
gaccattgcagttatctcctag

SEQ ID NO: 908934 - DNA, 22 bp, Artificial Sequence
  chemically synthesized
agaccattgcagttatctccta

SEQ ID NO: 908935 - DNA, 22 bp, Artificial Sequence
  chemically synthesized
tagaccattgcagttatctcct

SEQ ID NO: 908936 - DNA, 22 bp, Artificial Sequence
  chemically synthesized
tgacaaattttagaccattgca

SEQ ID NO: 908937 - DNA, 22 bp, Artificial Sequence
  chemically synthesized
taggagataactgcaatggtct

SEQ ID NO: 908938 - DNA, 22 bp, Artificial Sequence
  chemically synthesized
gtgacaaattttagaccattgc

SEQ ID NO: 908939 - DNA, 22 bp, Artificial Sequence
  chemically synthesized
tgtgacaaattttagaccattg

SEQ ID NO: 908940 - DNA, 22 bp, Artificial Sequence
  chemically synthesized
ggagataactgcaatggtctaa

SEQ ID NO: 908941 - DNA, 22 bp, Artificial Sequence
  chemically synthesized
ttgtgacaaattttagaccatt

SEQ ID NO: 908942 - DNA, 22 bp, Artificial Sequence
  chemically synthesized
tgacttttgtgacaaattttag

SEQ ID NO: 908943 - DNA, 22 bp, Artificial Sequence
  chemically synthesized
caatggtctaaaatttgtcaca

SEQ ID NO: 908944 - DNA, 22 bp, Artificial Sequence
  chemically synthesized
gtgctatgacttttgtgacaaa

SEQ ID NO: 908945 - DNA, 22 bp, Artificial Sequence
  chemically synthesized
ttggtgctatgacttttgtgac

SEQ ID NO: 908946 - DNA, 22 bp, Artificial Sequence
  chemically synthesized
tgttggtgctatgacttttgtg

SEQ ID NO: 908947 - DNA, 22 bp, Artificial Sequence
  chemically synthesized
ctgttggtgctatgacttttgt

SEQ ID NO: 908948 - DNA, 22 bp, Artificial Sequence
  chemically synthesized
aaatttgtcacaaaagtcatag

SEQ ID NO: 908949 - DNA, 22 bp, Artificial Sequence
  chemically synthesized
cttctgttggtgctatgacttt

SEQ ID NO: 908950 - DNA, 22 bp, Artificial Sequence
  chemically synthesized
gtcacaaaagtcatagcaccaa

SEQ ID NO: 908951 - DNA, 22 bp, Artificial Sequence
  chemically synthesized
tcacaaaagtcatagcaccaac

SEQ ID NO: 908952 - DNA, 22 bp, Artificial Sequence
  chemically synthesized
tcatgaagattgcttctgttgg

SEQ ID NO: 908953 - DNA, 22 bp, Artificial Sequence
  chemically synthesized
caatgtaaatgactatcatgaa

SEQ ID NO: 908954 - DNA, 22 bp, Artificial Sequence
  chemically synthesized
aattgcaatgtaaatgactatc

SEQ ID NO: 908955 - DNA, 22 bp, Artificial Sequence
  chemically synthesized
aactcaattgcaatgtaaatga

SEQ ID NO: 908956 - DNA, 22 bp, Artificial Sequence
  chemically synthesized
tgaactcaattgcaatgtaaat

SEQ ID NO: 908957 - DNA, 22 bp, Artificial Sequence
  chemically synthesized
catgatagtcatttacattgca

SEQ ID NO: 908958 - DNA, 22 bp, Artificial Sequence
  chemically synthesized
atgatagtcatttacattgcaa

SEQ ID NO: 908959 - DNA, 22 bp, Artificial Sequence
  chemically synthesized
acattgcaattgagttcagaat

SEQ ID NO: 908960 - DNA, 22 bp, Artificial Sequence
  chemically synthesized
cattgcaattgagttcagaatg

SEQ ID NO: 908961 - DNA, 22 bp, Artificial Sequence
  chemically synthesized
taaaagaatgaacattctgaac

SEQ ID NO: 908962 - DNA, 22 bp, Artificial Sequence
  chemically synthesized
ataaaagaatgaacattctgaa

SEQ ID NO: 908963 - DNA, 22 bp, Artificial Sequence
  chemically synthesized
tataaaagaatgaacattctga

SEQ ID NO: 908964 - DNA, 22 bp, Artificial Sequence
  chemically synthesized
ttataaaagaatgaacattctg

SEQ ID NO: 908965 - DNA, 22 bp, Artificial Sequence
  chemically synthesized
caattgagttcagaatgttcat

SEQ ID NO: 908966 - DNA, 22 bp, Artificial Sequence
  chemically synthesized
aaacttttataaaagaatgaac

SEQ ID NO: 908967 - DNA, 22 bp, Artificial Sequence
  chemically synthesized
agttcagaatgttcattctttt

SEQ ID NO: 908968 - DNA, 22 bp, Artificial Sequence
  chemically synthesized
ttgaaacttttataaaagaatg

SEQ ID NO: 908969 - DNA, 22 bp, Artificial Sequence
  chemically synthesized
attgaaacttttataaaagaat

SEQ ID NO: 908970 - DNA, 22 bp, Artificial Sequence
  chemically synthesized
agaatgttcattcttttataaa

SEQ ID NO: 908971 - DNA, 22 bp, Artificial Sequence
  chemically synthesized
gacttattgaaacttttataaa

SEQ ID NO: 908972 - DNA, 22 bp, Artificial Sequence
  chemically synthesized
ggacttattgaaacttttataa

SEQ ID NO: 908973 - DNA, 22 bp, Artificial Sequence
  chemically synthesized
ttggacttattgaaacttttat

SEQ ID NO: 908974 - DNA, 22 bp, Artificial Sequence
  chemically synthesized
cttggacttattgaaactttta

SEQ ID NO: 908975 - DNA, 22 bp, Artificial Sequence
  chemically synthesized
attcttttataaaagtttcaat

SEQ ID NO: 908976 - DNA, 22 bp, Artificial Sequence
  chemically synthesized
ttttataaaagtttcaataagt

SEQ ID NO: 908977 - DNA, 22 bp, Artificial Sequence
  chemically synthesized
ttataaaagtttcaataagtcc

SEQ ID NO: 908978 - DNA, 22 bp, Artificial Sequence
  chemically synthesized
tataaaagtttcaataagtcca

SEQ ID NO: 908979 - DNA, 22 bp, Artificial Sequence
  chemically synthesized
ataaaagtttcaataagtccaa

SEQ ID NO: 908980 - DNA, 22 bp, Artificial Sequence
  chemically synthesized
taaaagtttcaataagtccaag

SEQ ID NO: 908981 - DNA, 22 bp, Artificial Sequence
  chemically synthesized
aataggacagtacttcttggac

SEQ ID NO: 908982 - DNA, 22 bp, Artificial Sequence
  chemically synthesized
gaataggacagtacttcttgga

SEQ ID NO: 908983 - DNA, 22 bp, Artificial Sequence
  chemically synthesized
tgaataggacagtacttcttgg

SEQ ID NO: 908984 - DNA, 22 bp, Artificial Sequence
  chemically synthesized
caataagtccaagaagtactgt

SEQ ID NO: 908985 - DNA, 22 bp, Artificial Sequence
  chemically synthesized
aataagtccaagaagtactgtc

SEQ ID NO: 908986 - DNA, 22 bp, Artificial Sequence
  chemically synthesized
tgatgtgggtgacatcaacagt

SEQ ID NO: 908987 - DNA, 22 bp, Artificial Sequence
  chemically synthesized
tcctattcaaaactgttgatgt

SEQ ID NO: 908988 - DNA, 22 bp, Artificial Sequence
  chemically synthesized
actgtgatgtgggtgacatcaa

SEQ ID NO: 908989 - DNA, 22 bp, Artificial Sequence
  chemically synthesized
ttcaaaactgttgatgtcaccc

SEQ ID NO: 908990 - DNA, 22 bp, Artificial Sequence
  chemically synthesized
tgactgtgatgtgggtgacatc

SEQ ID NO: 908991 - DNA, 22 bp, Artificial Sequence
  chemically synthesized
aaaactgttgatgtcacccaca

SEQ ID NO: 908992 - DNA, 22 bp, Artificial Sequence
  chemically synthesized
ttgatgtcacccacatcacagt

SEQ ID NO: 908993 - DNA, 22 bp, Artificial Sequence
  chemically synthesized
atgtcacccacatcacagtcag

SEQ ID NO: 908994 - DNA, 22 bp, Artificial Sequence
  chemically synthesized
tgaaagtgacacattctgactg

SEQ ID NO: 908995 - DNA, 22 bp, Artificial Sequence
  chemically synthesized
gtgaaagtgacacattctgact

SEQ ID NO: 908996 - DNA, 22 bp, Artificial Sequence
  chemically synthesized
tgtgaaagtgacacattctgac

SEQ ID NO: 908997 - DNA, 22 bp, Artificial Sequence
  chemically synthesized
ttgtgaaagtgacacattctga

SEQ ID NO: 908998 - DNA, 22 bp, Artificial Sequence
  chemically synthesized
tttgtgaaagtgacacattctg

SEQ ID NO: 908999 - DNA, 22 bp, Artificial Sequence
  chemically synthesized
ttttgtgaaagtgacacattct

SEQ ID NO: 909000 - DNA, 22 bp, Artificial Sequence
  chemically synthesized
aaaatatttttttgtgaaagtg

SEQ ID NO: 909001 - DNA, 22 bp, Artificial Sequence
  chemically synthesized
aaatgcagtctaaaaatatttt

SEQ ID NO: 909002 - DNA, 22 bp, Artificial Sequence
  chemically synthesized
tcacaaaaaaatatttttagac

SEQ ID NO: 909003 - DNA, 22 bp, Artificial Sequence
  chemically synthesized
cacaaaaaaatatttttagact

SEQ ID NO: 909004 - DNA, 22 bp, Artificial Sequence
  chemically synthesized
tacctcaaatgcagtctaaaaa

SEQ ID NO: 909005 - DNA, 22 bp, Artificial Sequence
  chemically synthesized
acaaaaaaatatttttagactg

SEQ ID NO: 909006 - DNA, 22 bp, Artificial Sequence
  chemically synthesized
atacctcaaatgcagtctaaaa

SEQ ID NO: 909007 - DNA, 22 bp, Artificial Sequence
  chemically synthesized
atgcttatacctcaaatgcagt

SEQ ID NO: 909008 - DNA, 22 bp, Artificial Sequence
  chemically synthesized
atgactgatgcttatacctcaa

SEQ ID NO: 909009 - DNA, 22 bp, Artificial Sequence
  chemically synthesized
ttagactgcatttgaggtataa

SEQ ID NO: 909010 - DNA, 22 bp, Artificial Sequence
  chemically synthesized
tagactgcatttgaggtataag

SEQ ID NO: 909011 - DNA, 22 bp, Artificial Sequence
  chemically synthesized
agactgcatttgaggtataagc

SEQ ID NO: 909012 - DNA, 22 bp, Artificial Sequence
  chemically synthesized
gactgcatttgaggtataagca

SEQ ID NO: 909013 - DNA, 22 bp, Artificial Sequence
  chemically synthesized
tgactgatgactgatgcttata

SEQ ID NO: 909014 - DNA, 22 bp, Artificial Sequence
  chemically synthesized
catttgaggtataagcatcagt

SEQ ID NO: 909015 - DNA, 22 bp, Artificial Sequence
  chemically synthesized
gaggtataagcatcagtcatca

SEQ ID NO: 909016 - DNA, 22 bp, Artificial Sequence
  chemically synthesized
aggtataagcatcagtcatcag

SEQ ID NO: 909017 - DNA, 22 bp, Artificial Sequence
  chemically synthesized
caggcaacctgtgactgatgac

SEQ ID NO: 909018 - DNA, 22 bp, Artificial Sequence
  chemically synthesized
tgcaggcaacctgtgactgatg

SEQ ID NO: 909019 - DNA, 22 bp, Artificial Sequence
  chemically synthesized
cattctgcaggcaacctgtgac

SEQ ID NO: 909020 - DNA, 22 bp, Artificial Sequence
  chemically synthesized
atggttacattctgcaggcaac

SEQ ID NO: 909021 - DNA, 22 bp, Artificial Sequence
  chemically synthesized
tgatggttacattctgcaggca

SEQ ID NO: 909022 - DNA, 22 bp, Artificial Sequence
  chemically synthesized
ttctgatggttacattctgcag

SEQ ID NO: 909023 - DNA, 22 bp, Artificial Sequence
  chemically synthesized
gttctgatggttacattctgca

SEQ ID NO: 909024 - DNA, 22 bp, Artificial Sequence
  chemically synthesized
tttgttctgatggttacattct

SEQ ID NO: 909025 - DNA, 22 bp, Artificial Sequence
  chemically synthesized
tatttgttctgatggttacatt

SEQ ID NO: 909026 - DNA, 22 bp, Artificial Sequence
  chemically synthesized
cctgcagaatgtaaccatcaga

SEQ ID NO: 909027 - DNA, 22 bp, Artificial Sequence
  chemically synthesized
cagaatgtaaccatcagaacaa

SEQ ID NO: 909028 - DNA, 22 bp, Artificial Sequence
  chemically synthesized
aagaaaactctatttgttctga

SEQ ID NO: 909029 - DNA, 22 bp, Artificial Sequence
  chemically synthesized
caagaaaactctatttgttctg

SEQ ID NO: 909030 - DNA, 22 bp, Artificial Sequence
  chemically synthesized
tcttgaaatacccttttgatga

SEQ ID NO: 909031 - DNA, 22 bp, Artificial Sequence
  chemically synthesized
cttgaaatacccttttgatgac

SEQ ID NO: 909032 - DNA, 22 bp, Artificial Sequence
  chemically synthesized
ttgaaatacccttttgatgact

SEQ ID NO: 909033 - DNA, 22 bp, Artificial Sequence
  chemically synthesized
gaaatacccttttgatgacttt

SEQ ID NO: 909034 - DNA, 22 bp, Artificial Sequence
  chemically synthesized
aaatacccttttgatgactttg

SEQ ID NO: 909035 - DNA, 22 bp, Artificial Sequence
  chemically synthesized
ttgatgactttggtttccggcc

SEQ ID NO: 909036 - DNA, 22 bp, Artificial Sequence
  chemically synthesized
tgatgactttggtttccggccc

SEQ ID NO: 909037 - DNA, 22 bp, Artificial Sequence
  chemically synthesized
gatgactttggtttccggccca

SEQ ID NO: 909038 - DNA, 22 bp, Artificial Sequence
  chemically synthesized
atgactttggtttccggcccat

SEQ ID NO: 909039 - DNA, 22 bp, Artificial Sequence
  chemically synthesized
tggtttccggcccatttgctgg

SEQ ID NO: 909040 - DNA, 22 bp, Artificial Sequence
  chemically synthesized
ggtttccggcccatttgctggt

SEQ ID NO: 909041 - DNA, 22 bp, Artificial Sequence
  chemically synthesized
gtttccggcccatttgctggtc

SEQ ID NO: 909042 - DNA, 22 bp, Artificial Sequence
  chemically synthesized
ccggcccatttgctggtccatc

SEQ ID NO: 909043 - DNA, 22 bp, Artificial Sequence
  chemically synthesized
cggcccatttgctggtccatct

SEQ ID NO: 909044 - DNA, 22 bp, Artificial Sequence
  chemically synthesized
gccaagtgtggtgggaaaagag

SEQ ID NO: 909045 - DNA, 22 bp, Artificial Sequence
  chemically synthesized
gctggtccatctcttttcccac

SEQ ID NO: 909046 - DNA, 22 bp, Artificial Sequence
  chemically synthesized
ctggtccatctcttttcccacc

SEQ ID NO: 909047 - DNA, 22 bp, Artificial Sequence
  chemically synthesized
gtccatctcttttcccaccaca

SEQ ID NO: 909048 - DNA, 22 bp, Artificial Sequence
  chemically synthesized
gcatggttggccaagtgtggtg

SEQ ID NO: 909049 - DNA, 22 bp, Artificial Sequence
  chemically synthesized
ggcatggttggccaagtgtggt

SEQ ID NO: 909050 - DNA, 22 bp, Artificial Sequence
  chemically synthesized
tggcatggttggccaagtgtgg

SEQ ID NO: 909051 - DNA, 22 bp, Artificial Sequence
  chemically synthesized
ttttcccaccacacttggccaa

SEQ ID NO: 909052 - DNA, 22 bp, Artificial Sequence
  chemically synthesized
ttcccaccacacttggccaacc

SEQ ID NO: 909053 - DNA, 22 bp, Artificial Sequence
  chemically synthesized
tcccaccacacttggccaacca

SEQ ID NO: 909054 - DNA, 22 bp, Artificial Sequence
  chemically synthesized
cccaccacacttggccaaccat

SEQ ID NO: 909055 - DNA, 22 bp, Artificial Sequence
  chemically synthesized
ccaccacacttggccaaccatg

SEQ ID NO: 909056 - DNA, 22 bp, Artificial Sequence
  chemically synthesized
ggccaaccatgccaaagatgga

SEQ ID NO: 909057 - DNA, 22 bp, Artificial Sequence
  chemically synthesized
gccaaccatgccaaagatggac

SEQ ID NO: 909058 - DNA, 22 bp, Artificial Sequence
  chemically synthesized
tcaccgggacaagtatagtcca

SEQ ID NO: 909059 - DNA, 22 bp, Artificial Sequence
  chemically synthesized
agttatcaccgggacaagtata

SEQ ID NO: 909060 - DNA, 22 bp, Artificial Sequence
  chemically synthesized
cagttatcaccgggacaagtat

SEQ ID NO: 909061 - DNA, 22 bp, Artificial Sequence
  chemically synthesized
tcagttatcaccgggacaagta

SEQ ID NO: 909062 - DNA, 22 bp, Artificial Sequence
  chemically synthesized
tgaacattttcagttatcaccg

SEQ ID NO: 909063 - DNA, 22 bp, Artificial Sequence
  chemically synthesized
gtgaacattttcagttatcacc

SEQ ID NO: 909064 - DNA, 22 bp, Artificial Sequence
  chemically synthesized
tacttgtcccggtgataactga

SEQ ID NO: 909065 - DNA, 22 bp, Artificial Sequence
  chemically synthesized
taatttgtgaacattttcagtt

SEQ ID NO: 909066 - DNA, 22 bp, Artificial Sequence
  chemically synthesized
gtcccggtgataactgaaaatg

SEQ ID NO: 909067 - DNA, 22 bp, Artificial Sequence
  chemically synthesized
ataatttgtgaacattttcagt

SEQ ID NO: 909068 - DNA, 22 bp, Artificial Sequence
  chemically synthesized
tcccggtgataactgaaaatgt

SEQ ID NO: 909069 - DNA, 22 bp, Artificial Sequence
  chemically synthesized
cacttataatttgtgaacattt

SEQ ID NO: 909070 - DNA, 22 bp, Artificial Sequence
  chemically synthesized
aatgttgcacttataatttgtg

SEQ ID NO: 909071 - DNA, 22 bp, Artificial Sequence
  chemically synthesized
aaaatgttcacaaattataagt

SEQ ID NO: 909072 - DNA, 22 bp, Artificial Sequence
  chemically synthesized
agctgaatgttgcacttataat

SEQ ID NO: 909073 - DNA, 22 bp, Artificial Sequence
  chemically synthesized
gagctgaatgttgcacttataa

SEQ ID NO: 909074 - DNA, 22 bp, Artificial Sequence
  chemically synthesized
acaaattataagtgcaacattc

SEQ ID NO: 909075 - DNA, 22 bp, Artificial Sequence
  chemically synthesized
taagtgcaacattcagctcaaa

SEQ ID NO: 909076 - DNA, 22 bp, Artificial Sequence
  chemically synthesized
tggaaatgaaagcatttgagct

SEQ ID NO: 909077 - DNA, 22 bp, Artificial Sequence
  chemically synthesized
ttgtggaaatgaaagcatttga

SEQ ID NO: 909078 - DNA, 22 bp, Artificial Sequence
  chemically synthesized
gttgtggaaatgaaagcatttg

SEQ ID NO: 909079 - DNA, 22 bp, Artificial Sequence
  chemically synthesized
tgttgtggaaatgaaagcattt

SEQ ID NO: 909080 - DNA, 22 bp, Artificial Sequence
  chemically synthesized
agctcaaatgctttcatttcca

SEQ ID NO: 909081 - DNA, 22 bp, Artificial Sequence
  chemically synthesized
aaatgctttcatttccacaaca

SEQ ID NO: 909082 - DNA, 22 bp, Artificial Sequence
  chemically synthesized
gagaaaatccatcaattttgtt

SEQ ID NO: 909083 - DNA, 22 bp, Artificial Sequence
  chemically synthesized
tcatttccacaacaaaattgat

SEQ ID NO: 909084 - DNA, 22 bp, Artificial Sequence
  chemically synthesized
catttccacaacaaaattgatg

SEQ ID NO: 909085 - DNA, 22 bp, Artificial Sequence
  chemically synthesized
ctagagaaaatccatcaatttt

SEQ ID NO: 909086 - DNA, 22 bp, Artificial Sequence
  chemically synthesized
atttccacaacaaaattgatgg

SEQ ID NO: 909087 - DNA, 22 bp, Artificial Sequence
  chemically synthesized
ttgctagagaaaatccatcaat

SEQ ID NO: 909088 - DNA, 22 bp, Artificial Sequence
  chemically synthesized
gttgctagagaaaatccatcaa

SEQ ID NO: 909089 - DNA, 22 bp, Artificial Sequence
  chemically synthesized
ccacaacaaaattgatggattt

SEQ ID NO: 909090 - DNA, 22 bp, Artificial Sequence
  chemically synthesized
cacaacaaaattgatggatttt

SEQ ID NO: 909091 - DNA, 22 bp, Artificial Sequence
  chemically synthesized
tttgttgctagagaaaatccat

SEQ ID NO: 909092 - DNA, 22 bp, Artificial Sequence
  chemically synthesized
attgtttgttgctagagaaaat

SEQ ID NO: 909093 - DNA, 22 bp, Artificial Sequence
  chemically synthesized
cattgtttgttgctagagaaaa

SEQ ID NO: 909094 - DNA, 22 bp, Artificial Sequence
  chemically synthesized
atggattttctctagcaacaaa

SEQ ID NO: 909095 - DNA, 22 bp, Artificial Sequence
  chemically synthesized
acgagagcatttcattgtttgt

SEQ ID NO: 909096 - DNA, 22 bp, Artificial Sequence
  chemically synthesized
tctctagcaacaaacaatgaaa

SEQ ID NO: 909097 - DNA, 22 bp, Artificial Sequence
  chemically synthesized
ctctagcaacaaacaatgaaat

SEQ ID NO: 909098 - DNA, 22 bp, Artificial Sequence
  chemically synthesized
tctagcaacaaacaatgaaatg

SEQ ID NO: 909099 - DNA, 22 bp, Artificial Sequence
  chemically synthesized
tagcaacaaacaatgaaatgct

SEQ ID NO: 909100 - DNA, 22 bp, Artificial Sequence
  chemically synthesized
gcaacaaacaatgaaatgctct

SEQ ID NO: 909101 - DNA, 22 bp, Artificial Sequence
  chemically synthesized
caagacattgacgagagcattt

SEQ ID NO: 909102 - DNA, 22 bp, Artificial Sequence
  chemically synthesized
gaaccaattacaagacattgac

SEQ ID NO: 909103 - DNA, 22 bp, Artificial Sequence
  chemically synthesized
atattagaaccaattacaagac

SEQ ID NO: 909104 - DNA, 22 bp, Artificial Sequence
  chemically synthesized
ctgatattagaaccaattacaa

SEQ ID NO: 909105 - DNA, 22 bp, Artificial Sequence
  chemically synthesized
tcgtcaatgtcttgtaattggt

SEQ ID NO: 909106 - DNA, 22 bp, Artificial Sequence
  chemically synthesized
gctgatattagaaccaattaca

SEQ ID NO: 909107 - DNA, 22 bp, Artificial Sequence
  chemically synthesized
gtcaatgtcttgtaattggttc

SEQ ID NO: 909108 - DNA, 22 bp, Artificial Sequence
  chemically synthesized
gcttgctgatattagaaccaat

SEQ ID NO: 909109 - DNA, 22 bp, Artificial Sequence
  chemically synthesized
attggcttgctgatattagaac

SEQ ID NO: 909110 - DNA, 22 bp, Artificial Sequence
  chemically synthesized
gattggcttgctgatattagaa

SEQ ID NO: 909111 - DNA, 22 bp, Artificial Sequence
  chemically synthesized
tgattggcttgctgatattaga

SEQ ID NO: 909112 - DNA, 22 bp, Artificial Sequence
  chemically synthesized
ttgattggcttgctgatattag

SEQ ID NO: 909113 - DNA, 22 bp, Artificial Sequence
  chemically synthesized
gtaattggttctaatatcagca

SEQ ID NO: 909114 - DNA, 22 bp, Artificial Sequence
  chemically synthesized
taattggttctaatatcagcaa

SEQ ID NO: 909115 - DNA, 22 bp, Artificial Sequence
  chemically synthesized
ccttttgattggcttgctgata

SEQ ID NO: 909116 - DNA, 22 bp, Artificial Sequence
  chemically synthesized
tcccttttgattggcttgctga

SEQ ID NO: 909117 - DNA, 22 bp, Artificial Sequence
  chemically synthesized
ctcccttttgattggcttgctg

SEQ ID NO: 909118 - DNA, 22 bp, Artificial Sequence
  chemically synthesized
tctcccttttgattggcttgct

SEQ ID NO: 909119 - DNA, 22 bp, Artificial Sequence
  chemically synthesized
gttctaatatcagcaagccaat

SEQ ID NO: 909120 - DNA, 22 bp, Artificial Sequence
  chemically synthesized
ttctcccttttgattggcttgc

SEQ ID NO: 909121 - DNA, 22 bp, Artificial Sequence
  chemically synthesized
taatatcagcaagccaatcaaa

SEQ ID NO: 909122 - DNA, 22 bp, Artificial Sequence
  chemically synthesized
gtttttctcccttttgattggc

SEQ ID NO: 909123 - DNA, 22 bp, Artificial Sequence
  chemically synthesized
ggtttttctcccttttgattgg

SEQ ID NO: 909124 - DNA, 22 bp, Artificial Sequence
  chemically synthesized
atatcagcaagccaatcaaaag

SEQ ID NO: 909125 - DNA, 22 bp, Artificial Sequence
  chemically synthesized
atggagaaatttggtttttctc

SEQ ID NO: 909126 - DNA, 22 bp, Artificial Sequence
  chemically synthesized
ataagggcctgatggagaaatt

SEQ ID NO: 909127 - DNA, 22 bp, Artificial Sequence
  chemically synthesized
ctccatcaggcccttatcagcc

SEQ ID NO: 909128 - DNA, 22 bp, Artificial Sequence
  chemically synthesized
tccatcaggcccttatcagccc

SEQ ID NO: 909129 - DNA, 22 bp, Artificial Sequence
  chemically synthesized
catcaggcccttatcagccctt

SEQ ID NO: 909130 - DNA, 22 bp, Artificial Sequence
  chemically synthesized
tatgggtaacaaaagggctgat

SEQ ID NO: 909131 - DNA, 22 bp, Artificial Sequence
  chemically synthesized
atcagcccttttgttacccata

SEQ ID NO: 909132 - DNA, 22 bp, Artificial Sequence
  chemically synthesized
tcagcccttttgttacccatac

SEQ ID NO: 909133 - DNA, 22 bp, Artificial Sequence
  chemically synthesized
ggggcaagaccactgtatgggt

SEQ ID NO: 909134 - DNA, 22 bp, Artificial Sequence
  chemically synthesized
tggttcggggcaagaccactgt

SEQ ID NO: 909135 - DNA, 22 bp, Artificial Sequence
  chemically synthesized
ttgttacccatacagtggtctt

SEQ ID NO: 909136 - DNA, 22 bp, Artificial Sequence
  chemically synthesized
atggttcggggcaagaccactg

SEQ ID NO: 909137 - DNA, 22 bp, Artificial Sequence
  chemically synthesized
tgttacccatacagtggtcttg

SEQ ID NO: 909138 - DNA, 22 bp, Artificial Sequence
  chemically synthesized
gttacccatacagtggtcttgc

SEQ ID NO: 909139 - DNA, 22 bp, Artificial Sequence
  chemically synthesized
ttacccatacagtggtcttgcc

SEQ ID NO: 909140 - DNA, 22 bp, Artificial Sequence
  chemically synthesized
cccatacagtggtcttgccccg

SEQ ID NO: 909141 - DNA, 22 bp, Artificial Sequence
  chemically synthesized
tccaccttatggttcggggcaa

SEQ ID NO: 909142 - DNA, 22 bp, Artificial Sequence
  chemically synthesized
atccaccttatggttcggggca

SEQ ID NO: 909143 - DNA, 22 bp, Artificial Sequence
  chemically synthesized
atttatccaccttatggttcgg

SEQ ID NO: 909144 - DNA, 22 bp, Artificial Sequence
  chemically synthesized
ccctcatttatccaccttatgg

SEQ ID NO: 909145 - DNA, 22 bp, Artificial Sequence
  chemically synthesized
gccccgaaccataaggtggata

SEQ ID NO: 909146 - DNA, 22 bp, Artificial Sequence
  chemically synthesized
ccccgaaccataaggtggataa

SEQ ID NO: 909147 - DNA, 22 bp, Artificial Sequence
  chemically synthesized
gatgccaaaatcagcattcccc

SEQ ID NO: 909148 - DNA, 22 bp, Artificial Sequence
  chemically synthesized
aaagtaagctggatgccaaaat

SEQ ID NO: 909149 - DNA, 22 bp, Artificial Sequence
  chemically synthesized
tctgaaagtaagctggatgcca

SEQ ID NO: 909150 - DNA, 22 bp, Artificial Sequence
  chemically synthesized
gattatctgaaagtaagctgga

SEQ ID NO: 909151 - DNA, 22 bp, Artificial Sequence
  chemically synthesized
attttggcatccagcttacttt

SEQ ID NO: 909152 - DNA, 22 bp, Artificial Sequence
  chemically synthesized
tggcatccagcttactttcaga

SEQ ID NO: 909153 - DNA, 22 bp, Artificial Sequence
  chemically synthesized
ggcatccagcttactttcagat

SEQ ID NO: 909154 - DNA, 22 bp, Artificial Sequence
  chemically synthesized
gcatccagcttactttcagata

SEQ ID NO: 909155 - DNA, 22 bp, Artificial Sequence
  chemically synthesized
agaaggatgagctagattatct

SEQ ID NO: 909156 - DNA, 22 bp, Artificial Sequence
  chemically synthesized
actttcagataatctagctcat

SEQ ID NO: 909157 - DNA, 22 bp, Artificial Sequence
  chemically synthesized
ctttcagataatctagctcatc

SEQ ID NO: 909158 - DNA, 22 bp, Artificial Sequence
  chemically synthesized
tcagataatctagctcatcctt

SEQ ID NO: 909159 - DNA, 22 bp, Artificial Sequence
  chemically synthesized
gtgtcagctgagaaggatgagc

SEQ ID NO: 909160 - DNA, 22 bp, Artificial Sequence
  chemically synthesized
cagataatctagctcatccttc

SEQ ID NO: 909161 - DNA, 22 bp, Artificial Sequence
  chemically synthesized
agataatctagctcatccttct

SEQ ID NO: 909162 - DNA, 22 bp, Artificial Sequence
  chemically synthesized
tctcgtgtcagctgagaaggat

SEQ ID NO: 909163 - DNA, 22 bp, Artificial Sequence
  chemically synthesized
tgtctcgtgtcagctgagaagg

SEQ ID NO: 909164 - DNA, 22 bp, Artificial Sequence
  chemically synthesized
ctgtctcgtgtcagctgagaag

SEQ ID NO: 909165 - DNA, 22 bp, Artificial Sequence
  chemically synthesized
tttctgtctcgtgtcagctgag

SEQ ID NO: 909166 - DNA, 22 bp, Artificial Sequence
  chemically synthesized
gctcatccttctcagctgacac

SEQ ID NO: 909167 - DNA, 22 bp, Artificial Sequence
  chemically synthesized
atccttctcagctgacacgaga

SEQ ID NO: 909168 - DNA, 22 bp, Artificial Sequence
  chemically synthesized
atgttatttctgtctcgtgtca

SEQ ID NO: 909169 - DNA, 22 bp, Artificial Sequence
  chemically synthesized
gatgttatttctgtctcgtgtc

SEQ ID NO: 909170 - DNA, 22 bp, Artificial Sequence
  chemically synthesized
tgatgttatttctgtctcgtgt

SEQ ID NO: 909171 - DNA, 22 bp, Artificial Sequence
  chemically synthesized
ctcagctgacacgagacagaaa

SEQ ID NO: 909172 - DNA, 22 bp, Artificial Sequence
  chemically synthesized
tcagctgacacgagacagaaat

SEQ ID NO: 909173 - DNA, 22 bp, Artificial Sequence
  chemically synthesized
agctgacacgagacagaaataa

SEQ ID NO: 909174 - DNA, 22 bp, Artificial Sequence
  chemically synthesized
tcaccctttgatgttatttctg

SEQ ID NO: 909175 - DNA, 22 bp, Artificial Sequence
  chemically synthesized
atcaccctttgatgttatttct

SEQ ID NO: 909176 - DNA, 22 bp, Artificial Sequence
  chemically synthesized
acacgagacagaaataacatca

SEQ ID NO: 909177 - DNA, 22 bp, Artificial Sequence
  chemically synthesized
caagaaagagtttatcaccctt

SEQ ID NO: 909178 - DNA, 22 bp, Artificial Sequence
  chemically synthesized
gcaagaaagagtttatcaccct

SEQ ID NO: 909179 - DNA, 22 bp, Artificial Sequence
  chemically synthesized
tttcttgcaaacctggggttcc

SEQ ID NO: 909180 - DNA, 22 bp, Artificial Sequence
  chemically synthesized
tcttgcaaacctggggttccat

SEQ ID NO: 909181 - DNA, 22 bp, Artificial Sequence
  chemically synthesized
cttgcaaacctggggttccatg

SEQ ID NO: 909182 - DNA, 22 bp, Artificial Sequence
  chemically synthesized
gggccagtgaaccatggaaccc

SEQ ID NO: 909183 - DNA, 22 bp, Artificial Sequence
  chemically synthesized
ttgcaaacctggggttccatgg

SEQ ID NO: 909184 - DNA, 22 bp, Artificial Sequence
  chemically synthesized
gcaaacctggggttccatggtt

SEQ ID NO: 909185 - DNA, 22 bp, Artificial Sequence
  chemically synthesized
caaacctggggttccatggttc

SEQ ID NO: 909186 - DNA, 22 bp, Artificial Sequence
  chemically synthesized
ggcctggggccagtgaaccatg

SEQ ID NO: 909187 - DNA, 22 bp, Artificial Sequence
  chemically synthesized
gattaggcctggggccagtgaa

SEQ ID NO: 909188 - DNA, 22 bp, Artificial Sequence
  chemically synthesized
gggttccatggttcactggccc

SEQ ID NO: 909189 - DNA, 22 bp, Artificial Sequence
  chemically synthesized
ttggattaggcctggggccagt

SEQ ID NO: 909190 - DNA, 22 bp, Artificial Sequence
  chemically synthesized
catggttcactggccccaggcc

SEQ ID NO: 909191 - DNA, 22 bp, Artificial Sequence
  chemically synthesized
actggccccaggcctaatccaa

SEQ ID NO: 909192 - DNA, 22 bp, Artificial Sequence
  chemically synthesized
gccccaggcctaatccaacaat

SEQ ID NO: 909193 - DNA, 22 bp, Artificial Sequence
  chemically synthesized
tgtagaaaatggattgttggat

SEQ ID NO: 909194 - DNA, 22 bp, Artificial Sequence
  chemically synthesized
ttgtgtagaaaatggattgttg

SEQ ID NO: 909195 - DNA, 22 bp, Artificial Sequence
  chemically synthesized
attgtgtagaaaatggattgtt

SEQ ID NO: 909196 - DNA, 22 bp, Artificial Sequence
  chemically synthesized
tattgtgtagaaaatggattgt

SEQ ID NO: 909197 - DNA, 22 bp, Artificial Sequence
  chemically synthesized
ttattgtgtagaaaatggattg

SEQ ID NO: 909198 - DNA, 22 bp, Artificial Sequence
  chemically synthesized
ccttttattgtgtagaaaatgg

SEQ ID NO: 909199 - DNA, 22 bp, Artificial Sequence
  chemically synthesized
accttttattgtgtagaaaatg

SEQ ID NO: 909200 - DNA, 22 bp, Artificial Sequence
  chemically synthesized
atccaacaatccattttctaca

SEQ ID NO: 909201 - DNA, 22 bp, Artificial Sequence
  chemically synthesized
ttaccttttattgtgtagaaaa

SEQ ID NO: 909202 - DNA, 22 bp, Artificial Sequence
  chemically synthesized
cttaccttttattgtgtagaaa

SEQ ID NO: 909203 - DNA, 22 bp, Artificial Sequence
  chemically synthesized
taatgggtttcttaccttttat

SEQ ID NO: 909204 - DNA, 22 bp, Artificial Sequence
  chemically synthesized
tctacacaataaaaggtaagaa

SEQ ID NO: 909205 - DNA, 22 bp, Artificial Sequence
  chemically synthesized
ctacacaataaaaggtaagaaa

SEQ ID NO: 909206 - DNA, 22 bp, Artificial Sequence
  chemically synthesized
tacacaataaaaggtaagaaac

SEQ ID NO: 909207 - DNA, 22 bp, Artificial Sequence
  chemically synthesized
cacaataaaaggtaagaaaccc

SEQ ID NO: 909208 - DNA, 22 bp, Artificial Sequence
  chemically synthesized
taacagatctgtaatgggtttc

SEQ ID NO: 909209 - DNA, 22 bp, Artificial Sequence
  chemically synthesized
ataacagatctgtaatgggttt

SEQ ID NO: 909210 - DNA, 22 bp, Artificial Sequence
  chemically synthesized
ccaaggcttataacagatctgt

SEQ ID NO: 909211 - DNA, 22 bp, Artificial Sequence
  chemically synthesized
cagatctgttataagccttggc

SEQ ID NO: 909212 - DNA, 22 bp, Artificial Sequence
  chemically synthesized
ccgtataccacctgccaaggct

SEQ ID NO: 909213 - DNA, 22 bp, Artificial Sequence
  chemically synthesized
gccgtataccacctgccaaggc

SEQ ID NO: 909214 - DNA, 22 bp, Artificial Sequence
  chemically synthesized
tgccgtataccacctgccaagg

SEQ ID NO: 909215 - DNA, 22 bp, Artificial Sequence
  chemically synthesized
ttgccgtataccacctgccaag

SEQ ID NO: 909216 - DNA, 22 bp, Artificial Sequence
  chemically synthesized
ttataagccttggcaggtggta

SEQ ID NO: 909217 - DNA, 22 bp, Artificial Sequence
  chemically synthesized
catttttgccgtataccacctg

SEQ ID NO: 909218 - DNA, 22 bp, Artificial Sequence
  chemically synthesized
taagccttggcaggtggtatac

SEQ ID NO: 909219 - DNA, 22 bp, Artificial Sequence
  chemically synthesized
tgtattccatttttgccgtata

SEQ ID NO: 909220 - DNA, 22 bp, Artificial Sequence
  chemically synthesized
ggcaggtggtatacggcaaaaa

SEQ ID NO: 909221 - DNA, 22 bp, Artificial Sequence
  chemically synthesized
gcaggtggtatacggcaaaaat

SEQ ID NO: 909222 - DNA, 22 bp, Artificial Sequence
  chemically synthesized
gttgtgtattccatttttgccg

SEQ ID NO: 909223 - DNA, 22 bp, Artificial Sequence
  chemically synthesized
ggttggttgtgtattccatttt

SEQ ID NO: 909224 - DNA, 22 bp, Artificial Sequence
  chemically synthesized
aaaccatagaaaagggatacca

SEQ ID NO: 909225 - DNA, 22 bp, Artificial Sequence
  chemically synthesized
caaaccatagaaaagggatacc

SEQ ID NO: 909226 - DNA, 22 bp, Artificial Sequence
  chemically synthesized
gtgcttcaaaccatagaaaagg

SEQ ID NO: 909227 - DNA, 22 bp, Artificial Sequence
  chemically synthesized
ggtatcccttttctatggtttg

SEQ ID NO: 909228 - DNA, 22 bp, Artificial Sequence
  chemically synthesized
gtatcccttttctatggtttga

SEQ ID NO: 909229 - DNA, 22 bp, Artificial Sequence
  chemically synthesized
acccctagtgcttcaaaccata

SEQ ID NO: 909230 - DNA, 22 bp, Artificial Sequence
  chemically synthesized
ttctatggtttgaagcactagg

SEQ ID NO: 909231 - DNA, 22 bp, Artificial Sequence
  chemically synthesized
tctatggtttgaagcactaggg

SEQ ID NO: 909232 - DNA, 22 bp, Artificial Sequence
  chemically synthesized
atgtcagctgacccctagtgct

SEQ ID NO: 909233 - DNA, 22 bp, Artificial Sequence
  chemically synthesized
ctatggtttgaagcactagggg

SEQ ID NO: 909234 - DNA, 22 bp, Artificial Sequence
  chemically synthesized
tatggtttgaagcactaggggt

SEQ ID NO: 909235 - DNA, 22 bp, Artificial Sequence
  chemically synthesized
tggtttgaagcactaggggtca

SEQ ID NO: 909236 - DNA, 22 bp, Artificial Sequence
  chemically synthesized
tattcatgtcagctgaccccta

SEQ ID NO: 909237 - DNA, 22 bp, Artificial Sequence
  chemically synthesized
ctatattcatgtcagctgaccc

SEQ ID NO: 909238 - DNA, 22 bp, Artificial Sequence
  chemically synthesized
gaagcactaggggtcagctgac

SEQ ID NO: 909239 - DNA, 22 bp, Artificial Sequence
  chemically synthesized
aagcactaggggtcagctgaca

SEQ ID NO: 909240 - DNA, 22 bp, Artificial Sequence
  chemically synthesized
actactatattcatgtcagctg

SEQ ID NO: 909241 - DNA, 22 bp, Artificial Sequence
  chemically synthesized
ggggtcagctgacatgaatata

SEQ ID NO: 909242 - DNA, 22 bp, Artificial Sequence
  chemically synthesized
aatgctgactactatattcatg

SEQ ID NO: 909243 - DNA, 22 bp, Artificial Sequence
  chemically synthesized
atactaaatgctgactactata

SEQ ID NO: 909244 - DNA, 22 bp, Artificial Sequence
  chemically synthesized
aatactaaatgctgactactat

SEQ ID NO: 909245 - DNA, 22 bp, Artificial Sequence
  chemically synthesized
acatgaatatagtagtcagcat

SEQ ID NO: 909246 - DNA, 22 bp, Artificial Sequence
  chemically synthesized
aaataacttaatactaaatgct

SEQ ID NO: 909247 - DNA, 22 bp, Artificial Sequence
  chemically synthesized
tgtagctaaaataacttaatac

SEQ ID NO: 909248 - DNA, 22 bp, Artificial Sequence
  chemically synthesized
atgtagctaaaataacttaata

SEQ ID NO: 909249 - DNA, 22 bp, Artificial Sequence
  chemically synthesized
tttatgtagctaaaataactta

SEQ ID NO: 909250 - DNA, 22 bp, Artificial Sequence
  chemically synthesized
atttatgtagctaaaataactt

SEQ ID NO: 909251 - DNA, 22 bp, Artificial Sequence
  chemically synthesized
agtattaagttattttagctac

SEQ ID NO: 909252 - DNA, 22 bp, Artificial Sequence
  chemically synthesized
gtattaagttattttagctaca

SEQ ID NO: 909253 - DNA, 22 bp, Artificial Sequence
  chemically synthesized
agttattttagctacataaata

SEQ ID NO: 909254 - DNA, 22 bp, Artificial Sequence
  chemically synthesized
ttttagctacataaataaactc

SEQ ID NO: 909255 - DNA, 22 bp, Artificial Sequence
  chemically synthesized
atacatcaagatgtgagtttat

SEQ ID NO: 909256 - DNA, 22 bp, Artificial Sequence
  chemically synthesized
tagctacataaataaactcaca

SEQ ID NO: 909257 - DNA, 22 bp, Artificial Sequence
  chemically synthesized
agctacataaataaactcacat

SEQ ID NO: 909258 - DNA, 22 bp, Artificial Sequence
  chemically synthesized
gctacataaataaactcacatc

SEQ ID NO: 909259 - DNA, 22 bp, Artificial Sequence
  chemically synthesized
tactcatacatcaagatgtgag

SEQ ID NO: 909260 - DNA, 22 bp, Artificial Sequence
  chemically synthesized
atactcatacatcaagatgtga

SEQ ID NO: 909261 - DNA, 22 bp, Artificial Sequence
  chemically synthesized
cataaataaactcacatcttga

SEQ ID NO: 909262 - DNA, 22 bp, Artificial Sequence
  chemically synthesized
tatactcatacatcaagatgtg

SEQ ID NO: 909263 - DNA, 22 bp, Artificial Sequence
  chemically synthesized
tcaaatctttatactcatacat

SEQ ID NO: 909264 - DNA, 22 bp, Artificial Sequence
  chemically synthesized
tgtcaaatctttatactcatac

SEQ ID NO: 909265 - DNA, 22 bp, Artificial Sequence
  chemically synthesized
ctgtcaaatctttatactcata

SEQ ID NO: 909266 - DNA, 22 bp, Artificial Sequence
  chemically synthesized
acatcttgatgtatgagtataa

SEQ ID NO: 909267 - DNA, 22 bp, Artificial Sequence
  chemically synthesized
tctgtcaaatctttatactcat

SEQ ID NO: 909268 - DNA, 22 bp, Artificial Sequence
  chemically synthesized
ttctgtcaaatctttatactca

SEQ ID NO: 909269 - DNA, 22 bp, Artificial Sequence
  chemically synthesized
gatgtatgagtataaagatttg

SEQ ID NO: 909270 - DNA, 22 bp, Artificial Sequence
  chemically synthesized
atgtatgagtataaagatttga

SEQ ID NO: 909271 - DNA, 22 bp, Artificial Sequence
  chemically synthesized
gacagaaaagttcatttttggt

SEQ ID NO: 909272 - DNA, 22 bp, Artificial Sequence
  chemically synthesized
acagaaaagttcatttttggta

SEQ ID NO: 909273 - DNA, 22 bp, Artificial Sequence
  chemically synthesized
aagatcagaatcataccaaaaa

SEQ ID NO: 909274 - DNA, 22 bp, Artificial Sequence
  chemically synthesized
ttaaagatcagaatcataccaa

SEQ ID NO: 909275 - DNA, 22 bp, Artificial Sequence
  chemically synthesized
attaaagatcagaatcatacca

SEQ ID NO: 909276 - DNA, 22 bp, Artificial Sequence
  chemically synthesized
tattaaagatcagaatcatacc

SEQ ID NO: 909277 - DNA, 22 bp, Artificial Sequence
  chemically synthesized
ttattaaagatcagaatcatac

SEQ ID NO: 909278 - DNA, 22 bp, Artificial Sequence
  chemically synthesized
atttttggtatgattctgatct

SEQ ID NO: 909279 - DNA, 22 bp, Artificial Sequence
  chemically synthesized
ttggtatgattctgatctttaa

SEQ ID NO: 909280 - DNA, 22 bp, Artificial Sequence
  chemically synthesized
tggtatgattctgatctttaat

SEQ ID NO: 909281 - DNA, 22 bp, Artificial Sequence
  chemically synthesized
ggtatgattctgatctttaata

SEQ ID NO: 909282 - DNA, 22 bp, Artificial Sequence
  chemically synthesized
gtatgattctgatctttaataa

SEQ ID NO: 909283 - DNA, 22 bp, Artificial Sequence
  chemically synthesized
tgatctttaataaaaatcaccc

SEQ ID NO: 909284 - DNA, 22 bp, Artificial Sequence
  chemically synthesized
atctttaataaaaatcaccctg

SEQ ID NO: 909285 - DNA, 22 bp, Artificial Sequence
  chemically synthesized
taataaaaatcaccctgttatt

SEQ ID NO: 909286 - DNA, 22 bp, Artificial Sequence
  chemically synthesized
aataaaaatcaccctgttattt

SEQ ID NO: 909287 - DNA, 22 bp, Artificial Sequence
  chemically synthesized
ataaaaatcaccctgttatttt

SEQ ID NO: 909288 - DNA, 22 bp, Artificial Sequence
  chemically synthesized
caaagccaatatgccatacaaa

SEQ ID NO: 909289 - DNA, 22 bp, Artificial Sequence
  chemically synthesized
ttattttacttttgtatggcat

SEQ ID NO: 909290 - DNA, 22 bp, Artificial Sequence
  chemically synthesized
ttttacttttgtatggcatatt

SEQ ID NO: 909291 - DNA, 22 bp, Artificial Sequence
  chemically synthesized
tacttttgtatggcatattggc

SEQ ID NO: 909292 - DNA, 22 bp, Artificial Sequence
  chemically synthesized
acttttgtatggcatattggct

SEQ ID NO: 909293 - DNA, 22 bp, Artificial Sequence
  chemically synthesized
tatcacctgcaaagccaatatg

SEQ ID NO: 909294 - DNA, 22 bp, Artificial Sequence
  chemically synthesized
cttttgtatggcatattggctt

SEQ ID NO: 909295 - DNA, 22 bp, Artificial Sequence
  chemically synthesized
ttatatcacctgcaaagccaat

SEQ ID NO: 909296 - DNA, 22 bp, Artificial Sequence
  chemically synthesized
ttgtatggcatattggctttgc

SEQ ID NO: 909297 - DNA, 22 bp, Artificial Sequence
  chemically synthesized
attatatcacctgcaaagccaa

SEQ ID NO: 909298 - DNA, 22 bp, Artificial Sequence
  chemically synthesized
tgtatggcatattggctttgca

SEQ ID NO: 909299 - DNA, 22 bp, Artificial Sequence
  chemically synthesized
gtatggcatattggctttgcag

SEQ ID NO: 909300 - DNA, 22 bp, Artificial Sequence
  chemically synthesized
tatggcatattggctttgcagg

SEQ ID NO: 909301 - DNA, 22 bp, Artificial Sequence
  chemically synthesized
atttattatatcacctgcaaag

SEQ ID NO: 909302 - DNA, 22 bp, Artificial Sequence
  chemically synthesized
catttattatatcacctgcaaa

SEQ ID NO: 909303 - DNA, 22 bp, Artificial Sequence
  chemically synthesized
acccagtttcatttattatatc

SEQ ID NO: 909304 - DNA, 22 bp, Artificial Sequence
  chemically synthesized
gctttgcaggtgatataataaa

SEQ ID NO: 909305 - DNA, 22 bp, Artificial Sequence
  chemically synthesized
taacccagtttcatttattata

SEQ ID NO: 909306 - DNA, 22 bp, Artificial Sequence
  chemically synthesized
tgcaggtgatataataaatgaa

SEQ ID NO: 909307 - DNA, 22 bp, Artificial Sequence
  chemically synthesized
gcaggtgatataataaatgaaa

SEQ ID NO: 909308 - DNA, 22 bp, Artificial Sequence
  chemically synthesized
caggtgatataataaatgaaac

SEQ ID NO: 909309 - DNA, 22 bp, Artificial Sequence
  chemically synthesized
taaattctaacccagtttcatt

SEQ ID NO: 909310 - DNA, 22 bp, Artificial Sequence
  chemically synthesized
agaccacatattgtaaattcta

SEQ ID NO: 909311 - DNA, 22 bp, Artificial Sequence
  chemically synthesized
aagaccacatattgtaaattct

SEQ ID NO: 909312 - DNA, 22 bp, Artificial Sequence
  chemically synthesized
ggttagaatttacaatatgtgg

SEQ ID NO: 909313 - DNA, 22 bp, Artificial Sequence
  chemically synthesized
aaggccatatttaagaccacat

SEQ ID NO: 909314 - DNA, 22 bp, Artificial Sequence
  chemically synthesized
gaatttacaatatgtggtctta

SEQ ID NO: 909315 - DNA, 22 bp, Artificial Sequence
  chemically synthesized
acaatatgtggtcttaaatatg

SEQ ID NO: 909316 - DNA, 22 bp, Artificial Sequence
  chemically synthesized
caatatgtggtcttaaatatgg

SEQ ID NO: 909317 - DNA, 22 bp, Artificial Sequence
  chemically synthesized
aataaggaacaaagattaaagg

SEQ ID NO: 909318 - DNA, 22 bp, Artificial Sequence
  chemically synthesized
aaatatggcctttaatctttgt

SEQ ID NO: 909319 - DNA, 22 bp, Artificial Sequence
  chemically synthesized
aatatggcctttaatctttgtt

SEQ ID NO: 909320 - DNA, 22 bp, Artificial Sequence
  chemically synthesized
aggttaaataaggaacaaagat

SEQ ID NO: 909321 - DNA, 22 bp, Artificial Sequence
  chemically synthesized
aactgaggttaaataaggaaca

SEQ ID NO: 909322 - DNA, 22 bp, Artificial Sequence
  chemically synthesized
aaactgaggttaaataaggaac

SEQ ID NO: 909323 - DNA, 22 bp, Artificial Sequence
  chemically synthesized
cttaaactgaggttaaataagg

SEQ ID NO: 909324 - DNA, 22 bp, Artificial Sequence
  chemically synthesized
taatctttgttccttatttaac

SEQ ID NO: 909325 - DNA, 22 bp, Artificial Sequence
  chemically synthesized
aatctttgttccttatttaacc

SEQ ID NO: 909326 - DNA, 22 bp, Artificial Sequence
  chemically synthesized
atctttgttccttatttaacct

SEQ ID NO: 909327 - DNA, 22 bp, Artificial Sequence
  chemically synthesized
tgttccttatttaacctcagtt

SEQ ID NO: 909328 - DNA, 22 bp, Artificial Sequence
  chemically synthesized
gttccttatttaacctcagttt

SEQ ID NO: 909329 - DNA, 22 bp, Artificial Sequence
  chemically synthesized
ttccttatttaacctcagttta

SEQ ID NO: 909330 - DNA, 22 bp, Artificial Sequence
  chemically synthesized
atatgccaactccttaaactga

SEQ ID NO: 909331 - DNA, 22 bp, Artificial Sequence
  chemically synthesized
cttatttaacctcagtttaagg

SEQ ID NO: 909332 - DNA, 22 bp, Artificial Sequence
  chemically synthesized
catatgccaactccttaaactg

SEQ ID NO: 909333 - DNA, 22 bp, Artificial Sequence
  chemically synthesized
tcatatgccaactccttaaact

SEQ ID NO: 909334 - DNA, 22 bp, Artificial Sequence
  chemically synthesized
atttaacctcagtttaaggagt

SEQ ID NO: 909335 - DNA, 22 bp, Artificial Sequence
  chemically synthesized
tttaacctcagtttaaggagtt

SEQ ID NO: 909336 - DNA, 22 bp, Artificial Sequence
  chemically synthesized
aacctcagtttaaggagttggc

SEQ ID NO: 909337 - DNA, 22 bp, Artificial Sequence
  chemically synthesized
acctcagtttaaggagttggca

SEQ ID NO: 909338 - DNA, 22 bp, Artificial Sequence
  chemically synthesized
aatggaagttttcatatgccaa

SEQ ID NO: 909339 - DNA, 22 bp, Artificial Sequence
  chemically synthesized
agtttaaggagttggcatatga

SEQ ID NO: 909340 - DNA, 22 bp, Artificial Sequence
  chemically synthesized
aaggagttggcatatgaaaact

SEQ ID NO: 909341 - DNA, 22 bp, Artificial Sequence
  chemically synthesized
aggagttggcatatgaaaactt

SEQ ID NO: 909342 - DNA, 22 bp, Artificial Sequence
  chemically synthesized
gcatatgaaaacttccatttaa

SEQ ID NO: 909343 - DNA, 22 bp, Artificial Sequence
  chemically synthesized
ataatcgtgaaatgatattaaa

SEQ ID NO: 909344 - DNA, 22 bp, Artificial Sequence
  chemically synthesized
aataatcgtgaaatgatattaa

SEQ ID NO: 909345 - DNA, 22 bp, Artificial Sequence
  chemically synthesized
ataatttaataatcgtgaaatg

SEQ ID NO: 909346 - DNA, 22 bp, Artificial Sequence
  chemically synthesized
ccatttaatatcatttcacgat

SEQ ID NO: 909347 - DNA, 22 bp, Artificial Sequence
  chemically synthesized
catttaatatcatttcacgatt

SEQ ID NO: 909348 - DNA, 22 bp, Artificial Sequence
  chemically synthesized
taataatttaataatcgtgaaa

SEQ ID NO: 909349 - DNA, 22 bp, Artificial Sequence
  chemically synthesized
ctaataatttaataatcgtgaa

SEQ ID NO: 909350 - DNA, 22 bp, Artificial Sequence
  chemically synthesized
tctaataatttaataatcgtga

SEQ ID NO: 909351 - DNA, 22 bp, Artificial Sequence
  chemically synthesized
aatatcatttcacgattattaa

SEQ ID NO: 909352 - DNA, 22 bp, Artificial Sequence
  chemically synthesized
ctttctaataatttaataatcg

SEQ ID NO: 909353 - DNA, 22 bp, Artificial Sequence
  chemically synthesized
atatcatttcacgattattaaa

SEQ ID NO: 909354 - DNA, 22 bp, Artificial Sequence
  chemically synthesized
cctttctaataatttaataatc

SEQ ID NO: 909355 - DNA, 22 bp, Artificial Sequence
  chemically synthesized
cttcctttctaataatttaata

SEQ ID NO: 909356 - DNA, 22 bp, Artificial Sequence
  chemically synthesized
ccttcctttctaataatttaat

SEQ ID NO: 909357 - DNA, 22 bp, Artificial Sequence
  chemically synthesized
cacgattattaaattattagaa

SEQ ID NO: 909358 - DNA, 22 bp, Artificial Sequence
  chemically synthesized
acgattattaaattattagaaa

SEQ ID NO: 909359 - DNA, 22 bp, Artificial Sequence
  chemically synthesized
gagggagtttccttcctttcta

SEQ ID NO: 909360 - DNA, 22 bp, Artificial Sequence
  chemically synthesized
ttaaattattagaaaggaagga

SEQ ID NO: 909361 - DNA, 22 bp, Artificial Sequence
  chemically synthesized
aattattagaaaggaaggaaac

SEQ ID NO: 909362 - DNA, 22 bp, Artificial Sequence
  chemically synthesized
agactagagggagtttccttcc

SEQ ID NO: 909363 - DNA, 22 bp, Artificial Sequence
  chemically synthesized
ttagaaaggaaggaaactccct

SEQ ID NO: 909364 - DNA, 22 bp, Artificial Sequence
  chemically synthesized
gaaaggaaggaaactccctcta

SEQ ID NO: 909365 - DNA, 22 bp, Artificial Sequence
  chemically synthesized
catagcaccaaccctgagacta

SEQ ID NO: 909366 - DNA, 22 bp, Artificial Sequence
  chemically synthesized
acatagcaccaaccctgagact

SEQ ID NO: 909367 - DNA, 22 bp, Artificial Sequence
  chemically synthesized
cttacatagcaccaaccctgag

SEQ ID NO: 909368 - DNA, 22 bp, Artificial Sequence
  chemically synthesized
acttacatagcaccaaccctga

SEQ ID NO: 909369 - DNA, 22 bp, Artificial Sequence
  chemically synthesized
tacttacatagcaccaaccctg

SEQ ID NO: 909370 - DNA, 22 bp, Artificial Sequence
  chemically synthesized
ttacttacatagcaccaaccct

SEQ ID NO: 909371 - DNA, 22 bp, Artificial Sequence
  chemically synthesized
cctctagtctcagggttggtgc

SEQ ID NO: 909372 - DNA, 22 bp, Artificial Sequence
  chemically synthesized
tagtctcagggttggtgctatg

SEQ ID NO: 909373 - DNA, 22 bp, Artificial Sequence
  chemically synthesized
gtctcagggttggtgctatgta

SEQ ID NO: 909374 - DNA, 22 bp, Artificial Sequence
  chemically synthesized
caatgcttttacttacatagca

SEQ ID NO: 909375 - DNA, 22 bp, Artificial Sequence
  chemically synthesized
tgcaatgcttttacttacatag

SEQ ID NO: 909376 - DNA, 22 bp, Artificial Sequence
  chemically synthesized
ctgcaatgcttttacttacata

SEQ ID NO: 909377 - DNA, 22 bp, Artificial Sequence
  chemically synthesized
agggttggtgctatgtaagtaa

SEQ ID NO: 909378 - DNA, 22 bp, Artificial Sequence
  chemically synthesized
tttctgcaatgcttttacttac

SEQ ID NO: 909379 - DNA, 22 bp, Artificial Sequence
  chemically synthesized
gtttctgcaatgcttttactta

SEQ ID NO: 909380 - DNA, 22 bp, Artificial Sequence
  chemically synthesized
tgtttctgcaatgcttttactt

SEQ ID NO: 909381 - DNA, 22 bp, Artificial Sequence
  chemically synthesized
ttgtttctgcaatgcttttact

SEQ ID NO: 909382 - DNA, 22 bp, Artificial Sequence
  chemically synthesized
gtgctatgtaagtaaaagcatt

SEQ ID NO: 909383 - DNA, 22 bp, Artificial Sequence
  chemically synthesized
cttttgtttctgcaatgctttt

SEQ ID NO: 909384 - DNA, 22 bp, Artificial Sequence
  chemically synthesized
ccttttgtttctgcaatgcttt

SEQ ID NO: 909385 - DNA, 22 bp, Artificial Sequence
  chemically synthesized
tccttttgtttctgcaatgctt

SEQ ID NO: 909386 - DNA, 22 bp, Artificial Sequence
  chemically synthesized
tttccttttgtttctgcaatgc

SEQ ID NO: 909387 - DNA, 22 bp, Artificial Sequence
  chemically synthesized
tgtaagtaaaagcattgcagaa

SEQ ID NO: 909388 - DNA, 22 bp, Artificial Sequence
  chemically synthesized
ctttccttttgtttctgcaatg

SEQ ID NO: 909389 - DNA, 22 bp, Artificial Sequence
  chemically synthesized
tctttccttttgtttctgcaat

SEQ ID NO: 909390 - DNA, 22 bp, Artificial Sequence
  chemically synthesized
ttctttccttttgtttctgcaa

SEQ ID NO: 909391 - DNA, 22 bp, Artificial Sequence
  chemically synthesized
tttctttccttttgtttctgca

SEQ ID NO: 909392 - DNA, 22 bp, Artificial Sequence
  chemically synthesized
atataaaatgttttttctttcc

SEQ ID NO: 909393 - DNA, 22 bp, Artificial Sequence
  chemically synthesized
cagaaacaaaaggaaagaaaaa

SEQ ID NO: 909394 - DNA, 22 bp, Artificial Sequence
  chemically synthesized
ctaatataaaatgttttttctt

SEQ ID NO: 909395 - DNA, 22 bp, Artificial Sequence
  chemically synthesized
gctaatataaaatgttttttct

SEQ ID NO: 909396 - DNA, 22 bp, Artificial Sequence
  chemically synthesized
tgctaatataaaatgttttttc

SEQ ID NO: 909397 - DNA, 22 bp, Artificial Sequence
  chemically synthesized
tatattagcaaaatcccctttt

SEQ ID NO: 909398 - DNA, 22 bp, Artificial Sequence
  chemically synthesized
atattagcaaaatcccctttta

SEQ ID NO: 909399 - DNA, 22 bp, Artificial Sequence
  chemically synthesized
tattagcaaaatccccttttat

SEQ ID NO: 909400 - DNA, 22 bp, Artificial Sequence
  chemically synthesized
gcaaaatccccttttattatgt

SEQ ID NO: 909401 - DNA, 22 bp, Artificial Sequence
  chemically synthesized
gaaaggagaagaaatgacataa

SEQ ID NO: 909402 - DNA, 22 bp, Artificial Sequence
  chemically synthesized
tagaaaggagaagaaatgacat

SEQ ID NO: 909403 - DNA, 22 bp, Artificial Sequence
  chemically synthesized
ctagaaaggagaagaaatgaca

SEQ ID NO: 909404 - DNA, 22 bp, Artificial Sequence
  chemically synthesized
ttattatgtcatttcttctcct

SEQ ID NO: 909405 - DNA, 22 bp, Artificial Sequence
  chemically synthesized
tattatgtcatttcttctcctt

SEQ ID NO: 909406 - DNA, 22 bp, Artificial Sequence
  chemically synthesized
attatgtcatttcttctccttt

SEQ ID NO: 909407 - DNA, 22 bp, Artificial Sequence
  chemically synthesized
ttatgtcatttcttctcctttc

SEQ ID NO: 909408 - DNA, 22 bp, Artificial Sequence
  chemically synthesized
tgtcatttcttctcctttctag

SEQ ID NO: 909409 - DNA, 22 bp, Artificial Sequence
  chemically synthesized
aagcaatgacttctagaaagga

SEQ ID NO: 909410 - DNA, 22 bp, Artificial Sequence
  chemically synthesized
cctgaagcaatgacttctagaa

SEQ ID NO: 909411 - DNA, 22 bp, Artificial Sequence
  chemically synthesized
gcctgaagcaatgacttctaga

SEQ ID NO: 909412 - DNA, 22 bp, Artificial Sequence
  chemically synthesized
cttctcctttctagaagtcatt

SEQ ID NO: 909413 - DNA, 22 bp, Artificial Sequence
  chemically synthesized
ttctcctttctagaagtcattg

SEQ ID NO: 909414 - DNA, 22 bp, Artificial Sequence
  chemically synthesized
ctcctttctagaagtcattgct

SEQ ID NO: 909415 - DNA, 22 bp, Artificial Sequence
  chemically synthesized
tcctttctagaagtcattgctt

SEQ ID NO: 909416 - DNA, 22 bp, Artificial Sequence
  chemically synthesized
ctttctagaagtcattgcttca

SEQ ID NO: 909417 - DNA, 22 bp, Artificial Sequence
  chemically synthesized
tctagaagtcattgcttcaggc

SEQ ID NO: 909418 - DNA, 22 bp, Artificial Sequence
  chemically synthesized
ctagaagtcattgcttcaggca

SEQ ID NO: 909419 - DNA, 22 bp, Artificial Sequence
  chemically synthesized
tagaagtcattgcttcaggcaa

SEQ ID NO: 909420 - DNA, 22 bp, Artificial Sequence
  chemically synthesized
gcacaaaggtgtttgcctgaag

SEQ ID NO: 909421 - DNA, 22 bp, Artificial Sequence
  chemically synthesized
gaagtcattgcttcaggcaaac

SEQ ID NO: 909422 - DNA, 22 bp, Artificial Sequence
  chemically synthesized
ttagcacaaaggtgtttgcctg

SEQ ID NO: 909423 - DNA, 22 bp, Artificial Sequence
  chemically synthesized
attagcacaaaggtgtttgcct

SEQ ID NO: 909424 - DNA, 22 bp, Artificial Sequence
  chemically synthesized
tattagcacaaaggtgtttgcc

SEQ ID NO: 909425 - DNA, 22 bp, Artificial Sequence
  chemically synthesized
ctttattagcacaaaggtgttt

SEQ ID NO: 909426 - DNA, 22 bp, Artificial Sequence
  chemically synthesized
cttcaggcaaacacctttgtgc

SEQ ID NO: 909427 - DNA, 22 bp, Artificial Sequence
  chemically synthesized
caggcaaacacctttgtgctaa

SEQ ID NO: 909428 - DNA, 22 bp, Artificial Sequence
  chemically synthesized
aggcaaacacctttgtgctaat

SEQ ID NO: 909429 - DNA, 22 bp, Artificial Sequence
  chemically synthesized
agtaactcctttattagcacaa

SEQ ID NO: 909430 - DNA, 22 bp, Artificial Sequence
  chemically synthesized
aagtaactcctttattagcaca

SEQ ID NO: 909431 - DNA, 22 bp, Artificial Sequence
  chemically synthesized
taagtaactcctttattagcac

SEQ ID NO: 909432 - DNA, 22 bp, Artificial Sequence
  chemically synthesized
ttaagtaactcctttattagca

SEQ ID NO: 909433 - DNA, 22 bp, Artificial Sequence
  chemically synthesized
tgtgctaataaaggagttactt

SEQ ID NO: 909434 - DNA, 22 bp, Artificial Sequence
  chemically synthesized
gtgctaataaaggagttactta

SEQ ID NO: 909435 - DNA, 22 bp, Artificial Sequence
  chemically synthesized
tgctaataaaggagttacttaa

SEQ ID NO: 909436 - DNA, 22 bp, Artificial Sequence
  chemically synthesized
agtgtagcatttttaagtaact

SEQ ID NO: 909437 - DNA, 22 bp, Artificial Sequence
  chemically synthesized
cagtgtagcatttttaagtaac

SEQ ID NO: 909438 - DNA, 22 bp, Artificial Sequence
  chemically synthesized
ataaaggagttacttaaaaatg

SEQ ID NO: 909439 - DNA, 22 bp, Artificial Sequence
  chemically synthesized
catcttcagtgtagcattttta

SEQ ID NO: 909440 - DNA, 22 bp, Artificial Sequence
  chemically synthesized
tgcatcttcagtgtagcatttt

SEQ ID NO: 909441 - DNA, 22 bp, Artificial Sequence
  chemically synthesized
ataactctgcatcttcagtgta

SEQ ID NO: 909442 - DNA, 22 bp, Artificial Sequence
  chemically synthesized
cttaaaaatgctacactgaaga

SEQ ID NO: 909443 - DNA, 22 bp, Artificial Sequence
  chemically synthesized
cataactctgcatcttcagtgt

SEQ ID NO: 909444 - DNA, 22 bp, Artificial Sequence
  chemically synthesized
aaaaatgctacactgaagatgc

SEQ ID NO: 909445 - DNA, 22 bp, Artificial Sequence
  chemically synthesized
aaaatgctacactgaagatgca

SEQ ID NO: 909446 - DNA, 22 bp, Artificial Sequence
  chemically synthesized
cactgaagatgcagagttatga

SEQ ID NO: 909447 - DNA, 22 bp, Artificial Sequence
  chemically synthesized
aagatgcagagttatgaaattt

SEQ ID NO: 909448 - DNA, 22 bp, Artificial Sequence
  chemically synthesized
tgaaatttttctcctcctttct

SEQ ID NO: 909449 - DNA, 22 bp, Artificial Sequence
  chemically synthesized
ttctcctcctttctcttttcat

SEQ ID NO: 909450 - DNA, 22 bp, Artificial Sequence
  chemically synthesized
tctcctcctttctcttttcatc

SEQ ID NO: 909451 - DNA, 22 bp, Artificial Sequence
  chemically synthesized
ctcctcctttctcttttcatca

SEQ ID NO: 909452 - DNA, 22 bp, Artificial Sequence
  chemically synthesized
tcctcctttctcttttcatcat

SEQ ID NO: 909453 - DNA, 22 bp, Artificial Sequence
  chemically synthesized
ctcctttctcttttcatcatca

SEQ ID NO: 909454 - DNA, 22 bp, Artificial Sequence
  chemically synthesized
ctttctcttttcatcatcattt

SEQ ID NO: 909455 - DNA, 22 bp, Artificial Sequence
  chemically synthesized
tctcttttcatcatcatttata

SEQ ID NO: 909456 - DNA, 22 bp, Artificial Sequence
  chemically synthesized
ctcttttcatcatcatttatac

SEQ ID NO: 909457 - DNA, 22 bp, Artificial Sequence
  chemically synthesized
aaatgatgaagagtataaatga

SEQ ID NO: 909458 - DNA, 22 bp, Artificial Sequence
  chemically synthesized
tcttttcatcatcatttatact

SEQ ID NO: 909459 - DNA, 22 bp, Artificial Sequence
  chemically synthesized
aaaatgatgaagagtataaatg

SEQ ID NO: 909460 - DNA, 22 bp, Artificial Sequence
  chemically synthesized
ttttcatcatcatttatactct

SEQ ID NO: 909461 - DNA, 22 bp, Artificial Sequence
  chemically synthesized
ttcatcatcatttatactcttc

SEQ ID NO: 909462 - DNA, 22 bp, Artificial Sequence
  chemically synthesized
tcatcatcatttatactcttca

SEQ ID NO: 909463 - DNA, 22 bp, Artificial Sequence
  chemically synthesized
catcatcatttatactcttcat

SEQ ID NO: 909464 - DNA, 22 bp, Artificial Sequence
  chemically synthesized
atcatcatttatactcttcatc

SEQ ID NO: 909465 - DNA, 22 bp, Artificial Sequence
  chemically synthesized
atgatggatttaaaatgatgaa

SEQ ID NO: 909466 - DNA, 22 bp, Artificial Sequence
  chemically synthesized
atactcttcatcattttaaatc

SEQ ID NO: 909467 - DNA, 22 bp, Artificial Sequence
  chemically synthesized
tactcttcatcattttaaatcc

SEQ ID NO: 909468 - DNA, 22 bp, Artificial Sequence
  chemically synthesized
cccgttcatgatggatttaaaa

SEQ ID NO: 909469 - DNA, 22 bp, Artificial Sequence
  chemically synthesized
ctccccgttcatgatggattta

SEQ ID NO: 909470 - DNA, 22 bp, Artificial Sequence
  chemically synthesized
ttcatcattttaaatccatcat

SEQ ID NO: 909471 - DNA, 22 bp, Artificial Sequence
  chemically synthesized
tcctccccgttcatgatggatt

SEQ ID NO: 909472 - DNA, 22 bp, Artificial Sequence
  chemically synthesized
catcattttaaatccatcatga

SEQ ID NO: 909473 - DNA, 22 bp, Artificial Sequence
  chemically synthesized
atcattttaaatccatcatgaa

SEQ ID NO: 909474 - DNA, 22 bp, Artificial Sequence
  chemically synthesized
gcaatctctcctccccgttcat

SEQ ID NO: 909475 - DNA, 22 bp, Artificial Sequence
  chemically synthesized
agcaatctctcctccccgttca

SEQ ID NO: 909476 - DNA, 22 bp, Artificial Sequence
  chemically synthesized
taaatccatcatgaacggggag

SEQ ID NO: 909477 - DNA, 22 bp, Artificial Sequence
  chemically synthesized
aaatccatcatgaacggggagg

SEQ ID NO: 909478 - DNA, 22 bp, Artificial Sequence
  chemically synthesized
ttagcaatctctcctccccgtt

SEQ ID NO: 909479 - DNA, 22 bp, Artificial Sequence
  chemically synthesized
aatccatcatgaacggggagga

SEQ ID NO: 909480 - DNA, 22 bp, Artificial Sequence
  chemically synthesized
ttcttagcaatctctcctcccc

SEQ ID NO: 909481 - DNA, 22 bp, Artificial Sequence
  chemically synthesized
gactattcttagcaatctctcc

SEQ ID NO: 909482 - DNA, 22 bp, Artificial Sequence
  chemically synthesized
aaaacaaattcgactattctta

SEQ ID NO: 909483 - DNA, 22 bp, Artificial Sequence
  chemically synthesized
aactaaaaacaaattcgactat

SEQ ID NO: 909484 - DNA, 22 bp, Artificial Sequence
  chemically synthesized
caactaaaaacaaattcgacta

SEQ ID NO: 909485 - DNA, 22 bp, Artificial Sequence
  chemically synthesized
tcaactaaaaacaaattcgact

SEQ ID NO: 909486 - DNA, 22 bp, Artificial Sequence
  chemically synthesized
ctaagaatagtcgaatttgttt

SEQ ID NO: 909487 - DNA, 22 bp, Artificial Sequence
  chemically synthesized
attttcaactaaaaacaaattc

SEQ ID NO: 909488 - DNA, 22 bp, Artificial Sequence
  chemically synthesized
agaatagtcgaatttgttttta

SEQ ID NO: 909489 - DNA, 22 bp, Artificial Sequence
  chemically synthesized
agctaattttcaactaaaaaca

SEQ ID NO: 909490 - DNA, 22 bp, Artificial Sequence
  chemically synthesized
aaagttaagctaattttcaact

SEQ ID NO: 909491 - DNA, 22 bp, Artificial Sequence
  chemically synthesized
aaaagttaagctaattttcaac

SEQ ID NO: 909492 - DNA, 22 bp, Artificial Sequence
  chemically synthesized
tttaaaagttaagctaattttc

SEQ ID NO: 909493 - DNA, 22 bp, Artificial Sequence
  chemically synthesized
atttaaaagttaagctaatttt

SEQ ID NO: 909494 - DNA, 22 bp, Artificial Sequence
  chemically synthesized
gtttttagttgaaaattagctt

SEQ ID NO: 909495 - DNA, 22 bp, Artificial Sequence
  chemically synthesized
tatttaaaagttaagctaattt

SEQ ID NO: 909496 - DNA, 22 bp, Artificial Sequence
  chemically synthesized
tttttagttgaaaattagctta

SEQ ID NO: 909497 - DNA, 22 bp, Artificial Sequence
  chemically synthesized
ttagttgaaaattagcttaact

SEQ ID NO: 909498 - DNA, 22 bp, Artificial Sequence
  chemically synthesized
tagttgaaaattagcttaactt

SEQ ID NO: 909499 - DNA, 22 bp, Artificial Sequence
  chemically synthesized
gattttatttaaaagttaagct

SEQ ID NO: 909500 - DNA, 22 bp, Artificial Sequence
  chemically synthesized
agttgaaaattagcttaacttt

SEQ ID NO: 909501 - DNA, 22 bp, Artificial Sequence
  chemically synthesized
gttgaaaattagcttaactttt

SEQ ID NO: 909502 - DNA, 22 bp, Artificial Sequence
  chemically synthesized
aaaattagcttaacttttaaat

SEQ ID NO: 909503 - DNA, 22 bp, Artificial Sequence
  chemically synthesized
tgccctagattttatttaaaag

SEQ ID NO: 909504 - DNA, 22 bp, Artificial Sequence
  chemically synthesized
gcttaacttttaaataaaatct

SEQ ID NO: 909505 - DNA, 22 bp, Artificial Sequence
  chemically synthesized
agtatgctgtgccctagatttt

SEQ ID NO: 909506 - DNA, 22 bp, Artificial Sequence
  chemically synthesized
aacttttaaataaaatctaggg

SEQ ID NO: 909507 - DNA, 22 bp, Artificial Sequence
  chemically synthesized
aagtatgctgtgccctagattt

SEQ ID NO: 909508 - DNA, 22 bp, Artificial Sequence
  chemically synthesized
acttttaaataaaatctagggc

SEQ ID NO: 909509 - DNA, 22 bp, Artificial Sequence
  chemically synthesized
ttaaataaaatctagggcacag

SEQ ID NO: 909510 - DNA, 22 bp, Artificial Sequence
  chemically synthesized
taaataaaatctagggcacagc

SEQ ID NO: 909511 - DNA, 22 bp, Artificial Sequence
  chemically synthesized
aaataaaatctagggcacagca

SEQ ID NO: 909512 - DNA, 22 bp, Artificial Sequence
  chemically synthesized
aataaaatctagggcacagcat

SEQ ID NO: 909513 - DNA, 22 bp, Artificial Sequence
  chemically synthesized
gggcacagcatacttaagtgac

SEQ ID NO: 909514 - DNA, 22 bp, Artificial Sequence
  chemically synthesized
aaaatgtatatcaagcatgtaa

SEQ ID NO: 909515 - DNA, 22 bp, Artificial Sequence
  chemically synthesized
aagtgacacatttacatgcttg

SEQ ID NO: 909516 - DNA, 22 bp, Artificial Sequence
  chemically synthesized
agtgacacatttacatgcttga

SEQ ID NO: 909517 - DNA, 22 bp, Artificial Sequence
  chemically synthesized
catactgaaaatgtatatcaag

SEQ ID NO: 909518 - DNA, 22 bp, Artificial Sequence
  chemically synthesized
tctacatactgaaaatgtatat

SEQ ID NO: 909519 - DNA, 22 bp, Artificial Sequence
  chemically synthesized
acatgcttgatatacattttca

SEQ ID NO: 909520 - DNA, 22 bp, Artificial Sequence
  chemically synthesized
catgcttgatatacattttcag

SEQ ID NO: 909521 - DNA, 22 bp, Artificial Sequence
  chemically synthesized
ccactatctacatactgaaaat

SEQ ID NO: 909522 - DNA, 22 bp, Artificial Sequence
  chemically synthesized
ttgccactatctacatactgaa

SEQ ID NO: 909523 - DNA, 22 bp, Artificial Sequence
  chemically synthesized
gatatacattttcagtatgtag

SEQ ID NO: 909524 - DNA, 22 bp, Artificial Sequence
  chemically synthesized
atatacattttcagtatgtaga

SEQ ID NO: 909525 - DNA, 22 bp, Artificial Sequence
  chemically synthesized
attgttgccactatctacatac

SEQ ID NO: 909526 - DNA, 22 bp, Artificial Sequence
  chemically synthesized
cattgttgccactatctacata

SEQ ID NO: 909527 - DNA, 22 bp, Artificial Sequence
  chemically synthesized
tcagtatgtagatagtggcaac

SEQ ID NO: 909528 - DNA, 22 bp, Artificial Sequence
  chemically synthesized
cagtatgtagatagtggcaaca

SEQ ID NO: 909529 - DNA, 22 bp, Artificial Sequence
  chemically synthesized
agtatgtagatagtggcaacaa

SEQ ID NO: 909530 - DNA, 22 bp, Artificial Sequence
  chemically synthesized
catagtgaaacttcattgttgc

SEQ ID NO: 909531 - DNA, 22 bp, Artificial Sequence
  chemically synthesized
ccatagtgaaacttcattgttg

SEQ ID NO: 909532 - DNA, 22 bp, Artificial Sequence
  chemically synthesized
atttccatagtgaaacttcatt

SEQ ID NO: 909533 - DNA, 22 bp, Artificial Sequence
  chemically synthesized
tgtaacaactaatttccatagt

SEQ ID NO: 909534 - DNA, 22 bp, Artificial Sequence
  chemically synthesized
gtgtaacaactaatttccatag

SEQ ID NO: 909535 - DNA, 22 bp, Artificial Sequence
  chemically synthesized
atacttgtgtaacaactaattt

SEQ ID NO: 909536 - DNA, 22 bp, Artificial Sequence
  chemically synthesized
cactatggaaattagttgttac

SEQ ID NO: 909537 - DNA, 22 bp, Artificial Sequence
  chemically synthesized
actatggaaattagttgttaca

SEQ ID NO: 909538 - DNA, 22 bp, Artificial Sequence
  chemically synthesized
tggaaattagttgttacacaag

SEQ ID NO: 909539 - DNA, 22 bp, Artificial Sequence
  chemically synthesized
tgaagcactgatacttgtgtaa

SEQ ID NO: 909540 - DNA, 22 bp, Artificial Sequence
  chemically synthesized
gttgttacacaagtatcagtgc

SEQ ID NO: 909541 - DNA, 22 bp, Artificial Sequence
  chemically synthesized
ttacacaagtatcagtgcttca

SEQ ID NO: 909542 - DNA, 22 bp, Artificial Sequence
  chemically synthesized
cacaagtatcagtgcttcacaa

SEQ ID NO: 909543 - DNA, 22 bp, Artificial Sequence
  chemically synthesized
aaaaatataacaaaaatccagc

SEQ ID NO: 909544 - DNA, 22 bp, Artificial Sequence
  chemically synthesized
aaaaaatataacaaaaatccag

SEQ ID NO: 909545 - DNA, 22 bp, Artificial Sequence
  chemically synthesized
cacaatttatgctggatttttg

SEQ ID NO: 909546 - DNA, 22 bp, Artificial Sequence
  chemically synthesized
taaaaaatataacaaaaatcca

SEQ ID NO: 909547 - DNA, 22 bp, Artificial Sequence
  chemically synthesized
acaatttatgctggatttttgt

SEQ ID NO: 909548 - DNA, 22 bp, Artificial Sequence
  chemically synthesized
atgctggatttttgttatattt

SEQ ID NO: 909549 - DNA, 22 bp, Artificial Sequence
  chemically synthesized
tgctggatttttgttatatttt

SEQ ID NO: 909550 - DNA, 22 bp, Artificial Sequence
  chemically synthesized
gatttttgttatattttttaaa

SEQ ID NO: 909551 - DNA, 22 bp, Artificial Sequence
  chemically synthesized
caatataataatgttttaaaaa

SEQ ID NO: 909552 - DNA, 22 bp, Artificial Sequence
  chemically synthesized
ttgttatattttttaaaacatt

SEQ ID NO: 909553 - DNA, 22 bp, Artificial Sequence
  chemically synthesized
tgttatattttttaaaacatta

SEQ ID NO: 909554 - DNA, 22 bp, Artificial Sequence
  chemically synthesized
attccaatataataatgtttta

SEQ ID NO: 909555 - DNA, 22 bp, Artificial Sequence
  chemically synthesized
gttatattttttaaaacattat

SEQ ID NO: 909556 - DNA, 22 bp, Artificial Sequence
  chemically synthesized
ttatattttttaaaacattatt

SEQ ID NO: 909557 - DNA, 22 bp, Artificial Sequence
  chemically synthesized
ttcattccaatataataatgtt

SEQ ID NO: 909558 - DNA, 22 bp, Artificial Sequence
  chemically synthesized
gttcattccaatataataatgt

SEQ ID NO: 909559 - DNA, 22 bp, Artificial Sequence
  chemically synthesized
tattttttaaaacattattata

SEQ ID NO: 909560 - DNA, 22 bp, Artificial Sequence
  chemically synthesized
tttaaaacattattatattgga

SEQ ID NO: 909561 - DNA, 22 bp, Artificial Sequence
  chemically synthesized
ttaaaacattattatattggaa

SEQ ID NO: 909562 - DNA, 22 bp, Artificial Sequence
  chemically synthesized
taaaacattattatattggaat

SEQ ID NO: 909563 - DNA, 22 bp, Artificial Sequence
  chemically synthesized
aaaacattattatattggaatg

SEQ ID NO: 909564 - DNA, 22 bp, Artificial Sequence
  chemically synthesized
aaacattattatattggaatga

SEQ ID NO: 909565 - DNA, 22 bp, Artificial Sequence
  chemically synthesized
ttatattggaatgaacaaatta

SEQ ID NO: 909566 - DNA, 22 bp, Artificial Sequence
  chemically synthesized
accaaatacaagataatttgtt

SEQ ID NO: 909567 - DNA, 22 bp, Artificial Sequence
  chemically synthesized
tattggaatgaacaaattatct

SEQ ID NO: 909568 - DNA, 22 bp, Artificial Sequence
  chemically synthesized
gaatgaacaaattatcttgtat

SEQ ID NO: 909569 - DNA, 22 bp, Artificial Sequence
  chemically synthesized
ggaaacctcaccaaatacaaga

SEQ ID NO: 909570 - DNA, 22 bp, Artificial Sequence
  chemically synthesized
ttaggaaacctcaccaaataca

SEQ ID NO: 909571 - DNA, 22 bp, Artificial Sequence
  chemically synthesized
tattaggaaacctcaccaaata

SEQ ID NO: 909572 - DNA, 22 bp, Artificial Sequence
  chemically synthesized
ctattaggaaacctcaccaaat

SEQ ID NO: 909573 - DNA, 22 bp, Artificial Sequence
  chemically synthesized
tctattaggaaacctcaccaaa

SEQ ID NO: 909574 - DNA, 22 bp, Artificial Sequence
  chemically synthesized
tcttgtatttggtgaggtttcc

SEQ ID NO: 909575 - DNA, 22 bp, Artificial Sequence
  chemically synthesized
gataattttctattaggaaacc

SEQ ID NO: 909576 - DNA, 22 bp, Artificial Sequence
  chemically synthesized
gtatttggtgaggtttcctaat

SEQ ID NO: 909577 - DNA, 22 bp, Artificial Sequence
  chemically synthesized
tatttggtgaggtttcctaata

SEQ ID NO: 909578 - DNA, 22 bp, Artificial Sequence
  chemically synthesized
aagctagataattttctattag

SEQ ID NO: 909579 - DNA, 22 bp, Artificial Sequence
  chemically synthesized
ggtgaggtttcctaatagaaaa

SEQ ID NO: 909580 - DNA, 22 bp, Artificial Sequence
  chemically synthesized
gtgaggtttcctaatagaaaat

SEQ ID NO: 909581 - DNA, 22 bp, Artificial Sequence
  chemically synthesized
cactgaagctagataattttct

SEQ ID NO: 909582 - DNA, 22 bp, Artificial Sequence
  chemically synthesized
cctaatagaaaattatctagct

SEQ ID NO: 909583 - DNA, 22 bp, Artificial Sequence
  chemically synthesized
ctaatagaaaattatctagctt

SEQ ID NO: 909584 - DNA, 22 bp, Artificial Sequence
  chemically synthesized
atagaaaattatctagcttcag

SEQ ID NO: 909585 - DNA, 22 bp, Artificial Sequence
  chemically synthesized
tagaaggttacactgaagctag

SEQ ID NO: 909586 - DNA, 22 bp, Artificial Sequence
  chemically synthesized
gtagaaggttacactgaagcta

SEQ ID NO: 909587 - DNA, 22 bp, Artificial Sequence
  chemically synthesized
tctagcttcagtgtaaccttct

SEQ ID NO: 909588 - DNA, 22 bp, Artificial Sequence
  chemically synthesized
gcttcagtgtaaccttctacaa

SEQ ID NO: 909589 - DNA, 22 bp, Artificial Sequence
  chemically synthesized
cagtgtaaccttctacaaatgc

SEQ ID NO: 909590 - DNA, 22 bp, Artificial Sequence
  chemically synthesized
agtgtaaccttctacaaatgct

SEQ ID NO: 909591 - DNA, 22 bp, Artificial Sequence
  chemically synthesized
gcaaagtaaaggaaaagcattt

SEQ ID NO: 909592 - DNA, 22 bp, Artificial Sequence
  chemically synthesized
ggcaaagtaaaggaaaagcatt

SEQ ID NO: 909593 - DNA, 22 bp, Artificial Sequence
  chemically synthesized
tggcaaagtaaaggaaaagcat

SEQ ID NO: 909594 - DNA, 22 bp, Artificial Sequence
  chemically synthesized
attttggcaaagtaaaggaaaa

SEQ ID NO: 909595 - DNA, 22 bp, Artificial Sequence
  chemically synthesized
ctacaaatgcttttcctttact

SEQ ID NO: 909596 - DNA, 22 bp, Artificial Sequence
  chemically synthesized
tacaaatgcttttcctttactt

SEQ ID NO: 909597 - DNA, 22 bp, Artificial Sequence
  chemically synthesized
cctcattttggcaaagtaaagg

SEQ ID NO: 909598 - DNA, 22 bp, Artificial Sequence
  chemically synthesized
caaatgcttttcctttactttg

SEQ ID NO: 909599 - DNA, 22 bp, Artificial Sequence
  chemically synthesized
ccctcattttggcaaagtaaag

SEQ ID NO: 909600 - DNA, 22 bp, Artificial Sequence
  chemically synthesized
ttcctttactttgccaaaatga

SEQ ID NO: 909601 - DNA, 22 bp, Artificial Sequence
  chemically synthesized
tcctttactttgccaaaatgag

SEQ ID NO: 909602 - DNA, 22 bp, Artificial Sequence
  chemically synthesized
acatcagtttccctcattttgg

SEQ ID NO: 909603 - DNA, 22 bp, Artificial Sequence
  chemically synthesized
cctttactttgccaaaatgagg

SEQ ID NO: 909604 - DNA, 22 bp, Artificial Sequence
  chemically synthesized
gacatcagtttccctcattttg

SEQ ID NO: 909605 - DNA, 22 bp, Artificial Sequence
  chemically synthesized
ctttactttgccaaaatgaggg

SEQ ID NO: 909606 - DNA, 22 bp, Artificial Sequence
  chemically synthesized
tgacatcagtttccctcatttt

SEQ ID NO: 909607 - DNA, 22 bp, Artificial Sequence
  chemically synthesized
ttgacatcagtttccctcattt

SEQ ID NO: 909608 - DNA, 22 bp, Artificial Sequence
  chemically synthesized
tactttgccaaaatgagggaaa

SEQ ID NO: 909609 - DNA, 22 bp, Artificial Sequence
  chemically synthesized
actttgccaaaatgagggaaac

SEQ ID NO: 909610 - DNA, 22 bp, Artificial Sequence
  chemically synthesized
tttttgacatcagtttccctca

SEQ ID NO: 909611 - DNA, 22 bp, Artificial Sequence
  chemically synthesized
ctttgccaaaatgagggaaact

SEQ ID NO: 909612 - DNA, 22 bp, Artificial Sequence
  chemically synthesized
atttttgacatcagtttccctc

SEQ ID NO: 909613 - DNA, 22 bp, Artificial Sequence
  chemically synthesized
tatttttgacatcagtttccct

SEQ ID NO: 909614 - DNA, 22 bp, Artificial Sequence
  chemically synthesized
tgccaaaatgagggaaactgat

SEQ ID NO: 909615 - DNA, 22 bp, Artificial Sequence
  chemically synthesized
gccaaaatgagggaaactgatg

SEQ ID NO: 909616 - DNA, 22 bp, Artificial Sequence
  chemically synthesized
ccaaaatgagggaaactgatgt

SEQ ID NO: 909617 - DNA, 22 bp, Artificial Sequence
  chemically synthesized
cctttatttttgacatcagttt

SEQ ID NO: 909618 - DNA, 22 bp, Artificial Sequence
  chemically synthesized
cccctacctttatttttgacat

SEQ ID NO: 909619 - DNA, 22 bp, Artificial Sequence
  chemically synthesized
ccccctacctttatttttgaca

SEQ ID NO: 909620 - DNA, 22 bp, Artificial Sequence
  chemically synthesized
cccatcccttccccctaccttt

SEQ ID NO: 909621 - DNA, 22 bp, Artificial Sequence
  chemically synthesized
atgtcaaaaataaaggtagggg

SEQ ID NO: 909622 - DNA, 22 bp, Artificial Sequence
  chemically synthesized
ccccatcccttccccctacctt

SEQ ID NO: 909623 - DNA, 22 bp, Artificial Sequence
  chemically synthesized
cttccccatcccttccccctac

SEQ ID NO: 909624 - DNA, 22 bp, Artificial Sequence
  chemically synthesized
acactgcttccccatcccttcc

SEQ ID NO: 909625 - DNA, 22 bp, Artificial Sequence
  chemically synthesized
cacactgcttccccatcccttc

SEQ ID NO: 909626 - DNA, 22 bp, Artificial Sequence
  chemically synthesized
tcacactgcttccccatccctt

SEQ ID NO: 909627 - DNA, 22 bp, Artificial Sequence
  chemically synthesized
taacccagaaatccaagcagaa

SEQ ID NO: 909628 - DNA, 22 bp, Artificial Sequence
  chemically synthesized
attgtaacccagaaatccaagc

SEQ ID NO: 909629 - DNA, 22 bp, Artificial Sequence
  chemically synthesized
acttgctttctgcttggatttc

SEQ ID NO: 909630 - DNA, 22 bp, Artificial Sequence
  chemically synthesized
cttgctttctgcttggatttct

SEQ ID NO: 909631 - DNA, 22 bp, Artificial Sequence
  chemically synthesized
gctttctgcttggatttctggg

SEQ ID NO: 909632 - DNA, 22 bp, Artificial Sequence
  chemically synthesized
gcctgattgtaacccagaaatc

SEQ ID NO: 909633 - DNA, 22 bp, Artificial Sequence
  chemically synthesized
ctttctgcttggatttctgggt

SEQ ID NO: 909634 - DNA, 22 bp, Artificial Sequence
  chemically synthesized
ttggcctgattgtaacccagaa

SEQ ID NO: 909635 - DNA, 22 bp, Artificial Sequence
  chemically synthesized
tctgcttggatttctgggttac

SEQ ID NO: 909636 - DNA, 22 bp, Artificial Sequence
  chemically synthesized
ctgcttggatttctgggttaca

SEQ ID NO: 909637 - DNA, 22 bp, Artificial Sequence
  chemically synthesized
tgcttggatttctgggttacaa

SEQ ID NO: 909638 - DNA, 22 bp, Artificial Sequence
  chemically synthesized
cttggatttctgggttacaatc

SEQ ID NO: 909639 - DNA, 22 bp, Artificial Sequence
  chemically synthesized
ggatttctgggttacaatcagg

SEQ ID NO: 909640 - DNA, 22 bp, Artificial Sequence
  chemically synthesized
tcaatctattggcctgattgta

SEQ ID NO: 909641 - DNA, 22 bp, Artificial Sequence
  chemically synthesized
gatttctgggttacaatcaggc

SEQ ID NO: 909642 - DNA, 22 bp, Artificial Sequence
  chemically synthesized
atcaatctattggcctgattgt

SEQ ID NO: 909643 - DNA, 22 bp, Artificial Sequence
  chemically synthesized
tatcaatctattggcctgattg

SEQ ID NO: 909644 - DNA, 22 bp, Artificial Sequence
  chemically synthesized
ttatcaatctattggcctgatt

SEQ ID NO: 909645 - DNA, 22 bp, Artificial Sequence
  chemically synthesized
ctgggttacaatcaggccaata

SEQ ID NO: 909646 - DNA, 22 bp, Artificial Sequence
  chemically synthesized
tgggttacaatcaggccaatag

SEQ ID NO: 909647 - DNA, 22 bp, Artificial Sequence
  chemically synthesized
ggttacaatcaggccaatagat

SEQ ID NO: 909648 - DNA, 22 bp, Artificial Sequence
  chemically synthesized
aacatcgtttttatcaatctat

SEQ ID NO: 909649 - DNA, 22 bp, Artificial Sequence
  chemically synthesized
caatcaggccaatagattgata

SEQ ID NO: 909650 - DNA, 22 bp, Artificial Sequence
  chemically synthesized
tgaacatcgtttttatcaatct

SEQ ID NO: 909651 - DNA, 22 bp, Artificial Sequence
  chemically synthesized
attctgaacatcgtttttatca

SEQ ID NO: 909652 - DNA, 22 bp, Artificial Sequence
  chemically synthesized
aattctgaacatcgtttttatc

SEQ ID NO: 909653 - DNA, 22 bp, Artificial Sequence
  chemically synthesized
taattctgaacatcgtttttat

SEQ ID NO: 909654 - DNA, 22 bp, Artificial Sequence
  chemically synthesized
ttaattctgaacatcgttttta

SEQ ID NO: 909655 - DNA, 22 bp, Artificial Sequence
  chemically synthesized
agaggacttttaattctgaaca

SEQ ID NO: 909656 - DNA, 22 bp, Artificial Sequence
  chemically synthesized
ataaaaacgatgttcagaatta

SEQ ID NO: 909657 - DNA, 22 bp, Artificial Sequence
  chemically synthesized
agaattaaaagtcctctgaatt

SEQ ID NO: 909658 - DNA, 22 bp, Artificial Sequence
  chemically synthesized
aagtatgaacataattcagagg

SEQ ID NO: 909659 - DNA, 22 bp, Artificial Sequence
  chemically synthesized
aaagtatgaacataattcagag

SEQ ID NO: 909660 - DNA, 22 bp, Artificial Sequence
  chemically synthesized
taaagtatgaacataattcaga

SEQ ID NO: 909661 - DNA, 22 bp, Artificial Sequence
  chemically synthesized
ttaaagtatgaacataattcag

SEQ ID NO: 909662 - DNA, 22 bp, Artificial Sequence
  chemically synthesized
aaagtcctctgaattatgttca

SEQ ID NO: 909663 - DNA, 22 bp, Artificial Sequence
  chemically synthesized
acttttaaagtatgaacataat

SEQ ID NO: 909664 - DNA, 22 bp, Artificial Sequence
  chemically synthesized
tcacttttaaagtatgaacata

SEQ ID NO: 909665 - DNA, 22 bp, Artificial Sequence
  chemically synthesized
tgaattatgttcatactttaaa

SEQ ID NO: 909666 - DNA, 22 bp, Artificial Sequence
  chemically synthesized
aattatgttcatactttaaaag

SEQ ID NO: 909667 - DNA, 22 bp, Artificial Sequence
  chemically synthesized
tgttcatactttaaaagtgaga

SEQ ID NO: 909668 - DNA, 22 bp, Artificial Sequence
  chemically synthesized
aaacaccagcattctcactttt

SEQ ID NO: 909669 - DNA, 22 bp, Artificial Sequence
  chemically synthesized
caaacaccagcattctcacttt

SEQ ID NO: 909670 - DNA, 22 bp, Artificial Sequence
  chemically synthesized
tcaaacaccagcattctcactt

SEQ ID NO: 909671 - DNA, 22 bp, Artificial Sequence
  chemically synthesized
atactttaaaagtgagaatgct

SEQ ID NO: 909672 - DNA, 22 bp, Artificial Sequence
  chemically synthesized
ttttcaaacaccagcattctca

SEQ ID NO: 909673 - DNA, 22 bp, Artificial Sequence
  chemically synthesized
taaaagtgagaatgctggtgtt

SEQ ID NO: 909674 - DNA, 22 bp, Artificial Sequence
  chemically synthesized
aaaagtgagaatgctggtgttt

SEQ ID NO: 909675 - DNA, 22 bp, Artificial Sequence
  chemically synthesized
aaagtgagaatgctggtgtttg

SEQ ID NO: 909676 - DNA, 22 bp, Artificial Sequence
  chemically synthesized
gtgtttgaaaacaatgctggct

SEQ ID NO: 909677 - DNA, 22 bp, Artificial Sequence
  chemically synthesized
agaagcccaacaaagccagcat

SEQ ID NO: 909678 - DNA, 22 bp, Artificial Sequence
  chemically synthesized
cctaagaagcccaacaaagcca

SEQ ID NO: 909679 - DNA, 22 bp, Artificial Sequence
  chemically synthesized
gaaaacaatgctggctttgttg

SEQ ID NO: 909680 - DNA, 22 bp, Artificial Sequence
  chemically synthesized
aaaacaatgctggctttgttgg

SEQ ID NO: 909681 - DNA, 22 bp, Artificial Sequence
  chemically synthesized
ttgcctaagaagcccaacaaag

SEQ ID NO: 909682 - DNA, 22 bp, Artificial Sequence
  chemically synthesized
ctattgcctaagaagcccaaca

SEQ ID NO: 909683 - DNA, 22 bp, Artificial Sequence
  chemically synthesized
ctcctattgcctaagaagccca

SEQ ID NO: 909684 - DNA, 22 bp, Artificial Sequence
  chemically synthesized
tcctcctattgcctaagaagcc

SEQ ID NO: 909685 - DNA, 22 bp, Artificial Sequence
  chemically synthesized
ctcctcctattgcctaagaagc

SEQ ID NO: 909686 - DNA, 22 bp, Artificial Sequence
  chemically synthesized
tctcctcctattgcctaagaag

SEQ ID NO: 909687 - DNA, 22 bp, Artificial Sequence
  chemically synthesized
gctttgttgggcttcttaggca

SEQ ID NO: 909688 - DNA, 22 bp, Artificial Sequence
  chemically synthesized
ttctcctcctattgcctaagaa

SEQ ID NO: 909689 - DNA, 22 bp, Artificial Sequence
  chemically synthesized
tgttgggcttcttaggcaatag

SEQ ID NO: 909690 - DNA, 22 bp, Artificial Sequence
  chemically synthesized
gttgggcttcttaggcaatagg

SEQ ID NO: 909691 - DNA, 22 bp, Artificial Sequence
  chemically synthesized
ttgggcttcttaggcaatagga

SEQ ID NO: 909692 - DNA, 22 bp, Artificial Sequence
  chemically synthesized
ggcttcttaggcaataggagga

SEQ ID NO: 909693 - DNA, 22 bp, Artificial Sequence
  chemically synthesized
cttaggcaataggaggagaaaa

SEQ ID NO: 909694 - DNA, 22 bp, Artificial Sequence
  chemically synthesized
ttaggcaataggaggagaaaaa

SEQ ID NO: 909695 - DNA, 22 bp, Artificial Sequence
  chemically synthesized
gaaaatgatagatttttctcct

SEQ ID NO: 909696 - DNA, 22 bp, Artificial Sequence
  chemically synthesized
aggcaataggaggagaaaaatc

SEQ ID NO: 909697 - DNA, 22 bp, Artificial Sequence
  chemically synthesized
ggcaataggaggagaaaaatct

SEQ ID NO: 909698 - DNA, 22 bp, Artificial Sequence
  chemically synthesized
aaatgtgttggaaaatgataga

SEQ ID NO: 909699 - DNA, 22 bp, Artificial Sequence
  chemically synthesized
agctaaaatgtgttggaaaatg

SEQ ID NO: 909700 - DNA, 22 bp, Artificial Sequence
  chemically synthesized
cagctaaaatgtgttggaaaat

SEQ ID NO: 909701 - DNA, 22 bp, Artificial Sequence
  chemically synthesized
gcatttcagctaaaatgtgttg

SEQ ID NO: 909702 - DNA, 22 bp, Artificial Sequence
  chemically synthesized
tcattttccaacacattttagc

SEQ ID NO: 909703 - DNA, 22 bp, Artificial Sequence
  chemically synthesized
tccaacacattttagctgaaat

SEQ ID NO: 909704 - DNA, 22 bp, Artificial Sequence
  chemically synthesized
tgaccaactagcatttcagcta

SEQ ID NO: 909705 - DNA, 22 bp, Artificial Sequence
  chemically synthesized
ccaacacattttagctgaaatg

SEQ ID NO: 909706 - DNA, 22 bp, Artificial Sequence
  chemically synthesized
caacacattttagctgaaatgc

SEQ ID NO: 909707 - DNA, 22 bp, Artificial Sequence
  chemically synthesized
tatgaccaactagcatttcagc

SEQ ID NO: 909708 - DNA, 22 bp, Artificial Sequence
  chemically synthesized
ctatgaccaactagcatttcag

SEQ ID NO: 909709 - DNA, 22 bp, Artificial Sequence
  chemically synthesized
tctatgaccaactagcatttca

SEQ ID NO: 909710 - DNA, 22 bp, Artificial Sequence
  chemically synthesized
attttctatgaccaactagcat

SEQ ID NO: 909711 - DNA, 22 bp, Artificial Sequence
  chemically synthesized
cattttctatgaccaactagca

SEQ ID NO: 909712 - DNA, 22 bp, Artificial Sequence
  chemically synthesized
tcattttctatgaccaactagc

SEQ ID NO: 909713 - DNA, 22 bp, Artificial Sequence
  chemically synthesized
tagctgaaatgctagttggtca

SEQ ID NO: 909714 - DNA, 22 bp, Artificial Sequence
  chemically synthesized
agctgaaatgctagttggtcat

SEQ ID NO: 909715 - DNA, 22 bp, Artificial Sequence
  chemically synthesized
ctttcattttctatgaccaact

SEQ ID NO: 909716 - DNA, 22 bp, Artificial Sequence
  chemically synthesized
gctgaaatgctagttggtcata

SEQ ID NO: 909717 - DNA, 22 bp, Artificial Sequence
  chemically synthesized
aaatgctagttggtcatagaaa

SEQ ID NO: 909718 - DNA, 22 bp, Artificial Sequence
  chemically synthesized
atattactttcattttctatga

SEQ ID NO: 909719 - DNA, 22 bp, Artificial Sequence
  chemically synthesized
cgctgatattactttcattttc

SEQ ID NO: 909720 - DNA, 22 bp, Artificial Sequence
  chemically synthesized
gttggtcatagaaaatgaaagt

SEQ ID NO: 909721 - DNA, 22 bp, Artificial Sequence
  chemically synthesized
ttccgctgatattactttcatt

SEQ ID NO: 909722 - DNA, 22 bp, Artificial Sequence
  chemically synthesized
gtcatagaaaatgaaagtaata

SEQ ID NO: 909723 - DNA, 22 bp, Artificial Sequence
  chemically synthesized
ctattccgctgatattactttc

SEQ ID NO: 909724 - DNA, 22 bp, Artificial Sequence
  chemically synthesized
tcctattccgctgatattactt

SEQ ID NO: 909725 - DNA, 22 bp, Artificial Sequence
  chemically synthesized
ctctcctattccgctgatatta

SEQ ID NO: 909726 - DNA, 22 bp, Artificial Sequence
  chemically synthesized
agccactgctctcctattccgc

SEQ ID NO: 909727 - DNA, 22 bp, Artificial Sequence
  chemically synthesized
cagccactgctctcctattccg

SEQ ID NO: 909728 - DNA, 22 bp, Artificial Sequence
  chemically synthesized
tcagccactgctctcctattcc

SEQ ID NO: 909729 - DNA, 22 bp, Artificial Sequence
  chemically synthesized
gtggaaggcacagaggattttc

SEQ ID NO: 909730 - DNA, 22 bp, Artificial Sequence
  chemically synthesized
tcgtggaaggcacagaggattt

SEQ ID NO: 909731 - DNA, 22 bp, Artificial Sequence
  chemically synthesized
aaaatcctctgtgccttccacg

SEQ ID NO: 909732 - DNA, 22 bp, Artificial Sequence
  chemically synthesized
tgtgccttccacgagagccatt

SEQ ID NO: 909733 - DNA, 22 bp, Artificial Sequence
  chemically synthesized
tgccttccacgagagccatttg

SEQ ID NO: 909734 - DNA, 22 bp, Artificial Sequence
  chemically synthesized
gaggcagcaagacaaccaaatg

SEQ ID NO: 909735 - DNA, 22 bp, Artificial Sequence
  chemically synthesized
ccacgagagccatttggttgtc

SEQ ID NO: 909736 - DNA, 22 bp, Artificial Sequence
  chemically synthesized
cacgagagccatttggttgtct

SEQ ID NO: 909737 - DNA, 22 bp, Artificial Sequence
  chemically synthesized
ggttgtcttgctgcctctaact

SEQ ID NO: 909738 - DNA, 22 bp, Artificial Sequence
  chemically synthesized
gttgtcttgctgcctctaactc

SEQ ID NO: 909739 - DNA, 22 bp, Artificial Sequence
  chemically synthesized
tcttgctgcctctaactctcct

SEQ ID NO: 909740 - DNA, 22 bp, Artificial Sequence
  chemically synthesized
gctgcctctaactctcctctcc

SEQ ID NO: 909741 - DNA, 22 bp, Artificial Sequence
  chemically synthesized
ctgcctctaactctcctctcct

SEQ ID NO: 909742 - DNA, 22 bp, Artificial Sequence
  chemically synthesized
cctctaactctcctctccttca

SEQ ID NO: 909743 - DNA, 22 bp, Artificial Sequence
  chemically synthesized
tgaatgcaacaggtgaaggaga

SEQ ID NO: 909744 - DNA, 22 bp, Artificial Sequence
  chemically synthesized
taactctcctctccttcacctg

SEQ ID NO: 909745 - DNA, 22 bp, Artificial Sequence
  chemically synthesized
ttatgaatgcaacaggtgaagg

SEQ ID NO: 909746 - DNA, 22 bp, Artificial Sequence
  chemically synthesized
actctcctctccttcacctgtt

SEQ ID NO: 909747 - DNA, 22 bp, Artificial Sequence
  chemically synthesized
ctattatgaatgcaacaggtga

SEQ ID NO: 909748 - DNA, 22 bp, Artificial Sequence
  chemically synthesized
tcctctccttcacctgttgcat

SEQ ID NO: 909749 - DNA, 22 bp, Artificial Sequence
  chemically synthesized
ctctccttcacctgttgcattc

SEQ ID NO: 909750 - DNA, 22 bp, Artificial Sequence
  chemically synthesized
tgtgctactattatgaatgcaa

SEQ ID NO: 909751 - DNA, 22 bp, Artificial Sequence
  chemically synthesized
tccttcacctgttgcattcata

SEQ ID NO: 909752 - DNA, 22 bp, Artificial Sequence
  chemically synthesized
cttcacctgttgcattcataat

SEQ ID NO: 909753 - DNA, 22 bp, Artificial Sequence
  chemically synthesized
aactatgtgctactattatgaa

SEQ ID NO: 909754 - DNA, 22 bp, Artificial Sequence
  chemically synthesized
cacctgttgcattcataatagt

SEQ ID NO: 909755 - DNA, 22 bp, Artificial Sequence
  chemically synthesized
acctgttgcattcataatagta

SEQ ID NO: 909756 - DNA, 22 bp, Artificial Sequence
  chemically synthesized
ttgcattcataatagtagcaca

SEQ ID NO: 909757 - DNA, 22 bp, Artificial Sequence
  chemically synthesized
cattcataatagtagcacatag

SEQ ID NO: 909758 - DNA, 22 bp, Artificial Sequence
  chemically synthesized
gggagaaagctgaactatgtgc

SEQ ID NO: 909759 - DNA, 22 bp, Artificial Sequence
  chemically synthesized
ggggagaaagctgaactatgtg

SEQ ID NO: 909760 - DNA, 22 bp, Artificial Sequence
  chemically synthesized
ataatagtagcacatagttcag

SEQ ID NO: 909761 - DNA, 22 bp, Artificial Sequence
  chemically synthesized
ttggggagaaagctgaactatg

SEQ ID NO: 909762 - DNA, 22 bp, Artificial Sequence
  chemically synthesized
taaatatggctcttggggagaa

SEQ ID NO: 909763 - DNA, 22 bp, Artificial Sequence
  chemically synthesized
agctttctccccaagagccata

SEQ ID NO: 909764 - DNA, 22 bp, Artificial Sequence
  chemically synthesized
atcaaagttgtaaatatggctc

SEQ ID NO: 909765 - DNA, 22 bp, Artificial Sequence
  chemically synthesized
aatcaaagttgtaaatatggct

SEQ ID NO: 909766 - DNA, 22 bp, Artificial Sequence
  chemically synthesized
tctccccaagagccatatttac

SEQ ID NO: 909767 - DNA, 22 bp, Artificial Sequence
  chemically synthesized
ttaatcaaagttgtaaatatgg

SEQ ID NO: 909768 - DNA, 22 bp, Artificial Sequence
  chemically synthesized
ctccccaagagccatatttaca

SEQ ID NO: 909769 - DNA, 22 bp, Artificial Sequence
  chemically synthesized
cttaatcaaagttgtaaatatg

SEQ ID NO: 909770 - DNA, 22 bp, Artificial Sequence
  chemically synthesized
tccccaagagccatatttacaa

SEQ ID NO: 909771 - DNA, 22 bp, Artificial Sequence
  chemically synthesized
cccaagagccatatttacaact

SEQ ID NO: 909772 - DNA, 22 bp, Artificial Sequence
  chemically synthesized
accttcttaatcaaagttgtaa

SEQ ID NO: 909773 - DNA, 22 bp, Artificial Sequence
  chemically synthesized
caaaagtctcaccttcttaatc

SEQ ID NO: 909774 - DNA, 22 bp, Artificial Sequence
  chemically synthesized
tccaaaagtctcaccttcttaa

SEQ ID NO: 909775 - DNA, 22 bp, Artificial Sequence
  chemically synthesized
acaactttgattaagaaggtga

SEQ ID NO: 909776 - DNA, 22 bp, Artificial Sequence
  chemically synthesized
caactttgattaagaaggtgag

SEQ ID NO: 909777 - DNA, 22 bp, Artificial Sequence
  chemically synthesized
caaattctccaaaagtctcacc

SEQ ID NO: 909778 - DNA, 22 bp, Artificial Sequence
  chemically synthesized
tgattaagaaggtgagactttt

SEQ ID NO: 909779 - DNA, 22 bp, Artificial Sequence
  chemically synthesized
gattaagaaggtgagacttttg

SEQ ID NO: 909780 - DNA, 22 bp, Artificial Sequence
  chemically synthesized
attaagaaggtgagacttttgg

SEQ ID NO: 909781 - DNA, 22 bp, Artificial Sequence
  chemically synthesized
acctccaaattctccaaaagtc

SEQ ID NO: 909782 - DNA, 22 bp, Artificial Sequence
  chemically synthesized
tcacctccaaattctccaaaag

SEQ ID NO: 909783 - DNA, 22 bp, Artificial Sequence
  chemically synthesized
agaaggtgagacttttggagaa

SEQ ID NO: 909784 - DNA, 22 bp, Artificial Sequence
  chemically synthesized
attctcacctccaaattctcca

SEQ ID NO: 909785 - DNA, 22 bp, Artificial Sequence
  chemically synthesized
tgattctcacctccaaattctc

SEQ ID NO: 909786 - DNA, 22 bp, Artificial Sequence
  chemically synthesized
ttggagaatttggaggtgagaa

SEQ ID NO: 909787 - DNA, 22 bp, Artificial Sequence
  chemically synthesized
tggagaatttggaggtgagaat

SEQ ID NO: 909788 - DNA, 22 bp, Artificial Sequence
  chemically synthesized
ggagaatttggaggtgagaatc

SEQ ID NO: 909789 - DNA, 22 bp, Artificial Sequence
  chemically synthesized
gagaatttggaggtgagaatca

SEQ ID NO: 909790 - DNA, 22 bp, Artificial Sequence
  chemically synthesized
ggaggtgagaatcagagatgat

SEQ ID NO: 909791 - DNA, 22 bp, Artificial Sequence
  chemically synthesized
gaggtgagaatcagagatgatt

SEQ ID NO: 909792 - DNA, 22 bp, Artificial Sequence
  chemically synthesized
aaatagaaaaatgcaaagagca

SEQ ID NO: 909793 - DNA, 22 bp, Artificial Sequence
  chemically synthesized
tgtgcttgctctttgcattttt

SEQ ID NO: 909794 - DNA, 22 bp, Artificial Sequence
  chemically synthesized
gtgcttgctctttgcatttttc

SEQ ID NO: 909795 - DNA, 22 bp, Artificial Sequence
  chemically synthesized
tgcttgctctttgcatttttct

SEQ ID NO: 909796 - DNA, 22 bp, Artificial Sequence
  chemically synthesized
gctctttgcatttttctatttt

SEQ ID NO: 909797 - DNA, 22 bp, Artificial Sequence
  chemically synthesized
ctctttgcatttttctatttta

SEQ ID NO: 909798 - DNA, 22 bp, Artificial Sequence
  chemically synthesized
tttgcatttttctattttagta

SEQ ID NO: 909799 - DNA, 22 bp, Artificial Sequence
  chemically synthesized
tgcatttttctattttagtatt

SEQ ID NO: 909800 - DNA, 22 bp, Artificial Sequence
  chemically synthesized
gcatttttctattttagtatta

SEQ ID NO: 909801 - DNA, 22 bp, Artificial Sequence
  chemically synthesized
catttttctattttagtattac

SEQ ID NO: 909802 - DNA, 22 bp, Artificial Sequence
  chemically synthesized
aaaacagtaggagtaatactaa

SEQ ID NO: 909803 - DNA, 22 bp, Artificial Sequence
  chemically synthesized
ttctattttagtattactccta

SEQ ID NO: 909804 - DNA, 22 bp, Artificial Sequence
  chemically synthesized
gattaaaaacagtaggagtaat

SEQ ID NO: 909805 - DNA, 22 bp, Artificial Sequence
  chemically synthesized
tctattttagtattactcctac

SEQ ID NO: 909806 - DNA, 22 bp, Artificial Sequence
  chemically synthesized
ctattttagtattactcctact

SEQ ID NO: 909807 - DNA, 22 bp, Artificial Sequence
  chemically synthesized
tattttagtattactcctactg

SEQ ID NO: 909808 - DNA, 22 bp, Artificial Sequence
  chemically synthesized
ttttagtattactcctactgtt

SEQ ID NO: 909809 - DNA, 22 bp, Artificial Sequence
  chemically synthesized
tagtattactcctactgttttt

SEQ ID NO: 909810 - DNA, 22 bp, Artificial Sequence
  chemically synthesized
agtattactcctactgttttta

SEQ ID NO: 909811 - DNA, 22 bp, Artificial Sequence
  chemically synthesized
gtattactcctactgtttttaa

SEQ ID NO: 909812 - DNA, 22 bp, Artificial Sequence
  chemically synthesized
aaaaaatgttagattaaaaaca

SEQ ID NO: 909813 - DNA, 22 bp, Artificial Sequence
  chemically synthesized
ctcaaaaaatgttagattaaaa

SEQ ID NO: 909814 - DNA, 22 bp, Artificial Sequence
  chemically synthesized
ctcctactgtttttaatctaac

SEQ ID NO: 909815 - DNA, 22 bp, Artificial Sequence
  chemically synthesized
ctactgtttttaatctaacatt

SEQ ID NO: 909816 - DNA, 22 bp, Artificial Sequence
  chemically synthesized
taattgctcaaaaaatgttaga

SEQ ID NO: 909817 - DNA, 22 bp, Artificial Sequence
  chemically synthesized
ctgtttttaatctaacattttt

SEQ ID NO: 909818 - DNA, 22 bp, Artificial Sequence
  chemically synthesized
tttttaatctaacattttttga

SEQ ID NO: 909819 - DNA, 22 bp, Artificial Sequence
  chemically synthesized
ttaatctaacattttttgagca

SEQ ID NO: 909820 - DNA, 22 bp, Artificial Sequence
  chemically synthesized
gcatattgtaattgctcaaaaa

SEQ ID NO: 909821 - DNA, 22 bp, Artificial Sequence
  chemically synthesized
taatctaacattttttgagcaa

SEQ ID NO: 909822 - DNA, 22 bp, Artificial Sequence
  chemically synthesized
aatctaacattttttgagcaat

SEQ ID NO: 909823 - DNA, 22 bp, Artificial Sequence
  chemically synthesized
atctaacattttttgagcaatt

SEQ ID NO: 909824 - DNA, 22 bp, Artificial Sequence
  chemically synthesized
acattttttgagcaattacaat

SEQ ID NO: 909825 - DNA, 22 bp, Artificial Sequence
  chemically synthesized
tttgagcaattacaatatgcca

SEQ ID NO: 909826 - DNA, 22 bp, Artificial Sequence
  chemically synthesized
ttgagcaattacaatatgccag

SEQ ID NO: 909827 - DNA, 22 bp, Artificial Sequence
  chemically synthesized
tgagcaattacaatatgccaga

SEQ ID NO: 909828 - DNA, 22 bp, Artificial Sequence
  chemically synthesized
gagcaattacaatatgccagat

SEQ ID NO: 909829 - DNA, 22 bp, Artificial Sequence
  chemically synthesized
agcaattacaatatgccagata

SEQ ID NO: 909830 - DNA, 22 bp, Artificial Sequence
  chemically synthesized
caatatgccagatactgtgtta

SEQ ID NO: 909831 - DNA, 22 bp, Artificial Sequence
  chemically synthesized
aatgaggtagtaaatgggaaat

SEQ ID NO: 909832 - DNA, 22 bp, Artificial Sequence
  chemically synthesized
tgttacacatttcccatttact

SEQ ID NO: 909833 - DNA, 22 bp, Artificial Sequence
  chemically synthesized
cacatttcccatttactacctc

SEQ ID NO: 909834 - DNA, 22 bp, Artificial Sequence
  chemically synthesized
tggtgaaaattcaatgaggtag

SEQ ID NO: 909835 - DNA, 22 bp, Artificial Sequence
  chemically synthesized
cccatttactacctcattgaat

SEQ ID NO: 909836 - DNA, 22 bp, Artificial Sequence
  chemically synthesized
ccatttactacctcattgaatt

SEQ ID NO: 909837 - DNA, 22 bp, Artificial Sequence
  chemically synthesized
cccaggttgtggtgaaaattca

SEQ ID NO: 909838 - DNA, 22 bp, Artificial Sequence
  chemically synthesized
ccccaggttgtggtgaaaattc

SEQ ID NO: 909839 - DNA, 22 bp, Artificial Sequence
  chemically synthesized
actacctcattgaattttcacc

SEQ ID NO: 909840 - DNA, 22 bp, Artificial Sequence
  chemically synthesized
ctacctcattgaattttcacca

SEQ ID NO: 909841 - DNA, 22 bp, Artificial Sequence
  chemically synthesized
cctcattgaattttcaccacaa

SEQ ID NO: 909842 - DNA, 22 bp, Artificial Sequence
  chemically synthesized
attgaattttcaccacaacctg

SEQ ID NO: 909843 - DNA, 22 bp, Artificial Sequence
  chemically synthesized
aattttcaccacaacctgggga

SEQ ID NO: 909844 - DNA, 22 bp, Artificial Sequence
  chemically synthesized
aaagaagacacttccccaggtt

SEQ ID NO: 909845 - DNA, 22 bp, Artificial Sequence
  chemically synthesized
tcaccacaacctggggaagtgt

SEQ ID NO: 909846 - DNA, 22 bp, Artificial Sequence
  chemically synthesized
caccacaacctggggaagtgtc

SEQ ID NO: 909847 - DNA, 22 bp, Artificial Sequence
  chemically synthesized
accacaacctggggaagtgtct

SEQ ID NO: 909848 - DNA, 22 bp, Artificial Sequence
  chemically synthesized
aaatactaaaagaagacacttc

SEQ ID NO: 909849 - DNA, 22 bp, Artificial Sequence
  chemically synthesized
gggaagtgtcttcttttagtat

SEQ ID NO: 909850 - DNA, 22 bp, Artificial Sequence
  chemically synthesized
taacatccataaaattcaaata

SEQ ID NO: 909851 - DNA, 22 bp, Artificial Sequence
  chemically synthesized
cttttagtatttgaattttatg

SEQ ID NO: 909852 - DNA, 22 bp, Artificial Sequence
  chemically synthesized
agttataacatccataaaattc

SEQ ID NO: 909853 - DNA, 22 bp, Artificial Sequence
  chemically synthesized
ttttagtatttgaattttatgg

SEQ ID NO: 909854 - DNA, 22 bp, Artificial Sequence
  chemically synthesized
ttagtatttgaattttatggat

SEQ ID NO: 909855 - DNA, 22 bp, Artificial Sequence
  chemically synthesized
tagtatttgaattttatggatg

SEQ ID NO: 909856 - DNA, 22 bp, Artificial Sequence
  chemically synthesized
agtatttgaattttatggatgt

SEQ ID NO: 909857 - DNA, 22 bp, Artificial Sequence
  chemically synthesized
gtatttgaattttatggatgtt

SEQ ID NO: 909858 - DNA, 22 bp, Artificial Sequence
  chemically synthesized
tccatacctaagttataacatc

SEQ ID NO: 909859 - DNA, 22 bp, Artificial Sequence
  chemically synthesized
gaattttatggatgttataact

SEQ ID NO: 909860 - DNA, 22 bp, Artificial Sequence
  chemically synthesized
tgtccatacctaagttataaca

SEQ ID NO: 909861 - DNA, 22 bp, Artificial Sequence
  chemically synthesized
aattttatggatgttataactt

SEQ ID NO: 909862 - DNA, 22 bp, Artificial Sequence
  chemically synthesized
ctctgtccatacctaagttata

SEQ ID NO: 909863 - DNA, 22 bp, Artificial Sequence
  chemically synthesized
tatggatgttataacttaggta

SEQ ID NO: 909864 - DNA, 22 bp, Artificial Sequence
  chemically synthesized
atggatgttataacttaggtat

SEQ ID NO: 909865 - DNA, 22 bp, Artificial Sequence
  chemically synthesized
tggatgttataacttaggtatg

SEQ ID NO: 909866 - DNA, 22 bp, Artificial Sequence
  chemically synthesized
tacctactctgtccatacctaa

SEQ ID NO: 909867 - DNA, 22 bp, Artificial Sequence
  chemically synthesized
atacctactctgtccataccta

SEQ ID NO: 909868 - DNA, 22 bp, Artificial Sequence
  chemically synthesized
taacttaggtatggacagagta

SEQ ID NO: 909869 - DNA, 22 bp, Artificial Sequence
  chemically synthesized
tgtgatcttatacctactctgt

SEQ ID NO: 909870 - DNA, 22 bp, Artificial Sequence
  chemically synthesized
aggtatggacagagtaggtata

SEQ ID NO: 909871 - DNA, 22 bp, Artificial Sequence
  chemically synthesized
ggtatggacagagtaggtataa

SEQ ID NO: 909872 - DNA, 22 bp, Artificial Sequence
  chemically synthesized
ccagctatgtgatcttatacct

SEQ ID NO: 909873 - DNA, 22 bp, Artificial Sequence
  chemically synthesized
ctaccagctatgtgatcttata

SEQ ID NO: 909874 - DNA, 22 bp, Artificial Sequence
  chemically synthesized
gctaccagctatgtgatcttat

SEQ ID NO: 909875 - DNA, 22 bp, Artificial Sequence
  chemically synthesized
cacttgctaccagctatgtgat

SEQ ID NO: 909876 - DNA, 22 bp, Artificial Sequence
  chemically synthesized
tggattccacttgctaccagct

SEQ ID NO: 909877 - DNA, 22 bp, Artificial Sequence
  chemically synthesized
tgaattatggattccacttgct

SEQ ID NO: 909878 - DNA, 22 bp, Artificial Sequence
  chemically synthesized
gtagcaagtggaatccataatt

SEQ ID NO: 909879 - DNA, 22 bp, Artificial Sequence
  chemically synthesized
atgatgagattatgaattatgg

SEQ ID NO: 909880 - DNA, 22 bp, Artificial Sequence
  chemically synthesized
caggcattaatgatgagattat

SEQ ID NO: 909881 - DNA, 22 bp, Artificial Sequence
  chemically synthesized
ctgcaggcattaatgatgagat

SEQ ID NO: 909882 - DNA, 22 bp, Artificial Sequence
  chemically synthesized
actgcaggcattaatgatgaga

SEQ ID NO: 909883 - DNA, 22 bp, Artificial Sequence
  chemically synthesized
ataatctcatcattaatgcctg

SEQ ID NO: 909884 - DNA, 22 bp, Artificial Sequence
  chemically synthesized
atcattaatgcctgcagtaaat

SEQ ID NO: 909885 - DNA, 22 bp, Artificial Sequence
  chemically synthesized
atgcctgcagtaaattacctcc

SEQ ID NO: 909886 - DNA, 22 bp, Artificial Sequence
  chemically synthesized
cagtaaattacctcctcatcac

SEQ ID NO: 909887 - DNA, 22 bp, Artificial Sequence
  chemically synthesized
cctcctcatcactcctgtttac

SEQ ID NO: 909888 - DNA, 22 bp, Artificial Sequence
  chemically synthesized
caaacaaggaaaaagtaaacag

SEQ ID NO: 909889 - DNA, 22 bp, Artificial Sequence
  chemically synthesized
acaaacaaggaaaaagtaaaca

SEQ ID NO: 909890 - DNA, 22 bp, Artificial Sequence
  chemically synthesized
ctcatcactcctgtttactttt

SEQ ID NO: 909891 - DNA, 22 bp, Artificial Sequence
  chemically synthesized
tacaaacaaggaaaaagtaaac

SEQ ID NO: 909892 - DNA, 22 bp, Artificial Sequence
  chemically synthesized
atcactcctgtttactttttcc

SEQ ID NO: 909893 - DNA, 22 bp, Artificial Sequence
  chemically synthesized
ctgtttactttttccttgtttg

SEQ ID NO: 909894 - DNA, 22 bp, Artificial Sequence
  chemically synthesized
tttactttttccttgtttgtaa

SEQ ID NO: 909895 - DNA, 22 bp, Artificial Sequence
  chemically synthesized
actttttccttgtttgtaaagt

SEQ ID NO: 909896 - DNA, 22 bp, Artificial Sequence
  chemically synthesized
ctttttccttgtttgtaaagtg

SEQ ID NO: 909897 - DNA, 22 bp, Artificial Sequence
  chemically synthesized
tttccttgtttgtaaagtgtct

SEQ ID NO: 909898 - DNA, 22 bp, Artificial Sequence
  chemically synthesized
ttccttgtttgtaaagtgtctg

SEQ ID NO: 909899 - DNA, 22 bp, Artificial Sequence
  chemically synthesized
tccttgtttgtaaagtgtctga

SEQ ID NO: 909900 - DNA, 22 bp, Artificial Sequence
  chemically synthesized
ccttgtttgtaaagtgtctgat

SEQ ID NO: 909901 - DNA, 22 bp, Artificial Sequence
  chemically synthesized
cttgtttgtaaagtgtctgatc

SEQ ID NO: 909902 - DNA, 22 bp, Artificial Sequence
  chemically synthesized
gtttgtaaagtgtctgatccat

SEQ ID NO: 909903 - DNA, 22 bp, Artificial Sequence
  chemically synthesized
tttgtaaagtgtctgatccata

SEQ ID NO: 909904 - DNA, 22 bp, Artificial Sequence
  chemically synthesized
gtaaagtgtctgatccatattc

SEQ ID NO: 909905 - DNA, 22 bp, Artificial Sequence
  chemically synthesized
taaagtgtctgatccatattct

SEQ ID NO: 909906 - DNA, 22 bp, Artificial Sequence
  chemically synthesized
taataccatataggcaatgcca

SEQ ID NO: 909907 - DNA, 22 bp, Artificial Sequence
  chemically synthesized
atccatattcttggcattgcct

SEQ ID NO: 909908 - DNA, 22 bp, Artificial Sequence
  chemically synthesized
ttggcattgcctatatggtatt

SEQ ID NO: 909909 - DNA, 22 bp, Artificial Sequence
  chemically synthesized
ggcattgcctatatggtattat

SEQ ID NO: 909910 - DNA, 22 bp, Artificial Sequence
  chemically synthesized
gcattgcctatatggtattata

SEQ ID NO: 909911 - DNA, 22 bp, Artificial Sequence
  chemically synthesized
cctatatggtattatagtacat

SEQ ID NO: 909912 - DNA, 22 bp, Artificial Sequence
  chemically synthesized
gatagaaaccagtatgtactat

SEQ ID NO: 909913 - DNA, 22 bp, Artificial Sequence
  chemically synthesized
tatggtattatagtacatactg

SEQ ID NO: 909914 - DNA, 22 bp, Artificial Sequence
  chemically synthesized
tagtacatactggtttctatcc

SEQ ID NO: 909915 - DNA, 22 bp, Artificial Sequence
  chemically synthesized
tgagccaggaacctggatagaa

SEQ ID NO: 909916 - DNA, 22 bp, Artificial Sequence
  chemically synthesized
tgggtgttatgagccaggaacc

SEQ ID NO: 909917 - DNA, 22 bp, Artificial Sequence
  chemically synthesized
gtttctatccaggttcctggct

SEQ ID NO: 909918 - DNA, 22 bp, Artificial Sequence
  chemically synthesized
ctatccaggttcctggctcata

SEQ ID NO: 909919 - DNA, 22 bp, Artificial Sequence
  chemically synthesized
tatccaggttcctggctcataa

SEQ ID NO: 909920 - DNA, 22 bp, Artificial Sequence
  chemically synthesized
tccaggttcctggctcataaca

SEQ ID NO: 909921 - DNA, 22 bp, Artificial Sequence
  chemically synthesized
taacaagggctatgggtgttat

SEQ ID NO: 909922 - DNA, 22 bp, Artificial Sequence
  chemically synthesized
ctggctcataacacccatagcc

SEQ ID NO: 909923 - DNA, 22 bp, Artificial Sequence
  chemically synthesized
gctcataacacccatagccctt

SEQ ID NO: 909924 - DNA, 22 bp, Artificial Sequence
  chemically synthesized
ataacacccatagcccttgtta

SEQ ID NO: 909925 - DNA, 22 bp, Artificial Sequence
  chemically synthesized
taacaaaaaactgtaacaaggg

SEQ ID NO: 909926 - DNA, 22 bp, Artificial Sequence
  chemically synthesized
gttacagttttttgttataatg

SEQ ID NO: 909927 - DNA, 22 bp, Artificial Sequence
  chemically synthesized
ttacagttttttgttataatgt

SEQ ID NO: 909928 - DNA, 22 bp, Artificial Sequence
  chemically synthesized
cagttttttgttataatgttgg

SEQ ID NO: 909929 - DNA, 22 bp, Artificial Sequence
  chemically synthesized
agacccaacgcaaccaacatta

SEQ ID NO: 909930 - DNA, 22 bp, Artificial Sequence
  chemically synthesized
tttgttataatgttggttgcgt

SEQ ID NO: 909931 - DNA, 22 bp, Artificial Sequence
  chemically synthesized
ttgttataatgttggttgcgtt

SEQ ID NO: 909932 - DNA, 22 bp, Artificial Sequence
  chemically synthesized
cccctgagacccaacgcaacca

SEQ ID NO: 909933 - DNA, 22 bp, Artificial Sequence
  chemically synthesized
tgttataatgttggttgcgttg

SEQ ID NO: 909934 - DNA, 22 bp, Artificial Sequence
  chemically synthesized
gttataatgttggttgcgttgg

SEQ ID NO: 909935 - DNA, 22 bp, Artificial Sequence
  chemically synthesized
ttataatgttggttgcgttggg

SEQ ID NO: 909936 - DNA, 22 bp, Artificial Sequence
  chemically synthesized
taatgttggttgcgttgggtct

SEQ ID NO: 909937 - DNA, 22 bp, Artificial Sequence
  chemically synthesized
gttgcgttgggtctcaggggca

SEQ ID NO: 909938 - DNA, 22 bp, Artificial Sequence
  chemically synthesized
cgttgggtctcaggggcaggcc

SEQ ID NO: 909939 - DNA, 22 bp, Artificial Sequence
  chemically synthesized
ggtctcaggggcaggcctctga

SEQ ID NO: 909940 - DNA, 22 bp, Artificial Sequence
  chemically synthesized
aggggcaggcctctgaccttct

SEQ ID NO: 909941 - DNA, 22 bp, Artificial Sequence
  chemically synthesized
aagtgaaaggagagcaggagaa

SEQ ID NO: 909942 - DNA, 22 bp, Artificial Sequence
  chemically synthesized
tgaccttctcctgctctccttt

SEQ ID NO: 909943 - DNA, 22 bp, Artificial Sequence
  chemically synthesized
accttctcctgctctcctttca

SEQ ID NO: 909944 - DNA, 22 bp, Artificial Sequence
  chemically synthesized
ctcctgctctcctttcacttta

SEQ ID NO: 909945 - DNA, 22 bp, Artificial Sequence
  chemically synthesized
tcctgctctcctttcactttaa

SEQ ID NO: 909946 - DNA, 22 bp, Artificial Sequence
  chemically synthesized
ctgctctcctttcactttaatg

SEQ ID NO: 909947 - DNA, 22 bp, Artificial Sequence
  chemically synthesized
aaaggcgagggaacattaaagt

SEQ ID NO: 909948 - DNA, 22 bp, Artificial Sequence
  chemically synthesized
ctctcctttcactttaatgttc

SEQ ID NO: 909949 - DNA, 22 bp, Artificial Sequence
  chemically synthesized
tcctttcactttaatgttccct

SEQ ID NO: 909950 - DNA, 22 bp, Artificial Sequence
  chemically synthesized
ctttcactttaatgttccctcg

SEQ ID NO: 909951 - DNA, 22 bp, Artificial Sequence
  chemically synthesized
taatctgaaaggcgagggaaca

SEQ ID NO: 909952 - DNA, 22 bp, Artificial Sequence
  chemically synthesized
tcactttaatgttccctcgcct

SEQ ID NO: 909953 - DNA, 22 bp, Artificial Sequence
  chemically synthesized
cactttaatgttccctcgcctt

SEQ ID NO: 909954 - DNA, 22 bp, Artificial Sequence
  chemically synthesized
actttaatgttccctcgccttt

SEQ ID NO: 909955 - DNA, 22 bp, Artificial Sequence
  chemically synthesized
agacctataatctgaaaggcga

SEQ ID NO: 909956 - DNA, 22 bp, Artificial Sequence
  chemically synthesized
aagacctataatctgaaaggcg

SEQ ID NO: 909957 - DNA, 22 bp, Artificial Sequence
  chemically synthesized
taatgttccctcgcctttcaga

SEQ ID NO: 909958 - DNA, 22 bp, Artificial Sequence
  chemically synthesized
taagacctataatctgaaaggc

SEQ ID NO: 909959 - DNA, 22 bp, Artificial Sequence
  chemically synthesized
aatgttccctcgcctttcagat

SEQ ID NO: 909960 - DNA, 22 bp, Artificial Sequence
  chemically synthesized
ttaagacctataatctgaaagg

SEQ ID NO: 909961 - DNA, 22 bp, Artificial Sequence
  chemically synthesized
atgttccctcgcctttcagatt

SEQ ID NO: 909962 - DNA, 22 bp, Artificial Sequence
  chemically synthesized
cctcgcctttcagattataggt

SEQ ID NO: 909963 - DNA, 22 bp, Artificial Sequence
  chemically synthesized
gcctttcagattataggtctta

SEQ ID NO: 909964 - DNA, 22 bp, Artificial Sequence
  chemically synthesized
acaggaggtttttaagacctat

SEQ ID NO: 909965 - DNA, 22 bp, Artificial Sequence
  chemically synthesized
taacaggaggtttttaagacct

SEQ ID NO: 909966 - DNA, 22 bp, Artificial Sequence
  chemically synthesized
tcagattataggtcttaaaaac

SEQ ID NO: 909967 - DNA, 22 bp, Artificial Sequence
  chemically synthesized
cagattataggtcttaaaaacc

SEQ ID NO: 909968 - DNA, 22 bp, Artificial Sequence
  chemically synthesized
agattataggtcttaaaaacct

SEQ ID NO: 909969 - DNA, 22 bp, Artificial Sequence
  chemically synthesized
taggtcttaaaaacctcctgtt

SEQ ID NO: 909970 - DNA, 22 bp, Artificial Sequence
  chemically synthesized
aaaaacctcctgttagagggtc

SEQ ID NO: 909971 - DNA, 22 bp, Artificial Sequence
  chemically synthesized
aaaacctcctgttagagggtcc

SEQ ID NO: 909972 - DNA, 22 bp, Artificial Sequence
  chemically synthesized
cccaagggtatatggtgggacc

SEQ ID NO: 909973 - DNA, 22 bp, Artificial Sequence
  chemically synthesized
ccccaagggtatatggtgggac

SEQ ID NO: 909974 - DNA, 22 bp, Artificial Sequence
  chemically synthesized
ctgttagagggtcccaccatat

SEQ ID NO: 909975 - DNA, 22 bp, Artificial Sequence
  chemically synthesized
cttccccaagggtatatggtgg

SEQ ID NO: 909976 - DNA, 22 bp, Artificial Sequence
  chemically synthesized
ttagagggtcccaccatatacc

SEQ ID NO: 909977 - DNA, 22 bp, Artificial Sequence
  chemically synthesized
gagggtcccaccatataccctt

SEQ ID NO: 909978 - DNA, 22 bp, Artificial Sequence
  chemically synthesized
atgacatcagcattccttcccc

SEQ ID NO: 909979 - DNA, 22 bp, Artificial Sequence
  chemically synthesized
catgacatcagcattccttccc

SEQ ID NO: 909980 - DNA, 22 bp, Artificial Sequence
  chemically synthesized
tggaagcttcatgacatcagca

SEQ ID NO: 909981 - DNA, 22 bp, Artificial Sequence
  chemically synthesized
atggaagcttcatgacatcagc

SEQ ID NO: 909982 - DNA, 22 bp, Artificial Sequence
  chemically synthesized
ggggaaggaatgctgatgtcat

SEQ ID NO: 909983 - DNA, 22 bp, Artificial Sequence
  chemically synthesized
tatggaagcttcatgacatcag

SEQ ID NO: 909984 - DNA, 22 bp, Artificial Sequence
  chemically synthesized
gggaaggaatgctgatgtcatg

SEQ ID NO: 909985 - DNA, 22 bp, Artificial Sequence
  chemically synthesized
ttatggaagcttcatgacatca

SEQ ID NO: 909986 - DNA, 22 bp, Artificial Sequence
  chemically synthesized
tttatggaagcttcatgacatc

SEQ ID NO: 909987 - DNA, 22 bp, Artificial Sequence
  chemically synthesized
ttttttatggaagcttcatgac

SEQ ID NO: 909988 - DNA, 22 bp, Artificial Sequence
  chemically synthesized
gttttttatggaagcttcatga

SEQ ID NO: 909989 - DNA, 22 bp, Artificial Sequence
  chemically synthesized
tgttttttatggaagcttcatg

SEQ ID NO: 909990 - DNA, 22 bp, Artificial Sequence
  chemically synthesized
tttgttttttatggaagcttca

SEQ ID NO: 909991 - DNA, 22 bp, Artificial Sequence
  chemically synthesized
tcctctttgttttttatggaag

SEQ ID NO: 909992 - DNA, 22 bp, Artificial Sequence
  chemically synthesized
atgtcatgaagcttccataaaa

SEQ ID NO: 909993 - DNA, 22 bp, Artificial Sequence
  chemically synthesized
tgtcctctttgttttttatgga

SEQ ID NO: 909994 - DNA, 22 bp, Artificial Sequence
  chemically synthesized
gactctgtcctctttgtttttt

SEQ ID NO: 909995 - DNA, 22 bp, Artificial Sequence
  chemically synthesized
actggactctgtcctctttgtt

SEQ ID NO: 909996 - DNA, 22 bp, Artificial Sequence
  chemically synthesized
ccataaaaaacaaagaggacag

SEQ ID NO: 909997 - DNA, 22 bp, Artificial Sequence
  chemically synthesized
cataaaaaacaaagaggacaga

SEQ ID NO: 909998 - DNA, 22 bp, Artificial Sequence
  chemically synthesized
cccggaagctcactggactctg

SEQ ID NO: 909999 - DNA, 22 bp, Artificial Sequence
  chemically synthesized
agctacccggaagctcactgga

SEQ ID NO: 910000 - DNA, 22 bp, Artificial Sequence
  chemically synthesized
ttcagctacccggaagctcact

SEQ ID NO: 910001 - DNA, 22 bp, Artificial Sequence
  chemically synthesized
ggaatccccacctgttcagcta

SEQ ID NO: 910002 - DNA, 22 bp, Artificial Sequence
  chemically synthesized
taggaatccccacctgttcagc

SEQ ID NO: 910003 - DNA, 22 bp, Artificial Sequence
  chemically synthesized
ccgggtagctgaacaggtgggg

SEQ ID NO: 910004 - DNA, 22 bp, Artificial Sequence
  chemically synthesized
cgggtagctgaacaggtgggga

SEQ ID NO: 910005 - DNA, 22 bp, Artificial Sequence
  chemically synthesized
agtgcaccaccctctaggaatc

SEQ ID NO: 910006 - DNA, 22 bp, Artificial Sequence
  chemically synthesized
aacaggtggggattcctagagg

SEQ ID NO: 910007 - DNA, 22 bp, Artificial Sequence
  chemically synthesized
cctgagtgcaccaccctctagg

SEQ ID NO: 910008 - DNA, 22 bp, Artificial Sequence
  chemically synthesized
catgccctccctgagtgcacca

SEQ ID NO: 910009 - DNA, 22 bp, Artificial Sequence
  chemically synthesized
ccatgccctccctgagtgcacc

SEQ ID NO: 910010 - DNA, 22 bp, Artificial Sequence
  chemically synthesized
ctagagggtggtgcactcaggg

SEQ ID NO: 910011 - DNA, 22 bp, Artificial Sequence
  chemically synthesized
gagggtggtgcactcagggagg

SEQ ID NO: 910012 - DNA, 22 bp, Artificial Sequence
  chemically synthesized
agggagggcatggaagctccat

SEQ ID NO: 910013 - DNA, 22 bp, Artificial Sequence
  chemically synthesized
gggtggagggacggaaaggggc

SEQ ID NO: 910014 - DNA, 22 bp, Artificial Sequence
  chemically synthesized
catgcccctttccgtccctcca

SEQ ID NO: 910015 - DNA, 22 bp, Artificial Sequence
  chemically synthesized
tccgtccctccaccccaaccat

SEQ ID NO: 910016 - DNA, 22 bp, Artificial Sequence
  chemically synthesized
ccgtccctccaccccaaccata

SEQ ID NO: 910017 - DNA, 22 bp, Artificial Sequence
  chemically synthesized
cgtccctccaccccaaccatac

SEQ ID NO: 910018 - DNA, 22 bp, Artificial Sequence
  chemically synthesized
caccccaaccatacctcaccct

SEQ ID NO: 910019 - DNA, 22 bp, Artificial Sequence
  chemically synthesized
caaaggacacagatgaagagat

SEQ ID NO: 910020 - DNA, 22 bp, Artificial Sequence
  chemically synthesized
accctatgcatctcttcatctg

SEQ ID NO: 910021 - DNA, 22 bp, Artificial Sequence
  chemically synthesized
tgcatctcttcatctgtgtcct

SEQ ID NO: 910022 - DNA, 22 bp, Artificial Sequence
  chemically synthesized
tgataaaggatattgcaaagga

SEQ ID NO: 910023 - DNA, 22 bp, Artificial Sequence
  chemically synthesized
atgataaaggatattgcaaagg

SEQ ID NO: 910024 - DNA, 22 bp, Artificial Sequence
  chemically synthesized
ttcatctgtgtcctttgcaata

SEQ ID NO: 910025 - DNA, 22 bp, Artificial Sequence
  chemically synthesized
catctgtgtcctttgcaatatc

SEQ ID NO: 910026 - DNA, 22 bp, Artificial Sequence
  chemically synthesized
tttatgataaaggatattgcaa

SEQ ID NO: 910027 - DNA, 22 bp, Artificial Sequence
  chemically synthesized
atctgtgtcctttgcaatatcc

SEQ ID NO: 910028 - DNA, 22 bp, Artificial Sequence
  chemically synthesized
acctgtttatgataaaggatat

SEQ ID NO: 910029 - DNA, 22 bp, Artificial Sequence
  chemically synthesized
tgtcctttgcaatatcctttat

SEQ ID NO: 910030 - DNA, 22 bp, Artificial Sequence
  chemically synthesized
cacctgtttatgataaaggata

SEQ ID NO: 910031 - DNA, 22 bp, Artificial Sequence
  chemically synthesized
tcacctgtttatgataaaggat

SEQ ID NO: 910032 - DNA, 22 bp, Artificial Sequence
  chemically synthesized
gctttcacctgtttatgataaa

SEQ ID NO: 910033 - DNA, 22 bp, Artificial Sequence
  chemically synthesized
tgcaatatcctttatcataaac

SEQ ID NO: 910034 - DNA, 22 bp, Artificial Sequence
  chemically synthesized
gcaatatcctttatcataaaca

SEQ ID NO: 910035 - DNA, 22 bp, Artificial Sequence
  chemically synthesized
caatatcctttatcataaacag

SEQ ID NO: 910036 - DNA, 22 bp, Artificial Sequence
  chemically synthesized
aggaaaacactcgctttcacct

SEQ ID NO: 910037 - DNA, 22 bp, Artificial Sequence
  chemically synthesized
tatcataaacaggtgaaagcga

SEQ ID NO: 910038 - DNA, 22 bp, Artificial Sequence
  chemically synthesized
atcataaacaggtgaaagcgag

SEQ ID NO: 910039 - DNA, 22 bp, Artificial Sequence
  chemically synthesized
tcataaacaggtgaaagcgagt

SEQ ID NO: 910040 - DNA, 22 bp, Artificial Sequence
  chemically synthesized
acagaactcaggaaaacactcg

SEQ ID NO: 910041 - DNA, 22 bp, Artificial Sequence
  chemically synthesized
gagcagctcacagaactcagga

SEQ ID NO: 910042 - DNA, 22 bp, Artificial Sequence
  chemically synthesized
ctggagcagctcacagaactca

SEQ ID NO: 910043 - DNA, 22 bp, Artificial Sequence
  chemically synthesized
gctggagcagctcacagaactc

SEQ ID NO: 910044 - DNA, 22 bp, Artificial Sequence
  chemically synthesized
acttgctggagcagctcacaga

SEQ ID NO: 910045 - DNA, 22 bp, Artificial Sequence
  chemically synthesized
tcctgagttctgtgagctgctc

SEQ ID NO: 910046 - DNA, 22 bp, Artificial Sequence
  chemically synthesized
cctgagttctgtgagctgctcc

SEQ ID NO: 910047 - DNA, 22 bp, Artificial Sequence
  chemically synthesized
aactaacttgctggagcagctc

SEQ ID NO: 910048 - DNA, 22 bp, Artificial Sequence
  chemically synthesized
ctgagttctgtgagctgctcca

SEQ ID NO: 910049 - DNA, 22 bp, Artificial Sequence
  chemically synthesized
agttctgtgagctgctccagca

SEQ ID NO: 910050 - DNA, 22 bp, Artificial Sequence
  chemically synthesized
ggttcaactaacttgctggagc

SEQ ID NO: 910051 - DNA, 22 bp, Artificial Sequence
  chemically synthesized
gggttcaactaacttgctggag

SEQ ID NO: 910052 - DNA, 22 bp, Artificial Sequence
  chemically synthesized
tgggttcaactaacttgctgga

SEQ ID NO: 910053 - DNA, 22 bp, Artificial Sequence
  chemically synthesized
tgtgagctgctccagcaagtta

SEQ ID NO: 910054 - DNA, 22 bp, Artificial Sequence
  chemically synthesized
tttgggttcaactaacttgctg

SEQ ID NO: 910055 - DNA, 22 bp, Artificial Sequence
  chemically synthesized
tgagctgctccagcaagttagt

SEQ ID NO: 910056 - DNA, 22 bp, Artificial Sequence
  chemically synthesized
tctttgggttcaactaacttgc

SEQ ID NO: 910057 - DNA, 22 bp, Artificial Sequence
  chemically synthesized
ctccagcaagttagttgaaccc

SEQ ID NO: 910058 - DNA, 22 bp, Artificial Sequence
  chemically synthesized
cagcaagttagttgaacccaaa

SEQ ID NO: 910059 - DNA, 22 bp, Artificial Sequence
  chemically synthesized
ccatgaccctctctttgggttc

SEQ ID NO: 910060 - DNA, 22 bp, Artificial Sequence
  chemically synthesized
gggttcccatgaccctctcttt

SEQ ID NO: 910061 - DNA, 22 bp, Artificial Sequence
  chemically synthesized
gttgaacccaaagagagggtca

SEQ ID NO: 910062 - DNA, 22 bp, Artificial Sequence
  chemically synthesized
aagttggggttcccatgaccct

SEQ ID NO: 910063 - DNA, 22 bp, Artificial Sequence
  chemically synthesized
aacccaaagagagggtcatggg

SEQ ID NO: 910064 - DNA, 22 bp, Artificial Sequence
  chemically synthesized
caagttggggttcccatgaccc

SEQ ID NO: 910065 - DNA, 22 bp, Artificial Sequence
  chemically synthesized
acccatgggcttcaagttgggg

SEQ ID NO: 910066 - DNA, 22 bp, Artificial Sequence
  chemically synthesized
tgacccatgggcttcaagttgg

SEQ ID NO: 910067 - DNA, 22 bp, Artificial Sequence
  chemically synthesized
ctgacccatgggcttcaagttg

SEQ ID NO: 910068 - DNA, 22 bp, Artificial Sequence
  chemically synthesized
gaacttctgacccatgggcttc

SEQ ID NO: 910069 - DNA, 22 bp, Artificial Sequence
  chemically synthesized
tggaacttctgacccatgggct

SEQ ID NO: 910070 - DNA, 22 bp, Artificial Sequence
  chemically synthesized
gaagcccatgggtcagaagttc

SEQ ID NO: 910071 - DNA, 22 bp, Artificial Sequence
  chemically synthesized
aagcccatgggtcagaagttcc

SEQ ID NO: 910072 - DNA, 22 bp, Artificial Sequence
  chemically synthesized
aagtccaggcctctggaacttc

SEQ ID NO: 910073 - DNA, 22 bp, Artificial Sequence
  chemically synthesized
cagaggcctggacttgagactg

SEQ ID NO: 910074 - DNA, 22 bp, Artificial Sequence
  chemically synthesized
gacttgagactggtgtgtgtgt

SEQ ID NO: 910075 - DNA, 22 bp, Artificial Sequence
  chemically synthesized
gagactggtgtgtgtgtgtgtg

SEQ ID NO: 910076 - DNA, 22 bp, Artificial Sequence
  chemically synthesized
agactggtgtgtgtgtgtgtgt

SEQ ID NO: 910077 - DNA, 22 bp, Artificial Sequence
  chemically synthesized
gtgtgtgtgtgtgtgtgtgtgt

SEQ ID NO: 910078 - DNA, 22 bp, Artificial Sequence
  chemically synthesized
gcgcacgcgcgcgcacacacac

SEQ ID NO: 910079 - DNA, 22 bp, Artificial Sequence
  chemically synthesized
cacccccctagcgcacgcgcgc

SEQ ID NO: 910080 - DNA, 22 bp, Artificial Sequence
  chemically synthesized
tgcacccccctagcgcacgcgc

SEQ ID NO: 910081 - DNA, 22 bp, Artificial Sequence
  chemically synthesized
ctctgcacccccctagcgcacg

SEQ ID NO: 910082 - DNA, 22 bp, Artificial Sequence
  chemically synthesized
cctcctctgcacccccctagcg

SEQ ID NO: 910083 - DNA, 22 bp, Artificial Sequence
  chemically synthesized
agtaccgaggtctgcctcctct

SEQ ID NO: 910084 - DNA, 22 bp, Artificial Sequence
  chemically synthesized
ggggggtgcagaggaggcagac

SEQ ID NO: 910085 - DNA, 22 bp, Artificial Sequence
  chemically synthesized
agggctcagtaccgaggtctgc

SEQ ID NO: 910086 - DNA, 22 bp, Artificial Sequence
  chemically synthesized
ggtactgagccctcaatctatg

SEQ ID NO: 910087 - DNA, 22 bp, Artificial Sequence
  chemically synthesized
agccctcaatctatgggatctg

SEQ ID NO: 910088 - DNA, 22 bp, Artificial Sequence
  chemically synthesized
tccacccagagatagtgtcaga

SEQ ID NO: 910089 - DNA, 22 bp, Artificial Sequence
  chemically synthesized
aatctatgggatctgacactat

SEQ ID NO: 910090 - DNA, 22 bp, Artificial Sequence
  chemically synthesized
acactatccacccagagatagt

SEQ ID NO: 910091 - DNA, 22 bp, Artificial Sequence
  chemically synthesized
tgggatctgacactatctctgg

SEQ ID NO: 910092 - DNA, 22 bp, Artificial Sequence
  chemically synthesized
agtcctgacactatccacccag

SEQ ID NO: 910093 - DNA, 22 bp, Artificial Sequence
  chemically synthesized
acactatctctgggtggatagt

SEQ ID NO: 910094 - DNA, 22 bp, Artificial Sequence
  chemically synthesized
attcagtcctgacactatccac

SEQ ID NO: 910095 - DNA, 22 bp, Artificial Sequence
  chemically synthesized
taattcagtcctgacactatcc

SEQ ID NO: 910096 - DNA, 22 bp, Artificial Sequence
  chemically synthesized
tctctgggtggatagtgtcagg

SEQ ID NO: 910097 - DNA, 22 bp, Artificial Sequence
  chemically synthesized
tgggtggatagtgtcaggactg

SEQ ID NO: 910098 - DNA, 22 bp, Artificial Sequence
  chemically synthesized
ggtgtctctaattcagtcctga

SEQ ID NO: 910099 - DNA, 22 bp, Artificial Sequence
  chemically synthesized
ggtggatagtgtcaggactgaa

SEQ ID NO: 910100 - DNA, 22 bp, Artificial Sequence
  chemically synthesized
aattagagacacccagctggtg

SEQ ID NO: 910101 - DNA, 22 bp, Artificial Sequence
  chemically synthesized
gagacacccagctggtgcctgc

SEQ ID NO: 910102 - DNA, 22 bp, Artificial Sequence
  chemically synthesized
cccatacaccaaacagcaggca

SEQ ID NO: 910103 - DNA, 22 bp, Artificial Sequence
  chemically synthesized
ccccatacaccaaacagcaggc

SEQ ID NO: 910104 - DNA, 22 bp, Artificial Sequence
  chemically synthesized
tccccatacaccaaacagcagg

SEQ ID NO: 910105 - DNA, 22 bp, Artificial Sequence
  chemically synthesized
ttccccatacaccaaacagcag

SEQ ID NO: 910106 - DNA, 22 bp, Artificial Sequence
  chemically synthesized
tttccccatacaccaaacagca

SEQ ID NO: 910107 - DNA, 22 bp, Artificial Sequence
  chemically synthesized
ttttccccatacaccaaacagc

SEQ ID NO: 910108 - DNA, 22 bp, Artificial Sequence
  chemically synthesized
gtgcctgctgtttggtgtatgg

SEQ ID NO: 910109 - DNA, 22 bp, Artificial Sequence
  chemically synthesized
tggaatttttttccccatacac

SEQ ID NO: 910110 - DNA, 22 bp, Artificial Sequence
  chemically synthesized
gtggaatttttttccccataca

SEQ ID NO: 910111 - DNA, 22 bp, Artificial Sequence
  chemically synthesized
ctgtttggtgtatggggaaaaa

SEQ ID NO: 910112 - DNA, 22 bp, Artificial Sequence
  chemically synthesized
tttggtgtatggggaaaaaaat

SEQ ID NO: 910113 - DNA, 22 bp, Artificial Sequence
  chemically synthesized
ggtgtatggggaaaaaaattcc

SEQ ID NO: 910114 - DNA, 22 bp, Artificial Sequence
  chemically synthesized
gtgtatggggaaaaaaattcca

SEQ ID NO: 910115 - DNA, 22 bp, Artificial Sequence
  chemically synthesized
tgaccaaatttgtggaattttt

SEQ ID NO: 910116 - DNA, 22 bp, Artificial Sequence
  chemically synthesized
atgaccaaatttgtggaatttt

SEQ ID NO: 910117 - DNA, 22 bp, Artificial Sequence
  chemically synthesized
tatgaccaaatttgtggaattt

SEQ ID NO: 910118 - DNA, 22 bp, Artificial Sequence
  chemically synthesized
ttatgaccaaatttgtggaatt

SEQ ID NO: 910119 - DNA, 22 bp, Artificial Sequence
  chemically synthesized
cacaaatttggtcataaaagtc

SEQ ID NO: 910120 - DNA, 22 bp, Artificial Sequence
  chemically synthesized
ggtcataaaagtcttcttctgt

SEQ ID NO: 910121 - DNA, 22 bp, Artificial Sequence
  chemically synthesized
gtcataaaagtcttcttctgtg

SEQ ID NO: 910122 - DNA, 22 bp, Artificial Sequence
  chemically synthesized
aaatcgtaacaatcgtcaacac

SEQ ID NO: 910123 - DNA, 22 bp, Artificial Sequence
  chemically synthesized
tcaaatcgtaacaatcgtcaac

SEQ ID NO: 910124 - DNA, 22 bp, Artificial Sequence
  chemically synthesized
ctctcaaatcgtaacaatcgtc

SEQ ID NO: 910125 - DNA, 22 bp, Artificial Sequence
  chemically synthesized
cttctgtgttgacgattgttac

SEQ ID NO: 910126 - DNA, 22 bp, Artificial Sequence
  chemically synthesized
tactctcaaatcgtaacaatcg

SEQ ID NO: 910127 - DNA, 22 bp, Artificial Sequence
  chemically synthesized
ttctgtgttgacgattgttacg

SEQ ID NO: 910128 - DNA, 22 bp, Artificial Sequence
  chemically synthesized
tctactctcaaatcgtaacaat

SEQ ID NO: 910129 - DNA, 22 bp, Artificial Sequence
  chemically synthesized
ctgtgttgacgattgttacgat

SEQ ID NO: 910130 - DNA, 22 bp, Artificial Sequence
  chemically synthesized
ctctactctcaaatcgtaacaa

SEQ ID NO: 910131 - DNA, 22 bp, Artificial Sequence
  chemically synthesized
tgtgttgacgattgttacgatt

SEQ ID NO: 910132 - DNA, 22 bp, Artificial Sequence
  chemically synthesized
tctctactctcaaatcgtaaca

SEQ ID NO: 910133 - DNA, 22 bp, Artificial Sequence
  chemically synthesized
ttctctactctcaaatcgtaac

SEQ ID NO: 910134 - DNA, 22 bp, Artificial Sequence
  chemically synthesized
tgttgacgattgttacgatttg

SEQ ID NO: 910135 - DNA, 22 bp, Artificial Sequence
  chemically synthesized
tttctctactctcaaatcgtaa

SEQ ID NO: 910136 - DNA, 22 bp, Artificial Sequence
  chemically synthesized
acgattgttacgatttgagagt

SEQ ID NO: 910137 - DNA, 22 bp, Artificial Sequence
  chemically synthesized
accgtgttttttctctactctc

SEQ ID NO: 910138 - DNA, 22 bp, Artificial Sequence
  chemically synthesized
taaccgtgttttttctctactc

SEQ ID NO: 910139 - DNA, 22 bp, Artificial Sequence
  chemically synthesized
ttacgatttgagagtagagaaa

SEQ ID NO: 910140 - DNA, 22 bp, Artificial Sequence
  chemically synthesized
ctaaccgtgttttttctctact

SEQ ID NO: 910141 - DNA, 22 bp, Artificial Sequence
  chemically synthesized
tctaaccgtgttttttctctac

SEQ ID NO: 910142 - DNA, 22 bp, Artificial Sequence
  chemically synthesized
cgatttgagagtagagaaaaaa

SEQ ID NO: 910143 - DNA, 22 bp, Artificial Sequence
  chemically synthesized
tttctaaccgtgttttttctct

SEQ ID NO: 910144 - DNA, 22 bp, Artificial Sequence
  chemically synthesized
gagagtagagaaaaaacacggt

SEQ ID NO: 910145 - DNA, 22 bp, Artificial Sequence
  chemically synthesized
agagtagagaaaaaacacggtt

SEQ ID NO: 910146 - DNA, 22 bp, Artificial Sequence
  chemically synthesized
tgtatggaaaattctttctaac

SEQ ID NO: 910147 - DNA, 22 bp, Artificial Sequence
  chemically synthesized
cgctgtgtatggaaaattcttt

SEQ ID NO: 910148 - DNA, 22 bp, Artificial Sequence
  chemically synthesized
aaatgttacgctgtgtatggaa

SEQ ID NO: 910149 - DNA, 22 bp, Artificial Sequence
  chemically synthesized
gaaagaattttccatacacagc

SEQ ID NO: 910150 - DNA, 22 bp, Artificial Sequence
  chemically synthesized
ttgaaatgttacgctgtgtatg

SEQ ID NO: 910151 - DNA, 22 bp, Artificial Sequence
  chemically synthesized
caaattattgaaatgttacgct

SEQ ID NO: 910152 - DNA, 22 bp, Artificial Sequence
  chemically synthesized
ccaaattattgaaatgttacgc

SEQ ID NO: 910153 - DNA, 22 bp, Artificial Sequence
  chemically synthesized
tccaaattattgaaatgttacg

SEQ ID NO: 910154 - DNA, 22 bp, Artificial Sequence
  chemically synthesized
tccatacacagcgtaacatttc

SEQ ID NO: 910155 - DNA, 22 bp, Artificial Sequence
  chemically synthesized
ccatacacagcgtaacatttca

SEQ ID NO: 910156 - DNA, 22 bp, Artificial Sequence
  chemically synthesized
catacacagcgtaacatttcaa

SEQ ID NO: 910157 - DNA, 22 bp, Artificial Sequence
  chemically synthesized
actttccaaattattgaaatgt

SEQ ID NO: 910158 - DNA, 22 bp, Artificial Sequence
  chemically synthesized
aactttccaaattattgaaatg

SEQ ID NO: 910159 - DNA, 22 bp, Artificial Sequence
  chemically synthesized
caataatttggaaagttaaatg

SEQ ID NO: 910160 - DNA, 22 bp, Artificial Sequence
  chemically synthesized
aataatttggaaagttaaatgt

SEQ ID NO: 910161 - DNA, 22 bp, Artificial Sequence
  chemically synthesized
ggaaagttaaatgtcacgtatt

SEQ ID NO: 910162 - DNA, 22 bp, Artificial Sequence
  chemically synthesized
gaaagttaaatgtcacgtattc

SEQ ID NO: 910163 - DNA, 22 bp, Artificial Sequence
  chemically synthesized
atgacaatagtatataagaata

SEQ ID NO: 910164 - DNA, 22 bp, Artificial Sequence
  chemically synthesized
aatgacaatagtatataagaat

SEQ ID NO: 910165 - DNA, 22 bp, Artificial Sequence
  chemically synthesized
taatgacaatagtatataagaa

SEQ ID NO: 910166 - DNA, 22 bp, Artificial Sequence
  chemically synthesized
aatgtcacgtattcttatatac

SEQ ID NO: 910167 - DNA, 22 bp, Artificial Sequence
  chemically synthesized
tttaatgacaatagtatataag

SEQ ID NO: 910168 - DNA, 22 bp, Artificial Sequence
  chemically synthesized
atcactctttaatgacaatagt

SEQ ID NO: 910169 - DNA, 22 bp, Artificial Sequence
  chemically synthesized
ttatatactattgtcattaaag

SEQ ID NO: 910170 - DNA, 22 bp, Artificial Sequence
  chemically synthesized
atatactattgtcattaaagag

SEQ ID NO: 910171 - DNA, 22 bp, Artificial Sequence
  chemically synthesized
ccgaattaatcactctttaatg

SEQ ID NO: 910172 - DNA, 22 bp, Artificial Sequence
  chemically synthesized
tatactattgtcattaaagagt

SEQ ID NO: 910173 - DNA, 22 bp, Artificial Sequence
  chemically synthesized
ttaccgaattaatcactcttta

SEQ ID NO: 910174 - DNA, 22 bp, Artificial Sequence
  chemically synthesized
ttgtcattaaagagtgattaat

SEQ ID NO: 910175 - DNA, 22 bp, Artificial Sequence
  chemically synthesized
ccattattaccgaattaatcac

SEQ ID NO: 910176 - DNA, 22 bp, Artificial Sequence
  chemically synthesized
tcattaaagagtgattaattcg

SEQ ID NO: 910177 - DNA, 22 bp, Artificial Sequence
  chemically synthesized
attgccattattaccgaattaa

SEQ ID NO: 910178 - DNA, 22 bp, Artificial Sequence
  chemically synthesized
aagagtgattaattcggtaata

SEQ ID NO: 910179 - DNA, 22 bp, Artificial Sequence
  chemically synthesized
tccaagaaatctgattgccatt

SEQ ID NO: 910180 - DNA, 22 bp, Artificial Sequence
  chemically synthesized
attcggtaataatggcaatcag

SEQ ID NO: 910181 - DNA, 22 bp, Artificial Sequence
  chemically synthesized
ggtaataatggcaatcagattt

SEQ ID NO: 910182 - DNA, 22 bp, Artificial Sequence
  chemically synthesized
ggcctatccaagaaatctgatt

SEQ ID NO: 910183 - DNA, 22 bp, Artificial Sequence
  chemically synthesized
cggcctatccaagaaatctgat

SEQ ID NO: 910184 - DNA, 22 bp, Artificial Sequence
  chemically synthesized
agaatttcggcctatccaagaa

SEQ ID NO: 910185 - DNA, 22 bp, Artificial Sequence
  chemically synthesized
agctgagaatttcggcctatcc

SEQ ID NO: 910186 - DNA, 22 bp, Artificial Sequence
  chemically synthesized
gttcagctgagaatttcggcct

SEQ ID NO: 910187 - DNA, 22 bp, Artificial Sequence
  chemically synthesized
agttcagctgagaatttcggcc

SEQ ID NO: 910188 - DNA, 22 bp, Artificial Sequence
  chemically synthesized
tagttcagctgagaatttcggc

SEQ ID NO: 910189 - DNA, 22 bp, Artificial Sequence
  chemically synthesized
cttggataggccgaaattctca

SEQ ID NO: 910190 - DNA, 22 bp, Artificial Sequence
  chemically synthesized
ttggataggccgaaattctcag

SEQ ID NO: 910191 - DNA, 22 bp, Artificial Sequence
  chemically synthesized
ggataggccgaaattctcagct

SEQ ID NO: 910192 - DNA, 22 bp, Artificial Sequence
  chemically synthesized
atactttagttcagctgagaat

SEQ ID NO: 910193 - DNA, 22 bp, Artificial Sequence
  chemically synthesized
gataggccgaaattctcagctg

SEQ ID NO: 910194 - DNA, 22 bp, Artificial Sequence
  chemically synthesized
ctaatactttagttcagctgag

SEQ ID NO: 910195 - DNA, 22 bp, Artificial Sequence
  chemically synthesized
cctaatactttagttcagctga

SEQ ID NO: 910196 - DNA, 22 bp, Artificial Sequence
  chemically synthesized
ccttcctaatactttagttcag

SEQ ID NO: 910197 - DNA, 22 bp, Artificial Sequence
  chemically synthesized
tcagctgaactaaagtattagg

SEQ ID NO: 910198 - DNA, 22 bp, Artificial Sequence
  chemically synthesized
agctgaactaaagtattaggaa

SEQ ID NO: 910199 - DNA, 22 bp, Artificial Sequence
  chemically synthesized
tcatcatcatctaccttcctaa

SEQ ID NO: 910200 - DNA, 22 bp, Artificial Sequence
  chemically synthesized
gtcatcatcatctaccttccta

SEQ ID NO: 910201 - DNA, 22 bp, Artificial Sequence
  chemically synthesized
aactaaagtattaggaaggtag

SEQ ID NO: 910202 - DNA, 22 bp, Artificial Sequence
  chemically synthesized
aagtattaggaaggtagatgat

SEQ ID NO: 910203 - DNA, 22 bp, Artificial Sequence
  chemically synthesized
ggaaggtagatgatgatgacaa

SEQ ID NO: 910204 - DNA, 22 bp, Artificial Sequence
  chemically synthesized
gtagcatcatcgtccttgtcat

SEQ ID NO: 910205 - DNA, 22 bp, Artificial Sequence
  chemically synthesized
agtagcatcatcgtccttgtca

SEQ ID NO: 910206 - DNA, 22 bp, Artificial Sequence
  chemically synthesized
ttagtagcatcatcgtccttgt

SEQ ID NO: 910207 - DNA, 22 bp, Artificial Sequence
  chemically synthesized
ttcttagtagcatcatcgtcct

SEQ ID NO: 910208 - DNA, 22 bp, Artificial Sequence
  chemically synthesized
gttcttagtagcatcatcgtcc

SEQ ID NO: 910209 - DNA, 22 bp, Artificial Sequence
  chemically synthesized
tgttcttagtagcatcatcgtc

SEQ ID NO: 910210 - DNA, 22 bp, Artificial Sequence
  chemically synthesized
ttgttcttagtagcatcatcgt

SEQ ID NO: 910211 - DNA, 22 bp, Artificial Sequence
  chemically synthesized
cttttgttcttagtagcatcat

SEQ ID NO: 910212 - DNA, 22 bp, Artificial Sequence
  chemically synthesized
tcatgattgcttttgttcttag

SEQ ID NO: 910213 - DNA, 22 bp, Artificial Sequence
  chemically synthesized
ttatcatgattgcttttgttct

SEQ ID NO: 910214 - DNA, 22 bp, Artificial Sequence
  chemically synthesized
ttattatcatgattgcttttgt

SEQ ID NO: 910215 - DNA, 22 bp, Artificial Sequence
  chemically synthesized
ctaagaacaaaagcaatcatga

SEQ ID NO: 910216 - DNA, 22 bp, Artificial Sequence
  chemically synthesized
aataactattattatcatgatt

SEQ ID NO: 910217 - DNA, 22 bp, Artificial Sequence
  chemically synthesized
agaacaaaagcaatcatgataa

SEQ ID NO: 910218 - DNA, 22 bp, Artificial Sequence
  chemically synthesized
gtccagtgctcaataactatta

SEQ ID NO: 910219 - DNA, 22 bp, Artificial Sequence
  chemically synthesized
ggtccagtgctcaataactatt

SEQ ID NO: 910220 - DNA, 22 bp, Artificial Sequence
  chemically synthesized
ggcttggtccagtgctcaataa

SEQ ID NO: 910221 - DNA, 22 bp, Artificial Sequence
  chemically synthesized
gagctaggcttggtccagtgct

SEQ ID NO: 910222 - DNA, 22 bp, Artificial Sequence
  chemically synthesized
agagctaggcttggtccagtgc

SEQ ID NO: 910223 - DNA, 22 bp, Artificial Sequence
  chemically synthesized
tagagctaggcttggtccagtg

SEQ ID NO: 910224 - DNA, 22 bp, Artificial Sequence
  chemically synthesized
ttagagctaggcttggtccagt

SEQ ID NO: 910225 - DNA, 22 bp, Artificial Sequence
  chemically synthesized
ttgagcactggaccaagcctag

SEQ ID NO: 910226 - DNA, 22 bp, Artificial Sequence
  chemically synthesized
agcactggaccaagcctagctc

SEQ ID NO: 910227 - DNA, 22 bp, Artificial Sequence
  chemically synthesized
gaccaagcctagctctaaaagc

SEQ ID NO: 910228 - DNA, 22 bp, Artificial Sequence
  chemically synthesized
tgagaacaaacatcaggctttt

SEQ ID NO: 910229 - DNA, 22 bp, Artificial Sequence
  chemically synthesized
gttatgagaacaaacatcaggc

SEQ ID NO: 910230 - DNA, 22 bp, Artificial Sequence
  chemically synthesized
tagttatgagaacaaacatcag

SEQ ID NO: 910231 - DNA, 22 bp, Artificial Sequence
  chemically synthesized
gctctaaaagcctgatgtttgt

SEQ ID NO: 910232 - DNA, 22 bp, Artificial Sequence
  chemically synthesized
taaaagcctgatgtttgttctc

SEQ ID NO: 910233 - DNA, 22 bp, Artificial Sequence
  chemically synthesized
aaagcctgatgtttgttctcat

SEQ ID NO: 910234 - DNA, 22 bp, Artificial Sequence
  chemically synthesized
atgtttgttctcataactagag

SEQ ID NO: 910235 - DNA, 22 bp, Artificial Sequence
  chemically synthesized
gttctcataactagagtgaccc

SEQ ID NO: 910236 - DNA, 22 bp, Artificial Sequence
  chemically synthesized
ttctcataactagagtgaccct

SEQ ID NO: 910237 - DNA, 22 bp, Artificial Sequence
  chemically synthesized
tcataactagagtgaccctctc

SEQ ID NO: 910238 - DNA, 22 bp, Artificial Sequence
  chemically synthesized
ataactagagtgaccctctcta

SEQ ID NO: 910239 - DNA, 22 bp, Artificial Sequence
  chemically synthesized
gaagataaaatatatagagagg

SEQ ID NO: 910240 - DNA, 22 bp, Artificial Sequence
  chemically synthesized
agaagataaaatatatagagag

SEQ ID NO: 910241 - DNA, 22 bp, Artificial Sequence
  chemically synthesized
tagaagataaaatatatagaga

SEQ ID NO: 910242 - DNA, 22 bp, Artificial Sequence
  chemically synthesized
gagtgaccctctctatatattt

SEQ ID NO: 910243 - DNA, 22 bp, Artificial Sequence
  chemically synthesized
cactttagaagataaaatatat

SEQ ID NO: 910244 - DNA, 22 bp, Artificial Sequence
  chemically synthesized
tctatatattttatcttctaaa

SEQ ID NO: 910245 - DNA, 22 bp, Artificial Sequence
  chemically synthesized
tatatattttatcttctaaagt

SEQ ID NO: 910246 - DNA, 22 bp, Artificial Sequence
  chemically synthesized
tcataagtattccactttagaa

SEQ ID NO: 910247 - DNA, 22 bp, Artificial Sequence
  chemically synthesized
tatattttatcttctaaagtgg

SEQ ID NO: 910248 - DNA, 22 bp, Artificial Sequence
  chemically synthesized
attgtcataagtattccacttt

SEQ ID NO: 910249 - DNA, 22 bp, Artificial Sequence
  chemically synthesized
cattgtcataagtattccactt

SEQ ID NO: 910250 - DNA, 22 bp, Artificial Sequence
  chemically synthesized
tcattgtcataagtattccact

SEQ ID NO: 910251 - DNA, 22 bp, Artificial Sequence
  chemically synthesized
tatcttctaaagtggaatactt

SEQ ID NO: 910252 - DNA, 22 bp, Artificial Sequence
  chemically synthesized
tttcattgtcataagtattcca

SEQ ID NO: 910253 - DNA, 22 bp, Artificial Sequence
  chemically synthesized
atcttctaaagtggaatactta

SEQ ID NO: 910254 - DNA, 22 bp, Artificial Sequence
  chemically synthesized
tcttctaaagtggaatacttat

SEQ ID NO: 910255 - DNA, 22 bp, Artificial Sequence
  chemically synthesized
cctctttcattgtcataagtat

SEQ ID NO: 910256 - DNA, 22 bp, Artificial Sequence
  chemically synthesized
ctaaagtggaatacttatgaca

SEQ ID NO: 910257 - DNA, 22 bp, Artificial Sequence
  chemically synthesized
taaagtggaatacttatgacaa

SEQ ID NO: 910258 - DNA, 22 bp, Artificial Sequence
  chemically synthesized
aagtggaatacttatgacaatg

SEQ ID NO: 910259 - DNA, 22 bp, Artificial Sequence
  chemically synthesized
atagctccctctttcattgtca

SEQ ID NO: 910260 - DNA, 22 bp, Artificial Sequence
  chemically synthesized
aatagctccctctttcattgtc

SEQ ID NO: 910261 - DNA, 22 bp, Artificial Sequence
  chemically synthesized
taatagctccctctttcattgt

SEQ ID NO: 910262 - DNA, 22 bp, Artificial Sequence
  chemically synthesized
ttaatagctccctctttcattg

SEQ ID NO: 910263 - DNA, 22 bp, Artificial Sequence
  chemically synthesized
atgacaatgaaagagggagcta

SEQ ID NO: 910264 - DNA, 22 bp, Artificial Sequence
  chemically synthesized
tgacaatgaaagagggagctat

SEQ ID NO: 910265 - DNA, 22 bp, Artificial Sequence
  chemically synthesized
tcataatttttaatagctccct

SEQ ID NO: 910266 - DNA, 22 bp, Artificial Sequence
  chemically synthesized
tcctatcataatttttaatagc

SEQ ID NO: 910267 - DNA, 22 bp, Artificial Sequence
  chemically synthesized
ttatcctatcataatttttaat

SEQ ID NO: 910268 - DNA, 22 bp, Artificial Sequence
  chemically synthesized
cctgttatcctatcataatttt

SEQ ID NO: 910269 - DNA, 22 bp, Artificial Sequence
  chemically synthesized
gcctgttatcctatcataattt

SEQ ID NO: 910270 - DNA, 22 bp, Artificial Sequence
  chemically synthesized
tgcctgttatcctatcataatt

SEQ ID NO: 910271 - DNA, 22 bp, Artificial Sequence
  chemically synthesized
ttgcctgttatcctatcataat

SEQ ID NO: 910272 - DNA, 22 bp, Artificial Sequence
  chemically synthesized
gtttttgcctgttatcctatca

SEQ ID NO: 910273 - DNA, 22 bp, Artificial Sequence
  chemically synthesized
ttaaaaattatgataggataac

SEQ ID NO: 910274 - DNA, 22 bp, Artificial Sequence
  chemically synthesized
tggtttttgcctgttatcctat

SEQ ID NO: 910275 - DNA, 22 bp, Artificial Sequence
  chemically synthesized
aaaattatgataggataacagg

SEQ ID NO: 910276 - DNA, 22 bp, Artificial Sequence
  chemically synthesized
ttctggtttttgcctgttatcc

SEQ ID NO: 910277 - DNA, 22 bp, Artificial Sequence
  chemically synthesized
actgttctggtttttgcctgtt

SEQ ID NO: 910278 - DNA, 22 bp, Artificial Sequence
  chemically synthesized
tgactgttctggtttttgcctg

SEQ ID NO: 910279 - DNA, 22 bp, Artificial Sequence
  chemically synthesized
tgataggataacaggcaaaaac

SEQ ID NO: 910280 - DNA, 22 bp, Artificial Sequence
  chemically synthesized
ctctgactgttctggtttttgc

SEQ ID NO: 910281 - DNA, 22 bp, Artificial Sequence
  chemically synthesized
gctctgactgttctggtttttg

SEQ ID NO: 910282 - DNA, 22 bp, Artificial Sequence
  chemically synthesized
aatttgctctgactgttctggt

SEQ ID NO: 910283 - DNA, 22 bp, Artificial Sequence
  chemically synthesized
tgtgtcatgagtacatctcaat

SEQ ID NO: 910284 - DNA, 22 bp, Artificial Sequence
  chemically synthesized
ggttgtgtgtcatgagtacatc

SEQ ID NO: 910285 - DNA, 22 bp, Artificial Sequence
  chemically synthesized
ctaggttgtgtgtcatgagtac

SEQ ID NO: 910286 - DNA, 22 bp, Artificial Sequence
  chemically synthesized
ttactaggttgtgtgtcatgag

SEQ ID NO: 910287 - DNA, 22 bp, Artificial Sequence
  chemically synthesized
attactaggttgtgtgtcatga

SEQ ID NO: 910288 - DNA, 22 bp, Artificial Sequence
  chemically synthesized
agatgtactcatgacacacaac

SEQ ID NO: 910289 - DNA, 22 bp, Artificial Sequence
  chemically synthesized
acatgaggtttattactaggtt

SEQ ID NO: 910290 - DNA, 22 bp, Artificial Sequence
  chemically synthesized
atgacacacaacctagtaataa

SEQ ID NO: 910291 - DNA, 22 bp, Artificial Sequence
  chemically synthesized
acactgacatgaggtttattac

SEQ ID NO: 910292 - DNA, 22 bp, Artificial Sequence
  chemically synthesized
cacactgacatgaggtttatta

SEQ ID NO: 910293 - DNA, 22 bp, Artificial Sequence
  chemically synthesized
taatttcacactgacatgaggt

SEQ ID NO: 910294 - DNA, 22 bp, Artificial Sequence
  chemically synthesized
ctataatttcacactgacatga

SEQ ID NO: 910295 - DNA, 22 bp, Artificial Sequence
  chemically synthesized
gtaataaacctcatgtcagtgt

SEQ ID NO: 910296 - DNA, 22 bp, Artificial Sequence
  chemically synthesized
cctcctataatttcacactgac

SEQ ID NO: 910297 - DNA, 22 bp, Artificial Sequence
  chemically synthesized
gcctcctataatttcacactga

SEQ ID NO: 910298 - DNA, 22 bp, Artificial Sequence
  chemically synthesized
tgcctcctataatttcacactg

SEQ ID NO: 910299 - DNA, 22 bp, Artificial Sequence
  chemically synthesized
actttgcctcctataatttcac

SEQ ID NO: 910300 - DNA, 22 bp, Artificial Sequence
  chemically synthesized
gactttgcctcctataatttca

SEQ ID NO: 910301 - DNA, 22 bp, Artificial Sequence
  chemically synthesized
atgtcagtgtgaaattatagga

SEQ ID NO: 910302 - DNA, 22 bp, Artificial Sequence
  chemically synthesized
taacataagcatccttgacttt

SEQ ID NO: 910303 - DNA, 22 bp, Artificial Sequence
  chemically synthesized
ataacataagcatccttgactt

SEQ ID NO: 910304 - DNA, 22 bp, Artificial Sequence
  chemically synthesized
taggaggcaaagtcaaggatgc

SEQ ID NO: 910305 - DNA, 22 bp, Artificial Sequence
  chemically synthesized
aagtttataacataagcatcct

SEQ ID NO: 910306 - DNA, 22 bp, Artificial Sequence
  chemically synthesized
aaagtttataacataagcatcc

SEQ ID NO: 910307 - DNA, 22 bp, Artificial Sequence
  chemically synthesized
atgttataaactttaaattact

SEQ ID NO: 910308 - DNA, 22 bp, Artificial Sequence
  chemically synthesized
ggggaagggagtagtaatttaa

SEQ ID NO: 910309 - DNA, 22 bp, Artificial Sequence
  chemically synthesized
tgttataaactttaaattacta

SEQ ID NO: 910310 - DNA, 22 bp, Artificial Sequence
  chemically synthesized
taaactttaaattactactccc

SEQ ID NO: 910311 - DNA, 22 bp, Artificial Sequence
  chemically synthesized
agggttgggggaagggagtagt

SEQ ID NO: 910312 - DNA, 22 bp, Artificial Sequence
  chemically synthesized
taaattactactcccttccccc

SEQ ID NO: 910313 - DNA, 22 bp, Artificial Sequence
  chemically synthesized
aagctgagggttgggggaaggg

SEQ ID NO: 910314 - DNA, 22 bp, Artificial Sequence
  chemically synthesized
aaattactactcccttccccca

SEQ ID NO: 910315 - DNA, 22 bp, Artificial Sequence
  chemically synthesized
gaagctgagggttgggggaagg

SEQ ID NO: 910316 - DNA, 22 bp, Artificial Sequence
  chemically synthesized
aattactactcccttcccccaa

SEQ ID NO: 910317 - DNA, 22 bp, Artificial Sequence
  chemically synthesized
ctactcccttcccccaaccctc

SEQ ID NO: 910318 - DNA, 22 bp, Artificial Sequence
  chemically synthesized
aacagtttgaagctgagggttg

SEQ ID NO: 910319 - DNA, 22 bp, Artificial Sequence
  chemically synthesized
ctcccttcccccaaccctcagc

SEQ ID NO: 910320 - DNA, 22 bp, Artificial Sequence
  chemically synthesized
ctaaacagtttgaagctgaggg

SEQ ID NO: 910321 - DNA, 22 bp, Artificial Sequence
  chemically synthesized
ccttcccccaaccctcagcttc

SEQ ID NO: 910322 - DNA, 22 bp, Artificial Sequence
  chemically synthesized
cccccaaccctcagcttcaaac

SEQ ID NO: 910323 - DNA, 22 bp, Artificial Sequence
  chemically synthesized
ccccaaccctcagcttcaaact

SEQ ID NO: 910324 - DNA, 22 bp, Artificial Sequence
  chemically synthesized
tagttgctaaacagtttgaagc

SEQ ID NO: 910325 - DNA, 22 bp, Artificial Sequence
  chemically synthesized
atagttgctaaacagtttgaag

SEQ ID NO: 910326 - DNA, 22 bp, Artificial Sequence
  chemically synthesized
atttatagttgctaaacagttt

SEQ ID NO: 910327 - DNA, 22 bp, Artificial Sequence
  chemically synthesized
taatttatagttgctaaacagt

SEQ ID NO: 910328 - DNA, 22 bp, Artificial Sequence
  chemically synthesized
agcttcaaactgtttagcaact

SEQ ID NO: 910329 - DNA, 22 bp, Artificial Sequence
  chemically synthesized
atatctctaatttatagttgct

SEQ ID NO: 910330 - DNA, 22 bp, Artificial Sequence
  chemically synthesized
caaactgtttagcaactataaa

SEQ ID NO: 910331 - DNA, 22 bp, Artificial Sequence
  chemically synthesized
aaactgtttagcaactataaat

SEQ ID NO: 910332 - DNA, 22 bp, Artificial Sequence
  chemically synthesized
tttagcaactataaattagaga

SEQ ID NO: 910333 - DNA, 22 bp, Artificial Sequence
  chemically synthesized
taaatattcatatctctaattt

SEQ ID NO: 910334 - DNA, 22 bp, Artificial Sequence
  chemically synthesized
agcaactataaattagagatat

SEQ ID NO: 910335 - DNA, 22 bp, Artificial Sequence
  chemically synthesized
gcaactataaattagagatatg

SEQ ID NO: 910336 - DNA, 22 bp, Artificial Sequence
  chemically synthesized
gcattataaatattcatatctc

SEQ ID NO: 910337 - DNA, 22 bp, Artificial Sequence
  chemically synthesized
ggcattataaatattcatatct

SEQ ID NO: 910338 - DNA, 22 bp, Artificial Sequence
  chemically synthesized
taaattagagatatgaatattt

SEQ ID NO: 910339 - DNA, 22 bp, Artificial Sequence
  chemically synthesized
tagggcttggcattataaatat

SEQ ID NO: 910340 - DNA, 22 bp, Artificial Sequence
  chemically synthesized
atagggcttggcattataaata

SEQ ID NO: 910341 - DNA, 22 bp, Artificial Sequence
  chemically synthesized
tatagggcttggcattataaat

SEQ ID NO: 910342 - DNA, 22 bp, Artificial Sequence
  chemically synthesized
gagatatgaatatttataatgc

SEQ ID NO: 910343 - DNA, 22 bp, Artificial Sequence
  chemically synthesized
ataatgccaagccctataaaat

SEQ ID NO: 910344 - DNA, 22 bp, Artificial Sequence
  chemically synthesized
taatgccaagccctataaaatt

SEQ ID NO: 910345 - DNA, 22 bp, Artificial Sequence
  chemically synthesized
aaggacatgcataattttatag

SEQ ID NO: 910346 - DNA, 22 bp, Artificial Sequence
  chemically synthesized
aaaggacatgcataattttata

SEQ ID NO: 910347 - DNA, 22 bp, Artificial Sequence
  chemically synthesized
tttaaaggacatgcataatttt

SEQ ID NO: 910348 - DNA, 22 bp, Artificial Sequence
  chemically synthesized
atttaaaggacatgcataattt

SEQ ID NO: 910349 - DNA, 22 bp, Artificial Sequence
  chemically synthesized
ccttatttaaaggacatgcata

SEQ ID NO: 910350 - DNA, 22 bp, Artificial Sequence
  chemically synthesized
cccttatttaaaggacatgcat

SEQ ID NO: 910351 - DNA, 22 bp, Artificial Sequence
  chemically synthesized
taaaattatgcatgtcctttaa

SEQ ID NO: 910352 - DNA, 22 bp, Artificial Sequence
  chemically synthesized
ccacccttcccttatttaaagg

SEQ ID NO: 910353 - DNA, 22 bp, Artificial Sequence
  chemically synthesized
cccacccttcccttatttaaag

SEQ ID NO: 910354 - DNA, 22 bp, Artificial Sequence
  chemically synthesized
tgcatgtcctttaaataaggga

SEQ ID NO: 910355 - DNA, 22 bp, Artificial Sequence
  chemically synthesized
taaataagggaagggtgggaag

SEQ ID NO: 910356 - DNA, 22 bp, Artificial Sequence
  chemically synthesized
aaataagggaagggtgggaagt

SEQ ID NO: 910357 - DNA, 22 bp, Artificial Sequence
  chemically synthesized
aataagggaagggtgggaagtg

SEQ ID NO: 910358 - DNA, 22 bp, Artificial Sequence
  chemically synthesized
agcatatcataatcacttccca

SEQ ID NO: 910359 - DNA, 22 bp, Artificial Sequence
  chemically synthesized
taagcatatcataatcacttcc

SEQ ID NO: 910360 - DNA, 22 bp, Artificial Sequence
  chemically synthesized
ttctaagcatatcataatcact

SEQ ID NO: 910361 - DNA, 22 bp, Artificial Sequence
  chemically synthesized
tgttctaagcatatcataatca

SEQ ID NO: 910362 - DNA, 22 bp, Artificial Sequence
  chemically synthesized
tgtgccacattctgttctaagc

SEQ ID NO: 910363 - DNA, 22 bp, Artificial Sequence
  chemically synthesized
ctatgtgccacattctgttcta

SEQ ID NO: 910364 - DNA, 22 bp, Artificial Sequence
  chemically synthesized
tgatatgcttagaacagaatgt

SEQ ID NO: 910365 - DNA, 22 bp, Artificial Sequence
  chemically synthesized
aaggactactatgtgccacatt

SEQ ID NO: 910366 - DNA, 22 bp, Artificial Sequence
  chemically synthesized
ttaaaggactactatgtgccac

SEQ ID NO: 910367 - DNA, 22 bp, Artificial Sequence
  chemically synthesized
agaacagaatgtggcacatagt

SEQ ID NO: 910368 - DNA, 22 bp, Artificial Sequence
  chemically synthesized
gaacagaatgtggcacatagta

SEQ ID NO: 910369 - DNA, 22 bp, Artificial Sequence
  chemically synthesized
tctattaaaggactactatgtg

SEQ ID NO: 910370 - DNA, 22 bp, Artificial Sequence
  chemically synthesized
aagagctatctattaaaggact

SEQ ID NO: 910371 - DNA, 22 bp, Artificial Sequence
  chemically synthesized
ttcaagagctatctattaaagg

SEQ ID NO: 910372 - DNA, 22 bp, Artificial Sequence
  chemically synthesized
attcaagagctatctattaaag

SEQ ID NO: 910373 - DNA, 22 bp, Artificial Sequence
  chemically synthesized
tttattcaagagctatctatta

SEQ ID NO: 910374 - DNA, 22 bp, Artificial Sequence
  chemically synthesized
aattatttattcaagagctatc

SEQ ID NO: 910375 - DNA, 22 bp, Artificial Sequence
  chemically synthesized
taattaaattatttattcaaga

SEQ ID NO: 910376 - DNA, 22 bp, Artificial Sequence
  chemically synthesized
taatagatagctcttgaataaa

SEQ ID NO: 910377 - DNA, 22 bp, Artificial Sequence
  chemically synthesized
aatagatagctcttgaataaat

SEQ ID NO: 910378 - DNA, 22 bp, Artificial Sequence
  chemically synthesized
atagatagctcttgaataaata

SEQ ID NO: 910379 - DNA, 22 bp, Artificial Sequence
  chemically synthesized
cagcaaagctgtaattaaatta

SEQ ID NO: 910380 - DNA, 22 bp, Artificial Sequence
  chemically synthesized
ttgaataaataatttaattaca

SEQ ID NO: 910381 - DNA, 22 bp, Artificial Sequence
  chemically synthesized
gaataaataatttaattacagc

SEQ ID NO: 910382 - DNA, 22 bp, Artificial Sequence
  chemically synthesized
aataaataatttaattacagct

SEQ ID NO: 910383 - DNA, 22 bp, Artificial Sequence
  chemically synthesized
ataattacagcaaagctgtaat

SEQ ID NO: 910384 - DNA, 22 bp, Artificial Sequence
  chemically synthesized
tgtagttaataattacagcaaa

SEQ ID NO: 910385 - DNA, 22 bp, Artificial Sequence
  chemically synthesized
atgtagttaataattacagcaa

SEQ ID NO: 910386 - DNA, 22 bp, Artificial Sequence
  chemically synthesized
tatgtagttaataattacagca

SEQ ID NO: 910387 - DNA, 22 bp, Artificial Sequence
  chemically synthesized
aattacagctttgctgtaatta

SEQ ID NO: 910388 - DNA, 22 bp, Artificial Sequence
  chemically synthesized
attacagctttgctgtaattat

SEQ ID NO: 910389 - DNA, 22 bp, Artificial Sequence
  chemically synthesized
tttatgtagttaataattacag

SEQ ID NO: 910390 - DNA, 22 bp, Artificial Sequence
  chemically synthesized
ctttatgtagttaataattaca

SEQ ID NO: 910391 - DNA, 22 bp, Artificial Sequence
  chemically synthesized
tctttatgtagttaataattac

SEQ ID NO: 910392 - DNA, 22 bp, Artificial Sequence
  chemically synthesized
cagctttgctgtaattattaac

SEQ ID NO: 910393 - DNA, 22 bp, Artificial Sequence
  chemically synthesized
gatgttttctttatgtagttaa

SEQ ID NO: 910394 - DNA, 22 bp, Artificial Sequence
  chemically synthesized
tgctgtaattattaactacata

SEQ ID NO: 910395 - DNA, 22 bp, Artificial Sequence
  chemically synthesized
ggatgttttctttatgtagtta

SEQ ID NO: 910396 - DNA, 22 bp, Artificial Sequence
  chemically synthesized
gctgtaattattaactacataa

SEQ ID NO: 910397 - DNA, 22 bp, Artificial Sequence
  chemically synthesized
ctgtaattattaactacataaa

SEQ ID NO: 910398 - DNA, 22 bp, Artificial Sequence
  chemically synthesized
tttggatgttttctttatgtag

SEQ ID NO: 910399 - DNA, 22 bp, Artificial Sequence
  chemically synthesized
taattattaactacataaagaa

SEQ ID NO: 910400 - DNA, 22 bp, Artificial Sequence
  chemically synthesized
ttaactacataaagaaaacatc

SEQ ID NO: 910401 - DNA, 22 bp, Artificial Sequence
  chemically synthesized
actacataaagaaaacatccaa

SEQ ID NO: 910402 - DNA, 22 bp, Artificial Sequence
  chemically synthesized
gaaatccattatttggatgttt

SEQ ID NO: 910403 - DNA, 22 bp, Artificial Sequence
  chemically synthesized
ctggaaatccattatttggatg

SEQ ID NO: 910404 - DNA, 22 bp, Artificial Sequence
  chemically synthesized
cataaagaaaacatccaaataa

SEQ ID NO: 910405 - DNA, 22 bp, Artificial Sequence
  chemically synthesized
tgtaagttcctggaaatccatt

SEQ ID NO: 910406 - DNA, 22 bp, Artificial Sequence
  chemically synthesized
atgtaagttcctggaaatccat

SEQ ID NO: 910407 - DNA, 22 bp, Artificial Sequence
  chemically synthesized
tatgtaagttcctggaaatcca

SEQ ID NO: 910408 - DNA, 22 bp, Artificial Sequence
  chemically synthesized
tttatgtaagttcctggaaatc

SEQ ID NO: 910409 - DNA, 22 bp, Artificial Sequence
  chemically synthesized
ctttatgtaagttcctggaaat

SEQ ID NO: 910410 - DNA, 22 bp, Artificial Sequence
  chemically synthesized
tctttatgtaagttcctggaaa

SEQ ID NO: 910411 - DNA, 22 bp, Artificial Sequence
  chemically synthesized
aatgttttctttatgtaagttc

SEQ ID NO: 910412 - DNA, 22 bp, Artificial Sequence
  chemically synthesized
gaatgttttctttatgtaagtt

SEQ ID NO: 910413 - DNA, 22 bp, Artificial Sequence
  chemically synthesized
tcttgaatgttttctttatgta

SEQ ID NO: 910414 - DNA, 22 bp, Artificial Sequence
  chemically synthesized
ccaggaacttacataaagaaaa

SEQ ID NO: 910415 - DNA, 22 bp, Artificial Sequence
  chemically synthesized
caggaacttacataaagaaaac

SEQ ID NO: 910416 - DNA, 22 bp, Artificial Sequence
  chemically synthesized
acataaagaaaacattcaagat

SEQ ID NO: 910417 - DNA, 22 bp, Artificial Sequence
  chemically synthesized
cataaagaaaacattcaagata

SEQ ID NO: 910418 - DNA, 22 bp, Artificial Sequence
  chemically synthesized
ccagaaacccattatcttgaat

SEQ ID NO: 910419 - DNA, 22 bp, Artificial Sequence
  chemically synthesized
atagttcccagaaacccattat

SEQ ID NO: 910420 - DNA, 22 bp, Artificial Sequence
  chemically synthesized
aagataatgggtttctgggaac

SEQ ID NO: 910421 - DNA, 22 bp, Artificial Sequence
  chemically synthesized
ggcatatagtctgatagttccc

SEQ ID NO: 910422 - DNA, 22 bp, Artificial Sequence
  chemically synthesized
ttgggcatatagtctgatagtt

SEQ ID NO: 910423 - DNA, 22 bp, Artificial Sequence
  chemically synthesized
attgggcatatagtctgatagt

SEQ ID NO: 910424 - DNA, 22 bp, Artificial Sequence
  chemically synthesized
tttattgggcatatagtctgat

SEQ ID NO: 910425 - DNA, 22 bp, Artificial Sequence
  chemically synthesized
ctgggaactatcagactatatg

SEQ ID NO: 910426 - DNA, 22 bp, Artificial Sequence
  chemically synthesized
tgggaactatcagactatatgc

SEQ ID NO: 910427 - DNA, 22 bp, Artificial Sequence
  chemically synthesized
acctatttattgggcatatagt

SEQ ID NO: 910428 - DNA, 22 bp, Artificial Sequence
  chemically synthesized
ggaactatcagactatatgccc

SEQ ID NO: 910429 - DNA, 22 bp, Artificial Sequence
  chemically synthesized
tcagactatatgcccaataaat

SEQ ID NO: 910430 - DNA, 22 bp, Artificial Sequence
  chemically synthesized
tatgcccaataaataggtgaac

SEQ ID NO: 910431 - DNA, 22 bp, Artificial Sequence
  chemically synthesized
aaaaaaaaaaaaaaaaaaaaaa

SEQ ID NO: 910432 - DNA, 22 bp, Artificial Sequence
  chemically synthesized
tctcaaaaaaaaaaaaaaaaaa

SEQ ID NO: 910433 - DNA, 22 bp, Artificial Sequence
  chemically synthesized
tatctcaaaaaaaaaaaaaaaa

SEQ ID NO: 910434 - DNA, 22 bp, Artificial Sequence
  chemically synthesized
ttttttttttttttttttttga

SEQ ID NO: 910435 - DNA, 22 bp, Artificial Sequence
  chemically synthesized
tttttttttttttttttttgag

SEQ ID NO: 910436 - DNA, 22 bp, Artificial Sequence
  chemically synthesized
ttttttttttttttttttgaga

SEQ ID NO: 910437 - DNA, 22 bp, Artificial Sequence
  chemically synthesized
tttttttttttttttttgagat

SEQ ID NO: 910438 - DNA, 22 bp, Artificial Sequence
  chemically synthesized
ttttttttttttttttgagata

SEQ ID NO: 910439 - DNA, 22 bp, Artificial Sequence
  chemically synthesized
tttttttttttttttgagatag

SEQ ID NO: 910440 - DNA, 22 bp, Artificial Sequence
  chemically synthesized
ttttttttttttttgagataga

SEQ ID NO: 910441 - DNA, 22 bp, Artificial Sequence
  chemically synthesized
tttttttttttttgagatagag

SEQ ID NO: 910442 - DNA, 22 bp, Artificial Sequence
  chemically synthesized
ttttttttttttgagatagagt

SEQ ID NO: 910443 - DNA, 22 bp, Artificial Sequence
  chemically synthesized
tttttttttttgagatagagtc

SEQ ID NO: 910444 - DNA, 22 bp, Artificial Sequence
  chemically synthesized
gcgacagagcaagactctatct

SEQ ID NO: 910445 - DNA, 22 bp, Artificial Sequence
  chemically synthesized
ttttttttttgagatagagtct

SEQ ID NO: 910446 - DNA, 22 bp, Artificial Sequence
  chemically synthesized
tttttttttgagatagagtctt

SEQ ID NO: 910447 - DNA, 22 bp, Artificial Sequence
  chemically synthesized
ttttttttgagatagagtcttg

SEQ ID NO: 910448 - DNA, 22 bp, Artificial Sequence
  chemically synthesized
tttttttgagatagagtcttgc

SEQ ID NO: 910449 - DNA, 22 bp, Artificial Sequence
  chemically synthesized
ttttttgagatagagtcttgct

SEQ ID NO: 910450 - DNA, 22 bp, Artificial Sequence
  chemically synthesized
tttttgagatagagtcttgctc

SEQ ID NO: 910451 - DNA, 22 bp, Artificial Sequence
  chemically synthesized
ttttgagatagagtcttgctct

SEQ ID NO: 910452 - DNA, 22 bp, Artificial Sequence
  chemically synthesized
cagcctggcgacagagcaagac

SEQ ID NO: 910453 - DNA, 22 bp, Artificial Sequence
  chemically synthesized
tttgagatagagtcttgctctg

SEQ ID NO: 910454 - DNA, 22 bp, Artificial Sequence
  chemically synthesized
ttgagatagagtcttgctctgt

SEQ ID NO: 910455 - DNA, 22 bp, Artificial Sequence
  chemically synthesized
tgagatagagtcttgctctgtc

SEQ ID NO: 910456 - DNA, 22 bp, Artificial Sequence
  chemically synthesized
gagatagagtcttgctctgtcg

SEQ ID NO: 910457 - DNA, 22 bp, Artificial Sequence
  chemically synthesized
agatagagtcttgctctgtcgc

SEQ ID NO: 910458 - DNA, 22 bp, Artificial Sequence
  chemically synthesized
tactccagcctggcgacagagc

SEQ ID NO: 910459 - DNA, 22 bp, Artificial Sequence
  chemically synthesized
gctctgtcgccaggctggagta

SEQ ID NO: 910460 - DNA, 22 bp, Artificial Sequence
  chemically synthesized
ctctgtcgccaggctggagtat

SEQ ID NO: 910461 - DNA, 22 bp, Artificial Sequence
  chemically synthesized
tgtcgccaggctggagtatagc

SEQ ID NO: 910462 - DNA, 22 bp, Artificial Sequence
  chemically synthesized
tcgccaggctggagtatagcgg

SEQ ID NO: 910463 - DNA, 22 bp, Artificial Sequence
  chemically synthesized
cagtgagccaagatcatgccgc

SEQ ID NO: 910464 - DNA, 22 bp, Artificial Sequence
  chemically synthesized
gagtatagcggcatgatcttgg

SEQ ID NO: 910465 - DNA, 22 bp, Artificial Sequence
  chemically synthesized
aaccagggagtaggaggttgca

SEQ ID NO: 910466 - DNA, 22 bp, Artificial Sequence
  chemically synthesized
gaaccagggagtaggaggttgc

SEQ ID NO: 910467 - DNA, 22 bp, Artificial Sequence
  chemically synthesized
ggctcactgcaacctcctactc

SEQ ID NO: 910468 - DNA, 22 bp, Artificial Sequence
  chemically synthesized
gctcactgcaacctcctactcc

SEQ ID NO: 910469 - DNA, 22 bp, Artificial Sequence
  chemically synthesized
actgcaacctcctactccctgg

SEQ ID NO: 910470 - DNA, 22 bp, Artificial Sequence
  chemically synthesized
caacctcctactccctggttca

SEQ ID NO: 910471 - DNA, 22 bp, Artificial Sequence
  chemically synthesized
aggcaggagaatcacttgaacc

SEQ ID NO: 910472 - DNA, 22 bp, Artificial Sequence
  chemically synthesized
ctactccctggttcaagtgatt

SEQ ID NO: 910473 - DNA, 22 bp, Artificial Sequence
  chemically synthesized
ctccctggttcaagtgattctc

SEQ ID NO: 910474 - DNA, 22 bp, Artificial Sequence
  chemically synthesized
ggaggctgaggcaggagaatca

SEQ ID NO: 910475 - DNA, 22 bp, Artificial Sequence
  chemically synthesized
cctggttcaagtgattctcctg

SEQ ID NO: 910476 - DNA, 22 bp, Artificial Sequence
  chemically synthesized
gggaggctgaggcaggagaatc

SEQ ID NO: 910477 - DNA, 22 bp, Artificial Sequence
  chemically synthesized
tttgggaggctgaggcaggaga

SEQ ID NO: 910478 - DNA, 22 bp, Artificial Sequence
  chemically synthesized
gttcaagtgattctcctgcctc

SEQ ID NO: 910479 - DNA, 22 bp, Artificial Sequence
  chemically synthesized
aagtgattctcctgcctcagcc

SEQ ID NO: 910480 - DNA, 22 bp, Artificial Sequence
  chemically synthesized
taatcccagctatttgggaggc

SEQ ID NO: 910481 - DNA, 22 bp, Artificial Sequence
  chemically synthesized
tcctgcctcagcctcccaaata

SEQ ID NO: 910482 - DNA, 22 bp, Artificial Sequence
  chemically synthesized
ctgcctcagcctcccaaatagc

SEQ ID NO: 910483 - DNA, 22 bp, Artificial Sequence
  chemically synthesized
cctcagcctcccaaatagctgg

SEQ ID NO: 910484 - DNA, 22 bp, Artificial Sequence
  chemically synthesized
agcctcccaaatagctgggatt

SEQ ID NO: 910485 - DNA, 22 bp, Artificial Sequence
  chemically synthesized
ccaaatagctgggattacagac

SEQ ID NO: 910486 - DNA, 22 bp, Artificial Sequence
  chemically synthesized
agcgtggtggcatgtgtctgta

SEQ ID NO: 910487 - DNA, 22 bp, Artificial Sequence
  chemically synthesized
gctgagcgtggtggcatgtgtc

SEQ ID NO: 910488 - DNA, 22 bp, Artificial Sequence
  chemically synthesized
ggattacagacacatgccacca

SEQ ID NO: 910489 - DNA, 22 bp, Artificial Sequence
  chemically synthesized
cagacacatgccaccacgctca

SEQ ID NO: 910490 - DNA, 22 bp, Artificial Sequence
  chemically synthesized
aaaatacaaaaattagctgagc

SEQ ID NO: 910491 - DNA, 22 bp, Artificial Sequence
  chemically synthesized
ttaaaaatacaaaaattagctg

SEQ ID NO: 910492 - DNA, 22 bp, Artificial Sequence
  chemically synthesized
tattaaaaatacaaaaattagc

SEQ ID NO: 910493 - DNA, 22 bp, Artificial Sequence
  chemically synthesized
cgtctctattaaaaatacaaaa

SEQ ID NO: 910494 - DNA, 22 bp, Artificial Sequence
  chemically synthesized
agctaatttttgtatttttaat

SEQ ID NO: 910495 - DNA, 22 bp, Artificial Sequence
  chemically synthesized
atttttgtatttttaatagaga

SEQ ID NO: 910496 - DNA, 22 bp, Artificial Sequence
  chemically synthesized
ttgtatttttaatagagacgga

SEQ ID NO: 910497 - DNA, 22 bp, Artificial Sequence
  chemically synthesized
tgtatttttaatagagacggag

SEQ ID NO: 910498 - DNA, 22 bp, Artificial Sequence
  chemically synthesized
gtatttttaatagagacggagt

SEQ ID NO: 910499 - DNA, 22 bp, Artificial Sequence
  chemically synthesized
tatttttaatagagacggagtt

SEQ ID NO: 910500 - DNA, 22 bp, Artificial Sequence
  chemically synthesized
ttaatagagacggagttttgcc

SEQ ID NO: 910501 - DNA, 22 bp, Artificial Sequence
  chemically synthesized
taatagagacggagttttgcca

SEQ ID NO: 910502 - DNA, 22 bp, Artificial Sequence
  chemically synthesized
aatagagacggagttttgccat

SEQ ID NO: 910503 - DNA, 22 bp, Artificial Sequence
  chemically synthesized
atagagacggagttttgccatg

SEQ ID NO: 910504 - DNA, 22 bp, Artificial Sequence
  chemically synthesized
tgccatgttggctgggatggtc

SEQ ID NO: 910505 - DNA, 22 bp, Artificial Sequence
  chemically synthesized
gccatgttggctgggatggtct

SEQ ID NO: 910506 - DNA, 22 bp, Artificial Sequence
  chemically synthesized
ccatgttggctgggatggtctc

SEQ ID NO: 910507 - DNA, 22 bp, Artificial Sequence
  chemically synthesized
gctgggatggtctcgatctcct

SEQ ID NO: 910508 - DNA, 22 bp, Artificial Sequence
  chemically synthesized
ggatggtctcgatctcctgacc

SEQ ID NO: 910509 - DNA, 22 bp, Artificial Sequence
  chemically synthesized
gatctcctgaccttgtgatctg

SEQ ID NO: 910510 - DNA, 22 bp, Artificial Sequence
  chemically synthesized
ggaggcccaggcgggcagatca

SEQ ID NO: 910511 - DNA, 22 bp, Artificial Sequence
  chemically synthesized
gggaggcccaggcgggcagatc

SEQ ID NO: 910512 - DNA, 22 bp, Artificial Sequence
  chemically synthesized
tgggaggcccaggcgggcagat

SEQ ID NO: 910513 - DNA, 22 bp, Artificial Sequence
  chemically synthesized
ctgaccttgtgatctgcccgcc

SEQ ID NO: 910514 - DNA, 22 bp, Artificial Sequence
  chemically synthesized
accttgtgatctgcccgcctgg

SEQ ID NO: 910515 - DNA, 22 bp, Artificial Sequence
  chemically synthesized
gtgatctgcccgcctgggcctc

SEQ ID NO: 910516 - DNA, 22 bp, Artificial Sequence
  chemically synthesized
tgatctgcccgcctgggcctcc

SEQ ID NO: 910517 - DNA, 22 bp, Artificial Sequence
  chemically synthesized
taatcccagcactttgggaggc

SEQ ID NO: 910518 - DNA, 22 bp, Artificial Sequence
  chemically synthesized
cccgcctgggcctcccaaagtg

SEQ ID NO: 910519 - DNA, 22 bp, Artificial Sequence
  chemically synthesized
acgcctgtaatcccagcacttt

SEQ ID NO: 910520 - DNA, 22 bp, Artificial Sequence
  chemically synthesized
ggcctcccaaagtgctgggatt

SEQ ID NO: 910521 - DNA, 22 bp, Artificial Sequence
  chemically synthesized
ccaaagtgctgggattacaggc

SEQ ID NO: 910522 - DNA, 22 bp, Artificial Sequence
  chemically synthesized
ggattacaggcgtgagccacca

SEQ ID NO: 910523 - DNA, 22 bp, Artificial Sequence
  chemically synthesized
caggcgtgagccaccacacccg

SEQ ID NO: 910524 - DNA, 22 bp, Artificial Sequence
  chemically synthesized
tataagaaaacgggccgggtgt

SEQ ID NO: 910525 - DNA, 22 bp, Artificial Sequence
  chemically synthesized
ttatataagaaaacgggccggg

SEQ ID NO: 910526 - DNA, 22 bp, Artificial Sequence
  chemically synthesized
aaacgctattatataagaaaac

SEQ ID NO: 910527 - DNA, 22 bp, Artificial Sequence
  chemically synthesized
tgtgctaaaacgctattatata

SEQ ID NO: 910528 - DNA, 22 bp, Artificial Sequence
  chemically synthesized
taaatctgtgtgctaaaacgct

SEQ ID NO: 910529 - DNA, 22 bp, Artificial Sequence
  chemically synthesized
tcttatataatagcgttttagc

SEQ ID NO: 910530 - DNA, 22 bp, Artificial Sequence
  chemically synthesized
ataaatctgtgtgctaaaacgc

SEQ ID NO: 910531 - DNA, 22 bp, Artificial Sequence
  chemically synthesized
cttatataatagcgttttagca

SEQ ID NO: 910532 - DNA, 22 bp, Artificial Sequence
  chemically synthesized
tataaatctgtgtgctaaaacg

SEQ ID NO: 910533 - DNA, 22 bp, Artificial Sequence
  chemically synthesized
ttatataatagcgttttagcac

SEQ ID NO: 910534 - DNA, 22 bp, Artificial Sequence
  chemically synthesized
atataatagcgttttagcacac

SEQ ID NO: 910535 - DNA, 22 bp, Artificial Sequence
  chemically synthesized
tataatagcgttttagcacaca

SEQ ID NO: 910536 - DNA, 22 bp, Artificial Sequence
  chemically synthesized
attttataaatctgtgtgctaa

SEQ ID NO: 910537 - DNA, 22 bp, Artificial Sequence
  chemically synthesized
aattttataaatctgtgtgcta

SEQ ID NO: 910538 - DNA, 22 bp, Artificial Sequence
  chemically synthesized
taattttataaatctgtgtgct

SEQ ID NO: 910539 - DNA, 22 bp, Artificial Sequence
  chemically synthesized
ttaattttataaatctgtgtgc

SEQ ID NO: 910540 - DNA, 22 bp, Artificial Sequence
  chemically synthesized
acacagtttttaattttataaa

SEQ ID NO: 910541 - DNA, 22 bp, Artificial Sequence
  chemically synthesized
tagcacacagatttataaaatt

SEQ ID NO: 910542 - DNA, 22 bp, Artificial Sequence
  chemically synthesized
agcacacagatttataaaatta

SEQ ID NO: 910543 - DNA, 22 bp, Artificial Sequence
  chemically synthesized
gcacacagatttataaaattaa

SEQ ID NO: 910544 - DNA, 22 bp, Artificial Sequence
  chemically synthesized
taacacagttcacacagttttt

SEQ ID NO: 910545 - DNA, 22 bp, Artificial Sequence
  chemically synthesized
gtaacacagttcacacagtttt

SEQ ID NO: 910546 - DNA, 22 bp, Artificial Sequence
  chemically synthesized
ataaaattaaaaactgtgtgaa

SEQ ID NO: 910547 - DNA, 22 bp, Artificial Sequence
  chemically synthesized
taaaattaaaaactgtgtgaac

SEQ ID NO: 910548 - DNA, 22 bp, Artificial Sequence
  chemically synthesized
aagtgtatttgtaacacagttc

SEQ ID NO: 910549 - DNA, 22 bp, Artificial Sequence
  chemically synthesized
gaagtgtatttgtaacacagtt

SEQ ID NO: 910550 - DNA, 22 bp, Artificial Sequence
  chemically synthesized
aaaactgtgtgaactgtgttac

SEQ ID NO: 910551 - DNA, 22 bp, Artificial Sequence
  chemically synthesized
ccttgaagtgtatttgtaacac

SEQ ID NO: 910552 - DNA, 22 bp, Artificial Sequence
  chemically synthesized
tcccttgaagtgtatttgtaac

SEQ ID NO: 910553 - DNA, 22 bp, Artificial Sequence
  chemically synthesized
ctcccttgaagtgtatttgtaa

SEQ ID NO: 910554 - DNA, 22 bp, Artificial Sequence
  chemically synthesized
tgtgaactgtgttacaaataca

SEQ ID NO: 910555 - DNA, 22 bp, Artificial Sequence
  chemically synthesized
tctcccttgaagtgtatttgta

SEQ ID NO: 910556 - DNA, 22 bp, Artificial Sequence
  chemically synthesized
atgattttctcccttgaagtgt

SEQ ID NO: 910557 - DNA, 22 bp, Artificial Sequence
  chemically synthesized
tgttacaaatacacttcaaggg

SEQ ID NO: 910558 - DNA, 22 bp, Artificial Sequence
  chemically synthesized
caaatacacttcaagggagaaa

SEQ ID NO: 910559 - DNA, 22 bp, Artificial Sequence
  chemically synthesized
tgtgctcatgattttctccctt

SEQ ID NO: 910560 - DNA, 22 bp, Artificial Sequence
  chemically synthesized
atgtgctcatgattttctccct

SEQ ID NO: 910561 - DNA, 22 bp, Artificial Sequence
  chemically synthesized
tatgtgctcatgattttctccc

SEQ ID NO: 910562 - DNA, 22 bp, Artificial Sequence
  chemically synthesized
ttatgtgctcatgattttctcc

SEQ ID NO: 910563 - DNA, 22 bp, Artificial Sequence
  chemically synthesized
gagcttttatgtgctcatgatt

SEQ ID NO: 910564 - DNA, 22 bp, Artificial Sequence
  chemically synthesized
caagggagaaaatcatgagcac

SEQ ID NO: 910565 - DNA, 22 bp, Artificial Sequence
  chemically synthesized
aagggagaaaatcatgagcaca

SEQ ID NO: 910566 - DNA, 22 bp, Artificial Sequence
  chemically synthesized
cactggagcttttatgtgctca

SEQ ID NO: 910567 - DNA, 22 bp, Artificial Sequence
  chemically synthesized
gcagggaccagatagttccact

SEQ ID NO: 910568 - DNA, 22 bp, Artificial Sequence
  chemically synthesized
agcagggaccagatagttccac

SEQ ID NO: 910569 - DNA, 22 bp, Artificial Sequence
  chemically synthesized
gaagtcttagcagggaccagat

SEQ ID NO: 910570 - DNA, 22 bp, Artificial Sequence
  chemically synthesized
cagtggaactatctggtccctg

SEQ ID NO: 910571 - DNA, 22 bp, Artificial Sequence
  chemically synthesized
gctggaagtcttagcagggacc

SEQ ID NO: 910572 - DNA, 22 bp, Artificial Sequence
  chemically synthesized
tagctggaagtcttagcaggga

SEQ ID NO: 910573 - DNA, 22 bp, Artificial Sequence
  chemically synthesized
tctagctggaagtcttagcagg

SEQ ID NO: 910574 - DNA, 22 bp, Artificial Sequence
  chemically synthesized
ctctagctggaagtcttagcag

SEQ ID NO: 910575 - DNA, 22 bp, Artificial Sequence
  chemically synthesized
tctggtccctgctaagacttcc

SEQ ID NO: 910576 - DNA, 22 bp, Artificial Sequence
  chemically synthesized
gtccctgctaagacttccagct

SEQ ID NO: 910577 - DNA, 22 bp, Artificial Sequence
  chemically synthesized
taggaaatcatttctctagctg

SEQ ID NO: 910578 - DNA, 22 bp, Artificial Sequence
  chemically synthesized
ctaagacttccagctagagaaa

SEQ ID NO: 910579 - DNA, 22 bp, Artificial Sequence
  chemically synthesized
agacttccagctagagaaatga

SEQ ID NO: 910580 - DNA, 22 bp, Artificial Sequence
  chemically synthesized
ccagctagagaaatgatttcct

SEQ ID NO: 910581 - DNA, 22 bp, Artificial Sequence
  chemically synthesized
cagctagagaaatgatttccta

SEQ ID NO: 910582 - DNA, 22 bp, Artificial Sequence
  chemically synthesized
gagaaatgatttcctataatga

SEQ ID NO: 910583 - DNA, 22 bp, Artificial Sequence
  chemically synthesized
cctataatgattattatacttc

SEQ ID NO: 910584 - DNA, 22 bp, Artificial Sequence
  chemically synthesized
ctataatgattattatacttcc

SEQ ID NO: 910585 - DNA, 22 bp, Artificial Sequence
  chemically synthesized
taaaatatatagtaggaagtat

SEQ ID NO: 910586 - DNA, 22 bp, Artificial Sequence
  chemically synthesized
taatgattattatacttcctac

SEQ ID NO: 910587 - DNA, 22 bp, Artificial Sequence
  chemically synthesized
ttatacttcctactatatattt

SEQ ID NO: 910588 - DNA, 22 bp, Artificial Sequence
  chemically synthesized
tacttcctactatatattttac

SEQ ID NO: 910589 - DNA, 22 bp, Artificial Sequence
  chemically synthesized
cctactatatattttacagcat

SEQ ID NO: 910590 - DNA, 22 bp, Artificial Sequence
  chemically synthesized
ctactatatattttacagcatt

SEQ ID NO: 910591 - DNA, 22 bp, Artificial Sequence
  chemically synthesized
ctatatattttacagcattttt

SEQ ID NO: 910592 - DNA, 22 bp, Artificial Sequence
  chemically synthesized
tatattttacagcatttttttt

SEQ ID NO: 910593 - DNA, 22 bp, Artificial Sequence
  chemically synthesized
tggaaccccggaaaaaaaaatg

SEQ ID NO: 910594 - DNA, 22 bp, Artificial Sequence
  chemically synthesized
atggaaccccggaaaaaaaaat

SEQ ID NO: 910595 - DNA, 22 bp, Artificial Sequence
  chemically synthesized
tacagcatttttttttccgggg

SEQ ID NO: 910596 - DNA, 22 bp, Artificial Sequence
  chemically synthesized
gtatttatggaaccccggaaaa

SEQ ID NO: 910597 - DNA, 22 bp, Artificial Sequence
  chemically synthesized
acagcatttttttttccggggt

SEQ ID NO: 910598 - DNA, 22 bp, Artificial Sequence
  chemically synthesized
cagcatttttttttccggggtt

SEQ ID NO: 910599 - DNA, 22 bp, Artificial Sequence
  chemically synthesized
actggtatttatggaaccccgg

SEQ ID NO: 910600 - DNA, 22 bp, Artificial Sequence
  chemically synthesized
ttttttccggggttccataaat

SEQ ID NO: 910601 - DNA, 22 bp, Artificial Sequence
  chemically synthesized
tttttccggggttccataaata

SEQ ID NO: 910602 - DNA, 22 bp, Artificial Sequence
  chemically synthesized
ttttccggggttccataaatac

SEQ ID NO: 910603 - DNA, 22 bp, Artificial Sequence
  chemically synthesized
ccatattgactggtatttatgg

SEQ ID NO: 910604 - DNA, 22 bp, Artificial Sequence
  chemically synthesized
tttccggggttccataaatacc

SEQ ID NO: 910605 - DNA, 22 bp, Artificial Sequence
  chemically synthesized
ttccggggttccataaatacca

SEQ ID NO: 910606 - DNA, 22 bp, Artificial Sequence
  chemically synthesized
tccggggttccataaataccag

SEQ ID NO: 910607 - DNA, 22 bp, Artificial Sequence
  chemically synthesized
ttaccatattgactggtattta

SEQ ID NO: 910608 - DNA, 22 bp, Artificial Sequence
  chemically synthesized
ccggggttccataaataccagt

SEQ ID NO: 910609 - DNA, 22 bp, Artificial Sequence
  chemically synthesized
cggggttccataaataccagtc

SEQ ID NO: 910610 - DNA, 22 bp, Artificial Sequence
  chemically synthesized
gcattgttaccatattgactgg

SEQ ID NO: 910611 - DNA, 22 bp, Artificial Sequence
  chemically synthesized
cataaataccagtcaatatggt

SEQ ID NO: 910612 - DNA, 22 bp, Artificial Sequence
  chemically synthesized
actggcattgttaccatattga

SEQ ID NO: 910613 - DNA, 22 bp, Artificial Sequence
  chemically synthesized
cactggcattgttaccatattg

SEQ ID NO: 910614 - DNA, 22 bp, Artificial Sequence
  chemically synthesized
aaccaaataatagaatcttcac

SEQ ID NO: 910615 - DNA, 22 bp, Artificial Sequence
  chemically synthesized
caaccaaataatagaatcttca

SEQ ID NO: 910616 - DNA, 22 bp, Artificial Sequence
  chemically synthesized
tcaaccaaataatagaatcttc

SEQ ID NO: 910617 - DNA, 22 bp, Artificial Sequence
  chemically synthesized
ttcaaccaaataatagaatctt

SEQ ID NO: 910618 - DNA, 22 bp, Artificial Sequence
  chemically synthesized
tttcaaccaaataatagaatct

SEQ ID NO: 910619 - DNA, 22 bp, Artificial Sequence
  chemically synthesized
acgtgatgttttttcaaccaaa

SEQ ID NO: 910620 - DNA, 22 bp, Artificial Sequence
  chemically synthesized
aacgtgatgttttttcaaccaa

SEQ ID NO: 910621 - DNA, 22 bp, Artificial Sequence
  chemically synthesized
cccttaacgtgatgttttttca

SEQ ID NO: 910622 - DNA, 22 bp, Artificial Sequence
  chemically synthesized
tattatttggttgaaaaaacat

SEQ ID NO: 910623 - DNA, 22 bp, Artificial Sequence
  chemically synthesized
ttatttggttgaaaaaacatca

SEQ ID NO: 910624 - DNA, 22 bp, Artificial Sequence
  chemically synthesized
tttggttgaaaaaacatcacgt

SEQ ID NO: 910625 - DNA, 22 bp, Artificial Sequence
  chemically synthesized
agtcctgcccttaacgtgatgt

SEQ ID NO: 910626 - DNA, 22 bp, Artificial Sequence
  chemically synthesized
ggttgaaaaaacatcacgttaa

SEQ ID NO: 910627 - DNA, 22 bp, Artificial Sequence
  chemically synthesized
gttgaaaaaacatcacgttaag

SEQ ID NO: 910628 - DNA, 22 bp, Artificial Sequence
  chemically synthesized
ccattcagtcctgcccttaacg

SEQ ID NO: 910629 - DNA, 22 bp, Artificial Sequence
  chemically synthesized
aaaaaacatcacgttaagggca

SEQ ID NO: 910630 - DNA, 22 bp, Artificial Sequence
  chemically synthesized
atagttaccattcagtcctgcc

SEQ ID NO: 910631 - DNA, 22 bp, Artificial Sequence
  chemically synthesized
taatagttaccattcagtcctg

SEQ ID NO: 910632 - DNA, 22 bp, Artificial Sequence
  chemically synthesized
ttctaatagttaccattcagtc

SEQ ID NO: 910633 - DNA, 22 bp, Artificial Sequence
  chemically synthesized
agggcaggactgaatggtaact

SEQ ID NO: 910634 - DNA, 22 bp, Artificial Sequence
  chemically synthesized
atagattgttctaatagttacc

SEQ ID NO: 910635 - DNA, 22 bp, Artificial Sequence
  chemically synthesized
aatggtaactattagaacaatc

SEQ ID NO: 910636 - DNA, 22 bp, Artificial Sequence
  chemically synthesized
tcacaagatgacgattaataga

SEQ ID NO: 910637 - DNA, 22 bp, Artificial Sequence
  chemically synthesized
ttagaacaatctattaatcgtc

SEQ ID NO: 910638 - DNA, 22 bp, Artificial Sequence
  chemically synthesized
ctatcacaagatgacgattaat

SEQ ID NO: 910639 - DNA, 22 bp, Artificial Sequence
  chemically synthesized
cctatcacaagatgacgattaa

SEQ ID NO: 910640 - DNA, 22 bp, Artificial Sequence
  chemically synthesized
gaacaatctattaatcgtcatc

SEQ ID NO: 910641 - DNA, 22 bp, Artificial Sequence
  chemically synthesized
ttaatcgtcatcttgtgatagg

SEQ ID NO: 910642 - DNA, 22 bp, Artificial Sequence
  chemically synthesized
tccaatcaatttcctatcacaa

SEQ ID NO: 910643 - DNA, 22 bp, Artificial Sequence
  chemically synthesized
gtccaatcaatttcctatcaca

SEQ ID NO: 910644 - DNA, 22 bp, Artificial Sequence
  chemically synthesized
tgtccaatcaatttcctatcac

SEQ ID NO: 910645 - DNA, 22 bp, Artificial Sequence
  chemically synthesized
atcgtcatcttgtgataggaaa

SEQ ID NO: 910646 - DNA, 22 bp, Artificial Sequence
  chemically synthesized
gtgataggaaattgattggaca

SEQ ID NO: 910647 - DNA, 22 bp, Artificial Sequence
  chemically synthesized
tgataggaaattgattggacaa

SEQ ID NO: 910648 - DNA, 22 bp, Artificial Sequence
  chemically synthesized
aaaaatggacactttgtccaat

SEQ ID NO: 910649 - DNA, 22 bp, Artificial Sequence
  chemically synthesized
ctcaaaaatggacactttgtcc

SEQ ID NO: 910650 - DNA, 22 bp, Artificial Sequence
  chemically synthesized
gctcaaaaatggacactttgtc

SEQ ID NO: 910651 - DNA, 22 bp, Artificial Sequence
  chemically synthesized
cttgctcaaaaatggacacttt

SEQ ID NO: 910652 - DNA, 22 bp, Artificial Sequence
  chemically synthesized
attggacaaagtgtccattttt

SEQ ID NO: 910653 - DNA, 22 bp, Artificial Sequence
  chemically synthesized
cgactccttgctcaaaaatgga

SEQ ID NO: 910654 - DNA, 22 bp, Artificial Sequence
  chemically synthesized
ccgactccttgctcaaaaatgg

SEQ ID NO: 910655 - DNA, 22 bp, Artificial Sequence
  chemically synthesized
tccgactccttgctcaaaaatg

SEQ ID NO: 910656 - DNA, 22 bp, Artificial Sequence
  chemically synthesized
gacaaagtgtccatttttgagc

SEQ ID NO: 910657 - DNA, 22 bp, Artificial Sequence
  chemically synthesized
gctttccgactccttgctcaaa

SEQ ID NO: 910658 - DNA, 22 bp, Artificial Sequence
  chemically synthesized
ggctttccgactccttgctcaa

SEQ ID NO: 910659 - DNA, 22 bp, Artificial Sequence
  chemically synthesized
gagcttggctttccgactcctt

SEQ ID NO: 910660 - DNA, 22 bp, Artificial Sequence
  chemically synthesized
ttgagcaaggagtcggaaagcc

SEQ ID NO: 910661 - DNA, 22 bp, Artificial Sequence
  chemically synthesized
tgagcaaggagtcggaaagcca

SEQ ID NO: 910662 - DNA, 22 bp, Artificial Sequence
  chemically synthesized
gagcaaggagtcggaaagccaa

SEQ ID NO: 910663 - DNA, 22 bp, Artificial Sequence
  chemically synthesized
agcaaggagtcggaaagccaag

SEQ ID NO: 910664 - DNA, 22 bp, Artificial Sequence
  chemically synthesized
aataaagctagagcttggcttt

SEQ ID NO: 910665 - DNA, 22 bp, Artificial Sequence
  chemically synthesized
tagctttatttaattttctcct

SEQ ID NO: 910666 - DNA, 22 bp, Artificial Sequence
  chemically synthesized
gctttatttaattttctccttt

SEQ ID NO: 910667 - DNA, 22 bp, Artificial Sequence
  chemically synthesized
tatttaattttctcctttttgc

SEQ ID NO: 910668 - DNA, 22 bp, Artificial Sequence
  chemically synthesized
atttaattttctcctttttgct

SEQ ID NO: 910669 - DNA, 22 bp, Artificial Sequence
  chemically synthesized
tttaattttctcctttttgcta

SEQ ID NO: 910670 - DNA, 22 bp, Artificial Sequence
  chemically synthesized
aattttctcctttttgctattc

SEQ ID NO: 910671 - DNA, 22 bp, Artificial Sequence
  chemically synthesized
attttctcctttttgctattca

SEQ ID NO: 910672 - DNA, 22 bp, Artificial Sequence
  chemically synthesized
tctcctttttgctattcacatt

SEQ ID NO: 910673 - DNA, 22 bp, Artificial Sequence
  chemically synthesized
gtcgtcagtataaatgtgaata

SEQ ID NO: 910674 - DNA, 22 bp, Artificial Sequence
  chemically synthesized
ctcctttttgctattcacattt

SEQ ID NO: 910675 - DNA, 22 bp, Artificial Sequence
  chemically synthesized
tcctttttgctattcacattta

SEQ ID NO: 910676 - DNA, 22 bp, Artificial Sequence
  chemically synthesized
ttagtcgtcagtataaatgtga

SEQ ID NO: 910677 - DNA, 22 bp, Artificial Sequence
  chemically synthesized
ctttttgctattcacatttata

SEQ ID NO: 910678 - DNA, 22 bp, Artificial Sequence
  chemically synthesized
tttgctattcacatttatactg

SEQ ID NO: 910679 - DNA, 22 bp, Artificial Sequence
  chemically synthesized
ttgctattcacatttatactga

SEQ ID NO: 910680 - DNA, 22 bp, Artificial Sequence
  chemically synthesized
tgctattcacatttatactgac

SEQ ID NO: 910681 - DNA, 22 bp, Artificial Sequence
  chemically synthesized
gctattcacatttatactgacg

SEQ ID NO: 910682 - DNA, 22 bp, Artificial Sequence
  chemically synthesized
ctattcacatttatactgacga

SEQ ID NO: 910683 - DNA, 22 bp, Artificial Sequence
  chemically synthesized
ttcacatttatactgacgacta

SEQ ID NO: 910684 - DNA, 22 bp, Artificial Sequence
  chemically synthesized
acatttatactgacgactaata

SEQ ID NO: 910685 - DNA, 22 bp, Artificial Sequence
  chemically synthesized
tgtaatgacagtcattattagt

SEQ ID NO: 910686 - DNA, 22 bp, Artificial Sequence
  chemically synthesized
atactgacgactaataatgact

SEQ ID NO: 910687 - DNA, 22 bp, Artificial Sequence
  chemically synthesized
ctatgtaatgacagtcattatt

SEQ ID NO: 910688 - DNA, 22 bp, Artificial Sequence
  chemically synthesized
tactgacgactaataatgactg

SEQ ID NO: 910689 - DNA, 22 bp, Artificial Sequence
  chemically synthesized
gctatgtaatgacagtcattat

SEQ ID NO: 910690 - DNA, 22 bp, Artificial Sequence
  chemically synthesized
acgactaataatgactgtcatt

SEQ ID NO: 910691 - DNA, 22 bp, Artificial Sequence
  chemically synthesized
cagacgtatttgctatgtaatg

SEQ ID NO: 910692 - DNA, 22 bp, Artificial Sequence
  chemically synthesized
ataatgactgtcattacatagc

SEQ ID NO: 910693 - DNA, 22 bp, Artificial Sequence
  chemically synthesized
ccagacgtatttgctatgtaat

SEQ ID NO: 910694 - DNA, 22 bp, Artificial Sequence
  chemically synthesized
tccagacgtatttgctatgtaa

SEQ ID NO: 910695 - DNA, 22 bp, Artificial Sequence
  chemically synthesized
ttccagacgtatttgctatgta

SEQ ID NO: 910696 - DNA, 22 bp, Artificial Sequence
  chemically synthesized
tttccagacgtatttgctatgt

SEQ ID NO: 910697 - DNA, 22 bp, Artificial Sequence
  chemically synthesized
gtctttttccagacgtatttgc

SEQ ID NO: 910698 - DNA, 22 bp, Artificial Sequence
  chemically synthesized
agtctttttccagacgtatttg

SEQ ID NO: 910699 - DNA, 22 bp, Artificial Sequence
  chemically synthesized
tcattacatagcaaatacgtct

SEQ ID NO: 910700 - DNA, 22 bp, Artificial Sequence
  chemically synthesized
catagcaaatacgtctggaaaa

SEQ ID NO: 910701 - DNA, 22 bp, Artificial Sequence
  chemically synthesized
tataaggtaaatgaatgtttag

SEQ ID NO: 910702 - DNA, 22 bp, Artificial Sequence
  chemically synthesized
gtataaggtaaatgaatgttta

SEQ ID NO: 910703 - DNA, 22 bp, Artificial Sequence
  chemically synthesized
gaaaaagactaaacattcattt

SEQ ID NO: 910704 - DNA, 22 bp, Artificial Sequence
  chemically synthesized
atttgtataaggtaaatgaatg

SEQ ID NO: 910705 - DNA, 22 bp, Artificial Sequence
  chemically synthesized
catttgtataaggtaaatgaat

SEQ ID NO: 910706 - DNA, 22 bp, Artificial Sequence
  chemically synthesized
tcatttgtataaggtaaatgaa

SEQ ID NO: 910707 - DNA, 22 bp, Artificial Sequence
  chemically synthesized
ttttcatttgtataaggtaaat

SEQ ID NO: 910708 - DNA, 22 bp, Artificial Sequence
  chemically synthesized
attttcatttgtataaggtaaa

SEQ ID NO: 910709 - DNA, 22 bp, Artificial Sequence
  chemically synthesized
aacattcatttaccttatacaa

SEQ ID NO: 910710 - DNA, 22 bp, Artificial Sequence
  chemically synthesized
agatttattttcatttgtataa

SEQ ID NO: 910711 - DNA, 22 bp, Artificial Sequence
  chemically synthesized
cagatttattttcatttgtata

SEQ ID NO: 910712 - DNA, 22 bp, Artificial Sequence
  chemically synthesized
atttaccttatacaaatgaaaa

SEQ ID NO: 910713 - DNA, 22 bp, Artificial Sequence
  chemically synthesized
accttatacaaatgaaaataaa

SEQ ID NO: 910714 - DNA, 22 bp, Artificial Sequence
  chemically synthesized
ccttatacaaatgaaaataaat

SEQ ID NO: 910715 - DNA, 22 bp, Artificial Sequence
  chemically synthesized
atacaaatgaaaataaatctga

SEQ ID NO: 910716 - DNA, 22 bp, Artificial Sequence
  chemically synthesized
tacaaatgaaaataaatctgaa

SEQ ID NO: 910717 - DNA, 22 bp, Artificial Sequence
  chemically synthesized
aggagtaaacatttcagattta

SEQ ID NO: 910718 - DNA, 22 bp, Artificial Sequence
  chemically synthesized
aatatgtatctgaggagtaaac

SEQ ID NO: 910719 - DNA, 22 bp, Artificial Sequence
  chemically synthesized
taaatatgtatctgaggagtaa

SEQ ID NO: 910720 - DNA, 22 bp, Artificial Sequence
  chemically synthesized
ctaaatatgtatctgaggagta

SEQ ID NO: 910721 - DNA, 22 bp, Artificial Sequence
  chemically synthesized
cttctaaatatgtatctgagga

SEQ ID NO: 910722 - DNA, 22 bp, Artificial Sequence
  chemically synthesized
aaatgtttactcctcagataca

SEQ ID NO: 910723 - DNA, 22 bp, Artificial Sequence
  chemically synthesized
atcatgttgcttctaaatatgt

SEQ ID NO: 910724 - DNA, 22 bp, Artificial Sequence
  chemically synthesized
actcctcagatacatatttaga

SEQ ID NO: 910725 - DNA, 22 bp, Artificial Sequence
  chemically synthesized
ctcctcagatacatatttagaa

SEQ ID NO: 910726 - DNA, 22 bp, Artificial Sequence
  chemically synthesized
taatcatgttgcttctaaatat

SEQ ID NO: 910727 - DNA, 22 bp, Artificial Sequence
  chemically synthesized
ctcagatacatatttagaagca

SEQ ID NO: 910728 - DNA, 22 bp, Artificial Sequence
  chemically synthesized
atctctaatcatgttgcttcta

SEQ ID NO: 910729 - DNA, 22 bp, Artificial Sequence
  chemically synthesized
agatacatatttagaagcaaca

SEQ ID NO: 910730 - DNA, 22 bp, Artificial Sequence
  chemically synthesized
tattaatctctaatcatgttgc

SEQ ID NO: 910731 - DNA, 22 bp, Artificial Sequence
  chemically synthesized
gtattaatctctaatcatgttg

SEQ ID NO: 910732 - DNA, 22 bp, Artificial Sequence
  chemically synthesized
tgtattaatctctaatcatgtt

SEQ ID NO: 910733 - DNA, 22 bp, Artificial Sequence
  chemically synthesized
attttgtattaatctctaatca

SEQ ID NO: 910734 - DNA, 22 bp, Artificial Sequence
  chemically synthesized
agaagcaacatgattagagatt

SEQ ID NO: 910735 - DNA, 22 bp, Artificial Sequence
  chemically synthesized
gaagcaacatgattagagatta

SEQ ID NO: 910736 - DNA, 22 bp, Artificial Sequence
  chemically synthesized
gttcattttgtattaatctcta

SEQ ID NO: 910737 - DNA, 22 bp, Artificial Sequence
  chemically synthesized
cagaaatctggttcattttgta

SEQ ID NO: 910738 - DNA, 22 bp, Artificial Sequence
  chemically synthesized
ccagaaatctggttcattttgt

SEQ ID NO: 910739 - DNA, 22 bp, Artificial Sequence
  chemically synthesized
gagattaatacaaaatgaacca

SEQ ID NO: 910740 - DNA, 22 bp, Artificial Sequence
  chemically synthesized
aatttccagaaatctggttcat

SEQ ID NO: 910741 - DNA, 22 bp, Artificial Sequence
  chemically synthesized
atacaaaatgaaccagatttct

SEQ ID NO: 910742 - DNA, 22 bp, Artificial Sequence
  chemically synthesized
tatctaaatttccagaaatctg

SEQ ID NO: 910743 - DNA, 22 bp, Artificial Sequence
  chemically synthesized
gctgtatctaaatttccagaaa

SEQ ID NO: 910744 - DNA, 22 bp, Artificial Sequence
  chemically synthesized
ctggaaatttagatacagccaa

SEQ ID NO: 910745 - DNA, 22 bp, Artificial Sequence
  chemically synthesized
cacaatatacagttggctgtat

SEQ ID NO: 910746 - DNA, 22 bp, Artificial Sequence
  chemically synthesized
tggaaatttagatacagccaac

SEQ ID NO: 910747 - DNA, 22 bp, Artificial Sequence
  chemically synthesized
ccacaatatacagttggctgta

SEQ ID NO: 910748 - DNA, 22 bp, Artificial Sequence
  chemically synthesized
gaaatttagatacagccaactg

SEQ ID NO: 910749 - DNA, 22 bp, Artificial Sequence
  chemically synthesized
tcttccacaatatacagttggc

SEQ ID NO: 910750 - DNA, 22 bp, Artificial Sequence
  chemically synthesized
agatacagccaactgtatattg

SEQ ID NO: 910751 - DNA, 22 bp, Artificial Sequence
  chemically synthesized
gatacagccaactgtatattgt

SEQ ID NO: 910752 - DNA, 22 bp, Artificial Sequence
  chemically synthesized
gcacaaactatcttccacaata

SEQ ID NO: 910753 - DNA, 22 bp, Artificial Sequence
  chemically synthesized
ctagcacaaactatcttccaca

SEQ ID NO: 910754 - DNA, 22 bp, Artificial Sequence
  chemically synthesized
tatattgtggaagatagtttgt

SEQ ID NO: 910755 - DNA, 22 bp, Artificial Sequence
  chemically synthesized
tggaagatagtttgtgctagga

SEQ ID NO: 910756 - DNA, 22 bp, Artificial Sequence
  chemically synthesized
tgaaagtaaaaatacagtgcaa

SEQ ID NO: 910757 - DNA, 22 bp, Artificial Sequence
  chemically synthesized
gtgctaggagttgcactgtatt

SEQ ID NO: 910758 - DNA, 22 bp, Artificial Sequence
  chemically synthesized
tgctaggagttgcactgtattt

SEQ ID NO: 910759 - DNA, 22 bp, Artificial Sequence
  chemically synthesized
ggagttgcactgtatttttact

SEQ ID NO: 910760 - DNA, 22 bp, Artificial Sequence
  chemically synthesized
cactgtatttttactttcataa

SEQ ID NO: 910761 - DNA, 22 bp, Artificial Sequence
  chemically synthesized
tatttttactttcataattttt

SEQ ID NO: 910762 - DNA, 22 bp, Artificial Sequence
  chemically synthesized
aaaaaatcaccaaataaaaatt

SEQ ID NO: 910763 - DNA, 22 bp, Artificial Sequence
  chemically synthesized
caaaaaatcaccaaataaaaat

SEQ ID NO: 910764 - DNA, 22 bp, Artificial Sequence
  chemically synthesized
ttactttcataatttttatttg

SEQ ID NO: 910765 - DNA, 22 bp, Artificial Sequence
  chemically synthesized
tcaaaaaatcaccaaataaaaa

SEQ ID NO: 910766 - DNA, 22 bp, Artificial Sequence
  chemically synthesized
tactttcataatttttatttgg

SEQ ID NO: 910767 - DNA, 22 bp, Artificial Sequence
  chemically synthesized
actttcataatttttatttggt

SEQ ID NO: 910768 - DNA, 22 bp, Artificial Sequence
  chemically synthesized
ctttcataatttttatttggtg

SEQ ID NO: 910769 - DNA, 22 bp, Artificial Sequence
  chemically synthesized
ttttcaaaaaatcaccaaataa

SEQ ID NO: 910770 - DNA, 22 bp, Artificial Sequence
  chemically synthesized
tcataatttttatttggtgatt

SEQ ID NO: 910771 - DNA, 22 bp, Artificial Sequence
  chemically synthesized
cataatttttatttggtgattt

SEQ ID NO: 910772 - DNA, 22 bp, Artificial Sequence
  chemically synthesized
ataatttttatttggtgatttt

SEQ ID NO: 910773 - DNA, 22 bp, Artificial Sequence
  chemically synthesized
ttatttggtgattttttgaaaa

SEQ ID NO: 910774 - DNA, 22 bp, Artificial Sequence
  chemically synthesized
tatttggtgattttttgaaaat

SEQ ID NO: 910775 - DNA, 22 bp, Artificial Sequence
  chemically synthesized
atttggtgattttttgaaaata

SEQ ID NO: 910776 - DNA, 22 bp, Artificial Sequence
  chemically synthesized
tttggtgattttttgaaaataa

SEQ ID NO: 910777 - DNA, 22 bp, Artificial Sequence
  chemically synthesized
ggtgattttttgaaaataatac

SEQ ID NO: 910778 - DNA, 22 bp, Artificial Sequence
  chemically synthesized
ataataatacaggtattatttt

SEQ ID NO: 910779 - DNA, 22 bp, Artificial Sequence
  chemically synthesized
gtgattttttgaaaataatacc

SEQ ID NO: 910780 - DNA, 22 bp, Artificial Sequence
  chemically synthesized
tttgaaaataatacctgtatta

SEQ ID NO: 910781 - DNA, 22 bp, Artificial Sequence
  chemically synthesized
taatattgataataatacaggt

SEQ ID NO: 910782 - DNA, 22 bp, Artificial Sequence
  chemically synthesized
ttgaaaataatacctgtattat

SEQ ID NO: 910783 - DNA, 22 bp, Artificial Sequence
  chemically synthesized
gtaatattgataataatacagg

SEQ ID NO: 910784 - DNA, 22 bp, Artificial Sequence
  chemically synthesized
tgaaaataatacctgtattatt

SEQ ID NO: 910785 - DNA, 22 bp, Artificial Sequence
  chemically synthesized
tgtaatattgataataatacag

SEQ ID NO: 910786 - DNA, 22 bp, Artificial Sequence
  chemically synthesized
gaaaataatacctgtattatta

SEQ ID NO: 910787 - DNA, 22 bp, Artificial Sequence
  chemically synthesized
ttgtaatattgataataataca

SEQ ID NO: 910788 - DNA, 22 bp, Artificial Sequence
  chemically synthesized
aaaataatacctgtattattat

SEQ ID NO: 910789 - DNA, 22 bp, Artificial Sequence
  chemically synthesized
tattattatcaatattacaaaa

SEQ ID NO: 910790 - DNA, 22 bp, Artificial Sequence
  chemically synthesized
atatgggaataatttttgtaat

SEQ ID NO: 910791 - DNA, 22 bp, Artificial Sequence
  chemically synthesized
aatatgggaataatttttgtaa

SEQ ID NO: 910792 - DNA, 22 bp, Artificial Sequence
  chemically synthesized
taatatgggaataatttttgta

SEQ ID NO: 910793 - DNA, 22 bp, Artificial Sequence
  chemically synthesized
ttatcaatattacaaaaattat

SEQ ID NO: 910794 - DNA, 22 bp, Artificial Sequence
  chemically synthesized
tcaatattacaaaaattattcc

SEQ ID NO: 910795 - DNA, 22 bp, Artificial Sequence
  chemically synthesized
caaaaattattcccatattaaa

SEQ ID NO: 910796 - DNA, 22 bp, Artificial Sequence
  chemically synthesized
ttcccatattaaaggtttgtta

SEQ ID NO: 910797 - DNA, 22 bp, Artificial Sequence
  chemically synthesized
ccatattaaaggtttgttatat

SEQ ID NO: 910798 - DNA, 22 bp, Artificial Sequence
  chemically synthesized
caaatacaacatatataacaaa

SEQ ID NO: 910799 - DNA, 22 bp, Artificial Sequence
  chemically synthesized
acaaatacaacatatataacaa

SEQ ID NO: 910800 - DNA, 22 bp, Artificial Sequence
  chemically synthesized
aaggtttgttatatatgttgta

SEQ ID NO: 910801 - DNA, 22 bp, Artificial Sequence
  chemically synthesized
gttatatatgttgtatttgtaa

SEQ ID NO: 910802 - DNA, 22 bp, Artificial Sequence
  chemically synthesized
ttatatatgttgtatttgtaaa

SEQ ID NO: 910803 - DNA, 22 bp, Artificial Sequence
  chemically synthesized
tatatgttgtatttgtaaacct

SEQ ID NO: 910804 - DNA, 22 bp, Artificial Sequence
  chemically synthesized
ccgaggaaaaaggtaggtttac

SEQ ID NO: 910805 - DNA, 22 bp, Artificial Sequence
  chemically synthesized
accgaggaaaaaggtaggttta

SEQ ID NO: 910806 - DNA, 22 bp, Artificial Sequence
  chemically synthesized
taccgaggaaaaaggtaggttt

SEQ ID NO: 910807 - DNA, 22 bp, Artificial Sequence
  chemically synthesized
actttaccgaggaaaaaggtag

SEQ ID NO: 910808 - DNA, 22 bp, Artificial Sequence
  chemically synthesized
tatttgtaaacctacctttttc

SEQ ID NO: 910809 - DNA, 22 bp, Artificial Sequence
  chemically synthesized
ttcactttaccgaggaaaaagg

SEQ ID NO: 910810 - DNA, 22 bp, Artificial Sequence
  chemically synthesized
attcactttaccgaggaaaaag

SEQ ID NO: 910811 - DNA, 22 bp, Artificial Sequence
  chemically synthesized
gtaaacctacctttttcctcgg

SEQ ID NO: 910812 - DNA, 22 bp, Artificial Sequence
  chemically synthesized
taaacctacctttttcctcggt

SEQ ID NO: 910813 - DNA, 22 bp, Artificial Sequence
  chemically synthesized
agtgcatcttattcactttacc

SEQ ID NO: 910814 - DNA, 22 bp, Artificial Sequence
  chemically synthesized
cctttttcctcggtaaagtgaa

SEQ ID NO: 910815 - DNA, 22 bp, Artificial Sequence
  chemically synthesized
gttaagtgcatcttattcactt

SEQ ID NO: 910816 - DNA, 22 bp, Artificial Sequence
  chemically synthesized
tttcctcggtaaagtgaataag

SEQ ID NO: 910817 - DNA, 22 bp, Artificial Sequence
  chemically synthesized
agttaagtgcatcttattcact

SEQ ID NO: 910818 - DNA, 22 bp, Artificial Sequence
  chemically synthesized
ttcctcggtaaagtgaataaga

SEQ ID NO: 910819 - DNA, 22 bp, Artificial Sequence
  chemically synthesized
tagttaagtgcatcttattcac

SEQ ID NO: 910820 - DNA, 22 bp, Artificial Sequence
  chemically synthesized
tcctcggtaaagtgaataagat

SEQ ID NO: 910821 - DNA, 22 bp, Artificial Sequence
  chemically synthesized
cctcggtaaagtgaataagatg

SEQ ID NO: 910822 - DNA, 22 bp, Artificial Sequence
  chemically synthesized
ctcggtaaagtgaataagatgc

SEQ ID NO: 910823 - DNA, 22 bp, Artificial Sequence
  chemically synthesized
ggtaaagtgaataagatgcact

SEQ ID NO: 910824 - DNA, 22 bp, Artificial Sequence
  chemically synthesized
gaaagtgaattttagttaagtg

SEQ ID NO: 910825 - DNA, 22 bp, Artificial Sequence
  chemically synthesized
gctggaaagtgaattttagtta

SEQ ID NO: 910826 - DNA, 22 bp, Artificial Sequence
  chemically synthesized
ggctggaaagtgaattttagtt

SEQ ID NO: 910827 - DNA, 22 bp, Artificial Sequence
  chemically synthesized
agaaatttggctggaaagtgaa

SEQ ID NO: 910828 - DNA, 22 bp, Artificial Sequence
  chemically synthesized
aactaaaattcactttccagcc

SEQ ID NO: 910829 - DNA, 22 bp, Artificial Sequence
  chemically synthesized
actaaaattcactttccagcca

SEQ ID NO: 910830 - DNA, 22 bp, Artificial Sequence
  chemically synthesized
aaattcactttccagccaaatt

SEQ ID NO: 910831 - DNA, 22 bp, Artificial Sequence
  chemically synthesized
gaaaacaattaagaaatttggc

SEQ ID NO: 910832 - DNA, 22 bp, Artificial Sequence
  chemically synthesized
ggaaaacaattaagaaatttgg

SEQ ID NO: 910833 - DNA, 22 bp, Artificial Sequence
  chemically synthesized
tggaaaacaattaagaaatttg

SEQ ID NO: 910834 - DNA, 22 bp, Artificial Sequence
  chemically synthesized
actttccagccaaatttcttaa

SEQ ID NO: 910835 - DNA, 22 bp, Artificial Sequence
  chemically synthesized
tccagccaaatttcttaattgt

SEQ ID NO: 910836 - DNA, 22 bp, Artificial Sequence
  chemically synthesized
ccagccaaatttcttaattgtt

SEQ ID NO: 910837 - DNA, 22 bp, Artificial Sequence
  chemically synthesized
cagccaaatttcttaattgttt

SEQ ID NO: 910838 - DNA, 22 bp, Artificial Sequence
  chemically synthesized
cttaattgttttccaaaatgct

SEQ ID NO: 910839 - DNA, 22 bp, Artificial Sequence
  chemically synthesized
ttaattgttttccaaaatgctt

SEQ ID NO: 910840 - DNA, 22 bp, Artificial Sequence
  chemically synthesized
aattgttttccaaaatgctttt

SEQ ID NO: 910841 - DNA, 22 bp, Artificial Sequence
  chemically synthesized
attgttttccaaaatgcttttt

SEQ ID NO: 910842 - DNA, 22 bp, Artificial Sequence
  chemically synthesized
ttttccaaaatgcttttttctt

SEQ ID NO: 910843 - DNA, 22 bp, Artificial Sequence
  chemically synthesized
tccaaaatgcttttttctttat

SEQ ID NO: 910844 - DNA, 22 bp, Artificial Sequence
  chemically synthesized
ccaaaatgcttttttctttatg

SEQ ID NO: 910845 - DNA, 22 bp, Artificial Sequence
  chemically synthesized
caaaatgcttttttctttatgt

SEQ ID NO: 910846 - DNA, 22 bp, Artificial Sequence
  chemically synthesized
ttttctttatgtgcaccatttt

SEQ ID NO: 910847 - DNA, 22 bp, Artificial Sequence
  chemically synthesized
cccagacagtataaaatggtgc

SEQ ID NO: 910848 - DNA, 22 bp, Artificial Sequence
  chemically synthesized
tttctttatgtgcaccatttta

SEQ ID NO: 910849 - DNA, 22 bp, Artificial Sequence
  chemically synthesized
ttctttatgtgcaccattttat

SEQ ID NO: 910850 - DNA, 22 bp, Artificial Sequence
  chemically synthesized
tctttatgtgcaccattttata

SEQ ID NO: 910851 - DNA, 22 bp, Artificial Sequence
  chemically synthesized
ctgcccagacagtataaaatgg

SEQ ID NO: 910852 - DNA, 22 bp, Artificial Sequence
  chemically synthesized
ctttatgtgcaccattttatac

SEQ ID NO: 910853 - DNA, 22 bp, Artificial Sequence
  chemically synthesized
tttatgtgcaccattttatact

SEQ ID NO: 910854 - DNA, 22 bp, Artificial Sequence
  chemically synthesized
ttactgcccagacagtataaaa

SEQ ID NO: 910855 - DNA, 22 bp, Artificial Sequence
  chemically synthesized
tatgtgcaccattttatactgt

SEQ ID NO: 910856 - DNA, 22 bp, Artificial Sequence
  chemically synthesized
gttactgcccagacagtataaa

SEQ ID NO: 910857 - DNA, 22 bp, Artificial Sequence
  chemically synthesized
atgtgcaccattttatactgtc

SEQ ID NO: 910858 - DNA, 22 bp, Artificial Sequence
  chemically synthesized
tgtgcaccattttatactgtct

SEQ ID NO: 910859 - DNA, 22 bp, Artificial Sequence
  chemically synthesized
aatttgttactgcccagacagt

SEQ ID NO: 910860 - DNA, 22 bp, Artificial Sequence
  chemically synthesized
gaatttgttactgcccagacag

SEQ ID NO: 910861 - DNA, 22 bp, Artificial Sequence
  chemically synthesized
tttgaatttgttactgcccaga

SEQ ID NO: 910862 - DNA, 22 bp, Artificial Sequence
  chemically synthesized
ctatttgaatttgttactgccc

SEQ ID NO: 910863 - DNA, 22 bp, Artificial Sequence
  chemically synthesized
tatactgtctgggcagtaacaa

SEQ ID NO: 910864 - DNA, 22 bp, Artificial Sequence
  chemically synthesized
atactgtctgggcagtaacaaa

SEQ ID NO: 910865 - DNA, 22 bp, Artificial Sequence
  chemically synthesized
tactgtctgggcagtaacaaat

SEQ ID NO: 910866 - DNA, 22 bp, Artificial Sequence
  chemically synthesized
tctgggcagtaacaaattcaaa

SEQ ID NO: 910867 - DNA, 22 bp, Artificial Sequence
  chemically synthesized
ggcagtaacaaattcaaatagt

SEQ ID NO: 910868 - DNA, 22 bp, Artificial Sequence
  chemically synthesized
tatgtaaatggtaaattactat

SEQ ID NO: 910869 - DNA, 22 bp, Artificial Sequence
  chemically synthesized
atatgtaaatggtaaattacta

SEQ ID NO: 910870 - DNA, 22 bp, Artificial Sequence
  chemically synthesized
tttatatgtaaatggtaaatta

SEQ ID NO: 910871 - DNA, 22 bp, Artificial Sequence
  chemically synthesized
aaatagtaatttaccatttaca

SEQ ID NO: 910872 - DNA, 22 bp, Artificial Sequence
  chemically synthesized
caaataagatatactgtttata

SEQ ID NO: 910873 - DNA, 22 bp, Artificial Sequence
  chemically synthesized
acaaataagatatactgtttat

SEQ ID NO: 910874 - DNA, 22 bp, Artificial Sequence
  chemically synthesized
accatttacatataaacagtat

SEQ ID NO: 910875 - DNA, 22 bp, Artificial Sequence
  chemically synthesized
ccatttacatataaacagtata

SEQ ID NO: 910876 - DNA, 22 bp, Artificial Sequence
  chemically synthesized
acatataaacagtatatcttat

SEQ ID NO: 910877 - DNA, 22 bp, Artificial Sequence
  chemically synthesized
catataaacagtatatcttatt

SEQ ID NO: 910878 - DNA, 22 bp, Artificial Sequence
  chemically synthesized
cacataaaataccatttacaaa

SEQ ID NO: 910879 - DNA, 22 bp, Artificial Sequence
  chemically synthesized
tctacacataaaataccattta

SEQ ID NO: 910880 - DNA, 22 bp, Artificial Sequence
  chemically synthesized
ctatctacacataaaataccat

SEQ ID NO: 910881 - DNA, 22 bp, Artificial Sequence
  chemically synthesized
actatctacacataaaatacca

SEQ ID NO: 910882 - DNA, 22 bp, Artificial Sequence
  chemically synthesized
atttgtaaatggtattttatgt

SEQ ID NO: 910883 - DNA, 22 bp, Artificial Sequence
  chemically synthesized
tttgtaaatggtattttatgtg

SEQ ID NO: 910884 - DNA, 22 bp, Artificial Sequence
  chemically synthesized
gtaaatggtattttatgtgtag

SEQ ID NO: 910885 - DNA, 22 bp, Artificial Sequence
  chemically synthesized
taaatggtattttatgtgtaga

SEQ ID NO: 910886 - DNA, 22 bp, Artificial Sequence
  chemically synthesized
catgtaaacagtaatttactat

SEQ ID NO: 910887 - DNA, 22 bp, Artificial Sequence
  chemically synthesized
acatgtaaacagtaatttacta

SEQ ID NO: 910888 - DNA, 22 bp, Artificial Sequence
  chemically synthesized
tacatgtaaacagtaatttact

SEQ ID NO: 910889 - DNA, 22 bp, Artificial Sequence
  chemically synthesized
tatgtgtagatagtaaattact

SEQ ID NO: 910890 - DNA, 22 bp, Artificial Sequence
  chemically synthesized
atgtgtagatagtaaattactg

SEQ ID NO: 910891 - DNA, 22 bp, Artificial Sequence
  chemically synthesized
tgtgtagatagtaaattactgt

SEQ ID NO: 910892 - DNA, 22 bp, Artificial Sequence
  chemically synthesized
atcgcattttacatgtaaacag

SEQ ID NO: 910893 - DNA, 22 bp, Artificial Sequence
  chemically synthesized
catcgcattttacatgtaaaca

SEQ ID NO: 910894 - DNA, 22 bp, Artificial Sequence
  chemically synthesized
tcatcgcattttacatgtaaac

SEQ ID NO: 910895 - DNA, 22 bp, Artificial Sequence
  chemically synthesized
ttcatcgcattttacatgtaaa

SEQ ID NO: 910896 - DNA, 22 bp, Artificial Sequence
  chemically synthesized
aatttttcatcgcattttacat

SEQ ID NO: 910897 - DNA, 22 bp, Artificial Sequence
  chemically synthesized
aaatttttcatcgcattttaca

SEQ ID NO: 910898 - DNA, 22 bp, Artificial Sequence
  chemically synthesized
ctgtttacatgtaaaatgcgat

SEQ ID NO: 910899 - DNA, 22 bp, Artificial Sequence
  chemically synthesized
tttacatgtaaaatgcgatgaa

SEQ ID NO: 910900 - DNA, 22 bp, Artificial Sequence
  chemically synthesized
acatgtaaaatgcgatgaaaaa

SEQ ID NO: 910901 - DNA, 22 bp, Artificial Sequence
  chemically synthesized
aataagtttaaatttttcatcg

SEQ ID NO: 910902 - DNA, 22 bp, Artificial Sequence
  chemically synthesized
catgtaaaatgcgatgaaaaat

SEQ ID NO: 910903 - DNA, 22 bp, Artificial Sequence
  chemically synthesized
ttaaataagtttaaatttttca

SEQ ID NO: 910904 - DNA, 22 bp, Artificial Sequence
  chemically synthesized
gttaaataagtttaaatttttc

SEQ ID NO: 910905 - DNA, 22 bp, Artificial Sequence
  chemically synthesized
tgttaaataagtttaaattttt

SEQ ID NO: 910906 - DNA, 22 bp, Artificial Sequence
  chemically synthesized
tcattttgttaaataagtttaa

SEQ ID NO: 910907 - DNA, 22 bp, Artificial Sequence
  chemically synthesized
ataaatatgttgtcattttgtt

SEQ ID NO: 910908 - DNA, 22 bp, Artificial Sequence
  chemically synthesized
aataaatatgttgtcattttgt

SEQ ID NO: 910909 - DNA, 22 bp, Artificial Sequence
  chemically synthesized
aaacttatttaacaaaatgaca

SEQ ID NO: 910910 - DNA, 22 bp, Artificial Sequence
  chemically synthesized
taataaatatgttgtcattttg

SEQ ID NO: 910911 - DNA, 22 bp, Artificial Sequence
  chemically synthesized
aacttatttaacaaaatgacaa

SEQ ID NO: 910912 - DNA, 22 bp, Artificial Sequence
  chemically synthesized
gttttaataaatatgttgtcat

SEQ ID NO: 910913 - DNA, 22 bp, Artificial Sequence
  chemically synthesized
atttaacaaaatgacaacatat

SEQ ID NO: 910914 - DNA, 22 bp, Artificial Sequence
  chemically synthesized
tttaacaaaatgacaacatatt

SEQ ID NO: 910915 - DNA, 22 bp, Artificial Sequence
  chemically synthesized
ttagttttaataaatatgttgt

SEQ ID NO: 910916 - DNA, 22 bp, Artificial Sequence
  chemically synthesized
aacaaaatgacaacatatttat

SEQ ID NO: 910917 - DNA, 22 bp, Artificial Sequence
  chemically synthesized
ctattagttttaataaatatgt

SEQ ID NO: 910918 - DNA, 22 bp, Artificial Sequence
  chemically synthesized
acaaaatgacaacatatttatt

SEQ ID NO: 910919 - DNA, 22 bp, Artificial Sequence
  chemically synthesized
tgcattcctattagttttaata

SEQ ID NO: 910920 - DNA, 22 bp, Artificial Sequence
  chemically synthesized
attaaaactaataggaatgcat

SEQ ID NO: 910921 - DNA, 22 bp, Artificial Sequence
  chemically synthesized
ttaaaactaataggaatgcata

SEQ ID NO: 910922 - DNA, 22 bp, Artificial Sequence
  chemically synthesized
caggtggtgtacgttatgcatt

SEQ ID NO: 910923 - DNA, 22 bp, Artificial Sequence
  chemically synthesized
aaactaataggaatgcataacg

SEQ ID NO: 910924 - DNA, 22 bp, Artificial Sequence
  chemically synthesized
acaggtggtgtacgttatgcat

SEQ ID NO: 910925 - DNA, 22 bp, Artificial Sequence
  chemically synthesized
tacaggtggtgtacgttatgca

SEQ ID NO: 910926 - DNA, 22 bp, Artificial Sequence
  chemically synthesized
ataggaatgcataacgtacacc

SEQ ID NO: 910927 - DNA, 22 bp, Artificial Sequence
  chemically synthesized
atgtcaagtaattttacaggtg

SEQ ID NO: 910928 - DNA, 22 bp, Artificial Sequence
  chemically synthesized
aatgtcaagtaattttacaggt

SEQ ID NO: 910929 - DNA, 22 bp, Artificial Sequence
  chemically synthesized
taatgtcaagtaattttacagg

SEQ ID NO: 910930 - DNA, 22 bp, Artificial Sequence
  chemically synthesized
ttaatgtcaagtaattttacag

SEQ ID NO: 910931 - DNA, 22 bp, Artificial Sequence
  chemically synthesized
tttttaatgtcaagtaatttta

SEQ ID NO: 910932 - DNA, 22 bp, Artificial Sequence
  chemically synthesized
ctatttttaatgtcaagtaatt

SEQ ID NO: 910933 - DNA, 22 bp, Artificial Sequence
  chemically synthesized
aaatcctactatttttaatgtc

SEQ ID NO: 910934 - DNA, 22 bp, Artificial Sequence
  chemically synthesized
taaaattacttgacattaaaaa

SEQ ID NO: 910935 - DNA, 22 bp, Artificial Sequence
  chemically synthesized
gttaaaatcctactatttttaa

SEQ ID NO: 910936 - DNA, 22 bp, Artificial Sequence
  chemically synthesized
cttgacattaaaaatagtagga

SEQ ID NO: 910937 - DNA, 22 bp, Artificial Sequence
  chemically synthesized
agaattagttaaaatcctacta

SEQ ID NO: 910938 - DNA, 22 bp, Artificial Sequence
  chemically synthesized
gacattaaaaatagtaggattt

SEQ ID NO: 910939 - DNA, 22 bp, Artificial Sequence
  chemically synthesized
cagaattagttaaaatcctact

SEQ ID NO: 910940 - DNA, 22 bp, Artificial Sequence
  chemically synthesized
acattaaaaatagtaggatttt

SEQ ID NO: 910941 - DNA, 22 bp, Artificial Sequence
  chemically synthesized
tttcagaattagttaaaatcct

SEQ ID NO: 910942 - DNA, 22 bp, Artificial Sequence
  chemically synthesized
aaaatagtaggattttaactaa

SEQ ID NO: 910943 - DNA, 22 bp, Artificial Sequence
  chemically synthesized
tgttgtttcagaattagttaaa

SEQ ID NO: 910944 - DNA, 22 bp, Artificial Sequence
  chemically synthesized
atgttgtttcagaattagttaa

SEQ ID NO: 910945 - DNA, 22 bp, Artificial Sequence
  chemically synthesized
taactaattctgaaacaacata

SEQ ID NO: 910946 - DNA, 22 bp, Artificial Sequence
  chemically synthesized
aactaattctgaaacaacataa

SEQ ID NO: 910947 - DNA, 22 bp, Artificial Sequence
  chemically synthesized
actaattctgaaacaacataaa

SEQ ID NO: 910948 - DNA, 22 bp, Artificial Sequence
  chemically synthesized
attctgaaacaacataaacatg

SEQ ID NO: 910949 - DNA, 22 bp, Artificial Sequence
  chemically synthesized
tgtaatatagcaaaacatgttt

SEQ ID NO: 910950 - DNA, 22 bp, Artificial Sequence
  chemically synthesized
tgaaacaacataaacatgtttt

SEQ ID NO: 910951 - DNA, 22 bp, Artificial Sequence
  chemically synthesized
aaacaacataaacatgttttgc

SEQ ID NO: 910952 - DNA, 22 bp, Artificial Sequence
  chemically synthesized
cagttgtgtaatatagcaaaac

SEQ ID NO: 910953 - DNA, 22 bp, Artificial Sequence
  chemically synthesized
acagttgtgtaatatagcaaaa

SEQ ID NO: 910954 - DNA, 22 bp, Artificial Sequence
  chemically synthesized
tggaacatttacagttgtgtaa

SEQ ID NO: 910955 - DNA, 22 bp, Artificial Sequence
  chemically synthesized
ctgtggaacatttacagttgtg

SEQ ID NO: 910956 - DNA, 22 bp, Artificial Sequence
  chemically synthesized
tgctatattacacaactgtaaa

SEQ ID NO: 910957 - DNA, 22 bp, Artificial Sequence
  chemically synthesized
tgctgtggaacatttacagttg

SEQ ID NO: 910958 - DNA, 22 bp, Artificial Sequence
  chemically synthesized
gctatattacacaactgtaaat

SEQ ID NO: 910959 - DNA, 22 bp, Artificial Sequence
  chemically synthesized
ctatattacacaactgtaaatg

SEQ ID NO: 910960 - DNA, 22 bp, Artificial Sequence
  chemically synthesized
tctgctgtggaacatttacagt

SEQ ID NO: 910961 - DNA, 22 bp, Artificial Sequence
  chemically synthesized
ctctgctgtggaacatttacag

SEQ ID NO: 910962 - DNA, 22 bp, Artificial Sequence
  chemically synthesized
tattacacaactgtaaatgttc

SEQ ID NO: 910963 - DNA, 22 bp, Artificial Sequence
  chemically synthesized
cacaactgtaaatgttccacag

SEQ ID NO: 910964 - DNA, 22 bp, Artificial Sequence
  chemically synthesized
gaaccttctctgctgtggaaca

SEQ ID NO: 910965 - DNA, 22 bp, Artificial Sequence
  chemically synthesized
tagaaccttctctgctgtggaa

SEQ ID NO: 910966 - DNA, 22 bp, Artificial Sequence
  chemically synthesized
ctagaaccttctctgctgtgga

SEQ ID NO: 910967 - DNA, 22 bp, Artificial Sequence
  chemically synthesized
tctagaaccttctctgctgtgg

SEQ ID NO: 910968 - DNA, 22 bp, Artificial Sequence
  chemically synthesized
ctttctagaaccttctctgctg

SEQ ID NO: 910969 - DNA, 22 bp, Artificial Sequence
  chemically synthesized
taaatgttccacagcagagaag

SEQ ID NO: 910970 - DNA, 22 bp, Artificial Sequence
  chemically synthesized
aaattactttctagaaccttct

SEQ ID NO: 910971 - DNA, 22 bp, Artificial Sequence
  chemically synthesized
aaaattactttctagaaccttc

SEQ ID NO: 910972 - DNA, 22 bp, Artificial Sequence
  chemically synthesized
taaaattactttctagaacctt

SEQ ID NO: 910973 - DNA, 22 bp, Artificial Sequence
  chemically synthesized
cacagcagagaaggttctagaa

SEQ ID NO: 910974 - DNA, 22 bp, Artificial Sequence
  chemically synthesized
tgttttaaaattactttctaga

SEQ ID NO: 910975 - DNA, 22 bp, Artificial Sequence
  chemically synthesized
gatgctgtgttttaaaattact

SEQ ID NO: 910976 - DNA, 22 bp, Artificial Sequence
  chemically synthesized
tagaaagtaattttaaaacaca

SEQ ID NO: 910977 - DNA, 22 bp, Artificial Sequence
  chemically synthesized
agaactagatgctgtgttttaa

SEQ ID NO: 910978 - DNA, 22 bp, Artificial Sequence
  chemically synthesized
gagaactagatgctgtgtttta

SEQ ID NO: 910979 - DNA, 22 bp, Artificial Sequence
  chemically synthesized
gaaagtaattttaaaacacagc

SEQ ID NO: 910980 - DNA, 22 bp, Artificial Sequence
  chemically synthesized
tgagaactagatgctgtgtttt

SEQ ID NO: 910981 - DNA, 22 bp, Artificial Sequence
  chemically synthesized
ttgagaactagatgctgtgttt

SEQ ID NO: 910982 - DNA, 22 bp, Artificial Sequence
  chemically synthesized
tttgagaactagatgctgtgtt

SEQ ID NO: 910983 - DNA, 22 bp, Artificial Sequence
  chemically synthesized
ccctttttgagaactagatgct

SEQ ID NO: 910984 - DNA, 22 bp, Artificial Sequence
  chemically synthesized
gccctttttgagaactagatgc

SEQ ID NO: 910985 - DNA, 22 bp, Artificial Sequence
  chemically synthesized
tgccctttttgagaactagatg

SEQ ID NO: 910986 - DNA, 22 bp, Artificial Sequence
  chemically synthesized
ttgccctttttgagaactagat

SEQ ID NO: 910987 - DNA, 22 bp, Artificial Sequence
  chemically synthesized
taaaacacagcatctagttctc

SEQ ID NO: 910988 - DNA, 22 bp, Artificial Sequence
  chemically synthesized
aaaacacagcatctagttctca

SEQ ID NO: 910989 - DNA, 22 bp, Artificial Sequence
  chemically synthesized
aaacacagcatctagttctcaa

SEQ ID NO: 910990 - DNA, 22 bp, Artificial Sequence
  chemically synthesized
gtttttgccctttttgagaact

SEQ ID NO: 910991 - DNA, 22 bp, Artificial Sequence
  chemically synthesized
ggtttttgccctttttgagaac

SEQ ID NO: 910992 - DNA, 22 bp, Artificial Sequence
  chemically synthesized
tggtttttgccctttttgagaa

SEQ ID NO: 910993 - DNA, 22 bp, Artificial Sequence
  chemically synthesized
ctttggtttttgccctttttga

SEQ ID NO: 910994 - DNA, 22 bp, Artificial Sequence
  chemically synthesized
gctttggtttttgccctttttg

SEQ ID NO: 910995 - DNA, 22 bp, Artificial Sequence
  chemically synthesized
tgctttggtttttgcccttttt

SEQ ID NO: 910996 - DNA, 22 bp, Artificial Sequence
  chemically synthesized
ttgctttggtttttgccctttt

SEQ ID NO: 910997 - DNA, 22 bp, Artificial Sequence
  chemically synthesized
gttctcaaaaagggcaaaaacc

SEQ ID NO: 910998 - DNA, 22 bp, Artificial Sequence
  chemically synthesized
tcaaaaagggcaaaaaccaaag

SEQ ID NO: 910999 - DNA, 22 bp, Artificial Sequence
  chemically synthesized
tatgagtttttgctttggtttt

SEQ ID NO: 911000 - DNA, 22 bp, Artificial Sequence
  chemically synthesized
aaaaagggcaaaaaccaaagca

SEQ ID NO: 911001 - DNA, 22 bp, Artificial Sequence
  chemically synthesized
aaaaaactatatgagtttttgc

SEQ ID NO: 911002 - DNA, 22 bp, Artificial Sequence
  chemically synthesized
aaaaaaactatatgagtttttg

SEQ ID NO: 911003 - DNA, 22 bp, Artificial Sequence
  chemically synthesized
taaaaaaactatatgagttttt

SEQ ID NO: 911004 - DNA, 22 bp, Artificial Sequence
  chemically synthesized
ttaaaaaaactatatgagtttt

SEQ ID NO: 911005 - DNA, 22 bp, Artificial Sequence
  chemically synthesized
ttttaaaaaaactatatgagtt

SEQ ID NO: 911006 - DNA, 22 bp, Artificial Sequence
  chemically synthesized
cttttaaaaaaactatatgagt

SEQ ID NO: 911007 - DNA, 22 bp, Artificial Sequence
  chemically synthesized
tcttttaaaaaaactatatgag

SEQ ID NO: 911008 - DNA, 22 bp, Artificial Sequence
  chemically synthesized
ttttcttttaaaaaaactatat

SEQ ID NO: 911009 - DNA, 22 bp, Artificial Sequence
  chemically synthesized
attttcttttaaaaaaactata

SEQ ID NO: 911010 - DNA, 22 bp, Artificial Sequence
  chemically synthesized
atatagtttttttaaaagaaaa

SEQ ID NO: 911011 - DNA, 22 bp, Artificial Sequence
  chemically synthesized
aaatggggatttattttctttt

SEQ ID NO: 911012 - DNA, 22 bp, Artificial Sequence
  chemically synthesized
atattaaaatggggatttattt

SEQ ID NO: 911013 - DNA, 22 bp, Artificial Sequence
  chemically synthesized
ttttaaaagaaaataaatcccc

SEQ ID NO: 911014 - DNA, 22 bp, Artificial Sequence
  chemically synthesized
tttaaaagaaaataaatcccca

SEQ ID NO: 911015 - DNA, 22 bp, Artificial Sequence
  chemically synthesized
ttaaaagaaaataaatccccat

SEQ ID NO: 911016 - DNA, 22 bp, Artificial Sequence
  chemically synthesized
taaaagaaaataaatccccatt

SEQ ID NO: 911017 - DNA, 22 bp, Artificial Sequence
  chemically synthesized
aaaagaaaataaatccccattt

SEQ ID NO: 911018 - DNA, 22 bp, Artificial Sequence
  chemically synthesized
aaagaaaataaatccccatttt

SEQ ID NO: 911019 - DNA, 22 bp, Artificial Sequence
  chemically synthesized
tgtggataatatcctaatatta

SEQ ID NO: 911020 - DNA, 22 bp, Artificial Sequence
  chemically synthesized
atgtggataatatcctaatatt

SEQ ID NO: 911021 - DNA, 22 bp, Artificial Sequence
  chemically synthesized
tatgtggataatatcctaatat

SEQ ID NO: 911022 - DNA, 22 bp, Artificial Sequence
  chemically synthesized
ttatgtggataatatcctaata

SEQ ID NO: 911023 - DNA, 22 bp, Artificial Sequence
  chemically synthesized
taatattaggatattatccaca

SEQ ID NO: 911024 - DNA, 22 bp, Artificial Sequence
  chemically synthesized
aagtgatttttatgtggataat

SEQ ID NO: 911025 - DNA, 22 bp, Artificial Sequence
  chemically synthesized
aatattaggatattatccacat

SEQ ID NO: 911026 - DNA, 22 bp, Artificial Sequence
  chemically synthesized
atattaggatattatccacata

SEQ ID NO: 911027 - DNA, 22 bp, Artificial Sequence
  chemically synthesized
ggatattatccacataaaaatc

SEQ ID NO: 911028 - DNA, 22 bp, Artificial Sequence
  chemically synthesized
gtgaagctcaagtgatttttat

SEQ ID NO: 911029 - DNA, 22 bp, Artificial Sequence
  chemically synthesized
ggtgaagctcaagtgattttta

SEQ ID NO: 911030 - DNA, 22 bp, Artificial Sequence
  chemically synthesized
tggtgaagctcaagtgattttt

SEQ ID NO: 911031 - DNA, 22 bp, Artificial Sequence
  chemically synthesized
ttggtgaagctcaagtgatttt

SEQ ID NO: 911032 - DNA, 22 bp, Artificial Sequence
  chemically synthesized
tccacataaaaatcacttgagc

SEQ ID NO: 911033 - DNA, 22 bp, Artificial Sequence
  chemically synthesized
accttttggtgaagctcaagtg

SEQ ID NO: 911034 - DNA, 22 bp, Artificial Sequence
  chemically synthesized
aaccttttggtgaagctcaagt

SEQ ID NO: 911035 - DNA, 22 bp, Artificial Sequence
  chemically synthesized
taaccttttggtgaagctcaag

SEQ ID NO: 911036 - DNA, 22 bp, Artificial Sequence
  chemically synthesized
gagcttcaccaaaaggttaaaa

SEQ ID NO: 911037 - DNA, 22 bp, Artificial Sequence
  chemically synthesized
agcttcaccaaaaggttaaaac

SEQ ID NO: 911038 - DNA, 22 bp, Artificial Sequence
  chemically synthesized
caccaaaaggttaaaaccccta

SEQ ID NO: 911039 - DNA, 22 bp, Artificial Sequence
  chemically synthesized
caaaataaacagtaggggtttt

SEQ ID NO: 911040 - DNA, 22 bp, Artificial Sequence
  chemically synthesized
accaaaaggttaaaacccctac

SEQ ID NO: 911041 - DNA, 22 bp, Artificial Sequence
  chemically synthesized
aaacccctactgtttattttgg

SEQ ID NO: 911042 - DNA, 22 bp, Artificial Sequence
  chemically synthesized
aatataaaagtgattccaaaat

SEQ ID NO: 911043 - DNA, 22 bp, Artificial Sequence
  chemically synthesized
aaatataaaagtgattccaaaa

SEQ ID NO: 911044 - DNA, 22 bp, Artificial Sequence
  chemically synthesized
tttaaatataaaagtgattcca

SEQ ID NO: 911045 - DNA, 22 bp, Artificial Sequence
  chemically synthesized
ctgtttattttggaatcacttt

SEQ ID NO: 911046 - DNA, 22 bp, Artificial Sequence
  chemically synthesized
tatttaaatataaaagtgattc

SEQ ID NO: 911047 - DNA, 22 bp, Artificial Sequence
  chemically synthesized
ctatttaaatataaaagtgatt

SEQ ID NO: 911048 - DNA, 22 bp, Artificial Sequence
  chemically synthesized
tctatttaaatataaaagtgat

SEQ ID NO: 911049 - DNA, 22 bp, Artificial Sequence
  chemically synthesized
tttattttggaatcacttttat

SEQ ID NO: 911050 - DNA, 22 bp, Artificial Sequence
  chemically synthesized
attttggaatcacttttatatt

SEQ ID NO: 911051 - DNA, 22 bp, Artificial Sequence
  chemically synthesized
ttttggaatcacttttatattt

SEQ ID NO: 911052 - DNA, 22 bp, Artificial Sequence
  chemically synthesized
tggaatcacttttatatttaaa

SEQ ID NO: 911053 - DNA, 22 bp, Artificial Sequence
  chemically synthesized
ggaatcacttttatatttaaat

SEQ ID NO: 911054 - DNA, 22 bp, Artificial Sequence
  chemically synthesized
gaatcacttttatatttaaata

SEQ ID NO: 911055 - DNA, 22 bp, Artificial Sequence
  chemically synthesized
agaccatgtagctttctattta

SEQ ID NO: 911056 - DNA, 22 bp, Artificial Sequence
  chemically synthesized
gagaccatgtagctttctattt

SEQ ID NO: 911057 - DNA, 22 bp, Artificial Sequence
  chemically synthesized
tttgagaccatgtagctttcta

SEQ ID NO: 911058 - DNA, 22 bp, Artificial Sequence
  chemically synthesized
ttatatttaaatagaaagctac

SEQ ID NO: 911059 - DNA, 22 bp, Artificial Sequence
  chemically synthesized
atttgagaccatgtagctttct

SEQ ID NO: 911060 - DNA, 22 bp, Artificial Sequence
  chemically synthesized
tatatttaaatagaaagctaca

SEQ ID NO: 911061 - DNA, 22 bp, Artificial Sequence
  chemically synthesized
atatttaaatagaaagctacat

SEQ ID NO: 911062 - DNA, 22 bp, Artificial Sequence
  chemically synthesized
tatttaaatagaaagctacatg

SEQ ID NO: 911063 - DNA, 22 bp, Artificial Sequence
  chemically synthesized
aaatagaaagctacatggtctc

SEQ ID NO: 911064 - DNA, 22 bp, Artificial Sequence
  chemically synthesized
tgtgacttatttgagaccatgt

SEQ ID NO: 911065 - DNA, 22 bp, Artificial Sequence
  chemically synthesized
aatagaaagctacatggtctca

SEQ ID NO: 911066 - DNA, 22 bp, Artificial Sequence
  chemically synthesized
gaaaggttatgtgacttatttg

SEQ ID NO: 911067 - DNA, 22 bp, Artificial Sequence
  chemically synthesized
catggtctcaaataagtcacat

SEQ ID NO: 911068 - DNA, 22 bp, Artificial Sequence
  chemically synthesized
aaataagtcacataacctttct

SEQ ID NO: 911069 - DNA, 22 bp, Artificial Sequence
  chemically synthesized
aacaccgagtcctagaaaggtt

SEQ ID NO: 911070 - DNA, 22 bp, Artificial Sequence
  chemically synthesized
gaacaccgagtcctagaaaggt

SEQ ID NO: 911071 - DNA, 22 bp, Artificial Sequence
  chemically synthesized
tgaacaccgagtcctagaaagg

SEQ ID NO: 911072 - DNA, 22 bp, Artificial Sequence
  chemically synthesized
ttgaacaccgagtcctagaaag

SEQ ID NO: 911073 - DNA, 22 bp, Artificial Sequence
  chemically synthesized
tttttgaacaccgagtcctaga

SEQ ID NO: 911074 - DNA, 22 bp, Artificial Sequence
  chemically synthesized
atttttgaacaccgagtcctag

SEQ ID NO: 911075 - DNA, 22 bp, Artificial Sequence
  chemically synthesized
tatttttgaacaccgagtccta

SEQ ID NO: 911076 - DNA, 22 bp, Artificial Sequence
  chemically synthesized
tttatttttgaacaccgagtcc

SEQ ID NO: 911077 - DNA, 22 bp, Artificial Sequence
  chemically synthesized
tcattctttatttttgaacacc

SEQ ID NO: 911078 - DNA, 22 bp, Artificial Sequence
  chemically synthesized
atcattctttatttttgaacac

SEQ ID NO: 911079 - DNA, 22 bp, Artificial Sequence
  chemically synthesized
tctaggactcggtgttcaaaaa

SEQ ID NO: 911080 - DNA, 22 bp, Artificial Sequence
  chemically synthesized
tatcattctttatttttgaaca

SEQ ID NO: 911081 - DNA, 22 bp, Artificial Sequence
  chemically synthesized
ctaggactcggtgttcaaaaat

SEQ ID NO: 911082 - DNA, 22 bp, Artificial Sequence
  chemically synthesized
taggactcggtgttcaaaaata

SEQ ID NO: 911083 - DNA, 22 bp, Artificial Sequence
  chemically synthesized
ggactcggtgttcaaaaataaa

SEQ ID NO: 911084 - DNA, 22 bp, Artificial Sequence
  chemically synthesized
ggtgttcaaaaataaagaatga

SEQ ID NO: 911085 - DNA, 22 bp, Artificial Sequence
  chemically synthesized
aaaccaaaatatgctttatcat

SEQ ID NO: 911086 - DNA, 22 bp, Artificial Sequence
  chemically synthesized
aaaaataaagaatgataaagca

SEQ ID NO: 911087 - DNA, 22 bp, Artificial Sequence
  chemically synthesized
aaaaccaaaatatgctttatca

SEQ ID NO: 911088 - DNA, 22 bp, Artificial Sequence
  chemically synthesized
tttaaaaccaaaatatgcttta

SEQ ID NO: 911089 - DNA, 22 bp, Artificial Sequence
  chemically synthesized
atttaaaaccaaaatatgcttt

SEQ ID NO: 911090 - DNA, 22 bp, Artificial Sequence
  chemically synthesized
cccatttatttaaaaccaaaat

SEQ ID NO: 911091 - DNA, 22 bp, Artificial Sequence
  chemically synthesized
actacccatttatttaaaacca

SEQ ID NO: 911092 - DNA, 22 bp, Artificial Sequence
  chemically synthesized
aactacccatttatttaaaacc

SEQ ID NO: 911093 - DNA, 22 bp, Artificial Sequence
  chemically synthesized
taactacccatttatttaaaac

SEQ ID NO: 911094 - DNA, 22 bp, Artificial Sequence
  chemically synthesized
ttaactacccatttatttaaaa

SEQ ID NO: 911095 - DNA, 22 bp, Artificial Sequence
  chemically synthesized
tttaactacccatttatttaaa

SEQ ID NO: 911096 - DNA, 22 bp, Artificial Sequence
  chemically synthesized
ttttaactacccatttatttaa

SEQ ID NO: 911097 - DNA, 22 bp, Artificial Sequence
  chemically synthesized
tggttttaaataaatgggtagt

SEQ ID NO: 911098 - DNA, 22 bp, Artificial Sequence
  chemically synthesized
ggttttaaataaatgggtagtt

SEQ ID NO: 911099 - DNA, 22 bp, Artificial Sequence
  chemically synthesized
gttttaaataaatgggtagtta

SEQ ID NO: 911100 - DNA, 22 bp, Artificial Sequence
  chemically synthesized
taaataaatgggtagttaaaaa

SEQ ID NO: 911101 - DNA, 22 bp, Artificial Sequence
  chemically synthesized
tatgtgggtatttttttaacta

SEQ ID NO: 911102 - DNA, 22 bp, Artificial Sequence
  chemically synthesized
aaataaatgggtagttaaaaaa

SEQ ID NO: 911103 - DNA, 22 bp, Artificial Sequence
  chemically synthesized
aataaatgggtagttaaaaaaa

SEQ ID NO: 911104 - DNA, 22 bp, Artificial Sequence
  chemically synthesized
tatatgttatatgtgggtattt

SEQ ID NO: 911105 - DNA, 22 bp, Artificial Sequence
  chemically synthesized
gtatatgttatatgtgggtatt

SEQ ID NO: 911106 - DNA, 22 bp, Artificial Sequence
  chemically synthesized
tgtatatgttatatgtgggtat

SEQ ID NO: 911107 - DNA, 22 bp, Artificial Sequence
  chemically synthesized
tttgtatatgttatatgtgggt

SEQ ID NO: 911108 - DNA, 22 bp, Artificial Sequence
  chemically synthesized
ctctttgtatatgttatatgtg

SEQ ID NO: 911109 - DNA, 22 bp, Artificial Sequence
  chemically synthesized
aaaaaatacccacatataacat

SEQ ID NO: 911110 - DNA, 22 bp, Artificial Sequence
  chemically synthesized
attgctctttgtatatgttata

SEQ ID NO: 911111 - DNA, 22 bp, Artificial Sequence
  chemically synthesized
cattgctctttgtatatgttat

SEQ ID NO: 911112 - DNA, 22 bp, Artificial Sequence
  chemically synthesized
ttcattgctctttgtatatgtt

SEQ ID NO: 911113 - DNA, 22 bp, Artificial Sequence
  chemically synthesized
attcttcattgctctttgtata

SEQ ID NO: 911114 - DNA, 22 bp, Artificial Sequence
  chemically synthesized
ctcattcttcattgctctttgt

SEQ ID NO: 911115 - DNA, 22 bp, Artificial Sequence
  chemically synthesized
cctcattcttcattgctctttg

SEQ ID NO: 911116 - DNA, 22 bp, Artificial Sequence
  chemically synthesized
tcctcattcttcattgctcttt

SEQ ID NO: 911117 - DNA, 22 bp, Artificial Sequence
  chemically synthesized
tgtcccctttcctcattcttca

SEQ ID NO: 911118 - DNA, 22 bp, Artificial Sequence
  chemically synthesized
gtgtcccctttcctcattcttc

SEQ ID NO: 911119 - DNA, 22 bp, Artificial Sequence
  chemically synthesized
tgtgtcccctttcctcattctt

SEQ ID NO: 911120 - DNA, 22 bp, Artificial Sequence
  chemically synthesized
ttttgtgtcccctttcctcatt

SEQ ID NO: 911121 - DNA, 22 bp, Artificial Sequence
  chemically synthesized
attttgtgtcccctttcctcat

SEQ ID NO: 911122 - DNA, 22 bp, Artificial Sequence
  chemically synthesized
tattttgtgtcccctttcctca

SEQ ID NO: 911123 - DNA, 22 bp, Artificial Sequence
  chemically synthesized
ttattttgtgtcccctttcctc

SEQ ID NO: 911124 - DNA, 22 bp, Artificial Sequence
  chemically synthesized
tttattttgtgtcccctttcct

SEQ ID NO: 911125 - DNA, 22 bp, Artificial Sequence
  chemically synthesized
atgtctttttattttgtgtccc

SEQ ID NO: 911126 - DNA, 22 bp, Artificial Sequence
  chemically synthesized
catgtctttttattttgtgtcc

SEQ ID NO: 911127 - DNA, 22 bp, Artificial Sequence
  chemically synthesized
tcatgtctttttattttgtgtc

SEQ ID NO: 911128 - DNA, 22 bp, Artificial Sequence
  chemically synthesized
tttcatgtctttttattttgtg

SEQ ID NO: 911129 - DNA, 22 bp, Artificial Sequence
  chemically synthesized
atctctttcatgtctttttatt

SEQ ID NO: 911130 - DNA, 22 bp, Artificial Sequence
  chemically synthesized
catctctttcatgtctttttat

SEQ ID NO: 911131 - DNA, 22 bp, Artificial Sequence
  chemically synthesized
atcccagtttcatctctttcat

SEQ ID NO: 911132 - DNA, 22 bp, Artificial Sequence
  chemically synthesized
accccgttaatcccagtttcat

SEQ ID NO: 911133 - DNA, 22 bp, Artificial Sequence
  chemically synthesized
cctgaccccgttaatcccagtt

SEQ ID NO: 911134 - DNA, 22 bp, Artificial Sequence
  chemically synthesized
ccctgaccccgttaatcccagt

SEQ ID NO: 911135 - DNA, 22 bp, Artificial Sequence
  chemically synthesized
cttccctgaccccgttaatccc

SEQ ID NO: 911136 - DNA, 22 bp, Artificial Sequence
  chemically synthesized
tccttccctgaccccgttaatc

SEQ ID NO: 911137 - DNA, 22 bp, Artificial Sequence
  chemically synthesized
ctctccttccctgaccccgtta

SEQ ID NO: 911138 - DNA, 22 bp, Artificial Sequence
  chemically synthesized
tgctctccttccctgaccccgt

SEQ ID NO: 911139 - DNA, 22 bp, Artificial Sequence
  chemically synthesized
ctgctctccttccctgaccccg

SEQ ID NO: 911140 - DNA, 22 bp, Artificial Sequence
  chemically synthesized
ttctgctctccttccctgaccc

SEQ ID NO: 911141 - DNA, 22 bp, Artificial Sequence
  chemically synthesized
tcttctgctctccttccctgac

SEQ ID NO: 911142 - DNA, 22 bp, Artificial Sequence
  chemically synthesized
ggattaacggggtcagggaagg

SEQ ID NO: 911143 - DNA, 22 bp, Artificial Sequence
  chemically synthesized
acggggtcagggaaggagagca

SEQ ID NO: 911144 - DNA, 22 bp, Artificial Sequence
  chemically synthesized
tgtaacacattctcttctgctc

SEQ ID NO: 911145 - DNA, 22 bp, Artificial Sequence
  chemically synthesized
atgtaacacattctcttctgct

SEQ ID NO: 911146 - DNA, 22 bp, Artificial Sequence
  chemically synthesized
tttatgtaacacattctcttct

SEQ ID NO: 911147 - DNA, 22 bp, Artificial Sequence
  chemically synthesized
ccccagttgtttatgtaacaca

SEQ ID NO: 911148 - DNA, 22 bp, Artificial Sequence
  chemically synthesized
tgccccagttgtttatgtaaca

SEQ ID NO: 911149 - DNA, 22 bp, Artificial Sequence
  chemically synthesized
ctgccccagttgtttatgtaac

SEQ ID NO: 911150 - DNA, 22 bp, Artificial Sequence
  chemically synthesized
tctgccccagttgtttatgtaa

SEQ ID NO: 911151 - DNA, 22 bp, Artificial Sequence
  chemically synthesized
ttctgccccagttgtttatgta

SEQ ID NO: 911152 - DNA, 22 bp, Artificial Sequence
  chemically synthesized
tttctgccccagttgtttatgt

SEQ ID NO: 911153 - DNA, 22 bp, Artificial Sequence
  chemically synthesized
tttttctgccccagttgtttat

SEQ ID NO: 911154 - DNA, 22 bp, Artificial Sequence
  chemically synthesized
ccactctttttctgccccagtt

SEQ ID NO: 911155 - DNA, 22 bp, Artificial Sequence
  chemically synthesized
gccactctttttctgccccagt

SEQ ID NO: 911156 - DNA, 22 bp, Artificial Sequence
  chemically synthesized
cataaacaactggggcagaaaa

SEQ ID NO: 911157 - DNA, 22 bp, Artificial Sequence
  chemically synthesized
catatttgccactctttttctg

SEQ ID NO: 911158 - DNA, 22 bp, Artificial Sequence
  chemically synthesized
gcatatttgccactctttttct

SEQ ID NO: 911159 - DNA, 22 bp, Artificial Sequence
  chemically synthesized
tttgcatatttgccactctttt

SEQ ID NO: 911160 - DNA, 22 bp, Artificial Sequence
  chemically synthesized
tatttgcatatttgccactctt

SEQ ID NO: 911161 - DNA, 22 bp, Artificial Sequence
  chemically synthesized
ctatttgcatatttgccactct

SEQ ID NO: 911162 - DNA, 22 bp, Artificial Sequence
  chemically synthesized
tctatttgcatatttgccactc

SEQ ID NO: 911163 - DNA, 22 bp, Artificial Sequence
  chemically synthesized
gggcagaaaaagagtggcaaat

SEQ ID NO: 911164 - DNA, 22 bp, Artificial Sequence
  chemically synthesized
ttctatttgcatatttgccact

SEQ ID NO: 911165 - DNA, 22 bp, Artificial Sequence
  chemically synthesized
cttttctatttgcatatttgcc

SEQ ID NO: 911166 - DNA, 22 bp, Artificial Sequence
  chemically synthesized
gccatgaatctacttttctatt

SEQ ID NO: 911167 - DNA, 22 bp, Artificial Sequence
  chemically synthesized
caggcgtgagccaccgcacctg

SEQ ID NO: 911168 - DNA, 22 bp, Artificial Sequence
  chemically synthesized
atattacaggcgtgagccaccg

SEQ ID NO: 911169 - DNA, 22 bp, Artificial Sequence
  chemically synthesized
atggccaggtgcggtggctcac

SEQ ID NO: 911170 - DNA, 22 bp, Artificial Sequence
  chemically synthesized
ctgatattacaggcgtgagcca

SEQ ID NO: 911171 - DNA, 22 bp, Artificial Sequence
  chemically synthesized
ccaaattgctgatattacaggc

SEQ ID NO: 911172 - DNA, 22 bp, Artificial Sequence
  chemically synthesized
ggcctcccaaattgctgatatt

SEQ ID NO: 911173 - DNA, 22 bp, Artificial Sequence
  chemically synthesized
acgcctgtaatatcagcaattt

SEQ ID NO: 911174 - DNA, 22 bp, Artificial Sequence
  chemically synthesized
cccacctcggcctcccaaattg

SEQ ID NO: 911175 - DNA, 22 bp, Artificial Sequence
  chemically synthesized
taatatcagcaatttgggaggc

SEQ ID NO: 911176 - DNA, 22 bp, Artificial Sequence
  chemically synthesized
aggtgatctgcccacctcggcc

SEQ ID NO: 911177 - DNA, 22 bp, Artificial Sequence
  chemically synthesized
gggaggccgaggtgggcagatc

SEQ ID NO: 911178 - DNA, 22 bp, Artificial Sequence
  chemically synthesized
ccgacctcaggtgatctgccca

SEQ ID NO: 911179 - DNA, 22 bp, Artificial Sequence
  chemically synthesized
ggaggccgaggtgggcagatca

SEQ ID NO: 911180 - DNA, 22 bp, Artificial Sequence
  chemically synthesized
aactcccgacctcaggtgatct

SEQ ID NO: 911181 - DNA, 22 bp, Artificial Sequence
  chemically synthesized
aaactcccgacctcaggtgatc

SEQ ID NO: 911182 - DNA, 22 bp, Artificial Sequence
  chemically synthesized
gtcttaaactcccgacctcagg

SEQ ID NO: 911183 - DNA, 22 bp, Artificial Sequence
  chemically synthesized
atcaggctggtcttaaactccc

SEQ ID NO: 911184 - DNA, 22 bp, Artificial Sequence
  chemically synthesized
aggtcgggagtttaagaccagc

SEQ ID NO: 911185 - DNA, 22 bp, Artificial Sequence
  chemically synthesized
accacgttgatcaggctggtct

SEQ ID NO: 911186 - DNA, 22 bp, Artificial Sequence
  chemically synthesized
caccacgttgatcaggctggtc

SEQ ID NO: 911187 - DNA, 22 bp, Artificial Sequence
  chemically synthesized
aagaccagcctgatcaacgtgg

SEQ ID NO: 911188 - DNA, 22 bp, Artificial Sequence
  chemically synthesized
agaccagcctgatcaacgtggt

SEQ ID NO: 911189 - DNA, 22 bp, Artificial Sequence
  chemically synthesized
agtagagacggggtttcaccac

SEQ ID NO: 911190 - DNA, 22 bp, Artificial Sequence
  chemically synthesized
aagtagagacggggtttcacca

SEQ ID NO: 911191 - DNA, 22 bp, Artificial Sequence
  chemically synthesized
taagtagagacggggtttcacc

SEQ ID NO: 911192 - DNA, 22 bp, Artificial Sequence
  chemically synthesized
atcaacgtggtgaaaccccgtc

SEQ ID NO: 911193 - DNA, 22 bp, Artificial Sequence
  chemically synthesized
tattttaagtagagacggggtt

SEQ ID NO: 911194 - DNA, 22 bp, Artificial Sequence
  chemically synthesized
gtattttaagtagagacggggt

SEQ ID NO: 911195 - DNA, 22 bp, Artificial Sequence
  chemically synthesized
tgtattttaagtagagacgggg

SEQ ID NO: 911196 - DNA, 22 bp, Artificial Sequence
  chemically synthesized
ttgtattttaagtagagacggg

SEQ ID NO: 911197 - DNA, 22 bp, Artificial Sequence
  chemically synthesized
atttttgtattttaagtagaga

SEQ ID NO: 911198 - DNA, 22 bp, Artificial Sequence
  chemically synthesized
gctaatttttgtattttaagta

SEQ ID NO: 911199 - DNA, 22 bp, Artificial Sequence
  chemically synthesized
tacttaaaatacaaaaattagc

SEQ ID NO: 911200 - DNA, 22 bp, Artificial Sequence
  chemically synthesized
cttaaaatacaaaaattagcca

SEQ ID NO: 911201 - DNA, 22 bp, Artificial Sequence
  chemically synthesized
aaaatacaaaaattagccaggc

SEQ ID NO: 911202 - DNA, 22 bp, Artificial Sequence
  chemically synthesized
aaatacaaaaattagccaggcg

SEQ ID NO: 911203 - DNA, 22 bp, Artificial Sequence
  chemically synthesized
caggcatgcaccaccacgcctg

SEQ ID NO: 911204 - DNA, 22 bp, Artificial Sequence
  chemically synthesized
ggattacaggcatgcaccacca

SEQ ID NO: 911205 - DNA, 22 bp, Artificial Sequence
  chemically synthesized
gccaggcgtggtggtgcatgcc

SEQ ID NO: 911206 - DNA, 22 bp, Artificial Sequence
  chemically synthesized
ccgagtagctgggattacaggc

SEQ ID NO: 911207 - DNA, 22 bp, Artificial Sequence
  chemically synthesized
cccgagtagctgggattacagg

SEQ ID NO: 911208 - DNA, 22 bp, Artificial Sequence
  chemically synthesized
agcttcccgagtagctgggatt

SEQ ID NO: 911209 - DNA, 22 bp, Artificial Sequence
  chemically synthesized
cctcagcttcccgagtagctgg

SEQ ID NO: 911210 - DNA, 22 bp, Artificial Sequence
  chemically synthesized
ctgcctcagcttcccgagtagc

SEQ ID NO: 911211 - DNA, 22 bp, Artificial Sequence
  chemically synthesized
tcctgcctcagcttcccgagta

SEQ ID NO: 911212 - DNA, 22 bp, Artificial Sequence
  chemically synthesized
taatcccagctactcgggaagc

SEQ ID NO: 911213 - DNA, 22 bp, Artificial Sequence
  chemically synthesized
aagcgattctcctgcctcagct

SEQ ID NO: 911214 - DNA, 22 bp, Artificial Sequence
  chemically synthesized
ctcgggaagctgaggcaggaga

SEQ ID NO: 911215 - DNA, 22 bp, Artificial Sequence
  chemically synthesized
ggttcaagcgattctcctgcct

SEQ ID NO: 911216 - DNA, 22 bp, Artificial Sequence
  chemically synthesized
gggaagctgaggcaggagaatc

SEQ ID NO: 911217 - DNA, 22 bp, Artificial Sequence
  chemically synthesized
ctgggttcaagcgattctcctg

SEQ ID NO: 911218 - DNA, 22 bp, Artificial Sequence
  chemically synthesized
tctcctgggttcaagcgattct

SEQ ID NO: 911219 - DNA, 22 bp, Artificial Sequence
  chemically synthesized
tgtctcctgggttcaagcgatt

SEQ ID NO: 911220 - DNA, 22 bp, Artificial Sequence
  chemically synthesized
aggcaggagaatcgcttgaacc

SEQ ID NO: 911221 - DNA, 22 bp, Artificial Sequence
  chemically synthesized
caacctctgtctcctgggttca

SEQ ID NO: 911222 - DNA, 22 bp, Artificial Sequence
  chemically synthesized
actgcaacctctgtctcctggg

SEQ ID NO: 911223 - DNA, 22 bp, Artificial Sequence
  chemically synthesized
cactcactgcaacctctgtctc

SEQ ID NO: 911224 - DNA, 22 bp, Artificial Sequence
  chemically synthesized
gaacccaggagacagaggttgc

SEQ ID NO: 911225 - DNA, 22 bp, Artificial Sequence
  chemically synthesized
aacccaggagacagaggttgca

SEQ ID NO: 911226 - DNA, 22 bp, Artificial Sequence
  chemically synthesized
gagtgcaatggcacgatctcca

SEQ ID NO: 911227 - DNA, 22 bp, Artificial Sequence
  chemically synthesized
cagtgagtggagatcgtgccat

SEQ ID NO: 911228 - DNA, 22 bp, Artificial Sequence
  chemically synthesized
tcgcccaggctggagtgcaatg

SEQ ID NO: 911229 - DNA, 22 bp, Artificial Sequence
  chemically synthesized
tgtcgcccaggctggagtgcaa

SEQ ID NO: 911230 - DNA, 22 bp, Artificial Sequence
  chemically synthesized
ctctgtcgcccaggctggagtg

SEQ ID NO: 911231 - DNA, 22 bp, Artificial Sequence
  chemically synthesized
gctctgtcgcccaggctggagt

SEQ ID NO: 911232 - DNA, 22 bp, Artificial Sequence
  chemically synthesized
tgctctgtcgcccaggctggag

SEQ ID NO: 911233 - DNA, 22 bp, Artificial Sequence
  chemically synthesized
cactccagcctgggcgacagag

SEQ ID NO: 911234 - DNA, 22 bp, Artificial Sequence
  chemically synthesized
agacagagttttgctctgtcgc

SEQ ID NO: 911235 - DNA, 22 bp, Artificial Sequence
  chemically synthesized
gagacagagttttgctctgtcg

SEQ ID NO: 911236 - DNA, 22 bp, Artificial Sequence
  chemically synthesized
tgagacagagttttgctctgtc

SEQ ID NO: 911237 - DNA, 22 bp, Artificial Sequence
  chemically synthesized
ttgagacagagttttgctctgt

SEQ ID NO: 911238 - DNA, 22 bp, Artificial Sequence
  chemically synthesized
cagcctgggcgacagagcaaaa

SEQ ID NO: 911239 - DNA, 22 bp, Artificial Sequence
  chemically synthesized
tttgagacagagttttgctctg

SEQ ID NO: 911240 - DNA, 22 bp, Artificial Sequence
  chemically synthesized
ttttgagacagagttttgctct

SEQ ID NO: 911241 - DNA, 22 bp, Artificial Sequence
  chemically synthesized
tttttgagacagagttttgctc

SEQ ID NO: 911242 - DNA, 22 bp, Artificial Sequence
  chemically synthesized
ttttttgagacagagttttgct

SEQ ID NO: 911243 - DNA, 22 bp, Artificial Sequence
  chemically synthesized
tttttttgagacagagttttgc

SEQ ID NO: 911244 - DNA, 22 bp, Artificial Sequence
  chemically synthesized
ttttttttgagacagagttttg

SEQ ID NO: 911245 - DNA, 22 bp, Artificial Sequence
  chemically synthesized
tttttttttgagacagagtttt

SEQ ID NO: 911246 - DNA, 22 bp, Artificial Sequence
  chemically synthesized
ggcgacagagcaaaactctgtc

SEQ ID NO: 911247 - DNA, 22 bp, Artificial Sequence
  chemically synthesized
ttttttttttgagacagagttt

SEQ ID NO: 911248 - DNA, 22 bp, Artificial Sequence
  chemically synthesized
tttttttttttgagacagagtt

SEQ ID NO: 911249 - DNA, 22 bp, Artificial Sequence
  chemically synthesized
ttttttttttttgagacagagt

SEQ ID NO: 911250 - DNA, 22 bp, Artificial Sequence
  chemically synthesized
tttttttttttttgagacagag

SEQ ID NO: 911251 - DNA, 22 bp, Artificial Sequence
  chemically synthesized
ttttttttttttttttgagaca

SEQ ID NO: 911252 - DNA, 22 bp, Artificial Sequence
  chemically synthesized
gttttttttttttttttgagac

SEQ ID NO: 911253 - DNA, 22 bp, Artificial Sequence
  chemically synthesized
tgttttttttttttttttgaga

SEQ ID NO: 911254 - DNA, 22 bp, Artificial Sequence
  chemically synthesized
ttgttttttttttttttttgag

SEQ ID NO: 911255 - DNA, 22 bp, Artificial Sequence
  chemically synthesized
tttgttttttttttttttttga

SEQ ID NO: 911256 - DNA, 22 bp, Artificial Sequence
  chemically synthesized
tttttgtttttttttttttttt

SEQ ID NO: 911257 - DNA, 22 bp, Artificial Sequence
  chemically synthesized
ctttttgttttttttttttttt

SEQ ID NO: 911258 - DNA, 22 bp, Artificial Sequence
  chemically synthesized
tgtctcaaaaaaaaaaaaaaaa

SEQ ID NO: 911259 - DNA, 22 bp, Artificial Sequence
  chemically synthesized
tctcaaaaaaaaaaaaaaaaca

SEQ ID NO: 911260 - DNA, 22 bp, Artificial Sequence
  chemically synthesized
ggaatcttctttttgttttttt

SEQ ID NO: 911261 - DNA, 22 bp, Artificial Sequence
  chemically synthesized
aaaaaaaaaaaaaaaacaaaaa

SEQ ID NO: 911262 - DNA, 22 bp, Artificial Sequence
  chemically synthesized
ttaggaatcttctttttgtttt

SEQ ID NO: 911263 - DNA, 22 bp, Artificial Sequence
  chemically synthesized
attaggaatcttctttttgttt

SEQ ID NO: 911264 - DNA, 22 bp, Artificial Sequence
  chemically synthesized
tatatttattaggaatcttctt

SEQ ID NO: 911265 - DNA, 22 bp, Artificial Sequence
  chemically synthesized
atatatttattaggaatcttct

SEQ ID NO: 911266 - DNA, 22 bp, Artificial Sequence
  chemically synthesized
tatatatttattaggaatcttc

SEQ ID NO: 911267 - DNA, 22 bp, Artificial Sequence
  chemically synthesized
ttatatatttattaggaatctt

SEQ ID NO: 911268 - DNA, 22 bp, Artificial Sequence
  chemically synthesized
tttttatatatttattaggaat

SEQ ID NO: 911269 - DNA, 22 bp, Artificial Sequence
  chemically synthesized
atttttatatatttattaggaa

SEQ ID NO: 911270 - DNA, 22 bp, Artificial Sequence
  chemically synthesized
taggaatttatttttatatatt

SEQ ID NO: 911271 - DNA, 22 bp, Artificial Sequence
  chemically synthesized
ctaataaatatataaaaataaa

SEQ ID NO: 911272 - DNA, 22 bp, Artificial Sequence
  chemically synthesized
ataaatatataaaaataaattc

SEQ ID NO: 911273 - DNA, 22 bp, Artificial Sequence
  chemically synthesized
acacgtatattataggaattta

SEQ ID NO: 911274 - DNA, 22 bp, Artificial Sequence
  chemically synthesized
tgaattgacacgtatattatag

SEQ ID NO: 911275 - DNA, 22 bp, Artificial Sequence
  chemically synthesized
atctatgaattgacacgtatat

SEQ ID NO: 911276 - DNA, 22 bp, Artificial Sequence
  chemically synthesized
catctatgaattgacacgtata

SEQ ID NO: 911277 - DNA, 22 bp, Artificial Sequence
  chemically synthesized
tcatctatgaattgacacgtat

SEQ ID NO: 911278 - DNA, 22 bp, Artificial Sequence
  chemically synthesized
attttcatctatgaattgacac

SEQ ID NO: 911279 - DNA, 22 bp, Artificial Sequence
  chemically synthesized
ctataatatacgtgtcaattca

SEQ ID NO: 911280 - DNA, 22 bp, Artificial Sequence
  chemically synthesized
taatatacgtgtcaattcatag

SEQ ID NO: 911281 - DNA, 22 bp, Artificial Sequence
  chemically synthesized
ggctaattttcatctatgaatt

SEQ ID NO: 911282 - DNA, 22 bp, Artificial Sequence
  chemically synthesized
aggctaattttcatctatgaat

SEQ ID NO: 911283 - DNA, 22 bp, Artificial Sequence
  chemically synthesized
taggctaattttcatctatgaa

SEQ ID NO: 911284 - DNA, 22 bp, Artificial Sequence
  chemically synthesized
ttaggctaattttcatctatga

SEQ ID NO: 911285 - DNA, 22 bp, Artificial Sequence
  chemically synthesized
acttttaggctaattttcatct

SEQ ID NO: 911286 - DNA, 22 bp, Artificial Sequence
  chemically synthesized
tcacttttaggctaattttcat

SEQ ID NO: 911287 - DNA, 22 bp, Artificial Sequence
  chemically synthesized
ctcacttttaggctaattttca

SEQ ID NO: 911288 - DNA, 22 bp, Artificial Sequence
  chemically synthesized
tgtttctcacttttaggctaat

SEQ ID NO: 911289 - DNA, 22 bp, Artificial Sequence
  chemically synthesized
atagatgaaaattagcctaaaa

SEQ ID NO: 911290 - DNA, 22 bp, Artificial Sequence
  chemically synthesized
tgtgtttctcacttttaggcta

SEQ ID NO: 911291 - DNA, 22 bp, Artificial Sequence
  chemically synthesized
ctctgtgtttctcacttttagg

SEQ ID NO: 911292 - DNA, 22 bp, Artificial Sequence
  chemically synthesized
cctctgtgtttctcacttttag

SEQ ID NO: 911293 - DNA, 22 bp, Artificial Sequence
  chemically synthesized
ttcctctgtgtttctcactttt

SEQ ID NO: 911294 - DNA, 22 bp, Artificial Sequence
  chemically synthesized
tcttcctctgtgtttctcactt

SEQ ID NO: 911295 - DNA, 22 bp, Artificial Sequence
  chemically synthesized
gcctaaaagtgagaaacacaga

SEQ ID NO: 911296 - DNA, 22 bp, Artificial Sequence
  chemically synthesized
aaagtgagaaacacagaggaag

SEQ ID NO: 911297 - DNA, 22 bp, Artificial Sequence
  chemically synthesized
gccatcatcatcactctcttcc

SEQ ID NO: 911298 - DNA, 22 bp, Artificial Sequence
  chemically synthesized
tcgccatcatcatcactctctt

SEQ ID NO: 911299 - DNA, 22 bp, Artificial Sequence
  chemically synthesized
tctcgccatcatcatcactctc

SEQ ID NO: 911300 - DNA, 22 bp, Artificial Sequence
  chemically synthesized
aacatgcatgtgggtgtaggag

SEQ ID NO: 911301 - DNA, 22 bp, Artificial Sequence
  chemically synthesized
tgaacatgcatgtgggtgtagg

SEQ ID NO: 911302 - DNA, 22 bp, Artificial Sequence
  chemically synthesized
tctgaacatgcatgtgggtgta

SEQ ID NO: 911303 - DNA, 22 bp, Artificial Sequence
  chemically synthesized
ctctgaacatgcatgtgggtgt

SEQ ID NO: 911304 - DNA, 22 bp, Artificial Sequence
  chemically synthesized
tctctgaacatgcatgtgggtg

SEQ ID NO: 911305 - DNA, 22 bp, Artificial Sequence
  chemically synthesized
tattttctctgaacatgcatgt

SEQ ID NO: 911306 - DNA, 22 bp, Artificial Sequence
  chemically synthesized
gtattttctctgaacatgcatg

SEQ ID NO: 911307 - DNA, 22 bp, Artificial Sequence
  chemically synthesized
tgtattttctctgaacatgcat

SEQ ID NO: 911308 - DNA, 22 bp, Artificial Sequence
  chemically synthesized
ctacacccacatgcatgttcag

SEQ ID NO: 911309 - DNA, 22 bp, Artificial Sequence
  chemically synthesized
tttgtattttctctgaacatgc

SEQ ID NO: 911310 - DNA, 22 bp, Artificial Sequence
  chemically synthesized
ctttgtattttctctgaacatg

SEQ ID NO: 911311 - DNA, 22 bp, Artificial Sequence
  chemically synthesized
cacccacatgcatgttcagaga

SEQ ID NO: 911312 - DNA, 22 bp, Artificial Sequence
  chemically synthesized
atatttctttgtattttctctg

SEQ ID NO: 911313 - DNA, 22 bp, Artificial Sequence
  chemically synthesized
catatttctttgtattttctct

SEQ ID NO: 911314 - DNA, 22 bp, Artificial Sequence
  chemically synthesized
ttcatatttctttgtattttct

SEQ ID NO: 911315 - DNA, 22 bp, Artificial Sequence
  chemically synthesized
tccctcttcatatttctttgta

SEQ ID NO: 911316 - DNA, 22 bp, Artificial Sequence
  chemically synthesized
atccctcttcatatttctttgt

SEQ ID NO: 911317 - DNA, 22 bp, Artificial Sequence
  chemically synthesized
agagaaaatacaaagaaatatg

SEQ ID NO: 911318 - DNA, 22 bp, Artificial Sequence
  chemically synthesized
atatttatccctcttcatattt

SEQ ID NO: 911319 - DNA, 22 bp, Artificial Sequence
  chemically synthesized
aatatttatccctcttcatatt

SEQ ID NO: 911320 - DNA, 22 bp, Artificial Sequence
  chemically synthesized
taatatttatccctcttcatat

SEQ ID NO: 911321 - DNA, 22 bp, Artificial Sequence
  chemically synthesized
ttaatatttatccctcttcata

SEQ ID NO: 911322 - DNA, 22 bp, Artificial Sequence
  chemically synthesized
aggtgtttttaatatttatccc

SEQ ID NO: 911323 - DNA, 22 bp, Artificial Sequence
  chemically synthesized
actcaggtgtttttaatattta

SEQ ID NO: 911324 - DNA, 22 bp, Artificial Sequence
  chemically synthesized
tgactcaggtgtttttaatatt

SEQ ID NO: 911325 - DNA, 22 bp, Artificial Sequence
  chemically synthesized
ctgactcaggtgtttttaatat

SEQ ID NO: 911326 - DNA, 22 bp, Artificial Sequence
  chemically synthesized
acccacacttctgactcaggtg

SEQ ID NO: 911327 - DNA, 22 bp, Artificial Sequence
  chemically synthesized
cacccacacttctgactcaggt

SEQ ID NO: 911328 - DNA, 22 bp, Artificial Sequence
  chemically synthesized
aaaacacctgagtcagaagtgt

SEQ ID NO: 911329 - DNA, 22 bp, Artificial Sequence
  chemically synthesized
tgatcttcacccacacttctga

SEQ ID NO: 911330 - DNA, 22 bp, Artificial Sequence
  chemically synthesized
tatgatcttcacccacacttct

SEQ ID NO: 911331 - DNA, 22 bp, Artificial Sequence
  chemically synthesized
attctatgatcttcacccacac

SEQ ID NO: 911332 - DNA, 22 bp, Artificial Sequence
  chemically synthesized
agtcagaagtgtgggtgaagat

SEQ ID NO: 911333 - DNA, 22 bp, Artificial Sequence
  chemically synthesized
atcatctcattctatgatcttc

SEQ ID NO: 911334 - DNA, 22 bp, Artificial Sequence
  chemically synthesized
tgatcatctcattctatgatct

SEQ ID NO: 911335 - DNA, 22 bp, Artificial Sequence
  chemically synthesized
tctgatcatctcattctatgat

SEQ ID NO: 911336 - DNA, 22 bp, Artificial Sequence
  chemically synthesized
tctctgatcatctcattctatg

SEQ ID NO: 911337 - DNA, 22 bp, Artificial Sequence
  chemically synthesized
ctctctctgatcatctcattct

SEQ ID NO: 911338 - DNA, 22 bp, Artificial Sequence
  chemically synthesized
tgttcctctctctgatcatctc

SEQ ID NO: 911339 - DNA, 22 bp, Artificial Sequence
  chemically synthesized
tgtgttcctctctctgatcatc

SEQ ID NO: 911340 - DNA, 22 bp, Artificial Sequence
  chemically synthesized
gcctctgtgttcctctctctga

SEQ ID NO: 911341 - DNA, 22 bp, Artificial Sequence
  chemically synthesized
aagctagcctctgtgttcctct

SEQ ID NO: 911342 - DNA, 22 bp, Artificial Sequence
  chemically synthesized
ttaaagctagcctctgtgttcc

SEQ ID NO: 911343 - DNA, 22 bp, Artificial Sequence
  chemically synthesized
gctttaataacatccccacttt

SEQ ID NO: 911344 - DNA, 22 bp, Artificial Sequence
  chemically synthesized
taataacatccccactttgtgg

SEQ ID NO: 911345 - DNA, 22 bp, Artificial Sequence
  chemically synthesized
aataacatccccactttgtggc

SEQ ID NO: 911346 - DNA, 22 bp, Artificial Sequence
  chemically synthesized
ataacatccccactttgtggct

SEQ ID NO: 911347 - DNA, 22 bp, Artificial Sequence
  chemically synthesized
acaatgatacccgtaagagcca

SEQ ID NO: 911348 - DNA, 22 bp, Artificial Sequence
  chemically synthesized
aacaatgatacccgtaagagcc

SEQ ID NO: 911349 - DNA, 22 bp, Artificial Sequence
  chemically synthesized
taacaatgatacccgtaagagc

SEQ ID NO: 911350 - DNA, 22 bp, Artificial Sequence
  chemically synthesized
cagcctttaacaatgatacccg

SEQ ID NO: 911351 - DNA, 22 bp, Artificial Sequence
  chemically synthesized
tgtggctcttacgggtatcatt

SEQ ID NO: 911352 - DNA, 22 bp, Artificial Sequence
  chemically synthesized
acagcctttaacaatgataccc

SEQ ID NO: 911353 - DNA, 22 bp, Artificial Sequence
  chemically synthesized
gtggctcttacgggtatcattg

SEQ ID NO: 911354 - DNA, 22 bp, Artificial Sequence
  chemically synthesized
tacagcctttaacaatgatacc

SEQ ID NO: 911355 - DNA, 22 bp, Artificial Sequence
  chemically synthesized
tggctcttacgggtatcattgt

SEQ ID NO: 911356 - DNA, 22 bp, Artificial Sequence
  chemically synthesized
ttacagcctttaacaatgatac

SEQ ID NO: 911357 - DNA, 22 bp, Artificial Sequence
  chemically synthesized
accttttacagcctttaacaat

SEQ ID NO: 911358 - DNA, 22 bp, Artificial Sequence
  chemically synthesized
ttacgggtatcattgttaaagg

SEQ ID NO: 911359 - DNA, 22 bp, Artificial Sequence
  chemically synthesized
gaccttttacagcctttaacaa

SEQ ID NO: 911360 - DNA, 22 bp, Artificial Sequence
  chemically synthesized
acgggtatcattgttaaaggct

SEQ ID NO: 911361 - DNA, 22 bp, Artificial Sequence
  chemically synthesized
cgggtatcattgttaaaggctg

SEQ ID NO: 911362 - DNA, 22 bp, Artificial Sequence
  chemically synthesized
atacataacttgaccttttaca

SEQ ID NO: 911363 - DNA, 22 bp, Artificial Sequence
  chemically synthesized
ttaaaggctgtaaaaggtcaag

SEQ ID NO: 911364 - DNA, 22 bp, Artificial Sequence
  chemically synthesized
tctaatacataacttgaccttt

SEQ ID NO: 911365 - DNA, 22 bp, Artificial Sequence
  chemically synthesized
gtctaatacataacttgacctt

SEQ ID NO: 911366 - DNA, 22 bp, Artificial Sequence
  chemically synthesized
aaggctgtaaaaggtcaagtta

SEQ ID NO: 911367 - DNA, 22 bp, Artificial Sequence
  chemically synthesized
ttgtctaatacataacttgacc

SEQ ID NO: 911368 - DNA, 22 bp, Artificial Sequence
  chemically synthesized
attcttgtctaatacataactt

SEQ ID NO: 911369 - DNA, 22 bp, Artificial Sequence
  chemically synthesized
taaaaggtcaagttatgtatta

SEQ ID NO: 911370 - DNA, 22 bp, Artificial Sequence
  chemically synthesized
atgaaatgatatcctcattctt

SEQ ID NO: 911371 - DNA, 22 bp, Artificial Sequence
  chemically synthesized
tgtattagacaagaatgaggat

SEQ ID NO: 911372 - DNA, 22 bp, Artificial Sequence
  chemically synthesized
gacaagaatgaggatatcattt

SEQ ID NO: 911373 - DNA, 22 bp, Artificial Sequence
  chemically synthesized
atgcaatgaaggctcatgaaat

SEQ ID NO: 911374 - DNA, 22 bp, Artificial Sequence
  chemically synthesized
catgcaatgaaggctcatgaaa

SEQ ID NO: 911375 - DNA, 22 bp, Artificial Sequence
  chemically synthesized
tgggtagcttcatgcaatgaag

SEQ ID NO: 911376 - DNA, 22 bp, Artificial Sequence
  chemically synthesized
atgggtagcttcatgcaatgaa

SEQ ID NO: 911377 - DNA, 22 bp, Artificial Sequence
  chemically synthesized
catgagccttcattgcatgaag

SEQ ID NO: 911378 - DNA, 22 bp, Artificial Sequence
  chemically synthesized
atgagccttcattgcatgaagc

SEQ ID NO: 911379 - DNA, 22 bp, Artificial Sequence
  chemically synthesized
gcgtaaatttatgggtagcttc

SEQ ID NO: 911380 - DNA, 22 bp, Artificial Sequence
  chemically synthesized
cattgcatgaagctacccataa

SEQ ID NO: 911381 - DNA, 22 bp, Artificial Sequence
  chemically synthesized
attgcatgaagctacccataaa

SEQ ID NO: 911382 - DNA, 22 bp, Artificial Sequence
  chemically synthesized
catgaagctacccataaattta

SEQ ID NO: 911383 - DNA, 22 bp, Artificial Sequence
  chemically synthesized
aatatagccattagcgtaaatt

SEQ ID NO: 911384 - DNA, 22 bp, Artificial Sequence
  chemically synthesized
aactgaatatagccattagcgt

SEQ ID NO: 911385 - DNA, 22 bp, Artificial Sequence
  chemically synthesized
cccataaatttacgctaatggc

SEQ ID NO: 911386 - DNA, 22 bp, Artificial Sequence
  chemically synthesized
aaactgaatatagccattagcg

SEQ ID NO: 911387 - DNA, 22 bp, Artificial Sequence
  chemically synthesized
taaactgaatatagccattagc

SEQ ID NO: 911388 - DNA, 22 bp, Artificial Sequence
  chemically synthesized
ctttaaactgaatatagccatt

SEQ ID NO: 911389 - DNA, 22 bp, Artificial Sequence
  chemically synthesized
acgctaatggctatattcagtt

SEQ ID NO: 911390 - DNA, 22 bp, Artificial Sequence
  chemically synthesized
cgctaatggctatattcagttt

SEQ ID NO: 911391 - DNA, 22 bp, Artificial Sequence
  chemically synthesized
atggctatattcagtttaaagc

SEQ ID NO: 911392 - DNA, 22 bp, Artificial Sequence
  chemically synthesized
tattcagtttaaagcaaccctg

SEQ ID NO: 911393 - DNA, 22 bp, Artificial Sequence
  chemically synthesized
agggagtggtggacagggttgc

SEQ ID NO: 911394 - DNA, 22 bp, Artificial Sequence
  chemically synthesized
aagggagtggtggacagggttg

SEQ ID NO: 911395 - DNA, 22 bp, Artificial Sequence
  chemically synthesized
taagggagtggtggacagggtt

SEQ ID NO: 911396 - DNA, 22 bp, Artificial Sequence
  chemically synthesized
agtttaaagcaaccctgtccac

SEQ ID NO: 911397 - DNA, 22 bp, Artificial Sequence
  chemically synthesized
tttaagggagtggtggacaggg

SEQ ID NO: 911398 - DNA, 22 bp, Artificial Sequence
  chemically synthesized
ctttaagggagtggtggacagg

SEQ ID NO: 911399 - DNA, 22 bp, Artificial Sequence
  chemically synthesized
tttctttaagggagtggtggac

SEQ ID NO: 911400 - DNA, 22 bp, Artificial Sequence
  chemically synthesized
aaagcaaccctgtccaccactc

SEQ ID NO: 911401 - DNA, 22 bp, Artificial Sequence
  chemically synthesized
aagcaaccctgtccaccactcc

SEQ ID NO: 911402 - DNA, 22 bp, Artificial Sequence
  chemically synthesized
tccaccactcccttaaagaaat

SEQ ID NO: 911403 - DNA, 22 bp, Artificial Sequence
  chemically synthesized
ccttaaagaaatagctatatta

SEQ ID NO: 911404 - DNA, 22 bp, Artificial Sequence
  chemically synthesized
aaagaaatagctatattatctt

SEQ ID NO: 911405 - DNA, 22 bp, Artificial Sequence
  chemically synthesized
aagaaatagctatattatcttc

SEQ ID NO: 911406 - DNA, 22 bp, Artificial Sequence
  chemically synthesized
aagagagaaaacagcaggtgaa

SEQ ID NO: 911407 - DNA, 22 bp, Artificial Sequence
  chemically synthesized
ctgaagagagaaaacagcaggt

SEQ ID NO: 911408 - DNA, 22 bp, Artificial Sequence
  chemically synthesized
tattatcttcacctgctgtttt

SEQ ID NO: 911409 - DNA, 22 bp, Artificial Sequence
  chemically synthesized
attactgaagagagaaaacagc

SEQ ID NO: 911410 - DNA, 22 bp, Artificial Sequence
  chemically synthesized
cattactgaagagagaaaacag

SEQ ID NO: 911411 - DNA, 22 bp, Artificial Sequence
  chemically synthesized
tcttcacctgctgttttctctc

SEQ ID NO: 911412 - DNA, 22 bp, Artificial Sequence
  chemically synthesized
tatttcattactgaagagagaa

SEQ ID NO: 911413 - DNA, 22 bp, Artificial Sequence
  chemically synthesized
cacctgctgttttctctcttca

SEQ ID NO: 911414 - DNA, 22 bp, Artificial Sequence
  chemically synthesized
atatttcattactgaagagaga

SEQ ID NO: 911415 - DNA, 22 bp, Artificial Sequence
  chemically synthesized
acctgctgttttctctcttcag

SEQ ID NO: 911416 - DNA, 22 bp, Artificial Sequence
  chemically synthesized
ctgttttctctcttcagtaatg

SEQ ID NO: 911417 - DNA, 22 bp, Artificial Sequence
  chemically synthesized
tacatttatatttcattactga

SEQ ID NO: 911418 - DNA, 22 bp, Artificial Sequence
  chemically synthesized
ttttctctcttcagtaatgaaa

SEQ ID NO: 911419 - DNA, 22 bp, Artificial Sequence
  chemically synthesized
tctctcttcagtaatgaaatat

SEQ ID NO: 911420 - DNA, 22 bp, Artificial Sequence
  chemically synthesized
ctctcttcagtaatgaaatata

SEQ ID NO: 911421 - DNA, 22 bp, Artificial Sequence
  chemically synthesized
tctcttcagtaatgaaatataa

SEQ ID NO: 911422 - DNA, 22 bp, Artificial Sequence
  chemically synthesized
tcttcagtaatgaaatataaat

SEQ ID NO: 911423 - DNA, 22 bp, Artificial Sequence
  chemically synthesized
ttcagtaatgaaatataaatgt

SEQ ID NO: 911424 - DNA, 22 bp, Artificial Sequence
  chemically synthesized
cagtaatgaaatataaatgtac

SEQ ID NO: 911425 - DNA, 22 bp, Artificial Sequence
  chemically synthesized
agtaatgaaatataaatgtaca

SEQ ID NO: 911426 - DNA, 22 bp, Artificial Sequence
  chemically synthesized
caggtgtgagccaccgcgcccg

SEQ ID NO: 911427 - DNA, 22 bp, Artificial Sequence
  chemically synthesized
cgaaagtgcggggattacaggt

SEQ ID NO: 911428 - DNA, 22 bp, Artificial Sequence
  chemically synthesized
agcctccgaaagtgcggggatt

SEQ ID NO: 911429 - DNA, 22 bp, Artificial Sequence
  chemically synthesized
acacctgtaatccccgcacttt

SEQ ID NO: 911430 - DNA, 22 bp, Artificial Sequence
  chemically synthesized
acctcagcctccgaaagtgcgg

SEQ ID NO: 911431 - DNA, 22 bp, Artificial Sequence
  chemically synthesized
ctcacctcagcctccgaaagtg

SEQ ID NO: 911432 - DNA, 22 bp, Artificial Sequence
  chemically synthesized
taatccccgcactttcggaggc

SEQ ID NO: 911433 - DNA, 22 bp, Artificial Sequence
  chemically synthesized
atgatctgctcacctcagcctc

SEQ ID NO: 911434 - DNA, 22 bp, Artificial Sequence
  chemically synthesized
acctcatgatctgctcacctca

SEQ ID NO: 911435 - DNA, 22 bp, Artificial Sequence
  chemically synthesized
ctgacctcatgatctgctcacc

SEQ ID NO: 911436 - DNA, 22 bp, Artificial Sequence
  chemically synthesized
tcggaggctgaggtgagcagat

SEQ ID NO: 911437 - DNA, 22 bp, Artificial Sequence
  chemically synthesized
cggaggctgaggtgagcagatc

SEQ ID NO: 911438 - DNA, 22 bp, Artificial Sequence
  chemically synthesized
ggaggctgaggtgagcagatca

SEQ ID NO: 911439 - DNA, 22 bp, Artificial Sequence
  chemically synthesized
gaactcctgacctcatgatctg

SEQ ID NO: 911440 - DNA, 22 bp, Artificial Sequence
  chemically synthesized
aggtgagcagatcatgaggtca

SEQ ID NO: 911441 - DNA, 22 bp, Artificial Sequence
  chemically synthesized
gtctcgaactcctgacctcatg

SEQ ID NO: 911442 - DNA, 22 bp, Artificial Sequence
  chemically synthesized
gccatgtcggccaggctggtct

SEQ ID NO: 911443 - DNA, 22 bp, Artificial Sequence
  chemically synthesized
gagaccagcctggccgacatgg

SEQ ID NO: 911444 - DNA, 22 bp, Artificial Sequence
  chemically synthesized
gtagagatggagggttcgccat

SEQ ID NO: 911445 - DNA, 22 bp, Artificial Sequence
  chemically synthesized
agtagagatggagggttcgcca

SEQ ID NO: 911446 - DNA, 22 bp, Artificial Sequence
  chemically synthesized
tagtagagatggagggttcgcc

SEQ ID NO: 911447 - DNA, 22 bp, Artificial Sequence
  chemically synthesized
ttagtagagatggagggttcgc

SEQ ID NO: 911448 - DNA, 22 bp, Artificial Sequence
  chemically synthesized
gccgacatggcgaaccctccat

SEQ ID NO: 911449 - DNA, 22 bp, Artificial Sequence
  chemically synthesized
tatttttagtagagatggaggg

SEQ ID NO: 911450 - DNA, 22 bp, Artificial Sequence
  chemically synthesized
gtatttttagtagagatggagg

SEQ ID NO: 911451 - DNA, 22 bp, Artificial Sequence
  chemically synthesized
tgtatttttagtagagatggag

SEQ ID NO: 911452 - DNA, 22 bp, Artificial Sequence
  chemically synthesized
ttgtatttttagtagagatgga

SEQ ID NO: 911453 - DNA, 22 bp, Artificial Sequence
  chemically synthesized
atttttgtatttttagtagaga

SEQ ID NO: 911454 - DNA, 22 bp, Artificial Sequence
  chemically synthesized
catctctactaaaaatacaaaa

SEQ ID NO: 911455 - DNA, 22 bp, Artificial Sequence
  chemically synthesized
tactaaaaatacaaaaattagt

SEQ ID NO: 911456 - DNA, 22 bp, Artificial Sequence
  chemically synthesized
ctaaaaatacaaaaattagttg

SEQ ID NO: 911457 - DNA, 22 bp, Artificial Sequence
  chemically synthesized
aaaatacaaaaattagttgggt

SEQ ID NO: 911458 - DNA, 22 bp, Artificial Sequence
  chemically synthesized
caggcgcgcaccaccacaccca

SEQ ID NO: 911459 - DNA, 22 bp, Artificial Sequence
  chemically synthesized
ggactacaggcgcgcaccacca

SEQ ID NO: 911460 - DNA, 22 bp, Artificial Sequence
  chemically synthesized
gttgggtgtggtggtgcgcgcc

SEQ ID NO: 911461 - DNA, 22 bp, Artificial Sequence
  chemically synthesized
ggtgtggtggtgcgcgcctgta

SEQ ID NO: 911462 - DNA, 22 bp, Artificial Sequence
  chemically synthesized
gagtagctgggactacaggcgc

SEQ ID NO: 911463 - DNA, 22 bp, Artificial Sequence
  chemically synthesized
tcgagtagctgggactacaggc

SEQ ID NO: 911464 - DNA, 22 bp, Artificial Sequence
  chemically synthesized
agcctctcgagtagctgggact

SEQ ID NO: 911465 - DNA, 22 bp, Artificial Sequence
  chemically synthesized
cctcagcctctcgagtagctgg

SEQ ID NO: 911466 - DNA, 22 bp, Artificial Sequence
  chemically synthesized
tgcctcagcctctcgagtagct

SEQ ID NO: 911467 - DNA, 22 bp, Artificial Sequence
  chemically synthesized
ctgcctcagcctctcgagtagc

SEQ ID NO: 911468 - DNA, 22 bp, Artificial Sequence
  chemically synthesized
ttctgcctcagcctctcgagta

SEQ ID NO: 911469 - DNA, 22 bp, Artificial Sequence
  chemically synthesized
tagtcccagctactcgagaggc

SEQ ID NO: 911470 - DNA, 22 bp, Artificial Sequence
  chemically synthesized
aagtgattcttctgcctcagcc

SEQ ID NO: 911471 - DNA, 22 bp, Artificial Sequence
  chemically synthesized
ctcgagaggctgaggcagaaga

SEQ ID NO: 911472 - DNA, 22 bp, Artificial Sequence
  chemically synthesized
gagaggctgaggcagaagaatc

SEQ ID NO: 911473 - DNA, 22 bp, Artificial Sequence
  chemically synthesized
ccgggttcaagtgattcttctg

SEQ ID NO: 911474 - DNA, 22 bp, Artificial Sequence
  chemically synthesized
cacctcccgggttcaagtgatt

SEQ ID NO: 911475 - DNA, 22 bp, Artificial Sequence
  chemically synthesized
aggcagaagaatcacttgaacc

SEQ ID NO: 911476 - DNA, 22 bp, Artificial Sequence
  chemically synthesized
caacctccacctcccgggttca

SEQ ID NO: 911477 - DNA, 22 bp, Artificial Sequence
  chemically synthesized
actgcaacctccacctcccggg

SEQ ID NO: 911478 - DNA, 22 bp, Artificial Sequence
  chemically synthesized
agctcactgcaacctccacctc

SEQ ID NO: 911479 - DNA, 22 bp, Artificial Sequence
  chemically synthesized
gaacccgggaggtggaggttgc

SEQ ID NO: 911480 - DNA, 22 bp, Artificial Sequence
  chemically synthesized
aacccgggaggtggaggttgca

SEQ ID NO: 911481 - DNA, 22 bp, Artificial Sequence
  chemically synthesized
cagtgcagtggcacgatctcag

SEQ ID NO: 911482 - DNA, 22 bp, Artificial Sequence
  chemically synthesized
cagtgagctgagatcgtgccac

SEQ ID NO: 911483 - DNA, 22 bp, Artificial Sequence
  chemically synthesized
tcatccaggctgcagtgcagtg

SEQ ID NO: 911484 - DNA, 22 bp, Artificial Sequence
  chemically synthesized
gtcatccaggctgcagtgcagt

SEQ ID NO: 911485 - DNA, 22 bp, Artificial Sequence
  chemically synthesized
tgtcatccaggctgcagtgcag

SEQ ID NO: 911486 - DNA, 22 bp, Artificial Sequence
  chemically synthesized
agatcgtgccactgcactgcag

SEQ ID NO: 911487 - DNA, 22 bp, Artificial Sequence
  chemically synthesized
gctttgtcatccaggctgcagt

SEQ ID NO: 911488 - DNA, 22 bp, Artificial Sequence
  chemically synthesized
cactgcagcctggatgacaaag

SEQ ID NO: 911489 - DNA, 22 bp, Artificial Sequence
  chemically synthesized
agacagagtctcgctttgtcat

SEQ ID NO: 911490 - DNA, 22 bp, Artificial Sequence
  chemically synthesized
gagacagagtctcgctttgtca

SEQ ID NO: 911491 - DNA, 22 bp, Artificial Sequence
  chemically synthesized
tgagacagagtctcgctttgtc

SEQ ID NO: 911492 - DNA, 22 bp, Artificial Sequence
  chemically synthesized
ttgagacagagtctcgctttgt

SEQ ID NO: 911493 - DNA, 22 bp, Artificial Sequence
  chemically synthesized
cagcctggatgacaaagcgaga

SEQ ID NO: 911494 - DNA, 22 bp, Artificial Sequence
  chemically synthesized
tttgagacagagtctcgctttg

SEQ ID NO: 911495 - DNA, 22 bp, Artificial Sequence
  chemically synthesized
ttttttgagacagagtctcgct

SEQ ID NO: 911496 - DNA, 22 bp, Artificial Sequence
  chemically synthesized
attttttgagacagagtctcgc

SEQ ID NO: 911497 - DNA, 22 bp, Artificial Sequence
  chemically synthesized
gatgacaaagcgagactctgtc

SEQ ID NO: 911498 - DNA, 22 bp, Artificial Sequence
  chemically synthesized
tttattttttgagacagagtct

SEQ ID NO: 911499 - DNA, 22 bp, Artificial Sequence
  chemically synthesized
atttattttttgagacagagtc

SEQ ID NO: 911500 - DNA, 22 bp, Artificial Sequence
  chemically synthesized
tatttattttttgagacagagt

SEQ ID NO: 911501 - DNA, 22 bp, Artificial Sequence
  chemically synthesized
ttatttattttttgagacagag

SEQ ID NO: 911502 - DNA, 22 bp, Artificial Sequence
  chemically synthesized
tttatttattttttgagacaga

SEQ ID NO: 911503 - DNA, 22 bp, Artificial Sequence
  chemically synthesized
ttttatttattttttgagacag

SEQ ID NO: 911504 - DNA, 22 bp, Artificial Sequence
  chemically synthesized
tttttatttattttttgagaca

SEQ ID NO: 911505 - DNA, 22 bp, Artificial Sequence
  chemically synthesized
ttttttatttattttttgagac

SEQ ID NO: 911506 - DNA, 22 bp, Artificial Sequence
  chemically synthesized
tttttttatttattttttgaga

SEQ ID NO: 911507 - DNA, 22 bp, Artificial Sequence
  chemically synthesized
ttttttttatttattttttgag

SEQ ID NO: 911508 - DNA, 22 bp, Artificial Sequence
  chemically synthesized
tttttttttttatttatttttt

SEQ ID NO: 911509 - DNA, 22 bp, Artificial Sequence
  chemically synthesized
atttttttttttatttattttt

SEQ ID NO: 911510 - DNA, 22 bp, Artificial Sequence
  chemically synthesized
tatttttttttttatttatttt

SEQ ID NO: 911511 - DNA, 22 bp, Artificial Sequence
  chemically synthesized
ttttatttttttttttatttat

SEQ ID NO: 911512 - DNA, 22 bp, Artificial Sequence
  chemically synthesized
tgtctcaaaaaataaataaaaa

SEQ ID NO: 911513 - DNA, 22 bp, Artificial Sequence
  chemically synthesized
attttatttttttttttattta

SEQ ID NO: 911514 - DNA, 22 bp, Artificial Sequence
  chemically synthesized
tattttatttttttttttattt

SEQ ID NO: 911515 - DNA, 22 bp, Artificial Sequence
  chemically synthesized
tctcaaaaaataaataaaaaaa

SEQ ID NO: 911516 - DNA, 22 bp, Artificial Sequence
  chemically synthesized
aaaaaataaataaaaaaaaaaa

SEQ ID NO: 911517 - DNA, 22 bp, Artificial Sequence
  chemically synthesized
tacctttattttattttttttt

SEQ ID NO: 911518 - DNA, 22 bp, Artificial Sequence
  chemically synthesized
gtacctttattttatttttttt

SEQ ID NO: 911519 - DNA, 22 bp, Artificial Sequence
  chemically synthesized
ttgtacctttattttatttttt

SEQ ID NO: 911520 - DNA, 22 bp, Artificial Sequence
  chemically synthesized
ctcttgtacctttattttattt

SEQ ID NO: 911521 - DNA, 22 bp, Artificial Sequence
  chemically synthesized
actcttgtacctttattttatt

SEQ ID NO: 911522 - DNA, 22 bp, Artificial Sequence
  chemically synthesized
accccttactcttgtaccttta

SEQ ID NO: 911523 - DNA, 22 bp, Artificial Sequence
  chemically synthesized
agccaactgaccccttactctt

SEQ ID NO: 911524 - DNA, 22 bp, Artificial Sequence
  chemically synthesized
cgtattgagccaactgacccct

SEQ ID NO: 911525 - DNA, 22 bp, Artificial Sequence
  chemically synthesized
tgcgtattgagccaactgaccc

SEQ ID NO: 911526 - DNA, 22 bp, Artificial Sequence
  chemically synthesized
cattctgcgtattgagccaact

SEQ ID NO: 911527 - DNA, 22 bp, Artificial Sequence
  chemically synthesized
atatgctgcattctgcgtattg

SEQ ID NO: 911528 - DNA, 22 bp, Artificial Sequence
  chemically synthesized
taatatgctgcattctgcgtat

SEQ ID NO: 911529 - DNA, 22 bp, Artificial Sequence
  chemically synthesized
actctaatatgctgcattctgc

SEQ ID NO: 911530 - DNA, 22 bp, Artificial Sequence
  chemically synthesized
gctcaatacgcagaatgcagca

SEQ ID NO: 911531 - DNA, 22 bp, Artificial Sequence
  chemically synthesized
aatacgcagaatgcagcatatt

SEQ ID NO: 911532 - DNA, 22 bp, Artificial Sequence
  chemically synthesized
cacagctaactctaatatgctg

SEQ ID NO: 911533 - DNA, 22 bp, Artificial Sequence
  chemically synthesized
tccacagctaactctaatatgc

SEQ ID NO: 911534 - DNA, 22 bp, Artificial Sequence
  chemically synthesized
ctccacagctaactctaatatg

SEQ ID NO: 911535 - DNA, 22 bp, Artificial Sequence
  chemically synthesized
tctccacagctaactctaatat

SEQ ID NO: 911536 - DNA, 22 bp, Artificial Sequence
  chemically synthesized
gcaggtgactttctccacagct

SEQ ID NO: 911537 - DNA, 22 bp, Artificial Sequence
  chemically synthesized
gagttagctgtggagaaagtca

SEQ ID NO: 911538 - DNA, 22 bp, Artificial Sequence
  chemically synthesized
gctgtggagaaagtcacctgcc

SEQ ID NO: 911539 - DNA, 22 bp, Artificial Sequence
  chemically synthesized
atatcataatcagttggcaggt

SEQ ID NO: 911540 - DNA, 22 bp, Artificial Sequence
  chemically synthesized
tggagaaagtcacctgccaact

SEQ ID NO: 911541 - DNA, 22 bp, Artificial Sequence
  chemically synthesized
caaacatatcctaatatcataa

SEQ ID NO: 911542 - DNA, 22 bp, Artificial Sequence
  chemically synthesized
ccaactgattatgatattagga

SEQ ID NO: 911543 - DNA, 22 bp, Artificial Sequence
  chemically synthesized
attatgatattaggatatgttt

SEQ ID NO: 911544 - DNA, 22 bp, Artificial Sequence
  chemically synthesized
gtacatagtatctccaaacata

SEQ ID NO: 911545 - DNA, 22 bp, Artificial Sequence
  chemically synthesized
tgatattaggatatgtttggag

SEQ ID NO: 911546 - DNA, 22 bp, Artificial Sequence
  chemically synthesized
agtacatagtatctccaaacat

SEQ ID NO: 911547 - DNA, 22 bp, Artificial Sequence
  chemically synthesized
cttagtacatagtatctccaaa

SEQ ID NO: 911548 - DNA, 22 bp, Artificial Sequence
  chemically synthesized
ggatatgtttggagatactatg

SEQ ID NO: 911549 - DNA, 22 bp, Artificial Sequence
  chemically synthesized
ggagatactatgtactaaggaa

SEQ ID NO: 911550 - DNA, 22 bp, Artificial Sequence
  chemically synthesized
gagatactatgtactaaggaat

SEQ ID NO: 911551 - DNA, 22 bp, Artificial Sequence
  chemically synthesized
tgacatgaatatgtcaattcct

SEQ ID NO: 911552 - DNA, 22 bp, Artificial Sequence
  chemically synthesized
ctgtgacatgaatatgtcaatt

SEQ ID NO: 911553 - DNA, 22 bp, Artificial Sequence
  chemically synthesized
tgtactaaggaattgacatatt

SEQ ID NO: 911554 - DNA, 22 bp, Artificial Sequence
  chemically synthesized
aggaattgacatattcatgtca

SEQ ID NO: 911555 - DNA, 22 bp, Artificial Sequence
  chemically synthesized
gtgggtcatagttactgtgaca

SEQ ID NO: 911556 - DNA, 22 bp, Artificial Sequence
  chemically synthesized
acatattcatgtcacagtaact

SEQ ID NO: 911557 - DNA, 22 bp, Artificial Sequence
  chemically synthesized
gaactagtgggtcatagttact

SEQ ID NO: 911558 - DNA, 22 bp, Artificial Sequence
  chemically synthesized
atgtcacagtaactatgaccca

SEQ ID NO: 911559 - DNA, 22 bp, Artificial Sequence
  chemically synthesized
gagtgggtgatataattggaac

SEQ ID NO: 911560 - DNA, 22 bp, Artificial Sequence
  chemically synthesized
tgacccactagttccaattata

SEQ ID NO: 911561 - DNA, 22 bp, Artificial Sequence
  chemically synthesized
gttccaattatatcacccactc

SEQ ID NO: 911562 - DNA, 22 bp, Artificial Sequence
  chemically synthesized
atccaaaggttagagtgggtga

SEQ ID NO: 911563 - DNA, 22 bp, Artificial Sequence
  chemically synthesized
catccaaaggttagagtgggtg

SEQ ID NO: 911564 - DNA, 22 bp, Artificial Sequence
  chemically synthesized
caattatatcacccactctaac

SEQ ID NO: 911565 - DNA, 22 bp, Artificial Sequence
  chemically synthesized
cccttcatccaaaggttagagt

SEQ ID NO: 911566 - DNA, 22 bp, Artificial Sequence
  chemically synthesized
tatcacccactctaacctttgg

SEQ ID NO: 911567 - DNA, 22 bp, Artificial Sequence
  chemically synthesized
cagccctacccttcatccaaag

SEQ ID NO: 911568 - DNA, 22 bp, Artificial Sequence
  chemically synthesized
tgtcctccagccctacccttca

SEQ ID NO: 911569 - DNA, 22 bp, Artificial Sequence
  chemically synthesized
taacctttggatgaagggtagg

SEQ ID NO: 911570 - DNA, 22 bp, Artificial Sequence
  chemically synthesized
acctttggatgaagggtagggc

SEQ ID NO: 911571 - DNA, 22 bp, Artificial Sequence
  chemically synthesized
cctgtgtcctccagccctaccc

SEQ ID NO: 911572 - DNA, 22 bp, Artificial Sequence
  chemically synthesized
tggatgaagggtagggctggag

SEQ ID NO: 911573 - DNA, 22 bp, Artificial Sequence
  chemically synthesized
ggatgaagggtagggctggagg

SEQ ID NO: 911574 - DNA, 22 bp, Artificial Sequence
  chemically synthesized
gatgaagggtagggctggagga

SEQ ID NO: 911575 - DNA, 22 bp, Artificial Sequence
  chemically synthesized
gaggacacagggagggggtccg

SEQ ID NO: 911576 - DNA, 22 bp, Artificial Sequence
  chemically synthesized
caggagggtagaaataaagcgg

SEQ ID NO: 911577 - DNA, 22 bp, Artificial Sequence
  chemically synthesized
ttacaggagggtagaaataaag

SEQ ID NO: 911578 - DNA, 22 bp, Artificial Sequence
  chemically synthesized
attacaggagggtagaaataaa

SEQ ID NO: 911579 - DNA, 22 bp, Artificial Sequence
  chemically synthesized
cttattacaggagggtagaaat

SEQ ID NO: 911580 - DNA, 22 bp, Artificial Sequence
  chemically synthesized
acttattacaggagggtagaaa

SEQ ID NO: 911581 - DNA, 22 bp, Artificial Sequence
  chemically synthesized
ttacttattacaggagggtaga

SEQ ID NO: 911582 - DNA, 22 bp, Artificial Sequence
  chemically synthesized
aagctcttacttattacaggag

SEQ ID NO: 911583 - DNA, 22 bp, Artificial Sequence
  chemically synthesized
tatttctaccctcctgtaataa

SEQ ID NO: 911584 - DNA, 22 bp, Artificial Sequence
  chemically synthesized
atttctaccctcctgtaataag

SEQ ID NO: 911585 - DNA, 22 bp, Artificial Sequence
  chemically synthesized
tttctaccctcctgtaataagt

SEQ ID NO: 911586 - DNA, 22 bp, Artificial Sequence
  chemically synthesized
aatctcaagctcttacttatta

SEQ ID NO: 911587 - DNA, 22 bp, Artificial Sequence
  chemically synthesized
ctaccctcctgtaataagtaag

SEQ ID NO: 911588 - DNA, 22 bp, Artificial Sequence
  chemically synthesized
taccctcctgtaataagtaaga

SEQ ID NO: 911589 - DNA, 22 bp, Artificial Sequence
  chemically synthesized
ccctcctgtaataagtaagagc

SEQ ID NO: 911590 - DNA, 22 bp, Artificial Sequence
  chemically synthesized
attaaatctcaagctcttactt

SEQ ID NO: 911591 - DNA, 22 bp, Artificial Sequence
  chemically synthesized
cattaaatctcaagctcttact

SEQ ID NO: 911592 - DNA, 22 bp, Artificial Sequence
  chemically synthesized
ctgtaataagtaagagcttgag

SEQ ID NO: 911593 - DNA, 22 bp, Artificial Sequence
  chemically synthesized
atcttcattaaatctcaagctc

SEQ ID NO: 911594 - DNA, 22 bp, Artificial Sequence
  chemically synthesized
gatcttcattaaatctcaagct

SEQ ID NO: 911595 - DNA, 22 bp, Artificial Sequence
  chemically synthesized
taataagtaagagcttgagatt

SEQ ID NO: 911596 - DNA, 22 bp, Artificial Sequence
  chemically synthesized
gcagacagtcttgatcttcatt

SEQ ID NO: 911597 - DNA, 22 bp, Artificial Sequence
  chemically synthesized
gagatttaatgaagatcaagac

SEQ ID NO: 911598 - DNA, 22 bp, Artificial Sequence
  chemically synthesized
agatttaatgaagatcaagact

SEQ ID NO: 911599 - DNA, 22 bp, Artificial Sequence
  chemically synthesized
taacactggcagacagtcttga

SEQ ID NO: 911600 - DNA, 22 bp, Artificial Sequence
  chemically synthesized
ataacactggcagacagtcttg

SEQ ID NO: 911601 - DNA, 22 bp, Artificial Sequence
  chemically synthesized
aatgaagatcaagactgtctgc

SEQ ID NO: 911602 - DNA, 22 bp, Artificial Sequence
  chemically synthesized
atgaagatcaagactgtctgcc

SEQ ID NO: 911603 - DNA, 22 bp, Artificial Sequence
  chemically synthesized
tctgccagtgttataagccatt

SEQ ID NO: 911604 - DNA, 22 bp, Artificial Sequence
  chemically synthesized
aaagtaaaagaaaatggcttat

SEQ ID NO: 911605 - DNA, 22 bp, Artificial Sequence
  chemically synthesized
aaaagtaaaagaaaatggctta

SEQ ID NO: 911606 - DNA, 22 bp, Artificial Sequence
  chemically synthesized
taaaagtaaaagaaaatggctt

SEQ ID NO: 911607 - DNA, 22 bp, Artificial Sequence
  chemically synthesized
ttaaaagtaaaagaaaatggct

SEQ ID NO: 911608 - DNA, 22 bp, Artificial Sequence
  chemically synthesized
ccagtgttataagccattttct

SEQ ID NO: 911609 - DNA, 22 bp, Artificial Sequence
  chemically synthesized
tttaaaagtaaaagaaaatggc

SEQ ID NO: 911610 - DNA, 22 bp, Artificial Sequence
  chemically synthesized
ttttaaaagtaaaagaaaatgg

SEQ ID NO: 911611 - DNA, 22 bp, Artificial Sequence
  chemically synthesized
taagccattttcttttactttt

SEQ ID NO: 911612 - DNA, 22 bp, Artificial Sequence
  chemically synthesized
tcttttacttttaaaaaaactt

SEQ ID NO: 911613 - DNA, 22 bp, Artificial Sequence
  chemically synthesized
ggtaaataacacaagttttttt

SEQ ID NO: 911614 - DNA, 22 bp, Artificial Sequence
  chemically synthesized
cttttacttttaaaaaaacttg

SEQ ID NO: 911615 - DNA, 22 bp, Artificial Sequence
  chemically synthesized
aggtaaataacacaagtttttt

SEQ ID NO: 911616 - DNA, 22 bp, Artificial Sequence
  chemically synthesized
ttttacttttaaaaaaacttgt

SEQ ID NO: 911617 - DNA, 22 bp, Artificial Sequence
  chemically synthesized
ttacttttaaaaaaacttgtgt

SEQ ID NO: 911618 - DNA, 22 bp, Artificial Sequence
  chemically synthesized
tacttttaaaaaaacttgtgtt

SEQ ID NO: 911619 - DNA, 22 bp, Artificial Sequence
  chemically synthesized
acttttaaaaaaacttgtgtta

SEQ ID NO: 911620 - DNA, 22 bp, Artificial Sequence
  chemically synthesized
cttttaaaaaaacttgtgttat

SEQ ID NO: 911621 - DNA, 22 bp, Artificial Sequence
  chemically synthesized
ttaaaaaaacttgtgttattta

SEQ ID NO: 911622 - DNA, 22 bp, Artificial Sequence
  chemically synthesized
taaaaaaacttgtgttatttac

SEQ ID NO: 911623 - DNA, 22 bp, Artificial Sequence
  chemically synthesized
aaaaaaacttgtgttatttacc

SEQ ID NO: 911624 - DNA, 22 bp, Artificial Sequence
  chemically synthesized
aaaaaacttgtgttatttacct

SEQ ID NO: 911625 - DNA, 22 bp, Artificial Sequence
  chemically synthesized
gtgttatttacctaaatctggt

SEQ ID NO: 911626 - DNA, 22 bp, Artificial Sequence
  chemically synthesized
tgttatttacctaaatctggta

SEQ ID NO: 911627 - DNA, 22 bp, Artificial Sequence
  chemically synthesized
tttacctaaatctggtactgat

SEQ ID NO: 911628 - DNA, 22 bp, Artificial Sequence
  chemically synthesized
acctaaatctggtactgatcat

SEQ ID NO: 911629 - DNA, 22 bp, Artificial Sequence
  chemically synthesized
cctaaatctggtactgatcatt

SEQ ID NO: 911630 - DNA, 22 bp, Artificial Sequence
  chemically synthesized
gggatagaaagcaaatgatcag

SEQ ID NO: 911631 - DNA, 22 bp, Artificial Sequence
  chemically synthesized
agggatagaaagcaaatgatca

SEQ ID NO: 911632 - DNA, 22 bp, Artificial Sequence
  chemically synthesized
aatctggtactgatcatttgct

SEQ ID NO: 911633 - DNA, 22 bp, Artificial Sequence
  chemically synthesized
gatttagggatagaaagcaaat

SEQ ID NO: 911634 - DNA, 22 bp, Artificial Sequence
  chemically synthesized
agatttagggatagaaagcaaa

SEQ ID NO: 911635 - DNA, 22 bp, Artificial Sequence
  chemically synthesized
gtactgatcatttgctttctat

SEQ ID NO: 911636 - DNA, 22 bp, Artificial Sequence
  chemically synthesized
gtttagatttagggatagaaag

SEQ ID NO: 911637 - DNA, 22 bp, Artificial Sequence
  chemically synthesized
ttagtttagatttagggataga

SEQ ID NO: 911638 - DNA, 22 bp, Artificial Sequence
  chemically synthesized
atcatttgctttctatccctaa

SEQ ID NO: 911639 - DNA, 22 bp, Artificial Sequence
  chemically synthesized
gctttctatccctaaatctaaa

SEQ ID NO: 911640 - DNA, 22 bp, Artificial Sequence
  chemically synthesized
tatccctgttagtttagattta

SEQ ID NO: 911641 - DNA, 22 bp, Artificial Sequence
  chemically synthesized
ctttctatccctaaatctaaac

SEQ ID NO: 911642 - DNA, 22 bp, Artificial Sequence
  chemically synthesized
tgtatccctgttagtttagatt

SEQ ID NO: 911643 - DNA, 22 bp, Artificial Sequence
  chemically synthesized
tctatccctaaatctaaactaa

SEQ ID NO: 911644 - DNA, 22 bp, Artificial Sequence
  chemically synthesized
ctatccctaaatctaaactaac

SEQ ID NO: 911645 - DNA, 22 bp, Artificial Sequence
  chemically synthesized
tatccctaaatctaaactaaca

SEQ ID NO: 911646 - DNA, 22 bp, Artificial Sequence
  chemically synthesized
tccctaaatctaaactaacagg

SEQ ID NO: 911647 - DNA, 22 bp, Artificial Sequence
  chemically synthesized
aatctaaactaacagggataca

SEQ ID NO: 911648 - DNA, 22 bp, Artificial Sequence
  chemically synthesized
catccatatgcctctgtatccc

SEQ ID NO: 911649 - DNA, 22 bp, Artificial Sequence
  chemically synthesized
tccatccatatgcctctgtatc

SEQ ID NO: 911650 - DNA, 22 bp, Artificial Sequence
  chemically synthesized
ctccatccatatgcctctgtat

SEQ ID NO: 911651 - DNA, 22 bp, Artificial Sequence
  chemically synthesized
aactaacagggatacagaggca

SEQ ID NO: 911652 - DNA, 22 bp, Artificial Sequence
  chemically synthesized
tctccatccatatgcctctgta

SEQ ID NO: 911653 - DNA, 22 bp, Artificial Sequence
  chemically synthesized
ttctccatccatatgcctctgt

SEQ ID NO: 911654 - DNA, 22 bp, Artificial Sequence
  chemically synthesized
acagggatacagaggcatatgg

SEQ ID NO: 911655 - DNA, 22 bp, Artificial Sequence
  chemically synthesized
atcatcttttctccatccatat

SEQ ID NO: 911656 - DNA, 22 bp, Artificial Sequence
  chemically synthesized
aatcatcttttctccatccata

SEQ ID NO: 911657 - DNA, 22 bp, Artificial Sequence
  chemically synthesized
tttaatcatcttttctccatcc

SEQ ID NO: 911658 - DNA, 22 bp, Artificial Sequence
  chemically synthesized
aaattatttaatcatcttttct

SEQ ID NO: 911659 - DNA, 22 bp, Artificial Sequence
  chemically synthesized
gtcatattaaaattatttaatc

SEQ ID NO: 911660 - DNA, 22 bp, Artificial Sequence
  chemically synthesized
attagtcatattaaaattattt

SEQ ID NO: 911661 - DNA, 22 bp, Artificial Sequence
  chemically synthesized
ttcattagtcatattaaaatta

SEQ ID NO: 911662 - DNA, 22 bp, Artificial Sequence
  chemically synthesized
attcattagtcatattaaaatt

SEQ ID NO: 911663 - DNA, 22 bp, Artificial Sequence
  chemically synthesized
tattcattagtcatattaaaat

SEQ ID NO: 911664 - DNA, 22 bp, Artificial Sequence
  chemically synthesized
gaattttattcattagtcatat

SEQ ID NO: 911665 - DNA, 22 bp, Artificial Sequence
  chemically synthesized
ggaattttattcattagtcata

SEQ ID NO: 911666 - DNA, 22 bp, Artificial Sequence
  chemically synthesized
aataattttaatatgactaatg

SEQ ID NO: 911667 - DNA, 22 bp, Artificial Sequence
  chemically synthesized
taatatgactaatgaataaaat

SEQ ID NO: 911668 - DNA, 22 bp, Artificial Sequence
  chemically synthesized
aatatgactaatgaataaaatt

SEQ ID NO: 911669 - DNA, 22 bp, Artificial Sequence
  chemically synthesized
atatgactaatgaataaaattc

SEQ ID NO: 911670 - DNA, 22 bp, Artificial Sequence
  chemically synthesized
aatgccacaggatttggaattt

SEQ ID NO: 911671 - DNA, 22 bp, Artificial Sequence
  chemically synthesized
atgaataaaattccaaatcctg

SEQ ID NO: 911672 - DNA, 22 bp, Artificial Sequence
  chemically synthesized
ccattaaatgccacaggatttg

SEQ ID NO: 911673 - DNA, 22 bp, Artificial Sequence
  chemically synthesized
gccattaaatgccacaggattt

SEQ ID NO: 911674 - DNA, 22 bp, Artificial Sequence
  chemically synthesized
tgccattaaatgccacaggatt

SEQ ID NO: 911675 - DNA, 22 bp, Artificial Sequence
  chemically synthesized
caaatcctgtggcatttaatgg

SEQ ID NO: 911676 - DNA, 22 bp, Artificial Sequence
  chemically synthesized
atgcaatgtctttgccattaaa

SEQ ID NO: 911677 - DNA, 22 bp, Artificial Sequence
  chemically synthesized
aatgcaatgtctttgccattaa

SEQ ID NO: 911678 - DNA, 22 bp, Artificial Sequence
  chemically synthesized
taatgcaatgtctttgccatta

SEQ ID NO: 911679 - DNA, 22 bp, Artificial Sequence
  chemically synthesized
tggcatttaatggcaaagacat

SEQ ID NO: 911680 - DNA, 22 bp, Artificial Sequence
  chemically synthesized
taattttaatgcaatgtctttg

SEQ ID NO: 911681 - DNA, 22 bp, Artificial Sequence
  chemically synthesized
aatggcaaagacattgcattaa

SEQ ID NO: 911682 - DNA, 22 bp, Artificial Sequence
  chemically synthesized
atggcaaagacattgcattaaa

SEQ ID NO: 911683 - DNA, 22 bp, Artificial Sequence
  chemically synthesized
tgccaaaattataattttaatg

SEQ ID NO: 911684 - DNA, 22 bp, Artificial Sequence
  chemically synthesized
ctatgccaaaattataatttta

SEQ ID NO: 911685 - DNA, 22 bp, Artificial Sequence
  chemically synthesized
cctatgccaaaattataatttt

SEQ ID NO: 911686 - DNA, 22 bp, Artificial Sequence
  chemically synthesized
tttcctatgccaaaattataat

SEQ ID NO: 911687 - DNA, 22 bp, Artificial Sequence
  chemically synthesized
cattaaaattataattttggca

SEQ ID NO: 911688 - DNA, 22 bp, Artificial Sequence
  chemically synthesized
aaattataattttggcatagga

SEQ ID NO: 911689 - DNA, 22 bp, Artificial Sequence
  chemically synthesized
taattttggcataggaaacaga

SEQ ID NO: 911690 - DNA, 22 bp, Artificial Sequence
  chemically synthesized
cagcatccataatatctgtttc

SEQ ID NO: 911691 - DNA, 22 bp, Artificial Sequence
  chemically synthesized
ctacagcatccataatatctgt

SEQ ID NO: 911692 - DNA, 22 bp, Artificial Sequence
  chemically synthesized
tggcataggaaacagatattat

SEQ ID NO: 911693 - DNA, 22 bp, Artificial Sequence
  chemically synthesized
ggcataggaaacagatattatg

SEQ ID NO: 911694 - DNA, 22 bp, Artificial Sequence
  chemically synthesized
gcataggaaacagatattatgg

SEQ ID NO: 911695 - DNA, 22 bp, Artificial Sequence
  chemically synthesized
tattactacagcatccataata

SEQ ID NO: 911696 - DNA, 22 bp, Artificial Sequence
  chemically synthesized
atattactacagcatccataat

SEQ ID NO: 911697 - DNA, 22 bp, Artificial Sequence
  chemically synthesized
tggatgctgtagtaatataagt

SEQ ID NO: 911698 - DNA, 22 bp, Artificial Sequence
  chemically synthesized
cgaacaccatcatgtatagact

SEQ ID NO: 911699 - DNA, 22 bp, Artificial Sequence
  chemically synthesized
tagtaatataagtctatacatg

SEQ ID NO: 911700 - DNA, 22 bp, Artificial Sequence
  chemically synthesized
aggttacgaacaccatcatgta

SEQ ID NO: 911701 - DNA, 22 bp, Artificial Sequence
  chemically synthesized
aaactgaggttacgaacaccat

SEQ ID NO: 911702 - DNA, 22 bp, Artificial Sequence
  chemically synthesized
tacatgatggtgttcgtaacct

SEQ ID NO: 911703 - DNA, 22 bp, Artificial Sequence
  chemically synthesized
tgatagaaaattaaaactgagg

SEQ ID NO: 911704 - DNA, 22 bp, Artificial Sequence
  chemically synthesized
atgatagaaaattaaaactgag

SEQ ID NO: 911705 - DNA, 22 bp, Artificial Sequence
  chemically synthesized
tatgatagaaaattaaaactga

SEQ ID NO: 911706 - DNA, 22 bp, Artificial Sequence
  chemically synthesized
ttatgatagaaaattaaaactg

SEQ ID NO: 911707 - DNA, 22 bp, Artificial Sequence
  chemically synthesized
gtaacctcagttttaattttct

SEQ ID NO: 911708 - DNA, 22 bp, Artificial Sequence
  chemically synthesized
agttttaattttctatcataaa

SEQ ID NO: 911709 - DNA, 22 bp, Artificial Sequence
  chemically synthesized
taattttctatcataaaaattt

SEQ ID NO: 911710 - DNA, 22 bp, Artificial Sequence
  chemically synthesized
aattttctatcataaaaatttg

SEQ ID NO: 911711 - DNA, 22 bp, Artificial Sequence
  chemically synthesized
attttctatcataaaaatttga

SEQ ID NO: 911712 - DNA, 22 bp, Artificial Sequence
  chemically synthesized
caacagaataaaaagtcaaatt

SEQ ID NO: 911713 - DNA, 22 bp, Artificial Sequence
  chemically synthesized
tctatcataaaaatttgacttt

SEQ ID NO: 911714 - DNA, 22 bp, Artificial Sequence
  chemically synthesized
ctatcataaaaatttgactttt

SEQ ID NO: 911715 - DNA, 22 bp, Artificial Sequence
  chemically synthesized
tatcataaaaatttgacttttt

SEQ ID NO: 911716 - DNA, 22 bp, Artificial Sequence
  chemically synthesized
tcataaaaatttgactttttat

SEQ ID NO: 911717 - DNA, 22 bp, Artificial Sequence
  chemically synthesized
tgtgtcctgcaacagaataaaa

SEQ ID NO: 911718 - DNA, 22 bp, Artificial Sequence
  chemically synthesized
atgtgtcctgcaacagaataaa

SEQ ID NO: 911719 - DNA, 22 bp, Artificial Sequence
  chemically synthesized
tatgtgtcctgcaacagaataa

SEQ ID NO: 911720 - DNA, 22 bp, Artificial Sequence
  chemically synthesized
gactttttattctgttgcagga

SEQ ID NO: 911721 - DNA, 22 bp, Artificial Sequence
  chemically synthesized
actttttattctgttgcaggac

SEQ ID NO: 911722 - DNA, 22 bp, Artificial Sequence
  chemically synthesized
tttattctgttgcaggacacat

SEQ ID NO: 911723 - DNA, 22 bp, Artificial Sequence
  chemically synthesized
ttattctgttgcaggacacata

SEQ ID NO: 911724 - DNA, 22 bp, Artificial Sequence
  chemically synthesized
tattctgttgcaggacacataa

SEQ ID NO: 911725 - DNA, 22 bp, Artificial Sequence
  chemically synthesized
attctgttgcaggacacataaa

SEQ ID NO: 911726 - DNA, 22 bp, Artificial Sequence
  chemically synthesized
ttctgttgcaggacacataaaa

SEQ ID NO: 911727 - DNA, 22 bp, Artificial Sequence
  chemically synthesized
tgaaagagtcaaggttttatgt

SEQ ID NO: 911728 - DNA, 22 bp, Artificial Sequence
  chemically synthesized
tgttgcaggacacataaaacct

SEQ ID NO: 911729 - DNA, 22 bp, Artificial Sequence
  chemically synthesized
ttgcaggacacataaaaccttg

SEQ ID NO: 911730 - DNA, 22 bp, Artificial Sequence
  chemically synthesized
caggacacataaaaccttgact

SEQ ID NO: 911731 - DNA, 22 bp, Artificial Sequence
  chemically synthesized
tgggttgtgaaagagtcaaggt

SEQ ID NO: 911732 - DNA, 22 bp, Artificial Sequence
  chemically synthesized
gtgggttgtgaaagagtcaagg

SEQ ID NO: 911733 - DNA, 22 bp, Artificial Sequence
  chemically synthesized
tgtgggttgtgaaagagtcaag

SEQ ID NO: 911734 - DNA, 22 bp, Artificial Sequence
  chemically synthesized
gactctttcacaacccacaaag

SEQ ID NO: 911735 - DNA, 22 bp, Artificial Sequence
  chemically synthesized
actctttcacaacccacaaagc

SEQ ID NO: 911736 - DNA, 22 bp, Artificial Sequence
  chemically synthesized
aaatatacaatagcagctttgt

SEQ ID NO: 911737 - DNA, 22 bp, Artificial Sequence
  chemically synthesized
tttcacaacccacaaagctgct

SEQ ID NO: 911738 - DNA, 22 bp, Artificial Sequence
  chemically synthesized
tcacaacccacaaagctgctat

SEQ ID NO: 911739 - DNA, 22 bp, Artificial Sequence
  chemically synthesized
cacaacccacaaagctgctatt

SEQ ID NO: 911740 - DNA, 22 bp, Artificial Sequence
  chemically synthesized
tctaaaatatacaatagcagct

SEQ ID NO: 911741 - DNA, 22 bp, Artificial Sequence
  chemically synthesized
acaacccacaaagctgctattg

SEQ ID NO: 911742 - DNA, 22 bp, Artificial Sequence
  chemically synthesized
ctattgtatattttagatagtt

SEQ ID NO: 911743 - DNA, 22 bp, Artificial Sequence
  chemically synthesized
ttgtatattttagatagttctc

SEQ ID NO: 911744 - DNA, 22 bp, Artificial Sequence
  chemically synthesized
taggaaatgtgagagaactatc

SEQ ID NO: 911745 - DNA, 22 bp, Artificial Sequence
  chemically synthesized
tatattttagatagttctctca

SEQ ID NO: 911746 - DNA, 22 bp, Artificial Sequence
  chemically synthesized
taattgtaggaaatgtgagaga

SEQ ID NO: 911747 - DNA, 22 bp, Artificial Sequence
  chemically synthesized
tagatagttctctcacatttcc

SEQ ID NO: 911748 - DNA, 22 bp, Artificial Sequence
  chemically synthesized
agatagttctctcacatttcct

SEQ ID NO: 911749 - DNA, 22 bp, Artificial Sequence
  chemically synthesized
gatagttctctcacatttccta

SEQ ID NO: 911750 - DNA, 22 bp, Artificial Sequence
  chemically synthesized
tctcacatttcctacaattata

SEQ ID NO: 911751 - DNA, 22 bp, Artificial Sequence
  chemically synthesized
tcacatttcctacaattataat

SEQ ID NO: 911752 - DNA, 22 bp, Artificial Sequence
  chemically synthesized
acatttcctacaattataattt

SEQ ID NO: 911753 - DNA, 22 bp, Artificial Sequence
  chemically synthesized
cctacaattataatttttgttc

SEQ ID NO: 911754 - DNA, 22 bp, Artificial Sequence
  chemically synthesized
tgacaaaaagaagaacaaaaat

SEQ ID NO: 911755 - DNA, 22 bp, Artificial Sequence
  chemically synthesized
ctacaattataatttttgttct

SEQ ID NO: 911756 - DNA, 22 bp, Artificial Sequence
  chemically synthesized
atgacaaaaagaagaacaaaaa

SEQ ID NO: 911757 - DNA, 22 bp, Artificial Sequence
  chemically synthesized
caattataatttttgttcttct

SEQ ID NO: 911758 - DNA, 22 bp, Artificial Sequence
  chemically synthesized
taatttttgttcttctttttgt

SEQ ID NO: 911759 - DNA, 22 bp, Artificial Sequence
  chemically synthesized
agtacatcttatgacaaaaaga

SEQ ID NO: 911760 - DNA, 22 bp, Artificial Sequence
  chemically synthesized
ttgttcttctttttgtcataag

SEQ ID NO: 911761 - DNA, 22 bp, Artificial Sequence
  chemically synthesized
tgttcttctttttgtcataaga

SEQ ID NO: 911762 - DNA, 22 bp, Artificial Sequence
  chemically synthesized
gttcttctttttgtcataagat

SEQ ID NO: 911763 - DNA, 22 bp, Artificial Sequence
  chemically synthesized
ttcttctttttgtcataagatg

SEQ ID NO: 911764 - DNA, 22 bp, Artificial Sequence
  chemically synthesized
caatatctcagtacatcttatg

SEQ ID NO: 911765 - DNA, 22 bp, Artificial Sequence
  chemically synthesized
ttctttttgtcataagatgtac

SEQ ID NO: 911766 - DNA, 22 bp, Artificial Sequence
  chemically synthesized
tacaatatctcagtacatctta

SEQ ID NO: 911767 - DNA, 22 bp, Artificial Sequence
  chemically synthesized
ctttttgtcataagatgtactg

SEQ ID NO: 911768 - DNA, 22 bp, Artificial Sequence
  chemically synthesized
tttttgtcataagatgtactga

SEQ ID NO: 911769 - DNA, 22 bp, Artificial Sequence
  chemically synthesized
tttgtcataagatgtactgaga

SEQ ID NO: 911770 - DNA, 22 bp, Artificial Sequence
  chemically synthesized
ttgtcataagatgtactgagat

SEQ ID NO: 911771 - DNA, 22 bp, Artificial Sequence
  chemically synthesized
tgtcataagatgtactgagata

SEQ ID NO: 911772 - DNA, 22 bp, Artificial Sequence
  chemically synthesized
gtcataagatgtactgagatat

SEQ ID NO: 911773 - DNA, 22 bp, Artificial Sequence
  chemically synthesized
tcataagatgtactgagatatt

SEQ ID NO: 911774 - DNA, 22 bp, Artificial Sequence
  chemically synthesized
agatattgtagaacattttggg

SEQ ID NO: 911775 - DNA, 22 bp, Artificial Sequence
  chemically synthesized
tagaacattttgggtatccttc

SEQ ID NO: 911776 - DNA, 22 bp, Artificial Sequence
  chemically synthesized
ataaaaagagaacaaggaggaa

SEQ ID NO: 911777 - DNA, 22 bp, Artificial Sequence
  chemically synthesized
tgggtatccttcctccttgttc

SEQ ID NO: 911778 - DNA, 22 bp, Artificial Sequence
  chemically synthesized
gggtatccttcctccttgttct

SEQ ID NO: 911779 - DNA, 22 bp, Artificial Sequence
  chemically synthesized
ggtatccttcctccttgttctc

SEQ ID NO: 911780 - DNA, 22 bp, Artificial Sequence
  chemically synthesized
cctccttgttctctttttatga

SEQ ID NO: 911781 - DNA, 22 bp, Artificial Sequence
  chemically synthesized
ctccttgttctctttttatgag

SEQ ID NO: 911782 - DNA, 22 bp, Artificial Sequence
  chemically synthesized
cttgttctctttttatgaggga

SEQ ID NO: 911783 - DNA, 22 bp, Artificial Sequence
  chemically synthesized
gttctctttttatgagggatga

SEQ ID NO: 911784 - DNA, 22 bp, Artificial Sequence
  chemically synthesized
ttctctttttatgagggatgat

SEQ ID NO: 911785 - DNA, 22 bp, Artificial Sequence
  chemically synthesized
tctttttatgagggatgatttc

SEQ ID NO: 911786 - DNA, 22 bp, Artificial Sequence
  chemically synthesized
tttttatgagggatgatttcat

SEQ ID NO: 911787 - DNA, 22 bp, Artificial Sequence
  chemically synthesized
cataacaatacaaatgaaatca

SEQ ID NO: 911788 - DNA, 22 bp, Artificial Sequence
  chemically synthesized
tttatgagggatgatttcattt

SEQ ID NO: 911789 - DNA, 22 bp, Artificial Sequence
  chemically synthesized
ttatgagggatgatttcatttg

SEQ ID NO: 911790 - DNA, 22 bp, Artificial Sequence
  chemically synthesized
tatgagggatgatttcatttgt

SEQ ID NO: 911791 - DNA, 22 bp, Artificial Sequence
  chemically synthesized
atgagggatgatttcatttgta

SEQ ID NO: 911792 - DNA, 22 bp, Artificial Sequence
  chemically synthesized
tgagggatgatttcatttgtat

SEQ ID NO: 911793 - DNA, 22 bp, Artificial Sequence
  chemically synthesized
tagctacataacaatacaaatg

SEQ ID NO: 911794 - DNA, 22 bp, Artificial Sequence
  chemically synthesized
atagctacataacaatacaaat

SEQ ID NO: 911795 - DNA, 22 bp, Artificial Sequence
  chemically synthesized
tatagctacataacaatacaaa

SEQ ID NO: 911796 - DNA, 22 bp, Artificial Sequence
  chemically synthesized
aattttatagctacataacaat

SEQ ID NO: 911797 - DNA, 22 bp, Artificial Sequence
  chemically synthesized
catttgtattgttatgtagcta

SEQ ID NO: 911798 - DNA, 22 bp, Artificial Sequence
  chemically synthesized
atttgtattgttatgtagctat

SEQ ID NO: 911799 - DNA, 22 bp, Artificial Sequence
  chemically synthesized
gtattgttatgtagctataaaa

SEQ ID NO: 911800 - DNA, 22 bp, Artificial Sequence
  chemically synthesized
tattgttatgtagctataaaat

SEQ ID NO: 911801 - DNA, 22 bp, Artificial Sequence
  chemically synthesized
ttatgtagctataaaatttaat

SEQ ID NO: 911802 - DNA, 22 bp, Artificial Sequence
  chemically synthesized
tgtagctataaaatttaattgc

SEQ ID NO: 911803 - DNA, 22 bp, Artificial Sequence
  chemically synthesized
taaaatttaattgctgggacac

SEQ ID NO: 911804 - DNA, 22 bp, Artificial Sequence
  chemically synthesized
tgtatggagggaaggtggtgtc

SEQ ID NO: 911805 - DNA, 22 bp, Artificial Sequence
  chemically synthesized
atgtatggagggaaggtggtgt

SEQ ID NO: 911806 - DNA, 22 bp, Artificial Sequence
  chemically synthesized
tatgtatggagggaaggtggtg

SEQ ID NO: 911807 - DNA, 22 bp, Artificial Sequence
  chemically synthesized
aattgctgggacaccaccttcc

SEQ ID NO: 911808 - DNA, 22 bp, Artificial Sequence
  chemically synthesized
ttatgtatggagggaaggtggt

SEQ ID NO: 911809 - DNA, 22 bp, Artificial Sequence
  chemically synthesized
attgctgggacaccaccttccc

SEQ ID NO: 911810 - DNA, 22 bp, Artificial Sequence
  chemically synthesized
ctgggacaccaccttccctcca

SEQ ID NO: 911811 - DNA, 22 bp, Artificial Sequence
  chemically synthesized
ggacaccaccttccctccatac

SEQ ID NO: 911812 - DNA, 22 bp, Artificial Sequence
  chemically synthesized
tgtaaagatacagacttttatg

SEQ ID NO: 911813 - DNA, 22 bp, Artificial Sequence
  chemically synthesized
ccctccatacataaaagtctgt

SEQ ID NO: 911814 - DNA, 22 bp, Artificial Sequence
  chemically synthesized
cctccatacataaaagtctgta

SEQ ID NO: 911815 - DNA, 22 bp, Artificial Sequence
  chemically synthesized
catacataaaagtctgtatctt

SEQ ID NO: 911816 - DNA, 22 bp, Artificial Sequence
  chemically synthesized
caaaacatctgtgtaaagatac

SEQ ID NO: 911817 - DNA, 22 bp, Artificial Sequence
  chemically synthesized
atgattgcaaaacatctgtgta

SEQ ID NO: 911818 - DNA, 22 bp, Artificial Sequence
  chemically synthesized
aatgattgcaaaacatctgtgt

SEQ ID NO: 911819 - DNA, 22 bp, Artificial Sequence
  chemically synthesized
taatgattgcaaaacatctgtg

SEQ ID NO: 911820 - DNA, 22 bp, Artificial Sequence
  chemically synthesized
tatctttacacagatgttttgc

SEQ ID NO: 911821 - DNA, 22 bp, Artificial Sequence
  chemically synthesized
cctttaatgattgcaaaacatc

SEQ ID NO: 911822 - DNA, 22 bp, Artificial Sequence
  chemically synthesized
tacctttaatgattgcaaaaca

SEQ ID NO: 911823 - DNA, 22 bp, Artificial Sequence
  chemically synthesized
ctacctttaatgattgcaaaac

SEQ ID NO: 911824 - DNA, 22 bp, Artificial Sequence
  chemically synthesized
tacacagatgttttgcaatcat

SEQ ID NO: 911825 - DNA, 22 bp, Artificial Sequence
  chemically synthesized
acacagatgttttgcaatcatt

SEQ ID NO: 911826 - DNA, 22 bp, Artificial Sequence
  chemically synthesized
gtttctacctttaatgattgca

SEQ ID NO: 911827 - DNA, 22 bp, Artificial Sequence
  chemically synthesized
cacagatgttttgcaatcatta

SEQ ID NO: 911828 - DNA, 22 bp, Artificial Sequence
  chemically synthesized
ggtttctacctttaatgattgc

SEQ ID NO: 911829 - DNA, 22 bp, Artificial Sequence
  chemically synthesized
ttggtttctacctttaatgatt

SEQ ID NO: 911830 - DNA, 22 bp, Artificial Sequence
  chemically synthesized
cttggtttctacctttaatgat

SEQ ID NO: 911831 - DNA, 22 bp, Artificial Sequence
  chemically synthesized
tgcaatcattaaaggtagaaac

SEQ ID NO: 911832 - DNA, 22 bp, Artificial Sequence
  chemically synthesized
gcaatcattaaaggtagaaacc

SEQ ID NO: 911833 - DNA, 22 bp, Artificial Sequence
  chemically synthesized
caatcattaaaggtagaaacca

SEQ ID NO: 911834 - DNA, 22 bp, Artificial Sequence
  chemically synthesized
aaaaaaaaaaatcccttcttgg

SEQ ID NO: 911835 - DNA, 22 bp, Artificial Sequence
  chemically synthesized
gaaaaaaaaaaatcccttcttg

SEQ ID NO: 911836 - DNA, 22 bp, Artificial Sequence
  chemically synthesized
aaggtagaaaccaagaagggat

SEQ ID NO: 911837 - DNA, 22 bp, Artificial Sequence
  chemically synthesized
tttgaaaaaaaaaaatcccttc

SEQ ID NO: 911838 - DNA, 22 bp, Artificial Sequence
  chemically synthesized
aagcaggtagttatttgaaaaa

SEQ ID NO: 911839 - DNA, 22 bp, Artificial Sequence
  chemically synthesized
caagcaggtagttatttgaaaa

SEQ ID NO: 911840 - DNA, 22 bp, Artificial Sequence
  chemically synthesized
tttcaagcaggtagttatttga

SEQ ID NO: 911841 - DNA, 22 bp, Artificial Sequence
  chemically synthesized
tatttcaagcaggtagttattt

SEQ ID NO: 911842 - DNA, 22 bp, Artificial Sequence
  chemically synthesized
ttttttttcaaataactacctg

SEQ ID NO: 911843 - DNA, 22 bp, Artificial Sequence
  chemically synthesized
tttttttcaaataactacctgc

SEQ ID NO: 911844 - DNA, 22 bp, Artificial Sequence
  chemically synthesized
ttttttcaaataactacctgct

SEQ ID NO: 911845 - DNA, 22 bp, Artificial Sequence
  chemically synthesized
tttttcaaataactacctgctt

SEQ ID NO: 911846 - DNA, 22 bp, Artificial Sequence
  chemically synthesized
ttttcaaataactacctgcttg

SEQ ID NO: 911847 - DNA, 22 bp, Artificial Sequence
  chemically synthesized
tttcaaataactacctgcttga

SEQ ID NO: 911848 - DNA, 22 bp, Artificial Sequence
  chemically synthesized
agtgtctctatttcaagcaggt

SEQ ID NO: 911849 - DNA, 22 bp, Artificial Sequence
  chemically synthesized
ttcaaataactacctgcttgaa

SEQ ID NO: 911850 - DNA, 22 bp, Artificial Sequence
  chemically synthesized
aagtgtctctatttcaagcagg

SEQ ID NO: 911851 - DNA, 22 bp, Artificial Sequence
  chemically synthesized
tcaaataactacctgcttgaaa

SEQ ID NO: 911852 - DNA, 22 bp, Artificial Sequence
  chemically synthesized
caaataactacctgcttgaaat

SEQ ID NO: 911853 - DNA, 22 bp, Artificial Sequence
  chemically synthesized
aaataactacctgcttgaaata

SEQ ID NO: 911854 - DNA, 22 bp, Artificial Sequence
  chemically synthesized
cctgcttgaaatagagacactt

SEQ ID NO: 911855 - DNA, 22 bp, Artificial Sequence
  chemically synthesized
cttgaaatagagacacttaagc

SEQ ID NO: 911856 - DNA, 22 bp, Artificial Sequence
  chemically synthesized
aaaccataatgtgcgcttaagt

SEQ ID NO: 911857 - DNA, 22 bp, Artificial Sequence
  chemically synthesized
gaaatagagacacttaagcgca

SEQ ID NO: 911858 - DNA, 22 bp, Artificial Sequence
  chemically synthesized
aaatagagacacttaagcgcac

SEQ ID NO: 911859 - DNA, 22 bp, Artificial Sequence
  chemically synthesized
tgacattaaaaccataatgtgc

SEQ ID NO: 911860 - DNA, 22 bp, Artificial Sequence
  chemically synthesized
atgacattaaaaccataatgtg

SEQ ID NO: 911861 - DNA, 22 bp, Artificial Sequence
  chemically synthesized
tatgacattaaaaccataatgt

SEQ ID NO: 911862 - DNA, 22 bp, Artificial Sequence
  chemically synthesized
aagcgcacattatggttttaat

SEQ ID NO: 911863 - DNA, 22 bp, Artificial Sequence
  chemically synthesized
agcgcacattatggttttaatg

SEQ ID NO: 911864 - DNA, 22 bp, Artificial Sequence
  chemically synthesized
aaataagtaccaattttatgac

SEQ ID NO: 911865 - DNA, 22 bp, Artificial Sequence
  chemically synthesized
tggttttaatgtcataaaattg

SEQ ID NO: 911866 - DNA, 22 bp, Artificial Sequence
  chemically synthesized
ggaactaaaataagtaccaatt

SEQ ID NO: 911867 - DNA, 22 bp, Artificial Sequence
  chemically synthesized
taatgtcataaaattggtactt

SEQ ID NO: 911868 - DNA, 22 bp, Artificial Sequence
  chemically synthesized
aggaactaaaataagtaccaat

SEQ ID NO: 911869 - DNA, 22 bp, Artificial Sequence
  chemically synthesized
aatgtcataaaattggtactta

SEQ ID NO: 911870 - DNA, 22 bp, Artificial Sequence
  chemically synthesized
atgtcataaaattggtacttat

SEQ ID NO: 911871 - DNA, 22 bp, Artificial Sequence
  chemically synthesized
ataaaatatttaggaactaaaa

SEQ ID NO: 911872 - DNA, 22 bp, Artificial Sequence
  chemically synthesized
gtacttattttagttcctaaat

SEQ ID NO: 911873 - DNA, 22 bp, Artificial Sequence
  chemically synthesized
cacgactgataaaatatttagg

SEQ ID NO: 911874 - DNA, 22 bp, Artificial Sequence
  chemically synthesized
acacgactgataaaatatttag

SEQ ID NO: 911875 - DNA, 22 bp, Artificial Sequence
  chemically synthesized
attttagttcctaaatatttta

SEQ ID NO: 911876 - DNA, 22 bp, Artificial Sequence
  chemically synthesized
ttttagttcctaaatattttat

SEQ ID NO: 911877 - DNA, 22 bp, Artificial Sequence
  chemically synthesized
tagttcctaaatattttatcag

SEQ ID NO: 911878 - DNA, 22 bp, Artificial Sequence
  chemically synthesized
agttcctaaatattttatcagt

SEQ ID NO: 911879 - DNA, 22 bp, Artificial Sequence
  chemically synthesized
gttcctaaatattttatcagtc

SEQ ID NO: 911880 - DNA, 22 bp, Artificial Sequence
  chemically synthesized
ctaaatattttatcagtcgtgt

SEQ ID NO: 911881 - DNA, 22 bp, Artificial Sequence
  chemically synthesized
ataacagatcatttacacgact

SEQ ID NO: 911882 - DNA, 22 bp, Artificial Sequence
  chemically synthesized
aatattttatcagtcgtgtaaa

SEQ ID NO: 911883 - DNA, 22 bp, Artificial Sequence
  chemically synthesized
taataacagatcatttacacga

SEQ ID NO: 911884 - DNA, 22 bp, Artificial Sequence
  chemically synthesized
tatcagtcgtgtaaatgatctg

SEQ ID NO: 911885 - DNA, 22 bp, Artificial Sequence
  chemically synthesized
acattctaataacagatcattt

SEQ ID NO: 911886 - DNA, 22 bp, Artificial Sequence
  chemically synthesized
atcagtcgtgtaaatgatctgt

SEQ ID NO: 911887 - DNA, 22 bp, Artificial Sequence
  chemically synthesized
tcagtcgtgtaaatgatctgtt

SEQ ID NO: 911888 - DNA, 22 bp, Artificial Sequence
  chemically synthesized
gtgatgctgacattctaataac

SEQ ID NO: 911889 - DNA, 22 bp, Artificial Sequence
  chemically synthesized
aattggtgatgctgacattcta

SEQ ID NO: 911890 - DNA, 22 bp, Artificial Sequence
  chemically synthesized
aaattggtgatgctgacattct

SEQ ID NO: 911891 - DNA, 22 bp, Artificial Sequence
  chemically synthesized
taaattggtgatgctgacattc

SEQ ID NO: 911892 - DNA, 22 bp, Artificial Sequence
  chemically synthesized
ttaaattggtgatgctgacatt

SEQ ID NO: 911893 - DNA, 22 bp, Artificial Sequence
  chemically synthesized
tttaaattggtgatgctgacat

SEQ ID NO: 911894 - DNA, 22 bp, Artificial Sequence
  chemically synthesized
ttattagaatgtcagcatcacc

SEQ ID NO: 911895 - DNA, 22 bp, Artificial Sequence
  chemically synthesized
tattttttaaattggtgatgct

SEQ ID NO: 911896 - DNA, 22 bp, Artificial Sequence
  chemically synthesized
ttagaatgtcagcatcaccaat

SEQ ID NO: 911897 - DNA, 22 bp, Artificial Sequence
  chemically synthesized
ttgtattttttaaattggtgat

SEQ ID NO: 911898 - DNA, 22 bp, Artificial Sequence
  chemically synthesized
attgtattttttaaattggtga

SEQ ID NO: 911899 - DNA, 22 bp, Artificial Sequence
  chemically synthesized
gaatgtcagcatcaccaattta

SEQ ID NO: 911900 - DNA, 22 bp, Artificial Sequence
  chemically synthesized
tttattgtattttttaaattgg

SEQ ID NO: 911901 - DNA, 22 bp, Artificial Sequence
  chemically synthesized
tgtcaggttatttattgtattt

SEQ ID NO: 911902 - DNA, 22 bp, Artificial Sequence
  chemically synthesized
aattgtgtcaggttatttattg

SEQ ID NO: 911903 - DNA, 22 bp, Artificial Sequence
  chemically synthesized
gaattgtgtcaggttatttatt

SEQ ID NO: 911904 - DNA, 22 bp, Artificial Sequence
  chemically synthesized
tgaattgtgtcaggttatttat

SEQ ID NO: 911905 - DNA, 22 bp, Artificial Sequence
  chemically synthesized
aaaaaatacaataaataacctg

SEQ ID NO: 911906 - DNA, 22 bp, Artificial Sequence
  chemically synthesized
aaaaatacaataaataacctga

SEQ ID NO: 911907 - DNA, 22 bp, Artificial Sequence
  chemically synthesized
tgaacattttgaattgtgtcag

SEQ ID NO: 911908 - DNA, 22 bp, Artificial Sequence
  chemically synthesized
gtgaacattttgaattgtgtca

SEQ ID NO: 911909 - DNA, 22 bp, Artificial Sequence
  chemically synthesized
atttgtgaacattttgaattgt

SEQ ID NO: 911910 - DNA, 22 bp, Artificial Sequence
  chemically synthesized
agtcatctaatttgtgaacatt

SEQ ID NO: 911911 - DNA, 22 bp, Artificial Sequence
  chemically synthesized
acacaattcaaaatgttcacaa

SEQ ID NO: 911912 - DNA, 22 bp, Artificial Sequence
  chemically synthesized
cgatactgagtcatctaatttg

SEQ ID NO: 911913 - DNA, 22 bp, Artificial Sequence
  chemically synthesized
acgatactgagtcatctaattt

SEQ ID NO: 911914 - DNA, 22 bp, Artificial Sequence
  chemically synthesized
aaaatgttcacaaattagatga

SEQ ID NO: 911915 - DNA, 22 bp, Artificial Sequence
  chemically synthesized
tacgatactgagtcatctaatt

SEQ ID NO: 911916 - DNA, 22 bp, Artificial Sequence
  chemically synthesized
acaaattagatgactcagtatc

SEQ ID NO: 911917 - DNA, 22 bp, Artificial Sequence
  chemically synthesized
agtcaacatctttacgatactg

SEQ ID NO: 911918 - DNA, 22 bp, Artificial Sequence
  chemically synthesized
gatgactcagtatcgtaaagat

SEQ ID NO: 911919 - DNA, 22 bp, Artificial Sequence
  chemically synthesized
gagctcagtcaacatctttacg

SEQ ID NO: 911920 - DNA, 22 bp, Artificial Sequence
  chemically synthesized
agtatcgtaaagatgttgactg

SEQ ID NO: 911921 - DNA, 22 bp, Artificial Sequence
  chemically synthesized
tgaatctggagctcagtcaaca

SEQ ID NO: 911922 - DNA, 22 bp, Artificial Sequence
  chemically synthesized
gtgaatctggagctcagtcaac

SEQ ID NO: 911923 - DNA, 22 bp, Artificial Sequence
  chemically synthesized
tgtgaatctggagctcagtcaa

SEQ ID NO: 911924 - DNA, 22 bp, Artificial Sequence
  chemically synthesized
aaattttgtgaatctggagctc

SEQ ID NO: 911925 - DNA, 22 bp, Artificial Sequence
  chemically synthesized
attgaaattttgtgaatctgga

SEQ ID NO: 911926 - DNA, 22 bp, Artificial Sequence
  chemically synthesized
actgagctccagattcacaaaa

SEQ ID NO: 911927 - DNA, 22 bp, Artificial Sequence
  chemically synthesized
agctccagattcacaaaatttc

SEQ ID NO: 911928 - DNA, 22 bp, Artificial Sequence
  chemically synthesized
caggatattgattgaaattttg

SEQ ID NO: 911929 - DNA, 22 bp, Artificial Sequence
  chemically synthesized
ccaggatattgattgaaatttt

SEQ ID NO: 911930 - DNA, 22 bp, Artificial Sequence
  chemically synthesized
cagattcacaaaatttcaatca

SEQ ID NO: 911931 - DNA, 22 bp, Artificial Sequence
  chemically synthesized
acaaaatttcaatcaatatcct

SEQ ID NO: 911932 - DNA, 22 bp, Artificial Sequence
  chemically synthesized
cataaagccttccaggatattg

SEQ ID NO: 911933 - DNA, 22 bp, Artificial Sequence
  chemically synthesized
acataaagccttccaggatatt

SEQ ID NO: 911934 - DNA, 22 bp, Artificial Sequence
  chemically synthesized
tacataaagccttccaggatat

SEQ ID NO: 911935 - DNA, 22 bp, Artificial Sequence
  chemically synthesized
ttacataaagccttccaggata

SEQ ID NO: 911936 - DNA, 22 bp, Artificial Sequence
  chemically synthesized
tttttacataaagccttccagg

SEQ ID NO: 911937 - DNA, 22 bp, Artificial Sequence
  chemically synthesized
caatcaatatcctggaaggctt

SEQ ID NO: 911938 - DNA, 22 bp, Artificial Sequence
  chemically synthesized
aatcaatatcctggaaggcttt

SEQ ID NO: 911939 - DNA, 22 bp, Artificial Sequence
  chemically synthesized
tctatttttacataaagccttc

SEQ ID NO: 911940 - DNA, 22 bp, Artificial Sequence
  chemically synthesized
tattgtctatttttacataaag

SEQ ID NO: 911941 - DNA, 22 bp, Artificial Sequence
  chemically synthesized
gaactatattgtctatttttac

SEQ ID NO: 911942 - DNA, 22 bp, Artificial Sequence
  chemically synthesized
gaaggctttatgtaaaaataga

SEQ ID NO: 911943 - DNA, 22 bp, Artificial Sequence
  chemically synthesized
agaactatattgtctattttta

SEQ ID NO: 911944 - DNA, 22 bp, Artificial Sequence
  chemically synthesized
tagaactatattgtctattttt

SEQ ID NO: 911945 - DNA, 22 bp, Artificial Sequence
  chemically synthesized
tatgtaaaaatagacaatatag

SEQ ID NO: 911946 - DNA, 22 bp, Artificial Sequence
  chemically synthesized
atgtaaaaatagacaatatagt

SEQ ID NO: 911947 - DNA, 22 bp, Artificial Sequence
  chemically synthesized
tgtaaaaatagacaatatagtt

SEQ ID NO: 911948 - DNA, 22 bp, Artificial Sequence
  chemically synthesized
aataaattttagaactatattg

SEQ ID NO: 911949 - DNA, 22 bp, Artificial Sequence
  chemically synthesized
gaataaattttagaactatatt

SEQ ID NO: 911950 - DNA, 22 bp, Artificial Sequence
  chemically synthesized
tgaataaattttagaactatat

SEQ ID NO: 911951 - DNA, 22 bp, Artificial Sequence
  chemically synthesized
tttgaataaattttagaactat

SEQ ID NO: 911952 - DNA, 22 bp, Artificial Sequence
  chemically synthesized
gttctttgaataaattttagaa

SEQ ID NO: 911953 - DNA, 22 bp, Artificial Sequence
  chemically synthesized
ggttctttgaataaattttaga

SEQ ID NO: 911954 - DNA, 22 bp, Artificial Sequence
  chemically synthesized
tggttctttgaataaattttag

SEQ ID NO: 911955 - DNA, 22 bp, Artificial Sequence
  chemically synthesized
ttggttctttgaataaatttta

SEQ ID NO: 911956 - DNA, 22 bp, Artificial Sequence
  chemically synthesized
cttttggttctttgaataaatt

SEQ ID NO: 911957 - DNA, 22 bp, Artificial Sequence
  chemically synthesized
gctacttttggttctttgaata

SEQ ID NO: 911958 - DNA, 22 bp, Artificial Sequence
  chemically synthesized
ggctacttttggttctttgaat

SEQ ID NO: 911959 - DNA, 22 bp, Artificial Sequence
  chemically synthesized
taaaatttattcaaagaaccaa

SEQ ID NO: 911960 - DNA, 22 bp, Artificial Sequence
  chemically synthesized
ccttggctacttttggttcttt

SEQ ID NO: 911961 - DNA, 22 bp, Artificial Sequence
  chemically synthesized
aaatttattcaaagaaccaaaa

SEQ ID NO: 911962 - DNA, 22 bp, Artificial Sequence
  chemically synthesized
aagattgccttggctacttttg

SEQ ID NO: 911963 - DNA, 22 bp, Artificial Sequence
  chemically synthesized
attcaaagaaccaaaagtagcc

SEQ ID NO: 911964 - DNA, 22 bp, Artificial Sequence
  chemically synthesized
ttcaaagaaccaaaagtagcca

SEQ ID NO: 911965 - DNA, 22 bp, Artificial Sequence
  chemically synthesized
ttcaagattgccttggctactt

SEQ ID NO: 911966 - DNA, 22 bp, Artificial Sequence
  chemically synthesized
aaagaaccaaaagtagccaagg

SEQ ID NO: 911967 - DNA, 22 bp, Artificial Sequence
  chemically synthesized
ctattcaagattgccttggcta

SEQ ID NO: 911968 - DNA, 22 bp, Artificial Sequence
  chemically synthesized
cctattcaagattgccttggct

SEQ ID NO: 911969 - DNA, 22 bp, Artificial Sequence
  chemically synthesized
ttcctattcaagattgccttgg

SEQ ID NO: 911970 - DNA, 22 bp, Artificial Sequence
  chemically synthesized
ttcttcctattcaagattgcct

SEQ ID NO: 911971 - DNA, 22 bp, Artificial Sequence
  chemically synthesized
gttcttcctattcaagattgcc

SEQ ID NO: 911972 - DNA, 22 bp, Artificial Sequence
  chemically synthesized
tgttcttcctattcaagattgc

SEQ ID NO: 911973 - DNA, 22 bp, Artificial Sequence
  chemically synthesized
cactttgttcttcctattcaag

SEQ ID NO: 911974 - DNA, 22 bp, Artificial Sequence
  chemically synthesized
ccactttgttcttcctattcaa

SEQ ID NO: 911975 - DNA, 22 bp, Artificial Sequence
  chemically synthesized
tgtaaaccttccactttgttct

SEQ ID NO: 911976 - DNA, 22 bp, Artificial Sequence
  chemically synthesized
gaataggaagaacaaagtggaa

SEQ ID NO: 911977 - DNA, 22 bp, Artificial Sequence
  chemically synthesized
gttgtgtaaaccttccactttg

SEQ ID NO: 911978 - DNA, 22 bp, Artificial Sequence
  chemically synthesized
aataggaagaacaaagtggaag

SEQ ID NO: 911979 - DNA, 22 bp, Artificial Sequence
  chemically synthesized
gatctggttgtgtaaaccttcc

SEQ ID NO: 911980 - DNA, 22 bp, Artificial Sequence
  chemically synthesized
ggatctggttgtgtaaaccttc

SEQ ID NO: 911981 - DNA, 22 bp, Artificial Sequence
  chemically synthesized
tggatctggttgtgtaaacctt

SEQ ID NO: 911982 - DNA, 22 bp, Artificial Sequence
  chemically synthesized
aacattttggatctggttgtgt

SEQ ID NO: 911983 - DNA, 22 bp, Artificial Sequence
  chemically synthesized
aaacattttggatctggttgtg

SEQ ID NO: 911984 - DNA, 22 bp, Artificial Sequence
  chemically synthesized
tttaaacattttggatctggtt

SEQ ID NO: 911985 - DNA, 22 bp, Artificial Sequence
  chemically synthesized
atttaaacattttggatctggt

SEQ ID NO: 911986 - DNA, 22 bp, Artificial Sequence
  chemically synthesized
tatttaaacattttggatctgg

SEQ ID NO: 911987 - DNA, 22 bp, Artificial Sequence
  chemically synthesized
acacaaccagatccaaaatgtt

SEQ ID NO: 911988 - DNA, 22 bp, Artificial Sequence
  chemically synthesized
cacaaccagatccaaaatgttt

SEQ ID NO: 911989 - DNA, 22 bp, Artificial Sequence
  chemically synthesized
tatgtatatacgcaatcatttt

SEQ ID NO: 911990 - DNA, 22 bp, Artificial Sequence
  chemically synthesized
cattgtatgtatatacgcaatc

SEQ ID NO: 911991 - DNA, 22 bp, Artificial Sequence
  chemically synthesized
aaataaaatgattgcgtatata

SEQ ID NO: 911992 - DNA, 22 bp, Artificial Sequence
  chemically synthesized
aataaaatgattgcgtatatac

SEQ ID NO: 911993 - DNA, 22 bp, Artificial Sequence
  chemically synthesized
aataatattccattgtatgtat

SEQ ID NO: 911994 - DNA, 22 bp, Artificial Sequence
  chemically synthesized
tgactgaataatattccattgt

SEQ ID NO: 911995 - DNA, 22 bp, Artificial Sequence
  chemically synthesized
cgtatatacatacaatggaata

SEQ ID NO: 911996 - DNA, 22 bp, Artificial Sequence
  chemically synthesized
atgactgaataatattccattg

SEQ ID NO: 911997 - DNA, 22 bp, Artificial Sequence
  chemically synthesized
tatgactgaataatattccatt

SEQ ID NO: 911998 - DNA, 22 bp, Artificial Sequence
  chemically synthesized
ttatgactgaataatattccat

SEQ ID NO: 911999 - DNA, 22 bp, Artificial Sequence
  chemically synthesized
tttatgactgaataatattcca

SEQ ID NO: 912000 - DNA, 22 bp, Artificial Sequence
  chemically synthesized
ctttttatgactgaataatatt

SEQ ID NO: 912001 - DNA, 22 bp, Artificial Sequence
  chemically synthesized
attcctttttatgactgaataa

SEQ ID NO: 912002 - DNA, 22 bp, Artificial Sequence
  chemically synthesized
cattcctttttatgactgaata

SEQ ID NO: 912003 - DNA, 22 bp, Artificial Sequence
  chemically synthesized
ttcagtcataaaaaggaatgaa

SEQ ID NO: 912004 - DNA, 22 bp, Artificial Sequence
  chemically synthesized
agtcataaaaaggaatgaagtt

SEQ ID NO: 912005 - DNA, 22 bp, Artificial Sequence
  chemically synthesized
tagcatgtgtcagaacttcatt

SEQ ID NO: 912006 - DNA, 22 bp, Artificial Sequence
  chemically synthesized
tgttgtagcatgtgtcagaact

SEQ ID NO: 912007 - DNA, 22 bp, Artificial Sequence
  chemically synthesized
atctatgttgtagcatgtgtca

SEQ ID NO: 912008 - DNA, 22 bp, Artificial Sequence
  chemically synthesized
aaggttcatctatgttgtagca

SEQ ID NO: 912009 - DNA, 22 bp, Artificial Sequence
  chemically synthesized
caaggttcatctatgttgtagc

SEQ ID NO: 912010 - DNA, 22 bp, Artificial Sequence
  chemically synthesized
tcaaggttcatctatgttgtag

SEQ ID NO: 912011 - DNA, 22 bp, Artificial Sequence
  chemically synthesized
tgacacatgctacaacatagat

SEQ ID NO: 912012 - DNA, 22 bp, Artificial Sequence
  chemically synthesized
acacatgctacaacatagatga

SEQ ID NO: 912013 - DNA, 22 bp, Artificial Sequence
  chemically synthesized
agcataatattttcaaggttca

SEQ ID NO: 912014 - DNA, 22 bp, Artificial Sequence
  chemically synthesized
caacatagatgaaccttgaaaa

SEQ ID NO: 912015 - DNA, 22 bp, Artificial Sequence
  chemically synthesized
cctcagcataatattttcaagg

SEQ ID NO: 912016 - DNA, 22 bp, Artificial Sequence
  chemically synthesized
ccctcagcataatattttcaag

SEQ ID NO: 912017 - DNA, 22 bp, Artificial Sequence
  chemically synthesized
cttccctcagcataatattttc

SEQ ID NO: 912018 - DNA, 22 bp, Artificial Sequence
  chemically synthesized
acttccctcagcataatatttt

SEQ ID NO: 912019 - DNA, 22 bp, Artificial Sequence
  chemically synthesized
ccttacttccctcagcataata

SEQ ID NO: 912020 - DNA, 22 bp, Artificial Sequence
  chemically synthesized
tgtctgccttacttccctcagc

SEQ ID NO: 912021 - DNA, 22 bp, Artificial Sequence
  chemically synthesized
gaaaatattatgctgagggaag

SEQ ID NO: 912022 - DNA, 22 bp, Artificial Sequence
  chemically synthesized
gtgtctgccttacttccctcag

SEQ ID NO: 912023 - DNA, 22 bp, Artificial Sequence
  chemically synthesized
aaaatattatgctgagggaagt

SEQ ID NO: 912024 - DNA, 22 bp, Artificial Sequence
  chemically synthesized
tgtgtctgccttacttccctca

SEQ ID NO: 912025 - DNA, 22 bp, Artificial Sequence
  chemically synthesized
ccactttgtgtctgccttactt

SEQ ID NO: 912026 - DNA, 22 bp, Artificial Sequence
  chemically synthesized
gccactttgtgtctgccttact

SEQ ID NO: 912027 - DNA, 22 bp, Artificial Sequence
  chemically synthesized
tgctgagggaagtaaggcagac

SEQ ID NO: 912028 - DNA, 22 bp, Artificial Sequence
  chemically synthesized
agggaagtaaggcagacacaaa

SEQ ID NO: 912029 - DNA, 22 bp, Artificial Sequence
  chemically synthesized
tatatttgccactttgtgtctg

SEQ ID NO: 912030 - DNA, 22 bp, Artificial Sequence
  chemically synthesized
gaattatatatttgccactttg

SEQ ID NO: 912031 - DNA, 22 bp, Artificial Sequence
  chemically synthesized
tataattggaattatatatttg

SEQ ID NO: 912032 - DNA, 22 bp, Artificial Sequence
  chemically synthesized
atataattggaattatatattt

SEQ ID NO: 912033 - DNA, 22 bp, Artificial Sequence
  chemically synthesized
tatataattggaattatatatt

SEQ ID NO: 912034 - DNA, 22 bp, Artificial Sequence
  chemically synthesized
ttatataattggaattatatat

SEQ ID NO: 912035 - DNA, 22 bp, Artificial Sequence
  chemically synthesized
gatcttttatataattggaatt

SEQ ID NO: 912036 - DNA, 22 bp, Artificial Sequence
  chemically synthesized
tagatcttttatataattggaa

SEQ ID NO: 912037 - DNA, 22 bp, Artificial Sequence
  chemically synthesized
ttctagatcttttatataattg

SEQ ID NO: 912038 - DNA, 22 bp, Artificial Sequence
  chemically synthesized
gctattctagatcttttatata

SEQ ID NO: 912039 - DNA, 22 bp, Artificial Sequence
  chemically synthesized
ggctattctagatcttttatat

SEQ ID NO: 912040 - DNA, 22 bp, Artificial Sequence
  chemically synthesized
caattatataaaagatctagaa

SEQ ID NO: 912041 - DNA, 22 bp, Artificial Sequence
  chemically synthesized
tgaatttggctattctagatct

SEQ ID NO: 912042 - DNA, 22 bp, Artificial Sequence
  chemically synthesized
tatgaatttggctattctagat

SEQ ID NO: 912043 - DNA, 22 bp, Artificial Sequence
  chemically synthesized
ctatgaatttggctattctaga

SEQ ID NO: 912044 - DNA, 22 bp, Artificial Sequence
  chemically synthesized
tataaaagatctagaatagcca

SEQ ID NO: 912045 - DNA, 22 bp, Artificial Sequence
  chemically synthesized
tttctatgaatttggctattct

SEQ ID NO: 912046 - DNA, 22 bp, Artificial Sequence
  chemically synthesized
tgtttctatgaatttggctatt

SEQ ID NO: 912047 - DNA, 22 bp, Artificial Sequence
  chemically synthesized
ctgtttctatgaatttggctat

SEQ ID NO: 912048 - DNA, 22 bp, Artificial Sequence
  chemically synthesized
tctgtttctatgaatttggcta

SEQ ID NO: 912049 - DNA, 22 bp, Artificial Sequence
  chemically synthesized
ctttctgtttctatgaatttgg

SEQ ID NO: 912050 - DNA, 22 bp, Artificial Sequence
  chemically synthesized
gactactttctgtttctatgaa

SEQ ID NO: 912051 - DNA, 22 bp, Artificial Sequence
  chemically synthesized
gaatagccaaattcatagaaac

SEQ ID NO: 912052 - DNA, 22 bp, Artificial Sequence
  chemically synthesized
tggactactttctgtttctatg

SEQ ID NO: 912053 - DNA, 22 bp, Artificial Sequence
  chemically synthesized
gtagcctctggactactttctg

SEQ ID NO: 912054 - DNA, 22 bp, Artificial Sequence
  chemically synthesized
atagaaacagaaagtagtccag

SEQ ID NO: 912055 - DNA, 22 bp, Artificial Sequence
  chemically synthesized
ccatccgctagtagcctctgga

SEQ ID NO: 912056 - DNA, 22 bp, Artificial Sequence
  chemically synthesized
cccatccgctagtagcctctgg

SEQ ID NO: 912057 - DNA, 22 bp, Artificial Sequence
  chemically synthesized
ttcccatccgctagtagcctct

SEQ ID NO: 912058 - DNA, 22 bp, Artificial Sequence
  chemically synthesized
tcttcccatccgctagtagcct

SEQ ID NO: 912059 - DNA, 22 bp, Artificial Sequence
  chemically synthesized
tctcttcccatccgctagtagc

SEQ ID NO: 912060 - DNA, 22 bp, Artificial Sequence
  chemically synthesized
tctctcttcccatccgctagta

SEQ ID NO: 912061 - DNA, 22 bp, Artificial Sequence
  chemically synthesized
ctctctcttcccatccgctagt

SEQ ID NO: 912062 - DNA, 22 bp, Artificial Sequence
  chemically synthesized
tctctctcttcccatccgctag

SEQ ID NO: 912063 - DNA, 22 bp, Artificial Sequence
  chemically synthesized
ccctttctctctcttcccatcc

SEQ ID NO: 912064 - DNA, 22 bp, Artificial Sequence
  chemically synthesized
ctagcggatgggaagagagaga

SEQ ID NO: 912065 - DNA, 22 bp, Artificial Sequence
  chemically synthesized
gcggatgggaagagagagaaag

SEQ ID NO: 912066 - DNA, 22 bp, Artificial Sequence
  chemically synthesized
agcaatagttcccctttctctc

SEQ ID NO: 912067 - DNA, 22 bp, Artificial Sequence
  chemically synthesized
taaccattaagcaatagttccc

SEQ ID NO: 912068 - DNA, 22 bp, Artificial Sequence
  chemically synthesized
caaccagacagtctgtaaccat

SEQ ID NO: 912069 - DNA, 22 bp, Artificial Sequence
  chemically synthesized
ctccaaccagacagtctgtaac

SEQ ID NO: 912070 - DNA, 22 bp, Artificial Sequence
  chemically synthesized
ttgcttaatggttacagactgt

SEQ ID NO: 912071 - DNA, 22 bp, Artificial Sequence
  chemically synthesized
ttactccaaccagacagtctgt

SEQ ID NO: 912072 - DNA, 22 bp, Artificial Sequence
  chemically synthesized
attactccaaccagacagtctg

SEQ ID NO: 912073 - DNA, 22 bp, Artificial Sequence
  chemically synthesized
cttaatggttacagactgtctg

SEQ ID NO: 912074 - DNA, 22 bp, Artificial Sequence
  chemically synthesized
tattactccaaccagacagtct

SEQ ID NO: 912075 - DNA, 22 bp, Artificial Sequence
  chemically synthesized
ttattactccaaccagacagtc

SEQ ID NO: 912076 - DNA, 22 bp, Artificial Sequence
  chemically synthesized
tttattactccaaccagacagt

SEQ ID NO: 912077 - DNA, 22 bp, Artificial Sequence
  chemically synthesized
aatggttacagactgtctggtt

SEQ ID NO: 912078 - DNA, 22 bp, Artificial Sequence
  chemically synthesized
atggttacagactgtctggttg

SEQ ID NO: 912079 - DNA, 22 bp, Artificial Sequence
  chemically synthesized
caaaattttttattactccaac

SEQ ID NO: 912080 - DNA, 22 bp, Artificial Sequence
  chemically synthesized
cagactgtctggttggagtaat

SEQ ID NO: 912081 - DNA, 22 bp, Artificial Sequence
  chemically synthesized
tctggttggagtaataaaaaat

SEQ ID NO: 912082 - DNA, 22 bp, Artificial Sequence
  chemically synthesized
gttggagtaataaaaaattttg

SEQ ID NO: 912083 - DNA, 22 bp, Artificial Sequence
  chemically synthesized
gagtaataaaaaattttggagg

SEQ ID NO: 912084 - DNA, 22 bp, Artificial Sequence
  chemically synthesized
cagcgtgagccaccgcgcccag

SEQ ID NO: 912085 - DNA, 22 bp, Artificial Sequence
  chemically synthesized
tggaggctgggcgcggtggctc

SEQ ID NO: 912086 - DNA, 22 bp, Artificial Sequence
  chemically synthesized
ggattacagcgtgagccaccgc

SEQ ID NO: 912087 - DNA, 22 bp, Artificial Sequence
  chemically synthesized
ggaggctgggcgcggtggctca

SEQ ID NO: 912088 - DNA, 22 bp, Artificial Sequence
  chemically synthesized
gaggctgggcgcggtggctcac

SEQ ID NO: 912089 - DNA, 22 bp, Artificial Sequence
  chemically synthesized
ggcgcggtggctcacgctgtaa

SEQ ID NO: 912090 - DNA, 22 bp, Artificial Sequence
  chemically synthesized
ccaaagtcctgggattacagcg

SEQ ID NO: 912091 - DNA, 22 bp, Artificial Sequence
  chemically synthesized
gactcccaaagtcctgggatta

SEQ ID NO: 912092 - DNA, 22 bp, Artificial Sequence
  chemically synthesized
ggactcccaaagtcctgggatt

SEQ ID NO: 912093 - DNA, 22 bp, Artificial Sequence
  chemically synthesized
acgctgtaatcccaggactttg

SEQ ID NO: 912094 - DNA, 22 bp, Artificial Sequence
  chemically synthesized
taatcccaggactttgggagtc

SEQ ID NO: 912095 - DNA, 22 bp, Artificial Sequence
  chemically synthesized
aggtgatccgcccaccttggac

SEQ ID NO: 912096 - DNA, 22 bp, Artificial Sequence
  chemically synthesized
acctcaggtgatccgcccacct

SEQ ID NO: 912097 - DNA, 22 bp, Artificial Sequence
  chemically synthesized
tgggagtccaaggtgggcggat

SEQ ID NO: 912098 - DNA, 22 bp, Artificial Sequence
  chemically synthesized
gggagtccaaggtgggcggatc

SEQ ID NO: 912099 - DNA, 22 bp, Artificial Sequence
  chemically synthesized
ctgacctcaggtgatccgccca

SEQ ID NO: 912100 - DNA, 22 bp, Artificial Sequence
  chemically synthesized
ggagtccaaggtgggcggatca

SEQ ID NO: 912101 - DNA, 22 bp, Artificial Sequence
  chemically synthesized
aaactcctgacctcaggtgatc

SEQ ID NO: 912102 - DNA, 22 bp, Artificial Sequence
  chemically synthesized
gtctcaaactcctgacctcagg

SEQ ID NO: 912103 - DNA, 22 bp, Artificial Sequence
  chemically synthesized
gccaggctggtctcaaactcct

SEQ ID NO: 912104 - DNA, 22 bp, Artificial Sequence
  chemically synthesized
aggtcaggagtttgagaccagc

SEQ ID NO: 912105 - DNA, 22 bp, Artificial Sequence
  chemically synthesized
ccatgttggccaggctggtctc

SEQ ID NO: 912106 - DNA, 22 bp, Artificial Sequence
  chemically synthesized
gccatgttggccaggctggtct

SEQ ID NO: 912107 - DNA, 22 bp, Artificial Sequence
  chemically synthesized
tgccatgttggccaggctggtc

SEQ ID NO: 912108 - DNA, 22 bp, Artificial Sequence
  chemically synthesized
gagaccagcctggccaacatgg

SEQ ID NO: 912109 - DNA, 22 bp, Artificial Sequence
  chemically synthesized
agaccagcctggccaacatggc

SEQ ID NO: 912110 - DNA, 22 bp, Artificial Sequence
  chemically synthesized
gtagagatggggttttgccatg

SEQ ID NO: 912111 - DNA, 22 bp, Artificial Sequence
  chemically synthesized
agtagagatggggttttgccat

SEQ ID NO: 912112 - DNA, 22 bp, Artificial Sequence
  chemically synthesized
tagtagagatggggttttgcca

SEQ ID NO: 912113 - DNA, 22 bp, Artificial Sequence
  chemically synthesized
ttagtagagatggggttttgcc

SEQ ID NO: 912114 - DNA, 22 bp, Artificial Sequence
  chemically synthesized
gccaacatggcaaaaccccatc

SEQ ID NO: 912115 - DNA, 22 bp, Artificial Sequence
  chemically synthesized
tatttttagtagagatggggtt

SEQ ID NO: 912116 - DNA, 22 bp, Artificial Sequence
  chemically synthesized
gtatttttagtagagatggggt

SEQ ID NO: 912117 - DNA, 22 bp, Artificial Sequence
  chemically synthesized
tgtatttttagtagagatgggg

SEQ ID NO: 912118 - DNA, 22 bp, Artificial Sequence
  chemically synthesized
ttgtatttttagtagagatggg

SEQ ID NO: 912119 - DNA, 22 bp, Artificial Sequence
  chemically synthesized
agtttttgtatttttagtagag

SEQ ID NO: 912120 - DNA, 22 bp, Artificial Sequence
  chemically synthesized
tactaaaaatacaaaaacttag

SEQ ID NO: 912121 - DNA, 22 bp, Artificial Sequence
  chemically synthesized
ccagcatgcccagctaagtttt

SEQ ID NO: 912122 - DNA, 22 bp, Artificial Sequence
  chemically synthesized
ctaaaaatacaaaaacttagct

SEQ ID NO: 912123 - DNA, 22 bp, Artificial Sequence
  chemically synthesized
aaaatacaaaaacttagctggg

SEQ ID NO: 912124 - DNA, 22 bp, Artificial Sequence
  chemically synthesized
caggcacctgccagcatgccca

SEQ ID NO: 912125 - DNA, 22 bp, Artificial Sequence
  chemically synthesized
ggattacaggcacctgccagca

SEQ ID NO: 912126 - DNA, 22 bp, Artificial Sequence
  chemically synthesized
agctgggcatgctggcaggtgc

SEQ ID NO: 912127 - DNA, 22 bp, Artificial Sequence
  chemically synthesized
gctgggcatgctggcaggtgcc

SEQ ID NO: 912128 - DNA, 22 bp, Artificial Sequence
  chemically synthesized
gtagctgggattacaggcacct

SEQ ID NO: 912129 - DNA, 22 bp, Artificial Sequence
  chemically synthesized
ggcatgctggcaggtgcctgta

SEQ ID NO: 912130 - DNA, 22 bp, Artificial Sequence
  chemically synthesized
cctagtagctgggattacaggc

SEQ ID NO: 912131 - DNA, 22 bp, Artificial Sequence
  chemically synthesized
gcaggtgcctgtaatcccagct

SEQ ID NO: 912132 - DNA, 22 bp, Artificial Sequence
  chemically synthesized
agcctccctagtagctgggatt

SEQ ID NO: 912133 - DNA, 22 bp, Artificial Sequence
  chemically synthesized
cctcagcctccctagtagctgg

SEQ ID NO: 912134 - DNA, 22 bp, Artificial Sequence
  chemically synthesized
ctgcctcagcctccctagtagc

SEQ ID NO: 912135 - DNA, 22 bp, Artificial Sequence
  chemically synthesized
tcctgcctcagcctccctagta

SEQ ID NO: 912136 - DNA, 22 bp, Artificial Sequence
  chemically synthesized
taatcccagctactagggaggc

SEQ ID NO: 912137 - DNA, 22 bp, Artificial Sequence
  chemically synthesized
aagtggttctcctgcctcagcc

SEQ ID NO: 912138 - DNA, 22 bp, Artificial Sequence
  chemically synthesized
ctagggaggctgaggcaggaga

SEQ ID NO: 912139 - DNA, 22 bp, Artificial Sequence
  chemically synthesized
gggaggctgaggcaggagaacc

SEQ ID NO: 912140 - DNA, 22 bp, Artificial Sequence
  chemically synthesized
ccaggttcaagtggttctcctg

SEQ ID NO: 912141 - DNA, 22 bp, Artificial Sequence
  chemically synthesized
cgcctcccaggttcaagtggtt

SEQ ID NO: 912142 - DNA, 22 bp, Artificial Sequence
  chemically synthesized
ccgcctcccaggttcaagtggt

SEQ ID NO: 912143 - DNA, 22 bp, Artificial Sequence
  chemically synthesized
aggcaggagaaccacttgaacc

SEQ ID NO: 912144 - DNA, 22 bp, Artificial Sequence
  chemically synthesized
caacttccgcctcccaggttca

SEQ ID NO: 912145 - DNA, 22 bp, Artificial Sequence
  chemically synthesized
actgcaacttccgcctcccagg

SEQ ID NO: 912146 - DNA, 22 bp, Artificial Sequence
  chemically synthesized
ggctcactgcaacttccgcctc

SEQ ID NO: 912147 - DNA, 22 bp, Artificial Sequence
  chemically synthesized
gaacctgggaggcggaagttgc

SEQ ID NO: 912148 - DNA, 22 bp, Artificial Sequence
  chemically synthesized
aacctgggaggcggaagttgca

SEQ ID NO: 912149 - DNA, 22 bp, Artificial Sequence
  chemically synthesized
ggaggcggaagttgcagtgagc

SEQ ID NO: 912150 - DNA, 22 bp, Artificial Sequence
  chemically synthesized
gagtgcagtggcgcgatctcgg

SEQ ID NO: 912151 - DNA, 22 bp, Artificial Sequence
  chemically synthesized
cagtgagccgagatcgcgccac

SEQ ID NO: 912152 - DNA, 22 bp, Artificial Sequence
  chemically synthesized
aggctggagtgcagtggcgcga

SEQ ID NO: 912153 - DNA, 22 bp, Artificial Sequence
  chemically synthesized
tgtcgctcaggctggagtgcag

SEQ ID NO: 912154 - DNA, 22 bp, Artificial Sequence
  chemically synthesized
gctgtgtcgctcaggctggagt

SEQ ID NO: 912155 - DNA, 22 bp, Artificial Sequence
  chemically synthesized
cactccagcctgagcgacacag

SEQ ID NO: 912156 - DNA, 22 bp, Artificial Sequence
  chemically synthesized
gagacagagtctcgctgtgtcg

SEQ ID NO: 912157 - DNA, 22 bp, Artificial Sequence
  chemically synthesized
ggagacagagtctcgctgtgtc

SEQ ID NO: 912158 - DNA, 22 bp, Artificial Sequence
  chemically synthesized
tggagacagagtctcgctgtgt

SEQ ID NO: 912159 - DNA, 22 bp, Artificial Sequence
  chemically synthesized
cagcctgagcgacacagcgaga

SEQ ID NO: 912160 - DNA, 22 bp, Artificial Sequence
  chemically synthesized
ttggagacagagtctcgctgtg

SEQ ID NO: 912161 - DNA, 22 bp, Artificial Sequence
  chemically synthesized
tttggagacagagtctcgctgt

SEQ ID NO: 912162 - DNA, 22 bp, Artificial Sequence
  chemically synthesized
ttttggagacagagtctcgctg

SEQ ID NO: 912163 - DNA, 22 bp, Artificial Sequence
  chemically synthesized
ttttttggagacagagtctcgc

SEQ ID NO: 912164 - DNA, 22 bp, Artificial Sequence
  chemically synthesized
cttttttggagacagagtctcg

SEQ ID NO: 912165 - DNA, 22 bp, Artificial Sequence
  chemically synthesized
tcttttttggagacagagtctc

SEQ ID NO: 912166 - DNA, 22 bp, Artificial Sequence
  chemically synthesized
agcgacacagcgagactctgtc

SEQ ID NO: 912167 - DNA, 22 bp, Artificial Sequence
  chemically synthesized
ttcttttttggagacagagtct

SEQ ID NO: 912168 - DNA, 22 bp, Artificial Sequence
  chemically synthesized
tttcttttttggagacagagtc

SEQ ID NO: 912169 - DNA, 22 bp, Artificial Sequence
  chemically synthesized
ttttcttttttggagacagagt

SEQ ID NO: 912170 - DNA, 22 bp, Artificial Sequence
  chemically synthesized
tttttcttttttggagacagag

SEQ ID NO: 912171 - DNA, 22 bp, Artificial Sequence
  chemically synthesized
ttttttcttttttggagacaga

SEQ ID NO: 912172 - DNA, 22 bp, Artificial Sequence
  chemically synthesized
tttttttcttttttggagacag

SEQ ID NO: 912173 - DNA, 22 bp, Artificial Sequence
  chemically synthesized
ttttttttcttttttggagaca

SEQ ID NO: 912174 - DNA, 22 bp, Artificial Sequence
  chemically synthesized
tgtctccaaaaaagaaaaaaaa

SEQ ID NO: 912175 - DNA, 22 bp, Artificial Sequence
  chemically synthesized
tctccaaaaaagaaaaaaaaaa

SEQ ID NO: 912176 - DNA, 22 bp, Artificial Sequence
  chemically synthesized
tgccccacccccaatttttttt

SEQ ID NO: 912177 - DNA, 22 bp, Artificial Sequence
  chemically synthesized
caaaaaagaaaaaaaaaaattg

SEQ ID NO: 912178 - DNA, 22 bp, Artificial Sequence
  chemically synthesized
atgccccacccccaattttttt

SEQ ID NO: 912179 - DNA, 22 bp, Artificial Sequence
  chemically synthesized
caaccatcaccacagtttatgc

SEQ ID NO: 912180 - DNA, 22 bp, Artificial Sequence
  chemically synthesized
ttacaaccatcaccacagttta

SEQ ID NO: 912181 - DNA, 22 bp, Artificial Sequence
  chemically synthesized
ggggtggggcataaactgtggt

SEQ ID NO: 912182 - DNA, 22 bp, Artificial Sequence
  chemically synthesized
attacaaccatcaccacagttt

SEQ ID NO: 912183 - DNA, 22 bp, Artificial Sequence
  chemically synthesized
agtggcatttattacaaccatc

SEQ ID NO: 912184 - DNA, 22 bp, Artificial Sequence
  chemically synthesized
tggtgatggttgtaataaatgc

SEQ ID NO: 912185 - DNA, 22 bp, Artificial Sequence
  chemically synthesized
gtgtgtccagctcagtggcatt

SEQ ID NO: 912186 - DNA, 22 bp, Artificial Sequence
  chemically synthesized
cgtgtgtccagctcagtggcat

SEQ ID NO: 912187 - DNA, 22 bp, Artificial Sequence
  chemically synthesized
taataaatgccactgagctgga

SEQ ID NO: 912188 - DNA, 22 bp, Artificial Sequence
  chemically synthesized
gtcatttcgtgtgtccagctca

SEQ ID NO: 912189 - DNA, 22 bp, Artificial Sequence
  chemically synthesized
agtcatttcgtgtgtccagctc

SEQ ID NO: 912190 - DNA, 22 bp, Artificial Sequence
  chemically synthesized
tagtcatttcgtgtgtccagct

SEQ ID NO: 912191 - DNA, 22 bp, Artificial Sequence
  chemically synthesized
tcattttagtcatttcgtgtgt

SEQ ID NO: 912192 - DNA, 22 bp, Artificial Sequence
  chemically synthesized
agctggacacacgaaatgacta

SEQ ID NO: 912193 - DNA, 22 bp, Artificial Sequence
  chemically synthesized
gacacacgaaatgactaaaatg

SEQ ID NO: 912194 - DNA, 22 bp, Artificial Sequence
  chemically synthesized
aaatgacaattttttatgttat

SEQ ID NO: 912195 - DNA, 22 bp, Artificial Sequence
  chemically synthesized
aggtgtgataaaatatataaca

SEQ ID NO: 912196 - DNA, 22 bp, Artificial Sequence
  chemically synthesized
aaggtgtgataaaatatataac

SEQ ID NO: 912197 - DNA, 22 bp, Artificial Sequence
  chemically synthesized
taaggtgtgataaaatatataa

SEQ ID NO: 912198 - DNA, 22 bp, Artificial Sequence
  chemically synthesized
ttaaggtgtgataaaatatata

SEQ ID NO: 912199 - DNA, 22 bp, Artificial Sequence
  chemically synthesized
tttaaggtgtgataaaatatat

SEQ ID NO: 912200 - DNA, 22 bp, Artificial Sequence
  chemically synthesized
ttttaaggtgtgataaaatata

SEQ ID NO: 912201 - DNA, 22 bp, Artificial Sequence
  chemically synthesized
tttatgttatatattttatcac

SEQ ID NO: 912202 - DNA, 22 bp, Artificial Sequence
  chemically synthesized
cttttttaaggtgtgataaaat

SEQ ID NO: 912203 - DNA, 22 bp, Artificial Sequence
  chemically synthesized
ttatgttatatattttatcaca

SEQ ID NO: 912204 - DNA, 22 bp, Artificial Sequence
  chemically synthesized
tatgttatatattttatcacac

SEQ ID NO: 912205 - DNA, 22 bp, Artificial Sequence
  chemically synthesized
atgttatatattttatcacacc

SEQ ID NO: 912206 - DNA, 22 bp, Artificial Sequence
  chemically synthesized
tgttatatattttatcacacct

SEQ ID NO: 912207 - DNA, 22 bp, Artificial Sequence
  chemically synthesized
ggtgttacttttttaaggtgtg

SEQ ID NO: 912208 - DNA, 22 bp, Artificial Sequence
  chemically synthesized
cggtgttacttttttaaggtgt

SEQ ID NO: 912209 - DNA, 22 bp, Artificial Sequence
  chemically synthesized
tatattttatcacaccttaaaa

SEQ ID NO: 912210 - DNA, 22 bp, Artificial Sequence
  chemically synthesized
tatcacaccttaaaaaagtaac

SEQ ID NO: 912211 - DNA, 22 bp, Artificial Sequence
  chemically synthesized
atcacaccttaaaaaagtaaca

SEQ ID NO: 912212 - DNA, 22 bp, Artificial Sequence
  chemically synthesized
tcacaccttaaaaaagtaacac

SEQ ID NO: 912213 - DNA, 22 bp, Artificial Sequence
  chemically synthesized
aatcgtatttcggtgttacttt

SEQ ID NO: 912214 - DNA, 22 bp, Artificial Sequence
  chemically synthesized
aaaaaagtaacaccgaaatacg

SEQ ID NO: 912215 - DNA, 22 bp, Artificial Sequence
  chemically synthesized
aaaaagtaacaccgaaatacga

SEQ ID NO: 912216 - DNA, 22 bp, Artificial Sequence
  chemically synthesized
aagtgaacaattcaatcgtatt

SEQ ID NO: 912217 - DNA, 22 bp, Artificial Sequence
  chemically synthesized
aaagtgaacaattcaatcgtat

SEQ ID NO: 912218 - DNA, 22 bp, Artificial Sequence
  chemically synthesized
atttaaagtgaacaattcaatc

SEQ ID NO: 912219 - DNA, 22 bp, Artificial Sequence
  chemically synthesized
aactcatttaaagtgaacaatt

SEQ ID NO: 912220 - DNA, 22 bp, Artificial Sequence
  chemically synthesized
acataccattaaactcatttaa

SEQ ID NO: 912221 - DNA, 22 bp, Artificial Sequence
  chemically synthesized
aattgttcactttaaatgagtt

SEQ ID NO: 912222 - DNA, 22 bp, Artificial Sequence
  chemically synthesized
ttcactttaaatgagtttaatg

SEQ ID NO: 912223 - DNA, 22 bp, Artificial Sequence
  chemically synthesized
taattcacataccattaaactc

SEQ ID NO: 912224 - DNA, 22 bp, Artificial Sequence
  chemically synthesized
actttaaatgagtttaatggta

SEQ ID NO: 912225 - DNA, 22 bp, Artificial Sequence
  chemically synthesized
taaatgagtttaatggtatgtg

SEQ ID NO: 912226 - DNA, 22 bp, Artificial Sequence
  chemically synthesized
aaatgagtttaatggtatgtga

SEQ ID NO: 912227 - DNA, 22 bp, Artificial Sequence
  chemically synthesized
ccgagctataattcacatacca

SEQ ID NO: 912228 - DNA, 22 bp, Artificial Sequence
  chemically synthesized
aatgagtttaatggtatgtgaa

SEQ ID NO: 912229 - DNA, 22 bp, Artificial Sequence
  chemically synthesized
aatggtatgtgaattatagctc

SEQ ID NO: 912230 - DNA, 22 bp, Artificial Sequence
  chemically synthesized
atggtatgtgaattatagctcg

SEQ ID NO: 912231 - DNA, 22 bp, Artificial Sequence
  chemically synthesized
aaacaatcctaccgagctataa

SEQ ID NO: 912232 - DNA, 22 bp, Artificial Sequence
  chemically synthesized
aaaacaatcctaccgagctata

SEQ ID NO: 912233 - DNA, 22 bp, Artificial Sequence
  chemically synthesized
taaaacaatcctaccgagctat

SEQ ID NO: 912234 - DNA, 22 bp, Artificial Sequence
  chemically synthesized
ttaaaacaatcctaccgagcta

SEQ ID NO: 912235 - DNA, 22 bp, Artificial Sequence
  chemically synthesized
tttaaaacaatcctaccgagct

SEQ ID NO: 912236 - DNA, 22 bp, Artificial Sequence
  chemically synthesized
ttttaaaacaatcctaccgagc

SEQ ID NO: 912237 - DNA, 22 bp, Artificial Sequence
  chemically synthesized
tttttaaaacaatcctaccgag

SEQ ID NO: 912238 - DNA, 22 bp, Artificial Sequence
  chemically synthesized
ttttttaaaacaatcctaccga

SEQ ID NO: 912239 - DNA, 22 bp, Artificial Sequence
  chemically synthesized
caatcttttttttaaaacaatc

SEQ ID NO: 912240 - DNA, 22 bp, Artificial Sequence
  chemically synthesized
tagctcggtaggattgttttaa

SEQ ID NO: 912241 - DNA, 22 bp, Artificial Sequence
  chemically synthesized
attacaatcttttttttaaaac

SEQ ID NO: 912242 - DNA, 22 bp, Artificial Sequence
  chemically synthesized
aattacaatcttttttttaaaa

SEQ ID NO: 912243 - DNA, 22 bp, Artificial Sequence
  chemically synthesized
ggtaggattgttttaaaaaaaa

SEQ ID NO: 912244 - DNA, 22 bp, Artificial Sequence
  chemically synthesized
gcttaattacaatctttttttt

SEQ ID NO: 912245 - DNA, 22 bp, Artificial Sequence
  chemically synthesized
actggcttaattacaatctttt

SEQ ID NO: 912246 - DNA, 22 bp, Artificial Sequence
  chemically synthesized
cactggcttaattacaatcttt

SEQ ID NO: 912247 - DNA, 22 bp, Artificial Sequence
  chemically synthesized
ttttaaaaaaaagattgtaatt

SEQ ID NO: 912248 - DNA, 22 bp, Artificial Sequence
  chemically synthesized
taaaaaaaagattgtaattaag

SEQ ID NO: 912249 - DNA, 22 bp, Artificial Sequence
  chemically synthesized
aaaaaaaagattgtaattaagc

SEQ ID NO: 912250 - DNA, 22 bp, Artificial Sequence
  chemically synthesized
aaaaaaagattgtaattaagcc

SEQ ID NO: 912251 - DNA, 22 bp, Artificial Sequence
  chemically synthesized
acaacagtacttcactggctta

SEQ ID NO: 912252 - DNA, 22 bp, Artificial Sequence
  chemically synthesized
aacaacagtacttcactggctt

SEQ ID NO: 912253 - DNA, 22 bp, Artificial Sequence
  chemically synthesized
taacaacagtacttcactggct

SEQ ID NO: 912254 - DNA, 22 bp, Artificial Sequence
  chemically synthesized
tactttaacaacagtacttcac

SEQ ID NO: 912255 - DNA, 22 bp, Artificial Sequence
  chemically synthesized
taattaagccagtgaagtactg

SEQ ID NO: 912256 - DNA, 22 bp, Artificial Sequence
  chemically synthesized
aatctgtactttaacaacagta

SEQ ID NO: 912257 - DNA, 22 bp, Artificial Sequence
  chemically synthesized
agccagtgaagtactgttgtta

SEQ ID NO: 912258 - DNA, 22 bp, Artificial Sequence
  chemically synthesized
attaaatctgtactttaacaac

SEQ ID NO: 912259 - DNA, 22 bp, Artificial Sequence
  chemically synthesized
gattaaatctgtactttaacaa

SEQ ID NO: 912260 - DNA, 22 bp, Artificial Sequence
  chemically synthesized
catttgattaaatctgtacttt

SEQ ID NO: 912261 - DNA, 22 bp, Artificial Sequence
  chemically synthesized
ccatttgattaaatctgtactt

SEQ ID NO: 912262 - DNA, 22 bp, Artificial Sequence
  chemically synthesized
ttccatttgattaaatctgtac

SEQ ID NO: 912263 - DNA, 22 bp, Artificial Sequence
  chemically synthesized
ttgttaaagtacagatttaatc

SEQ ID NO: 912264 - DNA, 22 bp, Artificial Sequence
  chemically synthesized
ttaaagtacagatttaatcaaa

SEQ ID NO: 912265 - DNA, 22 bp, Artificial Sequence
  chemically synthesized
tatcctcttccatttgattaaa

SEQ ID NO: 912266 - DNA, 22 bp, Artificial Sequence
  chemically synthesized
tgtatcctcttccatttgatta

SEQ ID NO: 912267 - DNA, 22 bp, Artificial Sequence
  chemically synthesized
aagtacagatttaatcaaatgg

SEQ ID NO: 912268 - DNA, 22 bp, Artificial Sequence
  chemically synthesized
gattctgtatcctcttccattt

SEQ ID NO: 912269 - DNA, 22 bp, Artificial Sequence
  chemically synthesized
tggattctgtatcctcttccat

SEQ ID NO: 912270 - DNA, 22 bp, Artificial Sequence
  chemically synthesized
ctggattctgtatcctcttcca

SEQ ID NO: 912271 - DNA, 22 bp, Artificial Sequence
  chemically synthesized
cttctggattctgtatcctctt

SEQ ID NO: 912272 - DNA, 22 bp, Artificial Sequence
  chemically synthesized
aatcaaatggaagaggatacag

SEQ ID NO: 912273 - DNA, 22 bp, Artificial Sequence
  chemically synthesized
atcaaatggaagaggatacaga

SEQ ID NO: 912274 - DNA, 22 bp, Artificial Sequence
  chemically synthesized
tatgtatgaatctgcttctgga

SEQ ID NO: 912275 - DNA, 22 bp, Artificial Sequence
  chemically synthesized
gtatgtatgaatctgcttctgg

SEQ ID NO: 912276 - DNA, 22 bp, Artificial Sequence
  chemically synthesized
tcataaatcaagagaacttgta

SEQ ID NO: 912277 - DNA, 22 bp, Artificial Sequence
  chemically synthesized
gtcataaatcaagagaacttgt

SEQ ID NO: 912278 - DNA, 22 bp, Artificial Sequence
  chemically synthesized
tgtcataaatcaagagaacttg

SEQ ID NO: 912279 - DNA, 22 bp, Artificial Sequence
  chemically synthesized
atacatacaagttctcttgatt

SEQ ID NO: 912280 - DNA, 22 bp, Artificial Sequence
  chemically synthesized
atggcatctttgtcataaatca

SEQ ID NO: 912281 - DNA, 22 bp, Artificial Sequence
  chemically synthesized
catggcatctttgtcataaatc

SEQ ID NO: 912282 - DNA, 22 bp, Artificial Sequence
  chemically synthesized
tcatggcatctttgtcataaat

SEQ ID NO: 912283 - DNA, 22 bp, Artificial Sequence
  chemically synthesized
tattttcatggcatctttgtca

SEQ ID NO: 912284 - DNA, 22 bp, Artificial Sequence
  chemically synthesized
tcttgatttatgacaaagatgc

SEQ ID NO: 912285 - DNA, 22 bp, Artificial Sequence
  chemically synthesized
ttgatttatgacaaagatgcca

SEQ ID NO: 912286 - DNA, 22 bp, Artificial Sequence
  chemically synthesized
gatttatgacaaagatgccatg

SEQ ID NO: 912287 - DNA, 22 bp, Artificial Sequence
  chemically synthesized
atttatgacaaagatgccatga

SEQ ID NO: 912288 - DNA, 22 bp, Artificial Sequence
  chemically synthesized
cccactgtattttcatggcatc

SEQ ID NO: 912289 - DNA, 22 bp, Artificial Sequence
  chemically synthesized
ccccactgtattttcatggcat

SEQ ID NO: 912290 - DNA, 22 bp, Artificial Sequence
  chemically synthesized
atgacaaagatgccatgaaaat

SEQ ID NO: 912291 - DNA, 22 bp, Artificial Sequence
  chemically synthesized
tgacaaagatgccatgaaaata

SEQ ID NO: 912292 - DNA, 22 bp, Artificial Sequence
  chemically synthesized
aaagacaatcatttccccactg

SEQ ID NO: 912293 - DNA, 22 bp, Artificial Sequence
  chemically synthesized
attcaaagacaatcatttcccc

SEQ ID NO: 912294 - DNA, 22 bp, Artificial Sequence
  chemically synthesized
ttcattcaaagacaatcatttc

SEQ ID NO: 912295 - DNA, 22 bp, Artificial Sequence
  chemically synthesized
atccagcactattcattcaaag

SEQ ID NO: 912296 - DNA, 22 bp, Artificial Sequence
  chemically synthesized
tctttgaatgaatagtgctgga

SEQ ID NO: 912297 - DNA, 22 bp, Artificial Sequence
  chemically synthesized
tgaatgaatagtgctggatcaa

SEQ ID NO: 912298 - DNA, 22 bp, Artificial Sequence
  chemically synthesized
gaatgaatagtgctggatcaat

SEQ ID NO: 912299 - DNA, 22 bp, Artificial Sequence
  chemically synthesized
aatgaatagtgctggatcaatt

SEQ ID NO: 912300 - DNA, 22 bp, Artificial Sequence
  chemically synthesized
tagtaaaaagcaacatcaattg

SEQ ID NO: 912301 - DNA, 22 bp, Artificial Sequence
  chemically synthesized
atagtaaaaagcaacatcaatt

SEQ ID NO: 912302 - DNA, 22 bp, Artificial Sequence
  chemically synthesized
gatcaattgatgttgcttttta

SEQ ID NO: 912303 - DNA, 22 bp, Artificial Sequence
  chemically synthesized
atgttgctttttactataaatt

SEQ ID NO: 912304 - DNA, 22 bp, Artificial Sequence
  chemically synthesized
ctttttactataaattcatatg

SEQ ID NO: 912305 - DNA, 22 bp, Artificial Sequence
  chemically synthesized
tttactataaattcatatgtac

SEQ ID NO: 912306 - DNA, 22 bp, Artificial Sequence
  chemically synthesized
ttactataaattcatatgtacc

SEQ ID NO: 912307 - DNA, 22 bp, Artificial Sequence
  chemically synthesized
tataaagcaagtggtacatatg

SEQ ID NO: 912308 - DNA, 22 bp, Artificial Sequence
  chemically synthesized
tactataaattcatatgtacca

SEQ ID NO: 912309 - DNA, 22 bp, Artificial Sequence
  chemically synthesized
atataaagcaagtggtacatat

SEQ ID NO: 912310 - DNA, 22 bp, Artificial Sequence
  chemically synthesized
actataaattcatatgtaccac

SEQ ID NO: 912311 - DNA, 22 bp, Artificial Sequence
  chemically synthesized
tatataaagcaagtggtacata

SEQ ID NO: 912312 - DNA, 22 bp, Artificial Sequence
  chemically synthesized
ctataaattcatatgtaccact

SEQ ID NO: 912313 - DNA, 22 bp, Artificial Sequence
  chemically synthesized
ttttatataaagcaagtggtac

SEQ ID NO: 912314 - DNA, 22 bp, Artificial Sequence
  chemically synthesized
taaattcatatgtaccacttgc

SEQ ID NO: 912315 - DNA, 22 bp, Artificial Sequence
  chemically synthesized
attttatataaagcaagtggta

SEQ ID NO: 912316 - DNA, 22 bp, Artificial Sequence
  chemically synthesized
atatgtaccacttgctttatat

SEQ ID NO: 912317 - DNA, 22 bp, Artificial Sequence
  chemically synthesized
atacatatttattttatataaa

SEQ ID NO: 912318 - DNA, 22 bp, Artificial Sequence
  chemically synthesized
aattaatacatatttattttat

SEQ ID NO: 912319 - DNA, 22 bp, Artificial Sequence
  chemically synthesized
ttaaattaatacatatttattt

SEQ ID NO: 912320 - DNA, 22 bp, Artificial Sequence
  chemically synthesized
attaaattaatacatatttatt

SEQ ID NO: 912321 - DNA, 22 bp, Artificial Sequence
  chemically synthesized
gctttatataaaataaatatgt

SEQ ID NO: 912322 - DNA, 22 bp, Artificial Sequence
  chemically synthesized
ctttatataaaataaatatgta

SEQ ID NO: 912323 - DNA, 22 bp, Artificial Sequence
  chemically synthesized
tttattaaattaatacatattt

SEQ ID NO: 912324 - DNA, 22 bp, Artificial Sequence
  chemically synthesized
tatataaaataaatatgtatta

SEQ ID NO: 912325 - DNA, 22 bp, Artificial Sequence
  chemically synthesized
atataaaataaatatgtattaa

SEQ ID NO: 912326 - DNA, 22 bp, Artificial Sequence
  chemically synthesized
tataaaataaatatgtattaat

SEQ ID NO: 912327 - DNA, 22 bp, Artificial Sequence
  chemically synthesized
acagtaatactatttattaaat

SEQ ID NO: 912328 - DNA, 22 bp, Artificial Sequence
  chemically synthesized
tataaatctaacagtaatacta

SEQ ID NO: 912329 - DNA, 22 bp, Artificial Sequence
  chemically synthesized
atttaataaatagtattactgt

SEQ ID NO: 912330 - DNA, 22 bp, Artificial Sequence
  chemically synthesized
aataaatagtattactgttaga

SEQ ID NO: 912331 - DNA, 22 bp, Artificial Sequence
  chemically synthesized
ataaatagtattactgttagat

SEQ ID NO: 912332 - DNA, 22 bp, Artificial Sequence
  chemically synthesized
catactatataaatctaacagt

SEQ ID NO: 912333 - DNA, 22 bp, Artificial Sequence
  chemically synthesized
gcatactatataaatctaacag

SEQ ID NO: 912334 - DNA, 22 bp, Artificial Sequence
  chemically synthesized
caccttgcatactatataaatc

SEQ ID NO: 912335 - DNA, 22 bp, Artificial Sequence
  chemically synthesized
ccaccttgcatactatataaat

SEQ ID NO: 912336 - DNA, 22 bp, Artificial Sequence
  chemically synthesized
tccaccttgcatactatataaa

SEQ ID NO: 912337 - DNA, 22 bp, Artificial Sequence
  chemically synthesized
ctgttagatttatatagtatgc

SEQ ID NO: 912338 - DNA, 22 bp, Artificial Sequence
  chemically synthesized
atctttccaccttgcatactat

SEQ ID NO: 912339 - DNA, 22 bp, Artificial Sequence
  chemically synthesized
catctttccaccttgcatacta

SEQ ID NO: 912340 - DNA, 22 bp, Artificial Sequence
  chemically synthesized
ttagatttatatagtatgcaag

SEQ ID NO: 912341 - DNA, 22 bp, Artificial Sequence
  chemically synthesized
tcatctttccaccttgcatact

SEQ ID NO: 912342 - DNA, 22 bp, Artificial Sequence
  chemically synthesized
gatttatatagtatgcaaggtg

SEQ ID NO: 912343 - DNA, 22 bp, Artificial Sequence
  chemically synthesized
tgagttttcatctttccacctt

SEQ ID NO: 912344 - DNA, 22 bp, Artificial Sequence
  chemically synthesized
atatagtatgcaaggtggaaag

SEQ ID NO: 912345 - DNA, 22 bp, Artificial Sequence
  chemically synthesized
gtgagttttcatctttccacct

SEQ ID NO: 912346 - DNA, 22 bp, Artificial Sequence
  chemically synthesized
tatagtatgcaaggtggaaaga

SEQ ID NO: 912347 - DNA, 22 bp, Artificial Sequence
  chemically synthesized
acttgtgagttttcatctttcc

SEQ ID NO: 912348 - DNA, 22 bp, Artificial Sequence
  chemically synthesized
ttaacttgtgagttttcatctt

SEQ ID NO: 912349 - DNA, 22 bp, Artificial Sequence
  chemically synthesized
attaacttgtgagttttcatct

SEQ ID NO: 912350 - DNA, 22 bp, Artificial Sequence
  chemically synthesized
atttattaacttgtgagttttc

SEQ ID NO: 912351 - DNA, 22 bp, Artificial Sequence
  chemically synthesized
ctgatttattaacttgtgagtt

SEQ ID NO: 912352 - DNA, 22 bp, Artificial Sequence
  chemically synthesized
cctactgatttattaacttgtg

SEQ ID NO: 912353 - DNA, 22 bp, Artificial Sequence
  chemically synthesized
acctactgatttattaacttgt

SEQ ID NO: 912354 - DNA, 22 bp, Artificial Sequence
  chemically synthesized
cttacctactgatttattaact

SEQ ID NO: 912355 - DNA, 22 bp, Artificial Sequence
  chemically synthesized
acttacctactgatttattaac

SEQ ID NO: 912356 - DNA, 22 bp, Artificial Sequence
  chemically synthesized
tttacttacctactgatttatt

SEQ ID NO: 912357 - DNA, 22 bp, Artificial Sequence
  chemically synthesized
atttacttacctactgatttat

SEQ ID NO: 912358 - DNA, 22 bp, Artificial Sequence
  chemically synthesized
tttatttacttacctactgatt

SEQ ID NO: 912359 - DNA, 22 bp, Artificial Sequence
  chemically synthesized
acaagttaataaatcagtaggt

SEQ ID NO: 912360 - DNA, 22 bp, Artificial Sequence
  chemically synthesized
atttatttacttacctactgat

SEQ ID NO: 912361 - DNA, 22 bp, Artificial Sequence
  chemically synthesized
ataaatcagtaggtaagtaaat

SEQ ID NO: 912362 - DNA, 22 bp, Artificial Sequence
  chemically synthesized
gccacaagtttatttatttact

SEQ ID NO: 912363 - DNA, 22 bp, Artificial Sequence
  chemically synthesized
acgttcgccacaagtttattta

SEQ ID NO: 912364 - DNA, 22 bp, Artificial Sequence
  chemically synthesized
atgtacactaacgttcgccaca

SEQ ID NO: 912365 - DNA, 22 bp, Artificial Sequence
  chemically synthesized
ataattaatgtacactaacgtt

SEQ ID NO: 912366 - DNA, 22 bp, Artificial Sequence
  chemically synthesized
aataattaatgtacactaacgt

SEQ ID NO: 912367 - DNA, 22 bp, Artificial Sequence
  chemically synthesized
gtggcgaacgttagtgtacatt

SEQ ID NO: 912368 - DNA, 22 bp, Artificial Sequence
  chemically synthesized
tggcgaacgttagtgtacatta

SEQ ID NO: 912369 - DNA, 22 bp, Artificial Sequence
  chemically synthesized
tggtatggacttaataattaat

SEQ ID NO: 912370 - DNA, 22 bp, Artificial Sequence
  chemically synthesized
gtgtacattaattattaagtcc

SEQ ID NO: 912371 - DNA, 22 bp, Artificial Sequence
  chemically synthesized
acacctgtggtatggacttaat

SEQ ID NO: 912372 - DNA, 22 bp, Artificial Sequence
  chemically synthesized
ttcacacctgtggtatggactt

SEQ ID NO: 912373 - DNA, 22 bp, Artificial Sequence
  chemically synthesized
attattcacacctgtggtatgg

SEQ ID NO: 912374 - DNA, 22 bp, Artificial Sequence
  chemically synthesized
attattaagtccataccacagg

SEQ ID NO: 912375 - DNA, 22 bp, Artificial Sequence
  chemically synthesized
ttaagtccataccacaggtgtg

SEQ ID NO: 912376 - DNA, 22 bp, Artificial Sequence
  chemically synthesized
agtccataccacaggtgtgaat

SEQ ID NO: 912377 - DNA, 22 bp, Artificial Sequence
  chemically synthesized
aacaagtgtcataaatcaaaat

SEQ ID NO: 912378 - DNA, 22 bp, Artificial Sequence
  chemically synthesized
gttaaacaagtgtcataaatca

SEQ ID NO: 912379 - DNA, 22 bp, Artificial Sequence
  chemically synthesized
tagttaaacaagtgtcataaat

SEQ ID NO: 912380 - DNA, 22 bp, Artificial Sequence
  chemically synthesized
gttctagttaaacaagtgtcat

SEQ ID NO: 912381 - DNA, 22 bp, Artificial Sequence
  chemically synthesized
attttgatttatgacacttgtt

SEQ ID NO: 912382 - DNA, 22 bp, Artificial Sequence
  chemically synthesized
tgatttatgacacttgtttaac

SEQ ID NO: 912383 - DNA, 22 bp, Artificial Sequence
  chemically synthesized
gatttatgacacttgtttaact

SEQ ID NO: 912384 - DNA, 22 bp, Artificial Sequence
  chemically synthesized
atttatgacacttgtttaacta

SEQ ID NO: 912385 - DNA, 22 bp, Artificial Sequence
  chemically synthesized
atgacacttgtttaactagaac

SEQ ID NO: 912386 - DNA, 22 bp, Artificial Sequence
  chemically synthesized
tgacacttgtttaactagaacc

SEQ ID NO: 912387 - DNA, 22 bp, Artificial Sequence
  chemically synthesized
aaaggacgtggtctggttctag

SEQ ID NO: 912388 - DNA, 22 bp, Artificial Sequence
  chemically synthesized
agctgaaaggacgtggtctggt

SEQ ID NO: 912389 - DNA, 22 bp, Artificial Sequence
  chemically synthesized
gtttaactagaaccagaccacg

SEQ ID NO: 912390 - DNA, 22 bp, Artificial Sequence
  chemically synthesized
aagctgaaaggacgtggtctgg

SEQ ID NO: 912391 - DNA, 22 bp, Artificial Sequence
  chemically synthesized
tttaactagaaccagaccacgt

SEQ ID NO: 912392 - DNA, 22 bp, Artificial Sequence
  chemically synthesized
aactagaaccagaccacgtcct

SEQ ID NO: 912393 - DNA, 22 bp, Artificial Sequence
  chemically synthesized
actagaaccagaccacgtcctt

SEQ ID NO: 912394 - DNA, 22 bp, Artificial Sequence
  chemically synthesized
gaaccagaccacgtcctttcag

SEQ ID NO: 912395 - DNA, 22 bp, Artificial Sequence
  chemically synthesized
acagtatttaagctgaaaggac

SEQ ID NO: 912396 - DNA, 22 bp, Artificial Sequence
  chemically synthesized
tcagcttaaatactgtcagtac

SEQ ID NO: 912397 - DNA, 22 bp, Artificial Sequence
  chemically synthesized
cagcttaaatactgtcagtaca

SEQ ID NO: 912398 - DNA, 22 bp, Artificial Sequence
  chemically synthesized
agtggccaggcatgtactgaca

SEQ ID NO: 912399 - DNA, 22 bp, Artificial Sequence
  chemically synthesized
agcttaaatactgtcagtacat

SEQ ID NO: 912400 - DNA, 22 bp, Artificial Sequence
  chemically synthesized
attcagtggccaggcatgtact

SEQ ID NO: 912401 - DNA, 22 bp, Artificial Sequence
  chemically synthesized
aattcagtggccaggcatgtac

SEQ ID NO: 912402 - DNA, 22 bp, Artificial Sequence
  chemically synthesized
aaatactgtcagtacatgcctg

SEQ ID NO: 912403 - DNA, 22 bp, Artificial Sequence
  chemically synthesized
aatactgtcagtacatgcctgg

SEQ ID NO: 912404 - DNA, 22 bp, Artificial Sequence
  chemically synthesized
tcagtacatgcctggccactga

SEQ ID NO: 912405 - DNA, 22 bp, Artificial Sequence
  chemically synthesized
aagaaatggcgaagtatttaat

SEQ ID NO: 912406 - DNA, 22 bp, Artificial Sequence
  chemically synthesized
gccactgaattaaatacttcgc

SEQ ID NO: 912407 - DNA, 22 bp, Artificial Sequence
  chemically synthesized
aattaaatacttcgccatttct

SEQ ID NO: 912408 - DNA, 22 bp, Artificial Sequence
  chemically synthesized
aagaatcagactgaagaaatgg

SEQ ID NO: 912409 - DNA, 22 bp, Artificial Sequence
  chemically synthesized
tgaagaatcagactgaagaaat

SEQ ID NO: 912410 - DNA, 22 bp, Artificial Sequence
  chemically synthesized
aatacttcgccatttcttcagt

SEQ ID NO: 912411 - DNA, 22 bp, Artificial Sequence
  chemically synthesized
ttctgaagaatcagactgaaga

SEQ ID NO: 912412 - DNA, 22 bp, Artificial Sequence
  chemically synthesized
cgccatttcttcagtctgattc

SEQ ID NO: 912413 - DNA, 22 bp, Artificial Sequence
  chemically synthesized
gccatttcttcagtctgattct

SEQ ID NO: 912414 - DNA, 22 bp, Artificial Sequence
  chemically synthesized
cataaattattctgaagaatca

SEQ ID NO: 912415 - DNA, 22 bp, Artificial Sequence
  chemically synthesized
gcataaattattctgaagaatc

SEQ ID NO: 912416 - DNA, 22 bp, Artificial Sequence
  chemically synthesized
tgcataaattattctgaagaat

SEQ ID NO: 912417 - DNA, 22 bp, Artificial Sequence
  chemically synthesized
ttgcataaattattctgaagaa

SEQ ID NO: 912418 - DNA, 22 bp, Artificial Sequence
  chemically synthesized
cttcagtctgattcttcagaat

SEQ ID NO: 912419 - DNA, 22 bp, Artificial Sequence
  chemically synthesized
tttgcataaattattctgaaga

SEQ ID NO: 912420 - DNA, 22 bp, Artificial Sequence
  chemically synthesized
ttcagtctgattcttcagaata

SEQ ID NO: 912421 - DNA, 22 bp, Artificial Sequence
  chemically synthesized
cagtctgattcttcagaataat

SEQ ID NO: 912422 - DNA, 22 bp, Artificial Sequence
  chemically synthesized
agtctgattcttcagaataatt

SEQ ID NO: 912423 - DNA, 22 bp, Artificial Sequence
  chemically synthesized
attcttcagaataatttatgca

SEQ ID NO: 912424 - DNA, 22 bp, Artificial Sequence
  chemically synthesized
taccacaattttttgcataaat

SEQ ID NO: 912425 - DNA, 22 bp, Artificial Sequence
  chemically synthesized
ataccacaattttttgcataaa

SEQ ID NO: 912426 - DNA, 22 bp, Artificial Sequence
  chemically synthesized
ttcagaataatttatgcaaaaa

SEQ ID NO: 912427 - DNA, 22 bp, Artificial Sequence
  chemically synthesized
cagaataatttatgcaaaaaat

SEQ ID NO: 912428 - DNA, 22 bp, Artificial Sequence
  chemically synthesized
agaataatttatgcaaaaaatt

SEQ ID NO: 912429 - DNA, 22 bp, Artificial Sequence
  chemically synthesized
atgcaaaaaattgtggtataaa

SEQ ID NO: 912430 - DNA, 22 bp, Artificial Sequence
  chemically synthesized
tgcaaaaaattgtggtataaat

SEQ ID NO: 912431 - DNA, 22 bp, Artificial Sequence
  chemically synthesized
atgaccaaatgccaaaatttat

SEQ ID NO: 912432 - DNA, 22 bp, Artificial Sequence
  chemically synthesized
cattaatgaccaaatgccaaaa

SEQ ID NO: 912433 - DNA, 22 bp, Artificial Sequence
  chemically synthesized
acattaatgaccaaatgccaaa

SEQ ID NO: 912434 - DNA, 22 bp, Artificial Sequence
  chemically synthesized
tacattaatgaccaaatgccaa

SEQ ID NO: 912435 - DNA, 22 bp, Artificial Sequence
  chemically synthesized
tggtataaattttggcatttgg

SEQ ID NO: 912436 - DNA, 22 bp, Artificial Sequence
  chemically synthesized
tggcatttggtcattaatgtaa

SEQ ID NO: 912437 - DNA, 22 bp, Artificial Sequence
  chemically synthesized
ggcatttggtcattaatgtaaa

SEQ ID NO: 912438 - DNA, 22 bp, Artificial Sequence
  chemically synthesized
gcatttggtcattaatgtaaag

SEQ ID NO: 912439 - DNA, 22 bp, Artificial Sequence
  chemically synthesized
ggtcattaatgtaaagccattc

SEQ ID NO: 912440 - DNA, 22 bp, Artificial Sequence
  chemically synthesized
gtcattaatgtaaagccattca

SEQ ID NO: 912441 - DNA, 22 bp, Artificial Sequence
  chemically synthesized
gaaaaaatgatgatggtgaatg

SEQ ID NO: 912442 - DNA, 22 bp, Artificial Sequence
  chemically synthesized
atgtaaagccattcaccatcat

SEQ ID NO: 912443 - DNA, 22 bp, Artificial Sequence
  chemically synthesized
tggctagaaaaaatgatgatgg

SEQ ID NO: 912444 - DNA, 22 bp, Artificial Sequence
  chemically synthesized
ttgtggctagaaaaaatgatga

SEQ ID NO: 912445 - DNA, 22 bp, Artificial Sequence
  chemically synthesized
gttgtggctagaaaaaatgatg

SEQ ID NO: 912446 - DNA, 22 bp, Artificial Sequence
  chemically synthesized
tgttgtggctagaaaaaatgat

SEQ ID NO: 912447 - DNA, 22 bp, Artificial Sequence
  chemically synthesized
accatcatcattttttctagcc

SEQ ID NO: 912448 - DNA, 22 bp, Artificial Sequence
  chemically synthesized
tatgttttgttgtggctagaaa

SEQ ID NO: 912449 - DNA, 22 bp, Artificial Sequence
  chemically synthesized
gctatatgttttgttgtggcta

SEQ ID NO: 912450 - DNA, 22 bp, Artificial Sequence
  chemically synthesized
ggctatatgttttgttgtggct

SEQ ID NO: 912451 - DNA, 22 bp, Artificial Sequence
  chemically synthesized
tggctatatgttttgttgtggc

SEQ ID NO: 912452 - DNA, 22 bp, Artificial Sequence
  chemically synthesized
ctttggctatatgttttgttgt

SEQ ID NO: 912453 - DNA, 22 bp, Artificial Sequence
  chemically synthesized
gctttggctatatgttttgttg

SEQ ID NO: 912454 - DNA, 22 bp, Artificial Sequence
  chemically synthesized
tttctagccacaacaaaacata

SEQ ID NO: 912455 - DNA, 22 bp, Artificial Sequence
  chemically synthesized
ttctagccacaacaaaacatat

SEQ ID NO: 912456 - DNA, 22 bp, Artificial Sequence
  chemically synthesized
tctagccacaacaaaacatata

SEQ ID NO: 912457 - DNA, 22 bp, Artificial Sequence
  chemically synthesized
ctagccacaacaaaacatatag

SEQ ID NO: 912458 - DNA, 22 bp, Artificial Sequence
  chemically synthesized
tagccacaacaaaacatatagc

SEQ ID NO: 912459 - DNA, 22 bp, Artificial Sequence
  chemically synthesized
accgtttgctttggctatatgt

SEQ ID NO: 912460 - DNA, 22 bp, Artificial Sequence
  chemically synthesized
gccacaacaaaacatatagcca

SEQ ID NO: 912461 - DNA, 22 bp, Artificial Sequence
  chemically synthesized
acctgaccgtttgctttggcta

SEQ ID NO: 912462 - DNA, 22 bp, Artificial Sequence
  chemically synthesized
aacctgaccgtttgctttggct

SEQ ID NO: 912463 - DNA, 22 bp, Artificial Sequence
  chemically synthesized
taacctgaccgtttgctttggc

SEQ ID NO: 912464 - DNA, 22 bp, Artificial Sequence
  chemically synthesized
ttaacctgaccgtttgctttgg

SEQ ID NO: 912465 - DNA, 22 bp, Artificial Sequence
  chemically synthesized
tttaacctgaccgtttgctttg

SEQ ID NO: 912466 - DNA, 22 bp, Artificial Sequence
  chemically synthesized
ttttaacctgaccgtttgcttt

SEQ ID NO: 912467 - DNA, 22 bp, Artificial Sequence
  chemically synthesized
tttttttaacctgaccgtttgc

SEQ ID NO: 912468 - DNA, 22 bp, Artificial Sequence
  chemically synthesized
gtttttttaacctgaccgtttg

SEQ ID NO: 912469 - DNA, 22 bp, Artificial Sequence
  chemically synthesized
tgtttttttaacctgaccgttt

SEQ ID NO: 912470 - DNA, 22 bp, Artificial Sequence
  chemically synthesized
ttttgtttttttaacctgaccg

SEQ ID NO: 912471 - DNA, 22 bp, Artificial Sequence
  chemically synthesized
gttttgtttttttaacctgacc

SEQ ID NO: 912472 - DNA, 22 bp, Artificial Sequence
  chemically synthesized
tgttttgtttttttaacctgac

SEQ ID NO: 912473 - DNA, 22 bp, Artificial Sequence
  chemically synthesized
ttttgttttgtttttttaacct

SEQ ID NO: 912474 - DNA, 22 bp, Artificial Sequence
  chemically synthesized
ttgttttgttttgtttttttaa

SEQ ID NO: 912475 - DNA, 22 bp, Artificial Sequence
  chemically synthesized
gtatgtggattgttgttttgtt

SEQ ID NO: 912476 - DNA, 22 bp, Artificial Sequence
  chemically synthesized
aaaaaacaaaacaaaacaacaa

SEQ ID NO: 912477 - DNA, 22 bp, Artificial Sequence
  chemically synthesized
gtcggggaggaggctggtatgt

SEQ ID NO: 912478 - DNA, 22 bp, Artificial Sequence
  chemically synthesized
attggtcggggaggaggctggt

SEQ ID NO: 912479 - DNA, 22 bp, Artificial Sequence
  chemically synthesized
cattggtcggggaggaggctgg

SEQ ID NO: 912480 - DNA, 22 bp, Artificial Sequence
  chemically synthesized
ggtgcttcattggtcggggagg

SEQ ID NO: 912481 - DNA, 22 bp, Artificial Sequence
  chemically synthesized
ctgggtgcttcattggtcgggg

SEQ ID NO: 912482 - DNA, 22 bp, Artificial Sequence
  chemically synthesized
cctgggtgcttcattggtcggg

SEQ ID NO: 912483 - DNA, 22 bp, Artificial Sequence
  chemically synthesized
tttcctgggtgcttcattggtc

SEQ ID NO: 912484 - DNA, 22 bp, Artificial Sequence
  chemically synthesized
gtttcctgggtgcttcattggt

SEQ ID NO: 912485 - DNA, 22 bp, Artificial Sequence
  chemically synthesized
tgtttcctgggtgcttcattgg

SEQ ID NO: 912486 - DNA, 22 bp, Artificial Sequence
  chemically synthesized
ctccccgaccaatgaagcaccc

SEQ ID NO: 912487 - DNA, 22 bp, Artificial Sequence
  chemically synthesized
cccgaccaatgaagcacccagg

SEQ ID NO: 912488 - DNA, 22 bp, Artificial Sequence
  chemically synthesized
tatgtattttgtttcctgggtg

SEQ ID NO: 912489 - DNA, 22 bp, Artificial Sequence
  chemically synthesized
gtatgtattttgtttcctgggt

SEQ ID NO: 912490 - DNA, 22 bp, Artificial Sequence
  chemically synthesized
caagtatttgtatgtattttgt

SEQ ID NO: 912491 - DNA, 22 bp, Artificial Sequence
  chemically synthesized
aatgttgcaagtatttgtatgt

SEQ ID NO: 912492 - DNA, 22 bp, Artificial Sequence
  chemically synthesized
cgtcacatgtgttaaatgttgc

SEQ ID NO: 912493 - DNA, 22 bp, Artificial Sequence
  chemically synthesized
ccgtcacatgtgttaaatgttg

SEQ ID NO: 912494 - DNA, 22 bp, Artificial Sequence
  chemically synthesized
ttccgtcacatgtgttaaatgt

SEQ ID NO: 912495 - DNA, 22 bp, Artificial Sequence
  chemically synthesized
accatctcttccgtcacatgtg

SEQ ID NO: 912496 - DNA, 22 bp, Artificial Sequence
  chemically synthesized
gcaacatttaacacatgtgacg

SEQ ID NO: 912497 - DNA, 22 bp, Artificial Sequence
  chemically synthesized
caacatttaacacatgtgacgg

SEQ ID NO: 912498 - DNA, 22 bp, Artificial Sequence
  chemically synthesized
gacattaaccatctcttccgtc

SEQ ID NO: 912499 - DNA, 22 bp, Artificial Sequence
  chemically synthesized
aacacatgtgacggaagagatg

SEQ ID NO: 912500 - DNA, 22 bp, Artificial Sequence
  chemically synthesized
acacatgtgacggaagagatgg

SEQ ID NO: 912501 - DNA, 22 bp, Artificial Sequence
  chemically synthesized
cagtggataaaggttagacatt

SEQ ID NO: 912502 - DNA, 22 bp, Artificial Sequence
  chemically synthesized
atgtctaacctttatccactgg

SEQ ID NO: 912503 - DNA, 22 bp, Artificial Sequence
  chemically synthesized
aagcagacaaatctccagtgga

SEQ ID NO: 912504 - DNA, 22 bp, Artificial Sequence
  chemically synthesized
acctttatccactggagatttg

SEQ ID NO: 912505 - DNA, 22 bp, Artificial Sequence
  chemically synthesized
tatccactggagatttgtctgc

SEQ ID NO: 912506 - DNA, 22 bp, Artificial Sequence
  chemically synthesized
atccactggagatttgtctgct

SEQ ID NO: 912507 - DNA, 22 bp, Artificial Sequence
  chemically synthesized
aaaataagctcaagcagacaaa

SEQ ID NO: 912508 - DNA, 22 bp, Artificial Sequence
  chemically synthesized
tccactggagatttgtctgctt

SEQ ID NO: 912509 - DNA, 22 bp, Artificial Sequence
  chemically synthesized
gaaaataagctcaagcagacaa

SEQ ID NO: 912510 - DNA, 22 bp, Artificial Sequence
  chemically synthesized
gagatttgtctgcttgagctta

SEQ ID NO: 912511 - DNA, 22 bp, Artificial Sequence
  chemically synthesized
gtctgcttgagcttattttcaa

SEQ ID NO: 912512 - DNA, 22 bp, Artificial Sequence
  chemically synthesized
tctgcttgagcttattttcaag

SEQ ID NO: 912513 - DNA, 22 bp, Artificial Sequence
  chemically synthesized
cttgagcttattttcaagttta

SEQ ID NO: 912514 - DNA, 22 bp, Artificial Sequence
  chemically synthesized
gagcttattttcaagtttatct

SEQ ID NO: 912515 - DNA, 22 bp, Artificial Sequence
  chemically synthesized
agcttattttcaagtttatctt

SEQ ID NO: 912516 - DNA, 22 bp, Artificial Sequence
  chemically synthesized
attttcaagtttatcttgctct

SEQ ID NO: 912517 - DNA, 22 bp, Artificial Sequence
  chemically synthesized
ttttcaagtttatcttgctctt

SEQ ID NO: 912518 - DNA, 22 bp, Artificial Sequence
  chemically synthesized
ccataagcccagaagagcaaga

SEQ ID NO: 912519 - DNA, 22 bp, Artificial Sequence
  chemically synthesized
tcaagtttatcttgctcttctg

SEQ ID NO: 912520 - DNA, 22 bp, Artificial Sequence
  chemically synthesized
caagtttatcttgctcttctgg

SEQ ID NO: 912521 - DNA, 22 bp, Artificial Sequence
  chemically synthesized
aagtttatcttgctcttctggg

SEQ ID NO: 912522 - DNA, 22 bp, Artificial Sequence
  chemically synthesized
taagtgctcccataagcccaga

SEQ ID NO: 912523 - DNA, 22 bp, Artificial Sequence
  chemically synthesized
gtaagtgctcccataagcccag

SEQ ID NO: 912524 - DNA, 22 bp, Artificial Sequence
  chemically synthesized
atcttgctcttctgggcttatg

SEQ ID NO: 912525 - DNA, 22 bp, Artificial Sequence
  chemically synthesized
tcttgctcttctgggcttatgg

SEQ ID NO: 912526 - DNA, 22 bp, Artificial Sequence
  chemically synthesized
gctcttctgggcttatgggagc

SEQ ID NO: 912527 - DNA, 22 bp, Artificial Sequence
  chemically synthesized
ctcttctgggcttatgggagca

SEQ ID NO: 912528 - DNA, 22 bp, Artificial Sequence
  chemically synthesized
ttctgggcttatgggagcactt

SEQ ID NO: 912529 - DNA, 22 bp, Artificial Sequence
  chemically synthesized
ctgggcttatgggagcacttac

SEQ ID NO: 912530 - DNA, 22 bp, Artificial Sequence
  chemically synthesized
tgggcttatgggagcacttaca

SEQ ID NO: 912531 - DNA, 22 bp, Artificial Sequence
  chemically synthesized
gaggacccgtgcttgtaagtgc

SEQ ID NO: 912532 - DNA, 22 bp, Artificial Sequence
  chemically synthesized
ggcttatgggagcacttacaag

SEQ ID NO: 912533 - DNA, 22 bp, Artificial Sequence
  chemically synthesized
atgggagcacttacaagcacgg

SEQ ID NO: 912534 - DNA, 22 bp, Artificial Sequence
  chemically synthesized
tgggagcacttacaagcacggg

SEQ ID NO: 912535 - DNA, 22 bp, Artificial Sequence
  chemically synthesized
aatgaaactggaggacccgtgc

SEQ ID NO: 912536 - DNA, 22 bp, Artificial Sequence
  chemically synthesized
acaagcacgggtcctccagttt

SEQ ID NO: 912537 - DNA, 22 bp, Artificial Sequence
  chemically synthesized
caagcacgggtcctccagtttc

SEQ ID NO: 912538 - DNA, 22 bp, Artificial Sequence
  chemically synthesized
aaacaattaaatgaaactggag

SEQ ID NO: 912539 - DNA, 22 bp, Artificial Sequence
  chemically synthesized
tcaaacaattaaatgaaactgg

SEQ ID NO: 912540 - DNA, 22 bp, Artificial Sequence
  chemically synthesized
cagtttcatttaattgtttgag

SEQ ID NO: 912541 - DNA, 22 bp, Artificial Sequence
  chemically synthesized
cgccagggaattctcaaacaat

SEQ ID NO: 912542 - DNA, 22 bp, Artificial Sequence
  chemically synthesized
catttaattgtttgagaattcc

SEQ ID NO: 912543 - DNA, 22 bp, Artificial Sequence
  chemically synthesized
cccctgcgccagggaattctca

SEQ ID NO: 912544 - DNA, 22 bp, Artificial Sequence
  chemically synthesized
atttaattgtttgagaattccc

SEQ ID NO: 912545 - DNA, 22 bp, Artificial Sequence
  chemically synthesized
aattgtttgagaattccctggc

SEQ ID NO: 912546 - DNA, 22 bp, Artificial Sequence
  chemically synthesized
attgtttgagaattccctggcg

SEQ ID NO: 912547 - DNA, 22 bp, Artificial Sequence
  chemically synthesized
tttgagaattccctggcgcagg

SEQ ID NO: 912548 - DNA, 22 bp, Artificial Sequence
  chemically synthesized
gtggaagagttgcccctgcgcc

SEQ ID NO: 912549 - DNA, 22 bp, Artificial Sequence
  chemically synthesized
gagaattccctggcgcaggggc

SEQ ID NO: 912550 - DNA, 22 bp, Artificial Sequence
  chemically synthesized
agaattccctggcgcaggggca

SEQ ID NO: 912551 - DNA, 22 bp, Artificial Sequence
  chemically synthesized
ctggtggaagagttgcccctgc

SEQ ID NO: 912552 - DNA, 22 bp, Artificial Sequence
  chemically synthesized
agttactggtggaagagttgcc

SEQ ID NO: 912553 - DNA, 22 bp, Artificial Sequence
  chemically synthesized
cctggcgcaggggcaactcttc

SEQ ID NO: 912554 - DNA, 22 bp, Artificial Sequence
  chemically synthesized
cagttactggtggaagagttgc

SEQ ID NO: 912555 - DNA, 22 bp, Artificial Sequence
  chemically synthesized
tttcagttactggtggaagagt

SEQ ID NO: 912556 - DNA, 22 bp, Artificial Sequence
  chemically synthesized
gcgcaggggcaactcttccacc

SEQ ID NO: 912557 - DNA, 22 bp, Artificial Sequence
  chemically synthesized
tctgtttcagttactggtggaa

SEQ ID NO: 912558 - DNA, 22 bp, Artificial Sequence
  chemically synthesized
gtctgtttcagttactggtgga

SEQ ID NO: 912559 - DNA, 22 bp, Artificial Sequence
  chemically synthesized
catttgtctgtttcagttactg

SEQ ID NO: 912560 - DNA, 22 bp, Artificial Sequence
  chemically synthesized
ttgcatttgtctgtttcagtta

SEQ ID NO: 912561 - DNA, 22 bp, Artificial Sequence
  chemically synthesized
ttccaccagtaactgaaacaga

SEQ ID NO: 912562 - DNA, 22 bp, Artificial Sequence
  chemically synthesized
ccaccagtaactgaaacagaca

SEQ ID NO: 912563 - DNA, 22 bp, Artificial Sequence
  chemically synthesized
caccagtaactgaaacagacaa

SEQ ID NO: 912564 - DNA, 22 bp, Artificial Sequence
  chemically synthesized
aacgttgttgcatttgtctgtt

SEQ ID NO: 912565 - DNA, 22 bp, Artificial Sequence
  chemically synthesized
aaacgttgttgcatttgtctgt

SEQ ID NO: 912566 - DNA, 22 bp, Artificial Sequence
  chemically synthesized
taaacgttgttgcatttgtctg

SEQ ID NO: 912567 - DNA, 22 bp, Artificial Sequence
  chemically synthesized
attttaaacgttgttgcatttg

SEQ ID NO: 912568 - DNA, 22 bp, Artificial Sequence
  chemically synthesized
aaacagacaaatgcaacaacgt

SEQ ID NO: 912569 - DNA, 22 bp, Artificial Sequence
  chemically synthesized
taattcattttaaacgttgttg

SEQ ID NO: 912570 - DNA, 22 bp, Artificial Sequence
  chemically synthesized
tgctgtaattcattttaaacgt

SEQ ID NO: 912571 - DNA, 22 bp, Artificial Sequence
  chemically synthesized
gaattgtgctgtaattcatttt

SEQ ID NO: 912572 - DNA, 22 bp, Artificial Sequence
  chemically synthesized
aaaatgaattacagcacaattc

SEQ ID NO: 912573 - DNA, 22 bp, Artificial Sequence
  chemically synthesized
aaatgaattacagcacaattcc

SEQ ID NO: 912574 - DNA, 22 bp, Artificial Sequence
  chemically synthesized
cagcacaattccaactaccttg

SEQ ID NO: 912575 - DNA, 22 bp, Artificial Sequence
  chemically synthesized
atcaatagaagcaaagacaagg

SEQ ID NO: 912576 - DNA, 22 bp, Artificial Sequence
  chemically synthesized
caactaccttgtctttgcttct

SEQ ID NO: 912577 - DNA, 22 bp, Artificial Sequence
  chemically synthesized
atagactaatcaatagaagcaa

SEQ ID NO: 912578 - DNA, 22 bp, Artificial Sequence
  chemically synthesized
gatagactaatcaatagaagca

SEQ ID NO: 912579 - DNA, 22 bp, Artificial Sequence
  chemically synthesized
tgatagactaatcaatagaagc

SEQ ID NO: 912580 - DNA, 22 bp, Artificial Sequence
  chemically synthesized
ccttgtctttgcttctattgat

SEQ ID NO: 912581 - DNA, 22 bp, Artificial Sequence
  chemically synthesized
attttgatagactaatcaatag

SEQ ID NO: 912582 - DNA, 22 bp, Artificial Sequence
  chemically synthesized
cattttgatagactaatcaata

SEQ ID NO: 912583 - DNA, 22 bp, Artificial Sequence
  chemically synthesized
gtctttgcttctattgattagt

SEQ ID NO: 912584 - DNA, 22 bp, Artificial Sequence
  chemically synthesized
tctttgcttctattgattagtc

SEQ ID NO: 912585 - DNA, 22 bp, Artificial Sequence
  chemically synthesized
tgcttctattgattagtctatc

SEQ ID NO: 912586 - DNA, 22 bp, Artificial Sequence
  chemically synthesized
gcttctattgattagtctatca

SEQ ID NO: 912587 - DNA, 22 bp, Artificial Sequence
  chemically synthesized
cttctattgattagtctatcaa

SEQ ID NO: 912588 - DNA, 22 bp, Artificial Sequence
  chemically synthesized
ctattgattagtctatcaaaat

SEQ ID NO: 912589 - DNA, 22 bp, Artificial Sequence
  chemically synthesized
tattgattagtctatcaaaatg

SEQ ID NO: 912590 - DNA, 22 bp, Artificial Sequence
  chemically synthesized
ggtcaagtcgcttcattttgat

SEQ ID NO: 912591 - DNA, 22 bp, Artificial Sequence
  chemically synthesized
ttgattagtctatcaaaatgaa

SEQ ID NO: 912592 - DNA, 22 bp, Artificial Sequence
  chemically synthesized
attagtctatcaaaatgaagcg

SEQ ID NO: 912593 - DNA, 22 bp, Artificial Sequence
  chemically synthesized
ggccctcggtcaagtcgcttca

SEQ ID NO: 912594 - DNA, 22 bp, Artificial Sequence
  chemically synthesized
gtctatcaaaatgaagcgactt

SEQ ID NO: 912595 - DNA, 22 bp, Artificial Sequence
  chemically synthesized
tcaaaatgaagcgacttgaccg

SEQ ID NO: 912596 - DNA, 22 bp, Artificial Sequence
  chemically synthesized
aggtaccactgggccctcggtc

SEQ ID NO: 912597 - DNA, 22 bp, Artificial Sequence
  chemically synthesized
gaggtaccactgggccctcggt

SEQ ID NO: 912598 - DNA, 22 bp, Artificial Sequence
  chemically synthesized
gtatttgaggtaccactgggcc

SEQ ID NO: 912599 - DNA, 22 bp, Artificial Sequence
  chemically synthesized
ttggtatttgaggtaccactgg

SEQ ID NO: 912600 - DNA, 22 bp, Artificial Sequence
  chemically synthesized
gaccgagggcccagtggtacct

SEQ ID NO: 912601 - DNA, 22 bp, Artificial Sequence
  chemically synthesized
accgagggcccagtggtacctc

SEQ ID NO: 912602 - DNA, 22 bp, Artificial Sequence
  chemically synthesized
agatagaaaactgttggtattt

SEQ ID NO: 912603 - DNA, 22 bp, Artificial Sequence
  chemically synthesized
tgctcagatagaaaactgttgg

SEQ ID NO: 912604 - DNA, 22 bp, Artificial Sequence
  chemically synthesized
tgtgctcagatagaaaactgtt

SEQ ID NO: 912605 - DNA, 22 bp, Artificial Sequence
  chemically synthesized
aaataccaacagttttctatct

SEQ ID NO: 912606 - DNA, 22 bp, Artificial Sequence
  chemically synthesized
agtcaatcagctctgtgctcag

SEQ ID NO: 912607 - DNA, 22 bp, Artificial Sequence
  chemically synthesized
cagtcaatcagctctgtgctca

SEQ ID NO: 912608 - DNA, 22 bp, Artificial Sequence
  chemically synthesized
tctatctgagcacagagctgat

SEQ ID NO: 912609 - DNA, 22 bp, Artificial Sequence
  chemically synthesized
ctatctgagcacagagctgatt

SEQ ID NO: 912610 - DNA, 22 bp, Artificial Sequence
  chemically synthesized
tatctgagcacagagctgattg

SEQ ID NO: 912611 - DNA, 22 bp, Artificial Sequence
  chemically synthesized
tctgagcacagagctgattgac

SEQ ID NO: 912612 - DNA, 22 bp, Artificial Sequence
  chemically synthesized
agcacagagctgattgactgaa

SEQ ID NO: 912613 - DNA, 22 bp, Artificial Sequence
  chemically synthesized
agggggtgagtgtttcagtcaa

SEQ ID NO: 912614 - DNA, 22 bp, Artificial Sequence
  chemically synthesized
ctgagggggtgagtgtttcagt

SEQ ID NO: 912615 - DNA, 22 bp, Artificial Sequence
  chemically synthesized
tctactgagggggtgagtgttt

SEQ ID NO: 912616 - DNA, 22 bp, Artificial Sequence
  chemically synthesized
atctactgagggggtgagtgtt

SEQ ID NO: 912617 - DNA, 22 bp, Artificial Sequence
  chemically synthesized
attgactgaaacactcaccccc

SEQ ID NO: 912618 - DNA, 22 bp, Artificial Sequence
  chemically synthesized
actgaaacactcaccccctcag

SEQ ID NO: 912619 - DNA, 22 bp, Artificial Sequence
  chemically synthesized
cagagatttatctactgagggg

SEQ ID NO: 912620 - DNA, 22 bp, Artificial Sequence
  chemically synthesized
aaacactcaccccctcagtaga

SEQ ID NO: 912621 - DNA, 22 bp, Artificial Sequence
  chemically synthesized
tacagagatttatctactgagg

SEQ ID NO: 912622 - DNA, 22 bp, Artificial Sequence
  chemically synthesized
ctacagagatttatctactgag

SEQ ID NO: 912623 - DNA, 22 bp, Artificial Sequence
  chemically synthesized
tctacagagatttatctactga

SEQ ID NO: 912624 - DNA, 22 bp, Artificial Sequence
  chemically synthesized
ttttctacagagatttatctac

SEQ ID NO: 912625 - DNA, 22 bp, Artificial Sequence
  chemically synthesized
attttctacagagatttatcta

SEQ ID NO: 912626 - DNA, 22 bp, Artificial Sequence
  chemically synthesized
accccctcagtagataaatctc

SEQ ID NO: 912627 - DNA, 22 bp, Artificial Sequence
  chemically synthesized
agtagataaatctctgtagaaa

SEQ ID NO: 912628 - DNA, 22 bp, Artificial Sequence
  chemically synthesized
tgagggataatataatcgttta

SEQ ID NO: 912629 - DNA, 22 bp, Artificial Sequence
  chemically synthesized
atgagggataatataatcgttt

SEQ ID NO: 912630 - DNA, 22 bp, Artificial Sequence
  chemically synthesized
tgtagaaaataaacgattatat

SEQ ID NO: 912631 - DNA, 22 bp, Artificial Sequence
  chemically synthesized
tagaaaataaacgattatatta

SEQ ID NO: 912632 - DNA, 22 bp, Artificial Sequence
  chemically synthesized
aaaaatttatgagggataatat

SEQ ID NO: 912633 - DNA, 22 bp, Artificial Sequence
  chemically synthesized
aaaaaatttatgagggataata

SEQ ID NO: 912634 - DNA, 22 bp, Artificial Sequence
  chemically synthesized
ttaaaaaatttatgagggataa

SEQ ID NO: 912635 - DNA, 22 bp, Artificial Sequence
  chemically synthesized
tcttaaaaaatttatgagggat

SEQ ID NO: 912636 - DNA, 22 bp, Artificial Sequence
  chemically synthesized
ctcttaaaaaatttatgaggga

SEQ ID NO: 912637 - DNA, 22 bp, Artificial Sequence
  chemically synthesized
tctcttaaaaaatttatgaggg

SEQ ID NO: 912638 - DNA, 22 bp, Artificial Sequence
  chemically synthesized
ttctcttaaaaaatttatgagg

SEQ ID NO: 912639 - DNA, 22 bp, Artificial Sequence
  chemically synthesized
tattatccctcataaatttttt

SEQ ID NO: 912640 - DNA, 22 bp, Artificial Sequence
  chemically synthesized
acatttttctcttaaaaaattt

SEQ ID NO: 912641 - DNA, 22 bp, Artificial Sequence
  chemically synthesized
tccctcataaattttttaagag

SEQ ID NO: 912642 - DNA, 22 bp, Artificial Sequence
  chemically synthesized
ccatctcacatttttctcttaa

SEQ ID NO: 912643 - DNA, 22 bp, Artificial Sequence
  chemically synthesized
accatctcacatttttctctta

SEQ ID NO: 912644 - DNA, 22 bp, Artificial Sequence
  chemically synthesized
taccatctcacatttttctctt

SEQ ID NO: 912645 - DNA, 22 bp, Artificial Sequence
  chemically synthesized
ataaattttttaagagaaaaat

SEQ ID NO: 912646 - DNA, 22 bp, Artificial Sequence
  chemically synthesized
ctttaccatctcacatttttct

SEQ ID NO: 912647 - DNA, 22 bp, Artificial Sequence
  chemically synthesized
tttaagagaaaaatgtgagatg

SEQ ID NO: 912648 - DNA, 22 bp, Artificial Sequence
  chemically synthesized
ttaagagaaaaatgtgagatgg

SEQ ID NO: 912649 - DNA, 22 bp, Artificial Sequence
  chemically synthesized
taagagaaaaatgtgagatggt

SEQ ID NO: 912650 - DNA, 22 bp, Artificial Sequence
  chemically synthesized
gagtgttgctttaccatctcac

SEQ ID NO: 912651 - DNA, 22 bp, Artificial Sequence
  chemically synthesized
aagagaaaaatgtgagatggta

SEQ ID NO: 912652 - DNA, 22 bp, Artificial Sequence
  chemically synthesized
ggagtgttgctttaccatctca

SEQ ID NO: 912653 - DNA, 22 bp, Artificial Sequence
  chemically synthesized
agagaaaaatgtgagatggtaa

SEQ ID NO: 912654 - DNA, 22 bp, Artificial Sequence
  chemically synthesized
tttggagtgttgctttaccatc

SEQ ID NO: 912655 - DNA, 22 bp, Artificial Sequence
  chemically synthesized
atttggagtgttgctttaccat

SEQ ID NO: 912656 - DNA, 22 bp, Artificial Sequence
  chemically synthesized
tatttggagtgttgctttacca

SEQ ID NO: 912657 - DNA, 22 bp, Artificial Sequence
  chemically synthesized
actttatttggagtgttgcttt

SEQ ID NO: 912658 - DNA, 22 bp, Artificial Sequence
  chemically synthesized
agacactaactttatttggagt

SEQ ID NO: 912659 - DNA, 22 bp, Artificial Sequence
  chemically synthesized
cagacactaactttatttggag

SEQ ID NO: 912660 - DNA, 22 bp, Artificial Sequence
  chemically synthesized
tcagacactaactttatttgga

SEQ ID NO: 912661 - DNA, 22 bp, Artificial Sequence
  chemically synthesized
caaataaagttagtgtctgaaa

SEQ ID NO: 912662 - DNA, 22 bp, Artificial Sequence
  chemically synthesized
atagagagataggttttcagac

SEQ ID NO: 912663 - DNA, 22 bp, Artificial Sequence
  chemically synthesized
tgatagagagataggttttcag

SEQ ID NO: 912664 - DNA, 22 bp, Artificial Sequence
  chemically synthesized
ctgatagagagataggttttca

SEQ ID NO: 912665 - DNA, 22 bp, Artificial Sequence
  chemically synthesized
tttctgatagagagataggttt

SEQ ID NO: 912666 - DNA, 22 bp, Artificial Sequence
  chemically synthesized
tatttctgatagagagataggt

SEQ ID NO: 912667 - DNA, 22 bp, Artificial Sequence
  chemically synthesized
gtgtctgaaaacctatctctct

SEQ ID NO: 912668 - DNA, 22 bp, Artificial Sequence
  chemically synthesized
ttctatttctgatagagagata

SEQ ID NO: 912669 - DNA, 22 bp, Artificial Sequence
  chemically synthesized
aaaacctatctctctatcagaa

SEQ ID NO: 912670 - DNA, 22 bp, Artificial Sequence
  chemically synthesized
acattgttctatttctgataga

SEQ ID NO: 912671 - DNA, 22 bp, Artificial Sequence
  chemically synthesized
ttcacattgttctatttctgat

SEQ ID NO: 912672 - DNA, 22 bp, Artificial Sequence
  chemically synthesized
gttcacattgttctatttctga

SEQ ID NO: 912673 - DNA, 22 bp, Artificial Sequence
  chemically synthesized
tctctctatcagaaatagaaca

SEQ ID NO: 912674 - DNA, 22 bp, Artificial Sequence
  chemically synthesized
tctatcagaaatagaacaatgt

SEQ ID NO: 912675 - DNA, 22 bp, Artificial Sequence
  chemically synthesized
atgaatttgttcacattgttct

SEQ ID NO: 912676 - DNA, 22 bp, Artificial Sequence
  chemically synthesized
tatcagaaatagaacaatgtga

SEQ ID NO: 912677 - DNA, 22 bp, Artificial Sequence
  chemically synthesized
tcagaaatagaacaatgtgaac

SEQ ID NO: 912678 - DNA, 22 bp, Artificial Sequence
  chemically synthesized
tgatacccaagaggctgatgaa

SEQ ID NO: 912679 - DNA, 22 bp, Artificial Sequence
  chemically synthesized
tggcatgctatgatacccaaga

SEQ ID NO: 912680 - DNA, 22 bp, Artificial Sequence
  chemically synthesized
atcagcctcttgggtatcatag

SEQ ID NO: 912681 - DNA, 22 bp, Artificial Sequence
  chemically synthesized
cggtatgctatggcatgctatg

SEQ ID NO: 912682 - DNA, 22 bp, Artificial Sequence
  chemically synthesized
ttgggtatcatagcatgccata

SEQ ID NO: 912683 - DNA, 22 bp, Artificial Sequence
  chemically synthesized
gggtatcatagcatgccatagc

SEQ ID NO: 912684 - DNA, 22 bp, Artificial Sequence
  chemically synthesized
ggtatcatagcatgccatagca

SEQ ID NO: 912685 - DNA, 22 bp, Artificial Sequence
  chemically synthesized
agcagcaagctacggtatgcta

SEQ ID NO: 912686 - DNA, 22 bp, Artificial Sequence
  chemically synthesized
tcagcagcaagctacggtatgc

SEQ ID NO: 912687 - DNA, 22 bp, Artificial Sequence
  chemically synthesized
ctcagcagcaagctacggtatg

SEQ ID NO: 912688 - DNA, 22 bp, Artificial Sequence
  chemically synthesized
agatgataatgcaatttctcag

SEQ ID NO: 912689 - DNA, 22 bp, Artificial Sequence
  chemically synthesized
aagatgataatgcaatttctca

SEQ ID NO: 912690 - DNA, 22 bp, Artificial Sequence
  chemically synthesized
ttaagatgataatgcaatttct

SEQ ID NO: 912691 - DNA, 22 bp, Artificial Sequence
  chemically synthesized
cctcttaagatgataatgcaat

SEQ ID NO: 912692 - DNA, 22 bp, Artificial Sequence
  chemically synthesized
gctgctgagaaattgcattatc

SEQ ID NO: 912693 - DNA, 22 bp, Artificial Sequence
  chemically synthesized
ctgctgagaaattgcattatca

SEQ ID NO: 912694 - DNA, 22 bp, Artificial Sequence
  chemically synthesized
ctgagaaattgcattatcatct

SEQ ID NO: 912695 - DNA, 22 bp, Artificial Sequence
  chemically synthesized
agaaattgcattatcatcttaa

SEQ ID NO: 912696 - DNA, 22 bp, Artificial Sequence
  chemically synthesized
aatgtcagttacctcttaagat

SEQ ID NO: 912697 - DNA, 22 bp, Artificial Sequence
  chemically synthesized
tcaatgtcagttacctcttaag

SEQ ID NO: 912698 - DNA, 22 bp, Artificial Sequence
  chemically synthesized
cattatcatcttaagaggtaac

SEQ ID NO: 912699 - DNA, 22 bp, Artificial Sequence
  chemically synthesized
tcatcttaagaggtaactgaca

SEQ ID NO: 912700 - DNA, 22 bp, Artificial Sequence
  chemically synthesized
agagtcaatactctcaatgtca

SEQ ID NO: 912701 - DNA, 22 bp, Artificial Sequence
  chemically synthesized
aagaggtaactgacattgagag

SEQ ID NO: 912702 - DNA, 22 bp, Artificial Sequence
  chemically synthesized
agaggtaactgacattgagagt

SEQ ID NO: 912703 - DNA, 22 bp, Artificial Sequence
  chemically synthesized
tgtatattgagagtcaatactc

SEQ ID NO: 912704 - DNA, 22 bp, Artificial Sequence
  chemically synthesized
acattgagagtattgactctca

SEQ ID NO: 912705 - DNA, 22 bp, Artificial Sequence
  chemically synthesized
gcactgtgtatattgagagtca

SEQ ID NO: 912706 - DNA, 22 bp, Artificial Sequence
  chemically synthesized
agagtattgactctcaatatac

SEQ ID NO: 912707 - DNA, 22 bp, Artificial Sequence
  chemically synthesized
gcacagtgcctggcactgtgta

SEQ ID NO: 912708 - DNA, 22 bp, Artificial Sequence
  chemically synthesized
actctcaatatacacagtgcca

SEQ ID NO: 912709 - DNA, 22 bp, Artificial Sequence
  chemically synthesized
tcaatatacacagtgccaggca

SEQ ID NO: 912710 - DNA, 22 bp, Artificial Sequence
  chemically synthesized
aatatacacagtgccaggcact

SEQ ID NO: 912711 - DNA, 22 bp, Artificial Sequence
  chemically synthesized
agataataaatgtgaaaaggtt

SEQ ID NO: 912712 - DNA, 22 bp, Artificial Sequence
  chemically synthesized
tgctaaccttttcacatttatt

SEQ ID NO: 912713 - DNA, 22 bp, Artificial Sequence
  chemically synthesized
accttttcacatttattatctt

SEQ ID NO: 912714 - DNA, 22 bp, Artificial Sequence
  chemically synthesized
ttcacatttattatcttagttt

SEQ ID NO: 912715 - DNA, 22 bp, Artificial Sequence
  chemically synthesized
taatatgaagataaactaagat

SEQ ID NO: 912716 - DNA, 22 bp, Artificial Sequence
  chemically synthesized
tcacatttattatcttagttta

SEQ ID NO: 912717 - DNA, 22 bp, Artificial Sequence
  chemically synthesized
cacatttattatcttagtttat

SEQ ID NO: 912718 - DNA, 22 bp, Artificial Sequence
  chemically synthesized
acatttattatcttagtttatc

SEQ ID NO: 912719 - DNA, 22 bp, Artificial Sequence
  chemically synthesized
ttataatatgaagataaactaa

SEQ ID NO: 912720 - DNA, 22 bp, Artificial Sequence
  chemically synthesized
attatcttagtttatcttcata

SEQ ID NO: 912721 - DNA, 22 bp, Artificial Sequence
  chemically synthesized
ttatcttagtttatcttcatat

SEQ ID NO: 912722 - DNA, 22 bp, Artificial Sequence
  chemically synthesized
atataattattataatatgaag

SEQ ID NO: 912723 - DNA, 22 bp, Artificial Sequence
  chemically synthesized
tcttagtttatcttcatattat

SEQ ID NO: 912724 - DNA, 22 bp, Artificial Sequence
  chemically synthesized
cctgatataattattataatat

SEQ ID NO: 912725 - DNA, 22 bp, Artificial Sequence
  chemically synthesized
agtttatcttcatattataata

SEQ ID NO: 912726 - DNA, 22 bp, Artificial Sequence
  chemically synthesized
gtttatcttcatattataataa

SEQ ID NO: 912727 - DNA, 22 bp, Artificial Sequence
  chemically synthesized
atcttcatattataataattat

SEQ ID NO: 912728 - DNA, 22 bp, Artificial Sequence
  chemically synthesized
gatctacctgatataattatta

SEQ ID NO: 912729 - DNA, 22 bp, Artificial Sequence
  chemically synthesized
tcttcatattataataattata

SEQ ID NO: 912730 - DNA, 22 bp, Artificial Sequence
  chemically synthesized
catattataataattatatcag

SEQ ID NO: 912731 - DNA, 22 bp, Artificial Sequence
  chemically synthesized
atattataataattatatcagg

SEQ ID NO: 912732 - DNA, 22 bp, Artificial Sequence
  chemically synthesized
taataattatatcaggtagatc

SEQ ID NO: 912733 - DNA, 22 bp, Artificial Sequence
  chemically synthesized
tatcaggtagatccaattatct

SEQ ID NO: 912734 - DNA, 22 bp, Artificial Sequence
  chemically synthesized
catataaaatgaagataattgg

SEQ ID NO: 912735 - DNA, 22 bp, Artificial Sequence
  chemically synthesized
ccatataaaatgaagataattg

SEQ ID NO: 912736 - DNA, 22 bp, Artificial Sequence
  chemically synthesized
cttccatataaaatgaagataa

SEQ ID NO: 912737 - DNA, 22 bp, Artificial Sequence
  chemically synthesized
ccttccatataaaatgaagata

SEQ ID NO: 912738 - DNA, 22 bp, Artificial Sequence
  chemically synthesized
agtttccttccatataaaatga

SEQ ID NO: 912739 - DNA, 22 bp, Artificial Sequence
  chemically synthesized
tctcagtttccttccatataaa

SEQ ID NO: 912740 - DNA, 22 bp, Artificial Sequence
  chemically synthesized
gtctcagtttccttccatataa

SEQ ID NO: 912741 - DNA, 22 bp, Artificial Sequence
  chemically synthesized
tgtctcagtttccttccatata

SEQ ID NO: 912742 - DNA, 22 bp, Artificial Sequence
  chemically synthesized
tcttcattttatatggaaggaa

SEQ ID NO: 912743 - DNA, 22 bp, Artificial Sequence
  chemically synthesized
cattttatatggaaggaaactg

SEQ ID NO: 912744 - DNA, 22 bp, Artificial Sequence
  chemically synthesized
acccctttgtctcagtttcctt

SEQ ID NO: 912745 - DNA, 22 bp, Artificial Sequence
  chemically synthesized
attttatatggaaggaaactga

SEQ ID NO: 912746 - DNA, 22 bp, Artificial Sequence
  chemically synthesized
aacccctttgtctcagtttcct

SEQ ID NO: 912747 - DNA, 22 bp, Artificial Sequence
  chemically synthesized
tatatggaaggaaactgagaca

SEQ ID NO: 912748 - DNA, 22 bp, Artificial Sequence
  chemically synthesized
atatggaaggaaactgagacaa

SEQ ID NO: 912749 - DNA, 22 bp, Artificial Sequence
  chemically synthesized
tatggaaggaaactgagacaaa

SEQ ID NO: 912750 - DNA, 22 bp, Artificial Sequence
  chemically synthesized
gtatttaacccctttgtctcag

SEQ ID NO: 912751 - DNA, 22 bp, Artificial Sequence
  chemically synthesized
ggagctggtatttaaccccttt

SEQ ID NO: 912752 - DNA, 22 bp, Artificial Sequence
  chemically synthesized
tgtcctgggagctggtatttaa

SEQ ID NO: 912753 - DNA, 22 bp, Artificial Sequence
  chemically synthesized
agacaaaggggttaaataccag

SEQ ID NO: 912754 - DNA, 22 bp, Artificial Sequence
  chemically synthesized
gtgtcctgggagctggtattta

SEQ ID NO: 912755 - DNA, 22 bp, Artificial Sequence
  chemically synthesized
gatttgtgtcctgggagctggt

SEQ ID NO: 912756 - DNA, 22 bp, Artificial Sequence
  chemically synthesized
ctagatttgtgtcctgggagct

SEQ ID NO: 912757 - DNA, 22 bp, Artificial Sequence
  chemically synthesized
gctagatttgtgtcctgggagc

SEQ ID NO: 912758 - DNA, 22 bp, Artificial Sequence
  chemically synthesized
cttgctagatttgtgtcctggg

SEQ ID NO: 912759 - DNA, 22 bp, Artificial Sequence
  chemically synthesized
aataccagctcccaggacacaa

SEQ ID NO: 912760 - DNA, 22 bp, Artificial Sequence
  chemically synthesized
ttgcttgctagatttgtgtcct

SEQ ID NO: 912761 - DNA, 22 bp, Artificial Sequence
  chemically synthesized
gttgcttgctagatttgtgtcc

SEQ ID NO: 912762 - DNA, 22 bp, Artificial Sequence
  chemically synthesized
tgttgcttgctagatttgtgtc

SEQ ID NO: 912763 - DNA, 22 bp, Artificial Sequence
  chemically synthesized
ccaggacacaaatctagcaagc

SEQ ID NO: 912764 - DNA, 22 bp, Artificial Sequence
  chemically synthesized
aaccacacctttgttgcttgct

SEQ ID NO: 912765 - DNA, 22 bp, Artificial Sequence
  chemically synthesized
gaaccacacctttgttgcttgc

SEQ ID NO: 912766 - DNA, 22 bp, Artificial Sequence
  chemically synthesized
cccaaatttgaaccacaccttt

SEQ ID NO: 912767 - DNA, 22 bp, Artificial Sequence
  chemically synthesized
gcaagcaacaaaggtgtggttc

SEQ ID NO: 912768 - DNA, 22 bp, Artificial Sequence
  chemically synthesized
cagaatgaaactacccaaattt

SEQ ID NO: 912769 - DNA, 22 bp, Artificial Sequence
  chemically synthesized
aaatttgggtagtttcattctg

SEQ ID NO: 912770 - DNA, 22 bp, Artificial Sequence
  chemically synthesized
gggtagtttcattctggagtcc

SEQ ID NO: 912771 - DNA, 22 bp, Artificial Sequence
  chemically synthesized
ggtagtttcattctggagtcct

SEQ ID NO: 912772 - DNA, 22 bp, Artificial Sequence
  chemically synthesized
cattctggagtcctcatttttt

SEQ ID NO: 912773 - DNA, 22 bp, Artificial Sequence
  chemically synthesized
gggatatgaagtaaaaaatgag

SEQ ID NO: 912774 - DNA, 22 bp, Artificial Sequence
  chemically synthesized
attctggagtcctcatttttta

SEQ ID NO: 912775 - DNA, 22 bp, Artificial Sequence
  chemically synthesized
agggatatgaagtaaaaaatga

SEQ ID NO: 912776 - DNA, 22 bp, Artificial Sequence
  chemically synthesized
tggagtcctcattttttacttc

SEQ ID NO: 912777 - DNA, 22 bp, Artificial Sequence
  chemically synthesized
gagtcctcattttttacttcat

SEQ ID NO: 912778 - DNA, 22 bp, Artificial Sequence
  chemically synthesized
gagaaatttagggatatgaagt

SEQ ID NO: 912779 - DNA, 22 bp, Artificial Sequence
  chemically synthesized
attttttacttcatatccctaa

SEQ ID NO: 912780 - DNA, 22 bp, Artificial Sequence
  chemically synthesized
tttacttcatatccctaaattt

SEQ ID NO: 912781 - DNA, 22 bp, Artificial Sequence
  chemically synthesized
ttacttcatatccctaaatttc

SEQ ID NO: 912782 - DNA, 22 bp, Artificial Sequence
  chemically synthesized
tacttcatatccctaaatttct

SEQ ID NO: 912783 - DNA, 22 bp, Artificial Sequence
  chemically synthesized
acttcatatccctaaatttctc

SEQ ID NO: 912784 - DNA, 22 bp, Artificial Sequence
  chemically synthesized
cttcatatccctaaatttctcg

SEQ ID NO: 912785 - DNA, 22 bp, Artificial Sequence
  chemically synthesized
catatccctaaatttctcgaac

SEQ ID NO: 912786 - DNA, 22 bp, Artificial Sequence
  chemically synthesized
atatccctaaatttctcgaact

SEQ ID NO: 912787 - DNA, 22 bp, Artificial Sequence
  chemically synthesized
tgtggtggtgaatgagttcgag

SEQ ID NO: 912788 - DNA, 22 bp, Artificial Sequence
  chemically synthesized
aatttctcgaactcattcacca

SEQ ID NO: 912789 - DNA, 22 bp, Artificial Sequence
  chemically synthesized
ctcgaactcattcaccaccaca

SEQ ID NO: 912790 - DNA, 22 bp, Artificial Sequence
  chemically synthesized
tcgaactcattcaccaccacat

SEQ ID NO: 912791 - DNA, 22 bp, Artificial Sequence
  chemically synthesized
gaactcattcaccaccacatag

SEQ ID NO: 912792 - DNA, 22 bp, Artificial Sequence
  chemically synthesized
ggaaagggcatacactatgtgg

SEQ ID NO: 912793 - DNA, 22 bp, Artificial Sequence
  chemically synthesized
gggaaagggcatacactatgtg

SEQ ID NO: 912794 - DNA, 22 bp, Artificial Sequence
  chemically synthesized
attcaccaccacatagtgtatg

SEQ ID NO: 912795 - DNA, 22 bp, Artificial Sequence
  chemically synthesized
accaccacatagtgtatgccct

SEQ ID NO: 912796 - DNA, 22 bp, Artificial Sequence
  chemically synthesized
gaggtcttgggaaagggcatac

SEQ ID NO: 912797 - DNA, 22 bp, Artificial Sequence
  chemically synthesized
ggaggtcttgggaaagggcata

SEQ ID NO: 912798 - DNA, 22 bp, Artificial Sequence
  chemically synthesized
tggaggtcttgggaaagggcat

SEQ ID NO: 912799 - DNA, 22 bp, Artificial Sequence
  chemically synthesized
acaccatggtgattttggaggt

SEQ ID NO: 912800 - DNA, 22 bp, Artificial Sequence
  chemically synthesized
tcccaagacctccaaaatcacc

SEQ ID NO: 912801 - DNA, 22 bp, Artificial Sequence
  chemically synthesized
cccaagacctccaaaatcacca

SEQ ID NO: 912802 - DNA, 22 bp, Artificial Sequence
  chemically synthesized
ccaagacctccaaaatcaccat

SEQ ID NO: 912803 - DNA, 22 bp, Artificial Sequence
  chemically synthesized
caaaatcaccatggtgttaaca

SEQ ID NO: 912804 - DNA, 22 bp, Artificial Sequence
  chemically synthesized
acaaaaatgaagtgttaacacc

SEQ ID NO: 912805 - DNA, 22 bp, Artificial Sequence
  chemically synthesized
gttgacaaaaatgaagtgttaa

SEQ ID NO: 912806 - DNA, 22 bp, Artificial Sequence
  chemically synthesized
agttgacaaaaatgaagtgtta

SEQ ID NO: 912807 - DNA, 22 bp, Artificial Sequence
  chemically synthesized
tagttgacaaaaatgaagtgtt

SEQ ID NO: 912808 - DNA, 22 bp, Artificial Sequence
  chemically synthesized
acacttcatttttgtcaactaa

SEQ ID NO: 912809 - DNA, 22 bp, Artificial Sequence
  chemically synthesized
tagcagacacagtaactttagt

SEQ ID NO: 912810 - DNA, 22 bp, Artificial Sequence
  chemically synthesized
catttttgtcaactaaagttac

SEQ ID NO: 912811 - DNA, 22 bp, Artificial Sequence
  chemically synthesized
atttttgtcaactaaagttact

SEQ ID NO: 912812 - DNA, 22 bp, Artificial Sequence
  chemically synthesized
ttgtcaactaaagttactgtgt

SEQ ID NO: 912813 - DNA, 22 bp, Artificial Sequence
  chemically synthesized
tgtcaactaaagttactgtgtc

SEQ ID NO: 912814 - DNA, 22 bp, Artificial Sequence
  chemically synthesized
gtcaactaaagttactgtgtct

SEQ ID NO: 912815 - DNA, 22 bp, Artificial Sequence
  chemically synthesized
tcaactaaagttactgtgtctg

SEQ ID NO: 912816 - DNA, 22 bp, Artificial Sequence
  chemically synthesized
atgggtactgtagcagacacag

SEQ ID NO: 912817 - DNA, 22 bp, Artificial Sequence
  chemically synthesized
aagttactgtgtctgctacagt

SEQ ID NO: 912818 - DNA, 22 bp, Artificial Sequence
  chemically synthesized
tatggctaatgggtactgtagc

SEQ ID NO: 912819 - DNA, 22 bp, Artificial Sequence
  chemically synthesized
ctgtgtctgctacagtacccat

SEQ ID NO: 912820 - DNA, 22 bp, Artificial Sequence
  chemically synthesized
tgtctgctacagtacccattag

SEQ ID NO: 912821 - DNA, 22 bp, Artificial Sequence
  chemically synthesized
atagcgttgtatggctaatggg

SEQ ID NO: 912822 - DNA, 22 bp, Artificial Sequence
  chemically synthesized
ctacagtacccattagccatac

SEQ ID NO: 912823 - DNA, 22 bp, Artificial Sequence
  chemically synthesized
cagtacccattagccatacaac

SEQ ID NO: 912824 - DNA, 22 bp, Artificial Sequence
  chemically synthesized
aatgttaatagcgttgtatggc

SEQ ID NO: 912825 - DNA, 22 bp, Artificial Sequence
  chemically synthesized
gaatgttaatagcgttgtatgg

SEQ ID NO: 912826 - DNA, 22 bp, Artificial Sequence
  chemically synthesized
acttgaatgttaatagcgttgt

SEQ ID NO: 912827 - DNA, 22 bp, Artificial Sequence
  chemically synthesized
attaacttgaatgttaatagcg

SEQ ID NO: 912828 - DNA, 22 bp, Artificial Sequence
  chemically synthesized
gattaacttgaatgttaatagc

SEQ ID NO: 912829 - DNA, 22 bp, Artificial Sequence
  chemically synthesized
tgattaacttgaatgttaatag

SEQ ID NO: 912830 - DNA, 22 bp, Artificial Sequence
  chemically synthesized
gccatacaacgctattaacatt

SEQ ID NO: 912831 - DNA, 22 bp, Artificial Sequence
  chemically synthesized
gtgaattttgattaacttgaat

SEQ ID NO: 912832 - DNA, 22 bp, Artificial Sequence
  chemically synthesized
agtgaattttgattaacttgaa

SEQ ID NO: 912833 - DNA, 22 bp, Artificial Sequence
  chemically synthesized
tagtgaattttgattaacttga

SEQ ID NO: 912834 - DNA, 22 bp, Artificial Sequence
  chemically synthesized
ttttagtgaattttgattaact

SEQ ID NO: 912835 - DNA, 22 bp, Artificial Sequence
  chemically synthesized
attttagtgaattttgattaac

SEQ ID NO: 912836 - DNA, 22 bp, Artificial Sequence
  chemically synthesized
ttaacattcaagttaatcaaaa

SEQ ID NO: 912837 - DNA, 22 bp, Artificial Sequence
  chemically synthesized
tattttagtgaattttgattaa

SEQ ID NO: 912838 - DNA, 22 bp, Artificial Sequence
  chemically synthesized
acattcaagttaatcaaaattc

SEQ ID NO: 912839 - DNA, 22 bp, Artificial Sequence
  chemically synthesized
agattttattttagtgaatttt

SEQ ID NO: 912840 - DNA, 22 bp, Artificial Sequence
  chemically synthesized
gagattttattttagtgaattt

SEQ ID NO: 912841 - DNA, 22 bp, Artificial Sequence
  chemically synthesized
aagttaatcaaaattcactaaa

SEQ ID NO: 912842 - DNA, 22 bp, Artificial Sequence
  chemically synthesized
atcaaaattcactaaaataaaa

SEQ ID NO: 912843 - DNA, 22 bp, Artificial Sequence
  chemically synthesized
aggaacttgagattttatttta

SEQ ID NO: 912844 - DNA, 22 bp, Artificial Sequence
  chemically synthesized
actaaaataaaatctcaagttc

SEQ ID NO: 912845 - DNA, 22 bp, Artificial Sequence
  chemically synthesized
gtcgtgtgactgaggaacttga

SEQ ID NO: 912846 - DNA, 22 bp, Artificial Sequence
  chemically synthesized
aaataaaatctcaagttcctca

SEQ ID NO: 912847 - DNA, 22 bp, Artificial Sequence
  chemically synthesized
gagagttggtcgtgtgactgag

SEQ ID NO: 912848 - DNA, 22 bp, Artificial Sequence
  chemically synthesized
aagttcctcagtcacacgacca

SEQ ID NO: 912849 - DNA, 22 bp, Artificial Sequence
  chemically synthesized
aatacctggagagttggtcgtg

SEQ ID NO: 912850 - DNA, 22 bp, Artificial Sequence
  chemically synthesized
gaatacctggagagttggtcgt

SEQ ID NO: 912851 - DNA, 22 bp, Artificial Sequence
  chemically synthesized
tgaatacctggagagttggtcg

SEQ ID NO: 912852 - DNA, 22 bp, Artificial Sequence
  chemically synthesized
ttgaatacctggagagttggtc

SEQ ID NO: 912853 - DNA, 22 bp, Artificial Sequence
  chemically synthesized
ctcagtcacacgaccaactctc

SEQ ID NO: 912854 - DNA, 22 bp, Artificial Sequence
  chemically synthesized
agtcacacgaccaactctccag

SEQ ID NO: 912855 - DNA, 22 bp, Artificial Sequence
  chemically synthesized
tgccttttgaatacctggagag

SEQ ID NO: 912856 - DNA, 22 bp, Artificial Sequence
  chemically synthesized
gtgccttttgaatacctggaga

SEQ ID NO: 912857 - DNA, 22 bp, Artificial Sequence
  chemically synthesized
tttgtgccttttgaatacctgg

SEQ ID NO: 912858 - DNA, 22 bp, Artificial Sequence
  chemically synthesized
gctatttgtgccttttgaatac

SEQ ID NO: 912859 - DNA, 22 bp, Artificial Sequence
  chemically synthesized
tccaggtattcaaaaggcacaa

SEQ ID NO: 912860 - DNA, 22 bp, Artificial Sequence
  chemically synthesized
caggtattcaaaaggcacaaat

SEQ ID NO: 912861 - DNA, 22 bp, Artificial Sequence
  chemically synthesized
taacgactagctatttgtgcct

SEQ ID NO: 912862 - DNA, 22 bp, Artificial Sequence
  chemically synthesized
gtaacgactagctatttgtgcc

SEQ ID NO: 912863 - DNA, 22 bp, Artificial Sequence
  chemically synthesized
tgtaacgactagctatttgtgc

SEQ ID NO: 912864 - DNA, 22 bp, Artificial Sequence
  chemically synthesized
ttgtaacgactagctatttgtg

SEQ ID NO: 912865 - DNA, 22 bp, Artificial Sequence
  chemically synthesized
aaaaggcacaaatagctagtcg

SEQ ID NO: 912866 - DNA, 22 bp, Artificial Sequence
  chemically synthesized
catcatccatttttgtaacgac

SEQ ID NO: 912867 - DNA, 22 bp, Artificial Sequence
  chemically synthesized
tgcatcatccatttttgtaacg

SEQ ID NO: 912868 - DNA, 22 bp, Artificial Sequence
  chemically synthesized
gtcgttacaaaaatggatgatg

SEQ ID NO: 912869 - DNA, 22 bp, Artificial Sequence
  chemically synthesized
caaaaatggatgatgcagaata

SEQ ID NO: 912870 - DNA, 22 bp, Artificial Sequence
  chemically synthesized
ccgtgatgatgaaaatattctg

SEQ ID NO: 912871 - DNA, 22 bp, Artificial Sequence
  chemically synthesized
aaatagaactcccgtgatgatg

SEQ ID NO: 912872 - DNA, 22 bp, Artificial Sequence
  chemically synthesized
caaatagaactcccgtgatgat

SEQ ID NO: 912873 - DNA, 22 bp, Artificial Sequence
  chemically synthesized
tcaaatagaactcccgtgatga

SEQ ID NO: 912874 - DNA, 22 bp, Artificial Sequence
  chemically synthesized
tcatcatcacgggagttctatt

SEQ ID NO: 912875 - DNA, 22 bp, Artificial Sequence
  chemically synthesized
catcatcacgggagttctattt

SEQ ID NO: 912876 - DNA, 22 bp, Artificial Sequence
  chemically synthesized
atcatcacgggagttctatttg

SEQ ID NO: 912877 - DNA, 22 bp, Artificial Sequence
  chemically synthesized
gatcagtgctttcaaatagaac

SEQ ID NO: 912878 - DNA, 22 bp, Artificial Sequence
  chemically synthesized
aaagaatctagatcagtgcttt

SEQ ID NO: 912879 - DNA, 22 bp, Artificial Sequence
  chemically synthesized
ctgaaagaatctagatcagtgc

SEQ ID NO: 912880 - DNA, 22 bp, Artificial Sequence
  chemically synthesized
tcctgaaagaatctagatcagt

SEQ ID NO: 912881 - DNA, 22 bp, Artificial Sequence
  chemically synthesized
tatttgaaagcactgatctaga

SEQ ID NO: 912882 - DNA, 22 bp, Artificial Sequence
  chemically synthesized
ctcctgaaagaatctagatcag

SEQ ID NO: 912883 - DNA, 22 bp, Artificial Sequence
  chemically synthesized
tctcctgaaagaatctagatca

SEQ ID NO: 912884 - DNA, 22 bp, Artificial Sequence
  chemically synthesized
tttgaaagcactgatctagatt

SEQ ID NO: 912885 - DNA, 22 bp, Artificial Sequence
  chemically synthesized
ttttctcctgaaagaatctaga

SEQ ID NO: 912886 - DNA, 22 bp, Artificial Sequence
  chemically synthesized
gaaagcactgatctagattctt

SEQ ID NO: 912887 - DNA, 22 bp, Artificial Sequence
  chemically synthesized
aaagcactgatctagattcttt

SEQ ID NO: 912888 - DNA, 22 bp, Artificial Sequence
  chemically synthesized
atctagattctttcaggagaaa

SEQ ID NO: 912889 - DNA, 22 bp, Artificial Sequence
  chemically synthesized
atatgcatgagtctattttctc

SEQ ID NO: 912890 - DNA, 22 bp, Artificial Sequence
  chemically synthesized
gattctttcaggagaaaataga

SEQ ID NO: 912891 - DNA, 22 bp, Artificial Sequence
  chemically synthesized
attaatatgcatgagtctattt

SEQ ID NO: 912892 - DNA, 22 bp, Artificial Sequence
  chemically synthesized
tttcaggagaaaatagactcat

SEQ ID NO: 912893 - DNA, 22 bp, Artificial Sequence
  chemically synthesized
ttaattaatatgcatgagtcta

SEQ ID NO: 912894 - DNA, 22 bp, Artificial Sequence
  chemically synthesized
tcaggagaaaatagactcatgc

SEQ ID NO: 912895 - DNA, 22 bp, Artificial Sequence
  chemically synthesized
attaattaatatgcatgagtct

SEQ ID NO: 912896 - DNA, 22 bp, Artificial Sequence
  chemically synthesized
caggagaaaatagactcatgca

SEQ ID NO: 912897 - DNA, 22 bp, Artificial Sequence
  chemically synthesized
aggagaaaatagactcatgcat

SEQ ID NO: 912898 - DNA, 22 bp, Artificial Sequence
  chemically synthesized
ttattaattaatatgcatgagt

SEQ ID NO: 912899 - DNA, 22 bp, Artificial Sequence
  chemically synthesized
cttattaattaatatgcatgag

SEQ ID NO: 912900 - DNA, 22 bp, Artificial Sequence
  chemically synthesized
tcttattaattaatatgcatga

SEQ ID NO: 912901 - DNA, 22 bp, Artificial Sequence
  chemically synthesized
gtggcattttcttattaattaa

SEQ ID NO: 912902 - DNA, 22 bp, Artificial Sequence
  chemically synthesized
agtggcattttcttattaatta

SEQ ID NO: 912903 - DNA, 22 bp, Artificial Sequence
  chemically synthesized
atgcatattaattaataagaaa

SEQ ID NO: 912904 - DNA, 22 bp, Artificial Sequence
  chemically synthesized
gaaacatatttagtggcatttt

SEQ ID NO: 912905 - DNA, 22 bp, Artificial Sequence
  chemically synthesized
attaataagaaaatgccactaa

SEQ ID NO: 912906 - DNA, 22 bp, Artificial Sequence
  chemically synthesized
attcgaaacatatttagtggca

SEQ ID NO: 912907 - DNA, 22 bp, Artificial Sequence
  chemically synthesized
ataagaaaatgccactaaatat

SEQ ID NO: 912908 - DNA, 22 bp, Artificial Sequence
  chemically synthesized
ataattcattcgaaacatattt

SEQ ID NO: 912909 - DNA, 22 bp, Artificial Sequence
  chemically synthesized
aatatgtttcgaatgaattatc

SEQ ID NO: 912910 - DNA, 22 bp, Artificial Sequence
  chemically synthesized
cgaatgaattatcaattatatt

SEQ ID NO: 912911 - DNA, 22 bp, Artificial Sequence
  chemically synthesized
gaatgaattatcaattatatta

SEQ ID NO: 912912 - DNA, 22 bp, Artificial Sequence
  chemically synthesized
agtgtcatatatagtaatataa

SEQ ID NO: 912913 - DNA, 22 bp, Artificial Sequence
  chemically synthesized
tcaattatattactatatatga

SEQ ID NO: 912914 - DNA, 22 bp, Artificial Sequence
  chemically synthesized
ccaaatgtattgagtgtcatat

SEQ ID NO: 912915 - DNA, 22 bp, Artificial Sequence
  chemically synthesized
cccaaatgtattgagtgtcata

SEQ ID NO: 912916 - DNA, 22 bp, Artificial Sequence
  chemically synthesized
tcccaaatgtattgagtgtcat

SEQ ID NO: 912917 - DNA, 22 bp, Artificial Sequence
  chemically synthesized
tattactatatatgacactcaa

SEQ ID NO: 912918 - DNA, 22 bp, Artificial Sequence
  chemically synthesized
tctttcccaaatgtattgagtg

SEQ ID NO: 912919 - DNA, 22 bp, Artificial Sequence
  chemically synthesized
atctttcccaaatgtattgagt

SEQ ID NO: 912920 - DNA, 22 bp, Artificial Sequence
  chemically synthesized
ctatatatgacactcaatacat

SEQ ID NO: 912921 - DNA, 22 bp, Artificial Sequence
  chemically synthesized
tatatgacactcaatacatttg

SEQ ID NO: 912922 - DNA, 22 bp, Artificial Sequence
  chemically synthesized
gaaatttatctttcccaaatgt

SEQ ID NO: 912923 - DNA, 22 bp, Artificial Sequence
  chemically synthesized
ggaaatttatctttcccaaatg

SEQ ID NO: 912924 - DNA, 22 bp, Artificial Sequence
  chemically synthesized
ttggaaatttatctttcccaaa

SEQ ID NO: 912925 - DNA, 22 bp, Artificial Sequence
  chemically synthesized
cttggaaatttatctttcccaa

SEQ ID NO: 912926 - DNA, 22 bp, Artificial Sequence
  chemically synthesized
tcttggaaatttatctttccca

SEQ ID NO: 912927 - DNA, 22 bp, Artificial Sequence
  chemically synthesized
ttcttggaaatttatctttccc

SEQ ID NO: 912928 - DNA, 22 bp, Artificial Sequence
  chemically synthesized
aatacatttgggaaagataaat

SEQ ID NO: 912929 - DNA, 22 bp, Artificial Sequence
  chemically synthesized
agtcttttcttggaaatttatc

SEQ ID NO: 912930 - DNA, 22 bp, Artificial Sequence
  chemically synthesized
gggaaagataaatttccaagaa

SEQ ID NO: 912931 - DNA, 22 bp, Artificial Sequence
  chemically synthesized
ggaaagataaatttccaagaaa

SEQ ID NO: 912932 - DNA, 22 bp, Artificial Sequence
  chemically synthesized
gaacaatgaactcagtcttttc

SEQ ID NO: 912933 - DNA, 22 bp, Artificial Sequence
  chemically synthesized
taccctagaacaatgaactcag

SEQ ID NO: 912934 - DNA, 22 bp, Artificial Sequence
  chemically synthesized
ccaagaaaagactgagttcatt

SEQ ID NO: 912935 - DNA, 22 bp, Artificial Sequence
  chemically synthesized
caagaaaagactgagttcattg

SEQ ID NO: 912936 - DNA, 22 bp, Artificial Sequence
  chemically synthesized
aagatggttataccctagaaca

SEQ ID NO: 912937 - DNA, 22 bp, Artificial Sequence
  chemically synthesized
gaagatggttataccctagaac

SEQ ID NO: 912938 - DNA, 22 bp, Artificial Sequence
  chemically synthesized
agttcattgttctagggtataa

SEQ ID NO: 912939 - DNA, 22 bp, Artificial Sequence
  chemically synthesized
attgttctagggtataaccatc

SEQ ID NO: 912940 - DNA, 22 bp, Artificial Sequence
  chemically synthesized
ttctagggtataaccatcttca

SEQ ID NO: 912941 - DNA, 22 bp, Artificial Sequence
  chemically synthesized
tagggtataaccatcttcaaat

SEQ ID NO: 912942 - DNA, 22 bp, Artificial Sequence
  chemically synthesized
gggtataaccatcttcaaatga

SEQ ID NO: 912943 - DNA, 22 bp, Artificial Sequence
  chemically synthesized
aaaaatagaaaagagtgggaat

SEQ ID NO: 912944 - DNA, 22 bp, Artificial Sequence
  chemically synthesized
caaatgattcccactcttttct

SEQ ID NO: 912945 - DNA, 22 bp, Artificial Sequence
  chemically synthesized
ggattcaaaaatagaaaagagt

SEQ ID NO: 912946 - DNA, 22 bp, Artificial Sequence
  chemically synthesized
aaatgattcccactcttttcta

SEQ ID NO: 912947 - DNA, 22 bp, Artificial Sequence
  chemically synthesized
gggattcaaaaatagaaaagag

SEQ ID NO: 912948 - DNA, 22 bp, Artificial Sequence
  chemically synthesized
ggtatttgggattcaaaaatag

SEQ ID NO: 912949 - DNA, 22 bp, Artificial Sequence
  chemically synthesized
ccactcttttctatttttgaat

SEQ ID NO: 912950 - DNA, 22 bp, Artificial Sequence
  chemically synthesized
ctaggtatttgggattcaaaaa

SEQ ID NO: 912951 - DNA, 22 bp, Artificial Sequence
  chemically synthesized
actaggtatttgggattcaaaa

SEQ ID NO: 912952 - DNA, 22 bp, Artificial Sequence
  chemically synthesized
tactaggtatttgggattcaaa

SEQ ID NO: 912953 - DNA, 22 bp, Artificial Sequence
  chemically synthesized
ttttctatttttgaatcccaaa

SEQ ID NO: 912954 - DNA, 22 bp, Artificial Sequence
  chemically synthesized
ttctatttttgaatcccaaata

SEQ ID NO: 912955 - DNA, 22 bp, Artificial Sequence
  chemically synthesized
tctatttttgaatcccaaatac

SEQ ID NO: 912956 - DNA, 22 bp, Artificial Sequence
  chemically synthesized
ctatttttgaatcccaaatacc

SEQ ID NO: 912957 - DNA, 22 bp, Artificial Sequence
  chemically synthesized
tatttttgaatcccaaatacct

SEQ ID NO: 912958 - DNA, 22 bp, Artificial Sequence
  chemically synthesized
tttttgaatcccaaatacctag

SEQ ID NO: 912959 - DNA, 22 bp, Artificial Sequence
  chemically synthesized
ttgaatcccaaatacctagtaa

SEQ ID NO: 912960 - DNA, 22 bp, Artificial Sequence
  chemically synthesized
tgaatcccaaatacctagtaaa

SEQ ID NO: 912961 - DNA, 22 bp, Artificial Sequence
  chemically synthesized
tacatccgatgttttactaggt

SEQ ID NO: 912962 - DNA, 22 bp, Artificial Sequence
  chemically synthesized
gaatcccaaatacctagtaaaa

SEQ ID NO: 912963 - DNA, 22 bp, Artificial Sequence
  chemically synthesized
aatcccaaatacctagtaaaac

SEQ ID NO: 912964 - DNA, 22 bp, Artificial Sequence
  chemically synthesized
actatacatccgatgttttact

SEQ ID NO: 912965 - DNA, 22 bp, Artificial Sequence
  chemically synthesized
gtaaaacatcggatgtatagtc

SEQ ID NO: 912966 - DNA, 22 bp, Artificial Sequence
  chemically synthesized
aataaacaaatatggagcactg

SEQ ID NO: 912967 - DNA, 22 bp, Artificial Sequence
  chemically synthesized
catatttgtttattgaattacg

SEQ ID NO: 912968 - DNA, 22 bp, Artificial Sequence
  chemically synthesized
gtttattgaattacgccatatt

SEQ ID NO: 912969 - DNA, 22 bp, Artificial Sequence
  chemically synthesized
tttattgaattacgccatattt

SEQ ID NO: 912970 - DNA, 22 bp, Artificial Sequence
  chemically synthesized
attgaattacgccatattttat

SEQ ID NO: 912971 - DNA, 22 bp, Artificial Sequence
  chemically synthesized
ttgaattacgccatattttatt

SEQ ID NO: 912972 - DNA, 22 bp, Artificial Sequence
  chemically synthesized
aattacgccatattttattttt

SEQ ID NO: 912973 - DNA, 22 bp, Artificial Sequence
  chemically synthesized
cgccatattttatttttatact

SEQ ID NO: 912974 - DNA, 22 bp, Artificial Sequence
  chemically synthesized
aacaagaaataaagtataaaaa

SEQ ID NO: 912975 - DNA, 22 bp, Artificial Sequence
  chemically synthesized
cacctgaacaagaaataaagta

SEQ ID NO: 912976 - DNA, 22 bp, Artificial Sequence
  chemically synthesized
acacctgaacaagaaataaagt

SEQ ID NO: 912977 - DNA, 22 bp, Artificial Sequence
  chemically synthesized
tatttttatactttatttcttg

SEQ ID NO: 912978 - DNA, 22 bp, Artificial Sequence
  chemically synthesized
atttttatactttatttcttgt

SEQ ID NO: 912979 - DNA, 22 bp, Artificial Sequence
  chemically synthesized
tttttatactttatttcttgtt

SEQ ID NO: 912980 - DNA, 22 bp, Artificial Sequence
  chemically synthesized
ttatactttatttcttgttcag

SEQ ID NO: 912981 - DNA, 22 bp, Artificial Sequence
  chemically synthesized
tatactttatttcttgttcagg

SEQ ID NO: 912982 - DNA, 22 bp, Artificial Sequence
  chemically synthesized
atactttatttcttgttcaggt

SEQ ID NO: 912983 - DNA, 22 bp, Artificial Sequence
  chemically synthesized
tactttatttcttgttcaggtg

SEQ ID NO: 912984 - DNA, 22 bp, Artificial Sequence
  chemically synthesized
tgaaacaagaggtttacacctg

SEQ ID NO: 912985 - DNA, 22 bp, Artificial Sequence
  chemically synthesized
tatttcttgttcaggtgtaaac

SEQ ID NO: 912986 - DNA, 22 bp, Artificial Sequence
  chemically synthesized
atttcttgttcaggtgtaaacc

SEQ ID NO: 912987 - DNA, 22 bp, Artificial Sequence
  chemically synthesized
tgtgaaacaagaggtttacacc

SEQ ID NO: 912988 - DNA, 22 bp, Artificial Sequence
  chemically synthesized
tttcttgttcaggtgtaaacct

SEQ ID NO: 912989 - DNA, 22 bp, Artificial Sequence
  chemically synthesized
ctgtgaaacaagaggtttacac

SEQ ID NO: 912990 - DNA, 22 bp, Artificial Sequence
  chemically synthesized
cttgttcaggtgtaaacctctt

SEQ ID NO: 912991 - DNA, 22 bp, Artificial Sequence
  chemically synthesized
tttctgtgaaacaagaggttta

SEQ ID NO: 912992 - DNA, 22 bp, Artificial Sequence
  chemically synthesized
ttgttcaggtgtaaacctcttg

SEQ ID NO: 912993 - DNA, 22 bp, Artificial Sequence
  chemically synthesized
atttctgtgaaacaagaggttt

SEQ ID NO: 912994 - DNA, 22 bp, Artificial Sequence
  chemically synthesized
gttcaggtgtaaacctcttgtt

SEQ ID NO: 912995 - DNA, 22 bp, Artificial Sequence
  chemically synthesized
ttcaggtgtaaacctcttgttt

SEQ ID NO: 912996 - DNA, 22 bp, Artificial Sequence
  chemically synthesized
aggtgtaaacctcttgtttcac

SEQ ID NO: 912997 - DNA, 22 bp, Artificial Sequence
  chemically synthesized
ttgtttcacagaaataaacgtt

SEQ ID NO: 912998 - DNA, 22 bp, Artificial Sequence
  chemically synthesized
gagtccaatgtcaaacgtttat

SEQ ID NO: 912999 - DNA, 22 bp, Artificial Sequence
  chemically synthesized
gtttcacagaaataaacgtttg

SEQ ID NO: 913000 - DNA, 22 bp, Artificial Sequence
  chemically synthesized
tttcacagaaataaacgtttga

SEQ ID NO: 913001 - DNA, 22 bp, Artificial Sequence
  chemically synthesized
cacagaaataaacgtttgacat

SEQ ID NO: 913002 - DNA, 22 bp, Artificial Sequence
  chemically synthesized
acagaaataaacgtttgacatt

SEQ ID NO: 913003 - DNA, 22 bp, Artificial Sequence
  chemically synthesized
cacatgtaaattagagtccaat

SEQ ID NO: 913004 - DNA, 22 bp, Artificial Sequence
  chemically synthesized
acacatgtaaattagagtccaa

SEQ ID NO: 913005 - DNA, 22 bp, Artificial Sequence
  chemically synthesized
tacacatgtaaattagagtcca

SEQ ID NO: 913006 - DNA, 22 bp, Artificial Sequence
  chemically synthesized
gacattggactctaatttacat

SEQ ID NO: 913007 - DNA, 22 bp, Artificial Sequence
  chemically synthesized
acattggactctaatttacatg

SEQ ID NO: 913008 - DNA, 22 bp, Artificial Sequence
  chemically synthesized
aggtgctttacacatgtaaatt

SEQ ID NO: 913009 - DNA, 22 bp, Artificial Sequence
  chemically synthesized
gactctaatttacatgtgtaaa

SEQ ID NO: 913010 - DNA, 22 bp, Artificial Sequence
  chemically synthesized
tcaatgattcaggtgctttaca

SEQ ID NO: 913011 - DNA, 22 bp, Artificial Sequence
  chemically synthesized
taatttacatgtgtaaagcacc

SEQ ID NO: 913012 - DNA, 22 bp, Artificial Sequence
  chemically synthesized
atcaatgattcaggtgctttac

SEQ ID NO: 913013 - DNA, 22 bp, Artificial Sequence
  chemically synthesized
tatcaatgattcaggtgcttta

SEQ ID NO: 913014 - DNA, 22 bp, Artificial Sequence
  chemically synthesized
atttacatgtgtaaagcacctg

SEQ ID NO: 913015 - DNA, 22 bp, Artificial Sequence
  chemically synthesized
acatgtgtaaagcacctgaatc

SEQ ID NO: 913016 - DNA, 22 bp, Artificial Sequence
  chemically synthesized
catgtgtaaagcacctgaatca

SEQ ID NO: 913017 - DNA, 22 bp, Artificial Sequence
  chemically synthesized
gtcctttatcaatgattcaggt

SEQ ID NO: 913018 - DNA, 22 bp, Artificial Sequence
  chemically synthesized
aatcattgataaaggaccaatt

SEQ ID NO: 913019 - DNA, 22 bp, Artificial Sequence
  chemically synthesized
ataaaggaccaatttcatttcc

SEQ ID NO: 913020 - DNA, 22 bp, Artificial Sequence
  chemically synthesized
cacggtcacataatcaaaggga

SEQ ID NO: 913021 - DNA, 22 bp, Artificial Sequence
  chemically synthesized
acacggtcacataatcaaaggg

SEQ ID NO: 913022 - DNA, 22 bp, Artificial Sequence
  chemically synthesized
tacacggtcacataatcaaagg

SEQ ID NO: 913023 - DNA, 22 bp, Artificial Sequence
  chemically synthesized
attttacacggtcacataatca

SEQ ID NO: 913024 - DNA, 22 bp, Artificial Sequence
  chemically synthesized
catttccctttgattatgtgac

SEQ ID NO: 913025 - DNA, 22 bp, Artificial Sequence
  chemically synthesized
atttccctttgattatgtgacc

SEQ ID NO: 913026 - DNA, 22 bp, Artificial Sequence
  chemically synthesized
tcctcattttacacggtcacat

SEQ ID NO: 913027 - DNA, 22 bp, Artificial Sequence
  chemically synthesized
ccctttgattatgtgaccgtgt

SEQ ID NO: 913028 - DNA, 22 bp, Artificial Sequence
  chemically synthesized
cctttgattatgtgaccgtgta

SEQ ID NO: 913029 - DNA, 22 bp, Artificial Sequence
  chemically synthesized
ttatcctcattttacacggtca

SEQ ID NO: 913030 - DNA, 22 bp, Artificial Sequence
  chemically synthesized
ctattatcctcattttacacgg

SEQ ID NO: 913031 - DNA, 22 bp, Artificial Sequence
  chemically synthesized
tgattatgtgaccgtgtaaaat

SEQ ID NO: 913032 - DNA, 22 bp, Artificial Sequence
  chemically synthesized
gattatgtgaccgtgtaaaatg

SEQ ID NO: 913033 - DNA, 22 bp, Artificial Sequence
  chemically synthesized
attatgtgaccgtgtaaaatga

SEQ ID NO: 913034 - DNA, 22 bp, Artificial Sequence
  chemically synthesized
tgtgaccgtgtaaaatgaggat

SEQ ID NO: 913035 - DNA, 22 bp, Artificial Sequence
  chemically synthesized
acaatggttgctattatcctca

SEQ ID NO: 913036 - DNA, 22 bp, Artificial Sequence
  chemically synthesized
gacaatggttgctattatcctc

SEQ ID NO: 913037 - DNA, 22 bp, Artificial Sequence
  chemically synthesized
tgacaatggttgctattatcct

SEQ ID NO: 913038 - DNA, 22 bp, Artificial Sequence
  chemically synthesized
atatcagattttgacaatggtt

SEQ ID NO: 913039 - DNA, 22 bp, Artificial Sequence
  chemically synthesized
catatcagattttgacaatggt

SEQ ID NO: 913040 - DNA, 22 bp, Artificial Sequence
  chemically synthesized
atcttcatatcagattttgaca

SEQ ID NO: 913041 - DNA, 22 bp, Artificial Sequence
  chemically synthesized
aatcttcatatcagattttgac

SEQ ID NO: 913042 - DNA, 22 bp, Artificial Sequence
  chemically synthesized
tttaatcttcatatcagatttt

SEQ ID NO: 913043 - DNA, 22 bp, Artificial Sequence
  chemically synthesized
atttaatcttcatatcagattt

SEQ ID NO: 913044 - DNA, 22 bp, Artificial Sequence
  chemically synthesized
tatttaatcttcatatcagatt

SEQ ID NO: 913045 - DNA, 22 bp, Artificial Sequence
  chemically synthesized
ttttatttaatcttcatatcag

SEQ ID NO: 913046 - DNA, 22 bp, Artificial Sequence
  chemically synthesized
tcaaaatctgatatgaagatta

SEQ ID NO: 913047 - DNA, 22 bp, Artificial Sequence
  chemically synthesized
cagccactattttatttaatct

SEQ ID NO: 913048 - DNA, 22 bp, Artificial Sequence
  chemically synthesized
acagccactattttatttaatc

SEQ ID NO: 913049 - DNA, 22 bp, Artificial Sequence
  chemically synthesized
atatgaagattaaataaaatag

SEQ ID NO: 913050 - DNA, 22 bp, Artificial Sequence
  chemically synthesized
gatacatttacagccactattt

SEQ ID NO: 913051 - DNA, 22 bp, Artificial Sequence
  chemically synthesized
aataaaatagtggctgtaaatg

SEQ ID NO: 913052 - DNA, 22 bp, Artificial Sequence
  chemically synthesized
tgtgccaagtattagatacatt

SEQ ID NO: 913053 - DNA, 22 bp, Artificial Sequence
  chemically synthesized
ttatgtgccaagtattagatac

SEQ ID NO: 913054 - DNA, 22 bp, Artificial Sequence
  chemically synthesized
cctgttatgtgccaagtattag

SEQ ID NO: 913055 - DNA, 22 bp, Artificial Sequence
  chemically synthesized
taaatgtatctaatacttggca

SEQ ID NO: 913056 - DNA, 22 bp, Artificial Sequence
  chemically synthesized
atcattccctgttatgtgccaa

SEQ ID NO: 913057 - DNA, 22 bp, Artificial Sequence
  chemically synthesized
aatcattccctgttatgtgcca

SEQ ID NO: 913058 - DNA, 22 bp, Artificial Sequence
  chemically synthesized
atatttaatcattccctgttat

SEQ ID NO: 913059 - DNA, 22 bp, Artificial Sequence
  chemically synthesized
atacttggcacataacagggaa

SEQ ID NO: 913060 - DNA, 22 bp, Artificial Sequence
  chemically synthesized
ggcacataacagggaatgatta

SEQ ID NO: 913061 - DNA, 22 bp, Artificial Sequence
  chemically synthesized
gcacataacagggaatgattaa

SEQ ID NO: 913062 - DNA, 22 bp, Artificial Sequence
  chemically synthesized
aatattaatttctcttcccctt

SEQ ID NO: 913063 - DNA, 22 bp, Artificial Sequence
  chemically synthesized
tcaagcagaaggtgaaagggga

SEQ ID NO: 913064 - DNA, 22 bp, Artificial Sequence
  chemically synthesized
atttctcttcccctttcacctt

SEQ ID NO: 913065 - DNA, 22 bp, Artificial Sequence
  chemically synthesized
gttgtcaagcagaaggtgaaag

SEQ ID NO: 913066 - DNA, 22 bp, Artificial Sequence
  chemically synthesized
agttgtcaagcagaaggtgaaa

SEQ ID NO: 913067 - DNA, 22 bp, Artificial Sequence
  chemically synthesized
tagttgtcaagcagaaggtgaa

SEQ ID NO: 913068 - DNA, 22 bp, Artificial Sequence
  chemically synthesized
ctcttcccctttcaccttctgc

SEQ ID NO: 913069 - DNA, 22 bp, Artificial Sequence
  chemically synthesized
tcttcccctttcaccttctgct

SEQ ID NO: 913070 - DNA, 22 bp, Artificial Sequence
  chemically synthesized
attttagttgtcaagcagaagg

SEQ ID NO: 913071 - DNA, 22 bp, Artificial Sequence
  chemically synthesized
ttcccctttcaccttctgcttg

SEQ ID NO: 913072 - DNA, 22 bp, Artificial Sequence
  chemically synthesized
cattttagttgtcaagcagaag

SEQ ID NO: 913073 - DNA, 22 bp, Artificial Sequence
  chemically synthesized
cccctttcaccttctgcttgac

SEQ ID NO: 913074 - DNA, 22 bp, Artificial Sequence
  chemically synthesized
ccctttcaccttctgcttgaca

SEQ ID NO: 913075 - DNA, 22 bp, Artificial Sequence
  chemically synthesized
tttcattttagttgtcaagcag

SEQ ID NO: 913076 - DNA, 22 bp, Artificial Sequence
  chemically synthesized
tcaccttctgcttgacaactaa

SEQ ID NO: 913077 - DNA, 22 bp, Artificial Sequence
  chemically synthesized
caccttctgcttgacaactaaa

SEQ ID NO: 913078 - DNA, 22 bp, Artificial Sequence
  chemically synthesized
gatctatttcattttagttgtc

SEQ ID NO: 913079 - DNA, 22 bp, Artificial Sequence
  chemically synthesized
accttctgcttgacaactaaaa

SEQ ID NO: 913080 - DNA, 22 bp, Artificial Sequence
  chemically synthesized
ggatctatttcattttagttgt

SEQ ID NO: 913081 - DNA, 22 bp, Artificial Sequence
  chemically synthesized
tggatctatttcattttagttg

SEQ ID NO: 913082 - DNA, 22 bp, Artificial Sequence
  chemically synthesized
ttggatctatttcattttagtt

SEQ ID NO: 913083 - DNA, 22 bp, Artificial Sequence
  chemically synthesized
ttttggatctatttcattttag

SEQ ID NO: 913084 - DNA, 22 bp, Artificial Sequence
  chemically synthesized
ctgcttgacaactaaaatgaaa

SEQ ID NO: 913085 - DNA, 22 bp, Artificial Sequence
  chemically synthesized
tgcttgacaactaaaatgaaat

SEQ ID NO: 913086 - DNA, 22 bp, Artificial Sequence
  chemically synthesized
cttgacaactaaaatgaaatag

SEQ ID NO: 913087 - DNA, 22 bp, Artificial Sequence
  chemically synthesized
gacaactaaaatgaaatagatc

SEQ ID NO: 913088 - DNA, 22 bp, Artificial Sequence
  chemically synthesized
acaactaaaatgaaatagatcc

SEQ ID NO: 913089 - DNA, 22 bp, Artificial Sequence
  chemically synthesized
ggaaagcagctcttttggatct

SEQ ID NO: 913090 - DNA, 22 bp, Artificial Sequence
  chemically synthesized
aggaaagcagctcttttggatc

SEQ ID NO: 913091 - DNA, 22 bp, Artificial Sequence
  chemically synthesized
taggaaagcagctcttttggat

SEQ ID NO: 913092 - DNA, 22 bp, Artificial Sequence
  chemically synthesized
aaatgaaatagatccaaaagag

SEQ ID NO: 913093 - DNA, 22 bp, Artificial Sequence
  chemically synthesized
gttttaggaaagcagctctttt

SEQ ID NO: 913094 - DNA, 22 bp, Artificial Sequence
  chemically synthesized
agttttaggaaagcagctcttt

SEQ ID NO: 913095 - DNA, 22 bp, Artificial Sequence
  chemically synthesized
tagttttaggaaagcagctctt

SEQ ID NO: 913096 - DNA, 22 bp, Artificial Sequence
  chemically synthesized
atggttttagttttaggaaagc

SEQ ID NO: 913097 - DNA, 22 bp, Artificial Sequence
  chemically synthesized
catggttttagttttaggaaag

SEQ ID NO: 913098 - DNA, 22 bp, Artificial Sequence
  chemically synthesized
tcatggttttagttttaggaaa

SEQ ID NO: 913099 - DNA, 22 bp, Artificial Sequence
  chemically synthesized
actttcatggttttagttttag

SEQ ID NO: 913100 - DNA, 22 bp, Artificial Sequence
  chemically synthesized
gattaactttcatggttttagt

SEQ ID NO: 913101 - DNA, 22 bp, Artificial Sequence
  chemically synthesized
ctttcctaaaactaaaaccatg

SEQ ID NO: 913102 - DNA, 22 bp, Artificial Sequence
  chemically synthesized
tcctaaaactaaaaccatgaaa

SEQ ID NO: 913103 - DNA, 22 bp, Artificial Sequence
  chemically synthesized
cctaaaactaaaaccatgaaag

SEQ ID NO: 913104 - DNA, 22 bp, Artificial Sequence
  chemically synthesized
ctaaaactaaaaccatgaaagt

SEQ ID NO: 913105 - DNA, 22 bp, Artificial Sequence
  chemically synthesized
tgcaattggattaactttcatg

SEQ ID NO: 913106 - DNA, 22 bp, Artificial Sequence
  chemically synthesized
aaactaaaaccatgaaagttaa

SEQ ID NO: 913107 - DNA, 22 bp, Artificial Sequence
  chemically synthesized
attgtgcaattggattaacttt

SEQ ID NO: 913108 - DNA, 22 bp, Artificial Sequence
  chemically synthesized
tgattgtgcaattggattaact

SEQ ID NO: 913109 - DNA, 22 bp, Artificial Sequence
  chemically synthesized
aaaccatgaaagttaatccaat

SEQ ID NO: 913110 - DNA, 22 bp, Artificial Sequence
  chemically synthesized
acatgctctgattgtgcaattg

SEQ ID NO: 913111 - DNA, 22 bp, Artificial Sequence
  chemically synthesized
actgacatgctctgattgtgca

SEQ ID NO: 913112 - DNA, 22 bp, Artificial Sequence
  chemically synthesized
gctgactgacatgctctgattg

SEQ ID NO: 913113 - DNA, 22 bp, Artificial Sequence
  chemically synthesized
atccaattgcacaatcagagca

SEQ ID NO: 913114 - DNA, 22 bp, Artificial Sequence
  chemically synthesized
ggctgactgacatgctctgatt

SEQ ID NO: 913115 - DNA, 22 bp, Artificial Sequence
  chemically synthesized
ccttggctgactgacatgctct

SEQ ID NO: 913116 - DNA, 22 bp, Artificial Sequence
  chemically synthesized
cccttggctgactgacatgctc

SEQ ID NO: 913117 - DNA, 22 bp, Artificial Sequence
  chemically synthesized
cttcccttggctgactgacatg

SEQ ID NO: 913118 - DNA, 22 bp, Artificial Sequence
  chemically synthesized
cacaatcagagcatgtcagtca

SEQ ID NO: 913119 - DNA, 22 bp, Artificial Sequence
  chemically synthesized
attacttcccttggctgactga

SEQ ID NO: 913120 - DNA, 22 bp, Artificial Sequence
  chemically synthesized
ctgattacttcccttggctgac

SEQ ID NO: 913121 - DNA, 22 bp, Artificial Sequence
  chemically synthesized
ttactgattacttcccttggct

SEQ ID NO: 913122 - DNA, 22 bp, Artificial Sequence
  chemically synthesized
attactgattacttcccttggc

SEQ ID NO: 913123 - DNA, 22 bp, Artificial Sequence
  chemically synthesized
cttattactgattacttccctt

SEQ ID NO: 913124 - DNA, 22 bp, Artificial Sequence
  chemically synthesized
tgatgtctgcttattactgatt

SEQ ID NO: 913125 - DNA, 22 bp, Artificial Sequence
  chemically synthesized
ctgtgatgtctgcttattactg

SEQ ID NO: 913126 - DNA, 22 bp, Artificial Sequence
  chemically synthesized
ataccgtcctactgtgatgtct

SEQ ID NO: 913127 - DNA, 22 bp, Artificial Sequence
  chemically synthesized
cataccgtcctactgtgatgtc

SEQ ID NO: 913128 - DNA, 22 bp, Artificial Sequence
  chemically synthesized
tcataccgtcctactgtgatgt

SEQ ID NO: 913129 - DNA, 22 bp, Artificial Sequence
  chemically synthesized
ttcataccgtcctactgtgatg

SEQ ID NO: 913130 - DNA, 22 bp, Artificial Sequence
  chemically synthesized
cagtggcttttcataccgtcct

SEQ ID NO: 913131 - DNA, 22 bp, Artificial Sequence
  chemically synthesized
ttccagtggcttttcataccgt

SEQ ID NO: 913132 - DNA, 22 bp, Artificial Sequence
  chemically synthesized
attccagtggcttttcataccg

SEQ ID NO: 913133 - DNA, 22 bp, Artificial Sequence
  chemically synthesized
aatagacatccagcttattcca

SEQ ID NO: 913134 - DNA, 22 bp, Artificial Sequence
  chemically synthesized
gttgaatagacatccagcttat

SEQ ID NO: 913135 - DNA, 22 bp, Artificial Sequence
  chemically synthesized
ggttgaatagacatccagctta

SEQ ID NO: 913136 - DNA, 22 bp, Artificial Sequence
  chemically synthesized
catttggttgaatagacatcca

SEQ ID NO: 913137 - DNA, 22 bp, Artificial Sequence
  chemically synthesized
gaataagctggatgtctattca

SEQ ID NO: 913138 - DNA, 22 bp, Artificial Sequence
  chemically synthesized
acattccatttggttgaataga

SEQ ID NO: 913139 - DNA, 22 bp, Artificial Sequence
  chemically synthesized
gttcacattccatttggttgaa

SEQ ID NO: 913140 - DNA, 22 bp, Artificial Sequence
  chemically synthesized
gatgtctattcaaccaaatgga

SEQ ID NO: 913141 - DNA, 22 bp, Artificial Sequence
  chemically synthesized
ttcaaccaaatggaatgtgaac

SEQ ID NO: 913142 - DNA, 22 bp, Artificial Sequence
  chemically synthesized
aaccaaatggaatgtgaaccaa

SEQ ID NO: 913143 - DNA, 22 bp, Artificial Sequence
  chemically synthesized
ggggtgtgggacgtggtgttgg

SEQ ID NO: 913144 - DNA, 22 bp, Artificial Sequence
  chemically synthesized
tctgggggtgtgggacgtggtg

SEQ ID NO: 913145 - DNA, 22 bp, Artificial Sequence
  chemically synthesized
gtctgggggtgtgggacgtggt

SEQ ID NO: 913146 - DNA, 22 bp, Artificial Sequence
  chemically synthesized
atttgtctgggggtgtgggacg

SEQ ID NO: 913147 - DNA, 22 bp, Artificial Sequence
  chemically synthesized
gctgatttgtctgggggtgtgg

SEQ ID NO: 913148 - DNA, 22 bp, Artificial Sequence
  chemically synthesized
agctgatttgtctgggggtgtg

SEQ ID NO: 913149 - DNA, 22 bp, Artificial Sequence
  chemically synthesized
tagctgatttgtctgggggtgt

SEQ ID NO: 913150 - DNA, 22 bp, Artificial Sequence
  chemically synthesized
ttttagctgatttgtctggggg

SEQ ID NO: 913151 - DNA, 22 bp, Artificial Sequence
  chemically synthesized
gttttagctgatttgtctgggg

SEQ ID NO: 913152 - DNA, 22 bp, Artificial Sequence
  chemically synthesized
tgttttagctgatttgtctggg

SEQ ID NO: 913153 - DNA, 22 bp, Artificial Sequence
  chemically synthesized
ccccgaagcaatgttttgtttt

SEQ ID NO: 913154 - DNA, 22 bp, Artificial Sequence
  chemically synthesized
tattcccccgaagcaatgtttt

SEQ ID NO: 913155 - DNA, 22 bp, Artificial Sequence
  chemically synthesized
aaacaaaacattgcttcggggg

SEQ ID NO: 913156 - DNA, 22 bp, Artificial Sequence
  chemically synthesized
aaggcattatattcccccgaag

SEQ ID NO: 913157 - DNA, 22 bp, Artificial Sequence
  chemically synthesized
aaaggcattatattcccccgaa

SEQ ID NO: 913158 - DNA, 22 bp, Artificial Sequence
  chemically synthesized
cttaaaggcattatattccccc

SEQ ID NO: 913159 - DNA, 22 bp, Artificial Sequence
  chemically synthesized
tacttaaaggcattatattccc

SEQ ID NO: 913160 - DNA, 22 bp, Artificial Sequence
  chemically synthesized
cttcgggggaatataatgcctt

SEQ ID NO: 913161 - DNA, 22 bp, Artificial Sequence
  chemically synthesized
agcctctacttaaaggcattat

SEQ ID NO: 913162 - DNA, 22 bp, Artificial Sequence
  chemically synthesized
cagcctctacttaaaggcatta

SEQ ID NO: 913163 - DNA, 22 bp, Artificial Sequence
  chemically synthesized
cgggggaatataatgcctttaa

SEQ ID NO: 913164 - DNA, 22 bp, Artificial Sequence
  chemically synthesized
gggggaatataatgcctttaag

SEQ ID NO: 913165 - DNA, 22 bp, Artificial Sequence
  chemically synthesized
accacttcagcctctacttaaa

SEQ ID NO: 913166 - DNA, 22 bp, Artificial Sequence
  chemically synthesized
ccagatcagtctcaccacttca

SEQ ID NO: 913167 - DNA, 22 bp, Artificial Sequence
  chemically synthesized
taagtagaggctgaagtggtga

SEQ ID NO: 913168 - DNA, 22 bp, Artificial Sequence
  chemically synthesized
aagtagaggctgaagtggtgag

SEQ ID NO: 913169 - DNA, 22 bp, Artificial Sequence
  chemically synthesized
agtagaggctgaagtggtgaga

SEQ ID NO: 913170 - DNA, 22 bp, Artificial Sequence
  chemically synthesized
gattgccagatcagtctcacca

SEQ ID NO: 913171 - DNA, 22 bp, Artificial Sequence
  chemically synthesized
aagtggtgagactgatctggca

SEQ ID NO: 913172 - DNA, 22 bp, Artificial Sequence
  chemically synthesized
gggaagatctggattgccagat

SEQ ID NO: 913173 - DNA, 22 bp, Artificial Sequence
  chemically synthesized
agggaagatctggattgccaga

SEQ ID NO: 913174 - DNA, 22 bp, Artificial Sequence
  chemically synthesized
ttagggaagatctggattgcca

SEQ ID NO: 913175 - DNA, 22 bp, Artificial Sequence
  chemically synthesized
cttagggaagatctggattgcc

SEQ ID NO: 913176 - DNA, 22 bp, Artificial Sequence
  chemically synthesized
tcttagggaagatctggattgc

SEQ ID NO: 913177 - DNA, 22 bp, Artificial Sequence
  chemically synthesized
atctggcaatccagatcttccc

SEQ ID NO: 913178 - DNA, 22 bp, Artificial Sequence
  chemically synthesized
gcaatccagatcttccctaaga

SEQ ID NO: 913179 - DNA, 22 bp, Artificial Sequence
  chemically synthesized
aaaagaagaatccattttctta

SEQ ID NO: 913180 - DNA, 22 bp, Artificial Sequence
  chemically synthesized
aaaaagaagaatccattttctt

SEQ ID NO: 913181 - DNA, 22 bp, Artificial Sequence
  chemically synthesized
taaaaagaagaatccattttct

SEQ ID NO: 913182 - DNA, 22 bp, Artificial Sequence
  chemically synthesized
ccctaagaaaatggattcttct

SEQ ID NO: 913183 - DNA, 22 bp, Artificial Sequence
  chemically synthesized
cctaagaaaatggattcttctt

SEQ ID NO: 913184 - DNA, 22 bp, Artificial Sequence
  chemically synthesized
agaagagtctttaaaaagaaga

SEQ ID NO: 913185 - DNA, 22 bp, Artificial Sequence
  chemically synthesized
agaaaatggattcttcttttta

SEQ ID NO: 913186 - DNA, 22 bp, Artificial Sequence
  chemically synthesized
gagaagagtctttaaaaagaag

SEQ ID NO: 913187 - DNA, 22 bp, Artificial Sequence
  chemically synthesized
gagatttgagaagagtctttaa

SEQ ID NO: 913188 - DNA, 22 bp, Artificial Sequence
  chemically synthesized
cctggagatttgagaagagtct

SEQ ID NO: 913189 - DNA, 22 bp, Artificial Sequence
  chemically synthesized
ttctttttaaagactcttctca

SEQ ID NO: 913190 - DNA, 22 bp, Artificial Sequence
  chemically synthesized
ctttttaaagactcttctcaaa

SEQ ID NO: 913191 - DNA, 22 bp, Artificial Sequence
  chemically synthesized
cctacctggagatttgagaaga

SEQ ID NO: 913192 - DNA, 22 bp, Artificial Sequence
  chemically synthesized
tttttaaagactcttctcaaat

SEQ ID NO: 913193 - DNA, 22 bp, Artificial Sequence
  chemically synthesized
tttaaagactcttctcaaatct

SEQ ID NO: 913194 - DNA, 22 bp, Artificial Sequence
  chemically synthesized
ttaaagactcttctcaaatctc

SEQ ID NO: 913195 - DNA, 22 bp, Artificial Sequence
  chemically synthesized
gttacctacctggagatttgag

SEQ ID NO: 913196 - DNA, 22 bp, Artificial Sequence
  chemically synthesized
taaagactcttctcaaatctcc

SEQ ID NO: 913197 - DNA, 22 bp, Artificial Sequence
  chemically synthesized
aaagactcttctcaaatctcca

SEQ ID NO: 913198 - DNA, 22 bp, Artificial Sequence
  chemically synthesized
aagactcttctcaaatctccag

SEQ ID NO: 913199 - DNA, 22 bp, Artificial Sequence
  chemically synthesized
tcctggttacctacctggagat

SEQ ID NO: 913200 - DNA, 22 bp, Artificial Sequence
  chemically synthesized
ttctcaaatctccaggtaggta

SEQ ID NO: 913201 - DNA, 22 bp, Artificial Sequence
  chemically synthesized
atctgtcctggttacctacctg

SEQ ID NO: 913202 - DNA, 22 bp, Artificial Sequence
  chemically synthesized
aatctgtcctggttacctacct

SEQ ID NO: 913203 - DNA, 22 bp, Artificial Sequence
  chemically synthesized
ctcaaatctccaggtaggtaac

SEQ ID NO: 913204 - DNA, 22 bp, Artificial Sequence
  chemically synthesized
taatctgtcctggttacctacc

SEQ ID NO: 913205 - DNA, 22 bp, Artificial Sequence
  chemically synthesized
tcaaatctccaggtaggtaacc

SEQ ID NO: 913206 - DNA, 22 bp, Artificial Sequence
  chemically synthesized
ttaatctgtcctggttacctac

SEQ ID NO: 913207 - DNA, 22 bp, Artificial Sequence
  chemically synthesized
tttaatctgtcctggttaccta

SEQ ID NO: 913208 - DNA, 22 bp, Artificial Sequence
  chemically synthesized
aaatctccaggtaggtaaccag

SEQ ID NO: 913209 - DNA, 22 bp, Artificial Sequence
  chemically synthesized
ttttaatctgtcctggttacct

SEQ ID NO: 913210 - DNA, 22 bp, Artificial Sequence
  chemically synthesized
caggtaggtaaccaggacagat

SEQ ID NO: 913211 - DNA, 22 bp, Artificial Sequence
  chemically synthesized
aatgggaatcacttttttaatc

SEQ ID NO: 913212 - DNA, 22 bp, Artificial Sequence
  chemically synthesized
aatctaaatgggaatcactttt

SEQ ID NO: 913213 - DNA, 22 bp, Artificial Sequence
  chemically synthesized
aaaaagtgattcccatttagat

SEQ ID NO: 913214 - DNA, 22 bp, Artificial Sequence
  chemically synthesized
tggaatcataaaatctaaatct

SEQ ID NO: 913215 - DNA, 22 bp, Artificial Sequence
  chemically synthesized
ccatttagatttagattttatg

SEQ ID NO: 913216 - DNA, 22 bp, Artificial Sequence
  chemically synthesized
agatttagattttatgattcca

SEQ ID NO: 913217 - DNA, 22 bp, Artificial Sequence
  chemically synthesized
aagaccagattgtggaatcata

SEQ ID NO: 913218 - DNA, 22 bp, Artificial Sequence
  chemically synthesized
gatttagattttatgattccac

SEQ ID NO: 913219 - DNA, 22 bp, Artificial Sequence
  chemically synthesized
agattttatgattccacaatct

SEQ ID NO: 913220 - DNA, 22 bp, Artificial Sequence
  chemically synthesized
gattttatgattccacaatctg

SEQ ID NO: 913221 - DNA, 22 bp, Artificial Sequence
  chemically synthesized
aaaactgaagaccagattgtgg

SEQ ID NO: 913222 - DNA, 22 bp, Artificial Sequence
  chemically synthesized
aaaaactgaagaccagattgtg

SEQ ID NO: 913223 - DNA, 22 bp, Artificial Sequence
  chemically synthesized
taaaaactgaagaccagattgt

SEQ ID NO: 913224 - DNA, 22 bp, Artificial Sequence
  chemically synthesized
tatgattccacaatctggtctt

SEQ ID NO: 913225 - DNA, 22 bp, Artificial Sequence
  chemically synthesized
atgattccacaatctggtcttc

SEQ ID NO: 913226 - DNA, 22 bp, Artificial Sequence
  chemically synthesized
tgattccacaatctggtcttca

SEQ ID NO: 913227 - DNA, 22 bp, Artificial Sequence
  chemically synthesized
atataattttaaaaactgaaga

SEQ ID NO: 913228 - DNA, 22 bp, Artificial Sequence
  chemically synthesized
catataattttaaaaactgaag

SEQ ID NO: 913229 - DNA, 22 bp, Artificial Sequence
  chemically synthesized
cacaatctggtcttcagttttt

SEQ ID NO: 913230 - DNA, 22 bp, Artificial Sequence
  chemically synthesized
acaacttcatataattttaaaa

SEQ ID NO: 913231 - DNA, 22 bp, Artificial Sequence
  chemically synthesized
cacaacttcatataattttaaa

SEQ ID NO: 913232 - DNA, 22 bp, Artificial Sequence
  chemically synthesized
gtcttcagtttttaaaattata

SEQ ID NO: 913233 - DNA, 22 bp, Artificial Sequence
  chemically synthesized
cagtttttaaaattatatgaag

SEQ ID NO: 913234 - DNA, 22 bp, Artificial Sequence
  chemically synthesized
agaacttcacaacttcatataa

SEQ ID NO: 913235 - DNA, 22 bp, Artificial Sequence
  chemically synthesized
agtttttaaaattatatgaagt

SEQ ID NO: 913236 - DNA, 22 bp, Artificial Sequence
  chemically synthesized
gagaacttcacaacttcatata

SEQ ID NO: 913237 - DNA, 22 bp, Artificial Sequence
  chemically synthesized
cttgagaacttcacaacttcat

SEQ ID NO: 913238 - DNA, 22 bp, Artificial Sequence
  chemically synthesized
acttgagaacttcacaacttca

SEQ ID NO: 913239 - DNA, 22 bp, Artificial Sequence
  chemically synthesized
ttaaaattatatgaagttgtga

SEQ ID NO: 913240 - DNA, 22 bp, Artificial Sequence
  chemically synthesized
tacttgagaacttcacaacttc

SEQ ID NO: 913241 - DNA, 22 bp, Artificial Sequence
  chemically synthesized
taaaattatatgaagttgtgaa

SEQ ID NO: 913242 - DNA, 22 bp, Artificial Sequence
  chemically synthesized
aaaattatatgaagttgtgaag

SEQ ID NO: 913243 - DNA, 22 bp, Artificial Sequence
  chemically synthesized
aaattatatgaagttgtgaagt

SEQ ID NO: 913244 - DNA, 22 bp, Artificial Sequence
  chemically synthesized
gattttacttgagaacttcaca

SEQ ID NO: 913245 - DNA, 22 bp, Artificial Sequence
  chemically synthesized
agattttacttgagaacttcac

SEQ ID NO: 913246 - DNA, 22 bp, Artificial Sequence
  chemically synthesized
tagattttacttgagaacttca

SEQ ID NO: 913247 - DNA, 22 bp, Artificial Sequence
  chemically synthesized
tatgaagttgtgaagttctcaa

SEQ ID NO: 913248 - DNA, 22 bp, Artificial Sequence
  chemically synthesized
attttagattttacttgagaac

SEQ ID NO: 913249 - DNA, 22 bp, Artificial Sequence
  chemically synthesized
aaattaattttagattttactt

SEQ ID NO: 913250 - DNA, 22 bp, Artificial Sequence
  chemically synthesized
gaaattaattttagattttact

SEQ ID NO: 913251 - DNA, 22 bp, Artificial Sequence
  chemically synthesized
tgaagttctcaagtaaaatcta

SEQ ID NO: 913252 - DNA, 22 bp, Artificial Sequence
  chemically synthesized
atttgaaattaattttagattt

SEQ ID NO: 913253 - DNA, 22 bp, Artificial Sequence
  chemically synthesized
gatttgaaattaattttagatt

SEQ ID NO: 913254 - DNA, 22 bp, Artificial Sequence
  chemically synthesized
tgatttgaaattaattttagat

SEQ ID NO: 913255 - DNA, 22 bp, Artificial Sequence
  chemically synthesized
tcaagtaaaatctaaaattaat

SEQ ID NO: 913256 - DNA, 22 bp, Artificial Sequence
  chemically synthesized
tctttgatttgaaattaatttt

SEQ ID NO: 913257 - DNA, 22 bp, Artificial Sequence
  chemically synthesized
aagtaaaatctaaaattaattt

SEQ ID NO: 913258 - DNA, 22 bp, Artificial Sequence
  chemically synthesized
atctttgatttgaaattaattt

SEQ ID NO: 913259 - DNA, 22 bp, Artificial Sequence
  chemically synthesized
tatctttgatttgaaattaatt

SEQ ID NO: 913260 - DNA, 22 bp, Artificial Sequence
  chemically synthesized
ttatctttgatttgaaattaat

SEQ ID NO: 913261 - DNA, 22 bp, Artificial Sequence
  chemically synthesized
acagtttttatctttgatttga

SEQ ID NO: 913262 - DNA, 22 bp, Artificial Sequence
  chemically synthesized
aaattaatttcaaatcaaagat

SEQ ID NO: 913263 - DNA, 22 bp, Artificial Sequence
  chemically synthesized
atttcaaatcaaagataaaaac

SEQ ID NO: 913264 - DNA, 22 bp, Artificial Sequence
  chemically synthesized
caaatcaaagataaaaactgtg

SEQ ID NO: 913265 - DNA, 22 bp, Artificial Sequence
  chemically synthesized
aaatcaaagataaaaactgtga

SEQ ID NO: 913266 - DNA, 22 bp, Artificial Sequence
  chemically synthesized
aatgtatataattcacagtttt

SEQ ID NO: 913267 - DNA, 22 bp, Artificial Sequence
  chemically synthesized
aatatgtctaaatgtatataat

SEQ ID NO: 913268 - DNA, 22 bp, Artificial Sequence
  chemically synthesized
tgaattatatacatttagacat

SEQ ID NO: 913269 - DNA, 22 bp, Artificial Sequence
  chemically synthesized
tatacatttagacatattgaat

SEQ ID NO: 913270 - DNA, 22 bp, Artificial Sequence
  chemically synthesized
cacatatagatgtatagattca

SEQ ID NO: 913271 - DNA, 22 bp, Artificial Sequence
  chemically synthesized
agacatattgaatctatacatc

SEQ ID NO: 913272 - DNA, 22 bp, Artificial Sequence
  chemically synthesized
gacatattgaatctatacatct

SEQ ID NO: 913273 - DNA, 22 bp, Artificial Sequence
  chemically synthesized
tacatctacacatatagatgta

SEQ ID NO: 913274 - DNA, 22 bp, Artificial Sequence
  chemically synthesized
aatctatacatctatatgtgta

SEQ ID NO: 913275 - DNA, 22 bp, Artificial Sequence
  chemically synthesized
catctatacatctacacatata

SEQ ID NO: 913276 - DNA, 22 bp, Artificial Sequence
  chemically synthesized
tacatctatatgtgtagatgta

SEQ ID NO: 913277 - DNA, 22 bp, Artificial Sequence
  chemically synthesized
tatgtgtagatgtatagatgca

SEQ ID NO: 913278 - DNA, 22 bp, Artificial Sequence
  chemically synthesized
tatatacacacacacatattgc

SEQ ID NO: 913279 - DNA, 22 bp, Artificial Sequence
  chemically synthesized
atatatacacacacacatattg

SEQ ID NO: 913280 - DNA, 22 bp, Artificial Sequence
  chemically synthesized
aaccagtgcacataagaacata

SEQ ID NO: 913281 - DNA, 22 bp, Artificial Sequence
  chemically synthesized
tgaaccagtgcacataagaaca

SEQ ID NO: 913282 - DNA, 22 bp, Artificial Sequence
  chemically synthesized
cagttctgaaccagtgcacata

SEQ ID NO: 913283 - DNA, 22 bp, Artificial Sequence
  chemically synthesized
accctgcagttctgaaccagtg

SEQ ID NO: 913284 - DNA, 22 bp, Artificial Sequence
  chemically synthesized
aaccctgcagttctgaaccagt

SEQ ID NO: 913285 - DNA, 22 bp, Artificial Sequence
  chemically synthesized
ttaaccctgcagttctgaacca

SEQ ID NO: 913286 - DNA, 22 bp, Artificial Sequence
  chemically synthesized
cttaaccctgcagttctgaacc

SEQ ID NO: 913287 - DNA, 22 bp, Artificial Sequence
  chemically synthesized
ttatgtgcactggttcagaact

SEQ ID NO: 913288 - DNA, 22 bp, Artificial Sequence
  chemically synthesized
ttcttaaccctgcagttctgaa

SEQ ID NO: 913289 - DNA, 22 bp, Artificial Sequence
  chemically synthesized
atgtgcactggttcagaactgc

SEQ ID NO: 913290 - DNA, 22 bp, Artificial Sequence
  chemically synthesized
cttcttaaccctgcagttctga

SEQ ID NO: 913291 - DNA, 22 bp, Artificial Sequence
  chemically synthesized
tgtgcactggttcagaactgca

SEQ ID NO: 913292 - DNA, 22 bp, Artificial Sequence
  chemically synthesized
tttcttcttaaccctgcagttc

SEQ ID NO: 913293 - DNA, 22 bp, Artificial Sequence
  chemically synthesized
atttcttcttaaccctgcagtt

SEQ ID NO: 913294 - DNA, 22 bp, Artificial Sequence
  chemically synthesized
tatttcttcttaaccctgcagt

SEQ ID NO: 913295 - DNA, 22 bp, Artificial Sequence
  chemically synthesized
gttcagaactgcagggttaaga

SEQ ID NO: 913296 - DNA, 22 bp, Artificial Sequence
  chemically synthesized
acaactttatttcttcttaacc

SEQ ID NO: 913297 - DNA, 22 bp, Artificial Sequence
  chemically synthesized
agaactgcagggttaagaagaa

SEQ ID NO: 913298 - DNA, 22 bp, Artificial Sequence
  chemically synthesized
tcacaactttatttcttcttaa

SEQ ID NO: 913299 - DNA, 22 bp, Artificial Sequence
  chemically synthesized
ctcacaactttatttcttctta

SEQ ID NO: 913300 - DNA, 22 bp, Artificial Sequence
  chemically synthesized
tctcacaactttatttcttctt

SEQ ID NO: 913301 - DNA, 22 bp, Artificial Sequence
  chemically synthesized
ttctcacaactttatttcttct

SEQ ID NO: 913302 - DNA, 22 bp, Artificial Sequence
  chemically synthesized
cagggttaagaagaaataaagt

SEQ ID NO: 913303 - DNA, 22 bp, Artificial Sequence
  chemically synthesized
aagtgtttttctcacaacttta

SEQ ID NO: 913304 - DNA, 22 bp, Artificial Sequence
  chemically synthesized
ctaaagtgtttttctcacaact

SEQ ID NO: 913305 - DNA, 22 bp, Artificial Sequence
  chemically synthesized
agaagaaataaagttgtgagaa

SEQ ID NO: 913306 - DNA, 22 bp, Artificial Sequence
  chemically synthesized
gctaaagtgtttttctcacaac

SEQ ID NO: 913307 - DNA, 22 bp, Artificial Sequence
  chemically synthesized
cttgctaaagtgtttttctcac

SEQ ID NO: 913308 - DNA, 22 bp, Artificial Sequence
  chemically synthesized
atagttccttgctaaagtgttt

SEQ ID NO: 913309 - DNA, 22 bp, Artificial Sequence
  chemically synthesized
ttcatagttccttgctaaagtg

SEQ ID NO: 913310 - DNA, 22 bp, Artificial Sequence
  chemically synthesized
tgagaaaaacactttagcaagg

SEQ ID NO: 913311 - DNA, 22 bp, Artificial Sequence
  chemically synthesized
ggttattcatagttccttgcta

SEQ ID NO: 913312 - DNA, 22 bp, Artificial Sequence
  chemically synthesized
cccattaggttattcatagttc

SEQ ID NO: 913313 - DNA, 22 bp, Artificial Sequence
  chemically synthesized
tgcccattaggttattcatagt

SEQ ID NO: 913314 - DNA, 22 bp, Artificial Sequence
  chemically synthesized
ctgcccattaggttattcatag

SEQ ID NO: 913315 - DNA, 22 bp, Artificial Sequence
  chemically synthesized
tctgcccattaggttattcata

SEQ ID NO: 913316 - DNA, 22 bp, Artificial Sequence
  chemically synthesized
tagcaaggaactatgaataacc

SEQ ID NO: 913317 - DNA, 22 bp, Artificial Sequence
  chemically synthesized
agcaaggaactatgaataacct

SEQ ID NO: 913318 - DNA, 22 bp, Artificial Sequence
  chemically synthesized
gcaaggaactatgaataaccta

SEQ ID NO: 913319 - DNA, 22 bp, Artificial Sequence
  chemically synthesized
gttttctgcccattaggttatt

SEQ ID NO: 913320 - DNA, 22 bp, Artificial Sequence
  chemically synthesized
aatcattggttttctgcccatt

SEQ ID NO: 913321 - DNA, 22 bp, Artificial Sequence
  chemically synthesized
tgaataacctaatgggcagaaa

SEQ ID NO: 913322 - DNA, 22 bp, Artificial Sequence
  chemically synthesized
attcaatcattggttttctgcc

SEQ ID NO: 913323 - DNA, 22 bp, Artificial Sequence
  chemically synthesized
aattcaatcattggttttctgc

SEQ ID NO: 913324 - DNA, 22 bp, Artificial Sequence
  chemically synthesized
taattcaatcattggttttctg

SEQ ID NO: 913325 - DNA, 22 bp, Artificial Sequence
  chemically synthesized
ttaattcaatcattggttttct

SEQ ID NO: 913326 - DNA, 22 bp, Artificial Sequence
  chemically synthesized
tttaattcaatcattggttttc

SEQ ID NO: 913327 - DNA, 22 bp, Artificial Sequence
  chemically synthesized
ttttttaattcaatcattggtt

SEQ ID NO: 913328 - DNA, 22 bp, Artificial Sequence
  chemically synthesized
atgggcagaaaaccaatgattg

SEQ ID NO: 913329 - DNA, 22 bp, Artificial Sequence
  chemically synthesized
cataaagaagtatatgaatcta

SEQ ID NO: 913330 - DNA, 22 bp, Artificial Sequence
  chemically synthesized
gcataaagaagtatatgaatct

SEQ ID NO: 913331 - DNA, 22 bp, Artificial Sequence
  chemically synthesized
aattaaaaaatagattcatata

SEQ ID NO: 913332 - DNA, 22 bp, Artificial Sequence
  chemically synthesized
cttgcataaagaagtatatgaa

SEQ ID NO: 913333 - DNA, 22 bp, Artificial Sequence
  chemically synthesized
aaaaatagattcatatacttct

SEQ ID NO: 913334 - DNA, 22 bp, Artificial Sequence
  chemically synthesized
atatacttctttatgcaagcag

SEQ ID NO: 913335 - DNA, 22 bp, Artificial Sequence
  chemically synthesized
aaatcccccagggcctgcttgc

SEQ ID NO: 913336 - DNA, 22 bp, Artificial Sequence
  chemically synthesized
tcaaatcccccagggcctgctt

SEQ ID NO: 913337 - DNA, 22 bp, Artificial Sequence
  chemically synthesized
ctcaaatcccccagggcctgct

SEQ ID NO: 913338 - DNA, 22 bp, Artificial Sequence
  chemically synthesized
tctcaaatcccccagggcctgc

SEQ ID NO: 913339 - DNA, 22 bp, Artificial Sequence
  chemically synthesized
ctttatgcaagcaggccctggg

SEQ ID NO: 913340 - DNA, 22 bp, Artificial Sequence
  chemically synthesized
tttatgcaagcaggccctgggg

SEQ ID NO: 913341 - DNA, 22 bp, Artificial Sequence
  chemically synthesized
ttttctcaaatcccccagggcc

SEQ ID NO: 913342 - DNA, 22 bp, Artificial Sequence
  chemically synthesized
attttctcaaatcccccagggc

SEQ ID NO: 913343 - DNA, 22 bp, Artificial Sequence
  chemically synthesized
tatgcaagcaggccctggggga

SEQ ID NO: 913344 - DNA, 22 bp, Artificial Sequence
  chemically synthesized
tattttctcaaatcccccaggg

SEQ ID NO: 913345 - DNA, 22 bp, Artificial Sequence
  chemically synthesized
atgcaagcaggccctgggggat

SEQ ID NO: 913346 - DNA, 22 bp, Artificial Sequence
  chemically synthesized
tgcaagcaggccctgggggatt

SEQ ID NO: 913347 - DNA, 22 bp, Artificial Sequence
  chemically synthesized
ggggatttgagaaaataaaatt

SEQ ID NO: 913348 - DNA, 22 bp, Artificial Sequence
  chemically synthesized
agcaagtcaaggtaattttatt

SEQ ID NO: 913349 - DNA, 22 bp, Artificial Sequence
  chemically synthesized
gagcaagtcaaggtaattttat

SEQ ID NO: 913350 - DNA, 22 bp, Artificial Sequence
  chemically synthesized
gagaaaataaaattaccttgac

SEQ ID NO: 913351 - DNA, 22 bp, Artificial Sequence
  chemically synthesized
agaaaataaaattaccttgact

SEQ ID NO: 913352 - DNA, 22 bp, Artificial Sequence
  chemically synthesized
aaagaaaagcttgagcaagtca

SEQ ID NO: 913353 - DNA, 22 bp, Artificial Sequence
  chemically synthesized
ccttgacttgctcaagcttttc

SEQ ID NO: 913354 - DNA, 22 bp, Artificial Sequence
  chemically synthesized
gacttgctcaagcttttctttt

SEQ ID NO: 913355 - DNA, 22 bp, Artificial Sequence
  chemically synthesized
acttgctcaagcttttctttta

SEQ ID NO: 913356 - DNA, 22 bp, Artificial Sequence
  chemically synthesized
gaaaagagcagcaactaaaaga

SEQ ID NO: 913357 - DNA, 22 bp, Artificial Sequence
  chemically synthesized
gctcaagcttttcttttagttg

SEQ ID NO: 913358 - DNA, 22 bp, Artificial Sequence
  chemically synthesized
ctcaagcttttcttttagttgc

SEQ ID NO: 913359 - DNA, 22 bp, Artificial Sequence
  chemically synthesized
aagcttttcttttagttgctgc

SEQ ID NO: 913360 - DNA, 22 bp, Artificial Sequence
  chemically synthesized
aacctggaaaagagcagcaact

SEQ ID NO: 913361 - DNA, 22 bp, Artificial Sequence
  chemically synthesized
gaacctggaaaagagcagcaac

SEQ ID NO: 913362 - DNA, 22 bp, Artificial Sequence
  chemically synthesized
ttcttttagttgctgctctttt

SEQ ID NO: 913363 - DNA, 22 bp, Artificial Sequence
  chemically synthesized
tcttttagttgctgctcttttc

SEQ ID NO: 913364 - DNA, 22 bp, Artificial Sequence
  chemically synthesized
cttttagttgctgctcttttcc

SEQ ID NO: 913365 - DNA, 22 bp, Artificial Sequence
  chemically synthesized
ttttagttgctgctcttttcca

SEQ ID NO: 913366 - DNA, 22 bp, Artificial Sequence
  chemically synthesized
ttagttgctgctcttttccagg

SEQ ID NO: 913367 - DNA, 22 bp, Artificial Sequence
  chemically synthesized
tagttgctgctcttttccaggt

SEQ ID NO: 913368 - DNA, 22 bp, Artificial Sequence
  chemically synthesized
agttgctgctcttttccaggtt

SEQ ID NO: 913369 - DNA, 22 bp, Artificial Sequence
  chemically synthesized
gtatcccacttgaacctggaaa

SEQ ID NO: 913370 - DNA, 22 bp, Artificial Sequence
  chemically synthesized
gttgctgctcttttccaggttc

SEQ ID NO: 913371 - DNA, 22 bp, Artificial Sequence
  chemically synthesized
ctagtatcccacttgaacctgg

SEQ ID NO: 913372 - DNA, 22 bp, Artificial Sequence
  chemically synthesized
ctgctcttttccaggttcaagt

SEQ ID NO: 913373 - DNA, 22 bp, Artificial Sequence
  chemically synthesized
ctcttttccaggttcaagtggg

SEQ ID NO: 913374 - DNA, 22 bp, Artificial Sequence
  chemically synthesized
ttttccaggttcaagtgggata

SEQ ID NO: 913375 - DNA, 22 bp, Artificial Sequence
  chemically synthesized
ttccaggttcaagtgggatact

SEQ ID NO: 913376 - DNA, 22 bp, Artificial Sequence
  chemically synthesized
tccaggttcaagtgggatacta

SEQ ID NO: 913377 - DNA, 22 bp, Artificial Sequence
  chemically synthesized
ccaggttcaagtgggatactag

SEQ ID NO: 913378 - DNA, 22 bp, Artificial Sequence
  chemically synthesized
caggttcaagtgggatactagc

SEQ ID NO: 913379 - DNA, 22 bp, Artificial Sequence
  chemically synthesized
gaggaagcagataacattgcta

SEQ ID NO: 913380 - DNA, 22 bp, Artificial Sequence
  chemically synthesized
aagtgggatactagcaatgtta

SEQ ID NO: 913381 - DNA, 22 bp, Artificial Sequence
  chemically synthesized
tggttggaggaagcagataaca

SEQ ID NO: 913382 - DNA, 22 bp, Artificial Sequence
  chemically synthesized
atggttggaggaagcagataac

SEQ ID NO: 913383 - DNA, 22 bp, Artificial Sequence
  chemically synthesized
tatggttggaggaagcagataa

SEQ ID NO: 913384 - DNA, 22 bp, Artificial Sequence
  chemically synthesized
ttttatggttggaggaagcaga

SEQ ID NO: 913385 - DNA, 22 bp, Artificial Sequence
  chemically synthesized
gttttatggttggaggaagcag

SEQ ID NO: 913386 - DNA, 22 bp, Artificial Sequence
  chemically synthesized
gcaatgttatctgcttcctcca

SEQ ID NO: 913387 - DNA, 22 bp, Artificial Sequence
  chemically synthesized
aatgaatttgttttatggttgg

SEQ ID NO: 913388 - DNA, 22 bp, Artificial Sequence
  chemically synthesized
aaatgaatttgttttatggttg

SEQ ID NO: 913389 - DNA, 22 bp, Artificial Sequence
  chemically synthesized
tctgcttcctccaaccataaaa

SEQ ID NO: 913390 - DNA, 22 bp, Artificial Sequence
  chemically synthesized
cttcctccaaccataaaacaaa

SEQ ID NO: 913391 - DNA, 22 bp, Artificial Sequence
  chemically synthesized
cctccaaccataaaacaaattc

SEQ ID NO: 913392 - DNA, 22 bp, Artificial Sequence
  chemically synthesized
ctccaaccataaaacaaattca

SEQ ID NO: 913393 - DNA, 22 bp, Artificial Sequence
  chemically synthesized
aaagagatttaaatgaatttgt

SEQ ID NO: 913394 - DNA, 22 bp, Artificial Sequence
  chemically synthesized
caaagagatttaaatgaatttg

SEQ ID NO: 913395 - DNA, 22 bp, Artificial Sequence
  chemically synthesized
caaccataaaacaaattcattt

SEQ ID NO: 913396 - DNA, 22 bp, Artificial Sequence
  chemically synthesized
tcagaatttcaaagagatttaa

SEQ ID NO: 913397 - DNA, 22 bp, Artificial Sequence
  chemically synthesized
gtcagaatttcaaagagattta

SEQ ID NO: 913398 - DNA, 22 bp, Artificial Sequence
  chemically synthesized
atttaaatctctttgaaattct

SEQ ID NO: 913399 - DNA, 22 bp, Artificial Sequence
  chemically synthesized
aaatctctttgaaattctgaca

SEQ ID NO: 913400 - DNA, 22 bp, Artificial Sequence
  chemically synthesized
aatctctttgaaattctgacaa

SEQ ID NO: 913401 - DNA, 22 bp, Artificial Sequence
  chemically synthesized
tttgaaattctgacaagatatt

SEQ ID NO: 913402 - DNA, 22 bp, Artificial Sequence
  chemically synthesized
gaagaacaaaagaatatcttgt

SEQ ID NO: 913403 - DNA, 22 bp, Artificial Sequence
  chemically synthesized
tgaaattctgacaagatattct

SEQ ID NO: 913404 - DNA, 22 bp, Artificial Sequence
  chemically synthesized
gaaattctgacaagatattctt

SEQ ID NO: 913405 - DNA, 22 bp, Artificial Sequence
  chemically synthesized
aaattctgacaagatattcttt

SEQ ID NO: 913406 - DNA, 22 bp, Artificial Sequence
  chemically synthesized
caggctagaagaacaaaagaat

SEQ ID NO: 913407 - DNA, 22 bp, Artificial Sequence
  chemically synthesized
tccaggctagaagaacaaaaga

SEQ ID NO: 913408 - DNA, 22 bp, Artificial Sequence
  chemically synthesized
tgacaagatattcttttgttct

SEQ ID NO: 913409 - DNA, 22 bp, Artificial Sequence
  chemically synthesized
ctccaggctagaagaacaaaag

SEQ ID NO: 913410 - DNA, 22 bp, Artificial Sequence
  chemically synthesized
tctccaggctagaagaacaaaa

SEQ ID NO: 913411 - DNA, 22 bp, Artificial Sequence
  chemically synthesized
acaagatattcttttgttcttc

SEQ ID NO: 913412 - DNA, 22 bp, Artificial Sequence
  chemically synthesized
tttctccaggctagaagaacaa

SEQ ID NO: 913413 - DNA, 22 bp, Artificial Sequence
  chemically synthesized
ctttctccaggctagaagaaca

SEQ ID NO: 913414 - DNA, 22 bp, Artificial Sequence
  chemically synthesized
ttctttctccaggctagaagaa

SEQ ID NO: 913415 - DNA, 22 bp, Artificial Sequence
  chemically synthesized
ttcttctttctccaggctagaa

SEQ ID NO: 913416 - DNA, 22 bp, Artificial Sequence
  chemically synthesized
attcttctttctccaggctaga

SEQ ID NO: 913417 - DNA, 22 bp, Artificial Sequence
  chemically synthesized
tattcttctttctccaggctag

SEQ ID NO: 913418 - DNA, 22 bp, Artificial Sequence
  chemically synthesized
ttttgttcttctagcctggaga

SEQ ID NO: 913419 - DNA, 22 bp, Artificial Sequence
  chemically synthesized
ttgttcttctagcctggagaaa

SEQ ID NO: 913420 - DNA, 22 bp, Artificial Sequence
  chemically synthesized
tgttcttctagcctggagaaag

SEQ ID NO: 913421 - DNA, 22 bp, Artificial Sequence
  chemically synthesized
gttcttctagcctggagaaaga

SEQ ID NO: 913422 - DNA, 22 bp, Artificial Sequence
  chemically synthesized
ttcttctagcctggagaaagaa

SEQ ID NO: 913423 - DNA, 22 bp, Artificial Sequence
  chemically synthesized
ttctagcctggagaaagaagaa

SEQ ID NO: 913424 - DNA, 22 bp, Artificial Sequence
  chemically synthesized
ctagcctggagaaagaagaata

SEQ ID NO: 913425 - DNA, 22 bp, Artificial Sequence
  chemically synthesized
tagcctggagaaagaagaataa

SEQ ID NO: 913426 - DNA, 22 bp, Artificial Sequence
  chemically synthesized
gcctggagaaagaagaataaaa

SEQ ID NO: 913427 - DNA, 22 bp, Artificial Sequence
  chemically synthesized
gaaaaaaaaataacaattttat

SEQ ID NO: 913428 - DNA, 22 bp, Artificial Sequence
  chemically synthesized
gagaaagaagaataaaattgtt

SEQ ID NO: 913429 - DNA, 22 bp, Artificial Sequence
  chemically synthesized
tgttggaaaaaaaaataacaat

SEQ ID NO: 913430 - DNA, 22 bp, Artificial Sequence
  chemically synthesized
agaactatgttggaaaaaaaaa

SEQ ID NO: 913431 - DNA, 22 bp, Artificial Sequence
  chemically synthesized
gagaactatgttggaaaaaaaa

SEQ ID NO: 913432 - DNA, 22 bp, Artificial Sequence
  chemically synthesized
ttatttttttttccaacatagt

SEQ ID NO: 913433 - DNA, 22 bp, Artificial Sequence
  chemically synthesized
tttttttttccaacatagttct

SEQ ID NO: 913434 - DNA, 22 bp, Artificial Sequence
  chemically synthesized
acaaatagtttgagaactatgt

SEQ ID NO: 913435 - DNA, 22 bp, Artificial Sequence
  chemically synthesized
ttttttccaacatagttctcaa

SEQ ID NO: 913436 - DNA, 22 bp, Artificial Sequence
  chemically synthesized
tttttccaacatagttctcaaa

SEQ ID NO: 913437 - DNA, 22 bp, Artificial Sequence
  chemically synthesized
ttttccaacatagttctcaaac

SEQ ID NO: 913438 - DNA, 22 bp, Artificial Sequence
  chemically synthesized
cattaacaaatagtttgagaac

SEQ ID NO: 913439 - DNA, 22 bp, Artificial Sequence
  chemically synthesized
tttccaacatagttctcaaact

SEQ ID NO: 913440 - DNA, 22 bp, Artificial Sequence
  chemically synthesized
gcattaacaaatagtttgagaa

SEQ ID NO: 913441 - DNA, 22 bp, Artificial Sequence
  chemically synthesized
ttccaacatagttctcaaacta

SEQ ID NO: 913442 - DNA, 22 bp, Artificial Sequence
  chemically synthesized
tccaacatagttctcaaactat

SEQ ID NO: 913443 - DNA, 22 bp, Artificial Sequence
  chemically synthesized
ccaacatagttctcaaactatt

SEQ ID NO: 913444 - DNA, 22 bp, Artificial Sequence
  chemically synthesized
caacatagttctcaaactattt

SEQ ID NO: 913445 - DNA, 22 bp, Artificial Sequence
  chemically synthesized
tgtcccagtttgcattaacaaa

SEQ ID NO: 913446 - DNA, 22 bp, Artificial Sequence
  chemically synthesized
gtgtcccagtttgcattaacaa

SEQ ID NO: 913447 - DNA, 22 bp, Artificial Sequence
  chemically synthesized
tcaaactatttgttaatgcaaa

SEQ ID NO: 913448 - DNA, 22 bp, Artificial Sequence
  chemically synthesized
aaactatttgttaatgcaaact

SEQ ID NO: 913449 - DNA, 22 bp, Artificial Sequence
  chemically synthesized
ccatgtttgtgtcccagtttgc

SEQ ID NO: 913450 - DNA, 22 bp, Artificial Sequence
  chemically synthesized
tttgttaatgcaaactgggaca

SEQ ID NO: 913451 - DNA, 22 bp, Artificial Sequence
  chemically synthesized
aattgccatgtttgtgtcccag

SEQ ID NO: 913452 - DNA, 22 bp, Artificial Sequence
  chemically synthesized
gttaatgcaaactgggacacaa

SEQ ID NO: 913453 - DNA, 22 bp, Artificial Sequence
  chemically synthesized
aaattgccatgtttgtgtccca

SEQ ID NO: 913454 - DNA, 22 bp, Artificial Sequence
  chemically synthesized
ttaatgcaaactgggacacaaa

SEQ ID NO: 913455 - DNA, 22 bp, Artificial Sequence
  chemically synthesized
taaattgccatgtttgtgtccc

SEQ ID NO: 913456 - DNA, 22 bp, Artificial Sequence
  chemically synthesized
ttaaattgccatgtttgtgtcc

SEQ ID NO: 913457 - DNA, 22 bp, Artificial Sequence
  chemically synthesized
atgcaaactgggacacaaacat

SEQ ID NO: 913458 - DNA, 22 bp, Artificial Sequence
  chemically synthesized
tttttaaattgccatgtttgtg

SEQ ID NO: 913459 - DNA, 22 bp, Artificial Sequence
  chemically synthesized
atttttaaattgccatgtttgt

SEQ ID NO: 913460 - DNA, 22 bp, Artificial Sequence
  chemically synthesized
cttatttttaaattgccatgtt

SEQ ID NO: 913461 - DNA, 22 bp, Artificial Sequence
  chemically synthesized
ggacacaaacatggcaatttaa

SEQ ID NO: 913462 - DNA, 22 bp, Artificial Sequence
  chemically synthesized
aattgcttatttttaaattgcc

SEQ ID NO: 913463 - DNA, 22 bp, Artificial Sequence
  chemically synthesized
aaattgcttatttttaaattgc

SEQ ID NO: 913464 - DNA, 22 bp, Artificial Sequence
  chemically synthesized
taaattgcttatttttaaattg

SEQ ID NO: 913465 - DNA, 22 bp, Artificial Sequence
  chemically synthesized
ttaaattgcttatttttaaatt

SEQ ID NO: 913466 - DNA, 22 bp, Artificial Sequence
  chemically synthesized
acatcttttaaattgcttattt

SEQ ID NO: 913467 - DNA, 22 bp, Artificial Sequence
  chemically synthesized
aaaaataagcaatttaaaagat

SEQ ID NO: 913468 - DNA, 22 bp, Artificial Sequence
  chemically synthesized
tgtatggttaacatcttttaaa

SEQ ID NO: 913469 - DNA, 22 bp, Artificial Sequence
  chemically synthesized
aaaataagcaatttaaaagatg

SEQ ID NO: 913470 - DNA, 22 bp, Artificial Sequence
  chemically synthesized
aattatgtatggttaacatctt

SEQ ID NO: 913471 - DNA, 22 bp, Artificial Sequence
  chemically synthesized
aaattatgtatggttaacatct

SEQ ID NO: 913472 - DNA, 22 bp, Artificial Sequence
  chemically synthesized
ttaaattatgtatggttaacat

SEQ ID NO: 913473 - DNA, 22 bp, Artificial Sequence
  chemically synthesized
cttaaattatgtatggttaaca

SEQ ID NO: 913474 - DNA, 22 bp, Artificial Sequence
  chemically synthesized
tcttaaattatgtatggttaac

SEQ ID NO: 913475 - DNA, 22 bp, Artificial Sequence
  chemically synthesized
aaaagatgttaaccatacataa

SEQ ID NO: 913476 - DNA, 22 bp, Artificial Sequence
  chemically synthesized
aaagatgttaaccatacataat

SEQ ID NO: 913477 - DNA, 22 bp, Artificial Sequence
  chemically synthesized
aaagtgaatgaattttcttaaa

SEQ ID NO: 913478 - DNA, 22 bp, Artificial Sequence
  chemically synthesized
accatacataatttaagaaaat

SEQ ID NO: 913479 - DNA, 22 bp, Artificial Sequence
  chemically synthesized
ttcaaagtgaatgaattttctt

SEQ ID NO: 913480 - DNA, 22 bp, Artificial Sequence
  chemically synthesized
gttcaaagtgaatgaattttct

SEQ ID NO: 913481 - DNA, 22 bp, Artificial Sequence
  chemically synthesized
tgttcaaagtgaatgaattttc

SEQ ID NO: 913482 - DNA, 22 bp, Artificial Sequence
  chemically synthesized
ctttgttcaaagtgaatgaatt

SEQ ID NO: 913483 - DNA, 22 bp, Artificial Sequence
  chemically synthesized
aaattactttgttcaaagtgaa

SEQ ID NO: 913484 - DNA, 22 bp, Artificial Sequence
  chemically synthesized
aagaaaattcattcactttgaa

SEQ ID NO: 913485 - DNA, 22 bp, Artificial Sequence
  chemically synthesized
agaaaattcattcactttgaac

SEQ ID NO: 913486 - DNA, 22 bp, Artificial Sequence
  chemically synthesized
aaatattgaaattactttgttc

SEQ ID NO: 913487 - DNA, 22 bp, Artificial Sequence
  chemically synthesized
gaaatattgaaattactttgtt

SEQ ID NO: 913488 - DNA, 22 bp, Artificial Sequence
  chemically synthesized
attcactttgaacaaagtaatt

SEQ ID NO: 913489 - DNA, 22 bp, Artificial Sequence
  chemically synthesized
ttgaaatattgaaattactttg

SEQ ID NO: 913490 - DNA, 22 bp, Artificial Sequence
  chemically synthesized
actttgaacaaagtaatttcaa

SEQ ID NO: 913491 - DNA, 22 bp, Artificial Sequence
  chemically synthesized
gagattcttgaaatattgaaat

SEQ ID NO: 913492 - DNA, 22 bp, Artificial Sequence
  chemically synthesized
tgaacaaagtaatttcaatatt

SEQ ID NO: 913493 - DNA, 22 bp, Artificial Sequence
  chemically synthesized
agagattcttgaaatattgaaa

SEQ ID NO: 913494 - DNA, 22 bp, Artificial Sequence
  chemically synthesized
gaacaaagtaatttcaatattt

SEQ ID NO: 913495 - DNA, 22 bp, Artificial Sequence
  chemically synthesized
aacaaagtaatttcaatatttc

SEQ ID NO: 913496 - DNA, 22 bp, Artificial Sequence
  chemically synthesized
tcatttagagattcttgaaata

SEQ ID NO: 913497 - DNA, 22 bp, Artificial Sequence
  chemically synthesized
atcatttagagattcttgaaat

SEQ ID NO: 913498 - DNA, 22 bp, Artificial Sequence
  chemically synthesized
ttatcatttagagattcttgaa

SEQ ID NO: 913499 - DNA, 22 bp, Artificial Sequence
  chemically synthesized
atctcttatcatttagagattc

SEQ ID NO: 913500 - DNA, 22 bp, Artificial Sequence
  chemically synthesized
caatatttcaagaatctctaaa

SEQ ID NO: 913501 - DNA, 22 bp, Artificial Sequence
  chemically synthesized
aatctcttatcatttagagatt

SEQ ID NO: 913502 - DNA, 22 bp, Artificial Sequence
  chemically synthesized
aatatttcaagaatctctaaat

SEQ ID NO: 913503 - DNA, 22 bp, Artificial Sequence
  chemically synthesized
taatctcttatcatttagagat

SEQ ID NO: 913504 - DNA, 22 bp, Artificial Sequence
  chemically synthesized
gattttaatctcttatcattta

SEQ ID NO: 913505 - DNA, 22 bp, Artificial Sequence
  chemically synthesized
caagaatctctaaatgataaga

SEQ ID NO: 913506 - DNA, 22 bp, Artificial Sequence
  chemically synthesized
aagaatctctaaatgataagag

SEQ ID NO: 913507 - DNA, 22 bp, Artificial Sequence
  chemically synthesized
ttcgattttaatctcttatcat

SEQ ID NO: 913508 - DNA, 22 bp, Artificial Sequence
  chemically synthesized
gttcgattttaatctcttatca

SEQ ID NO: 913509 - DNA, 22 bp, Artificial Sequence
  chemically synthesized
ttgttcgattttaatctcttat

SEQ ID NO: 913510 - DNA, 22 bp, Artificial Sequence
  chemically synthesized
cttgttcgattttaatctctta

SEQ ID NO: 913511 - DNA, 22 bp, Artificial Sequence
  chemically synthesized
tcttgttcgattttaatctctt

SEQ ID NO: 913512 - DNA, 22 bp, Artificial Sequence
  chemically synthesized
ttcttgttcgattttaatctct

SEQ ID NO: 913513 - DNA, 22 bp, Artificial Sequence
  chemically synthesized
taaatgataagagattaaaatc

SEQ ID NO: 913514 - DNA, 22 bp, Artificial Sequence
  chemically synthesized
aatgataagagattaaaatcga

SEQ ID NO: 913515 - DNA, 22 bp, Artificial Sequence
  chemically synthesized
aatcagaatttttcttgttcga

SEQ ID NO: 913516 - DNA, 22 bp, Artificial Sequence
  chemically synthesized
gaatcagaatttttcttgttcg

SEQ ID NO: 913517 - DNA, 22 bp, Artificial Sequence
  chemically synthesized
tgaatcagaatttttcttgttc

SEQ ID NO: 913518 - DNA, 22 bp, Artificial Sequence
  chemically synthesized
ttgaatcagaatttttcttgtt

SEQ ID NO: 913519 - DNA, 22 bp, Artificial Sequence
  chemically synthesized
aaatcgaacaagaaaaattctg

SEQ ID NO: 913520 - DNA, 22 bp, Artificial Sequence
  chemically synthesized
gccaggaatttttgaatcagaa

SEQ ID NO: 913521 - DNA, 22 bp, Artificial Sequence
  chemically synthesized
cgcctggccaggaatttttgaa

SEQ ID NO: 913522 - DNA, 22 bp, Artificial Sequence
  chemically synthesized
tgattcaaaaattcctggccag

SEQ ID NO: 913523 - DNA, 22 bp, Artificial Sequence
  chemically synthesized
attcaaaaattcctggccaggc

SEQ ID NO: 913524 - DNA, 22 bp, Artificial Sequence
  chemically synthesized
aaaaattcctggccaggcgcag

SEQ ID NO: 913525 - DNA, 22 bp, Artificial Sequence
  chemically synthesized
caggcatgagccactgcgcctg

SEQ ID NO: 913526 - DNA, 22 bp, Artificial Sequence
  chemically synthesized
gggttacaggcatgagccactg

SEQ ID NO: 913527 - DNA, 22 bp, Artificial Sequence
  chemically synthesized
ctggccaggcgcagtggctcat

SEQ ID NO: 913528 - DNA, 22 bp, Artificial Sequence
  chemically synthesized
gccaggcgcagtggctcatgcc

SEQ ID NO: 913529 - DNA, 22 bp, Artificial Sequence
  chemically synthesized
agcgctagggttacaggcatga

SEQ ID NO: 913530 - DNA, 22 bp, Artificial Sequence
  chemically synthesized
cctaagcgctagggttacaggc

SEQ ID NO: 913531 - DNA, 22 bp, Artificial Sequence
  chemically synthesized
atgcctgtaaccctagcgctta

SEQ ID NO: 913532 - DNA, 22 bp, Artificial Sequence
  chemically synthesized
taaccctagcgcttagggaggc

SEQ ID NO: 913533 - DNA, 22 bp, Artificial Sequence
  chemically synthesized
aagtgatccgcccacatcggcc

SEQ ID NO: 913534 - DNA, 22 bp, Artificial Sequence
  chemically synthesized
gcgcttagggaggccgatgtgg

SEQ ID NO: 913535 - DNA, 22 bp, Artificial Sequence
  chemically synthesized
acctcaagtgatccgcccacat

SEQ ID NO: 913536 - DNA, 22 bp, Artificial Sequence
  chemically synthesized
agggaggccgatgtgggcggat

SEQ ID NO: 913537 - DNA, 22 bp, Artificial Sequence
  chemically synthesized
gggaggccgatgtgggcggatc

SEQ ID NO: 913538 - DNA, 22 bp, Artificial Sequence
  chemically synthesized
ctgacctcaagtgatccgccca

SEQ ID NO: 913539 - DNA, 22 bp, Artificial Sequence
  chemically synthesized
gtcgcaaactcctgacctcaag

SEQ ID NO: 913540 - DNA, 22 bp, Artificial Sequence
  chemically synthesized
ccaggctggtcgcaaactcctg

SEQ ID NO: 913541 - DNA, 22 bp, Artificial Sequence
  chemically synthesized
gccaggctggtcgcaaactcct

SEQ ID NO: 913542 - DNA, 22 bp, Artificial Sequence
  chemically synthesized
gaggtcaggagtttgcgaccag

SEQ ID NO: 913543 - DNA, 22 bp, Artificial Sequence
  chemically synthesized
aggtcaggagtttgcgaccagc

SEQ ID NO: 913544 - DNA, 22 bp, Artificial Sequence
  chemically synthesized
accatatttgccaggctggtcg

SEQ ID NO: 913545 - DNA, 22 bp, Artificial Sequence
  chemically synthesized
caccatatttgccaggctggtc

SEQ ID NO: 913546 - DNA, 22 bp, Artificial Sequence
  chemically synthesized
gcgaccagcctggcaaatatgg

SEQ ID NO: 913547 - DNA, 22 bp, Artificial Sequence
  chemically synthesized
cgaccagcctggcaaatatggt

SEQ ID NO: 913548 - DNA, 22 bp, Artificial Sequence
  chemically synthesized
gtgtagacggggtttcaccata

SEQ ID NO: 913549 - DNA, 22 bp, Artificial Sequence
  chemically synthesized
agtgtagacggggtttcaccat

SEQ ID NO: 913550 - DNA, 22 bp, Artificial Sequence
  chemically synthesized
tagtgtagacggggtttcacca

SEQ ID NO: 913551 - DNA, 22 bp, Artificial Sequence
  chemically synthesized
ttagtgtagacggggtttcacc

SEQ ID NO: 913552 - DNA, 22 bp, Artificial Sequence
  chemically synthesized
gcaaatatggtgaaaccccgtc

SEQ ID NO: 913553 - DNA, 22 bp, Artificial Sequence
  chemically synthesized
tatttttagtgtagacggggtt

SEQ ID NO: 913554 - DNA, 22 bp, Artificial Sequence
  chemically synthesized
gtatttttagtgtagacggggt

SEQ ID NO: 913555 - DNA, 22 bp, Artificial Sequence
  chemically synthesized
tgtatttttagtgtagacgggg

SEQ ID NO: 913556 - DNA, 22 bp, Artificial Sequence
  chemically synthesized
ttgtatttttagtgtagacggg

SEQ ID NO: 913557 - DNA, 22 bp, Artificial Sequence
  chemically synthesized
gcaaatttttgtatttttagtg

SEQ ID NO: 913558 - DNA, 22 bp, Artificial Sequence
  chemically synthesized
cactaaaaatacaaaaatttgc

SEQ ID NO: 913559 - DNA, 22 bp, Artificial Sequence
  chemically synthesized
ccaccaaacctggcaaattttt

SEQ ID NO: 913560 - DNA, 22 bp, Artificial Sequence
  chemically synthesized
aaaatacaaaaatttgccaggt

SEQ ID NO: 913561 - DNA, 22 bp, Artificial Sequence
  chemically synthesized
caggcgcctgccaccaaacctg

SEQ ID NO: 913562 - DNA, 22 bp, Artificial Sequence
  chemically synthesized
ggattacaggcgcctgccacca

SEQ ID NO: 913563 - DNA, 22 bp, Artificial Sequence
  chemically synthesized
gccaggtttggtggcaggcgcc

SEQ ID NO: 913564 - DNA, 22 bp, Artificial Sequence
  chemically synthesized
ccaggtttggtggcaggcgcct

SEQ ID NO: 913565 - DNA, 22 bp, Artificial Sequence
  chemically synthesized
gtagctgggattacaggcgcct

SEQ ID NO: 913566 - DNA, 22 bp, Artificial Sequence
  chemically synthesized
cctagtagctgggattacaggc

SEQ ID NO: 913567 - DNA, 22 bp, Artificial Sequence
  chemically synthesized
ggtggcaggcgcctgtaatccc

SEQ ID NO: 913568 - DNA, 22 bp, Artificial Sequence
  chemically synthesized
gtggcaggcgcctgtaatccca

SEQ ID NO: 913569 - DNA, 22 bp, Artificial Sequence
  chemically synthesized
agcctccctagtagctgggatt

SEQ ID NO: 913570 - DNA, 22 bp, Artificial Sequence
  chemically synthesized
cctcagcctccctagtagctgg

SEQ ID NO: 913571 - DNA, 22 bp, Artificial Sequence
  chemically synthesized
ctgcctcagcctccctagtagc

SEQ ID NO: 913572 - DNA, 22 bp, Artificial Sequence
  chemically synthesized
tcctgcctcagcctccctagta

SEQ ID NO: 913573 - DNA, 22 bp, Artificial Sequence
  chemically synthesized
taatcccagctactagggaggc

SEQ ID NO: 913574 - DNA, 22 bp, Artificial Sequence
  chemically synthesized
aagtgattctcctgcctcagcc

SEQ ID NO: 913575 - DNA, 22 bp, Artificial Sequence
  chemically synthesized
ctagggaggctgaggcaggaga

SEQ ID NO: 913576 - DNA, 22 bp, Artificial Sequence
  chemically synthesized
cacgttcaagtgattctcctgc

SEQ ID NO: 913577 - DNA, 22 bp, Artificial Sequence
  chemically synthesized
gggaggctgaggcaggagaatc

SEQ ID NO: 913578 - DNA, 22 bp, Artificial Sequence
  chemically synthesized
ccacgttcaagtgattctcctg

SEQ ID NO: 913579 - DNA, 22 bp, Artificial Sequence
  chemically synthesized
ccttccacgttcaagtgattct

SEQ ID NO: 913580 - DNA, 22 bp, Artificial Sequence
  chemically synthesized
tgccttccacgttcaagtgatt

SEQ ID NO: 913581 - DNA, 22 bp, Artificial Sequence
  chemically synthesized
aggcaggagaatcacttgaacg

SEQ ID NO: 913582 - DNA, 22 bp, Artificial Sequence
  chemically synthesized
cagcctctgccttccacgttca

SEQ ID NO: 913583 - DNA, 22 bp, Artificial Sequence
  chemically synthesized
ctgcagcctctgccttccacgt

SEQ ID NO: 913584 - DNA, 22 bp, Artificial Sequence
  chemically synthesized
actgcagcctctgccttccacg

SEQ ID NO: 913585 - DNA, 22 bp, Artificial Sequence
  chemically synthesized
ggcttactgcagcctctgcctt

SEQ ID NO: 913586 - DNA, 22 bp, Artificial Sequence
  chemically synthesized
gaacgtggaaggcagaggctgc

SEQ ID NO: 913587 - DNA, 22 bp, Artificial Sequence
  chemically synthesized
aacgtggaaggcagaggctgca

SEQ ID NO: 913588 - DNA, 22 bp, Artificial Sequence
  chemically synthesized
cagtaagccgagatcgtgccac

SEQ ID NO: 913589 - DNA, 22 bp, Artificial Sequence
  chemically synthesized
cccggggtggagtgcagtggca

SEQ ID NO: 913590 - DNA, 22 bp, Artificial Sequence
  chemically synthesized
ttgcccggggtggagtgcagtg

SEQ ID NO: 913591 - DNA, 22 bp, Artificial Sequence
  chemically synthesized
tgttgcccggggtggagtgcag

SEQ ID NO: 913592 - DNA, 22 bp, Artificial Sequence
  chemically synthesized
tctgttgcccggggtggagtgc

SEQ ID NO: 913593 - DNA, 22 bp, Artificial Sequence
  chemically synthesized
ctctgttgcccggggtggagtg

SEQ ID NO: 913594 - DNA, 22 bp, Artificial Sequence
  chemically synthesized
tctctgttgcccggggtggagt

SEQ ID NO: 913595 - DNA, 22 bp, Artificial Sequence
  chemically synthesized
cactccaccccgggcaacagag

SEQ ID NO: 913596 - DNA, 22 bp, Artificial Sequence
  chemically synthesized
agatggagtctttctctgttgc

SEQ ID NO: 913597 - DNA, 22 bp, Artificial Sequence
  chemically synthesized
gagatggagtctttctctgttg

SEQ ID NO: 913598 - DNA, 22 bp, Artificial Sequence
  chemically synthesized
caccccgggcaacagagaaaga

SEQ ID NO: 913599 - DNA, 22 bp, Artificial Sequence
  chemically synthesized
catctcaaatacatacatacat

SEQ ID NO: 913600 - DNA, 22 bp, Artificial Sequence
  chemically synthesized
aaatacatacatacatacgtac

SEQ ID NO: 913601 - DNA, 22 bp, Artificial Sequence
  chemically synthesized
atgtatgtatgtatgtatgtat

SEQ ID NO: 913602 - DNA, 22 bp, Artificial Sequence
  chemically synthesized
aatgtatgtatgtatgtatgta

SEQ ID NO: 913603 - DNA, 22 bp, Artificial Sequence
  chemically synthesized
taatgtatgtatgtatgtatgt

SEQ ID NO: 913604 - DNA, 22 bp, Artificial Sequence
  chemically synthesized
attttaatgtatgtatgtatgt

SEQ ID NO: 913605 - DNA, 22 bp, Artificial Sequence
  chemically synthesized
ttcattttaatgtatgtatgta

SEQ ID NO: 913606 - DNA, 22 bp, Artificial Sequence
  chemically synthesized
attcattttaatgtatgtatgt

SEQ ID NO: 913607 - DNA, 22 bp, Artificial Sequence
  chemically synthesized
tattcattttaatgtatgtatg

SEQ ID NO: 913608 - DNA, 22 bp, Artificial Sequence
  chemically synthesized
ttttattcattttaatgtatgt

SEQ ID NO: 913609 - DNA, 22 bp, Artificial Sequence
  chemically synthesized
attttattcattttaatgtatg

SEQ ID NO: 913610 - DNA, 22 bp, Artificial Sequence
  chemically synthesized
tattttattcattttaatgtat

SEQ ID NO: 913611 - DNA, 22 bp, Artificial Sequence
  chemically synthesized
ttattttattcattttaatgta

SEQ ID NO: 913612 - DNA, 22 bp, Artificial Sequence
  chemically synthesized
gaatttttattttattcatttt

SEQ ID NO: 913613 - DNA, 22 bp, Artificial Sequence
  chemically synthesized
ttagaatttttattttattcat

SEQ ID NO: 913614 - DNA, 22 bp, Artificial Sequence
  chemically synthesized
aaatgaataaaataaaaattct

SEQ ID NO: 913615 - DNA, 22 bp, Artificial Sequence
  chemically synthesized
agatataatgacataatgttgt

SEQ ID NO: 913616 - DNA, 22 bp, Artificial Sequence
  chemically synthesized
ctcagatataatgacataatgt

SEQ ID NO: 913617 - DNA, 22 bp, Artificial Sequence
  chemically synthesized
gctcagatataatgacataatg

SEQ ID NO: 913618 - DNA, 22 bp, Artificial Sequence
  chemically synthesized
taacaacattatgtcattatat

SEQ ID NO: 913619 - DNA, 22 bp, Artificial Sequence
  chemically synthesized
acaacattatgtcattatatct

SEQ ID NO: 913620 - DNA, 22 bp, Artificial Sequence
  chemically synthesized
agaaaccttgctcagatataat

SEQ ID NO: 913621 - DNA, 22 bp, Artificial Sequence
  chemically synthesized
aagttgagaaaccttgctcaga

SEQ ID NO: 913622 - DNA, 22 bp, Artificial Sequence
  chemically synthesized
tgtcattatatctgagcaaggt

SEQ ID NO: 913623 - DNA, 22 bp, Artificial Sequence
  chemically synthesized
gtaatgctaaagttgagaaacc

SEQ ID NO: 913624 - DNA, 22 bp, Artificial Sequence
  chemically synthesized
tatctgagcaaggtttctcaac

SEQ ID NO: 913625 - DNA, 22 bp, Artificial Sequence
  chemically synthesized
agcaaggtttctcaactttagc

SEQ ID NO: 913626 - DNA, 22 bp, Artificial Sequence
  chemically synthesized
aatgttagtaatgctaaagttg

SEQ ID NO: 913627 - DNA, 22 bp, Artificial Sequence
  chemically synthesized
caaacctaaatgttagtaatgc

SEQ ID NO: 913628 - DNA, 22 bp, Artificial Sequence
  chemically synthesized
ccaaacctaaatgttagtaatg

SEQ ID NO: 913629 - DNA, 22 bp, Artificial Sequence
  chemically synthesized
ctcaactttagcattactaaca

SEQ ID NO: 913630 - DNA, 22 bp, Artificial Sequence
  chemically synthesized
tccaaacctaaatgttagtaat

SEQ ID NO: 913631 - DNA, 22 bp, Artificial Sequence
  chemically synthesized
tcaactttagcattactaacat

SEQ ID NO: 913632 - DNA, 22 bp, Artificial Sequence
  chemically synthesized
aactttagcattactaacattt

SEQ ID NO: 913633 - DNA, 22 bp, Artificial Sequence
  chemically synthesized
tagcattactaacatttaggtt

SEQ ID NO: 913634 - DNA, 22 bp, Artificial Sequence
  chemically synthesized
agcattactaacatttaggttt

SEQ ID NO: 913635 - DNA, 22 bp, Artificial Sequence
  chemically synthesized
gcattactaacatttaggtttg

SEQ ID NO: 913636 - DNA, 22 bp, Artificial Sequence
  chemically synthesized
acagcaaagaattttccaaacc

SEQ ID NO: 913637 - DNA, 22 bp, Artificial Sequence
  chemically synthesized
ctaacatttaggtttggaaaat

SEQ ID NO: 913638 - DNA, 22 bp, Artificial Sequence
  chemically synthesized
ctcacagcaaagaattttccaa

SEQ ID NO: 913639 - DNA, 22 bp, Artificial Sequence
  chemically synthesized
acatttaggtttggaaaattct

SEQ ID NO: 913640 - DNA, 22 bp, Artificial Sequence
  chemically synthesized
aggtttggaaaattctttgctg

SEQ ID NO: 913641 - DNA, 22 bp, Artificial Sequence
  chemically synthesized
ggtttggaaaattctttgctgt

SEQ ID NO: 913642 - DNA, 22 bp, Artificial Sequence
  chemically synthesized
ggaaaattctttgctgtgagca

SEQ ID NO: 913643 - DNA, 22 bp, Artificial Sequence
  chemically synthesized
gaaaattctttgctgtgagcag

SEQ ID NO: 913644 - DNA, 22 bp, Artificial Sequence
  chemically synthesized
caatgcagaggatagctgctca

SEQ ID NO: 913645 - DNA, 22 bp, Artificial Sequence
  chemically synthesized
tttgctgtgagcagctatcctc

SEQ ID NO: 913646 - DNA, 22 bp, Artificial Sequence
  chemically synthesized
tgctgtgagcagctatcctctg

SEQ ID NO: 913647 - DNA, 22 bp, Artificial Sequence
  chemically synthesized
gctgtgagcagctatcctctgc

SEQ ID NO: 913648 - DNA, 22 bp, Artificial Sequence
  chemically synthesized
ctgtgagcagctatcctctgca

SEQ ID NO: 913649 - DNA, 22 bp, Artificial Sequence
  chemically synthesized
aataccctacaatgcagaggat

SEQ ID NO: 913650 - DNA, 22 bp, Artificial Sequence
  chemically synthesized
tgagcagctatcctctgcattg

SEQ ID NO: 913651 - DNA, 22 bp, Artificial Sequence
  chemically synthesized
ctaaataccctacaatgcagag

SEQ ID NO: 913652 - DNA, 22 bp, Artificial Sequence
  chemically synthesized
tcctctgcattgtagggtattt

SEQ ID NO: 913653 - DNA, 22 bp, Artificial Sequence
  chemically synthesized
tgcattgtagggtatttagcag

SEQ ID NO: 913654 - DNA, 22 bp, Artificial Sequence
  chemically synthesized
cattgtagggtatttagcagta

SEQ ID NO: 913655 - DNA, 22 bp, Artificial Sequence
  chemically synthesized
aacaggccagggatactgctaa

SEQ ID NO: 913656 - DNA, 22 bp, Artificial Sequence
  chemically synthesized
tagggtatttagcagtatccct

SEQ ID NO: 913657 - DNA, 22 bp, Artificial Sequence
  chemically synthesized
agcagtatccctggcctgttga

SEQ ID NO: 913658 - DNA, 22 bp, Artificial Sequence
  chemically synthesized
gcagtatccctggcctgttgaa

SEQ ID NO: 913659 - DNA, 22 bp, Artificial Sequence
  chemically synthesized
gtatccagtgtgttcaacaggc

SEQ ID NO: 913660 - DNA, 22 bp, Artificial Sequence
  chemically synthesized
ctggtatccagtgtgttcaaca

SEQ ID NO: 913661 - DNA, 22 bp, Artificial Sequence
  chemically synthesized
ctactggtatccagtgtgttca

SEQ ID NO: 913662 - DNA, 22 bp, Artificial Sequence
  chemically synthesized
gcctgttgaacacactggatac

SEQ ID NO: 913663 - DNA, 22 bp, Artificial Sequence
  chemically synthesized
ttgaacacactggataccagta

SEQ ID NO: 913664 - DNA, 22 bp, Artificial Sequence
  chemically synthesized
aacacactggataccagtagta

SEQ ID NO: 913665 - DNA, 22 bp, Artificial Sequence
  chemically synthesized
aggggcgaggtgttactactgg

SEQ ID NO: 913666 - DNA, 22 bp, Artificial Sequence
  chemically synthesized
gataccagtagtaacacctcgc

SEQ ID NO: 913667 - DNA, 22 bp, Artificial Sequence
  chemically synthesized
tcacagctcaggggcgaggtgt

SEQ ID NO: 913668 - DNA, 22 bp, Artificial Sequence
  chemically synthesized
gttgtcacagctcaggggcgag

SEQ ID NO: 913669 - DNA, 22 bp, Artificial Sequence
  chemically synthesized
ggttgtcacagctcaggggcga

SEQ ID NO: 913670 - DNA, 22 bp, Artificial Sequence
  chemically synthesized
aaacatatttggttgtcacagc

SEQ ID NO: 913671 - DNA, 22 bp, Artificial Sequence
  chemically synthesized
gaaacatatttggttgtcacag

SEQ ID NO: 913672 - DNA, 22 bp, Artificial Sequence
  chemically synthesized
gcccctgagctgtgacaaccaa

SEQ ID NO: 913673 - DNA, 22 bp, Artificial Sequence
  chemically synthesized
agctgtgacaaccaaatatgtt

SEQ ID NO: 913674 - DNA, 22 bp, Artificial Sequence
  chemically synthesized
gcagtgccttgaaacatatttg

SEQ ID NO: 913675 - DNA, 22 bp, Artificial Sequence
  chemically synthesized
ggcagtgccttgaaacatattt

SEQ ID NO: 913676 - DNA, 22 bp, Artificial Sequence
  chemically synthesized
tgacaaccaaatatgtttcaag

SEQ ID NO: 913677 - DNA, 22 bp, Artificial Sequence
  chemically synthesized
caaggcactgccaaatatgctg

SEQ ID NO: 913678 - DNA, 22 bp, Artificial Sequence
  chemically synthesized
aaggcactgccaaatatgctgg

SEQ ID NO: 913679 - DNA, 22 bp, Artificial Sequence
  chemically synthesized
tccccacccccaaccccccagc

SEQ ID NO: 913680 - DNA, 22 bp, Artificial Sequence
  chemically synthesized
gtccccacccccaaccccccag

SEQ ID NO: 913681 - DNA, 22 bp, Artificial Sequence
  chemically synthesized
tgtccccacccccaacccccca

SEQ ID NO: 913682 - DNA, 22 bp, Artificial Sequence
  chemically synthesized
ccaaatatgctggggggttggg

SEQ ID NO: 913683 - DNA, 22 bp, Artificial Sequence
  chemically synthesized
gggggttgggggtggggacaaa

SEQ ID NO: 913684 - DNA, 22 bp, Artificial Sequence
  chemically synthesized
aaccagggacaattttgtcccc

SEQ ID NO: 913685 - DNA, 22 bp, Artificial Sequence
  chemically synthesized
tcaaccagggacaattttgtcc

SEQ ID NO: 913686 - DNA, 22 bp, Artificial Sequence
  chemically synthesized
gttctcaaccagggacaatttt

SEQ ID NO: 913687 - DNA, 22 bp, Artificial Sequence
  chemically synthesized
ggggtggggacaaaattgtccc

SEQ ID NO: 913688 - DNA, 22 bp, Artificial Sequence
  chemically synthesized
gttggttctcaaccagggacaa

SEQ ID NO: 913689 - DNA, 22 bp, Artificial Sequence
  chemically synthesized
agttggttctcaaccagggaca

SEQ ID NO: 913690 - DNA, 22 bp, Artificial Sequence
  chemically synthesized
tagttggttctcaaccagggac

SEQ ID NO: 913691 - DNA, 22 bp, Artificial Sequence
  chemically synthesized
ctttagttggttctcaaccagg

SEQ ID NO: 913692 - DNA, 22 bp, Artificial Sequence
  chemically synthesized
actttagttggttctcaaccag

SEQ ID NO: 913693 - DNA, 22 bp, Artificial Sequence
  chemically synthesized
tatacttactttagttggttct

SEQ ID NO: 913694 - DNA, 22 bp, Artificial Sequence
  chemically synthesized
tccctggttgagaaccaactaa

SEQ ID NO: 913695 - DNA, 22 bp, Artificial Sequence
  chemically synthesized
ggttatatacttactttagttg

SEQ ID NO: 913696 - DNA, 22 bp, Artificial Sequence
  chemically synthesized
aggttatatacttactttagtt

SEQ ID NO: 913697 - DNA, 22 bp, Artificial Sequence
  chemically synthesized
taggttatatacttactttagt

SEQ ID NO: 913698 - DNA, 22 bp, Artificial Sequence
  chemically synthesized
gttgagaaccaactaaagtaag

SEQ ID NO: 913699 - DNA, 22 bp, Artificial Sequence
  chemically synthesized
agaaccaactaaagtaagtata

SEQ ID NO: 913700 - DNA, 22 bp, Artificial Sequence
  chemically synthesized
taactttaggttatatacttac

SEQ ID NO: 913701 - DNA, 22 bp, Artificial Sequence
  chemically synthesized
gtaactttaggttatatactta

SEQ ID NO: 913702 - DNA, 22 bp, Artificial Sequence
  chemically synthesized
aaacttgtaactttaggttata

SEQ ID NO: 913703 - DNA, 22 bp, Artificial Sequence
  chemically synthesized
aaaacttgtaactttaggttat

SEQ ID NO: 913704 - DNA, 22 bp, Artificial Sequence
  chemically synthesized
taaaacttgtaactttaggtta

SEQ ID NO: 913705 - DNA, 22 bp, Artificial Sequence
  chemically synthesized
aagtaagtatataacctaaagt

SEQ ID NO: 913706 - DNA, 22 bp, Artificial Sequence
  chemically synthesized
aacattttaaaacttgtaactt

SEQ ID NO: 913707 - DNA, 22 bp, Artificial Sequence
  chemically synthesized
attaaacattttaaaacttgta

SEQ ID NO: 913708 - DNA, 22 bp, Artificial Sequence
  chemically synthesized
aattaaacattttaaaacttgt

SEQ ID NO: 913709 - DNA, 22 bp, Artificial Sequence
  chemically synthesized
taattaaacattttaaaacttg

SEQ ID NO: 913710 - DNA, 22 bp, Artificial Sequence
  chemically synthesized
aagttacaagttttaaaatgtt

SEQ ID NO: 913711 - DNA, 22 bp, Artificial Sequence
  chemically synthesized
caagttttaaaatgtttaatta

SEQ ID NO: 913712 - DNA, 22 bp, Artificial Sequence
  chemically synthesized
cataagtatactttaattaaac

SEQ ID NO: 913713 - DNA, 22 bp, Artificial Sequence
  chemically synthesized
ccataagtatactttaattaaa

SEQ ID NO: 913714 - DNA, 22 bp, Artificial Sequence
  chemically synthesized
tccataagtatactttaattaa

SEQ ID NO: 913715 - DNA, 22 bp, Artificial Sequence
  chemically synthesized
taaaatgtttaattaaagtata

SEQ ID NO: 913716 - DNA, 22 bp, Artificial Sequence
  chemically synthesized
attttccataagtatactttaa

SEQ ID NO: 913717 - DNA, 22 bp, Artificial Sequence
  chemically synthesized
aaaatgtttaattaaagtatac

SEQ ID NO: 913718 - DNA, 22 bp, Artificial Sequence
  chemically synthesized
aaatgtttaattaaagtatact

SEQ ID NO: 913719 - DNA, 22 bp, Artificial Sequence
  chemically synthesized
tcattttccataagtatacttt

SEQ ID NO: 913720 - DNA, 22 bp, Artificial Sequence
  chemically synthesized
tcctctcattttccataagtat

SEQ ID NO: 913721 - DNA, 22 bp, Artificial Sequence
  chemically synthesized
gtcctctcattttccataagta

SEQ ID NO: 913722 - DNA, 22 bp, Artificial Sequence
  chemically synthesized
tgtcctctcattttccataagt

SEQ ID NO: 913723 - DNA, 22 bp, Artificial Sequence
  chemically synthesized
aattaaagtatacttatggaaa

SEQ ID NO: 913724 - DNA, 22 bp, Artificial Sequence
  chemically synthesized
ttgtcctctcattttccataag

SEQ ID NO: 913725 - DNA, 22 bp, Artificial Sequence
  chemically synthesized
attaaagtatacttatggaaaa

SEQ ID NO: 913726 - DNA, 22 bp, Artificial Sequence
  chemically synthesized
aagtatacttatggaaaatgag

SEQ ID NO: 913727 - DNA, 22 bp, Artificial Sequence
  chemically synthesized
tatttttgtcctctcattttcc

SEQ ID NO: 913728 - DNA, 22 bp, Artificial Sequence
  chemically synthesized
atatttttgtcctctcattttc

SEQ ID NO: 913729 - DNA, 22 bp, Artificial Sequence
  chemically synthesized
tttatatttttgtcctctcatt

SEQ ID NO: 913730 - DNA, 22 bp, Artificial Sequence
  chemically synthesized
gtttatatttttgtcctctcat

SEQ ID NO: 913731 - DNA, 22 bp, Artificial Sequence
  chemically synthesized
atggaaaatgagaggacaaaaa

SEQ ID NO: 913732 - DNA, 22 bp, Artificial Sequence
  chemically synthesized
tggaaaatgagaggacaaaaat

SEQ ID NO: 913733 - DNA, 22 bp, Artificial Sequence
  chemically synthesized
aacaaaacaaaaaccttgttta

SEQ ID NO: 913734 - DNA, 22 bp, Artificial Sequence
  chemically synthesized
aaacaaaacaaaaaccttgttt

SEQ ID NO: 913735 - DNA, 22 bp, Artificial Sequence
  chemically synthesized
cttaaacaaaacaaaaaccttg

SEQ ID NO: 913736 - DNA, 22 bp, Artificial Sequence
  chemically synthesized
ctacttaaacaaaacaaaaacc

SEQ ID NO: 913737 - DNA, 22 bp, Artificial Sequence
  chemically synthesized
ttgttttgtttaagtagcagcc

SEQ ID NO: 913738 - DNA, 22 bp, Artificial Sequence
  chemically synthesized
tgttttgtttaagtagcagcca

SEQ ID NO: 913739 - DNA, 22 bp, Artificial Sequence
  chemically synthesized
gttttgtttaagtagcagccat

SEQ ID NO: 913740 - DNA, 22 bp, Artificial Sequence
  chemically synthesized
ttttgtttaagtagcagccatt

SEQ ID NO: 913741 - DNA, 22 bp, Artificial Sequence
  chemically synthesized
tgtttaagtagcagccatttta

SEQ ID NO: 913742 - DNA, 22 bp, Artificial Sequence
  chemically synthesized
gtttaagtagcagccattttat

SEQ ID NO: 913743 - DNA, 22 bp, Artificial Sequence
  chemically synthesized
tttaagtagcagccattttatc

SEQ ID NO: 913744 - DNA, 22 bp, Artificial Sequence
  chemically synthesized
aagtagcagccattttatctgc

SEQ ID NO: 913745 - DNA, 22 bp, Artificial Sequence
  chemically synthesized
agtagcagccattttatctgct

SEQ ID NO: 913746 - DNA, 22 bp, Artificial Sequence
  chemically synthesized
acccacagaataagaagcagat

SEQ ID NO: 913747 - DNA, 22 bp, Artificial Sequence
  chemically synthesized
gacccacagaataagaagcaga

SEQ ID NO: 913748 - DNA, 22 bp, Artificial Sequence
  chemically synthesized
tatctgcttcttattctgtggg

SEQ ID NO: 913749 - DNA, 22 bp, Artificial Sequence
  chemically synthesized
atctgcttcttattctgtgggt

SEQ ID NO: 913750 - DNA, 22 bp, Artificial Sequence
  chemically synthesized
tccaaatccttgacccacagaa

SEQ ID NO: 913751 - DNA, 22 bp, Artificial Sequence
  chemically synthesized
tctgcttcttattctgtgggtc

SEQ ID NO: 913752 - DNA, 22 bp, Artificial Sequence
  chemically synthesized
cttcttattctgtgggtcaagg

SEQ ID NO: 913753 - DNA, 22 bp, Artificial Sequence
  chemically synthesized
agccctatccaaatccttgacc

SEQ ID NO: 913754 - DNA, 22 bp, Artificial Sequence
  chemically synthesized
cttattctgtgggtcaaggatt

SEQ ID NO: 913755 - DNA, 22 bp, Artificial Sequence
  chemically synthesized
ttattctgtgggtcaaggattt

SEQ ID NO: 913756 - DNA, 22 bp, Artificial Sequence
  chemically synthesized
attctgtgggtcaaggatttgg

SEQ ID NO: 913757 - DNA, 22 bp, Artificial Sequence
  chemically synthesized
ttctgtgggtcaaggatttgga

SEQ ID NO: 913758 - DNA, 22 bp, Artificial Sequence
  chemically synthesized
aactgagccctatccaaatcct

SEQ ID NO: 913759 - DNA, 22 bp, Artificial Sequence
  chemically synthesized
tgtgggtcaaggatttggatag

SEQ ID NO: 913760 - DNA, 22 bp, Artificial Sequence
  chemically synthesized
ctcaactgagccctatccaaat

SEQ ID NO: 913761 - DNA, 22 bp, Artificial Sequence
  chemically synthesized
tgggtcaaggatttggataggg

SEQ ID NO: 913762 - DNA, 22 bp, Artificial Sequence
  chemically synthesized
ggatagggctcagttgagcagt

SEQ ID NO: 913763 - DNA, 22 bp, Artificial Sequence
  chemically synthesized
gatagggctcagttgagcagtt

SEQ ID NO: 913764 - DNA, 22 bp, Artificial Sequence
  chemically synthesized
aagccacataaagcagaactgc

SEQ ID NO: 913765 - DNA, 22 bp, Artificial Sequence
  chemically synthesized
agttgagcagttctgctttatg

SEQ ID NO: 913766 - DNA, 22 bp, Artificial Sequence
  chemically synthesized
aaccaagctgaagccacataaa

SEQ ID NO: 913767 - DNA, 22 bp, Artificial Sequence
  chemically synthesized
agcagttctgctttatgtggct

SEQ ID NO: 913768 - DNA, 22 bp, Artificial Sequence
  chemically synthesized
aaaccaagctgaagccacataa

SEQ ID NO: 913769 - DNA, 22 bp, Artificial Sequence
  chemically synthesized
taaaccaagctgaagccacata

SEQ ID NO: 913770 - DNA, 22 bp, Artificial Sequence
  chemically synthesized
ttttaaaccaagctgaagccac

SEQ ID NO: 913771 - DNA, 22 bp, Artificial Sequence
  chemically synthesized
attttaaaccaagctgaagcca

SEQ ID NO: 913772 - DNA, 22 bp, Artificial Sequence
  chemically synthesized
tattttaaaccaagctgaagcc

SEQ ID NO: 913773 - DNA, 22 bp, Artificial Sequence
  chemically synthesized
tgctttatgtggcttcagcttg

SEQ ID NO: 913774 - DNA, 22 bp, Artificial Sequence
  chemically synthesized
ctttatgtggcttcagcttggt

SEQ ID NO: 913775 - DNA, 22 bp, Artificial Sequence
  chemically synthesized
gtgttttattttaaaccaagct

SEQ ID NO: 913776 - DNA, 22 bp, Artificial Sequence
  chemically synthesized
tatgtggcttcagcttggttta

SEQ ID NO: 913777 - DNA, 22 bp, Artificial Sequence
  chemically synthesized
agtgttttattttaaaccaagc

SEQ ID NO: 913778 - DNA, 22 bp, Artificial Sequence
  chemically synthesized
atgtggcttcagcttggtttaa

SEQ ID NO: 913779 - DNA, 22 bp, Artificial Sequence
  chemically synthesized
tgtggcttcagcttggtttaaa

SEQ ID NO: 913780 - DNA, 22 bp, Artificial Sequence
  chemically synthesized
cagcttggtttaaaataaaaca

SEQ ID NO: 913781 - DNA, 22 bp, Artificial Sequence
  chemically synthesized
agcttggtttaaaataaaacac

SEQ ID NO: 913782 - DNA, 22 bp, Artificial Sequence
  chemically synthesized
gcatgtaataatttagtgtttt

SEQ ID NO: 913783 - DNA, 22 bp, Artificial Sequence
  chemically synthesized
agcatgtaataatttagtgttt

SEQ ID NO: 913784 - DNA, 22 bp, Artificial Sequence
  chemically synthesized
ggtttaaaataaaacactaaat

SEQ ID NO: 913785 - DNA, 22 bp, Artificial Sequence
  chemically synthesized
gtttaaaataaaacactaaatt

SEQ ID NO: 913786 - DNA, 22 bp, Artificial Sequence
  chemically synthesized
aaaataaaacactaaattatta

SEQ ID NO: 913787 - DNA, 22 bp, Artificial Sequence
  chemically synthesized
aaataaaacactaaattattac

SEQ ID NO: 913788 - DNA, 22 bp, Artificial Sequence
  chemically synthesized
ggaaaacagtttagcatgtaat

SEQ ID NO: 913789 - DNA, 22 bp, Artificial Sequence
  chemically synthesized
aattattacatgctaaactgtt

SEQ ID NO: 913790 - DNA, 22 bp, Artificial Sequence
  chemically synthesized
ttacatgctaaactgttttccg

SEQ ID NO: 913791 - DNA, 22 bp, Artificial Sequence
  chemically synthesized
tgagtcataattcggaaaacag

SEQ ID NO: 913792 - DNA, 22 bp, Artificial Sequence
  chemically synthesized
catgctaaactgttttccgaat

SEQ ID NO: 913793 - DNA, 22 bp, Artificial Sequence
  chemically synthesized
aactgttttccgaattatgact

SEQ ID NO: 913794 - DNA, 22 bp, Artificial Sequence
  chemically synthesized
aaataaggttgtgagtcataat

SEQ ID NO: 913795 - DNA, 22 bp, Artificial Sequence
  chemically synthesized
ctcaaataaggttgtgagtcat

SEQ ID NO: 913796 - DNA, 22 bp, Artificial Sequence
  chemically synthesized
ttttccgaattatgactcacaa

SEQ ID NO: 913797 - DNA, 22 bp, Artificial Sequence
  chemically synthesized
cctcaaataaggttgtgagtca

SEQ ID NO: 913798 - DNA, 22 bp, Artificial Sequence
  chemically synthesized
tcctcaaataaggttgtgagtc

SEQ ID NO: 913799 - DNA, 22 bp, Artificial Sequence
  chemically synthesized
tccgaattatgactcacaacct

SEQ ID NO: 913800 - DNA, 22 bp, Artificial Sequence
  chemically synthesized
tttcctcaaataaggttgtgag

SEQ ID NO: 913801 - DNA, 22 bp, Artificial Sequence
  chemically synthesized
ccgaattatgactcacaacctt

SEQ ID NO: 913802 - DNA, 22 bp, Artificial Sequence
  chemically synthesized
cgaattatgactcacaacctta

SEQ ID NO: 913803 - DNA, 22 bp, Artificial Sequence
  chemically synthesized
tctttcctcaaataaggttgtg

SEQ ID NO: 913804 - DNA, 22 bp, Artificial Sequence
  chemically synthesized
ctctttcctcaaataaggttgt

SEQ ID NO: 913805 - DNA, 22 bp, Artificial Sequence
  chemically synthesized
tctctttcctcaaataaggttg

SEQ ID NO: 913806 - DNA, 22 bp, Artificial Sequence
  chemically synthesized
ttctctttcctcaaataaggtt

SEQ ID NO: 913807 - DNA, 22 bp, Artificial Sequence
  chemically synthesized
tgactcacaaccttatttgagg

SEQ ID NO: 913808 - DNA, 22 bp, Artificial Sequence
  chemically synthesized
aatcagtttttctctttcctca

SEQ ID NO: 913809 - DNA, 22 bp, Artificial Sequence
  chemically synthesized
acaaccttatttgaggaaagag

SEQ ID NO: 913810 - DNA, 22 bp, Artificial Sequence
  chemically synthesized
aaatcagtttttctctttcctc

SEQ ID NO: 913811 - DNA, 22 bp, Artificial Sequence
  chemically synthesized
taaatcagtttttctctttcct

SEQ ID NO: 913812 - DNA, 22 bp, Artificial Sequence
  chemically synthesized
atttgaggaaagagaaaaactg

SEQ ID NO: 913813 - DNA, 22 bp, Artificial Sequence
  chemically synthesized
agtattttaaatcagtttttct

SEQ ID NO: 913814 - DNA, 22 bp, Artificial Sequence
  chemically synthesized
tttgaggaaagagaaaaactga

SEQ ID NO: 913815 - DNA, 22 bp, Artificial Sequence
  chemically synthesized
gaggaaagagaaaaactgattt

SEQ ID NO: 913816 - DNA, 22 bp, Artificial Sequence
  chemically synthesized
aggaaagagaaaaactgattta

SEQ ID NO: 913817 - DNA, 22 bp, Artificial Sequence
  chemically synthesized
cacgagtacaacatatgttaag

SEQ ID NO: 913818 - DNA, 22 bp, Artificial Sequence
  chemically synthesized
ccacgagtacaacatatgttaa

SEQ ID NO: 913819 - DNA, 22 bp, Artificial Sequence
  chemically synthesized
atttaaaatacttaacatatgt

SEQ ID NO: 913820 - DNA, 22 bp, Artificial Sequence
  chemically synthesized
aaaatacttaacatatgttgta

SEQ ID NO: 913821 - DNA, 22 bp, Artificial Sequence
  chemically synthesized
aaatacttaacatatgttgtac

SEQ ID NO: 913822 - DNA, 22 bp, Artificial Sequence
  chemically synthesized
aaacttccacgagtacaacata

SEQ ID NO: 913823 - DNA, 22 bp, Artificial Sequence
  chemically synthesized
ataattaaaacttccacgagta

SEQ ID NO: 913824 - DNA, 22 bp, Artificial Sequence
  chemically synthesized
aacatatgttgtactcgtggaa

SEQ ID NO: 913825 - DNA, 22 bp, Artificial Sequence
  chemically synthesized
cataattaaaacttccacgagt

SEQ ID NO: 913826 - DNA, 22 bp, Artificial Sequence
  chemically synthesized
acatatgttgtactcgtggaag

SEQ ID NO: 913827 - DNA, 22 bp, Artificial Sequence
  chemically synthesized
tcataattaaaacttccacgag

SEQ ID NO: 913828 - DNA, 22 bp, Artificial Sequence
  chemically synthesized
tatgcattttcataattaaaac

SEQ ID NO: 913829 - DNA, 22 bp, Artificial Sequence
  chemically synthesized
tactcgtggaagttttaattat

SEQ ID NO: 913830 - DNA, 22 bp, Artificial Sequence
  chemically synthesized
gtggaagttttaattatgaaaa

SEQ ID NO: 913831 - DNA, 22 bp, Artificial Sequence
  chemically synthesized
gcatagagttatatgcattttc

SEQ ID NO: 913832 - DNA, 22 bp, Artificial Sequence
  chemically synthesized
attagcatagagttatatgcat

SEQ ID NO: 913833 - DNA, 22 bp, Artificial Sequence
  chemically synthesized
taattatgaaaatgcatataac

SEQ ID NO: 913834 - DNA, 22 bp, Artificial Sequence
  chemically synthesized
aattatgaaaatgcatataact

SEQ ID NO: 913835 - DNA, 22 bp, Artificial Sequence
  chemically synthesized
attatgaaaatgcatataactc

SEQ ID NO: 913836 - DNA, 22 bp, Artificial Sequence
  chemically synthesized
tggctaattagcatagagttat

SEQ ID NO: 913837 - DNA, 22 bp, Artificial Sequence
  chemically synthesized
tgaaaatgcatataactctatg

SEQ ID NO: 913838 - DNA, 22 bp, Artificial Sequence
  chemically synthesized
atggctaattagcatagagtta

SEQ ID NO: 913839 - DNA, 22 bp, Artificial Sequence
  chemically synthesized
tatgctaattagccataaattt

SEQ ID NO: 913840 - DNA, 22 bp, Artificial Sequence
  chemically synthesized
tgctaattagccataaatttat

SEQ ID NO: 913841 - DNA, 22 bp, Artificial Sequence
  chemically synthesized
attagccataaatttattctta

SEQ ID NO: 913842 - DNA, 22 bp, Artificial Sequence
  chemically synthesized
caatcgaatatgtaagaataaa

SEQ ID NO: 913843 - DNA, 22 bp, Artificial Sequence
  chemically synthesized
acaatcgaatatgtaagaataa

SEQ ID NO: 913844 - DNA, 22 bp, Artificial Sequence
  chemically synthesized
gccataaatttattcttacata

SEQ ID NO: 913845 - DNA, 22 bp, Artificial Sequence
  chemically synthesized
tcttacaatcgaatatgtaaga

SEQ ID NO: 913846 - DNA, 22 bp, Artificial Sequence
  chemically synthesized
agctgtcttacaatcgaatatg

SEQ ID NO: 913847 - DNA, 22 bp, Artificial Sequence
  chemically synthesized
ttcagctgtcttacaatcgaat

SEQ ID NO: 913848 - DNA, 22 bp, Artificial Sequence
  chemically synthesized
gttcagctgtcttacaatcgaa

SEQ ID NO: 913849 - DNA, 22 bp, Artificial Sequence
  chemically synthesized
attcttacatattcgattgtaa

SEQ ID NO: 913850 - DNA, 22 bp, Artificial Sequence
  chemically synthesized
tgttcagctgtcttacaatcga

SEQ ID NO: 913851 - DNA, 22 bp, Artificial Sequence
  chemically synthesized
ttcttacatattcgattgtaag

SEQ ID NO: 913852 - DNA, 22 bp, Artificial Sequence
  chemically synthesized
ttacatattcgattgtaagaca

SEQ ID NO: 913853 - DNA, 22 bp, Artificial Sequence
  chemically synthesized
acatattcgattgtaagacagc

SEQ ID NO: 913854 - DNA, 22 bp, Artificial Sequence
  chemically synthesized
catattcgattgtaagacagct

SEQ ID NO: 913855 - DNA, 22 bp, Artificial Sequence
  chemically synthesized
gattgtaagacagctgaacaaa

SEQ ID NO: 913856 - DNA, 22 bp, Artificial Sequence
  chemically synthesized
agcacaaacaattttgttcagc

SEQ ID NO: 913857 - DNA, 22 bp, Artificial Sequence
  chemically synthesized
aagcacaaacaattttgttcag

SEQ ID NO: 913858 - DNA, 22 bp, Artificial Sequence
  chemically synthesized
taagcacaaacaattttgttca

SEQ ID NO: 913859 - DNA, 22 bp, Artificial Sequence
  chemically synthesized
taagacagctgaacaaaattgt

SEQ ID NO: 913860 - DNA, 22 bp, Artificial Sequence
  chemically synthesized
ttttaagcacaaacaattttgt

SEQ ID NO: 913861 - DNA, 22 bp, Artificial Sequence
  chemically synthesized
aattattttaagcacaaacaat

SEQ ID NO: 913862 - DNA, 22 bp, Artificial Sequence
  chemically synthesized
caattattttaagcacaaacaa

SEQ ID NO: 913863 - DNA, 22 bp, Artificial Sequence
  chemically synthesized
tcaattattttaagcacaaaca

SEQ ID NO: 913864 - DNA, 22 bp, Artificial Sequence
  chemically synthesized
aacaaaattgtttgtgcttaaa

SEQ ID NO: 913865 - DNA, 22 bp, Artificial Sequence
  chemically synthesized
tttgtgcttaaaataattgaaa

SEQ ID NO: 913866 - DNA, 22 bp, Artificial Sequence
  chemically synthesized
gtgcttaaaataattgaaaatt

SEQ ID NO: 913867 - DNA, 22 bp, Artificial Sequence
  chemically synthesized
tgcttaaaataattgaaaattt

SEQ ID NO: 913868 - DNA, 22 bp, Artificial Sequence
  chemically synthesized
aaaataattgaaaattttttgt

SEQ ID NO: 913869 - DNA, 22 bp, Artificial Sequence
  chemically synthesized
aaataattgaaaattttttgtt

SEQ ID NO: 913870 - DNA, 22 bp, Artificial Sequence
  chemically synthesized
ccaaaagacaacaaaacaaaaa

SEQ ID NO: 913871 - DNA, 22 bp, Artificial Sequence
  chemically synthesized
aaaattttttgttttgttgtct

SEQ ID NO: 913872 - DNA, 22 bp, Artificial Sequence
  chemically synthesized
cacatagttcccaaaagacaac

SEQ ID NO: 913873 - DNA, 22 bp, Artificial Sequence
  chemically synthesized
tttgttttgttgtcttttggga

SEQ ID NO: 913874 - DNA, 22 bp, Artificial Sequence
  chemically synthesized
ttgttttgttgtcttttgggaa

SEQ ID NO: 913875 - DNA, 22 bp, Artificial Sequence
  chemically synthesized
tgttttgttgtcttttgggaac

SEQ ID NO: 913876 - DNA, 22 bp, Artificial Sequence
  chemically synthesized
gttttgttgtcttttgggaact

SEQ ID NO: 913877 - DNA, 22 bp, Artificial Sequence
  chemically synthesized
ttttgttgtcttttgggaacta

SEQ ID NO: 913878 - DNA, 22 bp, Artificial Sequence
  chemically synthesized
tgttgtcttttgggaactatgt

SEQ ID NO: 913879 - DNA, 22 bp, Artificial Sequence
  chemically synthesized
catggaagctacacatagttcc

SEQ ID NO: 913880 - DNA, 22 bp, Artificial Sequence
  chemically synthesized
gttgtcttttgggaactatgtg

SEQ ID NO: 913881 - DNA, 22 bp, Artificial Sequence
  chemically synthesized
ccatggaagctacacatagttc

SEQ ID NO: 913882 - DNA, 22 bp, Artificial Sequence
  chemically synthesized
ttgtcttttgggaactatgtgt

SEQ ID NO: 913883 - DNA, 22 bp, Artificial Sequence
  chemically synthesized
tcttttgggaactatgtgtagc

SEQ ID NO: 913884 - DNA, 22 bp, Artificial Sequence
  chemically synthesized
aaagcttccatggaagctacac

SEQ ID NO: 913885 - DNA, 22 bp, Artificial Sequence
  chemically synthesized
ttgggaactatgtgtagcttcc

SEQ ID NO: 913886 - DNA, 22 bp, Artificial Sequence
  chemically synthesized
tgggaactatgtgtagcttcca

SEQ ID NO: 913887 - DNA, 22 bp, Artificial Sequence
  chemically synthesized
gggaactatgtgtagcttccat

SEQ ID NO: 913888 - DNA, 22 bp, Artificial Sequence
  chemically synthesized
ggaactatgtgtagcttccatg

SEQ ID NO: 913889 - DNA, 22 bp, Artificial Sequence
  chemically synthesized
agttaaaagcttccatggaagc

SEQ ID NO: 913890 - DNA, 22 bp, Artificial Sequence
  chemically synthesized
cagttaaaagcttccatggaag

SEQ ID NO: 913891 - DNA, 22 bp, Artificial Sequence
  chemically synthesized
tgtgtagcttccatggaagctt

SEQ ID NO: 913892 - DNA, 22 bp, Artificial Sequence
  chemically synthesized
cacttcagttaaaagcttccat

SEQ ID NO: 913893 - DNA, 22 bp, Artificial Sequence
  chemically synthesized
ccatggaagcttttaactgaag

SEQ ID NO: 913894 - DNA, 22 bp, Artificial Sequence
  chemically synthesized
catggaagcttttaactgaagt

SEQ ID NO: 913895 - DNA, 22 bp, Artificial Sequence
  chemically synthesized
tacgtatattacacttcagtta

SEQ ID NO: 913896 - DNA, 22 bp, Artificial Sequence
  chemically synthesized
ttaactgaagtgtaatatacgt

SEQ ID NO: 913897 - DNA, 22 bp, Artificial Sequence
  chemically synthesized
taactgaagtgtaatatacgta

SEQ ID NO: 913898 - DNA, 22 bp, Artificial Sequence
  chemically synthesized
tgcagtgtcctgtacgtatatt

SEQ ID NO: 913899 - DNA, 22 bp, Artificial Sequence
  chemically synthesized
aactgaagtgtaatatacgtac

SEQ ID NO: 913900 - DNA, 22 bp, Artificial Sequence
  chemically synthesized
actgaagtgtaatatacgtaca

SEQ ID NO: 913901 - DNA, 22 bp, Artificial Sequence
  chemically synthesized
aattgtgcagtgtcctgtacgt

SEQ ID NO: 913902 - DNA, 22 bp, Artificial Sequence
  chemically synthesized
aagtgtaatatacgtacaggac

SEQ ID NO: 913903 - DNA, 22 bp, Artificial Sequence
  chemically synthesized
tacagttaaattgtgcagtgtc

SEQ ID NO: 913904 - DNA, 22 bp, Artificial Sequence
  chemically synthesized
ggctatacagttaaattgtgca

SEQ ID NO: 913905 - DNA, 22 bp, Artificial Sequence
  chemically synthesized
ttgggctatacagttaaattgt

SEQ ID NO: 913906 - DNA, 22 bp, Artificial Sequence
  chemically synthesized
aaacactattgggctatacagt

SEQ ID NO: 913907 - DNA, 22 bp, Artificial Sequence
  chemically synthesized
aaaacactattgggctatacag

SEQ ID NO: 913908 - DNA, 22 bp, Artificial Sequence
  chemically synthesized
taaaacactattgggctataca

SEQ ID NO: 913909 - DNA, 22 bp, Artificial Sequence
  chemically synthesized
cacaatttaactgtatagccca

SEQ ID NO: 913910 - DNA, 22 bp, Artificial Sequence
  chemically synthesized
ttaaaacactattgggctatac

SEQ ID NO: 913911 - DNA, 22 bp, Artificial Sequence
  chemically synthesized
aatttttaaaacactattgggc

SEQ ID NO: 913912 - DNA, 22 bp, Artificial Sequence
  chemically synthesized
aactgtatagcccaatagtgtt

SEQ ID NO: 913913 - DNA, 22 bp, Artificial Sequence
  chemically synthesized
actgtatagcccaatagtgttt

SEQ ID NO: 913914 - DNA, 22 bp, Artificial Sequence
  chemically synthesized
tatagcccaatagtgttttaaa

SEQ ID NO: 913915 - DNA, 22 bp, Artificial Sequence
  chemically synthesized
tacagtgtgttcaatttttaaa

SEQ ID NO: 913916 - DNA, 22 bp, Artificial Sequence
  chemically synthesized
gttgtacagtgtgttcaatttt

SEQ ID NO: 913917 - DNA, 22 bp, Artificial Sequence
  chemically synthesized
tggttgtacagtgtgttcaatt

SEQ ID NO: 913918 - DNA, 22 bp, Artificial Sequence
  chemically synthesized
tctggttgtacagtgtgttcaa

SEQ ID NO: 913919 - DNA, 22 bp, Artificial Sequence
  chemically synthesized
ctctggttgtacagtgtgttca

SEQ ID NO: 913920 - DNA, 22 bp, Artificial Sequence
  chemically synthesized
cttctctggttgtacagtgtgt

SEQ ID NO: 913921 - DNA, 22 bp, Artificial Sequence
  chemically synthesized
ccttctctggttgtacagtgtg

SEQ ID NO: 913922 - DNA, 22 bp, Artificial Sequence
  chemically synthesized
taaaaattgaacacactgtaca

SEQ ID NO: 913923 - DNA, 22 bp, Artificial Sequence
  chemically synthesized
aaaaattgaacacactgtacaa

SEQ ID NO: 913924 - DNA, 22 bp, Artificial Sequence
  chemically synthesized
aaaattgaacacactgtacaac

SEQ ID NO: 913925 - DNA, 22 bp, Artificial Sequence
  chemically synthesized
tttccttctctggttgtacagt

SEQ ID NO: 913926 - DNA, 22 bp, Artificial Sequence
  chemically synthesized
tatttccttctctggttgtaca

SEQ ID NO: 913927 - DNA, 22 bp, Artificial Sequence
  chemically synthesized
aacacactgtacaaccagagaa

SEQ ID NO: 913928 - DNA, 22 bp, Artificial Sequence
  chemically synthesized
ataatattctatttccttctct

SEQ ID NO: 913929 - DNA, 22 bp, Artificial Sequence
  chemically synthesized
tgataatattctatttccttct

SEQ ID NO: 913930 - DNA, 22 bp, Artificial Sequence
  chemically synthesized
tacaaccagagaaggaaataga

SEQ ID NO: 913931 - DNA, 22 bp, Artificial Sequence
  chemically synthesized
agattctgataatattctattt

SEQ ID NO: 913932 - DNA, 22 bp, Artificial Sequence
  chemically synthesized
tgagattctgataatattctat

SEQ ID NO: 913933 - DNA, 22 bp, Artificial Sequence
  chemically synthesized
ctgagattctgataatattcta

SEQ ID NO: 913934 - DNA, 22 bp, Artificial Sequence
  chemically synthesized
caaagggataagaggagatttc

SEQ ID NO: 913935 - DNA, 22 bp, Artificial Sequence
  chemically synthesized
tcagaatctcagaaatctcctc

SEQ ID NO: 913936 - DNA, 22 bp, Artificial Sequence
  chemically synthesized
agaaatctcctcttatcccttt

SEQ ID NO: 913937 - DNA, 22 bp, Artificial Sequence
  chemically synthesized
gaggcagtgactgcaaagggat

SEQ ID NO: 913938 - DNA, 22 bp, Artificial Sequence
  chemically synthesized
ggaggcagtgactgcaaaggga

SEQ ID NO: 913939 - DNA, 22 bp, Artificial Sequence
  chemically synthesized
tacttggaggcagtgactgcaa

SEQ ID NO: 913940 - DNA, 22 bp, Artificial Sequence
  chemically synthesized
ctcttatccctttgcagtcact

SEQ ID NO: 913941 - DNA, 22 bp, Artificial Sequence
  chemically synthesized
ttatccctttgcagtcactgcc

SEQ ID NO: 913942 - DNA, 22 bp, Artificial Sequence
  chemically synthesized
gttatacttggaggcagtgact

SEQ ID NO: 913943 - DNA, 22 bp, Artificial Sequence
  chemically synthesized
atccctttgcagtcactgcctc

SEQ ID NO: 913944 - DNA, 22 bp, Artificial Sequence
  chemically synthesized
tccctttgcagtcactgcctcc

SEQ ID NO: 913945 - DNA, 22 bp, Artificial Sequence
  chemically synthesized
tgcagtcactgcctccaagtat

SEQ ID NO: 913946 - DNA, 22 bp, Artificial Sequence
  chemically synthesized
gcagtcactgcctccaagtata

SEQ ID NO: 913947 - DNA, 22 bp, Artificial Sequence
  chemically synthesized
cagtcactgcctccaagtataa

SEQ ID NO: 913948 - DNA, 22 bp, Artificial Sequence
  chemically synthesized
acagggtactggttatacttgg

SEQ ID NO: 913949 - DNA, 22 bp, Artificial Sequence
  chemically synthesized
cctccaagtataaccagtaccc

SEQ ID NO: 913950 - DNA, 22 bp, Artificial Sequence
  chemically synthesized
caagtataaccagtaccctgtc

SEQ ID NO: 913951 - DNA, 22 bp, Artificial Sequence
  chemically synthesized
agtaccggcaaaataatcaaag

SEQ ID NO: 913952 - DNA, 22 bp, Artificial Sequence
  chemically synthesized
tcaactttgattattttgccgg

SEQ ID NO: 913953 - DNA, 22 bp, Artificial Sequence
  chemically synthesized
ataatattcagtaccggcaaaa

SEQ ID NO: 913954 - DNA, 22 bp, Artificial Sequence
  chemically synthesized
cataatattcagtaccggcaaa

SEQ ID NO: 913955 - DNA, 22 bp, Artificial Sequence
  chemically synthesized
tcataatattcagtaccggcaa

SEQ ID NO: 913956 - DNA, 22 bp, Artificial Sequence
  chemically synthesized
tgattattttgccggtactgaa

SEQ ID NO: 913957 - DNA, 22 bp, Artificial Sequence
  chemically synthesized
gattattttgccggtactgaat

SEQ ID NO: 913958 - DNA, 22 bp, Artificial Sequence
  chemically synthesized
cattttcataatattcagtacc

SEQ ID NO: 913959 - DNA, 22 bp, Artificial Sequence
  chemically synthesized
attattttgccggtactgaata

SEQ ID NO: 913960 - DNA, 22 bp, Artificial Sequence
  chemically synthesized
ttttgccggtactgaatattat

SEQ ID NO: 913961 - DNA, 22 bp, Artificial Sequence
  chemically synthesized
tgccggtactgaatattatgaa

SEQ ID NO: 913962 - DNA, 22 bp, Artificial Sequence
  chemically synthesized
gccggtactgaatattatgaaa

SEQ ID NO: 913963 - DNA, 22 bp, Artificial Sequence
  chemically synthesized
ccggtactgaatattatgaaaa

SEQ ID NO: 913964 - DNA, 22 bp, Artificial Sequence
  chemically synthesized
aatattatgaaaatggaattgt

SEQ ID NO: 913965 - DNA, 22 bp, Artificial Sequence
  chemically synthesized
tgaaaatggaattgtatggctt

SEQ ID NO: 913966 - DNA, 22 bp, Artificial Sequence
  chemically synthesized
tatggctttatactcctttgtg

SEQ ID NO: 913967 - DNA, 22 bp, Artificial Sequence
  chemically synthesized
aatgaaaaaggcgagacacaaa

SEQ ID NO: 913968 - DNA, 22 bp, Artificial Sequence
  chemically synthesized
gaatgaaaaaggcgagacacaa

SEQ ID NO: 913969 - DNA, 22 bp, Artificial Sequence
  chemically synthesized
tgaatgaaaaaggcgagacaca

SEQ ID NO: 913970 - DNA, 22 bp, Artificial Sequence
  chemically synthesized
tatactcctttgtgtctcgcct

SEQ ID NO: 913971 - DNA, 22 bp, Artificial Sequence
  chemically synthesized
atactcctttgtgtctcgcctt

SEQ ID NO: 913972 - DNA, 22 bp, Artificial Sequence
  chemically synthesized
tactcctttgtgtctcgccttt

SEQ ID NO: 913973 - DNA, 22 bp, Artificial Sequence
  chemically synthesized
ctttgtgtctcgcctttttcat

SEQ ID NO: 913974 - DNA, 22 bp, Artificial Sequence
  chemically synthesized
tgtgtctcgcctttttcattca

SEQ ID NO: 913975 - DNA, 22 bp, Artificial Sequence
  chemically synthesized
gtgtctcgcctttttcattcaa

SEQ ID NO: 913976 - DNA, 22 bp, Artificial Sequence
  chemically synthesized
tgtctcgcctttttcattcaaa

SEQ ID NO: 913977 - DNA, 22 bp, Artificial Sequence
  chemically synthesized
tcgtaaacataattttgaatga

SEQ ID NO: 913978 - DNA, 22 bp, Artificial Sequence
  chemically synthesized
gcctttttcattcaaaattatg

SEQ ID NO: 913979 - DNA, 22 bp, Artificial Sequence
  chemically synthesized
tttcattcaaaattatgtttac

SEQ ID NO: 913980 - DNA, 22 bp, Artificial Sequence
  chemically synthesized
ttcattcaaaattatgtttacg

SEQ ID NO: 913981 - DNA, 22 bp, Artificial Sequence
  chemically synthesized
tcattcaaaattatgtttacga

SEQ ID NO: 913982 - DNA, 22 bp, Artificial Sequence
  chemically synthesized
cattcaaaattatgtttacgat

SEQ ID NO: 913983 - DNA, 22 bp, Artificial Sequence
  chemically synthesized
attcaaaattatgtttacgata

SEQ ID NO: 913984 - DNA, 22 bp, Artificial Sequence
  chemically synthesized
tatgcaacatggattatcgtaa

SEQ ID NO: 913985 - DNA, 22 bp, Artificial Sequence
  chemically synthesized
aaaattatgtttacgataatcc

SEQ ID NO: 913986 - DNA, 22 bp, Artificial Sequence
  chemically synthesized
aaattatatgcaacatggatta

SEQ ID NO: 913987 - DNA, 22 bp, Artificial Sequence
  chemically synthesized
tgtttacgataatccatgttgc

SEQ ID NO: 913988 - DNA, 22 bp, Artificial Sequence
  chemically synthesized
acgataatccatgttgcatata

SEQ ID NO: 913989 - DNA, 22 bp, Artificial Sequence
  chemically synthesized
cgataatccatgttgcatataa

SEQ ID NO: 913990 - DNA, 22 bp, Artificial Sequence
  chemically synthesized
atgaacagactaaaattatatg

SEQ ID NO: 913991 - DNA, 22 bp, Artificial Sequence
  chemically synthesized
catataattttagtctgttcat

SEQ ID NO: 913992 - DNA, 22 bp, Artificial Sequence
  chemically synthesized
tacagccaggttaatgaacaga

SEQ ID NO: 913993 - DNA, 22 bp, Artificial Sequence
  chemically synthesized
aatgctatacagccaggttaat

SEQ ID NO: 913994 - DNA, 22 bp, Artificial Sequence
  chemically synthesized
tagtctgttcattaacctggct

SEQ ID NO: 913995 - DNA, 22 bp, Artificial Sequence
  chemically synthesized
agtctgttcattaacctggctg

SEQ ID NO: 913996 - DNA, 22 bp, Artificial Sequence
  chemically synthesized
gtctgttcattaacctggctgt

SEQ ID NO: 913997 - DNA, 22 bp, Artificial Sequence
  chemically synthesized
cacaattaaatgctatacagcc

SEQ ID NO: 913998 - DNA, 22 bp, Artificial Sequence
  chemically synthesized
ttcattaacctggctgtatagc

SEQ ID NO: 913999 - DNA, 22 bp, Artificial Sequence
  chemically synthesized
acacaattaaatgctatacagc

SEQ ID NO: 914000 - DNA, 22 bp, Artificial Sequence
  chemically synthesized
attaacctggctgtatagcatt

SEQ ID NO: 914001 - DNA, 22 bp, Artificial Sequence
  chemically synthesized
tatttacacaattaaatgctat

SEQ ID NO: 914002 - DNA, 22 bp, Artificial Sequence
  chemically synthesized
acctggctgtatagcatttaat

SEQ ID NO: 914003 - DNA, 22 bp, Artificial Sequence
  chemically synthesized
gctgtatagcatttaattgtgt

SEQ ID NO: 914004 - DNA, 22 bp, Artificial Sequence
  chemically synthesized
aagtactatatttacacaatta

SEQ ID NO: 914005 - DNA, 22 bp, Artificial Sequence
  chemically synthesized
tatagcatttaattgtgtaaat

SEQ ID NO: 914006 - DNA, 22 bp, Artificial Sequence
  chemically synthesized
aattgtgtaaatatagtacttt

SEQ ID NO: 914007 - DNA, 22 bp, Artificial Sequence
  chemically synthesized
attgtgtaaatatagtacttta

SEQ ID NO: 914008 - DNA, 22 bp, Artificial Sequence
  chemically synthesized
tcacaaatgtccatctaaagta

SEQ ID NO: 914009 - DNA, 22 bp, Artificial Sequence
  chemically synthesized
tgtaaatatagtactttagatg

SEQ ID NO: 914010 - DNA, 22 bp, Artificial Sequence
  chemically synthesized
aattatcacaaatgtccatcta

SEQ ID NO: 914011 - DNA, 22 bp, Artificial Sequence
  chemically synthesized
aaaaaactgaattatcacaaat

SEQ ID NO: 914012 - DNA, 22 bp, Artificial Sequence
  chemically synthesized
tagatggacatttgtgataatt

SEQ ID NO: 914013 - DNA, 22 bp, Artificial Sequence
  chemically synthesized
agatggacatttgtgataattc

SEQ ID NO: 914014 - DNA, 22 bp, Artificial Sequence
  chemically synthesized
gatggacatttgtgataattca

SEQ ID NO: 914015 - DNA, 22 bp, Artificial Sequence
  chemically synthesized
atcattcaaaaaactgaattat

SEQ ID NO: 914016 - DNA, 22 bp, Artificial Sequence
  chemically synthesized
gtgataattcagttttttgaat

SEQ ID NO: 914017 - DNA, 22 bp, Artificial Sequence
  chemically synthesized
tgataattcagttttttgaatg

SEQ ID NO: 914018 - DNA, 22 bp, Artificial Sequence
  chemically synthesized
agttttttgaatgattagctat

SEQ ID NO: 914019 - DNA, 22 bp, Artificial Sequence
  chemically synthesized
aagcaaaaaaaaaaaaatagct

SEQ ID NO: 914020 - DNA, 22 bp, Artificial Sequence
  chemically synthesized
tttgaatgattagctatttttt

SEQ ID NO: 914021 - DNA, 22 bp, Artificial Sequence
  chemically synthesized
gaagcaaaaaaaaaaaaatagc

SEQ ID NO: 914022 - DNA, 22 bp, Artificial Sequence
  chemically synthesized
ttgaatgattagctattttttt

SEQ ID NO: 914023 - DNA, 22 bp, Artificial Sequence
  chemically synthesized
tgaatgattagctatttttttt

SEQ ID NO: 914024 - DNA, 22 bp, Artificial Sequence
  chemically synthesized
gaatgattagctattttttttt

SEQ ID NO: 914025 - DNA, 22 bp, Artificial Sequence
  chemically synthesized
aatgattagctatttttttttt

SEQ ID NO: 914026 - DNA, 22 bp, Artificial Sequence
  chemically synthesized
atttgaagcaaaaaaaaaaaaa

SEQ ID NO: 914027 - DNA, 22 bp, Artificial Sequence
  chemically synthesized
ttaatttgaagcaaaaaaaaaa

SEQ ID NO: 914028 - DNA, 22 bp, Artificial Sequence
  chemically synthesized
gttaatttgaagcaaaaaaaaa

SEQ ID NO: 914029 - DNA, 22 bp, Artificial Sequence
  chemically synthesized
gctatttttttttttttgcttc

SEQ ID NO: 914030 - DNA, 22 bp, Artificial Sequence
  chemically synthesized
tttttttttttttgcttcaaat

SEQ ID NO: 914031 - DNA, 22 bp, Artificial Sequence
  chemically synthesized
ttttttttttgcttcaaattaa

SEQ ID NO: 914032 - DNA, 22 bp, Artificial Sequence
  chemically synthesized
tttttttttgcttcaaattaac

SEQ ID NO: 914033 - DNA, 22 bp, Artificial Sequence
  chemically synthesized
ttttttttgcttcaaattaaca

SEQ ID NO: 914034 - DNA, 22 bp, Artificial Sequence
  chemically synthesized
ccaatacacatttgttaatttg

SEQ ID NO: 914035 - DNA, 22 bp, Artificial Sequence
  chemically synthesized
tttttttgcttcaaattaacaa

SEQ ID NO: 914036 - DNA, 22 bp, Artificial Sequence
  chemically synthesized
ttttttgcttcaaattaacaaa

SEQ ID NO: 914037 - DNA, 22 bp, Artificial Sequence
  chemically synthesized
tttttgcttcaaattaacaaat

SEQ ID NO: 914038 - DNA, 22 bp, Artificial Sequence
  chemically synthesized
ttttgcttcaaattaacaaatg

SEQ ID NO: 914039 - DNA, 22 bp, Artificial Sequence
  chemically synthesized
tttgcttcaaattaacaaatgt

SEQ ID NO: 914040 - DNA, 22 bp, Artificial Sequence
  chemically synthesized
ttgcttcaaattaacaaatgtg

SEQ ID NO: 914041 - DNA, 22 bp, Artificial Sequence
  chemically synthesized
tgcttcaaattaacaaatgtgt

SEQ ID NO: 914042 - DNA, 22 bp, Artificial Sequence
  chemically synthesized
gcttcaaattaacaaatgtgta

SEQ ID NO: 914043 - DNA, 22 bp, Artificial Sequence
  chemically synthesized
cttcaaattaacaaatgtgtat

SEQ ID NO: 914044 - DNA, 22 bp, Artificial Sequence
  chemically synthesized
caaattaacaaatgtgtattgg

SEQ ID NO: 914045 - DNA, 22 bp, Artificial Sequence
  chemically synthesized
aaattaacaaatgtgtattggg

SEQ ID NO: 914046 - DNA, 22 bp, Artificial Sequence
  chemically synthesized
gaaggtagtaagctcccaatac

SEQ ID NO: 914047 - DNA, 22 bp, Artificial Sequence
  chemically synthesized
agaaggtagtaagctcccaata

SEQ ID NO: 914048 - DNA, 22 bp, Artificial Sequence
  chemically synthesized
ttagaaggtagtaagctcccaa

SEQ ID NO: 914049 - DNA, 22 bp, Artificial Sequence
  chemically synthesized
acaaatgtgtattgggagctta

SEQ ID NO: 914050 - DNA, 22 bp, Artificial Sequence
  chemically synthesized
agctcttagaaggtagtaagct

SEQ ID NO: 914051 - DNA, 22 bp, Artificial Sequence
  chemically synthesized
ggagcttactaccttctaagag

SEQ ID NO: 914052 - DNA, 22 bp, Artificial Sequence
  chemically synthesized
atgcccaattgagctcttagaa

SEQ ID NO: 914053 - DNA, 22 bp, Artificial Sequence
  chemically synthesized
actaccttctaagagctcaatt

SEQ ID NO: 914054 - DNA, 22 bp, Artificial Sequence
  chemically synthesized
atcctaatgcccaattgagctc

SEQ ID NO: 914055 - DNA, 22 bp, Artificial Sequence
  chemically synthesized
ctaccttctaagagctcaattg

SEQ ID NO: 914056 - DNA, 22 bp, Artificial Sequence
  chemically synthesized
aatcctaatgcccaattgagct

SEQ ID NO: 914057 - DNA, 22 bp, Artificial Sequence
  chemically synthesized
taatcctaatgcccaattgagc

SEQ ID NO: 914058 - DNA, 22 bp, Artificial Sequence
  chemically synthesized
ccttctaagagctcaattgggc

SEQ ID NO: 914059 - DNA, 22 bp, Artificial Sequence
  chemically synthesized
ctaagagctcaattgggcatta

SEQ ID NO: 914060 - DNA, 22 bp, Artificial Sequence
  chemically synthesized
taagagctcaattgggcattag

SEQ ID NO: 914061 - DNA, 22 bp, Artificial Sequence
  chemically synthesized
agagctcaattgggcattagga

SEQ ID NO: 914062 - DNA, 22 bp, Artificial Sequence
  chemically synthesized
aattgggcattaggattaaaga

SEQ ID NO: 914063 - DNA, 22 bp, Artificial Sequence
  chemically synthesized
ggcattaggattaaagatatat

SEQ ID NO: 914064 - DNA, 22 bp, Artificial Sequence
  chemically synthesized
ggattaaagatatatacgttat

SEQ ID NO: 914065 - DNA, 22 bp, Artificial Sequence
  chemically synthesized
aagacaaggtatataacgtata

SEQ ID NO: 914066 - DNA, 22 bp, Artificial Sequence
  chemically synthesized
aagatatatacgttatatacct

SEQ ID NO: 914067 - DNA, 22 bp, Artificial Sequence
  chemically synthesized
tgaaatcctcaagacaaggtat

SEQ ID NO: 914068 - DNA, 22 bp, Artificial Sequence
  chemically synthesized
actatgaaatcctcaagacaag

SEQ ID NO: 914069 - DNA, 22 bp, Artificial Sequence
  chemically synthesized
attgactatgaaatcctcaaga

SEQ ID NO: 914070 - DNA, 22 bp, Artificial Sequence
  chemically synthesized
tcattgactatgaaatcctcaa

SEQ ID NO: 914071 - DNA, 22 bp, Artificial Sequence
  chemically synthesized
tataccttgtcttgaggatttc

SEQ ID NO: 914072 - DNA, 22 bp, Artificial Sequence
  chemically synthesized
ctcattgactatgaaatcctca

SEQ ID NO: 914073 - DNA, 22 bp, Artificial Sequence
  chemically synthesized
ttctcattgactatgaaatcct

SEQ ID NO: 914074 - DNA, 22 bp, Artificial Sequence
  chemically synthesized
cttctcattgactatgaaatcc

SEQ ID NO: 914075 - DNA, 22 bp, Artificial Sequence
  chemically synthesized
tttcttctcattgactatgaaa

SEQ ID NO: 914076 - DNA, 22 bp, Artificial Sequence
  chemically synthesized
gtttcttctcattgactatgaa

SEQ ID NO: 914077 - DNA, 22 bp, Artificial Sequence
  chemically synthesized
gtcttgaggatttcatagtcaa

SEQ ID NO: 914078 - DNA, 22 bp, Artificial Sequence
  chemically synthesized
tcttgaggatttcatagtcaat

SEQ ID NO: 914079 - DNA, 22 bp, Artificial Sequence
  chemically synthesized
gaggatttcatagtcaatgaga

SEQ ID NO: 914080 - DNA, 22 bp, Artificial Sequence
  chemically synthesized
aggatttcatagtcaatgagaa

SEQ ID NO: 914081 - DNA, 22 bp, Artificial Sequence
  chemically synthesized
catgcttgtttcttctcattga

SEQ ID NO: 914082 - DNA, 22 bp, Artificial Sequence
  chemically synthesized
acatgcttgtttcttctcattg

SEQ ID NO: 914083 - DNA, 22 bp, Artificial Sequence
  chemically synthesized
gcttacatgcttgtttcttctc

SEQ ID NO: 914084 - DNA, 22 bp, Artificial Sequence
  chemically synthesized
ggcttacatgcttgtttcttct

SEQ ID NO: 914085 - DNA, 22 bp, Artificial Sequence
  chemically synthesized
catagtcaatgagaagaaacaa

SEQ ID NO: 914086 - DNA, 22 bp, Artificial Sequence
  chemically synthesized
atagtcaatgagaagaaacaag

SEQ ID NO: 914087 - DNA, 22 bp, Artificial Sequence
  chemically synthesized
atcataatccttggcttacatg

SEQ ID NO: 914088 - DNA, 22 bp, Artificial Sequence
  chemically synthesized
aatcataatccttggcttacat

SEQ ID NO: 914089 - DNA, 22 bp, Artificial Sequence
  chemically synthesized
taatacttaatcataatccttg

SEQ ID NO: 914090 - DNA, 22 bp, Artificial Sequence
  chemically synthesized
ctataatacttaatcataatcc

SEQ ID NO: 914091 - DNA, 22 bp, Artificial Sequence
  chemically synthesized
ctcctataatacttaatcataa

SEQ ID NO: 914092 - DNA, 22 bp, Artificial Sequence
  chemically synthesized
tcctcctataatacttaatcat

SEQ ID NO: 914093 - DNA, 22 bp, Artificial Sequence
  chemically synthesized
ctcctcctataatacttaatca

SEQ ID NO: 914094 - DNA, 22 bp, Artificial Sequence
  chemically synthesized
tgattaagtattataggaggag

SEQ ID NO: 914095 - DNA, 22 bp, Artificial Sequence
  chemically synthesized
ccccagaaataacttctcctcc

SEQ ID NO: 914096 - DNA, 22 bp, Artificial Sequence
  chemically synthesized
agtattataggaggagaagtta

SEQ ID NO: 914097 - DNA, 22 bp, Artificial Sequence
  chemically synthesized
taggaggagaagttatttctgg

SEQ ID NO: 914098 - DNA, 22 bp, Artificial Sequence
  chemically synthesized
ccaagcactgccccagaaataa

SEQ ID NO: 914099 - DNA, 22 bp, Artificial Sequence
  chemically synthesized
ggatgtctcccaagcactgccc

SEQ ID NO: 914100 - DNA, 22 bp, Artificial Sequence
  chemically synthesized
tgggatgtctcccaagcactgc

SEQ ID NO: 914101 - DNA, 22 bp, Artificial Sequence
  chemically synthesized
tctgggatgtctcccaagcact

SEQ ID NO: 914102 - DNA, 22 bp, Artificial Sequence
  chemically synthesized
ctctgggatgtctcccaagcac

SEQ ID NO: 914103 - DNA, 22 bp, Artificial Sequence
  chemically synthesized
tttctggggcagtgcttgggag

SEQ ID NO: 914104 - DNA, 22 bp, Artificial Sequence
  chemically synthesized
ctggggcagtgcttgggagaca

SEQ ID NO: 914105 - DNA, 22 bp, Artificial Sequence
  chemically synthesized
tcttctctgggatgtctcccaa

SEQ ID NO: 914106 - DNA, 22 bp, Artificial Sequence
  chemically synthesized
tggggcagtgcttgggagacat

SEQ ID NO: 914107 - DNA, 22 bp, Artificial Sequence
  chemically synthesized
gggcagtgcttgggagacatcc

SEQ ID NO: 914108 - DNA, 22 bp, Artificial Sequence
  chemically synthesized
agatcattatcttctctgggat

SEQ ID NO: 914109 - DNA, 22 bp, Artificial Sequence
  chemically synthesized
gggagacatcccagagaagata

SEQ ID NO: 914110 - DNA, 22 bp, Artificial Sequence
  chemically synthesized
ggagacatcccagagaagataa

SEQ ID NO: 914111 - DNA, 22 bp, Artificial Sequence
  chemically synthesized
aagactcagatcattatcttct

SEQ ID NO: 914112 - DNA, 22 bp, Artificial Sequence
  chemically synthesized
caagactcagatcattatcttc

SEQ ID NO: 914113 - DNA, 22 bp, Artificial Sequence
  chemically synthesized
atgcttcaagactcagatcatt

SEQ ID NO: 914114 - DNA, 22 bp, Artificial Sequence
  chemically synthesized
catgcttcaagactcagatcat

SEQ ID NO: 914115 - DNA, 22 bp, Artificial Sequence
  chemically synthesized
tcttcatgcttcaagactcaga

SEQ ID NO: 914116 - DNA, 22 bp, Artificial Sequence
  chemically synthesized
atctatcttcatgcttcaagac

SEQ ID NO: 914117 - DNA, 22 bp, Artificial Sequence
  chemically synthesized
caacatgctgatctatcttcat

SEQ ID NO: 914118 - DNA, 22 bp, Artificial Sequence
  chemically synthesized
agtcttgaagcatgaagataga

SEQ ID NO: 914119 - DNA, 22 bp, Artificial Sequence
  chemically synthesized
ctgcaacatgctgatctatctt

SEQ ID NO: 914120 - DNA, 22 bp, Artificial Sequence
  chemically synthesized
ttcctgcaacatgctgatctat

SEQ ID NO: 914121 - DNA, 22 bp, Artificial Sequence
  chemically synthesized
gaagcatgaagatagatcagca

SEQ ID NO: 914122 - DNA, 22 bp, Artificial Sequence
  chemically synthesized
attcctgcaacatgctgatcta

SEQ ID NO: 914123 - DNA, 22 bp, Artificial Sequence
  chemically synthesized
aagcatgaagatagatcagcat

SEQ ID NO: 914124 - DNA, 22 bp, Artificial Sequence
  chemically synthesized
tgtcttattcctgcaacatgct

SEQ ID NO: 914125 - DNA, 22 bp, Artificial Sequence
  chemically synthesized
aacaggctgtgtcttattcctg

SEQ ID NO: 914126 - DNA, 22 bp, Artificial Sequence
  chemically synthesized
gaacaggctgtgtcttattcct

SEQ ID NO: 914127 - DNA, 22 bp, Artificial Sequence
  chemically synthesized
tgaacaggctgtgtcttattcc

SEQ ID NO: 914128 - DNA, 22 bp, Artificial Sequence
  chemically synthesized
tctttgaacaggctgtgtctta

SEQ ID NO: 914129 - DNA, 22 bp, Artificial Sequence
  chemically synthesized
caggaataagacacagcctgtt

SEQ ID NO: 914130 - DNA, 22 bp, Artificial Sequence
  chemically synthesized
aaggccctgtctttgaacaggc

SEQ ID NO: 914131 - DNA, 22 bp, Artificial Sequence
  chemically synthesized
tcaaggccctgtctttgaacag

SEQ ID NO: 914132 - DNA, 22 bp, Artificial Sequence
  chemically synthesized
tctcaaggccctgtctttgaac

SEQ ID NO: 914133 - DNA, 22 bp, Artificial Sequence
  chemically synthesized
tagttctctcaaggccctgtct

SEQ ID NO: 914134 - DNA, 22 bp, Artificial Sequence
  chemically synthesized
ttcaaagacagggccttgagag

SEQ ID NO: 914135 - DNA, 22 bp, Artificial Sequence
  chemically synthesized
aaagacagggccttgagagaac

SEQ ID NO: 914136 - DNA, 22 bp, Artificial Sequence
  chemically synthesized
cagaatgatcgcaactgtagtt

SEQ ID NO: 914137 - DNA, 22 bp, Artificial Sequence
  chemically synthesized
acagaatgatcgcaactgtagt

SEQ ID NO: 914138 - DNA, 22 bp, Artificial Sequence
  chemically synthesized
atttacagaatgatcgcaactg

SEQ ID NO: 914139 - DNA, 22 bp, Artificial Sequence
  chemically synthesized
gagagaactacagttgcgatca

SEQ ID NO: 914140 - DNA, 22 bp, Artificial Sequence
  chemically synthesized
tgatttacagaatgatcgcaac

SEQ ID NO: 914141 - DNA, 22 bp, Artificial Sequence
  chemically synthesized
agagaactacagttgcgatcat

SEQ ID NO: 914142 - DNA, 22 bp, Artificial Sequence
  chemically synthesized
cagttgcgatcattctgtaaat

SEQ ID NO: 914143 - DNA, 22 bp, Artificial Sequence
  chemically synthesized
cgatcattctgtaaatcagaat

SEQ ID NO: 914144 - DNA, 22 bp, Artificial Sequence
  chemically synthesized
tgtaaatcagaatctggttatt

SEQ ID NO: 914145 - DNA, 22 bp, Artificial Sequence
  chemically synthesized
taaatcagaatctggttattgg

SEQ ID NO: 914146 - DNA, 22 bp, Artificial Sequence
  chemically synthesized
aatgaatatatgcaagcataag

SEQ ID NO: 914147 - DNA, 22 bp, Artificial Sequence
  chemically synthesized
gttattggacttatgcttgcat

SEQ ID NO: 914148 - DNA, 22 bp, Artificial Sequence
  chemically synthesized
ttggacttatgcttgcatatat

SEQ ID NO: 914149 - DNA, 22 bp, Artificial Sequence
  chemically synthesized
gacttatgcttgcatatattca

SEQ ID NO: 914150 - DNA, 22 bp, Artificial Sequence
  chemically synthesized
atgcttgcatatattcattcag

SEQ ID NO: 914151 - DNA, 22 bp, Artificial Sequence
  chemically synthesized
tgcttgcatatattcattcagt

SEQ ID NO: 914152 - DNA, 22 bp, Artificial Sequence
  chemically synthesized
tcatataggaaaactgaatgaa

SEQ ID NO: 914153 - DNA, 22 bp, Artificial Sequence
  chemically synthesized
atcatataggaaaactgaatga

SEQ ID NO: 914154 - DNA, 22 bp, Artificial Sequence
  chemically synthesized
ttatcatataggaaaactgaat

SEQ ID NO: 914155 - DNA, 22 bp, Artificial Sequence
  chemically synthesized
gcatatattcattcagttttcc

SEQ ID NO: 914156 - DNA, 22 bp, Artificial Sequence
  chemically synthesized
catatattcattcagttttcct

SEQ ID NO: 914157 - DNA, 22 bp, Artificial Sequence
  chemically synthesized
aacaggctcttatcatatagga

SEQ ID NO: 914158 - DNA, 22 bp, Artificial Sequence
  chemically synthesized
gaacaggctcttatcatatagg

SEQ ID NO: 914159 - DNA, 22 bp, Artificial Sequence
  chemically synthesized
tgaacaggctcttatcatatag

SEQ ID NO: 914160 - DNA, 22 bp, Artificial Sequence
  chemically synthesized
attcagttttcctatatgataa

SEQ ID NO: 914161 - DNA, 22 bp, Artificial Sequence
  chemically synthesized
agttttcctatatgataagagc

SEQ ID NO: 914162 - DNA, 22 bp, Artificial Sequence
  chemically synthesized
tcctatatgataagagcctgtt

SEQ ID NO: 914163 - DNA, 22 bp, Artificial Sequence
  chemically synthesized
cctatatgataagagcctgttc

SEQ ID NO: 914164 - DNA, 22 bp, Artificial Sequence
  chemically synthesized
ctatatgataagagcctgttca

SEQ ID NO: 914165 - DNA, 22 bp, Artificial Sequence
  chemically synthesized
tatgataagagcctgttcaaag

SEQ ID NO: 914166 - DNA, 22 bp, Artificial Sequence
  chemically synthesized
cgtgtcccagaacagactttga

SEQ ID NO: 914167 - DNA, 22 bp, Artificial Sequence
  chemically synthesized
acgtgtcccagaacagactttg

SEQ ID NO: 914168 - DNA, 22 bp, Artificial Sequence
  chemically synthesized
tacgtgtcccagaacagacttt

SEQ ID NO: 914169 - DNA, 22 bp, Artificial Sequence
  chemically synthesized
ttcaaagtctgttctgggacac

SEQ ID NO: 914170 - DNA, 22 bp, Artificial Sequence
  chemically synthesized
aaagtctgttctgggacacgta

SEQ ID NO: 914171 - DNA, 22 bp, Artificial Sequence
  chemically synthesized
ttctgggacacgtaaagttaca

SEQ ID NO: 914172 - DNA, 22 bp, Artificial Sequence
  chemically synthesized
tgggacacgtaaagttacattc

SEQ ID NO: 914173 - DNA, 22 bp, Artificial Sequence
  chemically synthesized
ggacacgtaaagttacattctc

SEQ ID NO: 914174 - DNA, 22 bp, Artificial Sequence
  chemically synthesized
aaagagaatagacagaggggag

SEQ ID NO: 914175 - DNA, 22 bp, Artificial Sequence
  chemically synthesized
aaaagagaatagacagagggga

SEQ ID NO: 914176 - DNA, 22 bp, Artificial Sequence
  chemically synthesized
cattctcccctctgtctattct

SEQ ID NO: 914177 - DNA, 22 bp, Artificial Sequence
  chemically synthesized
tcccctctgtctattctctttt

SEQ ID NO: 914178 - DNA, 22 bp, Artificial Sequence
  chemically synthesized
ccctctgtctattctcttttaa

SEQ ID NO: 914179 - DNA, 22 bp, Artificial Sequence
  chemically synthesized
tgtctattctcttttaaattca

SEQ ID NO: 914180 - DNA, 22 bp, Artificial Sequence
  chemically synthesized
tctattctcttttaaattcatt

SEQ ID NO: 914181 - DNA, 22 bp, Artificial Sequence
  chemically synthesized
ttctcttttaaattcatttata

SEQ ID NO: 914182 - DNA, 22 bp, Artificial Sequence
  chemically synthesized
tcttttaaattcatttatacat

SEQ ID NO: 914183 - DNA, 22 bp, Artificial Sequence
  chemically synthesized
ttttaaattcatttatacattt

SEQ ID NO: 914184 - DNA, 22 bp, Artificial Sequence
  chemically synthesized
ttaaattcatttatacatttat

SEQ ID NO: 914185 - DNA, 22 bp, Artificial Sequence
  chemically synthesized
taaattcatttatacatttatt

SEQ ID NO: 914186 - DNA, 22 bp, Artificial Sequence
  chemically synthesized
taaaaataagcgaataaatgta

SEQ ID NO: 914187 - DNA, 22 bp, Artificial Sequence
  chemically synthesized
aaattcatttatacatttattc

SEQ ID NO: 914188 - DNA, 22 bp, Artificial Sequence
  chemically synthesized
gtaaaaataagcgaataaatgt

SEQ ID NO: 914189 - DNA, 22 bp, Artificial Sequence
  chemically synthesized
aattcatttatacatttattcg

SEQ ID NO: 914190 - DNA, 22 bp, Artificial Sequence
  chemically synthesized
atttatacatttattcgcttat

SEQ ID NO: 914191 - DNA, 22 bp, Artificial Sequence
  chemically synthesized
atacatttattcgcttattttt

SEQ ID NO: 914192 - DNA, 22 bp, Artificial Sequence
  chemically synthesized
tacatttattcgcttattttta

SEQ ID NO: 914193 - DNA, 22 bp, Artificial Sequence
  chemically synthesized
attcgcttatttttacaaatgt

SEQ ID NO: 914194 - DNA, 22 bp, Artificial Sequence
  chemically synthesized
ttcgcttatttttacaaatgtt

SEQ ID NO: 914195 - DNA, 22 bp, Artificial Sequence
  chemically synthesized
gcttatttttacaaatgtttat

SEQ ID NO: 914196 - DNA, 22 bp, Artificial Sequence
  chemically synthesized
aaaacaataaatcataaacatt

SEQ ID NO: 914197 - DNA, 22 bp, Artificial Sequence
  chemically synthesized
atttttacaaatgtttatgatt

SEQ ID NO: 914198 - DNA, 22 bp, Artificial Sequence
  chemically synthesized
tttttacaaatgtttatgattt

SEQ ID NO: 914199 - DNA, 22 bp, Artificial Sequence
  chemically synthesized
ttacaaatgtttatgatttatt

SEQ ID NO: 914200 - DNA, 22 bp, Artificial Sequence
  chemically synthesized
tacaaatgtttatgatttattg

SEQ ID NO: 914201 - DNA, 22 bp, Artificial Sequence
  chemically synthesized
acaaatgtttatgatttattgt

SEQ ID NO: 914202 - DNA, 22 bp, Artificial Sequence
  chemically synthesized
caaaaattaaaaacaataaatc

SEQ ID NO: 914203 - DNA, 22 bp, Artificial Sequence
  chemically synthesized
caaatgtttatgatttattgtt

SEQ ID NO: 914204 - DNA, 22 bp, Artificial Sequence
  chemically synthesized
tgtccctacaaaaattaaaaac

SEQ ID NO: 914205 - DNA, 22 bp, Artificial Sequence
  chemically synthesized
atgatttattgtttttaatttt

SEQ ID NO: 914206 - DNA, 22 bp, Artificial Sequence
  chemically synthesized
tgatttattgtttttaattttt

SEQ ID NO: 914207 - DNA, 22 bp, Artificial Sequence
  chemically synthesized
ctatgtccctacaaaaattaaa

SEQ ID NO: 914208 - DNA, 22 bp, Artificial Sequence
  chemically synthesized
actatgtccctacaaaaattaa

SEQ ID NO: 914209 - DNA, 22 bp, Artificial Sequence
  chemically synthesized
attgtttttaatttttgtaggg

SEQ ID NO: 914210 - DNA, 22 bp, Artificial Sequence
  chemically synthesized
ttgtttttaatttttgtaggga

SEQ ID NO: 914211 - DNA, 22 bp, Artificial Sequence
  chemically synthesized
tttttaatttttgtagggacat

SEQ ID NO: 914212 - DNA, 22 bp, Artificial Sequence
  chemically synthesized
ttaatttttgtagggacatagt

SEQ ID NO: 914213 - DNA, 22 bp, Artificial Sequence
  chemically synthesized
taatttttgtagggacatagta

SEQ ID NO: 914214 - DNA, 22 bp, Artificial Sequence
  chemically synthesized
aatttttgtagggacatagtaa

SEQ ID NO: 914215 - DNA, 22 bp, Artificial Sequence
  chemically synthesized
atttttgtagggacatagtaag

SEQ ID NO: 914216 - DNA, 22 bp, Artificial Sequence
  chemically synthesized
caagtacatacacttactatgt

SEQ ID NO: 914217 - DNA, 22 bp, Artificial Sequence
  chemically synthesized
ttgtagggacatagtaagtgta

SEQ ID NO: 914218 - DNA, 22 bp, Artificial Sequence
  chemically synthesized
tgtagggacatagtaagtgtat

SEQ ID NO: 914219 - DNA, 22 bp, Artificial Sequence
  chemically synthesized
gtagggacatagtaagtgtatg

SEQ ID NO: 914220 - DNA, 22 bp, Artificial Sequence
  chemically synthesized
tagggacatagtaagtgtatgt

SEQ ID NO: 914221 - DNA, 22 bp, Artificial Sequence
  chemically synthesized
acgtaccctacaagtacataca

SEQ ID NO: 914222 - DNA, 22 bp, Artificial Sequence
  chemically synthesized
catgcgtgtatcaaaatatctc

SEQ ID NO: 914223 - DNA, 22 bp, Artificial Sequence
  chemically synthesized
gtagggtacgtgagatattttg

SEQ ID NO: 914224 - DNA, 22 bp, Artificial Sequence
  chemically synthesized
tagggtacgtgagatattttga

SEQ ID NO: 914225 - DNA, 22 bp, Artificial Sequence
  chemically synthesized
attgcatgcgtgtatcaaaata

SEQ ID NO: 914226 - DNA, 22 bp, Artificial Sequence
  chemically synthesized
tcattgcatgcgtgtatcaaaa

SEQ ID NO: 914227 - DNA, 22 bp, Artificial Sequence
  chemically synthesized
ctcattgcatgcgtgtatcaaa

SEQ ID NO: 914228 - DNA, 22 bp, Artificial Sequence
  chemically synthesized
tttctcattgcatgcgtgtatc

SEQ ID NO: 914229 - DNA, 22 bp, Artificial Sequence
  chemically synthesized
atttctcattgcatgcgtgtat

SEQ ID NO: 914230 - DNA, 22 bp, Artificial Sequence
  chemically synthesized
tgatacacgcatgcaatgagaa

SEQ ID NO: 914231 - DNA, 22 bp, Artificial Sequence
  chemically synthesized
gatacacgcatgcaatgagaaa

SEQ ID NO: 914232 - DNA, 22 bp, Artificial Sequence
  chemically synthesized
atacacgcatgcaatgagaaat

SEQ ID NO: 914233 - DNA, 22 bp, Artificial Sequence
  chemically synthesized
ccagtgtcccaggaatgaacag

SEQ ID NO: 914234 - DNA, 22 bp, Artificial Sequence
  chemically synthesized
ctcccagtgtcccaggaatgaa

SEQ ID NO: 914235 - DNA, 22 bp, Artificial Sequence
  chemically synthesized
ttcattcctgggacactgggag

SEQ ID NO: 914236 - DNA, 22 bp, Artificial Sequence
  chemically synthesized
aaaacagaccctgctcccagtg

SEQ ID NO: 914237 - DNA, 22 bp, Artificial Sequence
  chemically synthesized
attcctgggacactgggagcag

SEQ ID NO: 914238 - DNA, 22 bp, Artificial Sequence
  chemically synthesized
ctgggacactgggagcagggtc

SEQ ID NO: 914239 - DNA, 22 bp, Artificial Sequence
  chemically synthesized
ggacactgggagcagggtctgt

SEQ ID NO: 914240 - DNA, 22 bp, Artificial Sequence
  chemically synthesized
gggataggttaaaaacagaccc

SEQ ID NO: 914241 - DNA, 22 bp, Artificial Sequence
  chemically synthesized
tattcgggataggttaaaaaca

SEQ ID NO: 914242 - DNA, 22 bp, Artificial Sequence
  chemically synthesized
ggagcagggtctgtttttaacc

SEQ ID NO: 914243 - DNA, 22 bp, Artificial Sequence
  chemically synthesized
gatcagatgttatattcgggat

SEQ ID NO: 914244 - DNA, 22 bp, Artificial Sequence
  chemically synthesized
tttttaacctatcccgaatata

SEQ ID NO: 914245 - DNA, 22 bp, Artificial Sequence
  chemically synthesized
tagatcagatgttatattcggg

SEQ ID NO: 914246 - DNA, 22 bp, Artificial Sequence
  chemically synthesized
ctagatcagatgttatattcgg

SEQ ID NO: 914247 - DNA, 22 bp, Artificial Sequence
  chemically synthesized
ttaacctatcccgaatataaca

SEQ ID NO: 914248 - DNA, 22 bp, Artificial Sequence
  chemically synthesized
taacctatcccgaatataacat

SEQ ID NO: 914249 - DNA, 22 bp, Artificial Sequence
  chemically synthesized
aacctatcccgaatataacatc

SEQ ID NO: 914250 - DNA, 22 bp, Artificial Sequence
  chemically synthesized
acctatcccgaatataacatct

SEQ ID NO: 914251 - DNA, 22 bp, Artificial Sequence
  chemically synthesized
tcccgaatataacatctgatct

SEQ ID NO: 914252 - DNA, 22 bp, Artificial Sequence
  chemically synthesized
ccagtcagataaggcagaagta

SEQ ID NO: 914253 - DNA, 22 bp, Artificial Sequence
  chemically synthesized
cccagtcagataaggcagaagt

SEQ ID NO: 914254 - DNA, 22 bp, Artificial Sequence
  chemically synthesized
atctagaagtacttctgcctta

SEQ ID NO: 914255 - DNA, 22 bp, Artificial Sequence
  chemically synthesized
atcttcccagtcagataaggca

SEQ ID NO: 914256 - DNA, 22 bp, Artificial Sequence
  chemically synthesized
gaagtacttctgccttatctga

SEQ ID NO: 914257 - DNA, 22 bp, Artificial Sequence
  chemically synthesized
ctgccttatctgactgggaaga

SEQ ID NO: 914258 - DNA, 22 bp, Artificial Sequence
  chemically synthesized
tgccttatctgactgggaagat

SEQ ID NO: 914259 - DNA, 22 bp, Artificial Sequence
  chemically synthesized
ccttatctgactgggaagatga

SEQ ID NO: 914260 - DNA, 22 bp, Artificial Sequence
  chemically synthesized
aagtaaatagcattcatcttcc

SEQ ID NO: 914261 - DNA, 22 bp, Artificial Sequence
  chemically synthesized
atctgactgggaagatgaatgc

SEQ ID NO: 914262 - DNA, 22 bp, Artificial Sequence
  chemically synthesized
tctgactgggaagatgaatgct

SEQ ID NO: 914263 - DNA, 22 bp, Artificial Sequence
  chemically synthesized
agctgaagtaaatagcattcat

SEQ ID NO: 914264 - DNA, 22 bp, Artificial Sequence
  chemically synthesized
tcagctgaagtaaatagcattc

SEQ ID NO: 914265 - DNA, 22 bp, Artificial Sequence
  chemically synthesized
actgggaagatgaatgctattt

SEQ ID NO: 914266 - DNA, 22 bp, Artificial Sequence
  chemically synthesized
ggaagatgaatgctatttactt

SEQ ID NO: 914267 - DNA, 22 bp, Artificial Sequence
  chemically synthesized
tttacttcagctgagagtatat

SEQ ID NO: 914268 - DNA, 22 bp, Artificial Sequence
  chemically synthesized
acttcagctgagagtatatttt

SEQ ID NO: 914269 - DNA, 22 bp, Artificial Sequence
  chemically synthesized
cttcagctgagagtatattttg

SEQ ID NO: 914270 - DNA, 22 bp, Artificial Sequence
  chemically synthesized
cagctgagagtatattttgttg

SEQ ID NO: 914271 - DNA, 22 bp, Artificial Sequence
  chemically synthesized
agctgagagtatattttgttgt

SEQ ID NO: 914272 - DNA, 22 bp, Artificial Sequence
  chemically synthesized
cccaaaatatatgagacaacaa

SEQ ID NO: 914273 - DNA, 22 bp, Artificial Sequence
  chemically synthesized
ccccaaaatatatgagacaaca

SEQ ID NO: 914274 - DNA, 22 bp, Artificial Sequence
  chemically synthesized
agagtatattttgttgtctcat

SEQ ID NO: 914275 - DNA, 22 bp, Artificial Sequence
  chemically synthesized
gtagtttccccaaaatatatga

SEQ ID NO: 914276 - DNA, 22 bp, Artificial Sequence
  chemically synthesized
tgttgtctcatatattttgggg

SEQ ID NO: 914277 - DNA, 22 bp, Artificial Sequence
  chemically synthesized
aactagtagtttccccaaaata

SEQ ID NO: 914278 - DNA, 22 bp, Artificial Sequence
  chemically synthesized
gttgtctcatatattttgggga

SEQ ID NO: 914279 - DNA, 22 bp, Artificial Sequence
  chemically synthesized
ttgtctcatatattttggggaa

SEQ ID NO: 914280 - DNA, 22 bp, Artificial Sequence
  chemically synthesized
ttaaactagtagtttccccaaa

SEQ ID NO: 914281 - DNA, 22 bp, Artificial Sequence
  chemically synthesized
attaaactagtagtttccccaa

SEQ ID NO: 914282 - DNA, 22 bp, Artificial Sequence
  chemically synthesized
tctcatatattttggggaaact

SEQ ID NO: 914283 - DNA, 22 bp, Artificial Sequence
  chemically synthesized
atttattaaactagtagtttcc

SEQ ID NO: 914284 - DNA, 22 bp, Artificial Sequence
  chemically synthesized
atatattttggggaaactacta

SEQ ID NO: 914285 - DNA, 22 bp, Artificial Sequence
  chemically synthesized
gatttattaaactagtagtttc

SEQ ID NO: 914286 - DNA, 22 bp, Artificial Sequence
  chemically synthesized
ttgatttattaaactagtagtt

SEQ ID NO: 914287 - DNA, 22 bp, Artificial Sequence
  chemically synthesized
tggggaaactactagtttaata

SEQ ID NO: 914288 - DNA, 22 bp, Artificial Sequence
  chemically synthesized
ggggaaactactagtttaataa

SEQ ID NO: 914289 - DNA, 22 bp, Artificial Sequence
  chemically synthesized
gggaaactactagtttaataaa

SEQ ID NO: 914290 - DNA, 22 bp, Artificial Sequence
  chemically synthesized
cagatctcttgatttattaaac

SEQ ID NO: 914291 - DNA, 22 bp, Artificial Sequence
  chemically synthesized
ctagtttaataaatcaagagat

SEQ ID NO: 914292 - DNA, 22 bp, Artificial Sequence
  chemically synthesized
cccgagctccagatctcttgat

SEQ ID NO: 914293 - DNA, 22 bp, Artificial Sequence
  chemically synthesized
tccccgagctccagatctcttg

SEQ ID NO: 914294 - DNA, 22 bp, Artificial Sequence
  chemically synthesized
gtttaataaatcaagagatctg

SEQ ID NO: 914295 - DNA, 22 bp, Artificial Sequence
  chemically synthesized
tctccccgagctccagatctct

SEQ ID NO: 914296 - DNA, 22 bp, Artificial Sequence
  chemically synthesized
aataaatcaagagatctggagc

SEQ ID NO: 914297 - DNA, 22 bp, Artificial Sequence
  chemically synthesized
ctctctccccgagctccagatc

SEQ ID NO: 914298 - DNA, 22 bp, Artificial Sequence
  chemically synthesized
ataaatcaagagatctggagct

SEQ ID NO: 914299 - DNA, 22 bp, Artificial Sequence
  chemically synthesized
cctctctccccgagctccagat

SEQ ID NO: 914300 - DNA, 22 bp, Artificial Sequence
  chemically synthesized
tcctctctccccgagctccaga

SEQ ID NO: 914301 - DNA, 22 bp, Artificial Sequence
  chemically synthesized
cagctttcctctctccccgagc

SEQ ID NO: 914302 - DNA, 22 bp, Artificial Sequence
  chemically synthesized
ccagctttcctctctccccgag

SEQ ID NO: 914303 - DNA, 22 bp, Artificial Sequence
  chemically synthesized
tttccagctttcctctctcccc

SEQ ID NO: 914304 - DNA, 22 bp, Artificial Sequence
  chemically synthesized
atttccagctttcctctctccc

SEQ ID NO: 914305 - DNA, 22 bp, Artificial Sequence
  chemically synthesized
gagctcggggagagaggaaagc

SEQ ID NO: 914306 - DNA, 22 bp, Artificial Sequence
  chemically synthesized
aagtccttatttccagctttcc

SEQ ID NO: 914307 - DNA, 22 bp, Artificial Sequence
  chemically synthesized
ggggagagaggaaagctggaaa

SEQ ID NO: 914308 - DNA, 22 bp, Artificial Sequence
  chemically synthesized
atgactaaagtccttatttcca

SEQ ID NO: 914309 - DNA, 22 bp, Artificial Sequence
  chemically synthesized
ctaatgactaaagtccttattt

SEQ ID NO: 914310 - DNA, 22 bp, Artificial Sequence
  chemically synthesized
attgctaatgactaaagtcctt

SEQ ID NO: 914311 - DNA, 22 bp, Artificial Sequence
  chemically synthesized
gaaataaggactttagtcatta

SEQ ID NO: 914312 - DNA, 22 bp, Artificial Sequence
  chemically synthesized
ccaactgattgctaatgactaa

SEQ ID NO: 914313 - DNA, 22 bp, Artificial Sequence
  chemically synthesized
tgccaactgattgctaatgact

SEQ ID NO: 914314 - DNA, 22 bp, Artificial Sequence
  chemically synthesized
tctgccaactgattgctaatga

SEQ ID NO: 914315 - DNA, 22 bp, Artificial Sequence
  chemically synthesized
ctctgccaactgattgctaatg

SEQ ID NO: 914316 - DNA, 22 bp, Artificial Sequence
  chemically synthesized
tctctgccaactgattgctaat

SEQ ID NO: 914317 - DNA, 22 bp, Artificial Sequence
  chemically synthesized
tagtcattagcaatcagttggc

SEQ ID NO: 914318 - DNA, 22 bp, Artificial Sequence
  chemically synthesized
agtcattagcaatcagttggca

SEQ ID NO: 914319 - DNA, 22 bp, Artificial Sequence
  chemically synthesized
ccgtgttttctctgccaactga

SEQ ID NO: 914320 - DNA, 22 bp, Artificial Sequence
  chemically synthesized
gtcattagcaatcagttggcag

SEQ ID NO: 914321 - DNA, 22 bp, Artificial Sequence
  chemically synthesized
accgtgttttctctgccaactg

SEQ ID NO: 914322 - DNA, 22 bp, Artificial Sequence
  chemically synthesized
gtttaccgtgttttctctgcca

SEQ ID NO: 914323 - DNA, 22 bp, Artificial Sequence
  chemically synthesized
gcaatcagttggcagagaaaac

SEQ ID NO: 914324 - DNA, 22 bp, Artificial Sequence
  chemically synthesized
aaaagttagtttaccgtgtttt

SEQ ID NO: 914325 - DNA, 22 bp, Artificial Sequence
  chemically synthesized
gttcaaaagttagtttaccgtg

SEQ ID NO: 914326 - DNA, 22 bp, Artificial Sequence
  chemically synthesized
gcagagaaaacacggtaaacta

SEQ ID NO: 914327 - DNA, 22 bp, Artificial Sequence
  chemically synthesized
ttagttcaaaagttagtttacc

SEQ ID NO: 914328 - DNA, 22 bp, Artificial Sequence
  chemically synthesized
attattagttcaaaagttagtt

SEQ ID NO: 914329 - DNA, 22 bp, Artificial Sequence
  chemically synthesized
acttttgaactaataattaaca

SEQ ID NO: 914330 - DNA, 22 bp, Artificial Sequence
  chemically synthesized
ttgaactaataattaacatttc

SEQ ID NO: 914331 - DNA, 22 bp, Artificial Sequence
  chemically synthesized
tgaactaataattaacatttca

SEQ ID NO: 914332 - DNA, 22 bp, Artificial Sequence
  chemically synthesized
gaactaataattaacatttcat

SEQ ID NO: 914333 - DNA, 22 bp, Artificial Sequence
  chemically synthesized
aactaataattaacatttcatg

SEQ ID NO: 914334 - DNA, 22 bp, Artificial Sequence
  chemically synthesized
agaaaatagcaaacatgaaatg

SEQ ID NO: 914335 - DNA, 22 bp, Artificial Sequence
  chemically synthesized
ataattaacatttcatgtttgc

SEQ ID NO: 914336 - DNA, 22 bp, Artificial Sequence
  chemically synthesized
acatttcatgtttgctattttc

SEQ ID NO: 914337 - DNA, 22 bp, Artificial Sequence
  chemically synthesized
catgtttgctattttctgagtc

SEQ ID NO: 914338 - DNA, 22 bp, Artificial Sequence
  chemically synthesized
atgtttgctattttctgagtcc

SEQ ID NO: 914339 - DNA, 22 bp, Artificial Sequence
  chemically synthesized
gctattttctgagtccattctt

SEQ ID NO: 914340 - DNA, 22 bp, Artificial Sequence
  chemically synthesized
ataaaacgaagaaagaatggac

SEQ ID NO: 914341 - DNA, 22 bp, Artificial Sequence
  chemically synthesized
ctattttctgagtccattcttt

SEQ ID NO: 914342 - DNA, 22 bp, Artificial Sequence
  chemically synthesized
ttttctgagtccattctttctt

SEQ ID NO: 914343 - DNA, 22 bp, Artificial Sequence
  chemically synthesized
aaattcataaaacgaagaaaga

SEQ ID NO: 914344 - DNA, 22 bp, Artificial Sequence
  chemically synthesized
tctgagtccattctttcttcgt

SEQ ID NO: 914345 - DNA, 22 bp, Artificial Sequence
  chemically synthesized
ctgagtccattctttcttcgtt

SEQ ID NO: 914346 - DNA, 22 bp, Artificial Sequence
  chemically synthesized
tgagtccattctttcttcgttt

SEQ ID NO: 914347 - DNA, 22 bp, Artificial Sequence
  chemically synthesized
agtccattctttcttcgtttta

SEQ ID NO: 914348 - DNA, 22 bp, Artificial Sequence
  chemically synthesized
tcaatgattaaaattcataaaa

SEQ ID NO: 914349 - DNA, 22 bp, Artificial Sequence
  chemically synthesized
tttcttcgttttatgaatttta

SEQ ID NO: 914350 - DNA, 22 bp, Artificial Sequence
  chemically synthesized
tcttcgttttatgaattttaat

SEQ ID NO: 914351 - DNA, 22 bp, Artificial Sequence
  chemically synthesized
cttcgttttatgaattttaatc

SEQ ID NO: 914352 - DNA, 22 bp, Artificial Sequence
  chemically synthesized
ttcgttttatgaattttaatca

SEQ ID NO: 914353 - DNA, 22 bp, Artificial Sequence
  chemically synthesized
cgttttatgaattttaatcatt

SEQ ID NO: 914354 - DNA, 22 bp, Artificial Sequence
  chemically synthesized
gttttatgaattttaatcattg

SEQ ID NO: 914355 - DNA, 22 bp, Artificial Sequence
  chemically synthesized
tatgaattttaatcattgacaa

SEQ ID NO: 914356 - DNA, 22 bp, Artificial Sequence
  chemically synthesized
aataagagagaattgtcaatga

SEQ ID NO: 914357 - DNA, 22 bp, Artificial Sequence
  chemically synthesized
atgaattttaatcattgacaat

SEQ ID NO: 914358 - DNA, 22 bp, Artificial Sequence
  chemically synthesized
aaataagagagaattgtcaatg

SEQ ID NO: 914359 - DNA, 22 bp, Artificial Sequence
  chemically synthesized
tgaattttaatcattgacaatt

SEQ ID NO: 914360 - DNA, 22 bp, Artificial Sequence
  chemically synthesized
aatttaaataagagagaattgt

SEQ ID NO: 914361 - DNA, 22 bp, Artificial Sequence
  chemically synthesized
caatttaaataagagagaattg

SEQ ID NO: 914362 - DNA, 22 bp, Artificial Sequence
  chemically synthesized
tcaatttaaataagagagaatt

SEQ ID NO: 914363 - DNA, 22 bp, Artificial Sequence
  chemically synthesized
taatcattgacaattctctctt

SEQ ID NO: 914364 - DNA, 22 bp, Artificial Sequence
  chemically synthesized
ttcaatttaaataagagagaat

SEQ ID NO: 914365 - DNA, 22 bp, Artificial Sequence
  chemically synthesized
aatcattgacaattctctctta

SEQ ID NO: 914366 - DNA, 22 bp, Artificial Sequence
  chemically synthesized
atcattgacaattctctcttat

SEQ ID NO: 914367 - DNA, 22 bp, Artificial Sequence
  chemically synthesized
tttttcaatttaaataagagag

SEQ ID NO: 914368 - DNA, 22 bp, Artificial Sequence
  chemically synthesized
ctatttttcaatttaaataaga

SEQ ID NO: 914369 - DNA, 22 bp, Artificial Sequence
  chemically synthesized
cctatttttcaatttaaataag

SEQ ID NO: 914370 - DNA, 22 bp, Artificial Sequence
  chemically synthesized
tcctatttttcaatttaaataa

SEQ ID NO: 914371 - DNA, 22 bp, Artificial Sequence
  chemically synthesized
acaattctctcttatttaaatt

SEQ ID NO: 914372 - DNA, 22 bp, Artificial Sequence
  chemically synthesized
ttcctatttttcaatttaaata

SEQ ID NO: 914373 - DNA, 22 bp, Artificial Sequence
  chemically synthesized
acttttcctatttttcaattta

SEQ ID NO: 914374 - DNA, 22 bp, Artificial Sequence
  chemically synthesized
tctcttatttaaattgaaaaat

SEQ ID NO: 914375 - DNA, 22 bp, Artificial Sequence
  chemically synthesized
tcttatttaaattgaaaaatag

SEQ ID NO: 914376 - DNA, 22 bp, Artificial Sequence
  chemically synthesized
aaattgacttttcctatttttc

SEQ ID NO: 914377 - DNA, 22 bp, Artificial Sequence
  chemically synthesized
ttatttaaattgaaaaatagga

SEQ ID NO: 914378 - DNA, 22 bp, Artificial Sequence
  chemically synthesized
gaaattgacttttcctattttt

SEQ ID NO: 914379 - DNA, 22 bp, Artificial Sequence
  chemically synthesized
tgaaattgacttttcctatttt

SEQ ID NO: 914380 - DNA, 22 bp, Artificial Sequence
  chemically synthesized
atttaaattgaaaaataggaaa

SEQ ID NO: 914381 - DNA, 22 bp, Artificial Sequence
  chemically synthesized
tttaaattgaaaaataggaaaa

SEQ ID NO: 914382 - DNA, 22 bp, Artificial Sequence
  chemically synthesized
aaattgaaaaataggaaaagtc

SEQ ID NO: 914383 - DNA, 22 bp, Artificial Sequence
  chemically synthesized
aattgaaaaataggaaaagtca

SEQ ID NO: 914384 - DNA, 22 bp, Artificial Sequence
  chemically synthesized
aaaaataggaaaagtcaatttc

SEQ ID NO: 914385 - DNA, 22 bp, Artificial Sequence
  chemically synthesized
accatacataagaaatcaacaa

SEQ ID NO: 914386 - DNA, 22 bp, Artificial Sequence
  chemically synthesized
caaagccttttgttgatttctt

SEQ ID NO: 914387 - DNA, 22 bp, Artificial Sequence
  chemically synthesized
aaagccttttgttgatttctta

SEQ ID NO: 914388 - DNA, 22 bp, Artificial Sequence
  chemically synthesized
ttgttgatttcttatgtatggt

SEQ ID NO: 914389 - DNA, 22 bp, Artificial Sequence
  chemically synthesized
tgttgatttcttatgtatggtt

SEQ ID NO: 914390 - DNA, 22 bp, Artificial Sequence
  chemically synthesized
gttgatttcttatgtatggtta

SEQ ID NO: 914391 - DNA, 22 bp, Artificial Sequence
  chemically synthesized
ttgatttcttatgtatggttaa

SEQ ID NO: 914392 - DNA, 22 bp, Artificial Sequence
  chemically synthesized
atttcttatgtatggttaacct

SEQ ID NO: 914393 - DNA, 22 bp, Artificial Sequence
  chemically synthesized
cttatgtatggttaaccttacg

SEQ ID NO: 914394 - DNA, 22 bp, Artificial Sequence
  chemically synthesized
ttatgtatggttaaccttacgg

SEQ ID NO: 914395 - DNA, 22 bp, Artificial Sequence
  chemically synthesized
atgtatggttaaccttacggtt

SEQ ID NO: 914396 - DNA, 22 bp, Artificial Sequence
  chemically synthesized
tgtatggttaaccttacggttc

SEQ ID NO: 914397 - DNA, 22 bp, Artificial Sequence
  chemically synthesized
accttacggttcctcctcttct

SEQ ID NO: 914398 - DNA, 22 bp, Artificial Sequence
  chemically synthesized
acggttcctcctcttcttctac

SEQ ID NO: 914399 - DNA, 22 bp, Artificial Sequence
  chemically synthesized
cggttcctcctcttcttctact

SEQ ID NO: 914400 - DNA, 22 bp, Artificial Sequence
  chemically synthesized
catggccaagcacatagagtag

SEQ ID NO: 914401 - DNA, 22 bp, Artificial Sequence
  chemically synthesized
ctcctcttcttctactctatgt

SEQ ID NO: 914402 - DNA, 22 bp, Artificial Sequence
  chemically synthesized
ccatggccaagcacatagagta

SEQ ID NO: 914403 - DNA, 22 bp, Artificial Sequence
  chemically synthesized
tccatggccaagcacatagagt

SEQ ID NO: 914404 - DNA, 22 bp, Artificial Sequence
  chemically synthesized
ctcttcttctactctatgtgct

SEQ ID NO: 914405 - DNA, 22 bp, Artificial Sequence
  chemically synthesized
gctttccatggccaagcacata

SEQ ID NO: 914406 - DNA, 22 bp, Artificial Sequence
  chemically synthesized
ttcttctactctatgtgcttgg

SEQ ID NO: 914407 - DNA, 22 bp, Artificial Sequence
  chemically synthesized
ggctttccatggccaagcacat

SEQ ID NO: 914408 - DNA, 22 bp, Artificial Sequence
  chemically synthesized
tggctttccatggccaagcaca

SEQ ID NO: 914409 - DNA, 22 bp, Artificial Sequence
  chemically synthesized
cttctactctatgtgcttggcc

SEQ ID NO: 914410 - DNA, 22 bp, Artificial Sequence
  chemically synthesized
ttctactctatgtgcttggcca

SEQ ID NO: 914411 - DNA, 22 bp, Artificial Sequence
  chemically synthesized
ctttggctttccatggccaagc

SEQ ID NO: 914412 - DNA, 22 bp, Artificial Sequence
  chemically synthesized
ctactctatgtgcttggccatg

SEQ ID NO: 914413 - DNA, 22 bp, Artificial Sequence
  chemically synthesized
tactctatgtgcttggccatgg

SEQ ID NO: 914414 - DNA, 22 bp, Artificial Sequence
  chemically synthesized
ctctatgtgcttggccatggaa

SEQ ID NO: 914415 - DNA, 22 bp, Artificial Sequence
  chemically synthesized
tatgtgcttggccatggaaagc

SEQ ID NO: 914416 - DNA, 22 bp, Artificial Sequence
  chemically synthesized
tgtgcttggccatggaaagcca

SEQ ID NO: 914417 - DNA, 22 bp, Artificial Sequence
  chemically synthesized
ggccatggaaagccaaaggaat

SEQ ID NO: 914418 - DNA, 22 bp, Artificial Sequence
  chemically synthesized
gccatggaaagccaaaggaatg

SEQ ID NO: 914419 - DNA, 22 bp, Artificial Sequence
  chemically synthesized
gagaggccagaagagcaccgta

SEQ ID NO: 914420 - DNA, 22 bp, Artificial Sequence
  chemically synthesized
ggagaggccagaagagcaccgt

SEQ ID NO: 914421 - DNA, 22 bp, Artificial Sequence
  chemically synthesized
tggagaggccagaagagcaccg

SEQ ID NO: 914422 - DNA, 22 bp, Artificial Sequence
  chemically synthesized
ttggagaggccagaagagcacc

SEQ ID NO: 914423 - DNA, 22 bp, Artificial Sequence
  chemically synthesized
tgtagcttttggagaggccaga

SEQ ID NO: 914424 - DNA, 22 bp, Artificial Sequence
  chemically synthesized
cggtgctcttctggcctctcca

SEQ ID NO: 914425 - DNA, 22 bp, Artificial Sequence
  chemically synthesized
ccaggtctgtgtagcttttgga

SEQ ID NO: 914426 - DNA, 22 bp, Artificial Sequence
  chemically synthesized
cccaggtctgtgtagcttttgg

SEQ ID NO: 914427 - DNA, 22 bp, Artificial Sequence
  chemically synthesized
ttctggcctctccaaaagctac

SEQ ID NO: 914428 - DNA, 22 bp, Artificial Sequence
  chemically synthesized
ctggcctctccaaaagctacac

SEQ ID NO: 914429 - DNA, 22 bp, Artificial Sequence
  chemically synthesized
cttcccaggtctgtgtagcttt

SEQ ID NO: 914430 - DNA, 22 bp, Artificial Sequence
  chemically synthesized
tggcctctccaaaagctacaca

SEQ ID NO: 914431 - DNA, 22 bp, Artificial Sequence
  chemically synthesized
gcctctccaaaagctacacaga

SEQ ID NO: 914432 - DNA, 22 bp, Artificial Sequence
  chemically synthesized
tccaaaagctacacagacctgg

SEQ ID NO: 914433 - DNA, 22 bp, Artificial Sequence
  chemically synthesized
cagacctccttcccaggtctgt

SEQ ID NO: 914434 - DNA, 22 bp, Artificial Sequence
  chemically synthesized
caaaagctacacagacctggga

SEQ ID NO: 914435 - DNA, 22 bp, Artificial Sequence
  chemically synthesized
gaatctgcagacctccttccca

SEQ ID NO: 914436 - DNA, 22 bp, Artificial Sequence
  chemically synthesized
ggaatctgcagacctccttccc

SEQ ID NO: 914437 - DNA, 22 bp, Artificial Sequence
  chemically synthesized
cacagacctgggaaggaggtct

SEQ ID NO: 914438 - DNA, 22 bp, Artificial Sequence
  chemically synthesized
aatgaatgtttggaatctgcag

SEQ ID NO: 914439 - DNA, 22 bp, Artificial Sequence
  chemically synthesized
caatgaatgtttggaatctgca

SEQ ID NO: 914440 - DNA, 22 bp, Artificial Sequence
  chemically synthesized
ggaaggaggtctgcagattcca

SEQ ID NO: 914441 - DNA, 22 bp, Artificial Sequence
  chemically synthesized
acttcaatgaatgtttggaatc

SEQ ID NO: 914442 - DNA, 22 bp, Artificial Sequence
  chemically synthesized
tcacttcaatgaatgtttggaa

SEQ ID NO: 914443 - DNA, 22 bp, Artificial Sequence
  chemically synthesized
cagattccaaacattcattgaa

SEQ ID NO: 914444 - DNA, 22 bp, Artificial Sequence
  chemically synthesized
caaacattcattgaagtgagag

SEQ ID NO: 914445 - DNA, 22 bp, Artificial Sequence
  chemically synthesized
caagaaggaaaaagcatcctct

SEQ ID NO: 914446 - DNA, 22 bp, Artificial Sequence
  chemically synthesized
attgaagtgagaggatgctttt

SEQ ID NO: 914447 - DNA, 22 bp, Artificial Sequence
  chemically synthesized
aagtgagaggatgctttttcct

SEQ ID NO: 914448 - DNA, 22 bp, Artificial Sequence
  chemically synthesized
agagtaagtatgtagactccaa

SEQ ID NO: 914449 - DNA, 22 bp, Artificial Sequence
  chemically synthesized
tttccttcttggagtctacata

SEQ ID NO: 914450 - DNA, 22 bp, Artificial Sequence
  chemically synthesized
ttccttcttggagtctacatac

SEQ ID NO: 914451 - DNA, 22 bp, Artificial Sequence
  chemically synthesized
tccttcttggagtctacatact

SEQ ID NO: 914452 - DNA, 22 bp, Artificial Sequence
  chemically synthesized
ccttcttggagtctacatactt

SEQ ID NO: 914453 - DNA, 22 bp, Artificial Sequence
  chemically synthesized
cttcttggagtctacatactta

SEQ ID NO: 914454 - DNA, 22 bp, Artificial Sequence
  chemically synthesized
cttggagtctacatacttactc

SEQ ID NO: 914455 - DNA, 22 bp, Artificial Sequence
  chemically synthesized
ttggagtctacatacttactct

SEQ ID NO: 914456 - DNA, 22 bp, Artificial Sequence
  chemically synthesized
gagagaatcactgagagtaagt

SEQ ID NO: 914457 - DNA, 22 bp, Artificial Sequence
  chemically synthesized
ggagtctacatacttactctca

SEQ ID NO: 914458 - DNA, 22 bp, Artificial Sequence
  chemically synthesized
cgagagaatcactgagagtaag

SEQ ID NO: 914459 - DNA, 22 bp, Artificial Sequence
  chemically synthesized
gagtctacatacttactctcag

SEQ ID NO: 914460 - DNA, 22 bp, Artificial Sequence
  chemically synthesized
catacttactctcagtgattct

SEQ ID NO: 914461 - DNA, 22 bp, Artificial Sequence
  chemically synthesized
actctcagtgattctctcgaag

SEQ ID NO: 914462 - DNA, 22 bp, Artificial Sequence
  chemically synthesized
ctctcagtgattctctcgaagt

SEQ ID NO: 914463 - DNA, 22 bp, Artificial Sequence
  chemically synthesized
agtcagaagtagagacttcgag

SEQ ID NO: 914464 - DNA, 22 bp, Artificial Sequence
  chemically synthesized
tcagtgattctctcgaagtctc

SEQ ID NO: 914465 - DNA, 22 bp, Artificial Sequence
  chemically synthesized
tgagtcagaagtagagacttcg

SEQ ID NO: 914466 - DNA, 22 bp, Artificial Sequence
  chemically synthesized
agtgattctctcgaagtctcta

SEQ ID NO: 914467 - DNA, 22 bp, Artificial Sequence
  chemically synthesized
tctgagtcagaagtagagactt

SEQ ID NO: 914468 - DNA, 22 bp, Artificial Sequence
  chemically synthesized
atctctctgagtcagaagtaga

SEQ ID NO: 914469 - DNA, 22 bp, Artificial Sequence
  chemically synthesized
catctctctgagtcagaagtag

SEQ ID NO: 914470 - DNA, 22 bp, Artificial Sequence
  chemically synthesized
tctcgaagtctctacttctgac

SEQ ID NO: 914471 - DNA, 22 bp, Artificial Sequence
  chemically synthesized
tcatctctctgagtcagaagta

SEQ ID NO: 914472 - DNA, 22 bp, Artificial Sequence
  chemically synthesized
tcgaagtctctacttctgactc

SEQ ID NO: 914473 - DNA, 22 bp, Artificial Sequence
  chemically synthesized
tttcatctctctgagtcagaag

SEQ ID NO: 914474 - DNA, 22 bp, Artificial Sequence
  chemically synthesized
gaagtctctacttctgactcag

SEQ ID NO: 914475 - DNA, 22 bp, Artificial Sequence
  chemically synthesized
tctttcatctctctgagtcaga

SEQ ID NO: 914476 - DNA, 22 bp, Artificial Sequence
  chemically synthesized
ctctttcatctctctgagtcag

SEQ ID NO: 914477 - DNA, 22 bp, Artificial Sequence
  chemically synthesized
cttctctttcatctctctgagt

SEQ ID NO: 914478 - DNA, 22 bp, Artificial Sequence
  chemically synthesized
tacttctgactcagagagatga

SEQ ID NO: 914479 - DNA, 22 bp, Artificial Sequence
  chemically synthesized
cttctgactcagagagatgaaa

SEQ ID NO: 914480 - DNA, 22 bp, Artificial Sequence
  chemically synthesized
ctgactcagagagatgaaagag

SEQ ID NO: 914481 - DNA, 22 bp, Artificial Sequence
  chemically synthesized
tgactcagagagatgaaagaga

SEQ ID NO: 914482 - DNA, 22 bp, Artificial Sequence
  chemically synthesized
actcagagagatgaaagagaag

SEQ ID NO: 914483 - DNA, 22 bp, Artificial Sequence
  chemically synthesized
agagagatgaaagagaaggaac

SEQ ID NO: 914484 - DNA, 22 bp, Artificial Sequence
  chemically synthesized
tggtaagggacagttccttctc

SEQ ID NO: 914485 - DNA, 22 bp, Artificial Sequence
  chemically synthesized
gtggtaagggacagttccttct

SEQ ID NO: 914486 - DNA, 22 bp, Artificial Sequence
  chemically synthesized
tggggagtgcagtttgtggtaa

SEQ ID NO: 914487 - DNA, 22 bp, Artificial Sequence
  chemically synthesized
gtggggagtgcagtttgtggta

SEQ ID NO: 914488 - DNA, 22 bp, Artificial Sequence
  chemically synthesized
tgtggggagtgcagtttgtggt

SEQ ID NO: 914489 - DNA, 22 bp, Artificial Sequence
  chemically synthesized
tcccttaccacaaactgcactc

SEQ ID NO: 914490 - DNA, 22 bp, Artificial Sequence
  chemically synthesized
accacaaactgcactccccaca

SEQ ID NO: 914491 - DNA, 22 bp, Artificial Sequence
  chemically synthesized
ccacaaactgcactccccacaa

SEQ ID NO: 914492 - DNA, 22 bp, Artificial Sequence
  chemically synthesized
cactccccacaaagcttactac

SEQ ID NO: 914493 - DNA, 22 bp, Artificial Sequence
  chemically synthesized
aggtaggaaggggtagtaagct

SEQ ID NO: 914494 - DNA, 22 bp, Artificial Sequence
  chemically synthesized
cccacaaagcttactacccctt

SEQ ID NO: 914495 - DNA, 22 bp, Artificial Sequence
  chemically synthesized
aaaagactcaggtaggaagggg

SEQ ID NO: 914496 - DNA, 22 bp, Artificial Sequence
  chemically synthesized
actaccccttcctacctgagtc

SEQ ID NO: 914497 - DNA, 22 bp, Artificial Sequence
  chemically synthesized
ctaccccttcctacctgagtct

SEQ ID NO: 914498 - DNA, 22 bp, Artificial Sequence
  chemically synthesized
ccccttcctacctgagtctttt

SEQ ID NO: 914499 - DNA, 22 bp, Artificial Sequence
  chemically synthesized
cctacctgagtctttttaatct

SEQ ID NO: 914500 - DNA, 22 bp, Artificial Sequence
  chemically synthesized
ctacctgagtctttttaatctt

SEQ ID NO: 914501 - DNA, 22 bp, Artificial Sequence
  chemically synthesized
cgtgtcccaggcaagattaaaa

SEQ ID NO: 914502 - DNA, 22 bp, Artificial Sequence
  chemically synthesized
cctgagtctttttaatcttgcc

SEQ ID NO: 914503 - DNA, 22 bp, Artificial Sequence
  chemically synthesized
tactccgtgtcccaggcaagat

SEQ ID NO: 914504 - DNA, 22 bp, Artificial Sequence
  chemically synthesized
agtctttttaatcttgcctggg

SEQ ID NO: 914505 - DNA, 22 bp, Artificial Sequence
  chemically synthesized
tgtactccgtgtcccaggcaag

SEQ ID NO: 914506 - DNA, 22 bp, Artificial Sequence
  chemically synthesized
ctctgtactccgtgtcccaggc

SEQ ID NO: 914507 - DNA, 22 bp, Artificial Sequence
  chemically synthesized
tttaatcttgcctgggacacgg

SEQ ID NO: 914508 - DNA, 22 bp, Artificial Sequence
  chemically synthesized
ttaatcttgcctgggacacgga

SEQ ID NO: 914509 - DNA, 22 bp, Artificial Sequence
  chemically synthesized
taatcttgcctgggacacggag

SEQ ID NO: 914510 - DNA, 22 bp, Artificial Sequence
  chemically synthesized
aatcttgcctgggacacggagt

SEQ ID NO: 914511 - DNA, 22 bp, Artificial Sequence
  chemically synthesized
atcttgcctgggacacggagta

SEQ ID NO: 914512 - DNA, 22 bp, Artificial Sequence
  chemically synthesized
caatctcctctgtactccgtgt

SEQ ID NO: 914513 - DNA, 22 bp, Artificial Sequence
  chemically synthesized
ccaatctcctctgtactccgtg

SEQ ID NO: 914514 - DNA, 22 bp, Artificial Sequence
  chemically synthesized
gcctgggacacggagtacagag

SEQ ID NO: 914515 - DNA, 22 bp, Artificial Sequence
  chemically synthesized
cctgggacacggagtacagagg

SEQ ID NO: 914516 - DNA, 22 bp, Artificial Sequence
  chemically synthesized
ggacacggagtacagaggagat

SEQ ID NO: 914517 - DNA, 22 bp, Artificial Sequence
  chemically synthesized
caagcaatttccaatctcctct

SEQ ID NO: 914518 - DNA, 22 bp, Artificial Sequence
  chemically synthesized
ttccaagcaatttccaatctcc

SEQ ID NO: 914519 - DNA, 22 bp, Artificial Sequence
  chemically synthesized
tattccaagcaatttccaatct

SEQ ID NO: 914520 - DNA, 22 bp, Artificial Sequence
  chemically synthesized
tctctattccaagcaatttcca

SEQ ID NO: 914521 - DNA, 22 bp, Artificial Sequence
  chemically synthesized
ttatctctattccaagcaattt

SEQ ID NO: 914522 - DNA, 22 bp, Artificial Sequence
  chemically synthesized
gaaattgcttggaatagagata

SEQ ID NO: 914523 - DNA, 22 bp, Artificial Sequence
  chemically synthesized
aagcaacagggattattatctc

SEQ ID NO: 914524 - DNA, 22 bp, Artificial Sequence
  chemically synthesized
taaagcaacagggattattatc

SEQ ID NO: 914525 - DNA, 22 bp, Artificial Sequence
  chemically synthesized
cttggaatagagataataatcc

SEQ ID NO: 914526 - DNA, 22 bp, Artificial Sequence
  chemically synthesized
ctctaaagcaacagggattatt

SEQ ID NO: 914527 - DNA, 22 bp, Artificial Sequence
  chemically synthesized
ggaatagagataataatccctg

SEQ ID NO: 914528 - DNA, 22 bp, Artificial Sequence
  chemically synthesized
actctaaagcaacagggattat

SEQ ID NO: 914529 - DNA, 22 bp, Artificial Sequence
  chemically synthesized
gaatagagataataatccctgt

SEQ ID NO: 914530 - DNA, 22 bp, Artificial Sequence
  chemically synthesized
cccatagggtttactctaaagc

SEQ ID NO: 914531 - DNA, 22 bp, Artificial Sequence
  chemically synthesized
ccccatagggtttactctaaag

SEQ ID NO: 914532 - DNA, 22 bp, Artificial Sequence
  chemically synthesized
ttgctttagagtaaaccctatg

SEQ ID NO: 914533 - DNA, 22 bp, Artificial Sequence
  chemically synthesized
ctttagagtaaaccctatgggg

SEQ ID NO: 914534 - DNA, 22 bp, Artificial Sequence
  chemically synthesized
tagagtaaaccctatggggaag

SEQ ID NO: 914535 - DNA, 22 bp, Artificial Sequence
  chemically synthesized
agagtaaaccctatggggaagt

SEQ ID NO: 914536 - DNA, 22 bp, Artificial Sequence
  chemically synthesized
gagtaaaccctatggggaagtg

SEQ ID NO: 914537 - DNA, 22 bp, Artificial Sequence
  chemically synthesized
ccagcaatcgagaccagccact

SEQ ID NO: 914538 - DNA, 22 bp, Artificial Sequence
  chemically synthesized
tggggaagtggctggtctcgat

SEQ ID NO: 914539 - DNA, 22 bp, Artificial Sequence
  chemically synthesized
aaacaaactgccagcaatcgag

SEQ ID NO: 914540 - DNA, 22 bp, Artificial Sequence
  chemically synthesized
taaaacaaactgccagcaatcg

SEQ ID NO: 914541 - DNA, 22 bp, Artificial Sequence
  chemically synthesized
cacattctaaaacaaactgcca

SEQ ID NO: 914542 - DNA, 22 bp, Artificial Sequence
  chemically synthesized
gtctcgattgctggcagtttgt

SEQ ID NO: 914543 - DNA, 22 bp, Artificial Sequence
  chemically synthesized
ttccacattctaaaacaaactg

SEQ ID NO: 914544 - DNA, 22 bp, Artificial Sequence
  chemically synthesized
gattgctggcagtttgttttag

SEQ ID NO: 914545 - DNA, 22 bp, Artificial Sequence
  chemically synthesized
ctggcagtttgttttagaatgt

SEQ ID NO: 914546 - DNA, 22 bp, Artificial Sequence
  chemically synthesized
gcagtttgttttagaatgtgga

SEQ ID NO: 914547 - DNA, 22 bp, Artificial Sequence
  chemically synthesized
aggggaaatggtgctgttccac

SEQ ID NO: 914548 - DNA, 22 bp, Artificial Sequence
  chemically synthesized
gttttagaatgtggaacagcac

SEQ ID NO: 914549 - DNA, 22 bp, Artificial Sequence
  chemically synthesized
ttttagaatgtggaacagcacc

SEQ ID NO: 914550 - DNA, 22 bp, Artificial Sequence
  chemically synthesized
tagaatgtggaacagcaccatt

SEQ ID NO: 914551 - DNA, 22 bp, Artificial Sequence
  chemically synthesized
agaatgtggaacagcaccattt

SEQ ID NO: 914552 - DNA, 22 bp, Artificial Sequence
  chemically synthesized
gaatgtggaacagcaccatttc

SEQ ID NO: 914553 - DNA, 22 bp, Artificial Sequence
  chemically synthesized
aggtcagaatctgaggggaaat

SEQ ID NO: 914554 - DNA, 22 bp, Artificial Sequence
  chemically synthesized
taaggtcagaatctgaggggaa

SEQ ID NO: 914555 - DNA, 22 bp, Artificial Sequence
  chemically synthesized
attctaaggtcagaatctgagg

SEQ ID NO: 914556 - DNA, 22 bp, Artificial Sequence
  chemically synthesized
cacaattgattctaaggtcaga

SEQ ID NO: 914557 - DNA, 22 bp, Artificial Sequence
  chemically synthesized
ccacaattgattctaaggtcag

SEQ ID NO: 914558 - DNA, 22 bp, Artificial Sequence
  chemically synthesized
cccctcagattctgaccttaga

SEQ ID NO: 914559 - DNA, 22 bp, Artificial Sequence
  chemically synthesized
ccctcagattctgaccttagaa

SEQ ID NO: 914560 - DNA, 22 bp, Artificial Sequence
  chemically synthesized
ttccacaattgattctaaggtc

SEQ ID NO: 914561 - DNA, 22 bp, Artificial Sequence
  chemically synthesized
cttccacaattgattctaaggt

SEQ ID NO: 914562 - DNA, 22 bp, Artificial Sequence
  chemically synthesized
ttcttccacaattgattctaag

SEQ ID NO: 914563 - DNA, 22 bp, Artificial Sequence
  chemically synthesized
cttcttccacaattgattctaa

SEQ ID NO: 914564 - DNA, 22 bp, Artificial Sequence
  chemically synthesized
agattctgaccttagaatcaat

SEQ ID NO: 914565 - DNA, 22 bp, Artificial Sequence
  chemically synthesized
tcttcttccacaattgattcta

SEQ ID NO: 914566 - DNA, 22 bp, Artificial Sequence
  chemically synthesized
tgaccttagaatcaattgtgga

SEQ ID NO: 914567 - DNA, 22 bp, Artificial Sequence
  chemically synthesized
gacgttttcttcttccacaatt

SEQ ID NO: 914568 - DNA, 22 bp, Artificial Sequence
  chemically synthesized
accttagaatcaattgtggaag

SEQ ID NO: 914569 - DNA, 22 bp, Artificial Sequence
  chemically synthesized
tactagacgttttcttcttcca

SEQ ID NO: 914570 - DNA, 22 bp, Artificial Sequence
  chemically synthesized
agaatcaattgtggaagaagaa

SEQ ID NO: 914571 - DNA, 22 bp, Artificial Sequence
  chemically synthesized
gaatcaattgtggaagaagaaa

SEQ ID NO: 914572 - DNA, 22 bp, Artificial Sequence
  chemically synthesized
tactatactagacgttttcttc

SEQ ID NO: 914573 - DNA, 22 bp, Artificial Sequence
  chemically synthesized
tggaagaagaaaacgtctagta

SEQ ID NO: 914574 - DNA, 22 bp, Artificial Sequence
  chemically synthesized
aacaaataaaggatgcctgtac

SEQ ID NO: 914575 - DNA, 22 bp, Artificial Sequence
  chemically synthesized
aaacaaataaaggatgcctgta

SEQ ID NO: 914576 - DNA, 22 bp, Artificial Sequence
  chemically synthesized
gtatagtacaggcatcctttat

SEQ ID NO: 914577 - DNA, 22 bp, Artificial Sequence
  chemically synthesized
gaacatttaaacaaataaagga

SEQ ID NO: 914578 - DNA, 22 bp, Artificial Sequence
  chemically synthesized
ggaacatttaaacaaataaagg

SEQ ID NO: 914579 - DNA, 22 bp, Artificial Sequence
  chemically synthesized
cttggaacatttaaacaaataa

SEQ ID NO: 914580 - DNA, 22 bp, Artificial Sequence
  chemically synthesized
aatctgcttggaacatttaaac

SEQ ID NO: 914581 - DNA, 22 bp, Artificial Sequence
  chemically synthesized
tatttgtttaaatgttccaagc

SEQ ID NO: 914582 - DNA, 22 bp, Artificial Sequence
  chemically synthesized
atttgtttaaatgttccaagca

SEQ ID NO: 914583 - DNA, 22 bp, Artificial Sequence
  chemically synthesized
tttgtttaaatgttccaagcag

SEQ ID NO: 914584 - DNA, 22 bp, Artificial Sequence
  chemically synthesized
gtttaaatgttccaagcagatt

SEQ ID NO: 914585 - DNA, 22 bp, Artificial Sequence
  chemically synthesized
tttaaatgttccaagcagattt

SEQ ID NO: 914586 - DNA, 22 bp, Artificial Sequence
  chemically synthesized
gacccaaggaattaaatctgct

SEQ ID NO: 914587 - DNA, 22 bp, Artificial Sequence
  chemically synthesized
aaatgttccaagcagatttaat

SEQ ID NO: 914588 - DNA, 22 bp, Artificial Sequence
  chemically synthesized
aatgttccaagcagatttaatt

SEQ ID NO: 914589 - DNA, 22 bp, Artificial Sequence
  chemically synthesized
aaaatctagacccaaggaatta

SEQ ID NO: 914590 - DNA, 22 bp, Artificial Sequence
  chemically synthesized
caagcagatttaattccttggg

SEQ ID NO: 914591 - DNA, 22 bp, Artificial Sequence
  chemically synthesized
aattccttgggtctagattttg

SEQ ID NO: 914592 - DNA, 22 bp, Artificial Sequence
  chemically synthesized
attccttgggtctagattttga

SEQ ID NO: 914593 - DNA, 22 bp, Artificial Sequence
  chemically synthesized
cttgggtctagattttgagggt

SEQ ID NO: 914594 - DNA, 22 bp, Artificial Sequence
  chemically synthesized
gggtctagattttgagggtcta

SEQ ID NO: 914595 - DNA, 22 bp, Artificial Sequence
  chemically synthesized
ggtctagattttgagggtctat

SEQ ID NO: 914596 - DNA, 22 bp, Artificial Sequence
  chemically synthesized
gattttgagggtctatctcatc

SEQ ID NO: 914597 - DNA, 22 bp, Artificial Sequence
  chemically synthesized
tgagggtctatctcatcttttt

SEQ ID NO: 914598 - DNA, 22 bp, Artificial Sequence
  chemically synthesized
gagggtctatctcatctttttc

SEQ ID NO: 914599 - DNA, 22 bp, Artificial Sequence
  chemically synthesized
agggtctatctcatctttttct

SEQ ID NO: 914600 - DNA, 22 bp, Artificial Sequence
  chemically synthesized
tctcatctttttctctctctct

SEQ ID NO: 914601 - DNA, 22 bp, Artificial Sequence
  chemically synthesized
cagagtagaaacagagagagag

SEQ ID NO: 914602 - DNA, 22 bp, Artificial Sequence
  chemically synthesized
gcagagtagaaacagagagaga

SEQ ID NO: 914603 - DNA, 22 bp, Artificial Sequence
  chemically synthesized
atctttttctctctctctgttt

SEQ ID NO: 914604 - DNA, 22 bp, Artificial Sequence
  chemically synthesized
tttctctctctctgtttctact

SEQ ID NO: 914605 - DNA, 22 bp, Artificial Sequence
  chemically synthesized
ttctctctctctgtttctactc

SEQ ID NO: 914606 - DNA, 22 bp, Artificial Sequence
  chemically synthesized
tctctctctctgtttctactct

SEQ ID NO: 914607 - DNA, 22 bp, Artificial Sequence
  chemically synthesized
ctctctctctgtttctactctg

SEQ ID NO: 914608 - DNA, 22 bp, Artificial Sequence
  chemically synthesized
tctctctctgtttctactctgc

SEQ ID NO: 914609 - DNA, 22 bp, Artificial Sequence
  chemically synthesized
tctctctgtttctactctgcaa

SEQ ID NO: 914610 - DNA, 22 bp, Artificial Sequence
  chemically synthesized
tctctgtttctactctgcaaat

SEQ ID NO: 914611 - DNA, 22 bp, Artificial Sequence
  chemically synthesized
tctgtttctactctgcaaatca

SEQ ID NO: 914612 - DNA, 22 bp, Artificial Sequence
  chemically synthesized
tgtttctactctgcaaatcatt

SEQ ID NO: 914613 - DNA, 22 bp, Artificial Sequence
  chemically synthesized
tttctactctgcaaatcattgc

SEQ ID NO: 914614 - DNA, 22 bp, Artificial Sequence
  chemically synthesized
ctactctgcaaatcattgcctc

SEQ ID NO: 914615 - DNA, 22 bp, Artificial Sequence
  chemically synthesized
tactctgcaaatcattgcctcc

SEQ ID NO: 914616 - DNA, 22 bp, Artificial Sequence
  chemically synthesized
ctctgcaaatcattgcctccat

SEQ ID NO: 914617 - DNA, 22 bp, Artificial Sequence
  chemically synthesized
gagtcaaatagtaatggaggca

SEQ ID NO: 914618 - DNA, 22 bp, Artificial Sequence
  chemically synthesized
tgcaaatcattgcctccattac

SEQ ID NO: 914619 - DNA, 22 bp, Artificial Sequence
  chemically synthesized
caaatcattgcctccattacta

SEQ ID NO: 914620 - DNA, 22 bp, Artificial Sequence
  chemically synthesized
cctccattactatttgactcca

SEQ ID NO: 914621 - DNA, 22 bp, Artificial Sequence
  chemically synthesized
tgcaaaatcatctggagtcaaa

SEQ ID NO: 914622 - DNA, 22 bp, Artificial Sequence
  chemically synthesized
cattactatttgactccagatg

SEQ ID NO: 914623 - DNA, 22 bp, Artificial Sequence
  chemically synthesized
ctatttgactccagatgatttt

SEQ ID NO: 914624 - DNA, 22 bp, Artificial Sequence
  chemically synthesized
agaacactgtgcaaaatcatct

SEQ ID NO: 914625 - DNA, 22 bp, Artificial Sequence
  chemically synthesized
tttgactccagatgattttgca

SEQ ID NO: 914626 - DNA, 22 bp, Artificial Sequence
  chemically synthesized
gactccagatgattttgcacag

SEQ ID NO: 914627 - DNA, 22 bp, Artificial Sequence
  chemically synthesized
actccagatgattttgcacagt

SEQ ID NO: 914628 - DNA, 22 bp, Artificial Sequence
  chemically synthesized
aaagtattcagaacactgtgca

SEQ ID NO: 914629 - DNA, 22 bp, Artificial Sequence
  chemically synthesized
cagatgattttgcacagtgttc

SEQ ID NO: 914630 - DNA, 22 bp, Artificial Sequence
  chemically synthesized
actaaaagtattcagaacactg

SEQ ID NO: 914631 - DNA, 22 bp, Artificial Sequence
  chemically synthesized
aactaaaagtattcagaacact

SEQ ID NO: 914632 - DNA, 22 bp, Artificial Sequence
  chemically synthesized
cttaactaaaagtattcagaac

SEQ ID NO: 914633 - DNA, 22 bp, Artificial Sequence
  chemically synthesized
acttaactaaaagtattcagaa

SEQ ID NO: 914634 - DNA, 22 bp, Artificial Sequence
  chemically synthesized
tacttaactaaaagtattcaga

SEQ ID NO: 914635 - DNA, 22 bp, Artificial Sequence
  chemically synthesized
tgcacagtgttctgaatacttt

SEQ ID NO: 914636 - DNA, 22 bp, Artificial Sequence
  chemically synthesized
gcacagtgttctgaatactttt

SEQ ID NO: 914637 - DNA, 22 bp, Artificial Sequence
  chemically synthesized
cacagtgttctgaatactttta

SEQ ID NO: 914638 - DNA, 22 bp, Artificial Sequence
  chemically synthesized
gcaagattttacttaactaaaa

SEQ ID NO: 914639 - DNA, 22 bp, Artificial Sequence
  chemically synthesized
agcaagattttacttaactaaa

SEQ ID NO: 914640 - DNA, 22 bp, Artificial Sequence
  chemically synthesized
tagcaagattttacttaactaa

SEQ ID NO: 914641 - DNA, 22 bp, Artificial Sequence
  chemically synthesized
tgaatacttttagttaagtaaa

SEQ ID NO: 914642 - DNA, 22 bp, Artificial Sequence
  chemically synthesized
aatacttttagttaagtaaaat

SEQ ID NO: 914643 - DNA, 22 bp, Artificial Sequence
  chemically synthesized
ttagttaagtaaaatcttgcta

SEQ ID NO: 914644 - DNA, 22 bp, Artificial Sequence
  chemically synthesized
tagttaagtaaaatcttgctaa

SEQ ID NO: 914645 - DNA, 22 bp, Artificial Sequence
  chemically synthesized
agttaagtaaaatcttgctaaa

SEQ ID NO: 914646 - DNA, 22 bp, Artificial Sequence
  chemically synthesized
gttaagtaaaatcttgctaaaa

SEQ ID NO: 914647 - DNA, 22 bp, Artificial Sequence
  chemically synthesized
aaatgtaatcagattttagcaa

SEQ ID NO: 914648 - DNA, 22 bp, Artificial Sequence
  chemically synthesized
caaatgtaatcagattttagca

SEQ ID NO: 914649 - DNA, 22 bp, Artificial Sequence
  chemically synthesized
tcaaatgtaatcagattttagc

SEQ ID NO: 914650 - DNA, 22 bp, Artificial Sequence
  chemically synthesized
agtaaaatcttgctaaaatctg

SEQ ID NO: 914651 - DNA, 22 bp, Artificial Sequence
  chemically synthesized
ttcaaatgtaatcagattttag

SEQ ID NO: 914652 - DNA, 22 bp, Artificial Sequence
  chemically synthesized
ggtttttcaaatgtaatcagat

SEQ ID NO: 914653 - DNA, 22 bp, Artificial Sequence
  chemically synthesized
gctaaaatctgattacatttga

SEQ ID NO: 914654 - DNA, 22 bp, Artificial Sequence
  chemically synthesized
ctaaaatctgattacatttgaa

SEQ ID NO: 914655 - DNA, 22 bp, Artificial Sequence
  chemically synthesized
aaatctgattacatttgaaaaa

SEQ ID NO: 914656 - DNA, 22 bp, Artificial Sequence
  chemically synthesized
ccaatgtgtctaggtttttcaa

SEQ ID NO: 914657 - DNA, 22 bp, Artificial Sequence
  chemically synthesized
gccaatgtgtctaggtttttca

SEQ ID NO: 914658 - DNA, 22 bp, Artificial Sequence
  chemically synthesized
attacatttgaaaaacctagac

SEQ ID NO: 914659 - DNA, 22 bp, Artificial Sequence
  chemically synthesized
catttgaaaaacctagacacat

SEQ ID NO: 914660 - DNA, 22 bp, Artificial Sequence
  chemically synthesized
aaagccttgccaatgtgtctag

SEQ ID NO: 914661 - DNA, 22 bp, Artificial Sequence
  chemically synthesized
aaaagccttgccaatgtgtcta

SEQ ID NO: 914662 - DNA, 22 bp, Artificial Sequence
  chemically synthesized
gaaaaacctagacacattggca

SEQ ID NO: 914663 - DNA, 22 bp, Artificial Sequence
  chemically synthesized
aaaaacctagacacattggcaa

SEQ ID NO: 914664 - DNA, 22 bp, Artificial Sequence
  chemically synthesized
aaaatgtttaaaagccttgcca

SEQ ID NO: 914665 - DNA, 22 bp, Artificial Sequence
  chemically synthesized
gacacattggcaaggcttttaa

SEQ ID NO: 914666 - DNA, 22 bp, Artificial Sequence
  chemically synthesized
gatgaaagttgaaaatgtttaa

SEQ ID NO: 914667 - DNA, 22 bp, Artificial Sequence
  chemically synthesized
tagatgaaagttgaaaatgttt

SEQ ID NO: 914668 - DNA, 22 bp, Artificial Sequence
  chemically synthesized
gcaaggcttttaaacattttca

SEQ ID NO: 914669 - DNA, 22 bp, Artificial Sequence
  chemically synthesized
ctagatgaaagttgaaaatgtt

SEQ ID NO: 914670 - DNA, 22 bp, Artificial Sequence
  chemically synthesized
cttctagatgaaagttgaaaat

SEQ ID NO: 914671 - DNA, 22 bp, Artificial Sequence
  chemically synthesized
ttaaacattttcaactttcatc

SEQ ID NO: 914672 - DNA, 22 bp, Artificial Sequence
  chemically synthesized
taaacattttcaactttcatct

SEQ ID NO: 914673 - DNA, 22 bp, Artificial Sequence
  chemically synthesized
aaacattttcaactttcatcta

SEQ ID NO: 914674 - DNA, 22 bp, Artificial Sequence
  chemically synthesized
aacattttcaactttcatctag

SEQ ID NO: 914675 - DNA, 22 bp, Artificial Sequence
  chemically synthesized
aacgtgtctgcttctagatgaa

SEQ ID NO: 914676 - DNA, 22 bp, Artificial Sequence
  chemically synthesized
aaacgtgtctgcttctagatga

SEQ ID NO: 914677 - DNA, 22 bp, Artificial Sequence
  chemically synthesized
cttaaacgtgtctgcttctaga

SEQ ID NO: 914678 - DNA, 22 bp, Artificial Sequence
  chemically synthesized
ccttaaacgtgtctgcttctag

SEQ ID NO: 914679 - DNA, 22 bp, Artificial Sequence
  chemically synthesized
tcaactttcatctagaagcaga

SEQ ID NO: 914680 - DNA, 22 bp, Artificial Sequence
  chemically synthesized
tccttaaacgtgtctgcttcta

SEQ ID NO: 914681 - DNA, 22 bp, Artificial Sequence
  chemically synthesized
caactttcatctagaagcagac

SEQ ID NO: 914682 - DNA, 22 bp, Artificial Sequence
  chemically synthesized
ttccttaaacgtgtctgcttct

SEQ ID NO: 914683 - DNA, 22 bp, Artificial Sequence
  chemically synthesized
aactttcatctagaagcagaca

SEQ ID NO: 914684 - DNA, 22 bp, Artificial Sequence
  chemically synthesized
ttttccttaaacgtgtctgctt

SEQ ID NO: 914685 - DNA, 22 bp, Artificial Sequence
  chemically synthesized
cttttccttaaacgtgtctgct

SEQ ID NO: 914686 - DNA, 22 bp, Artificial Sequence
  chemically synthesized
tcttttccttaaacgtgtctgc

SEQ ID NO: 914687 - DNA, 22 bp, Artificial Sequence
  chemically synthesized
tcatctagaagcagacacgttt

SEQ ID NO: 914688 - DNA, 22 bp, Artificial Sequence
  chemically synthesized
catctagaagcagacacgttta

SEQ ID NO: 914689 - DNA, 22 bp, Artificial Sequence
  chemically synthesized
atctagaagcagacacgtttaa

SEQ ID NO: 914690 - DNA, 22 bp, Artificial Sequence
  chemically synthesized
gggttttcttttccttaaacgt

SEQ ID NO: 914691 - DNA, 22 bp, Artificial Sequence
  chemically synthesized
ggggttttcttttccttaaacg

SEQ ID NO: 914692 - DNA, 22 bp, Artificial Sequence
  chemically synthesized
gaagcagacacgtttaaggaaa

SEQ ID NO: 914693 - DNA, 22 bp, Artificial Sequence
  chemically synthesized
gggggtttggggttttcttttc

SEQ ID NO: 914694 - DNA, 22 bp, Artificial Sequence
  chemically synthesized
ggggggtttggggttttctttt

SEQ ID NO: 914695 - DNA, 22 bp, Artificial Sequence
  chemically synthesized
tttggggggtttggggttttct

SEQ ID NO: 914696 - DNA, 22 bp, Artificial Sequence
  chemically synthesized
gtttggggggtttggggttttc

SEQ ID NO: 914697 - DNA, 22 bp, Artificial Sequence
  chemically synthesized
tttgtttggggggtttggggtt

SEQ ID NO: 914698 - DNA, 22 bp, Artificial Sequence
  chemically synthesized
aaggaaaagaaaaccccaaacc

SEQ ID NO: 914699 - DNA, 22 bp, Artificial Sequence
  chemically synthesized
gtttgtttggggggtttggggt

SEQ ID NO: 914700 - DNA, 22 bp, Artificial Sequence
  chemically synthesized
aggaaaagaaaaccccaaaccc

SEQ ID NO: 914701 - DNA, 22 bp, Artificial Sequence
  chemically synthesized
tgtttgtttggggggtttgggg

SEQ ID NO: 914702 - DNA, 22 bp, Artificial Sequence
  chemically synthesized
ttgtttgtttggggggtttggg

SEQ ID NO: 914703 - DNA, 22 bp, Artificial Sequence
  chemically synthesized
aatttttgtttgtttggggggt

SEQ ID NO: 914704 - DNA, 22 bp, Artificial Sequence
  chemically synthesized
aaatttttgtttgtttgggggg

SEQ ID NO: 914705 - DNA, 22 bp, Artificial Sequence
  chemically synthesized
cttaaatttttgtttgtttggg

SEQ ID NO: 914706 - DNA, 22 bp, Artificial Sequence
  chemically synthesized
ctccttaaatttttgtttgttt

SEQ ID NO: 914707 - DNA, 22 bp, Artificial Sequence
  chemically synthesized
ctgctccttaaatttttgtttg

SEQ ID NO: 914708 - DNA, 22 bp, Artificial Sequence
  chemically synthesized
cctgctccttaaatttttgttt

SEQ ID NO: 914709 - DNA, 22 bp, Artificial Sequence
  chemically synthesized
tcctgctccttaaatttttgtt

SEQ ID NO: 914710 - DNA, 22 bp, Artificial Sequence
  chemically synthesized
ttcctgctccttaaatttttgt

SEQ ID NO: 914711 - DNA, 22 bp, Artificial Sequence
  chemically synthesized
tttcctgctccttaaatttttg

SEQ ID NO: 914712 - DNA, 22 bp, Artificial Sequence
  chemically synthesized
ctttttcctgctccttaaattt

SEQ ID NO: 914713 - DNA, 22 bp, Artificial Sequence
  chemically synthesized
atattactttttcctgctcctt

SEQ ID NO: 914714 - DNA, 22 bp, Artificial Sequence
  chemically synthesized
gatattactttttcctgctcct

SEQ ID NO: 914715 - DNA, 22 bp, Artificial Sequence
  chemically synthesized
gtttgatattactttttcctgc

SEQ ID NO: 914716 - DNA, 22 bp, Artificial Sequence
  chemically synthesized
ggtttgatattactttttcctg

SEQ ID NO: 914717 - DNA, 22 bp, Artificial Sequence
  chemically synthesized
tggtttgatattactttttcct

SEQ ID NO: 914718 - DNA, 22 bp, Artificial Sequence
  chemically synthesized
ttggtttgatattactttttcc

SEQ ID NO: 914719 - DNA, 22 bp, Artificial Sequence
  chemically synthesized
tttggtttgatattactttttc

SEQ ID NO: 914720 - DNA, 22 bp, Artificial Sequence
  chemically synthesized
ttttggtttgatattacttttt

SEQ ID NO: 914721 - DNA, 22 bp, Artificial Sequence
  chemically synthesized
aaggagcaggaaaaagtaatat

SEQ ID NO: 914722 - DNA, 22 bp, Artificial Sequence
  chemically synthesized
aggagcaggaaaaagtaatatc

SEQ ID NO: 914723 - DNA, 22 bp, Artificial Sequence
  chemically synthesized
tttttttggtttgatattactt

SEQ ID NO: 914724 - DNA, 22 bp, Artificial Sequence
  chemically synthesized
ttatttttttggtttgatatta

SEQ ID NO: 914725 - DNA, 22 bp, Artificial Sequence
  chemically synthesized
ttattatttttttggtttgata

SEQ ID NO: 914726 - DNA, 22 bp, Artificial Sequence
  chemically synthesized
agggttattattatttttttgg

SEQ ID NO: 914727 - DNA, 22 bp, Artificial Sequence
  chemically synthesized
gagggttattattatttttttg

SEQ ID NO: 914728 - DNA, 22 bp, Artificial Sequence
  chemically synthesized
aacttgagggttattattattt

SEQ ID NO: 914729 - DNA, 22 bp, Artificial Sequence
  chemically synthesized
taaacttgagggttattattat

SEQ ID NO: 914730 - DNA, 22 bp, Artificial Sequence
  chemically synthesized
ctaaacttgagggttattatta

SEQ ID NO: 914731 - DNA, 22 bp, Artificial Sequence
  chemically synthesized
tctaaacttgagggttattatt

SEQ ID NO: 914732 - DNA, 22 bp, Artificial Sequence
  chemically synthesized
gaattttctaaacttgagggtt

SEQ ID NO: 914733 - DNA, 22 bp, Artificial Sequence
  chemically synthesized
agaattttctaaacttgagggt

SEQ ID NO: 914734 - DNA, 22 bp, Artificial Sequence
  chemically synthesized
atttagaattttctaaacttga

SEQ ID NO: 914735 - DNA, 22 bp, Artificial Sequence
  chemically synthesized
gatttagaattttctaaacttg

SEQ ID NO: 914736 - DNA, 22 bp, Artificial Sequence
  chemically synthesized
aagtttagaaaattctaaatca

SEQ ID NO: 914737 - DNA, 22 bp, Artificial Sequence
  chemically synthesized
aaaagaggggagtgtttgattt

SEQ ID NO: 914738 - DNA, 22 bp, Artificial Sequence
  chemically synthesized
gaaaagaggggagtgtttgatt

SEQ ID NO: 914739 - DNA, 22 bp, Artificial Sequence
  chemically synthesized
agaaaattctaaatcaaacact

SEQ ID NO: 914740 - DNA, 22 bp, Artificial Sequence
  chemically synthesized
gaaaattctaaatcaaacactc

SEQ ID NO: 914741 - DNA, 22 bp, Artificial Sequence
  chemically synthesized
taaatcaaacactcccctcttt

SEQ ID NO: 914742 - DNA, 22 bp, Artificial Sequence
  chemically synthesized
agacatatttgaaaagagggga

SEQ ID NO: 914743 - DNA, 22 bp, Artificial Sequence
  chemically synthesized
gagacatatttgaaaagagggg

SEQ ID NO: 914744 - DNA, 22 bp, Artificial Sequence
  chemically synthesized
aatcaaacactcccctcttttc

SEQ ID NO: 914745 - DNA, 22 bp, Artificial Sequence
  chemically synthesized
gtaaataatttgagacatattt

SEQ ID NO: 914746 - DNA, 22 bp, Artificial Sequence
  chemically synthesized
ccctcttttcaaatatgtctca

SEQ ID NO: 914747 - DNA, 22 bp, Artificial Sequence
  chemically synthesized
ttttcaaatatgtctcaaatta

SEQ ID NO: 914748 - DNA, 22 bp, Artificial Sequence
  chemically synthesized
ttcaaatatgtctcaaattatt

SEQ ID NO: 914749 - DNA, 22 bp, Artificial Sequence
  chemically synthesized
tcaaatatgtctcaaattattt

SEQ ID NO: 914750 - DNA, 22 bp, Artificial Sequence
  chemically synthesized
caaatatgtctcaaattattta

SEQ ID NO: 914751 - DNA, 22 bp, Artificial Sequence
  chemically synthesized
aaatatgtctcaaattatttac

SEQ ID NO: 914752 - DNA, 22 bp, Artificial Sequence
  chemically synthesized
atagaaaaaaatatgctagtaa

SEQ ID NO: 914753 - DNA, 22 bp, Artificial Sequence
  chemically synthesized
gatagaaaaaaatatgctagta

SEQ ID NO: 914754 - DNA, 22 bp, Artificial Sequence
  chemically synthesized
ttgatagaaaaaaatatgctag

SEQ ID NO: 914755 - DNA, 22 bp, Artificial Sequence
  chemically synthesized
aaattatttactagcatatttt

SEQ ID NO: 914756 - DNA, 22 bp, Artificial Sequence
  chemically synthesized
gatattcttgatagaaaaaaat

SEQ ID NO: 914757 - DNA, 22 bp, Artificial Sequence
  chemically synthesized
tttactagcatatttttttcta

SEQ ID NO: 914758 - DNA, 22 bp, Artificial Sequence
  chemically synthesized
actagcatatttttttctatca

SEQ ID NO: 914759 - DNA, 22 bp, Artificial Sequence
  chemically synthesized
ctagcatatttttttctatcaa

SEQ ID NO: 914760 - DNA, 22 bp, Artificial Sequence
  chemically synthesized
tactggatattcttgatagaaa

SEQ ID NO: 914761 - DNA, 22 bp, Artificial Sequence
  chemically synthesized
tgtactggatattcttgataga

SEQ ID NO: 914762 - DNA, 22 bp, Artificial Sequence
  chemically synthesized
gcatatttttttctatcaagaa

SEQ ID NO: 914763 - DNA, 22 bp, Artificial Sequence
  chemically synthesized
ctctgtactggatattcttgat

SEQ ID NO: 914764 - DNA, 22 bp, Artificial Sequence
  chemically synthesized
tcctctgtactggatattcttg

SEQ ID NO: 914765 - DNA, 22 bp, Artificial Sequence
  chemically synthesized
ttttctatcaagaatatccagt

SEQ ID NO: 914766 - DNA, 22 bp, Artificial Sequence
  chemically synthesized
tttctatcaagaatatccagta

SEQ ID NO: 914767 - DNA, 22 bp, Artificial Sequence
  chemically synthesized
ttctatcaagaatatccagtac

SEQ ID NO: 914768 - DNA, 22 bp, Artificial Sequence
  chemically synthesized
tctatcaagaatatccagtaca

SEQ ID NO: 914769 - DNA, 22 bp, Artificial Sequence
  chemically synthesized
ctatcaagaatatccagtacag

SEQ ID NO: 914770 - DNA, 22 bp, Artificial Sequence
  chemically synthesized
tatcaagaatatccagtacaga

SEQ ID NO: 914771 - DNA, 22 bp, Artificial Sequence
  chemically synthesized
tcaagaatatccagtacagagg

SEQ ID NO: 914772 - DNA, 22 bp, Artificial Sequence
  chemically synthesized
tgatgaataagcacaacatctc

SEQ ID NO: 914773 - DNA, 22 bp, Artificial Sequence
  chemically synthesized
aactatgatgaataagcacaac

SEQ ID NO: 914774 - DNA, 22 bp, Artificial Sequence
  chemically synthesized
tgcttattcatcatagttgaga

SEQ ID NO: 914775 - DNA, 22 bp, Artificial Sequence
  chemically synthesized
attcatcatagttgagatttat

SEQ ID NO: 914776 - DNA, 22 bp, Artificial Sequence
  chemically synthesized
ttcatcatagttgagatttata

SEQ ID NO: 914777 - DNA, 22 bp, Artificial Sequence
  chemically synthesized
aacccagtaatacatataaatc

SEQ ID NO: 914778 - DNA, 22 bp, Artificial Sequence
  chemically synthesized
atcatagttgagatttatatgt

SEQ ID NO: 914779 - DNA, 22 bp, Artificial Sequence
  chemically synthesized
gaacccagtaatacatataaat

SEQ ID NO: 914780 - DNA, 22 bp, Artificial Sequence
  chemically synthesized
agatttatatgtattactgggt

SEQ ID NO: 914781 - DNA, 22 bp, Artificial Sequence
  chemically synthesized
atatgtattactgggttcaaac

SEQ ID NO: 914782 - DNA, 22 bp, Artificial Sequence
  chemically synthesized
tatgtattactgggttcaaacc

SEQ ID NO: 914783 - DNA, 22 bp, Artificial Sequence
  chemically synthesized
ctgggttcaaaccctatattgt

SEQ ID NO: 914784 - DNA, 22 bp, Artificial Sequence
  chemically synthesized
ggttcaaaccctatattgtatg

SEQ ID NO: 914785 - DNA, 22 bp, Artificial Sequence
  chemically synthesized
aaaccctatattgtatgcttat

SEQ ID NO: 914786 - DNA, 22 bp, Artificial Sequence
  chemically synthesized
tattgtatgcttattttcttca

SEQ ID NO: 914787 - DNA, 22 bp, Artificial Sequence
  chemically synthesized
tatgcttattttcttcatttat

SEQ ID NO: 914788 - DNA, 22 bp, Artificial Sequence
  chemically synthesized
attttcttcatttattattcta

SEQ ID NO: 914789 - DNA, 22 bp, Artificial Sequence
  chemically synthesized
ttttcttcatttattattctac

SEQ ID NO: 914790 - DNA, 22 bp, Artificial Sequence
  chemically synthesized
cagagacacatagtagaataat

SEQ ID NO: 914791 - DNA, 22 bp, Artificial Sequence
  chemically synthesized
tcttcatttattattctactat

SEQ ID NO: 914792 - DNA, 22 bp, Artificial Sequence
  chemically synthesized
cttcatttattattctactatg

SEQ ID NO: 914793 - DNA, 22 bp, Artificial Sequence
  chemically synthesized
ttcatttattattctactatgt

SEQ ID NO: 914794 - DNA, 22 bp, Artificial Sequence
  chemically synthesized
catttattattctactatgtgt

SEQ ID NO: 914795 - DNA, 22 bp, Artificial Sequence
  chemically synthesized
atttattattctactatgtgtc

SEQ ID NO: 914796 - DNA, 22 bp, Artificial Sequence
  chemically synthesized
atgacctacagagacacatagt

SEQ ID NO: 914797 - DNA, 22 bp, Artificial Sequence
  chemically synthesized
attattctactatgtgtctctg

SEQ ID NO: 914798 - DNA, 22 bp, Artificial Sequence
  chemically synthesized
ttattctactatgtgtctctgt

SEQ ID NO: 914799 - DNA, 22 bp, Artificial Sequence
  chemically synthesized
ttctactatgtgtctctgtagg

SEQ ID NO: 914800 - DNA, 22 bp, Artificial Sequence
  chemically synthesized
tactatgtgtctctgtaggtca

SEQ ID NO: 914801 - DNA, 22 bp, Artificial Sequence
  chemically synthesized
aagcgtaattaatgacctacag

SEQ ID NO: 914802 - DNA, 22 bp, Artificial Sequence
  chemically synthesized
aaagcgtaattaatgacctaca

SEQ ID NO: 914803 - DNA, 22 bp, Artificial Sequence
  chemically synthesized
ctatgtgtctctgtaggtcatt

SEQ ID NO: 914804 - DNA, 22 bp, Artificial Sequence
  chemically synthesized
taaagcgtaattaatgacctac

SEQ ID NO: 914805 - DNA, 22 bp, Artificial Sequence
  chemically synthesized
ttaaagcgtaattaatgaccta

SEQ ID NO: 914806 - DNA, 22 bp, Artificial Sequence
  chemically synthesized
tgtgtctctgtaggtcattaat

SEQ ID NO: 914807 - DNA, 22 bp, Artificial Sequence
  chemically synthesized
tgtaggtcattaattacgcttt

SEQ ID NO: 914808 - DNA, 22 bp, Artificial Sequence
  chemically synthesized
taggtcattaattacgctttaa

SEQ ID NO: 914809 - DNA, 22 bp, Artificial Sequence
  chemically synthesized
aaaaatcaagtttttaaagcgt

SEQ ID NO: 914810 - DNA, 22 bp, Artificial Sequence
  chemically synthesized
aaaaaatcaagtttttaaagcg

SEQ ID NO: 914811 - DNA, 22 bp, Artificial Sequence
  chemically synthesized
ggatcttaaaaaatcaagtttt

SEQ ID NO: 914812 - DNA, 22 bp, Artificial Sequence
  chemically synthesized
attacgctttaaaaacttgatt

SEQ ID NO: 914813 - DNA, 22 bp, Artificial Sequence
  chemically synthesized
ctaggatcttaaaaaatcaagt

SEQ ID NO: 914814 - DNA, 22 bp, Artificial Sequence
  chemically synthesized
cgctttaaaaacttgatttttt

SEQ ID NO: 914815 - DNA, 22 bp, Artificial Sequence
  chemically synthesized
ttactaggatcttaaaaaatca

SEQ ID NO: 914816 - DNA, 22 bp, Artificial Sequence
  chemically synthesized
attactaggatcttaaaaaatc

SEQ ID NO: 914817 - DNA, 22 bp, Artificial Sequence
  chemically synthesized
taaaaacttgattttttaagat

SEQ ID NO: 914818 - DNA, 22 bp, Artificial Sequence
  chemically synthesized
aaaaacttgattttttaagatc

SEQ ID NO: 914819 - DNA, 22 bp, Artificial Sequence
  chemically synthesized
aaaacttgattttttaagatcc

SEQ ID NO: 914820 - DNA, 22 bp, Artificial Sequence
  chemically synthesized
tatatcttattactaggatctt

SEQ ID NO: 914821 - DNA, 22 bp, Artificial Sequence
  chemically synthesized
gattttttaagatcctagtaat

SEQ ID NO: 914822 - DNA, 22 bp, Artificial Sequence
  chemically synthesized
attttttaagatcctagtaata

SEQ ID NO: 914823 - DNA, 22 bp, Artificial Sequence
  chemically synthesized
tttaagatcctagtaataagat

SEQ ID NO: 914824 - DNA, 22 bp, Artificial Sequence
  chemically synthesized
ttaagatcctagtaataagata

SEQ ID NO: 914825 - DNA, 22 bp, Artificial Sequence
  chemically synthesized
taagatcctagtaataagatat

SEQ ID NO: 914826 - DNA, 22 bp, Artificial Sequence
  chemically synthesized
aagatcctagtaataagatata

SEQ ID NO: 914827 - DNA, 22 bp, Artificial Sequence
  chemically synthesized
agatcctagtaataagatatat

SEQ ID NO: 914828 - DNA, 22 bp, Artificial Sequence
  chemically synthesized
gtaataagatatataggggtac

SEQ ID NO: 914829 - DNA, 22 bp, Artificial Sequence
  chemically synthesized
ataacacaataatggtgaaata

SEQ ID NO: 914830 - DNA, 22 bp, Artificial Sequence
  chemically synthesized
ctaataacacaataatggtgaa

SEQ ID NO: 914831 - DNA, 22 bp, Artificial Sequence
  chemically synthesized
tatttcaccattattgtgttat

SEQ ID NO: 914832 - DNA, 22 bp, Artificial Sequence
  chemically synthesized
caccattattgtgttattagga

SEQ ID NO: 914833 - DNA, 22 bp, Artificial Sequence
  chemically synthesized
accattattgtgttattaggaa

SEQ ID NO: 914834 - DNA, 22 bp, Artificial Sequence
  chemically synthesized
ttgtgttattaggaattttgtt

SEQ ID NO: 914835 - DNA, 22 bp, Artificial Sequence
  chemically synthesized
tgttattaggaattttgtttgc

SEQ ID NO: 914836 - DNA, 22 bp, Artificial Sequence
  chemically synthesized
taataaaaaatgaaagcaaaca

SEQ ID NO: 914837 - DNA, 22 bp, Artificial Sequence
  chemically synthesized
ttaggaattttgtttgctttca

SEQ ID NO: 914838 - DNA, 22 bp, Artificial Sequence
  chemically synthesized
attataataaaaaatgaaagca

SEQ ID NO: 914839 - DNA, 22 bp, Artificial Sequence
  chemically synthesized
ggaattttgtttgctttcattt

SEQ ID NO: 914840 - DNA, 22 bp, Artificial Sequence
  chemically synthesized
ttcattataataaaaaatgaaa

SEQ ID NO: 914841 - DNA, 22 bp, Artificial Sequence
  chemically synthesized
tgtttgctttcattttttatta

SEQ ID NO: 914842 - DNA, 22 bp, Artificial Sequence
  chemically synthesized
gtttgctttcattttttattat

SEQ ID NO: 914843 - DNA, 22 bp, Artificial Sequence
  chemically synthesized
tttgctttcattttttattata

SEQ ID NO: 914844 - DNA, 22 bp, Artificial Sequence
  chemically synthesized
tagggttattcattataataaa

SEQ ID NO: 914845 - DNA, 22 bp, Artificial Sequence
  chemically synthesized
gctttcattttttattataatg

SEQ ID NO: 914846 - DNA, 22 bp, Artificial Sequence
  chemically synthesized
ctttcattttttattataatga

SEQ ID NO: 914847 - DNA, 22 bp, Artificial Sequence
  chemically synthesized
ttgtagggttattcattataat

SEQ ID NO: 914848 - DNA, 22 bp, Artificial Sequence
  chemically synthesized
attgtagggttattcattataa

SEQ ID NO: 914849 - DNA, 22 bp, Artificial Sequence
  chemically synthesized
tcattttttattataatgaata

SEQ ID NO: 914850 - DNA, 22 bp, Artificial Sequence
  chemically synthesized
cattttttattataatgaataa

SEQ ID NO: 914851 - DNA, 22 bp, Artificial Sequence
  chemically synthesized
attttttattataatgaataac

SEQ ID NO: 914852 - DNA, 22 bp, Artificial Sequence
  chemically synthesized
tttattataatgaataacccta

SEQ ID NO: 914853 - DNA, 22 bp, Artificial Sequence
  chemically synthesized
ttattataatgaataaccctac

SEQ ID NO: 914854 - DNA, 22 bp, Artificial Sequence
  chemically synthesized
tattataatgaataaccctaca

SEQ ID NO: 914855 - DNA, 22 bp, Artificial Sequence
  chemically synthesized
attataatgaataaccctacaa

SEQ ID NO: 914856 - DNA, 22 bp, Artificial Sequence
  chemically synthesized
ttataatgaataaccctacaat

SEQ ID NO: 914857 - DNA, 22 bp, Artificial Sequence
  chemically synthesized
taatgaataaccctacaataaa

SEQ ID NO: 914858 - DNA, 22 bp, Artificial Sequence
  chemically synthesized
aaaatgtataaataaatgtgtt

SEQ ID NO: 914859 - DNA, 22 bp, Artificial Sequence
  chemically synthesized
caataaacacatttatttatac

SEQ ID NO: 914860 - DNA, 22 bp, Artificial Sequence
  chemically synthesized
cagcagatacatgattcaaaat

SEQ ID NO: 914861 - DNA, 22 bp, Artificial Sequence
  chemically synthesized
atttatacattttgaatcatgt

SEQ ID NO: 914862 - DNA, 22 bp, Artificial Sequence
  chemically synthesized
attccagcagatacatgattca

SEQ ID NO: 914863 - DNA, 22 bp, Artificial Sequence
  chemically synthesized
tttatacattttgaatcatgta

SEQ ID NO: 914864 - DNA, 22 bp, Artificial Sequence
  chemically synthesized
tcattccagcagatacatgatt

SEQ ID NO: 914865 - DNA, 22 bp, Artificial Sequence
  chemically synthesized
atacattttgaatcatgtatct

SEQ ID NO: 914866 - DNA, 22 bp, Artificial Sequence
  chemically synthesized
tacattttgaatcatgtatctg

SEQ ID NO: 914867 - DNA, 22 bp, Artificial Sequence
  chemically synthesized
attctcattccagcagatacat

SEQ ID NO: 914868 - DNA, 22 bp, Artificial Sequence
  chemically synthesized
cattctcattccagcagataca

SEQ ID NO: 914869 - DNA, 22 bp, Artificial Sequence
  chemically synthesized
tcattctcattccagcagatac

SEQ ID NO: 914870 - DNA, 22 bp, Artificial Sequence
  chemically synthesized
ttcattctcattccagcagata

SEQ ID NO: 914871 - DNA, 22 bp, Artificial Sequence
  chemically synthesized
tgaatcatgtatctgctggaat

SEQ ID NO: 914872 - DNA, 22 bp, Artificial Sequence
  chemically synthesized
gaatcatgtatctgctggaatg

SEQ ID NO: 914873 - DNA, 22 bp, Artificial Sequence
  chemically synthesized
acttttcattctcattccagca

SEQ ID NO: 914874 - DNA, 22 bp, Artificial Sequence
  chemically synthesized
aatcatgtatctgctggaatga

SEQ ID NO: 914875 - DNA, 22 bp, Artificial Sequence
  chemically synthesized
ttaacttttcattctcattcca

SEQ ID NO: 914876 - DNA, 22 bp, Artificial Sequence
  chemically synthesized
ccattgttaacttttcattctc

SEQ ID NO: 914877 - DNA, 22 bp, Artificial Sequence
  chemically synthesized
ctggaatgagaatgaaaagtta

SEQ ID NO: 914878 - DNA, 22 bp, Artificial Sequence
  chemically synthesized
ggattcccattgttaacttttc

SEQ ID NO: 914879 - DNA, 22 bp, Artificial Sequence
  chemically synthesized
aggattcccattgttaactttt

SEQ ID NO: 914880 - DNA, 22 bp, Artificial Sequence
  chemically synthesized
gaatgagaatgaaaagttaaca

SEQ ID NO: 914881 - DNA, 22 bp, Artificial Sequence
  chemically synthesized
aatccttaggattcccattgtt

SEQ ID NO: 914882 - DNA, 22 bp, Artificial Sequence
  chemically synthesized
acaatgggaatcctaaggattt

SEQ ID NO: 914883 - DNA, 22 bp, Artificial Sequence
  chemically synthesized
aacaatgtgtatctaaatcctt

SEQ ID NO: 914884 - DNA, 22 bp, Artificial Sequence
  chemically synthesized
acagaaattcaacaatgtgtat

SEQ ID NO: 914885 - DNA, 22 bp, Artificial Sequence
  chemically synthesized
gacagaaattcaacaatgtgta

SEQ ID NO: 914886 - DNA, 22 bp, Artificial Sequence
  chemically synthesized
aggatttagatacacattgttg

SEQ ID NO: 914887 - DNA, 22 bp, Artificial Sequence
  chemically synthesized
agatacacattgttgaatttct

SEQ ID NO: 914888 - DNA, 22 bp, Artificial Sequence
  chemically synthesized
gatacacattgttgaatttctg

SEQ ID NO: 914889 - DNA, 22 bp, Artificial Sequence
  chemically synthesized
agtaccaaccttgacagaaatt

SEQ ID NO: 914890 - DNA, 22 bp, Artificial Sequence
  chemically synthesized
tgagtaccaaccttgacagaaa

SEQ ID NO: 914891 - DNA, 22 bp, Artificial Sequence
  chemically synthesized
ttgaatttctgtcaaggttggt

SEQ ID NO: 914892 - DNA, 22 bp, Artificial Sequence
  chemically synthesized
cgagtgttctgagtaccaacct

SEQ ID NO: 914893 - DNA, 22 bp, Artificial Sequence
  chemically synthesized
aatttctgtcaaggttggtact

SEQ ID NO: 914894 - DNA, 22 bp, Artificial Sequence
  chemically synthesized
acgagtgttctgagtaccaacc

SEQ ID NO: 914895 - DNA, 22 bp, Artificial Sequence
  chemically synthesized
ctgtcaaggttggtactcagaa

SEQ ID NO: 914896 - DNA, 22 bp, Artificial Sequence
  chemically synthesized
tgtcaaggttggtactcagaac

SEQ ID NO: 914897 - DNA, 22 bp, Artificial Sequence
  chemically synthesized
tcaaggttggtactcagaacac

SEQ ID NO: 914898 - DNA, 22 bp, Artificial Sequence
  chemically synthesized
gtgggagtttacgagtgttctg

SEQ ID NO: 914899 - DNA, 22 bp, Artificial Sequence
  chemically synthesized
ttggtgggagtttacgagtgtt

SEQ ID NO: 914900 - DNA, 22 bp, Artificial Sequence
  chemically synthesized
gtactcagaacactcgtaaact

SEQ ID NO: 914901 - DNA, 22 bp, Artificial Sequence
  chemically synthesized
taactgttggtgggagtttacg

SEQ ID NO: 914902 - DNA, 22 bp, Artificial Sequence
  chemically synthesized
gtaactgttggtgggagtttac

SEQ ID NO: 914903 - DNA, 22 bp, Artificial Sequence
  chemically synthesized
tgtaactgttggtgggagttta

SEQ ID NO: 914904 - DNA, 22 bp, Artificial Sequence
  chemically synthesized
agaacactcgtaaactcccacc

SEQ ID NO: 914905 - DNA, 22 bp, Artificial Sequence
  chemically synthesized
gtaaactcccaccaacagttac

SEQ ID NO: 914906 - DNA, 22 bp, Artificial Sequence
  chemically synthesized
ccaccaacagttacaaaatact

SEQ ID NO: 914907 - DNA, 22 bp, Artificial Sequence
  chemically synthesized
caaaatacttgtctcactacac

SEQ ID NO: 914908 - DNA, 22 bp, Artificial Sequence
  chemically synthesized
aatagtggcaaaagtgtagtga

SEQ ID NO: 914909 - DNA, 22 bp, Artificial Sequence
  chemically synthesized
taatgctcaatagtggcaaaag

SEQ ID NO: 914910 - DNA, 22 bp, Artificial Sequence
  chemically synthesized
gtctcactacacttttgccact

SEQ ID NO: 914911 - DNA, 22 bp, Artificial Sequence
  chemically synthesized
tctcactacacttttgccacta

SEQ ID NO: 914912 - DNA, 22 bp, Artificial Sequence
  chemically synthesized
actacacttttgccactattga

SEQ ID NO: 914913 - DNA, 22 bp, Artificial Sequence
  chemically synthesized
cacttttgccactattgagcat

SEQ ID NO: 914914 - DNA, 22 bp, Artificial Sequence
  chemically synthesized
gtatatcaattataatgctcaa

SEQ ID NO: 914915 - DNA, 22 bp, Artificial Sequence
  chemically synthesized
ttgccactattgagcattataa

SEQ ID NO: 914916 - DNA, 22 bp, Artificial Sequence
  chemically synthesized
ttggtatatcaattataatgct

SEQ ID NO: 914917 - DNA, 22 bp, Artificial Sequence
  chemically synthesized
tgccactattgagcattataat

SEQ ID NO: 914918 - DNA, 22 bp, Artificial Sequence
  chemically synthesized
attggtatatcaattataatgc

SEQ ID NO: 914919 - DNA, 22 bp, Artificial Sequence
  chemically synthesized
gccactattgagcattataatt

SEQ ID NO: 914920 - DNA, 22 bp, Artificial Sequence
  chemically synthesized
tattggtatatcaattataatg

SEQ ID NO: 914921 - DNA, 22 bp, Artificial Sequence
  chemically synthesized
ccactattgagcattataattg

SEQ ID NO: 914922 - DNA, 22 bp, Artificial Sequence
  chemically synthesized
ttttattggtatatcaattata

SEQ ID NO: 914923 - DNA, 22 bp, Artificial Sequence
  chemically synthesized
gttttattggtatatcaattat

SEQ ID NO: 914924 - DNA, 22 bp, Artificial Sequence
  chemically synthesized
ttgagcattataattgatatac

SEQ ID NO: 914925 - DNA, 22 bp, Artificial Sequence
  chemically synthesized
tttgttttattggtatatcaat

SEQ ID NO: 914926 - DNA, 22 bp, Artificial Sequence
  chemically synthesized
atttgttttattggtatatcaa

SEQ ID NO: 914927 - DNA, 22 bp, Artificial Sequence
  chemically synthesized
tatttgttttattggtatatca

SEQ ID NO: 914928 - DNA, 22 bp, Artificial Sequence
  chemically synthesized
agcattataattgatataccaa

SEQ ID NO: 914929 - DNA, 22 bp, Artificial Sequence
  chemically synthesized
ttatttgttttattggtatatc

SEQ ID NO: 914930 - DNA, 22 bp, Artificial Sequence
  chemically synthesized
tttatttgttttattggtatat

SEQ ID NO: 914931 - DNA, 22 bp, Artificial Sequence
  chemically synthesized
taattgatataccaataaaaca

SEQ ID NO: 914932 - DNA, 22 bp, Artificial Sequence
  chemically synthesized
tggcaagctttttatttgtttt

SEQ ID NO: 914933 - DNA, 22 bp, Artificial Sequence
  chemically synthesized
atataccaataaaacaaataaa

SEQ ID NO: 914934 - DNA, 22 bp, Artificial Sequence
  chemically synthesized
aaatatctatggcaagcttttt

SEQ ID NO: 914935 - DNA, 22 bp, Artificial Sequence
  chemically synthesized
aaaatatctatggcaagctttt

SEQ ID NO: 914936 - DNA, 22 bp, Artificial Sequence
  chemically synthesized
gtagaatacttaaaatatctat

SEQ ID NO: 914937 - DNA, 22 bp, Artificial Sequence
  chemically synthesized
ttagtagaatacttaaaatatc

SEQ ID NO: 914938 - DNA, 22 bp, Artificial Sequence
  chemically synthesized
ctattagtagaatacttaaaat

SEQ ID NO: 914939 - DNA, 22 bp, Artificial Sequence
  chemically synthesized
cctattagtagaatacttaaaa

SEQ ID NO: 914940 - DNA, 22 bp, Artificial Sequence
  chemically synthesized
tcctattagtagaatacttaaa

SEQ ID NO: 914941 - DNA, 22 bp, Artificial Sequence
  chemically synthesized
gccatagatattttaagtattc

SEQ ID NO: 914942 - DNA, 22 bp, Artificial Sequence
  chemically synthesized
ccatagatattttaagtattct

SEQ ID NO: 914943 - DNA, 22 bp, Artificial Sequence
  chemically synthesized
aactttcctattagtagaatac

SEQ ID NO: 914944 - DNA, 22 bp, Artificial Sequence
  chemically synthesized
caactttcctattagtagaata

SEQ ID NO: 914945 - DNA, 22 bp, Artificial Sequence
  chemically synthesized
tcaactttcctattagtagaat

SEQ ID NO: 914946 - DNA, 22 bp, Artificial Sequence
  chemically synthesized
taagtattctactaataggaaa

SEQ ID NO: 914947 - DNA, 22 bp, Artificial Sequence
  chemically synthesized
aagtattctactaataggaaag

SEQ ID NO: 914948 - DNA, 22 bp, Artificial Sequence
  chemically synthesized
agtattctactaataggaaagt

SEQ ID NO: 914949 - DNA, 22 bp, Artificial Sequence
  chemically synthesized
tactaataggaaagttgaaaat

SEQ ID NO: 914950 - DNA, 22 bp, Artificial Sequence
  chemically synthesized
ctaataggaaagttgaaaatgt

SEQ ID NO: 914951 - DNA, 22 bp, Artificial Sequence
  chemically synthesized
ataggaaagttgaaaatgttgt

SEQ ID NO: 914952 - DNA, 22 bp, Artificial Sequence
  chemically synthesized
aaaatgttgtatgtgtgtacat

SEQ ID NO: 914953 - DNA, 22 bp, Artificial Sequence
  chemically synthesized
aataaatgacaaacatgtacac

SEQ ID NO: 914954 - DNA, 22 bp, Artificial Sequence
  chemically synthesized
tatgtgtgtacatgtttgtcat

SEQ ID NO: 914955 - DNA, 22 bp, Artificial Sequence
  chemically synthesized
acagtggaaactaaataaatga

SEQ ID NO: 914956 - DNA, 22 bp, Artificial Sequence
  chemically synthesized
ccgataattgacagtggaaact

SEQ ID NO: 914957 - DNA, 22 bp, Artificial Sequence
  chemically synthesized
gtcatttatttagtttccactg

SEQ ID NO: 914958 - DNA, 22 bp, Artificial Sequence
  chemically synthesized
tcatttatttagtttccactgt

SEQ ID NO: 914959 - DNA, 22 bp, Artificial Sequence
  chemically synthesized
atttagtttccactgtcaatta

SEQ ID NO: 914960 - DNA, 22 bp, Artificial Sequence
  chemically synthesized
tttagtttccactgtcaattat

SEQ ID NO: 914961 - DNA, 22 bp, Artificial Sequence
  chemically synthesized
agtttccactgtcaattatcgg

SEQ ID NO: 914962 - DNA, 22 bp, Artificial Sequence
  chemically synthesized
gtttccactgtcaattatcggc

SEQ ID NO: 914963 - DNA, 22 bp, Artificial Sequence
  chemically synthesized
ccactgtcaattatcggcaatg

SEQ ID NO: 914964 - DNA, 22 bp, Artificial Sequence
  chemically synthesized
cactgtcaattatcggcaatgt

SEQ ID NO: 914965 - DNA, 22 bp, Artificial Sequence
  chemically synthesized
tcaattatcggcaatgtctgtt

SEQ ID NO: 914966 - DNA, 22 bp, Artificial Sequence
  chemically synthesized
tcggcaatgtctgttgcccatt

SEQ ID NO: 914967 - DNA, 22 bp, Artificial Sequence
  chemically synthesized
aaaataggaaaacacaggaaaa

SEQ ID NO: 914968 - DNA, 22 bp, Artificial Sequence
  chemically synthesized
aaaaataggaaaacacaggaaa

SEQ ID NO: 914969 - DNA, 22 bp, Artificial Sequence
  chemically synthesized
ttaaaaataggaaaacacagga

SEQ ID NO: 914970 - DNA, 22 bp, Artificial Sequence
  chemically synthesized
ttgcccatttttcctgtgtttt

SEQ ID NO: 914971 - DNA, 22 bp, Artificial Sequence
  chemically synthesized
cccatttttcctgtgttttcct

SEQ ID NO: 914972 - DNA, 22 bp, Artificial Sequence
  chemically synthesized
ttcctgtgttttcctattttta

SEQ ID NO: 914973 - DNA, 22 bp, Artificial Sequence
  chemically synthesized
tcctgtgttttcctatttttaa

SEQ ID NO: 914974 - DNA, 22 bp, Artificial Sequence
  chemically synthesized
cctgtgttttcctatttttaag

SEQ ID NO: 914975 - DNA, 22 bp, Artificial Sequence
  chemically synthesized
ctgtgttttcctatttttaaga

SEQ ID NO: 914976 - DNA, 22 bp, Artificial Sequence
  chemically synthesized
tgttttcctatttttaagagct

SEQ ID NO: 914977 - DNA, 22 bp, Artificial Sequence
  chemically synthesized
agataatgtgaaaagagctctt

SEQ ID NO: 914978 - DNA, 22 bp, Artificial Sequence
  chemically synthesized
cagataatgtgaaaagagctct

SEQ ID NO: 914979 - DNA, 22 bp, Artificial Sequence
  chemically synthesized
tcctatttttaagagctctttt

SEQ ID NO: 914980 - DNA, 22 bp, Artificial Sequence
  chemically synthesized
cctatttttaagagctcttttc

SEQ ID NO: 914981 - DNA, 22 bp, Artificial Sequence
  chemically synthesized
ctatttttaagagctcttttca

SEQ ID NO: 914982 - DNA, 22 bp, Artificial Sequence
  chemically synthesized
tgtttcagataatgtgaaaaga

SEQ ID NO: 914983 - DNA, 22 bp, Artificial Sequence
  chemically synthesized
tttttaagagctcttttcacat

SEQ ID NO: 914984 - DNA, 22 bp, Artificial Sequence
  chemically synthesized
ttaagagctcttttcacattat

SEQ ID NO: 914985 - DNA, 22 bp, Artificial Sequence
  chemically synthesized
taagagctcttttcacattatc

SEQ ID NO: 914986 - DNA, 22 bp, Artificial Sequence
  chemically synthesized
atctatgtttcagataatgtga

SEQ ID NO: 914987 - DNA, 22 bp, Artificial Sequence
  chemically synthesized
aagagctcttttcacattatct

SEQ ID NO: 914988 - DNA, 22 bp, Artificial Sequence
  chemically synthesized
agagctcttttcacattatctg

SEQ ID NO: 914989 - DNA, 22 bp, Artificial Sequence
  chemically synthesized
aattaatctatgtttcagataa

SEQ ID NO: 914990 - DNA, 22 bp, Artificial Sequence
  chemically synthesized
ttttcacattatctgaaacata

SEQ ID NO: 914991 - DNA, 22 bp, Artificial Sequence
  chemically synthesized
ttcacattatctgaaacataga

SEQ ID NO: 914992 - DNA, 22 bp, Artificial Sequence
  chemically synthesized
tcacattatctgaaacatagat

SEQ ID NO: 914993 - DNA, 22 bp, Artificial Sequence
  chemically synthesized
cacattatctgaaacatagatt

SEQ ID NO: 914994 - DNA, 22 bp, Artificial Sequence
  chemically synthesized
acattatctgaaacatagatta

SEQ ID NO: 914995 - DNA, 22 bp, Artificial Sequence
  chemically synthesized
gaaacgtagtctcaattaatct

SEQ ID NO: 914996 - DNA, 22 bp, Artificial Sequence
  chemically synthesized
tctgaaacatagattaattgag

SEQ ID NO: 914997 - DNA, 22 bp, Artificial Sequence
  chemically synthesized
aaacatagattaattgagacta

SEQ ID NO: 914998 - DNA, 22 bp, Artificial Sequence
  chemically synthesized
attgagactacgtttccagctt

SEQ ID NO: 914999 - DNA, 22 bp, Artificial Sequence
  chemically synthesized
aaaggcaaaaaggaagctggaa

SEQ ID NO: 915000 - DNA, 22 bp, Artificial Sequence
  chemically synthesized
agactacgtttccagcttcctt

SEQ ID NO: 915001 - DNA, 22 bp, Artificial Sequence
  chemically synthesized
ctaaaaggcaaaaaggaagctg

SEQ ID NO: 915002 - DNA, 22 bp, Artificial Sequence
  chemically synthesized
cgtttccagcttcctttttgcc

SEQ ID NO: 915003 - DNA, 22 bp, Artificial Sequence
  chemically synthesized
gaaaaaactactaaaaggcaaa

SEQ ID NO: 915004 - DNA, 22 bp, Artificial Sequence
  chemically synthesized
ccagcttcctttttgcctttta

SEQ ID NO: 915005 - DNA, 22 bp, Artificial Sequence
  chemically synthesized
agaaaaaactactaaaaggcaa

SEQ ID NO: 915006 - DNA, 22 bp, Artificial Sequence
  chemically synthesized
cagcttcctttttgccttttag

SEQ ID NO: 915007 - DNA, 22 bp, Artificial Sequence
  chemically synthesized
tttagaaaaaactactaaaagg

SEQ ID NO: 915008 - DNA, 22 bp, Artificial Sequence
  chemically synthesized
atttagaaaaaactactaaaag

SEQ ID NO: 915009 - DNA, 22 bp, Artificial Sequence
  chemically synthesized
tatttagaaaaaactactaaaa

SEQ ID NO: 915010 - DNA, 22 bp, Artificial Sequence
  chemically synthesized
cctttttgccttttagtagttt

SEQ ID NO: 915011 - DNA, 22 bp, Artificial Sequence
  chemically synthesized
ctttttgccttttagtagtttt

SEQ ID NO: 915012 - DNA, 22 bp, Artificial Sequence
  chemically synthesized
aattttatttagaaaaaactac

SEQ ID NO: 915013 - DNA, 22 bp, Artificial Sequence
  chemically synthesized
tttgccttttagtagttttttc

SEQ ID NO: 915014 - DNA, 22 bp, Artificial Sequence
  chemically synthesized
ttgccttttagtagttttttct

SEQ ID NO: 915015 - DNA, 22 bp, Artificial Sequence
  chemically synthesized
tgccttttagtagttttttcta

SEQ ID NO: 915016 - DNA, 22 bp, Artificial Sequence
  chemically synthesized
ttaaattttatttagaaaaaac

SEQ ID NO: 915017 - DNA, 22 bp, Artificial Sequence
  chemically synthesized
gccttttagtagttttttctaa

SEQ ID NO: 915018 - DNA, 22 bp, Artificial Sequence
  chemically synthesized
ccttttagtagttttttctaaa

SEQ ID NO: 915019 - DNA, 22 bp, Artificial Sequence
  chemically synthesized
ttagtagttttttctaaataaa

SEQ ID NO: 915020 - DNA, 22 bp, Artificial Sequence
  chemically synthesized
tagtagttttttctaaataaaa

SEQ ID NO: 915021 - DNA, 22 bp, Artificial Sequence
  chemically synthesized
agtagttttttctaaataaaat

SEQ ID NO: 915022 - DNA, 22 bp, Artificial Sequence
  chemically synthesized
gtagttttttctaaataaaatt

SEQ ID NO: 915023 - DNA, 22 bp, Artificial Sequence
  chemically synthesized
tttctaaataaaatttaacagt

SEQ ID NO: 915024 - DNA, 22 bp, Artificial Sequence
  chemically synthesized
ttctaaataaaatttaacagtt

SEQ ID NO: 915025 - DNA, 22 bp, Artificial Sequence
  chemically synthesized
tctaaataaaatttaacagttt

SEQ ID NO: 915026 - DNA, 22 bp, Artificial Sequence
  chemically synthesized
ctaaataaaatttaacagttta

SEQ ID NO: 915027 - DNA, 22 bp, Artificial Sequence
  chemically synthesized
taaataaaatttaacagtttat

SEQ ID NO: 915028 - DNA, 22 bp, Artificial Sequence
  chemically synthesized
aataaaatttaacagtttattt

SEQ ID NO: 915029 - DNA, 22 bp, Artificial Sequence
  chemically synthesized
tcaatgaacataatatcaaaga

SEQ ID NO: 915030 - DNA, 22 bp, Artificial Sequence
  chemically synthesized
aacagtttatttctttgatatt

SEQ ID NO: 915031 - DNA, 22 bp, Artificial Sequence
  chemically synthesized
acagtttatttctttgatatta

SEQ ID NO: 915032 - DNA, 22 bp, Artificial Sequence
  chemically synthesized
atttctttgatattatgttcat

SEQ ID NO: 915033 - DNA, 22 bp, Artificial Sequence
  chemically synthesized
aggatactatcaatgaacataa

SEQ ID NO: 915034 - DNA, 22 bp, Artificial Sequence
  chemically synthesized
tttctttgatattatgttcatt

SEQ ID NO: 915035 - DNA, 22 bp, Artificial Sequence
  chemically synthesized
aaggatactatcaatgaacata

SEQ ID NO: 915036 - DNA, 22 bp, Artificial Sequence
  chemically synthesized
taaggatactatcaatgaacat

SEQ ID NO: 915037 - DNA, 22 bp, Artificial Sequence
  chemically synthesized
ctttgatattatgttcattgat

SEQ ID NO: 915038 - DNA, 22 bp, Artificial Sequence
  chemically synthesized
tttgatattatgttcattgata

SEQ ID NO: 915039 - DNA, 22 bp, Artificial Sequence
  chemically synthesized
tgatattatgttcattgatagt

SEQ ID NO: 915040 - DNA, 22 bp, Artificial Sequence
  chemically synthesized
gatattatgttcattgatagta

SEQ ID NO: 915041 - DNA, 22 bp, Artificial Sequence
  chemically synthesized
atattatgttcattgatagtat

SEQ ID NO: 915042 - DNA, 22 bp, Artificial Sequence
  chemically synthesized
tgttcattgatagtatccttaa

SEQ ID NO: 915043 - DNA, 22 bp, Artificial Sequence
  chemically synthesized
attgatagtatccttaaaattg

SEQ ID NO: 915044 - DNA, 22 bp, Artificial Sequence
  chemically synthesized
atagtatccttaaaattgtggc

SEQ ID NO: 915045 - DNA, 22 bp, Artificial Sequence
  chemically synthesized
aacaatggtaaaatggccacaa

SEQ ID NO: 915046 - DNA, 22 bp, Artificial Sequence
  chemically synthesized
aaaattgtggccattttaccat

SEQ ID NO: 915047 - DNA, 22 bp, Artificial Sequence
  chemically synthesized
aaattgtggccattttaccatt

SEQ ID NO: 915048 - DNA, 22 bp, Artificial Sequence
  chemically synthesized
tggccattttaccattgttcag

SEQ ID NO: 915049 - DNA, 22 bp, Artificial Sequence
  chemically synthesized
taccattgttcagatattctca

SEQ ID NO: 915050 - DNA, 22 bp, Artificial Sequence
  chemically synthesized
accattgttcagatattctcat

SEQ ID NO: 915051 - DNA, 22 bp, Artificial Sequence
  chemically synthesized
ccattgttcagatattctcatt

SEQ ID NO: 915052 - DNA, 22 bp, Artificial Sequence
  chemically synthesized
ttcagatattctcatttattct

SEQ ID NO: 915053 - DNA, 22 bp, Artificial Sequence
  chemically synthesized
agatattctcatttattcttga

SEQ ID NO: 915054 - DNA, 22 bp, Artificial Sequence
  chemically synthesized
tcatttattcttgatcctttac

SEQ ID NO: 915055 - DNA, 22 bp, Artificial Sequence
  chemically synthesized
acaaatgaaagagtaaaggatc

SEQ ID NO: 915056 - DNA, 22 bp, Artificial Sequence
  chemically synthesized
aacaaatgaaagagtaaaggat

SEQ ID NO: 915057 - DNA, 22 bp, Artificial Sequence
  chemically synthesized
atttattcttgatcctttactc

SEQ ID NO: 915058 - DNA, 22 bp, Artificial Sequence
  chemically synthesized
taacaaatgaaagagtaaagga

SEQ ID NO: 915059 - DNA, 22 bp, Artificial Sequence
  chemically synthesized
ttaacaaatgaaagagtaaagg

SEQ ID NO: 915060 - DNA, 22 bp, Artificial Sequence
  chemically synthesized
tttaacaaatgaaagagtaaag

SEQ ID NO: 915061 - DNA, 22 bp, Artificial Sequence
  chemically synthesized
ttttaacaaatgaaagagtaaa

SEQ ID NO: 915062 - DNA, 22 bp, Artificial Sequence
  chemically synthesized
attcttgatcctttactctttc

SEQ ID NO: 915063 - DNA, 22 bp, Artificial Sequence
  chemically synthesized
ttcttgatcctttactctttca

SEQ ID NO: 915064 - DNA, 22 bp, Artificial Sequence
  chemically synthesized
ttttttaacaaatgaaagagta

SEQ ID NO: 915065 - DNA, 22 bp, Artificial Sequence
  chemically synthesized
ttgatcctttactctttcattt

SEQ ID NO: 915066 - DNA, 22 bp, Artificial Sequence
  chemically synthesized
ttcttttttaacaaatgaaaga

SEQ ID NO: 915067 - DNA, 22 bp, Artificial Sequence
  chemically synthesized
gatcctttactctttcatttgt

SEQ ID NO: 915068 - DNA, 22 bp, Artificial Sequence
  chemically synthesized
atcctttactctttcatttgtt

SEQ ID NO: 915069 - DNA, 22 bp, Artificial Sequence
  chemically synthesized
gttgttcttttttaacaaatga

SEQ ID NO: 915070 - DNA, 22 bp, Artificial Sequence
  chemically synthesized
ggttgttcttttttaacaaatg

SEQ ID NO: 915071 - DNA, 22 bp, Artificial Sequence
  chemically synthesized
tactctttcatttgttaaaaaa

SEQ ID NO: 915072 - DNA, 22 bp, Artificial Sequence
  chemically synthesized
actctttcatttgttaaaaaag

SEQ ID NO: 915073 - DNA, 22 bp, Artificial Sequence
  chemically synthesized
ctctttcatttgttaaaaaaga

SEQ ID NO: 915074 - DNA, 22 bp, Artificial Sequence
  chemically synthesized
aatatttggttgttctttttta

SEQ ID NO: 915075 - DNA, 22 bp, Artificial Sequence
  chemically synthesized
tttcatttgttaaaaaagaaca

SEQ ID NO: 915076 - DNA, 22 bp, Artificial Sequence
  chemically synthesized
tcatttgttaaaaaagaacaac

SEQ ID NO: 915077 - DNA, 22 bp, Artificial Sequence
  chemically synthesized
catttgttaaaaaagaacaacc

SEQ ID NO: 915078 - DNA, 22 bp, Artificial Sequence
  chemically synthesized
atttgttaaaaaagaacaacca

SEQ ID NO: 915079 - DNA, 22 bp, Artificial Sequence
  chemically synthesized
gttaaaaaagaacaaccaaata

SEQ ID NO: 915080 - DNA, 22 bp, Artificial Sequence
  chemically synthesized
agatggattaaatatttggttg

SEQ ID NO: 915081 - DNA, 22 bp, Artificial Sequence
  chemically synthesized
ttaaaaaagaacaaccaaatat

SEQ ID NO: 915082 - DNA, 22 bp, Artificial Sequence
  chemically synthesized
aagatggattaaatatttggtt

SEQ ID NO: 915083 - DNA, 22 bp, Artificial Sequence
  chemically synthesized
aaaaagaacaaccaaatattta

SEQ ID NO: 915084 - DNA, 22 bp, Artificial Sequence
  chemically synthesized
tataaatttaagatggattaaa

SEQ ID NO: 915085 - DNA, 22 bp, Artificial Sequence
  chemically synthesized
gaaacaacactatataaattta

SEQ ID NO: 915086 - DNA, 22 bp, Artificial Sequence
  chemically synthesized
aatccatcttaaatttatatag

SEQ ID NO: 915087 - DNA, 22 bp, Artificial Sequence
  chemically synthesized
atccatcttaaatttatatagt

SEQ ID NO: 915088 - DNA, 22 bp, Artificial Sequence
  chemically synthesized
aaggttagaaacaacactatat

SEQ ID NO: 915089 - DNA, 22 bp, Artificial Sequence
  chemically synthesized
caaggttagaaacaacactata

SEQ ID NO: 915090 - DNA, 22 bp, Artificial Sequence
  chemically synthesized
ttcaaggttagaaacaacacta

SEQ ID NO: 915091 - DNA, 22 bp, Artificial Sequence
  chemically synthesized
aaatttatatagtgttgtttct

SEQ ID NO: 915092 - DNA, 22 bp, Artificial Sequence
  chemically synthesized
aatttatatagtgttgtttcta

SEQ ID NO: 915093 - DNA, 22 bp, Artificial Sequence
  chemically synthesized
aaaaactcttcaaggttagaaa

SEQ ID NO: 915094 - DNA, 22 bp, Artificial Sequence
  chemically synthesized
atatagtgttgtttctaacctt

SEQ ID NO: 915095 - DNA, 22 bp, Artificial Sequence
  chemically synthesized
tatagtgttgtttctaaccttg

SEQ ID NO: 915096 - DNA, 22 bp, Artificial Sequence
  chemically synthesized
tgaaaaactcttcaaggttaga

SEQ ID NO: 915097 - DNA, 22 bp, Artificial Sequence
  chemically synthesized
ctgaaaaactcttcaaggttag

SEQ ID NO: 915098 - DNA, 22 bp, Artificial Sequence
  chemically synthesized
tttctaaccttgaagagttttt

SEQ ID NO: 915099 - DNA, 22 bp, Artificial Sequence
  chemically synthesized
ctaaccttgaagagtttttcag

SEQ ID NO: 915100 - DNA, 22 bp, Artificial Sequence
  chemically synthesized
taaccttgaagagtttttcaga

SEQ ID NO: 915101 - DNA, 22 bp, Artificial Sequence
  chemically synthesized
accttgaagagtttttcagaaa

SEQ ID NO: 915102 - DNA, 22 bp, Artificial Sequence
  chemically synthesized
ggggaaaaaatatcagtttctg

SEQ ID NO: 915103 - DNA, 22 bp, Artificial Sequence
  chemically synthesized
gaagagtttttcagaaactgat

SEQ ID NO: 915104 - DNA, 22 bp, Artificial Sequence
  chemically synthesized
aagagtttttcagaaactgata

SEQ ID NO: 915105 - DNA, 22 bp, Artificial Sequence
  chemically synthesized
ttcagaaactgatattttttcc

SEQ ID NO: 915106 - DNA, 22 bp, Artificial Sequence
  chemically synthesized
tcagaaactgatattttttccc

SEQ ID NO: 915107 - DNA, 22 bp, Artificial Sequence
  chemically synthesized
cagaaactgatattttttcccc

SEQ ID NO: 915108 - DNA, 22 bp, Artificial Sequence
  chemically synthesized
agaaactgatattttttccccc

SEQ ID NO: 915109 - DNA, 22 bp, Artificial Sequence
  chemically synthesized
agaagagatggtgctgggggaa

SEQ ID NO: 915110 - DNA, 22 bp, Artificial Sequence
  chemically synthesized
atattttttcccccagcaccat

SEQ ID NO: 915111 - DNA, 22 bp, Artificial Sequence
  chemically synthesized
tttcccccagcaccatctcttc

SEQ ID NO: 915112 - DNA, 22 bp, Artificial Sequence
  chemically synthesized
ttcccccagcaccatctcttct

SEQ ID NO: 915113 - DNA, 22 bp, Artificial Sequence
  chemically synthesized
tcccccagcaccatctcttctg

SEQ ID NO: 915114 - DNA, 22 bp, Artificial Sequence
  chemically synthesized
cccccagcaccatctcttctga

SEQ ID NO: 915115 - DNA, 22 bp, Artificial Sequence
  chemically synthesized
ccccagcaccatctcttctgaa

SEQ ID NO: 915116 - DNA, 22 bp, Artificial Sequence
  chemically synthesized
ttctgaattgatttatggtgct

SEQ ID NO: 915117 - DNA, 22 bp, Artificial Sequence
  chemically synthesized
ctgaattgatttatggtgcttt

SEQ ID NO: 915118 - DNA, 22 bp, Artificial Sequence
  chemically synthesized
tgaattgatttatggtgctttc

SEQ ID NO: 915119 - DNA, 22 bp, Artificial Sequence
  chemically synthesized
aaatatcatgaagaaagcacca

SEQ ID NO: 915120 - DNA, 22 bp, Artificial Sequence
  chemically synthesized
aaaatatcatgaagaaagcacc

SEQ ID NO: 915121 - DNA, 22 bp, Artificial Sequence
  chemically synthesized
aattgatttatggtgctttctt

SEQ ID NO: 915122 - DNA, 22 bp, Artificial Sequence
  chemically synthesized
atttatggtgctttcttcatga

SEQ ID NO: 915123 - DNA, 22 bp, Artificial Sequence
  chemically synthesized
atggtgctttcttcatgatatt

SEQ ID NO: 915124 - DNA, 22 bp, Artificial Sequence
  chemically synthesized
tggtgctttcttcatgatattt

SEQ ID NO: 915125 - DNA, 22 bp, Artificial Sequence
  chemically synthesized
tcttcatgatattttaagtttc

SEQ ID NO: 915126 - DNA, 22 bp, Artificial Sequence
  chemically synthesized
cttcatgatattttaagtttct

SEQ ID NO: 915127 - DNA, 22 bp, Artificial Sequence
  chemically synthesized
ttcatgatattttaagtttctg

SEQ ID NO: 915128 - DNA, 22 bp, Artificial Sequence
  chemically synthesized
catgatattttaagtttctgct

SEQ ID NO: 915129 - DNA, 22 bp, Artificial Sequence
  chemically synthesized
atgatattttaagtttctgctt

SEQ ID NO: 915130 - DNA, 22 bp, Artificial Sequence
  chemically synthesized
cagtagatcaacaagcagaaac

SEQ ID NO: 915131 - DNA, 22 bp, Artificial Sequence
  chemically synthesized
taagtttctgcttgttgatcta

SEQ ID NO: 915132 - DNA, 22 bp, Artificial Sequence
  chemically synthesized
aagtttctgcttgttgatctac

SEQ ID NO: 915133 - DNA, 22 bp, Artificial Sequence
  chemically synthesized
agtttctgcttgttgatctact

SEQ ID NO: 915134 - DNA, 22 bp, Artificial Sequence
  chemically synthesized
tcacaaaaatctacagtagatc

SEQ ID NO: 915135 - DNA, 22 bp, Artificial Sequence
  chemically synthesized
ctgcttgttgatctactgtaga

SEQ ID NO: 915136 - DNA, 22 bp, Artificial Sequence
  chemically synthesized
ctgtcacaaaaatctacagtag

SEQ ID NO: 915137 - DNA, 22 bp, Artificial Sequence
  chemically synthesized
tgcttgttgatctactgtagat

SEQ ID NO: 915138 - DNA, 22 bp, Artificial Sequence
  chemically synthesized
cttgttgatctactgtagattt

SEQ ID NO: 915139 - DNA, 22 bp, Artificial Sequence
  chemically synthesized
gttgatctactgtagatttttg

SEQ ID NO: 915140 - DNA, 22 bp, Artificial Sequence
  chemically synthesized
ttgatctactgtagatttttgt

SEQ ID NO: 915141 - DNA, 22 bp, Artificial Sequence
  chemically synthesized
atctactgtagatttttgtgac

SEQ ID NO: 915142 - DNA, 22 bp, Artificial Sequence
  chemically synthesized
acatagtgcattactgtcacaa

SEQ ID NO: 915143 - DNA, 22 bp, Artificial Sequence
  chemically synthesized
ctgtagatttttgtgacagtaa

SEQ ID NO: 915144 - DNA, 22 bp, Artificial Sequence
  chemically synthesized
tagatttttgtgacagtaatgc

SEQ ID NO: 915145 - DNA, 22 bp, Artificial Sequence
  chemically synthesized
caataattgacatagtgcatta

SEQ ID NO: 915146 - DNA, 22 bp, Artificial Sequence
  chemically synthesized
ttgtgacagtaatgcactatgt

SEQ ID NO: 915147 - DNA, 22 bp, Artificial Sequence
  chemically synthesized
tgtgacagtaatgcactatgtc

SEQ ID NO: 915148 - DNA, 22 bp, Artificial Sequence
  chemically synthesized
gtgacagtaatgcactatgtca

SEQ ID NO: 915149 - DNA, 22 bp, Artificial Sequence
  chemically synthesized
tgacagtaatgcactatgtcaa

SEQ ID NO: 915150 - DNA, 22 bp, Artificial Sequence
  chemically synthesized
aagctgcaataattgacatagt

SEQ ID NO: 915151 - DNA, 22 bp, Artificial Sequence
  chemically synthesized
aaagctgcaataattgacatag

SEQ ID NO: 915152 - DNA, 22 bp, Artificial Sequence
  chemically synthesized
taaagctgcaataattgacata

SEQ ID NO: 915153 - DNA, 22 bp, Artificial Sequence
  chemically synthesized
aacatattttaaagctgcaata

SEQ ID NO: 915154 - DNA, 22 bp, Artificial Sequence
  chemically synthesized
tgtcaattattgcagctttaaa

SEQ ID NO: 915155 - DNA, 22 bp, Artificial Sequence
  chemically synthesized
ccagaaattaaacatattttaa

SEQ ID NO: 915156 - DNA, 22 bp, Artificial Sequence
  chemically synthesized
ttgcagctttaaaatatgttta

SEQ ID NO: 915157 - DNA, 22 bp, Artificial Sequence
  chemically synthesized
acctaccagaaattaaacatat

SEQ ID NO: 915158 - DNA, 22 bp, Artificial Sequence
  chemically synthesized
cagctttaaaatatgtttaatt

SEQ ID NO: 915159 - DNA, 22 bp, Artificial Sequence
  chemically synthesized
taaaatatgtttaatttctggt

SEQ ID NO: 915160 - DNA, 22 bp, Artificial Sequence
  chemically synthesized
aaaatatgtttaatttctggta

SEQ ID NO: 915161 - DNA, 22 bp, Artificial Sequence
  chemically synthesized
aaatatgtttaatttctggtag

SEQ ID NO: 915162 - DNA, 22 bp, Artificial Sequence
  chemically synthesized
aagtgggagagcgggttaacct

SEQ ID NO: 915163 - DNA, 22 bp, Artificial Sequence
  chemically synthesized
aatttctggtaggttaacccgc

SEQ ID NO: 915164 - DNA, 22 bp, Artificial Sequence
  chemically synthesized
atttctggtaggttaacccgct

SEQ ID NO: 915165 - DNA, 22 bp, Artificial Sequence
  chemically synthesized
ctggtaggttaacccgctctcc

SEQ ID NO: 915166 - DNA, 22 bp, Artificial Sequence
  chemically synthesized
tggtaggttaacccgctctccc

SEQ ID NO: 915167 - DNA, 22 bp, Artificial Sequence
  chemically synthesized
gaataactaaagtgggagagcg

SEQ ID NO: 915168 - DNA, 22 bp, Artificial Sequence
  chemically synthesized
gtaggttaacccgctctcccac

SEQ ID NO: 915169 - DNA, 22 bp, Artificial Sequence
  chemically synthesized
acccgctctcccactttagtta

SEQ ID NO: 915170 - DNA, 22 bp, Artificial Sequence
  chemically synthesized
cataagttagaataactaaagt

SEQ ID NO: 915171 - DNA, 22 bp, Artificial Sequence
  chemically synthesized
tcccactttagttattctaact

SEQ ID NO: 915172 - DNA, 22 bp, Artificial Sequence
  chemically synthesized
ccactttagttattctaactta

SEQ ID NO: 915173 - DNA, 22 bp, Artificial Sequence
  chemically synthesized
aatgatacattacataagttag

SEQ ID NO: 915174 - DNA, 22 bp, Artificial Sequence
  chemically synthesized
tagttattctaacttatgtaat

SEQ ID NO: 915175 - DNA, 22 bp, Artificial Sequence
  chemically synthesized
actgaatgatacattacataag

SEQ ID NO: 915176 - DNA, 22 bp, Artificial Sequence
  chemically synthesized
agttattctaacttatgtaatg

SEQ ID NO: 915177 - DNA, 22 bp, Artificial Sequence
  chemically synthesized
gactgaatgatacattacataa

SEQ ID NO: 915178 - DNA, 22 bp, Artificial Sequence
  chemically synthesized
gttattctaacttatgtaatgt

SEQ ID NO: 915179 - DNA, 22 bp, Artificial Sequence
  chemically synthesized
ttctaacttatgtaatgtatca

SEQ ID NO: 915180 - DNA, 22 bp, Artificial Sequence
  chemically synthesized
taatttgactgaatgatacatt

SEQ ID NO: 915181 - DNA, 22 bp, Artificial Sequence
  chemically synthesized
ataatttgactgaatgatacat

SEQ ID NO: 915182 - DNA, 22 bp, Artificial Sequence
  chemically synthesized
taacttatgtaatgtatcattc

SEQ ID NO: 915183 - DNA, 22 bp, Artificial Sequence
  chemically synthesized
tataatttgactgaatgataca

SEQ ID NO: 915184 - DNA, 22 bp, Artificial Sequence
  chemically synthesized
acttatgtaatgtatcattcag

SEQ ID NO: 915185 - DNA, 22 bp, Artificial Sequence
  chemically synthesized
ttttataatttgactgaatgat

SEQ ID NO: 915186 - DNA, 22 bp, Artificial Sequence
  chemically synthesized
atgtaatgtatcattcagtcaa

SEQ ID NO: 915187 - DNA, 22 bp, Artificial Sequence
  chemically synthesized
tgtaatgtatcattcagtcaaa

SEQ ID NO: 915188 - DNA, 22 bp, Artificial Sequence
  chemically synthesized
agcgagaattgttttataattt

SEQ ID NO: 915189 - DNA, 22 bp, Artificial Sequence
  chemically synthesized
cagcgagaattgttttataatt

SEQ ID NO: 915190 - DNA, 22 bp, Artificial Sequence
  chemically synthesized
tcagcgagaattgttttataat

SEQ ID NO: 915191 - DNA, 22 bp, Artificial Sequence
  chemically synthesized
agtcaaattataaaacaattct

SEQ ID NO: 915192 - DNA, 22 bp, Artificial Sequence
  chemically synthesized
aaaattttcagcgagaattgtt

SEQ ID NO: 915193 - DNA, 22 bp, Artificial Sequence
  chemically synthesized
aaaaattttcagcgagaattgt

SEQ ID NO: 915194 - DNA, 22 bp, Artificial Sequence
  chemically synthesized
taaaacaattctcgctgaaaat

SEQ ID NO: 915195 - DNA, 22 bp, Artificial Sequence
  chemically synthesized
tcgctgaaaatttttaaatggg

SEQ ID NO: 915196 - DNA, 22 bp, Artificial Sequence
  chemically synthesized
atataatgcaatcccatttaaa

SEQ ID NO: 915197 - DNA, 22 bp, Artificial Sequence
  chemically synthesized
gctgaaaatttttaaatgggat

SEQ ID NO: 915198 - DNA, 22 bp, Artificial Sequence
  chemically synthesized
ttgatataatgcaatcccattt

SEQ ID NO: 915199 - DNA, 22 bp, Artificial Sequence
  chemically synthesized
attgatataatgcaatcccatt

SEQ ID NO: 915200 - DNA, 22 bp, Artificial Sequence
  chemically synthesized
aaaatttttaaatgggattgca

SEQ ID NO: 915201 - DNA, 22 bp, Artificial Sequence
  chemically synthesized
acttattgatataatgcaatcc

SEQ ID NO: 915202 - DNA, 22 bp, Artificial Sequence
  chemically synthesized
ttaaatgggattgcattatatc

SEQ ID NO: 915203 - DNA, 22 bp, Artificial Sequence
  chemically synthesized
taaatgggattgcattatatca

SEQ ID NO: 915204 - DNA, 22 bp, Artificial Sequence
  chemically synthesized
aaatgggattgcattatatcaa

SEQ ID NO: 915205 - DNA, 22 bp, Artificial Sequence
  chemically synthesized
aatgggattgcattatatcaat

SEQ ID NO: 915206 - DNA, 22 bp, Artificial Sequence
  chemically synthesized
acaaattaacttattgatataa

SEQ ID NO: 915207 - DNA, 22 bp, Artificial Sequence
  chemically synthesized
cacaaattaacttattgatata

SEQ ID NO: 915208 - DNA, 22 bp, Artificial Sequence
  chemically synthesized
ttcacaaattaacttattgata

SEQ ID NO: 915209 - DNA, 22 bp, Artificial Sequence
  chemically synthesized
cattatatcaataagttaattt

SEQ ID NO: 915210 - DNA, 22 bp, Artificial Sequence
  chemically synthesized
tatcaataagttaatttgtgaa

SEQ ID NO: 915211 - DNA, 22 bp, Artificial Sequence
  chemically synthesized
gaaaggcagtaattcttcacaa

SEQ ID NO: 915212 - DNA, 22 bp, Artificial Sequence
  chemically synthesized
tattggaaaggcagtaattctt

SEQ ID NO: 915213 - DNA, 22 bp, Artificial Sequence
  chemically synthesized
atttgtgaagaattactgcctt

SEQ ID NO: 915214 - DNA, 22 bp, Artificial Sequence
  chemically synthesized
gtgaagaattactgcctttcca

SEQ ID NO: 915215 - DNA, 22 bp, Artificial Sequence
  chemically synthesized
gcagaattatattggaaaggca

SEQ ID NO: 915216 - DNA, 22 bp, Artificial Sequence
  chemically synthesized
tgaagaattactgcctttccaa

SEQ ID NO: 915217 - DNA, 22 bp, Artificial Sequence
  chemically synthesized
agcagaattatattggaaaggc

SEQ ID NO: 915218 - DNA, 22 bp, Artificial Sequence
  chemically synthesized
ctgcctttccaatataattctg

SEQ ID NO: 915219 - DNA, 22 bp, Artificial Sequence
  chemically synthesized
cctttccaatataattctgcta

SEQ ID NO: 915220 - DNA, 22 bp, Artificial Sequence
  chemically synthesized
taaatacagaaagtttagcaga

SEQ ID NO: 915221 - DNA, 22 bp, Artificial Sequence
  chemically synthesized
tccaatataattctgctaaact

SEQ ID NO: 915222 - DNA, 22 bp, Artificial Sequence
  chemically synthesized
ccaatataattctgctaaactt

SEQ ID NO: 915223 - DNA, 22 bp, Artificial Sequence
  chemically synthesized
caatataattctgctaaacttt

SEQ ID NO: 915224 - DNA, 22 bp, Artificial Sequence
  chemically synthesized
tgctaaactttctgtatttaca

SEQ ID NO: 915225 - DNA, 22 bp, Artificial Sequence
  chemically synthesized
tgtccaagaacactgtaaatac

SEQ ID NO: 915226 - DNA, 22 bp, Artificial Sequence
  chemically synthesized
ctaaactttctgtatttacagt

SEQ ID NO: 915227 - DNA, 22 bp, Artificial Sequence
  chemically synthesized
tgtgtccaagaacactgtaaat

SEQ ID NO: 915228 - DNA, 22 bp, Artificial Sequence
  chemically synthesized
aactttctgtatttacagtgtt

SEQ ID NO: 915229 - DNA, 22 bp, Artificial Sequence
  chemically synthesized
tctgtatttacagtgttcttgg

SEQ ID NO: 915230 - DNA, 22 bp, Artificial Sequence
  chemically synthesized
ctgtatttacagtgttcttgga

SEQ ID NO: 915231 - DNA, 22 bp, Artificial Sequence
  chemically synthesized
tgtatttacagtgttcttggac

SEQ ID NO: 915232 - DNA, 22 bp, Artificial Sequence
  chemically synthesized
tatttacagtgttcttggacac

SEQ ID NO: 915233 - DNA, 22 bp, Artificial Sequence
  chemically synthesized
agtcccagatactctgtgtcca

SEQ ID NO: 915234 - DNA, 22 bp, Artificial Sequence
  chemically synthesized
acagtgttcttggacacagagt

SEQ ID NO: 915235 - DNA, 22 bp, Artificial Sequence
  chemically synthesized
cagtgttcttggacacagagta

SEQ ID NO: 915236 - DNA, 22 bp, Artificial Sequence
  chemically synthesized
ttggacacagagtatctgggac

SEQ ID NO: 915237 - DNA, 22 bp, Artificial Sequence
  chemically synthesized
ggacacagagtatctgggactc

SEQ ID NO: 915238 - DNA, 22 bp, Artificial Sequence
  chemically synthesized
tagtgtcccattgagtcccaga

SEQ ID NO: 915239 - DNA, 22 bp, Artificial Sequence
  chemically synthesized
gacacagagtatctgggactca

SEQ ID NO: 915240 - DNA, 22 bp, Artificial Sequence
  chemically synthesized
atagtgtcccattgagtcccag

SEQ ID NO: 915241 - DNA, 22 bp, Artificial Sequence
  chemically synthesized
tttatagtgtcccattgagtcc

SEQ ID NO: 915242 - DNA, 22 bp, Artificial Sequence
  chemically synthesized
attatttatagtgtcccattga

SEQ ID NO: 915243 - DNA, 22 bp, Artificial Sequence
  chemically synthesized
aattatttatagtgtcccattg

SEQ ID NO: 915244 - DNA, 22 bp, Artificial Sequence
  chemically synthesized
ggactcaatgggacactataaa

SEQ ID NO: 915245 - DNA, 22 bp, Artificial Sequence
  chemically synthesized
taaaatgtacttaattatttat

SEQ ID NO: 915246 - DNA, 22 bp, Artificial Sequence
  chemically synthesized
aatgggacactataaataatta

SEQ ID NO: 915247 - DNA, 22 bp, Artificial Sequence
  chemically synthesized
attataaaatgtacttaattat

SEQ ID NO: 915248 - DNA, 22 bp, Artificial Sequence
  chemically synthesized
aaggttaattataaaatgtact

SEQ ID NO: 915249 - DNA, 22 bp, Artificial Sequence
  chemically synthesized
taaataattaagtacattttat

SEQ ID NO: 915250 - DNA, 22 bp, Artificial Sequence
  chemically synthesized
atgctgaaggttaattataaaa

SEQ ID NO: 915251 - DNA, 22 bp, Artificial Sequence
  chemically synthesized
agtacattttataattaacctt

SEQ ID NO: 915252 - DNA, 22 bp, Artificial Sequence
  chemically synthesized
aaattgatgctgaaggttaatt

SEQ ID NO: 915253 - DNA, 22 bp, Artificial Sequence
  chemically synthesized
caaattgatgctgaaggttaat

SEQ ID NO: 915254 - DNA, 22 bp, Artificial Sequence
  chemically synthesized
tcaaattgatgctgaaggttaa

SEQ ID NO: 915255 - DNA, 22 bp, Artificial Sequence
  chemically synthesized
tctttcaaattgatgctgaagg

SEQ ID NO: 915256 - DNA, 22 bp, Artificial Sequence
  chemically synthesized
tataattaaccttcagcatcaa

SEQ ID NO: 915257 - DNA, 22 bp, Artificial Sequence
  chemically synthesized
ataattaaccttcagcatcaat

SEQ ID NO: 915258 - DNA, 22 bp, Artificial Sequence
  chemically synthesized
taattaaccttcagcatcaatt

SEQ ID NO: 915259 - DNA, 22 bp, Artificial Sequence
  chemically synthesized
accttcagcatcaatttgaaag

SEQ ID NO: 915260 - DNA, 22 bp, Artificial Sequence
  chemically synthesized
cagcatcaatttgaaagacagc

SEQ ID NO: 915261 - DNA, 22 bp, Artificial Sequence
  chemically synthesized
agcatcaatttgaaagacagca

SEQ ID NO: 915262 - DNA, 22 bp, Artificial Sequence
  chemically synthesized
gaaagacagcatcttgcatatg

SEQ ID NO: 915263 - DNA, 22 bp, Artificial Sequence
  chemically synthesized
aaagacagcatcttgcatatga

SEQ ID NO: 915264 - DNA, 22 bp, Artificial Sequence
  chemically synthesized
atatccataaaatcatatgcaa

SEQ ID NO: 915265 - DNA, 22 bp, Artificial Sequence
  chemically synthesized
gtatatggttaatatccataaa

SEQ ID NO: 915266 - DNA, 22 bp, Artificial Sequence
  chemically synthesized
gcatatgattttatggatatta

SEQ ID NO: 915267 - DNA, 22 bp, Artificial Sequence
  chemically synthesized
catatgattttatggatattaa

SEQ ID NO: 915268 - DNA, 22 bp, Artificial Sequence
  chemically synthesized
aattagtatatggttaatatcc

SEQ ID NO: 915269 - DNA, 22 bp, Artificial Sequence
  chemically synthesized
taaattagtatatggttaatat

SEQ ID NO: 915270 - DNA, 22 bp, Artificial Sequence
  chemically synthesized
ctaaattagtatatggttaata

SEQ ID NO: 915271 - DNA, 22 bp, Artificial Sequence
  chemically synthesized
tctaaattagtatatggttaat

SEQ ID NO: 915272 - DNA, 22 bp, Artificial Sequence
  chemically synthesized
tatggatattaaccatatacta

SEQ ID NO: 915273 - DNA, 22 bp, Artificial Sequence
  chemically synthesized
atggatattaaccatatactaa

SEQ ID NO: 915274 - DNA, 22 bp, Artificial Sequence
  chemically synthesized
tggatattaaccatatactaat

SEQ ID NO: 915275 - DNA, 22 bp, Artificial Sequence
  chemically synthesized
agagttttctaaattagtatat

SEQ ID NO: 915276 - DNA, 22 bp, Artificial Sequence
  chemically synthesized
aagagttttctaaattagtata

SEQ ID NO: 915277 - DNA, 22 bp, Artificial Sequence
  chemically synthesized
ttaagagttttctaaattagta

SEQ ID NO: 915278 - DNA, 22 bp, Artificial Sequence
  chemically synthesized
accatatactaatttagaaaac

SEQ ID NO: 915279 - DNA, 22 bp, Artificial Sequence
  chemically synthesized
agagttcttaagagttttctaa

SEQ ID NO: 915280 - DNA, 22 bp, Artificial Sequence
  chemically synthesized
tgagagttcttaagagttttct

SEQ ID NO: 915281 - DNA, 22 bp, Artificial Sequence
  chemically synthesized
ttctgagagttcttaagagttt

SEQ ID NO: 915282 - DNA, 22 bp, Artificial Sequence
  chemically synthesized
attctgagagttcttaagagtt

SEQ ID NO: 915283 - DNA, 22 bp, Artificial Sequence
  chemically synthesized
atttagaaaactcttaagaact

SEQ ID NO: 915284 - DNA, 22 bp, Artificial Sequence
  chemically synthesized
agaaaactcttaagaactctca

SEQ ID NO: 915285 - DNA, 22 bp, Artificial Sequence
  chemically synthesized
gaaaactcttaagaactctcag

SEQ ID NO: 915286 - DNA, 22 bp, Artificial Sequence
  chemically synthesized
agtgatgatttattctgagagt

SEQ ID NO: 915287 - DNA, 22 bp, Artificial Sequence
  chemically synthesized
aagtgatgatttattctgagag

SEQ ID NO: 915288 - DNA, 22 bp, Artificial Sequence
  chemically synthesized
tttaagtgatgatttattctga

SEQ ID NO: 915289 - DNA, 22 bp, Artificial Sequence
  chemically synthesized
ttaagaactctcagaataaatc

SEQ ID NO: 915290 - DNA, 22 bp, Artificial Sequence
  chemically synthesized
ctgtttaagtgatgatttattc

SEQ ID NO: 915291 - DNA, 22 bp, Artificial Sequence
  chemically synthesized
aagaactctcagaataaatcat

SEQ ID NO: 915292 - DNA, 22 bp, Artificial Sequence
  chemically synthesized
actgtttaagtgatgatttatt

SEQ ID NO: 915293 - DNA, 22 bp, Artificial Sequence
  chemically synthesized
agaactctcagaataaatcatc

SEQ ID NO: 915294 - DNA, 22 bp, Artificial Sequence
  chemically synthesized
tactgtttaagtgatgatttat

SEQ ID NO: 915295 - DNA, 22 bp, Artificial Sequence
  chemically synthesized
ttactgtttaagtgatgattta

SEQ ID NO: 915296 - DNA, 22 bp, Artificial Sequence
  chemically synthesized
tcagaataaatcatcacttaaa

SEQ ID NO: 915297 - DNA, 22 bp, Artificial Sequence
  chemically synthesized
agaataaatcatcacttaaaca

SEQ ID NO: 915298 - DNA, 22 bp, Artificial Sequence
  chemically synthesized
gccaaagcttttactgtttaag

SEQ ID NO: 915299 - DNA, 22 bp, Artificial Sequence
  chemically synthesized
agccaaagcttttactgtttaa

SEQ ID NO: 915300 - DNA, 22 bp, Artificial Sequence
  chemically synthesized
aaacagtaaaagctttggctaa

SEQ ID NO: 915301 - DNA, 22 bp, Artificial Sequence
  chemically synthesized
aacagtaaaagctttggctaag

SEQ ID NO: 915302 - DNA, 22 bp, Artificial Sequence
  chemically synthesized
tggctaagctttttgctgtctt

SEQ ID NO: 915303 - DNA, 22 bp, Artificial Sequence
  chemically synthesized
ggctaagctttttgctgtcttt

SEQ ID NO: 915304 - DNA, 22 bp, Artificial Sequence
  chemically synthesized
gctaagctttttgctgtctttc

SEQ ID NO: 915305 - DNA, 22 bp, Artificial Sequence
  chemically synthesized
agctttttgctgtctttctttt

SEQ ID NO: 915306 - DNA, 22 bp, Artificial Sequence
  chemically synthesized
cacaaatatcgtgtaaaaagaa

SEQ ID NO: 915307 - DNA, 22 bp, Artificial Sequence
  chemically synthesized
ccacaaatatcgtgtaaaaaga

SEQ ID NO: 915308 - DNA, 22 bp, Artificial Sequence
  chemically synthesized
tttgctgtctttctttttacac

SEQ ID NO: 915309 - DNA, 22 bp, Artificial Sequence
  chemically synthesized
tccacaaatatcgtgtaaaaag

SEQ ID NO: 915310 - DNA, 22 bp, Artificial Sequence
  chemically synthesized
ttgctgtctttctttttacacg

SEQ ID NO: 915311 - DNA, 22 bp, Artificial Sequence
  chemically synthesized
tgctgtctttctttttacacga

SEQ ID NO: 915312 - DNA, 22 bp, Artificial Sequence
  chemically synthesized
gctgtctttctttttacacgat

SEQ ID NO: 915313 - DNA, 22 bp, Artificial Sequence
  chemically synthesized
ctgtctttctttttacacgata

SEQ ID NO: 915314 - DNA, 22 bp, Artificial Sequence
  chemically synthesized
tctttctttttacacgatattt

SEQ ID NO: 915315 - DNA, 22 bp, Artificial Sequence
  chemically synthesized
tctttttacacgatatttgtgg

SEQ ID NO: 915316 - DNA, 22 bp, Artificial Sequence
  chemically synthesized
ctttttacacgatatttgtgga

SEQ ID NO: 915317 - DNA, 22 bp, Artificial Sequence
  chemically synthesized
gaaaaaaagttttccacaaata

SEQ ID NO: 915318 - DNA, 22 bp, Artificial Sequence
  chemically synthesized
tttttacacgatatttgtggaa

SEQ ID NO: 915319 - DNA, 22 bp, Artificial Sequence
  chemically synthesized
tttacacgatatttgtggaaaa

SEQ ID NO: 915320 - DNA, 22 bp, Artificial Sequence
  chemically synthesized
ttacacgatatttgtggaaaac

SEQ ID NO: 915321 - DNA, 22 bp, Artificial Sequence
  chemically synthesized
tacacgatatttgtggaaaact

SEQ ID NO: 915322 - DNA, 22 bp, Artificial Sequence
  chemically synthesized
acacgatatttgtggaaaactt

SEQ ID NO: 915323 - DNA, 22 bp, Artificial Sequence
  chemically synthesized
cacgatatttgtggaaaacttt

SEQ ID NO: 915324 - DNA, 22 bp, Artificial Sequence
  chemically synthesized
aatcactggaaaaaaagttttc

SEQ ID NO: 915325 - DNA, 22 bp, Artificial Sequence
  chemically synthesized
aaaaattaaatcactggaaaaa

SEQ ID NO: 915326 - DNA, 22 bp, Artificial Sequence
  chemically synthesized
gtggaaaactttttttccagtg

SEQ ID NO: 915327 - DNA, 22 bp, Artificial Sequence
  chemically synthesized
aaaaaattaaatcactggaaaa

SEQ ID NO: 915328 - DNA, 22 bp, Artificial Sequence
  chemically synthesized
tggaaaactttttttccagtga

SEQ ID NO: 915329 - DNA, 22 bp, Artificial Sequence
  chemically synthesized
taaaaaattaaatcactggaaa

SEQ ID NO: 915330 - DNA, 22 bp, Artificial Sequence
  chemically synthesized
ttaaaaaattaaatcactggaa

SEQ ID NO: 915331 - DNA, 22 bp, Artificial Sequence
  chemically synthesized
tttaaaaaattaaatcactgga

SEQ ID NO: 915332 - DNA, 22 bp, Artificial Sequence
  chemically synthesized
ttttaaaaaattaaatcactgg

SEQ ID NO: 915333 - DNA, 22 bp, Artificial Sequence
  chemically synthesized
tttttttaaaaaattaaatcac

SEQ ID NO: 915334 - DNA, 22 bp, Artificial Sequence
  chemically synthesized
tttttccagtgatttaattttt

SEQ ID NO: 915335 - DNA, 22 bp, Artificial Sequence
  chemically synthesized
ttttccagtgatttaatttttt

SEQ ID NO: 915336 - DNA, 22 bp, Artificial Sequence
  chemically synthesized
tttccagtgatttaatttttta

SEQ ID NO: 915337 - DNA, 22 bp, Artificial Sequence
  chemically synthesized
ttccagtgatttaattttttaa

SEQ ID NO: 915338 - DNA, 22 bp, Artificial Sequence
  chemically synthesized
tccagtgatttaattttttaaa

SEQ ID NO: 915339 - DNA, 22 bp, Artificial Sequence
  chemically synthesized
ccagtgatttaattttttaaaa

SEQ ID NO: 915340 - DNA, 22 bp, Artificial Sequence
  chemically synthesized
cagtgatttaattttttaaaaa

SEQ ID NO: 915341 - DNA, 22 bp, Artificial Sequence
  chemically synthesized
aaagatgctgtttttttaaaaa

SEQ ID NO: 915342 - DNA, 22 bp, Artificial Sequence
  chemically synthesized
aaaagatgctgtttttttaaaa

SEQ ID NO: 915343 - DNA, 22 bp, Artificial Sequence
  chemically synthesized
atatttaaaagatgctgttttt

SEQ ID NO: 915344 - DNA, 22 bp, Artificial Sequence
  chemically synthesized
catatttaaaagatgctgtttt

SEQ ID NO: 915345 - DNA, 22 bp, Artificial Sequence
  chemically synthesized
aattttttaaaaaaacagcatc

SEQ ID NO: 915346 - DNA, 22 bp, Artificial Sequence
  chemically synthesized
tcatatttaaaagatgctgttt

SEQ ID NO: 915347 - DNA, 22 bp, Artificial Sequence
  chemically synthesized
attttttaaaaaaacagcatct

SEQ ID NO: 915348 - DNA, 22 bp, Artificial Sequence
  chemically synthesized
tttaaaaaaacagcatctttta

SEQ ID NO: 915349 - DNA, 22 bp, Artificial Sequence
  chemically synthesized
ttaaaaaaacagcatcttttaa

SEQ ID NO: 915350 - DNA, 22 bp, Artificial Sequence
  chemically synthesized
taaaaaaacagcatcttttaaa

SEQ ID NO: 915351 - DNA, 22 bp, Artificial Sequence
  chemically synthesized
aaaaaaacagcatcttttaaat

SEQ ID NO: 915352 - DNA, 22 bp, Artificial Sequence
  chemically synthesized
aaaaaacagcatcttttaaata

SEQ ID NO: 915353 - DNA, 22 bp, Artificial Sequence
  chemically synthesized
ccaaatgttttcatatttaaaa

SEQ ID NO: 915354 - DNA, 22 bp, Artificial Sequence
  chemically synthesized
ttaaatatgaaaacatttggta

SEQ ID NO: 915355 - DNA, 22 bp, Artificial Sequence
  chemically synthesized
taaatatgaaaacatttggtag

SEQ ID NO: 915356 - DNA, 22 bp, Artificial Sequence
  chemically synthesized
gataagaaatgactaccaaatg

SEQ ID NO: 915357 - DNA, 22 bp, Artificial Sequence
  chemically synthesized
aaatatgaaaacatttggtagt

SEQ ID NO: 915358 - DNA, 22 bp, Artificial Sequence
  chemically synthesized
aatatgaaaacatttggtagtc

SEQ ID NO: 915359 - DNA, 22 bp, Artificial Sequence
  chemically synthesized
ggtagtcatttcttatctagat

SEQ ID NO: 915360 - DNA, 22 bp, Artificial Sequence
  chemically synthesized
gtagtcatttcttatctagatt

SEQ ID NO: 915361 - DNA, 22 bp, Artificial Sequence
  chemically synthesized
aaagtataaaaaaaatctagat

SEQ ID NO: 915362 - DNA, 22 bp, Artificial Sequence
  chemically synthesized
caaagtataaaaaaaatctaga

SEQ ID NO: 915363 - DNA, 22 bp, Artificial Sequence
  chemically synthesized
tatttcaaagtataaaaaaaat

SEQ ID NO: 915364 - DNA, 22 bp, Artificial Sequence
  chemically synthesized
atatttcaaagtataaaaaaaa

SEQ ID NO: 915365 - DNA, 22 bp, Artificial Sequence
  chemically synthesized
tatatttcaaagtataaaaaaa

SEQ ID NO: 915366 - DNA, 22 bp, Artificial Sequence
  chemically synthesized
cttatctagattttttttatac

SEQ ID NO: 915367 - DNA, 22 bp, Artificial Sequence
  chemically synthesized
ttatatttcaaagtataaaaaa

SEQ ID NO: 915368 - DNA, 22 bp, Artificial Sequence
  chemically synthesized
ttatctagattttttttatact

SEQ ID NO: 915369 - DNA, 22 bp, Artificial Sequence
  chemically synthesized
tttatatttcaaagtataaaaa

SEQ ID NO: 915370 - DNA, 22 bp, Artificial Sequence
  chemically synthesized
ttttatatttcaaagtataaaa

SEQ ID NO: 915371 - DNA, 22 bp, Artificial Sequence
  chemically synthesized
atctagattttttttatacttt

SEQ ID NO: 915372 - DNA, 22 bp, Artificial Sequence
  chemically synthesized
tctagattttttttatactttg

SEQ ID NO: 915373 - DNA, 22 bp, Artificial Sequence
  chemically synthesized
gattttttttatactttgaaat

SEQ ID NO: 915374 - DNA, 22 bp, Artificial Sequence
  chemically synthesized
tcaccatcttttttatatttca

SEQ ID NO: 915375 - DNA, 22 bp, Artificial Sequence
  chemically synthesized
tttttatactttgaaatataaa

SEQ ID NO: 915376 - DNA, 22 bp, Artificial Sequence
  chemically synthesized
gtcaccatcttttttatatttc

SEQ ID NO: 915377 - DNA, 22 bp, Artificial Sequence
  chemically synthesized
ttttatactttgaaatataaaa

SEQ ID NO: 915378 - DNA, 22 bp, Artificial Sequence
  chemically synthesized
tgtcaccatcttttttatattt

SEQ ID NO: 915379 - DNA, 22 bp, Artificial Sequence
  chemically synthesized
tttatactttgaaatataaaaa

SEQ ID NO: 915380 - DNA, 22 bp, Artificial Sequence
  chemically synthesized
ttatactttgaaatataaaaaa

SEQ ID NO: 915381 - DNA, 22 bp, Artificial Sequence
  chemically synthesized
tatactttgaaatataaaaaag

SEQ ID NO: 915382 - DNA, 22 bp, Artificial Sequence
  chemically synthesized
atactttgaaatataaaaaaga

SEQ ID NO: 915383 - DNA, 22 bp, Artificial Sequence
  chemically synthesized
tactttgaaatataaaaaagat

SEQ ID NO: 915384 - DNA, 22 bp, Artificial Sequence
  chemically synthesized
tgaaatataaaaaagatggtga

SEQ ID NO: 915385 - DNA, 22 bp, Artificial Sequence
  chemically synthesized
gaaatataaaaaagatggtgac

SEQ ID NO: 915386 - DNA, 22 bp, Artificial Sequence
  chemically synthesized
aaatataaaaaagatggtgaca

SEQ ID NO: 915387 - DNA, 22 bp, Artificial Sequence
  chemically synthesized
taacaaggtcccaacgggattt

SEQ ID NO: 915388 - DNA, 22 bp, Artificial Sequence
  chemically synthesized
gaaaagcagattataacaaggt

SEQ ID NO: 915389 - DNA, 22 bp, Artificial Sequence
  chemically synthesized
ggaaaagcagattataacaagg

SEQ ID NO: 915390 - DNA, 22 bp, Artificial Sequence
  chemically synthesized
ggaccttgttataatctgcttt

SEQ ID NO: 915391 - DNA, 22 bp, Artificial Sequence
  chemically synthesized
gttataatctgcttttccaagc

SEQ ID NO: 915392 - DNA, 22 bp, Artificial Sequence
  chemically synthesized
ttataatctgcttttccaagcg

SEQ ID NO: 915393 - DNA, 22 bp, Artificial Sequence
  chemically synthesized
agaaaacacatgcgcttggaaa

SEQ ID NO: 915394 - DNA, 22 bp, Artificial Sequence
  chemically synthesized
cagaaaacacatgcgcttggaa

SEQ ID NO: 915395 - DNA, 22 bp, Artificial Sequence
  chemically synthesized
taatctgcttttccaagcgcat

SEQ ID NO: 915396 - DNA, 22 bp, Artificial Sequence
  chemically synthesized
aaatttcagaaaacacatgcgc

SEQ ID NO: 915397 - DNA, 22 bp, Artificial Sequence
  chemically synthesized
gaaatttcagaaaacacatgcg

SEQ ID NO: 915398 - DNA, 22 bp, Artificial Sequence
  chemically synthesized
tgaaatttcagaaaacacatgc

SEQ ID NO: 915399 - DNA, 22 bp, Artificial Sequence
  chemically synthesized
cttttccaagcgcatgtgtttt

SEQ ID NO: 915400 - DNA, 22 bp, Artificial Sequence
  chemically synthesized
ttgaaatttcagaaaacacatg

SEQ ID NO: 915401 - DNA, 22 bp, Artificial Sequence
  chemically synthesized
ttccaagcgcatgtgttttctg

SEQ ID NO: 915402 - DNA, 22 bp, Artificial Sequence
  chemically synthesized
tccaagcgcatgtgttttctga

SEQ ID NO: 915403 - DNA, 22 bp, Artificial Sequence
  chemically synthesized
ccaagcgcatgtgttttctgaa

SEQ ID NO: 915404 - DNA, 22 bp, Artificial Sequence
  chemically synthesized
caagcgcatgtgttttctgaaa

SEQ ID NO: 915405 - DNA, 22 bp, Artificial Sequence
  chemically synthesized
aaatcgaggcttttgaaatttc

SEQ ID NO: 915406 - DNA, 22 bp, Artificial Sequence
  chemically synthesized
caaatcgaggcttttgaaattt

SEQ ID NO: 915407 - DNA, 22 bp, Artificial Sequence
  chemically synthesized
aaacttcaaatcgaggcttttg

SEQ ID NO: 915408 - DNA, 22 bp, Artificial Sequence
  chemically synthesized
aaaacttcaaatcgaggctttt

SEQ ID NO: 915409 - DNA, 22 bp, Artificial Sequence
  chemically synthesized
tctgaaatttcaaaagcctcga

SEQ ID NO: 915410 - DNA, 22 bp, Artificial Sequence
  chemically synthesized
taaaacttcaaatcgaggcttt

SEQ ID NO: 915411 - DNA, 22 bp, Artificial Sequence
  chemically synthesized
ctgaaatttcaaaagcctcgat

SEQ ID NO: 915412 - DNA, 22 bp, Artificial Sequence
  chemically synthesized
ttaaaacttcaaatcgaggctt

SEQ ID NO: 915413 - DNA, 22 bp, Artificial Sequence
  chemically synthesized
tgaaatttcaaaagcctcgatt

SEQ ID NO: 915414 - DNA, 22 bp, Artificial Sequence
  chemically synthesized
aaatttcaaaagcctcgatttg

SEQ ID NO: 915415 - DNA, 22 bp, Artificial Sequence
  chemically synthesized
cagcttttaaaacttcaaatcg

SEQ ID NO: 915416 - DNA, 22 bp, Artificial Sequence
  chemically synthesized
caaaagcctcgatttgaagttt

SEQ ID NO: 915417 - DNA, 22 bp, Artificial Sequence
  chemically synthesized
aaaagcctcgatttgaagtttt

SEQ ID NO: 915418 - DNA, 22 bp, Artificial Sequence
  chemically synthesized
aaattgcagcttttaaaacttc

SEQ ID NO: 915419 - DNA, 22 bp, Artificial Sequence
  chemically synthesized
gatttgaagttttaaaagctgc

SEQ ID NO: 915420 - DNA, 22 bp, Artificial Sequence
  chemically synthesized
gaagttttaaaagctgcaattt

SEQ ID NO: 915421 - DNA, 22 bp, Artificial Sequence
  chemically synthesized
aagttttaaaagctgcaatttg

SEQ ID NO: 915422 - DNA, 22 bp, Artificial Sequence
  chemically synthesized
aatacataaattcaaattgcag

SEQ ID NO: 915423 - DNA, 22 bp, Artificial Sequence
  chemically synthesized
taaaagctgcaatttgaattta

SEQ ID NO: 915424 - DNA, 22 bp, Artificial Sequence
  chemically synthesized
aaaagctgcaatttgaatttat

SEQ ID NO: 915425 - DNA, 22 bp, Artificial Sequence
  chemically synthesized
aaagctgcaatttgaatttatg

SEQ ID NO: 915426 - DNA, 22 bp, Artificial Sequence
  chemically synthesized
caatcatctgaatacataaatt

SEQ ID NO: 915427 - DNA, 22 bp, Artificial Sequence
  chemically synthesized
tgcaatcatctgaatacataaa

SEQ ID NO: 915428 - DNA, 22 bp, Artificial Sequence
  chemically synthesized
ctgcaatcatctgaatacataa

SEQ ID NO: 915429 - DNA, 22 bp, Artificial Sequence
  chemically synthesized
tctgcaatcatctgaatacata

SEQ ID NO: 915430 - DNA, 22 bp, Artificial Sequence
  chemically synthesized
caatttgaatttatgtattcag

SEQ ID NO: 915431 - DNA, 22 bp, Artificial Sequence
  chemically synthesized
ttctgcaatcatctgaatacat

SEQ ID NO: 915432 - DNA, 22 bp, Artificial Sequence
  chemically synthesized
cttttctgcaatcatctgaata

SEQ ID NO: 915433 - DNA, 22 bp, Artificial Sequence
  chemically synthesized
gcttttctgcaatcatctgaat

SEQ ID NO: 915434 - DNA, 22 bp, Artificial Sequence
  chemically synthesized
tgcttttctgcaatcatctgaa

SEQ ID NO: 915435 - DNA, 22 bp, Artificial Sequence
  chemically synthesized
gaatttatgtattcagatgatt

SEQ ID NO: 915436 - DNA, 22 bp, Artificial Sequence
  chemically synthesized
aatttatgtattcagatgattg

SEQ ID NO: 915437 - DNA, 22 bp, Artificial Sequence
  chemically synthesized
tttgcttttctgcaatcatctg

SEQ ID NO: 915438 - DNA, 22 bp, Artificial Sequence
  chemically synthesized
ctttgcttttctgcaatcatct

SEQ ID NO: 915439 - DNA, 22 bp, Artificial Sequence
  chemically synthesized
atgtattcagatgattgcagaa

SEQ ID NO: 915440 - DNA, 22 bp, Artificial Sequence
  chemically synthesized
tgtattcagatgattgcagaaa

SEQ ID NO: 915441 - DNA, 22 bp, Artificial Sequence
  chemically synthesized
tgtttctttgcttttctgcaat

SEQ ID NO: 915442 - DNA, 22 bp, Artificial Sequence
  chemically synthesized
actgtgtttctttgcttttctg

SEQ ID NO: 915443 - DNA, 22 bp, Artificial Sequence
  chemically synthesized
agatgattgcagaaaagcaaag

SEQ ID NO: 915444 - DNA, 22 bp, Artificial Sequence
  chemically synthesized
gaaatgctaactgtgtttcttt

SEQ ID NO: 915445 - DNA, 22 bp, Artificial Sequence
  chemically synthesized
cagaaaagcaaagaaacacagt

SEQ ID NO: 915446 - DNA, 22 bp, Artificial Sequence
  chemically synthesized
tcaagagacaagcctggaaatg

SEQ ID NO: 915447 - DNA, 22 bp, Artificial Sequence
  chemically synthesized
tgtcaagagacaagcctggaaa

SEQ ID NO: 915448 - DNA, 22 bp, Artificial Sequence
  chemically synthesized
ttctgtcaagagacaagcctgg

SEQ ID NO: 915449 - DNA, 22 bp, Artificial Sequence
  chemically synthesized
aactgttctgtcaagagacaag

SEQ ID NO: 915450 - DNA, 22 bp, Artificial Sequence
  chemically synthesized
gcatttccaggcttgtctcttg

SEQ ID NO: 915451 - DNA, 22 bp, Artificial Sequence
  chemically synthesized
aaactgttctgtcaagagacaa

SEQ ID NO: 915452 - DNA, 22 bp, Artificial Sequence
  chemically synthesized
ccaggcttgtctcttgacagaa

SEQ ID NO: 915453 - DNA, 22 bp, Artificial Sequence
  chemically synthesized
caggcttgtctcttgacagaac

SEQ ID NO: 915454 - DNA, 22 bp, Artificial Sequence
  chemically synthesized
gtctcttgacagaacagtttaa

SEQ ID NO: 915455 - DNA, 22 bp, Artificial Sequence
  chemically synthesized
tctcttgacagaacagtttaaa

SEQ ID NO: 915456 - DNA, 22 bp, Artificial Sequence
  chemically synthesized
ttgacagaacagtttaaacgtg

SEQ ID NO: 915457 - DNA, 22 bp, Artificial Sequence
  chemically synthesized
gacagaacagtttaaacgtgct

SEQ ID NO: 915458 - DNA, 22 bp, Artificial Sequence
  chemically synthesized
acagaacagtttaaacgtgctt

SEQ ID NO: 915459 - DNA, 22 bp, Artificial Sequence
  chemically synthesized
atgtgatgaatgccaatatgaa

SEQ ID NO: 915460 - DNA, 22 bp, Artificial Sequence
  chemically synthesized
catgtgatgaatgccaatatga

SEQ ID NO: 915461 - DNA, 22 bp, Artificial Sequence
  chemically synthesized
aaacgtgcttcatattggcatt

SEQ ID NO: 915462 - DNA, 22 bp, Artificial Sequence
  chemically synthesized
aacgtgcttcatattggcattc

SEQ ID NO: 915463 - DNA, 22 bp, Artificial Sequence
  chemically synthesized
catattggcattcatcacatga

SEQ ID NO: 915464 - DNA, 22 bp, Artificial Sequence
  chemically synthesized
atattggcattcatcacatgaa

SEQ ID NO: 915465 - DNA, 22 bp, Artificial Sequence
  chemically synthesized
gcattcatcacatgaagtgtta

SEQ ID NO: 915466 - DNA, 22 bp, Artificial Sequence
  chemically synthesized
atcacatgaagtgttatttctt

SEQ ID NO: 915467 - DNA, 22 bp, Artificial Sequence
  chemically synthesized
agcaagtaggtaaacaaagaaa

SEQ ID NO: 915468 - DNA, 22 bp, Artificial Sequence
  chemically synthesized
tttctttgtttacctacttgct

SEQ ID NO: 915469 - DNA, 22 bp, Artificial Sequence
  chemically synthesized
ccataagcattaagcaagtagg

SEQ ID NO: 915470 - DNA, 22 bp, Artificial Sequence
  chemically synthesized
ctttgtttacctacttgcttaa

SEQ ID NO: 915471 - DNA, 22 bp, Artificial Sequence
  chemically synthesized
tttgtttacctacttgcttaat

SEQ ID NO: 915472 - DNA, 22 bp, Artificial Sequence
  chemically synthesized
tgtttacctacttgcttaatgc

SEQ ID NO: 915473 - DNA, 22 bp, Artificial Sequence
  chemically synthesized
gtttacctacttgcttaatgct

SEQ ID NO: 915474 - DNA, 22 bp, Artificial Sequence
  chemically synthesized
tttacctacttgcttaatgctt

SEQ ID NO: 915475 - DNA, 22 bp, Artificial Sequence
  chemically synthesized
acctacttgcttaatgcttatg

SEQ ID NO: 915476 - DNA, 22 bp, Artificial Sequence
  chemically synthesized
aataaatcctcccataagcatt

SEQ ID NO: 915477 - DNA, 22 bp, Artificial Sequence
  chemically synthesized
cctacttgcttaatgcttatgg

SEQ ID NO: 915478 - DNA, 22 bp, Artificial Sequence
  chemically synthesized
tctgaataaatcctcccataag

SEQ ID NO: 915479 - DNA, 22 bp, Artificial Sequence
  chemically synthesized
cttgcttaatgcttatgggagg

SEQ ID NO: 915480 - DNA, 22 bp, Artificial Sequence
  chemically synthesized
gtctgaataaatcctcccataa

SEQ ID NO: 915481 - DNA, 22 bp, Artificial Sequence
  chemically synthesized
gcttaatgcttatgggaggatt

SEQ ID NO: 915482 - DNA, 22 bp, Artificial Sequence
  chemically synthesized
cttaatgcttatgggaggattt

SEQ ID NO: 915483 - DNA, 22 bp, Artificial Sequence
  chemically synthesized
ccacttgtctgaataaatcctc

SEQ ID NO: 915484 - DNA, 22 bp, Artificial Sequence
  chemically synthesized
aatgcttatgggaggatttatt

SEQ ID NO: 915485 - DNA, 22 bp, Artificial Sequence
  chemically synthesized
atgcttatgggaggatttattc

SEQ ID NO: 915486 - DNA, 22 bp, Artificial Sequence
  chemically synthesized
ctaccacttgtctgaataaatc

SEQ ID NO: 915487 - DNA, 22 bp, Artificial Sequence
  chemically synthesized
ttactaccacttgtctgaataa

SEQ ID NO: 915488 - DNA, 22 bp, Artificial Sequence
  chemically synthesized
atgggaggatttattcagacaa

SEQ ID NO: 915489 - DNA, 22 bp, Artificial Sequence
  chemically synthesized
tgggaggatttattcagacaag

SEQ ID NO: 915490 - DNA, 22 bp, Artificial Sequence
  chemically synthesized
ttattactaccacttgtctgaa

SEQ ID NO: 915491 - DNA, 22 bp, Artificial Sequence
  chemically synthesized
attattattactaccacttgtc

SEQ ID NO: 915492 - DNA, 22 bp, Artificial Sequence
  chemically synthesized
actcattattattactaccact

SEQ ID NO: 915493 - DNA, 22 bp, Artificial Sequence
  chemically synthesized
attcagacaagtggtagtaata

SEQ ID NO: 915494 - DNA, 22 bp, Artificial Sequence
  chemically synthesized
ttcagacaagtggtagtaataa

SEQ ID NO: 915495 - DNA, 22 bp, Artificial Sequence
  chemically synthesized
agacaagtggtagtaataataa

SEQ ID NO: 915496 - DNA, 22 bp, Artificial Sequence
  chemically synthesized
aatatctcactcattattatta

SEQ ID NO: 915497 - DNA, 22 bp, Artificial Sequence
  chemically synthesized
cagatgggtaatgttaaatatc

SEQ ID NO: 915498 - DNA, 22 bp, Artificial Sequence
  chemically synthesized
gcagatgggtaatgttaaatat

SEQ ID NO: 915499 - DNA, 22 bp, Artificial Sequence
  chemically synthesized
tttgcagatgggtaatgttaaa

SEQ ID NO: 915500 - DNA, 22 bp, Artificial Sequence
  chemically synthesized
atttgcagatgggtaatgttaa

SEQ ID NO: 915501 - DNA, 22 bp, Artificial Sequence
  chemically synthesized
gcacttatttgcagatgggtaa

SEQ ID NO: 915502 - DNA, 22 bp, Artificial Sequence
  chemically synthesized
agcacttatttgcagatgggta

SEQ ID NO: 915503 - DNA, 22 bp, Artificial Sequence
  chemically synthesized
aacattacccatctgcaaataa

SEQ ID NO: 915504 - DNA, 22 bp, Artificial Sequence
  chemically synthesized
acattacccatctgcaaataag

SEQ ID NO: 915505 - DNA, 22 bp, Artificial Sequence
  chemically synthesized
cccatctgcaaataagtgctaa

SEQ ID NO: 915506 - DNA, 22 bp, Artificial Sequence
  chemically synthesized
aaagtaaaatatttagcactta

SEQ ID NO: 915507 - DNA, 22 bp, Artificial Sequence
  chemically synthesized
taaaagtaaaatatttagcact

SEQ ID NO: 915508 - DNA, 22 bp, Artificial Sequence
  chemically synthesized
ctaaaagtaaaatatttagcac

SEQ ID NO: 915509 - DNA, 22 bp, Artificial Sequence
  chemically synthesized
caaataagtgctaaatatttta

SEQ ID NO: 915510 - DNA, 22 bp, Artificial Sequence
  chemically synthesized
aaatgcttctaaaagtaaaata

SEQ ID NO: 915511 - DNA, 22 bp, Artificial Sequence
  chemically synthesized
aatgtattgaaatgcttctaaa

SEQ ID NO: 915512 - DNA, 22 bp, Artificial Sequence
  chemically synthesized
aatattttacttttagaagcat

SEQ ID NO: 915513 - DNA, 22 bp, Artificial Sequence
  chemically synthesized
tacttttagaagcatttcaata

SEQ ID NO: 915514 - DNA, 22 bp, Artificial Sequence
  chemically synthesized
aatgtctaaatgtattgaaatg

SEQ ID NO: 915515 - DNA, 22 bp, Artificial Sequence
  chemically synthesized
acttttagaagcatttcaatac

SEQ ID NO: 915516 - DNA, 22 bp, Artificial Sequence
  chemically synthesized
cttttagaagcatttcaataca

SEQ ID NO: 915517 - DNA, 22 bp, Artificial Sequence
  chemically synthesized
ttagaagcatttcaatacattt

SEQ ID NO: 915518 - DNA, 22 bp, Artificial Sequence
  chemically synthesized
tagaagcatttcaatacattta

SEQ ID NO: 915519 - DNA, 22 bp, Artificial Sequence
  chemically synthesized
agaagcatttcaatacatttag

SEQ ID NO: 915520 - DNA, 22 bp, Artificial Sequence
  chemically synthesized
gaagcatttcaatacatttaga

SEQ ID NO: 915521 - DNA, 22 bp, Artificial Sequence
  chemically synthesized
aaaaaagctaaatgtctaaatg

SEQ ID NO: 915522 - DNA, 22 bp, Artificial Sequence
  chemically synthesized
taaaaaaagctaaatgtctaaa

SEQ ID NO: 915523 - DNA, 22 bp, Artificial Sequence
  chemically synthesized
ctaaaaaaagctaaatgtctaa

SEQ ID NO: 915524 - DNA, 22 bp, Artificial Sequence
  chemically synthesized
tctaaaaaaagctaaatgtcta

SEQ ID NO: 915525 - DNA, 22 bp, Artificial Sequence
  chemically synthesized
tttctaaaaaaagctaaatgtc

SEQ ID NO: 915526 - DNA, 22 bp, Artificial Sequence
  chemically synthesized
caatacatttagacatttagct

SEQ ID NO: 915527 - DNA, 22 bp, Artificial Sequence
  chemically synthesized
aatacatttagacatttagctt

SEQ ID NO: 915528 - DNA, 22 bp, Artificial Sequence
  chemically synthesized
agacatttagctttttttagaa

SEQ ID NO: 915529 - DNA, 22 bp, Artificial Sequence
  chemically synthesized
gacatttagctttttttagaaa

SEQ ID NO: 915530 - DNA, 22 bp, Artificial Sequence
  chemically synthesized
aaacagaagccattctttctaa

SEQ ID NO: 915531 - DNA, 22 bp, Artificial Sequence
  chemically synthesized
caaacagaagccattctttcta

SEQ ID NO: 915532 - DNA, 22 bp, Artificial Sequence
  chemically synthesized
agctttttttagaaagaatggc

SEQ ID NO: 915533 - DNA, 22 bp, Artificial Sequence
  chemically synthesized
gctttttttagaaagaatggct

SEQ ID NO: 915534 - DNA, 22 bp, Artificial Sequence
  chemically synthesized
tttttagaaagaatggcttctg

SEQ ID NO: 915535 - DNA, 22 bp, Artificial Sequence
  chemically synthesized
ttttagaaagaatggcttctgt

SEQ ID NO: 915536 - DNA, 22 bp, Artificial Sequence
  chemically synthesized
tttagaaagaatggcttctgtt

SEQ ID NO: 915537 - DNA, 22 bp, Artificial Sequence
  chemically synthesized
ttagaaagaatggcttctgttt

SEQ ID NO: 915538 - DNA, 22 bp, Artificial Sequence
  chemically synthesized
tagaaagaatggcttctgtttg

SEQ ID NO: 915539 - DNA, 22 bp, Artificial Sequence
  chemically synthesized
agaaagaatggcttctgtttga

SEQ ID NO: 915540 - DNA, 22 bp, Artificial Sequence
  chemically synthesized
gaaagaatggcttctgtttgaa

SEQ ID NO: 915541 - DNA, 22 bp, Artificial Sequence
  chemically synthesized
ctgtttgaaatattggctctgt

SEQ ID NO: 915542 - DNA, 22 bp, Artificial Sequence
  chemically synthesized
tgtttgaaatattggctctgtt

SEQ ID NO: 915543 - DNA, 22 bp, Artificial Sequence
  chemically synthesized
taatgtaaatggtaacagagcc

SEQ ID NO: 915544 - DNA, 22 bp, Artificial Sequence
  chemically synthesized
tttgaaatattggctctgttac

SEQ ID NO: 915545 - DNA, 22 bp, Artificial Sequence
  chemically synthesized
gtaatgtaaatggtaacagagc

SEQ ID NO: 915546 - DNA, 22 bp, Artificial Sequence
  chemically synthesized
gaaatattggctctgttaccat

SEQ ID NO: 915547 - DNA, 22 bp, Artificial Sequence
  chemically synthesized
aaatattggctctgttaccatt

SEQ ID NO: 915548 - DNA, 22 bp, Artificial Sequence
  chemically synthesized
ggaacatttgtaatgtaaatgg

SEQ ID NO: 915549 - DNA, 22 bp, Artificial Sequence
  chemically synthesized
gctctgttaccatttacattac

SEQ ID NO: 915550 - DNA, 22 bp, Artificial Sequence
  chemically synthesized
attgggaacatttgtaatgtaa

SEQ ID NO: 915551 - DNA, 22 bp, Artificial Sequence
  chemically synthesized
cattgggaacatttgtaatgta

SEQ ID NO: 915552 - DNA, 22 bp, Artificial Sequence
  chemically synthesized
tgttaccatttacattacaaat

SEQ ID NO: 915553 - DNA, 22 bp, Artificial Sequence
  chemically synthesized
ttaccatttacattacaaatgt

SEQ ID NO: 915554 - DNA, 22 bp, Artificial Sequence
  chemically synthesized
atttcattgggaacatttgtaa

SEQ ID NO: 915555 - DNA, 22 bp, Artificial Sequence
  chemically synthesized
aatttcattgggaacatttgta

SEQ ID NO: 915556 - DNA, 22 bp, Artificial Sequence
  chemically synthesized
taatttcattgggaacatttgt

SEQ ID NO: 915557 - DNA, 22 bp, Artificial Sequence
  chemically synthesized
ccatttacattacaaatgttcc

SEQ ID NO: 915558 - DNA, 22 bp, Artificial Sequence
  chemically synthesized
ctttaatttcattgggaacatt

SEQ ID NO: 915559 - DNA, 22 bp, Artificial Sequence
  chemically synthesized
cctttaatttcattgggaacat

SEQ ID NO: 915560 - DNA, 22 bp, Artificial Sequence
  chemically synthesized
acattacaaatgttcccaatga

SEQ ID NO: 915561 - DNA, 22 bp, Artificial Sequence
  chemically synthesized
cattacaaatgttcccaatgaa

SEQ ID NO: 915562 - DNA, 22 bp, Artificial Sequence
  chemically synthesized
caaatgttcccaatgaaattaa

SEQ ID NO: 915563 - DNA, 22 bp, Artificial Sequence
  chemically synthesized
ccaatgaaattaaaggaagcac

SEQ ID NO: 915564 - DNA, 22 bp, Artificial Sequence
  chemically synthesized
accatcgtaatacgtgcttcct

SEQ ID NO: 915565 - DNA, 22 bp, Artificial Sequence
  chemically synthesized
tcaccatcgtaatacgtgcttc

SEQ ID NO: 915566 - DNA, 22 bp, Artificial Sequence
  chemically synthesized
aaggaagcacgtattacgatgg

SEQ ID NO: 915567 - DNA, 22 bp, Artificial Sequence
  chemically synthesized
tgcaaatctctcaccatcgtaa

SEQ ID NO: 915568 - DNA, 22 bp, Artificial Sequence
  chemically synthesized
attatgcaaatctctcaccatc

SEQ ID NO: 915569 - DNA, 22 bp, Artificial Sequence
  chemically synthesized
tgattatgcaaatctctcacca

SEQ ID NO: 915570 - DNA, 22 bp, Artificial Sequence
  chemically synthesized
ctgattatgcaaatctctcacc

SEQ ID NO: 915571 - DNA, 22 bp, Artificial Sequence
  chemically synthesized
tctgattatgcaaatctctcac

SEQ ID NO: 915572 - DNA, 22 bp, Artificial Sequence
  chemically synthesized
ctttctgattatgcaaatctct

SEQ ID NO: 915573 - DNA, 22 bp, Artificial Sequence
  chemically synthesized
cctttctgattatgcaaatctc

SEQ ID NO: 915574 - DNA, 22 bp, Artificial Sequence
  chemically synthesized
cgatggtgagagatttgcataa

SEQ ID NO: 915575 - DNA, 22 bp, Artificial Sequence
  chemically synthesized
gcataatcagaaaggaagcgct

SEQ ID NO: 915576 - DNA, 22 bp, Artificial Sequence
  chemically synthesized
cataatcagaaaggaagcgcta

SEQ ID NO: 915577 - DNA, 22 bp, Artificial Sequence
  chemically synthesized
gcaacacatgagtagcgcttcc

SEQ ID NO: 915578 - DNA, 22 bp, Artificial Sequence
  chemically synthesized
agcaacacatgagtagcgcttc

SEQ ID NO: 915579 - DNA, 22 bp, Artificial Sequence
  chemically synthesized
aatttagcaacacatgagtagc

SEQ ID NO: 915580 - DNA, 22 bp, Artificial Sequence
  chemically synthesized
attgaatttagcaacacatgag

SEQ ID NO: 915581 - DNA, 22 bp, Artificial Sequence
  chemically synthesized
aattcattgaatttagcaacac

SEQ ID NO: 915582 - DNA, 22 bp, Artificial Sequence
  chemically synthesized
atgttaaattcattgaatttag

SEQ ID NO: 915583 - DNA, 22 bp, Artificial Sequence
  chemically synthesized
ctcatgtgttgctaaattcaat

SEQ ID NO: 915584 - DNA, 22 bp, Artificial Sequence
  chemically synthesized
atgtgttgctaaattcaatgaa

SEQ ID NO: 915585 - DNA, 22 bp, Artificial Sequence
  chemically synthesized
agagttaatgttaaattcattg

SEQ ID NO: 915586 - DNA, 22 bp, Artificial Sequence
  chemically synthesized
attaagagttaatgttaaattc

SEQ ID NO: 915587 - DNA, 22 bp, Artificial Sequence
  chemically synthesized
ctaaattcaatgaatttaacat

SEQ ID NO: 915588 - DNA, 22 bp, Artificial Sequence
  chemically synthesized
aattcaatgaatttaacattaa

SEQ ID NO: 915589 - DNA, 22 bp, Artificial Sequence
  chemically synthesized
aatgaatttaacattaactctt

SEQ ID NO: 915590 - DNA, 22 bp, Artificial Sequence
  chemically synthesized
aacattaactcttaatgaacat

SEQ ID NO: 915591 - DNA, 22 bp, Artificial Sequence
  chemically synthesized
acattaactcttaatgaacatt

SEQ ID NO: 915592 - DNA, 22 bp, Artificial Sequence
  chemically synthesized
actcttaatgaacattttctgt

SEQ ID NO: 915593 - DNA, 22 bp, Artificial Sequence
  chemically synthesized
ttaatgaacattttctgtcggg

SEQ ID NO: 915594 - DNA, 22 bp, Artificial Sequence
  chemically synthesized
gcgtaagagtagcccgacagaa

SEQ ID NO: 915595 - DNA, 22 bp, Artificial Sequence
  chemically synthesized
agcgtaagagtagcccgacaga

SEQ ID NO: 915596 - DNA, 22 bp, Artificial Sequence
  chemically synthesized
aatgaacattttctgtcgggct

SEQ ID NO: 915597 - DNA, 22 bp, Artificial Sequence
  chemically synthesized
atgaacattttctgtcgggcta

SEQ ID NO: 915598 - DNA, 22 bp, Artificial Sequence
  chemically synthesized
ttagcgtaagagtagcccgaca

SEQ ID NO: 915599 - DNA, 22 bp, Artificial Sequence
  chemically synthesized
ctcttagcgtaagagtagcccg

SEQ ID NO: 915600 - DNA, 22 bp, Artificial Sequence
  chemically synthesized
ttcctcttagcgtaagagtagc

SEQ ID NO: 915601 - DNA, 22 bp, Artificial Sequence
  chemically synthesized
tctgtcgggctactcttacgct

SEQ ID NO: 915602 - DNA, 22 bp, Artificial Sequence
  chemically synthesized
ctgtcgggctactcttacgcta

SEQ ID NO: 915603 - DNA, 22 bp, Artificial Sequence
  chemically synthesized
tgtcgggctactcttacgctaa

SEQ ID NO: 915604 - DNA, 22 bp, Artificial Sequence
  chemically synthesized
tcgggctactcttacgctaaga

SEQ ID NO: 915605 - DNA, 22 bp, Artificial Sequence
  chemically synthesized
gcagtctattcctcttagcgta

SEQ ID NO: 915606 - DNA, 22 bp, Artificial Sequence
  chemically synthesized
ggcagtctattcctcttagcgt

SEQ ID NO: 915607 - DNA, 22 bp, Artificial Sequence
  chemically synthesized
ctcttacgctaagaggaataga

SEQ ID NO: 915608 - DNA, 22 bp, Artificial Sequence
  chemically synthesized
ttacgctaagaggaatagactg

SEQ ID NO: 915609 - DNA, 22 bp, Artificial Sequence
  chemically synthesized
acgctaagaggaatagactgcc

SEQ ID NO: 915610 - DNA, 22 bp, Artificial Sequence
  chemically synthesized
cgctaagaggaatagactgcca

SEQ ID NO: 915611 - DNA, 22 bp, Artificial Sequence
  chemically synthesized
agaggaatagactgccaaatca

SEQ ID NO: 915612 - DNA, 22 bp, Artificial Sequence
  chemically synthesized
accaaaatcatgccatgtgatt

SEQ ID NO: 915613 - DNA, 22 bp, Artificial Sequence
  chemically synthesized
ccaaatcacatggcatgatttt

SEQ ID NO: 915614 - DNA, 22 bp, Artificial Sequence
  chemically synthesized
gatcccctcaccaaaatcatgc

SEQ ID NO: 915615 - DNA, 22 bp, Artificial Sequence
  chemically synthesized
ttagatcccctcaccaaaatca

SEQ ID NO: 915616 - DNA, 22 bp, Artificial Sequence
  chemically synthesized
gttagatcccctcaccaaaatc

SEQ ID NO: 915617 - DNA, 22 bp, Artificial Sequence
  chemically synthesized
aaacacttgttagatcccctca

SEQ ID NO: 915618 - DNA, 22 bp, Artificial Sequence
  chemically synthesized
cctgaaacacttgttagatccc

SEQ ID NO: 915619 - DNA, 22 bp, Artificial Sequence
  chemically synthesized
acctgaaacacttgttagatcc

SEQ ID NO: 915620 - DNA, 22 bp, Artificial Sequence
  chemically synthesized
tacctgaaacacttgttagatc

SEQ ID NO: 915621 - DNA, 22 bp, Artificial Sequence
  chemically synthesized
tggtgaggggatctaacaagtg

SEQ ID NO: 915622 - DNA, 22 bp, Artificial Sequence
  chemically synthesized
ggtgaggggatctaacaagtgt

SEQ ID NO: 915623 - DNA, 22 bp, Artificial Sequence
  chemically synthesized
gtgaggggatctaacaagtgtt

SEQ ID NO: 915624 - DNA, 22 bp, Artificial Sequence
  chemically synthesized
gcactttacctgaaacacttgt

SEQ ID NO: 915625 - DNA, 22 bp, Artificial Sequence
  chemically synthesized
tctagcactttacctgaaacac

SEQ ID NO: 915626 - DNA, 22 bp, Artificial Sequence
  chemically synthesized
acaagtgtttcaggtaaagtgc

SEQ ID NO: 915627 - DNA, 22 bp, Artificial Sequence
  chemically synthesized
tgaaactatctagcactttacc

SEQ ID NO: 915628 - DNA, 22 bp, Artificial Sequence
  chemically synthesized
cactgtgaaactatctagcact

SEQ ID NO: 915629 - DNA, 22 bp, Artificial Sequence
  chemically synthesized
caggtaaagtgctagatagttt

SEQ ID NO: 915630 - DNA, 22 bp, Artificial Sequence
  chemically synthesized
aggtaaagtgctagatagtttc

SEQ ID NO: 915631 - DNA, 22 bp, Artificial Sequence
  chemically synthesized
aaagattccactgtgaaactat

SEQ ID NO: 915632 - DNA, 22 bp, Artificial Sequence
  chemically synthesized
gatagtttcacagtggaatctt

SEQ ID NO: 915633 - DNA, 22 bp, Artificial Sequence
  chemically synthesized
cacagtggaatcttttaatatt

SEQ ID NO: 915634 - DNA, 22 bp, Artificial Sequence
  chemically synthesized
acagtggaatcttttaatattc

SEQ ID NO: 915635 - DNA, 22 bp, Artificial Sequence
  chemically synthesized
ttaatattccatacatcctttg

SEQ ID NO: 915636 - DNA, 22 bp, Artificial Sequence
  chemically synthesized
taatattccatacatcctttgg

SEQ ID NO: 915637 - DNA, 22 bp, Artificial Sequence
  chemically synthesized
aatattccatacatcctttgga

SEQ ID NO: 915638 - DNA, 22 bp, Artificial Sequence
  chemically synthesized
atattccatacatcctttggat

SEQ ID NO: 915639 - DNA, 22 bp, Artificial Sequence
  chemically synthesized
aaagcatataaaaggcaatcca

SEQ ID NO: 915640 - DNA, 22 bp, Artificial Sequence
  chemically synthesized
catacatcctttggattgcctt

SEQ ID NO: 915641 - DNA, 22 bp, Artificial Sequence
  chemically synthesized
attgaaagcatataaaaggcaa

SEQ ID NO: 915642 - DNA, 22 bp, Artificial Sequence
  chemically synthesized
cattgaaagcatataaaaggca

SEQ ID NO: 915643 - DNA, 22 bp, Artificial Sequence
  chemically synthesized
ttcattgaaagcatataaaagg

SEQ ID NO: 915644 - DNA, 22 bp, Artificial Sequence
  chemically synthesized
cttcattgaaagcatataaaag

SEQ ID NO: 915645 - DNA, 22 bp, Artificial Sequence
  chemically synthesized
tggattgccttttatatgcttt

SEQ ID NO: 915646 - DNA, 22 bp, Artificial Sequence
  chemically synthesized
ggattgccttttatatgctttc

SEQ ID NO: 915647 - DNA, 22 bp, Artificial Sequence
  chemically synthesized
agtttcttcattgaaagcatat

SEQ ID NO: 915648 - DNA, 22 bp, Artificial Sequence
  chemically synthesized
gattgccttttatatgctttca

SEQ ID NO: 915649 - DNA, 22 bp, Artificial Sequence
  chemically synthesized
cagtttcttcattgaaagcata

SEQ ID NO: 915650 - DNA, 22 bp, Artificial Sequence
  chemically synthesized
ccttttatatgctttcaatgaa

SEQ ID NO: 915651 - DNA, 22 bp, Artificial Sequence
  chemically synthesized
gaacttcagtttcttcattgaa

SEQ ID NO: 915652 - DNA, 22 bp, Artificial Sequence
  chemically synthesized
tagaacttcagtttcttcattg

SEQ ID NO: 915653 - DNA, 22 bp, Artificial Sequence
  chemically synthesized
ttatatgctttcaatgaagaaa

SEQ ID NO: 915654 - DNA, 22 bp, Artificial Sequence
  chemically synthesized
tatatgctttcaatgaagaaac

SEQ ID NO: 915655 - DNA, 22 bp, Artificial Sequence
  chemically synthesized
atatgctttcaatgaagaaact

SEQ ID NO: 915656 - DNA, 22 bp, Artificial Sequence
  chemically synthesized
tatgctttcaatgaagaaactg

SEQ ID NO: 915657 - DNA, 22 bp, Artificial Sequence
  chemically synthesized
tcaatgaagaaactgaagttct

SEQ ID NO: 915658 - DNA, 22 bp, Artificial Sequence
  chemically synthesized
caatgaagaaactgaagttcta

SEQ ID NO: 915659 - DNA, 22 bp, Artificial Sequence
  chemically synthesized
aatgaagaaactgaagttctag

SEQ ID NO: 915660 - DNA, 22 bp, Artificial Sequence
  chemically synthesized
ggtatgtgatgtatcaatctct

SEQ ID NO: 915661 - DNA, 22 bp, Artificial Sequence
  chemically synthesized
gggtatgtgatgtatcaatctc

SEQ ID NO: 915662 - DNA, 22 bp, Artificial Sequence
  chemically synthesized
tgggtatgtgatgtatcaatct

SEQ ID NO: 915663 - DNA, 22 bp, Artificial Sequence
  chemically synthesized
aagttctagagattgatacatc

SEQ ID NO: 915664 - DNA, 22 bp, Artificial Sequence
  chemically synthesized
tagagattgatacatcacatac

SEQ ID NO: 915665 - DNA, 22 bp, Artificial Sequence
  chemically synthesized
gagattgatacatcacataccc

SEQ ID NO: 915666 - DNA, 22 bp, Artificial Sequence
  chemically synthesized
atacatcacatacccaaaggtg

SEQ ID NO: 915667 - DNA, 22 bp, Artificial Sequence
  chemically synthesized
gaaaatgggatagtcacctttg

SEQ ID NO: 915668 - DNA, 22 bp, Artificial Sequence
  chemically synthesized
ggaaaatgggatagtcaccttt

SEQ ID NO: 915669 - DNA, 22 bp, Artificial Sequence
  chemically synthesized
atttggaaaatgggatagtcac

SEQ ID NO: 915670 - DNA, 22 bp, Artificial Sequence
  chemically synthesized
tcatttggaaaatgggatagtc

SEQ ID NO: 915671 - DNA, 22 bp, Artificial Sequence
  chemically synthesized
ctcatttggaaaatgggatagt

SEQ ID NO: 915672 - DNA, 22 bp, Artificial Sequence
  chemically synthesized
gagagagggacttctcatttgg

SEQ ID NO: 915673 - DNA, 22 bp, Artificial Sequence
  chemically synthesized
ggagagagggacttctcatttg

SEQ ID NO: 915674 - DNA, 22 bp, Artificial Sequence
  chemically synthesized
tcccattttccaaatgagaagt

SEQ ID NO: 915675 - DNA, 22 bp, Artificial Sequence
  chemically synthesized
tccaaatgagaagtccctctct

SEQ ID NO: 915676 - DNA, 22 bp, Artificial Sequence
  chemically synthesized
ccaaatgagaagtccctctctc

SEQ ID NO: 915677 - DNA, 22 bp, Artificial Sequence
  chemically synthesized
caaatgagaagtccctctctcc

SEQ ID NO: 915678 - DNA, 22 bp, Artificial Sequence
  chemically synthesized
aaggtgatcaaaaaacttggag

SEQ ID NO: 915679 - DNA, 22 bp, Artificial Sequence
  chemically synthesized
tgttaaaggtgatcaaaaaact

SEQ ID NO: 915680 - DNA, 22 bp, Artificial Sequence
  chemically synthesized
tatgttaaaggtgatcaaaaaa

SEQ ID NO: 915681 - DNA, 22 bp, Artificial Sequence
  chemically synthesized
ctatgttaaaggtgatcaaaaa

SEQ ID NO: 915682 - DNA, 22 bp, Artificial Sequence
  chemically synthesized
tctccaagttttttgatcacct

SEQ ID NO: 915683 - DNA, 22 bp, Artificial Sequence
  chemically synthesized
tccaagttttttgatcaccttt

SEQ ID NO: 915684 - DNA, 22 bp, Artificial Sequence
  chemically synthesized
aagtttctatgttaaaggtgat

SEQ ID NO: 915685 - DNA, 22 bp, Artificial Sequence
  chemically synthesized
caagttttttgatcacctttaa

SEQ ID NO: 915686 - DNA, 22 bp, Artificial Sequence
  chemically synthesized
taaagtttctatgttaaaggtg

SEQ ID NO: 915687 - DNA, 22 bp, Artificial Sequence
  chemically synthesized
ctaaagtttctatgttaaaggt

SEQ ID NO: 915688 - DNA, 22 bp, Artificial Sequence
  chemically synthesized
tctaaagtttctatgttaaagg

SEQ ID NO: 915689 - DNA, 22 bp, Artificial Sequence
  chemically synthesized
tttgatcacctttaacatagaa

SEQ ID NO: 915690 - DNA, 22 bp, Artificial Sequence
  chemically synthesized
ttgatcacctttaacatagaaa

SEQ ID NO: 915691 - DNA, 22 bp, Artificial Sequence
  chemically synthesized
cattttctaaagtttctatgtt

SEQ ID NO: 915692 - DNA, 22 bp, Artificial Sequence
  chemically synthesized
tgatcacctttaacatagaaac

SEQ ID NO: 915693 - DNA, 22 bp, Artificial Sequence
  chemically synthesized
gatcacctttaacatagaaact

SEQ ID NO: 915694 - DNA, 22 bp, Artificial Sequence
  chemically synthesized
atcacctttaacatagaaactt

SEQ ID NO: 915695 - DNA, 22 bp, Artificial Sequence
  chemically synthesized
tatctccattttctaaagtttc

SEQ ID NO: 915696 - DNA, 22 bp, Artificial Sequence
  chemically synthesized
taacatagaaactttagaaaat

SEQ ID NO: 915697 - DNA, 22 bp, Artificial Sequence
  chemically synthesized
aacatagaaactttagaaaatg

SEQ ID NO: 915698 - DNA, 22 bp, Artificial Sequence
  chemically synthesized
acatagaaactttagaaaatgg

SEQ ID NO: 915699 - DNA, 22 bp, Artificial Sequence
  chemically synthesized
tagaaaatggagatacaatgat

SEQ ID NO: 915700 - DNA, 22 bp, Artificial Sequence
  chemically synthesized
agaaaatggagatacaatgatc

SEQ ID NO: 915701 - DNA, 22 bp, Artificial Sequence
  chemically synthesized
gaaaatggagatacaatgatca

SEQ ID NO: 915702 - DNA, 22 bp, Artificial Sequence
  chemically synthesized
tatgtaaacaggtgatcattgt

SEQ ID NO: 915703 - DNA, 22 bp, Artificial Sequence
  chemically synthesized
aacattatatgtaaacaggtga

SEQ ID NO: 915704 - DNA, 22 bp, Artificial Sequence
  chemically synthesized
atgaattaaacattatatgtaa

SEQ ID NO: 915705 - DNA, 22 bp, Artificial Sequence
  chemically synthesized
tttacatataatgtttaattca

SEQ ID NO: 915706 - DNA, 22 bp, Artificial Sequence
  chemically synthesized
acatataatgtttaattcatta

SEQ ID NO: 915707 - DNA, 22 bp, Artificial Sequence
  chemically synthesized
catataatgtttaattcattaa

SEQ ID NO: 915708 - DNA, 22 bp, Artificial Sequence
  chemically synthesized
aagtagtacacacaatcaaatt

SEQ ID NO: 915709 - DNA, 22 bp, Artificial Sequence
  chemically synthesized
aaagtagtacacacaatcaaat

SEQ ID NO: 915710 - DNA, 22 bp, Artificial Sequence
  chemically synthesized
taaagtagtacacacaatcaaa

SEQ ID NO: 915711 - DNA, 22 bp, Artificial Sequence
  chemically synthesized
aattcattaatttgattgtgtg

SEQ ID NO: 915712 - DNA, 22 bp, Artificial Sequence
  chemically synthesized
attcattaatttgattgtgtgt

SEQ ID NO: 915713 - DNA, 22 bp, Artificial Sequence
  chemically synthesized
attaatttgattgtgtgtacta

SEQ ID NO: 915714 - DNA, 22 bp, Artificial Sequence
  chemically synthesized
tataattttaaagtagtacaca

SEQ ID NO: 915715 - DNA, 22 bp, Artificial Sequence
  chemically synthesized
atttgattgtgtgtactacttt

SEQ ID NO: 915716 - DNA, 22 bp, Artificial Sequence
  chemically synthesized
tactatataattttaaagtagt

SEQ ID NO: 915717 - DNA, 22 bp, Artificial Sequence
  chemically synthesized
gtactatataattttaaagtag

SEQ ID NO: 915718 - DNA, 22 bp, Artificial Sequence
  chemically synthesized
gattgtgtgtactactttaaaa

SEQ ID NO: 915719 - DNA, 22 bp, Artificial Sequence
  chemically synthesized
tgtactatataattttaaagta

SEQ ID NO: 915720 - DNA, 22 bp, Artificial Sequence
  chemically synthesized
attgtgtgtactactttaaaat

SEQ ID NO: 915721 - DNA, 22 bp, Artificial Sequence
  chemically synthesized
tgtgtactactttaaaattata

SEQ ID NO: 915722 - DNA, 22 bp, Artificial Sequence
  chemically synthesized
ctttaaaattatatagtacaaa

SEQ ID NO: 915723 - DNA, 22 bp, Artificial Sequence
  chemically synthesized
atgacataatattttgtactat

SEQ ID NO: 915724 - DNA, 22 bp, Artificial Sequence
  chemically synthesized
taaaattatatagtacaaaata

SEQ ID NO: 915725 - DNA, 22 bp, Artificial Sequence
  chemically synthesized
aaaattatatagtacaaaatat

SEQ ID NO: 915726 - DNA, 22 bp, Artificial Sequence
  chemically synthesized
aaattatatagtacaaaatatt

SEQ ID NO: 915727 - DNA, 22 bp, Artificial Sequence
  chemically synthesized
tatagtacaaaatattatgtca

SEQ ID NO: 915728 - DNA, 22 bp, Artificial Sequence
  chemically synthesized
tgtcattagatcacacttcttc

SEQ ID NO: 915729 - DNA, 22 bp, Artificial Sequence
  chemically synthesized
catgaaatatgaatgaagaagt

SEQ ID NO: 915730 - DNA, 22 bp, Artificial Sequence
  chemically synthesized
ttgcatgaaatatgaatgaaga

SEQ ID NO: 915731 - DNA, 22 bp, Artificial Sequence
  chemically synthesized
gatcacacttcttcattcatat

SEQ ID NO: 915732 - DNA, 22 bp, Artificial Sequence
  chemically synthesized
aacaaaattgttgcatgaaata

SEQ ID NO: 915733 - DNA, 22 bp, Artificial Sequence
  chemically synthesized
gaacaaaattgttgcatgaaat

SEQ ID NO: 915734 - DNA, 22 bp, Artificial Sequence
  chemically synthesized
cttcattcatatttcatgcaac

SEQ ID NO: 915735 - DNA, 22 bp, Artificial Sequence
  chemically synthesized
ttcattcatatttcatgcaaca

SEQ ID NO: 915736 - DNA, 22 bp, Artificial Sequence
  chemically synthesized
cattcatatttcatgcaacaat

SEQ ID NO: 915737 - DNA, 22 bp, Artificial Sequence
  chemically synthesized
attcatatttcatgcaacaatt

SEQ ID NO: 915738 - DNA, 22 bp, Artificial Sequence
  chemically synthesized
atatttcatgcaacaattttgt

SEQ ID NO: 915739 - DNA, 22 bp, Artificial Sequence
  chemically synthesized
tgaagaatttgaacaaaattgt

SEQ ID NO: 915740 - DNA, 22 bp, Artificial Sequence
  chemically synthesized
catgcaacaattttgttcaaat

SEQ ID NO: 915741 - DNA, 22 bp, Artificial Sequence
  chemically synthesized
atgcaacaattttgttcaaatt

SEQ ID NO: 915742 - DNA, 22 bp, Artificial Sequence
  chemically synthesized
aaggtgcctgtgaagaatttga

SEQ ID NO: 915743 - DNA, 22 bp, Artificial Sequence
  chemically synthesized
aatgttgaaggtgcctgtgaag

SEQ ID NO: 915744 - DNA, 22 bp, Artificial Sequence
  chemically synthesized
caatgttgaaggtgcctgtgaa

SEQ ID NO: 915745 - DNA, 22 bp, Artificial Sequence
  chemically synthesized
tgttcaaattcttcacaggcac

SEQ ID NO: 915746 - DNA, 22 bp, Artificial Sequence
  chemically synthesized
gttcaaattcttcacaggcacc

SEQ ID NO: 915747 - DNA, 22 bp, Artificial Sequence
  chemically synthesized
ttcaaattcttcacaggcacct

SEQ ID NO: 915748 - DNA, 22 bp, Artificial Sequence
  chemically synthesized
aaattcttcacaggcaccttca

SEQ ID NO: 915749 - DNA, 22 bp, Artificial Sequence
  chemically synthesized
ttcacaggcaccttcaacattg

SEQ ID NO: 915750 - DNA, 22 bp, Artificial Sequence
  chemically synthesized
cacaggcaccttcaacattgaa

SEQ ID NO: 915751 - DNA, 22 bp, Artificial Sequence
  chemically synthesized
acaggcaccttcaacattgaaa

SEQ ID NO: 915752 - DNA, 22 bp, Artificial Sequence
  chemically synthesized
caacattgaaatttgcatcctc

SEQ ID NO: 915753 - DNA, 22 bp, Artificial Sequence
  chemically synthesized
aacattgaaatttgcatcctca

SEQ ID NO: 915754 - DNA, 22 bp, Artificial Sequence
  chemically synthesized
aaatttgcatcctcatggatgc

SEQ ID NO: 915755 - DNA, 22 bp, Artificial Sequence
  chemically synthesized
ggcaacaacaagtgcatccatg

SEQ ID NO: 915756 - DNA, 22 bp, Artificial Sequence
  chemically synthesized
gcatcctcatggatgcacttgt

SEQ ID NO: 915757 - DNA, 22 bp, Artificial Sequence
  chemically synthesized
agttaggcaacaacaagtgcat

SEQ ID NO: 915758 - DNA, 22 bp, Artificial Sequence
  chemically synthesized
catcctcatggatgcacttgtt

SEQ ID NO: 915759 - DNA, 22 bp, Artificial Sequence
  chemically synthesized
atggatgcacttgttgttgcct

SEQ ID NO: 915760 - DNA, 22 bp, Artificial Sequence
  chemically synthesized
gaaaactgagttaggcaacaac

SEQ ID NO: 915761 - DNA, 22 bp, Artificial Sequence
  chemically synthesized
tggaaaactgagttaggcaaca

SEQ ID NO: 915762 - DNA, 22 bp, Artificial Sequence
  chemically synthesized
gttgttgcctaactcagttttc

SEQ ID NO: 915763 - DNA, 22 bp, Artificial Sequence
  chemically synthesized
ttgttgcctaactcagttttcc

SEQ ID NO: 915764 - DNA, 22 bp, Artificial Sequence
  chemically synthesized
ttgcctaactcagttttccaga

SEQ ID NO: 915765 - DNA, 22 bp, Artificial Sequence
  chemically synthesized
cctaactcagttttccagaggg

SEQ ID NO: 915766 - DNA, 22 bp, Artificial Sequence
  chemically synthesized
actcagttttccagagggcatc

SEQ ID NO: 915767 - DNA, 22 bp, Artificial Sequence
  chemically synthesized
agttttccagagggcatcatct

SEQ ID NO: 915768 - DNA, 22 bp, Artificial Sequence
  chemically synthesized
tccagagggcatcatctttact

SEQ ID NO: 915769 - DNA, 22 bp, Artificial Sequence
  chemically synthesized
ccagagggcatcatctttactt

SEQ ID NO: 915770 - DNA, 22 bp, Artificial Sequence
  chemically synthesized
cagagggcatcatctttactta

SEQ ID NO: 915771 - DNA, 22 bp, Artificial Sequence
  chemically synthesized
aggccacatggatgtaagtaaa

SEQ ID NO: 915772 - DNA, 22 bp, Artificial Sequence
  chemically synthesized
tacctcaggccacatggatgta

SEQ ID NO: 915773 - DNA, 22 bp, Artificial Sequence
  chemically synthesized
tacttacatccatgtggcctga

SEQ ID NO: 915774 - DNA, 22 bp, Artificial Sequence
  chemically synthesized
acttacatccatgtggcctgag

SEQ ID NO: 915775 - DNA, 22 bp, Artificial Sequence
  chemically synthesized
cttacatccatgtggcctgagg

SEQ ID NO: 915776 - DNA, 22 bp, Artificial Sequence
  chemically synthesized
agcagtactatacctcaggcca

SEQ ID NO: 915777 - DNA, 22 bp, Artificial Sequence
  chemically synthesized
acatccatgtggcctgaggtat

SEQ ID NO: 915778 - DNA, 22 bp, Artificial Sequence
  chemically synthesized
catccatgtggcctgaggtata

SEQ ID NO: 915779 - DNA, 22 bp, Artificial Sequence
  chemically synthesized
gattcagcagtactatacctca

SEQ ID NO: 915780 - DNA, 22 bp, Artificial Sequence
  chemically synthesized
tagattcagcagtactatacct

SEQ ID NO: 915781 - DNA, 22 bp, Artificial Sequence
  chemically synthesized
cctctagattcagcagtactat

SEQ ID NO: 915782 - DNA, 22 bp, Artificial Sequence
  chemically synthesized
aggtatagtactgctgaatcta

SEQ ID NO: 915783 - DNA, 22 bp, Artificial Sequence
  chemically synthesized
gtgaaacattacctctagattc

SEQ ID NO: 915784 - DNA, 22 bp, Artificial Sequence
  chemically synthesized
ctagtgaaacattacctctaga

SEQ ID NO: 915785 - DNA, 22 bp, Artificial Sequence
  chemically synthesized
ctgaatctagaggtaatgtttc

SEQ ID NO: 915786 - DNA, 22 bp, Artificial Sequence
  chemically synthesized
aatctagaggtaatgtttcact

SEQ ID NO: 915787 - DNA, 22 bp, Artificial Sequence
  chemically synthesized
cagtaaaattcctagtgaaaca

SEQ ID NO: 915788 - DNA, 22 bp, Artificial Sequence
  chemically synthesized
gcagtaaaattcctagtgaaac

SEQ ID NO: 915789 - DNA, 22 bp, Artificial Sequence
  chemically synthesized
gaggtaatgtttcactaggaat

SEQ ID NO: 915790 - DNA, 22 bp, Artificial Sequence
  chemically synthesized
tggcttgcagtaaaattcctag

SEQ ID NO: 915791 - DNA, 22 bp, Artificial Sequence
  chemically synthesized
gtggcttgcagtaaaattccta

SEQ ID NO: 915792 - DNA, 22 bp, Artificial Sequence
  chemically synthesized
cactaggaattttactgcaagc

SEQ ID NO: 915793 - DNA, 22 bp, Artificial Sequence
  chemically synthesized
actaggaattttactgcaagcc

SEQ ID NO: 915794 - DNA, 22 bp, Artificial Sequence
  chemically synthesized
ggaattttactgcaagccacaa

SEQ ID NO: 915795 - DNA, 22 bp, Artificial Sequence
  chemically synthesized
tgtaaatgtgtgcttgtggctt

SEQ ID NO: 915796 - DNA, 22 bp, Artificial Sequence
  chemically synthesized
ttatgtaaatgtgtgcttgtgg

SEQ ID NO: 915797 - DNA, 22 bp, Artificial Sequence
  chemically synthesized
tgttatgtaaatgtgtgcttgt

SEQ ID NO: 915798 - DNA, 22 bp, Artificial Sequence
  chemically synthesized
tactgcaagccacaagcacaca

SEQ ID NO: 915799 - DNA, 22 bp, Artificial Sequence
  chemically synthesized
actgcaagccacaagcacacat

SEQ ID NO: 915800 - DNA, 22 bp, Artificial Sequence
  chemically synthesized
ctgcaagccacaagcacacatt

SEQ ID NO: 915801 - DNA, 22 bp, Artificial Sequence
  chemically synthesized
tattctgttatgtaaatgtgtg

SEQ ID NO: 915802 - DNA, 22 bp, Artificial Sequence
  chemically synthesized
caagccacaagcacacatttac

SEQ ID NO: 915803 - DNA, 22 bp, Artificial Sequence
  chemically synthesized
cataacataaaactgtattctg

SEQ ID NO: 915804 - DNA, 22 bp, Artificial Sequence
  chemically synthesized
acataacataaaactgtattct

SEQ ID NO: 915805 - DNA, 22 bp, Artificial Sequence
  chemically synthesized
tacataacataaaactgtattc

SEQ ID NO: 915806 - DNA, 22 bp, Artificial Sequence
  chemically synthesized
acataacagaatacagttttat

SEQ ID NO: 915807 - DNA, 22 bp, Artificial Sequence
  chemically synthesized
tctttacataacataaaactgt

SEQ ID NO: 915808 - DNA, 22 bp, Artificial Sequence
  chemically synthesized
cataacagaatacagttttatg

SEQ ID NO: 915809 - DNA, 22 bp, Artificial Sequence
  chemically synthesized
tatgttatgtaaagacagcttt

SEQ ID NO: 915810 - DNA, 22 bp, Artificial Sequence
  chemically synthesized
atgttatgtaaagacagcttta

SEQ ID NO: 915811 - DNA, 22 bp, Artificial Sequence
  chemically synthesized
tgttatgtaaagacagctttat

SEQ ID NO: 915812 - DNA, 22 bp, Artificial Sequence
  chemically synthesized
tgtaaagacagctttatctttt

SEQ ID NO: 915813 - DNA, 22 bp, Artificial Sequence
  chemically synthesized
atggacatatggcacagaaaaa

SEQ ID NO: 915814 - DNA, 22 bp, Artificial Sequence
  chemically synthesized
tatcttttttctgtgccatatg

SEQ ID NO: 915815 - DNA, 22 bp, Artificial Sequence
  chemically synthesized
atcttttttctgtgccatatgt

SEQ ID NO: 915816 - DNA, 22 bp, Artificial Sequence
  chemically synthesized
tcttttttctgtgccatatgtc

SEQ ID NO: 915817 - DNA, 22 bp, Artificial Sequence
  chemically synthesized
ttttctgtgccatatgtccatg

SEQ ID NO: 915818 - DNA, 22 bp, Artificial Sequence
  chemically synthesized
catggtgtagctcatggacata

SEQ ID NO: 915819 - DNA, 22 bp, Artificial Sequence
  chemically synthesized
tttctgtgccatatgtccatga

SEQ ID NO: 915820 - DNA, 22 bp, Artificial Sequence
  chemically synthesized
ttctgtgccatatgtccatgag

SEQ ID NO: 915821 - DNA, 22 bp, Artificial Sequence
  chemically synthesized
tctgtgccatatgtccatgagc

SEQ ID NO: 915822 - DNA, 22 bp, Artificial Sequence
  chemically synthesized
ctgtgccatatgtccatgagct

SEQ ID NO: 915823 - DNA, 22 bp, Artificial Sequence
  chemically synthesized
tgtgccatatgtccatgagcta

SEQ ID NO: 915824 - DNA, 22 bp, Artificial Sequence
  chemically synthesized
tgccatatgtccatgagctaca

SEQ ID NO: 915825 - DNA, 22 bp, Artificial Sequence
  chemically synthesized
agtggttacatggtgtagctca

SEQ ID NO: 915826 - DNA, 22 bp, Artificial Sequence
  chemically synthesized
attaagtggttacatggtgtag

SEQ ID NO: 915827 - DNA, 22 bp, Artificial Sequence
  chemically synthesized
aaagtaactcattaagtggtta

SEQ ID NO: 915828 - DNA, 22 bp, Artificial Sequence
  chemically synthesized
ttaaaagtaactcattaagtgg

SEQ ID NO: 915829 - DNA, 22 bp, Artificial Sequence
  chemically synthesized
caccatgtaaccacttaatgag

SEQ ID NO: 915830 - DNA, 22 bp, Artificial Sequence
  chemically synthesized
tggaaagaatactgttaaaagt

SEQ ID NO: 915831 - DNA, 22 bp, Artificial Sequence
  chemically synthesized
aatgagttacttttaacagtat

SEQ ID NO: 915832 - DNA, 22 bp, Artificial Sequence
  chemically synthesized
atgagttacttttaacagtatt

SEQ ID NO: 915833 - DNA, 22 bp, Artificial Sequence
  chemically synthesized
taaacaagctatggaaagaata

SEQ ID NO: 915834 - DNA, 22 bp, Artificial Sequence
  chemically synthesized
cttttaacagtattctttccat

SEQ ID NO: 915835 - DNA, 22 bp, Artificial Sequence
  chemically synthesized
ttaacagtattctttccatagc

SEQ ID NO: 915836 - DNA, 22 bp, Artificial Sequence
  chemically synthesized
taacagtattctttccatagct

SEQ ID NO: 915837 - DNA, 22 bp, Artificial Sequence
  chemically synthesized
aacagtattctttccatagctt

SEQ ID NO: 915838 - DNA, 22 bp, Artificial Sequence
  chemically synthesized
acagtattctttccatagcttg

SEQ ID NO: 915839 - DNA, 22 bp, Artificial Sequence
  chemically synthesized
gatgccattgtaaacaagctat

SEQ ID NO: 915840 - DNA, 22 bp, Artificial Sequence
  chemically synthesized
tttccatagcttgtttacaatg

SEQ ID NO: 915841 - DNA, 22 bp, Artificial Sequence
  chemically synthesized
tccatagcttgtttacaatggc

SEQ ID NO: 915842 - DNA, 22 bp, Artificial Sequence
  chemically synthesized
caagagttggatgccattgtaa

SEQ ID NO: 915843 - DNA, 22 bp, Artificial Sequence
  chemically synthesized
ccatagcttgtttacaatggca

SEQ ID NO: 915844 - DNA, 22 bp, Artificial Sequence
  chemically synthesized
catagcttgtttacaatggcat

SEQ ID NO: 915845 - DNA, 22 bp, Artificial Sequence
  chemically synthesized
gtttacaatggcatccaactct

SEQ ID NO: 915846 - DNA, 22 bp, Artificial Sequence
  chemically synthesized
tttacaatggcatccaactctt

SEQ ID NO: 915847 - DNA, 22 bp, Artificial Sequence
  chemically synthesized
acaatggcatccaactcttgca

SEQ ID NO: 915848 - DNA, 22 bp, Artificial Sequence
  chemically synthesized
caatggcatccaactcttgcaa

SEQ ID NO: 915849 - DNA, 22 bp, Artificial Sequence
  chemically synthesized
tatgacatcacaattgcaagag

SEQ ID NO: 915850 - DNA, 22 bp, Artificial Sequence
  chemically synthesized
gttgtatgacatcacaattgca

SEQ ID NO: 915851 - DNA, 22 bp, Artificial Sequence
  chemically synthesized
ggttgtatgacatcacaattgc

SEQ ID NO: 915852 - DNA, 22 bp, Artificial Sequence
  chemically synthesized
tggttgtatgacatcacaattg

SEQ ID NO: 915853 - DNA, 22 bp, Artificial Sequence
  chemically synthesized
actttggttgtatgacatcaca

SEQ ID NO: 915854 - DNA, 22 bp, Artificial Sequence
  chemically synthesized
ttgcaattgtgatgtcatacaa

SEQ ID NO: 915855 - DNA, 22 bp, Artificial Sequence
  chemically synthesized
gcaattgtgatgtcatacaacc

SEQ ID NO: 915856 - DNA, 22 bp, Artificial Sequence
  chemically synthesized
gggattgactttggttgtatga

SEQ ID NO: 915857 - DNA, 22 bp, Artificial Sequence
  chemically synthesized
caattgtgatgtcatacaacca

SEQ ID NO: 915858 - DNA, 22 bp, Artificial Sequence
  chemically synthesized
agggattgactttggttgtatg

SEQ ID NO: 915859 - DNA, 22 bp, Artificial Sequence
  chemically synthesized
tgatgtcatacaaccaaagtca

SEQ ID NO: 915860 - DNA, 22 bp, Artificial Sequence
  chemically synthesized
acacagtttagggattgacttt

SEQ ID NO: 915861 - DNA, 22 bp, Artificial Sequence
  chemically synthesized
aacacagtttagggattgactt

SEQ ID NO: 915862 - DNA, 22 bp, Artificial Sequence
  chemically synthesized
ggagaaaataaatttaacacag

SEQ ID NO: 915863 - DNA, 22 bp, Artificial Sequence
  chemically synthesized
aactgtgttaaatttattttct

SEQ ID NO: 915864 - DNA, 22 bp, Artificial Sequence
  chemically synthesized
tgttaaatttattttctcccag

SEQ ID NO: 915865 - DNA, 22 bp, Artificial Sequence
  chemically synthesized
aatttattttctcccagtgtgt

SEQ ID NO: 915866 - DNA, 22 bp, Artificial Sequence
  chemically synthesized
attttctcccagtgtgtgtgtg

SEQ ID NO: 915867 - DNA, 22 bp, Artificial Sequence
  chemically synthesized
ttttctcccagtgtgtgtgtgt

SEQ ID NO: 915868 - DNA, 22 bp, Artificial Sequence
  chemically synthesized
tctcccagtgtgtgtgtgtctg

SEQ ID NO: 915869 - DNA, 22 bp, Artificial Sequence
  chemically synthesized
ctcccagtgtgtgtgtgtctgt

SEQ ID NO: 915870 - DNA, 22 bp, Artificial Sequence
  chemically synthesized
tcccagtgtgtgtgtgtctgtg

SEQ ID NO: 915871 - DNA, 22 bp, Artificial Sequence
  chemically synthesized
ccagtgtgtgtgtgtctgtgtg

SEQ ID NO: 915872 - DNA, 22 bp, Artificial Sequence
  chemically synthesized
atagaggagggcaaaaacacac

SEQ ID NO: 915873 - DNA, 22 bp, Artificial Sequence
  chemically synthesized
tgtgtgtgtgtttttgccctcc

SEQ ID NO: 915874 - DNA, 22 bp, Artificial Sequence
  chemically synthesized
tagaagtaaacctgatagagga

SEQ ID NO: 915875 - DNA, 22 bp, Artificial Sequence
  chemically synthesized
gtagaagtaaacctgatagagg

SEQ ID NO: 915876 - DNA, 22 bp, Artificial Sequence
  chemically synthesized
ttgccctcctctatcaggttta

SEQ ID NO: 915877 - DNA, 22 bp, Artificial Sequence
  chemically synthesized
tgccctcctctatcaggtttac

SEQ ID NO: 915878 - DNA, 22 bp, Artificial Sequence
  chemically synthesized
gccctcctctatcaggtttact

SEQ ID NO: 915879 - DNA, 22 bp, Artificial Sequence
  chemically synthesized
gaggcttgtagaagtaaacctg

SEQ ID NO: 915880 - DNA, 22 bp, Artificial Sequence
  chemically synthesized
ccctcctctatcaggtttactt

SEQ ID NO: 915881 - DNA, 22 bp, Artificial Sequence
  chemically synthesized
ggaggcttgtagaagtaaacct

SEQ ID NO: 915882 - DNA, 22 bp, Artificial Sequence
  chemically synthesized
tggaggcttgtagaagtaaacc

SEQ ID NO: 915883 - DNA, 22 bp, Artificial Sequence
  chemically synthesized
ttttggaggcttgtagaagtaa

SEQ ID NO: 915884 - DNA, 22 bp, Artificial Sequence
  chemically synthesized
ctctatcaggtttacttctaca

SEQ ID NO: 915885 - DNA, 22 bp, Artificial Sequence
  chemically synthesized
attttggaggcttgtagaagta

SEQ ID NO: 915886 - DNA, 22 bp, Artificial Sequence
  chemically synthesized
tatcaggtttacttctacaagc

SEQ ID NO: 915887 - DNA, 22 bp, Artificial Sequence
  chemically synthesized
tcaggtttacttctacaagcct

SEQ ID NO: 915888 - DNA, 22 bp, Artificial Sequence
  chemically synthesized
tgcttattttggaggcttgtag

SEQ ID NO: 915889 - DNA, 22 bp, Artificial Sequence
  chemically synthesized
atgcttattttggaggcttgta

SEQ ID NO: 915890 - DNA, 22 bp, Artificial Sequence
  chemically synthesized
aatttatgcttattttggaggc

SEQ ID NO: 915891 - DNA, 22 bp, Artificial Sequence
  chemically synthesized
acttctacaagcctccaaaata

SEQ ID NO: 915892 - DNA, 22 bp, Artificial Sequence
  chemically synthesized
tcaatttatgcttattttggag

SEQ ID NO: 915893 - DNA, 22 bp, Artificial Sequence
  chemically synthesized
cttctacaagcctccaaaataa

SEQ ID NO: 915894 - DNA, 22 bp, Artificial Sequence
  chemically synthesized
ttctcaatttatgcttattttg

SEQ ID NO: 915895 - DNA, 22 bp, Artificial Sequence
  chemically synthesized
ctacaagcctccaaaataagca

SEQ ID NO: 915896 - DNA, 22 bp, Artificial Sequence
  chemically synthesized
attctcaatttatgcttatttt

SEQ ID NO: 915897 - DNA, 22 bp, Artificial Sequence
  chemically synthesized
tacaagcctccaaaataagcat

SEQ ID NO: 915898 - DNA, 22 bp, Artificial Sequence
  chemically synthesized
caagcctccaaaataagcataa

SEQ ID NO: 915899 - DNA, 22 bp, Artificial Sequence
  chemically synthesized
acttattctcaatttatgctta

SEQ ID NO: 915900 - DNA, 22 bp, Artificial Sequence
  chemically synthesized
gacttattctcaatttatgctt

SEQ ID NO: 915901 - DNA, 22 bp, Artificial Sequence
  chemically synthesized
ccttgacttattctcaatttat

SEQ ID NO: 915902 - DNA, 22 bp, Artificial Sequence
  chemically synthesized
caaaataagcataaattgagaa

SEQ ID NO: 915903 - DNA, 22 bp, Artificial Sequence
  chemically synthesized
tccgggaaagatgtattgcctt

SEQ ID NO: 915904 - DNA, 22 bp, Artificial Sequence
  chemically synthesized
agaataagtcaaggcaatacat

SEQ ID NO: 915905 - DNA, 22 bp, Artificial Sequence
  chemically synthesized
aatcaaaacaacaaagtactgt

SEQ ID NO: 915906 - DNA, 22 bp, Artificial Sequence
  chemically synthesized
caatcaaaacaacaaagtactg

SEQ ID NO: 915907 - DNA, 22 bp, Artificial Sequence
  chemically synthesized
cttcaatcaaaacaacaaagta

SEQ ID NO: 915908 - DNA, 22 bp, Artificial Sequence
  chemically synthesized
acttcaatcaaaacaacaaagt

SEQ ID NO: 915909 - DNA, 22 bp, Artificial Sequence
  chemically synthesized
tcccggacagtactttgttgtt

SEQ ID NO: 915910 - DNA, 22 bp, Artificial Sequence
  chemically synthesized
tacttcaatcaaaacaacaaag

SEQ ID NO: 915911 - DNA, 22 bp, Artificial Sequence
  chemically synthesized
cccggacagtactttgttgttt

SEQ ID NO: 915912 - DNA, 22 bp, Artificial Sequence
  chemically synthesized
ccggacagtactttgttgtttt

SEQ ID NO: 915913 - DNA, 22 bp, Artificial Sequence
  chemically synthesized
ttttacttcaatcaaaacaaca

SEQ ID NO: 915914 - DNA, 22 bp, Artificial Sequence
  chemically synthesized
attttacttcaatcaaaacaac

SEQ ID NO: 915915 - DNA, 22 bp, Artificial Sequence
  chemically synthesized
tgttgttttgattgaagtaaaa

SEQ ID NO: 915916 - DNA, 22 bp, Artificial Sequence
  chemically synthesized
gttgttttgattgaagtaaaat

SEQ ID NO: 915917 - DNA, 22 bp, Artificial Sequence
  chemically synthesized
ttgttttgattgaagtaaaata

SEQ ID NO: 915918 - DNA, 22 bp, Artificial Sequence
  chemically synthesized
caagatggtcatttattttact

SEQ ID NO: 915919 - DNA, 22 bp, Artificial Sequence
  chemically synthesized
ttttgattgaagtaaaataaat

SEQ ID NO: 915920 - DNA, 22 bp, Artificial Sequence
  chemically synthesized
tgattgaagtaaaataaatgac

SEQ ID NO: 915921 - DNA, 22 bp, Artificial Sequence
  chemically synthesized
gattgaagtaaaataaatgacc

SEQ ID NO: 915922 - DNA, 22 bp, Artificial Sequence
  chemically synthesized
aaattacaagatggtcatttat

SEQ ID NO: 915923 - DNA, 22 bp, Artificial Sequence
  chemically synthesized
attgaagtaaaataaatgacca

SEQ ID NO: 915924 - DNA, 22 bp, Artificial Sequence
  chemically synthesized
tcaaattacaagatggtcattt

SEQ ID NO: 915925 - DNA, 22 bp, Artificial Sequence
  chemically synthesized
ctcaaattacaagatggtcatt

SEQ ID NO: 915926 - DNA, 22 bp, Artificial Sequence
  chemically synthesized
aagtaaaataaatgaccatctt

SEQ ID NO: 915927 - DNA, 22 bp, Artificial Sequence
  chemically synthesized
aagtttctcaaattacaagatg

SEQ ID NO: 915928 - DNA, 22 bp, Artificial Sequence
  chemically synthesized
tgaagtttctcaaattacaaga

SEQ ID NO: 915929 - DNA, 22 bp, Artificial Sequence
  chemically synthesized
ctgaagtttctcaaattacaag

SEQ ID NO: 915930 - DNA, 22 bp, Artificial Sequence
  chemically synthesized
aatccttctgaagtttctcaaa

SEQ ID NO: 915931 - DNA, 22 bp, Artificial Sequence
  chemically synthesized
gaatccttctgaagtttctcaa

SEQ ID NO: 915932 - DNA, 22 bp, Artificial Sequence
  chemically synthesized
tacttgaatccttctgaagttt

SEQ ID NO: 915933 - DNA, 22 bp, Artificial Sequence
  chemically synthesized
atacttgaatccttctgaagtt

SEQ ID NO: 915934 - DNA, 22 bp, Artificial Sequence
  chemically synthesized
gtaatttgagaaacttcagaag

SEQ ID NO: 915935 - DNA, 22 bp, Artificial Sequence
  chemically synthesized
taatttgagaaacttcagaagg

SEQ ID NO: 915936 - DNA, 22 bp, Artificial Sequence
  chemically synthesized
gagaaacttcagaaggattcaa

SEQ ID NO: 915937 - DNA, 22 bp, Artificial Sequence
  chemically synthesized
agaaacttcagaaggattcaag

SEQ ID NO: 915938 - DNA, 22 bp, Artificial Sequence
  chemically synthesized
gggaagggtcaacttatacttg

SEQ ID NO: 915939 - DNA, 22 bp, Artificial Sequence
  chemically synthesized
cagaaggattcaagtataagtt

SEQ ID NO: 915940 - DNA, 22 bp, Artificial Sequence
  chemically synthesized
agaaggattcaagtataagttg

SEQ ID NO: 915941 - DNA, 22 bp, Artificial Sequence
  chemically synthesized
cctcgggaagggtcaacttata

SEQ ID NO: 915942 - DNA, 22 bp, Artificial Sequence
  chemically synthesized
ccctcgggaagggtcaacttat

SEQ ID NO: 915943 - DNA, 22 bp, Artificial Sequence
  chemically synthesized
tccctcgggaagggtcaactta

SEQ ID NO: 915944 - DNA, 22 bp, Artificial Sequence
  chemically synthesized
gttttccctcgggaagggtcaa

SEQ ID NO: 915945 - DNA, 22 bp, Artificial Sequence
  chemically synthesized
ggttttccctcgggaagggtca

SEQ ID NO: 915946 - DNA, 22 bp, Artificial Sequence
  chemically synthesized
tggttttccctcgggaagggtc

SEQ ID NO: 915947 - DNA, 22 bp, Artificial Sequence
  chemically synthesized
aagtataagttgacccttcccg

SEQ ID NO: 915948 - DNA, 22 bp, Artificial Sequence
  chemically synthesized
ttttggttttccctcgggaagg

SEQ ID NO: 915949 - DNA, 22 bp, Artificial Sequence
  chemically synthesized
gttttggttttccctcgggaag

SEQ ID NO: 915950 - DNA, 22 bp, Artificial Sequence
  chemically synthesized
tgttttggttttccctcgggaa

SEQ ID NO: 915951 - DNA, 22 bp, Artificial Sequence
  chemically synthesized
acccttcccgagggaaaaccaa

SEQ ID NO: 915952 - DNA, 22 bp, Artificial Sequence
  chemically synthesized
cccgagggaaaaccaaaacaaa

SEQ ID NO: 915953 - DNA, 22 bp, Artificial Sequence
  chemically synthesized
ccgagggaaaaccaaaacaaaa

SEQ ID NO: 915954 - DNA, 22 bp, Artificial Sequence
  chemically synthesized
ggtgtgtgtagaaatcaatgtt

SEQ ID NO: 915955 - DNA, 22 bp, Artificial Sequence
  chemically synthesized
ctaggtgtgtgtagaaatcaat

SEQ ID NO: 915956 - DNA, 22 bp, Artificial Sequence
  chemically synthesized
aggaggttactaggtgtgtgta

SEQ ID NO: 915957 - DNA, 22 bp, Artificial Sequence
  chemically synthesized
atttctacacacacctagtaac

SEQ ID NO: 915958 - DNA, 22 bp, Artificial Sequence
  chemically synthesized
ctacacacacctagtaacctcc

SEQ ID NO: 915959 - DNA, 22 bp, Artificial Sequence
  chemically synthesized
tacacacacctagtaacctcct

SEQ ID NO: 915960 - DNA, 22 bp, Artificial Sequence
  chemically synthesized
cacacacctagtaacctcctca

SEQ ID NO: 915961 - DNA, 22 bp, Artificial Sequence
  chemically synthesized
cggagggtatggcctgaggagg

SEQ ID NO: 915962 - DNA, 22 bp, Artificial Sequence
  chemically synthesized
gtaacctcctcaggccataccc

SEQ ID NO: 915963 - DNA, 22 bp, Artificial Sequence
  chemically synthesized
ataatgacctacggagggtatg

SEQ ID NO: 915964 - DNA, 22 bp, Artificial Sequence
  chemically synthesized
tgataatgacctacggagggta

SEQ ID NO: 915965 - DNA, 22 bp, Artificial Sequence
  chemically synthesized
ctcaggccataccctccgtagg

SEQ ID NO: 915966 - DNA, 22 bp, Artificial Sequence
  chemically synthesized
attctgataatgacctacggag

SEQ ID NO: 915967 - DNA, 22 bp, Artificial Sequence
  chemically synthesized
aggccataccctccgtaggtca

SEQ ID NO: 915968 - DNA, 22 bp, Artificial Sequence
  chemically synthesized
tgattctgataatgacctacgg

SEQ ID NO: 915969 - DNA, 22 bp, Artificial Sequence
  chemically synthesized
ggttctgattctgataatgacc

SEQ ID NO: 915970 - DNA, 22 bp, Artificial Sequence
  chemically synthesized
gggttctgattctgataatgac

SEQ ID NO: 915971 - DNA, 22 bp, Artificial Sequence
  chemically synthesized
atgcttgggttctgattctgat

SEQ ID NO: 915972 - DNA, 22 bp, Artificial Sequence
  chemically synthesized
cgtaggtcattatcagaatcag

SEQ ID NO: 915973 - DNA, 22 bp, Artificial Sequence
  chemically synthesized
aaaataaagttgatgcttgggt

SEQ ID NO: 915974 - DNA, 22 bp, Artificial Sequence
  chemically synthesized
tcagaatcagaacccaagcatc

SEQ ID NO: 915975 - DNA, 22 bp, Artificial Sequence
  chemically synthesized
aaaaataaagttgatgcttggg

SEQ ID NO: 915976 - DNA, 22 bp, Artificial Sequence
  chemically synthesized
gcttaaaaataaagttgatgct

SEQ ID NO: 915977 - DNA, 22 bp, Artificial Sequence
  chemically synthesized
tatttttaagccaacatgtcta

SEQ ID NO: 915978 - DNA, 22 bp, Artificial Sequence
  chemically synthesized
atttttaagccaacatgtctac

SEQ ID NO: 915979 - DNA, 22 bp, Artificial Sequence
  chemically synthesized
tttttaagccaacatgtctacc

SEQ ID NO: 915980 - DNA, 22 bp, Artificial Sequence
  chemically synthesized
ttaagccaacatgtctaccata

SEQ ID NO: 915981 - DNA, 22 bp, Artificial Sequence
  chemically synthesized
taagccaacatgtctaccatac

SEQ ID NO: 915982 - DNA, 22 bp, Artificial Sequence
  chemically synthesized
aagccaacatgtctaccatacc

SEQ ID NO: 915983 - DNA, 22 bp, Artificial Sequence
  chemically synthesized
aagcaccaaccaggtatggtag

SEQ ID NO: 915984 - DNA, 22 bp, Artificial Sequence
  chemically synthesized
agccaacatgtctaccatacct

SEQ ID NO: 915985 - DNA, 22 bp, Artificial Sequence
  chemically synthesized
tacaactcaagcaccaaccagg

SEQ ID NO: 915986 - DNA, 22 bp, Artificial Sequence
  chemically synthesized
gtacaactcaagcaccaaccag

SEQ ID NO: 915987 - DNA, 22 bp, Artificial Sequence
  chemically synthesized
cttgtacaactcaagcaccaac

SEQ ID NO: 915988 - DNA, 22 bp, Artificial Sequence
  chemically synthesized
ccatacctggttggtgcttgag

SEQ ID NO: 915989 - DNA, 22 bp, Artificial Sequence
  chemically synthesized
gttggtgcttgagttgtacaag

SEQ ID NO: 915990 - DNA, 22 bp, Artificial Sequence
  chemically synthesized
gtgcttgagttgtacaagtaga

SEQ ID NO: 915991 - DNA, 22 bp, Artificial Sequence
  chemically synthesized
gggaaaatgaacaaatgtctac

SEQ ID NO: 915992 - DNA, 22 bp, Artificial Sequence
  chemically synthesized
gagttgtacaagtagacatttg

SEQ ID NO: 915993 - DNA, 22 bp, Artificial Sequence
  chemically synthesized
agggaaaatgaacaaatgtcta

SEQ ID NO: 915994 - DNA, 22 bp, Artificial Sequence
  chemically synthesized
agttgtacaagtagacatttgt

SEQ ID NO: 915995 - DNA, 22 bp, Artificial Sequence
  chemically synthesized
tagggaaaatgaacaaatgtct

SEQ ID NO: 915996 - DNA, 22 bp, Artificial Sequence
  chemically synthesized
tacaagtagacatttgttcatt

SEQ ID NO: 915997 - DNA, 22 bp, Artificial Sequence
  chemically synthesized
cgacaagacacaaactttaggg

SEQ ID NO: 915998 - DNA, 22 bp, Artificial Sequence
  chemically synthesized
gttcattttccctaaagtttgt

SEQ ID NO: 915999 - DNA, 22 bp, Artificial Sequence
  chemically synthesized
ttcattttccctaaagtttgtg

SEQ ID NO: 916000 - DNA, 22 bp, Artificial Sequence
  chemically synthesized
attccgacaagacacaaacttt

SEQ ID NO: 916001 - DNA, 22 bp, Artificial Sequence
  chemically synthesized
cattccgacaagacacaaactt

SEQ ID NO: 916002 - DNA, 22 bp, Artificial Sequence
  chemically synthesized
attttccctaaagtttgtgtct

SEQ ID NO: 916003 - DNA, 22 bp, Artificial Sequence
  chemically synthesized
tccctaaagtttgtgtcttgtc

SEQ ID NO: 916004 - DNA, 22 bp, Artificial Sequence
  chemically synthesized
ccctaaagtttgtgtcttgtcg

SEQ ID NO: 916005 - DNA, 22 bp, Artificial Sequence
  chemically synthesized
cctaaagtttgtgtcttgtcgg

SEQ ID NO: 916006 - DNA, 22 bp, Artificial Sequence
  chemically synthesized
aggagcacttcattccgacaag

SEQ ID NO: 916007 - DNA, 22 bp, Artificial Sequence
  chemically synthesized
aagtttgtgtcttgtcggaatg

SEQ ID NO: 916008 - DNA, 22 bp, Artificial Sequence
  chemically synthesized
gtgtcttgtcggaatgaagtgc

SEQ ID NO: 916009 - DNA, 22 bp, Artificial Sequence
  chemically synthesized
tccccctcaggagcacttcatt

SEQ ID NO: 916010 - DNA, 22 bp, Artificial Sequence
  chemically synthesized
tgtcttgtcggaatgaagtgct

SEQ ID NO: 916011 - DNA, 22 bp, Artificial Sequence
  chemically synthesized
gtcggaatgaagtgctcctgag

SEQ ID NO: 916012 - DNA, 22 bp, Artificial Sequence
  chemically synthesized
tcggaatgaagtgctcctgagg

SEQ ID NO: 916013 - DNA, 22 bp, Artificial Sequence
  chemically synthesized
atatattatccccctcaggagc

SEQ ID NO: 916014 - DNA, 22 bp, Artificial Sequence
  chemically synthesized
gatatattatccccctcaggag

SEQ ID NO: 916015 - DNA, 22 bp, Artificial Sequence
  chemically synthesized
agaaatcttgatatattatccc

SEQ ID NO: 916016 - DNA, 22 bp, Artificial Sequence
  chemically synthesized
ctgagggggataatatatcaag

SEQ ID NO: 916017 - DNA, 22 bp, Artificial Sequence
  chemically synthesized
agggggataatatatcaagatt

SEQ ID NO: 916018 - DNA, 22 bp, Artificial Sequence
  chemically synthesized
atagtgaggcataaatgactga

SEQ ID NO: 916019 - DNA, 22 bp, Artificial Sequence
  chemically synthesized
aatagtgaggcataaatgactg

SEQ ID NO: 916020 - DNA, 22 bp, Artificial Sequence
  chemically synthesized
cttaatagtgaggcataaatga

SEQ ID NO: 916021 - DNA, 22 bp, Artificial Sequence
  chemically synthesized
ccttaatagtgaggcataaatg

SEQ ID NO: 916022 - DNA, 22 bp, Artificial Sequence
  chemically synthesized
ctcagtcatttatgcctcacta

SEQ ID NO: 916023 - DNA, 22 bp, Artificial Sequence
  chemically synthesized
tcagtcatttatgcctcactat

SEQ ID NO: 916024 - DNA, 22 bp, Artificial Sequence
  chemically synthesized
atcatttccttaatagtgaggc

SEQ ID NO: 916025 - DNA, 22 bp, Artificial Sequence
  chemically synthesized
agtcatttatgcctcactatta

SEQ ID NO: 916026 - DNA, 22 bp, Artificial Sequence
  chemically synthesized
ctaatcatttccttaatagtga

SEQ ID NO: 916027 - DNA, 22 bp, Artificial Sequence
  chemically synthesized
atgcctcactattaaggaaatg

SEQ ID NO: 916028 - DNA, 22 bp, Artificial Sequence
  chemically synthesized
tgcctcactattaaggaaatga

SEQ ID NO: 916029 - DNA, 22 bp, Artificial Sequence
  chemically synthesized
aaaagttgctaatcatttcctt

SEQ ID NO: 916030 - DNA, 22 bp, Artificial Sequence
  chemically synthesized
ctcaaaagttgctaatcatttc

SEQ ID NO: 916031 - DNA, 22 bp, Artificial Sequence
  chemically synthesized
actattaaggaaatgattagca

SEQ ID NO: 916032 - DNA, 22 bp, Artificial Sequence
  chemically synthesized
ttaaggaaatgattagcaactt

SEQ ID NO: 916033 - DNA, 22 bp, Artificial Sequence
  chemically synthesized
cacatctactcaaaagttgcta

SEQ ID NO: 916034 - DNA, 22 bp, Artificial Sequence
  chemically synthesized
ccacatctactcaaaagttgct

SEQ ID NO: 916035 - DNA, 22 bp, Artificial Sequence
  chemically synthesized
aggaaatgattagcaacttttg

SEQ ID NO: 916036 - DNA, 22 bp, Artificial Sequence
  chemically synthesized
tccacatctactcaaaagttgc

SEQ ID NO: 916037 - DNA, 22 bp, Artificial Sequence
  chemically synthesized
atcgttttccacatctactcaa

SEQ ID NO: 916038 - DNA, 22 bp, Artificial Sequence
  chemically synthesized
cctcatcgttttccacatctac

SEQ ID NO: 916039 - DNA, 22 bp, Artificial Sequence
  chemically synthesized
gcaacttttgagtagatgtgga

SEQ ID NO: 916040 - DNA, 22 bp, Artificial Sequence
  chemically synthesized
ccctcatcgttttccacatcta

SEQ ID NO: 916041 - DNA, 22 bp, Artificial Sequence
  chemically synthesized
tccctcatcgttttccacatct

SEQ ID NO: 916042 - DNA, 22 bp, Artificial Sequence
  chemically synthesized
ttccctcatcgttttccacatc

SEQ ID NO: 916043 - DNA, 22 bp, Artificial Sequence
  chemically synthesized
ttgagtagatgtggaaaacgat

SEQ ID NO: 916044 - DNA, 22 bp, Artificial Sequence
  chemically synthesized
tgagtagatgtggaaaacgatg

SEQ ID NO: 916045 - DNA, 22 bp, Artificial Sequence
  chemically synthesized
aggtttttccctcatcgttttc

SEQ ID NO: 916046 - DNA, 22 bp, Artificial Sequence
  chemically synthesized
gagtagatgtggaaaacgatga

SEQ ID NO: 916047 - DNA, 22 bp, Artificial Sequence
  chemically synthesized
caggtttttccctcatcgtttt

SEQ ID NO: 916048 - DNA, 22 bp, Artificial Sequence
  chemically synthesized
agtagatgtggaaaacgatgag

SEQ ID NO: 916049 - DNA, 22 bp, Artificial Sequence
  chemically synthesized
accttcaggtttttccctcatc

SEQ ID NO: 916050 - DNA, 22 bp, Artificial Sequence
  chemically synthesized
ctaaccttcaggtttttccctc

SEQ ID NO: 916051 - DNA, 22 bp, Artificial Sequence
  chemically synthesized
gcattgctaaccttcaggtttt

SEQ ID NO: 916052 - DNA, 22 bp, Artificial Sequence
  chemically synthesized
catacagatattcgcattgcta

SEQ ID NO: 916053 - DNA, 22 bp, Artificial Sequence
  chemically synthesized
ccatacagatattcgcattgct

SEQ ID NO: 916054 - DNA, 22 bp, Artificial Sequence
  chemically synthesized
tccatacagatattcgcattgc

SEQ ID NO: 916055 - DNA, 22 bp, Artificial Sequence
  chemically synthesized
ctttccatacagatattcgcat

SEQ ID NO: 916056 - DNA, 22 bp, Artificial Sequence
  chemically synthesized
actttccatacagatattcgca

SEQ ID NO: 916057 - DNA, 22 bp, Artificial Sequence
  chemically synthesized
aaggttagcaatgcgaatatct

SEQ ID NO: 916058 - DNA, 22 bp, Artificial Sequence
  chemically synthesized
gacttactttccatacagatat

SEQ ID NO: 916059 - DNA, 22 bp, Artificial Sequence
  chemically synthesized
ggacttactttccatacagata

SEQ ID NO: 916060 - DNA, 22 bp, Artificial Sequence
  chemically synthesized
gcaatgcgaatatctgtatgga

SEQ ID NO: 916061 - DNA, 22 bp, Artificial Sequence
  chemically synthesized
gatttggacttactttccatac

SEQ ID NO: 916062 - DNA, 22 bp, Artificial Sequence
  chemically synthesized
agatttggacttactttccata

SEQ ID NO: 916063 - DNA, 22 bp, Artificial Sequence
  chemically synthesized
gcagcatttagatttggactta

SEQ ID NO: 916064 - DNA, 22 bp, Artificial Sequence
  chemically synthesized
tatggaaagtaagtccaaatct

SEQ ID NO: 916065 - DNA, 22 bp, Artificial Sequence
  chemically synthesized
ataactggcagcatttagattt

SEQ ID NO: 916066 - DNA, 22 bp, Artificial Sequence
  chemically synthesized
agctgataactggcagcattta

SEQ ID NO: 916067 - DNA, 22 bp, Artificial Sequence
  chemically synthesized
acgtactcagctgataactggc

SEQ ID NO: 916068 - DNA, 22 bp, Artificial Sequence
  chemically synthesized
aatgctgccagttatcagctga

SEQ ID NO: 916069 - DNA, 22 bp, Artificial Sequence
  chemically synthesized
gcccgtgttcacgtactcagct

SEQ ID NO: 916070 - DNA, 22 bp, Artificial Sequence
  chemically synthesized
ccagttatcagctgagtacgtg

SEQ ID NO: 916071 - DNA, 22 bp, Artificial Sequence
  chemically synthesized
aggaactcgcccgtgttcacgt

SEQ ID NO: 916072 - DNA, 22 bp, Artificial Sequence
  chemically synthesized
tcagctgagtacgtgaacacgg

SEQ ID NO: 916073 - DNA, 22 bp, Artificial Sequence
  chemically synthesized
agtacgtgaacacgggcgagtt

SEQ ID NO: 916074 - DNA, 22 bp, Artificial Sequence
  chemically synthesized
aagagattaaggaactcgcccg

SEQ ID NO: 916075 - DNA, 22 bp, Artificial Sequence
  chemically synthesized
agggctaaagagattaaggaac

SEQ ID NO: 916076 - DNA, 22 bp, Artificial Sequence
  chemically synthesized
agacgaggaaactgagggctaa

SEQ ID NO: 916077 - DNA, 22 bp, Artificial Sequence
  chemically synthesized
aagacgaggaaactgagggcta

SEQ ID NO: 916078 - DNA, 22 bp, Artificial Sequence
  chemically synthesized
cttaatctctttagccctcagt

SEQ ID NO: 916079 - DNA, 22 bp, Artificial Sequence
  chemically synthesized
taagacgaggaaactgagggct

SEQ ID NO: 916080 - DNA, 22 bp, Artificial Sequence
  chemically synthesized
aatctctttagccctcagtttc

SEQ ID NO: 916081 - DNA, 22 bp, Artificial Sequence
  chemically synthesized
atctctttagccctcagtttcc

SEQ ID NO: 916082 - DNA, 22 bp, Artificial Sequence
  chemically synthesized
attttaagacgaggaaactgag

SEQ ID NO: 916083 - DNA, 22 bp, Artificial Sequence
  chemically synthesized
taattttaagacgaggaaactg

SEQ ID NO: 916084 - DNA, 22 bp, Artificial Sequence
  chemically synthesized
tttagccctcagtttcctcgtc

SEQ ID NO: 916085 - DNA, 22 bp, Artificial Sequence
  chemically synthesized
ttctaattttaagacgaggaaa

SEQ ID NO: 916086 - DNA, 22 bp, Artificial Sequence
  chemically synthesized
tagccctcagtttcctcgtctt

SEQ ID NO: 916087 - DNA, 22 bp, Artificial Sequence
  chemically synthesized
agccctcagtttcctcgtctta

SEQ ID NO: 916088 - DNA, 22 bp, Artificial Sequence
  chemically synthesized
ttgttctaattttaagacgagg

SEQ ID NO: 916089 - DNA, 22 bp, Artificial Sequence
  chemically synthesized
gccctcagtttcctcgtcttaa

SEQ ID NO: 916090 - DNA, 22 bp, Artificial Sequence
  chemically synthesized
attgttctaattttaagacgag

SEQ ID NO: 916091 - DNA, 22 bp, Artificial Sequence
  chemically synthesized
agtttcctcgtcttaaaattag

SEQ ID NO: 916092 - DNA, 22 bp, Artificial Sequence
  chemically synthesized
aaatgtttattgttctaatttt

SEQ ID NO: 916093 - DNA, 22 bp, Artificial Sequence
  chemically synthesized
taaaatgtttattgttctaatt

SEQ ID NO: 916094 - DNA, 22 bp, Artificial Sequence
  chemically synthesized
cctcgtcttaaaattagaacaa

SEQ ID NO: 916095 - DNA, 22 bp, Artificial Sequence
  chemically synthesized
ctcgtcttaaaattagaacaat

SEQ ID NO: 916096 - DNA, 22 bp, Artificial Sequence
  chemically synthesized
gtcttaaaattagaacaataaa

SEQ ID NO: 916097 - DNA, 22 bp, Artificial Sequence
  chemically synthesized
acaacactctaaaatgtttatt

SEQ ID NO: 916098 - DNA, 22 bp, Artificial Sequence
  chemically synthesized
aaaattagaacaataaacattt

SEQ ID NO: 916099 - DNA, 22 bp, Artificial Sequence
  chemically synthesized
aaattagaacaataaacatttt

SEQ ID NO: 916100 - DNA, 22 bp, Artificial Sequence
  chemically synthesized
atcctcacaacactctaaaatg

SEQ ID NO: 916101 - DNA, 22 bp, Artificial Sequence
  chemically synthesized
aatcctcacaacactctaaaat

SEQ ID NO: 916102 - DNA, 22 bp, Artificial Sequence
  chemically synthesized
gaacaataaacattttagagtg

SEQ ID NO: 916103 - DNA, 22 bp, Artificial Sequence
  chemically synthesized
taatcctcacaacactctaaaa

SEQ ID NO: 916104 - DNA, 22 bp, Artificial Sequence
  chemically synthesized
caaaaaaaactttaatcctcac

SEQ ID NO: 916105 - DNA, 22 bp, Artificial Sequence
  chemically synthesized
tgcaaaaaaaactttaatcctc

SEQ ID NO: 916106 - DNA, 22 bp, Artificial Sequence
  chemically synthesized
tagagtgttgtgaggattaaag

SEQ ID NO: 916107 - DNA, 22 bp, Artificial Sequence
  chemically synthesized
ctgcaaaaaaaactttaatcct

SEQ ID NO: 916108 - DNA, 22 bp, Artificial Sequence
  chemically synthesized
agagtgttgtgaggattaaagt

SEQ ID NO: 916109 - DNA, 22 bp, Artificial Sequence
  chemically synthesized
gagtgttgtgaggattaaagtt

SEQ ID NO: 916110 - DNA, 22 bp, Artificial Sequence
  chemically synthesized
ggtttctgcaaaaaaaacttta

SEQ ID NO: 916111 - DNA, 22 bp, Artificial Sequence
  chemically synthesized
gggtttctgcaaaaaaaacttt

SEQ ID NO: 916112 - DNA, 22 bp, Artificial Sequence
  chemically synthesized
tgaggattaaagttttttttgc

SEQ ID NO: 916113 - DNA, 22 bp, Artificial Sequence
  chemically synthesized
aatcttgggtttctgcaaaaaa

SEQ ID NO: 916114 - DNA, 22 bp, Artificial Sequence
  chemically synthesized
ggctaaatcttgggtttctgca

SEQ ID NO: 916115 - DNA, 22 bp, Artificial Sequence
  chemically synthesized
aagttttttttgcagaaaccca

SEQ ID NO: 916116 - DNA, 22 bp, Artificial Sequence
  chemically synthesized
tttttgcagaaacccaagattt

SEQ ID NO: 916117 - DNA, 22 bp, Artificial Sequence
  chemically synthesized
ttttgcagaaacccaagattta

SEQ ID NO: 916118 - DNA, 22 bp, Artificial Sequence
  chemically synthesized
tttgcagaaacccaagatttag

SEQ ID NO: 916119 - DNA, 22 bp, Artificial Sequence
  chemically synthesized
ttgcagaaacccaagatttagc

SEQ ID NO: 916120 - DNA, 22 bp, Artificial Sequence
  chemically synthesized
gtgaagcactaggctaaatctt

SEQ ID NO: 916121 - DNA, 22 bp, Artificial Sequence
  chemically synthesized
tgcagaaacccaagatttagcc

SEQ ID NO: 916122 - DNA, 22 bp, Artificial Sequence
  chemically synthesized
gcagaaacccaagatttagcct

SEQ ID NO: 916123 - DNA, 22 bp, Artificial Sequence
  chemically synthesized
cagaaacccaagatttagccta

SEQ ID NO: 916124 - DNA, 22 bp, Artificial Sequence
  chemically synthesized
ttagtgaagcactaggctaaat

SEQ ID NO: 916125 - DNA, 22 bp, Artificial Sequence
  chemically synthesized
agtgctgttagtgaagcactag

SEQ ID NO: 916126 - DNA, 22 bp, Artificial Sequence
  chemically synthesized
gagtgctgttagtgaagcacta

SEQ ID NO: 916127 - DNA, 22 bp, Artificial Sequence
  chemically synthesized
tgagtgctgttagtgaagcact

SEQ ID NO: 916128 - DNA, 22 bp, Artificial Sequence
  chemically synthesized
ttgagtgctgttagtgaagcac

SEQ ID NO: 916129 - DNA, 22 bp, Artificial Sequence
  chemically synthesized
tttgagtgctgttagtgaagca

SEQ ID NO: 916130 - DNA, 22 bp, Artificial Sequence
  chemically synthesized
ttttgagtgctgttagtgaagc

SEQ ID NO: 916131 - DNA, 22 bp, Artificial Sequence
  chemically synthesized
tttttgagtgctgttagtgaag

SEQ ID NO: 916132 - DNA, 22 bp, Artificial Sequence
  chemically synthesized
agcctagtgcttcactaacagc

SEQ ID NO: 916133 - DNA, 22 bp, Artificial Sequence
  chemically synthesized
gcctagtgcttcactaacagca

SEQ ID NO: 916134 - DNA, 22 bp, Artificial Sequence
  chemically synthesized
ccattttttttgagtgctgtta

SEQ ID NO: 916135 - DNA, 22 bp, Artificial Sequence
  chemically synthesized
taccattttttttgagtgctgt

SEQ ID NO: 916136 - DNA, 22 bp, Artificial Sequence
  chemically synthesized
gtgcttcactaacagcactcaa

SEQ ID NO: 916137 - DNA, 22 bp, Artificial Sequence
  chemically synthesized
tctaccattttttttgagtgct

SEQ ID NO: 916138 - DNA, 22 bp, Artificial Sequence
  chemically synthesized
cactaacagcactcaaaaaaaa

SEQ ID NO: 916139 - DNA, 22 bp, Artificial Sequence
  chemically synthesized
tgttctctaccattttttttga

SEQ ID NO: 916140 - DNA, 22 bp, Artificial Sequence
  chemically synthesized
actaacagcactcaaaaaaaat

SEQ ID NO: 916141 - DNA, 22 bp, Artificial Sequence
  chemically synthesized
atgttctctaccattttttttg

SEQ ID NO: 916142 - DNA, 22 bp, Artificial Sequence
  chemically synthesized
tatgttctctaccatttttttt

SEQ ID NO: 916143 - DNA, 22 bp, Artificial Sequence
  chemically synthesized
ttatgttctctaccattttttt

SEQ ID NO: 916144 - DNA, 22 bp, Artificial Sequence
  chemically synthesized
acagcactcaaaaaaaatggta

SEQ ID NO: 916145 - DNA, 22 bp, Artificial Sequence
  chemically synthesized
cttttatgttctctaccatttt

SEQ ID NO: 916146 - DNA, 22 bp, Artificial Sequence
  chemically synthesized
tacctccttttatgttctctac

SEQ ID NO: 916147 - DNA, 22 bp, Artificial Sequence
  chemically synthesized
gtacctccttttatgttctcta

SEQ ID NO: 916148 - DNA, 22 bp, Artificial Sequence
  chemically synthesized
aaaaaaaatggtagagaacata

SEQ ID NO: 916149 - DNA, 22 bp, Artificial Sequence
  chemically synthesized
tgtacctccttttatgttctct

SEQ ID NO: 916150 - DNA, 22 bp, Artificial Sequence
  chemically synthesized
ttgtacctccttttatgttctc

SEQ ID NO: 916151 - DNA, 22 bp, Artificial Sequence
  chemically synthesized
tttgtacctccttttatgttct

SEQ ID NO: 916152 - DNA, 22 bp, Artificial Sequence
  chemically synthesized
ttttgtacctccttttatgttc

SEQ ID NO: 916153 - DNA, 22 bp, Artificial Sequence
  chemically synthesized
ccttttttgtacctccttttat

SEQ ID NO: 916154 - DNA, 22 bp, Artificial Sequence
  chemically synthesized
cccttttttgtacctcctttta

SEQ ID NO: 916155 - DNA, 22 bp, Artificial Sequence
  chemically synthesized
tcccttttttgtacctcctttt

SEQ ID NO: 916156 - DNA, 22 bp, Artificial Sequence
  chemically synthesized
tatccatattttcccttttttg

SEQ ID NO: 916157 - DNA, 22 bp, Artificial Sequence
  chemically synthesized
tgtatccatattttcccttttt

SEQ ID NO: 916158 - DNA, 22 bp, Artificial Sequence
  chemically synthesized
aaacagaaagctctgtatccat

SEQ ID NO: 916159 - DNA, 22 bp, Artificial Sequence
  chemically synthesized
ggattaaaacagaaagctctgt

SEQ ID NO: 916160 - DNA, 22 bp, Artificial Sequence
  chemically synthesized
taggattaaaacagaaagctct

SEQ ID NO: 916161 - DNA, 22 bp, Artificial Sequence
  chemically synthesized
gacacaattctaggattaaaac

SEQ ID NO: 916162 - DNA, 22 bp, Artificial Sequence
  chemically synthesized
agacacaattctaggattaaaa

SEQ ID NO: 916163 - DNA, 22 bp, Artificial Sequence
  chemically synthesized
tctgttttaatcctagaattgt

SEQ ID NO: 916164 - DNA, 22 bp, Artificial Sequence
  chemically synthesized
ctgttttaatcctagaattgtg

SEQ ID NO: 916165 - DNA, 22 bp, Artificial Sequence
  chemically synthesized
tgttttaatcctagaattgtgt

SEQ ID NO: 916166 - DNA, 22 bp, Artificial Sequence
  chemically synthesized
ttttaatcctagaattgtgtct

SEQ ID NO: 916167 - DNA, 22 bp, Artificial Sequence
  chemically synthesized
taatcctagaattgtgtctaag

SEQ ID NO: 916168 - DNA, 22 bp, Artificial Sequence
  chemically synthesized
aatcctagaattgtgtctaagc

SEQ ID NO: 916169 - DNA, 22 bp, Artificial Sequence
  chemically synthesized
atcctagaattgtgtctaagcc

SEQ ID NO: 916170 - DNA, 22 bp, Artificial Sequence
  chemically synthesized
tgtaagcacgtgggcttagaca

SEQ ID NO: 916171 - DNA, 22 bp, Artificial Sequence
  chemically synthesized
tctatgtaagcacgtgggctta

SEQ ID NO: 916172 - DNA, 22 bp, Artificial Sequence
  chemically synthesized
atctatgtaagcacgtgggctt

SEQ ID NO: 916173 - DNA, 22 bp, Artificial Sequence
  chemically synthesized
gaattgtgtctaagcccacgtg

SEQ ID NO: 916174 - DNA, 22 bp, Artificial Sequence
  chemically synthesized
tatctatgtaagcacgtgggct

SEQ ID NO: 916175 - DNA, 22 bp, Artificial Sequence
  chemically synthesized
ttatctatgtaagcacgtgggc

SEQ ID NO: 916176 - DNA, 22 bp, Artificial Sequence
  chemically synthesized
tgtctaagcccacgtgcttaca

SEQ ID NO: 916177 - DNA, 22 bp, Artificial Sequence
  chemically synthesized
taaatacttttatctatgtaag

SEQ ID NO: 916178 - DNA, 22 bp, Artificial Sequence
  chemically synthesized
ataaatacttttatctatgtaa

SEQ ID NO: 916179 - DNA, 22 bp, Artificial Sequence
  chemically synthesized
agcccacgtgcttacatagata

SEQ ID NO: 916180 - DNA, 22 bp, Artificial Sequence
  chemically synthesized
tataaatacttttatctatgta

SEQ ID NO: 916181 - DNA, 22 bp, Artificial Sequence
  chemically synthesized
ataatgttttataaatactttt

SEQ ID NO: 916182 - DNA, 22 bp, Artificial Sequence
  chemically synthesized
acatagataaaagtatttataa

SEQ ID NO: 916183 - DNA, 22 bp, Artificial Sequence
  chemically synthesized
catagataaaagtatttataaa

SEQ ID NO: 916184 - DNA, 22 bp, Artificial Sequence
  chemically synthesized
tgtactcataatgttttataaa

SEQ ID NO: 916185 - DNA, 22 bp, Artificial Sequence
  chemically synthesized
ctgtgtactcataatgttttat

SEQ ID NO: 916186 - DNA, 22 bp, Artificial Sequence
  chemically synthesized
ctcctgtgtactcataatgttt

SEQ ID NO: 916187 - DNA, 22 bp, Artificial Sequence
  chemically synthesized
agtactcctcctgtgtactcat

SEQ ID NO: 916188 - DNA, 22 bp, Artificial Sequence
  chemically synthesized
gagtactcctcctgtgtactca

SEQ ID NO: 916189 - DNA, 22 bp, Artificial Sequence
  chemically synthesized
ataaaacattatgagtacacag

SEQ ID NO: 916190 - DNA, 22 bp, Artificial Sequence
  chemically synthesized
tgagtactcctcctgtgtactc

SEQ ID NO: 916191 - DNA, 22 bp, Artificial Sequence
  chemically synthesized
taaaacattatgagtacacagg

SEQ ID NO: 916192 - DNA, 22 bp, Artificial Sequence
  chemically synthesized
aattttgagtactcctcctgtg

SEQ ID NO: 916193 - DNA, 22 bp, Artificial Sequence
  chemically synthesized
tgagtacacaggaggagtactc

SEQ ID NO: 916194 - DNA, 22 bp, Artificial Sequence
  chemically synthesized
atcaaaagttcaattttgagta

SEQ ID NO: 916195 - DNA, 22 bp, Artificial Sequence
  chemically synthesized
tcaggtggctcatcaaaagttc

SEQ ID NO: 916196 - DNA, 22 bp, Artificial Sequence
  chemically synthesized
aaaattgaacttttgatgagcc

SEQ ID NO: 916197 - DNA, 22 bp, Artificial Sequence
  chemically synthesized
aacttttgatgagccacctgac

SEQ ID NO: 916198 - DNA, 22 bp, Artificial Sequence
  chemically synthesized
ttgatgagccacctgacaactt

SEQ ID NO: 916199 - DNA, 22 bp, Artificial Sequence
  chemically synthesized
tgatgagccacctgacaacttt

SEQ ID NO: 916200 - DNA, 22 bp, Artificial Sequence
  chemically synthesized
gatgagccacctgacaacttta

SEQ ID NO: 916201 - DNA, 22 bp, Artificial Sequence
  chemically synthesized
atgagccacctgacaactttat

SEQ ID NO: 916202 - DNA, 22 bp, Artificial Sequence
  chemically synthesized
tcagtagggagaaataaagttg

SEQ ID NO: 916203 - DNA, 22 bp, Artificial Sequence
  chemically synthesized
gtcagtagggagaaataaagtt

SEQ ID NO: 916204 - DNA, 22 bp, Artificial Sequence
  chemically synthesized
acaactttatttctccctactg

SEQ ID NO: 916205 - DNA, 22 bp, Artificial Sequence
  chemically synthesized
tcaaggtagtttgtcagtaggg

SEQ ID NO: 916206 - DNA, 22 bp, Artificial Sequence
  chemically synthesized
gtcaaggtagtttgtcagtagg

SEQ ID NO: 916207 - DNA, 22 bp, Artificial Sequence
  chemically synthesized
tatttctccctactgacaaact

SEQ ID NO: 916208 - DNA, 22 bp, Artificial Sequence
  chemically synthesized
atttctccctactgacaaacta

SEQ ID NO: 916209 - DNA, 22 bp, Artificial Sequence
  chemically synthesized
tttctccctactgacaaactac

SEQ ID NO: 916210 - DNA, 22 bp, Artificial Sequence
  chemically synthesized
ctccctactgacaaactacctt

SEQ ID NO: 916211 - DNA, 22 bp, Artificial Sequence
  chemically synthesized
tccctactgacaaactaccttg

SEQ ID NO: 916212 - DNA, 22 bp, Artificial Sequence
  chemically synthesized
cctactgacaaactaccttgac

SEQ ID NO: 916213 - DNA, 22 bp, Artificial Sequence
  chemically synthesized
cccagcaaaatttgtcaaggta

SEQ ID NO: 916214 - DNA, 22 bp, Artificial Sequence
  chemically synthesized
ccccagcaaaatttgtcaaggt

SEQ ID NO: 916215 - DNA, 22 bp, Artificial Sequence
  chemically synthesized
tccccagcaaaatttgtcaagg

SEQ ID NO: 916216 - DNA, 22 bp, Artificial Sequence
  chemically synthesized
ctgacaaactaccttgacaaat

SEQ ID NO: 916217 - DNA, 22 bp, Artificial Sequence
  chemically synthesized
ttccccagcaaaatttgtcaag

SEQ ID NO: 916218 - DNA, 22 bp, Artificial Sequence
  chemically synthesized
tttccccagcaaaatttgtcaa

SEQ ID NO: 916219 - DNA, 22 bp, Artificial Sequence
  chemically synthesized
acaaactaccttgacaaatttt

SEQ ID NO: 916220 - DNA, 22 bp, Artificial Sequence
  chemically synthesized
ttttttccccagcaaaatttgt

SEQ ID NO: 916221 - DNA, 22 bp, Artificial Sequence
  chemically synthesized
ttgttttttccccagcaaaatt

SEQ ID NO: 916222 - DNA, 22 bp, Artificial Sequence
  chemically synthesized
tattgttttttccccagcaaaa

SEQ ID NO: 916223 - DNA, 22 bp, Artificial Sequence
  chemically synthesized
ccttgacaaattttgctgggga

SEQ ID NO: 916224 - DNA, 22 bp, Artificial Sequence
  chemically synthesized
tctattgttttttccccagcaa

SEQ ID NO: 916225 - DNA, 22 bp, Artificial Sequence
  chemically synthesized
gacaaattttgctggggaaaaa

SEQ ID NO: 916226 - DNA, 22 bp, Artificial Sequence
  chemically synthesized
attctctattgttttttcccca

SEQ ID NO: 916227 - DNA, 22 bp, Artificial Sequence
  chemically synthesized
acaaattttgctggggaaaaaa

SEQ ID NO: 916228 - DNA, 22 bp, Artificial Sequence
  chemically synthesized
acattaattctctattgttttt

SEQ ID NO: 916229 - DNA, 22 bp, Artificial Sequence
  chemically synthesized
tgctggggaaaaaacaatagag

SEQ ID NO: 916230 - DNA, 22 bp, Artificial Sequence
  chemically synthesized
gctggggaaaaaacaatagaga

SEQ ID NO: 916231 - DNA, 22 bp, Artificial Sequence
  chemically synthesized
ctggggaaaaaacaatagagaa

SEQ ID NO: 916232 - DNA, 22 bp, Artificial Sequence
  chemically synthesized
gggaaaaaacaatagagaatta

SEQ ID NO: 916233 - DNA, 22 bp, Artificial Sequence
  chemically synthesized
atagattgacattaattctcta

SEQ ID NO: 916234 - DNA, 22 bp, Artificial Sequence
  chemically synthesized
ctcatagattgacattaattct

SEQ ID NO: 916235 - DNA, 22 bp, Artificial Sequence
  chemically synthesized
actcatagattgacattaattc

SEQ ID NO: 916236 - DNA, 22 bp, Artificial Sequence
  chemically synthesized
gtggcacatttactcatagatt

SEQ ID NO: 916237 - DNA, 22 bp, Artificial Sequence
  chemically synthesized
atctggtggcacatttactcat

SEQ ID NO: 916238 - DNA, 22 bp, Artificial Sequence
  chemically synthesized
atgtcaatctatgagtaaatgt

SEQ ID NO: 916239 - DNA, 22 bp, Artificial Sequence
  chemically synthesized
gaagtagtctcatctggtggca

SEQ ID NO: 916240 - DNA, 22 bp, Artificial Sequence
  chemically synthesized
tgagtaaatgtgccaccagatg

SEQ ID NO: 916241 - DNA, 22 bp, Artificial Sequence
  chemically synthesized
acctagaagtagtctcatctgg

SEQ ID NO: 916242 - DNA, 22 bp, Artificial Sequence
  chemically synthesized
cacctagaagtagtctcatctg

SEQ ID NO: 916243 - DNA, 22 bp, Artificial Sequence
  chemically synthesized
catatatgcttcacctagaagt

SEQ ID NO: 916244 - DNA, 22 bp, Artificial Sequence
  chemically synthesized
tgattacatatatgcttcacct

SEQ ID NO: 916245 - DNA, 22 bp, Artificial Sequence
  chemically synthesized
cattgtgattacatatatgctt

SEQ ID NO: 916246 - DNA, 22 bp, Artificial Sequence
  chemically synthesized
cttctaggtgaagcatatatgt

SEQ ID NO: 916247 - DNA, 22 bp, Artificial Sequence
  chemically synthesized
ttgcattgtgattacatatatg

SEQ ID NO: 916248 - DNA, 22 bp, Artificial Sequence
  chemically synthesized
ctaggtgaagcatatatgtaat

SEQ ID NO: 916249 - DNA, 22 bp, Artificial Sequence
  chemically synthesized
taggtgaagcatatatgtaatc

SEQ ID NO: 916250 - DNA, 22 bp, Artificial Sequence
  chemically synthesized
ggtgaagcatatatgtaatcac

SEQ ID NO: 916251 - DNA, 22 bp, Artificial Sequence
  chemically synthesized
aataaatggctgttgcattgtg

SEQ ID NO: 916252 - DNA, 22 bp, Artificial Sequence
  chemically synthesized
gtagaccctcaataaatggctg

SEQ ID NO: 916253 - DNA, 22 bp, Artificial Sequence
  chemically synthesized
attgagggtctactagtgtcca

SEQ ID NO: 916254 - DNA, 22 bp, Artificial Sequence
  chemically synthesized
ttgagggtctactagtgtccat

SEQ ID NO: 916255 - DNA, 22 bp, Artificial Sequence
  chemically synthesized
acggccatatcaatggacacta

SEQ ID NO: 916256 - DNA, 22 bp, Artificial Sequence
  chemically synthesized
agggtctactagtgtccattga

SEQ ID NO: 916257 - DNA, 22 bp, Artificial Sequence
  chemically synthesized
ccgatattcacggccatatcaa

SEQ ID NO: 916258 - DNA, 22 bp, Artificial Sequence
  chemically synthesized
ctagtgtccattgatatggccg

SEQ ID NO: 916259 - DNA, 22 bp, Artificial Sequence
  chemically synthesized
ctgccgatattcacggccatat

SEQ ID NO: 916260 - DNA, 22 bp, Artificial Sequence
  chemically synthesized
gtgtccattgatatggccgtga

SEQ ID NO: 916261 - DNA, 22 bp, Artificial Sequence
  chemically synthesized
atatggccgtgaatatcggcag

SEQ ID NO: 916262 - DNA, 22 bp, Artificial Sequence
  chemically synthesized
ccaatcggatgtaaggtccatg

SEQ ID NO: 916263 - DNA, 22 bp, Artificial Sequence
  chemically synthesized
ctcccaatcggatgtaaggtcc

SEQ ID NO: 916264 - DNA, 22 bp, Artificial Sequence
  chemically synthesized
cctcccaatcggatgtaaggtc

SEQ ID NO: 916265 - DNA, 22 bp, Artificial Sequence
  chemically synthesized
cctcatggaccttacatccgat

SEQ ID NO: 916266 - DNA, 22 bp, Artificial Sequence
  chemically synthesized
cccttcctcccaatcggatgta

SEQ ID NO: 916267 - DNA, 22 bp, Artificial Sequence
  chemically synthesized
atggaccttacatccgattggg

SEQ ID NO: 916268 - DNA, 22 bp, Artificial Sequence
  chemically synthesized
cctccccttcctcccaatcgga

SEQ ID NO: 916269 - DNA, 22 bp, Artificial Sequence
  chemically synthesized
tctgcctccccttcctcccaat

SEQ ID NO: 916270 - DNA, 22 bp, Artificial Sequence
  chemically synthesized
ctgtctgcctccccttcctccc

SEQ ID NO: 916271 - DNA, 22 bp, Artificial Sequence
  chemically synthesized
actgtctgcctccccttcctcc

SEQ ID NO: 916272 - DNA, 22 bp, Artificial Sequence
  chemically synthesized
acatccgattgggaggaagggg

SEQ ID NO: 916273 - DNA, 22 bp, Artificial Sequence
  chemically synthesized
catccgattgggaggaagggga

SEQ ID NO: 916274 - DNA, 22 bp, Artificial Sequence
  chemically synthesized
tttactgtctgcctccccttcc

SEQ ID NO: 916275 - DNA, 22 bp, Artificial Sequence
  chemically synthesized
gtttactgtctgcctccccttc

SEQ ID NO: 916276 - DNA, 22 bp, Artificial Sequence
  chemically synthesized
tcttgtttactgtctgcctccc

SEQ ID NO: 916277 - DNA, 22 bp, Artificial Sequence
  chemically synthesized
atcttgtttactgtctgcctcc

SEQ ID NO: 916278 - DNA, 22 bp, Artificial Sequence
  chemically synthesized
tatcttgtttactgtctgcctc

SEQ ID NO: 916279 - DNA, 22 bp, Artificial Sequence
  chemically synthesized
ggaggaaggggaggcagacagt

SEQ ID NO: 916280 - DNA, 22 bp, Artificial Sequence
  chemically synthesized
tttatcttgtttactgtctgcc

SEQ ID NO: 916281 - DNA, 22 bp, Artificial Sequence
  chemically synthesized
ctttatcttgtttactgtctgc

SEQ ID NO: 916282 - DNA, 22 bp, Artificial Sequence
  chemically synthesized
tttctttatcttgtttactgtc

SEQ ID NO: 916283 - DNA, 22 bp, Artificial Sequence
  chemically synthesized
atttctttatcttgtttactgt

SEQ ID NO: 916284 - DNA, 22 bp, Artificial Sequence
  chemically synthesized
tatttctttatcttgtttactg

SEQ ID NO: 916285 - DNA, 22 bp, Artificial Sequence
  chemically synthesized
tagattttatttctttatcttg

SEQ ID NO: 916286 - DNA, 22 bp, Artificial Sequence
  chemically synthesized
tatcacaatctatagattttat

SEQ ID NO: 916287 - DNA, 22 bp, Artificial Sequence
  chemically synthesized
ctgtatcacaatctatagattt

SEQ ID NO: 916288 - DNA, 22 bp, Artificial Sequence
  chemically synthesized
actgtatcacaatctatagatt

SEQ ID NO: 916289 - DNA, 22 bp, Artificial Sequence
  chemically synthesized
taacacttactgtatcacaatc

SEQ ID NO: 916290 - DNA, 22 bp, Artificial Sequence
  chemically synthesized
tgtaacacttactgtatcacaa

SEQ ID NO: 916291 - DNA, 22 bp, Artificial Sequence
  chemically synthesized
ctctgtaacacttactgtatca

SEQ ID NO: 916292 - DNA, 22 bp, Artificial Sequence
  chemically synthesized
cctctgtaacacttactgtatc

SEQ ID NO: 916293 - DNA, 22 bp, Artificial Sequence
  chemically synthesized
tcctctgtaacacttactgtat

SEQ ID NO: 916294 - DNA, 22 bp, Artificial Sequence
  chemically synthesized
ttcctctgtaacacttactgta

SEQ ID NO: 916295 - DNA, 22 bp, Artificial Sequence
  chemically synthesized
tttcctctgtaacacttactgt

SEQ ID NO: 916296 - DNA, 22 bp, Artificial Sequence
  chemically synthesized
tagattgtgatacagtaagtgt

SEQ ID NO: 916297 - DNA, 22 bp, Artificial Sequence
  chemically synthesized
ttttcctctgtaacacttactg

SEQ ID NO: 916298 - DNA, 22 bp, Artificial Sequence
  chemically synthesized
atttttttcctctgtaacactt

SEQ ID NO: 916299 - DNA, 22 bp, Artificial Sequence
  chemically synthesized
catttttttcctctgtaacact

SEQ ID NO: 916300 - DNA, 22 bp, Artificial Sequence
  chemically synthesized
tgatacagtaagtgttacagag

SEQ ID NO: 916301 - DNA, 22 bp, Artificial Sequence
  chemically synthesized
catgcttcatttttttcctctg

SEQ ID NO: 916302 - DNA, 22 bp, Artificial Sequence
  chemically synthesized
ccatgcttcatttttttcctct

SEQ ID NO: 916303 - DNA, 22 bp, Artificial Sequence
  chemically synthesized
tccatgcttcatttttttcctc

SEQ ID NO: 916304 - DNA, 22 bp, Artificial Sequence
  chemically synthesized
ttccatgcttcatttttttcct

SEQ ID NO: 916305 - DNA, 22 bp, Artificial Sequence
  chemically synthesized
catcccttttccatgcttcatt

SEQ ID NO: 916306 - DNA, 22 bp, Artificial Sequence
  chemically synthesized
cagaggaaaaaaatgaagcatg

SEQ ID NO: 916307 - DNA, 22 bp, Artificial Sequence
  chemically synthesized
ccatcccttttccatgcttcat

SEQ ID NO: 916308 - DNA, 22 bp, Artificial Sequence
  chemically synthesized
aatatttccatcccttttccat

SEQ ID NO: 916309 - DNA, 22 bp, Artificial Sequence
  chemically synthesized
ccctcaatatttccatcccttt

SEQ ID NO: 916310 - DNA, 22 bp, Artificial Sequence
  chemically synthesized
cccctcaatatttccatccctt

SEQ ID NO: 916311 - DNA, 22 bp, Artificial Sequence
  chemically synthesized
cccatcttcccctcaatatttc

SEQ ID NO: 916312 - DNA, 22 bp, Artificial Sequence
  chemically synthesized
ctccccatcttcccctcaatat

SEQ ID NO: 916313 - DNA, 22 bp, Artificial Sequence
  chemically synthesized
taaaatcacaactgctccccat

SEQ ID NO: 916314 - DNA, 22 bp, Artificial Sequence
  chemically synthesized
ataaaatcacaactgctcccca

SEQ ID NO: 916315 - DNA, 22 bp, Artificial Sequence
  chemically synthesized
tataaaatcacaactgctcccc

SEQ ID NO: 916316 - DNA, 22 bp, Artificial Sequence
  chemically synthesized
aggggaagatggggagcagttg

SEQ ID NO: 916317 - DNA, 22 bp, Artificial Sequence
  chemically synthesized
tgatcaccctttataaaatcac

SEQ ID NO: 916318 - DNA, 22 bp, Artificial Sequence
  chemically synthesized
tatgatcaccctttataaaatc

SEQ ID NO: 916319 - DNA, 22 bp, Artificial Sequence
  chemically synthesized
ctatgatcaccctttataaaat

SEQ ID NO: 916320 - DNA, 22 bp, Artificial Sequence
  chemically synthesized
tgattttataaagggtgatcat

SEQ ID NO: 916321 - DNA, 22 bp, Artificial Sequence
  chemically synthesized
catggaaccttctatgatcacc

SEQ ID NO: 916322 - DNA, 22 bp, Artificial Sequence
  chemically synthesized
tccatggaaccttctatgatca

SEQ ID NO: 916323 - DNA, 22 bp, Artificial Sequence
  chemically synthesized
ctccatggaaccttctatgatc

SEQ ID NO: 916324 - DNA, 22 bp, Artificial Sequence
  chemically synthesized
tataaagggtgatcatagaagg

SEQ ID NO: 916325 - DNA, 22 bp, Artificial Sequence
  chemically synthesized
ataaagggtgatcatagaaggt

SEQ ID NO: 916326 - DNA, 22 bp, Artificial Sequence
  chemically synthesized
cttctccatggaaccttctatg

SEQ ID NO: 916327 - DNA, 22 bp, Artificial Sequence
  chemically synthesized
taaagggtgatcatagaaggtt

SEQ ID NO: 916328 - DNA, 22 bp, Artificial Sequence
  chemically synthesized
aaatgtctccttctccatggaa

SEQ ID NO: 916329 - DNA, 22 bp, Artificial Sequence
  chemically synthesized
ctcaaatgtctccttctccatg

SEQ ID NO: 916330 - DNA, 22 bp, Artificial Sequence
  chemically synthesized
gctcaaatgtctccttctccat

SEQ ID NO: 916331 - DNA, 22 bp, Artificial Sequence
  chemically synthesized
tgctcaaatgtctccttctcca

SEQ ID NO: 916332 - DNA, 22 bp, Artificial Sequence
  chemically synthesized
catggagaaggagacatttgag

SEQ ID NO: 916333 - DNA, 22 bp, Artificial Sequence
  chemically synthesized
ccacgaggactttgctcaaatg

SEQ ID NO: 916334 - DNA, 22 bp, Artificial Sequence
  chemically synthesized
gccagtccctaccacgaggact

SEQ ID NO: 916335 - DNA, 22 bp, Artificial Sequence
  chemically synthesized
gagcaaagtcctcgtggtaggg

SEQ ID NO: 916336 - DNA, 22 bp, Artificial Sequence
  chemically synthesized
agcaaagtcctcgtggtaggga

SEQ ID NO: 916337 - DNA, 22 bp, Artificial Sequence
  chemically synthesized
atgagcagctagccagtcccta

SEQ ID NO: 916338 - DNA, 22 bp, Artificial Sequence
  chemically synthesized
tctaatgagcagctagccagtc

SEQ ID NO: 916339 - DNA, 22 bp, Artificial Sequence
  chemically synthesized
gtctaatgagcagctagccagt

SEQ ID NO: 916340 - DNA, 22 bp, Artificial Sequence
  chemically synthesized
gtggtagggactggctagctgc

SEQ ID NO: 916341 - DNA, 22 bp, Artificial Sequence
  chemically synthesized
gctagctgctcattagacaagt

SEQ ID NO: 916342 - DNA, 22 bp, Artificial Sequence
  chemically synthesized
agagaaatgagtagacttgtct

SEQ ID NO: 916343 - DNA, 22 bp, Artificial Sequence
  chemically synthesized
gctgctcattagacaagtctac

SEQ ID NO: 916344 - DNA, 22 bp, Artificial Sequence
  chemically synthesized
ctcattagacaagtctactcat

SEQ ID NO: 916345 - DNA, 22 bp, Artificial Sequence
  chemically synthesized
cacaattaagagaaatgagtag

SEQ ID NO: 916346 - DNA, 22 bp, Artificial Sequence
  chemically synthesized
attagacaagtctactcatttc

SEQ ID NO: 916347 - DNA, 22 bp, Artificial Sequence
  chemically synthesized
gctgcacaattaagagaaatga

SEQ ID NO: 916348 - DNA, 22 bp, Artificial Sequence
  chemically synthesized
gacaagtctactcatttctctt

SEQ ID NO: 916349 - DNA, 22 bp, Artificial Sequence
  chemically synthesized
ctcatttctcttaattgtgcag

SEQ ID NO: 916350 - DNA, 22 bp, Artificial Sequence
  chemically synthesized
atttctcttaattgtgcagcta

SEQ ID NO: 916351 - DNA, 22 bp, Artificial Sequence
  chemically synthesized
ggaaatgacagctagctgcaca

SEQ ID NO: 916352 - DNA, 22 bp, Artificial Sequence
  chemically synthesized
ctcttaattgtgcagctagctg

SEQ ID NO: 916353 - DNA, 22 bp, Artificial Sequence
  chemically synthesized
tcttaattgtgcagctagctgt

SEQ ID NO: 916354 - DNA, 22 bp, Artificial Sequence
  chemically synthesized
ttaattgtgcagctagctgtca

SEQ ID NO: 916355 - DNA, 22 bp, Artificial Sequence
  chemically synthesized
aattgtgcagctagctgtcatt

SEQ ID NO: 916356 - DNA, 22 bp, Artificial Sequence
  chemically synthesized
attgtgcagctagctgtcattt

SEQ ID NO: 916357 - DNA, 22 bp, Artificial Sequence
  chemically synthesized
tgcagctagctgtcatttccca

SEQ ID NO: 916358 - DNA, 22 bp, Artificial Sequence
  chemically synthesized
atggcaagggagactgggaaat

SEQ ID NO: 916359 - DNA, 22 bp, Artificial Sequence
  chemically synthesized
gctgtcatttcccagtctccct

SEQ ID NO: 916360 - DNA, 22 bp, Artificial Sequence
  chemically synthesized
tcatttcccagtctcccttgcc

SEQ ID NO: 916361 - DNA, 22 bp, Artificial Sequence
  chemically synthesized
cccagtctcccttgccattagt

SEQ ID NO: 916362 - DNA, 22 bp, Artificial Sequence
  chemically synthesized
ccagtctcccttgccattagtt

SEQ ID NO: 916363 - DNA, 22 bp, Artificial Sequence
  chemically synthesized
agtcatgtagccaaactaatgg

SEQ ID NO: 916364 - DNA, 22 bp, Artificial Sequence
  chemically synthesized
gaactcagtcatgtagccaaac

SEQ ID NO: 916365 - DNA, 22 bp, Artificial Sequence
  chemically synthesized
ccttgccattagtttggctaca

SEQ ID NO: 916366 - DNA, 22 bp, Artificial Sequence
  chemically synthesized
gctcgaactcagtcatgtagcc

SEQ ID NO: 916367 - DNA, 22 bp, Artificial Sequence
  chemically synthesized
gccattagtttggctacatgac

SEQ ID NO: 916368 - DNA, 22 bp, Artificial Sequence
  chemically synthesized
ccattagtttggctacatgact

SEQ ID NO: 916369 - DNA, 22 bp, Artificial Sequence
  chemically synthesized
cattggctcgaactcagtcatg

SEQ ID NO: 916370 - DNA, 22 bp, Artificial Sequence
  chemically synthesized
gtttggctacatgactgagttc

SEQ ID NO: 916371 - DNA, 22 bp, Artificial Sequence
  chemically synthesized
acactccattggctcgaactca

SEQ ID NO: 916372 - DNA, 22 bp, Artificial Sequence
  chemically synthesized
ggctacatgactgagttcgagc

SEQ ID NO: 916373 - DNA, 22 bp, Artificial Sequence
  chemically synthesized
gctacatgactgagttcgagcc

SEQ ID NO: 916374 - DNA, 22 bp, Artificial Sequence
  chemically synthesized
ctcacactccattggctcgaac

SEQ ID NO: 916375 - DNA, 22 bp, Artificial Sequence
  chemically synthesized
gctcacactccattggctcgaa

SEQ ID NO: 916376 - DNA, 22 bp, Artificial Sequence
  chemically synthesized
tgctcacactccattggctcga

SEQ ID NO: 916377 - DNA, 22 bp, Artificial Sequence
  chemically synthesized
catgactgagttcgagccaatg

SEQ ID NO: 916378 - DNA, 22 bp, Artificial Sequence
  chemically synthesized
ttgctcacactccattggctcg

SEQ ID NO: 916379 - DNA, 22 bp, Artificial Sequence
  chemically synthesized
agttcgagccaatggagtgtga

SEQ ID NO: 916380 - DNA, 22 bp, Artificial Sequence
  chemically synthesized
gagccaatggagtgtgagcaaa

SEQ ID NO: 916381 - DNA, 22 bp, Artificial Sequence
  chemically synthesized
atgagcatcacttttgctcaca

SEQ ID NO: 916382 - DNA, 22 bp, Artificial Sequence
  chemically synthesized
atattcatgagcatcacttttg

SEQ ID NO: 916383 - DNA, 22 bp, Artificial Sequence
  chemically synthesized
catattcatgagcatcactttt

SEQ ID NO: 916384 - DNA, 22 bp, Artificial Sequence
  chemically synthesized
tgagccaggcttcatattcatg

SEQ ID NO: 916385 - DNA, 22 bp, Artificial Sequence
  chemically synthesized
gaggtggggttatgagccaggc

SEQ ID NO: 916386 - DNA, 22 bp, Artificial Sequence
  chemically synthesized
atgaatatgaagcctggctcat

SEQ ID NO: 916387 - DNA, 22 bp, Artificial Sequence
  chemically synthesized
ttggaggtggggttatgagcca

SEQ ID NO: 916388 - DNA, 22 bp, Artificial Sequence
  chemically synthesized
gctcataaccccacctccaata

SEQ ID NO: 916389 - DNA, 22 bp, Artificial Sequence
  chemically synthesized
ataaccccacctccaataacca

SEQ ID NO: 916390 - DNA, 22 bp, Artificial Sequence
  chemically synthesized
catatgtggtggtggttattgg

SEQ ID NO: 916391 - DNA, 22 bp, Artificial Sequence
  chemically synthesized
caataaccaccaccacatatgt

SEQ ID NO: 916392 - DNA, 22 bp, Artificial Sequence
  chemically synthesized
tacataagaatgaaaaagaaca

SEQ ID NO: 916393 - DNA, 22 bp, Artificial Sequence
  chemically synthesized
gtacataagaatgaaaaagaac

SEQ ID NO: 916394 - DNA, 22 bp, Artificial Sequence
  chemically synthesized
ttgtacataagaatgaaaaaga

SEQ ID NO: 916395 - DNA, 22 bp, Artificial Sequence
  chemically synthesized
tgctcttgtacataagaatgaa

SEQ ID NO: 916396 - DNA, 22 bp, Artificial Sequence
  chemically synthesized
cttgttctttttcattcttatg

SEQ ID NO: 916397 - DNA, 22 bp, Artificial Sequence
  chemically synthesized
gttctttttcattcttatgtac

SEQ ID NO: 916398 - DNA, 22 bp, Artificial Sequence
  chemically synthesized
ttctttttcattcttatgtaca

SEQ ID NO: 916399 - DNA, 22 bp, Artificial Sequence
  chemically synthesized
tttttcattcttatgtacaaga

SEQ ID NO: 916400 - DNA, 22 bp, Artificial Sequence
  chemically synthesized
aaaatcactgtgctcttgtaca

SEQ ID NO: 916401 - DNA, 22 bp, Artificial Sequence
  chemically synthesized
tttcattcttatgtacaagagc

SEQ ID NO: 916402 - DNA, 22 bp, Artificial Sequence
  chemically synthesized
caaaatcactgtgctcttgtac

SEQ ID NO: 916403 - DNA, 22 bp, Artificial Sequence
  chemically synthesized
ttcattcttatgtacaagagca

SEQ ID NO: 916404 - DNA, 22 bp, Artificial Sequence
  chemically synthesized
tcattcttatgtacaagagcac

SEQ ID NO: 916405 - DNA, 22 bp, Artificial Sequence
  chemically synthesized
cattcttatgtacaagagcaca

SEQ ID NO: 916406 - DNA, 22 bp, Artificial Sequence
  chemically synthesized
attcttatgtacaagagcacag

SEQ ID NO: 916407 - DNA, 22 bp, Artificial Sequence
  chemically synthesized
ttatgtacaagagcacagtgat

SEQ ID NO: 916408 - DNA, 22 bp, Artificial Sequence
  chemically synthesized
atgtacaagagcacagtgattt

SEQ ID NO: 916409 - DNA, 22 bp, Artificial Sequence
  chemically synthesized
tgtacaagagcacagtgatttt

SEQ ID NO: 916410 - DNA, 22 bp, Artificial Sequence
  chemically synthesized
acatacggatttcaaaatcact

SEQ ID NO: 916411 - DNA, 22 bp, Artificial Sequence
  chemically synthesized
aacatacggatttcaaaatcac

SEQ ID NO: 916412 - DNA, 22 bp, Artificial Sequence
  chemically synthesized
taacatacggatttcaaaatca

SEQ ID NO: 916413 - DNA, 22 bp, Artificial Sequence
  chemically synthesized
atgtctttaacatacggatttc

SEQ ID NO: 916414 - DNA, 22 bp, Artificial Sequence
  chemically synthesized
tgatgtctttaacatacggatt

SEQ ID NO: 916415 - DNA, 22 bp, Artificial Sequence
  chemically synthesized
tggctctgatgtctttaacata

SEQ ID NO: 916416 - DNA, 22 bp, Artificial Sequence
  chemically synthesized
gtggctctgatgtctttaacat

SEQ ID NO: 916417 - DNA, 22 bp, Artificial Sequence
  chemically synthesized
tgtggctctgatgtctttaaca

SEQ ID NO: 916418 - DNA, 22 bp, Artificial Sequence
  chemically synthesized
tgaaatccgtatgttaaagaca

SEQ ID NO: 916419 - DNA, 22 bp, Artificial Sequence
  chemically synthesized
ttgtggctctgatgtctttaac

SEQ ID NO: 916420 - DNA, 22 bp, Artificial Sequence
  chemically synthesized
gaaatccgtatgttaaagacat

SEQ ID NO: 916421 - DNA, 22 bp, Artificial Sequence
  chemically synthesized
aaatccgtatgttaaagacatc

SEQ ID NO: 916422 - DNA, 22 bp, Artificial Sequence
  chemically synthesized
gcttttgtggctctgatgtctt

SEQ ID NO: 916423 - DNA, 22 bp, Artificial Sequence
  chemically synthesized
cgcttttgtggctctgatgtct

SEQ ID NO: 916424 - DNA, 22 bp, Artificial Sequence
  chemically synthesized
aagacatcagagccacaaaagc

SEQ ID NO: 916425 - DNA, 22 bp, Artificial Sequence
  chemically synthesized
caaatggtggatcaggggggcc

SEQ ID NO: 916426 - DNA, 22 bp, Artificial Sequence
  chemically synthesized
ctccaaatggtggatcaggggg

SEQ ID NO: 916427 - DNA, 22 bp, Artificial Sequence
  chemically synthesized
cctccaaatggtggatcagggg

SEQ ID NO: 916428 - DNA, 22 bp, Artificial Sequence
  chemically synthesized
ggcccccctgatccaccatttg

SEQ ID NO: 916429 - DNA, 22 bp, Artificial Sequence
  chemically synthesized
gtcaacaagtagatttcctcca

SEQ ID NO: 916430 - DNA, 22 bp, Artificial Sequence
  chemically synthesized
atccaccatttggaggaaatct

SEQ ID NO: 916431 - DNA, 22 bp, Artificial Sequence
  chemically synthesized
tggtcaacaagtagatttcctc

SEQ ID NO: 916432 - DNA, 22 bp, Artificial Sequence
  chemically synthesized
ctggtcaacaagtagatttcct

SEQ ID NO: 916433 - DNA, 22 bp, Artificial Sequence
  chemically synthesized
tctggtcaacaagtagatttcc

SEQ ID NO: 916434 - DNA, 22 bp, Artificial Sequence
  chemically synthesized
ggaggaaatctacttgttgacc

SEQ ID NO: 916435 - DNA, 22 bp, Artificial Sequence
  chemically synthesized
caaaaattttctggtcaacaag

SEQ ID NO: 916436 - DNA, 22 bp, Artificial Sequence
  chemically synthesized
gaggaaatctacttgttgacca

SEQ ID NO: 916437 - DNA, 22 bp, Artificial Sequence
  chemically synthesized
acaaaaattttctggtcaacaa

SEQ ID NO: 916438 - DNA, 22 bp, Artificial Sequence
  chemically synthesized
tacaaaaattttctggtcaaca

SEQ ID NO: 916439 - DNA, 22 bp, Artificial Sequence
  chemically synthesized
cttgttgaccagaaaatttttg

SEQ ID NO: 916440 - DNA, 22 bp, Artificial Sequence
  chemically synthesized
atgcaaactttacaaaaatttt

SEQ ID NO: 916441 - DNA, 22 bp, Artificial Sequence
  chemically synthesized
gttgaccagaaaatttttgtaa

SEQ ID NO: 916442 - DNA, 22 bp, Artificial Sequence
  chemically synthesized
ttgaccagaaaatttttgtaaa

SEQ ID NO: 916443 - DNA, 22 bp, Artificial Sequence
  chemically synthesized
cgttcatgcaaactttacaaaa

SEQ ID NO: 916444 - DNA, 22 bp, Artificial Sequence
  chemically synthesized
ccgttcatgcaaactttacaaa

SEQ ID NO: 916445 - DNA, 22 bp, Artificial Sequence
  chemically synthesized
accagaaaatttttgtaaagtt

SEQ ID NO: 916446 - DNA, 22 bp, Artificial Sequence
  chemically synthesized
tccgttcatgcaaactttacaa

SEQ ID NO: 916447 - DNA, 22 bp, Artificial Sequence
  chemically synthesized
ttgtaaagtttgcatgaacgga

SEQ ID NO: 916448 - DNA, 22 bp, Artificial Sequence
  chemically synthesized
tgtaaagtttgcatgaacggaa

SEQ ID NO: 916449 - DNA, 22 bp, Artificial Sequence
  chemically synthesized
gtaaagtttgcatgaacggaaa

SEQ ID NO: 916450 - DNA, 22 bp, Artificial Sequence
  chemically synthesized
taaagtttgcatgaacggaaag

SEQ ID NO: 916451 - DNA, 22 bp, Artificial Sequence
  chemically synthesized
acataatagaaactttccgttc

SEQ ID NO: 916452 - DNA, 22 bp, Artificial Sequence
  chemically synthesized
aacataatagaaactttccgtt

SEQ ID NO: 916453 - DNA, 22 bp, Artificial Sequence
  chemically synthesized
gcatgaacggaaagtttctatt

SEQ ID NO: 916454 - DNA, 22 bp, Artificial Sequence
  chemically synthesized
catgaacggaaagtttctatta

SEQ ID NO: 916455 - DNA, 22 bp, Artificial Sequence
  chemically synthesized
agtggcttaacataatagaaac

SEQ ID NO: 916456 - DNA, 22 bp, Artificial Sequence
  chemically synthesized
ctattatgttaagccactgagg

SEQ ID NO: 916457 - DNA, 22 bp, Artificial Sequence
  chemically synthesized
tattatgttaagccactgaggt

SEQ ID NO: 916458 - DNA, 22 bp, Artificial Sequence
  chemically synthesized
ttatgttaagccactgaggtgt

SEQ ID NO: 916459 - DNA, 22 bp, Artificial Sequence
  chemically synthesized
tgttaagccactgaggtgtggg

SEQ ID NO: 916460 - DNA, 22 bp, Artificial Sequence
  chemically synthesized
taaaaaaaaaaaagcccacacc

SEQ ID NO: 916461 - DNA, 22 bp, Artificial Sequence
  chemically synthesized
agccactgaggtgtgggctttt

SEQ ID NO: 916462 - DNA, 22 bp, Artificial Sequence
  chemically synthesized
ctataaaaaaaaaaaagcccac

SEQ ID NO: 916463 - DNA, 22 bp, Artificial Sequence
  chemically synthesized
aagctgctataaaaaaaaaaaa

SEQ ID NO: 916464 - DNA, 22 bp, Artificial Sequence
  chemically synthesized
aggtgtgggctttttttttttt

SEQ ID NO: 916465 - DNA, 22 bp, Artificial Sequence
  chemically synthesized
ttaaagctgctataaaaaaaaa

SEQ ID NO: 916466 - DNA, 22 bp, Artificial Sequence
  chemically synthesized
attaaagctgctataaaaaaaa

SEQ ID NO: 916467 - DNA, 22 bp, Artificial Sequence
  chemically synthesized
tattaaagctgctataaaaaaa

SEQ ID NO: 916468 - DNA, 22 bp, Artificial Sequence
  chemically synthesized
tctttattaaagctgctataaa

SEQ ID NO: 916469 - DNA, 22 bp, Artificial Sequence
  chemically synthesized
cctatctttattaaagctgcta

SEQ ID NO: 916470 - DNA, 22 bp, Artificial Sequence
  chemically synthesized
ttttttttttatagcagcttta

SEQ ID NO: 916471 - DNA, 22 bp, Artificial Sequence
  chemically synthesized
tttttttttatagcagctttaa

SEQ ID NO: 916472 - DNA, 22 bp, Artificial Sequence
  chemically synthesized
ttttttttatagcagctttaat

SEQ ID NO: 916473 - DNA, 22 bp, Artificial Sequence
  chemically synthesized
tttttttatagcagctttaata

SEQ ID NO: 916474 - DNA, 22 bp, Artificial Sequence
  chemically synthesized
ttttttatagcagctttaataa

SEQ ID NO: 916475 - DNA, 22 bp, Artificial Sequence
  chemically synthesized
tattacctatctttattaaagc

SEQ ID NO: 916476 - DNA, 22 bp, Artificial Sequence
  chemically synthesized
tttttatagcagctttaataaa

SEQ ID NO: 916477 - DNA, 22 bp, Artificial Sequence
  chemically synthesized
ttttatagcagctttaataaag

SEQ ID NO: 916478 - DNA, 22 bp, Artificial Sequence
  chemically synthesized
tatattacctatctttattaaa

SEQ ID NO: 916479 - DNA, 22 bp, Artificial Sequence
  chemically synthesized
tttatagcagctttaataaaga

SEQ ID NO: 916480 - DNA, 22 bp, Artificial Sequence
  chemically synthesized
ctatattacctatctttattaa

SEQ ID NO: 916481 - DNA, 22 bp, Artificial Sequence
  chemically synthesized
ttatagcagctttaataaagat

SEQ ID NO: 916482 - DNA, 22 bp, Artificial Sequence
  chemically synthesized
tatagcagctttaataaagata

SEQ ID NO: 916483 - DNA, 22 bp, Artificial Sequence
  chemically synthesized
atagcagctttaataaagatag

SEQ ID NO: 916484 - DNA, 22 bp, Artificial Sequence
  chemically synthesized
tttctatattacctatctttat

SEQ ID NO: 916485 - DNA, 22 bp, Artificial Sequence
  chemically synthesized
tagcagctttaataaagatagg

SEQ ID NO: 916486 - DNA, 22 bp, Artificial Sequence
  chemically synthesized
atttctatattacctatcttta

SEQ ID NO: 916487 - DNA, 22 bp, Artificial Sequence
  chemically synthesized
tatttctatattacctatcttt

SEQ ID NO: 916488 - DNA, 22 bp, Artificial Sequence
  chemically synthesized
tttatttctatattacctatct

SEQ ID NO: 916489 - DNA, 22 bp, Artificial Sequence
  chemically synthesized
ctttatttctatattacctatc

SEQ ID NO: 916490 - DNA, 22 bp, Artificial Sequence
  chemically synthesized
gcttctttatttctatattacc

SEQ ID NO: 916491 - DNA, 22 bp, Artificial Sequence
  chemically synthesized
taataaagataggtaatataga

SEQ ID NO: 916492 - DNA, 22 bp, Artificial Sequence
  chemically synthesized
aataaagataggtaatatagaa

SEQ ID NO: 916493 - DNA, 22 bp, Artificial Sequence
  chemically synthesized
ataaagataggtaatatagaaa

SEQ ID NO: 916494 - DNA, 22 bp, Artificial Sequence
  chemically synthesized
cctcgcttctttatttctatat

SEQ ID NO: 916495 - DNA, 22 bp, Artificial Sequence
  chemically synthesized
ctccctcgcttctttatttcta

SEQ ID NO: 916496 - DNA, 22 bp, Artificial Sequence
  chemically synthesized
catggcctcctccctcgcttct

SEQ ID NO: 916497 - DNA, 22 bp, Artificial Sequence
  chemically synthesized
gcatggcctcctccctcgcttc

SEQ ID NO: 916498 - DNA, 22 bp, Artificial Sequence
  chemically synthesized
ccgcaatatttgcatggcctcc

SEQ ID NO: 916499 - DNA, 22 bp, Artificial Sequence
  chemically synthesized
cccgcaatatttgcatggcctc

SEQ ID NO: 916500 - DNA, 22 bp, Artificial Sequence
  chemically synthesized
tcccgcaatatttgcatggcct

SEQ ID NO: 916501 - DNA, 22 bp, Artificial Sequence
  chemically synthesized
tttcccgcaatatttgcatggc

SEQ ID NO: 916502 - DNA, 22 bp, Artificial Sequence
  chemically synthesized
gggcgttctttcccgcaatatt

SEQ ID NO: 916503 - DNA, 22 bp, Artificial Sequence
  chemically synthesized
agggcgttctttcccgcaatat

SEQ ID NO: 916504 - DNA, 22 bp, Artificial Sequence
  chemically synthesized
cttagggcgttctttcccgcaa

SEQ ID NO: 916505 - DNA, 22 bp, Artificial Sequence
  chemically synthesized
tgcttagggcgttctttcccgc

SEQ ID NO: 916506 - DNA, 22 bp, Artificial Sequence
  chemically synthesized
tctgcttagggcgttctttccc

SEQ ID NO: 916507 - DNA, 22 bp, Artificial Sequence
  chemically synthesized
ctctgcttagggcgttctttcc

SEQ ID NO: 916508 - DNA, 22 bp, Artificial Sequence
  chemically synthesized
tctctgcttagggcgttctttc

SEQ ID NO: 916509 - DNA, 22 bp, Artificial Sequence
  chemically synthesized
ttttctctgcttagggcgttct

SEQ ID NO: 916510 - DNA, 22 bp, Artificial Sequence
  chemically synthesized
gttttctctgcttagggcgttc

SEQ ID NO: 916511 - DNA, 22 bp, Artificial Sequence
  chemically synthesized
cgggaaagaacgccctaagcag

SEQ ID NO: 916512 - DNA, 22 bp, Artificial Sequence
  chemically synthesized
tacttgttttctctgcttaggg

SEQ ID NO: 916513 - DNA, 22 bp, Artificial Sequence
  chemically synthesized
gtacttgttttctctgcttagg

SEQ ID NO: 916514 - DNA, 22 bp, Artificial Sequence
  chemically synthesized
tgtacttgttttctctgcttag

SEQ ID NO: 916515 - DNA, 22 bp, Artificial Sequence
  chemically synthesized
aaggcctttgtacttgttttct

SEQ ID NO: 916516 - DNA, 22 bp, Artificial Sequence
  chemically synthesized
cctcaaggcctttgtacttgtt

SEQ ID NO: 916517 - DNA, 22 bp, Artificial Sequence
  chemically synthesized
agcagagaaaacaagtacaaag

SEQ ID NO: 916518 - DNA, 22 bp, Artificial Sequence
  chemically synthesized
ctgcctcaaggcctttgtactt

SEQ ID NO: 916519 - DNA, 22 bp, Artificial Sequence
  chemically synthesized
cactcctgcctcaaggcctttg

SEQ ID NO: 916520 - DNA, 22 bp, Artificial Sequence
  chemically synthesized
ctacactcctgcctcaaggcct

SEQ ID NO: 916521 - DNA, 22 bp, Artificial Sequence
  chemically synthesized
actacactcctgcctcaaggcc

SEQ ID NO: 916522 - DNA, 22 bp, Artificial Sequence
  chemically synthesized
ttactacactcctgcctcaagg

SEQ ID NO: 916523 - DNA, 22 bp, Artificial Sequence
  chemically synthesized
ggacgttcttactacactcctg

SEQ ID NO: 916524 - DNA, 22 bp, Artificial Sequence
  chemically synthesized
aggacgttcttactacactcct

SEQ ID NO: 916525 - DNA, 22 bp, Artificial Sequence
  chemically synthesized
taggacgttcttactacactcc

SEQ ID NO: 916526 - DNA, 22 bp, Artificial Sequence
  chemically synthesized
ttaggacgttcttactacactc

SEQ ID NO: 916527 - DNA, 22 bp, Artificial Sequence
  chemically synthesized
tttttaggacgttcttactaca

SEQ ID NO: 916528 - DNA, 22 bp, Artificial Sequence
  chemically synthesized
gaggcaggagtgtagtaagaac

SEQ ID NO: 916529 - DNA, 22 bp, Artificial Sequence
  chemically synthesized
aggcaggagtgtagtaagaacg

SEQ ID NO: 916530 - DNA, 22 bp, Artificial Sequence
  chemically synthesized
gctgtttttaggacgttcttac

SEQ ID NO: 916531 - DNA, 22 bp, Artificial Sequence
  chemically synthesized
cgctgtttttaggacgttctta

SEQ ID NO: 916532 - DNA, 22 bp, Artificial Sequence
  chemically synthesized
ttcgctgtttttaggacgttct

SEQ ID NO: 916533 - DNA, 22 bp, Artificial Sequence
  chemically synthesized
cttcgctgtttttaggacgttc

SEQ ID NO: 916534 - DNA, 22 bp, Artificial Sequence
  chemically synthesized
acttcttcgctgtttttaggac

SEQ ID NO: 916535 - DNA, 22 bp, Artificial Sequence
  chemically synthesized
ttcacttcttcgctgtttttag

SEQ ID NO: 916536 - DNA, 22 bp, Artificial Sequence
  chemically synthesized
gttcacttcttcgctgttttta

SEQ ID NO: 916537 - DNA, 22 bp, Artificial Sequence
  chemically synthesized
ttgttcacttcttcgctgtttt

SEQ ID NO: 916538 - DNA, 22 bp, Artificial Sequence
  chemically synthesized
cttgttcacttcttcgctgttt

SEQ ID NO: 916539 - DNA, 22 bp, Artificial Sequence
  chemically synthesized
aacttcttgttcacttcttcgc

SEQ ID NO: 916540 - DNA, 22 bp, Artificial Sequence
  chemically synthesized
tgaacttcttgttcacttcttc

SEQ ID NO: 916541 - DNA, 22 bp, Artificial Sequence
  chemically synthesized
ctgaacttcttgttcacttctt

SEQ ID NO: 916542 - DNA, 22 bp, Artificial Sequence
  chemically synthesized
aaaacagcgaagaagtgaacaa

SEQ ID NO: 916543 - DNA, 22 bp, Artificial Sequence
  chemically synthesized
catttctgaacttcttgttcac

SEQ ID NO: 916544 - DNA, 22 bp, Artificial Sequence
  chemically synthesized
actccatttctgaacttcttgt

SEQ ID NO: 916545 - DNA, 22 bp, Artificial Sequence
  chemically synthesized
ctcactccatttctgaacttct

SEQ ID NO: 916546 - DNA, 22 bp, Artificial Sequence
  chemically synthesized
cctcactccatttctgaacttc

SEQ ID NO: 916547 - DNA, 22 bp, Artificial Sequence
  chemically synthesized
tcctcactccatttctgaactt

SEQ ID NO: 916548 - DNA, 22 bp, Artificial Sequence
  chemically synthesized
ctttcctcactccatttctgaa

SEQ ID NO: 916549 - DNA, 22 bp, Artificial Sequence
  chemically synthesized
gtaatctcctttcctcactcca

SEQ ID NO: 916550 - DNA, 22 bp, Artificial Sequence
  chemically synthesized
agaaatggagtgaggaaaggag

SEQ ID NO: 916551 - DNA, 22 bp, Artificial Sequence
  chemically synthesized
ggccacatctagtaatctcctt

SEQ ID NO: 916552 - DNA, 22 bp, Artificial Sequence
  chemically synthesized
gggccacatctagtaatctcct

SEQ ID NO: 916553 - DNA, 22 bp, Artificial Sequence
  chemically synthesized
tgggccacatctagtaatctcc

SEQ ID NO: 916554 - DNA, 22 bp, Artificial Sequence
  chemically synthesized
ttgggccacatctagtaatctc

SEQ ID NO: 916555 - DNA, 22 bp, Artificial Sequence
  chemically synthesized
aatagaaggcttttgggccaca

SEQ ID NO: 916556 - DNA, 22 bp, Artificial Sequence
  chemically synthesized
tgaatagaaggcttttgggcca

SEQ ID NO: 916557 - DNA, 22 bp, Artificial Sequence
  chemically synthesized
ctagatgtggcccaaaagcctt

SEQ ID NO: 916558 - DNA, 22 bp, Artificial Sequence
  chemically synthesized
gatgtggcccaaaagccttcta

SEQ ID NO: 916559 - DNA, 22 bp, Artificial Sequence
  chemically synthesized
cagatagaatctctgaatagaa

SEQ ID NO: 916560 - DNA, 22 bp, Artificial Sequence
  chemically synthesized
agattccagatagaatctctga

SEQ ID NO: 916561 - DNA, 22 bp, Artificial Sequence
  chemically synthesized
cagattccagatagaatctctg

SEQ ID NO: 916562 - DNA, 22 bp, Artificial Sequence
  chemically synthesized
ctattcagagattctatctgga

SEQ ID NO: 916563 - DNA, 22 bp, Artificial Sequence
  chemically synthesized
tattcagagattctatctggaa

SEQ ID NO: 916564 - DNA, 22 bp, Artificial Sequence
  chemically synthesized
ttcagagattctatctggaatc

SEQ ID NO: 916565 - DNA, 22 bp, Artificial Sequence
  chemically synthesized
taaaagccttcagattccagat

SEQ ID NO: 916566 - DNA, 22 bp, Artificial Sequence
  chemically synthesized
agagattctatctggaatctga

SEQ ID NO: 916567 - DNA, 22 bp, Artificial Sequence
  chemically synthesized
tatctggaatctgaaggctttt

SEQ ID NO: 916568 - DNA, 22 bp, Artificial Sequence
  chemically synthesized
tctggaatctgaaggcttttat

SEQ ID NO: 916569 - DNA, 22 bp, Artificial Sequence
  chemically synthesized
gaatctgaaggcttttataatc

SEQ ID NO: 916570 - DNA, 22 bp, Artificial Sequence
  chemically synthesized
gatgtgggatagggattataaa

SEQ ID NO: 916571 - DNA, 22 bp, Artificial Sequence
  chemically synthesized
aattcgatgtgggatagggatt

SEQ ID NO: 916572 - DNA, 22 bp, Artificial Sequence
  chemically synthesized
aaggcttttataatccctatcc

SEQ ID NO: 916573 - DNA, 22 bp, Artificial Sequence
  chemically synthesized
ttataatccctatcccacatcg

SEQ ID NO: 916574 - DNA, 22 bp, Artificial Sequence
  chemically synthesized
tataatccctatcccacatcga

SEQ ID NO: 916575 - DNA, 22 bp, Artificial Sequence
  chemically synthesized
ataatccctatcccacatcgaa

SEQ ID NO: 916576 - DNA, 22 bp, Artificial Sequence
  chemically synthesized
taatccctatcccacatcgaat

SEQ ID NO: 916577 - DNA, 22 bp, Artificial Sequence
  chemically synthesized
cccagaaactgaattcgatgtg

SEQ ID NO: 916578 - DNA, 22 bp, Artificial Sequence
  chemically synthesized
acccagaaactgaattcgatgt

SEQ ID NO: 916579 - DNA, 22 bp, Artificial Sequence
  chemically synthesized
tacccagaaactgaattcgatg

SEQ ID NO: 916580 - DNA, 22 bp, Artificial Sequence
  chemically synthesized
ttacccagaaactgaattcgat

SEQ ID NO: 916581 - DNA, 22 bp, Artificial Sequence
  chemically synthesized
tttttacccagaaactgaattc

SEQ ID NO: 916582 - DNA, 22 bp, Artificial Sequence
  chemically synthesized
atttttacccagaaactgaatt

SEQ ID NO: 916583 - DNA, 22 bp, Artificial Sequence
  chemically synthesized
tcccacatcgaattcagtttct

SEQ ID NO: 916584 - DNA, 22 bp, Artificial Sequence
  chemically synthesized
taatttatttttacccagaaac

SEQ ID NO: 916585 - DNA, 22 bp, Artificial Sequence
  chemically synthesized
tataatttatttttacccagaa

SEQ ID NO: 916586 - DNA, 22 bp, Artificial Sequence
  chemically synthesized
ctctataatttatttttaccca

SEQ ID NO: 916587 - DNA, 22 bp, Artificial Sequence
  chemically synthesized
agtttctgggtaaaaataaatt

SEQ ID NO: 916588 - DNA, 22 bp, Artificial Sequence
  chemically synthesized
ctgggtaaaaataaattataga

SEQ ID NO: 916589 - DNA, 22 bp, Artificial Sequence
  chemically synthesized
tgggtaaaaataaattatagag

SEQ ID NO: 916590 - DNA, 22 bp, Artificial Sequence
  chemically synthesized
ccaaacatattgctctataatt

SEQ ID NO: 916591 - DNA, 22 bp, Artificial Sequence
  chemically synthesized
cccaaacatattgctctataat

SEQ ID NO: 916592 - DNA, 22 bp, Artificial Sequence
  chemically synthesized
ggtaaaaataaattatagagca

SEQ ID NO: 916593 - DNA, 22 bp, Artificial Sequence
  chemically synthesized
agatttcccaaacatattgctc

SEQ ID NO: 916594 - DNA, 22 bp, Artificial Sequence
  chemically synthesized
agtctgagatttcccaaacata

SEQ ID NO: 916595 - DNA, 22 bp, Artificial Sequence
  chemically synthesized
tagagcaatatgtttgggaaat

SEQ ID NO: 916596 - DNA, 22 bp, Artificial Sequence
  chemically synthesized
gagaacacagttcagtctgaga

SEQ ID NO: 916597 - DNA, 22 bp, Artificial Sequence
  chemically synthesized
gggaaatctcagactgaactgt

SEQ ID NO: 916598 - DNA, 22 bp, Artificial Sequence
  chemically synthesized
ggaaatctcagactgaactgtg

SEQ ID NO: 916599 - DNA, 22 bp, Artificial Sequence
  chemically synthesized
aagtagcattggagaacacagt

SEQ ID NO: 916600 - DNA, 22 bp, Artificial Sequence
  chemically synthesized
ttaaagtagcattggagaacac

SEQ ID NO: 916601 - DNA, 22 bp, Artificial Sequence
  chemically synthesized
agactgaactgtgttctccaat

SEQ ID NO: 916602 - DNA, 22 bp, Artificial Sequence
  chemically synthesized
gatctattaaagtagcattgga

SEQ ID NO: 916603 - DNA, 22 bp, Artificial Sequence
  chemically synthesized
aactgtgttctccaatgctact

SEQ ID NO: 916604 - DNA, 22 bp, Artificial Sequence
  chemically synthesized
attggatctattaaagtagcat

SEQ ID NO: 916605 - DNA, 22 bp, Artificial Sequence
  chemically synthesized
tgttctccaatgctactttaat

SEQ ID NO: 916606 - DNA, 22 bp, Artificial Sequence
  chemically synthesized
gttgattggatctattaaagta

SEQ ID NO: 916607 - DNA, 22 bp, Artificial Sequence
  chemically synthesized
tccaatgctactttaatagatc

SEQ ID NO: 916608 - DNA, 22 bp, Artificial Sequence
  chemically synthesized
agttagttgattggatctatta

SEQ ID NO: 916609 - DNA, 22 bp, Artificial Sequence
  chemically synthesized
caatgctactttaatagatcca

SEQ ID NO: 916610 - DNA, 22 bp, Artificial Sequence
  chemically synthesized
gggctcagttagttgattggat

SEQ ID NO: 916611 - DNA, 22 bp, Artificial Sequence
  chemically synthesized
ctttaatagatccaatcaacta

SEQ ID NO: 916612 - DNA, 22 bp, Artificial Sequence
  chemically synthesized
taatagatccaatcaactaact

SEQ ID NO: 916613 - DNA, 22 bp, Artificial Sequence
  chemically synthesized
aatagatccaatcaactaactg

SEQ ID NO: 916614 - DNA, 22 bp, Artificial Sequence
  chemically synthesized
atagatccaatcaactaactga

SEQ ID NO: 916615 - DNA, 22 bp, Artificial Sequence
  chemically synthesized
gggggaagtcctagggctcagt

SEQ ID NO: 916616 - DNA, 22 bp, Artificial Sequence
  chemically synthesized
actgagccctaggacttccccc

SEQ ID NO: 916617 - DNA, 22 bp, Artificial Sequence
  chemically synthesized
agccctaggacttccccccaga

SEQ ID NO: 916618 - DNA, 22 bp, Artificial Sequence
  chemically synthesized
ggacttccccccagatttttgt

SEQ ID NO: 916619 - DNA, 22 bp, Artificial Sequence
  chemically synthesized
tgtagacagcacacacaaaaat

SEQ ID NO: 916620 - DNA, 22 bp, Artificial Sequence
  chemically synthesized
ccccccagatttttgtgtgtgc

SEQ ID NO: 916621 - DNA, 22 bp, Artificial Sequence
  chemically synthesized
cccccagatttttgtgtgtgct

SEQ ID NO: 916622 - DNA, 22 bp, Artificial Sequence
  chemically synthesized
agcaactgtgtagacagcacac

SEQ ID NO: 916623 - DNA, 22 bp, Artificial Sequence
  chemically synthesized
cagcaactgtgtagacagcaca

SEQ ID NO: 916624 - DNA, 22 bp, Artificial Sequence
  chemically synthesized
tttcagcaactgtgtagacagc

SEQ ID NO: 916625 - DNA, 22 bp, Artificial Sequence
  chemically synthesized
ttgtgtgtgctgtctacacagt

SEQ ID NO: 916626 - DNA, 22 bp, Artificial Sequence
  chemically synthesized
tgtgtgtgctgtctacacagtt

SEQ ID NO: 916627 - DNA, 22 bp, Artificial Sequence
  chemically synthesized
gtgtgtgctgtctacacagttg

SEQ ID NO: 916628 - DNA, 22 bp, Artificial Sequence
  chemically synthesized
tgtgtgctgtctacacagttgc

SEQ ID NO: 916629 - DNA, 22 bp, Artificial Sequence
  chemically synthesized
ccgaagcctgtttcagcaactg

SEQ ID NO: 916630 - DNA, 22 bp, Artificial Sequence
  chemically synthesized
cccgaagcctgtttcagcaact

SEQ ID NO: 916631 - DNA, 22 bp, Artificial Sequence
  chemically synthesized
tcccgaagcctgtttcagcaac

SEQ ID NO: 916632 - DNA, 22 bp, Artificial Sequence
  chemically synthesized
tctacacagttgctgaaacagg

SEQ ID NO: 916633 - DNA, 22 bp, Artificial Sequence
  chemically synthesized
agattttcccgaagcctgtttc

SEQ ID NO: 916634 - DNA, 22 bp, Artificial Sequence
  chemically synthesized
cacagttgctgaaacaggcttc

SEQ ID NO: 916635 - DNA, 22 bp, Artificial Sequence
  chemically synthesized
ctgaaacaggcttcgggaaaat

SEQ ID NO: 916636 - DNA, 22 bp, Artificial Sequence
  chemically synthesized
aaacaggcttcgggaaaatctg

SEQ ID NO: 916637 - DNA, 22 bp, Artificial Sequence
  chemically synthesized
cgggaaaatctgaggatgcttt

SEQ ID NO: 916638 - DNA, 22 bp, Artificial Sequence
  chemically synthesized
gggaaaatctgaggatgctttg

SEQ ID NO: 916639 - DNA, 22 bp, Artificial Sequence
  chemically synthesized
acagatgaagatccaaagcatc

SEQ ID NO: 916640 - DNA, 22 bp, Artificial Sequence
  chemically synthesized
tgacagatgaagatccaaagca

SEQ ID NO: 916641 - DNA, 22 bp, Artificial Sequence
  chemically synthesized
cctctgacagatgaagatccaa

SEQ ID NO: 916642 - DNA, 22 bp, Artificial Sequence
  chemically synthesized
tgcctctgacagatgaagatcc

SEQ ID NO: 916643 - DNA, 22 bp, Artificial Sequence
  chemically synthesized
aggatgctttggatcttcatct

SEQ ID NO: 916644 - DNA, 22 bp, Artificial Sequence
  chemically synthesized
tggatcttcatctgtcagaggc

SEQ ID NO: 916645 - DNA, 22 bp, Artificial Sequence
  chemically synthesized
ggatcttcatctgtcagaggca

SEQ ID NO: 916646 - DNA, 22 bp, Artificial Sequence
  chemically synthesized
gatcttcatctgtcagaggcag

SEQ ID NO: 916647 - DNA, 22 bp, Artificial Sequence
  chemically synthesized
ataggtgatgtaactctgcctc

SEQ ID NO: 916648 - DNA, 22 bp, Artificial Sequence
  chemically synthesized
catctgtcagaggcagagttac

SEQ ID NO: 916649 - DNA, 22 bp, Artificial Sequence
  chemically synthesized
ctgataggtgatgtaactctgc

SEQ ID NO: 916650 - DNA, 22 bp, Artificial Sequence
  chemically synthesized
atctgtcagaggcagagttaca

SEQ ID NO: 916651 - DNA, 22 bp, Artificial Sequence
  chemically synthesized
actgataggtgatgtaactctg

SEQ ID NO: 916652 - DNA, 22 bp, Artificial Sequence
  chemically synthesized
tactgataggtgatgtaactct

SEQ ID NO: 916653 - DNA, 22 bp, Artificial Sequence
  chemically synthesized
tcagaggcagagttacatcacc

SEQ ID NO: 916654 - DNA, 22 bp, Artificial Sequence
  chemically synthesized
tgacaggctttactgataggtg

SEQ ID NO: 916655 - DNA, 22 bp, Artificial Sequence
  chemically synthesized
gtgacaggctttactgataggt

SEQ ID NO: 916656 - DNA, 22 bp, Artificial Sequence
  chemically synthesized
tgtgacaggctttactgatagg

SEQ ID NO: 916657 - DNA, 22 bp, Artificial Sequence
  chemically synthesized
catcacctatcagtaaagcctg

SEQ ID NO: 916658 - DNA, 22 bp, Artificial Sequence
  chemically synthesized
tcagtaaagcctgtcacaaagc

SEQ ID NO: 916659 - DNA, 22 bp, Artificial Sequence
  chemically synthesized
tcggatggtaatggctttgtga

SEQ ID NO: 916660 - DNA, 22 bp, Artificial Sequence
  chemically synthesized
tatcggatggtaatggctttgt

SEQ ID NO: 916661 - DNA, 22 bp, Artificial Sequence
  chemically synthesized
ctatcggatggtaatggctttg

SEQ ID NO: 916662 - DNA, 22 bp, Artificial Sequence
  chemically synthesized
tctatcggatggtaatggcttt

SEQ ID NO: 916663 - DNA, 22 bp, Artificial Sequence
  chemically synthesized
cattttctatcggatggtaatg

SEQ ID NO: 916664 - DNA, 22 bp, Artificial Sequence
  chemically synthesized
tcacaaagccattaccatccga

SEQ ID NO: 916665 - DNA, 22 bp, Artificial Sequence
  chemically synthesized
attgcattttctatcggatggt

SEQ ID NO: 916666 - DNA, 22 bp, Artificial Sequence
  chemically synthesized
aattgcattttctatcggatgg

SEQ ID NO: 916667 - DNA, 22 bp, Artificial Sequence
  chemically synthesized
ttaattgcattttctatcggat

SEQ ID NO: 916668 - DNA, 22 bp, Artificial Sequence
  chemically synthesized
ccatccgatagaaaatgcaatt

SEQ ID NO: 916669 - DNA, 22 bp, Artificial Sequence
  chemically synthesized
aagtcataccctcttaattgca

SEQ ID NO: 916670 - DNA, 22 bp, Artificial Sequence
  chemically synthesized
gaagtcataccctcttaattgc

SEQ ID NO: 916671 - DNA, 22 bp, Artificial Sequence
  chemically synthesized
agagggtatgacttcaaaccgt

SEQ ID NO: 916672 - DNA, 22 bp, Artificial Sequence
  chemically synthesized
aaatcagaaaaaacggtttgaa

SEQ ID NO: 916673 - DNA, 22 bp, Artificial Sequence
  chemically synthesized
ggattcaaatcagaaaaaacgg

SEQ ID NO: 916674 - DNA, 22 bp, Artificial Sequence
  chemically synthesized
aactgggattcaaatcagaaaa

SEQ ID NO: 916675 - DNA, 22 bp, Artificial Sequence
  chemically synthesized
caaaccgttttttctgatttga

SEQ ID NO: 916676 - DNA, 22 bp, Artificial Sequence
  chemically synthesized
aaaccgttttttctgatttgaa

SEQ ID NO: 916677 - DNA, 22 bp, Artificial Sequence
  chemically synthesized
tttctgatttgaatcccagttc

SEQ ID NO: 916678 - DNA, 22 bp, Artificial Sequence
  chemically synthesized
ttctgatttgaatcccagttca

SEQ ID NO: 916679 - DNA, 22 bp, Artificial Sequence
  chemically synthesized
tctgatttgaatcccagttcag

SEQ ID NO: 916680 - DNA, 22 bp, Artificial Sequence
  chemically synthesized
cgaagggaaaaactgaactggg

SEQ ID NO: 916681 - DNA, 22 bp, Artificial Sequence
  chemically synthesized
ctgatttgaatcccagttcagt

SEQ ID NO: 916682 - DNA, 22 bp, Artificial Sequence
  chemically synthesized
tgatttgaatcccagttcagtt

SEQ ID NO: 916683 - DNA, 22 bp, Artificial Sequence
  chemically synthesized
atttgaatcccagttcagtttt

SEQ ID NO: 916684 - DNA, 22 bp, Artificial Sequence
  chemically synthesized
gaatcccagttcagtttttccc

SEQ ID NO: 916685 - DNA, 22 bp, Artificial Sequence
  chemically synthesized
aatgtctgcgaagggaaaaact

SEQ ID NO: 916686 - DNA, 22 bp, Artificial Sequence
  chemically synthesized
aatcccagttcagtttttccct

SEQ ID NO: 916687 - DNA, 22 bp, Artificial Sequence
  chemically synthesized
gaatgtctgcgaagggaaaaac

SEQ ID NO: 916688 - DNA, 22 bp, Artificial Sequence
  chemically synthesized
agtttttcccttcgcagacatt

SEQ ID NO: 916689 - DNA, 22 bp, Artificial Sequence
  chemically synthesized
ttcccttcgcagacattcaaac

SEQ ID NO: 916690 - DNA, 22 bp, Artificial Sequence
  chemically synthesized
tcccttcgcagacattcaaaca

SEQ ID NO: 916691 - DNA, 22 bp, Artificial Sequence
  chemically synthesized
cccttcgcagacattcaaacac

SEQ ID NO: 916692 - DNA, 22 bp, Artificial Sequence
  chemically synthesized
ccttcgcagacattcaaacacc

SEQ ID NO: 916693 - DNA, 22 bp, Artificial Sequence
  chemically synthesized
ggcaggaagatgatggtgtttg

SEQ ID NO: 916694 - DNA, 22 bp, Artificial Sequence
  chemically synthesized
aggcaggaagatgatggtgttt

SEQ ID NO: 916695 - DNA, 22 bp, Artificial Sequence
  chemically synthesized
cgcagacattcaaacaccatca

SEQ ID NO: 916696 - DNA, 22 bp, Artificial Sequence
  chemically synthesized
gcagacattcaaacaccatcat

SEQ ID NO: 916697 - DNA, 22 bp, Artificial Sequence
  chemically synthesized
aaacaccatcatcttcctgcct

SEQ ID NO: 916698 - DNA, 22 bp, Artificial Sequence
  chemically synthesized
acagaggagcacgtttaggcag

SEQ ID NO: 916699 - DNA, 22 bp, Artificial Sequence
  chemically synthesized
gacagaggagcacgtttaggca

SEQ ID NO: 916700 - DNA, 22 bp, Artificial Sequence
  chemically synthesized
aacttgacagaggagcacgttt

SEQ ID NO: 916701 - DNA, 22 bp, Artificial Sequence
  chemically synthesized
cctgcctaaacgtgctcctctg

SEQ ID NO: 916702 - DNA, 22 bp, Artificial Sequence
  chemically synthesized
ctgcctaaacgtgctcctctgt

SEQ ID NO: 916703 - DNA, 22 bp, Artificial Sequence
  chemically synthesized
cctaaacgtgctcctctgtcaa

SEQ ID NO: 916704 - DNA, 22 bp, Artificial Sequence
  chemically synthesized
aacgtgctcctctgtcaagttc

SEQ ID NO: 916705 - DNA, 22 bp, Artificial Sequence
  chemically synthesized
gtggagtcatccattgaacttg

SEQ ID NO: 916706 - DNA, 22 bp, Artificial Sequence
  chemically synthesized
ctctgtcaagttcaatggatga

SEQ ID NO: 916707 - DNA, 22 bp, Artificial Sequence
  chemically synthesized
tgtcaagttcaatggatgactc

SEQ ID NO: 916708 - DNA, 22 bp, Artificial Sequence
  chemically synthesized
tcaagttcaatggatgactcca

SEQ ID NO: 916709 - DNA, 22 bp, Artificial Sequence
  chemically synthesized
aaaaaccgggagctggtggagt

SEQ ID NO: 916710 - DNA, 22 bp, Artificial Sequence
  chemically synthesized
aaaaaaccgggagctggtggag

SEQ ID NO: 916711 - DNA, 22 bp, Artificial Sequence
  chemically synthesized
aatggatgactccaccagctcc

SEQ ID NO: 916712 - DNA, 22 bp, Artificial Sequence
  chemically synthesized
agcttaaaaaaccgggagctgg

SEQ ID NO: 916713 - DNA, 22 bp, Artificial Sequence
  chemically synthesized
cagcttaaaaaaccgggagctg

SEQ ID NO: 916714 - DNA, 22 bp, Artificial Sequence
  chemically synthesized
tcagcttaaaaaaccgggagct

SEQ ID NO: 916715 - DNA, 22 bp, Artificial Sequence
  chemically synthesized
cactttcagcttaaaaaaccgg

SEQ ID NO: 916716 - DNA, 22 bp, Artificial Sequence
  chemically synthesized
tacactttcagcttaaaaaacc

SEQ ID NO: 916717 - DNA, 22 bp, Artificial Sequence
  chemically synthesized
caccagctcccggttttttaag

SEQ ID NO: 916718 - DNA, 22 bp, Artificial Sequence
  chemically synthesized
ctacactttcagcttaaaaaac

SEQ ID NO: 916719 - DNA, 22 bp, Artificial Sequence
  chemically synthesized
ccggttttttaagctgaaagtg

SEQ ID NO: 916720 - DNA, 22 bp, Artificial Sequence
  chemically synthesized
tttaagctgaaagtgtagaagt

SEQ ID NO: 916721 - DNA, 22 bp, Artificial Sequence
  chemically synthesized
ttaagctgaaagtgtagaagtc

SEQ ID NO: 916722 - DNA, 22 bp, Artificial Sequence
  chemically synthesized
taagctgaaagtgtagaagtca

SEQ ID NO: 916723 - DNA, 22 bp, Artificial Sequence
  chemically synthesized
aagctgaaagtgtagaagtcat

SEQ ID NO: 916724 - DNA, 22 bp, Artificial Sequence
  chemically synthesized
agctgaaagtgtagaagtcatc

SEQ ID NO: 916725 - DNA, 22 bp, Artificial Sequence
  chemically synthesized
aaagtgtagaagtcatccttga

SEQ ID NO: 916726 - DNA, 22 bp, Artificial Sequence
  chemically synthesized
ggagtgagggagagagaagaat

SEQ ID NO: 916727 - DNA, 22 bp, Artificial Sequence
  chemically synthesized
tgggagtgagggagagagaaga

SEQ ID NO: 916728 - DNA, 22 bp, Artificial Sequence
  chemically synthesized
atacgctctgggagtgagggag

SEQ ID NO: 916729 - DNA, 22 bp, Artificial Sequence
  chemically synthesized
gattcttctctctccctcactc

SEQ ID NO: 916730 - DNA, 22 bp, Artificial Sequence
  chemically synthesized
attcttctctctccctcactcc

SEQ ID NO: 916731 - DNA, 22 bp, Artificial Sequence
  chemically synthesized
ttgatacgctctgggagtgagg

SEQ ID NO: 916732 - DNA, 22 bp, Artificial Sequence
  chemically synthesized
attgatacgctctgggagtgag

SEQ ID NO: 916733 - DNA, 22 bp, Artificial Sequence
  chemically synthesized
ttctctctccctcactcccaga

SEQ ID NO: 916734 - DNA, 22 bp, Artificial Sequence
  chemically synthesized
ctctctccctcactcccagagc

SEQ ID NO: 916735 - DNA, 22 bp, Artificial Sequence
  chemically synthesized
tctctccctcactcccagagcg

SEQ ID NO: 916736 - DNA, 22 bp, Artificial Sequence
  chemically synthesized
tctccctcactcccagagcgta

SEQ ID NO: 916737 - DNA, 22 bp, Artificial Sequence
  chemically synthesized
tccctcactcccagagcgtatc

SEQ ID NO: 916738 - DNA, 22 bp, Artificial Sequence
  chemically synthesized
cctcactcccagagcgtatcaa

SEQ ID NO: 916739 - DNA, 22 bp, Artificial Sequence
  chemically synthesized
tgaggacatgcttattgatacg

SEQ ID NO: 916740 - DNA, 22 bp, Artificial Sequence
  chemically synthesized
atgaggacatgcttattgatac

SEQ ID NO: 916741 - DNA, 22 bp, Artificial Sequence
  chemically synthesized
actcccagagcgtatcaataag

SEQ ID NO: 916742 - DNA, 22 bp, Artificial Sequence
  chemically synthesized
ccagagcgtatcaataagcatg

SEQ ID NO: 916743 - DNA, 22 bp, Artificial Sequence
  chemically synthesized
aagtggacttatgaggacatgc

SEQ ID NO: 916744 - DNA, 22 bp, Artificial Sequence
  chemically synthesized
tcaagtggacttatgaggacat

SEQ ID NO: 916745 - DNA, 22 bp, Artificial Sequence
  chemically synthesized
ctcaagtggacttatgaggaca

SEQ ID NO: 916746 - DNA, 22 bp, Artificial Sequence
  chemically synthesized
aagagagatttctcaagtggac

SEQ ID NO: 916747 - DNA, 22 bp, Artificial Sequence
  chemically synthesized
ataagtccacttgagaaatctc

SEQ ID NO: 916748 - DNA, 22 bp, Artificial Sequence
  chemically synthesized
gagaaatctctcttgaatctgc

SEQ ID NO: 916749 - DNA, 22 bp, Artificial Sequence
  chemically synthesized
agaaatctctcttgaatctgcc

SEQ ID NO: 916750 - DNA, 22 bp, Artificial Sequence
  chemically synthesized
tcttgaatctgcccacttctct

SEQ ID NO: 916751 - DNA, 22 bp, Artificial Sequence
  chemically synthesized
ttgaatctgcccacttctctcc

SEQ ID NO: 916752 - DNA, 22 bp, Artificial Sequence
  chemically synthesized
gaatctgcccacttctctccat

SEQ ID NO: 916753 - DNA, 22 bp, Artificial Sequence
  chemically synthesized
aatctgcccacttctctccatc

SEQ ID NO: 916754 - DNA, 22 bp, Artificial Sequence
  chemically synthesized
cccacttctctccatcctcctg

SEQ ID NO: 916755 - DNA, 22 bp, Artificial Sequence
  chemically synthesized
ctctccatcctcctgtcgctgt

SEQ ID NO: 916756 - DNA, 22 bp, Artificial Sequence
  chemically synthesized
tctccatcctcctgtcgctgtc

SEQ ID NO: 916757 - DNA, 22 bp, Artificial Sequence
  chemically synthesized
tccatcctcctgtcgctgtctc

SEQ ID NO: 916758 - DNA, 22 bp, Artificial Sequence
  chemically synthesized
catcctcctgtcgctgtctcct

SEQ ID NO: 916759 - DNA, 22 bp, Artificial Sequence
  chemically synthesized
ctgtcgctgtctccttcgctcc

SEQ ID NO: 916760 - DNA, 22 bp, Artificial Sequence
  chemically synthesized
tcgctgtctccttcgctccttc

SEQ ID NO: 916761 - DNA, 22 bp, Artificial Sequence
  chemically synthesized
aaatcagaatgagaaggagcga

SEQ ID NO: 916762 - DNA, 22 bp, Artificial Sequence
  chemically synthesized
tctccttcgctccttctcattc

SEQ ID NO: 916763 - DNA, 22 bp, Artificial Sequence
  chemically synthesized
cttcgctccttctcattctgat

SEQ ID NO: 916764 - DNA, 22 bp, Artificial Sequence
  chemically synthesized
cgctccttctcattctgatttc

SEQ ID NO: 916765 - DNA, 22 bp, Artificial Sequence
  chemically synthesized
gctccttctcattctgatttca

SEQ ID NO: 916766 - DNA, 22 bp, Artificial Sequence
  chemically synthesized
cttctcattctgatttcaactt

SEQ ID NO: 916767 - DNA, 22 bp, Artificial Sequence
  chemically synthesized
gatcaaaaataaaagttgaaat

SEQ ID NO: 916768 - DNA, 22 bp, Artificial Sequence
  chemically synthesized
ctcattctgatttcaactttta

SEQ ID NO: 916769 - DNA, 22 bp, Artificial Sequence
  chemically synthesized
tcattctgatttcaacttttat

SEQ ID NO: 916770 - DNA, 22 bp, Artificial Sequence
  chemically synthesized
cctggatcaaaaataaaagttg

SEQ ID NO: 916771 - DNA, 22 bp, Artificial Sequence
  chemically synthesized
attctgatttcaacttttattt

SEQ ID NO: 916772 - DNA, 22 bp, Artificial Sequence
  chemically synthesized
tgatttcaacttttatttttga

SEQ ID NO: 916773 - DNA, 22 bp, Artificial Sequence
  chemically synthesized
atttcaacttttatttttgatc

SEQ ID NO: 916774 - DNA, 22 bp, Artificial Sequence
  chemically synthesized
tacgtatactacctggatcaaa

SEQ ID NO: 916775 - DNA, 22 bp, Artificial Sequence
  chemically synthesized
caacttttatttttgatccagg

SEQ ID NO: 916776 - DNA, 22 bp, Artificial Sequence
  chemically synthesized
aacttttatttttgatccaggt

SEQ ID NO: 916777 - DNA, 22 bp, Artificial Sequence
  chemically synthesized
ttatttttgatccaggtagtat

SEQ ID NO: 916778 - DNA, 22 bp, Artificial Sequence
  chemically synthesized
tatttttgatccaggtagtata

SEQ ID NO: 916779 - DNA, 22 bp, Artificial Sequence
  chemically synthesized
atttttgatccaggtagtatac

SEQ ID NO: 916780 - DNA, 22 bp, Artificial Sequence
  chemically synthesized
tttttgatccaggtagtatacg

SEQ ID NO: 916781 - DNA, 22 bp, Artificial Sequence
  chemically synthesized
ttgatccaggtagtatacgtac

SEQ ID NO: 916782 - DNA, 22 bp, Artificial Sequence
  chemically synthesized
tgatccaggtagtatacgtaca

SEQ ID NO: 916783 - DNA, 22 bp, Artificial Sequence
  chemically synthesized
aggtaacaaacctgtacgtata

SEQ ID NO: 916784 - DNA, 22 bp, Artificial Sequence
  chemically synthesized
gatccaggtagtatacgtacag

SEQ ID NO: 916785 - DNA, 22 bp, Artificial Sequence
  chemically synthesized
atccaggtagtatacgtacagg

SEQ ID NO: 916786 - DNA, 22 bp, Artificial Sequence
  chemically synthesized
gcatcacacaacatactcaggt

SEQ ID NO: 916787 - DNA, 22 bp, Artificial Sequence
  chemically synthesized
ggcatcacacaacatactcagg

SEQ ID NO: 916788 - DNA, 22 bp, Artificial Sequence
  chemically synthesized
aaccttggcatcacacaacata

SEQ ID NO: 916789 - DNA, 22 bp, Artificial Sequence
  chemically synthesized
gttacctgagtatgttgtgtga

SEQ ID NO: 916790 - DNA, 22 bp, Artificial Sequence
  chemically synthesized
ttacctgagtatgttgtgtgat

SEQ ID NO: 916791 - DNA, 22 bp, Artificial Sequence
  chemically synthesized
ccctaaaccttggcatcacaca

SEQ ID NO: 916792 - DNA, 22 bp, Artificial Sequence
  chemically synthesized
cctgagtatgttgtgtgatgcc

SEQ ID NO: 916793 - DNA, 22 bp, Artificial Sequence
  chemically synthesized
accctaaaccttggcatcacac

SEQ ID NO: 916794 - DNA, 22 bp, Artificial Sequence
  chemically synthesized
taccctaaaccttggcatcaca

SEQ ID NO: 916795 - DNA, 22 bp, Artificial Sequence
  chemically synthesized
ttaccctaaaccttggcatcac

SEQ ID NO: 916796 - DNA, 22 bp, Artificial Sequence
  chemically synthesized
agtatgttgtgtgatgccaagg

SEQ ID NO: 916797 - DNA, 22 bp, Artificial Sequence
  chemically synthesized
tgtgatgccaaggtttagggta

SEQ ID NO: 916798 - DNA, 22 bp, Artificial Sequence
  chemically synthesized
tgtgtggtgggatcatttttac

SEQ ID NO: 916799 - DNA, 22 bp, Artificial Sequence
  chemically synthesized
cctgtgtgtggtgggatcattt

SEQ ID NO: 916800 - DNA, 22 bp, Artificial Sequence
  chemically synthesized
actacctgtgtgtggtgggatc

SEQ ID NO: 916801 - DNA, 22 bp, Artificial Sequence
  chemically synthesized
agggtaaaaatgatcccaccac

SEQ ID NO: 916802 - DNA, 22 bp, Artificial Sequence
  chemically synthesized
gggtaaaaatgatcccaccaca

SEQ ID NO: 916803 - DNA, 22 bp, Artificial Sequence
  chemically synthesized
tgctcactacctgtgtgtggtg

SEQ ID NO: 916804 - DNA, 22 bp, Artificial Sequence
  chemically synthesized
tcgggtactatgctcactacct

SEQ ID NO: 916805 - DNA, 22 bp, Artificial Sequence
  chemically synthesized
cctatcgggtactatgctcact

SEQ ID NO: 916806 - DNA, 22 bp, Artificial Sequence
  chemically synthesized
aaaaactacctatcgggtacta

SEQ ID NO: 916807 - DNA, 22 bp, Artificial Sequence
  chemically synthesized
gaagggggaggaaggagagggg

SEQ ID NO: 916808 - DNA, 22 bp, Artificial Sequence
  chemically synthesized
ttcaacccttgcccctctcctt

SEQ ID NO: 916809 - DNA, 22 bp, Artificial Sequence
  chemically synthesized
tcaacccttgcccctctccttc

SEQ ID NO: 916810 - DNA, 22 bp, Artificial Sequence
  chemically synthesized
caacccttgcccctctccttcc

SEQ ID NO: 916811 - DNA, 22 bp, Artificial Sequence
  chemically synthesized
ctagaagggggaggaaggagag

SEQ ID NO: 916812 - DNA, 22 bp, Artificial Sequence
  chemically synthesized
aacccttgcccctctccttcct

SEQ ID NO: 916813 - DNA, 22 bp, Artificial Sequence
  chemically synthesized
gggactactagaagggggagga

SEQ ID NO: 916814 - DNA, 22 bp, Artificial Sequence
  chemically synthesized
gcccctctccttcctccccctt

SEQ ID NO: 916815 - DNA, 22 bp, Artificial Sequence
  chemically synthesized
cccctctccttcctcccccttc

SEQ ID NO: 916816 - DNA, 22 bp, Artificial Sequence
  chemically synthesized
tccttcctcccccttctagtag

SEQ ID NO: 916817 - DNA, 22 bp, Artificial Sequence
  chemically synthesized
cttcctcccccttctagtagtc

SEQ ID NO: 916818 - DNA, 22 bp, Artificial Sequence
  chemically synthesized
cctcccccttctagtagtcccc

SEQ ID NO: 916819 - DNA, 22 bp, Artificial Sequence
  chemically synthesized
ctcccccttctagtagtcccca

SEQ ID NO: 916820 - DNA, 22 bp, Artificial Sequence
  chemically synthesized
ccccttctagtagtccccaatg

SEQ ID NO: 916821 - DNA, 22 bp, Artificial Sequence
  chemically synthesized
ctagtagtccccaatgtctatt

SEQ ID NO: 916822 - DNA, 22 bp, Artificial Sequence
  chemically synthesized
tagtagtccccaatgtctattg

SEQ ID NO: 916823 - DNA, 22 bp, Artificial Sequence
  chemically synthesized
taaaggtgaaaacaatagacat

SEQ ID NO: 916824 - DNA, 22 bp, Artificial Sequence
  chemically synthesized
gtagtccccaatgtctattgtt

SEQ ID NO: 916825 - DNA, 22 bp, Artificial Sequence
  chemically synthesized
attataaaggtgaaaacaatag

SEQ ID NO: 916826 - DNA, 22 bp, Artificial Sequence
  chemically synthesized
ggtactcattataaaggtgaaa

SEQ ID NO: 916827 - DNA, 22 bp, Artificial Sequence
  chemically synthesized
aacattgggtactcattataaa

SEQ ID NO: 916828 - DNA, 22 bp, Artificial Sequence
  chemically synthesized
ttgttttcacctttataatgag

SEQ ID NO: 916829 - DNA, 22 bp, Artificial Sequence
  chemically synthesized
ttttcacctttataatgagtac

SEQ ID NO: 916830 - DNA, 22 bp, Artificial Sequence
  chemically synthesized
tcacctttataatgagtaccca

SEQ ID NO: 916831 - DNA, 22 bp, Artificial Sequence
  chemically synthesized
gaagctaaacattgggtactca

SEQ ID NO: 916832 - DNA, 22 bp, Artificial Sequence
  chemically synthesized
cacctttataatgagtacccaa

SEQ ID NO: 916833 - DNA, 22 bp, Artificial Sequence
  chemically synthesized
acctttataatgagtacccaat

SEQ ID NO: 916834 - DNA, 22 bp, Artificial Sequence
  chemically synthesized
tataatgagtacccaatgttta

SEQ ID NO: 916835 - DNA, 22 bp, Artificial Sequence
  chemically synthesized
ataatgagtacccaatgtttag

SEQ ID NO: 916836 - DNA, 22 bp, Artificial Sequence
  chemically synthesized
taatgagtacccaatgtttagc

SEQ ID NO: 916837 - DNA, 22 bp, Artificial Sequence
  chemically synthesized
agcttctaactatcttcggttt

SEQ ID NO: 916838 - DNA, 22 bp, Artificial Sequence
  chemically synthesized
gcttctaactatcttcggtttt

SEQ ID NO: 916839 - DNA, 22 bp, Artificial Sequence
  chemically synthesized
atgcaggaacagaaaaccgaag

SEQ ID NO: 916840 - DNA, 22 bp, Artificial Sequence
  chemically synthesized
ctaactatcttcggttttctgt

SEQ ID NO: 916841 - DNA, 22 bp, Artificial Sequence
  chemically synthesized
taactatcttcggttttctgtt

SEQ ID NO: 916842 - DNA, 22 bp, Artificial Sequence
  chemically synthesized
actatcttcggttttctgttcc

SEQ ID NO: 916843 - DNA, 22 bp, Artificial Sequence
  chemically synthesized
agtgaattaatgcaggaacaga

SEQ ID NO: 916844 - DNA, 22 bp, Artificial Sequence
  chemically synthesized
tcttcggttttctgttcctgca

SEQ ID NO: 916845 - DNA, 22 bp, Artificial Sequence
  chemically synthesized
tcctaagtgaattaatgcagga

SEQ ID NO: 916846 - DNA, 22 bp, Artificial Sequence
  chemically synthesized
cggttttctgttcctgcattaa

SEQ ID NO: 916847 - DNA, 22 bp, Artificial Sequence
  chemically synthesized
ggttttctgttcctgcattaat

SEQ ID NO: 916848 - DNA, 22 bp, Artificial Sequence
  chemically synthesized
tctgttcctgcattaattcact

SEQ ID NO: 916849 - DNA, 22 bp, Artificial Sequence
  chemically synthesized
ctgttcctgcattaattcactt

SEQ ID NO: 916850 - DNA, 22 bp, Artificial Sequence
  chemically synthesized
tgttcctgcattaattcactta

SEQ ID NO: 916851 - DNA, 22 bp, Artificial Sequence
  chemically synthesized
gaggtcattatcctaagtgaat

SEQ ID NO: 916852 - DNA, 22 bp, Artificial Sequence
  chemically synthesized
ttcctgcattaattcacttagg

SEQ ID NO: 916853 - DNA, 22 bp, Artificial Sequence
  chemically synthesized
ctgcattaattcacttaggata

SEQ ID NO: 916854 - DNA, 22 bp, Artificial Sequence
  chemically synthesized
cattaattcacttaggataatg

SEQ ID NO: 916855 - DNA, 22 bp, Artificial Sequence
  chemically synthesized
attcacttaggataatgacctc

SEQ ID NO: 916856 - DNA, 22 bp, Artificial Sequence
  chemically synthesized
acttaggataatgacctccagc

SEQ ID NO: 916857 - DNA, 22 bp, Artificial Sequence
  chemically synthesized
aggataatgacctccagctgca

SEQ ID NO: 916858 - DNA, 22 bp, Artificial Sequence
  chemically synthesized
taggaacatggatgcagctgga

SEQ ID NO: 916859 - DNA, 22 bp, Artificial Sequence
  chemically synthesized
ggataatgacctccagctgcat

SEQ ID NO: 916860 - DNA, 22 bp, Artificial Sequence
  chemically synthesized
gtaggaacatggatgcagctgg

SEQ ID NO: 916861 - DNA, 22 bp, Artificial Sequence
  chemically synthesized
tgtaggaacatggatgcagctg

SEQ ID NO: 916862 - DNA, 22 bp, Artificial Sequence
  chemically synthesized
ttgtaggaacatggatgcagct

SEQ ID NO: 916863 - DNA, 22 bp, Artificial Sequence
  chemically synthesized
cagctgcatccatgttcctaca

SEQ ID NO: 916864 - DNA, 22 bp, Artificial Sequence
  chemically synthesized
catccatgttcctacaaaaggc

SEQ ID NO: 916865 - DNA, 22 bp, Artificial Sequence
  chemically synthesized
ctacaaaaggcgtgactgtatg

SEQ ID NO: 916866 - DNA, 22 bp, Artificial Sequence
  chemically synthesized
caaaaggcgtgactgtatgctt

SEQ ID NO: 916867 - DNA, 22 bp, Artificial Sequence
  chemically synthesized
cacagtcataaaaagcatacag

SEQ ID NO: 916868 - DNA, 22 bp, Artificial Sequence
  chemically synthesized
tatgctttttatgactgtgtag

SEQ ID NO: 916869 - DNA, 22 bp, Artificial Sequence
  chemically synthesized
tttatgactgtgtagtattcca

SEQ ID NO: 916870 - DNA, 22 bp, Artificial Sequence
  chemically synthesized
ttatgactgtgtagtattccat

SEQ ID NO: 916871 - DNA, 22 bp, Artificial Sequence
  chemically synthesized
tatgactgtgtagtattccatg

SEQ ID NO: 916872 - DNA, 22 bp, Artificial Sequence
  chemically synthesized
atgactgtgtagtattccatgg

SEQ ID NO: 916873 - DNA, 22 bp, Artificial Sequence
  chemically synthesized
tgactgtgtagtattccatggt

SEQ ID NO: 916874 - DNA, 22 bp, Artificial Sequence
  chemically synthesized
tgtagtattccatggtgcatgt

SEQ ID NO: 916875 - DNA, 22 bp, Artificial Sequence
  chemically synthesized
aatgaaataaacgtggtataca

SEQ ID NO: 916876 - DNA, 22 bp, Artificial Sequence
  chemically synthesized
catggtgcatgtataccacgtt

SEQ ID NO: 916877 - DNA, 22 bp, Artificial Sequence
  chemically synthesized
ggtgcccaccagtggtggattg

SEQ ID NO: 916878 - DNA, 22 bp, Artificial Sequence
  chemically synthesized
atttcattcaatccaccactgg

SEQ ID NO: 916879 - DNA, 22 bp, Artificial Sequence
  chemically synthesized
tttcattcaatccaccactggt

SEQ ID NO: 916880 - DNA, 22 bp, Artificial Sequence
  chemically synthesized
cattcaatccaccactggtggg

SEQ ID NO: 916881 - DNA, 22 bp, Artificial Sequence
  chemically synthesized
attcaatccaccactggtgggc

SEQ ID NO: 916882 - DNA, 22 bp, Artificial Sequence
  chemically synthesized
aatccaccactggtgggcacct

SEQ ID NO: 916883 - DNA, 22 bp, Artificial Sequence
  chemically synthesized
gtgggcacctaggttgattcca

SEQ ID NO: 916884 - DNA, 22 bp, Artificial Sequence
  chemically synthesized
tacagtaacaaagacatggaat

SEQ ID NO: 916885 - DNA, 22 bp, Artificial Sequence
  chemically synthesized
ggttgattccatgtctttgtta

SEQ ID NO: 916886 - DNA, 22 bp, Artificial Sequence
  chemically synthesized
attccatgtctttgttactgta

SEQ ID NO: 916887 - DNA, 22 bp, Artificial Sequence
  chemically synthesized
gtcgcagcactatacagtaaca

SEQ ID NO: 916888 - DNA, 22 bp, Artificial Sequence
  chemically synthesized
catgtctttgttactgtatagt

SEQ ID NO: 916889 - DNA, 22 bp, Artificial Sequence
  chemically synthesized
acatgttcgtcgcagcactata

SEQ ID NO: 916890 - DNA, 22 bp, Artificial Sequence
  chemically synthesized
tgttactgtatagtgctgcgac

SEQ ID NO: 916891 - DNA, 22 bp, Artificial Sequence
  chemically synthesized
gttactgtatagtgctgcgacg

SEQ ID NO: 916892 - DNA, 22 bp, Artificial Sequence
  chemically synthesized
ttactgtatagtgctgcgacga

SEQ ID NO: 916893 - DNA, 22 bp, Artificial Sequence
  chemically synthesized
ctgtatagtgctgcgacgaaca

SEQ ID NO: 916894 - DNA, 22 bp, Artificial Sequence
  chemically synthesized
tatagtgctgcgacgaacatgt

SEQ ID NO: 916895 - DNA, 22 bp, Artificial Sequence
  chemically synthesized
ccaaagagacacatgtactcac

SEQ ID NO: 916896 - DNA, 22 bp, Artificial Sequence
  chemically synthesized
cgacgaacatgtgagtacatgt

SEQ ID NO: 916897 - DNA, 22 bp, Artificial Sequence
  chemically synthesized
taccaaagagacacatgtactc

SEQ ID NO: 916898 - DNA, 22 bp, Artificial Sequence
  chemically synthesized
ctaccaaagagacacatgtact

SEQ ID NO: 916899 - DNA, 22 bp, Artificial Sequence
  chemically synthesized
tctaccaaagagacacatgtac

SEQ ID NO: 916900 - DNA, 22 bp, Artificial Sequence
  chemically synthesized
aaagaacacgaatctttctacc

SEQ ID NO: 916901 - DNA, 22 bp, Artificial Sequence
  chemically synthesized
aaaagaacacgaatctttctac

SEQ ID NO: 916902 - DNA, 22 bp, Artificial Sequence
  chemically synthesized
tttggtagaaagattcgtgttc

SEQ ID NO: 916903 - DNA, 22 bp, Artificial Sequence
  chemically synthesized
tggtagaaagattcgtgttctt

SEQ ID NO: 916904 - DNA, 22 bp, Artificial Sequence
  chemically synthesized
gtatatatttaaaagaacacga

SEQ ID NO: 916905 - DNA, 22 bp, Artificial Sequence
  chemically synthesized
ggtagaaagattcgtgttcttt

SEQ ID NO: 916906 - DNA, 22 bp, Artificial Sequence
  chemically synthesized
ggtatatatttaaaagaacacg

SEQ ID NO: 916907 - DNA, 22 bp, Artificial Sequence
  chemically synthesized
gtagaaagattcgtgttctttt

SEQ ID NO: 916908 - DNA, 22 bp, Artificial Sequence
  chemically synthesized
cttggtatatatttaaaagaac

SEQ ID NO: 916909 - DNA, 22 bp, Artificial Sequence
  chemically synthesized
attacttggtatatatttaaaa

SEQ ID NO: 916910 - DNA, 22 bp, Artificial Sequence
  chemically synthesized
gtgttcttttaaatatatacca

SEQ ID NO: 916911 - DNA, 22 bp, Artificial Sequence
  chemically synthesized
ttttaaatatataccaagtaat

SEQ ID NO: 916912 - DNA, 22 bp, Artificial Sequence
  chemically synthesized
ttaaatatataccaagtaatga

SEQ ID NO: 916913 - DNA, 22 bp, Artificial Sequence
  chemically synthesized
aacccagcaatctcattacttg

SEQ ID NO: 916914 - DNA, 22 bp, Artificial Sequence
  chemically synthesized
taaatatataccaagtaatgag

SEQ ID NO: 916915 - DNA, 22 bp, Artificial Sequence
  chemically synthesized
aaatatataccaagtaatgaga

SEQ ID NO: 916916 - DNA, 22 bp, Artificial Sequence
  chemically synthesized
aatatataccaagtaatgagat

SEQ ID NO: 916917 - DNA, 22 bp, Artificial Sequence
  chemically synthesized
ccattcaacccagcaatctcat

SEQ ID NO: 916918 - DNA, 22 bp, Artificial Sequence
  chemically synthesized
aaagagagctgccattcaaccc

SEQ ID NO: 916919 - DNA, 22 bp, Artificial Sequence
  chemically synthesized
aaaagagagctgccattcaacc

SEQ ID NO: 916920 - DNA, 22 bp, Artificial Sequence
  chemically synthesized
ctgggttgaatggcagctctct

SEQ ID NO: 916921 - DNA, 22 bp, Artificial Sequence
  chemically synthesized
aaagaacttaaaagagagctgc

SEQ ID NO: 916922 - DNA, 22 bp, Artificial Sequence
  chemically synthesized
tcaaagaacttaaaagagagct

SEQ ID NO: 916923 - DNA, 22 bp, Artificial Sequence
  chemically synthesized
ggttgaatggcagctctctttt

SEQ ID NO: 916924 - DNA, 22 bp, Artificial Sequence
  chemically synthesized
ctcaaagaacttaaaagagagc

SEQ ID NO: 916925 - DNA, 22 bp, Artificial Sequence
  chemically synthesized
aatggcagctctcttttaagtt

SEQ ID NO: 916926 - DNA, 22 bp, Artificial Sequence
  chemically synthesized
aaaatttctcaaagaacttaaa

SEQ ID NO: 916927 - DNA, 22 bp, Artificial Sequence
  chemically synthesized
gaaaatttctcaaagaacttaa

SEQ ID NO: 916928 - DNA, 22 bp, Artificial Sequence
  chemically synthesized
tcttttaagttctttgagaaat

SEQ ID NO: 916929 - DNA, 22 bp, Artificial Sequence
  chemically synthesized
ttttaagttctttgagaaattt

SEQ ID NO: 916930 - DNA, 22 bp, Artificial Sequence
  chemically synthesized
ttaagttctttgagaaattttc

SEQ ID NO: 916931 - DNA, 22 bp, Artificial Sequence
  chemically synthesized
taagttctttgagaaattttca

SEQ ID NO: 916932 - DNA, 22 bp, Artificial Sequence
  chemically synthesized
tggagagcagtttgaaaatttc

SEQ ID NO: 916933 - DNA, 22 bp, Artificial Sequence
  chemically synthesized
aagttctttgagaaattttcaa

SEQ ID NO: 916934 - DNA, 22 bp, Artificial Sequence
  chemically synthesized
agttctttgagaaattttcaaa

SEQ ID NO: 916935 - DNA, 22 bp, Artificial Sequence
  chemically synthesized
tttgagaaattttcaaactgct

SEQ ID NO: 916936 - DNA, 22 bp, Artificial Sequence
  chemically synthesized
ggcactgtggagagcagtttga

SEQ ID NO: 916937 - DNA, 22 bp, Artificial Sequence
  chemically synthesized
aggcactgtggagagcagtttg

SEQ ID NO: 916938 - DNA, 22 bp, Artificial Sequence
  chemically synthesized
tgagaaattttcaaactgctct

SEQ ID NO: 916939 - DNA, 22 bp, Artificial Sequence
  chemically synthesized
gagaaattttcaaactgctctc

SEQ ID NO: 916940 - DNA, 22 bp, Artificial Sequence
  chemically synthesized
agaaattttcaaactgctctcc

SEQ ID NO: 916941 - DNA, 22 bp, Artificial Sequence
  chemically synthesized
tcaaactgctctccacagtgcc

SEQ ID NO: 916942 - DNA, 22 bp, Artificial Sequence
  chemically synthesized
caaactgctctccacagtgcct

SEQ ID NO: 916943 - DNA, 22 bp, Artificial Sequence
  chemically synthesized
aaactgctctccacagtgccta

SEQ ID NO: 916944 - DNA, 22 bp, Artificial Sequence
  chemically synthesized
ctctccacagtgcctaaactca

SEQ ID NO: 916945 - DNA, 22 bp, Artificial Sequence
  chemically synthesized
tgggaatgtaaatgagtttagg

SEQ ID NO: 916946 - DNA, 22 bp, Artificial Sequence
  chemically synthesized
atgggaatgtaaatgagtttag

SEQ ID NO: 916947 - DNA, 22 bp, Artificial Sequence
  chemically synthesized
tccacagtgcctaaactcattt

SEQ ID NO: 916948 - DNA, 22 bp, Artificial Sequence
  chemically synthesized
tttatgggaatgtaaatgagtt

SEQ ID NO: 916949 - DNA, 22 bp, Artificial Sequence
  chemically synthesized
cacagtgcctaaactcatttac

SEQ ID NO: 916950 - DNA, 22 bp, Artificial Sequence
  chemically synthesized
tacactgtttatgggaatgtaa

SEQ ID NO: 916951 - DNA, 22 bp, Artificial Sequence
  chemically synthesized
atacactgtttatgggaatgta

SEQ ID NO: 916952 - DNA, 22 bp, Artificial Sequence
  chemically synthesized
aactcatttacattcccataaa

SEQ ID NO: 916953 - DNA, 22 bp, Artificial Sequence
  chemically synthesized
atttacattcccataaacagtg

SEQ ID NO: 916954 - DNA, 22 bp, Artificial Sequence
  chemically synthesized
acattcccataaacagtgtata

SEQ ID NO: 916955 - DNA, 22 bp, Artificial Sequence
  chemically synthesized
cattcccataaacagtgtataa

SEQ ID NO: 916956 - DNA, 22 bp, Artificial Sequence
  chemically synthesized
agagaaaagggaatgcttatac

SEQ ID NO: 916957 - DNA, 22 bp, Artificial Sequence
  chemically synthesized
ccataaacagtgtataagcatt

SEQ ID NO: 916958 - DNA, 22 bp, Artificial Sequence
  chemically synthesized
cagagaaaagggaatgcttata

SEQ ID NO: 916959 - DNA, 22 bp, Artificial Sequence
  chemically synthesized
ccttttctctgaagcctcacca

SEQ ID NO: 916960 - DNA, 22 bp, Artificial Sequence
  chemically synthesized
ttctctgaagcctcaccatcat

SEQ ID NO: 916961 - DNA, 22 bp, Artificial Sequence
  chemically synthesized
tctctgaagcctcaccatcatc

SEQ ID NO: 916962 - DNA, 22 bp, Artificial Sequence
  chemically synthesized
ctctgaagcctcaccatcatct

SEQ ID NO: 916963 - DNA, 22 bp, Artificial Sequence
  chemically synthesized
tctgaagcctcaccatcatctg

SEQ ID NO: 916964 - DNA, 22 bp, Artificial Sequence
  chemically synthesized
tgaagcctcaccatcatctgtt

SEQ ID NO: 916965 - DNA, 22 bp, Artificial Sequence
  chemically synthesized
aagcctcaccatcatctgttgt

SEQ ID NO: 916966 - DNA, 22 bp, Artificial Sequence
  chemically synthesized
aaaagtcaaaaaacaacagatg

SEQ ID NO: 916967 - DNA, 22 bp, Artificial Sequence
  chemically synthesized
ttaaaaagtcaaaaaacaacag

SEQ ID NO: 916968 - DNA, 22 bp, Artificial Sequence
  chemically synthesized
ttattaaaaagtcaaaaaacaa

SEQ ID NO: 916969 - DNA, 22 bp, Artificial Sequence
  chemically synthesized
accatcatctgttgttttttga

SEQ ID NO: 916970 - DNA, 22 bp, Artificial Sequence
  chemically synthesized
ttgttttttgactttttaataa

SEQ ID NO: 916971 - DNA, 22 bp, Artificial Sequence
  chemically synthesized
ttttttgactttttaataatag

SEQ ID NO: 916972 - DNA, 22 bp, Artificial Sequence
  chemically synthesized
tttgactttttaataatagcca

SEQ ID NO: 916973 - DNA, 22 bp, Artificial Sequence
  chemically synthesized
ttgactttttaataatagccat

SEQ ID NO: 916974 - DNA, 22 bp, Artificial Sequence
  chemically synthesized
tgactttttaataatagccatt

SEQ ID NO: 916975 - DNA, 22 bp, Artificial Sequence
  chemically synthesized
gactttttaataatagccattc

SEQ ID NO: 916976 - DNA, 22 bp, Artificial Sequence
  chemically synthesized
gaaatcagaacagaatggctat

SEQ ID NO: 916977 - DNA, 22 bp, Artificial Sequence
  chemically synthesized
actttttaataatagccattct

SEQ ID NO: 916978 - DNA, 22 bp, Artificial Sequence
  chemically synthesized
ttagaaatcagaacagaatggc

SEQ ID NO: 916979 - DNA, 22 bp, Artificial Sequence
  chemically synthesized
tttaataatagccattctgttc

SEQ ID NO: 916980 - DNA, 22 bp, Artificial Sequence
  chemically synthesized
ttaataatagccattctgttct

SEQ ID NO: 916981 - DNA, 22 bp, Artificial Sequence
  chemically synthesized
taataatagccattctgttctg

SEQ ID NO: 916982 - DNA, 22 bp, Artificial Sequence
  chemically synthesized
aataatagccattctgttctga

SEQ ID NO: 916983 - DNA, 22 bp, Artificial Sequence
  chemically synthesized
ataatagccattctgttctgat

SEQ ID NO: 916984 - DNA, 22 bp, Artificial Sequence
  chemically synthesized
agagaggctgttagaaatcaga

SEQ ID NO: 916985 - DNA, 22 bp, Artificial Sequence
  chemically synthesized
tgttctgatttctaacagcctc

SEQ ID NO: 916986 - DNA, 22 bp, Artificial Sequence
  chemically synthesized
ttctgatttctaacagcctctc

SEQ ID NO: 916987 - DNA, 22 bp, Artificial Sequence
  chemically synthesized
gaaagcagtctcagagaggctg

SEQ ID NO: 916988 - DNA, 22 bp, Artificial Sequence
  chemically synthesized
tgatttctaacagcctctctga

SEQ ID NO: 916989 - DNA, 22 bp, Artificial Sequence
  chemically synthesized
atttctaacagcctctctgaga

SEQ ID NO: 916990 - DNA, 22 bp, Artificial Sequence
  chemically synthesized
attagaaagcagtctcagagag

SEQ ID NO: 916991 - DNA, 22 bp, Artificial Sequence
  chemically synthesized
ctaacagcctctctgagactgc

SEQ ID NO: 916992 - DNA, 22 bp, Artificial Sequence
  chemically synthesized
taacagcctctctgagactgct

SEQ ID NO: 916993 - DNA, 22 bp, Artificial Sequence
  chemically synthesized
acagcctctctgagactgcttt

SEQ ID NO: 916994 - DNA, 22 bp, Artificial Sequence
  chemically synthesized
tctgagactgctttctaattag

SEQ ID NO: 916995 - DNA, 22 bp, Artificial Sequence
  chemically synthesized
tgagactgctttctaattagct

SEQ ID NO: 916996 - DNA, 22 bp, Artificial Sequence
  chemically synthesized
agactgctttctaattagctcg

SEQ ID NO: 916997 - DNA, 22 bp, Artificial Sequence
  chemically synthesized
ctttctaattagctcgtgcctc

SEQ ID NO: 916998 - DNA, 22 bp, Artificial Sequence
  chemically synthesized
tctaattagctcgtgcctccta

SEQ ID NO: 916999 - DNA, 22 bp, Artificial Sequence
  chemically synthesized
ctaattagctcgtgcctcctac

SEQ ID NO: 917000 - DNA, 22 bp, Artificial Sequence
  chemically synthesized
taattagctcgtgcctcctacc

SEQ ID NO: 917001 - DNA, 22 bp, Artificial Sequence
  chemically synthesized
attagctcgtgcctcctacctt

SEQ ID NO: 917002 - DNA, 22 bp, Artificial Sequence
  chemically synthesized
gctcgtgcctcctaccttgtct

SEQ ID NO: 917003 - DNA, 22 bp, Artificial Sequence
  chemically synthesized
gtgcctcctaccttgtctcctt

SEQ ID NO: 917004 - DNA, 22 bp, Artificial Sequence
  chemically synthesized
ctaccttgtctccttcttatcc

SEQ ID NO: 917005 - DNA, 22 bp, Artificial Sequence
  chemically synthesized
aagtgtaaagagtggataagaa

SEQ ID NO: 917006 - DNA, 22 bp, Artificial Sequence
  chemically synthesized
ccttgtctccttcttatccact

SEQ ID NO: 917007 - DNA, 22 bp, Artificial Sequence
  chemically synthesized
tgaagtgtaaagagtggataag

SEQ ID NO: 917008 - DNA, 22 bp, Artificial Sequence
  chemically synthesized
ttctgaagtgtaaagagtggat

SEQ ID NO: 917009 - DNA, 22 bp, Artificial Sequence
  chemically synthesized
gtctccttcttatccactcttt

SEQ ID NO: 917010 - DNA, 22 bp, Artificial Sequence
  chemically synthesized
attctgaagtgtaaagagtgga

SEQ ID NO: 917011 - DNA, 22 bp, Artificial Sequence
  chemically synthesized
tctccttcttatccactcttta

SEQ ID NO: 917012 - DNA, 22 bp, Artificial Sequence
  chemically synthesized
ttattctgaagtgtaaagagtg

SEQ ID NO: 917013 - DNA, 22 bp, Artificial Sequence
  chemically synthesized
cttcttatccactctttacact

SEQ ID NO: 917014 - DNA, 22 bp, Artificial Sequence
  chemically synthesized
cttatccactctttacacttca

SEQ ID NO: 917015 - DNA, 22 bp, Artificial Sequence
  chemically synthesized
ttatccactctttacacttcag

SEQ ID NO: 917016 - DNA, 22 bp, Artificial Sequence
  chemically synthesized
atccactctttacacttcagaa

SEQ ID NO: 917017 - DNA, 22 bp, Artificial Sequence
  chemically synthesized
tccactctttacacttcagaat

SEQ ID NO: 917018 - DNA, 22 bp, Artificial Sequence
  chemically synthesized
gaaagatctcttattctgaagt

SEQ ID NO: 917019 - DNA, 22 bp, Artificial Sequence
  chemically synthesized
agaaagatctcttattctgaag

SEQ ID NO: 917020 - DNA, 22 bp, Artificial Sequence
  chemically synthesized
tagaaagatctcttattctgaa

SEQ ID NO: 917021 - DNA, 22 bp, Artificial Sequence
  chemically synthesized
tttacacttcagaataagagat

SEQ ID NO: 917022 - DNA, 22 bp, Artificial Sequence
  chemically synthesized
tacacttcagaataagagatct

SEQ ID NO: 917023 - DNA, 22 bp, Artificial Sequence
  chemically synthesized
acacttcagaataagagatctt

SEQ ID NO: 917024 - DNA, 22 bp, Artificial Sequence
  chemically synthesized
cacttcagaataagagatcttt

SEQ ID NO: 917025 - DNA, 22 bp, Artificial Sequence
  chemically synthesized
cagaataagagatctttctaaa

SEQ ID NO: 917026 - DNA, 22 bp, Artificial Sequence
  chemically synthesized
agaataagagatctttctaaaa

SEQ ID NO: 917027 - DNA, 22 bp, Artificial Sequence
  chemically synthesized
tctaaaatatgttgctgatcat

SEQ ID NO: 917028 - DNA, 22 bp, Artificial Sequence
  chemically synthesized
ctaaaatatgttgctgatcatg

SEQ ID NO: 917029 - DNA, 22 bp, Artificial Sequence
  chemically synthesized
agtatatgaggacatgatcagc

SEQ ID NO: 917030 - DNA, 22 bp, Artificial Sequence
  chemically synthesized
taaaatatgttgctgatcatgt

SEQ ID NO: 917031 - DNA, 22 bp, Artificial Sequence
  chemically synthesized
aaatatgttgctgatcatgtcc

SEQ ID NO: 917032 - DNA, 22 bp, Artificial Sequence
  chemically synthesized
ttgagtatatgaggacatgatc

SEQ ID NO: 917033 - DNA, 22 bp, Artificial Sequence
  chemically synthesized
ggatgttgttgagtatatgagg

SEQ ID NO: 917034 - DNA, 22 bp, Artificial Sequence
  chemically synthesized
ctgatcatgtcctcatatactc

SEQ ID NO: 917035 - DNA, 22 bp, Artificial Sequence
  chemically synthesized
atcatgtcctcatatactcaac

SEQ ID NO: 917036 - DNA, 22 bp, Artificial Sequence
  chemically synthesized
gcactaggatgttgttgagtat

SEQ ID NO: 917037 - DNA, 22 bp, Artificial Sequence
  chemically synthesized
tcccattggcactaggatgttg

SEQ ID NO: 917038 - DNA, 22 bp, Artificial Sequence
  chemically synthesized
atcccattggcactaggatgtt

SEQ ID NO: 917039 - DNA, 22 bp, Artificial Sequence
  chemically synthesized
atatactcaacaacatcctagt

SEQ ID NO: 917040 - DNA, 22 bp, Artificial Sequence
  chemically synthesized
tatcccattggcactaggatgt

SEQ ID NO: 917041 - DNA, 22 bp, Artificial Sequence
  chemically synthesized
tattttatcccattggcactag

SEQ ID NO: 917042 - DNA, 22 bp, Artificial Sequence
  chemically synthesized
aacaacatcctagtgccaatgg

SEQ ID NO: 917043 - DNA, 22 bp, Artificial Sequence
  chemically synthesized
gagaagttatattttatcccat

SEQ ID NO: 917044 - DNA, 22 bp, Artificial Sequence
  chemically synthesized
gtgccaatgggataaaatataa

SEQ ID NO: 917045 - DNA, 22 bp, Artificial Sequence
  chemically synthesized
accatgttagagaagttatatt

SEQ ID NO: 917046 - DNA, 22 bp, Artificial Sequence
  chemically synthesized
gaccatgttagagaagttatat

SEQ ID NO: 917047 - DNA, 22 bp, Artificial Sequence
  chemically synthesized
tgaccatgttagagaagttata

SEQ ID NO: 917048 - DNA, 22 bp, Artificial Sequence
  chemically synthesized
ttgaccatgttagagaagttat

SEQ ID NO: 917049 - DNA, 22 bp, Artificial Sequence
  chemically synthesized
tttgaccatgttagagaagtta

SEQ ID NO: 917050 - DNA, 22 bp, Artificial Sequence
  chemically synthesized
ctctaacatggtcaaaaagccc

SEQ ID NO: 917051 - DNA, 22 bp, Artificial Sequence
  chemically synthesized
tctaacatggtcaaaaagccct

SEQ ID NO: 917052 - DNA, 22 bp, Artificial Sequence
  chemically synthesized
taacatggtcaaaaagcccttt

SEQ ID NO: 917053 - DNA, 22 bp, Artificial Sequence
  chemically synthesized
acatggtcaaaaagccctttgt

SEQ ID NO: 917054 - DNA, 22 bp, Artificial Sequence
  chemically synthesized
tgtgatctggtctctacttcta

SEQ ID NO: 917055 - DNA, 22 bp, Artificial Sequence
  chemically synthesized
gtgatctggtctctacttctat

SEQ ID NO: 917056 - DNA, 22 bp, Artificial Sequence
  chemically synthesized
tgatctggtctctacttctatt

SEQ ID NO: 917057 - DNA, 22 bp, Artificial Sequence
  chemically synthesized
gtctctacttctatttcttcat

SEQ ID NO: 917058 - DNA, 22 bp, Artificial Sequence
  chemically synthesized
tacagtgcaaagaaagatgaag

SEQ ID NO: 917059 - DNA, 22 bp, Artificial Sequence
  chemically synthesized
tacttctatttcttcatctttc

SEQ ID NO: 917060 - DNA, 22 bp, Artificial Sequence
  chemically synthesized
cttctatttcttcatctttctt

SEQ ID NO: 917061 - DNA, 22 bp, Artificial Sequence
  chemically synthesized
ctatttcttcatctttctttgc

SEQ ID NO: 917062 - DNA, 22 bp, Artificial Sequence
  chemically synthesized
tatttcttcatctttctttgca

SEQ ID NO: 917063 - DNA, 22 bp, Artificial Sequence
  chemically synthesized
tttcttcatctttctttgcact

SEQ ID NO: 917064 - DNA, 22 bp, Artificial Sequence
  chemically synthesized
catgaactatacagtgcaaaga

SEQ ID NO: 917065 - DNA, 22 bp, Artificial Sequence
  chemically synthesized
cttcatctttctttgcactgta

SEQ ID NO: 917066 - DNA, 22 bp, Artificial Sequence
  chemically synthesized
ttccatgaactatacagtgcaa

SEQ ID NO: 917067 - DNA, 22 bp, Artificial Sequence
  chemically synthesized
ttcatctttctttgcactgtat

SEQ ID NO: 917068 - DNA, 22 bp, Artificial Sequence
  chemically synthesized
catctttctttgcactgtatag

SEQ ID NO: 917069 - DNA, 22 bp, Artificial Sequence
  chemically synthesized
atctttctttgcactgtatagt

SEQ ID NO: 917070 - DNA, 22 bp, Artificial Sequence
  chemically synthesized
tctttgcactgtatagttcatg

SEQ ID NO: 917071 - DNA, 22 bp, Artificial Sequence
  chemically synthesized
ctttgcactgtatagttcatgg

SEQ ID NO: 917072 - DNA, 22 bp, Artificial Sequence
  chemically synthesized
tttgcactgtatagttcatgga

SEQ ID NO: 917073 - DNA, 22 bp, Artificial Sequence
  chemically synthesized
tgcactgtatagttcatggaac

SEQ ID NO: 917074 - DNA, 22 bp, Artificial Sequence
  chemically synthesized
gcactgtatagttcatggaaca

SEQ ID NO: 917075 - DNA, 22 bp, Artificial Sequence
  chemically synthesized
cactgtatagttcatggaacaa

SEQ ID NO: 917076 - DNA, 22 bp, Artificial Sequence
  chemically synthesized
aggaagagtaagttgttccatg

SEQ ID NO: 917077 - DNA, 22 bp, Artificial Sequence
  chemically synthesized
aaggaagagtaagttgttccat

SEQ ID NO: 917078 - DNA, 22 bp, Artificial Sequence
  chemically synthesized
taaggaagagtaagttgttcca

SEQ ID NO: 917079 - DNA, 22 bp, Artificial Sequence
  chemically synthesized
tatagttcatggaacaacttac

SEQ ID NO: 917080 - DNA, 22 bp, Artificial Sequence
  chemically synthesized
gattttaaggaagagtaagttg

SEQ ID NO: 917081 - DNA, 22 bp, Artificial Sequence
  chemically synthesized
atggaacaacttactcttcctt

SEQ ID NO: 917082 - DNA, 22 bp, Artificial Sequence
  chemically synthesized
atatggatatagtgctggattt

SEQ ID NO: 917083 - DNA, 22 bp, Artificial Sequence
  chemically synthesized
actcttccttaaaatccagcac

SEQ ID NO: 917084 - DNA, 22 bp, Artificial Sequence
  chemically synthesized
ctcttccttaaaatccagcact

SEQ ID NO: 917085 - DNA, 22 bp, Artificial Sequence
  chemically synthesized
ttccttaaaatccagcactata

SEQ ID NO: 917086 - DNA, 22 bp, Artificial Sequence
  chemically synthesized
ccttaaaatccagcactatatc

SEQ ID NO: 917087 - DNA, 22 bp, Artificial Sequence
  chemically synthesized
cttaaaatccagcactatatcc

SEQ ID NO: 917088 - DNA, 22 bp, Artificial Sequence
  chemically synthesized
aaaatccagcactatatccata

SEQ ID NO: 917089 - DNA, 22 bp, Artificial Sequence
  chemically synthesized
aaatccagcactatatccatat

SEQ ID NO: 917090 - DNA, 22 bp, Artificial Sequence
  chemically synthesized
tatgatgaatcctgatatggat

SEQ ID NO: 917091 - DNA, 22 bp, Artificial Sequence
  chemically synthesized
tatccatatcaggattcatcat

SEQ ID NO: 917092 - DNA, 22 bp, Artificial Sequence
  chemically synthesized
atcatacaatgttccctctgcc

SEQ ID NO: 917093 - DNA, 22 bp, Artificial Sequence
  chemically synthesized
cctctgcctgggatgtccttcc

SEQ ID NO: 917094 - DNA, 22 bp, Artificial Sequence
  chemically synthesized
gatgaagatgtatggaaggaca

SEQ ID NO: 917095 - DNA, 22 bp, Artificial Sequence
  chemically synthesized
tgcctgggatgtccttccatac

SEQ ID NO: 917096 - DNA, 22 bp, Artificial Sequence
  chemically synthesized
cctagatgaagatgtatggaag

SEQ ID NO: 917097 - DNA, 22 bp, Artificial Sequence
  chemically synthesized
cctgggatgtccttccatacat

SEQ ID NO: 917098 - DNA, 22 bp, Artificial Sequence
  chemically synthesized
ggatgtccttccatacatcttc

SEQ ID NO: 917099 - DNA, 22 bp, Artificial Sequence
  chemically synthesized
gagctacctagatgaagatgta

SEQ ID NO: 917100 - DNA, 22 bp, Artificial Sequence
  chemically synthesized
ccatacatcttcatctaggtag

SEQ ID NO: 917101 - DNA, 22 bp, Artificial Sequence
  chemically synthesized
catacatcttcatctaggtagc

SEQ ID NO: 917102 - DNA, 22 bp, Artificial Sequence
  chemically synthesized
gaaaggtcaacctggagctacc

SEQ ID NO: 917103 - DNA, 22 bp, Artificial Sequence
  chemically synthesized
catctaggtagctccaggttga

SEQ ID NO: 917104 - DNA, 22 bp, Artificial Sequence
  chemically synthesized
agattggaaaggtcaacctgga

SEQ ID NO: 917105 - DNA, 22 bp, Artificial Sequence
  chemically synthesized
atctaggtagctccaggttgac

SEQ ID NO: 917106 - DNA, 22 bp, Artificial Sequence
  chemically synthesized
acctgagattggaaaggtcaac

SEQ ID NO: 917107 - DNA, 22 bp, Artificial Sequence
  chemically synthesized
ggtagctccaggttgacctttc

SEQ ID NO: 917108 - DNA, 22 bp, Artificial Sequence
  chemically synthesized
caggttgacctttccaatctca

SEQ ID NO: 917109 - DNA, 22 bp, Artificial Sequence
  chemically synthesized
acctttccaatctcaggttaga

SEQ ID NO: 917110 - DNA, 22 bp, Artificial Sequence
  chemically synthesized
tagaggaagtgatgtctaacct

SEQ ID NO: 917111 - DNA, 22 bp, Artificial Sequence
  chemically synthesized
gtagaggaagtgatgtctaacc

SEQ ID NO: 917112 - DNA, 22 bp, Artificial Sequence
  chemically synthesized
tgtagaggaagtgatgtctaac

SEQ ID NO: 917113 - DNA, 22 bp, Artificial Sequence
  chemically synthesized
tccaatctcaggttagacatca

SEQ ID NO: 917114 - DNA, 22 bp, Artificial Sequence
  chemically synthesized
ccaatctcaggttagacatcac

SEQ ID NO: 917115 - DNA, 22 bp, Artificial Sequence
  chemically synthesized
caatctcaggttagacatcact

SEQ ID NO: 917116 - DNA, 22 bp, Artificial Sequence
  chemically synthesized
aggttagacatcacttcctcta

SEQ ID NO: 917117 - DNA, 22 bp, Artificial Sequence
  chemically synthesized
atcaaggaaagctttgtagagg

SEQ ID NO: 917118 - DNA, 22 bp, Artificial Sequence
  chemically synthesized
gacatcacttcctctacaaagc

SEQ ID NO: 917119 - DNA, 22 bp, Artificial Sequence
  chemically synthesized
attaatcaaggaaagctttgta

SEQ ID NO: 917120 - DNA, 22 bp, Artificial Sequence
  chemically synthesized
cctctacaaagctttccttgat

SEQ ID NO: 917121 - DNA, 22 bp, Artificial Sequence
  chemically synthesized
ctctacaaagctttccttgatt

SEQ ID NO: 917122 - DNA, 22 bp, Artificial Sequence
  chemically synthesized
gggatgtctaattaatcaagga

SEQ ID NO: 917123 - DNA, 22 bp, Artificial Sequence
  chemically synthesized
tacaaagctttccttgattaat

SEQ ID NO: 917124 - DNA, 22 bp, Artificial Sequence
  chemically synthesized
caaagctttccttgattaatta

SEQ ID NO: 917125 - DNA, 22 bp, Artificial Sequence
  chemically synthesized
ggttggggatgtctaattaatc

SEQ ID NO: 917126 - DNA, 22 bp, Artificial Sequence
  chemically synthesized
tacctgggttggggatgtctaa

SEQ ID NO: 917127 - DNA, 22 bp, Artificial Sequence
  chemically synthesized
tccttgattaattagacatccc

SEQ ID NO: 917128 - DNA, 22 bp, Artificial Sequence
  chemically synthesized
ccttgattaattagacatcccc

SEQ ID NO: 917129 - DNA, 22 bp, Artificial Sequence
  chemically synthesized
cttgattaattagacatcccca

SEQ ID NO: 917130 - DNA, 22 bp, Artificial Sequence
  chemically synthesized
gattaattagacatccccaacc

SEQ ID NO: 917131 - DNA, 22 bp, Artificial Sequence
  chemically synthesized
attaattagacatccccaaccc

SEQ ID NO: 917132 - DNA, 22 bp, Artificial Sequence
  chemically synthesized
tgacctatacctgggttgggga

SEQ ID NO: 917133 - DNA, 22 bp, Artificial Sequence
  chemically synthesized
attagacatccccaacccaggt

SEQ ID NO: 917134 - DNA, 22 bp, Artificial Sequence
  chemically synthesized
gacatccccaacccaggtatag

SEQ ID NO: 917135 - DNA, 22 bp, Artificial Sequence
  chemically synthesized
cataacaggacctgtgacctat

SEQ ID NO: 917136 - DNA, 22 bp, Artificial Sequence
  chemically synthesized
tgggactacataacaggacctg

SEQ ID NO: 917137 - DNA, 22 bp, Artificial Sequence
  chemically synthesized
tgaggggctgtgggactacata

SEQ ID NO: 917138 - DNA, 22 bp, Artificial Sequence
  chemically synthesized
ttatgtagtcccacagcccctc

SEQ ID NO: 917139 - DNA, 22 bp, Artificial Sequence
  chemically synthesized
tgtagtcccacagcccctcata

SEQ ID NO: 917140 - DNA, 22 bp, Artificial Sequence
  chemically synthesized
tgatggaaacattatgaggggc

SEQ ID NO: 917141 - DNA, 22 bp, Artificial Sequence
  chemically synthesized
ctgtgatggaaacattatgagg

SEQ ID NO: 917142 - DNA, 22 bp, Artificial Sequence
  chemically synthesized
cctgtgatggaaacattatgag

SEQ ID NO: 917143 - DNA, 22 bp, Artificial Sequence
  chemically synthesized
cagtatttcctgtgatggaaac

SEQ ID NO: 917144 - DNA, 22 bp, Artificial Sequence
  chemically synthesized
ataatgtttccatcacaggaaa

SEQ ID NO: 917145 - DNA, 22 bp, Artificial Sequence
  chemically synthesized
ccatcacaggaaatactgtaat

SEQ ID NO: 917146 - DNA, 22 bp, Artificial Sequence
  chemically synthesized
catcacaggaaatactgtaatt

SEQ ID NO: 917147 - DNA, 22 bp, Artificial Sequence
  chemically synthesized
atgaacatgggaaattacagta

SEQ ID NO: 917148 - DNA, 22 bp, Artificial Sequence
  chemically synthesized
gatgaacatgggaaattacagt

SEQ ID NO: 917149 - DNA, 22 bp, Artificial Sequence
  chemically synthesized
caatagtttgatgaacatggga

SEQ ID NO: 917150 - DNA, 22 bp, Artificial Sequence
  chemically synthesized
taatttcccatgttcatcaaac

SEQ ID NO: 917151 - DNA, 22 bp, Artificial Sequence
  chemically synthesized
cccatgttcatcaaactattgc

SEQ ID NO: 917152 - DNA, 22 bp, Artificial Sequence
  chemically synthesized
ccatgttcatcaaactattgca

SEQ ID NO: 917153 - DNA, 22 bp, Artificial Sequence
  chemically synthesized
atcaaactattgcagattttct

SEQ ID NO: 917154 - DNA, 22 bp, Artificial Sequence
  chemically synthesized
ttgcagattttctatctattgt

SEQ ID NO: 917155 - DNA, 22 bp, Artificial Sequence
  chemically synthesized
cagattttctatctattgtgat

SEQ ID NO: 917156 - DNA, 22 bp, Artificial Sequence
  chemically synthesized
aggatagggtgcgatcacaata

SEQ ID NO: 917157 - DNA, 22 bp, Artificial Sequence
  chemically synthesized
tctatctattgtgatcgcaccc

SEQ ID NO: 917158 - DNA, 22 bp, Artificial Sequence
  chemically synthesized
ctatctattgtgatcgcaccct

SEQ ID NO: 917159 - DNA, 22 bp, Artificial Sequence
  chemically synthesized
agtactgaggatagggtgcgat

SEQ ID NO: 917160 - DNA, 22 bp, Artificial Sequence
  chemically synthesized
tatctattgtgatcgcacccta

SEQ ID NO: 917161 - DNA, 22 bp, Artificial Sequence
  chemically synthesized
tctattgtgatcgcaccctatc

SEQ ID NO: 917162 - DNA, 22 bp, Artificial Sequence
  chemically synthesized
ttgtgatcgcaccctatcctca

SEQ ID NO: 917163 - DNA, 22 bp, Artificial Sequence
  chemically synthesized
tatgctaagtactgaggatagg

SEQ ID NO: 917164 - DNA, 22 bp, Artificial Sequence
  chemically synthesized
tgatcgcaccctatcctcagta

SEQ ID NO: 917165 - DNA, 22 bp, Artificial Sequence
  chemically synthesized
agcaaatactatatgctaagta

SEQ ID NO: 917166 - DNA, 22 bp, Artificial Sequence
  chemically synthesized
tcctcagtacttagcatatagt

SEQ ID NO: 917167 - DNA, 22 bp, Artificial Sequence
  chemically synthesized
agtacttagcatatagtatttg

SEQ ID NO: 917168 - DNA, 22 bp, Artificial Sequence
  chemically synthesized
atataggaactaagcaaatact

SEQ ID NO: 917169 - DNA, 22 bp, Artificial Sequence
  chemically synthesized
ttaatataggaactaagcaaat

SEQ ID NO: 917170 - DNA, 22 bp, Artificial Sequence
  chemically synthesized
agcatatagtatttgcttagtt

SEQ ID NO: 917171 - DNA, 22 bp, Artificial Sequence
  chemically synthesized
gcatatagtatttgcttagttc

SEQ ID NO: 917172 - DNA, 22 bp, Artificial Sequence
  chemically synthesized
ggagattattaatataggaact

SEQ ID NO: 917173 - DNA, 22 bp, Artificial Sequence
  chemically synthesized
gcttagttcctatattaataat

SEQ ID NO: 917174 - DNA, 22 bp, Artificial Sequence
  chemically synthesized
cttagttcctatattaataatc

SEQ ID NO: 917175 - DNA, 22 bp, Artificial Sequence
  chemically synthesized
agttcctatattaataatctcc

SEQ ID NO: 917176 - DNA, 22 bp, Artificial Sequence
  chemically synthesized
gttcctatattaataatctcct

SEQ ID NO: 917177 - DNA, 22 bp, Artificial Sequence
  chemically synthesized
agatgatgtcattaggagatta

SEQ ID NO: 917178 - DNA, 22 bp, Artificial Sequence
  chemically synthesized
ctatattaataatctcctaatg

SEQ ID NO: 917179 - DNA, 22 bp, Artificial Sequence
  chemically synthesized
tattaataatctcctaatgaca

SEQ ID NO: 917180 - DNA, 22 bp, Artificial Sequence
  chemically synthesized
ataatctcctaatgacatcatc

SEQ ID NO: 917181 - DNA, 22 bp, Artificial Sequence
  chemically synthesized
gagatatacaattaagatgatg

SEQ ID NO: 917182 - DNA, 22 bp, Artificial Sequence
  chemically synthesized
ggagatatacaattaagatgat

SEQ ID NO: 917183 - DNA, 22 bp, Artificial Sequence
  chemically synthesized
cttggagatatacaattaagat

SEQ ID NO: 917184 - DNA, 22 bp, Artificial Sequence
  chemically synthesized
ctaatgacatcatcttaattgt

SEQ ID NO: 917185 - DNA, 22 bp, Artificial Sequence
  chemically synthesized
ttacttggagatatacaattaa

SEQ ID NO: 917186 - DNA, 22 bp, Artificial Sequence
  chemically synthesized
atgacatcatcttaattgtata

SEQ ID NO: 917187 - DNA, 22 bp, Artificial Sequence
  chemically synthesized
tgaaataatgttattacttgga

SEQ ID NO: 917188 - DNA, 22 bp, Artificial Sequence
  chemically synthesized
aattgtatatctccaagtaata

SEQ ID NO: 917189 - DNA, 22 bp, Artificial Sequence
  chemically synthesized
attgtatatctccaagtaataa

SEQ ID NO: 917190 - DNA, 22 bp, Artificial Sequence
  chemically synthesized
ctatgaaataatgttattactt

SEQ ID NO: 917191 - DNA, 22 bp, Artificial Sequence
  chemically synthesized
tatatctccaagtaataacatt

SEQ ID NO: 917192 - DNA, 22 bp, Artificial Sequence
  chemically synthesized
cccagactactatgaaataatg

SEQ ID NO: 917193 - DNA, 22 bp, Artificial Sequence
  chemically synthesized
caagtaataacattatttcata

SEQ ID NO: 917194 - DNA, 22 bp, Artificial Sequence
  chemically synthesized
atggaaaatctccccagactac

SEQ ID NO: 917195 - DNA, 22 bp, Artificial Sequence
  chemically synthesized
catggaaaatctccccagacta

SEQ ID NO: 917196 - DNA, 22 bp, Artificial Sequence
  chemically synthesized
ttcatggaaaatctccccagac

SEQ ID NO: 917197 - DNA, 22 bp, Artificial Sequence
  chemically synthesized
tttcatagtagtctggggagat

SEQ ID NO: 917198 - DNA, 22 bp, Artificial Sequence
  chemically synthesized
ttcttcatggaaaatctcccca

SEQ ID NO: 917199 - DNA, 22 bp, Artificial Sequence
  chemically synthesized
gttcttcatggaaaatctcccc

SEQ ID NO: 917200 - DNA, 22 bp, Artificial Sequence
  chemically synthesized
catagtagtctggggagatttt

SEQ ID NO: 917201 - DNA, 22 bp, Artificial Sequence
  chemically synthesized
tgttcttcatggaaaatctccc

SEQ ID NO: 917202 - DNA, 22 bp, Artificial Sequence
  chemically synthesized
atagtagtctggggagattttc

SEQ ID NO: 917203 - DNA, 22 bp, Artificial Sequence
  chemically synthesized
gggagattttccatgaagaaca

SEQ ID NO: 917204 - DNA, 22 bp, Artificial Sequence
  chemically synthesized
ccatacacacacactttgttct

SEQ ID NO: 917205 - DNA, 22 bp, Artificial Sequence
  chemically synthesized
cctcccatacacacacactttg

SEQ ID NO: 917206 - DNA, 22 bp, Artificial Sequence
  chemically synthesized
tccatgaagaacaaagtgtgtg

SEQ ID NO: 917207 - DNA, 22 bp, Artificial Sequence
  chemically synthesized
ccatgaagaacaaagtgtgtgt

SEQ ID NO: 917208 - DNA, 22 bp, Artificial Sequence
  chemically synthesized
catgaagaacaaagtgtgtgtg

SEQ ID NO: 917209 - DNA, 22 bp, Artificial Sequence
  chemically synthesized
tacagaacctgcctcccataca

SEQ ID NO: 917210 - DNA, 22 bp, Artificial Sequence
  chemically synthesized
atacagaacctgcctcccatac

SEQ ID NO: 917211 - DNA, 22 bp, Artificial Sequence
  chemically synthesized
tatacagaacctgcctcccata

SEQ ID NO: 917212 - DNA, 22 bp, Artificial Sequence
  chemically synthesized
attttatacagaacctgcctcc

SEQ ID NO: 917213 - DNA, 22 bp, Artificial Sequence
  chemically synthesized
gttaattttatacagaacctgc

SEQ ID NO: 917214 - DNA, 22 bp, Artificial Sequence
  chemically synthesized
cgttaattttatacagaacctg

SEQ ID NO: 917215 - DNA, 22 bp, Artificial Sequence
  chemically synthesized
aatttcgttaattttatacaga

SEQ ID NO: 917216 - DNA, 22 bp, Artificial Sequence
  chemically synthesized
gttgaatttcgttaattttata

SEQ ID NO: 917217 - DNA, 22 bp, Artificial Sequence
  chemically synthesized
cctggttgaatttcgttaattt

SEQ ID NO: 917218 - DNA, 22 bp, Artificial Sequence
  chemically synthesized
ccctggttgaatttcgttaatt

SEQ ID NO: 917219 - DNA, 22 bp, Artificial Sequence
  chemically synthesized
tccctggttgaatttcgttaat

SEQ ID NO: 917220 - DNA, 22 bp, Artificial Sequence
  chemically synthesized
tgtataaaattaacgaaattca

SEQ ID NO: 917221 - DNA, 22 bp, Artificial Sequence
  chemically synthesized
tataaaattaacgaaattcaac

SEQ ID NO: 917222 - DNA, 22 bp, Artificial Sequence
  chemically synthesized
tatagctttccctggttgaatt

SEQ ID NO: 917223 - DNA, 22 bp, Artificial Sequence
  chemically synthesized
ctgtatagctttccctggttga

SEQ ID NO: 917224 - DNA, 22 bp, Artificial Sequence
  chemically synthesized
gctgtatagctttccctggttg

SEQ ID NO: 917225 - DNA, 22 bp, Artificial Sequence
  chemically synthesized
acgaaattcaaccagggaaagc

SEQ ID NO: 917226 - DNA, 22 bp, Artificial Sequence
  chemically synthesized
caaacacttgctgtatagcttt

SEQ ID NO: 917227 - DNA, 22 bp, Artificial Sequence
  chemically synthesized
acaaacacttgctgtatagctt

SEQ ID NO: 917228 - DNA, 22 bp, Artificial Sequence
  chemically synthesized
aaccagggaaagctatacagca

SEQ ID NO: 917229 - DNA, 22 bp, Artificial Sequence
  chemically synthesized
atgagccatagtttacaaacac

SEQ ID NO: 917230 - DNA, 22 bp, Artificial Sequence
  chemically synthesized
tacagcaagtgtttgtaaacta

SEQ ID NO: 917231 - DNA, 22 bp, Artificial Sequence
  chemically synthesized
gttcatgagccatagtttacaa

SEQ ID NO: 917232 - DNA, 22 bp, Artificial Sequence
  chemically synthesized
ggttcatgagccatagtttaca

SEQ ID NO: 917233 - DNA, 22 bp, Artificial Sequence
  chemically synthesized
gtaaactatggctcatgaacca

SEQ ID NO: 917234 - DNA, 22 bp, Artificial Sequence
  chemically synthesized
taaactatggctcatgaaccaa

SEQ ID NO: 917235 - DNA, 22 bp, Artificial Sequence
  chemically synthesized
tggctcatgaaccaagttgtgc

SEQ ID NO: 917236 - DNA, 22 bp, Artificial Sequence
  chemically synthesized
caaaaacaggtggtgagcacaa

SEQ ID NO: 917237 - DNA, 22 bp, Artificial Sequence
  chemically synthesized
acaaaaacaggtggtgagcaca

SEQ ID NO: 917238 - DNA, 22 bp, Artificial Sequence
  chemically synthesized
atgaaccaagttgtgctcacca

SEQ ID NO: 917239 - DNA, 22 bp, Artificial Sequence
  chemically synthesized
tttacaaaaacaggtggtgagc

SEQ ID NO: 917240 - DNA, 22 bp, Artificial Sequence
  chemically synthesized
atttacaaaaacaggtggtgag

SEQ ID NO: 917241 - DNA, 22 bp, Artificial Sequence
  chemically synthesized
tatttacaaaaacaggtggtga

SEQ ID NO: 917242 - DNA, 22 bp, Artificial Sequence
  chemically synthesized
tgctcaccacctgtttttgtaa

SEQ ID NO: 917243 - DNA, 22 bp, Artificial Sequence
  chemically synthesized
cagtaaaactttatttacaaaa

SEQ ID NO: 917244 - DNA, 22 bp, Artificial Sequence
  chemically synthesized
accacctgtttttgtaaataaa

SEQ ID NO: 917245 - DNA, 22 bp, Artificial Sequence
  chemically synthesized
ttccagtaaaactttatttaca

SEQ ID NO: 917246 - DNA, 22 bp, Artificial Sequence
  chemically synthesized
tgttccagtaaaactttattta

SEQ ID NO: 917247 - DNA, 22 bp, Artificial Sequence
  chemically synthesized
tttttgtaaataaagttttact

SEQ ID NO: 917248 - DNA, 22 bp, Artificial Sequence
  chemically synthesized
ttgtaaataaagttttactgga

SEQ ID NO: 917249 - DNA, 22 bp, Artificial Sequence
  chemically synthesized
tgtaaataaagttttactggaa

SEQ ID NO: 917250 - DNA, 22 bp, Artificial Sequence
  chemically synthesized
gtaaataaagttttactggaac

SEQ ID NO: 917251 - DNA, 22 bp, Artificial Sequence
  chemically synthesized
taaataaagttttactggaaca

SEQ ID NO: 917252 - DNA, 22 bp, Artificial Sequence
  chemically synthesized
tactggaacagagctacactca

SEQ ID NO: 917253 - DNA, 22 bp, Artificial Sequence
  chemically synthesized
actggaacagagctacactcat

SEQ ID NO: 917254 - DNA, 22 bp, Artificial Sequence
  chemically synthesized
ctggaacagagctacactcatt

SEQ ID NO: 917255 - DNA, 22 bp, Artificial Sequence
  chemically synthesized
gaacagagctacactcattcat

SEQ ID NO: 917256 - DNA, 22 bp, Artificial Sequence
  chemically synthesized
cactcattcatttacatattgt

SEQ ID NO: 917257 - DNA, 22 bp, Artificial Sequence
  chemically synthesized
attcatttacatattgtctatg

SEQ ID NO: 917258 - DNA, 22 bp, Artificial Sequence
  chemically synthesized
tagcatgaaagtaaccatagac

SEQ ID NO: 917259 - DNA, 22 bp, Artificial Sequence
  chemically synthesized
atttacatattgtctatggtta

SEQ ID NO: 917260 - DNA, 22 bp, Artificial Sequence
  chemically synthesized
ttgtagcatgaaagtaaccata

SEQ ID NO: 917261 - DNA, 22 bp, Artificial Sequence
  chemically synthesized
acatattgtctatggttacttt

SEQ ID NO: 917262 - DNA, 22 bp, Artificial Sequence
  chemically synthesized
catattgtctatggttactttc

SEQ ID NO: 917263 - DNA, 22 bp, Artificial Sequence
  chemically synthesized
ctattgtagcatgaaagtaacc

SEQ ID NO: 917264 - DNA, 22 bp, Artificial Sequence
  chemically synthesized
tgctattgtagcatgaaagtaa

SEQ ID NO: 917265 - DNA, 22 bp, Artificial Sequence
  chemically synthesized
tctatggttactttcatgctac

SEQ ID NO: 917266 - DNA, 22 bp, Artificial Sequence
  chemically synthesized
aactctgctattgtagcatgaa

SEQ ID NO: 917267 - DNA, 22 bp, Artificial Sequence
  chemically synthesized
ctcaactctgctattgtagcat

SEQ ID NO: 917268 - DNA, 22 bp, Artificial Sequence
  chemically synthesized
tggttactttcatgctacaata

SEQ ID NO: 917269 - DNA, 22 bp, Artificial Sequence
  chemically synthesized
caactactcaactctgctattg

SEQ ID NO: 917270 - DNA, 22 bp, Artificial Sequence
  chemically synthesized
ctttcatgctacaatagcagag

SEQ ID NO: 917271 - DNA, 22 bp, Artificial Sequence
  chemically synthesized
ctgcaactactcaactctgcta

SEQ ID NO: 917272 - DNA, 22 bp, Artificial Sequence
  chemically synthesized
tcatgctacaatagcagagttg

SEQ ID NO: 917273 - DNA, 22 bp, Artificial Sequence
  chemically synthesized
gctgcaactactcaactctgct

SEQ ID NO: 917274 - DNA, 22 bp, Artificial Sequence
  chemically synthesized
catgctacaatagcagagttga

SEQ ID NO: 917275 - DNA, 22 bp, Artificial Sequence
  chemically synthesized
tgctgcaactactcaactctgc

SEQ ID NO: 917276 - DNA, 22 bp, Artificial Sequence
  chemically synthesized
atgctacaatagcagagttgag

SEQ ID NO: 917277 - DNA, 22 bp, Artificial Sequence
  chemically synthesized
aatctttgctgcaactactcaa

SEQ ID NO: 917278 - DNA, 22 bp, Artificial Sequence
  chemically synthesized
caatagcagagttgagtagttg

SEQ ID NO: 917279 - DNA, 22 bp, Artificial Sequence
  chemically synthesized
tgggccattcaatctttgctgc

SEQ ID NO: 917280 - DNA, 22 bp, Artificial Sequence
  chemically synthesized
gtgggccattcaatctttgctg

SEQ ID NO: 917281 - DNA, 22 bp, Artificial Sequence
  chemically synthesized
tgtgggccattcaatctttgct

SEQ ID NO: 917282 - DNA, 22 bp, Artificial Sequence
  chemically synthesized
agtagttgcagcaaagattgaa

SEQ ID NO: 917283 - DNA, 22 bp, Artificial Sequence
  chemically synthesized
gctttgtgggccattcaatctt

SEQ ID NO: 917284 - DNA, 22 bp, Artificial Sequence
  chemically synthesized
ggctttgtgggccattcaatct

SEQ ID NO: 917285 - DNA, 22 bp, Artificial Sequence
  chemically synthesized
tggctttgtgggccattcaatc

SEQ ID NO: 917286 - DNA, 22 bp, Artificial Sequence
  chemically synthesized
cagcaaagattgaatggcccac

SEQ ID NO: 917287 - DNA, 22 bp, Artificial Sequence
  chemically synthesized
aatgcctttggctttgtgggcc

SEQ ID NO: 917288 - DNA, 22 bp, Artificial Sequence
  chemically synthesized
aatggcccacaaagccaaaggc

SEQ ID NO: 917289 - DNA, 22 bp, Artificial Sequence
  chemically synthesized
agtaaagtgccagatactaaat

SEQ ID NO: 917290 - DNA, 22 bp, Artificial Sequence
  chemically synthesized
gagtaaagtgccagatactaaa

SEQ ID NO: 917291 - DNA, 22 bp, Artificial Sequence
  chemically synthesized
agtatctggcactttactcaag

SEQ ID NO: 917292 - DNA, 22 bp, Artificial Sequence
  chemically synthesized
gtatctggcactttactcaagt

SEQ ID NO: 917293 - DNA, 22 bp, Artificial Sequence
  chemically synthesized
gcactttactcaagtttaccac

SEQ ID NO: 917294 - DNA, 22 bp, Artificial Sequence
  chemically synthesized
tcacatagcagatggtggtaaa

SEQ ID NO: 917295 - DNA, 22 bp, Artificial Sequence
  chemically synthesized
atcacatagcagatggtggtaa

SEQ ID NO: 917296 - DNA, 22 bp, Artificial Sequence
  chemically synthesized
tactcaagtttaccaccatctg

SEQ ID NO: 917297 - DNA, 22 bp, Artificial Sequence
  chemically synthesized
actcaagtttaccaccatctgc

SEQ ID NO: 917298 - DNA, 22 bp, Artificial Sequence
  chemically synthesized
ctcaagtttaccaccatctgct

SEQ ID NO: 917299 - DNA, 22 bp, Artificial Sequence
  chemically synthesized
aagtttaccaccatctgctatg

SEQ ID NO: 917300 - DNA, 22 bp, Artificial Sequence
  chemically synthesized
agaaggagatttatcacatagc

SEQ ID NO: 917301 - DNA, 22 bp, Artificial Sequence
  chemically synthesized
accaccatctgctatgtgataa

SEQ ID NO: 917302 - DNA, 22 bp, Artificial Sequence
  chemically synthesized
ccaccatctgctatgtgataaa

SEQ ID NO: 917303 - DNA, 22 bp, Artificial Sequence
  chemically synthesized
gtagatgtctaagaaggagatt

SEQ ID NO: 917304 - DNA, 22 bp, Artificial Sequence
  chemically synthesized
ctatgtgataaatctccttctt

SEQ ID NO: 917305 - DNA, 22 bp, Artificial Sequence
  chemically synthesized
cctagtagatgtctaagaagga

SEQ ID NO: 917306 - DNA, 22 bp, Artificial Sequence
  chemically synthesized
tgtgataaatctccttcttaga

SEQ ID NO: 917307 - DNA, 22 bp, Artificial Sequence
  chemically synthesized
attccctagtagatgtctaaga

SEQ ID NO: 917308 - DNA, 22 bp, Artificial Sequence
  chemically synthesized
aattccctagtagatgtctaag

SEQ ID NO: 917309 - DNA, 22 bp, Artificial Sequence
  chemically synthesized
taattccctagtagatgtctaa

SEQ ID NO: 917310 - DNA, 22 bp, Artificial Sequence
  chemically synthesized
gtatctttaattccctagtaga

SEQ ID NO: 917311 - DNA, 22 bp, Artificial Sequence
  chemically synthesized
cttcttagacatctactaggga

SEQ ID NO: 917312 - DNA, 22 bp, Artificial Sequence
  chemically synthesized
tcgtatctttaattccctagta

SEQ ID NO: 917313 - DNA, 22 bp, Artificial Sequence
  chemically synthesized
cttagacatctactagggaatt

SEQ ID NO: 917314 - DNA, 22 bp, Artificial Sequence
  chemically synthesized
ttagacatctactagggaatta

SEQ ID NO: 917315 - DNA, 22 bp, Artificial Sequence
  chemically synthesized
agacatctactagggaattaaa

SEQ ID NO: 917316 - DNA, 22 bp, Artificial Sequence
  chemically synthesized
gacatctactagggaattaaag

SEQ ID NO: 917317 - DNA, 22 bp, Artificial Sequence
  chemically synthesized
tatcagaactctcgtatcttta

SEQ ID NO: 917318 - DNA, 22 bp, Artificial Sequence
  chemically synthesized
atatcagaactctcgtatcttt

SEQ ID NO: 917319 - DNA, 22 bp, Artificial Sequence
  chemically synthesized
ctagggaattaaagatacgaga

SEQ ID NO: 917320 - DNA, 22 bp, Artificial Sequence
  chemically synthesized
ttatatcagaactctcgtatct

SEQ ID NO: 917321 - DNA, 22 bp, Artificial Sequence
  chemically synthesized
cttatatcagaactctcgtatc

SEQ ID NO: 917322 - DNA, 22 bp, Artificial Sequence
  chemically synthesized
tcttatatcagaactctcgtat

SEQ ID NO: 917323 - DNA, 22 bp, Artificial Sequence
  chemically synthesized
gggaattaaagatacgagagtt

SEQ ID NO: 917324 - DNA, 22 bp, Artificial Sequence
  chemically synthesized
aagatacgagagttctgatata

SEQ ID NO: 917325 - DNA, 22 bp, Artificial Sequence
  chemically synthesized
tacagattttcttatatcagaa

SEQ ID NO: 917326 - DNA, 22 bp, Artificial Sequence
  chemically synthesized
tagagattatacagattttctt

SEQ ID NO: 917327 - DNA, 22 bp, Artificial Sequence
  chemically synthesized
atagagattatacagattttct

SEQ ID NO: 917328 - DNA, 22 bp, Artificial Sequence
  chemically synthesized
gtttatagagattatacagatt

SEQ ID NO: 917329 - DNA, 22 bp, Artificial Sequence
  chemically synthesized
tgatataagaaaatctgtataa

SEQ ID NO: 917330 - DNA, 22 bp, Artificial Sequence
  chemically synthesized
atataagaaaatctgtataatc

SEQ ID NO: 917331 - DNA, 22 bp, Artificial Sequence
  chemically synthesized
gcataccactggtttatagaga

SEQ ID NO: 917332 - DNA, 22 bp, Artificial Sequence
  chemically synthesized
cgcataccactggtttatagag

SEQ ID NO: 917333 - DNA, 22 bp, Artificial Sequence
  chemically synthesized
tataatctctataaaccagtgg

SEQ ID NO: 917334 - DNA, 22 bp, Artificial Sequence
  chemically synthesized
atgacttcgcataccactggtt

SEQ ID NO: 917335 - DNA, 22 bp, Artificial Sequence
  chemically synthesized
catgacttcgcataccactggt

SEQ ID NO: 917336 - DNA, 22 bp, Artificial Sequence
  chemically synthesized
tcatgacttcgcataccactgg

SEQ ID NO: 917337 - DNA, 22 bp, Artificial Sequence
  chemically synthesized
tataaaccagtggtatgcgaag

SEQ ID NO: 917338 - DNA, 22 bp, Artificial Sequence
  chemically synthesized
taaaccagtggtatgcgaagtc

SEQ ID NO: 917339 - DNA, 22 bp, Artificial Sequence
  chemically synthesized
tcatagatattttcatgacttc

SEQ ID NO: 917340 - DNA, 22 bp, Artificial Sequence
  chemically synthesized
attatcatagatattttcatga

SEQ ID NO: 917341 - DNA, 22 bp, Artificial Sequence
  chemically synthesized
taattatcatagatattttcat

SEQ ID NO: 917342 - DNA, 22 bp, Artificial Sequence
  chemically synthesized
aaggggtgaggagtagttctaa

SEQ ID NO: 917343 - DNA, 22 bp, Artificial Sequence
  chemically synthesized
caaggggtgaggagtagttcta

SEQ ID NO: 917344 - DNA, 22 bp, Artificial Sequence
  chemically synthesized
tttcaaggggtgaggagtagtt

SEQ ID NO: 917345 - DNA, 22 bp, Artificial Sequence
  chemically synthesized
tgataattagaactactcctca

SEQ ID NO: 917346 - DNA, 22 bp, Artificial Sequence
  chemically synthesized
atgattgtttcaaggggtgagg

SEQ ID NO: 917347 - DNA, 22 bp, Artificial Sequence
  chemically synthesized
gaactactcctcaccccttgaa

SEQ ID NO: 917348 - DNA, 22 bp, Artificial Sequence
  chemically synthesized
ctcctcaccccttgaaacaatc

SEQ ID NO: 917349 - DNA, 22 bp, Artificial Sequence
  chemically synthesized
tgtaaagtgctcatgattgttt

SEQ ID NO: 917350 - DNA, 22 bp, Artificial Sequence
  chemically synthesized
ctcaccccttgaaacaatcatg

SEQ ID NO: 917351 - DNA, 22 bp, Artificial Sequence
  chemically synthesized
accccttgaaacaatcatgagc

SEQ ID NO: 917352 - DNA, 22 bp, Artificial Sequence
  chemically synthesized
gaaacaatcatgagcactttac

SEQ ID NO: 917353 - DNA, 22 bp, Artificial Sequence
  chemically synthesized
aaacaatcatgagcactttaca

SEQ ID NO: 917354 - DNA, 22 bp, Artificial Sequence
  chemically synthesized
tgaaataataattgtgtaaagt

SEQ ID NO: 917355 - DNA, 22 bp, Artificial Sequence
  chemically synthesized
tcctgtgaaataataattgtgt

SEQ ID NO: 917356 - DNA, 22 bp, Artificial Sequence
  chemically synthesized
gtcctgtgaaataataattgtg

SEQ ID NO: 917357 - DNA, 22 bp, Artificial Sequence
  chemically synthesized
tttgtcctgtgaaataataatt

SEQ ID NO: 917358 - DNA, 22 bp, Artificial Sequence
  chemically synthesized
tatttgtcctgtgaaataataa

SEQ ID NO: 917359 - DNA, 22 bp, Artificial Sequence
  chemically synthesized
ctatttgtcctgtgaaataata

SEQ ID NO: 917360 - DNA, 22 bp, Artificial Sequence
  chemically synthesized
tctatttgtcctgtgaaataat

SEQ ID NO: 917361 - DNA, 22 bp, Artificial Sequence
  chemically synthesized
ttctatttgtcctgtgaaataa

SEQ ID NO: 917362 - DNA, 22 bp, Artificial Sequence
  chemically synthesized
tacacaattattatttcacagg

SEQ ID NO: 917363 - DNA, 22 bp, Artificial Sequence
  chemically synthesized
acacaattattatttcacagga

SEQ ID NO: 917364 - DNA, 22 bp, Artificial Sequence
  chemically synthesized
cacaattattatttcacaggac

SEQ ID NO: 917365 - DNA, 22 bp, Artificial Sequence
  chemically synthesized
gtttttctatttgtcctgtgaa

SEQ ID NO: 917366 - DNA, 22 bp, Artificial Sequence
  chemically synthesized
ttatttcacaggacaaatagaa

SEQ ID NO: 917367 - DNA, 22 bp, Artificial Sequence
  chemically synthesized
tttcacaggacaaatagaaaaa

SEQ ID NO: 917368 - DNA, 22 bp, Artificial Sequence
  chemically synthesized
cacaggacaaatagaaaaacta

SEQ ID NO: 917369 - DNA, 22 bp, Artificial Sequence
  chemically synthesized
acaggacaaatagaaaaactag

SEQ ID NO: 917370 - DNA, 22 bp, Artificial Sequence
  chemically synthesized
taatcagatgcaatgtctagtt

SEQ ID NO: 917371 - DNA, 22 bp, Artificial Sequence
  chemically synthesized
ataatcagatgcaatgtctagt

SEQ ID NO: 917372 - DNA, 22 bp, Artificial Sequence
  chemically synthesized
atgtttataatcagatgcaatg

SEQ ID NO: 917373 - DNA, 22 bp, Artificial Sequence
  chemically synthesized
gacattgcatctgattataaac

SEQ ID NO: 917374 - DNA, 22 bp, Artificial Sequence
  chemically synthesized
aacagaattaatgtttataatc

SEQ ID NO: 917375 - DNA, 22 bp, Artificial Sequence
  chemically synthesized
aaacagaattaatgtttataat

SEQ ID NO: 917376 - DNA, 22 bp, Artificial Sequence
  chemically synthesized
catctgattataaacattaatt

SEQ ID NO: 917377 - DNA, 22 bp, Artificial Sequence
  chemically synthesized
gtgaatttaaacagaattaatg

SEQ ID NO: 917378 - DNA, 22 bp, Artificial Sequence
  chemically synthesized
attataaacattaattctgttt

SEQ ID NO: 917379 - DNA, 22 bp, Artificial Sequence
  chemically synthesized
taaacattaattctgtttaaat

SEQ ID NO: 917380 - DNA, 22 bp, Artificial Sequence
  chemically synthesized
gaaatgttcgtgaatttaaaca

SEQ ID NO: 917381 - DNA, 22 bp, Artificial Sequence
  chemically synthesized
atagttggaaatgttcgtgaat

SEQ ID NO: 917382 - DNA, 22 bp, Artificial Sequence
  chemically synthesized
attctgtttaaattcacgaaca

SEQ ID NO: 917383 - DNA, 22 bp, Artificial Sequence
  chemically synthesized
tcatagttggaaatgttcgtga

SEQ ID NO: 917384 - DNA, 22 bp, Artificial Sequence
  chemically synthesized
ctcatagttggaaatgttcgtg

SEQ ID NO: 917385 - DNA, 22 bp, Artificial Sequence
  chemically synthesized
tgtttaaattcacgaacatttc

SEQ ID NO: 917386 - DNA, 22 bp, Artificial Sequence
  chemically synthesized
tttaaattcacgaacatttcca

SEQ ID NO: 917387 - DNA, 22 bp, Artificial Sequence
  chemically synthesized
aaattcacgaacatttccaact

SEQ ID NO: 917388 - DNA, 22 bp, Artificial Sequence
  chemically synthesized
aattcacgaacatttccaacta

SEQ ID NO: 917389 - DNA, 22 bp, Artificial Sequence
  chemically synthesized
acgaacatttccaactatgaga

SEQ ID NO: 917390 - DNA, 22 bp, Artificial Sequence
  chemically synthesized
aggtaagtagatatagtttctc

SEQ ID NO: 917391 - DNA, 22 bp, Artificial Sequence
  chemically synthesized
taaggtaagtagatatagtttc

SEQ ID NO: 917392 - DNA, 22 bp, Artificial Sequence
  chemically synthesized
ccaactatgagaaactatatct

SEQ ID NO: 917393 - DNA, 22 bp, Artificial Sequence
  chemically synthesized
caactatgagaaactatatcta

SEQ ID NO: 917394 - DNA, 22 bp, Artificial Sequence
  chemically synthesized
attctaaggtaagtagatatag

SEQ ID NO: 917395 - DNA, 22 bp, Artificial Sequence
  chemically synthesized
gattctaaggtaagtagatata

SEQ ID NO: 917396 - DNA, 22 bp, Artificial Sequence
  chemically synthesized
tgagaaactatatctacttacc

SEQ ID NO: 917397 - DNA, 22 bp, Artificial Sequence
  chemically synthesized
catgtttgattctaaggtaagt

SEQ ID NO: 917398 - DNA, 22 bp, Artificial Sequence
  chemically synthesized
ccatgtttgattctaaggtaag

SEQ ID NO: 917399 - DNA, 22 bp, Artificial Sequence
  chemically synthesized
tccatgtttgattctaaggtaa

SEQ ID NO: 917400 - DNA, 22 bp, Artificial Sequence
  chemically synthesized
ttttccatgtttgattctaagg

SEQ ID NO: 917401 - DNA, 22 bp, Artificial Sequence
  chemically synthesized
tatctacttaccttagaatcaa

SEQ ID NO: 917402 - DNA, 22 bp, Artificial Sequence
  chemically synthesized
actattttccatgtttgattct

SEQ ID NO: 917403 - DNA, 22 bp, Artificial Sequence
  chemically synthesized
gactattttccatgtttgattc

SEQ ID NO: 917404 - DNA, 22 bp, Artificial Sequence
  chemically synthesized
tgactattttccatgtttgatt

SEQ ID NO: 917405 - DNA, 22 bp, Artificial Sequence
  chemically synthesized
ttgactattttccatgtttgat

SEQ ID NO: 917406 - DNA, 22 bp, Artificial Sequence
  chemically synthesized
cttaccttagaatcaaacatgg

SEQ ID NO: 917407 - DNA, 22 bp, Artificial Sequence
  chemically synthesized
accttagaatcaaacatggaaa

SEQ ID NO: 917408 - DNA, 22 bp, Artificial Sequence
  chemically synthesized
ccttagaatcaaacatggaaaa

SEQ ID NO: 917409 - DNA, 22 bp, Artificial Sequence
  chemically synthesized
agaatcaaacatggaaaatagt

SEQ ID NO: 917410 - DNA, 22 bp, Artificial Sequence
  chemically synthesized
gaatcaaacatggaaaatagtc

SEQ ID NO: 917411 - DNA, 22 bp, Artificial Sequence
  chemically synthesized
tgcctctgcctcacttttcttg

SEQ ID NO: 917412 - DNA, 22 bp, Artificial Sequence
  chemically synthesized
tgcctcacttttcttgtcttgg

SEQ ID NO: 917413 - DNA, 22 bp, Artificial Sequence
  chemically synthesized
cctcacttttcttgtcttggct

SEQ ID NO: 917414 - DNA, 22 bp, Artificial Sequence
  chemically synthesized
gcataatgtaaaagccaagaca

SEQ ID NO: 917415 - DNA, 22 bp, Artificial Sequence
  chemically synthesized
acttttcttgtcttggctttta

SEQ ID NO: 917416 - DNA, 22 bp, Artificial Sequence
  chemically synthesized
ttcttgtcttggcttttacatt

SEQ ID NO: 917417 - DNA, 22 bp, Artificial Sequence
  chemically synthesized
tcttgtcttggcttttacatta

SEQ ID NO: 917418 - DNA, 22 bp, Artificial Sequence
  chemically synthesized
cttgtcttggcttttacattat

SEQ ID NO: 917419 - DNA, 22 bp, Artificial Sequence
  chemically synthesized
ttgtcttggcttttacattatg

SEQ ID NO: 917420 - DNA, 22 bp, Artificial Sequence
  chemically synthesized
gtcttggcttttacattatgcc

SEQ ID NO: 917421 - DNA, 22 bp, Artificial Sequence
  chemically synthesized
tcttggcttttacattatgcca

SEQ ID NO: 917422 - DNA, 22 bp, Artificial Sequence
  chemically synthesized
ggcttttacattatgccagttt

SEQ ID NO: 917423 - DNA, 22 bp, Artificial Sequence
  chemically synthesized
gcttttacattatgccagtttc

SEQ ID NO: 917424 - DNA, 22 bp, Artificial Sequence
  chemically synthesized
ttacattatgccagtttcttta

SEQ ID NO: 917425 - DNA, 22 bp, Artificial Sequence
  chemically synthesized
tacattatgccagtttctttat

SEQ ID NO: 917426 - DNA, 22 bp, Artificial Sequence
  chemically synthesized
acattatgccagtttctttata

SEQ ID NO: 917427 - DNA, 22 bp, Artificial Sequence
  chemically synthesized
cattatgccagtttctttatat

SEQ ID NO: 917428 - DNA, 22 bp, Artificial Sequence
  chemically synthesized
ggaagaaagagaaatataaaga

SEQ ID NO: 917429 - DNA, 22 bp, Artificial Sequence
  chemically synthesized
tgccagtttctttatatttctc

SEQ ID NO: 917430 - DNA, 22 bp, Artificial Sequence
  chemically synthesized
tgggttaggaagaaagagaaat

SEQ ID NO: 917431 - DNA, 22 bp, Artificial Sequence
  chemically synthesized
gttgtgggttaggaagaaagag

SEQ ID NO: 917432 - DNA, 22 bp, Artificial Sequence
  chemically synthesized
ctttatatttctctttcttcct

SEQ ID NO: 917433 - DNA, 22 bp, Artificial Sequence
  chemically synthesized
tttatatttctctttcttccta

SEQ ID NO: 917434 - DNA, 22 bp, Artificial Sequence
  chemically synthesized
tatatttctctttcttcctaac

SEQ ID NO: 917435 - DNA, 22 bp, Artificial Sequence
  chemically synthesized
atatttctctttcttcctaacc

SEQ ID NO: 917436 - DNA, 22 bp, Artificial Sequence
  chemically synthesized
tatttctctttcttcctaaccc

SEQ ID NO: 917437 - DNA, 22 bp, Artificial Sequence
  chemically synthesized
ctctttcttcctaacccacaac

SEQ ID NO: 917438 - DNA, 22 bp, Artificial Sequence
  chemically synthesized
tctttcttcctaacccacaacc

SEQ ID NO: 917439 - DNA, 22 bp, Artificial Sequence
  chemically synthesized
tttcttcctaacccacaaccaa

SEQ ID NO: 917440 - DNA, 22 bp, Artificial Sequence
  chemically synthesized
tcttcctaacccacaaccaact

SEQ ID NO: 917441 - DNA, 22 bp, Artificial Sequence
  chemically synthesized
cttcctaacccacaaccaactt

SEQ ID NO: 917442 - DNA, 22 bp, Artificial Sequence
  chemically synthesized
ttcctaacccacaaccaacttt

SEQ ID NO: 917443 - DNA, 22 bp, Artificial Sequence
  chemically synthesized
taaaataaatgataaagttggt

SEQ ID NO: 917444 - DNA, 22 bp, Artificial Sequence
  chemically synthesized
cctaacccacaaccaactttat

SEQ ID NO: 917445 - DNA, 22 bp, Artificial Sequence
  chemically synthesized
ctaacccacaaccaactttatc

SEQ ID NO: 917446 - DNA, 22 bp, Artificial Sequence
  chemically synthesized
acccacaaccaactttatcatt

SEQ ID NO: 917447 - DNA, 22 bp, Artificial Sequence
  chemically synthesized
tatcatttattttataatttca

SEQ ID NO: 917448 - DNA, 22 bp, Artificial Sequence
  chemically synthesized
atcatttattttataatttcac

SEQ ID NO: 917449 - DNA, 22 bp, Artificial Sequence
  chemically synthesized
tcatttattttataatttcacc

SEQ ID NO: 917450 - DNA, 22 bp, Artificial Sequence
  chemically synthesized
agtaacaaaaaagaggtgaaat

SEQ ID NO: 917451 - DNA, 22 bp, Artificial Sequence
  chemically synthesized
attttataatttcacctctttt

SEQ ID NO: 917452 - DNA, 22 bp, Artificial Sequence
  chemically synthesized
ttttataatttcacctcttttt

SEQ ID NO: 917453 - DNA, 22 bp, Artificial Sequence
  chemically synthesized
tataatttcacctcttttttgt

SEQ ID NO: 917454 - DNA, 22 bp, Artificial Sequence
  chemically synthesized
taaaactgagtaacaaaaaaga

SEQ ID NO: 917455 - DNA, 22 bp, Artificial Sequence
  chemically synthesized
ataatttcacctcttttttgtt

SEQ ID NO: 917456 - DNA, 22 bp, Artificial Sequence
  chemically synthesized
taatttcacctcttttttgtta

SEQ ID NO: 917457 - DNA, 22 bp, Artificial Sequence
  chemically synthesized
cacctcttttttgttactcagt

SEQ ID NO: 917458 - DNA, 22 bp, Artificial Sequence
  chemically synthesized
acctcttttttgttactcagtt

SEQ ID NO: 917459 - DNA, 22 bp, Artificial Sequence
  chemically synthesized
ttttttgttactcagttttata

SEQ ID NO: 917460 - DNA, 22 bp, Artificial Sequence
  chemically synthesized
ttttgttactcagttttataat

SEQ ID NO: 917461 - DNA, 22 bp, Artificial Sequence
  chemically synthesized
tttgttactcagttttataatt

SEQ ID NO: 917462 - DNA, 22 bp, Artificial Sequence
  chemically synthesized
ttgttactcagttttataattt

SEQ ID NO: 917463 - DNA, 22 bp, Artificial Sequence
  chemically synthesized
tgttactcagttttataatttc

SEQ ID NO: 917464 - DNA, 22 bp, Artificial Sequence
  chemically synthesized
gttactcagttttataatttca

SEQ ID NO: 917465 - DNA, 22 bp, Artificial Sequence
  chemically synthesized
ttactcagttttataatttcac

SEQ ID NO: 917466 - DNA, 22 bp, Artificial Sequence
  chemically synthesized
ctcagttttataatttcacctc

SEQ ID NO: 917467 - DNA, 22 bp, Artificial Sequence
  chemically synthesized
agtaacaaaataggaggtgaaa

SEQ ID NO: 917468 - DNA, 22 bp, Artificial Sequence
  chemically synthesized
agttttataatttcacctccta

SEQ ID NO: 917469 - DNA, 22 bp, Artificial Sequence
  chemically synthesized
tataatttcacctcctattttg

SEQ ID NO: 917470 - DNA, 22 bp, Artificial Sequence
  chemically synthesized
ataatttcacctcctattttgt

SEQ ID NO: 917471 - DNA, 22 bp, Artificial Sequence
  chemically synthesized
taatttcacctcctattttgtt

SEQ ID NO: 917472 - DNA, 22 bp, Artificial Sequence
  chemically synthesized
cacctcctattttgttactcaa

SEQ ID NO: 917473 - DNA, 22 bp, Artificial Sequence
  chemically synthesized
acctcctattttgttactcaat

SEQ ID NO: 917474 - DNA, 22 bp, Artificial Sequence
  chemically synthesized
ctattttgttactcaatttttt

SEQ ID NO: 917475 - DNA, 22 bp, Artificial Sequence
  chemically synthesized
ttttgttactcaatttttttcc

SEQ ID NO: 917476 - DNA, 22 bp, Artificial Sequence
  chemically synthesized
tgttactcaatttttttcccct

SEQ ID NO: 917477 - DNA, 22 bp, Artificial Sequence
  chemically synthesized
gttactcaatttttttcccctc

SEQ ID NO: 917478 - DNA, 22 bp, Artificial Sequence
  chemically synthesized
ttactcaatttttttcccctct

SEQ ID NO: 917479 - DNA, 22 bp, Artificial Sequence
  chemically synthesized
ctcaatttttttcccctctggg

SEQ ID NO: 917480 - DNA, 22 bp, Artificial Sequence
  chemically synthesized
aatttttttcccctctgggctt

SEQ ID NO: 917481 - DNA, 22 bp, Artificial Sequence
  chemically synthesized
ttttcccctctgggctttatgg

SEQ ID NO: 917482 - DNA, 22 bp, Artificial Sequence
  chemically synthesized
tttcccctctgggctttatggt

SEQ ID NO: 917483 - DNA, 22 bp, Artificial Sequence
  chemically synthesized
ttcccctctgggctttatggtg

SEQ ID NO: 917484 - DNA, 22 bp, Artificial Sequence
  chemically synthesized
tcccctctgggctttatggtga

SEQ ID NO: 917485 - DNA, 22 bp, Artificial Sequence
  chemically synthesized
cccctctgggctttatggtgat

SEQ ID NO: 917486 - DNA, 22 bp, Artificial Sequence
  chemically synthesized
ccctctgggctttatggtgatt

SEQ ID NO: 917487 - DNA, 22 bp, Artificial Sequence
  chemically synthesized
tgggctttatggtgatttttat

SEQ ID NO: 917488 - DNA, 22 bp, Artificial Sequence
  chemically synthesized
ggctttatggtgatttttatta

SEQ ID NO: 917489 - DNA, 22 bp, Artificial Sequence
  chemically synthesized
aaaatacagacacagtaataaa

SEQ ID NO: 917490 - DNA, 22 bp, Artificial Sequence
  chemically synthesized
tatggtgatttttattactgtg

SEQ ID NO: 917491 - DNA, 22 bp, Artificial Sequence
  chemically synthesized
atggtgatttttattactgtgt

SEQ ID NO: 917492 - DNA, 22 bp, Artificial Sequence
  chemically synthesized
tggtgatttttattactgtgtc

SEQ ID NO: 917493 - DNA, 22 bp, Artificial Sequence
  chemically synthesized
ttattactgtgtctgtattttg

SEQ ID NO: 917494 - DNA, 22 bp, Artificial Sequence
  chemically synthesized
ccacgaggaattcaaaatacag

SEQ ID NO: 917495 - DNA, 22 bp, Artificial Sequence
  chemically synthesized
tattactgtgtctgtattttga

SEQ ID NO: 917496 - DNA, 22 bp, Artificial Sequence
  chemically synthesized
attactgtgtctgtattttgaa

SEQ ID NO: 917497 - DNA, 22 bp, Artificial Sequence
  chemically synthesized
ttactgtgtctgtattttgaat

SEQ ID NO: 917498 - DNA, 22 bp, Artificial Sequence
  chemically synthesized
ctaccacgaggaattcaaaata

SEQ ID NO: 917499 - DNA, 22 bp, Artificial Sequence
  chemically synthesized
ctgtgtctgtattttgaattcc

SEQ ID NO: 917500 - DNA, 22 bp, Artificial Sequence
  chemically synthesized
tgtctgtattttgaattcctcg

SEQ ID NO: 917501 - DNA, 22 bp, Artificial Sequence
  chemically synthesized
tattttgaattcctcgtggtag

SEQ ID NO: 917502 - DNA, 22 bp, Artificial Sequence
  chemically synthesized
ggggtggaaagaattactacca

SEQ ID NO: 917503 - DNA, 22 bp, Artificial Sequence
  chemically synthesized
tgaattcctcgtggtagtaatt

SEQ ID NO: 917504 - DNA, 22 bp, Artificial Sequence
  chemically synthesized
gaattcctcgtggtagtaattc

SEQ ID NO: 917505 - DNA, 22 bp, Artificial Sequence
  chemically synthesized
tgggggtggaaagaattactac

SEQ ID NO: 917506 - DNA, 22 bp, Artificial Sequence
  chemically synthesized
aattcctcgtggtagtaattct

SEQ ID NO: 917507 - DNA, 22 bp, Artificial Sequence
  chemically synthesized
ctgggggtggaaagaattacta

SEQ ID NO: 917508 - DNA, 22 bp, Artificial Sequence
  chemically synthesized
tctgggggtggaaagaattact

SEQ ID NO: 917509 - DNA, 22 bp, Artificial Sequence
  chemically synthesized
ttctgggggtggaaagaattac

SEQ ID NO: 917510 - DNA, 22 bp, Artificial Sequence
  chemically synthesized
tttctgggggtggaaagaatta

SEQ ID NO: 917511 - DNA, 22 bp, Artificial Sequence
  chemically synthesized
ctcgtggtagtaattctttcca

SEQ ID NO: 917512 - DNA, 22 bp, Artificial Sequence
  chemically synthesized
gtggtagtaattctttccaccc

SEQ ID NO: 917513 - DNA, 22 bp, Artificial Sequence
  chemically synthesized
tttccacccccagaaaaaatgt

SEQ ID NO: 917514 - DNA, 22 bp, Artificial Sequence
  chemically synthesized
agaaaacagatgacattttttc

SEQ ID NO: 917515 - DNA, 22 bp, Artificial Sequence
  chemically synthesized
gagaaaacagatgacatttttt

SEQ ID NO: 917516 - DNA, 22 bp, Artificial Sequence
  chemically synthesized
tccacccccagaaaaaatgtca

SEQ ID NO: 917517 - DNA, 22 bp, Artificial Sequence
  chemically synthesized
ccacccccagaaaaaatgtcat

SEQ ID NO: 917518 - DNA, 22 bp, Artificial Sequence
  chemically synthesized
cacccccagaaaaaatgtcatc

SEQ ID NO: 917519 - DNA, 22 bp, Artificial Sequence
  chemically synthesized
gaaacatacatagtttgagaaa

SEQ ID NO: 917520 - DNA, 22 bp, Artificial Sequence
  chemically synthesized
cactggaaacatacatagtttg

SEQ ID NO: 917521 - DNA, 22 bp, Artificial Sequence
  chemically synthesized
ttttctcaaactatgtatgttt

SEQ ID NO: 917522 - DNA, 22 bp, Artificial Sequence
  chemically synthesized
atattccactggaaacatacat

SEQ ID NO: 917523 - DNA, 22 bp, Artificial Sequence
  chemically synthesized
tctcaaactatgtatgtttcca

SEQ ID NO: 917524 - DNA, 22 bp, Artificial Sequence
  chemically synthesized
ctcaaactatgtatgtttccag

SEQ ID NO: 917525 - DNA, 22 bp, Artificial Sequence
  chemically synthesized
tcaaactatgtatgtttccagt

SEQ ID NO: 917526 - DNA, 22 bp, Artificial Sequence
  chemically synthesized
aaactatgtatgtttccagtgg

SEQ ID NO: 917527 - DNA, 22 bp, Artificial Sequence
  chemically synthesized
tataatgtattcatattccact

SEQ ID NO: 917528 - DNA, 22 bp, Artificial Sequence
  chemically synthesized
tgtatgtttccagtggaatatg

SEQ ID NO: 917529 - DNA, 22 bp, Artificial Sequence
  chemically synthesized
tatataatgtattcatattcca

SEQ ID NO: 917530 - DNA, 22 bp, Artificial Sequence
  chemically synthesized
cgtctctatataatgtattcat

SEQ ID NO: 917531 - DNA, 22 bp, Artificial Sequence
  chemically synthesized
ccgtctctatataatgtattca

SEQ ID NO: 917532 - DNA, 22 bp, Artificial Sequence
  chemically synthesized
ccagtggaatatgaatacatta

SEQ ID NO: 917533 - DNA, 22 bp, Artificial Sequence
  chemically synthesized
cagtggaatatgaatacattat

SEQ ID NO: 917534 - DNA, 22 bp, Artificial Sequence
  chemically synthesized
gggtttccgtctctatataatg

SEQ ID NO: 917535 - DNA, 22 bp, Artificial Sequence
  chemically synthesized
cgggtttccgtctctatataat

SEQ ID NO: 917536 - DNA, 22 bp, Artificial Sequence
  chemically synthesized
gggaacttcgggtttccgtctc

SEQ ID NO: 917537 - DNA, 22 bp, Artificial Sequence
  chemically synthesized
tggggaacttcgggtttccgtc

SEQ ID NO: 917538 - DNA, 22 bp, Artificial Sequence
  chemically synthesized
tctggggaacttcgggtttccg

SEQ ID NO: 917539 - DNA, 22 bp, Artificial Sequence
  chemically synthesized
tatagagacggaaacccgaagt

SEQ ID NO: 917540 - DNA, 22 bp, Artificial Sequence
  chemically synthesized
actctctggggaacttcgggtt

SEQ ID NO: 917541 - DNA, 22 bp, Artificial Sequence
  chemically synthesized
tcactctctggggaacttcggg

SEQ ID NO: 917542 - DNA, 22 bp, Artificial Sequence
  chemically synthesized
tctcactctctggggaacttcg

SEQ ID NO: 917543 - DNA, 22 bp, Artificial Sequence
  chemically synthesized
tctctcactctctggggaactt

SEQ ID NO: 917544 - DNA, 22 bp, Artificial Sequence
  chemically synthesized
tctctctcactctctggggaac

SEQ ID NO: 917545 - DNA, 22 bp, Artificial Sequence
  chemically synthesized
tctctctctcactctctgggga

SEQ ID NO: 917546 - DNA, 22 bp, Artificial Sequence
  chemically synthesized
tctctctctctcactctctggg

SEQ ID NO: 917547 - DNA, 22 bp, Artificial Sequence
  chemically synthesized
tctctctctctctcactctctg

SEQ ID NO: 917548 - DNA, 22 bp, Artificial Sequence
  chemically synthesized
tctctctctctctctcactctc

SEQ ID NO: 917549 - DNA, 22 bp, Artificial Sequence
  chemically synthesized
tctctctctctctctctcactc

SEQ ID NO: 917550 - DNA, 22 bp, Artificial Sequence
  chemically synthesized
tctctctctctctctctctcac

SEQ ID NO: 917551 - DNA, 22 bp, Artificial Sequence
  chemically synthesized
tctctctctctctctctctctc

SEQ ID NO: 917552 - DNA, 22 bp, Artificial Sequence
  chemically synthesized
cccagagagtgagagagagaga

SEQ ID NO: 917553 - DNA, 22 bp, Artificial Sequence
  chemically synthesized
tctctctctctctctctctctc

SEQ ID NO: 917554 - DNA, 22 bp, Artificial Sequence
  chemically synthesized
tctctctctctctctctctctc

SEQ ID NO: 917555 - DNA, 22 bp, Artificial Sequence
  chemically synthesized
tctctctctctctctctctctc

SEQ ID NO: 917556 - DNA, 22 bp, Artificial Sequence
  chemically synthesized
tctctctctctctctctctctc

SEQ ID NO: 917557 - DNA, 22 bp, Artificial Sequence
  chemically synthesized
tctctctctctctctctctctc

SEQ ID NO: 917558 - DNA, 22 bp, Artificial Sequence
  chemically synthesized
tctctctctctctctctctctc

SEQ ID NO: 917559 - DNA, 22 bp, Artificial Sequence
  chemically synthesized
tctctctctctctctctctctc

SEQ ID NO: 917560 - DNA, 22 bp, Artificial Sequence
  chemically synthesized
tctctctctctctctctctctc

SEQ ID NO: 917561 - DNA, 22 bp, Artificial Sequence
  chemically synthesized
tctctctctctctctctctctc

SEQ ID NO: 917562 - DNA, 22 bp, Artificial Sequence
  chemically synthesized
tctctctctctctctctctctc

SEQ ID NO: 917563 - DNA, 22 bp, Artificial Sequence
  chemically synthesized
tctctctctctctctctctctc

SEQ ID NO: 917564 - DNA, 22 bp, Artificial Sequence
  chemically synthesized
tctctctctctctctctctctc

SEQ ID NO: 917565 - DNA, 22 bp, Artificial Sequence
  chemically synthesized
tctctctctctctctctctctc

SEQ ID NO: 917566 - DNA, 22 bp, Artificial Sequence
  chemically synthesized
ctctctctctctctctctctct

SEQ ID NO: 917567 - DNA, 22 bp, Artificial Sequence
  chemically synthesized
tctctctctctctctctctctc

SEQ ID NO: 917568 - DNA, 22 bp, Artificial Sequence
  chemically synthesized
ttctctctctctctctctctct

SEQ ID NO: 917569 - DNA, 22 bp, Artificial Sequence
  chemically synthesized
ccttttctctctctctctctct

SEQ ID NO: 917570 - DNA, 22 bp, Artificial Sequence
  chemically synthesized
gagtatgaaagtgatgatcaaa

SEQ ID NO: 917571 - DNA, 22 bp, Artificial Sequence
  chemically synthesized
ctcgagtatgaaagtgatgatc

SEQ ID NO: 917572 - DNA, 22 bp, Artificial Sequence
  chemically synthesized
tgctcgagtatgaaagtgatga

SEQ ID NO: 917573 - DNA, 22 bp, Artificial Sequence
  chemically synthesized
ctgctcgagtatgaaagtgatg

SEQ ID NO: 917574 - DNA, 22 bp, Artificial Sequence
  chemically synthesized
tctgctcgagtatgaaagtgat

SEQ ID NO: 917575 - DNA, 22 bp, Artificial Sequence
  chemically synthesized
cctttctgctcgagtatgaaag

SEQ ID NO: 917576 - DNA, 22 bp, Artificial Sequence
  chemically synthesized
gcctttctgctcgagtatgaaa

SEQ ID NO: 917577 - DNA, 22 bp, Artificial Sequence
  chemically synthesized
tgcctttctgctcgagtatgaa

SEQ ID NO: 917578 - DNA, 22 bp, Artificial Sequence
  chemically synthesized
tgatcatcactttcatactcga

SEQ ID NO: 917579 - DNA, 22 bp, Artificial Sequence
  chemically synthesized
gatcatcactttcatactcgag

SEQ ID NO: 917580 - DNA, 22 bp, Artificial Sequence
  chemically synthesized
atcatcactttcatactcgagc

SEQ ID NO: 917581 - DNA, 22 bp, Artificial Sequence
  chemically synthesized
tcatactcgagcagaaaggcaa

SEQ ID NO: 917582 - DNA, 22 bp, Artificial Sequence
  chemically synthesized
catactcgagcagaaaggcaaa

SEQ ID NO: 917583 - DNA, 22 bp, Artificial Sequence
  chemically synthesized
atactcgagcagaaaggcaaag

SEQ ID NO: 917584 - DNA, 22 bp, Artificial Sequence
  chemically synthesized
gagcagaaaggcaaagggtatt

SEQ ID NO: 917585 - DNA, 22 bp, Artificial Sequence
  chemically synthesized
aataagtgaaacggaaataccc

SEQ ID NO: 917586 - DNA, 22 bp, Artificial Sequence
  chemically synthesized
aaataagtgaaacggaaatacc

SEQ ID NO: 917587 - DNA, 22 bp, Artificial Sequence
  chemically synthesized
tgtgcagagtttaaataagtga

SEQ ID NO: 917588 - DNA, 22 bp, Artificial Sequence
  chemically synthesized
caattatgtgcagagtttaaat

SEQ ID NO: 917589 - DNA, 22 bp, Artificial Sequence
  chemically synthesized
ccgtttcacttatttaaactct

SEQ ID NO: 917590 - DNA, 22 bp, Artificial Sequence
  chemically synthesized
cgtttcacttatttaaactctg

SEQ ID NO: 917591 - DNA, 22 bp, Artificial Sequence
  chemically synthesized
gctgcaattatgtgcagagttt

SEQ ID NO: 917592 - DNA, 22 bp, Artificial Sequence
  chemically synthesized
agctgcaattatgtgcagagtt

SEQ ID NO: 917593 - DNA, 22 bp, Artificial Sequence
  chemically synthesized
cacttatttaaactctgcacat

SEQ ID NO: 917594 - DNA, 22 bp, Artificial Sequence
  chemically synthesized
acttatttaaactctgcacata

SEQ ID NO: 917595 - DNA, 22 bp, Artificial Sequence
  chemically synthesized
atttaaactctgcacataattg

SEQ ID NO: 917596 - DNA, 22 bp, Artificial Sequence
  chemically synthesized
tttaaactctgcacataattgc

SEQ ID NO: 917597 - DNA, 22 bp, Artificial Sequence
  chemically synthesized
aggaacttagctgcaattatgt

SEQ ID NO: 917598 - DNA, 22 bp, Artificial Sequence
  chemically synthesized
tgaggaacttagctgcaattat

SEQ ID NO: 917599 - DNA, 22 bp, Artificial Sequence
  chemically synthesized
aaactctgcacataattgcagc

SEQ ID NO: 917600 - DNA, 22 bp, Artificial Sequence
  chemically synthesized
ctgaggaacttagctgcaatta

SEQ ID NO: 917601 - DNA, 22 bp, Artificial Sequence
  chemically synthesized
aactctgcacataattgcagct

SEQ ID NO: 917602 - DNA, 22 bp, Artificial Sequence
  chemically synthesized
tttctgaggaacttagctgcaa

SEQ ID NO: 917603 - DNA, 22 bp, Artificial Sequence
  chemically synthesized
tgtttctgaggaacttagctgc

SEQ ID NO: 917604 - DNA, 22 bp, Artificial Sequence
  chemically synthesized
tgcacataattgcagctaagtt

SEQ ID NO: 917605 - DNA, 22 bp, Artificial Sequence
  chemically synthesized
cacataattgcagctaagttcc

SEQ ID NO: 917606 - DNA, 22 bp, Artificial Sequence
  chemically synthesized
cagctaagttcctcagaaacag

SEQ ID NO: 917607 - DNA, 22 bp, Artificial Sequence
  chemically synthesized
aagaatagtaacctctgtttct

SEQ ID NO: 917608 - DNA, 22 bp, Artificial Sequence
  chemically synthesized
aaagaatagtaacctctgtttc

SEQ ID NO: 917609 - DNA, 22 bp, Artificial Sequence
  chemically synthesized
taaagaatagtaacctctgttt

SEQ ID NO: 917610 - DNA, 22 bp, Artificial Sequence
  chemically synthesized
ttaaagaatagtaacctctgtt

SEQ ID NO: 917611 - DNA, 22 bp, Artificial Sequence
  chemically synthesized
agttcctcagaaacagaggtta

SEQ ID NO: 917612 - DNA, 22 bp, Artificial Sequence
  chemically synthesized
ttttaaagaatagtaacctctg

SEQ ID NO: 917613 - DNA, 22 bp, Artificial Sequence
  chemically synthesized
ctcagaaacagaggttactatt

SEQ ID NO: 917614 - DNA, 22 bp, Artificial Sequence
  chemically synthesized
tattcttttaaagaatagtaac

SEQ ID NO: 917615 - DNA, 22 bp, Artificial Sequence
  chemically synthesized
agaaacagaggttactattctt

SEQ ID NO: 917616 - DNA, 22 bp, Artificial Sequence
  chemically synthesized
tggctatattcttttaaagaat

SEQ ID NO: 917617 - DNA, 22 bp, Artificial Sequence
  chemically synthesized
ctgtggctatattcttttaaag

SEQ ID NO: 917618 - DNA, 22 bp, Artificial Sequence
  chemically synthesized
tacctcctgtggctatattctt

SEQ ID NO: 917619 - DNA, 22 bp, Artificial Sequence
  chemically synthesized
ctattctttaaaagaatatagc

SEQ ID NO: 917620 - DNA, 22 bp, Artificial Sequence
  chemically synthesized
gtacctcctgtggctatattct

SEQ ID NO: 917621 - DNA, 22 bp, Artificial Sequence
  chemically synthesized
tgtacctcctgtggctatattc

SEQ ID NO: 917622 - DNA, 22 bp, Artificial Sequence
  chemically synthesized
ttgtacctcctgtggctatatt

SEQ ID NO: 917623 - DNA, 22 bp, Artificial Sequence
  chemically synthesized
ttctttaaaagaatatagccac

SEQ ID NO: 917624 - DNA, 22 bp, Artificial Sequence
  chemically synthesized
tttttgtacctcctgtggctat

SEQ ID NO: 917625 - DNA, 22 bp, Artificial Sequence
  chemically synthesized
tttaaaagaatatagccacagg

SEQ ID NO: 917626 - DNA, 22 bp, Artificial Sequence
  chemically synthesized
taaaagaatatagccacaggag

SEQ ID NO: 917627 - DNA, 22 bp, Artificial Sequence
  chemically synthesized
aaaagaatatagccacaggagg

SEQ ID NO: 917628 - DNA, 22 bp, Artificial Sequence
  chemically synthesized
aaagaatatagccacaggaggt

SEQ ID NO: 917629 - DNA, 22 bp, Artificial Sequence
  chemically synthesized
agggaatataactatttttgta

SEQ ID NO: 917630 - DNA, 22 bp, Artificial Sequence
  chemically synthesized
cagggaatataactatttttgt

SEQ ID NO: 917631 - DNA, 22 bp, Artificial Sequence
  chemically synthesized
tttcagggaatataactatttt

SEQ ID NO: 917632 - DNA, 22 bp, Artificial Sequence
  chemically synthesized
aggaaatactgtttcagggaat

SEQ ID NO: 917633 - DNA, 22 bp, Artificial Sequence
  chemically synthesized
aaggaaatactgtttcagggaa

SEQ ID NO: 917634 - DNA, 22 bp, Artificial Sequence
  chemically synthesized
tattccctgaaacagtatttcc

SEQ ID NO: 917635 - DNA, 22 bp, Artificial Sequence
  chemically synthesized
cctgaaacagtatttccttaaa

SEQ ID NO: 917636 - DNA, 22 bp, Artificial Sequence
  chemically synthesized
aaacagtatttccttaaatgtg

SEQ ID NO: 917637 - DNA, 22 bp, Artificial Sequence
  chemically synthesized
ccaggggtccccagaccacatt

SEQ ID NO: 917638 - DNA, 22 bp, Artificial Sequence
  chemically synthesized
ccttaaatgtggtctggggacc

SEQ ID NO: 917639 - DNA, 22 bp, Artificial Sequence
  chemically synthesized
cttaaatgtggtctggggaccc

SEQ ID NO: 917640 - DNA, 22 bp, Artificial Sequence
  chemically synthesized
agggactcccaggggtccccag

SEQ ID NO: 917641 - DNA, 22 bp, Artificial Sequence
  chemically synthesized
aaatgtggtctggggacccctg

SEQ ID NO: 917642 - DNA, 22 bp, Artificial Sequence
  chemically synthesized
aatgtggtctggggacccctgg

SEQ ID NO: 917643 - DNA, 22 bp, Artificial Sequence
  chemically synthesized
catgggtctcagggactcccag

SEQ ID NO: 917644 - DNA, 22 bp, Artificial Sequence
  chemically synthesized
gggacccctgggagtccctgag

SEQ ID NO: 917645 - DNA, 22 bp, Artificial Sequence
  chemically synthesized
acagaaccactgcatgggtctc

SEQ ID NO: 917646 - DNA, 22 bp, Artificial Sequence
  chemically synthesized
ggagtccctgagacccatgcag

SEQ ID NO: 917647 - DNA, 22 bp, Artificial Sequence
  chemically synthesized
gacctcacagaaccactgcatg

SEQ ID NO: 917648 - DNA, 22 bp, Artificial Sequence
  chemically synthesized
ggacctcacagaaccactgcat

SEQ ID NO: 917649 - DNA, 22 bp, Artificial Sequence
  chemically synthesized
agacccatgcagtggttctgtg

SEQ ID NO: 917650 - DNA, 22 bp, Artificial Sequence
  chemically synthesized
cgaaaataatttggacctcaca

SEQ ID NO: 917651 - DNA, 22 bp, Artificial Sequence
  chemically synthesized
ttacgaaaataatttggacctc

SEQ ID NO: 917652 - DNA, 22 bp, Artificial Sequence
  chemically synthesized
gtattattacgaaaataatttg

SEQ ID NO: 917653 - DNA, 22 bp, Artificial Sequence
  chemically synthesized
agtattattacgaaaataattt

SEQ ID NO: 917654 - DNA, 22 bp, Artificial Sequence
  chemically synthesized
tgtgaggtccaaattattttcg

SEQ ID NO: 917655 - DNA, 22 bp, Artificial Sequence
  chemically synthesized
tgaggtccaaattattttcgta

SEQ ID NO: 917656 - DNA, 22 bp, Artificial Sequence
  chemically synthesized
ttttcgtaataatactaagatg

SEQ ID NO: 917657 - DNA, 22 bp, Artificial Sequence
  chemically synthesized
tcgtaataatactaagatgtta

SEQ ID NO: 917658 - DNA, 22 bp, Artificial Sequence
  chemically synthesized
cgtaataatactaagatgttat

SEQ ID NO: 917659 - DNA, 22 bp, Artificial Sequence
  chemically synthesized
gtaataatactaagatgttatt

SEQ ID NO: 917660 - DNA, 22 bp, Artificial Sequence
  chemically synthesized
agatgttatttgactttttcct

SEQ ID NO: 917661 - DNA, 22 bp, Artificial Sequence
  chemically synthesized
ataatagaatgagagaggaaaa

SEQ ID NO: 917662 - DNA, 22 bp, Artificial Sequence
  chemically synthesized
tttgactttttcctctctcatt

SEQ ID NO: 917663 - DNA, 22 bp, Artificial Sequence
  chemically synthesized
gactttttcctctctcattcta

SEQ ID NO: 917664 - DNA, 22 bp, Artificial Sequence
  chemically synthesized
aaaaactcataatagaatgaga

SEQ ID NO: 917665 - DNA, 22 bp, Artificial Sequence
  chemically synthesized
actttttcctctctcattctat

SEQ ID NO: 917666 - DNA, 22 bp, Artificial Sequence
  chemically synthesized
tgaaaaactcataatagaatga

SEQ ID NO: 917667 - DNA, 22 bp, Artificial Sequence
  chemically synthesized
tttcctctctcattctattatg

SEQ ID NO: 917668 - DNA, 22 bp, Artificial Sequence
  chemically synthesized
ttcctctctcattctattatga

SEQ ID NO: 917669 - DNA, 22 bp, Artificial Sequence
  chemically synthesized
tcctctctcattctattatgag

SEQ ID NO: 917670 - DNA, 22 bp, Artificial Sequence
  chemically synthesized
cctctctcattctattatgagt

SEQ ID NO: 917671 - DNA, 22 bp, Artificial Sequence
  chemically synthesized
ctctctcattctattatgagtt

SEQ ID NO: 917672 - DNA, 22 bp, Artificial Sequence
  chemically synthesized
tctcattctattatgagttttt

SEQ ID NO: 917673 - DNA, 22 bp, Artificial Sequence
  chemically synthesized
tcattctattatgagtttttca

SEQ ID NO: 917674 - DNA, 22 bp, Artificial Sequence
  chemically synthesized
attctattatgagtttttcaga

SEQ ID NO: 917675 - DNA, 22 bp, Artificial Sequence
  chemically synthesized
gcatcatgtagcctctgaaaaa

SEQ ID NO: 917676 - DNA, 22 bp, Artificial Sequence
  chemically synthesized
tattatgagtttttcagaggct

SEQ ID NO: 917677 - DNA, 22 bp, Artificial Sequence
  chemically synthesized
ttatgagtttttcagaggctac

SEQ ID NO: 917678 - DNA, 22 bp, Artificial Sequence
  chemically synthesized
tgagtttttcagaggctacatg

SEQ ID NO: 917679 - DNA, 22 bp, Artificial Sequence
  chemically synthesized
tcatatctcgcatcatgtagcc

SEQ ID NO: 917680 - DNA, 22 bp, Artificial Sequence
  chemically synthesized
ttcagaggctacatgatgcgag

SEQ ID NO: 917681 - DNA, 22 bp, Artificial Sequence
  chemically synthesized
tcagaggctacatgatgcgaga

SEQ ID NO: 917682 - DNA, 22 bp, Artificial Sequence
  chemically synthesized
cagaggctacatgatgcgagat

SEQ ID NO: 917683 - DNA, 22 bp, Artificial Sequence
  chemically synthesized
agaggctacatgatgcgagata

SEQ ID NO: 917684 - DNA, 22 bp, Artificial Sequence
  chemically synthesized
aatgtgctgtcatatctcgcat

SEQ ID NO: 917685 - DNA, 22 bp, Artificial Sequence
  chemically synthesized
cattgaatgtgctgtcatatct

SEQ ID NO: 917686 - DNA, 22 bp, Artificial Sequence
  chemically synthesized
tgcattgaatgtgctgtcatat

SEQ ID NO: 917687 - DNA, 22 bp, Artificial Sequence
  chemically synthesized
catgatgcgagatatgacagca

SEQ ID NO: 917688 - DNA, 22 bp, Artificial Sequence
  chemically synthesized
ctgcattgaatgtgctgtcata

SEQ ID NO: 917689 - DNA, 22 bp, Artificial Sequence
  chemically synthesized
tttctgcattgaatgtgctgtc

SEQ ID NO: 917690 - DNA, 22 bp, Artificial Sequence
  chemically synthesized
tatctgtttctgcattgaatgt

SEQ ID NO: 917691 - DNA, 22 bp, Artificial Sequence
  chemically synthesized
atatctgtttctgcattgaatg

SEQ ID NO: 917692 - DNA, 22 bp, Artificial Sequence
  chemically synthesized
ttatatctgtttctgcattgaa

SEQ ID NO: 917693 - DNA, 22 bp, Artificial Sequence
  chemically synthesized
gttcttatatctgtttctgcat

SEQ ID NO: 917694 - DNA, 22 bp, Artificial Sequence
  chemically synthesized
aatgcagaaacagatataagaa

SEQ ID NO: 917695 - DNA, 22 bp, Artificial Sequence
  chemically synthesized
agagaaggcagctggttcttat

SEQ ID NO: 917696 - DNA, 22 bp, Artificial Sequence
  chemically synthesized
aagagaaggcagctggttctta

SEQ ID NO: 917697 - DNA, 22 bp, Artificial Sequence
  chemically synthesized
gcttaagagaaggcagctggtt

SEQ ID NO: 917698 - DNA, 22 bp, Artificial Sequence
  chemically synthesized
aaagttagcttaagagaaggca

SEQ ID NO: 917699 - DNA, 22 bp, Artificial Sequence
  chemically synthesized
aaaagttagcttaagagaaggc

SEQ ID NO: 917700 - DNA, 22 bp, Artificial Sequence
  chemically synthesized
taaaagttagcttaagagaagg

SEQ ID NO: 917701 - DNA, 22 bp, Artificial Sequence
  chemically synthesized
tttaaaagttagcttaagagaa

SEQ ID NO: 917702 - DNA, 22 bp, Artificial Sequence
  chemically synthesized
caaatctctttaaaagttagct

SEQ ID NO: 917703 - DNA, 22 bp, Artificial Sequence
  chemically synthesized
gcaaatctctttaaaagttagc

SEQ ID NO: 917704 - DNA, 22 bp, Artificial Sequence
  chemically synthesized
ccttctcttaagctaactttta

SEQ ID NO: 917705 - DNA, 22 bp, Artificial Sequence
  chemically synthesized
tgcaaatctctttaaaagttag

SEQ ID NO: 917706 - DNA, 22 bp, Artificial Sequence
  chemically synthesized
ttgcaaatctctttaaaagtta

SEQ ID NO: 917707 - DNA, 22 bp, Artificial Sequence
  chemically synthesized
ctcttaagctaacttttaaaga

SEQ ID NO: 917708 - DNA, 22 bp, Artificial Sequence
  chemically synthesized
tcttaagctaacttttaaagag

SEQ ID NO: 917709 - DNA, 22 bp, Artificial Sequence
  chemically synthesized
catttttgcaaatctctttaaa

SEQ ID NO: 917710 - DNA, 22 bp, Artificial Sequence
  chemically synthesized
ttaagctaacttttaaagagat

SEQ ID NO: 917711 - DNA, 22 bp, Artificial Sequence
  chemically synthesized
acatttttgcaaatctctttaa

SEQ ID NO: 917712 - DNA, 22 bp, Artificial Sequence
  chemically synthesized
tacatttttgcaaatctcttta

SEQ ID NO: 917713 - DNA, 22 bp, Artificial Sequence
  chemically synthesized
aagctaacttttaaagagattt

SEQ ID NO: 917714 - DNA, 22 bp, Artificial Sequence
  chemically synthesized
agctaacttttaaagagatttg

SEQ ID NO: 917715 - DNA, 22 bp, Artificial Sequence
  chemically synthesized
ttttacatttttgcaaatctct

SEQ ID NO: 917716 - DNA, 22 bp, Artificial Sequence
  chemically synthesized
gttttacatttttgcaaatctc

SEQ ID NO: 917717 - DNA, 22 bp, Artificial Sequence
  chemically synthesized
acttttaaagagatttgcaaaa

SEQ ID NO: 917718 - DNA, 22 bp, Artificial Sequence
  chemically synthesized
ttaaagagatttgcaaaaatgt

SEQ ID NO: 917719 - DNA, 22 bp, Artificial Sequence
  chemically synthesized
taaagagatttgcaaaaatgta

SEQ ID NO: 917720 - DNA, 22 bp, Artificial Sequence
  chemically synthesized
aaagagatttgcaaaaatgtaa

SEQ ID NO: 917721 - DNA, 22 bp, Artificial Sequence
  chemically synthesized
aagagatttgcaaaaatgtaaa

SEQ ID NO: 917722 - DNA, 22 bp, Artificial Sequence
  chemically synthesized
gcaaaaatgtaaaacaagatca

SEQ ID NO: 917723 - DNA, 22 bp, Artificial Sequence
  chemically synthesized
caaaaatgtaaaacaagatcac

SEQ ID NO: 917724 - DNA, 22 bp, Artificial Sequence
  chemically synthesized
caacagaaacaatatagtgaga

SEQ ID NO: 917725 - DNA, 22 bp, Artificial Sequence
  chemically synthesized
tacaacagaaacaatatagtga

SEQ ID NO: 917726 - DNA, 22 bp, Artificial Sequence
  chemically synthesized
ctacaacagaaacaatatagtg

SEQ ID NO: 917727 - DNA, 22 bp, Artificial Sequence
  chemically synthesized
ttctacaacagaaacaatatag

SEQ ID NO: 917728 - DNA, 22 bp, Artificial Sequence
  chemically synthesized
tctcttctacaacagaaacaat

SEQ ID NO: 917729 - DNA, 22 bp, Artificial Sequence
  chemically synthesized
ttctcactatattgtttctgtt

SEQ ID NO: 917730 - DNA, 22 bp, Artificial Sequence
  chemically synthesized
ctcactatattgtttctgttgt

SEQ ID NO: 917731 - DNA, 22 bp, Artificial Sequence
  chemically synthesized
tcactatattgtttctgttgta

SEQ ID NO: 917732 - DNA, 22 bp, Artificial Sequence
  chemically synthesized
aactatctcttctacaacagaa

SEQ ID NO: 917733 - DNA, 22 bp, Artificial Sequence
  chemically synthesized
aaactatctcttctacaacaga

SEQ ID NO: 917734 - DNA, 22 bp, Artificial Sequence
  chemically synthesized
actatattgtttctgttgtaga

SEQ ID NO: 917735 - DNA, 22 bp, Artificial Sequence
  chemically synthesized
taaactatctcttctacaacag

SEQ ID NO: 917736 - DNA, 22 bp, Artificial Sequence
  chemically synthesized
ttaaactatctcttctacaaca

SEQ ID NO: 917737 - DNA, 22 bp, Artificial Sequence
  chemically synthesized
tattgtttctgttgtagaagag

SEQ ID NO: 917738 - DNA, 22 bp, Artificial Sequence
  chemically synthesized
gtttttaaactatctcttctac

SEQ ID NO: 917739 - DNA, 22 bp, Artificial Sequence
  chemically synthesized
agtttttaaactatctcttcta

SEQ ID NO: 917740 - DNA, 22 bp, Artificial Sequence
  chemically synthesized
tttctgttgtagaagagatagt

SEQ ID NO: 917741 - DNA, 22 bp, Artificial Sequence
  chemically synthesized
ctgttgtagaagagatagttta

SEQ ID NO: 917742 - DNA, 22 bp, Artificial Sequence
  chemically synthesized
tgttgtagaagagatagtttaa

SEQ ID NO: 917743 - DNA, 22 bp, Artificial Sequence
  chemically synthesized
ttgtagaagagatagtttaaaa

SEQ ID NO: 917744 - DNA, 22 bp, Artificial Sequence
  chemically synthesized
tagaagagatagtttaaaaact

SEQ ID NO: 917745 - DNA, 22 bp, Artificial Sequence
  chemically synthesized
aaataaaaaataaatgtttagt

SEQ ID NO: 917746 - DNA, 22 bp, Artificial Sequence
  chemically synthesized
catgttgaaataaaaaataaat

SEQ ID NO: 917747 - DNA, 22 bp, Artificial Sequence
  chemically synthesized
aaaaactaaacatttatttttt

SEQ ID NO: 917748 - DNA, 22 bp, Artificial Sequence
  chemically synthesized
aaaactaaacatttatttttta

SEQ ID NO: 917749 - DNA, 22 bp, Artificial Sequence
  chemically synthesized
aaattgcatgttgaaataaaaa

SEQ ID NO: 917750 - DNA, 22 bp, Artificial Sequence
  chemically synthesized
aaaattgcatgttgaaataaaa

SEQ ID NO: 917751 - DNA, 22 bp, Artificial Sequence
  chemically synthesized
taaaattgcatgttgaaataaa

SEQ ID NO: 917752 - DNA, 22 bp, Artificial Sequence
  chemically synthesized
aacatttattttttatttcaac

SEQ ID NO: 917753 - DNA, 22 bp, Artificial Sequence
  chemically synthesized
attttaaaattgcatgttgaaa

SEQ ID NO: 917754 - DNA, 22 bp, Artificial Sequence
  chemically synthesized
attttttatttcaacatgcaat

SEQ ID NO: 917755 - DNA, 22 bp, Artificial Sequence
  chemically synthesized
attcattttaaaattgcatgtt

SEQ ID NO: 917756 - DNA, 22 bp, Artificial Sequence
  chemically synthesized
ttttttatttcaacatgcaatt

SEQ ID NO: 917757 - DNA, 22 bp, Artificial Sequence
  chemically synthesized
ttaattcattttaaaattgcat

SEQ ID NO: 917758 - DNA, 22 bp, Artificial Sequence
  chemically synthesized
tttatttcaacatgcaatttta

SEQ ID NO: 917759 - DNA, 22 bp, Artificial Sequence
  chemically synthesized
attaattcattttaaaattgca

SEQ ID NO: 917760 - DNA, 22 bp, Artificial Sequence
  chemically synthesized
ttatttcaacatgcaattttaa

SEQ ID NO: 917761 - DNA, 22 bp, Artificial Sequence
  chemically synthesized
tatttcaacatgcaattttaaa

SEQ ID NO: 917762 - DNA, 22 bp, Artificial Sequence
  chemically synthesized
atttcaacatgcaattttaaaa

SEQ ID NO: 917763 - DNA, 22 bp, Artificial Sequence
  chemically synthesized
cttattaattcattttaaaatt

SEQ ID NO: 917764 - DNA, 22 bp, Artificial Sequence
  chemically synthesized
tttcaacatgcaattttaaaat

SEQ ID NO: 917765 - DNA, 22 bp, Artificial Sequence
  chemically synthesized
acttattaattcattttaaaat

SEQ ID NO: 917766 - DNA, 22 bp, Artificial Sequence
  chemically synthesized
caacatgcaattttaaaatgaa

SEQ ID NO: 917767 - DNA, 22 bp, Artificial Sequence
  chemically synthesized
aacatgcaattttaaaatgaat

SEQ ID NO: 917768 - DNA, 22 bp, Artificial Sequence
  chemically synthesized
aaaatatttacttattaattca

SEQ ID NO: 917769 - DNA, 22 bp, Artificial Sequence
  chemically synthesized
ttcaaaatatttacttattaat

SEQ ID NO: 917770 - DNA, 22 bp, Artificial Sequence
  chemically synthesized
taaaatgaattaataagtaaat

SEQ ID NO: 917771 - DNA, 22 bp, Artificial Sequence
  chemically synthesized
aaaatgaattaataagtaaata

SEQ ID NO: 917772 - DNA, 22 bp, Artificial Sequence
  chemically synthesized
aaatgaattaataagtaaatat

SEQ ID NO: 917773 - DNA, 22 bp, Artificial Sequence
  chemically synthesized
ataagtaaatattttgaacaat

SEQ ID NO: 917774 - DNA, 22 bp, Artificial Sequence
  chemically synthesized
aaaaaaaaaaaaaaaagtggta

SEQ ID NO: 917775 - DNA, 22 bp, Artificial Sequence
  chemically synthesized
tgaacaattaccactttttttt

SEQ ID NO: 917776 - DNA, 22 bp, Artificial Sequence
  chemically synthesized
gaacaattaccacttttttttt

SEQ ID NO: 917777 - DNA, 22 bp, Artificial Sequence
  chemically synthesized
aacaattaccactttttttttt

SEQ ID NO: 917778 - DNA, 22 bp, Artificial Sequence
  chemically synthesized
cgtctcaaaaaaaaaaaaaaaa

SEQ ID NO: 917779 - DNA, 22 bp, Artificial Sequence
  chemically synthesized
ccacttttttttttttttttga

SEQ ID NO: 917780 - DNA, 22 bp, Artificial Sequence
  chemically synthesized
ttttttttttttttgagacgga

SEQ ID NO: 917781 - DNA, 22 bp, Artificial Sequence
  chemically synthesized
tttttttttttttgagacggag

SEQ ID NO: 917782 - DNA, 22 bp, Artificial Sequence
  chemically synthesized
ttttttttttttgagacggagt

SEQ ID NO: 917783 - DNA, 22 bp, Artificial Sequence
  chemically synthesized
tttttttttttgagacggagtc

SEQ ID NO: 917784 - DNA, 22 bp, Artificial Sequence
  chemically synthesized
ttttttttttgagacggagtct

SEQ ID NO: 917785 - DNA, 22 bp, Artificial Sequence
  chemically synthesized
tttttttttgagacggagtctc

SEQ ID NO: 917786 - DNA, 22 bp, Artificial Sequence
  chemically synthesized
ttttttttgagacggagtctca

SEQ ID NO: 917787 - DNA, 22 bp, Artificial Sequence
  chemically synthesized
tttttttgagacggagtctcac

SEQ ID NO: 917788 - DNA, 22 bp, Artificial Sequence
  chemically synthesized
ttttttgagacggagtctcact

SEQ ID NO: 917789 - DNA, 22 bp, Artificial Sequence
  chemically synthesized
tttttgagacggagtctcactc

SEQ ID NO: 917790 - DNA, 22 bp, Artificial Sequence
  chemically synthesized
ttttgagacggagtctcactct

SEQ ID NO: 917791 - DNA, 22 bp, Artificial Sequence
  chemically synthesized
cagccgggcgacagagtgagac

SEQ ID NO: 917792 - DNA, 22 bp, Artificial Sequence
  chemically synthesized
tttgagacggagtctcactctg

SEQ ID NO: 917793 - DNA, 22 bp, Artificial Sequence
  chemically synthesized
ttgagacggagtctcactctgt

SEQ ID NO: 917794 - DNA, 22 bp, Artificial Sequence
  chemically synthesized
tgagacggagtctcactctgtc

SEQ ID NO: 917795 - DNA, 22 bp, Artificial Sequence
  chemically synthesized
gagacggagtctcactctgtcg

SEQ ID NO: 917796 - DNA, 22 bp, Artificial Sequence
  chemically synthesized
agacggagtctcactctgtcgc

SEQ ID NO: 917797 - DNA, 22 bp, Artificial Sequence
  chemically synthesized
cactccagccgggcgacagagt

SEQ ID NO: 917798 - DNA, 22 bp, Artificial Sequence
  chemically synthesized
actctgtcgcccggctggagtg

SEQ ID NO: 917799 - DNA, 22 bp, Artificial Sequence
  chemically synthesized
tgtcgcccggctggagtgcagt

SEQ ID NO: 917800 - DNA, 22 bp, Artificial Sequence
  chemically synthesized
tcgcccggctggagtgcagtgg

SEQ ID NO: 917801 - DNA, 22 bp, Artificial Sequence
  chemically synthesized
cagtgagccgagatcgcaccac

SEQ ID NO: 917802 - DNA, 22 bp, Artificial Sequence
  chemically synthesized
gagtgcagtggtgcgatctcgg

SEQ ID NO: 917803 - DNA, 22 bp, Artificial Sequence
  chemically synthesized
gaacccgggaggcagaggttgc

SEQ ID NO: 917804 - DNA, 22 bp, Artificial Sequence
  chemically synthesized
ctcgaacccgggaggcagaggt

SEQ ID NO: 917805 - DNA, 22 bp, Artificial Sequence
  chemically synthesized
ggctcactgcaacctctgcctc

SEQ ID NO: 917806 - DNA, 22 bp, Artificial Sequence
  chemically synthesized
actgcaacctctgcctcccggg

SEQ ID NO: 917807 - DNA, 22 bp, Artificial Sequence
  chemically synthesized
caacctctgcctcccgggttcg

SEQ ID NO: 917808 - DNA, 22 bp, Artificial Sequence
  chemically synthesized
aagcagaagaattgctcgaacc

SEQ ID NO: 917809 - DNA, 22 bp, Artificial Sequence
  chemically synthesized
tgcctcccgggttcgagcaatt

SEQ ID NO: 917810 - DNA, 22 bp, Artificial Sequence
  chemically synthesized
cctcccgggttcgagcaattct

SEQ ID NO: 917811 - DNA, 22 bp, Artificial Sequence
  chemically synthesized
ccgggttcgagcaattcttctg

SEQ ID NO: 917812 - DNA, 22 bp, Artificial Sequence
  chemically synthesized
gggaggctgaagcagaagaatt

SEQ ID NO: 917813 - DNA, 22 bp, Artificial Sequence
  chemically synthesized
ctcgggaggctgaagcagaaga

SEQ ID NO: 917814 - DNA, 22 bp, Artificial Sequence
  chemically synthesized
gagcaattcttctgcttcagcc

SEQ ID NO: 917815 - DNA, 22 bp, Artificial Sequence
  chemically synthesized
tagtcccagctactcgggaggc

SEQ ID NO: 917816 - DNA, 22 bp, Artificial Sequence
  chemically synthesized
ttctgcttcagcctcccgagta

SEQ ID NO: 917817 - DNA, 22 bp, Artificial Sequence
  chemically synthesized
ctgcttcagcctcccgagtagc

SEQ ID NO: 917818 - DNA, 22 bp, Artificial Sequence
  chemically synthesized
tgcttcagcctcccgagtagct

SEQ ID NO: 917819 - DNA, 22 bp, Artificial Sequence
  chemically synthesized
cttcagcctcccgagtagctgg

SEQ ID NO: 917820 - DNA, 22 bp, Artificial Sequence
  chemically synthesized
cagcctcccgagtagctgggac

SEQ ID NO: 917821 - DNA, 22 bp, Artificial Sequence
  chemically synthesized
agcctcccgagtagctgggact

SEQ ID NO: 917822 - DNA, 22 bp, Artificial Sequence
  chemically synthesized
ccgagtagctgggactacaggc

SEQ ID NO: 917823 - DNA, 22 bp, Artificial Sequence
  chemically synthesized
ggactacaggcgcccgccacca

SEQ ID NO: 917824 - DNA, 22 bp, Artificial Sequence
  chemically synthesized
caggcgcccgccaccactcctg

SEQ ID NO: 917825 - DNA, 22 bp, Artificial Sequence
  chemically synthesized
ctgtttgtttgttttgttttgt

SEQ ID NO: 917826 - DNA, 22 bp, Artificial Sequence
  chemically synthesized
tttgtttgttttgttttgttct

SEQ ID NO: 917827 - DNA, 22 bp, Artificial Sequence
  chemically synthesized
gtttgttttgttttgttctgct

SEQ ID NO: 917828 - DNA, 22 bp, Artificial Sequence
  chemically synthesized
tttgttttgttttgttctgctt

SEQ ID NO: 917829 - DNA, 22 bp, Artificial Sequence
  chemically synthesized
gttttgttttgttctgcttttt

SEQ ID NO: 917830 - DNA, 22 bp, Artificial Sequence
  chemically synthesized
ttttgttttgttctgctttttt

SEQ ID NO: 917831 - DNA, 22 bp, Artificial Sequence
  chemically synthesized
tgttttgttctgcttttttttt

SEQ ID NO: 917832 - DNA, 22 bp, Artificial Sequence
  chemically synthesized
gttttgttctgctttttttttt

SEQ ID NO: 917833 - DNA, 22 bp, Artificial Sequence
  chemically synthesized
ttttgttctgcttttttttttt

SEQ ID NO: 917834 - DNA, 22 bp, Artificial Sequence
  chemically synthesized
aaaatacaaaaaaaaaaaaaaa

SEQ ID NO: 917835 - DNA, 22 bp, Artificial Sequence
  chemically synthesized
tgttctgctttttttttttttt

SEQ ID NO: 917836 - DNA, 22 bp, Artificial Sequence
  chemically synthesized
gttctgcttttttttttttttt

SEQ ID NO: 917837 - DNA, 22 bp, Artificial Sequence
  chemically synthesized
ttctgctttttttttttttttt

SEQ ID NO: 917838 - DNA, 22 bp, Artificial Sequence
  chemically synthesized
ttaaaaatacaaaaaaaaaaaa

SEQ ID NO: 917839 - DNA, 22 bp, Artificial Sequence
  chemically synthesized
tgttaaaaatacaaaaaaaaaa

SEQ ID NO: 917840 - DNA, 22 bp, Artificial Sequence
  chemically synthesized
tgcttttttttttttttttttg

SEQ ID NO: 917841 - DNA, 22 bp, Artificial Sequence
  chemically synthesized
cttttttttttttttttttgta

SEQ ID NO: 917842 - DNA, 22 bp, Artificial Sequence
  chemically synthesized
tctctgttaaaaatacaaaaaa

SEQ ID NO: 917843 - DNA, 22 bp, Artificial Sequence
  chemically synthesized
ttttttttttttttttgtattt

SEQ ID NO: 917844 - DNA, 22 bp, Artificial Sequence
  chemically synthesized
tttttttttttttttgtatttt

SEQ ID NO: 917845 - DNA, 22 bp, Artificial Sequence
  chemically synthesized
ttttttttttttttgtattttt

SEQ ID NO: 917846 - DNA, 22 bp, Artificial Sequence
  chemically synthesized
tttttttttttttgtattttta

SEQ ID NO: 917847 - DNA, 22 bp, Artificial Sequence
  chemically synthesized
ttttttttttttgtatttttaa

SEQ ID NO: 917848 - DNA, 22 bp, Artificial Sequence
  chemically synthesized
tttttttttttgtatttttaac

SEQ ID NO: 917849 - DNA, 22 bp, Artificial Sequence
  chemically synthesized
ttttttttttgtatttttaaca

SEQ ID NO: 917850 - DNA, 22 bp, Artificial Sequence
  chemically synthesized
tttttttttgtatttttaacag

SEQ ID NO: 917851 - DNA, 22 bp, Artificial Sequence
  chemically synthesized
ttttttttgtatttttaacaga

SEQ ID NO: 917852 - DNA, 22 bp, Artificial Sequence
  chemically synthesized
tttttttgtatttttaacagag

SEQ ID NO: 917853 - DNA, 22 bp, Artificial Sequence
  chemically synthesized
ttttttgtatttttaacagaga

SEQ ID NO: 917854 - DNA, 22 bp, Artificial Sequence
  chemically synthesized
tttttgtatttttaacagagac

SEQ ID NO: 917855 - DNA, 22 bp, Artificial Sequence
  chemically synthesized
ttttgtatttttaacagagaca

SEQ ID NO: 917856 - DNA, 22 bp, Artificial Sequence
  chemically synthesized
tttgtatttttaacagagacag

SEQ ID NO: 917857 - DNA, 22 bp, Artificial Sequence
  chemically synthesized
ttgtatttttaacagagacagg

SEQ ID NO: 917858 - DNA, 22 bp, Artificial Sequence
  chemically synthesized
tgtatttttaacagagacaggg

SEQ ID NO: 917859 - DNA, 22 bp, Artificial Sequence
  chemically synthesized
gtatttttaacagagacagggt

SEQ ID NO: 917860 - DNA, 22 bp, Artificial Sequence
  chemically synthesized
tatttttaacagagacagggtt

SEQ ID NO: 917861 - DNA, 22 bp, Artificial Sequence
  chemically synthesized
gtgaacatggtgaaaccctgtc

SEQ ID NO: 917862 - DNA, 22 bp, Artificial Sequence
  chemically synthesized
ttaacagagacagggtttcacc

SEQ ID NO: 917863 - DNA, 22 bp, Artificial Sequence
  chemically synthesized
taacagagacagggtttcacca

SEQ ID NO: 917864 - DNA, 22 bp, Artificial Sequence
  chemically synthesized
aacagagacagggtttcaccat

SEQ ID NO: 917865 - DNA, 22 bp, Artificial Sequence
  chemically synthesized
acagagacagggtttcaccatg

SEQ ID NO: 917866 - DNA, 22 bp, Artificial Sequence
  chemically synthesized
caccatgttcaccaggatggtc

SEQ ID NO: 917867 - DNA, 22 bp, Artificial Sequence
  chemically synthesized
accatgttcaccaggatggtct

SEQ ID NO: 917868 - DNA, 22 bp, Artificial Sequence
  chemically synthesized
accaggatggtctcgatctctt

SEQ ID NO: 917869 - DNA, 22 bp, Artificial Sequence
  chemically synthesized
gatctcttgacctcgtgatccg

SEQ ID NO: 917870 - DNA, 22 bp, Artificial Sequence
  chemically synthesized
ggaggccgaggcgggcggatca

SEQ ID NO: 917871 - DNA, 22 bp, Artificial Sequence
  chemically synthesized
tgggaggccgaggcgggcggat

SEQ ID NO: 917872 - DNA, 22 bp, Artificial Sequence
  chemically synthesized
ttgacctcgtgatccgcccgcc

SEQ ID NO: 917873 - DNA, 22 bp, Artificial Sequence
  chemically synthesized
gacctcgtgatccgcccgcctc

SEQ ID NO: 917874 - DNA, 22 bp, Artificial Sequence
  chemically synthesized
acctcgtgatccgcccgcctcg

SEQ ID NO: 917875 - DNA, 22 bp, Artificial Sequence
  chemically synthesized
gtgatccgcccgcctcggcctc

SEQ ID NO: 917876 - DNA, 22 bp, Artificial Sequence
  chemically synthesized
taatcccagcactctgggaggc

SEQ ID NO: 917877 - DNA, 22 bp, Artificial Sequence
  chemically synthesized
acgcctgtaatcccagcactct

SEQ ID NO: 917878 - DNA, 22 bp, Artificial Sequence
  chemically synthesized
ggcctcccagagtgctgggatt

SEQ ID NO: 917879 - DNA, 22 bp, Artificial Sequence
  chemically synthesized
ccagagtgctgggattacaggc

SEQ ID NO: 917880 - DNA, 22 bp, Artificial Sequence
  chemically synthesized
gccaggcgcggtgcctcacgcc

SEQ ID NO: 917881 - DNA, 22 bp, Artificial Sequence
  chemically synthesized
ggccaggcgcggtgcctcacgc

SEQ ID NO: 917882 - DNA, 22 bp, Artificial Sequence
  chemically synthesized
ggattacaggcgtgaggcaccg

SEQ ID NO: 917883 - DNA, 22 bp, Artificial Sequence
  chemically synthesized
tcttggccaggcgcggtgcctc

SEQ ID NO: 917884 - DNA, 22 bp, Artificial Sequence
  chemically synthesized
caggcgtgaggcaccgcgcctg

SEQ ID NO: 917885 - DNA, 22 bp, Artificial Sequence
  chemically synthesized
caaaaaaaattatcttggccag

SEQ ID NO: 917886 - DNA, 22 bp, Artificial Sequence
  chemically synthesized
tacaaaaaaaattatcttggcc

SEQ ID NO: 917887 - DNA, 22 bp, Artificial Sequence
  chemically synthesized
ctacaaaaaaaattatcttggc

SEQ ID NO: 917888 - DNA, 22 bp, Artificial Sequence
  chemically synthesized
tctacaaaaaaaattatcttgg

SEQ ID NO: 917889 - DNA, 22 bp, Artificial Sequence
  chemically synthesized
ttctacaaaaaaaattatcttg

SEQ ID NO: 917890 - DNA, 22 bp, Artificial Sequence
  chemically synthesized
tttttctacaaaaaaaattatc

SEQ ID NO: 917891 - DNA, 22 bp, Artificial Sequence
  chemically synthesized
gccaagataattttttttgtag

SEQ ID NO: 917892 - DNA, 22 bp, Artificial Sequence
  chemically synthesized
acaaggacatattatttttcta

SEQ ID NO: 917893 - DNA, 22 bp, Artificial Sequence
  chemically synthesized
tttttgtagaaaaataatatgt

SEQ ID NO: 917894 - DNA, 22 bp, Artificial Sequence
  chemically synthesized
ttttgtagaaaaataatatgtc

SEQ ID NO: 917895 - DNA, 22 bp, Artificial Sequence
  chemically synthesized
tttgtagaaaaataatatgtcc

SEQ ID NO: 917896 - DNA, 22 bp, Artificial Sequence
  chemically synthesized
ttgtagaaaaataatatgtcct

SEQ ID NO: 917897 - DNA, 22 bp, Artificial Sequence
  chemically synthesized
tgccagttgacaaggacatatt

SEQ ID NO: 917898 - DNA, 22 bp, Artificial Sequence
  chemically synthesized
tgtagaaaaataatatgtcctt

SEQ ID NO: 917899 - DNA, 22 bp, Artificial Sequence
  chemically synthesized
atgccagttgacaaggacatat

SEQ ID NO: 917900 - DNA, 22 bp, Artificial Sequence
  chemically synthesized
gtagaaaaataatatgtccttg

SEQ ID NO: 917901 - DNA, 22 bp, Artificial Sequence
  chemically synthesized
tagaaaaataatatgtccttgt

SEQ ID NO: 917902 - DNA, 22 bp, Artificial Sequence
  chemically synthesized
cttatgccagttgacaaggaca

SEQ ID NO: 917903 - DNA, 22 bp, Artificial Sequence
  chemically synthesized
tcattacttatgccagttgaca

SEQ ID NO: 917904 - DNA, 22 bp, Artificial Sequence
  chemically synthesized
gtcaactggcataagtaatgac

SEQ ID NO: 917905 - DNA, 22 bp, Artificial Sequence
  chemically synthesized
tcaactggcataagtaatgaca

SEQ ID NO: 917906 - DNA, 22 bp, Artificial Sequence
  chemically synthesized
ggcatgcatgataagctgtcat

SEQ ID NO: 917907 - DNA, 22 bp, Artificial Sequence
  chemically synthesized
gcataagtaatgacagcttatc

SEQ ID NO: 917908 - DNA, 22 bp, Artificial Sequence
  chemically synthesized
taatgacaaactcggcatgcat

SEQ ID NO: 917909 - DNA, 22 bp, Artificial Sequence
  chemically synthesized
ataatgacaaactcggcatgca

SEQ ID NO: 917910 - DNA, 22 bp, Artificial Sequence
  chemically synthesized
tataatgacaaactcggcatgc

SEQ ID NO: 917911 - DNA, 22 bp, Artificial Sequence
  chemically synthesized
atcatgcatgccgagtttgtca

SEQ ID NO: 917912 - DNA, 22 bp, Artificial Sequence
  chemically synthesized
aggtctttataatgacaaactc

SEQ ID NO: 917913 - DNA, 22 bp, Artificial Sequence
  chemically synthesized
tcatgcatgccgagtttgtcat

SEQ ID NO: 917914 - DNA, 22 bp, Artificial Sequence
  chemically synthesized
tctgaggtctttataatgacaa

SEQ ID NO: 917915 - DNA, 22 bp, Artificial Sequence
  chemically synthesized
gtctgaggtctttataatgaca

SEQ ID NO: 917916 - DNA, 22 bp, Artificial Sequence
  chemically synthesized
cttgtctgaggtctttataatg

SEQ ID NO: 917917 - DNA, 22 bp, Artificial Sequence
  chemically synthesized
acttgtctgaggtctttataat

SEQ ID NO: 917918 - DNA, 22 bp, Artificial Sequence
  chemically synthesized
tttacttgtctgaggtctttat

SEQ ID NO: 917919 - DNA, 22 bp, Artificial Sequence
  chemically synthesized
tattatttacttgtctgaggtc

SEQ ID NO: 917920 - DNA, 22 bp, Artificial Sequence
  chemically synthesized
gtcattataaagacctcagaca

SEQ ID NO: 917921 - DNA, 22 bp, Artificial Sequence
  chemically synthesized
tcattataaagacctcagacaa

SEQ ID NO: 917922 - DNA, 22 bp, Artificial Sequence
  chemically synthesized
cattgtattatttacttgtctg

SEQ ID NO: 917923 - DNA, 22 bp, Artificial Sequence
  chemically synthesized
acattgtattatttacttgtct

SEQ ID NO: 917924 - DNA, 22 bp, Artificial Sequence
  chemically synthesized
tacattgtattatttacttgtc

SEQ ID NO: 917925 - DNA, 22 bp, Artificial Sequence
  chemically synthesized
taaagacctcagacaagtaaat

SEQ ID NO: 917926 - DNA, 22 bp, Artificial Sequence
  chemically synthesized
attttacattgtattatttact

SEQ ID NO: 917927 - DNA, 22 bp, Artificial Sequence
  chemically synthesized
cattttacattgtattatttac

SEQ ID NO: 917928 - DNA, 22 bp, Artificial Sequence
  chemically synthesized
tcattttacattgtattattta

SEQ ID NO: 917929 - DNA, 22 bp, Artificial Sequence
  chemically synthesized
agacaagtaaataatacaatgt

SEQ ID NO: 917930 - DNA, 22 bp, Artificial Sequence
  chemically synthesized
aattttcattttacattgtatt

SEQ ID NO: 917931 - DNA, 22 bp, Artificial Sequence
  chemically synthesized
caattttcattttacattgtat

SEQ ID NO: 917932 - DNA, 22 bp, Artificial Sequence
  chemically synthesized
tttcaattttcattttacattg

SEQ ID NO: 917933 - DNA, 22 bp, Artificial Sequence
  chemically synthesized
atggattatttcaattttcatt

SEQ ID NO: 917934 - DNA, 22 bp, Artificial Sequence
  chemically synthesized
atacctaatggattatttcaat

SEQ ID NO: 917935 - DNA, 22 bp, Artificial Sequence
  chemically synthesized
catacctaatggattatttcaa

SEQ ID NO: 917936 - DNA, 22 bp, Artificial Sequence
  chemically synthesized
ttcatacctaatggattatttc

SEQ ID NO: 917937 - DNA, 22 bp, Artificial Sequence
  chemically synthesized
cttcatacctaatggattattt

SEQ ID NO: 917938 - DNA, 22 bp, Artificial Sequence
  chemically synthesized
tggtggatttcttcatacctaa

SEQ ID NO: 917939 - DNA, 22 bp, Artificial Sequence
  chemically synthesized
gtggtggatttcttcataccta

SEQ ID NO: 917940 - DNA, 22 bp, Artificial Sequence
  chemically synthesized
aaataatccattaggtatgaag

SEQ ID NO: 917941 - DNA, 22 bp, Artificial Sequence
  chemically synthesized
gaatgtttgtggtggatttctt

SEQ ID NO: 917942 - DNA, 22 bp, Artificial Sequence
  chemically synthesized
ggtatgaagaaatccaccacaa

SEQ ID NO: 917943 - DNA, 22 bp, Artificial Sequence
  chemically synthesized
caactggaatgtttgtggtgga

SEQ ID NO: 917944 - DNA, 22 bp, Artificial Sequence
  chemically synthesized
aactccaactggaatgtttgtg

SEQ ID NO: 917945 - DNA, 22 bp, Artificial Sequence
  chemically synthesized
tgaactccaactggaatgtttg

SEQ ID NO: 917946 - DNA, 22 bp, Artificial Sequence
  chemically synthesized
ctgaactccaactggaatgttt

SEQ ID NO: 917947 - DNA, 22 bp, Artificial Sequence
  chemically synthesized
gcaaatttctgaactccaactg

SEQ ID NO: 917948 - DNA, 22 bp, Artificial Sequence
  chemically synthesized
attggcaaatttctgaactcca

SEQ ID NO: 917949 - DNA, 22 bp, Artificial Sequence
  chemically synthesized
cagttggagttcagaaatttgc

SEQ ID NO: 917950 - DNA, 22 bp, Artificial Sequence
  chemically synthesized
ataaattcattggcaaatttct

SEQ ID NO: 917951 - DNA, 22 bp, Artificial Sequence
  chemically synthesized
taataaattcattggcaaattt

SEQ ID NO: 917952 - DNA, 22 bp, Artificial Sequence
  chemically synthesized
gagttcagaaatttgccaatga

SEQ ID NO: 917953 - DNA, 22 bp, Artificial Sequence
  chemically synthesized
tctctaataaattcattggcaa

SEQ ID NO: 917954 - DNA, 22 bp, Artificial Sequence
  chemically synthesized
tgtctctaataaattcattggc

SEQ ID NO: 917955 - DNA, 22 bp, Artificial Sequence
  chemically synthesized
agaaatttgccaatgaatttat

SEQ ID NO: 917956 - DNA, 22 bp, Artificial Sequence
  chemically synthesized
cctctgtctctaataaattcat

SEQ ID NO: 917957 - DNA, 22 bp, Artificial Sequence
  chemically synthesized
acctccctctgtctctaataaa

SEQ ID NO: 917958 - DNA, 22 bp, Artificial Sequence
  chemically synthesized
gccaatgaatttattagagaca

SEQ ID NO: 917959 - DNA, 22 bp, Artificial Sequence
  chemically synthesized
ttcacctccctctgtctctaat

SEQ ID NO: 917960 - DNA, 22 bp, Artificial Sequence
  chemically synthesized
ccaatgaatttattagagacag

SEQ ID NO: 917961 - DNA, 22 bp, Artificial Sequence
  chemically synthesized
cattattcacctccctctgtct

SEQ ID NO: 917962 - DNA, 22 bp, Artificial Sequence
  chemically synthesized
gcctacattattcacctccctc

SEQ ID NO: 917963 - DNA, 22 bp, Artificial Sequence
  chemically synthesized
attagagacagagggaggtgaa

SEQ ID NO: 917964 - DNA, 22 bp, Artificial Sequence
  chemically synthesized
ttagagacagagggaggtgaat

SEQ ID NO: 917965 - DNA, 22 bp, Artificial Sequence
  chemically synthesized
gagacagagggaggtgaataat

SEQ ID NO: 917966 - DNA, 22 bp, Artificial Sequence
  chemically synthesized
atagtcattggcctacattatt

SEQ ID NO: 917967 - DNA, 22 bp, Artificial Sequence
  chemically synthesized
accctcatagtcattggcctac

SEQ ID NO: 917968 - DNA, 22 bp, Artificial Sequence
  chemically synthesized
aaagttgaccctcatagtcatt

SEQ ID NO: 917969 - DNA, 22 bp, Artificial Sequence
  chemically synthesized
taaaagttgaccctcatagtca

SEQ ID NO: 917970 - DNA, 22 bp, Artificial Sequence
  chemically synthesized
actctaaaagttgaccctcata

SEQ ID NO: 917971 - DNA, 22 bp, Artificial Sequence
  chemically synthesized
attaactctaaaagttgaccct

SEQ ID NO: 917972 - DNA, 22 bp, Artificial Sequence
  chemically synthesized
ggcagttcattaactctaaaag

SEQ ID NO: 917973 - DNA, 22 bp, Artificial Sequence
  chemically synthesized
aggcagttcattaactctaaaa

SEQ ID NO: 917974 - DNA, 22 bp, Artificial Sequence
  chemically synthesized
tgagggtcaacttttagagtta

SEQ ID NO: 917975 - DNA, 22 bp, Artificial Sequence
  chemically synthesized
ccagtaaatatttaggcagttc

SEQ ID NO: 917976 - DNA, 22 bp, Artificial Sequence
  chemically synthesized
ttagagttaatgaactgcctaa

SEQ ID NO: 917977 - DNA, 22 bp, Artificial Sequence
  chemically synthesized
tagagttaatgaactgcctaaa

SEQ ID NO: 917978 - DNA, 22 bp, Artificial Sequence
  chemically synthesized
agagttaatgaactgcctaaat

SEQ ID NO: 917979 - DNA, 22 bp, Artificial Sequence
  chemically synthesized
gagttaatgaactgcctaaata

SEQ ID NO: 917980 - DNA, 22 bp, Artificial Sequence
  chemically synthesized
atgaactgcctaaatatttact

SEQ ID NO: 917981 - DNA, 22 bp, Artificial Sequence
  chemically synthesized
gcatatcacagagattcccagt

SEQ ID NO: 917982 - DNA, 22 bp, Artificial Sequence
  chemically synthesized
cctaaatatttactgggaatct

SEQ ID NO: 917983 - DNA, 22 bp, Artificial Sequence
  chemically synthesized
aatatttactgggaatctctgt

SEQ ID NO: 917984 - DNA, 22 bp, Artificial Sequence
  chemically synthesized
gcctagcatatcacagagattc

SEQ ID NO: 917985 - DNA, 22 bp, Artificial Sequence
  chemically synthesized
agcctagcatatcacagagatt

SEQ ID NO: 917986 - DNA, 22 bp, Artificial Sequence
  chemically synthesized
cttagcctagcatatcacagag

SEQ ID NO: 917987 - DNA, 22 bp, Artificial Sequence
  chemically synthesized
actgggaatctctgtgatatgc

SEQ ID NO: 917988 - DNA, 22 bp, Artificial Sequence
  chemically synthesized
ctgggaatctctgtgatatgct

SEQ ID NO: 917989 - DNA, 22 bp, Artificial Sequence
  chemically synthesized
ggaatctctgtgatatgctagg

SEQ ID NO: 917990 - DNA, 22 bp, Artificial Sequence
  chemically synthesized
aaggtgccctacttagcctagc

SEQ ID NO: 917991 - DNA, 22 bp, Artificial Sequence
  chemically synthesized
gaaggtgccctacttagcctag

SEQ ID NO: 917992 - DNA, 22 bp, Artificial Sequence
  chemically synthesized
tgtgatatgctaggctaagtag

SEQ ID NO: 917993 - DNA, 22 bp, Artificial Sequence
  chemically synthesized
tgatatgctaggctaagtaggg

SEQ ID NO: 917994 - DNA, 22 bp, Artificial Sequence
  chemically synthesized
ggctaagtagggcaccttcaaa

SEQ ID NO: 917995 - DNA, 22 bp, Artificial Sequence
  chemically synthesized
agtagggcaccttcaaatgata

SEQ ID NO: 917996 - DNA, 22 bp, Artificial Sequence
  chemically synthesized
taagtgagcagtgtgtatatca

SEQ ID NO: 917997 - DNA, 22 bp, Artificial Sequence
  chemically synthesized
caaatgatatacacactgctca

SEQ ID NO: 917998 - DNA, 22 bp, Artificial Sequence
  chemically synthesized
aaatgatatacacactgctcac

SEQ ID NO: 917999 - DNA, 22 bp, Artificial Sequence
  chemically synthesized
agtgaaatataatctgtaagtg

SEQ ID NO: 918000 - DNA, 22 bp, Artificial Sequence
  chemically synthesized
cctcagtgaaatataatctgta

SEQ ID NO: 918001 - DNA, 22 bp, Artificial Sequence
  chemically synthesized
gcctcagtgaaatataatctgt

SEQ ID NO: 918002 - DNA, 22 bp, Artificial Sequence
  chemically synthesized
ctcacttacagattatatttca

SEQ ID NO: 918003 - DNA, 22 bp, Artificial Sequence
  chemically synthesized
acttacagattatatttcactg

SEQ ID NO: 918004 - DNA, 22 bp, Artificial Sequence
  chemically synthesized
acagattatatttcactgaggc

SEQ ID NO: 918005 - DNA, 22 bp, Artificial Sequence
  chemically synthesized
cagattatatttcactgaggca

SEQ ID NO: 918006 - DNA, 22 bp, Artificial Sequence
  chemically synthesized
atgacaggcgagcttgcctcag

SEQ ID NO: 918007 - DNA, 22 bp, Artificial Sequence
  chemically synthesized
tatttcactgaggcaagctcgc

SEQ ID NO: 918008 - DNA, 22 bp, Artificial Sequence
  chemically synthesized
cactgaggcaagctcgcctgtc

SEQ ID NO: 918009 - DNA, 22 bp, Artificial Sequence
  chemically synthesized
actgaggcaagctcgcctgtca

SEQ ID NO: 918010 - DNA, 22 bp, Artificial Sequence
  chemically synthesized
aggcaagctcgcctgtcattaa

SEQ ID NO: 918011 - DNA, 22 bp, Artificial Sequence
  chemically synthesized
ataaaatacagtaagttaatga

SEQ ID NO: 918012 - DNA, 22 bp, Artificial Sequence
  chemically synthesized
ttgataaaatacagtaagttaa

SEQ ID NO: 918013 - DNA, 22 bp, Artificial Sequence
  chemically synthesized
gttgataaaatacagtaagtta

SEQ ID NO: 918014 - DNA, 22 bp, Artificial Sequence
  chemically synthesized
gcctgtcattaacttactgtat

SEQ ID NO: 918015 - DNA, 22 bp, Artificial Sequence
  chemically synthesized
tcattaacttactgtattttat

SEQ ID NO: 918016 - DNA, 22 bp, Artificial Sequence
  chemically synthesized
aaatatttgttgataaaataca

SEQ ID NO: 918017 - DNA, 22 bp, Artificial Sequence
  chemically synthesized
acttactgtattttatcaacaa

SEQ ID NO: 918018 - DNA, 22 bp, Artificial Sequence
  chemically synthesized
actgtattttatcaacaaatat

SEQ ID NO: 918019 - DNA, 22 bp, Artificial Sequence
  chemically synthesized
ctgtattttatcaacaaatatt

SEQ ID NO: 918020 - DNA, 22 bp, Artificial Sequence
  chemically synthesized
tattttatcaacaaatatttga

SEQ ID NO: 918021 - DNA, 22 bp, Artificial Sequence
  chemically synthesized
gtatgtggtagatgctcaaata

SEQ ID NO: 918022 - DNA, 22 bp, Artificial Sequence
  chemically synthesized
tatcaacaaatatttgagcatc

SEQ ID NO: 918023 - DNA, 22 bp, Artificial Sequence
  chemically synthesized
atcaacaaatatttgagcatct

SEQ ID NO: 918024 - DNA, 22 bp, Artificial Sequence
  chemically synthesized
tcaacaaatatttgagcatcta

SEQ ID NO: 918025 - DNA, 22 bp, Artificial Sequence
  chemically synthesized
gagcatctaccacataccaggt

SEQ ID NO: 918026 - DNA, 22 bp, Artificial Sequence
  chemically synthesized
agcatctaccacataccaggta

SEQ ID NO: 918027 - DNA, 22 bp, Artificial Sequence
  chemically synthesized
atcaagtagcaaaatcagtacc

SEQ ID NO: 918028 - DNA, 22 bp, Artificial Sequence
  chemically synthesized
ccacataccaggtactgatttt

SEQ ID NO: 918029 - DNA, 22 bp, Artificial Sequence
  chemically synthesized
cctcatcaagtagcaaaatcag

SEQ ID NO: 918030 - DNA, 22 bp, Artificial Sequence
  chemically synthesized
actacctcatcaagtagcaaaa

SEQ ID NO: 918031 - DNA, 22 bp, Artificial Sequence
  chemically synthesized
ttaactacctcatcaagtagca

SEQ ID NO: 918032 - DNA, 22 bp, Artificial Sequence
  chemically synthesized
gttaactacctcatcaagtagc

SEQ ID NO: 918033 - DNA, 22 bp, Artificial Sequence
  chemically synthesized
tgttaactacctcatcaagtag

SEQ ID NO: 918034 - DNA, 22 bp, Artificial Sequence
  chemically synthesized
attttgctacttgatgaggtag

SEQ ID NO: 918035 - DNA, 22 bp, Artificial Sequence
  chemically synthesized
tcaacattttgttaactacctc

SEQ ID NO: 918036 - DNA, 22 bp, Artificial Sequence
  chemically synthesized
tgctacttgatgaggtagttaa

SEQ ID NO: 918037 - DNA, 22 bp, Artificial Sequence
  chemically synthesized
gctacttgatgaggtagttaac

SEQ ID NO: 918038 - DNA, 22 bp, Artificial Sequence
  chemically synthesized
ctacttgatgaggtagttaaca

SEQ ID NO: 918039 - DNA, 22 bp, Artificial Sequence
  chemically synthesized
gcctgtcaacattttgttaact

SEQ ID NO: 918040 - DNA, 22 bp, Artificial Sequence
  chemically synthesized
cttgatgaggtagttaacaaaa

SEQ ID NO: 918041 - DNA, 22 bp, Artificial Sequence
  chemically synthesized
gatgaggtagttaacaaaatgt

SEQ ID NO: 918042 - DNA, 22 bp, Artificial Sequence
  chemically synthesized
actagcctgtcaacattttgtt

SEQ ID NO: 918043 - DNA, 22 bp, Artificial Sequence
  chemically synthesized
atgaggtagttaacaaaatgtt

SEQ ID NO: 918044 - DNA, 22 bp, Artificial Sequence
  chemically synthesized
tatcactgactagcctgtcaac

SEQ ID NO: 918045 - DNA, 22 bp, Artificial Sequence
  chemically synthesized
acaaaatgttgacaggctagtc

SEQ ID NO: 918046 - DNA, 22 bp, Artificial Sequence
  chemically synthesized
atgtatctgtatcactgactag

SEQ ID NO: 918047 - DNA, 22 bp, Artificial Sequence
  chemically synthesized
acaggctagtcagtgatacaga

SEQ ID NO: 918048 - DNA, 22 bp, Artificial Sequence
  chemically synthesized
gtcagtgatacagatacatgaa

SEQ ID NO: 918049 - DNA, 22 bp, Artificial Sequence
  chemically synthesized
aaaaaataaaaacaataaaaaa

SEQ ID NO: 918050 - DNA, 22 bp, Artificial Sequence
  chemically synthesized
catctcaaaaaataaaaacaat

SEQ ID NO: 918051 - DNA, 22 bp, Artificial Sequence
  chemically synthesized
cttttttttattgtttttattt

SEQ ID NO: 918052 - DNA, 22 bp, Artificial Sequence
  chemically synthesized
ttttttattgtttttatttttt

SEQ ID NO: 918053 - DNA, 22 bp, Artificial Sequence
  chemically synthesized
tttttattgtttttattttttg

SEQ ID NO: 918054 - DNA, 22 bp, Artificial Sequence
  chemically synthesized
ttttattgtttttattttttga

SEQ ID NO: 918055 - DNA, 22 bp, Artificial Sequence
  chemically synthesized
tttattgtttttattttttgag

SEQ ID NO: 918056 - DNA, 22 bp, Artificial Sequence
  chemically synthesized
ttattgtttttattttttgaga

SEQ ID NO: 918057 - DNA, 22 bp, Artificial Sequence
  chemically synthesized
tattgtttttattttttgagat

SEQ ID NO: 918058 - DNA, 22 bp, Artificial Sequence
  chemically synthesized
attgtttttattttttgagatg

SEQ ID NO: 918059 - DNA, 22 bp, Artificial Sequence
  chemically synthesized
ttgtttttattttttgagatgg

SEQ ID NO: 918060 - DNA, 22 bp, Artificial Sequence
  chemically synthesized
tttttattttttgagatggagt

SEQ ID NO: 918061 - DNA, 22 bp, Artificial Sequence
  chemically synthesized
ggtgacagagcgagactccatc

SEQ ID NO: 918062 - DNA, 22 bp, Artificial Sequence
  chemically synthesized
ttattttttgagatggagtctc

SEQ ID NO: 918063 - DNA, 22 bp, Artificial Sequence
  chemically synthesized
tattttttgagatggagtctcg

SEQ ID NO: 918064 - DNA, 22 bp, Artificial Sequence
  chemically synthesized
attttttgagatggagtctcgc

SEQ ID NO: 918065 - DNA, 22 bp, Artificial Sequence
  chemically synthesized
ttttttgagatggagtctcgct

SEQ ID NO: 918066 - DNA, 22 bp, Artificial Sequence
  chemically synthesized
tttgagatggagtctcgctctg

SEQ ID NO: 918067 - DNA, 22 bp, Artificial Sequence
  chemically synthesized
ttgagatggagtctcgctctgt

SEQ ID NO: 918068 - DNA, 22 bp, Artificial Sequence
  chemically synthesized
tgagatggagtctcgctctgtc

SEQ ID NO: 918069 - DNA, 22 bp, Artificial Sequence
  chemically synthesized
gagatggagtctcgctctgtca

SEQ ID NO: 918070 - DNA, 22 bp, Artificial Sequence
  chemically synthesized
agatggagtctcgctctgtcac

SEQ ID NO: 918071 - DNA, 22 bp, Artificial Sequence
  chemically synthesized
caccccagcctgggtgacagag

SEQ ID NO: 918072 - DNA, 22 bp, Artificial Sequence
  chemically synthesized
gctctgtcacccaggctggggt

SEQ ID NO: 918073 - DNA, 22 bp, Artificial Sequence
  chemically synthesized
tgtcacccaggctggggtgcag

SEQ ID NO: 918074 - DNA, 22 bp, Artificial Sequence
  chemically synthesized
tcacccaggctggggtgcagtg

SEQ ID NO: 918075 - DNA, 22 bp, Artificial Sequence
  chemically synthesized
tgagccaagatcgcgccactgc

SEQ ID NO: 918076 - DNA, 22 bp, Artificial Sequence
  chemically synthesized
ctgtgagccaagatcgcgccac

SEQ ID NO: 918077 - DNA, 22 bp, Artificial Sequence
  chemically synthesized
gggtgcagtggcgcgatcttgg

SEQ ID NO: 918078 - DNA, 22 bp, Artificial Sequence
  chemically synthesized
aacccaggaggtggaggttgct

SEQ ID NO: 918079 - DNA, 22 bp, Artificial Sequence
  chemically synthesized
gaacccaggaggtggaggttgc

SEQ ID NO: 918080 - DNA, 22 bp, Artificial Sequence
  chemically synthesized
ggctcacagcaacctccacctc

SEQ ID NO: 918081 - DNA, 22 bp, Artificial Sequence
  chemically synthesized
gctcacagcaacctccacctcc

SEQ ID NO: 918082 - DNA, 22 bp, Artificial Sequence
  chemically synthesized
acagcaacctccacctcctggg

SEQ ID NO: 918083 - DNA, 22 bp, Artificial Sequence
  chemically synthesized
aggcaggagaatcgtttgaacc

SEQ ID NO: 918084 - DNA, 22 bp, Artificial Sequence
  chemically synthesized
cacctcctgggttcaaacgatt

SEQ ID NO: 918085 - DNA, 22 bp, Artificial Sequence
  chemically synthesized
ggaggctgaggcaggagaatcg

SEQ ID NO: 918086 - DNA, 22 bp, Artificial Sequence
  chemically synthesized
ctgggttcaaacgattctcctg

SEQ ID NO: 918087 - DNA, 22 bp, Artificial Sequence
  chemically synthesized
ctcggaggctgaggcaggagaa

SEQ ID NO: 918088 - DNA, 22 bp, Artificial Sequence
  chemically synthesized
ggttcaaacgattctcctgcct

SEQ ID NO: 918089 - DNA, 22 bp, Artificial Sequence
  chemically synthesized
aaacgattctcctgcctcagcc

SEQ ID NO: 918090 - DNA, 22 bp, Artificial Sequence
  chemically synthesized
atcccagctactcggaggctga

SEQ ID NO: 918091 - DNA, 22 bp, Artificial Sequence
  chemically synthesized
aatcccagctactcggaggctg

SEQ ID NO: 918092 - DNA, 22 bp, Artificial Sequence
  chemically synthesized
taatcccagctactcggaggct

SEQ ID NO: 918093 - DNA, 22 bp, Artificial Sequence
  chemically synthesized
tcctgcctcagcctccgagtag

SEQ ID NO: 918094 - DNA, 22 bp, Artificial Sequence
  chemically synthesized
ctgcctcagcctccgagtagct

SEQ ID NO: 918095 - DNA, 22 bp, Artificial Sequence
  chemically synthesized
cctcagcctccgagtagctggg

SEQ ID NO: 918096 - DNA, 22 bp, Artificial Sequence
  chemically synthesized
tcgcattttaatcccagctact

SEQ ID NO: 918097 - DNA, 22 bp, Artificial Sequence
  chemically synthesized
atcgcattttaatcccagctac

SEQ ID NO: 918098 - DNA, 22 bp, Artificial Sequence
  chemically synthesized
agcctccgagtagctgggatta

SEQ ID NO: 918099 - DNA, 22 bp, Artificial Sequence
  chemically synthesized
aatgcttatcgcattttaatcc

SEQ ID NO: 918100 - DNA, 22 bp, Artificial Sequence
  chemically synthesized
caatgcttatcgcattttaatc

SEQ ID NO: 918101 - DNA, 22 bp, Artificial Sequence
  chemically synthesized
cgagtagctgggattaaaatgc

SEQ ID NO: 918102 - DNA, 22 bp, Artificial Sequence
  chemically synthesized
cacttcaatgcttatcgcattt

SEQ ID NO: 918103 - DNA, 22 bp, Artificial Sequence
  chemically synthesized
ggattaaaatgcgataagcatt

SEQ ID NO: 918104 - DNA, 22 bp, Artificial Sequence
  chemically synthesized
aaatgcgataagcattgaagtg

SEQ ID NO: 918105 - DNA, 22 bp, Artificial Sequence
  chemically synthesized
gtgaatgcatagctacacttca

SEQ ID NO: 918106 - DNA, 22 bp, Artificial Sequence
  chemically synthesized
ggtgaatgcatagctacacttc

SEQ ID NO: 918107 - DNA, 22 bp, Artificial Sequence
  chemically synthesized
aagtgtagctatgcattcacca

SEQ ID NO: 918108 - DNA, 22 bp, Artificial Sequence
  chemically synthesized
gtagatgtgtaataaatgtttg

SEQ ID NO: 918109 - DNA, 22 bp, Artificial Sequence
  chemically synthesized
ggtagatgtgtaataaatgttt

SEQ ID NO: 918110 - DNA, 22 bp, Artificial Sequence
  chemically synthesized
tgcattcaccaaacatttatta

SEQ ID NO: 918111 - DNA, 22 bp, Artificial Sequence
  chemically synthesized
gcccttggtagatgtgtaataa

SEQ ID NO: 918112 - DNA, 22 bp, Artificial Sequence
  chemically synthesized
accaaacatttattacacatct

SEQ ID NO: 918113 - DNA, 22 bp, Artificial Sequence
  chemically synthesized
attacacatctaccaagggcca

SEQ ID NO: 918114 - DNA, 22 bp, Artificial Sequence
  chemically synthesized
ttacacatctaccaagggccag

SEQ ID NO: 918115 - DNA, 22 bp, Artificial Sequence
  chemically synthesized
cacatctaccaagggccaggca

SEQ ID NO: 918116 - DNA, 22 bp, Artificial Sequence
  chemically synthesized
ccaagggccaggcactatacta

SEQ ID NO: 918117 - DNA, 22 bp, Artificial Sequence
  chemically synthesized
aatatccagcaaaaatagtata

SEQ ID NO: 918118 - DNA, 22 bp, Artificial Sequence
  chemically synthesized
ctgaatatccagcaaaaatagt

SEQ ID NO: 918119 - DNA, 22 bp, Artificial Sequence
  chemically synthesized
actcctgaatatccagcaaaaa

SEQ ID NO: 918120 - DNA, 22 bp, Artificial Sequence
  chemically synthesized
ttcactcctgaatatccagcaa

SEQ ID NO: 918121 - DNA, 22 bp, Artificial Sequence
  chemically synthesized
gttcactcctgaatatccagca

SEQ ID NO: 918122 - DNA, 22 bp, Artificial Sequence
  chemically synthesized
tgttcactcctgaatatccagc

SEQ ID NO: 918123 - DNA, 22 bp, Artificial Sequence
  chemically synthesized
tactatttttgctggatattca

SEQ ID NO: 918124 - DNA, 22 bp, Artificial Sequence
  chemically synthesized
ttttgttcactcctgaatatcc

SEQ ID NO: 918125 - DNA, 22 bp, Artificial Sequence
  chemically synthesized
tgttttgttcactcctgaatat

SEQ ID NO: 918126 - DNA, 22 bp, Artificial Sequence
  chemically synthesized
tttttgctggatattcaggagt

SEQ ID NO: 918127 - DNA, 22 bp, Artificial Sequence
  chemically synthesized
gctctgttttgttcactcctga

SEQ ID NO: 918128 - DNA, 22 bp, Artificial Sequence
  chemically synthesized
ttgctggatattcaggagtgaa

SEQ ID NO: 918129 - DNA, 22 bp, Artificial Sequence
  chemically synthesized
tgctggatattcaggagtgaac

SEQ ID NO: 918130 - DNA, 22 bp, Artificial Sequence
  chemically synthesized
gctggatattcaggagtgaaca

SEQ ID NO: 918131 - DNA, 22 bp, Artificial Sequence
  chemically synthesized
ctggatattcaggagtgaacaa

SEQ ID NO: 918132 - DNA, 22 bp, Artificial Sequence
  chemically synthesized
gatattcaggagtgaacaaaac

SEQ ID NO: 918133 - DNA, 22 bp, Artificial Sequence
  chemically synthesized
cgtgtatggactggctctgttt

SEQ ID NO: 918134 - DNA, 22 bp, Artificial Sequence
  chemically synthesized
aggagtgaacaaaacagagcca

SEQ ID NO: 918135 - DNA, 22 bp, Artificial Sequence
  chemically synthesized
atgtcacccatgacaccataag

SEQ ID NO: 918136 - DNA, 22 bp, Artificial Sequence
  chemically synthesized
atgttgatgtcacccatgacac

SEQ ID NO: 918137 - DNA, 22 bp, Artificial Sequence
  chemically synthesized
aatgttgatgtcacccatgaca

SEQ ID NO: 918138 - DNA, 22 bp, Artificial Sequence
  chemically synthesized
gtggtttaatgttgatgtcacc

SEQ ID NO: 918139 - DNA, 22 bp, Artificial Sequence
  chemically synthesized
atggtgtcatgggtgacatcaa

SEQ ID NO: 918140 - DNA, 22 bp, Artificial Sequence
  chemically synthesized
tggtgtcatgggtgacatcaac

SEQ ID NO: 918141 - DNA, 22 bp, Artificial Sequence
  chemically synthesized
tatgattagtggtttaatgttg

SEQ ID NO: 918142 - DNA, 22 bp, Artificial Sequence
  chemically synthesized
gtatgattagtggtttaatgtt

SEQ ID NO: 918143 - DNA, 22 bp, Artificial Sequence
  chemically synthesized
tgtatgattagtggtttaatgt

SEQ ID NO: 918144 - DNA, 22 bp, Artificial Sequence
  chemically synthesized
ttgtatgattagtggtttaatg

SEQ ID NO: 918145 - DNA, 22 bp, Artificial Sequence
  chemically synthesized
ttttgtatgattagtggtttaa

SEQ ID NO: 918146 - DNA, 22 bp, Artificial Sequence
  chemically synthesized
aactcttttgtatgattagtgg

SEQ ID NO: 918147 - DNA, 22 bp, Artificial Sequence
  chemically synthesized
cattaaactcttttgtatgatt

SEQ ID NO: 918148 - DNA, 22 bp, Artificial Sequence
  chemically synthesized
gcattaaactcttttgtatgat

SEQ ID NO: 918149 - DNA, 22 bp, Artificial Sequence
  chemically synthesized
aaccactaatcatacaaaagag

SEQ ID NO: 918150 - DNA, 22 bp, Artificial Sequence
  chemically synthesized
atcatacaaaagagtttaatgc

SEQ ID NO: 918151 - DNA, 22 bp, Artificial Sequence
  chemically synthesized
tatatatgtatggtttgcatta

SEQ ID NO: 918152 - DNA, 22 bp, Artificial Sequence
  chemically synthesized
tatatatatgtatggtttgcat

SEQ ID NO: 918153 - DNA, 22 bp, Artificial Sequence
  chemically synthesized
ctatatatatgtatggtttgca

SEQ ID NO: 918154 - DNA, 22 bp, Artificial Sequence
  chemically synthesized
tctatatatatgtatggtttgc

SEQ ID NO: 918155 - DNA, 22 bp, Artificial Sequence
  chemically synthesized
ttctatatatatgtatggtttg

SEQ ID NO: 918156 - DNA, 22 bp, Artificial Sequence
  chemically synthesized
tttctatatatatgtatggttt

SEQ ID NO: 918157 - DNA, 22 bp, Artificial Sequence
  chemically synthesized
ttttctatatatatgtatggtt

SEQ ID NO: 918158 - DNA, 22 bp, Artificial Sequence
  chemically synthesized
atttttttctatatatatgtat

SEQ ID NO: 918159 - DNA, 22 bp, Artificial Sequence
  chemically synthesized
aatttttttctatatatatgta

SEQ ID NO: 918160 - DNA, 22 bp, Artificial Sequence
  chemically synthesized
aatgcaaaccatacatatatat

SEQ ID NO: 918161 - DNA, 22 bp, Artificial Sequence
  chemically synthesized
atgcaaaccatacatatatata

SEQ ID NO: 918162 - DNA, 22 bp, Artificial Sequence
  chemically synthesized
acaatcttaatttttttctata

SEQ ID NO: 918163 - DNA, 22 bp, Artificial Sequence
  chemically synthesized
ctaacaatcttaatttttttct

SEQ ID NO: 918164 - DNA, 22 bp, Artificial Sequence
  chemically synthesized
tcctaacaatcttaattttttt

SEQ ID NO: 918165 - DNA, 22 bp, Artificial Sequence
  chemically synthesized
taaaaaaggagtactctcctaa

SEQ ID NO: 918166 - DNA, 22 bp, Artificial Sequence
  chemically synthesized
gtaaaaaaggagtactctccta

SEQ ID NO: 918167 - DNA, 22 bp, Artificial Sequence
  chemically synthesized
agattgttaggagagtactcct

SEQ ID NO: 918168 - DNA, 22 bp, Artificial Sequence
  chemically synthesized
ttaggagagtactcctttttta

SEQ ID NO: 918169 - DNA, 22 bp, Artificial Sequence
  chemically synthesized
aaagtgaaagtttgtaaaaaag

SEQ ID NO: 918170 - DNA, 22 bp, Artificial Sequence
  chemically synthesized
ggagagtactccttttttacaa

SEQ ID NO: 918171 - DNA, 22 bp, Artificial Sequence
  chemically synthesized
tgaaagtgaaagtttgtaaaaa

SEQ ID NO: 918172 - DNA, 22 bp, Artificial Sequence
  chemically synthesized
tgaaagttctgaaagtgaaagt

SEQ ID NO: 918173 - DNA, 22 bp, Artificial Sequence
  chemically synthesized
cttttttacaaactttcacttt

SEQ ID NO: 918174 - DNA, 22 bp, Artificial Sequence
  chemically synthesized
ttttacaaactttcactttcag

SEQ ID NO: 918175 - DNA, 22 bp, Artificial Sequence
  chemically synthesized
tttacaaactttcactttcaga

SEQ ID NO: 918176 - DNA, 22 bp, Artificial Sequence
  chemically synthesized
ttacaaactttcactttcagaa

SEQ ID NO: 918177 - DNA, 22 bp, Artificial Sequence
  chemically synthesized
tacaaactttcactttcagaac

SEQ ID NO: 918178 - DNA, 22 bp, Artificial Sequence
  chemically synthesized
acaaactttcactttcagaact

SEQ ID NO: 918179 - DNA, 22 bp, Artificial Sequence
  chemically synthesized
caaactttcactttcagaactt

SEQ ID NO: 918180 - DNA, 22 bp, Artificial Sequence
  chemically synthesized
ggagcaacatacctatgaaagt

SEQ ID NO: 918181 - DNA, 22 bp, Artificial Sequence
  chemically synthesized
tcactttcagaactttcatagg

SEQ ID NO: 918182 - DNA, 22 bp, Artificial Sequence
  chemically synthesized
aggagcaacatacctatgaaag

SEQ ID NO: 918183 - DNA, 22 bp, Artificial Sequence
  chemically synthesized
cactttcagaactttcataggt

SEQ ID NO: 918184 - DNA, 22 bp, Artificial Sequence
  chemically synthesized
taggagcaacatacctatgaaa

SEQ ID NO: 918185 - DNA, 22 bp, Artificial Sequence
  chemically synthesized
actttcagaactttcataggta

SEQ ID NO: 918186 - DNA, 22 bp, Artificial Sequence
  chemically synthesized
cctttaggagcaacatacctat

SEQ ID NO: 918187 - DNA, 22 bp, Artificial Sequence
  chemically synthesized
tcagaactttcataggtatgtt

SEQ ID NO: 918188 - DNA, 22 bp, Artificial Sequence
  chemically synthesized
gcctttaggagcaacataccta

SEQ ID NO: 918189 - DNA, 22 bp, Artificial Sequence
  chemically synthesized
cagaactttcataggtatgttg

SEQ ID NO: 918190 - DNA, 22 bp, Artificial Sequence
  chemically synthesized
agaactttcataggtatgttgc

SEQ ID NO: 918191 - DNA, 22 bp, Artificial Sequence
  chemically synthesized
tcataggtatgttgctcctaaa

SEQ ID NO: 918192 - DNA, 22 bp, Artificial Sequence
  chemically synthesized
cataggtatgttgctcctaaag

SEQ ID NO: 918193 - DNA, 22 bp, Artificial Sequence
  chemically synthesized
atgcatatttgcctttaggagc

SEQ ID NO: 918194 - DNA, 22 bp, Artificial Sequence
  chemically synthesized
ataggtatgttgctcctaaagg

SEQ ID NO: 918195 - DNA, 22 bp, Artificial Sequence
  chemically synthesized
gatgcatatttgcctttaggag

SEQ ID NO: 918196 - DNA, 22 bp, Artificial Sequence
  chemically synthesized
ctcctaaaggcaaatatgcatc

SEQ ID NO: 918197 - DNA, 22 bp, Artificial Sequence
  chemically synthesized
ctaaaggcaaatatgcatcaaa

SEQ ID NO: 918198 - DNA, 22 bp, Artificial Sequence
  chemically synthesized
atggaaagtaaaatttgatgca

SEQ ID NO: 918199 - DNA, 22 bp, Artificial Sequence
  chemically synthesized
aaggcaaatatgcatcaaattt

SEQ ID NO: 918200 - DNA, 22 bp, Artificial Sequence
  chemically synthesized
ttcatggaaagtaaaatttgat

SEQ ID NO: 918201 - DNA, 22 bp, Artificial Sequence
  chemically synthesized
attcatggaaagtaaaatttga

SEQ ID NO: 918202 - DNA, 22 bp, Artificial Sequence
  chemically synthesized
accagtgaccccatttattcat

SEQ ID NO: 918203 - DNA, 22 bp, Artificial Sequence
  chemically synthesized
tactttccatgaataaatgggg

SEQ ID NO: 918204 - DNA, 22 bp, Artificial Sequence
  chemically synthesized
actttccatgaataaatggggt

SEQ ID NO: 918205 - DNA, 22 bp, Artificial Sequence
  chemically synthesized
ctttccatgaataaatggggtc

SEQ ID NO: 918206 - DNA, 22 bp, Artificial Sequence
  chemically synthesized
tagctgaccagtgaccccattt

SEQ ID NO: 918207 - DNA, 22 bp, Artificial Sequence
  chemically synthesized
tccatgaataaatggggtcact

SEQ ID NO: 918208 - DNA, 22 bp, Artificial Sequence
  chemically synthesized
ccatgaataaatggggtcactg

SEQ ID NO: 918209 - DNA, 22 bp, Artificial Sequence
  chemically synthesized
catgaataaatggggtcactgg

SEQ ID NO: 918210 - DNA, 22 bp, Artificial Sequence
  chemically synthesized
taataactatagctgaccagtg

SEQ ID NO: 918211 - DNA, 22 bp, Artificial Sequence
  chemically synthesized
gtcagctatagttattatagtt

SEQ ID NO: 918212 - DNA, 22 bp, Artificial Sequence
  chemically synthesized
gacatgataccaaaaactataa

SEQ ID NO: 918213 - DNA, 22 bp, Artificial Sequence
  chemically synthesized
tagttattatagtttttggtat

SEQ ID NO: 918214 - DNA, 22 bp, Artificial Sequence
  chemically synthesized
aagttagacatgataccaaaaa

SEQ ID NO: 918215 - DNA, 22 bp, Artificial Sequence
  chemically synthesized
gtctaaagttagacatgatacc

SEQ ID NO: 918216 - DNA, 22 bp, Artificial Sequence
  chemically synthesized
ttatagtttttggtatcatgtc

SEQ ID NO: 918217 - DNA, 22 bp, Artificial Sequence
  chemically synthesized
agtctaaagttagacatgatac

SEQ ID NO: 918218 - DNA, 22 bp, Artificial Sequence
  chemically synthesized
tagtttttggtatcatgtctaa

SEQ ID NO: 918219 - DNA, 22 bp, Artificial Sequence
  chemically synthesized
ttggtatcatgtctaactttag

SEQ ID NO: 918220 - DNA, 22 bp, Artificial Sequence
  chemically synthesized
tggtatcatgtctaactttaga

SEQ ID NO: 918221 - DNA, 22 bp, Artificial Sequence
  chemically synthesized
ggtatcatgtctaactttagac

SEQ ID NO: 918222 - DNA, 22 bp, Artificial Sequence
  chemically synthesized
gtatcatgtctaactttagact

SEQ ID NO: 918223 - DNA, 22 bp, Artificial Sequence
  chemically synthesized
actttagactaagatgtgtctc

SEQ ID NO: 918224 - DNA, 22 bp, Artificial Sequence
  chemically synthesized
tagactaagatgtgtctcctct

SEQ ID NO: 918225 - DNA, 22 bp, Artificial Sequence
  chemically synthesized
aaaaatacacacagaggagaca

SEQ ID NO: 918226 - DNA, 22 bp, Artificial Sequence
  chemically synthesized
agactaagatgtgtctcctctg

SEQ ID NO: 918227 - DNA, 22 bp, Artificial Sequence
  chemically synthesized
caaaaatacacacagaggagac

SEQ ID NO: 918228 - DNA, 22 bp, Artificial Sequence
  chemically synthesized
gactaagatgtgtctcctctgt

SEQ ID NO: 918229 - DNA, 22 bp, Artificial Sequence
  chemically synthesized
agatgtgtctcctctgtgtgta

SEQ ID NO: 918230 - DNA, 22 bp, Artificial Sequence
  chemically synthesized
gaaaacatttcaaaaatacaca

SEQ ID NO: 918231 - DNA, 22 bp, Artificial Sequence
  chemically synthesized
agaaaacatttcaaaaatacac

SEQ ID NO: 918232 - DNA, 22 bp, Artificial Sequence
  chemically synthesized
ctctgtgtgtatttttgaaatg

SEQ ID NO: 918233 - DNA, 22 bp, Artificial Sequence
  chemically synthesized
tgtgtgtatttttgaaatgttt

SEQ ID NO: 918234 - DNA, 22 bp, Artificial Sequence
  chemically synthesized
ataatgtttagaaaacatttca

SEQ ID NO: 918235 - DNA, 22 bp, Artificial Sequence
  chemically synthesized
tgtgtatttttgaaatgttttc

SEQ ID NO: 918236 - DNA, 22 bp, Artificial Sequence
  chemically synthesized
ttgaaatgttttctaaacatta

SEQ ID NO: 918237 - DNA, 22 bp, Artificial Sequence
  chemically synthesized
tgaaatgttttctaaacattat

SEQ ID NO: 918238 - DNA, 22 bp, Artificial Sequence
  chemically synthesized
gaaatgttttctaaacattatt

SEQ ID NO: 918239 - DNA, 22 bp, Artificial Sequence
  chemically synthesized
aaatgttttctaaacattatta

SEQ ID NO: 918240 - DNA, 22 bp, Artificial Sequence
  chemically synthesized
atggcacataatgagattaata

SEQ ID NO: 918241 - DNA, 22 bp, Artificial Sequence
  chemically synthesized
tctaaacattattaatctcatt

SEQ ID NO: 918242 - DNA, 22 bp, Artificial Sequence
  chemically synthesized
ctaaacattattaatctcatta

SEQ ID NO: 918243 - DNA, 22 bp, Artificial Sequence
  chemically synthesized
taaacattattaatctcattat

SEQ ID NO: 918244 - DNA, 22 bp, Artificial Sequence
  chemically synthesized
tactcatggcacataatgagat

SEQ ID NO: 918245 - DNA, 22 bp, Artificial Sequence
  chemically synthesized
gtactcatggcacataatgaga

SEQ ID NO: 918246 - DNA, 22 bp, Artificial Sequence
  chemically synthesized
aacattattaatctcattatgt

SEQ ID NO: 918247 - DNA, 22 bp, Artificial Sequence
  chemically synthesized
tgtactcatggcacataatgag

SEQ ID NO: 918248 - DNA, 22 bp, Artificial Sequence
  chemically synthesized
ttgtactcatggcacataatga

SEQ ID NO: 918249 - DNA, 22 bp, Artificial Sequence
  chemically synthesized
cttttgtactcatggcacataa

SEQ ID NO: 918250 - DNA, 22 bp, Artificial Sequence
  chemically synthesized
gcttttgtactcatggcacata

SEQ ID NO: 918251 - DNA, 22 bp, Artificial Sequence
  chemically synthesized
tgcttttgtactcatggcacat

SEQ ID NO: 918252 - DNA, 22 bp, Artificial Sequence
  chemically synthesized
ttaatctcattatgtgccatga

SEQ ID NO: 918253 - DNA, 22 bp, Artificial Sequence
  chemically synthesized
ctttgcttttgtactcatggca

SEQ ID NO: 918254 - DNA, 22 bp, Artificial Sequence
  chemically synthesized
atctcattatgtgccatgagta

SEQ ID NO: 918255 - DNA, 22 bp, Artificial Sequence
  chemically synthesized
gctttgcttttgtactcatggc

SEQ ID NO: 918256 - DNA, 22 bp, Artificial Sequence
  chemically synthesized
attatgtgccatgagtacaaaa

SEQ ID NO: 918257 - DNA, 22 bp, Artificial Sequence
  chemically synthesized
tgtgccatgagtacaaaagcaa

SEQ ID NO: 918258 - DNA, 22 bp, Artificial Sequence
  chemically synthesized
aacaaatttgctttgcttttgt

SEQ ID NO: 918259 - DNA, 22 bp, Artificial Sequence
  chemically synthesized
tcaacaaatttgctttgctttt

SEQ ID NO: 918260 - DNA, 22 bp, Artificial Sequence
  chemically synthesized
ccaggactctcaacaaatttgc

SEQ ID NO: 918261 - DNA, 22 bp, Artificial Sequence
  chemically synthesized
cccaggactctcaacaaatttg

SEQ ID NO: 918262 - DNA, 22 bp, Artificial Sequence
  chemically synthesized
tcccaggactctcaacaaattt

SEQ ID NO: 918263 - DNA, 22 bp, Artificial Sequence
  chemically synthesized
tgttttcccaggactctcaaca

SEQ ID NO: 918264 - DNA, 22 bp, Artificial Sequence
  chemically synthesized
tatgttttcccaggactctcaa

SEQ ID NO: 918265 - DNA, 22 bp, Artificial Sequence
  chemically synthesized
ctatgttttcccaggactctca

SEQ ID NO: 918266 - DNA, 22 bp, Artificial Sequence
  chemically synthesized
tctatgttttcccaggactctc

SEQ ID NO: 918267 - DNA, 22 bp, Artificial Sequence
  chemically synthesized
ttctatgttttcccaggactct

SEQ ID NO: 918268 - DNA, 22 bp, Artificial Sequence
  chemically synthesized
ttttctatgttttcccaggact

SEQ ID NO: 918269 - DNA, 22 bp, Artificial Sequence
  chemically synthesized
cttttctatgttttcccaggac

SEQ ID NO: 918270 - DNA, 22 bp, Artificial Sequence
  chemically synthesized
cttcttttctatgttttcccag

SEQ ID NO: 918271 - DNA, 22 bp, Artificial Sequence
  chemically synthesized
gttgagagtcctgggaaaacat

SEQ ID NO: 918272 - DNA, 22 bp, Artificial Sequence
  chemically synthesized
ttgagagtcctgggaaaacata

SEQ ID NO: 918273 - DNA, 22 bp, Artificial Sequence
  chemically synthesized
ttgcttcttttctatgttttcc

SEQ ID NO: 918274 - DNA, 22 bp, Artificial Sequence
  chemically synthesized
agagtcctgggaaaacatagaa

SEQ ID NO: 918275 - DNA, 22 bp, Artificial Sequence
  chemically synthesized
ttattgcttcttttctatgttt

SEQ ID NO: 918276 - DNA, 22 bp, Artificial Sequence
  chemically synthesized
ttattattgcttcttttctatg

SEQ ID NO: 918277 - DNA, 22 bp, Artificial Sequence
  chemically synthesized
ttgttattattgcttcttttct

SEQ ID NO: 918278 - DNA, 22 bp, Artificial Sequence
  chemically synthesized
ggaaaacatagaaaagaagcaa

SEQ ID NO: 918279 - DNA, 22 bp, Artificial Sequence
  chemically synthesized
ttattgttattattgcttcttt

SEQ ID NO: 918280 - DNA, 22 bp, Artificial Sequence
  chemically synthesized
attattattgttattattgctt

SEQ ID NO: 918281 - DNA, 22 bp, Artificial Sequence
  chemically synthesized
gattattattgttattattgct

SEQ ID NO: 918282 - DNA, 22 bp, Artificial Sequence
  chemically synthesized
aggaccttgattattattgtta

SEQ ID NO: 918283 - DNA, 22 bp, Artificial Sequence
  chemically synthesized
taaatgttgaggaccttgatta

SEQ ID NO: 918284 - DNA, 22 bp, Artificial Sequence
  chemically synthesized
agaaaattataaatgttgagga

SEQ ID NO: 918285 - DNA, 22 bp, Artificial Sequence
  chemically synthesized
gagaaaattataaatgttgagg

SEQ ID NO: 918286 - DNA, 22 bp, Artificial Sequence
  chemically synthesized
tgagaaaattataaatgttgag

SEQ ID NO: 918287 - DNA, 22 bp, Artificial Sequence
  chemically synthesized
agccctttgagaaaattataaa

SEQ ID NO: 918288 - DNA, 22 bp, Artificial Sequence
  chemically synthesized
agttaagccctttgagaaaatt

SEQ ID NO: 918289 - DNA, 22 bp, Artificial Sequence
  chemically synthesized
aacatttataattttctcaaag

SEQ ID NO: 918290 - DNA, 22 bp, Artificial Sequence
  chemically synthesized
ataattttctcaaagggcttaa

SEQ ID NO: 918291 - DNA, 22 bp, Artificial Sequence
  chemically synthesized
taattttctcaaagggcttaac

SEQ ID NO: 918292 - DNA, 22 bp, Artificial Sequence
  chemically synthesized
tctcaaagggcttaactgaata

SEQ ID NO: 918293 - DNA, 22 bp, Artificial Sequence
  chemically synthesized
ctcaaagggcttaactgaatat

SEQ ID NO: 918294 - DNA, 22 bp, Artificial Sequence
  chemically synthesized
tcaaagggcttaactgaatatc

SEQ ID NO: 918295 - DNA, 22 bp, Artificial Sequence
  chemically synthesized
aaaagaccgatagatattcagt

SEQ ID NO: 918296 - DNA, 22 bp, Artificial Sequence
  chemically synthesized
aaagggcttaactgaatatcta

SEQ ID NO: 918297 - DNA, 22 bp, Artificial Sequence
  chemically synthesized
cattcaaaagaccgatagatat

SEQ ID NO: 918298 - DNA, 22 bp, Artificial Sequence
  chemically synthesized
aactgaatatctatcggtcttt

SEQ ID NO: 918299 - DNA, 22 bp, Artificial Sequence
  chemically synthesized
actgaatatctatcggtctttt

SEQ ID NO: 918300 - DNA, 22 bp, Artificial Sequence
  chemically synthesized
aatatctatcggtcttttgaat

SEQ ID NO: 918301 - DNA, 22 bp, Artificial Sequence
  chemically synthesized
gaacatatgtctccattcaaaa

SEQ ID NO: 918302 - DNA, 22 bp, Artificial Sequence
  chemically synthesized
agaacatatgtctccattcaaa

SEQ ID NO: 918303 - DNA, 22 bp, Artificial Sequence
  chemically synthesized
ttagaacatatgtctccattca

SEQ ID NO: 918304 - DNA, 22 bp, Artificial Sequence
  chemically synthesized
tcggtcttttgaatggagacat

SEQ ID NO: 918305 - DNA, 22 bp, Artificial Sequence
  chemically synthesized
ttcttagaacatatgtctccat

SEQ ID NO: 918306 - DNA, 22 bp, Artificial Sequence
  chemically synthesized
gttcttagaacatatgtctcca

SEQ ID NO: 918307 - DNA, 22 bp, Artificial Sequence
  chemically synthesized
tgttcttagaacatatgtctcc

SEQ ID NO: 918308 - DNA, 22 bp, Artificial Sequence
  chemically synthesized
ttgttcttagaacatatgtctc

SEQ ID NO: 918309 - DNA, 22 bp, Artificial Sequence
  chemically synthesized
ttgaatggagacatatgttcta

SEQ ID NO: 918310 - DNA, 22 bp, Artificial Sequence
  chemically synthesized
tgaatggagacatatgttctaa

SEQ ID NO: 918311 - DNA, 22 bp, Artificial Sequence
  chemically synthesized
gaatggagacatatgttctaag

SEQ ID NO: 918312 - DNA, 22 bp, Artificial Sequence
  chemically synthesized
aatggagacatatgttctaaga

SEQ ID NO: 918313 - DNA, 22 bp, Artificial Sequence
  chemically synthesized
taagtgcttttgttcttagaac

SEQ ID NO: 918314 - DNA, 22 bp, Artificial Sequence
  chemically synthesized
caaatgactgtaagtgcttttg

SEQ ID NO: 918315 - DNA, 22 bp, Artificial Sequence
  chemically synthesized
tattccaaatgactgtaagtgc

SEQ ID NO: 918316 - DNA, 22 bp, Artificial Sequence
  chemically synthesized
taagaacaaaagcacttacagt

SEQ ID NO: 918317 - DNA, 22 bp, Artificial Sequence
  chemically synthesized
agaacaaaagcacttacagtca

SEQ ID NO: 918318 - DNA, 22 bp, Artificial Sequence
  chemically synthesized
gaaacaggttatattccaaatg

SEQ ID NO: 918319 - DNA, 22 bp, Artificial Sequence
  chemically synthesized
agaaacaggttatattccaaat

SEQ ID NO: 918320 - DNA, 22 bp, Artificial Sequence
  chemically synthesized
ttagaaacaggttatattccaa

SEQ ID NO: 918321 - DNA, 22 bp, Artificial Sequence
  chemically synthesized
cttagaaacaggttatattcca

SEQ ID NO: 918322 - DNA, 22 bp, Artificial Sequence
  chemically synthesized
ttcttagaaacaggttatattc

SEQ ID NO: 918323 - DNA, 22 bp, Artificial Sequence
  chemically synthesized
acagtcatttggaatataacct

SEQ ID NO: 918324 - DNA, 22 bp, Artificial Sequence
  chemically synthesized
cagtcatttggaatataacctg

SEQ ID NO: 918325 - DNA, 22 bp, Artificial Sequence
  chemically synthesized
ctcttcttagaaacaggttata

SEQ ID NO: 918326 - DNA, 22 bp, Artificial Sequence
  chemically synthesized
ggaatataacctgtttctaaga

SEQ ID NO: 918327 - DNA, 22 bp, Artificial Sequence
  chemically synthesized
gaatataacctgtttctaagaa

SEQ ID NO: 918328 - DNA, 22 bp, Artificial Sequence
  chemically synthesized
agtaagatccactgctcttctt

SEQ ID NO: 918329 - DNA, 22 bp, Artificial Sequence
  chemically synthesized
aatctaagtaagatccactgct

SEQ ID NO: 918330 - DNA, 22 bp, Artificial Sequence
  chemically synthesized
tttctaagaagagcagtggatc

SEQ ID NO: 918331 - DNA, 22 bp, Artificial Sequence
  chemically synthesized
caatctaagtaagatccactgc

SEQ ID NO: 918332 - DNA, 22 bp, Artificial Sequence
  chemically synthesized
tcaatctaagtaagatccactg

SEQ ID NO: 918333 - DNA, 22 bp, Artificial Sequence
  chemically synthesized
ttcaatctaagtaagatccact

SEQ ID NO: 918334 - DNA, 22 bp, Artificial Sequence
  chemically synthesized
ctaagaagagcagtggatctta

SEQ ID NO: 918335 - DNA, 22 bp, Artificial Sequence
  chemically synthesized
taagaagagcagtggatcttac

SEQ ID NO: 918336 - DNA, 22 bp, Artificial Sequence
  chemically synthesized
agaagagcagtggatcttactt

SEQ ID NO: 918337 - DNA, 22 bp, Artificial Sequence
  chemically synthesized
caaccaccacagccttttcaat

SEQ ID NO: 918338 - DNA, 22 bp, Artificial Sequence
  chemically synthesized
ttacaaccaccacagccttttc

SEQ ID NO: 918339 - DNA, 22 bp, Artificial Sequence
  chemically synthesized
acttagattgaaaaggctgtgg

SEQ ID NO: 918340 - DNA, 22 bp, Artificial Sequence
  chemically synthesized
cttagattgaaaaggctgtggt

SEQ ID NO: 918341 - DNA, 22 bp, Artificial Sequence
  chemically synthesized
actgttacaaccaccacagcct

SEQ ID NO: 918342 - DNA, 22 bp, Artificial Sequence
  chemically synthesized
agattgaaaaggctgtggtggt

SEQ ID NO: 918343 - DNA, 22 bp, Artificial Sequence
  chemically synthesized
gattgaaaaggctgtggtggtt

SEQ ID NO: 918344 - DNA, 22 bp, Artificial Sequence
  chemically synthesized
aaaaggctgtggtggttgtaac

SEQ ID NO: 918345 - DNA, 22 bp, Artificial Sequence
  chemically synthesized
agagggactcactgttacaacc

SEQ ID NO: 918346 - DNA, 22 bp, Artificial Sequence
  chemically synthesized
ctcagagggactcactgttaca

SEQ ID NO: 918347 - DNA, 22 bp, Artificial Sequence
  chemically synthesized
actcagagggactcactgttac

SEQ ID NO: 918348 - DNA, 22 bp, Artificial Sequence
  chemically synthesized
cttactcagagggactcactgt

SEQ ID NO: 918349 - DNA, 22 bp, Artificial Sequence
  chemically synthesized
tggtggttgtaacagtgagtcc

SEQ ID NO: 918350 - DNA, 22 bp, Artificial Sequence
  chemically synthesized
aatgttacttactcagagggac

SEQ ID NO: 918351 - DNA, 22 bp, Artificial Sequence
  chemically synthesized
caatgttacttactcagaggga

SEQ ID NO: 918352 - DNA, 22 bp, Artificial Sequence
  chemically synthesized
taacagtgagtccctctgagta

SEQ ID NO: 918353 - DNA, 22 bp, Artificial Sequence
  chemically synthesized
aatttcaatgttacttactcag

SEQ ID NO: 918354 - DNA, 22 bp, Artificial Sequence
  chemically synthesized
agggctcaatttcaatgttact

SEQ ID NO: 918355 - DNA, 22 bp, Artificial Sequence
  chemically synthesized
cagggctcaatttcaatgttac

SEQ ID NO: 918356 - DNA, 22 bp, Artificial Sequence
  chemically synthesized
tcagggctcaatttcaatgtta

SEQ ID NO: 918357 - DNA, 22 bp, Artificial Sequence
  chemically synthesized
tgagtaagtaacattgaaattg

SEQ ID NO: 918358 - DNA, 22 bp, Artificial Sequence
  chemically synthesized
agtaagtaacattgaaattgag

SEQ ID NO: 918359 - DNA, 22 bp, Artificial Sequence
  chemically synthesized
acatagttttcagggctcaatt

SEQ ID NO: 918360 - DNA, 22 bp, Artificial Sequence
  chemically synthesized
atattgacatagttttcagggc

SEQ ID NO: 918361 - DNA, 22 bp, Artificial Sequence
  chemically synthesized
aaattgagccctgaaaactatg

SEQ ID NO: 918362 - DNA, 22 bp, Artificial Sequence
  chemically synthesized
cggctgatattgacatagtttt

SEQ ID NO: 918363 - DNA, 22 bp, Artificial Sequence
  chemically synthesized
agccctgaaaactatgtcaata

SEQ ID NO: 918364 - DNA, 22 bp, Artificial Sequence
  chemically synthesized
tattccggctgatattgacata

SEQ ID NO: 918365 - DNA, 22 bp, Artificial Sequence
  chemically synthesized
aaaactatgtcaatatcagccg

SEQ ID NO: 918366 - DNA, 22 bp, Artificial Sequence
  chemically synthesized
taccatctgtattccggctgat

SEQ ID NO: 918367 - DNA, 22 bp, Artificial Sequence
  chemically synthesized
gtaccatctgtattccggctga

SEQ ID NO: 918368 - DNA, 22 bp, Artificial Sequence
  chemically synthesized
tgtcaatatcagccggaataca

SEQ ID NO: 918369 - DNA, 22 bp, Artificial Sequence
  chemically synthesized
tcttgtaccatctgtattccgg

SEQ ID NO: 918370 - DNA, 22 bp, Artificial Sequence
  chemically synthesized
gtcttgtaccatctgtattccg

SEQ ID NO: 918371 - DNA, 22 bp, Artificial Sequence
  chemically synthesized
tgtcttgtaccatctgtattcc

SEQ ID NO: 918372 - DNA, 22 bp, Artificial Sequence
  chemically synthesized
ctttgtcttgtaccatctgtat

SEQ ID NO: 918373 - DNA, 22 bp, Artificial Sequence
  chemically synthesized
attcctttgtcttgtaccatct

SEQ ID NO: 918374 - DNA, 22 bp, Artificial Sequence
  chemically synthesized
ataaaagctaattcctttgtct

SEQ ID NO: 918375 - DNA, 22 bp, Artificial Sequence
  chemically synthesized
gataaaagctaattcctttgtc

SEQ ID NO: 918376 - DNA, 22 bp, Artificial Sequence
  chemically synthesized
ccttgataaaagctaattcctt

SEQ ID NO: 918377 - DNA, 22 bp, Artificial Sequence
  chemically synthesized
taccttgataaaagctaattcc

SEQ ID NO: 918378 - DNA, 22 bp, Artificial Sequence
  chemically synthesized
ctaccttgataaaagctaattc

SEQ ID NO: 918379 - DNA, 22 bp, Artificial Sequence
  chemically synthesized
ttctaccttgataaaagctaat

SEQ ID NO: 918380 - DNA, 22 bp, Artificial Sequence
  chemically synthesized
cttctaccttgataaaagctaa

SEQ ID NO: 918381 - DNA, 22 bp, Artificial Sequence
  chemically synthesized
agtatttcttctaccttgataa

SEQ ID NO: 918382 - DNA, 22 bp, Artificial Sequence
  chemically synthesized
gctaagtatttcttctaccttg

SEQ ID NO: 918383 - DNA, 22 bp, Artificial Sequence
  chemically synthesized
gcttttatcaaggtagaagaaa

SEQ ID NO: 918384 - DNA, 22 bp, Artificial Sequence
  chemically synthesized
actcgctaagtatttcttctac

SEQ ID NO: 918385 - DNA, 22 bp, Artificial Sequence
  chemically synthesized
tgactcgctaagtatttcttct

SEQ ID NO: 918386 - DNA, 22 bp, Artificial Sequence
  chemically synthesized
ttatcaaggtagaagaaatact

SEQ ID NO: 918387 - DNA, 22 bp, Artificial Sequence
  chemically synthesized
tatcaaggtagaagaaatactt

SEQ ID NO: 918388 - DNA, 22 bp, Artificial Sequence
  chemically synthesized
ctctgactcgctaagtatttct

SEQ ID NO: 918389 - DNA, 22 bp, Artificial Sequence
  chemically synthesized
atcaaggtagaagaaatactta

SEQ ID NO: 918390 - DNA, 22 bp, Artificial Sequence
  chemically synthesized
tcaaggtagaagaaatacttag

SEQ ID NO: 918391 - DNA, 22 bp, Artificial Sequence
  chemically synthesized
aattcctctgactcgctaagta

SEQ ID NO: 918392 - DNA, 22 bp, Artificial Sequence
  chemically synthesized
caattcctctgactcgctaagt

SEQ ID NO: 918393 - DNA, 22 bp, Artificial Sequence
  chemically synthesized
gtttcaattcctctgactcgct

SEQ ID NO: 918394 - DNA, 22 bp, Artificial Sequence
  chemically synthesized
ctagtttcaattcctctgactc

SEQ ID NO: 918395 - DNA, 22 bp, Artificial Sequence
  chemically synthesized
aattcctagtttcaattcctct

SEQ ID NO: 918396 - DNA, 22 bp, Artificial Sequence
  chemically synthesized
agcgagtcagaggaattgaaac

SEQ ID NO: 918397 - DNA, 22 bp, Artificial Sequence
  chemically synthesized
gcgagtcagaggaattgaaact

SEQ ID NO: 918398 - DNA, 22 bp, Artificial Sequence
  chemically synthesized
gccacactgaattcctagtttc

SEQ ID NO: 918399 - DNA, 22 bp, Artificial Sequence
  chemically synthesized
agccacactgaattcctagttt

SEQ ID NO: 918400 - DNA, 22 bp, Artificial Sequence
  chemically synthesized
tagccacactgaattcctagtt

SEQ ID NO: 918401 - DNA, 22 bp, Artificial Sequence
  chemically synthesized
aactttagccacactgaattcc

SEQ ID NO: 918402 - DNA, 22 bp, Artificial Sequence
  chemically synthesized
taaactttagccacactgaatt

SEQ ID NO: 918403 - DNA, 22 bp, Artificial Sequence
  chemically synthesized
tctaaactttagccacactgaa

SEQ ID NO: 918404 - DNA, 22 bp, Artificial Sequence
  chemically synthesized
aaactaggaattcagtgtggct

SEQ ID NO: 918405 - DNA, 22 bp, Artificial Sequence
  chemically synthesized
tctctaaactttagccacactg

SEQ ID NO: 918406 - DNA, 22 bp, Artificial Sequence
  chemically synthesized
ctctctaaactttagccacact

SEQ ID NO: 918407 - DNA, 22 bp, Artificial Sequence
  chemically synthesized
tctctctaaactttagccacac

SEQ ID NO: 918408 - DNA, 22 bp, Artificial Sequence
  chemically synthesized
ttctctctaaactttagccaca

SEQ ID NO: 918409 - DNA, 22 bp, Artificial Sequence
  chemically synthesized
ggaattcagtgtggctaaagtt

SEQ ID NO: 918410 - DNA, 22 bp, Artificial Sequence
  chemically synthesized
catttttctctctaaactttag

SEQ ID NO: 918411 - DNA, 22 bp, Artificial Sequence
  chemically synthesized
tccatttttctctctaaacttt

SEQ ID NO: 918412 - DNA, 22 bp, Artificial Sequence
  chemically synthesized
agtgtggctaaagtttagagag

SEQ ID NO: 918413 - DNA, 22 bp, Artificial Sequence
  chemically synthesized
caactctccatttttctctcta

SEQ ID NO: 918414 - DNA, 22 bp, Artificial Sequence
  chemically synthesized
ctgcaactctccatttttctct

SEQ ID NO: 918415 - DNA, 22 bp, Artificial Sequence
  chemically synthesized
aagtttagagagaaaaatggag

SEQ ID NO: 918416 - DNA, 22 bp, Artificial Sequence
  chemically synthesized
gctcctgcaactctccattttt

SEQ ID NO: 918417 - DNA, 22 bp, Artificial Sequence
  chemically synthesized
agctcctgcaactctccatttt

SEQ ID NO: 918418 - DNA, 22 bp, Artificial Sequence
  chemically synthesized
agagagaaaaatggagagttgc

SEQ ID NO: 918419 - DNA, 22 bp, Artificial Sequence
  chemically synthesized
gacttagctcctgcaactctcc

SEQ ID NO: 918420 - DNA, 22 bp, Artificial Sequence
  chemically synthesized
gagagaaaaatggagagttgca

SEQ ID NO: 918421 - DNA, 22 bp, Artificial Sequence
  chemically synthesized
tggacttagctcctgcaactct

SEQ ID NO: 918422 - DNA, 22 bp, Artificial Sequence
  chemically synthesized
tctggacttagctcctgcaact

SEQ ID NO: 918423 - DNA, 22 bp, Artificial Sequence
  chemically synthesized
ctctggacttagctcctgcaac

SEQ ID NO: 918424 - DNA, 22 bp, Artificial Sequence
  chemically synthesized
tccatttctctggacttagctc

SEQ ID NO: 918425 - DNA, 22 bp, Artificial Sequence
  chemically synthesized
cctgtccatttctctggactta

SEQ ID NO: 918426 - DNA, 22 bp, Artificial Sequence
  chemically synthesized
caggagctaagtccagagaaat

SEQ ID NO: 918427 - DNA, 22 bp, Artificial Sequence
  chemically synthesized
agtccagagaaatggacaggta

SEQ ID NO: 918428 - DNA, 22 bp, Artificial Sequence
  chemically synthesized
atgcccagaggtaatgtagaag

SEQ ID NO: 918429 - DNA, 22 bp, Artificial Sequence
  chemically synthesized
aatgcccagaggtaatgtagaa

SEQ ID NO: 918430 - DNA, 22 bp, Artificial Sequence
  chemically synthesized
taatgcccagaggtaatgtaga

SEQ ID NO: 918431 - DNA, 22 bp, Artificial Sequence
  chemically synthesized
ctacattacctctgggcattaa

SEQ ID NO: 918432 - DNA, 22 bp, Artificial Sequence
  chemically synthesized
tacattacctctgggcattaaa

SEQ ID NO: 918433 - DNA, 22 bp, Artificial Sequence
  chemically synthesized
cattacctctgggcattaaaat

SEQ ID NO: 918434 - DNA, 22 bp, Artificial Sequence
  chemically synthesized
atgcagaatcaaattttaatgc

SEQ ID NO: 918435 - DNA, 22 bp, Artificial Sequence
  chemically synthesized
cctctgggcattaaaatttgat

SEQ ID NO: 918436 - DNA, 22 bp, Artificial Sequence
  chemically synthesized
tgggcattaaaatttgattctg

SEQ ID NO: 918437 - DNA, 22 bp, Artificial Sequence
  chemically synthesized
ataaagttcatgcagaatcaaa

SEQ ID NO: 918438 - DNA, 22 bp, Artificial Sequence
  chemically synthesized
ggcattaaaatttgattctgca

SEQ ID NO: 918439 - DNA, 22 bp, Artificial Sequence
  chemically synthesized
aaatttgattctgcatgaactt

SEQ ID NO: 918440 - DNA, 22 bp, Artificial Sequence
  chemically synthesized
gattctgcatgaactttattag

SEQ ID NO: 918441 - DNA, 22 bp, Artificial Sequence
  chemically synthesized
attctgcatgaactttattagt

SEQ ID NO: 918442 - DNA, 22 bp, Artificial Sequence
  chemically synthesized
tgcatgaactttattagtgtat

SEQ ID NO: 918443 - DNA, 22 bp, Artificial Sequence
  chemically synthesized
catgaactttattagtgtatta

SEQ ID NO: 918444 - DNA, 22 bp, Artificial Sequence
  chemically synthesized
acatggatgtaaaataaataat

SEQ ID NO: 918445 - DNA, 22 bp, Artificial Sequence
  chemically synthesized
tattagtgtattatttatttta

SEQ ID NO: 918446 - DNA, 22 bp, Artificial Sequence
  chemically synthesized
attagtgtattatttattttac

SEQ ID NO: 918447 - DNA, 22 bp, Artificial Sequence
  chemically synthesized
ttagtgtattatttattttaca

SEQ ID NO: 918448 - DNA, 22 bp, Artificial Sequence
  chemically synthesized
gtaattgacatggatgtaaaat

SEQ ID NO: 918449 - DNA, 22 bp, Artificial Sequence
  chemically synthesized
gtgtattatttattttacatcc

SEQ ID NO: 918450 - DNA, 22 bp, Artificial Sequence
  chemically synthesized
agtaattgacatggatgtaaaa

SEQ ID NO: 918451 - DNA, 22 bp, Artificial Sequence
  chemically synthesized
tttattttacatccatgtcaat

SEQ ID NO: 918452 - DNA, 22 bp, Artificial Sequence
  chemically synthesized
atgaatttagtaattgacatgg

SEQ ID NO: 918453 - DNA, 22 bp, Artificial Sequence
  chemically synthesized
aatgaatttagtaattgacatg

SEQ ID NO: 918454 - DNA, 22 bp, Artificial Sequence
  chemically synthesized
taatgaatttagtaattgacat

SEQ ID NO: 918455 - DNA, 22 bp, Artificial Sequence
  chemically synthesized
attttacatccatgtcaattac

SEQ ID NO: 918456 - DNA, 22 bp, Artificial Sequence
  chemically synthesized
ttaatgaatttagtaattgaca

SEQ ID NO: 918457 - DNA, 22 bp, Artificial Sequence
  chemically synthesized
ttttacatccatgtcaattact

SEQ ID NO: 918458 - DNA, 22 bp, Artificial Sequence
  chemically synthesized
tacatccatgtcaattactaaa

SEQ ID NO: 918459 - DNA, 22 bp, Artificial Sequence
  chemically synthesized
acatccatgtcaattactaaat

SEQ ID NO: 918460 - DNA, 22 bp, Artificial Sequence
  chemically synthesized
catccatgtcaattactaaatt

SEQ ID NO: 918461 - DNA, 22 bp, Artificial Sequence
  chemically synthesized
taccaaatttttaatgaattta

SEQ ID NO: 918462 - DNA, 22 bp, Artificial Sequence
  chemically synthesized
gtaccaaatttttaatgaattt

SEQ ID NO: 918463 - DNA, 22 bp, Artificial Sequence
  chemically synthesized
taccttgtaccaaatttttaat

SEQ ID NO: 918464 - DNA, 22 bp, Artificial Sequence
  chemically synthesized
ctaaattcattaaaaatttggt

SEQ ID NO: 918465 - DNA, 22 bp, Artificial Sequence
  chemically synthesized
atctgtaccttgtaccaaattt

SEQ ID NO: 918466 - DNA, 22 bp, Artificial Sequence
  chemically synthesized
aattcattaaaaatttggtaca

SEQ ID NO: 918467 - DNA, 22 bp, Artificial Sequence
  chemically synthesized
agttcatctgtaccttgtacca

SEQ ID NO: 918468 - DNA, 22 bp, Artificial Sequence
  chemically synthesized
attaaaaatttggtacaaggta

SEQ ID NO: 918469 - DNA, 22 bp, Artificial Sequence
  chemically synthesized
cctaagttcatctgtaccttgt

SEQ ID NO: 918470 - DNA, 22 bp, Artificial Sequence
  chemically synthesized
aaaatttggtacaaggtacaga

SEQ ID NO: 918471 - DNA, 22 bp, Artificial Sequence
  chemically synthesized
ggtacaaggtacagatgaactt

SEQ ID NO: 918472 - DNA, 22 bp, Artificial Sequence
  chemically synthesized
ggtagactccctaagttcatct

SEQ ID NO: 918473 - DNA, 22 bp, Artificial Sequence
  chemically synthesized
gtacaaggtacagatgaactta

SEQ ID NO: 918474 - DNA, 22 bp, Artificial Sequence
  chemically synthesized
ttaggtagactccctaagttca

SEQ ID NO: 918475 - DNA, 22 bp, Artificial Sequence
  chemically synthesized
agtaatctgttaggtagactcc

SEQ ID NO: 918476 - DNA, 22 bp, Artificial Sequence
  chemically synthesized
gagtaatctgttaggtagactc

SEQ ID NO: 918477 - DNA, 22 bp, Artificial Sequence
  chemically synthesized
agggagtctacctaacagatta

SEQ ID NO: 918478 - DNA, 22 bp, Artificial Sequence
  chemically synthesized
gggagtctacctaacagattac

SEQ ID NO: 918479 - DNA, 22 bp, Artificial Sequence
  chemically synthesized
cctaacagattactcaagattg

SEQ ID NO: 918480 - DNA, 22 bp, Artificial Sequence
  chemically synthesized
aaggatcaaaaccaatcttgag

SEQ ID NO: 918481 - DNA, 22 bp, Artificial Sequence
  chemically synthesized
caaggatcaaaaccaatcttga

SEQ ID NO: 918482 - DNA, 22 bp, Artificial Sequence
  chemically synthesized
acagattactcaagattggttt

SEQ ID NO: 918483 - DNA, 22 bp, Artificial Sequence
  chemically synthesized
cttcaaggatcaaaaccaatct

SEQ ID NO: 918484 - DNA, 22 bp, Artificial Sequence
  chemically synthesized
ctcaagattggttttgatcctt

SEQ ID NO: 918485 - DNA, 22 bp, Artificial Sequence
  chemically synthesized
aagattggttttgatccttgaa

SEQ ID NO: 918486 - DNA, 22 bp, Artificial Sequence
  chemically synthesized
agtgaagtggtctacttcaagg

SEQ ID NO: 918487 - DNA, 22 bp, Artificial Sequence
  chemically synthesized
gttttgatccttgaagtagacc

SEQ ID NO: 918488 - DNA, 22 bp, Artificial Sequence
  chemically synthesized
gctaagtgaagtggtctacttc

SEQ ID NO: 918489 - DNA, 22 bp, Artificial Sequence
  chemically synthesized
agctaagtgaagtggtctactt

SEQ ID NO: 918490 - DNA, 22 bp, Artificial Sequence
  chemically synthesized
tgatccttgaagtagaccactt

SEQ ID NO: 918491 - DNA, 22 bp, Artificial Sequence
  chemically synthesized
gatccttgaagtagaccacttc

SEQ ID NO: 918492 - DNA, 22 bp, Artificial Sequence
  chemically synthesized
atccttgaagtagaccacttca

SEQ ID NO: 918493 - DNA, 22 bp, Artificial Sequence
  chemically synthesized
gaagtagaccacttcacttagc

SEQ ID NO: 918494 - DNA, 22 bp, Artificial Sequence
  chemically synthesized
aagtagaccacttcacttagct

SEQ ID NO: 918495 - DNA, 22 bp, Artificial Sequence
  chemically synthesized
aaacggatgcttagctaagtga

SEQ ID NO: 918496 - DNA, 22 bp, Artificial Sequence
  chemically synthesized
aaaacggatgcttagctaagtg

SEQ ID NO: 918497 - DNA, 22 bp, Artificial Sequence
  chemically synthesized
taaaacggatgcttagctaagt

SEQ ID NO: 918498 - DNA, 22 bp, Artificial Sequence
  chemically synthesized
gtattttaaaacggatgcttag

SEQ ID NO: 918499 - DNA, 22 bp, Artificial Sequence
  chemically synthesized
tagtattttaaaacggatgctt

SEQ ID NO: 918500 - DNA, 22 bp, Artificial Sequence
  chemically synthesized
cacttagctaagcatccgtttt

SEQ ID NO: 918501 - DNA, 22 bp, Artificial Sequence
  chemically synthesized
acttagctaagcatccgtttta

SEQ ID NO: 918502 - DNA, 22 bp, Artificial Sequence
  chemically synthesized
gattctagtattttaaaacgga

SEQ ID NO: 918503 - DNA, 22 bp, Artificial Sequence
  chemically synthesized
ggattctagtattttaaaacgg

SEQ ID NO: 918504 - DNA, 22 bp, Artificial Sequence
  chemically synthesized
tggattctagtattttaaaacg

SEQ ID NO: 918505 - DNA, 22 bp, Artificial Sequence
  chemically synthesized
agctaagcatccgttttaaaat

SEQ ID NO: 918506 - DNA, 22 bp, Artificial Sequence
  chemically synthesized
gctaagcatccgttttaaaata

SEQ ID NO: 918507 - DNA, 22 bp, Artificial Sequence
  chemically synthesized
agcatccgttttaaaatactag

SEQ ID NO: 918508 - DNA, 22 bp, Artificial Sequence
  chemically synthesized
aagataccctttggattctagt

SEQ ID NO: 918509 - DNA, 22 bp, Artificial Sequence
  chemically synthesized
gaagataccctttggattctag

SEQ ID NO: 918510 - DNA, 22 bp, Artificial Sequence
  chemically synthesized
taaaatactagaatccaaaggg

SEQ ID NO: 918511 - DNA, 22 bp, Artificial Sequence
  chemically synthesized
aaaatactagaatccaaagggt

SEQ ID NO: 918512 - DNA, 22 bp, Artificial Sequence
  chemically synthesized
aaatactagaatccaaagggta

SEQ ID NO: 918513 - DNA, 22 bp, Artificial Sequence
  chemically synthesized
aaaaagaaatccttgaagatac

SEQ ID NO: 918514 - DNA, 22 bp, Artificial Sequence
  chemically synthesized
gaatccaaagggtatcttcaag

SEQ ID NO: 918515 - DNA, 22 bp, Artificial Sequence
  chemically synthesized
aaaaaagaaatccttgaagata

SEQ ID NO: 918516 - DNA, 22 bp, Artificial Sequence
  chemically synthesized
tttaaaaaagaaatccttgaag

SEQ ID NO: 918517 - DNA, 22 bp, Artificial Sequence
  chemically synthesized
ggtctgtttaaaaaagaaatcc

SEQ ID NO: 918518 - DNA, 22 bp, Artificial Sequence
  chemically synthesized
caaggatttcttttttaaacag

SEQ ID NO: 918519 - DNA, 22 bp, Artificial Sequence
  chemically synthesized
aaggatttcttttttaaacaga

SEQ ID NO: 918520 - DNA, 22 bp, Artificial Sequence
  chemically synthesized
tacatggctaggtctgtttaaa

SEQ ID NO: 918521 - DNA, 22 bp, Artificial Sequence
  chemically synthesized
ttgtacatggctaggtctgttt

SEQ ID NO: 918522 - DNA, 22 bp, Artificial Sequence
  chemically synthesized
tattgtacatggctaggtctgt

SEQ ID NO: 918523 - DNA, 22 bp, Artificial Sequence
  chemically synthesized
cttttttaaacagacctagcca

SEQ ID NO: 918524 - DNA, 22 bp, Artificial Sequence
  chemically synthesized
ttttttaaacagacctagccat

SEQ ID NO: 918525 - DNA, 22 bp, Artificial Sequence
  chemically synthesized
actctattgtacatggctaggt

SEQ ID NO: 918526 - DNA, 22 bp, Artificial Sequence
  chemically synthesized
gactctattgtacatggctagg

SEQ ID NO: 918527 - DNA, 22 bp, Artificial Sequence
  chemically synthesized
ttttaaacagacctagccatgt

SEQ ID NO: 918528 - DNA, 22 bp, Artificial Sequence
  chemically synthesized
tttaaacagacctagccatgta

SEQ ID NO: 918529 - DNA, 22 bp, Artificial Sequence
  chemically synthesized
ttaaacagacctagccatgtac

SEQ ID NO: 918530 - DNA, 22 bp, Artificial Sequence
  chemically synthesized
taaacagacctagccatgtaca

SEQ ID NO: 918531 - DNA, 22 bp, Artificial Sequence
  chemically synthesized
ccttgactctattgtacatggc

SEQ ID NO: 918532 - DNA, 22 bp, Artificial Sequence
  chemically synthesized
aaacagacctagccatgtacaa

SEQ ID NO: 918533 - DNA, 22 bp, Artificial Sequence
  chemically synthesized
aacagacctagccatgtacaat

SEQ ID NO: 918534 - DNA, 22 bp, Artificial Sequence
  chemically synthesized
cactgccttgactctattgtac

SEQ ID NO: 918535 - DNA, 22 bp, Artificial Sequence
  chemically synthesized
acactgccttgactctattgta

SEQ ID NO: 918536 - DNA, 22 bp, Artificial Sequence
  chemically synthesized
gtttacactgccttgactctat

SEQ ID NO: 918537 - DNA, 22 bp, Artificial Sequence
  chemically synthesized
agtttacactgccttgactcta

SEQ ID NO: 918538 - DNA, 22 bp, Artificial Sequence
  chemically synthesized
gccatgtacaatagagtcaagg

SEQ ID NO: 918539 - DNA, 22 bp, Artificial Sequence
  chemically synthesized
tagtttacactgccttgactct

SEQ ID NO: 918540 - DNA, 22 bp, Artificial Sequence
  chemically synthesized
agaaccagaaaacacatatttt

SEQ ID NO: 918541 - DNA, 22 bp, Artificial Sequence
  chemically synthesized
atctgagaaccagaaaacacat

SEQ ID NO: 918542 - DNA, 22 bp, Artificial Sequence
  chemically synthesized
ttgatctgagaaccagaaaaca

SEQ ID NO: 918543 - DNA, 22 bp, Artificial Sequence
  chemically synthesized
aaatatgtgttttctggttctc

SEQ ID NO: 918544 - DNA, 22 bp, Artificial Sequence
  chemically synthesized
tatgtcctattgatctgagaac

SEQ ID NO: 918545 - DNA, 22 bp, Artificial Sequence
  chemically synthesized
ctgtatgtcctattgatctgag

SEQ ID NO: 918546 - DNA, 22 bp, Artificial Sequence
  chemically synthesized
tctggttctcagatcaatagga

SEQ ID NO: 918547 - DNA, 22 bp, Artificial Sequence
  chemically synthesized
ctggttctcagatcaataggac

SEQ ID NO: 918548 - DNA, 22 bp, Artificial Sequence
  chemically synthesized
tggttctcagatcaataggaca

SEQ ID NO: 918549 - DNA, 22 bp, Artificial Sequence
  chemically synthesized
gttctcagatcaataggacata

SEQ ID NO: 918550 - DNA, 22 bp, Artificial Sequence
  chemically synthesized
tgtcagtctgctgtatgtccta

SEQ ID NO: 918551 - DNA, 22 bp, Artificial Sequence
  chemically synthesized
tcagatcaataggacatacagc

SEQ ID NO: 918552 - DNA, 22 bp, Artificial Sequence
  chemically synthesized
agatcaataggacatacagcag

SEQ ID NO: 918553 - DNA, 22 bp, Artificial Sequence
  chemically synthesized
agtgctatgtcagtctgctgta

SEQ ID NO: 918554 - DNA, 22 bp, Artificial Sequence
  chemically synthesized
ctaagtgctatgtcagtctgct

SEQ ID NO: 918555 - DNA, 22 bp, Artificial Sequence
  chemically synthesized
tcctaagtgctatgtcagtctg

SEQ ID NO: 918556 - DNA, 22 bp, Artificial Sequence
  chemically synthesized
ctcctaagtgctatgtcagtct

SEQ ID NO: 918557 - DNA, 22 bp, Artificial Sequence
  chemically synthesized
tctcctaagtgctatgtcagtc

SEQ ID NO: 918558 - DNA, 22 bp, Artificial Sequence
  chemically synthesized
acatagcacttaggagaaaatt

SEQ ID NO: 918559 - DNA, 22 bp, Artificial Sequence
  chemically synthesized
gtaaacatacagagaaattttc

SEQ ID NO: 918560 - DNA, 22 bp, Artificial Sequence
  chemically synthesized
cgtaaacatacagagaaatttt

SEQ ID NO: 918561 - DNA, 22 bp, Artificial Sequence
  chemically synthesized
tcgtaaacatacagagaaattt

SEQ ID NO: 918562 - DNA, 22 bp, Artificial Sequence
  chemically synthesized
agttttcgtaaacatacagaga

SEQ ID NO: 918563 - DNA, 22 bp, Artificial Sequence
  chemically synthesized
aggagaaaatttctctgtatgt

SEQ ID NO: 918564 - DNA, 22 bp, Artificial Sequence
  chemically synthesized
cagttttcgtaaacatacagag

SEQ ID NO: 918565 - DNA, 22 bp, Artificial Sequence
  chemically synthesized
ggagaaaatttctctgtatgtt

SEQ ID NO: 918566 - DNA, 22 bp, Artificial Sequence
  chemically synthesized
ccttcagttttcgtaaacatac

SEQ ID NO: 918567 - DNA, 22 bp, Artificial Sequence
  chemically synthesized
ctctgtatgtttacgaaaactg

SEQ ID NO: 918568 - DNA, 22 bp, Artificial Sequence
  chemically synthesized
tctgtatgtttacgaaaactga

SEQ ID NO: 918569 - DNA, 22 bp, Artificial Sequence
  chemically synthesized
tgtatgtttacgaaaactgaag

SEQ ID NO: 918570 - DNA, 22 bp, Artificial Sequence
  chemically synthesized
tatgtttacgaaaactgaaggg

SEQ ID NO: 918571 - DNA, 22 bp, Artificial Sequence
  chemically synthesized
acgaaaactgaagggagttttt

SEQ ID NO: 918572 - DNA, 22 bp, Artificial Sequence
  chemically synthesized
cgaaaactgaagggagtttttt

SEQ ID NO: 918573 - DNA, 22 bp, Artificial Sequence
  chemically synthesized
ccagtggagaaaaaaaaaaaaa

SEQ ID NO: 918574 - DNA, 22 bp, Artificial Sequence
  chemically synthesized
aagggagtttttttttttttct

SEQ ID NO: 918575 - DNA, 22 bp, Artificial Sequence
  chemically synthesized
ttttttttttctccactgggag

SEQ ID NO: 918576 - DNA, 22 bp, Artificial Sequence
  chemically synthesized
tttttttttctccactgggagc

SEQ ID NO: 918577 - DNA, 22 bp, Artificial Sequence
  chemically synthesized
ttttttttctccactgggagct

SEQ ID NO: 918578 - DNA, 22 bp, Artificial Sequence
  chemically synthesized
tttttttctccactgggagctg

SEQ ID NO: 918579 - DNA, 22 bp, Artificial Sequence
  chemically synthesized
ttttttctccactgggagctga

SEQ ID NO: 918580 - DNA, 22 bp, Artificial Sequence
  chemically synthesized
tttttctccactgggagctgac

SEQ ID NO: 918581 - DNA, 22 bp, Artificial Sequence
  chemically synthesized
ttttctccactgggagctgacc

SEQ ID NO: 918582 - DNA, 22 bp, Artificial Sequence
  chemically synthesized
gaaggtaatgatggtcagctcc

SEQ ID NO: 918583 - DNA, 22 bp, Artificial Sequence
  chemically synthesized
tttctccactgggagctgacca

SEQ ID NO: 918584 - DNA, 22 bp, Artificial Sequence
  chemically synthesized
ttctccactgggagctgaccat

SEQ ID NO: 918585 - DNA, 22 bp, Artificial Sequence
  chemically synthesized
tctccactgggagctgaccatc

SEQ ID NO: 918586 - DNA, 22 bp, Artificial Sequence
  chemically synthesized
ctccactgggagctgaccatca

SEQ ID NO: 918587 - DNA, 22 bp, Artificial Sequence
  chemically synthesized
tccactgggagctgaccatcat

SEQ ID NO: 918588 - DNA, 22 bp, Artificial Sequence
  chemically synthesized
agctggaaggtaatgatggtca

SEQ ID NO: 918589 - DNA, 22 bp, Artificial Sequence
  chemically synthesized
cactgggagctgaccatcatta

SEQ ID NO: 918590 - DNA, 22 bp, Artificial Sequence
  chemically synthesized
ggagctgaccatcattaccttc

SEQ ID NO: 918591 - DNA, 22 bp, Artificial Sequence
  chemically synthesized
atagattcagctggaaggtaat

SEQ ID NO: 918592 - DNA, 22 bp, Artificial Sequence
  chemically synthesized
tcatagattcagctggaaggta

SEQ ID NO: 918593 - DNA, 22 bp, Artificial Sequence
  chemically synthesized
tctcatagattcagctggaagg

SEQ ID NO: 918594 - DNA, 22 bp, Artificial Sequence
  chemically synthesized
accatcattaccttccagctga

SEQ ID NO: 918595 - DNA, 22 bp, Artificial Sequence
  chemically synthesized
ccttccagctgaatctatgaga

SEQ ID NO: 918596 - DNA, 22 bp, Artificial Sequence
  chemically synthesized
ccagctgaatctatgagagaat

SEQ ID NO: 918597 - DNA, 22 bp, Artificial Sequence
  chemically synthesized
cagctgaatctatgagagaatt

SEQ ID NO: 918598 - DNA, 22 bp, Artificial Sequence
  chemically synthesized
aggagaatgggaacagaattct

SEQ ID NO: 918599 - DNA, 22 bp, Artificial Sequence
  chemically synthesized
aatctatgagagaattctgttc

SEQ ID NO: 918600 - DNA, 22 bp, Artificial Sequence
  chemically synthesized
attcaggagaatgggaacagaa

SEQ ID NO: 918601 - DNA, 22 bp, Artificial Sequence
  chemically synthesized
ttaattcaggagaatgggaaca

SEQ ID NO: 918602 - DNA, 22 bp, Artificial Sequence
  chemically synthesized
tgagagaattctgttcccattc

SEQ ID NO: 918603 - DNA, 22 bp, Artificial Sequence
  chemically synthesized
gcaactattaattcaggagaat

SEQ ID NO: 918604 - DNA, 22 bp, Artificial Sequence
  chemically synthesized
agcaactattaattcaggagaa

SEQ ID NO: 918605 - DNA, 22 bp, Artificial Sequence
  chemically synthesized
ttagcaactattaattcaggag

SEQ ID NO: 918606 - DNA, 22 bp, Artificial Sequence
  chemically synthesized
cttagcaactattaattcagga

SEQ ID NO: 918607 - DNA, 22 bp, Artificial Sequence
  chemically synthesized
tgttcccattctcctgaattaa

SEQ ID NO: 918608 - DNA, 22 bp, Artificial Sequence
  chemically synthesized
tcttagcaactattaattcagg

SEQ ID NO: 918609 - DNA, 22 bp, Artificial Sequence
  chemically synthesized
ttcccattctcctgaattaata

SEQ ID NO: 918610 - DNA, 22 bp, Artificial Sequence
  chemically synthesized
ccattctcctgaattaatagtt

SEQ ID NO: 918611 - DNA, 22 bp, Artificial Sequence
  chemically synthesized
tgtggcattttcttagcaacta

SEQ ID NO: 918612 - DNA, 22 bp, Artificial Sequence
  chemically synthesized
tcctgaattaatagttgctaag

SEQ ID NO: 918613 - DNA, 22 bp, Artificial Sequence
  chemically synthesized
ctgaattaatagttgctaagaa

SEQ ID NO: 918614 - DNA, 22 bp, Artificial Sequence
  chemically synthesized
aattaatagttgctaagaaaat

SEQ ID NO: 918615 - DNA, 22 bp, Artificial Sequence
  chemically synthesized
atagttgctaagaaaatgccac

SEQ ID NO: 918616 - DNA, 22 bp, Artificial Sequence
  chemically synthesized
ctaagaaaatgccacataattt

SEQ ID NO: 918617 - DNA, 22 bp, Artificial Sequence
  chemically synthesized
agaaaatgccacataatttatt

SEQ ID NO: 918618 - DNA, 22 bp, Artificial Sequence
  chemically synthesized
agtcatatagcaaataaattat

SEQ ID NO: 918619 - DNA, 22 bp, Artificial Sequence
  chemically synthesized
aagtcatatagcaaataaatta

SEQ ID NO: 918620 - DNA, 22 bp, Artificial Sequence
  chemically synthesized
taagtcatatagcaaataaatt

SEQ ID NO: 918621 - DNA, 22 bp, Artificial Sequence
  chemically synthesized
ttaagtcatatagcaaataaat

SEQ ID NO: 918622 - DNA, 22 bp, Artificial Sequence
  chemically synthesized
ccttttaagtcatatagcaaat

SEQ ID NO: 918623 - DNA, 22 bp, Artificial Sequence
  chemically synthesized
gccttttaagtcatatagcaaa

SEQ ID NO: 918624 - DNA, 22 bp, Artificial Sequence
  chemically synthesized
tgccttttaagtcatatagcaa

SEQ ID NO: 918625 - DNA, 22 bp, Artificial Sequence
  chemically synthesized
tgctttgccttttaagtcatat

SEQ ID NO: 918626 - DNA, 22 bp, Artificial Sequence
  chemically synthesized
attatgctttgccttttaagtc

SEQ ID NO: 918627 - DNA, 22 bp, Artificial Sequence
  chemically synthesized
atttgctatatgacttaaaagg

SEQ ID NO: 918628 - DNA, 22 bp, Artificial Sequence
  chemically synthesized
cattatgctttgccttttaagt

SEQ ID NO: 918629 - DNA, 22 bp, Artificial Sequence
  chemically synthesized
tttgctatatgacttaaaaggc

SEQ ID NO: 918630 - DNA, 22 bp, Artificial Sequence
  chemically synthesized
tcattatgctttgccttttaag

SEQ ID NO: 918631 - DNA, 22 bp, Artificial Sequence
  chemically synthesized
gctatatgacttaaaaggcaaa

SEQ ID NO: 918632 - DNA, 22 bp, Artificial Sequence
  chemically synthesized
ctatatgacttaaaaggcaaag

SEQ ID NO: 918633 - DNA, 22 bp, Artificial Sequence
  chemically synthesized
attttcattatgctttgccttt

SEQ ID NO: 918634 - DNA, 22 bp, Artificial Sequence
  chemically synthesized
tcattttcattatgctttgcct

SEQ ID NO: 918635 - DNA, 22 bp, Artificial Sequence
  chemically synthesized
tatgacttaaaaggcaaagcat

SEQ ID NO: 918636 - DNA, 22 bp, Artificial Sequence
  chemically synthesized
ctctcattttcattatgctttg

SEQ ID NO: 918637 - DNA, 22 bp, Artificial Sequence
  chemically synthesized
actctcattttcattatgcttt

SEQ ID NO: 918638 - DNA, 22 bp, Artificial Sequence
  chemically synthesized
tactctcattttcattatgctt

SEQ ID NO: 918639 - DNA, 22 bp, Artificial Sequence
  chemically synthesized
ttttactctcattttcattatg

SEQ ID NO: 918640 - DNA, 22 bp, Artificial Sequence
  chemically synthesized
aaaaggcaaagcataatgaaaa

SEQ ID NO: 918641 - DNA, 22 bp, Artificial Sequence
  chemically synthesized
attttactctcattttcattat

SEQ ID NO: 918642 - DNA, 22 bp, Artificial Sequence
  chemically synthesized
aaaggcaaagcataatgaaaat

SEQ ID NO: 918643 - DNA, 22 bp, Artificial Sequence
  chemically synthesized
tattttactctcattttcatta

SEQ ID NO: 918644 - DNA, 22 bp, Artificial Sequence
  chemically synthesized
ttattttactctcattttcatt

SEQ ID NO: 918645 - DNA, 22 bp, Artificial Sequence
  chemically synthesized
atggccttttattttactctca

SEQ ID NO: 918646 - DNA, 22 bp, Artificial Sequence
  chemically synthesized
gttaatggccttttattttact

SEQ ID NO: 918647 - DNA, 22 bp, Artificial Sequence
  chemically synthesized
tcgttaatggccttttatttta

SEQ ID NO: 918648 - DNA, 22 bp, Artificial Sequence
  chemically synthesized
ctcgttaatggccttttatttt

SEQ ID NO: 918649 - DNA, 22 bp, Artificial Sequence
  chemically synthesized
tctcgttaatggccttttattt

SEQ ID NO: 918650 - DNA, 22 bp, Artificial Sequence
  chemically synthesized
tatatgcaatattttctcgtta

SEQ ID NO: 918651 - DNA, 22 bp, Artificial Sequence
  chemically synthesized
atatatgcaatattttctcgtt

SEQ ID NO: 918652 - DNA, 22 bp, Artificial Sequence
  chemically synthesized
acgagaaaatattgcatatata

SEQ ID NO: 918653 - DNA, 22 bp, Artificial Sequence
  chemically synthesized
tatatatgacacaaatttatat

SEQ ID NO: 918654 - DNA, 22 bp, Artificial Sequence
  chemically synthesized
ctatatatatgacacaaattta

SEQ ID NO: 918655 - DNA, 22 bp, Artificial Sequence
  chemically synthesized
actatatatatgacacaaattt

SEQ ID NO: 918656 - DNA, 22 bp, Artificial Sequence
  chemically synthesized
catatataaatttgtgtcatat

SEQ ID NO: 918657 - DNA, 22 bp, Artificial Sequence
  chemically synthesized
gtatgatgcaaatttactatat

SEQ ID NO: 918658 - DNA, 22 bp, Artificial Sequence
  chemically synthesized
gtgtcatatatatagtaaattt

SEQ ID NO: 918659 - DNA, 22 bp, Artificial Sequence
  chemically synthesized
tgtcatatatatagtaaatttg

SEQ ID NO: 918660 - DNA, 22 bp, Artificial Sequence
  chemically synthesized
atattggtatgatgcaaattta

SEQ ID NO: 918661 - DNA, 22 bp, Artificial Sequence
  chemically synthesized
cctgatattggtatgatgcaaa

SEQ ID NO: 918662 - DNA, 22 bp, Artificial Sequence
  chemically synthesized
tccctgatattggtatgatgca

SEQ ID NO: 918663 - DNA, 22 bp, Artificial Sequence
  chemically synthesized
ctccctgatattggtatgatgc

SEQ ID NO: 918664 - DNA, 22 bp, Artificial Sequence
  chemically synthesized
tctccctgatattggtatgatg

SEQ ID NO: 918665 - DNA, 22 bp, Artificial Sequence
  chemically synthesized
ttctccctgatattggtatgat

SEQ ID NO: 918666 - DNA, 22 bp, Artificial Sequence
  chemically synthesized
cttttctccctgatattggtat

SEQ ID NO: 918667 - DNA, 22 bp, Artificial Sequence
  chemically synthesized
acttttctccctgatattggta

SEQ ID NO: 918668 - DNA, 22 bp, Artificial Sequence
  chemically synthesized
gcatcataccaatatcagggag

SEQ ID NO: 918669 - DNA, 22 bp, Artificial Sequence
  chemically synthesized
catcataccaatatcagggaga

SEQ ID NO: 918670 - DNA, 22 bp, Artificial Sequence
  chemically synthesized
acaaggtaatcttacttttctc

SEQ ID NO: 918671 - DNA, 22 bp, Artificial Sequence
  chemically synthesized
gacaaggtaatcttacttttct

SEQ ID NO: 918672 - DNA, 22 bp, Artificial Sequence
  chemically synthesized
atgcttgacaaggtaatcttac

SEQ ID NO: 918673 - DNA, 22 bp, Artificial Sequence
  chemically synthesized
gatgcttgacaaggtaatctta

SEQ ID NO: 918674 - DNA, 22 bp, Artificial Sequence
  chemically synthesized
tgcttgatgcttgacaaggtaa

SEQ ID NO: 918675 - DNA, 22 bp, Artificial Sequence
  chemically synthesized
gtgcttgatgcttgacaaggta

SEQ ID NO: 918676 - DNA, 22 bp, Artificial Sequence
  chemically synthesized
cttgtgcttgatgcttgacaag

SEQ ID NO: 918677 - DNA, 22 bp, Artificial Sequence
  chemically synthesized
gctacttgtgcttgatgcttga

SEQ ID NO: 918678 - DNA, 22 bp, Artificial Sequence
  chemically synthesized
agctacttgtgcttgatgcttg

SEQ ID NO: 918679 - DNA, 22 bp, Artificial Sequence
  chemically synthesized
ccttgtcaagcatcaagcacaa

SEQ ID NO: 918680 - DNA, 22 bp, Artificial Sequence
  chemically synthesized
aggtttagctacttgtgcttga

SEQ ID NO: 918681 - DNA, 22 bp, Artificial Sequence
  chemically synthesized
aaggtttagctacttgtgcttg

SEQ ID NO: 918682 - DNA, 22 bp, Artificial Sequence
  chemically synthesized
gtcaagcatcaagcacaagtag

SEQ ID NO: 918683 - DNA, 22 bp, Artificial Sequence
  chemically synthesized
tcaagcatcaagcacaagtagc

SEQ ID NO: 918684 - DNA, 22 bp, Artificial Sequence
  chemically synthesized
tatttaaggtttagctacttgt

SEQ ID NO: 918685 - DNA, 22 bp, Artificial Sequence
  chemically synthesized
tccactgtatttaaggtttagc

SEQ ID NO: 918686 - DNA, 22 bp, Artificial Sequence
  chemically synthesized
attatccactgtatttaaggtt

SEQ ID NO: 918687 - DNA, 22 bp, Artificial Sequence
  chemically synthesized
ctcattatccactgtatttaag

SEQ ID NO: 918688 - DNA, 22 bp, Artificial Sequence
  chemically synthesized
agtgttcctcattatccactgt

SEQ ID NO: 918689 - DNA, 22 bp, Artificial Sequence
  chemically synthesized
aaccttaaatacagtggataat

SEQ ID NO: 918690 - DNA, 22 bp, Artificial Sequence
  chemically synthesized
gtatctcagtgttcctcattat

SEQ ID NO: 918691 - DNA, 22 bp, Artificial Sequence
  chemically synthesized
aaatacagtggataatgaggaa

SEQ ID NO: 918692 - DNA, 22 bp, Artificial Sequence
  chemically synthesized
aatacagtggataatgaggaac

SEQ ID NO: 918693 - DNA, 22 bp, Artificial Sequence
  chemically synthesized
aaaaatattggtatctcagtgt

SEQ ID NO: 918694 - DNA, 22 bp, Artificial Sequence
  chemically synthesized
aaaaaatattggtatctcagtg

SEQ ID NO: 918695 - DNA, 22 bp, Artificial Sequence
  chemically synthesized
taaaaaatattggtatctcagt

SEQ ID NO: 918696 - DNA, 22 bp, Artificial Sequence
  chemically synthesized
agataccaatattttttaaagc

SEQ ID NO: 918697 - DNA, 22 bp, Artificial Sequence
  chemically synthesized
aaaataaataaatagaagcttt

SEQ ID NO: 918698 - DNA, 22 bp, Artificial Sequence
  chemically synthesized
tctcaaaataaataaatagaag

SEQ ID NO: 918699 - DNA, 22 bp, Artificial Sequence
  chemically synthesized
tttaaagcttctatttatttat

SEQ ID NO: 918700 - DNA, 22 bp, Artificial Sequence
  chemically synthesized
ttaaagcttctatttatttatt

SEQ ID NO: 918701 - DNA, 22 bp, Artificial Sequence
  chemically synthesized
taaagcttctatttatttattt

SEQ ID NO: 918702 - DNA, 22 bp, Artificial Sequence
  chemically synthesized
aaagcttctatttatttatttt

SEQ ID NO: 918703 - DNA, 22 bp, Artificial Sequence
  chemically synthesized
aagcttctatttatttattttg

SEQ ID NO: 918704 - DNA, 22 bp, Artificial Sequence
  chemically synthesized
ctatttatttattttgagacag

SEQ ID NO: 918705 - DNA, 22 bp, Artificial Sequence
  chemically synthesized
tatttatttattttgagacagg

SEQ ID NO: 918706 - DNA, 22 bp, Artificial Sequence
  chemically synthesized
tttatttattttgagacagggt

SEQ ID NO: 918707 - DNA, 22 bp, Artificial Sequence
  chemically synthesized
ccacaccccaggagaccctgtc

SEQ ID NO: 918708 - DNA, 22 bp, Artificial Sequence
  chemically synthesized
atttattttgagacagggtctc

SEQ ID NO: 918709 - DNA, 22 bp, Artificial Sequence
  chemically synthesized
tttattttgagacagggtctcc

SEQ ID NO: 918710 - DNA, 22 bp, Artificial Sequence
  chemically synthesized
attttgagacagggtctcctgg

SEQ ID NO: 918711 - DNA, 22 bp, Artificial Sequence
  chemically synthesized
ttttgagacagggtctcctggg

SEQ ID NO: 918712 - DNA, 22 bp, Artificial Sequence
  chemically synthesized
tgagacagggtctcctggggtg

SEQ ID NO: 918713 - DNA, 22 bp, Artificial Sequence
  chemically synthesized
gagacagggtctcctggggtgt

SEQ ID NO: 918714 - DNA, 22 bp, Artificial Sequence
  chemically synthesized
agacagggtctcctggggtgtg

SEQ ID NO: 918715 - DNA, 22 bp, Artificial Sequence
  chemically synthesized
taatcatgctaccacaccccag

SEQ ID NO: 918716 - DNA, 22 bp, Artificial Sequence
  chemically synthesized
cagtgagctataatcatgctac

SEQ ID NO: 918717 - DNA, 22 bp, Artificial Sequence
  chemically synthesized
ctggggtgtggtagcatgatta

SEQ ID NO: 918718 - DNA, 22 bp, Artificial Sequence
  chemically synthesized
gggtgtggtagcatgattatag

SEQ ID NO: 918719 - DNA, 22 bp, Artificial Sequence
  chemically synthesized
gaggttacagtgagctataatc

SEQ ID NO: 918720 - DNA, 22 bp, Artificial Sequence
  chemically synthesized
agcccaggagttggaggttaca

SEQ ID NO: 918721 - DNA, 22 bp, Artificial Sequence
  chemically synthesized
gagcccaggagttggaggttac

SEQ ID NO: 918722 - DNA, 22 bp, Artificial Sequence
  chemically synthesized
ttgagcccaggagttggaggtt

SEQ ID NO: 918723 - DNA, 22 bp, Artificial Sequence
  chemically synthesized
tagctcactgtaacctccaact

SEQ ID NO: 918724 - DNA, 22 bp, Artificial Sequence
  chemically synthesized
cttgagcccaggagttggaggt

SEQ ID NO: 918725 - DNA, 22 bp, Artificial Sequence
  chemically synthesized
actgtaacctccaactcctggg

SEQ ID NO: 918726 - DNA, 22 bp, Artificial Sequence
  chemically synthesized
ggagaatttcttgagcccagga

SEQ ID NO: 918727 - DNA, 22 bp, Artificial Sequence
  chemically synthesized
taacctccaactcctgggctca

SEQ ID NO: 918728 - DNA, 22 bp, Artificial Sequence
  chemically synthesized
agttgggagaatttcttgagcc

SEQ ID NO: 918729 - DNA, 22 bp, Artificial Sequence
  chemically synthesized
caactcctgggctcaagaaatt

SEQ ID NO: 918730 - DNA, 22 bp, Artificial Sequence
  chemically synthesized
ctgggctcaagaaattctccca

SEQ ID NO: 918731 - DNA, 22 bp, Artificial Sequence
  chemically synthesized
gggaggctgagttgggagaatt

SEQ ID NO: 918732 - DNA, 22 bp, Artificial Sequence
  chemically synthesized
ggctcaagaaattctcccaact

SEQ ID NO: 918733 - DNA, 22 bp, Artificial Sequence
  chemically synthesized
gatgctcgggaggctgagttgg

SEQ ID NO: 918734 - DNA, 22 bp, Artificial Sequence
  chemically synthesized
aagaaattctcccaactcagcc

SEQ ID NO: 918735 - DNA, 22 bp, Artificial Sequence
  chemically synthesized
tagtcctagatgctcgggaggc

SEQ ID NO: 918736 - DNA, 22 bp, Artificial Sequence
  chemically synthesized
tcccaactcagcctcccgagca

SEQ ID NO: 918737 - DNA, 22 bp, Artificial Sequence
  chemically synthesized
ccaactcagcctcccgagcatc

SEQ ID NO: 918738 - DNA, 22 bp, Artificial Sequence
  chemically synthesized
agcctcccgagcatctaggact

SEQ ID NO: 918739 - DNA, 22 bp, Artificial Sequence
  chemically synthesized
tggtgatgcaagcctgtagtcc

SEQ ID NO: 918740 - DNA, 22 bp, Artificial Sequence
  chemically synthesized
ccgagcatctaggactacaggc

SEQ ID NO: 918741 - DNA, 22 bp, Artificial Sequence
  chemically synthesized
ggactacaggcttgcatcacca

SEQ ID NO: 918742 - DNA, 22 bp, Artificial Sequence
  chemically synthesized
aaaatgtagccgactgtggtga

SEQ ID NO: 918743 - DNA, 22 bp, Artificial Sequence
  chemically synthesized
caggcttgcatcaccacagtcg

SEQ ID NO: 918744 - DNA, 22 bp, Artificial Sequence
  chemically synthesized
gcatcaccacagtcggctacat

SEQ ID NO: 918745 - DNA, 22 bp, Artificial Sequence
  chemically synthesized
catcaccacagtcggctacatt

SEQ ID NO: 918746 - DNA, 22 bp, Artificial Sequence
  chemically synthesized
cataaaattaaaaatgtagccg

SEQ ID NO: 918747 - DNA, 22 bp, Artificial Sequence
  chemically synthesized
tacataaaattaaaaatgtagc

SEQ ID NO: 918748 - DNA, 22 bp, Artificial Sequence
  chemically synthesized
catctctacataaaattaaaaa

SEQ ID NO: 918749 - DNA, 22 bp, Artificial Sequence
  chemically synthesized
catttttaattttatgtagaga

SEQ ID NO: 918750 - DNA, 22 bp, Artificial Sequence
  chemically synthesized
ttaattttatgtagagatggaa

SEQ ID NO: 918751 - DNA, 22 bp, Artificial Sequence
  chemically synthesized
taattttatgtagagatggaat

SEQ ID NO: 918752 - DNA, 22 bp, Artificial Sequence
  chemically synthesized
aattttatgtagagatggaatg

SEQ ID NO: 918753 - DNA, 22 bp, Artificial Sequence
  chemically synthesized
ggcacatagcaacattccatct

SEQ ID NO: 918754 - DNA, 22 bp, Artificial Sequence
  chemically synthesized
attttatgtagagatggaatgt

SEQ ID NO: 918755 - DNA, 22 bp, Artificial Sequence
  chemically synthesized
gggcacatagcaacattccatc

SEQ ID NO: 918756 - DNA, 22 bp, Artificial Sequence
  chemically synthesized
tatgtagagatggaatgttgct

SEQ ID NO: 918757 - DNA, 22 bp, Artificial Sequence
  chemically synthesized
atgtagagatggaatgttgcta

SEQ ID NO: 918758 - DNA, 22 bp, Artificial Sequence
  chemically synthesized
tgtagagatggaatgttgctat

SEQ ID NO: 918759 - DNA, 22 bp, Artificial Sequence
  chemically synthesized
aagaccagcttgggcacatagc

SEQ ID NO: 918760 - DNA, 22 bp, Artificial Sequence
  chemically synthesized
ctatgtgcccaagctggtcttg

SEQ ID NO: 918761 - DNA, 22 bp, Artificial Sequence
  chemically synthesized
aggccaggagttcaagaccagc

SEQ ID NO: 918762 - DNA, 22 bp, Artificial Sequence
  chemically synthesized
gaggccaggagttcaagaccag

SEQ ID NO: 918763 - DNA, 22 bp, Artificial Sequence
  chemically synthesized
tgtgcccaagctggtcttgaac

SEQ ID NO: 918764 - DNA, 22 bp, Artificial Sequence
  chemically synthesized
cttgaggccaggagttcaagac

SEQ ID NO: 918765 - DNA, 22 bp, Artificial Sequence
  chemically synthesized
gtcttgaactcctggcctcaag

SEQ ID NO: 918766 - DNA, 22 bp, Artificial Sequence
  chemically synthesized
gaactcctggcctcaagcaatc

SEQ ID NO: 918767 - DNA, 22 bp, Artificial Sequence
  chemically synthesized
aactcctggcctcaagcaatcc

SEQ ID NO: 918768 - DNA, 22 bp, Artificial Sequence
  chemically synthesized
ggaggccaaggcaagaggattg

SEQ ID NO: 918769 - DNA, 22 bp, Artificial Sequence
  chemically synthesized
ctggcctcaagcaatcctcttg

SEQ ID NO: 918770 - DNA, 22 bp, Artificial Sequence
  chemically synthesized
gggaggccaaggcaagaggatt

SEQ ID NO: 918771 - DNA, 22 bp, Artificial Sequence
  chemically synthesized
tgggaggccaaggcaagaggat

SEQ ID NO: 918772 - DNA, 22 bp, Artificial Sequence
  chemically synthesized
gcctcaagcaatcctcttgcct

SEQ ID NO: 918773 - DNA, 22 bp, Artificial Sequence
  chemically synthesized
aagcaatcctcttgccttggcc

SEQ ID NO: 918774 - DNA, 22 bp, Artificial Sequence
  chemically synthesized
agtgctttgggaggccaaggca

SEQ ID NO: 918775 - DNA, 22 bp, Artificial Sequence
  chemically synthesized
tcatctcagtgctttgggaggc

SEQ ID NO: 918776 - DNA, 22 bp, Artificial Sequence
  chemically synthesized
ttgccttggcctcccaaagcac

SEQ ID NO: 918777 - DNA, 22 bp, Artificial Sequence
  chemically synthesized
gccttggcctcccaaagcactg

SEQ ID NO: 918778 - DNA, 22 bp, Artificial Sequence
  chemically synthesized
ccttggcctcccaaagcactga

SEQ ID NO: 918779 - DNA, 22 bp, Artificial Sequence
  chemically synthesized
atgcctgtcatctcagtgcttt

SEQ ID NO: 918780 - DNA, 22 bp, Artificial Sequence
  chemically synthesized
ggcctcccaaagcactgagatg

SEQ ID NO: 918781 - DNA, 22 bp, Artificial Sequence
  chemically synthesized
gcctcccaaagcactgagatga

SEQ ID NO: 918782 - DNA, 22 bp, Artificial Sequence
  chemically synthesized
ccaaagcactgagatgacaggc

SEQ ID NO: 918783 - DNA, 22 bp, Artificial Sequence
  chemically synthesized
ggcacatggctcatgcctgtca

SEQ ID NO: 918784 - DNA, 22 bp, Artificial Sequence
  chemically synthesized
actgggcacatggctcatgcct

SEQ ID NO: 918785 - DNA, 22 bp, Artificial Sequence
  chemically synthesized
agatgacaggcatgagccatgt

SEQ ID NO: 918786 - DNA, 22 bp, Artificial Sequence
  chemically synthesized
aaagttgactgggcacatggct

SEQ ID NO: 918787 - DNA, 22 bp, Artificial Sequence
  chemically synthesized
aatgaaaattaaaagttgactg

SEQ ID NO: 918788 - DNA, 22 bp, Artificial Sequence
  chemically synthesized
ttaaatgaaaattaaaagttga

SEQ ID NO: 918789 - DNA, 22 bp, Artificial Sequence
  chemically synthesized
ataaagctgttaaatgaaaatt

SEQ ID NO: 918790 - DNA, 22 bp, Artificial Sequence
  chemically synthesized
aataaagctgttaaatgaaaat

SEQ ID NO: 918791 - DNA, 22 bp, Artificial Sequence
  chemically synthesized
aatacttaataaagctgttaaa

SEQ ID NO: 918792 - DNA, 22 bp, Artificial Sequence
  chemically synthesized
aaatacttaataaagctgttaa

SEQ ID NO: 918793 - DNA, 22 bp, Artificial Sequence
  chemically synthesized
ttaattttcatttaacagcttt

SEQ ID NO: 918794 - DNA, 22 bp, Artificial Sequence
  chemically synthesized
taattttcatttaacagcttta

SEQ ID NO: 918795 - DNA, 22 bp, Artificial Sequence
  chemically synthesized
aattttcatttaacagctttat

SEQ ID NO: 918796 - DNA, 22 bp, Artificial Sequence
  chemically synthesized
attttcatttaacagctttatt

SEQ ID NO: 918797 - DNA, 22 bp, Artificial Sequence
  chemically synthesized
tcatttaacagctttattaagt

SEQ ID NO: 918798 - DNA, 22 bp, Artificial Sequence
  chemically synthesized
catttaacagctttattaagta

SEQ ID NO: 918799 - DNA, 22 bp, Artificial Sequence
  chemically synthesized
atttaacagctttattaagtat

SEQ ID NO: 918800 - DNA, 22 bp, Artificial Sequence
  chemically synthesized
aacagctttattaagtatttaa

SEQ ID NO: 918801 - DNA, 22 bp, Artificial Sequence
  chemically synthesized
acagctttattaagtatttaag

SEQ ID NO: 918802 - DNA, 22 bp, Artificial Sequence
  chemically synthesized
tggacccatcgtgtacacctta

SEQ ID NO: 918803 - DNA, 22 bp, Artificial Sequence
  chemically synthesized
tattaagtatttaaggtgtaca

SEQ ID NO: 918804 - DNA, 22 bp, Artificial Sequence
  chemically synthesized
attaagtatttaaggtgtacac

SEQ ID NO: 918805 - DNA, 22 bp, Artificial Sequence
  chemically synthesized
ttaagtatttaaggtgtacacg

SEQ ID NO: 918806 - DNA, 22 bp, Artificial Sequence
  chemically synthesized
attatggacccatcgtgtacac

SEQ ID NO: 918807 - DNA, 22 bp, Artificial Sequence
  chemically synthesized
agtatttaaggtgtacacgatg

SEQ ID NO: 918808 - DNA, 22 bp, Artificial Sequence
  chemically synthesized
ttaattatggacccatcgtgta

SEQ ID NO: 918809 - DNA, 22 bp, Artificial Sequence
  chemically synthesized
gttaattatggacccatcgtgt

SEQ ID NO: 918810 - DNA, 22 bp, Artificial Sequence
  chemically synthesized
tttgttaattatggacccatcg

SEQ ID NO: 918811 - DNA, 22 bp, Artificial Sequence
  chemically synthesized
aaggtgtacacgatgggtccat

SEQ ID NO: 918812 - DNA, 22 bp, Artificial Sequence
  chemically synthesized
aggtgtacacgatgggtccata

SEQ ID NO: 918813 - DNA, 22 bp, Artificial Sequence
  chemically synthesized
acaaacagatcttccccgactg

SEQ ID NO: 918814 - DNA, 22 bp, Artificial Sequence
  chemically synthesized
taagtcaaaccatcgtagtcag

SEQ ID NO: 918815 - DNA, 22 bp, Artificial Sequence
  chemically synthesized
ccccgactgactacgatggttt

SEQ ID NO: 918816 - DNA, 22 bp, Artificial Sequence
  chemically synthesized
cccgactgactacgatggtttg

SEQ ID NO: 918817 - DNA, 22 bp, Artificial Sequence
  chemically synthesized
aaaattgtaagtcaaaccatcg

SEQ ID NO: 918818 - DNA, 22 bp, Artificial Sequence
  chemically synthesized
caaaattgtaagtcaaaccatc

SEQ ID NO: 918819 - DNA, 22 bp, Artificial Sequence
  chemically synthesized
actacgatggtttgacttacaa

SEQ ID NO: 918820 - DNA, 22 bp, Artificial Sequence
  chemically synthesized
cgatggtttgacttacaatttt

SEQ ID NO: 918821 - DNA, 22 bp, Artificial Sequence
  chemically synthesized
caccatggtgaacttcaaaatt

SEQ ID NO: 918822 - DNA, 22 bp, Artificial Sequence
  chemically synthesized
gcaccatggtgaacttcaaaat

SEQ ID NO: 918823 - DNA, 22 bp, Artificial Sequence
  chemically synthesized
tgcaccatggtgaacttcaaaa

SEQ ID NO: 918824 - DNA, 22 bp, Artificial Sequence
  chemically synthesized
ttgcaccatggtgaacttcaaa

SEQ ID NO: 918825 - DNA, 22 bp, Artificial Sequence
  chemically synthesized
gacttacaattttgaagttcac

SEQ ID NO: 918826 - DNA, 22 bp, Artificial Sequence
  chemically synthesized
acttacaattttgaagttcacc

SEQ ID NO: 918827 - DNA, 22 bp, Artificial Sequence
  chemically synthesized
acaattttgaagttcaccatgg

SEQ ID NO: 918828 - DNA, 22 bp, Artificial Sequence
  chemically synthesized
caattttgaagttcaccatggt

SEQ ID NO: 918829 - DNA, 22 bp, Artificial Sequence
  chemically synthesized
tgaagttcaccatggtgcaaaa

SEQ ID NO: 918830 - DNA, 22 bp, Artificial Sequence
  chemically synthesized
aatgtgtatcgcttttgcacca

SEQ ID NO: 918831 - DNA, 22 bp, Artificial Sequence
  chemically synthesized
gaagttcaccatggtgcaaaag

SEQ ID NO: 918832 - DNA, 22 bp, Artificial Sequence
  chemically synthesized
aagttcaccatggtgcaaaagc

SEQ ID NO: 918833 - DNA, 22 bp, Artificial Sequence
  chemically synthesized
tactaaatgtgtatcgcttttg

SEQ ID NO: 918834 - DNA, 22 bp, Artificial Sequence
  chemically synthesized
accatggtgcaaaagcgataca

SEQ ID NO: 918835 - DNA, 22 bp, Artificial Sequence
  chemically synthesized
agtccaggattatactaaatgt

SEQ ID NO: 918836 - DNA, 22 bp, Artificial Sequence
  chemically synthesized
agtataatcctggactgaggat

SEQ ID NO: 918837 - DNA, 22 bp, Artificial Sequence
  chemically synthesized
gtataatcctggactgaggatg

SEQ ID NO: 918838 - DNA, 22 bp, Artificial Sequence
  chemically synthesized
gactgaggatggggttatatct

SEQ ID NO: 918839 - DNA, 22 bp, Artificial Sequence
  chemically synthesized
cagtgagtatatccagatataa

SEQ ID NO: 918840 - DNA, 22 bp, Artificial Sequence
  chemically synthesized
acagtgagtatatccagatata

SEQ ID NO: 918841 - DNA, 22 bp, Artificial Sequence
  chemically synthesized
aggatggggttatatctggata

SEQ ID NO: 918842 - DNA, 22 bp, Artificial Sequence
  chemically synthesized
aacttacagtgagtatatccag

SEQ ID NO: 918843 - DNA, 22 bp, Artificial Sequence
  chemically synthesized
caacttacagtgagtatatcca

SEQ ID NO: 918844 - DNA, 22 bp, Artificial Sequence
  chemically synthesized
tcaacttacagtgagtatatcc

SEQ ID NO: 918845 - DNA, 22 bp, Artificial Sequence
  chemically synthesized
tatctggatatactcactgtaa

SEQ ID NO: 918846 - DNA, 22 bp, Artificial Sequence
  chemically synthesized
atgatattttcaacttacagtg

SEQ ID NO: 918847 - DNA, 22 bp, Artificial Sequence
  chemically synthesized
gatatactcactgtaagttgaa

SEQ ID NO: 918848 - DNA, 22 bp, Artificial Sequence
  chemically synthesized
aattaatgatattttcaactta

SEQ ID NO: 918849 - DNA, 22 bp, Artificial Sequence
  chemically synthesized
caattaatgatattttcaactt

SEQ ID NO: 918850 - DNA, 22 bp, Artificial Sequence
  chemically synthesized
tcaattaatgatattttcaact

SEQ ID NO: 918851 - DNA, 22 bp, Artificial Sequence
  chemically synthesized
actgtaagttgaaaatatcatt

SEQ ID NO: 918852 - DNA, 22 bp, Artificial Sequence
  chemically synthesized
taagttgaaaatatcattaatt

SEQ ID NO: 918853 - DNA, 22 bp, Artificial Sequence
  chemically synthesized
aaaatatcattaattgaaaatg

SEQ ID NO: 918854 - DNA, 22 bp, Artificial Sequence
  chemically synthesized
tgagtcaaaagtacattttcaa

SEQ ID NO: 918855 - DNA, 22 bp, Artificial Sequence
  chemically synthesized
aaaatgttatgagtcaaaagta

SEQ ID NO: 918856 - DNA, 22 bp, Artificial Sequence
  chemically synthesized
attgaaaatgtacttttgactc

SEQ ID NO: 918857 - DNA, 22 bp, Artificial Sequence
  chemically synthesized
aaaatgtacttttgactcataa

SEQ ID NO: 918858 - DNA, 22 bp, Artificial Sequence
  chemically synthesized
ttgactcataacattttcaatt

SEQ ID NO: 918859 - DNA, 22 bp, Artificial Sequence
  chemically synthesized
tgactcataacattttcaattt

SEQ ID NO: 918860 - DNA, 22 bp, Artificial Sequence
  chemically synthesized
gactcataacattttcaattta

SEQ ID NO: 918861 - DNA, 22 bp, Artificial Sequence
  chemically synthesized
ataaacccatcataaattgaaa

SEQ ID NO: 918862 - DNA, 22 bp, Artificial Sequence
  chemically synthesized
actcataacattttcaatttat

SEQ ID NO: 918863 - DNA, 22 bp, Artificial Sequence
  chemically synthesized
ataacattttcaatttatgatg

SEQ ID NO: 918864 - DNA, 22 bp, Artificial Sequence
  chemically synthesized
tgtcctgataaacccatcataa

SEQ ID NO: 918865 - DNA, 22 bp, Artificial Sequence
  chemically synthesized
tcaatttatgatgggtttatca

SEQ ID NO: 918866 - DNA, 22 bp, Artificial Sequence
  chemically synthesized
caatttatgatgggtttatcag

SEQ ID NO: 918867 - DNA, 22 bp, Artificial Sequence
  chemically synthesized
aatttatgatgggtttatcagg

SEQ ID NO: 918868 - DNA, 22 bp, Artificial Sequence
  chemically synthesized
ggatgggattgtgtcctgataa

SEQ ID NO: 918869 - DNA, 22 bp, Artificial Sequence
  chemically synthesized
aggatgggattgtgtcctgata

SEQ ID NO: 918870 - DNA, 22 bp, Artificial Sequence
  chemically synthesized
atgatgggtttatcaggacaca

SEQ ID NO: 918871 - DNA, 22 bp, Artificial Sequence
  chemically synthesized
tgatgggtttatcaggacacaa

SEQ ID NO: 918872 - DNA, 22 bp, Artificial Sequence
  chemically synthesized
accttaggatgggattgtgtcc

SEQ ID NO: 918873 - DNA, 22 bp, Artificial Sequence
  chemically synthesized
ctcaccttaggatgggattgtg

SEQ ID NO: 918874 - DNA, 22 bp, Artificial Sequence
  chemically synthesized
atcaggacacaatcccatccta

SEQ ID NO: 918875 - DNA, 22 bp, Artificial Sequence
  chemically synthesized
tcaggacacaatcccatcctaa

SEQ ID NO: 918876 - DNA, 22 bp, Artificial Sequence
  chemically synthesized
tatacagatgctcctcacctta

SEQ ID NO: 918877 - DNA, 22 bp, Artificial Sequence
  chemically synthesized
atcacattgtatacagatgctc

SEQ ID NO: 918878 - DNA, 22 bp, Artificial Sequence
  chemically synthesized
aggtgaggagcatctgtataca

SEQ ID NO: 918879 - DNA, 22 bp, Artificial Sequence
  chemically synthesized
tatcccaattcatcacattgta

SEQ ID NO: 918880 - DNA, 22 bp, Artificial Sequence
  chemically synthesized
atatcccaattcatcacattgt

SEQ ID NO: 918881 - DNA, 22 bp, Artificial Sequence
  chemically synthesized
tatgcttatatcccaattcatc

SEQ ID NO: 918882 - DNA, 22 bp, Artificial Sequence
  chemically synthesized
tatacaatgtgatgaattggga

SEQ ID NO: 918883 - DNA, 22 bp, Artificial Sequence
  chemically synthesized
atggttgtatgcttatatccca

SEQ ID NO: 918884 - DNA, 22 bp, Artificial Sequence
  chemically synthesized
catggttgtatgcttatatccc

SEQ ID NO: 918885 - DNA, 22 bp, Artificial Sequence
  chemically synthesized
tggggatggtttcatggttgta

SEQ ID NO: 918886 - DNA, 22 bp, Artificial Sequence
  chemically synthesized
ggatataagcatacaaccatga

SEQ ID NO: 918887 - DNA, 22 bp, Artificial Sequence
  chemically synthesized
attatggggatggtttcatggt

SEQ ID NO: 918888 - DNA, 22 bp, Artificial Sequence
  chemically synthesized
gattatggggatggtttcatgg

SEQ ID NO: 918889 - DNA, 22 bp, Artificial Sequence
  chemically synthesized
ccttgattatggggatggtttc

SEQ ID NO: 918890 - DNA, 22 bp, Artificial Sequence
  chemically synthesized
gttaccttgattatggggatgg

SEQ ID NO: 918891 - DNA, 22 bp, Artificial Sequence
  chemically synthesized
ggttaccttgattatggggatg

SEQ ID NO: 918892 - DNA, 22 bp, Artificial Sequence
  chemically synthesized
atgcatatacttggttaccttg

SEQ ID NO: 918893 - DNA, 22 bp, Artificial Sequence
  chemically synthesized
gagttgatgcatatacttggtt

SEQ ID NO: 918894 - DNA, 22 bp, Artificial Sequence
  chemically synthesized
ggagttgatgcatatacttggt

SEQ ID NO: 918895 - DNA, 22 bp, Artificial Sequence
  chemically synthesized
tggagttgatgcatatacttgg

SEQ ID NO: 918896 - DNA, 22 bp, Artificial Sequence
  chemically synthesized
ttggagttgatgcatatacttg

SEQ ID NO: 918897 - DNA, 22 bp, Artificial Sequence
  chemically synthesized
caaaagtttgctcatgccccct

SEQ ID NO: 918898 - DNA, 22 bp, Artificial Sequence
  chemically synthesized
gctcatgcccccttcatttttt

SEQ ID NO: 918899 - DNA, 22 bp, Artificial Sequence
  chemically synthesized
ctcatgcccccttcattttttc

SEQ ID NO: 918900 - DNA, 22 bp, Artificial Sequence
  chemically synthesized
atgcccccttcattttttcttt

SEQ ID NO: 918901 - DNA, 22 bp, Artificial Sequence
  chemically synthesized
cattttttctttcttcttcttc

SEQ ID NO: 918902 - DNA, 22 bp, Artificial Sequence
  chemically synthesized
attttttctttcttcttcttca

SEQ ID NO: 918903 - DNA, 22 bp, Artificial Sequence
  chemically synthesized
tttctttcttcttcttcacttt

SEQ ID NO: 918904 - DNA, 22 bp, Artificial Sequence
  chemically synthesized
ttctttcttcttcttcactttc

SEQ ID NO: 918905 - DNA, 22 bp, Artificial Sequence
  chemically synthesized
tctttcttcttcttcactttct

SEQ ID NO: 918906 - DNA, 22 bp, Artificial Sequence
  chemically synthesized
ctttcttcttcttcactttctc

SEQ ID NO: 918907 - DNA, 22 bp, Artificial Sequence
  chemically synthesized
tttcttcttcttcactttctcc

SEQ ID NO: 918908 - DNA, 22 bp, Artificial Sequence
  chemically synthesized
tcttcttcttcactttctcctt

SEQ ID NO: 918909 - DNA, 22 bp, Artificial Sequence
  chemically synthesized
cttcttcttcactttctccttc

SEQ ID NO: 918910 - DNA, 22 bp, Artificial Sequence
  chemically synthesized
ttcttcttcactttctccttct

SEQ ID NO: 918911 - DNA, 22 bp, Artificial Sequence
  chemically synthesized
cttcttcactttctccttctcc

SEQ ID NO: 918912 - DNA, 22 bp, Artificial Sequence
  chemically synthesized
ttcttcactttctccttctcct

SEQ ID NO: 918913 - DNA, 22 bp, Artificial Sequence
  chemically synthesized
cttcactttctccttctccttc

SEQ ID NO: 918914 - DNA, 22 bp, Artificial Sequence
  chemically synthesized
ttcactttctccttctccttct

SEQ ID NO: 918915 - DNA, 22 bp, Artificial Sequence
  chemically synthesized
cactttctccttctccttcttc

SEQ ID NO: 918916 - DNA, 22 bp, Artificial Sequence
  chemically synthesized
actttctccttctccttcttct

SEQ ID NO: 918917 - DNA, 22 bp, Artificial Sequence
  chemically synthesized
ccataagaagaagaagaagaag

SEQ ID NO: 918918 - DNA, 22 bp, Artificial Sequence
  chemically synthesized
tctccttctccttcttcttctt

SEQ ID NO: 918919 - DNA, 22 bp, Artificial Sequence
  chemically synthesized
ctccttctccttcttcttcttc

SEQ ID NO: 918920 - DNA, 22 bp, Artificial Sequence
  chemically synthesized
ctaccataagaagaagaagaag

SEQ ID NO: 918921 - DNA, 22 bp, Artificial Sequence
  chemically synthesized
tccttctccttcttcttcttct

SEQ ID NO: 918922 - DNA, 22 bp, Artificial Sequence
  chemically synthesized
cttctccttcttcttcttcttc

SEQ ID NO: 918923 - DNA, 22 bp, Artificial Sequence
  chemically synthesized
ctccttcttcttcttcttctta

SEQ ID NO: 918924 - DNA, 22 bp, Artificial Sequence
  chemically synthesized
tccttcttcttcttcttcttat

SEQ ID NO: 918925 - DNA, 22 bp, Artificial Sequence
  chemically synthesized
agtgttcctaccataagaagaa

SEQ ID NO: 918926 - DNA, 22 bp, Artificial Sequence
  chemically synthesized
aagtgttcctaccataagaaga

SEQ ID NO: 918927 - DNA, 22 bp, Artificial Sequence
  chemically synthesized
cttcttcttcttcttcttatgg

SEQ ID NO: 918928 - DNA, 22 bp, Artificial Sequence
  chemically synthesized
cttcttcttcttcttatggtag

SEQ ID NO: 918929 - DNA, 22 bp, Artificial Sequence
  chemically synthesized
ttcttcttcttcttatggtagg

SEQ ID NO: 918930 - DNA, 22 bp, Artificial Sequence
  chemically synthesized
cttcttcttcttatggtaggaa

SEQ ID NO: 918931 - DNA, 22 bp, Artificial Sequence
  chemically synthesized
ttcttcttcttatggtaggaac

SEQ ID NO: 918932 - DNA, 22 bp, Artificial Sequence
  chemically synthesized
cttcttcttatggtaggaacac

SEQ ID NO: 918933 - DNA, 22 bp, Artificial Sequence
  chemically synthesized
ttcttcttatggtaggaacact

SEQ ID NO: 918934 - DNA, 22 bp, Artificial Sequence
  chemically synthesized
cttcttatggtaggaacactta

SEQ ID NO: 918935 - DNA, 22 bp, Artificial Sequence
  chemically synthesized
ttcttatggtaggaacacttaa

SEQ ID NO: 918936 - DNA, 22 bp, Artificial Sequence
  chemically synthesized
agaggatatgtcttaagtgttc

SEQ ID NO: 918937 - DNA, 22 bp, Artificial Sequence
  chemically synthesized
cttatggtaggaacacttaaga

SEQ ID NO: 918938 - DNA, 22 bp, Artificial Sequence
  chemically synthesized
ttatggtaggaacacttaagac

SEQ ID NO: 918939 - DNA, 22 bp, Artificial Sequence
  chemically synthesized
ttaagaggatatgtcttaagtg

SEQ ID NO: 918940 - DNA, 22 bp, Artificial Sequence
  chemically synthesized
atggtaggaacacttaagacat

SEQ ID NO: 918941 - DNA, 22 bp, Artificial Sequence
  chemically synthesized
tggtaggaacacttaagacata

SEQ ID NO: 918942 - DNA, 22 bp, Artificial Sequence
  chemically synthesized
ttattaagaggatatgtcttaa

SEQ ID NO: 918943 - DNA, 22 bp, Artificial Sequence
  chemically synthesized
aattattattaagaggatatgt

SEQ ID NO: 918944 - DNA, 22 bp, Artificial Sequence
  chemically synthesized
aaattattattaagaggatatg

SEQ ID NO: 918945 - DNA, 22 bp, Artificial Sequence
  chemically synthesized
tgcacttaaattattattaaga

SEQ ID NO: 918946 - DNA, 22 bp, Artificial Sequence
  chemically synthesized
aagacatatcctcttaataata

SEQ ID NO: 918947 - DNA, 22 bp, Artificial Sequence
  chemically synthesized
agacatatcctcttaataataa

SEQ ID NO: 918948 - DNA, 22 bp, Artificial Sequence
  chemically synthesized
tactgtgcacttaaattattat

SEQ ID NO: 918949 - DNA, 22 bp, Artificial Sequence
  chemically synthesized
ttaataataatttaagtgcaca

SEQ ID NO: 918950 - DNA, 22 bp, Artificial Sequence
  chemically synthesized
aataataatttaagtgcacagt

SEQ ID NO: 918951 - DNA, 22 bp, Artificial Sequence
  chemically synthesized
ataataatttaagtgcacagta

SEQ ID NO: 918952 - DNA, 22 bp, Artificial Sequence
  chemically synthesized
tacaacatagtgcctgtactgt

SEQ ID NO: 918953 - DNA, 22 bp, Artificial Sequence
  chemically synthesized
ctgtacaacatagtgcctgtac

SEQ ID NO: 918954 - DNA, 22 bp, Artificial Sequence
  chemically synthesized
aagtgcacagtacaggcactat

SEQ ID NO: 918955 - DNA, 22 bp, Artificial Sequence
  chemically synthesized
agtgcacagtacaggcactatg

SEQ ID NO: 918956 - DNA, 22 bp, Artificial Sequence
  chemically synthesized
aagatctgctgtacaacatagt

SEQ ID NO: 918957 - DNA, 22 bp, Artificial Sequence
  chemically synthesized
taaagatctgctgtacaacata

SEQ ID NO: 918958 - DNA, 22 bp, Artificial Sequence
  chemically synthesized
tgttgtacagcagatctttaga

SEQ ID NO: 918959 - DNA, 22 bp, Artificial Sequence
  chemically synthesized
tataatgtaaataagttctaaa

SEQ ID NO: 918960 - DNA, 22 bp, Artificial Sequence
  chemically synthesized
tacagcagatctttagaactta

SEQ ID NO: 918961 - DNA, 22 bp, Artificial Sequence
  chemically synthesized
agttatataatgtaaataagtt

SEQ ID NO: 918962 - DNA, 22 bp, Artificial Sequence
  chemically synthesized
cagttatataatgtaaataagt

SEQ ID NO: 918963 - DNA, 22 bp, Artificial Sequence
  chemically synthesized
tagaacttatttacattatata

SEQ ID NO: 918964 - DNA, 22 bp, Artificial Sequence
  chemically synthesized
agaacttatttacattatataa

SEQ ID NO: 918965 - DNA, 22 bp, Artificial Sequence
  chemically synthesized
gaacttatttacattatataac

SEQ ID NO: 918966 - DNA, 22 bp, Artificial Sequence
  chemically synthesized
atttacattatataactgaaac

SEQ ID NO: 918967 - DNA, 22 bp, Artificial Sequence
  chemically synthesized
aatgagtataaagtttcagtta

SEQ ID NO: 918968 - DNA, 22 bp, Artificial Sequence
  chemically synthesized
tttacattatataactgaaact

SEQ ID NO: 918969 - DNA, 22 bp, Artificial Sequence
  chemically synthesized
ttcaatgagtataaagtttcag

SEQ ID NO: 918970 - DNA, 22 bp, Artificial Sequence
  chemically synthesized
acattatataactgaaacttta

SEQ ID NO: 918971 - DNA, 22 bp, Artificial Sequence
  chemically synthesized
cattatataactgaaactttat

SEQ ID NO: 918972 - DNA, 22 bp, Artificial Sequence
  chemically synthesized
ctgttcaatgagtataaagttt

SEQ ID NO: 918973 - DNA, 22 bp, Artificial Sequence
  chemically synthesized
tataactgaaactttatactca

SEQ ID NO: 918974 - DNA, 22 bp, Artificial Sequence
  chemically synthesized
ggagttgctgttcaatgagtat

SEQ ID NO: 918975 - DNA, 22 bp, Artificial Sequence
  chemically synthesized
aaactttatactcattgaacag

SEQ ID NO: 918976 - DNA, 22 bp, Artificial Sequence
  chemically synthesized
tatactcattgaacagcaactc

SEQ ID NO: 918977 - DNA, 22 bp, Artificial Sequence
  chemically synthesized
atactcattgaacagcaactcc

SEQ ID NO: 918978 - DNA, 22 bp, Artificial Sequence
  chemically synthesized
tactcattgaacagcaactccc

SEQ ID NO: 918979 - DNA, 22 bp, Artificial Sequence
  chemically synthesized
ggcgaagggggaactgggagtt

SEQ ID NO: 918980 - DNA, 22 bp, Artificial Sequence
  chemically synthesized
attgaacagcaactcccagttc

SEQ ID NO: 918981 - DNA, 22 bp, Artificial Sequence
  chemically synthesized
aacagcaactcccagttccccc

SEQ ID NO: 918982 - DNA, 22 bp, Artificial Sequence
  chemically synthesized
ccagttcccccttcgcccagcc

SEQ ID NO: 918983 - DNA, 22 bp, Artificial Sequence
  chemically synthesized
ccccttcgcccagcccctggtt

SEQ ID NO: 918984 - DNA, 22 bp, Artificial Sequence
  chemically synthesized
cgcccagcccctggttactatc

SEQ ID NO: 918985 - DNA, 22 bp, Artificial Sequence
  chemically synthesized
gcccagcccctggttactatca

SEQ ID NO: 918986 - DNA, 22 bp, Artificial Sequence
  chemically synthesized
gtagaaccagagagtagaatga

SEQ ID NO: 918987 - DNA, 22 bp, Artificial Sequence
  chemically synthesized
gttactatcattctactctctg

SEQ ID NO: 918988 - DNA, 22 bp, Artificial Sequence
  chemically synthesized
ctatcattctactctctggttc

SEQ ID NO: 918989 - DNA, 22 bp, Artificial Sequence
  chemically synthesized
tcattctactctctggttctac

SEQ ID NO: 918990 - DNA, 22 bp, Artificial Sequence
  chemically synthesized
agacagtcaaactcgtagaacc

SEQ ID NO: 918991 - DNA, 22 bp, Artificial Sequence
  chemically synthesized
tactctctggttctacgagttt

SEQ ID NO: 918992 - DNA, 22 bp, Artificial Sequence
  chemically synthesized
ctctctggttctacgagtttga

SEQ ID NO: 918993 - DNA, 22 bp, Artificial Sequence
  chemically synthesized
tctggttctacgagtttgactg

SEQ ID NO: 918994 - DNA, 22 bp, Artificial Sequence
  chemically synthesized
tggttctacgagtttgactgtc

SEQ ID NO: 918995 - DNA, 22 bp, Artificial Sequence
  chemically synthesized
gttctacgagtttgactgtctc

SEQ ID NO: 918996 - DNA, 22 bp, Artificial Sequence
  chemically synthesized
tatgaggtgtctgagacagtca

SEQ ID NO: 918997 - DNA, 22 bp, Artificial Sequence
  chemically synthesized
atatgaggtgtctgagacagtc

SEQ ID NO: 918998 - DNA, 22 bp, Artificial Sequence
  chemically synthesized
tacgagtttgactgtctcagac

SEQ ID NO: 918999 - DNA, 22 bp, Artificial Sequence
  chemically synthesized
cgagtttgactgtctcagacac

SEQ ID NO: 919000 - DNA, 22 bp, Artificial Sequence
  chemically synthesized
catttatatgaggtgtctgaga

SEQ ID NO: 919001 - DNA, 22 bp, Artificial Sequence
  chemically synthesized
gactgtctcagacacctcatat

SEQ ID NO: 919002 - DNA, 22 bp, Artificial Sequence
  chemically synthesized
actgtctcagacacctcatata

SEQ ID NO: 919003 - DNA, 22 bp, Artificial Sequence
  chemically synthesized
aatgattccatttatatgaggt

SEQ ID NO: 919004 - DNA, 22 bp, Artificial Sequence
  chemically synthesized
tctcagacacctcatataaatg

SEQ ID NO: 919005 - DNA, 22 bp, Artificial Sequence
  chemically synthesized
agacacctcatataaatggaat

SEQ ID NO: 919006 - DNA, 22 bp, Artificial Sequence
  chemically synthesized
atataaatggaatcattcagta

SEQ ID NO: 919007 - DNA, 22 bp, Artificial Sequence
  chemically synthesized
agtatttgccctttggtgactg

SEQ ID NO: 919008 - DNA, 22 bp, Artificial Sequence
  chemically synthesized
agtgaaataagccagtcaccaa

SEQ ID NO: 919009 - DNA, 22 bp, Artificial Sequence
  chemically synthesized
tgctaagtgaaataagccagtc

SEQ ID NO: 919010 - DNA, 22 bp, Artificial Sequence
  chemically synthesized
gccctttggtgactggcttatt

SEQ ID NO: 919011 - DNA, 22 bp, Artificial Sequence
  chemically synthesized
ccctttggtgactggcttattt

SEQ ID NO: 919012 - DNA, 22 bp, Artificial Sequence
  chemically synthesized
tggtgactggcttatttcactt

SEQ ID NO: 919013 - DNA, 22 bp, Artificial Sequence
  chemically synthesized
ggtgactggcttatttcactta

SEQ ID NO: 919014 - DNA, 22 bp, Artificial Sequence
  chemically synthesized
gtgactggcttatttcacttag

SEQ ID NO: 919015 - DNA, 22 bp, Artificial Sequence
  chemically synthesized
gaaggcattatgctaagtgaaa

SEQ ID NO: 919016 - DNA, 22 bp, Artificial Sequence
  chemically synthesized
gcttatttcacttagcataatg

SEQ ID NO: 919017 - DNA, 22 bp, Artificial Sequence
  chemically synthesized
atttcacttagcataatgcctt

SEQ ID NO: 919018 - DNA, 22 bp, Artificial Sequence
  chemically synthesized
tttcacttagcataatgccttc

SEQ ID NO: 919019 - DNA, 22 bp, Artificial Sequence
  chemically synthesized
cacttagcataatgccttccag

SEQ ID NO: 919020 - DNA, 22 bp, Artificial Sequence
  chemically synthesized
acttagcataatgccttccagg

SEQ ID NO: 919021 - DNA, 22 bp, Artificial Sequence
  chemically synthesized
acaatatgtatgaacctggaag

SEQ ID NO: 919022 - DNA, 22 bp, Artificial Sequence
  chemically synthesized
gacaatatgtatgaacctggaa

SEQ ID NO: 919023 - DNA, 22 bp, Artificial Sequence
  chemically synthesized
agcataatgccttccaggttca

SEQ ID NO: 919024 - DNA, 22 bp, Artificial Sequence
  chemically synthesized
gcataatgccttccaggttcat

SEQ ID NO: 919025 - DNA, 22 bp, Artificial Sequence
  chemically synthesized
ccatatttgacaatatgtatga

SEQ ID NO: 919026 - DNA, 22 bp, Artificial Sequence
  chemically synthesized
ccaggttcatacatattgtcaa

SEQ ID NO: 919027 - DNA, 22 bp, Artificial Sequence
  chemically synthesized
caggttcatacatattgtcaaa

SEQ ID NO: 919028 - DNA, 22 bp, Artificial Sequence
  chemically synthesized
atacatattgtcaaatatggca

SEQ ID NO: 919029 - DNA, 22 bp, Artificial Sequence
  chemically synthesized
aaagggaaggacgtcctgccat

SEQ ID NO: 919030 - DNA, 22 bp, Artificial Sequence
  chemically synthesized
aaaagggaaggacgtcctgcca

SEQ ID NO: 919031 - DNA, 22 bp, Artificial Sequence
  chemically synthesized
tcaaatatggcaggacgtcctt

SEQ ID NO: 919032 - DNA, 22 bp, Artificial Sequence
  chemically synthesized
gccttaaaagggaaggacgtcc

SEQ ID NO: 919033 - DNA, 22 bp, Artificial Sequence
  chemically synthesized
ggccttaaaagggaaggacgtc

SEQ ID NO: 919034 - DNA, 22 bp, Artificial Sequence
  chemically synthesized
tttggccttaaaagggaaggac

SEQ ID NO: 919035 - DNA, 22 bp, Artificial Sequence
  chemically synthesized
atacagggaatattatttggcc

SEQ ID NO: 919036 - DNA, 22 bp, Artificial Sequence
  chemically synthesized
cccttttaaggccaaataatat

SEQ ID NO: 919037 - DNA, 22 bp, Artificial Sequence
  chemically synthesized
ccttttaaggccaaataatatt

SEQ ID NO: 919038 - DNA, 22 bp, Artificial Sequence
  chemically synthesized
ttaaggccaaataatattccct

SEQ ID NO: 919039 - DNA, 22 bp, Artificial Sequence
  chemically synthesized
taaggccaaataatattccctg

SEQ ID NO: 919040 - DNA, 22 bp, Artificial Sequence
  chemically synthesized
aaggccaaataatattccctgt

SEQ ID NO: 919041 - DNA, 22 bp, Artificial Sequence
  chemically synthesized
aggccaaataatattccctgta

SEQ ID NO: 919042 - DNA, 22 bp, Artificial Sequence
  chemically synthesized
cctgtatgaatacaccacattt

SEQ ID NO: 919043 - DNA, 22 bp, Artificial Sequence
  chemically synthesized
tatgaatacaccacattttctt

SEQ ID NO: 919044 - DNA, 22 bp, Artificial Sequence
  chemically synthesized
tgcatggaagaatgcatggata

SEQ ID NO: 919045 - DNA, 22 bp, Artificial Sequence
  chemically synthesized
tctttatccatgcattcttcca

SEQ ID NO: 919046 - DNA, 22 bp, Artificial Sequence
  chemically synthesized
ctttatccatgcattcttccat

SEQ ID NO: 919047 - DNA, 22 bp, Artificial Sequence
  chemically synthesized
tttatccatgcattcttccatg

SEQ ID NO: 919048 - DNA, 22 bp, Artificial Sequence
  chemically synthesized
tatccatgcattcttccatgca

SEQ ID NO: 919049 - DNA, 22 bp, Artificial Sequence
  chemically synthesized
atccatgcattcttccatgcac

SEQ ID NO: 919050 - DNA, 22 bp, Artificial Sequence
  chemically synthesized
tccatgcattcttccatgcaca

SEQ ID NO: 919051 - DNA, 22 bp, Artificial Sequence
  chemically synthesized
ttccatgcacagctatgctgta

SEQ ID NO: 919052 - DNA, 22 bp, Artificial Sequence
  chemically synthesized
ccatgcacagctatgctgtatt

SEQ ID NO: 919053 - DNA, 22 bp, Artificial Sequence
  chemically synthesized
catgcacagctatgctgtattg

SEQ ID NO: 919054 - DNA, 22 bp, Artificial Sequence
  chemically synthesized
acagtagccaagatatcaatac

SEQ ID NO: 919055 - DNA, 22 bp, Artificial Sequence
  chemically synthesized
ttcacagtagccaagatatcaa

SEQ ID NO: 919056 - DNA, 22 bp, Artificial Sequence
  chemically synthesized
tgctgtattgatatcttggcta

SEQ ID NO: 919057 - DNA, 22 bp, Artificial Sequence
  chemically synthesized
aagcattattcacagtagccaa

SEQ ID NO: 919058 - DNA, 22 bp, Artificial Sequence
  chemically synthesized
tattgatatcttggctactgtg

SEQ ID NO: 919059 - DNA, 22 bp, Artificial Sequence
  chemically synthesized
tgaagcattattcacagtagcc

SEQ ID NO: 919060 - DNA, 22 bp, Artificial Sequence
  chemically synthesized
tctgaagcattattcacagtag

SEQ ID NO: 919061 - DNA, 22 bp, Artificial Sequence
  chemically synthesized
ctctgaagcattattcacagta

SEQ ID NO: 919062 - DNA, 22 bp, Artificial Sequence
  chemically synthesized
atatcttggctactgtgaataa

SEQ ID NO: 919063 - DNA, 22 bp, Artificial Sequence
  chemically synthesized
atcttctctgaagcattattca

SEQ ID NO: 919064 - DNA, 22 bp, Artificial Sequence
  chemically synthesized
tcatcttctctgaagcattatt

SEQ ID NO: 919065 - DNA, 22 bp, Artificial Sequence
  chemically synthesized
ggctactgtgaataatgcttca

SEQ ID NO: 919066 - DNA, 22 bp, Artificial Sequence
  chemically synthesized
gctactgtgaataatgcttcag

SEQ ID NO: 919067 - DNA, 22 bp, Artificial Sequence
  chemically synthesized
cactctcatcttctctgaagca

SEQ ID NO: 919068 - DNA, 22 bp, Artificial Sequence
  chemically synthesized
ctgtgaataatgcttcagagaa

SEQ ID NO: 919069 - DNA, 22 bp, Artificial Sequence
  chemically synthesized
tgaataatgcttcagagaagat

SEQ ID NO: 919070 - DNA, 22 bp, Artificial Sequence
  chemically synthesized
aaaaagatatctgcactctcat

SEQ ID NO: 919071 - DNA, 22 bp, Artificial Sequence
  chemically synthesized
cagagaagatgagagtgcagat

SEQ ID NO: 919072 - DNA, 22 bp, Artificial Sequence
  chemically synthesized
agagaagatgagagtgcagata

SEQ ID NO: 919073 - DNA, 22 bp, Artificial Sequence
  chemically synthesized
aaaccagaatctcaaaaagata

SEQ ID NO: 919074 - DNA, 22 bp, Artificial Sequence
  chemically synthesized
tttgagattctggttttaattc

SEQ ID NO: 919075 - DNA, 22 bp, Artificial Sequence
  chemically synthesized
ttgagattctggttttaattct

SEQ ID NO: 919076 - DNA, 22 bp, Artificial Sequence
  chemically synthesized
tgagattctggttttaattctt

SEQ ID NO: 919077 - DNA, 22 bp, Artificial Sequence
  chemically synthesized
gagattctggttttaattcttt

SEQ ID NO: 919078 - DNA, 22 bp, Artificial Sequence
  chemically synthesized
ggtatatatcccaaagaattaa

SEQ ID NO: 919079 - DNA, 22 bp, Artificial Sequence
  chemically synthesized
agattctggttttaattctttg

SEQ ID NO: 919080 - DNA, 22 bp, Artificial Sequence
  chemically synthesized
ctgggtatatatcccaaagaat

SEQ ID NO: 919081 - DNA, 22 bp, Artificial Sequence
  chemically synthesized
tggttttaattctttgggatat

SEQ ID NO: 919082 - DNA, 22 bp, Artificial Sequence
  chemically synthesized
actcctgggtatatatcccaaa

SEQ ID NO: 919083 - DNA, 22 bp, Artificial Sequence
  chemically synthesized
gttttaattctttgggatatat

SEQ ID NO: 919084 - DNA, 22 bp, Artificial Sequence
  chemically synthesized
taattctttgggatatataccc

SEQ ID NO: 919085 - DNA, 22 bp, Artificial Sequence
  chemically synthesized
aattctttgggatatataccca

SEQ ID NO: 919086 - DNA, 22 bp, Artificial Sequence
  chemically synthesized
attctttgggatatatacccag

SEQ ID NO: 919087 - DNA, 22 bp, Artificial Sequence
  chemically synthesized
tttgggatatatacccaggagt

SEQ ID NO: 919088 - DNA, 22 bp, Artificial Sequence
  chemically synthesized
tgggatatatacccaggagtga

SEQ ID NO: 919089 - DNA, 22 bp, Artificial Sequence
  chemically synthesized
gggatatatacccaggagtgag

SEQ ID NO: 919090 - DNA, 22 bp, Artificial Sequence
  chemically synthesized
ggatatatacccaggagtgagg

SEQ ID NO: 919091 - DNA, 22 bp, Artificial Sequence
  chemically synthesized
ccatatgatccagcaacctcac

SEQ ID NO: 919092 - DNA, 22 bp, Artificial Sequence
  chemically synthesized
aaaatagaactaccatatgatc

SEQ ID NO: 919093 - DNA, 22 bp, Artificial Sequence
  chemically synthesized
ctggatcatatggtagttctat

SEQ ID NO: 919094 - DNA, 22 bp, Artificial Sequence
  chemically synthesized
aaaaagttaaaaatagaactac

SEQ ID NO: 919095 - DNA, 22 bp, Artificial Sequence
  chemically synthesized
gaaaaagttaaaaatagaacta

SEQ ID NO: 919096 - DNA, 22 bp, Artificial Sequence
  chemically synthesized
gatcatatggtagttctatttt

SEQ ID NO: 919097 - DNA, 22 bp, Artificial Sequence
  chemically synthesized
ttgaaaaagttaaaaatagaac

SEQ ID NO: 919098 - DNA, 22 bp, Artificial Sequence
  chemically synthesized
tatttttaactttttcaagaac

SEQ ID NO: 919099 - DNA, 22 bp, Artificial Sequence
  chemically synthesized
tttttaactttttcaagaacct

SEQ ID NO: 919100 - DNA, 22 bp, Artificial Sequence
  chemically synthesized
ttaactttttcaagaacctttc

SEQ ID NO: 919101 - DNA, 22 bp, Artificial Sequence
  chemically synthesized
tagaacacagtagaaaggttct

SEQ ID NO: 919102 - DNA, 22 bp, Artificial Sequence
  chemically synthesized
taactttttcaagaacctttct

SEQ ID NO: 919103 - DNA, 22 bp, Artificial Sequence
  chemically synthesized
aactttttcaagaacctttcta

SEQ ID NO: 919104 - DNA, 22 bp, Artificial Sequence
  chemically synthesized
actttttcaagaacctttctac

SEQ ID NO: 919105 - DNA, 22 bp, Artificial Sequence
  chemically synthesized
ctatagaacacagtagaaaggt

SEQ ID NO: 919106 - DNA, 22 bp, Artificial Sequence
  chemically synthesized
tttcaagaacctttctactgtg

SEQ ID NO: 919107 - DNA, 22 bp, Artificial Sequence
  chemically synthesized
ttcaagaacctttctactgtgt

SEQ ID NO: 919108 - DNA, 22 bp, Artificial Sequence
  chemically synthesized
tcaagaacctttctactgtgtt

SEQ ID NO: 919109 - DNA, 22 bp, Artificial Sequence
  chemically synthesized
caagaacctttctactgtgttc

SEQ ID NO: 919110 - DNA, 22 bp, Artificial Sequence
  chemically synthesized
aagaacctttctactgtgttct

SEQ ID NO: 919111 - DNA, 22 bp, Artificial Sequence
  chemically synthesized
tctactgtgttctatagcagct

SEQ ID NO: 919112 - DNA, 22 bp, Artificial Sequence
  chemically synthesized
ctactgtgttctatagcagctg

SEQ ID NO: 919113 - DNA, 22 bp, Artificial Sequence
  chemically synthesized
tactgtgttctatagcagctgc

SEQ ID NO: 919114 - DNA, 22 bp, Artificial Sequence
  chemically synthesized
ctgtgttctatagcagctgcat

SEQ ID NO: 919115 - DNA, 22 bp, Artificial Sequence
  chemically synthesized
tgttctatagcagctgcatcat

SEQ ID NO: 919116 - DNA, 22 bp, Artificial Sequence
  chemically synthesized
tatagcagctgcatcatttttc

SEQ ID NO: 919117 - DNA, 22 bp, Artificial Sequence
  chemically synthesized
tagcagctgcatcatttttcca

SEQ ID NO: 919118 - DNA, 22 bp, Artificial Sequence
  chemically synthesized
gtacaccataggtggtaatgga

SEQ ID NO: 919119 - DNA, 22 bp, Artificial Sequence
  chemically synthesized
catcatttttccattaccacct

SEQ ID NO: 919120 - DNA, 22 bp, Artificial Sequence
  chemically synthesized
ttccattaccacctatggtgta

SEQ ID NO: 919121 - DNA, 22 bp, Artificial Sequence
  chemically synthesized
tccattaccacctatggtgtac

SEQ ID NO: 919122 - DNA, 22 bp, Artificial Sequence
  chemically synthesized
ccattaccacctatggtgtact

SEQ ID NO: 919123 - DNA, 22 bp, Artificial Sequence
  chemically synthesized
cattaccacctatggtgtacta

SEQ ID NO: 919124 - DNA, 22 bp, Artificial Sequence
  chemically synthesized
ccacctatggtgtactagcgtt

SEQ ID NO: 919125 - DNA, 22 bp, Artificial Sequence
  chemically synthesized
aggatgtgaggaaatcggaacg

SEQ ID NO: 919126 - DNA, 22 bp, Artificial Sequence
  chemically synthesized
tggtgtactagcgttccgattt

SEQ ID NO: 919127 - DNA, 22 bp, Artificial Sequence
  chemically synthesized
ttgaggatgtgaggaaatcgga

SEQ ID NO: 919128 - DNA, 22 bp, Artificial Sequence
  chemically synthesized
gcgttccgatttcctcacatcc

SEQ ID NO: 919129 - DNA, 22 bp, Artificial Sequence
  chemically synthesized
cgatttcctcacatcctcaaca

SEQ ID NO: 919130 - DNA, 22 bp, Artificial Sequence
  chemically synthesized
cctcacatcctcaacaacattt

SEQ ID NO: 919131 - DNA, 22 bp, Artificial Sequence
  chemically synthesized
ctcacatcctcaacaacatttc

SEQ ID NO: 919132 - DNA, 22 bp, Artificial Sequence
  chemically synthesized
acatcctcaacaacatttctta

SEQ ID NO: 919133 - DNA, 22 bp, Artificial Sequence
  chemically synthesized
aacaacatttcttatctcttgt

SEQ ID NO: 919134 - DNA, 22 bp, Artificial Sequence
  chemically synthesized
taaaaacaaaccaaaaacaaga

SEQ ID NO: 919135 - DNA, 22 bp, Artificial Sequence
  chemically synthesized
ctataaaaacaaaccaaaaaca

SEQ ID NO: 919136 - DNA, 22 bp, Artificial Sequence
  chemically synthesized
cttatctcttgtttttggtttg

SEQ ID NO: 919137 - DNA, 22 bp, Artificial Sequence
  chemically synthesized
ttatctcttgtttttggtttgt

SEQ ID NO: 919138 - DNA, 22 bp, Artificial Sequence
  chemically synthesized
atctcttgtttttggtttgttt

SEQ ID NO: 919139 - DNA, 22 bp, Artificial Sequence
  chemically synthesized
tctcttgtttttggtttgtttt

SEQ ID NO: 919140 - DNA, 22 bp, Artificial Sequence
  chemically synthesized
ggatggctactataaaaacaaa

SEQ ID NO: 919141 - DNA, 22 bp, Artificial Sequence
  chemically synthesized
ttgtttttggtttgtttttata

SEQ ID NO: 919142 - DNA, 22 bp, Artificial Sequence
  chemically synthesized
ttaggatggctactataaaaac

SEQ ID NO: 919143 - DNA, 22 bp, Artificial Sequence
  chemically synthesized
gtttttggtttgtttttatagt

SEQ ID NO: 919144 - DNA, 22 bp, Artificial Sequence
  chemically synthesized
tttttggtttgtttttatagta

SEQ ID NO: 919145 - DNA, 22 bp, Artificial Sequence
  chemically synthesized
ttggtttgtttttatagtagcc

SEQ ID NO: 919146 - DNA, 22 bp, Artificial Sequence
  chemically synthesized
tggtttgtttttatagtagcca

SEQ ID NO: 919147 - DNA, 22 bp, Artificial Sequence
  chemically synthesized
ggtttgtttttatagtagccat

SEQ ID NO: 919148 - DNA, 22 bp, Artificial Sequence
  chemically synthesized
acccctgttaggatggctacta

SEQ ID NO: 919149 - DNA, 22 bp, Artificial Sequence
  chemically synthesized
gtttgtttttatagtagccatc

SEQ ID NO: 919150 - DNA, 22 bp, Artificial Sequence
  chemically synthesized
gtttttatagtagccatcctaa

SEQ ID NO: 919151 - DNA, 22 bp, Artificial Sequence
  chemically synthesized
tttttatagtagccatcctaac

SEQ ID NO: 919152 - DNA, 22 bp, Artificial Sequence
  chemically synthesized
tcatctcacccctgttaggatg

SEQ ID NO: 919153 - DNA, 22 bp, Artificial Sequence
  chemically synthesized
ttatagtagccatcctaacagg

SEQ ID NO: 919154 - DNA, 22 bp, Artificial Sequence
  chemically synthesized
tatagtagccatcctaacaggg

SEQ ID NO: 919155 - DNA, 22 bp, Artificial Sequence
  chemically synthesized
atagtagccatcctaacagggg

SEQ ID NO: 919156 - DNA, 22 bp, Artificial Sequence
  chemically synthesized
tagtagccatcctaacaggggt

SEQ ID NO: 919157 - DNA, 22 bp, Artificial Sequence
  chemically synthesized
tgagatgaacactatcatctca

SEQ ID NO: 919158 - DNA, 22 bp, Artificial Sequence
  chemically synthesized
tgtgagatgaacactatcatct

SEQ ID NO: 919159 - DNA, 22 bp, Artificial Sequence
  chemically synthesized
acaggggtgagatgatagtgtt

SEQ ID NO: 919160 - DNA, 22 bp, Artificial Sequence
  chemically synthesized
atctcacagaggttttgatttg

SEQ ID NO: 919161 - DNA, 22 bp, Artificial Sequence
  chemically synthesized
gtcatcagggaaatgcaaatca

SEQ ID NO: 919162 - DNA, 22 bp, Artificial Sequence
  chemically synthesized
acagaggttttgatttgcattt

SEQ ID NO: 919163 - DNA, 22 bp, Artificial Sequence
  chemically synthesized
agcatcactagtcatcagggaa

SEQ ID NO: 919164 - DNA, 22 bp, Artificial Sequence
  chemically synthesized
tgatttgcatttccctgatgac

SEQ ID NO: 919165 - DNA, 22 bp, Artificial Sequence
  chemically synthesized
gatttgcatttccctgatgact

SEQ ID NO: 919166 - DNA, 22 bp, Artificial Sequence
  chemically synthesized
atttgcatttccctgatgacta

SEQ ID NO: 919167 - DNA, 22 bp, Artificial Sequence
  chemically synthesized
gcatttccctgatgactagtga

SEQ ID NO: 919168 - DNA, 22 bp, Artificial Sequence
  chemically synthesized
catttccctgatgactagtgat

SEQ ID NO: 919169 - DNA, 22 bp, Artificial Sequence
  chemically synthesized
ccctgatgactagtgatgctga

SEQ ID NO: 919170 - DNA, 22 bp, Artificial Sequence
  chemically synthesized
cctgatgactagtgatgctgag

SEQ ID NO: 919171 - DNA, 22 bp, Artificial Sequence
  chemically synthesized
atgactagtgatgctgagcacc

SEQ ID NO: 919172 - DNA, 22 bp, Artificial Sequence
  chemically synthesized
gtgatgctgagcaccttttcac

SEQ ID NO: 919173 - DNA, 22 bp, Artificial Sequence
  chemically synthesized
agcaccttttcacatacctgtt

SEQ ID NO: 919174 - DNA, 22 bp, Artificial Sequence
  chemically synthesized
ttcacatacctgttggccattt

SEQ ID NO: 919175 - DNA, 22 bp, Artificial Sequence
  chemically synthesized
tcacatacctgttggccatttc

SEQ ID NO: 919176 - DNA, 22 bp, Artificial Sequence
  chemically synthesized
cacatacctgttggccatttct

SEQ ID NO: 919177 - DNA, 22 bp, Artificial Sequence
  chemically synthesized
caaagaagacatagaaatggcc

SEQ ID NO: 919178 - DNA, 22 bp, Artificial Sequence
  chemically synthesized
acatacctgttggccatttcta

SEQ ID NO: 919179 - DNA, 22 bp, Artificial Sequence
  chemically synthesized
tccaaagaagacatagaaatgg

SEQ ID NO: 919180 - DNA, 22 bp, Artificial Sequence
  chemically synthesized
ctccaaagaagacatagaaatg

SEQ ID NO: 919181 - DNA, 22 bp, Artificial Sequence
  chemically synthesized
ttggccatttctatgtcttctt

SEQ ID NO: 919182 - DNA, 22 bp, Artificial Sequence
  chemically synthesized
gccatttctatgtcttctttgg

SEQ ID NO: 919183 - DNA, 22 bp, Artificial Sequence
  chemically synthesized
aatatatatttctccaaagaag

SEQ ID NO: 919184 - DNA, 22 bp, Artificial Sequence
  chemically synthesized
aaatatatatttctccaaagaa

SEQ ID NO: 919185 - DNA, 22 bp, Artificial Sequence
  chemically synthesized
ctatgtcttctttggagaaata

SEQ ID NO: 919186 - DNA, 22 bp, Artificial Sequence
  chemically synthesized
tatgtcttctttggagaaatat

SEQ ID NO: 919187 - DNA, 22 bp, Artificial Sequence
  chemically synthesized
tgtcttctttggagaaatatat

SEQ ID NO: 919188 - DNA, 22 bp, Artificial Sequence
  chemically synthesized
aaatatttaaatatatatttct

SEQ ID NO: 919189 - DNA, 22 bp, Artificial Sequence
  chemically synthesized
aaaatatttaaatatatatttc

SEQ ID NO: 919190 - DNA, 22 bp, Artificial Sequence
  chemically synthesized
taaaatatttaaatatatattt

SEQ ID NO: 919191 - DNA, 22 bp, Artificial Sequence
  chemically synthesized
ttaaaatatttaaatatatatt

SEQ ID NO: 919192 - DNA, 22 bp, Artificial Sequence
  chemically synthesized
ctttggagaaatatatatttaa

SEQ ID NO: 919193 - DNA, 22 bp, Artificial Sequence
  chemically synthesized
tttggagaaatatatatttaaa

SEQ ID NO: 919194 - DNA, 22 bp, Artificial Sequence
  chemically synthesized
atttttaaaatatttaaatata

SEQ ID NO: 919195 - DNA, 22 bp, Artificial Sequence
  chemically synthesized
gatttttaaaatatttaaatat

SEQ ID NO: 919196 - DNA, 22 bp, Artificial Sequence
  chemically synthesized
tggagaaatatatatttaaata

SEQ ID NO: 919197 - DNA, 22 bp, Artificial Sequence
  chemically synthesized
ggagaaatatatatttaaatat

SEQ ID NO: 919198 - DNA, 22 bp, Artificial Sequence
  chemically synthesized
gagaaatatatatttaaatatt

SEQ ID NO: 919199 - DNA, 22 bp, Artificial Sequence
  chemically synthesized
aaatattttaaaaatcaagtta

SEQ ID NO: 919200 - DNA, 22 bp, Artificial Sequence
  chemically synthesized
aatattttaaaaatcaagttat

SEQ ID NO: 919201 - DNA, 22 bp, Artificial Sequence
  chemically synthesized
aacaggaaaaaggcaaataact

SEQ ID NO: 919202 - DNA, 22 bp, Artificial Sequence
  chemically synthesized
taaaaatcaagttatttgcctt

SEQ ID NO: 919203 - DNA, 22 bp, Artificial Sequence
  chemically synthesized
aaaaatcaagttatttgccttt

SEQ ID NO: 919204 - DNA, 22 bp, Artificial Sequence
  chemically synthesized
aaaatcaagttatttgcctttt

SEQ ID NO: 919205 - DNA, 22 bp, Artificial Sequence
  chemically synthesized
atacaactcaacaggaaaaagg

SEQ ID NO: 919206 - DNA, 22 bp, Artificial Sequence
  chemically synthesized
ttaatacaactcaacaggaaaa

SEQ ID NO: 919207 - DNA, 22 bp, Artificial Sequence
  chemically synthesized
attgttaatacaactcaacagg

SEQ ID NO: 919208 - DNA, 22 bp, Artificial Sequence
  chemically synthesized
tttgcctttttcctgttgagtt

SEQ ID NO: 919209 - DNA, 22 bp, Artificial Sequence
  chemically synthesized
gcctttttcctgttgagttgta

SEQ ID NO: 919210 - DNA, 22 bp, Artificial Sequence
  chemically synthesized
cctttttcctgttgagttgtat

SEQ ID NO: 919211 - DNA, 22 bp, Artificial Sequence
  chemically synthesized
tttcctgttgagttgtattaac

SEQ ID NO: 919212 - DNA, 22 bp, Artificial Sequence
  chemically synthesized
ttcctgttgagttgtattaaca

SEQ ID NO: 919213 - DNA, 22 bp, Artificial Sequence
  chemically synthesized
tcctgttgagttgtattaacaa

SEQ ID NO: 919214 - DNA, 22 bp, Artificial Sequence
  chemically synthesized
cctgttgagttgtattaacaat

SEQ ID NO: 919215 - DNA, 22 bp, Artificial Sequence
  chemically synthesized
ctgttgagttgtattaacaatc

SEQ ID NO: 919216 - DNA, 22 bp, Artificial Sequence
  chemically synthesized
ttgagttgtattaacaatcagc

SEQ ID NO: 919217 - DNA, 22 bp, Artificial Sequence
  chemically synthesized
agttgtattaacaatcagctct

SEQ ID NO: 919218 - DNA, 22 bp, Artificial Sequence
  chemically synthesized
gtgtacagaaacagagctgatt

SEQ ID NO: 919219 - DNA, 22 bp, Artificial Sequence
  chemically synthesized
ttagtgtacagaaacagagctg

SEQ ID NO: 919220 - DNA, 22 bp, Artificial Sequence
  chemically synthesized
tattaacaatcagctctgtttc

SEQ ID NO: 919221 - DNA, 22 bp, Artificial Sequence
  chemically synthesized
ttgttagtgtacagaaacagag

SEQ ID NO: 919222 - DNA, 22 bp, Artificial Sequence
  chemically synthesized
attgttagtgtacagaaacaga

SEQ ID NO: 919223 - DNA, 22 bp, Artificial Sequence
  chemically synthesized
acaatcagctctgtttctgtac

SEQ ID NO: 919224 - DNA, 22 bp, Artificial Sequence
  chemically synthesized
ggtagcttattgttagtgtaca

SEQ ID NO: 919225 - DNA, 22 bp, Artificial Sequence
  chemically synthesized
ttgggtagcttattgttagtgt

SEQ ID NO: 919226 - DNA, 22 bp, Artificial Sequence
  chemically synthesized
tgtttctgtacactaacaataa

SEQ ID NO: 919227 - DNA, 22 bp, Artificial Sequence
  chemically synthesized
ttattgggtagcttattgttag

SEQ ID NO: 919228 - DNA, 22 bp, Artificial Sequence
  chemically synthesized
attattgggtagcttattgtta

SEQ ID NO: 919229 - DNA, 22 bp, Artificial Sequence
  chemically synthesized
tttctgtacactaacaataagc

SEQ ID NO: 919230 - DNA, 22 bp, Artificial Sequence
  chemically synthesized
ctgtacactaacaataagctac

SEQ ID NO: 919231 - DNA, 22 bp, Artificial Sequence
  chemically synthesized
tgtacactaacaataagctacc

SEQ ID NO: 919232 - DNA, 22 bp, Artificial Sequence
  chemically synthesized
tacactaacaataagctaccca

SEQ ID NO: 919233 - DNA, 22 bp, Artificial Sequence
  chemically synthesized
acaataagctacccaataataa

SEQ ID NO: 919234 - DNA, 22 bp, Artificial Sequence
  chemically synthesized
cccaataataagcttttcttct

SEQ ID NO: 919235 - DNA, 22 bp, Artificial Sequence
  chemically synthesized
ttcttctattggattatcttgt

SEQ ID NO: 919236 - DNA, 22 bp, Artificial Sequence
  chemically synthesized
tcttctattggattatcttgtc

SEQ ID NO: 919237 - DNA, 22 bp, Artificial Sequence
  chemically synthesized
cttctattggattatcttgtca

SEQ ID NO: 919238 - DNA, 22 bp, Artificial Sequence
  chemically synthesized
ttctattggattatcttgtcac

SEQ ID NO: 919239 - DNA, 22 bp, Artificial Sequence
  chemically synthesized
ctattggattatcttgtcacct

SEQ ID NO: 919240 - DNA, 22 bp, Artificial Sequence
  chemically synthesized
tattggattatcttgtcacctt

SEQ ID NO: 919241 - DNA, 22 bp, Artificial Sequence
  chemically synthesized
ttggattatcttgtcacctttg

SEQ ID NO: 919242 - DNA, 22 bp, Artificial Sequence
  chemically synthesized
gattatcttgtcacctttgtca

SEQ ID NO: 919243 - DNA, 22 bp, Artificial Sequence
  chemically synthesized
tggtcaatcaatatatgacaaa

SEQ ID NO: 919244 - DNA, 22 bp, Artificial Sequence
  chemically synthesized
atggtcaatcaatatatgacaa

SEQ ID NO: 919245 - DNA, 22 bp, Artificial Sequence
  chemically synthesized
tcttgtcacctttgtcatatat

SEQ ID NO: 919246 - DNA, 22 bp, Artificial Sequence
  chemically synthesized
gtcacctttgtcatatattgat

SEQ ID NO: 919247 - DNA, 22 bp, Artificial Sequence
  chemically synthesized
tatttatggtcaatcaatatat

SEQ ID NO: 919248 - DNA, 22 bp, Artificial Sequence
  chemically synthesized
tcacctttgtcatatattgatt

SEQ ID NO: 919249 - DNA, 22 bp, Artificial Sequence
  chemically synthesized
atatttatggtcaatcaatata

SEQ ID NO: 919250 - DNA, 22 bp, Artificial Sequence
  chemically synthesized
ttatatttatggtcaatcaata

SEQ ID NO: 919251 - DNA, 22 bp, Artificial Sequence
  chemically synthesized
tgtcatatattgattgaccata

SEQ ID NO: 919252 - DNA, 22 bp, Artificial Sequence
  chemically synthesized
gtcatatattgattgaccataa

SEQ ID NO: 919253 - DNA, 22 bp, Artificial Sequence
  chemically synthesized
tcatatattgattgaccataaa

SEQ ID NO: 919254 - DNA, 22 bp, Artificial Sequence
  chemically synthesized
attgaccataaatataagagtt

SEQ ID NO: 919255 - DNA, 22 bp, Artificial Sequence
  chemically synthesized
gatagtccagcaataaactctt

SEQ ID NO: 919256 - DNA, 22 bp, Artificial Sequence
  chemically synthesized
accataaatataagagtttatt

SEQ ID NO: 919257 - DNA, 22 bp, Artificial Sequence
  chemically synthesized
acaatggaagagactcgatagt

SEQ ID NO: 919258 - DNA, 22 bp, Artificial Sequence
  chemically synthesized
attgctggactatcgagtctct

SEQ ID NO: 919259 - DNA, 22 bp, Artificial Sequence
  chemically synthesized
ttgctggactatcgagtctctt

SEQ ID NO: 919260 - DNA, 22 bp, Artificial Sequence
  chemically synthesized
atgttgacaatggaagagactc

SEQ ID NO: 919261 - DNA, 22 bp, Artificial Sequence
  chemically synthesized
ctggactatcgagtctcttcca

SEQ ID NO: 919262 - DNA, 22 bp, Artificial Sequence
  chemically synthesized
ctaatgttgacaatggaagaga

SEQ ID NO: 919263 - DNA, 22 bp, Artificial Sequence
  chemically synthesized
gactatcgagtctcttccattg

SEQ ID NO: 919264 - DNA, 22 bp, Artificial Sequence
  chemically synthesized
cactcctaatgttgacaatgga

SEQ ID NO: 919265 - DNA, 22 bp, Artificial Sequence
  chemically synthesized
tcgagtctcttccattgtcaac

SEQ ID NO: 919266 - DNA, 22 bp, Artificial Sequence
  chemically synthesized
actgcactcctaatgttgacaa

SEQ ID NO: 919267 - DNA, 22 bp, Artificial Sequence
  chemically synthesized
ctaactgcactcctaatgttga

SEQ ID NO: 919268 - DNA, 22 bp, Artificial Sequence
  chemically synthesized
ttccattgtcaacattaggagt

SEQ ID NO: 919269 - DNA, 22 bp, Artificial Sequence
  chemically synthesized
ccattgtcaacattaggagtgc

SEQ ID NO: 919270 - DNA, 22 bp, Artificial Sequence
  chemically synthesized
aatctactaactgcactcctaa

SEQ ID NO: 919271 - DNA, 22 bp, Artificial Sequence
  chemically synthesized
cattgtcaacattaggagtgca

SEQ ID NO: 919272 - DNA, 22 bp, Artificial Sequence
  chemically synthesized
aaatctactaactgcactccta

SEQ ID NO: 919273 - DNA, 22 bp, Artificial Sequence
  chemically synthesized
ttaaatctactaactgcactcc

SEQ ID NO: 919274 - DNA, 22 bp, Artificial Sequence
  chemically synthesized
cttaaatctactaactgcactc

SEQ ID NO: 919275 - DNA, 22 bp, Artificial Sequence
  chemically synthesized
tcttaaatctactaactgcact

SEQ ID NO: 919276 - DNA, 22 bp, Artificial Sequence
  chemically synthesized
tcaacattaggagtgcagttag

SEQ ID NO: 919277 - DNA, 22 bp, Artificial Sequence
  chemically synthesized
ttcttaaatctactaactgcac

SEQ ID NO: 919278 - DNA, 22 bp, Artificial Sequence
  chemically synthesized
tttcttaaatctactaactgca

SEQ ID NO: 919279 - DNA, 22 bp, Artificial Sequence
  chemically synthesized
ttttcttaaatctactaactgc

SEQ ID NO: 919280 - DNA, 22 bp, Artificial Sequence
  chemically synthesized
atatttttttcttaaatctact

SEQ ID NO: 919281 - DNA, 22 bp, Artificial Sequence
  chemically synthesized
ggagtgcagttagtagatttaa

SEQ ID NO: 919282 - DNA, 22 bp, Artificial Sequence
  chemically synthesized
ttcatatttttttcttaaatct

SEQ ID NO: 919283 - DNA, 22 bp, Artificial Sequence
  chemically synthesized
gtagatttaagaaaaaaatatg

SEQ ID NO: 919284 - DNA, 22 bp, Artificial Sequence
  chemically synthesized
ggaaacaaacctattcatattt

SEQ ID NO: 919285 - DNA, 22 bp, Artificial Sequence
  chemically synthesized
aggaaacaaacctattcatatt

SEQ ID NO: 919286 - DNA, 22 bp, Artificial Sequence
  chemically synthesized
aagaaaaaaatatgaataggtt

SEQ ID NO: 919287 - DNA, 22 bp, Artificial Sequence
  chemically synthesized
agaaaaaaatatgaataggttt

SEQ ID NO: 919288 - DNA, 22 bp, Artificial Sequence
  chemically synthesized
taggtttaggaaacaaacctat

SEQ ID NO: 919289 - DNA, 22 bp, Artificial Sequence
  chemically synthesized
tagatcacctgtaggtttagga

SEQ ID NO: 919290 - DNA, 22 bp, Artificial Sequence
  chemically synthesized
atagatcacctgtaggtttagg

SEQ ID NO: 919291 - DNA, 22 bp, Artificial Sequence
  chemically synthesized
gtttcctaaacctacaggtgat

SEQ ID NO: 919292 - DNA, 22 bp, Artificial Sequence
  chemically synthesized
tttcctaaacctacaggtgatc

SEQ ID NO: 919293 - DNA, 22 bp, Artificial Sequence
  chemically synthesized
cctaaacctacaggtgatctat

SEQ ID NO: 919294 - DNA, 22 bp, Artificial Sequence
  chemically synthesized
ctaaacctacaggtgatctata

SEQ ID NO: 919295 - DNA, 22 bp, Artificial Sequence
  chemically synthesized
aacctacaggtgatctataagc

SEQ ID NO: 919296 - DNA, 22 bp, Artificial Sequence
  chemically synthesized
tcataaggacaggcttatagat

SEQ ID NO: 919297 - DNA, 22 bp, Artificial Sequence
  chemically synthesized
caggtgatctataagcctgtcc

SEQ ID NO: 919298 - DNA, 22 bp, Artificial Sequence
  chemically synthesized
taagcctgtccttatgacagta

SEQ ID NO: 919299 - DNA, 22 bp, Artificial Sequence
  chemically synthesized
tccttatgacagtaccacactg

SEQ ID NO: 919300 - DNA, 22 bp, Artificial Sequence
  chemically synthesized
caatgatgaagacagtgtggta

SEQ ID NO: 919301 - DNA, 22 bp, Artificial Sequence
  chemically synthesized
atgacagtaccacactgtcttc

SEQ ID NO: 919302 - DNA, 22 bp, Artificial Sequence
  chemically synthesized
tgacagtaccacactgtcttca

SEQ ID NO: 919303 - DNA, 22 bp, Artificial Sequence
  chemically synthesized
atgtaaatctgcaatgatgaag

SEQ ID NO: 919304 - DNA, 22 bp, Artificial Sequence
  chemically synthesized
gatgtaaatctgcaatgatgaa

SEQ ID NO: 919305 - DNA, 22 bp, Artificial Sequence
  chemically synthesized
aaatcttgatgtaaatctgcaa

SEQ ID NO: 919306 - DNA, 22 bp, Artificial Sequence
  chemically synthesized
caaatcttgatgtaaatctgca

SEQ ID NO: 919307 - DNA, 22 bp, Artificial Sequence
  chemically synthesized
tcttcatcattgcagatttaca

SEQ ID NO: 919308 - DNA, 22 bp, Artificial Sequence
  chemically synthesized
atttcaaatcttgatgtaaatc

SEQ ID NO: 919309 - DNA, 22 bp, Artificial Sequence
  chemically synthesized
catcattgcagatttacatcaa

SEQ ID NO: 919310 - DNA, 22 bp, Artificial Sequence
  chemically synthesized
atcattgcagatttacatcaag

SEQ ID NO: 919311 - DNA, 22 bp, Artificial Sequence
  chemically synthesized
cctgatttcaaatcttgatgta

SEQ ID NO: 919312 - DNA, 22 bp, Artificial Sequence
  chemically synthesized
cagatttacatcaagatttgaa

SEQ ID NO: 919313 - DNA, 22 bp, Artificial Sequence
  chemically synthesized
acatcaagatttgaaatcaggt

SEQ ID NO: 919314 - DNA, 22 bp, Artificial Sequence
  chemically synthesized
catcaagatttgaaatcaggta

SEQ ID NO: 919315 - DNA, 22 bp, Artificial Sequence
  chemically synthesized
aaatcaggacattacctgattt

SEQ ID NO: 919316 - DNA, 22 bp, Artificial Sequence
  chemically synthesized
gaaatcaggacattacctgatt

SEQ ID NO: 919317 - DNA, 22 bp, Artificial Sequence
  chemically synthesized
tgaaatcaggacattacctgat

SEQ ID NO: 919318 - DNA, 22 bp, Artificial Sequence
  chemically synthesized
gaggactttgaaatcaggacat

SEQ ID NO: 919319 - DNA, 22 bp, Artificial Sequence
  chemically synthesized
gaaatcaggtaatgtcctgatt

SEQ ID NO: 919320 - DNA, 22 bp, Artificial Sequence
  chemically synthesized
aaatcaggtaatgtcctgattt

SEQ ID NO: 919321 - DNA, 22 bp, Artificial Sequence
  chemically synthesized
atttcaaagtcctctaactttt

SEQ ID NO: 919322 - DNA, 22 bp, Artificial Sequence
  chemically synthesized
tgaaaaagaagaaaaaagttag

SEQ ID NO: 919323 - DNA, 22 bp, Artificial Sequence
  chemically synthesized
caaagtcctctaacttttttct

SEQ ID NO: 919324 - DNA, 22 bp, Artificial Sequence
  chemically synthesized
aaagtcctctaacttttttctt

SEQ ID NO: 919325 - DNA, 22 bp, Artificial Sequence
  chemically synthesized
taacttttttcttctttttcac

SEQ ID NO: 919326 - DNA, 22 bp, Artificial Sequence
  chemically synthesized
acttttttcttctttttcacaa

SEQ ID NO: 919327 - DNA, 22 bp, Artificial Sequence
  chemically synthesized
ttttcttctttttcacaattgt

SEQ ID NO: 919328 - DNA, 22 bp, Artificial Sequence
  chemically synthesized
tttcttctttttcacaattgtt

SEQ ID NO: 919329 - DNA, 22 bp, Artificial Sequence
  chemically synthesized
ttcttctttttcacaattgttt

SEQ ID NO: 919330 - DNA, 22 bp, Artificial Sequence
  chemically synthesized
tcttctttttcacaattgtttt

SEQ ID NO: 919331 - DNA, 22 bp, Artificial Sequence
  chemically synthesized
cttctttttcacaattgttttg

SEQ ID NO: 919332 - DNA, 22 bp, Artificial Sequence
  chemically synthesized
ttctttttcacaattgttttgg

SEQ ID NO: 919333 - DNA, 22 bp, Artificial Sequence
  chemically synthesized
ctttttcacaattgttttggct

SEQ ID NO: 919334 - DNA, 22 bp, Artificial Sequence
  chemically synthesized
tttttcacaattgttttggcta

SEQ ID NO: 919335 - DNA, 22 bp, Artificial Sequence
  chemically synthesized
aaatgtaccaaatagccaaaac

SEQ ID NO: 919336 - DNA, 22 bp, Artificial Sequence
  chemically synthesized
tttcacaattgttttggctatt

SEQ ID NO: 919337 - DNA, 22 bp, Artificial Sequence
  chemically synthesized
ttcacaattgttttggctattt

SEQ ID NO: 919338 - DNA, 22 bp, Artificial Sequence
  chemically synthesized
tcacaattgttttggctatttg

SEQ ID NO: 919339 - DNA, 22 bp, Artificial Sequence
  chemically synthesized
cacaattgttttggctatttgg

SEQ ID NO: 919340 - DNA, 22 bp, Artificial Sequence
  chemically synthesized
acaattgttttggctatttggt

SEQ ID NO: 919341 - DNA, 22 bp, Artificial Sequence
  chemically synthesized
ttttggctatttggtacatttg

SEQ ID NO: 919342 - DNA, 22 bp, Artificial Sequence
  chemically synthesized
tatatagcaattcaaatgtacc

SEQ ID NO: 919343 - DNA, 22 bp, Artificial Sequence
  chemically synthesized
atatatagcaattcaaatgtac

SEQ ID NO: 919344 - DNA, 22 bp, Artificial Sequence
  chemically synthesized
tggctatttggtacatttgaat

SEQ ID NO: 919345 - DNA, 22 bp, Artificial Sequence
  chemically synthesized
ggctatttggtacatttgaatt

SEQ ID NO: 919346 - DNA, 22 bp, Artificial Sequence
  chemically synthesized
gctatttggtacatttgaattg

SEQ ID NO: 919347 - DNA, 22 bp, Artificial Sequence
  chemically synthesized
tttggtacatttgaattgctat

SEQ ID NO: 919348 - DNA, 22 bp, Artificial Sequence
  chemically synthesized
ggtacatttgaattgctatata

SEQ ID NO: 919349 - DNA, 22 bp, Artificial Sequence
  chemically synthesized
gtacatttgaattgctatatat

SEQ ID NO: 919350 - DNA, 22 bp, Artificial Sequence
  chemically synthesized
atcccacaatttatatatagca

SEQ ID NO: 919351 - DNA, 22 bp, Artificial Sequence
  chemically synthesized
gaattgctatatataaattgtg

SEQ ID NO: 919352 - DNA, 22 bp, Artificial Sequence
  chemically synthesized
aaaaattgatcccacaatttat

SEQ ID NO: 919353 - DNA, 22 bp, Artificial Sequence
  chemically synthesized
aattgctatatataaattgtgg

SEQ ID NO: 919354 - DNA, 22 bp, Artificial Sequence
  chemically synthesized
ctatatataaattgtgggatca

SEQ ID NO: 919355 - DNA, 22 bp, Artificial Sequence
  chemically synthesized
tatataaattgtgggatcaatt

SEQ ID NO: 919356 - DNA, 22 bp, Artificial Sequence
  chemically synthesized
gcacaaattgaaaaattgatcc

SEQ ID NO: 919357 - DNA, 22 bp, Artificial Sequence
  chemically synthesized
ggcacaaattgaaaaattgatc

SEQ ID NO: 919358 - DNA, 22 bp, Artificial Sequence
  chemically synthesized
tgggatcaatttttcaatttgt

SEQ ID NO: 919359 - DNA, 22 bp, Artificial Sequence
  chemically synthesized
cacaatcttggcacaaattgaa

SEQ ID NO: 919360 - DNA, 22 bp, Artificial Sequence
  chemically synthesized
aaaaattgcacaatcttggcac

SEQ ID NO: 919361 - DNA, 22 bp, Artificial Sequence
  chemically synthesized
ttcaatttgtgccaagattgtg

SEQ ID NO: 919362 - DNA, 22 bp, Artificial Sequence
  chemically synthesized
tcaatttgtgccaagattgtgc

SEQ ID NO: 919363 - DNA, 22 bp, Artificial Sequence
  chemically synthesized
caatttgtgccaagattgtgca

SEQ ID NO: 919364 - DNA, 22 bp, Artificial Sequence
  chemically synthesized
aatttgtgccaagattgtgcaa

SEQ ID NO: 919365 - DNA, 22 bp, Artificial Sequence
  chemically synthesized
gcacaaattgaaaaattgcaca

SEQ ID NO: 919366 - DNA, 22 bp, Artificial Sequence
  chemically synthesized
gtgccaagattgtgcaattttt

SEQ ID NO: 919367 - DNA, 22 bp, Artificial Sequence
  chemically synthesized
tgccaagattgtgcaatttttc

SEQ ID NO: 919368 - DNA, 22 bp, Artificial Sequence
  chemically synthesized
gcagatgttggcacaaattgaa

SEQ ID NO: 919369 - DNA, 22 bp, Artificial Sequence
  chemically synthesized
agcagatgttggcacaaattga

SEQ ID NO: 919370 - DNA, 22 bp, Artificial Sequence
  chemically synthesized
tgcaatttttcaatttgtgcca

SEQ ID NO: 919371 - DNA, 22 bp, Artificial Sequence
  chemically synthesized
ttcaatttgtgccaacatctgc

SEQ ID NO: 919372 - DNA, 22 bp, Artificial Sequence
  chemically synthesized
tcaatttgtgccaacatctgct

SEQ ID NO: 919373 - DNA, 22 bp, Artificial Sequence
  chemically synthesized
catcgacatcttagcagatgtt

SEQ ID NO: 919374 - DNA, 22 bp, Artificial Sequence
  chemically synthesized
caatttgtgccaacatctgcta

SEQ ID NO: 919375 - DNA, 22 bp, Artificial Sequence
  chemically synthesized
aatttgtgccaacatctgctaa

SEQ ID NO: 919376 - DNA, 22 bp, Artificial Sequence
  chemically synthesized
gtgccaacatctgctaagatgt

SEQ ID NO: 919377 - DNA, 22 bp, Artificial Sequence
  chemically synthesized
tgccaacatctgctaagatgtc

SEQ ID NO: 919378 - DNA, 22 bp, Artificial Sequence
  chemically synthesized
atgcaatctccatcgacatctt

SEQ ID NO: 919379 - DNA, 22 bp, Artificial Sequence
  chemically synthesized
aatgcaatctccatcgacatct

SEQ ID NO: 919380 - DNA, 22 bp, Artificial Sequence
  chemically synthesized
tagatttaatgcaatctccatc

SEQ ID NO: 919381 - DNA, 22 bp, Artificial Sequence
  chemically synthesized
ctaagatgtcgatggagattgc

SEQ ID NO: 919382 - DNA, 22 bp, Artificial Sequence
  chemically synthesized
tatagatttaatgcaatctcca

SEQ ID NO: 919383 - DNA, 22 bp, Artificial Sequence
  chemically synthesized
agatgtcgatggagattgcatt

SEQ ID NO: 919384 - DNA, 22 bp, Artificial Sequence
  chemically synthesized
ttctatagatttaatgcaatct

SEQ ID NO: 919385 - DNA, 22 bp, Artificial Sequence
  chemically synthesized
gttctatagatttaatgcaatc

SEQ ID NO: 919386 - DNA, 22 bp, Artificial Sequence
  chemically synthesized
cccaacttgttctatagattta

SEQ ID NO: 919387 - DNA, 22 bp, Artificial Sequence
  chemically synthesized
tccccaacttgttctatagatt

SEQ ID NO: 919388 - DNA, 22 bp, Artificial Sequence
  chemically synthesized
cattaaatctatagaacaagtt

SEQ ID NO: 919389 - DNA, 22 bp, Artificial Sequence
  chemically synthesized
aatctatagaacaagttgggga

SEQ ID NO: 919390 - DNA, 22 bp, Artificial Sequence
  chemically synthesized
ataaggtagtgattctccccaa

SEQ ID NO: 919391 - DNA, 22 bp, Artificial Sequence
  chemically synthesized
tagaacaagttggggagaatca

SEQ ID NO: 919392 - DNA, 22 bp, Artificial Sequence
  chemically synthesized
aatactgataaggtagtgattc

SEQ ID NO: 919393 - DNA, 22 bp, Artificial Sequence
  chemically synthesized
gggagaatcactaccttatcag

SEQ ID NO: 919394 - DNA, 22 bp, Artificial Sequence
  chemically synthesized
gaagactcaatactgataaggt

SEQ ID NO: 919395 - DNA, 22 bp, Artificial Sequence
  chemically synthesized
atgaattggaagactcaatact

SEQ ID NO: 919396 - DNA, 22 bp, Artificial Sequence
  chemically synthesized
ccttatcagtattgagtcttcc

SEQ ID NO: 919397 - DNA, 22 bp, Artificial Sequence
  chemically synthesized
catgttcatgaattggaagact

SEQ ID NO: 919398 - DNA, 22 bp, Artificial Sequence
  chemically synthesized
atcagtattgagtcttccaatt

SEQ ID NO: 919399 - DNA, 22 bp, Artificial Sequence
  chemically synthesized
tcagtattgagtcttccaattc

SEQ ID NO: 919400 - DNA, 22 bp, Artificial Sequence
  chemically synthesized
agtcttccaattcatgaacatg

SEQ ID NO: 919401 - DNA, 22 bp, Artificial Sequence
  chemically synthesized
ccaattcatgaacatggaatat

SEQ ID NO: 919402 - DNA, 22 bp, Artificial Sequence
  chemically synthesized
caattcatgaacatggaatatg

SEQ ID NO: 919403 - DNA, 22 bp, Artificial Sequence
  chemically synthesized
aataaatgggaccatattccat

SEQ ID NO: 919404 - DNA, 22 bp, Artificial Sequence
  chemically synthesized
atgaacatggaatatggtccca

SEQ ID NO: 919405 - DNA, 22 bp, Artificial Sequence
  chemically synthesized
aaaatctaaataaatgggacca

SEQ ID NO: 919406 - DNA, 22 bp, Artificial Sequence
  chemically synthesized
agagaaattaaaaatctaaata

SEQ ID NO: 919407 - DNA, 22 bp, Artificial Sequence
  chemically synthesized
ctgagagaaattaaaaatctaa

SEQ ID NO: 919408 - DNA, 22 bp, Artificial Sequence
  chemically synthesized
atttagatttttaatttctctc

SEQ ID NO: 919409 - DNA, 22 bp, Artificial Sequence
  chemically synthesized
taatacattgctgagagaaatt

SEQ ID NO: 919410 - DNA, 22 bp, Artificial Sequence
  chemically synthesized
tttagatttttaatttctctca

SEQ ID NO: 919411 - DNA, 22 bp, Artificial Sequence
  chemically synthesized
agatttttaatttctctcagca

SEQ ID NO: 919412 - DNA, 22 bp, Artificial Sequence
  chemically synthesized
gatttttaatttctctcagcaa

SEQ ID NO: 919413 - DNA, 22 bp, Artificial Sequence
  chemically synthesized
aaaactgtaatacattgctgag

SEQ ID NO: 919414 - DNA, 22 bp, Artificial Sequence
  chemically synthesized
tgaaaactgtaatacattgctg

SEQ ID NO: 919415 - DNA, 22 bp, Artificial Sequence
  chemically synthesized
ttaatttctctcagcaatgtat

SEQ ID NO: 919416 - DNA, 22 bp, Artificial Sequence
  chemically synthesized
taatttctctcagcaatgtatt

SEQ ID NO: 919417 - DNA, 22 bp, Artificial Sequence
  chemically synthesized
aatttctctcagcaatgtatta

SEQ ID NO: 919418 - DNA, 22 bp, Artificial Sequence
  chemically synthesized
atttctctcagcaatgtattac

SEQ ID NO: 919419 - DNA, 22 bp, Artificial Sequence
  chemically synthesized
tactctgaaaactgtaatacat

SEQ ID NO: 919420 - DNA, 22 bp, Artificial Sequence
  chemically synthesized
ctctcagcaatgtattacagtt

SEQ ID NO: 919421 - DNA, 22 bp, Artificial Sequence
  chemically synthesized
tctcagcaatgtattacagttt

SEQ ID NO: 919422 - DNA, 22 bp, Artificial Sequence
  chemically synthesized
tcagcaatgtattacagttttc

SEQ ID NO: 919423 - DNA, 22 bp, Artificial Sequence
  chemically synthesized
aacctgtactctgaaaactgta

SEQ ID NO: 919424 - DNA, 22 bp, Artificial Sequence
  chemically synthesized
agcaatgtattacagttttcag

SEQ ID NO: 919425 - DNA, 22 bp, Artificial Sequence
  chemically synthesized
cagttttcagagtacaggttta

SEQ ID NO: 919426 - DNA, 22 bp, Artificial Sequence
  chemically synthesized
aaaatataagtactaaacctgt

SEQ ID NO: 919427 - DNA, 22 bp, Artificial Sequence
  chemically synthesized
gaaaatataagtactaaacctg

SEQ ID NO: 919428 - DNA, 22 bp, Artificial Sequence
  chemically synthesized
tcagagtacaggtttagtactt

SEQ ID NO: 919429 - DNA, 22 bp, Artificial Sequence
  chemically synthesized
cagagtacaggtttagtactta

SEQ ID NO: 919430 - DNA, 22 bp, Artificial Sequence
  chemically synthesized
agagtacaggtttagtacttat

SEQ ID NO: 919431 - DNA, 22 bp, Artificial Sequence
  chemically synthesized
aatggtcataaatttgaaaata

SEQ ID NO: 919432 - DNA, 22 bp, Artificial Sequence
  chemically synthesized
agtacttatattttcaaattta

SEQ ID NO: 919433 - DNA, 22 bp, Artificial Sequence
  chemically synthesized
gtacttatattttcaaatttat

SEQ ID NO: 919434 - DNA, 22 bp, Artificial Sequence
  chemically synthesized
atattttcaaatttatgaccat

SEQ ID NO: 919435 - DNA, 22 bp, Artificial Sequence
  chemically synthesized
tattttcaaatttatgaccatt

SEQ ID NO: 919436 - DNA, 22 bp, Artificial Sequence
  chemically synthesized
tcaaatttatgaccatttaatc

SEQ ID NO: 919437 - DNA, 22 bp, Artificial Sequence
  chemically synthesized
tagcataaaatagattaaatgg

SEQ ID NO: 919438 - DNA, 22 bp, Artificial Sequence
  chemically synthesized
caaatttatgaccatttaatct

SEQ ID NO: 919439 - DNA, 22 bp, Artificial Sequence
  chemically synthesized
gtagcataaaatagattaaatg

SEQ ID NO: 919440 - DNA, 22 bp, Artificial Sequence
  chemically synthesized
aaatttatgaccatttaatcta

SEQ ID NO: 919441 - DNA, 22 bp, Artificial Sequence
  chemically synthesized
tgtagcataaaatagattaaat

SEQ ID NO: 919442 - DNA, 22 bp, Artificial Sequence
  chemically synthesized
tttgtagcataaaatagattaa

SEQ ID NO: 919443 - DNA, 22 bp, Artificial Sequence
  chemically synthesized
atgaccatttaatctattttat

SEQ ID NO: 919444 - DNA, 22 bp, Artificial Sequence
  chemically synthesized
attctttgtagcataaaataga

SEQ ID NO: 919445 - DNA, 22 bp, Artificial Sequence
  chemically synthesized
tgaccatttaatctattttatg

SEQ ID NO: 919446 - DNA, 22 bp, Artificial Sequence
  chemically synthesized
cattctttgtagcataaaatag

SEQ ID NO: 919447 - DNA, 22 bp, Artificial Sequence
  chemically synthesized
aatctattttatgctacaaaga

SEQ ID NO: 919448 - DNA, 22 bp, Artificial Sequence
  chemically synthesized
atctattttatgctacaaagaa

SEQ ID NO: 919449 - DNA, 22 bp, Artificial Sequence
  chemically synthesized
agaaaataatttcattctttgt

SEQ ID NO: 919450 - DNA, 22 bp, Artificial Sequence
  chemically synthesized
ttttatgctacaaagaatgaaa

SEQ ID NO: 919451 - DNA, 22 bp, Artificial Sequence
  chemically synthesized
tatgctacaaagaatgaaatta

SEQ ID NO: 919452 - DNA, 22 bp, Artificial Sequence
  chemically synthesized
atgctacaaagaatgaaattat

SEQ ID NO: 919453 - DNA, 22 bp, Artificial Sequence
  chemically synthesized
tgctacaaagaatgaaattatt

SEQ ID NO: 919454 - DNA, 22 bp, Artificial Sequence
  chemically synthesized
aaaatgatactaagaaaataat

SEQ ID NO: 919455 - DNA, 22 bp, Artificial Sequence
  chemically synthesized
caaagaatgaaattattttctt

SEQ ID NO: 919456 - DNA, 22 bp, Artificial Sequence
  chemically synthesized
gcaataaaaaattgaaaatgat

SEQ ID NO: 919457 - DNA, 22 bp, Artificial Sequence
  chemically synthesized
ttttcttagtatcattttcaat

SEQ ID NO: 919458 - DNA, 22 bp, Artificial Sequence
  chemically synthesized
tcttagtatcattttcaatttt

SEQ ID NO: 919459 - DNA, 22 bp, Artificial Sequence
  chemically synthesized
cttagtatcattttcaattttt

SEQ ID NO: 919460 - DNA, 22 bp, Artificial Sequence
  chemically synthesized
ttagtatcattttcaatttttt

SEQ ID NO: 919461 - DNA, 22 bp, Artificial Sequence
  chemically synthesized
tgtactagcaataaaaaattga

SEQ ID NO: 919462 - DNA, 22 bp, Artificial Sequence
  chemically synthesized
agtatcattttcaattttttat

SEQ ID NO: 919463 - DNA, 22 bp, Artificial Sequence
  chemically synthesized
gtatcattttcaattttttatt

SEQ ID NO: 919464 - DNA, 22 bp, Artificial Sequence
  chemically synthesized
ctgtgtactagcaataaaaaat

SEQ ID NO: 919465 - DNA, 22 bp, Artificial Sequence
  chemically synthesized
cattcctgtgtactagcaataa

SEQ ID NO: 919466 - DNA, 22 bp, Artificial Sequence
  chemically synthesized
tcaattttttattgctagtaca

SEQ ID NO: 919467 - DNA, 22 bp, Artificial Sequence
  chemically synthesized
caattttttattgctagtacac

SEQ ID NO: 919468 - DNA, 22 bp, Artificial Sequence
  chemically synthesized
aattttttattgctagtacaca

SEQ ID NO: 919469 - DNA, 22 bp, Artificial Sequence
  chemically synthesized
tttattgctagtacacaggaat

SEQ ID NO: 919470 - DNA, 22 bp, Artificial Sequence
  chemically synthesized
ttattgctagtacacaggaatg

SEQ ID NO: 919471 - DNA, 22 bp, Artificial Sequence
  chemically synthesized
tattgctagtacacaggaatgt

SEQ ID NO: 919472 - DNA, 22 bp, Artificial Sequence
  chemically synthesized
attgctagtacacaggaatgta

SEQ ID NO: 919473 - DNA, 22 bp, Artificial Sequence
  chemically synthesized
ttgctagtacacaggaatgtaa

SEQ ID NO: 919474 - DNA, 22 bp, Artificial Sequence
  chemically synthesized
ctagtacacaggaatgtaattt

SEQ ID NO: 919475 - DNA, 22 bp, Artificial Sequence
  chemically synthesized
gtacacaggaatgtaatttatt

SEQ ID NO: 919476 - DNA, 22 bp, Artificial Sequence
  chemically synthesized
caagataatcaatatacaagaa

SEQ ID NO: 919477 - DNA, 22 bp, Artificial Sequence
  chemically synthesized
gcaagataatcaatatacaaga

SEQ ID NO: 919478 - DNA, 22 bp, Artificial Sequence
  chemically synthesized
atgaagcttgcaagataatcaa

SEQ ID NO: 919479 - DNA, 22 bp, Artificial Sequence
  chemically synthesized
attcttgtatattgattatctt

SEQ ID NO: 919480 - DNA, 22 bp, Artificial Sequence
  chemically synthesized
ttcttgtatattgattatcttg

SEQ ID NO: 919481 - DNA, 22 bp, Artificial Sequence
  chemically synthesized
ttgtatattgattatcttgcaa

SEQ ID NO: 919482 - DNA, 22 bp, Artificial Sequence
  chemically synthesized
gtatattgattatcttgcaagc

SEQ ID NO: 919483 - DNA, 22 bp, Artificial Sequence
  chemically synthesized
tatattgattatcttgcaagct

SEQ ID NO: 919484 - DNA, 22 bp, Artificial Sequence
  chemically synthesized
ataagttcatgaagcttgcaag

SEQ ID NO: 919485 - DNA, 22 bp, Artificial Sequence
  chemically synthesized
gatctgataagttcatgaagct

SEQ ID NO: 919486 - DNA, 22 bp, Artificial Sequence
  chemically synthesized
attatcttgcaagcttcatgaa

SEQ ID NO: 919487 - DNA, 22 bp, Artificial Sequence
  chemically synthesized
ctagatctgataagttcatgaa

SEQ ID NO: 919488 - DNA, 22 bp, Artificial Sequence
  chemically synthesized
tcttgcaagcttcatgaactta

SEQ ID NO: 919489 - DNA, 22 bp, Artificial Sequence
  chemically synthesized
gcaagcttcatgaacttatcag

SEQ ID NO: 919490 - DNA, 22 bp, Artificial Sequence
  chemically synthesized
caagcttcatgaacttatcaga

SEQ ID NO: 919491 - DNA, 22 bp, Artificial Sequence
  chemically synthesized
catgaacttatcagatctagca

SEQ ID NO: 919492 - DNA, 22 bp, Artificial Sequence
  chemically synthesized
atgaacttatcagatctagcag

SEQ ID NO: 919493 - DNA, 22 bp, Artificial Sequence
  chemically synthesized
atatccacaaaataactgctag

SEQ ID NO: 919494 - DNA, 22 bp, Artificial Sequence
  chemically synthesized
atcagatctagcagttattttg

SEQ ID NO: 919495 - DNA, 22 bp, Artificial Sequence
  chemically synthesized
tcagatctagcagttattttgt

SEQ ID NO: 919496 - DNA, 22 bp, Artificial Sequence
  chemically synthesized
gcagttattttgtggatatcag

SEQ ID NO: 919497 - DNA, 22 bp, Artificial Sequence
  chemically synthesized
tatgtagaaaaatctgatatcc

SEQ ID NO: 919498 - DNA, 22 bp, Artificial Sequence
  chemically synthesized
ttttgtggatatcagatttttc

SEQ ID NO: 919499 - DNA, 22 bp, Artificial Sequence
  chemically synthesized
tgtggatatcagatttttctac

SEQ ID NO: 919500 - DNA, 22 bp, Artificial Sequence
  chemically synthesized
gtggatatcagatttttctaca

SEQ ID NO: 919501 - DNA, 22 bp, Artificial Sequence
  chemically synthesized
tggatatcagatttttctacat

SEQ ID NO: 919502 - DNA, 22 bp, Artificial Sequence
  chemically synthesized
acagacaatacaatcctgtatg

SEQ ID NO: 919503 - DNA, 22 bp, Artificial Sequence
  chemically synthesized
ttcacagacaatacaatcctgt

SEQ ID NO: 919504 - DNA, 22 bp, Artificial Sequence
  chemically synthesized
attcacagacaatacaatcctg

SEQ ID NO: 919505 - DNA, 22 bp, Artificial Sequence
  chemically synthesized
tattcacagacaatacaatcct

SEQ ID NO: 919506 - DNA, 22 bp, Artificial Sequence
  chemically synthesized
ttctacatacaggattgtattg

SEQ ID NO: 919507 - DNA, 22 bp, Artificial Sequence
  chemically synthesized
tttattcacagacaatacaatc

SEQ ID NO: 919508 - DNA, 22 bp, Artificial Sequence
  chemically synthesized
tctacatacaggattgtattgt

SEQ ID NO: 919509 - DNA, 22 bp, Artificial Sequence
  chemically synthesized
ctacatacaggattgtattgtc

SEQ ID NO: 919510 - DNA, 22 bp, Artificial Sequence
  chemically synthesized
tctttattcacagacaatacaa

SEQ ID NO: 919511 - DNA, 22 bp, Artificial Sequence
  chemically synthesized
tacatacaggattgtattgtct

SEQ ID NO: 919512 - DNA, 22 bp, Artificial Sequence
  chemically synthesized
catacaggattgtattgtctgt

SEQ ID NO: 919513 - DNA, 22 bp, Artificial Sequence
  chemically synthesized
tattgtctgtgaataaagagag

SEQ ID NO: 919514 - DNA, 22 bp, Artificial Sequence
  chemically synthesized
tctgtgaataaagagagtttca

SEQ ID NO: 919515 - DNA, 22 bp, Artificial Sequence
  chemically synthesized
tgaataaagagagtttcatttc

SEQ ID NO: 919516 - DNA, 22 bp, Artificial Sequence
  chemically synthesized
catttcttcttctatactgtgg

SEQ ID NO: 919517 - DNA, 22 bp, Artificial Sequence
  chemically synthesized
atttcttcttctatactgtgga

SEQ ID NO: 919518 - DNA, 22 bp, Artificial Sequence
  chemically synthesized
cttcttctatactgtggatgcc

SEQ ID NO: 919519 - DNA, 22 bp, Artificial Sequence
  chemically synthesized
ttcttctatactgtggatgcct

SEQ ID NO: 919520 - DNA, 22 bp, Artificial Sequence
  chemically synthesized
cttctatactgtggatgcctcg

SEQ ID NO: 919521 - DNA, 22 bp, Artificial Sequence
  chemically synthesized
ttctatactgtggatgcctcgg

SEQ ID NO: 919522 - DNA, 22 bp, Artificial Sequence
  chemically synthesized
ctatactgtggatgcctcggat

SEQ ID NO: 919523 - DNA, 22 bp, Artificial Sequence
  chemically synthesized
tatactgtggatgcctcggatt

SEQ ID NO: 919524 - DNA, 22 bp, Artificial Sequence
  chemically synthesized
tactgtggatgcctcggattcc

SEQ ID NO: 919525 - DNA, 22 bp, Artificial Sequence
  chemically synthesized
tggatgcctcggattcctatct

SEQ ID NO: 919526 - DNA, 22 bp, Artificial Sequence
  chemically synthesized
ggattcctatctttctcctgga

SEQ ID NO: 919527 - DNA, 22 bp, Artificial Sequence
  chemically synthesized
caacaaaaaaacccaggtccag

SEQ ID NO: 919528 - DNA, 22 bp, Artificial Sequence
  chemically synthesized
ctatctttctcctggacctggg

SEQ ID NO: 919529 - DNA, 22 bp, Artificial Sequence
  chemically synthesized
ccaacaaaaaaacccaggtcca

SEQ ID NO: 919530 - DNA, 22 bp, Artificial Sequence
  chemically synthesized
tccaacaaaaaaacccaggtcc

SEQ ID NO: 919531 - DNA, 22 bp, Artificial Sequence
  chemically synthesized
tctttctcctggacctgggttt

SEQ ID NO: 919532 - DNA, 22 bp, Artificial Sequence
  chemically synthesized
tctcctggacctgggttttttt

SEQ ID NO: 919533 - DNA, 22 bp, Artificial Sequence
  chemically synthesized
aaattttccaacaaaaaaaccc

SEQ ID NO: 919534 - DNA, 22 bp, Artificial Sequence
  chemically synthesized
ctcctggacctgggtttttttg

SEQ ID NO: 919535 - DNA, 22 bp, Artificial Sequence
  chemically synthesized
aaaattttccaacaaaaaaacc

SEQ ID NO: 919536 - DNA, 22 bp, Artificial Sequence
  chemically synthesized
tcctggacctgggtttttttgt

SEQ ID NO: 919537 - DNA, 22 bp, Artificial Sequence
  chemically synthesized
ctggacctgggtttttttgttg

SEQ ID NO: 919538 - DNA, 22 bp, Artificial Sequence
  chemically synthesized
gacctgggtttttttgttggaa

SEQ ID NO: 919539 - DNA, 22 bp, Artificial Sequence
  chemically synthesized
gtaatttaaaattttccaacaa

SEQ ID NO: 919540 - DNA, 22 bp, Artificial Sequence
  chemically synthesized
ggtttttttgttggaaaatttt

SEQ ID NO: 919541 - DNA, 22 bp, Artificial Sequence
  chemically synthesized
aattagtaatttaaaattttcc

SEQ ID NO: 919542 - DNA, 22 bp, Artificial Sequence
  chemically synthesized
ttttgttggaaaattttaaatt

SEQ ID NO: 919543 - DNA, 22 bp, Artificial Sequence
  chemically synthesized
tttgttggaaaattttaaatta

SEQ ID NO: 919544 - DNA, 22 bp, Artificial Sequence
  chemically synthesized
ttgttggaaaattttaaattac

SEQ ID NO: 919545 - DNA, 22 bp, Artificial Sequence
  chemically synthesized
tgttggaaaattttaaattact

SEQ ID NO: 919546 - DNA, 22 bp, Artificial Sequence
  chemically synthesized
gttggaaaattttaaattacta

SEQ ID NO: 919547 - DNA, 22 bp, Artificial Sequence
  chemically synthesized
ttggaaaattttaaattactaa

SEQ ID NO: 919548 - DNA, 22 bp, Artificial Sequence
  chemically synthesized
gaaaattttaaattactaattc

SEQ ID NO: 919549 - DNA, 22 bp, Artificial Sequence
  chemically synthesized
acacaaacacagaaactgaatt

SEQ ID NO: 919550 - DNA, 22 bp, Artificial Sequence
  chemically synthesized
taaattactaattcagtttctg

SEQ ID NO: 919551 - DNA, 22 bp, Artificial Sequence
  chemically synthesized
aaattactaattcagtttctgt

SEQ ID NO: 919552 - DNA, 22 bp, Artificial Sequence
  chemically synthesized
aattactaattcagtttctgtg

SEQ ID NO: 919553 - DNA, 22 bp, Artificial Sequence
  chemically synthesized
ctaattcagtttctgtgtttgt

SEQ ID NO: 919554 - DNA, 22 bp, Artificial Sequence
  chemically synthesized
attcagtttctgtgtttgtgtt

SEQ ID NO: 919555 - DNA, 22 bp, Artificial Sequence
  chemically synthesized
agtttctgtgtttgtgttaggt

SEQ ID NO: 919556 - DNA, 22 bp, Artificial Sequence
  chemically synthesized
ctgtgtttgtgttaggtctatt

SEQ ID NO: 919557 - DNA, 22 bp, Artificial Sequence
  chemically synthesized
tgtgtttgtgttaggtctattc

SEQ ID NO: 919558 - DNA, 22 bp, Artificial Sequence
  chemically synthesized
tgtttgtgttaggtctattcat

SEQ ID NO: 919559 - DNA, 22 bp, Artificial Sequence
  chemically synthesized
gtgttaggtctattcatatgtc

SEQ ID NO: 919560 - DNA, 22 bp, Artificial Sequence
  chemically synthesized
aagaaaaaaatagacatatgaa

SEQ ID NO: 919561 - DNA, 22 bp, Artificial Sequence
  chemically synthesized
tgttaggtctattcatatgtct

SEQ ID NO: 919562 - DNA, 22 bp, Artificial Sequence
  chemically synthesized
attcaagaaaaaaatagacata

SEQ ID NO: 919563 - DNA, 22 bp, Artificial Sequence
  chemically synthesized
ggtctattcatatgtctatttt

SEQ ID NO: 919564 - DNA, 22 bp, Artificial Sequence
  chemically synthesized
ttcatatgtctatttttttctt

SEQ ID NO: 919565 - DNA, 22 bp, Artificial Sequence
  chemically synthesized
acaaaactgattcaagaaaaaa

SEQ ID NO: 919566 - DNA, 22 bp, Artificial Sequence
  chemically synthesized
atatgtctatttttttcttgaa

SEQ ID NO: 919567 - DNA, 22 bp, Artificial Sequence
  chemically synthesized
tttttttcttgaatcagttttg

SEQ ID NO: 919568 - DNA, 22 bp, Artificial Sequence
  chemically synthesized
ttttcttgaatcagttttgtta

SEQ ID NO: 919569 - DNA, 22 bp, Artificial Sequence
  chemically synthesized
tttcttgaatcagttttgttaa

SEQ ID NO: 919570 - DNA, 22 bp, Artificial Sequence
  chemically synthesized
gaaagacataaattaacaaaac

SEQ ID NO: 919571 - DNA, 22 bp, Artificial Sequence
  chemically synthesized
ttcttgaatcagttttgttaat

SEQ ID NO: 919572 - DNA, 22 bp, Artificial Sequence
  chemically synthesized
agaaagacataaattaacaaaa

SEQ ID NO: 919573 - DNA, 22 bp, Artificial Sequence
  chemically synthesized
tcttgaatcagttttgttaatt

SEQ ID NO: 919574 - DNA, 22 bp, Artificial Sequence
  chemically synthesized
cttgaatcagttttgttaattt

SEQ ID NO: 919575 - DNA, 22 bp, Artificial Sequence
  chemically synthesized
ttagaaagacataaattaacaa

SEQ ID NO: 919576 - DNA, 22 bp, Artificial Sequence
  chemically synthesized
ttgaatcagttttgttaattta

SEQ ID NO: 919577 - DNA, 22 bp, Artificial Sequence
  chemically synthesized
gaatcagttttgttaatttatg

SEQ ID NO: 919578 - DNA, 22 bp, Artificial Sequence
  chemically synthesized
aatcagttttgttaatttatgt

SEQ ID NO: 919579 - DNA, 22 bp, Artificial Sequence
  chemically synthesized
tgttaatttatgtctttctaag

SEQ ID NO: 919580 - DNA, 22 bp, Artificial Sequence
  chemically synthesized
aatgaaaaaattcttagaaaga

SEQ ID NO: 919581 - DNA, 22 bp, Artificial Sequence
  chemically synthesized
gttaatttatgtctttctaaga

SEQ ID NO: 919582 - DNA, 22 bp, Artificial Sequence
  chemically synthesized
ttaatttatgtctttctaagaa

SEQ ID NO: 919583 - DNA, 22 bp, Artificial Sequence
  chemically synthesized
atttatgtctttctaagaattt

SEQ ID NO: 919584 - DNA, 22 bp, Artificial Sequence
  chemically synthesized
atgtctttctaagaattttttc

SEQ ID NO: 919585 - DNA, 22 bp, Artificial Sequence
  chemically synthesized
tgtctttctaagaattttttca

SEQ ID NO: 919586 - DNA, 22 bp, Artificial Sequence
  chemically synthesized
caaaacatattaaatgaaaaaa

SEQ ID NO: 919587 - DNA, 22 bp, Artificial Sequence
  chemically synthesized
tgcaaaacatattaaatgaaaa

SEQ ID NO: 919588 - DNA, 22 bp, Artificial Sequence
  chemically synthesized
ctgcaaaacatattaaatgaaa

SEQ ID NO: 919589 - DNA, 22 bp, Artificial Sequence
  chemically synthesized
tctaagaattttttcatttaat

SEQ ID NO: 919590 - DNA, 22 bp, Artificial Sequence
  chemically synthesized
ctaagaattttttcatttaata

SEQ ID NO: 919591 - DNA, 22 bp, Artificial Sequence
  chemically synthesized
taagaattttttcatttaatat

SEQ ID NO: 919592 - DNA, 22 bp, Artificial Sequence
  chemically synthesized
agaattttttcatttaatatgt

SEQ ID NO: 919593 - DNA, 22 bp, Artificial Sequence
  chemically synthesized
tcaacaatttctgcaaaacata

SEQ ID NO: 919594 - DNA, 22 bp, Artificial Sequence
  chemically synthesized
tttcatttaatatgttttgcag

SEQ ID NO: 919595 - DNA, 22 bp, Artificial Sequence
  chemically synthesized
ttcatttaatatgttttgcaga

SEQ ID NO: 919596 - DNA, 22 bp, Artificial Sequence
  chemically synthesized
tcatttaatatgttttgcagaa

SEQ ID NO: 919597 - DNA, 22 bp, Artificial Sequence
  chemically synthesized
catttaatatgttttgcagaaa

SEQ ID NO: 919598 - DNA, 22 bp, Artificial Sequence
  chemically synthesized
atttaatatgttttgcagaaat

SEQ ID NO: 919599 - DNA, 22 bp, Artificial Sequence
  chemically synthesized
aatatgttttgcagaaattgtt

SEQ ID NO: 919600 - DNA, 22 bp, Artificial Sequence
  chemically synthesized
atatgttttgcagaaattgttg

SEQ ID NO: 919601 - DNA, 22 bp, Artificial Sequence
  chemically synthesized
tgcagaaattgttgacaatgtt

SEQ ID NO: 919602 - DNA, 22 bp, Artificial Sequence
  chemically synthesized
gcagaaattgttgacaatgttg

SEQ ID NO: 919603 - DNA, 22 bp, Artificial Sequence
  chemically synthesized
cagaaattgttgacaatgttgt

SEQ ID NO: 919604 - DNA, 22 bp, Artificial Sequence
  chemically synthesized
gaatgtaataacatgaacaaca

SEQ ID NO: 919605 - DNA, 22 bp, Artificial Sequence
  chemically synthesized
ttgacaatgttgttcatgttat

SEQ ID NO: 919606 - DNA, 22 bp, Artificial Sequence
  chemically synthesized
acaatgttgttcatgttattac

SEQ ID NO: 919607 - DNA, 22 bp, Artificial Sequence
  chemically synthesized
gaaagactagaatgtaataaca

SEQ ID NO: 919608 - DNA, 22 bp, Artificial Sequence
  chemically synthesized
ttcatgttattacattctagtc

SEQ ID NO: 919609 - DNA, 22 bp, Artificial Sequence
  chemically synthesized
cagaaattagaaagactagaat

SEQ ID NO: 919610 - DNA, 22 bp, Artificial Sequence
  chemically synthesized
atgttattacattctagtcttt

SEQ ID NO: 919611 - DNA, 22 bp, Artificial Sequence
  chemically synthesized
ttacattctagtctttctaatt

SEQ ID NO: 919612 - DNA, 22 bp, Artificial Sequence
  chemically synthesized
ccaaccctacagaaattagaaa

SEQ ID NO: 919613 - DNA, 22 bp, Artificial Sequence
  chemically synthesized
cattctagtctttctaatttct

SEQ ID NO: 919614 - DNA, 22 bp, Artificial Sequence
  chemically synthesized
ctaccaaccctacagaaattag

SEQ ID NO: 919615 - DNA, 22 bp, Artificial Sequence
  chemically synthesized
tagtctttctaatttctgtagg

SEQ ID NO: 919616 - DNA, 22 bp, Artificial Sequence
  chemically synthesized
gtctttctaatttctgtagggt

SEQ ID NO: 919617 - DNA, 22 bp, Artificial Sequence
  chemically synthesized
tctaatttctgtagggttggta

SEQ ID NO: 919618 - DNA, 22 bp, Artificial Sequence
  chemically synthesized
ctaatttctgtagggttggtag

SEQ ID NO: 919619 - DNA, 22 bp, Artificial Sequence
  chemically synthesized
taatttctgtagggttggtagt

SEQ ID NO: 919620 - DNA, 22 bp, Artificial Sequence
  chemically synthesized
atttctgtagggttggtagtaa

SEQ ID NO: 919621 - DNA, 22 bp, Artificial Sequence
  chemically synthesized
ctgtagggttggtagtaattac

SEQ ID NO: 919622 - DNA, 22 bp, Artificial Sequence
  chemically synthesized
tgtagggttggtagtaattacc

SEQ ID NO: 919623 - DNA, 22 bp, Artificial Sequence
  chemically synthesized
tagggttggtagtaattacccc

SEQ ID NO: 919624 - DNA, 22 bp, Artificial Sequence
  chemically synthesized
gtagtaattacccctttttcct

SEQ ID NO: 919625 - DNA, 22 bp, Artificial Sequence
  chemically synthesized
ccaaaatcataaaggaaaaagg

SEQ ID NO: 919626 - DNA, 22 bp, Artificial Sequence
  chemically synthesized
cccctttttcctttatgatttt

SEQ ID NO: 919627 - DNA, 22 bp, Artificial Sequence
  chemically synthesized
tttcctttatgattttggtaat

SEQ ID NO: 919628 - DNA, 22 bp, Artificial Sequence
  chemically synthesized
ttcctttatgattttggtaatt

SEQ ID NO: 919629 - DNA, 22 bp, Artificial Sequence
  chemically synthesized
tcctttatgattttggtaattc

SEQ ID NO: 919630 - DNA, 22 bp, Artificial Sequence
  chemically synthesized
cctttatgattttggtaattct

SEQ ID NO: 919631 - DNA, 22 bp, Artificial Sequence
  chemically synthesized
accaaaaaaaaaagaattacca

SEQ ID NO: 919632 - DNA, 22 bp, Artificial Sequence
  chemically synthesized
ctttatgattttggtaattctt

SEQ ID NO: 919633 - DNA, 22 bp, Artificial Sequence
  chemically synthesized
tatgattttggtaattcttttt

SEQ ID NO: 919634 - DNA, 22 bp, Artificial Sequence
  chemically synthesized
atgattttggtaattctttttt

SEQ ID NO: 919635 - DNA, 22 bp, Artificial Sequence
  chemically synthesized
gactgaccaaaaaaaaaagaat

SEQ ID NO: 919636 - DNA, 22 bp, Artificial Sequence
  chemically synthesized
tgattttggtaattcttttttt

SEQ ID NO: 919637 - DNA, 22 bp, Artificial Sequence
  chemically synthesized
gctagactgaccaaaaaaaaaa

SEQ ID NO: 919638 - DNA, 22 bp, Artificial Sequence
  chemically synthesized
agctagactgaccaaaaaaaaa

SEQ ID NO: 919639 - DNA, 22 bp, Artificial Sequence
  chemically synthesized
tagctagactgaccaaaaaaaa

SEQ ID NO: 919640 - DNA, 22 bp, Artificial Sequence
  chemically synthesized
tggtaattcttttttttttggt

SEQ ID NO: 919641 - DNA, 22 bp, Artificial Sequence
  chemically synthesized
ggtaattcttttttttttggtc

SEQ ID NO: 919642 - DNA, 22 bp, Artificial Sequence
  chemically synthesized
gtaattcttttttttttggtca

SEQ ID NO: 919643 - DNA, 22 bp, Artificial Sequence
  chemically synthesized
ttttttttttggtcagtctagc

SEQ ID NO: 919644 - DNA, 22 bp, Artificial Sequence
  chemically synthesized
ttttttttggtcagtctagcta

SEQ ID NO: 919645 - DNA, 22 bp, Artificial Sequence
  chemically synthesized
tttttttggtcagtctagctaa

SEQ ID NO: 919646 - DNA, 22 bp, Artificial Sequence
  chemically synthesized
catggagaagctttagctagac

SEQ ID NO: 919647 - DNA, 22 bp, Artificial Sequence
  chemically synthesized
ttttttggtcagtctagctaaa

SEQ ID NO: 919648 - DNA, 22 bp, Artificial Sequence
  chemically synthesized
acatggagaagctttagctaga

SEQ ID NO: 919649 - DNA, 22 bp, Artificial Sequence
  chemically synthesized
tttttggtcagtctagctaaag

SEQ ID NO: 919650 - DNA, 22 bp, Artificial Sequence
  chemically synthesized
tacatggagaagctttagctag

SEQ ID NO: 919651 - DNA, 22 bp, Artificial Sequence
  chemically synthesized
ttttggtcagtctagctaaagc

SEQ ID NO: 919652 - DNA, 22 bp, Artificial Sequence
  chemically synthesized
ttacatggagaagctttagcta

SEQ ID NO: 919653 - DNA, 22 bp, Artificial Sequence
  chemically synthesized
tttggtcagtctagctaaagct

SEQ ID NO: 919654 - DNA, 22 bp, Artificial Sequence
  chemically synthesized
tttacatggagaagctttagct

SEQ ID NO: 919655 - DNA, 22 bp, Artificial Sequence
  chemically synthesized
ttggtcagtctagctaaagctt

SEQ ID NO: 919656 - DNA, 22 bp, Artificial Sequence
  chemically synthesized
tggtcagtctagctaaagcttc

SEQ ID NO: 919657 - DNA, 22 bp, Artificial Sequence
  chemically synthesized
ggtcagtctagctaaagcttct

SEQ ID NO: 919658 - DNA, 22 bp, Artificial Sequence
  chemically synthesized
gtcagtctagctaaagcttctc

SEQ ID NO: 919659 - DNA, 22 bp, Artificial Sequence
  chemically synthesized
aaaatattttttacatggagaa

SEQ ID NO: 919660 - DNA, 22 bp, Artificial Sequence
  chemically synthesized
gaaaatattttttacatggaga

SEQ ID NO: 919661 - DNA, 22 bp, Artificial Sequence
  chemically synthesized
tgaaaatattttttacatggag

SEQ ID NO: 919662 - DNA, 22 bp, Artificial Sequence
  chemically synthesized
gctaaagcttctccatgtaaaa

SEQ ID NO: 919663 - DNA, 22 bp, Artificial Sequence
  chemically synthesized
atctttgaaaatattttttaca

SEQ ID NO: 919664 - DNA, 22 bp, Artificial Sequence
  chemically synthesized
aagcttctccatgtaaaaaata

SEQ ID NO: 919665 - DNA, 22 bp, Artificial Sequence
  chemically synthesized
ctccatgtaaaaaatattttca

SEQ ID NO: 919666 - DNA, 22 bp, Artificial Sequence
  chemically synthesized
tccatgtaaaaaatattttcaa

SEQ ID NO: 919667 - DNA, 22 bp, Artificial Sequence
  chemically synthesized
catgtaaaaaatattttcaaag

SEQ ID NO: 919668 - DNA, 22 bp, Artificial Sequence
  chemically synthesized
tcaaagattaatgtatggtttc

SEQ ID NO: 919669 - DNA, 22 bp, Artificial Sequence
  chemically synthesized
caaagattaatgtatggtttca

SEQ ID NO: 919670 - DNA, 22 bp, Artificial Sequence
  chemically synthesized
aaagattaatgtatggtttcat

SEQ ID NO: 919671 - DNA, 22 bp, Artificial Sequence
  chemically synthesized
atgtatggtttcattgattttt

SEQ ID NO: 919672 - DNA, 22 bp, Artificial Sequence
  chemically synthesized
cattgatttttctttcttcttc

SEQ ID NO: 919673 - DNA, 22 bp, Artificial Sequence
  chemically synthesized
attgatttttctttcttcttct

SEQ ID NO: 919674 - DNA, 22 bp, Artificial Sequence
  chemically synthesized
atttttctttcttcttcttcta

SEQ ID NO: 919675 - DNA, 22 bp, Artificial Sequence
  chemically synthesized
ttctttcttcttcttctatttt

SEQ ID NO: 919676 - DNA, 22 bp, Artificial Sequence
  chemically synthesized
tctttcttcttcttctatttta

SEQ ID NO: 919677 - DNA, 22 bp, Artificial Sequence
  chemically synthesized
ctttcttcttcttctattttat

SEQ ID NO: 919678 - DNA, 22 bp, Artificial Sequence
  chemically synthesized
gagcagaagtcaataaaataga

SEQ ID NO: 919679 - DNA, 22 bp, Artificial Sequence
  chemically synthesized
tttcttcttcttctattttatt

SEQ ID NO: 919680 - DNA, 22 bp, Artificial Sequence
  chemically synthesized
tcttcttcttctattttattga

SEQ ID NO: 919681 - DNA, 22 bp, Artificial Sequence
  chemically synthesized
cttcttcttctattttattgac

SEQ ID NO: 919682 - DNA, 22 bp, Artificial Sequence
  chemically synthesized
ttcttcttctattttattgact

SEQ ID NO: 919683 - DNA, 22 bp, Artificial Sequence
  chemically synthesized
cttcttctattttattgacttc

SEQ ID NO: 919684 - DNA, 22 bp, Artificial Sequence
  chemically synthesized
ttcttctattttattgacttct

SEQ ID NO: 919685 - DNA, 22 bp, Artificial Sequence
  chemically synthesized
cttctattttattgacttctgc

SEQ ID NO: 919686 - DNA, 22 bp, Artificial Sequence
  chemically synthesized
ttctattttattgacttctgct

SEQ ID NO: 919687 - DNA, 22 bp, Artificial Sequence
  chemically synthesized
ctattttattgacttctgctct

SEQ ID NO: 919688 - DNA, 22 bp, Artificial Sequence
  chemically synthesized
tattttattgacttctgctcta

SEQ ID NO: 919689 - DNA, 22 bp, Artificial Sequence
  chemically synthesized
ttttattgacttctgctctaac

SEQ ID NO: 919690 - DNA, 22 bp, Artificial Sequence
  chemically synthesized
tattgacttctgctctaacccc

SEQ ID NO: 919691 - DNA, 22 bp, Artificial Sequence
  chemically synthesized
attgacttctgctctaaccccc

SEQ ID NO: 919692 - DNA, 22 bp, Artificial Sequence
  chemically synthesized
ttgacttctgctctaacccccg

SEQ ID NO: 919693 - DNA, 22 bp, Artificial Sequence
  chemically synthesized
acttctgctctaacccccgtta

SEQ ID NO: 919694 - DNA, 22 bp, Artificial Sequence
  chemically synthesized
ctgctctaacccccgttatttc

SEQ ID NO: 919695 - DNA, 22 bp, Artificial Sequence
  chemically synthesized
tgctctaacccccgttatttcc

SEQ ID NO: 919696 - DNA, 22 bp, Artificial Sequence
  chemically synthesized
ctctaacccccgttatttcctt

SEQ ID NO: 919697 - DNA, 22 bp, Artificial Sequence
  chemically synthesized
taacccccgttatttccttcct

SEQ ID NO: 919698 - DNA, 22 bp, Artificial Sequence
  chemically synthesized
gaaggaagcataaggaaggaaa

SEQ ID NO: 919699 - DNA, 22 bp, Artificial Sequence
  chemically synthesized
acccccgttatttccttcctta

SEQ ID NO: 919700 - DNA, 22 bp, Artificial Sequence
  chemically synthesized
tttccttccttatgcttccttc

SEQ ID NO: 919701 - DNA, 22 bp, Artificial Sequence
  chemically synthesized
ccttccttatgcttccttcgag

SEQ ID NO: 919702 - DNA, 22 bp, Artificial Sequence
  chemically synthesized
cttccttatgcttccttcgagc

SEQ ID NO: 919703 - DNA, 22 bp, Artificial Sequence
  chemically synthesized
ccttatgcttccttcgagctta

SEQ ID NO: 919704 - DNA, 22 bp, Artificial Sequence
  chemically synthesized
cttatgcttccttcgagcttac

SEQ ID NO: 919705 - DNA, 22 bp, Artificial Sequence
  chemically synthesized
atgcttccttcgagcttactgt

SEQ ID NO: 919706 - DNA, 22 bp, Artificial Sequence
  chemically synthesized
tgcttccttcgagcttactgtg

SEQ ID NO: 919707 - DNA, 22 bp, Artificial Sequence
  chemically synthesized
gaaaaagaagaacacagtaagc

SEQ ID NO: 919708 - DNA, 22 bp, Artificial Sequence
  chemically synthesized
ccttcgagcttactgtgttctt

SEQ ID NO: 919709 - DNA, 22 bp, Artificial Sequence
  chemically synthesized
cttcgagcttactgtgttcttc

SEQ ID NO: 919710 - DNA, 22 bp, Artificial Sequence
  chemically synthesized
cgagcttactgtgttcttcttt

SEQ ID NO: 919711 - DNA, 22 bp, Artificial Sequence
  chemically synthesized
gagcttactgtgttcttctttt

SEQ ID NO: 919712 - DNA, 22 bp, Artificial Sequence
  chemically synthesized
gccataagaaactagaaaaaga

SEQ ID NO: 919713 - DNA, 22 bp, Artificial Sequence
  chemically synthesized
cgccataagaaactagaaaaag

SEQ ID NO: 919714 - DNA, 22 bp, Artificial Sequence
  chemically synthesized
actgtgttcttctttttctagt

SEQ ID NO: 919715 - DNA, 22 bp, Artificial Sequence
  chemically synthesized
tcgccataagaaactagaaaaa

SEQ ID NO: 919716 - DNA, 22 bp, Artificial Sequence
  chemically synthesized
ctgtgttcttctttttctagtt

SEQ ID NO: 919717 - DNA, 22 bp, Artificial Sequence
  chemically synthesized
tgttcttctttttctagtttct

SEQ ID NO: 919718 - DNA, 22 bp, Artificial Sequence
  chemically synthesized
aagctttcgccataagaaacta

SEQ ID NO: 919719 - DNA, 22 bp, Artificial Sequence
  chemically synthesized
ttctttttctagtttcttatgg

SEQ ID NO: 919720 - DNA, 22 bp, Artificial Sequence
  chemically synthesized
actcaagctttcgccataagaa

SEQ ID NO: 919721 - DNA, 22 bp, Artificial Sequence
  chemically synthesized
ctttttctagtttcttatggcg

SEQ ID NO: 919722 - DNA, 22 bp, Artificial Sequence
  chemically synthesized
tttttctagtttcttatggcga

SEQ ID NO: 919723 - DNA, 22 bp, Artificial Sequence
  chemically synthesized
tttctagtttcttatggcgaaa

SEQ ID NO: 919724 - DNA, 22 bp, Artificial Sequence
  chemically synthesized
ttctagtttcttatggcgaaag

SEQ ID NO: 919725 - DNA, 22 bp, Artificial Sequence
  chemically synthesized
tctagtttcttatggcgaaagc

SEQ ID NO: 919726 - DNA, 22 bp, Artificial Sequence
  chemically synthesized
ctagtttcttatggcgaaagct

SEQ ID NO: 919727 - DNA, 22 bp, Artificial Sequence
  chemically synthesized
tagtttcttatggcgaaagctt

SEQ ID NO: 919728 - DNA, 22 bp, Artificial Sequence
  chemically synthesized
aatcattaactcaagctttcgc

SEQ ID NO: 919729 - DNA, 22 bp, Artificial Sequence
  chemically synthesized
aaatcattaactcaagctttcg

SEQ ID NO: 919730 - DNA, 22 bp, Artificial Sequence
  chemically synthesized
gtttcttatggcgaaagcttga

SEQ ID NO: 919731 - DNA, 22 bp, Artificial Sequence
  chemically synthesized
ttaaatcattaactcaagcttt

SEQ ID NO: 919732 - DNA, 22 bp, Artificial Sequence
  chemically synthesized
cttatggcgaaagcttgagtta

SEQ ID NO: 919733 - DNA, 22 bp, Artificial Sequence
  chemically synthesized
ttatggcgaaagcttgagttaa

SEQ ID NO: 919734 - DNA, 22 bp, Artificial Sequence
  chemically synthesized
atggcgaaagcttgagttaatg

SEQ ID NO: 919735 - DNA, 22 bp, Artificial Sequence
  chemically synthesized
tggcgaaagcttgagttaatga

SEQ ID NO: 919736 - DNA, 22 bp, Artificial Sequence
  chemically synthesized
gaaaagaataaaattcttaaat

SEQ ID NO: 919737 - DNA, 22 bp, Artificial Sequence
  chemically synthesized
agaaaagaataaaattcttaaa

SEQ ID NO: 919738 - DNA, 22 bp, Artificial Sequence
  chemically synthesized
tagaaaagaataaaattcttaa

SEQ ID NO: 919739 - DNA, 22 bp, Artificial Sequence
  chemically synthesized
gagttaatgatttaagaatttt

SEQ ID NO: 919740 - DNA, 22 bp, Artificial Sequence
  chemically synthesized
agttaatgatttaagaatttta

SEQ ID NO: 919741 - DNA, 22 bp, Artificial Sequence
  chemically synthesized
ttttagaaaagaataaaattct

SEQ ID NO: 919742 - DNA, 22 bp, Artificial Sequence
  chemically synthesized
atgatttaagaattttattctt

SEQ ID NO: 919743 - DNA, 22 bp, Artificial Sequence
  chemically synthesized
aatacctattttagaaaagaat

SEQ ID NO: 919744 - DNA, 22 bp, Artificial Sequence
  chemically synthesized
aaatacctattttagaaaagaa

SEQ ID NO: 919745 - DNA, 22 bp, Artificial Sequence
  chemically synthesized
taaatacctattttagaaaaga

SEQ ID NO: 919746 - DNA, 22 bp, Artificial Sequence
  chemically synthesized
aagaattttattcttttctaaa

SEQ ID NO: 919747 - DNA, 22 bp, Artificial Sequence
  chemically synthesized
agaattttattcttttctaaaa

SEQ ID NO: 919748 - DNA, 22 bp, Artificial Sequence
  chemically synthesized
gttttaaatacctattttagaa

SEQ ID NO: 919749 - DNA, 22 bp, Artificial Sequence
  chemically synthesized
tagttttaaatacctattttag

SEQ ID NO: 919750 - DNA, 22 bp, Artificial Sequence
  chemically synthesized
ctagttttaaatacctatttta

SEQ ID NO: 919751 - DNA, 22 bp, Artificial Sequence
  chemically synthesized
tattcttttctaaaataggtat

SEQ ID NO: 919752 - DNA, 22 bp, Artificial Sequence
  chemically synthesized
attcttttctaaaataggtatt

SEQ ID NO: 919753 - DNA, 22 bp, Artificial Sequence
  chemically synthesized
ttcttttctaaaataggtattt

SEQ ID NO: 919754 - DNA, 22 bp, Artificial Sequence
  chemically synthesized
ttttctaaaataggtatttaaa

SEQ ID NO: 919755 - DNA, 22 bp, Artificial Sequence
  chemically synthesized
ttctaaaataggtatttaaaac

SEQ ID NO: 919756 - DNA, 22 bp, Artificial Sequence
  chemically synthesized
tctaaaataggtatttaaaact

SEQ ID NO: 919757 - DNA, 22 bp, Artificial Sequence
  chemically synthesized
ctaaaataggtatttaaaacta

SEQ ID NO: 919758 - DNA, 22 bp, Artificial Sequence
  chemically synthesized
cagggaaacttctagttttaaa

SEQ ID NO: 919759 - DNA, 22 bp, Artificial Sequence
  chemically synthesized
taaaataggtatttaaaactag

SEQ ID NO: 919760 - DNA, 22 bp, Artificial Sequence
  chemically synthesized
acagggaaacttctagttttaa

SEQ ID NO: 919761 - DNA, 22 bp, Artificial Sequence
  chemically synthesized
aaataggtatttaaaactagaa

SEQ ID NO: 919762 - DNA, 22 bp, Artificial Sequence
  chemically synthesized
aagcagtgcttacagggaaact

SEQ ID NO: 919763 - DNA, 22 bp, Artificial Sequence
  chemically synthesized
aaaactagaagtttccctgtaa

SEQ ID NO: 919764 - DNA, 22 bp, Artificial Sequence
  chemically synthesized
aaactagaagtttccctgtaag

SEQ ID NO: 919765 - DNA, 22 bp, Artificial Sequence
  chemically synthesized
gaagtttccctgtaagcactgc

SEQ ID NO: 919766 - DNA, 22 bp, Artificial Sequence
  chemically synthesized
taggatgtaactaaagcagtgc

SEQ ID NO: 919767 - DNA, 22 bp, Artificial Sequence
  chemically synthesized
ataggatgtaactaaagcagtg

SEQ ID NO: 919768 - DNA, 22 bp, Artificial Sequence
  chemically synthesized
ccctgtaagcactgctttagtt

SEQ ID NO: 919769 - DNA, 22 bp, Artificial Sequence
  chemically synthesized
cctgtaagcactgctttagtta

SEQ ID NO: 919770 - DNA, 22 bp, Artificial Sequence
  chemically synthesized
taagcactgctttagttacatc

SEQ ID NO: 919771 - DNA, 22 bp, Artificial Sequence
  chemically synthesized
ctttagttacatcctataaatc

SEQ ID NO: 919772 - DNA, 22 bp, Artificial Sequence
  chemically synthesized
tagttacatcctataaatcttg

SEQ ID NO: 919773 - DNA, 22 bp, Artificial Sequence
  chemically synthesized
agttacatcctataaatcttga

SEQ ID NO: 919774 - DNA, 22 bp, Artificial Sequence
  chemically synthesized
gttacatcctataaatcttgac

SEQ ID NO: 919775 - DNA, 22 bp, Artificial Sequence
  chemically synthesized
catcctataaatcttgacatgt

SEQ ID NO: 919776 - DNA, 22 bp, Artificial Sequence
  chemically synthesized
aataaaaataaaagcacaacat

SEQ ID NO: 919777 - DNA, 22 bp, Artificial Sequence
  chemically synthesized
taaatcttgacatgttgtgctt

SEQ ID NO: 919778 - DNA, 22 bp, Artificial Sequence
  chemically synthesized
aactgaataaaaataaaagcac

SEQ ID NO: 919779 - DNA, 22 bp, Artificial Sequence
  chemically synthesized
gaactgaataaaaataaaagca

SEQ ID NO: 919780 - DNA, 22 bp, Artificial Sequence
  chemically synthesized
tgaactgaataaaaataaaagc

SEQ ID NO: 919781 - DNA, 22 bp, Artificial Sequence
  chemically synthesized
gacatgttgtgcttttattttt

SEQ ID NO: 919782 - DNA, 22 bp, Artificial Sequence
  chemically synthesized
acatgttgtgcttttattttta

SEQ ID NO: 919783 - DNA, 22 bp, Artificial Sequence
  chemically synthesized
taaaatattttgaactgaataa

SEQ ID NO: 919784 - DNA, 22 bp, Artificial Sequence
  chemically synthesized
tgcttttatttttattcagttc

SEQ ID NO: 919785 - DNA, 22 bp, Artificial Sequence
  chemically synthesized
ttatttttattcagttcaaaat

SEQ ID NO: 919786 - DNA, 22 bp, Artificial Sequence
  chemically synthesized
tatttttattcagttcaaaata

SEQ ID NO: 919787 - DNA, 22 bp, Artificial Sequence
  chemically synthesized
atttttattcagttcaaaatat

SEQ ID NO: 919788 - DNA, 22 bp, Artificial Sequence
  chemically synthesized
tttttattcagttcaaaatatt

SEQ ID NO: 919789 - DNA, 22 bp, Artificial Sequence
  chemically synthesized
ttattcagttcaaaatatttta

SEQ ID NO: 919790 - DNA, 22 bp, Artificial Sequence
  chemically synthesized
tattcagttcaaaatattttat

SEQ ID NO: 919791 - DNA, 22 bp, Artificial Sequence
  chemically synthesized
attcagttcaaaatattttata

SEQ ID NO: 919792 - DNA, 22 bp, Artificial Sequence
  chemically synthesized
ttcagttcaaaatattttataa

SEQ ID NO: 919793 - DNA, 22 bp, Artificial Sequence
  chemically synthesized
aatcacataggaaattataaaa

SEQ ID NO: 919794 - DNA, 22 bp, Artificial Sequence
  chemically synthesized
agttcaaaatattttataattt

SEQ ID NO: 919795 - DNA, 22 bp, Artificial Sequence
  chemically synthesized
aaaatattttataatttcctat

SEQ ID NO: 919796 - DNA, 22 bp, Artificial Sequence
  chemically synthesized
aaaactaaatcacataggaaat

SEQ ID NO: 919797 - DNA, 22 bp, Artificial Sequence
  chemically synthesized
gttaaaaactaaatcacatagg

SEQ ID NO: 919798 - DNA, 22 bp, Artificial Sequence
  chemically synthesized
tataatttcctatgtgatttag

SEQ ID NO: 919799 - DNA, 22 bp, Artificial Sequence
  chemically synthesized
ataatttcctatgtgatttagt

SEQ ID NO: 919800 - DNA, 22 bp, Artificial Sequence
  chemically synthesized
taatttcctatgtgatttagtt

SEQ ID NO: 919801 - DNA, 22 bp, Artificial Sequence
  chemically synthesized
aatccattggttaaaaactaaa

SEQ ID NO: 919802 - DNA, 22 bp, Artificial Sequence
  chemically synthesized
taaatccattggttaaaaacta

SEQ ID NO: 919803 - DNA, 22 bp, Artificial Sequence
  chemically synthesized
cctatgtgatttagtttttaac

SEQ ID NO: 919804 - DNA, 22 bp, Artificial Sequence
  chemically synthesized
ctaaatccattggttaaaaact

SEQ ID NO: 919805 - DNA, 22 bp, Artificial Sequence
  chemically synthesized
ctatgtgatttagtttttaacc

SEQ ID NO: 919806 - DNA, 22 bp, Artificial Sequence
  chemically synthesized
tgtgatttagtttttaaccaat

SEQ ID NO: 919807 - DNA, 22 bp, Artificial Sequence
  chemically synthesized
aacaacttctaaatccattggt

SEQ ID NO: 919808 - DNA, 22 bp, Artificial Sequence
  chemically synthesized
agtttttaaccaatggatttag

SEQ ID NO: 919809 - DNA, 22 bp, Artificial Sequence
  chemically synthesized
gtttttaaccaatggatttaga

SEQ ID NO: 919810 - DNA, 22 bp, Artificial Sequence
  chemically synthesized
aaattcaacaacttctaaatcc

SEQ ID NO: 919811 - DNA, 22 bp, Artificial Sequence
  chemically synthesized
gaaattcaacaacttctaaatc

SEQ ID NO: 919812 - DNA, 22 bp, Artificial Sequence
  chemically synthesized
tgaaattcaacaacttctaaat

SEQ ID NO: 919813 - DNA, 22 bp, Artificial Sequence
  chemically synthesized
ttaaccaatggatttagaagtt

SEQ ID NO: 919814 - DNA, 22 bp, Artificial Sequence
  chemically synthesized
taaccaatggatttagaagttg

SEQ ID NO: 919815 - DNA, 22 bp, Artificial Sequence
  chemically synthesized
aaccaatggatttagaagttgt

SEQ ID NO: 919816 - DNA, 22 bp, Artificial Sequence
  chemically synthesized
accaatggatttagaagttgtt

SEQ ID NO: 919817 - DNA, 22 bp, Artificial Sequence
  chemically synthesized
agaagttgttgaatttcaaaat

SEQ ID NO: 919818 - DNA, 22 bp, Artificial Sequence
  chemically synthesized
gaagttgttgaatttcaaaata

SEQ ID NO: 919819 - DNA, 22 bp, Artificial Sequence
  chemically synthesized
gaagatatcaaaatattttgaa

SEQ ID NO: 919820 - DNA, 22 bp, Artificial Sequence
  chemically synthesized
ggaagatatcaaaatattttga

SEQ ID NO: 919821 - DNA, 22 bp, Artificial Sequence
  chemically synthesized
ttgaatttcaaaatattttgat

SEQ ID NO: 919822 - DNA, 22 bp, Artificial Sequence
  chemically synthesized
aatttcaaaatattttgatatc

SEQ ID NO: 919823 - DNA, 22 bp, Artificial Sequence
  chemically synthesized
caaaatattttgatatcttcca

SEQ ID NO: 919824 - DNA, 22 bp, Artificial Sequence
  chemically synthesized
aaaatattttgatatcttccaa

SEQ ID NO: 919825 - DNA, 22 bp, Artificial Sequence
  chemically synthesized
aacagaaggaaatttggaagat

SEQ ID NO: 919826 - DNA, 22 bp, Artificial Sequence
  chemically synthesized
gaattcaacagaaggaaatttg

SEQ ID NO: 919827 - DNA, 22 bp, Artificial Sequence
  chemically synthesized
tgatatcttccaaatttccttc

SEQ ID NO: 919828 - DNA, 22 bp, Artificial Sequence
  chemically synthesized
gatatcttccaaatttccttct

SEQ ID NO: 919829 - DNA, 22 bp, Artificial Sequence
  chemically synthesized
atatcttccaaatttccttctg

SEQ ID NO: 919830 - DNA, 22 bp, Artificial Sequence
  chemically synthesized
aattggaattcaacagaaggaa

SEQ ID NO: 919831 - DNA, 22 bp, Artificial Sequence
  chemically synthesized
ccaaatttccttctgttgaatt

SEQ ID NO: 919832 - DNA, 22 bp, Artificial Sequence
  chemically synthesized
caaatttccttctgttgaattc

SEQ ID NO: 919833 - DNA, 22 bp, Artificial Sequence
  chemically synthesized
ccttctgttgaattccaattta

SEQ ID NO: 919834 - DNA, 22 bp, Artificial Sequence
  chemically synthesized
atatgtcagaattaaattggaa

SEQ ID NO: 919835 - DNA, 22 bp, Artificial Sequence
  chemically synthesized
cttctgttgaattccaatttaa

SEQ ID NO: 919836 - DNA, 22 bp, Artificial Sequence
  chemically synthesized
aatatgtcagaattaaattgga

SEQ ID NO: 919837 - DNA, 22 bp, Artificial Sequence
  chemically synthesized
ttaatatgtcagaattaaattg

SEQ ID NO: 919838 - DNA, 22 bp, Artificial Sequence
  chemically synthesized
ctgttgaattccaatttaattc

SEQ ID NO: 919839 - DNA, 22 bp, Artificial Sequence
  chemically synthesized
tgttgaattccaatttaattct

SEQ ID NO: 919840 - DNA, 22 bp, Artificial Sequence
  chemically synthesized
tcttaatatgtcagaattaaat

SEQ ID NO: 919841 - DNA, 22 bp, Artificial Sequence
  chemically synthesized
ttgaattccaatttaattctga

SEQ ID NO: 919842 - DNA, 22 bp, Artificial Sequence
  chemically synthesized
aattccaatttaattctgacat

SEQ ID NO: 919843 - DNA, 22 bp, Artificial Sequence
  chemically synthesized
tgttctcttaatatgtcagaat

SEQ ID NO: 919844 - DNA, 22 bp, Artificial Sequence
  chemically synthesized
caatttaattctgacatattaa

SEQ ID NO: 919845 - DNA, 22 bp, Artificial Sequence
  chemically synthesized
ataaaaattatgttctcttaat

SEQ ID NO: 919846 - DNA, 22 bp, Artificial Sequence
  chemically synthesized
aattctgacatattaagagaac

SEQ ID NO: 919847 - DNA, 22 bp, Artificial Sequence
  chemically synthesized
attctgacatattaagagaaca

SEQ ID NO: 919848 - DNA, 22 bp, Artificial Sequence
  chemically synthesized
aattcataaaaattatgttctc

SEQ ID NO: 919849 - DNA, 22 bp, Artificial Sequence
  chemically synthesized
tgacatattaagagaacataat

SEQ ID NO: 919850 - DNA, 22 bp, Artificial Sequence
  chemically synthesized
gaattcataaaaattatgttct

SEQ ID NO: 919851 - DNA, 22 bp, Artificial Sequence
  chemically synthesized
acatattaagagaacataattt

SEQ ID NO: 919852 - DNA, 22 bp, Artificial Sequence
  chemically synthesized
aacaggcttgaattcataaaaa

SEQ ID NO: 919853 - DNA, 22 bp, Artificial Sequence
  chemically synthesized
agagaacataatttttatgaat

SEQ ID NO: 919854 - DNA, 22 bp, Artificial Sequence
  chemically synthesized
aatacactcaacaggcttgaat

SEQ ID NO: 919855 - DNA, 22 bp, Artificial Sequence
  chemically synthesized
ttatgaattcaagcctgttgag

SEQ ID NO: 919856 - DNA, 22 bp, Artificial Sequence
  chemically synthesized
tatgaattcaagcctgttgagt

SEQ ID NO: 919857 - DNA, 22 bp, Artificial Sequence
  chemically synthesized
atgaattcaagcctgttgagtg

SEQ ID NO: 919858 - DNA, 22 bp, Artificial Sequence
  chemically synthesized
tgaattcaagcctgttgagtgt

SEQ ID NO: 919859 - DNA, 22 bp, Artificial Sequence
  chemically synthesized
aagcctgttgagtgtattgaga

SEQ ID NO: 919860 - DNA, 22 bp, Artificial Sequence
  chemically synthesized
ggtcaaaaaacaaatctcaata

SEQ ID NO: 919861 - DNA, 22 bp, Artificial Sequence
  chemically synthesized
ttgagtgtattgagatttgttt

SEQ ID NO: 919862 - DNA, 22 bp, Artificial Sequence
  chemically synthesized
tgctaggtcaaaaaacaaatct

SEQ ID NO: 919863 - DNA, 22 bp, Artificial Sequence
  chemically synthesized
tatgctaggtcaaaaaacaaat

SEQ ID NO: 919864 - DNA, 22 bp, Artificial Sequence
  chemically synthesized
agtgtattgagatttgtttttt

SEQ ID NO: 919865 - DNA, 22 bp, Artificial Sequence
  chemically synthesized
agatttgttttttgacctagca

SEQ ID NO: 919866 - DNA, 22 bp, Artificial Sequence
  chemically synthesized
ggatagattctatgctaggtca

SEQ ID NO: 919867 - DNA, 22 bp, Artificial Sequence
  chemically synthesized
tgggatagattctatgctaggt

SEQ ID NO: 919868 - DNA, 22 bp, Artificial Sequence
  chemically synthesized
tctgggatagattctatgctag

SEQ ID NO: 919869 - DNA, 22 bp, Artificial Sequence
  chemically synthesized
ctctgggatagattctatgcta

SEQ ID NO: 919870 - DNA, 22 bp, Artificial Sequence
  chemically synthesized
gttttttgacctagcatagaat

SEQ ID NO: 919871 - DNA, 22 bp, Artificial Sequence
  chemically synthesized
tctctgggatagattctatgct

SEQ ID NO: 919872 - DNA, 22 bp, Artificial Sequence
  chemically synthesized
ttttttgacctagcatagaatc

SEQ ID NO: 919873 - DNA, 22 bp, Artificial Sequence
  chemically synthesized
tttgacctagcatagaatctat

SEQ ID NO: 919874 - DNA, 22 bp, Artificial Sequence
  chemically synthesized
ttgacctagcatagaatctatc

SEQ ID NO: 919875 - DNA, 22 bp, Artificial Sequence
  chemically synthesized
tgacctagcatagaatctatcc

SEQ ID NO: 919876 - DNA, 22 bp, Artificial Sequence
  chemically synthesized
gacctagcatagaatctatccc

SEQ ID NO: 919877 - DNA, 22 bp, Artificial Sequence
  chemically synthesized
acctagcatagaatctatccca

SEQ ID NO: 919878 - DNA, 22 bp, Artificial Sequence
  chemically synthesized
gcatagaatctatcccagagaa

SEQ ID NO: 919879 - DNA, 22 bp, Artificial Sequence
  chemically synthesized
aagtgcacatgaaattttctct

SEQ ID NO: 919880 - DNA, 22 bp, Artificial Sequence
  chemically synthesized
aaagtgcacatgaaattttctc

SEQ ID NO: 919881 - DNA, 22 bp, Artificial Sequence
  chemically synthesized
taaagtgcacatgaaattttct

SEQ ID NO: 919882 - DNA, 22 bp, Artificial Sequence
  chemically synthesized
ttttaaagtgcacatgaaattt

SEQ ID NO: 919883 - DNA, 22 bp, Artificial Sequence
  chemically synthesized
tcccagagaaaatttcatgtgc

SEQ ID NO: 919884 - DNA, 22 bp, Artificial Sequence
  chemically synthesized
catgtgcactttaaaataatat

SEQ ID NO: 919885 - DNA, 22 bp, Artificial Sequence
  chemically synthesized
atgtgcactttaaaataatatg

SEQ ID NO: 919886 - DNA, 22 bp, Artificial Sequence
  chemically synthesized
taaaataatatgtattctgctt

SEQ ID NO: 919887 - DNA, 22 bp, Artificial Sequence
  chemically synthesized
aaaataatatgtattctgcttt

SEQ ID NO: 919888 - DNA, 22 bp, Artificial Sequence
  chemically synthesized
aaataatatgtattctgctttc

SEQ ID NO: 919889 - DNA, 22 bp, Artificial Sequence
  chemically synthesized
taggagacgccaccaaatgaaa

SEQ ID NO: 919890 - DNA, 22 bp, Artificial Sequence
  chemically synthesized
ataggagacgccaccaaatgaa

SEQ ID NO: 919891 - DNA, 22 bp, Artificial Sequence
  chemically synthesized
acatttataggagacgccacca

SEQ ID NO: 919892 - DNA, 22 bp, Artificial Sequence
  chemically synthesized
tgctttcatttggtggcgtctc

SEQ ID NO: 919893 - DNA, 22 bp, Artificial Sequence
  chemically synthesized
ctttcatttggtggcgtctcct

SEQ ID NO: 919894 - DNA, 22 bp, Artificial Sequence
  chemically synthesized
actaacatttataggagacgcc

SEQ ID NO: 919895 - DNA, 22 bp, Artificial Sequence
  chemically synthesized
tcatttggtggcgtctcctata

SEQ ID NO: 919896 - DNA, 22 bp, Artificial Sequence
  chemically synthesized
catttggtggcgtctcctataa

SEQ ID NO: 919897 - DNA, 22 bp, Artificial Sequence
  chemically synthesized
atttggtggcgtctcctataaa

SEQ ID NO: 919898 - DNA, 22 bp, Artificial Sequence
  chemically synthesized
acctaactaacatttataggag

SEQ ID NO: 919899 - DNA, 22 bp, Artificial Sequence
  chemically synthesized
gacctaactaacatttatagga

SEQ ID NO: 919900 - DNA, 22 bp, Artificial Sequence
  chemically synthesized
ggtggcgtctcctataaatgtt

SEQ ID NO: 919901 - DNA, 22 bp, Artificial Sequence
  chemically synthesized
gtggcgtctcctataaatgtta

SEQ ID NO: 919902 - DNA, 22 bp, Artificial Sequence
  chemically synthesized
tcaaccagcttgacctaactaa

SEQ ID NO: 919903 - DNA, 22 bp, Artificial Sequence
  chemically synthesized
ctataaatgttagttaggtcaa

SEQ ID NO: 919904 - DNA, 22 bp, Artificial Sequence
  chemically synthesized
taaatgttagttaggtcaagct

SEQ ID NO: 919905 - DNA, 22 bp, Artificial Sequence
  chemically synthesized
accaacactatcaaccagcttg

SEQ ID NO: 919906 - DNA, 22 bp, Artificial Sequence
  chemically synthesized
gttaggtcaagctggttgatag

SEQ ID NO: 919907 - DNA, 22 bp, Artificial Sequence
  chemically synthesized
ggtcaagctggttgatagtgtt

SEQ ID NO: 919908 - DNA, 22 bp, Artificial Sequence
  chemically synthesized
gttgatagtgttggtgaattct

SEQ ID NO: 919909 - DNA, 22 bp, Artificial Sequence
  chemically synthesized
atagtgttggtgaattcttcta

SEQ ID NO: 919910 - DNA, 22 bp, Artificial Sequence
  chemically synthesized
gtgaattcttctatattgttgc

SEQ ID NO: 919911 - DNA, 22 bp, Artificial Sequence
  chemically synthesized
gacagaaaaatagcaacaatat

SEQ ID NO: 919912 - DNA, 22 bp, Artificial Sequence
  chemically synthesized
ttctatattgttgctatttttc

SEQ ID NO: 919913 - DNA, 22 bp, Artificial Sequence
  chemically synthesized
ctatattgttgctatttttctg

SEQ ID NO: 919914 - DNA, 22 bp, Artificial Sequence
  chemically synthesized
tatattgttgctatttttctgt

SEQ ID NO: 919915 - DNA, 22 bp, Artificial Sequence
  chemically synthesized
gcaggccaattagacagaaaaa

SEQ ID NO: 919916 - DNA, 22 bp, Artificial Sequence
  chemically synthesized
tattgttgctatttttctgtct

SEQ ID NO: 919917 - DNA, 22 bp, Artificial Sequence
  chemically synthesized
ttgctatttttctgtctaattg

SEQ ID NO: 919918 - DNA, 22 bp, Artificial Sequence
  chemically synthesized
aatagctggcaggccaattaga

SEQ ID NO: 919919 - DNA, 22 bp, Artificial Sequence
  chemically synthesized
ctatttttctgtctaattggcc

SEQ ID NO: 919920 - DNA, 22 bp, Artificial Sequence
  chemically synthesized
tcaatagctggcaggccaatta

SEQ ID NO: 919921 - DNA, 22 bp, Artificial Sequence
  chemically synthesized
tttttctgtctaattggcctgc

SEQ ID NO: 919922 - DNA, 22 bp, Artificial Sequence
  chemically synthesized
ctctcaatagctggcaggccaa

SEQ ID NO: 919923 - DNA, 22 bp, Artificial Sequence
  chemically synthesized
ttctgtctaattggcctgccag

SEQ ID NO: 919924 - DNA, 22 bp, Artificial Sequence
  chemically synthesized
tctgtctaattggcctgccagc

SEQ ID NO: 919925 - DNA, 22 bp, Artificial Sequence
  chemically synthesized
ctgtctaattggcctgccagct

SEQ ID NO: 919926 - DNA, 22 bp, Artificial Sequence
  chemically synthesized
tgtctaattggcctgccagcta

SEQ ID NO: 919927 - DNA, 22 bp, Artificial Sequence
  chemically synthesized
tctaattggcctgccagctatt

SEQ ID NO: 919928 - DNA, 22 bp, Artificial Sequence
  chemically synthesized
aaaccctactctcaatagctgg

SEQ ID NO: 919929 - DNA, 22 bp, Artificial Sequence
  chemically synthesized
caaaccctactctcaatagctg

SEQ ID NO: 919930 - DNA, 22 bp, Artificial Sequence
  chemically synthesized
attggcctgccagctattgaga

SEQ ID NO: 919931 - DNA, 22 bp, Artificial Sequence
  chemically synthesized
gcctgccagctattgagagtag

SEQ ID NO: 919932 - DNA, 22 bp, Artificial Sequence
  chemically synthesized
gagacttcaaaccctactctca

SEQ ID NO: 919933 - DNA, 22 bp, Artificial Sequence
  chemically synthesized
ttggagacttcaaaccctactc

SEQ ID NO: 919934 - DNA, 22 bp, Artificial Sequence
  chemically synthesized
ccagctattgagagtagggttt

SEQ ID NO: 919935 - DNA, 22 bp, Artificial Sequence
  chemically synthesized
ttattggagacttcaaacccta

SEQ ID NO: 919936 - DNA, 22 bp, Artificial Sequence
  chemically synthesized
ttgagagtagggtttgaagtct

SEQ ID NO: 919937 - DNA, 22 bp, Artificial Sequence
  chemically synthesized
agagtagggtttgaagtctcca

SEQ ID NO: 919938 - DNA, 22 bp, Artificial Sequence
  chemically synthesized
aacaattattattggagacttc

SEQ ID NO: 919939 - DNA, 22 bp, Artificial Sequence
  chemically synthesized
gacaattcaacaattattattg

SEQ ID NO: 919940 - DNA, 22 bp, Artificial Sequence
  chemically synthesized
gaagtctccaataataattgtt

SEQ ID NO: 919941 - DNA, 22 bp, Artificial Sequence
  chemically synthesized
aagtctccaataataattgttg

SEQ ID NO: 919942 - DNA, 22 bp, Artificial Sequence
  chemically synthesized
caataataattgttgaattgtc

SEQ ID NO: 919943 - DNA, 22 bp, Artificial Sequence
  chemically synthesized
aaaggagaactagacaattcaa

SEQ ID NO: 919944 - DNA, 22 bp, Artificial Sequence
  chemically synthesized
acagaattcaaaggagaactag

SEQ ID NO: 919945 - DNA, 22 bp, Artificial Sequence
  chemically synthesized
ttgaattgtctagttctccttt

SEQ ID NO: 919946 - DNA, 22 bp, Artificial Sequence
  chemically synthesized
aattgtctagttctcctttgaa

SEQ ID NO: 919947 - DNA, 22 bp, Artificial Sequence
  chemically synthesized
tctagttctcctttgaattctg

SEQ ID NO: 919948 - DNA, 22 bp, Artificial Sequence
  chemically synthesized
tgatgcagaaattgacagaatt

SEQ ID NO: 919949 - DNA, 22 bp, Artificial Sequence
  chemically synthesized
gttctcctttgaattctgtcaa

SEQ ID NO: 919950 - DNA, 22 bp, Artificial Sequence
  chemically synthesized
tatgatgcagaaattgacagaa

SEQ ID NO: 919951 - DNA, 22 bp, Artificial Sequence
  chemically synthesized
tcctttgaattctgtcaatttc

SEQ ID NO: 919952 - DNA, 22 bp, Artificial Sequence
  chemically synthesized
ctttgaattctgtcaatttctg

SEQ ID NO: 919953 - DNA, 22 bp, Artificial Sequence
  chemically synthesized
tgaattctgtcaatttctgcat

SEQ ID NO: 919954 - DNA, 22 bp, Artificial Sequence
  chemically synthesized
gaattctgtcaatttctgcatc

SEQ ID NO: 919955 - DNA, 22 bp, Artificial Sequence
  chemically synthesized
aattctgtcaatttctgcatca

SEQ ID NO: 919956 - DNA, 22 bp, Artificial Sequence
  chemically synthesized
tgtcaatttctgcatcatagaa

SEQ ID NO: 919957 - DNA, 22 bp, Artificial Sequence
  chemically synthesized
tcaatttctgcatcatagaatt

SEQ ID NO: 919958 - DNA, 22 bp, Artificial Sequence
  chemically synthesized
ataggaaagtcccaaattctat

SEQ ID NO: 919959 - DNA, 22 bp, Artificial Sequence
  chemically synthesized
ctgcatcatagaatttgggact

SEQ ID NO: 919960 - DNA, 22 bp, Artificial Sequence
  chemically synthesized
tgcatcatagaatttgggactt

SEQ ID NO: 919961 - DNA, 22 bp, Artificial Sequence
  chemically synthesized
catcatagaatttgggactttc

SEQ ID NO: 919962 - DNA, 22 bp, Artificial Sequence
  chemically synthesized
taaacgtatataattaatagga

SEQ ID NO: 919963 - DNA, 22 bp, Artificial Sequence
  chemically synthesized
gggactttcctattaattatat

SEQ ID NO: 919964 - DNA, 22 bp, Artificial Sequence
  chemically synthesized
ggactttcctattaattatata

SEQ ID NO: 919965 - DNA, 22 bp, Artificial Sequence
  chemically synthesized
tcctattaattatatacgttta

SEQ ID NO: 919966 - DNA, 22 bp, Artificial Sequence
  chemically synthesized
cctattaattatatacgtttat

SEQ ID NO: 919967 - DNA, 22 bp, Artificial Sequence
  chemically synthesized
ctattaattatatacgtttata

SEQ ID NO: 919968 - DNA, 22 bp, Artificial Sequence
  chemically synthesized
ttaattatatacgtttataatt

SEQ ID NO: 919969 - DNA, 22 bp, Artificial Sequence
  chemically synthesized
attatatacgtttataattgtt

SEQ ID NO: 919970 - DNA, 22 bp, Artificial Sequence
  chemically synthesized
agcagaaaatataacaattata

SEQ ID NO: 919971 - DNA, 22 bp, Artificial Sequence
  chemically synthesized
tatacgtttataattgttatat

SEQ ID NO: 919972 - DNA, 22 bp, Artificial Sequence
  chemically synthesized
ataattgttatattttctgctt

SEQ ID NO: 919973 - DNA, 22 bp, Artificial Sequence
  chemically synthesized
taattgttatattttctgctta

SEQ ID NO: 919974 - DNA, 22 bp, Artificial Sequence
  chemically synthesized
tataaggggtcaattaagcaga

SEQ ID NO: 919975 - DNA, 22 bp, Artificial Sequence
  chemically synthesized
ttatattttctgcttaattgac

SEQ ID NO: 919976 - DNA, 22 bp, Artificial Sequence
  chemically synthesized
attatataaggggtcaattaag

SEQ ID NO: 919977 - DNA, 22 bp, Artificial Sequence
  chemically synthesized
aattatataaggggtcaattaa

SEQ ID NO: 919978 - DNA, 22 bp, Artificial Sequence
  chemically synthesized
taattatataaggggtcaatta

SEQ ID NO: 919979 - DNA, 22 bp, Artificial Sequence
  chemically synthesized
tattttctgcttaattgacccc

SEQ ID NO: 919980 - DNA, 22 bp, Artificial Sequence
  chemically synthesized
ttaattatataaggggtcaatt

SEQ ID NO: 919981 - DNA, 22 bp, Artificial Sequence
  chemically synthesized
tctgcttaattgaccccttata

SEQ ID NO: 919982 - DNA, 22 bp, Artificial Sequence
  chemically synthesized
ctgcttaattgaccccttatat

SEQ ID NO: 919983 - DNA, 22 bp, Artificial Sequence
  chemically synthesized
tgcttaattgaccccttatata

SEQ ID NO: 919984 - DNA, 22 bp, Artificial Sequence
  chemically synthesized
cttaattgaccccttatataat

SEQ ID NO: 919985 - DNA, 22 bp, Artificial Sequence
  chemically synthesized
aattgaccccttatataattaa

SEQ ID NO: 919986 - DNA, 22 bp, Artificial Sequence
  chemically synthesized
attgaccccttatataattaaa

SEQ ID NO: 919987 - DNA, 22 bp, Artificial Sequence
  chemically synthesized
accccttatataattaaaaatg

SEQ ID NO: 919988 - DNA, 22 bp, Artificial Sequence
  chemically synthesized
atataattaaaaatgtcttttt

SEQ ID NO: 919989 - DNA, 22 bp, Artificial Sequence
  chemically synthesized
tataattaaaaatgtctttttc

SEQ ID NO: 919990 - DNA, 22 bp, Artificial Sequence
  chemically synthesized
aaaatgtctttttctcttgtta

SEQ ID NO: 919991 - DNA, 22 bp, Artificial Sequence
  chemically synthesized
tgacaaaatatgtaacaagaga

SEQ ID NO: 919992 - DNA, 22 bp, Artificial Sequence
  chemically synthesized
atgacaaaatatgtaacaagag

SEQ ID NO: 919993 - DNA, 22 bp, Artificial Sequence
  chemically synthesized
tatgacaaaatatgtaacaaga

SEQ ID NO: 919994 - DNA, 22 bp, Artificial Sequence
  chemically synthesized
tttctcttgttacatattttgt

SEQ ID NO: 919995 - DNA, 22 bp, Artificial Sequence
  chemically synthesized
ttctcttgttacatattttgtc

SEQ ID NO: 919996 - DNA, 22 bp, Artificial Sequence
  chemically synthesized
tctcttgttacatattttgtca

SEQ ID NO: 919997 - DNA, 22 bp, Artificial Sequence
  chemically synthesized
ctcttgttacatattttgtcat

SEQ ID NO: 919998 - DNA, 22 bp, Artificial Sequence
  chemically synthesized
tcttgttacatattttgtcata

SEQ ID NO: 919999 - DNA, 22 bp, Artificial Sequence
  chemically synthesized
ttgttacatattttgtcataaa

SEQ ID NO: 920000 - DNA, 22 bp, Artificial Sequence
  chemically synthesized
gttacatattttgtcataaagt

SEQ ID NO: 920001 - DNA, 22 bp, Artificial Sequence
  chemically synthesized
ttacatattttgtcataaagtc

SEQ ID NO: 920002 - DNA, 22 bp, Artificial Sequence
  chemically synthesized
catattttgtcataaagtctat

SEQ ID NO: 920003 - DNA, 22 bp, Artificial Sequence
  chemically synthesized
atgtcagacaaaatagacttta

SEQ ID NO: 920004 - DNA, 22 bp, Artificial Sequence
  chemically synthesized
tgtcataaagtctattttgtct

SEQ ID NO: 920005 - DNA, 22 bp, Artificial Sequence
  chemically synthesized
gtcataaagtctattttgtctg

SEQ ID NO: 920006 - DNA, 22 bp, Artificial Sequence
  chemically synthesized
tcataaagtctattttgtctga

SEQ ID NO: 920007 - DNA, 22 bp, Artificial Sequence
  chemically synthesized
ttttgtctgacattagtattgt

SEQ ID NO: 920008 - DNA, 22 bp, Artificial Sequence
  chemically synthesized
tgtctgacattagtattgtcac

SEQ ID NO: 920009 - DNA, 22 bp, Artificial Sequence
  chemically synthesized
gtctgacattagtattgtcact

SEQ ID NO: 920010 - DNA, 22 bp, Artificial Sequence
  chemically synthesized
tctgacattagtattgtcactt

SEQ ID NO: 920011 - DNA, 22 bp, Artificial Sequence
  chemically synthesized
catataaaaaatgaagtgacaa

SEQ ID NO: 920012 - DNA, 22 bp, Artificial Sequence
  chemically synthesized
acatataaaaaatgaagtgaca

SEQ ID NO: 920013 - DNA, 22 bp, Artificial Sequence
  chemically synthesized
acattagtattgtcacttcatt

SEQ ID NO: 920014 - DNA, 22 bp, Artificial Sequence
  chemically synthesized
tttacatataaaaaatgaagtg

SEQ ID NO: 920015 - DNA, 22 bp, Artificial Sequence
  chemically synthesized
gtattgtcacttcattttttat

SEQ ID NO: 920016 - DNA, 22 bp, Artificial Sequence
  chemically synthesized
tgcaaattgtttacatataaaa

SEQ ID NO: 920017 - DNA, 22 bp, Artificial Sequence
  chemically synthesized
tcacttcattttttatatgtaa

SEQ ID NO: 920018 - DNA, 22 bp, Artificial Sequence
  chemically synthesized
cattttttatatgtaaacaatt

SEQ ID NO: 920019 - DNA, 22 bp, Artificial Sequence
  chemically synthesized
attttttatatgtaaacaattt

SEQ ID NO: 920020 - DNA, 22 bp, Artificial Sequence
  chemically synthesized
tttatatgtaaacaatttgcat

SEQ ID NO: 920021 - DNA, 22 bp, Artificial Sequence
  chemically synthesized
ttatatgtaaacaatttgcata

SEQ ID NO: 920022 - DNA, 22 bp, Artificial Sequence
  chemically synthesized
tatatgtaaacaatttgcatag

SEQ ID NO: 920023 - DNA, 22 bp, Artificial Sequence
  chemically synthesized
atatgtaaacaatttgcatagt

SEQ ID NO: 920024 - DNA, 22 bp, Artificial Sequence
  chemically synthesized
tatgtaaacaatttgcatagta

SEQ ID NO: 920025 - DNA, 22 bp, Artificial Sequence
  chemically synthesized
aaagaaaaaagaggtactatgc

SEQ ID NO: 920026 - DNA, 22 bp, Artificial Sequence
  chemically synthesized
caaagaaaaaagaggtactatg

SEQ ID NO: 920027 - DNA, 22 bp, Artificial Sequence
  chemically synthesized
gcatagtacctcttttttcttt

SEQ ID NO: 920028 - DNA, 22 bp, Artificial Sequence
  chemically synthesized
catagtacctcttttttctttg

SEQ ID NO: 920029 - DNA, 22 bp, Artificial Sequence
  chemically synthesized
gagccaaaaccatataatttca

SEQ ID NO: 920030 - DNA, 22 bp, Artificial Sequence
  chemically synthesized
ttttttctttgaaattatatgg

SEQ ID NO: 920031 - DNA, 22 bp, Artificial Sequence
  chemically synthesized
ttttctttgaaattatatggtt

SEQ ID NO: 920032 - DNA, 22 bp, Artificial Sequence
  chemically synthesized
tttctttgaaattatatggttt

SEQ ID NO: 920033 - DNA, 22 bp, Artificial Sequence
  chemically synthesized
ttctttgaaattatatggtttt

SEQ ID NO: 920034 - DNA, 22 bp, Artificial Sequence
  chemically synthesized
tctttgaaattatatggttttg

SEQ ID NO: 920035 - DNA, 22 bp, Artificial Sequence
  chemically synthesized
ctttgaaattatatggttttgg

SEQ ID NO: 920036 - DNA, 22 bp, Artificial Sequence
  chemically synthesized
tttgaaattatatggttttggc

SEQ ID NO: 920037 - DNA, 22 bp, Artificial Sequence
  chemically synthesized
tgaaattatatggttttggctc

SEQ ID NO: 920038 - DNA, 22 bp, Artificial Sequence
  chemically synthesized
gaaattatatggttttggctct

SEQ ID NO: 920039 - DNA, 22 bp, Artificial Sequence
  chemically synthesized
aaattatatggttttggctcta

SEQ ID NO: 920040 - DNA, 22 bp, Artificial Sequence
  chemically synthesized
aaagagaaatgtattagagcca

SEQ ID NO: 920041 - DNA, 22 bp, Artificial Sequence
  chemically synthesized
aaaagagaaatgtattagagcc

SEQ ID NO: 920042 - DNA, 22 bp, Artificial Sequence
  chemically synthesized
tatggttttggctctaatacat

SEQ ID NO: 920043 - DNA, 22 bp, Artificial Sequence
  chemically synthesized
tttaaaagagaaatgtattaga

SEQ ID NO: 920044 - DNA, 22 bp, Artificial Sequence
  chemically synthesized
gtttaaaagagaaatgtattag

SEQ ID NO: 920045 - DNA, 22 bp, Artificial Sequence
  chemically synthesized
tggctctaatacatttctcttt

SEQ ID NO: 920046 - DNA, 22 bp, Artificial Sequence
  chemically synthesized
ggctctaatacatttctctttt

SEQ ID NO: 920047 - DNA, 22 bp, Artificial Sequence
  chemically synthesized
gctctaatacatttctctttta

SEQ ID NO: 920048 - DNA, 22 bp, Artificial Sequence
  chemically synthesized
taatacatttctcttttaaaca

SEQ ID NO: 920049 - DNA, 22 bp, Artificial Sequence
  chemically synthesized
atacatttctcttttaaacaaa

SEQ ID NO: 920050 - DNA, 22 bp, Artificial Sequence
  chemically synthesized
aaatatccaaccatagtttgtt

SEQ ID NO: 920051 - DNA, 22 bp, Artificial Sequence
  chemically synthesized
aaaatatccaaccatagtttgt

SEQ ID NO: 920052 - DNA, 22 bp, Artificial Sequence
  chemically synthesized
ctcttttaaacaaactatggtt

SEQ ID NO: 920053 - DNA, 22 bp, Artificial Sequence
  chemically synthesized
tttaaaatatccaaccatagtt

SEQ ID NO: 920054 - DNA, 22 bp, Artificial Sequence
  chemically synthesized
tcttttaaacaaactatggttg

SEQ ID NO: 920055 - DNA, 22 bp, Artificial Sequence
  chemically synthesized
ttttaaacaaactatggttgga

SEQ ID NO: 920056 - DNA, 22 bp, Artificial Sequence
  chemically synthesized
ttaaacaaactatggttggata

SEQ ID NO: 920057 - DNA, 22 bp, Artificial Sequence
  chemically synthesized
taaacaaactatggttggatat

SEQ ID NO: 920058 - DNA, 22 bp, Artificial Sequence
  chemically synthesized
aaacaaactatggttggatatt

SEQ ID NO: 920059 - DNA, 22 bp, Artificial Sequence
  chemically synthesized
aacaaactatggttggatattt

SEQ ID NO: 920060 - DNA, 22 bp, Artificial Sequence
  chemically synthesized
agacaggattatttaaaatatc

SEQ ID NO: 920061 - DNA, 22 bp, Artificial Sequence
  chemically synthesized
cagacaggattatttaaaatat

SEQ ID NO: 920062 - DNA, 22 bp, Artificial Sequence
  chemically synthesized
tggttggatattttaaataatc

SEQ ID NO: 920063 - DNA, 22 bp, Artificial Sequence
  chemically synthesized
gatattttaaataatcctgtct

SEQ ID NO: 920064 - DNA, 22 bp, Artificial Sequence
  chemically synthesized
taggcagagatttcagacagga

SEQ ID NO: 920065 - DNA, 22 bp, Artificial Sequence
  chemically synthesized
taaataatcctgtctgaaatct

SEQ ID NO: 920066 - DNA, 22 bp, Artificial Sequence
  chemically synthesized
aaataatcctgtctgaaatctc

SEQ ID NO: 920067 - DNA, 22 bp, Artificial Sequence
  chemically synthesized
caattataggcagagatttcag

SEQ ID NO: 920068 - DNA, 22 bp, Artificial Sequence
  chemically synthesized
aataatcctgtctgaaatctct

SEQ ID NO: 920069 - DNA, 22 bp, Artificial Sequence
  chemically synthesized
agcattccaattataggcagag

SEQ ID NO: 920070 - DNA, 22 bp, Artificial Sequence
  chemically synthesized
tctgaaatctctgcctataatt

SEQ ID NO: 920071 - DNA, 22 bp, Artificial Sequence
  chemically synthesized
aaatctctgcctataattggaa

SEQ ID NO: 920072 - DNA, 22 bp, Artificial Sequence
  chemically synthesized
tgcctataattggaatgcttag

SEQ ID NO: 920073 - DNA, 22 bp, Artificial Sequence
  chemically synthesized
cctataattggaatgcttagtt

SEQ ID NO: 920074 - DNA, 22 bp, Artificial Sequence
  chemically synthesized
tagtaaatgggagtgaactaag

SEQ ID NO: 920075 - DNA, 22 bp, Artificial Sequence
  chemically synthesized
taattggaatgcttagttcact

SEQ ID NO: 920076 - DNA, 22 bp, Artificial Sequence
  chemically synthesized
gaatgcttagttcactcccatt

SEQ ID NO: 920077 - DNA, 22 bp, Artificial Sequence
  chemically synthesized
catatcaatagttatagtaaat

SEQ ID NO: 920078 - DNA, 22 bp, Artificial Sequence
  chemically synthesized
agttcactcccatttactataa

SEQ ID NO: 920079 - DNA, 22 bp, Artificial Sequence
  chemically synthesized
gttcactcccatttactataac

SEQ ID NO: 920080 - DNA, 22 bp, Artificial Sequence
  chemically synthesized
actcccatttactataactatt

SEQ ID NO: 920081 - DNA, 22 bp, Artificial Sequence
  chemically synthesized
aacctacatatcaatagttata

SEQ ID NO: 920082 - DNA, 22 bp, Artificial Sequence
  chemically synthesized
ccatttactataactattgata

SEQ ID NO: 920083 - DNA, 22 bp, Artificial Sequence
  chemically synthesized
actataactattgatatgtagg

SEQ ID NO: 920084 - DNA, 22 bp, Artificial Sequence
  chemically synthesized
ctataactattgatatgtaggt

SEQ ID NO: 920085 - DNA, 22 bp, Artificial Sequence
  chemically synthesized
taactattgatatgtaggttga

SEQ ID NO: 920086 - DNA, 22 bp, Artificial Sequence
  chemically synthesized
gatatgggatactcaacctaca

SEQ ID NO: 920087 - DNA, 22 bp, Artificial Sequence
  chemically synthesized
ggatatgggatactcaacctac

SEQ ID NO: 920088 - DNA, 22 bp, Artificial Sequence
  chemically synthesized
tggatatgggatactcaaccta

SEQ ID NO: 920089 - DNA, 22 bp, Artificial Sequence
  chemically synthesized
ttgatatgtaggttgagtatcc

SEQ ID NO: 920090 - DNA, 22 bp, Artificial Sequence
  chemically synthesized
atatgtaggttgagtatcccat

SEQ ID NO: 920091 - DNA, 22 bp, Artificial Sequence
  chemically synthesized
caatcccaagcattttggatat

SEQ ID NO: 920092 - DNA, 22 bp, Artificial Sequence
  chemically synthesized
ccaatcccaagcattttggata

SEQ ID NO: 920093 - DNA, 22 bp, Artificial Sequence
  chemically synthesized
agtatcccatatccaaaatgct

SEQ ID NO: 920094 - DNA, 22 bp, Artificial Sequence
  chemically synthesized
aagaaatccaaaatccaaaaca

SEQ ID NO: 920095 - DNA, 22 bp, Artificial Sequence
  chemically synthesized
gggattggaagtgttttggatt

SEQ ID NO: 920096 - DNA, 22 bp, Artificial Sequence
  chemically synthesized
ggattggaagtgttttggattt

SEQ ID NO: 920097 - DNA, 22 bp, Artificial Sequence
  chemically synthesized
gaagtgttttggattttggatt

SEQ ID NO: 920098 - DNA, 22 bp, Artificial Sequence
  chemically synthesized
caaaatctaaagaaatccaaaa

SEQ ID NO: 920099 - DNA, 22 bp, Artificial Sequence
  chemically synthesized
tggattttggatttctttagat

SEQ ID NO: 920100 - DNA, 22 bp, Artificial Sequence
  chemically synthesized
ggattttggatttctttagatt

SEQ ID NO: 920101 - DNA, 22 bp, Artificial Sequence
  chemically synthesized
gattttggatttctttagattt

SEQ ID NO: 920102 - DNA, 22 bp, Artificial Sequence
  chemically synthesized
tggatttctttagattttgtaa

SEQ ID NO: 920103 - DNA, 22 bp, Artificial Sequence
  chemically synthesized
ggatttctttagattttgtaat

SEQ ID NO: 920104 - DNA, 22 bp, Artificial Sequence
  chemically synthesized
gatttctttagattttgtaata

SEQ ID NO: 920105 - DNA, 22 bp, Artificial Sequence
  chemically synthesized
ggtatatgcaaatattacaaaa

SEQ ID NO: 920106 - DNA, 22 bp, Artificial Sequence
  chemically synthesized
ctttagattttgtaatatttgc

SEQ ID NO: 920107 - DNA, 22 bp, Artificial Sequence
  chemically synthesized
tttagattttgtaatatttgca

SEQ ID NO: 920108 - DNA, 22 bp, Artificial Sequence
  chemically synthesized
tagattttgtaatatttgcata

SEQ ID NO: 920109 - DNA, 22 bp, Artificial Sequence
  chemically synthesized
agattttgtaatatttgcatat

SEQ ID NO: 920110 - DNA, 22 bp, Artificial Sequence
  chemically synthesized
gattttgtaatatttgcatata

SEQ ID NO: 920111 - DNA, 22 bp, Artificial Sequence
  chemically synthesized
caagatattaggtatatgcaaa

SEQ ID NO: 920112 - DNA, 22 bp, Artificial Sequence
  chemically synthesized
tctccaagatattaggtatatg

SEQ ID NO: 920113 - DNA, 22 bp, Artificial Sequence
  chemically synthesized
tgtaatatttgcatatacctaa

SEQ ID NO: 920114 - DNA, 22 bp, Artificial Sequence
  chemically synthesized
gtaatatttgcatatacctaat

SEQ ID NO: 920115 - DNA, 22 bp, Artificial Sequence
  chemically synthesized
taatatttgcatatacctaata

SEQ ID NO: 920116 - DNA, 22 bp, Artificial Sequence
  chemically synthesized
ggtcctatctccaagatattag

SEQ ID NO: 920117 - DNA, 22 bp, Artificial Sequence
  chemically synthesized
aggtcctatctccaagatatta

SEQ ID NO: 920118 - DNA, 22 bp, Artificial Sequence
  chemically synthesized
gcatatacctaatatcttggag

SEQ ID NO: 920119 - DNA, 22 bp, Artificial Sequence
  chemically synthesized
catatacctaatatcttggaga

SEQ ID NO: 920120 - DNA, 22 bp, Artificial Sequence
  chemically synthesized
aacttaggtcctatctccaaga

SEQ ID NO: 920121 - DNA, 22 bp, Artificial Sequence
  chemically synthesized
aaacttaggtcctatctccaag

SEQ ID NO: 920122 - DNA, 22 bp, Artificial Sequence
  chemically synthesized
atatcttggagataggacctaa

SEQ ID NO: 920123 - DNA, 22 bp, Artificial Sequence
  chemically synthesized
ggagataggacctaagtttaaa

SEQ ID NO: 920124 - DNA, 22 bp, Artificial Sequence
  chemically synthesized
gagataggacctaagtttaaac

SEQ ID NO: 920125 - DNA, 22 bp, Artificial Sequence
  chemically synthesized
agtttaaacacacatactatat

SEQ ID NO: 920126 - DNA, 22 bp, Artificial Sequence
  chemically synthesized
aaacacacatactatatatata

SEQ ID NO: 920127 - DNA, 22 bp, Artificial Sequence
  chemically synthesized
aacacacatactatatatatac

SEQ ID NO: 920128 - DNA, 22 bp, Artificial Sequence
  chemically synthesized
tatatatacatatatatatata

SEQ ID NO: 920129 - DNA, 22 bp, Artificial Sequence
  chemically synthesized
agatatatatatatacatatat

SEQ ID NO: 920130 - DNA, 22 bp, Artificial Sequence
  chemically synthesized
ttaagatatatatatatacata

SEQ ID NO: 920131 - DNA, 22 bp, Artificial Sequence
  chemically synthesized
tatgtataagatatctattaag

SEQ ID NO: 920132 - DNA, 22 bp, Artificial Sequence
  chemically synthesized
caggttatatgtataagatatc

SEQ ID NO: 920133 - DNA, 22 bp, Artificial Sequence
  chemically synthesized
cctccaggttatatgtataaga

SEQ ID NO: 920134 - DNA, 22 bp, Artificial Sequence
  chemically synthesized
aatagatatcttatacatataa

SEQ ID NO: 920135 - DNA, 22 bp, Artificial Sequence
  chemically synthesized
atagatatcttatacatataac

SEQ ID NO: 920136 - DNA, 22 bp, Artificial Sequence
  chemically synthesized
taaaattacctccaggttatat

SEQ ID NO: 920137 - DNA, 22 bp, Artificial Sequence
  chemically synthesized
ataaaattacctccaggttata

SEQ ID NO: 920138 - DNA, 22 bp, Artificial Sequence
  chemically synthesized
tataaaattacctccaggttat

SEQ ID NO: 920139 - DNA, 22 bp, Artificial Sequence
  chemically synthesized
atacatataacctggaggtaat

SEQ ID NO: 920140 - DNA, 22 bp, Artificial Sequence
  chemically synthesized
tacatataacctggaggtaatt

SEQ ID NO: 920141 - DNA, 22 bp, Artificial Sequence
  chemically synthesized
agatactttataaaattacctc

SEQ ID NO: 920142 - DNA, 22 bp, Artificial Sequence
  chemically synthesized
aagatactttataaaattacct

SEQ ID NO: 920143 - DNA, 22 bp, Artificial Sequence
  chemically synthesized
tttaagatactttataaaatta

SEQ ID NO: 920144 - DNA, 22 bp, Artificial Sequence
  chemically synthesized
gaggtaattttataaagtatct

SEQ ID NO: 920145 - DNA, 22 bp, Artificial Sequence
  chemically synthesized
atgcaaaaaattatttaagata

SEQ ID NO: 920146 - DNA, 22 bp, Artificial Sequence
  chemically synthesized
catgcaaaaaattatttaagat

SEQ ID NO: 920147 - DNA, 22 bp, Artificial Sequence
  chemically synthesized
tttcatgcaaaaaattatttaa

SEQ ID NO: 920148 - DNA, 22 bp, Artificial Sequence
  chemically synthesized
tataaagtatcttaaataattt

SEQ ID NO: 920149 - DNA, 22 bp, Artificial Sequence
  chemically synthesized
gtttcatgcaaaaaattattta

SEQ ID NO: 920150 - DNA, 22 bp, Artificial Sequence
  chemically synthesized
ataaagtatcttaaataatttt

SEQ ID NO: 920151 - DNA, 22 bp, Artificial Sequence
  chemically synthesized
tgtttcatgcaaaaaattattt

SEQ ID NO: 920152 - DNA, 22 bp, Artificial Sequence
  chemically synthesized
taaagtatcttaaataattttt

SEQ ID NO: 920153 - DNA, 22 bp, Artificial Sequence
  chemically synthesized
aaataattttttgcatgaaaca

SEQ ID NO: 920154 - DNA, 22 bp, Artificial Sequence
  chemically synthesized
aataattttttgcatgaaacaa

SEQ ID NO: 920155 - DNA, 22 bp, Artificial Sequence
  chemically synthesized
tttgcatgaaacaaagttttgg

SEQ ID NO: 920156 - DNA, 22 bp, Artificial Sequence
  chemically synthesized
ttgcatgaaacaaagttttggc

SEQ ID NO: 920157 - DNA, 22 bp, Artificial Sequence
  chemically synthesized
tgcatgaaacaaagttttggct

SEQ ID NO: 920158 - DNA, 22 bp, Artificial Sequence
  chemically synthesized
gcatgaaacaaagttttggctg

SEQ ID NO: 920159 - DNA, 22 bp, Artificial Sequence
  chemically synthesized
catgaaacaaagttttggctgt

SEQ ID NO: 920160 - DNA, 22 bp, Artificial Sequence
  chemically synthesized
taatgagtcacagtcaaaacac

SEQ ID NO: 920161 - DNA, 22 bp, Artificial Sequence
  chemically synthesized
acctgtaatgagtcacagtcaa

SEQ ID NO: 920162 - DNA, 22 bp, Artificial Sequence
  chemically synthesized
tggctgtgttttgactgtgact

SEQ ID NO: 920163 - DNA, 22 bp, Artificial Sequence
  chemically synthesized
ggctgtgttttgactgtgactc

SEQ ID NO: 920164 - DNA, 22 bp, Artificial Sequence
  chemically synthesized
gctgtgttttgactgtgactca

SEQ ID NO: 920165 - DNA, 22 bp, Artificial Sequence
  chemically synthesized
acacctgacctgtaatgagtca

SEQ ID NO: 920166 - DNA, 22 bp, Artificial Sequence
  chemically synthesized
tgttttgactgtgactcattac

SEQ ID NO: 920167 - DNA, 22 bp, Artificial Sequence
  chemically synthesized
cacacctgacctgtaatgagtc

SEQ ID NO: 920168 - DNA, 22 bp, Artificial Sequence
  chemically synthesized
tgactgtgactcattacaggtc

SEQ ID NO: 920169 - DNA, 22 bp, Artificial Sequence
  chemically synthesized
gactgtgactcattacaggtca

SEQ ID NO: 920170 - DNA, 22 bp, Artificial Sequence
  chemically synthesized
actgtgactcattacaggtcag

SEQ ID NO: 920171 - DNA, 22 bp, Artificial Sequence
  chemically synthesized
tgactcattacaggtcaggtgt

SEQ ID NO: 920172 - DNA, 22 bp, Artificial Sequence
  chemically synthesized
attacaggtcaggtgtgaaatt

SEQ ID NO: 920173 - DNA, 22 bp, Artificial Sequence
  chemically synthesized
caggtcaggtgtgaaattttcc

SEQ ID NO: 920174 - DNA, 22 bp, Artificial Sequence
  chemically synthesized
atataataccacaagtggaaaa

SEQ ID NO: 920175 - DNA, 22 bp, Artificial Sequence
  chemically synthesized
aaggttgatataataccacaag

SEQ ID NO: 920176 - DNA, 22 bp, Artificial Sequence
  chemically synthesized
tgaaggttgatataataccaca

SEQ ID NO: 920177 - DNA, 22 bp, Artificial Sequence
  chemically synthesized
ctgaaggttgatataataccac

SEQ ID NO: 920178 - DNA, 22 bp, Artificial Sequence
  chemically synthesized
tctgaaggttgatataatacca

SEQ ID NO: 920179 - DNA, 22 bp, Artificial Sequence
  chemically synthesized
tccacttgtggtattatatcaa

SEQ ID NO: 920180 - DNA, 22 bp, Artificial Sequence
  chemically synthesized
ccacttgtggtattatatcaac

SEQ ID NO: 920181 - DNA, 22 bp, Artificial Sequence
  chemically synthesized
cacttgtggtattatatcaacc

SEQ ID NO: 920182 - DNA, 22 bp, Artificial Sequence
  chemically synthesized
gtggtattatatcaaccttcag

SEQ ID NO: 920183 - DNA, 22 bp, Artificial Sequence
  chemically synthesized
tggtattatatcaaccttcaga

SEQ ID NO: 920184 - DNA, 22 bp, Artificial Sequence
  chemically synthesized
aaatgtgaaactttctgaaggt

SEQ ID NO: 920185 - DNA, 22 bp, Artificial Sequence
  chemically synthesized
taaaatgtgaaactttctgaag

SEQ ID NO: 920186 - DNA, 22 bp, Artificial Sequence
  chemically synthesized
tatcaaccttcagaaagtttca

SEQ ID NO: 920187 - DNA, 22 bp, Artificial Sequence
  chemically synthesized
aaatgctctaaaatgtgaaact

SEQ ID NO: 920188 - DNA, 22 bp, Artificial Sequence
  chemically synthesized
gaaatgctctaaaatgtgaaac

SEQ ID NO: 920189 - DNA, 22 bp, Artificial Sequence
  chemically synthesized
cagaaagtttcacattttagag

SEQ ID NO: 920190 - DNA, 22 bp, Artificial Sequence
  chemically synthesized
aaatttgaaatgctctaaaatg

SEQ ID NO: 920191 - DNA, 22 bp, Artificial Sequence
  chemically synthesized
agaaagtttcacattttagagc

SEQ ID NO: 920192 - DNA, 22 bp, Artificial Sequence
  chemically synthesized
cacattttagagcatttcaaat

SEQ ID NO: 920193 - DNA, 22 bp, Artificial Sequence
  chemically synthesized
aaaaaatctgaaatttgaaatg

SEQ ID NO: 920194 - DNA, 22 bp, Artificial Sequence
  chemically synthesized
acattttagagcatttcaaatt

SEQ ID NO: 920195 - DNA, 22 bp, Artificial Sequence
  chemically synthesized
ccattaaaaaaatctgaaattt

SEQ ID NO: 920196 - DNA, 22 bp, Artificial Sequence
  chemically synthesized
tagagcatttcaaatttcagat

SEQ ID NO: 920197 - DNA, 22 bp, Artificial Sequence
  chemically synthesized
agagcatttcaaatttcagatt

SEQ ID NO: 920198 - DNA, 22 bp, Artificial Sequence
  chemically synthesized
gagcatttcaaatttcagattt

SEQ ID NO: 920199 - DNA, 22 bp, Artificial Sequence
  chemically synthesized
agaattcccattaaaaaaatct

SEQ ID NO: 920200 - DNA, 22 bp, Artificial Sequence
  chemically synthesized
caaatttcagatttttttaatg

SEQ ID NO: 920201 - DNA, 22 bp, Artificial Sequence
  chemically synthesized
aaatttcagatttttttaatgg

SEQ ID NO: 920202 - DNA, 22 bp, Artificial Sequence
  chemically synthesized
aaagttgagaattcccattaaa

SEQ ID NO: 920203 - DNA, 22 bp, Artificial Sequence
  chemically synthesized
cagatttttttaatgggaattc

SEQ ID NO: 920204 - DNA, 22 bp, Artificial Sequence
  chemically synthesized
agatttttttaatgggaattct

SEQ ID NO: 920205 - DNA, 22 bp, Artificial Sequence
  chemically synthesized
caactaaaagttgagaattccc

SEQ ID NO: 920206 - DNA, 22 bp, Artificial Sequence
  chemically synthesized
ttttaatgggaattctcaactt

SEQ ID NO: 920207 - DNA, 22 bp, Artificial Sequence
  chemically synthesized
tttaatgggaattctcaacttt

SEQ ID NO: 920208 - DNA, 22 bp, Artificial Sequence
  chemically synthesized
ttaatgggaattctcaactttt

SEQ ID NO: 920209 - DNA, 22 bp, Artificial Sequence
  chemically synthesized
taatgggaattctcaactttta

SEQ ID NO: 920210 - DNA, 22 bp, Artificial Sequence
  chemically synthesized
aatgggaattctcaacttttag

SEQ ID NO: 920211 - DNA, 22 bp, Artificial Sequence
  chemically synthesized
atgggaattctcaacttttagt

SEQ ID NO: 920212 - DNA, 22 bp, Artificial Sequence
  chemically synthesized
tcaacttttagttgcaattaca

SEQ ID NO: 920213 - DNA, 22 bp, Artificial Sequence
  chemically synthesized
aacttttagttgcaattacatg

SEQ ID NO: 920214 - DNA, 22 bp, Artificial Sequence
  chemically synthesized
ttagttgcaattacatgtgcca

SEQ ID NO: 920215 - DNA, 22 bp, Artificial Sequence
  chemically synthesized
tagttgcaattacatgtgccat

SEQ ID NO: 920216 - DNA, 22 bp, Artificial Sequence
  chemically synthesized
agttgcaattacatgtgccata

SEQ ID NO: 920217 - DNA, 22 bp, Artificial Sequence
  chemically synthesized
gttgcaattacatgtgccatat

SEQ ID NO: 920218 - DNA, 22 bp, Artificial Sequence
  chemically synthesized
caattacatgtgccatattgta

SEQ ID NO: 920219 - DNA, 22 bp, Artificial Sequence
  chemically synthesized
catgtgccatattgtatttttt

SEQ ID NO: 920220 - DNA, 22 bp, Artificial Sequence
  chemically synthesized
tattttttcacatcttattcat

SEQ ID NO: 920221 - DNA, 22 bp, Artificial Sequence
  chemically synthesized
tttcacatcttattcatgtctt

SEQ ID NO: 920222 - DNA, 22 bp, Artificial Sequence
  chemically synthesized
ttcacatcttattcatgtcttt

SEQ ID NO: 920223 - DNA, 22 bp, Artificial Sequence
  chemically synthesized
tcacatcttattcatgtctttt

SEQ ID NO: 920224 - DNA, 22 bp, Artificial Sequence
  chemically synthesized
cacatcttattcatgtcttttt

SEQ ID NO: 920225 - DNA, 22 bp, Artificial Sequence
  chemically synthesized
acatcttattcatgtctttttt

SEQ ID NO: 920226 - DNA, 22 bp, Artificial Sequence
  chemically synthesized
attcatgtcttttttgttcctg

SEQ ID NO: 920227 - DNA, 22 bp, Artificial Sequence
  chemically synthesized
ttcatgtcttttttgttcctgt

SEQ ID NO: 920228 - DNA, 22 bp, Artificial Sequence
  chemically synthesized
atgtcttttttgttcctgtttc

SEQ ID NO: 920229 - DNA, 22 bp, Artificial Sequence
  chemically synthesized
ttttgttcctgtttctccttta

SEQ ID NO: 920230 - DNA, 22 bp, Artificial Sequence
  chemically synthesized
tttgttcctgtttctcctttac

SEQ ID NO: 920231 - DNA, 22 bp, Artificial Sequence
  chemically synthesized
ttgttcctgtttctcctttact

SEQ ID NO: 920232 - DNA, 22 bp, Artificial Sequence
  chemically synthesized
acaagacagtgcagtaaaggag

SEQ ID NO: 920233 - DNA, 22 bp, Artificial Sequence
  chemically synthesized
tgttcctgtttctcctttactg

SEQ ID NO: 920234 - DNA, 22 bp, Artificial Sequence
  chemically synthesized
gttcctgtttctcctttactgc

SEQ ID NO: 920235 - DNA, 22 bp, Artificial Sequence
  chemically synthesized
ttcctgtttctcctttactgca

SEQ ID NO: 920236 - DNA, 22 bp, Artificial Sequence
  chemically synthesized
ctgtttctcctttactgcactg

SEQ ID NO: 920237 - DNA, 22 bp, Artificial Sequence
  chemically synthesized
tttctcctttactgcactgtct

SEQ ID NO: 920238 - DNA, 22 bp, Artificial Sequence
  chemically synthesized
aaaataactaacaagacagtgc

SEQ ID NO: 920239 - DNA, 22 bp, Artificial Sequence
  chemically synthesized
ctcctttactgcactgtcttgt

SEQ ID NO: 920240 - DNA, 22 bp, Artificial Sequence
  chemically synthesized
tcctttactgcactgtcttgtt

SEQ ID NO: 920241 - DNA, 22 bp, Artificial Sequence
  chemically synthesized
ctttactgcactgtcttgttag

SEQ ID NO: 920242 - DNA, 22 bp, Artificial Sequence
  chemically synthesized
cacactaaaaataactaacaag

SEQ ID NO: 920243 - DNA, 22 bp, Artificial Sequence
  chemically synthesized
tactgcactgtcttgttagtta

SEQ ID NO: 920244 - DNA, 22 bp, Artificial Sequence
  chemically synthesized
actgcactgtcttgttagttat

SEQ ID NO: 920245 - DNA, 22 bp, Artificial Sequence
  chemically synthesized
ctgcactgtcttgttagttatt

SEQ ID NO: 920246 - DNA, 22 bp, Artificial Sequence
  chemically synthesized
cactgtcttgttagttattttt

SEQ ID NO: 920247 - DNA, 22 bp, Artificial Sequence
  chemically synthesized
aaattacacactaaaaataact

SEQ ID NO: 920248 - DNA, 22 bp, Artificial Sequence
  chemically synthesized
aaaattacacactaaaaataac

SEQ ID NO: 920249 - DNA, 22 bp, Artificial Sequence
  chemically synthesized
tcttgttagttatttttagtgt

SEQ ID NO: 920250 - DNA, 22 bp, Artificial Sequence
  chemically synthesized
gttagttatttttagtgtgtaa

SEQ ID NO: 920251 - DNA, 22 bp, Artificial Sequence
  chemically synthesized
ttagttatttttagtgtgtaat

SEQ ID NO: 920252 - DNA, 22 bp, Artificial Sequence
  chemically synthesized
gttatttttagtgtgtaatttt

SEQ ID NO: 920253 - DNA, 22 bp, Artificial Sequence
  chemically synthesized
aaaacaaaatttaaaattacac

SEQ ID NO: 920254 - DNA, 22 bp, Artificial Sequence
  chemically synthesized
tttttagtgtgtaattttaaat

SEQ ID NO: 920255 - DNA, 22 bp, Artificial Sequence
  chemically synthesized
ttagtgtgtaattttaaatttt

SEQ ID NO: 920256 - DNA, 22 bp, Artificial Sequence
  chemically synthesized
tagtgtgtaattttaaattttg

SEQ ID NO: 920257 - DNA, 22 bp, Artificial Sequence
  chemically synthesized
agtgtgtaattttaaattttgt

SEQ ID NO: 920258 - DNA, 22 bp, Artificial Sequence
  chemically synthesized
gtgtgtaattttaaattttgtt

SEQ ID NO: 920259 - DNA, 22 bp, Artificial Sequence
  chemically synthesized
agaaaataaatagttaaaaaca

SEQ ID NO: 920260 - DNA, 22 bp, Artificial Sequence
  chemically synthesized
taaattttgtttttaactattt

SEQ ID NO: 920261 - DNA, 22 bp, Artificial Sequence
  chemically synthesized
aaattttgtttttaactattta

SEQ ID NO: 920262 - DNA, 22 bp, Artificial Sequence
  chemically synthesized
aattttgtttttaactatttat

SEQ ID NO: 920263 - DNA, 22 bp, Artificial Sequence
  chemically synthesized
tgtttttaactatttattttct

SEQ ID NO: 920264 - DNA, 22 bp, Artificial Sequence
  chemically synthesized
gagcaagcactaagaaaataaa

SEQ ID NO: 920265 - DNA, 22 bp, Artificial Sequence
  chemically synthesized
gtttttaactatttattttctt

SEQ ID NO: 920266 - DNA, 22 bp, Artificial Sequence
  chemically synthesized
agagcaagcactaagaaaataa

SEQ ID NO: 920267 - DNA, 22 bp, Artificial Sequence
  chemically synthesized
tttttaactatttattttctta

SEQ ID NO: 920268 - DNA, 22 bp, Artificial Sequence
  chemically synthesized
tagagcaagcactaagaaaata

SEQ ID NO: 920269 - DNA, 22 bp, Artificial Sequence
  chemically synthesized
ttaactatttattttcttagtg

SEQ ID NO: 920270 - DNA, 22 bp, Artificial Sequence
  chemically synthesized
taactatttattttcttagtgc

SEQ ID NO: 920271 - DNA, 22 bp, Artificial Sequence
  chemically synthesized
aactatttattttcttagtgct

SEQ ID NO: 920272 - DNA, 22 bp, Artificial Sequence
  chemically synthesized
actatttattttcttagtgctt

SEQ ID NO: 920273 - DNA, 22 bp, Artificial Sequence
  chemically synthesized
tttattttcttagtgcttgctc

SEQ ID NO: 920274 - DNA, 22 bp, Artificial Sequence
  chemically synthesized
attttcttagtgcttgctctaa

SEQ ID NO: 920275 - DNA, 22 bp, Artificial Sequence
  chemically synthesized
ttttcttagtgcttgctctaaa

SEQ ID NO: 920276 - DNA, 22 bp, Artificial Sequence
  chemically synthesized
tcttagtgcttgctctaaagat

SEQ ID NO: 920277 - DNA, 22 bp, Artificial Sequence
  chemically synthesized
cttagtgcttgctctaaagatt

SEQ ID NO: 920278 - DNA, 22 bp, Artificial Sequence
  chemically synthesized
agatgcatatgtaatctttaga

SEQ ID NO: 920279 - DNA, 22 bp, Artificial Sequence
  chemically synthesized
ttagtgcttgctctaaagatta

SEQ ID NO: 920280 - DNA, 22 bp, Artificial Sequence
  chemically synthesized
agtgcttgctctaaagattaca

SEQ ID NO: 920281 - DNA, 22 bp, Artificial Sequence
  chemically synthesized
gtgcttgctctaaagattacat

SEQ ID NO: 920282 - DNA, 22 bp, Artificial Sequence
  chemically synthesized
gctctaaagattacatatgcat

SEQ ID NO: 920283 - DNA, 22 bp, Artificial Sequence
  chemically synthesized
tgatcaattaagatgcatatgt

SEQ ID NO: 920284 - DNA, 22 bp, Artificial Sequence
  chemically synthesized
ctctaaagattacatatgcatc

SEQ ID NO: 920285 - DNA, 22 bp, Artificial Sequence
  chemically synthesized
taaagattacatatgcatctta

SEQ ID NO: 920286 - DNA, 22 bp, Artificial Sequence
  chemically synthesized
aagattacatatgcatcttaat

SEQ ID NO: 920287 - DNA, 22 bp, Artificial Sequence
  chemically synthesized
agtaaattatgatcaattaaga

SEQ ID NO: 920288 - DNA, 22 bp, Artificial Sequence
  chemically synthesized
aagtaaattatgatcaattaag

SEQ ID NO: 920289 - DNA, 22 bp, Artificial Sequence
  chemically synthesized
catatgcatcttaattgatcat

SEQ ID NO: 920290 - DNA, 22 bp, Artificial Sequence
  chemically synthesized
aacttaagtaaattatgatcaa

SEQ ID NO: 920291 - DNA, 22 bp, Artificial Sequence
  chemically synthesized
gaacttaagtaaattatgatca

SEQ ID NO: 920292 - DNA, 22 bp, Artificial Sequence
  chemically synthesized
gtttgaacttaagtaaattatg

SEQ ID NO: 920293 - DNA, 22 bp, Artificial Sequence
  chemically synthesized
aattgatcataatttacttaag

SEQ ID NO: 920294 - DNA, 22 bp, Artificial Sequence
  chemically synthesized
aattagtttgaacttaagtaaa

SEQ ID NO: 920295 - DNA, 22 bp, Artificial Sequence
  chemically synthesized
attgatcataatttacttaagt

SEQ ID NO: 920296 - DNA, 22 bp, Artificial Sequence
  chemically synthesized
atcataatttacttaagttcaa

SEQ ID NO: 920297 - DNA, 22 bp, Artificial Sequence
  chemically synthesized
tgttaaattagtttgaacttaa

SEQ ID NO: 920298 - DNA, 22 bp, Artificial Sequence
  chemically synthesized
ctgtgttaaattagtttgaact

SEQ ID NO: 920299 - DNA, 22 bp, Artificial Sequence
  chemically synthesized
actgtgttaaattagtttgaac

SEQ ID NO: 920300 - DNA, 22 bp, Artificial Sequence
  chemically synthesized
tactgtgttaaattagtttgaa

SEQ ID NO: 920301 - DNA, 22 bp, Artificial Sequence
  chemically synthesized
acttaagttcaaactaatttaa

SEQ ID NO: 920302 - DNA, 22 bp, Artificial Sequence
  chemically synthesized
aattttactgtgttaaattagt

SEQ ID NO: 920303 - DNA, 22 bp, Artificial Sequence
  chemically synthesized
cttaagttcaaactaatttaac

SEQ ID NO: 920304 - DNA, 22 bp, Artificial Sequence
  chemically synthesized
aagttcaaactaatttaacaca

SEQ ID NO: 920305 - DNA, 22 bp, Artificial Sequence
  chemically synthesized
agttcaaactaatttaacacag

SEQ ID NO: 920306 - DNA, 22 bp, Artificial Sequence
  chemically synthesized
aaactaatttaacacagtaaaa

SEQ ID NO: 920307 - DNA, 22 bp, Artificial Sequence
  chemically synthesized
atttaacacagtaaaatttaga

SEQ ID NO: 920308 - DNA, 22 bp, Artificial Sequence
  chemically synthesized
gcagagaaaaatatctaaattt

SEQ ID NO: 920309 - DNA, 22 bp, Artificial Sequence
  chemically synthesized
agcagagaaaaatatctaaatt

SEQ ID NO: 920310 - DNA, 22 bp, Artificial Sequence
  chemically synthesized
aacacagtaaaatttagatatt

SEQ ID NO: 920311 - DNA, 22 bp, Artificial Sequence
  chemically synthesized
acacagtaaaatttagatattt

SEQ ID NO: 920312 - DNA, 22 bp, Artificial Sequence
  chemically synthesized
agatatttttctctgctaagct

SEQ ID NO: 920313 - DNA, 22 bp, Artificial Sequence
  chemically synthesized
gatatttttctctgctaagctc

SEQ ID NO: 920314 - DNA, 22 bp, Artificial Sequence
  chemically synthesized
ttctctgctaagctccattttt

SEQ ID NO: 920315 - DNA, 22 bp, Artificial Sequence
  chemically synthesized
tctctgctaagctccatttttg

SEQ ID NO: 920316 - DNA, 22 bp, Artificial Sequence
  chemically synthesized
ctctgctaagctccatttttgc

SEQ ID NO: 920317 - DNA, 22 bp, Artificial Sequence
  chemically synthesized
taagcaggaggagcaaaaatgg

SEQ ID NO: 920318 - DNA, 22 bp, Artificial Sequence
  chemically synthesized
tctgctaagctccatttttgct

SEQ ID NO: 920319 - DNA, 22 bp, Artificial Sequence
  chemically synthesized
ataagcaggaggagcaaaaatg

SEQ ID NO: 920320 - DNA, 22 bp, Artificial Sequence
  chemically synthesized
tgctaagctccatttttgctcc

SEQ ID NO: 920321 - DNA, 22 bp, Artificial Sequence
  chemically synthesized
ctaagctccatttttgctcctc

SEQ ID NO: 920322 - DNA, 22 bp, Artificial Sequence
  chemically synthesized
tgtttataagcaggaggagcaa

SEQ ID NO: 920323 - DNA, 22 bp, Artificial Sequence
  chemically synthesized
agctccatttttgctcctcctg

SEQ ID NO: 920324 - DNA, 22 bp, Artificial Sequence
  chemically synthesized
ttgtgtttataagcaggaggag

SEQ ID NO: 920325 - DNA, 22 bp, Artificial Sequence
  chemically synthesized
catttttgctcctcctgcttat

SEQ ID NO: 920326 - DNA, 22 bp, Artificial Sequence
  chemically synthesized
tgttattgtgtttataagcagg

SEQ ID NO: 920327 - DNA, 22 bp, Artificial Sequence
  chemically synthesized
ttgctcctcctgcttataaaca

SEQ ID NO: 920328 - DNA, 22 bp, Artificial Sequence
  chemically synthesized
tgctcctcctgcttataaacac

SEQ ID NO: 920329 - DNA, 22 bp, Artificial Sequence
  chemically synthesized
gctcctcctgcttataaacaca

SEQ ID NO: 920330 - DNA, 22 bp, Artificial Sequence
  chemically synthesized
ctcctcctgcttataaacacaa

SEQ ID NO: 920331 - DNA, 22 bp, Artificial Sequence
  chemically synthesized
taacattgtgttattgtgttta

SEQ ID NO: 920332 - DNA, 22 bp, Artificial Sequence
  chemically synthesized
ctcctgcttataaacacaataa

SEQ ID NO: 920333 - DNA, 22 bp, Artificial Sequence
  chemically synthesized
ctgcttataaacacaataacac

SEQ ID NO: 920334 - DNA, 22 bp, Artificial Sequence
  chemically synthesized
cttataaacacaataacacaat

SEQ ID NO: 920335 - DNA, 22 bp, Artificial Sequence
  chemically synthesized
ataaacacaataacacaatgtt

SEQ ID NO: 920336 - DNA, 22 bp, Artificial Sequence
  chemically synthesized
cataaaaattataacattgtgt

SEQ ID NO: 920337 - DNA, 22 bp, Artificial Sequence
  chemically synthesized
taaacacaataacacaatgtta

SEQ ID NO: 920338 - DNA, 22 bp, Artificial Sequence
  chemically synthesized
agattgcataaaaattataaca

SEQ ID NO: 920339 - DNA, 22 bp, Artificial Sequence
  chemically synthesized
aaagacctaagattgcataaaa

SEQ ID NO: 920340 - DNA, 22 bp, Artificial Sequence
  chemically synthesized
aaaagacctaagattgcataaa

SEQ ID NO: 920341 - DNA, 22 bp, Artificial Sequence
  chemically synthesized
taaaagacctaagattgcataa

SEQ ID NO: 920342 - DNA, 22 bp, Artificial Sequence
  chemically synthesized
tttaaaagacctaagattgcat

SEQ ID NO: 920343 - DNA, 22 bp, Artificial Sequence
  chemically synthesized
ctttaaaagacctaagattgca

SEQ ID NO: 920344 - DNA, 22 bp, Artificial Sequence
  chemically synthesized
taatttttatgcaatcttaggt

SEQ ID NO: 920345 - DNA, 22 bp, Artificial Sequence
  chemically synthesized
acttctttaaaagacctaagat

SEQ ID NO: 920346 - DNA, 22 bp, Artificial Sequence
  chemically synthesized
aacttctttaaaagacctaaga

SEQ ID NO: 920347 - DNA, 22 bp, Artificial Sequence
  chemically synthesized
taacttctttaaaagacctaag

SEQ ID NO: 920348 - DNA, 22 bp, Artificial Sequence
  chemically synthesized
ttaacttctttaaaagacctaa

SEQ ID NO: 920349 - DNA, 22 bp, Artificial Sequence
  chemically synthesized
ttatgcaatcttaggtctttta

SEQ ID NO: 920350 - DNA, 22 bp, Artificial Sequence
  chemically synthesized
ttttaacttctttaaaagacct

SEQ ID NO: 920351 - DNA, 22 bp, Artificial Sequence
  chemically synthesized
tatgcaatcttaggtcttttaa

SEQ ID NO: 920352 - DNA, 22 bp, Artificial Sequence
  chemically synthesized
cttttaacttctttaaaagacc

SEQ ID NO: 920353 - DNA, 22 bp, Artificial Sequence
  chemically synthesized
atgcaatcttaggtcttttaaa

SEQ ID NO: 920354 - DNA, 22 bp, Artificial Sequence
  chemically synthesized
tgcaatcttaggtcttttaaag

SEQ ID NO: 920355 - DNA, 22 bp, Artificial Sequence
  chemically synthesized
ttcttttaacttctttaaaaga

SEQ ID NO: 920356 - DNA, 22 bp, Artificial Sequence
  chemically synthesized
cttcttttaacttctttaaaag

SEQ ID NO: 920357 - DNA, 22 bp, Artificial Sequence
  chemically synthesized
tcttcttttaacttctttaaaa

SEQ ID NO: 920358 - DNA, 22 bp, Artificial Sequence
  chemically synthesized
ttcttcttttaacttctttaaa

SEQ ID NO: 920359 - DNA, 22 bp, Artificial Sequence
  chemically synthesized
aggtcttttaaagaagttaaaa

SEQ ID NO: 920360 - DNA, 22 bp, Artificial Sequence
  chemically synthesized
ggtcttttaaagaagttaaaag

SEQ ID NO: 920361 - DNA, 22 bp, Artificial Sequence
  chemically synthesized
ttaaagaagttaaaagaagaaa

SEQ ID NO: 920362 - DNA, 22 bp, Artificial Sequence
  chemically synthesized
taaagaagttaaaagaagaaaa

SEQ ID NO: 920363 - DNA, 22 bp, Artificial Sequence
  chemically synthesized
aaagaagttaaaagaagaaaaa

SEQ ID NO: 920364 - DNA, 22 bp, Artificial Sequence
  chemically synthesized
aagaagttaaaagaagaaaaac

SEQ ID NO: 920365 - DNA, 22 bp, Artificial Sequence
  chemically synthesized
tacaaatatagatatatgtttt

SEQ ID NO: 920366 - DNA, 22 bp, Artificial Sequence
  chemically synthesized
aaagaagaaaaacatatatcta

SEQ ID NO: 920367 - DNA, 22 bp, Artificial Sequence
  chemically synthesized
tatttgtacagtcttttatatg

SEQ ID NO: 920368 - DNA, 22 bp, Artificial Sequence
  chemically synthesized
ataaatatgtagatacatataa

SEQ ID NO: 920369 - DNA, 22 bp, Artificial Sequence
  chemically synthesized
gtacagtcttttatatgtatct

SEQ ID NO: 920370 - DNA, 22 bp, Artificial Sequence
  chemically synthesized
tacagtcttttatatgtatcta

SEQ ID NO: 920371 - DNA, 22 bp, Artificial Sequence
  chemically synthesized
ttatatgtatctacatatttat

SEQ ID NO: 920372 - DNA, 22 bp, Artificial Sequence
  chemically synthesized
tatatgtatctacatatttatc

SEQ ID NO: 920373 - DNA, 22 bp, Artificial Sequence
  chemically synthesized
atatgtatctacatatttatca

SEQ ID NO: 920374 - DNA, 22 bp, Artificial Sequence
  chemically synthesized
tatgtatctacatatttatcag

SEQ ID NO: 920375 - DNA, 22 bp, Artificial Sequence
  chemically synthesized
catatttatcagttctgtgatt

SEQ ID NO: 920376 - DNA, 22 bp, Artificial Sequence
  chemically synthesized
atcagttctgtgattctttatc

SEQ ID NO: 920377 - DNA, 22 bp, Artificial Sequence
  chemically synthesized
tcagttctgtgattctttatct

SEQ ID NO: 920378 - DNA, 22 bp, Artificial Sequence
  chemically synthesized
gaacccaaatgaagagataaag

SEQ ID NO: 920379 - DNA, 22 bp, Artificial Sequence
  chemically synthesized
tgtgattctttatctcttcatt

SEQ ID NO: 920380 - DNA, 22 bp, Artificial Sequence
  chemically synthesized
tgattctttatctcttcatttg

SEQ ID NO: 920381 - DNA, 22 bp, Artificial Sequence
  chemically synthesized
agtaactcgaacccaaatgaag

SEQ ID NO: 920382 - DNA, 22 bp, Artificial Sequence
  chemically synthesized
tttatctcttcatttgggttcg

SEQ ID NO: 920383 - DNA, 22 bp, Artificial Sequence
  chemically synthesized
tatctcttcatttgggttcgag

SEQ ID NO: 920384 - DNA, 22 bp, Artificial Sequence
  chemically synthesized
atctcttcatttgggttcgagt

SEQ ID NO: 920385 - DNA, 22 bp, Artificial Sequence
  chemically synthesized
tctcttcatttgggttcgagtt

SEQ ID NO: 920386 - DNA, 22 bp, Artificial Sequence
  chemically synthesized
ttcatttgggttcgagttactg

SEQ ID NO: 920387 - DNA, 22 bp, Artificial Sequence
  chemically synthesized
catttgggttcgagttactgaa

SEQ ID NO: 920388 - DNA, 22 bp, Artificial Sequence
  chemically synthesized
atttgggttcgagttactgaat

SEQ ID NO: 920389 - DNA, 22 bp, Artificial Sequence
  chemically synthesized
aaaagaagtgatattcagtaac

SEQ ID NO: 920390 - DNA, 22 bp, Artificial Sequence
  chemically synthesized
gggttcgagttactgaatatca

SEQ ID NO: 920391 - DNA, 22 bp, Artificial Sequence
  chemically synthesized
ggttcgagttactgaatatcac

SEQ ID NO: 920392 - DNA, 22 bp, Artificial Sequence
  chemically synthesized
aggctgaaaagaagtgatattc

SEQ ID NO: 920393 - DNA, 22 bp, Artificial Sequence
  chemically synthesized
gagttactgaatatcacttctt

SEQ ID NO: 920394 - DNA, 22 bp, Artificial Sequence
  chemically synthesized
ctgaatatcacttcttttcagc

SEQ ID NO: 920395 - DNA, 22 bp, Artificial Sequence
  chemically synthesized
aatatcacttcttttcagcctg

SEQ ID NO: 920396 - DNA, 22 bp, Artificial Sequence
  chemically synthesized
aataaagtcattcaggctgaaa

SEQ ID NO: 920397 - DNA, 22 bp, Artificial Sequence
  chemically synthesized
cttttcagcctgaatgacttta

SEQ ID NO: 920398 - DNA, 22 bp, Artificial Sequence
  chemically synthesized
ttttcagcctgaatgactttat

SEQ ID NO: 920399 - DNA, 22 bp, Artificial Sequence
  chemically synthesized
ttcagcctgaatgactttattt

SEQ ID NO: 920400 - DNA, 22 bp, Artificial Sequence
  chemically synthesized
caagaaaaaactaaataaagtc

SEQ ID NO: 920401 - DNA, 22 bp, Artificial Sequence
  chemically synthesized
tcagcctgaatgactttattta

SEQ ID NO: 920402 - DNA, 22 bp, Artificial Sequence
  chemically synthesized
acaagaaaaaactaaataaagt

SEQ ID NO: 920403 - DNA, 22 bp, Artificial Sequence
  chemically synthesized
cagcctgaatgactttatttag

SEQ ID NO: 920404 - DNA, 22 bp, Artificial Sequence
  chemically synthesized
agcctgaatgactttatttagt

SEQ ID NO: 920405 - DNA, 22 bp, Artificial Sequence
  chemically synthesized
acttacaagaaaaaactaaata

SEQ ID NO: 920406 - DNA, 22 bp, Artificial Sequence
  chemically synthesized
aatgactttatttagttttttc

SEQ ID NO: 920407 - DNA, 22 bp, Artificial Sequence
  chemically synthesized
acctgacttacaagaaaaaact

SEQ ID NO: 920408 - DNA, 22 bp, Artificial Sequence
  chemically synthesized
gctgacctgacttacaagaaaa

SEQ ID NO: 920409 - DNA, 22 bp, Artificial Sequence
  chemically synthesized
tatttagttttttcttgtaagt

SEQ ID NO: 920410 - DNA, 22 bp, Artificial Sequence
  chemically synthesized
ctagctgacctgacttacaaga

SEQ ID NO: 920411 - DNA, 22 bp, Artificial Sequence
  chemically synthesized
atttagttttttcttgtaagtc

SEQ ID NO: 920412 - DNA, 22 bp, Artificial Sequence
  chemically synthesized
gctagctgacctgacttacaag

SEQ ID NO: 920413 - DNA, 22 bp, Artificial Sequence
  chemically synthesized
tttagttttttcttgtaagtca

SEQ ID NO: 920414 - DNA, 22 bp, Artificial Sequence
  chemically synthesized
ttgctagctgacctgacttaca

SEQ ID NO: 920415 - DNA, 22 bp, Artificial Sequence
  chemically synthesized
cttgctagctgacctgacttac

SEQ ID NO: 920416 - DNA, 22 bp, Artificial Sequence
  chemically synthesized
agttttttcttgtaagtcaggt

SEQ ID NO: 920417 - DNA, 22 bp, Artificial Sequence
  chemically synthesized
gttttttcttgtaagtcaggtc

SEQ ID NO: 920418 - DNA, 22 bp, Artificial Sequence
  chemically synthesized
tttcttgtaagtcaggtcagct

SEQ ID NO: 920419 - DNA, 22 bp, Artificial Sequence
  chemically synthesized
ttcttgtaagtcaggtcagcta

SEQ ID NO: 920420 - DNA, 22 bp, Artificial Sequence
  chemically synthesized
tcttgtaagtcaggtcagctag

SEQ ID NO: 920421 - DNA, 22 bp, Artificial Sequence
  chemically synthesized
cttgtaagtcaggtcagctagc

SEQ ID NO: 920422 - DNA, 22 bp, Artificial Sequence
  chemically synthesized
ttgtaagtcaggtcagctagca

SEQ ID NO: 920423 - DNA, 22 bp, Artificial Sequence
  chemically synthesized
gtaagtcaggtcagctagcaag

SEQ ID NO: 920424 - DNA, 22 bp, Artificial Sequence
  chemically synthesized
taagtcaggtcagctagcaaga

SEQ ID NO: 920425 - DNA, 22 bp, Artificial Sequence
  chemically synthesized
agaatgagaatatttcttgcta

SEQ ID NO: 920426 - DNA, 22 bp, Artificial Sequence
  chemically synthesized
ccaagttgagaatgagaatatt

SEQ ID NO: 920427 - DNA, 22 bp, Artificial Sequence
  chemically synthesized
gcaagaaatattctcattctca

SEQ ID NO: 920428 - DNA, 22 bp, Artificial Sequence
  chemically synthesized
tcattctcaacttggtaatata

SEQ ID NO: 920429 - DNA, 22 bp, Artificial Sequence
  chemically synthesized
attctcaacttggtaatatatt

SEQ ID NO: 920430 - DNA, 22 bp, Artificial Sequence
  chemically synthesized
tcaacttggtaatatatttatt

SEQ ID NO: 920431 - DNA, 22 bp, Artificial Sequence
  chemically synthesized
aacttggtaatatatttatttt

SEQ ID NO: 920432 - DNA, 22 bp, Artificial Sequence
  chemically synthesized
aaaaatataggtaaaataaata

SEQ ID NO: 920433 - DNA, 22 bp, Artificial Sequence
  chemically synthesized
caaaaatataggtaaaataaat

SEQ ID NO: 920434 - DNA, 22 bp, Artificial Sequence
  chemically synthesized
ggtaatatatttattttaccta

SEQ ID NO: 920435 - DNA, 22 bp, Artificial Sequence
  chemically synthesized
gtaatatatttattttacctat

SEQ ID NO: 920436 - DNA, 22 bp, Artificial Sequence
  chemically synthesized
tccttcaaaaatataggtaaaa

SEQ ID NO: 920437 - DNA, 22 bp, Artificial Sequence
  chemically synthesized
attttacctatatttttgaagg

SEQ ID NO: 920438 - DNA, 22 bp, Artificial Sequence
  chemically synthesized
ttttacctatatttttgaagga

SEQ ID NO: 920439 - DNA, 22 bp, Artificial Sequence
  chemically synthesized
tacctatatttttgaaggatag

SEQ ID NO: 920440 - DNA, 22 bp, Artificial Sequence
  chemically synthesized
acctatatttttgaaggatagt

SEQ ID NO: 920441 - DNA, 22 bp, Artificial Sequence
  chemically synthesized
cctatatttttgaaggatagtt

SEQ ID NO: 920442 - DNA, 22 bp, Artificial Sequence
  chemically synthesized
cgcataaaacaaaactatcctt

SEQ ID NO: 920443 - DNA, 22 bp, Artificial Sequence
  chemically synthesized
tatttttgaaggatagttttgt

SEQ ID NO: 920444 - DNA, 22 bp, Artificial Sequence
  chemically synthesized
ttgaaggatagttttgttttat

SEQ ID NO: 920445 - DNA, 22 bp, Artificial Sequence
  chemically synthesized
tgaaggatagttttgttttatg

SEQ ID NO: 920446 - DNA, 22 bp, Artificial Sequence
  chemically synthesized
gaaggatagttttgttttatgc

SEQ ID NO: 920447 - DNA, 22 bp, Artificial Sequence
  chemically synthesized
aaggatagttttgttttatgcg

SEQ ID NO: 920448 - DNA, 22 bp, Artificial Sequence
  chemically synthesized
ccaaccaagaattccgcataaa

SEQ ID NO: 920449 - DNA, 22 bp, Artificial Sequence
  chemically synthesized
tgttttatgcggaattcttggt

SEQ ID NO: 920450 - DNA, 22 bp, Artificial Sequence
  chemically synthesized
gttttatgcggaattcttggtt

SEQ ID NO: 920451 - DNA, 22 bp, Artificial Sequence
  chemically synthesized
ttttatgcggaattcttggttg

SEQ ID NO: 920452 - DNA, 22 bp, Artificial Sequence
  chemically synthesized
tatgcggaattcttggttggca

SEQ ID NO: 920453 - DNA, 22 bp, Artificial Sequence
  chemically synthesized
atgcggaattcttggttggcaa

SEQ ID NO: 920454 - DNA, 22 bp, Artificial Sequence
  chemically synthesized
tgcggaattcttggttggcaat

SEQ ID NO: 920455 - DNA, 22 bp, Artificial Sequence
  chemically synthesized
agagaacacaaaattgccaacc

SEQ ID NO: 920456 - DNA, 22 bp, Artificial Sequence
  chemically synthesized
tcagagaacacaaaattgccaa

SEQ ID NO: 920457 - DNA, 22 bp, Artificial Sequence
  chemically synthesized
agagttctcagagaacacaaaa

SEQ ID NO: 920458 - DNA, 22 bp, Artificial Sequence
  chemically synthesized
ttggttggcaattttgtgttct

SEQ ID NO: 920459 - DNA, 22 bp, Artificial Sequence
  chemically synthesized
ggttggcaattttgtgttctct

SEQ ID NO: 920460 - DNA, 22 bp, Artificial Sequence
  chemically synthesized
gttggcaattttgtgttctctg

SEQ ID NO: 920461 - DNA, 22 bp, Artificial Sequence
  chemically synthesized
gcaattttgtgttctctgagaa

SEQ ID NO: 920462 - DNA, 22 bp, Artificial Sequence
  chemically synthesized
aaatgacatattcagagttctc

SEQ ID NO: 920463 - DNA, 22 bp, Artificial Sequence
  chemically synthesized
tgtgttctctgagaactctgaa

SEQ ID NO: 920464 - DNA, 22 bp, Artificial Sequence
  chemically synthesized
gtgttctctgagaactctgaat

SEQ ID NO: 920465 - DNA, 22 bp, Artificial Sequence
  chemically synthesized
tgttctctgagaactctgaata

SEQ ID NO: 920466 - DNA, 22 bp, Artificial Sequence
  chemically synthesized
tctgagaactctgaatatgtca

SEQ ID NO: 920467 - DNA, 22 bp, Artificial Sequence
  chemically synthesized
tgagaactctgaatatgtcatt

SEQ ID NO: 920468 - DNA, 22 bp, Artificial Sequence
  chemically synthesized
agaactctgaatatgtcatttc

SEQ ID NO: 920469 - DNA, 22 bp, Artificial Sequence
  chemically synthesized
tgaatatgtcatttcaatacct

SEQ ID NO: 920470 - DNA, 22 bp, Artificial Sequence
  chemically synthesized
aatatgtcatttcaatacctct

SEQ ID NO: 920471 - DNA, 22 bp, Artificial Sequence
  chemically synthesized
atcataaacaatagaggccaga

SEQ ID NO: 920472 - DNA, 22 bp, Artificial Sequence
  chemically synthesized
tcatcataaacaatagaggcca

SEQ ID NO: 920473 - DNA, 22 bp, Artificial Sequence
  chemically synthesized
ctcatcataaacaatagaggcc

SEQ ID NO: 920474 - DNA, 22 bp, Artificial Sequence
  chemically synthesized
caatacctctggcctctattgt

SEQ ID NO: 920475 - DNA, 22 bp, Artificial Sequence
  chemically synthesized
aatacctctggcctctattgtt

SEQ ID NO: 920476 - DNA, 22 bp, Artificial Sequence
  chemically synthesized
atttctcatcataaacaataga

SEQ ID NO: 920477 - DNA, 22 bp, Artificial Sequence
  chemically synthesized
tggcctctattgtttatgatga

SEQ ID NO: 920478 - DNA, 22 bp, Artificial Sequence
  chemically synthesized
atagttaatttctcatcataaa

SEQ ID NO: 920479 - DNA, 22 bp, Artificial Sequence
  chemically synthesized
gcctctattgtttatgatgaga

SEQ ID NO: 920480 - DNA, 22 bp, Artificial Sequence
  chemically synthesized
tattgtttatgatgagaaatta

SEQ ID NO: 920481 - DNA, 22 bp, Artificial Sequence
  chemically synthesized
ttgtttatgatgagaaattaac

SEQ ID NO: 920482 - DNA, 22 bp, Artificial Sequence
  chemically synthesized
tttatgatgagaaattaactat

SEQ ID NO: 920483 - DNA, 22 bp, Artificial Sequence
  chemically synthesized
atgatgagaaattaactatcaa

SEQ ID NO: 920484 - DNA, 22 bp, Artificial Sequence
  chemically synthesized
tgatgagaaattaactatcaat

SEQ ID NO: 920485 - DNA, 22 bp, Artificial Sequence
  chemically synthesized
atgtacagggatcacatgattg

SEQ ID NO: 920486 - DNA, 22 bp, Artificial Sequence
  chemically synthesized
ctcatgtacagggatcacatga

SEQ ID NO: 920487 - DNA, 22 bp, Artificial Sequence
  chemically synthesized
actatcaatcatgtgatccctg

SEQ ID NO: 920488 - DNA, 22 bp, Artificial Sequence
  chemically synthesized
tcaatcatgtgatccctgtaca

SEQ ID NO: 920489 - DNA, 22 bp, Artificial Sequence
  chemically synthesized
aaacaaccagaaaaaaatgact

SEQ ID NO: 920490 - DNA, 22 bp, Artificial Sequence
  chemically synthesized
aaaacaaccagaaaaaaatgac

SEQ ID NO: 920491 - DNA, 22 bp, Artificial Sequence
  chemically synthesized
taaaacaaccagaaaaaaatga

SEQ ID NO: 920492 - DNA, 22 bp, Artificial Sequence
  chemically synthesized
tacatgaggagtcatttttttc

SEQ ID NO: 920493 - DNA, 22 bp, Artificial Sequence
  chemically synthesized
ttttctggttgttttaaagact

SEQ ID NO: 920494 - DNA, 22 bp, Artificial Sequence
  chemically synthesized
tttctggttgttttaaagactt

SEQ ID NO: 920495 - DNA, 22 bp, Artificial Sequence
  chemically synthesized
ttctggttgttttaaagacttt

SEQ ID NO: 920496 - DNA, 22 bp, Artificial Sequence
  chemically synthesized
tctggttgttttaaagactttc

SEQ ID NO: 920497 - DNA, 22 bp, Artificial Sequence
  chemically synthesized
aaagacaaatgggaaagtcttt

SEQ ID NO: 920498 - DNA, 22 bp, Artificial Sequence
  chemically synthesized
ctggttgttttaaagactttcc

SEQ ID NO: 920499 - DNA, 22 bp, Artificial Sequence
  chemically synthesized
tggttgttttaaagactttccc

SEQ ID NO: 920500 - DNA, 22 bp, Artificial Sequence
  chemically synthesized
ttgaaagacaaatgggaaagtc

SEQ ID NO: 920501 - DNA, 22 bp, Artificial Sequence
  chemically synthesized
gttgttttaaagactttcccat

SEQ ID NO: 920502 - DNA, 22 bp, Artificial Sequence
  chemically synthesized
ttttaaagactttcccatttgt

SEQ ID NO: 920503 - DNA, 22 bp, Artificial Sequence
  chemically synthesized
aaattattgaaagacaaatggg

SEQ ID NO: 920504 - DNA, 22 bp, Artificial Sequence
  chemically synthesized
gaaattattgaaagacaaatgg

SEQ ID NO: 920505 - DNA, 22 bp, Artificial Sequence
  chemically synthesized
taaagactttcccatttgtctt

SEQ ID NO: 920506 - DNA, 22 bp, Artificial Sequence
  chemically synthesized
aaagactttcccatttgtcttt

SEQ ID NO: 920507 - DNA, 22 bp, Artificial Sequence
  chemically synthesized
aagactttcccatttgtctttc

SEQ ID NO: 920508 - DNA, 22 bp, Artificial Sequence
  chemically synthesized
atttgaaattattgaaagacaa

SEQ ID NO: 920509 - DNA, 22 bp, Artificial Sequence
  chemically synthesized
catttgaaattattgaaagaca

SEQ ID NO: 920510 - DNA, 22 bp, Artificial Sequence
  chemically synthesized
tcccatttgtctttcaataatt

SEQ ID NO: 920511 - DNA, 22 bp, Artificial Sequence
  chemically synthesized
cccatttgtctttcaataattt

SEQ ID NO: 920512 - DNA, 22 bp, Artificial Sequence
  chemically synthesized
ccatttgtctttcaataatttc

SEQ ID NO: 920513 - DNA, 22 bp, Artificial Sequence
  chemically synthesized
aaatagtttcatttgaaattat

SEQ ID NO: 920514 - DNA, 22 bp, Artificial Sequence
  chemically synthesized
ttgaaatagtttcatttgaaat

SEQ ID NO: 920515 - DNA, 22 bp, Artificial Sequence
  chemically synthesized
gtctttcaataatttcaaatga

SEQ ID NO: 920516 - DNA, 22 bp, Artificial Sequence
  chemically synthesized
tctttcaataatttcaaatgaa

SEQ ID NO: 920517 - DNA, 22 bp, Artificial Sequence
  chemically synthesized
tcaataatttcaaatgaaacta

SEQ ID NO: 920518 - DNA, 22 bp, Artificial Sequence
  chemically synthesized
caataatttcaaatgaaactat

SEQ ID NO: 920519 - DNA, 22 bp, Artificial Sequence
  chemically synthesized
aataatttcaaatgaaactatt

SEQ ID NO: 920520 - DNA, 22 bp, Artificial Sequence
  chemically synthesized
caaatgaaactatttcaatagt

SEQ ID NO: 920521 - DNA, 22 bp, Artificial Sequence
  chemically synthesized
aaatgaaactatttcaatagtt

SEQ ID NO: 920522 - DNA, 22 bp, Artificial Sequence
  chemically synthesized
aaacataagagtcaaactattg

SEQ ID NO: 920523 - DNA, 22 bp, Artificial Sequence
  chemically synthesized
tttcaatagtttgactcttatg

SEQ ID NO: 920524 - DNA, 22 bp, Artificial Sequence
  chemically synthesized
caatagtttgactcttatgttt

SEQ ID NO: 920525 - DNA, 22 bp, Artificial Sequence
  chemically synthesized
aatagtttgactcttatgtttt

SEQ ID NO: 920526 - DNA, 22 bp, Artificial Sequence
  chemically synthesized
gactcttatgttttagggtatt

SEQ ID NO: 920527 - DNA, 22 bp, Artificial Sequence
  chemically synthesized
actcttatgttttagggtattg

SEQ ID NO: 920528 - DNA, 22 bp, Artificial Sequence
  chemically synthesized
ttatgttttagggtattgatct

SEQ ID NO: 920529 - DNA, 22 bp, Artificial Sequence
  chemically synthesized
atgttttagggtattgatctct

SEQ ID NO: 920530 - DNA, 22 bp, Artificial Sequence
  chemically synthesized
tgttttagggtattgatctctt

SEQ ID NO: 920531 - DNA, 22 bp, Artificial Sequence
  chemically synthesized
tagggtattgatctcttcgtgt

SEQ ID NO: 920532 - DNA, 22 bp, Artificial Sequence
  chemically synthesized
agggtattgatctcttcgtgtt

SEQ ID NO: 920533 - DNA, 22 bp, Artificial Sequence
  chemically synthesized
gggtattgatctcttcgtgttt

SEQ ID NO: 920534 - DNA, 22 bp, Artificial Sequence
  chemically synthesized
aacaaaccccaaatagaataaa

SEQ ID NO: 920535 - DNA, 22 bp, Artificial Sequence
  chemically synthesized
atctcttcgtgtttattctatt

SEQ ID NO: 920536 - DNA, 22 bp, Artificial Sequence
  chemically synthesized
agctcaacaaaccccaaataga

SEQ ID NO: 920537 - DNA, 22 bp, Artificial Sequence
  chemically synthesized
ttcgtgtttattctatttgggg

SEQ ID NO: 920538 - DNA, 22 bp, Artificial Sequence
  chemically synthesized
cgtgtttattctatttggggtt

SEQ ID NO: 920539 - DNA, 22 bp, Artificial Sequence
  chemically synthesized
gtgtttattctatttggggttt

SEQ ID NO: 920540 - DNA, 22 bp, Artificial Sequence
  chemically synthesized
attctatttggggtttgttgag

SEQ ID NO: 920541 - DNA, 22 bp, Artificial Sequence
  chemically synthesized
ttctatttggggtttgttgagc

SEQ ID NO: 920542 - DNA, 22 bp, Artificial Sequence
  chemically synthesized
acaaatacggttaagctcaaca

SEQ ID NO: 920543 - DNA, 22 bp, Artificial Sequence
  chemically synthesized
tatttggggtttgttgagctta

SEQ ID NO: 920544 - DNA, 22 bp, Artificial Sequence
  chemically synthesized
cacaaatacggttaagctcaac

SEQ ID NO: 920545 - DNA, 22 bp, Artificial Sequence
  chemically synthesized
tttggggtttgttgagcttaac

SEQ ID NO: 920546 - DNA, 22 bp, Artificial Sequence
  chemically synthesized
ggggtttgttgagcttaaccgt

SEQ ID NO: 920547 - DNA, 22 bp, Artificial Sequence
  chemically synthesized
gggtttgttgagcttaaccgta

SEQ ID NO: 920548 - DNA, 22 bp, Artificial Sequence
  chemically synthesized
gttgagcttaaccgtatttgtg

SEQ ID NO: 920549 - DNA, 22 bp, Artificial Sequence
  chemically synthesized
ttgagcttaaccgtatttgtga

SEQ ID NO: 920550 - DNA, 22 bp, Artificial Sequence
  chemically synthesized
agcttaaccgtatttgtgaagt

SEQ ID NO: 920551 - DNA, 22 bp, Artificial Sequence
  chemically synthesized
aaccgtatttgtgaagtgtttg

SEQ ID NO: 920552 - DNA, 22 bp, Artificial Sequence
  chemically synthesized
accgtatttgtgaagtgtttgg

SEQ ID NO: 920553 - DNA, 22 bp, Artificial Sequence
  chemically synthesized
aagaaataatggccaaacactt

SEQ ID NO: 920554 - DNA, 22 bp, Artificial Sequence
  chemically synthesized
gaagaaataatggccaaacact

SEQ ID NO: 920555 - DNA, 22 bp, Artificial Sequence
  chemically synthesized
tttgaagaaataatggccaaac

SEQ ID NO: 920556 - DNA, 22 bp, Artificial Sequence
  chemically synthesized
gtgaagtgtttggccattattt

SEQ ID NO: 920557 - DNA, 22 bp, Artificial Sequence
  chemically synthesized
tgaagtgtttggccattatttc

SEQ ID NO: 920558 - DNA, 22 bp, Artificial Sequence
  chemically synthesized
ggccattatttcttcaaataat

SEQ ID NO: 920559 - DNA, 22 bp, Artificial Sequence
  chemically synthesized
gccattatttcttcaaataatt

SEQ ID NO: 920560 - DNA, 22 bp, Artificial Sequence
  chemically synthesized
aagaggcagaaaaattatttga

SEQ ID NO: 920561 - DNA, 22 bp, Artificial Sequence
  chemically synthesized
ttaaagaggcagaaaaattatt

SEQ ID NO: 920562 - DNA, 22 bp, Artificial Sequence
  chemically synthesized
tttcttcaaataatttttctgc

SEQ ID NO: 920563 - DNA, 22 bp, Artificial Sequence
  chemically synthesized
cttcaaataatttttctgcctc

SEQ ID NO: 920564 - DNA, 22 bp, Artificial Sequence
  chemically synthesized
ttcaaataatttttctgcctct

SEQ ID NO: 920565 - DNA, 22 bp, Artificial Sequence
  chemically synthesized
caaataatttttctgcctcttt

SEQ ID NO: 920566 - DNA, 22 bp, Artificial Sequence
  chemically synthesized
aaataatttttctgcctcttta

SEQ ID NO: 920567 - DNA, 22 bp, Artificial Sequence
  chemically synthesized
ttctgcctctttaacaacattc

SEQ ID NO: 920568 - DNA, 22 bp, Artificial Sequence
  chemically synthesized
cagaaaaaaagagaatgttgtt

SEQ ID NO: 920569 - DNA, 22 bp, Artificial Sequence
  chemically synthesized
tctgcctctttaacaacattct

SEQ ID NO: 920570 - DNA, 22 bp, Artificial Sequence
  chemically synthesized
ctgcctctttaacaacattctc

SEQ ID NO: 920571 - DNA, 22 bp, Artificial Sequence
  chemically synthesized
tgcctctttaacaacattctct

SEQ ID NO: 920572 - DNA, 22 bp, Artificial Sequence
  chemically synthesized
cctctttaacaacattctcttt

SEQ ID NO: 920573 - DNA, 22 bp, Artificial Sequence
  chemically synthesized
tttaacaacattctcttttttt

SEQ ID NO: 920574 - DNA, 22 bp, Artificial Sequence
  chemically synthesized
caagagttccagaaaaaaagag

SEQ ID NO: 920575 - DNA, 22 bp, Artificial Sequence
  chemically synthesized
taacaacattctctttttttct

SEQ ID NO: 920576 - DNA, 22 bp, Artificial Sequence
  chemically synthesized
aacaacattctctttttttctg

SEQ ID NO: 920577 - DNA, 22 bp, Artificial Sequence
  chemically synthesized
acaacattctctttttttctgg

SEQ ID NO: 920578 - DNA, 22 bp, Artificial Sequence
  chemically synthesized
tctttttttctggaactcttgt

SEQ ID NO: 920579 - DNA, 22 bp, Artificial Sequence
  chemically synthesized
tttttttctggaactcttgtaa

SEQ ID NO: 920580 - DNA, 22 bp, Artificial Sequence
  chemically synthesized
tttttctggaactcttgtaaca

SEQ ID NO: 920581 - DNA, 22 bp, Artificial Sequence
  chemically synthesized
ttttctggaactcttgtaacat

SEQ ID NO: 920582 - DNA, 22 bp, Artificial Sequence
  chemically synthesized
tttctggaactcttgtaacatc

SEQ ID NO: 920583 - DNA, 22 bp, Artificial Sequence
  chemically synthesized
ttctggaactcttgtaacatct

SEQ ID NO: 920584 - DNA, 22 bp, Artificial Sequence
  chemically synthesized
tctggaactcttgtaacatcta

SEQ ID NO: 920585 - DNA, 22 bp, Artificial Sequence
  chemically synthesized
agcatatcaatgtagatgttac

SEQ ID NO: 920586 - DNA, 22 bp, Artificial Sequence
  chemically synthesized
ctggaactcttgtaacatctac

SEQ ID NO: 920587 - DNA, 22 bp, Artificial Sequence
  chemically synthesized
tggaactcttgtaacatctaca

SEQ ID NO: 920588 - DNA, 22 bp, Artificial Sequence
  chemically synthesized
gaactcttgtaacatctacatt

SEQ ID NO: 920589 - DNA, 22 bp, Artificial Sequence
  chemically synthesized
ttgtaacatctacattgatatg

SEQ ID NO: 920590 - DNA, 22 bp, Artificial Sequence
  chemically synthesized
gtaacatctacattgatatgct

SEQ ID NO: 920591 - DNA, 22 bp, Artificial Sequence
  chemically synthesized
taacatctacattgatatgctc

SEQ ID NO: 920592 - DNA, 22 bp, Artificial Sequence
  chemically synthesized
tgtcaaaacattgagcatatca

SEQ ID NO: 920593 - DNA, 22 bp, Artificial Sequence
  chemically synthesized
gtgtcaaaacattgagcatatc

SEQ ID NO: 920594 - DNA, 22 bp, Artificial Sequence
  chemically synthesized
tgtgtcaaaacattgagcatat

SEQ ID NO: 920595 - DNA, 22 bp, Artificial Sequence
  chemically synthesized
cattgatatgctcaatgttttg

SEQ ID NO: 920596 - DNA, 22 bp, Artificial Sequence
  chemically synthesized
atatgctcaatgttttgacaca

SEQ ID NO: 920597 - DNA, 22 bp, Artificial Sequence
  chemically synthesized
aatgttttgacacaaagctatg

SEQ ID NO: 920598 - DNA, 22 bp, Artificial Sequence
  chemically synthesized
tgacacaaagctatgactcatg

SEQ ID NO: 920599 - DNA, 22 bp, Artificial Sequence
  chemically synthesized
gacacaaagctatgactcatgt

SEQ ID NO: 920600 - DNA, 22 bp, Artificial Sequence
  chemically synthesized
acacaaagctatgactcatgtt

SEQ ID NO: 920601 - DNA, 22 bp, Artificial Sequence
  chemically synthesized
tgactcatgttcgttttttata

SEQ ID NO: 920602 - DNA, 22 bp, Artificial Sequence
  chemically synthesized
atgttcgttttttatactgttt

SEQ ID NO: 920603 - DNA, 22 bp, Artificial Sequence
  chemically synthesized
aatgtcagaggtaaaacagtat

SEQ ID NO: 920604 - DNA, 22 bp, Artificial Sequence
  chemically synthesized
gttttttatactgttttacctc

SEQ ID NO: 920605 - DNA, 22 bp, Artificial Sequence
  chemically synthesized
tttatactgttttacctctgac

SEQ ID NO: 920606 - DNA, 22 bp, Artificial Sequence
  chemically synthesized
tccaatctgaatgtcagaggta

SEQ ID NO: 920607 - DNA, 22 bp, Artificial Sequence
  chemically synthesized
ttatactgttttacctctgaca

SEQ ID NO: 920608 - DNA, 22 bp, Artificial Sequence
  chemically synthesized
tatactgttttacctctgacat

SEQ ID NO: 920609 - DNA, 22 bp, Artificial Sequence
  chemically synthesized
atactgttttacctctgacatt

SEQ ID NO: 920610 - DNA, 22 bp, Artificial Sequence
  chemically synthesized
tactgttttacctctgacattc

SEQ ID NO: 920611 - DNA, 22 bp, Artificial Sequence
  chemically synthesized
ttttacctctgacattcagatt

SEQ ID NO: 920612 - DNA, 22 bp, Artificial Sequence
  chemically synthesized
tacctctgacattcagattgga

SEQ ID NO: 920613 - DNA, 22 bp, Artificial Sequence
  chemically synthesized
acctctgacattcagattggat

SEQ ID NO: 920614 - DNA, 22 bp, Artificial Sequence
  chemically synthesized
cctctgacattcagattggata

SEQ ID NO: 920615 - DNA, 22 bp, Artificial Sequence
  chemically synthesized
tgacattcagattggataattt

SEQ ID NO: 920616 - DNA, 22 bp, Artificial Sequence
  chemically synthesized
acattcagattggataattttt

SEQ ID NO: 920617 - DNA, 22 bp, Artificial Sequence
  chemically synthesized
aaaatagataaataaaaattat

SEQ ID NO: 920618 - DNA, 22 bp, Artificial Sequence
  chemically synthesized
gaaaatagataaataaaaatta

SEQ ID NO: 920619 - DNA, 22 bp, Artificial Sequence
  chemically synthesized
agattggataatttttatttat

SEQ ID NO: 920620 - DNA, 22 bp, Artificial Sequence
  chemically synthesized
gataatttttatttatctattt

SEQ ID NO: 920621 - DNA, 22 bp, Artificial Sequence
  chemically synthesized
ttatttatctattttcaaattt

SEQ ID NO: 920622 - DNA, 22 bp, Artificial Sequence
  chemically synthesized
tatttatctattttcaaattta

SEQ ID NO: 920623 - DNA, 22 bp, Artificial Sequence
  chemically synthesized
atttatctattttcaaatttac

SEQ ID NO: 920624 - DNA, 22 bp, Artificial Sequence
  chemically synthesized
tttatctattttcaaatttact

SEQ ID NO: 920625 - DNA, 22 bp, Artificial Sequence
  chemically synthesized
atctattttcaaatttactgat

SEQ ID NO: 920626 - DNA, 22 bp, Artificial Sequence
  chemically synthesized
tctattttcaaatttactgatt

SEQ ID NO: 920627 - DNA, 22 bp, Artificial Sequence
  chemically synthesized
ttttcaaatttactgatttttt

SEQ ID NO: 920628 - DNA, 22 bp, Artificial Sequence
  chemically synthesized
tcaaatttactgattttttttt

SEQ ID NO: 920629 - DNA, 22 bp, Artificial Sequence
  chemically synthesized
caaatttactgatttttttttt

SEQ ID NO: 920630 - DNA, 22 bp, Artificial Sequence
  chemically synthesized
aaatttactgattttttttttt

SEQ ID NO: 920631 - DNA, 22 bp, Artificial Sequence
  chemically synthesized
actgatttttttttttttctgt

SEQ ID NO: 920632 - DNA, 22 bp, Artificial Sequence
  chemically synthesized
ctgatttttttttttttctgtc

SEQ ID NO: 920633 - DNA, 22 bp, Artificial Sequence
  chemically synthesized
atttttttttttttctgtctta

SEQ ID NO: 920634 - DNA, 22 bp, Artificial Sequence
  chemically synthesized
aagagcagatagtaagacagaa

SEQ ID NO: 920635 - DNA, 22 bp, Artificial Sequence
  chemically synthesized
ttttttttttctgtcttactat

SEQ ID NO: 920636 - DNA, 22 bp, Artificial Sequence
  chemically synthesized
tttttttttctgtcttactatc

SEQ ID NO: 920637 - DNA, 22 bp, Artificial Sequence
  chemically synthesized
ttttttttctgtcttactatct

SEQ ID NO: 920638 - DNA, 22 bp, Artificial Sequence
  chemically synthesized
tttttttctgtcttactatctg

SEQ ID NO: 920639 - DNA, 22 bp, Artificial Sequence
  chemically synthesized
ttttttctgtcttactatctgc

SEQ ID NO: 920640 - DNA, 22 bp, Artificial Sequence
  chemically synthesized
tttttctgtcttactatctgct

SEQ ID NO: 920641 - DNA, 22 bp, Artificial Sequence
  chemically synthesized
atggggctcaagagcagatagt

SEQ ID NO: 920642 - DNA, 22 bp, Artificial Sequence
  chemically synthesized
ttttctgtcttactatctgctc

SEQ ID NO: 920643 - DNA, 22 bp, Artificial Sequence
  chemically synthesized
tttctgtcttactatctgctct

SEQ ID NO: 920644 - DNA, 22 bp, Artificial Sequence
  chemically synthesized
ttctgtcttactatctgctctt

SEQ ID NO: 920645 - DNA, 22 bp, Artificial Sequence
  chemically synthesized
tctgtcttactatctgctcttg

SEQ ID NO: 920646 - DNA, 22 bp, Artificial Sequence
  chemically synthesized
ctgtcttactatctgctcttga

SEQ ID NO: 920647 - DNA, 22 bp, Artificial Sequence
  chemically synthesized
tgtcttactatctgctcttgag

SEQ ID NO: 920648 - DNA, 22 bp, Artificial Sequence
  chemically synthesized
tcttactatctgctcttgagcc

SEQ ID NO: 920649 - DNA, 22 bp, Artificial Sequence
  chemically synthesized
actatctgctcttgagccccat

SEQ ID NO: 920650 - DNA, 22 bp, Artificial Sequence
  chemically synthesized
aaaaaatcactaatggggctca

SEQ ID NO: 920651 - DNA, 22 bp, Artificial Sequence
  chemically synthesized
ctatctgctcttgagccccatt

SEQ ID NO: 920652 - DNA, 22 bp, Artificial Sequence
  chemically synthesized
aaaaaaatcactaatggggctc

SEQ ID NO: 920653 - DNA, 22 bp, Artificial Sequence
  chemically synthesized
tctgctcttgagccccattagt

SEQ ID NO: 920654 - DNA, 22 bp, Artificial Sequence
  chemically synthesized
ctcttgagccccattagtgatt

SEQ ID NO: 920655 - DNA, 22 bp, Artificial Sequence
  chemically synthesized
ttgagccccattagtgattttt

SEQ ID NO: 920656 - DNA, 22 bp, Artificial Sequence
  chemically synthesized
gagccccattagtgattttttt

SEQ ID NO: 920657 - DNA, 22 bp, Artificial Sequence
  chemically synthesized
agccccattagtgattttttta

SEQ ID NO: 920658 - DNA, 22 bp, Artificial Sequence
  chemically synthesized
gaaagtagaataaccaaaattt

SEQ ID NO: 920659 - DNA, 22 bp, Artificial Sequence
  chemically synthesized
gtgatttttttaaattttggtt

SEQ ID NO: 920660 - DNA, 22 bp, Artificial Sequence
  chemically synthesized
gaattggaaagtagaataacca

SEQ ID NO: 920661 - DNA, 22 bp, Artificial Sequence
  chemically synthesized
ttttaaattttggttattctac

SEQ ID NO: 920662 - DNA, 22 bp, Artificial Sequence
  chemically synthesized
tagaattggaaagtagaataac

SEQ ID NO: 920663 - DNA, 22 bp, Artificial Sequence
  chemically synthesized
tttaaattttggttattctact

SEQ ID NO: 920664 - DNA, 22 bp, Artificial Sequence
  chemically synthesized
ttaaattttggttattctactt

SEQ ID NO: 920665 - DNA, 22 bp, Artificial Sequence
  chemically synthesized
taaattttggttattctacttt

SEQ ID NO: 920666 - DNA, 22 bp, Artificial Sequence
  chemically synthesized
aaattttggttattctactttc

SEQ ID NO: 920667 - DNA, 22 bp, Artificial Sequence
  chemically synthesized
aattttggttattctactttcc

SEQ ID NO: 920668 - DNA, 22 bp, Artificial Sequence
  chemically synthesized
tggttattctactttccaattc

SEQ ID NO: 920669 - DNA, 22 bp, Artificial Sequence
  chemically synthesized
ggttattctactttccaattct

SEQ ID NO: 920670 - DNA, 22 bp, Artificial Sequence
  chemically synthesized
gttattctactttccaattcta

SEQ ID NO: 920671 - DNA, 22 bp, Artificial Sequence
  chemically synthesized
ttctactttccaattctagaat

SEQ ID NO: 920672 - DNA, 22 bp, Artificial Sequence
  chemically synthesized
tactttccaattctagaatttt

SEQ ID NO: 920673 - DNA, 22 bp, Artificial Sequence
  chemically synthesized
ctttccaattctagaattttca

SEQ ID NO: 920674 - DNA, 22 bp, Artificial Sequence
  chemically synthesized
tccaattctagaattttcattt

SEQ ID NO: 920675 - DNA, 22 bp, Artificial Sequence
  chemically synthesized
tataaaagaaccaaatgaaaat

SEQ ID NO: 920676 - DNA, 22 bp, Artificial Sequence
  chemically synthesized
ccaattctagaattttcatttg

SEQ ID NO: 920677 - DNA, 22 bp, Artificial Sequence
  chemically synthesized
caattctagaattttcatttgg

SEQ ID NO: 920678 - DNA, 22 bp, Artificial Sequence
  chemically synthesized
tagaattttcatttggttcttt

SEQ ID NO: 920679 - DNA, 22 bp, Artificial Sequence
  chemically synthesized
gaattttcatttggttctttta

SEQ ID NO: 920680 - DNA, 22 bp, Artificial Sequence
  chemically synthesized
aaagatacacactatataaaag

SEQ ID NO: 920681 - DNA, 22 bp, Artificial Sequence
  chemically synthesized
tcatttggttcttttatatagt

SEQ ID NO: 920682 - DNA, 22 bp, Artificial Sequence
  chemically synthesized
catttggttcttttatatagtg

SEQ ID NO: 920683 - DNA, 22 bp, Artificial Sequence
  chemically synthesized
atttggttcttttatatagtgt

SEQ ID NO: 920684 - DNA, 22 bp, Artificial Sequence
  chemically synthesized
aactaaaagatacacactatat

SEQ ID NO: 920685 - DNA, 22 bp, Artificial Sequence
  chemically synthesized
ggttcttttatatagtgtgtat

SEQ ID NO: 920686 - DNA, 22 bp, Artificial Sequence
  chemically synthesized
gttcttttatatagtgtgtatc

SEQ ID NO: 920687 - DNA, 22 bp, Artificial Sequence
  chemically synthesized
ttttatatagtgtgtatctttt

SEQ ID NO: 920688 - DNA, 22 bp, Artificial Sequence
  chemically synthesized
ttatatagtgtgtatcttttag

SEQ ID NO: 920689 - DNA, 22 bp, Artificial Sequence
  chemically synthesized
tatatagtgtgtatcttttagt

SEQ ID NO: 920690 - DNA, 22 bp, Artificial Sequence
  chemically synthesized
atatagtgtgtatcttttagtt

SEQ ID NO: 920691 - DNA, 22 bp, Artificial Sequence
  chemically synthesized
tatagtgtgtatcttttagttg

SEQ ID NO: 920692 - DNA, 22 bp, Artificial Sequence
  chemically synthesized
caaatagagaatctcaactaaa

SEQ ID NO: 920693 - DNA, 22 bp, Artificial Sequence
  chemically synthesized
ttagttgagattctctatttgt

SEQ ID NO: 920694 - DNA, 22 bp, Artificial Sequence
  chemically synthesized
tagttgagattctctatttgta

SEQ ID NO: 920695 - DNA, 22 bp, Artificial Sequence
  chemically synthesized
agttgagattctctatttgtag

SEQ ID NO: 920696 - DNA, 22 bp, Artificial Sequence
  chemically synthesized
gttgagattctctatttgtagt

SEQ ID NO: 920697 - DNA, 22 bp, Artificial Sequence
  chemically synthesized
agattctctatttgtagttatt

SEQ ID NO: 920698 - DNA, 22 bp, Artificial Sequence
  chemically synthesized
aatgaaagtatggtaacaataa

SEQ ID NO: 920699 - DNA, 22 bp, Artificial Sequence
  chemically synthesized
tctatttgtagttattgttacc

SEQ ID NO: 920700 - DNA, 22 bp, Artificial Sequence
  chemically synthesized
tatttgtagttattgttaccat

SEQ ID NO: 920701 - DNA, 22 bp, Artificial Sequence
  chemically synthesized
tttgtagttattgttaccatac

SEQ ID NO: 920702 - DNA, 22 bp, Artificial Sequence
  chemically synthesized
gtagttattgttaccatacttt

SEQ ID NO: 920703 - DNA, 22 bp, Artificial Sequence
  chemically synthesized
aataattaaatgaaagtatggt

SEQ ID NO: 920704 - DNA, 22 bp, Artificial Sequence
  chemically synthesized
tagttattgttaccatactttc

SEQ ID NO: 920705 - DNA, 22 bp, Artificial Sequence
  chemically synthesized
aaataattaaatgaaagtatgg

SEQ ID NO: 920706 - DNA, 22 bp, Artificial Sequence
  chemically synthesized
ttgttaccatactttcatttaa

SEQ ID NO: 920707 - DNA, 22 bp, Artificial Sequence
  chemically synthesized
ttaccatactttcatttaatta

SEQ ID NO: 920708 - DNA, 22 bp, Artificial Sequence
  chemically synthesized
ccatactttcatttaattattt

SEQ ID NO: 920709 - DNA, 22 bp, Artificial Sequence
  chemically synthesized
aagaaaagcatgtttaaataat

SEQ ID NO: 920710 - DNA, 22 bp, Artificial Sequence
  chemically synthesized
tcatttaattatttaaacatgc

SEQ ID NO: 920711 - DNA, 22 bp, Artificial Sequence
  chemically synthesized
catttaattatttaaacatgct

SEQ ID NO: 920712 - DNA, 22 bp, Artificial Sequence
  chemically synthesized
atttaattatttaaacatgctt

SEQ ID NO: 920713 - DNA, 22 bp, Artificial Sequence
  chemically synthesized
aaacaactgaagaaaagcatgt

SEQ ID NO: 920714 - DNA, 22 bp, Artificial Sequence
  chemically synthesized
caaacaactgaagaaaagcatg

SEQ ID NO: 920715 - DNA, 22 bp, Artificial Sequence
  chemically synthesized
aattatttaaacatgcttttct

SEQ ID NO: 920716 - DNA, 22 bp, Artificial Sequence
  chemically synthesized
attatttaaacatgcttttctt

SEQ ID NO: 920717 - DNA, 22 bp, Artificial Sequence
  chemically synthesized
tttaaacatgcttttcttcagt

SEQ ID NO: 920718 - DNA, 22 bp, Artificial Sequence
  chemically synthesized
aaacatgcttttcttcagttgt

SEQ ID NO: 920719 - DNA, 22 bp, Artificial Sequence
  chemically synthesized
aacatgcttttcttcagttgtt

SEQ ID NO: 920720 - DNA, 22 bp, Artificial Sequence
  chemically synthesized
taaataccttcaaacaactgaa

SEQ ID NO: 920721 - DNA, 22 bp, Artificial Sequence
  chemically synthesized
ctataaataccttcaaacaact

SEQ ID NO: 920722 - DNA, 22 bp, Artificial Sequence
  chemically synthesized
ctactataaataccttcaaaca

SEQ ID NO: 920723 - DNA, 22 bp, Artificial Sequence
  chemically synthesized
ttcttcagttgtttgaaggtat

SEQ ID NO: 920724 - DNA, 22 bp, Artificial Sequence
  chemically synthesized
tcttcagttgtttgaaggtatt

SEQ ID NO: 920725 - DNA, 22 bp, Artificial Sequence
  chemically synthesized
cttcagttgtttgaaggtattt

SEQ ID NO: 920726 - DNA, 22 bp, Artificial Sequence
  chemically synthesized
ttcagttgtttgaaggtattta

SEQ ID NO: 920727 - DNA, 22 bp, Artificial Sequence
  chemically synthesized
aaggctcctactataaatacct

SEQ ID NO: 920728 - DNA, 22 bp, Artificial Sequence
  chemically synthesized
cagttgtttgaaggtatttata

SEQ ID NO: 920729 - DNA, 22 bp, Artificial Sequence
  chemically synthesized
aaaggctcctactataaatacc

SEQ ID NO: 920730 - DNA, 22 bp, Artificial Sequence
  chemically synthesized
agttgtttgaaggtatttatag

SEQ ID NO: 920731 - DNA, 22 bp, Artificial Sequence
  chemically synthesized
tttgaaggtatttatagtagga

SEQ ID NO: 920732 - DNA, 22 bp, Artificial Sequence
  chemically synthesized
gaaggtatttatagtaggagcc

SEQ ID NO: 920733 - DNA, 22 bp, Artificial Sequence
  chemically synthesized
aaggtatttatagtaggagcct

SEQ ID NO: 920734 - DNA, 22 bp, Artificial Sequence
  chemically synthesized
gcagatagagacttaaaggctc

SEQ ID NO: 920735 - DNA, 22 bp, Artificial Sequence
  chemically synthesized
atagtaggagcctttaagtctc

SEQ ID NO: 920736 - DNA, 22 bp, Artificial Sequence
  chemically synthesized
tagtaggagcctttaagtctct

SEQ ID NO: 920737 - DNA, 22 bp, Artificial Sequence
  chemically synthesized
gcccaggtattggcagatagag

SEQ ID NO: 920738 - DNA, 22 bp, Artificial Sequence
  chemically synthesized
aattggcccaggtattggcaga

SEQ ID NO: 920739 - DNA, 22 bp, Artificial Sequence
  chemically synthesized
taagtctctatctgccaatacc

SEQ ID NO: 920740 - DNA, 22 bp, Artificial Sequence
  chemically synthesized
tgaattggcccaggtattggca

SEQ ID NO: 920741 - DNA, 22 bp, Artificial Sequence
  chemically synthesized
aagtctctatctgccaatacct

SEQ ID NO: 920742 - DNA, 22 bp, Artificial Sequence
  chemically synthesized
agtctctatctgccaatacctg

SEQ ID NO: 920743 - DNA, 22 bp, Artificial Sequence
  chemically synthesized
tctctgaattggcccaggtatt

SEQ ID NO: 920744 - DNA, 22 bp, Artificial Sequence
  chemically synthesized
tatctgccaatacctgggccaa

SEQ ID NO: 920745 - DNA, 22 bp, Artificial Sequence
  chemically synthesized
tctgccaatacctgggccaatt

SEQ ID NO: 920746 - DNA, 22 bp, Artificial Sequence
  chemically synthesized
ccaatacctgggccaattcaga

SEQ ID NO: 920747 - DNA, 22 bp, Artificial Sequence
  chemically synthesized
ggccaattcagagacaactttt

SEQ ID NO: 920748 - DNA, 22 bp, Artificial Sequence
  chemically synthesized
atggggaaaagcagtcaacaaa

SEQ ID NO: 920749 - DNA, 22 bp, Artificial Sequence
  chemically synthesized
agagacaacttttgttgactgc

SEQ ID NO: 920750 - DNA, 22 bp, Artificial Sequence
  chemically synthesized
tcatggggaaaagcagtcaaca

SEQ ID NO: 920751 - DNA, 22 bp, Artificial Sequence
  chemically synthesized
tgacccattctcatggggaaaa

SEQ ID NO: 920752 - DNA, 22 bp, Artificial Sequence
  chemically synthesized
ttgttgactgcttttccccatg

SEQ ID NO: 920753 - DNA, 22 bp, Artificial Sequence
  chemically synthesized
tgttgactgcttttccccatga

SEQ ID NO: 920754 - DNA, 22 bp, Artificial Sequence
  chemically synthesized
gttgactgcttttccccatgag

SEQ ID NO: 920755 - DNA, 22 bp, Artificial Sequence
  chemically synthesized
ttgactgcttttccccatgaga

SEQ ID NO: 920756 - DNA, 22 bp, Artificial Sequence
  chemically synthesized
aactgtgacccattctcatggg

SEQ ID NO: 920757 - DNA, 22 bp, Artificial Sequence
  chemically synthesized
actgcttttccccatgagaatg

SEQ ID NO: 920758 - DNA, 22 bp, Artificial Sequence
  chemically synthesized
cttttccccatgagaatgggtc

SEQ ID NO: 920759 - DNA, 22 bp, Artificial Sequence
  chemically synthesized
ttccccatgagaatgggtcaca

SEQ ID NO: 920760 - DNA, 22 bp, Artificial Sequence
  chemically synthesized
tccccatgagaatgggtcacag

SEQ ID NO: 920761 - DNA, 22 bp, Artificial Sequence
  chemically synthesized
cgatacgttcaactgtgaccca

SEQ ID NO: 920762 - DNA, 22 bp, Artificial Sequence
  chemically synthesized
ccccatgagaatgggtcacagt

SEQ ID NO: 920763 - DNA, 22 bp, Artificial Sequence
  chemically synthesized
acgatacgttcaactgtgaccc

SEQ ID NO: 920764 - DNA, 22 bp, Artificial Sequence
  chemically synthesized
cccatgagaatgggtcacagtt

SEQ ID NO: 920765 - DNA, 22 bp, Artificial Sequence
  chemically synthesized
aagaaaaatttacgatacgttc

SEQ ID NO: 920766 - DNA, 22 bp, Artificial Sequence
  chemically synthesized
caagaaaaatttacgatacgtt

SEQ ID NO: 920767 - DNA, 22 bp, Artificial Sequence
  chemically synthesized
tcaagaaaaatttacgatacgt

SEQ ID NO: 920768 - DNA, 22 bp, Artificial Sequence
  chemically synthesized
aacgtatcgtaaatttttcttg

SEQ ID NO: 920769 - DNA, 22 bp, Artificial Sequence
  chemically synthesized
aaatgtcaaattttcaagaaaa

SEQ ID NO: 920770 - DNA, 22 bp, Artificial Sequence
  chemically synthesized
aaaatgtcaaattttcaagaaa

SEQ ID NO: 920771 - DNA, 22 bp, Artificial Sequence
  chemically synthesized
tttaaaatgtcaaattttcaag

SEQ ID NO: 920772 - DNA, 22 bp, Artificial Sequence
  chemically synthesized
atatgttatttaaaatgtcaaa

SEQ ID NO: 920773 - DNA, 22 bp, Artificial Sequence
  chemically synthesized
aatatgttatttaaaatgtcaa

SEQ ID NO: 920774 - DNA, 22 bp, Artificial Sequence
  chemically synthesized
ttcttgaaaatttgacatttta

SEQ ID NO: 920775 - DNA, 22 bp, Artificial Sequence
  chemically synthesized
taatatgttatttaaaatgtca

SEQ ID NO: 920776 - DNA, 22 bp, Artificial Sequence
  chemically synthesized
tcttgaaaatttgacattttaa

SEQ ID NO: 920777 - DNA, 22 bp, Artificial Sequence
  chemically synthesized
cttgaaaatttgacattttaaa

SEQ ID NO: 920778 - DNA, 22 bp, Artificial Sequence
  chemically synthesized
ttgaaaatttgacattttaaat

SEQ ID NO: 920779 - DNA, 22 bp, Artificial Sequence
  chemically synthesized
ctttaatatgttatttaaaatg

SEQ ID NO: 920780 - DNA, 22 bp, Artificial Sequence
  chemically synthesized
gaaaatttgacattttaaataa

SEQ ID NO: 920781 - DNA, 22 bp, Artificial Sequence
  chemically synthesized
aaaatttgacattttaaataac

SEQ ID NO: 920782 - DNA, 22 bp, Artificial Sequence
  chemically synthesized
gggctcctttaatatgttattt

SEQ ID NO: 920783 - DNA, 22 bp, Artificial Sequence
  chemically synthesized
ggggctcctttaatatgttatt

SEQ ID NO: 920784 - DNA, 22 bp, Artificial Sequence
  chemically synthesized
gacattttaaataacatattaa

SEQ ID NO: 920785 - DNA, 22 bp, Artificial Sequence
  chemically synthesized
acattttaaataacatattaaa

SEQ ID NO: 920786 - DNA, 22 bp, Artificial Sequence
  chemically synthesized
taaataacatattaaaggagcc

SEQ ID NO: 920787 - DNA, 22 bp, Artificial Sequence
  chemically synthesized
aaataacatattaaaggagccc

SEQ ID NO: 920788 - DNA, 22 bp, Artificial Sequence
  chemically synthesized
aataacatattaaaggagcccc

SEQ ID NO: 920789 - DNA, 22 bp, Artificial Sequence
  chemically synthesized
aaggagccccaaattctgatgt

SEQ ID NO: 920790 - DNA, 22 bp, Artificial Sequence
  chemically synthesized
ggcataagaaggaacatcagaa

SEQ ID NO: 920791 - DNA, 22 bp, Artificial Sequence
  chemically synthesized
aaaaacgctgggcataagaagg

SEQ ID NO: 920792 - DNA, 22 bp, Artificial Sequence
  chemically synthesized
aaaaaacgctgggcataagaag

SEQ ID NO: 920793 - DNA, 22 bp, Artificial Sequence
  chemically synthesized
tgatgttccttcttatgcccag

SEQ ID NO: 920794 - DNA, 22 bp, Artificial Sequence
  chemically synthesized
aatttaaaaaacgctgggcata

SEQ ID NO: 920795 - DNA, 22 bp, Artificial Sequence
  chemically synthesized
atgttccttcttatgcccagcg

SEQ ID NO: 920796 - DNA, 22 bp, Artificial Sequence
  chemically synthesized
caatttaaaaaacgctgggcat

SEQ ID NO: 920797 - DNA, 22 bp, Artificial Sequence
  chemically synthesized
cttcttatgcccagcgtttttt

SEQ ID NO: 920798 - DNA, 22 bp, Artificial Sequence
  chemically synthesized
aaacttcaatttaaaaaacgct

SEQ ID NO: 920799 - DNA, 22 bp, Artificial Sequence
  chemically synthesized
cttatgcccagcgttttttaaa

SEQ ID NO: 920800 - DNA, 22 bp, Artificial Sequence
  chemically synthesized
ttaaaacttcaatttaaaaaac

SEQ ID NO: 920801 - DNA, 22 bp, Artificial Sequence
  chemically synthesized
ttatgcccagcgttttttaaat

SEQ ID NO: 920802 - DNA, 22 bp, Artificial Sequence
  chemically synthesized
atgcccagcgttttttaaattg

SEQ ID NO: 920803 - DNA, 22 bp, Artificial Sequence
  chemically synthesized
tgcccagcgttttttaaattga

SEQ ID NO: 920804 - DNA, 22 bp, Artificial Sequence
  chemically synthesized
ggcaagttattaaaacttcaat

SEQ ID NO: 920805 - DNA, 22 bp, Artificial Sequence
  chemically synthesized
atctaggcaagttattaaaact

SEQ ID NO: 920806 - DNA, 22 bp, Artificial Sequence
  chemically synthesized
catctaggcaagttattaaaac

SEQ ID NO: 920807 - DNA, 22 bp, Artificial Sequence
  chemically synthesized
tttaaattgaagttttaataac

SEQ ID NO: 920808 - DNA, 22 bp, Artificial Sequence
  chemically synthesized
ttaaattgaagttttaataact

SEQ ID NO: 920809 - DNA, 22 bp, Artificial Sequence
  chemically synthesized
taaattgaagttttaataactt

SEQ ID NO: 920810 - DNA, 22 bp, Artificial Sequence
  chemically synthesized
aaattgaagttttaataacttg

SEQ ID NO: 920811 - DNA, 22 bp, Artificial Sequence
  chemically synthesized
aattgaagttttaataacttgc

SEQ ID NO: 920812 - DNA, 22 bp, Artificial Sequence
  chemically synthesized
cacagatttcatctaggcaagt

SEQ ID NO: 920813 - DNA, 22 bp, Artificial Sequence
  chemically synthesized
aagttttaataacttgcctaga

SEQ ID NO: 920814 - DNA, 22 bp, Artificial Sequence
  chemically synthesized
taataacttgcctagatgaaat

SEQ ID NO: 920815 - DNA, 22 bp, Artificial Sequence
  chemically synthesized
aataacttgcctagatgaaatc

SEQ ID NO: 920816 - DNA, 22 bp, Artificial Sequence
  chemically synthesized
ataacttgcctagatgaaatct

SEQ ID NO: 920817 - DNA, 22 bp, Artificial Sequence
  chemically synthesized
tggggaaacagattccacagat

SEQ ID NO: 920818 - DNA, 22 bp, Artificial Sequence
  chemically synthesized
gcctagatgaaatctgtggaat

SEQ ID NO: 920819 - DNA, 22 bp, Artificial Sequence
  chemically synthesized
cctagatgaaatctgtggaatc

SEQ ID NO: 920820 - DNA, 22 bp, Artificial Sequence
  chemically synthesized
gatgaaatctgtggaatctgtt

SEQ ID NO: 920821 - DNA, 22 bp, Artificial Sequence
  chemically synthesized
tggaatctgtttccccacagtg

SEQ ID NO: 920822 - DNA, 22 bp, Artificial Sequence
  chemically synthesized
tttccccacagtgtgtggctgt

SEQ ID NO: 920823 - DNA, 22 bp, Artificial Sequence
  chemically synthesized
ccccacagtgtgtggctgttga

SEQ ID NO: 920824 - DNA, 22 bp, Artificial Sequence
  chemically synthesized
cccacagtgtgtggctgttgat

SEQ ID NO: 920825 - DNA, 22 bp, Artificial Sequence
  chemically synthesized
acagagaaagaatatcaacagc

SEQ ID NO: 920826 - DNA, 22 bp, Artificial Sequence
  chemically synthesized
gacagagaaagaatatcaacag

SEQ ID NO: 920827 - DNA, 22 bp, Artificial Sequence
  chemically synthesized
tttgacagagaaagaatatcaa

SEQ ID NO: 920828 - DNA, 22 bp, Artificial Sequence
  chemically synthesized
ttgtttgacagagaaagaatat

SEQ ID NO: 920829 - DNA, 22 bp, Artificial Sequence
  chemically synthesized
tgttgtttgacagagaaagaat

SEQ ID NO: 920830 - DNA, 22 bp, Artificial Sequence
  chemically synthesized
ctgttgtttgacagagaaagaa

SEQ ID NO: 920831 - DNA, 22 bp, Artificial Sequence
  chemically synthesized
tttctgttgtttgacagagaaa

SEQ ID NO: 920832 - DNA, 22 bp, Artificial Sequence
  chemically synthesized
gtttctgttgtttgacagagaa

SEQ ID NO: 920833 - DNA, 22 bp, Artificial Sequence
  chemically synthesized
ttgatattctttctctgtcaaa

SEQ ID NO: 920834 - DNA, 22 bp, Artificial Sequence
  chemically synthesized
atattctttctctgtcaaacaa

SEQ ID NO: 920835 - DNA, 22 bp, Artificial Sequence
  chemically synthesized
tttctctgtcaaacaacagaaa

SEQ ID NO: 920836 - DNA, 22 bp, Artificial Sequence
  chemically synthesized
ggcatacagtttgtttctgttg

SEQ ID NO: 920837 - DNA, 22 bp, Artificial Sequence
  chemically synthesized
tctctgtcaaacaacagaaaca

SEQ ID NO: 920838 - DNA, 22 bp, Artificial Sequence
  chemically synthesized
ctctgtcaaacaacagaaacaa

SEQ ID NO: 920839 - DNA, 22 bp, Artificial Sequence
  chemically synthesized
tctgtcaaacaacagaaacaaa

SEQ ID NO: 920840 - DNA, 22 bp, Artificial Sequence
  chemically synthesized
tgtcaaacaacagaaacaaact

SEQ ID NO: 920841 - DNA, 22 bp, Artificial Sequence
  chemically synthesized
tcaaacaacagaaacaaactgt

SEQ ID NO: 920842 - DNA, 22 bp, Artificial Sequence
  chemically synthesized
ggaaactaggcatacagtttgt

SEQ ID NO: 920843 - DNA, 22 bp, Artificial Sequence
  chemically synthesized
taggaaactaggcatacagttt

SEQ ID NO: 920844 - DNA, 22 bp, Artificial Sequence
  chemically synthesized
cctctaggaaactaggcataca

SEQ ID NO: 920845 - DNA, 22 bp, Artificial Sequence
  chemically synthesized
acctctaggaaactaggcatac

SEQ ID NO: 920846 - DNA, 22 bp, Artificial Sequence
  chemically synthesized
tgcttacctctaggaaactagg

SEQ ID NO: 920847 - DNA, 22 bp, Artificial Sequence
  chemically synthesized
agctatgcttacctctaggaaa

SEQ ID NO: 920848 - DNA, 22 bp, Artificial Sequence
  chemically synthesized
tatgcctagtttcctagaggta

SEQ ID NO: 920849 - DNA, 22 bp, Artificial Sequence
  chemically synthesized
atgcaaattaagctatgcttac

SEQ ID NO: 920850 - DNA, 22 bp, Artificial Sequence
  chemically synthesized
gtttcctagaggtaagcatagc

SEQ ID NO: 920851 - DNA, 22 bp, Artificial Sequence
  chemically synthesized
actaatgcaaattaagctatgc

SEQ ID NO: 920852 - DNA, 22 bp, Artificial Sequence
  chemically synthesized
cctagaggtaagcatagcttaa

SEQ ID NO: 920853 - DNA, 22 bp, Artificial Sequence
  chemically synthesized
ctagaggtaagcatagcttaat

SEQ ID NO: 920854 - DNA, 22 bp, Artificial Sequence
  chemically synthesized
ttgactaatgcaaattaagcta

SEQ ID NO: 920855 - DNA, 22 bp, Artificial Sequence
  chemically synthesized
gaggtaagcatagcttaatttg

SEQ ID NO: 920856 - DNA, 22 bp, Artificial Sequence
  chemically synthesized
gccaactattgactaatgcaaa

SEQ ID NO: 920857 - DNA, 22 bp, Artificial Sequence
  chemically synthesized
ctggccaactattgactaatgc

SEQ ID NO: 920858 - DNA, 22 bp, Artificial Sequence
  chemically synthesized
aatttgcattagtcaatagttg

SEQ ID NO: 920859 - DNA, 22 bp, Artificial Sequence
  chemically synthesized
atttgcattagtcaatagttgg

SEQ ID NO: 920860 - DNA, 22 bp, Artificial Sequence
  chemically synthesized
agatcaactgctggccaactat

SEQ ID NO: 920861 - DNA, 22 bp, Artificial Sequence
  chemically synthesized
aagatcaactgctggccaacta

SEQ ID NO: 920862 - DNA, 22 bp, Artificial Sequence
  chemically synthesized
gcattagtcaatagttggccag

SEQ ID NO: 920863 - DNA, 22 bp, Artificial Sequence
  chemically synthesized
cattagtcaatagttggccagc

SEQ ID NO: 920864 - DNA, 22 bp, Artificial Sequence
  chemically synthesized
gtcaatagttggccagcagttg

SEQ ID NO: 920865 - DNA, 22 bp, Artificial Sequence
  chemically synthesized
aggtatttaagatcaactgctg

SEQ ID NO: 920866 - DNA, 22 bp, Artificial Sequence
  chemically synthesized
gaggtatttaagatcaactgct

SEQ ID NO: 920867 - DNA, 22 bp, Artificial Sequence
  chemically synthesized
gcttgaggtatttaagatcaac

SEQ ID NO: 920868 - DNA, 22 bp, Artificial Sequence
  chemically synthesized
ctggcttgaggtatttaagatc

SEQ ID NO: 920869 - DNA, 22 bp, Artificial Sequence
  chemically synthesized
actggcttgaggtatttaagat

SEQ ID NO: 920870 - DNA, 22 bp, Artificial Sequence
  chemically synthesized
gccagcagttgatcttaaatac

SEQ ID NO: 920871 - DNA, 22 bp, Artificial Sequence
  chemically synthesized
gaagtcttactggcttgaggta

SEQ ID NO: 920872 - DNA, 22 bp, Artificial Sequence
  chemically synthesized
ggaagtcttactggcttgaggt

SEQ ID NO: 920873 - DNA, 22 bp, Artificial Sequence
  chemically synthesized
atcttaaatacctcaagccagt

SEQ ID NO: 920874 - DNA, 22 bp, Artificial Sequence
  chemically synthesized
aaatacctcaagccagtaagac

SEQ ID NO: 920875 - DNA, 22 bp, Artificial Sequence
  chemically synthesized
aatacctcaagccagtaagact

SEQ ID NO: 920876 - DNA, 22 bp, Artificial Sequence
  chemically synthesized
gcaaaacttggaagtcttactg

SEQ ID NO: 920877 - DNA, 22 bp, Artificial Sequence
  chemically synthesized
agcaaaacttggaagtcttact

SEQ ID NO: 920878 - DNA, 22 bp, Artificial Sequence
  chemically synthesized
tagcaaaacttggaagtcttac

SEQ ID NO: 920879 - DNA, 22 bp, Artificial Sequence
  chemically synthesized
aagccagtaagacttccaagtt

SEQ ID NO: 920880 - DNA, 22 bp, Artificial Sequence
  chemically synthesized
acacatataaagaacctttagc

SEQ ID NO: 920881 - DNA, 22 bp, Artificial Sequence
  chemically synthesized
aacacatataaagaacctttag

SEQ ID NO: 920882 - DNA, 22 bp, Artificial Sequence
  chemically synthesized
taacacatataaagaaccttta

SEQ ID NO: 920883 - DNA, 22 bp, Artificial Sequence
  chemically synthesized
ccaagttttgctaaaggttctt

SEQ ID NO: 920884 - DNA, 22 bp, Artificial Sequence
  chemically synthesized
caagttttgctaaaggttcttt

SEQ ID NO: 920885 - DNA, 22 bp, Artificial Sequence
  chemically synthesized
tgctaaaggttctttatatgtg

SEQ ID NO: 920886 - DNA, 22 bp, Artificial Sequence
  chemically synthesized
gctaaaggttctttatatgtgt

SEQ ID NO: 920887 - DNA, 22 bp, Artificial Sequence
  chemically synthesized
ctaaaggttctttatatgtgtt

SEQ ID NO: 920888 - DNA, 22 bp, Artificial Sequence
  chemically synthesized
aatataccctttaacacatata

SEQ ID NO: 920889 - DNA, 22 bp, Artificial Sequence
  chemically synthesized
aaggttctttatatgtgttaaa

SEQ ID NO: 920890 - DNA, 22 bp, Artificial Sequence
  chemically synthesized
catgttgaatataccctttaac

SEQ ID NO: 920891 - DNA, 22 bp, Artificial Sequence
  chemically synthesized
tttatatgtgttaaagggtata

SEQ ID NO: 920892 - DNA, 22 bp, Artificial Sequence
  chemically synthesized
tatatgtgttaaagggtatatt

SEQ ID NO: 920893 - DNA, 22 bp, Artificial Sequence
  chemically synthesized
atatgtgttaaagggtatattc

SEQ ID NO: 920894 - DNA, 22 bp, Artificial Sequence
  chemically synthesized
tatgtgttaaagggtatattca

SEQ ID NO: 920895 - DNA, 22 bp, Artificial Sequence
  chemically synthesized
aaatgtgcctgcatgttgaata

SEQ ID NO: 920896 - DNA, 22 bp, Artificial Sequence
  chemically synthesized
aaaatgtgcctgcatgttgaat

SEQ ID NO: 920897 - DNA, 22 bp, Artificial Sequence
  chemically synthesized
aagggtatattcaacatgcagg

SEQ ID NO: 920898 - DNA, 22 bp, Artificial Sequence
  chemically synthesized
atgaaaacttaaaatgtgcctg

SEQ ID NO: 920899 - DNA, 22 bp, Artificial Sequence
  chemically synthesized
catgaaaacttaaaatgtgcct

SEQ ID NO: 920900 - DNA, 22 bp, Artificial Sequence
  chemically synthesized
cttcatgaaaacttaaaatgtg

SEQ ID NO: 920901 - DNA, 22 bp, Artificial Sequence
  chemically synthesized
aacatgcaggcacattttaagt

SEQ ID NO: 920902 - DNA, 22 bp, Artificial Sequence
  chemically synthesized
tgtctccttcatgaaaacttaa

SEQ ID NO: 920903 - DNA, 22 bp, Artificial Sequence
  chemically synthesized
gtgtctccttcatgaaaactta

SEQ ID NO: 920904 - DNA, 22 bp, Artificial Sequence
  chemically synthesized
cttgtgtctccttcatgaaaac

SEQ ID NO: 920905 - DNA, 22 bp, Artificial Sequence
  chemically synthesized
taagttttcatgaaggagacac

SEQ ID NO: 920906 - DNA, 22 bp, Artificial Sequence
  chemically synthesized
aagttttcatgaaggagacaca

SEQ ID NO: 920907 - DNA, 22 bp, Artificial Sequence
  chemically synthesized
agttttcatgaaggagacacaa

SEQ ID NO: 920908 - DNA, 22 bp, Artificial Sequence
  chemically synthesized
agtaaggactccttgtgtctcc

SEQ ID NO: 920909 - DNA, 22 bp, Artificial Sequence
  chemically synthesized
tcatgaaggagacacaaggagt

SEQ ID NO: 920910 - DNA, 22 bp, Artificial Sequence
  chemically synthesized
catgaaggagacacaaggagtc

SEQ ID NO: 920911 - DNA, 22 bp, Artificial Sequence
  chemically synthesized
atgaaggagacacaaggagtcc

SEQ ID NO: 920912 - DNA, 22 bp, Artificial Sequence
  chemically synthesized
caaaatgaggcagccgtaatag

SEQ ID NO: 920913 - DNA, 22 bp, Artificial Sequence
  chemically synthesized
actgaggcctattacggctgcc

SEQ ID NO: 920914 - DNA, 22 bp, Artificial Sequence
  chemically synthesized
ctgaggcctattacggctgcct

SEQ ID NO: 920915 - DNA, 22 bp, Artificial Sequence
  chemically synthesized
aggcctattacggctgcctcat

SEQ ID NO: 920916 - DNA, 22 bp, Artificial Sequence
  chemically synthesized
accagcatatctgcaaaatgag

SEQ ID NO: 920917 - DNA, 22 bp, Artificial Sequence
  chemically synthesized
aaccagcatatctgcaaaatga

SEQ ID NO: 920918 - DNA, 22 bp, Artificial Sequence
  chemically synthesized
ttacggctgcctcattttgcag

SEQ ID NO: 920919 - DNA, 22 bp, Artificial Sequence
  chemically synthesized
cggctgcctcattttgcagata

SEQ ID NO: 920920 - DNA, 22 bp, Artificial Sequence
  chemically synthesized
atttaaccagcatatctgcaaa

SEQ ID NO: 920921 - DNA, 22 bp, Artificial Sequence
  chemically synthesized
aatttaaccagcatatctgcaa

SEQ ID NO: 920922 - DNA, 22 bp, Artificial Sequence
  chemically synthesized
cctcattttgcagatatgctgg

SEQ ID NO: 920923 - DNA, 22 bp, Artificial Sequence
  chemically synthesized
attttgcagatatgctggttaa

SEQ ID NO: 920924 - DNA, 22 bp, Artificial Sequence
  chemically synthesized
gccagaaatttaatttaaccag

SEQ ID NO: 920925 - DNA, 22 bp, Artificial Sequence
  chemically synthesized
tgcagatatgctggttaaatta

SEQ ID NO: 920926 - DNA, 22 bp, Artificial Sequence
  chemically synthesized
gcagatatgctggttaaattaa

SEQ ID NO: 920927 - DNA, 22 bp, Artificial Sequence
  chemically synthesized
cagatatgctggttaaattaaa

SEQ ID NO: 920928 - DNA, 22 bp, Artificial Sequence
  chemically synthesized
gcagactggccagaaatttaat

SEQ ID NO: 920929 - DNA, 22 bp, Artificial Sequence
  chemically synthesized
actggcagactggccagaaatt

SEQ ID NO: 920930 - DNA, 22 bp, Artificial Sequence
  chemically synthesized
gttaaattaaatttctggccag

SEQ ID NO: 920931 - DNA, 22 bp, Artificial Sequence
  chemically synthesized
aattaaatttctggccagtctg

SEQ ID NO: 920932 - DNA, 22 bp, Artificial Sequence
  chemically synthesized
aatttctggccagtctgccagt

SEQ ID NO: 920933 - DNA, 22 bp, Artificial Sequence
  chemically synthesized
gaacaagtaactgactggcaga

SEQ ID NO: 920934 - DNA, 22 bp, Artificial Sequence
  chemically synthesized
ctggccagtctgccagtcagtt

SEQ ID NO: 920935 - DNA, 22 bp, Artificial Sequence
  chemically synthesized
attggaacaagtaactgactgg

SEQ ID NO: 920936 - DNA, 22 bp, Artificial Sequence
  chemically synthesized
tggccagtctgccagtcagtta

SEQ ID NO: 920937 - DNA, 22 bp, Artificial Sequence
  chemically synthesized
gattggaacaagtaactgactg

SEQ ID NO: 920938 - DNA, 22 bp, Artificial Sequence
  chemically synthesized
gccagtctgccagtcagttact

SEQ ID NO: 920939 - DNA, 22 bp, Artificial Sequence
  chemically synthesized
cagtcttgattggaacaagtaa

SEQ ID NO: 920940 - DNA, 22 bp, Artificial Sequence
  chemically synthesized
ccagtcagttacttgttccaat

SEQ ID NO: 920941 - DNA, 22 bp, Artificial Sequence
  chemically synthesized
aagttgcagtcttgattggaac

SEQ ID NO: 920942 - DNA, 22 bp, Artificial Sequence
  chemically synthesized
gcctaaagttgcagtcttgatt

SEQ ID NO: 920943 - DNA, 22 bp, Artificial Sequence
  chemically synthesized
cttgttccaatcaagactgcaa

SEQ ID NO: 920944 - DNA, 22 bp, Artificial Sequence
  chemically synthesized
agctggcctaaagttgcagtct

SEQ ID NO: 920945 - DNA, 22 bp, Artificial Sequence
  chemically synthesized
gttccaatcaagactgcaactt

SEQ ID NO: 920946 - DNA, 22 bp, Artificial Sequence
  chemically synthesized
ttccaatcaagactgcaacttt

SEQ ID NO: 920947 - DNA, 22 bp, Artificial Sequence
  chemically synthesized
caatcaagactgcaactttagg

SEQ ID NO: 920948 - DNA, 22 bp, Artificial Sequence
  chemically synthesized
caactttaggccagctgagttg

SEQ ID NO: 920949 - DNA, 22 bp, Artificial Sequence
  chemically synthesized
taggccagctgagttgctattc

SEQ ID NO: 920950 - DNA, 22 bp, Artificial Sequence
  chemically synthesized
aggccagctgagttgctattct

SEQ ID NO: 920951 - DNA, 22 bp, Artificial Sequence
  chemically synthesized
ggccagctgagttgctattctg

SEQ ID NO: 920952 - DNA, 22 bp, Artificial Sequence
  chemically synthesized
ggcggcaaacaaaaaggcagaa

SEQ ID NO: 920953 - DNA, 22 bp, Artificial Sequence
  chemically synthesized
agttgctattctgcctttttgt

SEQ ID NO: 920954 - DNA, 22 bp, Artificial Sequence
  chemically synthesized
ctattctgcctttttgtttgcc

SEQ ID NO: 920955 - DNA, 22 bp, Artificial Sequence
  chemically synthesized
ttctgcctttttgtttgccgcc

SEQ ID NO: 920956 - DNA, 22 bp, Artificial Sequence
  chemically synthesized
tgcctttttgtttgccgcctag

SEQ ID NO: 920957 - DNA, 22 bp, Artificial Sequence
  chemically synthesized
cctttttgtttgccgcctaggt

SEQ ID NO: 920958 - DNA, 22 bp, Artificial Sequence
  chemically synthesized
tcagtaacggtggagacctagg

SEQ ID NO: 920959 - DNA, 22 bp, Artificial Sequence
  chemically synthesized
tttgtttgccgcctaggtctcc

SEQ ID NO: 920960 - DNA, 22 bp, Artificial Sequence
  chemically synthesized
ttgtttgccgcctaggtctcca

SEQ ID NO: 920961 - DNA, 22 bp, Artificial Sequence
  chemically synthesized
tgtttgccgcctaggtctccac

SEQ ID NO: 920962 - DNA, 22 bp, Artificial Sequence
  chemically synthesized
gtttgccgcctaggtctccacc

SEQ ID NO: 920963 - DNA, 22 bp, Artificial Sequence
  chemically synthesized
tttgccgcctaggtctccaccg

SEQ ID NO: 920964 - DNA, 22 bp, Artificial Sequence
  chemically synthesized
gccgcctaggtctccaccgtta

SEQ ID NO: 920965 - DNA, 22 bp, Artificial Sequence
  chemically synthesized
ccgcctaggtctccaccgttac

SEQ ID NO: 920966 - DNA, 22 bp, Artificial Sequence
  chemically synthesized
ggtctccaccgttactgacaat

SEQ ID NO: 920967 - DNA, 22 bp, Artificial Sequence
  chemically synthesized
catgtccagaagcattgtcagt

SEQ ID NO: 920968 - DNA, 22 bp, Artificial Sequence
  chemically synthesized
caccgttactgacaatgcttct

SEQ ID NO: 920969 - DNA, 22 bp, Artificial Sequence
  chemically synthesized
aaactccatgtccagaagcatt

SEQ ID NO: 920970 - DNA, 22 bp, Artificial Sequence
  chemically synthesized
aaaactccatgtccagaagcat

SEQ ID NO: 920971 - DNA, 22 bp, Artificial Sequence
  chemically synthesized
ctgacaatgcttctggacatgg

SEQ ID NO: 920972 - DNA, 22 bp, Artificial Sequence
  chemically synthesized
acaatgcttctggacatggagt

SEQ ID NO: 920973 - DNA, 22 bp, Artificial Sequence
  chemically synthesized
aagcagaagtttaaaactccat

SEQ ID NO: 920974 - DNA, 22 bp, Artificial Sequence
  chemically synthesized
gaagcagaagtttaaaactcca

SEQ ID NO: 920975 - DNA, 22 bp, Artificial Sequence
  chemically synthesized
tttgaagcagaagtttaaaact

SEQ ID NO: 920976 - DNA, 22 bp, Artificial Sequence
  chemically synthesized
atttgaagcagaagtttaaaac

SEQ ID NO: 920977 - DNA, 22 bp, Artificial Sequence
  chemically synthesized
ctggacatggagttttaaactt

SEQ ID NO: 920978 - DNA, 22 bp, Artificial Sequence
  chemically synthesized
tatttgaagcagaagtttaaaa

SEQ ID NO: 920979 - DNA, 22 bp, Artificial Sequence
  chemically synthesized
tggacatggagttttaaacttc

SEQ ID NO: 920980 - DNA, 22 bp, Artificial Sequence
  chemically synthesized
gacatggagttttaaacttctg

SEQ ID NO: 920981 - DNA, 22 bp, Artificial Sequence
  chemically synthesized
attttatttgaagcagaagttt

SEQ ID NO: 920982 - DNA, 22 bp, Artificial Sequence
  chemically synthesized
taaacttctgcttcaaataaaa

SEQ ID NO: 920983 - DNA, 22 bp, Artificial Sequence
  chemically synthesized
aaacttctgcttcaaataaaat

SEQ ID NO: 920984 - DNA, 22 bp, Artificial Sequence
  chemically synthesized
aacttctgcttcaaataaaatc

SEQ ID NO: 920985 - DNA, 22 bp, Artificial Sequence
  chemically synthesized
atcaccacagggactgatttta

SEQ ID NO: 920986 - DNA, 22 bp, Artificial Sequence
  chemically synthesized
catcaccacagggactgatttt

SEQ ID NO: 920987 - DNA, 22 bp, Artificial Sequence
  chemically synthesized
ctgcttcaaataaaatcagtcc

SEQ ID NO: 920988 - DNA, 22 bp, Artificial Sequence
  chemically synthesized
tgcttcaaataaaatcagtccc

SEQ ID NO: 920989 - DNA, 22 bp, Artificial Sequence
  chemically synthesized
cttcaaataaaatcagtccctg

SEQ ID NO: 920990 - DNA, 22 bp, Artificial Sequence
  chemically synthesized
caaataaaatcagtccctgtgg

SEQ ID NO: 920991 - DNA, 22 bp, Artificial Sequence
  chemically synthesized
aaataaaatcagtccctgtggt

SEQ ID NO: 920992 - DNA, 22 bp, Artificial Sequence
  chemically synthesized
tggtgatgaagctgcttatttc

SEQ ID NO: 920993 - DNA, 22 bp, Artificial Sequence
  chemically synthesized
tcaaggtagaacaagccatgga

SEQ ID NO: 920994 - DNA, 22 bp, Artificial Sequence
  chemically synthesized
tatcaaggtagaacaagccatg

SEQ ID NO: 920995 - DNA, 22 bp, Artificial Sequence
  chemically synthesized
cttatttccatggcttgttcta

SEQ ID NO: 920996 - DNA, 22 bp, Artificial Sequence
  chemically synthesized
atttccatggcttgttctacct

SEQ ID NO: 920997 - DNA, 22 bp, Artificial Sequence
  chemically synthesized
tttccatggcttgttctacctt

SEQ ID NO: 920998 - DNA, 22 bp, Artificial Sequence
  chemically synthesized
ccatggcttgttctaccttgat

SEQ ID NO: 920999 - DNA, 22 bp, Artificial Sequence
  chemically synthesized
catggcttgttctaccttgata

SEQ ID NO: 921000 - DNA, 22 bp, Artificial Sequence
  chemically synthesized
gtcaagcataatagttctatca

SEQ ID NO: 921001 - DNA, 22 bp, Artificial Sequence
  chemically synthesized
ggtcaagcataatagttctatc

SEQ ID NO: 921002 - DNA, 22 bp, Artificial Sequence
  chemically synthesized
gttctaccttgatagaactatt

SEQ ID NO: 921003 - DNA, 22 bp, Artificial Sequence
  chemically synthesized
ttctaccttgatagaactatta

SEQ ID NO: 921004 - DNA, 22 bp, Artificial Sequence
  chemically synthesized
taccttgatagaactattatgc

SEQ ID NO: 921005 - DNA, 22 bp, Artificial Sequence
  chemically synthesized
ccagcttggtcaagcataatag

SEQ ID NO: 921006 - DNA, 22 bp, Artificial Sequence
  chemically synthesized
ccttgatagaactattatgctt

SEQ ID NO: 921007 - DNA, 22 bp, Artificial Sequence
  chemically synthesized
gatagaactattatgcttgacc

SEQ ID NO: 921008 - DNA, 22 bp, Artificial Sequence
  chemically synthesized
atagaactattatgcttgacca

SEQ ID NO: 921009 - DNA, 22 bp, Artificial Sequence
  chemically synthesized
ttatgcttgaccaagctgggag

SEQ ID NO: 921010 - DNA, 22 bp, Artificial Sequence
  chemically synthesized
cccccagtccccactcccagct

SEQ ID NO: 921011 - DNA, 22 bp, Artificial Sequence
  chemically synthesized
tgcttgaccaagctgggagtgg

SEQ ID NO: 921012 - DNA, 22 bp, Artificial Sequence
  chemically synthesized
tattgcccccagtccccactcc

SEQ ID NO: 921013 - DNA, 22 bp, Artificial Sequence
  chemically synthesized
gaccaagctgggagtggggact

SEQ ID NO: 921014 - DNA, 22 bp, Artificial Sequence
  chemically synthesized
accaagctgggagtggggactg

SEQ ID NO: 921015 - DNA, 22 bp, Artificial Sequence
  chemically synthesized
cctgtattgcccccagtcccca

SEQ ID NO: 921016 - DNA, 22 bp, Artificial Sequence
  chemically synthesized
gcctgtattgcccccagtcccc

SEQ ID NO: 921017 - DNA, 22 bp, Artificial Sequence
  chemically synthesized
ggagtggggactgggggcaata

SEQ ID NO: 921018 - DNA, 22 bp, Artificial Sequence
  chemically synthesized
tggtgtatttgcctgtattgcc

SEQ ID NO: 921019 - DNA, 22 bp, Artificial Sequence
  chemically synthesized
gtggtgtatttgcctgtattgc

SEQ ID NO: 921020 - DNA, 22 bp, Artificial Sequence
  chemically synthesized
ggggcaatacaggcaaatacac

SEQ ID NO: 921021 - DNA, 22 bp, Artificial Sequence
  chemically synthesized
tatatgaacaatatgaatttgt

SEQ ID NO: 921022 - DNA, 22 bp, Artificial Sequence
  chemically synthesized
gtatatgaacaatatgaatttg

SEQ ID NO: 921023 - DNA, 22 bp, Artificial Sequence
  chemically synthesized
tgtatatgaacaatatgaattt

SEQ ID NO: 921024 - DNA, 22 bp, Artificial Sequence
  chemically synthesized
aactttgtatatgaacaatatg

SEQ ID NO: 921025 - DNA, 22 bp, Artificial Sequence
  chemically synthesized
taaaaagtactaaactttgtat

SEQ ID NO: 921026 - DNA, 22 bp, Artificial Sequence
  chemically synthesized
atattgttcatatacaaagttt

SEQ ID NO: 921027 - DNA, 22 bp, Artificial Sequence
  chemically synthesized
ataaaaagtactaaactttgta

SEQ ID NO: 921028 - DNA, 22 bp, Artificial Sequence
  chemically synthesized
tttataaaaagtactaaacttt

SEQ ID NO: 921029 - DNA, 22 bp, Artificial Sequence
  chemically synthesized
ttcatatacaaagtttagtact

SEQ ID NO: 921030 - DNA, 22 bp, Artificial Sequence
  chemically synthesized
atatacaaagtttagtactttt

SEQ ID NO: 921031 - DNA, 22 bp, Artificial Sequence
  chemically synthesized
aaaagtgattatttataaaaag

SEQ ID NO: 921032 - DNA, 22 bp, Artificial Sequence
  chemically synthesized
aattaaaaagtgattatttata

SEQ ID NO: 921033 - DNA, 22 bp, Artificial Sequence
  chemically synthesized
agtactttttataaataatcac

SEQ ID NO: 921034 - DNA, 22 bp, Artificial Sequence
  chemically synthesized
gtactttttataaataatcact

SEQ ID NO: 921035 - DNA, 22 bp, Artificial Sequence
  chemically synthesized
tttataaataatcactttttaa

SEQ ID NO: 921036 - DNA, 22 bp, Artificial Sequence
  chemically synthesized
ttataaataatcactttttaat

SEQ ID NO: 921037 - DNA, 22 bp, Artificial Sequence
  chemically synthesized
tataaataatcactttttaatt

SEQ ID NO: 921038 - DNA, 22 bp, Artificial Sequence
  chemically synthesized
ataaataatcactttttaattt

SEQ ID NO: 921039 - DNA, 22 bp, Artificial Sequence
  chemically synthesized
taaataatcactttttaattta

SEQ ID NO: 921040 - DNA, 22 bp, Artificial Sequence
  chemically synthesized
gatatcaaccaacggcatatgc

SEQ ID NO: 921041 - DNA, 22 bp, Artificial Sequence
  chemically synthesized
tttaatttagcatatgccgttg

SEQ ID NO: 921042 - DNA, 22 bp, Artificial Sequence
  chemically synthesized
ttaatttagcatatgccgttgg

SEQ ID NO: 921043 - DNA, 22 bp, Artificial Sequence
  chemically synthesized
taatttagcatatgccgttggt

SEQ ID NO: 921044 - DNA, 22 bp, Artificial Sequence
  chemically synthesized
aatttagcatatgccgttggtt

SEQ ID NO: 921045 - DNA, 22 bp, Artificial Sequence
  chemically synthesized
atttagcatatgccgttggttg

SEQ ID NO: 921046 - DNA, 22 bp, Artificial Sequence
  chemically synthesized
tgaccctggatatcaaccaacg

SEQ ID NO: 921047 - DNA, 22 bp, Artificial Sequence
  chemically synthesized
atgaccctggatatcaaccaac

SEQ ID NO: 921048 - DNA, 22 bp, Artificial Sequence
  chemically synthesized
agcatatgccgttggttgatat

SEQ ID NO: 921049 - DNA, 22 bp, Artificial Sequence
  chemically synthesized
gcatatgccgttggttgatatc

SEQ ID NO: 921050 - DNA, 22 bp, Artificial Sequence
  chemically synthesized
gagaaaacatcttatgaccctg

SEQ ID NO: 921051 - DNA, 22 bp, Artificial Sequence
  chemically synthesized
gttgatatccagggtcataaga

SEQ ID NO: 921052 - DNA, 22 bp, Artificial Sequence
  chemically synthesized
atatccagggtcataagatgtt

SEQ ID NO: 921053 - DNA, 22 bp, Artificial Sequence
  chemically synthesized
cccaagaatcagtaaaatggga

SEQ ID NO: 921054 - DNA, 22 bp, Artificial Sequence
  chemically synthesized
tctccagtgtgtcccattttac

SEQ ID NO: 921055 - DNA, 22 bp, Artificial Sequence
  chemically synthesized
ctccagtgtgtcccattttact

SEQ ID NO: 921056 - DNA, 22 bp, Artificial Sequence
  chemically synthesized
tccagtgtgtcccattttactg

SEQ ID NO: 921057 - DNA, 22 bp, Artificial Sequence
  chemically synthesized
cagtgtgtcccattttactgat

SEQ ID NO: 921058 - DNA, 22 bp, Artificial Sequence
  chemically synthesized
gataaatctccccaagaatcag

SEQ ID NO: 921059 - DNA, 22 bp, Artificial Sequence
  chemically synthesized
tactgattcttggggagattta

SEQ ID NO: 921060 - DNA, 22 bp, Artificial Sequence
  chemically synthesized
actgattcttggggagatttat

SEQ ID NO: 921061 - DNA, 22 bp, Artificial Sequence
  chemically synthesized
ctgattcttggggagatttatc

SEQ ID NO: 921062 - DNA, 22 bp, Artificial Sequence
  chemically synthesized
attcttggggagatttatcgag

SEQ ID NO: 921063 - DNA, 22 bp, Artificial Sequence
  chemically synthesized
ttggggagatttatcgagctac

SEQ ID NO: 921064 - DNA, 22 bp, Artificial Sequence
  chemically synthesized
ggggagatttatcgagctactc

SEQ ID NO: 921065 - DNA, 22 bp, Artificial Sequence
  chemically synthesized
gggagatttatcgagctactca

SEQ ID NO: 921066 - DNA, 22 bp, Artificial Sequence
  chemically synthesized
gggatgataaagtgagtagctc

SEQ ID NO: 921067 - DNA, 22 bp, Artificial Sequence
  chemically synthesized
tggggatgataaagtgagtagc

SEQ ID NO: 921068 - DNA, 22 bp, Artificial Sequence
  chemically synthesized
ctggggatgataaagtgagtag

SEQ ID NO: 921069 - DNA, 22 bp, Artificial Sequence
  chemically synthesized
atcgagctactcactttatcat

SEQ ID NO: 921070 - DNA, 22 bp, Artificial Sequence
  chemically synthesized
tcgagctactcactttatcatc

SEQ ID NO: 921071 - DNA, 22 bp, Artificial Sequence
  chemically synthesized
ggtacatgacttctggggatga

SEQ ID NO: 921072 - DNA, 22 bp, Artificial Sequence
  chemically synthesized
ctcactttatcatccccagaag

SEQ ID NO: 921073 - DNA, 22 bp, Artificial Sequence
  chemically synthesized
actttatcatccccagaagtca

SEQ ID NO: 921074 - DNA, 22 bp, Artificial Sequence
  chemically synthesized
gtgtctgggtacatgacttctg

SEQ ID NO: 921075 - DNA, 22 bp, Artificial Sequence
  chemically synthesized
tatcatccccagaagtcatgta

SEQ ID NO: 921076 - DNA, 22 bp, Artificial Sequence
  chemically synthesized
atcatccccagaagtcatgtac

SEQ ID NO: 921077 - DNA, 22 bp, Artificial Sequence
  chemically synthesized
tcatccccagaagtcatgtacc

SEQ ID NO: 921078 - DNA, 22 bp, Artificial Sequence
  chemically synthesized
gaagttagtgtctgggtacatg

SEQ ID NO: 921079 - DNA, 22 bp, Artificial Sequence
  chemically synthesized
agaagttagtgtctgggtacat

SEQ ID NO: 921080 - DNA, 22 bp, Artificial Sequence
  chemically synthesized
tgcccagcacatgagtaggtgc

SEQ ID NO: 921081 - DNA, 22 bp, Artificial Sequence
  chemically synthesized
tatgcccagcacatgagtaggt

SEQ ID NO: 921082 - DNA, 22 bp, Artificial Sequence
  chemically synthesized
acttctaagcacctactcatgt

SEQ ID NO: 921083 - DNA, 22 bp, Artificial Sequence
  chemically synthesized
gctctatgcccagcacatgagt

SEQ ID NO: 921084 - DNA, 22 bp, Artificial Sequence
  chemically synthesized
ctaagcacctactcatgtgctg

SEQ ID NO: 921085 - DNA, 22 bp, Artificial Sequence
  chemically synthesized
taagcacctactcatgtgctgg

SEQ ID NO: 921086 - DNA, 22 bp, Artificial Sequence
  chemically synthesized
gctagctctatgcccagcacat

SEQ ID NO: 921087 - DNA, 22 bp, Artificial Sequence
  chemically synthesized
agcacctactcatgtgctgggc

SEQ ID NO: 921088 - DNA, 22 bp, Artificial Sequence
  chemically synthesized
ctcatgtgctgggcatagagct

SEQ ID NO: 921089 - DNA, 22 bp, Artificial Sequence
  chemically synthesized
atgtgctgggcatagagctagc

SEQ ID NO: 921090 - DNA, 22 bp, Artificial Sequence
  chemically synthesized
ggcatagagctagccaatttat

SEQ ID NO: 921091 - DNA, 22 bp, Artificial Sequence
  chemically synthesized
taagagtaagaggtaatgtaaa

SEQ ID NO: 921092 - DNA, 22 bp, Artificial Sequence
  chemically synthesized
gccaatttatttacattacctc

SEQ ID NO: 921093 - DNA, 22 bp, Artificial Sequence
  chemically synthesized
atttacattacctcttactctt

SEQ ID NO: 921094 - DNA, 22 bp, Artificial Sequence
  chemically synthesized
tagagatgttgtaagagtaaga

SEQ ID NO: 921095 - DNA, 22 bp, Artificial Sequence
  chemically synthesized
tttacattacctcttactctta

SEQ ID NO: 921096 - DNA, 22 bp, Artificial Sequence
  chemically synthesized
atagagatgttgtaagagtaag

SEQ ID NO: 921097 - DNA, 22 bp, Artificial Sequence
  chemically synthesized
acattacctcttactcttacaa

SEQ ID NO: 921098 - DNA, 22 bp, Artificial Sequence
  chemically synthesized
cattacctcttactcttacaac

SEQ ID NO: 921099 - DNA, 22 bp, Artificial Sequence
  chemically synthesized
cctcttactcttacaacatctc

SEQ ID NO: 921100 - DNA, 22 bp, Artificial Sequence
  chemically synthesized
ttactcttacaacatctctata

SEQ ID NO: 921101 - DNA, 22 bp, Artificial Sequence
  chemically synthesized
actcttacaacatctctataaa

SEQ ID NO: 921102 - DNA, 22 bp, Artificial Sequence
  chemically synthesized
ctcttacaacatctctataaat

SEQ ID NO: 921103 - DNA, 22 bp, Artificial Sequence
  chemically synthesized
ttacaacatctctataaatatg

SEQ ID NO: 921104 - DNA, 22 bp, Artificial Sequence
  chemically synthesized
acaacatctctataaatatgta

SEQ ID NO: 921105 - DNA, 22 bp, Artificial Sequence
  chemically synthesized
caacatctctataaatatgtac

SEQ ID NO: 921106 - DNA, 22 bp, Artificial Sequence
  chemically synthesized
atccaaaaataaagataatagt

SEQ ID NO: 921107 - DNA, 22 bp, Artificial Sequence
  chemically synthesized
tataaatatgtactattatctt

SEQ ID NO: 921108 - DNA, 22 bp, Artificial Sequence
  chemically synthesized
taaatatgtactattatcttta

SEQ ID NO: 921109 - DNA, 22 bp, Artificial Sequence
  chemically synthesized
ctaatccaaaaataaagataat

SEQ ID NO: 921110 - DNA, 22 bp, Artificial Sequence
  chemically synthesized
actaatccaaaaataaagataa

SEQ ID NO: 921111 - DNA, 22 bp, Artificial Sequence
  chemically synthesized
tactaatccaaaaataaagata

SEQ ID NO: 921112 - DNA, 22 bp, Artificial Sequence
  chemically synthesized
ttactaatccaaaaataaagat

SEQ ID NO: 921113 - DNA, 22 bp, Artificial Sequence
  chemically synthesized
cttttactaatccaaaaataaa

SEQ ID NO: 921114 - DNA, 22 bp, Artificial Sequence
  chemically synthesized
ccttttactaatccaaaaataa

SEQ ID NO: 921115 - DNA, 22 bp, Artificial Sequence
  chemically synthesized
agcttccttttactaatccaaa

SEQ ID NO: 921116 - DNA, 22 bp, Artificial Sequence
  chemically synthesized
ttatctttatttttggattagt

SEQ ID NO: 921117 - DNA, 22 bp, Artificial Sequence
  chemically synthesized
tctttatttttggattagtaaa

SEQ ID NO: 921118 - DNA, 22 bp, Artificial Sequence
  chemically synthesized
tctgagcttccttttactaatc

SEQ ID NO: 921119 - DNA, 22 bp, Artificial Sequence
  chemically synthesized
tatttttggattagtaaaagga

SEQ ID NO: 921120 - DNA, 22 bp, Artificial Sequence
  chemically synthesized
atttttggattagtaaaaggaa

SEQ ID NO: 921121 - DNA, 22 bp, Artificial Sequence
  chemically synthesized
aattatctgagcttccttttac

SEQ ID NO: 921122 - DNA, 22 bp, Artificial Sequence
  chemically synthesized
tttttggattagtaaaaggaag

SEQ ID NO: 921123 - DNA, 22 bp, Artificial Sequence
  chemically synthesized
aaattatctgagcttcctttta

SEQ ID NO: 921124 - DNA, 22 bp, Artificial Sequence
  chemically synthesized
ttggattagtaaaaggaagctc

SEQ ID NO: 921125 - DNA, 22 bp, Artificial Sequence
  chemically synthesized
cttaaattatctgagcttcctt

SEQ ID NO: 921126 - DNA, 22 bp, Artificial Sequence
  chemically synthesized
tggattagtaaaaggaagctca

SEQ ID NO: 921127 - DNA, 22 bp, Artificial Sequence
  chemically synthesized
ggattagtaaaaggaagctcag

SEQ ID NO: 921128 - DNA, 22 bp, Artificial Sequence
  chemically synthesized
gattagtaaaaggaagctcaga

SEQ ID NO: 921129 - DNA, 22 bp, Artificial Sequence
  chemically synthesized
gtaaaaggaagctcagataatt

SEQ ID NO: 921130 - DNA, 22 bp, Artificial Sequence
  chemically synthesized
caccagctacttaaattatctg

SEQ ID NO: 921131 - DNA, 22 bp, Artificial Sequence
  chemically synthesized
gcaccagctacttaaattatct

SEQ ID NO: 921132 - DNA, 22 bp, Artificial Sequence
  chemically synthesized
ttgcaccagctacttaaattat

SEQ ID NO: 921133 - DNA, 22 bp, Artificial Sequence
  chemically synthesized
tcttgcaccagctacttaaatt

SEQ ID NO: 921134 - DNA, 22 bp, Artificial Sequence
  chemically synthesized
ctcttgcaccagctacttaaat

SEQ ID NO: 921135 - DNA, 22 bp, Artificial Sequence
  chemically synthesized
tctcttgcaccagctacttaaa

SEQ ID NO: 921136 - DNA, 22 bp, Artificial Sequence
  chemically synthesized
ttctcttgcaccagctacttaa

SEQ ID NO: 921137 - DNA, 22 bp, Artificial Sequence
  chemically synthesized
tttctcttgcaccagctactta

SEQ ID NO: 921138 - DNA, 22 bp, Artificial Sequence
  chemically synthesized
ttttctcttgcaccagctactt

SEQ ID NO: 921139 - DNA, 22 bp, Artificial Sequence
  chemically synthesized
ttttttctcttgcaccagctac

SEQ ID NO: 921140 - DNA, 22 bp, Artificial Sequence
  chemically synthesized
agataatttaagtagctggtgc

SEQ ID NO: 921141 - DNA, 22 bp, Artificial Sequence
  chemically synthesized
ttcttttttctcttgcaccagc

SEQ ID NO: 921142 - DNA, 22 bp, Artificial Sequence
  chemically synthesized
gttcttttttctcttgcaccag

SEQ ID NO: 921143 - DNA, 22 bp, Artificial Sequence
  chemically synthesized
atttgttcttttttctcttgca

SEQ ID NO: 921144 - DNA, 22 bp, Artificial Sequence
  chemically synthesized
aatttgttcttttttctcttgc

SEQ ID NO: 921145 - DNA, 22 bp, Artificial Sequence
  chemically synthesized
aagtagctggtgcaagagaaaa

SEQ ID NO: 921146 - DNA, 22 bp, Artificial Sequence
  chemically synthesized
taatttgttcttttttctcttg

SEQ ID NO: 921147 - DNA, 22 bp, Artificial Sequence
  chemically synthesized
agtagctggtgcaagagaaaaa

SEQ ID NO: 921148 - DNA, 22 bp, Artificial Sequence
  chemically synthesized
ttaatttgttcttttttctctt

SEQ ID NO: 921149 - DNA, 22 bp, Artificial Sequence
  chemically synthesized
tatttttaatttgttctttttt

SEQ ID NO: 921150 - DNA, 22 bp, Artificial Sequence
  chemically synthesized
atatttttaatttgttcttttt

SEQ ID NO: 921151 - DNA, 22 bp, Artificial Sequence
  chemically synthesized
gtgcaagagaaaaaagaacaaa

SEQ ID NO: 921152 - DNA, 22 bp, Artificial Sequence
  chemically synthesized
cgtttatatttttaatttgttc

SEQ ID NO: 921153 - DNA, 22 bp, Artificial Sequence
  chemically synthesized
gcgtttatatttttaatttgtt

SEQ ID NO: 921154 - DNA, 22 bp, Artificial Sequence
  chemically synthesized
tgcgtttatatttttaatttgt

SEQ ID NO: 921155 - DNA, 22 bp, Artificial Sequence
  chemically synthesized
aaaatataaacgcaaagatacc

SEQ ID NO: 921156 - DNA, 22 bp, Artificial Sequence
  chemically synthesized
gaagtatgtaacatggtatctt

SEQ ID NO: 921157 - DNA, 22 bp, Artificial Sequence
  chemically synthesized
ggaagtatgtaacatggtatct

SEQ ID NO: 921158 - DNA, 22 bp, Artificial Sequence
  chemically synthesized
tggaagtatgtaacatggtatc

SEQ ID NO: 921159 - DNA, 22 bp, Artificial Sequence
  chemically synthesized
cctttggaagtatgtaacatgg

SEQ ID NO: 921160 - DNA, 22 bp, Artificial Sequence
  chemically synthesized
ttacctttggaagtatgtaaca

SEQ ID NO: 921161 - DNA, 22 bp, Artificial Sequence
  chemically synthesized
attacctttggaagtatgtaac

SEQ ID NO: 921162 - DNA, 22 bp, Artificial Sequence
  chemically synthesized
tgtttattacctttggaagtat

SEQ ID NO: 921163 - DNA, 22 bp, Artificial Sequence
  chemically synthesized
ccacctgtgtttattacctttg

SEQ ID NO: 921164 - DNA, 22 bp, Artificial Sequence
  chemically synthesized
cccacctgtgtttattaccttt

SEQ ID NO: 921165 - DNA, 22 bp, Artificial Sequence
  chemically synthesized
catacttccaaaggtaataaac

SEQ ID NO: 921166 - DNA, 22 bp, Artificial Sequence
  chemically synthesized
tcttcccacctgtgtttattac

SEQ ID NO: 921167 - DNA, 22 bp, Artificial Sequence
  chemically synthesized
ccaaaggtaataaacacaggtg

SEQ ID NO: 921168 - DNA, 22 bp, Artificial Sequence
  chemically synthesized
caaaggtaataaacacaggtgg

SEQ ID NO: 921169 - DNA, 22 bp, Artificial Sequence
  chemically synthesized
ggtaataatcacctatcttccc

SEQ ID NO: 921170 - DNA, 22 bp, Artificial Sequence
  chemically synthesized
aatgctgggtaataatcaccta

SEQ ID NO: 921171 - DNA, 22 bp, Artificial Sequence
  chemically synthesized
gcaactaaatgctgggtaataa

SEQ ID NO: 921172 - DNA, 22 bp, Artificial Sequence
  chemically synthesized
cataaacctggcaactaaatgc

SEQ ID NO: 921173 - DNA, 22 bp, Artificial Sequence
  chemically synthesized
ttacccagcatttagttgccag

SEQ ID NO: 921174 - DNA, 22 bp, Artificial Sequence
  chemically synthesized
gccattacataaacctggcaac

SEQ ID NO: 921175 - DNA, 22 bp, Artificial Sequence
  chemically synthesized
cccagcatttagttgccaggtt

SEQ ID NO: 921176 - DNA, 22 bp, Artificial Sequence
  chemically synthesized
aggttggccattacataaacct

SEQ ID NO: 921177 - DNA, 22 bp, Artificial Sequence
  chemically synthesized
caggttggccattacataaacc

SEQ ID NO: 921178 - DNA, 22 bp, Artificial Sequence
  chemically synthesized
agttgccaggtttatgtaatgg

SEQ ID NO: 921179 - DNA, 22 bp, Artificial Sequence
  chemically synthesized
gttgccaggtttatgtaatggc

SEQ ID NO: 921180 - DNA, 22 bp, Artificial Sequence
  chemically synthesized
gacttcaggttggccattacat

SEQ ID NO: 921181 - DNA, 22 bp, Artificial Sequence
  chemically synthesized
ggacttcaggttggccattaca

SEQ ID NO: 921182 - DNA, 22 bp, Artificial Sequence
  chemically synthesized
ccaggtttatgtaatggccaac

SEQ ID NO: 921183 - DNA, 22 bp, Artificial Sequence
  chemically synthesized
atgtaatggccaacctgaagtc

SEQ ID NO: 921184 - DNA, 22 bp, Artificial Sequence
  chemically synthesized
tgtaatggccaacctgaagtcc

SEQ ID NO: 921185 - DNA, 22 bp, Artificial Sequence
  chemically synthesized
ggcagtagtaaatcagagtact

SEQ ID NO: 921186 - DNA, 22 bp, Artificial Sequence
  chemically synthesized
aagtccaagtactctgatttac

SEQ ID NO: 921187 - DNA, 22 bp, Artificial Sequence
  chemically synthesized
tactaggcagtagtaaatcaga

SEQ ID NO: 921188 - DNA, 22 bp, Artificial Sequence
  chemically synthesized
atactaggcagtagtaaatcag

SEQ ID NO: 921189 - DNA, 22 bp, Artificial Sequence
  chemically synthesized
tatactaggcagtagtaaatca

SEQ ID NO: 921190 - DNA, 22 bp, Artificial Sequence
  chemically synthesized
gcctttatactaggcagtagta

SEQ ID NO: 921191 - DNA, 22 bp, Artificial Sequence
  chemically synthesized
attagcctttatactaggcagt

SEQ ID NO: 921192 - DNA, 22 bp, Artificial Sequence
  chemically synthesized
tgatttactactgcctagtata

SEQ ID NO: 921193 - DNA, 22 bp, Artificial Sequence
  chemically synthesized
ctaattagcctttatactaggc

SEQ ID NO: 921194 - DNA, 22 bp, Artificial Sequence
  chemically synthesized
gctaattagcctttatactagg

SEQ ID NO: 921195 - DNA, 22 bp, Artificial Sequence
  chemically synthesized
atttactactgcctagtataaa

SEQ ID NO: 921196 - DNA, 22 bp, Artificial Sequence
  chemically synthesized
ttgctaattagcctttatacta

SEQ ID NO: 921197 - DNA, 22 bp, Artificial Sequence
  chemically synthesized
cttgctaattagcctttatact

SEQ ID NO: 921198 - DNA, 22 bp, Artificial Sequence
  chemically synthesized
tcttgctaattagcctttatac

SEQ ID NO: 921199 - DNA, 22 bp, Artificial Sequence
  chemically synthesized
actactgcctagtataaaggct

SEQ ID NO: 921200 - DNA, 22 bp, Artificial Sequence
  chemically synthesized
ctactgcctagtataaaggcta

SEQ ID NO: 921201 - DNA, 22 bp, Artificial Sequence
  chemically synthesized
ctgcctagtataaaggctaatt

SEQ ID NO: 921202 - DNA, 22 bp, Artificial Sequence
  chemically synthesized
gtgttttcttgctaattagcct

SEQ ID NO: 921203 - DNA, 22 bp, Artificial Sequence
  chemically synthesized
ggtgttttcttgctaattagcc

SEQ ID NO: 921204 - DNA, 22 bp, Artificial Sequence
  chemically synthesized
cctagtataaaggctaattagc

SEQ ID NO: 921205 - DNA, 22 bp, Artificial Sequence
  chemically synthesized
tttggtgttttcttgctaatta

SEQ ID NO: 921206 - DNA, 22 bp, Artificial Sequence
  chemically synthesized
atttggtgttttcttgctaatt

SEQ ID NO: 921207 - DNA, 22 bp, Artificial Sequence
  chemically synthesized
gtataaaggctaattagcaaga

SEQ ID NO: 921208 - DNA, 22 bp, Artificial Sequence
  chemically synthesized
acttatttggtgttttcttgct

SEQ ID NO: 921209 - DNA, 22 bp, Artificial Sequence
  chemically synthesized
ctgacttatttggtgttttctt

SEQ ID NO: 921210 - DNA, 22 bp, Artificial Sequence
  chemically synthesized
ctactgacttatttggtgtttt

SEQ ID NO: 921211 - DNA, 22 bp, Artificial Sequence
  chemically synthesized
tcctactgacttatttggtgtt

SEQ ID NO: 921212 - DNA, 22 bp, Artificial Sequence
  chemically synthesized
attagcaagaaaacaccaaata

SEQ ID NO: 921213 - DNA, 22 bp, Artificial Sequence
  chemically synthesized
ctcctactgacttatttggtgt

SEQ ID NO: 921214 - DNA, 22 bp, Artificial Sequence
  chemically synthesized
tttctcctactgacttatttgg

SEQ ID NO: 921215 - DNA, 22 bp, Artificial Sequence
  chemically synthesized
gcaagaaaacaccaaataagtc

SEQ ID NO: 921216 - DNA, 22 bp, Artificial Sequence
  chemically synthesized
gtttctcctactgacttatttg

SEQ ID NO: 921217 - DNA, 22 bp, Artificial Sequence
  chemically synthesized
tccatgacaaaaacagcttgtt

SEQ ID NO: 921218 - DNA, 22 bp, Artificial Sequence
  chemically synthesized
gagtctatccatgacaaaaaca

SEQ ID NO: 921219 - DNA, 22 bp, Artificial Sequence
  chemically synthesized
atgattagagtctatccatgac

SEQ ID NO: 921220 - DNA, 22 bp, Artificial Sequence
  chemically synthesized
aatgattagagtctatccatga

SEQ ID NO: 921221 - DNA, 22 bp, Artificial Sequence
  chemically synthesized
taatgattagagtctatccatg

SEQ ID NO: 921222 - DNA, 22 bp, Artificial Sequence
  chemically synthesized
ttaatgattagagtctatccat

SEQ ID NO: 921223 - DNA, 22 bp, Artificial Sequence
  chemically synthesized
tttaatgattagagtctatcca

SEQ ID NO: 921224 - DNA, 22 bp, Artificial Sequence
  chemically synthesized
ttttaatgattagagtctatcc

SEQ ID NO: 921225 - DNA, 22 bp, Artificial Sequence
  chemically synthesized
tttttgtcatggatagactcta

SEQ ID NO: 921226 - DNA, 22 bp, Artificial Sequence
  chemically synthesized
tttttttaatgattagagtcta

SEQ ID NO: 921227 - DNA, 22 bp, Artificial Sequence
  chemically synthesized
ttgtcatggatagactctaatc

SEQ ID NO: 921228 - DNA, 22 bp, Artificial Sequence
  chemically synthesized
tgtcatggatagactctaatca

SEQ ID NO: 921229 - DNA, 22 bp, Artificial Sequence
  chemically synthesized
gtcatggatagactctaatcat

SEQ ID NO: 921230 - DNA, 22 bp, Artificial Sequence
  chemically synthesized
tcatggatagactctaatcatt

SEQ ID NO: 921231 - DNA, 22 bp, Artificial Sequence
  chemically synthesized
taatcattaaaaaaacaatcat

SEQ ID NO: 921232 - DNA, 22 bp, Artificial Sequence
  chemically synthesized
tgagccaatataatgattgttt

SEQ ID NO: 921233 - DNA, 22 bp, Artificial Sequence
  chemically synthesized
atgagccaatataatgattgtt

SEQ ID NO: 921234 - DNA, 22 bp, Artificial Sequence
  chemically synthesized
atcattaaaaaaacaatcatta

SEQ ID NO: 921235 - DNA, 22 bp, Artificial Sequence
  chemically synthesized
tatgagccaatataatgattgt

SEQ ID NO: 921236 - DNA, 22 bp, Artificial Sequence
  chemically synthesized
actttatgagccaatataatga

SEQ ID NO: 921237 - DNA, 22 bp, Artificial Sequence
  chemically synthesized
taactttatgagccaatataat

SEQ ID NO: 921238 - DNA, 22 bp, Artificial Sequence
  chemically synthesized
aaaaaacaatcattatattggc

SEQ ID NO: 921239 - DNA, 22 bp, Artificial Sequence
  chemically synthesized
tattggctcataaagttagaat

SEQ ID NO: 921240 - DNA, 22 bp, Artificial Sequence
  chemically synthesized
catgtgcgaatcaaattctaac

SEQ ID NO: 921241 - DNA, 22 bp, Artificial Sequence
  chemically synthesized
gctcataaagttagaatttgat

SEQ ID NO: 921242 - DNA, 22 bp, Artificial Sequence
  chemically synthesized
gaattacatgtgcgaatcaaat

SEQ ID NO: 921243 - DNA, 22 bp, Artificial Sequence
  chemically synthesized
ataaagttagaatttgattcgc

SEQ ID NO: 921244 - DNA, 22 bp, Artificial Sequence
  chemically synthesized
ttagaattacatgtgcgaatca

SEQ ID NO: 921245 - DNA, 22 bp, Artificial Sequence
  chemically synthesized
attagaattacatgtgcgaatc

SEQ ID NO: 921246 - DNA, 22 bp, Artificial Sequence
  chemically synthesized
tattagaattacatgtgcgaat

SEQ ID NO: 921247 - DNA, 22 bp, Artificial Sequence
  chemically synthesized
gaatttgattcgcacatgtaat

SEQ ID NO: 921248 - DNA, 22 bp, Artificial Sequence
  chemically synthesized
gattttattagaattacatgtg

SEQ ID NO: 921249 - DNA, 22 bp, Artificial Sequence
  chemically synthesized
gattcgcacatgtaattctaat

SEQ ID NO: 921250 - DNA, 22 bp, Artificial Sequence
  chemically synthesized
attcgcacatgtaattctaata

SEQ ID NO: 921251 - DNA, 22 bp, Artificial Sequence
  chemically synthesized
gcacatgtaattctaataaaat

SEQ ID NO: 921252 - DNA, 22 bp, Artificial Sequence
  chemically synthesized
taataaaatccagggtcccacg

SEQ ID NO: 921253 - DNA, 22 bp, Artificial Sequence
  chemically synthesized
ataaaatccagggtcccacgtg

SEQ ID NO: 921254 - DNA, 22 bp, Artificial Sequence
  chemically synthesized
acgaatatgggtcacgtgggac

SEQ ID NO: 921255 - DNA, 22 bp, Artificial Sequence
  chemically synthesized
aacgaatatgggtcacgtggga

SEQ ID NO: 921256 - DNA, 22 bp, Artificial Sequence
  chemically synthesized
taacgaatatgggtcacgtggg

SEQ ID NO: 921257 - DNA, 22 bp, Artificial Sequence
  chemically synthesized
tttaacgaatatgggtcacgtg

SEQ ID NO: 921258 - DNA, 22 bp, Artificial Sequence
  chemically synthesized
gtgtaactctttaacgaatatg

SEQ ID NO: 921259 - DNA, 22 bp, Artificial Sequence
  chemically synthesized
ttggtgtaactctttaacgaat

SEQ ID NO: 921260 - DNA, 22 bp, Artificial Sequence
  chemically synthesized
tgttggtgtaactctttaacga

SEQ ID NO: 921261 - DNA, 22 bp, Artificial Sequence
  chemically synthesized
tctgttggtgtaactctttaac

SEQ ID NO: 921262 - DNA, 22 bp, Artificial Sequence
  chemically synthesized
attctctgttggtgtaactctt

SEQ ID NO: 921263 - DNA, 22 bp, Artificial Sequence
  chemically synthesized
ggctgattctctgttggtgtaa

SEQ ID NO: 921264 - DNA, 22 bp, Artificial Sequence
  chemically synthesized
gttaaagagttacaccaacaga

SEQ ID NO: 921265 - DNA, 22 bp, Artificial Sequence
  chemically synthesized
ctgggctgattctctgttggtg

SEQ ID NO: 921266 - DNA, 22 bp, Artificial Sequence
  chemically synthesized
gctgggctgattctctgttggt

SEQ ID NO: 921267 - DNA, 22 bp, Artificial Sequence
  chemically synthesized
tgctgggctgattctctgttgg

SEQ ID NO: 921268 - DNA, 22 bp, Artificial Sequence
  chemically synthesized
ttgctgggctgattctctgttg

SEQ ID NO: 921269 - DNA, 22 bp, Artificial Sequence
  chemically synthesized
aagagttacaccaacagagaat

SEQ ID NO: 921270 - DNA, 22 bp, Artificial Sequence
  chemically synthesized
tttttgctgggctgattctctg

SEQ ID NO: 921271 - DNA, 22 bp, Artificial Sequence
  chemically synthesized
caccaacagagaatcagcccag

SEQ ID NO: 921272 - DNA, 22 bp, Artificial Sequence
  chemically synthesized
atgatctatttttgctgggctg

SEQ ID NO: 921273 - DNA, 22 bp, Artificial Sequence
  chemically synthesized
gatgatctatttttgctgggct

SEQ ID NO: 921274 - DNA, 22 bp, Artificial Sequence
  chemically synthesized
tgatgatctatttttgctgggc

SEQ ID NO: 921275 - DNA, 22 bp, Artificial Sequence
  chemically synthesized
ttgatgatctatttttgctggg

SEQ ID NO: 921276 - DNA, 22 bp, Artificial Sequence
  chemically synthesized
tttgatgatctatttttgctgg

SEQ ID NO: 921277 - DNA, 22 bp, Artificial Sequence
  chemically synthesized
ttttttgatgatctatttttgc

SEQ ID NO: 921278 - DNA, 22 bp, Artificial Sequence
  chemically synthesized
taattattttttgatgatctat

SEQ ID NO: 921279 - DNA, 22 bp, Artificial Sequence
  chemically synthesized
agattataattattttttgatg

SEQ ID NO: 921280 - DNA, 22 bp, Artificial Sequence
  chemically synthesized
aaatgtaaattgagattataat

SEQ ID NO: 921281 - DNA, 22 bp, Artificial Sequence
  chemically synthesized
aaaatgtaaattgagattataa

SEQ ID NO: 921282 - DNA, 22 bp, Artificial Sequence
  chemically synthesized
taaaatgtaaattgagattata

SEQ ID NO: 921283 - DNA, 22 bp, Artificial Sequence
  chemically synthesized
attttaaaatgtaaattgagat

SEQ ID NO: 921284 - DNA, 22 bp, Artificial Sequence
  chemically synthesized
tattaattttaaaatgtaaatt

SEQ ID NO: 921285 - DNA, 22 bp, Artificial Sequence
  chemically synthesized
cctatattaattttaaaatgta

SEQ ID NO: 921286 - DNA, 22 bp, Artificial Sequence
  chemically synthesized
taatctcaatttacattttaaa

SEQ ID NO: 921287 - DNA, 22 bp, Artificial Sequence
  chemically synthesized
aatttacattttaaaattaata

SEQ ID NO: 921288 - DNA, 22 bp, Artificial Sequence
  chemically synthesized
tagatgagttccctatattaat

SEQ ID NO: 921289 - DNA, 22 bp, Artificial Sequence
  chemically synthesized
acattttaaaattaatataggg

SEQ ID NO: 921290 - DNA, 22 bp, Artificial Sequence
  chemically synthesized
cattttaaaattaatataggga

SEQ ID NO: 921291 - DNA, 22 bp, Artificial Sequence
  chemically synthesized
taaattgtagatgagttcccta

SEQ ID NO: 921292 - DNA, 22 bp, Artificial Sequence
  chemically synthesized
taaaattaatatagggaactca

SEQ ID NO: 921293 - DNA, 22 bp, Artificial Sequence
  chemically synthesized
aaaattaatatagggaactcat

SEQ ID NO: 921294 - DNA, 22 bp, Artificial Sequence
  chemically synthesized
tgtaaattgtagatgagttccc

SEQ ID NO: 921295 - DNA, 22 bp, Artificial Sequence
  chemically synthesized
aaattaatatagggaactcatc

SEQ ID NO: 921296 - DNA, 22 bp, Artificial Sequence
  chemically synthesized
atatagggaactcatctacaat

SEQ ID NO: 921297 - DNA, 22 bp, Artificial Sequence
  chemically synthesized
gaatgttctgtaaattgtagat

SEQ ID NO: 921298 - DNA, 22 bp, Artificial Sequence
  chemically synthesized
tggaatgttctgtaaattgtag

SEQ ID NO: 921299 - DNA, 22 bp, Artificial Sequence
  chemically synthesized
atctacaatttacagaacattc

SEQ ID NO: 921300 - DNA, 22 bp, Artificial Sequence
  chemically synthesized
caatttacagaacattccagaa

SEQ ID NO: 921301 - DNA, 22 bp, Artificial Sequence
  chemically synthesized
acagaacattccagaactttca

SEQ ID NO: 921302 - DNA, 22 bp, Artificial Sequence
  chemically synthesized
cagaacattccagaactttcat

SEQ ID NO: 921303 - DNA, 22 bp, Artificial Sequence
  chemically synthesized
cagaactttcatttcttctcct

SEQ ID NO: 921304 - DNA, 22 bp, Artificial Sequence
  chemically synthesized
tcatttcttctcctcctcactt

SEQ ID NO: 921305 - DNA, 22 bp, Artificial Sequence
  chemically synthesized
catttcttctcctcctcacttt

SEQ ID NO: 921306 - DNA, 22 bp, Artificial Sequence
  chemically synthesized
atttcttctcctcctcactttt

SEQ ID NO: 921307 - DNA, 22 bp, Artificial Sequence
  chemically synthesized
gatgggtataaaaaaaagtgag

SEQ ID NO: 921308 - DNA, 22 bp, Artificial Sequence
  chemically synthesized
cttctcctcctcactttttttt

SEQ ID NO: 921309 - DNA, 22 bp, Artificial Sequence
  chemically synthesized
ttctcctcctcactttttttta

SEQ ID NO: 921310 - DNA, 22 bp, Artificial Sequence
  chemically synthesized
ctcctcctcacttttttttata

SEQ ID NO: 921311 - DNA, 22 bp, Artificial Sequence
  chemically synthesized
tcctcctcacttttttttatac

SEQ ID NO: 921312 - DNA, 22 bp, Artificial Sequence
  chemically synthesized
ctcctcacttttttttataccc

SEQ ID NO: 921313 - DNA, 22 bp, Artificial Sequence
  chemically synthesized
tgaagaactggatgggtataaa

SEQ ID NO: 921314 - DNA, 22 bp, Artificial Sequence
  chemically synthesized
ctcacttttttttatacccatc

SEQ ID NO: 921315 - DNA, 22 bp, Artificial Sequence
  chemically synthesized
acttttttttatacccatccag

SEQ ID NO: 921316 - DNA, 22 bp, Artificial Sequence
  chemically synthesized
aaagattgtgaagaactggatg

SEQ ID NO: 921317 - DNA, 22 bp, Artificial Sequence
  chemically synthesized
ttttttatacccatccagttct

SEQ ID NO: 921318 - DNA, 22 bp, Artificial Sequence
  chemically synthesized
tttttatacccatccagttctt

SEQ ID NO: 921319 - DNA, 22 bp, Artificial Sequence
  chemically synthesized
ttttatacccatccagttcttc

SEQ ID NO: 921320 - DNA, 22 bp, Artificial Sequence
  chemically synthesized
tttatacccatccagttcttca

SEQ ID NO: 921321 - DNA, 22 bp, Artificial Sequence
  chemically synthesized
ttatacccatccagttcttcac

SEQ ID NO: 921322 - DNA, 22 bp, Artificial Sequence
  chemically synthesized
tatacccatccagttcttcaca

SEQ ID NO: 921323 - DNA, 22 bp, Artificial Sequence
  chemically synthesized
atacccatccagttcttcacaa

SEQ ID NO: 921324 - DNA, 22 bp, Artificial Sequence
  chemically synthesized
tacccatccagttcttcacaat

SEQ ID NO: 921325 - DNA, 22 bp, Artificial Sequence
  chemically synthesized
agaggttgaaagattgtgaaga

SEQ ID NO: 921326 - DNA, 22 bp, Artificial Sequence
  chemically synthesized
cagaggttgaaagattgtgaag

SEQ ID NO: 921327 - DNA, 22 bp, Artificial Sequence
  chemically synthesized
gagtgtttcagaggttgaaaga

SEQ ID NO: 921328 - DNA, 22 bp, Artificial Sequence
  chemically synthesized
tggagtgtttcagaggttgaaa

SEQ ID NO: 921329 - DNA, 22 bp, Artificial Sequence
  chemically synthesized
ctggagtgtttcagaggttgaa

SEQ ID NO: 921330 - DNA, 22 bp, Artificial Sequence
  chemically synthesized
ttcacaatctttcaacctctga

SEQ ID NO: 921331 - DNA, 22 bp, Artificial Sequence
  chemically synthesized
cacaatctttcaacctctgaaa

SEQ ID NO: 921332 - DNA, 22 bp, Artificial Sequence
  chemically synthesized
acaatctttcaacctctgaaac

SEQ ID NO: 921333 - DNA, 22 bp, Artificial Sequence
  chemically synthesized
tcaacctctgaaacactccaga

SEQ ID NO: 921334 - DNA, 22 bp, Artificial Sequence
  chemically synthesized
caacctctgaaacactccagaa

SEQ ID NO: 921335 - DNA, 22 bp, Artificial Sequence
  chemically synthesized
aacctctgaaacactccagaaa

SEQ ID NO: 921336 - DNA, 22 bp, Artificial Sequence
  chemically synthesized
tgaatgtggatacggtttctgg

SEQ ID NO: 921337 - DNA, 22 bp, Artificial Sequence
  chemically synthesized
tgaaacactccagaaaccgtat

SEQ ID NO: 921338 - DNA, 22 bp, Artificial Sequence
  chemically synthesized
aaacactccagaaaccgtatcc

SEQ ID NO: 921339 - DNA, 22 bp, Artificial Sequence
  chemically synthesized
cagaaaccgtatccacattcac

SEQ ID NO: 921340 - DNA, 22 bp, Artificial Sequence
  chemically synthesized
ccccataaagataacaagagaa

SEQ ID NO: 921341 - DNA, 22 bp, Artificial Sequence
  chemically synthesized
tctaccccataaagataacaag

SEQ ID NO: 921342 - DNA, 22 bp, Artificial Sequence
  chemically synthesized
atctaccccataaagataacaa

SEQ ID NO: 921343 - DNA, 22 bp, Artificial Sequence
  chemically synthesized
acagattctcttgttatcttta

SEQ ID NO: 921344 - DNA, 22 bp, Artificial Sequence
  chemically synthesized
tcttgttatctttatggggtag

SEQ ID NO: 921345 - DNA, 22 bp, Artificial Sequence
  chemically synthesized
ttgttatctttatggggtagat

SEQ ID NO: 921346 - DNA, 22 bp, Artificial Sequence
  chemically synthesized
gttatctttatggggtagataa

SEQ ID NO: 921347 - DNA, 22 bp, Artificial Sequence
  chemically synthesized
caaaagcaaggtttatctaccc

SEQ ID NO: 921348 - DNA, 22 bp, Artificial Sequence
  chemically synthesized
ttatctttatggggtagataaa

SEQ ID NO: 921349 - DNA, 22 bp, Artificial Sequence
  chemically synthesized
tctttatggggtagataaacct

SEQ ID NO: 921350 - DNA, 22 bp, Artificial Sequence
  chemically synthesized
tatggggtagataaaccttgct

SEQ ID NO: 921351 - DNA, 22 bp, Artificial Sequence
  chemically synthesized
atggggtagataaaccttgctt

SEQ ID NO: 921352 - DNA, 22 bp, Artificial Sequence
  chemically synthesized
tggggtagataaaccttgcttt

SEQ ID NO: 921353 - DNA, 22 bp, Artificial Sequence
  chemically synthesized
tgtaaaaggaaagtatctacaa

SEQ ID NO: 921354 - DNA, 22 bp, Artificial Sequence
  chemically synthesized
gcttttgtagatactttccttt

SEQ ID NO: 921355 - DNA, 22 bp, Artificial Sequence
  chemically synthesized
cttttgtagatactttcctttt

SEQ ID NO: 921356 - DNA, 22 bp, Artificial Sequence
  chemically synthesized
ttgtagatactttccttttaca

SEQ ID NO: 921357 - DNA, 22 bp, Artificial Sequence
  chemically synthesized
tgtagatactttccttttacac

SEQ ID NO: 921358 - DNA, 22 bp, Artificial Sequence
  chemically synthesized
gtagatactttccttttacaca

SEQ ID NO: 921359 - DNA, 22 bp, Artificial Sequence
  chemically synthesized
tagatactttccttttacacaa

SEQ ID NO: 921360 - DNA, 22 bp, Artificial Sequence
  chemically synthesized
aggaaaaatgacgattgtgtaa

SEQ ID NO: 921361 - DNA, 22 bp, Artificial Sequence
  chemically synthesized
aaggaaaaatgacgattgtgta

SEQ ID NO: 921362 - DNA, 22 bp, Artificial Sequence
  chemically synthesized
tccttttacacaatcgtcattt

SEQ ID NO: 921363 - DNA, 22 bp, Artificial Sequence
  chemically synthesized
ccttttacacaatcgtcatttt

SEQ ID NO: 921364 - DNA, 22 bp, Artificial Sequence
  chemically synthesized
cttttacacaatcgtcattttt

SEQ ID NO: 921365 - DNA, 22 bp, Artificial Sequence
  chemically synthesized
gagaatacttaaggaaaaatga

SEQ ID NO: 921366 - DNA, 22 bp, Artificial Sequence
  chemically synthesized
ttacacaatcgtcatttttcct

SEQ ID NO: 921367 - DNA, 22 bp, Artificial Sequence
  chemically synthesized
ggagaatacttaaggaaaaatg

SEQ ID NO: 921368 - DNA, 22 bp, Artificial Sequence
  chemically synthesized
tacacaatcgtcatttttcctt

SEQ ID NO: 921369 - DNA, 22 bp, Artificial Sequence
  chemically synthesized
acacaatcgtcatttttcctta

SEQ ID NO: 921370 - DNA, 22 bp, Artificial Sequence
  chemically synthesized
cacaatcgtcatttttccttaa

SEQ ID NO: 921371 - DNA, 22 bp, Artificial Sequence
  chemically synthesized
aatggtgtggaatttggagaat

SEQ ID NO: 921372 - DNA, 22 bp, Artificial Sequence
  chemically synthesized
aaatggtgtggaatttggagaa

SEQ ID NO: 921373 - DNA, 22 bp, Artificial Sequence
  chemically synthesized
ttccttaagtattctccaaatt

SEQ ID NO: 921374 - DNA, 22 bp, Artificial Sequence
  chemically synthesized
taaatggtgtggaatttggaga

SEQ ID NO: 921375 - DNA, 22 bp, Artificial Sequence
  chemically synthesized
tccttaagtattctccaaattc

SEQ ID NO: 921376 - DNA, 22 bp, Artificial Sequence
  chemically synthesized
ccttaagtattctccaaattcc

SEQ ID NO: 921377 - DNA, 22 bp, Artificial Sequence
  chemically synthesized
cttaagtattctccaaattcca

SEQ ID NO: 921378 - DNA, 22 bp, Artificial Sequence
  chemically synthesized
aagtattctccaaattccacac

SEQ ID NO: 921379 - DNA, 22 bp, Artificial Sequence
  chemically synthesized
agtattctccaaattccacacc

SEQ ID NO: 921380 - DNA, 22 bp, Artificial Sequence
  chemically synthesized
taaattttaaatggtgtggaat

SEQ ID NO: 921381 - DNA, 22 bp, Artificial Sequence
  chemically synthesized
atcctataaattttaaatggtg

SEQ ID NO: 921382 - DNA, 22 bp, Artificial Sequence
  chemically synthesized
tccaaattccacaccatttaaa

SEQ ID NO: 921383 - DNA, 22 bp, Artificial Sequence
  chemically synthesized
caaattccacaccatttaaaat

SEQ ID NO: 921384 - DNA, 22 bp, Artificial Sequence
  chemically synthesized
tccattcatcctataaatttta

SEQ ID NO: 921385 - DNA, 22 bp, Artificial Sequence
  chemically synthesized
atccattcatcctataaatttt

SEQ ID NO: 921386 - DNA, 22 bp, Artificial Sequence
  chemically synthesized
tatccattcatcctataaattt

SEQ ID NO: 921387 - DNA, 22 bp, Artificial Sequence
  chemically synthesized
cacaccatttaaaatttatagg

SEQ ID NO: 921388 - DNA, 22 bp, Artificial Sequence
  chemically synthesized
tttatccattcatcctataaat

SEQ ID NO: 921389 - DNA, 22 bp, Artificial Sequence
  chemically synthesized
ctttatccattcatcctataaa

SEQ ID NO: 921390 - DNA, 22 bp, Artificial Sequence
  chemically synthesized
tctttatccattcatcctataa

SEQ ID NO: 921391 - DNA, 22 bp, Artificial Sequence
  chemically synthesized
aaaatttataggatgaatggat

SEQ ID NO: 921392 - DNA, 22 bp, Artificial Sequence
  chemically synthesized
aaatttataggatgaatggata

SEQ ID NO: 921393 - DNA, 22 bp, Artificial Sequence
  chemically synthesized
ataggatgaatggataaagaaa

SEQ ID NO: 921394 - DNA, 22 bp, Artificial Sequence
  chemically synthesized
taggatgaatggataaagaaaa

SEQ ID NO: 921395 - DNA, 22 bp, Artificial Sequence
  chemically synthesized
aataatatcccatggtgcatat

SEQ ID NO: 921396 - DNA, 22 bp, Artificial Sequence
  chemically synthesized
tatggctgaataatatcccatg

SEQ ID NO: 921397 - DNA, 22 bp, Artificial Sequence
  chemically synthesized
gtatggctgaataatatcccat

SEQ ID NO: 921398 - DNA, 22 bp, Artificial Sequence
  chemically synthesized
tgtatggctgaataatatccca

SEQ ID NO: 921399 - DNA, 22 bp, Artificial Sequence
  chemically synthesized
accctttgtatggctgaataat

SEQ ID NO: 921400 - DNA, 22 bp, Artificial Sequence
  chemically synthesized
caccctttgtatggctgaataa

SEQ ID NO: 921401 - DNA, 22 bp, Artificial Sequence
  chemically synthesized
ttcagccatacaaagggtgaaa

SEQ ID NO: 921402 - DNA, 22 bp, Artificial Sequence
  chemically synthesized
caaatgacaggatttcaccctt

SEQ ID NO: 921403 - DNA, 22 bp, Artificial Sequence
  chemically synthesized
agccatacaaagggtgaaatcc

SEQ ID NO: 921404 - DNA, 22 bp, Artificial Sequence
  chemically synthesized
ctgcaaatgacaggatttcacc

SEQ ID NO: 921405 - DNA, 22 bp, Artificial Sequence
  chemically synthesized
tccacgttgctgcaaatgacag

SEQ ID NO: 921406 - DNA, 22 bp, Artificial Sequence
  chemically synthesized
tatccacgttgctgcaaatgac

SEQ ID NO: 921407 - DNA, 22 bp, Artificial Sequence
  chemically synthesized
cagttctatccacgttgctgca

SEQ ID NO: 921408 - DNA, 22 bp, Artificial Sequence
  chemically synthesized
cctccagttctatccacgttgc

SEQ ID NO: 921409 - DNA, 22 bp, Artificial Sequence
  chemically synthesized
tcatttgcagcaacgtggatag

SEQ ID NO: 921410 - DNA, 22 bp, Artificial Sequence
  chemically synthesized
gcagcaacgtggatagaactgg

SEQ ID NO: 921411 - DNA, 22 bp, Artificial Sequence
  chemically synthesized
aaataattacctccagttctat

SEQ ID NO: 921412 - DNA, 22 bp, Artificial Sequence
  chemically synthesized
cagcaacgtggatagaactgga

SEQ ID NO: 921413 - DNA, 22 bp, Artificial Sequence
  chemically synthesized
aaaataattacctccagttcta

SEQ ID NO: 921414 - DNA, 22 bp, Artificial Sequence
  chemically synthesized
cttaaaataattacctccagtt

SEQ ID NO: 921415 - DNA, 22 bp, Artificial Sequence
  chemically synthesized
acttaaaataattacctccagt

SEQ ID NO: 921416 - DNA, 22 bp, Artificial Sequence
  chemically synthesized
ccttacttaaaataattacctc

SEQ ID NO: 921417 - DNA, 22 bp, Artificial Sequence
  chemically synthesized
accttacttaaaataattacct

SEQ ID NO: 921418 - DNA, 22 bp, Artificial Sequence
  chemically synthesized
gtttaccttacttaaaataatt

SEQ ID NO: 921419 - DNA, 22 bp, Artificial Sequence
  chemically synthesized
tgcctggtttaccttacttaaa

SEQ ID NO: 921420 - DNA, 22 bp, Artificial Sequence
  chemically synthesized
gaggtaattattttaagtaagg

SEQ ID NO: 921421 - DNA, 22 bp, Artificial Sequence
  chemically synthesized
tgtgcctggtttaccttactta

SEQ ID NO: 921422 - DNA, 22 bp, Artificial Sequence
  chemically synthesized
ctgtgcctggtttaccttactt

SEQ ID NO: 921423 - DNA, 22 bp, Artificial Sequence
  chemically synthesized
tctgtgcctggtttaccttact

SEQ ID NO: 921424 - DNA, 22 bp, Artificial Sequence
  chemically synthesized
tctttctgtgcctggtttacct

SEQ ID NO: 921425 - DNA, 22 bp, Artificial Sequence
  chemically synthesized
gtctttctgtgcctggtttacc

SEQ ID NO: 921426 - DNA, 22 bp, Artificial Sequence
  chemically synthesized
ttttaagtaaggtaaaccaggc

SEQ ID NO: 921427 - DNA, 22 bp, Artificial Sequence
  chemically synthesized
taagtaaggtaaaccaggcaca

SEQ ID NO: 921428 - DNA, 22 bp, Artificial Sequence
  chemically synthesized
aagtaaggtaaaccaggcacag

SEQ ID NO: 921429 - DNA, 22 bp, Artificial Sequence
  chemically synthesized
agtaaggtaaaccaggcacaga

SEQ ID NO: 921430 - DNA, 22 bp, Artificial Sequence
  chemically synthesized
ccacatgtgagtgacaacacat

SEQ ID NO: 921431 - DNA, 22 bp, Artificial Sequence
  chemically synthesized
gctcccacatgtgagtgacaac

SEQ ID NO: 921432 - DNA, 22 bp, Artificial Sequence
  chemically synthesized
agctcccacatgtgagtgacaa

SEQ ID NO: 921433 - DNA, 22 bp, Artificial Sequence
  chemically synthesized
tagctcccacatgtgagtgaca

SEQ ID NO: 921434 - DNA, 22 bp, Artificial Sequence
  chemically synthesized
ttagctcccacatgtgagtgac

SEQ ID NO: 921435 - DNA, 22 bp, Artificial Sequence
  chemically synthesized
tgtgttgtcactcacatgtggg

SEQ ID NO: 921436 - DNA, 22 bp, Artificial Sequence
  chemically synthesized
tcactcacatgtgggagctaaa

SEQ ID NO: 921437 - DNA, 22 bp, Artificial Sequence
  chemically synthesized
atgagatccatgtttttagctc

SEQ ID NO: 921438 - DNA, 22 bp, Artificial Sequence
  chemically synthesized
catgagatccatgtttttagct

SEQ ID NO: 921439 - DNA, 22 bp, Artificial Sequence
  chemically synthesized
tcatgagatccatgtttttagc

SEQ ID NO: 921440 - DNA, 22 bp, Artificial Sequence
  chemically synthesized
acatgtgggagctaaaaacatg

SEQ ID NO: 921441 - DNA, 22 bp, Artificial Sequence
  chemically synthesized
ctttcatgagatccatgttttt

SEQ ID NO: 921442 - DNA, 22 bp, Artificial Sequence
  chemically synthesized
aaaacatggatctcatgaaagt

SEQ ID NO: 921443 - DNA, 22 bp, Artificial Sequence
  chemically synthesized
gtaaccaccaaggtagtgtcta

SEQ ID NO: 921444 - DNA, 22 bp, Artificial Sequence
  chemically synthesized
tggtaaccaccaaggtagtgtc

SEQ ID NO: 921445 - DNA, 22 bp, Artificial Sequence
  chemically synthesized
atgaaagtagacactaccttgg

SEQ ID NO: 921446 - DNA, 22 bp, Artificial Sequence
  chemically synthesized
atctctggtaaccaccaaggta

SEQ ID NO: 921447 - DNA, 22 bp, Artificial Sequence
  chemically synthesized
tgatctctggtaaccaccaagg

SEQ ID NO: 921448 - DNA, 22 bp, Artificial Sequence
  chemically synthesized
ctgatctctggtaaccaccaag

SEQ ID NO: 921449 - DNA, 22 bp, Artificial Sequence
  chemically synthesized
tttctgatctctggtaaccacc

SEQ ID NO: 921450 - DNA, 22 bp, Artificial Sequence
  chemically synthesized
ctatttctgatctctggtaacc

SEQ ID NO: 921451 - DNA, 22 bp, Artificial Sequence
  chemically synthesized
ctcctatttctgatctctggta

SEQ ID NO: 921452 - DNA, 22 bp, Artificial Sequence
  chemically synthesized
ccttggtggttaccagagatca

SEQ ID NO: 921453 - DNA, 22 bp, Artificial Sequence
  chemically synthesized
cctactcctatttctgatctct

SEQ ID NO: 921454 - DNA, 22 bp, Artificial Sequence
  chemically synthesized
ggtggttaccagagatcagaaa

SEQ ID NO: 921455 - DNA, 22 bp, Artificial Sequence
  chemically synthesized
tccctactcctatttctgatct

SEQ ID NO: 921456 - DNA, 22 bp, Artificial Sequence
  chemically synthesized
gtggttaccagagatcagaaat

SEQ ID NO: 921457 - DNA, 22 bp, Artificial Sequence
  chemically synthesized
tcccctctccctactcctattt

SEQ ID NO: 921458 - DNA, 22 bp, Artificial Sequence
  chemically synthesized
ccagagatcagaaataggagta

SEQ ID NO: 921459 - DNA, 22 bp, Artificial Sequence
  chemically synthesized
gtcccctctccctactcctatt

SEQ ID NO: 921460 - DNA, 22 bp, Artificial Sequence
  chemically synthesized
tgtcccctctccctactcctat

SEQ ID NO: 921461 - DNA, 22 bp, Artificial Sequence
  chemically synthesized
ccctttgtcccctctccctact

SEQ ID NO: 921462 - DNA, 22 bp, Artificial Sequence
  chemically synthesized
cccctttgtcccctctccctac

SEQ ID NO: 921463 - DNA, 22 bp, Artificial Sequence
  chemically synthesized
tcccctttgtcccctctcccta

SEQ ID NO: 921464 - DNA, 22 bp, Artificial Sequence
  chemically synthesized
ttcccctttgtcccctctccct

SEQ ID NO: 921465 - DNA, 22 bp, Artificial Sequence
  chemically synthesized
tttttcccctttgtcccctctc

SEQ ID NO: 921466 - DNA, 22 bp, Artificial Sequence
  chemically synthesized
tgttatttttcccctttgtccc

SEQ ID NO: 921467 - DNA, 22 bp, Artificial Sequence
  chemically synthesized
atgttatttttcccctttgtcc

SEQ ID NO: 921468 - DNA, 22 bp, Artificial Sequence
  chemically synthesized
agtggtaataagtaaatttatg

SEQ ID NO: 921469 - DNA, 22 bp, Artificial Sequence
  chemically synthesized
agtatacagttcagtggtaata

SEQ ID NO: 921470 - DNA, 22 bp, Artificial Sequence
  chemically synthesized
aagtatacagttcagtggtaat

SEQ ID NO: 921471 - DNA, 22 bp, Artificial Sequence
  chemically synthesized
taagtatacagttcagtggtaa

SEQ ID NO: 921472 - DNA, 22 bp, Artificial Sequence
  chemically synthesized
ttaagtatacagttcagtggta

SEQ ID NO: 921473 - DNA, 22 bp, Artificial Sequence
  chemically synthesized
acttattaccactgaactgtat

SEQ ID NO: 921474 - DNA, 22 bp, Artificial Sequence
  chemically synthesized
ccatttttaagtatacagttca

SEQ ID NO: 921475 - DNA, 22 bp, Artificial Sequence
  chemically synthesized
cttattaccactgaactgtata

SEQ ID NO: 921476 - DNA, 22 bp, Artificial Sequence
  chemically synthesized
accatttttaagtatacagttc

SEQ ID NO: 921477 - DNA, 22 bp, Artificial Sequence
  chemically synthesized
taccatttttaagtatacagtt

SEQ ID NO: 921478 - DNA, 22 bp, Artificial Sequence
  chemically synthesized
attaccactgaactgtatactt

SEQ ID NO: 921479 - DNA, 22 bp, Artificial Sequence
  chemically synthesized
ttaccactgaactgtatactta

SEQ ID NO: 921480 - DNA, 22 bp, Artificial Sequence
  chemically synthesized
ccactgaactgtatacttaaaa

SEQ ID NO: 921481 - DNA, 22 bp, Artificial Sequence
  chemically synthesized
aactgtatacttaaaaatggta

SEQ ID NO: 921482 - DNA, 22 bp, Artificial Sequence
  chemically synthesized
tatacttaaaaatggtaaaggt

SEQ ID NO: 921483 - DNA, 22 bp, Artificial Sequence
  chemically synthesized
aaaaatggtaaaggtatattta

SEQ ID NO: 921484 - DNA, 22 bp, Artificial Sequence
  chemically synthesized
tataaataaaagtaaatatacc

SEQ ID NO: 921485 - DNA, 22 bp, Artificial Sequence
  chemically synthesized
aaaatggtaaaggtatatttac

SEQ ID NO: 921486 - DNA, 22 bp, Artificial Sequence
  chemically synthesized
tatataaataaaagtaaatata

SEQ ID NO: 921487 - DNA, 22 bp, Artificial Sequence
  chemically synthesized
aggtaaaatatacctctatata

SEQ ID NO: 921488 - DNA, 22 bp, Artificial Sequence
  chemically synthesized
acttttatttatatagaggtat

SEQ ID NO: 921489 - DNA, 22 bp, Artificial Sequence
  chemically synthesized
ttgaggtaaaatatacctctat

SEQ ID NO: 921490 - DNA, 22 bp, Artificial Sequence
  chemically synthesized
cttttatttatatagaggtata

SEQ ID NO: 921491 - DNA, 22 bp, Artificial Sequence
  chemically synthesized
attgaggtaaaatatacctcta

SEQ ID NO: 921492 - DNA, 22 bp, Artificial Sequence
  chemically synthesized
tattgaggtaaaatatacctct

SEQ ID NO: 921493 - DNA, 22 bp, Artificial Sequence
  chemically synthesized
ttatttatatagaggtatattt

SEQ ID NO: 921494 - DNA, 22 bp, Artificial Sequence
  chemically synthesized
tatttatatagaggtatatttt

SEQ ID NO: 921495 - DNA, 22 bp, Artificial Sequence
  chemically synthesized
atttatatagaggtatatttta

SEQ ID NO: 921496 - DNA, 22 bp, Artificial Sequence
  chemically synthesized
attttattgaggtaaaatatac

SEQ ID NO: 921497 - DNA, 22 bp, Artificial Sequence
  chemically synthesized
tttatatagaggtatattttac

SEQ ID NO: 921498 - DNA, 22 bp, Artificial Sequence
  chemically synthesized
aattttattgaggtaaaatata

SEQ ID NO: 921499 - DNA, 22 bp, Artificial Sequence
  chemically synthesized
atatagaggtatattttacctc

SEQ ID NO: 921500 - DNA, 22 bp, Artificial Sequence
  chemically synthesized
tatagaggtatattttacctca

SEQ ID NO: 921501 - DNA, 22 bp, Artificial Sequence
  chemically synthesized
aatttaattttattgaggtaaa

SEQ ID NO: 921502 - DNA, 22 bp, Artificial Sequence
  chemically synthesized
aaatttaattttattgaggtaa

SEQ ID NO: 921503 - DNA, 22 bp, Artificial Sequence
  chemically synthesized
taaatttaattttattgaggta

SEQ ID NO: 921504 - DNA, 22 bp, Artificial Sequence
  chemically synthesized
ttaaatttaattttattgaggt

SEQ ID NO: 921505 - DNA, 22 bp, Artificial Sequence
  chemically synthesized
tttaaatttaattttattgagg

SEQ ID NO: 921506 - DNA, 22 bp, Artificial Sequence
  chemically synthesized
aattttttaaatttaattttat

SEQ ID NO: 921507 - DNA, 22 bp, Artificial Sequence
  chemically synthesized
tacctcaataaaattaaattta

SEQ ID NO: 921508 - DNA, 22 bp, Artificial Sequence
  chemically synthesized
gcctgaattttttaaatttaat

SEQ ID NO: 921509 - DNA, 22 bp, Artificial Sequence
  chemically synthesized
acctcaataaaattaaatttaa

SEQ ID NO: 921510 - DNA, 22 bp, Artificial Sequence
  chemically synthesized
cctcaataaaattaaatttaaa

SEQ ID NO: 921511 - DNA, 22 bp, Artificial Sequence
  chemically synthesized
aataaaattaaatttaaaaaat

SEQ ID NO: 921512 - DNA, 22 bp, Artificial Sequence
  chemically synthesized
aatttaaaaaattcaggccaat

SEQ ID NO: 921513 - DNA, 22 bp, Artificial Sequence
  chemically synthesized
aaaaaattcaggccaatcacat

SEQ ID NO: 921514 - DNA, 22 bp, Artificial Sequence
  chemically synthesized
aaaaattcaggccaatcacatt

SEQ ID NO: 921515 - DNA, 22 bp, Artificial Sequence
  chemically synthesized
caggcatgagccaatgtgattg

SEQ ID NO: 921516 - DNA, 22 bp, Artificial Sequence
  chemically synthesized
aggccaatcacattggctcatg

SEQ ID NO: 921517 - DNA, 22 bp, Artificial Sequence
  chemically synthesized
ccaaagtgcggggattacaggc

SEQ ID NO: 921518 - DNA, 22 bp, Artificial Sequence
  chemically synthesized
gctcatgcctgtaatccccgca

SEQ ID NO: 921519 - DNA, 22 bp, Artificial Sequence
  chemically synthesized
agcctcccaaagtgcggggatt

SEQ ID NO: 921520 - DNA, 22 bp, Artificial Sequence
  chemically synthesized
atgcctgtaatccccgcacttt

SEQ ID NO: 921521 - DNA, 22 bp, Artificial Sequence
  chemically synthesized
taatccccgcactttgggaggc

SEQ ID NO: 921522 - DNA, 22 bp, Artificial Sequence
  chemically synthesized
aggtcaagtgatccacccacct

SEQ ID NO: 921523 - DNA, 22 bp, Artificial Sequence
  chemically synthesized
tgggaggctgaggtgggtggat

SEQ ID NO: 921524 - DNA, 22 bp, Artificial Sequence
  chemically synthesized
gggaggctgaggtgggtggatc

SEQ ID NO: 921525 - DNA, 22 bp, Artificial Sequence
  chemically synthesized
ctgaggtcaagtgatccaccca

SEQ ID NO: 921526 - DNA, 22 bp, Artificial Sequence
  chemically synthesized
ggaggctgaggtgggtggatca

SEQ ID NO: 921527 - DNA, 22 bp, Artificial Sequence
  chemically synthesized
aaactcctgaggtcaagtgatc

SEQ ID NO: 921528 - DNA, 22 bp, Artificial Sequence
  chemically synthesized
aggtgggtggatcacttgacct

SEQ ID NO: 921529 - DNA, 22 bp, Artificial Sequence
  chemically synthesized
gtctcaaactcctgaggtcaag

SEQ ID NO: 921530 - DNA, 22 bp, Artificial Sequence
  chemically synthesized
cccacctggtctcaaactcctg

SEQ ID NO: 921531 - DNA, 22 bp, Artificial Sequence
  chemically synthesized
tgttgcccacctggtctcaaac

SEQ ID NO: 921532 - DNA, 22 bp, Artificial Sequence
  chemically synthesized
gacctcaggagtttgagaccag

SEQ ID NO: 921533 - DNA, 22 bp, Artificial Sequence
  chemically synthesized
acctcaggagtttgagaccagg

SEQ ID NO: 921534 - DNA, 22 bp, Artificial Sequence
  chemically synthesized
actgtgttgcccacctggtctc

SEQ ID NO: 921535 - DNA, 22 bp, Artificial Sequence
  chemically synthesized
cactgtgttgcccacctggtct

SEQ ID NO: 921536 - DNA, 22 bp, Artificial Sequence
  chemically synthesized
aggagtttgagaccaggtgggc

SEQ ID NO: 921537 - DNA, 22 bp, Artificial Sequence
  chemically synthesized
gagaccaggtgggcaacacagt

SEQ ID NO: 921538 - DNA, 22 bp, Artificial Sequence
  chemically synthesized
agaccaggtgggcaacacagtg

SEQ ID NO: 921539 - DNA, 22 bp, Artificial Sequence
  chemically synthesized
gtagaggcaggatttcactgtg

SEQ ID NO: 921540 - DNA, 22 bp, Artificial Sequence
  chemically synthesized
ggtagaggcaggatttcactgt

SEQ ID NO: 921541 - DNA, 22 bp, Artificial Sequence
  chemically synthesized
tggtagaggcaggatttcactg

SEQ ID NO: 921542 - DNA, 22 bp, Artificial Sequence
  chemically synthesized
ttggtagaggcaggatttcact

SEQ ID NO: 921543 - DNA, 22 bp, Artificial Sequence
  chemically synthesized
tttggtagaggcaggatttcac

SEQ ID NO: 921544 - DNA, 22 bp, Artificial Sequence
  chemically synthesized
ttttggtagaggcaggatttca

SEQ ID NO: 921545 - DNA, 22 bp, Artificial Sequence
  chemically synthesized
tttttggtagaggcaggatttc

SEQ ID NO: 921546 - DNA, 22 bp, Artificial Sequence
  chemically synthesized
ttttttggtagaggcaggattt

SEQ ID NO: 921547 - DNA, 22 bp, Artificial Sequence
  chemically synthesized
tttttttggtagaggcaggatt

SEQ ID NO: 921548 - DNA, 22 bp, Artificial Sequence
  chemically synthesized
ttttttttggtagaggcaggat

SEQ ID NO: 921549 - DNA, 22 bp, Artificial Sequence
  chemically synthesized
tttttttttggtagaggcagga

SEQ ID NO: 921550 - DNA, 22 bp, Artificial Sequence
  chemically synthesized
ttttttttttggtagaggcagg

SEQ ID NO: 921551 - DNA, 22 bp, Artificial Sequence
  chemically synthesized
tttttttttttggtagaggcag

SEQ ID NO: 921552 - DNA, 22 bp, Artificial Sequence
  chemically synthesized
ttttttttttttggtagaggca

SEQ ID NO: 921553 - DNA, 22 bp, Artificial Sequence
  chemically synthesized
tttttttttttttggtagaggc

SEQ ID NO: 921554 - DNA, 22 bp, Artificial Sequence
  chemically synthesized
ttttttttttttttggtagagg

SEQ ID NO: 921555 - DNA, 22 bp, Artificial Sequence
  chemically synthesized
tttttttttttttttggtagag

SEQ ID NO: 921556 - DNA, 22 bp, Artificial Sequence
  chemically synthesized
ttttttttttttttttggtaga

SEQ ID NO: 921557 - DNA, 22 bp, Artificial Sequence
  chemically synthesized
tttttttttttttttttggtag

SEQ ID NO: 921558 - DNA, 22 bp, Artificial Sequence
  chemically synthesized
ttttttttttttttttttggta

SEQ ID NO: 921559 - DNA, 22 bp, Artificial Sequence
  chemically synthesized
ttttttttttttttttttttgg

SEQ ID NO: 921560 - DNA, 22 bp, Artificial Sequence
  chemically synthesized
cttttttttttttttttttttg

SEQ ID NO: 921561 - DNA, 22 bp, Artificial Sequence
  chemically synthesized
tttctttttttttttttttttt

SEQ ID NO: 921562 - DNA, 22 bp, Artificial Sequence
  chemically synthesized
cctctaccaaaaaaaaaaaaaa

SEQ ID NO: 921563 - DNA, 22 bp, Artificial Sequence
  chemically synthesized
taccaaaaaaaaaaaaaaaaaa

SEQ ID NO: 921564 - DNA, 22 bp, Artificial Sequence
  chemically synthesized
ccaaaaaaaaaaaaaaaaaaaa

SEQ ID NO: 921565 - DNA, 22 bp, Artificial Sequence
  chemically synthesized
cacccagctatttctttttttt

SEQ ID NO: 921566 - DNA, 22 bp, Artificial Sequence
  chemically synthesized
ctacacccagctatttcttttt

SEQ ID NO: 921567 - DNA, 22 bp, Artificial Sequence
  chemically synthesized
ggaccacagacacgggctacta

SEQ ID NO: 921568 - DNA, 22 bp, Artificial Sequence
  chemically synthesized
ggtgtagtagcccgtgtctgtg

SEQ ID NO: 921569 - DNA, 22 bp, Artificial Sequence
  chemically synthesized
agtagctgggaccacagacacg

SEQ ID NO: 921570 - DNA, 22 bp, Artificial Sequence
  chemically synthesized
ctgagtagctgggaccacagac

SEQ ID NO: 921571 - DNA, 22 bp, Artificial Sequence
  chemically synthesized
agcctcctgagtagctgggacc

SEQ ID NO: 921572 - DNA, 22 bp, Artificial Sequence
  chemically synthesized
caacctcagcctcctgagtagc

SEQ ID NO: 921573 - DNA, 22 bp, Artificial Sequence
  chemically synthesized
tggtcccagctactcaggaggc

SEQ ID NO: 921574 - DNA, 22 bp, Artificial Sequence
  chemically synthesized
aagcgatcctccaacctcagcc

SEQ ID NO: 921575 - DNA, 22 bp, Artificial Sequence
  chemically synthesized
ctcaggaggctgaggttggagg

SEQ ID NO: 921576 - DNA, 22 bp, Artificial Sequence
  chemically synthesized
aggaggctgaggttggaggatc

SEQ ID NO: 921577 - DNA, 22 bp, Artificial Sequence
  chemically synthesized
ccaggttcaagcgatcctccaa

SEQ ID NO: 921578 - DNA, 22 bp, Artificial Sequence
  chemically synthesized
atctcccaggttcaagcgatcc

SEQ ID NO: 921579 - DNA, 22 bp, Artificial Sequence
  chemically synthesized
gatctcccaggttcaagcgatc

SEQ ID NO: 921580 - DNA, 22 bp, Artificial Sequence
  chemically synthesized
aggttggaggatcgcttgaacc

SEQ ID NO: 921581 - DNA, 22 bp, Artificial Sequence
  chemically synthesized
cagccttgatctcccaggttca

SEQ ID NO: 921582 - DNA, 22 bp, Artificial Sequence
  chemically synthesized
gaggatcgcttgaacctgggag

SEQ ID NO: 921583 - DNA, 22 bp, Artificial Sequence
  chemically synthesized
actgcagccttgatctcccagg

SEQ ID NO: 921584 - DNA, 22 bp, Artificial Sequence
  chemically synthesized
gaacctgggagatcaaggctgc

SEQ ID NO: 921585 - DNA, 22 bp, Artificial Sequence
  chemically synthesized
aacctgggagatcaaggctgca

SEQ ID NO: 921586 - DNA, 22 bp, Artificial Sequence
  chemically synthesized
ggagatcaaggctgcagtgaac

SEQ ID NO: 921587 - DNA, 22 bp, Artificial Sequence
  chemically synthesized
gaatgcagtggcatgatcacag

SEQ ID NO: 921588 - DNA, 22 bp, Artificial Sequence
  chemically synthesized
cagtgaactgtgatcatgccac

SEQ ID NO: 921589 - DNA, 22 bp, Artificial Sequence
  chemically synthesized
aggctggaatgcagtggcatga

SEQ ID NO: 921590 - DNA, 22 bp, Artificial Sequence
  chemically synthesized
tcactcaggctggaatgcagtg

SEQ ID NO: 921591 - DNA, 22 bp, Artificial Sequence
  chemically synthesized
tgtcactcaggctggaatgcag

SEQ ID NO: 921592 - DNA, 22 bp, Artificial Sequence
  chemically synthesized
tgatcatgccactgcattccag

SEQ ID NO: 921593 - DNA, 22 bp, Artificial Sequence
  chemically synthesized
gctctgtcactcaggctggaat

SEQ ID NO: 921594 - DNA, 22 bp, Artificial Sequence
  chemically synthesized
tggctctgtcactcaggctgga

SEQ ID NO: 921595 - DNA, 22 bp, Artificial Sequence
  chemically synthesized
cattccagcctgagtgacagag

SEQ ID NO: 921596 - DNA, 22 bp, Artificial Sequence
  chemically synthesized
agatggggttctggctctgtca

SEQ ID NO: 921597 - DNA, 22 bp, Artificial Sequence
  chemically synthesized
gagatggggttctggctctgtc

SEQ ID NO: 921598 - DNA, 22 bp, Artificial Sequence
  chemically synthesized
tgagatggggttctggctctgt

SEQ ID NO: 921599 - DNA, 22 bp, Artificial Sequence
  chemically synthesized
cagcctgagtgacagagccaga

SEQ ID NO: 921600 - DNA, 22 bp, Artificial Sequence
  chemically synthesized
ttgagatggggttctggctctg

SEQ ID NO: 921601 - DNA, 22 bp, Artificial Sequence
  chemically synthesized
tttgagatggggttctggctct

SEQ ID NO: 921602 - DNA, 22 bp, Artificial Sequence
  chemically synthesized
ttttgagatggggttctggctc

SEQ ID NO: 921603 - DNA, 22 bp, Artificial Sequence
  chemically synthesized
ttttttgagatggggttctggc

SEQ ID NO: 921604 - DNA, 22 bp, Artificial Sequence
  chemically synthesized
cttttttgagatggggttctgg

SEQ ID NO: 921605 - DNA, 22 bp, Artificial Sequence
  chemically synthesized
tcttttttgagatggggttctg

SEQ ID NO: 921606 - DNA, 22 bp, Artificial Sequence
  chemically synthesized
agtgacagagccagaaccccat

SEQ ID NO: 921607 - DNA, 22 bp, Artificial Sequence
  chemically synthesized
tgaactttcttttttgagatgg

SEQ ID NO: 921608 - DNA, 22 bp, Artificial Sequence
  chemically synthesized
atgaactttcttttttgagatg

SEQ ID NO: 921609 - DNA, 22 bp, Artificial Sequence
  chemically synthesized
tatgaactttcttttttgagat

SEQ ID NO: 921610 - DNA, 22 bp, Artificial Sequence
  chemically synthesized
ttatgaactttcttttttgaga

SEQ ID NO: 921611 - DNA, 22 bp, Artificial Sequence
  chemically synthesized
atatgcttttatgaactttctt

SEQ ID NO: 921612 - DNA, 22 bp, Artificial Sequence
  chemically synthesized
gatatgcttttatgaactttct

SEQ ID NO: 921613 - DNA, 22 bp, Artificial Sequence
  chemically synthesized
tatttgatatgcttttatgaac

SEQ ID NO: 921614 - DNA, 22 bp, Artificial Sequence
  chemically synthesized
aaaaaagaaagttcataaaagc

SEQ ID NO: 921615 - DNA, 22 bp, Artificial Sequence
  chemically synthesized
aggaaaagtactatatttgata

SEQ ID NO: 921616 - DNA, 22 bp, Artificial Sequence
  chemically synthesized
ataaaagcatatcaaatatagt

SEQ ID NO: 921617 - DNA, 22 bp, Artificial Sequence
  chemically synthesized
tgtctaaggaaaagtactatat

SEQ ID NO: 921618 - DNA, 22 bp, Artificial Sequence
  chemically synthesized
atgtctaaggaaaagtactata

SEQ ID NO: 921619 - DNA, 22 bp, Artificial Sequence
  chemically synthesized
ttatgtctaaggaaaagtacta

SEQ ID NO: 921620 - DNA, 22 bp, Artificial Sequence
  chemically synthesized
ctcttatgtctaaggaaaagta

SEQ ID NO: 921621 - DNA, 22 bp, Artificial Sequence
  chemically synthesized
cctcttatgtctaaggaaaagt

SEQ ID NO: 921622 - DNA, 22 bp, Artificial Sequence
  chemically synthesized
agatatgtgcttcctcttatgt

SEQ ID NO: 921623 - DNA, 22 bp, Artificial Sequence
  chemically synthesized
tcagatatgtgcttcctcttat

SEQ ID NO: 921624 - DNA, 22 bp, Artificial Sequence
  chemically synthesized
ctcagatatgtgcttcctctta

SEQ ID NO: 921625 - DNA, 22 bp, Artificial Sequence
  chemically synthesized
ttccttagacataagaggaagc

SEQ ID NO: 921626 - DNA, 22 bp, Artificial Sequence
  chemically synthesized
tccttagacataagaggaagca

SEQ ID NO: 921627 - DNA, 22 bp, Artificial Sequence
  chemically synthesized
ccttagacataagaggaagcac

SEQ ID NO: 921628 - DNA, 22 bp, Artificial Sequence
  chemically synthesized
cttagacataagaggaagcaca

SEQ ID NO: 921629 - DNA, 22 bp, Artificial Sequence
  chemically synthesized
tgtcttctcagatatgtgcttc

SEQ ID NO: 921630 - DNA, 22 bp, Artificial Sequence
  chemically synthesized
agacataagaggaagcacatat

SEQ ID NO: 921631 - DNA, 22 bp, Artificial Sequence
  chemically synthesized
gacataagaggaagcacatatc

SEQ ID NO: 921632 - DNA, 22 bp, Artificial Sequence
  chemically synthesized
aagcctgtgtcttctcagatat

SEQ ID NO: 921633 - DNA, 22 bp, Artificial Sequence
  chemically synthesized
caagcctgtgtcttctcagata

SEQ ID NO: 921634 - DNA, 22 bp, Artificial Sequence
  chemically synthesized
acagcttcaagcctgtgtcttc

SEQ ID NO: 921635 - DNA, 22 bp, Artificial Sequence
  chemically synthesized
aacagcttcaagcctgtgtctt

SEQ ID NO: 921636 - DNA, 22 bp, Artificial Sequence
  chemically synthesized
ccagtttaacagcttcaagcct

SEQ ID NO: 921637 - DNA, 22 bp, Artificial Sequence
  chemically synthesized
gccagtttaacagcttcaagcc

SEQ ID NO: 921638 - DNA, 22 bp, Artificial Sequence
  chemically synthesized
agaagacacaggcttgaagctg

SEQ ID NO: 921639 - DNA, 22 bp, Artificial Sequence
  chemically synthesized
tttgccagtttaacagcttcaa

SEQ ID NO: 921640 - DNA, 22 bp, Artificial Sequence
  chemically synthesized
tgattatttgccagtttaacag

SEQ ID NO: 921641 - DNA, 22 bp, Artificial Sequence
  chemically synthesized
atgattatttgccagtttaaca

SEQ ID NO: 921642 - DNA, 22 bp, Artificial Sequence
  chemically synthesized
catttatgattatttgccagtt

SEQ ID NO: 921643 - DNA, 22 bp, Artificial Sequence
  chemically synthesized
gaagctgttaaactggcaaata

SEQ ID NO: 921644 - DNA, 22 bp, Artificial Sequence
  chemically synthesized
aagctgttaaactggcaaataa

SEQ ID NO: 921645 - DNA, 22 bp, Artificial Sequence
  chemically synthesized
cccactacatttatgattattt

SEQ ID NO: 921646 - DNA, 22 bp, Artificial Sequence
  chemically synthesized
ttaaactggcaaataatcataa

SEQ ID NO: 921647 - DNA, 22 bp, Artificial Sequence
  chemically synthesized
aactggcaaataatcataaatg

SEQ ID NO: 921648 - DNA, 22 bp, Artificial Sequence
  chemically synthesized
gcaaataatcataaatgtagtg

SEQ ID NO: 921649 - DNA, 22 bp, Artificial Sequence
  chemically synthesized
atagtgacgacagggtagaaca

SEQ ID NO: 921650 - DNA, 22 bp, Artificial Sequence
  chemically synthesized
actttcttatttgttctaccct

SEQ ID NO: 921651 - DNA, 22 bp, Artificial Sequence
  chemically synthesized
tcttatttgttctaccctgtcg

SEQ ID NO: 921652 - DNA, 22 bp, Artificial Sequence
  chemically synthesized
cttatttgttctaccctgtcgt

SEQ ID NO: 921653 - DNA, 22 bp, Artificial Sequence
  chemically synthesized
ttatttgttctaccctgtcgtc

SEQ ID NO: 921654 - DNA, 22 bp, Artificial Sequence
  chemically synthesized
atttgttctaccctgtcgtcac

SEQ ID NO: 921655 - DNA, 22 bp, Artificial Sequence
  chemically synthesized
tttgttctaccctgtcgtcact

SEQ ID NO: 921656 - DNA, 22 bp, Artificial Sequence
  chemically synthesized
gttctaccctgtcgtcactatt

SEQ ID NO: 921657 - DNA, 22 bp, Artificial Sequence
  chemically synthesized
ttctaccctgtcgtcactatta

SEQ ID NO: 921658 - DNA, 22 bp, Artificial Sequence
  chemically synthesized
taccctgtcgtcactattagct

SEQ ID NO: 921659 - DNA, 22 bp, Artificial Sequence
  chemically synthesized
tgtgaacaaagcagctaatagt

SEQ ID NO: 921660 - DNA, 22 bp, Artificial Sequence
  chemically synthesized
ccctgtcgtcactattagctgc

SEQ ID NO: 921661 - DNA, 22 bp, Artificial Sequence
  chemically synthesized
gctatgtgaacaaagcagctaa

SEQ ID NO: 921662 - DNA, 22 bp, Artificial Sequence
  chemically synthesized
tcgtcactattagctgctttgt

SEQ ID NO: 921663 - DNA, 22 bp, Artificial Sequence
  chemically synthesized
ttagctgctttgttcacatagc

SEQ ID NO: 921664 - DNA, 22 bp, Artificial Sequence
  chemically synthesized
gctgctttgttcacatagctag

SEQ ID NO: 921665 - DNA, 22 bp, Artificial Sequence
  chemically synthesized
catatgaccatatctagctatg

SEQ ID NO: 921666 - DNA, 22 bp, Artificial Sequence
  chemically synthesized
ctttgttcacatagctagatat

SEQ ID NO: 921667 - DNA, 22 bp, Artificial Sequence
  chemically synthesized
ttacatatgaccatatctagct

SEQ ID NO: 921668 - DNA, 22 bp, Artificial Sequence
  chemically synthesized
tgttcacatagctagatatggt

SEQ ID NO: 921669 - DNA, 22 bp, Artificial Sequence
  chemically synthesized
ttgttacatatgaccatatcta

SEQ ID NO: 921670 - DNA, 22 bp, Artificial Sequence
  chemically synthesized
gttcacatagctagatatggtc

SEQ ID NO: 921671 - DNA, 22 bp, Artificial Sequence
  chemically synthesized
attgttacatatgaccatatct

SEQ ID NO: 921672 - DNA, 22 bp, Artificial Sequence
  chemically synthesized
ttcacatagctagatatggtca

SEQ ID NO: 921673 - DNA, 22 bp, Artificial Sequence
  chemically synthesized
acatagctagatatggtcatat

SEQ ID NO: 921674 - DNA, 22 bp, Artificial Sequence
  chemically synthesized
ccttattgttacatatgaccat

SEQ ID NO: 921675 - DNA, 22 bp, Artificial Sequence
  chemically synthesized
cccttattgttacatatgacca

SEQ ID NO: 921676 - DNA, 22 bp, Artificial Sequence
  chemically synthesized
tcccttattgttacatatgacc

SEQ ID NO: 921677 - DNA, 22 bp, Artificial Sequence
  chemically synthesized
ttcccttattgttacatatgac

SEQ ID NO: 921678 - DNA, 22 bp, Artificial Sequence
  chemically synthesized
gatatggtcatatgtaacaata

SEQ ID NO: 921679 - DNA, 22 bp, Artificial Sequence
  chemically synthesized
tgccttttcccttattgttaca

SEQ ID NO: 921680 - DNA, 22 bp, Artificial Sequence
  chemically synthesized
gacccagatctgtgccttttcc

SEQ ID NO: 921681 - DNA, 22 bp, Artificial Sequence
  chemically synthesized
agacccagatctgtgccttttc

SEQ ID NO: 921682 - DNA, 22 bp, Artificial Sequence
  chemically synthesized
aaagtcagtgatttagacccag

SEQ ID NO: 921683 - DNA, 22 bp, Artificial Sequence
  chemically synthesized
ggtctaaatcactgacttttag

SEQ ID NO: 921684 - DNA, 22 bp, Artificial Sequence
  chemically synthesized
tagaaggatcgagaactaaaag

SEQ ID NO: 921685 - DNA, 22 bp, Artificial Sequence
  chemically synthesized
aatcactgacttttagttctcg

SEQ ID NO: 921686 - DNA, 22 bp, Artificial Sequence
  chemically synthesized
accaaagttatagaaggatcga

SEQ ID NO: 921687 - DNA, 22 bp, Artificial Sequence
  chemically synthesized
acttttagttctcgatccttct

SEQ ID NO: 921688 - DNA, 22 bp, Artificial Sequence
  chemically synthesized
ttagttctcgatccttctataa

SEQ ID NO: 921689 - DNA, 22 bp, Artificial Sequence
  chemically synthesized
tagttctcgatccttctataac

SEQ ID NO: 921690 - DNA, 22 bp, Artificial Sequence
  chemically synthesized
agttctcgatccttctataact

SEQ ID NO: 921691 - DNA, 22 bp, Artificial Sequence
  chemically synthesized
gttctcgatccttctataactt

SEQ ID NO: 921692 - DNA, 22 bp, Artificial Sequence
  chemically synthesized
tcgatccttctataactttggt

SEQ ID NO: 921693 - DNA, 22 bp, Artificial Sequence
  chemically synthesized
gatccttctataactttggtta

SEQ ID NO: 921694 - DNA, 22 bp, Artificial Sequence
  chemically synthesized
ctataactttggttagccttgg

SEQ ID NO: 921695 - DNA, 22 bp, Artificial Sequence
  chemically synthesized
tataactttggttagccttgga

SEQ ID NO: 921696 - DNA, 22 bp, Artificial Sequence
  chemically synthesized
taactttggttagccttggaca

SEQ ID NO: 921697 - DNA, 22 bp, Artificial Sequence
  chemically synthesized
tggttagccttggacatatatc

SEQ ID NO: 921698 - DNA, 22 bp, Artificial Sequence
  chemically synthesized
ggttagccttggacatatatct

SEQ ID NO: 921699 - DNA, 22 bp, Artificial Sequence
  chemically synthesized
gttagccttggacatatatctt

SEQ ID NO: 921700 - DNA, 22 bp, Artificial Sequence
  chemically synthesized
agcacaagaaaaaacaagatat

SEQ ID NO: 921701 - DNA, 22 bp, Artificial Sequence
  chemically synthesized
gccttggacatatatcttgttt

SEQ ID NO: 921702 - DNA, 22 bp, Artificial Sequence
  chemically synthesized
ggacatatatcttgttttttct

SEQ ID NO: 921703 - DNA, 22 bp, Artificial Sequence
  chemically synthesized
gacatatatcttgttttttctt

SEQ ID NO: 921704 - DNA, 22 bp, Artificial Sequence
  chemically synthesized
ccacattaagcacaagaaaaaa

SEQ ID NO: 921705 - DNA, 22 bp, Artificial Sequence
  chemically synthesized
caaattaccacattaagcacaa

SEQ ID NO: 921706 - DNA, 22 bp, Artificial Sequence
  chemically synthesized
acaaattaccacattaagcaca

SEQ ID NO: 921707 - DNA, 22 bp, Artificial Sequence
  chemically synthesized
tacaaattaccacattaagcac

SEQ ID NO: 921708 - DNA, 22 bp, Artificial Sequence
  chemically synthesized
gttttttcttgtgcttaatgtg

SEQ ID NO: 921709 - DNA, 22 bp, Artificial Sequence
  chemically synthesized
ttttttcttgtgcttaatgtgg

SEQ ID NO: 921710 - DNA, 22 bp, Artificial Sequence
  chemically synthesized
tttcttgtgcttaatgtggtaa

SEQ ID NO: 921711 - DNA, 22 bp, Artificial Sequence
  chemically synthesized
ttcttgtgcttaatgtggtaat

SEQ ID NO: 921712 - DNA, 22 bp, Artificial Sequence
  chemically synthesized
tcttgtgcttaatgtggtaatt

SEQ ID NO: 921713 - DNA, 22 bp, Artificial Sequence
  chemically synthesized
cttgtgcttaatgtggtaattt

SEQ ID NO: 921714 - DNA, 22 bp, Artificial Sequence
  chemically synthesized
tgtccattttacaaattaccac

SEQ ID NO: 921715 - DNA, 22 bp, Artificial Sequence
  chemically synthesized
ttgtgcttaatgtggtaatttg

SEQ ID NO: 921716 - DNA, 22 bp, Artificial Sequence
  chemically synthesized
atgtccattttacaaattacca

SEQ ID NO: 921717 - DNA, 22 bp, Artificial Sequence
  chemically synthesized
gtgcttaatgtggtaatttgta

SEQ ID NO: 921718 - DNA, 22 bp, Artificial Sequence
  chemically synthesized
ttatgtccattttacaaattac

SEQ ID NO: 921719 - DNA, 22 bp, Artificial Sequence
  chemically synthesized
tgcttaatgtggtaatttgtaa

SEQ ID NO: 921720 - DNA, 22 bp, Artificial Sequence
  chemically synthesized
aatgtggtaatttgtaaaatgg

SEQ ID NO: 921721 - DNA, 22 bp, Artificial Sequence
  chemically synthesized
atgtggtaatttgtaaaatgga

SEQ ID NO: 921722 - DNA, 22 bp, Artificial Sequence
  chemically synthesized
gtaaaatggacataagaatgct

SEQ ID NO: 921723 - DNA, 22 bp, Artificial Sequence
  chemically synthesized
taaaatggacataagaatgctg

SEQ ID NO: 921724 - DNA, 22 bp, Artificial Sequence
  chemically synthesized
gagatcataagcaaagcatggc

SEQ ID NO: 921725 - DNA, 22 bp, Artificial Sequence
  chemically synthesized
cgagatcataagcaaagcatgg

SEQ ID NO: 921726 - DNA, 22 bp, Artificial Sequence
  chemically synthesized
ttcgagatcataagcaaagcat

SEQ ID NO: 921727 - DNA, 22 bp, Artificial Sequence
  chemically synthesized
actcttcgagatcataagcaaa

SEQ ID NO: 921728 - DNA, 22 bp, Artificial Sequence
  chemically synthesized
acctgactcttcgagatcataa

SEQ ID NO: 921729 - DNA, 22 bp, Artificial Sequence
  chemically synthesized
ccatgctttgcttatgatctcg

SEQ ID NO: 921730 - DNA, 22 bp, Artificial Sequence
  chemically synthesized
tgcttatgatctcgaagagtca

SEQ ID NO: 921731 - DNA, 22 bp, Artificial Sequence
  chemically synthesized
gcttatgatctcgaagagtcag

SEQ ID NO: 921732 - DNA, 22 bp, Artificial Sequence
  chemically synthesized
cttatgatctcgaagagtcagg

SEQ ID NO: 921733 - DNA, 22 bp, Artificial Sequence
  chemically synthesized
atgatctcgaagagtcaggtga

SEQ ID NO: 921734 - DNA, 22 bp, Artificial Sequence
  chemically synthesized
tgatctcgaagagtcaggtgag

SEQ ID NO: 921735 - DNA, 22 bp, Artificial Sequence
  chemically synthesized
tacgtccatcatctcacctgac

SEQ ID NO: 921736 - DNA, 22 bp, Artificial Sequence
  chemically synthesized
atacgtccatcatctcacctga

SEQ ID NO: 921737 - DNA, 22 bp, Artificial Sequence
  chemically synthesized
tatacgtccatcatctcacctg

SEQ ID NO: 921738 - DNA, 22 bp, Artificial Sequence
  chemically synthesized
gaagagtcaggtgagatgatgg

SEQ ID NO: 921739 - DNA, 22 bp, Artificial Sequence
  chemically synthesized
tagagattttatacgtccatca

SEQ ID NO: 921740 - DNA, 22 bp, Artificial Sequence
  chemically synthesized
agttatagagattttatacgtc

SEQ ID NO: 921741 - DNA, 22 bp, Artificial Sequence
  chemically synthesized
tcgcaatatctcagttatagag

SEQ ID NO: 921742 - DNA, 22 bp, Artificial Sequence
  chemically synthesized
attgtcgcaatatctcagttat

SEQ ID NO: 921743 - DNA, 22 bp, Artificial Sequence
  chemically synthesized
aattgtcgcaatatctcagtta

SEQ ID NO: 921744 - DNA, 22 bp, Artificial Sequence
  chemically synthesized
ccacttaattgtcgcaatatct

SEQ ID NO: 921745 - DNA, 22 bp, Artificial Sequence
  chemically synthesized
cccacttaattgtcgcaatatc

SEQ ID NO: 921746 - DNA, 22 bp, Artificial Sequence
  chemically synthesized
tataactgagatattgcgacaa

SEQ ID NO: 921747 - DNA, 22 bp, Artificial Sequence
  chemically synthesized
taactgagatattgcgacaatt

SEQ ID NO: 921748 - DNA, 22 bp, Artificial Sequence
  chemically synthesized
caaatgtttcccacttaattgt

SEQ ID NO: 921749 - DNA, 22 bp, Artificial Sequence
  chemically synthesized
acaaatgtttcccacttaattg

SEQ ID NO: 921750 - DNA, 22 bp, Artificial Sequence
  chemically synthesized
agatattgcgacaattaagtgg

SEQ ID NO: 921751 - DNA, 22 bp, Artificial Sequence
  chemically synthesized
tacaaatgtttcccacttaatt

SEQ ID NO: 921752 - DNA, 22 bp, Artificial Sequence
  chemically synthesized
cgacaattaagtgggaaacatt

SEQ ID NO: 921753 - DNA, 22 bp, Artificial Sequence
  chemically synthesized
ataagagttttacaaatgtttc

SEQ ID NO: 921754 - DNA, 22 bp, Artificial Sequence
  chemically synthesized
gataagagttttacaaatgttt

SEQ ID NO: 921755 - DNA, 22 bp, Artificial Sequence
  chemically synthesized
tgataagagttttacaaatgtt

SEQ ID NO: 921756 - DNA, 22 bp, Artificial Sequence
  chemically synthesized
agtgggaaacatttgtaaaact

SEQ ID NO: 921757 - DNA, 22 bp, Artificial Sequence
  chemically synthesized
tgaacaggactttgataagagt

SEQ ID NO: 921758 - DNA, 22 bp, Artificial Sequence
  chemically synthesized
tatgaacaggactttgataaga

SEQ ID NO: 921759 - DNA, 22 bp, Artificial Sequence
  chemically synthesized
ctctatgaacaggactttgata

SEQ ID NO: 921760 - DNA, 22 bp, Artificial Sequence
  chemically synthesized
actctatgaacaggactttgat

SEQ ID NO: 921761 - DNA, 22 bp, Artificial Sequence
  chemically synthesized
gtaaaactcttatcaaagtcct

SEQ ID NO: 921762 - DNA, 22 bp, Artificial Sequence
  chemically synthesized
taaaactcttatcaaagtcctg

SEQ ID NO: 921763 - DNA, 22 bp, Artificial Sequence
  chemically synthesized
tgcatttactctatgaacagga

SEQ ID NO: 921764 - DNA, 22 bp, Artificial Sequence
  chemically synthesized
gtgcatttactctatgaacagg

SEQ ID NO: 921765 - DNA, 22 bp, Artificial Sequence
  chemically synthesized
tgtgcatttactctatgaacag

SEQ ID NO: 921766 - DNA, 22 bp, Artificial Sequence
  chemically synthesized
ttatcaaagtcctgttcataga

SEQ ID NO: 921767 - DNA, 22 bp, Artificial Sequence
  chemically synthesized
atcaaagtcctgttcatagagt

SEQ ID NO: 921768 - DNA, 22 bp, Artificial Sequence
  chemically synthesized
tcaaagtcctgttcatagagta

SEQ ID NO: 921769 - DNA, 22 bp, Artificial Sequence
  chemically synthesized
agttttgtgcatttactctatg

SEQ ID NO: 921770 - DNA, 22 bp, Artificial Sequence
  chemically synthesized
atgacactaagttttgtgcatt

SEQ ID NO: 921771 - DNA, 22 bp, Artificial Sequence
  chemically synthesized
ttcatagagtaaatgcacaaaa

SEQ ID NO: 921772 - DNA, 22 bp, Artificial Sequence
  chemically synthesized
atagagtaaatgcacaaaactt

SEQ ID NO: 921773 - DNA, 22 bp, Artificial Sequence
  chemically synthesized
gtattaatgacactaagttttg

SEQ ID NO: 921774 - DNA, 22 bp, Artificial Sequence
  chemically synthesized
caagagctagtattaatgacac

SEQ ID NO: 921775 - DNA, 22 bp, Artificial Sequence
  chemically synthesized
gaagttacaagagctagtatta

SEQ ID NO: 921776 - DNA, 22 bp, Artificial Sequence
  chemically synthesized
ggaagttacaagagctagtatt

SEQ ID NO: 921777 - DNA, 22 bp, Artificial Sequence
  chemically synthesized
agtgtcattaatactagctctt

SEQ ID NO: 921778 - DNA, 22 bp, Artificial Sequence
  chemically synthesized
gtgtcattaatactagctcttg

SEQ ID NO: 921779 - DNA, 22 bp, Artificial Sequence
  chemically synthesized
taaatttggaagttacaagagc

SEQ ID NO: 921780 - DNA, 22 bp, Artificial Sequence
  chemically synthesized
atactagctcttgtaacttcca

SEQ ID NO: 921781 - DNA, 22 bp, Artificial Sequence
  chemically synthesized
gctcttgtaacttccaaattta

SEQ ID NO: 921782 - DNA, 22 bp, Artificial Sequence
  chemically synthesized
atgtacccaaactataaatttg

SEQ ID NO: 921783 - DNA, 22 bp, Artificial Sequence
  chemically synthesized
ttgtaacttccaaatttatagt

SEQ ID NO: 921784 - DNA, 22 bp, Artificial Sequence
  chemically synthesized
ttcatgtacccaaactataaat

SEQ ID NO: 921785 - DNA, 22 bp, Artificial Sequence
  chemically synthesized
gtaacttccaaatttatagttt

SEQ ID NO: 921786 - DNA, 22 bp, Artificial Sequence
  chemically synthesized
taacttccaaatttatagtttg

SEQ ID NO: 921787 - DNA, 22 bp, Artificial Sequence
  chemically synthesized
tctattcatgtacccaaactat

SEQ ID NO: 921788 - DNA, 22 bp, Artificial Sequence
  chemically synthesized
ccaaatttatagtttgggtaca

SEQ ID NO: 921789 - DNA, 22 bp, Artificial Sequence
  chemically synthesized
caaatttatagtttgggtacat

SEQ ID NO: 921790 - DNA, 22 bp, Artificial Sequence
  chemically synthesized
atagtttgggtacatgaataga

SEQ ID NO: 921791 - DNA, 22 bp, Artificial Sequence
  chemically synthesized
tagtttgggtacatgaatagat

SEQ ID NO: 921792 - DNA, 22 bp, Artificial Sequence
  chemically synthesized
tgggtgatatcactatctattc

SEQ ID NO: 921793 - DNA, 22 bp, Artificial Sequence
  chemically synthesized
ctgtgggtgatatcactatcta

SEQ ID NO: 921794 - DNA, 22 bp, Artificial Sequence
  chemically synthesized
gggtacatgaatagatagtgat

SEQ ID NO: 921795 - DNA, 22 bp, Artificial Sequence
  chemically synthesized
ggtacatgaatagatagtgata

SEQ ID NO: 921796 - DNA, 22 bp, Artificial Sequence
  chemically synthesized
ccaaaatctactgtgggtgata

SEQ ID NO: 921797 - DNA, 22 bp, Artificial Sequence
  chemically synthesized
tcccaaaatctactgtgggtga

SEQ ID NO: 921798 - DNA, 22 bp, Artificial Sequence
  chemically synthesized
ctctcccaaaatctactgtggg

SEQ ID NO: 921799 - DNA, 22 bp, Artificial Sequence
  chemically synthesized
tattcctctcccaaaatctact

SEQ ID NO: 921800 - DNA, 22 bp, Artificial Sequence
  chemically synthesized
aacatgttatattcctctccca

SEQ ID NO: 921801 - DNA, 22 bp, Artificial Sequence
  chemically synthesized
tgggagaggaatataacatgtt

SEQ ID NO: 921802 - DNA, 22 bp, Artificial Sequence
  chemically synthesized
gggagaggaatataacatgttg

SEQ ID NO: 921803 - DNA, 22 bp, Artificial Sequence
  chemically synthesized
ggagaggaatataacatgttga

SEQ ID NO: 921804 - DNA, 22 bp, Artificial Sequence
  chemically synthesized
aaagtcagtatatccaaaactc

SEQ ID NO: 921805 - DNA, 22 bp, Artificial Sequence
  chemically synthesized
aaagccatctcaaagtcagtat

SEQ ID NO: 921806 - DNA, 22 bp, Artificial Sequence
  chemically synthesized
agttttggatatactgactttg

SEQ ID NO: 921807 - DNA, 22 bp, Artificial Sequence
  chemically synthesized
tgtctcaaagccatctcaaagt

SEQ ID NO: 921808 - DNA, 22 bp, Artificial Sequence
  chemically synthesized
tggatatactgactttgagatg

SEQ ID NO: 921809 - DNA, 22 bp, Artificial Sequence
  chemically synthesized
ggatatactgactttgagatgg

SEQ ID NO: 921810 - DNA, 22 bp, Artificial Sequence
  chemically synthesized
tatgtctcaaagccatctcaaa

SEQ ID NO: 921811 - DNA, 22 bp, Artificial Sequence
  chemically synthesized
gatatactgactttgagatggc

SEQ ID NO: 921812 - DNA, 22 bp, Artificial Sequence
  chemically synthesized
ctatgtctcaaagccatctcaa

SEQ ID NO: 921813 - DNA, 22 bp, Artificial Sequence
  chemically synthesized
ttctatgtctcaaagccatctc

SEQ ID NO: 921814 - DNA, 22 bp, Artificial Sequence
  chemically synthesized
ctcttctatgtctcaaagccat

SEQ ID NO: 921815 - DNA, 22 bp, Artificial Sequence
  chemically synthesized
cctcttctatgtctcaaagcca

SEQ ID NO: 921816 - DNA, 22 bp, Artificial Sequence
  chemically synthesized
actttgagatggctttgagaca

SEQ ID NO: 921817 - DNA, 22 bp, Artificial Sequence
  chemically synthesized
tgagatggctttgagacataga

SEQ ID NO: 921818 - DNA, 22 bp, Artificial Sequence
  chemically synthesized
gagatggctttgagacatagaa

SEQ ID NO: 921819 - DNA, 22 bp, Artificial Sequence
  chemically synthesized
agatggctttgagacatagaag

SEQ ID NO: 921820 - DNA, 22 bp, Artificial Sequence
  chemically synthesized
aaatggaccatttcctcttcta

SEQ ID NO: 921821 - DNA, 22 bp, Artificial Sequence
  chemically synthesized
caaatggaccatttcctcttct

SEQ ID NO: 921822 - DNA, 22 bp, Artificial Sequence
  chemically synthesized
tgagacatagaagaggaaatgg

SEQ ID NO: 921823 - DNA, 22 bp, Artificial Sequence
  chemically synthesized
gagacatagaagaggaaatggt

SEQ ID NO: 921824 - DNA, 22 bp, Artificial Sequence
  chemically synthesized
agacatagaagaggaaatggtc

SEQ ID NO: 921825 - DNA, 22 bp, Artificial Sequence
  chemically synthesized
catatgtagcttcaaatggacc

SEQ ID NO: 921826 - DNA, 22 bp, Artificial Sequence
  chemically synthesized
gacctacatatgtagcttcaaa

SEQ ID NO: 921827 - DNA, 22 bp, Artificial Sequence
  chemically synthesized
agattagacctacatatgtagc

SEQ ID NO: 921828 - DNA, 22 bp, Artificial Sequence
  chemically synthesized
cagattagacctacatatgtag

SEQ ID NO: 921829 - DNA, 22 bp, Artificial Sequence
  chemically synthesized
gaagctacatatgtaggtctaa

SEQ ID NO: 921830 - DNA, 22 bp, Artificial Sequence
  chemically synthesized
aagctacatatgtaggtctaat

SEQ ID NO: 921831 - DNA, 22 bp, Artificial Sequence
  chemically synthesized
catatgtaggtctaatctgaaa

SEQ ID NO: 921832 - DNA, 22 bp, Artificial Sequence
  chemically synthesized
gcccaatatatagtttcagatt

SEQ ID NO: 921833 - DNA, 22 bp, Artificial Sequence
  chemically synthesized
ggcccaatatatagtttcagat

SEQ ID NO: 921834 - DNA, 22 bp, Artificial Sequence
  chemically synthesized
atatttggcccaatatatagtt

SEQ ID NO: 921835 - DNA, 22 bp, Artificial Sequence
  chemically synthesized
atctgaaactatatattgggcc

SEQ ID NO: 921836 - DNA, 22 bp, Artificial Sequence
  chemically synthesized
agtctaatatttggcccaatat

SEQ ID NO: 921837 - DNA, 22 bp, Artificial Sequence
  chemically synthesized
aaactatatattgggccaaata

SEQ ID NO: 921838 - DNA, 22 bp, Artificial Sequence
  chemically synthesized
tggcctaagtctaatatttggc

SEQ ID NO: 921839 - DNA, 22 bp, Artificial Sequence
  chemically synthesized
atggcctaagtctaatatttgg

SEQ ID NO: 921840 - DNA, 22 bp, Artificial Sequence
  chemically synthesized
tatggcctaagtctaatatttg

SEQ ID NO: 921841 - DNA, 22 bp, Artificial Sequence
  chemically synthesized
tatattgggccaaatattagac

SEQ ID NO: 921842 - DNA, 22 bp, Artificial Sequence
  chemically synthesized
attttatggcctaagtctaata

SEQ ID NO: 921843 - DNA, 22 bp, Artificial Sequence
  chemically synthesized
cattttatggcctaagtctaat

SEQ ID NO: 921844 - DNA, 22 bp, Artificial Sequence
  chemically synthesized
ggccaaatattagacttaggcc

SEQ ID NO: 921845 - DNA, 22 bp, Artificial Sequence
  chemically synthesized
gacttaggccataaaatgaaat

SEQ ID NO: 921846 - DNA, 22 bp, Artificial Sequence
  chemically synthesized
ccaaagtcaccgatttcatttt

SEQ ID NO: 921847 - DNA, 22 bp, Artificial Sequence
  chemically synthesized
taccaaagtcaccgatttcatt

SEQ ID NO: 921848 - DNA, 22 bp, Artificial Sequence
  chemically synthesized
aggccataaaatgaaatcggtg

SEQ ID NO: 921849 - DNA, 22 bp, Artificial Sequence
  chemically synthesized
ggccataaaatgaaatcggtga

SEQ ID NO: 921850 - DNA, 22 bp, Artificial Sequence
  chemically synthesized
agcagtctctaccaaagtcacc

SEQ ID NO: 921851 - DNA, 22 bp, Artificial Sequence
  chemically synthesized
agcagctaagcagtctctacca

SEQ ID NO: 921852 - DNA, 22 bp, Artificial Sequence
  chemically synthesized
tggtagagactgcttagctgct

SEQ ID NO: 921853 - DNA, 22 bp, Artificial Sequence
  chemically synthesized
ggtagagactgcttagctgctt

SEQ ID NO: 921854 - DNA, 22 bp, Artificial Sequence
  chemically synthesized
gtagagactgcttagctgctta

SEQ ID NO: 921855 - DNA, 22 bp, Artificial Sequence
  chemically synthesized
cttagctgcttagcccatgatc

SEQ ID NO: 921856 - DNA, 22 bp, Artificial Sequence
  chemically synthesized
agctgcttagcccatgatccat

SEQ ID NO: 921857 - DNA, 22 bp, Artificial Sequence
  chemically synthesized
gctgcttagcccatgatccatt

SEQ ID NO: 921858 - DNA, 22 bp, Artificial Sequence
  chemically synthesized
aaaatgtagtggaatggatcat

SEQ ID NO: 921859 - DNA, 22 bp, Artificial Sequence
  chemically synthesized
cttagcccatgatccattccac

SEQ ID NO: 921860 - DNA, 22 bp, Artificial Sequence
  chemically synthesized
agcccatgatccattccactac

SEQ ID NO: 921861 - DNA, 22 bp, Artificial Sequence
  chemically synthesized
gcccatgatccattccactaca

SEQ ID NO: 921862 - DNA, 22 bp, Artificial Sequence
  chemically synthesized
caatgggcattcaaaatgtagt

SEQ ID NO: 921863 - DNA, 22 bp, Artificial Sequence
  chemically synthesized
cactacattttgaatgcccatt

SEQ ID NO: 921864 - DNA, 22 bp, Artificial Sequence
  chemically synthesized
cattttgaatgcccattgcagt

SEQ ID NO: 921865 - DNA, 22 bp, Artificial Sequence
  chemically synthesized
atgacaatgccaaactgcaatg

SEQ ID NO: 921866 - DNA, 22 bp, Artificial Sequence
  chemically synthesized
tcatgacaatgccaaactgcaa

SEQ ID NO: 921867 - DNA, 22 bp, Artificial Sequence
  chemically synthesized
tgaatgcccattgcagtttggc

SEQ ID NO: 921868 - DNA, 22 bp, Artificial Sequence
  chemically synthesized
gaatgcccattgcagtttggca

SEQ ID NO: 921869 - DNA, 22 bp, Artificial Sequence
  chemically synthesized
ttctcatgacaatgccaaactg

SEQ ID NO: 921870 - DNA, 22 bp, Artificial Sequence
  chemically synthesized
aatgcccattgcagtttggcat

SEQ ID NO: 921871 - DNA, 22 bp, Artificial Sequence
  chemically synthesized
attctcatgacaatgccaaact

SEQ ID NO: 921872 - DNA, 22 bp, Artificial Sequence
  chemically synthesized
gccagaatttattctcatgaca

SEQ ID NO: 921873 - DNA, 22 bp, Artificial Sequence
  chemically synthesized
cagtttggcattgtcatgagaa

SEQ ID NO: 921874 - DNA, 22 bp, Artificial Sequence
  chemically synthesized
ggcattgtcatgagaataaatt

SEQ ID NO: 921875 - DNA, 22 bp, Artificial Sequence
  chemically synthesized
gcattgtcatgagaataaattc

SEQ ID NO: 921876 - DNA, 22 bp, Artificial Sequence
  chemically synthesized
tatgtcattggccagaatttat

SEQ ID NO: 921877 - DNA, 22 bp, Artificial Sequence
  chemically synthesized
gtatgtcattggccagaattta

SEQ ID NO: 921878 - DNA, 22 bp, Artificial Sequence
  chemically synthesized
tcatgagaataaattctggcca

SEQ ID NO: 921879 - DNA, 22 bp, Artificial Sequence
  chemically synthesized
gcttgtatgtcattggccagaa

SEQ ID NO: 921880 - DNA, 22 bp, Artificial Sequence
  chemically synthesized
agcttgtatgtcattggccaga

SEQ ID NO: 921881 - DNA, 22 bp, Artificial Sequence
  chemically synthesized
tagcttgtatgtcattggccag

SEQ ID NO: 921882 - DNA, 22 bp, Artificial Sequence
  chemically synthesized
cacaacactttagcttgtatgt

SEQ ID NO: 921883 - DNA, 22 bp, Artificial Sequence
  chemically synthesized
tggccaatgacatacaagctaa

SEQ ID NO: 921884 - DNA, 22 bp, Artificial Sequence
  chemically synthesized
gccaatgacatacaagctaaag

SEQ ID NO: 921885 - DNA, 22 bp, Artificial Sequence
  chemically synthesized
atggaagatctacacaacactt

SEQ ID NO: 921886 - DNA, 22 bp, Artificial Sequence
  chemically synthesized
catggaagatctacacaacact

SEQ ID NO: 921887 - DNA, 22 bp, Artificial Sequence
  chemically synthesized
aagggacttcatggaagatcta

SEQ ID NO: 921888 - DNA, 22 bp, Artificial Sequence
  chemically synthesized
aaagggacttcatggaagatct

SEQ ID NO: 921889 - DNA, 22 bp, Artificial Sequence
  chemically synthesized
aagtgttgtgtagatcttccat

SEQ ID NO: 921890 - DNA, 22 bp, Artificial Sequence
  chemically synthesized
taaagggacttcatggaagatc

SEQ ID NO: 921891 - DNA, 22 bp, Artificial Sequence
  chemically synthesized
ttaaagggacttcatggaagat

SEQ ID NO: 921892 - DNA, 22 bp, Artificial Sequence
  chemically synthesized
cccttttaaagggacttcatgg

SEQ ID NO: 921893 - DNA, 22 bp, Artificial Sequence
  chemically synthesized
tgtagatcttccatgaagtccc

SEQ ID NO: 921894 - DNA, 22 bp, Artificial Sequence
  chemically synthesized
tacccttttaaagggacttcat

SEQ ID NO: 921895 - DNA, 22 bp, Artificial Sequence
  chemically synthesized
ccatgaagtccctttaaaaggg

SEQ ID NO: 921896 - DNA, 22 bp, Artificial Sequence
  chemically synthesized
catgaagtccctttaaaagggt

SEQ ID NO: 921897 - DNA, 22 bp, Artificial Sequence
  chemically synthesized
taaaagggtagaggtatccctt

SEQ ID NO: 921898 - DNA, 22 bp, Artificial Sequence
  chemically synthesized
aaaagggtagaggtatcccttt

SEQ ID NO: 921899 - DNA, 22 bp, Artificial Sequence
  chemically synthesized
aaagggtagaggtatccctttt

SEQ ID NO: 921900 - DNA, 22 bp, Artificial Sequence
  chemically synthesized
caaggtgtaggaagtggacaaa

SEQ ID NO: 921901 - DNA, 22 bp, Artificial Sequence
  chemically synthesized
aaaggctgcaaggtgtaggaag

SEQ ID NO: 921902 - DNA, 22 bp, Artificial Sequence
  chemically synthesized
caaaggctgcaaggtgtaggaa

SEQ ID NO: 921903 - DNA, 22 bp, Artificial Sequence
  chemically synthesized
tcaaaggctgcaaggtgtagga

SEQ ID NO: 921904 - DNA, 22 bp, Artificial Sequence
  chemically synthesized
ttttgtccacttcctacacctt

SEQ ID NO: 921905 - DNA, 22 bp, Artificial Sequence
  chemically synthesized
ttcaaaggctgcaaggtgtagg

SEQ ID NO: 921906 - DNA, 22 bp, Artificial Sequence
  chemically synthesized
tttgtccacttcctacaccttg

SEQ ID NO: 921907 - DNA, 22 bp, Artificial Sequence
  chemically synthesized
ttgtccacttcctacaccttgc

SEQ ID NO: 921908 - DNA, 22 bp, Artificial Sequence
  chemically synthesized
tgtccacttcctacaccttgca

SEQ ID NO: 921909 - DNA, 22 bp, Artificial Sequence
  chemically synthesized
cttttcaaaggctgcaaggtgt

SEQ ID NO: 921910 - DNA, 22 bp, Artificial Sequence
  chemically synthesized
gtccacttcctacaccttgcag

SEQ ID NO: 921911 - DNA, 22 bp, Artificial Sequence
  chemically synthesized
tccacttcctacaccttgcagc

SEQ ID NO: 921912 - DNA, 22 bp, Artificial Sequence
  chemically synthesized
cctacaccttgcagcctttgaa

SEQ ID NO: 921913 - DNA, 22 bp, Artificial Sequence
  chemically synthesized
tcacaactgcttttcaaaggct

SEQ ID NO: 921914 - DNA, 22 bp, Artificial Sequence
  chemically synthesized
ctacaccttgcagcctttgaaa

SEQ ID NO: 921915 - DNA, 22 bp, Artificial Sequence
  chemically synthesized
caccttgcagcctttgaaaagc

SEQ ID NO: 921916 - DNA, 22 bp, Artificial Sequence
  chemically synthesized
tctatcacaactgcttttcaaa

SEQ ID NO: 921917 - DNA, 22 bp, Artificial Sequence
  chemically synthesized
tatctatcacaactgcttttca

SEQ ID NO: 921918 - DNA, 22 bp, Artificial Sequence
  chemically synthesized
tctatctatcacaactgctttt

SEQ ID NO: 921919 - DNA, 22 bp, Artificial Sequence
  chemically synthesized
gcagcctttgaaaagcagttgt

SEQ ID NO: 921920 - DNA, 22 bp, Artificial Sequence
  chemically synthesized
cagcctttgaaaagcagttgtg

SEQ ID NO: 921921 - DNA, 22 bp, Artificial Sequence
  chemically synthesized
tcagctctctatctatcacaac

SEQ ID NO: 921922 - DNA, 22 bp, Artificial Sequence
  chemically synthesized
tgaaaagcagttgtgatagata

SEQ ID NO: 921923 - DNA, 22 bp, Artificial Sequence
  chemically synthesized
gaaaagcagttgtgatagatag

SEQ ID NO: 921924 - DNA, 22 bp, Artificial Sequence
  chemically synthesized
aaaagcagttgtgatagataga

SEQ ID NO: 921925 - DNA, 22 bp, Artificial Sequence
  chemically synthesized
tgatagatagagagctgatagt

SEQ ID NO: 921926 - DNA, 22 bp, Artificial Sequence
  chemically synthesized
atggatcaagatgactatcagc

SEQ ID NO: 921927 - DNA, 22 bp, Artificial Sequence
  chemically synthesized
cactcatggatcaagatgacta

SEQ ID NO: 921928 - DNA, 22 bp, Artificial Sequence
  chemically synthesized
acactcatggatcaagatgact

SEQ ID NO: 921929 - DNA, 22 bp, Artificial Sequence
  chemically synthesized
atagtcatcttgatccatgagt

SEQ ID NO: 921930 - DNA, 22 bp, Artificial Sequence
  chemically synthesized
gtgaggtccttacactcatgga

SEQ ID NO: 921931 - DNA, 22 bp, Artificial Sequence
  chemically synthesized
ggtgaggtccttacactcatgg

SEQ ID NO: 921932 - DNA, 22 bp, Artificial Sequence
  chemically synthesized
tggtgaggtccttacactcatg

SEQ ID NO: 921933 - DNA, 22 bp, Artificial Sequence
  chemically synthesized
gatccatgagtgtaaggacctc

SEQ ID NO: 921934 - DNA, 22 bp, Artificial Sequence
  chemically synthesized
ccatcctttggtgaggtcctta

SEQ ID NO: 921935 - DNA, 22 bp, Artificial Sequence
  chemically synthesized
atccatgagtgtaaggacctca

SEQ ID NO: 921936 - DNA, 22 bp, Artificial Sequence
  chemically synthesized
acagatctgccatcctttggtg

SEQ ID NO: 921937 - DNA, 22 bp, Artificial Sequence
  chemically synthesized
tctcacagatctgccatccttt

SEQ ID NO: 921938 - DNA, 22 bp, Artificial Sequence
  chemically synthesized
tgtctcacagatctgccatcct

SEQ ID NO: 921939 - DNA, 22 bp, Artificial Sequence
  chemically synthesized
ctgtctcacagatctgccatcc

SEQ ID NO: 921940 - DNA, 22 bp, Artificial Sequence
  chemically synthesized
accaaaggatggcagatctgtg

SEQ ID NO: 921941 - DNA, 22 bp, Artificial Sequence
  chemically synthesized
aagatccagatcccttctgtct

SEQ ID NO: 921942 - DNA, 22 bp, Artificial Sequence
  chemically synthesized
tgatgttgaagatccagatccc

SEQ ID NO: 921943 - DNA, 22 bp, Artificial Sequence
  chemically synthesized
tgagacagaagggatctggatc

SEQ ID NO: 921944 - DNA, 22 bp, Artificial Sequence
  chemically synthesized
tatgatgttgaagatccagatc

SEQ ID NO: 921945 - DNA, 22 bp, Artificial Sequence
  chemically synthesized
ctctatgatgttgaagatccag

SEQ ID NO: 921946 - DNA, 22 bp, Artificial Sequence
  chemically synthesized
gtatcattgctctatgatgttg

SEQ ID NO: 921947 - DNA, 22 bp, Artificial Sequence
  chemically synthesized
gatcttcaacatcatagagcaa

SEQ ID NO: 921948 - DNA, 22 bp, Artificial Sequence
  chemically synthesized
caacatcatagagcaatgatac

SEQ ID NO: 921949 - DNA, 22 bp, Artificial Sequence
  chemically synthesized
aacatcatagagcaatgatacc

SEQ ID NO: 921950 - DNA, 22 bp, Artificial Sequence
  chemically synthesized
ccagtaggtagtccgaggttgg

SEQ ID NO: 921951 - DNA, 22 bp, Artificial Sequence
  chemically synthesized
tagaaggaatctgccagtaggt

SEQ ID NO: 921952 - DNA, 22 bp, Artificial Sequence
  chemically synthesized
gtagaaggaatctgccagtagg

SEQ ID NO: 921953 - DNA, 22 bp, Artificial Sequence
  chemically synthesized
ttgtagaaggaatctgccagta

SEQ ID NO: 921954 - DNA, 22 bp, Artificial Sequence
  chemically synthesized
cttgtagaaggaatctgccagt

SEQ ID NO: 921955 - DNA, 22 bp, Artificial Sequence
  chemically synthesized
ggactacctactggcagattcc

SEQ ID NO: 921956 - DNA, 22 bp, Artificial Sequence
  chemically synthesized
atcttcttgtagaaggaatctg

SEQ ID NO: 921957 - DNA, 22 bp, Artificial Sequence
  chemically synthesized
cctactggcagattccttctac

SEQ ID NO: 921958 - DNA, 22 bp, Artificial Sequence
  chemically synthesized
ctggcagattccttctacaaga

SEQ ID NO: 921959 - DNA, 22 bp, Artificial Sequence
  chemically synthesized
gcagattccttctacaagaaga

SEQ ID NO: 921960 - DNA, 22 bp, Artificial Sequence
  chemically synthesized
cttctacaagaagatgaatata

SEQ ID NO: 921961 - DNA, 22 bp, Artificial Sequence
  chemically synthesized
aaacaaagtagaaatatattca

SEQ ID NO: 921962 - DNA, 22 bp, Artificial Sequence
  chemically synthesized
ctacaagaagatgaatatattt

SEQ ID NO: 921963 - DNA, 22 bp, Artificial Sequence
  chemically synthesized
tacaagaagatgaatatatttc

SEQ ID NO: 921964 - DNA, 22 bp, Artificial Sequence
  chemically synthesized
caagaagatgaatatatttcta

SEQ ID NO: 921965 - DNA, 22 bp, Artificial Sequence
  chemically synthesized
tagtaactgaaacaaagtagaa

SEQ ID NO: 921966 - DNA, 22 bp, Artificial Sequence
  chemically synthesized
aaaaagaattatagtaactgaa

SEQ ID NO: 921967 - DNA, 22 bp, Artificial Sequence
  chemically synthesized
ctactttgtttcagttactata

SEQ ID NO: 921968 - DNA, 22 bp, Artificial Sequence
  chemically synthesized
tactttgtttcagttactataa

SEQ ID NO: 921969 - DNA, 22 bp, Artificial Sequence
  chemically synthesized
ctttgtttcagttactataatt

SEQ ID NO: 921970 - DNA, 22 bp, Artificial Sequence
  chemically synthesized
tgtttcagttactataattctt

SEQ ID NO: 921971 - DNA, 22 bp, Artificial Sequence
  chemically synthesized
gggagattaaaaaagaattata

SEQ ID NO: 921972 - DNA, 22 bp, Artificial Sequence
  chemically synthesized
gtttcagttactataattcttt

SEQ ID NO: 921973 - DNA, 22 bp, Artificial Sequence
  chemically synthesized
tttcagttactataattctttt

SEQ ID NO: 921974 - DNA, 22 bp, Artificial Sequence
  chemically synthesized
cagttactataattctttttta

SEQ ID NO: 921975 - DNA, 22 bp, Artificial Sequence
  chemically synthesized
agttactataattcttttttaa

SEQ ID NO: 921976 - DNA, 22 bp, Artificial Sequence
  chemically synthesized
ctataattcttttttaatctcc

SEQ ID NO: 921977 - DNA, 22 bp, Artificial Sequence
  chemically synthesized
gaataatatctagggagattaa

SEQ ID NO: 921978 - DNA, 22 bp, Artificial Sequence
  chemically synthesized
taattcttttttaatctcccta

SEQ ID NO: 921979 - DNA, 22 bp, Artificial Sequence
  chemically synthesized
ttttttaatctccctagatatt

SEQ ID NO: 921980 - DNA, 22 bp, Artificial Sequence
  chemically synthesized
tatcaattagaataatatctag

SEQ ID NO: 921981 - DNA, 22 bp, Artificial Sequence
  chemically synthesized
ttttaatctccctagatattat

SEQ ID NO: 921982 - DNA, 22 bp, Artificial Sequence
  chemically synthesized
tttaatctccctagatattatt

SEQ ID NO: 921983 - DNA, 22 bp, Artificial Sequence
  chemically synthesized
ttaatctccctagatattattc

SEQ ID NO: 921984 - DNA, 22 bp, Artificial Sequence
  chemically synthesized
taatctccctagatattattct

SEQ ID NO: 921985 - DNA, 22 bp, Artificial Sequence
  chemically synthesized
actgtatcaattagaataatat

SEQ ID NO: 921986 - DNA, 22 bp, Artificial Sequence
  chemically synthesized
aatctccctagatattattcta

SEQ ID NO: 921987 - DNA, 22 bp, Artificial Sequence
  chemically synthesized
cactgtatcaattagaataata

SEQ ID NO: 921988 - DNA, 22 bp, Artificial Sequence
  chemically synthesized
atctccctagatattattctaa

SEQ ID NO: 921989 - DNA, 22 bp, Artificial Sequence
  chemically synthesized
tcactgtatcaattagaataat

SEQ ID NO: 921990 - DNA, 22 bp, Artificial Sequence
  chemically synthesized
cctagatattattctaattgat

SEQ ID NO: 921991 - DNA, 22 bp, Artificial Sequence
  chemically synthesized
gatattattctaattgatacag

SEQ ID NO: 921992 - DNA, 22 bp, Artificial Sequence
  chemically synthesized
ttctaattgatacagtgaaagc

SEQ ID NO: 921993 - DNA, 22 bp, Artificial Sequence
  chemically synthesized
taattgatacagtgaaagctac

SEQ ID NO: 921994 - DNA, 22 bp, Artificial Sequence
  chemically synthesized
attgatacagtgaaagctacat

SEQ ID NO: 921995 - DNA, 22 bp, Artificial Sequence
  chemically synthesized
tccatagcaacaaatgtagctt

SEQ ID NO: 921996 - DNA, 22 bp, Artificial Sequence
  chemically synthesized
atacagtgaaagctacatttgt

SEQ ID NO: 921997 - DNA, 22 bp, Artificial Sequence
  chemically synthesized
ttatccatagcaacaaatgtag

SEQ ID NO: 921998 - DNA, 22 bp, Artificial Sequence
  chemically synthesized
attgttatccatagcaacaaat

SEQ ID NO: 921999 - DNA, 22 bp, Artificial Sequence
  chemically synthesized
cctgattgttatccatagcaac

SEQ ID NO: 922000 - DNA, 22 bp, Artificial Sequence
  chemically synthesized
ccctgattgttatccatagcaa

SEQ ID NO: 922001 - DNA, 22 bp, Artificial Sequence
  chemically synthesized
catttgttgctatggataacaa

SEQ ID NO: 922002 - DNA, 22 bp, Artificial Sequence
  chemically synthesized
tacggtttccctgattgttatc

SEQ ID NO: 922003 - DNA, 22 bp, Artificial Sequence
  chemically synthesized
tatacggtttccctgattgtta

SEQ ID NO: 922004 - DNA, 22 bp, Artificial Sequence
  chemically synthesized
gttgctatggataacaatcagg

SEQ ID NO: 922005 - DNA, 22 bp, Artificial Sequence
  chemically synthesized
ttgctatggataacaatcaggg

SEQ ID NO: 922006 - DNA, 22 bp, Artificial Sequence
  chemically synthesized
attctatacggtttccctgatt

SEQ ID NO: 922007 - DNA, 22 bp, Artificial Sequence
  chemically synthesized
ctatggataacaatcagggaaa

SEQ ID NO: 922008 - DNA, 22 bp, Artificial Sequence
  chemically synthesized
tcattctatacggtttccctga

SEQ ID NO: 922009 - DNA, 22 bp, Artificial Sequence
  chemically synthesized
ctcattctatacggtttccctg

SEQ ID NO: 922010 - DNA, 22 bp, Artificial Sequence
  chemically synthesized
tggataacaatcagggaaaccg

SEQ ID NO: 922011 - DNA, 22 bp, Artificial Sequence
  chemically synthesized
ttctcattctatacggtttccc

SEQ ID NO: 922012 - DNA, 22 bp, Artificial Sequence
  chemically synthesized
cttctcattctatacggtttcc

SEQ ID NO: 922013 - DNA, 22 bp, Artificial Sequence
  chemically synthesized
ccttcttctcattctatacggt

SEQ ID NO: 922014 - DNA, 22 bp, Artificial Sequence
  chemically synthesized
aaccctcccttcttctcattct

SEQ ID NO: 922015 - DNA, 22 bp, Artificial Sequence
  chemically synthesized
tgaaccctcccttcttctcatt

SEQ ID NO: 922016 - DNA, 22 bp, Artificial Sequence
  chemically synthesized
ggacatgttctgaaccctccct

SEQ ID NO: 922017 - DNA, 22 bp, Artificial Sequence
  chemically synthesized
taggacatgttctgaaccctcc

SEQ ID NO: 922018 - DNA, 22 bp, Artificial Sequence
  chemically synthesized
tctaggacatgttctgaaccct

SEQ ID NO: 922019 - DNA, 22 bp, Artificial Sequence
  chemically synthesized
ctctaggacatgttctgaaccc

SEQ ID NO: 922020 - DNA, 22 bp, Artificial Sequence
  chemically synthesized
atgtttctctaggacatgttct

SEQ ID NO: 922021 - DNA, 22 bp, Artificial Sequence
  chemically synthesized
catcctgatgtttctctaggac

SEQ ID NO: 922022 - DNA, 22 bp, Artificial Sequence
  chemically synthesized
acatcctgatgtttctctagga

SEQ ID NO: 922023 - DNA, 22 bp, Artificial Sequence
  chemically synthesized
agaacatgtcctagagaaacat

SEQ ID NO: 922024 - DNA, 22 bp, Artificial Sequence
  chemically synthesized
ccccttacatcctgatgtttct

SEQ ID NO: 922025 - DNA, 22 bp, Artificial Sequence
  chemically synthesized
cctgccccttacatcctgatgt

SEQ ID NO: 922026 - DNA, 22 bp, Artificial Sequence
  chemically synthesized
acctgccccttacatcctgatg

SEQ ID NO: 922027 - DNA, 22 bp, Artificial Sequence
  chemically synthesized
tacctgccccttacatcctgat

SEQ ID NO: 922028 - DNA, 22 bp, Artificial Sequence
  chemically synthesized
ctttacctgccccttacatcct

SEQ ID NO: 922029 - DNA, 22 bp, Artificial Sequence
  chemically synthesized
gctttacctgccccttacatcc

SEQ ID NO: 922030 - DNA, 22 bp, Artificial Sequence
  chemically synthesized
gagaaacatcaggatgtaaggg

SEQ ID NO: 922031 - DNA, 22 bp, Artificial Sequence
  chemically synthesized
cttgctttacctgccccttaca

SEQ ID NO: 922032 - DNA, 22 bp, Artificial Sequence
  chemically synthesized
atgacactccttgctttacctg

SEQ ID NO: 922033 - DNA, 22 bp, Artificial Sequence
  chemically synthesized
tattgatgacactccttgcttt

SEQ ID NO: 922034 - DNA, 22 bp, Artificial Sequence
  chemically synthesized
ctatattgatgacactccttgc

SEQ ID NO: 922035 - DNA, 22 bp, Artificial Sequence
  chemically synthesized
actatattgatgacactccttg

SEQ ID NO: 922036 - DNA, 22 bp, Artificial Sequence
  chemically synthesized
cttactatattgatgacactcc

SEQ ID NO: 922037 - DNA, 22 bp, Artificial Sequence
  chemically synthesized
tgtaattccttactatattgat

SEQ ID NO: 922038 - DNA, 22 bp, Artificial Sequence
  chemically synthesized
tatgtaattccttactatattg

SEQ ID NO: 922039 - DNA, 22 bp, Artificial Sequence
  chemically synthesized
tctatgtaattccttactatat

SEQ ID NO: 922040 - DNA, 22 bp, Artificial Sequence
  chemically synthesized
cctctctatgtaattccttact

SEQ ID NO: 922041 - DNA, 22 bp, Artificial Sequence
  chemically synthesized
acctctctatgtaattccttac

SEQ ID NO: 922042 - DNA, 22 bp, Artificial Sequence
  chemically synthesized
ttacctctctatgtaattcctt

SEQ ID NO: 922043 - DNA, 22 bp, Artificial Sequence
  chemically synthesized
ttcttacctctctatgtaattc

SEQ ID NO: 922044 - DNA, 22 bp, Artificial Sequence
  chemically synthesized
attcttacctctctatgtaatt

SEQ ID NO: 922045 - DNA, 22 bp, Artificial Sequence
  chemically synthesized
aatttattcttacctctctatg

SEQ ID NO: 922046 - DNA, 22 bp, Artificial Sequence
  chemically synthesized
tctgaatttattcttacctctc

SEQ ID NO: 922047 - DNA, 22 bp, Artificial Sequence
  chemically synthesized
atctgaatttattcttacctct

SEQ ID NO: 922048 - DNA, 22 bp, Artificial Sequence
  chemically synthesized
atcttatctgaatttattctta

SEQ ID NO: 922049 - DNA, 22 bp, Artificial Sequence
  chemically synthesized
catagagaggtaagaataaatt

SEQ ID NO: 922050 - DNA, 22 bp, Artificial Sequence
  chemically synthesized
caagtcactaatcttatctgaa

SEQ ID NO: 922051 - DNA, 22 bp, Artificial Sequence
  chemically synthesized
ccaagtcactaatcttatctga

SEQ ID NO: 922052 - DNA, 22 bp, Artificial Sequence
  chemically synthesized
tcttccaagtcactaatcttat

SEQ ID NO: 922053 - DNA, 22 bp, Artificial Sequence
  chemically synthesized
atcttccaagtcactaatctta

SEQ ID NO: 922054 - DNA, 22 bp, Artificial Sequence
  chemically synthesized
tcttatcttccaagtcactaat

SEQ ID NO: 922055 - DNA, 22 bp, Artificial Sequence
  chemically synthesized
agataagattagtgacttggaa

SEQ ID NO: 922056 - DNA, 22 bp, Artificial Sequence
  chemically synthesized
gtcctatcttatcttccaagtc

SEQ ID NO: 922057 - DNA, 22 bp, Artificial Sequence
  chemically synthesized
ggtcctatcttatcttccaagt

SEQ ID NO: 922058 - DNA, 22 bp, Artificial Sequence
  chemically synthesized
gcacttggtcctatcttatctt

SEQ ID NO: 922059 - DNA, 22 bp, Artificial Sequence
  chemically synthesized
gtgacttggaagataagatagg

SEQ ID NO: 922060 - DNA, 22 bp, Artificial Sequence
  chemically synthesized
cgtattagcacttggtcctatc

SEQ ID NO: 922061 - DNA, 22 bp, Artificial Sequence
  chemically synthesized
ccgtattagcacttggtcctat

SEQ ID NO: 922062 - DNA, 22 bp, Artificial Sequence
  chemically synthesized
tccgtattagcacttggtccta

SEQ ID NO: 922063 - DNA, 22 bp, Artificial Sequence
  chemically synthesized
ggaagataagataggaccaagt

SEQ ID NO: 922064 - DNA, 22 bp, Artificial Sequence
  chemically synthesized
gaagataagataggaccaagtg

SEQ ID NO: 922065 - DNA, 22 bp, Artificial Sequence
  chemically synthesized
aacactttccgtattagcactt

SEQ ID NO: 922066 - DNA, 22 bp, Artificial Sequence
  chemically synthesized
actgaacactttccgtattagc

SEQ ID NO: 922067 - DNA, 22 bp, Artificial Sequence
  chemically synthesized
atacggaaagtgttcagttaat

SEQ ID NO: 922068 - DNA, 22 bp, Artificial Sequence
  chemically synthesized
tccgtaggccatgtgccattaa

SEQ ID NO: 922069 - DNA, 22 bp, Artificial Sequence
  chemically synthesized
ttatccgtaggccatgtgccat

SEQ ID NO: 922070 - DNA, 22 bp, Artificial Sequence
  chemically synthesized
gtcctattatccgtaggccatg

SEQ ID NO: 922071 - DNA, 22 bp, Artificial Sequence
  chemically synthesized
agttaatggcacatggcctacg

SEQ ID NO: 922072 - DNA, 22 bp, Artificial Sequence
  chemically synthesized
agtcctattatccgtaggccat

SEQ ID NO: 922073 - DNA, 22 bp, Artificial Sequence
  chemically synthesized
atggcacatggcctacggataa

SEQ ID NO: 922074 - DNA, 22 bp, Artificial Sequence
  chemically synthesized
gacatatcttagtcctattatc

SEQ ID NO: 922075 - DNA, 22 bp, Artificial Sequence
  chemically synthesized
aatccactggacatatcttagt

SEQ ID NO: 922076 - DNA, 22 bp, Artificial Sequence
  chemically synthesized
cggataataggactaagatatg

SEQ ID NO: 922077 - DNA, 22 bp, Artificial Sequence
  chemically synthesized
tagttaaatccactggacatat

SEQ ID NO: 922078 - DNA, 22 bp, Artificial Sequence
  chemically synthesized
gtagttaaatccactggacata

SEQ ID NO: 922079 - DNA, 22 bp, Artificial Sequence
  chemically synthesized
ttgtagttaaatccactggaca

SEQ ID NO: 922080 - DNA, 22 bp, Artificial Sequence
  chemically synthesized
cttgtagttaaatccactggac

SEQ ID NO: 922081 - DNA, 22 bp, Artificial Sequence
  chemically synthesized
agatatgtccagtggatttaac

SEQ ID NO: 922082 - DNA, 22 bp, Artificial Sequence
  chemically synthesized
ccaataacaacaatgatttctt

SEQ ID NO: 922083 - DNA, 22 bp, Artificial Sequence
  chemically synthesized
ttgccaataacaacaatgattt

SEQ ID NO: 922084 - DNA, 22 bp, Artificial Sequence
  chemically synthesized
aactacaagaaatcattgttgt

SEQ ID NO: 922085 - DNA, 22 bp, Artificial Sequence
  chemically synthesized
actacaagaaatcattgttgtt

SEQ ID NO: 922086 - DNA, 22 bp, Artificial Sequence
  chemically synthesized
caagaaatcattgttgttattg

SEQ ID NO: 922087 - DNA, 22 bp, Artificial Sequence
  chemically synthesized
agaaaccattattgccaataac

SEQ ID NO: 922088 - DNA, 22 bp, Artificial Sequence
  chemically synthesized
ctcagaaaccattattgccaat

SEQ ID NO: 922089 - DNA, 22 bp, Artificial Sequence
  chemically synthesized
ttgttattggcaataatggttt

SEQ ID NO: 922090 - DNA, 22 bp, Artificial Sequence
  chemically synthesized
ttattggcaataatggtttctg

SEQ ID NO: 922091 - DNA, 22 bp, Artificial Sequence
  chemically synthesized
ttggcaataatggtttctgagc

SEQ ID NO: 922092 - DNA, 22 bp, Artificial Sequence
  chemically synthesized
atccaaaccactgctcagaaac

SEQ ID NO: 922093 - DNA, 22 bp, Artificial Sequence
  chemically synthesized
gatccaaaccactgctcagaaa

SEQ ID NO: 922094 - DNA, 22 bp, Artificial Sequence
  chemically synthesized
tgatccaaaccactgctcagaa

SEQ ID NO: 922095 - DNA, 22 bp, Artificial Sequence
  chemically synthesized
gcaataatggtttctgagcagt

SEQ ID NO: 922096 - DNA, 22 bp, Artificial Sequence
  chemically synthesized
ttgatccaaaccactgctcaga

SEQ ID NO: 922097 - DNA, 22 bp, Artificial Sequence
  chemically synthesized
cttttgatccaaaccactgctc

SEQ ID NO: 922098 - DNA, 22 bp, Artificial Sequence
  chemically synthesized
gcttttgatccaaaccactgct

SEQ ID NO: 922099 - DNA, 22 bp, Artificial Sequence
  chemically synthesized
tttgcttttgatccaaaccact

SEQ ID NO: 922100 - DNA, 22 bp, Artificial Sequence
  chemically synthesized
ctgtttgcttttgatccaaacc

SEQ ID NO: 922101 - DNA, 22 bp, Artificial Sequence
  chemically synthesized
gctgtttgcttttgatccaaac

SEQ ID NO: 922102 - DNA, 22 bp, Artificial Sequence
  chemically synthesized
tgctgtttgcttttgatccaaa

SEQ ID NO: 922103 - DNA, 22 bp, Artificial Sequence
  chemically synthesized
ctgagcagtggtttggatcaaa

SEQ ID NO: 922104 - DNA, 22 bp, Artificial Sequence
  chemically synthesized
ttgctgtttgcttttgatccaa

SEQ ID NO: 922105 - DNA, 22 bp, Artificial Sequence
  chemically synthesized
tgagcagtggtttggatcaaaa

SEQ ID NO: 922106 - DNA, 22 bp, Artificial Sequence
  chemically synthesized
ttttgctgtttgcttttgatcc

SEQ ID NO: 922107 - DNA, 22 bp, Artificial Sequence
  chemically synthesized
agcagtggtttggatcaaaagc

SEQ ID NO: 922108 - DNA, 22 bp, Artificial Sequence
  chemically synthesized
tcttttgctgtttgcttttgat

SEQ ID NO: 922109 - DNA, 22 bp, Artificial Sequence
  chemically synthesized
ctctcttttgctgtttgctttt

SEQ ID NO: 922110 - DNA, 22 bp, Artificial Sequence
  chemically synthesized
tcctctcttttgctgtttgctt

SEQ ID NO: 922111 - DNA, 22 bp, Artificial Sequence
  chemically synthesized
cctctcctctcttttgctgttt

SEQ ID NO: 922112 - DNA, 22 bp, Artificial Sequence
  chemically synthesized
ggatcaaaagcaaacagcaaaa

SEQ ID NO: 922113 - DNA, 22 bp, Artificial Sequence
  chemically synthesized
ccctctcctctcttttgctgtt

SEQ ID NO: 922114 - DNA, 22 bp, Artificial Sequence
  chemically synthesized
gatcaaaagcaaacagcaaaag

SEQ ID NO: 922115 - DNA, 22 bp, Artificial Sequence
  chemically synthesized
tcacatttccctctcctctctt

SEQ ID NO: 922116 - DNA, 22 bp, Artificial Sequence
  chemically synthesized
ttatcacatttccctctcctct

SEQ ID NO: 922117 - DNA, 22 bp, Artificial Sequence
  chemically synthesized
tattatcacatttccctctcct

SEQ ID NO: 922118 - DNA, 22 bp, Artificial Sequence
  chemically synthesized
tctattatcacatttccctctc

SEQ ID NO: 922119 - DNA, 22 bp, Artificial Sequence
  chemically synthesized
aacacacattctctattatcac

SEQ ID NO: 922120 - DNA, 22 bp, Artificial Sequence
  chemically synthesized
aaacacacattctctattatca

SEQ ID NO: 922121 - DNA, 22 bp, Artificial Sequence
  chemically synthesized
cttaaacacacattctctatta

SEQ ID NO: 922122 - DNA, 22 bp, Artificial Sequence
  chemically synthesized
ttacttaaacacacattctcta

SEQ ID NO: 922123 - DNA, 22 bp, Artificial Sequence
  chemically synthesized
gtcactgttacttaaacacaca

SEQ ID NO: 922124 - DNA, 22 bp, Artificial Sequence
  chemically synthesized
atagttagtcactgttacttaa

SEQ ID NO: 922125 - DNA, 22 bp, Artificial Sequence
  chemically synthesized
catagttagtcactgttactta

SEQ ID NO: 922126 - DNA, 22 bp, Artificial Sequence
  chemically synthesized
ttcatagttagtcactgttact

SEQ ID NO: 922127 - DNA, 22 bp, Artificial Sequence
  chemically synthesized
cttcatagttagtcactgttac

SEQ ID NO: 922128 - DNA, 22 bp, Artificial Sequence
  chemically synthesized
aatcttcttcatagttagtcac

SEQ ID NO: 922129 - DNA, 22 bp, Artificial Sequence
  chemically synthesized
gaatcttcttcatagttagtca

SEQ ID NO: 922130 - DNA, 22 bp, Artificial Sequence
  chemically synthesized
aagtaacagtgactaactatga

SEQ ID NO: 922131 - DNA, 22 bp, Artificial Sequence
  chemically synthesized
agtaacagtgactaactatgaa

SEQ ID NO: 922132 - DNA, 22 bp, Artificial Sequence
  chemically synthesized
ccatttgaatcttcttcatagt

SEQ ID NO: 922133 - DNA, 22 bp, Artificial Sequence
  chemically synthesized
ttcccatttgaatcttcttcat

SEQ ID NO: 922134 - DNA, 22 bp, Artificial Sequence
  chemically synthesized
ttattcccatttgaatcttctt

SEQ ID NO: 922135 - DNA, 22 bp, Artificial Sequence
  chemically synthesized
ttattattcccatttgaatctt

SEQ ID NO: 922136 - DNA, 22 bp, Artificial Sequence
  chemically synthesized
gttattattcccatttgaatct

SEQ ID NO: 922137 - DNA, 22 bp, Artificial Sequence
  chemically synthesized
actatgaagaagattcaaatgg

SEQ ID NO: 922138 - DNA, 22 bp, Artificial Sequence
  chemically synthesized
ttgttattattcccatttgaat

SEQ ID NO: 922139 - DNA, 22 bp, Artificial Sequence
  chemically synthesized
cttgttattattcccatttgaa

SEQ ID NO: 922140 - DNA, 22 bp, Artificial Sequence
  chemically synthesized
tcttgttattattcccatttga

SEQ ID NO: 922141 - DNA, 22 bp, Artificial Sequence
  chemically synthesized
tgaagaagattcaaatgggaat

SEQ ID NO: 922142 - DNA, 22 bp, Artificial Sequence
  chemically synthesized
ccctttcttgttattattccca

SEQ ID NO: 922143 - DNA, 22 bp, Artificial Sequence
  chemically synthesized
cccctttcttgttattattccc

SEQ ID NO: 922144 - DNA, 22 bp, Artificial Sequence
  chemically synthesized
cttcccctttcttgttattatt

SEQ ID NO: 922145 - DNA, 22 bp, Artificial Sequence
  chemically synthesized
acttcccctttcttgttattat

SEQ ID NO: 922146 - DNA, 22 bp, Artificial Sequence
  chemically synthesized
ttacttcccctttcttgttatt

SEQ ID NO: 922147 - DNA, 22 bp, Artificial Sequence
  chemically synthesized
aaatgggaataataacaagaaa

SEQ ID NO: 922148 - DNA, 22 bp, Artificial Sequence
  chemically synthesized
acaaatgtctcttacttcccct

SEQ ID NO: 922149 - DNA, 22 bp, Artificial Sequence
  chemically synthesized
ggcaaccaaagttaacaaatgt

SEQ ID NO: 922150 - DNA, 22 bp, Artificial Sequence
  chemically synthesized
tgggcaaccaaagttaacaaat

SEQ ID NO: 922151 - DNA, 22 bp, Artificial Sequence
  chemically synthesized
agattctgggcaaccaaagtta

SEQ ID NO: 922152 - DNA, 22 bp, Artificial Sequence
  chemically synthesized
gttaactttggttgcccagaat

SEQ ID NO: 922153 - DNA, 22 bp, Artificial Sequence
  chemically synthesized
ttaactttggttgcccagaatc

SEQ ID NO: 922154 - DNA, 22 bp, Artificial Sequence
  chemically synthesized
actttggttgcccagaatctga

SEQ ID NO: 922155 - DNA, 22 bp, Artificial Sequence
  chemically synthesized
tggttgcccagaatctgaatgc

SEQ ID NO: 922156 - DNA, 22 bp, Artificial Sequence
  chemically synthesized
gacataatcagggcattcagat

SEQ ID NO: 922157 - DNA, 22 bp, Artificial Sequence
  chemically synthesized
ggttgcccagaatctgaatgcc

SEQ ID NO: 922158 - DNA, 22 bp, Artificial Sequence
  chemically synthesized
gttgcccagaatctgaatgccc

SEQ ID NO: 922159 - DNA, 22 bp, Artificial Sequence
  chemically synthesized
ttcgacataatcagggcattca

SEQ ID NO: 922160 - DNA, 22 bp, Artificial Sequence
  chemically synthesized
gttcgacataatcagggcattc

SEQ ID NO: 922161 - DNA, 22 bp, Artificial Sequence
  chemically synthesized
tgttcgacataatcagggcatt

SEQ ID NO: 922162 - DNA, 22 bp, Artificial Sequence
  chemically synthesized
cccagaatctgaatgccctgat

SEQ ID NO: 922163 - DNA, 22 bp, Artificial Sequence
  chemically synthesized
gggattttgttcgacataatca

SEQ ID NO: 922164 - DNA, 22 bp, Artificial Sequence
  chemically synthesized
ggggattttgttcgacataatc

SEQ ID NO: 922165 - DNA, 22 bp, Artificial Sequence
  chemically synthesized
aatgccctgattatgtcgaaca

SEQ ID NO: 922166 - DNA, 22 bp, Artificial Sequence
  chemically synthesized
tatttggggattttgttcgaca

SEQ ID NO: 922167 - DNA, 22 bp, Artificial Sequence
  chemically synthesized
gtatttggggattttgttcgac

SEQ ID NO: 922168 - DNA, 22 bp, Artificial Sequence
  chemically synthesized
catttgtatttggggattttgt

SEQ ID NO: 922169 - DNA, 22 bp, Artificial Sequence
  chemically synthesized
attatgtcgaacaaaatcccca

SEQ ID NO: 922170 - DNA, 22 bp, Artificial Sequence
  chemically synthesized
tgtcgaacaaaatccccaaata

SEQ ID NO: 922171 - DNA, 22 bp, Artificial Sequence
  chemically synthesized
ccccatcagattccatttgtat

SEQ ID NO: 922172 - DNA, 22 bp, Artificial Sequence
  chemically synthesized
cccccatcagattccatttgta

SEQ ID NO: 922173 - DNA, 22 bp, Artificial Sequence
  chemically synthesized
aacttcccccatcagattccat

SEQ ID NO: 922174 - DNA, 22 bp, Artificial Sequence
  chemically synthesized
aaaaactgaacttcccccatca

SEQ ID NO: 922175 - DNA, 22 bp, Artificial Sequence
  chemically synthesized
cagattcaaaaactgaacttcc

SEQ ID NO: 922176 - DNA, 22 bp, Artificial Sequence
  chemically synthesized
attccagattcaaaaactgaac

SEQ ID NO: 922177 - DNA, 22 bp, Artificial Sequence
  chemically synthesized
atgggggaagttcagtttttga

SEQ ID NO: 922178 - DNA, 22 bp, Artificial Sequence
  chemically synthesized
tcactcattccagattcaaaaa

SEQ ID NO: 922179 - DNA, 22 bp, Artificial Sequence
  chemically synthesized
tgtcactcattccagattcaaa

SEQ ID NO: 922180 - DNA, 22 bp, Artificial Sequence
  chemically synthesized
taattctgtcactcattccaga

SEQ ID NO: 922181 - DNA, 22 bp, Artificial Sequence
  chemically synthesized
ataattctgtcactcattccag

SEQ ID NO: 922182 - DNA, 22 bp, Artificial Sequence
  chemically synthesized
agtttttgaatctggaatgagt

SEQ ID NO: 922183 - DNA, 22 bp, Artificial Sequence
  chemically synthesized
ttgaatctggaatgagtgacag

SEQ ID NO: 922184 - DNA, 22 bp, Artificial Sequence
  chemically synthesized
tgaatctggaatgagtgacaga

SEQ ID NO: 922185 - DNA, 22 bp, Artificial Sequence
  chemically synthesized
gaatctggaatgagtgacagaa

SEQ ID NO: 922186 - DNA, 22 bp, Artificial Sequence
  chemically synthesized
aatctggaatgagtgacagaat

SEQ ID NO: 922187 - DNA, 22 bp, Artificial Sequence
  chemically synthesized
gatagtgccttataattctgtc

SEQ ID NO: 922188 - DNA, 22 bp, Artificial Sequence
  chemically synthesized
tagatagtgccttataattctg

SEQ ID NO: 922189 - DNA, 22 bp, Artificial Sequence
  chemically synthesized
gaatgagtgacagaattataag

SEQ ID NO: 922190 - DNA, 22 bp, Artificial Sequence
  chemically synthesized
gaaagaattctagatagtgcct

SEQ ID NO: 922191 - DNA, 22 bp, Artificial Sequence
  chemically synthesized
ctggaaagaattctagatagtg

SEQ ID NO: 922192 - DNA, 22 bp, Artificial Sequence
  chemically synthesized
ctactggaaagaattctagata

SEQ ID NO: 922193 - DNA, 22 bp, Artificial Sequence
  chemically synthesized
taaggcactatctagaattctt

SEQ ID NO: 922194 - DNA, 22 bp, Artificial Sequence
  chemically synthesized
tctagaattctttccagtagca

SEQ ID NO: 922195 - DNA, 22 bp, Artificial Sequence
  chemically synthesized
ggtgaagaatgtcattgctact

SEQ ID NO: 922196 - DNA, 22 bp, Artificial Sequence
  chemically synthesized
gaattctttccagtagcaatga

SEQ ID NO: 922197 - DNA, 22 bp, Artificial Sequence
  chemically synthesized
tttccagtagcaatgacattct

SEQ ID NO: 922198 - DNA, 22 bp, Artificial Sequence
  chemically synthesized
tccagtagcaatgacattcttc

SEQ ID NO: 922199 - DNA, 22 bp, Artificial Sequence
  chemically synthesized
cagacactgggtgaagaatgtc

SEQ ID NO: 922200 - DNA, 22 bp, Artificial Sequence
  chemically synthesized
ccagtagcaatgacattcttca

SEQ ID NO: 922201 - DNA, 22 bp, Artificial Sequence
  chemically synthesized
cagtagcaatgacattcttcac

SEQ ID NO: 922202 - DNA, 22 bp, Artificial Sequence
  chemically synthesized
ccactgcagacactgggtgaag

SEQ ID NO: 922203 - DNA, 22 bp, Artificial Sequence
  chemically synthesized
taccactgcagacactgggtga

SEQ ID NO: 922204 - DNA, 22 bp, Artificial Sequence
  chemically synthesized
ttcacccagtgtctgcagtggt

SEQ ID NO: 922205 - DNA, 22 bp, Artificial Sequence
  chemically synthesized
cacccagtgtctgcagtggtag

SEQ ID NO: 922206 - DNA, 22 bp, Artificial Sequence
  chemically synthesized
ccatgcaccactctaccactgc

SEQ ID NO: 922207 - DNA, 22 bp, Artificial Sequence
  chemically synthesized
acccagtgtctgcagtggtaga

SEQ ID NO: 922208 - DNA, 22 bp, Artificial Sequence
  chemically synthesized
cagtggtagagtggtgcatggc

SEQ ID NO: 922209 - DNA, 22 bp, Artificial Sequence
  chemically synthesized
gatgtaaacgttgccatgcacc

SEQ ID NO: 922210 - DNA, 22 bp, Artificial Sequence
  chemically synthesized
gcccccatacactagatgtaaa

SEQ ID NO: 922211 - DNA, 22 bp, Artificial Sequence
  chemically synthesized
acatctagtgtatgggggccag

SEQ ID NO: 922212 - DNA, 22 bp, Artificial Sequence
  chemically synthesized
catctagtgtatgggggccaga

SEQ ID NO: 922213 - DNA, 22 bp, Artificial Sequence
  chemically synthesized
gtgtatgggggccagacgtcgt

SEQ ID NO: 922214 - DNA, 22 bp, Artificial Sequence
  chemically synthesized
caggcatgtgccacgacgtctg

SEQ ID NO: 922215 - DNA, 22 bp, Artificial Sequence
  chemically synthesized
ggattacaggcatgtgccacga

SEQ ID NO: 922216 - DNA, 22 bp, Artificial Sequence
  chemically synthesized
ccacagtgctgggattacaggc

SEQ ID NO: 922217 - DNA, 22 bp, Artificial Sequence
  chemically synthesized
gcctcccacagtgctgggatta

SEQ ID NO: 922218 - DNA, 22 bp, Artificial Sequence
  chemically synthesized
agcctcccacagtgctgggatt

SEQ ID NO: 922219 - DNA, 22 bp, Artificial Sequence
  chemically synthesized
atcttagcctcccacagtgctg

SEQ ID NO: 922220 - DNA, 22 bp, Artificial Sequence
  chemically synthesized
taatcccagcactgtgggaggc

SEQ ID NO: 922221 - DNA, 22 bp, Artificial Sequence
  chemically synthesized
aagcgatccactcatcttagcc

SEQ ID NO: 922222 - DNA, 22 bp, Artificial Sequence
  chemically synthesized
gactcaagcgatccactcatct

SEQ ID NO: 922223 - DNA, 22 bp, Artificial Sequence
  chemically synthesized
ggactcaagcgatccactcatc

SEQ ID NO: 922224 - DNA, 22 bp, Artificial Sequence
  chemically synthesized
tgggaggctaagatgagtggat

SEQ ID NO: 922225 - DNA, 22 bp, Artificial Sequence
  chemically synthesized
ttggactcaagcgatccactca

SEQ ID NO: 922226 - DNA, 22 bp, Artificial Sequence
  chemically synthesized
gaactcttggactcaagcgatc

SEQ ID NO: 922227 - DNA, 22 bp, Artificial Sequence
  chemically synthesized
agatgagtggatcgcttgagtc

SEQ ID NO: 922228 - DNA, 22 bp, Artificial Sequence
  chemically synthesized
gatctcgaactcttggactcaa

SEQ ID NO: 922229 - DNA, 22 bp, Artificial Sequence
  chemically synthesized
gattggatctcgaactcttgga

SEQ ID NO: 922230 - DNA, 22 bp, Artificial Sequence
  chemically synthesized
gagtccaagagttcgagatcca

SEQ ID NO: 922231 - DNA, 22 bp, Artificial Sequence
  chemically synthesized
agtccaagagttcgagatccaa

SEQ ID NO: 922232 - DNA, 22 bp, Artificial Sequence
  chemically synthesized
tagtccaaatcataccctagat

SEQ ID NO: 922233 - DNA, 22 bp, Artificial Sequence
  chemically synthesized
gagatccaatctagggtatgat

SEQ ID NO: 922234 - DNA, 22 bp, Artificial Sequence
  chemically synthesized
caagaactatagtccaaatcat

SEQ ID NO: 922235 - DNA, 22 bp, Artificial Sequence
  chemically synthesized
agctccaagaactatagtccaa

SEQ ID NO: 922236 - DNA, 22 bp, Artificial Sequence
  chemically synthesized
gggtatgatttggactatagtt

SEQ ID NO: 922237 - DNA, 22 bp, Artificial Sequence
  chemically synthesized
aaaaaagaggctcagctccaag

SEQ ID NO: 922238 - DNA, 22 bp, Artificial Sequence
  chemically synthesized
ggactatagttcttggagctga

SEQ ID NO: 922239 - DNA, 22 bp, Artificial Sequence
  chemically synthesized
gactatagttcttggagctgag

SEQ ID NO: 922240 - DNA, 22 bp, Artificial Sequence
  chemically synthesized
tagttcttggagctgagcctct

SEQ ID NO: 922241 - DNA, 22 bp, Artificial Sequence
  chemically synthesized
ttggagctgagcctcttttttg

SEQ ID NO: 922242 - DNA, 22 bp, Artificial Sequence
  chemically synthesized
ggagctgagcctcttttttgag

SEQ ID NO: 922243 - DNA, 22 bp, Artificial Sequence
  chemically synthesized
gagctgagcctcttttttgagt

SEQ ID NO: 922244 - DNA, 22 bp, Artificial Sequence
  chemically synthesized
aaaatgggcagaactcaaaaaa

SEQ ID NO: 922245 - DNA, 22 bp, Artificial Sequence
  chemically synthesized
agcctcttttttgagttctgcc

SEQ ID NO: 922246 - DNA, 22 bp, Artificial Sequence
  chemically synthesized
ttttttgagttctgcccatttt

SEQ ID NO: 922247 - DNA, 22 bp, Artificial Sequence
  chemically synthesized
ttttgagttctgcccattttga

SEQ ID NO: 922248 - DNA, 22 bp, Artificial Sequence
  chemically synthesized
tttgagttctgcccattttgag

SEQ ID NO: 922249 - DNA, 22 bp, Artificial Sequence
  chemically synthesized
ttgagttctgcccattttgagc

SEQ ID NO: 922250 - DNA, 22 bp, Artificial Sequence
  chemically synthesized
tgagttctgcccattttgagct

SEQ ID NO: 922251 - DNA, 22 bp, Artificial Sequence
  chemically synthesized
gagttctgcccattttgagctg

SEQ ID NO: 922252 - DNA, 22 bp, Artificial Sequence
  chemically synthesized
agttctgcccattttgagctgg

SEQ ID NO: 922253 - DNA, 22 bp, Artificial Sequence
  chemically synthesized
tgcccattttgagctggttttc

SEQ ID NO: 922254 - DNA, 22 bp, Artificial Sequence
  chemically synthesized
aacaaagggatagaaaaccagc

SEQ ID NO: 922255 - DNA, 22 bp, Artificial Sequence
  chemically synthesized
cccattttgagctggttttcta

SEQ ID NO: 922256 - DNA, 22 bp, Artificial Sequence
  chemically synthesized
ctaaacaaagggatagaaaacc

SEQ ID NO: 922257 - DNA, 22 bp, Artificial Sequence
  chemically synthesized
tgagctggttttctatcccttt

SEQ ID NO: 922258 - DNA, 22 bp, Artificial Sequence
  chemically synthesized
ccattcctaaacaaagggatag

SEQ ID NO: 922259 - DNA, 22 bp, Artificial Sequence
  chemically synthesized
gagctggttttctatccctttg

SEQ ID NO: 922260 - DNA, 22 bp, Artificial Sequence
  chemically synthesized
agctggttttctatccctttgt

SEQ ID NO: 922261 - DNA, 22 bp, Artificial Sequence
  chemically synthesized
ttcccattcctaaacaaaggga

SEQ ID NO: 922262 - DNA, 22 bp, Artificial Sequence
  chemically synthesized
gttttctatccctttgtttagg

SEQ ID NO: 922263 - DNA, 22 bp, Artificial Sequence
  chemically synthesized
tctatccctttgtttaggaatg

SEQ ID NO: 922264 - DNA, 22 bp, Artificial Sequence
  chemically synthesized
ctatccctttgtttaggaatgg

SEQ ID NO: 922265 - DNA, 22 bp, Artificial Sequence
  chemically synthesized
tatccctttgtttaggaatggg

SEQ ID NO: 922266 - DNA, 22 bp, Artificial Sequence
  chemically synthesized
tccctttgtttaggaatgggaa

SEQ ID NO: 922267 - DNA, 22 bp, Artificial Sequence
  chemically synthesized
tgtttaggaatgggaacaggtc

SEQ ID NO: 922268 - DNA, 22 bp, Artificial Sequence
  chemically synthesized
gtttaggaatgggaacaggtct

SEQ ID NO: 922269 - DNA, 22 bp, Artificial Sequence
  chemically synthesized
ggagaaagatacagacctgttc

SEQ ID NO: 922270 - DNA, 22 bp, Artificial Sequence
  chemically synthesized
tttaggaatgggaacaggtctg

SEQ ID NO: 922271 - DNA, 22 bp, Artificial Sequence
  chemically synthesized
aggagaaagatacagacctgtt

SEQ ID NO: 922272 - DNA, 22 bp, Artificial Sequence
  chemically synthesized
taggagaaagatacagacctgt

SEQ ID NO: 922273 - DNA, 22 bp, Artificial Sequence
  chemically synthesized
aggaatgggaacaggtctgtat

SEQ ID NO: 922274 - DNA, 22 bp, Artificial Sequence
  chemically synthesized
ggaatgggaacaggtctgtatc

SEQ ID NO: 922275 - DNA, 22 bp, Artificial Sequence
  chemically synthesized
atagaagcggaaacggacttta

SEQ ID NO: 922276 - DNA, 22 bp, Artificial Sequence
  chemically synthesized
tatctttctcctaaagtccgtt

SEQ ID NO: 922277 - DNA, 22 bp, Artificial Sequence
  chemically synthesized
ttgatagaagcggaaacggact

SEQ ID NO: 922278 - DNA, 22 bp, Artificial Sequence
  chemically synthesized
gttgatagaagcggaaacggac

SEQ ID NO: 922279 - DNA, 22 bp, Artificial Sequence
  chemically synthesized
tgttgatagaagcggaaacgga

SEQ ID NO: 922280 - DNA, 22 bp, Artificial Sequence
  chemically synthesized
ttgttgatagaagcggaaacgg

SEQ ID NO: 922281 - DNA, 22 bp, Artificial Sequence
  chemically synthesized
tctcctaaagtccgtttccgct

SEQ ID NO: 922282 - DNA, 22 bp, Artificial Sequence
  chemically synthesized
ctcctaaagtccgtttccgctt

SEQ ID NO: 922283 - DNA, 22 bp, Artificial Sequence
  chemically synthesized
tcctaaagtccgtttccgcttc

SEQ ID NO: 922284 - DNA, 22 bp, Artificial Sequence
  chemically synthesized
ctaaagtccgtttccgcttcta

SEQ ID NO: 922285 - DNA, 22 bp, Artificial Sequence
  chemically synthesized
aagtccgtttccgcttctatca

SEQ ID NO: 922286 - DNA, 22 bp, Artificial Sequence
  chemically synthesized
ccgcttctatcaacaaaaactg

SEQ ID NO: 922287 - DNA, 22 bp, Artificial Sequence
  chemically synthesized
cgcttctatcaacaaaaactgg

SEQ ID NO: 922288 - DNA, 22 bp, Artificial Sequence
  chemically synthesized
tgaataacagaacccagttttt

SEQ ID NO: 922289 - DNA, 22 bp, Artificial Sequence
  chemically synthesized
ctatcaacaaaaactgggttct

SEQ ID NO: 922290 - DNA, 22 bp, Artificial Sequence
  chemically synthesized
tatcaacaaaaactgggttctg

SEQ ID NO: 922291 - DNA, 22 bp, Artificial Sequence
  chemically synthesized
tcaacaaaaactgggttctgtt

SEQ ID NO: 922292 - DNA, 22 bp, Artificial Sequence
  chemically synthesized
atagctgtgaataacagaaccc

SEQ ID NO: 922293 - DNA, 22 bp, Artificial Sequence
  chemically synthesized
tcagagttcatagctgtgaata

SEQ ID NO: 922294 - DNA, 22 bp, Artificial Sequence
  chemically synthesized
gtcagagttcatagctgtgaat

SEQ ID NO: 922295 - DNA, 22 bp, Artificial Sequence
  chemically synthesized
ggttctgttattcacagctatg

SEQ ID NO: 922296 - DNA, 22 bp, Artificial Sequence
  chemically synthesized
tacttgtcagagttcatagctg

SEQ ID NO: 922297 - DNA, 22 bp, Artificial Sequence
  chemically synthesized
tgttattcacagctatgaactc

SEQ ID NO: 922298 - DNA, 22 bp, Artificial Sequence
  chemically synthesized
ttattcacagctatgaactctg

SEQ ID NO: 922299 - DNA, 22 bp, Artificial Sequence
  chemically synthesized
cactgtacttgtcagagttcat

SEQ ID NO: 922300 - DNA, 22 bp, Artificial Sequence
  chemically synthesized
ttcacagctatgaactctgaca

SEQ ID NO: 922301 - DNA, 22 bp, Artificial Sequence
  chemically synthesized
attccactgtacttgtcagagt

SEQ ID NO: 922302 - DNA, 22 bp, Artificial Sequence
  chemically synthesized
acagctatgaactctgacaagt

SEQ ID NO: 922303 - DNA, 22 bp, Artificial Sequence
  chemically synthesized
tgaactctgacaagtacagtgg

SEQ ID NO: 922304 - DNA, 22 bp, Artificial Sequence
  chemically synthesized
caaatgcattcattccactgta

SEQ ID NO: 922305 - DNA, 22 bp, Artificial Sequence
  chemically synthesized
ccaaatgcattcattccactgt

SEQ ID NO: 922306 - DNA, 22 bp, Artificial Sequence
  chemically synthesized
tccaaatgcattcattccactg

SEQ ID NO: 922307 - DNA, 22 bp, Artificial Sequence
  chemically synthesized
tgacaagtacagtggaatgaat

SEQ ID NO: 922308 - DNA, 22 bp, Artificial Sequence
  chemically synthesized
ctttccaaatgcattcattcca

SEQ ID NO: 922309 - DNA, 22 bp, Artificial Sequence
  chemically synthesized
acaagtacagtggaatgaatgc

SEQ ID NO: 922310 - DNA, 22 bp, Artificial Sequence
  chemically synthesized
agacattcctttccaaatgcat

SEQ ID NO: 922311 - DNA, 22 bp, Artificial Sequence
  chemically synthesized
caatataaatatattcagacat

SEQ ID NO: 922312 - DNA, 22 bp, Artificial Sequence
  chemically synthesized
ggaaaggaatgtctgaatatat

SEQ ID NO: 922313 - DNA, 22 bp, Artificial Sequence
  chemically synthesized
gaaaggaatgtctgaatatatt

SEQ ID NO: 922314 - DNA, 22 bp, Artificial Sequence
  chemically synthesized
gattacaatataaatatattca

SEQ ID NO: 922315 - DNA, 22 bp, Artificial Sequence
  chemically synthesized
ctagattacaatataaatatat

SEQ ID NO: 922316 - DNA, 22 bp, Artificial Sequence
  chemically synthesized
gctcctagattacaatataaat

SEQ ID NO: 922317 - DNA, 22 bp, Artificial Sequence
  chemically synthesized
agctcctagattacaatataaa

SEQ ID NO: 922318 - DNA, 22 bp, Artificial Sequence
  chemically synthesized
tagctcctagattacaatataa

SEQ ID NO: 922319 - DNA, 22 bp, Artificial Sequence
  chemically synthesized
ttagctcctagattacaatata

SEQ ID NO: 922320 - DNA, 22 bp, Artificial Sequence
  chemically synthesized
aatatatttatattgtaatcta

SEQ ID NO: 922321 - DNA, 22 bp, Artificial Sequence
  chemically synthesized
atattgtaatctaggagctaaa

SEQ ID NO: 922322 - DNA, 22 bp, Artificial Sequence
  chemically synthesized
tattgtaatctaggagctaaaa

SEQ ID NO: 922323 - DNA, 22 bp, Artificial Sequence
  chemically synthesized
atcaggtgaatgtttttagctc

SEQ ID NO: 922324 - DNA, 22 bp, Artificial Sequence
  chemically synthesized
taatctaggagctaaaaacatt

SEQ ID NO: 922325 - DNA, 22 bp, Artificial Sequence
  chemically synthesized
tccctgatcaggtgaatgtttt

SEQ ID NO: 922326 - DNA, 22 bp, Artificial Sequence
  chemically synthesized
actatccctgatcaggtgaatg

SEQ ID NO: 922327 - DNA, 22 bp, Artificial Sequence
  chemically synthesized
ggagctaaaaacattcacctga

SEQ ID NO: 922328 - DNA, 22 bp, Artificial Sequence
  chemically synthesized
cctcactatccctgatcaggtg

SEQ ID NO: 922329 - DNA, 22 bp, Artificial Sequence
  chemically synthesized
ctgcctcactatccctgatcag

SEQ ID NO: 922330 - DNA, 22 bp, Artificial Sequence
  chemically synthesized
aaaacattcacctgatcaggga

SEQ ID NO: 922331 - DNA, 22 bp, Artificial Sequence
  chemically synthesized
tgctgcctcactatccctgatc

SEQ ID NO: 922332 - DNA, 22 bp, Artificial Sequence
  chemically synthesized
ctgctgcctcactatccctgat

SEQ ID NO: 922333 - DNA, 22 bp, Artificial Sequence
  chemically synthesized
tctgctgcctcactatccctga

SEQ ID NO: 922334 - DNA, 22 bp, Artificial Sequence
  chemically synthesized
ttctgctgcctcactatccctg

SEQ ID NO: 922335 - DNA, 22 bp, Artificial Sequence
  chemically synthesized
tttctgctgcctcactatccct

SEQ ID NO: 922336 - DNA, 22 bp, Artificial Sequence
  chemically synthesized
acctgatcagggatagtgaggc

SEQ ID NO: 922337 - DNA, 22 bp, Artificial Sequence
  chemically synthesized
ccctttttctgctgcctcacta

SEQ ID NO: 922338 - DNA, 22 bp, Artificial Sequence
  chemically synthesized
accctttttctgctgcctcact

SEQ ID NO: 922339 - DNA, 22 bp, Artificial Sequence
  chemically synthesized
taccctttttctgctgcctcac

SEQ ID NO: 922340 - DNA, 22 bp, Artificial Sequence
  chemically synthesized
atcagggatagtgaggcagcag

SEQ ID NO: 922341 - DNA, 22 bp, Artificial Sequence
  chemically synthesized
aatgcacacaaacacaagcata

SEQ ID NO: 922342 - DNA, 22 bp, Artificial Sequence
  chemically synthesized
gaatgcacacaaacacaagcat

SEQ ID NO: 922343 - DNA, 22 bp, Artificial Sequence
  chemically synthesized
ttgaatgcacacaaacacaagc

SEQ ID NO: 922344 - DNA, 22 bp, Artificial Sequence
  chemically synthesized
tctcttgaatgcacacaaacac

SEQ ID NO: 922345 - DNA, 22 bp, Artificial Sequence
  chemically synthesized
tgtctcttgaatgcacacaaac

SEQ ID NO: 922346 - DNA, 22 bp, Artificial Sequence
  chemically synthesized
ttctgtctcttgaatgcacaca

SEQ ID NO: 922347 - DNA, 22 bp, Artificial Sequence
  chemically synthesized
attattctgtctcttgaatgca

SEQ ID NO: 922348 - DNA, 22 bp, Artificial Sequence
  chemically synthesized
gtgtttgtgtgcattcaagaga

SEQ ID NO: 922349 - DNA, 22 bp, Artificial Sequence
  chemically synthesized
tgtttgtgtgcattcaagagac

SEQ ID NO: 922350 - DNA, 22 bp, Artificial Sequence
  chemically synthesized
gtgtgcattcaagagacagaat

SEQ ID NO: 922351 - DNA, 22 bp, Artificial Sequence
  chemically synthesized
ccccggttaattattctgtctc

SEQ ID NO: 922352 - DNA, 22 bp, Artificial Sequence
  chemically synthesized
tgtgcattcaagagacagaata

SEQ ID NO: 922353 - DNA, 22 bp, Artificial Sequence
  chemically synthesized
gccccggttaattattctgtct

SEQ ID NO: 922354 - DNA, 22 bp, Artificial Sequence
  chemically synthesized
aagagacagaataattaaccgg

SEQ ID NO: 922355 - DNA, 22 bp, Artificial Sequence
  chemically synthesized
agaggaatcttgccccggttaa

SEQ ID NO: 922356 - DNA, 22 bp, Artificial Sequence
  chemically synthesized
cagaggaatcttgccccggtta

SEQ ID NO: 922357 - DNA, 22 bp, Artificial Sequence
  chemically synthesized
atttcagaggaatcttgccccg

SEQ ID NO: 922358 - DNA, 22 bp, Artificial Sequence
  chemically synthesized
tcatttcagaggaatcttgccc

SEQ ID NO: 922359 - DNA, 22 bp, Artificial Sequence
  chemically synthesized
tctctcatttcagaggaatctt

SEQ ID NO: 922360 - DNA, 22 bp, Artificial Sequence
  chemically synthesized
atctctcatttcagaggaatct

SEQ ID NO: 922361 - DNA, 22 bp, Artificial Sequence
  chemically synthesized
accggggcaagattcctctgaa

SEQ ID NO: 922362 - DNA, 22 bp, Artificial Sequence
  chemically synthesized
agcagaaagccttatctctcat

SEQ ID NO: 922363 - DNA, 22 bp, Artificial Sequence
  chemically synthesized
ctctgaaatgagagataaggct

SEQ ID NO: 922364 - DNA, 22 bp, Artificial Sequence
  chemically synthesized
tattcagcagaaagccttatct

SEQ ID NO: 922365 - DNA, 22 bp, Artificial Sequence
  chemically synthesized
atattcagcagaaagccttatc

SEQ ID NO: 922366 - DNA, 22 bp, Artificial Sequence
  chemically synthesized
tgaaatgagagataaggctttc

SEQ ID NO: 922367 - DNA, 22 bp, Artificial Sequence
  chemically synthesized
aaatgagagataaggctttctg

SEQ ID NO: 922368 - DNA, 22 bp, Artificial Sequence
  chemically synthesized
tctgctgaatataaggattgtt

SEQ ID NO: 922369 - DNA, 22 bp, Artificial Sequence
  chemically synthesized
ctgctgaatataaggattgtta

SEQ ID NO: 922370 - DNA, 22 bp, Artificial Sequence
  chemically synthesized
tgctgaatataaggattgttat

SEQ ID NO: 922371 - DNA, 22 bp, Artificial Sequence
  chemically synthesized
tgatggtgaatgtataacaatc

SEQ ID NO: 922372 - DNA, 22 bp, Artificial Sequence
  chemically synthesized
ctgaatataaggattgttatac

SEQ ID NO: 922373 - DNA, 22 bp, Artificial Sequence
  chemically synthesized
aatataaggattgttatacatt

SEQ ID NO: 922374 - DNA, 22 bp, Artificial Sequence
  chemically synthesized
ccattatgatggtgaatgtata

SEQ ID NO: 922375 - DNA, 22 bp, Artificial Sequence
  chemically synthesized
accattatgatggtgaatgtat

SEQ ID NO: 922376 - DNA, 22 bp, Artificial Sequence
  chemically synthesized
tcatttaccattatgatggtga

SEQ ID NO: 922377 - DNA, 22 bp, Artificial Sequence
  chemically synthesized
atcatttaccattatgatggtg

SEQ ID NO: 922378 - DNA, 22 bp, Artificial Sequence
  chemically synthesized
ttatacattcaccatcataatg

SEQ ID NO: 922379 - DNA, 22 bp, Artificial Sequence
  chemically synthesized
tacattcaccatcataatggta

SEQ ID NO: 922380 - DNA, 22 bp, Artificial Sequence
  chemically synthesized
acaatttatcatttaccattat

SEQ ID NO: 922381 - DNA, 22 bp, Artificial Sequence
  chemically synthesized
accatcataatggtaaatgata

SEQ ID NO: 922382 - DNA, 22 bp, Artificial Sequence
  chemically synthesized
ccaatctaacaatttatcattt

SEQ ID NO: 922383 - DNA, 22 bp, Artificial Sequence
  chemically synthesized
tgtaagctgccaatctaacaat

SEQ ID NO: 922384 - DNA, 22 bp, Artificial Sequence
  chemically synthesized
gtgtaagctgccaatctaacaa

SEQ ID NO: 922385 - DNA, 22 bp, Artificial Sequence
  chemically synthesized
tatttgtgtaagctgccaatct

SEQ ID NO: 922386 - DNA, 22 bp, Artificial Sequence
  chemically synthesized
ttagattggcagcttacacaaa

SEQ ID NO: 922387 - DNA, 22 bp, Artificial Sequence
  chemically synthesized
gattggcagcttacacaaatat

SEQ ID NO: 922388 - DNA, 22 bp, Artificial Sequence
  chemically synthesized
taaaatgaaagtactatatttg

SEQ ID NO: 922389 - DNA, 22 bp, Artificial Sequence
  chemically synthesized
gtaaaatgaaagtactatattt

SEQ ID NO: 922390 - DNA, 22 bp, Artificial Sequence
  chemically synthesized
gcagcttacacaaatatagtac

SEQ ID NO: 922391 - DNA, 22 bp, Artificial Sequence
  chemically synthesized
acacaaatatagtactttcatt

SEQ ID NO: 922392 - DNA, 22 bp, Artificial Sequence
  chemically synthesized
cacaaatatagtactttcattt

SEQ ID NO: 922393 - DNA, 22 bp, Artificial Sequence
  chemically synthesized
aaaatcgtttgtaaaatgaaag

SEQ ID NO: 922394 - DNA, 22 bp, Artificial Sequence
  chemically synthesized
aaaaatcgtttgtaaaatgaaa

SEQ ID NO: 922395 - DNA, 22 bp, Artificial Sequence
  chemically synthesized
taaaaatcgtttgtaaaatgaa

SEQ ID NO: 922396 - DNA, 22 bp, Artificial Sequence
  chemically synthesized
ttaaaaatcgtttgtaaaatga

SEQ ID NO: 922397 - DNA, 22 bp, Artificial Sequence
  chemically synthesized
tcattttacaaacgatttttaa

SEQ ID NO: 922398 - DNA, 22 bp, Artificial Sequence
  chemically synthesized
tgataaatgtttttaaaaatcg

SEQ ID NO: 922399 - DNA, 22 bp, Artificial Sequence
  chemically synthesized
cattttacaaacgatttttaaa

SEQ ID NO: 922400 - DNA, 22 bp, Artificial Sequence
  chemically synthesized
attttacaaacgatttttaaaa

SEQ ID NO: 922401 - DNA, 22 bp, Artificial Sequence
  chemically synthesized
ctatgataaatgtttttaaaaa

SEQ ID NO: 922402 - DNA, 22 bp, Artificial Sequence
  chemically synthesized
tactatgataaatgtttttaaa

SEQ ID NO: 922403 - DNA, 22 bp, Artificial Sequence
  chemically synthesized
tacaaacgatttttaaaaacat

SEQ ID NO: 922404 - DNA, 22 bp, Artificial Sequence
  chemically synthesized
acaaacgatttttaaaaacatt

SEQ ID NO: 922405 - DNA, 22 bp, Artificial Sequence
  chemically synthesized
tctactatgataaatgttttta

SEQ ID NO: 922406 - DNA, 22 bp, Artificial Sequence
  chemically synthesized
caaacgatttttaaaaacattt

SEQ ID NO: 922407 - DNA, 22 bp, Artificial Sequence
  chemically synthesized
tctctactatgataaatgtttt

SEQ ID NO: 922408 - DNA, 22 bp, Artificial Sequence
  chemically synthesized
tctctctctactatgataaatg

SEQ ID NO: 922409 - DNA, 22 bp, Artificial Sequence
  chemically synthesized
atctctctctactatgataaat

SEQ ID NO: 922410 - DNA, 22 bp, Artificial Sequence
  chemically synthesized
tatctctctctactatgataaa

SEQ ID NO: 922411 - DNA, 22 bp, Artificial Sequence
  chemically synthesized
ttaaaaacatttatcatagtag

SEQ ID NO: 922412 - DNA, 22 bp, Artificial Sequence
  chemically synthesized
ttttatctctctctactatgat

SEQ ID NO: 922413 - DNA, 22 bp, Artificial Sequence
  chemically synthesized
taaaaacatttatcatagtaga

SEQ ID NO: 922414 - DNA, 22 bp, Artificial Sequence
  chemically synthesized
attttatctctctctactatga

SEQ ID NO: 922415 - DNA, 22 bp, Artificial Sequence
  chemically synthesized
aaaaacatttatcatagtagag

SEQ ID NO: 922416 - DNA, 22 bp, Artificial Sequence
  chemically synthesized
tattttatctctctctactatg

SEQ ID NO: 922417 - DNA, 22 bp, Artificial Sequence
  chemically synthesized
aaaacatttatcatagtagaga

SEQ ID NO: 922418 - DNA, 22 bp, Artificial Sequence
  chemically synthesized
aaatattttattttatctctct

SEQ ID NO: 922419 - DNA, 22 bp, Artificial Sequence
  chemically synthesized
atcatagtagagagagataaaa

SEQ ID NO: 922420 - DNA, 22 bp, Artificial Sequence
  chemically synthesized
tcatagtagagagagataaaat

SEQ ID NO: 922421 - DNA, 22 bp, Artificial Sequence
  chemically synthesized
aattaaaatattttattttatc

SEQ ID NO: 922422 - DNA, 22 bp, Artificial Sequence
  chemically synthesized
gaattaaaatattttattttat

SEQ ID NO: 922423 - DNA, 22 bp, Artificial Sequence
  chemically synthesized
atttgaattaaaatattttatt

SEQ ID NO: 922424 - DNA, 22 bp, Artificial Sequence
  chemically synthesized
caaaggttaatttgaattaaaa

SEQ ID NO: 922425 - DNA, 22 bp, Artificial Sequence
  chemically synthesized
tacaaaggttaatttgaattaa

SEQ ID NO: 922426 - DNA, 22 bp, Artificial Sequence
  chemically synthesized
ctacaaaggttaatttgaatta

SEQ ID NO: 922427 - DNA, 22 bp, Artificial Sequence
  chemically synthesized
tctacaaaggttaatttgaatt

SEQ ID NO: 922428 - DNA, 22 bp, Artificial Sequence
  chemically synthesized
ttctacaaaggttaatttgaat

SEQ ID NO: 922429 - DNA, 22 bp, Artificial Sequence
  chemically synthesized
tttctacaaaggttaatttgaa

SEQ ID NO: 922430 - DNA, 22 bp, Artificial Sequence
  chemically synthesized
taattcaaattaacctttgtag

SEQ ID NO: 922431 - DNA, 22 bp, Artificial Sequence
  chemically synthesized
aattcaaattaacctttgtaga

SEQ ID NO: 922432 - DNA, 22 bp, Artificial Sequence
  chemically synthesized
attcaaattaacctttgtagaa

SEQ ID NO: 922433 - DNA, 22 bp, Artificial Sequence
  chemically synthesized
taatgtgattttttctacaaag

SEQ ID NO: 922434 - DNA, 22 bp, Artificial Sequence
  chemically synthesized
ttataatgtgattttttctaca

SEQ ID NO: 922435 - DNA, 22 bp, Artificial Sequence
  chemically synthesized
aaattaacctttgtagaaaaaa

SEQ ID NO: 922436 - DNA, 22 bp, Artificial Sequence
  chemically synthesized
attataatgtgattttttctac

SEQ ID NO: 922437 - DNA, 22 bp, Artificial Sequence
  chemically synthesized
aatttattataatgtgattttt

SEQ ID NO: 922438 - DNA, 22 bp, Artificial Sequence
  chemically synthesized
acctttgtagaaaaaatcacat

SEQ ID NO: 922439 - DNA, 22 bp, Artificial Sequence
  chemically synthesized
tgtagaaaaaatcacattataa

SEQ ID NO: 922440 - DNA, 22 bp, Artificial Sequence
  chemically synthesized
gtagaaaaaatcacattataat

SEQ ID NO: 922441 - DNA, 22 bp, Artificial Sequence
  chemically synthesized
tagaaaaaatcacattataata

SEQ ID NO: 922442 - DNA, 22 bp, Artificial Sequence
  chemically synthesized
atataagtctaaatttattata

SEQ ID NO: 922443 - DNA, 22 bp, Artificial Sequence
  chemically synthesized
accattaatataagtctaaatt

SEQ ID NO: 922444 - DNA, 22 bp, Artificial Sequence
  chemically synthesized
gaccattaatataagtctaaat

SEQ ID NO: 922445 - DNA, 22 bp, Artificial Sequence
  chemically synthesized
taataaatttagacttatatta

SEQ ID NO: 922446 - DNA, 22 bp, Artificial Sequence
  chemically synthesized
tcatagtttgaccattaatata

SEQ ID NO: 922447 - DNA, 22 bp, Artificial Sequence
  chemically synthesized
agacttatattaatggtcaaac

SEQ ID NO: 922448 - DNA, 22 bp, Artificial Sequence
  chemically synthesized
tatgttgtcatagtttgaccat

SEQ ID NO: 922449 - DNA, 22 bp, Artificial Sequence
  chemically synthesized
gacttatattaatggtcaaact

SEQ ID NO: 922450 - DNA, 22 bp, Artificial Sequence
  chemically synthesized
attatatgttgtcatagtttga

SEQ ID NO: 922451 - DNA, 22 bp, Artificial Sequence
  chemically synthesized
atattaatggtcaaactatgac

SEQ ID NO: 922452 - DNA, 22 bp, Artificial Sequence
  chemically synthesized
tattaatggtcaaactatgaca

SEQ ID NO: 922453 - DNA, 22 bp, Artificial Sequence
  chemically synthesized
ctaattatatgttgtcatagtt

SEQ ID NO: 922454 - DNA, 22 bp, Artificial Sequence
  chemically synthesized
actaattatatgttgtcatagt

SEQ ID NO: 922455 - DNA, 22 bp, Artificial Sequence
  chemically synthesized
tactaattatatgttgtcatag

SEQ ID NO: 922456 - DNA, 22 bp, Artificial Sequence
  chemically synthesized
atggtcaaactatgacaacata

SEQ ID NO: 922457 - DNA, 22 bp, Artificial Sequence
  chemically synthesized
ttttactaattatatgttgtca

SEQ ID NO: 922458 - DNA, 22 bp, Artificial Sequence
  chemically synthesized
gttttactaattatatgttgtc

SEQ ID NO: 922459 - DNA, 22 bp, Artificial Sequence
  chemically synthesized
tgttttactaattatatgttgt

SEQ ID NO: 922460 - DNA, 22 bp, Artificial Sequence
  chemically synthesized
ttgttttactaattatatgttg

SEQ ID NO: 922461 - DNA, 22 bp, Artificial Sequence
  chemically synthesized
ttttgttttactaattatatgt

SEQ ID NO: 922462 - DNA, 22 bp, Artificial Sequence
  chemically synthesized
tcttttgttttactaattatat

SEQ ID NO: 922463 - DNA, 22 bp, Artificial Sequence
  chemically synthesized
tgacaacatataattagtaaaa

SEQ ID NO: 922464 - DNA, 22 bp, Artificial Sequence
  chemically synthesized
aaattctcttttgttttactaa

SEQ ID NO: 922465 - DNA, 22 bp, Artificial Sequence
  chemically synthesized
aaaattctcttttgttttacta

SEQ ID NO: 922466 - DNA, 22 bp, Artificial Sequence
  chemically synthesized
taaaattctcttttgttttact

SEQ ID NO: 922467 - DNA, 22 bp, Artificial Sequence
  chemically synthesized
cctttaaaattctcttttgttt

SEQ ID NO: 922468 - DNA, 22 bp, Artificial Sequence
  chemically synthesized
tcatgttccctttaaaattctc

SEQ ID NO: 922469 - DNA, 22 bp, Artificial Sequence
  chemically synthesized
gtaaaacaaaagagaattttaa

SEQ ID NO: 922470 - DNA, 22 bp, Artificial Sequence
  chemically synthesized
ttatcatgttccctttaaaatt

SEQ ID NO: 922471 - DNA, 22 bp, Artificial Sequence
  chemically synthesized
taaagggaacatgataatagac

SEQ ID NO: 922472 - DNA, 22 bp, Artificial Sequence
  chemically synthesized
aaagggaacatgataatagact

SEQ ID NO: 922473 - DNA, 22 bp, Artificial Sequence
  chemically synthesized
aagggaacatgataatagactt

SEQ ID NO: 922474 - DNA, 22 bp, Artificial Sequence
  chemically synthesized
gatatgtataataagtctatta

SEQ ID NO: 922475 - DNA, 22 bp, Artificial Sequence
  chemically synthesized
agatatgtataataagtctatt

SEQ ID NO: 922476 - DNA, 22 bp, Artificial Sequence
  chemically synthesized
atggatgtcttagatatgtata

SEQ ID NO: 922477 - DNA, 22 bp, Artificial Sequence
  chemically synthesized
atatagttaatggatgtcttag

SEQ ID NO: 922478 - DNA, 22 bp, Artificial Sequence
  chemically synthesized
attatacatatctaagacatcc

SEQ ID NO: 922479 - DNA, 22 bp, Artificial Sequence
  chemically synthesized
aatatagttaatggatgtctta

SEQ ID NO: 922480 - DNA, 22 bp, Artificial Sequence
  chemically synthesized
ttatacatatctaagacatcca

SEQ ID NO: 922481 - DNA, 22 bp, Artificial Sequence
  chemically synthesized
tacatatctaagacatccatta

SEQ ID NO: 922482 - DNA, 22 bp, Artificial Sequence
  chemically synthesized
gtttaatatagttaatggatgt

SEQ ID NO: 922483 - DNA, 22 bp, Artificial Sequence
  chemically synthesized
ggtttaatatagttaatggatg

SEQ ID NO: 922484 - DNA, 22 bp, Artificial Sequence
  chemically synthesized
ccttggtttaatatagttaatg

SEQ ID NO: 922485 - DNA, 22 bp, Artificial Sequence
  chemically synthesized
accttggtttaatatagttaat

SEQ ID NO: 922486 - DNA, 22 bp, Artificial Sequence
  chemically synthesized
cttaccttggtttaatatagtt

SEQ ID NO: 922487 - DNA, 22 bp, Artificial Sequence
  chemically synthesized
agacatccattaactatattaa

SEQ ID NO: 922488 - DNA, 22 bp, Artificial Sequence
  chemically synthesized
attccttaccttggtttaatat

SEQ ID NO: 922489 - DNA, 22 bp, Artificial Sequence
  chemically synthesized
ttgattccttaccttggtttaa

SEQ ID NO: 922490 - DNA, 22 bp, Artificial Sequence
  chemically synthesized
attgattccttaccttggttta

SEQ ID NO: 922491 - DNA, 22 bp, Artificial Sequence
  chemically synthesized
tattgattccttaccttggttt

SEQ ID NO: 922492 - DNA, 22 bp, Artificial Sequence
  chemically synthesized
actatattaaaccaaggtaagg

SEQ ID NO: 922493 - DNA, 22 bp, Artificial Sequence
  chemically synthesized
atcattttattgattccttacc

SEQ ID NO: 922494 - DNA, 22 bp, Artificial Sequence
  chemically synthesized
tattaaaccaaggtaaggaatc

SEQ ID NO: 922495 - DNA, 22 bp, Artificial Sequence
  chemically synthesized
aaccaaggtaaggaatcaataa

SEQ ID NO: 922496 - DNA, 22 bp, Artificial Sequence
  chemically synthesized
agagaaaaatgtgttgatcatt

SEQ ID NO: 922497 - DNA, 22 bp, Artificial Sequence
  chemically synthesized
caaaagaaaacccaaagtccta

SEQ ID NO: 922498 - DNA, 22 bp, Artificial Sequence
  chemically synthesized
acaaaagaaaacccaaagtcct

SEQ ID NO: 922499 - DNA, 22 bp, Artificial Sequence
  chemically synthesized
tttacaaaagaaaacccaaagt

SEQ ID NO: 922500 - DNA, 22 bp, Artificial Sequence
  chemically synthesized
gtttacaaaagaaaacccaaag

SEQ ID NO: 922501 - DNA, 22 bp, Artificial Sequence
  chemically synthesized
ttctcttaggactttgggtttt

SEQ ID NO: 922502 - DNA, 22 bp, Artificial Sequence
  chemically synthesized
tgtttacaaaagaaaacccaaa

SEQ ID NO: 922503 - DNA, 22 bp, Artificial Sequence
  chemically synthesized
tctcttaggactttgggttttc

SEQ ID NO: 922504 - DNA, 22 bp, Artificial Sequence
  chemically synthesized
ctcttaggactttgggttttct

SEQ ID NO: 922505 - DNA, 22 bp, Artificial Sequence
  chemically synthesized
tcttaggactttgggttttctt

SEQ ID NO: 922506 - DNA, 22 bp, Artificial Sequence
  chemically synthesized
cctttgtttacaaaagaaaacc

SEQ ID NO: 922507 - DNA, 22 bp, Artificial Sequence
  chemically synthesized
ttaggactttgggttttctttt

SEQ ID NO: 922508 - DNA, 22 bp, Artificial Sequence
  chemically synthesized
aggactttgggttttcttttgt

SEQ ID NO: 922509 - DNA, 22 bp, Artificial Sequence
  chemically synthesized
ggactttgggttttcttttgta

SEQ ID NO: 922510 - DNA, 22 bp, Artificial Sequence
  chemically synthesized
tgggttttcttttgtaaacaaa

SEQ ID NO: 922511 - DNA, 22 bp, Artificial Sequence
  chemically synthesized
gggttttcttttgtaaacaaag

SEQ ID NO: 922512 - DNA, 22 bp, Artificial Sequence
  chemically synthesized
ggttttcttttgtaaacaaagg

SEQ ID NO: 922513 - DNA, 22 bp, Artificial Sequence
  chemically synthesized
aggtgagtgtcctacctttgtt

SEQ ID NO: 922514 - DNA, 22 bp, Artificial Sequence
  chemically synthesized
tcttttgtaaacaaaggtagga

SEQ ID NO: 922515 - DNA, 22 bp, Artificial Sequence
  chemically synthesized
cttttgtaaacaaaggtaggac

SEQ ID NO: 922516 - DNA, 22 bp, Artificial Sequence
  chemically synthesized
ttttgtaaacaaaggtaggaca

SEQ ID NO: 922517 - DNA, 22 bp, Artificial Sequence
  chemically synthesized
tcctcaggtgagtgtcctacct

SEQ ID NO: 922518 - DNA, 22 bp, Artificial Sequence
  chemically synthesized
ttgtaaacaaaggtaggacact

SEQ ID NO: 922519 - DNA, 22 bp, Artificial Sequence
  chemically synthesized
tgtaaacaaaggtaggacactc

SEQ ID NO: 922520 - DNA, 22 bp, Artificial Sequence
  chemically synthesized
gtaaacaaaggtaggacactca

SEQ ID NO: 922521 - DNA, 22 bp, Artificial Sequence
  chemically synthesized
taaacaaaggtaggacactcac

SEQ ID NO: 922522 - DNA, 22 bp, Artificial Sequence
  chemically synthesized
caaaaaaggaatacactatcct

SEQ ID NO: 922523 - DNA, 22 bp, Artificial Sequence
  chemically synthesized
acctgaggatagtgtattcctt

SEQ ID NO: 922524 - DNA, 22 bp, Artificial Sequence
  chemically synthesized
aggatagtgtattccttttttg

SEQ ID NO: 922525 - DNA, 22 bp, Artificial Sequence
  chemically synthesized
gaatcacaaatcataacactcc

SEQ ID NO: 922526 - DNA, 22 bp, Artificial Sequence
  chemically synthesized
cttttttggagtgttatgattt

SEQ ID NO: 922527 - DNA, 22 bp, Artificial Sequence
  chemically synthesized
tgttagaatcacaaatcataac

SEQ ID NO: 922528 - DNA, 22 bp, Artificial Sequence
  chemically synthesized
atgttagaatcacaaatcataa

SEQ ID NO: 922529 - DNA, 22 bp, Artificial Sequence
  chemically synthesized
tatgttagaatcacaaatcata

SEQ ID NO: 922530 - DNA, 22 bp, Artificial Sequence
  chemically synthesized
ttttggagtgttatgatttgtg

SEQ ID NO: 922531 - DNA, 22 bp, Artificial Sequence
  chemically synthesized
ttatgttagaatcacaaatcat

SEQ ID NO: 922532 - DNA, 22 bp, Artificial Sequence
  chemically synthesized
tttggagtgttatgatttgtga

SEQ ID NO: 922533 - DNA, 22 bp, Artificial Sequence
  chemically synthesized
tttatgttagaatcacaaatca

SEQ ID NO: 922534 - DNA, 22 bp, Artificial Sequence
  chemically synthesized
ttggagtgttatgatttgtgat

SEQ ID NO: 922535 - DNA, 22 bp, Artificial Sequence
  chemically synthesized
tggagtgttatgatttgtgatt

SEQ ID NO: 922536 - DNA, 22 bp, Artificial Sequence
  chemically synthesized
tttttatgttagaatcacaaat

SEQ ID NO: 922537 - DNA, 22 bp, Artificial Sequence
  chemically synthesized
ggagtgttatgatttgtgattc

SEQ ID NO: 922538 - DNA, 22 bp, Artificial Sequence
  chemically synthesized
gagtgttatgatttgtgattct

SEQ ID NO: 922539 - DNA, 22 bp, Artificial Sequence
  chemically synthesized
caaagttctttttatgttagaa

SEQ ID NO: 922540 - DNA, 22 bp, Artificial Sequence
  chemically synthesized
acaaagttctttttatgttaga

SEQ ID NO: 922541 - DNA, 22 bp, Artificial Sequence
  chemically synthesized
tgatttgtgattctaacataaa

SEQ ID NO: 922542 - DNA, 22 bp, Artificial Sequence
  chemically synthesized
tttacaaagttctttttatgtt

SEQ ID NO: 922543 - DNA, 22 bp, Artificial Sequence
  chemically synthesized
atttacaaagttctttttatgt

SEQ ID NO: 922544 - DNA, 22 bp, Artificial Sequence
  chemically synthesized
gtgattctaacataaaaagaac

SEQ ID NO: 922545 - DNA, 22 bp, Artificial Sequence
  chemically synthesized
tgattctaacataaaaagaact

SEQ ID NO: 922546 - DNA, 22 bp, Artificial Sequence
  chemically synthesized
gaaacacttatttacaaagttc

SEQ ID NO: 922547 - DNA, 22 bp, Artificial Sequence
  chemically synthesized
taacataaaaagaactttgtaa

SEQ ID NO: 922548 - DNA, 22 bp, Artificial Sequence
  chemically synthesized
acataaaaagaactttgtaaat

SEQ ID NO: 922549 - DNA, 22 bp, Artificial Sequence
  chemically synthesized
taattagaaacacttatttaca

SEQ ID NO: 922550 - DNA, 22 bp, Artificial Sequence
  chemically synthesized
ataattagaaacacttatttac

SEQ ID NO: 922551 - DNA, 22 bp, Artificial Sequence
  chemically synthesized
tataattagaaacacttattta

SEQ ID NO: 922552 - DNA, 22 bp, Artificial Sequence
  chemically synthesized
tgtaaataagtgtttctaatta

SEQ ID NO: 922553 - DNA, 22 bp, Artificial Sequence
  chemically synthesized
agacacattttataattagaaa

SEQ ID NO: 922554 - DNA, 22 bp, Artificial Sequence
  chemically synthesized
gtaaataagtgtttctaattat

SEQ ID NO: 922555 - DNA, 22 bp, Artificial Sequence
  chemically synthesized
gagacacattttataattagaa

SEQ ID NO: 922556 - DNA, 22 bp, Artificial Sequence
  chemically synthesized
taaataagtgtttctaattata

SEQ ID NO: 922557 - DNA, 22 bp, Artificial Sequence
  chemically synthesized
tgagacacattttataattaga

SEQ ID NO: 922558 - DNA, 22 bp, Artificial Sequence
  chemically synthesized
tcctttgagacacattttataa

SEQ ID NO: 922559 - DNA, 22 bp, Artificial Sequence
  chemically synthesized
ctaattataaaatgtgtctcaa

SEQ ID NO: 922560 - DNA, 22 bp, Artificial Sequence
  chemically synthesized
aaagcctgtcctttgagacaca

SEQ ID NO: 922561 - DNA, 22 bp, Artificial Sequence
  chemically synthesized
taattataaaatgtgtctcaaa

SEQ ID NO: 922562 - DNA, 22 bp, Artificial Sequence
  chemically synthesized
attataaaatgtgtctcaaagg

SEQ ID NO: 922563 - DNA, 22 bp, Artificial Sequence
  chemically synthesized
ccctcaaagcctgtcctttgag

SEQ ID NO: 922564 - DNA, 22 bp, Artificial Sequence
  chemically synthesized
taaaatgtgtctcaaaggacag

SEQ ID NO: 922565 - DNA, 22 bp, Artificial Sequence
  chemically synthesized
tctaccctcaaagcctgtcctt

SEQ ID NO: 922566 - DNA, 22 bp, Artificial Sequence
  chemically synthesized
aattgtctaccctcaaagcctg

SEQ ID NO: 922567 - DNA, 22 bp, Artificial Sequence
  chemically synthesized
gaattgtctaccctcaaagcct

SEQ ID NO: 922568 - DNA, 22 bp, Artificial Sequence
  chemically synthesized
aaaggacaggctttgagggtag

SEQ ID NO: 922569 - DNA, 22 bp, Artificial Sequence
  chemically synthesized
aagaaacttgaattgtctaccc

SEQ ID NO: 922570 - DNA, 22 bp, Artificial Sequence
  chemically synthesized
ctgaagaaacttgaattgtcta

SEQ ID NO: 922571 - DNA, 22 bp, Artificial Sequence
  chemically synthesized
ttgctgaagaaacttgaattgt

SEQ ID NO: 922572 - DNA, 22 bp, Artificial Sequence
  chemically synthesized
gttgctgaagaaacttgaattg

SEQ ID NO: 922573 - DNA, 22 bp, Artificial Sequence
  chemically synthesized
tgagggtagacaattcaagttt

SEQ ID NO: 922574 - DNA, 22 bp, Artificial Sequence
  chemically synthesized
gagggtagacaattcaagtttc

SEQ ID NO: 922575 - DNA, 22 bp, Artificial Sequence
  chemically synthesized
cttgttgctgaagaaacttgaa

SEQ ID NO: 922576 - DNA, 22 bp, Artificial Sequence
  chemically synthesized
agggtagacaattcaagtttct

SEQ ID NO: 922577 - DNA, 22 bp, Artificial Sequence
  chemically synthesized
ccttgttgctgaagaaacttga

SEQ ID NO: 922578 - DNA, 22 bp, Artificial Sequence
  chemically synthesized
tccttgttgctgaagaaacttg

SEQ ID NO: 922579 - DNA, 22 bp, Artificial Sequence
  chemically synthesized
ttttccttgttgctgaagaaac

SEQ ID NO: 922580 - DNA, 22 bp, Artificial Sequence
  chemically synthesized
attttccttgttgctgaagaaa

SEQ ID NO: 922581 - DNA, 22 bp, Artificial Sequence
  chemically synthesized
catttattttccttgttgctga

SEQ ID NO: 922582 - DNA, 22 bp, Artificial Sequence
  chemically synthesized
tgcatttattttccttgttgct

SEQ ID NO: 922583 - DNA, 22 bp, Artificial Sequence
  chemically synthesized
aagtttcttcagcaacaaggaa

SEQ ID NO: 922584 - DNA, 22 bp, Artificial Sequence
  chemically synthesized
cttcagcaacaaggaaaataaa

SEQ ID NO: 922585 - DNA, 22 bp, Artificial Sequence
  chemically synthesized
ttcagcaacaaggaaaataaat

SEQ ID NO: 922586 - DNA, 22 bp, Artificial Sequence
  chemically synthesized
cagcaacaaggaaaataaatgc

SEQ ID NO: 922587 - DNA, 22 bp, Artificial Sequence
  chemically synthesized
agcaacaaggaaaataaatgca

SEQ ID NO: 922588 - DNA, 22 bp, Artificial Sequence
  chemically synthesized
aaaaaaaaaaaaaaaaaaaaaa

SEQ ID NO: 922589 - DNA, 22 bp, Artificial Sequence
  chemically synthesized
aaaaaaaaaaaaaaaaaaaaaa

SEQ ID NO: 922590 - DNA, 22 bp, Artificial Sequence
  chemically synthesized
taaaaaaaaaaaaaaaaaaaaa

SEQ ID NO: 922591 - DNA, 22 bp, Artificial Sequence
  chemically synthesized
ttaaaaaaaaaaaaaaaaaaaa

SEQ ID NO: 922592 - DNA, 22 bp, Artificial Sequence
  chemically synthesized
ggcctgtttttttttttttttt

SEQ ID NO: 922593 - DNA, 22 bp, Artificial Sequence
  chemically synthesized
gcctgttttttttttttttttt

SEQ ID NO: 922594 - DNA, 22 bp, Artificial Sequence
  chemically synthesized
tttttttttttttttttttttt

SEQ ID NO: 922595 - DNA, 22 bp, Artificial Sequence
  chemically synthesized
taccatttttaaaaaaaaaaaa

SEQ ID NO: 922596 - DNA, 22 bp, Artificial Sequence
  chemically synthesized
ttttttttttttttttttttta

SEQ ID NO: 922597 - DNA, 22 bp, Artificial Sequence
  chemically synthesized
ttttttttttttttttttttaa

SEQ ID NO: 922598 - DNA, 22 bp, Artificial Sequence
  chemically synthesized
tttttttttttttttttttaaa

SEQ ID NO: 922599 - DNA, 22 bp, Artificial Sequence
  chemically synthesized
ttttttttttttttttttaaaa

SEQ ID NO: 922600 - DNA, 22 bp, Artificial Sequence
  chemically synthesized
tttttttttttttttttaaaaa

SEQ ID NO: 922601 - DNA, 22 bp, Artificial Sequence
  chemically synthesized
ttttttttttttttttaaaaat

SEQ ID NO: 922602 - DNA, 22 bp, Artificial Sequence
  chemically synthesized
tttttttttttttttaaaaatg

SEQ ID NO: 922603 - DNA, 22 bp, Artificial Sequence
  chemically synthesized
ttttttttttttttaaaaatgg

SEQ ID NO: 922604 - DNA, 22 bp, Artificial Sequence
  chemically synthesized
tttttttttttttaaaaatggt

SEQ ID NO: 922605 - DNA, 22 bp, Artificial Sequence
  chemically synthesized
caccaagactgtaccattttta

SEQ ID NO: 922606 - DNA, 22 bp, Artificial Sequence
  chemically synthesized
ttttttttttttaaaaatggta

SEQ ID NO: 922607 - DNA, 22 bp, Artificial Sequence
  chemically synthesized
tttttttttttaaaaatggtac

SEQ ID NO: 922608 - DNA, 22 bp, Artificial Sequence
  chemically synthesized
ttttttttttaaaaatggtaca

SEQ ID NO: 922609 - DNA, 22 bp, Artificial Sequence
  chemically synthesized
tttttttttaaaaatggtacag

SEQ ID NO: 922610 - DNA, 22 bp, Artificial Sequence
  chemically synthesized
ttttttttaaaaatggtacagt

SEQ ID NO: 922611 - DNA, 22 bp, Artificial Sequence
  chemically synthesized
tttttttaaaaatggtacagtc

SEQ ID NO: 922612 - DNA, 22 bp, Artificial Sequence
  chemically synthesized
ttttttaaaaatggtacagtct

SEQ ID NO: 922613 - DNA, 22 bp, Artificial Sequence
  chemically synthesized
tttttaaaaatggtacagtctt

SEQ ID NO: 922614 - DNA, 22 bp, Artificial Sequence
  chemically synthesized
ttttaaaaatggtacagtcttg

SEQ ID NO: 922615 - DNA, 22 bp, Artificial Sequence
  chemically synthesized
tttaaaaatggtacagtcttgg

SEQ ID NO: 922616 - DNA, 22 bp, Artificial Sequence
  chemically synthesized
ttaaaaatggtacagtcttggt

SEQ ID NO: 922617 - DNA, 22 bp, Artificial Sequence
  chemically synthesized
taaaaatggtacagtcttggtg

SEQ ID NO: 922618 - DNA, 22 bp, Artificial Sequence
  chemically synthesized
aaaaatggtacagtcttggtgc

SEQ ID NO: 922619 - DNA, 22 bp, Artificial Sequence
  chemically synthesized
aaaatggtacagtcttggtgca

SEQ ID NO: 922620 - DNA, 22 bp, Artificial Sequence
  chemically synthesized
gacccaacagcagctgcaccaa

SEQ ID NO: 922621 - DNA, 22 bp, Artificial Sequence
  chemically synthesized
attggacccaacagcagctgca

SEQ ID NO: 922622 - DNA, 22 bp, Artificial Sequence
  chemically synthesized
ttgattggacccaacagcagct

SEQ ID NO: 922623 - DNA, 22 bp, Artificial Sequence
  chemically synthesized
tctgttgattggacccaacagc

SEQ ID NO: 922624 - DNA, 22 bp, Artificial Sequence
  chemically synthesized
ggtgcagctgctgttgggtcca

SEQ ID NO: 922625 - DNA, 22 bp, Artificial Sequence
  chemically synthesized
gtgcagctgctgttgggtccaa

SEQ ID NO: 922626 - DNA, 22 bp, Artificial Sequence
  chemically synthesized
aagtctatctgttgattggacc

SEQ ID NO: 922627 - DNA, 22 bp, Artificial Sequence
  chemically synthesized
aaagtctatctgttgattggac

SEQ ID NO: 922628 - DNA, 22 bp, Artificial Sequence
  chemically synthesized
ctgttgggtccaatcaacagat

SEQ ID NO: 922629 - DNA, 22 bp, Artificial Sequence
  chemically synthesized
catttaaagtctatctgttgat

SEQ ID NO: 922630 - DNA, 22 bp, Artificial Sequence
  chemically synthesized
ttgggtccaatcaacagataga

SEQ ID NO: 922631 - DNA, 22 bp, Artificial Sequence
  chemically synthesized
ttgcatttaaagtctatctgtt

SEQ ID NO: 922632 - DNA, 22 bp, Artificial Sequence
  chemically synthesized
ggtccaatcaacagatagactt

SEQ ID NO: 922633 - DNA, 22 bp, Artificial Sequence
  chemically synthesized
aggttattgcatttaaagtcta

SEQ ID NO: 922634 - DNA, 22 bp, Artificial Sequence
  chemically synthesized
aaggttattgcatttaaagtct

SEQ ID NO: 922635 - DNA, 22 bp, Artificial Sequence
  chemically synthesized
taaggttattgcatttaaagtc

SEQ ID NO: 922636 - DNA, 22 bp, Artificial Sequence
  chemically synthesized
cctttaaggttattgcatttaa

SEQ ID NO: 922637 - DNA, 22 bp, Artificial Sequence
  chemically synthesized
tccctttaaggttattgcattt

SEQ ID NO: 922638 - DNA, 22 bp, Artificial Sequence
  chemically synthesized
tctccctttaaggttattgcat

SEQ ID NO: 922639 - DNA, 22 bp, Artificial Sequence
  chemically synthesized
tctctccctttaaggttattgc

SEQ ID NO: 922640 - DNA, 22 bp, Artificial Sequence
  chemically synthesized
taaatgcaataaccttaaaggg

SEQ ID NO: 922641 - DNA, 22 bp, Artificial Sequence
  chemically synthesized
taaattctctctccctttaagg

SEQ ID NO: 922642 - DNA, 22 bp, Artificial Sequence
  chemically synthesized
aaatgcaataaccttaaaggga

SEQ ID NO: 922643 - DNA, 22 bp, Artificial Sequence
  chemically synthesized
aatgcaataaccttaaagggag

SEQ ID NO: 922644 - DNA, 22 bp, Artificial Sequence
  chemically synthesized
ctgtaaattctctctcccttta

SEQ ID NO: 922645 - DNA, 22 bp, Artificial Sequence
  chemically synthesized
ggttgctgtaaattctctctcc

SEQ ID NO: 922646 - DNA, 22 bp, Artificial Sequence
  chemically synthesized
gggttgctgtaaattctctctc

SEQ ID NO: 922647 - DNA, 22 bp, Artificial Sequence
  chemically synthesized
cttgggttgctgtaaattctct

SEQ ID NO: 922648 - DNA, 22 bp, Artificial Sequence
  chemically synthesized
acttgggttgctgtaaattctc

SEQ ID NO: 922649 - DNA, 22 bp, Artificial Sequence
  chemically synthesized
aaagggagagagaatttacagc

SEQ ID NO: 922650 - DNA, 22 bp, Artificial Sequence
  chemically synthesized
cttacttgggttgctgtaaatt

SEQ ID NO: 922651 - DNA, 22 bp, Artificial Sequence
  chemically synthesized
aagggagagagaatttacagca

SEQ ID NO: 922652 - DNA, 22 bp, Artificial Sequence
  chemically synthesized
acagcaacccaagtaaggagtc

SEQ ID NO: 922653 - DNA, 22 bp, Artificial Sequence
  chemically synthesized
cagcaacccaagtaaggagtct

SEQ ID NO: 922654 - DNA, 22 bp, Artificial Sequence
  chemically synthesized
actggggcatgtatttctttgt

SEQ ID NO: 922655 - DNA, 22 bp, Artificial Sequence
  chemically synthesized
gggcatgtatttctttgtgttt

SEQ ID NO: 922656 - DNA, 22 bp, Artificial Sequence
  chemically synthesized
cagagcccataacatgaaaagg

SEQ ID NO: 922657 - DNA, 22 bp, Artificial Sequence
  chemically synthesized
ctttgtgtttccttttcatgtt

SEQ ID NO: 922658 - DNA, 22 bp, Artificial Sequence
  chemically synthesized
tttgtgtttccttttcatgtta

SEQ ID NO: 922659 - DNA, 22 bp, Artificial Sequence
  chemically synthesized
tgtgtttccttttcatgttatg

SEQ ID NO: 922660 - DNA, 22 bp, Artificial Sequence
  chemically synthesized
gtgtttccttttcatgttatgg

SEQ ID NO: 922661 - DNA, 22 bp, Artificial Sequence
  chemically synthesized
tgtttccttttcatgttatggg

SEQ ID NO: 922662 - DNA, 22 bp, Artificial Sequence
  chemically synthesized
ccttttcatgttatgggctctg

SEQ ID NO: 922663 - DNA, 22 bp, Artificial Sequence
  chemically synthesized
cttttcatgttatgggctctgt

SEQ ID NO: 922664 - DNA, 22 bp, Artificial Sequence
  chemically synthesized
ttcatgttatgggctctgtagc

SEQ ID NO: 922665 - DNA, 22 bp, Artificial Sequence
  chemically synthesized
tcatgttatgggctctgtagct

SEQ ID NO: 922666 - DNA, 22 bp, Artificial Sequence
  chemically synthesized
catgttatgggctctgtagcta

SEQ ID NO: 922667 - DNA, 22 bp, Artificial Sequence
  chemically synthesized
atgttatgggctctgtagctac

SEQ ID NO: 922668 - DNA, 22 bp, Artificial Sequence
  chemically synthesized
tgggctctgtagctacccttgt

SEQ ID NO: 922669 - DNA, 22 bp, Artificial Sequence
  chemically synthesized
caaatggtcaatacaagggtag

SEQ ID NO: 922670 - DNA, 22 bp, Artificial Sequence
  chemically synthesized
tgtagctacccttgtattgacc

SEQ ID NO: 922671 - DNA, 22 bp, Artificial Sequence
  chemically synthesized
tagctacccttgtattgaccat

SEQ ID NO: 922672 - DNA, 22 bp, Artificial Sequence
  chemically synthesized
aatatactgcaaatggtcaata

SEQ ID NO: 922673 - DNA, 22 bp, Artificial Sequence
  chemically synthesized
gaatatactgcaaatggtcaat

SEQ ID NO: 922674 - DNA, 22 bp, Artificial Sequence
  chemically synthesized
tttgaatatactgcaaatggtc

SEQ ID NO: 922675 - DNA, 22 bp, Artificial Sequence
  chemically synthesized
atttgaatatactgcaaatggt

SEQ ID NO: 922676 - DNA, 22 bp, Artificial Sequence
  chemically synthesized
cccttgtattgaccatttgcag

SEQ ID NO: 922677 - DNA, 22 bp, Artificial Sequence
  chemically synthesized
gtattgaccatttgcagtatat

SEQ ID NO: 922678 - DNA, 22 bp, Artificial Sequence
  chemically synthesized
tattgaccatttgcagtatatt

SEQ ID NO: 922679 - DNA, 22 bp, Artificial Sequence
  chemically synthesized
accatttgcagtatattcaaat

SEQ ID NO: 922680 - DNA, 22 bp, Artificial Sequence
  chemically synthesized
gcagtatattcaaataaatgct

SEQ ID NO: 922681 - DNA, 22 bp, Artificial Sequence
  chemically synthesized
aagtatgaatacagcatttatt

SEQ ID NO: 922682 - DNA, 22 bp, Artificial Sequence
  chemically synthesized
cagtatattcaaataaatgctg

SEQ ID NO: 922683 - DNA, 22 bp, Artificial Sequence
  chemically synthesized
aaagtatgaatacagcatttat

SEQ ID NO: 922684 - DNA, 22 bp, Artificial Sequence
  chemically synthesized
aaataaatgctgtattcatact

SEQ ID NO: 922685 - DNA, 22 bp, Artificial Sequence
  chemically synthesized
tattcatactttaaatatacat

SEQ ID NO: 922686 - DNA, 22 bp, Artificial Sequence
  chemically synthesized
atactttaaatatacatatggg

SEQ ID NO: 922687 - DNA, 22 bp, Artificial Sequence
  chemically synthesized
gggaaagagtagatgcccatat

SEQ ID NO: 922688 - DNA, 22 bp, Artificial Sequence
  chemically synthesized
taaatatacatatgggcatcta

SEQ ID NO: 922689 - DNA, 22 bp, Artificial Sequence
  chemically synthesized
aaatatacatatgggcatctac

SEQ ID NO: 922690 - DNA, 22 bp, Artificial Sequence
  chemically synthesized
aatatacatatgggcatctact

SEQ ID NO: 922691 - DNA, 22 bp, Artificial Sequence
  chemically synthesized
gggcaccctagggaaagagtag

SEQ ID NO: 922692 - DNA, 22 bp, Artificial Sequence
  chemically synthesized
ggggcaccctagggaaagagta

SEQ ID NO: 922693 - DNA, 22 bp, Artificial Sequence
  chemically synthesized
tttggggcaccctagggaaaga

SEQ ID NO: 922694 - DNA, 22 bp, Artificial Sequence
  chemically synthesized
atttggggcaccctagggaaag

SEQ ID NO: 922695 - DNA, 22 bp, Artificial Sequence
  chemically synthesized
tatttggggcaccctagggaaa

SEQ ID NO: 922696 - DNA, 22 bp, Artificial Sequence
  chemically synthesized
ttatttggggcaccctagggaa

SEQ ID NO: 922697 - DNA, 22 bp, Artificial Sequence
  chemically synthesized
tttatttggggcaccctaggga

SEQ ID NO: 922698 - DNA, 22 bp, Artificial Sequence
  chemically synthesized
ctctttccctagggtgccccaa

SEQ ID NO: 922699 - DNA, 22 bp, Artificial Sequence
  chemically synthesized
tttccctagggtgccccaaata

SEQ ID NO: 922700 - DNA, 22 bp, Artificial Sequence
  chemically synthesized
tccctagggtgccccaaataaa

SEQ ID NO: 922701 - DNA, 22 bp, Artificial Sequence
  chemically synthesized
ccctagggtgccccaaataaaa

SEQ ID NO: 922702 - DNA, 22 bp, Artificial Sequence
  chemically synthesized
cctagggtgccccaaataaaaa

SEQ ID NO: 922703 - DNA, 22 bp, Artificial Sequence
  chemically synthesized
gggtgccccaaataaaaagggc

SEQ ID NO: 922704 - DNA, 22 bp, Artificial Sequence
  chemically synthesized
cagataagaaatgagccctttt

SEQ ID NO: 922705 - DNA, 22 bp, Artificial Sequence
  chemically synthesized
cagattgcagataagaaatgag

SEQ ID NO: 922706 - DNA, 22 bp, Artificial Sequence
  chemically synthesized
atcctacagattgcagataaga

SEQ ID NO: 922707 - DNA, 22 bp, Artificial Sequence
  chemically synthesized
catcctacagattgcagataag

SEQ ID NO: 922708 - DNA, 22 bp, Artificial Sequence
  chemically synthesized
atttcttatctgcaatctgtag

SEQ ID NO: 922709 - DNA, 22 bp, Artificial Sequence
  chemically synthesized
aaagatttcatcctacagattg

SEQ ID NO: 922710 - DNA, 22 bp, Artificial Sequence
  chemically synthesized
cttatctgcaatctgtaggatg

SEQ ID NO: 922711 - DNA, 22 bp, Artificial Sequence
  chemically synthesized
ttatctgcaatctgtaggatga

SEQ ID NO: 922712 - DNA, 22 bp, Artificial Sequence
  chemically synthesized
atctgcaatctgtaggatgaaa

SEQ ID NO: 922713 - DNA, 22 bp, Artificial Sequence
  chemically synthesized
tctgcaatctgtaggatgaaat

SEQ ID NO: 922714 - DNA, 22 bp, Artificial Sequence
  chemically synthesized
caatctgtaggatgaaatcttt

SEQ ID NO: 922715 - DNA, 22 bp, Artificial Sequence
  chemically synthesized
taggatgaaatctttgaactta

SEQ ID NO: 922716 - DNA, 22 bp, Artificial Sequence
  chemically synthesized
ccacaacatacaggaaaataag

SEQ ID NO: 922717 - DNA, 22 bp, Artificial Sequence
  chemically synthesized
tgaacttattttcctgtatgtt

SEQ ID NO: 922718 - DNA, 22 bp, Artificial Sequence
  chemically synthesized
gaacttattttcctgtatgttg

SEQ ID NO: 922719 - DNA, 22 bp, Artificial Sequence
  chemically synthesized
aacttattttcctgtatgttgt

SEQ ID NO: 922720 - DNA, 22 bp, Artificial Sequence
  chemically synthesized
attttcctgtatgttgtggtag

SEQ ID NO: 922721 - DNA, 22 bp, Artificial Sequence
  chemically synthesized
ttttcctgtatgttgtggtagg

SEQ ID NO: 922722 - DNA, 22 bp, Artificial Sequence
  chemically synthesized
tcctgtatgttgtggtaggttt

SEQ ID NO: 922723 - DNA, 22 bp, Artificial Sequence
  chemically synthesized
cctgtatgttgtggtaggtttt

SEQ ID NO: 922724 - DNA, 22 bp, Artificial Sequence
  chemically synthesized
ctgtatgttgtggtaggttttc

SEQ ID NO: 922725 - DNA, 22 bp, Artificial Sequence
  chemically synthesized
gggataaatcagggaaaaccta

SEQ ID NO: 922726 - DNA, 22 bp, Artificial Sequence
  chemically synthesized
tatgttgtggtaggttttccct

SEQ ID NO: 922727 - DNA, 22 bp, Artificial Sequence
  chemically synthesized
tggtaggttttccctgatttat

SEQ ID NO: 922728 - DNA, 22 bp, Artificial Sequence
  chemically synthesized
acaaacaaaatattggggataa

SEQ ID NO: 922729 - DNA, 22 bp, Artificial Sequence
  chemically synthesized
tccctgatttatccccaatatt

SEQ ID NO: 922730 - DNA, 22 bp, Artificial Sequence
  chemically synthesized
ccctgatttatccccaatattt

SEQ ID NO: 922731 - DNA, 22 bp, Artificial Sequence
  chemically synthesized
cctgatttatccccaatatttt

SEQ ID NO: 922732 - DNA, 22 bp, Artificial Sequence
  chemically synthesized
atttatccccaatattttgttt

SEQ ID NO: 922733 - DNA, 22 bp, Artificial Sequence
  chemically synthesized
atccccaatattttgtttgtca

SEQ ID NO: 922734 - DNA, 22 bp, Artificial Sequence
  chemically synthesized
tccccaatattttgtttgtcaa

SEQ ID NO: 922735 - DNA, 22 bp, Artificial Sequence
  chemically synthesized
tcacaaatcagaagggttgaca

SEQ ID NO: 922736 - DNA, 22 bp, Artificial Sequence
  chemically synthesized
taaactatcacaaatcagaagg

SEQ ID NO: 922737 - DNA, 22 bp, Artificial Sequence
  chemically synthesized
tgtttgtcaacccttctgattt

SEQ ID NO: 922738 - DNA, 22 bp, Artificial Sequence
  chemically synthesized
gtttgtcaacccttctgatttg

SEQ ID NO: 922739 - DNA, 22 bp, Artificial Sequence
  chemically synthesized
tttgtcaacccttctgatttgt

SEQ ID NO: 922740 - DNA, 22 bp, Artificial Sequence
  chemically synthesized
gtcaacccttctgatttgtgat

SEQ ID NO: 922741 - DNA, 22 bp, Artificial Sequence
  chemically synthesized
tcaacccttctgatttgtgata

SEQ ID NO: 922742 - DNA, 22 bp, Artificial Sequence
  chemically synthesized
ctgatttgtgatagtttacagt

SEQ ID NO: 922743 - DNA, 22 bp, Artificial Sequence
  chemically synthesized
tgatttgtgatagtttacagtg

SEQ ID NO: 922744 - DNA, 22 bp, Artificial Sequence
  chemically synthesized
atttgtgatagtttacagtggt

SEQ ID NO: 922745 - DNA, 22 bp, Artificial Sequence
  chemically synthesized
tggggccacagagtaccactgt

SEQ ID NO: 922746 - DNA, 22 bp, Artificial Sequence
  chemically synthesized
atggggccacagagtaccactg

SEQ ID NO: 922747 - DNA, 22 bp, Artificial Sequence
  chemically synthesized
gtgatagtttacagtggtactc

SEQ ID NO: 922748 - DNA, 22 bp, Artificial Sequence
  chemically synthesized
tatggggccacagagtaccact

SEQ ID NO: 922749 - DNA, 22 bp, Artificial Sequence
  chemically synthesized
tgatagtttacagtggtactct

SEQ ID NO: 922750 - DNA, 22 bp, Artificial Sequence
  chemically synthesized
acagtggtactctgtggcccca

SEQ ID NO: 922751 - DNA, 22 bp, Artificial Sequence
  chemically synthesized
cagtggtactctgtggccccat

SEQ ID NO: 922752 - DNA, 22 bp, Artificial Sequence
  chemically synthesized
tgtggccccataaagatcaccc

SEQ ID NO: 922753 - DNA, 22 bp, Artificial Sequence
  chemically synthesized
tggccccataaagatcacccat

SEQ ID NO: 922754 - DNA, 22 bp, Artificial Sequence
  chemically synthesized
gtggtgacaaatgaaccaaagt

SEQ ID NO: 922755 - DNA, 22 bp, Artificial Sequence
  chemically synthesized
tggttcatttgtcaccactagt

SEQ ID NO: 922756 - DNA, 22 bp, Artificial Sequence
  chemically synthesized
ggttcatttgtcaccactagtg

SEQ ID NO: 922757 - DNA, 22 bp, Artificial Sequence
  chemically synthesized
gttcatttgtcaccactagtgc

SEQ ID NO: 922758 - DNA, 22 bp, Artificial Sequence
  chemically synthesized
atttgtcaccactagtgctcat

SEQ ID NO: 922759 - DNA, 22 bp, Artificial Sequence
  chemically synthesized
gtcaccactagtgctcatctgc

SEQ ID NO: 922760 - DNA, 22 bp, Artificial Sequence
  chemically synthesized
tcaccactagtgctcatctgcc

SEQ ID NO: 922761 - DNA, 22 bp, Artificial Sequence
  chemically synthesized
aggtgtcaggaagccaacgtgg

SEQ ID NO: 922762 - DNA, 22 bp, Artificial Sequence
  chemically synthesized
gtgctcatctgccacgttggct

SEQ ID NO: 922763 - DNA, 22 bp, Artificial Sequence
  chemically synthesized
atctgccacgttggcttcctga

SEQ ID NO: 922764 - DNA, 22 bp, Artificial Sequence
  chemically synthesized
ccacgttggcttcctgacacct

SEQ ID NO: 922765 - DNA, 22 bp, Artificial Sequence
  chemically synthesized
tggaaaaggagttcaggtgtca

SEQ ID NO: 922766 - DNA, 22 bp, Artificial Sequence
  chemically synthesized
ctgtggaaaaggagttcaggtg

SEQ ID NO: 922767 - DNA, 22 bp, Artificial Sequence
  chemically synthesized
gcttcctgacacctgaactcct

SEQ ID NO: 922768 - DNA, 22 bp, Artificial Sequence
  chemically synthesized
cctgacacctgaactccttttc

SEQ ID NO: 922769 - DNA, 22 bp, Artificial Sequence
  chemically synthesized
agcactgctgtggaaaaggagt

SEQ ID NO: 922770 - DNA, 22 bp, Artificial Sequence
  chemically synthesized
ctgacacctgaactccttttcc

SEQ ID NO: 922771 - DNA, 22 bp, Artificial Sequence
  chemically synthesized
acacctgaactccttttccaca

SEQ ID NO: 922772 - DNA, 22 bp, Artificial Sequence
  chemically synthesized
accattaagcactgctgtggaa

SEQ ID NO: 922773 - DNA, 22 bp, Artificial Sequence
  chemically synthesized
aactccttttccacagcagtgc

SEQ ID NO: 922774 - DNA, 22 bp, Artificial Sequence
  chemically synthesized
cttttccacagcagtgcttaat

SEQ ID NO: 922775 - DNA, 22 bp, Artificial Sequence
  chemically synthesized
ttccacagcagtgcttaatggt

SEQ ID NO: 922776 - DNA, 22 bp, Artificial Sequence
  chemically synthesized
tccacagcagtgcttaatggtt

SEQ ID NO: 922777 - DNA, 22 bp, Artificial Sequence
  chemically synthesized
ccacagcagtgcttaatggtta

SEQ ID NO: 922778 - DNA, 22 bp, Artificial Sequence
  chemically synthesized
cacagcagtgcttaatggttaa

SEQ ID NO: 922779 - DNA, 22 bp, Artificial Sequence
  chemically synthesized
ccagagtacacattaaccatta

SEQ ID NO: 922780 - DNA, 22 bp, Artificial Sequence
  chemically synthesized
aatggttaatgtgtactctggg

SEQ ID NO: 922781 - DNA, 22 bp, Artificial Sequence
  chemically synthesized
atggttaatgtgtactctggga

SEQ ID NO: 922782 - DNA, 22 bp, Artificial Sequence
  chemically synthesized
atgtgtactctgggaattctgg

SEQ ID NO: 922783 - DNA, 22 bp, Artificial Sequence
  chemically synthesized
accagtaaacaaaccagaattc

SEQ ID NO: 922784 - DNA, 22 bp, Artificial Sequence
  chemically synthesized
ctaaccagtaaacaaaccagaa

SEQ ID NO: 922785 - DNA, 22 bp, Artificial Sequence
  chemically synthesized
gctaaccagtaaacaaaccaga

SEQ ID NO: 922786 - DNA, 22 bp, Artificial Sequence
  chemically synthesized
atttgctaaccagtaaacaaac

SEQ ID NO: 922787 - DNA, 22 bp, Artificial Sequence
  chemically synthesized
tgggaattctggtttgtttact

SEQ ID NO: 922788 - DNA, 22 bp, Artificial Sequence
  chemically synthesized
ggaattctggtttgtttactgg

SEQ ID NO: 922789 - DNA, 22 bp, Artificial Sequence
  chemically synthesized
aagtcattaatttgctaaccag

SEQ ID NO: 922790 - DNA, 22 bp, Artificial Sequence
  chemically synthesized
tggtttgtttactggttagcaa

SEQ ID NO: 922791 - DNA, 22 bp, Artificial Sequence
  chemically synthesized
tcaagtcattaatttgctaacc

SEQ ID NO: 922792 - DNA, 22 bp, Artificial Sequence
  chemically synthesized
gtttgtttactggttagcaaat

SEQ ID NO: 922793 - DNA, 22 bp, Artificial Sequence
  chemically synthesized
ctcaagtcattaatttgctaac

SEQ ID NO: 922794 - DNA, 22 bp, Artificial Sequence
  chemically synthesized
tctcaagtcattaatttgctaa

SEQ ID NO: 922795 - DNA, 22 bp, Artificial Sequence
  chemically synthesized
gtttactggttagcaaattaat

SEQ ID NO: 922796 - DNA, 22 bp, Artificial Sequence
  chemically synthesized
tttactggttagcaaattaatg

SEQ ID NO: 922797 - DNA, 22 bp, Artificial Sequence
  chemically synthesized
actggttagcaaattaatgact

SEQ ID NO: 922798 - DNA, 22 bp, Artificial Sequence
  chemically synthesized
ctggttagcaaattaatgactt

SEQ ID NO: 922799 - DNA, 22 bp, Artificial Sequence
  chemically synthesized
gttagcaaattaatgacttgag

SEQ ID NO: 922800 - DNA, 22 bp, Artificial Sequence
  chemically synthesized
aataaggtacctttctcaagtc

SEQ ID NO: 922801 - DNA, 22 bp, Artificial Sequence
  chemically synthesized
gcaaattaatgacttgagaaag

SEQ ID NO: 922802 - DNA, 22 bp, Artificial Sequence
  chemically synthesized
tcaataaggtacctttctcaag

SEQ ID NO: 922803 - DNA, 22 bp, Artificial Sequence
  chemically synthesized
ctcaataaggtacctttctcaa

SEQ ID NO: 922804 - DNA, 22 bp, Artificial Sequence
  chemically synthesized
cttctcaataaggtacctttct

SEQ ID NO: 922805 - DNA, 22 bp, Artificial Sequence
  chemically synthesized
atgacttgagaaaggtacctta

SEQ ID NO: 922806 - DNA, 22 bp, Artificial Sequence
  chemically synthesized
actgcttctcaataaggtacct

SEQ ID NO: 922807 - DNA, 22 bp, Artificial Sequence
  chemically synthesized
aactaactgcttctcaataagg

SEQ ID NO: 922808 - DNA, 22 bp, Artificial Sequence
  chemically synthesized
gagaaaggtaccttattgagaa

SEQ ID NO: 922809 - DNA, 22 bp, Artificial Sequence
  chemically synthesized
agaaaggtaccttattgagaag

SEQ ID NO: 922810 - DNA, 22 bp, Artificial Sequence
  chemically synthesized
cattgaactaactgcttctcaa

SEQ ID NO: 922811 - DNA, 22 bp, Artificial Sequence
  chemically synthesized
attgagaagcagttagttcaat

SEQ ID NO: 922812 - DNA, 22 bp, Artificial Sequence
  chemically synthesized
ttgagaagcagttagttcaatg

SEQ ID NO: 922813 - DNA, 22 bp, Artificial Sequence
  chemically synthesized
agaagcagttagttcaatggag

SEQ ID NO: 922814 - DNA, 22 bp, Artificial Sequence
  chemically synthesized
tcaatgtagagatggtggcaat

SEQ ID NO: 922815 - DNA, 22 bp, Artificial Sequence
  chemically synthesized
gttcaatggagattgccaccat

SEQ ID NO: 922816 - DNA, 22 bp, Artificial Sequence
  chemically synthesized
ctgtcaatgtagagatggtggc

SEQ ID NO: 922817 - DNA, 22 bp, Artificial Sequence
  chemically synthesized
gctgtcaatgtagagatggtgg

SEQ ID NO: 922818 - DNA, 22 bp, Artificial Sequence
  chemically synthesized
aatggagattgccaccatctct

SEQ ID NO: 922819 - DNA, 22 bp, Artificial Sequence
  chemically synthesized
tgctgtcaatgtagagatggtg

SEQ ID NO: 922820 - DNA, 22 bp, Artificial Sequence
  chemically synthesized
agccattttgctgtcaatgtag

SEQ ID NO: 922821 - DNA, 22 bp, Artificial Sequence
  chemically synthesized
ccaccatctctacattgacagc

SEQ ID NO: 922822 - DNA, 22 bp, Artificial Sequence
  chemically synthesized
aagacactgagccattttgctg

SEQ ID NO: 922823 - DNA, 22 bp, Artificial Sequence
  chemically synthesized
tacattgacagcaaaatggctc

SEQ ID NO: 922824 - DNA, 22 bp, Artificial Sequence
  chemically synthesized
cattgacagcaaaatggctcag

SEQ ID NO: 922825 - DNA, 22 bp, Artificial Sequence
  chemically synthesized
acagcaaaatggctcagtgtct

SEQ ID NO: 922826 - DNA, 22 bp, Artificial Sequence
  chemically synthesized
aacatcaggaggaagacaaggg

SEQ ID NO: 922827 - DNA, 22 bp, Artificial Sequence
  chemically synthesized
agtgtcttcagcccttgtcttc

SEQ ID NO: 922828 - DNA, 22 bp, Artificial Sequence
  chemically synthesized
cagcccttgtcttcctcctgat

SEQ ID NO: 922829 - DNA, 22 bp, Artificial Sequence
  chemically synthesized
agcccttgtcttcctcctgatg

SEQ ID NO: 922830 - DNA, 22 bp, Artificial Sequence
  chemically synthesized
aataggtaagtctgaacatcag

SEQ ID NO: 922831 - DNA, 22 bp, Artificial Sequence
  chemically synthesized
gaataggtaagtctgaacatca

SEQ ID NO: 922832 - DNA, 22 bp, Artificial Sequence
  chemically synthesized
gtcttcctcctgatgttcagac

SEQ ID NO: 922833 - DNA, 22 bp, Artificial Sequence
  chemically synthesized
tcttcctcctgatgttcagact

SEQ ID NO: 922834 - DNA, 22 bp, Artificial Sequence
  chemically synthesized
cctcctgatgttcagacttacc

SEQ ID NO: 922835 - DNA, 22 bp, Artificial Sequence
  chemically synthesized
ctcctgatgttcagacttacct

SEQ ID NO: 922836 - DNA, 22 bp, Artificial Sequence
  chemically synthesized
ctgatgttcagacttacctatt

SEQ ID NO: 922837 - DNA, 22 bp, Artificial Sequence
  chemically synthesized
atgttcagacttacctattcaa

SEQ ID NO: 922838 - DNA, 22 bp, Artificial Sequence
  chemically synthesized
agacttacctattcaaatgcgt

SEQ ID NO: 922839 - DNA, 22 bp, Artificial Sequence
  chemically synthesized
acctattcaaatgcgtgttttc

SEQ ID NO: 922840 - DNA, 22 bp, Artificial Sequence
  chemically synthesized
cctattcaaatgcgtgttttct

SEQ ID NO: 922841 - DNA, 22 bp, Artificial Sequence
  chemically synthesized
aaaataaggtgatcagaaaaca

SEQ ID NO: 922842 - DNA, 22 bp, Artificial Sequence
  chemically synthesized
ttcaaatgcgtgttttctgatc

SEQ ID NO: 922843 - DNA, 22 bp, Artificial Sequence
  chemically synthesized
aaatgcgtgttttctgatcacc

SEQ ID NO: 922844 - DNA, 22 bp, Artificial Sequence
  chemically synthesized
gaacattgaaaataaggtgatc

SEQ ID NO: 922845 - DNA, 22 bp, Artificial Sequence
  chemically synthesized
ggaacattgaaaataaggtgat

SEQ ID NO: 922846 - DNA, 22 bp, Artificial Sequence
  chemically synthesized
ttggaacattgaaaataaggtg

SEQ ID NO: 922847 - DNA, 22 bp, Artificial Sequence
  chemically synthesized
tctgatcaccttattttcaatg

SEQ ID NO: 922848 - DNA, 22 bp, Artificial Sequence
  chemically synthesized
ctgatcaccttattttcaatgt

SEQ ID NO: 922849 - DNA, 22 bp, Artificial Sequence
  chemically synthesized
tgatcaccttattttcaatgtt

SEQ ID NO: 922850 - DNA, 22 bp, Artificial Sequence
  chemically synthesized
aggagctcttggaacattgaaa

SEQ ID NO: 922851 - DNA, 22 bp, Artificial Sequence
  chemically synthesized
aaggagctcttggaacattgaa

SEQ ID NO: 922852 - DNA, 22 bp, Artificial Sequence
  chemically synthesized
atcaccttattttcaatgttcc

SEQ ID NO: 922853 - DNA, 22 bp, Artificial Sequence
  chemically synthesized
attttcaatgttccaagagctc

SEQ ID NO: 922854 - DNA, 22 bp, Artificial Sequence
  chemically synthesized
ttttcaatgttccaagagctcc

SEQ ID NO: 922855 - DNA, 22 bp, Artificial Sequence
  chemically synthesized
tcaatgttccaagagctcctta

SEQ ID NO: 922856 - DNA, 22 bp, Artificial Sequence
  chemically synthesized
caatgttccaagagctccttaa

SEQ ID NO: 922857 - DNA, 22 bp, Artificial Sequence
  chemically synthesized
aatgttccaagagctccttaag

SEQ ID NO: 922858 - DNA, 22 bp, Artificial Sequence
  chemically synthesized
ggatataatagtcttaaggagc

SEQ ID NO: 922859 - DNA, 22 bp, Artificial Sequence
  chemically synthesized
gggatataatagtcttaaggag

SEQ ID NO: 922860 - DNA, 22 bp, Artificial Sequence
  chemically synthesized
aacttgggatataatagtctta

SEQ ID NO: 922861 - DNA, 22 bp, Artificial Sequence
  chemically synthesized
caagagctccttaagactatta

SEQ ID NO: 922862 - DNA, 22 bp, Artificial Sequence
  chemically synthesized
cttaagactattatatcccaag

SEQ ID NO: 922863 - DNA, 22 bp, Artificial Sequence
  chemically synthesized
aagactattatatcccaagttg

SEQ ID NO: 922864 - DNA, 22 bp, Artificial Sequence
  chemically synthesized
agactattatatcccaagttga

SEQ ID NO: 922865 - DNA, 22 bp, Artificial Sequence
  chemically synthesized
ttatatcccaagttgagctctg

SEQ ID NO: 922866 - DNA, 22 bp, Artificial Sequence
  chemically synthesized
tatcccaagttgagctctgtat

SEQ ID NO: 922867 - DNA, 22 bp, Artificial Sequence
  chemically synthesized
agctctgtatgtctgatttgct

SEQ ID NO: 922868 - DNA, 22 bp, Artificial Sequence
  chemically synthesized
aatggaaagaggaaagcaaatc

SEQ ID NO: 922869 - DNA, 22 bp, Artificial Sequence
  chemically synthesized
tgtatgtctgatttgctttcct

SEQ ID NO: 922870 - DNA, 22 bp, Artificial Sequence
  chemically synthesized
tatgtctgatttgctttcctct

SEQ ID NO: 922871 - DNA, 22 bp, Artificial Sequence
  chemically synthesized
atttgctttcctctttccattc

SEQ ID NO: 922872 - DNA, 22 bp, Artificial Sequence
  chemically synthesized
gctttcctctttccattcagtt

SEQ ID NO: 922873 - DNA, 22 bp, Artificial Sequence
  chemically synthesized
ctttcctctttccattcagtta

SEQ ID NO: 922874 - DNA, 22 bp, Artificial Sequence
  chemically synthesized
tcctctttccattcagttactc

SEQ ID NO: 922875 - DNA, 22 bp, Artificial Sequence
  chemically synthesized
cctctttccattcagttactct

SEQ ID NO: 922876 - DNA, 22 bp, Artificial Sequence
  chemically synthesized
ctctttccattcagttactctc

SEQ ID NO: 922877 - DNA, 22 bp, Artificial Sequence
  chemically synthesized
tttccattcagttactctcctt

SEQ ID NO: 922878 - DNA, 22 bp, Artificial Sequence
  chemically synthesized
tccattcagttactctcctttg

SEQ ID NO: 922879 - DNA, 22 bp, Artificial Sequence
  chemically synthesized
ccattcagttactctcctttgt

SEQ ID NO: 922880 - DNA, 22 bp, Artificial Sequence
  chemically synthesized
cattcagttactctcctttgta

SEQ ID NO: 922881 - DNA, 22 bp, Artificial Sequence
  chemically synthesized
gtcaggataggaaatacaaagg

SEQ ID NO: 922882 - DNA, 22 bp, Artificial Sequence
  chemically synthesized
agttactctcctttgtatttcc

SEQ ID NO: 922883 - DNA, 22 bp, Artificial Sequence
  chemically synthesized
ttagtcaggataggaaatacaa

SEQ ID NO: 922884 - DNA, 22 bp, Artificial Sequence
  chemically synthesized
ctctcctttgtatttcctatcc

SEQ ID NO: 922885 - DNA, 22 bp, Artificial Sequence
  chemically synthesized
tcctttgtatttcctatcctga

SEQ ID NO: 922886 - DNA, 22 bp, Artificial Sequence
  chemically synthesized
ctttgtatttcctatcctgact

SEQ ID NO: 922887 - DNA, 22 bp, Artificial Sequence
  chemically synthesized
catggaaggctgttagtcagga

SEQ ID NO: 922888 - DNA, 22 bp, Artificial Sequence
  chemically synthesized
tgtatttcctatcctgactaac

SEQ ID NO: 922889 - DNA, 22 bp, Artificial Sequence
  chemically synthesized
gtatttcctatcctgactaaca

SEQ ID NO: 922890 - DNA, 22 bp, Artificial Sequence
  chemically synthesized
tatttcctatcctgactaacag

SEQ ID NO: 922891 - DNA, 22 bp, Artificial Sequence
  chemically synthesized
gctgcatggaaggctgttagtc

SEQ ID NO: 922892 - DNA, 22 bp, Artificial Sequence
  chemically synthesized
cctatcctgactaacagccttc

SEQ ID NO: 922893 - DNA, 22 bp, Artificial Sequence
  chemically synthesized
ctatcctgactaacagccttcc

SEQ ID NO: 922894 - DNA, 22 bp, Artificial Sequence
  chemically synthesized
tcctgactaacagccttccatg

SEQ ID NO: 922895 - DNA, 22 bp, Artificial Sequence
  chemically synthesized
ggggaactggctgcatggaagg

SEQ ID NO: 922896 - DNA, 22 bp, Artificial Sequence
  chemically synthesized
gggggaactggctgcatggaag

SEQ ID NO: 922897 - DNA, 22 bp, Artificial Sequence
  chemically synthesized
actaacagccttccatgcagcc

SEQ ID NO: 922898 - DNA, 22 bp, Artificial Sequence
  chemically synthesized
cttgggggaactggctgcatgg

SEQ ID NO: 922899 - DNA, 22 bp, Artificial Sequence
  chemically synthesized
gcttgggggaactggctgcatg

SEQ ID NO: 922900 - DNA, 22 bp, Artificial Sequence
  chemically synthesized
tgcttgggggaactggctgcat

SEQ ID NO: 922901 - DNA, 22 bp, Artificial Sequence
  chemically synthesized
ttgcttgggggaactggctgca

SEQ ID NO: 922902 - DNA, 22 bp, Artificial Sequence
  chemically synthesized
acagccttccatgcagccagtt

SEQ ID NO: 922903 - DNA, 22 bp, Artificial Sequence
  chemically synthesized
tttgcttgggggaactggctgc

SEQ ID NO: 922904 - DNA, 22 bp, Artificial Sequence
  chemically synthesized
caggttttttgcttgggggaac

SEQ ID NO: 922905 - DNA, 22 bp, Artificial Sequence
  chemically synthesized
ccatgcagccagttcccccaag

SEQ ID NO: 922906 - DNA, 22 bp, Artificial Sequence
  chemically synthesized
ccaggttttttgcttgggggaa

SEQ ID NO: 922907 - DNA, 22 bp, Artificial Sequence
  chemically synthesized
catgcagccagttcccccaagc

SEQ ID NO: 922908 - DNA, 22 bp, Artificial Sequence
  chemically synthesized
tccaggttttttgcttggggga

SEQ ID NO: 922909 - DNA, 22 bp, Artificial Sequence
  chemically synthesized
ttccaggttttttgcttggggg

SEQ ID NO: 922910 - DNA, 22 bp, Artificial Sequence
  chemically synthesized
ggatgatcccttttccaggttt

SEQ ID NO: 922911 - DNA, 22 bp, Artificial Sequence
  chemically synthesized
ccccaagcaaaaaacctggaaa

SEQ ID NO: 922912 - DNA, 22 bp, Artificial Sequence
  chemically synthesized
taggatgatcccttttccaggt

SEQ ID NO: 922913 - DNA, 22 bp, Artificial Sequence
  chemically synthesized
gaaaagggatcatcctagaatt

SEQ ID NO: 922914 - DNA, 22 bp, Artificial Sequence
  chemically synthesized
gaattgtcccttcattcccctc

SEQ ID NO: 922915 - DNA, 22 bp, Artificial Sequence
  chemically synthesized
agtagatgggatgatgagggga

SEQ ID NO: 922916 - DNA, 22 bp, Artificial Sequence
  chemically synthesized
tcccttcattcccctcatcatc

SEQ ID NO: 922917 - DNA, 22 bp, Artificial Sequence
  chemically synthesized
gtcgttaagtagatgggatgat

SEQ ID NO: 922918 - DNA, 22 bp, Artificial Sequence
  chemically synthesized
agtcgttaagtagatgggatga

SEQ ID NO: 922919 - DNA, 22 bp, Artificial Sequence
  chemically synthesized
cattcccctcatcatcccatct

SEQ ID NO: 922920 - DNA, 22 bp, Artificial Sequence
  chemically synthesized
attcccctcatcatcccatcta

SEQ ID NO: 922921 - DNA, 22 bp, Artificial Sequence
  chemically synthesized
ccctcatcatcccatctactta

SEQ ID NO: 922922 - DNA, 22 bp, Artificial Sequence
  chemically synthesized
atcatcccatctacttaacgac

SEQ ID NO: 922923 - DNA, 22 bp, Artificial Sequence
  chemically synthesized
atgaaagtggaacaatttagtc

SEQ ID NO: 922924 - DNA, 22 bp, Artificial Sequence
  chemically synthesized
gatgaaagtggaacaatttagt

SEQ ID NO: 922925 - DNA, 22 bp, Artificial Sequence
  chemically synthesized
cttaacgactaaattgttccac

SEQ ID NO: 922926 - DNA, 22 bp, Artificial Sequence
  chemically synthesized
aacgactaaattgttccacttt

SEQ ID NO: 922927 - DNA, 22 bp, Artificial Sequence
  chemically synthesized
acgactaaattgttccactttc

SEQ ID NO: 922928 - DNA, 22 bp, Artificial Sequence
  chemically synthesized
aagaaatacttgatgaaagtgg

SEQ ID NO: 922929 - DNA, 22 bp, Artificial Sequence
  chemically synthesized
aattgttccactttcatcaagt

SEQ ID NO: 922930 - DNA, 22 bp, Artificial Sequence
  chemically synthesized
acagattcaagaaatacttgat

SEQ ID NO: 922931 - DNA, 22 bp, Artificial Sequence
  chemically synthesized
ttccactttcatcaagtatttc

SEQ ID NO: 922932 - DNA, 22 bp, Artificial Sequence
  chemically synthesized
cactttcatcaagtatttcttg

SEQ ID NO: 922933 - DNA, 22 bp, Artificial Sequence
  chemically synthesized
aaaacctgacagattcaagaaa

SEQ ID NO: 922934 - DNA, 22 bp, Artificial Sequence
  chemically synthesized
aaaaacctgacagattcaagaa

SEQ ID NO: 922935 - DNA, 22 bp, Artificial Sequence
  chemically synthesized
tcatcaagtatttcttgaatct

SEQ ID NO: 922936 - DNA, 22 bp, Artificial Sequence
  chemically synthesized
taaaaacctgacagattcaaga

SEQ ID NO: 922937 - DNA, 22 bp, Artificial Sequence
  chemically synthesized
catcaagtatttcttgaatctg

SEQ ID NO: 922938 - DNA, 22 bp, Artificial Sequence
  chemically synthesized
atcaagtatttcttgaatctgt

SEQ ID NO: 922939 - DNA, 22 bp, Artificial Sequence
  chemically synthesized
cttgaatctgtcaggtttttaa

SEQ ID NO: 922940 - DNA, 22 bp, Artificial Sequence
  chemically synthesized
ttgaatctgtcaggtttttaaa

SEQ ID NO: 922941 - DNA, 22 bp, Artificial Sequence
  chemically synthesized
gaatctgtcaggtttttaaagt

SEQ ID NO: 922942 - DNA, 22 bp, Artificial Sequence
  chemically synthesized
aatctgtcaggtttttaaagtt

SEQ ID NO: 922943 - DNA, 22 bp, Artificial Sequence
  chemically synthesized
tcaggtttttaaagttctattc

SEQ ID NO: 922944 - DNA, 22 bp, Artificial Sequence
  chemically synthesized
gagacaatgagtaagcagaata

SEQ ID NO: 922945 - DNA, 22 bp, Artificial Sequence
  chemically synthesized
ttaaagttctattctgcttact

SEQ ID NO: 922946 - DNA, 22 bp, Artificial Sequence
  chemically synthesized
taaagttctattctgcttactc

SEQ ID NO: 922947 - DNA, 22 bp, Artificial Sequence
  chemically synthesized
aaagttctattctgcttactca

SEQ ID NO: 922948 - DNA, 22 bp, Artificial Sequence
  chemically synthesized
aagttctattctgcttactcat

SEQ ID NO: 922949 - DNA, 22 bp, Artificial Sequence
  chemically synthesized
aagttagagacaatgagtaagc

SEQ ID NO: 922950 - DNA, 22 bp, Artificial Sequence
  chemically synthesized
tattctgcttactcattgtctc

SEQ ID NO: 922951 - DNA, 22 bp, Artificial Sequence
  chemically synthesized
ttctgcttactcattgtctcta

SEQ ID NO: 922952 - DNA, 22 bp, Artificial Sequence
  chemically synthesized
tgcttactcattgtctctaact

SEQ ID NO: 922953 - DNA, 22 bp, Artificial Sequence
  chemically synthesized
cttactcattgtctctaacttg

SEQ ID NO: 922954 - DNA, 22 bp, Artificial Sequence
  chemically synthesized
gtggcagggtgactcaagttag

SEQ ID NO: 922955 - DNA, 22 bp, Artificial Sequence
  chemically synthesized
actcattgtctctaacttgagt

SEQ ID NO: 922956 - DNA, 22 bp, Artificial Sequence
  chemically synthesized
ctcattgtctctaacttgagtc

SEQ ID NO: 922957 - DNA, 22 bp, Artificial Sequence
  chemically synthesized
attgtctctaacttgagtcacc

SEQ ID NO: 922958 - DNA, 22 bp, Artificial Sequence
  chemically synthesized
tctctaacttgagtcaccctgc

SEQ ID NO: 922959 - DNA, 22 bp, Artificial Sequence
  chemically synthesized
taacttgagtcaccctgccact

SEQ ID NO: 922960 - DNA, 22 bp, Artificial Sequence
  chemically synthesized
acttgagtcaccctgccactag

SEQ ID NO: 922961 - DNA, 22 bp, Artificial Sequence
  chemically synthesized
gagtcaccctgccactagtttc

SEQ ID NO: 922962 - DNA, 22 bp, Artificial Sequence
  chemically synthesized
agtcaccctgccactagtttca

SEQ ID NO: 922963 - DNA, 22 bp, Artificial Sequence
  chemically synthesized
agagtgaaaaaaagagagtgaa

SEQ ID NO: 922964 - DNA, 22 bp, Artificial Sequence
  chemically synthesized
ccactagtttcactctcttttt

SEQ ID NO: 922965 - DNA, 22 bp, Artificial Sequence
  chemically synthesized
agctcagagtgaaaaaaagaga

SEQ ID NO: 922966 - DNA, 22 bp, Artificial Sequence
  chemically synthesized
gtttcactctctttttttcact

SEQ ID NO: 922967 - DNA, 22 bp, Artificial Sequence
  chemically synthesized
acagttgagctcagagtgaaaa

SEQ ID NO: 922968 - DNA, 22 bp, Artificial Sequence
  chemically synthesized
gacagttgagctcagagtgaaa

SEQ ID NO: 922969 - DNA, 22 bp, Artificial Sequence
  chemically synthesized
cactctctttttttcactctga

SEQ ID NO: 922970 - DNA, 22 bp, Artificial Sequence
  chemically synthesized
tgacagttgagctcagagtgaa

SEQ ID NO: 922971 - DNA, 22 bp, Artificial Sequence
  chemically synthesized
actctctttttttcactctgag

SEQ ID NO: 922972 - DNA, 22 bp, Artificial Sequence
  chemically synthesized
tctttttttcactctgagctca

SEQ ID NO: 922973 - DNA, 22 bp, Artificial Sequence
  chemically synthesized
tttttttcactctgagctcaac

SEQ ID NO: 922974 - DNA, 22 bp, Artificial Sequence
  chemically synthesized
tttttcactctgagctcaactg

SEQ ID NO: 922975 - DNA, 22 bp, Artificial Sequence
  chemically synthesized
ttttcactctgagctcaactgt

SEQ ID NO: 922976 - DNA, 22 bp, Artificial Sequence
  chemically synthesized
tttcactctgagctcaactgtc

SEQ ID NO: 922977 - DNA, 22 bp, Artificial Sequence
  chemically synthesized
atatgtccctttgacagttgag

SEQ ID NO: 922978 - DNA, 22 bp, Artificial Sequence
  chemically synthesized
ttcactctgagctcaactgtca

SEQ ID NO: 922979 - DNA, 22 bp, Artificial Sequence
  chemically synthesized
tcactctgagctcaactgtcaa

SEQ ID NO: 922980 - DNA, 22 bp, Artificial Sequence
  chemically synthesized
cactctgagctcaactgtcaaa

SEQ ID NO: 922981 - DNA, 22 bp, Artificial Sequence
  chemically synthesized
actctgagctcaactgtcaaag

SEQ ID NO: 922982 - DNA, 22 bp, Artificial Sequence
  chemically synthesized
catcctcatatgtccctttgac

SEQ ID NO: 922983 - DNA, 22 bp, Artificial Sequence
  chemically synthesized
tgagctcaactgtcaaagggac

SEQ ID NO: 922984 - DNA, 22 bp, Artificial Sequence
  chemically synthesized
gcatcctcatatgtccctttga

SEQ ID NO: 922985 - DNA, 22 bp, Artificial Sequence
  chemically synthesized
agctcaactgtcaaagggacat

SEQ ID NO: 922986 - DNA, 22 bp, Artificial Sequence
  chemically synthesized
gatttgcatcctcatatgtccc

SEQ ID NO: 922987 - DNA, 22 bp, Artificial Sequence
  chemically synthesized
agatttgcatcctcatatgtcc

SEQ ID NO: 922988 - DNA, 22 bp, Artificial Sequence
  chemically synthesized
aactgtcaaagggacatatgag

SEQ ID NO: 922989 - DNA, 22 bp, Artificial Sequence
  chemically synthesized
tagatttgcatcctcatatgtc

SEQ ID NO: 922990 - DNA, 22 bp, Artificial Sequence
  chemically synthesized
tcaaagggacatatgaggatgc

SEQ ID NO: 922991 - DNA, 22 bp, Artificial Sequence
  chemically synthesized
tatgctttagatttgcatcctc

SEQ ID NO: 922992 - DNA, 22 bp, Artificial Sequence
  chemically synthesized
atatgctttagatttgcatcct

SEQ ID NO: 922993 - DNA, 22 bp, Artificial Sequence
  chemically synthesized
tatatgctttagatttgcatcc

SEQ ID NO: 922994 - DNA, 22 bp, Artificial Sequence
  chemically synthesized
ttatatgctttagatttgcatc

SEQ ID NO: 922995 - DNA, 22 bp, Artificial Sequence
  chemically synthesized
ggacgtttttatatgctttaga

SEQ ID NO: 922996 - DNA, 22 bp, Artificial Sequence
  chemically synthesized
aagcatataaaaacgtcccaac

SEQ ID NO: 922997 - DNA, 22 bp, Artificial Sequence
  chemically synthesized
cagggtagaatataaggatgtt

SEQ ID NO: 922998 - DNA, 22 bp, Artificial Sequence
  chemically synthesized
ccagggtagaatataaggatgt

SEQ ID NO: 922999 - DNA, 22 bp, Artificial Sequence
  chemically synthesized
tccagggtagaatataaggatg

SEQ ID NO: 923000 - DNA, 22 bp, Artificial Sequence
  chemically synthesized
ttccagggtagaatataaggat

SEQ ID NO: 923001 - DNA, 22 bp, Artificial Sequence
  chemically synthesized
tttccagggtagaatataagga

SEQ ID NO: 923002 - DNA, 22 bp, Artificial Sequence
  chemically synthesized
aaagaattttttccagggtaga

SEQ ID NO: 923003 - DNA, 22 bp, Artificial Sequence
  chemically synthesized
aaatctcaaagaattttttcca

SEQ ID NO: 923004 - DNA, 22 bp, Artificial Sequence
  chemically synthesized
atattctaccctggaaaaaatt

SEQ ID NO: 923005 - DNA, 22 bp, Artificial Sequence
  chemically synthesized
gaaatctcaaagaattttttcc

SEQ ID NO: 923006 - DNA, 22 bp, Artificial Sequence
  chemically synthesized
tattctaccctggaaaaaattc

SEQ ID NO: 923007 - DNA, 22 bp, Artificial Sequence
  chemically synthesized
taccctggaaaaaattctttga

SEQ ID NO: 923008 - DNA, 22 bp, Artificial Sequence
  chemically synthesized
ccctggaaaaaattctttgaga

SEQ ID NO: 923009 - DNA, 22 bp, Artificial Sequence
  chemically synthesized
gaaaaaattctttgagatttca

SEQ ID NO: 923010 - DNA, 22 bp, Artificial Sequence
  chemically synthesized
tttgagatttcaaatcttccat

SEQ ID NO: 923011 - DNA, 22 bp, Artificial Sequence
  chemically synthesized
tgagatttcaaatcttccatga

SEQ ID NO: 923012 - DNA, 22 bp, Artificial Sequence
  chemically synthesized
gagatttcaaatcttccatgac

SEQ ID NO: 923013 - DNA, 22 bp, Artificial Sequence
  chemically synthesized
agatttcaaatcttccatgacc

SEQ ID NO: 923014 - DNA, 22 bp, Artificial Sequence
  chemically synthesized
tcaagatggaccaggtcatgga

SEQ ID NO: 923015 - DNA, 22 bp, Artificial Sequence
  chemically synthesized
caaatcttccatgacctggtcc

SEQ ID NO: 923016 - DNA, 22 bp, Artificial Sequence
  chemically synthesized
aaatcttccatgacctggtcca

SEQ ID NO: 923017 - DNA, 22 bp, Artificial Sequence
  chemically synthesized
ccatgacctggtccatcttgac

SEQ ID NO: 923018 - DNA, 22 bp, Artificial Sequence
  chemically synthesized
catgacctggtccatcttgaca

SEQ ID NO: 923019 - DNA, 22 bp, Artificial Sequence
  chemically synthesized
gtccatcttgacaatttcattt

SEQ ID NO: 923020 - DNA, 22 bp, Artificial Sequence
  chemically synthesized
aaaaatgacgccatgacaaatg

SEQ ID NO: 923021 - DNA, 22 bp, Artificial Sequence
  chemically synthesized
gacaatttcatttgtcatggcg

SEQ ID NO: 923022 - DNA, 22 bp, Artificial Sequence
  chemically synthesized
acaatttcatttgtcatggcgt

SEQ ID NO: 923023 - DNA, 22 bp, Artificial Sequence
  chemically synthesized
catttgtcatggcgtcattttt

SEQ ID NO: 923024 - DNA, 22 bp, Artificial Sequence
  chemically synthesized
atttgtcatggcgtcatttttc

SEQ ID NO: 923025 - DNA, 22 bp, Artificial Sequence
  chemically synthesized
tatgtaggaaggctgaaaaatg

SEQ ID NO: 923026 - DNA, 22 bp, Artificial Sequence
  chemically synthesized
atatgtaggaaggctgaaaaat

SEQ ID NO: 923027 - DNA, 22 bp, Artificial Sequence
  chemically synthesized
gtcatggcgtcatttttcagcc

SEQ ID NO: 923028 - DNA, 22 bp, Artificial Sequence
  chemically synthesized
tatatgtaggaaggctgaaaaa

SEQ ID NO: 923029 - DNA, 22 bp, Artificial Sequence
  chemically synthesized
tcatggcgtcatttttcagcct

SEQ ID NO: 923030 - DNA, 22 bp, Artificial Sequence
  chemically synthesized
ttatatgtaggaaggctgaaaa

SEQ ID NO: 923031 - DNA, 22 bp, Artificial Sequence
  chemically synthesized
cttttatatgtaggaaggctga

SEQ ID NO: 923032 - DNA, 22 bp, Artificial Sequence
  chemically synthesized
ccttttatatgtaggaaggctg

SEQ ID NO: 923033 - DNA, 22 bp, Artificial Sequence
  chemically synthesized
ttcagccttcctacatataaaa

SEQ ID NO: 923034 - DNA, 22 bp, Artificial Sequence
  chemically synthesized
tcagccttcctacatataaaag

SEQ ID NO: 923035 - DNA, 22 bp, Artificial Sequence
  chemically synthesized
cagccttcctacatataaaagg

SEQ ID NO: 923036 - DNA, 22 bp, Artificial Sequence
  chemically synthesized
ataaggggacttccttttatat

SEQ ID NO: 923037 - DNA, 22 bp, Artificial Sequence
  chemically synthesized
agccttcctacatataaaagga

SEQ ID NO: 923038 - DNA, 22 bp, Artificial Sequence
  chemically synthesized
gataaggggacttccttttata

SEQ ID NO: 923039 - DNA, 22 bp, Artificial Sequence
  chemically synthesized
cctacatataaaaggaagtccc

SEQ ID NO: 923040 - DNA, 22 bp, Artificial Sequence
  chemically synthesized
ctacatataaaaggaagtcccc

SEQ ID NO: 923041 - DNA, 22 bp, Artificial Sequence
  chemically synthesized
atcaagtttgataaggggactt

SEQ ID NO: 923042 - DNA, 22 bp, Artificial Sequence
  chemically synthesized
catataaaaggaagtcccctta

SEQ ID NO: 923043 - DNA, 22 bp, Artificial Sequence
  chemically synthesized
ccctaatcaagtttgataaggg

SEQ ID NO: 923044 - DNA, 22 bp, Artificial Sequence
  chemically synthesized
accctaatcaagtttgataagg

SEQ ID NO: 923045 - DNA, 22 bp, Artificial Sequence
  chemically synthesized
tccacttaccctaatcaagttt

SEQ ID NO: 923046 - DNA, 22 bp, Artificial Sequence
  chemically synthesized
atcaaacttgattagggtaagt

SEQ ID NO: 923047 - DNA, 22 bp, Artificial Sequence
  chemically synthesized
tcaaacttgattagggtaagtg

SEQ ID NO: 923048 - DNA, 22 bp, Artificial Sequence
  chemically synthesized
caaaaaccgcctatccacttac

SEQ ID NO: 923049 - DNA, 22 bp, Artificial Sequence
  chemically synthesized
ccaaaaaccgcctatccactta

SEQ ID NO: 923050 - DNA, 22 bp, Artificial Sequence
  chemically synthesized
tccaaaaaccgcctatccactt

SEQ ID NO: 923051 - DNA, 22 bp, Artificial Sequence
  chemically synthesized
ttccaaaaaccgcctatccact

SEQ ID NO: 923052 - DNA, 22 bp, Artificial Sequence
  chemically synthesized
gattagggtaagtggataggcg

SEQ ID NO: 923053 - DNA, 22 bp, Artificial Sequence
  chemically synthesized
attagggtaagtggataggcgg

SEQ ID NO: 923054 - DNA, 22 bp, Artificial Sequence
  chemically synthesized
gggtaagtggataggcggtttt

SEQ ID NO: 923055 - DNA, 22 bp, Artificial Sequence
  chemically synthesized
caatatttttccaaaaaccgcc

SEQ ID NO: 923056 - DNA, 22 bp, Artificial Sequence
  chemically synthesized
acaatatttttccaaaaaccgc

SEQ ID NO: 923057 - DNA, 22 bp, Artificial Sequence
  chemically synthesized
tacaatatttttccaaaaaccg

SEQ ID NO: 923058 - DNA, 22 bp, Artificial Sequence
  chemically synthesized
caattttacaatatttttccaa

SEQ ID NO: 923059 - DNA, 22 bp, Artificial Sequence
  chemically synthesized
tataatccctccaattttacaa

SEQ ID NO: 923060 - DNA, 22 bp, Artificial Sequence
  chemically synthesized
ttggaaaaatattgtaaaattg

SEQ ID NO: 923061 - DNA, 22 bp, Artificial Sequence
  chemically synthesized
atataatccctccaattttaca

SEQ ID NO: 923062 - DNA, 22 bp, Artificial Sequence
  chemically synthesized
tggaaaaatattgtaaaattgg

SEQ ID NO: 923063 - DNA, 22 bp, Artificial Sequence
  chemically synthesized
ggaaaaatattgtaaaattgga

SEQ ID NO: 923064 - DNA, 22 bp, Artificial Sequence
  chemically synthesized
gaaaaatattgtaaaattggag

SEQ ID NO: 923065 - DNA, 22 bp, Artificial Sequence
  chemically synthesized
taaaattggagggattatataa

SEQ ID NO: 923066 - DNA, 22 bp, Artificial Sequence
  chemically synthesized
aagatgtgtaaacacatttata

SEQ ID NO: 923067 - DNA, 22 bp, Artificial Sequence
  chemically synthesized
gaagatgtgtaaacacatttat

SEQ ID NO: 923068 - DNA, 22 bp, Artificial Sequence
  chemically synthesized
gagggattatataaatgtgttt

SEQ ID NO: 923069 - DNA, 22 bp, Artificial Sequence
  chemically synthesized
tataaatgtgtttacacatctt

SEQ ID NO: 923070 - DNA, 22 bp, Artificial Sequence
  chemically synthesized
agaaaaataaaatgtttgaaga

SEQ ID NO: 923071 - DNA, 22 bp, Artificial Sequence
  chemically synthesized
taagaaaaataaaatgtttgaa

SEQ ID NO: 923072 - DNA, 22 bp, Artificial Sequence
  chemically synthesized
acacatcttcaaacattttatt

SEQ ID NO: 923073 - DNA, 22 bp, Artificial Sequence
  chemically synthesized
cacatcttcaaacattttattt

SEQ ID NO: 923074 - DNA, 22 bp, Artificial Sequence
  chemically synthesized
tatattctaagaaaaataaaat

SEQ ID NO: 923075 - DNA, 22 bp, Artificial Sequence
  chemically synthesized
gtatattctaagaaaaataaaa

SEQ ID NO: 923076 - DNA, 22 bp, Artificial Sequence
  chemically synthesized
caaacattttatttttcttaga

SEQ ID NO: 923077 - DNA, 22 bp, Artificial Sequence
  chemically synthesized
aaacattttatttttcttagaa

SEQ ID NO: 923078 - DNA, 22 bp, Artificial Sequence
  chemically synthesized
tatttttcttagaatatacaag

SEQ ID NO: 923079 - DNA, 22 bp, Artificial Sequence
  chemically synthesized
atttttcttagaatatacaagt

SEQ ID NO: 923080 - DNA, 22 bp, Artificial Sequence
  chemically synthesized
tttttcttagaatatacaagtg

SEQ ID NO: 923081 - DNA, 22 bp, Artificial Sequence
  chemically synthesized
ttcttagaatatacaagtggtc

SEQ ID NO: 923082 - DNA, 22 bp, Artificial Sequence
  chemically synthesized
tcttagaatatacaagtggtca

SEQ ID NO: 923083 - DNA, 22 bp, Artificial Sequence
  chemically synthesized
cttagaatatacaagtggtcac

SEQ ID NO: 923084 - DNA, 22 bp, Artificial Sequence
  chemically synthesized
ttagaatatacaagtggtcact

SEQ ID NO: 923085 - DNA, 22 bp, Artificial Sequence
  chemically synthesized
agaatatacaagtggtcactca

SEQ ID NO: 923086 - DNA, 22 bp, Artificial Sequence
  chemically synthesized
gaatatacaagtggtcactcat

SEQ ID NO: 923087 - DNA, 22 bp, Artificial Sequence
  chemically synthesized
ggaccccataccaaatgagaag

SEQ ID NO: 923088 - DNA, 22 bp, Artificial Sequence
  chemically synthesized
atttacttctcatttggtatgg

SEQ ID NO: 923089 - DNA, 22 bp, Artificial Sequence
  chemically synthesized
acttctcatttggtatggggtc

SEQ ID NO: 923090 - DNA, 22 bp, Artificial Sequence
  chemically synthesized
cttctcatttggtatggggtcc

SEQ ID NO: 923091 - DNA, 22 bp, Artificial Sequence
  chemically synthesized
caggaaaagtctcggaccccat

SEQ ID NO: 923092 - DNA, 22 bp, Artificial Sequence
  chemically synthesized
ctcatttggtatggggtccgag

SEQ ID NO: 923093 - DNA, 22 bp, Artificial Sequence
  chemically synthesized
tcatttggtatggggtccgaga

SEQ ID NO: 923094 - DNA, 22 bp, Artificial Sequence
  chemically synthesized
ctccaggaaaagtctcggaccc

SEQ ID NO: 923095 - DNA, 22 bp, Artificial Sequence
  chemically synthesized
actccaggaaaagtctcggacc

SEQ ID NO: 923096 - DNA, 22 bp, Artificial Sequence
  chemically synthesized
atttggtatggggtccgagact

SEQ ID NO: 923097 - DNA, 22 bp, Artificial Sequence
  chemically synthesized
tactccaggaaaagtctcggac

SEQ ID NO: 923098 - DNA, 22 bp, Artificial Sequence
  chemically synthesized
ttactccaggaaaagtctcgga

SEQ ID NO: 923099 - DNA, 22 bp, Artificial Sequence
  chemically synthesized
ggtatggggtccgagacttttc

SEQ ID NO: 923100 - DNA, 22 bp, Artificial Sequence
  chemically synthesized
gtatggggtccgagacttttcc

SEQ ID NO: 923101 - DNA, 22 bp, Artificial Sequence
  chemically synthesized
tgggcttttactccaggaaaag

SEQ ID NO: 923102 - DNA, 22 bp, Artificial Sequence
  chemically synthesized
aacctgtgggcttttactccag

SEQ ID NO: 923103 - DNA, 22 bp, Artificial Sequence
  chemically synthesized
caacctgtgggcttttactcca

SEQ ID NO: 923104 - DNA, 22 bp, Artificial Sequence
  chemically synthesized
acttcaacctgtgggcttttac

SEQ ID NO: 923105 - DNA, 22 bp, Artificial Sequence
  chemically synthesized
aacttcaacctgtgggctttta

SEQ ID NO: 923106 - DNA, 22 bp, Artificial Sequence
  chemically synthesized
ttcctggagtaaaagcccacag

SEQ ID NO: 923107 - DNA, 22 bp, Artificial Sequence
  chemically synthesized
tcctggagtaaaagcccacagg

SEQ ID NO: 923108 - DNA, 22 bp, Artificial Sequence
  chemically synthesized
cctggagtaaaagcccacaggt

SEQ ID NO: 923109 - DNA, 22 bp, Artificial Sequence
  chemically synthesized
ctggagtaaaagcccacaggtt

SEQ ID NO: 923110 - DNA, 22 bp, Artificial Sequence
  chemically synthesized
gagtaaaagcccacaggttgaa

SEQ ID NO: 923111 - DNA, 22 bp, Artificial Sequence
  chemically synthesized
tgcaaaaagtaatatgcttaac

SEQ ID NO: 923112 - DNA, 22 bp, Artificial Sequence
  chemically synthesized
atgcaaaaagtaatatgcttaa

SEQ ID NO: 923113 - DNA, 22 bp, Artificial Sequence
  chemically synthesized
tatgcaaaaagtaatatgctta

SEQ ID NO: 923114 - DNA, 22 bp, Artificial Sequence
  chemically synthesized
aagttaagcatattactttttg

SEQ ID NO: 923115 - DNA, 22 bp, Artificial Sequence
  chemically synthesized
agcatattactttttgcataaa

SEQ ID NO: 923116 - DNA, 22 bp, Artificial Sequence
  chemically synthesized
tgaaatgtagaagtgttttatg

SEQ ID NO: 923117 - DNA, 22 bp, Artificial Sequence
  chemically synthesized
ctttttgcataaaacacttcta

SEQ ID NO: 923118 - DNA, 22 bp, Artificial Sequence
  chemically synthesized
tttgcataaaacacttctacat

SEQ ID NO: 923119 - DNA, 22 bp, Artificial Sequence
  chemically synthesized
ttgcataaaacacttctacatt

SEQ ID NO: 923120 - DNA, 22 bp, Artificial Sequence
  chemically synthesized
tgcataaaacacttctacattt

SEQ ID NO: 923121 - DNA, 22 bp, Artificial Sequence
  chemically synthesized
gcataaaacacttctacatttc

SEQ ID NO: 923122 - DNA, 22 bp, Artificial Sequence
  chemically synthesized
cataaaacacttctacatttca

SEQ ID NO: 923123 - DNA, 22 bp, Artificial Sequence
  chemically synthesized
aaagtcacagattatgaaatgt

SEQ ID NO: 923124 - DNA, 22 bp, Artificial Sequence
  chemically synthesized
ctacatttcataatctgtgact

SEQ ID NO: 923125 - DNA, 22 bp, Artificial Sequence
  chemically synthesized
tacatttcataatctgtgactt

SEQ ID NO: 923126 - DNA, 22 bp, Artificial Sequence
  chemically synthesized
catttcataatctgtgactttt

SEQ ID NO: 923127 - DNA, 22 bp, Artificial Sequence
  chemically synthesized
aaagaaaccaaactaaaagtca

SEQ ID NO: 923128 - DNA, 22 bp, Artificial Sequence
  chemically synthesized
cataatctgtgacttttagttt

SEQ ID NO: 923129 - DNA, 22 bp, Artificial Sequence
  chemically synthesized
ataatctgtgacttttagtttg

SEQ ID NO: 923130 - DNA, 22 bp, Artificial Sequence
  chemically synthesized
taattcaaagaaaccaaactaa

SEQ ID NO: 923131 - DNA, 22 bp, Artificial Sequence
  chemically synthesized
actgtaattcaaagaaaccaaa

SEQ ID NO: 923132 - DNA, 22 bp, Artificial Sequence
  chemically synthesized
tgacttttagtttggtttcttt

SEQ ID NO: 923133 - DNA, 22 bp, Artificial Sequence
  chemically synthesized
ttagtttggtttctttgaatta

SEQ ID NO: 923134 - DNA, 22 bp, Artificial Sequence
  chemically synthesized
caaatctgactgtaattcaaag

SEQ ID NO: 923135 - DNA, 22 bp, Artificial Sequence
  chemically synthesized
tagtttggtttctttgaattac

SEQ ID NO: 923136 - DNA, 22 bp, Artificial Sequence
  chemically synthesized
agtttggtttctttgaattaca

SEQ ID NO: 923137 - DNA, 22 bp, Artificial Sequence
  chemically synthesized
gtttggtttctttgaattacag

SEQ ID NO: 923138 - DNA, 22 bp, Artificial Sequence
  chemically synthesized
ggtttctttgaattacagtcag

SEQ ID NO: 923139 - DNA, 22 bp, Artificial Sequence
  chemically synthesized
gtttctttgaattacagtcaga

SEQ ID NO: 923140 - DNA, 22 bp, Artificial Sequence
  chemically synthesized
agcatctccaaatctgactgta

SEQ ID NO: 923141 - DNA, 22 bp, Artificial Sequence
  chemically synthesized
cagcatctccaaatctgactgt

SEQ ID NO: 923142 - DNA, 22 bp, Artificial Sequence
  chemically synthesized
tcagcatctccaaatctgactg

SEQ ID NO: 923143 - DNA, 22 bp, Artificial Sequence
  chemically synthesized
ctttgaattacagtcagatttg

SEQ ID NO: 923144 - DNA, 22 bp, Artificial Sequence
  chemically synthesized
tttgaattacagtcagatttgg

SEQ ID NO: 923145 - DNA, 22 bp, Artificial Sequence
  chemically synthesized
ttttcagcatctccaaatctga

SEQ ID NO: 923146 - DNA, 22 bp, Artificial Sequence
  chemically synthesized
tgaattacagtcagatttggag

SEQ ID NO: 923147 - DNA, 22 bp, Artificial Sequence
  chemically synthesized
gaattacagtcagatttggaga

SEQ ID NO: 923148 - DNA, 22 bp, Artificial Sequence
  chemically synthesized
aattacagtcagatttggagat

SEQ ID NO: 923149 - DNA, 22 bp, Artificial Sequence
  chemically synthesized
agattattttcagcatctccaa

SEQ ID NO: 923150 - DNA, 22 bp, Artificial Sequence
  chemically synthesized
cagtcagatttggagatgctga

SEQ ID NO: 923151 - DNA, 22 bp, Artificial Sequence
  chemically synthesized
cattgagattattttcagcatc

SEQ ID NO: 923152 - DNA, 22 bp, Artificial Sequence
  chemically synthesized
gcattgagattattttcagcat

SEQ ID NO: 923153 - DNA, 22 bp, Artificial Sequence
  chemically synthesized
tgcattgagattattttcagca

SEQ ID NO: 923154 - DNA, 22 bp, Artificial Sequence
  chemically synthesized
ggagatgctgaaaataatctca

SEQ ID NO: 923155 - DNA, 22 bp, Artificial Sequence
  chemically synthesized
gagatgctgaaaataatctcaa

SEQ ID NO: 923156 - DNA, 22 bp, Artificial Sequence
  chemically synthesized
aaaataatctcaatgcaaaata

SEQ ID NO: 923157 - DNA, 22 bp, Artificial Sequence
  chemically synthesized
aatgcaaaatacctccattttt

SEQ ID NO: 923158 - DNA, 22 bp, Artificial Sequence
  chemically synthesized
ggtatgagggatagaatcccca

SEQ ID NO: 923159 - DNA, 22 bp, Artificial Sequence
  chemically synthesized
cattttttggggattctatccc

SEQ ID NO: 923160 - DNA, 22 bp, Artificial Sequence
  chemically synthesized
agattgggtatgagggatagaa

SEQ ID NO: 923161 - DNA, 22 bp, Artificial Sequence
  chemically synthesized
aagattgggtatgagggataga

SEQ ID NO: 923162 - DNA, 22 bp, Artificial Sequence
  chemically synthesized
tttggggattctatccctcata

SEQ ID NO: 923163 - DNA, 22 bp, Artificial Sequence
  chemically synthesized
tttaagattgggtatgagggat

SEQ ID NO: 923164 - DNA, 22 bp, Artificial Sequence
  chemically synthesized
ttggggattctatccctcatac

SEQ ID NO: 923165 - DNA, 22 bp, Artificial Sequence
  chemically synthesized
tggggattctatccctcatacc

SEQ ID NO: 923166 - DNA, 22 bp, Artificial Sequence
  chemically synthesized
ggggattctatccctcataccc

SEQ ID NO: 923167 - DNA, 22 bp, Artificial Sequence
  chemically synthesized
gggattctatccctcataccca

SEQ ID NO: 923168 - DNA, 22 bp, Artificial Sequence
  chemically synthesized
tatccctcatacccaatcttaa

SEQ ID NO: 923169 - DNA, 22 bp, Artificial Sequence
  chemically synthesized
tccctcatacccaatcttaaac

SEQ ID NO: 923170 - DNA, 22 bp, Artificial Sequence
  chemically synthesized
atacccaatcttaaacagttgt

SEQ ID NO: 923171 - DNA, 22 bp, Artificial Sequence
  chemically synthesized
gatgtaggtaagacaactgttt

SEQ ID NO: 923172 - DNA, 22 bp, Artificial Sequence
  chemically synthesized
aattagatgtaggtaagacaac

SEQ ID NO: 923173 - DNA, 22 bp, Artificial Sequence
  chemically synthesized
ttgaattagatgtaggtaagac

SEQ ID NO: 923174 - DNA, 22 bp, Artificial Sequence
  chemically synthesized
aaacagttgtcttacctacatc

SEQ ID NO: 923175 - DNA, 22 bp, Artificial Sequence
  chemically synthesized
aacagttgtcttacctacatct

SEQ ID NO: 923176 - DNA, 22 bp, Artificial Sequence
  chemically synthesized
tcttacctacatctaattcaac

SEQ ID NO: 923177 - DNA, 22 bp, Artificial Sequence
  chemically synthesized
acctacatctaattcaacagca

SEQ ID NO: 923178 - DNA, 22 bp, Artificial Sequence
  chemically synthesized
cctacatctaattcaacagcac

SEQ ID NO: 923179 - DNA, 22 bp, Artificial Sequence
  chemically synthesized
catctaattcaacagcaccgtg

SEQ ID NO: 923180 - DNA, 22 bp, Artificial Sequence
  chemically synthesized
attcaacagcaccgtggttttt

SEQ ID NO: 923181 - DNA, 22 bp, Artificial Sequence
  chemically synthesized
aacagcaccgtggttttttttt

SEQ ID NO: 923182 - DNA, 22 bp, Artificial Sequence
  chemically synthesized
tttttttttttttttttttcct

SEQ ID NO: 923183 - DNA, 22 bp, Artificial Sequence
  chemically synthesized
ggtgacagagtgaggaaaaaaa

SEQ ID NO: 923184 - DNA, 22 bp, Artificial Sequence
  chemically synthesized
ttttttttttttttttttcctc

SEQ ID NO: 923185 - DNA, 22 bp, Artificial Sequence
  chemically synthesized
tttttttttttttttttcctca

SEQ ID NO: 923186 - DNA, 22 bp, Artificial Sequence
  chemically synthesized
ttttttttttttttttcctcac

SEQ ID NO: 923187 - DNA, 22 bp, Artificial Sequence
  chemically synthesized
tttttttttttttttcctcact

SEQ ID NO: 923188 - DNA, 22 bp, Artificial Sequence
  chemically synthesized
ttttttttttttttcctcactc

SEQ ID NO: 923189 - DNA, 22 bp, Artificial Sequence
  chemically synthesized
tttttttttttttcctcactct

SEQ ID NO: 923190 - DNA, 22 bp, Artificial Sequence
  chemically synthesized
ttttttttttttcctcactctg

SEQ ID NO: 923191 - DNA, 22 bp, Artificial Sequence
  chemically synthesized
cagcctgggtgacagagtgagg

SEQ ID NO: 923192 - DNA, 22 bp, Artificial Sequence
  chemically synthesized
tttttttttttcctcactctgt

SEQ ID NO: 923193 - DNA, 22 bp, Artificial Sequence
  chemically synthesized
ttttttttttcctcactctgtc

SEQ ID NO: 923194 - DNA, 22 bp, Artificial Sequence
  chemically synthesized
tttttttttcctcactctgtca

SEQ ID NO: 923195 - DNA, 22 bp, Artificial Sequence
  chemically synthesized
ttttttttcctcactctgtcac

SEQ ID NO: 923196 - DNA, 22 bp, Artificial Sequence
  chemically synthesized
tttttttcctcactctgtcacc

SEQ ID NO: 923197 - DNA, 22 bp, Artificial Sequence
  chemically synthesized
cactccagcctgggtgacagag

SEQ ID NO: 923198 - DNA, 22 bp, Artificial Sequence
  chemically synthesized
ttttttcctcactctgtcaccc

SEQ ID NO: 923199 - DNA, 22 bp, Artificial Sequence
  chemically synthesized
tttttcctcactctgtcaccca

SEQ ID NO: 923200 - DNA, 22 bp, Artificial Sequence
  chemically synthesized
ttttcctcactctgtcacccag

SEQ ID NO: 923201 - DNA, 22 bp, Artificial Sequence
  chemically synthesized
tttcctcactctgtcacccagg

SEQ ID NO: 923202 - DNA, 22 bp, Artificial Sequence
  chemically synthesized
ttcctcactctgtcacccaggc

SEQ ID NO: 923203 - DNA, 22 bp, Artificial Sequence
  chemically synthesized
tcctcactctgtcacccaggct

SEQ ID NO: 923204 - DNA, 22 bp, Artificial Sequence
  chemically synthesized
cctcactctgtcacccaggctg

SEQ ID NO: 923205 - DNA, 22 bp, Artificial Sequence
  chemically synthesized
ctcactctgtcacccaggctgg

SEQ ID NO: 923206 - DNA, 22 bp, Artificial Sequence
  chemically synthesized
actctgtcacccaggctggagt

SEQ ID NO: 923207 - DNA, 22 bp, Artificial Sequence
  chemically synthesized
tgtcacccaggctggagtgcaa

SEQ ID NO: 923208 - DNA, 22 bp, Artificial Sequence
  chemically synthesized
tcacccaggctggagtgcaatg

SEQ ID NO: 923209 - DNA, 22 bp, Artificial Sequence
  chemically synthesized
cagtgagacaagatcatgccat

SEQ ID NO: 923210 - DNA, 22 bp, Artificial Sequence
  chemically synthesized
gagtgcaatggcatgatcttgt

SEQ ID NO: 923211 - DNA, 22 bp, Artificial Sequence
  chemically synthesized
gaacccgggaggcggaggttgc

SEQ ID NO: 923212 - DNA, 22 bp, Artificial Sequence
  chemically synthesized
ctcgaacccgggaggcggaggt

SEQ ID NO: 923213 - DNA, 22 bp, Artificial Sequence
  chemically synthesized
gtctcactgcaacctccgcctc

SEQ ID NO: 923214 - DNA, 22 bp, Artificial Sequence
  chemically synthesized
tctcactgcaacctccgcctcc

SEQ ID NO: 923215 - DNA, 22 bp, Artificial Sequence
  chemically synthesized
actgcaacctccgcctcccggg

SEQ ID NO: 923216 - DNA, 22 bp, Artificial Sequence
  chemically synthesized
caacctccgcctcccgggttcg

SEQ ID NO: 923217 - DNA, 22 bp, Artificial Sequence
  chemically synthesized
aggtgggagagttgctcgaacc

SEQ ID NO: 923218 - DNA, 22 bp, Artificial Sequence
  chemically synthesized
cgcctcccgggttcgagcaact

SEQ ID NO: 923219 - DNA, 22 bp, Artificial Sequence
  chemically synthesized
ccgggttcgagcaactctccca

SEQ ID NO: 923220 - DNA, 22 bp, Artificial Sequence
  chemically synthesized
catgggagtctgaggtgggaga

SEQ ID NO: 923221 - DNA, 22 bp, Artificial Sequence
  chemically synthesized
gagcaactctcccacctcagac

SEQ ID NO: 923222 - DNA, 22 bp, Artificial Sequence
  chemically synthesized
tagtcccagctacatgggagtc

SEQ ID NO: 923223 - DNA, 22 bp, Artificial Sequence
  chemically synthesized
tcccacctcagactcccatgta

SEQ ID NO: 923224 - DNA, 22 bp, Artificial Sequence
  chemically synthesized
ccacctcagactcccatgtagc

SEQ ID NO: 923225 - DNA, 22 bp, Artificial Sequence
  chemically synthesized
agactcccatgtagctgggact

SEQ ID NO: 923226 - DNA, 22 bp, Artificial Sequence
  chemically synthesized
gccagacgtgggcctgtagtcc

SEQ ID NO: 923227 - DNA, 22 bp, Artificial Sequence
  chemically synthesized
ccatgtagctgggactacaggc

SEQ ID NO: 923228 - DNA, 22 bp, Artificial Sequence
  chemically synthesized
agccagacgtgggcctgtagtc

SEQ ID NO: 923229 - DNA, 22 bp, Artificial Sequence
  chemically synthesized
ggactacaggcccacgtctggc

SEQ ID NO: 923230 - DNA, 22 bp, Artificial Sequence
  chemically synthesized
agaaaatacaaaacttagccag

SEQ ID NO: 923231 - DNA, 22 bp, Artificial Sequence
  chemically synthesized
caggcccacgtctggctaagtt

SEQ ID NO: 923232 - DNA, 22 bp, Artificial Sequence
  chemically synthesized
ctaagaaaatacaaaacttagc

SEQ ID NO: 923233 - DNA, 22 bp, Artificial Sequence
  chemically synthesized
gctaagttttgtattttcttag

SEQ ID NO: 923234 - DNA, 22 bp, Artificial Sequence
  chemically synthesized
agttttgtattttcttagtagc

SEQ ID NO: 923235 - DNA, 22 bp, Artificial Sequence
  chemically synthesized
tgtattttcttagtagcgatgt

SEQ ID NO: 923236 - DNA, 22 bp, Artificial Sequence
  chemically synthesized
gtattttcttagtagcgatgtg

SEQ ID NO: 923237 - DNA, 22 bp, Artificial Sequence
  chemically synthesized
tattttcttagtagcgatgtgg

SEQ ID NO: 923238 - DNA, 22 bp, Artificial Sequence
  chemically synthesized
gccaacatggcgaaaccacatc

SEQ ID NO: 923239 - DNA, 22 bp, Artificial Sequence
  chemically synthesized
tcttagtagcgatgtggtttcg

SEQ ID NO: 923240 - DNA, 22 bp, Artificial Sequence
  chemically synthesized
cttagtagcgatgtggtttcgc

SEQ ID NO: 923241 - DNA, 22 bp, Artificial Sequence
  chemically synthesized
ttagtagcgatgtggtttcgcc

SEQ ID NO: 923242 - DNA, 22 bp, Artificial Sequence
  chemically synthesized
agtagcgatgtggtttcgccat

SEQ ID NO: 923243 - DNA, 22 bp, Artificial Sequence
  chemically synthesized
gtagcgatgtggtttcgccatg

SEQ ID NO: 923244 - DNA, 22 bp, Artificial Sequence
  chemically synthesized
gagaccagcctggccaacatgg

SEQ ID NO: 923245 - DNA, 22 bp, Artificial Sequence
  chemically synthesized
cgagaccagcctggccaacatg

SEQ ID NO: 923246 - DNA, 22 bp, Artificial Sequence
  chemically synthesized
cgccatgttggccaggctggtc

SEQ ID NO: 923247 - DNA, 22 bp, Artificial Sequence
  chemically synthesized
gccatgttggccaggctggtct

SEQ ID NO: 923248 - DNA, 22 bp, Artificial Sequence
  chemically synthesized
aggtcaggatttcgagaccagc

SEQ ID NO: 923249 - DNA, 22 bp, Artificial Sequence
  chemically synthesized
gccaggctggtctcgaaatcct

SEQ ID NO: 923250 - DNA, 22 bp, Artificial Sequence
  chemically synthesized
gtctcgaaatcctgacctcagg

SEQ ID NO: 923251 - DNA, 22 bp, Artificial Sequence
  chemically synthesized
gaaatcctgacctcaggtgatc

SEQ ID NO: 923252 - DNA, 22 bp, Artificial Sequence
  chemically synthesized
ggaggccgagatgggtggatca

SEQ ID NO: 923253 - DNA, 22 bp, Artificial Sequence
  chemically synthesized
gggaggccgagatgggtggatc

SEQ ID NO: 923254 - DNA, 22 bp, Artificial Sequence
  chemically synthesized
tgggaggccgagatgggtggat

SEQ ID NO: 923255 - DNA, 22 bp, Artificial Sequence
  chemically synthesized
acctcaggtgatccacccatct

SEQ ID NO: 923256 - DNA, 22 bp, Artificial Sequence
  chemically synthesized
aggtgatccacccatctcggcc

SEQ ID NO: 923257 - DNA, 22 bp, Artificial Sequence
  chemically synthesized
taatcccagcactttgggaggc

SEQ ID NO: 923258 - DNA, 22 bp, Artificial Sequence
  chemically synthesized
acacctataatcccagcacttt

SEQ ID NO: 923259 - DNA, 22 bp, Artificial Sequence
  chemically synthesized
ggcctcccaaagtgctgggatt

SEQ ID NO: 923260 - DNA, 22 bp, Artificial Sequence
  chemically synthesized
ccaaagtgctgggattataggt

SEQ ID NO: 923261 - DNA, 22 bp, Artificial Sequence
  chemically synthesized
ggattataggtgtgagccaccg

SEQ ID NO: 923262 - DNA, 22 bp, Artificial Sequence
  chemically synthesized
taggtgtgagccaccgcatctg

SEQ ID NO: 923263 - DNA, 22 bp, Artificial Sequence
  chemically synthesized
gaaaaaaaaaaaaggccagatg

SEQ ID NO: 923264 - DNA, 22 bp, Artificial Sequence
  chemically synthesized
ataaaggtgattagaaaaaaaa

SEQ ID NO: 923265 - DNA, 22 bp, Artificial Sequence
  chemically synthesized
gataaaggtgattagaaaaaaa

SEQ ID NO: 923266 - DNA, 22 bp, Artificial Sequence
  chemically synthesized
gccttttttttttttctaatca

SEQ ID NO: 923267 - DNA, 22 bp, Artificial Sequence
  chemically synthesized
gaagacttgataaaggtgatta

SEQ ID NO: 923268 - DNA, 22 bp, Artificial Sequence
  chemically synthesized
ttttttttttctaatcaccttt

SEQ ID NO: 923269 - DNA, 22 bp, Artificial Sequence
  chemically synthesized
ggaagacttgataaaggtgatt

SEQ ID NO: 923270 - DNA, 22 bp, Artificial Sequence
  chemically synthesized
tttttttttctaatcaccttta

SEQ ID NO: 923271 - DNA, 22 bp, Artificial Sequence
  chemically synthesized
tggaagacttgataaaggtgat

SEQ ID NO: 923272 - DNA, 22 bp, Artificial Sequence
  chemically synthesized
ttttttttctaatcacctttat

SEQ ID NO: 923273 - DNA, 22 bp, Artificial Sequence
  chemically synthesized
tttttttctaatcacctttatc

SEQ ID NO: 923274 - DNA, 22 bp, Artificial Sequence
  chemically synthesized
ttttttctaatcacctttatca

SEQ ID NO: 923275 - DNA, 22 bp, Artificial Sequence
  chemically synthesized
tttttctaatcacctttatcaa

SEQ ID NO: 923276 - DNA, 22 bp, Artificial Sequence
  chemically synthesized
ttttctaatcacctttatcaag

SEQ ID NO: 923277 - DNA, 22 bp, Artificial Sequence
  chemically synthesized
tttctaatcacctttatcaagt

SEQ ID NO: 923278 - DNA, 22 bp, Artificial Sequence
  chemically synthesized
ttctaatcacctttatcaagtc

SEQ ID NO: 923279 - DNA, 22 bp, Artificial Sequence
  chemically synthesized
aatgctttggaagacttgataa

SEQ ID NO: 923280 - DNA, 22 bp, Artificial Sequence
  chemically synthesized
tctaatcacctttatcaagtct

SEQ ID NO: 923281 - DNA, 22 bp, Artificial Sequence
  chemically synthesized
ctaatcacctttatcaagtctt

SEQ ID NO: 923282 - DNA, 22 bp, Artificial Sequence
  chemically synthesized
taatcacctttatcaagtcttc

SEQ ID NO: 923283 - DNA, 22 bp, Artificial Sequence
  chemically synthesized
atcacctttatcaagtcttcca

SEQ ID NO: 923284 - DNA, 22 bp, Artificial Sequence
  chemically synthesized
aattgaatgctttggaagactt

SEQ ID NO: 923285 - DNA, 22 bp, Artificial Sequence
  chemically synthesized
tatcaagtcttccaaagcattc

SEQ ID NO: 923286 - DNA, 22 bp, Artificial Sequence
  chemically synthesized
atcaagtcttccaaagcattca

SEQ ID NO: 923287 - DNA, 22 bp, Artificial Sequence
  chemically synthesized
tgaatactaaattgaatgcttt

SEQ ID NO: 923288 - DNA, 22 bp, Artificial Sequence
  chemically synthesized
tcaagtcttccaaagcattcaa

SEQ ID NO: 923289 - DNA, 22 bp, Artificial Sequence
  chemically synthesized
tatgaatactaaattgaatgct

SEQ ID NO: 923290 - DNA, 22 bp, Artificial Sequence
  chemically synthesized
ctatgaatactaaattgaatgc

SEQ ID NO: 923291 - DNA, 22 bp, Artificial Sequence
  chemically synthesized
tggtttctatgaatactaaatt

SEQ ID NO: 923292 - DNA, 22 bp, Artificial Sequence
  chemically synthesized
ccaaagcattcaatttagtatt

SEQ ID NO: 923293 - DNA, 22 bp, Artificial Sequence
  chemically synthesized
caaagcattcaatttagtattc

SEQ ID NO: 923294 - DNA, 22 bp, Artificial Sequence
  chemically synthesized
aatttagtattcatagaaacca
